United States Patent 7,691,997 (FUNCTIONAL AND HYPERFUNCTIONAL SIRNA) - sequence listing, part 9

SEQ ID NO: 332199 - RNA, 19 nt, Homo sapiens
gugaagaagugaaaccuuu

SEQ ID NO: 332200 - RNA, 19 nt, Homo sapiens
ggacauaagaagauaauug

SEQ ID NO: 332201 - RNA, 19 nt, Homo sapiens
gaauuggauuuguugguuu

SEQ ID NO: 332202 - RNA, 19 nt, Homo sapiens
gaaaguggguaaagaccau

SEQ ID NO: 332203 - RNA, 19 nt, Homo sapiens
gaggauuucugcaugaaga

SEQ ID NO: 332204 - RNA, 19 nt, Homo sapiens
uaaggugccucacugugua

SEQ ID NO: 332205 - RNA, 19 nt, Homo sapiens
agucaacacugcuuaguaa

SEQ ID NO: 332206 - RNA, 19 nt, Homo sapiens
gaggaugucauucaaauug

SEQ ID NO: 332207 - RNA, 19 nt, Homo sapiens
gcccgaaccuguaacuuga

SEQ ID NO: 332208 - RNA, 19 nt, Homo sapiens
ggagauagaagcagagaug

SEQ ID NO: 332209 - RNA, 19 nt, Homo sapiens
gaucugggacuaucugaaa

SEQ ID NO: 332210 - RNA, 19 nt, Homo sapiens
ggccacagcacaccacuua

SEQ ID NO: 332211 - RNA, 19 nt, Homo sapiens
guaaagaccauacguugga

SEQ ID NO: 332212 - RNA, 19 nt, Homo sapiens
ucacuacucugaccacugu

SEQ ID NO: 332213 - RNA, 19 nt, Homo sapiens
cgaauuggauuuguugguu

SEQ ID NO: 332214 - RNA, 19 nt, Homo sapiens
ggacaagggaggcauuaau

SEQ ID NO: 332215 - RNA, 19 nt, Homo sapiens
auacaaaggugccaagauc

SEQ ID NO: 332216 - RNA, 19 nt, Homo sapiens
gacaggugaugcucgaauu

SEQ ID NO: 332217 - RNA, 19 nt, Homo sapiens
gagaacucauuacuccaaa

SEQ ID NO: 332218 - RNA, 19 nt, Homo sapiens
gaaaagaucugggacuauc

SEQ ID NO: 332219 - RNA, 19 nt, Homo sapiens
aacauuggcuuuaagaaga

SEQ ID NO: 332220 - RNA, 19 nt, Homo sapiens
guaacuugaucuugauugu

SEQ ID NO: 332221 - RNA, 19 nt, Homo sapiens
gaauuuugaugaccuauug

SEQ ID NO: 332222 - RNA, 19 nt, Homo sapiens
ccaaaucuccauugaggaa

SEQ ID NO: 332223 - RNA, 19 nt, Homo sapiens
gaagagcauucuggcugaa

SEQ ID NO: 332224 - RNA, 19 nt, Homo sapiens
gcaguggcccgaaccugua

SEQ ID NO: 332225 - RNA, 19 nt, Homo sapiens
gguggcagccuaugaauuc

SEQ ID NO: 332226 - RNA, 19 nt, Homo sapiens
uagcuaagaucgcggagau

SEQ ID NO: 332227 - RNA, 19 nt, Homo sapiens
gaucuugauuguucuggau

SEQ ID NO: 332228 - RNA, 19 nt, Homo sapiens
caacauuggcuuuaagaag

SEQ ID NO: 332229 - RNA, 19 nt, Homo sapiens
uaagaucgcggagauagaa

SEQ ID NO: 332230 - RNA, 19 nt, Homo sapiens
ugaaaccuuugggacauaa

SEQ ID NO: 332231 - RNA, 19 nt, Homo sapiens
gaacuucauuugucuuacc

SEQ ID NO: 332232 - RNA, 19 nt, Homo sapiens
ggaugucauucaaauugug

SEQ ID NO: 332233 - RNA, 19 nt, Homo sapiens
gcccaucaccgcuggaauu

SEQ ID NO: 332234 - RNA, 19 nt, Homo sapiens
aaaggccaguuaccagauu

SEQ ID NO: 332235 - RNA, 19 nt, Homo sapiens
gcuggaaggcuuuggcauu

SEQ ID NO: 332236 - RNA, 19 nt, Homo sapiens
guggaggauuucugcauga

SEQ ID NO: 332237 - RNA, 19 nt, Homo sapiens
gaaggacaagggaggcauu

SEQ ID NO: 332238 - RNA, 19 nt, Homo sapiens
caaacccaaaggccaguua

SEQ ID NO: 332239 - RNA, 19 nt, Homo sapiens
gaaacuagugagaauuuac

SEQ ID NO: 332240 - RNA, 19 nt, Homo sapiens
caucaccgcuggaauuuug

SEQ ID NO: 332241 - RNA, 19 nt, Homo sapiens
gacaagggaggcauuaauc

SEQ ID NO: 332242 - RNA, 19 nt, Homo sapiens
uggauguccugaaaccuuu

SEQ ID NO: 332243 - RNA, 19 nt, Homo sapiens
acacaauccucagaaagug

SEQ ID NO: 332244 - RNA, 19 nt, Homo sapiens
gaaccuguaacuugaucuu

SEQ ID NO: 332245 - RNA, 19 nt, Homo sapiens
gggaagucaacacugcuua

SEQ ID NO: 332246 - RNA, 19 nt, Homo sapiens
aaaucuccauugaggaauu

SEQ ID NO: 332247 - RNA, 19 nt, Homo sapiens
ugccuggugucaucagaua

SEQ ID NO: 332248 - RNA, 19 nt, Homo sapiens
aaacuggaacuucauuugu

SEQ ID NO: 332249 - RNA, 19 nt, Homo sapiens
gagauggcucggacucaaa

SEQ ID NO: 332250 - RNA, 19 nt, Homo sapiens
cauugaaggugccaaggau

SEQ ID NO: 332251 - RNA, 19 nt, Homo sapiens
gcucgaauuggauuuguug

SEQ ID NO: 332252 - RNA, 19 nt, Homo sapiens
ugaaacacaauccucagaa

SEQ ID NO: 332253 - RNA, 19 nt, Homo sapiens
ccaguuaccagauuacaca

SEQ ID NO: 332254 - RNA, 19 nt, Homo sapiens
agugagaauuuacaccaaa

SEQ ID NO: 332255 - RNA, 19 nt, Homo sapiens
cugaaacuagugagaauuu

SEQ ID NO: 332256 - RNA, 19 nt, Homo sapiens
ggcccgaaccuguaacuug

SEQ ID NO: 332257 - RNA, 19 nt, Homo sapiens
uagaggucgucaagucauu

SEQ ID NO: 332258 - RNA, 19 nt, Homo sapiens
cgagaacucauuacuccaa

SEQ ID NO: 332259 - RNA, 19 nt, Homo sapiens
gaugugacucuacguagug

SEQ ID NO: 332260 - RNA, 19 nt, Homo sapiens
aacuugaucuugauuguuc

SEQ ID NO: 332261 - RNA, 19 nt, Homo sapiens
gcuaagaucgcggagauag

SEQ ID NO: 332262 - RNA, 19 nt, Homo sapiens
gaacucauuacuccaaagg

SEQ ID NO: 332263 - RNA, 19 nt, Homo sapiens
gaaacugugaagagcauuc

SEQ ID NO: 332264 - RNA, 19 nt, Homo sapiens
gcuuaaggcucgucuugcu

SEQ ID NO: 332265 - RNA, 19 nt, Homo sapiens
uggaacuucauuugucuua

SEQ ID NO: 332266 - RNA, 19 nt, Homo sapiens
uuaaggcucgucuugcuaa

SEQ ID NO: 332267 - RNA, 19 nt, Homo sapiens
agagauggcucggacucaa

SEQ ID NO: 332268 - RNA, 19 nt, Homo sapiens
gauacaaaggugccaagau

SEQ ID NO: 332269 - RNA, 19 nt, Homo sapiens
ccuaugaauucacuacucu

SEQ ID NO: 332270 - RNA, 19 nt, Homo sapiens
caacacugcuuaguaaccu

SEQ ID NO: 332271 - RNA, 19 nt, Homo sapiens
ccaaacuggaacuucauuu

SEQ ID NO: 332272 - RNA, 19 nt, Homo sapiens
gaugucauucaaauuguga

SEQ ID NO: 332273 - RNA, 19 nt, Homo sapiens
aaggccaguuaccagauua

SEQ ID NO: 332274 - RNA, 19 nt, Homo sapiens
gaguuuauauccccuguau

SEQ ID NO: 332275 - RNA, 19 nt, Homo sapiens
cgaugugacucuacguagu

SEQ ID NO: 332276 - RNA, 19 nt, Homo sapiens
acauuggcuuuaagaagaa

SEQ ID NO: 332277 - RNA, 19 nt, Homo sapiens
cugaaaccuuugggacaua

SEQ ID NO: 332278 - RNA, 19 nt, Homo sapiens
ggaucucccagguaucauu

SEQ ID NO: 332279 - RNA, 19 nt, Homo sapiens
gaagucaacacugcuuagu

SEQ ID NO: 332280 - RNA, 19 nt, Homo sapiens
ggaagucaacacugcuuag

SEQ ID NO: 332281 - RNA, 19 nt, Homo sapiens
ucauuugucuuaccuuggu

SEQ ID NO: 332282 - RNA, 19 nt, Homo sapiens
gaucucccagguaucauug

SEQ ID NO: 332283 - RNA, 19 nt, Homo sapiens
ccucauugaugugguggaa

SEQ ID NO: 332284 - RNA, 19 nt, Homo sapiens
cuggaaggcuuuggcauuc

SEQ ID NO: 332285 - RNA, 19 nt, Homo sapiens
gguagaggucgucaaguca

SEQ ID NO: 332286 - RNA, 19 nt, Homo sapiens
ugagguggcagccuaugaa

SEQ ID NO: 332287 - RNA, 19 nt, Homo sapiens
caaauugugaagaagugaa

SEQ ID NO: 332288 - RNA, 19 nt, Homo sapiens
caacagcguuccccaugau

SEQ ID NO: 332289 - RNA, 19 nt, Homo sapiens
ccauugaggaauuggauau

SEQ ID NO: 332290 - RNA, 19 nt, Homo sapiens
gcauucgcuugaacagcaa

SEQ ID NO: 332291 - RNA, 19 nt, Homo sapiens
ccugaaaccuuugggacau

SEQ ID NO: 332292 - RNA, 19 nt, Homo sapiens
aaacacaauccucagaaag

SEQ ID NO: 332293 - RNA, 19 nt, Homo sapiens
gugaaacacaauccucaga

SEQ ID NO: 332294 - RNA, 19 nt, Homo sapiens
caaaggccaguuaccagau

SEQ ID NO: 332295 - RNA, 19 nt, Homo sapiens
ugagcuggaugcugaaacu

SEQ ID NO: 332296 - RNA, 19 nt, Homo sapiens
uaugaauucacuacucuga

SEQ ID NO: 332297 - RNA, 19 nt, Homo sapiens
gcaaagaacucaccacaag

SEQ ID NO: 332298 - RNA, 19 nt, Homo sapiens
ugaaagaacuguccagauu

SEQ ID NO: 332299 - RNA, 19 nt, Homo sapiens
gcaggaaaguggagaauga

SEQ ID NO: 332300 - RNA, 19 nt, Homo sapiens
gaaucggcauguauacuua

SEQ ID NO: 332301 - RNA, 19 nt, Homo sapiens
gaaaguagcagucaucauc

SEQ ID NO: 332302 - RNA, 19 nt, Homo sapiens
ucacuuaccugaugcagaa

SEQ ID NO: 332303 - RNA, 19 nt, Homo sapiens
gcuaucaacugcagagauu

SEQ ID NO: 332304 - RNA, 19 nt, Homo sapiens
gauaauagggugcauuguu

SEQ ID NO: 332305 - RNA, 19 nt, Homo sapiens
ccagugaacuaauuugguu

SEQ ID NO: 332306 - RNA, 19 nt, Homo sapiens
gaucuuugcuuccuugcuu

SEQ ID NO: 332307 - RNA, 19 nt, Homo sapiens
uaacugacuuaacaacuga

SEQ ID NO: 332308 - RNA, 19 nt, Homo sapiens
caggcugucucauuuauuu

SEQ ID NO: 332309 - RNA, 19 nt, Homo sapiens
aaagaacuguccagauuga

SEQ ID NO: 332310 - RNA, 19 nt, Homo sapiens
cuagugauguagaaagaua

SEQ ID NO: 332311 - RNA, 19 nt, Homo sapiens
ccaagaaucggcauguaua

SEQ ID NO: 332312 - RNA, 19 nt, Homo sapiens
agaaugaggacaugaauaa

SEQ ID NO: 332313 - RNA, 19 nt, Homo sapiens
gaacaggcggcacaucauu

SEQ ID NO: 332314 - RNA, 19 nt, Homo sapiens
gaaagaacuguccagauug

SEQ ID NO: 332315 - RNA, 19 nt, Homo sapiens
gaaaaucgacucucauaaa

SEQ ID NO: 332316 - RNA, 19 nt, Homo sapiens
gcccuucacuguugcuuaa

SEQ ID NO: 332317 - RNA, 19 nt, Homo sapiens
agaaucagaugaagaugaa

SEQ ID NO: 332318 - RNA, 19 nt, Homo sapiens
ccaaucaaguucaccgaaa

SEQ ID NO: 332319 - RNA, 19 nt, Homo sapiens
cuacugaaguugggaaauu

SEQ ID NO: 332320 - RNA, 19 nt, Homo sapiens
caagagaggcggcaggaaa

SEQ ID NO: 332321 - RNA, 19 nt, Homo sapiens
gaaauugacagaugaaagg

SEQ ID NO: 332322 - RNA, 19 nt, Homo sapiens
gcacuugucuccuucuaac

SEQ ID NO: 332323 - RNA, 19 nt, Homo sapiens
auaaacagccuauuccuaa

SEQ ID NO: 332324 - RNA, 19 nt, Homo sapiens
gaugagcacuccugauuuu

SEQ ID NO: 332325 - RNA, 19 nt, Homo sapiens
gugcaaggccaucugcuua

SEQ ID NO: 332326 - RNA, 19 nt, Homo sapiens
guagaaagauacacugacu

SEQ ID NO: 332327 - RNA, 19 nt, Homo sapiens
uuucaaaucuguagcauag

SEQ ID NO: 332328 - RNA, 19 nt, Homo sapiens
gaaaaucaaagcagucaua

SEQ ID NO: 332329 - RNA, 19 nt, Homo sapiens
ugacuuaacaacugacuaa

SEQ ID NO: 332330 - RNA, 19 nt, Homo sapiens
gagaaugaggacaugaaua

SEQ ID NO: 332331 - RNA, 19 nt, Homo sapiens
aaacuuccguucugagaga

SEQ ID NO: 332332 - RNA, 19 nt, Homo sapiens
auaauagggugcauuguug

SEQ ID NO: 332333 - RNA, 19 nt, Homo sapiens
gaagugguguuccaugacu

SEQ ID NO: 332334 - RNA, 19 nt, Homo sapiens
ucugugcacuguagccuua

SEQ ID NO: 332335 - RNA, 19 nt, Homo sapiens
ggaugaaauugaagaacau

SEQ ID NO: 332336 - RNA, 19 nt, Homo sapiens
gaacgggagcggcugaaga

SEQ ID NO: 332337 - RNA, 19 nt, Homo sapiens
gcccuuagauguggcguuu

SEQ ID NO: 332338 - RNA, 19 nt, Homo sapiens
gauucuggaugaaauugaa

SEQ ID NO: 332339 - RNA, 19 nt, Homo sapiens
gcacaaugacuuucugaag

SEQ ID NO: 332340 - RNA, 19 nt, Homo sapiens
cagaugaagaugaagauuu

SEQ ID NO: 332341 - RNA, 19 nt, Homo sapiens
aagaagugguguuccauga

SEQ ID NO: 332342 - RNA, 19 nt, Homo sapiens
gcaguuggucuauucagaa

SEQ ID NO: 332343 - RNA, 19 nt, Homo sapiens
aaucugguguucuugcuaa

SEQ ID NO: 332344 - RNA, 19 nt, Homo sapiens
acaacugacuaaccauuga

SEQ ID NO: 332345 - RNA, 19 nt, Homo sapiens
aaaggauucuggaugaaau

SEQ ID NO: 332346 - RNA, 19 nt, Homo sapiens
gguguuccaugacuucaga

SEQ ID NO: 332347 - RNA, 19 nt, Homo sapiens
gugugaagguaacuaagaa

SEQ ID NO: 332348 - RNA, 19 nt, Homo sapiens
uaacuuugcccuucacugu

SEQ ID NO: 332349 - RNA, 19 nt, Homo sapiens
guagggagauggagaaaau

SEQ ID NO: 332350 - RNA, 19 nt, Homo sapiens
uaauauaaaccguguguca

SEQ ID NO: 332351 - RNA, 19 nt, Homo sapiens
ugugcaggcugucucauuu

SEQ ID NO: 332352 - RNA, 19 nt, Homo sapiens
uaacaacugacuaaccauu

SEQ ID NO: 332353 - RNA, 19 nt, Homo sapiens
gagggugccauccacauuu

SEQ ID NO: 332354 - RNA, 19 nt, Homo sapiens
gugcacauaucaagaaguc

SEQ ID NO: 332355 - RNA, 19 nt, Homo sapiens
agaaagauacacugacuug

SEQ ID NO: 332356 - RNA, 19 nt, Homo sapiens
ugaaggcaauacacaacaa

SEQ ID NO: 332357 - RNA, 19 nt, Homo sapiens
cauaaacagccuauuccua

SEQ ID NO: 332358 - RNA, 19 nt, Homo sapiens
agccacaccuggucuguuu

SEQ ID NO: 332359 - RNA, 19 nt, Homo sapiens
aaacauuccagaugcauga

SEQ ID NO: 332360 - RNA, 19 nt, Homo sapiens
ugacccaggaccuucauua

SEQ ID NO: 332361 - RNA, 19 nt, Homo sapiens
cauugucguuucauucauu

SEQ ID NO: 332362 - RNA, 19 nt, Homo sapiens
aaaaugagauuccagugaa

SEQ ID NO: 332363 - RNA, 19 nt, Homo sapiens
ccuuagauguggcguuuau

SEQ ID NO: 332364 - RNA, 19 nt, Homo sapiens
gcauaugugagugaaagua

SEQ ID NO: 332365 - RNA, 19 nt, Homo sapiens
agacgaagcuucacaaaag

SEQ ID NO: 332366 - RNA, 19 nt, Homo sapiens
ggagggugccauccacauu

SEQ ID NO: 332367 - RNA, 19 nt, Homo sapiens
gaaugaggacaugaauaaa

SEQ ID NO: 332368 - RNA, 19 nt, Homo sapiens
uggaugaaauugaagaaca

SEQ ID NO: 332369 - RNA, 19 nt, Homo sapiens
gaauauugugccugucauu

SEQ ID NO: 332370 - RNA, 19 nt, Homo sapiens
gagcagacuagacuucuca

SEQ ID NO: 332371 - RNA, 19 nt, Homo sapiens
uagggugcauuguugcuuu

SEQ ID NO: 332372 - RNA, 19 nt, Homo sapiens
guacccagaaagagucaua

SEQ ID NO: 332373 - RNA, 19 nt, Homo sapiens
ugaaucaggucuaggaaaa

SEQ ID NO: 332374 - RNA, 19 nt, Homo sapiens
uaacuaagaagugguguuc

SEQ ID NO: 332375 - RNA, 19 nt, Homo sapiens
cacuguugcuuaauuguga

SEQ ID NO: 332376 - RNA, 19 nt, Homo sapiens
cccagaaauugacagauga

SEQ ID NO: 332377 - RNA, 19 nt, Homo sapiens
gccuagugauguagaaaga

SEQ ID NO: 332378 - RNA, 19 nt, Homo sapiens
agaggugugugccuaguga

SEQ ID NO: 332379 - RNA, 19 nt, Homo sapiens
uaccugugccugagaauuu

SEQ ID NO: 332380 - RNA, 19 nt, Homo sapiens
augaggacaugaauaaaga

SEQ ID NO: 332381 - RNA, 19 nt, Homo sapiens
ggagaaugaggacaugaau

SEQ ID NO: 332382 - RNA, 19 nt, Homo sapiens
cagaaucagaugaagauga

SEQ ID NO: 332383 - RNA, 19 nt, Homo sapiens
gaaaaggauucuggaugaa

SEQ ID NO: 332384 - RNA, 19 nt, Homo sapiens
gacgagagcggcuugaaca

SEQ ID NO: 332385 - RNA, 19 nt, Homo sapiens
uaaaccgugugucauguca

SEQ ID NO: 332386 - RNA, 19 nt, Homo sapiens
ggaggaaaguagcagucau

SEQ ID NO: 332387 - RNA, 19 nt, Homo sapiens
ucaguugauugaagccaaa

SEQ ID NO: 332388 - RNA, 19 nt, Homo sapiens
gaaaaccgagcucauaaga

SEQ ID NO: 332389 - RNA, 19 nt, Homo sapiens
gggcacuugucuccuucua

SEQ ID NO: 332390 - RNA, 19 nt, Homo sapiens
uaacuuugcuggaaaaucu

SEQ ID NO: 332391 - RNA, 19 nt, Homo sapiens
gaugaaaggagacaauggu

SEQ ID NO: 332392 - RNA, 19 nt, Homo sapiens
agugucaccuuucuucuug

SEQ ID NO: 332393 - RNA, 19 nt, Homo sapiens
cuaccggguucuccugauu

SEQ ID NO: 332394 - RNA, 19 nt, Homo sapiens
ccacaucacaccacuugga

SEQ ID NO: 332395 - RNA, 19 nt, Homo sapiens
guauuucauugcuguguca

SEQ ID NO: 332396 - RNA, 19 nt, Homo sapiens
uaagaaaaccgagcucaua

SEQ ID NO: 332397 - RNA, 19 nt, Homo sapiens
ucaagaagcuggccaagaa

SEQ ID NO: 332398 - RNA, 19 nt, Homo sapiens
acgaugagcuuguguauaa

SEQ ID NO: 332399 - RNA, 19 nt, Homo sapiens
caagaaguaugaugcguuu

SEQ ID NO: 332400 - RNA, 19 nt, Homo sapiens
ugaagaagguguuaugucu

SEQ ID NO: 332401 - RNA, 19 nt, Homo sapiens
gagcuuguguauaacauuc

SEQ ID NO: 332402 - RNA, 19 nt, Homo sapiens
caaucaaguuccaaaugaa

SEQ ID NO: 332403 - RNA, 19 nt, Homo sapiens
cagaucagcuugaagaacu

SEQ ID NO: 332404 - RNA, 19 nt, Homo sapiens
caaaguggaugaggugaag

SEQ ID NO: 332405 - RNA, 19 nt, Homo sapiens
uaaauaaggcaggaaaguu

SEQ ID NO: 332406 - RNA, 19 nt, Homo sapiens
gagaagccaugagcagcaa

SEQ ID NO: 332407 - RNA, 19 nt, Homo sapiens
gguguuaugucuggcugua

SEQ ID NO: 332408 - RNA, 19 nt, Homo sapiens
ccaaaugaagaagguguua

SEQ ID NO: 332409 - RNA, 19 nt, Homo sapiens
gaagcuggccaagaaguau

SEQ ID NO: 332410 - RNA, 19 nt, Homo sapiens
aaauaaggcaggaaaguuc

SEQ ID NO: 332411 - RNA, 19 nt, Homo sapiens
gacagacgaugagcuugug

SEQ ID NO: 332412 - RNA, 19 nt, Homo sapiens
gaacuaugauccccagaag

SEQ ID NO: 332413 - RNA, 19 nt, Homo sapiens
gggaccagcagcacuguga

SEQ ID NO: 332414 - RNA, 19 nt, Homo sapiens
aaaugaagaagguguuaug

SEQ ID NO: 332415 - RNA, 19 nt, Homo sapiens
aaacaugguggccaaagug

SEQ ID NO: 332416 - RNA, 19 nt, Homo sapiens
gacgaugagcuuguguaua

SEQ ID NO: 332417 - RNA, 19 nt, Homo sapiens
gccaugagcagcaaagucu

SEQ ID NO: 332418 - RNA, 19 nt, Homo sapiens
gaugagcuuguguauaaca

SEQ ID NO: 332419 - RNA, 19 nt, Homo sapiens
ugacagacgaugagcuugu

SEQ ID NO: 332420 - RNA, 19 nt, Homo sapiens
agaagcuggccaagaagua

SEQ ID NO: 332421 - RNA, 19 nt, Homo sapiens
caaaugaagaagguguuau

SEQ ID NO: 332422 - RNA, 19 nt, Homo sapiens
ccaaaguggaugaggugaa

SEQ ID NO: 332423 - RNA, 19 nt, Homo sapiens
aauccucggcccagguuua

SEQ ID NO: 332424 - RNA, 19 nt, Homo sapiens
ucaaguuccaaaugaagaa

SEQ ID NO: 332425 - RNA, 19 nt, Homo sapiens
cggcccagguuuaaauaag

SEQ ID NO: 332426 - RNA, 19 nt, Homo sapiens
uugcagaucagcuugaaga

SEQ ID NO: 332427 - RNA, 19 nt, Homo sapiens
aggcuaaggccguggauau

SEQ ID NO: 332428 - RNA, 19 nt, Homo sapiens
guuuaaauaaggcaggaaa

SEQ ID NO: 332429 - RNA, 19 nt, Homo sapiens
acauucaccuggcugucaa

SEQ ID NO: 332430 - RNA, 19 nt, Homo sapiens
ggcccagguuuaaauaagg

SEQ ID NO: 332431 - RNA, 19 nt, Homo sapiens
cagacgaugagcuugugua

SEQ ID NO: 332432 - RNA, 19 nt, Homo sapiens
agaucagcuugaagaacua

SEQ ID NO: 332433 - RNA, 19 nt, Homo sapiens
cgcccuaaguucucugugu

SEQ ID NO: 332434 - RNA, 19 nt, Homo sapiens
gcagaucagcuugaagaac

SEQ ID NO: 332435 - RNA, 19 nt, Homo sapiens
cgaauccucggcccagguu

SEQ ID NO: 332436 - RNA, 19 nt, Homo sapiens
ccuauauuaaggcacauuu

SEQ ID NO: 332437 - RNA, 19 nt, Homo sapiens
ucagcuugaagaacuauga

SEQ ID NO: 332438 - RNA, 19 nt, Homo sapiens
uuaaauaaggcaggaaagu

SEQ ID NO: 332439 - RNA, 19 nt, Homo sapiens
ccucggcccagguuuaaau

SEQ ID NO: 332440 - RNA, 19 nt, Homo sapiens
gaagccaugagcagcaaag

SEQ ID NO: 332441 - RNA, 19 nt, Homo sapiens
gaaaggagauugagauuga

SEQ ID NO: 332442 - RNA, 19 nt, Homo sapiens
ggaaagaagaugcuaauua

SEQ ID NO: 332443 - RNA, 19 nt, Homo sapiens
gcaagcagaugaaugauga

SEQ ID NO: 332444 - RNA, 19 nt, Homo sapiens
gugcuucccucucuuauga

SEQ ID NO: 332445 - RNA, 19 nt, Homo sapiens
ugaagacgcugaccggaaa

SEQ ID NO: 332446 - RNA, 19 nt, Homo sapiens
gcagaugaaugaugagaag

SEQ ID NO: 332447 - RNA, 19 nt, Homo sapiens
gguaggagcagcaauuuau

SEQ ID NO: 332448 - RNA, 19 nt, Homo sapiens
agauugagauugacauuga

SEQ ID NO: 332449 - RNA, 19 nt, Homo sapiens
caucauauauccucucacu

SEQ ID NO: 332450 - RNA, 19 nt, Homo sapiens
ggaaaggagauugagauug

SEQ ID NO: 332451 - RNA, 19 nt, Homo sapiens
gauugagauugacauugaa

SEQ ID NO: 332452 - RNA, 19 nt, Homo sapiens
ggagauugagauugacauu

SEQ ID NO: 332453 - RNA, 19 nt, Homo sapiens
gaugaaugaugagaagaca

SEQ ID NO: 332454 - RNA, 19 nt, Homo sapiens
cagacaagguggagcgaau

SEQ ID NO: 332455 - RNA, 19 nt, Homo sapiens
gaagaugcuaauuaaagug

SEQ ID NO: 332456 - RNA, 19 nt, Homo sapiens
guggcaagcagaugaauga

SEQ ID NO: 332457 - RNA, 19 nt, Homo sapiens
gagauugacauugaaccua

SEQ ID NO: 332458 - RNA, 19 nt, Homo sapiens
gcccaguaauguaugucua

SEQ ID NO: 332459 - RNA, 19 nt, Homo sapiens
cagcagaggcucaucuaca

SEQ ID NO: 332460 - RNA, 19 nt, Homo sapiens
ucauauauccucucacucu

SEQ ID NO: 332461 - RNA, 19 nt, Homo sapiens
ggcaucauauauccucuca

SEQ ID NO: 332462 - RNA, 19 nt, Homo sapiens
ggucuuaggcagugaugga

SEQ ID NO: 332463 - RNA, 19 nt, Homo sapiens
gaugcuaauuaaagugaag

SEQ ID NO: 332464 - RNA, 19 nt, Homo sapiens
gagaggaggagguggucuu

SEQ ID NO: 332465 - RNA, 19 nt, Homo sapiens
cauugaaccuacagacaag

SEQ ID NO: 332466 - RNA, 19 nt, Homo sapiens
gagauugagauugacauug

SEQ ID NO: 332467 - RNA, 19 nt, Homo sapiens
gucccugguugucaauaaa

SEQ ID NO: 332468 - RNA, 19 nt, Homo sapiens
ugucccugguugucaauaa

SEQ ID NO: 332469 - RNA, 19 nt, Homo sapiens
gcgguaggagcagcaauuu

SEQ ID NO: 332470 - RNA, 19 nt, Homo sapiens
ggugggagacugugaggau

SEQ ID NO: 332471 - RNA, 19 nt, Homo sapiens
gaugcccaguaauguaugu

SEQ ID NO: 332472 - RNA, 19 nt, Homo sapiens
caacagcagaggcucaucu

SEQ ID NO: 332473 - RNA, 19 nt, Homo sapiens
acauugaaccuacagacaa

SEQ ID NO: 332474 - RNA, 19 nt, Homo sapiens
gacauugaaccuacagaca

SEQ ID NO: 332475 - RNA, 19 nt, Homo sapiens
cggaaaggagauugagauu

SEQ ID NO: 332476 - RNA, 19 nt, Homo sapiens
caagguggagcgaaucaag

SEQ ID NO: 332477 - RNA, 19 nt, Homo sapiens
gauugacauugaaccuaca

SEQ ID NO: 332478 - RNA, 19 nt, Homo sapiens
agaggaggagguggucuua

SEQ ID NO: 332479 - RNA, 19 nt, Homo sapiens
gacaagguggagcgaauca

SEQ ID NO: 332480 - RNA, 19 nt, Homo sapiens
ggcaagcagaugaaugaug

SEQ ID NO: 332481 - RNA, 19 nt, Homo sapiens
cgguaggagcagcaauuua

SEQ ID NO: 332482 - RNA, 19 nt, Homo sapiens
aggaggagguggucuuagg

SEQ ID NO: 332483 - RNA, 19 nt, Homo sapiens
ccugugugcuucccucucu

SEQ ID NO: 332484 - RNA, 19 nt, Homo sapiens
uggaugcccaguaauguau

SEQ ID NO: 332485 - RNA, 19 nt, Homo sapiens
guaggagcagcaauuuauc

SEQ ID NO: 332486 - RNA, 19 nt, Homo sapiens
gcagaggcucaucuacagu

SEQ ID NO: 332487 - RNA, 19 nt, Homo sapiens
gaaagaagcagcagaagaa

SEQ ID NO: 332488 - RNA, 19 nt, Homo sapiens
caagauggcucuggauaua

SEQ ID NO: 332489 - RNA, 19 nt, Homo sapiens
caaggaagcucccaaggaa

SEQ ID NO: 332490 - RNA, 19 nt, Homo sapiens
gaaagcaacugcaccugaa

SEQ ID NO: 332491 - RNA, 19 nt, Homo sapiens
ccaaauacaucacuaaauc

SEQ ID NO: 332492 - RNA, 19 nt, Homo sapiens
caaaggaugugccagagaa

SEQ ID NO: 332493 - RNA, 19 nt, Homo sapiens
guauguaccugggaaauuu

SEQ ID NO: 332494 - RNA, 19 nt, Homo sapiens
gaagaaagaagcagcagaa

SEQ ID NO: 332495 - RNA, 19 nt, Homo sapiens
gaacucagccuuaagaaag

SEQ ID NO: 332496 - RNA, 19 nt, Homo sapiens
gcaagucuccugugucaaa

SEQ ID NO: 332497 - RNA, 19 nt, Homo sapiens
gaaaggcguugucaccaau

SEQ ID NO: 332498 - RNA, 19 nt, Homo sapiens
acacagaacucagccuuaa

SEQ ID NO: 332499 - RNA, 19 nt, Homo sapiens
gaucauagaggaaaccaaa

SEQ ID NO: 332500 - RNA, 19 nt, Homo sapiens
ggaagaaggagaaacagaa

SEQ ID NO: 332501 - RNA, 19 nt, Homo sapiens
cgacggcgcugaaggaaau

SEQ ID NO: 332502 - RNA, 19 nt, Homo sapiens
ggauucaaaugcaugauau

SEQ ID NO: 332503 - RNA, 19 nt, Homo sapiens
gaaggaaggcucuagugaa

SEQ ID NO: 332504 - RNA, 19 nt, Homo sapiens
ggagaaagagaccaaagaa

SEQ ID NO: 332505 - RNA, 19 nt, Homo sapiens
aaggaaggcucuagugaaa

SEQ ID NO: 332506 - RNA, 19 nt, Homo sapiens
aaaccaaaguggaggauga

SEQ ID NO: 332507 - RNA, 19 nt, Homo sapiens
ggaagggagugauaaaggu

SEQ ID NO: 332508 - RNA, 19 nt, Homo sapiens
ggaagaagaaggccaggaa

SEQ ID NO: 332509 - RNA, 19 nt, Homo sapiens
aggaagagaucgccgagua

SEQ ID NO: 332510 - RNA, 19 nt, Homo sapiens
gagacuagauuuagcacau

SEQ ID NO: 332511 - RNA, 19 nt, Homo sapiens
agaaagagaccaaagaaga

SEQ ID NO: 332512 - RNA, 19 nt, Homo sapiens
agaaaucgcugcguacaga

SEQ ID NO: 332513 - RNA, 19 nt, Homo sapiens
ccaaaucuccugugccaaa

SEQ ID NO: 332514 - RNA, 19 nt, Homo sapiens
gagaggaagccgaagcuaa

SEQ ID NO: 332515 - RNA, 19 nt, Homo sapiens
gaugagaagucagaaaugg

SEQ ID NO: 332516 - RNA, 19 nt, Homo sapiens
ggaagaagaggaggaagaa

SEQ ID NO: 332517 - RNA, 19 nt, Homo sapiens
uuaccucacuggugcauuu

SEQ ID NO: 332518 - RNA, 19 nt, Homo sapiens
gggagaaccucguugacau

SEQ ID NO: 332519 - RNA, 19 nt, Homo sapiens
gaaagagaccaaagaagag

SEQ ID NO: 332520 - RNA, 19 nt, Homo sapiens
ggaagagaagguagagaaa

SEQ ID NO: 332521 - RNA, 19 nt, Homo sapiens
gacuagauuuagcacauuu

SEQ ID NO: 332522 - RNA, 19 nt, Homo sapiens
ggugaagagacuagauuua

SEQ ID NO: 332523 - RNA, 19 nt, Homo sapiens
caccugaaguuaaagaaga

SEQ ID NO: 332524 - RNA, 19 nt, Homo sapiens
gcaggaagaaggagaaaca

SEQ ID NO: 332525 - RNA, 19 nt, Homo sapiens
acccgaagcugaagaagaa

SEQ ID NO: 332526 - RNA, 19 nt, Homo sapiens
gaaggaagagaagaaagaa

SEQ ID NO: 332527 - RNA, 19 nt, Homo sapiens
ggaggaagggagugauaaa

SEQ ID NO: 332528 - RNA, 19 nt, Homo sapiens
ggaaaggugaacagaaaga

SEQ ID NO: 332529 - RNA, 19 nt, Homo sapiens
cacaauauccaguaagauu

SEQ ID NO: 332530 - RNA, 19 nt, Homo sapiens
gaagagacuagauuuagca

SEQ ID NO: 332531 - RNA, 19 nt, Homo sapiens
ggagaaagagaaggagaaa

SEQ ID NO: 332532 - RNA, 19 nt, Homo sapiens
ggggaaaggugaacagaaa

SEQ ID NO: 332533 - RNA, 19 nt, Homo sapiens
uaagguccaacacaaauuu

SEQ ID NO: 332534 - RNA, 19 nt, Homo sapiens
caaucacaauauccaguaa

SEQ ID NO: 332535 - RNA, 19 nt, Homo sapiens
ugagauguauuaugcaaag

SEQ ID NO: 332536 - RNA, 19 nt, Homo sapiens
gggauucaaaugcaugaua

SEQ ID NO: 332537 - RNA, 19 nt, Homo sapiens
gaggaggaagggagugaua

SEQ ID NO: 332538 - RNA, 19 nt, Homo sapiens
acagaaagaggaagaagaa

SEQ ID NO: 332539 - RNA, 19 nt, Homo sapiens
aagacuaccugaagacaga

SEQ ID NO: 332540 - RNA, 19 nt, Homo sapiens
gcgcaaagacuaccugaag

SEQ ID NO: 332541 - RNA, 19 nt, Homo sapiens
uaagccauaugacaauuuc

SEQ ID NO: 332542 - RNA, 19 nt, Homo sapiens
cgaaaucaccaguggaaga

SEQ ID NO: 332543 - RNA, 19 nt, Homo sapiens
aaaagaaaguggaggaaaa

SEQ ID NO: 332544 - RNA, 19 nt, Homo sapiens
ccaagagcaucgagcuaga

SEQ ID NO: 332545 - RNA, 19 nt, Homo sapiens
cagagugacuaagauuuga

SEQ ID NO: 332546 - RNA, 19 nt, Homo sapiens
ccaagucuccugugccaaa

SEQ ID NO: 332547 - RNA, 19 nt, Homo sapiens
agaggaagccgaagcuaaa

SEQ ID NO: 332548 - RNA, 19 nt, Homo sapiens
agaaaggcguugucaccaa

SEQ ID NO: 332549 - RNA, 19 nt, Homo sapiens
ccaaucacaauauccagua

SEQ ID NO: 332550 - RNA, 19 nt, Homo sapiens
ggggaugucuugagaugua

SEQ ID NO: 332551 - RNA, 19 nt, Homo sapiens
gggaggaagugaggaggaa

SEQ ID NO: 332552 - RNA, 19 nt, Homo sapiens
gaagaaggagaaacagaag

SEQ ID NO: 332553 - RNA, 19 nt, Homo sapiens
gagacccgcucgagcuuca

SEQ ID NO: 332554 - RNA, 19 nt, Homo sapiens
ugaaggaagagaagaaaga

SEQ ID NO: 332555 - RNA, 19 nt, Homo sapiens
gaggagaucauagaggaaa

SEQ ID NO: 332556 - RNA, 19 nt, Homo sapiens
ccagagugacuaagauuug

SEQ ID NO: 332557 - RNA, 19 nt, Homo sapiens
gcuaccaaauacaucacua

SEQ ID NO: 332558 - RNA, 19 nt, Homo sapiens
gugaggaaguggcuaccaa

SEQ ID NO: 332559 - RNA, 19 nt, Homo sapiens
gaagaaggccaggaagaag

SEQ ID NO: 332560 - RNA, 19 nt, Homo sapiens
gcaaucuuauguugaucga

SEQ ID NO: 332561 - RNA, 19 nt, Homo sapiens
ccucacuggugcauuuaaa

SEQ ID NO: 332562 - RNA, 19 nt, Homo sapiens
gaugucuugagauguauua

SEQ ID NO: 332563 - RNA, 19 nt, Homo sapiens
guuaagccauaugacaauu

SEQ ID NO: 332564 - RNA, 19 nt, Homo sapiens
uaaaggugcacuuggagaa

SEQ ID NO: 332565 - RNA, 19 nt, Homo sapiens
agguggagcuggacaagaa

SEQ ID NO: 332566 - RNA, 19 nt, Homo sapiens
ggaaaaggaggaagaagaa

SEQ ID NO: 332567 - RNA, 19 nt, Homo sapiens
guugaucgauguuaaacgu

SEQ ID NO: 332568 - RNA, 19 nt, Homo sapiens
ggagaaccucguugacaug

SEQ ID NO: 332569 - RNA, 19 nt, Homo sapiens
gauguauuaugcaaaguac

SEQ ID NO: 332570 - RNA, 19 nt, Homo sapiens
ggaagagaaagccaaaucu

SEQ ID NO: 332571 - RNA, 19 nt, Homo sapiens
aggcaagucuccuguguca

SEQ ID NO: 332572 - RNA, 19 nt, Homo sapiens
aaaggcaagucuccugugu

SEQ ID NO: 332573 - RNA, 19 nt, Homo sapiens
gcaguacuugcucaauaaa

SEQ ID NO: 332574 - RNA, 19 nt, Homo sapiens
ucguugacaugcacaguuu

SEQ ID NO: 332575 - RNA, 19 nt, Homo sapiens
gagcaggagaccaaggaaa

SEQ ID NO: 332576 - RNA, 19 nt, Homo sapiens
gaacagaaagaggaagaag

SEQ ID NO: 332577 - RNA, 19 nt, Homo sapiens
uggaagaggcaaagucaaa

SEQ ID NO: 332578 - RNA, 19 nt, Homo sapiens
gagaaggaaggcucuagug

SEQ ID NO: 332579 - RNA, 19 nt, Homo sapiens
ugagaagucagaaauggaa

SEQ ID NO: 332580 - RNA, 19 nt, Homo sapiens
agauggcucuggauauaga

SEQ ID NO: 332581 - RNA, 19 nt, Homo sapiens
gccgaagagugguucaaau

SEQ ID NO: 332582 - RNA, 19 nt, Homo sapiens
gaggagaaacuagugucua

SEQ ID NO: 332583 - RNA, 19 nt, Homo sapiens
cgguaaaggugcacuugga

SEQ ID NO: 332584 - RNA, 19 nt, Homo sapiens
ucaaggaagcucccaagga

SEQ ID NO: 332585 - RNA, 19 nt, Homo sapiens
gaaaucaccaguggaagag

SEQ ID NO: 332586 - RNA, 19 nt, Homo sapiens
agaggaaggugagcaggaa

SEQ ID NO: 332587 - RNA, 19 nt, Homo sapiens
ggacaauuaugauagcuua

SEQ ID NO: 332588 - RNA, 19 nt, Homo sapiens
gaaggaaccugcugucgaa

SEQ ID NO: 332589 - RNA, 19 nt, Homo sapiens
caagauggcucuggauaua

SEQ ID NO: 332590 - RNA, 19 nt, Homo sapiens
cguaaacacuugacuauaa

SEQ ID NO: 332591 - RNA, 19 nt, Homo sapiens
gaaagaaacugugauugug

SEQ ID NO: 332592 - RNA, 19 nt, Homo sapiens
ggaagacgcuaaacccaaa

SEQ ID NO: 332593 - RNA, 19 nt, Homo sapiens
ggaagaggcugaagauaag

SEQ ID NO: 332594 - RNA, 19 nt, Homo sapiens
ggagaagucugagaaagaa

SEQ ID NO: 332595 - RNA, 19 nt, Homo sapiens
gaagccaagucaccaguaa

SEQ ID NO: 332596 - RNA, 19 nt, Homo sapiens
agaagaaacugcuuagaug

SEQ ID NO: 332597 - RNA, 19 nt, Homo sapiens
gaucagaguaacacaauuu

SEQ ID NO: 332598 - RNA, 19 nt, Homo sapiens
ugagaugucuuaaccuauu

SEQ ID NO: 332599 - RNA, 19 nt, Homo sapiens
caagaagccugaggagaaa

SEQ ID NO: 332600 - RNA, 19 nt, Homo sapiens
gaagaaacugcuuagauga

SEQ ID NO: 332601 - RNA, 19 nt, Homo sapiens
ccaagugacugaagaagug

SEQ ID NO: 332602 - RNA, 19 nt, Homo sapiens
gaaugagcaguuagaaaua

SEQ ID NO: 332603 - RNA, 19 nt, Homo sapiens
ccaagaagccugaggagaa

SEQ ID NO: 332604 - RNA, 19 nt, Homo sapiens
caaagaauccaaaguugaa

SEQ ID NO: 332605 - RNA, 19 nt, Homo sapiens
cccaggcgauggacaauua

SEQ ID NO: 332606 - RNA, 19 nt, Homo sapiens
gaaaggaacauccggaaca

SEQ ID NO: 332607 - RNA, 19 nt, Homo sapiens
ggaguucacuuucaauugc

SEQ ID NO: 332608 - RNA, 19 nt, Homo sapiens
gaggagugguuccgaguga

SEQ ID NO: 332609 - RNA, 19 nt, Homo sapiens
gaaggcagaggaagagaaa

SEQ ID NO: 332610 - RNA, 19 nt, Homo sapiens
gaaggaagaggcugaagau

SEQ ID NO: 332611 - RNA, 19 nt, Homo sapiens
gcguggaccugcagaagaa

SEQ ID NO: 332612 - RNA, 19 nt, Homo sapiens
cagaugaccgcaauaauga

SEQ ID NO: 332613 - RNA, 19 nt, Homo sapiens
ggugaagagugucggauug

SEQ ID NO: 332614 - RNA, 19 nt, Homo sapiens
ugaaugagcaguuagaaau

SEQ ID NO: 332615 - RNA, 19 nt, Homo sapiens
gcaauauguuagcaagaga

SEQ ID NO: 332616 - RNA, 19 nt, Homo sapiens
caacgaaggaggaagcaaa

SEQ ID NO: 332617 - RNA, 19 nt, Homo sapiens
caaagaaggcagaggaaga

SEQ ID NO: 332618 - RNA, 19 nt, Homo sapiens
agagauagccgcuuacaga

SEQ ID NO: 332619 - RNA, 19 nt, Homo sapiens
auauagagauagccgcuua

SEQ ID NO: 332620 - RNA, 19 nt, Homo sapiens
ccacuggaguucacuuuca

SEQ ID NO: 332621 - RNA, 19 nt, Homo sapiens
gaaguaaggcagggagaaa

SEQ ID NO: 332622 - RNA, 19 nt, Homo sapiens
aaacagaggagaagaagga

SEQ ID NO: 332623 - RNA, 19 nt, Homo sapiens
cagccaaggugaacacaga

SEQ ID NO: 332624 - RNA, 19 nt, Homo sapiens
ccaaagaauccaaaguuga

SEQ ID NO: 332625 - RNA, 19 nt, Homo sapiens
gaugugaagucuccagaag

SEQ ID NO: 332626 - RNA, 19 nt, Homo sapiens
ggcacuggccacugaauua

SEQ ID NO: 332627 - RNA, 19 nt, Homo sapiens
gaacagccaaagaaacuca

SEQ ID NO: 332628 - RNA, 19 nt, Homo sapiens
gcccaaagaauccaaaguu

SEQ ID NO: 332629 - RNA, 19 nt, Homo sapiens
gcgaagagaagaucaaagu

SEQ ID NO: 332630 - RNA, 19 nt, Homo sapiens
gauagccgcuuacagaaaa

SEQ ID NO: 332631 - RNA, 19 nt, Homo sapiens
aggaagaggcugaagauaa

SEQ ID NO: 332632 - RNA, 19 nt, Homo sapiens
ggagaaagaggccaaagag

SEQ ID NO: 332633 - RNA, 19 nt, Homo sapiens
ugaccgcaauaaugaauga

SEQ ID NO: 332634 - RNA, 19 nt, Homo sapiens
gcgauggacaauuaugaua

SEQ ID NO: 332635 - RNA, 19 nt, Homo sapiens
ggaauuucuguuagcaaua

SEQ ID NO: 332636 - RNA, 19 nt, Homo sapiens
cagcaagccuccagagaag

SEQ ID NO: 332637 - RNA, 19 nt, Homo sapiens
cugaagaagugacugaaga

SEQ ID NO: 332638 - RNA, 19 nt, Homo sapiens
aggaggagauaacugagua

SEQ ID NO: 332639 - RNA, 19 nt, Homo sapiens
ugacagaugaccgcaauaa

SEQ ID NO: 332640 - RNA, 19 nt, Homo sapiens
ccaaagaaacucagaagag

SEQ ID NO: 332641 - RNA, 19 nt, Homo sapiens
ccaaaugccuucuguuuuc

SEQ ID NO: 332642 - RNA, 19 nt, Homo sapiens
cuugagaugucuuaaccua

SEQ ID NO: 332643 - RNA, 19 nt, Homo sapiens
gugcauuuauugccucuau

SEQ ID NO: 332644 - RNA, 19 nt, Homo sapiens
gcaaaccagcagagaagaa

SEQ ID NO: 332645 - RNA, 19 nt, Homo sapiens
agaagugacugaagaagag

SEQ ID NO: 332646 - RNA, 19 nt, Homo sapiens
agaaagaaacugugauugu

SEQ ID NO: 332647 - RNA, 19 nt, Homo sapiens
ucaaagugguggagaaguc

SEQ ID NO: 332648 - RNA, 19 nt, Homo sapiens
cccaaagaauccaaaguug

SEQ ID NO: 332649 - RNA, 19 nt, Homo sapiens
ggccaagucuccagcaaag

SEQ ID NO: 332650 - RNA, 19 nt, Homo sapiens
gagauagccgcuuacagaa

SEQ ID NO: 332651 - RNA, 19 nt, Homo sapiens
ggaucagaguaacacaauu

SEQ ID NO: 332652 - RNA, 19 nt, Homo sapiens
ccaagaaggaaccagauga

SEQ ID NO: 332653 - RNA, 19 nt, Homo sapiens
ugagaaagaaacugugauu

SEQ ID NO: 332654 - RNA, 19 nt, Homo sapiens
acagaugaccgcaauaaug

SEQ ID NO: 332655 - RNA, 19 nt, Homo sapiens
ucccggagcucaaggauca

SEQ ID NO: 332656 - RNA, 19 nt, Homo sapiens
cagagaaggccacagaaga

SEQ ID NO: 332657 - RNA, 19 nt, Homo sapiens
ccaaagccaaggaagauga

SEQ ID NO: 332658 - RNA, 19 nt, Homo sapiens
gagaagaaggacagcaaga

SEQ ID NO: 332659 - RNA, 19 nt, Homo sapiens
caagucaccaguaaaggaa

SEQ ID NO: 332660 - RNA, 19 nt, Homo sapiens
ccuggaaggugaagagugu

SEQ ID NO: 332661 - RNA, 19 nt, Homo sapiens
gcacuggccacugaauuau

SEQ ID NO: 332662 - RNA, 19 nt, Homo sapiens
gagaugucuuaaccuauuc

SEQ ID NO: 332663 - RNA, 19 nt, Homo sapiens
uuauguagcugaaugugau

SEQ ID NO: 332664 - RNA, 19 nt, Homo sapiens
ccgcccagcugcgagaaua

SEQ ID NO: 332665 - RNA, 19 nt, Homo sapiens
ggaagccaagucaccagua

SEQ ID NO: 332666 - RNA, 19 nt, Homo sapiens
gaagagucccggagcucaa

SEQ ID NO: 332667 - RNA, 19 nt, Homo sapiens
gagaagaagaaacaaaguc

SEQ ID NO: 332668 - RNA, 19 nt, Homo sapiens
gagaaagaaacugugauug

SEQ ID NO: 332669 - RNA, 19 nt, Homo sapiens
ggaggcagcaccggagaaa

SEQ ID NO: 332670 - RNA, 19 nt, Homo sapiens
gaagcaaaguccccugaga

SEQ ID NO: 332671 - RNA, 19 nt, Homo sapiens
agauggcucuggauauaga

SEQ ID NO: 332672 - RNA, 19 nt, Homo sapiens
gaagcaaaguccccugaga

SEQ ID NO: 332673 - RNA, 19 nt, Homo sapiens
gaagcaaaguccccugaga

SEQ ID NO: 332674 - RNA, 19 nt, Homo sapiens
gaagcaaaguccccugaga

SEQ ID NO: 332675 - RNA, 19 nt, Homo sapiens
gaagcaaaguccccugaga

SEQ ID NO: 332676 - RNA, 19 nt, Homo sapiens
caaaggaagaggcaaaguc

SEQ ID NO: 332677 - RNA, 19 nt, Homo sapiens
gaagucaaguccccugaga

SEQ ID NO: 332678 - RNA, 19 nt, Homo sapiens
ccaagucaccaguaaagga

SEQ ID NO: 332679 - RNA, 19 nt, Homo sapiens
gaaggacuccccaaaauuc

SEQ ID NO: 332680 - RNA, 19 nt, Homo sapiens
gaaauacauuaugcuugag

SEQ ID NO: 332681 - RNA, 19 nt, Homo sapiens
ggaaguaaggcagggagaa

SEQ ID NO: 332682 - RNA, 19 nt, Homo sapiens
cagagaaggaggaagcaaa

SEQ ID NO: 332683 - RNA, 19 nt, Homo sapiens
cagagaaggaggaagcaaa

SEQ ID NO: 332684 - RNA, 19 nt, Homo sapiens
cuuaaccuauucccaaaug

SEQ ID NO: 332685 - RNA, 19 nt, Homo sapiens
aagaagaaacugcuuagau

SEQ ID NO: 332686 - RNA, 19 nt, Homo sapiens
caagaaggaaccagaugau

SEQ ID NO: 332687 - RNA, 19 nt, Homo sapiens
ggacagaggcacuuccuua

SEQ ID NO: 332688 - RNA, 19 nt, Homo sapiens
ggacagcuaugguguuuca

SEQ ID NO: 332689 - RNA, 19 nt, Homo sapiens
guauacagcuaucuuagaa

SEQ ID NO: 332690 - RNA, 19 nt, Homo sapiens
gcacaagguugcacuguca

SEQ ID NO: 332691 - RNA, 19 nt, Homo sapiens
gaaauuaauucagcuguuc

SEQ ID NO: 332692 - RNA, 19 nt, Homo sapiens
cgagaaagauauugaugaa

SEQ ID NO: 332693 - RNA, 19 nt, Homo sapiens
ggagacaauuggacccaua

SEQ ID NO: 332694 - RNA, 19 nt, Homo sapiens
gcagaagaauggacgaaau

SEQ ID NO: 332695 - RNA, 19 nt, Homo sapiens
gcagaaggccagcggauuu

SEQ ID NO: 332696 - RNA, 19 nt, Homo sapiens
ggaagagucuguuguucug

SEQ ID NO: 332697 - RNA, 19 nt, Homo sapiens
gaagagggcugcagauacg

SEQ ID NO: 332698 - RNA, 19 nt, Homo sapiens
ggaccuaaauguggugaaa

SEQ ID NO: 332699 - RNA, 19 nt, Homo sapiens
gguaaaugguugauguauu

SEQ ID NO: 332700 - RNA, 19 nt, Homo sapiens
aaacuugccuggacagcua

SEQ ID NO: 332701 - RNA, 19 nt, Homo sapiens
guggaugacuucucuugua

SEQ ID NO: 332702 - RNA, 19 nt, Homo sapiens
uaauucagcuguuccagaa

SEQ ID NO: 332703 - RNA, 19 nt, Homo sapiens
gaacaccacccuuggaguu

SEQ ID NO: 332704 - RNA, 19 nt, Homo sapiens
guagauugcuggccacuca

SEQ ID NO: 332705 - RNA, 19 nt, Homo sapiens
gauccaggcucauuugcuu

SEQ ID NO: 332706 - RNA, 19 nt, Homo sapiens
guacagaacacgaugaaug

SEQ ID NO: 332707 - RNA, 19 nt, Homo sapiens
guacuaaccauaauagaga

SEQ ID NO: 332708 - RNA, 19 nt, Homo sapiens
ggauaggaaucgguaguuu

SEQ ID NO: 332709 - RNA, 19 nt, Homo sapiens
gggaugagauucgguauca

SEQ ID NO: 332710 - RNA, 19 nt, Homo sapiens
gcaaggauggcaagauauu

SEQ ID NO: 332711 - RNA, 19 nt, Homo sapiens
ggacugcucuaucgagauc

SEQ ID NO: 332712 - RNA, 19 nt, Homo sapiens
cugcaaggauggcaagaua

SEQ ID NO: 332713 - RNA, 19 nt, Homo sapiens
gaaugugccuuaagaacuc

SEQ ID NO: 332714 - RNA, 19 nt, Homo sapiens
gaugggaccuauucacugu

SEQ ID NO: 332715 - RNA, 19 nt, Homo sapiens
cagcuaagaugcauuacug

SEQ ID NO: 332716 - RNA, 19 nt, Homo sapiens
caagaugacugcaaaacua

SEQ ID NO: 332717 - RNA, 19 nt, Homo sapiens
gugcugaccuauucuguug

SEQ ID NO: 332718 - RNA, 19 nt, Homo sapiens
gagcgaugccgauggauuu

SEQ ID NO: 332719 - RNA, 19 nt, Homo sapiens
guaaaucauguuucccuua

SEQ ID NO: 332720 - RNA, 19 nt, Homo sapiens
acagauaauugccaaaguu

SEQ ID NO: 332721 - RNA, 19 nt, Homo sapiens
agucacaagucaauguuua

SEQ ID NO: 332722 - RNA, 19 nt, Homo sapiens
gcaguggccugagggauga

SEQ ID NO: 332723 - RNA, 19 nt, Homo sapiens
gaaauguguccuccuuuga

SEQ ID NO: 332724 - RNA, 19 nt, Homo sapiens
uaacaucaccuaugacauc

SEQ ID NO: 332725 - RNA, 19 nt, Homo sapiens
gauucgguaucacuacaua

SEQ ID NO: 332726 - RNA, 19 nt, Homo sapiens
ucaugugagugagaaauua

SEQ ID NO: 332727 - RNA, 19 nt, Homo sapiens
ucaccgagcuugaccuugu

SEQ ID NO: 332728 - RNA, 19 nt, Homo sapiens
gaauccaagugcugaccua

SEQ ID NO: 332729 - RNA, 19 nt, Homo sapiens
gggagacucugccuacugu

SEQ ID NO: 332730 - RNA, 19 nt, Homo sapiens
cuguagaggucauaacuuu

SEQ ID NO: 332731 - RNA, 19 nt, Homo sapiens
gaaguuucccguguuguaa

SEQ ID NO: 332732 - RNA, 19 nt, Homo sapiens
ugaugaaugugccuuaaga

SEQ ID NO: 332733 - RNA, 19 nt, Homo sapiens
gcagaaggaccuaaaugug

SEQ ID NO: 332734 - RNA, 19 nt, Homo sapiens
agaaauguguccuccuuug

SEQ ID NO: 332735 - RNA, 19 nt, Homo sapiens
ggagugauacuguccauuc

SEQ ID NO: 332736 - RNA, 19 nt, Homo sapiens
aaccugcagugauuucuua

SEQ ID NO: 332737 - RNA, 19 nt, Homo sapiens
aaagaaguuucccguguug

SEQ ID NO: 332738 - RNA, 19 nt, Homo sapiens
ggaguccuguauugacauu

SEQ ID NO: 332739 - RNA, 19 nt, Homo sapiens
gcaaggaauaauggauuua

SEQ ID NO: 332740 - RNA, 19 nt, Homo sapiens
caugguaaaugguugaugu

SEQ ID NO: 332741 - RNA, 19 nt, Homo sapiens
cuacagugccgugcauuua

SEQ ID NO: 332742 - RNA, 19 nt, Homo sapiens
caacuugagcugugaguau

SEQ ID NO: 332743 - RNA, 19 nt, Homo sapiens
ccuuugaacugcucagaaa

SEQ ID NO: 332744 - RNA, 19 nt, Homo sapiens
gugauagacccuccagaua

SEQ ID NO: 332745 - RNA, 19 nt, Homo sapiens
aaauaaaguugccuguugu

SEQ ID NO: 332746 - RNA, 19 nt, Homo sapiens
cauccaacgugauuaagga

SEQ ID NO: 332747 - RNA, 19 nt, Homo sapiens
gauaacaucaccuaugaca

SEQ ID NO: 332748 - RNA, 19 nt, Homo sapiens
uaagaacucacaccuguug

SEQ ID NO: 332749 - RNA, 19 nt, Homo sapiens
cgagagcgaugccgaugga

SEQ ID NO: 332750 - RNA, 19 nt, Homo sapiens
gcagaagcgguuuccauga

SEQ ID NO: 332751 - RNA, 19 nt, Homo sapiens
gcgagaaagauauugauga

SEQ ID NO: 332752 - RNA, 19 nt, Homo sapiens
acagaaauguguccuccuu

SEQ ID NO: 332753 - RNA, 19 nt, Homo sapiens
gaacuggagcacagcuauu

SEQ ID NO: 332754 - RNA, 19 nt, Homo sapiens
gagagagacucagcuccuu

SEQ ID NO: 332755 - RNA, 19 nt, Homo sapiens
caucaccuaugacaucaga

SEQ ID NO: 332756 - RNA, 19 nt, Homo sapiens
guguguggcucccaacaaa

SEQ ID NO: 332757 - RNA, 19 nt, Homo sapiens
gagauucgguaucacuaca

SEQ ID NO: 332758 - RNA, 19 nt, Homo sapiens
aaaauaaaguugccuguug

SEQ ID NO: 332759 - RNA, 19 nt, Homo sapiens
gcacaaugccagcaaagca

SEQ ID NO: 332760 - RNA, 19 nt, Homo sapiens
gcucauucuugcuaaccua

SEQ ID NO: 332761 - RNA, 19 nt, Homo sapiens
gaccauccaacgugauuaa

SEQ ID NO: 332762 - RNA, 19 nt, Homo sapiens
gaacucacaccuguuggaa

SEQ ID NO: 332763 - RNA, 19 nt, Homo sapiens
aaucauguuucccuuauca

SEQ ID NO: 332764 - RNA, 19 nt, Homo sapiens
gauaggaaucgguaguuug

SEQ ID NO: 332765 - RNA, 19 nt, Homo sapiens
ugaguauacagcuaucuua

SEQ ID NO: 332766 - RNA, 19 nt, Homo sapiens
gaucacauucuuccugaga

SEQ ID NO: 332767 - RNA, 19 nt, Homo sapiens
gcacagcuauuuugaacug

SEQ ID NO: 332768 - RNA, 19 nt, Homo sapiens
agacucagcuccuuuuauu

SEQ ID NO: 332769 - RNA, 19 nt, Homo sapiens
ggacaguggugggcuuugg

SEQ ID NO: 332770 - RNA, 19 nt, Homo sapiens
ggaaucgguaguuugguuu

SEQ ID NO: 332771 - RNA, 19 nt, Homo sapiens
ccaacgugauuaaggauag

SEQ ID NO: 332772 - RNA, 19 nt, Homo sapiens
uaugguguuucacggcuua

SEQ ID NO: 332773 - RNA, 19 nt, Homo sapiens
ggaaggagagguagauugc

SEQ ID NO: 332774 - RNA, 19 nt, Homo sapiens
ggucacaagcuguaucgaa

SEQ ID NO: 332775 - RNA, 19 nt, Homo sapiens
uccaagugcugaccuauuc

SEQ ID NO: 332776 - RNA, 19 nt, Homo sapiens
gugcaagagugguuacauc

SEQ ID NO: 332777 - RNA, 19 nt, Homo sapiens
ggaauaauggauuuacaag

SEQ ID NO: 332778 - RNA, 19 nt, Homo sapiens
cagauaauugccaaaguuu

SEQ ID NO: 332779 - RNA, 19 nt, Homo sapiens
cgacggacagcuugugauu

SEQ ID NO: 332780 - RNA, 19 nt, Homo sapiens
guucagagggaaucauuga

SEQ ID NO: 332781 - RNA, 19 nt, Homo sapiens
ggaagccacugcgagaaag

SEQ ID NO: 332782 - RNA, 19 nt, Homo sapiens
gugaagagggcugcagaua

SEQ ID NO: 332783 - RNA, 19 nt, Homo sapiens
uaagaugcauuacugucau

SEQ ID NO: 332784 - RNA, 19 nt, Homo sapiens
cauaauagagagagacuca

SEQ ID NO: 332785 - RNA, 19 nt, Homo sapiens
guaucgaaguggagacaau

SEQ ID NO: 332786 - RNA, 19 nt, Homo sapiens
gggaccaucugcagagcuu

SEQ ID NO: 332787 - RNA, 19 nt, Homo sapiens
ggaagaagcugccaaggaa

SEQ ID NO: 332788 - RNA, 19 nt, Homo sapiens
gaagauggcuuuggauauu

SEQ ID NO: 332789 - RNA, 19 nt, Homo sapiens
ggaggcagcugaagaggaa

SEQ ID NO: 332790 - RNA, 19 nt, Homo sapiens
ggaagagucugaagaagca

SEQ ID NO: 332791 - RNA, 19 nt, Homo sapiens
gaaauggcacgauaccuaa

SEQ ID NO: 332792 - RNA, 19 nt, Homo sapiens
gcagaacgcugaggaaugg

SEQ ID NO: 332793 - RNA, 19 nt, Homo sapiens
ggacacgaucaacaaauua

SEQ ID NO: 332794 - RNA, 19 nt, Homo sapiens
gaacaagcagcuaagaaga

SEQ ID NO: 332795 - RNA, 19 nt, Homo sapiens
ugaagaaagugcacgaaga

SEQ ID NO: 332796 - RNA, 19 nt, Homo sapiens
gaauugaggaccacaaaga

SEQ ID NO: 332797 - RNA, 19 nt, Homo sapiens
gcaacgaccucaaguccau

SEQ ID NO: 332798 - RNA, 19 nt, Homo sapiens
agagugaaauggcacgaua

SEQ ID NO: 332799 - RNA, 19 nt, Homo sapiens
caaggaagagucugaagaa

SEQ ID NO: 332800 - RNA, 19 nt, Homo sapiens
gaggagacccgacucaguu

SEQ ID NO: 332801 - RNA, 19 nt, Homo sapiens
agaaggaggugaaggugaa

SEQ ID NO: 332802 - RNA, 19 nt, Homo sapiens
ugaaauggcacgauaccua

SEQ ID NO: 332803 - RNA, 19 nt, Homo sapiens
gcugaggaaugguucaaga

SEQ ID NO: 332804 - RNA, 19 nt, Homo sapiens
gcaccgcacgcucagcuua

SEQ ID NO: 332805 - RNA, 19 nt, Homo sapiens
ggaacaagcagcuaagaag

SEQ ID NO: 332806 - RNA, 19 nt, Homo sapiens
acaagcagcuaagaagaaa

SEQ ID NO: 332807 - RNA, 19 nt, Homo sapiens
gaagaaagugcacgaagag

SEQ ID NO: 332808 - RNA, 19 nt, Homo sapiens
ccaagacccuggaaaucga

SEQ ID NO: 332809 - RNA, 19 nt, Homo sapiens
cagcuaagaagaaagauug

SEQ ID NO: 332810 - RNA, 19 nt, Homo sapiens
gaccagcuccuaucugaug

SEQ ID NO: 332811 - RNA, 19 nt, Homo sapiens
gugaagauggcuuuggaua

SEQ ID NO: 332812 - RNA, 19 nt, Homo sapiens
gcaggacacgaucaacaaa

SEQ ID NO: 332813 - RNA, 19 nt, Homo sapiens
caaggaagaggccgaggaa

SEQ ID NO: 332814 - RNA, 19 nt, Homo sapiens
gaucguugaugcccagucu

SEQ ID NO: 332815 - RNA, 19 nt, Homo sapiens
cacgauaccuaaaagaaua

SEQ ID NO: 332816 - RNA, 19 nt, Homo sapiens
aggacacgaucaacaaauu

SEQ ID NO: 332817 - RNA, 19 nt, Homo sapiens
gcagaacaagguccuggaa

SEQ ID NO: 332818 - RNA, 19 nt, Homo sapiens
gggaggaacaagcagcuaa

SEQ ID NO: 332819 - RNA, 19 nt, Homo sapiens
ggaagaggaggcagcugaa

SEQ ID NO: 332820 - RNA, 19 nt, Homo sapiens
gaaguggaggaaaccauug

SEQ ID NO: 332821 - RNA, 19 nt, Homo sapiens
ccagagcucccaggucuuu

SEQ ID NO: 332822 - RNA, 19 nt, Homo sapiens
ugaaugaagcgcuggagaa

SEQ ID NO: 332823 - RNA, 19 nt, Homo sapiens
agaaggagaggaaaccaaa

SEQ ID NO: 332824 - RNA, 19 nt, Homo sapiens
ccaaggaagagucugaaga

SEQ ID NO: 332825 - RNA, 19 nt, Homo sapiens
ggaagaggccgaggaagag

SEQ ID NO: 332826 - RNA, 19 nt, Homo sapiens
ugcaggagcuggaggacaa

SEQ ID NO: 332827 - RNA, 19 nt, Homo sapiens
ggaaaccaaagaagcugaa

SEQ ID NO: 332828 - RNA, 19 nt, Homo sapiens
cgaaguggaggaaaccauu

SEQ ID NO: 332829 - RNA, 19 nt, Homo sapiens
gcagcuaagaagaaagauu

SEQ ID NO: 332830 - RNA, 19 nt, Homo sapiens
gaaugaagcgcuggagaag

SEQ ID NO: 332831 - RNA, 19 nt, Homo sapiens
ugaccaagcccgaccuuuc

SEQ ID NO: 332832 - RNA, 19 nt, Homo sapiens
ggcuuuggauauugagauu

SEQ ID NO: 332833 - RNA, 19 nt, Homo sapiens
ugaagauggcuuuggauau

SEQ ID NO: 332834 - RNA, 19 nt, Homo sapiens
ggaggagaaggacaaggaa

SEQ ID NO: 332835 - RNA, 19 nt, Homo sapiens
ggagaggaaaccaaagaag

SEQ ID NO: 332836 - RNA, 19 nt, Homo sapiens
agaagaagaaggaggugaa

SEQ ID NO: 332837 - RNA, 19 nt, Homo sapiens
gaccacaaagagugaaaug

SEQ ID NO: 332838 - RNA, 19 nt, Homo sapiens
augaagcgcuggagaagca

SEQ ID NO: 332839 - RNA, 19 nt, Homo sapiens
aagaggagaucgccgaacu

SEQ ID NO: 332840 - RNA, 19 nt, Homo sapiens
gcugauggaacgccgcaaa

SEQ ID NO: 332841 - RNA, 19 nt, Homo sapiens
agauggcuuuggauauuga

SEQ ID NO: 332842 - RNA, 19 nt, Homo sapiens
aagauggcuuuggauauug

SEQ ID NO: 332843 - RNA, 19 nt, Homo sapiens
gaagaagaaggaggugaag

SEQ ID NO: 332844 - RNA, 19 nt, Homo sapiens
aggaagaggccgaggaaga

SEQ ID NO: 332845 - RNA, 19 nt, Homo sapiens
caccagccauguccaagag

SEQ ID NO: 332846 - RNA, 19 nt, Homo sapiens
gaggaacaagcagcuaaga

SEQ ID NO: 332847 - RNA, 19 nt, Homo sapiens
aggugaaggugaagaagga

SEQ ID NO: 332848 - RNA, 19 nt, Homo sapiens
ugaagaagcaaaagaagaa

SEQ ID NO: 332849 - RNA, 19 nt, Homo sapiens
gcuccuucccguccuacua

SEQ ID NO: 332850 - RNA, 19 nt, Homo sapiens
aagcagcuaagaagaaaga

SEQ ID NO: 332851 - RNA, 19 nt, Homo sapiens
gagacccgacucaguuuca

SEQ ID NO: 332852 - RNA, 19 nt, Homo sapiens
gacacgaucaacaaauuag

SEQ ID NO: 332853 - RNA, 19 nt, Homo sapiens
aacaagcagcuaagaagaa

SEQ ID NO: 332854 - RNA, 19 nt, Homo sapiens
ggaggaacaagcagcuaag

SEQ ID NO: 332855 - RNA, 19 nt, Homo sapiens
cggaagaugccaccaccaa

SEQ ID NO: 332856 - RNA, 19 nt, Homo sapiens
uuacagaccagcuccuauc

SEQ ID NO: 332857 - RNA, 19 nt, Homo sapiens
uuacaggaaacucuuggaa

SEQ ID NO: 332858 - RNA, 19 nt, Homo sapiens
aaggagaggaaaccaaaga

SEQ ID NO: 332859 - RNA, 19 nt, Homo sapiens
gaaggagaggaaaccaaag

SEQ ID NO: 332860 - RNA, 19 nt, Homo sapiens
agaagaaggaggugaaggu

SEQ ID NO: 332861 - RNA, 19 nt, Homo sapiens
ggagaaggacaaggaagag

SEQ ID NO: 332862 - RNA, 19 nt, Homo sapiens
accaagaccuccucaacgu

SEQ ID NO: 332863 - RNA, 19 nt, Homo sapiens
aagaagcugccaaggaaga

SEQ ID NO: 332864 - RNA, 19 nt, Homo sapiens
cugaggaagccaaggauga

SEQ ID NO: 332865 - RNA, 19 nt, Homo sapiens
gcacgauaccuaaaagaau

SEQ ID NO: 332866 - RNA, 19 nt, Homo sapiens
cacgaucaacaaauuagaa

SEQ ID NO: 332867 - RNA, 19 nt, Homo sapiens
caucagcaacgaccucaag

SEQ ID NO: 332868 - RNA, 19 nt, Homo sapiens
gaagaaggagaggaaacca

SEQ ID NO: 332869 - RNA, 19 nt, Homo sapiens
aaaagaagaagaagaagga

SEQ ID NO: 332870 - RNA, 19 nt, Homo sapiens
aggaagaagcugccaagga

SEQ ID NO: 332871 - RNA, 19 nt, Homo sapiens
gaagaggaggcagcugaag

SEQ ID NO: 332872 - RNA, 19 nt, Homo sapiens
ugauggacgaaaucucuuu

SEQ ID NO: 332873 - RNA, 19 nt, Homo sapiens
caccagcgugggaagcaua

SEQ ID NO: 332874 - RNA, 19 nt, Homo sapiens
ggccaagacccuggaaauc

SEQ ID NO: 332875 - RNA, 19 nt, Homo sapiens
aagaggaggcagcugaaga

SEQ ID NO: 332876 - RNA, 19 nt, Homo sapiens
ccgaggaggaggagaagga

SEQ ID NO: 332877 - RNA, 19 nt, Homo sapiens
ccaggucuuuggccgaucu

SEQ ID NO: 332878 - RNA, 19 nt, Homo sapiens
cgaggagacccgacucagu

SEQ ID NO: 332879 - RNA, 19 nt, Homo sapiens
acagcuugauggacgaaau

SEQ ID NO: 332880 - RNA, 19 nt, Homo sapiens
gccaagacccuggaaaucg

SEQ ID NO: 332881 - RNA, 19 nt, Homo sapiens
aaaccaaagaagcugaaga

SEQ ID NO: 332882 - RNA, 19 nt, Homo sapiens
ggagacccgacucaguuuc

SEQ ID NO: 332883 - RNA, 19 nt, Homo sapiens
acgugaagauggcuuugga

SEQ ID NO: 332884 - RNA, 19 nt, Homo sapiens
ugaggaccacaaagaguga

SEQ ID NO: 332885 - RNA, 19 nt, Homo sapiens
ggaaagaacuugacuaugg

SEQ ID NO: 332886 - RNA, 19 nt, Homo sapiens
gaagagugauggcaagaua

SEQ ID NO: 332887 - RNA, 19 nt, Homo sapiens
gagaagagggcgacaauua

SEQ ID NO: 332888 - RNA, 19 nt, Homo sapiens
guucaaaucuguuagcuuu

SEQ ID NO: 332889 - RNA, 19 nt, Homo sapiens
caugacaucuugcuuauaa

SEQ ID NO: 332890 - RNA, 19 nt, Homo sapiens
gaaaggcaauacuuagaug

SEQ ID NO: 332891 - RNA, 19 nt, Homo sapiens
gcaauuuggucauuaauac

SEQ ID NO: 332892 - RNA, 19 nt, Homo sapiens
agagucagcucacaucuaa

SEQ ID NO: 332893 - RNA, 19 nt, Homo sapiens
aaacaucguucguuacuau

SEQ ID NO: 332894 - RNA, 19 nt, Homo sapiens
ugggcuagcuagaauauua

SEQ ID NO: 332895 - RNA, 19 nt, Homo sapiens
caaggaaaggcaauacuua

SEQ ID NO: 332896 - RNA, 19 nt, Homo sapiens
ugagugagcugaaacugaa

SEQ ID NO: 332897 - RNA, 19 nt, Homo sapiens
ggaucuggcuaguguaauu

SEQ ID NO: 332898 - RNA, 19 nt, Homo sapiens
gcucaagcccugucagaua

SEQ ID NO: 332899 - RNA, 19 nt, Homo sapiens
gaugcaauuuggucauuaa

SEQ ID NO: 332900 - RNA, 19 nt, Homo sapiens
ugaguuaugugcauuaaug

SEQ ID NO: 332901 - RNA, 19 nt, Homo sapiens
caaacuggcuagagcagaa

SEQ ID NO: 332902 - RNA, 19 nt, Homo sapiens
gaacugaaacauccaaaca

SEQ ID NO: 332903 - RNA, 19 nt, Homo sapiens
uuacaugucuccugaacaa

SEQ ID NO: 332904 - RNA, 19 nt, Homo sapiens
gaaagaacucgcugggaaa

SEQ ID NO: 332905 - RNA, 19 nt, Homo sapiens
gaacaaaugaaucgcaugu

SEQ ID NO: 332906 - RNA, 19 nt, Homo sapiens
cacaugauauuucggaauu

SEQ ID NO: 332907 - RNA, 19 nt, Homo sapiens
ccaguuagaugcaauuugg

SEQ ID NO: 332908 - RNA, 19 nt, Homo sapiens
caaaugcuguaguguugaa

SEQ ID NO: 332909 - RNA, 19 nt, Homo sapiens
gaaaguaaagagaacauca

SEQ ID NO: 332910 - RNA, 19 nt, Homo sapiens
gcaaggaccugaagaaaag

SEQ ID NO: 332911 - RNA, 19 nt, Homo sapiens
ugagaacccuuuaauagca

SEQ ID NO: 332912 - RNA, 19 nt, Homo sapiens
gaaauuauuacgaggaugu

SEQ ID NO: 332913 - RNA, 19 nt, Homo sapiens
gagcugaaacugaaggaaa

SEQ ID NO: 332914 - RNA, 19 nt, Homo sapiens
gaaccaaggaaaggcaaua

SEQ ID NO: 332915 - RNA, 19 nt, Homo sapiens
ggcaugcgcuagccaggua

SEQ ID NO: 332916 - RNA, 19 nt, Homo sapiens
uuacgaggauguuaaacuu

SEQ ID NO: 332917 - RNA, 19 nt, Homo sapiens
uuaauaccaugacaucuug

SEQ ID NO: 332918 - RNA, 19 nt, Homo sapiens
cagaagauccggaggaaga

SEQ ID NO: 332919 - RNA, 19 nt, Homo sapiens
ugacugagugguaugcuua

SEQ ID NO: 332920 - RNA, 19 nt, Homo sapiens
aaucuuccauccucaguaa

SEQ ID NO: 332921 - RNA, 19 nt, Homo sapiens
uggcacaccuuauuacaug

SEQ ID NO: 332922 - RNA, 19 nt, Homo sapiens
ggaaaggcaauacuuagau

SEQ ID NO: 332923 - RNA, 19 nt, Homo sapiens
gaauaugagcugucuguca

SEQ ID NO: 332924 - RNA, 19 nt, Homo sapiens
ugaggacuaugaaguguug

SEQ ID NO: 332925 - RNA, 19 nt, Homo sapiens
gcaagauauuaguuuggaa

SEQ ID NO: 332926 - RNA, 19 nt, Homo sapiens
gcuguaguguugaauacuu

SEQ ID NO: 332927 - RNA, 19 nt, Homo sapiens
ccucaguaauuaagaagaa

SEQ ID NO: 332928 - RNA, 19 nt, Homo sapiens
cgucaagcuuggagacuuu

SEQ ID NO: 332929 - RNA, 19 nt, Homo sapiens
gacagaagcugagaaacag

SEQ ID NO: 332930 - RNA, 19 nt, Homo sapiens
caauugucaugucuagauu

SEQ ID NO: 332931 - RNA, 19 nt, Homo sapiens
ugacagaagcugagaaaca

SEQ ID NO: 332932 - RNA, 19 nt, Homo sapiens
uuaaaugacugagugguau

SEQ ID NO: 332933 - RNA, 19 nt, Homo sapiens
caaagcaagagaagaaaga

SEQ ID NO: 332934 - RNA, 19 nt, Homo sapiens
ccaucgaccuucuguugaa

SEQ ID NO: 332935 - RNA, 19 nt, Homo sapiens
ggcaauacuuagaugaaga

SEQ ID NO: 332936 - RNA, 19 nt, Homo sapiens
guaauggaauauugugaag

SEQ ID NO: 332937 - RNA, 19 nt, Homo sapiens
guaaagagaacaucaugag

SEQ ID NO: 332938 - RNA, 19 nt, Homo sapiens
gaauuugcuucgugaacug

SEQ ID NO: 332939 - RNA, 19 nt, Homo sapiens
ggcaagauauuaguuugga

SEQ ID NO: 332940 - RNA, 19 nt, Homo sapiens
agccaugccuuucuguaua

SEQ ID NO: 332941 - RNA, 19 nt, Homo sapiens
gaaggaaauucaguuacag

SEQ ID NO: 332942 - RNA, 19 nt, Homo sapiens
ccguuacucugaugaauug

SEQ ID NO: 332943 - RNA, 19 nt, Homo sapiens
gauggcaagauauuaguuu

SEQ ID NO: 332944 - RNA, 19 nt, Homo sapiens
aauauuccauugcucugua

SEQ ID NO: 332945 - RNA, 19 nt, Homo sapiens
gagacuagcagaggacaaa

SEQ ID NO: 332946 - RNA, 19 nt, Homo sapiens
gagagaagagggcgacaau

SEQ ID NO: 332947 - RNA, 19 nt, Homo sapiens
gaucuggcuaguguaauua

SEQ ID NO: 332948 - RNA, 19 nt, Homo sapiens
auccaaacaucguucguua

SEQ ID NO: 332949 - RNA, 19 nt, Homo sapiens
ccauugcucuguaguucaa

SEQ ID NO: 332950 - RNA, 19 nt, Homo sapiens
gagagucagcucacaucua

SEQ ID NO: 332951 - RNA, 19 nt, Homo sapiens
aauggaauauugugaagga

SEQ ID NO: 332952 - RNA, 19 nt, Homo sapiens
ucauuuaccuacuucuuuc

SEQ ID NO: 332953 - RNA, 19 nt, Homo sapiens
uaccaugacaucuugcuua

SEQ ID NO: 332954 - RNA, 19 nt, Homo sapiens
gugguaugcuuacaauugu

SEQ ID NO: 332955 - RNA, 19 nt, Homo sapiens
aaucagagaaggcaaauuc

SEQ ID NO: 332956 - RNA, 19 nt, Homo sapiens
caaacaucguucguuacua

SEQ ID NO: 332957 - RNA, 19 nt, Homo sapiens
ugagugguaugcuuacaau

SEQ ID NO: 332958 - RNA, 19 nt, Homo sapiens
gagccaugccuuucuguau

SEQ ID NO: 332959 - RNA, 19 nt, Homo sapiens
gccagaagauccggaggaa

SEQ ID NO: 332960 - RNA, 19 nt, Homo sapiens
gcugcuugcuguaugaguu

SEQ ID NO: 332961 - RNA, 19 nt, Homo sapiens
cuacuucuuucccacuaaa

SEQ ID NO: 332962 - RNA, 19 nt, Homo sapiens
ccugucagauauugagaaa

SEQ ID NO: 332963 - RNA, 19 nt, Homo sapiens
cauccucaguaauuaagaa

SEQ ID NO: 332964 - RNA, 19 nt, Homo sapiens
gaagagggcgacaauuagg

SEQ ID NO: 332965 - RNA, 19 nt, Homo sapiens
ugaaucgcauguccuacaa

SEQ ID NO: 332966 - RNA, 19 nt, Homo sapiens
gcagaaagaacaggagcuu

SEQ ID NO: 332967 - RNA, 19 nt, Homo sapiens
ccaaggaaaggcaauacuu

SEQ ID NO: 332968 - RNA, 19 nt, Homo sapiens
uagaugcaauuuggucauu

SEQ ID NO: 332969 - RNA, 19 nt, Homo sapiens
uuacaauugucaugucuag

SEQ ID NO: 332970 - RNA, 19 nt, Homo sapiens
cagcaacuauuguacaaaa

SEQ ID NO: 332971 - RNA, 19 nt, Homo sapiens
gauuggagcagaaagaaca

SEQ ID NO: 332972 - RNA, 19 nt, Homo sapiens
uucaaaugcuguaguguug

SEQ ID NO: 332973 - RNA, 19 nt, Homo sapiens
cucaagcccugucagauau

SEQ ID NO: 332974 - RNA, 19 nt, Homo sapiens
aagaaagauuggagcagaa

SEQ ID NO: 332975 - RNA, 19 nt, Homo sapiens
gcagacgagcaaagaagaa

SEQ ID NO: 332976 - RNA, 19 nt, Homo sapiens
cuuccauccucaguaauua

SEQ ID NO: 332977 - RNA, 19 nt, Homo sapiens
cuugagaacccuuuaauag

SEQ ID NO: 332978 - RNA, 19 nt, Homo sapiens
guaugaguuaugugcauua

SEQ ID NO: 332979 - RNA, 19 nt, Homo sapiens
gccaugccuuucuguauag

SEQ ID NO: 332980 - RNA, 19 nt, Homo sapiens
caugacagaagcugagaaa

SEQ ID NO: 332981 - RNA, 19 nt, Homo sapiens
cuuaaaggauuaccaucga

SEQ ID NO: 332982 - RNA, 19 nt, Homo sapiens
aaaugaaucgcauguccua

SEQ ID NO: 332983 - RNA, 19 nt, Homo sapiens
gcugaggacuaugaagugu

SEQ ID NO: 332984 - RNA, 19 nt, Homo sapiens
agacugauauucaaaugcu

SEQ ID NO: 332985 - RNA, 19 nt, Homo sapiens
gaaggacacuuguauauug

SEQ ID NO: 332986 - RNA, 19 nt, Homo sapiens
gaacagaaaugggaugcua

SEQ ID NO: 332987 - RNA, 19 nt, Homo sapiens
gauaucaaguccaagaaua

SEQ ID NO: 332988 - RNA, 19 nt, Homo sapiens
gaaggaggcuguucuuuua

SEQ ID NO: 332989 - RNA, 19 nt, Homo sapiens
ccuaaagguuugagaauua

SEQ ID NO: 332990 - RNA, 19 nt, Homo sapiens
gaaauuacuuaaccucuuc

SEQ ID NO: 332991 - RNA, 19 nt, Homo sapiens
ccaauuuccucaaccauaa

SEQ ID NO: 332992 - RNA, 19 nt, Homo sapiens
gauaaugccugaggaaaug

SEQ ID NO: 332993 - RNA, 19 nt, Homo sapiens
gggaaaaccugccuuauaa

SEQ ID NO: 332994 - RNA, 19 nt, Homo sapiens
ggaauauggugaggaagua

SEQ ID NO: 332995 - RNA, 19 nt, Homo sapiens
uaugaacucuguacccuua

SEQ ID NO: 332996 - RNA, 19 nt, Homo sapiens
ggaaauuacuuaaccucuu

SEQ ID NO: 332997 - RNA, 19 nt, Homo sapiens
caauuucccucaauguuaa

SEQ ID NO: 332998 - RNA, 19 nt, Homo sapiens
gaaagugcauugagaagag

SEQ ID NO: 332999 - RNA, 19 nt, Homo sapiens
gaaauaaggcuucccaagu

SEQ ID NO: 333000 - RNA, 19 nt, Homo sapiens
cgauagaggugguucugua

SEQ ID NO: 333001 - RNA, 19 nt, Homo sapiens
gaaagccaguucaccaaau

SEQ ID NO: 333002 - RNA, 19 nt, Homo sapiens
gcagaaaggaaaguuauuu

SEQ ID NO: 333003 - RNA, 19 nt, Homo sapiens
uagaggugguucuguaaua

SEQ ID NO: 333004 - RNA, 19 nt, Homo sapiens
gggagaagguauaguggaa

SEQ ID NO: 333005 - RNA, 19 nt, Homo sapiens
gaggaaguauuagaagaaa

SEQ ID NO: 333006 - RNA, 19 nt, Homo sapiens
gagaagguauaguggaaug

SEQ ID NO: 333007 - RNA, 19 nt, Homo sapiens
auacucaccuccaguuuaa

SEQ ID NO: 333008 - RNA, 19 nt, Homo sapiens
gaaaaugcauccauacuca

SEQ ID NO: 333009 - RNA, 19 nt, Homo sapiens
caggauagcuuugggaaau

SEQ ID NO: 333010 - RNA, 19 nt, Homo sapiens
guaaaucacauucacaaga

SEQ ID NO: 333011 - RNA, 19 nt, Homo sapiens
cugaagacaugauacuuaa

SEQ ID NO: 333012 - RNA, 19 nt, Homo sapiens
ggacacuuguauauuguga

SEQ ID NO: 333013 - RNA, 19 nt, Homo sapiens
gaaaggguagccauacuga

SEQ ID NO: 333014 - RNA, 19 nt, Homo sapiens
gauagaaaggguagccaua

SEQ ID NO: 333015 - RNA, 19 nt, Homo sapiens
aaaccugccuuauaacaau

SEQ ID NO: 333016 - RNA, 19 nt, Homo sapiens
gaaauugggagacuuugga

SEQ ID NO: 333017 - RNA, 19 nt, Homo sapiens
aaauaaggcuucccaaguc

SEQ ID NO: 333018 - RNA, 19 nt, Homo sapiens
gagggaugcugaccacaga

SEQ ID NO: 333019 - RNA, 19 nt, Homo sapiens
acaauuucccucaauguua

SEQ ID NO: 333020 - RNA, 19 nt, Homo sapiens
caaaugugccuuggaguaa

SEQ ID NO: 333021 - RNA, 19 nt, Homo sapiens
ggauagcuuugggaaauga

SEQ ID NO: 333022 - RNA, 19 nt, Homo sapiens
caugaaagcaguaaucaga

SEQ ID NO: 333023 - RNA, 19 nt, Homo sapiens
ugaaacacccuaauauugu

SEQ ID NO: 333024 - RNA, 19 nt, Homo sapiens
ugauuaguaucgugaguuu

SEQ ID NO: 333025 - RNA, 19 nt, Homo sapiens
ggaaagccaguucaccaaa

SEQ ID NO: 333026 - RNA, 19 nt, Homo sapiens
acagagauaucaaguccaa

SEQ ID NO: 333027 - RNA, 19 nt, Homo sapiens
ucagauguuugccaugaaa

SEQ ID NO: 333028 - RNA, 19 nt, Homo sapiens
ugaaagcaguaaucagaug

SEQ ID NO: 333029 - RNA, 19 nt, Homo sapiens
cauggaauauggugaggaa

SEQ ID NO: 333030 - RNA, 19 nt, Homo sapiens
ugugggaacuccuuauuau

SEQ ID NO: 333031 - RNA, 19 nt, Homo sapiens
gaggaaacucuuaauacuu

SEQ ID NO: 333032 - RNA, 19 nt, Homo sapiens
gauagaggugguucuguaa

SEQ ID NO: 333033 - RNA, 19 nt, Homo sapiens
gcaagaggaagaacaagau

SEQ ID NO: 333034 - RNA, 19 nt, Homo sapiens
ggcauuugcuuguaccuau

SEQ ID NO: 333035 - RNA, 19 nt, Homo sapiens
ccugaagacaugauacuua

SEQ ID NO: 333036 - RNA, 19 nt, Homo sapiens
aaucagauguuugccauga

SEQ ID NO: 333037 - RNA, 19 nt, Homo sapiens
gugguucuguaauaaagua

SEQ ID NO: 333038 - RNA, 19 nt, Homo sapiens
caagaggaagaacaagaua

SEQ ID NO: 333039 - RNA, 19 nt, Homo sapiens
gaacucaagggagaaggua

SEQ ID NO: 333040 - RNA, 19 nt, Homo sapiens
ggaagaacaagauagaaag

SEQ ID NO: 333041 - RNA, 19 nt, Homo sapiens
gugaggaaguauuagaaga

SEQ ID NO: 333042 - RNA, 19 nt, Homo sapiens
uuaugugccuccagaaauu

SEQ ID NO: 333043 - RNA, 19 nt, Homo sapiens
ccaagucuuucucuaauac

SEQ ID NO: 333044 - RNA, 19 nt, Homo sapiens
cauacucaccuccaguuua

SEQ ID NO: 333045 - RNA, 19 nt, Homo sapiens
gagaagaguaaacagagaa

SEQ ID NO: 333046 - RNA, 19 nt, Homo sapiens
uuaaacagcagaaaggaaa

SEQ ID NO: 333047 - RNA, 19 nt, Homo sapiens
gauugugggaaauuacuua

SEQ ID NO: 333048 - RNA, 19 nt, Homo sapiens
caagggagaagguauagug

SEQ ID NO: 333049 - RNA, 19 nt, Homo sapiens
guucaugcgacguauauuu

SEQ ID NO: 333050 - RNA, 19 nt, Homo sapiens
agaggugguucuguaauaa

SEQ ID NO: 333051 - RNA, 19 nt, Homo sapiens
aagcauaacacaccaagaa

SEQ ID NO: 333052 - RNA, 19 nt, Homo sapiens
uagcucggcuuguccagaa

SEQ ID NO: 333053 - RNA, 19 nt, Homo sapiens
gaguaaaucacauucacaa

SEQ ID NO: 333054 - RNA, 19 nt, Homo sapiens
guuauuuccugaagacaug

SEQ ID NO: 333055 - RNA, 19 nt, Homo sapiens
ggaaggaggcuguucuuuu

SEQ ID NO: 333056 - RNA, 19 nt, Homo sapiens
ugagaagaguaaacagaga

SEQ ID NO: 333057 - RNA, 19 nt, Homo sapiens
ccgagaucaucauggaaua

SEQ ID NO: 333058 - RNA, 19 nt, Homo sapiens
gggaacuccuuauuaugug

SEQ ID NO: 333059 - RNA, 19 nt, Homo sapiens
gcugaaggacacuuguaua

SEQ ID NO: 333060 - RNA, 19 nt, Homo sapiens
ggacaauuucccucaaugu

SEQ ID NO: 333061 - RNA, 19 nt, Homo sapiens
gcagucccauagaacagaa

SEQ ID NO: 333062 - RNA, 19 nt, Homo sapiens
ggucacgauucugucauuu

SEQ ID NO: 333063 - RNA, 19 nt, Homo sapiens
gaggggaucuaaugcaaaa

SEQ ID NO: 333064 - RNA, 19 nt, Homo sapiens
gcagagcucuuuugguuca

SEQ ID NO: 333065 - RNA, 19 nt, Homo sapiens
cccaagucuuucucuaaua

SEQ ID NO: 333066 - RNA, 19 nt, Homo sapiens
gacaauuucccucaauguu

SEQ ID NO: 333067 - RNA, 19 nt, Homo sapiens
gaaagcaguaaucagaugu

SEQ ID NO: 333068 - RNA, 19 nt, Homo sapiens
uaauaaugccuaccucaga

SEQ ID NO: 333069 - RNA, 19 nt, Homo sapiens
cggcagagcucuuuugguu

SEQ ID NO: 333070 - RNA, 19 nt, Homo sapiens
gcuuugcagucccauagaa

SEQ ID NO: 333071 - RNA, 19 nt, Homo sapiens
gcaguaaucagauguuugc

SEQ ID NO: 333072 - RNA, 19 nt, Homo sapiens
gucuagaacuccuguaagu

SEQ ID NO: 333073 - RNA, 19 nt, Homo sapiens
cgacguauauuuuccuuug

SEQ ID NO: 333074 - RNA, 19 nt, Homo sapiens
gcagaaucaggauagcuuu

SEQ ID NO: 333075 - RNA, 19 nt, Homo sapiens
caucguagcucggcuuguc

SEQ ID NO: 333076 - RNA, 19 nt, Homo sapiens
acacuuguauauugugaug

SEQ ID NO: 333077 - RNA, 19 nt, Homo sapiens
gauggaauacugugaugga

SEQ ID NO: 333078 - RNA, 19 nt, Homo sapiens
guaagcaguggcucaaaga

SEQ ID NO: 333079 - RNA, 19 nt, Homo sapiens
gcucuuacagcuuuggaaa

SEQ ID NO: 333080 - RNA, 19 nt, Homo sapiens
guccacugccgucucauua

SEQ ID NO: 333081 - RNA, 19 nt, Homo sapiens
gcauuugcuuguaccuaug

SEQ ID NO: 333082 - RNA, 19 nt, Homo sapiens
cacuuaaccugcagacaga

SEQ ID NO: 333083 - RNA, 19 nt, Homo sapiens
ugaaggacacuuguauauu

SEQ ID NO: 333084 - RNA, 19 nt, Homo sapiens
gaaugaagcagaggaaacu

SEQ ID NO: 333085 - RNA, 19 nt, Homo sapiens
gaaggacacuuguauauug

SEQ ID NO: 333086 - RNA, 19 nt, Homo sapiens
gaacagaaaugggaugcua

SEQ ID NO: 333087 - RNA, 19 nt, Homo sapiens
gauaucaaguccaagaaua

SEQ ID NO: 333088 - RNA, 19 nt, Homo sapiens
gaaggaggcuguucuuuua

SEQ ID NO: 333089 - RNA, 19 nt, Homo sapiens
ccuaaagguuugagaauua

SEQ ID NO: 333090 - RNA, 19 nt, Homo sapiens
gaaauuacuuaaccucuuc

SEQ ID NO: 333091 - RNA, 19 nt, Homo sapiens
ccaauuuccucaaccauaa

SEQ ID NO: 333092 - RNA, 19 nt, Homo sapiens
gauaaugccugaggaaaug

SEQ ID NO: 333093 - RNA, 19 nt, Homo sapiens
gggaaaaccugccuuauaa

SEQ ID NO: 333094 - RNA, 19 nt, Homo sapiens
ggaauauggugaggaagua

SEQ ID NO: 333095 - RNA, 19 nt, Homo sapiens
uaugaacucuguacccuua

SEQ ID NO: 333096 - RNA, 19 nt, Homo sapiens
ggaaauuacuuaaccucuu

SEQ ID NO: 333097 - RNA, 19 nt, Homo sapiens
gaaagugcauugagaagag

SEQ ID NO: 333098 - RNA, 19 nt, Homo sapiens
gaaauaaggcuucccaagu

SEQ ID NO: 333099 - RNA, 19 nt, Homo sapiens
cgauagaggugguucugua

SEQ ID NO: 333100 - RNA, 19 nt, Homo sapiens
gaaagccaguucaccaaau

SEQ ID NO: 333101 - RNA, 19 nt, Homo sapiens
gcagaaaggaaaguuauuu

SEQ ID NO: 333102 - RNA, 19 nt, Homo sapiens
uagaggugguucuguaaua

SEQ ID NO: 333103 - RNA, 19 nt, Homo sapiens
gggagaagguauaguggaa

SEQ ID NO: 333104 - RNA, 19 nt, Homo sapiens
gaggaaguauuagaagaaa

SEQ ID NO: 333105 - RNA, 19 nt, Homo sapiens
gagaagguauaguggaaug

SEQ ID NO: 333106 - RNA, 19 nt, Homo sapiens
auacucaccuccaguuuaa

SEQ ID NO: 333107 - RNA, 19 nt, Homo sapiens
gaaaaugcauccauacuca

SEQ ID NO: 333108 - RNA, 19 nt, Homo sapiens
caggauagcuuugggaaau

SEQ ID NO: 333109 - RNA, 19 nt, Homo sapiens
guaaaucacauucacaaga

SEQ ID NO: 333110 - RNA, 19 nt, Homo sapiens
cugaagacaugauacuuaa

SEQ ID NO: 333111 - RNA, 19 nt, Homo sapiens
ggacacuuguauauuguga

SEQ ID NO: 333112 - RNA, 19 nt, Homo sapiens
gaaaggguagccauacuga

SEQ ID NO: 333113 - RNA, 19 nt, Homo sapiens
gauagaaaggguagccaua

SEQ ID NO: 333114 - RNA, 19 nt, Homo sapiens
aaaccugccuuauaacaau

SEQ ID NO: 333115 - RNA, 19 nt, Homo sapiens
gaaauugggagacuuugga

SEQ ID NO: 333116 - RNA, 19 nt, Homo sapiens
aaauaaggcuucccaaguc

SEQ ID NO: 333117 - RNA, 19 nt, Homo sapiens
gagggaugcugaccacaga

SEQ ID NO: 333118 - RNA, 19 nt, Homo sapiens
caaaugugccuuggaguaa

SEQ ID NO: 333119 - RNA, 19 nt, Homo sapiens
ggauagcuuugggaaauga

SEQ ID NO: 333120 - RNA, 19 nt, Homo sapiens
caugaaagcaguaaucaga

SEQ ID NO: 333121 - RNA, 19 nt, Homo sapiens
ugaaacacccuaauauugu

SEQ ID NO: 333122 - RNA, 19 nt, Homo sapiens
ugauuaguaucgugaguuu

SEQ ID NO: 333123 - RNA, 19 nt, Homo sapiens
ggaaagccaguucaccaaa

SEQ ID NO: 333124 - RNA, 19 nt, Homo sapiens
acagagauaucaaguccaa

SEQ ID NO: 333125 - RNA, 19 nt, Homo sapiens
ucagauguuugccaugaaa

SEQ ID NO: 333126 - RNA, 19 nt, Homo sapiens
ugaaagcaguaaucagaug

SEQ ID NO: 333127 - RNA, 19 nt, Homo sapiens
cauggaauauggugaggaa

SEQ ID NO: 333128 - RNA, 19 nt, Homo sapiens
ugugggaacuccuuauuau

SEQ ID NO: 333129 - RNA, 19 nt, Homo sapiens
gaggaaacucuuaauacuu

SEQ ID NO: 333130 - RNA, 19 nt, Homo sapiens
gauagaggugguucuguaa

SEQ ID NO: 333131 - RNA, 19 nt, Homo sapiens
gcaagaggaagaacaagau

SEQ ID NO: 333132 - RNA, 19 nt, Homo sapiens
ggcauuugcuuguaccuau

SEQ ID NO: 333133 - RNA, 19 nt, Homo sapiens
ccugaagacaugauacuua

SEQ ID NO: 333134 - RNA, 19 nt, Homo sapiens
aaucagauguuugccauga

SEQ ID NO: 333135 - RNA, 19 nt, Homo sapiens
gugguucuguaauaaagua

SEQ ID NO: 333136 - RNA, 19 nt, Homo sapiens
caagaggaagaacaagaua

SEQ ID NO: 333137 - RNA, 19 nt, Homo sapiens
gaacucaagggagaaggua

SEQ ID NO: 333138 - RNA, 19 nt, Homo sapiens
ggaagaacaagauagaaag

SEQ ID NO: 333139 - RNA, 19 nt, Homo sapiens
gugaggaaguauuagaaga

SEQ ID NO: 333140 - RNA, 19 nt, Homo sapiens
uuaugugccuccagaaauu

SEQ ID NO: 333141 - RNA, 19 nt, Homo sapiens
ccaagucuuucucuaauac

SEQ ID NO: 333142 - RNA, 19 nt, Homo sapiens
cauacucaccuccaguuua

SEQ ID NO: 333143 - RNA, 19 nt, Homo sapiens
gagaagaguaaacagagaa

SEQ ID NO: 333144 - RNA, 19 nt, Homo sapiens
uuaaacagcagaaaggaaa

SEQ ID NO: 333145 - RNA, 19 nt, Homo sapiens
gauugugggaaauuacuua

SEQ ID NO: 333146 - RNA, 19 nt, Homo sapiens
caagggagaagguauagug

SEQ ID NO: 333147 - RNA, 19 nt, Homo sapiens
guucaugcgacguauauuu

SEQ ID NO: 333148 - RNA, 19 nt, Homo sapiens
agaggugguucuguaauaa

SEQ ID NO: 333149 - RNA, 19 nt, Homo sapiens
aagcauaacacaccaagaa

SEQ ID NO: 333150 - RNA, 19 nt, Homo sapiens
uagcucggcuuguccagaa

SEQ ID NO: 333151 - RNA, 19 nt, Homo sapiens
gaguaaaucacauucacaa

SEQ ID NO: 333152 - RNA, 19 nt, Homo sapiens
guuauuuccugaagacaug

SEQ ID NO: 333153 - RNA, 19 nt, Homo sapiens
ggaaggaggcuguucuuuu

SEQ ID NO: 333154 - RNA, 19 nt, Homo sapiens
ugagaagaguaaacagaga

SEQ ID NO: 333155 - RNA, 19 nt, Homo sapiens
ccgagaucaucauggaaua

SEQ ID NO: 333156 - RNA, 19 nt, Homo sapiens
gggaacuccuuauuaugug

SEQ ID NO: 333157 - RNA, 19 nt, Homo sapiens
gcugaaggacacuuguaua

SEQ ID NO: 333158 - RNA, 19 nt, Homo sapiens
gcagucccauagaacagaa

SEQ ID NO: 333159 - RNA, 19 nt, Homo sapiens
ggucacgauucugucauuu

SEQ ID NO: 333160 - RNA, 19 nt, Homo sapiens
gcagagcucuuuugguuca

SEQ ID NO: 333161 - RNA, 19 nt, Homo sapiens
gaaagcaguaaucagaugu

SEQ ID NO: 333162 - RNA, 19 nt, Homo sapiens
gaggggaucuaaugcaaaa

SEQ ID NO: 333163 - RNA, 19 nt, Homo sapiens
cccaagucuuucucuaaua

SEQ ID NO: 333164 - RNA, 19 nt, Homo sapiens
uaauaaugccuaccucaga

SEQ ID NO: 333165 - RNA, 19 nt, Homo sapiens
cggcagagcucuuuugguu

SEQ ID NO: 333166 - RNA, 19 nt, Homo sapiens
gcuuugcagucccauagaa

SEQ ID NO: 333167 - RNA, 19 nt, Homo sapiens
gucuagaacuccuguaagu

SEQ ID NO: 333168 - RNA, 19 nt, Homo sapiens
cgacguauauuuuccuuug

SEQ ID NO: 333169 - RNA, 19 nt, Homo sapiens
gcaguaaucagauguuugc

SEQ ID NO: 333170 - RNA, 19 nt, Homo sapiens
gcagaaucaggauagcuuu

SEQ ID NO: 333171 - RNA, 19 nt, Homo sapiens
caucguagcucggcuuguc

SEQ ID NO: 333172 - RNA, 19 nt, Homo sapiens
acacuuguauauugugaug

SEQ ID NO: 333173 - RNA, 19 nt, Homo sapiens
gauggaauacugugaugga

SEQ ID NO: 333174 - RNA, 19 nt, Homo sapiens
guaagcaguggcucaaaga

SEQ ID NO: 333175 - RNA, 19 nt, Homo sapiens
gcucuuacagcuuuggaaa

SEQ ID NO: 333176 - RNA, 19 nt, Homo sapiens
guccacugccgucucauua

SEQ ID NO: 333177 - RNA, 19 nt, Homo sapiens
gcauuugcuuguaccuaug

SEQ ID NO: 333178 - RNA, 19 nt, Homo sapiens
ugaaggacacuuguauauu

SEQ ID NO: 333179 - RNA, 19 nt, Homo sapiens
gaaugaagcagaggaaacu

SEQ ID NO: 333180 - RNA, 19 nt, Homo sapiens
ggguagccauacugauuug

SEQ ID NO: 333181 - RNA, 19 nt, Homo sapiens
gaaaugaagcaagcacagu

SEQ ID NO: 333182 - RNA, 19 nt, Homo sapiens
ugaggaaguauuagaagaa

SEQ ID NO: 333183 - RNA, 19 nt, Homo sapiens
cagcagaaaggaaaguuau

SEQ ID NO: 333184 - RNA, 19 nt, Homo sapiens
gcugagaugaucaugaguu

SEQ ID NO: 333185 - RNA, 19 nt, Homo sapiens
gcacaggcaugguuacuua

SEQ ID NO: 333186 - RNA, 19 nt, Homo sapiens
caaagaagcuauaacaugu

SEQ ID NO: 333187 - RNA, 19 nt, Homo sapiens
gaaaggacuugcaccauga

SEQ ID NO: 333188 - RNA, 19 nt, Homo sapiens
gaaauaaugcgcauggaua

SEQ ID NO: 333189 - RNA, 19 nt, Homo sapiens
gaucagugcuauugugaaa

SEQ ID NO: 333190 - RNA, 19 nt, Homo sapiens
gcaaagaagcuauaacaug

SEQ ID NO: 333191 - RNA, 19 nt, Homo sapiens
gcaaaucgauaugccaauu

SEQ ID NO: 333192 - RNA, 19 nt, Homo sapiens
aaagauggcuguaggaaug

SEQ ID NO: 333193 - RNA, 19 nt, Homo sapiens
aaugcaagauguccaauua

SEQ ID NO: 333194 - RNA, 19 nt, Homo sapiens
ggacgaaccuacuuugaag

SEQ ID NO: 333195 - RNA, 19 nt, Homo sapiens
ccacuuaaauucaggaguu

SEQ ID NO: 333196 - RNA, 19 nt, Homo sapiens
aaacagacccacuuaaauu

SEQ ID NO: 333197 - RNA, 19 nt, Homo sapiens
gcuaaaugcagcuuuguua

SEQ ID NO: 333198 - RNA, 19 nt, Homo sapiens
gaaugugacccaaggcuua

SEQ ID NO: 333199 - RNA, 19 nt, Homo sapiens
gaguauguguucucuauga

SEQ ID NO: 333200 - RNA, 19 nt, Homo sapiens
caugggagauuucuguuaa

SEQ ID NO: 333201 - RNA, 19 nt, Homo sapiens
gaacagcgaaugaauagau

SEQ ID NO: 333202 - RNA, 19 nt, Homo sapiens
caucagugcuucccauuug

SEQ ID NO: 333203 - RNA, 19 nt, Homo sapiens
ucacagcuguugcaaaguu

SEQ ID NO: 333204 - RNA, 19 nt, Homo sapiens
ggagaaucgugugaagaua

SEQ ID NO: 333205 - RNA, 19 nt, Homo sapiens
gcaaugacaucaccaagac

SEQ ID NO: 333206 - RNA, 19 nt, Homo sapiens
gaaugggcguacaguauau

SEQ ID NO: 333207 - RNA, 19 nt, Homo sapiens
gcccagauguggaguguga

SEQ ID NO: 333208 - RNA, 19 nt, Homo sapiens
gauaaugccuacugugaag

SEQ ID NO: 333209 - RNA, 19 nt, Homo sapiens
cagauaaccuugucucaca

SEQ ID NO: 333210 - RNA, 19 nt, Homo sapiens
gcugagaaauaaacaugaa

SEQ ID NO: 333211 - RNA, 19 nt, Homo sapiens
ggcagugaaugaauuauau

SEQ ID NO: 333212 - RNA, 19 nt, Homo sapiens
caauuuggauggcggauau

SEQ ID NO: 333213 - RNA, 19 nt, Homo sapiens
gcaaggaccagaccaugaa

SEQ ID NO: 333214 - RNA, 19 nt, Homo sapiens
gaauuugaguccuggauag

SEQ ID NO: 333215 - RNA, 19 nt, Homo sapiens
gaagaaugggcguacagua

SEQ ID NO: 333216 - RNA, 19 nt, Homo sapiens
guaaagcaaagaagcuaua

SEQ ID NO: 333217 - RNA, 19 nt, Homo sapiens
gaccagaccaugaaacuug

SEQ ID NO: 333218 - RNA, 19 nt, Homo sapiens
gaugaaugcucugaugguu

SEQ ID NO: 333219 - RNA, 19 nt, Homo sapiens
aauccugacugcccacuua

SEQ ID NO: 333220 - RNA, 19 nt, Homo sapiens
gaacugcacaugccugaau

SEQ ID NO: 333221 - RNA, 19 nt, Homo sapiens
ggaaaagucaucccuauuu

SEQ ID NO: 333222 - RNA, 19 nt, Homo sapiens
gauaccauuugcuucaauu

SEQ ID NO: 333223 - RNA, 19 nt, Homo sapiens
ucauggagcuacaggauau

SEQ ID NO: 333224 - RNA, 19 nt, Homo sapiens
gcucagugcccagaucuua

SEQ ID NO: 333225 - RNA, 19 nt, Homo sapiens
ggaguuauucucucaauuc

SEQ ID NO: 333226 - RNA, 19 nt, Homo sapiens
ccugaacccuggauagaaa

SEQ ID NO: 333227 - RNA, 19 nt, Homo sapiens
ggagauuucuguuaaaaga

SEQ ID NO: 333228 - RNA, 19 nt, Homo sapiens
gagccuguauugccgcuaa

SEQ ID NO: 333229 - RNA, 19 nt, Homo sapiens
uaagucggcucuugcguau

SEQ ID NO: 333230 - RNA, 19 nt, Homo sapiens
ccacuuaagucggcucuug

SEQ ID NO: 333231 - RNA, 19 nt, Homo sapiens
cauggagucucgggucuua

SEQ ID NO: 333232 - RNA, 19 nt, Homo sapiens
gaaaauuacuggggcaaaa

SEQ ID NO: 333233 - RNA, 19 nt, Homo sapiens
ggaaccaccuaccgagaau

SEQ ID NO: 333234 - RNA, 19 nt, Homo sapiens
caggcaugguuacuuaaua

SEQ ID NO: 333235 - RNA, 19 nt, Homo sapiens
guuuguagcugucgagaug

SEQ ID NO: 333236 - RNA, 19 nt, Homo sapiens
guuaauagcugagugaacu

SEQ ID NO: 333237 - RNA, 19 nt, Homo sapiens
gaaguguuuccuuacauuu

SEQ ID NO: 333238 - RNA, 19 nt, Homo sapiens
ugaaauuuguggagcuuga

SEQ ID NO: 333239 - RNA, 19 nt, Homo sapiens
gcacaauggucagauuugg

SEQ ID NO: 333240 - RNA, 19 nt, Homo sapiens
uccagagucucaucagaua

SEQ ID NO: 333241 - RNA, 19 nt, Homo sapiens
ggcaaaugcuguaaggaau

SEQ ID NO: 333242 - RNA, 19 nt, Homo sapiens
aguauaagcucguucuugu

SEQ ID NO: 333243 - RNA, 19 nt, Homo sapiens
uagcuucacuggugcagaa

SEQ ID NO: 333244 - RNA, 19 nt, Homo sapiens
uaagcacaauggucagauu

SEQ ID NO: 333245 - RNA, 19 nt, Homo sapiens
gagaaucgugugaagauau

SEQ ID NO: 333246 - RNA, 19 nt, Homo sapiens
gaauggaggagccuguauu

SEQ ID NO: 333247 - RNA, 19 nt, Homo sapiens
gauacucccagaagcauaa

SEQ ID NO: 333248 - RNA, 19 nt, Homo sapiens
gaucagaaucuucagaauc

SEQ ID NO: 333249 - RNA, 19 nt, Homo sapiens
agacuugccuggacgaaau

SEQ ID NO: 333250 - RNA, 19 nt, Homo sapiens
uggaguauguguucucuau

SEQ ID NO: 333251 - RNA, 19 nt, Homo sapiens
uaaggaaugcaaaucgaua

SEQ ID NO: 333252 - RNA, 19 nt, Homo sapiens
ggaaccauccagugugaaa

SEQ ID NO: 333253 - RNA, 19 nt, Homo sapiens
agaaugggcguacaguaua

SEQ ID NO: 333254 - RNA, 19 nt, Homo sapiens
gcaaagauggcuguaggaa

SEQ ID NO: 333255 - RNA, 19 nt, Homo sapiens
gaauggaacgacaugcaaa

SEQ ID NO: 333256 - RNA, 19 nt, Homo sapiens
gaaaaugcuuuaugcuuca

SEQ ID NO: 333257 - RNA, 19 nt, Homo sapiens
ucucacagcuguugcaaag

SEQ ID NO: 333258 - RNA, 19 nt, Homo sapiens
agaaguguuuccuuacauu

SEQ ID NO: 333259 - RNA, 19 nt, Homo sapiens
gaguuauucucucaauuca

SEQ ID NO: 333260 - RNA, 19 nt, Homo sapiens
acucuaaucugcccaaauc

SEQ ID NO: 333261 - RNA, 19 nt, Homo sapiens
gauguccaauuacuuguca

SEQ ID NO: 333262 - RNA, 19 nt, Homo sapiens
gcucaugucagaauggauu

SEQ ID NO: 333263 - RNA, 19 nt, Homo sapiens
agaaucgugugaagauauu

SEQ ID NO: 333264 - RNA, 19 nt, Homo sapiens
ugcuacagcugaacaguuu

SEQ ID NO: 333265 - RNA, 19 nt, Homo sapiens
gaaaauacaauguguguca

SEQ ID NO: 333266 - RNA, 19 nt, Homo sapiens
ggauaaugccuacugugaa

SEQ ID NO: 333267 - RNA, 19 nt, Homo sapiens
gagaaagaaauacagucua

SEQ ID NO: 333268 - RNA, 19 nt, Homo sapiens
gcgaaugaauagauuggau

SEQ ID NO: 333269 - RNA, 19 nt, Homo sapiens
ggaauggaacgacaugcaa

SEQ ID NO: 333270 - RNA, 19 nt, Homo sapiens
ucacaaaucagcacaacug

SEQ ID NO: 333271 - RNA, 19 nt, Homo sapiens
ggagaaagaaauacagucu

SEQ ID NO: 333272 - RNA, 19 nt, Homo sapiens
gcaaaugcuguaaggaaug

SEQ ID NO: 333273 - RNA, 19 nt, Homo sapiens
ccuacagauugacgucuua

SEQ ID NO: 333274 - RNA, 19 nt, Homo sapiens
gaaaagcccuccacagacu

SEQ ID NO: 333275 - RNA, 19 nt, Homo sapiens
gugagaaucccacaguuga

SEQ ID NO: 333276 - RNA, 19 nt, Homo sapiens
gcaagauguccaauuacuu

SEQ ID NO: 333277 - RNA, 19 nt, Homo sapiens
ucaccgcccucacacagaa

SEQ ID NO: 333278 - RNA, 19 nt, Homo sapiens
uagaaagccugagcccauu

SEQ ID NO: 333279 - RNA, 19 nt, Homo sapiens
gagaauuccaucugcagaa

SEQ ID NO: 333280 - RNA, 19 nt, Homo sapiens
gcugugaaacggacauuga

SEQ ID NO: 333281 - RNA, 19 nt, Homo sapiens
caugaaacuuguugagagu

SEQ ID NO: 333282 - RNA, 19 nt, Homo sapiens
gauggcaaaugcuguaagg

SEQ ID NO: 333283 - RNA, 19 nt, Homo sapiens
aaucgcaccuguccaacuu

SEQ ID NO: 333284 - RNA, 19 nt, Homo sapiens
guuccucacugcaagaaau

SEQ ID NO: 333285 - RNA, 19 nt, Homo sapiens
gaaacagccuucucccuua

SEQ ID NO: 333286 - RNA, 19 nt, Homo sapiens
gaaacgagcugccugcaaa

SEQ ID NO: 333287 - RNA, 19 nt, Homo sapiens
gaagcagccuacuaauaua

SEQ ID NO: 333288 - RNA, 19 nt, Homo sapiens
cagaugagcugaccaaaga

SEQ ID NO: 333289 - RNA, 19 nt, Homo sapiens
cgaauacacucuaugaauu

SEQ ID NO: 333290 - RNA, 19 nt, Homo sapiens
ucaaguacauggaguauga

SEQ ID NO: 333291 - RNA, 19 nt, Homo sapiens
ggucagagguuacgccauu

SEQ ID NO: 333292 - RNA, 19 nt, Homo sapiens
cgaaaggccucccgaaaga

SEQ ID NO: 333293 - RNA, 19 nt, Homo sapiens
guguacaucuuuagaguua

SEQ ID NO: 333294 - RNA, 19 nt, Homo sapiens
ccggauggaucuuuauuua

SEQ ID NO: 333295 - RNA, 19 nt, Homo sapiens
agaaagcucugaaagauug

SEQ ID NO: 333296 - RNA, 19 nt, Homo sapiens
ggauggaucuuuauuuauc

SEQ ID NO: 333297 - RNA, 19 nt, Homo sapiens
ccacaaggauguuggaaga

SEQ ID NO: 333298 - RNA, 19 nt, Homo sapiens
gagcugaaacccauugaua

SEQ ID NO: 333299 - RNA, 19 nt, Homo sapiens
gaaagugaccuagaugaaa

SEQ ID NO: 333300 - RNA, 19 nt, Homo sapiens
gugaauggcucucauaagu

SEQ ID NO: 333301 - RNA, 19 nt, Homo sapiens
gaagugagaaauucaaaga

SEQ ID NO: 333302 - RNA, 19 nt, Homo sapiens
caagauaucacaccaguug

SEQ ID NO: 333303 - RNA, 19 nt, Homo sapiens
ccucgcaacucucaagaua

SEQ ID NO: 333304 - RNA, 19 nt, Homo sapiens
caaagggaauuccaaagau

SEQ ID NO: 333305 - RNA, 19 nt, Homo sapiens
ggacagcaauauccaucaa

SEQ ID NO: 333306 - RNA, 19 nt, Homo sapiens
gaauggcucucauaaguac

SEQ ID NO: 333307 - RNA, 19 nt, Homo sapiens
gcucacgaaucuauggaua

SEQ ID NO: 333308 - RNA, 19 nt, Homo sapiens
ugaagcagccuacuaauau

SEQ ID NO: 333309 - RNA, 19 nt, Homo sapiens
gauaucagacuugguauuu

SEQ ID NO: 333310 - RNA, 19 nt, Homo sapiens
ggucauaauuguuucuguu

SEQ ID NO: 333311 - RNA, 19 nt, Homo sapiens
cagacugacucaccagaua

SEQ ID NO: 333312 - RNA, 19 nt, Homo sapiens
ggucgaagaucaaguacau

SEQ ID NO: 333313 - RNA, 19 nt, Homo sapiens
ccaucaaaguggacuauaa

SEQ ID NO: 333314 - RNA, 19 nt, Homo sapiens
ggaacauaaucuucaaguu

SEQ ID NO: 333315 - RNA, 19 nt, Homo sapiens
ggacagcacuugagaacac

SEQ ID NO: 333316 - RNA, 19 nt, Homo sapiens
gcaaccacuuugaguuauu

SEQ ID NO: 333317 - RNA, 19 nt, Homo sapiens
gugagaaauucaaagagua

SEQ ID NO: 333318 - RNA, 19 nt, Homo sapiens
gaugaaggguucuaucagu

SEQ ID NO: 333319 - RNA, 19 nt, Homo sapiens
gagguuacgccauugguua

SEQ ID NO: 333320 - RNA, 19 nt, Homo sapiens
aaagcggacuccucugaua

SEQ ID NO: 333321 - RNA, 19 nt, Homo sapiens
gaucccagcucucacuaug

SEQ ID NO: 333322 - RNA, 19 nt, Homo sapiens
gugaugaaguugaauugaa

SEQ ID NO: 333323 - RNA, 19 nt, Homo sapiens
gagagucuuggaacuauua

SEQ ID NO: 333324 - RNA, 19 nt, Homo sapiens
ugaaggaccuaaacgcuau

SEQ ID NO: 333325 - RNA, 19 nt, Homo sapiens
gcagauuacuggcuacaag

SEQ ID NO: 333326 - RNA, 19 nt, Homo sapiens
guggauacacucucaguua

SEQ ID NO: 333327 - RNA, 19 nt, Homo sapiens
ucacgaaucuauggauauu

SEQ ID NO: 333328 - RNA, 19 nt, Homo sapiens
ggugauaucagacuuggua

SEQ ID NO: 333329 - RNA, 19 nt, Homo sapiens
ccagaaccuuccucaguuu

SEQ ID NO: 333330 - RNA, 19 nt, Homo sapiens
caaccacuuugaguuauuu

SEQ ID NO: 333331 - RNA, 19 nt, Homo sapiens
gagacaaccuuaccuacuc

SEQ ID NO: 333332 - RNA, 19 nt, Homo sapiens
guguagacauuggcauuua

SEQ ID NO: 333333 - RNA, 19 nt, Homo sapiens
caaccugcauuucacuuug

SEQ ID NO: 333334 - RNA, 19 nt, Homo sapiens
guacaaagggaauuccaaa

SEQ ID NO: 333335 - RNA, 19 nt, Homo sapiens
guacaucuuuagaguuaug

SEQ ID NO: 333336 - RNA, 19 nt, Homo sapiens
gaacagcgaagcucauagu

SEQ ID NO: 333337 - RNA, 19 nt, Homo sapiens
acaagugguugacauuuga

SEQ ID NO: 333338 - RNA, 19 nt, Homo sapiens
auacaugacuggguuauug

SEQ ID NO: 333339 - RNA, 19 nt, Homo sapiens
ccaaggaugugacuguugu

SEQ ID NO: 333340 - RNA, 19 nt, Homo sapiens
gcaaacaccaaguacaaga

SEQ ID NO: 333341 - RNA, 19 nt, Homo sapiens
caugacaccaucaggauua

SEQ ID NO: 333342 - RNA, 19 nt, Homo sapiens
guauagugaugaaguugaa

SEQ ID NO: 333343 - RNA, 19 nt, Homo sapiens
gaaccuuccucaguuuaug

SEQ ID NO: 333344 - RNA, 19 nt, Homo sapiens
caaacaugcugcacugauc

SEQ ID NO: 333345 - RNA, 19 nt, Homo sapiens
aaaccaacaucccagcaaa

SEQ ID NO: 333346 - RNA, 19 nt, Homo sapiens
guucgaacauugucagaug

SEQ ID NO: 333347 - RNA, 19 nt, Homo sapiens
caaguggaaugcugguuau

SEQ ID NO: 333348 - RNA, 19 nt, Homo sapiens
ccaaguggaaugcugguua

SEQ ID NO: 333349 - RNA, 19 nt, Homo sapiens
ccaaugagcggcaguaaca

SEQ ID NO: 333350 - RNA, 19 nt, Homo sapiens
ggaugugacuguugugagu

SEQ ID NO: 333351 - RNA, 19 nt, Homo sapiens
caccuaaccuucgugcaua

SEQ ID NO: 333352 - RNA, 19 nt, Homo sapiens
ccuaagaccauaauuguga

SEQ ID NO: 333353 - RNA, 19 nt, Homo sapiens
gcucguuacuagcaucgua

SEQ ID NO: 333354 - RNA, 19 nt, Homo sapiens
aggcucuucuguuauauua

SEQ ID NO: 333355 - RNA, 19 nt, Homo sapiens
gaccaccuuugaauuaguu

SEQ ID NO: 333356 - RNA, 19 nt, Homo sapiens
guuauuuggugacugguuu

SEQ ID NO: 333357 - RNA, 19 nt, Homo sapiens
caucaaaguggacuauaaa

SEQ ID NO: 333358 - RNA, 19 nt, Homo sapiens
gccuagcucucuucacgua

SEQ ID NO: 333359 - RNA, 19 nt, Homo sapiens
gcucuaacaaucaauggua

SEQ ID NO: 333360 - RNA, 19 nt, Homo sapiens
ggaggcacuugacacagaa

SEQ ID NO: 333361 - RNA, 19 nt, Homo sapiens
ugaaguuaaugcagauuug

SEQ ID NO: 333362 - RNA, 19 nt, Homo sapiens
ccuaaacgcuaucacaaca

SEQ ID NO: 333363 - RNA, 19 nt, Homo sapiens
ggacuccucugauaaaaug

SEQ ID NO: 333364 - RNA, 19 nt, Homo sapiens
gauaauccuugaacaugca

SEQ ID NO: 333365 - RNA, 19 nt, Homo sapiens
cacaagugguugacauuug

SEQ ID NO: 333366 - RNA, 19 nt, Homo sapiens
gaugaagguuauuaucagu

SEQ ID NO: 333367 - RNA, 19 nt, Homo sapiens
aaagggaauuccaaagaug

SEQ ID NO: 333368 - RNA, 19 nt, Homo sapiens
ccucuccucuggacaguaa

SEQ ID NO: 333369 - RNA, 19 nt, Homo sapiens
gucugaagcuguccaauuc

SEQ ID NO: 333370 - RNA, 19 nt, Homo sapiens
ccgaguggcugcucuaaca

SEQ ID NO: 333371 - RNA, 19 nt, Homo sapiens
uauauaugcucacgaaucu

SEQ ID NO: 333372 - RNA, 19 nt, Homo sapiens
gcagccuacuaauauauau

SEQ ID NO: 333373 - RNA, 19 nt, Homo sapiens
caaugcaacugaaggagau

SEQ ID NO: 333374 - RNA, 19 nt, Homo sapiens
ggaacuauuaucaguagaa

SEQ ID NO: 333375 - RNA, 19 nt, Homo sapiens
ugacugcuuguuccaauua

SEQ ID NO: 333376 - RNA, 19 nt, Homo sapiens
ccaccaaaguauagugaug

SEQ ID NO: 333377 - RNA, 19 nt, Homo sapiens
agaugugaaugcagagaua

SEQ ID NO: 333378 - RNA, 19 nt, Homo sapiens
cagcaaacaccaaguacaa

SEQ ID NO: 333379 - RNA, 19 nt, Homo sapiens
ugauuacccugaaagcauu

SEQ ID NO: 333380 - RNA, 19 nt, Homo sapiens
gcggacaccugcaucagau

SEQ ID NO: 333381 - RNA, 19 nt, Homo sapiens
guaaaggaacauaaucuuc

SEQ ID NO: 333382 - RNA, 19 nt, Homo sapiens
ccaauuauguauggaaagu

SEQ ID NO: 333383 - RNA, 19 nt, Homo sapiens
gcaaccugcauuucacuuu

SEQ ID NO: 333384 - RNA, 19 nt, Homo sapiens
caaggaauuguacagagua

SEQ ID NO: 333385 - RNA, 19 nt, Homo sapiens
cuagugagcuguagaauug

SEQ ID NO: 333386 - RNA, 19 nt, Homo sapiens
gauauuugguuucagagua

SEQ ID NO: 333387 - RNA, 19 nt, Homo sapiens
cgacagggcuggugaaagu

SEQ ID NO: 333388 - RNA, 19 nt, Homo sapiens
gagcaaggaugaugguguu

SEQ ID NO: 333389 - RNA, 19 nt, Homo sapiens
gaaagagacaguccagcua

SEQ ID NO: 333390 - RNA, 19 nt, Homo sapiens
cgauggagcuucagcaaug

SEQ ID NO: 333391 - RNA, 19 nt, Homo sapiens
cggaaucucucccuggaua

SEQ ID NO: 333392 - RNA, 19 nt, Homo sapiens
ggaccgggcucugguauuc

SEQ ID NO: 333393 - RNA, 19 nt, Homo sapiens
agaauacugucuuuccaua

SEQ ID NO: 333394 - RNA, 19 nt, Homo sapiens
ggugacaucugcgcuuuaa

SEQ ID NO: 333395 - RNA, 19 nt, Homo sapiens
acaguuccaucuuccuuua

SEQ ID NO: 333396 - RNA, 19 nt, Homo sapiens
caaaaucaccuucccuuua

SEQ ID NO: 333397 - RNA, 19 nt, Homo sapiens
ugagacaggaguaguauuu

SEQ ID NO: 333398 - RNA, 19 nt, Homo sapiens
caggauauuugguuucaga

SEQ ID NO: 333399 - RNA, 19 nt, Homo sapiens
ccagauggcaggauauuug

SEQ ID NO: 333400 - RNA, 19 nt, Homo sapiens
ggagacagaucggcucagu

SEQ ID NO: 333401 - RNA, 19 nt, Homo sapiens
gaauuguccuccgcagcua

SEQ ID NO: 333402 - RNA, 19 nt, Homo sapiens
cuacagcguucauugucaa

SEQ ID NO: 333403 - RNA, 19 nt, Homo sapiens
aauacugucuuuccauaug

SEQ ID NO: 333404 - RNA, 19 nt, Homo sapiens
gagcaucuccguggccaaa

SEQ ID NO: 333405 - RNA, 19 nt, Homo sapiens
cauccagaguuccgaguga

SEQ ID NO: 333406 - RNA, 19 nt, Homo sapiens
ggcagcacauggucuccua

SEQ ID NO: 333407 - RNA, 19 nt, Homo sapiens
ggcaggauauuugguuuca

SEQ ID NO: 333408 - RNA, 19 nt, Homo sapiens
gaauacugucuuuccauau

SEQ ID NO: 333409 - RNA, 19 nt, Homo sapiens
gcagcuaugaugccuguga

SEQ ID NO: 333410 - RNA, 19 nt, Homo sapiens
cagguggccucuaccaugu

SEQ ID NO: 333411 - RNA, 19 nt, Homo sapiens
ugacugacuaucaaucaaa

SEQ ID NO: 333412 - RNA, 19 nt, Homo sapiens
gaaaccagaacaacuacca

SEQ ID NO: 333413 - RNA, 19 nt, Homo sapiens
gauggcaggauauuugguu

SEQ ID NO: 333414 - RNA, 19 nt, Homo sapiens
gcaggucuagugagcugua

SEQ ID NO: 333415 - RNA, 19 nt, Homo sapiens
ugacaucugcgcuuuaaag

SEQ ID NO: 333416 - RNA, 19 nt, Homo sapiens
ccacugccacugccgaauu

SEQ ID NO: 333417 - RNA, 19 nt, Homo sapiens
gaaucucucccuggauauu

SEQ ID NO: 333418 - RNA, 19 nt, Homo sapiens
gguggccucuaccauguug

SEQ ID NO: 333419 - RNA, 19 nt, Homo sapiens
gcacucuucucgccuuugc

SEQ ID NO: 333420 - RNA, 19 nt, Homo sapiens
agaaaggccggaaccacua

SEQ ID NO: 333421 - RNA, 19 nt, Homo sapiens
gcucagucgucaucaaugc

SEQ ID NO: 333422 - RNA, 19 nt, Homo sapiens
cggaaccacuacacagaga

SEQ ID NO: 333423 - RNA, 19 nt, Homo sapiens
ccucagcgaugaucauggu

SEQ ID NO: 333424 - RNA, 19 nt, Homo sapiens
aaagagacaguccagcuau

SEQ ID NO: 333425 - RNA, 19 nt, Homo sapiens
agacaggaguaguauuucu

SEQ ID NO: 333426 - RNA, 19 nt, Homo sapiens
gagaauacugucuuuccau

SEQ ID NO: 333427 - RNA, 19 nt, Homo sapiens
ugagaauacugucuuucca

SEQ ID NO: 333428 - RNA, 19 nt, Homo sapiens
gacaguuccaucuuccuuu

SEQ ID NO: 333429 - RNA, 19 nt, Homo sapiens
gcuccggcauugucuucuu

SEQ ID NO: 333430 - RNA, 19 nt, Homo sapiens
gcaaggaugaugguguuuc

SEQ ID NO: 333431 - RNA, 19 nt, Homo sapiens
guagugagcgauguugaga

SEQ ID NO: 333432 - RNA, 19 nt, Homo sapiens
cccgaaaccagaacaacua

SEQ ID NO: 333433 - RNA, 19 nt, Homo sapiens
gguccaaggcugagaacga

SEQ ID NO: 333434 - RNA, 19 nt, Homo sapiens
gacaggaguaguauuucuu

SEQ ID NO: 333435 - RNA, 19 nt, Homo sapiens
gggcacucuucucgccuuu

SEQ ID NO: 333436 - RNA, 19 nt, Homo sapiens
gcuguaggguuuggguguu

SEQ ID NO: 333437 - RNA, 19 nt, Homo sapiens
gcuggagacgccugaaaga

SEQ ID NO: 333438 - RNA, 19 nt, Homo sapiens
gaugaaugccagcccuaug

SEQ ID NO: 333439 - RNA, 19 nt, Homo sapiens
acaggaguaguauuucuuu

SEQ ID NO: 333440 - RNA, 19 nt, Homo sapiens
gcauugucuucuucuccaa

SEQ ID NO: 333441 - RNA, 19 nt, Homo sapiens
ggucagcccaagcaggaaa

SEQ ID NO: 333442 - RNA, 19 nt, Homo sapiens
ggaguaguauuucuuuucu

SEQ ID NO: 333443 - RNA, 19 nt, Homo sapiens
gcaaaaucaccuucccuuu

SEQ ID NO: 333444 - RNA, 19 nt, Homo sapiens
ugaugccugugauacacua

SEQ ID NO: 333445 - RNA, 19 nt, Homo sapiens
aaaaucaccuucccuuuac

SEQ ID NO: 333446 - RNA, 19 nt, Homo sapiens
ggaacacgggucuguagag

SEQ ID NO: 333447 - RNA, 19 nt, Homo sapiens
caaggaugaugguguuucc

SEQ ID NO: 333448 - RNA, 19 nt, Homo sapiens
ccuacagcguucauuguca

SEQ ID NO: 333449 - RNA, 19 nt, Homo sapiens
gaaaggccggaaccacuac

SEQ ID NO: 333450 - RNA, 19 nt, Homo sapiens
aagagacaguccagcuaug

SEQ ID NO: 333451 - RNA, 19 nt, Homo sapiens
gucaccagcuccggcauug

SEQ ID NO: 333452 - RNA, 19 nt, Homo sapiens
cagcuaugaugccugugau

SEQ ID NO: 333453 - RNA, 19 nt, Homo sapiens
cacugccacugccgaauug

SEQ ID NO: 333454 - RNA, 19 nt, Homo sapiens
cgucaucaaugcccgaaac

SEQ ID NO: 333455 - RNA, 19 nt, Homo sapiens
agugagcgauguugagaca

SEQ ID NO: 333456 - RNA, 19 nt, Homo sapiens
gggcaguagugagcgaugu

SEQ ID NO: 333457 - RNA, 19 nt, Homo sapiens
caugacugacuaucaauca

SEQ ID NO: 333458 - RNA, 19 nt, Homo sapiens
gggacggagucuucugucu

SEQ ID NO: 333459 - RNA, 19 nt, Homo sapiens
gcaguagugagcgauguug

SEQ ID NO: 333460 - RNA, 19 nt, Homo sapiens
ucagcugacucccgacucu

SEQ ID NO: 333461 - RNA, 19 nt, Homo sapiens
ucuacguccuguaugagaa

SEQ ID NO: 333462 - RNA, 19 nt, Homo sapiens
gauggagcuucagcaaugg

SEQ ID NO: 333463 - RNA, 19 nt, Homo sapiens
ucaaugcccgaaaccagaa

SEQ ID NO: 333464 - RNA, 19 nt, Homo sapiens
ggaaucucucccuggauau

SEQ ID NO: 333465 - RNA, 19 nt, Homo sapiens
gacucugccuucaggaaca

SEQ ID NO: 333466 - RNA, 19 nt, Homo sapiens
gccggaaccacuacacaga

SEQ ID NO: 333467 - RNA, 19 nt, Homo sapiens
gagcuguagaauugaauca

SEQ ID NO: 333468 - RNA, 19 nt, Homo sapiens
cccagcacauccagaguuc

SEQ ID NO: 333469 - RNA, 19 nt, Homo sapiens
agugagcuguagaauugaa

SEQ ID NO: 333470 - RNA, 19 nt, Homo sapiens
uggagacgccugaaagaca

SEQ ID NO: 333471 - RNA, 19 nt, Homo sapiens
caggaacacgggucuguag

SEQ ID NO: 333472 - RNA, 19 nt, Homo sapiens
cuucaggacucugccuuca

SEQ ID NO: 333473 - RNA, 19 nt, Homo sapiens
gggugacaucugcgcuuua

SEQ ID NO: 333474 - RNA, 19 nt, Homo sapiens
gcgauggagcuucagcaau

SEQ ID NO: 333475 - RNA, 19 nt, Homo sapiens
gagacaggaguaguauuuc

SEQ ID NO: 333476 - RNA, 19 nt, Homo sapiens
gcuaugaugccugugauac

SEQ ID NO: 333477 - RNA, 19 nt, Homo sapiens
guauggagcaaggaugaug

SEQ ID NO: 333478 - RNA, 19 nt, Homo sapiens
guacgaagccaaugauuac

SEQ ID NO: 333479 - RNA, 19 nt, Homo sapiens
agucucagcuggugaagaa

SEQ ID NO: 333480 - RNA, 19 nt, Homo sapiens
uguacgaagccaaugauua

SEQ ID NO: 333481 - RNA, 19 nt, Homo sapiens
gauugucuuucucauguuc

SEQ ID NO: 333482 - RNA, 19 nt, Homo sapiens
gcagaaggagagcguguuc

SEQ ID NO: 333483 - RNA, 19 nt, Homo sapiens
gggagcccaugccuacaga

SEQ ID NO: 333484 - RNA, 19 nt, Homo sapiens
acgaggagauugucuuucu

SEQ ID NO: 333485 - RNA, 19 nt, Homo sapiens
acucagaccuccagagcau

SEQ ID NO: 333486 - RNA, 19 nt, Homo sapiens
uuacgaggagauugucuuu

SEQ ID NO: 333487 - RNA, 19 nt, Homo sapiens
gcagcugugccuacucaga

SEQ ID NO: 333488 - RNA, 19 nt, Homo sapiens
gcccaugccuacagaaucc

SEQ ID NO: 333489 - RNA, 19 nt, Homo sapiens
ugacgcggcugugccaagu

SEQ ID NO: 333490 - RNA, 19 nt, Homo sapiens
gagcccaugccuacagaau

SEQ ID NO: 333491 - RNA, 19 nt, Homo sapiens
ccaaugauuacgaggagau

SEQ ID NO: 333492 - RNA, 19 nt, Homo sapiens
cagaccagggccaauguga

SEQ ID NO: 333493 - RNA, 19 nt, Homo sapiens
gaacccaugccccuuguau

SEQ ID NO: 333494 - RNA, 19 nt, Homo sapiens
gaaucgaucuguacuguaa

SEQ ID NO: 333495 - RNA, 19 nt, Homo sapiens
caacauacccuucuuuaaa

SEQ ID NO: 333496 - RNA, 19 nt, Homo sapiens
caaaggaaaucgaaacaug

SEQ ID NO: 333497 - RNA, 19 nt, Homo sapiens
cagaauaagugcuguuuga

SEQ ID NO: 333498 - RNA, 19 nt, Homo sapiens
cauacaauuugcacuguua

SEQ ID NO: 333499 - RNA, 19 nt, Homo sapiens
aaucugagccuaaaucuaa

SEQ ID NO: 333500 - RNA, 19 nt, Homo sapiens
ccaugcagcuucaucaauu

SEQ ID NO: 333501 - RNA, 19 nt, Homo sapiens
cuaaucagguuguuaaugu

SEQ ID NO: 333502 - RNA, 19 nt, Homo sapiens
caugguggguugucauaua

SEQ ID NO: 333503 - RNA, 19 nt, Homo sapiens
gaaaagugcuuagaaaguu

SEQ ID NO: 333504 - RNA, 19 nt, Homo sapiens
gcagaaaagugcuuagaaa

SEQ ID NO: 333505 - RNA, 19 nt, Homo sapiens
gaaacaugaccaaaucgua

SEQ ID NO: 333506 - RNA, 19 nt, Homo sapiens
gagcaauucauuucacuuu

SEQ ID NO: 333507 - RNA, 19 nt, Homo sapiens
ccacuggaaucgaucugua

SEQ ID NO: 333508 - RNA, 19 nt, Homo sapiens
ccagcucaaugccauauuu

SEQ ID NO: 333509 - RNA, 19 nt, Homo sapiens
guaauaaaucugagccuaa

SEQ ID NO: 333510 - RNA, 19 nt, Homo sapiens
cuguucaccuuauguauua

SEQ ID NO: 333511 - RNA, 19 nt, Homo sapiens
caaaguuccuguucaccuu

SEQ ID NO: 333512 - RNA, 19 nt, Homo sapiens
gcacgccaguuucaccauu

SEQ ID NO: 333513 - RNA, 19 nt, Homo sapiens
ucccaugucuuccacguua

SEQ ID NO: 333514 - RNA, 19 nt, Homo sapiens
gaauaagugcuguuugaga

SEQ ID NO: 333515 - RNA, 19 nt, Homo sapiens
caacuucucuuucaaacac

SEQ ID NO: 333516 - RNA, 19 nt, Homo sapiens
gcacuucuuuccucuccaa

SEQ ID NO: 333517 - RNA, 19 nt, Homo sapiens
gcaaauacuccaagcuuca

SEQ ID NO: 333518 - RNA, 19 nt, Homo sapiens
ucaaugccauauuucauga

SEQ ID NO: 333519 - RNA, 19 nt, Homo sapiens
cagcaucaauggcaacuuc

SEQ ID NO: 333520 - RNA, 19 nt, Homo sapiens
gcaccagcccuuccuuuga

SEQ ID NO: 333521 - RNA, 19 nt, Homo sapiens
guagucaauuaguacagua

SEQ ID NO: 333522 - RNA, 19 nt, Homo sapiens
gcucaggaccuacuaacaa

SEQ ID NO: 333523 - RNA, 19 nt, Homo sapiens
gccaacauacccuucuuua

SEQ ID NO: 333524 - RNA, 19 nt, Homo sapiens
gaucaaaguuccuguucac

SEQ ID NO: 333525 - RNA, 19 nt, Homo sapiens
aaaaugcaguccagaauaa

SEQ ID NO: 333526 - RNA, 19 nt, Homo sapiens
gccuaaaucuaaucagguu

SEQ ID NO: 333527 - RNA, 19 nt, Homo sapiens
ugacugucguguuuacaaa

SEQ ID NO: 333528 - RNA, 19 nt, Homo sapiens
caauuugcacuguuacuuu

SEQ ID NO: 333529 - RNA, 19 nt, Homo sapiens
aauaagugcuguuugagau

SEQ ID NO: 333530 - RNA, 19 nt, Homo sapiens
ggaucaaaguuccuguuca

SEQ ID NO: 333531 - RNA, 19 nt, Homo sapiens
gaaagcccucugacugauu

SEQ ID NO: 333532 - RNA, 19 nt, Homo sapiens
ugagacgcaugaaggcuaa

SEQ ID NO: 333533 - RNA, 19 nt, Homo sapiens
gagaggaggaggacgaaga

SEQ ID NO: 333534 - RNA, 19 nt, Homo sapiens
gcacgaggcagacaagaag

SEQ ID NO: 333535 - RNA, 19 nt, Homo sapiens
gcaauaauuaggaucuaug

SEQ ID NO: 333536 - RNA, 19 nt, Homo sapiens
gaucuguacuguaauuuug

SEQ ID NO: 333537 - RNA, 19 nt, Homo sapiens
ccaacauacccuucuuuaa

SEQ ID NO: 333538 - RNA, 19 nt, Homo sapiens
caauucaacacauuacuug

SEQ ID NO: 333539 - RNA, 19 nt, Homo sapiens
gauagccauucacaucaug

SEQ ID NO: 333540 - RNA, 19 nt, Homo sapiens
cuggagcccuucuuugaaa

SEQ ID NO: 333541 - RNA, 19 nt, Homo sapiens
caauuaguacaguagcuua

SEQ ID NO: 333542 - RNA, 19 nt, Homo sapiens
gagaaucugaagcuauuga

SEQ ID NO: 333543 - RNA, 19 nt, Homo sapiens
uaagagauacauucccuau

SEQ ID NO: 333544 - RNA, 19 nt, Homo sapiens
caugcagcuucaucaauuu

SEQ ID NO: 333545 - RNA, 19 nt, Homo sapiens
ccuuucccaugcugaauua

SEQ ID NO: 333546 - RNA, 19 nt, Homo sapiens
cgaauuugguguggcugua

SEQ ID NO: 333547 - RNA, 19 nt, Homo sapiens
gguggguugucauauauuc

SEQ ID NO: 333548 - RNA, 19 nt, Homo sapiens
cuucuuuccucuccaauug

SEQ ID NO: 333549 - RNA, 19 nt, Homo sapiens
caacaaaggaaaucgaaac

SEQ ID NO: 333550 - RNA, 19 nt, Homo sapiens
aaaggaaaucgaaacauga

SEQ ID NO: 333551 - RNA, 19 nt, Homo sapiens
gcuugacuaucacauacaa

SEQ ID NO: 333552 - RNA, 19 nt, Homo sapiens
guacuacugcugcaaagug

SEQ ID NO: 333553 - RNA, 19 nt, Homo sapiens
caccagcccuuccuuugau

SEQ ID NO: 333554 - RNA, 19 nt, Homo sapiens
aaagcccucugacugauug

SEQ ID NO: 333555 - RNA, 19 nt, Homo sapiens
gaaaucgaaacaugaccaa

SEQ ID NO: 333556 - RNA, 19 nt, Homo sapiens
ggaaucgaucuguacugua

SEQ ID NO: 333557 - RNA, 19 nt, Homo sapiens
caacauaucaauucaacac

SEQ ID NO: 333558 - RNA, 19 nt, Homo sapiens
aauggcaacuucucuuuca

SEQ ID NO: 333559 - RNA, 19 nt, Homo sapiens
ucaauggcaacuucucuuu

SEQ ID NO: 333560 - RNA, 19 nt, Homo sapiens
gaacgcagaggaggacuca

SEQ ID NO: 333561 - RNA, 19 nt, Homo sapiens
gugccuugcuauucuaaga

SEQ ID NO: 333562 - RNA, 19 nt, Homo sapiens
gguggugccuugcuauucu

SEQ ID NO: 333563 - RNA, 19 nt, Homo sapiens
ggaagaggaggaugacgau

SEQ ID NO: 333564 - RNA, 19 nt, Homo sapiens
ggaagaggaggaagaagag

SEQ ID NO: 333565 - RNA, 19 nt, Homo sapiens
guuaauguugggaguuaua

SEQ ID NO: 333566 - RNA, 19 nt, Homo sapiens
gacuaucacauacaauuug

SEQ ID NO: 333567 - RNA, 19 nt, Homo sapiens
ucacaagcaauaauuagga

SEQ ID NO: 333568 - RNA, 19 nt, Homo sapiens
aaacauucauccaguugca

SEQ ID NO: 333569 - RNA, 19 nt, Homo sapiens
uaagugcuguuugagaugu

SEQ ID NO: 333570 - RNA, 19 nt, Homo sapiens
ccacggaucaaucuucuca

SEQ ID NO: 333571 - RNA, 19 nt, Homo sapiens
cuacuaacaacaaaggaaa

SEQ ID NO: 333572 - RNA, 19 nt, Homo sapiens
gugcaaauacuccaagcuu

SEQ ID NO: 333573 - RNA, 19 nt, Homo sapiens
ugaaagcccucugacugau

SEQ ID NO: 333574 - RNA, 19 nt, Homo sapiens
agaggaggaugacgaucaa

SEQ ID NO: 333575 - RNA, 19 nt, Homo sapiens
gcagaggaggacucacuga

SEQ ID NO: 333576 - RNA, 19 nt, Homo sapiens
cacaacauaucaauucaac

SEQ ID NO: 333577 - RNA, 19 nt, Homo sapiens
uucccaugcugaauuauuu

SEQ ID NO: 333578 - RNA, 19 nt, Homo sapiens
cuccaagcuucaagugaua

SEQ ID NO: 333579 - RNA, 19 nt, Homo sapiens
aaacgaacccacugugcuu

SEQ ID NO: 333580 - RNA, 19 nt, Homo sapiens
caacacauuacuugcacaa

SEQ ID NO: 333581 - RNA, 19 nt, Homo sapiens
uaucacugcucaggaccua

SEQ ID NO: 333582 - RNA, 19 nt, Homo sapiens
ugucauuacugccuuugga

SEQ ID NO: 333583 - RNA, 19 nt, Homo sapiens
ugccauauuucaugauuag

SEQ ID NO: 333584 - RNA, 19 nt, Homo sapiens
ccaaagccacggaucaauc

SEQ ID NO: 333585 - RNA, 19 nt, Homo sapiens
uggaaucgaucuguacugu

SEQ ID NO: 333586 - RNA, 19 nt, Homo sapiens
uaaaaugcaguccagaaua

SEQ ID NO: 333587 - RNA, 19 nt, Homo sapiens
cugaagcuauugauguuuc

SEQ ID NO: 333588 - RNA, 19 nt, Homo sapiens
ugguguggcuguauucaga

SEQ ID NO: 333589 - RNA, 19 nt, Homo sapiens
gcuggagcccuucuuugaa

SEQ ID NO: 333590 - RNA, 19 nt, Homo sapiens
gcugcuugacuaucacaua

SEQ ID NO: 333591 - RNA, 19 nt, Homo sapiens
cacaagcaauaauuaggau

SEQ ID NO: 333592 - RNA, 19 nt, Homo sapiens
uaacaacaaaggaaaucga

SEQ ID NO: 333593 - RNA, 19 nt, Homo sapiens
gaaaacauucauccaguug

SEQ ID NO: 333594 - RNA, 19 nt, Homo sapiens
ggaaguggauugagaggaa

SEQ ID NO: 333595 - RNA, 19 nt, Homo sapiens
gcucaacucucgcaacuuc

SEQ ID NO: 333596 - RNA, 19 nt, Homo sapiens
gggcagcgcaguccuguua

SEQ ID NO: 333597 - RNA, 19 nt, Homo sapiens
gcaagguggugcccugcua

SEQ ID NO: 333598 - RNA, 19 nt, Homo sapiens
ggccagaccuaguguccua

SEQ ID NO: 333599 - RNA, 19 nt, Homo sapiens
gaaguggauugagaggaaa

SEQ ID NO: 333600 - RNA, 19 nt, Homo sapiens
cgcagaagcuguccaagau

SEQ ID NO: 333601 - RNA, 19 nt, Homo sapiens
ucucuugucuuacgauaug

SEQ ID NO: 333602 - RNA, 19 nt, Homo sapiens
gagaggaggaggaggaaga

SEQ ID NO: 333603 - RNA, 19 nt, Homo sapiens
ggaaagagagaggccaaga

SEQ ID NO: 333604 - RNA, 19 nt, Homo sapiens
gagagaggccaagacaauu

SEQ ID NO: 333605 - RNA, 19 nt, Homo sapiens
ggaagaggaggaggaagaa

SEQ ID NO: 333606 - RNA, 19 nt, Homo sapiens
ugaagaggguagaaguuag

SEQ ID NO: 333607 - RNA, 19 nt, Homo sapiens
ucucggacgugcccaaguu

SEQ ID NO: 333608 - RNA, 19 nt, Homo sapiens
gaacgcagcccuggacaac

SEQ ID NO: 333609 - RNA, 19 nt, Homo sapiens
gagaggccaagacaauuug

SEQ ID NO: 333610 - RNA, 19 nt, Homo sapiens
agagagaggccaagacaau

SEQ ID NO: 333611 - RNA, 19 nt, Homo sapiens
acaaugaaauaagcgagaa

SEQ ID NO: 333612 - RNA, 19 nt, Homo sapiens
agagaggccaagacaauuu

SEQ ID NO: 333613 - RNA, 19 nt, Homo sapiens
aauggcaacuucucacuca

SEQ ID NO: 333614 - RNA, 19 nt, Homo sapiens
uugaagaggguagaaguua

SEQ ID NO: 333615 - RNA, 19 nt, Homo sapiens
gagaaaagcuaccacuacu

SEQ ID NO: 333616 - RNA, 19 nt, Homo sapiens
ggaggaagaggaggaggaa

SEQ ID NO: 333617 - RNA, 19 nt, Homo sapiens
aaagagagaggccaagaca

SEQ ID NO: 333618 - RNA, 19 nt, Homo sapiens
aaagcuaccacuacucuau

SEQ ID NO: 333619 - RNA, 19 nt, Homo sapiens
cagcucaacucucgcaacu

SEQ ID NO: 333620 - RNA, 19 nt, Homo sapiens
gaagaggguagaaguuagg

SEQ ID NO: 333621 - RNA, 19 nt, Homo sapiens
ugaaauaagcgagaagauc

SEQ ID NO: 333622 - RNA, 19 nt, Homo sapiens
ccacuacucuaugcacuac

SEQ ID NO: 333623 - RNA, 19 nt, Homo sapiens
ccaagaagcgcaagaugac

SEQ ID NO: 333624 - RNA, 19 nt, Homo sapiens
cccaagaagcgcaagauga

SEQ ID NO: 333625 - RNA, 19 nt, Homo sapiens
gaaagagagaggccaagac

SEQ ID NO: 333626 - RNA, 19 nt, Homo sapiens
gaggggaaguggauugaga

SEQ ID NO: 333627 - RNA, 19 nt, Homo sapiens
ggcgcucccucuuucuuga

SEQ ID NO: 333628 - RNA, 19 nt, Homo sapiens
aaucucuugucuuacgaua

SEQ ID NO: 333629 - RNA, 19 nt, Homo sapiens
gcgccuagccaagaacuau

SEQ ID NO: 333630 - RNA, 19 nt, Homo sapiens
caauaucuucgcugagguu

SEQ ID NO: 333631 - RNA, 19 nt, Homo sapiens
gaaaagcuaccacuacucu

SEQ ID NO: 333632 - RNA, 19 nt, Homo sapiens
gggcagcugagcaauggaa

SEQ ID NO: 333633 - RNA, 19 nt, Homo sapiens
ucgcauggcgcucugaaga

SEQ ID NO: 333634 - RNA, 19 nt, Homo sapiens
gcaagcggccagaccuagu

SEQ ID NO: 333635 - RNA, 19 nt, Homo sapiens
gcagaagcuguccaagauc

SEQ ID NO: 333636 - RNA, 19 nt, Homo sapiens
cuuacgauaugcaccuuca

SEQ ID NO: 333637 - RNA, 19 nt, Homo sapiens
aggaagaggaggaggaaga

SEQ ID NO: 333638 - RNA, 19 nt, Homo sapiens
acgcagaagcuguccaaga

SEQ ID NO: 333639 - RNA, 19 nt, Homo sapiens
cuacaacagcuccgaguac

SEQ ID NO: 333640 - RNA, 19 nt, Homo sapiens
caagcggccagaccuagug

SEQ ID NO: 333641 - RNA, 19 nt, Homo sapiens
gcaaccgcaugcacaacuu

SEQ ID NO: 333642 - RNA, 19 nt, Homo sapiens
acaacgcccuguuucauuc

SEQ ID NO: 333643 - RNA, 19 nt, Homo sapiens
ucccaagccugcccaaaga

SEQ ID NO: 333644 - RNA, 19 nt, Homo sapiens
gcgcuucgccuacaacuac

SEQ ID NO: 333645 - RNA, 19 nt, Homo sapiens
acaccaagcucaccaaaau

SEQ ID NO: 333646 - RNA, 19 nt, Homo sapiens
ccacacaacgcccuguuuc

SEQ ID NO: 333647 - RNA, 19 nt, Homo sapiens
cacaacgcccuguuucauu

SEQ ID NO: 333648 - RNA, 19 nt, Homo sapiens
uuucauuccuuaccacuag

SEQ ID NO: 333649 - RNA, 19 nt, Homo sapiens
cagcagcggcagugaccua

SEQ ID NO: 333650 - RNA, 19 nt, Homo sapiens
cgcccuguuucauuccuua

SEQ ID NO: 333651 - RNA, 19 nt, Homo sapiens
cgacaccaagcucaccaaa

SEQ ID NO: 333652 - RNA, 19 nt, Homo sapiens
caaccgcaugcacaacuug

SEQ ID NO: 333653 - RNA, 19 nt, Homo sapiens
acacaacgcccuguuucau

SEQ ID NO: 333654 - RNA, 19 nt, Homo sapiens
caaagacuugcuccacaca

SEQ ID NO: 333655 - RNA, 19 nt, Homo sapiens
ggaauaagaugguagaaua

SEQ ID NO: 333656 - RNA, 19 nt, Homo sapiens
gauagaagcuacaguaaua

SEQ ID NO: 333657 - RNA, 19 nt, Homo sapiens
caacaaagcuaauccuuaa

SEQ ID NO: 333658 - RNA, 19 nt, Homo sapiens
gaagauaacucugucauuu

SEQ ID NO: 333659 - RNA, 19 nt, Homo sapiens
gaagaaaucugccuaguag

SEQ ID NO: 333660 - RNA, 19 nt, Homo sapiens
gaacaaaccauagcuauaa

SEQ ID NO: 333661 - RNA, 19 nt, Homo sapiens
gaauucaccuucuacauuu

SEQ ID NO: 333662 - RNA, 19 nt, Homo sapiens
ggaauuaacuguuuguuca

SEQ ID NO: 333663 - RNA, 19 nt, Homo sapiens
gaaacuggcugagcacaua

SEQ ID NO: 333664 - RNA, 19 nt, Homo sapiens
caucuuaccugcaaaguuu

SEQ ID NO: 333665 - RNA, 19 nt, Homo sapiens
gcaaacagguggcaggaaa

SEQ ID NO: 333666 - RNA, 19 nt, Homo sapiens
agaacuagcucaaagauuu

SEQ ID NO: 333667 - RNA, 19 nt, Homo sapiens
gacaagagcuacauuuaug

SEQ ID NO: 333668 - RNA, 19 nt, Homo sapiens
gcagugaaguugaagauga

SEQ ID NO: 333669 - RNA, 19 nt, Homo sapiens
gagauuagcucacaaaugc

SEQ ID NO: 333670 - RNA, 19 nt, Homo sapiens
aaacagacuuucucucuaa

SEQ ID NO: 333671 - RNA, 19 nt, Homo sapiens
caacuucaaugcagucuuu

SEQ ID NO: 333672 - RNA, 19 nt, Homo sapiens
ccaaagacgugguugauga

SEQ ID NO: 333673 - RNA, 19 nt, Homo sapiens
cagauaauccguauucuua

SEQ ID NO: 333674 - RNA, 19 nt, Homo sapiens
ggaaauaccagucaaaugu

SEQ ID NO: 333675 - RNA, 19 nt, Homo sapiens
ggacagaacuagcucaaag

SEQ ID NO: 333676 - RNA, 19 nt, Homo sapiens
gcaagaacagucagaauuu

SEQ ID NO: 333677 - RNA, 19 nt, Homo sapiens
gaaaggggcuugaaguuaa

SEQ ID NO: 333678 - RNA, 19 nt, Homo sapiens
uaaagaagguugcgcaguu

SEQ ID NO: 333679 - RNA, 19 nt, Homo sapiens
gaaggaaacagcauuuaaa

SEQ ID NO: 333680 - RNA, 19 nt, Homo sapiens
cagaacaacugcaaagaaa

SEQ ID NO: 333681 - RNA, 19 nt, Homo sapiens
cgaagucgcugcagccuaa

SEQ ID NO: 333682 - RNA, 19 nt, Homo sapiens
gaagagaccaagcaaguuu

SEQ ID NO: 333683 - RNA, 19 nt, Homo sapiens
ggaggaggauccauagauu

SEQ ID NO: 333684 - RNA, 19 nt, Homo sapiens
caaauguucucuuggauga

SEQ ID NO: 333685 - RNA, 19 nt, Homo sapiens
ggaaggaugugcaaaauaa

SEQ ID NO: 333686 - RNA, 19 nt, Homo sapiens
gcaaguacuuacaucaauu

SEQ ID NO: 333687 - RNA, 19 nt, Homo sapiens
ccacaaugcucucaagcua

SEQ ID NO: 333688 - RNA, 19 nt, Homo sapiens
ucauaaagcuguuggaaga

SEQ ID NO: 333689 - RNA, 19 nt, Homo sapiens
gaacauaugcggccuuuca

SEQ ID NO: 333690 - RNA, 19 nt, Homo sapiens
caacaugacuggcuuccuu

SEQ ID NO: 333691 - RNA, 19 nt, Homo sapiens
gcaacaaagcuaauccuua

SEQ ID NO: 333692 - RNA, 19 nt, Homo sapiens
cgaaauauguuuggugaaa

SEQ ID NO: 333693 - RNA, 19 nt, Homo sapiens
gcaguuagcaguuauaaau

SEQ ID NO: 333694 - RNA, 19 nt, Homo sapiens
caacaacacccucuuuauu

SEQ ID NO: 333695 - RNA, 19 nt, Homo sapiens
caaauacggaccaauguua

SEQ ID NO: 333696 - RNA, 19 nt, Homo sapiens
gcacauagagcaugaacaa

SEQ ID NO: 333697 - RNA, 19 nt, Homo sapiens
gcaaagccauaugaaauug

SEQ ID NO: 333698 - RNA, 19 nt, Homo sapiens
gcugauauaccaugucuua

SEQ ID NO: 333699 - RNA, 19 nt, Homo sapiens
aaacgaaacugugucaauu

SEQ ID NO: 333700 - RNA, 19 nt, Homo sapiens
ugaagaacuugcuagauaa

SEQ ID NO: 333701 - RNA, 19 nt, Homo sapiens
gaacaagcaacaaagcuaa

SEQ ID NO: 333702 - RNA, 19 nt, Homo sapiens
cuacaaaucauucuccuua

SEQ ID NO: 333703 - RNA, 19 nt, Homo sapiens
gaacacacauaccaaaguc

SEQ ID NO: 333704 - RNA, 19 nt, Homo sapiens
aaacacaaauuccagacua

SEQ ID NO: 333705 - RNA, 19 nt, Homo sapiens
ccaaacaucuuaccugcaa

SEQ ID NO: 333706 - RNA, 19 nt, Homo sapiens
caacugcucuggaacaugu

SEQ ID NO: 333707 - RNA, 19 nt, Homo sapiens
gccaagagaugaaauuuag

SEQ ID NO: 333708 - RNA, 19 nt, Homo sapiens
caaggaaugucuaaucaau

SEQ ID NO: 333709 - RNA, 19 nt, Homo sapiens
uaucuuguguccagaaaua

SEQ ID NO: 333710 - RNA, 19 nt, Homo sapiens
uuacagaucugcuugaugu

SEQ ID NO: 333711 - RNA, 19 nt, Homo sapiens
gcaagaaauuaacuaguca

SEQ ID NO: 333712 - RNA, 19 nt, Homo sapiens
gacagaaagugcugcaauu

SEQ ID NO: 333713 - RNA, 19 nt, Homo sapiens
augaagaacuugcuagaua

SEQ ID NO: 333714 - RNA, 19 nt, Homo sapiens
gaaacuaauucaugcagau

SEQ ID NO: 333715 - RNA, 19 nt, Homo sapiens
gacauucuguuucaaggua

SEQ ID NO: 333716 - RNA, 19 nt, Homo sapiens
gaucggcuguuguccuuaa

SEQ ID NO: 333717 - RNA, 19 nt, Homo sapiens
gaaauggaaucagggauca

SEQ ID NO: 333718 - RNA, 19 nt, Homo sapiens
gaacagcaucggugcagua

SEQ ID NO: 333719 - RNA, 19 nt, Homo sapiens
gaaggcagcucugaacauc

SEQ ID NO: 333720 - RNA, 19 nt, Homo sapiens
uaacaaugaccaucaauga

SEQ ID NO: 333721 - RNA, 19 nt, Homo sapiens
ugucaaaucuaguucguuu

SEQ ID NO: 333722 - RNA, 19 nt, Homo sapiens
caugaagaauuacuacgua

SEQ ID NO: 333723 - RNA, 19 nt, Homo sapiens
gaugugauauuccuucuag

SEQ ID NO: 333724 - RNA, 19 nt, Homo sapiens
uaagauugaugcuguguau

SEQ ID NO: 333725 - RNA, 19 nt, Homo sapiens
gcugaaagcaccaaacgua

SEQ ID NO: 333726 - RNA, 19 nt, Homo sapiens
ggaacuggguagaaaauua

SEQ ID NO: 333727 - RNA, 19 nt, Homo sapiens
ugaaucaaauguucucuug

SEQ ID NO: 333728 - RNA, 19 nt, Homo sapiens
ggacucaauuucaacucua

SEQ ID NO: 333729 - RNA, 19 nt, Homo sapiens
ggacuggucauuaauauca

SEQ ID NO: 333730 - RNA, 19 nt, Homo sapiens
caacagggaucauaaagcu

SEQ ID NO: 333731 - RNA, 19 nt, Homo sapiens
cguaaggguucuaugauuu

SEQ ID NO: 333732 - RNA, 19 nt, Homo sapiens
gaacaaaaccugcauacuu

SEQ ID NO: 333733 - RNA, 19 nt, Homo sapiens
ccacguuguuacuuucuua

SEQ ID NO: 333734 - RNA, 19 nt, Homo sapiens
gcacagaauuugacacacu

SEQ ID NO: 333735 - RNA, 19 nt, Homo sapiens
gaacaucuagggcaagcua

SEQ ID NO: 333736 - RNA, 19 nt, Homo sapiens
aaagaagguugcgcaguua

SEQ ID NO: 333737 - RNA, 19 nt, Homo sapiens
cacauggacuggucauuaa

SEQ ID NO: 333738 - RNA, 19 nt, Homo sapiens
cgacaaagaguuacugcua

SEQ ID NO: 333739 - RNA, 19 nt, Homo sapiens
gcaaucagucuuucuaaau

SEQ ID NO: 333740 - RNA, 19 nt, Homo sapiens
guacugagcacaacaagga

SEQ ID NO: 333741 - RNA, 19 nt, Homo sapiens
gcaacagcuuggccaguaa

SEQ ID NO: 333742 - RNA, 19 nt, Homo sapiens
gaagccaaaucacaguuau

SEQ ID NO: 333743 - RNA, 19 nt, Homo sapiens
agaaggagaugguguggaa

SEQ ID NO: 333744 - RNA, 19 nt, Homo sapiens
gcguguaucugguauaugu

SEQ ID NO: 333745 - RNA, 19 nt, Homo sapiens
uaacaugggcucuucacua

SEQ ID NO: 333746 - RNA, 19 nt, Homo sapiens
uaaagcagauaauccguau

SEQ ID NO: 333747 - RNA, 19 nt, Homo sapiens
gacaaagaguuacugcuau

SEQ ID NO: 333748 - RNA, 19 nt, Homo sapiens
gaguguauuucuggauuua

SEQ ID NO: 333749 - RNA, 19 nt, Homo sapiens
caaucagucuuucuaaaug

SEQ ID NO: 333750 - RNA, 19 nt, Homo sapiens
gaaauuguaguggaccuua

SEQ ID NO: 333751 - RNA, 19 nt, Homo sapiens
ggcaacagcuuggccagua

SEQ ID NO: 333752 - RNA, 19 nt, Homo sapiens
ccacaaggaucuccagaca

SEQ ID NO: 333753 - RNA, 19 nt, Homo sapiens
ggaccaauguuaaggaucu

SEQ ID NO: 333754 - RNA, 19 nt, Homo sapiens
gacaagaagcuauaaguau

SEQ ID NO: 333755 - RNA, 19 nt, Homo sapiens
ggaaggaccucuuugauuu

SEQ ID NO: 333756 - RNA, 19 nt, Homo sapiens
gacaaggaguuuacuauua

SEQ ID NO: 333757 - RNA, 19 nt, Homo sapiens
ggaugaagcugaaauggaa

SEQ ID NO: 333758 - RNA, 19 nt, Homo sapiens
ggagaucacacaacauuua

SEQ ID NO: 333759 - RNA, 19 nt, Homo sapiens
ggagacagcucuggauauu

SEQ ID NO: 333760 - RNA, 19 nt, Homo sapiens
gaagauggcugaggaguca

SEQ ID NO: 333761 - RNA, 19 nt, Homo sapiens
gaaauggaauaucugaaga

SEQ ID NO: 333762 - RNA, 19 nt, Homo sapiens
ucaaugaacucaagacaga

SEQ ID NO: 333763 - RNA, 19 nt, Homo sapiens
gaaagaagaagcaacaaug

SEQ ID NO: 333764 - RNA, 19 nt, Homo sapiens
gaaccaugaucuauuuaug

SEQ ID NO: 333765 - RNA, 19 nt, Homo sapiens
ccucaaagcuucguguuaa

SEQ ID NO: 333766 - RNA, 19 nt, Homo sapiens
ggaagaaccagucaccuuu

SEQ ID NO: 333767 - RNA, 19 nt, Homo sapiens
ggacugcaguacacaauca

SEQ ID NO: 333768 - RNA, 19 nt, Homo sapiens
uuaaaccacuggauaagaa

SEQ ID NO: 333769 - RNA, 19 nt, Homo sapiens
ggaguucaauugcgagaug

SEQ ID NO: 333770 - RNA, 19 nt, Homo sapiens
gcaagcacaauaccauuaa

SEQ ID NO: 333771 - RNA, 19 nt, Homo sapiens
ggaaugaaauccgaaacau

SEQ ID NO: 333772 - RNA, 19 nt, Homo sapiens
cgggaaccaugaucuauuu

SEQ ID NO: 333773 - RNA, 19 nt, Homo sapiens
ggaagcaacccaagacguu

SEQ ID NO: 333774 - RNA, 19 nt, Homo sapiens
caaagauacugacaugaag

SEQ ID NO: 333775 - RNA, 19 nt, Homo sapiens
gggaaggaccucuuugauu

SEQ ID NO: 333776 - RNA, 19 nt, Homo sapiens
ccauggagauagagaaaga

SEQ ID NO: 333777 - RNA, 19 nt, Homo sapiens
ucaaagauacugacaugaa

SEQ ID NO: 333778 - RNA, 19 nt, Homo sapiens
gaucacacaacauuuauuc

SEQ ID NO: 333779 - RNA, 19 nt, Homo sapiens
caaagcuucguguuaauaa

SEQ ID NO: 333780 - RNA, 19 nt, Homo sapiens
gguacuggaucaugauguu

SEQ ID NO: 333781 - RNA, 19 nt, Homo sapiens
acaagaagguacuggauca

SEQ ID NO: 333782 - RNA, 19 nt, Homo sapiens
cgugggagcuccagaacuu

SEQ ID NO: 333783 - RNA, 19 nt, Homo sapiens
ggugugaacuacuuugcaa

SEQ ID NO: 333784 - RNA, 19 nt, Homo sapiens
agaagguacuggaucauga

SEQ ID NO: 333785 - RNA, 19 nt, Homo sapiens
agacagcucuggauauucu

SEQ ID NO: 333786 - RNA, 19 nt, Homo sapiens
ucagaugacuccggaaaug

SEQ ID NO: 333787 - RNA, 19 nt, Homo sapiens
gaaggaccucuuugauuug

SEQ ID NO: 333788 - RNA, 19 nt, Homo sapiens
caagcacaauaccauuaaa

SEQ ID NO: 333789 - RNA, 19 nt, Homo sapiens
uggauauucugcacaauga

SEQ ID NO: 333790 - RNA, 19 nt, Homo sapiens
cuucaaagauacugacaug

SEQ ID NO: 333791 - RNA, 19 nt, Homo sapiens
gaugaaagaagaagcaaca

SEQ ID NO: 333792 - RNA, 19 nt, Homo sapiens
gggaggagaaggcuagaaa

SEQ ID NO: 333793 - RNA, 19 nt, Homo sapiens
gaggagagaauuacugcuu

SEQ ID NO: 333794 - RNA, 19 nt, Homo sapiens
caggagaucacacaacauu

SEQ ID NO: 333795 - RNA, 19 nt, Homo sapiens
ucaaagcuucguguuaaua

SEQ ID NO: 333796 - RNA, 19 nt, Homo sapiens
ugacaaggaguuuacuauu

SEQ ID NO: 333797 - RNA, 19 nt, Homo sapiens
aagcugaaauggaauaucu

SEQ ID NO: 333798 - RNA, 19 nt, Homo sapiens
caagagagccauccauagg

SEQ ID NO: 333799 - RNA, 19 nt, Homo sapiens
cacacaacauuuauucuuc

SEQ ID NO: 333800 - RNA, 19 nt, Homo sapiens
gaagaaccagucaccuuuc

SEQ ID NO: 333801 - RNA, 19 nt, Homo sapiens
cagccugucuuucgacuuc

SEQ ID NO: 333802 - RNA, 19 nt, Homo sapiens
ggaaccaugaucuauuuau

SEQ ID NO: 333803 - RNA, 19 nt, Homo sapiens
ggaaagggaaggaccucuu

SEQ ID NO: 333804 - RNA, 19 nt, Homo sapiens
agaaaucgaggccuugaaa

SEQ ID NO: 333805 - RNA, 19 nt, Homo sapiens
gcagcucaaugaacucaag

SEQ ID NO: 333806 - RNA, 19 nt, Homo sapiens
aaaguggaauacauggaaa

SEQ ID NO: 333807 - RNA, 19 nt, Homo sapiens
gagaucacacaacauuuau

SEQ ID NO: 333808 - RNA, 19 nt, Homo sapiens
caucaaggccacagcgauu

SEQ ID NO: 333809 - RNA, 19 nt, Homo sapiens
cuauuaaaccacuggauaa

SEQ ID NO: 333810 - RNA, 19 nt, Homo sapiens
gaaugaaauccgaaacauc

SEQ ID NO: 333811 - RNA, 19 nt, Homo sapiens
gguaauaaaucuguaucag

SEQ ID NO: 333812 - RNA, 19 nt, Homo sapiens
ggacaagaagguacuggau

SEQ ID NO: 333813 - RNA, 19 nt, Homo sapiens
gaccugagucuuuguuuua

SEQ ID NO: 333814 - RNA, 19 nt, Homo sapiens
gcacgagggaugaguugga

SEQ ID NO: 333815 - RNA, 19 nt, Homo sapiens
gaaacaucucguacaguga

SEQ ID NO: 333816 - RNA, 19 nt, Homo sapiens
gcugaaauggaauaucuga

SEQ ID NO: 333817 - RNA, 19 nt, Homo sapiens
ccagucaccuuucacuucu

SEQ ID NO: 333818 - RNA, 19 nt, Homo sapiens
ggcagcagcaagcacaaua

SEQ ID NO: 333819 - RNA, 19 nt, Homo sapiens
gauauucugcacaaugaga

SEQ ID NO: 333820 - RNA, 19 nt, Homo sapiens
ggagaaggaaagccgauuc

SEQ ID NO: 333821 - RNA, 19 nt, Homo sapiens
agaagcagauuuuagauga

SEQ ID NO: 333822 - RNA, 19 nt, Homo sapiens
ucucugaccugagucuuug

SEQ ID NO: 333823 - RNA, 19 nt, Homo sapiens
cuaguucucugaccugagu

SEQ ID NO: 333824 - RNA, 19 nt, Homo sapiens
gcagcaagcacaauaccau

SEQ ID NO: 333825 - RNA, 19 nt, Homo sapiens
gcagaugaaagaagaagca

SEQ ID NO: 333826 - RNA, 19 nt, Homo sapiens
guacagugacaaggaguuu

SEQ ID NO: 333827 - RNA, 19 nt, Homo sapiens
gauguacggugugaacuac

SEQ ID NO: 333828 - RNA, 19 nt, Homo sapiens
gggaugaagcugaaaugga

SEQ ID NO: 333829 - RNA, 19 nt, Homo sapiens
ggccaaguauggugacuac

SEQ ID NO: 333830 - RNA, 19 nt, Homo sapiens
ucacuucuuggccaaauuu

SEQ ID NO: 333831 - RNA, 19 nt, Homo sapiens
uaugugcaauugccuugaa

SEQ ID NO: 333832 - RNA, 19 nt, Homo sapiens
ugaaauggaauaucugaag

SEQ ID NO: 333833 - RNA, 19 nt, Homo sapiens
gaagguacuggaucaugau

SEQ ID NO: 333834 - RNA, 19 nt, Homo sapiens
ggauggaccagauaucaag

SEQ ID NO: 333835 - RNA, 19 nt, Homo sapiens
ccgaguggccuucuuugaa

SEQ ID NO: 333836 - RNA, 19 nt, Homo sapiens
acuauuaaaccacuggaua

SEQ ID NO: 333837 - RNA, 19 nt, Homo sapiens
ggaaaugugggaggagaga

SEQ ID NO: 333838 - RNA, 19 nt, Homo sapiens
ggaucaugauguuucaaag

SEQ ID NO: 333839 - RNA, 19 nt, Homo sapiens
aagcaacaauggccaacga

SEQ ID NO: 333840 - RNA, 19 nt, Homo sapiens
caauugccuugaacuacga

SEQ ID NO: 333841 - RNA, 19 nt, Homo sapiens
gggagacagcucuggauau

SEQ ID NO: 333842 - RNA, 19 nt, Homo sapiens
ugaaagaagaagcaacaau

SEQ ID NO: 333843 - RNA, 19 nt, Homo sapiens
gggaaccaugaucuauuua

SEQ ID NO: 333844 - RNA, 19 nt, Homo sapiens
gcugaccuguuggcugaaa

SEQ ID NO: 333845 - RNA, 19 nt, Homo sapiens
uaucagaugacuccggaaa

SEQ ID NO: 333846 - RNA, 19 nt, Homo sapiens
ccaaguauggugacuacga

SEQ ID NO: 333847 - RNA, 19 nt, Homo sapiens
gaaccagucaccuuucacu

SEQ ID NO: 333848 - RNA, 19 nt, Homo sapiens
ucucauggcguucuaguuc

SEQ ID NO: 333849 - RNA, 19 nt, Homo sapiens
gugcaauugccuugaacua

SEQ ID NO: 333850 - RNA, 19 nt, Homo sapiens
accguugccuccugacaua

SEQ ID NO: 333851 - RNA, 19 nt, Homo sapiens
gcgaagagccaagcagaag

SEQ ID NO: 333852 - RNA, 19 nt, Homo sapiens
gugacaaggaguuuacuau

SEQ ID NO: 333853 - RNA, 19 nt, Homo sapiens
aaugaaauccgaaacaucu

SEQ ID NO: 333854 - RNA, 19 nt, Homo sapiens
ggagauguacggugugaac

SEQ ID NO: 333855 - RNA, 19 nt, Homo sapiens
ggaaauagauccaauaaag

SEQ ID NO: 333856 - RNA, 19 nt, Homo sapiens
gaacgucgcugauggagaa

SEQ ID NO: 333857 - RNA, 19 nt, Homo sapiens
gaccugaacucgugccuua

SEQ ID NO: 333858 - RNA, 19 nt, Homo sapiens
gccaggagcugaacauuaa

SEQ ID NO: 333859 - RNA, 19 nt, Homo sapiens
gaacauagcacaaguaacu

SEQ ID NO: 333860 - RNA, 19 nt, Homo sapiens
guaaauaacaugcaaccua

SEQ ID NO: 333861 - RNA, 19 nt, Homo sapiens
guacauaucuaggcaucua

SEQ ID NO: 333862 - RNA, 19 nt, Homo sapiens
ccacaacaauaaccaguuu

SEQ ID NO: 333863 - RNA, 19 nt, Homo sapiens
gaaacacgguugaccugaa

SEQ ID NO: 333864 - RNA, 19 nt, Homo sapiens
guacacuccugcugccuua

SEQ ID NO: 333865 - RNA, 19 nt, Homo sapiens
guaugagucuccaacauuu

SEQ ID NO: 333866 - RNA, 19 nt, Homo sapiens
aaacagaacccacugauga

SEQ ID NO: 333867 - RNA, 19 nt, Homo sapiens
cgaauucucuggugguuga

SEQ ID NO: 333868 - RNA, 19 nt, Homo sapiens
agaaagggcucccgcagaa

SEQ ID NO: 333869 - RNA, 19 nt, Homo sapiens
ucagaugaguuacuguuaa

SEQ ID NO: 333870 - RNA, 19 nt, Homo sapiens
ggagucacgugcagccuuu

SEQ ID NO: 333871 - RNA, 19 nt, Homo sapiens
gaacagaacgucgcugaug

SEQ ID NO: 333872 - RNA, 19 nt, Homo sapiens
gaagaacacuauggcuaug

SEQ ID NO: 333873 - RNA, 19 nt, Homo sapiens
ggaagaacacuauggcuau

SEQ ID NO: 333874 - RNA, 19 nt, Homo sapiens
uauggaaccugccugaauu

SEQ ID NO: 333875 - RNA, 19 nt, Homo sapiens
cguaugagcuucggauuga

SEQ ID NO: 333876 - RNA, 19 nt, Homo sapiens
ggaaacguuugaugucugu

SEQ ID NO: 333877 - RNA, 19 nt, Homo sapiens
ggaagugccuuauuuaacc

SEQ ID NO: 333878 - RNA, 19 nt, Homo sapiens
ucagcugucuuuguaguua

SEQ ID NO: 333879 - RNA, 19 nt, Homo sapiens
uaaucuggcuucgaacaua

SEQ ID NO: 333880 - RNA, 19 nt, Homo sapiens
aagcaugguuuauucauug

SEQ ID NO: 333881 - RNA, 19 nt, Homo sapiens
ugggcacucuguacaauua

SEQ ID NO: 333882 - RNA, 19 nt, Homo sapiens
cuaggcaucuauuuaugua

SEQ ID NO: 333883 - RNA, 19 nt, Homo sapiens
gcauugaauuugcuacugu

SEQ ID NO: 333884 - RNA, 19 nt, Homo sapiens
ugugucagcugucuuugua

SEQ ID NO: 333885 - RNA, 19 nt, Homo sapiens
caucucagcucuuuuguaa

SEQ ID NO: 333886 - RNA, 19 nt, Homo sapiens
ccacagcaguaaaugaaau

SEQ ID NO: 333887 - RNA, 19 nt, Homo sapiens
acucgugccuuaggaauua

SEQ ID NO: 333888 - RNA, 19 nt, Homo sapiens
uaacuugaauagcacauca

SEQ ID NO: 333889 - RNA, 19 nt, Homo sapiens
cgccaacguuccaauuaua

SEQ ID NO: 333890 - RNA, 19 nt, Homo sapiens
gcagcugcauggcuacuug

SEQ ID NO: 333891 - RNA, 19 nt, Homo sapiens
gaagucagcggaggaagaa

SEQ ID NO: 333892 - RNA, 19 nt, Homo sapiens
ggagauggcgucccuguca

SEQ ID NO: 333893 - RNA, 19 nt, Homo sapiens
ggaaagaaacaaccugaag

SEQ ID NO: 333894 - RNA, 19 nt, Homo sapiens
gaacggcccacacgcaguu

SEQ ID NO: 333895 - RNA, 19 nt, Homo sapiens
cagaacccacugaugauua

SEQ ID NO: 333896 - RNA, 19 nt, Homo sapiens
gcacaucaauagguuacug

SEQ ID NO: 333897 - RNA, 19 nt, Homo sapiens
guuaaguccucucccaaga

SEQ ID NO: 333898 - RNA, 19 nt, Homo sapiens
cagaaacuccgacauugaa

SEQ ID NO: 333899 - RNA, 19 nt, Homo sapiens
gggcuucccugucagcaau

SEQ ID NO: 333900 - RNA, 19 nt, Homo sapiens
gaauagcacaucaauaggu

SEQ ID NO: 333901 - RNA, 19 nt, Homo sapiens
uaacaugcuucccuugucu

SEQ ID NO: 333902 - RNA, 19 nt, Homo sapiens
gcacgagcacccacuccua

SEQ ID NO: 333903 - RNA, 19 nt, Homo sapiens
ugaagucacugaacagaac

SEQ ID NO: 333904 - RNA, 19 nt, Homo sapiens
gcucagcccugcguugugu

SEQ ID NO: 333905 - RNA, 19 nt, Homo sapiens
uacuggaagugccuuauuu

SEQ ID NO: 333906 - RNA, 19 nt, Homo sapiens
gcagagaagcacccugaug

SEQ ID NO: 333907 - RNA, 19 nt, Homo sapiens
gcagagcacggacagcuau

SEQ ID NO: 333908 - RNA, 19 nt, Homo sapiens
uccagucccuuccaaguuu

SEQ ID NO: 333909 - RNA, 19 nt, Homo sapiens
gaugauuguuucacagaag

SEQ ID NO: 333910 - RNA, 19 nt, Homo sapiens
caucagggcaucauagaau

SEQ ID NO: 333911 - RNA, 19 nt, Homo sapiens
guaacaugcuucccuuguc

SEQ ID NO: 333912 - RNA, 19 nt, Homo sapiens
gaaauagauccaauaaagc

SEQ ID NO: 333913 - RNA, 19 nt, Homo sapiens
gaagugccuuauuuaacca

SEQ ID NO: 333914 - RNA, 19 nt, Homo sapiens
acagaagccuuaccacucu

SEQ ID NO: 333915 - RNA, 19 nt, Homo sapiens
aauagcacaucaauagguu

SEQ ID NO: 333916 - RNA, 19 nt, Homo sapiens
cauugaauuugcuacugua

SEQ ID NO: 333917 - RNA, 19 nt, Homo sapiens
ucauagaauugagcauuga

SEQ ID NO: 333918 - RNA, 19 nt, Homo sapiens
agaacccacugaugauuau

SEQ ID NO: 333919 - RNA, 19 nt, Homo sapiens
gagauggcgucccugucaa

SEQ ID NO: 333920 - RNA, 19 nt, Homo sapiens
guuaggaaauagauccaau

SEQ ID NO: 333921 - RNA, 19 nt, Homo sapiens
gagcacccacuccuaguug

SEQ ID NO: 333922 - RNA, 19 nt, Homo sapiens
ucagaaacuccgacauuga

SEQ ID NO: 333923 - RNA, 19 nt, Homo sapiens
gccuguaccacaacaauaa

SEQ ID NO: 333924 - RNA, 19 nt, Homo sapiens
gaacucgugccuuaggaau

SEQ ID NO: 333925 - RNA, 19 nt, Homo sapiens
uaacaugcaaccuaagugu

SEQ ID NO: 333926 - RNA, 19 nt, Homo sapiens
caucauagaauugagcauu

SEQ ID NO: 333927 - RNA, 19 nt, Homo sapiens
ccgccaacguuccaauuau

SEQ ID NO: 333928 - RNA, 19 nt, Homo sapiens
uuaccagacggcaacauua

SEQ ID NO: 333929 - RNA, 19 nt, Homo sapiens
ucaauagguuacuggacaa

SEQ ID NO: 333930 - RNA, 19 nt, Homo sapiens
gccaacguuccaauuauaa

SEQ ID NO: 333931 - RNA, 19 nt, Homo sapiens
ucgcgucucuugugucuca

SEQ ID NO: 333932 - RNA, 19 nt, Homo sapiens
cggcaacauuagaaaguga

SEQ ID NO: 333933 - RNA, 19 nt, Homo sapiens
gcaaccuaaguguaauaua

SEQ ID NO: 333934 - RNA, 19 nt, Homo sapiens
acaugcaaccuaaguguaa

SEQ ID NO: 333935 - RNA, 19 nt, Homo sapiens
cagaaacugcaaacacauu

SEQ ID NO: 333936 - RNA, 19 nt, Homo sapiens
caggagcugaacauuaaua

SEQ ID NO: 333937 - RNA, 19 nt, Homo sapiens
gaagccaguaccagcguuu

SEQ ID NO: 333938 - RNA, 19 nt, Homo sapiens
gaaaggagagacggacauc

SEQ ID NO: 333939 - RNA, 19 nt, Homo sapiens
gaacuucggaaaggagaga

SEQ ID NO: 333940 - RNA, 19 nt, Homo sapiens
cgacauugaacuucggaaa

SEQ ID NO: 333941 - RNA, 19 nt, Homo sapiens
gcagaaggaacggccugua

SEQ ID NO: 333942 - RNA, 19 nt, Homo sapiens
ucugucaucucagcucuuu

SEQ ID NO: 333943 - RNA, 19 nt, Homo sapiens
gaaggaaagcagggaggaa

SEQ ID NO: 333944 - RNA, 19 nt, Homo sapiens
gaagacguccucccuagcu

SEQ ID NO: 333945 - RNA, 19 nt, Homo sapiens
gcaacaagaggaaguacag

SEQ ID NO: 333946 - RNA, 19 nt, Homo sapiens
gaaaaggaaacguuugaug

SEQ ID NO: 333947 - RNA, 19 nt, Homo sapiens
gcugggcacucuguacaau

SEQ ID NO: 333948 - RNA, 19 nt, Homo sapiens
ccagacggcaacauuagaa

SEQ ID NO: 333949 - RNA, 19 nt, Homo sapiens
cgucagagcgagacucaga

SEQ ID NO: 333950 - RNA, 19 nt, Homo sapiens
caauaaccggcauccguuu

SEQ ID NO: 333951 - RNA, 19 nt, Homo sapiens
ggaagggagaccacugugu

SEQ ID NO: 333952 - RNA, 19 nt, Homo sapiens
ugccaggagcugaacauua

SEQ ID NO: 333953 - RNA, 19 nt, Homo sapiens
gcaggacuccaaggucauu

SEQ ID NO: 333954 - RNA, 19 nt, Homo sapiens
agacggacaucgggaggaa

SEQ ID NO: 333955 - RNA, 19 nt, Homo sapiens
ggaaauagauccaauaaag

SEQ ID NO: 333956 - RNA, 19 nt, Homo sapiens
gaacgucgcugauggagaa

SEQ ID NO: 333957 - RNA, 19 nt, Homo sapiens
gaccugaacucgugccuua

SEQ ID NO: 333958 - RNA, 19 nt, Homo sapiens
gccaggagcugaacauuaa

SEQ ID NO: 333959 - RNA, 19 nt, Homo sapiens
gaacauagcacaaguaacu

SEQ ID NO: 333960 - RNA, 19 nt, Homo sapiens
guaaauaacaugcaaccua

SEQ ID NO: 333961 - RNA, 19 nt, Homo sapiens
guacauaucuaggcaucua

SEQ ID NO: 333962 - RNA, 19 nt, Homo sapiens
ccacaacaauaaccaguuu

SEQ ID NO: 333963 - RNA, 19 nt, Homo sapiens
gaaacacgguugaccugaa

SEQ ID NO: 333964 - RNA, 19 nt, Homo sapiens
guacacuccugcugccuua

SEQ ID NO: 333965 - RNA, 19 nt, Homo sapiens
guaugagucuccaacauuu

SEQ ID NO: 333966 - RNA, 19 nt, Homo sapiens
aaacagaacccacugauga

SEQ ID NO: 333967 - RNA, 19 nt, Homo sapiens
cgaauucucuggugguuga

SEQ ID NO: 333968 - RNA, 19 nt, Homo sapiens
agaaagggcucccgcagaa

SEQ ID NO: 333969 - RNA, 19 nt, Homo sapiens
ucagaugaguuacuguuaa

SEQ ID NO: 333970 - RNA, 19 nt, Homo sapiens
gcgagagccugaagaguug

SEQ ID NO: 333971 - RNA, 19 nt, Homo sapiens
ggagucacgugcagccuuu

SEQ ID NO: 333972 - RNA, 19 nt, Homo sapiens
gaacagaacgucgcugaug

SEQ ID NO: 333973 - RNA, 19 nt, Homo sapiens
guaccuggaugacguaaau

SEQ ID NO: 333974 - RNA, 19 nt, Homo sapiens
uauggaaccugccugaauu

SEQ ID NO: 333975 - RNA, 19 nt, Homo sapiens
cguaugagcuucggauuga

SEQ ID NO: 333976 - RNA, 19 nt, Homo sapiens
ggaaacguuugaugucugu

SEQ ID NO: 333977 - RNA, 19 nt, Homo sapiens
ggaagugccuuauuuaacc

SEQ ID NO: 333978 - RNA, 19 nt, Homo sapiens
ucagcugucuuuguaguua

SEQ ID NO: 333979 - RNA, 19 nt, Homo sapiens
uaaucuggcuucgaacaua

SEQ ID NO: 333980 - RNA, 19 nt, Homo sapiens
aagcaugguuuauucauug

SEQ ID NO: 333981 - RNA, 19 nt, Homo sapiens
ugggcacucuguacaauua

SEQ ID NO: 333982 - RNA, 19 nt, Homo sapiens
cuaggcaucuauuuaugua

SEQ ID NO: 333983 - RNA, 19 nt, Homo sapiens
gcauugaauuugcuacugu

SEQ ID NO: 333984 - RNA, 19 nt, Homo sapiens
ugugucagcugucuuugua

SEQ ID NO: 333985 - RNA, 19 nt, Homo sapiens
caucucagcucuuuuguaa

SEQ ID NO: 333986 - RNA, 19 nt, Homo sapiens
acucgugccuuaggaauua

SEQ ID NO: 333987 - RNA, 19 nt, Homo sapiens
uaacuugaauagcacauca

SEQ ID NO: 333988 - RNA, 19 nt, Homo sapiens
cgccaacguuccaauuaua

SEQ ID NO: 333989 - RNA, 19 nt, Homo sapiens
gcagcugcauggcuacuug

SEQ ID NO: 333990 - RNA, 19 nt, Homo sapiens
ggagauggcgucccuguca

SEQ ID NO: 333991 - RNA, 19 nt, Homo sapiens
ggaaagaaacaaccugaag

SEQ ID NO: 333992 - RNA, 19 nt, Homo sapiens
gaacggcccacacgcaguu

SEQ ID NO: 333993 - RNA, 19 nt, Homo sapiens
cagaacccacugaugauua

SEQ ID NO: 333994 - RNA, 19 nt, Homo sapiens
gcacaucaauagguuacug

SEQ ID NO: 333995 - RNA, 19 nt, Homo sapiens
gaguuccucuucgaguuua

SEQ ID NO: 333996 - RNA, 19 nt, Homo sapiens
guuaaguccucucccaaga

SEQ ID NO: 333997 - RNA, 19 nt, Homo sapiens
cagaaacuccgacauugaa

SEQ ID NO: 333998 - RNA, 19 nt, Homo sapiens
gggcuucccugucagcaau

SEQ ID NO: 333999 - RNA, 19 nt, Homo sapiens
gaauagcacaucaauaggu

SEQ ID NO: 334000 - RNA, 19 nt, Homo sapiens
uaacaugcuucccuugucu

SEQ ID NO: 334001 - RNA, 19 nt, Homo sapiens
gcacgagcacccacuccua

SEQ ID NO: 334002 - RNA, 19 nt, Homo sapiens
ggaugacguaaaugaaaua

SEQ ID NO: 334003 - RNA, 19 nt, Homo sapiens
ugaagucacugaacagaac

SEQ ID NO: 334004 - RNA, 19 nt, Homo sapiens
gcucagcccugcguugugu

SEQ ID NO: 334005 - RNA, 19 nt, Homo sapiens
uacuggaagugccuuauuu

SEQ ID NO: 334006 - RNA, 19 nt, Homo sapiens
gcagagaagcacccugaug

SEQ ID NO: 334007 - RNA, 19 nt, Homo sapiens
gcagagcacggacagcuau

SEQ ID NO: 334008 - RNA, 19 nt, Homo sapiens
gaugauuguuucacagaag

SEQ ID NO: 334009 - RNA, 19 nt, Homo sapiens
caucagggcaucauagaau

SEQ ID NO: 334010 - RNA, 19 nt, Homo sapiens
cugaagaguuggaccaguu

SEQ ID NO: 334011 - RNA, 19 nt, Homo sapiens
guaacaugcuucccuuguc

SEQ ID NO: 334012 - RNA, 19 nt, Homo sapiens
gaaauagauccaauaaagc

SEQ ID NO: 334013 - RNA, 19 nt, Homo sapiens
gaagugccuuauuuaacca

SEQ ID NO: 334014 - RNA, 19 nt, Homo sapiens
acagaagccuuaccacucu

SEQ ID NO: 334015 - RNA, 19 nt, Homo sapiens
aauagcacaucaauagguu

SEQ ID NO: 334016 - RNA, 19 nt, Homo sapiens
cauugaauuugcuacugua

SEQ ID NO: 334017 - RNA, 19 nt, Homo sapiens
ucauagaauugagcauuga

SEQ ID NO: 334018 - RNA, 19 nt, Homo sapiens
agaacccacugaugauuau

SEQ ID NO: 334019 - RNA, 19 nt, Homo sapiens
gagauggcgucccugucaa

SEQ ID NO: 334020 - RNA, 19 nt, Homo sapiens
guuaggaaauagauccaau

SEQ ID NO: 334021 - RNA, 19 nt, Homo sapiens
gccuguaccacaacaauaa

SEQ ID NO: 334022 - RNA, 19 nt, Homo sapiens
gagcacccacuccuaguug

SEQ ID NO: 334023 - RNA, 19 nt, Homo sapiens
ucagaaacuccgacauuga

SEQ ID NO: 334024 - RNA, 19 nt, Homo sapiens
gaacucgugccuuaggaau

SEQ ID NO: 334025 - RNA, 19 nt, Homo sapiens
uaacaugcaaccuaagugu

SEQ ID NO: 334026 - RNA, 19 nt, Homo sapiens
caucauagaauugagcauu

SEQ ID NO: 334027 - RNA, 19 nt, Homo sapiens
ccgccaacguuccaauuau

SEQ ID NO: 334028 - RNA, 19 nt, Homo sapiens
uuaccagacggcaacauua

SEQ ID NO: 334029 - RNA, 19 nt, Homo sapiens
ucaauagguuacuggacaa

SEQ ID NO: 334030 - RNA, 19 nt, Homo sapiens
gccaacguuccaauuauaa

SEQ ID NO: 334031 - RNA, 19 nt, Homo sapiens
ucgcgucucuugugucuca

SEQ ID NO: 334032 - RNA, 19 nt, Homo sapiens
cggcaacauuagaaaguga

SEQ ID NO: 334033 - RNA, 19 nt, Homo sapiens
ggaccaggaguucgacuuc

SEQ ID NO: 334034 - RNA, 19 nt, Homo sapiens
gcaaccuaaguguaauaua

SEQ ID NO: 334035 - RNA, 19 nt, Homo sapiens
acaugcaaccuaaguguaa

SEQ ID NO: 334036 - RNA, 19 nt, Homo sapiens
cagaaacugcaaacacauu

SEQ ID NO: 334037 - RNA, 19 nt, Homo sapiens
caggagcugaacauuaaua

SEQ ID NO: 334038 - RNA, 19 nt, Homo sapiens
gaagccaguaccagcguuu

SEQ ID NO: 334039 - RNA, 19 nt, Homo sapiens
gaaaggagagacggacauc

SEQ ID NO: 334040 - RNA, 19 nt, Homo sapiens
gaacuucggaaaggagaga

SEQ ID NO: 334041 - RNA, 19 nt, Homo sapiens
cgacauugaacuucggaaa

SEQ ID NO: 334042 - RNA, 19 nt, Homo sapiens
gcagaaggaacggccugua

SEQ ID NO: 334043 - RNA, 19 nt, Homo sapiens
gcaacaagaggaaguacag

SEQ ID NO: 334044 - RNA, 19 nt, Homo sapiens
gaagacguccucccuagcu

SEQ ID NO: 334045 - RNA, 19 nt, Homo sapiens
ucugucaucucagcucuuu

SEQ ID NO: 334046 - RNA, 19 nt, Homo sapiens
gaaggaaagcagggaggaa

SEQ ID NO: 334047 - RNA, 19 nt, Homo sapiens
uggaugacguaaaugaaau

SEQ ID NO: 334048 - RNA, 19 nt, Homo sapiens
ccagaacacuauggcuaug

SEQ ID NO: 334049 - RNA, 19 nt, Homo sapiens
gaaaaggaaacguuugaug

SEQ ID NO: 334050 - RNA, 19 nt, Homo sapiens
gcugggcacucuguacaau

SEQ ID NO: 334051 - RNA, 19 nt, Homo sapiens
ccagacggcaacauuagaa

SEQ ID NO: 334052 - RNA, 19 nt, Homo sapiens
cgacuucgaguuccucuuc

SEQ ID NO: 334053 - RNA, 19 nt, Homo sapiens
caauaaccggcauccguuu

SEQ ID NO: 334054 - RNA, 19 nt, Homo sapiens
gcuugggccuguaccacaa

SEQ ID NO: 334055 - RNA, 19 nt, Homo sapiens
ggaaauagauccaauaaag

SEQ ID NO: 334056 - RNA, 19 nt, Homo sapiens
gaacgucgcugauggagaa

SEQ ID NO: 334057 - RNA, 19 nt, Homo sapiens
gaccugaacucgugccuua

SEQ ID NO: 334058 - RNA, 19 nt, Homo sapiens
gccaggagcugaacauuaa

SEQ ID NO: 334059 - RNA, 19 nt, Homo sapiens
gaacauagcacaaguaacu

SEQ ID NO: 334060 - RNA, 19 nt, Homo sapiens
guaaauaacaugcaaccua

SEQ ID NO: 334061 - RNA, 19 nt, Homo sapiens
guacauaucuaggcaucua

SEQ ID NO: 334062 - RNA, 19 nt, Homo sapiens
gaaacacgguugaccugaa

SEQ ID NO: 334063 - RNA, 19 nt, Homo sapiens
guacacuccugcugccuua

SEQ ID NO: 334064 - RNA, 19 nt, Homo sapiens
guaugagucuccaacauuu

SEQ ID NO: 334065 - RNA, 19 nt, Homo sapiens
aaacagaacccacugauga

SEQ ID NO: 334066 - RNA, 19 nt, Homo sapiens
cgaauucucuggugguuga

SEQ ID NO: 334067 - RNA, 19 nt, Homo sapiens
agaaagggcucccgcagaa

SEQ ID NO: 334068 - RNA, 19 nt, Homo sapiens
ucagaugaguuacuguuaa

SEQ ID NO: 334069 - RNA, 19 nt, Homo sapiens
ggagucacgugcagccuuu

SEQ ID NO: 334070 - RNA, 19 nt, Homo sapiens
gaacagaacgucgcugaug

SEQ ID NO: 334071 - RNA, 19 nt, Homo sapiens
uauggaaccugccugaauu

SEQ ID NO: 334072 - RNA, 19 nt, Homo sapiens
cguaugagcuucggauuga

SEQ ID NO: 334073 - RNA, 19 nt, Homo sapiens
ggaaacguuugaugucugu

SEQ ID NO: 334074 - RNA, 19 nt, Homo sapiens
ggaagugccuuauuuaacc

SEQ ID NO: 334075 - RNA, 19 nt, Homo sapiens
ucagcugucuuuguaguua

SEQ ID NO: 334076 - RNA, 19 nt, Homo sapiens
uaaucuggcuucgaacaua

SEQ ID NO: 334077 - RNA, 19 nt, Homo sapiens
aagcaugguuuauucauug

SEQ ID NO: 334078 - RNA, 19 nt, Homo sapiens
ugggcacucuguacaauua

SEQ ID NO: 334079 - RNA, 19 nt, Homo sapiens
cuaggcaucuauuuaugua

SEQ ID NO: 334080 - RNA, 19 nt, Homo sapiens
gcauugaauuugcuacugu

SEQ ID NO: 334081 - RNA, 19 nt, Homo sapiens
ugugucagcugucuuugua

SEQ ID NO: 334082 - RNA, 19 nt, Homo sapiens
caucucagcucuuuuguaa

SEQ ID NO: 334083 - RNA, 19 nt, Homo sapiens
ccacagcaguaaaugaaau

SEQ ID NO: 334084 - RNA, 19 nt, Homo sapiens
acucgugccuuaggaauua

SEQ ID NO: 334085 - RNA, 19 nt, Homo sapiens
uaacuugaauagcacauca

SEQ ID NO: 334086 - RNA, 19 nt, Homo sapiens
cgccaacguuccaauuaua

SEQ ID NO: 334087 - RNA, 19 nt, Homo sapiens
gcagcugcauggcuacuug

SEQ ID NO: 334088 - RNA, 19 nt, Homo sapiens
ggaaagaaacaaccugaag

SEQ ID NO: 334089 - RNA, 19 nt, Homo sapiens
gaacggcccacacgcaguu

SEQ ID NO: 334090 - RNA, 19 nt, Homo sapiens
cagaacccacugaugauua

SEQ ID NO: 334091 - RNA, 19 nt, Homo sapiens
gcacaucaauagguuacug

SEQ ID NO: 334092 - RNA, 19 nt, Homo sapiens
guuaaguccucucccaaga

SEQ ID NO: 334093 - RNA, 19 nt, Homo sapiens
cagaaacuccgacauugaa

SEQ ID NO: 334094 - RNA, 19 nt, Homo sapiens
gggcuucccugucagcaau

SEQ ID NO: 334095 - RNA, 19 nt, Homo sapiens
gaauagcacaucaauaggu

SEQ ID NO: 334096 - RNA, 19 nt, Homo sapiens
uaacaugcuucccuugucu

SEQ ID NO: 334097 - RNA, 19 nt, Homo sapiens
gcacgagcacccacuccua

SEQ ID NO: 334098 - RNA, 19 nt, Homo sapiens
ugaagucacugaacagaac

SEQ ID NO: 334099 - RNA, 19 nt, Homo sapiens
gcucagcccugcguugugu

SEQ ID NO: 334100 - RNA, 19 nt, Homo sapiens
uacuggaagugccuuauuu

SEQ ID NO: 334101 - RNA, 19 nt, Homo sapiens
gcagagaagcacccugaug

SEQ ID NO: 334102 - RNA, 19 nt, Homo sapiens
gcagagcacggacagcuau

SEQ ID NO: 334103 - RNA, 19 nt, Homo sapiens
gaugauuguuucacagaag

SEQ ID NO: 334104 - RNA, 19 nt, Homo sapiens
uccagucccuuccaaguuu

SEQ ID NO: 334105 - RNA, 19 nt, Homo sapiens
caucagggcaucauagaau

SEQ ID NO: 334106 - RNA, 19 nt, Homo sapiens
guaacaugcuucccuuguc

SEQ ID NO: 334107 - RNA, 19 nt, Homo sapiens
gaaauagauccaauaaagc

SEQ ID NO: 334108 - RNA, 19 nt, Homo sapiens
gaagugccuuauuuaacca

SEQ ID NO: 334109 - RNA, 19 nt, Homo sapiens
acagaagccuuaccacucu

SEQ ID NO: 334110 - RNA, 19 nt, Homo sapiens
aauagcacaucaauagguu

SEQ ID NO: 334111 - RNA, 19 nt, Homo sapiens
cauugaauuugcuacugua

SEQ ID NO: 334112 - RNA, 19 nt, Homo sapiens
ucauagaauugagcauuga

SEQ ID NO: 334113 - RNA, 19 nt, Homo sapiens
agaacccacugaugauuau

SEQ ID NO: 334114 - RNA, 19 nt, Homo sapiens
guuaggaaauagauccaau

SEQ ID NO: 334115 - RNA, 19 nt, Homo sapiens
gagcacccacuccuaguug

SEQ ID NO: 334116 - RNA, 19 nt, Homo sapiens
ucagaaacuccgacauuga

SEQ ID NO: 334117 - RNA, 19 nt, Homo sapiens
gaacucgugccuuaggaau

SEQ ID NO: 334118 - RNA, 19 nt, Homo sapiens
uaacaugcaaccuaagugu

SEQ ID NO: 334119 - RNA, 19 nt, Homo sapiens
caucauagaauugagcauu

SEQ ID NO: 334120 - RNA, 19 nt, Homo sapiens
ccgccaacguuccaauuau

SEQ ID NO: 334121 - RNA, 19 nt, Homo sapiens
uuaccagacggcaacauua

SEQ ID NO: 334122 - RNA, 19 nt, Homo sapiens
ucaauagguuacuggacaa

SEQ ID NO: 334123 - RNA, 19 nt, Homo sapiens
gccaacguuccaauuauaa

SEQ ID NO: 334124 - RNA, 19 nt, Homo sapiens
ucgcgucucuugugucuca

SEQ ID NO: 334125 - RNA, 19 nt, Homo sapiens
cggcaacauuagaaaguga

SEQ ID NO: 334126 - RNA, 19 nt, Homo sapiens
gcaaccuaaguguaauaua

SEQ ID NO: 334127 - RNA, 19 nt, Homo sapiens
acaugcaaccuaaguguaa

SEQ ID NO: 334128 - RNA, 19 nt, Homo sapiens
cagaaacugcaaacacauu

SEQ ID NO: 334129 - RNA, 19 nt, Homo sapiens
caggagcugaacauuaaua

SEQ ID NO: 334130 - RNA, 19 nt, Homo sapiens
gaagccaguaccagcguuu

SEQ ID NO: 334131 - RNA, 19 nt, Homo sapiens
gaaaggagagacggacauc

SEQ ID NO: 334132 - RNA, 19 nt, Homo sapiens
gaacuucggaaaggagaga

SEQ ID NO: 334133 - RNA, 19 nt, Homo sapiens
cgacauugaacuucggaaa

SEQ ID NO: 334134 - RNA, 19 nt, Homo sapiens
gcagaaggaacggccugua

SEQ ID NO: 334135 - RNA, 19 nt, Homo sapiens
ucugucaucucagcucuuu

SEQ ID NO: 334136 - RNA, 19 nt, Homo sapiens
gaaggaaagcagggaggaa

SEQ ID NO: 334137 - RNA, 19 nt, Homo sapiens
gaaaaggaaacguuugaug

SEQ ID NO: 334138 - RNA, 19 nt, Homo sapiens
gcugggcacucuguacaau

SEQ ID NO: 334139 - RNA, 19 nt, Homo sapiens
ccagacggcaacauuagaa

SEQ ID NO: 334140 - RNA, 19 nt, Homo sapiens
caauaaccggcauccguuu

SEQ ID NO: 334141 - RNA, 19 nt, Homo sapiens
cgucagagcgagacucaga

SEQ ID NO: 334142 - RNA, 19 nt, Homo sapiens
ggaagggagaccacugugu

SEQ ID NO: 334143 - RNA, 19 nt, Homo sapiens
ugccaggagcugaacauua

SEQ ID NO: 334144 - RNA, 19 nt, Homo sapiens
gcaggacuccaaggucauu

SEQ ID NO: 334145 - RNA, 19 nt, Homo sapiens
agacggacaucgggaggaa

SEQ ID NO: 334146 - RNA, 19 nt, Homo sapiens
ggacugucauugaaaagga

SEQ ID NO: 334147 - RNA, 19 nt, Homo sapiens
gcacucuguacaauuaguu

SEQ ID NO: 334148 - RNA, 19 nt, Homo sapiens
acaccaaaguccuggagau

SEQ ID NO: 334149 - RNA, 19 nt, Homo sapiens
gccggaauccugaaacuca

SEQ ID NO: 334150 - RNA, 19 nt, Homo sapiens
agaaacugcaaacacauuu

SEQ ID NO: 334151 - RNA, 19 nt, Homo sapiens
gaggaagggagaccacugu

SEQ ID NO: 334152 - RNA, 19 nt, Homo sapiens
acucagaaacuccgacauu

SEQ ID NO: 334153 - RNA, 19 nt, Homo sapiens
agagaaagcgaagccagua

SEQ ID NO: 334154 - RNA, 19 nt, Homo sapiens
aaacacgguugaccugaac

SEQ ID NO: 334155 - RNA, 19 nt, Homo sapiens
ggaaauagauccaauaaag

SEQ ID NO: 334156 - RNA, 19 nt, Homo sapiens
gaacgucgcugauggagaa

SEQ ID NO: 334157 - RNA, 19 nt, Homo sapiens
gaccugaacucgugccuua

SEQ ID NO: 334158 - RNA, 19 nt, Homo sapiens
gccaggagcugaacauuaa

SEQ ID NO: 334159 - RNA, 19 nt, Homo sapiens
gaacauagcacaaguaacu

SEQ ID NO: 334160 - RNA, 19 nt, Homo sapiens
guaaauaacaugcaaccua

SEQ ID NO: 334161 - RNA, 19 nt, Homo sapiens
guacauaucuaggcaucua

SEQ ID NO: 334162 - RNA, 19 nt, Homo sapiens
ccacaacaauaaccaguuu

SEQ ID NO: 334163 - RNA, 19 nt, Homo sapiens
gaaacacgguugaccugaa

SEQ ID NO: 334164 - RNA, 19 nt, Homo sapiens
guacacuccugcugccuua

SEQ ID NO: 334165 - RNA, 19 nt, Homo sapiens
guaugagucuccaacauuu

SEQ ID NO: 334166 - RNA, 19 nt, Homo sapiens
aaacagaacccacugauga

SEQ ID NO: 334167 - RNA, 19 nt, Homo sapiens
cgaauucucuggugguuga

SEQ ID NO: 334168 - RNA, 19 nt, Homo sapiens
agaaagggcucccgcagaa

SEQ ID NO: 334169 - RNA, 19 nt, Homo sapiens
ucagaugaguuacuguuaa

SEQ ID NO: 334170 - RNA, 19 nt, Homo sapiens
ggagucacgugcagccuuu

SEQ ID NO: 334171 - RNA, 19 nt, Homo sapiens
gaacagaacgucgcugaug

SEQ ID NO: 334172 - RNA, 19 nt, Homo sapiens
uauggaaccugccugaauu

SEQ ID NO: 334173 - RNA, 19 nt, Homo sapiens
cguaugagcuucggauuga

SEQ ID NO: 334174 - RNA, 19 nt, Homo sapiens
ggaaacguuugaugucugu

SEQ ID NO: 334175 - RNA, 19 nt, Homo sapiens
ggaagugccuuauuuaacc

SEQ ID NO: 334176 - RNA, 19 nt, Homo sapiens
ucagcugucuuuguaguua

SEQ ID NO: 334177 - RNA, 19 nt, Homo sapiens
uaaucuggcuucgaacaua

SEQ ID NO: 334178 - RNA, 19 nt, Homo sapiens
aagcaugguuuauucauug

SEQ ID NO: 334179 - RNA, 19 nt, Homo sapiens
ugggcacucuguacaauua

SEQ ID NO: 334180 - RNA, 19 nt, Homo sapiens
cuaggcaucuauuuaugua

SEQ ID NO: 334181 - RNA, 19 nt, Homo sapiens
gcauugaauuugcuacugu

SEQ ID NO: 334182 - RNA, 19 nt, Homo sapiens
ugugucagcugucuuugua

SEQ ID NO: 334183 - RNA, 19 nt, Homo sapiens
caucucagcucuuuuguaa

SEQ ID NO: 334184 - RNA, 19 nt, Homo sapiens
ccacagcaguaaaugaaau

SEQ ID NO: 334185 - RNA, 19 nt, Homo sapiens
acucgugccuuaggaauua

SEQ ID NO: 334186 - RNA, 19 nt, Homo sapiens
uaacuugaauagcacauca

SEQ ID NO: 334187 - RNA, 19 nt, Homo sapiens
cgccaacguuccaauuaua

SEQ ID NO: 334188 - RNA, 19 nt, Homo sapiens
gcagcugcauggcuacuug

SEQ ID NO: 334189 - RNA, 19 nt, Homo sapiens
ggagauggcgucccuguca

SEQ ID NO: 334190 - RNA, 19 nt, Homo sapiens
ggaaagaaacaaccugaag

SEQ ID NO: 334191 - RNA, 19 nt, Homo sapiens
gaacggcccacacgcaguu

SEQ ID NO: 334192 - RNA, 19 nt, Homo sapiens
cagaacccacugaugauua

SEQ ID NO: 334193 - RNA, 19 nt, Homo sapiens
gcacaucaauagguuacug

SEQ ID NO: 334194 - RNA, 19 nt, Homo sapiens
gaguuccucuucgaguuua

SEQ ID NO: 334195 - RNA, 19 nt, Homo sapiens
guuaaguccucucccaaga

SEQ ID NO: 334196 - RNA, 19 nt, Homo sapiens
cagaaacuccgacauugaa

SEQ ID NO: 334197 - RNA, 19 nt, Homo sapiens
gggcuucccugucagcaau

SEQ ID NO: 334198 - RNA, 19 nt, Homo sapiens
gaauagcacaucaauaggu

SEQ ID NO: 334199 - RNA, 19 nt, Homo sapiens
uaacaugcuucccuugucu

SEQ ID NO: 334200 - RNA, 19 nt, Homo sapiens
gcacgagcacccacuccua

SEQ ID NO: 334201 - RNA, 19 nt, Homo sapiens
ugaagucacugaacagaac

SEQ ID NO: 334202 - RNA, 19 nt, Homo sapiens
gcucagcccugcguugugu

SEQ ID NO: 334203 - RNA, 19 nt, Homo sapiens
uacuggaagugccuuauuu

SEQ ID NO: 334204 - RNA, 19 nt, Homo sapiens
gcagagaagcacccugaug

SEQ ID NO: 334205 - RNA, 19 nt, Homo sapiens
gcagagcacggacagcuau

SEQ ID NO: 334206 - RNA, 19 nt, Homo sapiens
gaugauuguuucacagaag

SEQ ID NO: 334207 - RNA, 19 nt, Homo sapiens
caucagggcaucauagaau

SEQ ID NO: 334208 - RNA, 19 nt, Homo sapiens
guaacaugcuucccuuguc

SEQ ID NO: 334209 - RNA, 19 nt, Homo sapiens
gaaauagauccaauaaagc

SEQ ID NO: 334210 - RNA, 19 nt, Homo sapiens
gaagugccuuauuuaacca

SEQ ID NO: 334211 - RNA, 19 nt, Homo sapiens
acagaagccuuaccacucu

SEQ ID NO: 334212 - RNA, 19 nt, Homo sapiens
aauagcacaucaauagguu

SEQ ID NO: 334213 - RNA, 19 nt, Homo sapiens
cauugaauuugcuacugua

SEQ ID NO: 334214 - RNA, 19 nt, Homo sapiens
ucauagaauugagcauuga

SEQ ID NO: 334215 - RNA, 19 nt, Homo sapiens
agaacccacugaugauuau

SEQ ID NO: 334216 - RNA, 19 nt, Homo sapiens
gagauggcgucccugucaa

SEQ ID NO: 334217 - RNA, 19 nt, Homo sapiens
guuaggaaauagauccaau

SEQ ID NO: 334218 - RNA, 19 nt, Homo sapiens
gccuguaccacaacaauaa

SEQ ID NO: 334219 - RNA, 19 nt, Homo sapiens
gagcacccacuccuaguug

SEQ ID NO: 334220 - RNA, 19 nt, Homo sapiens
ucagaaacuccgacauuga

SEQ ID NO: 334221 - RNA, 19 nt, Homo sapiens
gaacucgugccuuaggaau

SEQ ID NO: 334222 - RNA, 19 nt, Homo sapiens
uaacaugcaaccuaagugu

SEQ ID NO: 334223 - RNA, 19 nt, Homo sapiens
caucauagaauugagcauu

SEQ ID NO: 334224 - RNA, 19 nt, Homo sapiens
ccgccaacguuccaauuau

SEQ ID NO: 334225 - RNA, 19 nt, Homo sapiens
uuaccagacggcaacauua

SEQ ID NO: 334226 - RNA, 19 nt, Homo sapiens
ucaauagguuacuggacaa

SEQ ID NO: 334227 - RNA, 19 nt, Homo sapiens
gccaacguuccaauuauaa

SEQ ID NO: 334228 - RNA, 19 nt, Homo sapiens
ucgcgucucuugugucuca

SEQ ID NO: 334229 - RNA, 19 nt, Homo sapiens
cggcaacauuagaaaguga

SEQ ID NO: 334230 - RNA, 19 nt, Homo sapiens
ggaccaggaguucgacuuc

SEQ ID NO: 334231 - RNA, 19 nt, Homo sapiens
gcaaccuaaguguaauaua

SEQ ID NO: 334232 - RNA, 19 nt, Homo sapiens
acaugcaaccuaaguguaa

SEQ ID NO: 334233 - RNA, 19 nt, Homo sapiens
cagaaacugcaaacacauu

SEQ ID NO: 334234 - RNA, 19 nt, Homo sapiens
caggagcugaacauuaaua

SEQ ID NO: 334235 - RNA, 19 nt, Homo sapiens
gaagccaguaccagcguuu

SEQ ID NO: 334236 - RNA, 19 nt, Homo sapiens
gaaaggagagacggacauc

SEQ ID NO: 334237 - RNA, 19 nt, Homo sapiens
gaacuucggaaaggagaga

SEQ ID NO: 334238 - RNA, 19 nt, Homo sapiens
cgacauugaacuucggaaa

SEQ ID NO: 334239 - RNA, 19 nt, Homo sapiens
gcagaaggaacggccugua

SEQ ID NO: 334240 - RNA, 19 nt, Homo sapiens
ucugucaucucagcucuuu

SEQ ID NO: 334241 - RNA, 19 nt, Homo sapiens
gcaacaagaggaaguacag

SEQ ID NO: 334242 - RNA, 19 nt, Homo sapiens
gaaggaaagcagggaggaa

SEQ ID NO: 334243 - RNA, 19 nt, Homo sapiens
gaagacguccucccuagcu

SEQ ID NO: 334244 - RNA, 19 nt, Homo sapiens
ccagaacacuauggcuaug

SEQ ID NO: 334245 - RNA, 19 nt, Homo sapiens
gaaaaggaaacguuugaug

SEQ ID NO: 334246 - RNA, 19 nt, Homo sapiens
gcugggcacucuguacaau

SEQ ID NO: 334247 - RNA, 19 nt, Homo sapiens
ccagacggcaacauuagaa

SEQ ID NO: 334248 - RNA, 19 nt, Homo sapiens
cgacuucgaguuccucuuc

SEQ ID NO: 334249 - RNA, 19 nt, Homo sapiens
gcuugggccuguaccacaa

SEQ ID NO: 334250 - RNA, 19 nt, Homo sapiens
caauaaccggcauccguuu

SEQ ID NO: 334251 - RNA, 19 nt, Homo sapiens
ggaagggagaccacugugu

SEQ ID NO: 334252 - RNA, 19 nt, Homo sapiens
ugccaggagcugaacauua

SEQ ID NO: 334253 - RNA, 19 nt, Homo sapiens
gcaggacuccaaggucauu

SEQ ID NO: 334254 - RNA, 19 nt, Homo sapiens
agacggacaucgggaggaa

SEQ ID NO: 334255 - RNA, 19 nt, Homo sapiens
gcaggcaccuuuaggaaua

SEQ ID NO: 334256 - RNA, 19 nt, Homo sapiens
gaaacgacgucgccguaaa

SEQ ID NO: 334257 - RNA, 19 nt, Homo sapiens
ccacaacaauaaccaguuu

SEQ ID NO: 334258 - RNA, 19 nt, Homo sapiens
cgaauucucuggugguuga

SEQ ID NO: 334259 - RNA, 19 nt, Homo sapiens
gaagaacacuauggcuaug

SEQ ID NO: 334260 - RNA, 19 nt, Homo sapiens
ggaagaacacuauggcuau

SEQ ID NO: 334261 - RNA, 19 nt, Homo sapiens
cguaugagcuucggauuga

SEQ ID NO: 334262 - RNA, 19 nt, Homo sapiens
guccugauguggucuuuaa

SEQ ID NO: 334263 - RNA, 19 nt, Homo sapiens
gcagcugcauggcuacuug

SEQ ID NO: 334264 - RNA, 19 nt, Homo sapiens
ggagauggcgucccuguca

SEQ ID NO: 334265 - RNA, 19 nt, Homo sapiens
gaagucagcggaggaagaa

SEQ ID NO: 334266 - RNA, 19 nt, Homo sapiens
gguaacgccaucuuucuaa

SEQ ID NO: 334267 - RNA, 19 nt, Homo sapiens
cagaaacuccgacauugaa

SEQ ID NO: 334268 - RNA, 19 nt, Homo sapiens
cuuuaaggauggugaauga

SEQ ID NO: 334269 - RNA, 19 nt, Homo sapiens
ggaagcuucggaugcauuu

SEQ ID NO: 334270 - RNA, 19 nt, Homo sapiens
caacgguaacgccaucuuu

SEQ ID NO: 334271 - RNA, 19 nt, Homo sapiens
gcagagcacggacagcuau

SEQ ID NO: 334272 - RNA, 19 nt, Homo sapiens
uccagucccuuccaaguuu

SEQ ID NO: 334273 - RNA, 19 nt, Homo sapiens
gagauggcgucccugucaa

SEQ ID NO: 334274 - RNA, 19 nt, Homo sapiens
ucagaaacuccgacauuga

SEQ ID NO: 334275 - RNA, 19 nt, Homo sapiens
gccuguaccacaacaauaa

SEQ ID NO: 334276 - RNA, 19 nt, Homo sapiens
cagauagucacgguuauuu

SEQ ID NO: 334277 - RNA, 19 nt, Homo sapiens
gauggugaaugagcuuugu

SEQ ID NO: 334278 - RNA, 19 nt, Homo sapiens
gaaaaggcaaauagguaua

SEQ ID NO: 334279 - RNA, 19 nt, Homo sapiens
acucagauagucacgguua

SEQ ID NO: 334280 - RNA, 19 nt, Homo sapiens
gaagccaguaccagcguuu

SEQ ID NO: 334281 - RNA, 19 nt, Homo sapiens
gaaaggagagacggacauc

SEQ ID NO: 334282 - RNA, 19 nt, Homo sapiens
gaacuucggaaaggagaga

SEQ ID NO: 334283 - RNA, 19 nt, Homo sapiens
cgacauugaacuucggaaa

SEQ ID NO: 334284 - RNA, 19 nt, Homo sapiens
agccaucgaugcccugaaa

SEQ ID NO: 334285 - RNA, 19 nt, Homo sapiens
gcaacaagaggaaguacag

SEQ ID NO: 334286 - RNA, 19 nt, Homo sapiens
gaagacguccucccuagcu

SEQ ID NO: 334287 - RNA, 19 nt, Homo sapiens
guggcguguugcacauuua

SEQ ID NO: 334288 - RNA, 19 nt, Homo sapiens
aaagcagcguggcguguug

SEQ ID NO: 334289 - RNA, 19 nt, Homo sapiens
gcaggacuccaaggucauu

SEQ ID NO: 334290 - RNA, 19 nt, Homo sapiens
agacggacaucgggaggaa

SEQ ID NO: 334291 - RNA, 19 nt, Homo sapiens
cgucagagcgagacucaga

SEQ ID NO: 334292 - RNA, 19 nt, Homo sapiens
gcuugggccuguaccacaa

SEQ ID NO: 334293 - RNA, 19 nt, Homo sapiens
agagaaagcgaagccagua

SEQ ID NO: 334294 - RNA, 19 nt, Homo sapiens
acucagaaacuccgacauu

SEQ ID NO: 334295 - RNA, 19 nt, Homo sapiens
gccggaauccugaaacuca

SEQ ID NO: 334296 - RNA, 19 nt, Homo sapiens
acaccaaaguccuggagau

SEQ ID NO: 334297 - RNA, 19 nt, Homo sapiens
acugugugaugucccguua

SEQ ID NO: 334298 - RNA, 19 nt, Homo sapiens
ugugaugucccguuaguga

SEQ ID NO: 334299 - RNA, 19 nt, Homo sapiens
ggaaaggagagacggacau

SEQ ID NO: 334300 - RNA, 19 nt, Homo sapiens
cucagaaacuccgacauug

SEQ ID NO: 334301 - RNA, 19 nt, Homo sapiens
ggagguguuuuccagcuuu

SEQ ID NO: 334302 - RNA, 19 nt, Homo sapiens
gggaagcuucggaugcauu

SEQ ID NO: 334303 - RNA, 19 nt, Homo sapiens
cguggcguguugcacauuu

SEQ ID NO: 334304 - RNA, 19 nt, Homo sapiens
ggccuguaccacaacaaua

SEQ ID NO: 334305 - RNA, 19 nt, Homo sapiens
guaacgccaucuuucuaac

SEQ ID NO: 334306 - RNA, 19 nt, Homo sapiens
cugauguggucuuuaagga

SEQ ID NO: 334307 - RNA, 19 nt, Homo sapiens
caggcaccuuuaggaauaa

SEQ ID NO: 334308 - RNA, 19 nt, Homo sapiens
ugaagucagcggaggaaga

SEQ ID NO: 334309 - RNA, 19 nt, Homo sapiens
cagcggaggaagaacacua

SEQ ID NO: 334310 - RNA, 19 nt, Homo sapiens
gugaaaaggcaaauaggua

SEQ ID NO: 334311 - RNA, 19 nt, Homo sapiens
gauagucacgguuauuuug

SEQ ID NO: 334312 - RNA, 19 nt, Homo sapiens
ucagauagucacgguuauu

SEQ ID NO: 334313 - RNA, 19 nt, Homo sapiens
aggcaaauagguauagcua

SEQ ID NO: 334314 - RNA, 19 nt, Homo sapiens
uaaagcagcguggcguguu

SEQ ID NO: 334315 - RNA, 19 nt, Homo sapiens
cguaagccgugaacaugag

SEQ ID NO: 334316 - RNA, 19 nt, Homo sapiens
aaacuccgacauugaacuu

SEQ ID NO: 334317 - RNA, 19 nt, Homo sapiens
cagcaugcgagccgucauu

SEQ ID NO: 334318 - RNA, 19 nt, Homo sapiens
cgggagaggagaaacuuug

SEQ ID NO: 334319 - RNA, 19 nt, Homo sapiens
aaacgacgucgccguaaag

SEQ ID NO: 334320 - RNA, 19 nt, Homo sapiens
gccgaauucucuggugguu

SEQ ID NO: 334321 - RNA, 19 nt, Homo sapiens
acauugaacuucggaaagg

SEQ ID NO: 334322 - RNA, 19 nt, Homo sapiens
gacauugaacuucggaaag

SEQ ID NO: 334323 - RNA, 19 nt, Homo sapiens
gaaacuccgacauugaacu

SEQ ID NO: 334324 - RNA, 19 nt, Homo sapiens
gcaugcgagccgucauuga

SEQ ID NO: 334325 - RNA, 19 nt, Homo sapiens
agaaugagccgcugaugcu

SEQ ID NO: 334326 - RNA, 19 nt, Homo sapiens
ccugucaagucccgcaaga

SEQ ID NO: 334327 - RNA, 19 nt, Homo sapiens
gaaagcgaagccaguacca

SEQ ID NO: 334328 - RNA, 19 nt, Homo sapiens
gaccugugcaagccgaauu

SEQ ID NO: 334329 - RNA, 19 nt, Homo sapiens
gggcaacaccacccaguac

SEQ ID NO: 334330 - RNA, 19 nt, Homo sapiens
cguccucccuagcuccaaa

SEQ ID NO: 334331 - RNA, 19 nt, Homo sapiens
aagggaagcuucggaugca

SEQ ID NO: 334332 - RNA, 19 nt, Homo sapiens
ggauggugaaugagcuuug

SEQ ID NO: 334333 - RNA, 19 nt, Homo sapiens
gggaaaacauggcucuucu

SEQ ID NO: 334334 - RNA, 19 nt, Homo sapiens
gcuucuugcgaauguauaa

SEQ ID NO: 334335 - RNA, 19 nt, Homo sapiens
gggguugcauacucagaua

SEQ ID NO: 334336 - RNA, 19 nt, Homo sapiens
ugugugaugucccguuagu

SEQ ID NO: 334337 - RNA, 19 nt, Homo sapiens
cgguaacgccaucuuucua

SEQ ID NO: 334338 - RNA, 19 nt, Homo sapiens
gagguguuuuccagcuuua

SEQ ID NO: 334339 - RNA, 19 nt, Homo sapiens
ccgugggaauggcuccuuu

SEQ ID NO: 334340 - RNA, 19 nt, Homo sapiens
agaacacuauggcuaugca

SEQ ID NO: 334341 - RNA, 19 nt, Homo sapiens
ggagaaugagccgcugaug

SEQ ID NO: 334342 - RNA, 19 nt, Homo sapiens
ggucuucgggagaggagaa

SEQ ID NO: 334343 - RNA, 19 nt, Homo sapiens
aaacaucccugcucauuau

SEQ ID NO: 334344 - RNA, 19 nt, Homo sapiens
caccuuagcuggauacaaa

SEQ ID NO: 334345 - RNA, 19 nt, Homo sapiens
ccaauaaugucaccucgaa

SEQ ID NO: 334346 - RNA, 19 nt, Homo sapiens
ccaaaguuguguuuacuga

SEQ ID NO: 334347 - RNA, 19 nt, Homo sapiens
cccagaaccucgccaauaa

SEQ ID NO: 334348 - RNA, 19 nt, Homo sapiens
gaacuucuacgucaucaau

SEQ ID NO: 334349 - RNA, 19 nt, Homo sapiens
gaccacagauggacagcaa

SEQ ID NO: 334350 - RNA, 19 nt, Homo sapiens
gaucauggaugcccugaac

SEQ ID NO: 334351 - RNA, 19 nt, Homo sapiens
gaauaucggaacaagcaua

SEQ ID NO: 334352 - RNA, 19 nt, Homo sapiens
agacggagcccacggauga

SEQ ID NO: 334353 - RNA, 19 nt, Homo sapiens
aaaguuguguuuacugaga

SEQ ID NO: 334354 - RNA, 19 nt, Homo sapiens
gcagaaucgucucuuuaca

SEQ ID NO: 334355 - RNA, 19 nt, Homo sapiens
ggacuucagaucuucauug

SEQ ID NO: 334356 - RNA, 19 nt, Homo sapiens
agaaucgucucuuuacaga

SEQ ID NO: 334357 - RNA, 19 nt, Homo sapiens
gcggggaucuugaagcuua

SEQ ID NO: 334358 - RNA, 19 nt, Homo sapiens
gagaaacucggcuccagaa

SEQ ID NO: 334359 - RNA, 19 nt, Homo sapiens
caccagcuaugagaagaua

SEQ ID NO: 334360 - RNA, 19 nt, Homo sapiens
agacggacauuggaagaaa

SEQ ID NO: 334361 - RNA, 19 nt, Homo sapiens
gcugaugagcggauccuua

SEQ ID NO: 334362 - RNA, 19 nt, Homo sapiens
aaacaagccucugggacuu

SEQ ID NO: 334363 - RNA, 19 nt, Homo sapiens
gaaacucggcuccagaauc

SEQ ID NO: 334364 - RNA, 19 nt, Homo sapiens
acagauggacagcaaauuu

SEQ ID NO: 334365 - RNA, 19 nt, Homo sapiens
gacaagagccagcccaaca

SEQ ID NO: 334366 - RNA, 19 nt, Homo sapiens
gaaccucgccaauaauguc

SEQ ID NO: 334367 - RNA, 19 nt, Homo sapiens
gaacgaagaagagccgaau

SEQ ID NO: 334368 - RNA, 19 nt, Homo sapiens
agaccuacuuggaugauga

SEQ ID NO: 334369 - RNA, 19 nt, Homo sapiens
gcccaugguugaaagacaa

SEQ ID NO: 334370 - RNA, 19 nt, Homo sapiens
uuguugagaucccugaaua

SEQ ID NO: 334371 - RNA, 19 nt, Homo sapiens
gagcagggcgagaggagaa

SEQ ID NO: 334372 - RNA, 19 nt, Homo sapiens
gaagagccgaaugcacaua

SEQ ID NO: 334373 - RNA, 19 nt, Homo sapiens
cauauccgcacaccuguaa

SEQ ID NO: 334374 - RNA, 19 nt, Homo sapiens
gauagugggcaacaccaaa

SEQ ID NO: 334375 - RNA, 19 nt, Homo sapiens
uggcagaaucgucucuuua

SEQ ID NO: 334376 - RNA, 19 nt, Homo sapiens
gcucugccgugaucaugga

SEQ ID NO: 334377 - RNA, 19 nt, Homo sapiens
ggaccagaccuacuuggau

SEQ ID NO: 334378 - RNA, 19 nt, Homo sapiens
gaaaggcgagacggacauu

SEQ ID NO: 334379 - RNA, 19 nt, Homo sapiens
gcuuagaaacgccgacauu

SEQ ID NO: 334380 - RNA, 19 nt, Homo sapiens
gaauaugaccccacucuga

SEQ ID NO: 334381 - RNA, 19 nt, Homo sapiens
uuagaaacgccgacauuga

SEQ ID NO: 334382 - RNA, 19 nt, Homo sapiens
aaacucggcuccagaaucc

SEQ ID NO: 334383 - RNA, 19 nt, Homo sapiens
cgaccuguguccgcaguuu

SEQ ID NO: 334384 - RNA, 19 nt, Homo sapiens
acacacaccuuagcuggau

SEQ ID NO: 334385 - RNA, 19 nt, Homo sapiens
cagauggacagcaaauuug

SEQ ID NO: 334386 - RNA, 19 nt, Homo sapiens
caccaaaguccuggagaua

SEQ ID NO: 334387 - RNA, 19 nt, Homo sapiens
gaugaugagcugauagaca

SEQ ID NO: 334388 - RNA, 19 nt, Homo sapiens
gaaagacaagacacagaca

SEQ ID NO: 334389 - RNA, 19 nt, Homo sapiens
guggcagaaucgucucuuu

SEQ ID NO: 334390 - RNA, 19 nt, Homo sapiens
cugaugagcggauccuuaa

SEQ ID NO: 334391 - RNA, 19 nt, Homo sapiens
gcugauagacacacaccuu

SEQ ID NO: 334392 - RNA, 19 nt, Homo sapiens
ccauuaaacaggagcagaa

SEQ ID NO: 334393 - RNA, 19 nt, Homo sapiens
cagaaugccacgagccaaa

SEQ ID NO: 334394 - RNA, 19 nt, Homo sapiens
guauuugaauccgaacgaa

SEQ ID NO: 334395 - RNA, 19 nt, Homo sapiens
gacuucagaucuucauugg

SEQ ID NO: 334396 - RNA, 19 nt, Homo sapiens
caucauguacugcgagaau

SEQ ID NO: 334397 - RNA, 19 nt, Homo sapiens
gagcugcccaugguugaaa

SEQ ID NO: 334398 - RNA, 19 nt, Homo sapiens
ccucuucgacuaugaguau

SEQ ID NO: 334399 - RNA, 19 nt, Homo sapiens
cagaaccucgccaauaaug

SEQ ID NO: 334400 - RNA, 19 nt, Homo sapiens
ggaguuccagcacaucaug

SEQ ID NO: 334401 - RNA, 19 nt, Homo sapiens
ggagcccacggaugaauau

SEQ ID NO: 334402 - RNA, 19 nt, Homo sapiens
cgucaucaaugggaagaga

SEQ ID NO: 334403 - RNA, 19 nt, Homo sapiens
gcauauccgcacaccugua

SEQ ID NO: 334404 - RNA, 19 nt, Homo sapiens
ccacagauggacagcaaau

SEQ ID NO: 334405 - RNA, 19 nt, Homo sapiens
uuacugagaagaccacaga

SEQ ID NO: 334406 - RNA, 19 nt, Homo sapiens
acaccaaaguccuggagau

SEQ ID NO: 334407 - RNA, 19 nt, Homo sapiens
gacuaugaguauuugaauc

SEQ ID NO: 334408 - RNA, 19 nt, Homo sapiens
uuaaacaggagcagaacuu

SEQ ID NO: 334409 - RNA, 19 nt, Homo sapiens
aagacgagcuugacuucuc

SEQ ID NO: 334410 - RNA, 19 nt, Homo sapiens
cugauagacacacaccuua

SEQ ID NO: 334411 - RNA, 19 nt, Homo sapiens
ugaccaaaaggaaguauua

SEQ ID NO: 334412 - RNA, 19 nt, Homo sapiens
ugacuucuccauccucuuc

SEQ ID NO: 334413 - RNA, 19 nt, Homo sapiens
caagagccagcccaacaug

SEQ ID NO: 334414 - RNA, 19 nt, Homo sapiens
uagaaacgccgacauugag

SEQ ID NO: 334415 - RNA, 19 nt, Homo sapiens
cgacuaugaguauuugaau

SEQ ID NO: 334416 - RNA, 19 nt, Homo sapiens
ucauguacugcgagaauuu

SEQ ID NO: 334417 - RNA, 19 nt, Homo sapiens
gcaaauuugggagauggaa

SEQ ID NO: 334418 - RNA, 19 nt, Homo sapiens
gacagcaaauuugggagau

SEQ ID NO: 334419 - RNA, 19 nt, Homo sapiens
gacauuggaagaaagaaca

SEQ ID NO: 334420 - RNA, 19 nt, Homo sapiens
gagaagauagugggcaaca

SEQ ID NO: 334421 - RNA, 19 nt, Homo sapiens
gaaugccacgagccaaaga

SEQ ID NO: 334422 - RNA, 19 nt, Homo sapiens
caaaacaucccugcucauu

SEQ ID NO: 334423 - RNA, 19 nt, Homo sapiens
gagccaaagagccgccaaa

SEQ ID NO: 334424 - RNA, 19 nt, Homo sapiens
ggaaaggcgagacggacau

SEQ ID NO: 334425 - RNA, 19 nt, Homo sapiens
acauugagcugcggaaagg

SEQ ID NO: 334426 - RNA, 19 nt, Homo sapiens
gcggaagccaccaggaguu

SEQ ID NO: 334427 - RNA, 19 nt, Homo sapiens
acagcugccuggucuaugg

SEQ ID NO: 334428 - RNA, 19 nt, Homo sapiens
cuuuacagacugcaucuaa

SEQ ID NO: 334429 - RNA, 19 nt, Homo sapiens
gagacggacauuggaagaa

SEQ ID NO: 334430 - RNA, 19 nt, Homo sapiens
ccaaaguccuggagauacc

SEQ ID NO: 334431 - RNA, 19 nt, Homo sapiens
gaucacuccgucccacgaa

SEQ ID NO: 334432 - RNA, 19 nt, Homo sapiens
ccucgccugugauccacua

SEQ ID NO: 334433 - RNA, 19 nt, Homo sapiens
gcacaccuguaaaagugaa

SEQ ID NO: 334434 - RNA, 19 nt, Homo sapiens
cgaguccaaaguuguguuu

SEQ ID NO: 334435 - RNA, 19 nt, Homo sapiens
ggcagaaucgucucuuuac

SEQ ID NO: 334436 - RNA, 19 nt, Homo sapiens
gagggcaaccaucgacugu

SEQ ID NO: 334437 - RNA, 19 nt, Homo sapiens
ccagucagucaggcucuua

SEQ ID NO: 334438 - RNA, 19 nt, Homo sapiens
uaaacaggagcagaacuug

SEQ ID NO: 334439 - RNA, 19 nt, Homo sapiens
guugagaucccugaauauc

SEQ ID NO: 334440 - RNA, 19 nt, Homo sapiens
ugagaagaccacagaugga

SEQ ID NO: 334441 - RNA, 19 nt, Homo sapiens
ggaucuugaagcuuagaaa

SEQ ID NO: 334442 - RNA, 19 nt, Homo sapiens
cuucgacuaugaguauuug

SEQ ID NO: 334443 - RNA, 19 nt, Homo sapiens
aaacaucccugcucauuau

SEQ ID NO: 334444 - RNA, 19 nt, Homo sapiens
ccaauaaugucaccucgaa

SEQ ID NO: 334445 - RNA, 19 nt, Homo sapiens
ccaaaguuguguuuacuga

SEQ ID NO: 334446 - RNA, 19 nt, Homo sapiens
cccagaaccucgccaauaa

SEQ ID NO: 334447 - RNA, 19 nt, Homo sapiens
gaacuucuacgucaucaau

SEQ ID NO: 334448 - RNA, 19 nt, Homo sapiens
gaccacagauggacagcaa

SEQ ID NO: 334449 - RNA, 19 nt, Homo sapiens
cuacuuggaugauguuaau

SEQ ID NO: 334450 - RNA, 19 nt, Homo sapiens
gaucauggaugcccugaac

SEQ ID NO: 334451 - RNA, 19 nt, Homo sapiens
gaauaucggaacaagcaua

SEQ ID NO: 334452 - RNA, 19 nt, Homo sapiens
gaaaucagacguaaaagaa

SEQ ID NO: 334453 - RNA, 19 nt, Homo sapiens
agacggagcccacggauga

SEQ ID NO: 334454 - RNA, 19 nt, Homo sapiens
aaaguuguguuuacugaga

SEQ ID NO: 334455 - RNA, 19 nt, Homo sapiens
gcagaaucgucucuuuaca

SEQ ID NO: 334456 - RNA, 19 nt, Homo sapiens
ggacuucagaucuucauug

SEQ ID NO: 334457 - RNA, 19 nt, Homo sapiens
agaaucgucucuuuacaga

SEQ ID NO: 334458 - RNA, 19 nt, Homo sapiens
gcggggaucuugaagcuua

SEQ ID NO: 334459 - RNA, 19 nt, Homo sapiens
gagaaacucggcuccagaa

SEQ ID NO: 334460 - RNA, 19 nt, Homo sapiens
caccagcuaugagaagaua

SEQ ID NO: 334461 - RNA, 19 nt, Homo sapiens
agacggacauuggaagaaa

SEQ ID NO: 334462 - RNA, 19 nt, Homo sapiens
gcugaugagcggauccuua

SEQ ID NO: 334463 - RNA, 19 nt, Homo sapiens
aaacaagccucugggacuu

SEQ ID NO: 334464 - RNA, 19 nt, Homo sapiens
gaaacucggcuccagaauc

SEQ ID NO: 334465 - RNA, 19 nt, Homo sapiens
acagauggacagcaaauuu

SEQ ID NO: 334466 - RNA, 19 nt, Homo sapiens
gacaagagccagcccaaca

SEQ ID NO: 334467 - RNA, 19 nt, Homo sapiens
gaaccucgccaauaauguc

SEQ ID NO: 334468 - RNA, 19 nt, Homo sapiens
gaacgaagaagagccgaau

SEQ ID NO: 334469 - RNA, 19 nt, Homo sapiens
gcccaugguugaaagacaa

SEQ ID NO: 334470 - RNA, 19 nt, Homo sapiens
uuguugagaucccugaaua

SEQ ID NO: 334471 - RNA, 19 nt, Homo sapiens
gagcagggcgagaggagaa

SEQ ID NO: 334472 - RNA, 19 nt, Homo sapiens
gaagagccgaaugcacaua

SEQ ID NO: 334473 - RNA, 19 nt, Homo sapiens
cauauccgcacaccuguaa

SEQ ID NO: 334474 - RNA, 19 nt, Homo sapiens
gauagugggcaacaccaaa

SEQ ID NO: 334475 - RNA, 19 nt, Homo sapiens
uggcagaaucgucucuuua

SEQ ID NO: 334476 - RNA, 19 nt, Homo sapiens
gcucugccgugaucaugga

SEQ ID NO: 334477 - RNA, 19 nt, Homo sapiens
ggaccagaccuacuuggau

SEQ ID NO: 334478 - RNA, 19 nt, Homo sapiens
gaaaggcgagacggacauu

SEQ ID NO: 334479 - RNA, 19 nt, Homo sapiens
gcuuagaaacgccgacauu

SEQ ID NO: 334480 - RNA, 19 nt, Homo sapiens
gaauaugaccccacucuga

SEQ ID NO: 334481 - RNA, 19 nt, Homo sapiens
uuagaaacgccgacauuga

SEQ ID NO: 334482 - RNA, 19 nt, Homo sapiens
aaacucggcuccagaaucc

SEQ ID NO: 334483 - RNA, 19 nt, Homo sapiens
cgaccuguguccgcaguuu

SEQ ID NO: 334484 - RNA, 19 nt, Homo sapiens
ccagaaaucagacguaaaa

SEQ ID NO: 334485 - RNA, 19 nt, Homo sapiens
cagauggacagcaaauuug

SEQ ID NO: 334486 - RNA, 19 nt, Homo sapiens
caccaaaguccuggagaua

SEQ ID NO: 334487 - RNA, 19 nt, Homo sapiens
aaagaagccauuauagcaa

SEQ ID NO: 334488 - RNA, 19 nt, Homo sapiens
gaaagacaagacacagaca

SEQ ID NO: 334489 - RNA, 19 nt, Homo sapiens
guggcagaaucgucucuuu

SEQ ID NO: 334490 - RNA, 19 nt, Homo sapiens
cugaugagcggauccuuaa

SEQ ID NO: 334491 - RNA, 19 nt, Homo sapiens
ugccagaaaucagacguaa

SEQ ID NO: 334492 - RNA, 19 nt, Homo sapiens
ccauuaaacaggagcagaa

SEQ ID NO: 334493 - RNA, 19 nt, Homo sapiens
cagaaugccacgagccaaa

SEQ ID NO: 334494 - RNA, 19 nt, Homo sapiens
guauuugaauccgaacgaa

SEQ ID NO: 334495 - RNA, 19 nt, Homo sapiens
gacuucagaucuucauugg

SEQ ID NO: 334496 - RNA, 19 nt, Homo sapiens
agaccuacuuggaugaugu

SEQ ID NO: 334497 - RNA, 19 nt, Homo sapiens
caucauguacugcgagaau

SEQ ID NO: 334498 - RNA, 19 nt, Homo sapiens
gagcugcccaugguugaaa

SEQ ID NO: 334499 - RNA, 19 nt, Homo sapiens
ccucuucgacuaugaguau

SEQ ID NO: 334500 - RNA, 19 nt, Homo sapiens
cagaaccucgccaauaaug

SEQ ID NO: 334501 - RNA, 19 nt, Homo sapiens
ggaguuccagcacaucaug

SEQ ID NO: 334502 - RNA, 19 nt, Homo sapiens
ggagcccacggaugaauau

SEQ ID NO: 334503 - RNA, 19 nt, Homo sapiens
cgucaucaaugggaagaga

SEQ ID NO: 334504 - RNA, 19 nt, Homo sapiens
gcauauccgcacaccugua

SEQ ID NO: 334505 - RNA, 19 nt, Homo sapiens
ccacagauggacagcaaau

SEQ ID NO: 334506 - RNA, 19 nt, Homo sapiens
uuacugagaagaccacaga

SEQ ID NO: 334507 - RNA, 19 nt, Homo sapiens
acaccaaaguccuggagau

SEQ ID NO: 334508 - RNA, 19 nt, Homo sapiens
gacuaugaguauuugaauc

SEQ ID NO: 334509 - RNA, 19 nt, Homo sapiens
cguaaaagaagccauuaua

SEQ ID NO: 334510 - RNA, 19 nt, Homo sapiens
uuaaacaggagcagaacuu

SEQ ID NO: 334511 - RNA, 19 nt, Homo sapiens
aagacgagcuugacuucuc

SEQ ID NO: 334512 - RNA, 19 nt, Homo sapiens
ugaccaaaaggaaguauua

SEQ ID NO: 334513 - RNA, 19 nt, Homo sapiens
ugacuucuccauccucuuc

SEQ ID NO: 334514 - RNA, 19 nt, Homo sapiens
caagagccagcccaacaug

SEQ ID NO: 334515 - RNA, 19 nt, Homo sapiens
cgacuaugaguauuugaau

SEQ ID NO: 334516 - RNA, 19 nt, Homo sapiens
uagaaacgccgacauugag

SEQ ID NO: 334517 - RNA, 19 nt, Homo sapiens
ucauguacugcgagaauuu

SEQ ID NO: 334518 - RNA, 19 nt, Homo sapiens
gcaaauuugggagauggaa

SEQ ID NO: 334519 - RNA, 19 nt, Homo sapiens
gacagcaaauuugggagau

SEQ ID NO: 334520 - RNA, 19 nt, Homo sapiens
gacauuggaagaaagaaca

SEQ ID NO: 334521 - RNA, 19 nt, Homo sapiens
gagaagauagugggcaaca

SEQ ID NO: 334522 - RNA, 19 nt, Homo sapiens
gaaugccacgagccaaaga

SEQ ID NO: 334523 - RNA, 19 nt, Homo sapiens
caaaacaucccugcucauu

SEQ ID NO: 334524 - RNA, 19 nt, Homo sapiens
gagccaaagagccgccaaa

SEQ ID NO: 334525 - RNA, 19 nt, Homo sapiens
ggaaaggcgagacggacau

SEQ ID NO: 334526 - RNA, 19 nt, Homo sapiens
acauugagcugcggaaagg

SEQ ID NO: 334527 - RNA, 19 nt, Homo sapiens
cauuauagcaagacaccuu

SEQ ID NO: 334528 - RNA, 19 nt, Homo sapiens
gcggaagccaccaggaguu

SEQ ID NO: 334529 - RNA, 19 nt, Homo sapiens
acagcugccuggucuaugg

SEQ ID NO: 334530 - RNA, 19 nt, Homo sapiens
cuuuacagacugcaucuaa

SEQ ID NO: 334531 - RNA, 19 nt, Homo sapiens
gagacggacauuggaagaa

SEQ ID NO: 334532 - RNA, 19 nt, Homo sapiens
ccaaaguccuggagauacc

SEQ ID NO: 334533 - RNA, 19 nt, Homo sapiens
gaucacuccgucccacgaa

SEQ ID NO: 334534 - RNA, 19 nt, Homo sapiens
ccucgccugugauccacua

SEQ ID NO: 334535 - RNA, 19 nt, Homo sapiens
gcacaccuguaaaagugaa

SEQ ID NO: 334536 - RNA, 19 nt, Homo sapiens
cgaguccaaaguuguguuu

SEQ ID NO: 334537 - RNA, 19 nt, Homo sapiens
ggcagaaucgucucuuuac

SEQ ID NO: 334538 - RNA, 19 nt, Homo sapiens
gagggcaaccaucgacugu

SEQ ID NO: 334539 - RNA, 19 nt, Homo sapiens
ccagucagucaggcucuua

SEQ ID NO: 334540 - RNA, 19 nt, Homo sapiens
cuuggaugauguuaaugaa

SEQ ID NO: 334541 - RNA, 19 nt, Homo sapiens
uaaacaggagcagaacuug

SEQ ID NO: 334542 - RNA, 19 nt, Homo sapiens
guugagaucccugaauauc

SEQ ID NO: 334543 - RNA, 19 nt, Homo sapiens
caacuugucuuccuauuaa

SEQ ID NO: 334544 - RNA, 19 nt, Homo sapiens
gaagaugaccuacagauaa

SEQ ID NO: 334545 - RNA, 19 nt, Homo sapiens
ggacagagaaguuugauuu

SEQ ID NO: 334546 - RNA, 19 nt, Homo sapiens
gaagauacguggcucaaug

SEQ ID NO: 334547 - RNA, 19 nt, Homo sapiens
ggacaucucuuagcccaua

SEQ ID NO: 334548 - RNA, 19 nt, Homo sapiens
gcagcaggcucucuuguuu

SEQ ID NO: 334549 - RNA, 19 nt, Homo sapiens
ugaaggaacuugugagauu

SEQ ID NO: 334550 - RNA, 19 nt, Homo sapiens
gagaagagauugauuuguc

SEQ ID NO: 334551 - RNA, 19 nt, Homo sapiens
ggaaaggccuucuagagau

SEQ ID NO: 334552 - RNA, 19 nt, Homo sapiens
ggacagcacucaacucaag

SEQ ID NO: 334553 - RNA, 19 nt, Homo sapiens
gcacucaacucaagcacaa

SEQ ID NO: 334554 - RNA, 19 nt, Homo sapiens
gccaauaaaucuacaaaug

SEQ ID NO: 334555 - RNA, 19 nt, Homo sapiens
gagaugagaguguuaguaa

SEQ ID NO: 334556 - RNA, 19 nt, Homo sapiens
agaauuagaugcacaugaa

SEQ ID NO: 334557 - RNA, 19 nt, Homo sapiens
gaaauggccuaaccacagu

SEQ ID NO: 334558 - RNA, 19 nt, Homo sapiens
gaaucgcuuucacauauuu

SEQ ID NO: 334559 - RNA, 19 nt, Homo sapiens
ggagagacaugucccagau

SEQ ID NO: 334560 - RNA, 19 nt, Homo sapiens
aaauagaagugcaaccuaa

SEQ ID NO: 334561 - RNA, 19 nt, Homo sapiens
ggaccaacuugucuuccua

SEQ ID NO: 334562 - RNA, 19 nt, Homo sapiens
gaaguuccuccauaucaua

SEQ ID NO: 334563 - RNA, 19 nt, Homo sapiens
gacagcagaugaucgauau

SEQ ID NO: 334564 - RNA, 19 nt, Homo sapiens
gaagaaacuuggcaucaac

SEQ ID NO: 334565 - RNA, 19 nt, Homo sapiens
cauuaaaccugaaccagaa

SEQ ID NO: 334566 - RNA, 19 nt, Homo sapiens
gcaccuucauccuuaauau

SEQ ID NO: 334567 - RNA, 19 nt, Homo sapiens
aaauggaggucaugaaaug

SEQ ID NO: 334568 - RNA, 19 nt, Homo sapiens
ucaagaacuuccucauauu

SEQ ID NO: 334569 - RNA, 19 nt, Homo sapiens
gauaauaauugccaguaca

SEQ ID NO: 334570 - RNA, 19 nt, Homo sapiens
guaaauggaggucaugaaa

SEQ ID NO: 334571 - RNA, 19 nt, Homo sapiens
aaacugauauuggcagaaa

SEQ ID NO: 334572 - RNA, 19 nt, Homo sapiens
gaaaggccuucuagagauc

SEQ ID NO: 334573 - RNA, 19 nt, Homo sapiens
uuacaucuaucucuccuaa

SEQ ID NO: 334574 - RNA, 19 nt, Homo sapiens
gcucaagaacuuccucaua

SEQ ID NO: 334575 - RNA, 19 nt, Homo sapiens
ggacagcagaugaucgaua

SEQ ID NO: 334576 - RNA, 19 nt, Homo sapiens
ccaccuccaucuacuuuaa

SEQ ID NO: 334577 - RNA, 19 nt, Homo sapiens
gaaggaacuugugagauuc

SEQ ID NO: 334578 - RNA, 19 nt, Homo sapiens
gggcaacugugagcauuaa

SEQ ID NO: 334579 - RNA, 19 nt, Homo sapiens
aaacuuggcaucaacagua

SEQ ID NO: 334580 - RNA, 19 nt, Homo sapiens
agagacaugucccagauuu

SEQ ID NO: 334581 - RNA, 19 nt, Homo sapiens
guaaagaacagcauaugau

SEQ ID NO: 334582 - RNA, 19 nt, Homo sapiens
aagaugaccuacagauaaa

SEQ ID NO: 334583 - RNA, 19 nt, Homo sapiens
gcagaaagaauacuagagu

SEQ ID NO: 334584 - RNA, 19 nt, Homo sapiens
agaucaagcugccauacua

SEQ ID NO: 334585 - RNA, 19 nt, Homo sapiens
ggagguagaagggaagaua

SEQ ID NO: 334586 - RNA, 19 nt, Homo sapiens
gaaguacaguaucaacagu

SEQ ID NO: 334587 - RNA, 19 nt, Homo sapiens
aauaauaugucagccagua

SEQ ID NO: 334588 - RNA, 19 nt, Homo sapiens
ccacuuugcuuaccacauc

SEQ ID NO: 334589 - RNA, 19 nt, Homo sapiens
gaagcaagaacacagagaa

SEQ ID NO: 334590 - RNA, 19 nt, Homo sapiens
ggacuuggacacucauuau

SEQ ID NO: 334591 - RNA, 19 nt, Homo sapiens
gaacaccagccaucagguu

SEQ ID NO: 334592 - RNA, 19 nt, Homo sapiens
gaacacagagaagagauug

SEQ ID NO: 334593 - RNA, 19 nt, Homo sapiens
caagaacuuccucauauug

SEQ ID NO: 334594 - RNA, 19 nt, Homo sapiens
cucaagaacuuccucauau

SEQ ID NO: 334595 - RNA, 19 nt, Homo sapiens
ggugauuuguacugcuuua

SEQ ID NO: 334596 - RNA, 19 nt, Homo sapiens
cuuaauaugucacaguuug

SEQ ID NO: 334597 - RNA, 19 nt, Homo sapiens
gaagcugcagcccgauuua

SEQ ID NO: 334598 - RNA, 19 nt, Homo sapiens
uagcuaggauuggugauuu

SEQ ID NO: 334599 - RNA, 19 nt, Homo sapiens
gaggugaacgagauaauug

SEQ ID NO: 334600 - RNA, 19 nt, Homo sapiens
gcaaacuaauguuguguac

SEQ ID NO: 334601 - RNA, 19 nt, Homo sapiens
uaugauuccuucuccaauu

SEQ ID NO: 334602 - RNA, 19 nt, Homo sapiens
guacaaaaguucuggaaau

SEQ ID NO: 334603 - RNA, 19 nt, Homo sapiens
ccacuagacuggccuuuac

SEQ ID NO: 334604 - RNA, 19 nt, Homo sapiens
uaccgggagucuucucuua

SEQ ID NO: 334605 - RNA, 19 nt, Homo sapiens
gcagagaaauggccuaacc

SEQ ID NO: 334606 - RNA, 19 nt, Homo sapiens
ucaguuccuucacccuuua

SEQ ID NO: 334607 - RNA, 19 nt, Homo sapiens
gcucaaugcuucuguccau

SEQ ID NO: 334608 - RNA, 19 nt, Homo sapiens
ucacucaccuguuccuuca

SEQ ID NO: 334609 - RNA, 19 nt, Homo sapiens
ccaacuugucuuccuauua

SEQ ID NO: 334610 - RNA, 19 nt, Homo sapiens
gggcucacauuguccuuga

SEQ ID NO: 334611 - RNA, 19 nt, Homo sapiens
gcauccauuuacaucuuua

SEQ ID NO: 334612 - RNA, 19 nt, Homo sapiens
gaugacuacugcaaacugu

SEQ ID NO: 334613 - RNA, 19 nt, Homo sapiens
ugucuucaguuccaucuuu

SEQ ID NO: 334614 - RNA, 19 nt, Homo sapiens
ccagcggucugcucaagaa

SEQ ID NO: 334615 - RNA, 19 nt, Homo sapiens
gcaagccaagagauaauaa

SEQ ID NO: 334616 - RNA, 19 nt, Homo sapiens
uuuacgaccucaugcauuu

SEQ ID NO: 334617 - RNA, 19 nt, Homo sapiens
ugaagaugaccuacagaua

SEQ ID NO: 334618 - RNA, 19 nt, Homo sapiens
gaacagcauaugauuccuu

SEQ ID NO: 334619 - RNA, 19 nt, Homo sapiens
gagauaauaauugccagua

SEQ ID NO: 334620 - RNA, 19 nt, Homo sapiens
gccaagagauaauaauugc

SEQ ID NO: 334621 - RNA, 19 nt, Homo sapiens
ggaagugugacagaagaua

SEQ ID NO: 334622 - RNA, 19 nt, Homo sapiens
agaagaaacuuggcaucaa

SEQ ID NO: 334623 - RNA, 19 nt, Homo sapiens
gugcauccauuuacaucuu

SEQ ID NO: 334624 - RNA, 19 nt, Homo sapiens
gagaagaaacuuggcauca

SEQ ID NO: 334625 - RNA, 19 nt, Homo sapiens
cuuaccacaucauggauua

SEQ ID NO: 334626 - RNA, 19 nt, Homo sapiens
acagagaagagauugauuu

SEQ ID NO: 334627 - RNA, 19 nt, Homo sapiens
gggaagauaaucagggaaa

SEQ ID NO: 334628 - RNA, 19 nt, Homo sapiens
cagcagaugaucgauauuu

SEQ ID NO: 334629 - RNA, 19 nt, Homo sapiens
gcauguuucucuccuugga

SEQ ID NO: 334630 - RNA, 19 nt, Homo sapiens
gaugaccaauuuauaucug

SEQ ID NO: 334631 - RNA, 19 nt, Homo sapiens
cagaagaucgagagccuaa

SEQ ID NO: 334632 - RNA, 19 nt, Homo sapiens
gggauaucauuguucaaau

SEQ ID NO: 334633 - RNA, 19 nt, Homo sapiens
augcaacucuuucugguuu

SEQ ID NO: 334634 - RNA, 19 nt, Homo sapiens
gaugagaguguuaguaaag

SEQ ID NO: 334635 - RNA, 19 nt, Homo sapiens
cgacuuguguuucguguac

SEQ ID NO: 334636 - RNA, 19 nt, Homo sapiens
aaacuccgcaauucagaua

SEQ ID NO: 334637 - RNA, 19 nt, Homo sapiens
aauuagagcuguguucaga

SEQ ID NO: 334638 - RNA, 19 nt, Homo sapiens
gcccaaguauucaaauuac

SEQ ID NO: 334639 - RNA, 19 nt, Homo sapiens
gauuuguacugcuuuaugg

SEQ ID NO: 334640 - RNA, 19 nt, Homo sapiens
ggaaaugaacuuugcuuuu

SEQ ID NO: 334641 - RNA, 19 nt, Homo sapiens
ucaaauacaggacaaagau

SEQ ID NO: 334642 - RNA, 19 nt, Homo sapiens
cgacuucaaacucgucuuu

SEQ ID NO: 334643 - RNA, 19 nt, Homo sapiens
caacuugucuuccuauuaa

SEQ ID NO: 334644 - RNA, 19 nt, Homo sapiens
gaagaugaccuacagauaa

SEQ ID NO: 334645 - RNA, 19 nt, Homo sapiens
ggacagagaaguuugauuu

SEQ ID NO: 334646 - RNA, 19 nt, Homo sapiens
gaagauacguggcucaaug

SEQ ID NO: 334647 - RNA, 19 nt, Homo sapiens
ggacaucucuuagcccaua

SEQ ID NO: 334648 - RNA, 19 nt, Homo sapiens
gcagcaggcucucuuguuu

SEQ ID NO: 334649 - RNA, 19 nt, Homo sapiens
ugaaggaacuugugagauu

SEQ ID NO: 334650 - RNA, 19 nt, Homo sapiens
gagaagagauugauuuguc

SEQ ID NO: 334651 - RNA, 19 nt, Homo sapiens
ggaaaggccuucuagagau

SEQ ID NO: 334652 - RNA, 19 nt, Homo sapiens
ggacagcacucaacucaag

SEQ ID NO: 334653 - RNA, 19 nt, Homo sapiens
gcacucaacucaagcacaa

SEQ ID NO: 334654 - RNA, 19 nt, Homo sapiens
gccaauaaaucuacaaaug

SEQ ID NO: 334655 - RNA, 19 nt, Homo sapiens
gagaugagaguguuaguaa

SEQ ID NO: 334656 - RNA, 19 nt, Homo sapiens
agaauuagaugcacaugaa

SEQ ID NO: 334657 - RNA, 19 nt, Homo sapiens
gaaucgcuuucacauauuu

SEQ ID NO: 334658 - RNA, 19 nt, Homo sapiens
gaugauuuguuuaccagua

SEQ ID NO: 334659 - RNA, 19 nt, Homo sapiens
ggagagacaugucccagau

SEQ ID NO: 334660 - RNA, 19 nt, Homo sapiens
aaauagaagugcaaccuaa

SEQ ID NO: 334661 - RNA, 19 nt, Homo sapiens
ggaccaacuugucuuccua

SEQ ID NO: 334662 - RNA, 19 nt, Homo sapiens
gaaguuccuccauaucaua

SEQ ID NO: 334663 - RNA, 19 nt, Homo sapiens
gacagcagaugaucgauau

SEQ ID NO: 334664 - RNA, 19 nt, Homo sapiens
gaagaaacuuggcaucaac

SEQ ID NO: 334665 - RNA, 19 nt, Homo sapiens
cauuaaaccugaaccagaa

SEQ ID NO: 334666 - RNA, 19 nt, Homo sapiens
gcaccuucauccuuaauau

SEQ ID NO: 334667 - RNA, 19 nt, Homo sapiens
aaauggaggucaugaaaug

SEQ ID NO: 334668 - RNA, 19 nt, Homo sapiens
ucaagaacuuccucauauu

SEQ ID NO: 334669 - RNA, 19 nt, Homo sapiens
gauaauaauugccaguaca

SEQ ID NO: 334670 - RNA, 19 nt, Homo sapiens
guaaauggaggucaugaaa

SEQ ID NO: 334671 - RNA, 19 nt, Homo sapiens
aaacugauauuggcagaaa

SEQ ID NO: 334672 - RNA, 19 nt, Homo sapiens
gaaaggccuucuagagauc

SEQ ID NO: 334673 - RNA, 19 nt, Homo sapiens
uuacaucuaucucuccuaa

SEQ ID NO: 334674 - RNA, 19 nt, Homo sapiens
gcucaagaacuuccucaua

SEQ ID NO: 334675 - RNA, 19 nt, Homo sapiens
ggacagcagaugaucgaua

SEQ ID NO: 334676 - RNA, 19 nt, Homo sapiens
ccaccuccaucuacuuuaa

SEQ ID NO: 334677 - RNA, 19 nt, Homo sapiens
gaaggaacuugugagauuc

SEQ ID NO: 334678 - RNA, 19 nt, Homo sapiens
gggcaacugugagcauuaa

SEQ ID NO: 334679 - RNA, 19 nt, Homo sapiens
aaacuuggcaucaacagua

SEQ ID NO: 334680 - RNA, 19 nt, Homo sapiens
agagacaugucccagauuu

SEQ ID NO: 334681 - RNA, 19 nt, Homo sapiens
guaaagaacagcauaugau

SEQ ID NO: 334682 - RNA, 19 nt, Homo sapiens
aagaugaccuacagauaaa

SEQ ID NO: 334683 - RNA, 19 nt, Homo sapiens
gcagaaagaauacuagagu

SEQ ID NO: 334684 - RNA, 19 nt, Homo sapiens
agaucaagcugccauacua

SEQ ID NO: 334685 - RNA, 19 nt, Homo sapiens
ggagguagaagggaagaua

SEQ ID NO: 334686 - RNA, 19 nt, Homo sapiens
gaaguacaguaucaacagu

SEQ ID NO: 334687 - RNA, 19 nt, Homo sapiens
aauaauaugucagccagua

SEQ ID NO: 334688 - RNA, 19 nt, Homo sapiens
ccacuuugcuuaccacauc

SEQ ID NO: 334689 - RNA, 19 nt, Homo sapiens
gaagcaagaacacagagaa

SEQ ID NO: 334690 - RNA, 19 nt, Homo sapiens
ggacuuggacacucauuau

SEQ ID NO: 334691 - RNA, 19 nt, Homo sapiens
gaacacagagaagagauug

SEQ ID NO: 334692 - RNA, 19 nt, Homo sapiens
caagaacuuccucauauug

SEQ ID NO: 334693 - RNA, 19 nt, Homo sapiens
cucaagaacuuccucauau

SEQ ID NO: 334694 - RNA, 19 nt, Homo sapiens
ggugauuuguacugcuuua

SEQ ID NO: 334695 - RNA, 19 nt, Homo sapiens
cuuaauaugucacaguuug

SEQ ID NO: 334696 - RNA, 19 nt, Homo sapiens
gaagcugcagcccgauuua

SEQ ID NO: 334697 - RNA, 19 nt, Homo sapiens
uagcuaggauuggugauuu

SEQ ID NO: 334698 - RNA, 19 nt, Homo sapiens
gcaaacuaauguuguguac

SEQ ID NO: 334699 - RNA, 19 nt, Homo sapiens
uaugauuccuucuccaauu

SEQ ID NO: 334700 - RNA, 19 nt, Homo sapiens
guacaaaaguucuggaaau

SEQ ID NO: 334701 - RNA, 19 nt, Homo sapiens
ccacuagacuggccuuuac

SEQ ID NO: 334702 - RNA, 19 nt, Homo sapiens
uaccgggagucuucucuua

SEQ ID NO: 334703 - RNA, 19 nt, Homo sapiens
cacuuuagaugaugauuug

SEQ ID NO: 334704 - RNA, 19 nt, Homo sapiens
ucaguuccuucacccuuua

SEQ ID NO: 334705 - RNA, 19 nt, Homo sapiens
gcucaaugcuucuguccau

SEQ ID NO: 334706 - RNA, 19 nt, Homo sapiens
ucacucaccuguuccuuca

SEQ ID NO: 334707 - RNA, 19 nt, Homo sapiens
ccaacuugucuuccuauua

SEQ ID NO: 334708 - RNA, 19 nt, Homo sapiens
gggcucacauuguccuuga

SEQ ID NO: 334709 - RNA, 19 nt, Homo sapiens
gcauccauuuacaucuuua

SEQ ID NO: 334710 - RNA, 19 nt, Homo sapiens
gaugacuacugcaaacugu

SEQ ID NO: 334711 - RNA, 19 nt, Homo sapiens
ugucuucaguuccaucuuu

SEQ ID NO: 334712 - RNA, 19 nt, Homo sapiens
ccagcggucugcucaagaa

SEQ ID NO: 334713 - RNA, 19 nt, Homo sapiens
gcaagccaagagauaauaa

SEQ ID NO: 334714 - RNA, 19 nt, Homo sapiens
uuuacgaccucaugcauuu

SEQ ID NO: 334715 - RNA, 19 nt, Homo sapiens
ugaagaugaccuacagaua

SEQ ID NO: 334716 - RNA, 19 nt, Homo sapiens
gaacagcauaugauuccuu

SEQ ID NO: 334717 - RNA, 19 nt, Homo sapiens
gagauaauaauugccagua

SEQ ID NO: 334718 - RNA, 19 nt, Homo sapiens
gccaagagauaauaauugc

SEQ ID NO: 334719 - RNA, 19 nt, Homo sapiens
ggaagugugacagaagaua

SEQ ID NO: 334720 - RNA, 19 nt, Homo sapiens
agaagaaacuuggcaucaa

SEQ ID NO: 334721 - RNA, 19 nt, Homo sapiens
gugcauccauuuacaucuu

SEQ ID NO: 334722 - RNA, 19 nt, Homo sapiens
gagaagaaacuuggcauca

SEQ ID NO: 334723 - RNA, 19 nt, Homo sapiens
acagagaagagauugauuu

SEQ ID NO: 334724 - RNA, 19 nt, Homo sapiens
gggaagauaaucagggaaa

SEQ ID NO: 334725 - RNA, 19 nt, Homo sapiens
cagcagaugaucgauauuu

SEQ ID NO: 334726 - RNA, 19 nt, Homo sapiens
cuuaccacaucauggauua

SEQ ID NO: 334727 - RNA, 19 nt, Homo sapiens
gcauguuucucuccuugga

SEQ ID NO: 334728 - RNA, 19 nt, Homo sapiens
gaugaugauuuguuuacca

SEQ ID NO: 334729 - RNA, 19 nt, Homo sapiens
cagaagaucgagagccuaa

SEQ ID NO: 334730 - RNA, 19 nt, Homo sapiens
gggauaucauuguucaaau

SEQ ID NO: 334731 - RNA, 19 nt, Homo sapiens
augcaacucuuucugguuu

SEQ ID NO: 334732 - RNA, 19 nt, Homo sapiens
gaugagaguguuaguaaag

SEQ ID NO: 334733 - RNA, 19 nt, Homo sapiens
cgacuuguguuucguguac

SEQ ID NO: 334734 - RNA, 19 nt, Homo sapiens
aaacuccgcaauucagaua

SEQ ID NO: 334735 - RNA, 19 nt, Homo sapiens
aauuagagcuguguucaga

SEQ ID NO: 334736 - RNA, 19 nt, Homo sapiens
gcccaaguauucaaauuac

SEQ ID NO: 334737 - RNA, 19 nt, Homo sapiens
gauuuguacugcuuuaugg

SEQ ID NO: 334738 - RNA, 19 nt, Homo sapiens
ggaaaugaacuuugcuuuu

SEQ ID NO: 334739 - RNA, 19 nt, Homo sapiens
ucaaauacaggacaaagau

SEQ ID NO: 334740 - RNA, 19 nt, Homo sapiens
cgacuucaaacucgucuuu

SEQ ID NO: 334741 - RNA, 19 nt, Homo sapiens
uccaguggcugaccagauu

SEQ ID NO: 334742 - RNA, 19 nt, Homo sapiens
caaccacugucauccauac

SEQ ID NO: 334743 - RNA, 19 nt, Homo sapiens
caacuugucuuccuauuaa

SEQ ID NO: 334744 - RNA, 19 nt, Homo sapiens
gaagaugaccuacagauaa

SEQ ID NO: 334745 - RNA, 19 nt, Homo sapiens
ggacagagaaguuugauuu

SEQ ID NO: 334746 - RNA, 19 nt, Homo sapiens
gaagauacguggcucaaug

SEQ ID NO: 334747 - RNA, 19 nt, Homo sapiens
ggacaucucuuagcccaua

SEQ ID NO: 334748 - RNA, 19 nt, Homo sapiens
ugaaggaacuugugagauu

SEQ ID NO: 334749 - RNA, 19 nt, Homo sapiens
gagaagagauugauuuguc

SEQ ID NO: 334750 - RNA, 19 nt, Homo sapiens
ggaaaggccuucuagagau

SEQ ID NO: 334751 - RNA, 19 nt, Homo sapiens
gagcuaagaucgcgccauu

SEQ ID NO: 334752 - RNA, 19 nt, Homo sapiens
ggacagcacucaacucaag

SEQ ID NO: 334753 - RNA, 19 nt, Homo sapiens
gcacucaacucaagcacaa

SEQ ID NO: 334754 - RNA, 19 nt, Homo sapiens
gccaauaaaucuacaaaug

SEQ ID NO: 334755 - RNA, 19 nt, Homo sapiens
gagaugagaguguuaguaa

SEQ ID NO: 334756 - RNA, 19 nt, Homo sapiens
agaauuagaugcacaugaa

SEQ ID NO: 334757 - RNA, 19 nt, Homo sapiens
gaaucgcuuucacauauuu

SEQ ID NO: 334758 - RNA, 19 nt, Homo sapiens
aaauagaagugcaaccuaa

SEQ ID NO: 334759 - RNA, 19 nt, Homo sapiens
guaacgcugucucuacuaa

SEQ ID NO: 334760 - RNA, 19 nt, Homo sapiens
guucaucucugauauguuc

SEQ ID NO: 334761 - RNA, 19 nt, Homo sapiens
ggaccaacuugucuuccua

SEQ ID NO: 334762 - RNA, 19 nt, Homo sapiens
gaaguuccuccauaucaua

SEQ ID NO: 334763 - RNA, 19 nt, Homo sapiens
gacagcagaugaucgauau

SEQ ID NO: 334764 - RNA, 19 nt, Homo sapiens
gaagaaacuuggcaucaac

SEQ ID NO: 334765 - RNA, 19 nt, Homo sapiens
cauuaaaccugaaccagaa

SEQ ID NO: 334766 - RNA, 19 nt, Homo sapiens
gcaccuucauccuuaauau

SEQ ID NO: 334767 - RNA, 19 nt, Homo sapiens
aaauggaggucaugaaaug

SEQ ID NO: 334768 - RNA, 19 nt, Homo sapiens
ucaagaacuuccucauauu

SEQ ID NO: 334769 - RNA, 19 nt, Homo sapiens
gauaauaauugccaguaca

SEQ ID NO: 334770 - RNA, 19 nt, Homo sapiens
guaaauggaggucaugaaa

SEQ ID NO: 334771 - RNA, 19 nt, Homo sapiens
aaacugauauuggcagaaa

SEQ ID NO: 334772 - RNA, 19 nt, Homo sapiens
gaaaggccuucuagagauc

SEQ ID NO: 334773 - RNA, 19 nt, Homo sapiens
uuacaucuaucucuccuaa

SEQ ID NO: 334774 - RNA, 19 nt, Homo sapiens
gcucaagaacuuccucaua

SEQ ID NO: 334775 - RNA, 19 nt, Homo sapiens
ggacagcagaugaucgaua

SEQ ID NO: 334776 - RNA, 19 nt, Homo sapiens
ccaccuccaucuacuuuaa

SEQ ID NO: 334777 - RNA, 19 nt, Homo sapiens
gaaggaacuugugagauuc

SEQ ID NO: 334778 - RNA, 19 nt, Homo sapiens
uauauaacuuugccaggua

SEQ ID NO: 334779 - RNA, 19 nt, Homo sapiens
guaaguucaucucugauau

SEQ ID NO: 334780 - RNA, 19 nt, Homo sapiens
gggcaacugugagcauuaa

SEQ ID NO: 334781 - RNA, 19 nt, Homo sapiens
aaacuuggcaucaacagua

SEQ ID NO: 334782 - RNA, 19 nt, Homo sapiens
guaaagaacagcauaugau

SEQ ID NO: 334783 - RNA, 19 nt, Homo sapiens
aagaugaccuacagauaaa

SEQ ID NO: 334784 - RNA, 19 nt, Homo sapiens
gcagaaagaauacuagagu

SEQ ID NO: 334785 - RNA, 19 nt, Homo sapiens
agaucaagcugccauacua

SEQ ID NO: 334786 - RNA, 19 nt, Homo sapiens
ggagguagaagggaagaua

SEQ ID NO: 334787 - RNA, 19 nt, Homo sapiens
gaaguacaguaucaacagu

SEQ ID NO: 334788 - RNA, 19 nt, Homo sapiens
aauaauaugucagccagua

SEQ ID NO: 334789 - RNA, 19 nt, Homo sapiens
ccacuuugcuuaccacauc

SEQ ID NO: 334790 - RNA, 19 nt, Homo sapiens
gaagcaagaacacagagaa

SEQ ID NO: 334791 - RNA, 19 nt, Homo sapiens
ggacuuggacacucauuau

SEQ ID NO: 334792 - RNA, 19 nt, Homo sapiens
gguaaguucaucucugaua

SEQ ID NO: 334793 - RNA, 19 nt, Homo sapiens
gaacacagagaagagauug

SEQ ID NO: 334794 - RNA, 19 nt, Homo sapiens
caagaacuuccucauauug

SEQ ID NO: 334795 - RNA, 19 nt, Homo sapiens
cucaagaacuuccucauau

SEQ ID NO: 334796 - RNA, 19 nt, Homo sapiens
cuuaauaugucacaguuug

SEQ ID NO: 334797 - RNA, 19 nt, Homo sapiens
gaagcugcagcccgauuua

SEQ ID NO: 334798 - RNA, 19 nt, Homo sapiens
gcaaacuaauguuguguac

SEQ ID NO: 334799 - RNA, 19 nt, Homo sapiens
uaugauuccuucuccaauu

SEQ ID NO: 334800 - RNA, 19 nt, Homo sapiens
guacaaaaguucuggaaau

SEQ ID NO: 334801 - RNA, 19 nt, Homo sapiens
ccacuagacuggccuuuac

SEQ ID NO: 334802 - RNA, 19 nt, Homo sapiens
uaccgggagucuucucuua

SEQ ID NO: 334803 - RNA, 19 nt, Homo sapiens
gauauguucuugaaguagu

SEQ ID NO: 334804 - RNA, 19 nt, Homo sapiens
ucaguuccuucacccuuua

SEQ ID NO: 334805 - RNA, 19 nt, Homo sapiens
gcucaaugcuucuguccau

SEQ ID NO: 334806 - RNA, 19 nt, Homo sapiens
ucacucaccuguuccuuca

SEQ ID NO: 334807 - RNA, 19 nt, Homo sapiens
ccaacuugucuuccuauua

SEQ ID NO: 334808 - RNA, 19 nt, Homo sapiens
gggcucacauuguccuuga

SEQ ID NO: 334809 - RNA, 19 nt, Homo sapiens
gcauccauuuacaucuuua

SEQ ID NO: 334810 - RNA, 19 nt, Homo sapiens
ucucugauauguucuugaa

SEQ ID NO: 334811 - RNA, 19 nt, Homo sapiens
gaugacuacugcaaacugu

SEQ ID NO: 334812 - RNA, 19 nt, Homo sapiens
ugucuucaguuccaucuuu

SEQ ID NO: 334813 - RNA, 19 nt, Homo sapiens
ccagcggucugcucaagaa

SEQ ID NO: 334814 - RNA, 19 nt, Homo sapiens
gcaagccaagagauaauaa

SEQ ID NO: 334815 - RNA, 19 nt, Homo sapiens
uuuacgaccucaugcauuu

SEQ ID NO: 334816 - RNA, 19 nt, Homo sapiens
ugaagaugaccuacagaua

SEQ ID NO: 334817 - RNA, 19 nt, Homo sapiens
gaacagcauaugauuccuu

SEQ ID NO: 334818 - RNA, 19 nt, Homo sapiens
gagauaauaauugccagua

SEQ ID NO: 334819 - RNA, 19 nt, Homo sapiens
gccaagagauaauaauugc

SEQ ID NO: 334820 - RNA, 19 nt, Homo sapiens
ggaagugugacagaagaua

SEQ ID NO: 334821 - RNA, 19 nt, Homo sapiens
agaagaaacuuggcaucaa

SEQ ID NO: 334822 - RNA, 19 nt, Homo sapiens
gaagauucagggacuuuau

SEQ ID NO: 334823 - RNA, 19 nt, Homo sapiens
gagaagaaacuuggcauca

SEQ ID NO: 334824 - RNA, 19 nt, Homo sapiens
gugcauccauuuacaucuu

SEQ ID NO: 334825 - RNA, 19 nt, Homo sapiens
acagagaagagauugauuu

SEQ ID NO: 334826 - RNA, 19 nt, Homo sapiens
gggaagauaaucagggaaa

SEQ ID NO: 334827 - RNA, 19 nt, Homo sapiens
cagcagaugaucgauauuu

SEQ ID NO: 334828 - RNA, 19 nt, Homo sapiens
cuuaccacaucauggauua

SEQ ID NO: 334829 - RNA, 19 nt, Homo sapiens
cagaagaucgagagccuaa

SEQ ID NO: 334830 - RNA, 19 nt, Homo sapiens
gggauaucauuguucaaau

SEQ ID NO: 334831 - RNA, 19 nt, Homo sapiens
augcaacucuuucugguuu

SEQ ID NO: 334832 - RNA, 19 nt, Homo sapiens
gaugagaguguuaguaaag

SEQ ID NO: 334833 - RNA, 19 nt, Homo sapiens
cgacuuguguuucguguac

SEQ ID NO: 334834 - RNA, 19 nt, Homo sapiens
aaacuccgcaauucagaua

SEQ ID NO: 334835 - RNA, 19 nt, Homo sapiens
aauuagagcuguguucaga

SEQ ID NO: 334836 - RNA, 19 nt, Homo sapiens
gcccaaguauucaaauuac

SEQ ID NO: 334837 - RNA, 19 nt, Homo sapiens
gacaggagaaucacuugaa

SEQ ID NO: 334838 - RNA, 19 nt, Homo sapiens
ucaaauacaggacaaagau

SEQ ID NO: 334839 - RNA, 19 nt, Homo sapiens
cgacuucaaacucgucuuu

SEQ ID NO: 334840 - RNA, 19 nt, Homo sapiens
uccaguggcugaccagauu

SEQ ID NO: 334841 - RNA, 19 nt, Homo sapiens
caaccacugucauccauac

SEQ ID NO: 334842 - RNA, 19 nt, Homo sapiens
caucccaucugccacaguu

SEQ ID NO: 334843 - RNA, 19 nt, Homo sapiens
caacuugucuuccuauuaa

SEQ ID NO: 334844 - RNA, 19 nt, Homo sapiens
gaagaugaccuacagauaa

SEQ ID NO: 334845 - RNA, 19 nt, Homo sapiens
ggacagagaaguuugauuu

SEQ ID NO: 334846 - RNA, 19 nt, Homo sapiens
gaagauacguggcucaaug

SEQ ID NO: 334847 - RNA, 19 nt, Homo sapiens
ggacaucucuuagcccaua

SEQ ID NO: 334848 - RNA, 19 nt, Homo sapiens
gcagcaggcucucuuguuu

SEQ ID NO: 334849 - RNA, 19 nt, Homo sapiens
ugaaggaacuugugagauu

SEQ ID NO: 334850 - RNA, 19 nt, Homo sapiens
gagaagagauugauuuguc

SEQ ID NO: 334851 - RNA, 19 nt, Homo sapiens
ggaaaggccuucuagagau

SEQ ID NO: 334852 - RNA, 19 nt, Homo sapiens
ggacagcacucaacucaag

SEQ ID NO: 334853 - RNA, 19 nt, Homo sapiens
gcacucaacucaagcacaa

SEQ ID NO: 334854 - RNA, 19 nt, Homo sapiens
gccaauaaaucuacaaaug

SEQ ID NO: 334855 - RNA, 19 nt, Homo sapiens
gagaugagaguguuaguaa

SEQ ID NO: 334856 - RNA, 19 nt, Homo sapiens
agaauuagaugcacaugaa

SEQ ID NO: 334857 - RNA, 19 nt, Homo sapiens
gaaucgcuuucacauauuu

SEQ ID NO: 334858 - RNA, 19 nt, Homo sapiens
ggagagacaugucccagau

SEQ ID NO: 334859 - RNA, 19 nt, Homo sapiens
aaauagaagugcaaccuaa

SEQ ID NO: 334860 - RNA, 19 nt, Homo sapiens
ggaccaacuugucuuccua

SEQ ID NO: 334861 - RNA, 19 nt, Homo sapiens
gaaguuccuccauaucaua

SEQ ID NO: 334862 - RNA, 19 nt, Homo sapiens
gacagcagaugaucgauau

SEQ ID NO: 334863 - RNA, 19 nt, Homo sapiens
gaagaaacuuggcaucaac

SEQ ID NO: 334864 - RNA, 19 nt, Homo sapiens
cauuaaaccugaaccagaa

SEQ ID NO: 334865 - RNA, 19 nt, Homo sapiens
gcaccuucauccuuaauau

SEQ ID NO: 334866 - RNA, 19 nt, Homo sapiens
aaauggaggucaugaaaug

SEQ ID NO: 334867 - RNA, 19 nt, Homo sapiens
ucaagaacuuccucauauu

SEQ ID NO: 334868 - RNA, 19 nt, Homo sapiens
gauaauaauugccaguaca

SEQ ID NO: 334869 - RNA, 19 nt, Homo sapiens
guaaauggaggucaugaaa

SEQ ID NO: 334870 - RNA, 19 nt, Homo sapiens
aaacugauauuggcagaaa

SEQ ID NO: 334871 - RNA, 19 nt, Homo sapiens
gaaaggccuucuagagauc

SEQ ID NO: 334872 - RNA, 19 nt, Homo sapiens
uuacaucuaucucuccuaa

SEQ ID NO: 334873 - RNA, 19 nt, Homo sapiens
gcucaagaacuuccucaua

SEQ ID NO: 334874 - RNA, 19 nt, Homo sapiens
ggacagcagaugaucgaua

SEQ ID NO: 334875 - RNA, 19 nt, Homo sapiens
ccaccuccaucuacuuuaa

SEQ ID NO: 334876 - RNA, 19 nt, Homo sapiens
gaaggaacuugugagauuc

SEQ ID NO: 334877 - RNA, 19 nt, Homo sapiens
gggcaacugugagcauuaa

SEQ ID NO: 334878 - RNA, 19 nt, Homo sapiens
aaacuuggcaucaacagua

SEQ ID NO: 334879 - RNA, 19 nt, Homo sapiens
agagacaugucccagauuu

SEQ ID NO: 334880 - RNA, 19 nt, Homo sapiens
guaaagaacagcauaugau

SEQ ID NO: 334881 - RNA, 19 nt, Homo sapiens
aagaugaccuacagauaaa

SEQ ID NO: 334882 - RNA, 19 nt, Homo sapiens
gcagaaagaauacuagagu

SEQ ID NO: 334883 - RNA, 19 nt, Homo sapiens
agaucaagcugccauacua

SEQ ID NO: 334884 - RNA, 19 nt, Homo sapiens
ggagguagaagggaagaua

SEQ ID NO: 334885 - RNA, 19 nt, Homo sapiens
gaaguacaguaucaacagu

SEQ ID NO: 334886 - RNA, 19 nt, Homo sapiens
aauaauaugucagccagua

SEQ ID NO: 334887 - RNA, 19 nt, Homo sapiens
ccacuuugcuuaccacauc

SEQ ID NO: 334888 - RNA, 19 nt, Homo sapiens
gaugugaacgagauaauug

SEQ ID NO: 334889 - RNA, 19 nt, Homo sapiens
gaagcaagaacacagagaa

SEQ ID NO: 334890 - RNA, 19 nt, Homo sapiens
ggacuuggacacucauuau

SEQ ID NO: 334891 - RNA, 19 nt, Homo sapiens
gaacacagagaagagauug

SEQ ID NO: 334892 - RNA, 19 nt, Homo sapiens
caagaacuuccucauauug

SEQ ID NO: 334893 - RNA, 19 nt, Homo sapiens
cucaagaacuuccucauau

SEQ ID NO: 334894 - RNA, 19 nt, Homo sapiens
ggugauuuguacugcuuua

SEQ ID NO: 334895 - RNA, 19 nt, Homo sapiens
cuuaauaugucacaguuug

SEQ ID NO: 334896 - RNA, 19 nt, Homo sapiens
gaagcugcagcccgauuua

SEQ ID NO: 334897 - RNA, 19 nt, Homo sapiens
uagcuaggauuggugauuu

SEQ ID NO: 334898 - RNA, 19 nt, Homo sapiens
gcaaacuaauguuguguac

SEQ ID NO: 334899 - RNA, 19 nt, Homo sapiens
uaugauuccuucuccaauu

SEQ ID NO: 334900 - RNA, 19 nt, Homo sapiens
guacaaaaguucuggaaau

SEQ ID NO: 334901 - RNA, 19 nt, Homo sapiens
ccacuagacuggccuuuac

SEQ ID NO: 334902 - RNA, 19 nt, Homo sapiens
uaccgggagucuucucuua

SEQ ID NO: 334903 - RNA, 19 nt, Homo sapiens
ucaguuccuucacccuuua

SEQ ID NO: 334904 - RNA, 19 nt, Homo sapiens
gcucaaugcuucuguccau

SEQ ID NO: 334905 - RNA, 19 nt, Homo sapiens
ucacucaccuguuccuuca

SEQ ID NO: 334906 - RNA, 19 nt, Homo sapiens
ccaacuugucuuccuauua

SEQ ID NO: 334907 - RNA, 19 nt, Homo sapiens
gggcucacauuguccuuga

SEQ ID NO: 334908 - RNA, 19 nt, Homo sapiens
gaugacuacugcaaacugu

SEQ ID NO: 334909 - RNA, 19 nt, Homo sapiens
ugucuucaguuccaucuuu

SEQ ID NO: 334910 - RNA, 19 nt, Homo sapiens
ccagcggucugcucaagaa

SEQ ID NO: 334911 - RNA, 19 nt, Homo sapiens
gcaagccaagagauaauaa

SEQ ID NO: 334912 - RNA, 19 nt, Homo sapiens
uuuacgaccucaugcauuu

SEQ ID NO: 334913 - RNA, 19 nt, Homo sapiens
gcauccauuuacaucuuua

SEQ ID NO: 334914 - RNA, 19 nt, Homo sapiens
ugaagaugaccuacagaua

SEQ ID NO: 334915 - RNA, 19 nt, Homo sapiens
gaacagcauaugauuccuu

SEQ ID NO: 334916 - RNA, 19 nt, Homo sapiens
gagauaauaauugccagua

SEQ ID NO: 334917 - RNA, 19 nt, Homo sapiens
gccaagagauaauaauugc

SEQ ID NO: 334918 - RNA, 19 nt, Homo sapiens
ggaagugugacagaagaua

SEQ ID NO: 334919 - RNA, 19 nt, Homo sapiens
agaagaaacuuggcaucaa

SEQ ID NO: 334920 - RNA, 19 nt, Homo sapiens
gagaagaaacuuggcauca

SEQ ID NO: 334921 - RNA, 19 nt, Homo sapiens
gugcauccauuuacaucuu

SEQ ID NO: 334922 - RNA, 19 nt, Homo sapiens
acagagaagagauugauuu

SEQ ID NO: 334923 - RNA, 19 nt, Homo sapiens
gggaagauaaucagggaaa

SEQ ID NO: 334924 - RNA, 19 nt, Homo sapiens
cagcagaugaucgauauuu

SEQ ID NO: 334925 - RNA, 19 nt, Homo sapiens
cuuaccacaucauggauua

SEQ ID NO: 334926 - RNA, 19 nt, Homo sapiens
gcauguuucucuccuugga

SEQ ID NO: 334927 - RNA, 19 nt, Homo sapiens
cagaagaucgagagccuaa

SEQ ID NO: 334928 - RNA, 19 nt, Homo sapiens
gggauaucauuguucaaau

SEQ ID NO: 334929 - RNA, 19 nt, Homo sapiens
augcaacucuuucugguuu

SEQ ID NO: 334930 - RNA, 19 nt, Homo sapiens
gaugagaguguuaguaaag

SEQ ID NO: 334931 - RNA, 19 nt, Homo sapiens
cgacuuguguuucguguac

SEQ ID NO: 334932 - RNA, 19 nt, Homo sapiens
aaacuccgcaauucagaua

SEQ ID NO: 334933 - RNA, 19 nt, Homo sapiens
aauuagagcuguguucaga

SEQ ID NO: 334934 - RNA, 19 nt, Homo sapiens
gcccaaguauucaaauuac

SEQ ID NO: 334935 - RNA, 19 nt, Homo sapiens
gauuuguacugcuuuaugg

SEQ ID NO: 334936 - RNA, 19 nt, Homo sapiens
ggaaaugaacuuugcuuuu

SEQ ID NO: 334937 - RNA, 19 nt, Homo sapiens
uagaugaugugaacgagau

SEQ ID NO: 334938 - RNA, 19 nt, Homo sapiens
ucaaauacaggacaaagau

SEQ ID NO: 334939 - RNA, 19 nt, Homo sapiens
cgacuucaaacucgucuuu

SEQ ID NO: 334940 - RNA, 19 nt, Homo sapiens
uccaguggcugaccagauu

SEQ ID NO: 334941 - RNA, 19 nt, Homo sapiens
caaccacugucauccauac

SEQ ID NO: 334942 - RNA, 19 nt, Homo sapiens
caucccaucugccacaguu

SEQ ID NO: 334943 - RNA, 19 nt, Homo sapiens
guaauaaacugcucaauga

SEQ ID NO: 334944 - RNA, 19 nt, Homo sapiens
gggaagaacuggacucaga

SEQ ID NO: 334945 - RNA, 19 nt, Homo sapiens
ggaggagggugaagacuga

SEQ ID NO: 334946 - RNA, 19 nt, Homo sapiens
ggacacagcccuaucuuca

SEQ ID NO: 334947 - RNA, 19 nt, Homo sapiens
ggaagugagugagaucauu

SEQ ID NO: 334948 - RNA, 19 nt, Homo sapiens
augaggagcuggaauuuaa

SEQ ID NO: 334949 - RNA, 19 nt, Homo sapiens
cgaaacuccuuaccuauca

SEQ ID NO: 334950 - RNA, 19 nt, Homo sapiens
gcgacgagguggagucuga

SEQ ID NO: 334951 - RNA, 19 nt, Homo sapiens
ccaaggugguguucauuga

SEQ ID NO: 334952 - RNA, 19 nt, Homo sapiens
gguaauaaacugcucaaug

SEQ ID NO: 334953 - RNA, 19 nt, Homo sapiens
ggaccgcuuugaagaaguu

SEQ ID NO: 334954 - RNA, 19 nt, Homo sapiens
gcacugacauggacuucuc

SEQ ID NO: 334955 - RNA, 19 nt, Homo sapiens
gaggcuaggugccagaaug

SEQ ID NO: 334956 - RNA, 19 nt, Homo sapiens
gagccugccucaugcaaug

SEQ ID NO: 334957 - RNA, 19 nt, Homo sapiens
gagcaucccucagaagaca

SEQ ID NO: 334958 - RNA, 19 nt, Homo sapiens
gaagugagugagaucauug

SEQ ID NO: 334959 - RNA, 19 nt, Homo sapiens
gaugaggagcuggaauuua

SEQ ID NO: 334960 - RNA, 19 nt, Homo sapiens
ccacugacccuacagaugu

SEQ ID NO: 334961 - RNA, 19 nt, Homo sapiens
gagagcaucccucagaaga

SEQ ID NO: 334962 - RNA, 19 nt, Homo sapiens
uugcgaaacuccuuaccua

SEQ ID NO: 334963 - RNA, 19 nt, Homo sapiens
acagguugaugguaauaaa

SEQ ID NO: 334964 - RNA, 19 nt, Homo sapiens
ggacagguugaugguaaua

SEQ ID NO: 334965 - RNA, 19 nt, Homo sapiens
gcgggaaggucgucucagu

SEQ ID NO: 334966 - RNA, 19 nt, Homo sapiens
ugacucugcugccugagaa

SEQ ID NO: 334967 - RNA, 19 nt, Homo sapiens
agaauggacuggagugaag

SEQ ID NO: 334968 - RNA, 19 nt, Homo sapiens
gcaguccuacccagaguuu

SEQ ID NO: 334969 - RNA, 19 nt, Homo sapiens
gcacugcagaugaaaggaa

SEQ ID NO: 334970 - RNA, 19 nt, Homo sapiens
gguggagucugagcuaaau

SEQ ID NO: 334971 - RNA, 19 nt, Homo sapiens
gagguggagucugagcuaa

SEQ ID NO: 334972 - RNA, 19 nt, Homo sapiens
gcugagggauacaauaagg

SEQ ID NO: 334973 - RNA, 19 nt, Homo sapiens
cagcaucggugcccaucga

SEQ ID NO: 334974 - RNA, 19 nt, Homo sapiens
ggaaggucgucucaguaca

SEQ ID NO: 334975 - RNA, 19 nt, Homo sapiens
gaauucagacauugagcuu

SEQ ID NO: 334976 - RNA, 19 nt, Homo sapiens
ggaugaggagcuggaauuu

SEQ ID NO: 334977 - RNA, 19 nt, Homo sapiens
guaucacgcuggaggaagu

SEQ ID NO: 334978 - RNA, 19 nt, Homo sapiens
ugagggauacaauaaggua

SEQ ID NO: 334979 - RNA, 19 nt, Homo sapiens
gcgaaacuccuuaccuauc

SEQ ID NO: 334980 - RNA, 19 nt, Homo sapiens
ugaaccacgugaacuguca

SEQ ID NO: 334981 - RNA, 19 nt, Homo sapiens
cccagugccugcucuguga

SEQ ID NO: 334982 - RNA, 19 nt, Homo sapiens
ggggacagguugaugguaa

SEQ ID NO: 334983 - RNA, 19 nt, Homo sapiens
ucuaucaggugcaccguau

SEQ ID NO: 334984 - RNA, 19 nt, Homo sapiens
gcgcugcaccuaucgguau

SEQ ID NO: 334985 - RNA, 19 nt, Homo sapiens
uaagguagggccaggcuau

SEQ ID NO: 334986 - RNA, 19 nt, Homo sapiens
gcuucggaauucagacauu

SEQ ID NO: 334987 - RNA, 19 nt, Homo sapiens
gaggaggaggccacaguga

SEQ ID NO: 334988 - RNA, 19 nt, Homo sapiens
gggacagguugaugguaau

SEQ ID NO: 334989 - RNA, 19 nt, Homo sapiens
ggagggaggagggugaaga

SEQ ID NO: 334990 - RNA, 19 nt, Homo sapiens
cugcugagggauacaauaa

SEQ ID NO: 334991 - RNA, 19 nt, Homo sapiens
cugcggauguucccugaga

SEQ ID NO: 334992 - RNA, 19 nt, Homo sapiens
gaaggucgucucaguacag

SEQ ID NO: 334993 - RNA, 19 nt, Homo sapiens
cagaagacacggcggacuu

SEQ ID NO: 334994 - RNA, 19 nt, Homo sapiens
gaagacccugcuugcgaaa

SEQ ID NO: 334995 - RNA, 19 nt, Homo sapiens
ugaaccgacugcagagcaa

SEQ ID NO: 334996 - RNA, 19 nt, Homo sapiens
gagaggaggcgaggaacug

SEQ ID NO: 334997 - RNA, 19 nt, Homo sapiens
gaaacuccuuaccuaucag

SEQ ID NO: 334998 - RNA, 19 nt, Homo sapiens
uacccagaguuucagguuu

SEQ ID NO: 334999 - RNA, 19 nt, Homo sapiens
aaggugguguucauugaga

SEQ ID NO: 335000 - RNA, 19 nt, Homo sapiens
gggaaggucgucucaguac

SEQ ID NO: 335001 - RNA, 19 nt, Homo sapiens
ggaggaggccacagugaac

SEQ ID NO: 335002 - RNA, 19 nt, Homo sapiens
cuaugaagccguagucagu

SEQ ID NO: 335003 - RNA, 19 nt, Homo sapiens
cgagguggagucugagcua

SEQ ID NO: 335004 - RNA, 19 nt, Homo sapiens
cuauggcgcugcaccuauc

SEQ ID NO: 335005 - RNA, 19 nt, Homo sapiens
ggauguucccugagacuag

SEQ ID NO: 335006 - RNA, 19 nt, Homo sapiens
ggaggaagugagugagauc

SEQ ID NO: 335007 - RNA, 19 nt, Homo sapiens
acccagaguuucagguuuc

SEQ ID NO: 335008 - RNA, 19 nt, Homo sapiens
gccaguccaggucuacuuu

SEQ ID NO: 335009 - RNA, 19 nt, Homo sapiens
ggccucaugccuucuauca

SEQ ID NO: 335010 - RNA, 19 nt, Homo sapiens
agaagccacugacccuaca

SEQ ID NO: 335011 - RNA, 19 nt, Homo sapiens
gaagagccuccugccugaa

SEQ ID NO: 335012 - RNA, 19 nt, Homo sapiens
ccaaccaccugcaguuucc

SEQ ID NO: 335013 - RNA, 19 nt, Homo sapiens
gcccaaccaccugcaguuu

SEQ ID NO: 335014 - RNA, 19 nt, Homo sapiens
uccugaagcuucggaauuc

SEQ ID NO: 335015 - RNA, 19 nt, Homo sapiens
cuccuaggcuacagugaga

SEQ ID NO: 335016 - RNA, 19 nt, Homo sapiens
cagaauggacuggagugaa

SEQ ID NO: 335017 - RNA, 19 nt, Homo sapiens
cgggaaggucgucucagua

SEQ ID NO: 335018 - RNA, 19 nt, Homo sapiens
cuucggaauucagacauug

SEQ ID NO: 335019 - RNA, 19 nt, Homo sapiens
gacagguugaugguaauaa

SEQ ID NO: 335020 - RNA, 19 nt, Homo sapiens
caguccaggucuacuuuua

SEQ ID NO: 335021 - RNA, 19 nt, Homo sapiens
uaucaggugcaccguauca

SEQ ID NO: 335022 - RNA, 19 nt, Homo sapiens
aggaugaggagcuggaauu

SEQ ID NO: 335023 - RNA, 19 nt, Homo sapiens
gguugaugguaauaaacug

SEQ ID NO: 335024 - RNA, 19 nt, Homo sapiens
agugugggcuggcuguugu

SEQ ID NO: 335025 - RNA, 19 nt, Homo sapiens
ggaauuuaagcugguguuc

SEQ ID NO: 335026 - RNA, 19 nt, Homo sapiens
ggagcugaggaucgaggua

SEQ ID NO: 335027 - RNA, 19 nt, Homo sapiens
ggagugguggcuacagaag

SEQ ID NO: 335028 - RNA, 19 nt, Homo sapiens
uggagucugagcuaaauga

SEQ ID NO: 335029 - RNA, 19 nt, Homo sapiens
ccgcaucaccuccaucucu

SEQ ID NO: 335030 - RNA, 19 nt, Homo sapiens
ggaagggugagacggacau

SEQ ID NO: 335031 - RNA, 19 nt, Homo sapiens
gcgaauauguagagaugua

SEQ ID NO: 335032 - RNA, 19 nt, Homo sapiens
gauuaucccucaacuauag

SEQ ID NO: 335033 - RNA, 19 nt, Homo sapiens
caagugagccaucauuuga

SEQ ID NO: 335034 - RNA, 19 nt, Homo sapiens
gcccagaacugccgcaaga

SEQ ID NO: 335035 - RNA, 19 nt, Homo sapiens
cagcgaauauguagagaug

SEQ ID NO: 335036 - RNA, 19 nt, Homo sapiens
ugauacagcuguccacuuc

SEQ ID NO: 335037 - RNA, 19 nt, Homo sapiens
gaugggauuuccuucauuc

SEQ ID NO: 335038 - RNA, 19 nt, Homo sapiens
caagguacccgcugacaga

SEQ ID NO: 335039 - RNA, 19 nt, Homo sapiens
gccgguagaugacuuuaau

SEQ ID NO: 335040 - RNA, 19 nt, Homo sapiens
ucucaggccugcucaguga

SEQ ID NO: 335041 - RNA, 19 nt, Homo sapiens
gaacgggagcggcuucuca

SEQ ID NO: 335042 - RNA, 19 nt, Homo sapiens
gauucuggcuucccacuuc

SEQ ID NO: 335043 - RNA, 19 nt, Homo sapiens
uggagcggcugaccaauga

SEQ ID NO: 335044 - RNA, 19 nt, Homo sapiens
agaggaagcuggaaaccau

SEQ ID NO: 335045 - RNA, 19 nt, Homo sapiens
guuccaagguguguucaaa

SEQ ID NO: 335046 - RNA, 19 nt, Homo sapiens
caacagcuacucuccugaa

SEQ ID NO: 335047 - RNA, 19 nt, Homo sapiens
gcuguccacuucagagcua

SEQ ID NO: 335048 - RNA, 19 nt, Homo sapiens
gauggaggccacagacuga

SEQ ID NO: 335049 - RNA, 19 nt, Homo sapiens
ugacuuuaaugagcuauug

SEQ ID NO: 335050 - RNA, 19 nt, Homo sapiens
gaaucugucuucccugacu

SEQ ID NO: 335051 - RNA, 19 nt, Homo sapiens
gaaguuccaagguguguuc

SEQ ID NO: 335052 - RNA, 19 nt, Homo sapiens
ggaugacaauggcaacaag

SEQ ID NO: 335053 - RNA, 19 nt, Homo sapiens
ccaagugagccaucauuug

SEQ ID NO: 335054 - RNA, 19 nt, Homo sapiens
cagaagaggaugacaaugg

SEQ ID NO: 335055 - RNA, 19 nt, Homo sapiens
ggcaggagaucauguccau

SEQ ID NO: 335056 - RNA, 19 nt, Homo sapiens
cuauagcgaugcugaaucu

SEQ ID NO: 335057 - RNA, 19 nt, Homo sapiens
agaaaaggcugagaacgua

SEQ ID NO: 335058 - RNA, 19 nt, Homo sapiens
gagcuguaccgugacauuu

SEQ ID NO: 335059 - RNA, 19 nt, Homo sapiens
gagcaggaacagggugaua

SEQ ID NO: 335060 - RNA, 19 nt, Homo sapiens
gaucugacucugccuuuag

SEQ ID NO: 335061 - RNA, 19 nt, Homo sapiens
gaaaacaaaacacagcaaa

SEQ ID NO: 335062 - RNA, 19 nt, Homo sapiens
caggagaucauguccauca

SEQ ID NO: 335063 - RNA, 19 nt, Homo sapiens
uggaacugcugaugggauu

SEQ ID NO: 335064 - RNA, 19 nt, Homo sapiens
ggagagauggaacugacuu

SEQ ID NO: 335065 - RNA, 19 nt, Homo sapiens
agggagggcuggaaucugu

SEQ ID NO: 335066 - RNA, 19 nt, Homo sapiens
uucauucccuucugauaaa

SEQ ID NO: 335067 - RNA, 19 nt, Homo sapiens
gaacugcugaugggauuuc

SEQ ID NO: 335068 - RNA, 19 nt, Homo sapiens
ucaacuugccgguagauga

SEQ ID NO: 335069 - RNA, 19 nt, Homo sapiens
uagcgaugcugaaucucuu

SEQ ID NO: 335070 - RNA, 19 nt, Homo sapiens
uauaaagugcgcuacagaa

SEQ ID NO: 335071 - RNA, 19 nt, Homo sapiens
gaccagaagaggaugacaa

SEQ ID NO: 335072 - RNA, 19 nt, Homo sapiens
cuucauucccuucugauaa

SEQ ID NO: 335073 - RNA, 19 nt, Homo sapiens
ggaaagaaaaggcugagaa

SEQ ID NO: 335074 - RNA, 19 nt, Homo sapiens
auaaagugcgcuacagaaa

SEQ ID NO: 335075 - RNA, 19 nt, Homo sapiens
ugaugggauuuccuucauu

SEQ ID NO: 335076 - RNA, 19 nt, Homo sapiens
ccaagaagacccagaaucc

SEQ ID NO: 335077 - RNA, 19 nt, Homo sapiens
gcaggaacagggugauaca

SEQ ID NO: 335078 - RNA, 19 nt, Homo sapiens
ggagcugaguucucuagac

SEQ ID NO: 335079 - RNA, 19 nt, Homo sapiens
agaucugacucugccuuua

SEQ ID NO: 335080 - RNA, 19 nt, Homo sapiens
gcaagaggaagcuggaaac

SEQ ID NO: 335081 - RNA, 19 nt, Homo sapiens
cuucagagcuaggagagau

SEQ ID NO: 335082 - RNA, 19 nt, Homo sapiens
cgguagaugacuuuaauga

SEQ ID NO: 335083 - RNA, 19 nt, Homo sapiens
caacuauagcgaugcugaa

SEQ ID NO: 335084 - RNA, 19 nt, Homo sapiens
gcgcagcgaauauguagag

SEQ ID NO: 335085 - RNA, 19 nt, Homo sapiens
agauguacccaguggagua

SEQ ID NO: 335086 - RNA, 19 nt, Homo sapiens
cuccaccacccacaacuua

SEQ ID NO: 335087 - RNA, 19 nt, Homo sapiens
gagcugcagggucugaaug

SEQ ID NO: 335088 - RNA, 19 nt, Homo sapiens
gcugagaacguaaaacuga

SEQ ID NO: 335089 - RNA, 19 nt, Homo sapiens
aaacacagcaaaacagaaa

SEQ ID NO: 335090 - RNA, 19 nt, Homo sapiens
ccuagaaaauggaaaacaa

SEQ ID NO: 335091 - RNA, 19 nt, Homo sapiens
ggaccuccaccacccacaa

SEQ ID NO: 335092 - RNA, 19 nt, Homo sapiens
gagagauggaacugacuug

SEQ ID NO: 335093 - RNA, 19 nt, Homo sapiens
gcugaugggauuuccuuca

SEQ ID NO: 335094 - RNA, 19 nt, Homo sapiens
ugacaauggcaacaagugu

SEQ ID NO: 335095 - RNA, 19 nt, Homo sapiens
gaagcuggaaaccauugug

SEQ ID NO: 335096 - RNA, 19 nt, Homo sapiens
gaggaagcuggaaaccauu

SEQ ID NO: 335097 - RNA, 19 nt, Homo sapiens
auacuccuauggcaacaug

SEQ ID NO: 335098 - RNA, 19 nt, Homo sapiens
gcaccuucgggaugaauca

SEQ ID NO: 335099 - RNA, 19 nt, Homo sapiens
ggucugaaugcuccaagug

SEQ ID NO: 335100 - RNA, 19 nt, Homo sapiens
ugacuuggcaggagaucau

SEQ ID NO: 335101 - RNA, 19 nt, Homo sapiens
cuauaaagugcgcuacaga

SEQ ID NO: 335102 - RNA, 19 nt, Homo sapiens
gaaggagcugaguucucua

SEQ ID NO: 335103 - RNA, 19 nt, Homo sapiens
caaaacacagcaaaacaga

SEQ ID NO: 335104 - RNA, 19 nt, Homo sapiens
gaaaaggcugagaacguaa

SEQ ID NO: 335105 - RNA, 19 nt, Homo sapiens
caagguggcagcccagaac

SEQ ID NO: 335106 - RNA, 19 nt, Homo sapiens
gggaaaagagugggcauuu

SEQ ID NO: 335107 - RNA, 19 nt, Homo sapiens
uaaagugcgcuacagaaaa

SEQ ID NO: 335108 - RNA, 19 nt, Homo sapiens
cugaugggauuuccuucau

SEQ ID NO: 335109 - RNA, 19 nt, Homo sapiens
caacuugccgguagaugac

SEQ ID NO: 335110 - RNA, 19 nt, Homo sapiens
ccaagauggaggccacaga

SEQ ID NO: 335111 - RNA, 19 nt, Homo sapiens
uccagcaccuucgggauga

SEQ ID NO: 335112 - RNA, 19 nt, Homo sapiens
gguagaugacuuuaaugag

SEQ ID NO: 335113 - RNA, 19 nt, Homo sapiens
ggcagggagucgggaugaa

SEQ ID NO: 335114 - RNA, 19 nt, Homo sapiens
auacugucaucaucuugga

SEQ ID NO: 335115 - RNA, 19 nt, Homo sapiens
gcauagaccuggacaauua

SEQ ID NO: 335116 - RNA, 19 nt, Homo sapiens
ggacuuaaaugccuucuua

SEQ ID NO: 335117 - RNA, 19 nt, Homo sapiens
ggacuacaaugucuuuauu

SEQ ID NO: 335118 - RNA, 19 nt, Homo sapiens
gaagaucccuuucaccaau

SEQ ID NO: 335119 - RNA, 19 nt, Homo sapiens
gcagacauuuccagcauaa

SEQ ID NO: 335120 - RNA, 19 nt, Homo sapiens
gaaguggccagaccauuua

SEQ ID NO: 335121 - RNA, 19 nt, Homo sapiens
gaacagcaguggcaagauc

SEQ ID NO: 335122 - RNA, 19 nt, Homo sapiens
gaacuaguccucuuagaau

SEQ ID NO: 335123 - RNA, 19 nt, Homo sapiens
gcagaggaaugauggagaa

SEQ ID NO: 335124 - RNA, 19 nt, Homo sapiens
ggaaguggccagaccauuu

SEQ ID NO: 335125 - RNA, 19 nt, Homo sapiens
gaacaguuguacuuucaga

SEQ ID NO: 335126 - RNA, 19 nt, Homo sapiens
gugaagauuuggaggauuu

SEQ ID NO: 335127 - RNA, 19 nt, Homo sapiens
ccaaauaccaguugaguga

SEQ ID NO: 335128 - RNA, 19 nt, Homo sapiens
gggauucggugaagauuug

SEQ ID NO: 335129 - RNA, 19 nt, Homo sapiens
ucaaugaacugcuguccaa

SEQ ID NO: 335130 - RNA, 19 nt, Homo sapiens
gaacacaucagcaagugaa

SEQ ID NO: 335131 - RNA, 19 nt, Homo sapiens
ggacagagucaccauuuga

SEQ ID NO: 335132 - RNA, 19 nt, Homo sapiens
ggguggacguggauacuua

SEQ ID NO: 335133 - RNA, 19 nt, Homo sapiens
gcaaugcuuucucugaaga

SEQ ID NO: 335134 - RNA, 19 nt, Homo sapiens
ugccugagcucuucuguaa

SEQ ID NO: 335135 - RNA, 19 nt, Homo sapiens
gcugcuaaauguucucuuu

SEQ ID NO: 335136 - RNA, 19 nt, Homo sapiens
auucaaagcugcuaaaugu

SEQ ID NO: 335137 - RNA, 19 nt, Homo sapiens
ccauaaagacuccguguaa

SEQ ID NO: 335138 - RNA, 19 nt, Homo sapiens
acacuggcuuugagauuua

SEQ ID NO: 335139 - RNA, 19 nt, Homo sapiens
ggacauagaucugauugac

SEQ ID NO: 335140 - RNA, 19 nt, Homo sapiens
ggacaacuaaugugaguga

SEQ ID NO: 335141 - RNA, 19 nt, Homo sapiens
cuacagagaggacaacuaa

SEQ ID NO: 335142 - RNA, 19 nt, Homo sapiens
gaagcuauguuggaugaga

SEQ ID NO: 335143 - RNA, 19 nt, Homo sapiens
gaagugaacacaucagcaa

SEQ ID NO: 335144 - RNA, 19 nt, Homo sapiens
gagaacagccugcauugga

SEQ ID NO: 335145 - RNA, 19 nt, Homo sapiens
gaaugcuuguguugaguaa

SEQ ID NO: 335146 - RNA, 19 nt, Homo sapiens
caucagagccugcaugugu

SEQ ID NO: 335147 - RNA, 19 nt, Homo sapiens
gcuuugagauuuagaguca

SEQ ID NO: 335148 - RNA, 19 nt, Homo sapiens
cagaagcagugccuaguga

SEQ ID NO: 335149 - RNA, 19 nt, Homo sapiens
aaaaggagauucccaauau

SEQ ID NO: 335150 - RNA, 19 nt, Homo sapiens
ccagaugguuccaggacua

SEQ ID NO: 335151 - RNA, 19 nt, Homo sapiens
ugacucaggccuuuccuua

SEQ ID NO: 335152 - RNA, 19 nt, Homo sapiens
gcaguggccuugauuuguc

SEQ ID NO: 335153 - RNA, 19 nt, Homo sapiens
gcauuggaaucuacagaga

SEQ ID NO: 335154 - RNA, 19 nt, Homo sapiens
ucuagaagauugagaagug

SEQ ID NO: 335155 - RNA, 19 nt, Homo sapiens
ggaccuggccauugaagaa

SEQ ID NO: 335156 - RNA, 19 nt, Homo sapiens
gaggugaggugucgagaag

SEQ ID NO: 335157 - RNA, 19 nt, Homo sapiens
gaggaaugauggagaaucu

SEQ ID NO: 335158 - RNA, 19 nt, Homo sapiens
ggcaagaucucauguccau

SEQ ID NO: 335159 - RNA, 19 nt, Homo sapiens
gcucaucccuuguguucug

SEQ ID NO: 335160 - RNA, 19 nt, Homo sapiens
gaggacaacuaaugugagu

SEQ ID NO: 335161 - RNA, 19 nt, Homo sapiens
ggauaucauuggccauguu

SEQ ID NO: 335162 - RNA, 19 nt, Homo sapiens
ucaccauucugcugaguuu

SEQ ID NO: 335163 - RNA, 19 nt, Homo sapiens
gcagagcaguggccuugau

SEQ ID NO: 335164 - RNA, 19 nt, Homo sapiens
gagaggacaacuaauguga

SEQ ID NO: 335165 - RNA, 19 nt, Homo sapiens
gauggagaaucuaguguag

SEQ ID NO: 335166 - RNA, 19 nt, Homo sapiens
caagugaaauccuguacag

SEQ ID NO: 335167 - RNA, 19 nt, Homo sapiens
ggaaggagggauagaagga

SEQ ID NO: 335168 - RNA, 19 nt, Homo sapiens
uaaaugccuucuuauccaa

SEQ ID NO: 335169 - RNA, 19 nt, Homo sapiens
ggaauuugacucugacuca

SEQ ID NO: 335170 - RNA, 19 nt, Homo sapiens
gaugagaucagccuuaugg

SEQ ID NO: 335171 - RNA, 19 nt, Homo sapiens
gagcauagaccuggacaau

SEQ ID NO: 335172 - RNA, 19 nt, Homo sapiens
gagauucccaauauucaaa

SEQ ID NO: 335173 - RNA, 19 nt, Homo sapiens
ggaaggaauggaccuguga

SEQ ID NO: 335174 - RNA, 19 nt, Homo sapiens
ggagcuauguggagcaaag

SEQ ID NO: 335175 - RNA, 19 nt, Homo sapiens
ggaaaugcaggccauggaa

SEQ ID NO: 335176 - RNA, 19 nt, Homo sapiens
ccaguggccuccaagaugu

SEQ ID NO: 335177 - RNA, 19 nt, Homo sapiens
gccuguagcuccagccaaa

SEQ ID NO: 335178 - RNA, 19 nt, Homo sapiens
gagcaguggccuugauuug

SEQ ID NO: 335179 - RNA, 19 nt, Homo sapiens
gagcucaucccuuguguuc

SEQ ID NO: 335180 - RNA, 19 nt, Homo sapiens
ggucuagaaugcuuguguu

SEQ ID NO: 335181 - RNA, 19 nt, Homo sapiens
gggacacucugacccaaga

SEQ ID NO: 335182 - RNA, 19 nt, Homo sapiens
caacacuggcuuugagauu

SEQ ID NO: 335183 - RNA, 19 nt, Homo sapiens
uccaauauaucuucucaga

SEQ ID NO: 335184 - RNA, 19 nt, Homo sapiens
ccaaaggaccggagaaagu

SEQ ID NO: 335185 - RNA, 19 nt, Homo sapiens
augaacugcuguccaaaua

SEQ ID NO: 335186 - RNA, 19 nt, Homo sapiens
caagaucucauguccauca

SEQ ID NO: 335187 - RNA, 19 nt, Homo sapiens
cuaagcaguuucucuggaa

SEQ ID NO: 335188 - RNA, 19 nt, Homo sapiens
aaaggagauucccaauauu

SEQ ID NO: 335189 - RNA, 19 nt, Homo sapiens
ugacagggcucuucuuucc

SEQ ID NO: 335190 - RNA, 19 nt, Homo sapiens
gagcagggauucggugaag

SEQ ID NO: 335191 - RNA, 19 nt, Homo sapiens
auacuuaccugaccucaca

SEQ ID NO: 335192 - RNA, 19 nt, Homo sapiens
gcuaccagccugaguauuc

SEQ ID NO: 335193 - RNA, 19 nt, Homo sapiens
cagagucaccauuugauuu

SEQ ID NO: 335194 - RNA, 19 nt, Homo sapiens
cagcagacauuuccagcau

SEQ ID NO: 335195 - RNA, 19 nt, Homo sapiens
gaacugcuguccaaauacc

SEQ ID NO: 335196 - RNA, 19 nt, Homo sapiens
gggacagagucaccauuug

SEQ ID NO: 335197 - RNA, 19 nt, Homo sapiens
acauagaucugauugacau

SEQ ID NO: 335198 - RNA, 19 nt, Homo sapiens
ccaaagaggacauagaucu

SEQ ID NO: 335199 - RNA, 19 nt, Homo sapiens
gagaagggaaagugaaugu

SEQ ID NO: 335200 - RNA, 19 nt, Homo sapiens
agagagagaugcuguugag

SEQ ID NO: 335201 - RNA, 19 nt, Homo sapiens
aauguucucuuugccauaa

SEQ ID NO: 335202 - RNA, 19 nt, Homo sapiens
ucacuuauagggucuagaa

SEQ ID NO: 335203 - RNA, 19 nt, Homo sapiens
gugaggaagugacuguaug

SEQ ID NO: 335204 - RNA, 19 nt, Homo sapiens
agaacagccugcauuggaa

SEQ ID NO: 335205 - RNA, 19 nt, Homo sapiens
ucaaagcugcuaaauguuc

SEQ ID NO: 335206 - RNA, 19 nt, Homo sapiens
ggaaugauggagaaucuag

SEQ ID NO: 335207 - RNA, 19 nt, Homo sapiens
gauaucauuggccauguuu

SEQ ID NO: 335208 - RNA, 19 nt, Homo sapiens
gaagggaagguggcagaaa

SEQ ID NO: 335209 - RNA, 19 nt, Homo sapiens
uuaaaugccuucuuaucca

SEQ ID NO: 335210 - RNA, 19 nt, Homo sapiens
acucaggccuuuccuuaga

SEQ ID NO: 335211 - RNA, 19 nt, Homo sapiens
gagaaggagcugcgagaug

SEQ ID NO: 335212 - RNA, 19 nt, Homo sapiens
uaaacauucugguccuuca

SEQ ID NO: 335213 - RNA, 19 nt, Homo sapiens
gaccuggacuggguuagga

SEQ ID NO: 335214 - RNA, 19 nt, Homo sapiens
acagagaggacaacuaaug

SEQ ID NO: 335215 - RNA, 19 nt, Homo sapiens
ugacagaaguugacaauua

SEQ ID NO: 335216 - RNA, 19 nt, Homo sapiens
gagaaagaauugccuguaa

SEQ ID NO: 335217 - RNA, 19 nt, Homo sapiens
gugaaaugcucauacuuua

SEQ ID NO: 335218 - RNA, 19 nt, Homo sapiens
gaagccagauguuaagaaa

SEQ ID NO: 335219 - RNA, 19 nt, Homo sapiens
ccaaagagcaguucaauga

SEQ ID NO: 335220 - RNA, 19 nt, Homo sapiens
uaaaguggcugcucagaau

SEQ ID NO: 335221 - RNA, 19 nt, Homo sapiens
gaguuacagugucuuaaua

SEQ ID NO: 335222 - RNA, 19 nt, Homo sapiens
guaagaagccagauguuaa

SEQ ID NO: 335223 - RNA, 19 nt, Homo sapiens
gagaugaacuuagggcaaa

SEQ ID NO: 335224 - RNA, 19 nt, Homo sapiens
gacagaaguugacaauuau

SEQ ID NO: 335225 - RNA, 19 nt, Homo sapiens
gaaagaguaugagcuggaa

SEQ ID NO: 335226 - RNA, 19 nt, Homo sapiens
gcccucaccugcuacuuua

SEQ ID NO: 335227 - RNA, 19 nt, Homo sapiens
gaacacaccagagaaagaa

SEQ ID NO: 335228 - RNA, 19 nt, Homo sapiens
gcgcagacauucccguuug

SEQ ID NO: 335229 - RNA, 19 nt, Homo sapiens
caaugaagcucaacuugca

SEQ ID NO: 335230 - RNA, 19 nt, Homo sapiens
gaggagcuauuauccauuc

SEQ ID NO: 335231 - RNA, 19 nt, Homo sapiens
gauaugacaucuggcuaaa

SEQ ID NO: 335232 - RNA, 19 nt, Homo sapiens
gagcaagauuuagaucauu

SEQ ID NO: 335233 - RNA, 19 nt, Homo sapiens
uggaguaagucgagaagua

SEQ ID NO: 335234 - RNA, 19 nt, Homo sapiens
caaacagaaugguccuaaa

SEQ ID NO: 335235 - RNA, 19 nt, Homo sapiens
uaagagcugguacuaauaa

SEQ ID NO: 335236 - RNA, 19 nt, Homo sapiens
caccuuauaucucgaaguu

SEQ ID NO: 335237 - RNA, 19 nt, Homo sapiens
gcacagcagaauucaauga

SEQ ID NO: 335238 - RNA, 19 nt, Homo sapiens
uugcaaagcuuucaaccaa

SEQ ID NO: 335239 - RNA, 19 nt, Homo sapiens
agaacuagagcaagauuua

SEQ ID NO: 335240 - RNA, 19 nt, Homo sapiens
ugaagagacaggugaauuu

SEQ ID NO: 335241 - RNA, 19 nt, Homo sapiens
uuuaagagcugguacuaau

SEQ ID NO: 335242 - RNA, 19 nt, Homo sapiens
gggaggagcuauuauccau

SEQ ID NO: 335243 - RNA, 19 nt, Homo sapiens
gaaagaauugccuguaagu

SEQ ID NO: 335244 - RNA, 19 nt, Homo sapiens
ucucugaacuucuaaaugg

SEQ ID NO: 335245 - RNA, 19 nt, Homo sapiens
gaaguggaagagcuagaua

SEQ ID NO: 335246 - RNA, 19 nt, Homo sapiens
gcaaagcuuucaaccaaaa

SEQ ID NO: 335247 - RNA, 19 nt, Homo sapiens
ggacauggauuugauugac

SEQ ID NO: 335248 - RNA, 19 nt, Homo sapiens
ggauuugauugacauacuu

SEQ ID NO: 335249 - RNA, 19 nt, Homo sapiens
cuacuuggccucagugauu

SEQ ID NO: 335250 - RNA, 19 nt, Homo sapiens
caacucagcaccuuauauc

SEQ ID NO: 335251 - RNA, 19 nt, Homo sapiens
gcauuucacuaaacacaag

SEQ ID NO: 335252 - RNA, 19 nt, Homo sapiens
cagaugcuuuguacuuuga

SEQ ID NO: 335253 - RNA, 19 nt, Homo sapiens
gaagagacaggugaauuuc

SEQ ID NO: 335254 - RNA, 19 nt, Homo sapiens
acaacuagaugaagagaca

SEQ ID NO: 335255 - RNA, 19 nt, Homo sapiens
ggaaagacaagaacaacuc

SEQ ID NO: 335256 - RNA, 19 nt, Homo sapiens
ucaguauguugaaucagua

SEQ ID NO: 335257 - RNA, 19 nt, Homo sapiens
gaugugaaaugcucauacu

SEQ ID NO: 335258 - RNA, 19 nt, Homo sapiens
ucaacgaaaugauguccaa

SEQ ID NO: 335259 - RNA, 19 nt, Homo sapiens
cacaagagaugaacuuagg

SEQ ID NO: 335260 - RNA, 19 nt, Homo sapiens
ugaaagcacagcagaauuc

SEQ ID NO: 335261 - RNA, 19 nt, Homo sapiens
ucuauacccucaauggaaa

SEQ ID NO: 335262 - RNA, 19 nt, Homo sapiens
aagcucaacuugcauuaau

SEQ ID NO: 335263 - RNA, 19 nt, Homo sapiens
gaagcucaacuugcauuaa

SEQ ID NO: 335264 - RNA, 19 nt, Homo sapiens
ggaagugucaaacagaaug

SEQ ID NO: 335265 - RNA, 19 nt, Homo sapiens
gcagcauccucuccacaga

SEQ ID NO: 335266 - RNA, 19 nt, Homo sapiens
gguagccccuguugauuua

SEQ ID NO: 335267 - RNA, 19 nt, Homo sapiens
gaaucaguaguuucacuuu

SEQ ID NO: 335268 - RNA, 19 nt, Homo sapiens
gcauuggagugucaguaug

SEQ ID NO: 335269 - RNA, 19 nt, Homo sapiens
ucagaugcuuuguacuuug

SEQ ID NO: 335270 - RNA, 19 nt, Homo sapiens
ggaguaagucgagaaguau

SEQ ID NO: 335271 - RNA, 19 nt, Homo sapiens
ucauuaaccucccuguugu

SEQ ID NO: 335272 - RNA, 19 nt, Homo sapiens
aaacaccaguacauucuuc

SEQ ID NO: 335273 - RNA, 19 nt, Homo sapiens
ugugaaaugcucauacuuu

SEQ ID NO: 335274 - RNA, 19 nt, Homo sapiens
gcaaacaagagauggcaau

SEQ ID NO: 335275 - RNA, 19 nt, Homo sapiens
aaacaacucagcaccuuau

SEQ ID NO: 335276 - RNA, 19 nt, Homo sapiens
acgaaaugauguccaaaga

SEQ ID NO: 335277 - RNA, 19 nt, Homo sapiens
ggcaaaagcucuccauauc

SEQ ID NO: 335278 - RNA, 19 nt, Homo sapiens
gaaaaccccauucacaaaa

SEQ ID NO: 335279 - RNA, 19 nt, Homo sapiens
gauucugacuccggcauuu

SEQ ID NO: 335280 - RNA, 19 nt, Homo sapiens
gacagugaacucauuaaau

SEQ ID NO: 335281 - RNA, 19 nt, Homo sapiens
cagcacauccagucagaaa

SEQ ID NO: 335282 - RNA, 19 nt, Homo sapiens
ugagaacacaccagagaaa

SEQ ID NO: 335283 - RNA, 19 nt, Homo sapiens
gauauagaucuuggaguaa

SEQ ID NO: 335284 - RNA, 19 nt, Homo sapiens
ccauugauguuucugaucu

SEQ ID NO: 335285 - RNA, 19 nt, Homo sapiens
guaacuguaguccacauuu

SEQ ID NO: 335286 - RNA, 19 nt, Homo sapiens
cgagagcccagucuucauu

SEQ ID NO: 335287 - RNA, 19 nt, Homo sapiens
gcuaguuucuguguaagug

SEQ ID NO: 335288 - RNA, 19 nt, Homo sapiens
ggaaaaccccauucacaaa

SEQ ID NO: 335289 - RNA, 19 nt, Homo sapiens
agaaagaauugccuguaag

SEQ ID NO: 335290 - RNA, 19 nt, Homo sapiens
ugacagugaacucauuaaa

SEQ ID NO: 335291 - RNA, 19 nt, Homo sapiens
agaaguagguaacuguagu

SEQ ID NO: 335292 - RNA, 19 nt, Homo sapiens
ugggcuaguuucuguguaa

SEQ ID NO: 335293 - RNA, 19 nt, Homo sapiens
aguaagaagccagauguua

SEQ ID NO: 335294 - RNA, 19 nt, Homo sapiens
gaauacucccugcagcaaa

SEQ ID NO: 335295 - RNA, 19 nt, Homo sapiens
ggaaaaccuuauucuccua

SEQ ID NO: 335296 - RNA, 19 nt, Homo sapiens
gacauggauuugauugaca

SEQ ID NO: 335297 - RNA, 19 nt, Homo sapiens
acagcagaauucaaugauu

SEQ ID NO: 335298 - RNA, 19 nt, Homo sapiens
caacacagauuuuggugau

SEQ ID NO: 335299 - RNA, 19 nt, Homo sapiens
ccacagucaacacagauuu

SEQ ID NO: 335300 - RNA, 19 nt, Homo sapiens
aaucagaugcuuuguacuu

SEQ ID NO: 335301 - RNA, 19 nt, Homo sapiens
ggaggcucaucucacaaga

SEQ ID NO: 335302 - RNA, 19 nt, Homo sapiens
gaaagcacagcagaauuca

SEQ ID NO: 335303 - RNA, 19 nt, Homo sapiens
ggacauugagcaaguuugg

SEQ ID NO: 335304 - RNA, 19 nt, Homo sapiens
gcagacauucccguuugua

SEQ ID NO: 335305 - RNA, 19 nt, Homo sapiens
cauuugggcuaguuucugu

SEQ ID NO: 335306 - RNA, 19 nt, Homo sapiens
gucaguauguugaaucagu

SEQ ID NO: 335307 - RNA, 19 nt, Homo sapiens
uuaggaggauuugaccuuu

SEQ ID NO: 335308 - RNA, 19 nt, Homo sapiens
gaacuagagcaagauuuag

SEQ ID NO: 335309 - RNA, 19 nt, Homo sapiens
ucaaacagaaugguccuaa

SEQ ID NO: 335310 - RNA, 19 nt, Homo sapiens
uauuauccauuccugaguu

SEQ ID NO: 335311 - RNA, 19 nt, Homo sapiens
aaaguaagaagccagaugu

SEQ ID NO: 335312 - RNA, 19 nt, Homo sapiens
caugcuacgugaugaagau

SEQ ID NO: 335313 - RNA, 19 nt, Homo sapiens
gcaagauuuagaucauuug

SEQ ID NO: 335314 - RNA, 19 nt, Homo sapiens
gcucaacuugcauuaauuc

SEQ ID NO: 335315 - RNA, 19 nt, Homo sapiens
gaaagaaacugaagaaaga

SEQ ID NO: 335316 - RNA, 19 nt, Homo sapiens
ggaaauagauguucugucu

SEQ ID NO: 335317 - RNA, 19 nt, Homo sapiens
gggaauucauggauuauua

SEQ ID NO: 335318 - RNA, 19 nt, Homo sapiens
cgaaagagaucaagauaug

SEQ ID NO: 335319 - RNA, 19 nt, Homo sapiens
cgagugaacuugaaucuuu

SEQ ID NO: 335320 - RNA, 19 nt, Homo sapiens
ggagucaacuucccaauug

SEQ ID NO: 335321 - RNA, 19 nt, Homo sapiens
gaagaaaugccucuaugua

SEQ ID NO: 335322 - RNA, 19 nt, Homo sapiens
ugaaaucucuguagccuuu

SEQ ID NO: 335323 - RNA, 19 nt, Homo sapiens
gaacauggcacgaaagaga

SEQ ID NO: 335324 - RNA, 19 nt, Homo sapiens
ccaagaauccuccagguua

SEQ ID NO: 335325 - RNA, 19 nt, Homo sapiens
uuaaggagcuugauuuguu

SEQ ID NO: 335326 - RNA, 19 nt, Homo sapiens
gcacuuacaaucacuaauu

SEQ ID NO: 335327 - RNA, 19 nt, Homo sapiens
gauaauagaccagcaauug

SEQ ID NO: 335328 - RNA, 19 nt, Homo sapiens
uaagcacucugauuucuaa

SEQ ID NO: 335329 - RNA, 19 nt, Homo sapiens
gcaccaccaucccggaaua

SEQ ID NO: 335330 - RNA, 19 nt, Homo sapiens
cuagaugccuuaauauuug

SEQ ID NO: 335331 - RNA, 19 nt, Homo sapiens
caacguagccuuuguuaca

SEQ ID NO: 335332 - RNA, 19 nt, Homo sapiens
gaccagaaggguaagauua

SEQ ID NO: 335333 - RNA, 19 nt, Homo sapiens
gggcaagugcaauuuauua

SEQ ID NO: 335334 - RNA, 19 nt, Homo sapiens
gaacauaauuggagaaccu

SEQ ID NO: 335335 - RNA, 19 nt, Homo sapiens
gaaguccgcugggaaauag

SEQ ID NO: 335336 - RNA, 19 nt, Homo sapiens
uaucagaacuuguaagagu

SEQ ID NO: 335337 - RNA, 19 nt, Homo sapiens
ggaaagaaacugaagaaag

SEQ ID NO: 335338 - RNA, 19 nt, Homo sapiens
ggagcaagauucuggacaa

SEQ ID NO: 335339 - RNA, 19 nt, Homo sapiens
aaagagcagucaaagauga

SEQ ID NO: 335340 - RNA, 19 nt, Homo sapiens
ggacuggguuuguugugaa

SEQ ID NO: 335341 - RNA, 19 nt, Homo sapiens
uaaggagcuugauuuguuu

SEQ ID NO: 335342 - RNA, 19 nt, Homo sapiens
gucaaaggaugaagaaaga

SEQ ID NO: 335343 - RNA, 19 nt, Homo sapiens
gggcucagaugacuguaaa

SEQ ID NO: 335344 - RNA, 19 nt, Homo sapiens
caaaggcucuauggaagaa

SEQ ID NO: 335345 - RNA, 19 nt, Homo sapiens
gagggcaagugcaauuuau

SEQ ID NO: 335346 - RNA, 19 nt, Homo sapiens
caauguaucagaacuugua

SEQ ID NO: 335347 - RNA, 19 nt, Homo sapiens
gcaauugccuauacuuggu

SEQ ID NO: 335348 - RNA, 19 nt, Homo sapiens
gcgaagucaugauguauuc

SEQ ID NO: 335349 - RNA, 19 nt, Homo sapiens
gaacacaaaggcucuaugg

SEQ ID NO: 335350 - RNA, 19 nt, Homo sapiens
acacaaaggcucuauggaa

SEQ ID NO: 335351 - RNA, 19 nt, Homo sapiens
acaaugauccugccaagaa

SEQ ID NO: 335352 - RNA, 19 nt, Homo sapiens
gaaagagcagucaaagaug

SEQ ID NO: 335353 - RNA, 19 nt, Homo sapiens
agaaagagcagucaaagau

SEQ ID NO: 335354 - RNA, 19 nt, Homo sapiens
aaauaggacacccaucuua

SEQ ID NO: 335355 - RNA, 19 nt, Homo sapiens
ugaaaagccugaaaucaaa

SEQ ID NO: 335356 - RNA, 19 nt, Homo sapiens
caaaagacccaaaacuaua

SEQ ID NO: 335357 - RNA, 19 nt, Homo sapiens
ucagaugacuguaaaauga

SEQ ID NO: 335358 - RNA, 19 nt, Homo sapiens
gaagauaauagaccagcaa

SEQ ID NO: 335359 - RNA, 19 nt, Homo sapiens
ggagaaccuuuccuucaag

SEQ ID NO: 335360 - RNA, 19 nt, Homo sapiens
aggauacucugaagaacua

SEQ ID NO: 335361 - RNA, 19 nt, Homo sapiens
gcacgaaagagaucaagau

SEQ ID NO: 335362 - RNA, 19 nt, Homo sapiens
cauaucacaguaucaguua

SEQ ID NO: 335363 - RNA, 19 nt, Homo sapiens
ccacauguccgugcaauug

SEQ ID NO: 335364 - RNA, 19 nt, Homo sapiens
uaacagagggcaagugcaa

SEQ ID NO: 335365 - RNA, 19 nt, Homo sapiens
ggaagaaaugccucuaugu

SEQ ID NO: 335366 - RNA, 19 nt, Homo sapiens
cuuucuagaugccuuaaua

SEQ ID NO: 335367 - RNA, 19 nt, Homo sapiens
gaaauucuugcuucucgaa

SEQ ID NO: 335368 - RNA, 19 nt, Homo sapiens
gagugaacuugaaucuuug

SEQ ID NO: 335369 - RNA, 19 nt, Homo sapiens
gcaaaagacccaaaacuau

SEQ ID NO: 335370 - RNA, 19 nt, Homo sapiens
gaagaaagagcagucaaag

SEQ ID NO: 335371 - RNA, 19 nt, Homo sapiens
cuauguaggugaaguguuc

SEQ ID NO: 335372 - RNA, 19 nt, Homo sapiens
cggaauaccuggaguugca

SEQ ID NO: 335373 - RNA, 19 nt, Homo sapiens
gccaaacugcgcaaagaua

SEQ ID NO: 335374 - RNA, 19 nt, Homo sapiens
uaacccaguuugaaaucuu

SEQ ID NO: 335375 - RNA, 19 nt, Homo sapiens
uuaacugacuuucuagaug

SEQ ID NO: 335376 - RNA, 19 nt, Homo sapiens
aaauagauguucugucucu

SEQ ID NO: 335377 - RNA, 19 nt, Homo sapiens
gaaaggaaagaaacugaag

SEQ ID NO: 335378 - RNA, 19 nt, Homo sapiens
uggagaaccuuuccuucaa

SEQ ID NO: 335379 - RNA, 19 nt, Homo sapiens
gggcuagcuugguuccuuu

SEQ ID NO: 335380 - RNA, 19 nt, Homo sapiens
gaaguccaagccacaauga

SEQ ID NO: 335381 - RNA, 19 nt, Homo sapiens
gcaauugcagcacuuacaa

SEQ ID NO: 335382 - RNA, 19 nt, Homo sapiens
gauaugucuucuccgacua

SEQ ID NO: 335383 - RNA, 19 nt, Homo sapiens
caagaauccuccagguuac

SEQ ID NO: 335384 - RNA, 19 nt, Homo sapiens
uggaagaaaugccucuaug

SEQ ID NO: 335385 - RNA, 19 nt, Homo sapiens
acacaaaggcagaaaggaa

SEQ ID NO: 335386 - RNA, 19 nt, Homo sapiens
gagcaagauucuggacaau

SEQ ID NO: 335387 - RNA, 19 nt, Homo sapiens
gaaaugccucuauguaggu

SEQ ID NO: 335388 - RNA, 19 nt, Homo sapiens
gaacuauguaccuucuuau

SEQ ID NO: 335389 - RNA, 19 nt, Homo sapiens
caaugauccugccaagaau

SEQ ID NO: 335390 - RNA, 19 nt, Homo sapiens
ugaagaaagagcagucaaa

SEQ ID NO: 335391 - RNA, 19 nt, Homo sapiens
ggcaagugcaauuuauuaa

SEQ ID NO: 335392 - RNA, 19 nt, Homo sapiens
uauuaaauuucggcccuua

SEQ ID NO: 335393 - RNA, 19 nt, Homo sapiens
ucuggagucuucaauguau

SEQ ID NO: 335394 - RNA, 19 nt, Homo sapiens
aaucuggagucuucaaugu

SEQ ID NO: 335395 - RNA, 19 nt, Homo sapiens
cggccaauguccaaaauua

SEQ ID NO: 335396 - RNA, 19 nt, Homo sapiens
cacgaaagagaucaagaua

SEQ ID NO: 335397 - RNA, 19 nt, Homo sapiens
caaccauacuaucaugaca

SEQ ID NO: 335398 - RNA, 19 nt, Homo sapiens
caacuucccaauuggagaa

SEQ ID NO: 335399 - RNA, 19 nt, Homo sapiens
ccaaacugcgcaaagauau

SEQ ID NO: 335400 - RNA, 19 nt, Homo sapiens
gaaaacgcaaguacuuuaa

SEQ ID NO: 335401 - RNA, 19 nt, Homo sapiens
uauaagcacucugauuucu

SEQ ID NO: 335402 - RNA, 19 nt, Homo sapiens
acuaauucccuuaagguua

SEQ ID NO: 335403 - RNA, 19 nt, Homo sapiens
cacaaaggcagaaaggaaa

SEQ ID NO: 335404 - RNA, 19 nt, Homo sapiens
ggaaguccaagccacaaug

SEQ ID NO: 335405 - RNA, 19 nt, Homo sapiens
gaaugucaaaggaugaaga

SEQ ID NO: 335406 - RNA, 19 nt, Homo sapiens
gagaagcgaaugucaaagg

SEQ ID NO: 335407 - RNA, 19 nt, Homo sapiens
ugaaguccgcugggaaaua

SEQ ID NO: 335408 - RNA, 19 nt, Homo sapiens
cagaaaggaaagaaacuga

SEQ ID NO: 335409 - RNA, 19 nt, Homo sapiens
caaauaggacacccaucuu

SEQ ID NO: 335410 - RNA, 19 nt, Homo sapiens
ucaaauaggacacccaucu

SEQ ID NO: 335411 - RNA, 19 nt, Homo sapiens
gaaagagaucaagauaugu

SEQ ID NO: 335412 - RNA, 19 nt, Homo sapiens
cgaaaacgcaaguacuuua

SEQ ID NO: 335413 - RNA, 19 nt, Homo sapiens
aagggucgaugauauuuca

SEQ ID NO: 335414 - RNA, 19 nt, Homo sapiens
gcacgccgagugaacuuga

SEQ ID NO: 335415 - RNA, 19 nt, Homo sapiens
ggacagggaugggcucuga

SEQ ID NO: 335416 - RNA, 19 nt, Homo sapiens
ucaaggagcuggaccucua

SEQ ID NO: 335417 - RNA, 19 nt, Homo sapiens
ucacugagcucauccaagu

SEQ ID NO: 335418 - RNA, 19 nt, Homo sapiens
agacagagauggacaaguc

SEQ ID NO: 335419 - RNA, 19 nt, Homo sapiens
gaacaggacccaacuucuc

SEQ ID NO: 335420 - RNA, 19 nt, Homo sapiens
ggagcaagcggcacaaauc

SEQ ID NO: 335421 - RNA, 19 nt, Homo sapiens
ggacaagucaccauucaac

SEQ ID NO: 335422 - RNA, 19 nt, Homo sapiens
gcacuggccucagaagaac

SEQ ID NO: 335423 - RNA, 19 nt, Homo sapiens
gagcaucaccggcaagaag

SEQ ID NO: 335424 - RNA, 19 nt, Homo sapiens
gcgagaagcccgaggucaa

SEQ ID NO: 335425 - RNA, 19 nt, Homo sapiens
ugagcgagaugcagagcaa

SEQ ID NO: 335426 - RNA, 19 nt, Homo sapiens
agaagcggaugucgaagga

SEQ ID NO: 335427 - RNA, 19 nt, Homo sapiens
gauagcaaaggucuucuuc

SEQ ID NO: 335428 - RNA, 19 nt, Homo sapiens
ugaagaagacagagaugga

SEQ ID NO: 335429 - RNA, 19 nt, Homo sapiens
gaggacagcaagcccauca

SEQ ID NO: 335430 - RNA, 19 nt, Homo sapiens
aaacaaaggcagaagaaaa

SEQ ID NO: 335431 - RNA, 19 nt, Homo sapiens
gcucugcauuucccuacga

SEQ ID NO: 335432 - RNA, 19 nt, Homo sapiens
acacauagacgcacacacu

SEQ ID NO: 335433 - RNA, 19 nt, Homo sapiens
cagcgucacugagcucauc

SEQ ID NO: 335434 - RNA, 19 nt, Homo sapiens
ggaacaggacccaacuucu

SEQ ID NO: 335435 - RNA, 19 nt, Homo sapiens
ggucauggucauccuguuc

SEQ ID NO: 335436 - RNA, 19 nt, Homo sapiens
uggccaagcugcgcaagga

SEQ ID NO: 335437 - RNA, 19 nt, Homo sapiens
ggauagcaaaggucuucuu

SEQ ID NO: 335438 - RNA, 19 nt, Homo sapiens
cccaggacccgcucaaaga

SEQ ID NO: 335439 - RNA, 19 nt, Homo sapiens
caacuggacggaggacaug

SEQ ID NO: 335440 - RNA, 19 nt, Homo sapiens
gcaacuggacggaggacau

SEQ ID NO: 335441 - RNA, 19 nt, Homo sapiens
aagcgcaaguacuucaaga

SEQ ID NO: 335442 - RNA, 19 nt, Homo sapiens
gaagacagagauggacaag

SEQ ID NO: 335443 - RNA, 19 nt, Homo sapiens
acgagaagcggaugucgaa

SEQ ID NO: 335444 - RNA, 19 nt, Homo sapiens
cuacccaccucaucucaac

SEQ ID NO: 335445 - RNA, 19 nt, Homo sapiens
gcacacacucaggaggaaa

SEQ ID NO: 335446 - RNA, 19 nt, Homo sapiens
gagcaagcggcacaaaucg

SEQ ID NO: 335447 - RNA, 19 nt, Homo sapiens
gggagcaagcggcacaaau

SEQ ID NO: 335448 - RNA, 19 nt, Homo sapiens
gacaagucaccauucaaca

SEQ ID NO: 335449 - RNA, 19 nt, Homo sapiens
ccaggacccgcucaaagau

SEQ ID NO: 335450 - RNA, 19 nt, Homo sapiens
guccuccgcucugcauuuc

SEQ ID NO: 335451 - RNA, 19 nt, Homo sapiens
cgggcucgauggaggaaga

SEQ ID NO: 335452 - RNA, 19 nt, Homo sapiens
gaugaguuccacccguuca

SEQ ID NO: 335453 - RNA, 19 nt, Homo sapiens
gaacaaaucuucugcaugu

SEQ ID NO: 335454 - RNA, 19 nt, Homo sapiens
ccagagaacuuguauuuga

SEQ ID NO: 335455 - RNA, 19 nt, Homo sapiens
gaaaacaaguuccagauua

SEQ ID NO: 335456 - RNA, 19 nt, Homo sapiens
ggaagaauauugauggauu

SEQ ID NO: 335457 - RNA, 19 nt, Homo sapiens
gaaagacaguggcuacaaa

SEQ ID NO: 335458 - RNA, 19 nt, Homo sapiens
uuaaagagcuugagaauac

SEQ ID NO: 335459 - RNA, 19 nt, Homo sapiens
aaacuuaucugcagagguu

SEQ ID NO: 335460 - RNA, 19 nt, Homo sapiens
gacaguggcuacaaaguuu

SEQ ID NO: 335461 - RNA, 19 nt, Homo sapiens
aguaagagcugggcauuua

SEQ ID NO: 335462 - RNA, 19 nt, Homo sapiens
ugacuaacauucaagauug

SEQ ID NO: 335463 - RNA, 19 nt, Homo sapiens
uaaggagccugacggauuu

SEQ ID NO: 335464 - RNA, 19 nt, Homo sapiens
gcaagugacuaacauucaa

SEQ ID NO: 335465 - RNA, 19 nt, Homo sapiens
uaacggaagugucagaaga

SEQ ID NO: 335466 - RNA, 19 nt, Homo sapiens
aaacuuuccucaccuauug

SEQ ID NO: 335467 - RNA, 19 nt, Homo sapiens
guagaagccuuugauaaug

SEQ ID NO: 335468 - RNA, 19 nt, Homo sapiens
gugcacauguugucuguuu

SEQ ID NO: 335469 - RNA, 19 nt, Homo sapiens
gugcacagauuaugaugaa

SEQ ID NO: 335470 - RNA, 19 nt, Homo sapiens
gagguugucucacucaaga

SEQ ID NO: 335471 - RNA, 19 nt, Homo sapiens
caacuucauucaauaagga

SEQ ID NO: 335472 - RNA, 19 nt, Homo sapiens
agaaagaugucauuugcaa

SEQ ID NO: 335473 - RNA, 19 nt, Homo sapiens
agaaagaugcuauguauug

SEQ ID NO: 335474 - RNA, 19 nt, Homo sapiens
caagauuggucucucaaau

SEQ ID NO: 335475 - RNA, 19 nt, Homo sapiens
gagcaggcgucucuugaug

SEQ ID NO: 335476 - RNA, 19 nt, Homo sapiens
gaagaaaacgccacuuuaa

SEQ ID NO: 335477 - RNA, 19 nt, Homo sapiens
ggaacacgauaacgaagga

SEQ ID NO: 335478 - RNA, 19 nt, Homo sapiens
uagaagccuuugauaauga

SEQ ID NO: 335479 - RNA, 19 nt, Homo sapiens
gcaagagccgauggaauua

SEQ ID NO: 335480 - RNA, 19 nt, Homo sapiens
cuauugacaugacaucuaa

SEQ ID NO: 335481 - RNA, 19 nt, Homo sapiens
cgaaggcuguauauauuga

SEQ ID NO: 335482 - RNA, 19 nt, Homo sapiens
gcacagauuaugaugaaga

SEQ ID NO: 335483 - RNA, 19 nt, Homo sapiens
gcaugcaacugugguuaaa

SEQ ID NO: 335484 - RNA, 19 nt, Homo sapiens
gaaagaugcuauguauugg

SEQ ID NO: 335485 - RNA, 19 nt, Homo sapiens
gcaauagagcaguccauuu

SEQ ID NO: 335486 - RNA, 19 nt, Homo sapiens
gaacgucggaaacugauga

SEQ ID NO: 335487 - RNA, 19 nt, Homo sapiens
ccaaagccaugcagaucaa

SEQ ID NO: 335488 - RNA, 19 nt, Homo sapiens
uuaauuagcuccacagcau

SEQ ID NO: 335489 - RNA, 19 nt, Homo sapiens
cagagaacuuguauuugaa

SEQ ID NO: 335490 - RNA, 19 nt, Homo sapiens
gguuaaaguuccagaagug

SEQ ID NO: 335491 - RNA, 19 nt, Homo sapiens
gcuguguacuuucaagauu

SEQ ID NO: 335492 - RNA, 19 nt, Homo sapiens
gcaggaacacgauaacgaa

SEQ ID NO: 335493 - RNA, 19 nt, Homo sapiens
cagggaagcugcagaaguc

SEQ ID NO: 335494 - RNA, 19 nt, Homo sapiens
ggcccaacuucauucaaua

SEQ ID NO: 335495 - RNA, 19 nt, Homo sapiens
ucaaguaguuguauuucug

SEQ ID NO: 335496 - RNA, 19 nt, Homo sapiens
gguccuuaauucugcuuua

SEQ ID NO: 335497 - RNA, 19 nt, Homo sapiens
gaaacucaguaauucuaca

SEQ ID NO: 335498 - RNA, 19 nt, Homo sapiens
gaggaaacgggaauucauu

SEQ ID NO: 335499 - RNA, 19 nt, Homo sapiens
ggacgugcuucucagugaa

SEQ ID NO: 335500 - RNA, 19 nt, Homo sapiens
acaagaugaugguccuuaa

SEQ ID NO: 335501 - RNA, 19 nt, Homo sapiens
ugcgaaggcuguauauauu

SEQ ID NO: 335502 - RNA, 19 nt, Homo sapiens
gagaugaccgaggcucuua

SEQ ID NO: 335503 - RNA, 19 nt, Homo sapiens
uaaugaagcugccaaaaga

SEQ ID NO: 335504 - RNA, 19 nt, Homo sapiens
guagcaauguggacaagau

SEQ ID NO: 335505 - RNA, 19 nt, Homo sapiens
gaugcuauguauugggaaa

SEQ ID NO: 335506 - RNA, 19 nt, Homo sapiens
gaccugugaugucauuuca

SEQ ID NO: 335507 - RNA, 19 nt, Homo sapiens
uuagaaagaugucauuugc

SEQ ID NO: 335508 - RNA, 19 nt, Homo sapiens
caaguaugguacauucuuc

SEQ ID NO: 335509 - RNA, 19 nt, Homo sapiens
auuaaacacucuccacaaa

SEQ ID NO: 335510 - RNA, 19 nt, Homo sapiens
gaugaagauuagauugugu

SEQ ID NO: 335511 - RNA, 19 nt, Homo sapiens
caagggagccaagagauga

SEQ ID NO: 335512 - RNA, 19 nt, Homo sapiens
ggaauuagagagcuacaca

SEQ ID NO: 335513 - RNA, 19 nt, Homo sapiens
gcugagcugcuuucacuaa

SEQ ID NO: 335514 - RNA, 19 nt, Homo sapiens
gacaagaugaugguccuua

SEQ ID NO: 335515 - RNA, 19 nt, Homo sapiens
auaaaggauuggugacaaa

SEQ ID NO: 335516 - RNA, 19 nt, Homo sapiens
aaagcucgcuguccgaugu

SEQ ID NO: 335517 - RNA, 19 nt, Homo sapiens
gagaagcgucgacugaaug

SEQ ID NO: 335518 - RNA, 19 nt, Homo sapiens
aggguaagguuguuucuga

SEQ ID NO: 335519 - RNA, 19 nt, Homo sapiens
ucggagcacuggcaucaaa

SEQ ID NO: 335520 - RNA, 19 nt, Homo sapiens
gagagcaggaacacgauaa

SEQ ID NO: 335521 - RNA, 19 nt, Homo sapiens
ucagaaguguccucaguag

SEQ ID NO: 335522 - RNA, 19 nt, Homo sapiens
ugaaugaccugguuuuaga

SEQ ID NO: 335523 - RNA, 19 nt, Homo sapiens
uuacacagcguccaucuau

SEQ ID NO: 335524 - RNA, 19 nt, Homo sapiens
agaaguguccucaguagaa

SEQ ID NO: 335525 - RNA, 19 nt, Homo sapiens
gcuguccgauguuucagaa

SEQ ID NO: 335526 - RNA, 19 nt, Homo sapiens
ugagaagcgucgacugaau

SEQ ID NO: 335527 - RNA, 19 nt, Homo sapiens
caauagagcaguccauuuu

SEQ ID NO: 335528 - RNA, 19 nt, Homo sapiens
ccaugcagaucaaaguaga

SEQ ID NO: 335529 - RNA, 19 nt, Homo sapiens
uaaacacucuccacaaagc

SEQ ID NO: 335530 - RNA, 19 nt, Homo sapiens
gagcugggcauuuagaaag

SEQ ID NO: 335531 - RNA, 19 nt, Homo sapiens
cuguguacuuucaagauua

SEQ ID NO: 335532 - RNA, 19 nt, Homo sapiens
auaaggagccugacggauu

SEQ ID NO: 335533 - RNA, 19 nt, Homo sapiens
ucagaagacuccacaacag

SEQ ID NO: 335534 - RNA, 19 nt, Homo sapiens
gcgaaggcuguauauauug

SEQ ID NO: 335535 - RNA, 19 nt, Homo sapiens
auucuucucuuacuccuuu

SEQ ID NO: 335536 - RNA, 19 nt, Homo sapiens
caagagauucagaaacuca

SEQ ID NO: 335537 - RNA, 19 nt, Homo sapiens
gagaauacggggaaauuaa

SEQ ID NO: 335538 - RNA, 19 nt, Homo sapiens
gaugucauuugcaauagag

SEQ ID NO: 335539 - RNA, 19 nt, Homo sapiens
gugacuaacauucaagauu

SEQ ID NO: 335540 - RNA, 19 nt, Homo sapiens
uaaaagacauuucgaacuc

SEQ ID NO: 335541 - RNA, 19 nt, Homo sapiens
aguagaagccuuugauaau

SEQ ID NO: 335542 - RNA, 19 nt, Homo sapiens
agcaagagccgauggaauu

SEQ ID NO: 335543 - RNA, 19 nt, Homo sapiens
ggugucaaguaguuguauu

SEQ ID NO: 335544 - RNA, 19 nt, Homo sapiens
ucgauggugucaaguaguu

SEQ ID NO: 335545 - RNA, 19 nt, Homo sapiens
gagauucagaaacucagua

SEQ ID NO: 335546 - RNA, 19 nt, Homo sapiens
uaauugcacugggagaaga

SEQ ID NO: 335547 - RNA, 19 nt, Homo sapiens
aauaaaggauuggugacaa

SEQ ID NO: 335548 - RNA, 19 nt, Homo sapiens
gcccaacuucauucaauaa

SEQ ID NO: 335549 - RNA, 19 nt, Homo sapiens
acacauagauaggguaagg

SEQ ID NO: 335550 - RNA, 19 nt, Homo sapiens
acccagagaacuuguauuu

SEQ ID NO: 335551 - RNA, 19 nt, Homo sapiens
guacauucuucucuuacuc

SEQ ID NO: 335552 - RNA, 19 nt, Homo sapiens
gaaguguccucaguagaac

SEQ ID NO: 335553 - RNA, 19 nt, Homo sapiens
gaaggaguuugugcaguuu

SEQ ID NO: 335554 - RNA, 19 nt, Homo sapiens
gcagugcccucuccucuca

SEQ ID NO: 335555 - RNA, 19 nt, Homo sapiens
ugacggagcuggugagagu

SEQ ID NO: 335556 - RNA, 19 nt, Homo sapiens
ugaaggaguuugugcaguu

SEQ ID NO: 335557 - RNA, 19 nt, Homo sapiens
caggaaagcuggacuucug

SEQ ID NO: 335558 - RNA, 19 nt, Homo sapiens
ggagagcccuguugaugac

SEQ ID NO: 335559 - RNA, 19 nt, Homo sapiens
gcgagaagcccgagaucaa

SEQ ID NO: 335560 - RNA, 19 nt, Homo sapiens
gacggcaacuuucugaaca

SEQ ID NO: 335561 - RNA, 19 nt, Homo sapiens
gagaagaaauuuugagaac

SEQ ID NO: 335562 - RNA, 19 nt, Homo sapiens
gaacaucccacagcagucu

SEQ ID NO: 335563 - RNA, 19 nt, Homo sapiens
gaauccggacaaucagaua

SEQ ID NO: 335564 - RNA, 19 nt, Homo sapiens
uaaguuuccaggacuguuu

SEQ ID NO: 335565 - RNA, 19 nt, Homo sapiens
cuaaagaagucaggaaagc

SEQ ID NO: 335566 - RNA, 19 nt, Homo sapiens
acaaucagauaguucaaac

SEQ ID NO: 335567 - RNA, 19 nt, Homo sapiens
agaacuggaucuuuaucug

SEQ ID NO: 335568 - RNA, 19 nt, Homo sapiens
ugauaaagaucgacaaaag

SEQ ID NO: 335569 - RNA, 19 nt, Homo sapiens
gacaaucagauaguucaaa

SEQ ID NO: 335570 - RNA, 19 nt, Homo sapiens
aguccugguuccucugaua

SEQ ID NO: 335571 - RNA, 19 nt, Homo sapiens
ggacggcaacuuucugaac

SEQ ID NO: 335572 - RNA, 19 nt, Homo sapiens
ggaauccggacaaucagau

SEQ ID NO: 335573 - RNA, 19 nt, Homo sapiens
ccacaucacauuggaguca

SEQ ID NO: 335574 - RNA, 19 nt, Homo sapiens
ggacaaucagauaguucaa

SEQ ID NO: 335575 - RNA, 19 nt, Homo sapiens
ccagccacaucacauugga

SEQ ID NO: 335576 - RNA, 19 nt, Homo sapiens
uggccaagcugcgcaagga

SEQ ID NO: 335577 - RNA, 19 nt, Homo sapiens
uggagagcccuguugauga

SEQ ID NO: 335578 - RNA, 19 nt, Homo sapiens
caucagggcccaacuucuc

SEQ ID NO: 335579 - RNA, 19 nt, Homo sapiens
gauaaagaucgacaaaaga

SEQ ID NO: 335580 - RNA, 19 nt, Homo sapiens
aagcgcaaguacuucaaga

SEQ ID NO: 335581 - RNA, 19 nt, Homo sapiens
gaccaucacgggcaagaag

SEQ ID NO: 335582 - RNA, 19 nt, Homo sapiens
gagagucccagcuacuaca

SEQ ID NO: 335583 - RNA, 19 nt, Homo sapiens
gcccaacgauguggaugca

SEQ ID NO: 335584 - RNA, 19 nt, Homo sapiens
ggagagucccagcuacuac

SEQ ID NO: 335585 - RNA, 19 nt, Homo sapiens
cagucgagcccguauuuca

SEQ ID NO: 335586 - RNA, 19 nt, Homo sapiens
ggagaagaaauuuugagaa

SEQ ID NO: 335587 - RNA, 19 nt, Homo sapiens
cgacaaaagaaacaacaaa

SEQ ID NO: 335588 - RNA, 19 nt, Homo sapiens
cagcaucagcccugcacuu

SEQ ID NO: 335589 - RNA, 19 nt, Homo sapiens
uuaucuggcuuacuuuguc

SEQ ID NO: 335590 - RNA, 19 nt, Homo sapiens
agcccgagaucaagcagaa

SEQ ID NO: 335591 - RNA, 19 nt, Homo sapiens
aaaaugagaagaagagguu

SEQ ID NO: 335592 - RNA, 19 nt, Homo sapiens
ggagucacaaucaaagaac

SEQ ID NO: 335593 - RNA, 19 nt, Homo sapiens
aaaagcggaugucgaagga

SEQ ID NO: 335594 - RNA, 19 nt, Homo sapiens
ucugauaaagaucgacaaa

SEQ ID NO: 335595 - RNA, 19 nt, Homo sapiens
gaugaguuccacccguuca

SEQ ID NO: 335596 - RNA, 19 nt, Homo sapiens
cagcaucagggcccaacuu

SEQ ID NO: 335597 - RNA, 19 nt, Homo sapiens
gagucacaaucaaagaacu

SEQ ID NO: 335598 - RNA, 19 nt, Homo sapiens
gcagguauuugacauauua

SEQ ID NO: 335599 - RNA, 19 nt, Homo sapiens
gcaauagccugccauguuu

SEQ ID NO: 335600 - RNA, 19 nt, Homo sapiens
gcaccuagcugccaaagaa

SEQ ID NO: 335601 - RNA, 19 nt, Homo sapiens
gaugggaucugcacuguaa

SEQ ID NO: 335602 - RNA, 19 nt, Homo sapiens
gaggaaaucugacuuggaa

SEQ ID NO: 335603 - RNA, 19 nt, Homo sapiens
gcccauaccuucaaauauu

SEQ ID NO: 335604 - RNA, 19 nt, Homo sapiens
gggaugagguugcuuacua

SEQ ID NO: 335605 - RNA, 19 nt, Homo sapiens
caacuuggcuuccuuucuu

SEQ ID NO: 335606 - RNA, 19 nt, Homo sapiens
gggaaggccugaacaaaug

SEQ ID NO: 335607 - RNA, 19 nt, Homo sapiens
gaaccacgccucuagauau

SEQ ID NO: 335608 - RNA, 19 nt, Homo sapiens
cagcaaagguuauuguuca

SEQ ID NO: 335609 - RNA, 19 nt, Homo sapiens
ggaugagguugcuuacuaa

SEQ ID NO: 335610 - RNA, 19 nt, Homo sapiens
caaagaaggacaugauaaa

SEQ ID NO: 335611 - RNA, 19 nt, Homo sapiens
ccacagauguucauagaca

SEQ ID NO: 335612 - RNA, 19 nt, Homo sapiens
ggcagaagaugauccauau

SEQ ID NO: 335613 - RNA, 19 nt, Homo sapiens
gaaauuaggucuggggaua

SEQ ID NO: 335614 - RNA, 19 nt, Homo sapiens
agaaggacaugauaaaguu

SEQ ID NO: 335615 - RNA, 19 nt, Homo sapiens
gaagucacaucugguuuga

SEQ ID NO: 335616 - RNA, 19 nt, Homo sapiens
ggaggaaauuuaucuucuu

SEQ ID NO: 335617 - RNA, 19 nt, Homo sapiens
gacagaagcugaagugcau

SEQ ID NO: 335618 - RNA, 19 nt, Homo sapiens
cagaagaugauccauauuu

SEQ ID NO: 335619 - RNA, 19 nt, Homo sapiens
gcaaucauccaccuucauu

SEQ ID NO: 335620 - RNA, 19 nt, Homo sapiens
ggagacauccuuccgcaaa

SEQ ID NO: 335621 - RNA, 19 nt, Homo sapiens
caaagguuauuguucaguu

SEQ ID NO: 335622 - RNA, 19 nt, Homo sapiens
cuacuauccugaaaucaaa

SEQ ID NO: 335623 - RNA, 19 nt, Homo sapiens
ggaaggauuuggagauuuu

SEQ ID NO: 335624 - RNA, 19 nt, Homo sapiens
gcaggaaggaccucuagaa

SEQ ID NO: 335625 - RNA, 19 nt, Homo sapiens
ggacaguacuaccuacgau

SEQ ID NO: 335626 - RNA, 19 nt, Homo sapiens
ugacaaaguucagaaagau

SEQ ID NO: 335627 - RNA, 19 nt, Homo sapiens
cccauaccuucaaauauua

SEQ ID NO: 335628 - RNA, 19 nt, Homo sapiens
ccaaagaaggacaugauaa

SEQ ID NO: 335629 - RNA, 19 nt, Homo sapiens
aaacagagaggauuucguu

SEQ ID NO: 335630 - RNA, 19 nt, Homo sapiens
ccacaaggcagcaaauaga

SEQ ID NO: 335631 - RNA, 19 nt, Homo sapiens
aaacacuuauggacaacua

SEQ ID NO: 335632 - RNA, 19 nt, Homo sapiens
ggaaccacgccucuagaua

SEQ ID NO: 335633 - RNA, 19 nt, Homo sapiens
agucacaucugguuugauu

SEQ ID NO: 335634 - RNA, 19 nt, Homo sapiens
gugcuggaguucaggauaa

SEQ ID NO: 335635 - RNA, 19 nt, Homo sapiens
agaagaugauccauauuug

SEQ ID NO: 335636 - RNA, 19 nt, Homo sapiens
gaacuuugagccucucuau

SEQ ID NO: 335637 - RNA, 19 nt, Homo sapiens
cauggacacugaaucuaaa

SEQ ID NO: 335638 - RNA, 19 nt, Homo sapiens
aagaagaagugcagaggaa

SEQ ID NO: 335639 - RNA, 19 nt, Homo sapiens
gugacaaaguucagaaaga

SEQ ID NO: 335640 - RNA, 19 nt, Homo sapiens
uaucagacgccaucuauga

SEQ ID NO: 335641 - RNA, 19 nt, Homo sapiens
acccugaccuugccuauuu

SEQ ID NO: 335642 - RNA, 19 nt, Homo sapiens
ggauuucguuuccguuaug

SEQ ID NO: 335643 - RNA, 19 nt, Homo sapiens
gggaaggauuuggagauuu

SEQ ID NO: 335644 - RNA, 19 nt, Homo sapiens
gaggauuucguuuccguua

SEQ ID NO: 335645 - RNA, 19 nt, Homo sapiens
ggacaacuaugaggucucu

SEQ ID NO: 335646 - RNA, 19 nt, Homo sapiens
gauccuucuuugacucaua

SEQ ID NO: 335647 - RNA, 19 nt, Homo sapiens
ugacaaaagugaugacaaa

SEQ ID NO: 335648 - RNA, 19 nt, Homo sapiens
ggacaggacagcuggaugu

SEQ ID NO: 335649 - RNA, 19 nt, Homo sapiens
caugagaaaugaucuguac

SEQ ID NO: 335650 - RNA, 19 nt, Homo sapiens
gcaaagaggcaugccaaug

SEQ ID NO: 335651 - RNA, 19 nt, Homo sapiens
ugaggucacucuaacguau

SEQ ID NO: 335652 - RNA, 19 nt, Homo sapiens
ucacuaagcaggaagaugu

SEQ ID NO: 335653 - RNA, 19 nt, Homo sapiens
caucugguuugauuucuga

SEQ ID NO: 335654 - RNA, 19 nt, Homo sapiens
ggguauagcuucccacacu

SEQ ID NO: 335655 - RNA, 19 nt, Homo sapiens
gggaggaaauuuaucuucu

SEQ ID NO: 335656 - RNA, 19 nt, Homo sapiens
gcacgacaacaucucauug

SEQ ID NO: 335657 - RNA, 19 nt, Homo sapiens
caugauaaaguucucagua

SEQ ID NO: 335658 - RNA, 19 nt, Homo sapiens
acuauggauuuccuacuua

SEQ ID NO: 335659 - RNA, 19 nt, Homo sapiens
gggcuacaccgaagcaauu

SEQ ID NO: 335660 - RNA, 19 nt, Homo sapiens
caggauaaccucuuucuag

SEQ ID NO: 335661 - RNA, 19 nt, Homo sapiens
gguauagcuucccacacua

SEQ ID NO: 335662 - RNA, 19 nt, Homo sapiens
aagcugaagugcauccaaa

SEQ ID NO: 335663 - RNA, 19 nt, Homo sapiens
gaagaugauccauauuugg

SEQ ID NO: 335664 - RNA, 19 nt, Homo sapiens
aagaugugguggaggauuu

SEQ ID NO: 335665 - RNA, 19 nt, Homo sapiens
aggauaaccucuuucuaga

SEQ ID NO: 335666 - RNA, 19 nt, Homo sapiens
ccauggacacugaaucuaa

SEQ ID NO: 335667 - RNA, 19 nt, Homo sapiens
ggaggcauguuugguagug

SEQ ID NO: 335668 - RNA, 19 nt, Homo sapiens
ucauuuggauccuucuuug

SEQ ID NO: 335669 - RNA, 19 nt, Homo sapiens
gguaucagacgccaucuau

SEQ ID NO: 335670 - RNA, 19 nt, Homo sapiens
caagacagaagcugaagug

SEQ ID NO: 335671 - RNA, 19 nt, Homo sapiens
ccaaaacacuuauggacaa

SEQ ID NO: 335672 - RNA, 19 nt, Homo sapiens
gcagcuguauaaguuacua

SEQ ID NO: 335673 - RNA, 19 nt, Homo sapiens
gaagagagugcuggaguuc

SEQ ID NO: 335674 - RNA, 19 nt, Homo sapiens
ccuggugccucuagugaaa

SEQ ID NO: 335675 - RNA, 19 nt, Homo sapiens
aaauuuagccugcugacaa

SEQ ID NO: 335676 - RNA, 19 nt, Homo sapiens
ggagggugaugcccaugug

SEQ ID NO: 335677 - RNA, 19 nt, Homo sapiens
gccaaagaaggacaugaua

SEQ ID NO: 335678 - RNA, 19 nt, Homo sapiens
gacauuaucaacaugagaa

SEQ ID NO: 335679 - RNA, 19 nt, Homo sapiens
aaaggacccugaagguugu

SEQ ID NO: 335680 - RNA, 19 nt, Homo sapiens
cuauaauccuggacucuug

SEQ ID NO: 335681 - RNA, 19 nt, Homo sapiens
ccacccggcuucagaaugg

SEQ ID NO: 335682 - RNA, 19 nt, Homo sapiens
gcugcuuucuguugucauu

SEQ ID NO: 335683 - RNA, 19 nt, Homo sapiens
cgaagcaauugaagugauc

SEQ ID NO: 335684 - RNA, 19 nt, Homo sapiens
caaagcagcaggagcagau

SEQ ID NO: 335685 - RNA, 19 nt, Homo sapiens
agaagagagugcuggaguu

SEQ ID NO: 335686 - RNA, 19 nt, Homo sapiens
agaagcucaugcccaauuu

SEQ ID NO: 335687 - RNA, 19 nt, Homo sapiens
cagaagcucaugcccaauu

SEQ ID NO: 335688 - RNA, 19 nt, Homo sapiens
gcauccaacuugaaaauug

SEQ ID NO: 335689 - RNA, 19 nt, Homo sapiens
caaaaugccccaugauuau

SEQ ID NO: 335690 - RNA, 19 nt, Homo sapiens
gcaaaccuggguauacuuc

SEQ ID NO: 335691 - RNA, 19 nt, Homo sapiens
ccacaagacagaagcugaa

SEQ ID NO: 335692 - RNA, 19 nt, Homo sapiens
acugcuaacucucaacaaa

SEQ ID NO: 335693 - RNA, 19 nt, Homo sapiens
gaugacauuaucaacauga

SEQ ID NO: 335694 - RNA, 19 nt, Homo sapiens
ccaaugcccuuuucgacua

SEQ ID NO: 335695 - RNA, 19 nt, Homo sapiens
caaugcauccaacuugaaa

SEQ ID NO: 335696 - RNA, 19 nt, Homo sapiens
acaaaaugccccaugauua

SEQ ID NO: 335697 - RNA, 19 nt, Homo sapiens
agagcaaccuaaacagaga

SEQ ID NO: 335698 - RNA, 19 nt, Homo sapiens
ggacaugacugcccaauuu

SEQ ID NO: 335699 - RNA, 19 nt, Homo sapiens
ccaaacaguucaccuauua

SEQ ID NO: 335700 - RNA, 19 nt, Homo sapiens
gcacagaggugaaggaaga

SEQ ID NO: 335701 - RNA, 19 nt, Homo sapiens
ggacgugucugauuccaaa

SEQ ID NO: 335702 - RNA, 19 nt, Homo sapiens
gcagagaggcuuccgauuu

SEQ ID NO: 335703 - RNA, 19 nt, Homo sapiens
caucaaaccugaagauuuc

SEQ ID NO: 335704 - RNA, 19 nt, Homo sapiens
gugaagaccuugcugcuaa

SEQ ID NO: 335705 - RNA, 19 nt, Homo sapiens
ccaaagaacugaagaaggu

SEQ ID NO: 335706 - RNA, 19 nt, Homo sapiens
gcagaaagaugacauugag

SEQ ID NO: 335707 - RNA, 19 nt, Homo sapiens
ccagagacauggagaguug

SEQ ID NO: 335708 - RNA, 19 nt, Homo sapiens
ggacuucucucccacagau

SEQ ID NO: 335709 - RNA, 19 nt, Homo sapiens
aaauugaacuccuccauug

SEQ ID NO: 335710 - RNA, 19 nt, Homo sapiens
gcagcgagcucgagaguac

SEQ ID NO: 335711 - RNA, 19 nt, Homo sapiens
gcaucaaaccugaagauuu

SEQ ID NO: 335712 - RNA, 19 nt, Homo sapiens
cagagaggcuuccgauuuc

SEQ ID NO: 335713 - RNA, 19 nt, Homo sapiens
ggugauggaucugaguaua

SEQ ID NO: 335714 - RNA, 19 nt, Homo sapiens
cgugaacgcucgcaccuuu

SEQ ID NO: 335715 - RNA, 19 nt, Homo sapiens
ggguggagaugaaguuuau

SEQ ID NO: 335716 - RNA, 19 nt, Homo sapiens
ugaagaaggugauggaucu

SEQ ID NO: 335717 - RNA, 19 nt, Homo sapiens
gugacaaggugcagaaaga

SEQ ID NO: 335718 - RNA, 19 nt, Homo sapiens
gaugaaguuuaucugcuuu

SEQ ID NO: 335719 - RNA, 19 nt, Homo sapiens
gcauaugccugacuuugag

SEQ ID NO: 335720 - RNA, 19 nt, Homo sapiens
gaaagaugacauugagguu

SEQ ID NO: 335721 - RNA, 19 nt, Homo sapiens
aaguuuaucugcuuuguga

SEQ ID NO: 335722 - RNA, 19 nt, Homo sapiens
gcuaaaugcugcucagaac

SEQ ID NO: 335723 - RNA, 19 nt, Homo sapiens
gcccauccaugauagcaaa

SEQ ID NO: 335724 - RNA, 19 nt, Homo sapiens
gcaagaggccaaagaacug

SEQ ID NO: 335725 - RNA, 19 nt, Homo sapiens
cgaacagccuugcaucuag

SEQ ID NO: 335726 - RNA, 19 nt, Homo sapiens
caaauugaacuccuccauu

SEQ ID NO: 335727 - RNA, 19 nt, Homo sapiens
gcgcuucucugccuuccuu

SEQ ID NO: 335728 - RNA, 19 nt, Homo sapiens
gacaugacugcccaauuua

SEQ ID NO: 335729 - RNA, 19 nt, Homo sapiens
ggagcaagaggccaaagaa

SEQ ID NO: 335730 - RNA, 19 nt, Homo sapiens
guagacacguaccgacaga

SEQ ID NO: 335731 - RNA, 19 nt, Homo sapiens
caaauaaaggauucucaug

SEQ ID NO: 335732 - RNA, 19 nt, Homo sapiens
uaaacaguaugccauugug

SEQ ID NO: 335733 - RNA, 19 nt, Homo sapiens
ggaacagccuaagcagaga

SEQ ID NO: 335734 - RNA, 19 nt, Homo sapiens
gaaggcuggugcugacauc

SEQ ID NO: 335735 - RNA, 19 nt, Homo sapiens
ugaagaccuugcugcuaaa

SEQ ID NO: 335736 - RNA, 19 nt, Homo sapiens
cagaugugcauaaacagua

SEQ ID NO: 335737 - RNA, 19 nt, Homo sapiens
gcagaccagugucauugag

SEQ ID NO: 335738 - RNA, 19 nt, Homo sapiens
gggcagaccagugucauug

SEQ ID NO: 335739 - RNA, 19 nt, Homo sapiens
caaccuggguguccugcau

SEQ ID NO: 335740 - RNA, 19 nt, Homo sapiens
gaaagaccuaucccacugu

SEQ ID NO: 335741 - RNA, 19 nt, Homo sapiens
gagaaggacacccgaagca

SEQ ID NO: 335742 - RNA, 19 nt, Homo sapiens
ggacgagaacggagacaca

SEQ ID NO: 335743 - RNA, 19 nt, Homo sapiens
cuaugaggaugaugagaau

SEQ ID NO: 335744 - RNA, 19 nt, Homo sapiens
ugacuaagaagaacaugau

SEQ ID NO: 335745 - RNA, 19 nt, Homo sapiens
ggaucggcauggagacuca

SEQ ID NO: 335746 - RNA, 19 nt, Homo sapiens
ucauugagcagauagucua

SEQ ID NO: 335747 - RNA, 19 nt, Homo sapiens
gaagauugagcggccugua

SEQ ID NO: 335748 - RNA, 19 nt, Homo sapiens
acauugagguucgguucua

SEQ ID NO: 335749 - RNA, 19 nt, Homo sapiens
cugaagauuucucgaaugg

SEQ ID NO: 335750 - RNA, 19 nt, Homo sapiens
gcagccugguagacacgua

SEQ ID NO: 335751 - RNA, 19 nt, Homo sapiens
uaucacaagaugaagauug

SEQ ID NO: 335752 - RNA, 19 nt, Homo sapiens
uccaaacaguucaccuauu

SEQ ID NO: 335753 - RNA, 19 nt, Homo sapiens
gaauggauggcaggccuuu

SEQ ID NO: 335754 - RNA, 19 nt, Homo sapiens
acaaggugcagaaagauga

SEQ ID NO: 335755 - RNA, 19 nt, Homo sapiens
agacgaguguggugagcuu

SEQ ID NO: 335756 - RNA, 19 nt, Homo sapiens
ugacggcgcaggacgagaa

SEQ ID NO: 335757 - RNA, 19 nt, Homo sapiens
ugauggaucugaguauagu

SEQ ID NO: 335758 - RNA, 19 nt, Homo sapiens
ggucuggaugguauuauug

SEQ ID NO: 335759 - RNA, 19 nt, Homo sapiens
ccacugucaagaucuguaa

SEQ ID NO: 335760 - RNA, 19 nt, Homo sapiens
ggugaagaccuugcugcua

SEQ ID NO: 335761 - RNA, 19 nt, Homo sapiens
ccugaagauuucucgaaug

SEQ ID NO: 335762 - RNA, 19 nt, Homo sapiens
agaccuugcugcuaaaugc

SEQ ID NO: 335763 - RNA, 19 nt, Homo sapiens
cugaagggccugagaagga

SEQ ID NO: 335764 - RNA, 19 nt, Homo sapiens
caagaggccaaagaacuga

SEQ ID NO: 335765 - RNA, 19 nt, Homo sapiens
ccucaguugggacaaauaa

SEQ ID NO: 335766 - RNA, 19 nt, Homo sapiens
gacaaggugcagaaagaug

SEQ ID NO: 335767 - RNA, 19 nt, Homo sapiens
gaaguuuaucugcuuugug

SEQ ID NO: 335768 - RNA, 19 nt, Homo sapiens
aucacaagaugaagauuga

SEQ ID NO: 335769 - RNA, 19 nt, Homo sapiens
ucuaugaggaugaugagaa

SEQ ID NO: 335770 - RNA, 19 nt, Homo sapiens
gggcaucaaaccugaagau

SEQ ID NO: 335771 - RNA, 19 nt, Homo sapiens
agcgggagcuggagcaaga

SEQ ID NO: 335772 - RNA, 19 nt, Homo sapiens
ugauacagcucugcagaac

SEQ ID NO: 335773 - RNA, 19 nt, Homo sapiens
gcugacauccaugcugaaa

SEQ ID NO: 335774 - RNA, 19 nt, Homo sapiens
ucacccgccuccuucugaa

SEQ ID NO: 335775 - RNA, 19 nt, Homo sapiens
aagauugagcggccuguaa

SEQ ID NO: 335776 - RNA, 19 nt, Homo sapiens
ugaaguuuaucugcuuugu

SEQ ID NO: 335777 - RNA, 19 nt, Homo sapiens
ugacugcccaauuuaacaa

SEQ ID NO: 335778 - RNA, 19 nt, Homo sapiens
gacaaauaaaggauucuca

SEQ ID NO: 335779 - RNA, 19 nt, Homo sapiens
ugggacaaauaaaggauuc

SEQ ID NO: 335780 - RNA, 19 nt, Homo sapiens
ccacugcaccuagccauca

SEQ ID NO: 335781 - RNA, 19 nt, Homo sapiens
gagcccuacucgacuacug

SEQ ID NO: 335782 - RNA, 19 nt, Homo sapiens
gaggggacgugucugauuc

SEQ ID NO: 335783 - RNA, 19 nt, Homo sapiens
agaugugcauaaacaguau

SEQ ID NO: 335784 - RNA, 19 nt, Homo sapiens
ccagugucauugagcagau

SEQ ID NO: 335785 - RNA, 19 nt, Homo sapiens
ucccagcccauccaugaua

SEQ ID NO: 335786 - RNA, 19 nt, Homo sapiens
gcaugugacuaagaagaac

SEQ ID NO: 335787 - RNA, 19 nt, Homo sapiens
auacagcucugcagaaccu

SEQ ID NO: 335788 - RNA, 19 nt, Homo sapiens
cgagggaccagccaagauc

SEQ ID NO: 335789 - RNA, 19 nt, Homo sapiens
ugacuuugagggacuguau

SEQ ID NO: 335790 - RNA, 19 nt, Homo sapiens
cagugucauugagcagaua

SEQ ID NO: 335791 - RNA, 19 nt, Homo sapiens
cuauuacccucugguggaa

SEQ ID NO: 335792 - RNA, 19 nt, Homo sapiens
gaaggugauggaucugagu

SEQ ID NO: 335793 - RNA, 19 nt, Homo sapiens
acaugacugcccaauuuaa

SEQ ID NO: 335794 - RNA, 19 nt, Homo sapiens
ucaguugggacaaauaaag

SEQ ID NO: 335795 - RNA, 19 nt, Homo sapiens
gugauacagcucugcagaa

SEQ ID NO: 335796 - RNA, 19 nt, Homo sapiens
gaagaccuugcugcuaaau

SEQ ID NO: 335797 - RNA, 19 nt, Homo sapiens
acgaacagccuugcaucua

SEQ ID NO: 335798 - RNA, 19 nt, Homo sapiens
gaaagaacauggacuugua

SEQ ID NO: 335799 - RNA, 19 nt, Homo sapiens
cgagaaagaucauugaaau

SEQ ID NO: 335800 - RNA, 19 nt, Homo sapiens
gaacauggacuuguauauu

SEQ ID NO: 335801 - RNA, 19 nt, Homo sapiens
ucaaggagcugcaggagau

SEQ ID NO: 335802 - RNA, 19 nt, Homo sapiens
gguauccugugacauguaa

SEQ ID NO: 335803 - RNA, 19 nt, Homo sapiens
gauguggggugaaaaguua

SEQ ID NO: 335804 - RNA, 19 nt, Homo sapiens
guaaaugguguacauaaug

SEQ ID NO: 335805 - RNA, 19 nt, Homo sapiens
ggaaggaccacauuuuaua

SEQ ID NO: 335806 - RNA, 19 nt, Homo sapiens
gcgacgggcugaagaagga

SEQ ID NO: 335807 - RNA, 19 nt, Homo sapiens
ggacgagaaagaucauuga

SEQ ID NO: 335808 - RNA, 19 nt, Homo sapiens
aggacgagcugcccuauga

SEQ ID NO: 335809 - RNA, 19 nt, Homo sapiens
gcugaugucaacagaguua

SEQ ID NO: 335810 - RNA, 19 nt, Homo sapiens
gaucagcccucauuuuguu

SEQ ID NO: 335811 - RNA, 19 nt, Homo sapiens
gggcugaugucaacagagu

SEQ ID NO: 335812 - RNA, 19 nt, Homo sapiens
gguaggaucagcccucauu

SEQ ID NO: 335813 - RNA, 19 nt, Homo sapiens
uaaaggguguacuuauauc

SEQ ID NO: 335814 - RNA, 19 nt, Homo sapiens
caaaggggcugaaagaaca

SEQ ID NO: 335815 - RNA, 19 nt, Homo sapiens
ccacuccacuuggcuguga

SEQ ID NO: 335816 - RNA, 19 nt, Homo sapiens
agucagaguucacggaguu

SEQ ID NO: 335817 - RNA, 19 nt, Homo sapiens
gcacuuggccaucauccau

SEQ ID NO: 335818 - RNA, 19 nt, Homo sapiens
acauggacuuguauauuug

SEQ ID NO: 335819 - RNA, 19 nt, Homo sapiens
agaaauugcugaggcacuu

SEQ ID NO: 335820 - RNA, 19 nt, Homo sapiens
gcugaaagaacauggacuu

SEQ ID NO: 335821 - RNA, 19 nt, Homo sapiens
acacuuagccucuauccau

SEQ ID NO: 335822 - RNA, 19 nt, Homo sapiens
gaucauugaaauucugaga

SEQ ID NO: 335823 - RNA, 19 nt, Homo sapiens
ccagugguauccugugaca

SEQ ID NO: 335824 - RNA, 19 nt, Homo sapiens
guuaagcguucagugaugu

SEQ ID NO: 335825 - RNA, 19 nt, Homo sapiens
ccugaaggcuaccaacuac

SEQ ID NO: 335826 - RNA, 19 nt, Homo sapiens
gaagaaggagcggcuacug

SEQ ID NO: 335827 - RNA, 19 nt, Homo sapiens
ugaaagacgaggaguacga

SEQ ID NO: 335828 - RNA, 19 nt, Homo sapiens
ugaaggcuaccaacuacaa

SEQ ID NO: 335829 - RNA, 19 nt, Homo sapiens
gcagacuccacuccacuug

SEQ ID NO: 335830 - RNA, 19 nt, Homo sapiens
ugaaagaacauggacuugu

SEQ ID NO: 335831 - RNA, 19 nt, Homo sapiens
acgagcagauggucaagga

SEQ ID NO: 335832 - RNA, 19 nt, Homo sapiens
gaaaaguuacuaccuguca

SEQ ID NO: 335833 - RNA, 19 nt, Homo sapiens
gggacgagaaagaucauug

SEQ ID NO: 335834 - RNA, 19 nt, Homo sapiens
ccaugaaagacgaggagua

SEQ ID NO: 335835 - RNA, 19 nt, Homo sapiens
cccuacaccuugccuguga

SEQ ID NO: 335836 - RNA, 19 nt, Homo sapiens
ccugucaagguuuguguua

SEQ ID NO: 335837 - RNA, 19 nt, Homo sapiens
gaaggaccacauuuuauau

SEQ ID NO: 335838 - RNA, 19 nt, Homo sapiens
gacgagaaagaucauugaa

SEQ ID NO: 335839 - RNA, 19 nt, Homo sapiens
gggacucguuccugcacuu

SEQ ID NO: 335840 - RNA, 19 nt, Homo sapiens
gaaggcuaccaacuacaau

SEQ ID NO: 335841 - RNA, 19 nt, Homo sapiens
ucugggagcuggcugugau

SEQ ID NO: 335842 - RNA, 19 nt, Homo sapiens
caccaaccagccagaaauu

SEQ ID NO: 335843 - RNA, 19 nt, Homo sapiens
ugucuacacuuagccucua

SEQ ID NO: 335844 - RNA, 19 nt, Homo sapiens
ucaccaaccagccagaaau

SEQ ID NO: 335845 - RNA, 19 nt, Homo sapiens
aaagaacauggacuuguau

SEQ ID NO: 335846 - RNA, 19 nt, Homo sapiens
ggccagcugacacuagaaa

SEQ ID NO: 335847 - RNA, 19 nt, Homo sapiens
ucaacagaguuaccuacca

SEQ ID NO: 335848 - RNA, 19 nt, Homo sapiens
guaggaucagcccucauuu

SEQ ID NO: 335849 - RNA, 19 nt, Homo sapiens
gagcugcccuaugaugacu

SEQ ID NO: 335850 - RNA, 19 nt, Homo sapiens
gacgagcugcccuaugaug

SEQ ID NO: 335851 - RNA, 19 nt, Homo sapiens
ugccagagagugaggauga

SEQ ID NO: 335852 - RNA, 19 nt, Homo sapiens
aaaaggcacugaccaugga

SEQ ID NO: 335853 - RNA, 19 nt, Homo sapiens
cuccgagacuuucgaggaa

SEQ ID NO: 335854 - RNA, 19 nt, Homo sapiens
gaugaggagagcuaugaca

SEQ ID NO: 335855 - RNA, 19 nt, Homo sapiens
gugaggaugaggagagcua

SEQ ID NO: 335856 - RNA, 19 nt, Homo sapiens
uguuaagcguucagugaug

SEQ ID NO: 335857 - RNA, 19 nt, Homo sapiens
gaucaccaaccagccagaa

SEQ ID NO: 335858 - RNA, 19 nt, Homo sapiens
cuucagaugcugccagaga

SEQ ID NO: 335859 - RNA, 19 nt, Homo sapiens
uggugucacuccuguugaa

SEQ ID NO: 335860 - RNA, 19 nt, Homo sapiens
acgagaaagaucauugaaa

SEQ ID NO: 335861 - RNA, 19 nt, Homo sapiens
aagaacauggacuuguaua

SEQ ID NO: 335862 - RNA, 19 nt, Homo sapiens
cuugggugcugaugucaau

SEQ ID NO: 335863 - RNA, 19 nt, Homo sapiens
caugaaagacgaggaguac

SEQ ID NO: 335864 - RNA, 19 nt, Homo sapiens
ugggccagcugacacuaga

SEQ ID NO: 335865 - RNA, 19 nt, Homo sapiens
guccuugggugcugauguc

SEQ ID NO: 335866 - RNA, 19 nt, Homo sapiens
ucauggaaggaccacauuu

SEQ ID NO: 335867 - RNA, 19 nt, Homo sapiens
ggacucguuccugcacuug

SEQ ID NO: 335868 - RNA, 19 nt, Homo sapiens
agaacauggacuuguauau

SEQ ID NO: 335869 - RNA, 19 nt, Homo sapiens
gcacugcacuuggcuguga

SEQ ID NO: 335870 - RNA, 19 nt, Homo sapiens
acauggaccugcagaauga

SEQ ID NO: 335871 - RNA, 19 nt, Homo sapiens
gcacuuggcugugauucau

SEQ ID NO: 335872 - RNA, 19 nt, Homo sapiens
gagacgagggcgaugaaua

SEQ ID NO: 335873 - RNA, 19 nt, Homo sapiens
caugaacccuuccuggauu

SEQ ID NO: 335874 - RNA, 19 nt, Homo sapiens
gagcugaccuugacaaacc

SEQ ID NO: 335875 - RNA, 19 nt, Homo sapiens
acaaagauguggagauggu

SEQ ID NO: 335876 - RNA, 19 nt, Homo sapiens
ggacacggcacugcacuug

SEQ ID NO: 335877 - RNA, 19 nt, Homo sapiens
cgugugauuuguuucauug

SEQ ID NO: 335878 - RNA, 19 nt, Homo sapiens
gcaugaacccuuccuggau

SEQ ID NO: 335879 - RNA, 19 nt, Homo sapiens
guacauggaccugcagaau

SEQ ID NO: 335880 - RNA, 19 nt, Homo sapiens
cgaugaauacgacgacauu

SEQ ID NO: 335881 - RNA, 19 nt, Homo sapiens
gaaggaagaagaggagagu

SEQ ID NO: 335882 - RNA, 19 nt, Homo sapiens
ugaauacgacgacauugug

SEQ ID NO: 335883 - RNA, 19 nt, Homo sapiens
cacagcagccgcagccaaa

SEQ ID NO: 335884 - RNA, 19 nt, Homo sapiens
cgagggcgaggacgagaaa

SEQ ID NO: 335885 - RNA, 19 nt, Homo sapiens
gccguuauccacaaagaug

SEQ ID NO: 335886 - RNA, 19 nt, Homo sapiens
agacgagggcgaugaauac

SEQ ID NO: 335887 - RNA, 19 nt, Homo sapiens
ggaccugcagaaugaccua

SEQ ID NO: 335888 - RNA, 19 nt, Homo sapiens
agagugaggaggacuggaa

SEQ ID NO: 335889 - RNA, 19 nt, Homo sapiens
aaacaaaacccuaguucug

SEQ ID NO: 335890 - RNA, 19 nt, Homo sapiens
ccgugugauuuguuucauu

SEQ ID NO: 335891 - RNA, 19 nt, Homo sapiens
aggaagaagaggagaguga

SEQ ID NO: 335892 - RNA, 19 nt, Homo sapiens
gcuggaggcugaaaacuac

SEQ ID NO: 335893 - RNA, 19 nt, Homo sapiens
ccgaugugcuggagcuucu

SEQ ID NO: 335894 - RNA, 19 nt, Homo sapiens
cgacuuggagaaggaagaa

SEQ ID NO: 335895 - RNA, 19 nt, Homo sapiens
uacauggaccugcagaaug

SEQ ID NO: 335896 - RNA, 19 nt, Homo sapiens
guaccccgauuccgacuug

SEQ ID NO: 335897 - RNA, 19 nt, Homo sapiens
gaaauaggagcaagcagaa

SEQ ID NO: 335898 - RNA, 19 nt, Homo sapiens
ggaaacugcugcuguguac

SEQ ID NO: 335899 - RNA, 19 nt, Homo sapiens
gaaccaaccacucauggaa

SEQ ID NO: 335900 - RNA, 19 nt, Homo sapiens
ggaagggaaguuucaguaa

SEQ ID NO: 335901 - RNA, 19 nt, Homo sapiens
agaagagacugaaauagga

SEQ ID NO: 335902 - RNA, 19 nt, Homo sapiens
ucaguaacaugacacuaaa

SEQ ID NO: 335903 - RNA, 19 nt, Homo sapiens
gaagggaaguuucaguaac

SEQ ID NO: 335904 - RNA, 19 nt, Homo sapiens
uuaaagacuucacacagaa

SEQ ID NO: 335905 - RNA, 19 nt, Homo sapiens
ggaaguuucaguaacauga

SEQ ID NO: 335906 - RNA, 19 nt, Homo sapiens
gagaagagacugaaauagg

SEQ ID NO: 335907 - RNA, 19 nt, Homo sapiens
gggaagggaaguuucagua

SEQ ID NO: 335908 - RNA, 19 nt, Homo sapiens
gugagaagagacugaaaua

SEQ ID NO: 335909 - RNA, 19 nt, Homo sapiens
gaagaaccaaccacucaug

SEQ ID NO: 335910 - RNA, 19 nt, Homo sapiens
guacgacucuggcauugag

SEQ ID NO: 335911 - RNA, 19 nt, Homo sapiens
uuuaaagacuucacacaga

SEQ ID NO: 335912 - RNA, 19 nt, Homo sapiens
ccugagagguguccaucuu

SEQ ID NO: 335913 - RNA, 19 nt, Homo sapiens
cagaagaaccaaccacuca

SEQ ID NO: 335914 - RNA, 19 nt, Homo sapiens
ggcaggugcucuuguuuua

SEQ ID NO: 335915 - RNA, 19 nt, Homo sapiens
ggaccggcauggagacaca

SEQ ID NO: 335916 - RNA, 19 nt, Homo sapiens
ccaaugaaugaaugaauga

SEQ ID NO: 335917 - RNA, 19 nt, Homo sapiens
gggaaacugcugcugugua

SEQ ID NO: 335918 - RNA, 19 nt, Homo sapiens
gaauugcugcuucggaaug

SEQ ID NO: 335919 - RNA, 19 nt, Homo sapiens
uggaagcacucacuuacau

SEQ ID NO: 335920 - RNA, 19 nt, Homo sapiens
gaagaucucagggaaacug

SEQ ID NO: 335921 - RNA, 19 nt, Homo sapiens
aagggaaguuucaguaaca

SEQ ID NO: 335922 - RNA, 19 nt, Homo sapiens
ucuggaagccggagccaua

SEQ ID NO: 335923 - RNA, 19 nt, Homo sapiens
gaaugaaugagugaaugaa

SEQ ID NO: 335924 - RNA, 19 nt, Homo sapiens
uccaaugaaugaaugaaug

SEQ ID NO: 335925 - RNA, 19 nt, Homo sapiens
ggagacacagcccuucaug

SEQ ID NO: 335926 - RNA, 19 nt, Homo sapiens
uaaaauggcagagacguua

SEQ ID NO: 335927 - RNA, 19 nt, Homo sapiens
ugaaugaaugagugaauga

SEQ ID NO: 335928 - RNA, 19 nt, Homo sapiens
ugaaugagugaaugaauca

SEQ ID NO: 335929 - RNA, 19 nt, Homo sapiens
gaaaauggcaggugcucuu

SEQ ID NO: 335930 - RNA, 19 nt, Homo sapiens
gaagcacucacuuacaucu

SEQ ID NO: 335931 - RNA, 19 nt, Homo sapiens
aauggcaggugcucuuguu

SEQ ID NO: 335932 - RNA, 19 nt, Homo sapiens
ggaccugacugaggaaucc

SEQ ID NO: 335933 - RNA, 19 nt, Homo sapiens
accaaccacucauggaauu

SEQ ID NO: 335934 - RNA, 19 nt, Homo sapiens
aaauaaccuuuaccagaca

SEQ ID NO: 335935 - RNA, 19 nt, Homo sapiens
ggagggacugcaaguggaa

SEQ ID NO: 335936 - RNA, 19 nt, Homo sapiens
gcaccuggcuguggaaacc

SEQ ID NO: 335937 - RNA, 19 nt, Homo sapiens
guucggcugcccacaguaa

SEQ ID NO: 335938 - RNA, 19 nt, Homo sapiens
ccaucuggcuguacaucug

SEQ ID NO: 335939 - RNA, 19 nt, Homo sapiens
ugaaugaaugaaugaguga

SEQ ID NO: 335940 - RNA, 19 nt, Homo sapiens
ugagagguguccaucuucu

SEQ ID NO: 335941 - RNA, 19 nt, Homo sapiens
cuguuugccucucuugaaa

SEQ ID NO: 335942 - RNA, 19 nt, Homo sapiens
gggcuccagugguaagaca

SEQ ID NO: 335943 - RNA, 19 nt, Homo sapiens
ugaaugaaucaacgaagga

SEQ ID NO: 335944 - RNA, 19 nt, Homo sapiens
ggacugcaaguggaagaga

SEQ ID NO: 335945 - RNA, 19 nt, Homo sapiens
ggaaucccuuguccuuuug

SEQ ID NO: 335946 - RNA, 19 nt, Homo sapiens
ugcggaauguggaggauga

SEQ ID NO: 335947 - RNA, 19 nt, Homo sapiens
caacgaaggagugagucaa

SEQ ID NO: 335948 - RNA, 19 nt, Homo sapiens
caguacgacucuggcauug

SEQ ID NO: 335949 - RNA, 19 nt, Homo sapiens
gcugcuguguaccgacuga

SEQ ID NO: 335950 - RNA, 19 nt, Homo sapiens
gcccuuugaugaccugaag

SEQ ID NO: 335951 - RNA, 19 nt, Homo sapiens
gcuggaagcacucacuuac

SEQ ID NO: 335952 - RNA, 19 nt, Homo sapiens
uucaguaacaugacacuaa

SEQ ID NO: 335953 - RNA, 19 nt, Homo sapiens
gggcugauuccaccuaugg

SEQ ID NO: 335954 - RNA, 19 nt, Homo sapiens
ggaagcacucacuuacauc

SEQ ID NO: 335955 - RNA, 19 nt, Homo sapiens
gagacacagcccuucaugu

SEQ ID NO: 335956 - RNA, 19 nt, Homo sapiens
ggaauugcugcuucggaau

SEQ ID NO: 335957 - RNA, 19 nt, Homo sapiens
uaacaugacacuaaaaugg

SEQ ID NO: 335958 - RNA, 19 nt, Homo sapiens
augaaugagugaaugaauc

SEQ ID NO: 335959 - RNA, 19 nt, Homo sapiens
agagguguccaucuucuug

SEQ ID NO: 335960 - RNA, 19 nt, Homo sapiens
gaagccuguuugccucucu

SEQ ID NO: 335961 - RNA, 19 nt, Homo sapiens
gcgggcugauuccaccuau

SEQ ID NO: 335962 - RNA, 19 nt, Homo sapiens
caccguuguuuaaagacuu

SEQ ID NO: 335963 - RNA, 19 nt, Homo sapiens
ggaagccggagccauaacu

SEQ ID NO: 335964 - RNA, 19 nt, Homo sapiens
uugaugaccugaagaucuc

SEQ ID NO: 335965 - RNA, 19 nt, Homo sapiens
gagagguguccaucuucuu

SEQ ID NO: 335966 - RNA, 19 nt, Homo sapiens
gaaugaaugaaugagugaa

SEQ ID NO: 335967 - RNA, 19 nt, Homo sapiens
caaggaaccacaggagaag

SEQ ID NO: 335968 - RNA, 19 nt, Homo sapiens
gagugaaugaaucaacgaa

SEQ ID NO: 335969 - RNA, 19 nt, Homo sapiens
uggcuugucuccacauugc

SEQ ID NO: 335970 - RNA, 19 nt, Homo sapiens
ggaggagggacugcaagug

SEQ ID NO: 335971 - RNA, 19 nt, Homo sapiens
caggcuaugugcucuucug

SEQ ID NO: 335972 - RNA, 19 nt, Homo sapiens
gaggaacaucucacucucu

SEQ ID NO: 335973 - RNA, 19 nt, Homo sapiens
ccagagccaggcagaggaa

SEQ ID NO: 335974 - RNA, 19 nt, Homo sapiens
ugaaucaacgaaggaguga

SEQ ID NO: 335975 - RNA, 19 nt, Homo sapiens
gaagccggagccauaacug

SEQ ID NO: 335976 - RNA, 19 nt, Homo sapiens
ucaccuacacccuguccuu

SEQ ID NO: 335977 - RNA, 19 nt, Homo sapiens
ugacugaggaaucccuugu

SEQ ID NO: 335978 - RNA, 19 nt, Homo sapiens
gggcaggucugaugaguaa

SEQ ID NO: 335979 - RNA, 19 nt, Homo sapiens
gaagaagccuccacaucug

SEQ ID NO: 335980 - RNA, 19 nt, Homo sapiens
ggugaugccucccaugaaa

SEQ ID NO: 335981 - RNA, 19 nt, Homo sapiens
ggaagaagccuccacaucu

SEQ ID NO: 335982 - RNA, 19 nt, Homo sapiens
gaaggaaggguaagggaaa

SEQ ID NO: 335983 - RNA, 19 nt, Homo sapiens
ccaugggaauaaagaauaa

SEQ ID NO: 335984 - RNA, 19 nt, Homo sapiens
gagcgggaauggagacaga

SEQ ID NO: 335985 - RNA, 19 nt, Homo sapiens
ccagaugccuacaccgauu

SEQ ID NO: 335986 - RNA, 19 nt, Homo sapiens
ucuccgagcuucuuaaaca

SEQ ID NO: 335987 - RNA, 19 nt, Homo sapiens
acucugccguuuccuaaua

SEQ ID NO: 335988 - RNA, 19 nt, Homo sapiens
ggagaccccuggccaaauu

SEQ ID NO: 335989 - RNA, 19 nt, Homo sapiens
gccaugggaauaaagaaua

SEQ ID NO: 335990 - RNA, 19 nt, Homo sapiens
ggugggagcgaaaguugua

SEQ ID NO: 335991 - RNA, 19 nt, Homo sapiens
caagugacccuagggaaga

SEQ ID NO: 335992 - RNA, 19 nt, Homo sapiens
gcucugaggagguacuuga

SEQ ID NO: 335993 - RNA, 19 nt, Homo sapiens
ggcagccucuggcgauuug

SEQ ID NO: 335994 - RNA, 19 nt, Homo sapiens
gaggaagagcugcgugaga

SEQ ID NO: 335995 - RNA, 19 nt, Homo sapiens
ugacucugccguuuccuaa

SEQ ID NO: 335996 - RNA, 19 nt, Homo sapiens
gggaacaugcccagaagug

SEQ ID NO: 335997 - RNA, 19 nt, Homo sapiens
gggaauaaagaauaaggau

SEQ ID NO: 335998 - RNA, 19 nt, Homo sapiens
gauaugggugggagcgaaa

SEQ ID NO: 335999 - RNA, 19 nt, Homo sapiens
gggaagaagcaagaaacuu

SEQ ID NO: 336000 - RNA, 19 nt, Homo sapiens
ugaagaggaggaagaagau

SEQ ID NO: 336001 - RNA, 19 nt, Homo sapiens
cgccaccacugcuccuuga

SEQ ID NO: 336002 - RNA, 19 nt, Homo sapiens
gaagaggaggaagaagaug

SEQ ID NO: 336003 - RNA, 19 nt, Homo sapiens
ggaaggguaagggaaagga

SEQ ID NO: 336004 - RNA, 19 nt, Homo sapiens
cugaagaggaggaagaaga

SEQ ID NO: 336005 - RNA, 19 nt, Homo sapiens
acacccaggccucgaugua

SEQ ID NO: 336006 - RNA, 19 nt, Homo sapiens
ucgcuuucgucguuacuug

SEQ ID NO: 336007 - RNA, 19 nt, Homo sapiens
aagaugaugccuccaagga

SEQ ID NO: 336008 - RNA, 19 nt, Homo sapiens
aagaggaggaagaagauga

SEQ ID NO: 336009 - RNA, 19 nt, Homo sapiens
gagcagugacagcccuuuc

SEQ ID NO: 336010 - RNA, 19 nt, Homo sapiens
gaaaggauggggaccacaa

SEQ ID NO: 336011 - RNA, 19 nt, Homo sapiens
gggcagccucuggcgauuu

SEQ ID NO: 336012 - RNA, 19 nt, Homo sapiens
ggaggacgaguggcaggaa

SEQ ID NO: 336013 - RNA, 19 nt, Homo sapiens
gaaggguaagggaaaggau

SEQ ID NO: 336014 - RNA, 19 nt, Homo sapiens
acccaggccucgauguaga

SEQ ID NO: 336015 - RNA, 19 nt, Homo sapiens
cagaugccuacaccgauuu

SEQ ID NO: 336016 - RNA, 19 nt, Homo sapiens
gaggcagaaggaaggguaa

SEQ ID NO: 336017 - RNA, 19 nt, Homo sapiens
ccgggaacaugcccagaag

SEQ ID NO: 336018 - RNA, 19 nt, Homo sapiens
aaggugaugccucccauga

SEQ ID NO: 336019 - RNA, 19 nt, Homo sapiens
aagaagaugaugccuccaa

SEQ ID NO: 336020 - RNA, 19 nt, Homo sapiens
gagaagagcuuggcuauug

SEQ ID NO: 336021 - RNA, 19 nt, Homo sapiens
gagcuggacuuaagcauga

SEQ ID NO: 336022 - RNA, 19 nt, Homo sapiens
gcacccaccuggacaucua

SEQ ID NO: 336023 - RNA, 19 nt, Homo sapiens
caagcagccuucuguuuga

SEQ ID NO: 336024 - RNA, 19 nt, Homo sapiens
caguguagcugaagaugaa

SEQ ID NO: 336025 - RNA, 19 nt, Homo sapiens
gagcuuggcuauuguggau

SEQ ID NO: 336026 - RNA, 19 nt, Homo sapiens
cuacgggcaucuagaaauu

SEQ ID NO: 336027 - RNA, 19 nt, Homo sapiens
uggcugagcugcugcuuga

SEQ ID NO: 336028 - RNA, 19 nt, Homo sapiens
ccaagcagccuucuguuug

SEQ ID NO: 336029 - RNA, 19 nt, Homo sapiens
caacuacgggcaucuagaa

SEQ ID NO: 336030 - RNA, 19 nt, Homo sapiens
gcacgaggccugcaacuac

SEQ ID NO: 336031 - RNA, 19 nt, Homo sapiens
gcuccaagcucuucuuucg

SEQ ID NO: 336032 - RNA, 19 nt, Homo sapiens
caaggaaggcugugcucua

SEQ ID NO: 336033 - RNA, 19 nt, Homo sapiens
ccuguaaucccaacacuuu

SEQ ID NO: 336034 - RNA, 19 nt, Homo sapiens
ggucaucugugagcagcua

SEQ ID NO: 336035 - RNA, 19 nt, Homo sapiens
ggguagugcuuuccaagau

SEQ ID NO: 336036 - RNA, 19 nt, Homo sapiens
uggaggagcuggacuuaag

SEQ ID NO: 336037 - RNA, 19 nt, Homo sapiens
gucagaaccuccagcaugu

SEQ ID NO: 336038 - RNA, 19 nt, Homo sapiens
uuagagaccugugcagaug

SEQ ID NO: 336039 - RNA, 19 nt, Homo sapiens
gaguucaaguucaggauca

SEQ ID NO: 336040 - RNA, 19 nt, Homo sapiens
caaccugggccucaccuuu

SEQ ID NO: 336041 - RNA, 19 nt, Homo sapiens
agggagagcugaaugagau

SEQ ID NO: 336042 - RNA, 19 nt, Homo sapiens
gcacccuccugcacuuaga

SEQ ID NO: 336043 - RNA, 19 nt, Homo sapiens
gguagugcuuuccaagaug

SEQ ID NO: 336044 - RNA, 19 nt, Homo sapiens
cagcugaggcuuaccagaa

SEQ ID NO: 336045 - RNA, 19 nt, Homo sapiens
gaaaccccgucucuacuaa

SEQ ID NO: 336046 - RNA, 19 nt, Homo sapiens
gacaaccgcaggcccagua

SEQ ID NO: 336047 - RNA, 19 nt, Homo sapiens
ggacccgccucuaucucaa

SEQ ID NO: 336048 - RNA, 19 nt, Homo sapiens
gcuuggcuauuguggauga

SEQ ID NO: 336049 - RNA, 19 nt, Homo sapiens
gggacaaggcuguuagaga

SEQ ID NO: 336050 - RNA, 19 nt, Homo sapiens
gcaggagaauggcgugaac

SEQ ID NO: 336051 - RNA, 19 nt, Homo sapiens
ccucaacuguggccacuuc

SEQ ID NO: 336052 - RNA, 19 nt, Homo sapiens
uggccgagauggaggacua

SEQ ID NO: 336053 - RNA, 19 nt, Homo sapiens
ccagggcagcugaggcuua

SEQ ID NO: 336054 - RNA, 19 nt, Homo sapiens
gcaacgauuacuucaggaa

SEQ ID NO: 336055 - RNA, 19 nt, Homo sapiens
uccgauaccuggccaagga

SEQ ID NO: 336056 - RNA, 19 nt, Homo sapiens
gagcaaugacgagguguug

SEQ ID NO: 336057 - RNA, 19 nt, Homo sapiens
ucgagaccauccuggcuaa

SEQ ID NO: 336058 - RNA, 19 nt, Homo sapiens
gaagagcuuggcuauugug

SEQ ID NO: 336059 - RNA, 19 nt, Homo sapiens
ccacgaugcccucaacugu

SEQ ID NO: 336060 - RNA, 19 nt, Homo sapiens
gcaacuacgggcaucuaga

SEQ ID NO: 336061 - RNA, 19 nt, Homo sapiens
uagcugaagaugaagauga

SEQ ID NO: 336062 - RNA, 19 nt, Homo sapiens
uugcacagguccuccaaga

SEQ ID NO: 336063 - RNA, 19 nt, Homo sapiens
ugaggaagcgguucaugga

SEQ ID NO: 336064 - RNA, 19 nt, Homo sapiens
cgaagccccuaauaaauga

SEQ ID NO: 336065 - RNA, 19 nt, Homo sapiens
gugccauggucaucuguga

SEQ ID NO: 336066 - RNA, 19 nt, Homo sapiens
agaagagcuuggcuauugu

SEQ ID NO: 336067 - RNA, 19 nt, Homo sapiens
aaggaaggcugugcucuag

SEQ ID NO: 336068 - RNA, 19 nt, Homo sapiens
gcaaguggaaccggcgaaa

SEQ ID NO: 336069 - RNA, 19 nt, Homo sapiens
agaccuggcugaacauugc

SEQ ID NO: 336070 - RNA, 19 nt, Homo sapiens
gagcgagugcugcgugguu

SEQ ID NO: 336071 - RNA, 19 nt, Homo sapiens
cggagcagaaccaccuuua

SEQ ID NO: 336072 - RNA, 19 nt, Homo sapiens
gagcagaaccaccuuuacg

SEQ ID NO: 336073 - RNA, 19 nt, Homo sapiens
gucaggagaucgagaccau

SEQ ID NO: 336074 - RNA, 19 nt, Homo sapiens
ccucauggagccuguauuc

SEQ ID NO: 336075 - RNA, 19 nt, Homo sapiens
ggaccaggcccagcuuaca

SEQ ID NO: 336076 - RNA, 19 nt, Homo sapiens
ccaagaccugggagacuuu

SEQ ID NO: 336077 - RNA, 19 nt, Homo sapiens
ccaagcgagcccugaagaa

SEQ ID NO: 336078 - RNA, 19 nt, Homo sapiens
ggagagcugaaugagauga

SEQ ID NO: 336079 - RNA, 19 nt, Homo sapiens
gggccugugggacaagaua

SEQ ID NO: 336080 - RNA, 19 nt, Homo sapiens
aagccaccuugcagaguuu

SEQ ID NO: 336081 - RNA, 19 nt, Homo sapiens
cccaagcagccuucuguuu

SEQ ID NO: 336082 - RNA, 19 nt, Homo sapiens
caagcgagcccugaagaag

SEQ ID NO: 336083 - RNA, 19 nt, Homo sapiens
gcuacaaccugggcaccau

SEQ ID NO: 336084 - RNA, 19 nt, Homo sapiens
uagcuuccuuggccuguca

SEQ ID NO: 336085 - RNA, 19 nt, Homo sapiens
caccugacccugucugcaa

SEQ ID NO: 336086 - RNA, 19 nt, Homo sapiens
gccagucgagggaugcuuu

SEQ ID NO: 336087 - RNA, 19 nt, Homo sapiens
gguguuggcugaggugacu

SEQ ID NO: 336088 - RNA, 19 nt, Homo sapiens
cauccggguucgaguucaa

SEQ ID NO: 336089 - RNA, 19 nt, Homo sapiens
uccaagaccugggagacuu

SEQ ID NO: 336090 - RNA, 19 nt, Homo sapiens
ggccccagcuucuuucuga

SEQ ID NO: 336091 - RNA, 19 nt, Homo sapiens
agcagugggugaagcugua

SEQ ID NO: 336092 - RNA, 19 nt, Homo sapiens
gaaccggcgaaacgacaug

SEQ ID NO: 336093 - RNA, 19 nt, Homo sapiens
gccaagcgagcccugaaga

SEQ ID NO: 336094 - RNA, 19 nt, Homo sapiens
gagaccauccuggcuaaca

SEQ ID NO: 336095 - RNA, 19 nt, Homo sapiens
guuagagaccugugcagau

SEQ ID NO: 336096 - RNA, 19 nt, Homo sapiens
aaccgcaggcccaguagua

SEQ ID NO: 336097 - RNA, 19 nt, Homo sapiens
gcgccacuaugaggaggaa

SEQ ID NO: 336098 - RNA, 19 nt, Homo sapiens
caccgaagccccuaauaaa

SEQ ID NO: 336099 - RNA, 19 nt, Homo sapiens
gaguugcagugcgccaguu

SEQ ID NO: 336100 - RNA, 19 nt, Homo sapiens
ggaggaggacgaggagcuu

SEQ ID NO: 336101 - RNA, 19 nt, Homo sapiens
uggagccuguauuccgaua

SEQ ID NO: 336102 - RNA, 19 nt, Homo sapiens
agaccauccuggcuaacau

SEQ ID NO: 336103 - RNA, 19 nt, Homo sapiens
accuggagcuggcacauuc

SEQ ID NO: 336104 - RNA, 19 nt, Homo sapiens
accagaagcagcugcguuu

SEQ ID NO: 336105 - RNA, 19 nt, Homo sapiens
agcgagugcugcgugguua

SEQ ID NO: 336106 - RNA, 19 nt, Homo sapiens
gaccauccuggcuaacaug

SEQ ID NO: 336107 - RNA, 19 nt, Homo sapiens
ucaccgaagccccuaauaa

SEQ ID NO: 336108 - RNA, 19 nt, Homo sapiens
ggagcagaaccaccuuuac

SEQ ID NO: 336109 - RNA, 19 nt, Homo sapiens
cagcagcagcagcucagaa

SEQ ID NO: 336110 - RNA, 19 nt, Homo sapiens
ccaccacacugggagacau

SEQ ID NO: 336111 - RNA, 19 nt, Homo sapiens
gcaauaagccuguuaguuu

SEQ ID NO: 336112 - RNA, 19 nt, Homo sapiens
ggaauuagcugcucucuuc

SEQ ID NO: 336113 - RNA, 19 nt, Homo sapiens
gcacagacauugccacaga

SEQ ID NO: 336114 - RNA, 19 nt, Homo sapiens
gaggauggcuuccgugaaa

SEQ ID NO: 336115 - RNA, 19 nt, Homo sapiens
gaaaagcucuucagcaaaa

SEQ ID NO: 336116 - RNA, 19 nt, Homo sapiens
caacaaugauuaugagaga

SEQ ID NO: 336117 - RNA, 19 nt, Homo sapiens
gguaagaacugacuaugug

SEQ ID NO: 336118 - RNA, 19 nt, Homo sapiens
ugacuuggcuguccuuaaa

SEQ ID NO: 336119 - RNA, 19 nt, Homo sapiens
cuucuucucucuucuauua

SEQ ID NO: 336120 - RNA, 19 nt, Homo sapiens
caucaugacucgaguaaau

SEQ ID NO: 336121 - RNA, 19 nt, Homo sapiens
ccagggagguugcaucauu

SEQ ID NO: 336122 - RNA, 19 nt, Homo sapiens
gacgaaagcuguggaucua

SEQ ID NO: 336123 - RNA, 19 nt, Homo sapiens
gaacucaucuuagccuugu

SEQ ID NO: 336124 - RNA, 19 nt, Homo sapiens
uaauuagggugcaaggaua

SEQ ID NO: 336125 - RNA, 19 nt, Homo sapiens
caauaagccuguuaguuuc

SEQ ID NO: 336126 - RNA, 19 nt, Homo sapiens
caacagaagccucaaguuc

SEQ ID NO: 336127 - RNA, 19 nt, Homo sapiens
gcacucagguaaauacagu

SEQ ID NO: 336128 - RNA, 19 nt, Homo sapiens
uaaagaagcaccacgagaa

SEQ ID NO: 336129 - RNA, 19 nt, Homo sapiens
gcaaggauaagguguaaga

SEQ ID NO: 336130 - RNA, 19 nt, Homo sapiens
gaaaaccgcagauaaagua

SEQ ID NO: 336131 - RNA, 19 nt, Homo sapiens
ccugagaucuucuuugaug

SEQ ID NO: 336132 - RNA, 19 nt, Homo sapiens
ggaaacaucagccagauca

SEQ ID NO: 336133 - RNA, 19 nt, Homo sapiens
ggcaggaaguguuaaguga

SEQ ID NO: 336134 - RNA, 19 nt, Homo sapiens
gaucaggccuucuguaagc

SEQ ID NO: 336135 - RNA, 19 nt, Homo sapiens
gacagugaccugaagauaa

SEQ ID NO: 336136 - RNA, 19 nt, Homo sapiens
ggacagugaccugaagaua

SEQ ID NO: 336137 - RNA, 19 nt, Homo sapiens
ggagguugcaucauuguuu

SEQ ID NO: 336138 - RNA, 19 nt, Homo sapiens
ggucugcucuggcugagaa

SEQ ID NO: 336139 - RNA, 19 nt, Homo sapiens
gaagaggccacguuggauu

SEQ ID NO: 336140 - RNA, 19 nt, Homo sapiens
gagcaacaaugauuaugag

SEQ ID NO: 336141 - RNA, 19 nt, Homo sapiens
gugaacaccuccagcaguu

SEQ ID NO: 336142 - RNA, 19 nt, Homo sapiens
caggaaguguuaagugauu

SEQ ID NO: 336143 - RNA, 19 nt, Homo sapiens
gcaggagcguuacagguau

SEQ ID NO: 336144 - RNA, 19 nt, Homo sapiens
acagugaccugaagauaau

SEQ ID NO: 336145 - RNA, 19 nt, Homo sapiens
ggcuggagguugaauguuu

SEQ ID NO: 336146 - RNA, 19 nt, Homo sapiens
gacagaacaucaucaagca

SEQ ID NO: 336147 - RNA, 19 nt, Homo sapiens
gcaguuaugcuucaaguca

SEQ ID NO: 336148 - RNA, 19 nt, Homo sapiens
gagaagaaacaauggauuc

SEQ ID NO: 336149 - RNA, 19 nt, Homo sapiens
cuaccaaucuaggagaaua

SEQ ID NO: 336150 - RNA, 19 nt, Homo sapiens
caacagcauuccacucaca

SEQ ID NO: 336151 - RNA, 19 nt, Homo sapiens
ggaaguugcuuggccaauc

SEQ ID NO: 336152 - RNA, 19 nt, Homo sapiens
ggucugcucucuaccaauc

SEQ ID NO: 336153 - RNA, 19 nt, Homo sapiens
gagcuguuccuuccaguuu

SEQ ID NO: 336154 - RNA, 19 nt, Homo sapiens
ggagcacccugagaaaguu

SEQ ID NO: 336155 - RNA, 19 nt, Homo sapiens
gcacaguggccucuucaga

SEQ ID NO: 336156 - RNA, 19 nt, Homo sapiens
gcgaaucacuccggacaug

SEQ ID NO: 336157 - RNA, 19 nt, Homo sapiens
gugcaaggauaagguguaa

SEQ ID NO: 336158 - RNA, 19 nt, Homo sapiens
cagaaaagcucuucagcaa

SEQ ID NO: 336159 - RNA, 19 nt, Homo sapiens
ucaacuagaucccuggaau

SEQ ID NO: 336160 - RNA, 19 nt, Homo sapiens
agaacuggcuggagguuga

SEQ ID NO: 336161 - RNA, 19 nt, Homo sapiens
cuacagcuccgucuccuaa

SEQ ID NO: 336162 - RNA, 19 nt, Homo sapiens
aaagaucccugugugaaau

SEQ ID NO: 336163 - RNA, 19 nt, Homo sapiens
cacguuggauuuacaagaa

SEQ ID NO: 336164 - RNA, 19 nt, Homo sapiens
gaaacccucugcacauugc

SEQ ID NO: 336165 - RNA, 19 nt, Homo sapiens
gcgguguccuuacccagua

SEQ ID NO: 336166 - RNA, 19 nt, Homo sapiens
gaccugaagauaauguuaa

SEQ ID NO: 336167 - RNA, 19 nt, Homo sapiens
ggucaaguaccggcaguua

SEQ ID NO: 336168 - RNA, 19 nt, Homo sapiens
gaacaccuccagcaguuuc

SEQ ID NO: 336169 - RNA, 19 nt, Homo sapiens
gagaucuucuuugauguug

SEQ ID NO: 336170 - RNA, 19 nt, Homo sapiens
ggagaagaaacaauggauu

SEQ ID NO: 336171 - RNA, 19 nt, Homo sapiens
ucugugaacugcuuaagga

SEQ ID NO: 336172 - RNA, 19 nt, Homo sapiens
gaguaccuguggagaagaa

SEQ ID NO: 336173 - RNA, 19 nt, Homo sapiens
gaguguggcugaccagaag

SEQ ID NO: 336174 - RNA, 19 nt, Homo sapiens
ggacaugauggccacauug

SEQ ID NO: 336175 - RNA, 19 nt, Homo sapiens
ggacgaaagcuguggaucu

SEQ ID NO: 336176 - RNA, 19 nt, Homo sapiens
ucagguaaauacaguagug

SEQ ID NO: 336177 - RNA, 19 nt, Homo sapiens
cuagaucccuggaauuucu

SEQ ID NO: 336178 - RNA, 19 nt, Homo sapiens
gcacuggaucggcuacauu

SEQ ID NO: 336179 - RNA, 19 nt, Homo sapiens
gcuuaaggacucccaguuu

SEQ ID NO: 336180 - RNA, 19 nt, Homo sapiens
caggagcguuacagguaua

SEQ ID NO: 336181 - RNA, 19 nt, Homo sapiens
ggucuuaagggaagugaaa

SEQ ID NO: 336182 - RNA, 19 nt, Homo sapiens
caacuagaucccuggaauu

SEQ ID NO: 336183 - RNA, 19 nt, Homo sapiens
ggagugaagaagaguuuga

SEQ ID NO: 336184 - RNA, 19 nt, Homo sapiens
ggagaaagucgagcuguuc

SEQ ID NO: 336185 - RNA, 19 nt, Homo sapiens
gaaauaucuuccagcuucu

SEQ ID NO: 336186 - RNA, 19 nt, Homo sapiens
guaauuagggugcaaggau

SEQ ID NO: 336187 - RNA, 19 nt, Homo sapiens
ggaccugacucucaaugac

SEQ ID NO: 336188 - RNA, 19 nt, Homo sapiens
ggaaacccucugcacauug

SEQ ID NO: 336189 - RNA, 19 nt, Homo sapiens
gugaucagccagccaauga

SEQ ID NO: 336190 - RNA, 19 nt, Homo sapiens
ccaaacaggcaacagcauu

SEQ ID NO: 336191 - RNA, 19 nt, Homo sapiens
cagcucagaugccacaaca

SEQ ID NO: 336192 - RNA, 19 nt, Homo sapiens
caguuucucuccauuuguu

SEQ ID NO: 336193 - RNA, 19 nt, Homo sapiens
gcacauugcccagaagcuu

SEQ ID NO: 336194 - RNA, 19 nt, Homo sapiens
gaucuucuuugauguuguc

SEQ ID NO: 336195 - RNA, 19 nt, Homo sapiens
caccagcacucagguaaau

SEQ ID NO: 336196 - RNA, 19 nt, Homo sapiens
aaggagaccucgcucaaca

SEQ ID NO: 336197 - RNA, 19 nt, Homo sapiens
gcaguaucuugcuggagaa

SEQ ID NO: 336198 - RNA, 19 nt, Homo sapiens
gaccauaugcugacagauc

SEQ ID NO: 336199 - RNA, 19 nt, Homo sapiens
aagaaacaauggauuccuu

SEQ ID NO: 336200 - RNA, 19 nt, Homo sapiens
cagggagguugcaucauug

SEQ ID NO: 336201 - RNA, 19 nt, Homo sapiens
ucaaguaccggcaguuaug

SEQ ID NO: 336202 - RNA, 19 nt, Homo sapiens
uggaaacccucugcacauu

SEQ ID NO: 336203 - RNA, 19 nt, Homo sapiens
agaaacaauggauuccuua

SEQ ID NO: 336204 - RNA, 19 nt, Homo sapiens
ggaggaguguuagcaucaa

SEQ ID NO: 336205 - RNA, 19 nt, Homo sapiens
gccaaucccaagauaauga

SEQ ID NO: 336206 - RNA, 19 nt, Homo sapiens
ccagccagcucccucaaca

SEQ ID NO: 336207 - RNA, 19 nt, Homo sapiens
aagaucaggccuucuguaa

SEQ ID NO: 336208 - RNA, 19 nt, Homo sapiens
ccaaagaucaggccuucug

SEQ ID NO: 336209 - RNA, 19 nt, Homo sapiens
gaaguugcuuggccaaucc

SEQ ID NO: 336210 - RNA, 19 nt, Homo sapiens
gaaagucgagcuguuccuu

SEQ ID NO: 336211 - RNA, 19 nt, Homo sapiens
gcacacagguucucuaauu

SEQ ID NO: 336212 - RNA, 19 nt, Homo sapiens
gaaaugaaauuccacauag

SEQ ID NO: 336213 - RNA, 19 nt, Homo sapiens
gaaaugagcagagaagaua

SEQ ID NO: 336214 - RNA, 19 nt, Homo sapiens
gaaaagagauggugauuug

SEQ ID NO: 336215 - RNA, 19 nt, Homo sapiens
gcacaaguguccuuugauu

SEQ ID NO: 336216 - RNA, 19 nt, Homo sapiens
caaaggagcuuccauguac

SEQ ID NO: 336217 - RNA, 19 nt, Homo sapiens
gagaucagcaaguuaauua

SEQ ID NO: 336218 - RNA, 19 nt, Homo sapiens
ugauaucucuugcggauua

SEQ ID NO: 336219 - RNA, 19 nt, Homo sapiens
gcagaggcauuucauauca

SEQ ID NO: 336220 - RNA, 19 nt, Homo sapiens
gauuucagcuguuuaaaga

SEQ ID NO: 336221 - RNA, 19 nt, Homo sapiens
gcaggauccucaaguagua

SEQ ID NO: 336222 - RNA, 19 nt, Homo sapiens
uaaggcaggugcauugaua

SEQ ID NO: 336223 - RNA, 19 nt, Homo sapiens
gaauuaaccugccauugug

SEQ ID NO: 336224 - RNA, 19 nt, Homo sapiens
gagcacaaguguccuuuga

SEQ ID NO: 336225 - RNA, 19 nt, Homo sapiens
gaacaacuaacaacagaaa

SEQ ID NO: 336226 - RNA, 19 nt, Homo sapiens
agaaaucccuugucuauuc

SEQ ID NO: 336227 - RNA, 19 nt, Homo sapiens
gcaggucccuuaugaugaa

SEQ ID NO: 336228 - RNA, 19 nt, Homo sapiens
gaaaaugccugaaacauca

SEQ ID NO: 336229 - RNA, 19 nt, Homo sapiens
gaaaugcgguaaccauaca

SEQ ID NO: 336230 - RNA, 19 nt, Homo sapiens
gaugaaaucucugcuguuc

SEQ ID NO: 336231 - RNA, 19 nt, Homo sapiens
gagaagauacccacagaaa

SEQ ID NO: 336232 - RNA, 19 nt, Homo sapiens
gggagugucuuguggauga

SEQ ID NO: 336233 - RNA, 19 nt, Homo sapiens
gagauaugcuguguggaua

SEQ ID NO: 336234 - RNA, 19 nt, Homo sapiens
gacaagcgguguaacaaga

SEQ ID NO: 336235 - RNA, 19 nt, Homo sapiens
ccacaucacugaaccuguu

SEQ ID NO: 336236 - RNA, 19 nt, Homo sapiens
ggaaugagaagcaccauau

SEQ ID NO: 336237 - RNA, 19 nt, Homo sapiens
gaaucaaccuuggcagaaa

SEQ ID NO: 336238 - RNA, 19 nt, Homo sapiens
gggaaagaauaguaagaaa

SEQ ID NO: 336239 - RNA, 19 nt, Homo sapiens
caagagaaaugcacuguac

SEQ ID NO: 336240 - RNA, 19 nt, Homo sapiens
gagauuagcagaggcauuu

SEQ ID NO: 336241 - RNA, 19 nt, Homo sapiens
cauuugaacugcauaaaga

SEQ ID NO: 336242 - RNA, 19 nt, Homo sapiens
gaagcaaaccuaagaguca

SEQ ID NO: 336243 - RNA, 19 nt, Homo sapiens
ccaggcaggucccuuauga

SEQ ID NO: 336244 - RNA, 19 nt, Homo sapiens
gcacuuuccuaacucagaa

SEQ ID NO: 336245 - RNA, 19 nt, Homo sapiens
gcaggugcauugauaguuc

SEQ ID NO: 336246 - RNA, 19 nt, Homo sapiens
cggcauaaauguaaugaga

SEQ ID NO: 336247 - RNA, 19 nt, Homo sapiens
aggaaagucugauggauuu

SEQ ID NO: 336248 - RNA, 19 nt, Homo sapiens
gagcagaaaugaaauucca

SEQ ID NO: 336249 - RNA, 19 nt, Homo sapiens
caaaggaugaccucaauga

SEQ ID NO: 336250 - RNA, 19 nt, Homo sapiens
ccuaauaccuacacuuguu

SEQ ID NO: 336251 - RNA, 19 nt, Homo sapiens
ggacucuguuugaauauuc

SEQ ID NO: 336252 - RNA, 19 nt, Homo sapiens
caacacaguuuguauacag

SEQ ID NO: 336253 - RNA, 19 nt, Homo sapiens
gagcauaguccuucugaga

SEQ ID NO: 336254 - RNA, 19 nt, Homo sapiens
caauacagaugcugcugaa

SEQ ID NO: 336255 - RNA, 19 nt, Homo sapiens
ucagaaaucccuugucuau

SEQ ID NO: 336256 - RNA, 19 nt, Homo sapiens
cgagauguguuauguggaa

SEQ ID NO: 336257 - RNA, 19 nt, Homo sapiens
gcacuuagauaaaagaaug

SEQ ID NO: 336258 - RNA, 19 nt, Homo sapiens
gugaauaagggaaagaaua

SEQ ID NO: 336259 - RNA, 19 nt, Homo sapiens
ggccaggacugcccacauu

SEQ ID NO: 336260 - RNA, 19 nt, Homo sapiens
guaaugagauaugcugugu

SEQ ID NO: 336261 - RNA, 19 nt, Homo sapiens
gaaaagcucugccaugaag

SEQ ID NO: 336262 - RNA, 19 nt, Homo sapiens
uuagagagcucgaccagau

SEQ ID NO: 336263 - RNA, 19 nt, Homo sapiens
ccaccucccugucaccuuu

SEQ ID NO: 336264 - RNA, 19 nt, Homo sapiens
ucuggacucuguuugaaua

SEQ ID NO: 336265 - RNA, 19 nt, Homo sapiens
agacagacauugcuugcuu

SEQ ID NO: 336266 - RNA, 19 nt, Homo sapiens
ggacuauugggcuuuauuu

SEQ ID NO: 336267 - RNA, 19 nt, Homo sapiens
ggacuaagaagaucaugau

SEQ ID NO: 336268 - RNA, 19 nt, Homo sapiens
gagggacuauugggcuuua

SEQ ID NO: 336269 - RNA, 19 nt, Homo sapiens
aagugaagaugcuacauuu

SEQ ID NO: 336270 - RNA, 19 nt, Homo sapiens
gcagauggccagagugguu

SEQ ID NO: 336271 - RNA, 19 nt, Homo sapiens
ggaguugucagagcuguua

SEQ ID NO: 336272 - RNA, 19 nt, Homo sapiens
cagagaagauacccacaga

SEQ ID NO: 336273 - RNA, 19 nt, Homo sapiens
gagcagaccucagauacag

SEQ ID NO: 336274 - RNA, 19 nt, Homo sapiens
gccauggccuucagaauca

SEQ ID NO: 336275 - RNA, 19 nt, Homo sapiens
uguaauaaaucgcccaaga

SEQ ID NO: 336276 - RNA, 19 nt, Homo sapiens
cuaagaagaucaugaugca

SEQ ID NO: 336277 - RNA, 19 nt, Homo sapiens
ugaagcaucuaguacuuau

SEQ ID NO: 336278 - RNA, 19 nt, Homo sapiens
ugaagaugcuacauuuaug

SEQ ID NO: 336279 - RNA, 19 nt, Homo sapiens
gaguggagcagaaaugaaa

SEQ ID NO: 336280 - RNA, 19 nt, Homo sapiens
ggugagguuuguagaaaga

SEQ ID NO: 336281 - RNA, 19 nt, Homo sapiens
guuaccauguguuucauuu

SEQ ID NO: 336282 - RNA, 19 nt, Homo sapiens
gaacuuggcagucaucaac

SEQ ID NO: 336283 - RNA, 19 nt, Homo sapiens
ugaauuaaccugccauugu

SEQ ID NO: 336284 - RNA, 19 nt, Homo sapiens
uaccauguguuucauuuga

SEQ ID NO: 336285 - RNA, 19 nt, Homo sapiens
gacagacauugcuugcuuu

SEQ ID NO: 336286 - RNA, 19 nt, Homo sapiens
gcaaucacgcauucaaaga

SEQ ID NO: 336287 - RNA, 19 nt, Homo sapiens
gcaugagugugucagaaau

SEQ ID NO: 336288 - RNA, 19 nt, Homo sapiens
ucagugacguugagaagga

SEQ ID NO: 336289 - RNA, 19 nt, Homo sapiens
ccaguucccugugguacua

SEQ ID NO: 336290 - RNA, 19 nt, Homo sapiens
gugaagaugcuacauuuau

SEQ ID NO: 336291 - RNA, 19 nt, Homo sapiens
cagaugcucuuucagaaca

SEQ ID NO: 336292 - RNA, 19 nt, Homo sapiens
ccaggaggguugaccaaga

SEQ ID NO: 336293 - RNA, 19 nt, Homo sapiens
uggcagaaauugaggaaug

SEQ ID NO: 336294 - RNA, 19 nt, Homo sapiens
aaacagaaccaugugcuaa

SEQ ID NO: 336295 - RNA, 19 nt, Homo sapiens
gcucuggacucuguuugaa

SEQ ID NO: 336296 - RNA, 19 nt, Homo sapiens
ugacacauccaaagcauga

SEQ ID NO: 336297 - RNA, 19 nt, Homo sapiens
caaucuccauggccucuaa

SEQ ID NO: 336298 - RNA, 19 nt, Homo sapiens
gcauaguccuucugagagu

SEQ ID NO: 336299 - RNA, 19 nt, Homo sapiens
gugaucaguucuagaccua

SEQ ID NO: 336300 - RNA, 19 nt, Homo sapiens
uagguauaguggagacuua

SEQ ID NO: 336301 - RNA, 19 nt, Homo sapiens
gaagaucaugaugcacuua

SEQ ID NO: 336302 - RNA, 19 nt, Homo sapiens
uccauggccucuaagauaa

SEQ ID NO: 336303 - RNA, 19 nt, Homo sapiens
ugaagaaccuugucaucgu

SEQ ID NO: 336304 - RNA, 19 nt, Homo sapiens
guggugagguuuguagaaa

SEQ ID NO: 336305 - RNA, 19 nt, Homo sapiens
caaguaguaucuccuuucu

SEQ ID NO: 336306 - RNA, 19 nt, Homo sapiens
ggaaauauagagagcaagu

SEQ ID NO: 336307 - RNA, 19 nt, Homo sapiens
gaaggagacuguggaccau

SEQ ID NO: 336308 - RNA, 19 nt, Homo sapiens
gaaccgauguaggaaaguc

SEQ ID NO: 336309 - RNA, 19 nt, Homo sapiens
uaauaggauugguagaaga

SEQ ID NO: 336310 - RNA, 19 nt, Homo sapiens
gcacuucucauaccacauc

SEQ ID NO: 336311 - RNA, 19 nt, Homo sapiens
gcacacagguucucuaauu

SEQ ID NO: 336312 - RNA, 19 nt, Homo sapiens
gaaaugaaauuccacauag

SEQ ID NO: 336313 - RNA, 19 nt, Homo sapiens
gaaaugagcagagaagaua

SEQ ID NO: 336314 - RNA, 19 nt, Homo sapiens
gaaaagagauggugauuug

SEQ ID NO: 336315 - RNA, 19 nt, Homo sapiens
gcacaaguguccuuugauu

SEQ ID NO: 336316 - RNA, 19 nt, Homo sapiens
caaaggagcuuccauguac

SEQ ID NO: 336317 - RNA, 19 nt, Homo sapiens
gagaucagcaaguuaauua

SEQ ID NO: 336318 - RNA, 19 nt, Homo sapiens
ugauaucucuugcggauua

SEQ ID NO: 336319 - RNA, 19 nt, Homo sapiens
gcagaggcauuucauauca

SEQ ID NO: 336320 - RNA, 19 nt, Homo sapiens
gauuucagcuguuuaaaga

SEQ ID NO: 336321 - RNA, 19 nt, Homo sapiens
gcaggauccucaaguagua

SEQ ID NO: 336322 - RNA, 19 nt, Homo sapiens
gaauuaaccugccauugug

SEQ ID NO: 336323 - RNA, 19 nt, Homo sapiens
gaauaagguugaagucgaa

SEQ ID NO: 336324 - RNA, 19 nt, Homo sapiens
gagcacaaguguccuuuga

SEQ ID NO: 336325 - RNA, 19 nt, Homo sapiens
gaacaacuaacaacagaaa

SEQ ID NO: 336326 - RNA, 19 nt, Homo sapiens
gcaggucccuuaugaugaa

SEQ ID NO: 336327 - RNA, 19 nt, Homo sapiens
gaaaugcgguaaccauaca

SEQ ID NO: 336328 - RNA, 19 nt, Homo sapiens
gaugaaaucucugcuguuc

SEQ ID NO: 336329 - RNA, 19 nt, Homo sapiens
gagaagauacccacagaaa

SEQ ID NO: 336330 - RNA, 19 nt, Homo sapiens
gggagugucuuguggauga

SEQ ID NO: 336331 - RNA, 19 nt, Homo sapiens
gagauaugcuguguggaua

SEQ ID NO: 336332 - RNA, 19 nt, Homo sapiens
gacaagcgguguaacaaga

SEQ ID NO: 336333 - RNA, 19 nt, Homo sapiens
ggaaugagaagcaccauau

SEQ ID NO: 336334 - RNA, 19 nt, Homo sapiens
gaaucaaccuuggcagaaa

SEQ ID NO: 336335 - RNA, 19 nt, Homo sapiens
caagagaaaugcacuguac

SEQ ID NO: 336336 - RNA, 19 nt, Homo sapiens
gagauuagcagaggcauuu

SEQ ID NO: 336337 - RNA, 19 nt, Homo sapiens
cauuugaacugcauaaaga

SEQ ID NO: 336338 - RNA, 19 nt, Homo sapiens
gaagcaaaccuaagaguca

SEQ ID NO: 336339 - RNA, 19 nt, Homo sapiens
ccaggcaggucccuuauga

SEQ ID NO: 336340 - RNA, 19 nt, Homo sapiens
gcacuuuccuaacucagaa

SEQ ID NO: 336341 - RNA, 19 nt, Homo sapiens
cggcauaaauguaaugaga

SEQ ID NO: 336342 - RNA, 19 nt, Homo sapiens
aggaaagucugauggauuu

SEQ ID NO: 336343 - RNA, 19 nt, Homo sapiens
gagcagaaaugaaauucca

SEQ ID NO: 336344 - RNA, 19 nt, Homo sapiens
caaaggaugaccucaauga

SEQ ID NO: 336345 - RNA, 19 nt, Homo sapiens
ccuaauaccuacacuuguu

SEQ ID NO: 336346 - RNA, 19 nt, Homo sapiens
caacacaguuuguauacag

SEQ ID NO: 336347 - RNA, 19 nt, Homo sapiens
gagcauaguccuucugaga

SEQ ID NO: 336348 - RNA, 19 nt, Homo sapiens
cgagauguguuauguggaa

SEQ ID NO: 336349 - RNA, 19 nt, Homo sapiens
caauacagaugcugcugaa

SEQ ID NO: 336350 - RNA, 19 nt, Homo sapiens
ggccaggacugcccacauu

SEQ ID NO: 336351 - RNA, 19 nt, Homo sapiens
guaaugagauaugcugugu

SEQ ID NO: 336352 - RNA, 19 nt, Homo sapiens
gaaaagcucugccaugaag

SEQ ID NO: 336353 - RNA, 19 nt, Homo sapiens
uuagagagcucgaccagau

SEQ ID NO: 336354 - RNA, 19 nt, Homo sapiens
ccaccucccugucaccuuu

SEQ ID NO: 336355 - RNA, 19 nt, Homo sapiens
ccacuggacauuucucuaa

SEQ ID NO: 336356 - RNA, 19 nt, Homo sapiens
aagugaagaugcuacauuu

SEQ ID NO: 336357 - RNA, 19 nt, Homo sapiens
gcagauggccagagugguu

SEQ ID NO: 336358 - RNA, 19 nt, Homo sapiens
ggaguugucagagcuguua

SEQ ID NO: 336359 - RNA, 19 nt, Homo sapiens
cagagaagauacccacaga

SEQ ID NO: 336360 - RNA, 19 nt, Homo sapiens
gagcagaccucagauacag

SEQ ID NO: 336361 - RNA, 19 nt, Homo sapiens
gccauggccuucagaauca

SEQ ID NO: 336362 - RNA, 19 nt, Homo sapiens
uguaauaaaucgcccaaga

SEQ ID NO: 336363 - RNA, 19 nt, Homo sapiens
ugaagcaucuaguacuuau

SEQ ID NO: 336364 - RNA, 19 nt, Homo sapiens
ugaagaugcuacauuuaug

SEQ ID NO: 336365 - RNA, 19 nt, Homo sapiens
gaguggagcagaaaugaaa

SEQ ID NO: 336366 - RNA, 19 nt, Homo sapiens
gcaaucaaguccuggaaac

SEQ ID NO: 336367 - RNA, 19 nt, Homo sapiens
ggugagguuuguagaaaga

SEQ ID NO: 336368 - RNA, 19 nt, Homo sapiens
guuaccauguguuucauuu

SEQ ID NO: 336369 - RNA, 19 nt, Homo sapiens
gaacuuggcagucaucaac

SEQ ID NO: 336370 - RNA, 19 nt, Homo sapiens
ugaauuaaccugccauugu

SEQ ID NO: 336371 - RNA, 19 nt, Homo sapiens
uaccauguguuucauuuga

SEQ ID NO: 336372 - RNA, 19 nt, Homo sapiens
ucagugacguugagaagga

SEQ ID NO: 336373 - RNA, 19 nt, Homo sapiens
ccaguucccugugguacua

SEQ ID NO: 336374 - RNA, 19 nt, Homo sapiens
gugaagaugcuacauuuau

SEQ ID NO: 336375 - RNA, 19 nt, Homo sapiens
cagaugcucuuucagaaca

SEQ ID NO: 336376 - RNA, 19 nt, Homo sapiens
ccaggaggguugaccaaga

SEQ ID NO: 336377 - RNA, 19 nt, Homo sapiens
uggcagaaauugaggaaug

SEQ ID NO: 336378 - RNA, 19 nt, Homo sapiens
aaacagaaccaugugcuaa

SEQ ID NO: 336379 - RNA, 19 nt, Homo sapiens
caaucuccauggccucuaa

SEQ ID NO: 336380 - RNA, 19 nt, Homo sapiens
gcauaguccuucugagagu

SEQ ID NO: 336381 - RNA, 19 nt, Homo sapiens
uccauggccucuaagauaa

SEQ ID NO: 336382 - RNA, 19 nt, Homo sapiens
ugaagaaccuugucaucgu

SEQ ID NO: 336383 - RNA, 19 nt, Homo sapiens
guggugagguuuguagaaa

SEQ ID NO: 336384 - RNA, 19 nt, Homo sapiens
caaguaguaucuccuuucu

SEQ ID NO: 336385 - RNA, 19 nt, Homo sapiens
uaauaggauugguagaaga

SEQ ID NO: 336386 - RNA, 19 nt, Homo sapiens
gaaggagacuguggaccau

SEQ ID NO: 336387 - RNA, 19 nt, Homo sapiens
gaaccgauguaggaaaguc

SEQ ID NO: 336388 - RNA, 19 nt, Homo sapiens
acaaguguccuuugauuug

SEQ ID NO: 336389 - RNA, 19 nt, Homo sapiens
aaacuccucucagccaauu

SEQ ID NO: 336390 - RNA, 19 nt, Homo sapiens
uaacccaugugagaauauu

SEQ ID NO: 336391 - RNA, 19 nt, Homo sapiens
ggcagaaauugaggaauga

SEQ ID NO: 336392 - RNA, 19 nt, Homo sapiens
uagcagaggcauuucauau

SEQ ID NO: 336393 - RNA, 19 nt, Homo sapiens
ggagaucagcaaguuaauu

SEQ ID NO: 336394 - RNA, 19 nt, Homo sapiens
caagcgguguaacaagaaa

SEQ ID NO: 336395 - RNA, 19 nt, Homo sapiens
ggaccaugcucucgcacau

SEQ ID NO: 336396 - RNA, 19 nt, Homo sapiens
gagcuguuaccauguguuu

SEQ ID NO: 336397 - RNA, 19 nt, Homo sapiens
agaaccaugugcuaaagaa

SEQ ID NO: 336398 - RNA, 19 nt, Homo sapiens
uacagaugcugcugaauuc

SEQ ID NO: 336399 - RNA, 19 nt, Homo sapiens
agauacagcuggauuagag

SEQ ID NO: 336400 - RNA, 19 nt, Homo sapiens
guggagaucagcaaguuaa

SEQ ID NO: 336401 - RNA, 19 nt, Homo sapiens
acaaaggagcuuccaugua

SEQ ID NO: 336402 - RNA, 19 nt, Homo sapiens
ucaagcagauggccagagu

SEQ ID NO: 336403 - RNA, 19 nt, Homo sapiens
ggugugcugugaauugguu

SEQ ID NO: 336404 - RNA, 19 nt, Homo sapiens
caggagggccaccgacaua

SEQ ID NO: 336405 - RNA, 19 nt, Homo sapiens
gaucagagagugggacaga

SEQ ID NO: 336406 - RNA, 19 nt, Homo sapiens
ccugucaccugguugauau

SEQ ID NO: 336407 - RNA, 19 nt, Homo sapiens
gaccauccaguauaucauu

SEQ ID NO: 336408 - RNA, 19 nt, Homo sapiens
gugaaaagcucugccauga

SEQ ID NO: 336409 - RNA, 19 nt, Homo sapiens
ggcaaggucuccagcaucu

SEQ ID NO: 336410 - RNA, 19 nt, Homo sapiens
ugaacugcauaaagaaaug

SEQ ID NO: 336411 - RNA, 19 nt, Homo sapiens
gcacacagguucucuaauu

SEQ ID NO: 336412 - RNA, 19 nt, Homo sapiens
caucguauguucucaauua

SEQ ID NO: 336413 - RNA, 19 nt, Homo sapiens
gaaaugaaauuccacauag

SEQ ID NO: 336414 - RNA, 19 nt, Homo sapiens
gaaaugagcagagaagaua

SEQ ID NO: 336415 - RNA, 19 nt, Homo sapiens
gcacaaguguccuuugauu

SEQ ID NO: 336416 - RNA, 19 nt, Homo sapiens
caaaggagcuuccauguac

SEQ ID NO: 336417 - RNA, 19 nt, Homo sapiens
gcaauaaagugaaguccaa

SEQ ID NO: 336418 - RNA, 19 nt, Homo sapiens
gauuucagcuguuuaaaga

SEQ ID NO: 336419 - RNA, 19 nt, Homo sapiens
gcaggauccucaaguagua

SEQ ID NO: 336420 - RNA, 19 nt, Homo sapiens
gaauuaaccugccauugug

SEQ ID NO: 336421 - RNA, 19 nt, Homo sapiens
gagcacaaguguccuuuga

SEQ ID NO: 336422 - RNA, 19 nt, Homo sapiens
gaacaacuaacaacagaaa

SEQ ID NO: 336423 - RNA, 19 nt, Homo sapiens
gcaggucccuuaugaugaa

SEQ ID NO: 336424 - RNA, 19 nt, Homo sapiens
caaggcagguagauuauga

SEQ ID NO: 336425 - RNA, 19 nt, Homo sapiens
gaaaugcgguaaccauaca

SEQ ID NO: 336426 - RNA, 19 nt, Homo sapiens
gaugaaaucucugcuguuc

SEQ ID NO: 336427 - RNA, 19 nt, Homo sapiens
gagaagauacccacagaaa

SEQ ID NO: 336428 - RNA, 19 nt, Homo sapiens
gagauaugcuguguggaua

SEQ ID NO: 336429 - RNA, 19 nt, Homo sapiens
gacaagcgguguaacaaga

SEQ ID NO: 336430 - RNA, 19 nt, Homo sapiens
gaaaugcaauaaagugaag

SEQ ID NO: 336431 - RNA, 19 nt, Homo sapiens
ggaaugagaagcaccauau

SEQ ID NO: 336432 - RNA, 19 nt, Homo sapiens
gaaucaaccuuggcagaaa

SEQ ID NO: 336433 - RNA, 19 nt, Homo sapiens
caagagaaaugcacuguac

SEQ ID NO: 336434 - RNA, 19 nt, Homo sapiens
cauuugaacugcauaaaga

SEQ ID NO: 336435 - RNA, 19 nt, Homo sapiens
gaagcaaaccuaagaguca

SEQ ID NO: 336436 - RNA, 19 nt, Homo sapiens
ccaggcaggucccuuauga

SEQ ID NO: 336437 - RNA, 19 nt, Homo sapiens
gagacaggguugccacaaa

SEQ ID NO: 336438 - RNA, 19 nt, Homo sapiens
ggccaaggcagguagauua

SEQ ID NO: 336439 - RNA, 19 nt, Homo sapiens
gaaauugugguguaucuau

SEQ ID NO: 336440 - RNA, 19 nt, Homo sapiens
gcacuuuccuaacucagaa

SEQ ID NO: 336441 - RNA, 19 nt, Homo sapiens
cggcauaaauguaaugaga

SEQ ID NO: 336442 - RNA, 19 nt, Homo sapiens
aggaaagucugauggauuu

SEQ ID NO: 336443 - RNA, 19 nt, Homo sapiens
gagcagaaaugaaauucca

SEQ ID NO: 336444 - RNA, 19 nt, Homo sapiens
caaaggaugaccucaauga

SEQ ID NO: 336445 - RNA, 19 nt, Homo sapiens
ccuaauaccuacacuuguu

SEQ ID NO: 336446 - RNA, 19 nt, Homo sapiens
caacacaguuuguauacag

SEQ ID NO: 336447 - RNA, 19 nt, Homo sapiens
gagcauaguccuucugaga

SEQ ID NO: 336448 - RNA, 19 nt, Homo sapiens
cgagauguguuauguggaa

SEQ ID NO: 336449 - RNA, 19 nt, Homo sapiens
caauacagaugcugcugaa

SEQ ID NO: 336450 - RNA, 19 nt, Homo sapiens
gcaugagaaugauacaaug

SEQ ID NO: 336451 - RNA, 19 nt, Homo sapiens
ggccaggacugcccacauu

SEQ ID NO: 336452 - RNA, 19 nt, Homo sapiens
guaaugagauaugcugugu

SEQ ID NO: 336453 - RNA, 19 nt, Homo sapiens
gaaaagcucugccaugaag

SEQ ID NO: 336454 - RNA, 19 nt, Homo sapiens
uuagagagcucgaccagau

SEQ ID NO: 336455 - RNA, 19 nt, Homo sapiens
ccaccucccugucaccuuu

SEQ ID NO: 336456 - RNA, 19 nt, Homo sapiens
gcaaaggcaugagaaugau

SEQ ID NO: 336457 - RNA, 19 nt, Homo sapiens
caaccuggauggauuugga

SEQ ID NO: 336458 - RNA, 19 nt, Homo sapiens
ugaaguaacucaggaaugg

SEQ ID NO: 336459 - RNA, 19 nt, Homo sapiens
aagugaagaugcuacauuu

SEQ ID NO: 336460 - RNA, 19 nt, Homo sapiens
gcagauggccagagugguu

SEQ ID NO: 336461 - RNA, 19 nt, Homo sapiens
ggaguugucagagcuguua

SEQ ID NO: 336462 - RNA, 19 nt, Homo sapiens
cagagaagauacccacaga

SEQ ID NO: 336463 - RNA, 19 nt, Homo sapiens
gagcagaccucagauacag

SEQ ID NO: 336464 - RNA, 19 nt, Homo sapiens
gccauggccuucagaauca

SEQ ID NO: 336465 - RNA, 19 nt, Homo sapiens
uguaauaaaucgcccaaga

SEQ ID NO: 336466 - RNA, 19 nt, Homo sapiens
ugaagaugcuacauuuaug

SEQ ID NO: 336467 - RNA, 19 nt, Homo sapiens
gaguggagcagaaaugaaa

SEQ ID NO: 336468 - RNA, 19 nt, Homo sapiens
ggugagguuuguagaaaga

SEQ ID NO: 336469 - RNA, 19 nt, Homo sapiens
guuaccauguguuucauuu

SEQ ID NO: 336470 - RNA, 19 nt, Homo sapiens
gaacuuggcagucaucaac

SEQ ID NO: 336471 - RNA, 19 nt, Homo sapiens
ggaggcgggugagggauaa

SEQ ID NO: 336472 - RNA, 19 nt, Homo sapiens
gucaacaaguggauaaaga

SEQ ID NO: 336473 - RNA, 19 nt, Homo sapiens
ugaauuaaccugccauugu

SEQ ID NO: 336474 - RNA, 19 nt, Homo sapiens
uaccauguguuucauuuga

SEQ ID NO: 336475 - RNA, 19 nt, Homo sapiens
ccaguucccugugguacua

SEQ ID NO: 336476 - RNA, 19 nt, Homo sapiens
gugaagaugcuacauuuau

SEQ ID NO: 336477 - RNA, 19 nt, Homo sapiens
cagaugcucuuucagaaca

SEQ ID NO: 336478 - RNA, 19 nt, Homo sapiens
ccaggaggguugaccaaga

SEQ ID NO: 336479 - RNA, 19 nt, Homo sapiens
uggcagaaauugaggaaug

SEQ ID NO: 336480 - RNA, 19 nt, Homo sapiens
cacccuaacagauauaaua

SEQ ID NO: 336481 - RNA, 19 nt, Homo sapiens
caacaaguggauaaagaaa

SEQ ID NO: 336482 - RNA, 19 nt, Homo sapiens
aaacagaaccaugugcuaa

SEQ ID NO: 336483 - RNA, 19 nt, Homo sapiens
gcauaguccuucugagagu

SEQ ID NO: 336484 - RNA, 19 nt, Homo sapiens
ugagauguugcgagaauua

SEQ ID NO: 336485 - RNA, 19 nt, Homo sapiens
ugaagaaccuugucaucgu

SEQ ID NO: 336486 - RNA, 19 nt, Homo sapiens
guggugagguuuguagaaa

SEQ ID NO: 336487 - RNA, 19 nt, Homo sapiens
caaguaguaucuccuuucu

SEQ ID NO: 336488 - RNA, 19 nt, Homo sapiens
gaacuuauccauguaacca

SEQ ID NO: 336489 - RNA, 19 nt, Homo sapiens
gcccaucagucaacaagug

SEQ ID NO: 336490 - RNA, 19 nt, Homo sapiens
gaaggagacuguggaccau

SEQ ID NO: 336491 - RNA, 19 nt, Homo sapiens
gaaccgauguaggaaaguc

SEQ ID NO: 336492 - RNA, 19 nt, Homo sapiens
uaauaggauugguagaaga

SEQ ID NO: 336493 - RNA, 19 nt, Homo sapiens
caggucacccuaacagaua

SEQ ID NO: 336494 - RNA, 19 nt, Homo sapiens
acaaguguccuuugauuug

SEQ ID NO: 336495 - RNA, 19 nt, Homo sapiens
aaacuccucucagccaauu

SEQ ID NO: 336496 - RNA, 19 nt, Homo sapiens
uaacccaugugagaauauu

SEQ ID NO: 336497 - RNA, 19 nt, Homo sapiens
ggcagaaauugaggaauga

SEQ ID NO: 336498 - RNA, 19 nt, Homo sapiens
gcaggagaauugcuugaac

SEQ ID NO: 336499 - RNA, 19 nt, Homo sapiens
acagcaaccuggauggauu

SEQ ID NO: 336500 - RNA, 19 nt, Homo sapiens
guuuauagcagcacaauuc

SEQ ID NO: 336501 - RNA, 19 nt, Homo sapiens
caagcgguguaacaagaaa

SEQ ID NO: 336502 - RNA, 19 nt, Homo sapiens
uacagaugcugcugaauuc

SEQ ID NO: 336503 - RNA, 19 nt, Homo sapiens
ggaccaugcucucgcacau

SEQ ID NO: 336504 - RNA, 19 nt, Homo sapiens
gagcuguuaccauguguuu

SEQ ID NO: 336505 - RNA, 19 nt, Homo sapiens
agaaccaugugcuaaagaa

SEQ ID NO: 336506 - RNA, 19 nt, Homo sapiens
agauacagcuggauuagag

SEQ ID NO: 336507 - RNA, 19 nt, Homo sapiens
uguaaucccagcuacuuua

SEQ ID NO: 336508 - RNA, 19 nt, Homo sapiens
gcacacgcauguuuauagc

SEQ ID NO: 336509 - RNA, 19 nt, Homo sapiens
acaaaggagcuuccaugua

SEQ ID NO: 336510 - RNA, 19 nt, Homo sapiens
ucaagcagauggccagagu

SEQ ID NO: 336511 - RNA, 19 nt, Homo sapiens
ggaaauugaucaacucuuc

SEQ ID NO: 336512 - RNA, 19 nt, Homo sapiens
ggacagaaaccacuuaguu

SEQ ID NO: 336513 - RNA, 19 nt, Homo sapiens
gaacaaccuucucaaccaa

SEQ ID NO: 336514 - RNA, 19 nt, Homo sapiens
gagcacagauuguucaaac

SEQ ID NO: 336515 - RNA, 19 nt, Homo sapiens
guugcaagccuuugucuua

SEQ ID NO: 336516 - RNA, 19 nt, Homo sapiens
aaaccaagccgaugaagaa

SEQ ID NO: 336517 - RNA, 19 nt, Homo sapiens
gaucacauucugcccuuua

SEQ ID NO: 336518 - RNA, 19 nt, Homo sapiens
caaaggagagaaggaaaua

SEQ ID NO: 336519 - RNA, 19 nt, Homo sapiens
uuuaauaaguggcucagua

SEQ ID NO: 336520 - RNA, 19 nt, Homo sapiens
cagagaugcuugaagaaga

SEQ ID NO: 336521 - RNA, 19 nt, Homo sapiens
gagggaccauggagcagua

SEQ ID NO: 336522 - RNA, 19 nt, Homo sapiens
cgacagagcagauuguugu

SEQ ID NO: 336523 - RNA, 19 nt, Homo sapiens
gaagaagcaaugacacaga

SEQ ID NO: 336524 - RNA, 19 nt, Homo sapiens
gaaggaaauaccugcauga

SEQ ID NO: 336525 - RNA, 19 nt, Homo sapiens
gcaaacagcaauaguucga

SEQ ID NO: 336526 - RNA, 19 nt, Homo sapiens
gcaguacacaaagcacuua

SEQ ID NO: 336527 - RNA, 19 nt, Homo sapiens
caucgucuaucaaccaguu

SEQ ID NO: 336528 - RNA, 19 nt, Homo sapiens
ggacaaggucaaaccauca

SEQ ID NO: 336529 - RNA, 19 nt, Homo sapiens
gggaaucucacacugacua

SEQ ID NO: 336530 - RNA, 19 nt, Homo sapiens
ggucauguuucucacuguu

SEQ ID NO: 336531 - RNA, 19 nt, Homo sapiens
gaggcaagcccgagcuaaa

SEQ ID NO: 336532 - RNA, 19 nt, Homo sapiens
cuacgugaaugccaaacaa

SEQ ID NO: 336533 - RNA, 19 nt, Homo sapiens
gcaccauucuccagcaagu

SEQ ID NO: 336534 - RNA, 19 nt, Homo sapiens
cuaacugaauggacgcuuu

SEQ ID NO: 336535 - RNA, 19 nt, Homo sapiens
gaagcaaugacacagauca

SEQ ID NO: 336536 - RNA, 19 nt, Homo sapiens
uggugaagguggacgauuu

SEQ ID NO: 336537 - RNA, 19 nt, Homo sapiens
ggaccuauuucagacuguu

SEQ ID NO: 336538 - RNA, 19 nt, Homo sapiens
ccaagccgaugaagaagca

SEQ ID NO: 336539 - RNA, 19 nt, Homo sapiens
caggcaauguggucaauuc

SEQ ID NO: 336540 - RNA, 19 nt, Homo sapiens
gaggccagcuaaucacauc

SEQ ID NO: 336541 - RNA, 19 nt, Homo sapiens
gcugaucaaggucauguuu

SEQ ID NO: 336542 - RNA, 19 nt, Homo sapiens
acaaagcacuuaccuugac

SEQ ID NO: 336543 - RNA, 19 nt, Homo sapiens
caggagggauggucaugau

SEQ ID NO: 336544 - RNA, 19 nt, Homo sapiens
gcacggaguguaccucaca

SEQ ID NO: 336545 - RNA, 19 nt, Homo sapiens
gcaagcccgagcuaaacua

SEQ ID NO: 336546 - RNA, 19 nt, Homo sapiens
cagcaaacagcaauaguuc

SEQ ID NO: 336547 - RNA, 19 nt, Homo sapiens
ucagacuguugaugacauu

SEQ ID NO: 336548 - RNA, 19 nt, Homo sapiens
guucaaacaggagccaaua

SEQ ID NO: 336549 - RNA, 19 nt, Homo sapiens
ugaauggacgcuuuguauu

SEQ ID NO: 336550 - RNA, 19 nt, Homo sapiens
uugaugacauugacauuuc

SEQ ID NO: 336551 - RNA, 19 nt, Homo sapiens
gcaagccuuugucuuacuc

SEQ ID NO: 336552 - RNA, 19 nt, Homo sapiens
ccaggaaauugaucaacuc

SEQ ID NO: 336553 - RNA, 19 nt, Homo sapiens
gcagagaugcuugaagaag

SEQ ID NO: 336554 - RNA, 19 nt, Homo sapiens
ggaaucucacacugacuaa

SEQ ID NO: 336555 - RNA, 19 nt, Homo sapiens
uugaucaacucuuccaaug

SEQ ID NO: 336556 - RNA, 19 nt, Homo sapiens
aagaagcaaugacacagau

SEQ ID NO: 336557 - RNA, 19 nt, Homo sapiens
aaacaggagccaauaccaa

SEQ ID NO: 336558 - RNA, 19 nt, Homo sapiens
uuucaggcaugaucacuau

SEQ ID NO: 336559 - RNA, 19 nt, Homo sapiens
aggaaguucuaucuuguga

SEQ ID NO: 336560 - RNA, 19 nt, Homo sapiens
caaaccaagccgaugaaga

SEQ ID NO: 336561 - RNA, 19 nt, Homo sapiens
ucacagccuucuaggaucu

SEQ ID NO: 336562 - RNA, 19 nt, Homo sapiens
aauggacgcuuuguauuca

SEQ ID NO: 336563 - RNA, 19 nt, Homo sapiens
gaagucagccagccaucuc

SEQ ID NO: 336564 - RNA, 19 nt, Homo sapiens
gaucauccgaguguccuaa

SEQ ID NO: 336565 - RNA, 19 nt, Homo sapiens
ccaaaggagagaaggaaau

SEQ ID NO: 336566 - RNA, 19 nt, Homo sapiens
gagccucucuacgugaaug

SEQ ID NO: 336567 - RNA, 19 nt, Homo sapiens
cagcuaaucacaucaacug

SEQ ID NO: 336568 - RNA, 19 nt, Homo sapiens
uaacugaauggacgcuuug

SEQ ID NO: 336569 - RNA, 19 nt, Homo sapiens
gcagcaggguggugucacu

SEQ ID NO: 336570 - RNA, 19 nt, Homo sapiens
ccucacagccuucuaggau

SEQ ID NO: 336571 - RNA, 19 nt, Homo sapiens
acauugacauuucauggau

SEQ ID NO: 336572 - RNA, 19 nt, Homo sapiens
gacauugacauuucaugga

SEQ ID NO: 336573 - RNA, 19 nt, Homo sapiens
gaaaaggauaguccccaua

SEQ ID NO: 336574 - RNA, 19 nt, Homo sapiens
gaaauaccugcaugagucu

SEQ ID NO: 336575 - RNA, 19 nt, Homo sapiens
gagcgaggcacggagugua

SEQ ID NO: 336576 - RNA, 19 nt, Homo sapiens
ugugauacggaaacaauaa

SEQ ID NO: 336577 - RNA, 19 nt, Homo sapiens
guugaugacauugacauuu

SEQ ID NO: 336578 - RNA, 19 nt, Homo sapiens
auaaguggcucaguauuac

SEQ ID NO: 336579 - RNA, 19 nt, Homo sapiens
uuaauaaguggcucaguau

SEQ ID NO: 336580 - RNA, 19 nt, Homo sapiens
ugaucaaggucauguuucu

SEQ ID NO: 336581 - RNA, 19 nt, Homo sapiens
ggacagcaaguggcacaga

SEQ ID NO: 336582 - RNA, 19 nt, Homo sapiens
ggccagacccagcagauca

SEQ ID NO: 336583 - RNA, 19 nt, Homo sapiens
gucaaaccaucaugcaagu

SEQ ID NO: 336584 - RNA, 19 nt, Homo sapiens
ccaagggcagccauuaaug

SEQ ID NO: 336585 - RNA, 19 nt, Homo sapiens
gccuuugucuuacucuuuc

SEQ ID NO: 336586 - RNA, 19 nt, Homo sapiens
ggcaagggacugucacugu

SEQ ID NO: 336587 - RNA, 19 nt, Homo sapiens
cugaauggacgcuuuguau

SEQ ID NO: 336588 - RNA, 19 nt, Homo sapiens
gcaggagcacagauuguuc

SEQ ID NO: 336589 - RNA, 19 nt, Homo sapiens
cacacugacuaacugaaug

SEQ ID NO: 336590 - RNA, 19 nt, Homo sapiens
acagcaaacagcaauaguu

SEQ ID NO: 336591 - RNA, 19 nt, Homo sapiens
cacauucugcccuuuacua

SEQ ID NO: 336592 - RNA, 19 nt, Homo sapiens
guccaagggcagccauuaa

SEQ ID NO: 336593 - RNA, 19 nt, Homo sapiens
gagggauggucaugauggu

SEQ ID NO: 336594 - RNA, 19 nt, Homo sapiens
caaaccaucaugcaaguac

SEQ ID NO: 336595 - RNA, 19 nt, Homo sapiens
caaagcacuuaccuugacu

SEQ ID NO: 336596 - RNA, 19 nt, Homo sapiens
cacaaagcacuuaccuuga

SEQ ID NO: 336597 - RNA, 19 nt, Homo sapiens
ugaugacauugacauuuca

SEQ ID NO: 336598 - RNA, 19 nt, Homo sapiens
agucaggaccuauuucaga

SEQ ID NO: 336599 - RNA, 19 nt, Homo sapiens
gaaguugcaagccuuuguc

SEQ ID NO: 336600 - RNA, 19 nt, Homo sapiens
ggaggcaagcccgagcuaa

SEQ ID NO: 336601 - RNA, 19 nt, Homo sapiens
gugauacggaaacaauaaa

SEQ ID NO: 336602 - RNA, 19 nt, Homo sapiens
cauugacauuucauggauu

SEQ ID NO: 336603 - RNA, 19 nt, Homo sapiens
guauacagcaaacagcaau

SEQ ID NO: 336604 - RNA, 19 nt, Homo sapiens
uauuucagacuguugauga

SEQ ID NO: 336605 - RNA, 19 nt, Homo sapiens
ucacacugacuaacugaau

SEQ ID NO: 336606 - RNA, 19 nt, Homo sapiens
gagcugaucaaggucaugu

SEQ ID NO: 336607 - RNA, 19 nt, Homo sapiens
gacaggaaucucacuugga

SEQ ID NO: 336608 - RNA, 19 nt, Homo sapiens
uaugcaggauccaaaccaa

SEQ ID NO: 336609 - RNA, 19 nt, Homo sapiens
guaccucacagccuucuag

SEQ ID NO: 336610 - RNA, 19 nt, Homo sapiens
gagaaggaaauaccugcau

SEQ ID NO: 336611 - RNA, 19 nt, Homo sapiens
ggaaauugaucaacucuuc

SEQ ID NO: 336612 - RNA, 19 nt, Homo sapiens
ggacagaaaccacuuaguu

SEQ ID NO: 336613 - RNA, 19 nt, Homo sapiens
gaacaaccuucucaaccaa

SEQ ID NO: 336614 - RNA, 19 nt, Homo sapiens
gagcacagauuguucaaac

SEQ ID NO: 336615 - RNA, 19 nt, Homo sapiens
guugcaagccuuugucuua

SEQ ID NO: 336616 - RNA, 19 nt, Homo sapiens
aaaccaagccgaugaagaa

SEQ ID NO: 336617 - RNA, 19 nt, Homo sapiens
gaucacauucugcccuuua

SEQ ID NO: 336618 - RNA, 19 nt, Homo sapiens
caaaggagagaaggaaaua

SEQ ID NO: 336619 - RNA, 19 nt, Homo sapiens
uuuaauaaguggcucagua

SEQ ID NO: 336620 - RNA, 19 nt, Homo sapiens
cagagaugcuugaagaaga

SEQ ID NO: 336621 - RNA, 19 nt, Homo sapiens
gagggaccauggagcagua

SEQ ID NO: 336622 - RNA, 19 nt, Homo sapiens
cgacagagcagauuguugu

SEQ ID NO: 336623 - RNA, 19 nt, Homo sapiens
gaagaagcaaugacacaga

SEQ ID NO: 336624 - RNA, 19 nt, Homo sapiens
gaaggaaauaccugcauga

SEQ ID NO: 336625 - RNA, 19 nt, Homo sapiens
gcaaacagcaauaguucga

SEQ ID NO: 336626 - RNA, 19 nt, Homo sapiens
gcaguacacaaagcacuua

SEQ ID NO: 336627 - RNA, 19 nt, Homo sapiens
caucgucuaucaaccaguu

SEQ ID NO: 336628 - RNA, 19 nt, Homo sapiens
ggacaaggucaaaccauca

SEQ ID NO: 336629 - RNA, 19 nt, Homo sapiens
gggaaucucacacugacua

SEQ ID NO: 336630 - RNA, 19 nt, Homo sapiens
ggucauguuucucacuguu

SEQ ID NO: 336631 - RNA, 19 nt, Homo sapiens
gaggcaagcccgagcuaaa

SEQ ID NO: 336632 - RNA, 19 nt, Homo sapiens
cuacgugaaugccaaacaa

SEQ ID NO: 336633 - RNA, 19 nt, Homo sapiens
gcaccauucuccagcaagu

SEQ ID NO: 336634 - RNA, 19 nt, Homo sapiens
cuaacugaauggacgcuuu

SEQ ID NO: 336635 - RNA, 19 nt, Homo sapiens
gaagcaaugacacagauca

SEQ ID NO: 336636 - RNA, 19 nt, Homo sapiens
uggugaagguggacgauuu

SEQ ID NO: 336637 - RNA, 19 nt, Homo sapiens
ggaccuauuucagacuguu

SEQ ID NO: 336638 - RNA, 19 nt, Homo sapiens
ccaagccgaugaagaagca

SEQ ID NO: 336639 - RNA, 19 nt, Homo sapiens
caggcaauguggucaauuc

SEQ ID NO: 336640 - RNA, 19 nt, Homo sapiens
gaggccagcuaaucacauc

SEQ ID NO: 336641 - RNA, 19 nt, Homo sapiens
gcugaucaaggucauguuu

SEQ ID NO: 336642 - RNA, 19 nt, Homo sapiens
acaaagcacuuaccuugac

SEQ ID NO: 336643 - RNA, 19 nt, Homo sapiens
caggagggauggucaugau

SEQ ID NO: 336644 - RNA, 19 nt, Homo sapiens
gcacggaguguaccucaca

SEQ ID NO: 336645 - RNA, 19 nt, Homo sapiens
gcaagcccgagcuaaacua

SEQ ID NO: 336646 - RNA, 19 nt, Homo sapiens
cagcaaacagcaauaguuc

SEQ ID NO: 336647 - RNA, 19 nt, Homo sapiens
ucagacuguugaugacauu

SEQ ID NO: 336648 - RNA, 19 nt, Homo sapiens
guucaaacaggagccaaua

SEQ ID NO: 336649 - RNA, 19 nt, Homo sapiens
gguccaagggcagccauua

SEQ ID NO: 336650 - RNA, 19 nt, Homo sapiens
ugaauggacgcuuuguauu

SEQ ID NO: 336651 - RNA, 19 nt, Homo sapiens
uugaugacauugacauuuc

SEQ ID NO: 336652 - RNA, 19 nt, Homo sapiens
gcaagccuuugucuuacuc

SEQ ID NO: 336653 - RNA, 19 nt, Homo sapiens
ccaggaaauugaucaacuc

SEQ ID NO: 336654 - RNA, 19 nt, Homo sapiens
gcagagaugcuugaagaag

SEQ ID NO: 336655 - RNA, 19 nt, Homo sapiens
ggaaucucacacugacuaa

SEQ ID NO: 336656 - RNA, 19 nt, Homo sapiens
uugaucaacucuuccaaug

SEQ ID NO: 336657 - RNA, 19 nt, Homo sapiens
aagaagcaaugacacagau

SEQ ID NO: 336658 - RNA, 19 nt, Homo sapiens
aaacaggagccaauaccaa

SEQ ID NO: 336659 - RNA, 19 nt, Homo sapiens
uuucaggcaugaucacuau

SEQ ID NO: 336660 - RNA, 19 nt, Homo sapiens
aggaaguucuaucuuguga

SEQ ID NO: 336661 - RNA, 19 nt, Homo sapiens
caaaccaagccgaugaaga

SEQ ID NO: 336662 - RNA, 19 nt, Homo sapiens
ucacagccuucuaggaucu

SEQ ID NO: 336663 - RNA, 19 nt, Homo sapiens
aauggacgcuuuguauuca

SEQ ID NO: 336664 - RNA, 19 nt, Homo sapiens
gaagucagccagccaucuc

SEQ ID NO: 336665 - RNA, 19 nt, Homo sapiens
gaucauccgaguguccuaa

SEQ ID NO: 336666 - RNA, 19 nt, Homo sapiens
ccaaaggagagaaggaaau

SEQ ID NO: 336667 - RNA, 19 nt, Homo sapiens
gagccucucuacgugaaug

SEQ ID NO: 336668 - RNA, 19 nt, Homo sapiens
cagcuaaucacaucaacug

SEQ ID NO: 336669 - RNA, 19 nt, Homo sapiens
uaacugaauggacgcuuug

SEQ ID NO: 336670 - RNA, 19 nt, Homo sapiens
ccucacagccuucuaggau

SEQ ID NO: 336671 - RNA, 19 nt, Homo sapiens
acauugacauuucauggau

SEQ ID NO: 336672 - RNA, 19 nt, Homo sapiens
gacauugacauuucaugga

SEQ ID NO: 336673 - RNA, 19 nt, Homo sapiens
gaaaaggauaguccccaua

SEQ ID NO: 336674 - RNA, 19 nt, Homo sapiens
gaaauaccugcaugagucu

SEQ ID NO: 336675 - RNA, 19 nt, Homo sapiens
gagcgaggcacggagugua

SEQ ID NO: 336676 - RNA, 19 nt, Homo sapiens
ugugauacggaaacaauaa

SEQ ID NO: 336677 - RNA, 19 nt, Homo sapiens
guugaugacauugacauuu

SEQ ID NO: 336678 - RNA, 19 nt, Homo sapiens
auaaguggcucaguauuac

SEQ ID NO: 336679 - RNA, 19 nt, Homo sapiens
uuaauaaguggcucaguau

SEQ ID NO: 336680 - RNA, 19 nt, Homo sapiens
ugaucaaggucauguuucu

SEQ ID NO: 336681 - RNA, 19 nt, Homo sapiens
ggacagcaaguggcacaga

SEQ ID NO: 336682 - RNA, 19 nt, Homo sapiens
ggccagacccagcagauca

SEQ ID NO: 336683 - RNA, 19 nt, Homo sapiens
gucaaaccaucaugcaagu

SEQ ID NO: 336684 - RNA, 19 nt, Homo sapiens
ccaagggcagccauuaaug

SEQ ID NO: 336685 - RNA, 19 nt, Homo sapiens
gccuuugucuuacucuuuc

SEQ ID NO: 336686 - RNA, 19 nt, Homo sapiens
ggcaagggacugucacugu

SEQ ID NO: 336687 - RNA, 19 nt, Homo sapiens
cugaauggacgcuuuguau

SEQ ID NO: 336688 - RNA, 19 nt, Homo sapiens
gcaggagcacagauuguuc

SEQ ID NO: 336689 - RNA, 19 nt, Homo sapiens
cacacugacuaacugaaug

SEQ ID NO: 336690 - RNA, 19 nt, Homo sapiens
guccaagggcagccauuaa

SEQ ID NO: 336691 - RNA, 19 nt, Homo sapiens
cacauucugcccuuuacua

SEQ ID NO: 336692 - RNA, 19 nt, Homo sapiens
acagcaaacagcaauaguu

SEQ ID NO: 336693 - RNA, 19 nt, Homo sapiens
gagggauggucaugauggu

SEQ ID NO: 336694 - RNA, 19 nt, Homo sapiens
caaaccaucaugcaaguac

SEQ ID NO: 336695 - RNA, 19 nt, Homo sapiens
caaagcacuuaccuugacu

SEQ ID NO: 336696 - RNA, 19 nt, Homo sapiens
cacaaagcacuuaccuuga

SEQ ID NO: 336697 - RNA, 19 nt, Homo sapiens
ugaugacauugacauuuca

SEQ ID NO: 336698 - RNA, 19 nt, Homo sapiens
agucaggaccuauuucaga

SEQ ID NO: 336699 - RNA, 19 nt, Homo sapiens
gaaguugcaagccuuuguc

SEQ ID NO: 336700 - RNA, 19 nt, Homo sapiens
ggaggcaagcccgagcuaa

SEQ ID NO: 336701 - RNA, 19 nt, Homo sapiens
gugauacggaaacaauaaa

SEQ ID NO: 336702 - RNA, 19 nt, Homo sapiens
guauacagcaaacagcaau

SEQ ID NO: 336703 - RNA, 19 nt, Homo sapiens
cauugacauuucauggauu

SEQ ID NO: 336704 - RNA, 19 nt, Homo sapiens
uauuucagacuguugauga

SEQ ID NO: 336705 - RNA, 19 nt, Homo sapiens
ucacacugacuaacugaau

SEQ ID NO: 336706 - RNA, 19 nt, Homo sapiens
gagcugaucaaggucaugu

SEQ ID NO: 336707 - RNA, 19 nt, Homo sapiens
gacaggaaucucacuugga

SEQ ID NO: 336708 - RNA, 19 nt, Homo sapiens
uaugcaggauccaaaccaa

SEQ ID NO: 336709 - RNA, 19 nt, Homo sapiens
guaccucacagccuucuag

SEQ ID NO: 336710 - RNA, 19 nt, Homo sapiens
gagaaggaaauaccugcau

SEQ ID NO: 336711 - RNA, 19 nt, Homo sapiens
caaagaauguguucaagaa

SEQ ID NO: 336712 - RNA, 19 nt, Homo sapiens
uaagugaguucaucaguuu

SEQ ID NO: 336713 - RNA, 19 nt, Homo sapiens
guuaccagcuggcuuaaua

SEQ ID NO: 336714 - RNA, 19 nt, Homo sapiens
ggaggaagucauuauguua

SEQ ID NO: 336715 - RNA, 19 nt, Homo sapiens
gauauucucuuugcuaugu

SEQ ID NO: 336716 - RNA, 19 nt, Homo sapiens
uguggaaccucugaaauua

SEQ ID NO: 336717 - RNA, 19 nt, Homo sapiens
guaagugaguucaucaguu

SEQ ID NO: 336718 - RNA, 19 nt, Homo sapiens
uggaaccucugaaauuaua

SEQ ID NO: 336719 - RNA, 19 nt, Homo sapiens
gaaaggugccaucaagaga

SEQ ID NO: 336720 - RNA, 19 nt, Homo sapiens
caacacgguucugacagua

SEQ ID NO: 336721 - RNA, 19 nt, Homo sapiens
uauaacaucugaagcaagu

SEQ ID NO: 336722 - RNA, 19 nt, Homo sapiens
gacaguauuucaugacaau

SEQ ID NO: 336723 - RNA, 19 nt, Homo sapiens
aaacguggcuaggauaaug

SEQ ID NO: 336724 - RNA, 19 nt, Homo sapiens
gcaaacguggcuaggauaa

SEQ ID NO: 336725 - RNA, 19 nt, Homo sapiens
cagaggaggcauuuacuaa

SEQ ID NO: 336726 - RNA, 19 nt, Homo sapiens
aagaauguguucaagaaug

SEQ ID NO: 336727 - RNA, 19 nt, Homo sapiens
aggaaucucugcagacuau

SEQ ID NO: 336728 - RNA, 19 nt, Homo sapiens
gaggaagucauuauguuau

SEQ ID NO: 336729 - RNA, 19 nt, Homo sapiens
gaaugaucaugaagacaca

SEQ ID NO: 336730 - RNA, 19 nt, Homo sapiens
aacagaugcuucucaacua

SEQ ID NO: 336731 - RNA, 19 nt, Homo sapiens
caacagaugcuucucaacu

SEQ ID NO: 336732 - RNA, 19 nt, Homo sapiens
gaggacagcaugaaugauc

SEQ ID NO: 336733 - RNA, 19 nt, Homo sapiens
uggaggaagucauuauguu

SEQ ID NO: 336734 - RNA, 19 nt, Homo sapiens
caucauaucaacagauuuc

SEQ ID NO: 336735 - RNA, 19 nt, Homo sapiens
cacagacggucaacaacaa

SEQ ID NO: 336736 - RNA, 19 nt, Homo sapiens
ccaaagaauguguucaaga

SEQ ID NO: 336737 - RNA, 19 nt, Homo sapiens
acacgguucugacaguauu

SEQ ID NO: 336738 - RNA, 19 nt, Homo sapiens
gaucaugaagacacaaaug

SEQ ID NO: 336739 - RNA, 19 nt, Homo sapiens
ccagcuggcuuaauaacca

SEQ ID NO: 336740 - RNA, 19 nt, Homo sapiens
cagagaggcuaugaaagga

SEQ ID NO: 336741 - RNA, 19 nt, Homo sapiens
agaauguguucaagaaugu

SEQ ID NO: 336742 - RNA, 19 nt, Homo sapiens
ggaagucauuauguuauac

SEQ ID NO: 336743 - RNA, 19 nt, Homo sapiens
guucaagaauguguaagug

SEQ ID NO: 336744 - RNA, 19 nt, Homo sapiens
uaacaucugaagcaaguga

SEQ ID NO: 336745 - RNA, 19 nt, Homo sapiens
ucagagaggcuaugaaagg

SEQ ID NO: 336746 - RNA, 19 nt, Homo sapiens
ugacaguauuucaugacaa

SEQ ID NO: 336747 - RNA, 19 nt, Homo sapiens
gggcugcauuggagguuga

SEQ ID NO: 336748 - RNA, 19 nt, Homo sapiens
caaaagaugccaaagaaug

SEQ ID NO: 336749 - RNA, 19 nt, Homo sapiens
uuagauagguguucuucag

SEQ ID NO: 336750 - RNA, 19 nt, Homo sapiens
uacaacagaugcuucucaa

SEQ ID NO: 336751 - RNA, 19 nt, Homo sapiens
cuuuaggcuuugacaguua

SEQ ID NO: 336752 - RNA, 19 nt, Homo sapiens
gagguugaaaucacaaaga

SEQ ID NO: 336753 - RNA, 19 nt, Homo sapiens
cagauggacuaagugaaga

SEQ ID NO: 336754 - RNA, 19 nt, Homo sapiens
cuacagauggacuaaguga

SEQ ID NO: 336755 - RNA, 19 nt, Homo sapiens
agucacagcuacagaugga

SEQ ID NO: 336756 - RNA, 19 nt, Homo sapiens
cgggaaagauugcaaaaga

SEQ ID NO: 336757 - RNA, 19 nt, Homo sapiens
agacacaaaugguucaaaa

SEQ ID NO: 336758 - RNA, 19 nt, Homo sapiens
gaaucucugcagacuauau

SEQ ID NO: 336759 - RNA, 19 nt, Homo sapiens
ccacagacggucaacaaca

SEQ ID NO: 336760 - RNA, 19 nt, Homo sapiens
uaugucuacuuuaggcuuu

SEQ ID NO: 336761 - RNA, 19 nt, Homo sapiens
aacaaucaauggagaagau

SEQ ID NO: 336762 - RNA, 19 nt, Homo sapiens
ccucaaacgggaaagauug

SEQ ID NO: 336763 - RNA, 19 nt, Homo sapiens
uauauuggaggaagucauu

SEQ ID NO: 336764 - RNA, 19 nt, Homo sapiens
gaggaggcauuuacuaacc

SEQ ID NO: 336765 - RNA, 19 nt, Homo sapiens
ucuuugcuaugucuacuuu

SEQ ID NO: 336766 - RNA, 19 nt, Homo sapiens
aaggugccaucaagagaaa

SEQ ID NO: 336767 - RNA, 19 nt, Homo sapiens
caugaagacacaaaugguu

SEQ ID NO: 336768 - RNA, 19 nt, Homo sapiens
caacaucauaucaacagau

SEQ ID NO: 336769 - RNA, 19 nt, Homo sapiens
agugaaaggugccaucaag

SEQ ID NO: 336770 - RNA, 19 nt, Homo sapiens
acagaugcuucucaacuag

SEQ ID NO: 336771 - RNA, 19 nt, Homo sapiens
gcagucacagcuacagaug

SEQ ID NO: 336772 - RNA, 19 nt, Homo sapiens
gaaauucagagaggcuaug

SEQ ID NO: 336773 - RNA, 19 nt, Homo sapiens
ugacaacacgguucugaca

SEQ ID NO: 336774 - RNA, 19 nt, Homo sapiens
acaacacgguucugacagu

SEQ ID NO: 336775 - RNA, 19 nt, Homo sapiens
caagagaaacggaaaacaa

SEQ ID NO: 336776 - RNA, 19 nt, Homo sapiens
guucugacaguauuucaug

SEQ ID NO: 336777 - RNA, 19 nt, Homo sapiens
ugcaaaagaugccaaagaa

SEQ ID NO: 336778 - RNA, 19 nt, Homo sapiens
aaaggugccaucaagagaa

SEQ ID NO: 336779 - RNA, 19 nt, Homo sapiens
gccaaagaauguguucaag

SEQ ID NO: 336780 - RNA, 19 nt, Homo sapiens
aaacgggaaagauugcaaa

SEQ ID NO: 336781 - RNA, 19 nt, Homo sapiens
acagaggaggcauuuacua

SEQ ID NO: 336782 - RNA, 19 nt, Homo sapiens
uuacagaggaggcauuuac

SEQ ID NO: 336783 - RNA, 19 nt, Homo sapiens
gaaaacaaucaauggagaa

SEQ ID NO: 336784 - RNA, 19 nt, Homo sapiens
ggaaagauugcaaaagaug

SEQ ID NO: 336785 - RNA, 19 nt, Homo sapiens
gaaaggagaaaagggaauu

SEQ ID NO: 336786 - RNA, 19 nt, Homo sapiens
ugaaaggugccaucaagag

SEQ ID NO: 336787 - RNA, 19 nt, Homo sapiens
gcaaauucaguuuucauga

SEQ ID NO: 336788 - RNA, 19 nt, Homo sapiens
uggacuaagugaagagcuu

SEQ ID NO: 336789 - RNA, 19 nt, Homo sapiens
cuacaacagaugcuucuca

SEQ ID NO: 336790 - RNA, 19 nt, Homo sapiens
cacaaaugguucaaaagaa

SEQ ID NO: 336791 - RNA, 19 nt, Homo sapiens
acagauggacuaagugaag

SEQ ID NO: 336792 - RNA, 19 nt, Homo sapiens
gagcagucacagcuacaga

SEQ ID NO: 336793 - RNA, 19 nt, Homo sapiens
ggaauugguggagcaguca

SEQ ID NO: 336794 - RNA, 19 nt, Homo sapiens
aagaauguguaagugaguu

SEQ ID NO: 336795 - RNA, 19 nt, Homo sapiens
gaagacacaaaugguucaa

SEQ ID NO: 336796 - RNA, 19 nt, Homo sapiens
cuaggaaucucugcagacu

SEQ ID NO: 336797 - RNA, 19 nt, Homo sapiens
cacaaagauuagacaccuu

SEQ ID NO: 336798 - RNA, 19 nt, Homo sapiens
gcuuacagaggaggcauuu

SEQ ID NO: 336799 - RNA, 19 nt, Homo sapiens
cugaggacagcaugaauga

SEQ ID NO: 336800 - RNA, 19 nt, Homo sapiens
gugaaaggugccaucaaga

SEQ ID NO: 336801 - RNA, 19 nt, Homo sapiens
caagugaaaggugccauca

SEQ ID NO: 336802 - RNA, 19 nt, Homo sapiens
gggaaagauugcaaaagau

SEQ ID NO: 336803 - RNA, 19 nt, Homo sapiens
gauacugaggacagcauga

SEQ ID NO: 336804 - RNA, 19 nt, Homo sapiens
guggaaccucugaaauuau

SEQ ID NO: 336805 - RNA, 19 nt, Homo sapiens
caaacgggaaagauugcaa

SEQ ID NO: 336806 - RNA, 19 nt, Homo sapiens
agguugaaaucacaaagau

SEQ ID NO: 336807 - RNA, 19 nt, Homo sapiens
acaacaucauaucaacaga

SEQ ID NO: 336808 - RNA, 19 nt, Homo sapiens
uacacaacaucauaucaac

SEQ ID NO: 336809 - RNA, 19 nt, Homo sapiens
guuaugguuuacacaacau

SEQ ID NO: 336810 - RNA, 19 nt, Homo sapiens
aaccacagacggucaacaa

SEQ ID NO: 336811 - RNA, 19 nt, Homo sapiens
gcagaaagaugcaauauuu

SEQ ID NO: 336812 - RNA, 19 nt, Homo sapiens
gaaggaggauuugguggua

SEQ ID NO: 336813 - RNA, 19 nt, Homo sapiens
gagaguggguggauucauu

SEQ ID NO: 336814 - RNA, 19 nt, Homo sapiens
gagcagaguugucgagaug

SEQ ID NO: 336815 - RNA, 19 nt, Homo sapiens
ggacagauccagacacuug

SEQ ID NO: 336816 - RNA, 19 nt, Homo sapiens
gaaacuggaugaagaugug

SEQ ID NO: 336817 - RNA, 19 nt, Homo sapiens
ggaaacauucuuugcauuu

SEQ ID NO: 336818 - RNA, 19 nt, Homo sapiens
gagugugguugaagaaaua

SEQ ID NO: 336819 - RNA, 19 nt, Homo sapiens
guccaaugcuaugaaauua

SEQ ID NO: 336820 - RNA, 19 nt, Homo sapiens
gaauguguguagcugcuuu

SEQ ID NO: 336821 - RNA, 19 nt, Homo sapiens
caccaaugcucaacagauu

SEQ ID NO: 336822 - RNA, 19 nt, Homo sapiens
uccaagagaugaacugaaa

SEQ ID NO: 336823 - RNA, 19 nt, Homo sapiens
ggaugaagaugugaagaug

SEQ ID NO: 336824 - RNA, 19 nt, Homo sapiens
gacagcagcucuaccagau

SEQ ID NO: 336825 - RNA, 19 nt, Homo sapiens
gagccuggauucacacaga

SEQ ID NO: 336826 - RNA, 19 nt, Homo sapiens
gcauuuaagagacagauuu

SEQ ID NO: 336827 - RNA, 19 nt, Homo sapiens
agaagcgccuguacucuuu

SEQ ID NO: 336828 - RNA, 19 nt, Homo sapiens
ugaagagugugguugaaga

SEQ ID NO: 336829 - RNA, 19 nt, Homo sapiens
gaacugaaaccuccaaagc

SEQ ID NO: 336830 - RNA, 19 nt, Homo sapiens
gauaucgccauggcaauua

SEQ ID NO: 336831 - RNA, 19 nt, Homo sapiens
cagaggccauggaaacauu

SEQ ID NO: 336832 - RNA, 19 nt, Homo sapiens
caggagagauccagcagau

SEQ ID NO: 336833 - RNA, 19 nt, Homo sapiens
gaggugcgccagucuguaa

SEQ ID NO: 336834 - RNA, 19 nt, Homo sapiens
uuaugaaacuggaugaaga

SEQ ID NO: 336835 - RNA, 19 nt, Homo sapiens
gaagagugugguugaagaa

SEQ ID NO: 336836 - RNA, 19 nt, Homo sapiens
cuaggacacuggugcacua

SEQ ID NO: 336837 - RNA, 19 nt, Homo sapiens
gcucguauuaagaagauua

SEQ ID NO: 336838 - RNA, 19 nt, Homo sapiens
gguguacgguauuucuuga

SEQ ID NO: 336839 - RNA, 19 nt, Homo sapiens
cagcagaucaucacuaaca

SEQ ID NO: 336840 - RNA, 19 nt, Homo sapiens
gaguguguguccaaugcua

SEQ ID NO: 336841 - RNA, 19 nt, Homo sapiens
ugcagcagaucaucacuaa

SEQ ID NO: 336842 - RNA, 19 nt, Homo sapiens
gaagaugugaagaugauca

SEQ ID NO: 336843 - RNA, 19 nt, Homo sapiens
ggaauuuaacagugaaaga

SEQ ID NO: 336844 - RNA, 19 nt, Homo sapiens
aaacugugcuagucuccuu

SEQ ID NO: 336845 - RNA, 19 nt, Homo sapiens
acuaggacuuuguguguuu

SEQ ID NO: 336846 - RNA, 19 nt, Homo sapiens
ccaggaaacuaggacuuug

SEQ ID NO: 336847 - RNA, 19 nt, Homo sapiens
gaagaugaucagugcagaa

SEQ ID NO: 336848 - RNA, 19 nt, Homo sapiens
aaacuaggacuuugugugu

SEQ ID NO: 336849 - RNA, 19 nt, Homo sapiens
caaggacacccaacacaau

SEQ ID NO: 336850 - RNA, 19 nt, Homo sapiens
ggauucacacagaagauaa

SEQ ID NO: 336851 - RNA, 19 nt, Homo sapiens
gcugcaguauauccgcuua

SEQ ID NO: 336852 - RNA, 19 nt, Homo sapiens
ccggccagcugcaguauau

SEQ ID NO: 336853 - RNA, 19 nt, Homo sapiens
gcagaguugucgagauguc

SEQ ID NO: 336854 - RNA, 19 nt, Homo sapiens
gguacuagcagcagugaug

SEQ ID NO: 336855 - RNA, 19 nt, Homo sapiens
gaacucccacuggcucgua

SEQ ID NO: 336856 - RNA, 19 nt, Homo sapiens
uggaaacauucuuugcauu

SEQ ID NO: 336857 - RNA, 19 nt, Homo sapiens
cagcagugaugcccagcaa

SEQ ID NO: 336858 - RNA, 19 nt, Homo sapiens
gauauuguuccaagagaug

SEQ ID NO: 336859 - RNA, 19 nt, Homo sapiens
gaugaagaugugaagauga

SEQ ID NO: 336860 - RNA, 19 nt, Homo sapiens
ggccauggaaacauucuuu

SEQ ID NO: 336861 - RNA, 19 nt, Homo sapiens
ccaaggacacccaacacaa

SEQ ID NO: 336862 - RNA, 19 nt, Homo sapiens
cagaagcgccuguacucuu

SEQ ID NO: 336863 - RNA, 19 nt, Homo sapiens
gcagugaugcccagcaaag

SEQ ID NO: 336864 - RNA, 19 nt, Homo sapiens
gugcuagucuccuuugcau

SEQ ID NO: 336865 - RNA, 19 nt, Homo sapiens
ggacacuggugcacuacac

SEQ ID NO: 336866 - RNA, 19 nt, Homo sapiens
cgagauguccacagaagga

SEQ ID NO: 336867 - RNA, 19 nt, Homo sapiens
gauggaauuaggugaaugu

SEQ ID NO: 336868 - RNA, 19 nt, Homo sapiens
ggucagcaggugcagauug

SEQ ID NO: 336869 - RNA, 19 nt, Homo sapiens
ccacuggcucguauuaaga

SEQ ID NO: 336870 - RNA, 19 nt, Homo sapiens
cagauggaauuaggugaau

SEQ ID NO: 336871 - RNA, 19 nt, Homo sapiens
agagugugguugaagaaau

SEQ ID NO: 336872 - RNA, 19 nt, Homo sapiens
guccacagaaggaggauuu

SEQ ID NO: 336873 - RNA, 19 nt, Homo sapiens
gcaaggacagcagcaguuc

SEQ ID NO: 336874 - RNA, 19 nt, Homo sapiens
ccagacacuugccaccaau

SEQ ID NO: 336875 - RNA, 19 nt, Homo sapiens
gucagcaggugcagauugu

SEQ ID NO: 336876 - RNA, 19 nt, Homo sapiens
ucacacagaagauaacaag

SEQ ID NO: 336877 - RNA, 19 nt, Homo sapiens
ggccucgggucauggaaga

SEQ ID NO: 336878 - RNA, 19 nt, Homo sapiens
uguccaaugcuaugaaauu

SEQ ID NO: 336879 - RNA, 19 nt, Homo sapiens
gcacuggacagaccaugca

SEQ ID NO: 336880 - RNA, 19 nt, Homo sapiens
gacaaugcagguuggagaa

SEQ ID NO: 336881 - RNA, 19 nt, Homo sapiens
gaauuuaacagugaaagac

SEQ ID NO: 336882 - RNA, 19 nt, Homo sapiens
gcccucagauggaauuagg

SEQ ID NO: 336883 - RNA, 19 nt, Homo sapiens
gagccaguccaguacuauu

SEQ ID NO: 336884 - RNA, 19 nt, Homo sapiens
ccgagccaguccaguacua

SEQ ID NO: 336885 - RNA, 19 nt, Homo sapiens
caucgauauuguuccaaga

SEQ ID NO: 336886 - RNA, 19 nt, Homo sapiens
guaucaggcacucaaguug

SEQ ID NO: 336887 - RNA, 19 nt, Homo sapiens
gacagaccaugcaggugau

SEQ ID NO: 336888 - RNA, 19 nt, Homo sapiens
gccaaggcagcccagauuu

SEQ ID NO: 336889 - RNA, 19 nt, Homo sapiens
guucuggccucgggucaug

SEQ ID NO: 336890 - RNA, 19 nt, Homo sapiens
ccagggacccaggaaacua

SEQ ID NO: 336891 - RNA, 19 nt, Homo sapiens
ucagauggaauuaggugaa

SEQ ID NO: 336892 - RNA, 19 nt, Homo sapiens
augaagaugugaagaugau

SEQ ID NO: 336893 - RNA, 19 nt, Homo sapiens
ccagcagaaagaugcaaua

SEQ ID NO: 336894 - RNA, 19 nt, Homo sapiens
ccgcuuagcccagccugua

SEQ ID NO: 336895 - RNA, 19 nt, Homo sapiens
cgauauuguuccaagagau

SEQ ID NO: 336896 - RNA, 19 nt, Homo sapiens
gucgagauguccacagaag

SEQ ID NO: 336897 - RNA, 19 nt, Homo sapiens
ccaguccaguacuauuuca

SEQ ID NO: 336898 - RNA, 19 nt, Homo sapiens
cagcagaaagaugcaauau

SEQ ID NO: 336899 - RNA, 19 nt, Homo sapiens
uaccagauccagcaaguca

SEQ ID NO: 336900 - RNA, 19 nt, Homo sapiens
gcagaucaucacuaacaca

SEQ ID NO: 336901 - RNA, 19 nt, Homo sapiens
gcaacccaccgcuguccaa

SEQ ID NO: 336902 - RNA, 19 nt, Homo sapiens
gaauuaggugaaugugugu

SEQ ID NO: 336903 - RNA, 19 nt, Homo sapiens
ccaccaaugcucaacagau

SEQ ID NO: 336904 - RNA, 19 nt, Homo sapiens
cuucgagccuggauucaca

SEQ ID NO: 336905 - RNA, 19 nt, Homo sapiens
uguguccaaugcuaugaaa

SEQ ID NO: 336906 - RNA, 19 nt, Homo sapiens
ggacacccaacacaauuuu

SEQ ID NO: 336907 - RNA, 19 nt, Homo sapiens
ucgauauuguuccaagaga

SEQ ID NO: 336908 - RNA, 19 nt, Homo sapiens
ggguguacgguauuucuug

SEQ ID NO: 336909 - RNA, 19 nt, Homo sapiens
ggaggugcgccagucugua

SEQ ID NO: 336910 - RNA, 19 nt, Homo sapiens
ugauaucgccauggcaauu

SEQ ID NO: 336911 - RNA, 19 nt, Homo sapiens
ggacuaaacuucagcauuc

SEQ ID NO: 336912 - RNA, 19 nt, Homo sapiens
gggcagacccgcaacauua

SEQ ID NO: 336913 - RNA, 19 nt, Homo sapiens
gcaaggaggugaugguguu

SEQ ID NO: 336914 - RNA, 19 nt, Homo sapiens
uauaaggacugcaugguaa

SEQ ID NO: 336915 - RNA, 19 nt, Homo sapiens
ugggagaggugaacauuaa

SEQ ID NO: 336916 - RNA, 19 nt, Homo sapiens
caagggagcagcuuucuau

SEQ ID NO: 336917 - RNA, 19 nt, Homo sapiens
uaccucaaccuguaaauua

SEQ ID NO: 336918 - RNA, 19 nt, Homo sapiens
gaacauuaacaacagugua

SEQ ID NO: 336919 - RNA, 19 nt, Homo sapiens
ucaaggcgcugaccaugga

SEQ ID NO: 336920 - RNA, 19 nt, Homo sapiens
cacuggaacucauauugua

SEQ ID NO: 336921 - RNA, 19 nt, Homo sapiens
gcacuggaacucauauugu

SEQ ID NO: 336922 - RNA, 19 nt, Homo sapiens
uaauguccauguuguucua

SEQ ID NO: 336923 - RNA, 19 nt, Homo sapiens
caggaaggcugugagaaga

SEQ ID NO: 336924 - RNA, 19 nt, Homo sapiens
caaagcacuggaacucaua

SEQ ID NO: 336925 - RNA, 19 nt, Homo sapiens
gcaggaaggcugugagaag

SEQ ID NO: 336926 - RNA, 19 nt, Homo sapiens
ucaaagcacuggaacucau

SEQ ID NO: 336927 - RNA, 19 nt, Homo sapiens
ggauagauacggccugugu

SEQ ID NO: 336928 - RNA, 19 nt, Homo sapiens
uaccacgacucacaccuuu

SEQ ID NO: 336929 - RNA, 19 nt, Homo sapiens
aggacugcaugguaauuua

SEQ ID NO: 336930 - RNA, 19 nt, Homo sapiens
gaggugaacauuaacaaca

SEQ ID NO: 336931 - RNA, 19 nt, Homo sapiens
ggacugcaugguaauuuau

SEQ ID NO: 336932 - RNA, 19 nt, Homo sapiens
ggagcaagcggucaucauc

SEQ ID NO: 336933 - RNA, 19 nt, Homo sapiens
acacucugaucacagcuuu

SEQ ID NO: 336934 - RNA, 19 nt, Homo sapiens
ugaggugcauagcguaaug

SEQ ID NO: 336935 - RNA, 19 nt, Homo sapiens
gggagcagcuuucuauccu

SEQ ID NO: 336936 - RNA, 19 nt, Homo sapiens
gagaggugaacauuaacaa

SEQ ID NO: 336937 - RNA, 19 nt, Homo sapiens
uuauaaggacugcauggua

SEQ ID NO: 336938 - RNA, 19 nt, Homo sapiens
acaguguauucaaacagua

SEQ ID NO: 336939 - RNA, 19 nt, Homo sapiens
ggagaggugaacauuaaca

SEQ ID NO: 336940 - RNA, 19 nt, Homo sapiens
guucuacacucugaucaca

SEQ ID NO: 336941 - RNA, 19 nt, Homo sapiens
ccacuggacuaaacuucag

SEQ ID NO: 336942 - RNA, 19 nt, Homo sapiens
ccacgacucacaccuuugu

SEQ ID NO: 336943 - RNA, 19 nt, Homo sapiens
ccaagugccgggacccaaa

SEQ ID NO: 336944 - RNA, 19 nt, Homo sapiens
gacugcaugguaauuuaua

SEQ ID NO: 336945 - RNA, 19 nt, Homo sapiens
ggacccaaaucccguugac

SEQ ID NO: 336946 - RNA, 19 nt, Homo sapiens
guaccacgacucacaccuu

SEQ ID NO: 336947 - RNA, 19 nt, Homo sapiens
acaacaguguauucaaaca

SEQ ID NO: 336948 - RNA, 19 nt, Homo sapiens
ggugaacauuaacaacagu

SEQ ID NO: 336949 - RNA, 19 nt, Homo sapiens
cucccuaccucaaccugua

SEQ ID NO: 336950 - RNA, 19 nt, Homo sapiens
cauauuguaccacgacuca

SEQ ID NO: 336951 - RNA, 19 nt, Homo sapiens
caucaucccaucccaucuu

SEQ ID NO: 336952 - RNA, 19 nt, Homo sapiens
ccaagggagcagcuuucua

SEQ ID NO: 336953 - RNA, 19 nt, Homo sapiens
gcgaauucucgguguguga

SEQ ID NO: 336954 - RNA, 19 nt, Homo sapiens
ccgugaagcugcagacacu

SEQ ID NO: 336955 - RNA, 19 nt, Homo sapiens
uaaggacugcaugguaauu

SEQ ID NO: 336956 - RNA, 19 nt, Homo sapiens
ccucaaccuguaaauuauu

SEQ ID NO: 336957 - RNA, 19 nt, Homo sapiens
cgacucacaccuuugucaa

SEQ ID NO: 336958 - RNA, 19 nt, Homo sapiens
gaccaccgccacagacauc

SEQ ID NO: 336959 - RNA, 19 nt, Homo sapiens
uagcguaauguccauguug

SEQ ID NO: 336960 - RNA, 19 nt, Homo sapiens
cagcguccggacccaauaa

SEQ ID NO: 336961 - RNA, 19 nt, Homo sapiens
aacaguguauucaaacagu

SEQ ID NO: 336962 - RNA, 19 nt, Homo sapiens
cauuaacaacaguguauuc

SEQ ID NO: 336963 - RNA, 19 nt, Homo sapiens
cucaggaucuggacuucga

SEQ ID NO: 336964 - RNA, 19 nt, Homo sapiens
caacaguguauucaaacag

SEQ ID NO: 336965 - RNA, 19 nt, Homo sapiens
cuaccucaaccuguaaauu

SEQ ID NO: 336966 - RNA, 19 nt, Homo sapiens
gaauugacuucgacuguga

SEQ ID NO: 336967 - RNA, 19 nt, Homo sapiens
guaaauggcaauucuuuga

SEQ ID NO: 336968 - RNA, 19 nt, Homo sapiens
uaggagcacuguaguaaau

SEQ ID NO: 336969 - RNA, 19 nt, Homo sapiens
cacagcaggugucauauau

SEQ ID NO: 336970 - RNA, 19 nt, Homo sapiens
gcaccgccuucucuaaaug

SEQ ID NO: 336971 - RNA, 19 nt, Homo sapiens
gagucuggguguauuuauu

SEQ ID NO: 336972 - RNA, 19 nt, Homo sapiens
ccacagcaggugucauaua

SEQ ID NO: 336973 - RNA, 19 nt, Homo sapiens
gagcacauagacuccuuua

SEQ ID NO: 336974 - RNA, 19 nt, Homo sapiens
cagcaggugucauauaugg

SEQ ID NO: 336975 - RNA, 19 nt, Homo sapiens
cauccuggcugcugugguu

SEQ ID NO: 336976 - RNA, 19 nt, Homo sapiens
ccuagggccugguccauga

SEQ ID NO: 336977 - RNA, 19 nt, Homo sapiens
gccauggacucuacacugu

SEQ ID NO: 336978 - RNA, 19 nt, Homo sapiens
gagagucugugcagugagu

SEQ ID NO: 336979 - RNA, 19 nt, Homo sapiens
cauggacucuacacuguga

SEQ ID NO: 336980 - RNA, 19 nt, Homo sapiens
gcacauagacuccuuuacc

SEQ ID NO: 336981 - RNA, 19 nt, Homo sapiens
gggaggagguggagaagcu

SEQ ID NO: 336982 - RNA, 19 nt, Homo sapiens
ccugaaacuuacacacaaa

SEQ ID NO: 336983 - RNA, 19 nt, Homo sapiens
ucccuggccuguucuguuu

SEQ ID NO: 336984 - RNA, 19 nt, Homo sapiens
ggagcacuguaguaaaugg

SEQ ID NO: 336985 - RNA, 19 nt, Homo sapiens
gcuuacacguggaggaaug

SEQ ID NO: 336986 - RNA, 19 nt, Homo sapiens
gcccaaagccagacagcaa

SEQ ID NO: 336987 - RNA, 19 nt, Homo sapiens
ccagggagaggccaugauu

SEQ ID NO: 336988 - RNA, 19 nt, Homo sapiens
cuccuugccuccuguguaa

SEQ ID NO: 336989 - RNA, 19 nt, Homo sapiens
uuugguggcuugcaaguau

SEQ ID NO: 336990 - RNA, 19 nt, Homo sapiens
ccaaccagaccguguguga

SEQ ID NO: 336991 - RNA, 19 nt, Homo sapiens
uguaguaaauggcaauucu

SEQ ID NO: 336992 - RNA, 19 nt, Homo sapiens
ccucaucccugucuauugc

SEQ ID NO: 336993 - RNA, 19 nt, Homo sapiens
ggaaugcggcaagaaggaa

SEQ ID NO: 336994 - RNA, 19 nt, Homo sapiens
cgacauggacccggagcua

SEQ ID NO: 336995 - RNA, 19 nt, Homo sapiens
gaggaucggaggcuuguca

SEQ ID NO: 336996 - RNA, 19 nt, Homo sapiens
cguuaagugaugaacauua

SEQ ID NO: 336997 - RNA, 19 nt, Homo sapiens
ggcaccgccuucucuaaau

SEQ ID NO: 336998 - RNA, 19 nt, Homo sapiens
uggagagucugugcaguga

SEQ ID NO: 336999 - RNA, 19 nt, Homo sapiens
acucuacacugugaacuug

SEQ ID NO: 337000 - RNA, 19 nt, Homo sapiens
ccuguguaaucauuucuug

SEQ ID NO: 337001 - RNA, 19 nt, Homo sapiens
acacacaggaggagaaauc

SEQ ID NO: 337002 - RNA, 19 nt, Homo sapiens
gacauggacccggagcuaa

SEQ ID NO: 337003 - RNA, 19 nt, Homo sapiens
uagacuccuuuacccauga

SEQ ID NO: 337004 - RNA, 19 nt, Homo sapiens
cacaaaacguuaagugaug

SEQ ID NO: 337005 - RNA, 19 nt, Homo sapiens
gggaaugcggcaagaagga

SEQ ID NO: 337006 - RNA, 19 nt, Homo sapiens
caaccucaucccugucuau

SEQ ID NO: 337007 - RNA, 19 nt, Homo sapiens
gagaagcaucggagggaau

SEQ ID NO: 337008 - RNA, 19 nt, Homo sapiens
caugauggagucagguuug

SEQ ID NO: 337009 - RNA, 19 nt, Homo sapiens
guaguaaauggcaauucuu

SEQ ID NO: 337010 - RNA, 19 nt, Homo sapiens
uggcaccgccuucucuaaa

SEQ ID NO: 337011 - RNA, 19 nt, Homo sapiens
agccuaagaugaagaggau

SEQ ID NO: 337012 - RNA, 19 nt, Homo sapiens
agucuggguguauuuauuu

SEQ ID NO: 337013 - RNA, 19 nt, Homo sapiens
gggcugagacuggauacug

SEQ ID NO: 337014 - RNA, 19 nt, Homo sapiens
ggccaugauucgcccaaag

SEQ ID NO: 337015 - RNA, 19 nt, Homo sapiens
gggacuaggagcacuguag

SEQ ID NO: 337016 - RNA, 19 nt, Homo sapiens
ggauuucucccagcucuag

SEQ ID NO: 337017 - RNA, 19 nt, Homo sapiens
gggcuuacacguggaggaa

SEQ ID NO: 337018 - RNA, 19 nt, Homo sapiens
gcaugccugugugacauca

SEQ ID NO: 337019 - RNA, 19 nt, Homo sapiens
uccugaaacuuacacacaa

SEQ ID NO: 337020 - RNA, 19 nt, Homo sapiens
cccuugagcugagauggaa

SEQ ID NO: 337021 - RNA, 19 nt, Homo sapiens
uuccugagcuuggccagaa

SEQ ID NO: 337022 - RNA, 19 nt, Homo sapiens
ucacuuuucuccaugaguu

SEQ ID NO: 337023 - RNA, 19 nt, Homo sapiens
cuaccagcccgagcacaua

SEQ ID NO: 337024 - RNA, 19 nt, Homo sapiens
aacguuaagugaugaacau

SEQ ID NO: 337025 - RNA, 19 nt, Homo sapiens
gaaugcggcaagaaggaau

SEQ ID NO: 337026 - RNA, 19 nt, Homo sapiens
uccagaacaagaccucaua

SEQ ID NO: 337027 - RNA, 19 nt, Homo sapiens
ucugggaaauggcuugaag

SEQ ID NO: 337028 - RNA, 19 nt, Homo sapiens
cacacuuccuguccagaga

SEQ ID NO: 337029 - RNA, 19 nt, Homo sapiens
uagcauguguuugguucug

SEQ ID NO: 337030 - RNA, 19 nt, Homo sapiens
cuaggagcacuguaguaaa

SEQ ID NO: 337031 - RNA, 19 nt, Homo sapiens
ucacuucugaccacacuuc

SEQ ID NO: 337032 - RNA, 19 nt, Homo sapiens
gugaugaacauuaaauagc

SEQ ID NO: 337033 - RNA, 19 nt, Homo sapiens
ccuccuguguaaucauuuc

SEQ ID NO: 337034 - RNA, 19 nt, Homo sapiens
ugccuccuguguaaucauu

SEQ ID NO: 337035 - RNA, 19 nt, Homo sapiens
caaguauguuuuagcaugu

SEQ ID NO: 337036 - RNA, 19 nt, Homo sapiens
ggcaagaaggaauugacuu

SEQ ID NO: 337037 - RNA, 19 nt, Homo sapiens
ccagucugcugcccuccau

SEQ ID NO: 337038 - RNA, 19 nt, Homo sapiens
cuagaaagcuggucacuaa

SEQ ID NO: 337039 - RNA, 19 nt, Homo sapiens
aaaccuagauuccggauua

SEQ ID NO: 337040 - RNA, 19 nt, Homo sapiens
ggaaagaccugcagcaucu

SEQ ID NO: 337041 - RNA, 19 nt, Homo sapiens
ccucagaucuuacuuggua

SEQ ID NO: 337042 - RNA, 19 nt, Homo sapiens
auacagaccucagaucuua

SEQ ID NO: 337043 - RNA, 19 nt, Homo sapiens
gggaugggcugucagaauu

SEQ ID NO: 337044 - RNA, 19 nt, Homo sapiens
caaggaggaugcccaauug

SEQ ID NO: 337045 - RNA, 19 nt, Homo sapiens
acaagaagcucuccaagau

SEQ ID NO: 337046 - RNA, 19 nt, Homo sapiens
gaaagcuggucacuaacuu

SEQ ID NO: 337047 - RNA, 19 nt, Homo sapiens
acuccuagcucuacaagua

SEQ ID NO: 337048 - RNA, 19 nt, Homo sapiens
cccuaggacuuacuuauua

SEQ ID NO: 337049 - RNA, 19 nt, Homo sapiens
gcaaggaggaugcccaauu

SEQ ID NO: 337050 - RNA, 19 nt, Homo sapiens
caaacagcccggaguauuu

SEQ ID NO: 337051 - RNA, 19 nt, Homo sapiens
aagaagcucuccaagauug

SEQ ID NO: 337052 - RNA, 19 nt, Homo sapiens
gaaccugcauagaagaaau

SEQ ID NO: 337053 - RNA, 19 nt, Homo sapiens
gcccagcugugcagaauug

SEQ ID NO: 337054 - RNA, 19 nt, Homo sapiens
caagcucucucacugaaug

SEQ ID NO: 337055 - RNA, 19 nt, Homo sapiens
ggaggaugcccaauuguug

SEQ ID NO: 337056 - RNA, 19 nt, Homo sapiens
gacaagaagcucuccaaga

SEQ ID NO: 337057 - RNA, 19 nt, Homo sapiens
gcagacggaugagccuuga

SEQ ID NO: 337058 - RNA, 19 nt, Homo sapiens
ggucagcaguggaaugaag

SEQ ID NO: 337059 - RNA, 19 nt, Homo sapiens
gcagaauuguuugcuagug

SEQ ID NO: 337060 - RNA, 19 nt, Homo sapiens
uaacuuugcagacggauga

SEQ ID NO: 337061 - RNA, 19 nt, Homo sapiens
uagaagaaaugaacucacu

SEQ ID NO: 337062 - RNA, 19 nt, Homo sapiens
ccaaacagcccggaguauu

SEQ ID NO: 337063 - RNA, 19 nt, Homo sapiens
cagaauuguuugcuagugu

SEQ ID NO: 337064 - RNA, 19 nt, Homo sapiens
caagaagcucuccaagauu

SEQ ID NO: 337065 - RNA, 19 nt, Homo sapiens
gaacucacugcauuucugu

SEQ ID NO: 337066 - RNA, 19 nt, Homo sapiens
ccucagcuguguauccuau

SEQ ID NO: 337067 - RNA, 19 nt, Homo sapiens
uuccaccgcucacugcuua

SEQ ID NO: 337068 - RNA, 19 nt, Homo sapiens
ucaugaugcucaacucaga

SEQ ID NO: 337069 - RNA, 19 nt, Homo sapiens
gcuauuuauugccgaguug

SEQ ID NO: 337070 - RNA, 19 nt, Homo sapiens
ugagugccuugcccucuuu

SEQ ID NO: 337071 - RNA, 19 nt, Homo sapiens
gcacauacagaccucagau

SEQ ID NO: 337072 - RNA, 19 nt, Homo sapiens
cagcugugcagaauuguuu

SEQ ID NO: 337073 - RNA, 19 nt, Homo sapiens
cuuagaaccugcauagaag

SEQ ID NO: 337074 - RNA, 19 nt, Homo sapiens
gcccuaggacuuacuuauu

SEQ ID NO: 337075 - RNA, 19 nt, Homo sapiens
ccuuagaaccugcauagaa

SEQ ID NO: 337076 - RNA, 19 nt, Homo sapiens
ccacaucucacuucugcuu

SEQ ID NO: 337077 - RNA, 19 nt, Homo sapiens
ugaacucacugcauuucug

SEQ ID NO: 337078 - RNA, 19 nt, Homo sapiens
cucaguagcugggaauuau

SEQ ID NO: 337079 - RNA, 19 nt, Homo sapiens
cccaagcucucucacugaa

SEQ ID NO: 337080 - RNA, 19 nt, Homo sapiens
uauccuaucuguucuagcu

SEQ ID NO: 337081 - RNA, 19 nt, Homo sapiens
uggaauccuugcuggcuuu

SEQ ID NO: 337082 - RNA, 19 nt, Homo sapiens
acauaucucugugugauuc

SEQ ID NO: 337083 - RNA, 19 nt, Homo sapiens
aaacagcccggaguauuug

SEQ ID NO: 337084 - RNA, 19 nt, Homo sapiens
ugagcuauuuggcuacuuc

SEQ ID NO: 337085 - RNA, 19 nt, Homo sapiens
gugagugccuugcccucuu

SEQ ID NO: 337086 - RNA, 19 nt, Homo sapiens
caacuccugguguguguga

SEQ ID NO: 337087 - RNA, 19 nt, Homo sapiens
ccuccucccucgcaccaaa

SEQ ID NO: 337088 - RNA, 19 nt, Homo sapiens
gcuggucacuaacuuugca

SEQ ID NO: 337089 - RNA, 19 nt, Homo sapiens
gaggaaggcugggguuaga

SEQ ID NO: 337090 - RNA, 19 nt, Homo sapiens
ccuuauaccuuggcaugga

SEQ ID NO: 337091 - RNA, 19 nt, Homo sapiens
uccuagcucuacaaguaua

SEQ ID NO: 337092 - RNA, 19 nt, Homo sapiens
ccaaacuccuagcucuaca

SEQ ID NO: 337093 - RNA, 19 nt, Homo sapiens
ggccuuagaaccugcauag

SEQ ID NO: 337094 - RNA, 19 nt, Homo sapiens
ggaauccuugcuggcuuua

SEQ ID NO: 337095 - RNA, 19 nt, Homo sapiens
ggucccaucugccucuuuu

SEQ ID NO: 337096 - RNA, 19 nt, Homo sapiens
ggauguccuuccucaacuc

SEQ ID NO: 337097 - RNA, 19 nt, Homo sapiens
ccucccugcuuacgccuuu

SEQ ID NO: 337098 - RNA, 19 nt, Homo sapiens
uagcugggaauuauggaaa

SEQ ID NO: 337099 - RNA, 19 nt, Homo sapiens
ucucaguagcugggaauua

SEQ ID NO: 337100 - RNA, 19 nt, Homo sapiens
ggaugggcugucagaauug

SEQ ID NO: 337101 - RNA, 19 nt, Homo sapiens
gaccauggaacccugaagu

SEQ ID NO: 337102 - RNA, 19 nt, Homo sapiens
cugcuuacgccuuuccuuu

SEQ ID NO: 337103 - RNA, 19 nt, Homo sapiens
gcauagaagaaaugaacuc

SEQ ID NO: 337104 - RNA, 19 nt, Homo sapiens
uagugugguugguauggaa

SEQ ID NO: 337105 - RNA, 19 nt, Homo sapiens
ccuaggacuuacuuauuac

SEQ ID NO: 337106 - RNA, 19 nt, Homo sapiens
gcaccucgagggcuauucu

SEQ ID NO: 337107 - RNA, 19 nt, Homo sapiens
cuugcuuccucccugcuua

SEQ ID NO: 337108 - RNA, 19 nt, Homo sapiens
caccaaacuccuagcucua

SEQ ID NO: 337109 - RNA, 19 nt, Homo sapiens
ucacuucugcuuccucauc

SEQ ID NO: 337110 - RNA, 19 nt, Homo sapiens
gcccggaguauuugcagaa

SEQ ID NO: 337111 - RNA, 19 nt, Homo sapiens
uggccaagcccaccacuuc

SEQ ID NO: 337112 - RNA, 19 nt, Homo sapiens
cauacagaccucagaucuu

SEQ ID NO: 337113 - RNA, 19 nt, Homo sapiens
ugugcagaauuguuugcua

SEQ ID NO: 337114 - RNA, 19 nt, Homo sapiens
ugugugagcaugcccuuug

SEQ ID NO: 337115 - RNA, 19 nt, Homo sapiens
gcgccuggccaucugcuau

SEQ ID NO: 337116 - RNA, 19 nt, Homo sapiens
agaaaugaacucacugcau

SEQ ID NO: 337117 - RNA, 19 nt, Homo sapiens
cauagaagaaaugaacuca

SEQ ID NO: 337118 - RNA, 19 nt, Homo sapiens
uagaaccugcauagaagaa

SEQ ID NO: 337119 - RNA, 19 nt, Homo sapiens
gaccucagcuguguauccu

SEQ ID NO: 337120 - RNA, 19 nt, Homo sapiens
uaagccagccacacuugga

SEQ ID NO: 337121 - RNA, 19 nt, Homo sapiens
caaacuccuagcucuacaa

SEQ ID NO: 337122 - RNA, 19 nt, Homo sapiens
aaagaccugcagcaucuga

SEQ ID NO: 337123 - RNA, 19 nt, Homo sapiens
ggcccuaggacuuacuuau

SEQ ID NO: 337124 - RNA, 19 nt, Homo sapiens
ugaaugcugccucuucuac

SEQ ID NO: 337125 - RNA, 19 nt, Homo sapiens
uuacuaagccagccacacu

SEQ ID NO: 337126 - RNA, 19 nt, Homo sapiens
uugcuagugugguugguau

SEQ ID NO: 337127 - RNA, 19 nt, Homo sapiens
acaagaagcucuccaagau

SEQ ID NO: 337128 - RNA, 19 nt, Homo sapiens
gacaagaagcucuccaaga

SEQ ID NO: 337129 - RNA, 19 nt, Homo sapiens
ucgccgagcuccgcaaauu

SEQ ID NO: 337130 - RNA, 19 nt, Homo sapiens
ggaccaagcagcagauucg

SEQ ID NO: 337131 - RNA, 19 nt, Homo sapiens
cuacaucuccuaucucaac

SEQ ID NO: 337132 - RNA, 19 nt, Homo sapiens
caagaagcucuccaagauc

SEQ ID NO: 337133 - RNA, 19 nt, Homo sapiens
ugcuacaucuccuaucuca

SEQ ID NO: 337134 - RNA, 19 nt, Homo sapiens
ucugcuacaucuccuaucu

SEQ ID NO: 337135 - RNA, 19 nt, Homo sapiens
cagcuacucucuauuguua

SEQ ID NO: 337136 - RNA, 19 nt, Homo sapiens
gagguuguguaucauauua

SEQ ID NO: 337137 - RNA, 19 nt, Homo sapiens
ggaagcauguguucuguga

SEQ ID NO: 337138 - RNA, 19 nt, Homo sapiens
gcuacucucuauuguuaua

SEQ ID NO: 337139 - RNA, 19 nt, Homo sapiens
gaaugugcccuacguguuu

SEQ ID NO: 337140 - RNA, 19 nt, Homo sapiens
guaaugugauguugauguu

SEQ ID NO: 337141 - RNA, 19 nt, Homo sapiens
gcaagagacuaccaagaca

SEQ ID NO: 337142 - RNA, 19 nt, Homo sapiens
gcagaaagagccaggagaa

SEQ ID NO: 337143 - RNA, 19 nt, Homo sapiens
gaaugggacuuucuuuggu

SEQ ID NO: 337144 - RNA, 19 nt, Homo sapiens
cagcagucauguaacuaua

SEQ ID NO: 337145 - RNA, 19 nt, Homo sapiens
caagugucguuuacuaaug

SEQ ID NO: 337146 - RNA, 19 nt, Homo sapiens
gggauuagguaucauuugg

SEQ ID NO: 337147 - RNA, 19 nt, Homo sapiens
cauauuaucuguguuagca

SEQ ID NO: 337148 - RNA, 19 nt, Homo sapiens
guucauguguucuccauuc

SEQ ID NO: 337149 - RNA, 19 nt, Homo sapiens
guccaagugucguuuacua

SEQ ID NO: 337150 - RNA, 19 nt, Homo sapiens
uaaacagcauucauugugu

SEQ ID NO: 337151 - RNA, 19 nt, Homo sapiens
gaaagagucgggagugaca

SEQ ID NO: 337152 - RNA, 19 nt, Homo sapiens
guguuagcauguaguauuu

SEQ ID NO: 337153 - RNA, 19 nt, Homo sapiens
uugaaaggcucuuagucua

SEQ ID NO: 337154 - RNA, 19 nt, Homo sapiens
gccacuagcuuccuguugu

SEQ ID NO: 337155 - RNA, 19 nt, Homo sapiens
agacagacgcuaugacuga

SEQ ID NO: 337156 - RNA, 19 nt, Homo sapiens
gacugaggcugaugugaau

SEQ ID NO: 337157 - RNA, 19 nt, Homo sapiens
ggaggaagcauguguucug

SEQ ID NO: 337158 - RNA, 19 nt, Homo sapiens
gggcaucucugaguucauc

SEQ ID NO: 337159 - RNA, 19 nt, Homo sapiens
gcagucauguaacuauaag

SEQ ID NO: 337160 - RNA, 19 nt, Homo sapiens
cuugugagcauccuaauaa

SEQ ID NO: 337161 - RNA, 19 nt, Homo sapiens
cauguguucuccauucuug

SEQ ID NO: 337162 - RNA, 19 nt, Homo sapiens
cagagagcaugaacugaug

SEQ ID NO: 337163 - RNA, 19 nt, Homo sapiens
cagcagauccaauccauuc

SEQ ID NO: 337164 - RNA, 19 nt, Homo sapiens
ugaaacagcagauccaauc

SEQ ID NO: 337165 - RNA, 19 nt, Homo sapiens
gaggaagcauguguucugu

SEQ ID NO: 337166 - RNA, 19 nt, Homo sapiens
uguacucucugucacauga

SEQ ID NO: 337167 - RNA, 19 nt, Homo sapiens
ggagugacaagcucagaga

SEQ ID NO: 337168 - RNA, 19 nt, Homo sapiens
ugacugaggcugaugugaa

SEQ ID NO: 337169 - RNA, 19 nt, Homo sapiens
gaaagagccaggagaaagc

SEQ ID NO: 337170 - RNA, 19 nt, Homo sapiens
ccacaaccaugcccuugag

SEQ ID NO: 337171 - RNA, 19 nt, Homo sapiens
uuaaacagcauucauugug

SEQ ID NO: 337172 - RNA, 19 nt, Homo sapiens
guucagcagucauguaacu

SEQ ID NO: 337173 - RNA, 19 nt, Homo sapiens
ggaccucguucagcaguca

SEQ ID NO: 337174 - RNA, 19 nt, Homo sapiens
gugagcauccuaauaaauc

SEQ ID NO: 337175 - RNA, 19 nt, Homo sapiens
ggcagcagcauaccaaaga

SEQ ID NO: 337176 - RNA, 19 nt, Homo sapiens
aggcugaugugaauccaaa

SEQ ID NO: 337177 - RNA, 19 nt, Homo sapiens
guucggcuauguccaagug

SEQ ID NO: 337178 - RNA, 19 nt, Homo sapiens
auucauacguguucaagug

SEQ ID NO: 337179 - RNA, 19 nt, Homo sapiens
ccacuagcuuccuguugug

SEQ ID NO: 337180 - RNA, 19 nt, Homo sapiens
ccauucagcaguccauuga

SEQ ID NO: 337181 - RNA, 19 nt, Homo sapiens
gguaaugugauguugaugu

SEQ ID NO: 337182 - RNA, 19 nt, Homo sapiens
gguuguguaucauauuauc

SEQ ID NO: 337183 - RNA, 19 nt, Homo sapiens
acaagaaugugcccuacgu

SEQ ID NO: 337184 - RNA, 19 nt, Homo sapiens
ccaagugucguuuacuaau

SEQ ID NO: 337185 - RNA, 19 nt, Homo sapiens
caagacagacgcuaugacu

SEQ ID NO: 337186 - RNA, 19 nt, Homo sapiens
ccuaauaaaucuguuccau

SEQ ID NO: 337187 - RNA, 19 nt, Homo sapiens
gugaaugggacuuucuuug

SEQ ID NO: 337188 - RNA, 19 nt, Homo sapiens
uguguuagcauguaguauu

SEQ ID NO: 337189 - RNA, 19 nt, Homo sapiens
ugaaugggacuuucuuugg

SEQ ID NO: 337190 - RNA, 19 nt, Homo sapiens
gaagcuacuggaccucguu

SEQ ID NO: 337191 - RNA, 19 nt, Homo sapiens
caaaccgacacgcguggua

SEQ ID NO: 337192 - RNA, 19 nt, Homo sapiens
ggcaagagacuaccaagac

SEQ ID NO: 337193 - RNA, 19 nt, Homo sapiens
gauggagccaggacagaga

SEQ ID NO: 337194 - RNA, 19 nt, Homo sapiens
gcagcagcauaccaaagag

SEQ ID NO: 337195 - RNA, 19 nt, Homo sapiens
gaucaagggguuucauuug

SEQ ID NO: 337196 - RNA, 19 nt, Homo sapiens
ggugaaugggacuuucuuu

SEQ ID NO: 337197 - RNA, 19 nt, Homo sapiens
agaaagagccaggagaaag

SEQ ID NO: 337198 - RNA, 19 nt, Homo sapiens
cagaaagagccaggagaaa

SEQ ID NO: 337199 - RNA, 19 nt, Homo sapiens
uuucagcuacucucuauug

SEQ ID NO: 337200 - RNA, 19 nt, Homo sapiens
uuucuuugguggacacuug

SEQ ID NO: 337201 - RNA, 19 nt, Homo sapiens
gccugucucuggugaaugg

SEQ ID NO: 337202 - RNA, 19 nt, Homo sapiens
guagcagggcagcagcaua

SEQ ID NO: 337203 - RNA, 19 nt, Homo sapiens
aagugucguuuacuaaugu

SEQ ID NO: 337204 - RNA, 19 nt, Homo sapiens
ucucugaguucaucgugau

SEQ ID NO: 337205 - RNA, 19 nt, Homo sapiens
cagccugucucuggugaau

SEQ ID NO: 337206 - RNA, 19 nt, Homo sapiens
aaugugauguugauguucu

SEQ ID NO: 337207 - RNA, 19 nt, Homo sapiens
gcauguguucugugagguu

SEQ ID NO: 337208 - RNA, 19 nt, Homo sapiens
agaaugugcccuacguguu

SEQ ID NO: 337209 - RNA, 19 nt, Homo sapiens
cugagguuguguaucauau

SEQ ID NO: 337210 - RNA, 19 nt, Homo sapiens
ugagcauccuaauaaaucu

SEQ ID NO: 337211 - RNA, 19 nt, Homo sapiens
cagcauaccaaagagaugu

SEQ ID NO: 337212 - RNA, 19 nt, Homo sapiens
gcagcauaccaaagagaug

SEQ ID NO: 337213 - RNA, 19 nt, Homo sapiens
uagcagggcagcagcauac

SEQ ID NO: 337214 - RNA, 19 nt, Homo sapiens
cugccauccuucauccuuu

SEQ ID NO: 337215 - RNA, 19 nt, Homo sapiens
ucagcagucauguaacuau

SEQ ID NO: 337216 - RNA, 19 nt, Homo sapiens
uugaaagagucgggaguga

SEQ ID NO: 337217 - RNA, 19 nt, Homo sapiens
ucguucagcagucauguaa

SEQ ID NO: 337218 - RNA, 19 nt, Homo sapiens
ccugagguuguguaucaua

SEQ ID NO: 337219 - RNA, 19 nt, Homo sapiens
cuaccaagacagacgcuau

SEQ ID NO: 337220 - RNA, 19 nt, Homo sapiens
gcugcugugugaagacaag

SEQ ID NO: 337221 - RNA, 19 nt, Homo sapiens
cauggagaccuggcuggua

SEQ ID NO: 337222 - RNA, 19 nt, Homo sapiens
cauguaguauuuucagcua

SEQ ID NO: 337223 - RNA, 19 nt, Homo sapiens
guucugucaccaucaaaga

SEQ ID NO: 337224 - RNA, 19 nt, Homo sapiens
ugggucagauguacucucu

SEQ ID NO: 337225 - RNA, 19 nt, Homo sapiens
ccaugugggucagauguac

SEQ ID NO: 337226 - RNA, 19 nt, Homo sapiens
uugguaaugugauguugau

SEQ ID NO: 337227 - RNA, 19 nt, Homo sapiens
cauacguguucaagugauc

SEQ ID NO: 337228 - RNA, 19 nt, Homo sapiens
uaucuguguuagcauguag

SEQ ID NO: 337229 - RNA, 19 nt, Homo sapiens
caacggagcuuauaacaua

SEQ ID NO: 337230 - RNA, 19 nt, Homo sapiens
gaacagaaccucccaaauu

SEQ ID NO: 337231 - RNA, 19 nt, Homo sapiens
gggcgaaccugcuaugaua

SEQ ID NO: 337232 - RNA, 19 nt, Homo sapiens
acacugaccuccacucuua

SEQ ID NO: 337233 - RNA, 19 nt, Homo sapiens
gcacugaugucccuccuuu

SEQ ID NO: 337234 - RNA, 19 nt, Homo sapiens
gaacggaaaugaagacaag

SEQ ID NO: 337235 - RNA, 19 nt, Homo sapiens
gaagaugaauuccgugguu

SEQ ID NO: 337236 - RNA, 19 nt, Homo sapiens
gcucugaauuucuucuuua

SEQ ID NO: 337237 - RNA, 19 nt, Homo sapiens
agacaagagugccuuauuu

SEQ ID NO: 337238 - RNA, 19 nt, Homo sapiens
ggaaauaccaugaggaaga

SEQ ID NO: 337239 - RNA, 19 nt, Homo sapiens
acacggagcuguaccacua

SEQ ID NO: 337240 - RNA, 19 nt, Homo sapiens
gcuaugauauugaugaaug

SEQ ID NO: 337241 - RNA, 19 nt, Homo sapiens
gauugaaacuuccuacaug

SEQ ID NO: 337242 - RNA, 19 nt, Homo sapiens
aacagaaccucccaaauuu

SEQ ID NO: 337243 - RNA, 19 nt, Homo sapiens
uaaccuggaucgaauagaa

SEQ ID NO: 337244 - RNA, 19 nt, Homo sapiens
gaagguuuauuaucgagaa

SEQ ID NO: 337245 - RNA, 19 nt, Homo sapiens
cagcaacacucuacuugaa

SEQ ID NO: 337246 - RNA, 19 nt, Homo sapiens
gagccaaccaccaucauua

SEQ ID NO: 337247 - RNA, 19 nt, Homo sapiens
ggaagaaucuguauuucac

SEQ ID NO: 337248 - RNA, 19 nt, Homo sapiens
gcaguaggauauuggcauu

SEQ ID NO: 337249 - RNA, 19 nt, Homo sapiens
ccagauagaaugucaauau

SEQ ID NO: 337250 - RNA, 19 nt, Homo sapiens
gcaacuugguccagauuga

SEQ ID NO: 337251 - RNA, 19 nt, Homo sapiens
gacagggaaucaauugaaa

SEQ ID NO: 337252 - RNA, 19 nt, Homo sapiens
guaggaauuucaaggugua

SEQ ID NO: 337253 - RNA, 19 nt, Homo sapiens
gcacuucgaugcguucuca

SEQ ID NO: 337254 - RNA, 19 nt, Homo sapiens
ggagacggaugcuuuccaa

SEQ ID NO: 337255 - RNA, 19 nt, Homo sapiens
gcagcacccucaggucaua

SEQ ID NO: 337256 - RNA, 19 nt, Homo sapiens
ccaaggagacggaugcuuu

SEQ ID NO: 337257 - RNA, 19 nt, Homo sapiens
gaauagaaguggcgaagcu

SEQ ID NO: 337258 - RNA, 19 nt, Homo sapiens
gaaacuggccuucauaacu

SEQ ID NO: 337259 - RNA, 19 nt, Homo sapiens
cauacgacauucucaaaga

SEQ ID NO: 337260 - RNA, 19 nt, Homo sapiens
guucuagccuccucugauu

SEQ ID NO: 337261 - RNA, 19 nt, Homo sapiens
ggaguuaaggaggaaauua

SEQ ID NO: 337262 - RNA, 19 nt, Homo sapiens
aaacuggccuucauaacug

SEQ ID NO: 337263 - RNA, 19 nt, Homo sapiens
ggcauuugguggaugauaa

SEQ ID NO: 337264 - RNA, 19 nt, Homo sapiens
gcaccacgcccuucuccua

SEQ ID NO: 337265 - RNA, 19 nt, Homo sapiens
ccacaugacagaaccaauu

SEQ ID NO: 337266 - RNA, 19 nt, Homo sapiens
ccuccacucuuacguagua

SEQ ID NO: 337267 - RNA, 19 nt, Homo sapiens
gaagagcaacggagcuuau

SEQ ID NO: 337268 - RNA, 19 nt, Homo sapiens
cagaagguaucgcuguuga

SEQ ID NO: 337269 - RNA, 19 nt, Homo sapiens
gccaagauguagaugaaug

SEQ ID NO: 337270 - RNA, 19 nt, Homo sapiens
cgggcaaucuggucauuaa

SEQ ID NO: 337271 - RNA, 19 nt, Homo sapiens
ggccaagccugccaagaug

SEQ ID NO: 337272 - RNA, 19 nt, Homo sapiens
gcaaucuggucauuaagca

SEQ ID NO: 337273 - RNA, 19 nt, Homo sapiens
acccuggacuucucuaaua

SEQ ID NO: 337274 - RNA, 19 nt, Homo sapiens
gaagcaacuugguccagau

SEQ ID NO: 337275 - RNA, 19 nt, Homo sapiens
cuuauuuccuuuccaagua

SEQ ID NO: 337276 - RNA, 19 nt, Homo sapiens
cacacaaucugcaauaauc

SEQ ID NO: 337277 - RNA, 19 nt, Homo sapiens
cuucacgcaucuacacuua

SEQ ID NO: 337278 - RNA, 19 nt, Homo sapiens
aagaauggguucagcauca

SEQ ID NO: 337279 - RNA, 19 nt, Homo sapiens
aaaagaauguccaauggua

SEQ ID NO: 337280 - RNA, 19 nt, Homo sapiens
gauauuggcauuuguuagu

SEQ ID NO: 337281 - RNA, 19 nt, Homo sapiens
ccaauggacugcacuucga

SEQ ID NO: 337282 - RNA, 19 nt, Homo sapiens
ggacagacuggaacagaga

SEQ ID NO: 337283 - RNA, 19 nt, Homo sapiens
gaaauaccaugaggaagac

SEQ ID NO: 337284 - RNA, 19 nt, Homo sapiens
gagcaggacggauucaaga

SEQ ID NO: 337285 - RNA, 19 nt, Homo sapiens
ugaugaggaugaagauuau

SEQ ID NO: 337286 - RNA, 19 nt, Homo sapiens
gggcagaguaugaugauga

SEQ ID NO: 337287 - RNA, 19 nt, Homo sapiens
ggaugaaguugaggaaaca

SEQ ID NO: 337288 - RNA, 19 nt, Homo sapiens
gaaccaggucuuuccaguu

SEQ ID NO: 337289 - RNA, 19 nt, Homo sapiens
gaaccaauuuacacucaac

SEQ ID NO: 337290 - RNA, 19 nt, Homo sapiens
cagaaccaauuuacacuca

SEQ ID NO: 337291 - RNA, 19 nt, Homo sapiens
gagcucagccucgcuuuga

SEQ ID NO: 337292 - RNA, 19 nt, Homo sapiens
caaccaccaucauuagaca

SEQ ID NO: 337293 - RNA, 19 nt, Homo sapiens
ucauuggacuggccuuuga

SEQ ID NO: 337294 - RNA, 19 nt, Homo sapiens
aaccaggucuuuccaguug

SEQ ID NO: 337295 - RNA, 19 nt, Homo sapiens
ccaaguuccugccgugguu

SEQ ID NO: 337296 - RNA, 19 nt, Homo sapiens
gcgcggugguugucacuug

SEQ ID NO: 337297 - RNA, 19 nt, Homo sapiens
gggaagaaucuguauuuca

SEQ ID NO: 337298 - RNA, 19 nt, Homo sapiens
ucacugagccuuccauugg

SEQ ID NO: 337299 - RNA, 19 nt, Homo sapiens
ucagugggauucuuaugga

SEQ ID NO: 337300 - RNA, 19 nt, Homo sapiens
gcagggacccagaccagaa

SEQ ID NO: 337301 - RNA, 19 nt, Homo sapiens
cagaaccucccaaauuuga

SEQ ID NO: 337302 - RNA, 19 nt, Homo sapiens
gcacgagcgagaacacauu

SEQ ID NO: 337303 - RNA, 19 nt, Homo sapiens
gggaguacacggugacuga

SEQ ID NO: 337304 - RNA, 19 nt, Homo sapiens
gaaccugcuaugauauuga

SEQ ID NO: 337305 - RNA, 19 nt, Homo sapiens
gggaggugcugacacauac

SEQ ID NO: 337306 - RNA, 19 nt, Homo sapiens
gacaagagugccuuauuuc

SEQ ID NO: 337307 - RNA, 19 nt, Homo sapiens
gaagguaucgcuguugauc

SEQ ID NO: 337308 - RNA, 19 nt, Homo sapiens
gcuccuccgugcacauuga

SEQ ID NO: 337309 - RNA, 19 nt, Homo sapiens
ugacagggaaucaauugaa

SEQ ID NO: 337310 - RNA, 19 nt, Homo sapiens
ggaagagcaacggagcuua

SEQ ID NO: 337311 - RNA, 19 nt, Homo sapiens
ggucugcaguuccauacga

SEQ ID NO: 337312 - RNA, 19 nt, Homo sapiens
aauuuacacucaaccauga

SEQ ID NO: 337313 - RNA, 19 nt, Homo sapiens
aagagugccuuauuuccuu

SEQ ID NO: 337314 - RNA, 19 nt, Homo sapiens
gagauaaccccaagauuga

SEQ ID NO: 337315 - RNA, 19 nt, Homo sapiens
gaccagaaaggcaagagaa

SEQ ID NO: 337316 - RNA, 19 nt, Homo sapiens
ccaagguucuagucucugu

SEQ ID NO: 337317 - RNA, 19 nt, Homo sapiens
agacugaccuggugaaucc

SEQ ID NO: 337318 - RNA, 19 nt, Homo sapiens
gacagacucuaaccuggau

SEQ ID NO: 337319 - RNA, 19 nt, Homo sapiens
gccacacaaucugcaauaa

SEQ ID NO: 337320 - RNA, 19 nt, Homo sapiens
gacgugugcuaacaacaga

SEQ ID NO: 337321 - RNA, 19 nt, Homo sapiens
gaugaugucccaccacagu

SEQ ID NO: 337322 - RNA, 19 nt, Homo sapiens
uaggucagauauuugagaa

SEQ ID NO: 337323 - RNA, 19 nt, Homo sapiens
ugggagagcuagucuacau

SEQ ID NO: 337324 - RNA, 19 nt, Homo sapiens
gcgaaccugcuaugauauu

SEQ ID NO: 337325 - RNA, 19 nt, Homo sapiens
gaacacugaccuccacucu

SEQ ID NO: 337326 - RNA, 19 nt, Homo sapiens
ggaguuguuuucagcuaua

SEQ ID NO: 337327 - RNA, 19 nt, Homo sapiens
gaugugccuuaaauuauac

SEQ ID NO: 337328 - RNA, 19 nt, Homo sapiens
gagcagccccucccagaua

SEQ ID NO: 337329 - RNA, 19 nt, Homo sapiens
ccaucaacgugaaccauua

SEQ ID NO: 337330 - RNA, 19 nt, Homo sapiens
ggccguagaccuuguauau

SEQ ID NO: 337331 - RNA, 19 nt, Homo sapiens
caauaaagcccacgcucuu

SEQ ID NO: 337332 - RNA, 19 nt, Homo sapiens
ccguagaccuuguauauac

SEQ ID NO: 337333 - RNA, 19 nt, Homo sapiens
ggaggccacucuugucucu

SEQ ID NO: 337334 - RNA, 19 nt, Homo sapiens
gcugaaggccgucguggaa

SEQ ID NO: 337335 - RNA, 19 nt, Homo sapiens
ggccucaucugcaccaugu

SEQ ID NO: 337336 - RNA, 19 nt, Homo sapiens
ggacauuccagaaggacaa

SEQ ID NO: 337337 - RNA, 19 nt, Homo sapiens
guagucaacaucuucauca

SEQ ID NO: 337338 - RNA, 19 nt, Homo sapiens
ccacgggccugguguucau

SEQ ID NO: 337339 - RNA, 19 nt, Homo sapiens
gaugcugccugcccugcaa

SEQ ID NO: 337340 - RNA, 19 nt, Homo sapiens
ggaccagcccuugcucuga

SEQ ID NO: 337341 - RNA, 19 nt, Homo sapiens
ggagucgccauaccuguga

SEQ ID NO: 337342 - RNA, 19 nt, Homo sapiens
ucaaguacgaccuuaacaa

SEQ ID NO: 337343 - RNA, 19 nt, Homo sapiens
cugcucaucuuccuuguca

SEQ ID NO: 337344 - RNA, 19 nt, Homo sapiens
cagcuucgccuucuaugug

SEQ ID NO: 337345 - RNA, 19 nt, Homo sapiens
aagcuggacuuccucaaca

SEQ ID NO: 337346 - RNA, 19 nt, Homo sapiens
ugaaggccgucguggaaca

SEQ ID NO: 337347 - RNA, 19 nt, Homo sapiens
gagccagucaggccuguga

SEQ ID NO: 337348 - RNA, 19 nt, Homo sapiens
ucaggacauuccagaagga

SEQ ID NO: 337349 - RNA, 19 nt, Homo sapiens
gccguagaccuuguauaua

SEQ ID NO: 337350 - RNA, 19 nt, Homo sapiens
caaguacgaccuuaacaac

SEQ ID NO: 337351 - RNA, 19 nt, Homo sapiens
gcaggaggccacucuuguc

SEQ ID NO: 337352 - RNA, 19 nt, Homo sapiens
gcacccacuuuucuaauca

SEQ ID NO: 337353 - RNA, 19 nt, Homo sapiens
agagaccugugcccagaga

SEQ ID NO: 337354 - RNA, 19 nt, Homo sapiens
gcccagagggucagaacug

SEQ ID NO: 337355 - RNA, 19 nt, Homo sapiens
ccacuuuucuaaucaugaa

SEQ ID NO: 337356 - RNA, 19 nt, Homo sapiens
aggccacucuugucucuca

SEQ ID NO: 337357 - RNA, 19 nt, Homo sapiens
uuaacaacccggacaagca

SEQ ID NO: 337358 - RNA, 19 nt, Homo sapiens
cccagccucuguccacuuc

SEQ ID NO: 337359 - RNA, 19 nt, Homo sapiens
gguagucaacaucuucauc

SEQ ID NO: 337360 - RNA, 19 nt, Homo sapiens
ccaucaaccugaaccauua

SEQ ID NO: 337361 - RNA, 19 nt, Homo sapiens
cuaagggacuuccaucuug

SEQ ID NO: 337362 - RNA, 19 nt, Homo sapiens
caggagagcuucugaaagg

SEQ ID NO: 337363 - RNA, 19 nt, Homo sapiens
ccacagcaccugaguuaaa

SEQ ID NO: 337364 - RNA, 19 nt, Homo sapiens
caacgcagccaccaucuug

SEQ ID NO: 337365 - RNA, 19 nt, Homo sapiens
gaaaagcaguggcgacuca

SEQ ID NO: 337366 - RNA, 19 nt, Homo sapiens
ucacuguggucaucaaugu

SEQ ID NO: 337367 - RNA, 19 nt, Homo sapiens
gauggaaucagcaagagaa

SEQ ID NO: 337368 - RNA, 19 nt, Homo sapiens
ggacguggcccuguucaug

SEQ ID NO: 337369 - RNA, 19 nt, Homo sapiens
ggaccuaaguaaggcaugu

SEQ ID NO: 337370 - RNA, 19 nt, Homo sapiens
gaccauccucucauuacua

SEQ ID NO: 337371 - RNA, 19 nt, Homo sapiens
gagaaaacaucgaccuuca

SEQ ID NO: 337372 - RNA, 19 nt, Homo sapiens
ggaauccucucugaaugca

SEQ ID NO: 337373 - RNA, 19 nt, Homo sapiens
guaaggcaugucugucuaa

SEQ ID NO: 337374 - RNA, 19 nt, Homo sapiens
cagggaccauccucucauu

SEQ ID NO: 337375 - RNA, 19 nt, Homo sapiens
ggaccauccucucauuacu

SEQ ID NO: 337376 - RNA, 19 nt, Homo sapiens
cgagauggaaucagcaaga

SEQ ID NO: 337377 - RNA, 19 nt, Homo sapiens
gccagggccucaaggaauc

SEQ ID NO: 337378 - RNA, 19 nt, Homo sapiens
caguauagcugcccuugcu

SEQ ID NO: 337379 - RNA, 19 nt, Homo sapiens
gagauggaaucagcaagag

SEQ ID NO: 337380 - RNA, 19 nt, Homo sapiens
acccacagcaccugaguua

SEQ ID NO: 337381 - RNA, 19 nt, Homo sapiens
gcuuaaggaugcugguucu

SEQ ID NO: 337382 - RNA, 19 nt, Homo sapiens
aguaaggcaugucugucua

SEQ ID NO: 337383 - RNA, 19 nt, Homo sapiens
ccacagcccaggagagcuu

SEQ ID NO: 337384 - RNA, 19 nt, Homo sapiens
aaagguuucuucaaaucca

SEQ ID NO: 337385 - RNA, 19 nt, Homo sapiens
uugcacggcugaaccugaa

SEQ ID NO: 337386 - RNA, 19 nt, Homo sapiens
cuaaguaaggcaugucugu

SEQ ID NO: 337387 - RNA, 19 nt, Homo sapiens
cgacucaaccagcucaaca

SEQ ID NO: 337388 - RNA, 19 nt, Homo sapiens
gcacggcugaaccugaaug

SEQ ID NO: 337389 - RNA, 19 nt, Homo sapiens
gaugcugguucugacucua

SEQ ID NO: 337390 - RNA, 19 nt, Homo sapiens
uuaaggaugcugguucuga

SEQ ID NO: 337391 - RNA, 19 nt, Homo sapiens
caucugcuggaccuaagua

SEQ ID NO: 337392 - RNA, 19 nt, Homo sapiens
cuucugaaaggacaguaua

SEQ ID NO: 337393 - RNA, 19 nt, Homo sapiens
ugaaugagguagaaaagca

SEQ ID NO: 337394 - RNA, 19 nt, Homo sapiens
aaacaucgaccuucaaccu

SEQ ID NO: 337395 - RNA, 19 nt, Homo sapiens
gcagggaccauccucucau

SEQ ID NO: 337396 - RNA, 19 nt, Homo sapiens
gacguggcccuguucaugu

SEQ ID NO: 337397 - RNA, 19 nt, Homo sapiens
ggaugcugguucugacucu

SEQ ID NO: 337398 - RNA, 19 nt, Homo sapiens
ucuaagggacuuccaucuu

SEQ ID NO: 337399 - RNA, 19 nt, Homo sapiens
cccaggagagcuucugaaa

SEQ ID NO: 337400 - RNA, 19 nt, Homo sapiens
gaacuucugccuccuuccu

SEQ ID NO: 337401 - RNA, 19 nt, Homo sapiens
guacugccagccauaccuu

SEQ ID NO: 337402 - RNA, 19 nt, Homo sapiens
uaaggcaugucugucuaag

SEQ ID NO: 337403 - RNA, 19 nt, Homo sapiens
gccagcccaucaaccugaa

SEQ ID NO: 337404 - RNA, 19 nt, Homo sapiens
gggaccauccucucauuac

SEQ ID NO: 337405 - RNA, 19 nt, Homo sapiens
cccaucaaccugaaccauu

SEQ ID NO: 337406 - RNA, 19 nt, Homo sapiens
gagggcagcgagauggaau

SEQ ID NO: 337407 - RNA, 19 nt, Homo sapiens
gagcagagauacuuaccua

SEQ ID NO: 337408 - RNA, 19 nt, Homo sapiens
gagcagcacuggcauugaa

SEQ ID NO: 337409 - RNA, 19 nt, Homo sapiens
gaacacagaugggcugcuu

SEQ ID NO: 337410 - RNA, 19 nt, Homo sapiens
ucagaaagguggaauuuua

SEQ ID NO: 337411 - RNA, 19 nt, Homo sapiens
gagaagagagcaaguuaug

SEQ ID NO: 337412 - RNA, 19 nt, Homo sapiens
ccucaacucucaguacuuu

SEQ ID NO: 337413 - RNA, 19 nt, Homo sapiens
gaaacccagugcuauguag

SEQ ID NO: 337414 - RNA, 19 nt, Homo sapiens
ccggauaccucaacucuca

SEQ ID NO: 337415 - RNA, 19 nt, Homo sapiens
gacaagcaacagaacuuua

SEQ ID NO: 337416 - RNA, 19 nt, Homo sapiens
gaucggacccugcgaaugg

SEQ ID NO: 337417 - RNA, 19 nt, Homo sapiens
uaacaucgacgccagacaa

SEQ ID NO: 337418 - RNA, 19 nt, Homo sapiens
acaagcaacagaacuuuaa

SEQ ID NO: 337419 - RNA, 19 nt, Homo sapiens
agacuugacuucugugagu

SEQ ID NO: 337420 - RNA, 19 nt, Homo sapiens
caccaggccuccucacaga

SEQ ID NO: 337421 - RNA, 19 nt, Homo sapiens
ggaagaauacacccagcuu

SEQ ID NO: 337422 - RNA, 19 nt, Homo sapiens
ggaaacuuuuggaagaaua

SEQ ID NO: 337423 - RNA, 19 nt, Homo sapiens
ugaggcauuugacuucauu

SEQ ID NO: 337424 - RNA, 19 nt, Homo sapiens
uuaccuauccuucagcuuu

SEQ ID NO: 337425 - RNA, 19 nt, Homo sapiens
ugaacucucucuggcauug

SEQ ID NO: 337426 - RNA, 19 nt, Homo sapiens
ugacuucugugaguuuaga

SEQ ID NO: 337427 - RNA, 19 nt, Homo sapiens
ccucugccuugcccgaaua

SEQ ID NO: 337428 - RNA, 19 nt, Homo sapiens
gaaccuugacucucuugau

SEQ ID NO: 337429 - RNA, 19 nt, Homo sapiens
gcacagcuccccucacuug

SEQ ID NO: 337430 - RNA, 19 nt, Homo sapiens
cuuaagacuugacuucugu

SEQ ID NO: 337431 - RNA, 19 nt, Homo sapiens
aaccuugacucucuugaug

SEQ ID NO: 337432 - RNA, 19 nt, Homo sapiens
cgaaacccagugcuaugua

SEQ ID NO: 337433 - RNA, 19 nt, Homo sapiens
ccauggcuaucuccucuuc

SEQ ID NO: 337434 - RNA, 19 nt, Homo sapiens
caagcaacagaacuuuaaa

SEQ ID NO: 337435 - RNA, 19 nt, Homo sapiens
gaggucagacugcaguuuc

SEQ ID NO: 337436 - RNA, 19 nt, Homo sapiens
gcuggagcagagauacuua

SEQ ID NO: 337437 - RNA, 19 nt, Homo sapiens
ccacuuacaggaagacaca

SEQ ID NO: 337438 - RNA, 19 nt, Homo sapiens
gcgaaugguuuuggcuaua

SEQ ID NO: 337439 - RNA, 19 nt, Homo sapiens
gucacccacugucuuaaga

SEQ ID NO: 337440 - RNA, 19 nt, Homo sapiens
ccaggccuccucacagauu

SEQ ID NO: 337441 - RNA, 19 nt, Homo sapiens
cagaaaaucuacaauuguc

SEQ ID NO: 337442 - RNA, 19 nt, Homo sapiens
cagacaagcaacagaacuu

SEQ ID NO: 337443 - RNA, 19 nt, Homo sapiens
gugggaaacuuuuggaaga

SEQ ID NO: 337444 - RNA, 19 nt, Homo sapiens
gggccuaugugugaaagca

SEQ ID NO: 337445 - RNA, 19 nt, Homo sapiens
agacaagcaacagaacuuu

SEQ ID NO: 337446 - RNA, 19 nt, Homo sapiens
cuagugcucaugugacuug

SEQ ID NO: 337447 - RNA, 19 nt, Homo sapiens
uaucgaaacccagugcuau

SEQ ID NO: 337448 - RNA, 19 nt, Homo sapiens
augagaagagagcaaguua

SEQ ID NO: 337449 - RNA, 19 nt, Homo sapiens
ccuugacucucuugaugga

SEQ ID NO: 337450 - RNA, 19 nt, Homo sapiens
cuugacuucugugaguuua

SEQ ID NO: 337451 - RNA, 19 nt, Homo sapiens
auacuuaccuauccuucag

SEQ ID NO: 337452 - RNA, 19 nt, Homo sapiens
ucaagcuggagcagagaua

SEQ ID NO: 337453 - RNA, 19 nt, Homo sapiens
ucuuaagacuugacuucug

SEQ ID NO: 337454 - RNA, 19 nt, Homo sapiens
ggacgccaccaugagaaga

SEQ ID NO: 337455 - RNA, 19 nt, Homo sapiens
agucuugagucaccuguca

SEQ ID NO: 337456 - RNA, 19 nt, Homo sapiens
ucaacucucaguacuuugu

SEQ ID NO: 337457 - RNA, 19 nt, Homo sapiens
ucagacugcaguuucagaa

SEQ ID NO: 337458 - RNA, 19 nt, Homo sapiens
gacuugacuucugugaguu

SEQ ID NO: 337459 - RNA, 19 nt, Homo sapiens
ugagaagagagcaaguuau

SEQ ID NO: 337460 - RNA, 19 nt, Homo sapiens
caugagaagagagcaaguu

SEQ ID NO: 337461 - RNA, 19 nt, Homo sapiens
gaacagcaaaggggcagua

SEQ ID NO: 337462 - RNA, 19 nt, Homo sapiens
caucgacgccagacaagca

SEQ ID NO: 337463 - RNA, 19 nt, Homo sapiens
caaguuauggccacagcau

SEQ ID NO: 337464 - RNA, 19 nt, Homo sapiens
gggcugcuugggaaagaaa

SEQ ID NO: 337465 - RNA, 19 nt, Homo sapiens
uaagacuugacuucuguga

SEQ ID NO: 337466 - RNA, 19 nt, Homo sapiens
ugacaugcgguucccugaa

SEQ ID NO: 337467 - RNA, 19 nt, Homo sapiens
cacaccagcaggcaagauu

SEQ ID NO: 337468 - RNA, 19 nt, Homo sapiens
guccuugggugguuuccau

SEQ ID NO: 337469 - RNA, 19 nt, Homo sapiens
acgcagaccuucagcauua

SEQ ID NO: 337470 - RNA, 19 nt, Homo sapiens
gagcaccgauuucugguuu

SEQ ID NO: 337471 - RNA, 19 nt, Homo sapiens
ggucucagcuauccucuug

SEQ ID NO: 337472 - RNA, 19 nt, Homo sapiens
gaaagucugguccuacauu

SEQ ID NO: 337473 - RNA, 19 nt, Homo sapiens
gcuauccucuugcucugua

SEQ ID NO: 337474 - RNA, 19 nt, Homo sapiens
ggcaagagcggcaagauga

SEQ ID NO: 337475 - RNA, 19 nt, Homo sapiens
gcaccgauuucugguuuga

SEQ ID NO: 337476 - RNA, 19 nt, Homo sapiens
gggaaagucugguccuaca

SEQ ID NO: 337477 - RNA, 19 nt, Homo sapiens
aaagucugguccuacauuu

SEQ ID NO: 337478 - RNA, 19 nt, Homo sapiens
caucauaucaggcuacauc

SEQ ID NO: 337479 - RNA, 19 nt, Homo sapiens
ccucuuguuucuucauuca

SEQ ID NO: 337480 - RNA, 19 nt, Homo sapiens
gugcacagccuccuucucu

SEQ ID NO: 337481 - RNA, 19 nt, Homo sapiens
gcacagccuccuucucucu

SEQ ID NO: 337482 - RNA, 19 nt, Homo sapiens
cugauguucugccugauug

SEQ ID NO: 337483 - RNA, 19 nt, Homo sapiens
gacaucauaucaggcuaca

SEQ ID NO: 337484 - RNA, 19 nt, Homo sapiens
gaaggcaagagcggcaaga

SEQ ID NO: 337485 - RNA, 19 nt, Homo sapiens
uguucugccugauugcuuu

SEQ ID NO: 337486 - RNA, 19 nt, Homo sapiens
gaaaccuugugagcagaag

SEQ ID NO: 337487 - RNA, 19 nt, Homo sapiens
gcagaccuucagcauuaug

SEQ ID NO: 337488 - RNA, 19 nt, Homo sapiens
gacgcagaccuucagcauu

SEQ ID NO: 337489 - RNA, 19 nt, Homo sapiens
gcaagagcggcaagaugag

SEQ ID NO: 337490 - RNA, 19 nt, Homo sapiens
gagauucaagagucugauc

SEQ ID NO: 337491 - RNA, 19 nt, Homo sapiens
ggaaagucugguccuacau

SEQ ID NO: 337492 - RNA, 19 nt, Homo sapiens
ucgggaaagucugguccua

SEQ ID NO: 337493 - RNA, 19 nt, Homo sapiens
uuugagcguuguauuccaa

SEQ ID NO: 337494 - RNA, 19 nt, Homo sapiens
guaaauaucuggcaacuua

SEQ ID NO: 337495 - RNA, 19 nt, Homo sapiens
gaaagaagcuugucucaga

SEQ ID NO: 337496 - RNA, 19 nt, Homo sapiens
gaacauaauugcaggagua

SEQ ID NO: 337497 - RNA, 19 nt, Homo sapiens
ccaaagcacuuacaguuua

SEQ ID NO: 337498 - RNA, 19 nt, Homo sapiens
gggaagaaguuauguuaua

SEQ ID NO: 337499 - RNA, 19 nt, Homo sapiens
ccaaguagaucucgaagua

SEQ ID NO: 337500 - RNA, 19 nt, Homo sapiens
gagauuagcucauugaaag

SEQ ID NO: 337501 - RNA, 19 nt, Homo sapiens
gaaaccaacucauucagaa

SEQ ID NO: 337502 - RNA, 19 nt, Homo sapiens
gaaauccucuugugauaga

SEQ ID NO: 337503 - RNA, 19 nt, Homo sapiens
gaucagaaguuuagguuau

SEQ ID NO: 337504 - RNA, 19 nt, Homo sapiens
gaaaggaguucucguucuu

SEQ ID NO: 337505 - RNA, 19 nt, Homo sapiens
ucaagaagcuacucuagaa

SEQ ID NO: 337506 - RNA, 19 nt, Homo sapiens
gaagagauaugccuguugu

SEQ ID NO: 337507 - RNA, 19 nt, Homo sapiens
gcaaaucgagggaaacaua

SEQ ID NO: 337508 - RNA, 19 nt, Homo sapiens
gauagaggguauagcauaa

SEQ ID NO: 337509 - RNA, 19 nt, Homo sapiens
agagugaacuacagaaaua

SEQ ID NO: 337510 - RNA, 19 nt, Homo sapiens
caacuuguguguuuacuga

SEQ ID NO: 337511 - RNA, 19 nt, Homo sapiens
gaauuaugcugguaguaaa

SEQ ID NO: 337512 - RNA, 19 nt, Homo sapiens
ggaaaugcacggcuugaua

SEQ ID NO: 337513 - RNA, 19 nt, Homo sapiens
gaaguaaucgaacaaauug

SEQ ID NO: 337514 - RNA, 19 nt, Homo sapiens
caaucagccuuaacuauaa

SEQ ID NO: 337515 - RNA, 19 nt, Homo sapiens
gaaaccaucuguaucaaag

SEQ ID NO: 337516 - RNA, 19 nt, Homo sapiens
aaacaauacuggauacuga

SEQ ID NO: 337517 - RNA, 19 nt, Homo sapiens
gaggguauagcauaaauua

SEQ ID NO: 337518 - RNA, 19 nt, Homo sapiens
gaagagggauagaggguau

SEQ ID NO: 337519 - RNA, 19 nt, Homo sapiens
aaacaugggucaaaggaaa

SEQ ID NO: 337520 - RNA, 19 nt, Homo sapiens
gaguaaaggagauaaguua

SEQ ID NO: 337521 - RNA, 19 nt, Homo sapiens
ggccuugucugguguauuu

SEQ ID NO: 337522 - RNA, 19 nt, Homo sapiens
ggaauaaacaugcaaugaa

SEQ ID NO: 337523 - RNA, 19 nt, Homo sapiens
gaaguuccacaucaucuua

SEQ ID NO: 337524 - RNA, 19 nt, Homo sapiens
gaacaaggucugucuccua

SEQ ID NO: 337525 - RNA, 19 nt, Homo sapiens
gaaagcagcauguccgaaa

SEQ ID NO: 337526 - RNA, 19 nt, Homo sapiens
ucaaacagaugacaacaug

SEQ ID NO: 337527 - RNA, 19 nt, Homo sapiens
gaauaaacaugcaaugaac

SEQ ID NO: 337528 - RNA, 19 nt, Homo sapiens
ggaaaguggucaucauaca

SEQ ID NO: 337529 - RNA, 19 nt, Homo sapiens
guacauaugugcucuaaaa

SEQ ID NO: 337530 - RNA, 19 nt, Homo sapiens
gaaauucacaucaaaguca

SEQ ID NO: 337531 - RNA, 19 nt, Homo sapiens
gaucagagcacuuauucaa

SEQ ID NO: 337532 - RNA, 19 nt, Homo sapiens
gcagaaggaggaaacauaa

SEQ ID NO: 337533 - RNA, 19 nt, Homo sapiens
ucaaucagccuuaacuaua

SEQ ID NO: 337534 - RNA, 19 nt, Homo sapiens
gaauugauacuguugguaa

SEQ ID NO: 337535 - RNA, 19 nt, Homo sapiens
cauagagucuuguacauau

SEQ ID NO: 337536 - RNA, 19 nt, Homo sapiens
ucagaaagcucaccaaggu

SEQ ID NO: 337537 - RNA, 19 nt, Homo sapiens
ucaaaguccucaucacauu

SEQ ID NO: 337538 - RNA, 19 nt, Homo sapiens
gacagaaaguacauuagaa

SEQ ID NO: 337539 - RNA, 19 nt, Homo sapiens
ggauagaggguauagcaua

SEQ ID NO: 337540 - RNA, 19 nt, Homo sapiens
auacagauaugucuccuaa

SEQ ID NO: 337541 - RNA, 19 nt, Homo sapiens
gaaaccaaaucaagacaca

SEQ ID NO: 337542 - RNA, 19 nt, Homo sapiens
ucacacaccuccaagauca

SEQ ID NO: 337543 - RNA, 19 nt, Homo sapiens
uuacguaucccuuagaaua

SEQ ID NO: 337544 - RNA, 19 nt, Homo sapiens
cgaaauaaauacagugauc

SEQ ID NO: 337545 - RNA, 19 nt, Homo sapiens
gaucaaggacugcgucaaa

SEQ ID NO: 337546 - RNA, 19 nt, Homo sapiens
gaagauuccugauguugca

SEQ ID NO: 337547 - RNA, 19 nt, Homo sapiens
gaagaaaccaacucauuca

SEQ ID NO: 337548 - RNA, 19 nt, Homo sapiens
ggaagaaaccaacucauuc

SEQ ID NO: 337549 - RNA, 19 nt, Homo sapiens
ggucuuaaaggcugaaaua

SEQ ID NO: 337550 - RNA, 19 nt, Homo sapiens
gcagaagaaauucauauug

SEQ ID NO: 337551 - RNA, 19 nt, Homo sapiens
gaagaaaguguucccaaug

SEQ ID NO: 337552 - RNA, 19 nt, Homo sapiens
ggagauugaugacaagcaa

SEQ ID NO: 337553 - RNA, 19 nt, Homo sapiens
gcacaaacaugggucaaag

SEQ ID NO: 337554 - RNA, 19 nt, Homo sapiens
gaaaagacacuucacagua

SEQ ID NO: 337555 - RNA, 19 nt, Homo sapiens
aaacaaaccacccagaauu

SEQ ID NO: 337556 - RNA, 19 nt, Homo sapiens
gcaaguuacucaggaauca

SEQ ID NO: 337557 - RNA, 19 nt, Homo sapiens
cagaagagccaaggaauaa

SEQ ID NO: 337558 - RNA, 19 nt, Homo sapiens
uaagguugauugugcgaua

SEQ ID NO: 337559 - RNA, 19 nt, Homo sapiens
gaaacugccaaauguaauu

SEQ ID NO: 337560 - RNA, 19 nt, Homo sapiens
cagaagaaauucauauugg

SEQ ID NO: 337561 - RNA, 19 nt, Homo sapiens
gaagaaucaaucagccuua

SEQ ID NO: 337562 - RNA, 19 nt, Homo sapiens
ucucaucacucaucaaaga

SEQ ID NO: 337563 - RNA, 19 nt, Homo sapiens
gaacaugagagaagcagaa

SEQ ID NO: 337564 - RNA, 19 nt, Homo sapiens
gcguucaacuuguguguuu

SEQ ID NO: 337565 - RNA, 19 nt, Homo sapiens
ggaguacugucucaucuca

SEQ ID NO: 337566 - RNA, 19 nt, Homo sapiens
caaauggaaagaacacaua

SEQ ID NO: 337567 - RNA, 19 nt, Homo sapiens
gcaguucuguagcucauga

SEQ ID NO: 337568 - RNA, 19 nt, Homo sapiens
agaagucgaucgagaaguu

SEQ ID NO: 337569 - RNA, 19 nt, Homo sapiens
caaccucauugauaagaaa

SEQ ID NO: 337570 - RNA, 19 nt, Homo sapiens
gcacuuacaguuuagcaaa

SEQ ID NO: 337571 - RNA, 19 nt, Homo sapiens
agaggaagcucaagaucaa

SEQ ID NO: 337572 - RNA, 19 nt, Homo sapiens
gcauauagaccaccuagug

SEQ ID NO: 337573 - RNA, 19 nt, Homo sapiens
gaggaaaugcagagauuaa

SEQ ID NO: 337574 - RNA, 19 nt, Homo sapiens
gcaaaggagaauauuacua

SEQ ID NO: 337575 - RNA, 19 nt, Homo sapiens
aaacaggacuuaggccaaa

SEQ ID NO: 337576 - RNA, 19 nt, Homo sapiens
caagaaaucaggagaguuc

SEQ ID NO: 337577 - RNA, 19 nt, Homo sapiens
agaaggagguggcugagaa

SEQ ID NO: 337578 - RNA, 19 nt, Homo sapiens
gagaagagauaugccuguu

SEQ ID NO: 337579 - RNA, 19 nt, Homo sapiens
gcucaagcccacagauaua

SEQ ID NO: 337580 - RNA, 19 nt, Homo sapiens
guaagguggucaguuguuu

SEQ ID NO: 337581 - RNA, 19 nt, Homo sapiens
caaggucugucuccuauag

SEQ ID NO: 337582 - RNA, 19 nt, Homo sapiens
ccacagcuuuaaauacuga

SEQ ID NO: 337583 - RNA, 19 nt, Homo sapiens
agaaucaucuucagaaagu

SEQ ID NO: 337584 - RNA, 19 nt, Homo sapiens
caauaccgaucagaaguuu

SEQ ID NO: 337585 - RNA, 19 nt, Homo sapiens
agaacgagaugucacuaaa

SEQ ID NO: 337586 - RNA, 19 nt, Homo sapiens
gaacuacagaaauagcuuu

SEQ ID NO: 337587 - RNA, 19 nt, Homo sapiens
caaaaucacuggcaccaaa

SEQ ID NO: 337588 - RNA, 19 nt, Homo sapiens
ucaaggagcagaucuucua

SEQ ID NO: 337589 - RNA, 19 nt, Homo sapiens
gaaugaaauccucuuguga

SEQ ID NO: 337590 - RNA, 19 nt, Homo sapiens
gaagacacaaacaaacaaa

SEQ ID NO: 337591 - RNA, 19 nt, Homo sapiens
ggacggaagauuaaaggaa

SEQ ID NO: 337592 - RNA, 19 nt, Homo sapiens
ugucucaucucaucauauu

SEQ ID NO: 337593 - RNA, 19 nt, Homo sapiens
gaaguaaaucugaaaccaa

SEQ ID NO: 337594 - RNA, 19 nt, Homo sapiens
gcuacaacuuugcgacaua

SEQ ID NO: 337595 - RNA, 19 nt, Homo sapiens
guaaauaucgguggugauu

SEQ ID NO: 337596 - RNA, 19 nt, Homo sapiens
gacaacugguggcagauuu

SEQ ID NO: 337597 - RNA, 19 nt, Homo sapiens
caacuuugcgacauaaauu

SEQ ID NO: 337598 - RNA, 19 nt, Homo sapiens
gcaccgagggccuucagua

SEQ ID NO: 337599 - RNA, 19 nt, Homo sapiens
aaauaucgguggugauugu

SEQ ID NO: 337600 - RNA, 19 nt, Homo sapiens
gcguuaaugucgucacuug

SEQ ID NO: 337601 - RNA, 19 nt, Homo sapiens
cuacaacuuugcgacauaa

SEQ ID NO: 337602 - RNA, 19 nt, Homo sapiens
ggguccaacuccuuucuuu

SEQ ID NO: 337603 - RNA, 19 nt, Homo sapiens
ccaaaccgucccagcguua

SEQ ID NO: 337604 - RNA, 19 nt, Homo sapiens
gaaccaccgcuacaagaug

SEQ ID NO: 337605 - RNA, 19 nt, Homo sapiens
ccacgcaggucaagaucug

SEQ ID NO: 337606 - RNA, 19 nt, Homo sapiens
gauauugucagccgucuuc

SEQ ID NO: 337607 - RNA, 19 nt, Homo sapiens
gaacucuacgccguguuua

SEQ ID NO: 337608 - RNA, 19 nt, Homo sapiens
uuaaugucgucacuugaaa

SEQ ID NO: 337609 - RNA, 19 nt, Homo sapiens
guuaaugucgucacuugaa

SEQ ID NO: 337610 - RNA, 19 nt, Homo sapiens
gcccaugccucuccuucug

SEQ ID NO: 337611 - RNA, 19 nt, Homo sapiens
aaccaccgcuacaagauga

SEQ ID NO: 337612 - RNA, 19 nt, Homo sapiens
gguggugauuguugccaaa

SEQ ID NO: 337613 - RNA, 19 nt, Homo sapiens
gugaguagcgauauuguca

SEQ ID NO: 337614 - RNA, 19 nt, Homo sapiens
guccuuauggugguuauua

SEQ ID NO: 337615 - RNA, 19 nt, Homo sapiens
uaaagcaaguggagaacac

SEQ ID NO: 337616 - RNA, 19 nt, Homo sapiens
ugucagccgucuucuaaag

SEQ ID NO: 337617 - RNA, 19 nt, Homo sapiens
cagaaccaccgcuacaaga

SEQ ID NO: 337618 - RNA, 19 nt, Homo sapiens
ugaacucuacgccguguuu

SEQ ID NO: 337619 - RNA, 19 nt, Homo sapiens
ccaaggcgcagaccuacga

SEQ ID NO: 337620 - RNA, 19 nt, Homo sapiens
cauguaaacguucugacaa

SEQ ID NO: 337621 - RNA, 19 nt, Homo sapiens
guccaacuccuuucuuugu

SEQ ID NO: 337622 - RNA, 19 nt, Homo sapiens
gccacgaauugaccaagug

SEQ ID NO: 337623 - RNA, 19 nt, Homo sapiens
gguggcagauuucgcuuuu

SEQ ID NO: 337624 - RNA, 19 nt, Homo sapiens
ccaugccucuccuucugaa

SEQ ID NO: 337625 - RNA, 19 nt, Homo sapiens
ccgaagguccggaggaaga

SEQ ID NO: 337626 - RNA, 19 nt, Homo sapiens
gaaccaugucgcugaccaa

SEQ ID NO: 337627 - RNA, 19 nt, Homo sapiens
ccacgaauugaccaaguga

SEQ ID NO: 337628 - RNA, 19 nt, Homo sapiens
ccaugucgcugaccaacac

SEQ ID NO: 337629 - RNA, 19 nt, Homo sapiens
gaauugaccaagugaagcu

SEQ ID NO: 337630 - RNA, 19 nt, Homo sapiens
acgagucaccggacaauga

SEQ ID NO: 337631 - RNA, 19 nt, Homo sapiens
gcgcagcuucgcuucuuug

SEQ ID NO: 337632 - RNA, 19 nt, Homo sapiens
ggaggccucgguccuuaug

SEQ ID NO: 337633 - RNA, 19 nt, Homo sapiens
ggucagggacggcaaacca

SEQ ID NO: 337634 - RNA, 19 nt, Homo sapiens
guaaacguucugacaacug

SEQ ID NO: 337635 - RNA, 19 nt, Homo sapiens
uuauggccauguaaacguu

SEQ ID NO: 337636 - RNA, 19 nt, Homo sapiens
caaaccgucccagcguuaa

SEQ ID NO: 337637 - RNA, 19 nt, Homo sapiens
ccgagggccuucaguacuc

SEQ ID NO: 337638 - RNA, 19 nt, Homo sapiens
gguccaacuccuuucuuug

SEQ ID NO: 337639 - RNA, 19 nt, Homo sapiens
gcccagcaguggacuuggu

SEQ ID NO: 337640 - RNA, 19 nt, Homo sapiens
gcuuucuuccuuucucuuu

SEQ ID NO: 337641 - RNA, 19 nt, Homo sapiens
ccauguaaacguucugaca

SEQ ID NO: 337642 - RNA, 19 nt, Homo sapiens
ucagccgucuucuaaagca

SEQ ID NO: 337643 - RNA, 19 nt, Homo sapiens
auugucagccgucuucuaa

SEQ ID NO: 337644 - RNA, 19 nt, Homo sapiens
cagaauguuugcgcagcuu

SEQ ID NO: 337645 - RNA, 19 nt, Homo sapiens
ggucaaggacaucuuagac

SEQ ID NO: 337646 - RNA, 19 nt, Homo sapiens
ugugcaaacauuucucaaa

SEQ ID NO: 337647 - RNA, 19 nt, Homo sapiens
ugacaacugguggcagauu

SEQ ID NO: 337648 - RNA, 19 nt, Homo sapiens
ucuacgccguguuuacaga

SEQ ID NO: 337649 - RNA, 19 nt, Homo sapiens
ucgcugaccaacacaaaga

SEQ ID NO: 337650 - RNA, 19 nt, Homo sapiens
ccagaaccaccgcuacaag

SEQ ID NO: 337651 - RNA, 19 nt, Homo sapiens
ggugauuguugccaaaaug

SEQ ID NO: 337652 - RNA, 19 nt, Homo sapiens
gguaagagguauuggauuu

SEQ ID NO: 337653 - RNA, 19 nt, Homo sapiens
gcuccaaucugucacauaa

SEQ ID NO: 337654 - RNA, 19 nt, Homo sapiens
aaacagaacuccacugcaa

SEQ ID NO: 337655 - RNA, 19 nt, Homo sapiens
acaagaaacuguccaaaug

SEQ ID NO: 337656 - RNA, 19 nt, Homo sapiens
gaaugaaggcgcaggcuua

SEQ ID NO: 337657 - RNA, 19 nt, Homo sapiens
ggucacuacugcauuuaua

SEQ ID NO: 337658 - RNA, 19 nt, Homo sapiens
auagaaaguuggccaauuu

SEQ ID NO: 337659 - RNA, 19 nt, Homo sapiens
ggaaaggccucuucucaac

SEQ ID NO: 337660 - RNA, 19 nt, Homo sapiens
gaaaggacaaccaggauga

SEQ ID NO: 337661 - RNA, 19 nt, Homo sapiens
gaacacagcgcagaaugaa

SEQ ID NO: 337662 - RNA, 19 nt, Homo sapiens
gaauaucaacucugaaaga

SEQ ID NO: 337663 - RNA, 19 nt, Homo sapiens
gaaacuguccaaaugcuuu

SEQ ID NO: 337664 - RNA, 19 nt, Homo sapiens
cugaagagcuagucuauca

SEQ ID NO: 337665 - RNA, 19 nt, Homo sapiens
gcaaauagucuccaaagag

SEQ ID NO: 337666 - RNA, 19 nt, Homo sapiens
gaugucaccaacugaauua

SEQ ID NO: 337667 - RNA, 19 nt, Homo sapiens
gaacagacgcuauaagacu

SEQ ID NO: 337668 - RNA, 19 nt, Homo sapiens
cauuggaacuagucauuaa

SEQ ID NO: 337669 - RNA, 19 nt, Homo sapiens
caacagagacagugaaagu

SEQ ID NO: 337670 - RNA, 19 nt, Homo sapiens
uaacagcuauccuuacuac

SEQ ID NO: 337671 - RNA, 19 nt, Homo sapiens
uaacaaacccugcuccaau

SEQ ID NO: 337672 - RNA, 19 nt, Homo sapiens
aagacaagcuguauaaaca

SEQ ID NO: 337673 - RNA, 19 nt, Homo sapiens
gagaagcacuccucuuugc

SEQ ID NO: 337674 - RNA, 19 nt, Homo sapiens
gcuauaagacuaagcgaaa

SEQ ID NO: 337675 - RNA, 19 nt, Homo sapiens
cagggugucucauaugaaa

SEQ ID NO: 337676 - RNA, 19 nt, Homo sapiens
ugacaaccauuaugaucaa

SEQ ID NO: 337677 - RNA, 19 nt, Homo sapiens
gaauugcuuucugcucuuu

SEQ ID NO: 337678 - RNA, 19 nt, Homo sapiens
gcucaggugacaaccauua

SEQ ID NO: 337679 - RNA, 19 nt, Homo sapiens
uugcaaggguuacacauuu

SEQ ID NO: 337680 - RNA, 19 nt, Homo sapiens
gcagagagcaaaggagaaa

SEQ ID NO: 337681 - RNA, 19 nt, Homo sapiens
ggaaaaccauucuaaaaca

SEQ ID NO: 337682 - RNA, 19 nt, Homo sapiens
ugacaauccuugagaaucu

SEQ ID NO: 337683 - RNA, 19 nt, Homo sapiens
gcuggagaauuuagaauca

SEQ ID NO: 337684 - RNA, 19 nt, Homo sapiens
gcagagaccgagccagaaa

SEQ ID NO: 337685 - RNA, 19 nt, Homo sapiens
aaaaugguaugccaacuua

SEQ ID NO: 337686 - RNA, 19 nt, Homo sapiens
cagaacagacgcuauaaga

SEQ ID NO: 337687 - RNA, 19 nt, Homo sapiens
gcuaggggcuguugcauuu

SEQ ID NO: 337688 - RNA, 19 nt, Homo sapiens
ugaaagagcaaaccuaaca

SEQ ID NO: 337689 - RNA, 19 nt, Homo sapiens
gaaacaacagagacaguga

SEQ ID NO: 337690 - RNA, 19 nt, Homo sapiens
gcagaggagguaagaggua

SEQ ID NO: 337691 - RNA, 19 nt, Homo sapiens
guucugcuguuacguuuga

SEQ ID NO: 337692 - RNA, 19 nt, Homo sapiens
caaggauucuguucugcaa

SEQ ID NO: 337693 - RNA, 19 nt, Homo sapiens
cauuaaaucccaaauccua

SEQ ID NO: 337694 - RNA, 19 nt, Homo sapiens
acuuaugccucgcuuauuu

SEQ ID NO: 337695 - RNA, 19 nt, Homo sapiens
ucacuaaagggcuucauuu

SEQ ID NO: 337696 - RNA, 19 nt, Homo sapiens
gaaaggcaacauaauucuu

SEQ ID NO: 337697 - RNA, 19 nt, Homo sapiens
ggaagaacacagcgcagaa

SEQ ID NO: 337698 - RNA, 19 nt, Homo sapiens
ccaagccgcucacguccuu

SEQ ID NO: 337699 - RNA, 19 nt, Homo sapiens
uaacuuaugccucgcuuau

SEQ ID NO: 337700 - RNA, 19 nt, Homo sapiens
ggcaaauagucuccaaaga

SEQ ID NO: 337701 - RNA, 19 nt, Homo sapiens
ccagcacuuuguaugauuu

SEQ ID NO: 337702 - RNA, 19 nt, Homo sapiens
gagggaaaaucaaguggua

SEQ ID NO: 337703 - RNA, 19 nt, Homo sapiens
gugaauccaucuugcuuuc

SEQ ID NO: 337704 - RNA, 19 nt, Homo sapiens
ccugaaaggcaacauaauu

SEQ ID NO: 337705 - RNA, 19 nt, Homo sapiens
cccuugggcuggagaauuu

SEQ ID NO: 337706 - RNA, 19 nt, Homo sapiens
aaaggccucuucucaacuu

SEQ ID NO: 337707 - RNA, 19 nt, Homo sapiens
ccaaauagaacaagaugca

SEQ ID NO: 337708 - RNA, 19 nt, Homo sapiens
uauaacagcuauccuuacu

SEQ ID NO: 337709 - RNA, 19 nt, Homo sapiens
acccaucucugaacuggua

SEQ ID NO: 337710 - RNA, 19 nt, Homo sapiens
gucauuaacccaucucuga

SEQ ID NO: 337711 - RNA, 19 nt, Homo sapiens
gcuuucugcucuuuacauu

SEQ ID NO: 337712 - RNA, 19 nt, Homo sapiens
ccuccugugucacugaaua

SEQ ID NO: 337713 - RNA, 19 nt, Homo sapiens
acagagacagugaaaguuu

SEQ ID NO: 337714 - RNA, 19 nt, Homo sapiens
aauagaaaguuggccaauu

SEQ ID NO: 337715 - RNA, 19 nt, Homo sapiens
gaagaacacagcgcagaau

SEQ ID NO: 337716 - RNA, 19 nt, Homo sapiens
ggaugucaccaacugaauu

SEQ ID NO: 337717 - RNA, 19 nt, Homo sapiens
ucagaaguuuccuggaguu

SEQ ID NO: 337718 - RNA, 19 nt, Homo sapiens
caggguggcccaaauagaa

SEQ ID NO: 337719 - RNA, 19 nt, Homo sapiens
aacagacgcuauaagacua

SEQ ID NO: 337720 - RNA, 19 nt, Homo sapiens
aagggucacuacugcauuu

SEQ ID NO: 337721 - RNA, 19 nt, Homo sapiens
gaaguuuccuggaguuuuc

SEQ ID NO: 337722 - RNA, 19 nt, Homo sapiens
uuacaggguggcccaaaua

SEQ ID NO: 337723 - RNA, 19 nt, Homo sapiens
caaagagaacgcccucaug

SEQ ID NO: 337724 - RNA, 19 nt, Homo sapiens
uaaaagagaggggcaaaua

SEQ ID NO: 337725 - RNA, 19 nt, Homo sapiens
cacugaauaucaacucuga

SEQ ID NO: 337726 - RNA, 19 nt, Homo sapiens
gaaguucagccaucagaag

SEQ ID NO: 337727 - RNA, 19 nt, Homo sapiens
uaaauuaguuuggguucuc

SEQ ID NO: 337728 - RNA, 19 nt, Homo sapiens
agaauugcguggaaaucuu

SEQ ID NO: 337729 - RNA, 19 nt, Homo sapiens
uguauaacagcuauccuua

SEQ ID NO: 337730 - RNA, 19 nt, Homo sapiens
gaagggucacuacugcauu

SEQ ID NO: 337731 - RNA, 19 nt, Homo sapiens
gugagacaaugaaacaaca

SEQ ID NO: 337732 - RNA, 19 nt, Homo sapiens
gcaucugacaggugaauug

SEQ ID NO: 337733 - RNA, 19 nt, Homo sapiens
ucuuucaacuugcaauuug

SEQ ID NO: 337734 - RNA, 19 nt, Homo sapiens
uuucugcucuuuacauuuc

SEQ ID NO: 337735 - RNA, 19 nt, Homo sapiens
gguauuggauuuucacaga

SEQ ID NO: 337736 - RNA, 19 nt, Homo sapiens
ggagguaagagguauugga

SEQ ID NO: 337737 - RNA, 19 nt, Homo sapiens
cuuuaucugucuugacuuu

SEQ ID NO: 337738 - RNA, 19 nt, Homo sapiens
ggacaaccaggaugaggau

SEQ ID NO: 337739 - RNA, 19 nt, Homo sapiens
gagaaaggacaaccaggau

SEQ ID NO: 337740 - RNA, 19 nt, Homo sapiens
cccagggugucucauauga

SEQ ID NO: 337741 - RNA, 19 nt, Homo sapiens
uggguucucuacaugcaua

SEQ ID NO: 337742 - RNA, 19 nt, Homo sapiens
aaccuagacuucagagaga

SEQ ID NO: 337743 - RNA, 19 nt, Homo sapiens
aaacacaacaagaaacugu

SEQ ID NO: 337744 - RNA, 19 nt, Homo sapiens
gagguaagagguauuggau

SEQ ID NO: 337745 - RNA, 19 nt, Homo sapiens
cagaggagguaagagguau

SEQ ID NO: 337746 - RNA, 19 nt, Homo sapiens
guggaaaggccucuucuca

SEQ ID NO: 337747 - RNA, 19 nt, Homo sapiens
ccucggagcugggagacuu

SEQ ID NO: 337748 - RNA, 19 nt, Homo sapiens
gaggaugucaccaacugaa

SEQ ID NO: 337749 - RNA, 19 nt, Homo sapiens
gacaaugaaacaacagaga

SEQ ID NO: 337750 - RNA, 19 nt, Homo sapiens
ugugauguauauuguguug

SEQ ID NO: 337751 - RNA, 19 nt, Homo sapiens
caacaagaaacuguccaaa

SEQ ID NO: 337752 - RNA, 19 nt, Homo sapiens
ggagaagacuuucgaacaa

SEQ ID NO: 337753 - RNA, 19 nt, Homo sapiens
ucacgcagcuguugaagaa

SEQ ID NO: 337754 - RNA, 19 nt, Homo sapiens
gaagcacgcugccgagaug

SEQ ID NO: 337755 - RNA, 19 nt, Homo sapiens
gagaagacuuucgaacaaa

SEQ ID NO: 337756 - RNA, 19 nt, Homo sapiens
ggacaaagacgggaagaga

SEQ ID NO: 337757 - RNA, 19 nt, Homo sapiens
ccacacggcaucaacaaua

SEQ ID NO: 337758 - RNA, 19 nt, Homo sapiens
ccggagagcucauccugaa

SEQ ID NO: 337759 - RNA, 19 nt, Homo sapiens
ggacgacgacuacaauaag

SEQ ID NO: 337760 - RNA, 19 nt, Homo sapiens
ggaagaggacgacgacuac

SEQ ID NO: 337761 - RNA, 19 nt, Homo sapiens
acaaagacgggaagagaaa

SEQ ID NO: 337762 - RNA, 19 nt, Homo sapiens
gcuguacccugccgcguau

SEQ ID NO: 337763 - RNA, 19 nt, Homo sapiens
gacaaagacgggaagagaa

SEQ ID NO: 337764 - RNA, 19 nt, Homo sapiens
gaggacgacgacuacaaua

SEQ ID NO: 337765 - RNA, 19 nt, Homo sapiens
ggacugccacgcuuuagca

SEQ ID NO: 337766 - RNA, 19 nt, Homo sapiens
cacacggcaucaacaauau

SEQ ID NO: 337767 - RNA, 19 nt, Homo sapiens
caucaaggauccauuuugu

SEQ ID NO: 337768 - RNA, 19 nt, Homo sapiens
ccucaucaaggauccauuu

SEQ ID NO: 337769 - RNA, 19 nt, Homo sapiens
gcacagcauggccgagaug

SEQ ID NO: 337770 - RNA, 19 nt, Homo sapiens
gaaaaucacgcagcuguug

SEQ ID NO: 337771 - RNA, 19 nt, Homo sapiens
ggagacagagcgccucaag

SEQ ID NO: 337772 - RNA, 19 nt, Homo sapiens
ggaccaaguggaggaagaa

SEQ ID NO: 337773 - RNA, 19 nt, Homo sapiens
gggcucguuuggccuauuc

SEQ ID NO: 337774 - RNA, 19 nt, Homo sapiens
gaagacuuucgaacaaaca

SEQ ID NO: 337775 - RNA, 19 nt, Homo sapiens
ccaaguggaggaagaagca

SEQ ID NO: 337776 - RNA, 19 nt, Homo sapiens
uggagaagacuuucgaaca

SEQ ID NO: 337777 - RNA, 19 nt, Homo sapiens
gacgacgacuacaauaagc

SEQ ID NO: 337778 - RNA, 19 nt, Homo sapiens
aggaagaggacgacgacua

SEQ ID NO: 337779 - RNA, 19 nt, Homo sapiens
cagcauggccgagaugaag

SEQ ID NO: 337780 - RNA, 19 nt, Homo sapiens
gccggacugccacgcuuua

SEQ ID NO: 337781 - RNA, 19 nt, Homo sapiens
gacagagagucaggucaag

SEQ ID NO: 337782 - RNA, 19 nt, Homo sapiens
aaacacacgagacccacuu

SEQ ID NO: 337783 - RNA, 19 nt, Homo sapiens
ucaaggauccauuuuguug

SEQ ID NO: 337784 - RNA, 19 nt, Homo sapiens
gaagcaggacucggagaca

SEQ ID NO: 337785 - RNA, 19 nt, Homo sapiens
cggaccaaguggaggaaga

SEQ ID NO: 337786 - RNA, 19 nt, Homo sapiens
agaagacuuucgaacaaac

SEQ ID NO: 337787 - RNA, 19 nt, Homo sapiens
agaggacgacgacuacaau

SEQ ID NO: 337788 - RNA, 19 nt, Homo sapiens
gaagaggacgacgacuaca

SEQ ID NO: 337789 - RNA, 19 nt, Homo sapiens
aggacgacgacuacaauaa

SEQ ID NO: 337790 - RNA, 19 nt, Homo sapiens
gaagugagguguucaggua

SEQ ID NO: 337791 - RNA, 19 nt, Homo sapiens
gaaggagggugguuaagaa

SEQ ID NO: 337792 - RNA, 19 nt, Homo sapiens
ggagggugguuaagaaaua

SEQ ID NO: 337793 - RNA, 19 nt, Homo sapiens
guaaaugaaucccaccuuu

SEQ ID NO: 337794 - RNA, 19 nt, Homo sapiens
gaagcaguaccgacaauga

SEQ ID NO: 337795 - RNA, 19 nt, Homo sapiens
gagaagcaguaccgacaau

SEQ ID NO: 337796 - RNA, 19 nt, Homo sapiens
cagcaguuguggucaauau

SEQ ID NO: 337797 - RNA, 19 nt, Homo sapiens
ggaaggagggugguuaaga

SEQ ID NO: 337798 - RNA, 19 nt, Homo sapiens
gcaguuguggucaauauug

SEQ ID NO: 337799 - RNA, 19 nt, Homo sapiens
gguaaucgcuaauuguacu

SEQ ID NO: 337800 - RNA, 19 nt, Homo sapiens
ggacagggaccaccucuac

SEQ ID NO: 337801 - RNA, 19 nt, Homo sapiens
gaacuauucaagcaguaaa

SEQ ID NO: 337802 - RNA, 19 nt, Homo sapiens
aguaaugugucacuugauu

SEQ ID NO: 337803 - RNA, 19 nt, Homo sapiens
guuuaagugugcauuaguu

SEQ ID NO: 337804 - RNA, 19 nt, Homo sapiens
gaggaaggagggugguuaa

SEQ ID NO: 337805 - RNA, 19 nt, Homo sapiens
gugguaaucgcuaauugua

SEQ ID NO: 337806 - RNA, 19 nt, Homo sapiens
cauaggcaccgcauucuga

SEQ ID NO: 337807 - RNA, 19 nt, Homo sapiens
gggcacaguugaggaagga

SEQ ID NO: 337808 - RNA, 19 nt, Homo sapiens
gggcauaggcaccgcauuc

SEQ ID NO: 337809 - RNA, 19 nt, Homo sapiens
guaaugugucacuugauuu

SEQ ID NO: 337810 - RNA, 19 nt, Homo sapiens
ggagggcacaguugaggaa

SEQ ID NO: 337811 - RNA, 19 nt, Homo sapiens
guacugauuguuuaagugu

SEQ ID NO: 337812 - RNA, 19 nt, Homo sapiens
ugaaucccaccuuuacuaa

SEQ ID NO: 337813 - RNA, 19 nt, Homo sapiens
ccaccuaccauucuuggaa

SEQ ID NO: 337814 - RNA, 19 nt, Homo sapiens
ggaacuauucaagcaguaa

SEQ ID NO: 337815 - RNA, 19 nt, Homo sapiens
ucacuugauuuggaacuau

SEQ ID NO: 337816 - RNA, 19 nt, Homo sapiens
cggcugaacugcucaucau

SEQ ID NO: 337817 - RNA, 19 nt, Homo sapiens
cuaaaacacuuucucugaa

SEQ ID NO: 337818 - RNA, 19 nt, Homo sapiens
uaaugugucacuugauuug

SEQ ID NO: 337819 - RNA, 19 nt, Homo sapiens
auucugaucuggacaaagu

SEQ ID NO: 337820 - RNA, 19 nt, Homo sapiens
ccacccaccuaccauucuu

SEQ ID NO: 337821 - RNA, 19 nt, Homo sapiens
gcauucugaucuggacaaa

SEQ ID NO: 337822 - RNA, 19 nt, Homo sapiens
ggagaagcaguaccgacaa

SEQ ID NO: 337823 - RNA, 19 nt, Homo sapiens
ugaggaaggagggugguua

SEQ ID NO: 337824 - RNA, 19 nt, Homo sapiens
guaccgacaaugacgaaga

SEQ ID NO: 337825 - RNA, 19 nt, Homo sapiens
gcauuugcucucucgauug

SEQ ID NO: 337826 - RNA, 19 nt, Homo sapiens
ugcauuugcucucucgauu

SEQ ID NO: 337827 - RNA, 19 nt, Homo sapiens
gcaccagccagcagaaugg

SEQ ID NO: 337828 - RNA, 19 nt, Homo sapiens
ggucaauauugugguaauc

SEQ ID NO: 337829 - RNA, 19 nt, Homo sapiens
aaaaguaccuccccugucu

SEQ ID NO: 337830 - RNA, 19 nt, Homo sapiens
uguggucaauauuguggua

SEQ ID NO: 337831 - RNA, 19 nt, Homo sapiens
aaaugaaucccaccuuuac

SEQ ID NO: 337832 - RNA, 19 nt, Homo sapiens
gcauuuacuggguaggauu

SEQ ID NO: 337833 - RNA, 19 nt, Homo sapiens
gguacucccugcagaagcu

SEQ ID NO: 337834 - RNA, 19 nt, Homo sapiens
gagggugguuaagaaauac

SEQ ID NO: 337835 - RNA, 19 nt, Homo sapiens
acccugagaucugggcaua

SEQ ID NO: 337836 - RNA, 19 nt, Homo sapiens
uaccgacaaugacgaagau

SEQ ID NO: 337837 - RNA, 19 nt, Homo sapiens
caguuguggucaauauugu

SEQ ID NO: 337838 - RNA, 19 nt, Homo sapiens
cacuugauuuggaacuauu

SEQ ID NO: 337839 - RNA, 19 nt, Homo sapiens
ccagggacacagcccauug

SEQ ID NO: 337840 - RNA, 19 nt, Homo sapiens
gggagcagacccugagauc

SEQ ID NO: 337841 - RNA, 19 nt, Homo sapiens
ucucagcaguuguggucaa

SEQ ID NO: 337842 - RNA, 19 nt, Homo sapiens
gaaauccuccagggacaca

SEQ ID NO: 337843 - RNA, 19 nt, Homo sapiens
acagggaccaccucuacaa

SEQ ID NO: 337844 - RNA, 19 nt, Homo sapiens
uggaacuauucaagcagua

SEQ ID NO: 337845 - RNA, 19 nt, Homo sapiens
gaccacccaccuaccauuc

SEQ ID NO: 337846 - RNA, 19 nt, Homo sapiens
ugcagaagcuggcauacac

SEQ ID NO: 337847 - RNA, 19 nt, Homo sapiens
cagggaccaccucuacaaa

SEQ ID NO: 337848 - RNA, 19 nt, Homo sapiens
cgaccacccaccuaccauu

SEQ ID NO: 337849 - RNA, 19 nt, Homo sapiens
gccgacgcccugaaucuug

SEQ ID NO: 337850 - RNA, 19 nt, Homo sapiens
cauuugcucucucgauugc

SEQ ID NO: 337851 - RNA, 19 nt, Homo sapiens
gcauaggcaccgcauucug

SEQ ID NO: 337852 - RNA, 19 nt, Homo sapiens
ccugagaucugggcauagg

SEQ ID NO: 337853 - RNA, 19 nt, Homo sapiens
uguacugauuguuuaagug

SEQ ID NO: 337854 - RNA, 19 nt, Homo sapiens
augaaucccaccuuuacua

SEQ ID NO: 337855 - RNA, 19 nt, Homo sapiens
gucacuugauuuggaacua

SEQ ID NO: 337856 - RNA, 19 nt, Homo sapiens
ugugucacuugauuuggaa

SEQ ID NO: 337857 - RNA, 19 nt, Homo sapiens
caucaucggcugguacauc

SEQ ID NO: 337858 - RNA, 19 nt, Homo sapiens
gaaaugacaccaauaauag

SEQ ID NO: 337859 - RNA, 19 nt, Homo sapiens
gcagaaaugacaccaauaa

SEQ ID NO: 337860 - RNA, 19 nt, Homo sapiens
guacaaauacugcagaaau

SEQ ID NO: 337861 - RNA, 19 nt, Homo sapiens
ggaauccuccugcuaaaga

SEQ ID NO: 337862 - RNA, 19 nt, Homo sapiens
gcucaaaucucuguuacuc

SEQ ID NO: 337863 - RNA, 19 nt, Homo sapiens
ggaggcugcugguacaaau

SEQ ID NO: 337864 - RNA, 19 nt, Homo sapiens
cugcuucccuguugaauug

SEQ ID NO: 337865 - RNA, 19 nt, Homo sapiens
uacaaauacugcagaaaug

SEQ ID NO: 337866 - RNA, 19 nt, Homo sapiens
gaauccuccugcuaaagaa

SEQ ID NO: 337867 - RNA, 19 nt, Homo sapiens
gaauaaaaccuugcucuuu

SEQ ID NO: 337868 - RNA, 19 nt, Homo sapiens
cagggaaggugcugaaugg

SEQ ID NO: 337869 - RNA, 19 nt, Homo sapiens
uuauguuccugcuguauuu

SEQ ID NO: 337870 - RNA, 19 nt, Homo sapiens
gagcucaaaucucuguuac

SEQ ID NO: 337871 - RNA, 19 nt, Homo sapiens
gucaugaucugcucggaau

SEQ ID NO: 337872 - RNA, 19 nt, Homo sapiens
ggccaccggucacuucaug

SEQ ID NO: 337873 - RNA, 19 nt, Homo sapiens
cuguugaauuggugaauaa

SEQ ID NO: 337874 - RNA, 19 nt, Homo sapiens
ccuguugaauuggugaaua

SEQ ID NO: 337875 - RNA, 19 nt, Homo sapiens
gacacaacagcguggcuua

SEQ ID NO: 337876 - RNA, 19 nt, Homo sapiens
cugcagaaaugacaccaau

SEQ ID NO: 337877 - RNA, 19 nt, Homo sapiens
gcagacacagauuauguuc

SEQ ID NO: 337878 - RNA, 19 nt, Homo sapiens
uguaaauccugagcucaaa

SEQ ID NO: 337879 - RNA, 19 nt, Homo sapiens
gcagcugagucaugaucug

SEQ ID NO: 337880 - RNA, 19 nt, Homo sapiens
gaaugggacccuguugaug

SEQ ID NO: 337881 - RNA, 19 nt, Homo sapiens
aaucucuguuacuccauua

SEQ ID NO: 337882 - RNA, 19 nt, Homo sapiens
acaaauacugcagaaauga

SEQ ID NO: 337883 - RNA, 19 nt, Homo sapiens
acaggaggcugcugguaca

SEQ ID NO: 337884 - RNA, 19 nt, Homo sapiens
gcucggaauccuccugcua

SEQ ID NO: 337885 - RNA, 19 nt, Homo sapiens
agacacagauuauguuccu

SEQ ID NO: 337886 - RNA, 19 nt, Homo sapiens
ugagcucaaaucucuguua

SEQ ID NO: 337887 - RNA, 19 nt, Homo sapiens
aaaucucuguuacuccauu

SEQ ID NO: 337888 - RNA, 19 nt, Homo sapiens
guacaggaggcugcuggua

SEQ ID NO: 337889 - RNA, 19 nt, Homo sapiens
caccagaaauaucgcugau

SEQ ID NO: 337890 - RNA, 19 nt, Homo sapiens
ucggaauccuccugcuaaa

SEQ ID NO: 337891 - RNA, 19 nt, Homo sapiens
gaggcugcugguacaaaua

SEQ ID NO: 337892 - RNA, 19 nt, Homo sapiens
ugaaugggacccuguugau

SEQ ID NO: 337893 - RNA, 19 nt, Homo sapiens
cugaugcagacacagauua

SEQ ID NO: 337894 - RNA, 19 nt, Homo sapiens
cagaaaugacaccaauaau

SEQ ID NO: 337895 - RNA, 19 nt, Homo sapiens
auccugagcucaaaucucu

SEQ ID NO: 337896 - RNA, 19 nt, Homo sapiens
ccagggaaggugcugaaug

SEQ ID NO: 337897 - RNA, 19 nt, Homo sapiens
uuacuccauuacugugauu

SEQ ID NO: 337898 - RNA, 19 nt, Homo sapiens
uaaauccugagcucaaauc

SEQ ID NO: 337899 - RNA, 19 nt, Homo sapiens
guaaauccugagcucaaau

SEQ ID NO: 337900 - RNA, 19 nt, Homo sapiens
agauuauguuccugcugua

SEQ ID NO: 337901 - RNA, 19 nt, Homo sapiens
gcugaugcagacacagauu

SEQ ID NO: 337902 - RNA, 19 nt, Homo sapiens
guuacuccauuacugugau

SEQ ID NO: 337903 - RNA, 19 nt, Homo sapiens
cagccgagccagcaagauc

SEQ ID NO: 337904 - RNA, 19 nt, Homo sapiens
cacaacagcguggcuuaga

SEQ ID NO: 337905 - RNA, 19 nt, Homo sapiens
ggacaucgauuaaaccuaa

SEQ ID NO: 337906 - RNA, 19 nt, Homo sapiens
ccacaugauugucaccuua

SEQ ID NO: 337907 - RNA, 19 nt, Homo sapiens
ggaaccagcuaccuacuca

SEQ ID NO: 337908 - RNA, 19 nt, Homo sapiens
gaaguccuaucaagagaga

SEQ ID NO: 337909 - RNA, 19 nt, Homo sapiens
ggagggacaucgauuaaac

SEQ ID NO: 337910 - RNA, 19 nt, Homo sapiens
gagggagggacaucgauua

SEQ ID NO: 337911 - RNA, 19 nt, Homo sapiens
gagaggaaccagcuaccua

SEQ ID NO: 337912 - RNA, 19 nt, Homo sapiens
guaucggucuuucaacuau

SEQ ID NO: 337913 - RNA, 19 nt, Homo sapiens
ggaaacgccuggcuaaaau

SEQ ID NO: 337914 - RNA, 19 nt, Homo sapiens
aucaguagcuuggauaaua

SEQ ID NO: 337915 - RNA, 19 nt, Homo sapiens
ucauaccacuugcuauuau

SEQ ID NO: 337916 - RNA, 19 nt, Homo sapiens
gaaguggcucgcaucagua

SEQ ID NO: 337917 - RNA, 19 nt, Homo sapiens
guacagagccaucguuaac

SEQ ID NO: 337918 - RNA, 19 nt, Homo sapiens
gagaauacaaugaacauac

SEQ ID NO: 337919 - RNA, 19 nt, Homo sapiens
agaaguggcucgcaucagu

SEQ ID NO: 337920 - RNA, 19 nt, Homo sapiens
aaggugggcugcaaacuga

SEQ ID NO: 337921 - RNA, 19 nt, Homo sapiens
caaaccacauccuuuacau

SEQ ID NO: 337922 - RNA, 19 nt, Homo sapiens
gaucaugcccucuaagucu

SEQ ID NO: 337923 - RNA, 19 nt, Homo sapiens
gaccaauucuguuuuacua

SEQ ID NO: 337924 - RNA, 19 nt, Homo sapiens
cccaacaucuucaucucua

SEQ ID NO: 337925 - RNA, 19 nt, Homo sapiens
aaauugugcuugucuuugu

SEQ ID NO: 337926 - RNA, 19 nt, Homo sapiens
gcaggaaauggcaauguga

SEQ ID NO: 337927 - RNA, 19 nt, Homo sapiens
ccaacaucuucaucucuaa

SEQ ID NO: 337928 - RNA, 19 nt, Homo sapiens
ggagaauacaaugaacaua

SEQ ID NO: 337929 - RNA, 19 nt, Homo sapiens
cccauuugcucuuuaccua

SEQ ID NO: 337930 - RNA, 19 nt, Homo sapiens
ucaacccauuugcucuuua

SEQ ID NO: 337931 - RNA, 19 nt, Homo sapiens
gcuguuucaucuucuguug

SEQ ID NO: 337932 - RNA, 19 nt, Homo sapiens
gcaacaucaugcuggugaa

SEQ ID NO: 337933 - RNA, 19 nt, Homo sapiens
ggugaccaauucuguuuua

SEQ ID NO: 337934 - RNA, 19 nt, Homo sapiens
cuuggucuauuuccucaua

SEQ ID NO: 337935 - RNA, 19 nt, Homo sapiens
gcaaacugaucccugucau

SEQ ID NO: 337936 - RNA, 19 nt, Homo sapiens
cuaaaugggcacagcauga

SEQ ID NO: 337937 - RNA, 19 nt, Homo sapiens
cauaccacuugcuauuauu

SEQ ID NO: 337938 - RNA, 19 nt, Homo sapiens
ccucauaccacuugcuauu

SEQ ID NO: 337939 - RNA, 19 nt, Homo sapiens
ucaguagcuuggauaauag

SEQ ID NO: 337940 - RNA, 19 nt, Homo sapiens
gaaagcuucaggaggcauu

SEQ ID NO: 337941 - RNA, 19 nt, Homo sapiens
aauagcagcuucacagcau

SEQ ID NO: 337942 - RNA, 19 nt, Homo sapiens
uaaaugggcacagcaugaa

SEQ ID NO: 337943 - RNA, 19 nt, Homo sapiens
ugacaucucugaaaagcaa

SEQ ID NO: 337944 - RNA, 19 nt, Homo sapiens
gagaucaugcccucuaagu

SEQ ID NO: 337945 - RNA, 19 nt, Homo sapiens
caacccauuugcucuuuac

SEQ ID NO: 337946 - RNA, 19 nt, Homo sapiens
uaucggucuuucaacuaua

SEQ ID NO: 337947 - RNA, 19 nt, Homo sapiens
gcguaugacaucucugaaa

SEQ ID NO: 337948 - RNA, 19 nt, Homo sapiens
ggucuuucaacuauaauga

SEQ ID NO: 337949 - RNA, 19 nt, Homo sapiens
ucacagcauguaucccaua

SEQ ID NO: 337950 - RNA, 19 nt, Homo sapiens
uuccaaaccacauccuuua

SEQ ID NO: 337951 - RNA, 19 nt, Homo sapiens
caaucuuccuggagaauac

SEQ ID NO: 337952 - RNA, 19 nt, Homo sapiens
acacaaucuuccuggagaa

SEQ ID NO: 337953 - RNA, 19 nt, Homo sapiens
cuaagucucuuuccaaccu

SEQ ID NO: 337954 - RNA, 19 nt, Homo sapiens
gcaucaguagcuuggauaa

SEQ ID NO: 337955 - RNA, 19 nt, Homo sapiens
caaggugggcugcaaacug

SEQ ID NO: 337956 - RNA, 19 nt, Homo sapiens
gugcguaugacaucucuga

SEQ ID NO: 337957 - RNA, 19 nt, Homo sapiens
gucaacccauuugcucuuu

SEQ ID NO: 337958 - RNA, 19 nt, Homo sapiens
ucccauacccucaaacaga

SEQ ID NO: 337959 - RNA, 19 nt, Homo sapiens
cguaugacaucucugaaaa

SEQ ID NO: 337960 - RNA, 19 nt, Homo sapiens
uuacauguaucggucuuuc

SEQ ID NO: 337961 - RNA, 19 nt, Homo sapiens
ccaaaccacauccuuuaca

SEQ ID NO: 337962 - RNA, 19 nt, Homo sapiens
gacaucgauuaaaccuaaa

SEQ ID NO: 337963 - RNA, 19 nt, Homo sapiens
gguacagagccaucguuaa

SEQ ID NO: 337964 - RNA, 19 nt, Homo sapiens
auccaaagauucauucagu

SEQ ID NO: 337965 - RNA, 19 nt, Homo sapiens
gcaaugcuaagaacauggu

SEQ ID NO: 337966 - RNA, 19 nt, Homo sapiens
ucucuaggccacaugauug

SEQ ID NO: 337967 - RNA, 19 nt, Homo sapiens
cccucaaacagaugaauua

SEQ ID NO: 337968 - RNA, 19 nt, Homo sapiens
cccauacccucaaacagau

SEQ ID NO: 337969 - RNA, 19 nt, Homo sapiens
gggagggacaucgauuaaa

SEQ ID NO: 337970 - RNA, 19 nt, Homo sapiens
aggagaucaugcccucuaa

SEQ ID NO: 337971 - RNA, 19 nt, Homo sapiens
ccucuaagucucuuuccaa

SEQ ID NO: 337972 - RNA, 19 nt, Homo sapiens
gcucuucagcggugcguau

SEQ ID NO: 337973 - RNA, 19 nt, Homo sapiens
uaaaagcgcacacaaucuu

SEQ ID NO: 337974 - RNA, 19 nt, Homo sapiens
uggcaauucuugugucaac

SEQ ID NO: 337975 - RNA, 19 nt, Homo sapiens
cacggaaacgccuggcuaa

SEQ ID NO: 337976 - RNA, 19 nt, Homo sapiens
cauauugcaaagaccuuaa

SEQ ID NO: 337977 - RNA, 19 nt, Homo sapiens
gccacaugauugucaccuu

SEQ ID NO: 337978 - RNA, 19 nt, Homo sapiens
ugugggcuguuucaucuuc

SEQ ID NO: 337979 - RNA, 19 nt, Homo sapiens
uuugugggcuguuucaucu

SEQ ID NO: 337980 - RNA, 19 nt, Homo sapiens
aaggagaucaugcccucua

SEQ ID NO: 337981 - RNA, 19 nt, Homo sapiens
ccgaagcgguguuuucaga

SEQ ID NO: 337982 - RNA, 19 nt, Homo sapiens
acaucaugcuggugaagau

SEQ ID NO: 337983 - RNA, 19 nt, Homo sapiens
acaaucuuccuggagaaua

SEQ ID NO: 337984 - RNA, 19 nt, Homo sapiens
ucauauugcaaagaccuua

SEQ ID NO: 337985 - RNA, 19 nt, Homo sapiens
cucuuuaccuacucaguga

SEQ ID NO: 337986 - RNA, 19 nt, Homo sapiens
gaagcgguguuuucagaag

SEQ ID NO: 337987 - RNA, 19 nt, Homo sapiens
auucuugugucaacccauu

SEQ ID NO: 337988 - RNA, 19 nt, Homo sapiens
cucauaccacuugcuauua

SEQ ID NO: 337989 - RNA, 19 nt, Homo sapiens
ggguuuccguguucacucu

SEQ ID NO: 337990 - RNA, 19 nt, Homo sapiens
gcucagaacuggaucuaug

SEQ ID NO: 337991 - RNA, 19 nt, Homo sapiens
cugaggaacugguagauua

SEQ ID NO: 337992 - RNA, 19 nt, Homo sapiens
caaguuggcaggaacauua

SEQ ID NO: 337993 - RNA, 19 nt, Homo sapiens
ggaccaggcuguaggaaau

SEQ ID NO: 337994 - RNA, 19 nt, Homo sapiens
uacaggaacuucaucauaa

SEQ ID NO: 337995 - RNA, 19 nt, Homo sapiens
gaacuggaucuaugaauga

SEQ ID NO: 337996 - RNA, 19 nt, Homo sapiens
ggaacuucaucauaauuug

SEQ ID NO: 337997 - RNA, 19 nt, Homo sapiens
gagagauuaucaagcguuu

SEQ ID NO: 337998 - RNA, 19 nt, Homo sapiens
gagaucggcuugugguuuc

SEQ ID NO: 337999 - RNA, 19 nt, Homo sapiens
gggcagaccacauugcuuu

SEQ ID NO: 338000 - RNA, 19 nt, Homo sapiens
gcugugaguucucccugua

SEQ ID NO: 338001 - RNA, 19 nt, Homo sapiens
uuacaggaacuucaucaua

SEQ ID NO: 338002 - RNA, 19 nt, Homo sapiens
gaccauccguggagacuuc

SEQ ID NO: 338003 - RNA, 19 nt, Homo sapiens
gaaccauggccaacuguga

SEQ ID NO: 338004 - RNA, 19 nt, Homo sapiens
ggagaucggcuugugguuu

SEQ ID NO: 338005 - RNA, 19 nt, Homo sapiens
ggagacuucugcauacaag

SEQ ID NO: 338006 - RNA, 19 nt, Homo sapiens
agaacuggaucuaugaaug

SEQ ID NO: 338007 - RNA, 19 nt, Homo sapiens
gcauacaaguuggcaggaa

SEQ ID NO: 338008 - RNA, 19 nt, Homo sapiens
gcuguaggaaaucuaguua

SEQ ID NO: 338009 - RNA, 19 nt, Homo sapiens
gaacuucaucauaauuugg

SEQ ID NO: 338010 - RNA, 19 nt, Homo sapiens
acaggaacuucaucauaau

SEQ ID NO: 338011 - RNA, 19 nt, Homo sapiens
ggcaggaacauuauacaug

SEQ ID NO: 338012 - RNA, 19 nt, Homo sapiens
ccacauugcuuuucacauc

SEQ ID NO: 338013 - RNA, 19 nt, Homo sapiens
caggagggcagaccacauu

SEQ ID NO: 338014 - RNA, 19 nt, Homo sapiens
agaaggagaucggcuugug

SEQ ID NO: 338015 - RNA, 19 nt, Homo sapiens
cagccggaguucaaaccua

SEQ ID NO: 338016 - RNA, 19 nt, Homo sapiens
ggucuugugggagagauua

SEQ ID NO: 338017 - RNA, 19 nt, Homo sapiens
cauuauacauggcagugau

SEQ ID NO: 338018 - RNA, 19 nt, Homo sapiens
guaccuucauugcgaucaa

SEQ ID NO: 338019 - RNA, 19 nt, Homo sapiens
agccggaguucaaaccuaa

SEQ ID NO: 338020 - RNA, 19 nt, Homo sapiens
acacuacguugaccugaag

SEQ ID NO: 338021 - RNA, 19 nt, Homo sapiens
caggaacuucaucauaauu

SEQ ID NO: 338022 - RNA, 19 nt, Homo sapiens
gaaggaaccauggccaacu

SEQ ID NO: 338023 - RNA, 19 nt, Homo sapiens
cguggagacuucugcauac

SEQ ID NO: 338024 - RNA, 19 nt, Homo sapiens
ccguggagacuucugcaua

SEQ ID NO: 338025 - RNA, 19 nt, Homo sapiens
gcagaggaccaggcuguag

SEQ ID NO: 338026 - RNA, 19 nt, Homo sapiens
gagauuaucaagcguuuug

SEQ ID NO: 338027 - RNA, 19 nt, Homo sapiens
aaggaaccauggccaacug

SEQ ID NO: 338028 - RNA, 19 nt, Homo sapiens
caaggaacacuacguugac

SEQ ID NO: 338029 - RNA, 19 nt, Homo sapiens
ucucaaggaacacuacguu

SEQ ID NO: 338030 - RNA, 19 nt, Homo sapiens
ggugaaauacaugcacuca

SEQ ID NO: 338031 - RNA, 19 nt, Homo sapiens
guggagacuucugcauaca

SEQ ID NO: 338032 - RNA, 19 nt, Homo sapiens
aacacuacguugaccugaa

SEQ ID NO: 338033 - RNA, 19 nt, Homo sapiens
aagaucuucucaaggaaca

SEQ ID NO: 338034 - RNA, 19 nt, Homo sapiens
ccgccuuguuggucugaaa

SEQ ID NO: 338035 - RNA, 19 nt, Homo sapiens
gcaacaggauugaucauuc

SEQ ID NO: 338036 - RNA, 19 nt, Homo sapiens
gcacuacauugaccugaaa

SEQ ID NO: 338037 - RNA, 19 nt, Homo sapiens
ggacacagcucuucauucc

SEQ ID NO: 338038 - RNA, 19 nt, Homo sapiens
cugaagaacugguugacua

SEQ ID NO: 338039 - RNA, 19 nt, Homo sapiens
gaagacaggccgagugaug

SEQ ID NO: 338040 - RNA, 19 nt, Homo sapiens
caacaggauugaucauucu

SEQ ID NO: 338041 - RNA, 19 nt, Homo sapiens
ugacugggucuaugaauaa

SEQ ID NO: 338042 - RNA, 19 nt, Homo sapiens
ucccugggcuggugaagua

SEQ ID NO: 338043 - RNA, 19 nt, Homo sapiens
ugaagcagcacuacauuga

SEQ ID NO: 338044 - RNA, 19 nt, Homo sapiens
acacagcucuucauuccau

SEQ ID NO: 338045 - RNA, 19 nt, Homo sapiens
gcucaugacugggucuaug

SEQ ID NO: 338046 - RNA, 19 nt, Homo sapiens
gcauucagguuggcaggaa

SEQ ID NO: 338047 - RNA, 19 nt, Homo sapiens
ucauggcagugauucagua

SEQ ID NO: 338048 - RNA, 19 nt, Homo sapiens
guuuaagccugaagaacug

SEQ ID NO: 338049 - RNA, 19 nt, Homo sapiens
gcaccuucaucgccaucaa

SEQ ID NO: 338050 - RNA, 19 nt, Homo sapiens
augacugggucuaugaaua

SEQ ID NO: 338051 - RNA, 19 nt, Homo sapiens
ggcaggaacaucauucaug

SEQ ID NO: 338052 - RNA, 19 nt, Homo sapiens
gugaagacaggccgaguga

SEQ ID NO: 338053 - RNA, 19 nt, Homo sapiens
ccugaaagaccgaccauuc

SEQ ID NO: 338054 - RNA, 19 nt, Homo sapiens
aagaacugguugacuacaa

SEQ ID NO: 338055 - RNA, 19 nt, Homo sapiens
gguuuaagccugaagaacu

SEQ ID NO: 338056 - RNA, 19 nt, Homo sapiens
caggauugaucauucuuuu

SEQ ID NO: 338057 - RNA, 19 nt, Homo sapiens
gcucuucauuccauugacu

SEQ ID NO: 338058 - RNA, 19 nt, Homo sapiens
ucaagcgcuucgagcagaa

SEQ ID NO: 338059 - RNA, 19 nt, Homo sapiens
gggcugaacguggugaaga

SEQ ID NO: 338060 - RNA, 19 nt, Homo sapiens
ggcaacaggauugaucauu

SEQ ID NO: 338061 - RNA, 19 nt, Homo sapiens
ucaaagccaggcaccauuc

SEQ ID NO: 338062 - RNA, 19 nt, Homo sapiens
gaacugguugacuacaagu

SEQ ID NO: 338063 - RNA, 19 nt, Homo sapiens
agaacugguugacuacaag

SEQ ID NO: 338064 - RNA, 19 nt, Homo sapiens
gaagaacugguugacuaca

SEQ ID NO: 338065 - RNA, 19 nt, Homo sapiens
cagguuggcaggaacauca

SEQ ID NO: 338066 - RNA, 19 nt, Homo sapiens
gaggcaacaggauugauca

SEQ ID NO: 338067 - RNA, 19 nt, Homo sapiens
uggcagugauucaguaaaa

SEQ ID NO: 338068 - RNA, 19 nt, Homo sapiens
cugaagaacaccugaagca

SEQ ID NO: 338069 - RNA, 19 nt, Homo sapiens
gggcuggugaaguacauga

SEQ ID NO: 338070 - RNA, 19 nt, Homo sapiens
ggcacuggcuguaugagua

SEQ ID NO: 338071 - RNA, 19 nt, Homo sapiens
caucuucgcuaaccucuuc

SEQ ID NO: 338072 - RNA, 19 nt, Homo sapiens
ccaacgugguccaagguuu

SEQ ID NO: 338073 - RNA, 19 nt, Homo sapiens
gcaccuuccuggccgugaa

SEQ ID NO: 338074 - RNA, 19 nt, Homo sapiens
gcaccgccaucaugaucug

SEQ ID NO: 338075 - RNA, 19 nt, Homo sapiens
gcugggcacuggcuguaug

SEQ ID NO: 338076 - RNA, 19 nt, Homo sapiens
ucaaguugguggcgcugaa

SEQ ID NO: 338077 - RNA, 19 nt, Homo sapiens
gcgcuuggagcaucccuuu

SEQ ID NO: 338078 - RNA, 19 nt, Homo sapiens
gcacuggcuguaugaguag

SEQ ID NO: 338079 - RNA, 19 nt, Homo sapiens
uggacgggcugcugaacau

SEQ ID NO: 338080 - RNA, 19 nt, Homo sapiens
ggauuucugcaucgagguu

SEQ ID NO: 338081 - RNA, 19 nt, Homo sapiens
caacgugguccaagguuuu

SEQ ID NO: 338082 - RNA, 19 nt, Homo sapiens
gcuuggagcaucccuuugg

SEQ ID NO: 338083 - RNA, 19 nt, Homo sapiens
cauaaccucuccucuaaag

SEQ ID NO: 338084 - RNA, 19 nt, Homo sapiens
uaucauaaccucuccucua

SEQ ID NO: 338085 - RNA, 19 nt, Homo sapiens
caacuucagugccuuucug

SEQ ID NO: 338086 - RNA, 19 nt, Homo sapiens
ccacuuacuucccuguuca

SEQ ID NO: 338087 - RNA, 19 nt, Homo sapiens
gaagcccgauggcgugcaa

SEQ ID NO: 338088 - RNA, 19 nt, Homo sapiens
aucauaaccucuccucuaa

SEQ ID NO: 338089 - RNA, 19 nt, Homo sapiens
caaagugccggacaaccuu

SEQ ID NO: 338090 - RNA, 19 nt, Homo sapiens
aaaccugccugucccaaac

SEQ ID NO: 338091 - RNA, 19 nt, Homo sapiens
caaaccugccugucccaaa

SEQ ID NO: 338092 - RNA, 19 nt, Homo sapiens
ggacgugauccagcgcuuu

SEQ ID NO: 338093 - RNA, 19 nt, Homo sapiens
gacgugauccagcgcuuug

SEQ ID NO: 338094 - RNA, 19 nt, Homo sapiens
uaaaggggaggcauuaaaa

SEQ ID NO: 338095 - RNA, 19 nt, Homo sapiens
caacuaccuccgucagcaa

SEQ ID NO: 338096 - RNA, 19 nt, Homo sapiens
caagccagcacaagauugg

SEQ ID NO: 338097 - RNA, 19 nt, Homo sapiens
cuaccuccgucagcaagaa

SEQ ID NO: 338098 - RNA, 19 nt, Homo sapiens
cuucuacccugcccucauc

SEQ ID NO: 338099 - RNA, 19 nt, Homo sapiens
ggggaggcauuaaaauuca

SEQ ID NO: 338100 - RNA, 19 nt, Homo sapiens
gaacccaagcccacaucca

SEQ ID NO: 338101 - RNA, 19 nt, Homo sapiens
gacuucagcguccacauca

SEQ ID NO: 338102 - RNA, 19 nt, Homo sapiens
ccaaagugccggacaaccu

SEQ ID NO: 338103 - RNA, 19 nt, Homo sapiens
ccaagccagcacaagauug

SEQ ID NO: 338104 - RNA, 19 nt, Homo sapiens
guccacaucagcaggaaug

SEQ ID NO: 338105 - RNA, 19 nt, Homo sapiens
ugacuucagcguccacauc

SEQ ID NO: 338106 - RNA, 19 nt, Homo sapiens
gaauguggcuguagaugaa

SEQ ID NO: 338107 - RNA, 19 nt, Homo sapiens
cagcuuugcuccugaaauu

SEQ ID NO: 338108 - RNA, 19 nt, Homo sapiens
guaagaaaguacucauugu

SEQ ID NO: 338109 - RNA, 19 nt, Homo sapiens
cugaagggcuggauggaua

SEQ ID NO: 338110 - RNA, 19 nt, Homo sapiens
gaaaguacucauugucuau

SEQ ID NO: 338111 - RNA, 19 nt, Homo sapiens
gaaccuggcgcaacuccua

SEQ ID NO: 338112 - RNA, 19 nt, Homo sapiens
gaaauugcauccgaagaag

SEQ ID NO: 338113 - RNA, 19 nt, Homo sapiens
acacuucuguggauuuaaa

SEQ ID NO: 338114 - RNA, 19 nt, Homo sapiens
ccacgaagccuacaagcaa

SEQ ID NO: 338115 - RNA, 19 nt, Homo sapiens
gguaagaaaguacucauug

SEQ ID NO: 338116 - RNA, 19 nt, Homo sapiens
cacagugucugauuuguau

SEQ ID NO: 338117 - RNA, 19 nt, Homo sapiens
ugaagaauguggcuguaga

SEQ ID NO: 338118 - RNA, 19 nt, Homo sapiens
agaaaguacucauugucua

SEQ ID NO: 338119 - RNA, 19 nt, Homo sapiens
gaagacaggagucaaugga

SEQ ID NO: 338120 - RNA, 19 nt, Homo sapiens
uuacacuucuguggauuua

SEQ ID NO: 338121 - RNA, 19 nt, Homo sapiens
caacggauccuugaagaau

SEQ ID NO: 338122 - RNA, 19 nt, Homo sapiens
ugaaauugcauccgaagaa

SEQ ID NO: 338123 - RNA, 19 nt, Homo sapiens
ucacugguacucuuucuaa

SEQ ID NO: 338124 - RNA, 19 nt, Homo sapiens
gaagauggugcugucauga

SEQ ID NO: 338125 - RNA, 19 nt, Homo sapiens
ggaggcugaccuagugaua

SEQ ID NO: 338126 - RNA, 19 nt, Homo sapiens
aggcugaccuagugauauu

SEQ ID NO: 338127 - RNA, 19 nt, Homo sapiens
gauaucacugguacucuuu

SEQ ID NO: 338128 - RNA, 19 nt, Homo sapiens
agauggugcugucaugaaa

SEQ ID NO: 338129 - RNA, 19 nt, Homo sapiens
cggccgagauguacacgaa

SEQ ID NO: 338130 - RNA, 19 nt, Homo sapiens
ucacagugucugauuugua

SEQ ID NO: 338131 - RNA, 19 nt, Homo sapiens
gccgagauguacacgaaga

SEQ ID NO: 338132 - RNA, 19 nt, Homo sapiens
gguaaacuagcgcuccuuu

SEQ ID NO: 338133 - RNA, 19 nt, Homo sapiens
agaagauggugcugucaug

SEQ ID NO: 338134 - RNA, 19 nt, Homo sapiens
ccgguuugcuccaggguaa

SEQ ID NO: 338135 - RNA, 19 nt, Homo sapiens
gacaaagauaucacuggua

SEQ ID NO: 338136 - RNA, 19 nt, Homo sapiens
gaagaauguggcuguagau

SEQ ID NO: 338137 - RNA, 19 nt, Homo sapiens
uggacucgcugaagagaga

SEQ ID NO: 338138 - RNA, 19 nt, Homo sapiens
uauggcagguaagaaagua

SEQ ID NO: 338139 - RNA, 19 nt, Homo sapiens
cacgaagccuacaagcaaa

SEQ ID NO: 338140 - RNA, 19 nt, Homo sapiens
gcacuucgggcaauaacuc

SEQ ID NO: 338141 - RNA, 19 nt, Homo sapiens
agauaucacugguacucuu

SEQ ID NO: 338142 - RNA, 19 nt, Homo sapiens
auggugcugucaugaaaua

SEQ ID NO: 338143 - RNA, 19 nt, Homo sapiens
gccagggcuuugccuuuga

SEQ ID NO: 338144 - RNA, 19 nt, Homo sapiens
ucacguaagcagcacacua

SEQ ID NO: 338145 - RNA, 19 nt, Homo sapiens
gaggcacggccgagaugua

SEQ ID NO: 338146 - RNA, 19 nt, Homo sapiens
ucgggaggcugaccuagug

SEQ ID NO: 338147 - RNA, 19 nt, Homo sapiens
uaagaaaguacucauuguc

SEQ ID NO: 338148 - RNA, 19 nt, Homo sapiens
gcacagcccacuggcacuu

SEQ ID NO: 338149 - RNA, 19 nt, Homo sapiens
gggcuuugccuuugacauc

SEQ ID NO: 338150 - RNA, 19 nt, Homo sapiens
caaaucagagagaaggaau

SEQ ID NO: 338151 - RNA, 19 nt, Homo sapiens
auccugagguuuucaauua

SEQ ID NO: 338152 - RNA, 19 nt, Homo sapiens
gccgagggccacagacaaa

SEQ ID NO: 338153 - RNA, 19 nt, Homo sapiens
agaauguggcuguagauga

SEQ ID NO: 338154 - RNA, 19 nt, Homo sapiens
ggugcugucaugaaauaaa

SEQ ID NO: 338155 - RNA, 19 nt, Homo sapiens
accaggaacccaagucuuu

SEQ ID NO: 338156 - RNA, 19 nt, Homo sapiens
ugccagggcuuugccuuug

SEQ ID NO: 338157 - RNA, 19 nt, Homo sapiens
gagagacuacgcaggaaag

SEQ ID NO: 338158 - RNA, 19 nt, Homo sapiens
uugcuggacucgcugaaga

SEQ ID NO: 338159 - RNA, 19 nt, Homo sapiens
gagaagauggugcugucau

SEQ ID NO: 338160 - RNA, 19 nt, Homo sapiens
uauuucaguucccgcugua

SEQ ID NO: 338161 - RNA, 19 nt, Homo sapiens
auucuacgauuccgguuug

SEQ ID NO: 338162 - RNA, 19 nt, Homo sapiens
uuucaauuauggaguggaa

SEQ ID NO: 338163 - RNA, 19 nt, Homo sapiens
gauucuacgauuccgguuu

SEQ ID NO: 338164 - RNA, 19 nt, Homo sapiens
cgucacagugucugauuug

SEQ ID NO: 338165 - RNA, 19 nt, Homo sapiens
gaggcugaccuagugauau

SEQ ID NO: 338166 - RNA, 19 nt, Homo sapiens
gcagguaagaaaguacuca

SEQ ID NO: 338167 - RNA, 19 nt, Homo sapiens
gugccagggcuuugccuuu

SEQ ID NO: 338168 - RNA, 19 nt, Homo sapiens
ggccacagacaaagauauc

SEQ ID NO: 338169 - RNA, 19 nt, Homo sapiens
ccgucacagugucugauuu

SEQ ID NO: 338170 - RNA, 19 nt, Homo sapiens
gugcugucaugaaauaaaa

SEQ ID NO: 338171 - RNA, 19 nt, Homo sapiens
ucaaaucagagagaaggaa

SEQ ID NO: 338172 - RNA, 19 nt, Homo sapiens
cccagaggcugcagaccau

SEQ ID NO: 338173 - RNA, 19 nt, Homo sapiens
gacaggagucaauggagau

SEQ ID NO: 338174 - RNA, 19 nt, Homo sapiens
ccagccacccaucaaauca

SEQ ID NO: 338175 - RNA, 19 nt, Homo sapiens
aaagauaucacugguacuc

SEQ ID NO: 338176 - RNA, 19 nt, Homo sapiens
gcaccgucacagugucuga

SEQ ID NO: 338177 - RNA, 19 nt, Homo sapiens
acggauccuugaagaaugu

SEQ ID NO: 338178 - RNA, 19 nt, Homo sapiens
cauccgaagaagaaagaaa

SEQ ID NO: 338179 - RNA, 19 nt, Homo sapiens
aagagagacuacgcaggaa

SEQ ID NO: 338180 - RNA, 19 nt, Homo sapiens
aauugcauccgaagaagaa

SEQ ID NO: 338181 - RNA, 19 nt, Homo sapiens
guaaacuagcgcuccuuuc

SEQ ID NO: 338182 - RNA, 19 nt, Homo sapiens
ucccaggauucuacgauuc

SEQ ID NO: 338183 - RNA, 19 nt, Homo sapiens
cgagggccacagacaaaga

SEQ ID NO: 338184 - RNA, 19 nt, Homo sapiens
ugauuuguaugccaugaac

SEQ ID NO: 338185 - RNA, 19 nt, Homo sapiens
cuugaagaauguggcugua

SEQ ID NO: 338186 - RNA, 19 nt, Homo sapiens
ccacccaucaaaucagaga

SEQ ID NO: 338187 - RNA, 19 nt, Homo sapiens
gcucagaucucaugggaua

SEQ ID NO: 338188 - RNA, 19 nt, Homo sapiens
caauacaucucacuuguuu

SEQ ID NO: 338189 - RNA, 19 nt, Homo sapiens
aaacagaucuccuggcaaa

SEQ ID NO: 338190 - RNA, 19 nt, Homo sapiens
ggaguuaacgggugaauaa

SEQ ID NO: 338191 - RNA, 19 nt, Homo sapiens
guuaacgggugaauaauaa

SEQ ID NO: 338192 - RNA, 19 nt, Homo sapiens
gaaauugguuggguucauu

SEQ ID NO: 338193 - RNA, 19 nt, Homo sapiens
ggaaauaccaaaugcauug

SEQ ID NO: 338194 - RNA, 19 nt, Homo sapiens
gcauggagcugcacucuag

SEQ ID NO: 338195 - RNA, 19 nt, Homo sapiens
gauguuuggucuuuaauga

SEQ ID NO: 338196 - RNA, 19 nt, Homo sapiens
cagcaaacauccauaucua

SEQ ID NO: 338197 - RNA, 19 nt, Homo sapiens
ggaaccagauguuagauca

SEQ ID NO: 338198 - RNA, 19 nt, Homo sapiens
aagcagaccucauugauug

SEQ ID NO: 338199 - RNA, 19 nt, Homo sapiens
ccagcgaacuugacaauug

SEQ ID NO: 338200 - RNA, 19 nt, Homo sapiens
ggaagaugaugacaacaug

SEQ ID NO: 338201 - RNA, 19 nt, Homo sapiens
gagcugcacucuaggagaa

SEQ ID NO: 338202 - RNA, 19 nt, Homo sapiens
gcagaaauaugaccaugca

SEQ ID NO: 338203 - RNA, 19 nt, Homo sapiens
gacaacauguuccgauuug

SEQ ID NO: 338204 - RNA, 19 nt, Homo sapiens
ccaagaaacugagaccaaa

SEQ ID NO: 338205 - RNA, 19 nt, Homo sapiens
gcucgugauuggcauauaa

SEQ ID NO: 338206 - RNA, 19 nt, Homo sapiens
caaagacgaccagcauuua

SEQ ID NO: 338207 - RNA, 19 nt, Homo sapiens
auacaggaaugaagccuua

SEQ ID NO: 338208 - RNA, 19 nt, Homo sapiens
ggccagaccugccugcauu

SEQ ID NO: 338209 - RNA, 19 nt, Homo sapiens
ggaacaggcucagaucuca

SEQ ID NO: 338210 - RNA, 19 nt, Homo sapiens
ggacaauuucauuccauua

SEQ ID NO: 338211 - RNA, 19 nt, Homo sapiens
gaagcagaccucauugauu

SEQ ID NO: 338212 - RNA, 19 nt, Homo sapiens
caagaggguugcuccaguu

SEQ ID NO: 338213 - RNA, 19 nt, Homo sapiens
cagaagacaucguaugcuu

SEQ ID NO: 338214 - RNA, 19 nt, Homo sapiens
cugcuuagcucaucuuaga

SEQ ID NO: 338215 - RNA, 19 nt, Homo sapiens
gcagagaggauccaggaaa

SEQ ID NO: 338216 - RNA, 19 nt, Homo sapiens
aaagaaagcagcugaacaa

SEQ ID NO: 338217 - RNA, 19 nt, Homo sapiens
ccaaagacgaccagcauuu

SEQ ID NO: 338218 - RNA, 19 nt, Homo sapiens
guccagaccuuugaggaua

SEQ ID NO: 338219 - RNA, 19 nt, Homo sapiens
acaaggauguuuggucuuu

SEQ ID NO: 338220 - RNA, 19 nt, Homo sapiens
acggcaaccugcaguauua

SEQ ID NO: 338221 - RNA, 19 nt, Homo sapiens
ccagguacuugaagcaauu

SEQ ID NO: 338222 - RNA, 19 nt, Homo sapiens
agaagaagaugguagagau

SEQ ID NO: 338223 - RNA, 19 nt, Homo sapiens
caaugacacuggagccaaa

SEQ ID NO: 338224 - RNA, 19 nt, Homo sapiens
acggagaggugacagauuu

SEQ ID NO: 338225 - RNA, 19 nt, Homo sapiens
agaacuauguggaagauga

SEQ ID NO: 338226 - RNA, 19 nt, Homo sapiens
ccucccagcugccauguuu

SEQ ID NO: 338227 - RNA, 19 nt, Homo sapiens
caccugagcagaaauauga

SEQ ID NO: 338228 - RNA, 19 nt, Homo sapiens
cagaggagacauuggcuua

SEQ ID NO: 338229 - RNA, 19 nt, Homo sapiens
ugacagauuuccugagcuu

SEQ ID NO: 338230 - RNA, 19 nt, Homo sapiens
caugagcacugcagcgauu

SEQ ID NO: 338231 - RNA, 19 nt, Homo sapiens
gaagucauccugccaacug

SEQ ID NO: 338232 - RNA, 19 nt, Homo sapiens
caaggauguuuggucuuua

SEQ ID NO: 338233 - RNA, 19 nt, Homo sapiens
agaauaucaucgacacuuu

SEQ ID NO: 338234 - RNA, 19 nt, Homo sapiens
acaagaagcugcguuccaa

SEQ ID NO: 338235 - RNA, 19 nt, Homo sapiens
acacaugccuauuucugaa

SEQ ID NO: 338236 - RNA, 19 nt, Homo sapiens
gcaaagggagcagaacuga

SEQ ID NO: 338237 - RNA, 19 nt, Homo sapiens
ggucucaagucggaaauug

SEQ ID NO: 338238 - RNA, 19 nt, Homo sapiens
ccaaaugcauuguuguucu

SEQ ID NO: 338239 - RNA, 19 nt, Homo sapiens
gugcggaucucuggaguga

SEQ ID NO: 338240 - RNA, 19 nt, Homo sapiens
ggaccuccuuguaacauca

SEQ ID NO: 338241 - RNA, 19 nt, Homo sapiens
uggagaagcucaaguuugg

SEQ ID NO: 338242 - RNA, 19 nt, Homo sapiens
cagagaggauccaggaaau

SEQ ID NO: 338243 - RNA, 19 nt, Homo sapiens
acaucucacuuguuucuaa

SEQ ID NO: 338244 - RNA, 19 nt, Homo sapiens
agaggcuucugucuuauuu

SEQ ID NO: 338245 - RNA, 19 nt, Homo sapiens
ggaaaggcucccuguccua

SEQ ID NO: 338246 - RNA, 19 nt, Homo sapiens
cauuagccauuucuuguug

SEQ ID NO: 338247 - RNA, 19 nt, Homo sapiens
ggagaccauuaucagugua

SEQ ID NO: 338248 - RNA, 19 nt, Homo sapiens
agaccugccugcauucuga

SEQ ID NO: 338249 - RNA, 19 nt, Homo sapiens
gaggagacauuggcuuauc

SEQ ID NO: 338250 - RNA, 19 nt, Homo sapiens
gaaugagaacuauguggaa

SEQ ID NO: 338251 - RNA, 19 nt, Homo sapiens
ggcuaauucugcagaguuu

SEQ ID NO: 338252 - RNA, 19 nt, Homo sapiens
gaagcucaaguuuggcaua

SEQ ID NO: 338253 - RNA, 19 nt, Homo sapiens
caaaugcauuguuguucug

SEQ ID NO: 338254 - RNA, 19 nt, Homo sapiens
ggacaaagugcccaagucu

SEQ ID NO: 338255 - RNA, 19 nt, Homo sapiens
ucaagccucuggucacaug

SEQ ID NO: 338256 - RNA, 19 nt, Homo sapiens
gaauguaacugcugaaaac

SEQ ID NO: 338257 - RNA, 19 nt, Homo sapiens
gagaauaucaucgacacuu

SEQ ID NO: 338258 - RNA, 19 nt, Homo sapiens
ggaaauugguuggguucau

SEQ ID NO: 338259 - RNA, 19 nt, Homo sapiens
aaggauguuuggucuuuaa

SEQ ID NO: 338260 - RNA, 19 nt, Homo sapiens
cagcgaacuugacaauugu

SEQ ID NO: 338261 - RNA, 19 nt, Homo sapiens
uguacacccuccugaauga

SEQ ID NO: 338262 - RNA, 19 nt, Homo sapiens
caaaggccuuggacaacug

SEQ ID NO: 338263 - RNA, 19 nt, Homo sapiens
ggauugacucugcauuuga

SEQ ID NO: 338264 - RNA, 19 nt, Homo sapiens
gaacugaaccggcuuuacc

SEQ ID NO: 338265 - RNA, 19 nt, Homo sapiens
ccacaagagucucaaagcu

SEQ ID NO: 338266 - RNA, 19 nt, Homo sapiens
acacccagcuacuuuaaca

SEQ ID NO: 338267 - RNA, 19 nt, Homo sapiens
cgucaccucuccgcucaua

SEQ ID NO: 338268 - RNA, 19 nt, Homo sapiens
gauagcacguggagcucuu

SEQ ID NO: 338269 - RNA, 19 nt, Homo sapiens
gggaggaaauaccaaaugc

SEQ ID NO: 338270 - RNA, 19 nt, Homo sapiens
ccacaacuccugucuaacu

SEQ ID NO: 338271 - RNA, 19 nt, Homo sapiens
gaggauaucaaaggacaaa

SEQ ID NO: 338272 - RNA, 19 nt, Homo sapiens
gaccaaagaagcugcuguu

SEQ ID NO: 338273 - RNA, 19 nt, Homo sapiens
gcucaauacaucucacuug

SEQ ID NO: 338274 - RNA, 19 nt, Homo sapiens
aaagacgaccagcauuuaa

SEQ ID NO: 338275 - RNA, 19 nt, Homo sapiens
guagggagagagcugagua

SEQ ID NO: 338276 - RNA, 19 nt, Homo sapiens
uuaauuacauccucaugca

SEQ ID NO: 338277 - RNA, 19 nt, Homo sapiens
gaggaaauaccaaaugcau

SEQ ID NO: 338278 - RNA, 19 nt, Homo sapiens
gaggacaauuucauuccau

SEQ ID NO: 338279 - RNA, 19 nt, Homo sapiens
caagauggcggacgagagu

SEQ ID NO: 338280 - RNA, 19 nt, Homo sapiens
ugagcugccucugagauuu

SEQ ID NO: 338281 - RNA, 19 nt, Homo sapiens
ggaaauacagaaggccauu

SEQ ID NO: 338282 - RNA, 19 nt, Homo sapiens
ugacuggcuuugagaagga

SEQ ID NO: 338283 - RNA, 19 nt, Homo sapiens
gaggguugcuccaguucug

SEQ ID NO: 338284 - RNA, 19 nt, Homo sapiens
gagaagaagaugguagaga

SEQ ID NO: 338285 - RNA, 19 nt, Homo sapiens
gaucagccugugaagauga

SEQ ID NO: 338286 - RNA, 19 nt, Homo sapiens
ccacacccagcuacuuuaa

SEQ ID NO: 338287 - RNA, 19 nt, Homo sapiens
gaaagaggcuggcuacaca

SEQ ID NO: 338288 - RNA, 19 nt, Homo sapiens
guacagaagugagacauaa

SEQ ID NO: 338289 - RNA, 19 nt, Homo sapiens
gaggugaucucgcaaaguu

SEQ ID NO: 338290 - RNA, 19 nt, Homo sapiens
agaaguggcugaagaaaga

SEQ ID NO: 338291 - RNA, 19 nt, Homo sapiens
gggcagugcuccaguggua

SEQ ID NO: 338292 - RNA, 19 nt, Homo sapiens
gaagugagacauaauggaa

SEQ ID NO: 338293 - RNA, 19 nt, Homo sapiens
gaagggagaccugcugauu

SEQ ID NO: 338294 - RNA, 19 nt, Homo sapiens
gagcagcuacuacaugauu

SEQ ID NO: 338295 - RNA, 19 nt, Homo sapiens
aagagcagcuacuacauga

SEQ ID NO: 338296 - RNA, 19 nt, Homo sapiens
aguagaggcugcugugaaa

SEQ ID NO: 338297 - RNA, 19 nt, Homo sapiens
gaucauggaugcgcucaag

SEQ ID NO: 338298 - RNA, 19 nt, Homo sapiens
ccugugaccucaauuaaag

SEQ ID NO: 338299 - RNA, 19 nt, Homo sapiens
agggagaccugcugauuga

SEQ ID NO: 338300 - RNA, 19 nt, Homo sapiens
acaccuaucuaagccauuu

SEQ ID NO: 338301 - RNA, 19 nt, Homo sapiens
gcuacacaaucgaaugguu

SEQ ID NO: 338302 - RNA, 19 nt, Homo sapiens
gugcugaagugugauguga

SEQ ID NO: 338303 - RNA, 19 nt, Homo sapiens
caagagcagcuacuacaug

SEQ ID NO: 338304 - RNA, 19 nt, Homo sapiens
ugcaggagcuggagaagug

SEQ ID NO: 338305 - RNA, 19 nt, Homo sapiens
gcuccucucugcuugugaa

SEQ ID NO: 338306 - RNA, 19 nt, Homo sapiens
cagagaaggaggagaaguu

SEQ ID NO: 338307 - RNA, 19 nt, Homo sapiens
ugaccucaauuaaagcaau

SEQ ID NO: 338308 - RNA, 19 nt, Homo sapiens
cuacacaaucgaaugguuu

SEQ ID NO: 338309 - RNA, 19 nt, Homo sapiens
gagaaguggcugaagaaag

SEQ ID NO: 338310 - RNA, 19 nt, Homo sapiens
ggagaaguggcugaagaaa

SEQ ID NO: 338311 - RNA, 19 nt, Homo sapiens
ggugaucucgcaaaguuau

SEQ ID NO: 338312 - RNA, 19 nt, Homo sapiens
gguacagaagugagacaua

SEQ ID NO: 338313 - RNA, 19 nt, Homo sapiens
gaggcuggcuacacaaucg

SEQ ID NO: 338314 - RNA, 19 nt, Homo sapiens
cuggagaaguggcugaaga

SEQ ID NO: 338315 - RNA, 19 nt, Homo sapiens
ucuaggcacucugcagaaa

SEQ ID NO: 338316 - RNA, 19 nt, Homo sapiens
gcugaagugugaugugacu

SEQ ID NO: 338317 - RNA, 19 nt, Homo sapiens
gaaccucggcagccuacug

SEQ ID NO: 338318 - RNA, 19 nt, Homo sapiens
gagaaggaggagaaguuga

SEQ ID NO: 338319 - RNA, 19 nt, Homo sapiens
cuaugugugugaucuugaa

SEQ ID NO: 338320 - RNA, 19 nt, Homo sapiens
uaucagcuccucucugcuu

SEQ ID NO: 338321 - RNA, 19 nt, Homo sapiens
gagaccugcugauugacau

SEQ ID NO: 338322 - RNA, 19 nt, Homo sapiens
caagauauucugccuagac

SEQ ID NO: 338323 - RNA, 19 nt, Homo sapiens
ggagaccugcugauugaca

SEQ ID NO: 338324 - RNA, 19 nt, Homo sapiens
caaggacaccuaucuaagc

SEQ ID NO: 338325 - RNA, 19 nt, Homo sapiens
gaaggaggagaaguugaga

SEQ ID NO: 338326 - RNA, 19 nt, Homo sapiens
gugcuccagugguacagaa

SEQ ID NO: 338327 - RNA, 19 nt, Homo sapiens
ccaaggacaccuaucuaag

SEQ ID NO: 338328 - RNA, 19 nt, Homo sapiens
guccagagaaggaggagaa

SEQ ID NO: 338329 - RNA, 19 nt, Homo sapiens
ucaaggguccagagaagga

SEQ ID NO: 338330 - RNA, 19 nt, Homo sapiens
agucaaggguccagagaag

SEQ ID NO: 338331 - RNA, 19 nt, Homo sapiens
uccaaggacaccuaucuaa

SEQ ID NO: 338332 - RNA, 19 nt, Homo sapiens
uagaggcugcugugaaaga

SEQ ID NO: 338333 - RNA, 19 nt, Homo sapiens
caguagaggcugcugugaa

SEQ ID NO: 338334 - RNA, 19 nt, Homo sapiens
acagaagugagacauaaug

SEQ ID NO: 338335 - RNA, 19 nt, Homo sapiens
gccugugaccucaauuaaa

SEQ ID NO: 338336 - RNA, 19 nt, Homo sapiens
aaucaggcuucaccuccaa

SEQ ID NO: 338337 - RNA, 19 nt, Homo sapiens
cgaaugguuugaggugauc

SEQ ID NO: 338338 - RNA, 19 nt, Homo sapiens
ugaccuaugugugugaucu

SEQ ID NO: 338339 - RNA, 19 nt, Homo sapiens
caacaacgaaggacuuuuc

SEQ ID NO: 338340 - RNA, 19 nt, Homo sapiens
ucgaaugguuugaggugau

SEQ ID NO: 338341 - RNA, 19 nt, Homo sapiens
ugagacaggcggucaagca

SEQ ID NO: 338342 - RNA, 19 nt, Homo sapiens
gccaacaacgaaggacuuu

SEQ ID NO: 338343 - RNA, 19 nt, Homo sapiens
gcagugcuccagugguaca

SEQ ID NO: 338344 - RNA, 19 nt, Homo sapiens
agugagacauaauggaauc

SEQ ID NO: 338345 - RNA, 19 nt, Homo sapiens
ugaagugugaugugacuca

SEQ ID NO: 338346 - RNA, 19 nt, Homo sapiens
gagucaaggguccagagaa

SEQ ID NO: 338347 - RNA, 19 nt, Homo sapiens
ggccaacaacgaaggacuu

SEQ ID NO: 338348 - RNA, 19 nt, Homo sapiens
uggagaaguggcugaagaa

SEQ ID NO: 338349 - RNA, 19 nt, Homo sapiens
aagggagaccugcugauug

SEQ ID NO: 338350 - RNA, 19 nt, Homo sapiens
cagcuccucucugcuugug

SEQ ID NO: 338351 - RNA, 19 nt, Homo sapiens
gcaacgaucaccuaaauua

SEQ ID NO: 338352 - RNA, 19 nt, Homo sapiens
agaaggaucuggccauuua

SEQ ID NO: 338353 - RNA, 19 nt, Homo sapiens
ggaagacucugaagaagau

SEQ ID NO: 338354 - RNA, 19 nt, Homo sapiens
agacagaacucgucagauu

SEQ ID NO: 338355 - RNA, 19 nt, Homo sapiens
gcauacccaugaaauuuaa

SEQ ID NO: 338356 - RNA, 19 nt, Homo sapiens
ggaggaagacucugaagaa

SEQ ID NO: 338357 - RNA, 19 nt, Homo sapiens
gaaagcugccuuccagaaa

SEQ ID NO: 338358 - RNA, 19 nt, Homo sapiens
gacaggaaauucugaaaca

SEQ ID NO: 338359 - RNA, 19 nt, Homo sapiens
gguagacuaugcucugaaa

SEQ ID NO: 338360 - RNA, 19 nt, Homo sapiens
gcagaagggugccgagaca

SEQ ID NO: 338361 - RNA, 19 nt, Homo sapiens
gaggaugccuucucuacug

SEQ ID NO: 338362 - RNA, 19 nt, Homo sapiens
ggagucaccaacaccauua

SEQ ID NO: 338363 - RNA, 19 nt, Homo sapiens
caagaaggaucuggccauu

SEQ ID NO: 338364 - RNA, 19 nt, Homo sapiens
aagcaacgaucaccuaaau

SEQ ID NO: 338365 - RNA, 19 nt, Homo sapiens
ugucugagcugguggaguu

SEQ ID NO: 338366 - RNA, 19 nt, Homo sapiens
gaagggcggucucguucug

SEQ ID NO: 338367 - RNA, 19 nt, Homo sapiens
ggacgaggaggaagagaaa

SEQ ID NO: 338368 - RNA, 19 nt, Homo sapiens
gaggcuaccugguuuacug

SEQ ID NO: 338369 - RNA, 19 nt, Homo sapiens
gugcauacccaugaaauuu

SEQ ID NO: 338370 - RNA, 19 nt, Homo sapiens
ggacuagugguguaugauu

SEQ ID NO: 338371 - RNA, 19 nt, Homo sapiens
gaaacagccacaccuacaa

SEQ ID NO: 338372 - RNA, 19 nt, Homo sapiens
caauauggauggguucuuc

SEQ ID NO: 338373 - RNA, 19 nt, Homo sapiens
gucaaagacuggacuagug

SEQ ID NO: 338374 - RNA, 19 nt, Homo sapiens
gagauugggcucuguugaa

SEQ ID NO: 338375 - RNA, 19 nt, Homo sapiens
caaagaggaagaaaucuca

SEQ ID NO: 338376 - RNA, 19 nt, Homo sapiens
cgacgcuucuacccucaua

SEQ ID NO: 338377 - RNA, 19 nt, Homo sapiens
cagcaaagaggaagaaauc

SEQ ID NO: 338378 - RNA, 19 nt, Homo sapiens
gugcucaccuccagaagga

SEQ ID NO: 338379 - RNA, 19 nt, Homo sapiens
agacuggacuaguggugua

SEQ ID NO: 338380 - RNA, 19 nt, Homo sapiens
gagcugacuccaacucuga

SEQ ID NO: 338381 - RNA, 19 nt, Homo sapiens
gaggaagacucugaagaag

SEQ ID NO: 338382 - RNA, 19 nt, Homo sapiens
ugaaccggcucaagaagga

SEQ ID NO: 338383 - RNA, 19 nt, Homo sapiens
gaagcuaaagcaacgauca

SEQ ID NO: 338384 - RNA, 19 nt, Homo sapiens
uaaagcaacgaucaccuaa

SEQ ID NO: 338385 - RNA, 19 nt, Homo sapiens
uggcccagcugaugaagaa

SEQ ID NO: 338386 - RNA, 19 nt, Homo sapiens
ggaggaagagaaagaagug

SEQ ID NO: 338387 - RNA, 19 nt, Homo sapiens
aagcguugcugcccauuga

SEQ ID NO: 338388 - RNA, 19 nt, Homo sapiens
uaaaaccucuggccacuga

SEQ ID NO: 338389 - RNA, 19 nt, Homo sapiens
aaaggugacugggaagcua

SEQ ID NO: 338390 - RNA, 19 nt, Homo sapiens
gcacaggcucuaaucaauc

SEQ ID NO: 338391 - RNA, 19 nt, Homo sapiens
gaaagagggcagccaagag

SEQ ID NO: 338392 - RNA, 19 nt, Homo sapiens
gcaaagaggaagaaaucuc

SEQ ID NO: 338393 - RNA, 19 nt, Homo sapiens
gcagccagccagccaagaa

SEQ ID NO: 338394 - RNA, 19 nt, Homo sapiens
gaggaagggcggucucguu

SEQ ID NO: 338395 - RNA, 19 nt, Homo sapiens
cuaaagcaacgaucaccua

SEQ ID NO: 338396 - RNA, 19 nt, Homo sapiens
gaagggugccgagacagaa

SEQ ID NO: 338397 - RNA, 19 nt, Homo sapiens
uugccaaguucaagaaauu

SEQ ID NO: 338398 - RNA, 19 nt, Homo sapiens
gacuagugguguaugauuc

SEQ ID NO: 338399 - RNA, 19 nt, Homo sapiens
aaauuacaguccuccaaga

SEQ ID NO: 338400 - RNA, 19 nt, Homo sapiens
aaacagccacaccuacaaa

SEQ ID NO: 338401 - RNA, 19 nt, Homo sapiens
gagcggauccuggacaugu

SEQ ID NO: 338402 - RNA, 19 nt, Homo sapiens
gcagaucaauguggaugag

SEQ ID NO: 338403 - RNA, 19 nt, Homo sapiens
ggagauugggcucuguuga

SEQ ID NO: 338404 - RNA, 19 nt, Homo sapiens
ugaauggcaucuccaaagg

SEQ ID NO: 338405 - RNA, 19 nt, Homo sapiens
uuacaguccuccaagaaag

SEQ ID NO: 338406 - RNA, 19 nt, Homo sapiens
ccacgggccuagacuuugg

SEQ ID NO: 338407 - RNA, 19 nt, Homo sapiens
gcacuggggucaucuccaa

SEQ ID NO: 338408 - RNA, 19 nt, Homo sapiens
gcaaguuggacccuacgaa

SEQ ID NO: 338409 - RNA, 19 nt, Homo sapiens
cgaaagagggcagccaaga

SEQ ID NO: 338410 - RNA, 19 nt, Homo sapiens
gugugauccuugccaauga

SEQ ID NO: 338411 - RNA, 19 nt, Homo sapiens
guaccuggcugggcacuac

SEQ ID NO: 338412 - RNA, 19 nt, Homo sapiens
uacgguagaugacuaugga

SEQ ID NO: 338413 - RNA, 19 nt, Homo sapiens
ugcauacccaugaaauuua

SEQ ID NO: 338414 - RNA, 19 nt, Homo sapiens
gggcacagacacacaaaca

SEQ ID NO: 338415 - RNA, 19 nt, Homo sapiens
guucuucauugccaaguuc

SEQ ID NO: 338416 - RNA, 19 nt, Homo sapiens
gaguugcuccugagugcua

SEQ ID NO: 338417 - RNA, 19 nt, Homo sapiens
gauccagccgugaagacua

SEQ ID NO: 338418 - RNA, 19 nt, Homo sapiens
ccaaggauccagccgugaa

SEQ ID NO: 338419 - RNA, 19 nt, Homo sapiens
gaggaaagaccagcuacau

SEQ ID NO: 338420 - RNA, 19 nt, Homo sapiens
ugaagacuaacaaggauga

SEQ ID NO: 338421 - RNA, 19 nt, Homo sapiens
ggaggaggaagacucugaa

SEQ ID NO: 338422 - RNA, 19 nt, Homo sapiens
acucagaauuguccacugu

SEQ ID NO: 338423 - RNA, 19 nt, Homo sapiens
aaacagcaacaucccaaga

SEQ ID NO: 338424 - RNA, 19 nt, Homo sapiens
cuacauggcccagcugaug

SEQ ID NO: 338425 - RNA, 19 nt, Homo sapiens
gaucaauguggaugaggaa

SEQ ID NO: 338426 - RNA, 19 nt, Homo sapiens
cuacugugcauacccauga

SEQ ID NO: 338427 - RNA, 19 nt, Homo sapiens
agaaagcugccuuccagaa

SEQ ID NO: 338428 - RNA, 19 nt, Homo sapiens
gacagaacucgucagauuc

SEQ ID NO: 338429 - RNA, 19 nt, Homo sapiens
ugaaacagccacaccuaca

SEQ ID NO: 338430 - RNA, 19 nt, Homo sapiens
auggauggguucuucauug

SEQ ID NO: 338431 - RNA, 19 nt, Homo sapiens
ggcggucucguucugaaua

SEQ ID NO: 338432 - RNA, 19 nt, Homo sapiens
cugauacgguagaugacua

SEQ ID NO: 338433 - RNA, 19 nt, Homo sapiens
agacuaacaaggaugagaa

SEQ ID NO: 338434 - RNA, 19 nt, Homo sapiens
cgugaagacuaacaaggau

SEQ ID NO: 338435 - RNA, 19 nt, Homo sapiens
gggagucaccaacaccauu

SEQ ID NO: 338436 - RNA, 19 nt, Homo sapiens
gcaagcucauggaccucuu

SEQ ID NO: 338437 - RNA, 19 nt, Homo sapiens
ugggaauucugcgugauuu

SEQ ID NO: 338438 - RNA, 19 nt, Homo sapiens
aggccacccugaaaccuaa

SEQ ID NO: 338439 - RNA, 19 nt, Homo sapiens
cacuguaccuucugucaca

SEQ ID NO: 338440 - RNA, 19 nt, Homo sapiens
cagccacaccuacaaaugu

SEQ ID NO: 338441 - RNA, 19 nt, Homo sapiens
gaagcguugcugcccauug

SEQ ID NO: 338442 - RNA, 19 nt, Homo sapiens
ggaacucuugccucuguga

SEQ ID NO: 338443 - RNA, 19 nt, Homo sapiens
caagggcacagacacacaa

SEQ ID NO: 338444 - RNA, 19 nt, Homo sapiens
ucagaauuguccacuguac

SEQ ID NO: 338445 - RNA, 19 nt, Homo sapiens
agacuugccucaggucauc

SEQ ID NO: 338446 - RNA, 19 nt, Homo sapiens
uacugcaccuguucuauca

SEQ ID NO: 338447 - RNA, 19 nt, Homo sapiens
cuaacaaggaugagaagga

SEQ ID NO: 338448 - RNA, 19 nt, Homo sapiens
ggugugauccuugccaaug

SEQ ID NO: 338449 - RNA, 19 nt, Homo sapiens
ggucaaagacuggacuagu

SEQ ID NO: 338450 - RNA, 19 nt, Homo sapiens
ugcacaggcucuaaucaau

SEQ ID NO: 338451 - RNA, 19 nt, Homo sapiens
caaccucacuugcuucuua

SEQ ID NO: 338452 - RNA, 19 nt, Homo sapiens
cagagaagcugguuauaaa

SEQ ID NO: 338453 - RNA, 19 nt, Homo sapiens
caaaguggauccaguuaga

SEQ ID NO: 338454 - RNA, 19 nt, Homo sapiens
gaagccagcugcucggaaa

SEQ ID NO: 338455 - RNA, 19 nt, Homo sapiens
cuauugaccugaagaauuu

SEQ ID NO: 338456 - RNA, 19 nt, Homo sapiens
gaagaaaugaggaaacuau

SEQ ID NO: 338457 - RNA, 19 nt, Homo sapiens
gcaauucugugugguauau

SEQ ID NO: 338458 - RNA, 19 nt, Homo sapiens
aaugaaggcuugacuauug

SEQ ID NO: 338459 - RNA, 19 nt, Homo sapiens
agagagggcuguagucauu

SEQ ID NO: 338460 - RNA, 19 nt, Homo sapiens
ccauuaaucuugaucauuc

SEQ ID NO: 338461 - RNA, 19 nt, Homo sapiens
cgacaucacugaggaagaa

SEQ ID NO: 338462 - RNA, 19 nt, Homo sapiens
ggauggaacuuugggauug

SEQ ID NO: 338463 - RNA, 19 nt, Homo sapiens
gaaagcaucaucaacauca

SEQ ID NO: 338464 - RNA, 19 nt, Homo sapiens
gcacgaagaagaaaugaug

SEQ ID NO: 338465 - RNA, 19 nt, Homo sapiens
ccaacgaacugcuggaaga

SEQ ID NO: 338466 - RNA, 19 nt, Homo sapiens
gguguacuguguuugauuu

SEQ ID NO: 338467 - RNA, 19 nt, Homo sapiens
ccagagaaacugccacaua

SEQ ID NO: 338468 - RNA, 19 nt, Homo sapiens
caagaaagcaucaucaaca

SEQ ID NO: 338469 - RNA, 19 nt, Homo sapiens
uacauacgguucuguuaua

SEQ ID NO: 338470 - RNA, 19 nt, Homo sapiens
gugagaagcuggagaugga

SEQ ID NO: 338471 - RNA, 19 nt, Homo sapiens
gaaaaggcauuguugaguu

SEQ ID NO: 338472 - RNA, 19 nt, Homo sapiens
ugaggaaacuauuugagaa

SEQ ID NO: 338473 - RNA, 19 nt, Homo sapiens
ccugaagucucuaauguga

SEQ ID NO: 338474 - RNA, 19 nt, Homo sapiens
caaggaggcucgugagaag

SEQ ID NO: 338475 - RNA, 19 nt, Homo sapiens
ccaguuagaugaugaagag

SEQ ID NO: 338476 - RNA, 19 nt, Homo sapiens
aaacaaacgucgccgauac

SEQ ID NO: 338477 - RNA, 19 nt, Homo sapiens
gaucucggcucacugcaau

SEQ ID NO: 338478 - RNA, 19 nt, Homo sapiens
gggaaaccauggcaaagug

SEQ ID NO: 338479 - RNA, 19 nt, Homo sapiens
gaggagaagucgagguuag

SEQ ID NO: 338480 - RNA, 19 nt, Homo sapiens
cagagaaacugccacauac

SEQ ID NO: 338481 - RNA, 19 nt, Homo sapiens
aaguggagcuggacaauau

SEQ ID NO: 338482 - RNA, 19 nt, Homo sapiens
gaacuccuccugcauucaa

SEQ ID NO: 338483 - RNA, 19 nt, Homo sapiens
uagcggagauugccaaagu

SEQ ID NO: 338484 - RNA, 19 nt, Homo sapiens
guacauacgguucuguuau

SEQ ID NO: 338485 - RNA, 19 nt, Homo sapiens
gggauuccuuccaauaguu

SEQ ID NO: 338486 - RNA, 19 nt, Homo sapiens
gggauuccuuccaauaguu

SEQ ID NO: 338487 - RNA, 19 nt, Homo sapiens
gagagcagccacccagauu

SEQ ID NO: 338488 - RNA, 19 nt, Homo sapiens
uggaagagcugcacaacca

SEQ ID NO: 338489 - RNA, 19 nt, Homo sapiens
uaacuugccuccaucuuuu

SEQ ID NO: 338490 - RNA, 19 nt, Homo sapiens
guacuacucuaagggauuc

SEQ ID NO: 338491 - RNA, 19 nt, Homo sapiens
gauggaacuuugggauuga

SEQ ID NO: 338492 - RNA, 19 nt, Homo sapiens
gagcagccacccagauuug

SEQ ID NO: 338493 - RNA, 19 nt, Homo sapiens
gaggaaacuauuugagaaa

SEQ ID NO: 338494 - RNA, 19 nt, Homo sapiens
caacaggccagcagccaaa

SEQ ID NO: 338495 - RNA, 19 nt, Homo sapiens
cuaauaaguugcagugucu

SEQ ID NO: 338496 - RNA, 19 nt, Homo sapiens
caggguuacuguauacuga

SEQ ID NO: 338497 - RNA, 19 nt, Homo sapiens
ucucuaaugugacuguuga

SEQ ID NO: 338498 - RNA, 19 nt, Homo sapiens
gaugaggcgccaagaagaa

SEQ ID NO: 338499 - RNA, 19 nt, Homo sapiens
ggauuccuuccaauaguua

SEQ ID NO: 338500 - RNA, 19 nt, Homo sapiens
ggauuccuuccaauaguua

SEQ ID NO: 338501 - RNA, 19 nt, Homo sapiens
caaacaaacgucgccgaua

SEQ ID NO: 338502 - RNA, 19 nt, Homo sapiens
ucauugagauggagaagca

SEQ ID NO: 338503 - RNA, 19 nt, Homo sapiens
aagagggacuuccagagaa

SEQ ID NO: 338504 - RNA, 19 nt, Homo sapiens
gaaaccuuccucaguaugu

SEQ ID NO: 338505 - RNA, 19 nt, Homo sapiens
uucgaaaccuuccucagua

SEQ ID NO: 338506 - RNA, 19 nt, Homo sapiens
ggacuagccagaauucuac

SEQ ID NO: 338507 - RNA, 19 nt, Homo sapiens
aaacgucgccgauacuaau

SEQ ID NO: 338508 - RNA, 19 nt, Homo sapiens
accaacaacugaacgcuuu

SEQ ID NO: 338509 - RNA, 19 nt, Homo sapiens
caaguggaccgcaacauca

SEQ ID NO: 338510 - RNA, 19 nt, Homo sapiens
gaucuacccugccuguacu

SEQ ID NO: 338511 - RNA, 19 nt, Homo sapiens
gaucuacccugccuguacu

SEQ ID NO: 338512 - RNA, 19 nt, Homo sapiens
ccagcaauuucacaaggaa

SEQ ID NO: 338513 - RNA, 19 nt, Homo sapiens
gcaaaaccauacuccaaga

SEQ ID NO: 338514 - RNA, 19 nt, Homo sapiens
guucaagcuuguccagguu

SEQ ID NO: 338515 - RNA, 19 nt, Homo sapiens
ggaguguaguggcaugauc

SEQ ID NO: 338516 - RNA, 19 nt, Homo sapiens
guacuguguuugauuuguc

SEQ ID NO: 338517 - RNA, 19 nt, Homo sapiens
ucauugguguacuguguuu

SEQ ID NO: 338518 - RNA, 19 nt, Homo sapiens
ucuaugauguugcuguuca

SEQ ID NO: 338519 - RNA, 19 nt, Homo sapiens
ucacuugcuucuuauccuu

SEQ ID NO: 338520 - RNA, 19 nt, Homo sapiens
caucuuguuucauuugcuu

SEQ ID NO: 338521 - RNA, 19 nt, Homo sapiens
aagaaagcaucaucaacau

SEQ ID NO: 338522 - RNA, 19 nt, Homo sapiens
gaugccggauggaacuuug

SEQ ID NO: 338523 - RNA, 19 nt, Homo sapiens
gcuggaaggcacucauuga

SEQ ID NO: 338524 - RNA, 19 nt, Homo sapiens
ccauggaccaguuagauga

SEQ ID NO: 338525 - RNA, 19 nt, Homo sapiens
gaacugggaggcacuuugc

SEQ ID NO: 338526 - RNA, 19 nt, Homo sapiens
cuccugaccucgugaucua

SEQ ID NO: 338527 - RNA, 19 nt, Homo sapiens
ccaguuagagcccauuaau

SEQ ID NO: 338528 - RNA, 19 nt, Homo sapiens
gcaaaguggauccaguuag

SEQ ID NO: 338529 - RNA, 19 nt, Homo sapiens
ggcaaaguggauccaguua

SEQ ID NO: 338530 - RNA, 19 nt, Homo sapiens
ggaaaaguguuagggauuc

SEQ ID NO: 338531 - RNA, 19 nt, Homo sapiens
gugcauuccugaagucucu

SEQ ID NO: 338532 - RNA, 19 nt, Homo sapiens
ucaaaacccuuaaaagaag

SEQ ID NO: 338533 - RNA, 19 nt, Homo sapiens
caaacgucgccgauacuaa

SEQ ID NO: 338534 - RNA, 19 nt, Homo sapiens
gcagcugcgugugcgcuuu

SEQ ID NO: 338535 - RNA, 19 nt, Homo sapiens
ggaagaaaugaggaaacua

SEQ ID NO: 338536 - RNA, 19 nt, Homo sapiens
ugauaggccuaguacaauc

SEQ ID NO: 338537 - RNA, 19 nt, Homo sapiens
uuaacuugccuccaucuuu

SEQ ID NO: 338538 - RNA, 19 nt, Homo sapiens
uagagcccauuaaucuuga

SEQ ID NO: 338539 - RNA, 19 nt, Homo sapiens
aaaccauacuccaagaaag

SEQ ID NO: 338540 - RNA, 19 nt, Homo sapiens
ggaacugggaggcacuuug

SEQ ID NO: 338541 - RNA, 19 nt, Homo sapiens
ucgaaaccuuccucaguau

SEQ ID NO: 338542 - RNA, 19 nt, Homo sapiens
guucacagcuuuucuugau

SEQ ID NO: 338543 - RNA, 19 nt, Homo sapiens
aaacaaugcaauucugugu

SEQ ID NO: 338544 - RNA, 19 nt, Homo sapiens
uuagggauuccuuccaaua

SEQ ID NO: 338545 - RNA, 19 nt, Homo sapiens
ugucugcaaucgaaguuga

SEQ ID NO: 338546 - RNA, 19 nt, Homo sapiens
gaaaggcaggcgaagucuu

SEQ ID NO: 338547 - RNA, 19 nt, Homo sapiens
uuagagcccauuaaucuug

SEQ ID NO: 338548 - RNA, 19 nt, Homo sapiens
aaguugcagugucuaguuu

SEQ ID NO: 338549 - RNA, 19 nt, Homo sapiens
uaaguugcagugucuaguu

SEQ ID NO: 338550 - RNA, 19 nt, Homo sapiens
cuaaugagacaggauuuga

SEQ ID NO: 338551 - RNA, 19 nt, Homo sapiens
ggagggacauuaagaaaua

SEQ ID NO: 338552 - RNA, 19 nt, Homo sapiens
ggaaagaguugccauaaug

SEQ ID NO: 338553 - RNA, 19 nt, Homo sapiens
ccacguggcuucuucgaua

SEQ ID NO: 338554 - RNA, 19 nt, Homo sapiens
gagcagagcccucauguga

SEQ ID NO: 338555 - RNA, 19 nt, Homo sapiens
ccaaagaguuuauugauca

SEQ ID NO: 338556 - RNA, 19 nt, Homo sapiens
ccaagaagaugaacuuaga

SEQ ID NO: 338557 - RNA, 19 nt, Homo sapiens
gaaguuauguuguucaaag

SEQ ID NO: 338558 - RNA, 19 nt, Homo sapiens
ggaagaauaugacauugug

SEQ ID NO: 338559 - RNA, 19 nt, Homo sapiens
gaucgcagcuggaagagaa

SEQ ID NO: 338560 - RNA, 19 nt, Homo sapiens
gaacacgcaugucuggaaa

SEQ ID NO: 338561 - RNA, 19 nt, Homo sapiens
acacagagcucaucuaugg

SEQ ID NO: 338562 - RNA, 19 nt, Homo sapiens
gggcauaucuuguuguuca

SEQ ID NO: 338563 - RNA, 19 nt, Homo sapiens
gaagauacccagagaauag

SEQ ID NO: 338564 - RNA, 19 nt, Homo sapiens
gaagggaagcccauucuaa

SEQ ID NO: 338565 - RNA, 19 nt, Homo sapiens
ccacagauauaaagaacaa

SEQ ID NO: 338566 - RNA, 19 nt, Homo sapiens
auaaggaucuucccacuuu

SEQ ID NO: 338567 - RNA, 19 nt, Homo sapiens
gaaagaggcauucccagaa

SEQ ID NO: 338568 - RNA, 19 nt, Homo sapiens
caacagcggcaauuugaua

SEQ ID NO: 338569 - RNA, 19 nt, Homo sapiens
ccucguguguccauaauua

SEQ ID NO: 338570 - RNA, 19 nt, Homo sapiens
gagaggauccugaagauga

SEQ ID NO: 338571 - RNA, 19 nt, Homo sapiens
gauaaaggagggacauuaa

SEQ ID NO: 338572 - RNA, 19 nt, Homo sapiens
gaagugaccaaccgccuua

SEQ ID NO: 338573 - RNA, 19 nt, Homo sapiens
gaaauucggcugugcuuug

SEQ ID NO: 338574 - RNA, 19 nt, Homo sapiens
gguccaagcugcagguauu

SEQ ID NO: 338575 - RNA, 19 nt, Homo sapiens
caguugaucuccaaaguuu

SEQ ID NO: 338576 - RNA, 19 nt, Homo sapiens
gcagagcccucaugugaca

SEQ ID NO: 338577 - RNA, 19 nt, Homo sapiens
uggaagaggugaacaaaga

SEQ ID NO: 338578 - RNA, 19 nt, Homo sapiens
acaaugaacugcucaagga

SEQ ID NO: 338579 - RNA, 19 nt, Homo sapiens
gcacuggcccucuuugaaa

SEQ ID NO: 338580 - RNA, 19 nt, Homo sapiens
ggagaggagugggaaauug

SEQ ID NO: 338581 - RNA, 19 nt, Homo sapiens
gaagaugaacuuagacaug

SEQ ID NO: 338582 - RNA, 19 nt, Homo sapiens
gcuagaaucacuugacuuu

SEQ ID NO: 338583 - RNA, 19 nt, Homo sapiens
gaaacgggaugcacugagu

SEQ ID NO: 338584 - RNA, 19 nt, Homo sapiens
ggauaaaggagggacauua

SEQ ID NO: 338585 - RNA, 19 nt, Homo sapiens
cauacgaaccuaaagaaua

SEQ ID NO: 338586 - RNA, 19 nt, Homo sapiens
ggacacagagcucaucuau

SEQ ID NO: 338587 - RNA, 19 nt, Homo sapiens
gaaagaguugccauaauga

SEQ ID NO: 338588 - RNA, 19 nt, Homo sapiens
ugaaggagcgggucaguaa

SEQ ID NO: 338589 - RNA, 19 nt, Homo sapiens
gcucagucccuacauauuu

SEQ ID NO: 338590 - RNA, 19 nt, Homo sapiens
gaagugcacuggcccucuu

SEQ ID NO: 338591 - RNA, 19 nt, Homo sapiens
gcacuuaccagcucaagga

SEQ ID NO: 338592 - RNA, 19 nt, Homo sapiens
gauacaggcugacgaacug

SEQ ID NO: 338593 - RNA, 19 nt, Homo sapiens
aggcagagaugaaagauau

SEQ ID NO: 338594 - RNA, 19 nt, Homo sapiens
agaauuugcugcauuuaga

SEQ ID NO: 338595 - RNA, 19 nt, Homo sapiens
ggacgucacugcuaauucg

SEQ ID NO: 338596 - RNA, 19 nt, Homo sapiens
ccaggagacuguuaaagug

SEQ ID NO: 338597 - RNA, 19 nt, Homo sapiens
gcucuucccucucgccaaa

SEQ ID NO: 338598 - RNA, 19 nt, Homo sapiens
acgcugagcugacgucaaa

SEQ ID NO: 338599 - RNA, 19 nt, Homo sapiens
ucacuuccuuagagaauaa

SEQ ID NO: 338600 - RNA, 19 nt, Homo sapiens
caaugaagauacccagaga

SEQ ID NO: 338601 - RNA, 19 nt, Homo sapiens
uuaagcacauggagaauga

SEQ ID NO: 338602 - RNA, 19 nt, Homo sapiens
ggucugccaucaccauauu

SEQ ID NO: 338603 - RNA, 19 nt, Homo sapiens
acaaauaaguuacccucaa

SEQ ID NO: 338604 - RNA, 19 nt, Homo sapiens
aauggaagcugguuaaagu

SEQ ID NO: 338605 - RNA, 19 nt, Homo sapiens
aagaugaacuuagacauga

SEQ ID NO: 338606 - RNA, 19 nt, Homo sapiens
gcaaugacccugagcucuu

SEQ ID NO: 338607 - RNA, 19 nt, Homo sapiens
gggagaggauccugaagau

SEQ ID NO: 338608 - RNA, 19 nt, Homo sapiens
ggagaacgaccgagucuuc

SEQ ID NO: 338609 - RNA, 19 nt, Homo sapiens
gaugaaagauaugggaauc

SEQ ID NO: 338610 - RNA, 19 nt, Homo sapiens
gaucacauguucgguguuc

SEQ ID NO: 338611 - RNA, 19 nt, Homo sapiens
cuaacaggcuggcaaugaa

SEQ ID NO: 338612 - RNA, 19 nt, Homo sapiens
ugauguccauggaagaaua

SEQ ID NO: 338613 - RNA, 19 nt, Homo sapiens
gaaagcgaccauccucuau

SEQ ID NO: 338614 - RNA, 19 nt, Homo sapiens
guacaugggcacagagauu

SEQ ID NO: 338615 - RNA, 19 nt, Homo sapiens
ggucaaccaucacuuccuu

SEQ ID NO: 338616 - RNA, 19 nt, Homo sapiens
caaauaaguuacccucaac

SEQ ID NO: 338617 - RNA, 19 nt, Homo sapiens
gacaugaacccauccaaug

SEQ ID NO: 338618 - RNA, 19 nt, Homo sapiens
ggagugggaaauugauuaa

SEQ ID NO: 338619 - RNA, 19 nt, Homo sapiens
gauugccacugcuuucauu

SEQ ID NO: 338620 - RNA, 19 nt, Homo sapiens
caauaucgcgguucucuau

SEQ ID NO: 338621 - RNA, 19 nt, Homo sapiens
caacaugcuccuagagauu

SEQ ID NO: 338622 - RNA, 19 nt, Homo sapiens
ggagacuguuaaagugaaa

SEQ ID NO: 338623 - RNA, 19 nt, Homo sapiens
ggucacuuguccucaguuu

SEQ ID NO: 338624 - RNA, 19 nt, Homo sapiens
aaagaagccugguggcaau

SEQ ID NO: 338625 - RNA, 19 nt, Homo sapiens
gaaguggccaagaagauga

SEQ ID NO: 338626 - RNA, 19 nt, Homo sapiens
uaaaggagggacauuaaga

SEQ ID NO: 338627 - RNA, 19 nt, Homo sapiens
ggaauguucugcugguucu

SEQ ID NO: 338628 - RNA, 19 nt, Homo sapiens
gagaggagugggaaauuga

SEQ ID NO: 338629 - RNA, 19 nt, Homo sapiens
cuaauucguuucagugaug

SEQ ID NO: 338630 - RNA, 19 nt, Homo sapiens
cagacaaaccaaagaagua

SEQ ID NO: 338631 - RNA, 19 nt, Homo sapiens
cacaaggucuauccaaugu

SEQ ID NO: 338632 - RNA, 19 nt, Homo sapiens
acaauucccucaucagcaa

SEQ ID NO: 338633 - RNA, 19 nt, Homo sapiens
gcaaaucgcaagcuuaugc

SEQ ID NO: 338634 - RNA, 19 nt, Homo sapiens
ggaacacgcaugucuggaa

SEQ ID NO: 338635 - RNA, 19 nt, Homo sapiens
ggaauuggagccgguguaa

SEQ ID NO: 338636 - RNA, 19 nt, Homo sapiens
ggccgaagcuccagaacuc

SEQ ID NO: 338637 - RNA, 19 nt, Homo sapiens
gguuggacgucacugcuaa

SEQ ID NO: 338638 - RNA, 19 nt, Homo sapiens
ccaccgaguccuucauuaa

SEQ ID NO: 338639 - RNA, 19 nt, Homo sapiens
gccaaagaguuuauugauc

SEQ ID NO: 338640 - RNA, 19 nt, Homo sapiens
gagggacauuaagaaauaa

SEQ ID NO: 338641 - RNA, 19 nt, Homo sapiens
uaaaguggaugagguugga

SEQ ID NO: 338642 - RNA, 19 nt, Homo sapiens
cauguacccugaugaagug

SEQ ID NO: 338643 - RNA, 19 nt, Homo sapiens
gccaggagcugcaguacca

SEQ ID NO: 338644 - RNA, 19 nt, Homo sapiens
gcaaugaucgcagcuggaa

SEQ ID NO: 338645 - RNA, 19 nt, Homo sapiens
ucacagagauaugcauaca

SEQ ID NO: 338646 - RNA, 19 nt, Homo sapiens
gacccucaaugccaagaaa

SEQ ID NO: 338647 - RNA, 19 nt, Homo sapiens
ggcaacagcggcaauuuga

SEQ ID NO: 338648 - RNA, 19 nt, Homo sapiens
gaagaaaggaagagcuaca

SEQ ID NO: 338649 - RNA, 19 nt, Homo sapiens
ggacggcaagucacacaaa

SEQ ID NO: 338650 - RNA, 19 nt, Homo sapiens
ggaagcccauucuaaacuc

SEQ ID NO: 338651 - RNA, 19 nt, Homo sapiens
gaagagagauuccauugaa

SEQ ID NO: 338652 - RNA, 19 nt, Homo sapiens
ugaaagagcucaacaacaa

SEQ ID NO: 338653 - RNA, 19 nt, Homo sapiens
uaagugaccugcuuuguaa

SEQ ID NO: 338654 - RNA, 19 nt, Homo sapiens
ggaaagaagucuccagaau

SEQ ID NO: 338655 - RNA, 19 nt, Homo sapiens
gagagaaacugaagaaauc

SEQ ID NO: 338656 - RNA, 19 nt, Homo sapiens
ugaaguacaugcagaauga

SEQ ID NO: 338657 - RNA, 19 nt, Homo sapiens
caacaacaauguggagaaa

SEQ ID NO: 338658 - RNA, 19 nt, Homo sapiens
ccagauaagugacauaagu

SEQ ID NO: 338659 - RNA, 19 nt, Homo sapiens
ggaaauuucuguucaagac

SEQ ID NO: 338660 - RNA, 19 nt, Homo sapiens
guauuuaacugccuugugu

SEQ ID NO: 338661 - RNA, 19 nt, Homo sapiens
gaaagaagucuccagaauc

SEQ ID NO: 338662 - RNA, 19 nt, Homo sapiens
ggucuucccuguaugauuc

SEQ ID NO: 338663 - RNA, 19 nt, Homo sapiens
uaucuuuggugcuguauuu

SEQ ID NO: 338664 - RNA, 19 nt, Homo sapiens
gcucaaaucucggcagaau

SEQ ID NO: 338665 - RNA, 19 nt, Homo sapiens
gcaaacagcacauucagau

SEQ ID NO: 338666 - RNA, 19 nt, Homo sapiens
ggagagaaacugaagaaau

SEQ ID NO: 338667 - RNA, 19 nt, Homo sapiens
ugacauaagugaccugcuu

SEQ ID NO: 338668 - RNA, 19 nt, Homo sapiens
caaaggagauagaaacaac

SEQ ID NO: 338669 - RNA, 19 nt, Homo sapiens
aaagaagucuccagaaucu

SEQ ID NO: 338670 - RNA, 19 nt, Homo sapiens
gagaagagagauuccauug

SEQ ID NO: 338671 - RNA, 19 nt, Homo sapiens
gaacaucugagcucaaauc

SEQ ID NO: 338672 - RNA, 19 nt, Homo sapiens
gagauggccuguccuugga

SEQ ID NO: 338673 - RNA, 19 nt, Homo sapiens
ggucgaggacuauuucuuu

SEQ ID NO: 338674 - RNA, 19 nt, Homo sapiens
caagacacacuucaccaua

SEQ ID NO: 338675 - RNA, 19 nt, Homo sapiens
ccauggaacaucccaaaua

SEQ ID NO: 338676 - RNA, 19 nt, Homo sapiens
ccaaagggauuuuaacuug

SEQ ID NO: 338677 - RNA, 19 nt, Homo sapiens
gcucaaauccagauaagug

SEQ ID NO: 338678 - RNA, 19 nt, Homo sapiens
gagauuccauugaaagucu

SEQ ID NO: 338679 - RNA, 19 nt, Homo sapiens
caccugaccuugugcuuga

SEQ ID NO: 338680 - RNA, 19 nt, Homo sapiens
cagaagagccugagagaca

SEQ ID NO: 338681 - RNA, 19 nt, Homo sapiens
gaaagagcucaacaacaaa

SEQ ID NO: 338682 - RNA, 19 nt, Homo sapiens
gaagugggcaggagaaugg

SEQ ID NO: 338683 - RNA, 19 nt, Homo sapiens
acaggaaccuaccaacuga

SEQ ID NO: 338684 - RNA, 19 nt, Homo sapiens
aagacacacuucaccauaa

SEQ ID NO: 338685 - RNA, 19 nt, Homo sapiens
aggaugaccuucaguauca

SEQ ID NO: 338686 - RNA, 19 nt, Homo sapiens
gcaaagcccucagcagcau

SEQ ID NO: 338687 - RNA, 19 nt, Homo sapiens
ucgaauuugucaaccaaua

SEQ ID NO: 338688 - RNA, 19 nt, Homo sapiens
gagcucaaauccagauaag

SEQ ID NO: 338689 - RNA, 19 nt, Homo sapiens
ucgcaccacuguguauuua

SEQ ID NO: 338690 - RNA, 19 nt, Homo sapiens
gcagagaacucagccucau

SEQ ID NO: 338691 - RNA, 19 nt, Homo sapiens
aagaacaucugagcucaaa

SEQ ID NO: 338692 - RNA, 19 nt, Homo sapiens
cugccaagcugaaauugaa

SEQ ID NO: 338693 - RNA, 19 nt, Homo sapiens
aagguugucugcauggaua

SEQ ID NO: 338694 - RNA, 19 nt, Homo sapiens
ugauggagauauuuacaug

SEQ ID NO: 338695 - RNA, 19 nt, Homo sapiens
caacauugcugugcuccau

SEQ ID NO: 338696 - RNA, 19 nt, Homo sapiens
gaaagaccaggcugucguu

SEQ ID NO: 338697 - RNA, 19 nt, Homo sapiens
agaaaucgcucuucaugcu

SEQ ID NO: 338698 - RNA, 19 nt, Homo sapiens
uaacaaaggagauagaaac

SEQ ID NO: 338699 - RNA, 19 nt, Homo sapiens
agaccaaauuccaccagua

SEQ ID NO: 338700 - RNA, 19 nt, Homo sapiens
cauggaacaucccaaauac

SEQ ID NO: 338701 - RNA, 19 nt, Homo sapiens
ucagcaagcagcagaauga

SEQ ID NO: 338702 - RNA, 19 nt, Homo sapiens
gaccaaauuccaccaguau

SEQ ID NO: 338703 - RNA, 19 nt, Homo sapiens
ggccuguccuuggaaauuu

SEQ ID NO: 338704 - RNA, 19 nt, Homo sapiens
gcaccacuguguauuuaac

SEQ ID NO: 338705 - RNA, 19 nt, Homo sapiens
gcaaguggaaguucaccaa

SEQ ID NO: 338706 - RNA, 19 nt, Homo sapiens
gggaugacuuuccaagaca

SEQ ID NO: 338707 - RNA, 19 nt, Homo sapiens
acaaguagcacccuggauu

SEQ ID NO: 338708 - RNA, 19 nt, Homo sapiens
gaucacacgcccacagaga

SEQ ID NO: 338709 - RNA, 19 nt, Homo sapiens
gagaagcggagacccaaga

SEQ ID NO: 338710 - RNA, 19 nt, Homo sapiens
ccaccaguaugcaaugaau

SEQ ID NO: 338711 - RNA, 19 nt, Homo sapiens
gagauggaggaaagugaua

SEQ ID NO: 338712 - RNA, 19 nt, Homo sapiens
gccaggcccucaccuacuu

SEQ ID NO: 338713 - RNA, 19 nt, Homo sapiens
cagccucauuccugcuuua

SEQ ID NO: 338714 - RNA, 19 nt, Homo sapiens
accaggagaugcugaacua

SEQ ID NO: 338715 - RNA, 19 nt, Homo sapiens
uugcugugcuccauaguuu

SEQ ID NO: 338716 - RNA, 19 nt, Homo sapiens
guagcacccuggauugauc

SEQ ID NO: 338717 - RNA, 19 nt, Homo sapiens
gcugugcucuuugccugua

SEQ ID NO: 338718 - RNA, 19 nt, Homo sapiens
gcugcagaauccuucauga

SEQ ID NO: 338719 - RNA, 19 nt, Homo sapiens
aagcaggccuggcgcaaug

SEQ ID NO: 338720 - RNA, 19 nt, Homo sapiens
uaucgaauuugucaaccaa

SEQ ID NO: 338721 - RNA, 19 nt, Homo sapiens
aaacuaacacccagucugu

SEQ ID NO: 338722 - RNA, 19 nt, Homo sapiens
cgccuuugcucaugacauu

SEQ ID NO: 338723 - RNA, 19 nt, Homo sapiens
gcaucgaccugggcuggaa

SEQ ID NO: 338724 - RNA, 19 nt, Homo sapiens
gaagaacaucugagcucaa

SEQ ID NO: 338725 - RNA, 19 nt, Homo sapiens
caaguagcacccuggauug

SEQ ID NO: 338726 - RNA, 19 nt, Homo sapiens
gcaggucgaggacuauuuc

SEQ ID NO: 338727 - RNA, 19 nt, Homo sapiens
acccugagcucuucgaaau

SEQ ID NO: 338728 - RNA, 19 nt, Homo sapiens
gauggccuguccuuggaaa

SEQ ID NO: 338729 - RNA, 19 nt, Homo sapiens
ccaggccaccucuauguuu

SEQ ID NO: 338730 - RNA, 19 nt, Homo sapiens
gcaauggagagaaacugaa

SEQ ID NO: 338731 - RNA, 19 nt, Homo sapiens
aagagagauuccauugaaa

SEQ ID NO: 338732 - RNA, 19 nt, Homo sapiens
gagauagaaacaacaggaa

SEQ ID NO: 338733 - RNA, 19 nt, Homo sapiens
auaagugaccugcuuugua

SEQ ID NO: 338734 - RNA, 19 nt, Homo sapiens
ugguggaacucuccuguga

SEQ ID NO: 338735 - RNA, 19 nt, Homo sapiens
aacuggagcuaaaguggua

SEQ ID NO: 338736 - RNA, 19 nt, Homo sapiens
ucacucagcugugcaucga

SEQ ID NO: 338737 - RNA, 19 nt, Homo sapiens
guaacaaaggagauagaaa

SEQ ID NO: 338738 - RNA, 19 nt, Homo sapiens
uggaagcgguaacaaagga

SEQ ID NO: 338739 - RNA, 19 nt, Homo sapiens
ucaaaucucggcagaaucu

SEQ ID NO: 338740 - RNA, 19 nt, Homo sapiens
gagcucaacaacaaauuca

SEQ ID NO: 338741 - RNA, 19 nt, Homo sapiens
ccacucggcugcagaaucc

SEQ ID NO: 338742 - RNA, 19 nt, Homo sapiens
guacaugggcacagagauc

SEQ ID NO: 338743 - RNA, 19 nt, Homo sapiens
ggagccaggccaccucuau

SEQ ID NO: 338744 - RNA, 19 nt, Homo sapiens
ucugcuggcuuccugcuuu

SEQ ID NO: 338745 - RNA, 19 nt, Homo sapiens
cgaaaucccaccugaccuu

SEQ ID NO: 338746 - RNA, 19 nt, Homo sapiens
ggucggccaucaccguguu

SEQ ID NO: 338747 - RNA, 19 nt, Homo sapiens
caccaacaauggcaacauc

SEQ ID NO: 338748 - RNA, 19 nt, Homo sapiens
gcagacacgugcguuacuc

SEQ ID NO: 338749 - RNA, 19 nt, Homo sapiens
ccauaaggccaaagggauu

SEQ ID NO: 338750 - RNA, 19 nt, Homo sapiens
ucuagacagucccgaaguu

SEQ ID NO: 338751 - RNA, 19 nt, Homo sapiens
gaagagagauuccauugaa

SEQ ID NO: 338752 - RNA, 19 nt, Homo sapiens
ugaaagagcucaacaacaa

SEQ ID NO: 338753 - RNA, 19 nt, Homo sapiens
uaagugaccugcuuuguaa

SEQ ID NO: 338754 - RNA, 19 nt, Homo sapiens
ggaaagaagucuccagaau

SEQ ID NO: 338755 - RNA, 19 nt, Homo sapiens
gagagaaacugaagaaauc

SEQ ID NO: 338756 - RNA, 19 nt, Homo sapiens
ugaaguacaugcagaauga

SEQ ID NO: 338757 - RNA, 19 nt, Homo sapiens
caacaacaauguggagaaa

SEQ ID NO: 338758 - RNA, 19 nt, Homo sapiens
ccagauaagugacauaagu

SEQ ID NO: 338759 - RNA, 19 nt, Homo sapiens
ggaaauuucuguucaagac

SEQ ID NO: 338760 - RNA, 19 nt, Homo sapiens
guauuuaacugccuugugu

SEQ ID NO: 338761 - RNA, 19 nt, Homo sapiens
gaaagaagucuccagaauc

SEQ ID NO: 338762 - RNA, 19 nt, Homo sapiens
ggucuucccuguaugauuc

SEQ ID NO: 338763 - RNA, 19 nt, Homo sapiens
uaucuuuggugcuguauuu

SEQ ID NO: 338764 - RNA, 19 nt, Homo sapiens
gcucaaaucucggcagaau

SEQ ID NO: 338765 - RNA, 19 nt, Homo sapiens
gcaaacagcacauucagau

SEQ ID NO: 338766 - RNA, 19 nt, Homo sapiens
ggagagaaacugaagaaau

SEQ ID NO: 338767 - RNA, 19 nt, Homo sapiens
ugacauaagugaccugcuu

SEQ ID NO: 338768 - RNA, 19 nt, Homo sapiens
caaaggagauagaaacaac

SEQ ID NO: 338769 - RNA, 19 nt, Homo sapiens
aaagaagucuccagaaucu

SEQ ID NO: 338770 - RNA, 19 nt, Homo sapiens
gagaagagagauuccauug

SEQ ID NO: 338771 - RNA, 19 nt, Homo sapiens
gaacaucugagcucaaauc

SEQ ID NO: 338772 - RNA, 19 nt, Homo sapiens
gagauggccuguccuugga

SEQ ID NO: 338773 - RNA, 19 nt, Homo sapiens
ggucgaggacuauuucuuu

SEQ ID NO: 338774 - RNA, 19 nt, Homo sapiens
caagacacacuucaccaua

SEQ ID NO: 338775 - RNA, 19 nt, Homo sapiens
ccauggaacaucccaaaua

SEQ ID NO: 338776 - RNA, 19 nt, Homo sapiens
ccaaagggauuuuaacuug

SEQ ID NO: 338777 - RNA, 19 nt, Homo sapiens
gcucaaauccagauaagug

SEQ ID NO: 338778 - RNA, 19 nt, Homo sapiens
gagauuccauugaaagucu

SEQ ID NO: 338779 - RNA, 19 nt, Homo sapiens
caccugaccuugugcuuga

SEQ ID NO: 338780 - RNA, 19 nt, Homo sapiens
cagaagagccugagagaca

SEQ ID NO: 338781 - RNA, 19 nt, Homo sapiens
gaaagagcucaacaacaaa

SEQ ID NO: 338782 - RNA, 19 nt, Homo sapiens
gaagugggcaggagaaugg

SEQ ID NO: 338783 - RNA, 19 nt, Homo sapiens
acaggaaccuaccaacuga

SEQ ID NO: 338784 - RNA, 19 nt, Homo sapiens
aagacacacuucaccauaa

SEQ ID NO: 338785 - RNA, 19 nt, Homo sapiens
aggaugaccuucaguauca

SEQ ID NO: 338786 - RNA, 19 nt, Homo sapiens
gcaaagcccucagcagcau

SEQ ID NO: 338787 - RNA, 19 nt, Homo sapiens
ucgaauuugucaaccaaua

SEQ ID NO: 338788 - RNA, 19 nt, Homo sapiens
gagcucaaauccagauaag

SEQ ID NO: 338789 - RNA, 19 nt, Homo sapiens
ucgcaccacuguguauuua

SEQ ID NO: 338790 - RNA, 19 nt, Homo sapiens
gcagagaacucagccucau

SEQ ID NO: 338791 - RNA, 19 nt, Homo sapiens
aagaacaucugagcucaaa

SEQ ID NO: 338792 - RNA, 19 nt, Homo sapiens
cugccaagcugaaauugaa

SEQ ID NO: 338793 - RNA, 19 nt, Homo sapiens
aagguugucugcauggaua

SEQ ID NO: 338794 - RNA, 19 nt, Homo sapiens
ugauggagauauuuacaug

SEQ ID NO: 338795 - RNA, 19 nt, Homo sapiens
caacauugcugugcuccau

SEQ ID NO: 338796 - RNA, 19 nt, Homo sapiens
gaaagaccaggcugucguu

SEQ ID NO: 338797 - RNA, 19 nt, Homo sapiens
agaaaucgcucuucaugcu

SEQ ID NO: 338798 - RNA, 19 nt, Homo sapiens
uaacaaaggagauagaaac

SEQ ID NO: 338799 - RNA, 19 nt, Homo sapiens
agaccaaauuccaccagua

SEQ ID NO: 338800 - RNA, 19 nt, Homo sapiens
cauggaacaucccaaauac

SEQ ID NO: 338801 - RNA, 19 nt, Homo sapiens
ucagcaagcagcagaauga

SEQ ID NO: 338802 - RNA, 19 nt, Homo sapiens
gaccaaauuccaccaguau

SEQ ID NO: 338803 - RNA, 19 nt, Homo sapiens
ggccuguccuuggaaauuu

SEQ ID NO: 338804 - RNA, 19 nt, Homo sapiens
gcaccacuguguauuuaac

SEQ ID NO: 338805 - RNA, 19 nt, Homo sapiens
gcaaguggaaguucaccaa

SEQ ID NO: 338806 - RNA, 19 nt, Homo sapiens
gggaugacuuuccaagaca

SEQ ID NO: 338807 - RNA, 19 nt, Homo sapiens
acaaguagcacccuggauu

SEQ ID NO: 338808 - RNA, 19 nt, Homo sapiens
gaucacacgcccacagaga

SEQ ID NO: 338809 - RNA, 19 nt, Homo sapiens
gagaagcggagacccaaga

SEQ ID NO: 338810 - RNA, 19 nt, Homo sapiens
ccaccaguaugcaaugaau

SEQ ID NO: 338811 - RNA, 19 nt, Homo sapiens
gagauggaggaaagugaua

SEQ ID NO: 338812 - RNA, 19 nt, Homo sapiens
gccaggcccucaccuacuu

SEQ ID NO: 338813 - RNA, 19 nt, Homo sapiens
cagccucauuccugcuuua

SEQ ID NO: 338814 - RNA, 19 nt, Homo sapiens
accaggagaugcugaacua

SEQ ID NO: 338815 - RNA, 19 nt, Homo sapiens
uugcugugcuccauaguuu

SEQ ID NO: 338816 - RNA, 19 nt, Homo sapiens
guagcacccuggauugauc

SEQ ID NO: 338817 - RNA, 19 nt, Homo sapiens
gcugugcucuuugccugua

SEQ ID NO: 338818 - RNA, 19 nt, Homo sapiens
gcugcagaauccuucauga

SEQ ID NO: 338819 - RNA, 19 nt, Homo sapiens
aagcaggccuggcgcaaug

SEQ ID NO: 338820 - RNA, 19 nt, Homo sapiens
uaucgaauuugucaaccaa

SEQ ID NO: 338821 - RNA, 19 nt, Homo sapiens
aaacuaacacccagucugu

SEQ ID NO: 338822 - RNA, 19 nt, Homo sapiens
cgccuuugcucaugacauu

SEQ ID NO: 338823 - RNA, 19 nt, Homo sapiens
gcaucgaccugggcuggaa

SEQ ID NO: 338824 - RNA, 19 nt, Homo sapiens
gaagaacaucugagcucaa

SEQ ID NO: 338825 - RNA, 19 nt, Homo sapiens
caaguagcacccuggauug

SEQ ID NO: 338826 - RNA, 19 nt, Homo sapiens
gcaggucgaggacuauuuc

SEQ ID NO: 338827 - RNA, 19 nt, Homo sapiens
acccugagcucuucgaaau

SEQ ID NO: 338828 - RNA, 19 nt, Homo sapiens
gauggccuguccuuggaaa

SEQ ID NO: 338829 - RNA, 19 nt, Homo sapiens
ccaggccaccucuauguuu

SEQ ID NO: 338830 - RNA, 19 nt, Homo sapiens
gcaauggagagaaacugaa

SEQ ID NO: 338831 - RNA, 19 nt, Homo sapiens
aagagagauuccauugaaa

SEQ ID NO: 338832 - RNA, 19 nt, Homo sapiens
gagauagaaacaacaggaa

SEQ ID NO: 338833 - RNA, 19 nt, Homo sapiens
auaagugaccugcuuugua

SEQ ID NO: 338834 - RNA, 19 nt, Homo sapiens
ugguggaacucuccuguga

SEQ ID NO: 338835 - RNA, 19 nt, Homo sapiens
aacuggagcuaaaguggua

SEQ ID NO: 338836 - RNA, 19 nt, Homo sapiens
guaacaaaggagauagaaa

SEQ ID NO: 338837 - RNA, 19 nt, Homo sapiens
uggaagcgguaacaaagga

SEQ ID NO: 338838 - RNA, 19 nt, Homo sapiens
ucaaaucucggcagaaucu

SEQ ID NO: 338839 - RNA, 19 nt, Homo sapiens
gagcucaacaacaaauuca

SEQ ID NO: 338840 - RNA, 19 nt, Homo sapiens
ccacucggcugcagaaucc

SEQ ID NO: 338841 - RNA, 19 nt, Homo sapiens
guacaugggcacagagauc

SEQ ID NO: 338842 - RNA, 19 nt, Homo sapiens
ggagccaggccaccucuau

SEQ ID NO: 338843 - RNA, 19 nt, Homo sapiens
ucugcuggcuuccugcuuu

SEQ ID NO: 338844 - RNA, 19 nt, Homo sapiens
cgaaaucccaccugaccuu

SEQ ID NO: 338845 - RNA, 19 nt, Homo sapiens
ggucggccaucaccguguu

SEQ ID NO: 338846 - RNA, 19 nt, Homo sapiens
caccaacaauggcaacauc

SEQ ID NO: 338847 - RNA, 19 nt, Homo sapiens
gcagacacgugcguuacuc

SEQ ID NO: 338848 - RNA, 19 nt, Homo sapiens
ccauaaggccaaagggauu

SEQ ID NO: 338849 - RNA, 19 nt, Homo sapiens
ucuagacagucccgaaguu

SEQ ID NO: 338850 - RNA, 19 nt, Homo sapiens
uuacuugaccuccuaacaa

SEQ ID NO: 338851 - RNA, 19 nt, Homo sapiens
gaagaagaccuuuaaagaa

SEQ ID NO: 338852 - RNA, 19 nt, Homo sapiens
ggaagaagaccuuuaaaga

SEQ ID NO: 338853 - RNA, 19 nt, Homo sapiens
gaacagcacaagaguuaua

SEQ ID NO: 338854 - RNA, 19 nt, Homo sapiens
gcacaagaguuauaagauc

SEQ ID NO: 338855 - RNA, 19 nt, Homo sapiens
ugaagcaccuggagaauga

SEQ ID NO: 338856 - RNA, 19 nt, Homo sapiens
cggaacagcacaagaguua

SEQ ID NO: 338857 - RNA, 19 nt, Homo sapiens
aagaagaccuuuaaagaag

SEQ ID NO: 338858 - RNA, 19 nt, Homo sapiens
gaagaccuuuaaagaagug

SEQ ID NO: 338859 - RNA, 19 nt, Homo sapiens
ccaggaagaagaccuuuaa

SEQ ID NO: 338860 - RNA, 19 nt, Homo sapiens
gcacgaggaaccuguguga

SEQ ID NO: 338861 - RNA, 19 nt, Homo sapiens
caaguucccucgugugaag

SEQ ID NO: 338862 - RNA, 19 nt, Homo sapiens
gcaccggcaucaccaggaa

SEQ ID NO: 338863 - RNA, 19 nt, Homo sapiens
cacaggaaauguucaccua

SEQ ID NO: 338864 - RNA, 19 nt, Homo sapiens
uacuacagcuccauuaaga

SEQ ID NO: 338865 - RNA, 19 nt, Homo sapiens
gcaaccacaucaaguaugc

SEQ ID NO: 338866 - RNA, 19 nt, Homo sapiens
acaggcaccuaccagcuua

SEQ ID NO: 338867 - RNA, 19 nt, Homo sapiens
ccaacaugcugcuggaaau

SEQ ID NO: 338868 - RNA, 19 nt, Homo sapiens
ucaccgagcucugcauuca

SEQ ID NO: 338869 - RNA, 19 nt, Homo sapiens
cgaggagacuuccgaaucu

SEQ ID NO: 338870 - RNA, 19 nt, Homo sapiens
uauaagauccgcuucaaca

SEQ ID NO: 338871 - RNA, 19 nt, Homo sapiens
aggagauggucaacuauuu

SEQ ID NO: 338872 - RNA, 19 nt, Homo sapiens
guuauaagauccgcuucaa

SEQ ID NO: 338873 - RNA, 19 nt, Homo sapiens
gccacggccucuuucauga

SEQ ID NO: 338874 - RNA, 19 nt, Homo sapiens
gcugguacaugagcacuga

SEQ ID NO: 338875 - RNA, 19 nt, Homo sapiens
gaaggaguccaguaacaca

SEQ ID NO: 338876 - RNA, 19 nt, Homo sapiens
ggagauggucaacuauuuc

SEQ ID NO: 338877 - RNA, 19 nt, Homo sapiens
caggaaauguucaccuaca

SEQ ID NO: 338878 - RNA, 19 nt, Homo sapiens
gggacuucaucaaccagua

SEQ ID NO: 338879 - RNA, 19 nt, Homo sapiens
ggaggugacaagccgcaua

SEQ ID NO: 338880 - RNA, 19 nt, Homo sapiens
cagcugcccugauggagau

SEQ ID NO: 338881 - RNA, 19 nt, Homo sapiens
gagaauggagagagcuuug

SEQ ID NO: 338882 - RNA, 19 nt, Homo sapiens
agacaaggcagcaguggaa

SEQ ID NO: 338883 - RNA, 19 nt, Homo sapiens
gccaggcucucaccuucuu

SEQ ID NO: 338884 - RNA, 19 nt, Homo sapiens
acaauccgcucaguggaaa

SEQ ID NO: 338885 - RNA, 19 nt, Homo sapiens
agaggaaggaguccaguaa

SEQ ID NO: 338886 - RNA, 19 nt, Homo sapiens
gcucggccaucacaguguu

SEQ ID NO: 338887 - RNA, 19 nt, Homo sapiens
gcucccaacuugaccaucu

SEQ ID NO: 338888 - RNA, 19 nt, Homo sapiens
cagcacaagaguuauaaga

SEQ ID NO: 338889 - RNA, 19 nt, Homo sapiens
uaacaugggcaacuugaag

SEQ ID NO: 338890 - RNA, 19 nt, Homo sapiens
guuaccagcuagccaaagu

SEQ ID NO: 338891 - RNA, 19 nt, Homo sapiens
uucaguggcugguacauga

SEQ ID NO: 338892 - RNA, 19 nt, Homo sapiens
gaucaccgagcucugcauu

SEQ ID NO: 338893 - RNA, 19 nt, Homo sapiens
gagauccaccucacuguag

SEQ ID NO: 338894 - RNA, 19 nt, Homo sapiens
cagaagagcccagggaaca

SEQ ID NO: 338895 - RNA, 19 nt, Homo sapiens
gaaggcgacaauccuguau

SEQ ID NO: 338896 - RNA, 19 nt, Homo sapiens
caacaugcugcuggaaauu

SEQ ID NO: 338897 - RNA, 19 nt, Homo sapiens
caguagagcagcuggagaa

SEQ ID NO: 338898 - RNA, 19 nt, Homo sapiens
acacacggcuggaggaacu

SEQ ID NO: 338899 - RNA, 19 nt, Homo sapiens
aucaggagauggucaacua

SEQ ID NO: 338900 - RNA, 19 nt, Homo sapiens
ccucgucccuguggaaaga

SEQ ID NO: 338901 - RNA, 19 nt, Homo sapiens
ggucugcacaggaaauguu

SEQ ID NO: 338902 - RNA, 19 nt, Homo sapiens
gcaugacauugagagcaaa

SEQ ID NO: 338903 - RNA, 19 nt, Homo sapiens
gcucagcaccuuggcagaa

SEQ ID NO: 338904 - RNA, 19 nt, Homo sapiens
ucaugaagcaccuggagaa

SEQ ID NO: 338905 - RNA, 19 nt, Homo sapiens
guacuacagcuccauuaag

SEQ ID NO: 338906 - RNA, 19 nt, Homo sapiens
ggagaauggagagagcuuu

SEQ ID NO: 338907 - RNA, 19 nt, Homo sapiens
ugaaggcgacaauccugua

SEQ ID NO: 338908 - RNA, 19 nt, Homo sapiens
agaagaccuuuaaagaagu

SEQ ID NO: 338909 - RNA, 19 nt, Homo sapiens
acaguaacaugggcaacuu

SEQ ID NO: 338910 - RNA, 19 nt, Homo sapiens
guacaugagcacugagauc

SEQ ID NO: 338911 - RNA, 19 nt, Homo sapiens
gugcacaggcggaagaugu

SEQ ID NO: 338912 - RNA, 19 nt, Homo sapiens
aggaaggaguccaguaaca

SEQ ID NO: 338913 - RNA, 19 nt, Homo sapiens
caggagauggucaacuauu

SEQ ID NO: 338914 - RNA, 19 nt, Homo sapiens
gaggagacuuccgaaucug

SEQ ID NO: 338915 - RNA, 19 nt, Homo sapiens
ugccgaugcucccaacuug

SEQ ID NO: 338916 - RNA, 19 nt, Homo sapiens
ggagagcgagcugguguuc

SEQ ID NO: 338917 - RNA, 19 nt, Homo sapiens
ggacacacggcuggaggaa

SEQ ID NO: 338918 - RNA, 19 nt, Homo sapiens
caaggcagcaguggaaauc

SEQ ID NO: 338919 - RNA, 19 nt, Homo sapiens
ugccugggcucccugguau

SEQ ID NO: 338920 - RNA, 19 nt, Homo sapiens
gaucuccgccucgcucaug

SEQ ID NO: 338921 - RNA, 19 nt, Homo sapiens
ugcaugacauugagagcaa

SEQ ID NO: 338922 - RNA, 19 nt, Homo sapiens
agagauccaccucacugua

SEQ ID NO: 338923 - RNA, 19 nt, Homo sapiens
gaauggagagagcuuugca

SEQ ID NO: 338924 - RNA, 19 nt, Homo sapiens
ucccaugacuuugguguuc

SEQ ID NO: 338925 - RNA, 19 nt, Homo sapiens
ccacucccaugacuuuggu

SEQ ID NO: 338926 - RNA, 19 nt, Homo sapiens
gcagcccacucccaugacu

SEQ ID NO: 338927 - RNA, 19 nt, Homo sapiens
gagagauccaccucacugu

SEQ ID NO: 338928 - RNA, 19 nt, Homo sapiens
aggcagcaguggaaaucaa

SEQ ID NO: 338929 - RNA, 19 nt, Homo sapiens
ucugcaaccacaucaagua

SEQ ID NO: 338930 - RNA, 19 nt, Homo sapiens
gagacccugugcccugcuu

SEQ ID NO: 338931 - RNA, 19 nt, Homo sapiens
cuguagcugugcuggcaua

SEQ ID NO: 338932 - RNA, 19 nt, Homo sapiens
ccacggccucuuucaugaa

SEQ ID NO: 338933 - RNA, 19 nt, Homo sapiens
ccgaggagacuuccgaauc

SEQ ID NO: 338934 - RNA, 19 nt, Homo sapiens
gggagcaucaccuaugaca

SEQ ID NO: 338935 - RNA, 19 nt, Homo sapiens
acgaacagcggcuucaaga

SEQ ID NO: 338936 - RNA, 19 nt, Homo sapiens
ccugugagaccuucugugu

SEQ ID NO: 338937 - RNA, 19 nt, Homo sapiens
caguacuacagcuccauua

SEQ ID NO: 338938 - RNA, 19 nt, Homo sapiens
ggcaucaccaggaagaaga

SEQ ID NO: 338939 - RNA, 19 nt, Homo sapiens
agaccuacgugcaggacau

SEQ ID NO: 338940 - RNA, 19 nt, Homo sapiens
ggacuucaucaaccaguac

SEQ ID NO: 338941 - RNA, 19 nt, Homo sapiens
cuuugcagcugcccugaug

SEQ ID NO: 338942 - RNA, 19 nt, Homo sapiens
guaacaugggcaacuugaa

SEQ ID NO: 338943 - RNA, 19 nt, Homo sapiens
ggcagccucacuccuguuu

SEQ ID NO: 338944 - RNA, 19 nt, Homo sapiens
aaccuucgcucggccauca

SEQ ID NO: 338945 - RNA, 19 nt, Homo sapiens
gaagauguuccaggcuaca

SEQ ID NO: 338946 - RNA, 19 nt, Homo sapiens
gcacaggcggaagauguuc

SEQ ID NO: 338947 - RNA, 19 nt, Homo sapiens
ggaagcugcagguguucga

SEQ ID NO: 338948 - RNA, 19 nt, Homo sapiens
ggccaacgccgugaagauc

SEQ ID NO: 338949 - RNA, 19 nt, Homo sapiens
ggaaggaguccaguaacac

SEQ ID NO: 338950 - RNA, 19 nt, Homo sapiens
ccugggcucccugguauuu

SEQ ID NO: 338951 - RNA, 19 nt, Homo sapiens
ggacauacauuaucugaga

SEQ ID NO: 338952 - RNA, 19 nt, Homo sapiens
gaagaacgaguauggauua

SEQ ID NO: 338953 - RNA, 19 nt, Homo sapiens
uaacccaacuccauuaaua

SEQ ID NO: 338954 - RNA, 19 nt, Homo sapiens
gaacaggaaucaggcauuu

SEQ ID NO: 338955 - RNA, 19 nt, Homo sapiens
gaaaguagcuaaggaguuc

SEQ ID NO: 338956 - RNA, 19 nt, Homo sapiens
caaauucccuggagauaaa

SEQ ID NO: 338957 - RNA, 19 nt, Homo sapiens
gggaacauauuacuucuuu

SEQ ID NO: 338958 - RNA, 19 nt, Homo sapiens
gauuggaccuuucagauuu

SEQ ID NO: 338959 - RNA, 19 nt, Homo sapiens
gcacuaggccuuccaauga

SEQ ID NO: 338960 - RNA, 19 nt, Homo sapiens
gaauacaucuggcaagaca

SEQ ID NO: 338961 - RNA, 19 nt, Homo sapiens
ucaguuaaaucgcagcuua

SEQ ID NO: 338962 - RNA, 19 nt, Homo sapiens
gauccaacaucaaguaaug

SEQ ID NO: 338963 - RNA, 19 nt, Homo sapiens
uaacgaacauucacauuag

SEQ ID NO: 338964 - RNA, 19 nt, Homo sapiens
gaaacuaccaggugacaaa

SEQ ID NO: 338965 - RNA, 19 nt, Homo sapiens
uggaagagcuccuuauguu

SEQ ID NO: 338966 - RNA, 19 nt, Homo sapiens
gggauaagcuggcugcaau

SEQ ID NO: 338967 - RNA, 19 nt, Homo sapiens
ccacaaagaagaacgagua

SEQ ID NO: 338968 - RNA, 19 nt, Homo sapiens
ggagauaccacaaagaaga

SEQ ID NO: 338969 - RNA, 19 nt, Homo sapiens
gaacgaguauggauuacca

SEQ ID NO: 338970 - RNA, 19 nt, Homo sapiens
aaucugaacucuccugaaa

SEQ ID NO: 338971 - RNA, 19 nt, Homo sapiens
ggaaaggacacgacucuau

SEQ ID NO: 338972 - RNA, 19 nt, Homo sapiens
ggaggaaaguagcuaagga

SEQ ID NO: 338973 - RNA, 19 nt, Homo sapiens
caugagcaguucaggguua

SEQ ID NO: 338974 - RNA, 19 nt, Homo sapiens
cagccagucuucuauguuu

SEQ ID NO: 338975 - RNA, 19 nt, Homo sapiens
gaaaggacacgacucuaug

SEQ ID NO: 338976 - RNA, 19 nt, Homo sapiens
ugacaguucuauuugauug

SEQ ID NO: 338977 - RNA, 19 nt, Homo sapiens
cuauaaagauccaacauca

SEQ ID NO: 338978 - RNA, 19 nt, Homo sapiens
caaguaaugaugacaguaa

SEQ ID NO: 338979 - RNA, 19 nt, Homo sapiens
gaaaaucucuaccccaaau

SEQ ID NO: 338980 - RNA, 19 nt, Homo sapiens
acaaauagcaugagcaguu

SEQ ID NO: 338981 - RNA, 19 nt, Homo sapiens
uuaccaggcuccagcuaua

SEQ ID NO: 338982 - RNA, 19 nt, Homo sapiens
gaacaguaugucuggauuu

SEQ ID NO: 338983 - RNA, 19 nt, Homo sapiens
ggucagcugucucaguuug

SEQ ID NO: 338984 - RNA, 19 nt, Homo sapiens
caagaaagaaguuuguaga

SEQ ID NO: 338985 - RNA, 19 nt, Homo sapiens
uggaaugauuggccuguua

SEQ ID NO: 338986 - RNA, 19 nt, Homo sapiens
gagugacaguucuauuuga

SEQ ID NO: 338987 - RNA, 19 nt, Homo sapiens
guacagauggacccaaauu

SEQ ID NO: 338988 - RNA, 19 nt, Homo sapiens
uggaaugaauaacuccuua

SEQ ID NO: 338989 - RNA, 19 nt, Homo sapiens
caaagaagaacgaguaugg

SEQ ID NO: 338990 - RNA, 19 nt, Homo sapiens
ggaaugauuggccuguuaa

SEQ ID NO: 338991 - RNA, 19 nt, Homo sapiens
caggucagcugucucaguu

SEQ ID NO: 338992 - RNA, 19 nt, Homo sapiens
gcauggagccaacaaugaa

SEQ ID NO: 338993 - RNA, 19 nt, Homo sapiens
ugauuggccuguuaacauu

SEQ ID NO: 338994 - RNA, 19 nt, Homo sapiens
ggauuggaccuuucagauu

SEQ ID NO: 338995 - RNA, 19 nt, Homo sapiens
gaccuucucuucuaucucu

SEQ ID NO: 338996 - RNA, 19 nt, Homo sapiens
ggacugauggacauacauu

SEQ ID NO: 338997 - RNA, 19 nt, Homo sapiens
caaauagcaugagcaguuc

SEQ ID NO: 338998 - RNA, 19 nt, Homo sapiens
ggaacagacggaagugaaa

SEQ ID NO: 338999 - RNA, 19 nt, Homo sapiens
ggaaaguagcuaaggaguu

SEQ ID NO: 339000 - RNA, 19 nt, Homo sapiens
gauaagcuggcugcaauaa

SEQ ID NO: 339001 - RNA, 19 nt, Homo sapiens
ccaacaaugucacuucaca

SEQ ID NO: 339002 - RNA, 19 nt, Homo sapiens
uaacaaaaccagcaaauga

SEQ ID NO: 339003 - RNA, 19 nt, Homo sapiens
ggaagagcuccuuauguug

SEQ ID NO: 339004 - RNA, 19 nt, Homo sapiens
gauuuggaaugaacaggaa

SEQ ID NO: 339005 - RNA, 19 nt, Homo sapiens
aaagauccaacaucaagua

SEQ ID NO: 339006 - RNA, 19 nt, Homo sapiens
caacaauaccccucaguua

SEQ ID NO: 339007 - RNA, 19 nt, Homo sapiens
caauaaaacuuggccgaua

SEQ ID NO: 339008 - RNA, 19 nt, Homo sapiens
uaagcuggcugcaauaaaa

SEQ ID NO: 339009 - RNA, 19 nt, Homo sapiens
uaauauguaugccaaagca

SEQ ID NO: 339010 - RNA, 19 nt, Homo sapiens
ccaaauucccuggagauaa

SEQ ID NO: 339011 - RNA, 19 nt, Homo sapiens
ggacuucucaauacacaau

SEQ ID NO: 339012 - RNA, 19 nt, Homo sapiens
cagaagcucgccaagcaua

SEQ ID NO: 339013 - RNA, 19 nt, Homo sapiens
aaucgcagcuuaucacaag

SEQ ID NO: 339014 - RNA, 19 nt, Homo sapiens
ugucuuaacuggaggaaag

SEQ ID NO: 339015 - RNA, 19 nt, Homo sapiens
gagauaccacaaagaagaa

SEQ ID NO: 339016 - RNA, 19 nt, Homo sapiens
gauuggagauaccacaaag

SEQ ID NO: 339017 - RNA, 19 nt, Homo sapiens
ugaacaguaugucuggauu

SEQ ID NO: 339018 - RNA, 19 nt, Homo sapiens
cauuaggccucaaucugaa

SEQ ID NO: 339019 - RNA, 19 nt, Homo sapiens
ggugaggacugauggacau

SEQ ID NO: 339020 - RNA, 19 nt, Homo sapiens
ugacacgacccuugaguga

SEQ ID NO: 339021 - RNA, 19 nt, Homo sapiens
ggaaucaggcauuuggaau

SEQ ID NO: 339022 - RNA, 19 nt, Homo sapiens
caguaugucuggauuugga

SEQ ID NO: 339023 - RNA, 19 nt, Homo sapiens
acacgacccuugagugaca

SEQ ID NO: 339024 - RNA, 19 nt, Homo sapiens
ggauaagcuggcugcaaua

SEQ ID NO: 339025 - RNA, 19 nt, Homo sapiens
gacagacccaggaauggua

SEQ ID NO: 339026 - RNA, 19 nt, Homo sapiens
gacauacauuaucugagaa

SEQ ID NO: 339027 - RNA, 19 nt, Homo sapiens
aacagaagcucgccaagca

SEQ ID NO: 339028 - RNA, 19 nt, Homo sapiens
ggucagggcauuggaauuc

SEQ ID NO: 339029 - RNA, 19 nt, Homo sapiens
ugacaggauuggaccuuuc

SEQ ID NO: 339030 - RNA, 19 nt, Homo sapiens
ggaacauauuacuucuuug

SEQ ID NO: 339031 - RNA, 19 nt, Homo sapiens
cauguuuggugcuucaaga

SEQ ID NO: 339032 - RNA, 19 nt, Homo sapiens
guacaucuugcauuaggaa

SEQ ID NO: 339033 - RNA, 19 nt, Homo sapiens
gcagagacagacccaggaa

SEQ ID NO: 339034 - RNA, 19 nt, Homo sapiens
gaggacugauggacauaca

SEQ ID NO: 339035 - RNA, 19 nt, Homo sapiens
gguaacccaacuccauuaa

SEQ ID NO: 339036 - RNA, 19 nt, Homo sapiens
ccaggaaugguacaucuug

SEQ ID NO: 339037 - RNA, 19 nt, Homo sapiens
cuaggaauaugaugaacca

SEQ ID NO: 339038 - RNA, 19 nt, Homo sapiens
acauuaggccucaaucuga

SEQ ID NO: 339039 - RNA, 19 nt, Homo sapiens
gaggaaaggacacgacucu

SEQ ID NO: 339040 - RNA, 19 nt, Homo sapiens
caacagggguaccaacaau

SEQ ID NO: 339041 - RNA, 19 nt, Homo sapiens
ugagugacaguucuauuug

SEQ ID NO: 339042 - RNA, 19 nt, Homo sapiens
aaguacagauggacccaaa

SEQ ID NO: 339043 - RNA, 19 nt, Homo sapiens
guaaugaugacaguaaauc

SEQ ID NO: 339044 - RNA, 19 nt, Homo sapiens
ucccaggacuucucaauac

SEQ ID NO: 339045 - RNA, 19 nt, Homo sapiens
gugaaaaugugacaggauu

SEQ ID NO: 339046 - RNA, 19 nt, Homo sapiens
ggcauggagccaacaauga

SEQ ID NO: 339047 - RNA, 19 nt, Homo sapiens
caucugaguacuuaacgaa

SEQ ID NO: 339048 - RNA, 19 nt, Homo sapiens
caucuugcauuaggaagug

SEQ ID NO: 339049 - RNA, 19 nt, Homo sapiens
uuucagauuucccagcauu

SEQ ID NO: 339050 - RNA, 19 nt, Homo sapiens
uaccaacaaugucacuuca

SEQ ID NO: 339051 - RNA, 19 nt, Homo sapiens
caacagauaugcgcaaaua

SEQ ID NO: 339052 - RNA, 19 nt, Homo sapiens
gcaaaugcuucuucucuuu

SEQ ID NO: 339053 - RNA, 19 nt, Homo sapiens
gaccaucacugacgaguuu

SEQ ID NO: 339054 - RNA, 19 nt, Homo sapiens
gcaccuacaucuacuuuga

SEQ ID NO: 339055 - RNA, 19 nt, Homo sapiens
ccagguaacuuccuuuaaa

SEQ ID NO: 339056 - RNA, 19 nt, Homo sapiens
gcaaaguucuguuggauag

SEQ ID NO: 339057 - RNA, 19 nt, Homo sapiens
gcuggucucuugucagaua

SEQ ID NO: 339058 - RNA, 19 nt, Homo sapiens
aaccaaagcuuacagcaaa

SEQ ID NO: 339059 - RNA, 19 nt, Homo sapiens
ggagggagcagcagcagua

SEQ ID NO: 339060 - RNA, 19 nt, Homo sapiens
aaauucaguuccuccauua

SEQ ID NO: 339061 - RNA, 19 nt, Homo sapiens
gaacgaguuucucuacgau

SEQ ID NO: 339062 - RNA, 19 nt, Homo sapiens
ggacuaaagcuccuuggaa

SEQ ID NO: 339063 - RNA, 19 nt, Homo sapiens
caaaugcuucuucucuuua

SEQ ID NO: 339064 - RNA, 19 nt, Homo sapiens
ggacgacguugaguacuau

SEQ ID NO: 339065 - RNA, 19 nt, Homo sapiens
ccaacgagaucaaggacaa

SEQ ID NO: 339066 - RNA, 19 nt, Homo sapiens
gggcuggucucuugucaga

SEQ ID NO: 339067 - RNA, 19 nt, Homo sapiens
gaacugugcuuuucauugu

SEQ ID NO: 339068 - RNA, 19 nt, Homo sapiens
guaugaggcugaccuaaag

SEQ ID NO: 339069 - RNA, 19 nt, Homo sapiens
ccauuacacuugccacauu

SEQ ID NO: 339070 - RNA, 19 nt, Homo sapiens
ggcagaagcuccacaaugc

SEQ ID NO: 339071 - RNA, 19 nt, Homo sapiens
guaccagcccuguccuuua

SEQ ID NO: 339072 - RNA, 19 nt, Homo sapiens
gggagcagcagcaguagua

SEQ ID NO: 339073 - RNA, 19 nt, Homo sapiens
gaagaagggcgacaaggau

SEQ ID NO: 339074 - RNA, 19 nt, Homo sapiens
gaagagagugcgucuguag

SEQ ID NO: 339075 - RNA, 19 nt, Homo sapiens
ucucuaagccuucuuggua

SEQ ID NO: 339076 - RNA, 19 nt, Homo sapiens
uaaauuaccaauccacuug

SEQ ID NO: 339077 - RNA, 19 nt, Homo sapiens
ugacuucccucuguauuga

SEQ ID NO: 339078 - RNA, 19 nt, Homo sapiens
gcacuaaggcacaguaucu

SEQ ID NO: 339079 - RNA, 19 nt, Homo sapiens
ccucugagcuccuugaagu

SEQ ID NO: 339080 - RNA, 19 nt, Homo sapiens
ggaaaacucugaagaugau

SEQ ID NO: 339081 - RNA, 19 nt, Homo sapiens
ggagcaguuugaagauauu

SEQ ID NO: 339082 - RNA, 19 nt, Homo sapiens
ugacuguccugcucugaaa

SEQ ID NO: 339083 - RNA, 19 nt, Homo sapiens
gacaucauccugagcagua

SEQ ID NO: 339084 - RNA, 19 nt, Homo sapiens
ggacaagaggcagcuuaua

SEQ ID NO: 339085 - RNA, 19 nt, Homo sapiens
ugacuugucugagggauga

SEQ ID NO: 339086 - RNA, 19 nt, Homo sapiens
gagacacucuucuucaucu

SEQ ID NO: 339087 - RNA, 19 nt, Homo sapiens
cacauguggugauuaguaa

SEQ ID NO: 339088 - RNA, 19 nt, Homo sapiens
auaaaugucuuggugguuu

SEQ ID NO: 339089 - RNA, 19 nt, Homo sapiens
agaggcagcuuauagacaa

SEQ ID NO: 339090 - RNA, 19 nt, Homo sapiens
gacaagaggcagcuuauag

SEQ ID NO: 339091 - RNA, 19 nt, Homo sapiens
ucauuugucuccugacuug

SEQ ID NO: 339092 - RNA, 19 nt, Homo sapiens
caaugggccuccacaguuc

SEQ ID NO: 339093 - RNA, 19 nt, Homo sapiens
uaccagcccuguccuuuau

SEQ ID NO: 339094 - RNA, 19 nt, Homo sapiens
gaagguacuccaugcucua

SEQ ID NO: 339095 - RNA, 19 nt, Homo sapiens
agaaggagauuaagaagcu

SEQ ID NO: 339096 - RNA, 19 nt, Homo sapiens
guuaauuccucuccaaucu

SEQ ID NO: 339097 - RNA, 19 nt, Homo sapiens
uaaggauccugcucuggaa

SEQ ID NO: 339098 - RNA, 19 nt, Homo sapiens
gaaggagauuaagaagcua

SEQ ID NO: 339099 - RNA, 19 nt, Homo sapiens
guggagcaguuugaagaua

SEQ ID NO: 339100 - RNA, 19 nt, Homo sapiens
ucaaugggccuccacaguu

SEQ ID NO: 339101 - RNA, 19 nt, Homo sapiens
ggauccugcucuggaauaa

SEQ ID NO: 339102 - RNA, 19 nt, Homo sapiens
ggugugacuucccucugua

SEQ ID NO: 339103 - RNA, 19 nt, Homo sapiens
ccaaggcccuaaagaagca

SEQ ID NO: 339104 - RNA, 19 nt, Homo sapiens
cauuacacuugccacauuu

SEQ ID NO: 339105 - RNA, 19 nt, Homo sapiens
caagcgagcaucaggagaa

SEQ ID NO: 339106 - RNA, 19 nt, Homo sapiens
caucagcucuggcauugag

SEQ ID NO: 339107 - RNA, 19 nt, Homo sapiens
agaauggcgccaccaguua

SEQ ID NO: 339108 - RNA, 19 nt, Homo sapiens
cagggaagauggcggacaa

SEQ ID NO: 339109 - RNA, 19 nt, Homo sapiens
guucaguggccaacagaua

SEQ ID NO: 339110 - RNA, 19 nt, Homo sapiens
gaaggagaaggaagagguu

SEQ ID NO: 339111 - RNA, 19 nt, Homo sapiens
gccagauguucccuucuuu

SEQ ID NO: 339112 - RNA, 19 nt, Homo sapiens
gagcagggcaccuacaucu

SEQ ID NO: 339113 - RNA, 19 nt, Homo sapiens
gacguugaguacuauguug

SEQ ID NO: 339114 - RNA, 19 nt, Homo sapiens
gggaccaaaucaagacaug

SEQ ID NO: 339115 - RNA, 19 nt, Homo sapiens
ucugugagcugccaguuuc

SEQ ID NO: 339116 - RNA, 19 nt, Homo sapiens
uuugcacccucuuaucuua

SEQ ID NO: 339117 - RNA, 19 nt, Homo sapiens
cagccagucuccagccaaa

SEQ ID NO: 339118 - RNA, 19 nt, Homo sapiens
cuaaagaaggagauuaaga

SEQ ID NO: 339119 - RNA, 19 nt, Homo sapiens
uaaaugucuuggugguuug

SEQ ID NO: 339120 - RNA, 19 nt, Homo sapiens
ucacagcugcgguaccuuu

SEQ ID NO: 339121 - RNA, 19 nt, Homo sapiens
aaucuccgcugguaucuca

SEQ ID NO: 339122 - RNA, 19 nt, Homo sapiens
cagaauggcgccaccaguu

SEQ ID NO: 339123 - RNA, 19 nt, Homo sapiens
agacauggguagcguccaa

SEQ ID NO: 339124 - RNA, 19 nt, Homo sapiens
ggacaagcgcaaacuccaa

SEQ ID NO: 339125 - RNA, 19 nt, Homo sapiens
gguacuccaugcucuagga

SEQ ID NO: 339126 - RNA, 19 nt, Homo sapiens
cagccaaggcccuaaagaa

SEQ ID NO: 339127 - RNA, 19 nt, Homo sapiens
acagauaugcgcaaauaga

SEQ ID NO: 339128 - RNA, 19 nt, Homo sapiens
uggagcaguuugaagauau

SEQ ID NO: 339129 - RNA, 19 nt, Homo sapiens
gagcugccaguuucauuug

SEQ ID NO: 339130 - RNA, 19 nt, Homo sapiens
gcacccucuuaucuuagua

SEQ ID NO: 339131 - RNA, 19 nt, Homo sapiens
gcugucaggcccuaaggua

SEQ ID NO: 339132 - RNA, 19 nt, Homo sapiens
gcugguaucucagaagucu

SEQ ID NO: 339133 - RNA, 19 nt, Homo sapiens
uagaguguuuccagcauug

SEQ ID NO: 339134 - RNA, 19 nt, Homo sapiens
gcagggcaccuacaucuac

SEQ ID NO: 339135 - RNA, 19 nt, Homo sapiens
cggcagagguggcuuugag

SEQ ID NO: 339136 - RNA, 19 nt, Homo sapiens
gcaagaagaagggcgacaa

SEQ ID NO: 339137 - RNA, 19 nt, Homo sapiens
gugcagacacgcaagaaga

SEQ ID NO: 339138 - RNA, 19 nt, Homo sapiens
gaccuaaagaaggagauua

SEQ ID NO: 339139 - RNA, 19 nt, Homo sapiens
ugaagagagugcgucugua

SEQ ID NO: 339140 - RNA, 19 nt, Homo sapiens
acaagaggcagcuuauaga

SEQ ID NO: 339141 - RNA, 19 nt, Homo sapiens
ccaccuaccucacuaugcu

SEQ ID NO: 339142 - RNA, 19 nt, Homo sapiens
gccaacagauaugcgcaaa

SEQ ID NO: 339143 - RNA, 19 nt, Homo sapiens
caagaucaaggacgacguu

SEQ ID NO: 339144 - RNA, 19 nt, Homo sapiens
aggcugaccuaaagaagga

SEQ ID NO: 339145 - RNA, 19 nt, Homo sapiens
ccacauggaggaugagauc

SEQ ID NO: 339146 - RNA, 19 nt, Homo sapiens
gauaagcaggaccggauug

SEQ ID NO: 339147 - RNA, 19 nt, Homo sapiens
gguagauccugcccagaag

SEQ ID NO: 339148 - RNA, 19 nt, Homo sapiens
ccaagagaguaugaagaga

SEQ ID NO: 339149 - RNA, 19 nt, Homo sapiens
gggcaccuacaucuacuuu

SEQ ID NO: 339150 - RNA, 19 nt, Homo sapiens
gcauugcaaaguucuguug

SEQ ID NO: 339151 - RNA, 19 nt, Homo sapiens
gcaaaucucugaccuccuu

SEQ ID NO: 339152 - RNA, 19 nt, Homo sapiens
uaggaaagcucaaguaaau

SEQ ID NO: 339153 - RNA, 19 nt, Homo sapiens
caagugggcuuccuccuuu

SEQ ID NO: 339154 - RNA, 19 nt, Homo sapiens
gaacuuccuucucccuuaa

SEQ ID NO: 339155 - RNA, 19 nt, Homo sapiens
guagauggcagaacacuua

SEQ ID NO: 339156 - RNA, 19 nt, Homo sapiens
ggacuugauugugucauua

SEQ ID NO: 339157 - RNA, 19 nt, Homo sapiens
caaagaggagcaaccauua

SEQ ID NO: 339158 - RNA, 19 nt, Homo sapiens
ggacguuugugcaguauug

SEQ ID NO: 339159 - RNA, 19 nt, Homo sapiens
uagcagaccugauugagaa

SEQ ID NO: 339160 - RNA, 19 nt, Homo sapiens
gcagauaucuaacagugau

SEQ ID NO: 339161 - RNA, 19 nt, Homo sapiens
ugacaaaccuucagauucu

SEQ ID NO: 339162 - RNA, 19 nt, Homo sapiens
guaaaugcauuaucaacug

SEQ ID NO: 339163 - RNA, 19 nt, Homo sapiens
gcaaagaggagcaaccauu

SEQ ID NO: 339164 - RNA, 19 nt, Homo sapiens
guuauaaccugacgcuaaa

SEQ ID NO: 339165 - RNA, 19 nt, Homo sapiens
ucaaagggcagucucaaua

SEQ ID NO: 339166 - RNA, 19 nt, Homo sapiens
gcuaaagaguucauaagga

SEQ ID NO: 339167 - RNA, 19 nt, Homo sapiens
uccaguaccugaucaauuu

SEQ ID NO: 339168 - RNA, 19 nt, Homo sapiens
gcacagagccaguuggaau

SEQ ID NO: 339169 - RNA, 19 nt, Homo sapiens
gaagagcugcaaaggauaa

SEQ ID NO: 339170 - RNA, 19 nt, Homo sapiens
ugacaccacugcagaggua

SEQ ID NO: 339171 - RNA, 19 nt, Homo sapiens
auacugcaguuacuucuua

SEQ ID NO: 339172 - RNA, 19 nt, Homo sapiens
guaaacaccaagaauauga

SEQ ID NO: 339173 - RNA, 19 nt, Homo sapiens
gguaguagauggcagaaca

SEQ ID NO: 339174 - RNA, 19 nt, Homo sapiens
ggaaguugauggaaagaca

SEQ ID NO: 339175 - RNA, 19 nt, Homo sapiens
ccaauucucucaauaguac

SEQ ID NO: 339176 - RNA, 19 nt, Homo sapiens
cagaagacccagcaguuua

SEQ ID NO: 339177 - RNA, 19 nt, Homo sapiens
ccaagaauaugaacagaag

SEQ ID NO: 339178 - RNA, 19 nt, Homo sapiens
gaacuccucuucacacacu

SEQ ID NO: 339179 - RNA, 19 nt, Homo sapiens
ccacaucucuucagaacuc

SEQ ID NO: 339180 - RNA, 19 nt, Homo sapiens
gugcuuauguaaccuauau

SEQ ID NO: 339181 - RNA, 19 nt, Homo sapiens
guaacuggccgauugcuaa

SEQ ID NO: 339182 - RNA, 19 nt, Homo sapiens
gcaaaagaauguauuggaa

SEQ ID NO: 339183 - RNA, 19 nt, Homo sapiens
uagcauccaucuuguauuc

SEQ ID NO: 339184 - RNA, 19 nt, Homo sapiens
ugaacuuccuucucccuua

SEQ ID NO: 339185 - RNA, 19 nt, Homo sapiens
auaaggaggugagaaguaa

SEQ ID NO: 339186 - RNA, 19 nt, Homo sapiens
gaaagacaaauucaucugu

SEQ ID NO: 339187 - RNA, 19 nt, Homo sapiens
gacaaauucaucuguagua

SEQ ID NO: 339188 - RNA, 19 nt, Homo sapiens
gcucccuucucaucucuua

SEQ ID NO: 339189 - RNA, 19 nt, Homo sapiens
aaauguaccucuuucuuca

SEQ ID NO: 339190 - RNA, 19 nt, Homo sapiens
ggucauuaccaucucuuua

SEQ ID NO: 339191 - RNA, 19 nt, Homo sapiens
gagcugaaauguaagucau

SEQ ID NO: 339192 - RNA, 19 nt, Homo sapiens
aguaguaacuggccgauug

SEQ ID NO: 339193 - RNA, 19 nt, Homo sapiens
aggaagagcugcaaaggau

SEQ ID NO: 339194 - RNA, 19 nt, Homo sapiens
uacgugagauugcuaaaug

SEQ ID NO: 339195 - RNA, 19 nt, Homo sapiens
gaggagcaaccauuagaaa

SEQ ID NO: 339196 - RNA, 19 nt, Homo sapiens
ccacagacauccagugacu

SEQ ID NO: 339197 - RNA, 19 nt, Homo sapiens
uaauaaacgugaagauguc

SEQ ID NO: 339198 - RNA, 19 nt, Homo sapiens
caucuuguauucagcuuau

SEQ ID NO: 339199 - RNA, 19 nt, Homo sapiens
gugacacuguugaauguuu

SEQ ID NO: 339200 - RNA, 19 nt, Homo sapiens
ugcaaaggauaaagaauga

SEQ ID NO: 339201 - RNA, 19 nt, Homo sapiens
caaggaaauguaccucuuu

SEQ ID NO: 339202 - RNA, 19 nt, Homo sapiens
gcaggcgggucgucaaagu

SEQ ID NO: 339203 - RNA, 19 nt, Homo sapiens
gguccuagcauccaucuug

SEQ ID NO: 339204 - RNA, 19 nt, Homo sapiens
gacgauuaaucuauaggaa

SEQ ID NO: 339205 - RNA, 19 nt, Homo sapiens
uaacagagucacagucguu

SEQ ID NO: 339206 - RNA, 19 nt, Homo sapiens
ggguaaacaccaagaauau

SEQ ID NO: 339207 - RNA, 19 nt, Homo sapiens
cuuaaggcaucucuaggua

SEQ ID NO: 339208 - RNA, 19 nt, Homo sapiens
ucaacaaugugguaguaga

SEQ ID NO: 339209 - RNA, 19 nt, Homo sapiens
cgucuuuguuguagguuua

SEQ ID NO: 339210 - RNA, 19 nt, Homo sapiens
uuacuuaacccuguaguuu

SEQ ID NO: 339211 - RNA, 19 nt, Homo sapiens
cgauuaaucuauaggaaag

SEQ ID NO: 339212 - RNA, 19 nt, Homo sapiens
guaauuucuuggacuugaa

SEQ ID NO: 339213 - RNA, 19 nt, Homo sapiens
gauaauucccagcagauau

SEQ ID NO: 339214 - RNA, 19 nt, Homo sapiens
uaaggcaucucuagguaca

SEQ ID NO: 339215 - RNA, 19 nt, Homo sapiens
ugucaacaaugugguagua

SEQ ID NO: 339216 - RNA, 19 nt, Homo sapiens
gcauggagcccuuggagau

SEQ ID NO: 339217 - RNA, 19 nt, Homo sapiens
cauaaggaggugagaagua

SEQ ID NO: 339218 - RNA, 19 nt, Homo sapiens
uaaccuauauccggucaga

SEQ ID NO: 339219 - RNA, 19 nt, Homo sapiens
gaagacccagcaguuuaua

SEQ ID NO: 339220 - RNA, 19 nt, Homo sapiens
guucggugguuucuuguga

SEQ ID NO: 339221 - RNA, 19 nt, Homo sapiens
caaaggauaaagaaugaga

SEQ ID NO: 339222 - RNA, 19 nt, Homo sapiens
ggaagagcugcaaaggaua

SEQ ID NO: 339223 - RNA, 19 nt, Homo sapiens
acaaggaaauguaccucuu

SEQ ID NO: 339224 - RNA, 19 nt, Homo sapiens
ggaaagcucaaguaaaugc

SEQ ID NO: 339225 - RNA, 19 nt, Homo sapiens
uauaggaaagcucaaguaa

SEQ ID NO: 339226 - RNA, 19 nt, Homo sapiens
agggcagucucaauacuua

SEQ ID NO: 339227 - RNA, 19 nt, Homo sapiens
gcaaaccccaccucaaaua

SEQ ID NO: 339228 - RNA, 19 nt, Homo sapiens
gaaacaaucccaguaucau

SEQ ID NO: 339229 - RNA, 19 nt, Homo sapiens
cuucucaucucuuauguuc

SEQ ID NO: 339230 - RNA, 19 nt, Homo sapiens
ccagaagacccagcaguuu

SEQ ID NO: 339231 - RNA, 19 nt, Homo sapiens
cgaauucgcacugaugaaa

SEQ ID NO: 339232 - RNA, 19 nt, Homo sapiens
ggaaagacaaauucaucug

SEQ ID NO: 339233 - RNA, 19 nt, Homo sapiens
aagaauguauuggaaguug

SEQ ID NO: 339234 - RNA, 19 nt, Homo sapiens
ccacagcucccuucucauc

SEQ ID NO: 339235 - RNA, 19 nt, Homo sapiens
cagaaacaaucccaguauc

SEQ ID NO: 339236 - RNA, 19 nt, Homo sapiens
cggguaaacaccaagaaua

SEQ ID NO: 339237 - RNA, 19 nt, Homo sapiens
gagcugcaaaggauaaaga

SEQ ID NO: 339238 - RNA, 19 nt, Homo sapiens
ucucaucucuuauguucug

SEQ ID NO: 339239 - RNA, 19 nt, Homo sapiens
gcccacaucucuucagaac

SEQ ID NO: 339240 - RNA, 19 nt, Homo sapiens
caagaccaaccuucccuuu

SEQ ID NO: 339241 - RNA, 19 nt, Homo sapiens
cuaccagauuugccgauuu

SEQ ID NO: 339242 - RNA, 19 nt, Homo sapiens
gccgauugcuaaagaguuc

SEQ ID NO: 339243 - RNA, 19 nt, Homo sapiens
uauuggaaguugauggaaa

SEQ ID NO: 339244 - RNA, 19 nt, Homo sapiens
gaaagcagugguccuagca

SEQ ID NO: 339245 - RNA, 19 nt, Homo sapiens
guuugucuguugcgcauaa

SEQ ID NO: 339246 - RNA, 19 nt, Homo sapiens
cagauuuacuacagaguuc

SEQ ID NO: 339247 - RNA, 19 nt, Homo sapiens
aaaccugacugcauguauc

SEQ ID NO: 339248 - RNA, 19 nt, Homo sapiens
uuccuucucccuuaaauua

SEQ ID NO: 339249 - RNA, 19 nt, Homo sapiens
ucagaaacaaucccaguau

SEQ ID NO: 339250 - RNA, 19 nt, Homo sapiens
gcaggcggguaaacaccaa

SEQ ID NO: 339251 - RNA, 19 nt, Homo sapiens
ggaaacaagugaaagcaua

SEQ ID NO: 339252 - RNA, 19 nt, Homo sapiens
gaaugagucuguugugugu

SEQ ID NO: 339253 - RNA, 19 nt, Homo sapiens
acaaagauaugcagaacaa

SEQ ID NO: 339254 - RNA, 19 nt, Homo sapiens
ggugagaccugccugaaug

SEQ ID NO: 339255 - RNA, 19 nt, Homo sapiens
gaaagcauauggguuagau

SEQ ID NO: 339256 - RNA, 19 nt, Homo sapiens
cagcaucaccugccuguua

SEQ ID NO: 339257 - RNA, 19 nt, Homo sapiens
gcauauggguuagauguug

SEQ ID NO: 339258 - RNA, 19 nt, Homo sapiens
gaacugcucugaggagauc

SEQ ID NO: 339259 - RNA, 19 nt, Homo sapiens
gcagaggcguggcagacua

SEQ ID NO: 339260 - RNA, 19 nt, Homo sapiens
guaccaaucaugaaucuuu

SEQ ID NO: 339261 - RNA, 19 nt, Homo sapiens
ggacaucacggaucauaug

SEQ ID NO: 339262 - RNA, 19 nt, Homo sapiens
acagagagcuccugcuuca

SEQ ID NO: 339263 - RNA, 19 nt, Homo sapiens
uguuucagguucaguauua

SEQ ID NO: 339264 - RNA, 19 nt, Homo sapiens
caacagcuccuuccacuuc

SEQ ID NO: 339265 - RNA, 19 nt, Homo sapiens
gcacacggccagcagauga

SEQ ID NO: 339266 - RNA, 19 nt, Homo sapiens
gcgacaagguguugacguu

SEQ ID NO: 339267 - RNA, 19 nt, Homo sapiens
gcacagagagcuccugcuu

SEQ ID NO: 339268 - RNA, 19 nt, Homo sapiens
ggauuaauuugcaucugaa

SEQ ID NO: 339269 - RNA, 19 nt, Homo sapiens
ggcaagcccugcaagaaug

SEQ ID NO: 339270 - RNA, 19 nt, Homo sapiens
ggccagaacugugaggaaa

SEQ ID NO: 339271 - RNA, 19 nt, Homo sapiens
ugaaauaggaaacaaguga

SEQ ID NO: 339272 - RNA, 19 nt, Homo sapiens
gcacgcggauuaauuugca

SEQ ID NO: 339273 - RNA, 19 nt, Homo sapiens
gaacggggcuaacaaagau

SEQ ID NO: 339274 - RNA, 19 nt, Homo sapiens
ggagugggaccaacuguga

SEQ ID NO: 339275 - RNA, 19 nt, Homo sapiens
gaaacaagugaaagcauau

SEQ ID NO: 339276 - RNA, 19 nt, Homo sapiens
gaaauaggaaacaagugaa

SEQ ID NO: 339277 - RNA, 19 nt, Homo sapiens
cggauuaauuugcaucuga

SEQ ID NO: 339278 - RNA, 19 nt, Homo sapiens
caagagugcacccauggua

SEQ ID NO: 339279 - RNA, 19 nt, Homo sapiens
uaacaaagauaugcagaac

SEQ ID NO: 339280 - RNA, 19 nt, Homo sapiens
caauguggaugccgcaguu

SEQ ID NO: 339281 - RNA, 19 nt, Homo sapiens
ccugagggcuucaaagugu

SEQ ID NO: 339282 - RNA, 19 nt, Homo sapiens
gcagcgagaacauugauga

SEQ ID NO: 339283 - RNA, 19 nt, Homo sapiens
gaggaacuguagaugaugu

SEQ ID NO: 339284 - RNA, 19 nt, Homo sapiens
agugaaagcauauggguua

SEQ ID NO: 339285 - RNA, 19 nt, Homo sapiens
ggacccaacugcgagauca

SEQ ID NO: 339286 - RNA, 19 nt, Homo sapiens
gcaagaauggugccaagug

SEQ ID NO: 339287 - RNA, 19 nt, Homo sapiens
ccagaugcgucccaagaug

SEQ ID NO: 339288 - RNA, 19 nt, Homo sapiens
gaacgagcauaguccaaaa

SEQ ID NO: 339289 - RNA, 19 nt, Homo sapiens
aagaaaugauguuggagaa

SEQ ID NO: 339290 - RNA, 19 nt, Homo sapiens
gcgcaugcaucacgacauc

SEQ ID NO: 339291 - RNA, 19 nt, Homo sapiens
caacgaguguggccagaag

SEQ ID NO: 339292 - RNA, 19 nt, Homo sapiens
gaacuguagaugauguauu

SEQ ID NO: 339293 - RNA, 19 nt, Homo sapiens
gaagcaaggaggccaagga

SEQ ID NO: 339294 - RNA, 19 nt, Homo sapiens
cgucaucaauggcugcaaa

SEQ ID NO: 339295 - RNA, 19 nt, Homo sapiens
cgagaacauugaugacugu

SEQ ID NO: 339296 - RNA, 19 nt, Homo sapiens
gguuagauguugccaugug

SEQ ID NO: 339297 - RNA, 19 nt, Homo sapiens
ccggaggccuucaaguaaa

SEQ ID NO: 339298 - RNA, 19 nt, Homo sapiens
uggacaagaucaaugaguu

SEQ ID NO: 339299 - RNA, 19 nt, Homo sapiens
gaugcgagaucgacgucaa

SEQ ID NO: 339300 - RNA, 19 nt, Homo sapiens
gaccagaugcgucccaaga

SEQ ID NO: 339301 - RNA, 19 nt, Homo sapiens
caacauccaggacaacaug

SEQ ID NO: 339302 - RNA, 19 nt, Homo sapiens
gagaagggaaguugaacga

SEQ ID NO: 339303 - RNA, 19 nt, Homo sapiens
ugaggcugcuggacgagua

SEQ ID NO: 339304 - RNA, 19 nt, Homo sapiens
gcgaguccgucaucaaugg

SEQ ID NO: 339305 - RNA, 19 nt, Homo sapiens
ggacaagaucaaugaguuc

SEQ ID NO: 339306 - RNA, 19 nt, Homo sapiens
uguaguuguucguugguua

SEQ ID NO: 339307 - RNA, 19 nt, Homo sapiens
caguugugcuccugaagaa

SEQ ID NO: 339308 - RNA, 19 nt, Homo sapiens
acacagaaacacugccuuu

SEQ ID NO: 339309 - RNA, 19 nt, Homo sapiens
gcaguugugcuccugaaga

SEQ ID NO: 339310 - RNA, 19 nt, Homo sapiens
ggacugugcggagcaugua

SEQ ID NO: 339311 - RNA, 19 nt, Homo sapiens
ucagcgggauccacuguga

SEQ ID NO: 339312 - RNA, 19 nt, Homo sapiens
gaauccaacccuuguguca

SEQ ID NO: 339313 - RNA, 19 nt, Homo sapiens
gaccaacugugacaucaac

SEQ ID NO: 339314 - RNA, 19 nt, Homo sapiens
caucugaaauaggaaacaa

SEQ ID NO: 339315 - RNA, 19 nt, Homo sapiens
caacguggacgacugcaau

SEQ ID NO: 339316 - RNA, 19 nt, Homo sapiens
ggacugcagcgagaacauu

SEQ ID NO: 339317 - RNA, 19 nt, Homo sapiens
gguucaguauuauguaguu

SEQ ID NO: 339318 - RNA, 19 nt, Homo sapiens
ggacggacccaacacuuac

SEQ ID NO: 339319 - RNA, 19 nt, Homo sapiens
caugagauguguggacugu

SEQ ID NO: 339320 - RNA, 19 nt, Homo sapiens
gcaaaggcaagcccugcaa

SEQ ID NO: 339321 - RNA, 19 nt, Homo sapiens
ccugugaggucgacaucaa

SEQ ID NO: 339322 - RNA, 19 nt, Homo sapiens
gcacugcgaggucaacaca

SEQ ID NO: 339323 - RNA, 19 nt, Homo sapiens
caugaggaacuguagauga

SEQ ID NO: 339324 - RNA, 19 nt, Homo sapiens
gaugguuucuugcaagcau

SEQ ID NO: 339325 - RNA, 19 nt, Homo sapiens
guucugagagccaggguuu

SEQ ID NO: 339326 - RNA, 19 nt, Homo sapiens
aaacaagcaaguucugaga

SEQ ID NO: 339327 - RNA, 19 nt, Homo sapiens
gaagaacggggcuaacaaa

SEQ ID NO: 339328 - RNA, 19 nt, Homo sapiens
ugacugcucccucaacuuc

SEQ ID NO: 339329 - RNA, 19 nt, Homo sapiens
caaauucaacgggcucuug

SEQ ID NO: 339330 - RNA, 19 nt, Homo sapiens
ggugugcacugugagauca

SEQ ID NO: 339331 - RNA, 19 nt, Homo sapiens
ggaaguugaacgagcauag

SEQ ID NO: 339332 - RNA, 19 nt, Homo sapiens
gcacccaugguaccaauca

SEQ ID NO: 339333 - RNA, 19 nt, Homo sapiens
acaacgaggucggcuccua

SEQ ID NO: 339334 - RNA, 19 nt, Homo sapiens
uagaugaccugggcaaguc

SEQ ID NO: 339335 - RNA, 19 nt, Homo sapiens
ccaagaaguuccgguucga

SEQ ID NO: 339336 - RNA, 19 nt, Homo sapiens
gggaccaacugugacauca

SEQ ID NO: 339337 - RNA, 19 nt, Homo sapiens
cgacgucacccacgagugu

SEQ ID NO: 339338 - RNA, 19 nt, Homo sapiens
aaaugauacugauggugaa

SEQ ID NO: 339339 - RNA, 19 nt, Homo sapiens
guucguugguuauacaagu

SEQ ID NO: 339340 - RNA, 19 nt, Homo sapiens
gauguugccauguguuuua

SEQ ID NO: 339341 - RNA, 19 nt, Homo sapiens
gaacaacagggaggagaca

SEQ ID NO: 339342 - RNA, 19 nt, Homo sapiens
acagggagcauguguaaca

SEQ ID NO: 339343 - RNA, 19 nt, Homo sapiens
uaccaaucaugaaucuuug

SEQ ID NO: 339344 - RNA, 19 nt, Homo sapiens
ugucccagaugaugagcua

SEQ ID NO: 339345 - RNA, 19 nt, Homo sapiens
cacaaggugucuuccagau

SEQ ID NO: 339346 - RNA, 19 nt, Homo sapiens
acgaggaccuggagaccaa

SEQ ID NO: 339347 - RNA, 19 nt, Homo sapiens
ggcaauccgaggacuauga

SEQ ID NO: 339348 - RNA, 19 nt, Homo sapiens
uggacggacccaacacuua

SEQ ID NO: 339349 - RNA, 19 nt, Homo sapiens
gaguguguaugccaagagu

SEQ ID NO: 339350 - RNA, 19 nt, Homo sapiens
aaagauaugcagaacaaca

SEQ ID NO: 339351 - RNA, 19 nt, Homo sapiens
gcaauguggugaugggaaa

SEQ ID NO: 339352 - RNA, 19 nt, Homo sapiens
cggaggacauggccagaua

SEQ ID NO: 339353 - RNA, 19 nt, Homo sapiens
ggacauggccagauacuac

SEQ ID NO: 339354 - RNA, 19 nt, Homo sapiens
gcagagauauggaaaacga

SEQ ID NO: 339355 - RNA, 19 nt, Homo sapiens
gaugagagaaagcacagaa

SEQ ID NO: 339356 - RNA, 19 nt, Homo sapiens
cagccaccaugcuagguaa

SEQ ID NO: 339357 - RNA, 19 nt, Homo sapiens
ccagaacucggcuugaaga

SEQ ID NO: 339358 - RNA, 19 nt, Homo sapiens
gcccagagacacugauuuc

SEQ ID NO: 339359 - RNA, 19 nt, Homo sapiens
gauuucagaccucuugaug

SEQ ID NO: 339360 - RNA, 19 nt, Homo sapiens
uuucagaccucuugaugag

SEQ ID NO: 339361 - RNA, 19 nt, Homo sapiens
ucccagaacucggcuugaa

SEQ ID NO: 339362 - RNA, 19 nt, Homo sapiens
gcuugaagacccugcaaug

SEQ ID NO: 339363 - RNA, 19 nt, Homo sapiens
gacacuacaucaaccucau

SEQ ID NO: 339364 - RNA, 19 nt, Homo sapiens
ccaccaugcuagguaacaa

SEQ ID NO: 339365 - RNA, 19 nt, Homo sapiens
cgagaauccacccauccua

SEQ ID NO: 339366 - RNA, 19 nt, Homo sapiens
ccagccaccaugcuaggua

SEQ ID NO: 339367 - RNA, 19 nt, Homo sapiens
gcgcugcgacacuacauca

SEQ ID NO: 339368 - RNA, 19 nt, Homo sapiens
uugaagacccugcaaugug

SEQ ID NO: 339369 - RNA, 19 nt, Homo sapiens
ccacccauccuaccaaugc

SEQ ID NO: 339370 - RNA, 19 nt, Homo sapiens
ccaggcagagauauggaaa

SEQ ID NO: 339371 - RNA, 19 nt, Homo sapiens
gagagaaagcacagaaaau

SEQ ID NO: 339372 - RNA, 19 nt, Homo sapiens
gcacaaaccuuucaaguau

SEQ ID NO: 339373 - RNA, 19 nt, Homo sapiens
ccaaauugcuuguuucuuu

SEQ ID NO: 339374 - RNA, 19 nt, Homo sapiens
guauacagcucaccaauga

SEQ ID NO: 339375 - RNA, 19 nt, Homo sapiens
ggagagaaaugaagaaauc

SEQ ID NO: 339376 - RNA, 19 nt, Homo sapiens
cugcaaggcuuauugauua

SEQ ID NO: 339377 - RNA, 19 nt, Homo sapiens
gcaaagagucaccaaauuu

SEQ ID NO: 339378 - RNA, 19 nt, Homo sapiens
ggacaacacugccuuucaa

SEQ ID NO: 339379 - RNA, 19 nt, Homo sapiens
gcacucagcuccucuaucu

SEQ ID NO: 339380 - RNA, 19 nt, Homo sapiens
aaagagagucugagaauua

SEQ ID NO: 339381 - RNA, 19 nt, Homo sapiens
caaguuaacucgugcaaga

SEQ ID NO: 339382 - RNA, 19 nt, Homo sapiens
gaagucagcugcuaugaag

SEQ ID NO: 339383 - RNA, 19 nt, Homo sapiens
gcucagugguguuguauuu

SEQ ID NO: 339384 - RNA, 19 nt, Homo sapiens
gaagcuaaccuaauuggua

SEQ ID NO: 339385 - RNA, 19 nt, Homo sapiens
ggagaugacugcagugaga

SEQ ID NO: 339386 - RNA, 19 nt, Homo sapiens
gagauaagcagauuaaguu

SEQ ID NO: 339387 - RNA, 19 nt, Homo sapiens
aaacuagucuuaacuguug

SEQ ID NO: 339388 - RNA, 19 nt, Homo sapiens
gaaagagagucugagaauu

SEQ ID NO: 339389 - RNA, 19 nt, Homo sapiens
ggagguggcuggcucuaaa

SEQ ID NO: 339390 - RNA, 19 nt, Homo sapiens
caaggaaccugcuuugaug

SEQ ID NO: 339391 - RNA, 19 nt, Homo sapiens
ggaagaagggugugaguuu

SEQ ID NO: 339392 - RNA, 19 nt, Homo sapiens
ucaagaggcugcaccuuaa

SEQ ID NO: 339393 - RNA, 19 nt, Homo sapiens
gcagguagcucagaccauu

SEQ ID NO: 339394 - RNA, 19 nt, Homo sapiens
gcaacugccuuccagguuu

SEQ ID NO: 339395 - RNA, 19 nt, Homo sapiens
gaaacccaguaaccaauaa

SEQ ID NO: 339396 - RNA, 19 nt, Homo sapiens
gaugcuaccugucuggaua

SEQ ID NO: 339397 - RNA, 19 nt, Homo sapiens
gaagaagggugugaguuug

SEQ ID NO: 339398 - RNA, 19 nt, Homo sapiens
gugcaggucuucauauaaa

SEQ ID NO: 339399 - RNA, 19 nt, Homo sapiens
ggaggcagcucagauuuga

SEQ ID NO: 339400 - RNA, 19 nt, Homo sapiens
gcacugagagcuccuguuu

SEQ ID NO: 339401 - RNA, 19 nt, Homo sapiens
gaauggagguuccuguaug

SEQ ID NO: 339402 - RNA, 19 nt, Homo sapiens
gaacgauggucgcugcauu

SEQ ID NO: 339403 - RNA, 19 nt, Homo sapiens
aaccaaagguguaauguuu

SEQ ID NO: 339404 - RNA, 19 nt, Homo sapiens
ugaauugugugguaucuaa

SEQ ID NO: 339405 - RNA, 19 nt, Homo sapiens
cugauuaucuugcugcuua

SEQ ID NO: 339406 - RNA, 19 nt, Homo sapiens
gaagguacccugguuauug

SEQ ID NO: 339407 - RNA, 19 nt, Homo sapiens
uaacaugccugaugguuuc

SEQ ID NO: 339408 - RNA, 19 nt, Homo sapiens
guuguacccuugccauuua

SEQ ID NO: 339409 - RNA, 19 nt, Homo sapiens
gaacacauuugucccagau

SEQ ID NO: 339410 - RNA, 19 nt, Homo sapiens
ggucagcgguguaccauug

SEQ ID NO: 339411 - RNA, 19 nt, Homo sapiens
gugagugucugaaggguua

SEQ ID NO: 339412 - RNA, 19 nt, Homo sapiens
ggaaagagagucugagaau

SEQ ID NO: 339413 - RNA, 19 nt, Homo sapiens
ggaagaagucucugaguga

SEQ ID NO: 339414 - RNA, 19 nt, Homo sapiens
gauauuaacaggugaauuc

SEQ ID NO: 339415 - RNA, 19 nt, Homo sapiens
caacuaacguagaaacuca

SEQ ID NO: 339416 - RNA, 19 nt, Homo sapiens
ggagaggugugcuuguuga

SEQ ID NO: 339417 - RNA, 19 nt, Homo sapiens
ccacuuaccugauuugucu

SEQ ID NO: 339418 - RNA, 19 nt, Homo sapiens
ggacugaacuuuccuuagc

SEQ ID NO: 339419 - RNA, 19 nt, Homo sapiens
acaaugagauguuugguau

SEQ ID NO: 339420 - RNA, 19 nt, Homo sapiens
ucaaaggugugcauuguga

SEQ ID NO: 339421 - RNA, 19 nt, Homo sapiens
gaagggagcaccugugaga

SEQ ID NO: 339422 - RNA, 19 nt, Homo sapiens
caaggugucuuccagauuc

SEQ ID NO: 339423 - RNA, 19 nt, Homo sapiens
ggacugugcugcugaccaa

SEQ ID NO: 339424 - RNA, 19 nt, Homo sapiens
cagaagauguggaugaaug

SEQ ID NO: 339425 - RNA, 19 nt, Homo sapiens
gcaaauggaaguaccugua

SEQ ID NO: 339426 - RNA, 19 nt, Homo sapiens
gcauaugaaacuagucuua

SEQ ID NO: 339427 - RNA, 19 nt, Homo sapiens
acaacaacaugcagguuua

SEQ ID NO: 339428 - RNA, 19 nt, Homo sapiens
ggacacagcagcaccuuga

SEQ ID NO: 339429 - RNA, 19 nt, Homo sapiens
ggcaagaccuuugugcuuu

SEQ ID NO: 339430 - RNA, 19 nt, Homo sapiens
gugagaacauugaugauug

SEQ ID NO: 339431 - RNA, 19 nt, Homo sapiens
gcagugagaacauugauga

SEQ ID NO: 339432 - RNA, 19 nt, Homo sapiens
gaaaguaaaggcugaagau

SEQ ID NO: 339433 - RNA, 19 nt, Homo sapiens
gcagaccacuucaaagaca

SEQ ID NO: 339434 - RNA, 19 nt, Homo sapiens
gaaugcagcucucauccau

SEQ ID NO: 339435 - RNA, 19 nt, Homo sapiens
gcagugaccagauugauga

SEQ ID NO: 339436 - RNA, 19 nt, Homo sapiens
ggagaaagggaaugugaaa

SEQ ID NO: 339437 - RNA, 19 nt, Homo sapiens
gagcagcuguggacaagug

SEQ ID NO: 339438 - RNA, 19 nt, Homo sapiens
gggauuaacuccuucucuu

SEQ ID NO: 339439 - RNA, 19 nt, Homo sapiens
gaaugcugcuguuugcaaa

SEQ ID NO: 339440 - RNA, 19 nt, Homo sapiens
gaaacucaacagaacauuu

SEQ ID NO: 339441 - RNA, 19 nt, Homo sapiens
gaaacuagucuuaacuguu

SEQ ID NO: 339442 - RNA, 19 nt, Homo sapiens
ggagaacauugacaacugu

SEQ ID NO: 339443 - RNA, 19 nt, Homo sapiens
gcuguuauguaaaugauug

SEQ ID NO: 339444 - RNA, 19 nt, Homo sapiens
gaacugggauauaagucau

SEQ ID NO: 339445 - RNA, 19 nt, Homo sapiens
agccauagcuggugacaaa

SEQ ID NO: 339446 - RNA, 19 nt, Homo sapiens
caacagguuucagugauga

SEQ ID NO: 339447 - RNA, 19 nt, Homo sapiens
gagcaacccuugugugaac

SEQ ID NO: 339448 - RNA, 19 nt, Homo sapiens
ucauuuggguucugaauug

SEQ ID NO: 339449 - RNA, 19 nt, Homo sapiens
guagagacauaacugacuu

SEQ ID NO: 339450 - RNA, 19 nt, Homo sapiens
gagaggugguuuagggauu

SEQ ID NO: 339451 - RNA, 19 nt, Homo sapiens
aagguaagauggauaauca

SEQ ID NO: 339452 - RNA, 19 nt, Homo sapiens
ugugaaagcugucauuaca

SEQ ID NO: 339453 - RNA, 19 nt, Homo sapiens
gauaauggacaacuauaga

SEQ ID NO: 339454 - RNA, 19 nt, Homo sapiens
gagaagcaauucgucaguu

SEQ ID NO: 339455 - RNA, 19 nt, Homo sapiens
ccgaguaacugaucuagau

SEQ ID NO: 339456 - RNA, 19 nt, Homo sapiens
gcagaagguacccugguua

SEQ ID NO: 339457 - RNA, 19 nt, Homo sapiens
gaaugugccucaaauccau

SEQ ID NO: 339458 - RNA, 19 nt, Homo sapiens
gauauaagugucucuguga

SEQ ID NO: 339459 - RNA, 19 nt, Homo sapiens
gaaccaaagguguaauguu

SEQ ID NO: 339460 - RNA, 19 nt, Homo sapiens
gcagaagcauuuuaguuaa

SEQ ID NO: 339461 - RNA, 19 nt, Homo sapiens
gcaggagguggauguguua

SEQ ID NO: 339462 - RNA, 19 nt, Homo sapiens
gaaccaaggaaccugcuuu

SEQ ID NO: 339463 - RNA, 19 nt, Homo sapiens
gcauuaaucgcuacaguug

SEQ ID NO: 339464 - RNA, 19 nt, Homo sapiens
uggauaaagucaaucguuu

SEQ ID NO: 339465 - RNA, 19 nt, Homo sapiens
caagcucagugguguugua

SEQ ID NO: 339466 - RNA, 19 nt, Homo sapiens
guacuaugguuacuuccuu

SEQ ID NO: 339467 - RNA, 19 nt, Homo sapiens
caaaacagcccuauaagaa

SEQ ID NO: 339468 - RNA, 19 nt, Homo sapiens
ggagggaccugcucugacu

SEQ ID NO: 339469 - RNA, 19 nt, Homo sapiens
cagaggauguggaugaaug

SEQ ID NO: 339470 - RNA, 19 nt, Homo sapiens
gaccgcauauuccugacua

SEQ ID NO: 339471 - RNA, 19 nt, Homo sapiens
ggaaagguaugagggaaag

SEQ ID NO: 339472 - RNA, 19 nt, Homo sapiens
gggcuucagucuuccuuua

SEQ ID NO: 339473 - RNA, 19 nt, Homo sapiens
gaagacagcucccacuacu

SEQ ID NO: 339474 - RNA, 19 nt, Homo sapiens
gcaccuggcugcccguuau

SEQ ID NO: 339475 - RNA, 19 nt, Homo sapiens
guacugcgccgaccacuuu

SEQ ID NO: 339476 - RNA, 19 nt, Homo sapiens
gcagauguaugcauuccuu

SEQ ID NO: 339477 - RNA, 19 nt, Homo sapiens
ccacuucccuugucuguuc

SEQ ID NO: 339478 - RNA, 19 nt, Homo sapiens
uaauauggcuucuggucaa

SEQ ID NO: 339479 - RNA, 19 nt, Homo sapiens
ggacguagcccaggagaga

SEQ ID NO: 339480 - RNA, 19 nt, Homo sapiens
ccacgaggaugcuaucugu

SEQ ID NO: 339481 - RNA, 19 nt, Homo sapiens
ggucagaauugugaaguga

SEQ ID NO: 339482 - RNA, 19 nt, Homo sapiens
ggugugaacugcgaaguga

SEQ ID NO: 339483 - RNA, 19 nt, Homo sapiens
gcaccugccucgagagcuu

SEQ ID NO: 339484 - RNA, 19 nt, Homo sapiens
gcaacccgguguacgagaa

SEQ ID NO: 339485 - RNA, 19 nt, Homo sapiens
gaacugcgaagugaacauu

SEQ ID NO: 339486 - RNA, 19 nt, Homo sapiens
gcagucagaauaucgauga

SEQ ID NO: 339487 - RNA, 19 nt, Homo sapiens
cuacaauggugauaacugu

SEQ ID NO: 339488 - RNA, 19 nt, Homo sapiens
ucucuucccucauuccuuu

SEQ ID NO: 339489 - RNA, 19 nt, Homo sapiens
cgaaaccgcucuacagacu

SEQ ID NO: 339490 - RNA, 19 nt, Homo sapiens
gcuccugccucccugguuu

SEQ ID NO: 339491 - RNA, 19 nt, Homo sapiens
cgaccucacuuacgacugu

SEQ ID NO: 339492 - RNA, 19 nt, Homo sapiens
uaguaaugcuggagauuga

SEQ ID NO: 339493 - RNA, 19 nt, Homo sapiens
cggccaagcuggauucugu

SEQ ID NO: 339494 - RNA, 19 nt, Homo sapiens
cguccugccuccuuucuuu

SEQ ID NO: 339495 - RNA, 19 nt, Homo sapiens
aaaccgcucuacagacuug

SEQ ID NO: 339496 - RNA, 19 nt, Homo sapiens
gugaucggcucgguaguaa

SEQ ID NO: 339497 - RNA, 19 nt, Homo sapiens
gaucggcucgguaguaaug

SEQ ID NO: 339498 - RNA, 19 nt, Homo sapiens
gagagcugcagucagaaua

SEQ ID NO: 339499 - RNA, 19 nt, Homo sapiens
cagggcagauguaugcauu

SEQ ID NO: 339500 - RNA, 19 nt, Homo sapiens
gcuucagucuuccuuuauu

SEQ ID NO: 339501 - RNA, 19 nt, Homo sapiens
ccaagcggcuaaagguaga

SEQ ID NO: 339502 - RNA, 19 nt, Homo sapiens
ggagguuuccguugccuuu

SEQ ID NO: 339503 - RNA, 19 nt, Homo sapiens
ggaagcccgugugcaaaug

SEQ ID NO: 339504 - RNA, 19 nt, Homo sapiens
agacuggccuccuguguca

SEQ ID NO: 339505 - RNA, 19 nt, Homo sapiens
gcucgucaguucuuagauc

SEQ ID NO: 339506 - RNA, 19 nt, Homo sapiens
uggaugagcuugggaaauc

SEQ ID NO: 339507 - RNA, 19 nt, Homo sapiens
cagggugucuuccagauuc

SEQ ID NO: 339508 - RNA, 19 nt, Homo sapiens
gcaggaauggcgccaaaug

SEQ ID NO: 339509 - RNA, 19 nt, Homo sapiens
gcaaggaccgagucaaugg

SEQ ID NO: 339510 - RNA, 19 nt, Homo sapiens
caguucaccuguaucugua

SEQ ID NO: 339511 - RNA, 19 nt, Homo sapiens
caagcuggauucuguguac

SEQ ID NO: 339512 - RNA, 19 nt, Homo sapiens
ggagcccacugccaacaug

SEQ ID NO: 339513 - RNA, 19 nt, Homo sapiens
gaccugccguggcuauaug

SEQ ID NO: 339514 - RNA, 19 nt, Homo sapiens
ccucuucucuuuccaccaa

SEQ ID NO: 339515 - RNA, 19 nt, Homo sapiens
cagacuggauggacacaga

SEQ ID NO: 339516 - RNA, 19 nt, Homo sapiens
ugacugggaucccguguac

SEQ ID NO: 339517 - RNA, 19 nt, Homo sapiens
cuucagucuuccuuuauuu

SEQ ID NO: 339518 - RNA, 19 nt, Homo sapiens
auaaggacaugcaggauag

SEQ ID NO: 339519 - RNA, 19 nt, Homo sapiens
gccuagaccugguggacaa

SEQ ID NO: 339520 - RNA, 19 nt, Homo sapiens
ccgcguggcuucuuucuac

SEQ ID NO: 339521 - RNA, 19 nt, Homo sapiens
cgucaguucuuagaucuug

SEQ ID NO: 339522 - RNA, 19 nt, Homo sapiens
aauaaggacaugcaggaua

SEQ ID NO: 339523 - RNA, 19 nt, Homo sapiens
uggcauggaugucaaugug

SEQ ID NO: 339524 - RNA, 19 nt, Homo sapiens
gcacuugcaacccggugua

SEQ ID NO: 339525 - RNA, 19 nt, Homo sapiens
ggcaguguguggaugaaga

SEQ ID NO: 339526 - RNA, 19 nt, Homo sapiens
ggaauaguuaacacucaaa

SEQ ID NO: 339527 - RNA, 19 nt, Homo sapiens
gguuugagggucagaauug

SEQ ID NO: 339528 - RNA, 19 nt, Homo sapiens
ggugaucggcucgguagua

SEQ ID NO: 339529 - RNA, 19 nt, Homo sapiens
gcuggcgccucuucaacaa

SEQ ID NO: 339530 - RNA, 19 nt, Homo sapiens
cacaucagcuagcaucauc

SEQ ID NO: 339531 - RNA, 19 nt, Homo sapiens
guaguaaugcuggagauug

SEQ ID NO: 339532 - RNA, 19 nt, Homo sapiens
gagcugcagucagaauauc

SEQ ID NO: 339533 - RNA, 19 nt, Homo sapiens
gcccaacgccugccacaau

SEQ ID NO: 339534 - RNA, 19 nt, Homo sapiens
guacugguagccacuguga

SEQ ID NO: 339535 - RNA, 19 nt, Homo sapiens
uagagggcaugguggaaga

SEQ ID NO: 339536 - RNA, 19 nt, Homo sapiens
gaccuucaccugucacugu

SEQ ID NO: 339537 - RNA, 19 nt, Homo sapiens
acacuggcccuuccuguga

SEQ ID NO: 339538 - RNA, 19 nt, Homo sapiens
ccaguucaccuguaucugu

SEQ ID NO: 339539 - RNA, 19 nt, Homo sapiens
uacuuucucuuccugguaa

SEQ ID NO: 339540 - RNA, 19 nt, Homo sapiens
guacacgacccagguaugu

SEQ ID NO: 339541 - RNA, 19 nt, Homo sapiens
guacuggcgagacugcuuu

SEQ ID NO: 339542 - RNA, 19 nt, Homo sapiens
gcagucgccugagaaugau

SEQ ID NO: 339543 - RNA, 19 nt, Homo sapiens
gcgaggcagacaucaauga

SEQ ID NO: 339544 - RNA, 19 nt, Homo sapiens
gaucaggacaucaaugacu

SEQ ID NO: 339545 - RNA, 19 nt, Homo sapiens
guaacguggagaucaauga

SEQ ID NO: 339546 - RNA, 19 nt, Homo sapiens
cuacacagggccacuaugu

SEQ ID NO: 339547 - RNA, 19 nt, Homo sapiens
ggaugagcuugggaaauca

SEQ ID NO: 339548 - RNA, 19 nt, Homo sapiens
ucaguggacucaacaccau

SEQ ID NO: 339549 - RNA, 19 nt, Homo sapiens
guacuuucucuuccuggua

SEQ ID NO: 339550 - RNA, 19 nt, Homo sapiens
guaaaugugggacuacaag

SEQ ID NO: 339551 - RNA, 19 nt, Homo sapiens
gcuggauucuguguaccua

SEQ ID NO: 339552 - RNA, 19 nt, Homo sapiens
ggcaaguguuggccugaga

SEQ ID NO: 339553 - RNA, 19 nt, Homo sapiens
gggcugcggcugugaacaa

SEQ ID NO: 339554 - RNA, 19 nt, Homo sapiens
ggaugaggcagaugacaca

SEQ ID NO: 339555 - RNA, 19 nt, Homo sapiens
ugaagaggaugaggcagau

SEQ ID NO: 339556 - RNA, 19 nt, Homo sapiens
gcuucucacugcacaagga

SEQ ID NO: 339557 - RNA, 19 nt, Homo sapiens
ggaccugccguggcuauau

SEQ ID NO: 339558 - RNA, 19 nt, Homo sapiens
guggcgaccucacuuacga

SEQ ID NO: 339559 - RNA, 19 nt, Homo sapiens
ugcagucgccugagaauga

SEQ ID NO: 339560 - RNA, 19 nt, Homo sapiens
uagaccugguggacaagua

SEQ ID NO: 339561 - RNA, 19 nt, Homo sapiens
ccaccucccucacuucacu

SEQ ID NO: 339562 - RNA, 19 nt, Homo sapiens
aaugcuggcuuccuucugu

SEQ ID NO: 339563 - RNA, 19 nt, Homo sapiens
uggauggcgucaacaccua

SEQ ID NO: 339564 - RNA, 19 nt, Homo sapiens
ggacgacguggacgagugu

SEQ ID NO: 339565 - RNA, 19 nt, Homo sapiens
ccagggacgucagugugaa

SEQ ID NO: 339566 - RNA, 19 nt, Homo sapiens
cccaagcccugcauuguac

SEQ ID NO: 339567 - RNA, 19 nt, Homo sapiens
gcgcugggcaugaagaaca

SEQ ID NO: 339568 - RNA, 19 nt, Homo sapiens
caaugugcguggcccagau

SEQ ID NO: 339569 - RNA, 19 nt, Homo sapiens
ggggugcucugcgagauua

SEQ ID NO: 339570 - RNA, 19 nt, Homo sapiens
gcagcgauggaauggguuu

SEQ ID NO: 339571 - RNA, 19 nt, Homo sapiens
cugcaggaauggcgccaaa

SEQ ID NO: 339572 - RNA, 19 nt, Homo sapiens
acaaauggcugacaaauau

SEQ ID NO: 339573 - RNA, 19 nt, Homo sapiens
ggacagaacugcucaaagg

SEQ ID NO: 339574 - RNA, 19 nt, Homo sapiens
gaacucugcugguagcuuu

SEQ ID NO: 339575 - RNA, 19 nt, Homo sapiens
gaaccuggaugacuguauu

SEQ ID NO: 339576 - RNA, 19 nt, Homo sapiens
ggaaagaggguuuaagaug

SEQ ID NO: 339577 - RNA, 19 nt, Homo sapiens
cuaaaucugucacccauaa

SEQ ID NO: 339578 - RNA, 19 nt, Homo sapiens
ggaaggagcgguggaagua

SEQ ID NO: 339579 - RNA, 19 nt, Homo sapiens
ggacuuaugugcccagaag

SEQ ID NO: 339580 - RNA, 19 nt, Homo sapiens
aagcugauuugaaguguua

SEQ ID NO: 339581 - RNA, 19 nt, Homo sapiens
gcugaugacuccuugcauu

SEQ ID NO: 339582 - RNA, 19 nt, Homo sapiens
caacaaagaacuccacugu

SEQ ID NO: 339583 - RNA, 19 nt, Homo sapiens
gcaggcauaugggauguaa

SEQ ID NO: 339584 - RNA, 19 nt, Homo sapiens
gaguuuaguuucucuccua

SEQ ID NO: 339585 - RNA, 19 nt, Homo sapiens
gcacggacggugucaguaa

SEQ ID NO: 339586 - RNA, 19 nt, Homo sapiens
aaugaaggguugugaguuu

SEQ ID NO: 339587 - RNA, 19 nt, Homo sapiens
uggaagaccugguugaaga

SEQ ID NO: 339588 - RNA, 19 nt, Homo sapiens
ucaaggcacugaagccaaa

SEQ ID NO: 339589 - RNA, 19 nt, Homo sapiens
ggugugagguggagauaga

SEQ ID NO: 339590 - RNA, 19 nt, Homo sapiens
guacugccaugaucacuuc

SEQ ID NO: 339591 - RNA, 19 nt, Homo sapiens
ggucauggguguggauuug

SEQ ID NO: 339592 - RNA, 19 nt, Homo sapiens
cauaugggauguaagaugu

SEQ ID NO: 339593 - RNA, 19 nt, Homo sapiens
ggacagcauuggucucaag

SEQ ID NO: 339594 - RNA, 19 nt, Homo sapiens
ggagccagcugccuugauc

SEQ ID NO: 339595 - RNA, 19 nt, Homo sapiens
gggccaggcugaagaaaca

SEQ ID NO: 339596 - RNA, 19 nt, Homo sapiens
gaagggccacgcugucaaa

SEQ ID NO: 339597 - RNA, 19 nt, Homo sapiens
gcaggaggguccacguugu

SEQ ID NO: 339598 - RNA, 19 nt, Homo sapiens
cacaaauggcugacaaaua

SEQ ID NO: 339599 - RNA, 19 nt, Homo sapiens
uccaagaaaugcccauaaa

SEQ ID NO: 339600 - RNA, 19 nt, Homo sapiens
gaagagugucuguuugaug

SEQ ID NO: 339601 - RNA, 19 nt, Homo sapiens
guaaggaccagaaagacaa

SEQ ID NO: 339602 - RNA, 19 nt, Homo sapiens
ccaagucccugugaacaug

SEQ ID NO: 339603 - RNA, 19 nt, Homo sapiens
ggacugcuccgaagaugug

SEQ ID NO: 339604 - RNA, 19 nt, Homo sapiens
ggugagacgugccaguuuc

SEQ ID NO: 339605 - RNA, 19 nt, Homo sapiens
gcagaguggaguggaaaua

SEQ ID NO: 339606 - RNA, 19 nt, Homo sapiens
caacgggcacugugagaaa

SEQ ID NO: 339607 - RNA, 19 nt, Homo sapiens
gcacugagccaaggcauag

SEQ ID NO: 339608 - RNA, 19 nt, Homo sapiens
gcccaacccugcgauaaug

SEQ ID NO: 339609 - RNA, 19 nt, Homo sapiens
gaccaguacugccaugauc

SEQ ID NO: 339610 - RNA, 19 nt, Homo sapiens
gcaucugccugccuggauu

SEQ ID NO: 339611 - RNA, 19 nt, Homo sapiens
gggugugucuggccacgua

SEQ ID NO: 339612 - RNA, 19 nt, Homo sapiens
guaggacucuggguaagga

SEQ ID NO: 339613 - RNA, 19 nt, Homo sapiens
ccagaacccugugccaaug

SEQ ID NO: 339614 - RNA, 19 nt, Homo sapiens
ucagccaacccauguguua

SEQ ID NO: 339615 - RNA, 19 nt, Homo sapiens
uuaagaacccuaaaucugu

SEQ ID NO: 339616 - RNA, 19 nt, Homo sapiens
gcauaugggauguaagaug

SEQ ID NO: 339617 - RNA, 19 nt, Homo sapiens
ccaagcagauauguaagga

SEQ ID NO: 339618 - RNA, 19 nt, Homo sapiens
ggccggagccgauaaagau

SEQ ID NO: 339619 - RNA, 19 nt, Homo sapiens
uagaagggcagcucuguga

SEQ ID NO: 339620 - RNA, 19 nt, Homo sapiens
caccagagcagacaucuuc

SEQ ID NO: 339621 - RNA, 19 nt, Homo sapiens
ggacacccguggaccugau

SEQ ID NO: 339622 - RNA, 19 nt, Homo sapiens
ggcagaaguugaugaggau

SEQ ID NO: 339623 - RNA, 19 nt, Homo sapiens
aauggcagcugcucagaga

SEQ ID NO: 339624 - RNA, 19 nt, Homo sapiens
auagacgucucuucccuuu

SEQ ID NO: 339625 - RNA, 19 nt, Homo sapiens
aggaugggcuggacaccua

SEQ ID NO: 339626 - RNA, 19 nt, Homo sapiens
gcccacaaauggcugacaa

SEQ ID NO: 339627 - RNA, 19 nt, Homo sapiens
gcccaguccuccuccagaa

SEQ ID NO: 339628 - RNA, 19 nt, Homo sapiens
ggaagaccugguugaagaa

SEQ ID NO: 339629 - RNA, 19 nt, Homo sapiens
cagagauccucaugugugu

SEQ ID NO: 339630 - RNA, 19 nt, Homo sapiens
gugaggaggauaucgauga

SEQ ID NO: 339631 - RNA, 19 nt, Homo sapiens
gaagccaaaggcagaaguu

SEQ ID NO: 339632 - RNA, 19 nt, Homo sapiens
gcaccugucuggaccuacu

SEQ ID NO: 339633 - RNA, 19 nt, Homo sapiens
aaccagcacugacuacugu

SEQ ID NO: 339634 - RNA, 19 nt, Homo sapiens
aaaucugucacccauaaua

SEQ ID NO: 339635 - RNA, 19 nt, Homo sapiens
accaagaauugcaggcaua

SEQ ID NO: 339636 - RNA, 19 nt, Homo sapiens
gaaauaccccuaaguugga

SEQ ID NO: 339637 - RNA, 19 nt, Homo sapiens
ucagggccaugucucaaug

SEQ ID NO: 339638 - RNA, 19 nt, Homo sapiens
ugccagagauccucaugug

SEQ ID NO: 339639 - RNA, 19 nt, Homo sapiens
gugaggagaaccuggauga

SEQ ID NO: 339640 - RNA, 19 nt, Homo sapiens
gaaggguugugaguuuagu

SEQ ID NO: 339641 - RNA, 19 nt, Homo sapiens
caaaggcagaaguugauga

SEQ ID NO: 339642 - RNA, 19 nt, Homo sapiens
ccacagccaacccugcuuu

SEQ ID NO: 339643 - RNA, 19 nt, Homo sapiens
uaaagcugauuugaagugu

SEQ ID NO: 339644 - RNA, 19 nt, Homo sapiens
uauauaugguuuccaaagg

SEQ ID NO: 339645 - RNA, 19 nt, Homo sapiens
gaggacagcauuggucuca

SEQ ID NO: 339646 - RNA, 19 nt, Homo sapiens
caacugcaccugcccuaca

SEQ ID NO: 339647 - RNA, 19 nt, Homo sapiens
uauguaaggaccagaaaga

SEQ ID NO: 339648 - RNA, 19 nt, Homo sapiens
gauauguaaggaccagaaa

SEQ ID NO: 339649 - RNA, 19 nt, Homo sapiens
gauaaugcgaggaagauac

SEQ ID NO: 339650 - RNA, 19 nt, Homo sapiens
ucugaagagugucuguuug

SEQ ID NO: 339651 - RNA, 19 nt, Homo sapiens
agacgucucuucccuuugc

SEQ ID NO: 339652 - RNA, 19 nt, Homo sapiens
ccacuuggaagacaugugu

SEQ ID NO: 339653 - RNA, 19 nt, Homo sapiens
agaaaugcccauaaaccaa

SEQ ID NO: 339654 - RNA, 19 nt, Homo sapiens
gguucugccuccaacauuc

SEQ ID NO: 339655 - RNA, 19 nt, Homo sapiens
gggagcagacgccgcuauu

SEQ ID NO: 339656 - RNA, 19 nt, Homo sapiens
ugaugaggauggaguugug

SEQ ID NO: 339657 - RNA, 19 nt, Homo sapiens
guaaggaaggaucgugaug

SEQ ID NO: 339658 - RNA, 19 nt, Homo sapiens
ucugugagguggagaccaa

SEQ ID NO: 339659 - RNA, 19 nt, Homo sapiens
gccaacccauguguuaaug

SEQ ID NO: 339660 - RNA, 19 nt, Homo sapiens
caaauggcugacaaauauu

SEQ ID NO: 339661 - RNA, 19 nt, Homo sapiens
ccacaaauggcugacaaau

SEQ ID NO: 339662 - RNA, 19 nt, Homo sapiens
gcccagcucugccaaaaug

SEQ ID NO: 339663 - RNA, 19 nt, Homo sapiens
caagaaaugcccauaaacc

SEQ ID NO: 339664 - RNA, 19 nt, Homo sapiens
ccugggagcuugcgguucu

SEQ ID NO: 339665 - RNA, 19 nt, Homo sapiens
gaugacuggcccugugauu

SEQ ID NO: 339666 - RNA, 19 nt, Homo sapiens
gccaaaggcagaaguugau

SEQ ID NO: 339667 - RNA, 19 nt, Homo sapiens
gcagugccacccacagugu

SEQ ID NO: 339668 - RNA, 19 nt, Homo sapiens
agacucugauggacuuaug

SEQ ID NO: 339669 - RNA, 19 nt, Homo sapiens
aaucugucacccauaauaa

SEQ ID NO: 339670 - RNA, 19 nt, Homo sapiens
aaagaggguuuaagaugcu

SEQ ID NO: 339671 - RNA, 19 nt, Homo sapiens
augaaggguugugaguuua

SEQ ID NO: 339672 - RNA, 19 nt, Homo sapiens
ggauauggcuuaggaauga

SEQ ID NO: 339673 - RNA, 19 nt, Homo sapiens
uaaguggacuggugucaua

SEQ ID NO: 339674 - RNA, 19 nt, Homo sapiens
ggacuggugucauaaacuu

SEQ ID NO: 339675 - RNA, 19 nt, Homo sapiens
gaaagucucguuugguaaa

SEQ ID NO: 339676 - RNA, 19 nt, Homo sapiens
aagaaagucucguuuggua

SEQ ID NO: 339677 - RNA, 19 nt, Homo sapiens
gcaccagccugcacaccua

SEQ ID NO: 339678 - RNA, 19 nt, Homo sapiens
ggugagagaccacacauuu

SEQ ID NO: 339679 - RNA, 19 nt, Homo sapiens
ucugauagcuguuucaaau

SEQ ID NO: 339680 - RNA, 19 nt, Homo sapiens
caacagauaagaaaggaaa

SEQ ID NO: 339681 - RNA, 19 nt, Homo sapiens
gucauaaacuuucuccauu

SEQ ID NO: 339682 - RNA, 19 nt, Homo sapiens
ggaaacguguuguaucuac

SEQ ID NO: 339683 - RNA, 19 nt, Homo sapiens
ucagugaagucuagaauca

SEQ ID NO: 339684 - RNA, 19 nt, Homo sapiens
aagcagaaacagcauauua

SEQ ID NO: 339685 - RNA, 19 nt, Homo sapiens
guacaaguauuacaaccau

SEQ ID NO: 339686 - RNA, 19 nt, Homo sapiens
ucacauugcacucaucaua

SEQ ID NO: 339687 - RNA, 19 nt, Homo sapiens
uaacugaugaguaaacuga

SEQ ID NO: 339688 - RNA, 19 nt, Homo sapiens
uaagacacauugacuccuu

SEQ ID NO: 339689 - RNA, 19 nt, Homo sapiens
uaaaccagcucugaacuuc

SEQ ID NO: 339690 - RNA, 19 nt, Homo sapiens
cgaagaaagucucguuugg

SEQ ID NO: 339691 - RNA, 19 nt, Homo sapiens
gggauucucucaucuaacu

SEQ ID NO: 339692 - RNA, 19 nt, Homo sapiens
cagggauucucucaucuaa

SEQ ID NO: 339693 - RNA, 19 nt, Homo sapiens
uugcuuacauccucugaua

SEQ ID NO: 339694 - RNA, 19 nt, Homo sapiens
caagguaagcucaggauau

SEQ ID NO: 339695 - RNA, 19 nt, Homo sapiens
ucauagcccucagacauuu

SEQ ID NO: 339696 - RNA, 19 nt, Homo sapiens
agugaagucuagaaucaua

SEQ ID NO: 339697 - RNA, 19 nt, Homo sapiens
cuacuugucauaucacuaa

SEQ ID NO: 339698 - RNA, 19 nt, Homo sapiens
aagguaggcugcaaaauua

SEQ ID NO: 339699 - RNA, 19 nt, Homo sapiens
ugauagcuguuucaaaugu

SEQ ID NO: 339700 - RNA, 19 nt, Homo sapiens
cagagcagccaacagauaa

SEQ ID NO: 339701 - RNA, 19 nt, Homo sapiens
ccagagcagccaacagaua

SEQ ID NO: 339702 - RNA, 19 nt, Homo sapiens
gccuuacccuugcagcuua

SEQ ID NO: 339703 - RNA, 19 nt, Homo sapiens
gaacuuccaagcuccaaau

SEQ ID NO: 339704 - RNA, 19 nt, Homo sapiens
uugggaagauucucuauug

SEQ ID NO: 339705 - RNA, 19 nt, Homo sapiens
cuagugcaauuccaagaaa

SEQ ID NO: 339706 - RNA, 19 nt, Homo sapiens
acauugcacucaucauauu

SEQ ID NO: 339707 - RNA, 19 nt, Homo sapiens
ccuugaauccuauguauuu

SEQ ID NO: 339708 - RNA, 19 nt, Homo sapiens
uagcagggauucucucauc

SEQ ID NO: 339709 - RNA, 19 nt, Homo sapiens
uaggaaacguguuguaucu

SEQ ID NO: 339710 - RNA, 19 nt, Homo sapiens
gcagggauucucucaucua

SEQ ID NO: 339711 - RNA, 19 nt, Homo sapiens
gcuuaggaaugacuuacuu

SEQ ID NO: 339712 - RNA, 19 nt, Homo sapiens
aaugugagaugcugaaaca

SEQ ID NO: 339713 - RNA, 19 nt, Homo sapiens
gaucauaugaggaccuuuc

SEQ ID NO: 339714 - RNA, 19 nt, Homo sapiens
gcauugaacagaccacaga

SEQ ID NO: 339715 - RNA, 19 nt, Homo sapiens
cagagaugacuauuacuuu

SEQ ID NO: 339716 - RNA, 19 nt, Homo sapiens
gcagccaacagauaagaaa

SEQ ID NO: 339717 - RNA, 19 nt, Homo sapiens
gcccucagacauuuauaua

SEQ ID NO: 339718 - RNA, 19 nt, Homo sapiens
gaaacaugcagcucuucaa

SEQ ID NO: 339719 - RNA, 19 nt, Homo sapiens
caccaucaaaggaauauaa

SEQ ID NO: 339720 - RNA, 19 nt, Homo sapiens
cacauugacuccuuuccaa

SEQ ID NO: 339721 - RNA, 19 nt, Homo sapiens
gcgaagaaagucucguuug

SEQ ID NO: 339722 - RNA, 19 nt, Homo sapiens
augcagcucuucaacauga

SEQ ID NO: 339723 - RNA, 19 nt, Homo sapiens
uguagacuguuucacauug

SEQ ID NO: 339724 - RNA, 19 nt, Homo sapiens
cacaccaacuguccuaaga

SEQ ID NO: 339725 - RNA, 19 nt, Homo sapiens
ugacuccuuuccaauagaa

SEQ ID NO: 339726 - RNA, 19 nt, Homo sapiens
ccagagaugacuauuacuu

SEQ ID NO: 339727 - RNA, 19 nt, Homo sapiens
aagguaagcucaggauaug

SEQ ID NO: 339728 - RNA, 19 nt, Homo sapiens
aaauguaaccuaucacuca

SEQ ID NO: 339729 - RNA, 19 nt, Homo sapiens
ggaaacaugcagcucuuca

SEQ ID NO: 339730 - RNA, 19 nt, Homo sapiens
gaagaaagucucguuuggu

SEQ ID NO: 339731 - RNA, 19 nt, Homo sapiens
gaggaccuuucauaucugu

SEQ ID NO: 339732 - RNA, 19 nt, Homo sapiens
gggaaaauguaaccuauca

SEQ ID NO: 339733 - RNA, 19 nt, Homo sapiens
caagguaggcugcaaaauu

SEQ ID NO: 339734 - RNA, 19 nt, Homo sapiens
ugagagaccacacauuuua

SEQ ID NO: 339735 - RNA, 19 nt, Homo sapiens
guaaaccagcucugaacuu

SEQ ID NO: 339736 - RNA, 19 nt, Homo sapiens
caacuguccuaagaacaau

SEQ ID NO: 339737 - RNA, 19 nt, Homo sapiens
ccaacuguccuaagaacaa

SEQ ID NO: 339738 - RNA, 19 nt, Homo sapiens
caauaggaaccgucaaugu

SEQ ID NO: 339739 - RNA, 19 nt, Homo sapiens
gaaaacucaugaucaagau

SEQ ID NO: 339740 - RNA, 19 nt, Homo sapiens
ggcgagcagugccaaucua

SEQ ID NO: 339741 - RNA, 19 nt, Homo sapiens
gaagacuaccagagggaaa

SEQ ID NO: 339742 - RNA, 19 nt, Homo sapiens
gccaacagauaagaaagga

SEQ ID NO: 339743 - RNA, 19 nt, Homo sapiens
ccaaauccaaggaaacaug

SEQ ID NO: 339744 - RNA, 19 nt, Homo sapiens
ccaagaaaauaucacugua

SEQ ID NO: 339745 - RNA, 19 nt, Homo sapiens
gcaccaagaagucacucaa

SEQ ID NO: 339746 - RNA, 19 nt, Homo sapiens
cuaccgcaguggagagaaa

SEQ ID NO: 339747 - RNA, 19 nt, Homo sapiens
ccacccgggucaccaauag

SEQ ID NO: 339748 - RNA, 19 nt, Homo sapiens
uccaagagcugugguaugg

SEQ ID NO: 339749 - RNA, 19 nt, Homo sapiens
gauagcuguuucaaaugug

SEQ ID NO: 339750 - RNA, 19 nt, Homo sapiens
cagggcaaauagucaagaa

SEQ ID NO: 339751 - RNA, 19 nt, Homo sapiens
uaacugcccagcuccaaga

SEQ ID NO: 339752 - RNA, 19 nt, Homo sapiens
gcagagaugggcagauugg

SEQ ID NO: 339753 - RNA, 19 nt, Homo sapiens
ccucauagcccucagacau

SEQ ID NO: 339754 - RNA, 19 nt, Homo sapiens
aaacagaaaacucccaaua

SEQ ID NO: 339755 - RNA, 19 nt, Homo sapiens
acaugcagcucuucaacau

SEQ ID NO: 339756 - RNA, 19 nt, Homo sapiens
guaaugagucagugaaguc

SEQ ID NO: 339757 - RNA, 19 nt, Homo sapiens
gggaaagccugagcaugca

SEQ ID NO: 339758 - RNA, 19 nt, Homo sapiens
gaccacacauuuuaugaga

SEQ ID NO: 339759 - RNA, 19 nt, Homo sapiens
caagaagcacaccuacaga

SEQ ID NO: 339760 - RNA, 19 nt, Homo sapiens
uaaccuaucacucaagaag

SEQ ID NO: 339761 - RNA, 19 nt, Homo sapiens
uguaaccuaucacucaaga

SEQ ID NO: 339762 - RNA, 19 nt, Homo sapiens
gagggaaaauguaaccuau

SEQ ID NO: 339763 - RNA, 19 nt, Homo sapiens
gcaguggagagaaauuuca

SEQ ID NO: 339764 - RNA, 19 nt, Homo sapiens
gccagaagccacccuagga

SEQ ID NO: 339765 - RNA, 19 nt, Homo sapiens
uauccuugggccauaauua

SEQ ID NO: 339766 - RNA, 19 nt, Homo sapiens
ucaagaagcacaccuacag

SEQ ID NO: 339767 - RNA, 19 nt, Homo sapiens
gagcagccaacagauaaga

SEQ ID NO: 339768 - RNA, 19 nt, Homo sapiens
ccuggagagugcugugaaa

SEQ ID NO: 339769 - RNA, 19 nt, Homo sapiens
gcagaaacagcauauuagc

SEQ ID NO: 339770 - RNA, 19 nt, Homo sapiens
ucaagaagccagugauggu

SEQ ID NO: 339771 - RNA, 19 nt, Homo sapiens
agaagccacccuaggagua

SEQ ID NO: 339772 - RNA, 19 nt, Homo sapiens
ggaaugauaugcuuguuua

SEQ ID NO: 339773 - RNA, 19 nt, Homo sapiens
ccaaagcacuguccuguaa

SEQ ID NO: 339774 - RNA, 19 nt, Homo sapiens
cagcuuaucuugagaggua

SEQ ID NO: 339775 - RNA, 19 nt, Homo sapiens
caacacaggcugcucaaua

SEQ ID NO: 339776 - RNA, 19 nt, Homo sapiens
gaacuuaucauccagaaga

SEQ ID NO: 339777 - RNA, 19 nt, Homo sapiens
ucucaacacuuuagguuua

SEQ ID NO: 339778 - RNA, 19 nt, Homo sapiens
ugaaagugccaacaaauua

SEQ ID NO: 339779 - RNA, 19 nt, Homo sapiens
gguacaggauuggaaauua

SEQ ID NO: 339780 - RNA, 19 nt, Homo sapiens
cacaaaggaucacauauga

SEQ ID NO: 339781 - RNA, 19 nt, Homo sapiens
gaagcuaucugugauuuag

SEQ ID NO: 339782 - RNA, 19 nt, Homo sapiens
guacaggauuggaaauuau

SEQ ID NO: 339783 - RNA, 19 nt, Homo sapiens
cuucagagguugcacauuu

SEQ ID NO: 339784 - RNA, 19 nt, Homo sapiens
gaacuagacaauggaaaua

SEQ ID NO: 339785 - RNA, 19 nt, Homo sapiens
aaacaaacauugccaucuu

SEQ ID NO: 339786 - RNA, 19 nt, Homo sapiens
gggaucaacuugcaagaga

SEQ ID NO: 339787 - RNA, 19 nt, Homo sapiens
gagaaaagcuguaguaaac

SEQ ID NO: 339788 - RNA, 19 nt, Homo sapiens
ggacuguuauuucauuuag

SEQ ID NO: 339789 - RNA, 19 nt, Homo sapiens
gaaagugccaacaaauuau

SEQ ID NO: 339790 - RNA, 19 nt, Homo sapiens
uaccagauguuucauagaa

SEQ ID NO: 339791 - RNA, 19 nt, Homo sapiens
gacagucauuacuccauua

SEQ ID NO: 339792 - RNA, 19 nt, Homo sapiens
acaggcugcucaauauuua

SEQ ID NO: 339793 - RNA, 19 nt, Homo sapiens
gaaauagcagugccagaaa

SEQ ID NO: 339794 - RNA, 19 nt, Homo sapiens
gaaaagcuguugaacuuau

SEQ ID NO: 339795 - RNA, 19 nt, Homo sapiens
gcacucagcacucauagga

SEQ ID NO: 339796 - RNA, 19 nt, Homo sapiens
gcaacugcuugauaaguau

SEQ ID NO: 339797 - RNA, 19 nt, Homo sapiens
gcaaaugaaugcgacuaug

SEQ ID NO: 339798 - RNA, 19 nt, Homo sapiens
ggauguaguugaaauagca

SEQ ID NO: 339799 - RNA, 19 nt, Homo sapiens
ccucugcacuuaauacauu

SEQ ID NO: 339800 - RNA, 19 nt, Homo sapiens
gccaucaccucugcacuua

SEQ ID NO: 339801 - RNA, 19 nt, Homo sapiens
gcgaagacggccaguauuu

SEQ ID NO: 339802 - RNA, 19 nt, Homo sapiens
cagcacagcaggucugaua

SEQ ID NO: 339803 - RNA, 19 nt, Homo sapiens
gcugcuggaucuauaauug

SEQ ID NO: 339804 - RNA, 19 nt, Homo sapiens
gcgacuauguugacaaugu

SEQ ID NO: 339805 - RNA, 19 nt, Homo sapiens
gaucacauaugagcaagga

SEQ ID NO: 339806 - RNA, 19 nt, Homo sapiens
uauauggacucuucauuuc

SEQ ID NO: 339807 - RNA, 19 nt, Homo sapiens
caacaacugucacccucuu

SEQ ID NO: 339808 - RNA, 19 nt, Homo sapiens
ccaaugcaguuucuaauac

SEQ ID NO: 339809 - RNA, 19 nt, Homo sapiens
agacugaauucacuacuga

SEQ ID NO: 339810 - RNA, 19 nt, Homo sapiens
caacaaaaguucucacaug

SEQ ID NO: 339811 - RNA, 19 nt, Homo sapiens
ccaaggauguaguugaaau

SEQ ID NO: 339812 - RNA, 19 nt, Homo sapiens
ccagaucgcaucaaacaaa

SEQ ID NO: 339813 - RNA, 19 nt, Homo sapiens
ucucugaacugugaucuuu

SEQ ID NO: 339814 - RNA, 19 nt, Homo sapiens
gccaacaaauuauugauag

SEQ ID NO: 339815 - RNA, 19 nt, Homo sapiens
caucugaacuagacaaugg

SEQ ID NO: 339816 - RNA, 19 nt, Homo sapiens
cacagcaggucugauaaua

SEQ ID NO: 339817 - RNA, 19 nt, Homo sapiens
ugucuaagcugucuaaguc

SEQ ID NO: 339818 - RNA, 19 nt, Homo sapiens
gacagacaauuguucaguu

SEQ ID NO: 339819 - RNA, 19 nt, Homo sapiens
cauugccgcuauuauauuu

SEQ ID NO: 339820 - RNA, 19 nt, Homo sapiens
uaaagaacaaugaguguga

SEQ ID NO: 339821 - RNA, 19 nt, Homo sapiens
uggcugagcaacugaauua

SEQ ID NO: 339822 - RNA, 19 nt, Homo sapiens
gcacuguccuguaagucuu

SEQ ID NO: 339823 - RNA, 19 nt, Homo sapiens
ggaaaacauuaguggaaua

SEQ ID NO: 339824 - RNA, 19 nt, Homo sapiens
gagcuaaucagguaaagau

SEQ ID NO: 339825 - RNA, 19 nt, Homo sapiens
cuccagagcuaaucaggua

SEQ ID NO: 339826 - RNA, 19 nt, Homo sapiens
ugaacuauauggacucuuc

SEQ ID NO: 339827 - RNA, 19 nt, Homo sapiens
gugaagcuaucugugauuu

SEQ ID NO: 339828 - RNA, 19 nt, Homo sapiens
gcagucuaaucaugacaaa

SEQ ID NO: 339829 - RNA, 19 nt, Homo sapiens
aguggcagcugucucaaua

SEQ ID NO: 339830 - RNA, 19 nt, Homo sapiens
gaagggaggacagacaauu

SEQ ID NO: 339831 - RNA, 19 nt, Homo sapiens
gacaggucauuucagagua

SEQ ID NO: 339832 - RNA, 19 nt, Homo sapiens
gccaaugcaguuucuaaua

SEQ ID NO: 339833 - RNA, 19 nt, Homo sapiens
caucaccucugcacuuaau

SEQ ID NO: 339834 - RNA, 19 nt, Homo sapiens
caauaucaguuaugccaau

SEQ ID NO: 339835 - RNA, 19 nt, Homo sapiens
ggacauugagaacuugaaa

SEQ ID NO: 339836 - RNA, 19 nt, Homo sapiens
gaugcuccaugucugaauu

SEQ ID NO: 339837 - RNA, 19 nt, Homo sapiens
ccagcauuauuguaguuua

SEQ ID NO: 339838 - RNA, 19 nt, Homo sapiens
caaaguggcagcugucuca

SEQ ID NO: 339839 - RNA, 19 nt, Homo sapiens
gcaaccaauuaaagaacaa

SEQ ID NO: 339840 - RNA, 19 nt, Homo sapiens
acaagaggauccacaaagu

SEQ ID NO: 339841 - RNA, 19 nt, Homo sapiens
uaauccagaucgcaucaaa

SEQ ID NO: 339842 - RNA, 19 nt, Homo sapiens
uaaugcugcuacucugaua

SEQ ID NO: 339843 - RNA, 19 nt, Homo sapiens
gcuguuugcucccaugaug

SEQ ID NO: 339844 - RNA, 19 nt, Homo sapiens
ugcaacugcuugauaagua

SEQ ID NO: 339845 - RNA, 19 nt, Homo sapiens
ucaagaaggauguacugua

SEQ ID NO: 339846 - RNA, 19 nt, Homo sapiens
gggugcagcuuucccagaa

SEQ ID NO: 339847 - RNA, 19 nt, Homo sapiens
caaauaaugcugcuacucu

SEQ ID NO: 339848 - RNA, 19 nt, Homo sapiens
gugaaagugccaacaaauu

SEQ ID NO: 339849 - RNA, 19 nt, Homo sapiens
agacagggauaugcguaua

SEQ ID NO: 339850 - RNA, 19 nt, Homo sapiens
ucagagguguuucuagugu

SEQ ID NO: 339851 - RNA, 19 nt, Homo sapiens
ugaaauagcagugccagaa

SEQ ID NO: 339852 - RNA, 19 nt, Homo sapiens
gauacucuguagcugugua

SEQ ID NO: 339853 - RNA, 19 nt, Homo sapiens
aguauuuccugcaugcuua

SEQ ID NO: 339854 - RNA, 19 nt, Homo sapiens
ccauuaacauccucacugu

SEQ ID NO: 339855 - RNA, 19 nt, Homo sapiens
ggcccauucuucaucauuu

SEQ ID NO: 339856 - RNA, 19 nt, Homo sapiens
caaggauguaguugaaaua

SEQ ID NO: 339857 - RNA, 19 nt, Homo sapiens
ccgaaaagcuguugaacuu

SEQ ID NO: 339858 - RNA, 19 nt, Homo sapiens
cagcaggucugauaauagg

SEQ ID NO: 339859 - RNA, 19 nt, Homo sapiens
ggaaucagugguuagcauu

SEQ ID NO: 339860 - RNA, 19 nt, Homo sapiens
gguaaugacuauuuaucgu

SEQ ID NO: 339861 - RNA, 19 nt, Homo sapiens
cuauauggacucuucauuu

SEQ ID NO: 339862 - RNA, 19 nt, Homo sapiens
gcaacugaauuacaaaaga

SEQ ID NO: 339863 - RNA, 19 nt, Homo sapiens
caaaugaaugcgacuaugu

SEQ ID NO: 339864 - RNA, 19 nt, Homo sapiens
acacaaaggaucacauaug

SEQ ID NO: 339865 - RNA, 19 nt, Homo sapiens
gaacaccagcugcaacaca

SEQ ID NO: 339866 - RNA, 19 nt, Homo sapiens
acagacaauuguucaguug

SEQ ID NO: 339867 - RNA, 19 nt, Homo sapiens
gaaacuggagccaccauca

SEQ ID NO: 339868 - RNA, 19 nt, Homo sapiens
gggcgaagacggccaguau

SEQ ID NO: 339869 - RNA, 19 nt, Homo sapiens
gcacagcaggucugauaau

SEQ ID NO: 339870 - RNA, 19 nt, Homo sapiens
gaaaagcuguaguaaacug

SEQ ID NO: 339871 - RNA, 19 nt, Homo sapiens
ggacucuucauuucauauu

SEQ ID NO: 339872 - RNA, 19 nt, Homo sapiens
ggaaugauaugcuuguuua

SEQ ID NO: 339873 - RNA, 19 nt, Homo sapiens
ccaaagcacuguccuguaa

SEQ ID NO: 339874 - RNA, 19 nt, Homo sapiens
cagcuuaucuugagaggua

SEQ ID NO: 339875 - RNA, 19 nt, Homo sapiens
caacacaggcugcucaaua

SEQ ID NO: 339876 - RNA, 19 nt, Homo sapiens
gaacuuaucauccagaaga

SEQ ID NO: 339877 - RNA, 19 nt, Homo sapiens
ucucaacacuuuagguuua

SEQ ID NO: 339878 - RNA, 19 nt, Homo sapiens
ugaaagugccaacaaauua

SEQ ID NO: 339879 - RNA, 19 nt, Homo sapiens
gguacaggauuggaaauua

SEQ ID NO: 339880 - RNA, 19 nt, Homo sapiens
cacaaaggaucacauauga

SEQ ID NO: 339881 - RNA, 19 nt, Homo sapiens
gaagcuaucugugauuuag

SEQ ID NO: 339882 - RNA, 19 nt, Homo sapiens
guacaggauuggaaauuau

SEQ ID NO: 339883 - RNA, 19 nt, Homo sapiens
cuucagagguugcacauuu

SEQ ID NO: 339884 - RNA, 19 nt, Homo sapiens
gaacuagacaauggaaaua

SEQ ID NO: 339885 - RNA, 19 nt, Homo sapiens
gggaucaacuugcaagaga

SEQ ID NO: 339886 - RNA, 19 nt, Homo sapiens
gagaaaagcuguaguaaac

SEQ ID NO: 339887 - RNA, 19 nt, Homo sapiens
ggacuguuauuucauuuag

SEQ ID NO: 339888 - RNA, 19 nt, Homo sapiens
gaaagugccaacaaauuau

SEQ ID NO: 339889 - RNA, 19 nt, Homo sapiens
uaccagauguuucauagaa

SEQ ID NO: 339890 - RNA, 19 nt, Homo sapiens
gacagucauuacuccauua

SEQ ID NO: 339891 - RNA, 19 nt, Homo sapiens
acaggcugcucaauauuua

SEQ ID NO: 339892 - RNA, 19 nt, Homo sapiens
gaaauagcagugccagaaa

SEQ ID NO: 339893 - RNA, 19 nt, Homo sapiens
gaaaagcuguugaacuuau

SEQ ID NO: 339894 - RNA, 19 nt, Homo sapiens
gcacucagcacucauagga

SEQ ID NO: 339895 - RNA, 19 nt, Homo sapiens
gcaacugcuugauaaguau

SEQ ID NO: 339896 - RNA, 19 nt, Homo sapiens
gcaaaugaaugcgacuaug

SEQ ID NO: 339897 - RNA, 19 nt, Homo sapiens
ggauguaguugaaauagca

SEQ ID NO: 339898 - RNA, 19 nt, Homo sapiens
ccucugcacuuaauacauu

SEQ ID NO: 339899 - RNA, 19 nt, Homo sapiens
gccaucaccucugcacuua

SEQ ID NO: 339900 - RNA, 19 nt, Homo sapiens
gcgaagacggccaguauuu

SEQ ID NO: 339901 - RNA, 19 nt, Homo sapiens
cagcacagcaggucugaua

SEQ ID NO: 339902 - RNA, 19 nt, Homo sapiens
gcugcuggaucuauaauug

SEQ ID NO: 339903 - RNA, 19 nt, Homo sapiens
gcgacuauguugacaaugu

SEQ ID NO: 339904 - RNA, 19 nt, Homo sapiens
gaucacauaugagcaagga

SEQ ID NO: 339905 - RNA, 19 nt, Homo sapiens
uauauggacucuucauuuc

SEQ ID NO: 339906 - RNA, 19 nt, Homo sapiens
caacaacugucacccucuu

SEQ ID NO: 339907 - RNA, 19 nt, Homo sapiens
ccaaugcaguuucuaauac

SEQ ID NO: 339908 - RNA, 19 nt, Homo sapiens
agacugaauucacuacuga

SEQ ID NO: 339909 - RNA, 19 nt, Homo sapiens
caacaaaaguucucacaug

SEQ ID NO: 339910 - RNA, 19 nt, Homo sapiens
ccaaggauguaguugaaau

SEQ ID NO: 339911 - RNA, 19 nt, Homo sapiens
ucucugaacugugaucuuu

SEQ ID NO: 339912 - RNA, 19 nt, Homo sapiens
gccaacaaauuauugauag

SEQ ID NO: 339913 - RNA, 19 nt, Homo sapiens
caucugaacuagacaaugg

SEQ ID NO: 339914 - RNA, 19 nt, Homo sapiens
cacagcaggucugauaaua

SEQ ID NO: 339915 - RNA, 19 nt, Homo sapiens
ugucuaagcugucuaaguc

SEQ ID NO: 339916 - RNA, 19 nt, Homo sapiens
gacagacaauuguucaguu

SEQ ID NO: 339917 - RNA, 19 nt, Homo sapiens
cauugccgcuauuauauuu

SEQ ID NO: 339918 - RNA, 19 nt, Homo sapiens
uaaagaacaaugaguguga

SEQ ID NO: 339919 - RNA, 19 nt, Homo sapiens
uggcugagcaacugaauua

SEQ ID NO: 339920 - RNA, 19 nt, Homo sapiens
gcacuguccuguaagucuu

SEQ ID NO: 339921 - RNA, 19 nt, Homo sapiens
ggaaaacauuaguggaaua

SEQ ID NO: 339922 - RNA, 19 nt, Homo sapiens
ugaacuauauggacucuuc

SEQ ID NO: 339923 - RNA, 19 nt, Homo sapiens
gugaagcuaucugugauuu

SEQ ID NO: 339924 - RNA, 19 nt, Homo sapiens
gcagucuaaucaugacaaa

SEQ ID NO: 339925 - RNA, 19 nt, Homo sapiens
aguggcagcugucucaaua

SEQ ID NO: 339926 - RNA, 19 nt, Homo sapiens
gaagggaggacagacaauu

SEQ ID NO: 339927 - RNA, 19 nt, Homo sapiens
gaucgcaucaaacaaguaa

SEQ ID NO: 339928 - RNA, 19 nt, Homo sapiens
gacaggucauuucagagua

SEQ ID NO: 339929 - RNA, 19 nt, Homo sapiens
gccaaugcaguuucuaaua

SEQ ID NO: 339930 - RNA, 19 nt, Homo sapiens
caucaccucugcacuuaau

SEQ ID NO: 339931 - RNA, 19 nt, Homo sapiens
caauaucaguuaugccaau

SEQ ID NO: 339932 - RNA, 19 nt, Homo sapiens
ggacauugagaacuugaaa

SEQ ID NO: 339933 - RNA, 19 nt, Homo sapiens
gaugcuccaugucugaauu

SEQ ID NO: 339934 - RNA, 19 nt, Homo sapiens
ccagcauuauuguaguuua

SEQ ID NO: 339935 - RNA, 19 nt, Homo sapiens
caaaguggcagcugucuca

SEQ ID NO: 339936 - RNA, 19 nt, Homo sapiens
gcaaccaauuaaagaacaa

SEQ ID NO: 339937 - RNA, 19 nt, Homo sapiens
acaagaggauccacaaagu

SEQ ID NO: 339938 - RNA, 19 nt, Homo sapiens
uaauccagaucgcaucaaa

SEQ ID NO: 339939 - RNA, 19 nt, Homo sapiens
uaaugcugcuacucugaua

SEQ ID NO: 339940 - RNA, 19 nt, Homo sapiens
gcuguuugcucccaugaug

SEQ ID NO: 339941 - RNA, 19 nt, Homo sapiens
ugcaacugcuugauaagua

SEQ ID NO: 339942 - RNA, 19 nt, Homo sapiens
ucaagaaggauguacugua

SEQ ID NO: 339943 - RNA, 19 nt, Homo sapiens
gggugcagcuuucccagaa

SEQ ID NO: 339944 - RNA, 19 nt, Homo sapiens
caaauaaugcugcuacucu

SEQ ID NO: 339945 - RNA, 19 nt, Homo sapiens
gugaaagugccaacaaauu

SEQ ID NO: 339946 - RNA, 19 nt, Homo sapiens
agacagggauaugcguaua

SEQ ID NO: 339947 - RNA, 19 nt, Homo sapiens
ucagagguguuucuagugu

SEQ ID NO: 339948 - RNA, 19 nt, Homo sapiens
ugaaauagcagugccagaa

SEQ ID NO: 339949 - RNA, 19 nt, Homo sapiens
gauacucuguagcugugua

SEQ ID NO: 339950 - RNA, 19 nt, Homo sapiens
aguauuuccugcaugcuua

SEQ ID NO: 339951 - RNA, 19 nt, Homo sapiens
ccauuaacauccucacugu

SEQ ID NO: 339952 - RNA, 19 nt, Homo sapiens
ggcccauucuucaucauuu

SEQ ID NO: 339953 - RNA, 19 nt, Homo sapiens
caaggauguaguugaaaua

SEQ ID NO: 339954 - RNA, 19 nt, Homo sapiens
ccgaaaagcuguugaacuu

SEQ ID NO: 339955 - RNA, 19 nt, Homo sapiens
cagcaggucugauaauagg

SEQ ID NO: 339956 - RNA, 19 nt, Homo sapiens
ggaaucagugguuagcauu

SEQ ID NO: 339957 - RNA, 19 nt, Homo sapiens
gguaaugacuauuuaucgu

SEQ ID NO: 339958 - RNA, 19 nt, Homo sapiens
cuauauggacucuucauuu

SEQ ID NO: 339959 - RNA, 19 nt, Homo sapiens
gcaacugaauuacaaaaga

SEQ ID NO: 339960 - RNA, 19 nt, Homo sapiens
gggcgaagacggccaguau

SEQ ID NO: 339961 - RNA, 19 nt, Homo sapiens
gaaacuggagccaccauca

SEQ ID NO: 339962 - RNA, 19 nt, Homo sapiens
acagacaauuguucaguug

SEQ ID NO: 339963 - RNA, 19 nt, Homo sapiens
caaaugaaugcgacuaugu

SEQ ID NO: 339964 - RNA, 19 nt, Homo sapiens
acacaaaggaucacauaug

SEQ ID NO: 339965 - RNA, 19 nt, Homo sapiens
gaacaccagcugcaacaca

SEQ ID NO: 339966 - RNA, 19 nt, Homo sapiens
gcacagcaggucugauaau

SEQ ID NO: 339967 - RNA, 19 nt, Homo sapiens
gaaaagcuguaguaaacug

SEQ ID NO: 339968 - RNA, 19 nt, Homo sapiens
ggacucuucauuucauauu

SEQ ID NO: 339969 - RNA, 19 nt, Homo sapiens
acaggucauuucagaguaa

SEQ ID NO: 339970 - RNA, 19 nt, Homo sapiens
gcaccaagaggaccaauac

SEQ ID NO: 339971 - RNA, 19 nt, Homo sapiens
agagguguuucuaguguaa

SEQ ID NO: 339972 - RNA, 19 nt, Homo sapiens
gaagcaagauauaagagaa

SEQ ID NO: 339973 - RNA, 19 nt, Homo sapiens
ggaaguauauaaccaagau

SEQ ID NO: 339974 - RNA, 19 nt, Homo sapiens
gagcuaaucagaagcauaa

SEQ ID NO: 339975 - RNA, 19 nt, Homo sapiens
cuaauggacugucaauauu

SEQ ID NO: 339976 - RNA, 19 nt, Homo sapiens
aaacaaacauugccaucuu

SEQ ID NO: 339977 - RNA, 19 nt, Homo sapiens
gcugcuggaucuauaauug

SEQ ID NO: 339978 - RNA, 19 nt, Homo sapiens
gcgaagacggccaguauuu

SEQ ID NO: 339979 - RNA, 19 nt, Homo sapiens
ccagaucgcaucaaacaaa

SEQ ID NO: 339980 - RNA, 19 nt, Homo sapiens
gacagacaauuguucaguu

SEQ ID NO: 339981 - RNA, 19 nt, Homo sapiens
gcuuugcuauacugacuua

SEQ ID NO: 339982 - RNA, 19 nt, Homo sapiens
gcuaaucagaagcauaaua

SEQ ID NO: 339983 - RNA, 19 nt, Homo sapiens
gaacuaauggacugucaau

SEQ ID NO: 339984 - RNA, 19 nt, Homo sapiens
gaagggaggacagacaauu

SEQ ID NO: 339985 - RNA, 19 nt, Homo sapiens
uaauccagaucgcaucaaa

SEQ ID NO: 339986 - RNA, 19 nt, Homo sapiens
ccaucaagcugucuaaguc

SEQ ID NO: 339987 - RNA, 19 nt, Homo sapiens
caaaauccguaauucauug

SEQ ID NO: 339988 - RNA, 19 nt, Homo sapiens
gaaacuggagccaccauca

SEQ ID NO: 339989 - RNA, 19 nt, Homo sapiens
acagacaauuguucaguug

SEQ ID NO: 339990 - RNA, 19 nt, Homo sapiens
gggcgaagacggccaguau

SEQ ID NO: 339991 - RNA, 19 nt, Homo sapiens
guucauuuguuucuuguca

SEQ ID NO: 339992 - RNA, 19 nt, Homo sapiens
gcaccaagaggaccaauac

SEQ ID NO: 339993 - RNA, 19 nt, Homo sapiens
gaucaucuuaagcuaauug

SEQ ID NO: 339994 - RNA, 19 nt, Homo sapiens
gacagaaccagucagcauu

SEQ ID NO: 339995 - RNA, 19 nt, Homo sapiens
ugucuaaguccaaagauuu

SEQ ID NO: 339996 - RNA, 19 nt, Homo sapiens
gaaccagucagcauucuac

SEQ ID NO: 339997 - RNA, 19 nt, Homo sapiens
acuaauggacugucaauau

SEQ ID NO: 339998 - RNA, 19 nt, Homo sapiens
guuguucauuuguuucuug

SEQ ID NO: 339999 - RNA, 19 nt, Homo sapiens
ggcagaaggaaauguguuu

SEQ ID NO: 340000 - RNA, 19 nt, Homo sapiens
caaguccucuccaucugau

SEQ ID NO: 340001 - RNA, 19 nt, Homo sapiens
ggacagacaauuguucagu

SEQ ID NO: 340002 - RNA, 19 nt, Homo sapiens
gacugucaauauucagaaa

SEQ ID NO: 340003 - RNA, 19 nt, Homo sapiens
ggacugucaauauucagaa

SEQ ID NO: 340004 - RNA, 19 nt, Homo sapiens
ugucaauaguccugauuau

SEQ ID NO: 340005 - RNA, 19 nt, Homo sapiens
gcaguucauggauucauug

SEQ ID NO: 340006 - RNA, 19 nt, Homo sapiens
caagcugucuaaguccaaa

SEQ ID NO: 340007 - RNA, 19 nt, Homo sapiens
gaggacagacaauuguuca

SEQ ID NO: 340008 - RNA, 19 nt, Homo sapiens
cuccagagcuaaucagaag

SEQ ID NO: 340009 - RNA, 19 nt, Homo sapiens
gaagccggcagcaccaaga

SEQ ID NO: 340010 - RNA, 19 nt, Homo sapiens
ggaggacagacaauuguuc

SEQ ID NO: 340011 - RNA, 19 nt, Homo sapiens
caugaagcaagauauaaga

SEQ ID NO: 340012 - RNA, 19 nt, Homo sapiens
gagaaaugccccaaaaugu

SEQ ID NO: 340013 - RNA, 19 nt, Homo sapiens
uuaugcugcuggaucuaua

SEQ ID NO: 340014 - RNA, 19 nt, Homo sapiens
ccaacaguauuuuccagua

SEQ ID NO: 340015 - RNA, 19 nt, Homo sapiens
ccaaguccucuccaucuga

SEQ ID NO: 340016 - RNA, 19 nt, Homo sapiens
ggaccaauacgggcgaaga

SEQ ID NO: 340017 - RNA, 19 nt, Homo sapiens
gacaauuguucaguugcaa

SEQ ID NO: 340018 - RNA, 19 nt, Homo sapiens
aauggacugucaauauuca

SEQ ID NO: 340019 - RNA, 19 nt, Homo sapiens
cagcucccauccagcagaa

SEQ ID NO: 340020 - RNA, 19 nt, Homo sapiens
ugaagcaagauauaagaga

SEQ ID NO: 340021 - RNA, 19 nt, Homo sapiens
gggaagggaggacagacaa

SEQ ID NO: 340022 - RNA, 19 nt, Homo sapiens
agacaauuguucaguugca

SEQ ID NO: 340023 - RNA, 19 nt, Homo sapiens
gaagacggccaguauuuuc

SEQ ID NO: 340024 - RNA, 19 nt, Homo sapiens
gaucgcaucaaacaaacau

SEQ ID NO: 340025 - RNA, 19 nt, Homo sapiens
gaccaccguuaauccagau

SEQ ID NO: 340026 - RNA, 19 nt, Homo sapiens
uaauggacugucaauauuc

SEQ ID NO: 340027 - RNA, 19 nt, Homo sapiens
gcaagauauaagagaagaa

SEQ ID NO: 340028 - RNA, 19 nt, Homo sapiens
aacaaacauugccaucuuc

SEQ ID NO: 340029 - RNA, 19 nt, Homo sapiens
ccagggaacgguugaagca

SEQ ID NO: 340030 - RNA, 19 nt, Homo sapiens
cuacugagcgagugugcuu

SEQ ID NO: 340031 - RNA, 19 nt, Homo sapiens
gggcagaaggaaauguguu

SEQ ID NO: 340032 - RNA, 19 nt, Homo sapiens
caaacaaacauugccaucu

SEQ ID NO: 340033 - RNA, 19 nt, Homo sapiens
ggaagggaggacagacaau

SEQ ID NO: 340034 - RNA, 19 nt, Homo sapiens
uggauaucaugaagcaaga

SEQ ID NO: 340035 - RNA, 19 nt, Homo sapiens
agacagaaccagucagcau

SEQ ID NO: 340036 - RNA, 19 nt, Homo sapiens
gggaggacagacaauuguu

SEQ ID NO: 340037 - RNA, 19 nt, Homo sapiens
aaacuggagccaccaucaa

SEQ ID NO: 340038 - RNA, 19 nt, Homo sapiens
aagaacuaauggacuguca

SEQ ID NO: 340039 - RNA, 19 nt, Homo sapiens
caacaguauuuuccaguag

SEQ ID NO: 340040 - RNA, 19 nt, Homo sapiens
caagauauaagagaagaac

SEQ ID NO: 340041 - RNA, 19 nt, Homo sapiens
ucgcaucaaacaaacauug

SEQ ID NO: 340042 - RNA, 19 nt, Homo sapiens
ccagucagcauucuacaac

SEQ ID NO: 340043 - RNA, 19 nt, Homo sapiens
cgagaaaugccccaaaaug

SEQ ID NO: 340044 - RNA, 19 nt, Homo sapiens
gaacgguugaagcacugaa

SEQ ID NO: 340045 - RNA, 19 nt, Homo sapiens
cagaucgcaucaaacaaac

SEQ ID NO: 340046 - RNA, 19 nt, Homo sapiens
ucaugaagcaagauauaag

SEQ ID NO: 340047 - RNA, 19 nt, Homo sapiens
agcauaauaucuccuggau

SEQ ID NO: 340048 - RNA, 19 nt, Homo sapiens
caccaaguccucuccaucu

SEQ ID NO: 340049 - RNA, 19 nt, Homo sapiens
ugcaguucauggauucauu

SEQ ID NO: 340050 - RNA, 19 nt, Homo sapiens
cugucuaaguccaaagauu

SEQ ID NO: 340051 - RNA, 19 nt, Homo sapiens
ccaccaucaagcugucuaa

SEQ ID NO: 340052 - RNA, 19 nt, Homo sapiens
ccagagcuaaucagaagca

SEQ ID NO: 340053 - RNA, 19 nt, Homo sapiens
gccaagacagaaccaguca

SEQ ID NO: 340054 - RNA, 19 nt, Homo sapiens
uaguuaugcugcuggaucu

SEQ ID NO: 340055 - RNA, 19 nt, Homo sapiens
ggcgaagacggccaguauu

SEQ ID NO: 340056 - RNA, 19 nt, Homo sapiens
gcaagacguugguggagua

SEQ ID NO: 340057 - RNA, 19 nt, Homo sapiens
ccaaggagcugguggagau

SEQ ID NO: 340058 - RNA, 19 nt, Homo sapiens
gcauccagaucuccaagaa

SEQ ID NO: 340059 - RNA, 19 nt, Homo sapiens
gaugaggccuguggugugu

SEQ ID NO: 340060 - RNA, 19 nt, Homo sapiens
ugaaagccgugauggaaca

SEQ ID NO: 340061 - RNA, 19 nt, Homo sapiens
gcccaggucugugugauau

SEQ ID NO: 340062 - RNA, 19 nt, Homo sapiens
cucaauaccucaucaguca

SEQ ID NO: 340063 - RNA, 19 nt, Homo sapiens
ccacgcaagccgcucaaua

SEQ ID NO: 340064 - RNA, 19 nt, Homo sapiens
ggugaaagccgugauggaa

SEQ ID NO: 340065 - RNA, 19 nt, Homo sapiens
ccaucaagcucuccaaguc

SEQ ID NO: 340066 - RNA, 19 nt, Homo sapiens
gggugcagcugucccagaa

SEQ ID NO: 340067 - RNA, 19 nt, Homo sapiens
gagcggguaugccuaguac

SEQ ID NO: 340068 - RNA, 19 nt, Homo sapiens
gagaggaaggcgaauacuu

SEQ ID NO: 340069 - RNA, 19 nt, Homo sapiens
gaccucagcuugguguagu

SEQ ID NO: 340070 - RNA, 19 nt, Homo sapiens
ccgagaagguccgagaaau

SEQ ID NO: 340071 - RNA, 19 nt, Homo sapiens
gaagcuggcggcugagagu

SEQ ID NO: 340072 - RNA, 19 nt, Homo sapiens
gcagcugccucaacaucag

SEQ ID NO: 340073 - RNA, 19 nt, Homo sapiens
ugcagaagguacaagaaga

SEQ ID NO: 340074 - RNA, 19 nt, Homo sapiens
gaaaucccacaagcgauga

SEQ ID NO: 340075 - RNA, 19 nt, Homo sapiens
gcacggcagaggccuugaa

SEQ ID NO: 340076 - RNA, 19 nt, Homo sapiens
gaccggagccaccaucaag

SEQ ID NO: 340077 - RNA, 19 nt, Homo sapiens
cagcaacacgggagaggaa

SEQ ID NO: 340078 - RNA, 19 nt, Homo sapiens
ccaaccuccuggcauccua

SEQ ID NO: 340079 - RNA, 19 nt, Homo sapiens
cgagaagguccgagaaauc

SEQ ID NO: 340080 - RNA, 19 nt, Homo sapiens
guagucauaggcaggauug

SEQ ID NO: 340081 - RNA, 19 nt, Homo sapiens
ucagucagcgggucaccua

SEQ ID NO: 340082 - RNA, 19 nt, Homo sapiens
agauugcggugccugagaa

SEQ ID NO: 340083 - RNA, 19 nt, Homo sapiens
gccaucagcacggcgcuua

SEQ ID NO: 340084 - RNA, 19 nt, Homo sapiens
ucugugugauaucuguaua

SEQ ID NO: 340085 - RNA, 19 nt, Homo sapiens
gagauugcggugccugaga

SEQ ID NO: 340086 - RNA, 19 nt, Homo sapiens
ccaggucugugugauaucu

SEQ ID NO: 340087 - RNA, 19 nt, Homo sapiens
gccgagaagguccgagaaa

SEQ ID NO: 340088 - RNA, 19 nt, Homo sapiens
cggcagaggccuugaaugc

SEQ ID NO: 340089 - RNA, 19 nt, Homo sapiens
gcagaagguacaagaagac

SEQ ID NO: 340090 - RNA, 19 nt, Homo sapiens
ugagcgccaucgugcagaa

SEQ ID NO: 340091 - RNA, 19 nt, Homo sapiens
ggcccaggucugugugaua

SEQ ID NO: 340092 - RNA, 19 nt, Homo sapiens
gagccaagcaggccaagcu

SEQ ID NO: 340093 - RNA, 19 nt, Homo sapiens
gagaagguccgagaaaucc

SEQ ID NO: 340094 - RNA, 19 nt, Homo sapiens
gggagaggaaggcgaauac

SEQ ID NO: 340095 - RNA, 19 nt, Homo sapiens
gugcagaagguacaagaag

SEQ ID NO: 340096 - RNA, 19 nt, Homo sapiens
ccaagcaggccaagcugau

SEQ ID NO: 340097 - RNA, 19 nt, Homo sapiens
cggcugagagugccaagga

SEQ ID NO: 340098 - RNA, 19 nt, Homo sapiens
gagaagcuggcggcugaga

SEQ ID NO: 340099 - RNA, 19 nt, Homo sapiens
agccugagguggucaacau

SEQ ID NO: 340100 - RNA, 19 nt, Homo sapiens
caaacaagcugcacagaaa

SEQ ID NO: 340101 - RNA, 19 nt, Homo sapiens
caguuugucuccauucuua

SEQ ID NO: 340102 - RNA, 19 nt, Homo sapiens
gcacagaaauuggaacagu

SEQ ID NO: 340103 - RNA, 19 nt, Homo sapiens
uaagaacacugcagaaugg

SEQ ID NO: 340104 - RNA, 19 nt, Homo sapiens
uaggaggucugacugauaa

SEQ ID NO: 340105 - RNA, 19 nt, Homo sapiens
gcaauaaucugugguucug

SEQ ID NO: 340106 - RNA, 19 nt, Homo sapiens
ggauuugacucgggccuua

SEQ ID NO: 340107 - RNA, 19 nt, Homo sapiens
gaacggauacaccuaugaa

SEQ ID NO: 340108 - RNA, 19 nt, Homo sapiens
gaugaaagguuuggagauc

SEQ ID NO: 340109 - RNA, 19 nt, Homo sapiens
gcaaacaagcugcacagaa

SEQ ID NO: 340110 - RNA, 19 nt, Homo sapiens
acaaggucaucauggauua

SEQ ID NO: 340111 - RNA, 19 nt, Homo sapiens
gcaccgaccucaaguugca

SEQ ID NO: 340112 - RNA, 19 nt, Homo sapiens
gauuacaggugugagcaua

SEQ ID NO: 340113 - RNA, 19 nt, Homo sapiens
ggaaggcaccuaugugaug

SEQ ID NO: 340114 - RNA, 19 nt, Homo sapiens
ggauacaccuaugaagauu

SEQ ID NO: 340115 - RNA, 19 nt, Homo sapiens
ggagaaggccaaccaugaa

SEQ ID NO: 340116 - RNA, 19 nt, Homo sapiens
gcacggcacuguggacuuc

SEQ ID NO: 340117 - RNA, 19 nt, Homo sapiens
aacaaggacuaauccaaua

SEQ ID NO: 340118 - RNA, 19 nt, Homo sapiens
gcccaaugaugaaagguuu

SEQ ID NO: 340119 - RNA, 19 nt, Homo sapiens
ggaacaguuugucuccauu

SEQ ID NO: 340120 - RNA, 19 nt, Homo sapiens
ucagagggcccaaugauga

SEQ ID NO: 340121 - RNA, 19 nt, Homo sapiens
gcuucucacucaucacuaa

SEQ ID NO: 340122 - RNA, 19 nt, Homo sapiens
gaauggcuucugucucaua

SEQ ID NO: 340123 - RNA, 19 nt, Homo sapiens
gaccucaaguugcaauaau

SEQ ID NO: 340124 - RNA, 19 nt, Homo sapiens
gagaacggauacaccuaug

SEQ ID NO: 340125 - RNA, 19 nt, Homo sapiens
cuaacaaggucaucaugga

SEQ ID NO: 340126 - RNA, 19 nt, Homo sapiens
ucucaaagcugggauuaca

SEQ ID NO: 340127 - RNA, 19 nt, Homo sapiens
gccagauccucuucucaaa

SEQ ID NO: 340128 - RNA, 19 nt, Homo sapiens
gaaggccaaccaugaagaa

SEQ ID NO: 340129 - RNA, 19 nt, Homo sapiens
ggagaacggauacaccuau

SEQ ID NO: 340130 - RNA, 19 nt, Homo sapiens
aaacaaggacuaauccaau

SEQ ID NO: 340131 - RNA, 19 nt, Homo sapiens
ggccuuagaacuuugcaua

SEQ ID NO: 340132 - RNA, 19 nt, Homo sapiens
cucaguaccuggaaacaaa

SEQ ID NO: 340133 - RNA, 19 nt, Homo sapiens
gcagguuccacauguauga

SEQ ID NO: 340134 - RNA, 19 nt, Homo sapiens
gauacaccuaugaagauua

SEQ ID NO: 340135 - RNA, 19 nt, Homo sapiens
cuuagcagcuggcaaacaa

SEQ ID NO: 340136 - RNA, 19 nt, Homo sapiens
aggucugacugauaaauua

SEQ ID NO: 340137 - RNA, 19 nt, Homo sapiens
ucaugugccucuguccuua

SEQ ID NO: 340138 - RNA, 19 nt, Homo sapiens
caaacaaggacuaauccaa

SEQ ID NO: 340139 - RNA, 19 nt, Homo sapiens
gcauuccacucccugacaa

SEQ ID NO: 340140 - RNA, 19 nt, Homo sapiens
uggcuucugucucauacua

SEQ ID NO: 340141 - RNA, 19 nt, Homo sapiens
gaccaaacaaggacuaauc

SEQ ID NO: 340142 - RNA, 19 nt, Homo sapiens
ggagaugcccaggauuuga

SEQ ID NO: 340143 - RNA, 19 nt, Homo sapiens
guggagaugcccaggauuu

SEQ ID NO: 340144 - RNA, 19 nt, Homo sapiens
cacagaaauuggaacaguu

SEQ ID NO: 340145 - RNA, 19 nt, Homo sapiens
caggaaggcaccuauguga

SEQ ID NO: 340146 - RNA, 19 nt, Homo sapiens
aaggugacauucccaguga

SEQ ID NO: 340147 - RNA, 19 nt, Homo sapiens
gcccagaucuuugacuaca

SEQ ID NO: 340148 - RNA, 19 nt, Homo sapiens
gaacaguuugucuccauuc

SEQ ID NO: 340149 - RNA, 19 nt, Homo sapiens
gcugauccgugaccauauc

SEQ ID NO: 340150 - RNA, 19 nt, Homo sapiens
gguuguagcagaaaggaaa

SEQ ID NO: 340151 - RNA, 19 nt, Homo sapiens
ggccaaccaugaagaaguc

SEQ ID NO: 340152 - RNA, 19 nt, Homo sapiens
cuacuagcucuuugagaua

SEQ ID NO: 340153 - RNA, 19 nt, Homo sapiens
ccagaucuuugacuacagu

SEQ ID NO: 340154 - RNA, 19 nt, Homo sapiens
uacuagcucuuugagauaa

SEQ ID NO: 340155 - RNA, 19 nt, Homo sapiens
acagaaauuggaacaguuu

SEQ ID NO: 340156 - RNA, 19 nt, Homo sapiens
gaucuuugacuacagugaa

SEQ ID NO: 340157 - RNA, 19 nt, Homo sapiens
uaacucaggcccagaucuu

SEQ ID NO: 340158 - RNA, 19 nt, Homo sapiens
ggucugacugauaaauuaa

SEQ ID NO: 340159 - RNA, 19 nt, Homo sapiens
gaggucugacugauaaauu

SEQ ID NO: 340160 - RNA, 19 nt, Homo sapiens
gaaauuggaacaguuuguc

SEQ ID NO: 340161 - RNA, 19 nt, Homo sapiens
cagggcagguuccacaugu

SEQ ID NO: 340162 - RNA, 19 nt, Homo sapiens
cuagcucuuugagauaaua

SEQ ID NO: 340163 - RNA, 19 nt, Homo sapiens
uggagaaggccaaccauga

SEQ ID NO: 340164 - RNA, 19 nt, Homo sapiens
acucgggccuuagaacuuu

SEQ ID NO: 340165 - RNA, 19 nt, Homo sapiens
uaaaucaccagagaccaaa

SEQ ID NO: 340166 - RNA, 19 nt, Homo sapiens
ccucuguccuuagguugua

SEQ ID NO: 340167 - RNA, 19 nt, Homo sapiens
gucuuuggcuucucacuca

SEQ ID NO: 340168 - RNA, 19 nt, Homo sapiens
gggcagguuccacauguau

SEQ ID NO: 340169 - RNA, 19 nt, Homo sapiens
guguuuggguuccugaaug

SEQ ID NO: 340170 - RNA, 19 nt, Homo sapiens
gggcucaguucugccuuau

SEQ ID NO: 340171 - RNA, 19 nt, Homo sapiens
uaacaaggucaucauggau

SEQ ID NO: 340172 - RNA, 19 nt, Homo sapiens
gauuaggaggucugacuga

SEQ ID NO: 340173 - RNA, 19 nt, Homo sapiens
uuaggaggucugacugaua

SEQ ID NO: 340174 - RNA, 19 nt, Homo sapiens
uauaagaacacugcagaau

SEQ ID NO: 340175 - RNA, 19 nt, Homo sapiens
gcugggagcagacgcuguu

SEQ ID NO: 340176 - RNA, 19 nt, Homo sapiens
cagauccucuucucaaagc

SEQ ID NO: 340177 - RNA, 19 nt, Homo sapiens
ccacacaagacccaaguag

SEQ ID NO: 340178 - RNA, 19 nt, Homo sapiens
cggauacaccuaugaagau

SEQ ID NO: 340179 - RNA, 19 nt, Homo sapiens
auaagaacacugcagaaug

SEQ ID NO: 340180 - RNA, 19 nt, Homo sapiens
gugccucuguccuuagguu

SEQ ID NO: 340181 - RNA, 19 nt, Homo sapiens
uggcaucucccacacaaga

SEQ ID NO: 340182 - RNA, 19 nt, Homo sapiens
gagaaggccaaccaugaag

SEQ ID NO: 340183 - RNA, 19 nt, Homo sapiens
gcaacgugagcuacaggaa

SEQ ID NO: 340184 - RNA, 19 nt, Homo sapiens
cgaccucaaguugcaauaa

SEQ ID NO: 340185 - RNA, 19 nt, Homo sapiens
gcuguucucauuccuguuc

SEQ ID NO: 340186 - RNA, 19 nt, Homo sapiens
aggcccagaucuuugacua

SEQ ID NO: 340187 - RNA, 19 nt, Homo sapiens
ccaguugaccugccuugga

SEQ ID NO: 340188 - RNA, 19 nt, Homo sapiens
cggcagccuugcucaguuc

SEQ ID NO: 340189 - RNA, 19 nt, Homo sapiens
agucuuagcagcuggcaaa

SEQ ID NO: 340190 - RNA, 19 nt, Homo sapiens
ugaaagguuuggagaucgu

SEQ ID NO: 340191 - RNA, 19 nt, Homo sapiens
gcagggcagguuccacaug

SEQ ID NO: 340192 - RNA, 19 nt, Homo sapiens
ggaggucugacugauaaau

SEQ ID NO: 340193 - RNA, 19 nt, Homo sapiens
cuuagaacuuugcauagca

SEQ ID NO: 340194 - RNA, 19 nt, Homo sapiens
ggagcaacgugagcuacag

SEQ ID NO: 340195 - RNA, 19 nt, Homo sapiens
uaugaaggguacccacucu

SEQ ID NO: 340196 - RNA, 19 nt, Homo sapiens
gagaccaaacaaggacuaa

SEQ ID NO: 340197 - RNA, 19 nt, Homo sapiens
ucaaguugcaauaaucugu

SEQ ID NO: 340198 - RNA, 19 nt, Homo sapiens
aagcaccgaccucaaguug

SEQ ID NO: 340199 - RNA, 19 nt, Homo sapiens
ucuggcaucucccacacaa

SEQ ID NO: 340200 - RNA, 19 nt, Homo sapiens
gaucucaguuucccuagaa

SEQ ID NO: 340201 - RNA, 19 nt, Homo sapiens
ggacaagggucaggugaug

SEQ ID NO: 340202 - RNA, 19 nt, Homo sapiens
ggaaggagaaccuggaguu

SEQ ID NO: 340203 - RNA, 19 nt, Homo sapiens
ggugaugacugguuacuac

SEQ ID NO: 340204 - RNA, 19 nt, Homo sapiens
gcagcagcgucuucgacua

SEQ ID NO: 340205 - RNA, 19 nt, Homo sapiens
ccugggaggucacaucuug

SEQ ID NO: 340206 - RNA, 19 nt, Homo sapiens
ccucuucgcuugcagauac

SEQ ID NO: 340207 - RNA, 19 nt, Homo sapiens
gaaaauuccucuacaucuc

SEQ ID NO: 340208 - RNA, 19 nt, Homo sapiens
gcccguagcccugagaauu

SEQ ID NO: 340209 - RNA, 19 nt, Homo sapiens
cccguagcccugagaauua

SEQ ID NO: 340210 - RNA, 19 nt, Homo sapiens
gggcaaacgcaucaaagug

SEQ ID NO: 340211 - RNA, 19 nt, Homo sapiens
ccguagcccugagaauuaa

SEQ ID NO: 340212 - RNA, 19 nt, Homo sapiens
ggacaguggcgacgaggau

SEQ ID NO: 340213 - RNA, 19 nt, Homo sapiens
ggaucucaguuucccuaga

SEQ ID NO: 340214 - RNA, 19 nt, Homo sapiens
ccgcagcugcuaccaguuu

SEQ ID NO: 340215 - RNA, 19 nt, Homo sapiens
ugaaauccacgcucaccaa

SEQ ID NO: 340216 - RNA, 19 nt, Homo sapiens
ggcccgaguucaccucugu

SEQ ID NO: 340217 - RNA, 19 nt, Homo sapiens
gaggguggccaaacuccuu

SEQ ID NO: 340218 - RNA, 19 nt, Homo sapiens
cgaguucaccucugucauc

SEQ ID NO: 340219 - RNA, 19 nt, Homo sapiens
aauccacgcucaccaagag

SEQ ID NO: 340220 - RNA, 19 nt, Homo sapiens
gaaccaggaaggaaaauuc

SEQ ID NO: 340221 - RNA, 19 nt, Homo sapiens
gcgcuggucuccgaagucu

SEQ ID NO: 340222 - RNA, 19 nt, Homo sapiens
ggucucaccauccuugcuu

SEQ ID NO: 340223 - RNA, 19 nt, Homo sapiens
gcggaagcgaggucaaaug

SEQ ID NO: 340224 - RNA, 19 nt, Homo sapiens
ccagggcaaacgcaucaaa

SEQ ID NO: 340225 - RNA, 19 nt, Homo sapiens
ucguguggcugcagucugu

SEQ ID NO: 340226 - RNA, 19 nt, Homo sapiens
cugcacggaucucaguuuc

SEQ ID NO: 340227 - RNA, 19 nt, Homo sapiens
cagcgucuucgacuacauu

SEQ ID NO: 340228 - RNA, 19 nt, Homo sapiens
gcuuuguguucgccuugaa

SEQ ID NO: 340229 - RNA, 19 nt, Homo sapiens
gacaagggucaggugauga

SEQ ID NO: 340230 - RNA, 19 nt, Homo sapiens
ccagagccacguggacuug

SEQ ID NO: 340231 - RNA, 19 nt, Homo sapiens
cagagucagcgaccacaug

SEQ ID NO: 340232 - RNA, 19 nt, Homo sapiens
ugacagcgauuuagaguuu

SEQ ID NO: 340233 - RNA, 19 nt, Homo sapiens
cagagcaccuccaaucaua

SEQ ID NO: 340234 - RNA, 19 nt, Homo sapiens
ugacgaaccuuuagaggaa

SEQ ID NO: 340235 - RNA, 19 nt, Homo sapiens
gaaacacaaugaagucuca

SEQ ID NO: 340236 - RNA, 19 nt, Homo sapiens
ccacaauucuuaaaggaaa

SEQ ID NO: 340237 - RNA, 19 nt, Homo sapiens
gaaacaagucugagaagaa

SEQ ID NO: 340238 - RNA, 19 nt, Homo sapiens
ggagaggagucugaacuaa

SEQ ID NO: 340239 - RNA, 19 nt, Homo sapiens
ggcauuagauggcuucauu

SEQ ID NO: 340240 - RNA, 19 nt, Homo sapiens
gaauucacuucaaggcaua

SEQ ID NO: 340241 - RNA, 19 nt, Homo sapiens
gaaaggagguuugcuucau

SEQ ID NO: 340242 - RNA, 19 nt, Homo sapiens
acaagaacauucagaaguu

SEQ ID NO: 340243 - RNA, 19 nt, Homo sapiens
gcaaagggaagucguguug

SEQ ID NO: 340244 - RNA, 19 nt, Homo sapiens
ucaauguucucaucaaaga

SEQ ID NO: 340245 - RNA, 19 nt, Homo sapiens
gaaccucggcagcacuuua

SEQ ID NO: 340246 - RNA, 19 nt, Homo sapiens
caagaacauucagaaguuu

SEQ ID NO: 340247 - RNA, 19 nt, Homo sapiens
acaaucagcuuuaaccaau

SEQ ID NO: 340248 - RNA, 19 nt, Homo sapiens
ucaagaaguucccacaaau

SEQ ID NO: 340249 - RNA, 19 nt, Homo sapiens
ggcaacaccacaauucuua

SEQ ID NO: 340250 - RNA, 19 nt, Homo sapiens
cagcaggacucgcuacuuc

SEQ ID NO: 340251 - RNA, 19 nt, Homo sapiens
aggaagagcuccacaagau

SEQ ID NO: 340252 - RNA, 19 nt, Homo sapiens
ucaaagagcucaguuccau

SEQ ID NO: 340253 - RNA, 19 nt, Homo sapiens
gaacuaaaccccuggcuuu

SEQ ID NO: 340254 - RNA, 19 nt, Homo sapiens
ggaaaucugugacauucag

SEQ ID NO: 340255 - RNA, 19 nt, Homo sapiens
cacacucgguggucaguua

SEQ ID NO: 340256 - RNA, 19 nt, Homo sapiens
aaggaaaugugcauaguug

SEQ ID NO: 340257 - RNA, 19 nt, Homo sapiens
gagaggagucugaacuaaa

SEQ ID NO: 340258 - RNA, 19 nt, Homo sapiens
aaaggagguuugcuucauu

SEQ ID NO: 340259 - RNA, 19 nt, Homo sapiens
cgaaacaagucugagaaga

SEQ ID NO: 340260 - RNA, 19 nt, Homo sapiens
gcacacagccaugucagaa

SEQ ID NO: 340261 - RNA, 19 nt, Homo sapiens
gaacaagaacauucagaag

SEQ ID NO: 340262 - RNA, 19 nt, Homo sapiens
uaaauuuccucccagaaca

SEQ ID NO: 340263 - RNA, 19 nt, Homo sapiens
guucaauguucucaucaaa

SEQ ID NO: 340264 - RNA, 19 nt, Homo sapiens
gcacugaagucgggacaca

SEQ ID NO: 340265 - RNA, 19 nt, Homo sapiens
caaccucuuugcacaguga

SEQ ID NO: 340266 - RNA, 19 nt, Homo sapiens
ugacaacacccuuucaaga

SEQ ID NO: 340267 - RNA, 19 nt, Homo sapiens
aaacaagucugagaagaag

SEQ ID NO: 340268 - RNA, 19 nt, Homo sapiens
uuagauggcuucauuaucg

SEQ ID NO: 340269 - RNA, 19 nt, Homo sapiens
gaaagacagagccaagaga

SEQ ID NO: 340270 - RNA, 19 nt, Homo sapiens
uaaaggaaaugugcauagu

SEQ ID NO: 340271 - RNA, 19 nt, Homo sapiens
caacaccacaauucuuaaa

SEQ ID NO: 340272 - RNA, 19 nt, Homo sapiens
ucacccagcugauguugga

SEQ ID NO: 340273 - RNA, 19 nt, Homo sapiens
ucacagagcaccuccaauc

SEQ ID NO: 340274 - RNA, 19 nt, Homo sapiens
gcagaaacacaaugaaguc

SEQ ID NO: 340275 - RNA, 19 nt, Homo sapiens
cauaguugacgaaccuuua

SEQ ID NO: 340276 - RNA, 19 nt, Homo sapiens
gcauuagauggcuucauua

SEQ ID NO: 340277 - RNA, 19 nt, Homo sapiens
gaaccucaggcuaugacua

SEQ ID NO: 340278 - RNA, 19 nt, Homo sapiens
ugucauggaucagaauuug

SEQ ID NO: 340279 - RNA, 19 nt, Homo sapiens
ccucaguaaugaagaauuc

SEQ ID NO: 340280 - RNA, 19 nt, Homo sapiens
gggacacaaucagcuuuaa

SEQ ID NO: 340281 - RNA, 19 nt, Homo sapiens
cucaagaaguucccacaaa

SEQ ID NO: 340282 - RNA, 19 nt, Homo sapiens
gcaacaccacaauucuuaa

SEQ ID NO: 340283 - RNA, 19 nt, Homo sapiens
ggacaaaaccaccguguug

SEQ ID NO: 340284 - RNA, 19 nt, Homo sapiens
gcagauguccggguggaaa

SEQ ID NO: 340285 - RNA, 19 nt, Homo sapiens
ggaaaggagguuugcuuca

SEQ ID NO: 340286 - RNA, 19 nt, Homo sapiens
cgucggaugucauggauca

SEQ ID NO: 340287 - RNA, 19 nt, Homo sapiens
ggaugaagaugagaaagac

SEQ ID NO: 340288 - RNA, 19 nt, Homo sapiens
ccaguucaauguucucauc

SEQ ID NO: 340289 - RNA, 19 nt, Homo sapiens
aggcauagcuuggaaugga

SEQ ID NO: 340290 - RNA, 19 nt, Homo sapiens
gggagaggagucugaacua

SEQ ID NO: 340291 - RNA, 19 nt, Homo sapiens
gaucacagagcaccuccaa

SEQ ID NO: 340292 - RNA, 19 nt, Homo sapiens
caccacaauucuuaaagga

SEQ ID NO: 340293 - RNA, 19 nt, Homo sapiens
ccacaaauccucgcacaca

SEQ ID NO: 340294 - RNA, 19 nt, Homo sapiens
ccucagcacuaaaggacaa

SEQ ID NO: 340295 - RNA, 19 nt, Homo sapiens
gcccagacuucagccauga

SEQ ID NO: 340296 - RNA, 19 nt, Homo sapiens
uaggauaccugccuuuuga

SEQ ID NO: 340297 - RNA, 19 nt, Homo sapiens
caccuccaaucauaggaua

SEQ ID NO: 340298 - RNA, 19 nt, Homo sapiens
uuagaggaauucacuucaa

SEQ ID NO: 340299 - RNA, 19 nt, Homo sapiens
gaauucacccagcugaugu

SEQ ID NO: 340300 - RNA, 19 nt, Homo sapiens
cagacucacuacuacauca

SEQ ID NO: 340301 - RNA, 19 nt, Homo sapiens
gagaaagacagagccaaga

SEQ ID NO: 340302 - RNA, 19 nt, Homo sapiens
agaggagucugaacuaaac

SEQ ID NO: 340303 - RNA, 19 nt, Homo sapiens
caaggcagcccucggaagu

SEQ ID NO: 340304 - RNA, 19 nt, Homo sapiens
caagaaguucccacaaauc

SEQ ID NO: 340305 - RNA, 19 nt, Homo sapiens
gcugggaaccucaggcuau

SEQ ID NO: 340306 - RNA, 19 nt, Homo sapiens
ucuaauggaugaagaugag

SEQ ID NO: 340307 - RNA, 19 nt, Homo sapiens
ucugugacauucagcaaga

SEQ ID NO: 340308 - RNA, 19 nt, Homo sapiens
uagaggaauucacuucaag

SEQ ID NO: 340309 - RNA, 19 nt, Homo sapiens
ggaaaaggucaucggauuu

SEQ ID NO: 340310 - RNA, 19 nt, Homo sapiens
gcuugaacccaaaggaauu

SEQ ID NO: 340311 - RNA, 19 nt, Homo sapiens
aaacggaaaucugugacau

SEQ ID NO: 340312 - RNA, 19 nt, Homo sapiens
gguccaaagccaaugagaa

SEQ ID NO: 340313 - RNA, 19 nt, Homo sapiens
gaccaucaaagaccagcua

SEQ ID NO: 340314 - RNA, 19 nt, Homo sapiens
ggcauagcuuggaauggaa

SEQ ID NO: 340315 - RNA, 19 nt, Homo sapiens
acggaaaucugugacauuc

SEQ ID NO: 340316 - RNA, 19 nt, Homo sapiens
ccaaaggucagcaguggau

SEQ ID NO: 340317 - RNA, 19 nt, Homo sapiens
aaugaagucucagcgcaaa

SEQ ID NO: 340318 - RNA, 19 nt, Homo sapiens
uagcuuggaauggaaauuu

SEQ ID NO: 340319 - RNA, 19 nt, Homo sapiens
gugcauaguugacgaaccu

SEQ ID NO: 340320 - RNA, 19 nt, Homo sapiens
aaggagguuugcuucauug

SEQ ID NO: 340321 - RNA, 19 nt, Homo sapiens
gacaacacccuuucaagac

SEQ ID NO: 340322 - RNA, 19 nt, Homo sapiens
agaacaagaacauucagaa

SEQ ID NO: 340323 - RNA, 19 nt, Homo sapiens
gauguuggaggcauuagau

SEQ ID NO: 340324 - RNA, 19 nt, Homo sapiens
caaucagcuuuaaccaaug

SEQ ID NO: 340325 - RNA, 19 nt, Homo sapiens
ggacgggacggcaagucaa

SEQ ID NO: 340326 - RNA, 19 nt, Homo sapiens
cagcagcagcuacagcaaa

SEQ ID NO: 340327 - RNA, 19 nt, Homo sapiens
ggaagagcuccacaagauc

SEQ ID NO: 340328 - RNA, 19 nt, Homo sapiens
ucaccuaccaucaguggaa

SEQ ID NO: 340329 - RNA, 19 nt, Homo sapiens
gcugcagacucacuacuac

SEQ ID NO: 340330 - RNA, 19 nt, Homo sapiens
guacaggcaccaaccucuu

SEQ ID NO: 340331 - RNA, 19 nt, Homo sapiens
gguggucaguuacgcagau

SEQ ID NO: 340332 - RNA, 19 nt, Homo sapiens
gaaagcacaugccaguuua

SEQ ID NO: 340333 - RNA, 19 nt, Homo sapiens
acaaggaucugccauaaua

SEQ ID NO: 340334 - RNA, 19 nt, Homo sapiens
gaacagaagugugacauug

SEQ ID NO: 340335 - RNA, 19 nt, Homo sapiens
gcaauaaugucaucucuau

SEQ ID NO: 340336 - RNA, 19 nt, Homo sapiens
caacagaaauugugcuuga

SEQ ID NO: 340337 - RNA, 19 nt, Homo sapiens
caacuccucugaaagauaa

SEQ ID NO: 340338 - RNA, 19 nt, Homo sapiens
gaguuuauguggaggauua

SEQ ID NO: 340339 - RNA, 19 nt, Homo sapiens
gaauggauguagacaaauu

SEQ ID NO: 340340 - RNA, 19 nt, Homo sapiens
ccaaauaaguaccagcaua

SEQ ID NO: 340341 - RNA, 19 nt, Homo sapiens
gaacuggaauugcagaaau

SEQ ID NO: 340342 - RNA, 19 nt, Homo sapiens
gaccugcacuuucauugua

SEQ ID NO: 340343 - RNA, 19 nt, Homo sapiens
caacaacucagcagagaua

SEQ ID NO: 340344 - RNA, 19 nt, Homo sapiens
ggaaugggauauugacaga

SEQ ID NO: 340345 - RNA, 19 nt, Homo sapiens
gaacuuaccagugcuguuu

SEQ ID NO: 340346 - RNA, 19 nt, Homo sapiens
ggaauccaaucccaguaua

SEQ ID NO: 340347 - RNA, 19 nt, Homo sapiens
acagaaauguuacaggaua

SEQ ID NO: 340348 - RNA, 19 nt, Homo sapiens
gugcagaguugcucacuuu

SEQ ID NO: 340349 - RNA, 19 nt, Homo sapiens
uaaacauucuggacacaua

SEQ ID NO: 340350 - RNA, 19 nt, Homo sapiens
gagcgaaacucucguccuu

SEQ ID NO: 340351 - RNA, 19 nt, Homo sapiens
gcuugaaucuuuccauaaa

SEQ ID NO: 340352 - RNA, 19 nt, Homo sapiens
gcaccuguaugcaauagaa

SEQ ID NO: 340353 - RNA, 19 nt, Homo sapiens
gagauucgcugucuucuac

SEQ ID NO: 340354 - RNA, 19 nt, Homo sapiens
gcacaucuucaaacaauaa

SEQ ID NO: 340355 - RNA, 19 nt, Homo sapiens
uaacaauauugcccaagua

SEQ ID NO: 340356 - RNA, 19 nt, Homo sapiens
caaauaaugucccagcaau

SEQ ID NO: 340357 - RNA, 19 nt, Homo sapiens
uaaguaggcuugcugauag

SEQ ID NO: 340358 - RNA, 19 nt, Homo sapiens
ucacaaggaucugccauaa

SEQ ID NO: 340359 - RNA, 19 nt, Homo sapiens
ugucacagcuaucaaauug

SEQ ID NO: 340360 - RNA, 19 nt, Homo sapiens
caacaaccaugaugugcuu

SEQ ID NO: 340361 - RNA, 19 nt, Homo sapiens
gaaauuggaccauacacuu

SEQ ID NO: 340362 - RNA, 19 nt, Homo sapiens
ucacuuuccucaaccauuu

SEQ ID NO: 340363 - RNA, 19 nt, Homo sapiens
gugccuagauauuaaagua

SEQ ID NO: 340364 - RNA, 19 nt, Homo sapiens
gaccaauugugccuagaua

SEQ ID NO: 340365 - RNA, 19 nt, Homo sapiens
agagauagaugcaucaaau

SEQ ID NO: 340366 - RNA, 19 nt, Homo sapiens
caagauacuucauuaacug

SEQ ID NO: 340367 - RNA, 19 nt, Homo sapiens
ggagaagcuuuaaauguca

SEQ ID NO: 340368 - RNA, 19 nt, Homo sapiens
gauaacacacaacaguuua

SEQ ID NO: 340369 - RNA, 19 nt, Homo sapiens
guaaguaggcuugcugaua

SEQ ID NO: 340370 - RNA, 19 nt, Homo sapiens
gagaaaaccugccaacuau

SEQ ID NO: 340371 - RNA, 19 nt, Homo sapiens
cagcaucuguugaguuaaa

SEQ ID NO: 340372 - RNA, 19 nt, Homo sapiens
ggaagaaauuggaccauac

SEQ ID NO: 340373 - RNA, 19 nt, Homo sapiens
gcagaacauuguacagaug

SEQ ID NO: 340374 - RNA, 19 nt, Homo sapiens
uuacucaucuggaauaguu

SEQ ID NO: 340375 - RNA, 19 nt, Homo sapiens
aagagaaacucaaucagaa

SEQ ID NO: 340376 - RNA, 19 nt, Homo sapiens
gaauuaaacaccaaucaga

SEQ ID NO: 340377 - RNA, 19 nt, Homo sapiens
gaaaucaaacggcagagaa

SEQ ID NO: 340378 - RNA, 19 nt, Homo sapiens
guaagucagucuaauguag

SEQ ID NO: 340379 - RNA, 19 nt, Homo sapiens
gguguuguguccaucauaa

SEQ ID NO: 340380 - RNA, 19 nt, Homo sapiens
uggaauaguuucucacuug

SEQ ID NO: 340381 - RNA, 19 nt, Homo sapiens
uaucgucucucucaaaguu

SEQ ID NO: 340382 - RNA, 19 nt, Homo sapiens
ugagaaaucuauagcuuca

SEQ ID NO: 340383 - RNA, 19 nt, Homo sapiens
caacuauaaucuugucuuc

SEQ ID NO: 340384 - RNA, 19 nt, Homo sapiens
agaaggcacuccuguagaa

SEQ ID NO: 340385 - RNA, 19 nt, Homo sapiens
caauugugccuagauauua

SEQ ID NO: 340386 - RNA, 19 nt, Homo sapiens
gaccaaugcacauauaauu

SEQ ID NO: 340387 - RNA, 19 nt, Homo sapiens
guacuacaguuagguuuga

SEQ ID NO: 340388 - RNA, 19 nt, Homo sapiens
guuagacuauugagccaua

SEQ ID NO: 340389 - RNA, 19 nt, Homo sapiens
gugcuugaaucuuuccaua

SEQ ID NO: 340390 - RNA, 19 nt, Homo sapiens
caaauaacauucugauagc

SEQ ID NO: 340391 - RNA, 19 nt, Homo sapiens
gaggauauauacaguugau

SEQ ID NO: 340392 - RNA, 19 nt, Homo sapiens
ggaauaguuucucacuugu

SEQ ID NO: 340393 - RNA, 19 nt, Homo sapiens
uaagagaaacucaaucaga

SEQ ID NO: 340394 - RNA, 19 nt, Homo sapiens
caucaaauaucgucucucu

SEQ ID NO: 340395 - RNA, 19 nt, Homo sapiens
gauaaaccuucuagcaaca

SEQ ID NO: 340396 - RNA, 19 nt, Homo sapiens
cuaaacaaccaucuaauga

SEQ ID NO: 340397 - RNA, 19 nt, Homo sapiens
ccaguuaugucacagcuau

SEQ ID NO: 340398 - RNA, 19 nt, Homo sapiens
caacauuucucaguguaga

SEQ ID NO: 340399 - RNA, 19 nt, Homo sapiens
gaauuucacacuuuaccua

SEQ ID NO: 340400 - RNA, 19 nt, Homo sapiens
gauuaccacagaaauguua

SEQ ID NO: 340401 - RNA, 19 nt, Homo sapiens
caaggcacaucuucaaaca

SEQ ID NO: 340402 - RNA, 19 nt, Homo sapiens
uuaaaugccuaucuucaga

SEQ ID NO: 340403 - RNA, 19 nt, Homo sapiens
gagauagaugcaucaaaua

SEQ ID NO: 340404 - RNA, 19 nt, Homo sapiens
aaacagcuguacccacuga

SEQ ID NO: 340405 - RNA, 19 nt, Homo sapiens
auaaccaccucaacugaua

SEQ ID NO: 340406 - RNA, 19 nt, Homo sapiens
aggcacagcucaguaagua

SEQ ID NO: 340407 - RNA, 19 nt, Homo sapiens
guacagcugugaaggaucu

SEQ ID NO: 340408 - RNA, 19 nt, Homo sapiens
caauguguccuccaccuua

SEQ ID NO: 340409 - RNA, 19 nt, Homo sapiens
ucagaaggcucagggacua

SEQ ID NO: 340410 - RNA, 19 nt, Homo sapiens
ucaaauaucgucucucuca

SEQ ID NO: 340411 - RNA, 19 nt, Homo sapiens
gagccuucaucuucuguaa

SEQ ID NO: 340412 - RNA, 19 nt, Homo sapiens
uaaaucaugcuguuucuga

SEQ ID NO: 340413 - RNA, 19 nt, Homo sapiens
aggaauggauguagacaaa

SEQ ID NO: 340414 - RNA, 19 nt, Homo sapiens
ggauucagccucaauggaa

SEQ ID NO: 340415 - RNA, 19 nt, Homo sapiens
cauuagugaugauccauuu

SEQ ID NO: 340416 - RNA, 19 nt, Homo sapiens
gcuaucaaauugccaagau

SEQ ID NO: 340417 - RNA, 19 nt, Homo sapiens
guacuuuccguucaauuaa

SEQ ID NO: 340418 - RNA, 19 nt, Homo sapiens
auuaguaccugaccaauug

SEQ ID NO: 340419 - RNA, 19 nt, Homo sapiens
acacaucaguccaguugaa

SEQ ID NO: 340420 - RNA, 19 nt, Homo sapiens
gagacuuacucaucuggaa

SEQ ID NO: 340421 - RNA, 19 nt, Homo sapiens
aaaagaagcuucccaguuc

SEQ ID NO: 340422 - RNA, 19 nt, Homo sapiens
gcccacacauuaaugauuc

SEQ ID NO: 340423 - RNA, 19 nt, Homo sapiens
uguaggugcuguuguauau

SEQ ID NO: 340424 - RNA, 19 nt, Homo sapiens
ccuacuaaaucaccuacua

SEQ ID NO: 340425 - RNA, 19 nt, Homo sapiens
gaaaaccugccaacuauaa

SEQ ID NO: 340426 - RNA, 19 nt, Homo sapiens
ccagugcuguuucuaguau

SEQ ID NO: 340427 - RNA, 19 nt, Homo sapiens
caaaguauuuccagucaac

SEQ ID NO: 340428 - RNA, 19 nt, Homo sapiens
guaccuaagcaaacagaua

SEQ ID NO: 340429 - RNA, 19 nt, Homo sapiens
ccaaguaccuaagcaaaca

SEQ ID NO: 340430 - RNA, 19 nt, Homo sapiens
gaccauacacuuucucaga

SEQ ID NO: 340431 - RNA, 19 nt, Homo sapiens
gcaacuccucugaaagaua

SEQ ID NO: 340432 - RNA, 19 nt, Homo sapiens
gaagaaagcccgacuuaua

SEQ ID NO: 340433 - RNA, 19 nt, Homo sapiens
gcgaacggcuucuaaauuu

SEQ ID NO: 340434 - RNA, 19 nt, Homo sapiens
gcaccagguucuugacuua

SEQ ID NO: 340435 - RNA, 19 nt, Homo sapiens
gagauuuaauugccaguua

SEQ ID NO: 340436 - RNA, 19 nt, Homo sapiens
ucagagagcuguuuguuuc

SEQ ID NO: 340437 - RNA, 19 nt, Homo sapiens
gaaaugagggacaaagaaa

SEQ ID NO: 340438 - RNA, 19 nt, Homo sapiens
gcagcugccucuacaguuu

SEQ ID NO: 340439 - RNA, 19 nt, Homo sapiens
gggagccacucacggauua

SEQ ID NO: 340440 - RNA, 19 nt, Homo sapiens
gcaagugauuucagaaugu

SEQ ID NO: 340441 - RNA, 19 nt, Homo sapiens
guaauuagcuaugccauca

SEQ ID NO: 340442 - RNA, 19 nt, Homo sapiens
caacauguuuggaguuaug

SEQ ID NO: 340443 - RNA, 19 nt, Homo sapiens
gccaucauguuucuauaua

SEQ ID NO: 340444 - RNA, 19 nt, Homo sapiens
gaauacauguucaauaagg

SEQ ID NO: 340445 - RNA, 19 nt, Homo sapiens
gagguacaauugcgaauau

SEQ ID NO: 340446 - RNA, 19 nt, Homo sapiens
gaugagaccaauugugaua

SEQ ID NO: 340447 - RNA, 19 nt, Homo sapiens
gaacaguaccugaccauca

SEQ ID NO: 340448 - RNA, 19 nt, Homo sapiens
ggauggauaugacuuagug

SEQ ID NO: 340449 - RNA, 19 nt, Homo sapiens
guucuugacuuacaaauag

SEQ ID NO: 340450 - RNA, 19 nt, Homo sapiens
uaccaucacuccuguguuu

SEQ ID NO: 340451 - RNA, 19 nt, Homo sapiens
caugguggauuauuucaaa

SEQ ID NO: 340452 - RNA, 19 nt, Homo sapiens
aaacauuacugccucuuau

SEQ ID NO: 340453 - RNA, 19 nt, Homo sapiens
cauuaaacgucaagagaaa

SEQ ID NO: 340454 - RNA, 19 nt, Homo sapiens
gugauuaccuucccuguca

SEQ ID NO: 340455 - RNA, 19 nt, Homo sapiens
ccaguuagauguggcauga

SEQ ID NO: 340456 - RNA, 19 nt, Homo sapiens
ggaaugcacaguugacuug

SEQ ID NO: 340457 - RNA, 19 nt, Homo sapiens
ccacguacuucaugaccua

SEQ ID NO: 340458 - RNA, 19 nt, Homo sapiens
ccagagagaugaacgucuu

SEQ ID NO: 340459 - RNA, 19 nt, Homo sapiens
caacuggauugaauacaug

SEQ ID NO: 340460 - RNA, 19 nt, Homo sapiens
ucaaauccaucagucagua

SEQ ID NO: 340461 - RNA, 19 nt, Homo sapiens
uuacagcuacugaagauua

SEQ ID NO: 340462 - RNA, 19 nt, Homo sapiens
gaacguagcgccugugaac

SEQ ID NO: 340463 - RNA, 19 nt, Homo sapiens
cuagaaaggaagagauuua

SEQ ID NO: 340464 - RNA, 19 nt, Homo sapiens
gcaguguggugcuacagaa

SEQ ID NO: 340465 - RNA, 19 nt, Homo sapiens
ggaacucuguccaggauuc

SEQ ID NO: 340466 - RNA, 19 nt, Homo sapiens
ggcagcagcuuugaacgua

SEQ ID NO: 340467 - RNA, 19 nt, Homo sapiens
ggauugugguguuggcuuu

SEQ ID NO: 340468 - RNA, 19 nt, Homo sapiens
gaccucugcugacuuuauu

SEQ ID NO: 340469 - RNA, 19 nt, Homo sapiens
ggcaugggcugcaacaaug

SEQ ID NO: 340470 - RNA, 19 nt, Homo sapiens
gucaacauguuuggaguua

SEQ ID NO: 340471 - RNA, 19 nt, Homo sapiens
gccuauaguucugcaguua

SEQ ID NO: 340472 - RNA, 19 nt, Homo sapiens
ggaguaagccaucccacaa

SEQ ID NO: 340473 - RNA, 19 nt, Homo sapiens
gacacuagauggcugugaa

SEQ ID NO: 340474 - RNA, 19 nt, Homo sapiens
ccauguuccuuucggauaa

SEQ ID NO: 340475 - RNA, 19 nt, Homo sapiens
gcacaccuucucucucuuu

SEQ ID NO: 340476 - RNA, 19 nt, Homo sapiens
ugaacuaaaucgugaaagu

SEQ ID NO: 340477 - RNA, 19 nt, Homo sapiens
ccacaaguucuauaccaua

SEQ ID NO: 340478 - RNA, 19 nt, Homo sapiens
gauuggcagucuucauuga

SEQ ID NO: 340479 - RNA, 19 nt, Homo sapiens
agaaguggcucccaguaug

SEQ ID NO: 340480 - RNA, 19 nt, Homo sapiens
gaacuaaaucgugaaagug

SEQ ID NO: 340481 - RNA, 19 nt, Homo sapiens
gaacgaaguauugaagaug

SEQ ID NO: 340482 - RNA, 19 nt, Homo sapiens
ccacugcccuugugauuac

SEQ ID NO: 340483 - RNA, 19 nt, Homo sapiens
ucacugacaaacacauuua

SEQ ID NO: 340484 - RNA, 19 nt, Homo sapiens
ugccaagacugcucuauug

SEQ ID NO: 340485 - RNA, 19 nt, Homo sapiens
uuacauagggccaucagua

SEQ ID NO: 340486 - RNA, 19 nt, Homo sapiens
acuccuacaugguggauua

SEQ ID NO: 340487 - RNA, 19 nt, Homo sapiens
acaaagaaagcaucucgua

SEQ ID NO: 340488 - RNA, 19 nt, Homo sapiens
caagugauuucagaauguu

SEQ ID NO: 340489 - RNA, 19 nt, Homo sapiens
gcucuggucugcagucauc

SEQ ID NO: 340490 - RNA, 19 nt, Homo sapiens
gaccaguucugcaaugcuu

SEQ ID NO: 340491 - RNA, 19 nt, Homo sapiens
gggauuggcagucuucauu

SEQ ID NO: 340492 - RNA, 19 nt, Homo sapiens
ccuacaugguggauuauuu

SEQ ID NO: 340493 - RNA, 19 nt, Homo sapiens
uaaauuacuuccagaacag

SEQ ID NO: 340494 - RNA, 19 nt, Homo sapiens
aacacgaacugcaccauuu

SEQ ID NO: 340495 - RNA, 19 nt, Homo sapiens
ucccaucgauagcaauaua

SEQ ID NO: 340496 - RNA, 19 nt, Homo sapiens
caugaacaaugccaccaaa

SEQ ID NO: 340497 - RNA, 19 nt, Homo sapiens
ccaacuggauugaauacau

SEQ ID NO: 340498 - RNA, 19 nt, Homo sapiens
ggacaugcugccuauaguu

SEQ ID NO: 340499 - RNA, 19 nt, Homo sapiens
gacauuaaacgucaagaga

SEQ ID NO: 340500 - RNA, 19 nt, Homo sapiens
ggacgacuucuuuguguau

SEQ ID NO: 340501 - RNA, 19 nt, Homo sapiens
gaccuccgcuugacauaca

SEQ ID NO: 340502 - RNA, 19 nt, Homo sapiens
caaaggcugugacgagucu

SEQ ID NO: 340503 - RNA, 19 nt, Homo sapiens
ccaaugcaauguacaaugc

SEQ ID NO: 340504 - RNA, 19 nt, Homo sapiens
ggaguucugcagccacaua

SEQ ID NO: 340505 - RNA, 19 nt, Homo sapiens
gggacaagagguacaauug

SEQ ID NO: 340506 - RNA, 19 nt, Homo sapiens
cgacuuauagccaguaaug

SEQ ID NO: 340507 - RNA, 19 nt, Homo sapiens
ggagccacguacuucauga

SEQ ID NO: 340508 - RNA, 19 nt, Homo sapiens
gcuccugccucucugaaug

SEQ ID NO: 340509 - RNA, 19 nt, Homo sapiens
gggacgacuucuuugugua

SEQ ID NO: 340510 - RNA, 19 nt, Homo sapiens
gagcugauguacccuuugg

SEQ ID NO: 340511 - RNA, 19 nt, Homo sapiens
ccacaggacacuaaacuuc

SEQ ID NO: 340512 - RNA, 19 nt, Homo sapiens
gacuugggaagcaguauua

SEQ ID NO: 340513 - RNA, 19 nt, Homo sapiens
ugagauuccugcccauguu

SEQ ID NO: 340514 - RNA, 19 nt, Homo sapiens
gagaaguggcucccaguau

SEQ ID NO: 340515 - RNA, 19 nt, Homo sapiens
cgucaggccugguguuugu

SEQ ID NO: 340516 - RNA, 19 nt, Homo sapiens
guauuuggccauggucuua

SEQ ID NO: 340517 - RNA, 19 nt, Homo sapiens
gugcacaccuucucucucu

SEQ ID NO: 340518 - RNA, 19 nt, Homo sapiens
gcaggcuucugguggauuc

SEQ ID NO: 340519 - RNA, 19 nt, Homo sapiens
uaaugcaagugacaaagga

SEQ ID NO: 340520 - RNA, 19 nt, Homo sapiens
ccauguagcugccaagacu

SEQ ID NO: 340521 - RNA, 19 nt, Homo sapiens
cacaaguucuauaccauau

SEQ ID NO: 340522 - RNA, 19 nt, Homo sapiens
ccgaaaccaugggcauuaa

SEQ ID NO: 340523 - RNA, 19 nt, Homo sapiens
cagaggugcugaagaugga

SEQ ID NO: 340524 - RNA, 19 nt, Homo sapiens
uaacgccacugcccuugug

SEQ ID NO: 340525 - RNA, 19 nt, Homo sapiens
auacaaguuugcuccauga

SEQ ID NO: 340526 - RNA, 19 nt, Homo sapiens
aaaggauggauaugacuua

SEQ ID NO: 340527 - RNA, 19 nt, Homo sapiens
ggacagaguuuugccaaug

SEQ ID NO: 340528 - RNA, 19 nt, Homo sapiens
cuagauggcugugaaugug

SEQ ID NO: 340529 - RNA, 19 nt, Homo sapiens
cauccugacugaacugugu

SEQ ID NO: 340530 - RNA, 19 nt, Homo sapiens
gaacggcuucuaaauuucu

SEQ ID NO: 340531 - RNA, 19 nt, Homo sapiens
ugaacgaaguauugaagau

SEQ ID NO: 340532 - RNA, 19 nt, Homo sapiens
gaaccuaccuagagccuua

SEQ ID NO: 340533 - RNA, 19 nt, Homo sapiens
ggacguauauuucugguuu

SEQ ID NO: 340534 - RNA, 19 nt, Homo sapiens
ucaaagauguauccaguua

SEQ ID NO: 340535 - RNA, 19 nt, Homo sapiens
gaaauaggauggagacugu

SEQ ID NO: 340536 - RNA, 19 nt, Homo sapiens
ccagauaagugaaguaauu

SEQ ID NO: 340537 - RNA, 19 nt, Homo sapiens
ggagauagguacuguuguu

SEQ ID NO: 340538 - RNA, 19 nt, Homo sapiens
gagcagaggacguauauuu

SEQ ID NO: 340539 - RNA, 19 nt, Homo sapiens
ggaagaaagugaaagugaa

SEQ ID NO: 340540 - RNA, 19 nt, Homo sapiens
gagaaagaaugcaguguga

SEQ ID NO: 340541 - RNA, 19 nt, Homo sapiens
gaagaaacaggccagauaa

SEQ ID NO: 340542 - RNA, 19 nt, Homo sapiens
guaauaagguucugagcaa

SEQ ID NO: 340543 - RNA, 19 nt, Homo sapiens
cagcuaauauucccaguaa

SEQ ID NO: 340544 - RNA, 19 nt, Homo sapiens
gagaugugcuccugaaaga

SEQ ID NO: 340545 - RNA, 19 nt, Homo sapiens
ccagaaacauuaauuggaa

SEQ ID NO: 340546 - RNA, 19 nt, Homo sapiens
aggaugagcuugcaaagua

SEQ ID NO: 340547 - RNA, 19 nt, Homo sapiens
gaacagaagaucaagaaau

SEQ ID NO: 340548 - RNA, 19 nt, Homo sapiens
gaaaauaagugcucuguca

SEQ ID NO: 340549 - RNA, 19 nt, Homo sapiens
ccacguuucuccugguuua

SEQ ID NO: 340550 - RNA, 19 nt, Homo sapiens
gaagagagacaaagaguuc

SEQ ID NO: 340551 - RNA, 19 nt, Homo sapiens
gagcagaaguuaagcaaag

SEQ ID NO: 340552 - RNA, 19 nt, Homo sapiens
ccagguuacucgcaucuua

SEQ ID NO: 340553 - RNA, 19 nt, Homo sapiens
aagcaaagcugaugaaucu

SEQ ID NO: 340554 - RNA, 19 nt, Homo sapiens
gcaaauuacuucuuacaac

SEQ ID NO: 340555 - RNA, 19 nt, Homo sapiens
gaaguaauuugccuaaggu

SEQ ID NO: 340556 - RNA, 19 nt, Homo sapiens
gcagaccuaugacuucuug

SEQ ID NO: 340557 - RNA, 19 nt, Homo sapiens
aaacugagauccuugaaca

SEQ ID NO: 340558 - RNA, 19 nt, Homo sapiens
gagccaagaucgugccauu

SEQ ID NO: 340559 - RNA, 19 nt, Homo sapiens
guacgccucugucuauuug

SEQ ID NO: 340560 - RNA, 19 nt, Homo sapiens
ggaggaagggaaucaauuu

SEQ ID NO: 340561 - RNA, 19 nt, Homo sapiens
cgaagaaacaggccagaua

SEQ ID NO: 340562 - RNA, 19 nt, Homo sapiens
gguggaaaguuaucacuga

SEQ ID NO: 340563 - RNA, 19 nt, Homo sapiens
caaaggaaaugaaggucuu

SEQ ID NO: 340564 - RNA, 19 nt, Homo sapiens
caacuggccuucagagauc

SEQ ID NO: 340565 - RNA, 19 nt, Homo sapiens
ucgagcaaauuacuucuua

SEQ ID NO: 340566 - RNA, 19 nt, Homo sapiens
guacagagcagaggacgua

SEQ ID NO: 340567 - RNA, 19 nt, Homo sapiens
ccuaaacccuuaaccuaaa

SEQ ID NO: 340568 - RNA, 19 nt, Homo sapiens
gaugugggaugcuacagaa

SEQ ID NO: 340569 - RNA, 19 nt, Homo sapiens
gcagauggagcagaaguua

SEQ ID NO: 340570 - RNA, 19 nt, Homo sapiens
gaaagugaaagugaagaua

SEQ ID NO: 340571 - RNA, 19 nt, Homo sapiens
gcucaugccuucacaacug

SEQ ID NO: 340572 - RNA, 19 nt, Homo sapiens
ggaggaagaggaagagaaa

SEQ ID NO: 340573 - RNA, 19 nt, Homo sapiens
caagaaauguacuaagucu

SEQ ID NO: 340574 - RNA, 19 nt, Homo sapiens
gaucugaugugggaugcua

SEQ ID NO: 340575 - RNA, 19 nt, Homo sapiens
ggaagggaaucaauuucga

SEQ ID NO: 340576 - RNA, 19 nt, Homo sapiens
gaaacaggccagauaagug

SEQ ID NO: 340577 - RNA, 19 nt, Homo sapiens
aaaugaaucucacaaaugg

SEQ ID NO: 340578 - RNA, 19 nt, Homo sapiens
ggacaagcuuacccaacaa

SEQ ID NO: 340579 - RNA, 19 nt, Homo sapiens
ggcaucuucugucuuguua

SEQ ID NO: 340580 - RNA, 19 nt, Homo sapiens
gaggaaaaguuuaaccuaa

SEQ ID NO: 340581 - RNA, 19 nt, Homo sapiens
ggagcagccugaugugaug

SEQ ID NO: 340582 - RNA, 19 nt, Homo sapiens
gggaaucaauuucgagcaa

SEQ ID NO: 340583 - RNA, 19 nt, Homo sapiens
acaaagaguuccugaaguc

SEQ ID NO: 340584 - RNA, 19 nt, Homo sapiens
aacagaagaucaagaaaug

SEQ ID NO: 340585 - RNA, 19 nt, Homo sapiens
caacauucauacagucaga

SEQ ID NO: 340586 - RNA, 19 nt, Homo sapiens
guucugagcaacauucaua

SEQ ID NO: 340587 - RNA, 19 nt, Homo sapiens
gcgggcaucuucugucuug

SEQ ID NO: 340588 - RNA, 19 nt, Homo sapiens
cagaagaucaagaaaugua

SEQ ID NO: 340589 - RNA, 19 nt, Homo sapiens
uaauaguucugaugcgaaa

SEQ ID NO: 340590 - RNA, 19 nt, Homo sapiens
gaaagaaugcagugugaca

SEQ ID NO: 340591 - RNA, 19 nt, Homo sapiens
gaccaagucguauuucauu

SEQ ID NO: 340592 - RNA, 19 nt, Homo sapiens
ggaaucaauuucgagcaaa

SEQ ID NO: 340593 - RNA, 19 nt, Homo sapiens
ggaaaugaaggucuuguuc

SEQ ID NO: 340594 - RNA, 19 nt, Homo sapiens
gggaaauucuccuuguaau

SEQ ID NO: 340595 - RNA, 19 nt, Homo sapiens
gaagaggaagaaagugaaa

SEQ ID NO: 340596 - RNA, 19 nt, Homo sapiens
ugagguagaagaauuguuu

SEQ ID NO: 340597 - RNA, 19 nt, Homo sapiens
gaugguugguggauagcua

SEQ ID NO: 340598 - RNA, 19 nt, Homo sapiens
aaacaggccagauaaguga

SEQ ID NO: 340599 - RNA, 19 nt, Homo sapiens
caaugaagaggaaguuaaa

SEQ ID NO: 340600 - RNA, 19 nt, Homo sapiens
auacaucgcuguuggagau

SEQ ID NO: 340601 - RNA, 19 nt, Homo sapiens
guagaagaauuguuugaac

SEQ ID NO: 340602 - RNA, 19 nt, Homo sapiens
ccaacacuaucuguacuaa

SEQ ID NO: 340603 - RNA, 19 nt, Homo sapiens
gacaaagaguuccugaagu

SEQ ID NO: 340604 - RNA, 19 nt, Homo sapiens
gagaccaagucguauuuca

SEQ ID NO: 340605 - RNA, 19 nt, Homo sapiens
uaacuacgaugggagcuau

SEQ ID NO: 340606 - RNA, 19 nt, Homo sapiens
gaagaaggccaagaaucaa

SEQ ID NO: 340607 - RNA, 19 nt, Homo sapiens
caacuucuagugaaacuga

SEQ ID NO: 340608 - RNA, 19 nt, Homo sapiens
uaaagcaggcaauagauga

SEQ ID NO: 340609 - RNA, 19 nt, Homo sapiens
ggauggagacuguggaaga

SEQ ID NO: 340610 - RNA, 19 nt, Homo sapiens
agaagaaggccaagaauca

SEQ ID NO: 340611 - RNA, 19 nt, Homo sapiens
gaagaagaaggccaagaau

SEQ ID NO: 340612 - RNA, 19 nt, Homo sapiens
ggucaaccggugaagaaua

SEQ ID NO: 340613 - RNA, 19 nt, Homo sapiens
gggccuugcugugacaaua

SEQ ID NO: 340614 - RNA, 19 nt, Homo sapiens
caucuucugucuuguuaau

SEQ ID NO: 340615 - RNA, 19 nt, Homo sapiens
uaucuuagcuaacuuaucc

SEQ ID NO: 340616 - RNA, 19 nt, Homo sapiens
gcuacagaaggcacuauua

SEQ ID NO: 340617 - RNA, 19 nt, Homo sapiens
ccuguaaucccaacacuuu

SEQ ID NO: 340618 - RNA, 19 nt, Homo sapiens
ugccuaaggucacagcuaa

SEQ ID NO: 340619 - RNA, 19 nt, Homo sapiens
ugaugaaucugcaccuguu

SEQ ID NO: 340620 - RNA, 19 nt, Homo sapiens
caacuuagguuuuacucuu

SEQ ID NO: 340621 - RNA, 19 nt, Homo sapiens
aguuggagaucuuacauuu

SEQ ID NO: 340622 - RNA, 19 nt, Homo sapiens
gaagaaagugaaagugaag

SEQ ID NO: 340623 - RNA, 19 nt, Homo sapiens
uagaaucccauuagaggua

SEQ ID NO: 340624 - RNA, 19 nt, Homo sapiens
ucaaugaagaggaaguuaa

SEQ ID NO: 340625 - RNA, 19 nt, Homo sapiens
gagcagaccuaugacuucu

SEQ ID NO: 340626 - RNA, 19 nt, Homo sapiens
uuucagagcagaccuauga

SEQ ID NO: 340627 - RNA, 19 nt, Homo sapiens
gacaaauucuuggagaugu

SEQ ID NO: 340628 - RNA, 19 nt, Homo sapiens
gaauggugguacuccuuau

SEQ ID NO: 340629 - RNA, 19 nt, Homo sapiens
aaaguucugggcuaucuua

SEQ ID NO: 340630 - RNA, 19 nt, Homo sapiens
ccaguaaagauaccaugua

SEQ ID NO: 340631 - RNA, 19 nt, Homo sapiens
ugaaguaauuugccuaagg

SEQ ID NO: 340632 - RNA, 19 nt, Homo sapiens
ccacuggucucucucauua

SEQ ID NO: 340633 - RNA, 19 nt, Homo sapiens
gcacuuguaugaugaggua

SEQ ID NO: 340634 - RNA, 19 nt, Homo sapiens
gacaauaucugacaucucu

SEQ ID NO: 340635 - RNA, 19 nt, Homo sapiens
ggagacgccuuaaacuuga

SEQ ID NO: 340636 - RNA, 19 nt, Homo sapiens
ggacagggcagauuguaaa

SEQ ID NO: 340637 - RNA, 19 nt, Homo sapiens
gaaacuaaacuucuccaaa

SEQ ID NO: 340638 - RNA, 19 nt, Homo sapiens
gauuaaagguugugagucu

SEQ ID NO: 340639 - RNA, 19 nt, Homo sapiens
gggugaggcugguguguuu

SEQ ID NO: 340640 - RNA, 19 nt, Homo sapiens
gggagacgccuuaaacuug

SEQ ID NO: 340641 - RNA, 19 nt, Homo sapiens
agaagucgcucauccugaa

SEQ ID NO: 340642 - RNA, 19 nt, Homo sapiens
uaucugacaucucugcaaa

SEQ ID NO: 340643 - RNA, 19 nt, Homo sapiens
ccagagcccucccucaugu

SEQ ID NO: 340644 - RNA, 19 nt, Homo sapiens
ccacuggccugaagacaca

SEQ ID NO: 340645 - RNA, 19 nt, Homo sapiens
ggcaguugcuggucuguga

SEQ ID NO: 340646 - RNA, 19 nt, Homo sapiens
gcgaugacgcggaguauga

SEQ ID NO: 340647 - RNA, 19 nt, Homo sapiens
aggaggaggugucuuauuc

SEQ ID NO: 340648 - RNA, 19 nt, Homo sapiens
aaaccaacauucaacuugu

SEQ ID NO: 340649 - RNA, 19 nt, Homo sapiens
caaaccaacauucaacuug

SEQ ID NO: 340650 - RNA, 19 nt, Homo sapiens
ggaccaaaccaacauucaa

SEQ ID NO: 340651 - RNA, 19 nt, Homo sapiens
ggaggcugaugcaugagaa

SEQ ID NO: 340652 - RNA, 19 nt, Homo sapiens
ggacaaccaggccaaguuc

SEQ ID NO: 340653 - RNA, 19 nt, Homo sapiens
gcccagaaacuguggauug

SEQ ID NO: 340654 - RNA, 19 nt, Homo sapiens
cagaggcagagccguauua

SEQ ID NO: 340655 - RNA, 19 nt, Homo sapiens
gggagagacugggagaaga

SEQ ID NO: 340656 - RNA, 19 nt, Homo sapiens
cuacagccuucuacaagau

SEQ ID NO: 340657 - RNA, 19 nt, Homo sapiens
ggauuacgcccucuucaca

SEQ ID NO: 340658 - RNA, 19 nt, Homo sapiens
ggagacagcaccaguucug

SEQ ID NO: 340659 - RNA, 19 nt, Homo sapiens
cugcaucuguggaauguga

SEQ ID NO: 340660 - RNA, 19 nt, Homo sapiens
ucacagggccgucggacaa

SEQ ID NO: 340661 - RNA, 19 nt, Homo sapiens
caugugaggccuucaguga

SEQ ID NO: 340662 - RNA, 19 nt, Homo sapiens
ccuauaaucccagcacuuu

SEQ ID NO: 340663 - RNA, 19 nt, Homo sapiens
cccagaaacuguggauuga

SEQ ID NO: 340664 - RNA, 19 nt, Homo sapiens
ggacccagcuucccaucac

SEQ ID NO: 340665 - RNA, 19 nt, Homo sapiens
caacuaacgugacgauccu

SEQ ID NO: 340666 - RNA, 19 nt, Homo sapiens
gcagugugcuggugaugac

SEQ ID NO: 340667 - RNA, 19 nt, Homo sapiens
gcaccugacaucaccauuc

SEQ ID NO: 340668 - RNA, 19 nt, Homo sapiens
agagaugguucagcuggua

SEQ ID NO: 340669 - RNA, 19 nt, Homo sapiens
gacccuccaucaggauuaa

SEQ ID NO: 340670 - RNA, 19 nt, Homo sapiens
uggaugacauggagaagau

SEQ ID NO: 340671 - RNA, 19 nt, Homo sapiens
gaagccagcaccugacauc

SEQ ID NO: 340672 - RNA, 19 nt, Homo sapiens
gcaugagaauugcuugaac

SEQ ID NO: 340673 - RNA, 19 nt, Homo sapiens
gauccaagaggaaucuaug

SEQ ID NO: 340674 - RNA, 19 nt, Homo sapiens
caggagagcgggacacuca

SEQ ID NO: 340675 - RNA, 19 nt, Homo sapiens
ccugugaccucagcgauga

SEQ ID NO: 340676 - RNA, 19 nt, Homo sapiens
ggggacaucugguguaaga

SEQ ID NO: 340677 - RNA, 19 nt, Homo sapiens
ccugggcacuuguaugaug

SEQ ID NO: 340678 - RNA, 19 nt, Homo sapiens
aagaccagcugcccacaga

SEQ ID NO: 340679 - RNA, 19 nt, Homo sapiens
gguacacggagcacacaua

SEQ ID NO: 340680 - RNA, 19 nt, Homo sapiens
ggagagacugggagaagau

SEQ ID NO: 340681 - RNA, 19 nt, Homo sapiens
cuagugccauuauuaucuu

SEQ ID NO: 340682 - RNA, 19 nt, Homo sapiens
uugggaggcugaugcauga

SEQ ID NO: 340683 - RNA, 19 nt, Homo sapiens
cgcaggaggaggugucuua

SEQ ID NO: 340684 - RNA, 19 nt, Homo sapiens
cugaaggccuggcgcaguu

SEQ ID NO: 340685 - RNA, 19 nt, Homo sapiens
ggacccugcuagaggugaa

SEQ ID NO: 340686 - RNA, 19 nt, Homo sapiens
gauuguaaacgucgucuca

SEQ ID NO: 340687 - RNA, 19 nt, Homo sapiens
ucuacagccuucuacaaga

SEQ ID NO: 340688 - RNA, 19 nt, Homo sapiens
ggagcguccuucugcaagu

SEQ ID NO: 340689 - RNA, 19 nt, Homo sapiens
gcagcuggcggugcaguuu

SEQ ID NO: 340690 - RNA, 19 nt, Homo sapiens
caccgugaauguucuguuc

SEQ ID NO: 340691 - RNA, 19 nt, Homo sapiens
agcagaaacucuucacugu

SEQ ID NO: 340692 - RNA, 19 nt, Homo sapiens
ggagagcgggacacucaga

SEQ ID NO: 340693 - RNA, 19 nt, Homo sapiens
ugcaguggcugaagaaugg

SEQ ID NO: 340694 - RNA, 19 nt, Homo sapiens
ggucuacagccuucuacaa

SEQ ID NO: 340695 - RNA, 19 nt, Homo sapiens
gcgaaaccgugagcuccuu

SEQ ID NO: 340696 - RNA, 19 nt, Homo sapiens
ccccggagcucagauaaua

SEQ ID NO: 340697 - RNA, 19 nt, Homo sapiens
uuguaaacgucgucucaaa

SEQ ID NO: 340698 - RNA, 19 nt, Homo sapiens
guaccagaguagaaacaag

SEQ ID NO: 340699 - RNA, 19 nt, Homo sapiens
gaccuccacuggccugaag

SEQ ID NO: 340700 - RNA, 19 nt, Homo sapiens
gaugacauggagaagauau

SEQ ID NO: 340701 - RNA, 19 nt, Homo sapiens
ggaggagacagucauggau

SEQ ID NO: 340702 - RNA, 19 nt, Homo sapiens
caccugacaucaccauucu

SEQ ID NO: 340703 - RNA, 19 nt, Homo sapiens
cagccuggccaacauggua

SEQ ID NO: 340704 - RNA, 19 nt, Homo sapiens
ggacuccaggguuccacua

SEQ ID NO: 340705 - RNA, 19 nt, Homo sapiens
cagcugcacugccagaacu

SEQ ID NO: 340706 - RNA, 19 nt, Homo sapiens
gagcguccuucugcaagug

SEQ ID NO: 340707 - RNA, 19 nt, Homo sapiens
gcucagauaauaggcaguu

SEQ ID NO: 340708 - RNA, 19 nt, Homo sapiens
gagucaggaacgaauauga

SEQ ID NO: 340709 - RNA, 19 nt, Homo sapiens
caucaggauuaaagguugu

SEQ ID NO: 340710 - RNA, 19 nt, Homo sapiens
ucgcucauccugaacguaa

SEQ ID NO: 340711 - RNA, 19 nt, Homo sapiens
cagggcagauuguaaacgu

SEQ ID NO: 340712 - RNA, 19 nt, Homo sapiens
gaggggacaucugguguaa

SEQ ID NO: 340713 - RNA, 19 nt, Homo sapiens
ccgauucucugcccuucga

SEQ ID NO: 340714 - RNA, 19 nt, Homo sapiens
ggccugaagacacauauca

SEQ ID NO: 340715 - RNA, 19 nt, Homo sapiens
gauccucuccauccugguu

SEQ ID NO: 340716 - RNA, 19 nt, Homo sapiens
ccaaaccaacauucaacuu

SEQ ID NO: 340717 - RNA, 19 nt, Homo sapiens
ggaguacguggucaacugu

SEQ ID NO: 340718 - RNA, 19 nt, Homo sapiens
gguuaggugagcuccauaa

SEQ ID NO: 340719 - RNA, 19 nt, Homo sapiens
acacuccacuggucucucu

SEQ ID NO: 340720 - RNA, 19 nt, Homo sapiens
ugacaaagggacccagcuu

SEQ ID NO: 340721 - RNA, 19 nt, Homo sapiens
ugaagacacauaucaggau

SEQ ID NO: 340722 - RNA, 19 nt, Homo sapiens
gaccaaaccaacauucaac

SEQ ID NO: 340723 - RNA, 19 nt, Homo sapiens
cggcugcuccgucuuguug

SEQ ID NO: 340724 - RNA, 19 nt, Homo sapiens
ggacgacggccucuaucag

SEQ ID NO: 340725 - RNA, 19 nt, Homo sapiens
acacggagcacacauacca

SEQ ID NO: 340726 - RNA, 19 nt, Homo sapiens
guacacggagcacacauac

SEQ ID NO: 340727 - RNA, 19 nt, Homo sapiens
caggugaagaugaggauau

SEQ ID NO: 340728 - RNA, 19 nt, Homo sapiens
gauucaccaugccaaacug

SEQ ID NO: 340729 - RNA, 19 nt, Homo sapiens
caucccagacugagaacaa

SEQ ID NO: 340730 - RNA, 19 nt, Homo sapiens
ggguuggcuuuagaaacua

SEQ ID NO: 340731 - RNA, 19 nt, Homo sapiens
gcaccugcaggaauuuaca

SEQ ID NO: 340732 - RNA, 19 nt, Homo sapiens
ggaggaagaugcagaguca

SEQ ID NO: 340733 - RNA, 19 nt, Homo sapiens
gagcaccaguuaucuuuaa

SEQ ID NO: 340734 - RNA, 19 nt, Homo sapiens
caaaaugccuguuuaguuu

SEQ ID NO: 340735 - RNA, 19 nt, Homo sapiens
gaugugaaacucuuaagua

SEQ ID NO: 340736 - RNA, 19 nt, Homo sapiens
aagcagaggcaaugaauua

SEQ ID NO: 340737 - RNA, 19 nt, Homo sapiens
gcacaaaagucaaaucaga

SEQ ID NO: 340738 - RNA, 19 nt, Homo sapiens
ccaagaggcuauucaagau

SEQ ID NO: 340739 - RNA, 19 nt, Homo sapiens
cgaaggcaguccaauuaaa

SEQ ID NO: 340740 - RNA, 19 nt, Homo sapiens
ugaagaggaugaugaugaa

SEQ ID NO: 340741 - RNA, 19 nt, Homo sapiens
ccaagaauguguuguccaa

SEQ ID NO: 340742 - RNA, 19 nt, Homo sapiens
gauaaauguuguccagguu

SEQ ID NO: 340743 - RNA, 19 nt, Homo sapiens
guagcaagguuccacagaa

SEQ ID NO: 340744 - RNA, 19 nt, Homo sapiens
ccaguggucuuaagguuga

SEQ ID NO: 340745 - RNA, 19 nt, Homo sapiens
uaaaggccgacaaagauua

SEQ ID NO: 340746 - RNA, 19 nt, Homo sapiens
uagcaagguuccacagaaa

SEQ ID NO: 340747 - RNA, 19 nt, Homo sapiens
uaagguggauaaugaugaa

SEQ ID NO: 340748 - RNA, 19 nt, Homo sapiens
uacgaaggcaguccaauua

SEQ ID NO: 340749 - RNA, 19 nt, Homo sapiens
gaaggcaguccaauuaaag

SEQ ID NO: 340750 - RNA, 19 nt, Homo sapiens
ggaaaagacucaaaaccau

SEQ ID NO: 340751 - RNA, 19 nt, Homo sapiens
acuuuaagguggauaauga

SEQ ID NO: 340752 - RNA, 19 nt, Homo sapiens
ugaugaagaugaugaugau

SEQ ID NO: 340753 - RNA, 19 nt, Homo sapiens
uuuaagaacggucaguuua

SEQ ID NO: 340754 - RNA, 19 nt, Homo sapiens
guagaagacauuaaagcaa

SEQ ID NO: 340755 - RNA, 19 nt, Homo sapiens
ugaugacgaugaugaugaa

SEQ ID NO: 340756 - RNA, 19 nt, Homo sapiens
ugaugaagaugaugacgau

SEQ ID NO: 340757 - RNA, 19 nt, Homo sapiens
ggaugaugaugaagaugau

SEQ ID NO: 340758 - RNA, 19 nt, Homo sapiens
ugaagaugaugaugaugau

SEQ ID NO: 340759 - RNA, 19 nt, Homo sapiens
cgccuucucuccuaccuaa

SEQ ID NO: 340760 - RNA, 19 nt, Homo sapiens
cuuaguagcuguggaggaa

SEQ ID NO: 340761 - RNA, 19 nt, Homo sapiens
ucagggccagugcauauua

SEQ ID NO: 340762 - RNA, 19 nt, Homo sapiens
cagaggcaaugaauuacga

SEQ ID NO: 340763 - RNA, 19 nt, Homo sapiens
gaagcagaggcaaugaauu

SEQ ID NO: 340764 - RNA, 19 nt, Homo sapiens
aaggaugaguugcacauug

SEQ ID NO: 340765 - RNA, 19 nt, Homo sapiens
aaaaggaccuaguucugua

SEQ ID NO: 340766 - RNA, 19 nt, Homo sapiens
gugguucucuucccaaagu

SEQ ID NO: 340767 - RNA, 19 nt, Homo sapiens
ugaagaugaugacgaugau

SEQ ID NO: 340768 - RNA, 19 nt, Homo sapiens
ggaggaugugaaacucuua

SEQ ID NO: 340769 - RNA, 19 nt, Homo sapiens
ggaggaggaugugaaacuc

SEQ ID NO: 340770 - RNA, 19 nt, Homo sapiens
guucagggccagugcauau

SEQ ID NO: 340771 - RNA, 19 nt, Homo sapiens
aagauucgauggacaugga

SEQ ID NO: 340772 - RNA, 19 nt, Homo sapiens
ugacgaugaugaugaagag

SEQ ID NO: 340773 - RNA, 19 nt, Homo sapiens
ggaagaugcagagucagaa

SEQ ID NO: 340774 - RNA, 19 nt, Homo sapiens
uaagaacggucaguuuagg

SEQ ID NO: 340775 - RNA, 19 nt, Homo sapiens
gaacuaaaggccgacaaag

SEQ ID NO: 340776 - RNA, 19 nt, Homo sapiens
uuacgaaggcaguccaauu

SEQ ID NO: 340777 - RNA, 19 nt, Homo sapiens
agucaaaucagaauggaaa

SEQ ID NO: 340778 - RNA, 19 nt, Homo sapiens
gaggaugugaaacucuuaa

SEQ ID NO: 340779 - RNA, 19 nt, Homo sapiens
gagcagcguucuuuuaucu

SEQ ID NO: 340780 - RNA, 19 nt, Homo sapiens
cuaaaggccgacaaagauu

SEQ ID NO: 340781 - RNA, 19 nt, Homo sapiens
ccaaaaugccuguuuaguu

SEQ ID NO: 340782 - RNA, 19 nt, Homo sapiens
caucaacaccaagaucaaa

SEQ ID NO: 340783 - RNA, 19 nt, Homo sapiens
gcaguccaauuaaaguaac

SEQ ID NO: 340784 - RNA, 19 nt, Homo sapiens
ggcaguccaauuaaaguaa

SEQ ID NO: 340785 - RNA, 19 nt, Homo sapiens
agaggaugaugaugaagau

SEQ ID NO: 340786 - RNA, 19 nt, Homo sapiens
aggaugaguugcacauugu

SEQ ID NO: 340787 - RNA, 19 nt, Homo sapiens
uggaggaagucucuuuaag

SEQ ID NO: 340788 - RNA, 19 nt, Homo sapiens
gaagaggaggaggauguga

SEQ ID NO: 340789 - RNA, 19 nt, Homo sapiens
guaacacuggcaacuuuga

SEQ ID NO: 340790 - RNA, 19 nt, Homo sapiens
acuaaaggccgacaaagau

SEQ ID NO: 340791 - RNA, 19 nt, Homo sapiens
ggaacuccacccuuugcuu

SEQ ID NO: 340792 - RNA, 19 nt, Homo sapiens
uaaauguuguccagguucu

SEQ ID NO: 340793 - RNA, 19 nt, Homo sapiens
aaagucaaaucagaaugga

SEQ ID NO: 340794 - RNA, 19 nt, Homo sapiens
aagaugaugaugaugauga

SEQ ID NO: 340795 - RNA, 19 nt, Homo sapiens
ugaacuaaaggccgacaaa

SEQ ID NO: 340796 - RNA, 19 nt, Homo sapiens
gaagaugcagagucagaag

SEQ ID NO: 340797 - RNA, 19 nt, Homo sapiens
caaaggaugaguugcacau

SEQ ID NO: 340798 - RNA, 19 nt, Homo sapiens
guggaggaagucucuuuaa

SEQ ID NO: 340799 - RNA, 19 nt, Homo sapiens
gaugaggaagcugaagaaa

SEQ ID NO: 340800 - RNA, 19 nt, Homo sapiens
uaguagcuguggaggaaga

SEQ ID NO: 340801 - RNA, 19 nt, Homo sapiens
ugaagcagaggcaaugaau

SEQ ID NO: 340802 - RNA, 19 nt, Homo sapiens
gaugaguugcacauuguug

SEQ ID NO: 340803 - RNA, 19 nt, Homo sapiens
gaaaaugagcaccaguuau

SEQ ID NO: 340804 - RNA, 19 nt, Homo sapiens
gaaaugguggggagacaaa

SEQ ID NO: 340805 - RNA, 19 nt, Homo sapiens
ugacugaccaagaggcuau

SEQ ID NO: 340806 - RNA, 19 nt, Homo sapiens
aaaccaucaucaacaccaa

SEQ ID NO: 340807 - RNA, 19 nt, Homo sapiens
gaauggaaaagacucaaaa

SEQ ID NO: 340808 - RNA, 19 nt, Homo sapiens
aagaugaugacgaugauga

SEQ ID NO: 340809 - RNA, 19 nt, Homo sapiens
gaugcagagucagaagaug

SEQ ID NO: 340810 - RNA, 19 nt, Homo sapiens
uaacacuggcaacuuugaa

SEQ ID NO: 340811 - RNA, 19 nt, Homo sapiens
cgaugaugaugaagaggau

SEQ ID NO: 340812 - RNA, 19 nt, Homo sapiens
aagaauguguuguccaaaa

SEQ ID NO: 340813 - RNA, 19 nt, Homo sapiens
aagaggcuauucaagaucu

SEQ ID NO: 340814 - RNA, 19 nt, Homo sapiens
accaagaggcuauucaaga

SEQ ID NO: 340815 - RNA, 19 nt, Homo sapiens
ugaccaagaggcuauucaa

SEQ ID NO: 340816 - RNA, 19 nt, Homo sapiens
ugaaaaugagcaccaguua

SEQ ID NO: 340817 - RNA, 19 nt, Homo sapiens
augaagaggaugaugauga

SEQ ID NO: 340818 - RNA, 19 nt, Homo sapiens
ggaugugaaacucuuaagu

SEQ ID NO: 340819 - RNA, 19 nt, Homo sapiens
ugagcaccaguuaucuuua

SEQ ID NO: 340820 - RNA, 19 nt, Homo sapiens
gccacccgauggaagauuc

SEQ ID NO: 340821 - RNA, 19 nt, Homo sapiens
gggcuggugcaaaggauga

SEQ ID NO: 340822 - RNA, 19 nt, Homo sapiens
acgagauacuccagccaaa

SEQ ID NO: 340823 - RNA, 19 nt, Homo sapiens
gaagaugaugaugaugaug

SEQ ID NO: 340824 - RNA, 19 nt, Homo sapiens
aaaacuugcugcugaugaa

SEQ ID NO: 340825 - RNA, 19 nt, Homo sapiens
uguccaaaaugccuguuua

SEQ ID NO: 340826 - RNA, 19 nt, Homo sapiens
uuaagguggauaaugauga

SEQ ID NO: 340827 - RNA, 19 nt, Homo sapiens
gaugaugacgaugaugaug

SEQ ID NO: 340828 - RNA, 19 nt, Homo sapiens
gguagcaagguuccacaga

SEQ ID NO: 340829 - RNA, 19 nt, Homo sapiens
aggaggaugugaaacucuu

SEQ ID NO: 340830 - RNA, 19 nt, Homo sapiens
agaggaggaggaugugaaa

SEQ ID NO: 340831 - RNA, 19 nt, Homo sapiens
gaacuaucuuuucgguugu

SEQ ID NO: 340832 - RNA, 19 nt, Homo sapiens
gguagaaccucaccuguua

SEQ ID NO: 340833 - RNA, 19 nt, Homo sapiens
gaaagugguuugaaaguga

SEQ ID NO: 340834 - RNA, 19 nt, Homo sapiens
caacacuucucacaucuua

SEQ ID NO: 340835 - RNA, 19 nt, Homo sapiens
agaauuugcuggaccauuu

SEQ ID NO: 340836 - RNA, 19 nt, Homo sapiens
gaaccucaccuguuacuga

SEQ ID NO: 340837 - RNA, 19 nt, Homo sapiens
acgcagaccugauggauuu

SEQ ID NO: 340838 - RNA, 19 nt, Homo sapiens
gagcuaaucccauguacaa

SEQ ID NO: 340839 - RNA, 19 nt, Homo sapiens
ggacagacguaggccaaga

SEQ ID NO: 340840 - RNA, 19 nt, Homo sapiens
uagauaaagugguuugaug

SEQ ID NO: 340841 - RNA, 19 nt, Homo sapiens
ggacuccucugaucgaucu

SEQ ID NO: 340842 - RNA, 19 nt, Homo sapiens
ucagugagccgaaugaaga

SEQ ID NO: 340843 - RNA, 19 nt, Homo sapiens
gcaguggauugcuccuuga

SEQ ID NO: 340844 - RNA, 19 nt, Homo sapiens
ccugauggauuucaagaau

SEQ ID NO: 340845 - RNA, 19 nt, Homo sapiens
gcuaaucccauguacaaug

SEQ ID NO: 340846 - RNA, 19 nt, Homo sapiens
ugaaagugguuugaaagug

SEQ ID NO: 340847 - RNA, 19 nt, Homo sapiens
ugucaacacuucucacauc

SEQ ID NO: 340848 - RNA, 19 nt, Homo sapiens
gaauaaacuucagcaccau

SEQ ID NO: 340849 - RNA, 19 nt, Homo sapiens
ugaucgaucugcccuccua

SEQ ID NO: 340850 - RNA, 19 nt, Homo sapiens
accgugagcuuccuccuuu

SEQ ID NO: 340851 - RNA, 19 nt, Homo sapiens
caucuuaugcuaacuguag

SEQ ID NO: 340852 - RNA, 19 nt, Homo sapiens
gcuggaccauuuggaagaa

SEQ ID NO: 340853 - RNA, 19 nt, Homo sapiens
ccagagcuaaucccaugua

SEQ ID NO: 340854 - RNA, 19 nt, Homo sapiens
aaagugguuugaaagugaa

SEQ ID NO: 340855 - RNA, 19 nt, Homo sapiens
uacugaaagugguuugaaa

SEQ ID NO: 340856 - RNA, 19 nt, Homo sapiens
cuucucacaucuuaugcua

SEQ ID NO: 340857 - RNA, 19 nt, Homo sapiens
gaauuugcuggaccauuug

SEQ ID NO: 340858 - RNA, 19 nt, Homo sapiens
uguaacagcuuccgguacu

SEQ ID NO: 340859 - RNA, 19 nt, Homo sapiens
cugauggauuucaagaauu

SEQ ID NO: 340860 - RNA, 19 nt, Homo sapiens
ucucacaucuuaugcuaac

SEQ ID NO: 340861 - RNA, 19 nt, Homo sapiens
aaccucaccuguuacugaa

SEQ ID NO: 340862 - RNA, 19 nt, Homo sapiens
gugguuugauggugacuuc

SEQ ID NO: 340863 - RNA, 19 nt, Homo sapiens
gauaaagugguuugauggu

SEQ ID NO: 340864 - RNA, 19 nt, Homo sapiens
acacuucucacaucuuaug

SEQ ID NO: 340865 - RNA, 19 nt, Homo sapiens
uaacagcuuccgguacuga

SEQ ID NO: 340866 - RNA, 19 nt, Homo sapiens
gcagcuuccugucaacacu

SEQ ID NO: 340867 - RNA, 19 nt, Homo sapiens
agagcggacugggcuguaa

SEQ ID NO: 340868 - RNA, 19 nt, Homo sapiens
uaacagccagggaggacaa

SEQ ID NO: 340869 - RNA, 19 nt, Homo sapiens
gaccugauggauuucaaga

SEQ ID NO: 340870 - RNA, 19 nt, Homo sapiens
cuaaucccauguacaaugc

SEQ ID NO: 340871 - RNA, 19 nt, Homo sapiens
guagauaaagugguuugau

SEQ ID NO: 340872 - RNA, 19 nt, Homo sapiens
ccauggaguugugaucauc

SEQ ID NO: 340873 - RNA, 19 nt, Homo sapiens
caacgcagaccugauggau

SEQ ID NO: 340874 - RNA, 19 nt, Homo sapiens
ccucaccuguuacugaaag

SEQ ID NO: 340875 - RNA, 19 nt, Homo sapiens
guccaacgcagaccugaug

SEQ ID NO: 340876 - RNA, 19 nt, Homo sapiens
gccauggaguugugaucau

SEQ ID NO: 340877 - RNA, 19 nt, Homo sapiens
gagcagcaagcaguggauu

SEQ ID NO: 340878 - RNA, 19 nt, Homo sapiens
aacuguagauaaagugguu

SEQ ID NO: 340879 - RNA, 19 nt, Homo sapiens
gugguuugaaagugaauaa

SEQ ID NO: 340880 - RNA, 19 nt, Homo sapiens
gucaacacuucucacaucu

SEQ ID NO: 340881 - RNA, 19 nt, Homo sapiens
gcaagggucuggcugcuuu

SEQ ID NO: 340882 - RNA, 19 nt, Homo sapiens
gaugguuucuuaccuuuga

SEQ ID NO: 340883 - RNA, 19 nt, Homo sapiens
ccuuugaagugacucauuu

SEQ ID NO: 340884 - RNA, 19 nt, Homo sapiens
gaggcggcauuaagaggaa

SEQ ID NO: 340885 - RNA, 19 nt, Homo sapiens
ccacaggugucuggaaguc

SEQ ID NO: 340886 - RNA, 19 nt, Homo sapiens
gagggcaggugggaagcaa

SEQ ID NO: 340887 - RNA, 19 nt, Homo sapiens
aggagcagcgcaaccauuu

SEQ ID NO: 340888 - RNA, 19 nt, Homo sapiens
cuuggaaacguccggguua

SEQ ID NO: 340889 - RNA, 19 nt, Homo sapiens
gugcugaggcggcauuaag

SEQ ID NO: 340890 - RNA, 19 nt, Homo sapiens
ggagcagcgcaaccauuug

SEQ ID NO: 340891 - RNA, 19 nt, Homo sapiens
ggaaacguccggguuacag

SEQ ID NO: 340892 - RNA, 19 nt, Homo sapiens
ggugaaauaaagucaacau

SEQ ID NO: 340893 - RNA, 19 nt, Homo sapiens
agacaccugcuucugauuc

SEQ ID NO: 340894 - RNA, 19 nt, Homo sapiens
cgcagucccuccagagaca

SEQ ID NO: 340895 - RNA, 19 nt, Homo sapiens
caggagcagcgcaaccauu

SEQ ID NO: 340896 - RNA, 19 nt, Homo sapiens
caaaggagccaacaagaag

SEQ ID NO: 340897 - RNA, 19 nt, Homo sapiens
ugagcggccugggauguua

SEQ ID NO: 340898 - RNA, 19 nt, Homo sapiens
gggcucgccuucugcaaga

SEQ ID NO: 340899 - RNA, 19 nt, Homo sapiens
acaaaggagccaacaagaa

SEQ ID NO: 340900 - RNA, 19 nt, Homo sapiens
gccucaagcuggaccgaau

SEQ ID NO: 340901 - RNA, 19 nt, Homo sapiens
auacaaaggagccaacaag

SEQ ID NO: 340902 - RNA, 19 nt, Homo sapiens
uacaaaggagccaacaaga

SEQ ID NO: 340903 - RNA, 19 nt, Homo sapiens
gcauugagcugacacgaaa

SEQ ID NO: 340904 - RNA, 19 nt, Homo sapiens
ucaaugaccuguacacuug

SEQ ID NO: 340905 - RNA, 19 nt, Homo sapiens
caacacagccucaagaaug

SEQ ID NO: 340906 - RNA, 19 nt, Homo sapiens
gguacucacucaccaauga

SEQ ID NO: 340907 - RNA, 19 nt, Homo sapiens
ccucaagaauggagucuaa

SEQ ID NO: 340908 - RNA, 19 nt, Homo sapiens
uaaaacaccuggccuauga

SEQ ID NO: 340909 - RNA, 19 nt, Homo sapiens
ggaaguaauuugaauagcu

SEQ ID NO: 340910 - RNA, 19 nt, Homo sapiens
gccaagcgcucaugcucua

SEQ ID NO: 340911 - RNA, 19 nt, Homo sapiens
ucagugacauuguggguuu

SEQ ID NO: 340912 - RNA, 19 nt, Homo sapiens
ggauggaaguaauuugaau

SEQ ID NO: 340913 - RNA, 19 nt, Homo sapiens
guauacagcuuugggauca

SEQ ID NO: 340914 - RNA, 19 nt, Homo sapiens
ugaaacgugugaaccguaa

SEQ ID NO: 340915 - RNA, 19 nt, Homo sapiens
gauugucuccuucuucaua

SEQ ID NO: 340916 - RNA, 19 nt, Homo sapiens
ccaagacagcauauuauaa

SEQ ID NO: 340917 - RNA, 19 nt, Homo sapiens
gccaagacagcauauuaua

SEQ ID NO: 340918 - RNA, 19 nt, Homo sapiens
gcaaaggccgaguuaucua

SEQ ID NO: 340919 - RNA, 19 nt, Homo sapiens
gcagcaacauccuggacaa

SEQ ID NO: 340920 - RNA, 19 nt, Homo sapiens
gcaaggacacaccguuuau

SEQ ID NO: 340921 - RNA, 19 nt, Homo sapiens
caagacagcauauuauaag

SEQ ID NO: 340922 - RNA, 19 nt, Homo sapiens
gagcaaggacacaccguuu

SEQ ID NO: 340923 - RNA, 19 nt, Homo sapiens
gccaaaggauggaaguaau

SEQ ID NO: 340924 - RNA, 19 nt, Homo sapiens
aggcauaccuggaggagaa

SEQ ID NO: 340925 - RNA, 19 nt, Homo sapiens
caaaggauggaaguaauuu

SEQ ID NO: 340926 - RNA, 19 nt, Homo sapiens
cauauaaagacccagauaa

SEQ ID NO: 340927 - RNA, 19 nt, Homo sapiens
gaagagggguggcgcagaa

SEQ ID NO: 340928 - RNA, 19 nt, Homo sapiens
gaaccgaagcuuucaaggu

SEQ ID NO: 340929 - RNA, 19 nt, Homo sapiens
cagauaaucccgaguacuu

SEQ ID NO: 340930 - RNA, 19 nt, Homo sapiens
ggaagaugcagcuggagaa

SEQ ID NO: 340931 - RNA, 19 nt, Homo sapiens
ugaccugccuccucuccua

SEQ ID NO: 340932 - RNA, 19 nt, Homo sapiens
cgaacaaucuggaggaacu

SEQ ID NO: 340933 - RNA, 19 nt, Homo sapiens
ggaggagagucaccugaag

SEQ ID NO: 340934 - RNA, 19 nt, Homo sapiens
ccagugaagacaccagaua

SEQ ID NO: 340935 - RNA, 19 nt, Homo sapiens
caaccaagaucaccuuucc

SEQ ID NO: 340936 - RNA, 19 nt, Homo sapiens
gcgcaaaggccgaguuauc

SEQ ID NO: 340937 - RNA, 19 nt, Homo sapiens
ccaaaggauggaaguaauu

SEQ ID NO: 340938 - RNA, 19 nt, Homo sapiens
gcuacacgccugcgaggua

SEQ ID NO: 340939 - RNA, 19 nt, Homo sapiens
uguuugaacugaagcauau

SEQ ID NO: 340940 - RNA, 19 nt, Homo sapiens
cgcgaccgccucaauauua

SEQ ID NO: 340941 - RNA, 19 nt, Homo sapiens
gcacagggacacucacaca

SEQ ID NO: 340942 - RNA, 19 nt, Homo sapiens
acacaccguuuaugccaaa

SEQ ID NO: 340943 - RNA, 19 nt, Homo sapiens
ggaggaguuuggugguuuc

SEQ ID NO: 340944 - RNA, 19 nt, Homo sapiens
gggaagcccugaagaucca

SEQ ID NO: 340945 - RNA, 19 nt, Homo sapiens
caacuuugauguguacaag

SEQ ID NO: 340946 - RNA, 19 nt, Homo sapiens
uagacaacuuugaugugua

SEQ ID NO: 340947 - RNA, 19 nt, Homo sapiens
agagucaccuggaggaguu

SEQ ID NO: 340948 - RNA, 19 nt, Homo sapiens
gaaaaguccuguuugaacu

SEQ ID NO: 340949 - RNA, 19 nt, Homo sapiens
agaugcagcuggagaagga

SEQ ID NO: 340950 - RNA, 19 nt, Homo sapiens
cuacuucagugacauugug

SEQ ID NO: 340951 - RNA, 19 nt, Homo sapiens
aauuacggcucccugcuaa

SEQ ID NO: 340952 - RNA, 19 nt, Homo sapiens
gauguggaaccgaagcuuu

SEQ ID NO: 340953 - RNA, 19 nt, Homo sapiens
uggaauuccugaagcaguu

SEQ ID NO: 340954 - RNA, 19 nt, Homo sapiens
gagcagagacaauuaaaau

SEQ ID NO: 340955 - RNA, 19 nt, Homo sapiens
gaagggcaaaggcaagguu

SEQ ID NO: 340956 - RNA, 19 nt, Homo sapiens
uugcuuugaugcugucaua

SEQ ID NO: 340957 - RNA, 19 nt, Homo sapiens
ucacucagcggauguggaa

SEQ ID NO: 340958 - RNA, 19 nt, Homo sapiens
uguacaagguggagacaau

SEQ ID NO: 340959 - RNA, 19 nt, Homo sapiens
gacgggcuccugcucuaua

SEQ ID NO: 340960 - RNA, 19 nt, Homo sapiens
agacaacuuugauguguac

SEQ ID NO: 340961 - RNA, 19 nt, Homo sapiens
guacugccgcuggccaaua

SEQ ID NO: 340962 - RNA, 19 nt, Homo sapiens
ggccgaagccuuugacagu

SEQ ID NO: 340963 - RNA, 19 nt, Homo sapiens
gcaucacccuggacuggau

SEQ ID NO: 340964 - RNA, 19 nt, Homo sapiens
ggaauuccugaagcaguua

SEQ ID NO: 340965 - RNA, 19 nt, Homo sapiens
caugagcagagacaauuaa

SEQ ID NO: 340966 - RNA, 19 nt, Homo sapiens
gacugaagaugccccguua

SEQ ID NO: 340967 - RNA, 19 nt, Homo sapiens
caauuacggcucccugcua

SEQ ID NO: 340968 - RNA, 19 nt, Homo sapiens
gaaaagagacuaggugaag

SEQ ID NO: 340969 - RNA, 19 nt, Homo sapiens
cagccuugcuacccuguga

SEQ ID NO: 340970 - RNA, 19 nt, Homo sapiens
guacaagguggagacaauu

SEQ ID NO: 340971 - RNA, 19 nt, Homo sapiens
cgugguagaugggcgcuuu

SEQ ID NO: 340972 - RNA, 19 nt, Homo sapiens
ucaagggcaugcuguuucu

SEQ ID NO: 340973 - RNA, 19 nt, Homo sapiens
uugccaagacagcauauua

SEQ ID NO: 340974 - RNA, 19 nt, Homo sapiens
gcauucugauugucuccuu

SEQ ID NO: 340975 - RNA, 19 nt, Homo sapiens
cuugcuacccugugacuua

SEQ ID NO: 340976 - RNA, 19 nt, Homo sapiens
gaagaugccccguuacugu

SEQ ID NO: 340977 - RNA, 19 nt, Homo sapiens
auagacaacuuugaugugu

SEQ ID NO: 340978 - RNA, 19 nt, Homo sapiens
uggugacccugcucaauga

SEQ ID NO: 340979 - RNA, 19 nt, Homo sapiens
acuaugggcuggagagcuu

SEQ ID NO: 340980 - RNA, 19 nt, Homo sapiens
ggcaugcuguuucuacaca

SEQ ID NO: 340981 - RNA, 19 nt, Homo sapiens
ccaugagcagagacaauua

SEQ ID NO: 340982 - RNA, 19 nt, Homo sapiens
uggaggaguuuggugguuu

SEQ ID NO: 340983 - RNA, 19 nt, Homo sapiens
ucaagaauggagucuaaug

SEQ ID NO: 340984 - RNA, 19 nt, Homo sapiens
ugcgggaugugcagaauga

SEQ ID NO: 340985 - RNA, 19 nt, Homo sapiens
gaggauggccuggugaaca

SEQ ID NO: 340986 - RNA, 19 nt, Homo sapiens
guacuuggaauuccugaag

SEQ ID NO: 340987 - RNA, 19 nt, Homo sapiens
gggaggagagucaccugaa

SEQ ID NO: 340988 - RNA, 19 nt, Homo sapiens
caagaauggagucuaaugg

SEQ ID NO: 340989 - RNA, 19 nt, Homo sapiens
uauaaagacccagauaauc

SEQ ID NO: 340990 - RNA, 19 nt, Homo sapiens
ccuguacacuugcuuugau

SEQ ID NO: 340991 - RNA, 19 nt, Homo sapiens
ggugacguauacagcuuug

SEQ ID NO: 340992 - RNA, 19 nt, Homo sapiens
aaaguccuguuugaacuga

SEQ ID NO: 340993 - RNA, 19 nt, Homo sapiens
cugauugucuccuucuuca

SEQ ID NO: 340994 - RNA, 19 nt, Homo sapiens
acauauaaagacccagaua

SEQ ID NO: 340995 - RNA, 19 nt, Homo sapiens
ggagaacagcagcaacauc

SEQ ID NO: 340996 - RNA, 19 nt, Homo sapiens
ugaagcauaugcgggaugu

SEQ ID NO: 340997 - RNA, 19 nt, Homo sapiens
uucaaggugugacaggaua

SEQ ID NO: 340998 - RNA, 19 nt, Homo sapiens
ggaguggugggacugaaga

SEQ ID NO: 340999 - RNA, 19 nt, Homo sapiens
ccgaagccuuugacagugu

SEQ ID NO: 341000 - RNA, 19 nt, Homo sapiens
gagcaguacgcgaacaauc

SEQ ID NO: 341001 - RNA, 19 nt, Homo sapiens
gcaacauccuggacaaccu

SEQ ID NO: 341002 - RNA, 19 nt, Homo sapiens
caaccucguggcugugaaa

SEQ ID NO: 341003 - RNA, 19 nt, Homo sapiens
gcagaaggcugacgucuau

SEQ ID NO: 341004 - RNA, 19 nt, Homo sapiens
gcucagcccuguacauaua

SEQ ID NO: 341005 - RNA, 19 nt, Homo sapiens
ccaaagagauuguccagaa

SEQ ID NO: 341006 - RNA, 19 nt, Homo sapiens
gaacacugcuucucgaaug

SEQ ID NO: 341007 - RNA, 19 nt, Homo sapiens
ggaaucaccuucaucaugu

SEQ ID NO: 341008 - RNA, 19 nt, Homo sapiens
ggacccaacugaaugaaga

SEQ ID NO: 341009 - RNA, 19 nt, Homo sapiens
gaacacaaccugagcuaug

SEQ ID NO: 341010 - RNA, 19 nt, Homo sapiens
gggagaaucugaccaaugg

SEQ ID NO: 341011 - RNA, 19 nt, Homo sapiens
gaaagcugaugcuggagaa

SEQ ID NO: 341012 - RNA, 19 nt, Homo sapiens
gggauuaugucuucuuuua

SEQ ID NO: 341013 - RNA, 19 nt, Homo sapiens
uaugagagauguucaguuc

SEQ ID NO: 341014 - RNA, 19 nt, Homo sapiens
ggagcuggcuagcauguug

SEQ ID NO: 341015 - RNA, 19 nt, Homo sapiens
gaggauggacuucgaauug

SEQ ID NO: 341016 - RNA, 19 nt, Homo sapiens
cauagacccucccaacauu

SEQ ID NO: 341017 - RNA, 19 nt, Homo sapiens
gaaauguugucgccaucaa

SEQ ID NO: 341018 - RNA, 19 nt, Homo sapiens
agaccuaccuuauauggaa

SEQ ID NO: 341019 - RNA, 19 nt, Homo sapiens
aaggaaagaugcgaacaua

SEQ ID NO: 341020 - RNA, 19 nt, Homo sapiens
gcacaggaaucaccuucau

SEQ ID NO: 341021 - RNA, 19 nt, Homo sapiens
guuuccagcuuccuaauuu

SEQ ID NO: 341022 - RNA, 19 nt, Homo sapiens
caaccuguuucuucucaaa

SEQ ID NO: 341023 - RNA, 19 nt, Homo sapiens
ugagagauguucaguucaa

SEQ ID NO: 341024 - RNA, 19 nt, Homo sapiens
caacaccggucacuucaag

SEQ ID NO: 341025 - RNA, 19 nt, Homo sapiens
ggaaauaccagaucuuugc

SEQ ID NO: 341026 - RNA, 19 nt, Homo sapiens
gagcugagaagcagauuug

SEQ ID NO: 341027 - RNA, 19 nt, Homo sapiens
ugacagccaugcccucuau

SEQ ID NO: 341028 - RNA, 19 nt, Homo sapiens
caacuuggacuggauguuu

SEQ ID NO: 341029 - RNA, 19 nt, Homo sapiens
gacgacccauccugugaua

SEQ ID NO: 341030 - RNA, 19 nt, Homo sapiens
caccagaaauugcucguau

SEQ ID NO: 341031 - RNA, 19 nt, Homo sapiens
gcagugguccuuucuacuu

SEQ ID NO: 341032 - RNA, 19 nt, Homo sapiens
gacuggauguuucguuauu

SEQ ID NO: 341033 - RNA, 19 nt, Homo sapiens
gaugggauccugcuauaug

SEQ ID NO: 341034 - RNA, 19 nt, Homo sapiens
ggaaagaugcgaacauacu

SEQ ID NO: 341035 - RNA, 19 nt, Homo sapiens
gaaggcgccugcucugagu

SEQ ID NO: 341036 - RNA, 19 nt, Homo sapiens
ccaacugaaugaagagcua

SEQ ID NO: 341037 - RNA, 19 nt, Homo sapiens
agaaggagcuggcuagcau

SEQ ID NO: 341038 - RNA, 19 nt, Homo sapiens
uaacugggcugguugucau

SEQ ID NO: 341039 - RNA, 19 nt, Homo sapiens
gcgaacauacuggcucuua

SEQ ID NO: 341040 - RNA, 19 nt, Homo sapiens
ccaaggaugcccuagauga

SEQ ID NO: 341041 - RNA, 19 nt, Homo sapiens
ugccauaauugacaacuuu

SEQ ID NO: 341042 - RNA, 19 nt, Homo sapiens
uggacuggauguuucguua

SEQ ID NO: 341043 - RNA, 19 nt, Homo sapiens
cgugggaguuuacaggaua

SEQ ID NO: 341044 - RNA, 19 nt, Homo sapiens
cuacuucagugacauuguu

SEQ ID NO: 341045 - RNA, 19 nt, Homo sapiens
ccaucaaacaugugaauaa

SEQ ID NO: 341046 - RNA, 19 nt, Homo sapiens
acgaagauaucacggugua

SEQ ID NO: 341047 - RNA, 19 nt, Homo sapiens
gcauagacccucccaacau

SEQ ID NO: 341048 - RNA, 19 nt, Homo sapiens
ugacagcccaugggaaaua

SEQ ID NO: 341049 - RNA, 19 nt, Homo sapiens
caaagagauuguccagaag

SEQ ID NO: 341050 - RNA, 19 nt, Homo sapiens
caucaaacaugugaauaag

SEQ ID NO: 341051 - RNA, 19 nt, Homo sapiens
cagcucagcccuguacaua

SEQ ID NO: 341052 - RNA, 19 nt, Homo sapiens
gaaucaccuucaucauguu

SEQ ID NO: 341053 - RNA, 19 nt, Homo sapiens
ggauggacuucgaauugug

SEQ ID NO: 341054 - RNA, 19 nt, Homo sapiens
gaaagaugcgaacauacug

SEQ ID NO: 341055 - RNA, 19 nt, Homo sapiens
caccaaggaugcccuagau

SEQ ID NO: 341056 - RNA, 19 nt, Homo sapiens
ucguauggcccuagcauua

SEQ ID NO: 341057 - RNA, 19 nt, Homo sapiens
ggaacaguaugccaauaac

SEQ ID NO: 341058 - RNA, 19 nt, Homo sapiens
gaacaaugaccgagagacu

SEQ ID NO: 341059 - RNA, 19 nt, Homo sapiens
gcugaaguccugaaugaga

SEQ ID NO: 341060 - RNA, 19 nt, Homo sapiens
gagaggccuuucagacugu

SEQ ID NO: 341061 - RNA, 19 nt, Homo sapiens
gcuaggaugcuuccagcua

SEQ ID NO: 341062 - RNA, 19 nt, Homo sapiens
gcaccagcauauuggacaa

SEQ ID NO: 341063 - RNA, 19 nt, Homo sapiens
ccaucucacucgcuucauu

SEQ ID NO: 341064 - RNA, 19 nt, Homo sapiens
gaacauacuggcucuuagg

SEQ ID NO: 341065 - RNA, 19 nt, Homo sapiens
gcugacgucuauagcuuug

SEQ ID NO: 341066 - RNA, 19 nt, Homo sapiens
cgacccauccugugauaaa

SEQ ID NO: 341067 - RNA, 19 nt, Homo sapiens
ugaccggccucacuacuuc

SEQ ID NO: 341068 - RNA, 19 nt, Homo sapiens
gaagcucugcucuaccaaa

SEQ ID NO: 341069 - RNA, 19 nt, Homo sapiens
cugcuuugaugccauaauu

SEQ ID NO: 341070 - RNA, 19 nt, Homo sapiens
ggacuucgaauuguggaaa

SEQ ID NO: 341071 - RNA, 19 nt, Homo sapiens
uagaugagcuaggaugcuu

SEQ ID NO: 341072 - RNA, 19 nt, Homo sapiens
gcccuagucuccaccuuuc

SEQ ID NO: 341073 - RNA, 19 nt, Homo sapiens
cuguauaccugcuuugaug

SEQ ID NO: 341074 - RNA, 19 nt, Homo sapiens
gaaugagacaauacaggaa

SEQ ID NO: 341075 - RNA, 19 nt, Homo sapiens
augcugaaguccugaauga

SEQ ID NO: 341076 - RNA, 19 nt, Homo sapiens
ugacauuguuggcuucaca

SEQ ID NO: 341077 - RNA, 19 nt, Homo sapiens
gccagacuuuggacagauu

SEQ ID NO: 341078 - RNA, 19 nt, Homo sapiens
gucuauagcuuugggauca

SEQ ID NO: 341079 - RNA, 19 nt, Homo sapiens
ccaacugugugguggauag

SEQ ID NO: 341080 - RNA, 19 nt, Homo sapiens
gcuggcugcuucuaugaug

SEQ ID NO: 341081 - RNA, 19 nt, Homo sapiens
gaaaugaagggaaaaggaa

SEQ ID NO: 341082 - RNA, 19 nt, Homo sapiens
gcuuugaugccauaauuga

SEQ ID NO: 341083 - RNA, 19 nt, Homo sapiens
ugaccuguauaccugcuuu

SEQ ID NO: 341084 - RNA, 19 nt, Homo sapiens
ccacaacagcauuauuuca

SEQ ID NO: 341085 - RNA, 19 nt, Homo sapiens
acauuugcauugucacuga

SEQ ID NO: 341086 - RNA, 19 nt, Homo sapiens
ugaauaagaagcgcauuga

SEQ ID NO: 341087 - RNA, 19 nt, Homo sapiens
uaccagaucuuugccaaca

SEQ ID NO: 341088 - RNA, 19 nt, Homo sapiens
uaccuuauauggaaguugu

SEQ ID NO: 341089 - RNA, 19 nt, Homo sapiens
cagaugaccggccucacua

SEQ ID NO: 341090 - RNA, 19 nt, Homo sapiens
agaugcaguuucuuccuuu

SEQ ID NO: 341091 - RNA, 19 nt, Homo sapiens
uagaugcaguuucuuccuu

SEQ ID NO: 341092 - RNA, 19 nt, Homo sapiens
gaguuuacaggauauucua

SEQ ID NO: 341093 - RNA, 19 nt, Homo sapiens
uuucaacccuggcaauugu

SEQ ID NO: 341094 - RNA, 19 nt, Homo sapiens
ggaggauggacuucgaauu

SEQ ID NO: 341095 - RNA, 19 nt, Homo sapiens
gaagaugccccguuauugu

SEQ ID NO: 341096 - RNA, 19 nt, Homo sapiens
cagcugaggcuacgcauag

SEQ ID NO: 341097 - RNA, 19 nt, Homo sapiens
ucaacgccaugcaccagaa

SEQ ID NO: 341098 - RNA, 19 nt, Homo sapiens
uggaacaguaugccaauaa

SEQ ID NO: 341099 - RNA, 19 nt, Homo sapiens
gaccggacccaacugaaug

SEQ ID NO: 341100 - RNA, 19 nt, Homo sapiens
ugauaaaacuccacuuuca

SEQ ID NO: 341101 - RNA, 19 nt, Homo sapiens
gaagauaucacgguguaac

SEQ ID NO: 341102 - RNA, 19 nt, Homo sapiens
augaugggauccugcuaua

SEQ ID NO: 341103 - RNA, 19 nt, Homo sapiens
gcagaaggcugacgucuau

SEQ ID NO: 341104 - RNA, 19 nt, Homo sapiens
gcucagcccuguacauaua

SEQ ID NO: 341105 - RNA, 19 nt, Homo sapiens
ccaaagagauuguccagaa

SEQ ID NO: 341106 - RNA, 19 nt, Homo sapiens
gaacacugcuucucgaaug

SEQ ID NO: 341107 - RNA, 19 nt, Homo sapiens
ggaaucaccuucaucaugu

SEQ ID NO: 341108 - RNA, 19 nt, Homo sapiens
ggacccaacugaaugaaga

SEQ ID NO: 341109 - RNA, 19 nt, Homo sapiens
gaacacaaccugagcuaug

SEQ ID NO: 341110 - RNA, 19 nt, Homo sapiens
gggagaaucugaccaaugg

SEQ ID NO: 341111 - RNA, 19 nt, Homo sapiens
gaaagcugaugcuggagaa

SEQ ID NO: 341112 - RNA, 19 nt, Homo sapiens
gggauuaugucuucuuuua

SEQ ID NO: 341113 - RNA, 19 nt, Homo sapiens
uaugagagauguucaguuc

SEQ ID NO: 341114 - RNA, 19 nt, Homo sapiens
ggagcuggcuagcauguug

SEQ ID NO: 341115 - RNA, 19 nt, Homo sapiens
gaggauggacuucgaauug

SEQ ID NO: 341116 - RNA, 19 nt, Homo sapiens
cauagacccucccaacauu

SEQ ID NO: 341117 - RNA, 19 nt, Homo sapiens
gaaauguugucgccaucaa

SEQ ID NO: 341118 - RNA, 19 nt, Homo sapiens
agaccuaccuuauauggaa

SEQ ID NO: 341119 - RNA, 19 nt, Homo sapiens
aaggaaagaugcgaacaua

SEQ ID NO: 341120 - RNA, 19 nt, Homo sapiens
gcacaggaaucaccuucau

SEQ ID NO: 341121 - RNA, 19 nt, Homo sapiens
guuuccagcuuccuaauuu

SEQ ID NO: 341122 - RNA, 19 nt, Homo sapiens
ugagagauguucaguucaa

SEQ ID NO: 341123 - RNA, 19 nt, Homo sapiens
caacaccggucacuucaag

SEQ ID NO: 341124 - RNA, 19 nt, Homo sapiens
ggaaauaccagaucuuugc

SEQ ID NO: 341125 - RNA, 19 nt, Homo sapiens
gagcugagaagcagauuug

SEQ ID NO: 341126 - RNA, 19 nt, Homo sapiens
ugacagccaugcccucuau

SEQ ID NO: 341127 - RNA, 19 nt, Homo sapiens
caacuuggacuggauguuu

SEQ ID NO: 341128 - RNA, 19 nt, Homo sapiens
gacgacccauccugugaua

SEQ ID NO: 341129 - RNA, 19 nt, Homo sapiens
caccagaaauugcucguau

SEQ ID NO: 341130 - RNA, 19 nt, Homo sapiens
gcagugguccuuucuacuu

SEQ ID NO: 341131 - RNA, 19 nt, Homo sapiens
gacuggauguuucguuauu

SEQ ID NO: 341132 - RNA, 19 nt, Homo sapiens
gaugggauccugcuauaug

SEQ ID NO: 341133 - RNA, 19 nt, Homo sapiens
ggaaagaugcgaacauacu

SEQ ID NO: 341134 - RNA, 19 nt, Homo sapiens
ccaacugaaugaagagcua

SEQ ID NO: 341135 - RNA, 19 nt, Homo sapiens
gaaggcgccugcucugagu

SEQ ID NO: 341136 - RNA, 19 nt, Homo sapiens
agaaggagcuggcuagcau

SEQ ID NO: 341137 - RNA, 19 nt, Homo sapiens
uaacugggcugguugucau

SEQ ID NO: 341138 - RNA, 19 nt, Homo sapiens
gcgaacauacuggcucuua

SEQ ID NO: 341139 - RNA, 19 nt, Homo sapiens
ccaaggaugcccuagauga

SEQ ID NO: 341140 - RNA, 19 nt, Homo sapiens
ugccauaauugacaacuuu

SEQ ID NO: 341141 - RNA, 19 nt, Homo sapiens
uggacuggauguuucguua

SEQ ID NO: 341142 - RNA, 19 nt, Homo sapiens
cgugggaguuuacaggaua

SEQ ID NO: 341143 - RNA, 19 nt, Homo sapiens
cuacuucagugacauuguu

SEQ ID NO: 341144 - RNA, 19 nt, Homo sapiens
ccaucaaacaugugaauaa

SEQ ID NO: 341145 - RNA, 19 nt, Homo sapiens
acgaagauaucacggugua

SEQ ID NO: 341146 - RNA, 19 nt, Homo sapiens
gcauagacccucccaacau

SEQ ID NO: 341147 - RNA, 19 nt, Homo sapiens
ugacagcccaugggaaaua

SEQ ID NO: 341148 - RNA, 19 nt, Homo sapiens
caaagagauuguccagaag

SEQ ID NO: 341149 - RNA, 19 nt, Homo sapiens
caucaaacaugugaauaag

SEQ ID NO: 341150 - RNA, 19 nt, Homo sapiens
cagcucagcccuguacaua

SEQ ID NO: 341151 - RNA, 19 nt, Homo sapiens
gaaucaccuucaucauguu

SEQ ID NO: 341152 - RNA, 19 nt, Homo sapiens
ggauggacuucgaauugug

SEQ ID NO: 341153 - RNA, 19 nt, Homo sapiens
gaaagaugcgaacauacug

SEQ ID NO: 341154 - RNA, 19 nt, Homo sapiens
caccaaggaugcccuagau

SEQ ID NO: 341155 - RNA, 19 nt, Homo sapiens
ucguauggcccuagcauua

SEQ ID NO: 341156 - RNA, 19 nt, Homo sapiens
ggaacaguaugccaauaac

SEQ ID NO: 341157 - RNA, 19 nt, Homo sapiens
gaacaaugaccgagagacu

SEQ ID NO: 341158 - RNA, 19 nt, Homo sapiens
gcugaaguccugaaugaga

SEQ ID NO: 341159 - RNA, 19 nt, Homo sapiens
gagaggccuuucagacugu

SEQ ID NO: 341160 - RNA, 19 nt, Homo sapiens
gcuaggaugcuuccagcua

SEQ ID NO: 341161 - RNA, 19 nt, Homo sapiens
gcaccagcauauuggacaa

SEQ ID NO: 341162 - RNA, 19 nt, Homo sapiens
ccaucucacucgcuucauu

SEQ ID NO: 341163 - RNA, 19 nt, Homo sapiens
gaacauacuggcucuuagg

SEQ ID NO: 341164 - RNA, 19 nt, Homo sapiens
gcugacgucuauagcuuug

SEQ ID NO: 341165 - RNA, 19 nt, Homo sapiens
cgacccauccugugauaaa

SEQ ID NO: 341166 - RNA, 19 nt, Homo sapiens
ugaccggccucacuacuuc

SEQ ID NO: 341167 - RNA, 19 nt, Homo sapiens
gaagcucugcucuaccaaa

SEQ ID NO: 341168 - RNA, 19 nt, Homo sapiens
cugcuuugaugccauaauu

SEQ ID NO: 341169 - RNA, 19 nt, Homo sapiens
ggacuucgaauuguggaaa

SEQ ID NO: 341170 - RNA, 19 nt, Homo sapiens
uagaugagcuaggaugcuu

SEQ ID NO: 341171 - RNA, 19 nt, Homo sapiens
cuguauaccugcuuugaug

SEQ ID NO: 341172 - RNA, 19 nt, Homo sapiens
gaaugagacaauacaggaa

SEQ ID NO: 341173 - RNA, 19 nt, Homo sapiens
augcugaaguccugaauga

SEQ ID NO: 341174 - RNA, 19 nt, Homo sapiens
ugacauuguuggcuucaca

SEQ ID NO: 341175 - RNA, 19 nt, Homo sapiens
gccagacuuuggacagauu

SEQ ID NO: 341176 - RNA, 19 nt, Homo sapiens
gucuauagcuuugggauca

SEQ ID NO: 341177 - RNA, 19 nt, Homo sapiens
ccaacugugugguggauag

SEQ ID NO: 341178 - RNA, 19 nt, Homo sapiens
gcuggcugcuucuaugaug

SEQ ID NO: 341179 - RNA, 19 nt, Homo sapiens
gaaaugaagggaaaaggaa

SEQ ID NO: 341180 - RNA, 19 nt, Homo sapiens
gcuuugaugccauaauuga

SEQ ID NO: 341181 - RNA, 19 nt, Homo sapiens
ugaccuguauaccugcuuu

SEQ ID NO: 341182 - RNA, 19 nt, Homo sapiens
ccacaacagcauuauuuca

SEQ ID NO: 341183 - RNA, 19 nt, Homo sapiens
acauuugcauugucacuga

SEQ ID NO: 341184 - RNA, 19 nt, Homo sapiens
ugaauaagaagcgcauuga

SEQ ID NO: 341185 - RNA, 19 nt, Homo sapiens
uaccagaucuuugccaaca

SEQ ID NO: 341186 - RNA, 19 nt, Homo sapiens
uaccuuauauggaaguugu

SEQ ID NO: 341187 - RNA, 19 nt, Homo sapiens
agaugcaguuucuuccuuu

SEQ ID NO: 341188 - RNA, 19 nt, Homo sapiens
uagaugcaguuucuuccuu

SEQ ID NO: 341189 - RNA, 19 nt, Homo sapiens
gaguuuacaggauauucua

SEQ ID NO: 341190 - RNA, 19 nt, Homo sapiens
uuucaacccuggcaauugu

SEQ ID NO: 341191 - RNA, 19 nt, Homo sapiens
ggaggauggacuucgaauu

SEQ ID NO: 341192 - RNA, 19 nt, Homo sapiens
cagaugaccggccucacua

SEQ ID NO: 341193 - RNA, 19 nt, Homo sapiens
gaagaugccccguuauugu

SEQ ID NO: 341194 - RNA, 19 nt, Homo sapiens
cagcugaggcuacgcauag

SEQ ID NO: 341195 - RNA, 19 nt, Homo sapiens
ucaacgccaugcaccagaa

SEQ ID NO: 341196 - RNA, 19 nt, Homo sapiens
uggaacaguaugccaauaa

SEQ ID NO: 341197 - RNA, 19 nt, Homo sapiens
gaccggacccaacugaaug

SEQ ID NO: 341198 - RNA, 19 nt, Homo sapiens
ugauaaaacuccacuuuca

SEQ ID NO: 341199 - RNA, 19 nt, Homo sapiens
gaagauaucacgguguaac

SEQ ID NO: 341200 - RNA, 19 nt, Homo sapiens
augaugggauccugcuaua

SEQ ID NO: 341201 - RNA, 19 nt, Homo sapiens
agaaucgucugcugauaag

SEQ ID NO: 341202 - RNA, 19 nt, Homo sapiens
cgaacauacuggcucuuag

SEQ ID NO: 341203 - RNA, 19 nt, Homo sapiens
ggagauggcucauggaaga

SEQ ID NO: 341204 - RNA, 19 nt, Homo sapiens
gaagacaucgugcgcaaua

SEQ ID NO: 341205 - RNA, 19 nt, Homo sapiens
gcuaauggccuucuacuuu

SEQ ID NO: 341206 - RNA, 19 nt, Homo sapiens
caacagcucuuccuaugga

SEQ ID NO: 341207 - RNA, 19 nt, Homo sapiens
gaacagaacauuugaaggu

SEQ ID NO: 341208 - RNA, 19 nt, Homo sapiens
caaaucauguggccuagaa

SEQ ID NO: 341209 - RNA, 19 nt, Homo sapiens
aaacagcucucccugcaaa

SEQ ID NO: 341210 - RNA, 19 nt, Homo sapiens
gagcggaacugcuacuuca

SEQ ID NO: 341211 - RNA, 19 nt, Homo sapiens
ggauuacguuaacauguuu

SEQ ID NO: 341212 - RNA, 19 nt, Homo sapiens
ggagauagacggguugaaa

SEQ ID NO: 341213 - RNA, 19 nt, Homo sapiens
ggagcuggcuugcuaaugg

SEQ ID NO: 341214 - RNA, 19 nt, Homo sapiens
gaaacaagggcucaauaug

SEQ ID NO: 341215 - RNA, 19 nt, Homo sapiens
gagaaacaagggcucaaua

SEQ ID NO: 341216 - RNA, 19 nt, Homo sapiens
ugaaagacaucaaugaaac

SEQ ID NO: 341217 - RNA, 19 nt, Homo sapiens
acacguccaucuacaguuu

SEQ ID NO: 341218 - RNA, 19 nt, Homo sapiens
cgucuuggcucuacaugaa

SEQ ID NO: 341219 - RNA, 19 nt, Homo sapiens
acuaggagcuggcuugcua

SEQ ID NO: 341220 - RNA, 19 nt, Homo sapiens
cagcagacuuggaacagaa

SEQ ID NO: 341221 - RNA, 19 nt, Homo sapiens
aaacacgacuuugaagcua

SEQ ID NO: 341222 - RNA, 19 nt, Homo sapiens
gggcagguguccauagaug

SEQ ID NO: 341223 - RNA, 19 nt, Homo sapiens
gagauucuuuaaggagaua

SEQ ID NO: 341224 - RNA, 19 nt, Homo sapiens
ggaugacucguacuuguuu

SEQ ID NO: 341225 - RNA, 19 nt, Homo sapiens
ggcucaauauggaggauua

SEQ ID NO: 341226 - RNA, 19 nt, Homo sapiens
ccagguggcuuacgaggau

SEQ ID NO: 341227 - RNA, 19 nt, Homo sapiens
ggagguuauuggugauuau

SEQ ID NO: 341228 - RNA, 19 nt, Homo sapiens
aaaguucaguugagaaaca

SEQ ID NO: 341229 - RNA, 19 nt, Homo sapiens
aaacaagggcucaauaugg

SEQ ID NO: 341230 - RNA, 19 nt, Homo sapiens
aacaagggcucaauaugga

SEQ ID NO: 341231 - RNA, 19 nt, Homo sapiens
gcaauauccaggccaguga

SEQ ID NO: 341232 - RNA, 19 nt, Homo sapiens
uuacgaggauucagacugu

SEQ ID NO: 341233 - RNA, 19 nt, Homo sapiens
caggaugacucguacuugu

SEQ ID NO: 341234 - RNA, 19 nt, Homo sapiens
gaagagaggagacaaacac

SEQ ID NO: 341235 - RNA, 19 nt, Homo sapiens
aaccugaguuugagaaguu

SEQ ID NO: 341236 - RNA, 19 nt, Homo sapiens
caggaagaaauacagaaua

SEQ ID NO: 341237 - RNA, 19 nt, Homo sapiens
gaaaaguucaguugagaaa

SEQ ID NO: 341238 - RNA, 19 nt, Homo sapiens
gaagaaauacagaauaacc

SEQ ID NO: 341239 - RNA, 19 nt, Homo sapiens
aggauuacguuaacauguu

SEQ ID NO: 341240 - RNA, 19 nt, Homo sapiens
caauauggaggauuacguu

SEQ ID NO: 341241 - RNA, 19 nt, Homo sapiens
cgacgagaccaaagacuug

SEQ ID NO: 341242 - RNA, 19 nt, Homo sapiens
uggaaaacaucgggaauua

SEQ ID NO: 341243 - RNA, 19 nt, Homo sapiens
gaacccagcaagaagaaag

SEQ ID NO: 341244 - RNA, 19 nt, Homo sapiens
gaucgaggugcugguguua

SEQ ID NO: 341245 - RNA, 19 nt, Homo sapiens
acagaacauuugaagguau

SEQ ID NO: 341246 - RNA, 19 nt, Homo sapiens
gaaguacucagagcugguu

SEQ ID NO: 341247 - RNA, 19 nt, Homo sapiens
cuagaagaaucggcaguga

SEQ ID NO: 341248 - RNA, 19 nt, Homo sapiens
aacagaacauuugaaggua

SEQ ID NO: 341249 - RNA, 19 nt, Homo sapiens
agaaacaagggcucaauau

SEQ ID NO: 341250 - RNA, 19 nt, Homo sapiens
cuaauggccuucuacuuuu

SEQ ID NO: 341251 - RNA, 19 nt, Homo sapiens
ggacagugaaaccugaguu

SEQ ID NO: 341252 - RNA, 19 nt, Homo sapiens
gcacacguccaucuacagu

SEQ ID NO: 341253 - RNA, 19 nt, Homo sapiens
gcgcugcacuggucuacag

SEQ ID NO: 341254 - RNA, 19 nt, Homo sapiens
cagaacauuugaagguauc

SEQ ID NO: 341255 - RNA, 19 nt, Homo sapiens
caagaugggcgagaugaug

SEQ ID NO: 341256 - RNA, 19 nt, Homo sapiens
gaugaaaaccgaauuguag

SEQ ID NO: 341257 - RNA, 19 nt, Homo sapiens
gaggauuacguuaacaugu

SEQ ID NO: 341258 - RNA, 19 nt, Homo sapiens
gagauagacggguugaaag

SEQ ID NO: 341259 - RNA, 19 nt, Homo sapiens
ggaggauuacguuaacaug

SEQ ID NO: 341260 - RNA, 19 nt, Homo sapiens
gagacuacgccuucuucaa

SEQ ID NO: 341261 - RNA, 19 nt, Homo sapiens
ggccgaaugucaaauaucc

SEQ ID NO: 341262 - RNA, 19 nt, Homo sapiens
uucaacagcucuuccuaug

SEQ ID NO: 341263 - RNA, 19 nt, Homo sapiens
gacuacgccuucuucaaca

SEQ ID NO: 341264 - RNA, 19 nt, Homo sapiens
gcgccaagccagaccuuau

SEQ ID NO: 341265 - RNA, 19 nt, Homo sapiens
ugccugagauucuuuaagg

SEQ ID NO: 341266 - RNA, 19 nt, Homo sapiens
agagaguggugaucaugug

SEQ ID NO: 341267 - RNA, 19 nt, Homo sapiens
gaggcgaacccagcaagaa

SEQ ID NO: 341268 - RNA, 19 nt, Homo sapiens
cauguggccuagaagaauc

SEQ ID NO: 341269 - RNA, 19 nt, Homo sapiens
cauguuuguugaaggauuc

SEQ ID NO: 341270 - RNA, 19 nt, Homo sapiens
ggaagagaggagacaaaca

SEQ ID NO: 341271 - RNA, 19 nt, Homo sapiens
caaagacuuggaucuggaa

SEQ ID NO: 341272 - RNA, 19 nt, Homo sapiens
aaaccgaauuguagagcau

SEQ ID NO: 341273 - RNA, 19 nt, Homo sapiens
ugauugccaugacugaugu

SEQ ID NO: 341274 - RNA, 19 nt, Homo sapiens
gagagaguggugaucaugu

SEQ ID NO: 341275 - RNA, 19 nt, Homo sapiens
ccgggcagguguccauaga

SEQ ID NO: 341276 - RNA, 19 nt, Homo sapiens
agaagaaucggcagugaca

SEQ ID NO: 341277 - RNA, 19 nt, Homo sapiens
aggagguuauuggugauua

SEQ ID NO: 341278 - RNA, 19 nt, Homo sapiens
gcgaacccagcaagaagaa

SEQ ID NO: 341279 - RNA, 19 nt, Homo sapiens
uauggaggauuacguuaac

SEQ ID NO: 341280 - RNA, 19 nt, Homo sapiens
aacacgacuuugaagcuaa

SEQ ID NO: 341281 - RNA, 19 nt, Homo sapiens
ggagcggaacugcuacuuc

SEQ ID NO: 341282 - RNA, 19 nt, Homo sapiens
ugagauucuuuaaggagau

SEQ ID NO: 341283 - RNA, 19 nt, Homo sapiens
ucaggaagaaauacagaau

SEQ ID NO: 341284 - RNA, 19 nt, Homo sapiens
gagguuauuggugauuauu

SEQ ID NO: 341285 - RNA, 19 nt, Homo sapiens
uuauacagcagacuuggaa

SEQ ID NO: 341286 - RNA, 19 nt, Homo sapiens
ggauggagggaaaauuaua

SEQ ID NO: 341287 - RNA, 19 nt, Homo sapiens
ccauggaggugaaaaguuc

SEQ ID NO: 341288 - RNA, 19 nt, Homo sapiens
gaugaugcucgcccuguuc

SEQ ID NO: 341289 - RNA, 19 nt, Homo sapiens
agacuacgccuucuucaac

SEQ ID NO: 341290 - RNA, 19 nt, Homo sapiens
auagacggguugaaagaca

SEQ ID NO: 341291 - RNA, 19 nt, Homo sapiens
agauagacggguugaaaga

SEQ ID NO: 341292 - RNA, 19 nt, Homo sapiens
gcacccaggagguuauugg

SEQ ID NO: 341293 - RNA, 19 nt, Homo sapiens
gaggagacaaacacgacuu

SEQ ID NO: 341294 - RNA, 19 nt, Homo sapiens
gacaccauccggagcauca

SEQ ID NO: 341295 - RNA, 19 nt, Homo sapiens
gugauugccaugacugaug

SEQ ID NO: 341296 - RNA, 19 nt, Homo sapiens
agaucgaggugcugguguu

SEQ ID NO: 341297 - RNA, 19 nt, Homo sapiens
gugagagaguggugaucau

SEQ ID NO: 341298 - RNA, 19 nt, Homo sapiens
aaucggcagugacaggaau

SEQ ID NO: 341299 - RNA, 19 nt, Homo sapiens
gcaaaucauguggccuaga

SEQ ID NO: 341300 - RNA, 19 nt, Homo sapiens
gacuuggaacagaacauuu

SEQ ID NO: 341301 - RNA, 19 nt, Homo sapiens
acagcagacuuggaacaga

SEQ ID NO: 341302 - RNA, 19 nt, Homo sapiens
agaugaugcucgcccuguu

SEQ ID NO: 341303 - RNA, 19 nt, Homo sapiens
gaacaagccuaaaggauuc

SEQ ID NO: 341304 - RNA, 19 nt, Homo sapiens
gaacugaaagcauguauuu

SEQ ID NO: 341305 - RNA, 19 nt, Homo sapiens
gaagugaacugucucugaa

SEQ ID NO: 341306 - RNA, 19 nt, Homo sapiens
ggacguaccucauuuccuu

SEQ ID NO: 341307 - RNA, 19 nt, Homo sapiens
ggacugaagugcaauuugu

SEQ ID NO: 341308 - RNA, 19 nt, Homo sapiens
ggaagaaagagauacauuu

SEQ ID NO: 341309 - RNA, 19 nt, Homo sapiens
gcaaaccgcugacaagucu

SEQ ID NO: 341310 - RNA, 19 nt, Homo sapiens
gaagugcaauuuguugaaa

SEQ ID NO: 341311 - RNA, 19 nt, Homo sapiens
gaugggaaauguauuacuu

SEQ ID NO: 341312 - RNA, 19 nt, Homo sapiens
gaauaucaguucuaaccuu

SEQ ID NO: 341313 - RNA, 19 nt, Homo sapiens
ggaaugagccgaggauuug

SEQ ID NO: 341314 - RNA, 19 nt, Homo sapiens
gggcuuagaucccacuuga

SEQ ID NO: 341315 - RNA, 19 nt, Homo sapiens
ucagggaucuucuccguuu

SEQ ID NO: 341316 - RNA, 19 nt, Homo sapiens
caaccuauaucucccuuga

SEQ ID NO: 341317 - RNA, 19 nt, Homo sapiens
gggaacaagucauugaaga

SEQ ID NO: 341318 - RNA, 19 nt, Homo sapiens
gaacaagucauugaagaga

SEQ ID NO: 341319 - RNA, 19 nt, Homo sapiens
ggccgaagcugaccuuuag

SEQ ID NO: 341320 - RNA, 19 nt, Homo sapiens
gauagaauccuuuggaauc

SEQ ID NO: 341321 - RNA, 19 nt, Homo sapiens
gaacaaggcagaaguuggu

SEQ ID NO: 341322 - RNA, 19 nt, Homo sapiens
ugacacagccgcaaaucua

SEQ ID NO: 341323 - RNA, 19 nt, Homo sapiens
gugcggcgaugaucuguuu

SEQ ID NO: 341324 - RNA, 19 nt, Homo sapiens
uggagaaccucgagcagua

SEQ ID NO: 341325 - RNA, 19 nt, Homo sapiens
guaccucauuuccuucuuu

SEQ ID NO: 341326 - RNA, 19 nt, Homo sapiens
gaaaaggacaaaccuauaa

SEQ ID NO: 341327 - RNA, 19 nt, Homo sapiens
guagauucccaguuuauuu

SEQ ID NO: 341328 - RNA, 19 nt, Homo sapiens
ggugggagcuguccguuca

SEQ ID NO: 341329 - RNA, 19 nt, Homo sapiens
aaacacagguccacguugu

SEQ ID NO: 341330 - RNA, 19 nt, Homo sapiens
agaauccuuuggaaucuua

SEQ ID NO: 341331 - RNA, 19 nt, Homo sapiens
ucuuggagcugacuuacua

SEQ ID NO: 341332 - RNA, 19 nt, Homo sapiens
ccacguaguucccauuuac

SEQ ID NO: 341333 - RNA, 19 nt, Homo sapiens
gaaaauggcuggguaagca

SEQ ID NO: 341334 - RNA, 19 nt, Homo sapiens
gagcagguguuucugucuu

SEQ ID NO: 341335 - RNA, 19 nt, Homo sapiens
gaaacccacuccuccaucu

SEQ ID NO: 341336 - RNA, 19 nt, Homo sapiens
gaucagcgagcucgagaaa

SEQ ID NO: 341337 - RNA, 19 nt, Homo sapiens
gagccgaggauuugaauau

SEQ ID NO: 341338 - RNA, 19 nt, Homo sapiens
uaauagaagugaacugucu

SEQ ID NO: 341339 - RNA, 19 nt, Homo sapiens
auacuuagagucccaauuu

SEQ ID NO: 341340 - RNA, 19 nt, Homo sapiens
ucagagcgacauaucuuua

SEQ ID NO: 341341 - RNA, 19 nt, Homo sapiens
ugauugauguucccucuug

SEQ ID NO: 341342 - RNA, 19 nt, Homo sapiens
ucaagaaccuagugcaucu

SEQ ID NO: 341343 - RNA, 19 nt, Homo sapiens
gaagccguguuucgaugaa

SEQ ID NO: 341344 - RNA, 19 nt, Homo sapiens
acaagucauugaagagaaa

SEQ ID NO: 341345 - RNA, 19 nt, Homo sapiens
ugaaagggaacaagucauu

SEQ ID NO: 341346 - RNA, 19 nt, Homo sapiens
agaacaagccuaaaggauu

SEQ ID NO: 341347 - RNA, 19 nt, Homo sapiens
gcugacaagucuuucuaga

SEQ ID NO: 341348 - RNA, 19 nt, Homo sapiens
ccaggagucucaucagcaa

SEQ ID NO: 341349 - RNA, 19 nt, Homo sapiens
agagcgacauaucuuuaua

SEQ ID NO: 341350 - RNA, 19 nt, Homo sapiens
ccauggagauccucaucaa

SEQ ID NO: 341351 - RNA, 19 nt, Homo sapiens
aagaagagccugccagaga

SEQ ID NO: 341352 - RNA, 19 nt, Homo sapiens
gaaagcauguauuuuggaa

SEQ ID NO: 341353 - RNA, 19 nt, Homo sapiens
caagagagagcucaguuuc

SEQ ID NO: 341354 - RNA, 19 nt, Homo sapiens
gaaccuagugcaucugugu

SEQ ID NO: 341355 - RNA, 19 nt, Homo sapiens
gcaaccaaauguggcuuga

SEQ ID NO: 341356 - RNA, 19 nt, Homo sapiens
ccucuugcacugaauaaua

SEQ ID NO: 341357 - RNA, 19 nt, Homo sapiens
uggaggaggucaagagaga

SEQ ID NO: 341358 - RNA, 19 nt, Homo sapiens
gagaaguguaugugcauuu

SEQ ID NO: 341359 - RNA, 19 nt, Homo sapiens
aaagcaacauggacauuuc

SEQ ID NO: 341360 - RNA, 19 nt, Homo sapiens
guacacgcauuugucuuug

SEQ ID NO: 341361 - RNA, 19 nt, Homo sapiens
gaaagggaacaagucauug

SEQ ID NO: 341362 - RNA, 19 nt, Homo sapiens
aaauguggcuugacgaagu

SEQ ID NO: 341363 - RNA, 19 nt, Homo sapiens
ggaaucuuauggcaaccaa

SEQ ID NO: 341364 - RNA, 19 nt, Homo sapiens
ccaacgagcugguccucau

SEQ ID NO: 341365 - RNA, 19 nt, Homo sapiens
caaccgcccuggagacaag

SEQ ID NO: 341366 - RNA, 19 nt, Homo sapiens
gggccgaagcugaccuuua

SEQ ID NO: 341367 - RNA, 19 nt, Homo sapiens
ucagcgagcucgagaaagg

SEQ ID NO: 341368 - RNA, 19 nt, Homo sapiens
gcugcaacgucuugaacaa

SEQ ID NO: 341369 - RNA, 19 nt, Homo sapiens
acauggacauuuccuucua

SEQ ID NO: 341370 - RNA, 19 nt, Homo sapiens
caaccucaguacacgcauu

SEQ ID NO: 341371 - RNA, 19 nt, Homo sapiens
cgagaaaggucagaaagac

SEQ ID NO: 341372 - RNA, 19 nt, Homo sapiens
ccacugcggaccaacuaua

SEQ ID NO: 341373 - RNA, 19 nt, Homo sapiens
gagaacaagccuaaaggau

SEQ ID NO: 341374 - RNA, 19 nt, Homo sapiens
ccaacagccucaaggaucu

SEQ ID NO: 341375 - RNA, 19 nt, Homo sapiens
gucgugguuucaucucuua

SEQ ID NO: 341376 - RNA, 19 nt, Homo sapiens
gccgaggauuugaauauca

SEQ ID NO: 341377 - RNA, 19 nt, Homo sapiens
caacuaacgaugggaaaug

SEQ ID NO: 341378 - RNA, 19 nt, Homo sapiens
agaaguguaugugcauuug

SEQ ID NO: 341379 - RNA, 19 nt, Homo sapiens
gaccagaggggaccuuuua

SEQ ID NO: 341380 - RNA, 19 nt, Homo sapiens
gcauuugucuuuguuugca

SEQ ID NO: 341381 - RNA, 19 nt, Homo sapiens
agaagagccugccagagau

SEQ ID NO: 341382 - RNA, 19 nt, Homo sapiens
caguacagccgccucaauu

SEQ ID NO: 341383 - RNA, 19 nt, Homo sapiens
gugcugcgguuguuguuca

SEQ ID NO: 341384 - RNA, 19 nt, Homo sapiens
augaagaccuggccacaug

SEQ ID NO: 341385 - RNA, 19 nt, Homo sapiens
aaggaaagaagccguguuu

SEQ ID NO: 341386 - RNA, 19 nt, Homo sapiens
aaagggaacaagucauuga

SEQ ID NO: 341387 - RNA, 19 nt, Homo sapiens
accuauaucucccuugaaa

SEQ ID NO: 341388 - RNA, 19 nt, Homo sapiens
gacacagccgcaaaucuaa

SEQ ID NO: 341389 - RNA, 19 nt, Homo sapiens
acacgcauuugucuuuguu

SEQ ID NO: 341390 - RNA, 19 nt, Homo sapiens
ccaaauguggcuugacgaa

SEQ ID NO: 341391 - RNA, 19 nt, Homo sapiens
cagguaagccauuuuauaa

SEQ ID NO: 341392 - RNA, 19 nt, Homo sapiens
aaacacaccaagaagcauu

SEQ ID NO: 341393 - RNA, 19 nt, Homo sapiens
gcaggaggagcagguguuu

SEQ ID NO: 341394 - RNA, 19 nt, Homo sapiens
ggggaggccuuuucuuuga

SEQ ID NO: 341395 - RNA, 19 nt, Homo sapiens
ggugagaggaucugugugu

SEQ ID NO: 341396 - RNA, 19 nt, Homo sapiens
cauuuacuccuuaaucuga

SEQ ID NO: 341397 - RNA, 19 nt, Homo sapiens
ccaaacacaccaagaagca

SEQ ID NO: 341398 - RNA, 19 nt, Homo sapiens
ucaagagagagcucaguuu

SEQ ID NO: 341399 - RNA, 19 nt, Homo sapiens
gaagagccugccagagaug

SEQ ID NO: 341400 - RNA, 19 nt, Homo sapiens
gaucccacuugagucguaa

SEQ ID NO: 341401 - RNA, 19 nt, Homo sapiens
ggaacaagucauugaagag

SEQ ID NO: 341402 - RNA, 19 nt, Homo sapiens
gcuuagaucccacuugagu

SEQ ID NO: 341403 - RNA, 19 nt, Homo sapiens
ggacgggaguaguaauuua

SEQ ID NO: 341404 - RNA, 19 nt, Homo sapiens
cuacagaacuccucaagaa

SEQ ID NO: 341405 - RNA, 19 nt, Homo sapiens
aaagugcacugaaagauaa

SEQ ID NO: 341406 - RNA, 19 nt, Homo sapiens
gaugauggaauuucgauua

SEQ ID NO: 341407 - RNA, 19 nt, Homo sapiens
gcacuggacugucuucauc

SEQ ID NO: 341408 - RNA, 19 nt, Homo sapiens
ggacugucuucaucaagua

SEQ ID NO: 341409 - RNA, 19 nt, Homo sapiens
gugcaaaucuguggauauu

SEQ ID NO: 341410 - RNA, 19 nt, Homo sapiens
gaagaaggcucccauuuuc

SEQ ID NO: 341411 - RNA, 19 nt, Homo sapiens
gaacagccauuagaagaag

SEQ ID NO: 341412 - RNA, 19 nt, Homo sapiens
gagcaaacguguccaaugc

SEQ ID NO: 341413 - RNA, 19 nt, Homo sapiens
gaacucuucugaugaugga

SEQ ID NO: 341414 - RNA, 19 nt, Homo sapiens
uaaagugcacugaaagaua

SEQ ID NO: 341415 - RNA, 19 nt, Homo sapiens
cgauuaaagugcacugaaa

SEQ ID NO: 341416 - RNA, 19 nt, Homo sapiens
gaaaggagaagggcuguga

SEQ ID NO: 341417 - RNA, 19 nt, Homo sapiens
gauggaauuucgauuaaag

SEQ ID NO: 341418 - RNA, 19 nt, Homo sapiens
ucaaguauuucccuacaga

SEQ ID NO: 341419 - RNA, 19 nt, Homo sapiens
caauagcgccuuuaaguca

SEQ ID NO: 341420 - RNA, 19 nt, Homo sapiens
gcaaaucuguggauauucc

SEQ ID NO: 341421 - RNA, 19 nt, Homo sapiens
gagaucauuuggcuagaga

SEQ ID NO: 341422 - RNA, 19 nt, Homo sapiens
gaaaagaacagccauuaga

SEQ ID NO: 341423 - RNA, 19 nt, Homo sapiens
ccaauauucuguugcuguu

SEQ ID NO: 341424 - RNA, 19 nt, Homo sapiens
ccaugucccuugugcauug

SEQ ID NO: 341425 - RNA, 19 nt, Homo sapiens
aagauaaagugacuaagug

SEQ ID NO: 341426 - RNA, 19 nt, Homo sapiens
acaauaacgucgauguguu

SEQ ID NO: 341427 - RNA, 19 nt, Homo sapiens
gcucagccaguucaacaua

SEQ ID NO: 341428 - RNA, 19 nt, Homo sapiens
ggcaauagcgccuuuaagu

SEQ ID NO: 341429 - RNA, 19 nt, Homo sapiens
uaaaaggccucucuucuca

SEQ ID NO: 341430 - RNA, 19 nt, Homo sapiens
ccaaguggguggauaucug

SEQ ID NO: 341431 - RNA, 19 nt, Homo sapiens
ccaagcuacucacuguauu

SEQ ID NO: 341432 - RNA, 19 nt, Homo sapiens
ucccguggguggacaauaa

SEQ ID NO: 341433 - RNA, 19 nt, Homo sapiens
uagaagaaggcucccauuu

SEQ ID NO: 341434 - RNA, 19 nt, Homo sapiens
caacugcuccacaaacaug

SEQ ID NO: 341435 - RNA, 19 nt, Homo sapiens
caucaaguauuucccuaca

SEQ ID NO: 341436 - RNA, 19 nt, Homo sapiens
agacugaugcuuugacuga

SEQ ID NO: 341437 - RNA, 19 nt, Homo sapiens
agaagucccugcugcacaa

SEQ ID NO: 341438 - RNA, 19 nt, Homo sapiens
gcaauagcgccuuuaaguc

SEQ ID NO: 341439 - RNA, 19 nt, Homo sapiens
cgggaguaguaauuuauuu

SEQ ID NO: 341440 - RNA, 19 nt, Homo sapiens
gccaacugcuccacaaaca

SEQ ID NO: 341441 - RNA, 19 nt, Homo sapiens
guauuggacgggaguagua

SEQ ID NO: 341442 - RNA, 19 nt, Homo sapiens
ucauuuggcuagagauugu

SEQ ID NO: 341443 - RNA, 19 nt, Homo sapiens
ggcuagagauugucugagu

SEQ ID NO: 341444 - RNA, 19 nt, Homo sapiens
gaucauuuggcuagagauu

SEQ ID NO: 341445 - RNA, 19 nt, Homo sapiens
aauauucuguugcuguuug

SEQ ID NO: 341446 - RNA, 19 nt, Homo sapiens
gucacuggcuuguuuguuc

SEQ ID NO: 341447 - RNA, 19 nt, Homo sapiens
gcucaucaacgacaagguu

SEQ ID NO: 341448 - RNA, 19 nt, Homo sapiens
ggacaauaacgucgaugug

SEQ ID NO: 341449 - RNA, 19 nt, Homo sapiens
gagcucagccaguucaaca

SEQ ID NO: 341450 - RNA, 19 nt, Homo sapiens
gugaagagugugcucguuu

SEQ ID NO: 341451 - RNA, 19 nt, Homo sapiens
cuuaaacucuugucagucu

SEQ ID NO: 341452 - RNA, 19 nt, Homo sapiens
ggauauuccauuuguagga

SEQ ID NO: 341453 - RNA, 19 nt, Homo sapiens
aagaacagccauuagaaga

SEQ ID NO: 341454 - RNA, 19 nt, Homo sapiens
cuucucaucuggugccaaa

SEQ ID NO: 341455 - RNA, 19 nt, Homo sapiens
gagcuggagcgaggcaaua

SEQ ID NO: 341456 - RNA, 19 nt, Homo sapiens
gacaauaacgucgaugugu

SEQ ID NO: 341457 - RNA, 19 nt, Homo sapiens
uguaagcacuggacugucu

SEQ ID NO: 341458 - RNA, 19 nt, Homo sapiens
cacuagcuauggcauuaaa

SEQ ID NO: 341459 - RNA, 19 nt, Homo sapiens
gucugucacuggcuuguuu

SEQ ID NO: 341460 - RNA, 19 nt, Homo sapiens
caauaacgucgauguguuc

SEQ ID NO: 341461 - RNA, 19 nt, Homo sapiens
aaaggccucucuucucauc

SEQ ID NO: 341462 - RNA, 19 nt, Homo sapiens
gaagugcaaaucuguggau

SEQ ID NO: 341463 - RNA, 19 nt, Homo sapiens
gaagagugugcucguuuua

SEQ ID NO: 341464 - RNA, 19 nt, Homo sapiens
gccuuuaagucaccagaug

SEQ ID NO: 341465 - RNA, 19 nt, Homo sapiens
cacuuaaacucuugucagu

SEQ ID NO: 341466 - RNA, 19 nt, Homo sapiens
auacauguuugaagugcaa

SEQ ID NO: 341467 - RNA, 19 nt, Homo sapiens
caagcuacucacuguauug

SEQ ID NO: 341468 - RNA, 19 nt, Homo sapiens
gacgggaguaguaauuuau

SEQ ID NO: 341469 - RNA, 19 nt, Homo sapiens
ucagccaguucaacauaug

SEQ ID NO: 341470 - RNA, 19 nt, Homo sapiens
cgacaugcccauccugaca

SEQ ID NO: 341471 - RNA, 19 nt, Homo sapiens
acuccaagcuacucacugu

SEQ ID NO: 341472 - RNA, 19 nt, Homo sapiens
guauuucccuacagaacuc

SEQ ID NO: 341473 - RNA, 19 nt, Homo sapiens
aagguuccguugcagcuuu

SEQ ID NO: 341474 - RNA, 19 nt, Homo sapiens
cagaaaagaacagccauua

SEQ ID NO: 341475 - RNA, 19 nt, Homo sapiens
ugaaucaucacuagcuaug

SEQ ID NO: 341476 - RNA, 19 nt, Homo sapiens
gauuaaagugcacugaaag

SEQ ID NO: 341477 - RNA, 19 nt, Homo sapiens
cuagagauugucugaguga

SEQ ID NO: 341478 - RNA, 19 nt, Homo sapiens
ugccaaagguuccguugca

SEQ ID NO: 341479 - RNA, 19 nt, Homo sapiens
aucacuagcuauggcauua

SEQ ID NO: 341480 - RNA, 19 nt, Homo sapiens
uguguucuauacauuguga

SEQ ID NO: 341481 - RNA, 19 nt, Homo sapiens
agaacagccauuagaagaa

SEQ ID NO: 341482 - RNA, 19 nt, Homo sapiens
caucauccuuccuuagacu

SEQ ID NO: 341483 - RNA, 19 nt, Homo sapiens
caagacaccugccccaagu

SEQ ID NO: 341484 - RNA, 19 nt, Homo sapiens
ggaaguucagggccauaga

SEQ ID NO: 341485 - RNA, 19 nt, Homo sapiens
guccuucgcgcacaagaaa

SEQ ID NO: 341486 - RNA, 19 nt, Homo sapiens
caagaaaacagagaucauu

SEQ ID NO: 341487 - RNA, 19 nt, Homo sapiens
ugaagagugugcucguuuu

SEQ ID NO: 341488 - RNA, 19 nt, Homo sapiens
agaagaaggcucccauuuu

SEQ ID NO: 341489 - RNA, 19 nt, Homo sapiens
aaagaacagccauuagaag

SEQ ID NO: 341490 - RNA, 19 nt, Homo sapiens
ggggaaauuuauaaagcua

SEQ ID NO: 341491 - RNA, 19 nt, Homo sapiens
gaguggccaugucccuugu

SEQ ID NO: 341492 - RNA, 19 nt, Homo sapiens
uuuguucccuaccaauauu

SEQ ID NO: 341493 - RNA, 19 nt, Homo sapiens
gagcgucuccuugacuugu

SEQ ID NO: 341494 - RNA, 19 nt, Homo sapiens
ugagacggcaggagacuuc

SEQ ID NO: 341495 - RNA, 19 nt, Homo sapiens
ccacgggcaaggacacuau

SEQ ID NO: 341496 - RNA, 19 nt, Homo sapiens
gaaaacagagaucauuugg

SEQ ID NO: 341497 - RNA, 19 nt, Homo sapiens
uggacugucuucaucaagu

SEQ ID NO: 341498 - RNA, 19 nt, Homo sapiens
agagugugcucguuuuaaa

SEQ ID NO: 341499 - RNA, 19 nt, Homo sapiens
cuaccaauauucuguugcu

SEQ ID NO: 341500 - RNA, 19 nt, Homo sapiens
gguggacaauaacgucgau

SEQ ID NO: 341501 - RNA, 19 nt, Homo sapiens
auccugacauuguaugcua

SEQ ID NO: 341502 - RNA, 19 nt, Homo sapiens
uacagaacuccucaagaaa

SEQ ID NO: 341503 - RNA, 19 nt, Homo sapiens
gaaagcagcucccuaacuu

SEQ ID NO: 341504 - RNA, 19 nt, Homo sapiens
gcacacagauguuuccaaa

SEQ ID NO: 341505 - RNA, 19 nt, Homo sapiens
gaauaguugugucauguua

SEQ ID NO: 341506 - RNA, 19 nt, Homo sapiens
gaucugagcaggagaaaua

SEQ ID NO: 341507 - RNA, 19 nt, Homo sapiens
agaauaagcugaacaguug

SEQ ID NO: 341508 - RNA, 19 nt, Homo sapiens
ucucauagguugucuuaua

SEQ ID NO: 341509 - RNA, 19 nt, Homo sapiens
gaaacaacaugauggacaa

SEQ ID NO: 341510 - RNA, 19 nt, Homo sapiens
caaagaggauuguucaguu

SEQ ID NO: 341511 - RNA, 19 nt, Homo sapiens
ccaauacggucauuagauu

SEQ ID NO: 341512 - RNA, 19 nt, Homo sapiens
gcaaugauauccacuugug

SEQ ID NO: 341513 - RNA, 19 nt, Homo sapiens
gaacaagacauacuucaau

SEQ ID NO: 341514 - RNA, 19 nt, Homo sapiens
acaccaagguacaauguua

SEQ ID NO: 341515 - RNA, 19 nt, Homo sapiens
gaagaaacauacuguccau

SEQ ID NO: 341516 - RNA, 19 nt, Homo sapiens
ccacaggaaugaagagaga

SEQ ID NO: 341517 - RNA, 19 nt, Homo sapiens
ggaauaagaauaagcugaa

SEQ ID NO: 341518 - RNA, 19 nt, Homo sapiens
caaaaggcauuuccgcuua

SEQ ID NO: 341519 - RNA, 19 nt, Homo sapiens
auacagcagugccuauaua

SEQ ID NO: 341520 - RNA, 19 nt, Homo sapiens
gaccagacaucuuugaagu

SEQ ID NO: 341521 - RNA, 19 nt, Homo sapiens
gcagcucccuaacuucaaa

SEQ ID NO: 341522 - RNA, 19 nt, Homo sapiens
ggguggagaccaaauaaua

SEQ ID NO: 341523 - RNA, 19 nt, Homo sapiens
uaccuuagcucuugcuuau

SEQ ID NO: 341524 - RNA, 19 nt, Homo sapiens
uuaauuugcucccaacuga

SEQ ID NO: 341525 - RNA, 19 nt, Homo sapiens
gcauuuccgcuuacaauuu

SEQ ID NO: 341526 - RNA, 19 nt, Homo sapiens
aagauagucugaagucauu

SEQ ID NO: 341527 - RNA, 19 nt, Homo sapiens
cuucucagcugcaaauauu

SEQ ID NO: 341528 - RNA, 19 nt, Homo sapiens
gaaagauagucugaaguca

SEQ ID NO: 341529 - RNA, 19 nt, Homo sapiens
agaaguaccugccauccaa

SEQ ID NO: 341530 - RNA, 19 nt, Homo sapiens
ggaugaugauuaugaaaca

SEQ ID NO: 341531 - RNA, 19 nt, Homo sapiens
gauugggucaucuugauua

SEQ ID NO: 341532 - RNA, 19 nt, Homo sapiens
caacauacuuugauuaccu

SEQ ID NO: 341533 - RNA, 19 nt, Homo sapiens
ggaauauucacuuuaccua

SEQ ID NO: 341534 - RNA, 19 nt, Homo sapiens
cugcaaauauuauggagaa

SEQ ID NO: 341535 - RNA, 19 nt, Homo sapiens
uaagggaggauuuaauuug

SEQ ID NO: 341536 - RNA, 19 nt, Homo sapiens
cacccuuccuucuuuaaua

SEQ ID NO: 341537 - RNA, 19 nt, Homo sapiens
gaggcgauguguaaguuga

SEQ ID NO: 341538 - RNA, 19 nt, Homo sapiens
caagcuuucuggcauaaau

SEQ ID NO: 341539 - RNA, 19 nt, Homo sapiens
agagaaagcagcucccuaa

SEQ ID NO: 341540 - RNA, 19 nt, Homo sapiens
caacugauugucacuuaaa

SEQ ID NO: 341541 - RNA, 19 nt, Homo sapiens
aagcacaaccugcaacaua

SEQ ID NO: 341542 - RNA, 19 nt, Homo sapiens
gguacaauguuaaaggaau

SEQ ID NO: 341543 - RNA, 19 nt, Homo sapiens
caaccacaaucuguuauuc

SEQ ID NO: 341544 - RNA, 19 nt, Homo sapiens
gucaagagauuuuccauuu

SEQ ID NO: 341545 - RNA, 19 nt, Homo sapiens
cagcaaugauauccacuug

SEQ ID NO: 341546 - RNA, 19 nt, Homo sapiens
aaccuggccuugaucauaa

SEQ ID NO: 341547 - RNA, 19 nt, Homo sapiens
gaaguaacaccaagguaca

SEQ ID NO: 341548 - RNA, 19 nt, Homo sapiens
cauuuccgcuuacaauuug

SEQ ID NO: 341549 - RNA, 19 nt, Homo sapiens
ccaacugauugucacuuaa

SEQ ID NO: 341550 - RNA, 19 nt, Homo sapiens
cccaacugauugucacuua

SEQ ID NO: 341551 - RNA, 19 nt, Homo sapiens
aaagacaaauuccaaagag

SEQ ID NO: 341552 - RNA, 19 nt, Homo sapiens
uagauuagauugucaacag

SEQ ID NO: 341553 - RNA, 19 nt, Homo sapiens
gacaagaugagagacaaua

SEQ ID NO: 341554 - RNA, 19 nt, Homo sapiens
ggagaaacaacaugaugga

SEQ ID NO: 341555 - RNA, 19 nt, Homo sapiens
uaaugugccuaauuucaug

SEQ ID NO: 341556 - RNA, 19 nt, Homo sapiens
aaacugcagauacuucaua

SEQ ID NO: 341557 - RNA, 19 nt, Homo sapiens
ggccauccuuacuuuauga

SEQ ID NO: 341558 - RNA, 19 nt, Homo sapiens
caagcccagucgcauuuaa

SEQ ID NO: 341559 - RNA, 19 nt, Homo sapiens
uguguaaguugaauccuuu

SEQ ID NO: 341560 - RNA, 19 nt, Homo sapiens
gccaugauauuuaccuuag

SEQ ID NO: 341561 - RNA, 19 nt, Homo sapiens
ccuauauagugacugauuu

SEQ ID NO: 341562 - RNA, 19 nt, Homo sapiens
caagagcauuuuagaguaa

SEQ ID NO: 341563 - RNA, 19 nt, Homo sapiens
ggucucgggaugaugauua

SEQ ID NO: 341564 - RNA, 19 nt, Homo sapiens
gauauccacuugugucaac

SEQ ID NO: 341565 - RNA, 19 nt, Homo sapiens
aaggagaugagaaauguua

SEQ ID NO: 341566 - RNA, 19 nt, Homo sapiens
aaagaggauuguucaguuc

SEQ ID NO: 341567 - RNA, 19 nt, Homo sapiens
aaaccuggccuugaucaua

SEQ ID NO: 341568 - RNA, 19 nt, Homo sapiens
uuauggagcugugaucauu

SEQ ID NO: 341569 - RNA, 19 nt, Homo sapiens
uuaauaagcaggagcgaaa

SEQ ID NO: 341570 - RNA, 19 nt, Homo sapiens
gaacaguugaccugcuuug

SEQ ID NO: 341571 - RNA, 19 nt, Homo sapiens
gcugcaaauagcuaaauua

SEQ ID NO: 341572 - RNA, 19 nt, Homo sapiens
cagaagugguuugagguuu

SEQ ID NO: 341573 - RNA, 19 nt, Homo sapiens
gaugagagacaauaaguac

SEQ ID NO: 341574 - RNA, 19 nt, Homo sapiens
ccaccucacagcaaugaua

SEQ ID NO: 341575 - RNA, 19 nt, Homo sapiens
cgugugcuuugaucaauuu

SEQ ID NO: 341576 - RNA, 19 nt, Homo sapiens
gcaauguguuucaaucacu

SEQ ID NO: 341577 - RNA, 19 nt, Homo sapiens
gaggguggagaccaaauaa

SEQ ID NO: 341578 - RNA, 19 nt, Homo sapiens
caucugcccuuggccauga

SEQ ID NO: 341579 - RNA, 19 nt, Homo sapiens
ugucaagcuuucuggcaua

SEQ ID NO: 341580 - RNA, 19 nt, Homo sapiens
caauagccauguccacgau

SEQ ID NO: 341581 - RNA, 19 nt, Homo sapiens
gcaaccacaaucuguuauu

SEQ ID NO: 341582 - RNA, 19 nt, Homo sapiens
gugccuauauagugacuga

SEQ ID NO: 341583 - RNA, 19 nt, Homo sapiens
cagcagugccuauauagug

SEQ ID NO: 341584 - RNA, 19 nt, Homo sapiens
cgaaagauagucugaaguc

SEQ ID NO: 341585 - RNA, 19 nt, Homo sapiens
ucuuggugcugcaguauuu

SEQ ID NO: 341586 - RNA, 19 nt, Homo sapiens
gaccugcuuugaagaaaca

SEQ ID NO: 341587 - RNA, 19 nt, Homo sapiens
gugaggcgauguguaaguu

SEQ ID NO: 341588 - RNA, 19 nt, Homo sapiens
gccgaaagauagucugaag

SEQ ID NO: 341589 - RNA, 19 nt, Homo sapiens
aaguacagguccagugaaa

SEQ ID NO: 341590 - RNA, 19 nt, Homo sapiens
ccaacauccugauugugaa

SEQ ID NO: 341591 - RNA, 19 nt, Homo sapiens
ugacuuguggcgucuuaua

SEQ ID NO: 341592 - RNA, 19 nt, Homo sapiens
cauccuuacuuuaugauag

SEQ ID NO: 341593 - RNA, 19 nt, Homo sapiens
gggccauccuuacuuuaug

SEQ ID NO: 341594 - RNA, 19 nt, Homo sapiens
agacaucuuugaagugcuu

SEQ ID NO: 341595 - RNA, 19 nt, Homo sapiens
aagaauaagcugaacaguu

SEQ ID NO: 341596 - RNA, 19 nt, Homo sapiens
agacaaauacgugugcuuu

SEQ ID NO: 341597 - RNA, 19 nt, Homo sapiens
uuccugaucuaccaaguaa

SEQ ID NO: 341598 - RNA, 19 nt, Homo sapiens
aacaagacauacuucaaug

SEQ ID NO: 341599 - RNA, 19 nt, Homo sapiens
uguauaaacugugugacuu

SEQ ID NO: 341600 - RNA, 19 nt, Homo sapiens
gcaagcccagucgcauuua

SEQ ID NO: 341601 - RNA, 19 nt, Homo sapiens
ggaaucaucagaucauugc

SEQ ID NO: 341602 - RNA, 19 nt, Homo sapiens
uuaccaacauccugauugu

SEQ ID NO: 341603 - RNA, 19 nt, Homo sapiens
gaacauagaugcuacagua

SEQ ID NO: 341604 - RNA, 19 nt, Homo sapiens
gcacugcacuucuggaaua

SEQ ID NO: 341605 - RNA, 19 nt, Homo sapiens
gaacauguaugauuucugu

SEQ ID NO: 341606 - RNA, 19 nt, Homo sapiens
guacaaguauccacaauca

SEQ ID NO: 341607 - RNA, 19 nt, Homo sapiens
aaaugaagguggaacaaua

SEQ ID NO: 341608 - RNA, 19 nt, Homo sapiens
ggagauaaacugaaauuug

SEQ ID NO: 341609 - RNA, 19 nt, Homo sapiens
gagauaaacugaaauuugc

SEQ ID NO: 341610 - RNA, 19 nt, Homo sapiens
gguaguagguugcauuaug

SEQ ID NO: 341611 - RNA, 19 nt, Homo sapiens
acaaucaccuugacaguaa

SEQ ID NO: 341612 - RNA, 19 nt, Homo sapiens
aaacaccacugaacagaaa

SEQ ID NO: 341613 - RNA, 19 nt, Homo sapiens
gggcagagccugugugaaa

SEQ ID NO: 341614 - RNA, 19 nt, Homo sapiens
uaaggaagcugugguguga

SEQ ID NO: 341615 - RNA, 19 nt, Homo sapiens
cauagaugcuacaguauuu

SEQ ID NO: 341616 - RNA, 19 nt, Homo sapiens
guaguagguugcauuauga

SEQ ID NO: 341617 - RNA, 19 nt, Homo sapiens
ggaaacgauugccaacuau

SEQ ID NO: 341618 - RNA, 19 nt, Homo sapiens
gaacaauacgggccacaaa

SEQ ID NO: 341619 - RNA, 19 nt, Homo sapiens
aaacucaucuucacagugu

SEQ ID NO: 341620 - RNA, 19 nt, Homo sapiens
gcagucacuuugcuuaaga

SEQ ID NO: 341621 - RNA, 19 nt, Homo sapiens
guuguaacauuucacagua

SEQ ID NO: 341622 - RNA, 19 nt, Homo sapiens
gaaccggacuugccuuugg

SEQ ID NO: 341623 - RNA, 19 nt, Homo sapiens
gagagacccuggacacugu

SEQ ID NO: 341624 - RNA, 19 nt, Homo sapiens
gagcuuuacuuuguggaua

SEQ ID NO: 341625 - RNA, 19 nt, Homo sapiens
uguauaugcuacuguguua

SEQ ID NO: 341626 - RNA, 19 nt, Homo sapiens
gaacagcaacuacagaaag

SEQ ID NO: 341627 - RNA, 19 nt, Homo sapiens
uagauuagguguaagacuu

SEQ ID NO: 341628 - RNA, 19 nt, Homo sapiens
caaguuacauccgcuuuau

SEQ ID NO: 341629 - RNA, 19 nt, Homo sapiens
aagaagaaguggaucuaaa

SEQ ID NO: 341630 - RNA, 19 nt, Homo sapiens
ucacagaggcuaccaaugu

SEQ ID NO: 341631 - RNA, 19 nt, Homo sapiens
gcucucauguauuuaaaga

SEQ ID NO: 341632 - RNA, 19 nt, Homo sapiens
gaaacgauugccaacuaua

SEQ ID NO: 341633 - RNA, 19 nt, Homo sapiens
caaaugaccacuaccauca

SEQ ID NO: 341634 - RNA, 19 nt, Homo sapiens
gaaaauggguccaauaggu

SEQ ID NO: 341635 - RNA, 19 nt, Homo sapiens
ugucuaccguucacucuua

SEQ ID NO: 341636 - RNA, 19 nt, Homo sapiens
ggcuuuauguugcaauuaa

SEQ ID NO: 341637 - RNA, 19 nt, Homo sapiens
cuggagagcuuuacuuugu

SEQ ID NO: 341638 - RNA, 19 nt, Homo sapiens
cuaaguuugucuacacuaa

SEQ ID NO: 341639 - RNA, 19 nt, Homo sapiens
aggaaacgauugccaacua

SEQ ID NO: 341640 - RNA, 19 nt, Homo sapiens
ucaaagauaaggcaacaaa

SEQ ID NO: 341641 - RNA, 19 nt, Homo sapiens
ggaguaaauugaagaacca

SEQ ID NO: 341642 - RNA, 19 nt, Homo sapiens
uaaauuccuuccaugauag

SEQ ID NO: 341643 - RNA, 19 nt, Homo sapiens
gaggagauaaacugaaauu

SEQ ID NO: 341644 - RNA, 19 nt, Homo sapiens
uagguugcauuaugaguaa

SEQ ID NO: 341645 - RNA, 19 nt, Homo sapiens
gaagaaguggaucuaaaug

SEQ ID NO: 341646 - RNA, 19 nt, Homo sapiens
gauaguaccaagcugauug

SEQ ID NO: 341647 - RNA, 19 nt, Homo sapiens
gcuacuguguuacauguug

SEQ ID NO: 341648 - RNA, 19 nt, Homo sapiens
gauuagguguaagacuuua

SEQ ID NO: 341649 - RNA, 19 nt, Homo sapiens
gaacuggagagcuuuacuu

SEQ ID NO: 341650 - RNA, 19 nt, Homo sapiens
ucgaggagauaaacugaaa

SEQ ID NO: 341651 - RNA, 19 nt, Homo sapiens
ucacaguguuccacauuau

SEQ ID NO: 341652 - RNA, 19 nt, Homo sapiens
agccagagcuuauagauag

SEQ ID NO: 341653 - RNA, 19 nt, Homo sapiens
ggacugcacacaucuuguu

SEQ ID NO: 341654 - RNA, 19 nt, Homo sapiens
agaaguggaucuaaaugga

SEQ ID NO: 341655 - RNA, 19 nt, Homo sapiens
acucuuaccuauaccuuaa

SEQ ID NO: 341656 - RNA, 19 nt, Homo sapiens
gagccagagcuuauagaua

SEQ ID NO: 341657 - RNA, 19 nt, Homo sapiens
gagcuaaguuugucuacac

SEQ ID NO: 341658 - RNA, 19 nt, Homo sapiens
gaaguggaucuaaauggaa

SEQ ID NO: 341659 - RNA, 19 nt, Homo sapiens
ggcacugucuauagucuuu

SEQ ID NO: 341660 - RNA, 19 nt, Homo sapiens
gaaaugaagguggaacaau

SEQ ID NO: 341661 - RNA, 19 nt, Homo sapiens
agucauacgucuuuagaug

SEQ ID NO: 341662 - RNA, 19 nt, Homo sapiens
ucacaguauuuacaagcua

SEQ ID NO: 341663 - RNA, 19 nt, Homo sapiens
gagagacggugggaaaaua

SEQ ID NO: 341664 - RNA, 19 nt, Homo sapiens
guagguugcauuaugagua

SEQ ID NO: 341665 - RNA, 19 nt, Homo sapiens
gcaacaaaaugguuuacuu

SEQ ID NO: 341666 - RNA, 19 nt, Homo sapiens
gcacguuuggugaaaguuu

SEQ ID NO: 341667 - RNA, 19 nt, Homo sapiens
gcugagagacggugggaaa

SEQ ID NO: 341668 - RNA, 19 nt, Homo sapiens
gugcagaggcugaugagaa

SEQ ID NO: 341669 - RNA, 19 nt, Homo sapiens
caggucggcuggcuaauca

SEQ ID NO: 341670 - RNA, 19 nt, Homo sapiens
gggaacuccucaacacuca

SEQ ID NO: 341671 - RNA, 19 nt, Homo sapiens
uaaagaagaaguggaucua

SEQ ID NO: 341672 - RNA, 19 nt, Homo sapiens
gggccuggcaguacaagua

SEQ ID NO: 341673 - RNA, 19 nt, Homo sapiens
aaguggaccuguacugaaa

SEQ ID NO: 341674 - RNA, 19 nt, Homo sapiens
ggucaguuguagacucuug

SEQ ID NO: 341675 - RNA, 19 nt, Homo sapiens
gaaccagacaguggaagaa

SEQ ID NO: 341676 - RNA, 19 nt, Homo sapiens
gacccauucauacuaaaua

SEQ ID NO: 341677 - RNA, 19 nt, Homo sapiens
ucuauagucuuucuuccuu

SEQ ID NO: 341678 - RNA, 19 nt, Homo sapiens
gaggcuuuauguugcaauu

SEQ ID NO: 341679 - RNA, 19 nt, Homo sapiens
ucaaguuacauccgcuuua

SEQ ID NO: 341680 - RNA, 19 nt, Homo sapiens
guaaauugaagaaccaugu

SEQ ID NO: 341681 - RNA, 19 nt, Homo sapiens
ccaaugacucuuucacaga

SEQ ID NO: 341682 - RNA, 19 nt, Homo sapiens
gggaguauucgcugauuga

SEQ ID NO: 341683 - RNA, 19 nt, Homo sapiens
caaguggaccuguacugaa

SEQ ID NO: 341684 - RNA, 19 nt, Homo sapiens
gguguaagacuuuaagaag

SEQ ID NO: 341685 - RNA, 19 nt, Homo sapiens
gcagagagaaguacuuuug

SEQ ID NO: 341686 - RNA, 19 nt, Homo sapiens
aguauucgcugauugagau

SEQ ID NO: 341687 - RNA, 19 nt, Homo sapiens
ccuauuaaauuccuuccau

SEQ ID NO: 341688 - RNA, 19 nt, Homo sapiens
uuuaugaacuggagagcuu

SEQ ID NO: 341689 - RNA, 19 nt, Homo sapiens
aggaagcuguggugugaaa

SEQ ID NO: 341690 - RNA, 19 nt, Homo sapiens
guagaggcuuuauguugca

SEQ ID NO: 341691 - RNA, 19 nt, Homo sapiens
uggaugccauucacucuga

SEQ ID NO: 341692 - RNA, 19 nt, Homo sapiens
ccaaaaugcuggugugugu

SEQ ID NO: 341693 - RNA, 19 nt, Homo sapiens
aauaguacccaaccaaaga

SEQ ID NO: 341694 - RNA, 19 nt, Homo sapiens
uaaaauggaccuaucugua

SEQ ID NO: 341695 - RNA, 19 nt, Homo sapiens
guacaaacucaucuucaca

SEQ ID NO: 341696 - RNA, 19 nt, Homo sapiens
gauuguggccuguacugaa

SEQ ID NO: 341697 - RNA, 19 nt, Homo sapiens
agaaaacugugguuaaaga

SEQ ID NO: 341698 - RNA, 19 nt, Homo sapiens
ucacuuugcuuaagaugcu

SEQ ID NO: 341699 - RNA, 19 nt, Homo sapiens
ccaaguggaccuguacuga

SEQ ID NO: 341700 - RNA, 19 nt, Homo sapiens
gcuuuacuuuguggauaua

SEQ ID NO: 341701 - RNA, 19 nt, Homo sapiens
ucaauaguacccaaccaaa

SEQ ID NO: 341702 - RNA, 19 nt, Homo sapiens
gcaguguuauuuucuuuga

SEQ ID NO: 341703 - RNA, 19 nt, Homo sapiens
gaagacagcauguguguua

SEQ ID NO: 341704 - RNA, 19 nt, Homo sapiens
aaagucaugugccauauua

SEQ ID NO: 341705 - RNA, 19 nt, Homo sapiens
acaagugucugcagaagua

SEQ ID NO: 341706 - RNA, 19 nt, Homo sapiens
guucaugaauugagaguaa

SEQ ID NO: 341707 - RNA, 19 nt, Homo sapiens
caacugaccugccacaaag

SEQ ID NO: 341708 - RNA, 19 nt, Homo sapiens
aaagagaucucgaaguguu

SEQ ID NO: 341709 - RNA, 19 nt, Homo sapiens
caacuuaacucuucaucca

SEQ ID NO: 341710 - RNA, 19 nt, Homo sapiens
gagaaccacuccagaauac

SEQ ID NO: 341711 - RNA, 19 nt, Homo sapiens
cuuauacacugucuucaua

SEQ ID NO: 341712 - RNA, 19 nt, Homo sapiens
uuuaauggcucucaugaaa

SEQ ID NO: 341713 - RNA, 19 nt, Homo sapiens
ugauugggcucuauacauu

SEQ ID NO: 341714 - RNA, 19 nt, Homo sapiens
agaagaagauauagcaaga

SEQ ID NO: 341715 - RNA, 19 nt, Homo sapiens
guauuuauguguugaguca

SEQ ID NO: 341716 - RNA, 19 nt, Homo sapiens
ccacaaaguuagaagaaag

SEQ ID NO: 341717 - RNA, 19 nt, Homo sapiens
ccacuugcuuugagauaaa

SEQ ID NO: 341718 - RNA, 19 nt, Homo sapiens
gcaaagucaugugccauau

SEQ ID NO: 341719 - RNA, 19 nt, Homo sapiens
gcaagaagacagcaugugu

SEQ ID NO: 341720 - RNA, 19 nt, Homo sapiens
caagagaaccacuccagaa

SEQ ID NO: 341721 - RNA, 19 nt, Homo sapiens
agaauugccuuuacuaucu

SEQ ID NO: 341722 - RNA, 19 nt, Homo sapiens
gaacuucaagaaacauuug

SEQ ID NO: 341723 - RNA, 19 nt, Homo sapiens
gaaccacuccagaauacuu

SEQ ID NO: 341724 - RNA, 19 nt, Homo sapiens
cagcagguauuuauguguu

SEQ ID NO: 341725 - RNA, 19 nt, Homo sapiens
aaccauggcuacuuucuga

SEQ ID NO: 341726 - RNA, 19 nt, Homo sapiens
cgacgaguauuauaacaag

SEQ ID NO: 341727 - RNA, 19 nt, Homo sapiens
gaagauauagcaagaagac

SEQ ID NO: 341728 - RNA, 19 nt, Homo sapiens
gaaaacagacuugaagaaa

SEQ ID NO: 341729 - RNA, 19 nt, Homo sapiens
guauugcauuugucauuug

SEQ ID NO: 341730 - RNA, 19 nt, Homo sapiens
gagcagcagguauuuaugu

SEQ ID NO: 341731 - RNA, 19 nt, Homo sapiens
gcagguauuuauguguuga

SEQ ID NO: 341732 - RNA, 19 nt, Homo sapiens
gccauugucagguaucaua

SEQ ID NO: 341733 - RNA, 19 nt, Homo sapiens
acacugucuucauauguaa

SEQ ID NO: 341734 - RNA, 19 nt, Homo sapiens
gauuuagugucccuuauac

SEQ ID NO: 341735 - RNA, 19 nt, Homo sapiens
agacugaccauacugauau

SEQ ID NO: 341736 - RNA, 19 nt, Homo sapiens
gaagaaaauucagauguuc

SEQ ID NO: 341737 - RNA, 19 nt, Homo sapiens
uguguuaccugcuccagaa

SEQ ID NO: 341738 - RNA, 19 nt, Homo sapiens
gauguccuguugucuuaau

SEQ ID NO: 341739 - RNA, 19 nt, Homo sapiens
agagaaccacuccagaaua

SEQ ID NO: 341740 - RNA, 19 nt, Homo sapiens
gaagaagauauagcaagaa

SEQ ID NO: 341741 - RNA, 19 nt, Homo sapiens
uaucuugguugugcuguuu

SEQ ID NO: 341742 - RNA, 19 nt, Homo sapiens
augauguccuguugucuua

SEQ ID NO: 341743 - RNA, 19 nt, Homo sapiens
aguauaagcuguggauugu

SEQ ID NO: 341744 - RNA, 19 nt, Homo sapiens
ucaagaaacauuugguuca

SEQ ID NO: 341745 - RNA, 19 nt, Homo sapiens
ggaacuucaagaaacauuu

SEQ ID NO: 341746 - RNA, 19 nt, Homo sapiens
ccacucggaauucugauuu

SEQ ID NO: 341747 - RNA, 19 nt, Homo sapiens
aaacuuuggcucuguaaga

SEQ ID NO: 341748 - RNA, 19 nt, Homo sapiens
uauauucugcccuuaguuu

SEQ ID NO: 341749 - RNA, 19 nt, Homo sapiens
caagaaacauuugguucag

SEQ ID NO: 341750 - RNA, 19 nt, Homo sapiens
gccacaaaguuagaagaaa

SEQ ID NO: 341751 - RNA, 19 nt, Homo sapiens
gagugggccucaggugaaa

SEQ ID NO: 341752 - RNA, 19 nt, Homo sapiens
guaagucuucuuggcuuua

SEQ ID NO: 341753 - RNA, 19 nt, Homo sapiens
aagaagauauagcaagaag

SEQ ID NO: 341754 - RNA, 19 nt, Homo sapiens
ggcuaucgguaacaacuga

SEQ ID NO: 341755 - RNA, 19 nt, Homo sapiens
ugauuuagugucccuuaua

SEQ ID NO: 341756 - RNA, 19 nt, Homo sapiens
uagaagaaaggauugauuc

SEQ ID NO: 341757 - RNA, 19 nt, Homo sapiens
ccauggcuacuuucugaua

SEQ ID NO: 341758 - RNA, 19 nt, Homo sapiens
agcaaaccauggcuacuuu

SEQ ID NO: 341759 - RNA, 19 nt, Homo sapiens
caaagucaugugccauauu

SEQ ID NO: 341760 - RNA, 19 nt, Homo sapiens
cagacugaccauacugaua

SEQ ID NO: 341761 - RNA, 19 nt, Homo sapiens
ccagaauacuuccagaaaa

SEQ ID NO: 341762 - RNA, 19 nt, Homo sapiens
acgguaaacuuccucauag

SEQ ID NO: 341763 - RNA, 19 nt, Homo sapiens
uauacacugucuucauaug

SEQ ID NO: 341764 - RNA, 19 nt, Homo sapiens
ccuguugucuuaauccaau

SEQ ID NO: 341765 - RNA, 19 nt, Homo sapiens
guuaccugcuccagaaaga

SEQ ID NO: 341766 - RNA, 19 nt, Homo sapiens
ggaguuauucauucaucaa

SEQ ID NO: 341767 - RNA, 19 nt, Homo sapiens
gaugaucaacuuaacucuu

SEQ ID NO: 341768 - RNA, 19 nt, Homo sapiens
gaauugccuuuacuaucuc

SEQ ID NO: 341769 - RNA, 19 nt, Homo sapiens
aaucuggccuuuucugaua

SEQ ID NO: 341770 - RNA, 19 nt, Homo sapiens
aaucagaagacuacgguaa

SEQ ID NO: 341771 - RNA, 19 nt, Homo sapiens
ggcaugauguccuguuguc

SEQ ID NO: 341772 - RNA, 19 nt, Homo sapiens
guugguguauugcauuugu

SEQ ID NO: 341773 - RNA, 19 nt, Homo sapiens
ugaccauacugauauuagu

SEQ ID NO: 341774 - RNA, 19 nt, Homo sapiens
gagaugaucaacuuaacuc

SEQ ID NO: 341775 - RNA, 19 nt, Homo sapiens
gcccuuaguuugucuuacu

SEQ ID NO: 341776 - RNA, 19 nt, Homo sapiens
ugccuuuacuaucucuuua

SEQ ID NO: 341777 - RNA, 19 nt, Homo sapiens
gcugauuuagugucccuua

SEQ ID NO: 341778 - RNA, 19 nt, Homo sapiens
caaguugguguauugcauu

SEQ ID NO: 341779 - RNA, 19 nt, Homo sapiens
ucaaguugguguauugcau

SEQ ID NO: 341780 - RNA, 19 nt, Homo sapiens
cuuuauugcuaguucagua

SEQ ID NO: 341781 - RNA, 19 nt, Homo sapiens
uaagucuucuuggcuuuau

SEQ ID NO: 341782 - RNA, 19 nt, Homo sapiens
cagaauugccuuuacuauc

SEQ ID NO: 341783 - RNA, 19 nt, Homo sapiens
uacgguaaacuuccucaua

SEQ ID NO: 341784 - RNA, 19 nt, Homo sapiens
gacugaccauacugauauu

SEQ ID NO: 341785 - RNA, 19 nt, Homo sapiens
augaucaacuuaacucuuc

SEQ ID NO: 341786 - RNA, 19 nt, Homo sapiens
gauugggcucuauacauuu

SEQ ID NO: 341787 - RNA, 19 nt, Homo sapiens
aacauuugguucagcauug

SEQ ID NO: 341788 - RNA, 19 nt, Homo sapiens
uugcauuugucauuuguug

SEQ ID NO: 341789 - RNA, 19 nt, Homo sapiens
acaacugaccugccacaaa

SEQ ID NO: 341790 - RNA, 19 nt, Homo sapiens
gaauugagaguaaaacguu

SEQ ID NO: 341791 - RNA, 19 nt, Homo sapiens
acacuugccacagagaaua

SEQ ID NO: 341792 - RNA, 19 nt, Homo sapiens
ucauacagaauugccuuua

SEQ ID NO: 341793 - RNA, 19 nt, Homo sapiens
cagcaaaccauggcuacuu

SEQ ID NO: 341794 - RNA, 19 nt, Homo sapiens
ccaauucuauauggguuuc

SEQ ID NO: 341795 - RNA, 19 nt, Homo sapiens
uguaagucuucuuggcuuu

SEQ ID NO: 341796 - RNA, 19 nt, Homo sapiens
cauacagaauugccuuuac

SEQ ID NO: 341797 - RNA, 19 nt, Homo sapiens
ucaguauauucugcccuua

SEQ ID NO: 341798 - RNA, 19 nt, Homo sapiens
auacagaauugccuuuacu

SEQ ID NO: 341799 - RNA, 19 nt, Homo sapiens
gacgaguauuauaacaaga

SEQ ID NO: 341800 - RNA, 19 nt, Homo sapiens
agaguaaaacguucuguua

SEQ ID NO: 341801 - RNA, 19 nt, Homo sapiens
cccacuugcuuugagauaa

SEQ ID NO: 341802 - RNA, 19 nt, Homo sapiens
aaacauuugguucagcauu

SEQ ID NO: 341803 - RNA, 19 nt, Homo sapiens
ggacagagcuccaccauga

SEQ ID NO: 341804 - RNA, 19 nt, Homo sapiens
guacagagcuuuccugaug

SEQ ID NO: 341805 - RNA, 19 nt, Homo sapiens
uagaauagcuucauccaua

SEQ ID NO: 341806 - RNA, 19 nt, Homo sapiens
ggacuaggcuggcggauug

SEQ ID NO: 341807 - RNA, 19 nt, Homo sapiens
guugaagucuguacaaaua

SEQ ID NO: 341808 - RNA, 19 nt, Homo sapiens
gaacugggcuaccucucua

SEQ ID NO: 341809 - RNA, 19 nt, Homo sapiens
gaacucagccacucaggua

SEQ ID NO: 341810 - RNA, 19 nt, Homo sapiens
ggauaugcaugauucuuaa

SEQ ID NO: 341811 - RNA, 19 nt, Homo sapiens
uaacagggaugaaugacuu

SEQ ID NO: 341812 - RNA, 19 nt, Homo sapiens
gagcacaugugguuguaaa

SEQ ID NO: 341813 - RNA, 19 nt, Homo sapiens
gaacagaagaugucagaug

SEQ ID NO: 341814 - RNA, 19 nt, Homo sapiens
gagcuuuccugaugauauu

SEQ ID NO: 341815 - RNA, 19 nt, Homo sapiens
gacauuugcugcuaucauu

SEQ ID NO: 341816 - RNA, 19 nt, Homo sapiens
gaaaacuccuuccaauuaa

SEQ ID NO: 341817 - RNA, 19 nt, Homo sapiens
agaaacagaugguaguauu

SEQ ID NO: 341818 - RNA, 19 nt, Homo sapiens
caucagagccaguguguuu

SEQ ID NO: 341819 - RNA, 19 nt, Homo sapiens
guaccugcauucugccuua

SEQ ID NO: 341820 - RNA, 19 nt, Homo sapiens
ccacuuacuuuaaugagaa

SEQ ID NO: 341821 - RNA, 19 nt, Homo sapiens
guacuucgccacuuacuuu

SEQ ID NO: 341822 - RNA, 19 nt, Homo sapiens
gguaaaagcugcuaguauu

SEQ ID NO: 341823 - RNA, 19 nt, Homo sapiens
cauuugaucuucacagaaa

SEQ ID NO: 341824 - RNA, 19 nt, Homo sapiens
gcuagguggugcuuacuaa

SEQ ID NO: 341825 - RNA, 19 nt, Homo sapiens
gaugauaugguaacaugua

SEQ ID NO: 341826 - RNA, 19 nt, Homo sapiens
ggacuuaaccguugcaaag

SEQ ID NO: 341827 - RNA, 19 nt, Homo sapiens
ggaggagagccaucuauuu

SEQ ID NO: 341828 - RNA, 19 nt, Homo sapiens
cagcauauccagugaguuu

SEQ ID NO: 341829 - RNA, 19 nt, Homo sapiens
ccucauacguuauugcauu

SEQ ID NO: 341830 - RNA, 19 nt, Homo sapiens
cuaauuaccuucucaggau

SEQ ID NO: 341831 - RNA, 19 nt, Homo sapiens
cuaaaggccugcugacaga

SEQ ID NO: 341832 - RNA, 19 nt, Homo sapiens
ugaaugacuuucugaaugu

SEQ ID NO: 341833 - RNA, 19 nt, Homo sapiens
caucaucaaugucuuuguu

SEQ ID NO: 341834 - RNA, 19 nt, Homo sapiens
ucacuuugauggagauaaa

SEQ ID NO: 341835 - RNA, 19 nt, Homo sapiens
gaaacagaugguaguauuu

SEQ ID NO: 341836 - RNA, 19 nt, Homo sapiens
ggauuagggugggaucuuu

SEQ ID NO: 341837 - RNA, 19 nt, Homo sapiens
gcucagacaugcaagaagu

SEQ ID NO: 341838 - RNA, 19 nt, Homo sapiens
gcauugcacucuuuguuuc

SEQ ID NO: 341839 - RNA, 19 nt, Homo sapiens
cagguaaaccggaacaaua

SEQ ID NO: 341840 - RNA, 19 nt, Homo sapiens
aaaauacccucauacguua

SEQ ID NO: 341841 - RNA, 19 nt, Homo sapiens
acaaggauaugcaugauuc

SEQ ID NO: 341842 - RNA, 19 nt, Homo sapiens
gaggaguacucuuguuuua

SEQ ID NO: 341843 - RNA, 19 nt, Homo sapiens
uaaaggcacucugugaaga

SEQ ID NO: 341844 - RNA, 19 nt, Homo sapiens
ugaaauaauugugcugcua

SEQ ID NO: 341845 - RNA, 19 nt, Homo sapiens
gcaggugguugaagucugu

SEQ ID NO: 341846 - RNA, 19 nt, Homo sapiens
gcaucuugcugaaguaugu

SEQ ID NO: 341847 - RNA, 19 nt, Homo sapiens
guguuuauguggaauguuu

SEQ ID NO: 341848 - RNA, 19 nt, Homo sapiens
aacagaagaugucagauga

SEQ ID NO: 341849 - RNA, 19 nt, Homo sapiens
ccagucagucucagauuua

SEQ ID NO: 341850 - RNA, 19 nt, Homo sapiens
ucaccuggcugcaguagga

SEQ ID NO: 341851 - RNA, 19 nt, Homo sapiens
ucuccaaacuggucauaaa

SEQ ID NO: 341852 - RNA, 19 nt, Homo sapiens
cuacagcuguuuccucaga

SEQ ID NO: 341853 - RNA, 19 nt, Homo sapiens
cucaggagcuguggacuua

SEQ ID NO: 341854 - RNA, 19 nt, Homo sapiens
aaauaacacuggauuaguc

SEQ ID NO: 341855 - RNA, 19 nt, Homo sapiens
cgugggagcugucaucaug

SEQ ID NO: 341856 - RNA, 19 nt, Homo sapiens
gcucagccauugcuaucaa

SEQ ID NO: 341857 - RNA, 19 nt, Homo sapiens
caucaacccugccuauagu

SEQ ID NO: 341858 - RNA, 19 nt, Homo sapiens
uguggaauguuuaaggaua

SEQ ID NO: 341859 - RNA, 19 nt, Homo sapiens
cugaugauauuuacucuug

SEQ ID NO: 341860 - RNA, 19 nt, Homo sapiens
caacuagaauagcuucauc

SEQ ID NO: 341861 - RNA, 19 nt, Homo sapiens
gagacaaggauaugcauga

SEQ ID NO: 341862 - RNA, 19 nt, Homo sapiens
agaaaacuccuuccaauua

SEQ ID NO: 341863 - RNA, 19 nt, Homo sapiens
aagaugauaugguaacaug

SEQ ID NO: 341864 - RNA, 19 nt, Homo sapiens
guaauauagcacagaguua

SEQ ID NO: 341865 - RNA, 19 nt, Homo sapiens
cagcagaaucgucauguuu

SEQ ID NO: 341866 - RNA, 19 nt, Homo sapiens
uaucaucuguuccaucaau

SEQ ID NO: 341867 - RNA, 19 nt, Homo sapiens
ccaaaagcauuauuacuga

SEQ ID NO: 341868 - RNA, 19 nt, Homo sapiens
ccaggaggguggugauaga

SEQ ID NO: 341869 - RNA, 19 nt, Homo sapiens
agguggugcuuacuaauua

SEQ ID NO: 341870 - RNA, 19 nt, Homo sapiens
gugcugggauguuacuuug

SEQ ID NO: 341871 - RNA, 19 nt, Homo sapiens
ggaaaaugguguugaagga

SEQ ID NO: 341872 - RNA, 19 nt, Homo sapiens
uagggcauguggcauuaua

SEQ ID NO: 341873 - RNA, 19 nt, Homo sapiens
gaggaggaguacucuuguu

SEQ ID NO: 341874 - RNA, 19 nt, Homo sapiens
aggaguacuucgccacuua

SEQ ID NO: 341875 - RNA, 19 nt, Homo sapiens
gauggauggucuuuuauaa

SEQ ID NO: 341876 - RNA, 19 nt, Homo sapiens
gaaguucgagaagccaaua

SEQ ID NO: 341877 - RNA, 19 nt, Homo sapiens
uauuauggcccucacauuu

SEQ ID NO: 341878 - RNA, 19 nt, Homo sapiens
gauuuaaguugcucuggau

SEQ ID NO: 341879 - RNA, 19 nt, Homo sapiens
gguguucgcuguucaucug

SEQ ID NO: 341880 - RNA, 19 nt, Homo sapiens
gaacaguaauggaaaaugg

SEQ ID NO: 341881 - RNA, 19 nt, Homo sapiens
agucaagucuagacaggua

SEQ ID NO: 341882 - RNA, 19 nt, Homo sapiens
ggaccagguuuucuuauga

SEQ ID NO: 341883 - RNA, 19 nt, Homo sapiens
uaggagugguuacaacuga

SEQ ID NO: 341884 - RNA, 19 nt, Homo sapiens
gucaguagguguuaguaug

SEQ ID NO: 341885 - RNA, 19 nt, Homo sapiens
gaggagagccaucuauuuu

SEQ ID NO: 341886 - RNA, 19 nt, Homo sapiens
gguaguauuuaugaacuga

SEQ ID NO: 341887 - RNA, 19 nt, Homo sapiens
caacugagcuuuuaguaac

SEQ ID NO: 341888 - RNA, 19 nt, Homo sapiens
uaacaucaacccugccuau

SEQ ID NO: 341889 - RNA, 19 nt, Homo sapiens
uugcggagcugguaagaau

SEQ ID NO: 341890 - RNA, 19 nt, Homo sapiens
agaauagcuucauccauau

SEQ ID NO: 341891 - RNA, 19 nt, Homo sapiens
auaccuaccuuuucaguua

SEQ ID NO: 341892 - RNA, 19 nt, Homo sapiens
ccaagggccagcucaguuu

SEQ ID NO: 341893 - RNA, 19 nt, Homo sapiens
gaaugacuuucugaauguu

SEQ ID NO: 341894 - RNA, 19 nt, Homo sapiens
gagaagccaauaaguacuu

SEQ ID NO: 341895 - RNA, 19 nt, Homo sapiens
gaacaauaagcaggaaguu

SEQ ID NO: 341896 - RNA, 19 nt, Homo sapiens
gagcaguggcuggauuuaa

SEQ ID NO: 341897 - RNA, 19 nt, Homo sapiens
gcuaucauuccaacacuaa

SEQ ID NO: 341898 - RNA, 19 nt, Homo sapiens
ccuagggcauguggcauua

SEQ ID NO: 341899 - RNA, 19 nt, Homo sapiens
gagcauugccuaccuggau

SEQ ID NO: 341900 - RNA, 19 nt, Homo sapiens
gcacagaguuaugaaugac

SEQ ID NO: 341901 - RNA, 19 nt, Homo sapiens
gaugauauuuacucuugag

SEQ ID NO: 341902 - RNA, 19 nt, Homo sapiens
ggauuucuugggagucuua

SEQ ID NO: 341903 - RNA, 19 nt, Homo sapiens
ggaagaaacugcaugaaua

SEQ ID NO: 341904 - RNA, 19 nt, Homo sapiens
caagaaagcucacaaauug

SEQ ID NO: 341905 - RNA, 19 nt, Homo sapiens
gcagugagguugaauauaa

SEQ ID NO: 341906 - RNA, 19 nt, Homo sapiens
caagaaggcuuauggcuua

SEQ ID NO: 341907 - RNA, 19 nt, Homo sapiens
gaaaggcacugcacauuau

SEQ ID NO: 341908 - RNA, 19 nt, Homo sapiens
gaaguuggauucugaaaga

SEQ ID NO: 341909 - RNA, 19 nt, Homo sapiens
ccaaugagcuggcaaguga

SEQ ID NO: 341910 - RNA, 19 nt, Homo sapiens
ucagugagguuaaguauaa

SEQ ID NO: 341911 - RNA, 19 nt, Homo sapiens
gggcacagcuucaaaguga

SEQ ID NO: 341912 - RNA, 19 nt, Homo sapiens
ccgcaaagcucagcauuua

SEQ ID NO: 341913 - RNA, 19 nt, Homo sapiens
cagaaucccugcacagaua

SEQ ID NO: 341914 - RNA, 19 nt, Homo sapiens
caagaaagcucacgaacuc

SEQ ID NO: 341915 - RNA, 19 nt, Homo sapiens
cgaaugagcgccucuauaa

SEQ ID NO: 341916 - RNA, 19 nt, Homo sapiens
gcaaugagcgcauguauag

SEQ ID NO: 341917 - RNA, 19 nt, Homo sapiens
gcaaccagauaacgaauga

SEQ ID NO: 341918 - RNA, 19 nt, Homo sapiens
gcuacaagcugacaauaga

SEQ ID NO: 341919 - RNA, 19 nt, Homo sapiens
ggaaaggauuugagaugaa

SEQ ID NO: 341920 - RNA, 19 nt, Homo sapiens
gaucacaccugcuuaucaa

SEQ ID NO: 341921 - RNA, 19 nt, Homo sapiens
caucggaacucaucaguga

SEQ ID NO: 341922 - RNA, 19 nt, Homo sapiens
agagugaugucaaguauaa

SEQ ID NO: 341923 - RNA, 19 nt, Homo sapiens
gcagagugaugucaaguau

SEQ ID NO: 341924 - RNA, 19 nt, Homo sapiens
gaugguggcuauaaacuga

SEQ ID NO: 341925 - RNA, 19 nt, Homo sapiens
gaaauucagcaaccagaua

SEQ ID NO: 341926 - RNA, 19 nt, Homo sapiens
cgaacucgcuagugacaua

SEQ ID NO: 341927 - RNA, 19 nt, Homo sapiens
ccagaugcuuugaaguuua

SEQ ID NO: 341928 - RNA, 19 nt, Homo sapiens
caaggaggauuaugagaga

SEQ ID NO: 341929 - RNA, 19 nt, Homo sapiens
gagguaccaucaacaauau

SEQ ID NO: 341930 - RNA, 19 nt, Homo sapiens
gagaagaucagcuguauag

SEQ ID NO: 341931 - RNA, 19 nt, Homo sapiens
gaagaaggcccugcuguug

SEQ ID NO: 341932 - RNA, 19 nt, Homo sapiens
uaaagcagcuggagaggau

SEQ ID NO: 341933 - RNA, 19 nt, Homo sapiens
gcgagaaacuguauaagag

SEQ ID NO: 341934 - RNA, 19 nt, Homo sapiens
gggaaaggauuugagauga

SEQ ID NO: 341935 - RNA, 19 nt, Homo sapiens
gaauuaccgugcugacuau

SEQ ID NO: 341936 - RNA, 19 nt, Homo sapiens
gcacagauacacccugauu

SEQ ID NO: 341937 - RNA, 19 nt, Homo sapiens
caucccagaucuuccuuua

SEQ ID NO: 341938 - RNA, 19 nt, Homo sapiens
ccaagaaagcucacaaauu

SEQ ID NO: 341939 - RNA, 19 nt, Homo sapiens
gcauuuagccacagacgua

SEQ ID NO: 341940 - RNA, 19 nt, Homo sapiens
agagugagcuggaguacaa

SEQ ID NO: 341941 - RNA, 19 nt, Homo sapiens
ugaaaggcacugcacauua

SEQ ID NO: 341942 - RNA, 19 nt, Homo sapiens
gcaagaugaugcugucugu

SEQ ID NO: 341943 - RNA, 19 nt, Homo sapiens
gaaguuuguucaccagaga

SEQ ID NO: 341944 - RNA, 19 nt, Homo sapiens
ggagauauagccagugauu

SEQ ID NO: 341945 - RNA, 19 nt, Homo sapiens
gaaaguggaaguuggauuc

SEQ ID NO: 341946 - RNA, 19 nt, Homo sapiens
gcaaaggcuucuggugaaa

SEQ ID NO: 341947 - RNA, 19 nt, Homo sapiens
ggaaugugcagaccaauau

SEQ ID NO: 341948 - RNA, 19 nt, Homo sapiens
gcuuugaaguuuaccagua

SEQ ID NO: 341949 - RNA, 19 nt, Homo sapiens
gaaaggauuugagaugaag

SEQ ID NO: 341950 - RNA, 19 nt, Homo sapiens
caaaugagagagccuauug

SEQ ID NO: 341951 - RNA, 19 nt, Homo sapiens
gaagaucagcuguauagau

SEQ ID NO: 341952 - RNA, 19 nt, Homo sapiens
ucccagaucuuccuuuauu

SEQ ID NO: 341953 - RNA, 19 nt, Homo sapiens
ugaaguacaaggaggauua

SEQ ID NO: 341954 - RNA, 19 nt, Homo sapiens
ggacacaguaucacaaguu

SEQ ID NO: 341955 - RNA, 19 nt, Homo sapiens
ugaaagaugccaauuauag

SEQ ID NO: 341956 - RNA, 19 nt, Homo sapiens
cuacagacaugacuuugug

SEQ ID NO: 341957 - RNA, 19 nt, Homo sapiens
gaacaguguaaaucaguuu

SEQ ID NO: 341958 - RNA, 19 nt, Homo sapiens
ggagaucgccagugauuuc

SEQ ID NO: 341959 - RNA, 19 nt, Homo sapiens
cuagggagaucgccaguga

SEQ ID NO: 341960 - RNA, 19 nt, Homo sapiens
gaaggcaggagaacucauu

SEQ ID NO: 341961 - RNA, 19 nt, Homo sapiens
gggcagaugugaaguggau

SEQ ID NO: 341962 - RNA, 19 nt, Homo sapiens
guaaacaucaggcaugcua

SEQ ID NO: 341963 - RNA, 19 nt, Homo sapiens
aaagaaggcugggagaaga

SEQ ID NO: 341964 - RNA, 19 nt, Homo sapiens
ccagccaaguggaguauaa

SEQ ID NO: 341965 - RNA, 19 nt, Homo sapiens
ccaagaagauggugaacag

SEQ ID NO: 341966 - RNA, 19 nt, Homo sapiens
aaagaaggcuggagaacuc

SEQ ID NO: 341967 - RNA, 19 nt, Homo sapiens
gcugagcugugccaagaaa

SEQ ID NO: 341968 - RNA, 19 nt, Homo sapiens
gauaucagccuugcacauu

SEQ ID NO: 341969 - RNA, 19 nt, Homo sapiens
gcuauaaacugagguugga

SEQ ID NO: 341970 - RNA, 19 nt, Homo sapiens
cuugaaagaugccaauuau

SEQ ID NO: 341971 - RNA, 19 nt, Homo sapiens
ugagguaccaucaacaaua

SEQ ID NO: 341972 - RNA, 19 nt, Homo sapiens
gacaugacuuugugaagga

SEQ ID NO: 341973 - RNA, 19 nt, Homo sapiens
gaaagcaucggaacucauc

SEQ ID NO: 341974 - RNA, 19 nt, Homo sapiens
ccaagcaguggauagauua

SEQ ID NO: 341975 - RNA, 19 nt, Homo sapiens
gaugugaaguggaugaaag

SEQ ID NO: 341976 - RNA, 19 nt, Homo sapiens
uguccaagcugcagaguga

SEQ ID NO: 341977 - RNA, 19 nt, Homo sapiens
gaaacugcaugaauacacu

SEQ ID NO: 341978 - RNA, 19 nt, Homo sapiens
gugacaaagucuacagaaa

SEQ ID NO: 341979 - RNA, 19 nt, Homo sapiens
cauaaagcaucauuacaca

SEQ ID NO: 341980 - RNA, 19 nt, Homo sapiens
gaagaaacugcaugaauac

SEQ ID NO: 341981 - RNA, 19 nt, Homo sapiens
gaagcuggaugccaugucu

SEQ ID NO: 341982 - RNA, 19 nt, Homo sapiens
agagugaugugaauuacaa

SEQ ID NO: 341983 - RNA, 19 nt, Homo sapiens
uaaagacacuccggagaug

SEQ ID NO: 341984 - RNA, 19 nt, Homo sapiens
gaagaaggcaggagaacuc

SEQ ID NO: 341985 - RNA, 19 nt, Homo sapiens
aggcaggacuucaauaaga

SEQ ID NO: 341986 - RNA, 19 nt, Homo sapiens
ggaauauacagaagacuau

SEQ ID NO: 341987 - RNA, 19 nt, Homo sapiens
aagaugaugcugucuguua

SEQ ID NO: 341988 - RNA, 19 nt, Homo sapiens
gacaaagucuacagaaacu

SEQ ID NO: 341989 - RNA, 19 nt, Homo sapiens
gaagaaagcaucggaacuc

SEQ ID NO: 341990 - RNA, 19 nt, Homo sapiens
gcaaucaggacuacaaaca

SEQ ID NO: 341991 - RNA, 19 nt, Homo sapiens
gagcaaacuucgagauggu

SEQ ID NO: 341992 - RNA, 19 nt, Homo sapiens
uauaagagcagcugggaaa

SEQ ID NO: 341993 - RNA, 19 nt, Homo sapiens
ggacuaugaacaacaaaga

SEQ ID NO: 341994 - RNA, 19 nt, Homo sapiens
gaaggacuuugccaagagu

SEQ ID NO: 341995 - RNA, 19 nt, Homo sapiens
caaccugagugacgcaaga

SEQ ID NO: 341996 - RNA, 19 nt, Homo sapiens
gaacaaggagaaaacauaa

SEQ ID NO: 341997 - RNA, 19 nt, Homo sapiens
agagcgagcugcaguacaa

SEQ ID NO: 341998 - RNA, 19 nt, Homo sapiens
gagguuaaguauaaagaag

SEQ ID NO: 341999 - RNA, 19 nt, Homo sapiens
ucaaacagcuaugaaacug

SEQ ID NO: 342000 - RNA, 19 nt, Homo sapiens
uaagagagggcaugaugaa

SEQ ID NO: 342001 - RNA, 19 nt, Homo sapiens
agacacgaguauacaauga

SEQ ID NO: 342002 - RNA, 19 nt, Homo sapiens
gaaugagcgccucuauaaa

SEQ ID NO: 342003 - RNA, 19 nt, Homo sapiens
ccagaaagcucuacauuug

SEQ ID NO: 342004 - RNA, 19 nt, Homo sapiens
ggagaaagaugaaacugaa

SEQ ID NO: 342005 - RNA, 19 nt, Homo sapiens
ggauacagcuggacaagaa

SEQ ID NO: 342006 - RNA, 19 nt, Homo sapiens
ggaaagcuauaucuauuug

SEQ ID NO: 342007 - RNA, 19 nt, Homo sapiens
aaacuuuggugcauuguua

SEQ ID NO: 342008 - RNA, 19 nt, Homo sapiens
gaaaugaaugucugagaua

SEQ ID NO: 342009 - RNA, 19 nt, Homo sapiens
gagaaugcaccucuuguua

SEQ ID NO: 342010 - RNA, 19 nt, Homo sapiens
gaaggaaagcuauaucuau

SEQ ID NO: 342011 - RNA, 19 nt, Homo sapiens
gaacuuccauuuguauuca

SEQ ID NO: 342012 - RNA, 19 nt, Homo sapiens
ugaaaugacugaguacaaa

SEQ ID NO: 342013 - RNA, 19 nt, Homo sapiens
ugacuuaucuaccauugaa

SEQ ID NO: 342014 - RNA, 19 nt, Homo sapiens
gagauacgucugugacuua

SEQ ID NO: 342015 - RNA, 19 nt, Homo sapiens
ucacaacuuugacguaauu

SEQ ID NO: 342016 - RNA, 19 nt, Homo sapiens
caaggacaguugauacaaa

SEQ ID NO: 342017 - RNA, 19 nt, Homo sapiens
ggugugaaaugacugagua

SEQ ID NO: 342018 - RNA, 19 nt, Homo sapiens
gaaaacaagugguuauaga

SEQ ID NO: 342019 - RNA, 19 nt, Homo sapiens
gaaccacuuuguagaugaa

SEQ ID NO: 342020 - RNA, 19 nt, Homo sapiens
gcagccgacugauuacgua

SEQ ID NO: 342021 - RNA, 19 nt, Homo sapiens
ccgcaaacgugaaauucua

SEQ ID NO: 342022 - RNA, 19 nt, Homo sapiens
cauagaggauucuuacaga

SEQ ID NO: 342023 - RNA, 19 nt, Homo sapiens
uaauagcugugaucaguga

SEQ ID NO: 342024 - RNA, 19 nt, Homo sapiens
gcacugacaauccagcuaa

SEQ ID NO: 342025 - RNA, 19 nt, Homo sapiens
guacauguaugaaauuggu

SEQ ID NO: 342026 - RNA, 19 nt, Homo sapiens
uaucggcucuauucucuaa

SEQ ID NO: 342027 - RNA, 19 nt, Homo sapiens
uaagagaaauacgccagua

SEQ ID NO: 342028 - RNA, 19 nt, Homo sapiens
guggugauguaacaagaua

SEQ ID NO: 342029 - RNA, 19 nt, Homo sapiens
ugaaaugaaugucugagau

SEQ ID NO: 342030 - RNA, 19 nt, Homo sapiens
guuacuaccuauacaaugu

SEQ ID NO: 342031 - RNA, 19 nt, Homo sapiens
gaaugcaccucuuguuacu

SEQ ID NO: 342032 - RNA, 19 nt, Homo sapiens
gcuguuugguuuguuuaua

SEQ ID NO: 342033 - RNA, 19 nt, Homo sapiens
auaacuaccuccucacuug

SEQ ID NO: 342034 - RNA, 19 nt, Homo sapiens
gcacaaacacaccucaaca

SEQ ID NO: 342035 - RNA, 19 nt, Homo sapiens
ggaaacaagugugauuugc

SEQ ID NO: 342036 - RNA, 19 nt, Homo sapiens
caauccagcuaauccagaa

SEQ ID NO: 342037 - RNA, 19 nt, Homo sapiens
ccuggcagccgacugauua

SEQ ID NO: 342038 - RNA, 19 nt, Homo sapiens
uaucuaccauugaaggaaa

SEQ ID NO: 342039 - RNA, 19 nt, Homo sapiens
guuuguagacuccuuuaua

SEQ ID NO: 342040 - RNA, 19 nt, Homo sapiens
gcucuagauucauaaauac

SEQ ID NO: 342041 - RNA, 19 nt, Homo sapiens
gagcagauuaagcgaguaa

SEQ ID NO: 342042 - RNA, 19 nt, Homo sapiens
ggccaagaguuacgggauu

SEQ ID NO: 342043 - RNA, 19 nt, Homo sapiens
cagagaagcuccugcuacu

SEQ ID NO: 342044 - RNA, 19 nt, Homo sapiens
gagagcagaugccauuuug

SEQ ID NO: 342045 - RNA, 19 nt, Homo sapiens
cuucacaacuuugacguaa

SEQ ID NO: 342046 - RNA, 19 nt, Homo sapiens
ugaaggaaagcuauaucua

SEQ ID NO: 342047 - RNA, 19 nt, Homo sapiens
ggucugugguccuaaaucu

SEQ ID NO: 342048 - RNA, 19 nt, Homo sapiens
uggaauagaugucucaaaa

SEQ ID NO: 342049 - RNA, 19 nt, Homo sapiens
gucuugagcucuaaaguag

SEQ ID NO: 342050 - RNA, 19 nt, Homo sapiens
caagucauuugcggauauu

SEQ ID NO: 342051 - RNA, 19 nt, Homo sapiens
gaagaguacagugccauga

SEQ ID NO: 342052 - RNA, 19 nt, Homo sapiens
cagaaccacuuuguagaug

SEQ ID NO: 342053 - RNA, 19 nt, Homo sapiens
uuuaauagcugugaucagu

SEQ ID NO: 342054 - RNA, 19 nt, Homo sapiens
agaaagcucuacauuugca

SEQ ID NO: 342055 - RNA, 19 nt, Homo sapiens
gagcagaugccauuuugua

SEQ ID NO: 342056 - RNA, 19 nt, Homo sapiens
guuaucggcucuauucucu

SEQ ID NO: 342057 - RNA, 19 nt, Homo sapiens
ccaaaccgcaaacgugaaa

SEQ ID NO: 342058 - RNA, 19 nt, Homo sapiens
gggaaacaagugugauuug

SEQ ID NO: 342059 - RNA, 19 nt, Homo sapiens
gguccuaaaucuguccaaa

SEQ ID NO: 342060 - RNA, 19 nt, Homo sapiens
guaaaacuuuggugcauug

SEQ ID NO: 342061 - RNA, 19 nt, Homo sapiens
ugagauacgucugugacuu

SEQ ID NO: 342062 - RNA, 19 nt, Homo sapiens
cagaggcaguggagcuuga

SEQ ID NO: 342063 - RNA, 19 nt, Homo sapiens
cagacaggguguugaagau

SEQ ID NO: 342064 - RNA, 19 nt, Homo sapiens
uuacgggauuccauucauu

SEQ ID NO: 342065 - RNA, 19 nt, Homo sapiens
aaacaagugguuauagaug

SEQ ID NO: 342066 - RNA, 19 nt, Homo sapiens
gguucuugcuggugugaaa

SEQ ID NO: 342067 - RNA, 19 nt, Homo sapiens
caucaauaauagcaaguca

SEQ ID NO: 342068 - RNA, 19 nt, Homo sapiens
gcuaauccagaaccacuuu

SEQ ID NO: 342069 - RNA, 19 nt, Homo sapiens
ucaaauuugugucauacca

SEQ ID NO: 342070 - RNA, 19 nt, Homo sapiens
gagaaagaugaaacugaaa

SEQ ID NO: 342071 - RNA, 19 nt, Homo sapiens
uaaacuggcaucugcucua

SEQ ID NO: 342072 - RNA, 19 nt, Homo sapiens
gcaaacgugaaauucuauu

SEQ ID NO: 342073 - RNA, 19 nt, Homo sapiens
ugccauguguggugaugua

SEQ ID NO: 342074 - RNA, 19 nt, Homo sapiens
gaccagacaggguguugaa

SEQ ID NO: 342075 - RNA, 19 nt, Homo sapiens
gcagauguucaaauauugu

SEQ ID NO: 342076 - RNA, 19 nt, Homo sapiens
guaaaagacucggaugaug

SEQ ID NO: 342077 - RNA, 19 nt, Homo sapiens
agaaccacuuuguagauga

SEQ ID NO: 342078 - RNA, 19 nt, Homo sapiens
aaacucaacagcagugaug

SEQ ID NO: 342079 - RNA, 19 nt, Homo sapiens
caguggagcuugagguucu

SEQ ID NO: 342080 - RNA, 19 nt, Homo sapiens
ucucaguaguuuaguacaa

SEQ ID NO: 342081 - RNA, 19 nt, Homo sapiens
cauguguggugauguaaca

SEQ ID NO: 342082 - RNA, 19 nt, Homo sapiens
ccagacaggguguugaaga

SEQ ID NO: 342083 - RNA, 19 nt, Homo sapiens
agaguacagugccaugaga

SEQ ID NO: 342084 - RNA, 19 nt, Homo sapiens
ccagaaccacuuuguagau

SEQ ID NO: 342085 - RNA, 19 nt, Homo sapiens
ugucuugagcucuaaagua

SEQ ID NO: 342086 - RNA, 19 nt, Homo sapiens
caaacgugaaauucuauug

SEQ ID NO: 342087 - RNA, 19 nt, Homo sapiens
aaaagcaguucaugucuga

SEQ ID NO: 342088 - RNA, 19 nt, Homo sapiens
ugauguaccuauggugcua

SEQ ID NO: 342089 - RNA, 19 nt, Homo sapiens
aaacuggcaucugcucuag

SEQ ID NO: 342090 - RNA, 19 nt, Homo sapiens
gugaaaugacugaguacaa

SEQ ID NO: 342091 - RNA, 19 nt, Homo sapiens
aacagugucuugagcucua

SEQ ID NO: 342092 - RNA, 19 nt, Homo sapiens
ccacuuuguagaugaauau

SEQ ID NO: 342093 - RNA, 19 nt, Homo sapiens
gaauaacuaccuccucacu

SEQ ID NO: 342094 - RNA, 19 nt, Homo sapiens
guugcugucuucagucuca

SEQ ID NO: 342095 - RNA, 19 nt, Homo sapiens
gccaagaguuacgggauuc

SEQ ID NO: 342096 - RNA, 19 nt, Homo sapiens
caagugugauuugccaaca

SEQ ID NO: 342097 - RNA, 19 nt, Homo sapiens
ccuuaugcaugaaaugaau

SEQ ID NO: 342098 - RNA, 19 nt, Homo sapiens
ccaccauagaggauucuua

SEQ ID NO: 342099 - RNA, 19 nt, Homo sapiens
uugcggauauuaaccucua

SEQ ID NO: 342100 - RNA, 19 nt, Homo sapiens
uaccagaaagcucuacauu

SEQ ID NO: 342101 - RNA, 19 nt, Homo sapiens
auacgucugugacuuaucu

SEQ ID NO: 342102 - RNA, 19 nt, Homo sapiens
gaaaugacugaguacaaac

SEQ ID NO: 342103 - RNA, 19 nt, Homo sapiens
gaaacaugaucacaccuua

SEQ ID NO: 342104 - RNA, 19 nt, Homo sapiens
uaacagcacacaugaauua

SEQ ID NO: 342105 - RNA, 19 nt, Homo sapiens
gagcugcaguuucuaauaa

SEQ ID NO: 342106 - RNA, 19 nt, Homo sapiens
aaacaagggugguaaauau

SEQ ID NO: 342107 - RNA, 19 nt, Homo sapiens
caggaacgcucauaauuaa

SEQ ID NO: 342108 - RNA, 19 nt, Homo sapiens
gauuacaucugcaguuuaa

SEQ ID NO: 342109 - RNA, 19 nt, Homo sapiens
aaacaggccugcuuuacua

SEQ ID NO: 342110 - RNA, 19 nt, Homo sapiens
ggucuuagcuguuggcauu

SEQ ID NO: 342111 - RNA, 19 nt, Homo sapiens
gaaagauggugaugaugaa

SEQ ID NO: 342112 - RNA, 19 nt, Homo sapiens
agaauuagcugguuaacaa

SEQ ID NO: 342113 - RNA, 19 nt, Homo sapiens
ucagagagcacaaagauua

SEQ ID NO: 342114 - RNA, 19 nt, Homo sapiens
guaaagauggcccuaaaua

SEQ ID NO: 342115 - RNA, 19 nt, Homo sapiens
gaaagggucacuucuguaa

SEQ ID NO: 342116 - RNA, 19 nt, Homo sapiens
cuacaaggcuaucggauuu

SEQ ID NO: 342117 - RNA, 19 nt, Homo sapiens
gaaggagucuaucagugua

SEQ ID NO: 342118 - RNA, 19 nt, Homo sapiens
gaacuucaaugucuuugug

SEQ ID NO: 342119 - RNA, 19 nt, Homo sapiens
gaaacaagggugguaaaua

SEQ ID NO: 342120 - RNA, 19 nt, Homo sapiens
ggugguaaauauccaguua

SEQ ID NO: 342121 - RNA, 19 nt, Homo sapiens
gaacgaaucuuugugacau

SEQ ID NO: 342122 - RNA, 19 nt, Homo sapiens
gacuauaucuguuaugcua

SEQ ID NO: 342123 - RNA, 19 nt, Homo sapiens
gaaccaaucacacuucaaa

SEQ ID NO: 342124 - RNA, 19 nt, Homo sapiens
cuaguaaccuggcauguuu

SEQ ID NO: 342125 - RNA, 19 nt, Homo sapiens
gaugcuacauggaucguua

SEQ ID NO: 342126 - RNA, 19 nt, Homo sapiens
ugaaauuggugacuaugua

SEQ ID NO: 342127 - RNA, 19 nt, Homo sapiens
uaaaggagcuaaaggaagu

SEQ ID NO: 342128 - RNA, 19 nt, Homo sapiens
gcacacaacguuucacaaa

SEQ ID NO: 342129 - RNA, 19 nt, Homo sapiens
ggacauuguugugaaauug

SEQ ID NO: 342130 - RNA, 19 nt, Homo sapiens
aaaggaagauggaaugcua

SEQ ID NO: 342131 - RNA, 19 nt, Homo sapiens
gcuaucggauuuacuauug

SEQ ID NO: 342132 - RNA, 19 nt, Homo sapiens
uggcaaauguauccaaaua

SEQ ID NO: 342133 - RNA, 19 nt, Homo sapiens
ggaagaugaugggacauuu

SEQ ID NO: 342134 - RNA, 19 nt, Homo sapiens
gagaagaccucccaauggu

SEQ ID NO: 342135 - RNA, 19 nt, Homo sapiens
ggaaguaccucuugaucca

SEQ ID NO: 342136 - RNA, 19 nt, Homo sapiens
gagguaagcuaauuaaugc

SEQ ID NO: 342137 - RNA, 19 nt, Homo sapiens
ugacaaggaucaucuagug

SEQ ID NO: 342138 - RNA, 19 nt, Homo sapiens
ucaaaacucugcagcauua

SEQ ID NO: 342139 - RNA, 19 nt, Homo sapiens
gaaggugauuucagcuaaa

SEQ ID NO: 342140 - RNA, 19 nt, Homo sapiens
aaggauagcuucagaaauc

SEQ ID NO: 342141 - RNA, 19 nt, Homo sapiens
uaaacaacguguaugcaaa

SEQ ID NO: 342142 - RNA, 19 nt, Homo sapiens
ccagaaagauggugaugau

SEQ ID NO: 342143 - RNA, 19 nt, Homo sapiens
caaauggagucccaauaga

SEQ ID NO: 342144 - RNA, 19 nt, Homo sapiens
caccauaccauuucuguua

SEQ ID NO: 342145 - RNA, 19 nt, Homo sapiens
gaucauucauguuucagaa

SEQ ID NO: 342146 - RNA, 19 nt, Homo sapiens
uaagaagacguuugguuua

SEQ ID NO: 342147 - RNA, 19 nt, Homo sapiens
gaaaucaggcaagugcuua

SEQ ID NO: 342148 - RNA, 19 nt, Homo sapiens
caacguguaugcaaauugu

SEQ ID NO: 342149 - RNA, 19 nt, Homo sapiens
cuacauggaucguuaaaca

SEQ ID NO: 342150 - RNA, 19 nt, Homo sapiens
gcaaugccucuaaugaaua

SEQ ID NO: 342151 - RNA, 19 nt, Homo sapiens
gcagaucauucauguuuca

SEQ ID NO: 342152 - RNA, 19 nt, Homo sapiens
aagggucacuucuguaaua

SEQ ID NO: 342153 - RNA, 19 nt, Homo sapiens
gacauucucucucagcauu

SEQ ID NO: 342154 - RNA, 19 nt, Homo sapiens
gggauuacaucugcaguuu

SEQ ID NO: 342155 - RNA, 19 nt, Homo sapiens
gcacaaacaucagcaggau

SEQ ID NO: 342156 - RNA, 19 nt, Homo sapiens
ggaaagcugagaccuauga

SEQ ID NO: 342157 - RNA, 19 nt, Homo sapiens
uaaaggacauacccgugua

SEQ ID NO: 342158 - RNA, 19 nt, Homo sapiens
gcgaagacuauaucuguua

SEQ ID NO: 342159 - RNA, 19 nt, Homo sapiens
gagugugaauguccaagua

SEQ ID NO: 342160 - RNA, 19 nt, Homo sapiens
ugcaacagauuugguauua

SEQ ID NO: 342161 - RNA, 19 nt, Homo sapiens
gaaggaaugcucaguuuca

SEQ ID NO: 342162 - RNA, 19 nt, Homo sapiens
ucaaauggguuaccuccaa

SEQ ID NO: 342163 - RNA, 19 nt, Homo sapiens
gaacauauggguagagagu

SEQ ID NO: 342164 - RNA, 19 nt, Homo sapiens
gccaugaauuccuuuguuu

SEQ ID NO: 342165 - RNA, 19 nt, Homo sapiens
gaaacagacgucacauuga

SEQ ID NO: 342166 - RNA, 19 nt, Homo sapiens
ugaaugguuucgaaucuaa

SEQ ID NO: 342167 - RNA, 19 nt, Homo sapiens
caaguaaugguguauguaa

SEQ ID NO: 342168 - RNA, 19 nt, Homo sapiens
uaaccuggcauguuugaua

SEQ ID NO: 342169 - RNA, 19 nt, Homo sapiens
ggaaagcaucuacuuaaau

SEQ ID NO: 342170 - RNA, 19 nt, Homo sapiens
gaacugacagaucaacuug

SEQ ID NO: 342171 - RNA, 19 nt, Homo sapiens
gagaaaaccuugcagauca

SEQ ID NO: 342172 - RNA, 19 nt, Homo sapiens
gaagacguuugguuuaaag

SEQ ID NO: 342173 - RNA, 19 nt, Homo sapiens
acaggaacgcucauaauua

SEQ ID NO: 342174 - RNA, 19 nt, Homo sapiens
gaacuauuaccuacucuug

SEQ ID NO: 342175 - RNA, 19 nt, Homo sapiens
ggaacaguuuguacaguau

SEQ ID NO: 342176 - RNA, 19 nt, Homo sapiens
ggaaauuaccaauguauag

SEQ ID NO: 342177 - RNA, 19 nt, Homo sapiens
aaagaggaauuaagaggaa

SEQ ID NO: 342178 - RNA, 19 nt, Homo sapiens
gcucauaauuaacaucaug

SEQ ID NO: 342179 - RNA, 19 nt, Homo sapiens
gcaacagauuugguauuaa

SEQ ID NO: 342180 - RNA, 19 nt, Homo sapiens
ugucagcccucucauacua

SEQ ID NO: 342181 - RNA, 19 nt, Homo sapiens
ggaucaggaagucaaauua

SEQ ID NO: 342182 - RNA, 19 nt, Homo sapiens
ugaauuaggcccucuggua

SEQ ID NO: 342183 - RNA, 19 nt, Homo sapiens
cagaguacaccuuaaagua

SEQ ID NO: 342184 - RNA, 19 nt, Homo sapiens
ggccuucaguacaaaguua

SEQ ID NO: 342185 - RNA, 19 nt, Homo sapiens
aagaagacguuugguuuaa

SEQ ID NO: 342186 - RNA, 19 nt, Homo sapiens
ggauacaguucaauaugau

SEQ ID NO: 342187 - RNA, 19 nt, Homo sapiens
ccuaagcacuuguuuguca

SEQ ID NO: 342188 - RNA, 19 nt, Homo sapiens
acaauacagugguaagaaa

SEQ ID NO: 342189 - RNA, 19 nt, Homo sapiens
ggaagcccuugaaugguuu

SEQ ID NO: 342190 - RNA, 19 nt, Homo sapiens
cuaagaagacguuugguuu

SEQ ID NO: 342191 - RNA, 19 nt, Homo sapiens
gcuuauagguguuacauac

SEQ ID NO: 342192 - RNA, 19 nt, Homo sapiens
caaauggguuaccuccaaa

SEQ ID NO: 342193 - RNA, 19 nt, Homo sapiens
gaacacagggcaagacaca

SEQ ID NO: 342194 - RNA, 19 nt, Homo sapiens
gaacaguuuguacaguaua

SEQ ID NO: 342195 - RNA, 19 nt, Homo sapiens
gaaagagccggcugaagga

SEQ ID NO: 342196 - RNA, 19 nt, Homo sapiens
gaagaaacaagggugguaa

SEQ ID NO: 342197 - RNA, 19 nt, Homo sapiens
caaggaucaucuaguggua

SEQ ID NO: 342198 - RNA, 19 nt, Homo sapiens
aauaugaacuggaaugcaa

SEQ ID NO: 342199 - RNA, 19 nt, Homo sapiens
acucagggcugguucauug

SEQ ID NO: 342200 - RNA, 19 nt, Homo sapiens
gcaaugcaaguaacaaaga

SEQ ID NO: 342201 - RNA, 19 nt, Homo sapiens
cagcagaagcaaccuauuu

SEQ ID NO: 342202 - RNA, 19 nt, Homo sapiens
ggauuaccaccaccuauaa

SEQ ID NO: 342203 - RNA, 19 nt, Homo sapiens
gauaaugccucaacugauu

SEQ ID NO: 342204 - RNA, 19 nt, Homo sapiens
gaaacagaauacccaguua

SEQ ID NO: 342205 - RNA, 19 nt, Homo sapiens
gaaaggauuuaaccacaaa

SEQ ID NO: 342206 - RNA, 19 nt, Homo sapiens
gaaaggaaauguuguuugg

SEQ ID NO: 342207 - RNA, 19 nt, Homo sapiens
gaacuggaaugaagugguu

SEQ ID NO: 342208 - RNA, 19 nt, Homo sapiens
uggcacagcuggaguauaa

SEQ ID NO: 342209 - RNA, 19 nt, Homo sapiens
ggaaugaagugguuacaca

SEQ ID NO: 342210 - RNA, 19 nt, Homo sapiens
gauaggaacuggaaugaag

SEQ ID NO: 342211 - RNA, 19 nt, Homo sapiens
gagcugaaauagaagauga

SEQ ID NO: 342212 - RNA, 19 nt, Homo sapiens
ggacucaggcaaccaaaua

SEQ ID NO: 342213 - RNA, 19 nt, Homo sapiens
ggagaacaugguuuaauua

SEQ ID NO: 342214 - RNA, 19 nt, Homo sapiens
aagaaacacuggauacuuu

SEQ ID NO: 342215 - RNA, 19 nt, Homo sapiens
ggucuaugauugacaagua

SEQ ID NO: 342216 - RNA, 19 nt, Homo sapiens
gcucauuauugacuacuua

SEQ ID NO: 342217 - RNA, 19 nt, Homo sapiens
gcugaacuguggaauagua

SEQ ID NO: 342218 - RNA, 19 nt, Homo sapiens
gcacugaagucauucucaa

SEQ ID NO: 342219 - RNA, 19 nt, Homo sapiens
ugaagaagaccuacuuuaa

SEQ ID NO: 342220 - RNA, 19 nt, Homo sapiens
ucaauauccuuacgcauaa

SEQ ID NO: 342221 - RNA, 19 nt, Homo sapiens
gaagaugaguuugaugaug

SEQ ID NO: 342222 - RNA, 19 nt, Homo sapiens
agaagaagaugaugaugaa

SEQ ID NO: 342223 - RNA, 19 nt, Homo sapiens
ggucacagcucucaucaag

SEQ ID NO: 342224 - RNA, 19 nt, Homo sapiens
guacauagccacggacuuu

SEQ ID NO: 342225 - RNA, 19 nt, Homo sapiens
caacaacacucaaccuucu

SEQ ID NO: 342226 - RNA, 19 nt, Homo sapiens
gggaggagguggauaggaa

SEQ ID NO: 342227 - RNA, 19 nt, Homo sapiens
cgaauuaaauccagaucuu

SEQ ID NO: 342228 - RNA, 19 nt, Homo sapiens
gaacagacagauccaguug

SEQ ID NO: 342229 - RNA, 19 nt, Homo sapiens
gaucagagaugcaauugac

SEQ ID NO: 342230 - RNA, 19 nt, Homo sapiens
gaaauacaacagaugauga

SEQ ID NO: 342231 - RNA, 19 nt, Homo sapiens
ccagcugucuuuacaauga

SEQ ID NO: 342232 - RNA, 19 nt, Homo sapiens
uuacaugacuuuagugguu

SEQ ID NO: 342233 - RNA, 19 nt, Homo sapiens
ugacugaaaucuucucuca

SEQ ID NO: 342234 - RNA, 19 nt, Homo sapiens
gagccaagaaagaauaaua

SEQ ID NO: 342235 - RNA, 19 nt, Homo sapiens
cuacuuagcugaguucaau

SEQ ID NO: 342236 - RNA, 19 nt, Homo sapiens
ggaaacagaauacccaguu

SEQ ID NO: 342237 - RNA, 19 nt, Homo sapiens
gaaaugguuuggaacucaa

SEQ ID NO: 342238 - RNA, 19 nt, Homo sapiens
gauagacugugguuuaagu

SEQ ID NO: 342239 - RNA, 19 nt, Homo sapiens
uaucagggcuuucacaaca

SEQ ID NO: 342240 - RNA, 19 nt, Homo sapiens
ggagaugccugugcaguuc

SEQ ID NO: 342241 - RNA, 19 nt, Homo sapiens
uggagaacaugguuuaauu

SEQ ID NO: 342242 - RNA, 19 nt, Homo sapiens
uacaacagaugaugaagaa

SEQ ID NO: 342243 - RNA, 19 nt, Homo sapiens
gaagagagagcagaagcua

SEQ ID NO: 342244 - RNA, 19 nt, Homo sapiens
aauagaagaugacgaugaa

SEQ ID NO: 342245 - RNA, 19 nt, Homo sapiens
caacagaugaugaagaaga

SEQ ID NO: 342246 - RNA, 19 nt, Homo sapiens
gcucagcguucauguuguu

SEQ ID NO: 342247 - RNA, 19 nt, Homo sapiens
gagaauauacgcuuaugga

SEQ ID NO: 342248 - RNA, 19 nt, Homo sapiens
gggcugaacuguggaauag

SEQ ID NO: 342249 - RNA, 19 nt, Homo sapiens
aagaugaguuugaugauga

SEQ ID NO: 342250 - RNA, 19 nt, Homo sapiens
aagaagaccuacuuuaaca

SEQ ID NO: 342251 - RNA, 19 nt, Homo sapiens
gaagaagaccuacuuuaac

SEQ ID NO: 342252 - RNA, 19 nt, Homo sapiens
gucaauauccuuacgcaua

SEQ ID NO: 342253 - RNA, 19 nt, Homo sapiens
gaacuguggaauaguaauu

SEQ ID NO: 342254 - RNA, 19 nt, Homo sapiens
cagcauuucuauuacauug

SEQ ID NO: 342255 - RNA, 19 nt, Homo sapiens
ugaaauauccagaugagaa

SEQ ID NO: 342256 - RNA, 19 nt, Homo sapiens
gaauaugcccguuggucua

SEQ ID NO: 342257 - RNA, 19 nt, Homo sapiens
ccacggacuuuacguugaa

SEQ ID NO: 342258 - RNA, 19 nt, Homo sapiens
agacagauccaguugagua

SEQ ID NO: 342259 - RNA, 19 nt, Homo sapiens
ggaagaagaagaagaugau

SEQ ID NO: 342260 - RNA, 19 nt, Homo sapiens
gccagacccuuuccuauuc

SEQ ID NO: 342261 - RNA, 19 nt, Homo sapiens
caaagcauauauacguuuc

SEQ ID NO: 342262 - RNA, 19 nt, Homo sapiens
gugagaacaugcagcugua

SEQ ID NO: 342263 - RNA, 19 nt, Homo sapiens
gcaauugaccgugaaguug

SEQ ID NO: 342264 - RNA, 19 nt, Homo sapiens
gcaauaccgauacaucaaa

SEQ ID NO: 342265 - RNA, 19 nt, Homo sapiens
ccaggagucuaagagaaua

SEQ ID NO: 342266 - RNA, 19 nt, Homo sapiens
caccaucuaugcaaaguga

SEQ ID NO: 342267 - RNA, 19 nt, Homo sapiens
caagguugccugugguaua

SEQ ID NO: 342268 - RNA, 19 nt, Homo sapiens
guguucagcauuucuauua

SEQ ID NO: 342269 - RNA, 19 nt, Homo sapiens
gaaauauccagaugagaau

SEQ ID NO: 342270 - RNA, 19 nt, Homo sapiens
caucuaauuucaccguuga

SEQ ID NO: 342271 - RNA, 19 nt, Homo sapiens
gaaauggugagacaggauu

SEQ ID NO: 342272 - RNA, 19 nt, Homo sapiens
gguccucuuugauaucuuu

SEQ ID NO: 342273 - RNA, 19 nt, Homo sapiens
aaggaaauguuguuuggaa

SEQ ID NO: 342274 - RNA, 19 nt, Homo sapiens
gaaguugaagcuguugaua

SEQ ID NO: 342275 - RNA, 19 nt, Homo sapiens
gacaggaucugggcgagaa

SEQ ID NO: 342276 - RNA, 19 nt, Homo sapiens
gaguuucgcugauccagau

SEQ ID NO: 342277 - RNA, 19 nt, Homo sapiens
ggaggaagaagaagaagau

SEQ ID NO: 342278 - RNA, 19 nt, Homo sapiens
ggaaauacaacagaugaug

SEQ ID NO: 342279 - RNA, 19 nt, Homo sapiens
ugauacacaugcuagauug

SEQ ID NO: 342280 - RNA, 19 nt, Homo sapiens
augaugaucuugauacuga

SEQ ID NO: 342281 - RNA, 19 nt, Homo sapiens
uugaagcacugaagucauu

SEQ ID NO: 342282 - RNA, 19 nt, Homo sapiens
ugaaaggauuuaaccacaa

SEQ ID NO: 342283 - RNA, 19 nt, Homo sapiens
ccauuuaacggauccauuu

SEQ ID NO: 342284 - RNA, 19 nt, Homo sapiens
ggaagaauuagaagagaga

SEQ ID NO: 342285 - RNA, 19 nt, Homo sapiens
gcacauggaagaaccuugu

SEQ ID NO: 342286 - RNA, 19 nt, Homo sapiens
cagcaaaugugguccucuu

SEQ ID NO: 342287 - RNA, 19 nt, Homo sapiens
aaggagaaaugguuuggaa

SEQ ID NO: 342288 - RNA, 19 nt, Homo sapiens
aaugugaccucaaggagaa

SEQ ID NO: 342289 - RNA, 19 nt, Homo sapiens
gaagagauucggaaaauug

SEQ ID NO: 342290 - RNA, 19 nt, Homo sapiens
ucuauuacauugacugaug

SEQ ID NO: 342291 - RNA, 19 nt, Homo sapiens
ggaugaaucugaggaagag

SEQ ID NO: 342292 - RNA, 19 nt, Homo sapiens
aagaggagguggaggaaga

SEQ ID NO: 342293 - RNA, 19 nt, Homo sapiens
gaagaccuacuuuaacauc

SEQ ID NO: 342294 - RNA, 19 nt, Homo sapiens
uguuucagcucauuauuga

SEQ ID NO: 342295 - RNA, 19 nt, Homo sapiens
gaugaggguuaugaacauu

SEQ ID NO: 342296 - RNA, 19 nt, Homo sapiens
caugcuagauugagagaau

SEQ ID NO: 342297 - RNA, 19 nt, Homo sapiens
ggagguggaggaagaagaa

SEQ ID NO: 342298 - RNA, 19 nt, Homo sapiens
gcucauagagggccaggaa

SEQ ID NO: 342299 - RNA, 19 nt, Homo sapiens
ucagguaccaggagucuaa

SEQ ID NO: 342300 - RNA, 19 nt, Homo sapiens
aaacagaauacccaguuaa

SEQ ID NO: 342301 - RNA, 19 nt, Homo sapiens
caauaccgauacaucaaau

SEQ ID NO: 342302 - RNA, 19 nt, Homo sapiens
ggaacaaggcgaagucuac

SEQ ID NO: 342303 - RNA, 19 nt, Homo sapiens
gaaacggccucauguauuu

SEQ ID NO: 342304 - RNA, 19 nt, Homo sapiens
ggacauacacauuuacaua

SEQ ID NO: 342305 - RNA, 19 nt, Homo sapiens
gcaaguggauccugacuga

SEQ ID NO: 342306 - RNA, 19 nt, Homo sapiens
gcagaugaaugucuugaaa

SEQ ID NO: 342307 - RNA, 19 nt, Homo sapiens
uaguauagcucaucuugua

SEQ ID NO: 342308 - RNA, 19 nt, Homo sapiens
ugaagaaacugcauuguca

SEQ ID NO: 342309 - RNA, 19 nt, Homo sapiens
gcaaucaaauggaauuaag

SEQ ID NO: 342310 - RNA, 19 nt, Homo sapiens
ggaaacggccucauguauu

SEQ ID NO: 342311 - RNA, 19 nt, Homo sapiens
gcaaauguccggagugaug

SEQ ID NO: 342312 - RNA, 19 nt, Homo sapiens
ucccagagaugcucaagua

SEQ ID NO: 342313 - RNA, 19 nt, Homo sapiens
gcguugagcuacugacaaa

SEQ ID NO: 342314 - RNA, 19 nt, Homo sapiens
gcggaaauguguguguaua

SEQ ID NO: 342315 - RNA, 19 nt, Homo sapiens
caaauggaauuaagucucu

SEQ ID NO: 342316 - RNA, 19 nt, Homo sapiens
gagccacguuagaugaaua

SEQ ID NO: 342317 - RNA, 19 nt, Homo sapiens
gaaagcggauuuuggaauu

SEQ ID NO: 342318 - RNA, 19 nt, Homo sapiens
gcuaauggccucuuuaugg

SEQ ID NO: 342319 - RNA, 19 nt, Homo sapiens
gggcaaauguccggaguga

SEQ ID NO: 342320 - RNA, 19 nt, Homo sapiens
gcagggagcuacagucacu

SEQ ID NO: 342321 - RNA, 19 nt, Homo sapiens
gaacacggagugacccaaa

SEQ ID NO: 342322 - RNA, 19 nt, Homo sapiens
gaggugcaaucaaauggaa

SEQ ID NO: 342323 - RNA, 19 nt, Homo sapiens
cacaggagguuaacucaga

SEQ ID NO: 342324 - RNA, 19 nt, Homo sapiens
gggcaacaguagccacauu

SEQ ID NO: 342325 - RNA, 19 nt, Homo sapiens
gaagaucagcaaacgcaaa

SEQ ID NO: 342326 - RNA, 19 nt, Homo sapiens
ggagugauguccgcacaga

SEQ ID NO: 342327 - RNA, 19 nt, Homo sapiens
ggacaccucuuacgaugac

SEQ ID NO: 342328 - RNA, 19 nt, Homo sapiens
uaaagcaccacucuugauu

SEQ ID NO: 342329 - RNA, 19 nt, Homo sapiens
aaaccuaacccugucuuua

SEQ ID NO: 342330 - RNA, 19 nt, Homo sapiens
caauaauucacccaguuua

SEQ ID NO: 342331 - RNA, 19 nt, Homo sapiens
ggaaauguguguguauacu

SEQ ID NO: 342332 - RNA, 19 nt, Homo sapiens
ugacauacagccauauuau

SEQ ID NO: 342333 - RNA, 19 nt, Homo sapiens
cuugaucucaugacuauua

SEQ ID NO: 342334 - RNA, 19 nt, Homo sapiens
gaccaugcccuucaccaaa

SEQ ID NO: 342335 - RNA, 19 nt, Homo sapiens
gaagaaagcggauuuugga

SEQ ID NO: 342336 - RNA, 19 nt, Homo sapiens
acagugacauacagccaua

SEQ ID NO: 342337 - RNA, 19 nt, Homo sapiens
uggagaauguggugcguaa

SEQ ID NO: 342338 - RNA, 19 nt, Homo sapiens
ggucagagaugugcuugca

SEQ ID NO: 342339 - RNA, 19 nt, Homo sapiens
gaaauguguguguauacuu

SEQ ID NO: 342340 - RNA, 19 nt, Homo sapiens
gcagaggugcaaucaaaug

SEQ ID NO: 342341 - RNA, 19 nt, Homo sapiens
cacauuggcugaugcuuca

SEQ ID NO: 342342 - RNA, 19 nt, Homo sapiens
gaaacuucgagccacguua

SEQ ID NO: 342343 - RNA, 19 nt, Homo sapiens
gaagaaacugcauugucaa

SEQ ID NO: 342344 - RNA, 19 nt, Homo sapiens
agaauguggugcguaagua

SEQ ID NO: 342345 - RNA, 19 nt, Homo sapiens
guaugaaacccgcauggaa

SEQ ID NO: 342346 - RNA, 19 nt, Homo sapiens
aaccuaacccugucuuuaa

SEQ ID NO: 342347 - RNA, 19 nt, Homo sapiens
gcauggaauuaucuguaug

SEQ ID NO: 342348 - RNA, 19 nt, Homo sapiens
aaaggaagaaagcggauuu

SEQ ID NO: 342349 - RNA, 19 nt, Homo sapiens
gaaacccgcauggaauuau

SEQ ID NO: 342350 - RNA, 19 nt, Homo sapiens
gaaggaaaguuuuguuaac

SEQ ID NO: 342351 - RNA, 19 nt, Homo sapiens
ggucaccguugcccaagug

SEQ ID NO: 342352 - RNA, 19 nt, Homo sapiens
gacccaaaccgaacauaug

SEQ ID NO: 342353 - RNA, 19 nt, Homo sapiens
cauaguauagcucaucuug

SEQ ID NO: 342354 - RNA, 19 nt, Homo sapiens
gggaagaccuuuuguaugc

SEQ ID NO: 342355 - RNA, 19 nt, Homo sapiens
gcuauuguccucuguaucu

SEQ ID NO: 342356 - RNA, 19 nt, Homo sapiens
aacaauaauucacccaguu

SEQ ID NO: 342357 - RNA, 19 nt, Homo sapiens
ucacuuauccagguuggua

SEQ ID NO: 342358 - RNA, 19 nt, Homo sapiens
gauggcacugucucacuua

SEQ ID NO: 342359 - RNA, 19 nt, Homo sapiens
gcugagugcugaugaagac

SEQ ID NO: 342360 - RNA, 19 nt, Homo sapiens
uuacgaugacucagauaua

SEQ ID NO: 342361 - RNA, 19 nt, Homo sapiens
caauuucacugucccaaaa

SEQ ID NO: 342362 - RNA, 19 nt, Homo sapiens
ggaaggaaaguuuuguuaa

SEQ ID NO: 342363 - RNA, 19 nt, Homo sapiens
cagagaugcucaaguacuc

SEQ ID NO: 342364 - RNA, 19 nt, Homo sapiens
gugacauacagccauauua

SEQ ID NO: 342365 - RNA, 19 nt, Homo sapiens
gggcauuuaucccagagau

SEQ ID NO: 342366 - RNA, 19 nt, Homo sapiens
aaacggaaacggccucaug

SEQ ID NO: 342367 - RNA, 19 nt, Homo sapiens
ccacagccacacauaguau

SEQ ID NO: 342368 - RNA, 19 nt, Homo sapiens
gagaauguggugcguaagu

SEQ ID NO: 342369 - RNA, 19 nt, Homo sapiens
cagcaccuuuggagaaugu

SEQ ID NO: 342370 - RNA, 19 nt, Homo sapiens
acaauaauucacccaguuu

SEQ ID NO: 342371 - RNA, 19 nt, Homo sapiens
ugacucagauauacucaac

SEQ ID NO: 342372 - RNA, 19 nt, Homo sapiens
cgcauggaauuaucuguau

SEQ ID NO: 342373 - RNA, 19 nt, Homo sapiens
ugaaacccgcauggaauua

SEQ ID NO: 342374 - RNA, 19 nt, Homo sapiens
gaugcuaauggccucuuua

SEQ ID NO: 342375 - RNA, 19 nt, Homo sapiens
gcaagcuauuguccucugu

SEQ ID NO: 342376 - RNA, 19 nt, Homo sapiens
cacguuagaugaauauacu

SEQ ID NO: 342377 - RNA, 19 nt, Homo sapiens
cggaaacggccucauguau

SEQ ID NO: 342378 - RNA, 19 nt, Homo sapiens
agacacagucacccaguuu

SEQ ID NO: 342379 - RNA, 19 nt, Homo sapiens
guacguggccagacacagu

SEQ ID NO: 342380 - RNA, 19 nt, Homo sapiens
ugauggcacugucucacuu

SEQ ID NO: 342381 - RNA, 19 nt, Homo sapiens
cauggaauuaucuguauga

SEQ ID NO: 342382 - RNA, 19 nt, Homo sapiens
ccgcauggaauuaucugua

SEQ ID NO: 342383 - RNA, 19 nt, Homo sapiens
uaugaaacccgcauggaau

SEQ ID NO: 342384 - RNA, 19 nt, Homo sapiens
gagaugcucaaguacucua

SEQ ID NO: 342385 - RNA, 19 nt, Homo sapiens
guauuugagucuaauccau

SEQ ID NO: 342386 - RNA, 19 nt, Homo sapiens
uccuugaucucaugacuau

SEQ ID NO: 342387 - RNA, 19 nt, Homo sapiens
acaggcagaugaaugucuu

SEQ ID NO: 342388 - RNA, 19 nt, Homo sapiens
cagacacagucacccaguu

SEQ ID NO: 342389 - RNA, 19 nt, Homo sapiens
aaagcaccacucuugauuu

SEQ ID NO: 342390 - RNA, 19 nt, Homo sapiens
cuacuuacaccgagcauag

SEQ ID NO: 342391 - RNA, 19 nt, Homo sapiens
gaggugaccaugcccuuca

SEQ ID NO: 342392 - RNA, 19 nt, Homo sapiens
ggucaugcguugagcuacu

SEQ ID NO: 342393 - RNA, 19 nt, Homo sapiens
gcaccacucuugauuuucu

SEQ ID NO: 342394 - RNA, 19 nt, Homo sapiens
cuguggagguggugacauu

SEQ ID NO: 342395 - RNA, 19 nt, Homo sapiens
caucuuguaccaucacaga

SEQ ID NO: 342396 - RNA, 19 nt, Homo sapiens
gugaagaaacugcauuguc

SEQ ID NO: 342397 - RNA, 19 nt, Homo sapiens
aagcaccacucuugauuuu

SEQ ID NO: 342398 - RNA, 19 nt, Homo sapiens
ggaaaguuuuguuaaccuu

SEQ ID NO: 342399 - RNA, 19 nt, Homo sapiens
ggugcaaucaaauggaauu

SEQ ID NO: 342400 - RNA, 19 nt, Homo sapiens
ggagcuacagucacuaugg

SEQ ID NO: 342401 - RNA, 19 nt, Homo sapiens
gccacagccacacauagua

SEQ ID NO: 342402 - RNA, 19 nt, Homo sapiens
aagcuauuguccucuguau

SEQ ID NO: 342403 - RNA, 19 nt, Homo sapiens
guuggaaugugaacaauaa

SEQ ID NO: 342404 - RNA, 19 nt, Homo sapiens
agacuucccugccguguuu

SEQ ID NO: 342405 - RNA, 19 nt, Homo sapiens
ggaaugugaacaauaaaga

SEQ ID NO: 342406 - RNA, 19 nt, Homo sapiens
caagcacacucacuuaaag

SEQ ID NO: 342407 - RNA, 19 nt, Homo sapiens
gaagaggguuguuuugguu

SEQ ID NO: 342408 - RNA, 19 nt, Homo sapiens
gaagggaagaggguuguuu

SEQ ID NO: 342409 - RNA, 19 nt, Homo sapiens
gcacacucacuuaaagaaa

SEQ ID NO: 342410 - RNA, 19 nt, Homo sapiens
gugcuggguuggaauguga

SEQ ID NO: 342411 - RNA, 19 nt, Homo sapiens
gaacugagcauuuucaaag

SEQ ID NO: 342412 - RNA, 19 nt, Homo sapiens
ccaagcacacucacuuaaa

SEQ ID NO: 342413 - RNA, 19 nt, Homo sapiens
gaacaauaaagaggaaugu

SEQ ID NO: 342414 - RNA, 19 nt, Homo sapiens
cucccaaucuuccuucuuu

SEQ ID NO: 342415 - RNA, 19 nt, Homo sapiens
gagacuaggccagaacuga

SEQ ID NO: 342416 - RNA, 19 nt, Homo sapiens
ugacugugcuggguuggaa

SEQ ID NO: 342417 - RNA, 19 nt, Homo sapiens
cuccagcucucuuguuuau

SEQ ID NO: 342418 - RNA, 19 nt, Homo sapiens
ggccagaacugagcauuuu

SEQ ID NO: 342419 - RNA, 19 nt, Homo sapiens
cgacgacauucuagacauc

SEQ ID NO: 342420 - RNA, 19 nt, Homo sapiens
ccagcucucuuguuuaugc

SEQ ID NO: 342421 - RNA, 19 nt, Homo sapiens
guucugcagucuaguaugg

SEQ ID NO: 342422 - RNA, 19 nt, Homo sapiens
gcucucuuguuuaugcaaa

SEQ ID NO: 342423 - RNA, 19 nt, Homo sapiens
ggaagaggguuguuuuggu

SEQ ID NO: 342424 - RNA, 19 nt, Homo sapiens
gguuggaaugugaacaaua

SEQ ID NO: 342425 - RNA, 19 nt, Homo sapiens
gcgcggaagaagauaaaga

SEQ ID NO: 342426 - RNA, 19 nt, Homo sapiens
ugugaacaauaaagaggaa

SEQ ID NO: 342427 - RNA, 19 nt, Homo sapiens
gaaugugaacaauaaagag

SEQ ID NO: 342428 - RNA, 19 nt, Homo sapiens
ggacgacgacauucuagac

SEQ ID NO: 342429 - RNA, 19 nt, Homo sapiens
caaaguucccgaggagaga

SEQ ID NO: 342430 - RNA, 19 nt, Homo sapiens
ggcuguggccgaaagguuu

SEQ ID NO: 342431 - RNA, 19 nt, Homo sapiens
caagccggacgacgacauu

SEQ ID NO: 342432 - RNA, 19 nt, Homo sapiens
cccaagcacacucacuuaa

SEQ ID NO: 342433 - RNA, 19 nt, Homo sapiens
uuaguucugcagucuagua

SEQ ID NO: 342434 - RNA, 19 nt, Homo sapiens
cacacucacuuaaagaaaa

SEQ ID NO: 342435 - RNA, 19 nt, Homo sapiens
gggcuguggccgaaagguu

SEQ ID NO: 342436 - RNA, 19 nt, Homo sapiens
cucuccagcucucuuguuu

SEQ ID NO: 342437 - RNA, 19 nt, Homo sapiens
ggaagagaagucccuaucc

SEQ ID NO: 342438 - RNA, 19 nt, Homo sapiens
gccggacgacgacauucua

SEQ ID NO: 342439 - RNA, 19 nt, Homo sapiens
ugaacaauaaagaggaaug

SEQ ID NO: 342440 - RNA, 19 nt, Homo sapiens
ggguuggaaugugaacaau

SEQ ID NO: 342441 - RNA, 19 nt, Homo sapiens
cggaagagaagucccuauc

SEQ ID NO: 342442 - RNA, 19 nt, Homo sapiens
uuaguuaguucugcagucu

SEQ ID NO: 342443 - RNA, 19 nt, Homo sapiens
gcaaaggccugaagaguga

SEQ ID NO: 342444 - RNA, 19 nt, Homo sapiens
gcagaauucuaaugcaaua

SEQ ID NO: 342445 - RNA, 19 nt, Homo sapiens
ggacuuguguuacuucauc

SEQ ID NO: 342446 - RNA, 19 nt, Homo sapiens
gaauuuagaugcuggucau

SEQ ID NO: 342447 - RNA, 19 nt, Homo sapiens
ccaagacaaucucgccaaa

SEQ ID NO: 342448 - RNA, 19 nt, Homo sapiens
ucacugggcuccacaccuu

SEQ ID NO: 342449 - RNA, 19 nt, Homo sapiens
acaacuagauagauuagga

SEQ ID NO: 342450 - RNA, 19 nt, Homo sapiens
ccaacaacuagauagauua

SEQ ID NO: 342451 - RNA, 19 nt, Homo sapiens
ugaugaaguuugagguaaa

SEQ ID NO: 342452 - RNA, 19 nt, Homo sapiens
caagucaugcccgaauuua

SEQ ID NO: 342453 - RNA, 19 nt, Homo sapiens
gugcagcuuuugugaauua

SEQ ID NO: 342454 - RNA, 19 nt, Homo sapiens
gcaaauauccccaaagcuu

SEQ ID NO: 342455 - RNA, 19 nt, Homo sapiens
acgguucucugcaucguua

SEQ ID NO: 342456 - RNA, 19 nt, Homo sapiens
ggagcgcgaucucuacaag

SEQ ID NO: 342457 - RNA, 19 nt, Homo sapiens
uccaacaacuagauagauu

SEQ ID NO: 342458 - RNA, 19 nt, Homo sapiens
gacgacuucugcucccuuu

SEQ ID NO: 342459 - RNA, 19 nt, Homo sapiens
guaacacauuaaagcugua

SEQ ID NO: 342460 - RNA, 19 nt, Homo sapiens
cagcccagcuccagaaugg

SEQ ID NO: 342461 - RNA, 19 nt, Homo sapiens
ggaugacaauuugcugaga

SEQ ID NO: 342462 - RNA, 19 nt, Homo sapiens
gcaaugaggcuguauuuuc

SEQ ID NO: 342463 - RNA, 19 nt, Homo sapiens
gcagcucccaccucaguuu

SEQ ID NO: 342464 - RNA, 19 nt, Homo sapiens
caaugacuuugacuugaug

SEQ ID NO: 342465 - RNA, 19 nt, Homo sapiens
uagcaaugaggcuguauuu

SEQ ID NO: 342466 - RNA, 19 nt, Homo sapiens
cuaauucucauguggauug

SEQ ID NO: 342467 - RNA, 19 nt, Homo sapiens
caaccuguaacacauuaaa

SEQ ID NO: 342468 - RNA, 19 nt, Homo sapiens
caacaacuagauagauuag

SEQ ID NO: 342469 - RNA, 19 nt, Homo sapiens
caaugaggcuguauuuuca

SEQ ID NO: 342470 - RNA, 19 nt, Homo sapiens
gaugaaguuugagguaaag

SEQ ID NO: 342471 - RNA, 19 nt, Homo sapiens
uguaugaccgcgcaaauau

SEQ ID NO: 342472 - RNA, 19 nt, Homo sapiens
ucaagucaugcccgaauuu

SEQ ID NO: 342473 - RNA, 19 nt, Homo sapiens
aggcagaauucuaaugcaa

SEQ ID NO: 342474 - RNA, 19 nt, Homo sapiens
aagacaaucucgccaaagg

SEQ ID NO: 342475 - RNA, 19 nt, Homo sapiens
gggcugaggugagacuucu

SEQ ID NO: 342476 - RNA, 19 nt, Homo sapiens
cacauccucucggccauuu

SEQ ID NO: 342477 - RNA, 19 nt, Homo sapiens
uugaugaaguuugagguaa

SEQ ID NO: 342478 - RNA, 19 nt, Homo sapiens
gagugcagcuuuugugaau

SEQ ID NO: 342479 - RNA, 19 nt, Homo sapiens
cuccugggaugacaauuug

SEQ ID NO: 342480 - RNA, 19 nt, Homo sapiens
ucugagggcugaggugaga

SEQ ID NO: 342481 - RNA, 19 nt, Homo sapiens
gaauucuaaugcaauaagc

SEQ ID NO: 342482 - RNA, 19 nt, Homo sapiens
caauauccaacaacuagau

SEQ ID NO: 342483 - RNA, 19 nt, Homo sapiens
ggccauggaauaugucaau

SEQ ID NO: 342484 - RNA, 19 nt, Homo sapiens
uucaaccuguaacacauua

SEQ ID NO: 342485 - RNA, 19 nt, Homo sapiens
cagcucccaccucaguuua

SEQ ID NO: 342486 - RNA, 19 nt, Homo sapiens
ccauggaauaugucaauga

SEQ ID NO: 342487 - RNA, 19 nt, Homo sapiens
aagcuguaauuagcaauga

SEQ ID NO: 342488 - RNA, 19 nt, Homo sapiens
ggaaaccuggguccuaguc

SEQ ID NO: 342489 - RNA, 19 nt, Homo sapiens
ugaaguccaggcagaauuc

SEQ ID NO: 342490 - RNA, 19 nt, Homo sapiens
ccaccucccaccucucuga

SEQ ID NO: 342491 - RNA, 19 nt, Homo sapiens
agucaugcccgaauuuaga

SEQ ID NO: 342492 - RNA, 19 nt, Homo sapiens
cagcaaaggccugaagagu

SEQ ID NO: 342493 - RNA, 19 nt, Homo sapiens
caaauauccccaaagcuuu

SEQ ID NO: 342494 - RNA, 19 nt, Homo sapiens
gcucccaccucaguuuagu

SEQ ID NO: 342495 - RNA, 19 nt, Homo sapiens
gcacgguucucugcaucgu

SEQ ID NO: 342496 - RNA, 19 nt, Homo sapiens
ucaguugcuuccuggacuu

SEQ ID NO: 342497 - RNA, 19 nt, Homo sapiens
gagcagcaaaggccugaag

SEQ ID NO: 342498 - RNA, 19 nt, Homo sapiens
cuuguaaccuccccauuuu

SEQ ID NO: 342499 - RNA, 19 nt, Homo sapiens
aguccaggcagaauucuaa

SEQ ID NO: 342500 - RNA, 19 nt, Homo sapiens
ucuccugggaugacaauuu

SEQ ID NO: 342501 - RNA, 19 nt, Homo sapiens
uaaagcgggaacccucuga

SEQ ID NO: 342502 - RNA, 19 nt, Homo sapiens
gccaaaggcaccuccuauc

SEQ ID NO: 342503 - RNA, 19 nt, Homo sapiens
gagagagcugugugcagaa

SEQ ID NO: 342504 - RNA, 19 nt, Homo sapiens
gccauggaauaugucaaug

SEQ ID NO: 342505 - RNA, 19 nt, Homo sapiens
cauguggauuggacgacuu

SEQ ID NO: 342506 - RNA, 19 nt, Homo sapiens
ggcagaauucuaaugcaau

SEQ ID NO: 342507 - RNA, 19 nt, Homo sapiens
gacaauuugcugagagagu

SEQ ID NO: 342508 - RNA, 19 nt, Homo sapiens
ucugcucccuuuccaguuc

SEQ ID NO: 342509 - RNA, 19 nt, Homo sapiens
ucucggccauuucugaagu

SEQ ID NO: 342510 - RNA, 19 nt, Homo sapiens
gcgcaaauauccccaaagc

SEQ ID NO: 342511 - RNA, 19 nt, Homo sapiens
caaaggcaccuccuauccu

SEQ ID NO: 342512 - RNA, 19 nt, Homo sapiens
ccaaaggcaccuccuaucc

SEQ ID NO: 342513 - RNA, 19 nt, Homo sapiens
caagaaguccccaagacaa

SEQ ID NO: 342514 - RNA, 19 nt, Homo sapiens
gcagcaaaggccugaagag

SEQ ID NO: 342515 - RNA, 19 nt, Homo sapiens
uaggaccucuauccgagau

SEQ ID NO: 342516 - RNA, 19 nt, Homo sapiens
gcuuguaaccuccccauuu

SEQ ID NO: 342517 - RNA, 19 nt, Homo sapiens
aaacccagcccacaugacu

SEQ ID NO: 342518 - RNA, 19 nt, Homo sapiens
gcuccgugcuguccaucug

SEQ ID NO: 342519 - RNA, 19 nt, Homo sapiens
caaggaagauguauuugua

SEQ ID NO: 342520 - RNA, 19 nt, Homo sapiens
gaacggauaugguuucauc

SEQ ID NO: 342521 - RNA, 19 nt, Homo sapiens
gauuggagcugaagaccua

SEQ ID NO: 342522 - RNA, 19 nt, Homo sapiens
cagcagaccguaaccauua

SEQ ID NO: 342523 - RNA, 19 nt, Homo sapiens
gaaauuccagcaauaagaa

SEQ ID NO: 342524 - RNA, 19 nt, Homo sapiens
gagagacuguggaguuuga

SEQ ID NO: 342525 - RNA, 19 nt, Homo sapiens
ggacggcaaugaagaagau

SEQ ID NO: 342526 - RNA, 19 nt, Homo sapiens
gaacaagguagaccaguga

SEQ ID NO: 342527 - RNA, 19 nt, Homo sapiens
ggaguuugauguuguugaa

SEQ ID NO: 342528 - RNA, 19 nt, Homo sapiens
ggaaugacaccaaggaaga

SEQ ID NO: 342529 - RNA, 19 nt, Homo sapiens
uaaaagaccucuacaagga

SEQ ID NO: 342530 - RNA, 19 nt, Homo sapiens
ccaacaagaagaaauauga

SEQ ID NO: 342531 - RNA, 19 nt, Homo sapiens
gcaaugaagaagauaaaga

SEQ ID NO: 342532 - RNA, 19 nt, Homo sapiens
ggauaugguuucaucaaca

SEQ ID NO: 342533 - RNA, 19 nt, Homo sapiens
ccggaaauaccuagaaaua

SEQ ID NO: 342534 - RNA, 19 nt, Homo sapiens
caaccagggugcaggagaa

SEQ ID NO: 342535 - RNA, 19 nt, Homo sapiens
agaacuaucugcauuaucu

SEQ ID NO: 342536 - RNA, 19 nt, Homo sapiens
guaaggaacggauaugguu

SEQ ID NO: 342537 - RNA, 19 nt, Homo sapiens
cugaguaaaugccggcuua

SEQ ID NO: 342538 - RNA, 19 nt, Homo sapiens
gaccagauaaauagaacua

SEQ ID NO: 342539 - RNA, 19 nt, Homo sapiens
cauccaacaagaagaaaua

SEQ ID NO: 342540 - RNA, 19 nt, Homo sapiens
caccaaggaagauguauuu

SEQ ID NO: 342541 - RNA, 19 nt, Homo sapiens
ccagugaggcagauaugua

SEQ ID NO: 342542 - RNA, 19 nt, Homo sapiens
guucaaggcaguaaauaug

SEQ ID NO: 342543 - RNA, 19 nt, Homo sapiens
gcggaggcagcaaauguua

SEQ ID NO: 342544 - RNA, 19 nt, Homo sapiens
agacugccauaaagaagaa

SEQ ID NO: 342545 - RNA, 19 nt, Homo sapiens
ugaaauuccagcaauaaga

SEQ ID NO: 342546 - RNA, 19 nt, Homo sapiens
cgacgcagacgcccagaaa

SEQ ID NO: 342547 - RNA, 19 nt, Homo sapiens
gaacuaucugcauuaucua

SEQ ID NO: 342548 - RNA, 19 nt, Homo sapiens
gagcugaagaccuaaagug

SEQ ID NO: 342549 - RNA, 19 nt, Homo sapiens
guucccaccuuacuacaug

SEQ ID NO: 342550 - RNA, 19 nt, Homo sapiens
cugaagaccuaaagugcuu

SEQ ID NO: 342551 - RNA, 19 nt, Homo sapiens
gagaggacggcaaugaaga

SEQ ID NO: 342552 - RNA, 19 nt, Homo sapiens
gcagaccguaaccauuaua

SEQ ID NO: 342553 - RNA, 19 nt, Homo sapiens
gcagcagaccguaaccauu

SEQ ID NO: 342554 - RNA, 19 nt, Homo sapiens
cggaaauaccuagaaauaa

SEQ ID NO: 342555 - RNA, 19 nt, Homo sapiens
cagcaaaauuaccagaaua

SEQ ID NO: 342556 - RNA, 19 nt, Homo sapiens
uggagagacuguggaguuu

SEQ ID NO: 342557 - RNA, 19 nt, Homo sapiens
gauaugguuucaucaacag

SEQ ID NO: 342558 - RNA, 19 nt, Homo sapiens
acaccagacugccauaaag

SEQ ID NO: 342559 - RNA, 19 nt, Homo sapiens
ccaaggaagauguauuugu

SEQ ID NO: 342560 - RNA, 19 nt, Homo sapiens
gauggagggugcugacaac

SEQ ID NO: 342561 - RNA, 19 nt, Homo sapiens
ccacgcaauuaccagcaaa

SEQ ID NO: 342562 - RNA, 19 nt, Homo sapiens
gggcgucgaccacaguauu

SEQ ID NO: 342563 - RNA, 19 nt, Homo sapiens
ggaggcagcaaauguuaca

SEQ ID NO: 342564 - RNA, 19 nt, Homo sapiens
ggauauagaccacgauucc

SEQ ID NO: 342565 - RNA, 19 nt, Homo sapiens
cgccggaaauaccuagaaa

SEQ ID NO: 342566 - RNA, 19 nt, Homo sapiens
uaaggaacggauaugguuu

SEQ ID NO: 342567 - RNA, 19 nt, Homo sapiens
uaacugaggauguaaaaga

SEQ ID NO: 342568 - RNA, 19 nt, Homo sapiens
uaccaucucuaccaucauc

SEQ ID NO: 342569 - RNA, 19 nt, Homo sapiens
cuagagaggacggcaauga

SEQ ID NO: 342570 - RNA, 19 nt, Homo sapiens
ugacaccaaggaagaugua

SEQ ID NO: 342571 - RNA, 19 nt, Homo sapiens
agaaggucaucgcaacgaa

SEQ ID NO: 342572 - RNA, 19 nt, Homo sapiens
gaaaugaacaaaagauugg

SEQ ID NO: 342573 - RNA, 19 nt, Homo sapiens
uguaggagauggagagacu

SEQ ID NO: 342574 - RNA, 19 nt, Homo sapiens
cuuaccaucucuaccauca

SEQ ID NO: 342575 - RNA, 19 nt, Homo sapiens
gaacgagggaucggagagu

SEQ ID NO: 342576 - RNA, 19 nt, Homo sapiens
ucaaggcaguaaauaugca

SEQ ID NO: 342577 - RNA, 19 nt, Homo sapiens
guacaccagacugccauaa

SEQ ID NO: 342578 - RNA, 19 nt, Homo sapiens
aauagucacgccggaaaua

SEQ ID NO: 342579 - RNA, 19 nt, Homo sapiens
caagauggcaaagagacaa

SEQ ID NO: 342580 - RNA, 19 nt, Homo sapiens
ccacaagauggcaaagaga

SEQ ID NO: 342581 - RNA, 19 nt, Homo sapiens
uagagaggacggcaaugaa

SEQ ID NO: 342582 - RNA, 19 nt, Homo sapiens
gaccguaaccauuauagac

SEQ ID NO: 342583 - RNA, 19 nt, Homo sapiens
gugcggaggcagcaaaugu

SEQ ID NO: 342584 - RNA, 19 nt, Homo sapiens
cccguugaccagauaaaua

SEQ ID NO: 342585 - RNA, 19 nt, Homo sapiens
ggagagacuguggaguuug

SEQ ID NO: 342586 - RNA, 19 nt, Homo sapiens
caauguaaggaacggauau

SEQ ID NO: 342587 - RNA, 19 nt, Homo sapiens
gaaugacaccaaggaagau

SEQ ID NO: 342588 - RNA, 19 nt, Homo sapiens
guuuagucauccaacaaga

SEQ ID NO: 342589 - RNA, 19 nt, Homo sapiens
cggcaaugaagaagauaaa

SEQ ID NO: 342590 - RNA, 19 nt, Homo sapiens
ucaauguaaggaacggaua

SEQ ID NO: 342591 - RNA, 19 nt, Homo sapiens
acaauagucacgccggaaa

SEQ ID NO: 342592 - RNA, 19 nt, Homo sapiens
ggucaucgcaacgaagguu

SEQ ID NO: 342593 - RNA, 19 nt, Homo sapiens
uaaaccacaagauggcaaa

SEQ ID NO: 342594 - RNA, 19 nt, Homo sapiens
cagugaggcagauauguau

SEQ ID NO: 342595 - RNA, 19 nt, Homo sapiens
ccaguucaaggcaguaaau

SEQ ID NO: 342596 - RNA, 19 nt, Homo sapiens
ugauguuguugaaggagaa

SEQ ID NO: 342597 - RNA, 19 nt, Homo sapiens
gaccagugaggcagauaug

SEQ ID NO: 342598 - RNA, 19 nt, Homo sapiens
caccagacugccauaaaga

SEQ ID NO: 342599 - RNA, 19 nt, Homo sapiens
ucuaccaucauccgguuua

SEQ ID NO: 342600 - RNA, 19 nt, Homo sapiens
acaguaaaaugguucaaug

SEQ ID NO: 342601 - RNA, 19 nt, Homo sapiens
ggucagcagccaccucaag

SEQ ID NO: 342602 - RNA, 19 nt, Homo sapiens
gaaaaucaaggagaugaga

SEQ ID NO: 342603 - RNA, 19 nt, Homo sapiens
guagaccagugaggcagau

SEQ ID NO: 342604 - RNA, 19 nt, Homo sapiens
cagacugccauaaagaaga

SEQ ID NO: 342605 - RNA, 19 nt, Homo sapiens
agaaaacccuaaaccacaa

SEQ ID NO: 342606 - RNA, 19 nt, Homo sapiens
agaggacggcaaugaagaa

SEQ ID NO: 342607 - RNA, 19 nt, Homo sapiens
ccagggugcaggagaacaa

SEQ ID NO: 342608 - RNA, 19 nt, Homo sapiens
caaaauuaccagaauagug

SEQ ID NO: 342609 - RNA, 19 nt, Homo sapiens
cggauaugguuucaucaac

SEQ ID NO: 342610 - RNA, 19 nt, Homo sapiens
agaauaaccccaggaagua

SEQ ID NO: 342611 - RNA, 19 nt, Homo sapiens
guugaccagauaaauagaa

SEQ ID NO: 342612 - RNA, 19 nt, Homo sapiens
ccagcaaaauuaccagaau

SEQ ID NO: 342613 - RNA, 19 nt, Homo sapiens
gcacaaaccaagaagauua

SEQ ID NO: 342614 - RNA, 19 nt, Homo sapiens
gaaaaucgccaaucaauua

SEQ ID NO: 342615 - RNA, 19 nt, Homo sapiens
ggaaugcaauaaagaguaa

SEQ ID NO: 342616 - RNA, 19 nt, Homo sapiens
gagauaggcuugccagaug

SEQ ID NO: 342617 - RNA, 19 nt, Homo sapiens
caagauggcagcagaauuu

SEQ ID NO: 342618 - RNA, 19 nt, Homo sapiens
gaaguggauuguauuguga

SEQ ID NO: 342619 - RNA, 19 nt, Homo sapiens
ggguguggcuccucuguua

SEQ ID NO: 342620 - RNA, 19 nt, Homo sapiens
ugacuuagcaggaauuuaa

SEQ ID NO: 342621 - RNA, 19 nt, Homo sapiens
ggauaggaaucaagaaguu

SEQ ID NO: 342622 - RNA, 19 nt, Homo sapiens
gaucuguucuccugauaaa

SEQ ID NO: 342623 - RNA, 19 nt, Homo sapiens
gcagauggguuguauacau

SEQ ID NO: 342624 - RNA, 19 nt, Homo sapiens
gcagaaaauucgucacuua

SEQ ID NO: 342625 - RNA, 19 nt, Homo sapiens
gagcauugcauucaguuua

SEQ ID NO: 342626 - RNA, 19 nt, Homo sapiens
aaucacagguacacauuua

SEQ ID NO: 342627 - RNA, 19 nt, Homo sapiens
ccaagaagauuaugcaagu

SEQ ID NO: 342628 - RNA, 19 nt, Homo sapiens
uaacaaauaugugggagaa

SEQ ID NO: 342629 - RNA, 19 nt, Homo sapiens
uuaaaggcauccuguuaua

SEQ ID NO: 342630 - RNA, 19 nt, Homo sapiens
gcaaugacuccaacccuua

SEQ ID NO: 342631 - RNA, 19 nt, Homo sapiens
ggucaauuccuuaguauaa

SEQ ID NO: 342632 - RNA, 19 nt, Homo sapiens
caauagaccagaucugaua

SEQ ID NO: 342633 - RNA, 19 nt, Homo sapiens
gcaauuagaagccauccua

SEQ ID NO: 342634 - RNA, 19 nt, Homo sapiens
agaaauagaagucuccuua

SEQ ID NO: 342635 - RNA, 19 nt, Homo sapiens
gguaagagauaugcucauu

SEQ ID NO: 342636 - RNA, 19 nt, Homo sapiens
gagaaaggccgacuacaga

SEQ ID NO: 342637 - RNA, 19 nt, Homo sapiens
gagauaugcucauuauuac

SEQ ID NO: 342638 - RNA, 19 nt, Homo sapiens
gaagaaacaaggcauugaa

SEQ ID NO: 342639 - RNA, 19 nt, Homo sapiens
gcauuugccuuccgaguau

SEQ ID NO: 342640 - RNA, 19 nt, Homo sapiens
caagauguccuacagauga

SEQ ID NO: 342641 - RNA, 19 nt, Homo sapiens
augcaaaucuggcuuagua

SEQ ID NO: 342642 - RNA, 19 nt, Homo sapiens
gagacuuccuugcuucuuu

SEQ ID NO: 342643 - RNA, 19 nt, Homo sapiens
gcagaagauugaaguagga

SEQ ID NO: 342644 - RNA, 19 nt, Homo sapiens
ggccagaaauccuuaacaa

SEQ ID NO: 342645 - RNA, 19 nt, Homo sapiens
caaaugaaggaaugcaaua

SEQ ID NO: 342646 - RNA, 19 nt, Homo sapiens
cuaaagugauuccuucuug

SEQ ID NO: 342647 - RNA, 19 nt, Homo sapiens
ggaaggcccuccucacagu

SEQ ID NO: 342648 - RNA, 19 nt, Homo sapiens
ccagaaauccuuaacaaau

SEQ ID NO: 342649 - RNA, 19 nt, Homo sapiens
uuaaaggucucccacaaga

SEQ ID NO: 342650 - RNA, 19 nt, Homo sapiens
gaucuucacugucuuacuc

SEQ ID NO: 342651 - RNA, 19 nt, Homo sapiens
uggaaaugcuuaacgcuuu

SEQ ID NO: 342652 - RNA, 19 nt, Homo sapiens
gaaacaaggcauugaaucu

SEQ ID NO: 342653 - RNA, 19 nt, Homo sapiens
gaugucauaucuucuuugu

SEQ ID NO: 342654 - RNA, 19 nt, Homo sapiens
ccaagugggucaauuccuu

SEQ ID NO: 342655 - RNA, 19 nt, Homo sapiens
gcaaaucuggcuuaguaaa

SEQ ID NO: 342656 - RNA, 19 nt, Homo sapiens
ggcaagauguugaaugcaa

SEQ ID NO: 342657 - RNA, 19 nt, Homo sapiens
ugacaaagccaaacagugu

SEQ ID NO: 342658 - RNA, 19 nt, Homo sapiens
gaagucuccuuauauacau

SEQ ID NO: 342659 - RNA, 19 nt, Homo sapiens
caugaaagcagcacacauu

SEQ ID NO: 342660 - RNA, 19 nt, Homo sapiens
ucagaugacuaccguguug

SEQ ID NO: 342661 - RNA, 19 nt, Homo sapiens
gaaggugucaauuugguuu

SEQ ID NO: 342662 - RNA, 19 nt, Homo sapiens
gaaaggccgacuacagauu

SEQ ID NO: 342663 - RNA, 19 nt, Homo sapiens
aaaggaggcuuggugcuaa

SEQ ID NO: 342664 - RNA, 19 nt, Homo sapiens
ucucuuggcucgacagauu

SEQ ID NO: 342665 - RNA, 19 nt, Homo sapiens
gaaauagaagucuccuuau

SEQ ID NO: 342666 - RNA, 19 nt, Homo sapiens
gggcugggcuuucuauugg

SEQ ID NO: 342667 - RNA, 19 nt, Homo sapiens
gcauucaguuuaccucaga

SEQ ID NO: 342668 - RNA, 19 nt, Homo sapiens
gcaaggacaagcaauuaga

SEQ ID NO: 342669 - RNA, 19 nt, Homo sapiens
guaagagauaugcucauua

SEQ ID NO: 342670 - RNA, 19 nt, Homo sapiens
gguuaaaggucucccacaa

SEQ ID NO: 342671 - RNA, 19 nt, Homo sapiens
ggaaucaagaaguuacuaa

SEQ ID NO: 342672 - RNA, 19 nt, Homo sapiens
aagaaggucuggauaggaa

SEQ ID NO: 342673 - RNA, 19 nt, Homo sapiens
ggaagaaggucuggauagg

SEQ ID NO: 342674 - RNA, 19 nt, Homo sapiens
guuacucucugcugaugua

SEQ ID NO: 342675 - RNA, 19 nt, Homo sapiens
gauggcagcagaauuuauu

SEQ ID NO: 342676 - RNA, 19 nt, Homo sapiens
acaaaccucucagcacuaa

SEQ ID NO: 342677 - RNA, 19 nt, Homo sapiens
guccugagcuaacacuaaa

SEQ ID NO: 342678 - RNA, 19 nt, Homo sapiens
cguggaaggugucaauuug

SEQ ID NO: 342679 - RNA, 19 nt, Homo sapiens
gacaaggaauuuucagaua

SEQ ID NO: 342680 - RNA, 19 nt, Homo sapiens
uuacuaguaucacugcuuu

SEQ ID NO: 342681 - RNA, 19 nt, Homo sapiens
gugggucaauuccuuagua

SEQ ID NO: 342682 - RNA, 19 nt, Homo sapiens
ccacaagacugguauucuc

SEQ ID NO: 342683 - RNA, 19 nt, Homo sapiens
gaauccaacuucccguuca

SEQ ID NO: 342684 - RNA, 19 nt, Homo sapiens
gaaguaggacugguuguug

SEQ ID NO: 342685 - RNA, 19 nt, Homo sapiens
cuaauuugcucugugguaa

SEQ ID NO: 342686 - RNA, 19 nt, Homo sapiens
gaaggcagacuuucuacau

SEQ ID NO: 342687 - RNA, 19 nt, Homo sapiens
gcgcuuaccuucccaugca

SEQ ID NO: 342688 - RNA, 19 nt, Homo sapiens
caagggaagugaccaaggu

SEQ ID NO: 342689 - RNA, 19 nt, Homo sapiens
gcaagcuucuuaucauugg

SEQ ID NO: 342690 - RNA, 19 nt, Homo sapiens
uggaugacauugagagauu

SEQ ID NO: 342691 - RNA, 19 nt, Homo sapiens
gaaaauucgucacuuaauc

SEQ ID NO: 342692 - RNA, 19 nt, Homo sapiens
agacuuggaugucauaucu

SEQ ID NO: 342693 - RNA, 19 nt, Homo sapiens
ccacuuagaagauguuguu

SEQ ID NO: 342694 - RNA, 19 nt, Homo sapiens
ggaacguucucuaccuuca

SEQ ID NO: 342695 - RNA, 19 nt, Homo sapiens
gauaggaaucaagaaguua

SEQ ID NO: 342696 - RNA, 19 nt, Homo sapiens
ggacauggagaaagcagaa

SEQ ID NO: 342697 - RNA, 19 nt, Homo sapiens
aaugagagggcaucaguua

SEQ ID NO: 342698 - RNA, 19 nt, Homo sapiens
gcuaacauucgcaaacuuu

SEQ ID NO: 342699 - RNA, 19 nt, Homo sapiens
agaaguggauuguauugug

SEQ ID NO: 342700 - RNA, 19 nt, Homo sapiens
acagauggauccugaauac

SEQ ID NO: 342701 - RNA, 19 nt, Homo sapiens
ugaacgguaucaucaaaug

SEQ ID NO: 342702 - RNA, 19 nt, Homo sapiens
cauaaaggccaguacuaaa

SEQ ID NO: 342703 - RNA, 19 nt, Homo sapiens
caaaggaggcuuggugcua

SEQ ID NO: 342704 - RNA, 19 nt, Homo sapiens
ggcaagauguccuacagau

SEQ ID NO: 342705 - RNA, 19 nt, Homo sapiens
ggaaaaggcagaagauuga

SEQ ID NO: 342706 - RNA, 19 nt, Homo sapiens
ugaaagauagguauggaaa

SEQ ID NO: 342707 - RNA, 19 nt, Homo sapiens
ucaagauacuggacuaagu

SEQ ID NO: 342708 - RNA, 19 nt, Homo sapiens
caagaucuguucuccugau

SEQ ID NO: 342709 - RNA, 19 nt, Homo sapiens
uuucuucccuagcuuauuu

SEQ ID NO: 342710 - RNA, 19 nt, Homo sapiens
gauccugaauaccguguga

SEQ ID NO: 342711 - RNA, 19 nt, Homo sapiens
ggagaaugauaucaaacca

SEQ ID NO: 342712 - RNA, 19 nt, Homo sapiens
cagauggguuguauacaug

SEQ ID NO: 342713 - RNA, 19 nt, Homo sapiens
gaaccuggcugcuguauug

SEQ ID NO: 342714 - RNA, 19 nt, Homo sapiens
gcucagcucugcauaagua

SEQ ID NO: 342715 - RNA, 19 nt, Homo sapiens
ggagauggguuccagauga

SEQ ID NO: 342716 - RNA, 19 nt, Homo sapiens
gaagagacagacaugauua

SEQ ID NO: 342717 - RNA, 19 nt, Homo sapiens
ggaaaucccauucuucuaa

SEQ ID NO: 342718 - RNA, 19 nt, Homo sapiens
gaaaugaccuaugcccaaa

SEQ ID NO: 342719 - RNA, 19 nt, Homo sapiens
ggaagucacugccauggaa

SEQ ID NO: 342720 - RNA, 19 nt, Homo sapiens
gaacucaaguccagcauuc

SEQ ID NO: 342721 - RNA, 19 nt, Homo sapiens
gaaaucccauucuucuaaa

SEQ ID NO: 342722 - RNA, 19 nt, Homo sapiens
ugaaaucacugcauuacaa

SEQ ID NO: 342723 - RNA, 19 nt, Homo sapiens
gaaccacuuugcaauugua

SEQ ID NO: 342724 - RNA, 19 nt, Homo sapiens
ggcauuagcuguuauuuua

SEQ ID NO: 342725 - RNA, 19 nt, Homo sapiens
ugacaaaucucugcuuuau

SEQ ID NO: 342726 - RNA, 19 nt, Homo sapiens
ggacuuuauuugccauaua

SEQ ID NO: 342727 - RNA, 19 nt, Homo sapiens
gaugacaaaucucugcuuu

SEQ ID NO: 342728 - RNA, 19 nt, Homo sapiens
ggagaaagccaacuauguu

SEQ ID NO: 342729 - RNA, 19 nt, Homo sapiens
caacgugguuucuacauau

SEQ ID NO: 342730 - RNA, 19 nt, Homo sapiens
gcaaauaccuaggcuaucu

SEQ ID NO: 342731 - RNA, 19 nt, Homo sapiens
gcaagaggcuagcacugaa

SEQ ID NO: 342732 - RNA, 19 nt, Homo sapiens
gagaaagccaacuauguua

SEQ ID NO: 342733 - RNA, 19 nt, Homo sapiens
agacagaguagucaaauua

SEQ ID NO: 342734 - RNA, 19 nt, Homo sapiens
guagcaagcuguaguagau

SEQ ID NO: 342735 - RNA, 19 nt, Homo sapiens
ucuccucucuucauaauua

SEQ ID NO: 342736 - RNA, 19 nt, Homo sapiens
gaggaaacgucaucucuuc

SEQ ID NO: 342737 - RNA, 19 nt, Homo sapiens
ccacuagcaucucaaauau

SEQ ID NO: 342738 - RNA, 19 nt, Homo sapiens
gaagugguauaagaaauga

SEQ ID NO: 342739 - RNA, 19 nt, Homo sapiens
gcugaagguuagagcauua

SEQ ID NO: 342740 - RNA, 19 nt, Homo sapiens
gugcaaacauuaaagcaaa

SEQ ID NO: 342741 - RNA, 19 nt, Homo sapiens
uaagcacacugucucauuu

SEQ ID NO: 342742 - RNA, 19 nt, Homo sapiens
ucagcaaccuagugaguua

SEQ ID NO: 342743 - RNA, 19 nt, Homo sapiens
ggaaguauguuuguuucuu

SEQ ID NO: 342744 - RNA, 19 nt, Homo sapiens
gaauccaugugguguauga

SEQ ID NO: 342745 - RNA, 19 nt, Homo sapiens
gaagaucgaguuugaugaa

SEQ ID NO: 342746 - RNA, 19 nt, Homo sapiens
agacagacaugauuacuca

SEQ ID NO: 342747 - RNA, 19 nt, Homo sapiens
gaucgaguuugaugaaaga

SEQ ID NO: 342748 - RNA, 19 nt, Homo sapiens
ggauacacuuccaaagaaa

SEQ ID NO: 342749 - RNA, 19 nt, Homo sapiens
caacacauuucuuuacaca

SEQ ID NO: 342750 - RNA, 19 nt, Homo sapiens
gaagaaggccuuugagcau

SEQ ID NO: 342751 - RNA, 19 nt, Homo sapiens
cuuaauaucuccucucuuc

SEQ ID NO: 342752 - RNA, 19 nt, Homo sapiens
ggguaaauccuauuagaaa

SEQ ID NO: 342753 - RNA, 19 nt, Homo sapiens
gccacuagcaucucaaaua

SEQ ID NO: 342754 - RNA, 19 nt, Homo sapiens
cacacugucucauuugaua

SEQ ID NO: 342755 - RNA, 19 nt, Homo sapiens
gaagguuagagcauuauaa

SEQ ID NO: 342756 - RNA, 19 nt, Homo sapiens
cauggaagcuuuucuuuaa

SEQ ID NO: 342757 - RNA, 19 nt, Homo sapiens
gcaauccaccuuccaaaga

SEQ ID NO: 342758 - RNA, 19 nt, Homo sapiens
ucaacgugguuucuacaua

SEQ ID NO: 342759 - RNA, 19 nt, Homo sapiens
gagacagaguagucaaauu

SEQ ID NO: 342760 - RNA, 19 nt, Homo sapiens
ccuagaagcugaagguuag

SEQ ID NO: 342761 - RNA, 19 nt, Homo sapiens
caacaugggcaaccugauu

SEQ ID NO: 342762 - RNA, 19 nt, Homo sapiens
ugaaauggauaaacucauc

SEQ ID NO: 342763 - RNA, 19 nt, Homo sapiens
gaagguaucaugagaagag

SEQ ID NO: 342764 - RNA, 19 nt, Homo sapiens
ccaggacuguuuuauauua

SEQ ID NO: 342765 - RNA, 19 nt, Homo sapiens
ucucaaauaucaggacuuu

SEQ ID NO: 342766 - RNA, 19 nt, Homo sapiens
caaguuacuguucagaaua

SEQ ID NO: 342767 - RNA, 19 nt, Homo sapiens
ucacugccauggaagcuuu

SEQ ID NO: 342768 - RNA, 19 nt, Homo sapiens
gauaggaaguauguuuguu

SEQ ID NO: 342769 - RNA, 19 nt, Homo sapiens
gauccaagaccuagaccua

SEQ ID NO: 342770 - RNA, 19 nt, Homo sapiens
gauuugugaugcaaugauu

SEQ ID NO: 342771 - RNA, 19 nt, Homo sapiens
ggaaguacccauucauagu

SEQ ID NO: 342772 - RNA, 19 nt, Homo sapiens
ggcuagcacugaauucauu

SEQ ID NO: 342773 - RNA, 19 nt, Homo sapiens
ucaaguuacuguucagaau

SEQ ID NO: 342774 - RNA, 19 nt, Homo sapiens
ccagcauucucaacuauau

SEQ ID NO: 342775 - RNA, 19 nt, Homo sapiens
aagaaggccuuugagcaua

SEQ ID NO: 342776 - RNA, 19 nt, Homo sapiens
ggaaaacaauugucuaucu

SEQ ID NO: 342777 - RNA, 19 nt, Homo sapiens
cauagucacuucugaugau

SEQ ID NO: 342778 - RNA, 19 nt, Homo sapiens
aagaugaaaucacugcauu

SEQ ID NO: 342779 - RNA, 19 nt, Homo sapiens
gcagugaucuuuguuuuau

SEQ ID NO: 342780 - RNA, 19 nt, Homo sapiens
gugaugcaaugauuaacaa

SEQ ID NO: 342781 - RNA, 19 nt, Homo sapiens
ucaaaggacacgagagaaa

SEQ ID NO: 342782 - RNA, 19 nt, Homo sapiens
gagauggguuccagaugau

SEQ ID NO: 342783 - RNA, 19 nt, Homo sapiens
gguauccggucgcccauug

SEQ ID NO: 342784 - RNA, 19 nt, Homo sapiens
gaaguacccauucauaguc

SEQ ID NO: 342785 - RNA, 19 nt, Homo sapiens
acuagcaucucaaauauca

SEQ ID NO: 342786 - RNA, 19 nt, Homo sapiens
gccagaggcugcaaagaca

SEQ ID NO: 342787 - RNA, 19 nt, Homo sapiens
cuccaaaucugaacaguca

SEQ ID NO: 342788 - RNA, 19 nt, Homo sapiens
aaagagcauuuacacaugu

SEQ ID NO: 342789 - RNA, 19 nt, Homo sapiens
gcaacacccaugugccuuu

SEQ ID NO: 342790 - RNA, 19 nt, Homo sapiens
aauaucuccucucuucaua

SEQ ID NO: 342791 - RNA, 19 nt, Homo sapiens
gaucgagccacuccucaaa

SEQ ID NO: 342792 - RNA, 19 nt, Homo sapiens
cgucaucucuucccaugga

SEQ ID NO: 342793 - RNA, 19 nt, Homo sapiens
ucaaauccagggacaaauu

SEQ ID NO: 342794 - RNA, 19 nt, Homo sapiens
ucaccaagguucagcagau

SEQ ID NO: 342795 - RNA, 19 nt, Homo sapiens
cuaaaucuguguguguauu

SEQ ID NO: 342796 - RNA, 19 nt, Homo sapiens
aauaauagccucgguucua

SEQ ID NO: 342797 - RNA, 19 nt, Homo sapiens
gcccaaagaacaaauacuu

SEQ ID NO: 342798 - RNA, 19 nt, Homo sapiens
gcccagauaugagaacuuc

SEQ ID NO: 342799 - RNA, 19 nt, Homo sapiens
caaacuuccuggccaaugg

SEQ ID NO: 342800 - RNA, 19 nt, Homo sapiens
guagucaaauuagauguuc

SEQ ID NO: 342801 - RNA, 19 nt, Homo sapiens
ucucaaucaugccgcuuua

SEQ ID NO: 342802 - RNA, 19 nt, Homo sapiens
agggacaaauuuaguguuu

SEQ ID NO: 342803 - RNA, 19 nt, Homo sapiens
cauuugauauccacaacuu

SEQ ID NO: 342804 - RNA, 19 nt, Homo sapiens
aaguuuacguguccaaauu

SEQ ID NO: 342805 - RNA, 19 nt, Homo sapiens
caagauaucaacgugguuu

SEQ ID NO: 342806 - RNA, 19 nt, Homo sapiens
guagauucccaacaauaaa

SEQ ID NO: 342807 - RNA, 19 nt, Homo sapiens
augcauauauggauugcua

SEQ ID NO: 342808 - RNA, 19 nt, Homo sapiens
cugcauaaguaauucaaga

SEQ ID NO: 342809 - RNA, 19 nt, Homo sapiens
caagagcuaaagagcauuu

SEQ ID NO: 342810 - RNA, 19 nt, Homo sapiens
caacacccaugugccuuug

SEQ ID NO: 342811 - RNA, 19 nt, Homo sapiens
gaaagccaacuauguuaag

SEQ ID NO: 342812 - RNA, 19 nt, Homo sapiens
gugaugaaguugugggaau

SEQ ID NO: 342813 - RNA, 19 nt, Homo sapiens
gggcaacucucccgucaaa

SEQ ID NO: 342814 - RNA, 19 nt, Homo sapiens
ccagaagacucgcucaauu

SEQ ID NO: 342815 - RNA, 19 nt, Homo sapiens
cagcaacccuacaguauau

SEQ ID NO: 342816 - RNA, 19 nt, Homo sapiens
gcauguagcauauaaaugu

SEQ ID NO: 342817 - RNA, 19 nt, Homo sapiens
gaacugcugcgacaacaga

SEQ ID NO: 342818 - RNA, 19 nt, Homo sapiens
guaacaacauggaucaaag

SEQ ID NO: 342819 - RNA, 19 nt, Homo sapiens
gaacaugaauuggcaucuc

SEQ ID NO: 342820 - RNA, 19 nt, Homo sapiens
caacagagacgcuacaacu

SEQ ID NO: 342821 - RNA, 19 nt, Homo sapiens
gcucaauucccucauuauu

SEQ ID NO: 342822 - RNA, 19 nt, Homo sapiens
ugacuucagagaacaauaa

SEQ ID NO: 342823 - RNA, 19 nt, Homo sapiens
gcagggguauugaugauaa

SEQ ID NO: 342824 - RNA, 19 nt, Homo sapiens
ucgcucaauucccucauua

SEQ ID NO: 342825 - RNA, 19 nt, Homo sapiens
gcaacccuacaguauauaa

SEQ ID NO: 342826 - RNA, 19 nt, Homo sapiens
gcaacucucccgucaaaca

SEQ ID NO: 342827 - RNA, 19 nt, Homo sapiens
cauccaagguaacaacaug

SEQ ID NO: 342828 - RNA, 19 nt, Homo sapiens
ucagcaacccuacaguaua

SEQ ID NO: 342829 - RNA, 19 nt, Homo sapiens
gaugguggacguuaaggaa

SEQ ID NO: 342830 - RNA, 19 nt, Homo sapiens
cucaauucccucauuauua

SEQ ID NO: 342831 - RNA, 19 nt, Homo sapiens
ugaacaaggugauguccau

SEQ ID NO: 342832 - RNA, 19 nt, Homo sapiens
gguaacaacauggaucaaa

SEQ ID NO: 342833 - RNA, 19 nt, Homo sapiens
cagaagacucgcucaauuc

SEQ ID NO: 342834 - RNA, 19 nt, Homo sapiens
gggaguacucgguauguga

SEQ ID NO: 342835 - RNA, 19 nt, Homo sapiens
uguaucucauggaggauua

SEQ ID NO: 342836 - RNA, 19 nt, Homo sapiens
aaaggaguuugccagaaga

SEQ ID NO: 342837 - RNA, 19 nt, Homo sapiens
ugugauauuucucgcuuau

SEQ ID NO: 342838 - RNA, 19 nt, Homo sapiens
uggcaucucuccccauaua

SEQ ID NO: 342839 - RNA, 19 nt, Homo sapiens
aaaacaagcucuccaagca

SEQ ID NO: 342840 - RNA, 19 nt, Homo sapiens
acucucccgucaaacaaua

SEQ ID NO: 342841 - RNA, 19 nt, Homo sapiens
ccuacaguauauaagcuuu

SEQ ID NO: 342842 - RNA, 19 nt, Homo sapiens
caacucucccgucaaacaa

SEQ ID NO: 342843 - RNA, 19 nt, Homo sapiens
gugugugccuugucgagaa

SEQ ID NO: 342844 - RNA, 19 nt, Homo sapiens
acagagacgcuacaacuca

SEQ ID NO: 342845 - RNA, 19 nt, Homo sapiens
gaacaucacggcggaaacg

SEQ ID NO: 342846 - RNA, 19 nt, Homo sapiens
gcugauccaggcagauauu

SEQ ID NO: 342847 - RNA, 19 nt, Homo sapiens
gcagaugguggacguuaag

SEQ ID NO: 342848 - RNA, 19 nt, Homo sapiens
ccaggcagauauuuugaaa

SEQ ID NO: 342849 - RNA, 19 nt, Homo sapiens
gaugauaaacacuggaacu

SEQ ID NO: 342850 - RNA, 19 nt, Homo sapiens
gcaaaacaucccaaaccua

SEQ ID NO: 342851 - RNA, 19 nt, Homo sapiens
aagcagaugguggacguua

SEQ ID NO: 342852 - RNA, 19 nt, Homo sapiens
aagcugauccaggcagaua

SEQ ID NO: 342853 - RNA, 19 nt, Homo sapiens
cuucagcaacccuacagua

SEQ ID NO: 342854 - RNA, 19 nt, Homo sapiens
ccagagcacccugcccaaa

SEQ ID NO: 342855 - RNA, 19 nt, Homo sapiens
cuggaacucucagugcaaa

SEQ ID NO: 342856 - RNA, 19 nt, Homo sapiens
uaacaacauggaucaaagg

SEQ ID NO: 342857 - RNA, 19 nt, Homo sapiens
gcaucucuccccauauaua

SEQ ID NO: 342858 - RNA, 19 nt, Homo sapiens
ugaaacgcgauguaaggaa

SEQ ID NO: 342859 - RNA, 19 nt, Homo sapiens
uaugaaacgcgauguaagg

SEQ ID NO: 342860 - RNA, 19 nt, Homo sapiens
acgcggagcauaagaguca

SEQ ID NO: 342861 - RNA, 19 nt, Homo sapiens
ucuuacaggugaacaaggu

SEQ ID NO: 342862 - RNA, 19 nt, Homo sapiens
gaucuuacaggugaacaag

SEQ ID NO: 342863 - RNA, 19 nt, Homo sapiens
cuucagagaacaauaaacu

SEQ ID NO: 342864 - RNA, 19 nt, Homo sapiens
ggguauugaugauaaacac

SEQ ID NO: 342865 - RNA, 19 nt, Homo sapiens
gauccaggcagauauuuug

SEQ ID NO: 342866 - RNA, 19 nt, Homo sapiens
gccagaagacucgcucaau

SEQ ID NO: 342867 - RNA, 19 nt, Homo sapiens
ugugugccuugucgagaaa

SEQ ID NO: 342868 - RNA, 19 nt, Homo sapiens
gaucaaaacgggcaacucu

SEQ ID NO: 342869 - RNA, 19 nt, Homo sapiens
caucggccaucgacauucg

SEQ ID NO: 342870 - RNA, 19 nt, Homo sapiens
cagaacaucacggcggaaa

SEQ ID NO: 342871 - RNA, 19 nt, Homo sapiens
aaucggaagaacaugaauu

SEQ ID NO: 342872 - RNA, 19 nt, Homo sapiens
gacuucagagaacaauaaa

SEQ ID NO: 342873 - RNA, 19 nt, Homo sapiens
uuuaugaaacgcgauguaa

SEQ ID NO: 342874 - RNA, 19 nt, Homo sapiens
uggagcaacuugaggguaa

SEQ ID NO: 342875 - RNA, 19 nt, Homo sapiens
caacuugaggguaauaaug

SEQ ID NO: 342876 - RNA, 19 nt, Homo sapiens
ggcgauggauucgaauuga

SEQ ID NO: 342877 - RNA, 19 nt, Homo sapiens
cgccaguacuucuuugaaa

SEQ ID NO: 342878 - RNA, 19 nt, Homo sapiens
gggaacucaucaaauaauc

SEQ ID NO: 342879 - RNA, 19 nt, Homo sapiens
gcaaggccaagcaguccua

SEQ ID NO: 342880 - RNA, 19 nt, Homo sapiens
ggaacucaucaaauaauca

SEQ ID NO: 342881 - RNA, 19 nt, Homo sapiens
gagcaacuugaggguaaua

SEQ ID NO: 342882 - RNA, 19 nt, Homo sapiens
gaucuaaggaccccaguuu

SEQ ID NO: 342883 - RNA, 19 nt, Homo sapiens
ugauaacgcugaggaaggu

SEQ ID NO: 342884 - RNA, 19 nt, Homo sapiens
ugagacccaugcccaggaa

SEQ ID NO: 342885 - RNA, 19 nt, Homo sapiens
ugacaggugcuccgagaga

SEQ ID NO: 342886 - RNA, 19 nt, Homo sapiens
ggauggcccagcugaucua

SEQ ID NO: 342887 - RNA, 19 nt, Homo sapiens
gcaacuugaggguaauaau

SEQ ID NO: 342888 - RNA, 19 nt, Homo sapiens
caaaaucacaauucucuga

SEQ ID NO: 342889 - RNA, 19 nt, Homo sapiens
agagcuggaugcugagaga

SEQ ID NO: 342890 - RNA, 19 nt, Homo sapiens
gaaaauaacagagcuggau

SEQ ID NO: 342891 - RNA, 19 nt, Homo sapiens
gacaggaggcacuggguau

SEQ ID NO: 342892 - RNA, 19 nt, Homo sapiens
gaacucaucaaauaaucac

SEQ ID NO: 342893 - RNA, 19 nt, Homo sapiens
gccaguacuucuuugaaac

SEQ ID NO: 342894 - RNA, 19 nt, Homo sapiens
ggguaauaaugaugaugau

SEQ ID NO: 342895 - RNA, 19 nt, Homo sapiens
gacaggugcuccgagagau

SEQ ID NO: 342896 - RNA, 19 nt, Homo sapiens
ggagcaacuugaggguaau

SEQ ID NO: 342897 - RNA, 19 nt, Homo sapiens
ggcuggcgauggauucgaa

SEQ ID NO: 342898 - RNA, 19 nt, Homo sapiens
ggaggcacuggguaucuga

SEQ ID NO: 342899 - RNA, 19 nt, Homo sapiens
ucacaauucucugauuuug

SEQ ID NO: 342900 - RNA, 19 nt, Homo sapiens
uggcccagcugaucuaagg

SEQ ID NO: 342901 - RNA, 19 nt, Homo sapiens
aacuugaggguaauaauga

SEQ ID NO: 342902 - RNA, 19 nt, Homo sapiens
gcgauggauucgaauugac

SEQ ID NO: 342903 - RNA, 19 nt, Homo sapiens
ggagcaaggugaaauacau

SEQ ID NO: 342904 - RNA, 19 nt, Homo sapiens
cgagaucaauggacucuug

SEQ ID NO: 342905 - RNA, 19 nt, Homo sapiens
ggaggagcaaggugaaaua

SEQ ID NO: 342906 - RNA, 19 nt, Homo sapiens
ggacacgcaugugcacaga

SEQ ID NO: 342907 - RNA, 19 nt, Homo sapiens
ggaccaagaaggcaaccaa

SEQ ID NO: 342908 - RNA, 19 nt, Homo sapiens
aggcugagguggaccaaga

SEQ ID NO: 342909 - RNA, 19 nt, Homo sapiens
acacgcaugugcacagaau

SEQ ID NO: 342910 - RNA, 19 nt, Homo sapiens
ccaagaaggcaaccaaguc

SEQ ID NO: 342911 - RNA, 19 nt, Homo sapiens
cugaugcucuccagccaaa

SEQ ID NO: 342912 - RNA, 19 nt, Homo sapiens
agcaacagcuggucaacau

SEQ ID NO: 342913 - RNA, 19 nt, Homo sapiens
gacugcguguggccuauga

SEQ ID NO: 342914 - RNA, 19 nt, Homo sapiens
gcaaggugaaauacaucaa

SEQ ID NO: 342915 - RNA, 19 nt, Homo sapiens
gagcaaggugaaauacauc

SEQ ID NO: 342916 - RNA, 19 nt, Homo sapiens
gagacugcguguggccuau

SEQ ID NO: 342917 - RNA, 19 nt, Homo sapiens
ggaugcaccuguggaccau

SEQ ID NO: 342918 - RNA, 19 nt, Homo sapiens
caaggugaaauacaucaag

SEQ ID NO: 342919 - RNA, 19 nt, Homo sapiens
gggcucggacagugagaaa

SEQ ID NO: 342920 - RNA, 19 nt, Homo sapiens
ggacagcauccugcagaca

SEQ ID NO: 342921 - RNA, 19 nt, Homo sapiens
gucaacauccgugccauga

SEQ ID NO: 342922 - RNA, 19 nt, Homo sapiens
acagcauccugcagacaga

SEQ ID NO: 342923 - RNA, 19 nt, Homo sapiens
gcucuccagccaaaccaaa

SEQ ID NO: 342924 - RNA, 19 nt, Homo sapiens
caggugcugcugucacuga

SEQ ID NO: 342925 - RNA, 19 nt, Homo sapiens
ggcacugugucaggcauug

SEQ ID NO: 342926 - RNA, 19 nt, Homo sapiens
gcacuacgguggggacauc

SEQ ID NO: 342927 - RNA, 19 nt, Homo sapiens
gcucggacagugagaaagg

SEQ ID NO: 342928 - RNA, 19 nt, Homo sapiens
ggacaacccuuucgaguuc

SEQ ID NO: 342929 - RNA, 19 nt, Homo sapiens
ccagugaccucaacaggaa

SEQ ID NO: 342930 - RNA, 19 nt, Homo sapiens
ccacaauacuucagugaug

SEQ ID NO: 342931 - RNA, 19 nt, Homo sapiens
gaagaguggucuccguuuc

SEQ ID NO: 342932 - RNA, 19 nt, Homo sapiens
ugacugagcucuacaucga

SEQ ID NO: 342933 - RNA, 19 nt, Homo sapiens
ccagaugccuuccauuuca

SEQ ID NO: 342934 - RNA, 19 nt, Homo sapiens
gagaccagcuucaucuuca

SEQ ID NO: 342935 - RNA, 19 nt, Homo sapiens
gcgcagagaaccugacuga

SEQ ID NO: 342936 - RNA, 19 nt, Homo sapiens
gaaccugacugagcucuac

SEQ ID NO: 342937 - RNA, 19 nt, Homo sapiens
aacagaagcugcaguguca

SEQ ID NO: 342938 - RNA, 19 nt, Homo sapiens
gagacccgguggagaagaa

SEQ ID NO: 342939 - RNA, 19 nt, Homo sapiens
caaaggcucugggcuccaa

SEQ ID NO: 342940 - RNA, 19 nt, Homo sapiens
ggacugguggucaagauug

SEQ ID NO: 342941 - RNA, 19 nt, Homo sapiens
ucugggagaucuucaccua

SEQ ID NO: 342942 - RNA, 19 nt, Homo sapiens
gcucauggucuucgaguau

SEQ ID NO: 342943 - RNA, 19 nt, Homo sapiens
gaaggaggcguccgagagu

SEQ ID NO: 342944 - RNA, 19 nt, Homo sapiens
ggagaagaaggacgaaaca

SEQ ID NO: 342945 - RNA, 19 nt, Homo sapiens
gcaccaugcugcccauucg

SEQ ID NO: 342946 - RNA, 19 nt, Homo sapiens
cagccacggugaugaaauc

SEQ ID NO: 342947 - RNA, 19 nt, Homo sapiens
ggucaagauuggugauuuu

SEQ ID NO: 342948 - RNA, 19 nt, Homo sapiens
cgagaacccacaauacuuc

SEQ ID NO: 342949 - RNA, 19 nt, Homo sapiens
ccucugcacuguucuugug

SEQ ID NO: 342950 - RNA, 19 nt, Homo sapiens
cagcaacgccacagcauca

SEQ ID NO: 342951 - RNA, 19 nt, Homo sapiens
ucucgccgguggacacuaa

SEQ ID NO: 342952 - RNA, 19 nt, Homo sapiens
ucucugcgcuggcucuuca

SEQ ID NO: 342953 - RNA, 19 nt, Homo sapiens
ccugcuggcuuggcugaua

SEQ ID NO: 342954 - RNA, 19 nt, Homo sapiens
gcggagugccugaacagaa

SEQ ID NO: 342955 - RNA, 19 nt, Homo sapiens
cgccagaugccuuccauuu

SEQ ID NO: 342956 - RNA, 19 nt, Homo sapiens
ccagaggucuacgccauca

SEQ ID NO: 342957 - RNA, 19 nt, Homo sapiens
ucuacagcaccgacuauua

SEQ ID NO: 342958 - RNA, 19 nt, Homo sapiens
ucaacgcucuggagucucu

SEQ ID NO: 342959 - RNA, 19 nt, Homo sapiens
gcaagcagcccugguacca

SEQ ID NO: 342960 - RNA, 19 nt, Homo sapiens
cuacagcaccgacuauuac

SEQ ID NO: 342961 - RNA, 19 nt, Homo sapiens
gaacccacaauacuucagu

SEQ ID NO: 342962 - RNA, 19 nt, Homo sapiens
ccagcuucaucuucacuga

SEQ ID NO: 342963 - RNA, 19 nt, Homo sapiens
gguaccagcucuccaacac

SEQ ID NO: 342964 - RNA, 19 nt, Homo sapiens
cggagugccugaacagaag

SEQ ID NO: 342965 - RNA, 19 nt, Homo sapiens
agagcauccuguaccguaa

SEQ ID NO: 342966 - RNA, 19 nt, Homo sapiens
ucaucgagaacccacaaua

SEQ ID NO: 342967 - RNA, 19 nt, Homo sapiens
ccaugucccugcauuucau

SEQ ID NO: 342968 - RNA, 19 nt, Homo sapiens
gcagucagccacggugaug

SEQ ID NO: 342969 - RNA, 19 nt, Homo sapiens
gcuccaaggccacaucauc

SEQ ID NO: 342970 - RNA, 19 nt, Homo sapiens
uuucuacgcugcuccuugu

SEQ ID NO: 342971 - RNA, 19 nt, Homo sapiens
ggcugacccuggccaaugu

SEQ ID NO: 342972 - RNA, 19 nt, Homo sapiens
gcaugagcagggauaucua

SEQ ID NO: 342973 - RNA, 19 nt, Homo sapiens
ugaagaguggucuccguuu

SEQ ID NO: 342974 - RNA, 19 nt, Homo sapiens
gccagaugccuuccauuuc

SEQ ID NO: 342975 - RNA, 19 nt, Homo sapiens
acacggcgguggagaugca

SEQ ID NO: 342976 - RNA, 19 nt, Homo sapiens
uggucaagauuggugauuu

SEQ ID NO: 342977 - RNA, 19 nt, Homo sapiens
cucauggucuucgaguaua

SEQ ID NO: 342978 - RNA, 19 nt, Homo sapiens
gccugccucuuccuuucua

SEQ ID NO: 342979 - RNA, 19 nt, Homo sapiens
cuucaacgcucuggagucu

SEQ ID NO: 342980 - RNA, 19 nt, Homo sapiens
ucauggucuucgaguauau

SEQ ID NO: 342981 - RNA, 19 nt, Homo sapiens
gggacaucgugcucaagug

SEQ ID NO: 342982 - RNA, 19 nt, Homo sapiens
gugcagggccucuccuuac

SEQ ID NO: 342983 - RNA, 19 nt, Homo sapiens
cuucagugaugccuguguu

SEQ ID NO: 342984 - RNA, 19 nt, Homo sapiens
gagaacccacaauacuuca

SEQ ID NO: 342985 - RNA, 19 nt, Homo sapiens
ucgagaacccacaauacuu

SEQ ID NO: 342986 - RNA, 19 nt, Homo sapiens
aaauguggacggagaaaca

SEQ ID NO: 342987 - RNA, 19 nt, Homo sapiens
gaggcaaucgacugcauca

SEQ ID NO: 342988 - RNA, 19 nt, Homo sapiens
gccgggacaucgugcucaa

SEQ ID NO: 342989 - RNA, 19 nt, Homo sapiens
caucgagaacccacaauac

SEQ ID NO: 342990 - RNA, 19 nt, Homo sapiens
uggacaacccuuucgaguu

SEQ ID NO: 342991 - RNA, 19 nt, Homo sapiens
ggcaugagcagggauaucu

SEQ ID NO: 342992 - RNA, 19 nt, Homo sapiens
ggccaugucccugcauuuc

SEQ ID NO: 342993 - RNA, 19 nt, Homo sapiens
cagaagcugcagugucaug

SEQ ID NO: 342994 - RNA, 19 nt, Homo sapiens
gagucucucuccuggaaaa

SEQ ID NO: 342995 - RNA, 19 nt, Homo sapiens
cgucuuugccugccucuuc

SEQ ID NO: 342996 - RNA, 19 nt, Homo sapiens
cuggagacccgguggagaa

SEQ ID NO: 342997 - RNA, 19 nt, Homo sapiens
ccggcuggauccucacaga

SEQ ID NO: 342998 - RNA, 19 nt, Homo sapiens
caucaucgagaacccacaa

SEQ ID NO: 342999 - RNA, 19 nt, Homo sapiens
gacacuaacagcacaucug

SEQ ID NO: 343000 - RNA, 19 nt, Homo sapiens
ugagaccagcuucaucuuc

SEQ ID NO: 343001 - RNA, 19 nt, Homo sapiens
guacagauaucgagaguuu

SEQ ID NO: 343002 - RNA, 19 nt, Homo sapiens
gaacagaaguaaugaaauc

SEQ ID NO: 343003 - RNA, 19 nt, Homo sapiens
ccacagacgucacugauaa

SEQ ID NO: 343004 - RNA, 19 nt, Homo sapiens
guaaugcuguuucugcuua

SEQ ID NO: 343005 - RNA, 19 nt, Homo sapiens
caaucuggcuucugcauua

SEQ ID NO: 343006 - RNA, 19 nt, Homo sapiens
gcaagacacuccaaguuug

SEQ ID NO: 343007 - RNA, 19 nt, Homo sapiens
gaaagucuaucacauuauc

SEQ ID NO: 343008 - RNA, 19 nt, Homo sapiens
gaaaagagguggauucaug

SEQ ID NO: 343009 - RNA, 19 nt, Homo sapiens
caagaucccugucauugaa

SEQ ID NO: 343010 - RNA, 19 nt, Homo sapiens
gaacaucucucggucuaug

SEQ ID NO: 343011 - RNA, 19 nt, Homo sapiens
ggaagcagaucucuugugu

SEQ ID NO: 343012 - RNA, 19 nt, Homo sapiens
gaaaugauagcgugcagua

SEQ ID NO: 343013 - RNA, 19 nt, Homo sapiens
ugagaaaucugacaauugu

SEQ ID NO: 343014 - RNA, 19 nt, Homo sapiens
gaaagcagcaagaauauuc

SEQ ID NO: 343015 - RNA, 19 nt, Homo sapiens
aaagauggcuuccgugaga

SEQ ID NO: 343016 - RNA, 19 nt, Homo sapiens
gaaggaaagucuaucacau

SEQ ID NO: 343017 - RNA, 19 nt, Homo sapiens
aagaugauguugaagcuua

SEQ ID NO: 343018 - RNA, 19 nt, Homo sapiens
ugauagcacugguuuguuu

SEQ ID NO: 343019 - RNA, 19 nt, Homo sapiens
guacagcacugacuacuac

SEQ ID NO: 343020 - RNA, 19 nt, Homo sapiens
aggaaagucuaucacauua

SEQ ID NO: 343021 - RNA, 19 nt, Homo sapiens
gggaacaucucucggucua

SEQ ID NO: 343022 - RNA, 19 nt, Homo sapiens
ugaccaaccuccagcauga

SEQ ID NO: 343023 - RNA, 19 nt, Homo sapiens
agacaaaggccuuaacaaa

SEQ ID NO: 343024 - RNA, 19 nt, Homo sapiens
ccaccaagcugcucuccuu

SEQ ID NO: 343025 - RNA, 19 nt, Homo sapiens
gguaccagcugucaaacaa

SEQ ID NO: 343026 - RNA, 19 nt, Homo sapiens
gauaaucccacucacauga

SEQ ID NO: 343027 - RNA, 19 nt, Homo sapiens
gcgcuucagugguucuaua

SEQ ID NO: 343028 - RNA, 19 nt, Homo sapiens
gagaacaucaccgaaauuu

SEQ ID NO: 343029 - RNA, 19 nt, Homo sapiens
gaaauacucagcaacuguu

SEQ ID NO: 343030 - RNA, 19 nt, Homo sapiens
aaugaaagcagcaagaaua

SEQ ID NO: 343031 - RNA, 19 nt, Homo sapiens
ggaccuuucugaggaguaa

SEQ ID NO: 343032 - RNA, 19 nt, Homo sapiens
aaagauuucucaugguuug

SEQ ID NO: 343033 - RNA, 19 nt, Homo sapiens
gcucauaaagcauuucuga

SEQ ID NO: 343034 - RNA, 19 nt, Homo sapiens
gggaucagcuggugucagu

SEQ ID NO: 343035 - RNA, 19 nt, Homo sapiens
aaacuuguguucaaucugu

SEQ ID NO: 343036 - RNA, 19 nt, Homo sapiens
gcucaagccagacacauuu

SEQ ID NO: 343037 - RNA, 19 nt, Homo sapiens
aauuguggauucuggauua

SEQ ID NO: 343038 - RNA, 19 nt, Homo sapiens
ccagagagaaagaagauuu

SEQ ID NO: 343039 - RNA, 19 nt, Homo sapiens
ccaaacauaugaaugaaac

SEQ ID NO: 343040 - RNA, 19 nt, Homo sapiens
ugacuugucugaacugauc

SEQ ID NO: 343041 - RNA, 19 nt, Homo sapiens
ggcaagacacuccaaguuu

SEQ ID NO: 343042 - RNA, 19 nt, Homo sapiens
gacacaagauggcgcauag

SEQ ID NO: 343043 - RNA, 19 nt, Homo sapiens
ccacucacaugaacaaugg

SEQ ID NO: 343044 - RNA, 19 nt, Homo sapiens
gugauccgguuccuaauau

SEQ ID NO: 343045 - RNA, 19 nt, Homo sapiens
gguuagaaaucaucaacga

SEQ ID NO: 343046 - RNA, 19 nt, Homo sapiens
gcacugguuuguuucucaa

SEQ ID NO: 343047 - RNA, 19 nt, Homo sapiens
gcuuaagccuguguauaaa

SEQ ID NO: 343048 - RNA, 19 nt, Homo sapiens
acacaguauugacuucuuu

SEQ ID NO: 343049 - RNA, 19 nt, Homo sapiens
gggaugucguccuggauaa

SEQ ID NO: 343050 - RNA, 19 nt, Homo sapiens
ggaaauacucagcaacugu

SEQ ID NO: 343051 - RNA, 19 nt, Homo sapiens
gauuggagccuaacagugu

SEQ ID NO: 343052 - RNA, 19 nt, Homo sapiens
cagagagaaagaagauuua

SEQ ID NO: 343053 - RNA, 19 nt, Homo sapiens
gcaccgaggaguuaagaga

SEQ ID NO: 343054 - RNA, 19 nt, Homo sapiens
caacaagcaccgaggaguu

SEQ ID NO: 343055 - RNA, 19 nt, Homo sapiens
ccacagaaccuuugucaac

SEQ ID NO: 343056 - RNA, 19 nt, Homo sapiens
gucaaacaaugaggugaua

SEQ ID NO: 343057 - RNA, 19 nt, Homo sapiens
ccacacacagggcuccuua

SEQ ID NO: 343058 - RNA, 19 nt, Homo sapiens
ggugauccgguuccuaaua

SEQ ID NO: 343059 - RNA, 19 nt, Homo sapiens
ggaaggaaagucuaucaca

SEQ ID NO: 343060 - RNA, 19 nt, Homo sapiens
ggacugagaaaucugacaa

SEQ ID NO: 343061 - RNA, 19 nt, Homo sapiens
gaugauagcacugguuugu

SEQ ID NO: 343062 - RNA, 19 nt, Homo sapiens
gcauauagcccagcagauc

SEQ ID NO: 343063 - RNA, 19 nt, Homo sapiens
gcuucugcauuacuauuaa

SEQ ID NO: 343064 - RNA, 19 nt, Homo sapiens
gaagaucaagauucuguca

SEQ ID NO: 343065 - RNA, 19 nt, Homo sapiens
acaaaggccuuaacaaacg

SEQ ID NO: 343066 - RNA, 19 nt, Homo sapiens
gacaaaggccuuaacaaac

SEQ ID NO: 343067 - RNA, 19 nt, Homo sapiens
ggagguguaugagcugaug

SEQ ID NO: 343068 - RNA, 19 nt, Homo sapiens
gaaggaugccagugacaau

SEQ ID NO: 343069 - RNA, 19 nt, Homo sapiens
ggaaggaugagaaacagau

SEQ ID NO: 343070 - RNA, 19 nt, Homo sapiens
gcaaacagcccugguacca

SEQ ID NO: 343071 - RNA, 19 nt, Homo sapiens
gggagaacuugcuggugaa

SEQ ID NO: 343072 - RNA, 19 nt, Homo sapiens
caggugauccgguuccuaa

SEQ ID NO: 343073 - RNA, 19 nt, Homo sapiens
gauuuguacugccugaaug

SEQ ID NO: 343074 - RNA, 19 nt, Homo sapiens
uagaaaucaucaacgaaga

SEQ ID NO: 343075 - RNA, 19 nt, Homo sapiens
ggccuuaacaaacguaauu

SEQ ID NO: 343076 - RNA, 19 nt, Homo sapiens
ucacgauucuuacccuuuc

SEQ ID NO: 343077 - RNA, 19 nt, Homo sapiens
caucaaagacuccgagaag

SEQ ID NO: 343078 - RNA, 19 nt, Homo sapiens
cagcacaucaagcgacaua

SEQ ID NO: 343079 - RNA, 19 nt, Homo sapiens
cccagaugcugucauuauu

SEQ ID NO: 343080 - RNA, 19 nt, Homo sapiens
gcccagaugcugucauuau

SEQ ID NO: 343081 - RNA, 19 nt, Homo sapiens
gauuucugcucacuucaug

SEQ ID NO: 343082 - RNA, 19 nt, Homo sapiens
ucuaucacauuauccugua

SEQ ID NO: 343083 - RNA, 19 nt, Homo sapiens
gauacccaauugugguuug

SEQ ID NO: 343084 - RNA, 19 nt, Homo sapiens
gaaugaaagcagcaagaau

SEQ ID NO: 343085 - RNA, 19 nt, Homo sapiens
guccagacacucaggauuu

SEQ ID NO: 343086 - RNA, 19 nt, Homo sapiens
ggaucaagacucuccaaga

SEQ ID NO: 343087 - RNA, 19 nt, Homo sapiens
ugacgaguuugucuaggaa

SEQ ID NO: 343088 - RNA, 19 nt, Homo sapiens
gaacaucaagggcauccau

SEQ ID NO: 343089 - RNA, 19 nt, Homo sapiens
ccagagagcaucauguaca

SEQ ID NO: 343090 - RNA, 19 nt, Homo sapiens
ccaagaucccugucauuga

SEQ ID NO: 343091 - RNA, 19 nt, Homo sapiens
cagaaaagguuagaaauca

SEQ ID NO: 343092 - RNA, 19 nt, Homo sapiens
gaacugcagcgaaugacau

SEQ ID NO: 343093 - RNA, 19 nt, Homo sapiens
gaaggaugagaaacagauu

SEQ ID NO: 343094 - RNA, 19 nt, Homo sapiens
cagcagacacuccaguuug

SEQ ID NO: 343095 - RNA, 19 nt, Homo sapiens
cauuaucucuuucucucuu

SEQ ID NO: 343096 - RNA, 19 nt, Homo sapiens
caaacaaugaggugauaga

SEQ ID NO: 343097 - RNA, 19 nt, Homo sapiens
gcacaucgucaaguucuau

SEQ ID NO: 343098 - RNA, 19 nt, Homo sapiens
ugaaugcuauaaccucugu

SEQ ID NO: 343099 - RNA, 19 nt, Homo sapiens
gaaaauccccaguacuuug

SEQ ID NO: 343100 - RNA, 19 nt, Homo sapiens
cagcaaugaugaugacucu

SEQ ID NO: 343101 - RNA, 19 nt, Homo sapiens
gcgaacaucuucauauaaa

SEQ ID NO: 343102 - RNA, 19 nt, Homo sapiens
ccaaagagguguacgaugu

SEQ ID NO: 343103 - RNA, 19 nt, Homo sapiens
gagcgaaucugcuagugaa

SEQ ID NO: 343104 - RNA, 19 nt, Homo sapiens
ggagagacaucgugcugaa

SEQ ID NO: 343105 - RNA, 19 nt, Homo sapiens
aagcgaacaucuucauaua

SEQ ID NO: 343106 - RNA, 19 nt, Homo sapiens
gaaguucacuacagagagu

SEQ ID NO: 343107 - RNA, 19 nt, Homo sapiens
ucaccaaccugcagcauga

SEQ ID NO: 343108 - RNA, 19 nt, Homo sapiens
ggucgacgguccaaauuug

SEQ ID NO: 343109 - RNA, 19 nt, Homo sapiens
cuacaacaauggcaacuau

SEQ ID NO: 343110 - RNA, 19 nt, Homo sapiens
gaauaucacuuccauacac

SEQ ID NO: 343111 - RNA, 19 nt, Homo sapiens
caaaugcaaugauccuugu

SEQ ID NO: 343112 - RNA, 19 nt, Homo sapiens
ucacggacaucucaaggaa

SEQ ID NO: 343113 - RNA, 19 nt, Homo sapiens
cagcagcgguugaacauca

SEQ ID NO: 343114 - RNA, 19 nt, Homo sapiens
gcaagacugagaucaauug

SEQ ID NO: 343115 - RNA, 19 nt, Homo sapiens
aaucugaacuggaccaaug

SEQ ID NO: 343116 - RNA, 19 nt, Homo sapiens
acaaugcuguuaucacuug

SEQ ID NO: 343117 - RNA, 19 nt, Homo sapiens
acggacaucucaaggaaua

SEQ ID NO: 343118 - RNA, 19 nt, Homo sapiens
caacaucacggacaucuca

SEQ ID NO: 343119 - RNA, 19 nt, Homo sapiens
ugacaaugcuguuaucacu

SEQ ID NO: 343120 - RNA, 19 nt, Homo sapiens
gaacgccaguaucaacauc

SEQ ID NO: 343121 - RNA, 19 nt, Homo sapiens
gcaaugggaacgccaguau

SEQ ID NO: 343122 - RNA, 19 nt, Homo sapiens
ucaacaagcccacccacua

SEQ ID NO: 343123 - RNA, 19 nt, Homo sapiens
ccagagccuuugccaagaa

SEQ ID NO: 343124 - RNA, 19 nt, Homo sapiens
cagcaagacugagaucaau

SEQ ID NO: 343125 - RNA, 19 nt, Homo sapiens
ucaaggagaucuacaaaau

SEQ ID NO: 343126 - RNA, 19 nt, Homo sapiens
caaucuaccuggacauucu

SEQ ID NO: 343127 - RNA, 19 nt, Homo sapiens
auggagaccugaauaaguu

SEQ ID NO: 343128 - RNA, 19 nt, Homo sapiens
caaauugugucugcagcaa

SEQ ID NO: 343129 - RNA, 19 nt, Homo sapiens
gaucuucaccuauggaaag

SEQ ID NO: 343130 - RNA, 19 nt, Homo sapiens
ucugggagaucuucaccua

SEQ ID NO: 343131 - RNA, 19 nt, Homo sapiens
gccacaagccggacacgua

SEQ ID NO: 343132 - RNA, 19 nt, Homo sapiens
caguuggacuugcugcuuu

SEQ ID NO: 343133 - RNA, 19 nt, Homo sapiens
gcagcaagacugagaucaa

SEQ ID NO: 343134 - RNA, 19 nt, Homo sapiens
uguaguuucuggcggauuu

SEQ ID NO: 343135 - RNA, 19 nt, Homo sapiens
ugggagaucuucaccuaug

SEQ ID NO: 343136 - RNA, 19 nt, Homo sapiens
ucacuuccauacacauaga

SEQ ID NO: 343137 - RNA, 19 nt, Homo sapiens
ucaucauggucuuugaaua

SEQ ID NO: 343138 - RNA, 19 nt, Homo sapiens
gagagcacggauaacuuua

SEQ ID NO: 343139 - RNA, 19 nt, Homo sapiens
cagaaccucuacugcauca

SEQ ID NO: 343140 - RNA, 19 nt, Homo sapiens
gccagaaccucuacugcau

SEQ ID NO: 343141 - RNA, 19 nt, Homo sapiens
agagagcacggauaacuuu

SEQ ID NO: 343142 - RNA, 19 nt, Homo sapiens
gcucccagcuuccucucuu

SEQ ID NO: 343143 - RNA, 19 nt, Homo sapiens
caaacacggaggucauuga

SEQ ID NO: 343144 - RNA, 19 nt, Homo sapiens
gcgucuggcuggacuaugu

SEQ ID NO: 343145 - RNA, 19 nt, Homo sapiens
gcuguuaucacuugcaaug

SEQ ID NO: 343146 - RNA, 19 nt, Homo sapiens
ggaggucauugagugcauu

SEQ ID NO: 343147 - RNA, 19 nt, Homo sapiens
ggagcgaaucugcuaguga

SEQ ID NO: 343148 - RNA, 19 nt, Homo sapiens
gcccgacacuguggucauu

SEQ ID NO: 343149 - RNA, 19 nt, Homo sapiens
ccacaaaccagaagaagac

SEQ ID NO: 343150 - RNA, 19 nt, Homo sapiens
ccacaccuccuaucacugu

SEQ ID NO: 343151 - RNA, 19 nt, Homo sapiens
gcucggcguuucaaagaag

SEQ ID NO: 343152 - RNA, 19 nt, Homo sapiens
caucaaggagaucuacaaa

SEQ ID NO: 343153 - RNA, 19 nt, Homo sapiens
gaacaucaaggagaucuac

SEQ ID NO: 343154 - RNA, 19 nt, Homo sapiens
ccacaagccggacacguau

SEQ ID NO: 343155 - RNA, 19 nt, Homo sapiens
gugguucucuucgucauga

SEQ ID NO: 343156 - RNA, 19 nt, Homo sapiens
caugagcaaugccaguguu

SEQ ID NO: 343157 - RNA, 19 nt, Homo sapiens
gggcugcaguccaucaaca

SEQ ID NO: 343158 - RNA, 19 nt, Homo sapiens
gcucaacgccguggacaug

SEQ ID NO: 343159 - RNA, 19 nt, Homo sapiens
ucuacagcacggauuauua

SEQ ID NO: 343160 - RNA, 19 nt, Homo sapiens
agauggaugucucucuuug

SEQ ID NO: 343161 - RNA, 19 nt, Homo sapiens
uggcaacuauacccucauu

SEQ ID NO: 343162 - RNA, 19 nt, Homo sapiens
caacaagcccacccacuac

SEQ ID NO: 343163 - RNA, 19 nt, Homo sapiens
caucauggucuuugaauac

SEQ ID NO: 343164 - RNA, 19 nt, Homo sapiens
uaucuuguuugacgaagug

SEQ ID NO: 343165 - RNA, 19 nt, Homo sapiens
gagggugacaaugcuguua

SEQ ID NO: 343166 - RNA, 19 nt, Homo sapiens
ccauuugcguuauauaaac

SEQ ID NO: 343167 - RNA, 19 nt, Homo sapiens
ugacugaagcgaacaucuu

SEQ ID NO: 343168 - RNA, 19 nt, Homo sapiens
caacugcagcugugacauc

SEQ ID NO: 343169 - RNA, 19 nt, Homo sapiens
guaaccggcucaccacacu

SEQ ID NO: 343170 - RNA, 19 nt, Homo sapiens
gcucuacaccggacuucaa

SEQ ID NO: 343171 - RNA, 19 nt, Homo sapiens
gaggucauugagugcauua

SEQ ID NO: 343172 - RNA, 19 nt, Homo sapiens
ugaaggauuuugcaucuga

SEQ ID NO: 343173 - RNA, 19 nt, Homo sapiens
gcaucccugucauugagaa

SEQ ID NO: 343174 - RNA, 19 nt, Homo sapiens
aguccaagaucauccaugu

SEQ ID NO: 343175 - RNA, 19 nt, Homo sapiens
ggagcacugcaucgaguuu

SEQ ID NO: 343176 - RNA, 19 nt, Homo sapiens
acaaaauccuccaugcuuu

SEQ ID NO: 343177 - RNA, 19 nt, Homo sapiens
ccacauugccagucagauc

SEQ ID NO: 343178 - RNA, 19 nt, Homo sapiens
aagcauggagaccugaaua

SEQ ID NO: 343179 - RNA, 19 nt, Homo sapiens
gcacauugucaaguucuau

SEQ ID NO: 343180 - RNA, 19 nt, Homo sapiens
cuaccaagagggagagauu

SEQ ID NO: 343181 - RNA, 19 nt, Homo sapiens
cuuccucucuuccgcauga

SEQ ID NO: 343182 - RNA, 19 nt, Homo sapiens
uaucacuuccauacacaua

SEQ ID NO: 343183 - RNA, 19 nt, Homo sapiens
ggacaucucaaggaauauc

SEQ ID NO: 343184 - RNA, 19 nt, Homo sapiens
cguccgcgaugguuucaga

SEQ ID NO: 343185 - RNA, 19 nt, Homo sapiens
ucgucaugaucaacaaaua

SEQ ID NO: 343186 - RNA, 19 nt, Homo sapiens
ccauacacauagagaacug

SEQ ID NO: 343187 - RNA, 19 nt, Homo sapiens
ccacagcagcgguugaaca

SEQ ID NO: 343188 - RNA, 19 nt, Homo sapiens
gaaagcagccaugguucca

SEQ ID NO: 343189 - RNA, 19 nt, Homo sapiens
uggugaaugugacgaguga

SEQ ID NO: 343190 - RNA, 19 nt, Homo sapiens
caucaagaacucaggacuu

SEQ ID NO: 343191 - RNA, 19 nt, Homo sapiens
aauugugucugcagcaaga

SEQ ID NO: 343192 - RNA, 19 nt, Homo sapiens
ggugagggagccuuuggaa

SEQ ID NO: 343193 - RNA, 19 nt, Homo sapiens
ucgcaucccugucauugag

SEQ ID NO: 343194 - RNA, 19 nt, Homo sapiens
gcugccugcucuucaacaa

SEQ ID NO: 343195 - RNA, 19 nt, Homo sapiens
acuugacgcuggugaaugu

SEQ ID NO: 343196 - RNA, 19 nt, Homo sapiens
caacuugacgcuggugaau

SEQ ID NO: 343197 - RNA, 19 nt, Homo sapiens
aaagagguguacgauguca

SEQ ID NO: 343198 - RNA, 19 nt, Homo sapiens
cuacagcacggauuauuac

SEQ ID NO: 343199 - RNA, 19 nt, Homo sapiens
gcgaaucugcuagugaaga

SEQ ID NO: 343200 - RNA, 19 nt, Homo sapiens
gguuggagcgaaucugcua

SEQ ID NO: 343201 - RNA, 19 nt, Homo sapiens
gcaucagccuaaagaaguu

SEQ ID NO: 343202 - RNA, 19 nt, Homo sapiens
ucacuggccucaccugcaa

SEQ ID NO: 343203 - RNA, 19 nt, Homo sapiens
uggaggccgucgucccuua

SEQ ID NO: 343204 - RNA, 19 nt, Homo sapiens
gcuucaacauggagcugua

SEQ ID NO: 343205 - RNA, 19 nt, Homo sapiens
gcucaagucucaggaccau

SEQ ID NO: 343206 - RNA, 19 nt, Homo sapiens
gcagcccagugcuccaaga

SEQ ID NO: 343207 - RNA, 19 nt, Homo sapiens
ccgcggagagggcuucuuu

SEQ ID NO: 343208 - RNA, 19 nt, Homo sapiens
gcugcaagcccuucuacug

SEQ ID NO: 343209 - RNA, 19 nt, Homo sapiens
acugugaccuggacuaugg

SEQ ID NO: 343210 - RNA, 19 nt, Homo sapiens
cguggcagcuaccgcauca

SEQ ID NO: 343211 - RNA, 19 nt, Homo sapiens
ccacugugaccuggacuau

SEQ ID NO: 343212 - RNA, 19 nt, Homo sapiens
caagugaacucaacaaaga

SEQ ID NO: 343213 - RNA, 19 nt, Homo sapiens
gcaaggaggugguuucuuc

SEQ ID NO: 343214 - RNA, 19 nt, Homo sapiens
gcaagcaucuuuacuagga

SEQ ID NO: 343215 - RNA, 19 nt, Homo sapiens
gagcaaggcuaaagagcua

SEQ ID NO: 343216 - RNA, 19 nt, Homo sapiens
caaauucucuucugauuca

SEQ ID NO: 343217 - RNA, 19 nt, Homo sapiens
gagagcaacuucauguaaa

SEQ ID NO: 343218 - RNA, 19 nt, Homo sapiens
gaaauuuacuccgcugauu

SEQ ID NO: 343219 - RNA, 19 nt, Homo sapiens
gcagacaucgcaacaagua

SEQ ID NO: 343220 - RNA, 19 nt, Homo sapiens
gagaauguccugugucaaa

SEQ ID NO: 343221 - RNA, 19 nt, Homo sapiens
gaaguuucacugugucuua

SEQ ID NO: 343222 - RNA, 19 nt, Homo sapiens
gauggaauuucaacaagaa

SEQ ID NO: 343223 - RNA, 19 nt, Homo sapiens
uggcagauccuauaaauaa

SEQ ID NO: 343224 - RNA, 19 nt, Homo sapiens
ggagagcaacuucauguaa

SEQ ID NO: 343225 - RNA, 19 nt, Homo sapiens
caagaagccucccuaaugg

SEQ ID NO: 343226 - RNA, 19 nt, Homo sapiens
ggacacaccgaaucuauga

SEQ ID NO: 343227 - RNA, 19 nt, Homo sapiens
gaucacagcugccuucacu

SEQ ID NO: 343228 - RNA, 19 nt, Homo sapiens
caucauguauggcaaauuc

SEQ ID NO: 343229 - RNA, 19 nt, Homo sapiens
caacaaguaccuucuguga

SEQ ID NO: 343230 - RNA, 19 nt, Homo sapiens
gcaacuucauguaaagauu

SEQ ID NO: 343231 - RNA, 19 nt, Homo sapiens
ugauugagauggugagaaa

SEQ ID NO: 343232 - RNA, 19 nt, Homo sapiens
ggcaaauucucuucugauu

SEQ ID NO: 343233 - RNA, 19 nt, Homo sapiens
uggaauaccugucuaguca

SEQ ID NO: 343234 - RNA, 19 nt, Homo sapiens
gaaauccuguacauacuag

SEQ ID NO: 343235 - RNA, 19 nt, Homo sapiens
ccacacaugucaauuccaa

SEQ ID NO: 343236 - RNA, 19 nt, Homo sapiens
gauugcagcuggcauggaa

SEQ ID NO: 343237 - RNA, 19 nt, Homo sapiens
gcacauugcaauucagauu

SEQ ID NO: 343238 - RNA, 19 nt, Homo sapiens
caaccugugugcaugcuuu

SEQ ID NO: 343239 - RNA, 19 nt, Homo sapiens
ggauggaauuucaacaaga

SEQ ID NO: 343240 - RNA, 19 nt, Homo sapiens
gcaaauauuccuuuacuac

SEQ ID NO: 343241 - RNA, 19 nt, Homo sapiens
cccaauaccuccuggauau

SEQ ID NO: 343242 - RNA, 19 nt, Homo sapiens
ggaaaugccaccacacaga

SEQ ID NO: 343243 - RNA, 19 nt, Homo sapiens
ucuaggagaccaagauuua

SEQ ID NO: 343244 - RNA, 19 nt, Homo sapiens
acaagaagccucccuaaug

SEQ ID NO: 343245 - RNA, 19 nt, Homo sapiens
gggaagagcccguggaugu

SEQ ID NO: 343246 - RNA, 19 nt, Homo sapiens
ggaauaaccagaagucauc

SEQ ID NO: 343247 - RNA, 19 nt, Homo sapiens
ggccauugcuuuacucuuc

SEQ ID NO: 343248 - RNA, 19 nt, Homo sapiens
ggaaauccuguacauacua

SEQ ID NO: 343249 - RNA, 19 nt, Homo sapiens
cauggaacaucucaaguga

SEQ ID NO: 343250 - RNA, 19 nt, Homo sapiens
guaagguucucauuuagca

SEQ ID NO: 343251 - RNA, 19 nt, Homo sapiens
ccagauauccuaauuacau

SEQ ID NO: 343252 - RNA, 19 nt, Homo sapiens
cauggcagauccuauaaau

SEQ ID NO: 343253 - RNA, 19 nt, Homo sapiens
gugaaauccuggagaaugu

SEQ ID NO: 343254 - RNA, 19 nt, Homo sapiens
gaagacugcccacccagaa

SEQ ID NO: 343255 - RNA, 19 nt, Homo sapiens
caacaagaagccucccuaa

SEQ ID NO: 343256 - RNA, 19 nt, Homo sapiens
acagagugcuggaaugaga

SEQ ID NO: 343257 - RNA, 19 nt, Homo sapiens
ccacuggagucuuguuugu

SEQ ID NO: 343258 - RNA, 19 nt, Homo sapiens
caucccagcuugcgauuca

SEQ ID NO: 343259 - RNA, 19 nt, Homo sapiens
ggaauggguaucaccguuu

SEQ ID NO: 343260 - RNA, 19 nt, Homo sapiens
caaaggauuccaaggagaa

SEQ ID NO: 343261 - RNA, 19 nt, Homo sapiens
acagcugccuucacuauga

SEQ ID NO: 343262 - RNA, 19 nt, Homo sapiens
gaacaucucaagugaacuc

SEQ ID NO: 343263 - RNA, 19 nt, Homo sapiens
ugacuugugucgcgaugaa

SEQ ID NO: 343264 - RNA, 19 nt, Homo sapiens
gaaccaaugaauaacauca

SEQ ID NO: 343265 - RNA, 19 nt, Homo sapiens
gauccaaucaggaagcaaa

SEQ ID NO: 343266 - RNA, 19 nt, Homo sapiens
caacagguccucccagagu

SEQ ID NO: 343267 - RNA, 19 nt, Homo sapiens
aaauuuacuccgcugauua

SEQ ID NO: 343268 - RNA, 19 nt, Homo sapiens
cauauaaacccaagagcaa

SEQ ID NO: 343269 - RNA, 19 nt, Homo sapiens
uagcagacaucgcaacaag

SEQ ID NO: 343270 - RNA, 19 nt, Homo sapiens
aauauugucugccuucuag

SEQ ID NO: 343271 - RNA, 19 nt, Homo sapiens
ggcagauccuauaaauaaa

SEQ ID NO: 343272 - RNA, 19 nt, Homo sapiens
caucaauggauacccaaua

SEQ ID NO: 343273 - RNA, 19 nt, Homo sapiens
uguaaagauuucagacuug

SEQ ID NO: 343274 - RNA, 19 nt, Homo sapiens
gccauggaauucccaguau

SEQ ID NO: 343275 - RNA, 19 nt, Homo sapiens
caaacuagacggccguaga

SEQ ID NO: 343276 - RNA, 19 nt, Homo sapiens
gcacuggccaugugacuag

SEQ ID NO: 343277 - RNA, 19 nt, Homo sapiens
gcaaauucucuucugauuc

SEQ ID NO: 343278 - RNA, 19 nt, Homo sapiens
gaagaugggacugugaaau

SEQ ID NO: 343279 - RNA, 19 nt, Homo sapiens
gaacugcaccaccccaaua

SEQ ID NO: 343280 - RNA, 19 nt, Homo sapiens
ugauaaguguucucaguuc

SEQ ID NO: 343281 - RNA, 19 nt, Homo sapiens
aagcaagcaucuuuacuag

SEQ ID NO: 343282 - RNA, 19 nt, Homo sapiens
cagauauccuaauuacaug

SEQ ID NO: 343283 - RNA, 19 nt, Homo sapiens
gugccuaccucaucaugga

SEQ ID NO: 343284 - RNA, 19 nt, Homo sapiens
cuauaaaggccaucucuau

SEQ ID NO: 343285 - RNA, 19 nt, Homo sapiens
gcuuuacucuucuucuuca

SEQ ID NO: 343286 - RNA, 19 nt, Homo sapiens
gcaugugcaagauuuauug

SEQ ID NO: 343287 - RNA, 19 nt, Homo sapiens
gcgauucauucccaucaau

SEQ ID NO: 343288 - RNA, 19 nt, Homo sapiens
gaagagcccguggauguuc

SEQ ID NO: 343289 - RNA, 19 nt, Homo sapiens
gaauaccugucuagucacu

SEQ ID NO: 343290 - RNA, 19 nt, Homo sapiens
aaacuagacggccguagaa

SEQ ID NO: 343291 - RNA, 19 nt, Homo sapiens
ccaaucaggaagcaaauau

SEQ ID NO: 343292 - RNA, 19 nt, Homo sapiens
cacacaagcucuacuacuc

SEQ ID NO: 343293 - RNA, 19 nt, Homo sapiens
ggaagaauugggugagugu

SEQ ID NO: 343294 - RNA, 19 nt, Homo sapiens
ggaagagcccguggauguu

SEQ ID NO: 343295 - RNA, 19 nt, Homo sapiens
aaugugaaauccuggagaa

SEQ ID NO: 343296 - RNA, 19 nt, Homo sapiens
caaccgcaccgucuauaug

SEQ ID NO: 343297 - RNA, 19 nt, Homo sapiens
uuacuccgcugauuacuac

SEQ ID NO: 343298 - RNA, 19 nt, Homo sapiens
aaauggaaauccuguacau

SEQ ID NO: 343299 - RNA, 19 nt, Homo sapiens
ggagaagaauaaaauggaa

SEQ ID NO: 343300 - RNA, 19 nt, Homo sapiens
ucacagcugccuucacuau

SEQ ID NO: 343301 - RNA, 19 nt, Homo sapiens
gaauggguaucaccguuuu

SEQ ID NO: 343302 - RNA, 19 nt, Homo sapiens
ugacagagugcuggaauga

SEQ ID NO: 343303 - RNA, 19 nt, Homo sapiens
gcucuuaccaugcucugaa

SEQ ID NO: 343304 - RNA, 19 nt, Homo sapiens
gaugaaccaaugaauaaca

SEQ ID NO: 343305 - RNA, 19 nt, Homo sapiens
uggagaauguccuguguca

SEQ ID NO: 343306 - RNA, 19 nt, Homo sapiens
acaugucaauuccaaauca

SEQ ID NO: 343307 - RNA, 19 nt, Homo sapiens
gacuagcacuggccaugug

SEQ ID NO: 343308 - RNA, 19 nt, Homo sapiens
uaaaggccaucucuaucuc

SEQ ID NO: 343309 - RNA, 19 nt, Homo sapiens
caaagucucugggaaucca

SEQ ID NO: 343310 - RNA, 19 nt, Homo sapiens
auucuuaccugacccuuga

SEQ ID NO: 343311 - RNA, 19 nt, Homo sapiens
gaaacugccaaacugugaa

SEQ ID NO: 343312 - RNA, 19 nt, Homo sapiens
gaucuggucuguugguuug

SEQ ID NO: 343313 - RNA, 19 nt, Homo sapiens
ggaacucgcugcugccuau

SEQ ID NO: 343314 - RNA, 19 nt, Homo sapiens
gaagcaguauuguacagaa

SEQ ID NO: 343315 - RNA, 19 nt, Homo sapiens
ccaauaaagugaaacaaag

SEQ ID NO: 343316 - RNA, 19 nt, Homo sapiens
ggaccucagucaccuuuga

SEQ ID NO: 343317 - RNA, 19 nt, Homo sapiens
gcaggugccuccucagaug

SEQ ID NO: 343318 - RNA, 19 nt, Homo sapiens
gcaaugugcuaguguacga

SEQ ID NO: 343319 - RNA, 19 nt, Homo sapiens
gaaaugggaguuccugaga

SEQ ID NO: 343320 - RNA, 19 nt, Homo sapiens
gaaacugacagcuuuguau

SEQ ID NO: 343321 - RNA, 19 nt, Homo sapiens
gaagacagaauaugguuca

SEQ ID NO: 343322 - RNA, 19 nt, Homo sapiens
gcuccucucuguccucuga

SEQ ID NO: 343323 - RNA, 19 nt, Homo sapiens
caaaaugugugccuucaaa

SEQ ID NO: 343324 - RNA, 19 nt, Homo sapiens
aaugggaguuccugagaua

SEQ ID NO: 343325 - RNA, 19 nt, Homo sapiens
caaacaggccaaacucaaa

SEQ ID NO: 343326 - RNA, 19 nt, Homo sapiens
cagcccaaaucauaacuuu

SEQ ID NO: 343327 - RNA, 19 nt, Homo sapiens
ugucauauauggagugaau

SEQ ID NO: 343328 - RNA, 19 nt, Homo sapiens
uuccaacucugaaagguua

SEQ ID NO: 343329 - RNA, 19 nt, Homo sapiens
acgcacagcccaaaucaua

SEQ ID NO: 343330 - RNA, 19 nt, Homo sapiens
cagcaaaugccuuucaaga

SEQ ID NO: 343331 - RNA, 19 nt, Homo sapiens
gacagacacuggcuacuac

SEQ ID NO: 343332 - RNA, 19 nt, Homo sapiens
gggaggaguuccggcauga

SEQ ID NO: 343333 - RNA, 19 nt, Homo sapiens
gcccaaaucauaacuuuca

SEQ ID NO: 343334 - RNA, 19 nt, Homo sapiens
cgacagacacuggcuacua

SEQ ID NO: 343335 - RNA, 19 nt, Homo sapiens
ucaaagaaacugacagcuu

SEQ ID NO: 343336 - RNA, 19 nt, Homo sapiens
ggucaucgcuugccuuuuc

SEQ ID NO: 343337 - RNA, 19 nt, Homo sapiens
guacagaacacgguauugu

SEQ ID NO: 343338 - RNA, 19 nt, Homo sapiens
ccacuggcguccuguuugu

SEQ ID NO: 343339 - RNA, 19 nt, Homo sapiens
ccagggcuguauacauuga

SEQ ID NO: 343340 - RNA, 19 nt, Homo sapiens
gcacaaacaggccaaacuc

SEQ ID NO: 343341 - RNA, 19 nt, Homo sapiens
ggaauucaagggaaagugu

SEQ ID NO: 343342 - RNA, 19 nt, Homo sapiens
gaggagcggacgcaucgua

SEQ ID NO: 343343 - RNA, 19 nt, Homo sapiens
ucaaaacgcugaaggacaa

SEQ ID NO: 343344 - RNA, 19 nt, Homo sapiens
gcaaccggaccauuuaugu

SEQ ID NO: 343345 - RNA, 19 nt, Homo sapiens
acugacagcuuuguauuug

SEQ ID NO: 343346 - RNA, 19 nt, Homo sapiens
gagcggacgcaucguagaa

SEQ ID NO: 343347 - RNA, 19 nt, Homo sapiens
ugugggaggucuucagcua

SEQ ID NO: 343348 - RNA, 19 nt, Homo sapiens
uauguggacucgcuucaga

SEQ ID NO: 343349 - RNA, 19 nt, Homo sapiens
aaacugacagcuuuguauu

SEQ ID NO: 343350 - RNA, 19 nt, Homo sapiens
gggaauaagggccugcaaa

SEQ ID NO: 343351 - RNA, 19 nt, Homo sapiens
gguggcagcuucacuccau

SEQ ID NO: 343352 - RNA, 19 nt, Homo sapiens
ucagucaccuuugagaaga

SEQ ID NO: 343353 - RNA, 19 nt, Homo sapiens
ggucuugguuugcuucucu

SEQ ID NO: 343354 - RNA, 19 nt, Homo sapiens
agagggcgcugaugacaca

SEQ ID NO: 343355 - RNA, 19 nt, Homo sapiens
guuugcaugugccggaaua

SEQ ID NO: 343356 - RNA, 19 nt, Homo sapiens
gacguacccucguguaguc

SEQ ID NO: 343357 - RNA, 19 nt, Homo sapiens
gcucaggcauggauuacag

SEQ ID NO: 343358 - RNA, 19 nt, Homo sapiens
cagaggaagcaguauugua

SEQ ID NO: 343359 - RNA, 19 nt, Homo sapiens
ggaauaagggccugcaaaa

SEQ ID NO: 343360 - RNA, 19 nt, Homo sapiens
gaacggcaagcaccaccaa

SEQ ID NO: 343361 - RNA, 19 nt, Homo sapiens
acaaggggcuucugaaaug

SEQ ID NO: 343362 - RNA, 19 nt, Homo sapiens
gagcagcaaaugccuuuca

SEQ ID NO: 343363 - RNA, 19 nt, Homo sapiens
gggcaaccuuuccaacuac

SEQ ID NO: 343364 - RNA, 19 nt, Homo sapiens
acgacaagcugaacgugaa

SEQ ID NO: 343365 - RNA, 19 nt, Homo sapiens
caacgcacagcccaaauca

SEQ ID NO: 343366 - RNA, 19 nt, Homo sapiens
gggaguuccugagauacaa

SEQ ID NO: 343367 - RNA, 19 nt, Homo sapiens
gacaaccgaucuggucugu

SEQ ID NO: 343368 - RNA, 19 nt, Homo sapiens
acagcggccuucaccauga

SEQ ID NO: 343369 - RNA, 19 nt, Homo sapiens
ggucuuaagaugacuuuag

SEQ ID NO: 343370 - RNA, 19 nt, Homo sapiens
ugacagcuuuguauuuggu

SEQ ID NO: 343371 - RNA, 19 nt, Homo sapiens
caaguucuccaucgacuca

SEQ ID NO: 343372 - RNA, 19 nt, Homo sapiens
ugcgguggcuaaagaauga

SEQ ID NO: 343373 - RNA, 19 nt, Homo sapiens
ggugguagacugguaguga

SEQ ID NO: 343374 - RNA, 19 nt, Homo sapiens
ggcuucagcugcccaagug

SEQ ID NO: 343375 - RNA, 19 nt, Homo sapiens
ggaccagugcucacaguuc

SEQ ID NO: 343376 - RNA, 19 nt, Homo sapiens
caucauguacggcaaguuc

SEQ ID NO: 343377 - RNA, 19 nt, Homo sapiens
ugagcaugaucuucagcua

SEQ ID NO: 343378 - RNA, 19 nt, Homo sapiens
gcugggagaggaccgguuu

SEQ ID NO: 343379 - RNA, 19 nt, Homo sapiens
gcuaccaucagugcuauaa

SEQ ID NO: 343380 - RNA, 19 nt, Homo sapiens
ccaacgggaugaagaccau

SEQ ID NO: 343381 - RNA, 19 nt, Homo sapiens
ucuguugguuugaggauga

SEQ ID NO: 343382 - RNA, 19 nt, Homo sapiens
gcacagcccaaaucauaac

SEQ ID NO: 343383 - RNA, 19 nt, Homo sapiens
gcacacauuguugguccua

SEQ ID NO: 343384 - RNA, 19 nt, Homo sapiens
ggaagcaguauuguacaga

SEQ ID NO: 343385 - RNA, 19 nt, Homo sapiens
guucagaggaagcaguauu

SEQ ID NO: 343386 - RNA, 19 nt, Homo sapiens
gaauucaagggaaaguguu

SEQ ID NO: 343387 - RNA, 19 nt, Homo sapiens
cagcuucacuccaugucau

SEQ ID NO: 343388 - RNA, 19 nt, Homo sapiens
gcgcugaugacacacagaa

SEQ ID NO: 343389 - RNA, 19 nt, Homo sapiens
ggggcaaccuuuccaacua

SEQ ID NO: 343390 - RNA, 19 nt, Homo sapiens
agaaucauguacagagcuu

SEQ ID NO: 343391 - RNA, 19 nt, Homo sapiens
gucuuaagaugacuuuagu

SEQ ID NO: 343392 - RNA, 19 nt, Homo sapiens
gugagcagcaaaugccuuu

SEQ ID NO: 343393 - RNA, 19 nt, Homo sapiens
acaaacaggccaaacucaa

SEQ ID NO: 343394 - RNA, 19 nt, Homo sapiens
agacuucccugagcuugga

SEQ ID NO: 343395 - RNA, 19 nt, Homo sapiens
agaggaagcaguauuguac

SEQ ID NO: 343396 - RNA, 19 nt, Homo sapiens
gaggaccgguuugggaaag

SEQ ID NO: 343397 - RNA, 19 nt, Homo sapiens
uuuggaauguucagaggaa

SEQ ID NO: 343398 - RNA, 19 nt, Homo sapiens
agccaaagauucgcuggaa

SEQ ID NO: 343399 - RNA, 19 nt, Homo sapiens
ccccagggcuguauacauu

SEQ ID NO: 343400 - RNA, 19 nt, Homo sapiens
uguaugcccucaugaucga

SEQ ID NO: 343401 - RNA, 19 nt, Homo sapiens
aggccaaacucaaagagau

SEQ ID NO: 343402 - RNA, 19 nt, Homo sapiens
caaccggaccauuuaugug

SEQ ID NO: 343403 - RNA, 19 nt, Homo sapiens
aaucauguacagagcuuaa

SEQ ID NO: 343404 - RNA, 19 nt, Homo sapiens
aacgugcgguggcuaaaga

SEQ ID NO: 343405 - RNA, 19 nt, Homo sapiens
caugucauauauggaguga

SEQ ID NO: 343406 - RNA, 19 nt, Homo sapiens
gauccgaacgacccuuuag

SEQ ID NO: 343407 - RNA, 19 nt, Homo sapiens
gcaccagcccagugagcaa

SEQ ID NO: 343408 - RNA, 19 nt, Homo sapiens
acggcgaccuccacgaauu

SEQ ID NO: 343409 - RNA, 19 nt, Homo sapiens
ucauuaaccagcacaaaca

SEQ ID NO: 343410 - RNA, 19 nt, Homo sapiens
ggauccgaacgacccuuua

SEQ ID NO: 343411 - RNA, 19 nt, Homo sapiens
aaugugugccuucaaagaa

SEQ ID NO: 343412 - RNA, 19 nt, Homo sapiens
caagauagcugacuuugga

SEQ ID NO: 343413 - RNA, 19 nt, Homo sapiens
gcagauaccuggaugaugu

SEQ ID NO: 343414 - RNA, 19 nt, Homo sapiens
gguaagaacuacacaauca

SEQ ID NO: 343415 - RNA, 19 nt, Homo sapiens
gaacuacacaaucaagaua

SEQ ID NO: 343416 - RNA, 19 nt, Homo sapiens
gaagaaccgucccucauuc

SEQ ID NO: 343417 - RNA, 19 nt, Homo sapiens
ggaggaugcuggaugauga

SEQ ID NO: 343418 - RNA, 19 nt, Homo sapiens
gaaacgcaguggauuauag

SEQ ID NO: 343419 - RNA, 19 nt, Homo sapiens
guccacagcugccaaauau

SEQ ID NO: 343420 - RNA, 19 nt, Homo sapiens
cuagaaaguuccaagguuu

SEQ ID NO: 343421 - RNA, 19 nt, Homo sapiens
gagcagaugccaacaagaa

SEQ ID NO: 343422 - RNA, 19 nt, Homo sapiens
gaacgagagugccaccaau

SEQ ID NO: 343423 - RNA, 19 nt, Homo sapiens
acaccaaucugaaguuuau

SEQ ID NO: 343424 - RNA, 19 nt, Homo sapiens
caacaagaaugccaggaau

SEQ ID NO: 343425 - RNA, 19 nt, Homo sapiens
ccaaucagaugcugcaaug

SEQ ID NO: 343426 - RNA, 19 nt, Homo sapiens
gacagaggcuuguuugcuu

SEQ ID NO: 343427 - RNA, 19 nt, Homo sapiens
gaagaucuuuaaggaggua

SEQ ID NO: 343428 - RNA, 19 nt, Homo sapiens
gagaucauguuugaauuug

SEQ ID NO: 343429 - RNA, 19 nt, Homo sapiens
guaugagaguggagcuuua

SEQ ID NO: 343430 - RNA, 19 nt, Homo sapiens
caagggagaccuacaaguu

SEQ ID NO: 343431 - RNA, 19 nt, Homo sapiens
ugaaguaccuuuccucucu

SEQ ID NO: 343432 - RNA, 19 nt, Homo sapiens
gaugcuggaugaugaaaug

SEQ ID NO: 343433 - RNA, 19 nt, Homo sapiens
guuuauggcuacccaaauu

SEQ ID NO: 343434 - RNA, 19 nt, Homo sapiens
gaauggagaucucaaucag

SEQ ID NO: 343435 - RNA, 19 nt, Homo sapiens
uaugaucacugaauacaug

SEQ ID NO: 343436 - RNA, 19 nt, Homo sapiens
caacauguuugcuaaaggu

SEQ ID NO: 343437 - RNA, 19 nt, Homo sapiens
ccauguacaagaucaauua

SEQ ID NO: 343438 - RNA, 19 nt, Homo sapiens
gacuuacgaucgcaucuuu

SEQ ID NO: 343439 - RNA, 19 nt, Homo sapiens
guuuguggcuugaauuauu

SEQ ID NO: 343440 - RNA, 19 nt, Homo sapiens
guacaguggugacuauuac

SEQ ID NO: 343441 - RNA, 19 nt, Homo sapiens
caucauccaucuauuaucu

SEQ ID NO: 343442 - RNA, 19 nt, Homo sapiens
cauccaggcugauacgaaa

SEQ ID NO: 343443 - RNA, 19 nt, Homo sapiens
uagauggcuuggugucuua

SEQ ID NO: 343444 - RNA, 19 nt, Homo sapiens
gaaggaguuucugcagauu

SEQ ID NO: 343445 - RNA, 19 nt, Homo sapiens
gaggccagauuccagauga

SEQ ID NO: 343446 - RNA, 19 nt, Homo sapiens
guucagugcucuagaaagu

SEQ ID NO: 343447 - RNA, 19 nt, Homo sapiens
ccaaacaucauccaucuau

SEQ ID NO: 343448 - RNA, 19 nt, Homo sapiens
gauccaaugcuuaaaguug

SEQ ID NO: 343449 - RNA, 19 nt, Homo sapiens
uuaaggagguacagugcua

SEQ ID NO: 343450 - RNA, 19 nt, Homo sapiens
cgaagaaccgucccucauu

SEQ ID NO: 343451 - RNA, 19 nt, Homo sapiens
ggagaagagauacgaagaa

SEQ ID NO: 343452 - RNA, 19 nt, Homo sapiens
gaucaugucucggcucaag

SEQ ID NO: 343453 - RNA, 19 nt, Homo sapiens
cagaagggcuaggccaauu

SEQ ID NO: 343454 - RNA, 19 nt, Homo sapiens
gagguuccaucauuuaucu

SEQ ID NO: 343455 - RNA, 19 nt, Homo sapiens
cagaugaacagguuauuga

SEQ ID NO: 343456 - RNA, 19 nt, Homo sapiens
gugggagacuuucaccuuu

SEQ ID NO: 343457 - RNA, 19 nt, Homo sapiens
ggaaugauuuucuuaagga

SEQ ID NO: 343458 - RNA, 19 nt, Homo sapiens
ugucuggccuggacgauuu

SEQ ID NO: 343459 - RNA, 19 nt, Homo sapiens
ugaaggaguuucugcagau

SEQ ID NO: 343460 - RNA, 19 nt, Homo sapiens
ugagaauacuggagaguuc

SEQ ID NO: 343461 - RNA, 19 nt, Homo sapiens
gaaguaccuuuccucucuu

SEQ ID NO: 343462 - RNA, 19 nt, Homo sapiens
gacccucucuguaugauca

SEQ ID NO: 343463 - RNA, 19 nt, Homo sapiens
cuaaaggugugaagaucuu

SEQ ID NO: 343464 - RNA, 19 nt, Homo sapiens
ugauggagcuguuggauac

SEQ ID NO: 343465 - RNA, 19 nt, Homo sapiens
gagaagagauacgaagaac

SEQ ID NO: 343466 - RNA, 19 nt, Homo sapiens
caaguucacuacagcaagu

SEQ ID NO: 343467 - RNA, 19 nt, Homo sapiens
caaacaucauccaucuauu

SEQ ID NO: 343468 - RNA, 19 nt, Homo sapiens
gugugaagaucuuuaagga

SEQ ID NO: 343469 - RNA, 19 nt, Homo sapiens
uaccuuuccucucuuaauu

SEQ ID NO: 343470 - RNA, 19 nt, Homo sapiens
ugagaucaccuuccaauca

SEQ ID NO: 343471 - RNA, 19 nt, Homo sapiens
aaagaagcguuucacaaca

SEQ ID NO: 343472 - RNA, 19 nt, Homo sapiens
aaucagaugcugcaaugua

SEQ ID NO: 343473 - RNA, 19 nt, Homo sapiens
gagaucaccuuccaaucag

SEQ ID NO: 343474 - RNA, 19 nt, Homo sapiens
ccaugaagguccacugcaa

SEQ ID NO: 343475 - RNA, 19 nt, Homo sapiens
gaagggcuaggccaauuga

SEQ ID NO: 343476 - RNA, 19 nt, Homo sapiens
gcggaaccgucaugggaaa

SEQ ID NO: 343477 - RNA, 19 nt, Homo sapiens
cugaugaccugaaggaguu

SEQ ID NO: 343478 - RNA, 19 nt, Homo sapiens
gcucagguccucccuacaa

SEQ ID NO: 343479 - RNA, 19 nt, Homo sapiens
ggaaacgcaguggauuaua

SEQ ID NO: 343480 - RNA, 19 nt, Homo sapiens
ugacaggaggcaacacaua

SEQ ID NO: 343481 - RNA, 19 nt, Homo sapiens
ccaagugauucuagcaugu

SEQ ID NO: 343482 - RNA, 19 nt, Homo sapiens
aagaagcguuucacaacaa

SEQ ID NO: 343483 - RNA, 19 nt, Homo sapiens
ccaacaccaucuucugaga

SEQ ID NO: 343484 - RNA, 19 nt, Homo sapiens
ucuagaaaguuccaagguu

SEQ ID NO: 343485 - RNA, 19 nt, Homo sapiens
gagagacagaggcuuguuu

SEQ ID NO: 343486 - RNA, 19 nt, Homo sapiens
ucuguaugaucacugaaua

SEQ ID NO: 343487 - RNA, 19 nt, Homo sapiens
gcugggagaaggacaguuu

SEQ ID NO: 343488 - RNA, 19 nt, Homo sapiens
ucacccagacccaugaaua

SEQ ID NO: 343489 - RNA, 19 nt, Homo sapiens
ucagugcucuagaaaguuc

SEQ ID NO: 343490 - RNA, 19 nt, Homo sapiens
gaucucaaucaguuucuuu

SEQ ID NO: 343491 - RNA, 19 nt, Homo sapiens
cugaauacauggagaaugg

SEQ ID NO: 343492 - RNA, 19 nt, Homo sapiens
gaaguggagggaauggaaa

SEQ ID NO: 343493 - RNA, 19 nt, Homo sapiens
uggaugauguucagugaga

SEQ ID NO: 343494 - RNA, 19 nt, Homo sapiens
gaucauguuugaauuugac

SEQ ID NO: 343495 - RNA, 19 nt, Homo sapiens
ucagguuaauccagcuaua

SEQ ID NO: 343496 - RNA, 19 nt, Homo sapiens
acagaggcuuguuugcuuu

SEQ ID NO: 343497 - RNA, 19 nt, Homo sapiens
cuacaagaccuaccacuca

SEQ ID NO: 343498 - RNA, 19 nt, Homo sapiens
caaucaagauagcugacuu

SEQ ID NO: 343499 - RNA, 19 nt, Homo sapiens
uuacaccaaucugaaguuu

SEQ ID NO: 343500 - RNA, 19 nt, Homo sapiens
gcagaugccaacaagaaug

SEQ ID NO: 343501 - RNA, 19 nt, Homo sapiens
ucaagugucaauaccauuu

SEQ ID NO: 343502 - RNA, 19 nt, Homo sapiens
ccagugccaucaaguguca

SEQ ID NO: 343503 - RNA, 19 nt, Homo sapiens
ccuaugauccaaugcuuaa

SEQ ID NO: 343504 - RNA, 19 nt, Homo sapiens
caucaagugucaauaccau

SEQ ID NO: 343505 - RNA, 19 nt, Homo sapiens
ggagguacagugcuacuuc

SEQ ID NO: 343506 - RNA, 19 nt, Homo sapiens
ggauacagcaugacagaag

SEQ ID NO: 343507 - RNA, 19 nt, Homo sapiens
caauguacaacaacucuga

SEQ ID NO: 343508 - RNA, 19 nt, Homo sapiens
gggaaacgcaguggauuau

SEQ ID NO: 343509 - RNA, 19 nt, Homo sapiens
augaacagguuauugagaa

SEQ ID NO: 343510 - RNA, 19 nt, Homo sapiens
gaugaacagguuauugaga

SEQ ID NO: 343511 - RNA, 19 nt, Homo sapiens
auggagaucucaaucaguu

SEQ ID NO: 343512 - RNA, 19 nt, Homo sapiens
gcagauuucuugaccaaua

SEQ ID NO: 343513 - RNA, 19 nt, Homo sapiens
gaagcaauguugacaauau

SEQ ID NO: 343514 - RNA, 19 nt, Homo sapiens
gaagaugacucugcuaaau

SEQ ID NO: 343515 - RNA, 19 nt, Homo sapiens
gaaacuuccuacugcuuua

SEQ ID NO: 343516 - RNA, 19 nt, Homo sapiens
ggacuuggcuuguuagaag

SEQ ID NO: 343517 - RNA, 19 nt, Homo sapiens
gaagaagucauaaagagaa

SEQ ID NO: 343518 - RNA, 19 nt, Homo sapiens
gaaaggaagaagucauaaa

SEQ ID NO: 343519 - RNA, 19 nt, Homo sapiens
uuacggacuuggcuuguua

SEQ ID NO: 343520 - RNA, 19 nt, Homo sapiens
gaugauggcaggaaugaaa

SEQ ID NO: 343521 - RNA, 19 nt, Homo sapiens
caggagaaguucaugaaga

SEQ ID NO: 343522 - RNA, 19 nt, Homo sapiens
caaacacacuuaucugucu

SEQ ID NO: 343523 - RNA, 19 nt, Homo sapiens
ggaagaagucauaaagaga

SEQ ID NO: 343524 - RNA, 19 nt, Homo sapiens
cuaaauguuugcagucuug

SEQ ID NO: 343525 - RNA, 19 nt, Homo sapiens
ggaaagaggaagugcuaga

SEQ ID NO: 343526 - RNA, 19 nt, Homo sapiens
cuucuacaauugugguuua

SEQ ID NO: 343527 - RNA, 19 nt, Homo sapiens
ugaaacggcagcuguauga

SEQ ID NO: 343528 - RNA, 19 nt, Homo sapiens
ggaagaugacucugcuaaa

SEQ ID NO: 343529 - RNA, 19 nt, Homo sapiens
ccaauaugcauacaucaaa

SEQ ID NO: 343530 - RNA, 19 nt, Homo sapiens
acacuuaucugucucuucu

SEQ ID NO: 343531 - RNA, 19 nt, Homo sapiens
gcagcuguaugagaauaaa

SEQ ID NO: 343532 - RNA, 19 nt, Homo sapiens
caucaaagauuaguaaagc

SEQ ID NO: 343533 - RNA, 19 nt, Homo sapiens
ggaaaggaagaagucauaa

SEQ ID NO: 343534 - RNA, 19 nt, Homo sapiens
aagcacauguucccucuug

SEQ ID NO: 343535 - RNA, 19 nt, Homo sapiens
ugaccaauaugcauacauc

SEQ ID NO: 343536 - RNA, 19 nt, Homo sapiens
agaagacccuacauacuca

SEQ ID NO: 343537 - RNA, 19 nt, Homo sapiens
gagaauaaacccagaagac

SEQ ID NO: 343538 - RNA, 19 nt, Homo sapiens
gcaugcuacuccuggcuuu

SEQ ID NO: 343539 - RNA, 19 nt, Homo sapiens
gacaaacacacuuaucugu

SEQ ID NO: 343540 - RNA, 19 nt, Homo sapiens
ggaaacaggagaaguucau

SEQ ID NO: 343541 - RNA, 19 nt, Homo sapiens
agaugacucugcuaaaugu

SEQ ID NO: 343542 - RNA, 19 nt, Homo sapiens
gaguuaauccaggaagaua

SEQ ID NO: 343543 - RNA, 19 nt, Homo sapiens
caauauaccagcuccacaa

SEQ ID NO: 343544 - RNA, 19 nt, Homo sapiens
ggaagcaauguugacaaua

SEQ ID NO: 343545 - RNA, 19 nt, Homo sapiens
uggaaaggaagaagucaua

SEQ ID NO: 343546 - RNA, 19 nt, Homo sapiens
aaagccagcugaaggaaag

SEQ ID NO: 343547 - RNA, 19 nt, Homo sapiens
ugaggaaacaggagaaguu

SEQ ID NO: 343548 - RNA, 19 nt, Homo sapiens
ugacucugcuaaauguuug

SEQ ID NO: 343549 - RNA, 19 nt, Homo sapiens
caauaugcauacaucaaag

SEQ ID NO: 343550 - RNA, 19 nt, Homo sapiens
cagauuucuugaccaauau

SEQ ID NO: 343551 - RNA, 19 nt, Homo sapiens
gauucaucaucccuuaauu

SEQ ID NO: 343552 - RNA, 19 nt, Homo sapiens
cagaagacccuacauacuc

SEQ ID NO: 343553 - RNA, 19 nt, Homo sapiens
gggaguuaauccaggaaga

SEQ ID NO: 343554 - RNA, 19 nt, Homo sapiens
gcacauguucccucuugga

SEQ ID NO: 343555 - RNA, 19 nt, Homo sapiens
aagcagauuucuugaccaa

SEQ ID NO: 343556 - RNA, 19 nt, Homo sapiens
uggaagcaauguugacaau

SEQ ID NO: 343557 - RNA, 19 nt, Homo sapiens
gcuaaauguuugcagucuu

SEQ ID NO: 343558 - RNA, 19 nt, Homo sapiens
gugcucagauucagaagag

SEQ ID NO: 343559 - RNA, 19 nt, Homo sapiens
gaagaggagcuuguugcaa

SEQ ID NO: 343560 - RNA, 19 nt, Homo sapiens
gaagaggaaaugaaagcau

SEQ ID NO: 343561 - RNA, 19 nt, Homo sapiens
cggcagcuguaugagaaua

SEQ ID NO: 343562 - RNA, 19 nt, Homo sapiens
aggaagaagucauaaagag

SEQ ID NO: 343563 - RNA, 19 nt, Homo sapiens
aaaggaagaagucauaaag

SEQ ID NO: 343564 - RNA, 19 nt, Homo sapiens
uuucaacacugggaguuaa

SEQ ID NO: 343565 - RNA, 19 nt, Homo sapiens
gaaagcauuagaagcagau

SEQ ID NO: 343566 - RNA, 19 nt, Homo sapiens
guuaauccaggaagauauu

SEQ ID NO: 343567 - RNA, 19 nt, Homo sapiens
gaaugaaaauccagcuugu

SEQ ID NO: 343568 - RNA, 19 nt, Homo sapiens
aacggcagcuguaugagaa

SEQ ID NO: 343569 - RNA, 19 nt, Homo sapiens
gaaagaggaagugcuagag

SEQ ID NO: 343570 - RNA, 19 nt, Homo sapiens
caaagccagcugaaggaaa

SEQ ID NO: 343571 - RNA, 19 nt, Homo sapiens
aaacaggagaaguucauga

SEQ ID NO: 343572 - RNA, 19 nt, Homo sapiens
uacaugugauugugauuca

SEQ ID NO: 343573 - RNA, 19 nt, Homo sapiens
aaacggcagcuguaugaga

SEQ ID NO: 343574 - RNA, 19 nt, Homo sapiens
aaggaaagaggaagugcua

SEQ ID NO: 343575 - RNA, 19 nt, Homo sapiens
uggaagaugacucugcuaa

SEQ ID NO: 343576 - RNA, 19 nt, Homo sapiens
aaauccagcuuguaugcau

SEQ ID NO: 343577 - RNA, 19 nt, Homo sapiens
uuaucugucucuucuacaa

SEQ ID NO: 343578 - RNA, 19 nt, Homo sapiens
ugacaaacacacuuaucug

SEQ ID NO: 343579 - RNA, 19 nt, Homo sapiens
ggaguuaauccaggaagau

SEQ ID NO: 343580 - RNA, 19 nt, Homo sapiens
gaaacaggagaaguucaug

SEQ ID NO: 343581 - RNA, 19 nt, Homo sapiens
gaggaaacaggagaaguuc

SEQ ID NO: 343582 - RNA, 19 nt, Homo sapiens
ccagaagacccuacauacu

SEQ ID NO: 343583 - RNA, 19 nt, Homo sapiens
aggagaaguucaugaagag

SEQ ID NO: 343584 - RNA, 19 nt, Homo sapiens
aauguuugcagucuuguaa

SEQ ID NO: 343585 - RNA, 19 nt, Homo sapiens
aaagaggaagugcuagaga

SEQ ID NO: 343586 - RNA, 19 nt, Homo sapiens
uauaccagcuccacaaaau

SEQ ID NO: 343587 - RNA, 19 nt, Homo sapiens
aagaugacucugcuaaaug

SEQ ID NO: 343588 - RNA, 19 nt, Homo sapiens
gagauucuuacuauuacug

SEQ ID NO: 343589 - RNA, 19 nt, Homo sapiens
gugacaaacacacuuaucu

SEQ ID NO: 343590 - RNA, 19 nt, Homo sapiens
gauauucuugauacuggaa

SEQ ID NO: 343591 - RNA, 19 nt, Homo sapiens
uguuugcagucuuguaaau

SEQ ID NO: 343592 - RNA, 19 nt, Homo sapiens
gaaaauccagcuuguaugc

SEQ ID NO: 343593 - RNA, 19 nt, Homo sapiens
guuugcagucuuguaaaua

SEQ ID NO: 343594 - RNA, 19 nt, Homo sapiens
gaagacccuacauacucaa

SEQ ID NO: 343595 - RNA, 19 nt, Homo sapiens
acccagaagacccuacaua

SEQ ID NO: 343596 - RNA, 19 nt, Homo sapiens
aaggaagaagucauaaaga

SEQ ID NO: 343597 - RNA, 19 nt, Homo sapiens
cagaagaggaaaugaaagc

SEQ ID NO: 343598 - RNA, 19 nt, Homo sapiens
cagcugaaggaaagaggaa

SEQ ID NO: 343599 - RNA, 19 nt, Homo sapiens
aacaggagaaguucaugaa

SEQ ID NO: 343600 - RNA, 19 nt, Homo sapiens
uaacccauguuucucauua

SEQ ID NO: 343601 - RNA, 19 nt, Homo sapiens
gaaggucgccuaagccuaa

SEQ ID NO: 343602 - RNA, 19 nt, Homo sapiens
gcuccuaucugugcacuua

SEQ ID NO: 343603 - RNA, 19 nt, Homo sapiens
ggacuccguuccucuauga

SEQ ID NO: 343604 - RNA, 19 nt, Homo sapiens
ggaucuggcuguugaguug

SEQ ID NO: 343605 - RNA, 19 nt, Homo sapiens
gauggugccuggucucuga

SEQ ID NO: 343606 - RNA, 19 nt, Homo sapiens
gaaauuagugugcggcaaa

SEQ ID NO: 343607 - RNA, 19 nt, Homo sapiens
ggagugggcucagagucua

SEQ ID NO: 343608 - RNA, 19 nt, Homo sapiens
ccacagagcacaugacuag

SEQ ID NO: 343609 - RNA, 19 nt, Homo sapiens
gaagacagucccaggagaa

SEQ ID NO: 343610 - RNA, 19 nt, Homo sapiens
gcuuggaucuggcuguuga

SEQ ID NO: 343611 - RNA, 19 nt, Homo sapiens
ccguguaucucucaauaaa

SEQ ID NO: 343612 - RNA, 19 nt, Homo sapiens
ccaggcagcuccaagaaag

SEQ ID NO: 343613 - RNA, 19 nt, Homo sapiens
ggaccuugggccauaauuu

SEQ ID NO: 343614 - RNA, 19 nt, Homo sapiens
gaacgaggaccuggacuca

SEQ ID NO: 343615 - RNA, 19 nt, Homo sapiens
gcacuuccugccaaacuuu

SEQ ID NO: 343616 - RNA, 19 nt, Homo sapiens
gaaaagggccucuaacaag

SEQ ID NO: 343617 - RNA, 19 nt, Homo sapiens
gaucucguaucacuagcuu

SEQ ID NO: 343618 - RNA, 19 nt, Homo sapiens
uaacaaggagaaauuagug

SEQ ID NO: 343619 - RNA, 19 nt, Homo sapiens
ccguggagcuguacaacuu

SEQ ID NO: 343620 - RNA, 19 nt, Homo sapiens
ccacaagccuggucaucag

SEQ ID NO: 343621 - RNA, 19 nt, Homo sapiens
cgacaucuacuccaaagug

SEQ ID NO: 343622 - RNA, 19 nt, Homo sapiens
gaaaacaaaccccguguau

SEQ ID NO: 343623 - RNA, 19 nt, Homo sapiens
gcucagagucuagcaaaug

SEQ ID NO: 343624 - RNA, 19 nt, Homo sapiens
aaaugagagucgaaugcua

SEQ ID NO: 343625 - RNA, 19 nt, Homo sapiens
ggcacagacucauuuguca

SEQ ID NO: 343626 - RNA, 19 nt, Homo sapiens
ccucgucucugccaacuuc

SEQ ID NO: 343627 - RNA, 19 nt, Homo sapiens
gcgcuccucucccagauag

SEQ ID NO: 343628 - RNA, 19 nt, Homo sapiens
caacuuccgccacaucuuc

SEQ ID NO: 343629 - RNA, 19 nt, Homo sapiens
ucuaugacuucuaccacua

SEQ ID NO: 343630 - RNA, 19 nt, Homo sapiens
acgaggaccuggacucaga

SEQ ID NO: 343631 - RNA, 19 nt, Homo sapiens
gaccuugggccauaauuuc

SEQ ID NO: 343632 - RNA, 19 nt, Homo sapiens
gaaacagggccagcacaga

SEQ ID NO: 343633 - RNA, 19 nt, Homo sapiens
uuaagaaggucgccuaagc

SEQ ID NO: 343634 - RNA, 19 nt, Homo sapiens
gagaaggaaaugaaaugug

SEQ ID NO: 343635 - RNA, 19 nt, Homo sapiens
ccauguuucucauuagugu

SEQ ID NO: 343636 - RNA, 19 nt, Homo sapiens
guguaucucucaauaaagg

SEQ ID NO: 343637 - RNA, 19 nt, Homo sapiens
gcucaggagugggcucaga

SEQ ID NO: 343638 - RNA, 19 nt, Homo sapiens
agagucgaaugcuacagua

SEQ ID NO: 343639 - RNA, 19 nt, Homo sapiens
aaaaugggcuggccuggaa

SEQ ID NO: 343640 - RNA, 19 nt, Homo sapiens
cagagaaggaaaugaaaug

SEQ ID NO: 343641 - RNA, 19 nt, Homo sapiens
ggaaaagggccucuaacaa

SEQ ID NO: 343642 - RNA, 19 nt, Homo sapiens
cuucauguccuucauauuc

SEQ ID NO: 343643 - RNA, 19 nt, Homo sapiens
caaaaucccucuccaacca

SEQ ID NO: 343644 - RNA, 19 nt, Homo sapiens
ccucuaacaaggagaaauu

SEQ ID NO: 343645 - RNA, 19 nt, Homo sapiens
gaccaacgcacucuucuac

SEQ ID NO: 343646 - RNA, 19 nt, Homo sapiens
acaccgacaucuacuccaa

SEQ ID NO: 343647 - RNA, 19 nt, Homo sapiens
uacgucagcuccaccauca

SEQ ID NO: 343648 - RNA, 19 nt, Homo sapiens
ccaacgcacucuucuacgu

SEQ ID NO: 343649 - RNA, 19 nt, Homo sapiens
caacguggccagccugagu

SEQ ID NO: 343650 - RNA, 19 nt, Homo sapiens
gagcugggagccacaggaa

SEQ ID NO: 343651 - RNA, 19 nt, Homo sapiens
gaagccgcaccaagaaguu

SEQ ID NO: 343652 - RNA, 19 nt, Homo sapiens
gaaaugagagucgaaugcu

SEQ ID NO: 343653 - RNA, 19 nt, Homo sapiens
cagaagggacgccggauca

SEQ ID NO: 343654 - RNA, 19 nt, Homo sapiens
ggccagccuucucgaggaa

SEQ ID NO: 343655 - RNA, 19 nt, Homo sapiens
ggucuguggcugugacuga

SEQ ID NO: 343656 - RNA, 19 nt, Homo sapiens
gggcucagagucuagcaaa

SEQ ID NO: 343657 - RNA, 19 nt, Homo sapiens
ugacuucuaccacuacuuc

SEQ ID NO: 343658 - RNA, 19 nt, Homo sapiens
gagagucgaaugcuacagu

SEQ ID NO: 343659 - RNA, 19 nt, Homo sapiens
gagaaaugagagucgaaug

SEQ ID NO: 343660 - RNA, 19 nt, Homo sapiens
ccagagaaggaaaugaaau

SEQ ID NO: 343661 - RNA, 19 nt, Homo sapiens
gagcgcuccucucccagau

SEQ ID NO: 343662 - RNA, 19 nt, Homo sapiens
uaucugcagucgcuuggau

SEQ ID NO: 343663 - RNA, 19 nt, Homo sapiens
ggacgugaacaccgacauc

SEQ ID NO: 343664 - RNA, 19 nt, Homo sapiens
aaacaaaccccguguaucu

SEQ ID NO: 343665 - RNA, 19 nt, Homo sapiens
gcggccaggucaugaugug

SEQ ID NO: 343666 - RNA, 19 nt, Homo sapiens
aggaacagauguggucguu

SEQ ID NO: 343667 - RNA, 19 nt, Homo sapiens
gcaccaagaaguucaucag

SEQ ID NO: 343668 - RNA, 19 nt, Homo sapiens
uuugaaagccagaacaaga

SEQ ID NO: 343669 - RNA, 19 nt, Homo sapiens
ugacggugccuaugcuguu

SEQ ID NO: 343670 - RNA, 19 nt, Homo sapiens
agccugcacuggagucuga

SEQ ID NO: 343671 - RNA, 19 nt, Homo sapiens
gucgaaugcuacaguaucu

SEQ ID NO: 343672 - RNA, 19 nt, Homo sapiens
ggugccuggucucugagua

SEQ ID NO: 343673 - RNA, 19 nt, Homo sapiens
gcgcauuccgugugcuuug

SEQ ID NO: 343674 - RNA, 19 nt, Homo sapiens
cgccuaagccuaagagaag

SEQ ID NO: 343675 - RNA, 19 nt, Homo sapiens
ggccucagccucaagaucu

SEQ ID NO: 343676 - RNA, 19 nt, Homo sapiens
gcaguggucaucgccuuug

SEQ ID NO: 343677 - RNA, 19 nt, Homo sapiens
ucaacaccuucauguccuu

SEQ ID NO: 343678 - RNA, 19 nt, Homo sapiens
gagagagggcagaguggau

SEQ ID NO: 343679 - RNA, 19 nt, Homo sapiens
ccaagaaagcucccugacu

SEQ ID NO: 343680 - RNA, 19 nt, Homo sapiens
guuccucuaugacuucuac

SEQ ID NO: 343681 - RNA, 19 nt, Homo sapiens
ucccgaagccgcaccaaga

SEQ ID NO: 343682 - RNA, 19 nt, Homo sapiens
gaguugacggguuccuuga

SEQ ID NO: 343683 - RNA, 19 nt, Homo sapiens
guggagcuguacaacuuca

SEQ ID NO: 343684 - RNA, 19 nt, Homo sapiens
gcuuaagaaggucgccuaa

SEQ ID NO: 343685 - RNA, 19 nt, Homo sapiens
gugccuggucucugaguaa

SEQ ID NO: 343686 - RNA, 19 nt, Homo sapiens
ugaaagccagaacaagaga

SEQ ID NO: 343687 - RNA, 19 nt, Homo sapiens
gacggugccuaugcuguuc

SEQ ID NO: 343688 - RNA, 19 nt, Homo sapiens
cagacucauuugucaccuu

SEQ ID NO: 343689 - RNA, 19 nt, Homo sapiens
ccaugcccguggagcugua

SEQ ID NO: 343690 - RNA, 19 nt, Homo sapiens
ccuggucucugaguaagau

SEQ ID NO: 343691 - RNA, 19 nt, Homo sapiens
caccgucaaggucgucaua

SEQ ID NO: 343692 - RNA, 19 nt, Homo sapiens
gcaguuuucuuuguucuca

SEQ ID NO: 343693 - RNA, 19 nt, Homo sapiens
ugaccaacgcacucuucua

SEQ ID NO: 343694 - RNA, 19 nt, Homo sapiens
ccuauucgcugcacuuccu

SEQ ID NO: 343695 - RNA, 19 nt, Homo sapiens
gcgccuccuuggucucuag

SEQ ID NO: 343696 - RNA, 19 nt, Homo sapiens
cgaagccgcaccaagaagu

SEQ ID NO: 343697 - RNA, 19 nt, Homo sapiens
ggucaucucgguccugaac

SEQ ID NO: 343698 - RNA, 19 nt, Homo sapiens
ucuugaugcuccuaucugu

SEQ ID NO: 343699 - RNA, 19 nt, Homo sapiens
gggagccacaggaagcaaa

SEQ ID NO: 343700 - RNA, 19 nt, Homo sapiens
ccaaggagcuggagaaagu

SEQ ID NO: 343701 - RNA, 19 nt, Homo sapiens
ccaagcuucugguugauua

SEQ ID NO: 343702 - RNA, 19 nt, Homo sapiens
gggccaagcuucugguuga

SEQ ID NO: 343703 - RNA, 19 nt, Homo sapiens
gcuacgagaugcuuaagga

SEQ ID NO: 343704 - RNA, 19 nt, Homo sapiens
gccgagagcuggacuuugu

SEQ ID NO: 343705 - RNA, 19 nt, Homo sapiens
gggagcaugugaugaagaa

SEQ ID NO: 343706 - RNA, 19 nt, Homo sapiens
gaugggcgcuggaugaagu

SEQ ID NO: 343707 - RNA, 19 nt, Homo sapiens
ugaagaauguggacaccaa

SEQ ID NO: 343708 - RNA, 19 nt, Homo sapiens
gugaucggcuuaacuuaga

SEQ ID NO: 343709 - RNA, 19 nt, Homo sapiens
cgagcaggaucccaaugua

SEQ ID NO: 343710 - RNA, 19 nt, Homo sapiens
ccaccugucuccacuuuca

SEQ ID NO: 343711 - RNA, 19 nt, Homo sapiens
cgacgcagcccaucaugaa

SEQ ID NO: 343712 - RNA, 19 nt, Homo sapiens
gaaaguguacgacccaaag

SEQ ID NO: 343713 - RNA, 19 nt, Homo sapiens
gaaccagugaugccucaaa

SEQ ID NO: 343714 - RNA, 19 nt, Homo sapiens
gcccacagcuacuggaauc

SEQ ID NO: 343715 - RNA, 19 nt, Homo sapiens
gugaugguguccuggauga

SEQ ID NO: 343716 - RNA, 19 nt, Homo sapiens
gcuucugguugauuaauga

SEQ ID NO: 343717 - RNA, 19 nt, Homo sapiens
gagcugaggcgcuuugaag

SEQ ID NO: 343718 - RNA, 19 nt, Homo sapiens
gaagagcugaggcgcuuug

SEQ ID NO: 343719 - RNA, 19 nt, Homo sapiens
ugcaugauaucaacaguga

SEQ ID NO: 343720 - RNA, 19 nt, Homo sapiens
gagcaugugaugaagaaug

SEQ ID NO: 343721 - RNA, 19 nt, Homo sapiens
ugaaucuccugaaacaguu

SEQ ID NO: 343722 - RNA, 19 nt, Homo sapiens
gagguggacacuucagaaa

SEQ ID NO: 343723 - RNA, 19 nt, Homo sapiens
acagguggaucaucugaau

SEQ ID NO: 343724 - RNA, 19 nt, Homo sapiens
gaugggcauuuccgagaga

SEQ ID NO: 343725 - RNA, 19 nt, Homo sapiens
ggagguggacacuucagaa

SEQ ID NO: 343726 - RNA, 19 nt, Homo sapiens
guccaccugucuccacuuu

SEQ ID NO: 343727 - RNA, 19 nt, Homo sapiens
gaaugaggaggacgacaug

SEQ ID NO: 343728 - RNA, 19 nt, Homo sapiens
guacagguggaucaucuga

SEQ ID NO: 343729 - RNA, 19 nt, Homo sapiens
ucagugaucggcuuaacuu

SEQ ID NO: 343730 - RNA, 19 nt, Homo sapiens
gagccgagagcuggacuuu

SEQ ID NO: 343731 - RNA, 19 nt, Homo sapiens
gaacaccuggacccucaga

SEQ ID NO: 343732 - RNA, 19 nt, Homo sapiens
uccaggaggucaucgaugu

SEQ ID NO: 343733 - RNA, 19 nt, Homo sapiens
gcaccgcgagcacccuaaa

SEQ ID NO: 343734 - RNA, 19 nt, Homo sapiens
ggcguuaucuggagucacu

SEQ ID NO: 343735 - RNA, 19 nt, Homo sapiens
ucaucugaaucuccugaaa

SEQ ID NO: 343736 - RNA, 19 nt, Homo sapiens
ggcacggccuggcauuuca

SEQ ID NO: 343737 - RNA, 19 nt, Homo sapiens
uggaggcacucuucaccaa

SEQ ID NO: 343738 - RNA, 19 nt, Homo sapiens
gaaguggcacagucagcuu

SEQ ID NO: 343739 - RNA, 19 nt, Homo sapiens
ggaugaaguggcacaguca

SEQ ID NO: 343740 - RNA, 19 nt, Homo sapiens
gggagacaguggagaugca

SEQ ID NO: 343741 - RNA, 19 nt, Homo sapiens
uguacgacccaaagaauga

SEQ ID NO: 343742 - RNA, 19 nt, Homo sapiens
gccaagcccaguugaagga

SEQ ID NO: 343743 - RNA, 19 nt, Homo sapiens
gcgagcacccuaaagucaa

SEQ ID NO: 343744 - RNA, 19 nt, Homo sapiens
ucaccaaggagcuggagaa

SEQ ID NO: 343745 - RNA, 19 nt, Homo sapiens
gagcaggaucccaauguac

SEQ ID NO: 343746 - RNA, 19 nt, Homo sapiens
gcagccaagcccaguugaa

SEQ ID NO: 343747 - RNA, 19 nt, Homo sapiens
acgagaugcuuaaggaaca

SEQ ID NO: 343748 - RNA, 19 nt, Homo sapiens
guucaagcgcuacgagaug

SEQ ID NO: 343749 - RNA, 19 nt, Homo sapiens
guacgacgcagcccaucau

SEQ ID NO: 343750 - RNA, 19 nt, Homo sapiens
ccaaugcggaggacaucaa

SEQ ID NO: 343751 - RNA, 19 nt, Homo sapiens
ccucagaaccagcauacau

SEQ ID NO: 343752 - RNA, 19 nt, Homo sapiens
ccaggaggucaucgaugua

SEQ ID NO: 343753 - RNA, 19 nt, Homo sapiens
caaguuccacccagacaca

SEQ ID NO: 343754 - RNA, 19 nt, Homo sapiens
ggagcuggaggcacucuuc

SEQ ID NO: 343755 - RNA, 19 nt, Homo sapiens
ccaauguacagguggauca

SEQ ID NO: 343756 - RNA, 19 nt, Homo sapiens
ccuggcauuucacgcauug

SEQ ID NO: 343757 - RNA, 19 nt, Homo sapiens
cauacugcaugauaucaac

SEQ ID NO: 343758 - RNA, 19 nt, Homo sapiens
ggaggucaucgauguacug

SEQ ID NO: 343759 - RNA, 19 nt, Homo sapiens
gcuuaaggaacacgagaga

SEQ ID NO: 343760 - RNA, 19 nt, Homo sapiens
ucagaaccagcauacauuc

SEQ ID NO: 343761 - RNA, 19 nt, Homo sapiens
gcucagugaucggcuuaac

SEQ ID NO: 343762 - RNA, 19 nt, Homo sapiens
ggacacuucagaaaagaaa

SEQ ID NO: 343763 - RNA, 19 nt, Homo sapiens
gguggacacuucagaaaag

SEQ ID NO: 343764 - RNA, 19 nt, Homo sapiens
cacgagagacggcguuauc

SEQ ID NO: 343765 - RNA, 19 nt, Homo sapiens
ccgguuccauccaaauaca

SEQ ID NO: 343766 - RNA, 19 nt, Homo sapiens
gauggacgccgagcaggau

SEQ ID NO: 343767 - RNA, 19 nt, Homo sapiens
agcaugugaugaagaaugu

SEQ ID NO: 343768 - RNA, 19 nt, Homo sapiens
gugcucagugaucggcuua

SEQ ID NO: 343769 - RNA, 19 nt, Homo sapiens
gagcuggaggcacucuuca

SEQ ID NO: 343770 - RNA, 19 nt, Homo sapiens
cugaaucuccugaaacagu

SEQ ID NO: 343771 - RNA, 19 nt, Homo sapiens
gaagaaagcuguuaacuca

SEQ ID NO: 343772 - RNA, 19 nt, Homo sapiens
gaagaaaggcuuagaauga

SEQ ID NO: 343773 - RNA, 19 nt, Homo sapiens
gaaaguauaugacccuaaa

SEQ ID NO: 343774 - RNA, 19 nt, Homo sapiens
gauaaacacuucagagaaa

SEQ ID NO: 343775 - RNA, 19 nt, Homo sapiens
gcaaagaacuggauuuagu

SEQ ID NO: 343776 - RNA, 19 nt, Homo sapiens
gaagaagagucuaaauuug

SEQ ID NO: 343777 - RNA, 19 nt, Homo sapiens
ugaaugagguugauacuaa

SEQ ID NO: 343778 - RNA, 19 nt, Homo sapiens
ggaagagacugauggauug

SEQ ID NO: 343779 - RNA, 19 nt, Homo sapiens
ggaaacagauaaacacuuc

SEQ ID NO: 343780 - RNA, 19 nt, Homo sapiens
gaaaaucacccuaaaguua

SEQ ID NO: 343781 - RNA, 19 nt, Homo sapiens
guaggaagguuaagaaugu

SEQ ID NO: 343782 - RNA, 19 nt, Homo sapiens
cagaugagcuucagaaaca

SEQ ID NO: 343783 - RNA, 19 nt, Homo sapiens
ugaagaggaugauauggua

SEQ ID NO: 343784 - RNA, 19 nt, Homo sapiens
gcaagaaguaggaagguua

SEQ ID NO: 343785 - RNA, 19 nt, Homo sapiens
ucaguugucucaucuguaa

SEQ ID NO: 343786 - RNA, 19 nt, Homo sapiens
gggaacauguaaugaauga

SEQ ID NO: 343787 - RNA, 19 nt, Homo sapiens
uagaagcccuauuuacuaa

SEQ ID NO: 343788 - RNA, 19 nt, Homo sapiens
ggaauaucaucaggucaua

SEQ ID NO: 343789 - RNA, 19 nt, Homo sapiens
ggaccauccugcuacagua

SEQ ID NO: 343790 - RNA, 19 nt, Homo sapiens
gaauuagaagcccuauuua

SEQ ID NO: 343791 - RNA, 19 nt, Homo sapiens
gagggaacauguaaugaau

SEQ ID NO: 343792 - RNA, 19 nt, Homo sapiens
cuaaagaguuggagaaagu

SEQ ID NO: 343793 - RNA, 19 nt, Homo sapiens
gaaguaggaagguuaagaa

SEQ ID NO: 343794 - RNA, 19 nt, Homo sapiens
gaagaaggcagaugagcuu

SEQ ID NO: 343795 - RNA, 19 nt, Homo sapiens
gaagaagaaaggcuuagaa

SEQ ID NO: 343796 - RNA, 19 nt, Homo sapiens
caaagaacuggauuuagua

SEQ ID NO: 343797 - RNA, 19 nt, Homo sapiens
gaaagcagacauagaggaa

SEQ ID NO: 343798 - RNA, 19 nt, Homo sapiens
gaagauagaaccaccagau

SEQ ID NO: 343799 - RNA, 19 nt, Homo sapiens
agaauuagaagcccuauuu

SEQ ID NO: 343800 - RNA, 19 nt, Homo sapiens
ccaccaagcucuucuaaaa

SEQ ID NO: 343801 - RNA, 19 nt, Homo sapiens
caccagaacuuggaagaaa

SEQ ID NO: 343802 - RNA, 19 nt, Homo sapiens
gggaagagacugauggauu

SEQ ID NO: 343803 - RNA, 19 nt, Homo sapiens
gaacaugaaaggagagaau

SEQ ID NO: 343804 - RNA, 19 nt, Homo sapiens
ccacacauuuaaagucuga

SEQ ID NO: 343805 - RNA, 19 nt, Homo sapiens
acccaucucuucacuauuu

SEQ ID NO: 343806 - RNA, 19 nt, Homo sapiens
caagucaucuuaccucucu

SEQ ID NO: 343807 - RNA, 19 nt, Homo sapiens
uaaguuggauucccuucaa

SEQ ID NO: 343808 - RNA, 19 nt, Homo sapiens
ggacaaaacuugaugaacu

SEQ ID NO: 343809 - RNA, 19 nt, Homo sapiens
ggauucccuucaagauaua

SEQ ID NO: 343810 - RNA, 19 nt, Homo sapiens
gaauaucucaagcaaguga

SEQ ID NO: 343811 - RNA, 19 nt, Homo sapiens
cucagaagcuggaauauca

SEQ ID NO: 343812 - RNA, 19 nt, Homo sapiens
gaacuggauuuaguaaguc

SEQ ID NO: 343813 - RNA, 19 nt, Homo sapiens
ggaagcaaagaucaacuaa

SEQ ID NO: 343814 - RNA, 19 nt, Homo sapiens
ccugaauccugacaaguuu

SEQ ID NO: 343815 - RNA, 19 nt, Homo sapiens
gaagcaaagaucaacuaaa

SEQ ID NO: 343816 - RNA, 19 nt, Homo sapiens
gaaaagaagaagagucuaa

SEQ ID NO: 343817 - RNA, 19 nt, Homo sapiens
caagacucgucaugaagaa

SEQ ID NO: 343818 - RNA, 19 nt, Homo sapiens
ggcaacaagugaucuggaa

SEQ ID NO: 343819 - RNA, 19 nt, Homo sapiens
gagaaaagcuccagaaagc

SEQ ID NO: 343820 - RNA, 19 nt, Homo sapiens
gaucucaguugucucaucu

SEQ ID NO: 343821 - RNA, 19 nt, Homo sapiens
ggaagaaagcuguuaacuc

SEQ ID NO: 343822 - RNA, 19 nt, Homo sapiens
ggaugaacaagaauuagaa

SEQ ID NO: 343823 - RNA, 19 nt, Homo sapiens
uggauucccuucaagauau

SEQ ID NO: 343824 - RNA, 19 nt, Homo sapiens
caguauugcuuucucuuga

SEQ ID NO: 343825 - RNA, 19 nt, Homo sapiens
gaaguuugagccacacauu

SEQ ID NO: 343826 - RNA, 19 nt, Homo sapiens
agacccaucucuucacuau

SEQ ID NO: 343827 - RNA, 19 nt, Homo sapiens
caagaaguaggaagguuaa

SEQ ID NO: 343828 - RNA, 19 nt, Homo sapiens
aagcaaagaacuggauuua

SEQ ID NO: 343829 - RNA, 19 nt, Homo sapiens
uuagaagcccuauuuacua

SEQ ID NO: 343830 - RNA, 19 nt, Homo sapiens
gauacuggacuuuauuaug

SEQ ID NO: 343831 - RNA, 19 nt, Homo sapiens
gcuggagaauugaaguuug

SEQ ID NO: 343832 - RNA, 19 nt, Homo sapiens
gcaaagaucaacuaaaaga

SEQ ID NO: 343833 - RNA, 19 nt, Homo sapiens
agacauagaggaaauaaag

SEQ ID NO: 343834 - RNA, 19 nt, Homo sapiens
ccagaaagcagacauagag

SEQ ID NO: 343835 - RNA, 19 nt, Homo sapiens
cagauacuggacuuuauua

SEQ ID NO: 343836 - RNA, 19 nt, Homo sapiens
guauugcuuucucuugauu

SEQ ID NO: 343837 - RNA, 19 nt, Homo sapiens
agaacuggauuuaguaagu

SEQ ID NO: 343838 - RNA, 19 nt, Homo sapiens
gcagacauagaggaaauaa

SEQ ID NO: 343839 - RNA, 19 nt, Homo sapiens
cagauaaacacuucagaga

SEQ ID NO: 343840 - RNA, 19 nt, Homo sapiens
ggaaagugcgaagauagaa

SEQ ID NO: 343841 - RNA, 19 nt, Homo sapiens
agaaugagggaacauguaa

SEQ ID NO: 343842 - RNA, 19 nt, Homo sapiens
ggaacacuaugacaagacu

SEQ ID NO: 343843 - RNA, 19 nt, Homo sapiens
ucaaagcggcaacaaguga

SEQ ID NO: 343844 - RNA, 19 nt, Homo sapiens
ucacagaggaagaacuaaa

SEQ ID NO: 343845 - RNA, 19 nt, Homo sapiens
ugagguugauacuaacaaa

SEQ ID NO: 343846 - RNA, 19 nt, Homo sapiens
gauuggauccuaaugacuu

SEQ ID NO: 343847 - RNA, 19 nt, Homo sapiens
ugaugaauaucucaagcaa

SEQ ID NO: 343848 - RNA, 19 nt, Homo sapiens
uuaagaagaaggcagauga

SEQ ID NO: 343849 - RNA, 19 nt, Homo sapiens
gaaugagguugauacuaac

SEQ ID NO: 343850 - RNA, 19 nt, Homo sapiens
cagaacguguuacgaguca

SEQ ID NO: 343851 - RNA, 19 nt, Homo sapiens
gaaaugaugaaggaacaug

SEQ ID NO: 343852 - RNA, 19 nt, Homo sapiens
aagcagacauagaggaaau

SEQ ID NO: 343853 - RNA, 19 nt, Homo sapiens
augaauaucucaagcaagu

SEQ ID NO: 343854 - RNA, 19 nt, Homo sapiens
cuggagaauugaaguuuga

SEQ ID NO: 343855 - RNA, 19 nt, Homo sapiens
ggaagaagaaaggcuuaga

SEQ ID NO: 343856 - RNA, 19 nt, Homo sapiens
gugauggauuccuggauga

SEQ ID NO: 343857 - RNA, 19 nt, Homo sapiens
aaagagguaugggaagaga

SEQ ID NO: 343858 - RNA, 19 nt, Homo sapiens
agaaagcuguuaacucaac

SEQ ID NO: 343859 - RNA, 19 nt, Homo sapiens
ugagggaacauguaaugaa

SEQ ID NO: 343860 - RNA, 19 nt, Homo sapiens
gguagaaauggaagaagaa

SEQ ID NO: 343861 - RNA, 19 nt, Homo sapiens
aggaugauaugguagaaau

SEQ ID NO: 343862 - RNA, 19 nt, Homo sapiens
uuauuuaccugccugaaca

SEQ ID NO: 343863 - RNA, 19 nt, Homo sapiens
gcaugaaaaucacccuaaa

SEQ ID NO: 343864 - RNA, 19 nt, Homo sapiens
caacaagugaucuggaaca

SEQ ID NO: 343865 - RNA, 19 nt, Homo sapiens
uguggaaagugcgaagaua

SEQ ID NO: 343866 - RNA, 19 nt, Homo sapiens
ugguagaaauggaagaaga

SEQ ID NO: 343867 - RNA, 19 nt, Homo sapiens
acaauuugaucaccuaaac

SEQ ID NO: 343868 - RNA, 19 nt, Homo sapiens
uugaagcugugccuauuga

SEQ ID NO: 343869 - RNA, 19 nt, Homo sapiens
aguuugagccacacauuua

SEQ ID NO: 343870 - RNA, 19 nt, Homo sapiens
uaaaagagguaugggaaga

SEQ ID NO: 343871 - RNA, 19 nt, Homo sapiens
gaaaggagcuggaagaaga

SEQ ID NO: 343872 - RNA, 19 nt, Homo sapiens
gggaacaguuugaauauaa

SEQ ID NO: 343873 - RNA, 19 nt, Homo sapiens
cgagaaggaugcacagaua

SEQ ID NO: 343874 - RNA, 19 nt, Homo sapiens
gcaagaggcugagaggaaa

SEQ ID NO: 343875 - RNA, 19 nt, Homo sapiens
gguggcaacugaugcuuua

SEQ ID NO: 343876 - RNA, 19 nt, Homo sapiens
gcagccagguggaaacuaa

SEQ ID NO: 343877 - RNA, 19 nt, Homo sapiens
gcaguagccugaagcagaa

SEQ ID NO: 343878 - RNA, 19 nt, Homo sapiens
gaaccagccucaccuaucu

SEQ ID NO: 343879 - RNA, 19 nt, Homo sapiens
gaauggagaccuuuccuuu

SEQ ID NO: 343880 - RNA, 19 nt, Homo sapiens
cagcuggacuugaguauug

SEQ ID NO: 343881 - RNA, 19 nt, Homo sapiens
cuagagaacuuccuacaga

SEQ ID NO: 343882 - RNA, 19 nt, Homo sapiens
gcaaacagagcacuacuga

SEQ ID NO: 343883 - RNA, 19 nt, Homo sapiens
gaacagcugaugacuuuga

SEQ ID NO: 343884 - RNA, 19 nt, Homo sapiens
aggaacagcugaugacuuu

SEQ ID NO: 343885 - RNA, 19 nt, Homo sapiens
agaaaugccuugaagagaa

SEQ ID NO: 343886 - RNA, 19 nt, Homo sapiens
gaagagaggcagaaacuca

SEQ ID NO: 343887 - RNA, 19 nt, Homo sapiens
ggugaugacugccaaguau

SEQ ID NO: 343888 - RNA, 19 nt, Homo sapiens
gaagguggcaggcauagaa

SEQ ID NO: 343889 - RNA, 19 nt, Homo sapiens
gcaaacgggucucccuaga

SEQ ID NO: 343890 - RNA, 19 nt, Homo sapiens
gcaggcagcugagcacuau

SEQ ID NO: 343891 - RNA, 19 nt, Homo sapiens
ugaccaugcugcucuuaua

SEQ ID NO: 343892 - RNA, 19 nt, Homo sapiens
cccagaagcuugcagauga

SEQ ID NO: 343893 - RNA, 19 nt, Homo sapiens
gcaacaggaucaagaacug

SEQ ID NO: 343894 - RNA, 19 nt, Homo sapiens
gaaaugccuugaagagaag

SEQ ID NO: 343895 - RNA, 19 nt, Homo sapiens
ccaaguagcugggauuaca

SEQ ID NO: 343896 - RNA, 19 nt, Homo sapiens
gggcugcacuccucucuug

SEQ ID NO: 343897 - RNA, 19 nt, Homo sapiens
ggaguucgcuacccugcaa

SEQ ID NO: 343898 - RNA, 19 nt, Homo sapiens
aggaacagcuggcuaagaa

SEQ ID NO: 343899 - RNA, 19 nt, Homo sapiens
gagguacgauuccggagaa

SEQ ID NO: 343900 - RNA, 19 nt, Homo sapiens
uggaagaacugaguaagaa

SEQ ID NO: 343901 - RNA, 19 nt, Homo sapiens
gaagagcucuccccaccua

SEQ ID NO: 343902 - RNA, 19 nt, Homo sapiens
ccacagcgagcuccagaua

SEQ ID NO: 343903 - RNA, 19 nt, Homo sapiens
gaagagcagcagcguugua

SEQ ID NO: 343904 - RNA, 19 nt, Homo sapiens
gaagcuagauguggaagag

SEQ ID NO: 343905 - RNA, 19 nt, Homo sapiens
ggcaggagcugaccucaca

SEQ ID NO: 343906 - RNA, 19 nt, Homo sapiens
ugaaggagguagcggagaa

SEQ ID NO: 343907 - RNA, 19 nt, Homo sapiens
gaggacgggcuaaaccuua

SEQ ID NO: 343908 - RNA, 19 nt, Homo sapiens
ugaguuggcugucauucuu

SEQ ID NO: 343909 - RNA, 19 nt, Homo sapiens
caaagaaggcccuguccaa

SEQ ID NO: 343910 - RNA, 19 nt, Homo sapiens
ggagggaggcugagaaaca

SEQ ID NO: 343911 - RNA, 19 nt, Homo sapiens
ugaagcaacugaaggaaca

SEQ ID NO: 343912 - RNA, 19 nt, Homo sapiens
uagagaugcuggagacuga

SEQ ID NO: 343913 - RNA, 19 nt, Homo sapiens
gcaagcuccucaccgagaa

SEQ ID NO: 343914 - RNA, 19 nt, Homo sapiens
ccacgcagaucaucaacau

SEQ ID NO: 343915 - RNA, 19 nt, Homo sapiens
auggagaccuuuccuuuaa

SEQ ID NO: 343916 - RNA, 19 nt, Homo sapiens
gcugaugagagaaguaaua

SEQ ID NO: 343917 - RNA, 19 nt, Homo sapiens
caagaucauugacagaauc

SEQ ID NO: 343918 - RNA, 19 nt, Homo sapiens
ggagaaggcccaggagcua

SEQ ID NO: 343919 - RNA, 19 nt, Homo sapiens
gcaagaggaggcacaguau

SEQ ID NO: 343920 - RNA, 19 nt, Homo sapiens
ggaggagaauggagaccuu

SEQ ID NO: 343921 - RNA, 19 nt, Homo sapiens
cagagagacuggacuuugu

SEQ ID NO: 343922 - RNA, 19 nt, Homo sapiens
gaagagggacagcaaaucu

SEQ ID NO: 343923 - RNA, 19 nt, Homo sapiens
acuauaagcugcagaugga

SEQ ID NO: 343924 - RNA, 19 nt, Homo sapiens
cagagcagaugggcaauga

SEQ ID NO: 343925 - RNA, 19 nt, Homo sapiens
cagaugaccucuccacucu

SEQ ID NO: 343926 - RNA, 19 nt, Homo sapiens
ugucccagcugcaggauaa

SEQ ID NO: 343927 - RNA, 19 nt, Homo sapiens
gccuagcccugcugaauga

SEQ ID NO: 343928 - RNA, 19 nt, Homo sapiens
gaucuagaagggaccauaa

SEQ ID NO: 343929 - RNA, 19 nt, Homo sapiens
caacugaugcuuuaaagag

SEQ ID NO: 343930 - RNA, 19 nt, Homo sapiens
ggagcugggccaagaauug

SEQ ID NO: 343931 - RNA, 19 nt, Homo sapiens
gaacagcuggcuaagaaag

SEQ ID NO: 343932 - RNA, 19 nt, Homo sapiens
ugaaggaacagcuggcuaa

SEQ ID NO: 343933 - RNA, 19 nt, Homo sapiens
ugucuagccugaucacuga

SEQ ID NO: 343934 - RNA, 19 nt, Homo sapiens
cuacugaggcccagaagaa

SEQ ID NO: 343935 - RNA, 19 nt, Homo sapiens
uaaaagagcuggaggaacu

SEQ ID NO: 343936 - RNA, 19 nt, Homo sapiens
ggagaagguggcaggcaua

SEQ ID NO: 343937 - RNA, 19 nt, Homo sapiens
ggaagaacugaguaagaaa

SEQ ID NO: 343938 - RNA, 19 nt, Homo sapiens
ggacagugcucuggagacu

SEQ ID NO: 343939 - RNA, 19 nt, Homo sapiens
gcucaugcccugacggaaa

SEQ ID NO: 343940 - RNA, 19 nt, Homo sapiens
gcaggaccaugcccagcaa

SEQ ID NO: 343941 - RNA, 19 nt, Homo sapiens
ugagacggcugaagaagca

SEQ ID NO: 343942 - RNA, 19 nt, Homo sapiens
cagaauccauggcacugaa

SEQ ID NO: 343943 - RNA, 19 nt, Homo sapiens
gggcagagaaggccagcua

SEQ ID NO: 343944 - RNA, 19 nt, Homo sapiens
uagagaacuuccuacagaa

SEQ ID NO: 343945 - RNA, 19 nt, Homo sapiens
ggaccuagagaacuuccua

SEQ ID NO: 343946 - RNA, 19 nt, Homo sapiens
uagaaucccuggagagucu

SEQ ID NO: 343947 - RNA, 19 nt, Homo sapiens
uggagcagcugcagaagga

SEQ ID NO: 343948 - RNA, 19 nt, Homo sapiens
gcaaggugcagcagcagaa

SEQ ID NO: 343949 - RNA, 19 nt, Homo sapiens
ggcaagaggcugagaggaa

SEQ ID NO: 343950 - RNA, 19 nt, Homo sapiens
ggagcugcgugacaagaau

SEQ ID NO: 343951 - RNA, 19 nt, Homo sapiens
gacagcaaaucuugaagca

SEQ ID NO: 343952 - RNA, 19 nt, Homo sapiens
gguggaaacuaauucuaag

SEQ ID NO: 343953 - RNA, 19 nt, Homo sapiens
ccacgaagagguacgauuc

SEQ ID NO: 343954 - RNA, 19 nt, Homo sapiens
agaaggagcagcaguugaa

SEQ ID NO: 343955 - RNA, 19 nt, Homo sapiens
ugaagcagcaggccaaaga

SEQ ID NO: 343956 - RNA, 19 nt, Homo sapiens
ggugcugggugaugucuug

SEQ ID NO: 343957 - RNA, 19 nt, Homo sapiens
gcuacaggaugcccucaau

SEQ ID NO: 343958 - RNA, 19 nt, Homo sapiens
gagggagauucgcuuccua

SEQ ID NO: 343959 - RNA, 19 nt, Homo sapiens
ugaagcagccggugucaga

SEQ ID NO: 343960 - RNA, 19 nt, Homo sapiens
caacacacccaagaagcua

SEQ ID NO: 343961 - RNA, 19 nt, Homo sapiens
gcagauggagaaagccaaa

SEQ ID NO: 343962 - RNA, 19 nt, Homo sapiens
gacaagaaugagagccuua

SEQ ID NO: 343963 - RNA, 19 nt, Homo sapiens
cagaugagacggcugaaga

SEQ ID NO: 343964 - RNA, 19 nt, Homo sapiens
ggcugucauucuuaaauuu

SEQ ID NO: 343965 - RNA, 19 nt, Homo sapiens
ggugggauuuggagugaug

SEQ ID NO: 343966 - RNA, 19 nt, Homo sapiens
gcaccacgcagaucaucaa

SEQ ID NO: 343967 - RNA, 19 nt, Homo sapiens
ggagaucacccuguucuag

SEQ ID NO: 343968 - RNA, 19 nt, Homo sapiens
cagcugagagugaguguga

SEQ ID NO: 343969 - RNA, 19 nt, Homo sapiens
gaacuccaggccuguguug

SEQ ID NO: 343970 - RNA, 19 nt, Homo sapiens
ccucugagcucaccacacu

SEQ ID NO: 343971 - RNA, 19 nt, Homo sapiens
ggaaauggcugagcguuua

SEQ ID NO: 343972 - RNA, 19 nt, Homo sapiens
gaacaccauugaaggcuua

SEQ ID NO: 343973 - RNA, 19 nt, Homo sapiens
gcguuuagcugacaaauau

SEQ ID NO: 343974 - RNA, 19 nt, Homo sapiens
gaaagucuaguacucaaua

SEQ ID NO: 343975 - RNA, 19 nt, Homo sapiens
uagaagaucucaguuauug

SEQ ID NO: 343976 - RNA, 19 nt, Homo sapiens
gaacacauccuuuguacga

SEQ ID NO: 343977 - RNA, 19 nt, Homo sapiens
ucaaacagguuacuaugaa

SEQ ID NO: 343978 - RNA, 19 nt, Homo sapiens
gggcuaacuuggauucaua

SEQ ID NO: 343979 - RNA, 19 nt, Homo sapiens
gagagacuuuccugacaua

SEQ ID NO: 343980 - RNA, 19 nt, Homo sapiens
acacagcccuggaaauauu

SEQ ID NO: 343981 - RNA, 19 nt, Homo sapiens
ccaaguguccuucaagaua

SEQ ID NO: 343982 - RNA, 19 nt, Homo sapiens
ucacaaauuucuuggauca

SEQ ID NO: 343983 - RNA, 19 nt, Homo sapiens
gaacugaacaccauugaag

SEQ ID NO: 343984 - RNA, 19 nt, Homo sapiens
gaaagugcauucaguccau

SEQ ID NO: 343985 - RNA, 19 nt, Homo sapiens
cggcaaagaugaaguagug

SEQ ID NO: 343986 - RNA, 19 nt, Homo sapiens
gaaagaauuacagcugaua

SEQ ID NO: 343987 - RNA, 19 nt, Homo sapiens
gaucagaugaagaagauaa

SEQ ID NO: 343988 - RNA, 19 nt, Homo sapiens
caaguguccuucaagauau

SEQ ID NO: 343989 - RNA, 19 nt, Homo sapiens
agaggagggugaacauaua

SEQ ID NO: 343990 - RNA, 19 nt, Homo sapiens
gagauugcuuugcauaaau

SEQ ID NO: 343991 - RNA, 19 nt, Homo sapiens
agacagcaguugcauuuga

SEQ ID NO: 343992 - RNA, 19 nt, Homo sapiens
caaacagguuacuaugaaa

SEQ ID NO: 343993 - RNA, 19 nt, Homo sapiens
uuacacagcccuggaaaua

SEQ ID NO: 343994 - RNA, 19 nt, Homo sapiens
ggacuuaugguauuagaau

SEQ ID NO: 343995 - RNA, 19 nt, Homo sapiens
gcuuaaacccauauuguaa

SEQ ID NO: 343996 - RNA, 19 nt, Homo sapiens
uggcagaccuggcuuccua

SEQ ID NO: 343997 - RNA, 19 nt, Homo sapiens
gaacauauaagggaaaugg

SEQ ID NO: 343998 - RNA, 19 nt, Homo sapiens
ucauagagaucccaagugu

SEQ ID NO: 343999 - RNA, 19 nt, Homo sapiens
gggaaauggugaagcaaau

SEQ ID NO: 344000 - RNA, 19 nt, Homo sapiens
gcggagggucaaauuauua

SEQ ID NO: 344001 - RNA, 19 nt, Homo sapiens
ccaccucucugacucuaaa

SEQ ID NO: 344002 - RNA, 19 nt, Homo sapiens
ggagagacuuuccugacau

SEQ ID NO: 344003 - RNA, 19 nt, Homo sapiens
uaagggaaauggugaagca

SEQ ID NO: 344004 - RNA, 19 nt, Homo sapiens
gaagaucucaguuauuguc

SEQ ID NO: 344005 - RNA, 19 nt, Homo sapiens
uacaggaacucucuacaga

SEQ ID NO: 344006 - RNA, 19 nt, Homo sapiens
gcaaucauguaaacuucug

SEQ ID NO: 344007 - RNA, 19 nt, Homo sapiens
gauauccgcaaucauguaa

SEQ ID NO: 344008 - RNA, 19 nt, Homo sapiens
ucgagaagauguugaagug

SEQ ID NO: 344009 - RNA, 19 nt, Homo sapiens
gauuguaccugacauucug

SEQ ID NO: 344010 - RNA, 19 nt, Homo sapiens
ucaugaagcugguguacau

SEQ ID NO: 344011 - RNA, 19 nt, Homo sapiens
cgagaaacguggucuuugg

SEQ ID NO: 344012 - RNA, 19 nt, Homo sapiens
gaaauggugaagcaaauca

SEQ ID NO: 344013 - RNA, 19 nt, Homo sapiens
aaucaggaaugcuguauca

SEQ ID NO: 344014 - RNA, 19 nt, Homo sapiens
ugacauacaucagucuguu

SEQ ID NO: 344015 - RNA, 19 nt, Homo sapiens
gcaguugcauuugacuuug

SEQ ID NO: 344016 - RNA, 19 nt, Homo sapiens
ccacuaacgugauaauacu

SEQ ID NO: 344017 - RNA, 19 nt, Homo sapiens
agagauugcuuugcauaaa

SEQ ID NO: 344018 - RNA, 19 nt, Homo sapiens
ccucauuccuucucuguau

SEQ ID NO: 344019 - RNA, 19 nt, Homo sapiens
cacuguacaucuuauauga

SEQ ID NO: 344020 - RNA, 19 nt, Homo sapiens
agagacagcaguugcauuu

SEQ ID NO: 344021 - RNA, 19 nt, Homo sapiens
gaaagaggagggugaacau

SEQ ID NO: 344022 - RNA, 19 nt, Homo sapiens
acaaauaugaggaagcuaa

SEQ ID NO: 344023 - RNA, 19 nt, Homo sapiens
gaagauaaggauaguuuac

SEQ ID NO: 344024 - RNA, 19 nt, Homo sapiens
agauaucacuguacucaug

SEQ ID NO: 344025 - RNA, 19 nt, Homo sapiens
aagaugaaguaguggcaua

SEQ ID NO: 344026 - RNA, 19 nt, Homo sapiens
guuaacaucagacaacgua

SEQ ID NO: 344027 - RNA, 19 nt, Homo sapiens
gaaaaucaacagugaauug

SEQ ID NO: 344028 - RNA, 19 nt, Homo sapiens
acuagaagaucucaguuau

SEQ ID NO: 344029 - RNA, 19 nt, Homo sapiens
agaaacaacuagaagaucu

SEQ ID NO: 344030 - RNA, 19 nt, Homo sapiens
gacacccacuaacgugaua

SEQ ID NO: 344031 - RNA, 19 nt, Homo sapiens
gacaacguaaucagaauuu

SEQ ID NO: 344032 - RNA, 19 nt, Homo sapiens
ccucauauggccguuauua

SEQ ID NO: 344033 - RNA, 19 nt, Homo sapiens
guacauaguguugggcuaa

SEQ ID NO: 344034 - RNA, 19 nt, Homo sapiens
caagauaucacuguacuca

SEQ ID NO: 344035 - RNA, 19 nt, Homo sapiens
gaggagggugaacauauaa

SEQ ID NO: 344036 - RNA, 19 nt, Homo sapiens
uaaggauaguuuacaggaa

SEQ ID NO: 344037 - RNA, 19 nt, Homo sapiens
guuugaauguguugaguug

SEQ ID NO: 344038 - RNA, 19 nt, Homo sapiens
cgaagaggaaagucuagua

SEQ ID NO: 344039 - RNA, 19 nt, Homo sapiens
aaucaacagugaauuguag

SEQ ID NO: 344040 - RNA, 19 nt, Homo sapiens
cagcgaaagugcauucagu

SEQ ID NO: 344041 - RNA, 19 nt, Homo sapiens
aaacaggacuuggcaaagg

SEQ ID NO: 344042 - RNA, 19 nt, Homo sapiens
acaaauuucuuggaucaga

SEQ ID NO: 344043 - RNA, 19 nt, Homo sapiens
cagucaaacuucauagaga

SEQ ID NO: 344044 - RNA, 19 nt, Homo sapiens
aaacggcaaagaugaagua

SEQ ID NO: 344045 - RNA, 19 nt, Homo sapiens
ccaguucucucugauagug

SEQ ID NO: 344046 - RNA, 19 nt, Homo sapiens
cuacagaacagaaaugcuu

SEQ ID NO: 344047 - RNA, 19 nt, Homo sapiens
ggaacucucuacagaacag

SEQ ID NO: 344048 - RNA, 19 nt, Homo sapiens
ggaaagcuguuggguccau

SEQ ID NO: 344049 - RNA, 19 nt, Homo sapiens
gaugaagaagauaaggaua

SEQ ID NO: 344050 - RNA, 19 nt, Homo sapiens
gaucccaaguguccuucaa

SEQ ID NO: 344051 - RNA, 19 nt, Homo sapiens
ccagagauugcuuugcaua

SEQ ID NO: 344052 - RNA, 19 nt, Homo sapiens
gaagaggaaagucuaguac

SEQ ID NO: 344053 - RNA, 19 nt, Homo sapiens
uaccagagauugcuuugca

SEQ ID NO: 344054 - RNA, 19 nt, Homo sapiens
ggcuuaaacccauauugua

SEQ ID NO: 344055 - RNA, 19 nt, Homo sapiens
cugaucaacuucgacauuu

SEQ ID NO: 344056 - RNA, 19 nt, Homo sapiens
caaauaugaggaagcuaaa

SEQ ID NO: 344057 - RNA, 19 nt, Homo sapiens
gggaaauggcugagcguuu

SEQ ID NO: 344058 - RNA, 19 nt, Homo sapiens
acagaaaugcuuuguugaa

SEQ ID NO: 344059 - RNA, 19 nt, Homo sapiens
gaaagcuguuggguccauu

SEQ ID NO: 344060 - RNA, 19 nt, Homo sapiens
gacauacaucagucuguua

SEQ ID NO: 344061 - RNA, 19 nt, Homo sapiens
ggacaaaacggcaaagaug

SEQ ID NO: 344062 - RNA, 19 nt, Homo sapiens
ggaaaagucugcgggaaau

SEQ ID NO: 344063 - RNA, 19 nt, Homo sapiens
ucaaacaggacuuggcaaa

SEQ ID NO: 344064 - RNA, 19 nt, Homo sapiens
ugaagaagauaaggauagu

SEQ ID NO: 344065 - RNA, 19 nt, Homo sapiens
uggaucagaugaagaagau

SEQ ID NO: 344066 - RNA, 19 nt, Homo sapiens
caaauuucuuggaucagau

SEQ ID NO: 344067 - RNA, 19 nt, Homo sapiens
gacgagaaacguggucuuu

SEQ ID NO: 344068 - RNA, 19 nt, Homo sapiens
ucagagagcaguacauucu

SEQ ID NO: 344069 - RNA, 19 nt, Homo sapiens
guugaacacauccuuugua

SEQ ID NO: 344070 - RNA, 19 nt, Homo sapiens
caccugaacugaacaccau

SEQ ID NO: 344071 - RNA, 19 nt, Homo sapiens
gaagaagcauuucagaaua

SEQ ID NO: 344072 - RNA, 19 nt, Homo sapiens
gaagagagauugaaaccaa

SEQ ID NO: 344073 - RNA, 19 nt, Homo sapiens
gaauggcucucaugaacua

SEQ ID NO: 344074 - RNA, 19 nt, Homo sapiens
ggaaagaaguaguugucua

SEQ ID NO: 344075 - RNA, 19 nt, Homo sapiens
guaaugaccuggagcaguu

SEQ ID NO: 344076 - RNA, 19 nt, Homo sapiens
ggacaggcaucuuuguuug

SEQ ID NO: 344077 - RNA, 19 nt, Homo sapiens
uagagcagauucaguguua

SEQ ID NO: 344078 - RNA, 19 nt, Homo sapiens
caacacauauugcaucuuc

SEQ ID NO: 344079 - RNA, 19 nt, Homo sapiens
ggauuugccugcagaguuu

SEQ ID NO: 344080 - RNA, 19 nt, Homo sapiens
gagcacacauggaaucuga

SEQ ID NO: 344081 - RNA, 19 nt, Homo sapiens
ccacaugucuuacagauca

SEQ ID NO: 344082 - RNA, 19 nt, Homo sapiens
ugaagaagauguagauaug

SEQ ID NO: 344083 - RNA, 19 nt, Homo sapiens
acagggagcucaauucaaa

SEQ ID NO: 344084 - RNA, 19 nt, Homo sapiens
gagguucccugccuuguuu

SEQ ID NO: 344085 - RNA, 19 nt, Homo sapiens
agaaagugcuggaaauaaa

SEQ ID NO: 344086 - RNA, 19 nt, Homo sapiens
gcaaaccuguugaugagaa

SEQ ID NO: 344087 - RNA, 19 nt, Homo sapiens
gcacaucaauagucuaaca

SEQ ID NO: 344088 - RNA, 19 nt, Homo sapiens
ccacaaauaccaccucuaa

SEQ ID NO: 344089 - RNA, 19 nt, Homo sapiens
ccaaguucaucccauguua

SEQ ID NO: 344090 - RNA, 19 nt, Homo sapiens
gaugaagauucccuuguuu

SEQ ID NO: 344091 - RNA, 19 nt, Homo sapiens
gaacaaccaaccuaagauu

SEQ ID NO: 344092 - RNA, 19 nt, Homo sapiens
gaacuucguuuagaggauu

SEQ ID NO: 344093 - RNA, 19 nt, Homo sapiens
ucacuaagguugguuacua

SEQ ID NO: 344094 - RNA, 19 nt, Homo sapiens
gaaggaagcagugaagaaa

SEQ ID NO: 344095 - RNA, 19 nt, Homo sapiens
uggcacaacuucaacauuu

SEQ ID NO: 344096 - RNA, 19 nt, Homo sapiens
gcaugaagauaauguaaag

SEQ ID NO: 344097 - RNA, 19 nt, Homo sapiens
gauaauggauccuuaacag

SEQ ID NO: 344098 - RNA, 19 nt, Homo sapiens
gaaaugcuccgccauauac

SEQ ID NO: 344099 - RNA, 19 nt, Homo sapiens
caacuggacucuugcuaau

SEQ ID NO: 344100 - RNA, 19 nt, Homo sapiens
cuacuuagaugauaaccaa

SEQ ID NO: 344101 - RNA, 19 nt, Homo sapiens
ggagagagauuuaguuucc

SEQ ID NO: 344102 - RNA, 19 nt, Homo sapiens
gcagaccaauacuggauuu

SEQ ID NO: 344103 - RNA, 19 nt, Homo sapiens
ugaaggagaugugaauuug

SEQ ID NO: 344104 - RNA, 19 nt, Homo sapiens
gaaagguuaugguucaauc

SEQ ID NO: 344105 - RNA, 19 nt, Homo sapiens
gaaggaagagagauugaaa

SEQ ID NO: 344106 - RNA, 19 nt, Homo sapiens
cagaagaggagacaguuua

SEQ ID NO: 344107 - RNA, 19 nt, Homo sapiens
gaagucuccuuaacccaaa

SEQ ID NO: 344108 - RNA, 19 nt, Homo sapiens
gugaagggcuaaauaggaa

SEQ ID NO: 344109 - RNA, 19 nt, Homo sapiens
ggucaaagcuggaguuagc

SEQ ID NO: 344110 - RNA, 19 nt, Homo sapiens
uaaauacacccaucuauca

SEQ ID NO: 344111 - RNA, 19 nt, Homo sapiens
uuacuacaccuacucauua

SEQ ID NO: 344112 - RNA, 19 nt, Homo sapiens
caacuggcuuuggcaauuu

SEQ ID NO: 344113 - RNA, 19 nt, Homo sapiens
ugagauagcugguguuagg

SEQ ID NO: 344114 - RNA, 19 nt, Homo sapiens
caucuucacugggaauuaa

SEQ ID NO: 344115 - RNA, 19 nt, Homo sapiens
ggaccagucucuucucauc

SEQ ID NO: 344116 - RNA, 19 nt, Homo sapiens
ggaggccucuuuggaaauu

SEQ ID NO: 344117 - RNA, 19 nt, Homo sapiens
ggauccgucucuuaaguaa

SEQ ID NO: 344118 - RNA, 19 nt, Homo sapiens
cagaugaacuauccacaga

SEQ ID NO: 344119 - RNA, 19 nt, Homo sapiens
gcugagggaucuuaaauac

SEQ ID NO: 344120 - RNA, 19 nt, Homo sapiens
gcuggagccucgaagcaua

SEQ ID NO: 344121 - RNA, 19 nt, Homo sapiens
gcccagagguggagcaguu

SEQ ID NO: 344122 - RNA, 19 nt, Homo sapiens
ccaagaagagcauuaagaa

SEQ ID NO: 344123 - RNA, 19 nt, Homo sapiens
ccagaaggcucuuacuaca

SEQ ID NO: 344124 - RNA, 19 nt, Homo sapiens
cagcagauccuuuggacua

SEQ ID NO: 344125 - RNA, 19 nt, Homo sapiens
ccaacagccuccauuucua

SEQ ID NO: 344126 - RNA, 19 nt, Homo sapiens
gaugaacuguguccucuca

SEQ ID NO: 344127 - RNA, 19 nt, Homo sapiens
ucaagaucauucaguguuu

SEQ ID NO: 344128 - RNA, 19 nt, Homo sapiens
aaagaaagccagaugaaga

SEQ ID NO: 344129 - RNA, 19 nt, Homo sapiens
ggaaggaagcagugaagaa

SEQ ID NO: 344130 - RNA, 19 nt, Homo sapiens
aaacaugcgugcugcuuug

SEQ ID NO: 344131 - RNA, 19 nt, Homo sapiens
gaagagcauuaagaaguug

SEQ ID NO: 344132 - RNA, 19 nt, Homo sapiens
gcagcaucuuuaaugaaua

SEQ ID NO: 344133 - RNA, 19 nt, Homo sapiens
gauaucaacuaugaaggaa

SEQ ID NO: 344134 - RNA, 19 nt, Homo sapiens
ggaguuuggccaacagaua

SEQ ID NO: 344135 - RNA, 19 nt, Homo sapiens
gcacccagcagguauuauu

SEQ ID NO: 344136 - RNA, 19 nt, Homo sapiens
ggaaauaaacacagcaaca

SEQ ID NO: 344137 - RNA, 19 nt, Homo sapiens
agaagagcauuaagaaguu

SEQ ID NO: 344138 - RNA, 19 nt, Homo sapiens
ccaggaggauuguuuggaa

SEQ ID NO: 344139 - RNA, 19 nt, Homo sapiens
gaaacaaaaugggaucuuu

SEQ ID NO: 344140 - RNA, 19 nt, Homo sapiens
gcucaucauccgacacuua

SEQ ID NO: 344141 - RNA, 19 nt, Homo sapiens
ggaaacagggagcucaauu

SEQ ID NO: 344142 - RNA, 19 nt, Homo sapiens
uaucaacuaugaaggaaga

SEQ ID NO: 344143 - RNA, 19 nt, Homo sapiens
ccagaucgccuugcugaua

SEQ ID NO: 344144 - RNA, 19 nt, Homo sapiens
gcacuaacauaaguaccaa

SEQ ID NO: 344145 - RNA, 19 nt, Homo sapiens
gcgcaucuuugcucuguug

SEQ ID NO: 344146 - RNA, 19 nt, Homo sapiens
caaagcagauacuucucaa

SEQ ID NO: 344147 - RNA, 19 nt, Homo sapiens
gaaacagggagcucaauuc

SEQ ID NO: 344148 - RNA, 19 nt, Homo sapiens
gaagaaggaagagagauug

SEQ ID NO: 344149 - RNA, 19 nt, Homo sapiens
gaacuaguacaacuggauu

SEQ ID NO: 344150 - RNA, 19 nt, Homo sapiens
ugagacaggugauaaugga

SEQ ID NO: 344151 - RNA, 19 nt, Homo sapiens
ccaaccaguuuccuuauuc

SEQ ID NO: 344152 - RNA, 19 nt, Homo sapiens
gauagaaccuccgacucaa

SEQ ID NO: 344153 - RNA, 19 nt, Homo sapiens
gaacuguguccucucauug

SEQ ID NO: 344154 - RNA, 19 nt, Homo sapiens
uaagcaaaccuguugauga

SEQ ID NO: 344155 - RNA, 19 nt, Homo sapiens
guaccaagcaccaguguau

SEQ ID NO: 344156 - RNA, 19 nt, Homo sapiens
cauguuagcuccaaagcau

SEQ ID NO: 344157 - RNA, 19 nt, Homo sapiens
gaugaacuauccacagaag

SEQ ID NO: 344158 - RNA, 19 nt, Homo sapiens
acagugacaugguagauau

SEQ ID NO: 344159 - RNA, 19 nt, Homo sapiens
cuacugggacuacuauuaa

SEQ ID NO: 344160 - RNA, 19 nt, Homo sapiens
ggagugagacaggugauaa

SEQ ID NO: 344161 - RNA, 19 nt, Homo sapiens
gagcgcagcagccuaauuc

SEQ ID NO: 344162 - RNA, 19 nt, Homo sapiens
gaagugcugagggaucuua

SEQ ID NO: 344163 - RNA, 19 nt, Homo sapiens
agaagcaucaggagacuua

SEQ ID NO: 344164 - RNA, 19 nt, Homo sapiens
ggacgcucauuucguguug

SEQ ID NO: 344165 - RNA, 19 nt, Homo sapiens
guugaagacugcuccuuug

SEQ ID NO: 344166 - RNA, 19 nt, Homo sapiens
uugcugauaucaacuauga

SEQ ID NO: 344167 - RNA, 19 nt, Homo sapiens
uaggaaggcugaaguuaca

SEQ ID NO: 344168 - RNA, 19 nt, Homo sapiens
ugauaccauuguugcauua

SEQ ID NO: 344169 - RNA, 19 nt, Homo sapiens
cuacaccuacucauuauaa

SEQ ID NO: 344170 - RNA, 19 nt, Homo sapiens
acaaauaccagugggaaua

SEQ ID NO: 344171 - RNA, 19 nt, Homo sapiens
gaagaagcauuucagaaua

SEQ ID NO: 344172 - RNA, 19 nt, Homo sapiens
gaagagagauugaaaccaa

SEQ ID NO: 344173 - RNA, 19 nt, Homo sapiens
gaauggcucucaugaacua

SEQ ID NO: 344174 - RNA, 19 nt, Homo sapiens
ggaaagaaguaguugucua

SEQ ID NO: 344175 - RNA, 19 nt, Homo sapiens
guaaugaccuggagcaguu

SEQ ID NO: 344176 - RNA, 19 nt, Homo sapiens
ggacaggcaucuuuguuug

SEQ ID NO: 344177 - RNA, 19 nt, Homo sapiens
uagagcagauucaguguua

SEQ ID NO: 344178 - RNA, 19 nt, Homo sapiens
caacacauauugcaucuuc

SEQ ID NO: 344179 - RNA, 19 nt, Homo sapiens
ggauuugccugcagaguuu

SEQ ID NO: 344180 - RNA, 19 nt, Homo sapiens
gagcacacauggaaucuga

SEQ ID NO: 344181 - RNA, 19 nt, Homo sapiens
ccacaugucuuacagauca

SEQ ID NO: 344182 - RNA, 19 nt, Homo sapiens
ugaagaagauguagauaug

SEQ ID NO: 344183 - RNA, 19 nt, Homo sapiens
acagggagcucaauucaaa

SEQ ID NO: 344184 - RNA, 19 nt, Homo sapiens
gagguucccugccuuguuu

SEQ ID NO: 344185 - RNA, 19 nt, Homo sapiens
agaaagugcuggaaauaaa

SEQ ID NO: 344186 - RNA, 19 nt, Homo sapiens
gcaaaccuguugaugagaa

SEQ ID NO: 344187 - RNA, 19 nt, Homo sapiens
gcacaucaauagucuaaca

SEQ ID NO: 344188 - RNA, 19 nt, Homo sapiens
ccacaaauaccaccucuaa

SEQ ID NO: 344189 - RNA, 19 nt, Homo sapiens
gaugaagauucccuuguuu

SEQ ID NO: 344190 - RNA, 19 nt, Homo sapiens
gaacaaccaaccuaagauu

SEQ ID NO: 344191 - RNA, 19 nt, Homo sapiens
gaacuucguuuagaggauu

SEQ ID NO: 344192 - RNA, 19 nt, Homo sapiens
ucacuaagguugguuacua

SEQ ID NO: 344193 - RNA, 19 nt, Homo sapiens
gaaggaagcagugaagaaa

SEQ ID NO: 344194 - RNA, 19 nt, Homo sapiens
uggcacaacuucaacauuu

SEQ ID NO: 344195 - RNA, 19 nt, Homo sapiens
gcaugaagauaauguaaag

SEQ ID NO: 344196 - RNA, 19 nt, Homo sapiens
gauaauggauccuuaacag

SEQ ID NO: 344197 - RNA, 19 nt, Homo sapiens
gaaaugcuccgccauauac

SEQ ID NO: 344198 - RNA, 19 nt, Homo sapiens
caacuggacucuugcuaau

SEQ ID NO: 344199 - RNA, 19 nt, Homo sapiens
cuacuuagaugauaaccaa

SEQ ID NO: 344200 - RNA, 19 nt, Homo sapiens
ggagagagauuuaguuucc

SEQ ID NO: 344201 - RNA, 19 nt, Homo sapiens
gcagaccaauacuggauuu

SEQ ID NO: 344202 - RNA, 19 nt, Homo sapiens
ugaaggagaugugaauuug

SEQ ID NO: 344203 - RNA, 19 nt, Homo sapiens
gaaagguuaugguucaauc

SEQ ID NO: 344204 - RNA, 19 nt, Homo sapiens
gaaggaagagagauugaaa

SEQ ID NO: 344205 - RNA, 19 nt, Homo sapiens
cagaagaggagacaguuua

SEQ ID NO: 344206 - RNA, 19 nt, Homo sapiens
caccauaccuuugcuacua

SEQ ID NO: 344207 - RNA, 19 nt, Homo sapiens
gaagucuccuuaacccaaa

SEQ ID NO: 344208 - RNA, 19 nt, Homo sapiens
gugaagggcuaaauaggaa

SEQ ID NO: 344209 - RNA, 19 nt, Homo sapiens
ggucaaagcuggaguuagc

SEQ ID NO: 344210 - RNA, 19 nt, Homo sapiens
uuacuacaccuacucauua

SEQ ID NO: 344211 - RNA, 19 nt, Homo sapiens
caacuggcuuuggcaauuu

SEQ ID NO: 344212 - RNA, 19 nt, Homo sapiens
ugagauagcugguguuagg

SEQ ID NO: 344213 - RNA, 19 nt, Homo sapiens
caucuucacugggaauuaa

SEQ ID NO: 344214 - RNA, 19 nt, Homo sapiens
ggaccagucucuucucauc

SEQ ID NO: 344215 - RNA, 19 nt, Homo sapiens
ggaggccucuuuggaaauu

SEQ ID NO: 344216 - RNA, 19 nt, Homo sapiens
ggauccgucucuuaaguaa

SEQ ID NO: 344217 - RNA, 19 nt, Homo sapiens
cagaugaacuauccacaga

SEQ ID NO: 344218 - RNA, 19 nt, Homo sapiens
gcuggagccucgaagcaua

SEQ ID NO: 344219 - RNA, 19 nt, Homo sapiens
gcccagagguggagcaguu

SEQ ID NO: 344220 - RNA, 19 nt, Homo sapiens
ccaagaagagcauuaagaa

SEQ ID NO: 344221 - RNA, 19 nt, Homo sapiens
ccagaaggcucuuacuaca

SEQ ID NO: 344222 - RNA, 19 nt, Homo sapiens
gcugagggcucuuaacuac

SEQ ID NO: 344223 - RNA, 19 nt, Homo sapiens
cagcagauccuuuggacua

SEQ ID NO: 344224 - RNA, 19 nt, Homo sapiens
ccaacagccuccauuucua

SEQ ID NO: 344225 - RNA, 19 nt, Homo sapiens
gaugaacuguguccucuca

SEQ ID NO: 344226 - RNA, 19 nt, Homo sapiens
ggccacaccugggucuuua

SEQ ID NO: 344227 - RNA, 19 nt, Homo sapiens
ucaagaucauucaguguuu

SEQ ID NO: 344228 - RNA, 19 nt, Homo sapiens
aaagaaagccagaugaaga

SEQ ID NO: 344229 - RNA, 19 nt, Homo sapiens
ggaaggaagcagugaagaa

SEQ ID NO: 344230 - RNA, 19 nt, Homo sapiens
aaacaugcgugcugcuuug

SEQ ID NO: 344231 - RNA, 19 nt, Homo sapiens
gaagagcauuaagaaguug

SEQ ID NO: 344232 - RNA, 19 nt, Homo sapiens
gcagcaucuuuaaugaaua

SEQ ID NO: 344233 - RNA, 19 nt, Homo sapiens
gauaucaacuaugaaggaa

SEQ ID NO: 344234 - RNA, 19 nt, Homo sapiens
ggaguuuggccaacagaua

SEQ ID NO: 344235 - RNA, 19 nt, Homo sapiens
gcacccagcagguauuauu

SEQ ID NO: 344236 - RNA, 19 nt, Homo sapiens
ggaaauaaacacagcaaca

SEQ ID NO: 344237 - RNA, 19 nt, Homo sapiens
agaagagcauuaagaaguu

SEQ ID NO: 344238 - RNA, 19 nt, Homo sapiens
ccaggaggauuguuuggaa

SEQ ID NO: 344239 - RNA, 19 nt, Homo sapiens
gaaacaaaaugggaucuuu

SEQ ID NO: 344240 - RNA, 19 nt, Homo sapiens
gcucaucauccgacacuua

SEQ ID NO: 344241 - RNA, 19 nt, Homo sapiens
ggaaacagggagcucaauu

SEQ ID NO: 344242 - RNA, 19 nt, Homo sapiens
uaucaacuaugaaggaaga

SEQ ID NO: 344243 - RNA, 19 nt, Homo sapiens
ccagaucgccuugcugaua

SEQ ID NO: 344244 - RNA, 19 nt, Homo sapiens
gcacuaacauaaguaccaa

SEQ ID NO: 344245 - RNA, 19 nt, Homo sapiens
gcgcaucuuugcucuguug

SEQ ID NO: 344246 - RNA, 19 nt, Homo sapiens
caaagcagauacuucucaa

SEQ ID NO: 344247 - RNA, 19 nt, Homo sapiens
gaaacagggagcucaauuc

SEQ ID NO: 344248 - RNA, 19 nt, Homo sapiens
gaagaaggaagagagauug

SEQ ID NO: 344249 - RNA, 19 nt, Homo sapiens
gaacuaguacaacuggauu

SEQ ID NO: 344250 - RNA, 19 nt, Homo sapiens
ugagacaggugauaaugga

SEQ ID NO: 344251 - RNA, 19 nt, Homo sapiens
gauagaaccuccgacucaa

SEQ ID NO: 344252 - RNA, 19 nt, Homo sapiens
gaacuguguccucucauug

SEQ ID NO: 344253 - RNA, 19 nt, Homo sapiens
uaagcaaaccuguugauga

SEQ ID NO: 344254 - RNA, 19 nt, Homo sapiens
guaccaagcaccaguguau

SEQ ID NO: 344255 - RNA, 19 nt, Homo sapiens
cauguuagcuccaaagcau

SEQ ID NO: 344256 - RNA, 19 nt, Homo sapiens
gaugaacuauccacagaag

SEQ ID NO: 344257 - RNA, 19 nt, Homo sapiens
acagugacaugguagauau

SEQ ID NO: 344258 - RNA, 19 nt, Homo sapiens
cuacugggacuacuauuaa

SEQ ID NO: 344259 - RNA, 19 nt, Homo sapiens
ggagugagacaggugauaa

SEQ ID NO: 344260 - RNA, 19 nt, Homo sapiens
gagcgcagcagccuaauuc

SEQ ID NO: 344261 - RNA, 19 nt, Homo sapiens
agaagcaucaggagacuua

SEQ ID NO: 344262 - RNA, 19 nt, Homo sapiens
ggacgcucauuucguguug

SEQ ID NO: 344263 - RNA, 19 nt, Homo sapiens
guugaagacugcuccuuug

SEQ ID NO: 344264 - RNA, 19 nt, Homo sapiens
uugcugauaucaacuauga

SEQ ID NO: 344265 - RNA, 19 nt, Homo sapiens
uaggaaggcugaaguuaca

SEQ ID NO: 344266 - RNA, 19 nt, Homo sapiens
ugauaccauuguugcauua

SEQ ID NO: 344267 - RNA, 19 nt, Homo sapiens
cuacaccuacucauuauaa

SEQ ID NO: 344268 - RNA, 19 nt, Homo sapiens
acaaauaccagugggaaua

SEQ ID NO: 344269 - RNA, 19 nt, Homo sapiens
gcaagucacuagaggaacu

SEQ ID NO: 344270 - RNA, 19 nt, Homo sapiens
ugacagacauuaugaucuc

SEQ ID NO: 344271 - RNA, 19 nt, Homo sapiens
gaagagagauugaaaccaa

SEQ ID NO: 344272 - RNA, 19 nt, Homo sapiens
ggaaagaaguaguugucua

SEQ ID NO: 344273 - RNA, 19 nt, Homo sapiens
ggacaggcaucuuuguuug

SEQ ID NO: 344274 - RNA, 19 nt, Homo sapiens
ggagagauuuaaagaauuc

SEQ ID NO: 344275 - RNA, 19 nt, Homo sapiens
gcaagucauucagcuaaua

SEQ ID NO: 344276 - RNA, 19 nt, Homo sapiens
gauacgggauuucuuugua

SEQ ID NO: 344277 - RNA, 19 nt, Homo sapiens
gaugugcaguuuaaucuuu

SEQ ID NO: 344278 - RNA, 19 nt, Homo sapiens
acagggagcucaauucaaa

SEQ ID NO: 344279 - RNA, 19 nt, Homo sapiens
agaaagugcuggaaauaaa

SEQ ID NO: 344280 - RNA, 19 nt, Homo sapiens
gcaaaccuguugaugagaa

SEQ ID NO: 344281 - RNA, 19 nt, Homo sapiens
gcacaucaauagucuaaca

SEQ ID NO: 344282 - RNA, 19 nt, Homo sapiens
ccacaaauaccaccucuaa

SEQ ID NO: 344283 - RNA, 19 nt, Homo sapiens
ugaauucucugcucaguga

SEQ ID NO: 344284 - RNA, 19 nt, Homo sapiens
gaugaagauucccuuguuu

SEQ ID NO: 344285 - RNA, 19 nt, Homo sapiens
gaacaaccaaccuaagauu

SEQ ID NO: 344286 - RNA, 19 nt, Homo sapiens
gaacuucguuuagaggauu

SEQ ID NO: 344287 - RNA, 19 nt, Homo sapiens
ucacuaagguugguuacua

SEQ ID NO: 344288 - RNA, 19 nt, Homo sapiens
gaaggaagcagugaagaaa

SEQ ID NO: 344289 - RNA, 19 nt, Homo sapiens
uggcacaacuucaacauuu

SEQ ID NO: 344290 - RNA, 19 nt, Homo sapiens
cuacuuagaugauaaccaa

SEQ ID NO: 344291 - RNA, 19 nt, Homo sapiens
ggagagagauuuaguuucc

SEQ ID NO: 344292 - RNA, 19 nt, Homo sapiens
gcagaccaauacuggauuu

SEQ ID NO: 344293 - RNA, 19 nt, Homo sapiens
ugaaggagaugugaauuug

SEQ ID NO: 344294 - RNA, 19 nt, Homo sapiens
gaaagguuaugguucaauc

SEQ ID NO: 344295 - RNA, 19 nt, Homo sapiens
gaaggaagagagauugaaa

SEQ ID NO: 344296 - RNA, 19 nt, Homo sapiens
gauuauuccucuacagauu

SEQ ID NO: 344297 - RNA, 19 nt, Homo sapiens
gcaaucacguugaaacaag

SEQ ID NO: 344298 - RNA, 19 nt, Homo sapiens
gugaagggcuaaauaggaa

SEQ ID NO: 344299 - RNA, 19 nt, Homo sapiens
ggucaaagcuggaguuagc

SEQ ID NO: 344300 - RNA, 19 nt, Homo sapiens
uuacuacaccuacucauua

SEQ ID NO: 344301 - RNA, 19 nt, Homo sapiens
caacuggcuuuggcaauuu

SEQ ID NO: 344302 - RNA, 19 nt, Homo sapiens
ggaccagucucuucucauc

SEQ ID NO: 344303 - RNA, 19 nt, Homo sapiens
ggaggccucuuuggaaauu

SEQ ID NO: 344304 - RNA, 19 nt, Homo sapiens
ccaagaagagcauuaagaa

SEQ ID NO: 344305 - RNA, 19 nt, Homo sapiens
ccagaaggcucuuacuaca

SEQ ID NO: 344306 - RNA, 19 nt, Homo sapiens
cggguaaccuugauauuug

SEQ ID NO: 344307 - RNA, 19 nt, Homo sapiens
agaauucucuugcuguuug

SEQ ID NO: 344308 - RNA, 19 nt, Homo sapiens
cacaguaaauucugccuuu

SEQ ID NO: 344309 - RNA, 19 nt, Homo sapiens
ggaaggaagcagugaagaa

SEQ ID NO: 344310 - RNA, 19 nt, Homo sapiens
aaacaugcgugcugcuuug

SEQ ID NO: 344311 - RNA, 19 nt, Homo sapiens
gaagagcauuaagaaguug

SEQ ID NO: 344312 - RNA, 19 nt, Homo sapiens
uaccugaugugcaguuuaa

SEQ ID NO: 344313 - RNA, 19 nt, Homo sapiens
gauaucaacuaugaaggaa

SEQ ID NO: 344314 - RNA, 19 nt, Homo sapiens
ggaguuuggccaacagaua

SEQ ID NO: 344315 - RNA, 19 nt, Homo sapiens
gcacccagcagguauuauu

SEQ ID NO: 344316 - RNA, 19 nt, Homo sapiens
ggaaauaaacacagcaaca

SEQ ID NO: 344317 - RNA, 19 nt, Homo sapiens
agaagagcauuaagaaguu

SEQ ID NO: 344318 - RNA, 19 nt, Homo sapiens
ccaggaggauuguuuggaa

SEQ ID NO: 344319 - RNA, 19 nt, Homo sapiens
ggaaacagggagcucaauu

SEQ ID NO: 344320 - RNA, 19 nt, Homo sapiens
uaucaacuaugaaggaaga

SEQ ID NO: 344321 - RNA, 19 nt, Homo sapiens
ccagaucgccuugcugaua

SEQ ID NO: 344322 - RNA, 19 nt, Homo sapiens
gcacuaacauaaguaccaa

SEQ ID NO: 344323 - RNA, 19 nt, Homo sapiens
gaaacagggagcucaauuc

SEQ ID NO: 344324 - RNA, 19 nt, Homo sapiens
gaagaaggaagagagauug

SEQ ID NO: 344325 - RNA, 19 nt, Homo sapiens
gaacuaguacaacuggauu

SEQ ID NO: 344326 - RNA, 19 nt, Homo sapiens
uaagcaaaccuguugauga

SEQ ID NO: 344327 - RNA, 19 nt, Homo sapiens
guaccaagcaccaguguau

SEQ ID NO: 344328 - RNA, 19 nt, Homo sapiens
cuacugggacuacuauuaa

SEQ ID NO: 344329 - RNA, 19 nt, Homo sapiens
guugaagacugcuccuuug

SEQ ID NO: 344330 - RNA, 19 nt, Homo sapiens
uugcugauaucaacuauga

SEQ ID NO: 344331 - RNA, 19 nt, Homo sapiens
uaggaaggcugaaguuaca

SEQ ID NO: 344332 - RNA, 19 nt, Homo sapiens
ugauaccauuguugcauua

SEQ ID NO: 344333 - RNA, 19 nt, Homo sapiens
cuacaccuacucauuauaa

SEQ ID NO: 344334 - RNA, 19 nt, Homo sapiens
acaaauaccagugggaaua

SEQ ID NO: 344335 - RNA, 19 nt, Homo sapiens
gcaagucacuagaggaacu

SEQ ID NO: 344336 - RNA, 19 nt, Homo sapiens
aaaggacagugaauuugaa

SEQ ID NO: 344337 - RNA, 19 nt, Homo sapiens
gagcauccgucuaaaacua

SEQ ID NO: 344338 - RNA, 19 nt, Homo sapiens
uagaggaacuucguuuaga

SEQ ID NO: 344339 - RNA, 19 nt, Homo sapiens
guacagauacuauggucaa

SEQ ID NO: 344340 - RNA, 19 nt, Homo sapiens
cauuuggacuugcugaauu

SEQ ID NO: 344341 - RNA, 19 nt, Homo sapiens
cuggagagauuuaaagaau

SEQ ID NO: 344342 - RNA, 19 nt, Homo sapiens
uguuuaaggucucccauuu

SEQ ID NO: 344343 - RNA, 19 nt, Homo sapiens
gaguuuggccaacagauaa

SEQ ID NO: 344344 - RNA, 19 nt, Homo sapiens
gguuaugguucaaucuauu

SEQ ID NO: 344345 - RNA, 19 nt, Homo sapiens
ggaugaccgagaagaaaua

SEQ ID NO: 344346 - RNA, 19 nt, Homo sapiens
gcaacaguguggaugauac

SEQ ID NO: 344347 - RNA, 19 nt, Homo sapiens
caagucacaucucuuugau

SEQ ID NO: 344348 - RNA, 19 nt, Homo sapiens
ugucagacccuaagaagaa

SEQ ID NO: 344349 - RNA, 19 nt, Homo sapiens
caacaccaugggauuauuu

SEQ ID NO: 344350 - RNA, 19 nt, Homo sapiens
caacagaaucagcagacua

SEQ ID NO: 344351 - RNA, 19 nt, Homo sapiens
ucuuauggcugcugaaaug

SEQ ID NO: 344352 - RNA, 19 nt, Homo sapiens
cgcaauuacuuguaucauu

SEQ ID NO: 344353 - RNA, 19 nt, Homo sapiens
cagaucgccuugcugauau

SEQ ID NO: 344354 - RNA, 19 nt, Homo sapiens
gggaacaaccaaccuaaga

SEQ ID NO: 344355 - RNA, 19 nt, Homo sapiens
ggcaauaacaagcuuacua

SEQ ID NO: 344356 - RNA, 19 nt, Homo sapiens
cagguauuauucucacuaa

SEQ ID NO: 344357 - RNA, 19 nt, Homo sapiens
agaugaagauucccuuguu

SEQ ID NO: 344358 - RNA, 19 nt, Homo sapiens
ccaagucacaucucuuuga

SEQ ID NO: 344359 - RNA, 19 nt, Homo sapiens
gcaauaacaagcuuacuac

SEQ ID NO: 344360 - RNA, 19 nt, Homo sapiens
gcaccaacaccaugggauu

SEQ ID NO: 344361 - RNA, 19 nt, Homo sapiens
acaaauaccaccucuaauc

SEQ ID NO: 344362 - RNA, 19 nt, Homo sapiens
gcauuugguucuagcaaca

SEQ ID NO: 344363 - RNA, 19 nt, Homo sapiens
ggacagugaauuugaaugg

SEQ ID NO: 344364 - RNA, 19 nt, Homo sapiens
guacaaagaaguugaagac

SEQ ID NO: 344365 - RNA, 19 nt, Homo sapiens
gaaggagaugugaauuuga

SEQ ID NO: 344366 - RNA, 19 nt, Homo sapiens
aagcaaaccuguugaugag

SEQ ID NO: 344367 - RNA, 19 nt, Homo sapiens
aaauccagguggucucuuu

SEQ ID NO: 344368 - RNA, 19 nt, Homo sapiens
aaacaaugccuuugcacaa

SEQ ID NO: 344369 - RNA, 19 nt, Homo sapiens
gaaauaaacacagcaacag

SEQ ID NO: 344370 - RNA, 19 nt, Homo sapiens
cagaaagugcuggaaauaa

SEQ ID NO: 344371 - RNA, 19 nt, Homo sapiens
gaagaagcauuucagaaua

SEQ ID NO: 344372 - RNA, 19 nt, Homo sapiens
gaagagagauugaaaccaa

SEQ ID NO: 344373 - RNA, 19 nt, Homo sapiens
gaauggcucucaugaacua

SEQ ID NO: 344374 - RNA, 19 nt, Homo sapiens
ggaaagaaguaguugucua

SEQ ID NO: 344375 - RNA, 19 nt, Homo sapiens
guaaugaccuggagcaguu

SEQ ID NO: 344376 - RNA, 19 nt, Homo sapiens
ggacaggcaucuuuguuug

SEQ ID NO: 344377 - RNA, 19 nt, Homo sapiens
uagagcagauucaguguua

SEQ ID NO: 344378 - RNA, 19 nt, Homo sapiens
caacacauauugcaucuuc

SEQ ID NO: 344379 - RNA, 19 nt, Homo sapiens
ggauuugccugcagaguuu

SEQ ID NO: 344380 - RNA, 19 nt, Homo sapiens
gagcacacauggaaucuga

SEQ ID NO: 344381 - RNA, 19 nt, Homo sapiens
ccacaugucuuacagauca

SEQ ID NO: 344382 - RNA, 19 nt, Homo sapiens
ugaagaagauguagauaug

SEQ ID NO: 344383 - RNA, 19 nt, Homo sapiens
acagggagcucaauucaaa

SEQ ID NO: 344384 - RNA, 19 nt, Homo sapiens
gagguucccugccuuguuu

SEQ ID NO: 344385 - RNA, 19 nt, Homo sapiens
agaaagugcuggaaauaaa

SEQ ID NO: 344386 - RNA, 19 nt, Homo sapiens
gcaaaccuguugaugagaa

SEQ ID NO: 344387 - RNA, 19 nt, Homo sapiens
gcacaucaauagucuaaca

SEQ ID NO: 344388 - RNA, 19 nt, Homo sapiens
ccacaaauaccaccucuaa

SEQ ID NO: 344389 - RNA, 19 nt, Homo sapiens
gaugaagauucccuuguuu

SEQ ID NO: 344390 - RNA, 19 nt, Homo sapiens
gaacaaccaaccuaagauu

SEQ ID NO: 344391 - RNA, 19 nt, Homo sapiens
gaacuucguuuagaggauu

SEQ ID NO: 344392 - RNA, 19 nt, Homo sapiens
ucacuaagguugguuacua

SEQ ID NO: 344393 - RNA, 19 nt, Homo sapiens
gaaggaagcagugaagaaa

SEQ ID NO: 344394 - RNA, 19 nt, Homo sapiens
uggcacaacuucaacauuu

SEQ ID NO: 344395 - RNA, 19 nt, Homo sapiens
gcaugaagauaauguaaag

SEQ ID NO: 344396 - RNA, 19 nt, Homo sapiens
gauaauggauccuuaacag

SEQ ID NO: 344397 - RNA, 19 nt, Homo sapiens
gaaaugcuccgccauauac

SEQ ID NO: 344398 - RNA, 19 nt, Homo sapiens
caacuggacucuugcuaau

SEQ ID NO: 344399 - RNA, 19 nt, Homo sapiens
cuacuuagaugauaaccaa

SEQ ID NO: 344400 - RNA, 19 nt, Homo sapiens
ggagagagauuuaguuucc

SEQ ID NO: 344401 - RNA, 19 nt, Homo sapiens
gcagaccaauacuggauuu

SEQ ID NO: 344402 - RNA, 19 nt, Homo sapiens
ugaaggagaugugaauuug

SEQ ID NO: 344403 - RNA, 19 nt, Homo sapiens
gaaagguuaugguucaauc

SEQ ID NO: 344404 - RNA, 19 nt, Homo sapiens
gaaggaagagagauugaaa

SEQ ID NO: 344405 - RNA, 19 nt, Homo sapiens
cagaagaggagacaguuua

SEQ ID NO: 344406 - RNA, 19 nt, Homo sapiens
caccauaccuuugcuacua

SEQ ID NO: 344407 - RNA, 19 nt, Homo sapiens
gaagucuccuuaacccaaa

SEQ ID NO: 344408 - RNA, 19 nt, Homo sapiens
gugaagggcuaaauaggaa

SEQ ID NO: 344409 - RNA, 19 nt, Homo sapiens
ggucaaagcuggaguuagc

SEQ ID NO: 344410 - RNA, 19 nt, Homo sapiens
uuacuacaccuacucauua

SEQ ID NO: 344411 - RNA, 19 nt, Homo sapiens
caacuggcuuuggcaauuu

SEQ ID NO: 344412 - RNA, 19 nt, Homo sapiens
ugagauagcugguguuagg

SEQ ID NO: 344413 - RNA, 19 nt, Homo sapiens
caucuucacugggaauuaa

SEQ ID NO: 344414 - RNA, 19 nt, Homo sapiens
ggaccagucucuucucauc

SEQ ID NO: 344415 - RNA, 19 nt, Homo sapiens
ggaggccucuuuggaaauu

SEQ ID NO: 344416 - RNA, 19 nt, Homo sapiens
ggauccgucucuuaaguaa

SEQ ID NO: 344417 - RNA, 19 nt, Homo sapiens
cagaugaacuauccacaga

SEQ ID NO: 344418 - RNA, 19 nt, Homo sapiens
gcccagagguggagcaguu

SEQ ID NO: 344419 - RNA, 19 nt, Homo sapiens
ccaagaagagcauuaagaa

SEQ ID NO: 344420 - RNA, 19 nt, Homo sapiens
ccagaaggcucuuacuaca

SEQ ID NO: 344421 - RNA, 19 nt, Homo sapiens
ccaacagccuccauuucua

SEQ ID NO: 344422 - RNA, 19 nt, Homo sapiens
gaugaacuguguccucuca

SEQ ID NO: 344423 - RNA, 19 nt, Homo sapiens
ggccacaccugggucuuua

SEQ ID NO: 344424 - RNA, 19 nt, Homo sapiens
ucaagaucauucaguguuu

SEQ ID NO: 344425 - RNA, 19 nt, Homo sapiens
aaagaaagccagaugaaga

SEQ ID NO: 344426 - RNA, 19 nt, Homo sapiens
ggaaggaagcagugaagaa

SEQ ID NO: 344427 - RNA, 19 nt, Homo sapiens
aaacaugcgugcugcuuug

SEQ ID NO: 344428 - RNA, 19 nt, Homo sapiens
gaagagcauuaagaaguug

SEQ ID NO: 344429 - RNA, 19 nt, Homo sapiens
gcagcaucuuuaaugaaua

SEQ ID NO: 344430 - RNA, 19 nt, Homo sapiens
gauaucaacuaugaaggaa

SEQ ID NO: 344431 - RNA, 19 nt, Homo sapiens
ggaguuuggccaacagaua

SEQ ID NO: 344432 - RNA, 19 nt, Homo sapiens
gcacccagcagguauuauu

SEQ ID NO: 344433 - RNA, 19 nt, Homo sapiens
ggaaauaaacacagcaaca

SEQ ID NO: 344434 - RNA, 19 nt, Homo sapiens
agaagagcauuaagaaguu

SEQ ID NO: 344435 - RNA, 19 nt, Homo sapiens
ccaggaggauuguuuggaa

SEQ ID NO: 344436 - RNA, 19 nt, Homo sapiens
gaaacaaaaugggaucuuu

SEQ ID NO: 344437 - RNA, 19 nt, Homo sapiens
gcucaucauccgacacuua

SEQ ID NO: 344438 - RNA, 19 nt, Homo sapiens
ggaaacagggagcucaauu

SEQ ID NO: 344439 - RNA, 19 nt, Homo sapiens
uaucaacuaugaaggaaga

SEQ ID NO: 344440 - RNA, 19 nt, Homo sapiens
ccagaucgccuugcugaua

SEQ ID NO: 344441 - RNA, 19 nt, Homo sapiens
gcacuaacauaaguaccaa

SEQ ID NO: 344442 - RNA, 19 nt, Homo sapiens
gcgcaucuuugcucuguug

SEQ ID NO: 344443 - RNA, 19 nt, Homo sapiens
caaagcagauacuucucaa

SEQ ID NO: 344444 - RNA, 19 nt, Homo sapiens
gaaacagggagcucaauuc

SEQ ID NO: 344445 - RNA, 19 nt, Homo sapiens
gaagaaggaagagagauug

SEQ ID NO: 344446 - RNA, 19 nt, Homo sapiens
gaacuaguacaacuggauu

SEQ ID NO: 344447 - RNA, 19 nt, Homo sapiens
ugagacaggugauaaugga

SEQ ID NO: 344448 - RNA, 19 nt, Homo sapiens
gauagaaccuccgacucaa

SEQ ID NO: 344449 - RNA, 19 nt, Homo sapiens
gaacuguguccucucauug

SEQ ID NO: 344450 - RNA, 19 nt, Homo sapiens
uaagcaaaccuguugauga

SEQ ID NO: 344451 - RNA, 19 nt, Homo sapiens
guaccaagcaccaguguau

SEQ ID NO: 344452 - RNA, 19 nt, Homo sapiens
cauguuagcuccaaagcau

SEQ ID NO: 344453 - RNA, 19 nt, Homo sapiens
gaugaacuauccacagaag

SEQ ID NO: 344454 - RNA, 19 nt, Homo sapiens
acagugacaugguagauau

SEQ ID NO: 344455 - RNA, 19 nt, Homo sapiens
cuacugggacuacuauuaa

SEQ ID NO: 344456 - RNA, 19 nt, Homo sapiens
ggagugagacaggugauaa

SEQ ID NO: 344457 - RNA, 19 nt, Homo sapiens
gagcgcagcagccuaauuc

SEQ ID NO: 344458 - RNA, 19 nt, Homo sapiens
agaagcaucaggagacuua

SEQ ID NO: 344459 - RNA, 19 nt, Homo sapiens
ggacgcucauuucguguug

SEQ ID NO: 344460 - RNA, 19 nt, Homo sapiens
guugaagacugcuccuuug

SEQ ID NO: 344461 - RNA, 19 nt, Homo sapiens
uugcugauaucaacuauga

SEQ ID NO: 344462 - RNA, 19 nt, Homo sapiens
uaggaaggcugaaguuaca

SEQ ID NO: 344463 - RNA, 19 nt, Homo sapiens
ugauaccauuguugcauua

SEQ ID NO: 344464 - RNA, 19 nt, Homo sapiens
cuacaccuacucauuauaa

SEQ ID NO: 344465 - RNA, 19 nt, Homo sapiens
acaaauaccagugggaaua

SEQ ID NO: 344466 - RNA, 19 nt, Homo sapiens
gcaagucacuagaggaacu

SEQ ID NO: 344467 - RNA, 19 nt, Homo sapiens
gagcauccgucuaaaacua

SEQ ID NO: 344468 - RNA, 19 nt, Homo sapiens
uagaggaacuucguuuaga

SEQ ID NO: 344469 - RNA, 19 nt, Homo sapiens
guacagauacuauggucaa

SEQ ID NO: 344470 - RNA, 19 nt, Homo sapiens
guuuauagcauuccuggua

SEQ ID NO: 344471 - RNA, 19 nt, Homo sapiens
caaaggaacuggaaugaua

SEQ ID NO: 344472 - RNA, 19 nt, Homo sapiens
ggaaauaacugagcacuuu

SEQ ID NO: 344473 - RNA, 19 nt, Homo sapiens
gcaaaggcuuguaaauuua

SEQ ID NO: 344474 - RNA, 19 nt, Homo sapiens
ggcaaaggcuuguaaauuu

SEQ ID NO: 344475 - RNA, 19 nt, Homo sapiens
gcacaaguauuacacauca

SEQ ID NO: 344476 - RNA, 19 nt, Homo sapiens
ccacaaguauugcccuuua

SEQ ID NO: 344477 - RNA, 19 nt, Homo sapiens
gaacuggaaugauaaugga

SEQ ID NO: 344478 - RNA, 19 nt, Homo sapiens
gcaaugcguucguggcuuu

SEQ ID NO: 344479 - RNA, 19 nt, Homo sapiens
uaacugagcacuuugaauu

SEQ ID NO: 344480 - RNA, 19 nt, Homo sapiens
guaguuaucugagcuuaaa

SEQ ID NO: 344481 - RNA, 19 nt, Homo sapiens
gaacauggacuacacacaa

SEQ ID NO: 344482 - RNA, 19 nt, Homo sapiens
gccauauucuguaguauuu

SEQ ID NO: 344483 - RNA, 19 nt, Homo sapiens
gaaacuuuguccuucauug

SEQ ID NO: 344484 - RNA, 19 nt, Homo sapiens
ggacaagcauguugauucu

SEQ ID NO: 344485 - RNA, 19 nt, Homo sapiens
auacauaacucccuggaaa

SEQ ID NO: 344486 - RNA, 19 nt, Homo sapiens
gagaauacagcuccgauuu

SEQ ID NO: 344487 - RNA, 19 nt, Homo sapiens
ccacgugacuuucaacaau

SEQ ID NO: 344488 - RNA, 19 nt, Homo sapiens
gaauacagcuccgauuucu

SEQ ID NO: 344489 - RNA, 19 nt, Homo sapiens
ggagaugacacccagcaua

SEQ ID NO: 344490 - RNA, 19 nt, Homo sapiens
auacagcuccgauuucuua

SEQ ID NO: 344491 - RNA, 19 nt, Homo sapiens
guauugcccuuuaacaaga

SEQ ID NO: 344492 - RNA, 19 nt, Homo sapiens
ggacaagcgucgccggaau

SEQ ID NO: 344493 - RNA, 19 nt, Homo sapiens
uaggugggcacaaguauua

SEQ ID NO: 344494 - RNA, 19 nt, Homo sapiens
cggcagaguugaaugaaug

SEQ ID NO: 344495 - RNA, 19 nt, Homo sapiens
gcaguucagacaaauguaa

SEQ ID NO: 344496 - RNA, 19 nt, Homo sapiens
gaaugauaauggaaacugu

SEQ ID NO: 344497 - RNA, 19 nt, Homo sapiens
gaauaugaacaucgacauu

SEQ ID NO: 344498 - RNA, 19 nt, Homo sapiens
gagaugacacccagcauau

SEQ ID NO: 344499 - RNA, 19 nt, Homo sapiens
ccaccuugcuuguaccaaa

SEQ ID NO: 344500 - RNA, 19 nt, Homo sapiens
ggauuuagaacauggacua

SEQ ID NO: 344501 - RNA, 19 nt, Homo sapiens
guaccuuuauggacaacua

SEQ ID NO: 344502 - RNA, 19 nt, Homo sapiens
gauaugagucacugccuuu

SEQ ID NO: 344503 - RNA, 19 nt, Homo sapiens
ugaauucuccuccaacuug

SEQ ID NO: 344504 - RNA, 19 nt, Homo sapiens
guaacaccguccaacauuc

SEQ ID NO: 344505 - RNA, 19 nt, Homo sapiens
acauucagaugcacaacua

SEQ ID NO: 344506 - RNA, 19 nt, Homo sapiens
gaaauaacugagcacuuug

SEQ ID NO: 344507 - RNA, 19 nt, Homo sapiens
gagcuacaguuaccacucu

SEQ ID NO: 344508 - RNA, 19 nt, Homo sapiens
gcacuucggcagaguugaa

SEQ ID NO: 344509 - RNA, 19 nt, Homo sapiens
cccaagcacuucaaaggaa

SEQ ID NO: 344510 - RNA, 19 nt, Homo sapiens
uagaagacauucagaugca

SEQ ID NO: 344511 - RNA, 19 nt, Homo sapiens
gaaggcaaaggcuuguaaa

SEQ ID NO: 344512 - RNA, 19 nt, Homo sapiens
ggacuacacacaauacagu

SEQ ID NO: 344513 - RNA, 19 nt, Homo sapiens
guuuguaaguguuguaugu

SEQ ID NO: 344514 - RNA, 19 nt, Homo sapiens
acaagcauguugauucuag

SEQ ID NO: 344515 - RNA, 19 nt, Homo sapiens
cagaagaaagauugcuaua

SEQ ID NO: 344516 - RNA, 19 nt, Homo sapiens
gaacccugacuaucaaaug

SEQ ID NO: 344517 - RNA, 19 nt, Homo sapiens
gguagaagacauucagaug

SEQ ID NO: 344518 - RNA, 19 nt, Homo sapiens
gcaguccuccauuaaggua

SEQ ID NO: 344519 - RNA, 19 nt, Homo sapiens
agaguugaaugaaugaaga

SEQ ID NO: 344520 - RNA, 19 nt, Homo sapiens
gggacaagcauguugauuc

SEQ ID NO: 344521 - RNA, 19 nt, Homo sapiens
cgggaucucuccacaacuu

SEQ ID NO: 344522 - RNA, 19 nt, Homo sapiens
gacagcaguccuccauuaa

SEQ ID NO: 344523 - RNA, 19 nt, Homo sapiens
ggaaauguuuggccaugcu

SEQ ID NO: 344524 - RNA, 19 nt, Homo sapiens
ggcgaacccugacuaucaa

SEQ ID NO: 344525 - RNA, 19 nt, Homo sapiens
gcauggaccucaccaacac

SEQ ID NO: 344526 - RNA, 19 nt, Homo sapiens
cuccagaguuugucaaguu

SEQ ID NO: 344527 - RNA, 19 nt, Homo sapiens
agauaaguguguuugcaaa

SEQ ID NO: 344528 - RNA, 19 nt, Homo sapiens
gcauauccagcaauucuau

SEQ ID NO: 344529 - RNA, 19 nt, Homo sapiens
cacaaguauugcccuuuaa

SEQ ID NO: 344530 - RNA, 19 nt, Homo sapiens
ggaacuggaaugauaaugg

SEQ ID NO: 344531 - RNA, 19 nt, Homo sapiens
ggauugauuccauuguuga

SEQ ID NO: 344532 - RNA, 19 nt, Homo sapiens
gaagagagacgcggagaac

SEQ ID NO: 344533 - RNA, 19 nt, Homo sapiens
uaccguugauguugauaaa

SEQ ID NO: 344534 - RNA, 19 nt, Homo sapiens
aaagauaaguguguuugca

SEQ ID NO: 344535 - RNA, 19 nt, Homo sapiens
ucaaggaacccaagagagu

SEQ ID NO: 344536 - RNA, 19 nt, Homo sapiens
ccuccaacuugcagaauau

SEQ ID NO: 344537 - RNA, 19 nt, Homo sapiens
aaacucaucuuuugcaaug

SEQ ID NO: 344538 - RNA, 19 nt, Homo sapiens
acauaacucccuggaaaua

SEQ ID NO: 344539 - RNA, 19 nt, Homo sapiens
caagucacaugggcagaga

SEQ ID NO: 344540 - RNA, 19 nt, Homo sapiens
aaaggaacuggaaugauaa

SEQ ID NO: 344541 - RNA, 19 nt, Homo sapiens
ggacacuuuaccuuucuaa

SEQ ID NO: 344542 - RNA, 19 nt, Homo sapiens
caagagaguggaagaacug

SEQ ID NO: 344543 - RNA, 19 nt, Homo sapiens
gcucaaggaacccaagaga

SEQ ID NO: 344544 - RNA, 19 nt, Homo sapiens
cagcaguccuccauuaagg

SEQ ID NO: 344545 - RNA, 19 nt, Homo sapiens
acacuuuaccuuucuaaga

SEQ ID NO: 344546 - RNA, 19 nt, Homo sapiens
ggaggguaaacucaucuuu

SEQ ID NO: 344547 - RNA, 19 nt, Homo sapiens
gaagccaugccuuguguuc

SEQ ID NO: 344548 - RNA, 19 nt, Homo sapiens
caccaacacugaaaucacu

SEQ ID NO: 344549 - RNA, 19 nt, Homo sapiens
uauguaccguugauguuga

SEQ ID NO: 344550 - RNA, 19 nt, Homo sapiens
ggaaugauaauggaaacug

SEQ ID NO: 344551 - RNA, 19 nt, Homo sapiens
uugaaugaaugaagagaga

SEQ ID NO: 344552 - RNA, 19 nt, Homo sapiens
cagcuucaguaccuuuaug

SEQ ID NO: 344553 - RNA, 19 nt, Homo sapiens
ucuaguauggcacaugaua

SEQ ID NO: 344554 - RNA, 19 nt, Homo sapiens
gggcacaaguauuacacau

SEQ ID NO: 344555 - RNA, 19 nt, Homo sapiens
aggcaaaggcuuguaaauu

SEQ ID NO: 344556 - RNA, 19 nt, Homo sapiens
gaagaaggcaaaggcuugu

SEQ ID NO: 344557 - RNA, 19 nt, Homo sapiens
ccaagagaguggaagaacu

SEQ ID NO: 344558 - RNA, 19 nt, Homo sapiens
ugucaguacugccgauuuc

SEQ ID NO: 344559 - RNA, 19 nt, Homo sapiens
cggaaucgcugucaguacu

SEQ ID NO: 344560 - RNA, 19 nt, Homo sapiens
auacguguguuuagcaaau

SEQ ID NO: 344561 - RNA, 19 nt, Homo sapiens
cauaacucccuggaaauaa

SEQ ID NO: 344562 - RNA, 19 nt, Homo sapiens
cauguugauucuagguuga

SEQ ID NO: 344563 - RNA, 19 nt, Homo sapiens
acacacacauacacacaca

SEQ ID NO: 344564 - RNA, 19 nt, Homo sapiens
gauaauggaaacugucaag

SEQ ID NO: 344565 - RNA, 19 nt, Homo sapiens
cuucucagagcuacaguua

SEQ ID NO: 344566 - RNA, 19 nt, Homo sapiens
gaacuucguacccuuugca

SEQ ID NO: 344567 - RNA, 19 nt, Homo sapiens
cagaguuugucaaguuuag

SEQ ID NO: 344568 - RNA, 19 nt, Homo sapiens
uggaagaacugcaaaacaa

SEQ ID NO: 344569 - RNA, 19 nt, Homo sapiens
gagaguggaagaacugcaa

SEQ ID NO: 344570 - RNA, 19 nt, Homo sapiens
gcccaaagccgaccaagac

SEQ ID NO: 344571 - RNA, 19 nt, Homo sapiens
caaaggaacuggaaugaua

SEQ ID NO: 344572 - RNA, 19 nt, Homo sapiens
ggaaauaacugagcacuuu

SEQ ID NO: 344573 - RNA, 19 nt, Homo sapiens
gcaaaggcuuguaaauuua

SEQ ID NO: 344574 - RNA, 19 nt, Homo sapiens
ggcaaaggcuuguaaauuu

SEQ ID NO: 344575 - RNA, 19 nt, Homo sapiens
gcacaaguauuacacauca

SEQ ID NO: 344576 - RNA, 19 nt, Homo sapiens
ccacaaguauugcccuuua

SEQ ID NO: 344577 - RNA, 19 nt, Homo sapiens
gaacuggaaugauaaugga

SEQ ID NO: 344578 - RNA, 19 nt, Homo sapiens
gcaaugcguucguggcuuu

SEQ ID NO: 344579 - RNA, 19 nt, Homo sapiens
uaacugagcacuuugaauu

SEQ ID NO: 344580 - RNA, 19 nt, Homo sapiens
guaguuaucugagcuuaaa

SEQ ID NO: 344581 - RNA, 19 nt, Homo sapiens
gaacauggacuacacacaa

SEQ ID NO: 344582 - RNA, 19 nt, Homo sapiens
gccauauucuguaguauuu

SEQ ID NO: 344583 - RNA, 19 nt, Homo sapiens
gaaacuuuguccuucauug

SEQ ID NO: 344584 - RNA, 19 nt, Homo sapiens
ggacaagcauguugauucu

SEQ ID NO: 344585 - RNA, 19 nt, Homo sapiens
auacauaacucccuggaaa

SEQ ID NO: 344586 - RNA, 19 nt, Homo sapiens
gagaauacagcuccgauuu

SEQ ID NO: 344587 - RNA, 19 nt, Homo sapiens
ccacgugacuuucaacaau

SEQ ID NO: 344588 - RNA, 19 nt, Homo sapiens
gaauacagcuccgauuucu

SEQ ID NO: 344589 - RNA, 19 nt, Homo sapiens
ggagaugacacccagcaua

SEQ ID NO: 344590 - RNA, 19 nt, Homo sapiens
auacagcuccgauuucuua

SEQ ID NO: 344591 - RNA, 19 nt, Homo sapiens
guauugcccuuuaacaaga

SEQ ID NO: 344592 - RNA, 19 nt, Homo sapiens
ggacaagcgucgccggaau

SEQ ID NO: 344593 - RNA, 19 nt, Homo sapiens
uaggugggcacaaguauua

SEQ ID NO: 344594 - RNA, 19 nt, Homo sapiens
cggcagaguugaaugaaug

SEQ ID NO: 344595 - RNA, 19 nt, Homo sapiens
gcaguucagacaaauguaa

SEQ ID NO: 344596 - RNA, 19 nt, Homo sapiens
gaaugauaauggaaacugu

SEQ ID NO: 344597 - RNA, 19 nt, Homo sapiens
gaauaugaacaucgacauu

SEQ ID NO: 344598 - RNA, 19 nt, Homo sapiens
gagaugacacccagcauau

SEQ ID NO: 344599 - RNA, 19 nt, Homo sapiens
ccaccuugcuuguaccaaa

SEQ ID NO: 344600 - RNA, 19 nt, Homo sapiens
ggauuuagaacauggacua

SEQ ID NO: 344601 - RNA, 19 nt, Homo sapiens
guaccuuuauggacaacua

SEQ ID NO: 344602 - RNA, 19 nt, Homo sapiens
gauaugagucacugccuuu

SEQ ID NO: 344603 - RNA, 19 nt, Homo sapiens
ugaauucuccuccaacuug

SEQ ID NO: 344604 - RNA, 19 nt, Homo sapiens
guaacaccguccaacauuc

SEQ ID NO: 344605 - RNA, 19 nt, Homo sapiens
acauucagaugcacaacua

SEQ ID NO: 344606 - RNA, 19 nt, Homo sapiens
gaaauaacugagcacuuug

SEQ ID NO: 344607 - RNA, 19 nt, Homo sapiens
gagcuacaguuaccacucu

SEQ ID NO: 344608 - RNA, 19 nt, Homo sapiens
gcacuucggcagaguugaa

SEQ ID NO: 344609 - RNA, 19 nt, Homo sapiens
cccaagcacuucaaaggaa

SEQ ID NO: 344610 - RNA, 19 nt, Homo sapiens
uagaagacauucagaugca

SEQ ID NO: 344611 - RNA, 19 nt, Homo sapiens
gaaggcaaaggcuuguaaa

SEQ ID NO: 344612 - RNA, 19 nt, Homo sapiens
ggacuacacacaauacagu

SEQ ID NO: 344613 - RNA, 19 nt, Homo sapiens
guuuguaaguguuguaugu

SEQ ID NO: 344614 - RNA, 19 nt, Homo sapiens
acaagcauguugauucuag

SEQ ID NO: 344615 - RNA, 19 nt, Homo sapiens
cagaagaaagauugcuaua

SEQ ID NO: 344616 - RNA, 19 nt, Homo sapiens
gaacccugacuaucaaaug

SEQ ID NO: 344617 - RNA, 19 nt, Homo sapiens
gguagaagacauucagaug

SEQ ID NO: 344618 - RNA, 19 nt, Homo sapiens
gcaguccuccauuaaggua

SEQ ID NO: 344619 - RNA, 19 nt, Homo sapiens
agaguugaaugaaugaaga

SEQ ID NO: 344620 - RNA, 19 nt, Homo sapiens
gggacaagcauguugauuc

SEQ ID NO: 344621 - RNA, 19 nt, Homo sapiens
cgggaucucuccacaacuu

SEQ ID NO: 344622 - RNA, 19 nt, Homo sapiens
gacagcaguccuccauuaa

SEQ ID NO: 344623 - RNA, 19 nt, Homo sapiens
ggaaauguuuggccaugcu

SEQ ID NO: 344624 - RNA, 19 nt, Homo sapiens
ggcgaacccugacuaucaa

SEQ ID NO: 344625 - RNA, 19 nt, Homo sapiens
gcauggaccucaccaacac

SEQ ID NO: 344626 - RNA, 19 nt, Homo sapiens
cuccagaguuugucaaguu

SEQ ID NO: 344627 - RNA, 19 nt, Homo sapiens
agauaaguguguuugcaaa

SEQ ID NO: 344628 - RNA, 19 nt, Homo sapiens
gcauauccagcaauucuau

SEQ ID NO: 344629 - RNA, 19 nt, Homo sapiens
cacaaguauugcccuuuaa

SEQ ID NO: 344630 - RNA, 19 nt, Homo sapiens
ggaacuggaaugauaaugg

SEQ ID NO: 344631 - RNA, 19 nt, Homo sapiens
ggauugauuccauuguuga

SEQ ID NO: 344632 - RNA, 19 nt, Homo sapiens
gaagagagacgcggagaac

SEQ ID NO: 344633 - RNA, 19 nt, Homo sapiens
uaccguugauguugauaaa

SEQ ID NO: 344634 - RNA, 19 nt, Homo sapiens
aaagauaaguguguuugca

SEQ ID NO: 344635 - RNA, 19 nt, Homo sapiens
ucaaggaacccaagagagu

SEQ ID NO: 344636 - RNA, 19 nt, Homo sapiens
ccuccaacuugcagaauau

SEQ ID NO: 344637 - RNA, 19 nt, Homo sapiens
acauaacucccuggaaaua

SEQ ID NO: 344638 - RNA, 19 nt, Homo sapiens
caagucacaugggcagaga

SEQ ID NO: 344639 - RNA, 19 nt, Homo sapiens
aaaggaacuggaaugauaa

SEQ ID NO: 344640 - RNA, 19 nt, Homo sapiens
ggacacuuuaccuuucuaa

SEQ ID NO: 344641 - RNA, 19 nt, Homo sapiens
caagagaguggaagaacug

SEQ ID NO: 344642 - RNA, 19 nt, Homo sapiens
gcucaaggaacccaagaga

SEQ ID NO: 344643 - RNA, 19 nt, Homo sapiens
cagcaguccuccauuaagg

SEQ ID NO: 344644 - RNA, 19 nt, Homo sapiens
acacuuuaccuuucuaaga

SEQ ID NO: 344645 - RNA, 19 nt, Homo sapiens
gaagccaugccuuguguuc

SEQ ID NO: 344646 - RNA, 19 nt, Homo sapiens
caccaacacugaaaucacu

SEQ ID NO: 344647 - RNA, 19 nt, Homo sapiens
uauguaccguugauguuga

SEQ ID NO: 344648 - RNA, 19 nt, Homo sapiens
ggaaugauaauggaaacug

SEQ ID NO: 344649 - RNA, 19 nt, Homo sapiens
uugaaugaaugaagagaga

SEQ ID NO: 344650 - RNA, 19 nt, Homo sapiens
cagcuucaguaccuuuaug

SEQ ID NO: 344651 - RNA, 19 nt, Homo sapiens
ucuaguauggcacaugaua

SEQ ID NO: 344652 - RNA, 19 nt, Homo sapiens
gggcacaaguauuacacau

SEQ ID NO: 344653 - RNA, 19 nt, Homo sapiens
aggcaaaggcuuguaaauu

SEQ ID NO: 344654 - RNA, 19 nt, Homo sapiens
gaagaaggcaaaggcuugu

SEQ ID NO: 344655 - RNA, 19 nt, Homo sapiens
ccaagagaguggaagaacu

SEQ ID NO: 344656 - RNA, 19 nt, Homo sapiens
ugucaguacugccgauuuc

SEQ ID NO: 344657 - RNA, 19 nt, Homo sapiens
cggaaucgcugucaguacu

SEQ ID NO: 344658 - RNA, 19 nt, Homo sapiens
auacguguguuuagcaaau

SEQ ID NO: 344659 - RNA, 19 nt, Homo sapiens
cauaacucccuggaaauaa

SEQ ID NO: 344660 - RNA, 19 nt, Homo sapiens
cauguugauucuagguuga

SEQ ID NO: 344661 - RNA, 19 nt, Homo sapiens
acacacacauacacacaca

SEQ ID NO: 344662 - RNA, 19 nt, Homo sapiens
gauaauggaaacugucaag

SEQ ID NO: 344663 - RNA, 19 nt, Homo sapiens
gaacuucguacccuuugca

SEQ ID NO: 344664 - RNA, 19 nt, Homo sapiens
uggaagaacugcaaaacaa

SEQ ID NO: 344665 - RNA, 19 nt, Homo sapiens
gagaguggaagaacugcaa

SEQ ID NO: 344666 - RNA, 19 nt, Homo sapiens
cuucucagagcuacaguua

SEQ ID NO: 344667 - RNA, 19 nt, Homo sapiens
cagaguuugucaaguuuag

SEQ ID NO: 344668 - RNA, 19 nt, Homo sapiens
gcccaaagccgaccaagac

SEQ ID NO: 344669 - RNA, 19 nt, Homo sapiens
cagcauauccagcaauucu

SEQ ID NO: 344670 - RNA, 19 nt, Homo sapiens
ucaaaugaguggagaugac

SEQ ID NO: 344671 - RNA, 19 nt, Homo sapiens
caaaggaacuggaaugaua

SEQ ID NO: 344672 - RNA, 19 nt, Homo sapiens
ggaaauaacugagcacuuu

SEQ ID NO: 344673 - RNA, 19 nt, Homo sapiens
gcaaaggcuuguaaauuua

SEQ ID NO: 344674 - RNA, 19 nt, Homo sapiens
ggcaaaggcuuguaaauuu

SEQ ID NO: 344675 - RNA, 19 nt, Homo sapiens
gcacaaguauuacacauca

SEQ ID NO: 344676 - RNA, 19 nt, Homo sapiens
ccacaaguauugcccuuua

SEQ ID NO: 344677 - RNA, 19 nt, Homo sapiens
gaacuggaaugauaaugga

SEQ ID NO: 344678 - RNA, 19 nt, Homo sapiens
uaacugagcacuuugaauu

SEQ ID NO: 344679 - RNA, 19 nt, Homo sapiens
guaguuaucugagcuuaaa

SEQ ID NO: 344680 - RNA, 19 nt, Homo sapiens
gaacauggacuacacacaa

SEQ ID NO: 344681 - RNA, 19 nt, Homo sapiens
gccauauucuguaguauuu

SEQ ID NO: 344682 - RNA, 19 nt, Homo sapiens
gaaacuuuguccuucauug

SEQ ID NO: 344683 - RNA, 19 nt, Homo sapiens
ggacaagcauguugauucu

SEQ ID NO: 344684 - RNA, 19 nt, Homo sapiens
auacauaacucccuggaaa

SEQ ID NO: 344685 - RNA, 19 nt, Homo sapiens
gagaauacagcuccgauuu

SEQ ID NO: 344686 - RNA, 19 nt, Homo sapiens
ccacgugacuuucaacaau

SEQ ID NO: 344687 - RNA, 19 nt, Homo sapiens
gaauacagcuccgauuucu

SEQ ID NO: 344688 - RNA, 19 nt, Homo sapiens
ggagaugacacccagcaua

SEQ ID NO: 344689 - RNA, 19 nt, Homo sapiens
auacagcuccgauuucuua

SEQ ID NO: 344690 - RNA, 19 nt, Homo sapiens
guauugcccuuuaacaaga

SEQ ID NO: 344691 - RNA, 19 nt, Homo sapiens
ggacaagcgucgccggaau

SEQ ID NO: 344692 - RNA, 19 nt, Homo sapiens
ucgauuagcauacagaaua

SEQ ID NO: 344693 - RNA, 19 nt, Homo sapiens
uaggugggcacaaguauua

SEQ ID NO: 344694 - RNA, 19 nt, Homo sapiens
cggcagaguugaaugaaug

SEQ ID NO: 344695 - RNA, 19 nt, Homo sapiens
gcaguucagacaaauguaa

SEQ ID NO: 344696 - RNA, 19 nt, Homo sapiens
gaaugauaauggaaacugu

SEQ ID NO: 344697 - RNA, 19 nt, Homo sapiens
gaauaugaacaucgacauu

SEQ ID NO: 344698 - RNA, 19 nt, Homo sapiens
gagaugacacccagcauau

SEQ ID NO: 344699 - RNA, 19 nt, Homo sapiens
ccaccuugcuuguaccaaa

SEQ ID NO: 344700 - RNA, 19 nt, Homo sapiens
ggauuuagaacauggacua

SEQ ID NO: 344701 - RNA, 19 nt, Homo sapiens
guaccuuuauggacaacua

SEQ ID NO: 344702 - RNA, 19 nt, Homo sapiens
gauaugagucacugccuuu

SEQ ID NO: 344703 - RNA, 19 nt, Homo sapiens
guaacaccguccaacauuc

SEQ ID NO: 344704 - RNA, 19 nt, Homo sapiens
acauucagaugcacaacua

SEQ ID NO: 344705 - RNA, 19 nt, Homo sapiens
gaaauaacugagcacuuug

SEQ ID NO: 344706 - RNA, 19 nt, Homo sapiens
gagcuacaguuaccacucu

SEQ ID NO: 344707 - RNA, 19 nt, Homo sapiens
gcacuucggcagaguugaa

SEQ ID NO: 344708 - RNA, 19 nt, Homo sapiens
cccaagcacuucaaaggaa

SEQ ID NO: 344709 - RNA, 19 nt, Homo sapiens
uagaagacauucagaugca

SEQ ID NO: 344710 - RNA, 19 nt, Homo sapiens
gaaggcaaaggcuuguaaa

SEQ ID NO: 344711 - RNA, 19 nt, Homo sapiens
ggacuacacacaauacagu

SEQ ID NO: 344712 - RNA, 19 nt, Homo sapiens
guuuguaaguguuguaugu

SEQ ID NO: 344713 - RNA, 19 nt, Homo sapiens
acaagcauguugauucuag

SEQ ID NO: 344714 - RNA, 19 nt, Homo sapiens
cagaagaaagauugcuaua

SEQ ID NO: 344715 - RNA, 19 nt, Homo sapiens
cgauuagcauacagaauau

SEQ ID NO: 344716 - RNA, 19 nt, Homo sapiens
gaacccugacuaucaaaug

SEQ ID NO: 344717 - RNA, 19 nt, Homo sapiens
gguagaagacauucagaug

SEQ ID NO: 344718 - RNA, 19 nt, Homo sapiens
gcaguccuccauuaaggua

SEQ ID NO: 344719 - RNA, 19 nt, Homo sapiens
agaguugaaugaaugaaga

SEQ ID NO: 344720 - RNA, 19 nt, Homo sapiens
gggacaagcauguugauuc

SEQ ID NO: 344721 - RNA, 19 nt, Homo sapiens
cgggaucucuccacaacuu

SEQ ID NO: 344722 - RNA, 19 nt, Homo sapiens
gacagcaguccuccauuaa

SEQ ID NO: 344723 - RNA, 19 nt, Homo sapiens
ggaaauguuuggccaugcu

SEQ ID NO: 344724 - RNA, 19 nt, Homo sapiens
ggcgaacccugacuaucaa

SEQ ID NO: 344725 - RNA, 19 nt, Homo sapiens
gcauggaccucaccaacac

SEQ ID NO: 344726 - RNA, 19 nt, Homo sapiens
cuccagaguuugucaaguu

SEQ ID NO: 344727 - RNA, 19 nt, Homo sapiens
agauaaguguguuugcaaa

SEQ ID NO: 344728 - RNA, 19 nt, Homo sapiens
gcauauccagcaauucuau

SEQ ID NO: 344729 - RNA, 19 nt, Homo sapiens
cacaaguauugcccuuuaa

SEQ ID NO: 344730 - RNA, 19 nt, Homo sapiens
ggaacuggaaugauaaugg

SEQ ID NO: 344731 - RNA, 19 nt, Homo sapiens
gaagagagacgcggagaac

SEQ ID NO: 344732 - RNA, 19 nt, Homo sapiens
uaccguugauguugauaaa

SEQ ID NO: 344733 - RNA, 19 nt, Homo sapiens
aaagauaaguguguuugca

SEQ ID NO: 344734 - RNA, 19 nt, Homo sapiens
ucaaggaacccaagagagu

SEQ ID NO: 344735 - RNA, 19 nt, Homo sapiens
acauaacucccuggaaaua

SEQ ID NO: 344736 - RNA, 19 nt, Homo sapiens
caagucacaugggcagaga

SEQ ID NO: 344737 - RNA, 19 nt, Homo sapiens
aaaggaacuggaaugauaa

SEQ ID NO: 344738 - RNA, 19 nt, Homo sapiens
ggacacuuuaccuuucuaa

SEQ ID NO: 344739 - RNA, 19 nt, Homo sapiens
caagagaguggaagaacug

SEQ ID NO: 344740 - RNA, 19 nt, Homo sapiens
gcucaaggaacccaagaga

SEQ ID NO: 344741 - RNA, 19 nt, Homo sapiens
cagcaguccuccauuaagg

SEQ ID NO: 344742 - RNA, 19 nt, Homo sapiens
acacuuuaccuuucuaaga

SEQ ID NO: 344743 - RNA, 19 nt, Homo sapiens
gaagccaugccuuguguuc

SEQ ID NO: 344744 - RNA, 19 nt, Homo sapiens
caccaacacugaaaucacu

SEQ ID NO: 344745 - RNA, 19 nt, Homo sapiens
uauguaccguugauguuga

SEQ ID NO: 344746 - RNA, 19 nt, Homo sapiens
ggaaugauaauggaaacug

SEQ ID NO: 344747 - RNA, 19 nt, Homo sapiens
cagcuucaguaccuuuaug

SEQ ID NO: 344748 - RNA, 19 nt, Homo sapiens
uugaaugaaugaagagaga

SEQ ID NO: 344749 - RNA, 19 nt, Homo sapiens
ucuaguauggcacaugaua

SEQ ID NO: 344750 - RNA, 19 nt, Homo sapiens
gggcacaaguauuacacau

SEQ ID NO: 344751 - RNA, 19 nt, Homo sapiens
aggcaaaggcuuguaaauu

SEQ ID NO: 344752 - RNA, 19 nt, Homo sapiens
gaagaaggcaaaggcuugu

SEQ ID NO: 344753 - RNA, 19 nt, Homo sapiens
ccaagagaguggaagaacu

SEQ ID NO: 344754 - RNA, 19 nt, Homo sapiens
ugucaguacugccgauuuc

SEQ ID NO: 344755 - RNA, 19 nt, Homo sapiens
cggaaucgcugucaguacu

SEQ ID NO: 344756 - RNA, 19 nt, Homo sapiens
auacguguguuuagcaaau

SEQ ID NO: 344757 - RNA, 19 nt, Homo sapiens
cauaacucccuggaaauaa

SEQ ID NO: 344758 - RNA, 19 nt, Homo sapiens
cauguugauucuagguuga

SEQ ID NO: 344759 - RNA, 19 nt, Homo sapiens
aaacuuuguccuucauuga

SEQ ID NO: 344760 - RNA, 19 nt, Homo sapiens
acacacacauacacacaca

SEQ ID NO: 344761 - RNA, 19 nt, Homo sapiens
gauaauggaaacugucaag

SEQ ID NO: 344762 - RNA, 19 nt, Homo sapiens
gaacuucguacccuuugca

SEQ ID NO: 344763 - RNA, 19 nt, Homo sapiens
uggaagaacugcaaaacaa

SEQ ID NO: 344764 - RNA, 19 nt, Homo sapiens
gagaguggaagaacugcaa

SEQ ID NO: 344765 - RNA, 19 nt, Homo sapiens
gcccaaagccgaccaagac

SEQ ID NO: 344766 - RNA, 19 nt, Homo sapiens
cagcauauccagcaauucu

SEQ ID NO: 344767 - RNA, 19 nt, Homo sapiens
cagaguuugucaaguuuag

SEQ ID NO: 344768 - RNA, 19 nt, Homo sapiens
ucaaaugaguggagaugac

SEQ ID NO: 344769 - RNA, 19 nt, Homo sapiens
ccgggucgguuuacuacaa

SEQ ID NO: 344770 - RNA, 19 nt, Homo sapiens
ccauuaagguagaagacau

SEQ ID NO: 344771 - RNA, 19 nt, Homo sapiens
caaaggaacuggaaugaua

SEQ ID NO: 344772 - RNA, 19 nt, Homo sapiens
ggaaauaacugagcacuuu

SEQ ID NO: 344773 - RNA, 19 nt, Homo sapiens
gcaaaggcuuguaaauuua

SEQ ID NO: 344774 - RNA, 19 nt, Homo sapiens
ggcaaaggcuuguaaauuu

SEQ ID NO: 344775 - RNA, 19 nt, Homo sapiens
gcacaaguauuacacauca

SEQ ID NO: 344776 - RNA, 19 nt, Homo sapiens
ccacaaguauugcccuuua

SEQ ID NO: 344777 - RNA, 19 nt, Homo sapiens
gaacuggaaugauaaugga

SEQ ID NO: 344778 - RNA, 19 nt, Homo sapiens
gcaaugcguucguggcuuu

SEQ ID NO: 344779 - RNA, 19 nt, Homo sapiens
uaacugagcacuuugaauu

SEQ ID NO: 344780 - RNA, 19 nt, Homo sapiens
guaguuaucugagcuuaaa

SEQ ID NO: 344781 - RNA, 19 nt, Homo sapiens
gaacauggacuacacacaa

SEQ ID NO: 344782 - RNA, 19 nt, Homo sapiens
gccauauucuguaguauuu

SEQ ID NO: 344783 - RNA, 19 nt, Homo sapiens
gaaacuuuguccuucauug

SEQ ID NO: 344784 - RNA, 19 nt, Homo sapiens
ggacaagcauguugauucu

SEQ ID NO: 344785 - RNA, 19 nt, Homo sapiens
auacauaacucccuggaaa

SEQ ID NO: 344786 - RNA, 19 nt, Homo sapiens
ccacgugacuuucaacaau

SEQ ID NO: 344787 - RNA, 19 nt, Homo sapiens
ggagaugacacccagcaua

SEQ ID NO: 344788 - RNA, 19 nt, Homo sapiens
guauugcccuuuaacaaga

SEQ ID NO: 344789 - RNA, 19 nt, Homo sapiens
ggacaagcgucgccggaau

SEQ ID NO: 344790 - RNA, 19 nt, Homo sapiens
uaggugggcacaaguauua

SEQ ID NO: 344791 - RNA, 19 nt, Homo sapiens
cggcagaguugaaugaaug

SEQ ID NO: 344792 - RNA, 19 nt, Homo sapiens
gcaguucagacaaauguaa

SEQ ID NO: 344793 - RNA, 19 nt, Homo sapiens
gaaugauaauggaaacugu

SEQ ID NO: 344794 - RNA, 19 nt, Homo sapiens
gaauaugaacaucgacauu

SEQ ID NO: 344795 - RNA, 19 nt, Homo sapiens
gagaugacacccagcauau

SEQ ID NO: 344796 - RNA, 19 nt, Homo sapiens
ccaccuugcuuguaccaaa

SEQ ID NO: 344797 - RNA, 19 nt, Homo sapiens
ggauuuagaacauggacua

SEQ ID NO: 344798 - RNA, 19 nt, Homo sapiens
guaccuuuauggacaacua

SEQ ID NO: 344799 - RNA, 19 nt, Homo sapiens
gauaugagucacugccuuu

SEQ ID NO: 344800 - RNA, 19 nt, Homo sapiens
ugaauucuccuccaacuug

SEQ ID NO: 344801 - RNA, 19 nt, Homo sapiens
guaacaccguccaacauuc

SEQ ID NO: 344802 - RNA, 19 nt, Homo sapiens
acauucagaugcacaacua

SEQ ID NO: 344803 - RNA, 19 nt, Homo sapiens
gaaauaacugagcacuuug

SEQ ID NO: 344804 - RNA, 19 nt, Homo sapiens
gcacuucggcagaguugaa

SEQ ID NO: 344805 - RNA, 19 nt, Homo sapiens
cccaagcacuucaaaggaa

SEQ ID NO: 344806 - RNA, 19 nt, Homo sapiens
uagaagacauucagaugca

SEQ ID NO: 344807 - RNA, 19 nt, Homo sapiens
gaaggcaaaggcuuguaaa

SEQ ID NO: 344808 - RNA, 19 nt, Homo sapiens
ggacuacacacaauacagu

SEQ ID NO: 344809 - RNA, 19 nt, Homo sapiens
guuuguaaguguuguaugu

SEQ ID NO: 344810 - RNA, 19 nt, Homo sapiens
acaagcauguugauucuag

SEQ ID NO: 344811 - RNA, 19 nt, Homo sapiens
cagaagaaagauugcuaua

SEQ ID NO: 344812 - RNA, 19 nt, Homo sapiens
gaacccugacuaucaaaug

SEQ ID NO: 344813 - RNA, 19 nt, Homo sapiens
gguagaagacauucagaug

SEQ ID NO: 344814 - RNA, 19 nt, Homo sapiens
gcaguccuccauuaaggua

SEQ ID NO: 344815 - RNA, 19 nt, Homo sapiens
agaguugaaugaaugaaga

SEQ ID NO: 344816 - RNA, 19 nt, Homo sapiens
gggacaagcauguugauuc

SEQ ID NO: 344817 - RNA, 19 nt, Homo sapiens
cgggaucucuccacaacuu

SEQ ID NO: 344818 - RNA, 19 nt, Homo sapiens
gacagcaguccuccauuaa

SEQ ID NO: 344819 - RNA, 19 nt, Homo sapiens
ggaaauguuuggccaugcu

SEQ ID NO: 344820 - RNA, 19 nt, Homo sapiens
ggcgaacccugacuaucaa

SEQ ID NO: 344821 - RNA, 19 nt, Homo sapiens
agauaaguguguuugcaaa

SEQ ID NO: 344822 - RNA, 19 nt, Homo sapiens
gcauauccagcaauucuau

SEQ ID NO: 344823 - RNA, 19 nt, Homo sapiens
cacaaguauugcccuuuaa

SEQ ID NO: 344824 - RNA, 19 nt, Homo sapiens
ggaacuggaaugauaaugg

SEQ ID NO: 344825 - RNA, 19 nt, Homo sapiens
ggauugauuccauuguuga

SEQ ID NO: 344826 - RNA, 19 nt, Homo sapiens
uaccguugauguugauaaa

SEQ ID NO: 344827 - RNA, 19 nt, Homo sapiens
aaagauaaguguguuugca

SEQ ID NO: 344828 - RNA, 19 nt, Homo sapiens
ucaaggaacccaagagagu

SEQ ID NO: 344829 - RNA, 19 nt, Homo sapiens
ccuccaacuugcagaauau

SEQ ID NO: 344830 - RNA, 19 nt, Homo sapiens
aaacucaucuuuugcaaug

SEQ ID NO: 344831 - RNA, 19 nt, Homo sapiens
acauaacucccuggaaaua

SEQ ID NO: 344832 - RNA, 19 nt, Homo sapiens
caagucacaugggcagaga

SEQ ID NO: 344833 - RNA, 19 nt, Homo sapiens
aaaggaacuggaaugauaa

SEQ ID NO: 344834 - RNA, 19 nt, Homo sapiens
ggacacuuuaccuuucuaa

SEQ ID NO: 344835 - RNA, 19 nt, Homo sapiens
caagagaguggaagaacug

SEQ ID NO: 344836 - RNA, 19 nt, Homo sapiens
gcucaaggaacccaagaga

SEQ ID NO: 344837 - RNA, 19 nt, Homo sapiens
cagcaguccuccauuaagg

SEQ ID NO: 344838 - RNA, 19 nt, Homo sapiens
acacuuuaccuuucuaaga

SEQ ID NO: 344839 - RNA, 19 nt, Homo sapiens
ggaggguaaacucaucuuu

SEQ ID NO: 344840 - RNA, 19 nt, Homo sapiens
uauguaccguugauguuga

SEQ ID NO: 344841 - RNA, 19 nt, Homo sapiens
ggaaugauaauggaaacug

SEQ ID NO: 344842 - RNA, 19 nt, Homo sapiens
uugaaugaaugaagacaga

SEQ ID NO: 344843 - RNA, 19 nt, Homo sapiens
ucuaguauggcacaugaua

SEQ ID NO: 344844 - RNA, 19 nt, Homo sapiens
gggcacaaguauuacacau

SEQ ID NO: 344845 - RNA, 19 nt, Homo sapiens
aggcaaaggcuuguaaauu

SEQ ID NO: 344846 - RNA, 19 nt, Homo sapiens
gaagaaggcaaaggcuugu

SEQ ID NO: 344847 - RNA, 19 nt, Homo sapiens
ccaagagaguggaagaacu

SEQ ID NO: 344848 - RNA, 19 nt, Homo sapiens
ugucaguacugccgauuuc

SEQ ID NO: 344849 - RNA, 19 nt, Homo sapiens
cggaaucgcugucaguacu

SEQ ID NO: 344850 - RNA, 19 nt, Homo sapiens
auacguguguuuagcaaau

SEQ ID NO: 344851 - RNA, 19 nt, Homo sapiens
cauaacucccuggaaauaa

SEQ ID NO: 344852 - RNA, 19 nt, Homo sapiens
cauguugauucuagguuga

SEQ ID NO: 344853 - RNA, 19 nt, Homo sapiens
aaacuuuguccuucauuga

SEQ ID NO: 344854 - RNA, 19 nt, Homo sapiens
acacacacauacacacaca

SEQ ID NO: 344855 - RNA, 19 nt, Homo sapiens
gauaauggaaacugucaag

SEQ ID NO: 344856 - RNA, 19 nt, Homo sapiens
gaacuucguacccuuugca

SEQ ID NO: 344857 - RNA, 19 nt, Homo sapiens
uggaagaacugcaaaacaa

SEQ ID NO: 344858 - RNA, 19 nt, Homo sapiens
gagaguggaagaacugcaa

SEQ ID NO: 344859 - RNA, 19 nt, Homo sapiens
gcccaaagccgaccaagac

SEQ ID NO: 344860 - RNA, 19 nt, Homo sapiens
ccauuaagguagaagacau

SEQ ID NO: 344861 - RNA, 19 nt, Homo sapiens
cagcauauccagcaauucu

SEQ ID NO: 344862 - RNA, 19 nt, Homo sapiens
ucaaaugaguggagaugac

SEQ ID NO: 344863 - RNA, 19 nt, Homo sapiens
ccgggucgguuuacuacaa

SEQ ID NO: 344864 - RNA, 19 nt, Homo sapiens
ccagaacuucguacccuuu

SEQ ID NO: 344865 - RNA, 19 nt, Homo sapiens
uuucuaguauggcacauga

SEQ ID NO: 344866 - RNA, 19 nt, Homo sapiens
aaauaggugggcacaagua

SEQ ID NO: 344867 - RNA, 19 nt, Homo sapiens
gauucuagguugaaaaugu

SEQ ID NO: 344868 - RNA, 19 nt, Homo sapiens
aaauuuacccaaugcaguu

SEQ ID NO: 344869 - RNA, 19 nt, Homo sapiens
ccuggacacuuuaccuuuc

SEQ ID NO: 344870 - RNA, 19 nt, Homo sapiens
cccagcauauccagcaauu

SEQ ID NO: 344871 - RNA, 19 nt, Homo sapiens
ggaaguagauggagaaauu

SEQ ID NO: 344872 - RNA, 19 nt, Homo sapiens
gaaggaggaugguuuauug

SEQ ID NO: 344873 - RNA, 19 nt, Homo sapiens
gaacugagcccacuucuga

SEQ ID NO: 344874 - RNA, 19 nt, Homo sapiens
gaacuugaccugccaauuu

SEQ ID NO: 344875 - RNA, 19 nt, Homo sapiens
guucaaagcucuuggauug

SEQ ID NO: 344876 - RNA, 19 nt, Homo sapiens
cgagaaauaugccuaggua

SEQ ID NO: 344877 - RNA, 19 nt, Homo sapiens
gaacucaagguuagucaua

SEQ ID NO: 344878 - RNA, 19 nt, Homo sapiens
ggaugcagauguaaauuug

SEQ ID NO: 344879 - RNA, 19 nt, Homo sapiens
uaacugagauacaggauuc

SEQ ID NO: 344880 - RNA, 19 nt, Homo sapiens
cgaaggcuguugcaaauga

SEQ ID NO: 344881 - RNA, 19 nt, Homo sapiens
uaacaggccagauauaauu

SEQ ID NO: 344882 - RNA, 19 nt, Homo sapiens
ugaaacacaggaugaauua

SEQ ID NO: 344883 - RNA, 19 nt, Homo sapiens
gcaaaucacaugaacaguu

SEQ ID NO: 344884 - RNA, 19 nt, Homo sapiens
ugaaguggaugcuuuaugu

SEQ ID NO: 344885 - RNA, 19 nt, Homo sapiens
ugaaucagcuacuuacaga

SEQ ID NO: 344886 - RNA, 19 nt, Homo sapiens
gcaagaugcucauacacau

SEQ ID NO: 344887 - RNA, 19 nt, Homo sapiens
gagaaggaacuuaagaauu

SEQ ID NO: 344888 - RNA, 19 nt, Homo sapiens
uggaugaucugaauaaugu

SEQ ID NO: 344889 - RNA, 19 nt, Homo sapiens
aaggcaagcuaaagaauaa

SEQ ID NO: 344890 - RNA, 19 nt, Homo sapiens
gauauucuuugaugaagug

SEQ ID NO: 344891 - RNA, 19 nt, Homo sapiens
acaccuaacuccaggcuuu

SEQ ID NO: 344892 - RNA, 19 nt, Homo sapiens
gcauggaugaucugaauaa

SEQ ID NO: 344893 - RNA, 19 nt, Homo sapiens
gauauggaacgaagaauug

SEQ ID NO: 344894 - RNA, 19 nt, Homo sapiens
ggaaaggcaagcuaaagaa

SEQ ID NO: 344895 - RNA, 19 nt, Homo sapiens
gaggaugguuuauugacaa

SEQ ID NO: 344896 - RNA, 19 nt, Homo sapiens
cuaagaagccaauaacuga

SEQ ID NO: 344897 - RNA, 19 nt, Homo sapiens
ugaagaggauaaugaguau

SEQ ID NO: 344898 - RNA, 19 nt, Homo sapiens
ggaaagaauacuucaaaca

SEQ ID NO: 344899 - RNA, 19 nt, Homo sapiens
gaagcugagagaacuauuu

SEQ ID NO: 344900 - RNA, 19 nt, Homo sapiens
gugaagaggauaaugagua

SEQ ID NO: 344901 - RNA, 19 nt, Homo sapiens
uaaugaagcuacaggaaca

SEQ ID NO: 344902 - RNA, 19 nt, Homo sapiens
ggcgaaggcuguugcaaau

SEQ ID NO: 344903 - RNA, 19 nt, Homo sapiens
gaaaccaccucuucaacac

SEQ ID NO: 344904 - RNA, 19 nt, Homo sapiens
guagugagaaggaacuuaa

SEQ ID NO: 344905 - RNA, 19 nt, Homo sapiens
uagaggagcuagcccauca

SEQ ID NO: 344906 - RNA, 19 nt, Homo sapiens
gaaauggcaagacagaaga

SEQ ID NO: 344907 - RNA, 19 nt, Homo sapiens
gucaauagagucuuaauga

SEQ ID NO: 344908 - RNA, 19 nt, Homo sapiens
ggaggaugguuuauugaca

SEQ ID NO: 344909 - RNA, 19 nt, Homo sapiens
gaugaugauucaaguaugg

SEQ ID NO: 344910 - RNA, 19 nt, Homo sapiens
ugaaagcuauucugaugau

SEQ ID NO: 344911 - RNA, 19 nt, Homo sapiens
ccgaauuacuaaacaugua

SEQ ID NO: 344912 - RNA, 19 nt, Homo sapiens
guuagacccugcuuugaga

SEQ ID NO: 344913 - RNA, 19 nt, Homo sapiens
gaaaggcaagcuaaagaau

SEQ ID NO: 344914 - RNA, 19 nt, Homo sapiens
gacaggaaauggcaagaca

SEQ ID NO: 344915 - RNA, 19 nt, Homo sapiens
gaagcacgccagcagguuu

SEQ ID NO: 344916 - RNA, 19 nt, Homo sapiens
agagauggauggucuggaa

SEQ ID NO: 344917 - RNA, 19 nt, Homo sapiens
gagauugugucuggaguau

SEQ ID NO: 344918 - RNA, 19 nt, Homo sapiens
caaauacuccugagaugga

SEQ ID NO: 344919 - RNA, 19 nt, Homo sapiens
cuucaaacauugugcagaa

SEQ ID NO: 344920 - RNA, 19 nt, Homo sapiens
gaugugggaggcaaugaua

SEQ ID NO: 344921 - RNA, 19 nt, Homo sapiens
ugccaaagauucugaagga

SEQ ID NO: 344922 - RNA, 19 nt, Homo sapiens
ggaaauggcaagacagaag

SEQ ID NO: 344923 - RNA, 19 nt, Homo sapiens
aauugaagcuguccuacaa

SEQ ID NO: 344924 - RNA, 19 nt, Homo sapiens
gguccgagcuguggcuuga

SEQ ID NO: 344925 - RNA, 19 nt, Homo sapiens
ggaccugucaugugagaaa

SEQ ID NO: 344926 - RNA, 19 nt, Homo sapiens
acugaaagcuauucugaug

SEQ ID NO: 344927 - RNA, 19 nt, Homo sapiens
cagaagaguggaaaugaaa

SEQ ID NO: 344928 - RNA, 19 nt, Homo sapiens
aaaggcaagcuaaagaaua

SEQ ID NO: 344929 - RNA, 19 nt, Homo sapiens
acagaagaguggaaaugaa

SEQ ID NO: 344930 - RNA, 19 nt, Homo sapiens
ucaaaugcaccauguauca

SEQ ID NO: 344931 - RNA, 19 nt, Homo sapiens
caggguucguggauaauaa

SEQ ID NO: 344932 - RNA, 19 nt, Homo sapiens
guucccugcugucuuuaua

SEQ ID NO: 344933 - RNA, 19 nt, Homo sapiens
aaaggugaacucaagguua

SEQ ID NO: 344934 - RNA, 19 nt, Homo sapiens
gaaagaccgacgcgaugaa

SEQ ID NO: 344935 - RNA, 19 nt, Homo sapiens
gacaaaaccccaaguguaa

SEQ ID NO: 344936 - RNA, 19 nt, Homo sapiens
gacagaagaguggaaauga

SEQ ID NO: 344937 - RNA, 19 nt, Homo sapiens
gggaaggcuuugucacugu

SEQ ID NO: 344938 - RNA, 19 nt, Homo sapiens
ugagcaagcugugucaaau

SEQ ID NO: 344939 - RNA, 19 nt, Homo sapiens
cugcaggguucguggauaa

SEQ ID NO: 344940 - RNA, 19 nt, Homo sapiens
ugaguauacugaaagcuau

SEQ ID NO: 344941 - RNA, 19 nt, Homo sapiens
ggacugugcauugaacuga

SEQ ID NO: 344942 - RNA, 19 nt, Homo sapiens
gcaaggacugugcauugaa

SEQ ID NO: 344943 - RNA, 19 nt, Homo sapiens
gcagcaaugugugcaguca

SEQ ID NO: 344944 - RNA, 19 nt, Homo sapiens
gggaggcaaugauaugaca

SEQ ID NO: 344945 - RNA, 19 nt, Homo sapiens
aaacggaaaggcaagcuaa

SEQ ID NO: 344946 - RNA, 19 nt, Homo sapiens
gaaacggaaaggcaagcua

SEQ ID NO: 344947 - RNA, 19 nt, Homo sapiens
gcaggguucguggauaaua

SEQ ID NO: 344948 - RNA, 19 nt, Homo sapiens
aggaaaggcugggaacuga

SEQ ID NO: 344949 - RNA, 19 nt, Homo sapiens
caauagagucuuaaugaag

SEQ ID NO: 344950 - RNA, 19 nt, Homo sapiens
gccaauaacugagauacag

SEQ ID NO: 344951 - RNA, 19 nt, Homo sapiens
gaaaaguaauccuaagaag

SEQ ID NO: 344952 - RNA, 19 nt, Homo sapiens
ugaaugaggccaagcugaa

SEQ ID NO: 344953 - RNA, 19 nt, Homo sapiens
gauguaaauuuggaagcaa

SEQ ID NO: 344954 - RNA, 19 nt, Homo sapiens
uugaugaaguggaugcuuu

SEQ ID NO: 344955 - RNA, 19 nt, Homo sapiens
uaaucgaccagacucguua

SEQ ID NO: 344956 - RNA, 19 nt, Homo sapiens
cugcauggaugaucugaau

SEQ ID NO: 344957 - RNA, 19 nt, Homo sapiens
gaagaccccugccaaagau

SEQ ID NO: 344958 - RNA, 19 nt, Homo sapiens
ccacuaacaggccagauau

SEQ ID NO: 344959 - RNA, 19 nt, Homo sapiens
ugugugauauucuuugaug

SEQ ID NO: 344960 - RNA, 19 nt, Homo sapiens
uaaaagaggucugcaagau

SEQ ID NO: 344961 - RNA, 19 nt, Homo sapiens
ucuuggaccugucauguga

SEQ ID NO: 344962 - RNA, 19 nt, Homo sapiens
gagauggagcaaagagaaa

SEQ ID NO: 344963 - RNA, 19 nt, Homo sapiens
ugcagucaauagagucuua

SEQ ID NO: 344964 - RNA, 19 nt, Homo sapiens
aagguucgaccgagaaaua

SEQ ID NO: 344965 - RNA, 19 nt, Homo sapiens
gaagaauuguagcccaacu

SEQ ID NO: 344966 - RNA, 19 nt, Homo sapiens
ucuccaacgugaaguuuga

SEQ ID NO: 344967 - RNA, 19 nt, Homo sapiens
agaucucucugcuuuggua

SEQ ID NO: 344968 - RNA, 19 nt, Homo sapiens
gccacuaacaggccagaua

SEQ ID NO: 344969 - RNA, 19 nt, Homo sapiens
ucaaagcucuuggauuggu

SEQ ID NO: 344970 - RNA, 19 nt, Homo sapiens
aaacacaggaugaauuaca

SEQ ID NO: 344971 - RNA, 19 nt, Homo sapiens
gcaguggccucuuuacuua

SEQ ID NO: 344972 - RNA, 19 nt, Homo sapiens
caauggagguucuuugaaa

SEQ ID NO: 344973 - RNA, 19 nt, Homo sapiens
gcaaacagauaucaaugga

SEQ ID NO: 344974 - RNA, 19 nt, Homo sapiens
gaggcuggcuguaaaguaa

SEQ ID NO: 344975 - RNA, 19 nt, Homo sapiens
gcuaugcaguggaugcuua

SEQ ID NO: 344976 - RNA, 19 nt, Homo sapiens
gcaagugaauccugcaaca

SEQ ID NO: 344977 - RNA, 19 nt, Homo sapiens
gcaccauccugcuguauca

SEQ ID NO: 344978 - RNA, 19 nt, Homo sapiens
ugacugcaguggccucuuu

SEQ ID NO: 344979 - RNA, 19 nt, Homo sapiens
gguuaggauucccaaauuu

SEQ ID NO: 344980 - RNA, 19 nt, Homo sapiens
ggauuucucuugucuuugg

SEQ ID NO: 344981 - RNA, 19 nt, Homo sapiens
gauaugaaccacacggaaa

SEQ ID NO: 344982 - RNA, 19 nt, Homo sapiens
gacagcgucucggauauga

SEQ ID NO: 344983 - RNA, 19 nt, Homo sapiens
gcccagggauuucucuugu

SEQ ID NO: 344984 - RNA, 19 nt, Homo sapiens
uacagcugcucuagccuua

SEQ ID NO: 344985 - RNA, 19 nt, Homo sapiens
gaugccagcacaauugaaa

SEQ ID NO: 344986 - RNA, 19 nt, Homo sapiens
uaaaggaagacaaggcauu

SEQ ID NO: 344987 - RNA, 19 nt, Homo sapiens
aaauuuggccugcugcuuu

SEQ ID NO: 344988 - RNA, 19 nt, Homo sapiens
agggauuucucuugucuuu

SEQ ID NO: 344989 - RNA, 19 nt, Homo sapiens
guugacagcgucucggaua

SEQ ID NO: 344990 - RNA, 19 nt, Homo sapiens
gaaccacacggaaauuugg

SEQ ID NO: 344991 - RNA, 19 nt, Homo sapiens
gaugcaaacagauaucaau

SEQ ID NO: 344992 - RNA, 19 nt, Homo sapiens
ugguuaggauucccaaauu

SEQ ID NO: 344993 - RNA, 19 nt, Homo sapiens
gcauuuacacggagaacga

SEQ ID NO: 344994 - RNA, 19 nt, Homo sapiens
ggaagacaaggcauuuaca

SEQ ID NO: 344995 - RNA, 19 nt, Homo sapiens
aaaggaagacaaggcauuu

SEQ ID NO: 344996 - RNA, 19 nt, Homo sapiens
cccacuaugucaccaugua

SEQ ID NO: 344997 - RNA, 19 nt, Homo sapiens
ccagggauuucucuugucu

SEQ ID NO: 344998 - RNA, 19 nt, Homo sapiens
cgauguggauccagcuguu

SEQ ID NO: 344999 - RNA, 19 nt, Homo sapiens
gaaauuuggccugcugcuu

SEQ ID NO: 345000 - RNA, 19 nt, Homo sapiens
gaugggagccgugaucaag

SEQ ID NO: 345001 - RNA, 19 nt, Homo sapiens
cagcugcucuagccuuagu

SEQ ID NO: 345002 - RNA, 19 nt, Homo sapiens
ccgggaaggugucucaagu

SEQ ID NO: 345003 - RNA, 19 nt, Homo sapiens
ggagauccagugggaauca

SEQ ID NO: 345004 - RNA, 19 nt, Homo sapiens
cuugagaugcaaacagaua

SEQ ID NO: 345005 - RNA, 19 nt, Homo sapiens
gaagacaaggcauuuacac

SEQ ID NO: 345006 - RNA, 19 nt, Homo sapiens
aagugaauccugcaacaaa

SEQ ID NO: 345007 - RNA, 19 nt, Homo sapiens
ggagugcgauguggaucca

SEQ ID NO: 345008 - RNA, 19 nt, Homo sapiens
gagaugcaaacagauauca

SEQ ID NO: 345009 - RNA, 19 nt, Homo sapiens
uuuguugguugucgaauau

SEQ ID NO: 345010 - RNA, 19 nt, Homo sapiens
ugaaccacacggaaauuug

SEQ ID NO: 345011 - RNA, 19 nt, Homo sapiens
ggcuguaaaguaaguguaa

SEQ ID NO: 345012 - RNA, 19 nt, Homo sapiens
uuugaaaccugucagaacu

SEQ ID NO: 345013 - RNA, 19 nt, Homo sapiens
caagugaauccugcaacaa

SEQ ID NO: 345014 - RNA, 19 nt, Homo sapiens
ucugaugccagcacaauug

SEQ ID NO: 345015 - RNA, 19 nt, Homo sapiens
ugaggcuggcuguaaagua

SEQ ID NO: 345016 - RNA, 19 nt, Homo sapiens
guucucaccuucccaacac

SEQ ID NO: 345017 - RNA, 19 nt, Homo sapiens
gaggaugggagccgugauc

SEQ ID NO: 345018 - RNA, 19 nt, Homo sapiens
ccacauccuuggggaagua

SEQ ID NO: 345019 - RNA, 19 nt, Homo sapiens
caugguuuauuaugggaau

SEQ ID NO: 345020 - RNA, 19 nt, Homo sapiens
cccaacccauggagaccua

SEQ ID NO: 345021 - RNA, 19 nt, Homo sapiens
ugggagccgugaucaagau

SEQ ID NO: 345022 - RNA, 19 nt, Homo sapiens
gugguuaggauucccaaau

SEQ ID NO: 345023 - RNA, 19 nt, Homo sapiens
uaucaauggagguucuuug

SEQ ID NO: 345024 - RNA, 19 nt, Homo sapiens
ccauauuccucagacucaa

SEQ ID NO: 345025 - RNA, 19 nt, Homo sapiens
ccacugaugccccaugaaa

SEQ ID NO: 345026 - RNA, 19 nt, Homo sapiens
ggaugggagccgugaucaa

SEQ ID NO: 345027 - RNA, 19 nt, Homo sapiens
aaggaagacaaggcauuua

SEQ ID NO: 345028 - RNA, 19 nt, Homo sapiens
ugcaguggccucuuuacuu

SEQ ID NO: 345029 - RNA, 19 nt, Homo sapiens
gcuguaaaguaaguguaag

SEQ ID NO: 345030 - RNA, 19 nt, Homo sapiens
uuucugaggcuggcuguaa

SEQ ID NO: 345031 - RNA, 19 nt, Homo sapiens
ugacagcgucucggauaug

SEQ ID NO: 345032 - RNA, 19 nt, Homo sapiens
caugcugucugaagguucu

SEQ ID NO: 345033 - RNA, 19 nt, Homo sapiens
gagcaugcugucugaaggu

SEQ ID NO: 345034 - RNA, 19 nt, Homo sapiens
gcucacccauccccacuga

SEQ ID NO: 345035 - RNA, 19 nt, Homo sapiens
agauaucaauggagguucu

SEQ ID NO: 345036 - RNA, 19 nt, Homo sapiens
uuacuuaaaggaagacaag

SEQ ID NO: 345037 - RNA, 19 nt, Homo sapiens
gacugcaguggccucuuua

SEQ ID NO: 345038 - RNA, 19 nt, Homo sapiens
uggccacccugcucugugu

SEQ ID NO: 345039 - RNA, 19 nt, Homo sapiens
ccugcuguaucacaucaug

SEQ ID NO: 345040 - RNA, 19 nt, Homo sapiens
gaacuuaccucuugccaaa

SEQ ID NO: 345041 - RNA, 19 nt, Homo sapiens
gaaaggugcuuccgaggua

SEQ ID NO: 345042 - RNA, 19 nt, Homo sapiens
ccaugaagcuugagacaua

SEQ ID NO: 345043 - RNA, 19 nt, Homo sapiens
ccaaaucucuggacaaguu

SEQ ID NO: 345044 - RNA, 19 nt, Homo sapiens
gcaccgaccugcagaaaga

SEQ ID NO: 345045 - RNA, 19 nt, Homo sapiens
ggaggcagcuggcacaaga

SEQ ID NO: 345046 - RNA, 19 nt, Homo sapiens
ucacagaacuacagagaga

SEQ ID NO: 345047 - RNA, 19 nt, Homo sapiens
caaaggccauuuauauuca

SEQ ID NO: 345048 - RNA, 19 nt, Homo sapiens
ucacaucccuuguccagaa

SEQ ID NO: 345049 - RNA, 19 nt, Homo sapiens
caacacagcccagggauuu

SEQ ID NO: 345050 - RNA, 19 nt, Homo sapiens
gcugaggccuggcugaauu

SEQ ID NO: 345051 - RNA, 19 nt, Homo sapiens
gcuggaagccugucaaaga

SEQ ID NO: 345052 - RNA, 19 nt, Homo sapiens
ccaaaggccauuuauauuc

SEQ ID NO: 345053 - RNA, 19 nt, Homo sapiens
gaaggcagcucacgaaacc

SEQ ID NO: 345054 - RNA, 19 nt, Homo sapiens
ggucuuggaauuagucaua

SEQ ID NO: 345055 - RNA, 19 nt, Homo sapiens
gcagaaagagggcgaguuc

SEQ ID NO: 345056 - RNA, 19 nt, Homo sapiens
ggagaccauucuuuccaaa

SEQ ID NO: 345057 - RNA, 19 nt, Homo sapiens
ucaguccucucaccacuuu

SEQ ID NO: 345058 - RNA, 19 nt, Homo sapiens
gccaaaggccauuuauauu

SEQ ID NO: 345059 - RNA, 19 nt, Homo sapiens
ucagucagcagaagagaua

SEQ ID NO: 345060 - RNA, 19 nt, Homo sapiens
gucaagcacugguaccaaa

SEQ ID NO: 345061 - RNA, 19 nt, Homo sapiens
acauauagcuggagaccau

SEQ ID NO: 345062 - RNA, 19 nt, Homo sapiens
gagaguucauccaggaaau

SEQ ID NO: 345063 - RNA, 19 nt, Homo sapiens
gcaguucuguugccacucu

SEQ ID NO: 345064 - RNA, 19 nt, Homo sapiens
gaguucauccaggaaauua

SEQ ID NO: 345065 - RNA, 19 nt, Homo sapiens
aaugauggaucucagaaau

SEQ ID NO: 345066 - RNA, 19 nt, Homo sapiens
gaaaccaacagcaguccaa

SEQ ID NO: 345067 - RNA, 19 nt, Homo sapiens
ggaagcugccaccucagua

SEQ ID NO: 345068 - RNA, 19 nt, Homo sapiens
ugccaaaggccauuuauau

SEQ ID NO: 345069 - RNA, 19 nt, Homo sapiens
gaagcugccaccucaguau

SEQ ID NO: 345070 - RNA, 19 nt, Homo sapiens
gacuaucucuugccagaca

SEQ ID NO: 345071 - RNA, 19 nt, Homo sapiens
cagaagagauaaaagcaaa

SEQ ID NO: 345072 - RNA, 19 nt, Homo sapiens
ggagaguucauccaggaaa

SEQ ID NO: 345073 - RNA, 19 nt, Homo sapiens
gagaaggcagcucacgaaa

SEQ ID NO: 345074 - RNA, 19 nt, Homo sapiens
ugauggaucucagaaauac

SEQ ID NO: 345075 - RNA, 19 nt, Homo sapiens
cagcaacucugcaucuacu

SEQ ID NO: 345076 - RNA, 19 nt, Homo sapiens
ggacggucuuggaauuagu

SEQ ID NO: 345077 - RNA, 19 nt, Homo sapiens
gccacucucucuccuguca

SEQ ID NO: 345078 - RNA, 19 nt, Homo sapiens
ggagcgagggagcaugaaa

SEQ ID NO: 345079 - RNA, 19 nt, Homo sapiens
gcuccuacccugugugugu

SEQ ID NO: 345080 - RNA, 19 nt, Homo sapiens
aaucgaggguuucuggaau

SEQ ID NO: 345081 - RNA, 19 nt, Homo sapiens
caugaagcuugagacauau

SEQ ID NO: 345082 - RNA, 19 nt, Homo sapiens
cggcggacccuacaggaaa

SEQ ID NO: 345083 - RNA, 19 nt, Homo sapiens
ucgaggguuucuggaauuu

SEQ ID NO: 345084 - RNA, 19 nt, Homo sapiens
gaaacccacgccugugauc

SEQ ID NO: 345085 - RNA, 19 nt, Homo sapiens
gaaauaccccagccaaauc

SEQ ID NO: 345086 - RNA, 19 nt, Homo sapiens
caaucgaggguuucuggaa

SEQ ID NO: 345087 - RNA, 19 nt, Homo sapiens
guaccaaaauuguaagaag

SEQ ID NO: 345088 - RNA, 19 nt, Homo sapiens
acgcugaccugguugucuu

SEQ ID NO: 345089 - RNA, 19 nt, Homo sapiens
ucaaugauggaucucagaa

SEQ ID NO: 345090 - RNA, 19 nt, Homo sapiens
caaugauggaucucagaaa

SEQ ID NO: 345091 - RNA, 19 nt, Homo sapiens
caggcugugcuccauauuu

SEQ ID NO: 345092 - RNA, 19 nt, Homo sapiens
uagcuggagaccauucuuu

SEQ ID NO: 345093 - RNA, 19 nt, Homo sapiens
ggacccuacaggaaacuug

SEQ ID NO: 345094 - RNA, 19 nt, Homo sapiens
cuggaagccugucaaagag

SEQ ID NO: 345095 - RNA, 19 nt, Homo sapiens
gaggguuucuggaauuuuc

SEQ ID NO: 345096 - RNA, 19 nt, Homo sapiens
agucauaaacuaccagcaa

SEQ ID NO: 345097 - RNA, 19 nt, Homo sapiens
gucuuggaauuagucauaa

SEQ ID NO: 345098 - RNA, 19 nt, Homo sapiens
gggaagcugccaccucagu

SEQ ID NO: 345099 - RNA, 19 nt, Homo sapiens
cagcuggaagccugucaaa

SEQ ID NO: 345100 - RNA, 19 nt, Homo sapiens
gcacugguaccaaaauugu

SEQ ID NO: 345101 - RNA, 19 nt, Homo sapiens
caucccuuguccagaauuc

SEQ ID NO: 345102 - RNA, 19 nt, Homo sapiens
agccaaaucucuggacaag

SEQ ID NO: 345103 - RNA, 19 nt, Homo sapiens
cuucacagaacuacagaga

SEQ ID NO: 345104 - RNA, 19 nt, Homo sapiens
ggaaagggcuccaguguua

SEQ ID NO: 345105 - RNA, 19 nt, Homo sapiens
gaacagagagauuuagaua

SEQ ID NO: 345106 - RNA, 19 nt, Homo sapiens
gaaaggugcuuccgaggua

SEQ ID NO: 345107 - RNA, 19 nt, Homo sapiens
ucagugagcugguguauaa

SEQ ID NO: 345108 - RNA, 19 nt, Homo sapiens
caacacagcccaaggauuu

SEQ ID NO: 345109 - RNA, 19 nt, Homo sapiens
ccaaaucucuggacaaguu

SEQ ID NO: 345110 - RNA, 19 nt, Homo sapiens
gcaccgaccugcagaaaga

SEQ ID NO: 345111 - RNA, 19 nt, Homo sapiens
gaaauaugguuacauugga

SEQ ID NO: 345112 - RNA, 19 nt, Homo sapiens
ggaggcagcuggcacaaga

SEQ ID NO: 345113 - RNA, 19 nt, Homo sapiens
ucacagaacuacagagaga

SEQ ID NO: 345114 - RNA, 19 nt, Homo sapiens
gcugaggccuggcugaauu

SEQ ID NO: 345115 - RNA, 19 nt, Homo sapiens
gagagaacagagagauuua

SEQ ID NO: 345116 - RNA, 19 nt, Homo sapiens
acagagagauuuagauaag

SEQ ID NO: 345117 - RNA, 19 nt, Homo sapiens
gcuggaagccugucaaaga

SEQ ID NO: 345118 - RNA, 19 nt, Homo sapiens
gaaggcagcucacgaaacc

SEQ ID NO: 345119 - RNA, 19 nt, Homo sapiens
ggaggguaaugucuaaugu

SEQ ID NO: 345120 - RNA, 19 nt, Homo sapiens
ggucuuggaauuagucaua

SEQ ID NO: 345121 - RNA, 19 nt, Homo sapiens
gcagaaagagggcgaguuc

SEQ ID NO: 345122 - RNA, 19 nt, Homo sapiens
ucaguccucucaccacuuu

SEQ ID NO: 345123 - RNA, 19 nt, Homo sapiens
gucaagcacugguaccaaa

SEQ ID NO: 345124 - RNA, 19 nt, Homo sapiens
gaaauuccagccuugacuu

SEQ ID NO: 345125 - RNA, 19 nt, Homo sapiens
gagcugguguauaauccaa

SEQ ID NO: 345126 - RNA, 19 nt, Homo sapiens
gcaguucuguugccacucu

SEQ ID NO: 345127 - RNA, 19 nt, Homo sapiens
gagaguucauccaggaaau

SEQ ID NO: 345128 - RNA, 19 nt, Homo sapiens
gagaacagagagauuuaga

SEQ ID NO: 345129 - RNA, 19 nt, Homo sapiens
gaguucauccaggaaauua

SEQ ID NO: 345130 - RNA, 19 nt, Homo sapiens
aaugauggaucucagaaau

SEQ ID NO: 345131 - RNA, 19 nt, Homo sapiens
gaaaauauucccugagaga

SEQ ID NO: 345132 - RNA, 19 nt, Homo sapiens
ucacuucauuccaccuauu

SEQ ID NO: 345133 - RNA, 19 nt, Homo sapiens
ggaagcugccaccucagua

SEQ ID NO: 345134 - RNA, 19 nt, Homo sapiens
gaagcugccaccucaguau

SEQ ID NO: 345135 - RNA, 19 nt, Homo sapiens
gacuaucucuugccagaca

SEQ ID NO: 345136 - RNA, 19 nt, Homo sapiens
gaggguaaugucuaaugua

SEQ ID NO: 345137 - RNA, 19 nt, Homo sapiens
ggccuucuaugcccucuau

SEQ ID NO: 345138 - RNA, 19 nt, Homo sapiens
ggagaguucauccaggaaa

SEQ ID NO: 345139 - RNA, 19 nt, Homo sapiens
gaugggaggguaaugucua

SEQ ID NO: 345140 - RNA, 19 nt, Homo sapiens
ucuaugcccucuauccuau

SEQ ID NO: 345141 - RNA, 19 nt, Homo sapiens
agagagaacagagagauuu

SEQ ID NO: 345142 - RNA, 19 nt, Homo sapiens
gagagagaacagagagauu

SEQ ID NO: 345143 - RNA, 19 nt, Homo sapiens
ugauggaucucagaaauac

SEQ ID NO: 345144 - RNA, 19 nt, Homo sapiens
gagaaggcagcucacgaaa

SEQ ID NO: 345145 - RNA, 19 nt, Homo sapiens
aggguaaugucuaauguau

SEQ ID NO: 345146 - RNA, 19 nt, Homo sapiens
cagagagauuuagauaaga

SEQ ID NO: 345147 - RNA, 19 nt, Homo sapiens
gcugguguauaauccaaga

SEQ ID NO: 345148 - RNA, 19 nt, Homo sapiens
cagcaacucugcaucuacu

SEQ ID NO: 345149 - RNA, 19 nt, Homo sapiens
ggacggucuuggaauuagu

SEQ ID NO: 345150 - RNA, 19 nt, Homo sapiens
gggaaagggcuccaguguu

SEQ ID NO: 345151 - RNA, 19 nt, Homo sapiens
ggauucugcuggcugaaag

SEQ ID NO: 345152 - RNA, 19 nt, Homo sapiens
aauauucccugagagagaa

SEQ ID NO: 345153 - RNA, 19 nt, Homo sapiens
gccacucucucuccuguca

SEQ ID NO: 345154 - RNA, 19 nt, Homo sapiens
uggaccaguuccuucauuu

SEQ ID NO: 345155 - RNA, 19 nt, Homo sapiens
ggagcgagggagcaugaaa

SEQ ID NO: 345156 - RNA, 19 nt, Homo sapiens
gcuccuacccugugugugu

SEQ ID NO: 345157 - RNA, 19 nt, Homo sapiens
gaccugcaccauccucuga

SEQ ID NO: 345158 - RNA, 19 nt, Homo sapiens
agagagauuuagauaagag

SEQ ID NO: 345159 - RNA, 19 nt, Homo sapiens
gaaagggcuccaguguuau

SEQ ID NO: 345160 - RNA, 19 nt, Homo sapiens
uacccucauuucucucaua

SEQ ID NO: 345161 - RNA, 19 nt, Homo sapiens
agaaauaugguuacauugg

SEQ ID NO: 345162 - RNA, 19 nt, Homo sapiens
cggcggacccuacaggaaa

SEQ ID NO: 345163 - RNA, 19 nt, Homo sapiens
gggaggguaaugucuaaug

SEQ ID NO: 345164 - RNA, 19 nt, Homo sapiens
ugcccucuauccuaucaua

SEQ ID NO: 345165 - RNA, 19 nt, Homo sapiens
ccucauuucucucauagac

SEQ ID NO: 345166 - RNA, 19 nt, Homo sapiens
gaaauaccccagccaaauc

SEQ ID NO: 345167 - RNA, 19 nt, Homo sapiens
cauuccaccuauucucuga

SEQ ID NO: 345168 - RNA, 19 nt, Homo sapiens
ucaaugauggaucucagaa

SEQ ID NO: 345169 - RNA, 19 nt, Homo sapiens
guaccaaaauuguaagaag

SEQ ID NO: 345170 - RNA, 19 nt, Homo sapiens
acgcugaccugguugucuu

SEQ ID NO: 345171 - RNA, 19 nt, Homo sapiens
aaauauucccugagagaga

SEQ ID NO: 345172 - RNA, 19 nt, Homo sapiens
uccacagccucacuucauu

SEQ ID NO: 345173 - RNA, 19 nt, Homo sapiens
caaugauggaucucagaaa

SEQ ID NO: 345174 - RNA, 19 nt, Homo sapiens
gcaccugaugggaggguaa

SEQ ID NO: 345175 - RNA, 19 nt, Homo sapiens
agccuugacuuucuucugu

SEQ ID NO: 345176 - RNA, 19 nt, Homo sapiens
ggacccuacaggaaacuug

SEQ ID NO: 345177 - RNA, 19 nt, Homo sapiens
cuggaagccugucaaagag

SEQ ID NO: 345178 - RNA, 19 nt, Homo sapiens
ccugacuccuggccuucua

SEQ ID NO: 345179 - RNA, 19 nt, Homo sapiens
agucauaaacuaccagcaa

SEQ ID NO: 345180 - RNA, 19 nt, Homo sapiens
aaauuccagccuugacuuu

SEQ ID NO: 345181 - RNA, 19 nt, Homo sapiens
ccacagccucacuucauuc

SEQ ID NO: 345182 - RNA, 19 nt, Homo sapiens
gucuuggaauuagucauaa

SEQ ID NO: 345183 - RNA, 19 nt, Homo sapiens
gggaagcugccaccucagu

SEQ ID NO: 345184 - RNA, 19 nt, Homo sapiens
cagcuggaagccugucaaa

SEQ ID NO: 345185 - RNA, 19 nt, Homo sapiens
augggaggguaaugucuaa

SEQ ID NO: 345186 - RNA, 19 nt, Homo sapiens
gagagauuuagauaagaga

SEQ ID NO: 345187 - RNA, 19 nt, Homo sapiens
cugaaaauauucccugaga

SEQ ID NO: 345188 - RNA, 19 nt, Homo sapiens
cagaaauaugguuacauug

SEQ ID NO: 345189 - RNA, 19 nt, Homo sapiens
uuccaccuauucucugaaa

SEQ ID NO: 345190 - RNA, 19 nt, Homo sapiens
guguauaauccaagacaga

SEQ ID NO: 345191 - RNA, 19 nt, Homo sapiens
gcacugguaccaaaauugu

SEQ ID NO: 345192 - RNA, 19 nt, Homo sapiens
ggguaaugucuaauguauu

SEQ ID NO: 345193 - RNA, 19 nt, Homo sapiens
uaugcccucuauccuauca

SEQ ID NO: 345194 - RNA, 19 nt, Homo sapiens
ucaacacagcccaaggauu

SEQ ID NO: 345195 - RNA, 19 nt, Homo sapiens
agccaaaucucuggacaag

SEQ ID NO: 345196 - RNA, 19 nt, Homo sapiens
cuucacagaacuacagaga

SEQ ID NO: 345197 - RNA, 19 nt, Homo sapiens
gaaggucaauuacaacuuu

SEQ ID NO: 345198 - RNA, 19 nt, Homo sapiens
gaaauuaacucagacacaa

SEQ ID NO: 345199 - RNA, 19 nt, Homo sapiens
caaccuggauaaugaguua

SEQ ID NO: 345200 - RNA, 19 nt, Homo sapiens
gaagguggcuacaaagaug

SEQ ID NO: 345201 - RNA, 19 nt, Homo sapiens
gugcugagcuucucucuga

SEQ ID NO: 345202 - RNA, 19 nt, Homo sapiens
ccaccaaacuaaaggauuu

SEQ ID NO: 345203 - RNA, 19 nt, Homo sapiens
gagaagcuguguaucuauu

SEQ ID NO: 345204 - RNA, 19 nt, Homo sapiens
ggacaaagaagcaaagguu

SEQ ID NO: 345205 - RNA, 19 nt, Homo sapiens
gcuagacaguucuuuguuu

SEQ ID NO: 345206 - RNA, 19 nt, Homo sapiens
aaaggaaacugaagccaaa

SEQ ID NO: 345207 - RNA, 19 nt, Homo sapiens
caaagagugugaaaggaaa

SEQ ID NO: 345208 - RNA, 19 nt, Homo sapiens
ucacugaacuccagcagaa

SEQ ID NO: 345209 - RNA, 19 nt, Homo sapiens
ggaguggagugccggauuu

SEQ ID NO: 345210 - RNA, 19 nt, Homo sapiens
gggauaagcugaaguucug

SEQ ID NO: 345211 - RNA, 19 nt, Homo sapiens
gauuugauccucuugauaa

SEQ ID NO: 345212 - RNA, 19 nt, Homo sapiens
ccaccagguucuuucuuua

SEQ ID NO: 345213 - RNA, 19 nt, Homo sapiens
gaaguuucauccgcaaauu

SEQ ID NO: 345214 - RNA, 19 nt, Homo sapiens
gugaggaaguuucuacuga

SEQ ID NO: 345215 - RNA, 19 nt, Homo sapiens
caacuuugauacuuacuca

SEQ ID NO: 345216 - RNA, 19 nt, Homo sapiens
gcucauugaucuguauaaa

SEQ ID NO: 345217 - RNA, 19 nt, Homo sapiens
gaacaggggugcagaaaag

SEQ ID NO: 345218 - RNA, 19 nt, Homo sapiens
caacgugacauccucgaua

SEQ ID NO: 345219 - RNA, 19 nt, Homo sapiens
ucaaggaaauccaugaaca

SEQ ID NO: 345220 - RNA, 19 nt, Homo sapiens
ggugagaacccuugcacua

SEQ ID NO: 345221 - RNA, 19 nt, Homo sapiens
ccuccuaccuaccaagaua

SEQ ID NO: 345222 - RNA, 19 nt, Homo sapiens
gacaaagaagcaaagguua

SEQ ID NO: 345223 - RNA, 19 nt, Homo sapiens
caacaaaugcuuccuagag

SEQ ID NO: 345224 - RNA, 19 nt, Homo sapiens
ucuauuggauggucaacua

SEQ ID NO: 345225 - RNA, 19 nt, Homo sapiens
caccagauaucuccucaga

SEQ ID NO: 345226 - RNA, 19 nt, Homo sapiens
gcuguuaauuugaguacuu

SEQ ID NO: 345227 - RNA, 19 nt, Homo sapiens
ucacaguccugcagcgaaa

SEQ ID NO: 345228 - RNA, 19 nt, Homo sapiens
gaaaacugcuuccgacaau

SEQ ID NO: 345229 - RNA, 19 nt, Homo sapiens
uaaugugaguggagauaaa

SEQ ID NO: 345230 - RNA, 19 nt, Homo sapiens
guacaaagagugugaaagg

SEQ ID NO: 345231 - RNA, 19 nt, Homo sapiens
ccaaaguccucaacgaaag

SEQ ID NO: 345232 - RNA, 19 nt, Homo sapiens
gauggucaacuacaacuuu

SEQ ID NO: 345233 - RNA, 19 nt, Homo sapiens
cuagacaguucuuuguuug

SEQ ID NO: 345234 - RNA, 19 nt, Homo sapiens
aagcaggauucucaacuuu

SEQ ID NO: 345235 - RNA, 19 nt, Homo sapiens
guagcaaccugaaauuaac

SEQ ID NO: 345236 - RNA, 19 nt, Homo sapiens
gugaagcacugguacaaag

SEQ ID NO: 345237 - RNA, 19 nt, Homo sapiens
cagccaagauccagauugu

SEQ ID NO: 345238 - RNA, 19 nt, Homo sapiens
ccaaaagucuucacauguu

SEQ ID NO: 345239 - RNA, 19 nt, Homo sapiens
caggccaccuucuggauaa

SEQ ID NO: 345240 - RNA, 19 nt, Homo sapiens
ugaguuaccugcaccaucu

SEQ ID NO: 345241 - RNA, 19 nt, Homo sapiens
caacuacaacuuugaagau

SEQ ID NO: 345242 - RNA, 19 nt, Homo sapiens
gaggcucucuugugcaugu

SEQ ID NO: 345243 - RNA, 19 nt, Homo sapiens
ucuggaaggucaauuacaa

SEQ ID NO: 345244 - RNA, 19 nt, Homo sapiens
uggauaaguucaucaagga

SEQ ID NO: 345245 - RNA, 19 nt, Homo sapiens
gauaaaauaugcuggcaau

SEQ ID NO: 345246 - RNA, 19 nt, Homo sapiens
gaagcuggguugguuuauc

SEQ ID NO: 345247 - RNA, 19 nt, Homo sapiens
gaugguacccuuguccuuu

SEQ ID NO: 345248 - RNA, 19 nt, Homo sapiens
aaagcaggauucucaacuu

SEQ ID NO: 345249 - RNA, 19 nt, Homo sapiens
aggagaagcuguguaucua

SEQ ID NO: 345250 - RNA, 19 nt, Homo sapiens
gaagcaaagguuagguuau

SEQ ID NO: 345251 - RNA, 19 nt, Homo sapiens
gaucucgucguguuccaua

SEQ ID NO: 345252 - RNA, 19 nt, Homo sapiens
ugagaacccuugcacuaca

SEQ ID NO: 345253 - RNA, 19 nt, Homo sapiens
uguagcaaccugaaauuaa

SEQ ID NO: 345254 - RNA, 19 nt, Homo sapiens
guugguuuauccaggaaua

SEQ ID NO: 345255 - RNA, 19 nt, Homo sapiens
cucuuuagcuguuaauuug

SEQ ID NO: 345256 - RNA, 19 nt, Homo sapiens
aagcaaagguuagguuauc

SEQ ID NO: 345257 - RNA, 19 nt, Homo sapiens
cagaagcuggguugguuua

SEQ ID NO: 345258 - RNA, 19 nt, Homo sapiens
gaagcuguguaucuauugg

SEQ ID NO: 345259 - RNA, 19 nt, Homo sapiens
ccauccagguguucacaaa

SEQ ID NO: 345260 - RNA, 19 nt, Homo sapiens
uaacaucauccguacauuc

SEQ ID NO: 345261 - RNA, 19 nt, Homo sapiens
aagcugaaguucugucugu

SEQ ID NO: 345262 - RNA, 19 nt, Homo sapiens
gaugagaccgugaggaagu

SEQ ID NO: 345263 - RNA, 19 nt, Homo sapiens
cucccaaccuggauaauga

SEQ ID NO: 345264 - RNA, 19 nt, Homo sapiens
aacgugacauccucgauaa

SEQ ID NO: 345265 - RNA, 19 nt, Homo sapiens
ccugauauauccaccagau

SEQ ID NO: 345266 - RNA, 19 nt, Homo sapiens
ggucaagaacacagugauu

SEQ ID NO: 345267 - RNA, 19 nt, Homo sapiens
cuucacauguucaaacguu

SEQ ID NO: 345268 - RNA, 19 nt, Homo sapiens
ccagauucaugcacuguag

SEQ ID NO: 345269 - RNA, 19 nt, Homo sapiens
acaaagagugugaaaggaa

SEQ ID NO: 345270 - RNA, 19 nt, Homo sapiens
ggagaagcuguguaucuau

SEQ ID NO: 345271 - RNA, 19 nt, Homo sapiens
gaggcguugucuggaaaua

SEQ ID NO: 345272 - RNA, 19 nt, Homo sapiens
agaagcaaagguuagguua

SEQ ID NO: 345273 - RNA, 19 nt, Homo sapiens
agaggcaacuccgauggua

SEQ ID NO: 345274 - RNA, 19 nt, Homo sapiens
gcuuugagccucccaagug

SEQ ID NO: 345275 - RNA, 19 nt, Homo sapiens
caucauccguacauuccuu

SEQ ID NO: 345276 - RNA, 19 nt, Homo sapiens
ccagauggcagguuugcaa

SEQ ID NO: 345277 - RNA, 19 nt, Homo sapiens
guuggcaucuucuggacaa

SEQ ID NO: 345278 - RNA, 19 nt, Homo sapiens
gagcuucucucugaaaucc

SEQ ID NO: 345279 - RNA, 19 nt, Homo sapiens
guacaugccacccaguugu

SEQ ID NO: 345280 - RNA, 19 nt, Homo sapiens
cagcauguguggccuguac

SEQ ID NO: 345281 - RNA, 19 nt, Homo sapiens
gucaagaacacagugauuu

SEQ ID NO: 345282 - RNA, 19 nt, Homo sapiens
auaaagcacuggcaucaac

SEQ ID NO: 345283 - RNA, 19 nt, Homo sapiens
agacaguucuuuguuugga

SEQ ID NO: 345284 - RNA, 19 nt, Homo sapiens
uccaccagguucuuucuuu

SEQ ID NO: 345285 - RNA, 19 nt, Homo sapiens
acuugaagguggcuacaaa

SEQ ID NO: 345286 - RNA, 19 nt, Homo sapiens
aaagauacccaaaggucaa

SEQ ID NO: 345287 - RNA, 19 nt, Homo sapiens
ggaaggucaauuacaacuu

SEQ ID NO: 345288 - RNA, 19 nt, Homo sapiens
gagcuggucacacaauauc

SEQ ID NO: 345289 - RNA, 19 nt, Homo sapiens
gcacugggucagcugaguu

SEQ ID NO: 345290 - RNA, 19 nt, Homo sapiens
gaaggaggaggagcuugaa

SEQ ID NO: 345291 - RNA, 19 nt, Homo sapiens
gaucaaaugccaggagaag

SEQ ID NO: 345292 - RNA, 19 nt, Homo sapiens
acauugggcuagacaguuc

SEQ ID NO: 345293 - RNA, 19 nt, Homo sapiens
caccagguucuuucuuuaa

SEQ ID NO: 345294 - RNA, 19 nt, Homo sapiens
caagaacacagugauuuua

SEQ ID NO: 345295 - RNA, 19 nt, Homo sapiens
gaagcccuacgaagaaugu

SEQ ID NO: 345296 - RNA, 19 nt, Homo sapiens
ccucuuuagcuguuaauuu

SEQ ID NO: 345297 - RNA, 19 nt, Homo sapiens
gaaggucaauuacaacuuu

SEQ ID NO: 345298 - RNA, 19 nt, Homo sapiens
caaccuggauaaugaguua

SEQ ID NO: 345299 - RNA, 19 nt, Homo sapiens
gcauauaccaguugugaua

SEQ ID NO: 345300 - RNA, 19 nt, Homo sapiens
gugcugagcuucucucuga

SEQ ID NO: 345301 - RNA, 19 nt, Homo sapiens
ccaccaaacuaaaggauuu

SEQ ID NO: 345302 - RNA, 19 nt, Homo sapiens
gagaagcuguguaucuauu

SEQ ID NO: 345303 - RNA, 19 nt, Homo sapiens
ggacaaagaagcaaagguu

SEQ ID NO: 345304 - RNA, 19 nt, Homo sapiens
aaaggaaacugaagccaaa

SEQ ID NO: 345305 - RNA, 19 nt, Homo sapiens
caaagagugugaaaggaaa

SEQ ID NO: 345306 - RNA, 19 nt, Homo sapiens
ucacugaacuccagcagaa

SEQ ID NO: 345307 - RNA, 19 nt, Homo sapiens
ggaguggagugccggauuu

SEQ ID NO: 345308 - RNA, 19 nt, Homo sapiens
gccauagaauccugaauaa

SEQ ID NO: 345309 - RNA, 19 nt, Homo sapiens
gggauaagcugaaguucug

SEQ ID NO: 345310 - RNA, 19 nt, Homo sapiens
gauuugauccucuugauaa

SEQ ID NO: 345311 - RNA, 19 nt, Homo sapiens
ccaauuagcuccuccuuuu

SEQ ID NO: 345312 - RNA, 19 nt, Homo sapiens
ggaguauccucuugccaaa

SEQ ID NO: 345313 - RNA, 19 nt, Homo sapiens
gugaggaaguuucuacuga

SEQ ID NO: 345314 - RNA, 19 nt, Homo sapiens
ggccaacccuuucauuaga

SEQ ID NO: 345315 - RNA, 19 nt, Homo sapiens
gcucauugaucuguauaaa

SEQ ID NO: 345316 - RNA, 19 nt, Homo sapiens
gaacaggggugcagaaaag

SEQ ID NO: 345317 - RNA, 19 nt, Homo sapiens
aaagauacuugaaggucua

SEQ ID NO: 345318 - RNA, 19 nt, Homo sapiens
caacgugacauccucgaua

SEQ ID NO: 345319 - RNA, 19 nt, Homo sapiens
uccaaaggcucagauuaua

SEQ ID NO: 345320 - RNA, 19 nt, Homo sapiens
ucaaggaaauccaugaaca

SEQ ID NO: 345321 - RNA, 19 nt, Homo sapiens
gaacuucaagcucuccaaa

SEQ ID NO: 345322 - RNA, 19 nt, Homo sapiens
gacaaagaagcaaagguua

SEQ ID NO: 345323 - RNA, 19 nt, Homo sapiens
caacaaaugcuuccuagag

SEQ ID NO: 345324 - RNA, 19 nt, Homo sapiens
ucuauuggauggucaacua

SEQ ID NO: 345325 - RNA, 19 nt, Homo sapiens
ucacaguccugcagcgaaa

SEQ ID NO: 345326 - RNA, 19 nt, Homo sapiens
gaaaacugcuuccgacaau

SEQ ID NO: 345327 - RNA, 19 nt, Homo sapiens
uaaugugaguggagauaaa

SEQ ID NO: 345328 - RNA, 19 nt, Homo sapiens
auaugaggcuguugucuuu

SEQ ID NO: 345329 - RNA, 19 nt, Homo sapiens
guacaaagagugugaaagg

SEQ ID NO: 345330 - RNA, 19 nt, Homo sapiens
ccaaaguccucaacgaaag

SEQ ID NO: 345331 - RNA, 19 nt, Homo sapiens
gauggucaacuacaacuuu

SEQ ID NO: 345332 - RNA, 19 nt, Homo sapiens
ccaaaggcucagauuauaa

SEQ ID NO: 345333 - RNA, 19 nt, Homo sapiens
ucacucacauccauucuuc

SEQ ID NO: 345334 - RNA, 19 nt, Homo sapiens
acacagacauccucuaugc

SEQ ID NO: 345335 - RNA, 19 nt, Homo sapiens
gugaagcacugguacaaag

SEQ ID NO: 345336 - RNA, 19 nt, Homo sapiens
cagccaagauccagauugu

SEQ ID NO: 345337 - RNA, 19 nt, Homo sapiens
ggaauccucugugucuuca

SEQ ID NO: 345338 - RNA, 19 nt, Homo sapiens
ggaaagugccgacaaugca

SEQ ID NO: 345339 - RNA, 19 nt, Homo sapiens
caggccaccuucuggauaa

SEQ ID NO: 345340 - RNA, 19 nt, Homo sapiens
ugaguuaccugcaccaucu

SEQ ID NO: 345341 - RNA, 19 nt, Homo sapiens
caacuacaacuuugaagau

SEQ ID NO: 345342 - RNA, 19 nt, Homo sapiens
cugcaaacccuuucauaaa

SEQ ID NO: 345343 - RNA, 19 nt, Homo sapiens
gaagcuggguugguuuauc

SEQ ID NO: 345344 - RNA, 19 nt, Homo sapiens
ucuggaaggucaauuacaa

SEQ ID NO: 345345 - RNA, 19 nt, Homo sapiens
uggauaaguucaucaagga

SEQ ID NO: 345346 - RNA, 19 nt, Homo sapiens
gauaaaauaugcuggcaau

SEQ ID NO: 345347 - RNA, 19 nt, Homo sapiens
gaugguacccuuguccuuu

SEQ ID NO: 345348 - RNA, 19 nt, Homo sapiens
gcucagauuauaacuguug

SEQ ID NO: 345349 - RNA, 19 nt, Homo sapiens
aggagaagcuguguaucua

SEQ ID NO: 345350 - RNA, 19 nt, Homo sapiens
gaaggucuaggugcuuuaa

SEQ ID NO: 345351 - RNA, 19 nt, Homo sapiens
gaagcaaagguuagguuau

SEQ ID NO: 345352 - RNA, 19 nt, Homo sapiens
gaucucgucguguuccaua

SEQ ID NO: 345353 - RNA, 19 nt, Homo sapiens
ccaggaaguuguggagcua

SEQ ID NO: 345354 - RNA, 19 nt, Homo sapiens
guugguuuauccaggaaua

SEQ ID NO: 345355 - RNA, 19 nt, Homo sapiens
caggccaacccuuucauua

SEQ ID NO: 345356 - RNA, 19 nt, Homo sapiens
aagcaaagguuagguuauc

SEQ ID NO: 345357 - RNA, 19 nt, Homo sapiens
gaagcuguguaucuauugg

SEQ ID NO: 345358 - RNA, 19 nt, Homo sapiens
ccauccagguguucacaaa

SEQ ID NO: 345359 - RNA, 19 nt, Homo sapiens
cagaagcuggguugguuua

SEQ ID NO: 345360 - RNA, 19 nt, Homo sapiens
ugacacagacauccucuau

SEQ ID NO: 345361 - RNA, 19 nt, Homo sapiens
uaacaucauccguacauuc

SEQ ID NO: 345362 - RNA, 19 nt, Homo sapiens
aagcugaaguucugucugu

SEQ ID NO: 345363 - RNA, 19 nt, Homo sapiens
gccaacccuuucauuagaa

SEQ ID NO: 345364 - RNA, 19 nt, Homo sapiens
gaugagaccgugaggaagu

SEQ ID NO: 345365 - RNA, 19 nt, Homo sapiens
cucccaaccuggauaauga

SEQ ID NO: 345366 - RNA, 19 nt, Homo sapiens
aacgugacauccucgauaa

SEQ ID NO: 345367 - RNA, 19 nt, Homo sapiens
gcagccaggccaacccuuu

SEQ ID NO: 345368 - RNA, 19 nt, Homo sapiens
gcagacaccaggaaguugu

SEQ ID NO: 345369 - RNA, 19 nt, Homo sapiens
acaaagagugugaaaggaa

SEQ ID NO: 345370 - RNA, 19 nt, Homo sapiens
ggagaagcuguguaucuau

SEQ ID NO: 345371 - RNA, 19 nt, Homo sapiens
cuucugagccugccuuuau

SEQ ID NO: 345372 - RNA, 19 nt, Homo sapiens
agaagcaaagguuagguua

SEQ ID NO: 345373 - RNA, 19 nt, Homo sapiens
gcuuugagccucccaagug

SEQ ID NO: 345374 - RNA, 19 nt, Homo sapiens
caucauccguacauuccuu

SEQ ID NO: 345375 - RNA, 19 nt, Homo sapiens
agaggcaacuccgauggua

SEQ ID NO: 345376 - RNA, 19 nt, Homo sapiens
cacauacccucacuuaaac

SEQ ID NO: 345377 - RNA, 19 nt, Homo sapiens
guuggcaucuucuggacaa

SEQ ID NO: 345378 - RNA, 19 nt, Homo sapiens
gagcuucucucugaaaucc

SEQ ID NO: 345379 - RNA, 19 nt, Homo sapiens
aggcucagauuauaacugu

SEQ ID NO: 345380 - RNA, 19 nt, Homo sapiens
agccauagaauccugaaua

SEQ ID NO: 345381 - RNA, 19 nt, Homo sapiens
auaaagcacuggcaucaac

SEQ ID NO: 345382 - RNA, 19 nt, Homo sapiens
aauccucugugucuucaaa

SEQ ID NO: 345383 - RNA, 19 nt, Homo sapiens
ucuuauuucugucaacuug

SEQ ID NO: 345384 - RNA, 19 nt, Homo sapiens
ggaaggucaauuacaacuu

SEQ ID NO: 345385 - RNA, 19 nt, Homo sapiens
gagcuggucacacaauauc

SEQ ID NO: 345386 - RNA, 19 nt, Homo sapiens
gcacugggucagcugaguu

SEQ ID NO: 345387 - RNA, 19 nt, Homo sapiens
gaaggaggaggagcuugaa

SEQ ID NO: 345388 - RNA, 19 nt, Homo sapiens
gaucaaaugccaggagaag

SEQ ID NO: 345389 - RNA, 19 nt, Homo sapiens
caaaggcucagauuauaac

SEQ ID NO: 345390 - RNA, 19 nt, Homo sapiens
ucucggugcuuccaacuca

SEQ ID NO: 345391 - RNA, 19 nt, Homo sapiens
uggagcuggucacacaaua

SEQ ID NO: 345392 - RNA, 19 nt, Homo sapiens
gcacaaaaucgucaaggaa

SEQ ID NO: 345393 - RNA, 19 nt, Homo sapiens
gaagcccuacgaagaaugu

SEQ ID NO: 345394 - RNA, 19 nt, Homo sapiens
gacccaaccaauaauguga

SEQ ID NO: 345395 - RNA, 19 nt, Homo sapiens
ucacuuuaugugcaucuua

SEQ ID NO: 345396 - RNA, 19 nt, Homo sapiens
gacugcaaacccuuucaua

SEQ ID NO: 345397 - RNA, 19 nt, Homo sapiens
caaauuagcucacaucuuu

SEQ ID NO: 345398 - RNA, 19 nt, Homo sapiens
caaaauggcuccagaauua

SEQ ID NO: 345399 - RNA, 19 nt, Homo sapiens
ggaaagacuugacugcaua

SEQ ID NO: 345400 - RNA, 19 nt, Homo sapiens
caagugccaugauugauua

SEQ ID NO: 345401 - RNA, 19 nt, Homo sapiens
gcgcagagauccuugauga

SEQ ID NO: 345402 - RNA, 19 nt, Homo sapiens
ggaaggaguucguagagaa

SEQ ID NO: 345403 - RNA, 19 nt, Homo sapiens
gaaggugcuugcagguuua

SEQ ID NO: 345404 - RNA, 19 nt, Homo sapiens
ccagauaaguugacgcuaa

SEQ ID NO: 345405 - RNA, 19 nt, Homo sapiens
gcauggcgcugguacguaa

SEQ ID NO: 345406 - RNA, 19 nt, Homo sapiens
ggaaggaacaggaaacaaa

SEQ ID NO: 345407 - RNA, 19 nt, Homo sapiens
ccaauuagcugagaagaau

SEQ ID NO: 345408 - RNA, 19 nt, Homo sapiens
gugcagagauccucaguga

SEQ ID NO: 345409 - RNA, 19 nt, Homo sapiens
guccagaacugaauccuaa

SEQ ID NO: 345410 - RNA, 19 nt, Homo sapiens
gcaguuagguggcucuuuc

SEQ ID NO: 345411 - RNA, 19 nt, Homo sapiens
gauccagacuccaugguuu

SEQ ID NO: 345412 - RNA, 19 nt, Homo sapiens
caaagaaauuggugugugu

SEQ ID NO: 345413 - RNA, 19 nt, Homo sapiens
aaacuuaccugcuaggaau

SEQ ID NO: 345414 - RNA, 19 nt, Homo sapiens
ucacagagcugcggaggaa

SEQ ID NO: 345415 - RNA, 19 nt, Homo sapiens
gcauaaagaugucaguucu

SEQ ID NO: 345416 - RNA, 19 nt, Homo sapiens
agacuugacugcauaaaga

SEQ ID NO: 345417 - RNA, 19 nt, Homo sapiens
gaacugaauccuaagaaau

SEQ ID NO: 345418 - RNA, 19 nt, Homo sapiens
guacguaaauagaccaaug

SEQ ID NO: 345419 - RNA, 19 nt, Homo sapiens
gaggacagggcuucuaaua

SEQ ID NO: 345420 - RNA, 19 nt, Homo sapiens
ggaaaguggugguacaagu

SEQ ID NO: 345421 - RNA, 19 nt, Homo sapiens
gaaaacugcuuccggaauu

SEQ ID NO: 345422 - RNA, 19 nt, Homo sapiens
ugaagccucugauacuuaa

SEQ ID NO: 345423 - RNA, 19 nt, Homo sapiens
gaggagggcuugcucaucu

SEQ ID NO: 345424 - RNA, 19 nt, Homo sapiens
caacucaggugcaugauac

SEQ ID NO: 345425 - RNA, 19 nt, Homo sapiens
gaccugcucugccaaguug

SEQ ID NO: 345426 - RNA, 19 nt, Homo sapiens
ggacagggcuucuaauacc

SEQ ID NO: 345427 - RNA, 19 nt, Homo sapiens
ugagagagauuguguacau

SEQ ID NO: 345428 - RNA, 19 nt, Homo sapiens
caacgggacuucaucaucu

SEQ ID NO: 345429 - RNA, 19 nt, Homo sapiens
cagauaaguugacgcuaaa

SEQ ID NO: 345430 - RNA, 19 nt, Homo sapiens
gaaaggaagccacugaaca

SEQ ID NO: 345431 - RNA, 19 nt, Homo sapiens
ggaauucucccaucaaagu

SEQ ID NO: 345432 - RNA, 19 nt, Homo sapiens
aagggaagcuccucugauu

SEQ ID NO: 345433 - RNA, 19 nt, Homo sapiens
agacauguaugauugaaug

SEQ ID NO: 345434 - RNA, 19 nt, Homo sapiens
gcagagauccuugaugaga

SEQ ID NO: 345435 - RNA, 19 nt, Homo sapiens
ggccaccacuggacuauug

SEQ ID NO: 345436 - RNA, 19 nt, Homo sapiens
guacaagugccaugauuga

SEQ ID NO: 345437 - RNA, 19 nt, Homo sapiens
caucagcaccuguguguuu

SEQ ID NO: 345438 - RNA, 19 nt, Homo sapiens
agaaagcacucuaggaauc

SEQ ID NO: 345439 - RNA, 19 nt, Homo sapiens
cauauuggcuuacuuuguc

SEQ ID NO: 345440 - RNA, 19 nt, Homo sapiens
agaaggugcuugcagguuu

SEQ ID NO: 345441 - RNA, 19 nt, Homo sapiens
gcaguucgaggucaaguuu

SEQ ID NO: 345442 - RNA, 19 nt, Homo sapiens
gcucaguucuggcaccaaa

SEQ ID NO: 345443 - RNA, 19 nt, Homo sapiens
gcaauugaaagcuaaguga

SEQ ID NO: 345444 - RNA, 19 nt, Homo sapiens
ggccuagucuuagccaaua

SEQ ID NO: 345445 - RNA, 19 nt, Homo sapiens
gagcaacucaggugcauga

SEQ ID NO: 345446 - RNA, 19 nt, Homo sapiens
ggaccagaguguggacuuu

SEQ ID NO: 345447 - RNA, 19 nt, Homo sapiens
gauggaaccagauaaguug

SEQ ID NO: 345448 - RNA, 19 nt, Homo sapiens
ggucaaggguggcucuuca

SEQ ID NO: 345449 - RNA, 19 nt, Homo sapiens
ggaggaacuucaugaacau

SEQ ID NO: 345450 - RNA, 19 nt, Homo sapiens
ggaggaacuuugugaacau

SEQ ID NO: 345451 - RNA, 19 nt, Homo sapiens
ucuaauaccugugccauau

SEQ ID NO: 345452 - RNA, 19 nt, Homo sapiens
ggagagaggugagcaacca

SEQ ID NO: 345453 - RNA, 19 nt, Homo sapiens
gaacaggaaacaaagaaag

SEQ ID NO: 345454 - RNA, 19 nt, Homo sapiens
aaacuggagucgagaccua

SEQ ID NO: 345455 - RNA, 19 nt, Homo sapiens
aaucagcaauugaaagcua

SEQ ID NO: 345456 - RNA, 19 nt, Homo sapiens
ucugagacauguaugauug

SEQ ID NO: 345457 - RNA, 19 nt, Homo sapiens
gaccacccaugcuuucuga

SEQ ID NO: 345458 - RNA, 19 nt, Homo sapiens
cagagaaagugaagaccaa

SEQ ID NO: 345459 - RNA, 19 nt, Homo sapiens
gaaagacuugacugcauaa

SEQ ID NO: 345460 - RNA, 19 nt, Homo sapiens
caucgauacugccugguaa

SEQ ID NO: 345461 - RNA, 19 nt, Homo sapiens
ucccauggcuuacacacua

SEQ ID NO: 345462 - RNA, 19 nt, Homo sapiens
gauaccaucuguucauuuu

SEQ ID NO: 345463 - RNA, 19 nt, Homo sapiens
ggauggcugugauguugaa

SEQ ID NO: 345464 - RNA, 19 nt, Homo sapiens
guguguguguguuuaauuu

SEQ ID NO: 345465 - RNA, 19 nt, Homo sapiens
gaaauuggugugugugugu

SEQ ID NO: 345466 - RNA, 19 nt, Homo sapiens
ccucugagcucgguugcua

SEQ ID NO: 345467 - RNA, 19 nt, Homo sapiens
gaaaguggugguacaagug

SEQ ID NO: 345468 - RNA, 19 nt, Homo sapiens
gaacaaggccguugauacc

SEQ ID NO: 345469 - RNA, 19 nt, Homo sapiens
ugacauccguagaucuuga

SEQ ID NO: 345470 - RNA, 19 nt, Homo sapiens
gaacagggguguauuucau

SEQ ID NO: 345471 - RNA, 19 nt, Homo sapiens
gcaacucaggugcaugaua

SEQ ID NO: 345472 - RNA, 19 nt, Homo sapiens
ccuguucucugccgucuuu

SEQ ID NO: 345473 - RNA, 19 nt, Homo sapiens
cagccugacucuccacaaa

SEQ ID NO: 345474 - RNA, 19 nt, Homo sapiens
gaucccaccucccuuucuu

SEQ ID NO: 345475 - RNA, 19 nt, Homo sapiens
gcaugcccauauuggcuua

SEQ ID NO: 345476 - RNA, 19 nt, Homo sapiens
cggaggaacuucaugaaca

SEQ ID NO: 345477 - RNA, 19 nt, Homo sapiens
cacaaggccucaagaguca

SEQ ID NO: 345478 - RNA, 19 nt, Homo sapiens
ccacuggacuauugguuuc

SEQ ID NO: 345479 - RNA, 19 nt, Homo sapiens
agugaaggcugcuguguga

SEQ ID NO: 345480 - RNA, 19 nt, Homo sapiens
gaggaacuuugugaacauu

SEQ ID NO: 345481 - RNA, 19 nt, Homo sapiens
agaacugaauccuaagaaa

SEQ ID NO: 345482 - RNA, 19 nt, Homo sapiens
acagaaagcacucuaggaa

SEQ ID NO: 345483 - RNA, 19 nt, Homo sapiens
cuaauuggaugccucuuca

SEQ ID NO: 345484 - RNA, 19 nt, Homo sapiens
uaaauagaccaaugcaguu

SEQ ID NO: 345485 - RNA, 19 nt, Homo sapiens
gggaagcuccucugauuca

SEQ ID NO: 345486 - RNA, 19 nt, Homo sapiens
cuaggaaucuuaggcagaa

SEQ ID NO: 345487 - RNA, 19 nt, Homo sapiens
caguuugccuuccugaauu

SEQ ID NO: 345488 - RNA, 19 nt, Homo sapiens
caggagagcaugcccauau

SEQ ID NO: 345489 - RNA, 19 nt, Homo sapiens
gcugagaagaauuaucuaa

SEQ ID NO: 345490 - RNA, 19 nt, Homo sapiens
gaaggaacaggaaacaaag

SEQ ID NO: 345491 - RNA, 19 nt, Homo sapiens
cagccacagucauuuggua

SEQ ID NO: 345492 - RNA, 19 nt, Homo sapiens
ucucugcccaugcaaauua

SEQ ID NO: 345493 - RNA, 19 nt, Homo sapiens
ccaccucccuuucuuagca

SEQ ID NO: 345494 - RNA, 19 nt, Homo sapiens
gcaaauuagcucacaucuu

SEQ ID NO: 345495 - RNA, 19 nt, Homo sapiens
gcccagcucucaagucuac

SEQ ID NO: 345496 - RNA, 19 nt, Homo sapiens
gugcagcccugggauguga

SEQ ID NO: 345497 - RNA, 19 nt, Homo sapiens
gcagacaaauugggcauua

SEQ ID NO: 345498 - RNA, 19 nt, Homo sapiens
guagauggcuggcuguuga

SEQ ID NO: 345499 - RNA, 19 nt, Homo sapiens
uaaaucaaguccuucagua

SEQ ID NO: 345500 - RNA, 19 nt, Homo sapiens
ccacagacccaaccaguua

SEQ ID NO: 345501 - RNA, 19 nt, Homo sapiens
uaacguacuuggugaauau

SEQ ID NO: 345502 - RNA, 19 nt, Homo sapiens
uaggaaggauuaaugguua

SEQ ID NO: 345503 - RNA, 19 nt, Homo sapiens
gcacacaacuaccauccuu

SEQ ID NO: 345504 - RNA, 19 nt, Homo sapiens
cuacaucuguugcaacuaa

SEQ ID NO: 345505 - RNA, 19 nt, Homo sapiens
gagaguccauugaaauuau

SEQ ID NO: 345506 - RNA, 19 nt, Homo sapiens
gaaagggaauauaaguaug

SEQ ID NO: 345507 - RNA, 19 nt, Homo sapiens
ccacaaaguucuuccuaug

SEQ ID NO: 345508 - RNA, 19 nt, Homo sapiens
gcaccagguucucuuuauu

SEQ ID NO: 345509 - RNA, 19 nt, Homo sapiens
guaauggcaucuauauuca

SEQ ID NO: 345510 - RNA, 19 nt, Homo sapiens
gaacaacguuuaugaaccu

SEQ ID NO: 345511 - RNA, 19 nt, Homo sapiens
gaaggugugucuacgacuu

SEQ ID NO: 345512 - RNA, 19 nt, Homo sapiens
gguaggacguugucugcua

SEQ ID NO: 345513 - RNA, 19 nt, Homo sapiens
gcagagguuugcuguacuu

SEQ ID NO: 345514 - RNA, 19 nt, Homo sapiens
ggugaaaugcaucuauaua

SEQ ID NO: 345515 - RNA, 19 nt, Homo sapiens
gacaucaugcugaccauua

SEQ ID NO: 345516 - RNA, 19 nt, Homo sapiens
gagacugccuguaaacuag

SEQ ID NO: 345517 - RNA, 19 nt, Homo sapiens
acaaaguucuuccuaugaa

SEQ ID NO: 345518 - RNA, 19 nt, Homo sapiens
aaaguuaucucuggguauu

SEQ ID NO: 345519 - RNA, 19 nt, Homo sapiens
cauaaaaggcuucaucuua

SEQ ID NO: 345520 - RNA, 19 nt, Homo sapiens
caaauugggcauuaucuug

SEQ ID NO: 345521 - RNA, 19 nt, Homo sapiens
gauauaguccuccuuggaa

SEQ ID NO: 345522 - RNA, 19 nt, Homo sapiens
cgacaucauucccuauaau

SEQ ID NO: 345523 - RNA, 19 nt, Homo sapiens
gcacauuccacucccauga

SEQ ID NO: 345524 - RNA, 19 nt, Homo sapiens
guggacaaauugaccuuaa

SEQ ID NO: 345525 - RNA, 19 nt, Homo sapiens
acacaacuaccauccuuua

SEQ ID NO: 345526 - RNA, 19 nt, Homo sapiens
aaggugaaaugcaucuaua

SEQ ID NO: 345527 - RNA, 19 nt, Homo sapiens
caaauugaccuuaacaucu

SEQ ID NO: 345528 - RNA, 19 nt, Homo sapiens
agagucaaguggacaaauu

SEQ ID NO: 345529 - RNA, 19 nt, Homo sapiens
gagguuugcuguacuuagu

SEQ ID NO: 345530 - RNA, 19 nt, Homo sapiens
aaucaaguccuucaguaua

SEQ ID NO: 345531 - RNA, 19 nt, Homo sapiens
acagacagccucuaaauca

SEQ ID NO: 345532 - RNA, 19 nt, Homo sapiens
gugcauguguacuuccuaa

SEQ ID NO: 345533 - RNA, 19 nt, Homo sapiens
caccaggguuguauucuau

SEQ ID NO: 345534 - RNA, 19 nt, Homo sapiens
gaaccugccguuugcuuug

SEQ ID NO: 345535 - RNA, 19 nt, Homo sapiens
gaagaaaaccuugcugaaa

SEQ ID NO: 345536 - RNA, 19 nt, Homo sapiens
cgagaguccauugaaauua

SEQ ID NO: 345537 - RNA, 19 nt, Homo sapiens
guaggacguugucugcuau

SEQ ID NO: 345538 - RNA, 19 nt, Homo sapiens
acaccaggguuguauucua

SEQ ID NO: 345539 - RNA, 19 nt, Homo sapiens
aagaaaaccuugcugaaaa

SEQ ID NO: 345540 - RNA, 19 nt, Homo sapiens
caaaguucuuccuaugaau

SEQ ID NO: 345541 - RNA, 19 nt, Homo sapiens
uauaauuuccucacuggua

SEQ ID NO: 345542 - RNA, 19 nt, Homo sapiens
gcugucagaucugugguuu

SEQ ID NO: 345543 - RNA, 19 nt, Homo sapiens
gaccauuuaugccgggauu

SEQ ID NO: 345544 - RNA, 19 nt, Homo sapiens
gaagggcauucagaaauac

SEQ ID NO: 345545 - RNA, 19 nt, Homo sapiens
ggacaaauugaccuuaaca

SEQ ID NO: 345546 - RNA, 19 nt, Homo sapiens
uguaauggcaucuauauuc

SEQ ID NO: 345547 - RNA, 19 nt, Homo sapiens
gagcauggguccacauacg

SEQ ID NO: 345548 - RNA, 19 nt, Homo sapiens
gcagugcugugugaugaug

SEQ ID NO: 345549 - RNA, 19 nt, Homo sapiens
gcuaccuucugauguugua

SEQ ID NO: 345550 - RNA, 19 nt, Homo sapiens
gauggcuggcuguugauua

SEQ ID NO: 345551 - RNA, 19 nt, Homo sapiens
gaucaaggaggaugagcuu

SEQ ID NO: 345552 - RNA, 19 nt, Homo sapiens
uguuguaacugccguaaga

SEQ ID NO: 345553 - RNA, 19 nt, Homo sapiens
ggcaccagguucucuuuau

SEQ ID NO: 345554 - RNA, 19 nt, Homo sapiens
cagacagccucuaaaucaa

SEQ ID NO: 345555 - RNA, 19 nt, Homo sapiens
gaaaugcaucuauauacag

SEQ ID NO: 345556 - RNA, 19 nt, Homo sapiens
uuuccaaacuagcacauuu

SEQ ID NO: 345557 - RNA, 19 nt, Homo sapiens
ugaaauacagacaggauug

SEQ ID NO: 345558 - RNA, 19 nt, Homo sapiens
ggcuucaucuuauaaagug

SEQ ID NO: 345559 - RNA, 19 nt, Homo sapiens
uggcaucuauauucaguug

SEQ ID NO: 345560 - RNA, 19 nt, Homo sapiens
acaucaugcugaccauuaa

SEQ ID NO: 345561 - RNA, 19 nt, Homo sapiens
uggagagacugccuguaaa

SEQ ID NO: 345562 - RNA, 19 nt, Homo sapiens
ugucuacgacuucgagaua

SEQ ID NO: 345563 - RNA, 19 nt, Homo sapiens
caucgcagcccuugagguu

SEQ ID NO: 345564 - RNA, 19 nt, Homo sapiens
uagcacauuugcagagguu

SEQ ID NO: 345565 - RNA, 19 nt, Homo sapiens
cuaccauccuuuaccugua

SEQ ID NO: 345566 - RNA, 19 nt, Homo sapiens
caacuaccauccuuuaccu

SEQ ID NO: 345567 - RNA, 19 nt, Homo sapiens
aucaaguccuucaguauaa

SEQ ID NO: 345568 - RNA, 19 nt, Homo sapiens
ggcuggcuguugauuauga

SEQ ID NO: 345569 - RNA, 19 nt, Homo sapiens
aaauguggcugcguucaug

SEQ ID NO: 345570 - RNA, 19 nt, Homo sapiens
uccaaccucugaugacauu

SEQ ID NO: 345571 - RNA, 19 nt, Homo sapiens
gaugaaauacagacaggau

SEQ ID NO: 345572 - RNA, 19 nt, Homo sapiens
ugaagcaggcguuguuguu

SEQ ID NO: 345573 - RNA, 19 nt, Homo sapiens
cuggagagacugccuguaa

SEQ ID NO: 345574 - RNA, 19 nt, Homo sapiens
gcacauuugcagagguuug

SEQ ID NO: 345575 - RNA, 19 nt, Homo sapiens
auaauuuccucacugguau

SEQ ID NO: 345576 - RNA, 19 nt, Homo sapiens
cuucgagaguccauugaaa

SEQ ID NO: 345577 - RNA, 19 nt, Homo sapiens
gagcuucgagaguccauug

SEQ ID NO: 345578 - RNA, 19 nt, Homo sapiens
uaacugccguaagaggaaa

SEQ ID NO: 345579 - RNA, 19 nt, Homo sapiens
gaacucaugaagcuaccuu

SEQ ID NO: 345580 - RNA, 19 nt, Homo sapiens
gggagcauggguccacaua

SEQ ID NO: 345581 - RNA, 19 nt, Homo sapiens
gaagcaggcguuguuguuc

SEQ ID NO: 345582 - RNA, 19 nt, Homo sapiens
uuacuuaugggauguagaa

SEQ ID NO: 345583 - RNA, 19 nt, Homo sapiens
ugucugcagugcuguguga

SEQ ID NO: 345584 - RNA, 19 nt, Homo sapiens
cacaaaguucuuccuauga

SEQ ID NO: 345585 - RNA, 19 nt, Homo sapiens
gauugugaaugcucugaag

SEQ ID NO: 345586 - RNA, 19 nt, Homo sapiens
guagaaggcagaaaauauu

SEQ ID NO: 345587 - RNA, 19 nt, Homo sapiens
gacagccucuaaaucaagu

SEQ ID NO: 345588 - RNA, 19 nt, Homo sapiens
gugaaaugcaucuauauac

SEQ ID NO: 345589 - RNA, 19 nt, Homo sapiens
caaggaggaugagcuucga

SEQ ID NO: 345590 - RNA, 19 nt, Homo sapiens
guaacugccguaagaggaa

SEQ ID NO: 345591 - RNA, 19 nt, Homo sapiens
aaauugggcauuaucuuga

SEQ ID NO: 345592 - RNA, 19 nt, Homo sapiens
ucgacaucauucccuauaa

SEQ ID NO: 345593 - RNA, 19 nt, Homo sapiens
agagacugccuguaaacua

SEQ ID NO: 345594 - RNA, 19 nt, Homo sapiens
cuuaacaucuagagcuuuc

SEQ ID NO: 345595 - RNA, 19 nt, Homo sapiens
gaagagucaaguggacaaa

SEQ ID NO: 345596 - RNA, 19 nt, Homo sapiens
guacuuagucgcggaguuc

SEQ ID NO: 345597 - RNA, 19 nt, Homo sapiens
gaugaucggcugaauguaa

SEQ ID NO: 345598 - RNA, 19 nt, Homo sapiens
guuguaaucgugcaaauaa

SEQ ID NO: 345599 - RNA, 19 nt, Homo sapiens
gaauguaacagaggaacua

SEQ ID NO: 345600 - RNA, 19 nt, Homo sapiens
cagaggaacuaacguccaa

SEQ ID NO: 345601 - RNA, 19 nt, Homo sapiens
gcuccgaaccuucagcuuu

SEQ ID NO: 345602 - RNA, 19 nt, Homo sapiens
cgaauuagcgguguauuuc

SEQ ID NO: 345603 - RNA, 19 nt, Homo sapiens
gaccaugucuucauuugcu

SEQ ID NO: 345604 - RNA, 19 nt, Homo sapiens
gcucaucucgccuggguuu

SEQ ID NO: 345605 - RNA, 19 nt, Homo sapiens
ggacagcuuugcaguucuc

SEQ ID NO: 345606 - RNA, 19 nt, Homo sapiens
aaacgcucacuccgaauua

SEQ ID NO: 345607 - RNA, 19 nt, Homo sapiens
gacaagacgaggauucuca

SEQ ID NO: 345608 - RNA, 19 nt, Homo sapiens
caaucuuucagcuaacuua

SEQ ID NO: 345609 - RNA, 19 nt, Homo sapiens
uaaacgcucacuccgaauu

SEQ ID NO: 345610 - RNA, 19 nt, Homo sapiens
aaggacagcuuugcaguuc

SEQ ID NO: 345611 - RNA, 19 nt, Homo sapiens
ucuuucagcuaacuuauuc

SEQ ID NO: 345612 - RNA, 19 nt, Homo sapiens
ccgaauuagcgguguauuu

SEQ ID NO: 345613 - RNA, 19 nt, Homo sapiens
caaggacagcuuugcaguu

SEQ ID NO: 345614 - RNA, 19 nt, Homo sapiens
ucauuugcuuccacaagaa

SEQ ID NO: 345615 - RNA, 19 nt, Homo sapiens
agacgaggauucucaacgu

SEQ ID NO: 345616 - RNA, 19 nt, Homo sapiens
ucagcuaacuuauucuacu

SEQ ID NO: 345617 - RNA, 19 nt, Homo sapiens
ccgaccaugucuucauuug

SEQ ID NO: 345618 - RNA, 19 nt, Homo sapiens
cgguguauuucuugaaguu

SEQ ID NO: 345619 - RNA, 19 nt, Homo sapiens
aauuagcgguguauuucuu

SEQ ID NO: 345620 - RNA, 19 nt, Homo sapiens
ccaggugggcgagggaaua

SEQ ID NO: 345621 - RNA, 19 nt, Homo sapiens
cugcagcggauccucaaua

SEQ ID NO: 345622 - RNA, 19 nt, Homo sapiens
acagacgccaaacgcauua

SEQ ID NO: 345623 - RNA, 19 nt, Homo sapiens
gagagacgcagcggagguu

SEQ ID NO: 345624 - RNA, 19 nt, Homo sapiens
acccgacgcuugcuucaug

SEQ ID NO: 345625 - RNA, 19 nt, Homo sapiens
cgcauuaacuggcgaacag

SEQ ID NO: 345626 - RNA, 19 nt, Homo sapiens
cagcuaacuuauucuacuc

SEQ ID NO: 345627 - RNA, 19 nt, Homo sapiens
gaauuagcgguguauuucu

SEQ ID NO: 345628 - RNA, 19 nt, Homo sapiens
caagaaccgcgaggacaga

SEQ ID NO: 345629 - RNA, 19 nt, Homo sapiens
uucauuugcuuccacaaga

SEQ ID NO: 345630 - RNA, 19 nt, Homo sapiens
gcgagccgaccaugucuuc

SEQ ID NO: 345631 - RNA, 19 nt, Homo sapiens
gcggcagccucuacaucga

SEQ ID NO: 345632 - RNA, 19 nt, Homo sapiens
cacagacgccaaacgcauu

SEQ ID NO: 345633 - RNA, 19 nt, Homo sapiens
gagccgaccaugucuucau

SEQ ID NO: 345634 - RNA, 19 nt, Homo sapiens
agccgaccaugucuucauu

SEQ ID NO: 345635 - RNA, 19 nt, Homo sapiens
ugcagcggauccucaauag

SEQ ID NO: 345636 - RNA, 19 nt, Homo sapiens
gcagcagcagugagaguuc

SEQ ID NO: 345637 - RNA, 19 nt, Homo sapiens
gagcaaagaaggauuguua

SEQ ID NO: 345638 - RNA, 19 nt, Homo sapiens
gaugugauguucaugguuu

SEQ ID NO: 345639 - RNA, 19 nt, Homo sapiens
gaagagaagaugaaaguga

SEQ ID NO: 345640 - RNA, 19 nt, Homo sapiens
gaagaggaauauauagcaa

SEQ ID NO: 345641 - RNA, 19 nt, Homo sapiens
ucucucagcucuaauauau

SEQ ID NO: 345642 - RNA, 19 nt, Homo sapiens
gccaaacucuaauuaauuc

SEQ ID NO: 345643 - RNA, 19 nt, Homo sapiens
gaaagugaacuaugucuuc

SEQ ID NO: 345644 - RNA, 19 nt, Homo sapiens
ggacuuagcccgcagagau

SEQ ID NO: 345645 - RNA, 19 nt, Homo sapiens
ggccugcccuuaacuguuu

SEQ ID NO: 345646 - RNA, 19 nt, Homo sapiens
gcaguaaggaagaggaaua

SEQ ID NO: 345647 - RNA, 19 nt, Homo sapiens
gcaguguccuugaguuguu

SEQ ID NO: 345648 - RNA, 19 nt, Homo sapiens
gaacuggcauuagaagcuu

SEQ ID NO: 345649 - RNA, 19 nt, Homo sapiens
aggcaaguguguuguguua

SEQ ID NO: 345650 - RNA, 19 nt, Homo sapiens
guaaggaagaggaauauau

SEQ ID NO: 345651 - RNA, 19 nt, Homo sapiens
cauguaaucaccaauagua

SEQ ID NO: 345652 - RNA, 19 nt, Homo sapiens
ucacauguaaucaccaaua

SEQ ID NO: 345653 - RNA, 19 nt, Homo sapiens
aagagaagaugaaagugaa

SEQ ID NO: 345654 - RNA, 19 nt, Homo sapiens
gcaaguguguuguguuacu

SEQ ID NO: 345655 - RNA, 19 nt, Homo sapiens
aaacugcgcugugugaugu

SEQ ID NO: 345656 - RNA, 19 nt, Homo sapiens
gaggaugcuuuacccaaga

SEQ ID NO: 345657 - RNA, 19 nt, Homo sapiens
gggugaggguugccuauug

SEQ ID NO: 345658 - RNA, 19 nt, Homo sapiens
ggaagaggaauauauagca

SEQ ID NO: 345659 - RNA, 19 nt, Homo sapiens
uuuaugaacuggcauuaga

SEQ ID NO: 345660 - RNA, 19 nt, Homo sapiens
gaagaugaaagugaacuau

SEQ ID NO: 345661 - RNA, 19 nt, Homo sapiens
agucauagaggaugcuuua

SEQ ID NO: 345662 - RNA, 19 nt, Homo sapiens
gggcuucucugugugcauu

SEQ ID NO: 345663 - RNA, 19 nt, Homo sapiens
gggaggacauugccuagag

SEQ ID NO: 345664 - RNA, 19 nt, Homo sapiens
agaugaaagugaacuaugu

SEQ ID NO: 345665 - RNA, 19 nt, Homo sapiens
ggugaggguugccuauugu

SEQ ID NO: 345666 - RNA, 19 nt, Homo sapiens
gccagagccuguuuguaga

SEQ ID NO: 345667 - RNA, 19 nt, Homo sapiens
ggguagcgcugggagugua

SEQ ID NO: 345668 - RNA, 19 nt, Homo sapiens
gcuguuggcuuucuguuuu

SEQ ID NO: 345669 - RNA, 19 nt, Homo sapiens
gagccuguuuguagaaauc

SEQ ID NO: 345670 - RNA, 19 nt, Homo sapiens
ggaggcaaguguguugugu

SEQ ID NO: 345671 - RNA, 19 nt, Homo sapiens
uaccugggcuucucugugu

SEQ ID NO: 345672 - RNA, 19 nt, Homo sapiens
ggccagaugugauguucau

SEQ ID NO: 345673 - RNA, 19 nt, Homo sapiens
aggaauauauagcaacuca

SEQ ID NO: 345674 - RNA, 19 nt, Homo sapiens
gcuccugaguauaggcuuu

SEQ ID NO: 345675 - RNA, 19 nt, Homo sapiens
guguuacugugucaauaaa

SEQ ID NO: 345676 - RNA, 19 nt, Homo sapiens
ugaagauguuuaugaacug

SEQ ID NO: 345677 - RNA, 19 nt, Homo sapiens
gagcuccacuccugaagac

SEQ ID NO: 345678 - RNA, 19 nt, Homo sapiens
caaagaaggauuguuagca

SEQ ID NO: 345679 - RNA, 19 nt, Homo sapiens
cuuagggacuggauacuuc

SEQ ID NO: 345680 - RNA, 19 nt, Homo sapiens
ccucguucuuuacagcuua

SEQ ID NO: 345681 - RNA, 19 nt, Homo sapiens
gaagggccgagaagacaga

SEQ ID NO: 345682 - RNA, 19 nt, Homo sapiens
gauaaacacccaggacagu

SEQ ID NO: 345683 - RNA, 19 nt, Homo sapiens
agaguuugcugaagagaag

SEQ ID NO: 345684 - RNA, 19 nt, Homo sapiens
gaggguugccuauuguguu

SEQ ID NO: 345685 - RNA, 19 nt, Homo sapiens
aacacuagccaaacucuaa

SEQ ID NO: 345686 - RNA, 19 nt, Homo sapiens
ugugauguguucuaucuag

SEQ ID NO: 345687 - RNA, 19 nt, Homo sapiens
gcugugugauguguucuau

SEQ ID NO: 345688 - RNA, 19 nt, Homo sapiens
gcuagaguuugcugaagag

SEQ ID NO: 345689 - RNA, 19 nt, Homo sapiens
ugugugauguguucuaucu

SEQ ID NO: 345690 - RNA, 19 nt, Homo sapiens
cacauguaaucaccaauag

SEQ ID NO: 345691 - RNA, 19 nt, Homo sapiens
gauggauuauuagcugaug

SEQ ID NO: 345692 - RNA, 19 nt, Homo sapiens
cagggauccuucucucuca

SEQ ID NO: 345693 - RNA, 19 nt, Homo sapiens
caccaauaguaaaugaaga

SEQ ID NO: 345694 - RNA, 19 nt, Homo sapiens
cagagccuguuuguagaaa

SEQ ID NO: 345695 - RNA, 19 nt, Homo sapiens
caaacagcaguaaggaaga

SEQ ID NO: 345696 - RNA, 19 nt, Homo sapiens
gggcaguguccuugaguug

SEQ ID NO: 345697 - RNA, 19 nt, Homo sapiens
gcaaagaaggauuguuagc

SEQ ID NO: 345698 - RNA, 19 nt, Homo sapiens
ucacaaacagcaguaagga

SEQ ID NO: 345699 - RNA, 19 nt, Homo sapiens
cuagccaaacucuaauuaa

SEQ ID NO: 345700 - RNA, 19 nt, Homo sapiens
caucguccacuuccaguau

SEQ ID NO: 345701 - RNA, 19 nt, Homo sapiens
ggggagagaucuagauugg

SEQ ID NO: 345702 - RNA, 19 nt, Homo sapiens
cagaugugauguucauggu

SEQ ID NO: 345703 - RNA, 19 nt, Homo sapiens
guuacugugucaauaaacu

SEQ ID NO: 345704 - RNA, 19 nt, Homo sapiens
aaacagcaguaaggaagag

SEQ ID NO: 345705 - RNA, 19 nt, Homo sapiens
caaaucacugccaggaguu

SEQ ID NO: 345706 - RNA, 19 nt, Homo sapiens
ggggaugccugggccuuua

SEQ ID NO: 345707 - RNA, 19 nt, Homo sapiens
cuuuacagcuuaguguuau

SEQ ID NO: 345708 - RNA, 19 nt, Homo sapiens
uaaacugcgcugugugaug

SEQ ID NO: 345709 - RNA, 19 nt, Homo sapiens
ucuaaacugcgcuguguga

SEQ ID NO: 345710 - RNA, 19 nt, Homo sapiens
cugaagagaagaugaaagu

SEQ ID NO: 345711 - RNA, 19 nt, Homo sapiens
acccaggacaguaguauuu

SEQ ID NO: 345712 - RNA, 19 nt, Homo sapiens
agccagagccuguuuguag

SEQ ID NO: 345713 - RNA, 19 nt, Homo sapiens
uuaguguuauucuggcauu

SEQ ID NO: 345714 - RNA, 19 nt, Homo sapiens
ucuuuacagcuuaguguua

SEQ ID NO: 345715 - RNA, 19 nt, Homo sapiens
uuucuaaacugcgcugugu

SEQ ID NO: 345716 - RNA, 19 nt, Homo sapiens
uaaacacccaggacaguag

SEQ ID NO: 345717 - RNA, 19 nt, Homo sapiens
ccagagccuguuuguagaa

SEQ ID NO: 345718 - RNA, 19 nt, Homo sapiens
uguguuacugugucaauaa

SEQ ID NO: 345719 - RNA, 19 nt, Homo sapiens
caaguguguuguguuacug

SEQ ID NO: 345720 - RNA, 19 nt, Homo sapiens
acuagccaaacucuaauua

SEQ ID NO: 345721 - RNA, 19 nt, Homo sapiens
auaggggcauugaaauuua

SEQ ID NO: 345722 - RNA, 19 nt, Homo sapiens
gcacugucaggcucagguu

SEQ ID NO: 345723 - RNA, 19 nt, Homo sapiens
cuucuugggcuuugagauu

SEQ ID NO: 345724 - RNA, 19 nt, Homo sapiens
gaugaaagugaacuauguc

SEQ ID NO: 345725 - RNA, 19 nt, Homo sapiens
acuucuggcuggcugagua

SEQ ID NO: 345726 - RNA, 19 nt, Homo sapiens
agaggaauauauagcaacu

SEQ ID NO: 345727 - RNA, 19 nt, Homo sapiens
gagggacugucuggguuca

SEQ ID NO: 345728 - RNA, 19 nt, Homo sapiens
ugcuagaguuugcugaaga

SEQ ID NO: 345729 - RNA, 19 nt, Homo sapiens
cagcucuaauauauaagga

SEQ ID NO: 345730 - RNA, 19 nt, Homo sapiens
gggaugccugggccuuuaa

SEQ ID NO: 345731 - RNA, 19 nt, Homo sapiens
uuaaauaggggcauugaaa

SEQ ID NO: 345732 - RNA, 19 nt, Homo sapiens
guauuuugccuuugaguaa

SEQ ID NO: 345733 - RNA, 19 nt, Homo sapiens
accagaacuuguccgauga

SEQ ID NO: 345734 - RNA, 19 nt, Homo sapiens
cgucuggccuggaguaagc

SEQ ID NO: 345735 - RNA, 19 nt, Homo sapiens
guugacucguugaaauugu

SEQ ID NO: 345736 - RNA, 19 nt, Homo sapiens
auaaacacccaggacagua

SEQ ID NO: 345737 - RNA, 19 nt, Homo sapiens
gaauagaccuugacacuaa

SEQ ID NO: 345738 - RNA, 19 nt, Homo sapiens
guagaaagaugugagauaa

SEQ ID NO: 345739 - RNA, 19 nt, Homo sapiens
caaauuguaugcuuucuga

SEQ ID NO: 345740 - RNA, 19 nt, Homo sapiens
gagcgaagauaccugcuaa

SEQ ID NO: 345741 - RNA, 19 nt, Homo sapiens
gaucuuggauggauugcua

SEQ ID NO: 345742 - RNA, 19 nt, Homo sapiens
ggagaaagaucugcaagug

SEQ ID NO: 345743 - RNA, 19 nt, Homo sapiens
gaucuuaguagccauauuu

SEQ ID NO: 345744 - RNA, 19 nt, Homo sapiens
gcacaucuccacuuaauag

SEQ ID NO: 345745 - RNA, 19 nt, Homo sapiens
uaucaccgcuggagaacua

SEQ ID NO: 345746 - RNA, 19 nt, Homo sapiens
gaagaugggccuggacuuu

SEQ ID NO: 345747 - RNA, 19 nt, Homo sapiens
ucacaacccauuagucaua

SEQ ID NO: 345748 - RNA, 19 nt, Homo sapiens
uaggauaucugacgggauu

SEQ ID NO: 345749 - RNA, 19 nt, Homo sapiens
ggauauggguucuccuuca

SEQ ID NO: 345750 - RNA, 19 nt, Homo sapiens
ggaacagaaagcuuuauaa

SEQ ID NO: 345751 - RNA, 19 nt, Homo sapiens
ggagaccaauauccaagaa

SEQ ID NO: 345752 - RNA, 19 nt, Homo sapiens
gaacagaaagcuuuauaac

SEQ ID NO: 345753 - RNA, 19 nt, Homo sapiens
ugagauaauucuacacaga

SEQ ID NO: 345754 - RNA, 19 nt, Homo sapiens
caacuggacgguguauuua

SEQ ID NO: 345755 - RNA, 19 nt, Homo sapiens
ggaggucucacucuucuuu

SEQ ID NO: 345756 - RNA, 19 nt, Homo sapiens
gccaggaguuugcuucauu

SEQ ID NO: 345757 - RNA, 19 nt, Homo sapiens
gagauaacuuacucaagau

SEQ ID NO: 345758 - RNA, 19 nt, Homo sapiens
gaaacuucauccaucacaa

SEQ ID NO: 345759 - RNA, 19 nt, Homo sapiens
gcucgaagacuaaaggaaa

SEQ ID NO: 345760 - RNA, 19 nt, Homo sapiens
gugcauaccuguuuaccau

SEQ ID NO: 345761 - RNA, 19 nt, Homo sapiens
ggaauagaccuugacacua

SEQ ID NO: 345762 - RNA, 19 nt, Homo sapiens
gcacuguugggauguguua

SEQ ID NO: 345763 - RNA, 19 nt, Homo sapiens
guggugcuguguucuauuu

SEQ ID NO: 345764 - RNA, 19 nt, Homo sapiens
gaaagucaugggccuguuu

SEQ ID NO: 345765 - RNA, 19 nt, Homo sapiens
ggaggugucuggucugucu

SEQ ID NO: 345766 - RNA, 19 nt, Homo sapiens
gaaagggucacggugcaua

SEQ ID NO: 345767 - RNA, 19 nt, Homo sapiens
gcagcgcucuuuguucuga

SEQ ID NO: 345768 - RNA, 19 nt, Homo sapiens
agacacacauccaccuaaa

SEQ ID NO: 345769 - RNA, 19 nt, Homo sapiens
gaugugagauaacuuacuc

SEQ ID NO: 345770 - RNA, 19 nt, Homo sapiens
ggauucugcucgccaaaug

SEQ ID NO: 345771 - RNA, 19 nt, Homo sapiens
caaggaacccagugagauu

SEQ ID NO: 345772 - RNA, 19 nt, Homo sapiens
ucaauucuccugaggcuaa

SEQ ID NO: 345773 - RNA, 19 nt, Homo sapiens
caucuccacuuaauagaau

SEQ ID NO: 345774 - RNA, 19 nt, Homo sapiens
gccaucugguugcuaauuu

SEQ ID NO: 345775 - RNA, 19 nt, Homo sapiens
gggauggaauuaauagaca

SEQ ID NO: 345776 - RNA, 19 nt, Homo sapiens
ggugccaucugguugcuaa

SEQ ID NO: 345777 - RNA, 19 nt, Homo sapiens
ccagugagauuguugaacu

SEQ ID NO: 345778 - RNA, 19 nt, Homo sapiens
gcgcugaucauauuugaga

SEQ ID NO: 345779 - RNA, 19 nt, Homo sapiens
gaacuacuccgugaaccuu

SEQ ID NO: 345780 - RNA, 19 nt, Homo sapiens
caucacaacccauuaguca

SEQ ID NO: 345781 - RNA, 19 nt, Homo sapiens
uggcacaucuccacuuaau

SEQ ID NO: 345782 - RNA, 19 nt, Homo sapiens
aaagggaggucucacucuu

SEQ ID NO: 345783 - RNA, 19 nt, Homo sapiens
ugacuguacuguuuaacug

SEQ ID NO: 345784 - RNA, 19 nt, Homo sapiens
guucacugcuaccaugauu

SEQ ID NO: 345785 - RNA, 19 nt, Homo sapiens
caagacaaguccugauugc

SEQ ID NO: 345786 - RNA, 19 nt, Homo sapiens
gacacuaacacucuaauuc

SEQ ID NO: 345787 - RNA, 19 nt, Homo sapiens
gauauggguucuccuucau

SEQ ID NO: 345788 - RNA, 19 nt, Homo sapiens
ggaggcaacgggacacuga

SEQ ID NO: 345789 - RNA, 19 nt, Homo sapiens
gaacugaagcacgagauuc

SEQ ID NO: 345790 - RNA, 19 nt, Homo sapiens
cggauucacugcacacaug

SEQ ID NO: 345791 - RNA, 19 nt, Homo sapiens
acaacuggacgguguauuu

SEQ ID NO: 345792 - RNA, 19 nt, Homo sapiens
acagagacacaguggaaua

SEQ ID NO: 345793 - RNA, 19 nt, Homo sapiens
cuacagagacacaguggaa

SEQ ID NO: 345794 - RNA, 19 nt, Homo sapiens
cagaaagcuuuauaacaag

SEQ ID NO: 345795 - RNA, 19 nt, Homo sapiens
gauuccugcuuuacagaaa

SEQ ID NO: 345796 - RNA, 19 nt, Homo sapiens
agaaagaugugagauaacu

SEQ ID NO: 345797 - RNA, 19 nt, Homo sapiens
ucagacuccuuuacuggaa

SEQ ID NO: 345798 - RNA, 19 nt, Homo sapiens
ucacggugcauaccuguuu

SEQ ID NO: 345799 - RNA, 19 nt, Homo sapiens
acacuaacacucuaauuca

SEQ ID NO: 345800 - RNA, 19 nt, Homo sapiens
guggugggauggaauuaau

SEQ ID NO: 345801 - RNA, 19 nt, Homo sapiens
gaugaucuuaguagccaua

SEQ ID NO: 345802 - RNA, 19 nt, Homo sapiens
gugaugagcaggaccuuug

SEQ ID NO: 345803 - RNA, 19 nt, Homo sapiens
cacaacccauuagucauaa

SEQ ID NO: 345804 - RNA, 19 nt, Homo sapiens
uaaaggaaacuucauccau

SEQ ID NO: 345805 - RNA, 19 nt, Homo sapiens
gugguggaguggauugauu

SEQ ID NO: 345806 - RNA, 19 nt, Homo sapiens
gacccagccugacccaugu

SEQ ID NO: 345807 - RNA, 19 nt, Homo sapiens
gagagacgguguccaucag

SEQ ID NO: 345808 - RNA, 19 nt, Homo sapiens
caucacugcugaagagucu

SEQ ID NO: 345809 - RNA, 19 nt, Homo sapiens
uguagaaagaugugagaua

SEQ ID NO: 345810 - RNA, 19 nt, Homo sapiens
cacuaacacucuaauucaa

SEQ ID NO: 345811 - RNA, 19 nt, Homo sapiens
aaggaaacuucauccauca

SEQ ID NO: 345812 - RNA, 19 nt, Homo sapiens
gaacccagugagauuguug

SEQ ID NO: 345813 - RNA, 19 nt, Homo sapiens
ccaggaguuugcuucauuc

SEQ ID NO: 345814 - RNA, 19 nt, Homo sapiens
gaaagaugugagauaacuu

SEQ ID NO: 345815 - RNA, 19 nt, Homo sapiens
gacaaaauguagaaagaug

SEQ ID NO: 345816 - RNA, 19 nt, Homo sapiens
ggacuuugccggauucacu

SEQ ID NO: 345817 - RNA, 19 nt, Homo sapiens
gacccaggcugucccucuu

SEQ ID NO: 345818 - RNA, 19 nt, Homo sapiens
acuggacgguguauuuaaa

SEQ ID NO: 345819 - RNA, 19 nt, Homo sapiens
gauaacuuacucaagauuc

SEQ ID NO: 345820 - RNA, 19 nt, Homo sapiens
gauguguuaucuccuugug

SEQ ID NO: 345821 - RNA, 19 nt, Homo sapiens
guuguguccugcacuguug

SEQ ID NO: 345822 - RNA, 19 nt, Homo sapiens
gggauuuguuaucuucaug

SEQ ID NO: 345823 - RNA, 19 nt, Homo sapiens
ggaauuaauagacauccau

SEQ ID NO: 345824 - RNA, 19 nt, Homo sapiens
ggauggaauuaauagacau

SEQ ID NO: 345825 - RNA, 19 nt, Homo sapiens
ggaacccagugagauuguu

SEQ ID NO: 345826 - RNA, 19 nt, Homo sapiens
ccaagacaaguccugauug

SEQ ID NO: 345827 - RNA, 19 nt, Homo sapiens
cacagcaggucacucacaa

SEQ ID NO: 345828 - RNA, 19 nt, Homo sapiens
ggagcgaagauaccugcua

SEQ ID NO: 345829 - RNA, 19 nt, Homo sapiens
ggaaacuucauccaucaca

SEQ ID NO: 345830 - RNA, 19 nt, Homo sapiens
uugcagaacagcauggaua

SEQ ID NO: 345831 - RNA, 19 nt, Homo sapiens
cggacucgcugaacuugug

SEQ ID NO: 345832 - RNA, 19 nt, Homo sapiens
uggaacagaaagcuuuaua

SEQ ID NO: 345833 - RNA, 19 nt, Homo sapiens
accaagagcugaggaagau

SEQ ID NO: 345834 - RNA, 19 nt, Homo sapiens
cacggugcauaccuguuua

SEQ ID NO: 345835 - RNA, 19 nt, Homo sapiens
gagacacaguggaauagac

SEQ ID NO: 345836 - RNA, 19 nt, Homo sapiens
gaucuucacaaacauugga

SEQ ID NO: 345837 - RNA, 19 nt, Homo sapiens
gaagaaagauggacaggua

SEQ ID NO: 345838 - RNA, 19 nt, Homo sapiens
gaacagagcaagaucacua

SEQ ID NO: 345839 - RNA, 19 nt, Homo sapiens
gaagaugguuggagacuau

SEQ ID NO: 345840 - RNA, 19 nt, Homo sapiens
gcaggaaggucaaagagaa

SEQ ID NO: 345841 - RNA, 19 nt, Homo sapiens
gaaauacuguuugagguuu

SEQ ID NO: 345842 - RNA, 19 nt, Homo sapiens
gggcugaacacuccaauua

SEQ ID NO: 345843 - RNA, 19 nt, Homo sapiens
gcaaugaagucucugaagu

SEQ ID NO: 345844 - RNA, 19 nt, Homo sapiens
auaaagaacucucccguuu

SEQ ID NO: 345845 - RNA, 19 nt, Homo sapiens
ugaagucucugaagugaaa

SEQ ID NO: 345846 - RNA, 19 nt, Homo sapiens
cagcagcggugguaacuuu

SEQ ID NO: 345847 - RNA, 19 nt, Homo sapiens
ugacaucucugcaaucuuc

SEQ ID NO: 345848 - RNA, 19 nt, Homo sapiens
ucaaccaccuuucagauaa

SEQ ID NO: 345849 - RNA, 19 nt, Homo sapiens
uaaauucccuggccuuuca

SEQ ID NO: 345850 - RNA, 19 nt, Homo sapiens
gacgaugucuucauaccua

SEQ ID NO: 345851 - RNA, 19 nt, Homo sapiens
gagaagaaagugaagagua

SEQ ID NO: 345852 - RNA, 19 nt, Homo sapiens
gaaacuggguuccugcaau

SEQ ID NO: 345853 - RNA, 19 nt, Homo sapiens
guacauggcugcugcugau

SEQ ID NO: 345854 - RNA, 19 nt, Homo sapiens
ggacaaggaacacauuuau

SEQ ID NO: 345855 - RNA, 19 nt, Homo sapiens
gaagaucagcugaccauug

SEQ ID NO: 345856 - RNA, 19 nt, Homo sapiens
ggacgcagcagauugguuu

SEQ ID NO: 345857 - RNA, 19 nt, Homo sapiens
uaacuucgccuguggauga

SEQ ID NO: 345858 - RNA, 19 nt, Homo sapiens
guacugggguucaugauua

SEQ ID NO: 345859 - RNA, 19 nt, Homo sapiens
uuacaggccugaugaauuc

SEQ ID NO: 345860 - RNA, 19 nt, Homo sapiens
cauaggugaucucauuuaa

SEQ ID NO: 345861 - RNA, 19 nt, Homo sapiens
ccaaguuguuugagaaauu

SEQ ID NO: 345862 - RNA, 19 nt, Homo sapiens
gaaauguccagaacaagaa

SEQ ID NO: 345863 - RNA, 19 nt, Homo sapiens
aagaucagcugaccauuga

SEQ ID NO: 345864 - RNA, 19 nt, Homo sapiens
gcauaggugaucucauuua

SEQ ID NO: 345865 - RNA, 19 nt, Homo sapiens
gaaggcugaugccaaguug

SEQ ID NO: 345866 - RNA, 19 nt, Homo sapiens
agaauuggaugacuauaga

SEQ ID NO: 345867 - RNA, 19 nt, Homo sapiens
acacuggccuacaggaaua

SEQ ID NO: 345868 - RNA, 19 nt, Homo sapiens
uaggugaucucauuuaauc

SEQ ID NO: 345869 - RNA, 19 nt, Homo sapiens
gaacucucccguuuggaua

SEQ ID NO: 345870 - RNA, 19 nt, Homo sapiens
gggcauugcucauccugaa

SEQ ID NO: 345871 - RNA, 19 nt, Homo sapiens
uugcauaggugaucucauu

SEQ ID NO: 345872 - RNA, 19 nt, Homo sapiens
acaaggaacacauuuauga

SEQ ID NO: 345873 - RNA, 19 nt, Homo sapiens
gcaagcaguuaaagagcaa

SEQ ID NO: 345874 - RNA, 19 nt, Homo sapiens
aaagacaacuguacaagag

SEQ ID NO: 345875 - RNA, 19 nt, Homo sapiens
gaagauacuacuuaagugu

SEQ ID NO: 345876 - RNA, 19 nt, Homo sapiens
gaacaagaagauacuacuu

SEQ ID NO: 345877 - RNA, 19 nt, Homo sapiens
ggaaguggcuauggcuaug

SEQ ID NO: 345878 - RNA, 19 nt, Homo sapiens
ggacagaggcuauggaacu

SEQ ID NO: 345879 - RNA, 19 nt, Homo sapiens
gcugaacacuccaauuaag

SEQ ID NO: 345880 - RNA, 19 nt, Homo sapiens
uuaaguaucugacaucucu

SEQ ID NO: 345881 - RNA, 19 nt, Homo sapiens
ggaugacuauagagaagaa

SEQ ID NO: 345882 - RNA, 19 nt, Homo sapiens
acacuccaauuaaggauuu

SEQ ID NO: 345883 - RNA, 19 nt, Homo sapiens
caucaguauugaagcauuu

SEQ ID NO: 345884 - RNA, 19 nt, Homo sapiens
gcaguuaaagagcaaauug

SEQ ID NO: 345885 - RNA, 19 nt, Homo sapiens
ggaaguggcuuugguagcu

SEQ ID NO: 345886 - RNA, 19 nt, Homo sapiens
ucccuggccuuucauauuu

SEQ ID NO: 345887 - RNA, 19 nt, Homo sapiens
guaagaagaaucauugcaa

SEQ ID NO: 345888 - RNA, 19 nt, Homo sapiens
ggaggaaguggcuuuggua

SEQ ID NO: 345889 - RNA, 19 nt, Homo sapiens
caacaaagacaacuguaca

SEQ ID NO: 345890 - RNA, 19 nt, Homo sapiens
aaagaacucucccguuugg

SEQ ID NO: 345891 - RNA, 19 nt, Homo sapiens
caaagacaacuguacaaga

SEQ ID NO: 345892 - RNA, 19 nt, Homo sapiens
gaaguggcuuugguagcua

SEQ ID NO: 345893 - RNA, 19 nt, Homo sapiens
aaacuggguuccugcaaug

SEQ ID NO: 345894 - RNA, 19 nt, Homo sapiens
gaaagauggacagguauga

SEQ ID NO: 345895 - RNA, 19 nt, Homo sapiens
ggaggccauugccauugua

SEQ ID NO: 345896 - RNA, 19 nt, Homo sapiens
gaaaguccaccuccuuaca

SEQ ID NO: 345897 - RNA, 19 nt, Homo sapiens
ucagaaggcaaaugacuuu

SEQ ID NO: 345898 - RNA, 19 nt, Homo sapiens
acaauagacugaagcaagu

SEQ ID NO: 345899 - RNA, 19 nt, Homo sapiens
aggaacacauuuaugauga

SEQ ID NO: 345900 - RNA, 19 nt, Homo sapiens
gggacaaggaacacauuua

SEQ ID NO: 345901 - RNA, 19 nt, Homo sapiens
gguaugacaaguccaauau

SEQ ID NO: 345902 - RNA, 19 nt, Homo sapiens
agaagaaagugaagaguac

SEQ ID NO: 345903 - RNA, 19 nt, Homo sapiens
uacaagagcuuacaaucag

SEQ ID NO: 345904 - RNA, 19 nt, Homo sapiens
gaauauccaccuaucacuu

SEQ ID NO: 345905 - RNA, 19 nt, Homo sapiens
cuacguggaucaguauuug

SEQ ID NO: 345906 - RNA, 19 nt, Homo sapiens
gagcuuacaaucagaacuu

SEQ ID NO: 345907 - RNA, 19 nt, Homo sapiens
guauuuguaucacuacugu

SEQ ID NO: 345908 - RNA, 19 nt, Homo sapiens
gguuaagucuguuuuauga

SEQ ID NO: 345909 - RNA, 19 nt, Homo sapiens
aaaugacuuuggaccauaa

SEQ ID NO: 345910 - RNA, 19 nt, Homo sapiens
gaugccaaguuguuugaga

SEQ ID NO: 345911 - RNA, 19 nt, Homo sapiens
guucaggagcuuccauuaa

SEQ ID NO: 345912 - RNA, 19 nt, Homo sapiens
gauccugucuaugcucauu

SEQ ID NO: 345913 - RNA, 19 nt, Homo sapiens
gcuacuauauaugugauga

SEQ ID NO: 345914 - RNA, 19 nt, Homo sapiens
gaauacaagagcuuacaau

SEQ ID NO: 345915 - RNA, 19 nt, Homo sapiens
ugaaauguccagaacaaga

SEQ ID NO: 345916 - RNA, 19 nt, Homo sapiens
gacagaggcuauggaacuu

SEQ ID NO: 345917 - RNA, 19 nt, Homo sapiens
cauauaugguggagagaug

SEQ ID NO: 345918 - RNA, 19 nt, Homo sapiens
uaucugacaucucugcaau

SEQ ID NO: 345919 - RNA, 19 nt, Homo sapiens
gauaaagaauuggaugacu

SEQ ID NO: 345920 - RNA, 19 nt, Homo sapiens
gagacagacuacacaacug

SEQ ID NO: 345921 - RNA, 19 nt, Homo sapiens
uauccagagucuuccuaua

SEQ ID NO: 345922 - RNA, 19 nt, Homo sapiens
ugccacaauugucuauaua

SEQ ID NO: 345923 - RNA, 19 nt, Homo sapiens
cagcaaagggcuucauguu

SEQ ID NO: 345924 - RNA, 19 nt, Homo sapiens
gcaccaagcaaugacauau

SEQ ID NO: 345925 - RNA, 19 nt, Homo sapiens
aaugaagucucugaaguga

SEQ ID NO: 345926 - RNA, 19 nt, Homo sapiens
gaucaacaaagacaacugu

SEQ ID NO: 345927 - RNA, 19 nt, Homo sapiens
gcaaagggaagagcaggaa

SEQ ID NO: 345928 - RNA, 19 nt, Homo sapiens
uccagagucuuccuauaaa

SEQ ID NO: 345929 - RNA, 19 nt, Homo sapiens
gacucuacguggaucagua

SEQ ID NO: 345930 - RNA, 19 nt, Homo sapiens
ugucuaugcucauuauugu

SEQ ID NO: 345931 - RNA, 19 nt, Homo sapiens
caaauugucacacaucaag

SEQ ID NO: 345932 - RNA, 19 nt, Homo sapiens
ccagagucuuccuauaaau

SEQ ID NO: 345933 - RNA, 19 nt, Homo sapiens
uaaagaacucucccguuug

SEQ ID NO: 345934 - RNA, 19 nt, Homo sapiens
ucacuacuguguuguggau

SEQ ID NO: 345935 - RNA, 19 nt, Homo sapiens
ucuaccagccucccuauuu

SEQ ID NO: 345936 - RNA, 19 nt, Homo sapiens
accaagcaaugacauauau

SEQ ID NO: 345937 - RNA, 19 nt, Homo sapiens
cagcagcgcuccaggaaug

SEQ ID NO: 345938 - RNA, 19 nt, Homo sapiens
ugaagaagagcuuaaguuu

SEQ ID NO: 345939 - RNA, 19 nt, Homo sapiens
ccaaucaggugaaggaugu

SEQ ID NO: 345940 - RNA, 19 nt, Homo sapiens
gcggguaccuggaugaaga

SEQ ID NO: 345941 - RNA, 19 nt, Homo sapiens
caucaggccucuccaagau

SEQ ID NO: 345942 - RNA, 19 nt, Homo sapiens
gaaaagagagaaagggaua

SEQ ID NO: 345943 - RNA, 19 nt, Homo sapiens
uauaugcccugacaacuuc

SEQ ID NO: 345944 - RNA, 19 nt, Homo sapiens
gcaguuugcucauuguuuu

SEQ ID NO: 345945 - RNA, 19 nt, Homo sapiens
gccaagacccagacacuuu

SEQ ID NO: 345946 - RNA, 19 nt, Homo sapiens
ucccaucccuaccuaauuu

SEQ ID NO: 345947 - RNA, 19 nt, Homo sapiens
guaccuggaugaagaagag

SEQ ID NO: 345948 - RNA, 19 nt, Homo sapiens
gggauaaucaccuggaaga

SEQ ID NO: 345949 - RNA, 19 nt, Homo sapiens
cgagagagucacuucauga

SEQ ID NO: 345950 - RNA, 19 nt, Homo sapiens
gaagaagagcuuaaguuuu

SEQ ID NO: 345951 - RNA, 19 nt, Homo sapiens
guauaugcccugacaacuu

SEQ ID NO: 345952 - RNA, 19 nt, Homo sapiens
ugagaguggugccagagaa

SEQ ID NO: 345953 - RNA, 19 nt, Homo sapiens
gcccugacaacuucuguaa

SEQ ID NO: 345954 - RNA, 19 nt, Homo sapiens
aucccuaccuaauuuguua

SEQ ID NO: 345955 - RNA, 19 nt, Homo sapiens
uuagcgaggucacgagaga

SEQ ID NO: 345956 - RNA, 19 nt, Homo sapiens
agagagaaagggauaauca

SEQ ID NO: 345957 - RNA, 19 nt, Homo sapiens
ucaggccucuccaagaugu

SEQ ID NO: 345958 - RNA, 19 nt, Homo sapiens
guggguauaugcccugaca

SEQ ID NO: 345959 - RNA, 19 nt, Homo sapiens
ccugacaacuucuguaagc

SEQ ID NO: 345960 - RNA, 19 nt, Homo sapiens
gaaaauuggagcagaggaa

SEQ ID NO: 345961 - RNA, 19 nt, Homo sapiens
cugaaaaccuucugcaguu

SEQ ID NO: 345962 - RNA, 19 nt, Homo sapiens
cacaucccaucccuaccua

SEQ ID NO: 345963 - RNA, 19 nt, Homo sapiens
cagccaaucaggugaagga

SEQ ID NO: 345964 - RNA, 19 nt, Homo sapiens
gaugaagaagagcuuaagu

SEQ ID NO: 345965 - RNA, 19 nt, Homo sapiens
acgagagagucacuucaug

SEQ ID NO: 345966 - RNA, 19 nt, Homo sapiens
ugauggagaugggaaaauu

SEQ ID NO: 345967 - RNA, 19 nt, Homo sapiens
caagaugucagccaaucag

SEQ ID NO: 345968 - RNA, 19 nt, Homo sapiens
cuucugcaguuugcucauu

SEQ ID NO: 345969 - RNA, 19 nt, Homo sapiens
aaagagagaaagggauaau

SEQ ID NO: 345970 - RNA, 19 nt, Homo sapiens
ggaugaagaagagcuuaag

SEQ ID NO: 345971 - RNA, 19 nt, Homo sapiens
gagcggguaccuggaugaa

SEQ ID NO: 345972 - RNA, 19 nt, Homo sapiens
agucagaaaccaaguccuu

SEQ ID NO: 345973 - RNA, 19 nt, Homo sapiens
ccaagaugucagccaauca

SEQ ID NO: 345974 - RNA, 19 nt, Homo sapiens
gaaauuaccucccaaguug

SEQ ID NO: 345975 - RNA, 19 nt, Homo sapiens
gcaaagguauuguggauga

SEQ ID NO: 345976 - RNA, 19 nt, Homo sapiens
ugacauagcuucuaacagu

SEQ ID NO: 345977 - RNA, 19 nt, Homo sapiens
gcuaaacccuuuccugauu

SEQ ID NO: 345978 - RNA, 19 nt, Homo sapiens
ggagggaguuuguguuuga

SEQ ID NO: 345979 - RNA, 19 nt, Homo sapiens
gaacgggcaauaugaguua

SEQ ID NO: 345980 - RNA, 19 nt, Homo sapiens
caauauggcuaaacccuuu

SEQ ID NO: 345981 - RNA, 19 nt, Homo sapiens
ccacagaucuggagguaug

SEQ ID NO: 345982 - RNA, 19 nt, Homo sapiens
caaccacccuugccuguuu

SEQ ID NO: 345983 - RNA, 19 nt, Homo sapiens
gaacgaagguaccggaaag

SEQ ID NO: 345984 - RNA, 19 nt, Homo sapiens
ggaugaugcuucuuauauu

SEQ ID NO: 345985 - RNA, 19 nt, Homo sapiens
gggaagaaaugguucaaau

SEQ ID NO: 345986 - RNA, 19 nt, Homo sapiens
ggaagggucuauugcagaa

SEQ ID NO: 345987 - RNA, 19 nt, Homo sapiens
gaaaggaucagugucgaua

SEQ ID NO: 345988 - RNA, 19 nt, Homo sapiens
ugaaaucccugaugaggaa

SEQ ID NO: 345989 - RNA, 19 nt, Homo sapiens
ucucuggucuucugaaaua

SEQ ID NO: 345990 - RNA, 19 nt, Homo sapiens
gaucacauuuaguagcaua

SEQ ID NO: 345991 - RNA, 19 nt, Homo sapiens
ucacugaccugggaucuuu

SEQ ID NO: 345992 - RNA, 19 nt, Homo sapiens
gaaguaaggauuucggauu

SEQ ID NO: 345993 - RNA, 19 nt, Homo sapiens
gaagguacguauucugcaa

SEQ ID NO: 345994 - RNA, 19 nt, Homo sapiens
ggaaauuaccucccaaguu

SEQ ID NO: 345995 - RNA, 19 nt, Homo sapiens
ccucugagcuuuucauuua

SEQ ID NO: 345996 - RNA, 19 nt, Homo sapiens
ggaaccauauucucuuaga

SEQ ID NO: 345997 - RNA, 19 nt, Homo sapiens
gaaaaugacuuccuuccuu

SEQ ID NO: 345998 - RNA, 19 nt, Homo sapiens
cgaagaagacuaaggcuuu

SEQ ID NO: 345999 - RNA, 19 nt, Homo sapiens
ccagugauuucuccuguuu

SEQ ID NO: 346000 - RNA, 19 nt, Homo sapiens
cuacuacaauggcaucuuu

SEQ ID NO: 346001 - RNA, 19 nt, Homo sapiens
gaagauaguguacgcauca

SEQ ID NO: 346002 - RNA, 19 nt, Homo sapiens
uaagaaagaccuucagaga

SEQ ID NO: 346003 - RNA, 19 nt, Homo sapiens
ucaaacauauccuggcaaa

SEQ ID NO: 346004 - RNA, 19 nt, Homo sapiens
gccagaaagugaucacaaa

SEQ ID NO: 346005 - RNA, 19 nt, Homo sapiens
gaaauucgaccagcuaaau

SEQ ID NO: 346006 - RNA, 19 nt, Homo sapiens
gaaaucugcuucccuacca

SEQ ID NO: 346007 - RNA, 19 nt, Homo sapiens
guggaaccauauucucuua

SEQ ID NO: 346008 - RNA, 19 nt, Homo sapiens
caagacagacuccaaguga

SEQ ID NO: 346009 - RNA, 19 nt, Homo sapiens
gagcagaacagguuuguca

SEQ ID NO: 346010 - RNA, 19 nt, Homo sapiens
gagagaaucacaaucagaa

SEQ ID NO: 346011 - RNA, 19 nt, Homo sapiens
ggagaucuggcuucuagua

SEQ ID NO: 346012 - RNA, 19 nt, Homo sapiens
gcgcggagcuguuccucaa

SEQ ID NO: 346013 - RNA, 19 nt, Homo sapiens
gagaagauaagauugaaga

SEQ ID NO: 346014 - RNA, 19 nt, Homo sapiens
ugacuuccuuccuuccuua

SEQ ID NO: 346015 - RNA, 19 nt, Homo sapiens
gaagagcguuuccuaaucc

SEQ ID NO: 346016 - RNA, 19 nt, Homo sapiens
gaacuuggaaugugaaugg

SEQ ID NO: 346017 - RNA, 19 nt, Homo sapiens
ccucuaagguacuaauuug

SEQ ID NO: 346018 - RNA, 19 nt, Homo sapiens
ggaccaaccaagcaccuua

SEQ ID NO: 346019 - RNA, 19 nt, Homo sapiens
ggaagcacuuugaguaucu

SEQ ID NO: 346020 - RNA, 19 nt, Homo sapiens
gggugaagguuguggauga

SEQ ID NO: 346021 - RNA, 19 nt, Homo sapiens
gggaugaugcuucuuauau

SEQ ID NO: 346022 - RNA, 19 nt, Homo sapiens
ccugauaucuacugcauug

SEQ ID NO: 346023 - RNA, 19 nt, Homo sapiens
gggagggucucaucaaaca

SEQ ID NO: 346024 - RNA, 19 nt, Homo sapiens
gcaaggagcauaacguaca

SEQ ID NO: 346025 - RNA, 19 nt, Homo sapiens
gggcagaugucaccuccuu

SEQ ID NO: 346026 - RNA, 19 nt, Homo sapiens
gcaguuauuacaugcauuu

SEQ ID NO: 346027 - RNA, 19 nt, Homo sapiens
guccauggcuguagagaga

SEQ ID NO: 346028 - RNA, 19 nt, Homo sapiens
cuucagauguguucaagaa

SEQ ID NO: 346029 - RNA, 19 nt, Homo sapiens
gaacauauacagaguugag

SEQ ID NO: 346030 - RNA, 19 nt, Homo sapiens
gaagagcuccagcagauca

SEQ ID NO: 346031 - RNA, 19 nt, Homo sapiens
guagaucaccuauucaaau

SEQ ID NO: 346032 - RNA, 19 nt, Homo sapiens
ggagucacauggaacugaa

SEQ ID NO: 346033 - RNA, 19 nt, Homo sapiens
gcacguaugcaguauccua

SEQ ID NO: 346034 - RNA, 19 nt, Homo sapiens
cauauccaguguuguguaa

SEQ ID NO: 346035 - RNA, 19 nt, Homo sapiens
cagcaaagguauuguggau

SEQ ID NO: 346036 - RNA, 19 nt, Homo sapiens
caugaucgcuacucucuuc

SEQ ID NO: 346037 - RNA, 19 nt, Homo sapiens
gagaugccauagaaauguu

SEQ ID NO: 346038 - RNA, 19 nt, Homo sapiens
agaaagaccuucagagacu

SEQ ID NO: 346039 - RNA, 19 nt, Homo sapiens
gagggucucaucaaacaua

SEQ ID NO: 346040 - RNA, 19 nt, Homo sapiens
gcuuugaaaucccugauga

SEQ ID NO: 346041 - RNA, 19 nt, Homo sapiens
uugaguaucugaagaguga

SEQ ID NO: 346042 - RNA, 19 nt, Homo sapiens
ucucuuagaucacauuuag

SEQ ID NO: 346043 - RNA, 19 nt, Homo sapiens
gaaaucccuucugcaaaug

SEQ ID NO: 346044 - RNA, 19 nt, Homo sapiens
gcugugagauuuguauuuc

SEQ ID NO: 346045 - RNA, 19 nt, Homo sapiens
guagagagagguuugcauu

SEQ ID NO: 346046 - RNA, 19 nt, Homo sapiens
gcgggagggucucaucaaa

SEQ ID NO: 346047 - RNA, 19 nt, Homo sapiens
guuauuacaugcauuugug

SEQ ID NO: 346048 - RNA, 19 nt, Homo sapiens
gauuacuucuugacuauca

SEQ ID NO: 346049 - RNA, 19 nt, Homo sapiens
gggagaagauaagauugaa

SEQ ID NO: 346050 - RNA, 19 nt, Homo sapiens
cagcaacaauggacagguu

SEQ ID NO: 346051 - RNA, 19 nt, Homo sapiens
ugauugacauagcuucuaa

SEQ ID NO: 346052 - RNA, 19 nt, Homo sapiens
gaucaagggugugguuagu

SEQ ID NO: 346053 - RNA, 19 nt, Homo sapiens
ugagagcauucauguuuga

SEQ ID NO: 346054 - RNA, 19 nt, Homo sapiens
gaaccauauucucuuagau

SEQ ID NO: 346055 - RNA, 19 nt, Homo sapiens
ggaucagugucgauacauu

SEQ ID NO: 346056 - RNA, 19 nt, Homo sapiens
uauacagaguugagaguuu

SEQ ID NO: 346057 - RNA, 19 nt, Homo sapiens
uaaagagacuggccaacag

SEQ ID NO: 346058 - RNA, 19 nt, Homo sapiens
gcaggcccaucuagagcua

SEQ ID NO: 346059 - RNA, 19 nt, Homo sapiens
ugagagagaaucacaauca

SEQ ID NO: 346060 - RNA, 19 nt, Homo sapiens
agccaaaguuaccauauuu

SEQ ID NO: 346061 - RNA, 19 nt, Homo sapiens
aaggagaucuggcuucuag

SEQ ID NO: 346062 - RNA, 19 nt, Homo sapiens
uuaccaaacucauagacuu

SEQ ID NO: 346063 - RNA, 19 nt, Homo sapiens
gaggcucugugccguauga

SEQ ID NO: 346064 - RNA, 19 nt, Homo sapiens
gaagguaccggaaagucuu

SEQ ID NO: 346065 - RNA, 19 nt, Homo sapiens
cgaauucuuuggagaggaa

SEQ ID NO: 346066 - RNA, 19 nt, Homo sapiens
aaccuuggcugaacuguga

SEQ ID NO: 346067 - RNA, 19 nt, Homo sapiens
cauucagacuuucagauuu

SEQ ID NO: 346068 - RNA, 19 nt, Homo sapiens
uuucagggcuucuuggauu

SEQ ID NO: 346069 - RNA, 19 nt, Homo sapiens
ggaagaaaugguucaaauc

SEQ ID NO: 346070 - RNA, 19 nt, Homo sapiens
ugucuagaguccuuuguuu

SEQ ID NO: 346071 - RNA, 19 nt, Homo sapiens
aggaagagcuccagcagau

SEQ ID NO: 346072 - RNA, 19 nt, Homo sapiens
guugggagauuugaauuau

SEQ ID NO: 346073 - RNA, 19 nt, Homo sapiens
gcaaagcgagagaaagaau

SEQ ID NO: 346074 - RNA, 19 nt, Homo sapiens
gaaauuaccucccaaguug

SEQ ID NO: 346075 - RNA, 19 nt, Homo sapiens
gcaaagguauuguggauga

SEQ ID NO: 346076 - RNA, 19 nt, Homo sapiens
ugacauagcuucuaacagu

SEQ ID NO: 346077 - RNA, 19 nt, Homo sapiens
gcuaaacccuuuccugauu

SEQ ID NO: 346078 - RNA, 19 nt, Homo sapiens
ggagggaguuuguguuuga

SEQ ID NO: 346079 - RNA, 19 nt, Homo sapiens
gaacgggcaauaugaguua

SEQ ID NO: 346080 - RNA, 19 nt, Homo sapiens
caauauggcuaaacccuuu

SEQ ID NO: 346081 - RNA, 19 nt, Homo sapiens
ccacagaucuggagguaug

SEQ ID NO: 346082 - RNA, 19 nt, Homo sapiens
caaccacccuugccuguuu

SEQ ID NO: 346083 - RNA, 19 nt, Homo sapiens
gaacgaagguaccggaaag

SEQ ID NO: 346084 - RNA, 19 nt, Homo sapiens
ggaugaugcuucuuauauu

SEQ ID NO: 346085 - RNA, 19 nt, Homo sapiens
gggaagaaaugguucaaau

SEQ ID NO: 346086 - RNA, 19 nt, Homo sapiens
ggaagggucuauugcagaa

SEQ ID NO: 346087 - RNA, 19 nt, Homo sapiens
gaaaggaucagugucgaua

SEQ ID NO: 346088 - RNA, 19 nt, Homo sapiens
ugaaaucccugaugaggaa

SEQ ID NO: 346089 - RNA, 19 nt, Homo sapiens
ucucuggucuucugaaaua

SEQ ID NO: 346090 - RNA, 19 nt, Homo sapiens
gaucacauuuaguagcaua

SEQ ID NO: 346091 - RNA, 19 nt, Homo sapiens
ucacugaccugggaucuuu

SEQ ID NO: 346092 - RNA, 19 nt, Homo sapiens
gaaguaaggauuucggauu

SEQ ID NO: 346093 - RNA, 19 nt, Homo sapiens
gaagguacguauucugcaa

SEQ ID NO: 346094 - RNA, 19 nt, Homo sapiens
ggaaauuaccucccaaguu

SEQ ID NO: 346095 - RNA, 19 nt, Homo sapiens
ccucugagcuuuucauuua

SEQ ID NO: 346096 - RNA, 19 nt, Homo sapiens
ggaaccauauucucuuaga

SEQ ID NO: 346097 - RNA, 19 nt, Homo sapiens
gaaaaugacuuccuuccuu

SEQ ID NO: 346098 - RNA, 19 nt, Homo sapiens
cgaagaagacuaaggcuuu

SEQ ID NO: 346099 - RNA, 19 nt, Homo sapiens
ccagugauuucuccuguuu

SEQ ID NO: 346100 - RNA, 19 nt, Homo sapiens
cuacuacaauggcaucuuu

SEQ ID NO: 346101 - RNA, 19 nt, Homo sapiens
gaagauaguguacgcauca

SEQ ID NO: 346102 - RNA, 19 nt, Homo sapiens
uaagaaagaccuucagaga

SEQ ID NO: 346103 - RNA, 19 nt, Homo sapiens
ucaaacauauccuggcaaa

SEQ ID NO: 346104 - RNA, 19 nt, Homo sapiens
gccagaaagugaucacaaa

SEQ ID NO: 346105 - RNA, 19 nt, Homo sapiens
gaaauucgaccagcuaaau

SEQ ID NO: 346106 - RNA, 19 nt, Homo sapiens
gaaaucugcuucccuacca

SEQ ID NO: 346107 - RNA, 19 nt, Homo sapiens
guggaaccauauucucuua

SEQ ID NO: 346108 - RNA, 19 nt, Homo sapiens
caagacagacuccaaguga

SEQ ID NO: 346109 - RNA, 19 nt, Homo sapiens
gagcagaacagguuuguca

SEQ ID NO: 346110 - RNA, 19 nt, Homo sapiens
gagagaaucacaaucagaa

SEQ ID NO: 346111 - RNA, 19 nt, Homo sapiens
ggagaucuggcuucuagua

SEQ ID NO: 346112 - RNA, 19 nt, Homo sapiens
gcgcggagcuguuccucaa

SEQ ID NO: 346113 - RNA, 19 nt, Homo sapiens
gagaagauaagauugaaga

SEQ ID NO: 346114 - RNA, 19 nt, Homo sapiens
ugacuuccuuccuuccuua

SEQ ID NO: 346115 - RNA, 19 nt, Homo sapiens
gaagagcguuuccuaaucc

SEQ ID NO: 346116 - RNA, 19 nt, Homo sapiens
gaacuuggaaugugaaugg

SEQ ID NO: 346117 - RNA, 19 nt, Homo sapiens
ccucuaagguacuaauuug

SEQ ID NO: 346118 - RNA, 19 nt, Homo sapiens
ggaccaaccaagcaccuua

SEQ ID NO: 346119 - RNA, 19 nt, Homo sapiens
ggaagcacuuugaguaucu

SEQ ID NO: 346120 - RNA, 19 nt, Homo sapiens
gggugaagguuguggauga

SEQ ID NO: 346121 - RNA, 19 nt, Homo sapiens
gggaugaugcuucuuauau

SEQ ID NO: 346122 - RNA, 19 nt, Homo sapiens
ccugauaucuacugcauug

SEQ ID NO: 346123 - RNA, 19 nt, Homo sapiens
gggagggucucaucaaaca

SEQ ID NO: 346124 - RNA, 19 nt, Homo sapiens
gcaaggagcauaacguaca

SEQ ID NO: 346125 - RNA, 19 nt, Homo sapiens
gggcagaugucaccuccuu

SEQ ID NO: 346126 - RNA, 19 nt, Homo sapiens
gcaguuauuacaugcauuu

SEQ ID NO: 346127 - RNA, 19 nt, Homo sapiens
guccauggcuguagagaga

SEQ ID NO: 346128 - RNA, 19 nt, Homo sapiens
cuucagauguguucaagaa

SEQ ID NO: 346129 - RNA, 19 nt, Homo sapiens
gaacauauacagaguugag

SEQ ID NO: 346130 - RNA, 19 nt, Homo sapiens
gaagagcuccagcagauca

SEQ ID NO: 346131 - RNA, 19 nt, Homo sapiens
guagaucaccuauucaaau

SEQ ID NO: 346132 - RNA, 19 nt, Homo sapiens
ggagucacauggaacugaa

SEQ ID NO: 346133 - RNA, 19 nt, Homo sapiens
gcacguaugcaguauccua

SEQ ID NO: 346134 - RNA, 19 nt, Homo sapiens
cauauccaguguuguguaa

SEQ ID NO: 346135 - RNA, 19 nt, Homo sapiens
cagcaaagguauuguggau

SEQ ID NO: 346136 - RNA, 19 nt, Homo sapiens
caugaucgcuacucucuuc

SEQ ID NO: 346137 - RNA, 19 nt, Homo sapiens
gagaugccauagaaauguu

SEQ ID NO: 346138 - RNA, 19 nt, Homo sapiens
agaaagaccuucagagacu

SEQ ID NO: 346139 - RNA, 19 nt, Homo sapiens
gagggucucaucaaacaua

SEQ ID NO: 346140 - RNA, 19 nt, Homo sapiens
gcuuugaaaucccugauga

SEQ ID NO: 346141 - RNA, 19 nt, Homo sapiens
uugaguaucugaagaguga

SEQ ID NO: 346142 - RNA, 19 nt, Homo sapiens
ucucuuagaucacauuuag

SEQ ID NO: 346143 - RNA, 19 nt, Homo sapiens
gaaaucccuucugcaaaug

SEQ ID NO: 346144 - RNA, 19 nt, Homo sapiens
gcugugagauuuguauuuc

SEQ ID NO: 346145 - RNA, 19 nt, Homo sapiens
guagagagagguuugcauu

SEQ ID NO: 346146 - RNA, 19 nt, Homo sapiens
gcgggagggucucaucaaa

SEQ ID NO: 346147 - RNA, 19 nt, Homo sapiens
guuauuacaugcauuugug

SEQ ID NO: 346148 - RNA, 19 nt, Homo sapiens
gauuacuucuugacuauca

SEQ ID NO: 346149 - RNA, 19 nt, Homo sapiens
gggagaagauaagauugaa

SEQ ID NO: 346150 - RNA, 19 nt, Homo sapiens
cagcaacaauggacagguu

SEQ ID NO: 346151 - RNA, 19 nt, Homo sapiens
ugauugacauagcuucuaa

SEQ ID NO: 346152 - RNA, 19 nt, Homo sapiens
gaucaagggugugguuagu

SEQ ID NO: 346153 - RNA, 19 nt, Homo sapiens
ugagagcauucauguuuga

SEQ ID NO: 346154 - RNA, 19 nt, Homo sapiens
gaaccauauucucuuagau

SEQ ID NO: 346155 - RNA, 19 nt, Homo sapiens
ggaucagugucgauacauu

SEQ ID NO: 346156 - RNA, 19 nt, Homo sapiens
uauacagaguugagaguuu

SEQ ID NO: 346157 - RNA, 19 nt, Homo sapiens
uaaagagacuggccaacag

SEQ ID NO: 346158 - RNA, 19 nt, Homo sapiens
gcaggcccaucuagagcua

SEQ ID NO: 346159 - RNA, 19 nt, Homo sapiens
ugagagagaaucacaauca

SEQ ID NO: 346160 - RNA, 19 nt, Homo sapiens
agccaaaguuaccauauuu

SEQ ID NO: 346161 - RNA, 19 nt, Homo sapiens
aaggagaucuggcuucuag

SEQ ID NO: 346162 - RNA, 19 nt, Homo sapiens
uuaccaaacucauagacuu

SEQ ID NO: 346163 - RNA, 19 nt, Homo sapiens
gaggcucugugccguauga

SEQ ID NO: 346164 - RNA, 19 nt, Homo sapiens
gaagguaccggaaagucuu

SEQ ID NO: 346165 - RNA, 19 nt, Homo sapiens
cgaauucuuuggagaggaa

SEQ ID NO: 346166 - RNA, 19 nt, Homo sapiens
aaccuuggcugaacuguga

SEQ ID NO: 346167 - RNA, 19 nt, Homo sapiens
cauucagacuuucagauuu

SEQ ID NO: 346168 - RNA, 19 nt, Homo sapiens
uuucagggcuucuuggauu

SEQ ID NO: 346169 - RNA, 19 nt, Homo sapiens
ggaagaaaugguucaaauc

SEQ ID NO: 346170 - RNA, 19 nt, Homo sapiens
ugucuagaguccuuuguuu

SEQ ID NO: 346171 - RNA, 19 nt, Homo sapiens
aggaagagcuccagcagau

SEQ ID NO: 346172 - RNA, 19 nt, Homo sapiens
guugggagauuugaauuau

SEQ ID NO: 346173 - RNA, 19 nt, Homo sapiens
gcaaagcgagagaaagaau

SEQ ID NO: 346174 - RNA, 19 nt, Homo sapiens
gagcagaccuuuauguauu

SEQ ID NO: 346175 - RNA, 19 nt, Homo sapiens
gcagucaaauguaaugaua

SEQ ID NO: 346176 - RNA, 19 nt, Homo sapiens
gaacaacuuugguaaugaa

SEQ ID NO: 346177 - RNA, 19 nt, Homo sapiens
gugagaagcuggaaauauu

SEQ ID NO: 346178 - RNA, 19 nt, Homo sapiens
cgaaagagcuaaauaucga

SEQ ID NO: 346179 - RNA, 19 nt, Homo sapiens
gcagagggauuuggaauuc

SEQ ID NO: 346180 - RNA, 19 nt, Homo sapiens
ggauaugggucacacuuau

SEQ ID NO: 346181 - RNA, 19 nt, Homo sapiens
gaaguugaguugaugaaag

SEQ ID NO: 346182 - RNA, 19 nt, Homo sapiens
gaacaucaagaaaucauga

SEQ ID NO: 346183 - RNA, 19 nt, Homo sapiens
ucaauuccaucucuuaguu

SEQ ID NO: 346184 - RNA, 19 nt, Homo sapiens
gaagagaucaccggcguaa

SEQ ID NO: 346185 - RNA, 19 nt, Homo sapiens
caaauuaaguaugcugcua

SEQ ID NO: 346186 - RNA, 19 nt, Homo sapiens
gagcacaucccaaagcaaa

SEQ ID NO: 346187 - RNA, 19 nt, Homo sapiens
gugauuggaugcucuuuga

SEQ ID NO: 346188 - RNA, 19 nt, Homo sapiens
acaaauacuuuccgucaga

SEQ ID NO: 346189 - RNA, 19 nt, Homo sapiens
ggugucagcuuccauguag

SEQ ID NO: 346190 - RNA, 19 nt, Homo sapiens
gcaaagccaucgugaagac

SEQ ID NO: 346191 - RNA, 19 nt, Homo sapiens
aaagagaccuaaaccagau

SEQ ID NO: 346192 - RNA, 19 nt, Homo sapiens
gcagccauauggaagacua

SEQ ID NO: 346193 - RNA, 19 nt, Homo sapiens
gcacucugguagcuguuaa

SEQ ID NO: 346194 - RNA, 19 nt, Homo sapiens
uaaaccagaugagaaguau

SEQ ID NO: 346195 - RNA, 19 nt, Homo sapiens
gaucuacuaugugauguca

SEQ ID NO: 346196 - RNA, 19 nt, Homo sapiens
ggccgacgaucuacuaugu

SEQ ID NO: 346197 - RNA, 19 nt, Homo sapiens
cagaugagaaguauuauuc

SEQ ID NO: 346198 - RNA, 19 nt, Homo sapiens
aaccagaugagaaguauua

SEQ ID NO: 346199 - RNA, 19 nt, Homo sapiens
cgagugagcagaccuuuau

SEQ ID NO: 346200 - RNA, 19 nt, Homo sapiens
gggaccauguaacuuaauu

SEQ ID NO: 346201 - RNA, 19 nt, Homo sapiens
cagauacuauguugcauca

SEQ ID NO: 346202 - RNA, 19 nt, Homo sapiens
agaaacaucugaggugguu

SEQ ID NO: 346203 - RNA, 19 nt, Homo sapiens
gagaguugccuuugugaga

SEQ ID NO: 346204 - RNA, 19 nt, Homo sapiens
ggaccauguaacuuaauua

SEQ ID NO: 346205 - RNA, 19 nt, Homo sapiens
cugaggaugugaaacuuaa

SEQ ID NO: 346206 - RNA, 19 nt, Homo sapiens
gagguugguuucagcaugu

SEQ ID NO: 346207 - RNA, 19 nt, Homo sapiens
gaaaucaugaacaacuuug

SEQ ID NO: 346208 - RNA, 19 nt, Homo sapiens
gacgggcucugaugacgaa

SEQ ID NO: 346209 - RNA, 19 nt, Homo sapiens
ugaacaacuuugguaauga

SEQ ID NO: 346210 - RNA, 19 nt, Homo sapiens
uagcuugaauuaagggauu

SEQ ID NO: 346211 - RNA, 19 nt, Homo sapiens
cggcuaguauuaaugugua

SEQ ID NO: 346212 - RNA, 19 nt, Homo sapiens
caugggcgcuuacacuguu

SEQ ID NO: 346213 - RNA, 19 nt, Homo sapiens
cagagaggauuaucuaugc

SEQ ID NO: 346214 - RNA, 19 nt, Homo sapiens
ccgacgaucuacuauguga

SEQ ID NO: 346215 - RNA, 19 nt, Homo sapiens
gauuggaugcucuuugaaa

SEQ ID NO: 346216 - RNA, 19 nt, Homo sapiens
gaccuaaaccagaugagaa

SEQ ID NO: 346217 - RNA, 19 nt, Homo sapiens
uggcgucuauggaucauuu

SEQ ID NO: 346218 - RNA, 19 nt, Homo sapiens
gggcgaaagagcuaaauau

SEQ ID NO: 346219 - RNA, 19 nt, Homo sapiens
uagcaagacugaaauacag

SEQ ID NO: 346220 - RNA, 19 nt, Homo sapiens
caacuuugguaaugaagag

SEQ ID NO: 346221 - RNA, 19 nt, Homo sapiens
caagaaaucaugaacaacu

SEQ ID NO: 346222 - RNA, 19 nt, Homo sapiens
acccagcguuggacaaaua

SEQ ID NO: 346223 - RNA, 19 nt, Homo sapiens
uggaauuccuggagaguug

SEQ ID NO: 346224 - RNA, 19 nt, Homo sapiens
agcagaccuuuauguauua

SEQ ID NO: 346225 - RNA, 19 nt, Homo sapiens
gugagcagaccuuuaugua

SEQ ID NO: 346226 - RNA, 19 nt, Homo sapiens
aaacaucugaggugguuaa

SEQ ID NO: 346227 - RNA, 19 nt, Homo sapiens
cauaggaacaucaagaaau

SEQ ID NO: 346228 - RNA, 19 nt, Homo sapiens
gcucugaugacgaagauga

SEQ ID NO: 346229 - RNA, 19 nt, Homo sapiens
aaagcagucugucgucuca

SEQ ID NO: 346230 - RNA, 19 nt, Homo sapiens
ccagagaggauuaucuaug

SEQ ID NO: 346231 - RNA, 19 nt, Homo sapiens
gaucugaggaugugaaacu

SEQ ID NO: 346232 - RNA, 19 nt, Homo sapiens
guaccgauccugagaccuu

SEQ ID NO: 346233 - RNA, 19 nt, Homo sapiens
aaauaucgauguuguuggu

SEQ ID NO: 346234 - RNA, 19 nt, Homo sapiens
auaggaacaucaagaaauc

SEQ ID NO: 346235 - RNA, 19 nt, Homo sapiens
ggaacgggcgaaagagcua

SEQ ID NO: 346236 - RNA, 19 nt, Homo sapiens
ggauuugacugugcuagca

SEQ ID NO: 346237 - RNA, 19 nt, Homo sapiens
gaaaguugccagagcacau

SEQ ID NO: 346238 - RNA, 19 nt, Homo sapiens
ugagaagcuggaaauauuu

SEQ ID NO: 346239 - RNA, 19 nt, Homo sapiens
gcuugcaguuaauaucauu

SEQ ID NO: 346240 - RNA, 19 nt, Homo sapiens
gaugaugacuuuugauagu

SEQ ID NO: 346241 - RNA, 19 nt, Homo sapiens
gcagaccuuuauguauuau

SEQ ID NO: 346242 - RNA, 19 nt, Homo sapiens
guuaauaucauugccaaga

SEQ ID NO: 346243 - RNA, 19 nt, Homo sapiens
cuaaauaucgauguuguug

SEQ ID NO: 346244 - RNA, 19 nt, Homo sapiens
gugaagacccuugcugcua

SEQ ID NO: 346245 - RNA, 19 nt, Homo sapiens
gcacccugccugugucuug

SEQ ID NO: 346246 - RNA, 19 nt, Homo sapiens
cgaaguagaggaacaggau

SEQ ID NO: 346247 - RNA, 19 nt, Homo sapiens
gaaaugcaugugggugauu

SEQ ID NO: 346248 - RNA, 19 nt, Homo sapiens
cuaaaccagaugagaagua

SEQ ID NO: 346249 - RNA, 19 nt, Homo sapiens
uaaagccccuucugcaaaa

SEQ ID NO: 346250 - RNA, 19 nt, Homo sapiens
uagcaaagccaucgugaag

SEQ ID NO: 346251 - RNA, 19 nt, Homo sapiens
uuaguguugugaccuguuu

SEQ ID NO: 346252 - RNA, 19 nt, Homo sapiens
guauuaauguguagauagc

SEQ ID NO: 346253 - RNA, 19 nt, Homo sapiens
gaccugggagacauucuaa

SEQ ID NO: 346254 - RNA, 19 nt, Homo sapiens
agaguugccuuugugagaa

SEQ ID NO: 346255 - RNA, 19 nt, Homo sapiens
ggcgguggcuuuccuggau

SEQ ID NO: 346256 - RNA, 19 nt, Homo sapiens
cuaugcaaauccuuguaaa

SEQ ID NO: 346257 - RNA, 19 nt, Homo sapiens
ggcaacucaugcagcaauu

SEQ ID NO: 346258 - RNA, 19 nt, Homo sapiens
gacgaucuacuaugugaug

SEQ ID NO: 346259 - RNA, 19 nt, Homo sapiens
cagagcacaucccaaagca

SEQ ID NO: 346260 - RNA, 19 nt, Homo sapiens
gugcuucggcuaguauuaa

SEQ ID NO: 346261 - RNA, 19 nt, Homo sapiens
augaacaacuuugguaaug

SEQ ID NO: 346262 - RNA, 19 nt, Homo sapiens
ugugaaugauggcgucuau

SEQ ID NO: 346263 - RNA, 19 nt, Homo sapiens
gaggaugugaaacuuaaau

SEQ ID NO: 346264 - RNA, 19 nt, Homo sapiens
ggauugccacugaugauuc

SEQ ID NO: 346265 - RNA, 19 nt, Homo sapiens
gcacaucccaaagcaaagu

SEQ ID NO: 346266 - RNA, 19 nt, Homo sapiens
gagaggauuaucuaugcaa

SEQ ID NO: 346267 - RNA, 19 nt, Homo sapiens
ccugggcgcucugagauug

SEQ ID NO: 346268 - RNA, 19 nt, Homo sapiens
caucugaggugguuaaaag

SEQ ID NO: 346269 - RNA, 19 nt, Homo sapiens
cagacacgcuacucaagag

SEQ ID NO: 346270 - RNA, 19 nt, Homo sapiens
guauuauucauccagcaua

SEQ ID NO: 346271 - RNA, 19 nt, Homo sapiens
gaaugauggcgucuaugga

SEQ ID NO: 346272 - RNA, 19 nt, Homo sapiens
gggcucugaugacgaagau

SEQ ID NO: 346273 - RNA, 19 nt, Homo sapiens
gagaucaccggcguaauca

SEQ ID NO: 346274 - RNA, 19 nt, Homo sapiens
guaggaaacugaauacaua

SEQ ID NO: 346275 - RNA, 19 nt, Homo sapiens
gagaagggcuuagaacaaa

SEQ ID NO: 346276 - RNA, 19 nt, Homo sapiens
uaaagaagguggacagaga

SEQ ID NO: 346277 - RNA, 19 nt, Homo sapiens
cauaggaacccauuacuua

SEQ ID NO: 346278 - RNA, 19 nt, Homo sapiens
gaccaucucucagaaguuu

SEQ ID NO: 346279 - RNA, 19 nt, Homo sapiens
guacguaggaaacugaaua

SEQ ID NO: 346280 - RNA, 19 nt, Homo sapiens
gaagggacauaaagaaggu

SEQ ID NO: 346281 - RNA, 19 nt, Homo sapiens
cauaauggcugcacugagu

SEQ ID NO: 346282 - RNA, 19 nt, Homo sapiens
cauguugccugugugauua

SEQ ID NO: 346283 - RNA, 19 nt, Homo sapiens
gaacuaaggcaacugagau

SEQ ID NO: 346284 - RNA, 19 nt, Homo sapiens
gaaacugaauacauaacug

SEQ ID NO: 346285 - RNA, 19 nt, Homo sapiens
gagaagaacaacaaauaga

SEQ ID NO: 346286 - RNA, 19 nt, Homo sapiens
gaagguggacagagaacua

SEQ ID NO: 346287 - RNA, 19 nt, Homo sapiens
guaggaagaugauuuugua

SEQ ID NO: 346288 - RNA, 19 nt, Homo sapiens
ccaggcagcucucccaaug

SEQ ID NO: 346289 - RNA, 19 nt, Homo sapiens
ugagaugcaucgacgaauu

SEQ ID NO: 346290 - RNA, 19 nt, Homo sapiens
caaagguacucacagaaca

SEQ ID NO: 346291 - RNA, 19 nt, Homo sapiens
gagaugcaucgacgaauuu

SEQ ID NO: 346292 - RNA, 19 nt, Homo sapiens
gaaguacguaggaaacuga

SEQ ID NO: 346293 - RNA, 19 nt, Homo sapiens
caucagagccauagaagau

SEQ ID NO: 346294 - RNA, 19 nt, Homo sapiens
gcugugacuugcacccaua

SEQ ID NO: 346295 - RNA, 19 nt, Homo sapiens
gaagggcuuagaacaaauu

SEQ ID NO: 346296 - RNA, 19 nt, Homo sapiens
acaaucaggugugaccaua

SEQ ID NO: 346297 - RNA, 19 nt, Homo sapiens
aaacugagaagaacaacaa

SEQ ID NO: 346298 - RNA, 19 nt, Homo sapiens
ggagugccauuucccaaag

SEQ ID NO: 346299 - RNA, 19 nt, Homo sapiens
cugagaagaacaacaaaua

SEQ ID NO: 346300 - RNA, 19 nt, Homo sapiens
ucagagccauagaagauga

SEQ ID NO: 346301 - RNA, 19 nt, Homo sapiens
agugaaggauggaaaggua

SEQ ID NO: 346302 - RNA, 19 nt, Homo sapiens
ugaacccgaucaagucaaa

SEQ ID NO: 346303 - RNA, 19 nt, Homo sapiens
cgacugccuuggaucgaaa

SEQ ID NO: 346304 - RNA, 19 nt, Homo sapiens
gcauaggaacccauuacuu

SEQ ID NO: 346305 - RNA, 19 nt, Homo sapiens
uaggaucggugaauguaug

SEQ ID NO: 346306 - RNA, 19 nt, Homo sapiens
ucagaaguuuggagaggaa

SEQ ID NO: 346307 - RNA, 19 nt, Homo sapiens
ggaagaugauuuuguaaag

SEQ ID NO: 346308 - RNA, 19 nt, Homo sapiens
ucagaagggacauaaagaa

SEQ ID NO: 346309 - RNA, 19 nt, Homo sapiens
ugagaagggcuuagaacaa

SEQ ID NO: 346310 - RNA, 19 nt, Homo sapiens
gaaagccaucagagccaua

SEQ ID NO: 346311 - RNA, 19 nt, Homo sapiens
aaucaggugugaccauaau

SEQ ID NO: 346312 - RNA, 19 nt, Homo sapiens
caauguuucuccucuccuu

SEQ ID NO: 346313 - RNA, 19 nt, Homo sapiens
ggagaggaaagccaucaga

SEQ ID NO: 346314 - RNA, 19 nt, Homo sapiens
gcgaccaucucucagaagu

SEQ ID NO: 346315 - RNA, 19 nt, Homo sapiens
aggcagcucucccaauguu

SEQ ID NO: 346316 - RNA, 19 nt, Homo sapiens
acagaacaaucagguguga

SEQ ID NO: 346317 - RNA, 19 nt, Homo sapiens
caagucaaaguucgaguga

SEQ ID NO: 346318 - RNA, 19 nt, Homo sapiens
ucccaaagguacucacaga

SEQ ID NO: 346319 - RNA, 19 nt, Homo sapiens
uaauagaagucaguuacuc

SEQ ID NO: 346320 - RNA, 19 nt, Homo sapiens
gcagcugugucaagaucga

SEQ ID NO: 346321 - RNA, 19 nt, Homo sapiens
gauggaaagguaugugugu

SEQ ID NO: 346322 - RNA, 19 nt, Homo sapiens
agucaaaguucgagugaag

SEQ ID NO: 346323 - RNA, 19 nt, Homo sapiens
gcagcucucccaauguuuc

SEQ ID NO: 346324 - RNA, 19 nt, Homo sapiens
gagcuugccaaacugagaa

SEQ ID NO: 346325 - RNA, 19 nt, Homo sapiens
cugaauacauaacugcaau

SEQ ID NO: 346326 - RNA, 19 nt, Homo sapiens
ggaaacugaauacauaacu

SEQ ID NO: 346327 - RNA, 19 nt, Homo sapiens
acaugaacaucugcaaaga

SEQ ID NO: 346328 - RNA, 19 nt, Homo sapiens
gguacucacagaacaauca

SEQ ID NO: 346329 - RNA, 19 nt, Homo sapiens
ugugaucucuacccauguu

SEQ ID NO: 346330 - RNA, 19 nt, Homo sapiens
cggcagcugugucaagauc

SEQ ID NO: 346331 - RNA, 19 nt, Homo sapiens
ccauguugccugugugauu

SEQ ID NO: 346332 - RNA, 19 nt, Homo sapiens
auaggaacccauuacuuaa

SEQ ID NO: 346333 - RNA, 19 nt, Homo sapiens
ugagaagaacaacaaauag

SEQ ID NO: 346334 - RNA, 19 nt, Homo sapiens
uaaggcaacugagaugcau

SEQ ID NO: 346335 - RNA, 19 nt, Homo sapiens
ugaaguacguaggaaacug

SEQ ID NO: 346336 - RNA, 19 nt, Homo sapiens
cuacaugaacaucugcaaa

SEQ ID NO: 346337 - RNA, 19 nt, Homo sapiens
aaguacagcuacaugaaca

SEQ ID NO: 346338 - RNA, 19 nt, Homo sapiens
gcgagagcuugccaaacug

SEQ ID NO: 346339 - RNA, 19 nt, Homo sapiens
gaauacauaacugcaaucu

SEQ ID NO: 346340 - RNA, 19 nt, Homo sapiens
augaacaucugcaaagagu

SEQ ID NO: 346341 - RNA, 19 nt, Homo sapiens
agcgagagcuugccaaacu

SEQ ID NO: 346342 - RNA, 19 nt, Homo sapiens
cuacccauguugccugugu

SEQ ID NO: 346343 - RNA, 19 nt, Homo sapiens
aaagaagguggacagagaa

SEQ ID NO: 346344 - RNA, 19 nt, Homo sapiens
gcgcauaggaacccauuac

SEQ ID NO: 346345 - RNA, 19 nt, Homo sapiens
gaauguaugcgguuuugaa

SEQ ID NO: 346346 - RNA, 19 nt, Homo sapiens
ccaaagguacucacagaac

SEQ ID NO: 346347 - RNA, 19 nt, Homo sapiens
gcccauaugauccuugcaa

SEQ ID NO: 346348 - RNA, 19 nt, Homo sapiens
ggaugagaaggauguaaca

SEQ ID NO: 346349 - RNA, 19 nt, Homo sapiens
cagaagggacauaaagaag

SEQ ID NO: 346350 - RNA, 19 nt, Homo sapiens
agaagggcuuagaacaaau

SEQ ID NO: 346351 - RNA, 19 nt, Homo sapiens
agagaacuaaggcaacuga

SEQ ID NO: 346352 - RNA, 19 nt, Homo sapiens
caaucaggugugaccauaa

SEQ ID NO: 346353 - RNA, 19 nt, Homo sapiens
gccaaacugagaagaacaa

SEQ ID NO: 346354 - RNA, 19 nt, Homo sapiens
gugauuauaagcuuuacug

SEQ ID NO: 346355 - RNA, 19 nt, Homo sapiens
ccugugugauuauaagcuu

SEQ ID NO: 346356 - RNA, 19 nt, Homo sapiens
ccauauccguacugcuugu

SEQ ID NO: 346357 - RNA, 19 nt, Homo sapiens
cgagagcuugccaaacuga

SEQ ID NO: 346358 - RNA, 19 nt, Homo sapiens
cugcgaccaucucucagaa

SEQ ID NO: 346359 - RNA, 19 nt, Homo sapiens
gcucuugcggccuguguga

SEQ ID NO: 346360 - RNA, 19 nt, Homo sapiens
ccguacugcuugugcuauu

SEQ ID NO: 346361 - RNA, 19 nt, Homo sapiens
cguaggaaacugaauacau

SEQ ID NO: 346362 - RNA, 19 nt, Homo sapiens
uguaaagugcgcauaggaa

SEQ ID NO: 346363 - RNA, 19 nt, Homo sapiens
gucagaagggacauaaaga

SEQ ID NO: 346364 - RNA, 19 nt, Homo sapiens
acagcuacaugaacaucug

SEQ ID NO: 346365 - RNA, 19 nt, Homo sapiens
acagagaacuaaggcaacu

SEQ ID NO: 346366 - RNA, 19 nt, Homo sapiens
ucaaaguucgagugaagga

SEQ ID NO: 346367 - RNA, 19 nt, Homo sapiens
gaaggauggaaagguaugu

SEQ ID NO: 346368 - RNA, 19 nt, Homo sapiens
guacagcuacaugaacauc

SEQ ID NO: 346369 - RNA, 19 nt, Homo sapiens
aaagguacucacagaacaa

SEQ ID NO: 346370 - RNA, 19 nt, Homo sapiens
agaacuaaggcaacugaga

SEQ ID NO: 346371 - RNA, 19 nt, Homo sapiens
caaagaggauucugaaaga

SEQ ID NO: 346372 - RNA, 19 nt, Homo sapiens
gaagauugauagucuaaug

SEQ ID NO: 346373 - RNA, 19 nt, Homo sapiens
uaacagaucuuguaaacca

SEQ ID NO: 346374 - RNA, 19 nt, Homo sapiens
gaagggagaccgagacaaa

SEQ ID NO: 346375 - RNA, 19 nt, Homo sapiens
gaacggaagccaaccauga

SEQ ID NO: 346376 - RNA, 19 nt, Homo sapiens
uaagugaccucucuacaga

SEQ ID NO: 346377 - RNA, 19 nt, Homo sapiens
ggccuuaaauuuacuacua

SEQ ID NO: 346378 - RNA, 19 nt, Homo sapiens
ccucugagcuuucuaaauc

SEQ ID NO: 346379 - RNA, 19 nt, Homo sapiens
uaacgagucucacgcagaa

SEQ ID NO: 346380 - RNA, 19 nt, Homo sapiens
aagaugagaugaacaaaga

SEQ ID NO: 346381 - RNA, 19 nt, Homo sapiens
agaacaagauccuuaaaga

SEQ ID NO: 346382 - RNA, 19 nt, Homo sapiens
gcaacucgcugacaaggau

SEQ ID NO: 346383 - RNA, 19 nt, Homo sapiens
ugacuuugcuccuuccuuu

SEQ ID NO: 346384 - RNA, 19 nt, Homo sapiens
cgacaggccuuaaauuuac

SEQ ID NO: 346385 - RNA, 19 nt, Homo sapiens
gaaggcaguuccagucuca

SEQ ID NO: 346386 - RNA, 19 nt, Homo sapiens
gguaacagaucuuguaaac

SEQ ID NO: 346387 - RNA, 19 nt, Homo sapiens
gaacaagauccuuaaagau

SEQ ID NO: 346388 - RNA, 19 nt, Homo sapiens
ggaaauuauuguccugaau

SEQ ID NO: 346389 - RNA, 19 nt, Homo sapiens
uuaugucgcugaagcuuua

SEQ ID NO: 346390 - RNA, 19 nt, Homo sapiens
ugaaggaguugaagcagaa

SEQ ID NO: 346391 - RNA, 19 nt, Homo sapiens
gcaaagaggauucugaaag

SEQ ID NO: 346392 - RNA, 19 nt, Homo sapiens
gagaaggagugccucaugu

SEQ ID NO: 346393 - RNA, 19 nt, Homo sapiens
gaaauuauuguccugaaug

SEQ ID NO: 346394 - RNA, 19 nt, Homo sapiens
ucacagccaucauaucaga

SEQ ID NO: 346395 - RNA, 19 nt, Homo sapiens
aaagagaacaagauccuua

SEQ ID NO: 346396 - RNA, 19 nt, Homo sapiens
caaagaggcugagaacagu

SEQ ID NO: 346397 - RNA, 19 nt, Homo sapiens
acaagauccuuaaagauga

SEQ ID NO: 346398 - RNA, 19 nt, Homo sapiens
ggagauggcgagagagaaa

SEQ ID NO: 346399 - RNA, 19 nt, Homo sapiens
ggaaauacaaugugagaag

SEQ ID NO: 346400 - RNA, 19 nt, Homo sapiens
cgacuucaacgacuucaua

SEQ ID NO: 346401 - RNA, 19 nt, Homo sapiens
acaaagagagcuugaagaa

SEQ ID NO: 346402 - RNA, 19 nt, Homo sapiens
gaagaaacaccuacaacag

SEQ ID NO: 346403 - RNA, 19 nt, Homo sapiens
ccaagaauccaccucauug

SEQ ID NO: 346404 - RNA, 19 nt, Homo sapiens
aggaaucucucucagguuu

SEQ ID NO: 346405 - RNA, 19 nt, Homo sapiens
uggaugaacuggagaggaa

SEQ ID NO: 346406 - RNA, 19 nt, Homo sapiens
uacagaagaugaugacuca

SEQ ID NO: 346407 - RNA, 19 nt, Homo sapiens
ucgacaggccuuaaauuua

SEQ ID NO: 346408 - RNA, 19 nt, Homo sapiens
gcuagaacgcugugacaaa

SEQ ID NO: 346409 - RNA, 19 nt, Homo sapiens
gaccuugagcuggaaauua

SEQ ID NO: 346410 - RNA, 19 nt, Homo sapiens
ccaagcacuucacaauaga

SEQ ID NO: 346411 - RNA, 19 nt, Homo sapiens
cccaagcacuucacaauag

SEQ ID NO: 346412 - RNA, 19 nt, Homo sapiens
caaguguaaugccaauuuc

SEQ ID NO: 346413 - RNA, 19 nt, Homo sapiens
ggaggcagguggaacaaac

SEQ ID NO: 346414 - RNA, 19 nt, Homo sapiens
agaaggauccgccugcuuu

SEQ ID NO: 346415 - RNA, 19 nt, Homo sapiens
uggagcagcugaaggaguu

SEQ ID NO: 346416 - RNA, 19 nt, Homo sapiens
ggagauccagcccuaagaa

SEQ ID NO: 346417 - RNA, 19 nt, Homo sapiens
ccgcugugcuucacuaaau

SEQ ID NO: 346418 - RNA, 19 nt, Homo sapiens
ggagaaggagugccucaug

SEQ ID NO: 346419 - RNA, 19 nt, Homo sapiens
gguaccacauuuuaacuua

SEQ ID NO: 346420 - RNA, 19 nt, Homo sapiens
ggagagugccauugaagau

SEQ ID NO: 346421 - RNA, 19 nt, Homo sapiens
auaaacagcugagucugaa

SEQ ID NO: 346422 - RNA, 19 nt, Homo sapiens
auuggaggcugaugaagua

SEQ ID NO: 346423 - RNA, 19 nt, Homo sapiens
ucucuggaaugcauuuauu

SEQ ID NO: 346424 - RNA, 19 nt, Homo sapiens
gcuaugagcggaagaacau

SEQ ID NO: 346425 - RNA, 19 nt, Homo sapiens
gcagcgggaaucagcauaa

SEQ ID NO: 346426 - RNA, 19 nt, Homo sapiens
aaagacagccucugagcuu

SEQ ID NO: 346427 - RNA, 19 nt, Homo sapiens
ucugggaucuguucuggaa

SEQ ID NO: 346428 - RNA, 19 nt, Homo sapiens
ugaaugaccggguaacaga

SEQ ID NO: 346429 - RNA, 19 nt, Homo sapiens
ccaaagaggcugagaacag

SEQ ID NO: 346430 - RNA, 19 nt, Homo sapiens
ggaggccgacucagagaaa

SEQ ID NO: 346431 - RNA, 19 nt, Homo sapiens
agaggauucugaaagacua

SEQ ID NO: 346432 - RNA, 19 nt, Homo sapiens
cagaaaagcuggucucagu

SEQ ID NO: 346433 - RNA, 19 nt, Homo sapiens
acaaguguaaugccaauuu

SEQ ID NO: 346434 - RNA, 19 nt, Homo sapiens
acauuaggguaccacauuu

SEQ ID NO: 346435 - RNA, 19 nt, Homo sapiens
cgaccucacagccaucaua

SEQ ID NO: 346436 - RNA, 19 nt, Homo sapiens
gaagaacaucgaccucaca

SEQ ID NO: 346437 - RNA, 19 nt, Homo sapiens
gagaugaacaaagagauug

SEQ ID NO: 346438 - RNA, 19 nt, Homo sapiens
gagaacaagauccuuaaag

SEQ ID NO: 346439 - RNA, 19 nt, Homo sapiens
aacaaacccuggaggagaa

SEQ ID NO: 346440 - RNA, 19 nt, Homo sapiens
gggaacagcacugcaaaga

SEQ ID NO: 346441 - RNA, 19 nt, Homo sapiens
ugcagaagcugagcacauu

SEQ ID NO: 346442 - RNA, 19 nt, Homo sapiens
ccucacagccaucauauca

SEQ ID NO: 346443 - RNA, 19 nt, Homo sapiens
aacaagauccuuaaagaug

SEQ ID NO: 346444 - RNA, 19 nt, Homo sapiens
ggaugauugacaacuauaa

SEQ ID NO: 346445 - RNA, 19 nt, Homo sapiens
gcaugaaggaggagaagga

SEQ ID NO: 346446 - RNA, 19 nt, Homo sapiens
ucaggucacuguaaaauga

SEQ ID NO: 346447 - RNA, 19 nt, Homo sapiens
gauauagucaccuguugga

SEQ ID NO: 346448 - RNA, 19 nt, Homo sapiens
gcaggaagcacuugguuuu

SEQ ID NO: 346449 - RNA, 19 nt, Homo sapiens
gcgagcagcccagaacaaa

SEQ ID NO: 346450 - RNA, 19 nt, Homo sapiens
cuagaacgcugugacaaag

SEQ ID NO: 346451 - RNA, 19 nt, Homo sapiens
caacaucgagcgcaugaag

SEQ ID NO: 346452 - RNA, 19 nt, Homo sapiens
ucagagaggacguuugaug

SEQ ID NO: 346453 - RNA, 19 nt, Homo sapiens
gcuccuuccuuuccugaga

SEQ ID NO: 346454 - RNA, 19 nt, Homo sapiens
gaugagaugaacaaagaga

SEQ ID NO: 346455 - RNA, 19 nt, Homo sapiens
gcgguuaagugaccucucu

SEQ ID NO: 346456 - RNA, 19 nt, Homo sapiens
ggaagccaaccaugaagga

SEQ ID NO: 346457 - RNA, 19 nt, Homo sapiens
uuacagcccucauuguuuu

SEQ ID NO: 346458 - RNA, 19 nt, Homo sapiens
ugagaucacuguguagaag

SEQ ID NO: 346459 - RNA, 19 nt, Homo sapiens
uaacuuaccaugacuuugc

SEQ ID NO: 346460 - RNA, 19 nt, Homo sapiens
gccaagccauagcugagaa

SEQ ID NO: 346461 - RNA, 19 nt, Homo sapiens
aagcaaagacagccucuga

SEQ ID NO: 346462 - RNA, 19 nt, Homo sapiens
ggacaucaacacccugaca

SEQ ID NO: 346463 - RNA, 19 nt, Homo sapiens
gauaagaagauugauaguc

SEQ ID NO: 346464 - RNA, 19 nt, Homo sapiens
ugaccucucuacagaagau

SEQ ID NO: 346465 - RNA, 19 nt, Homo sapiens
ucacaagcgaggaaugaaa

SEQ ID NO: 346466 - RNA, 19 nt, Homo sapiens
caucauacgccaacguguu

SEQ ID NO: 346467 - RNA, 19 nt, Homo sapiens
ugacaaagagaacaagauc

SEQ ID NO: 346468 - RNA, 19 nt, Homo sapiens
gagaagagcgaggaguaug

SEQ ID NO: 346469 - RNA, 19 nt, Homo sapiens
gccugugcaugcagauuaa

SEQ ID NO: 346470 - RNA, 19 nt, Homo sapiens
gcagaagcugagcacauuu

SEQ ID NO: 346471 - RNA, 19 nt, Homo sapiens
caaagaggauucugaaaga

SEQ ID NO: 346472 - RNA, 19 nt, Homo sapiens
gaagauugauagucuaaug

SEQ ID NO: 346473 - RNA, 19 nt, Homo sapiens
uaacagaucuuguaaacca

SEQ ID NO: 346474 - RNA, 19 nt, Homo sapiens
gaagggagaccgagacaaa

SEQ ID NO: 346475 - RNA, 19 nt, Homo sapiens
caucagugcugugaaauaa

SEQ ID NO: 346476 - RNA, 19 nt, Homo sapiens
uaagugaccucucuacaga

SEQ ID NO: 346477 - RNA, 19 nt, Homo sapiens
ggagugagcuaucaucagu

SEQ ID NO: 346478 - RNA, 19 nt, Homo sapiens
ccucugagcuuucuaaauc

SEQ ID NO: 346479 - RNA, 19 nt, Homo sapiens
uaacgagucucacgcagaa

SEQ ID NO: 346480 - RNA, 19 nt, Homo sapiens
aagaugagaugaacaaaga

SEQ ID NO: 346481 - RNA, 19 nt, Homo sapiens
agaacaagauccuuaaaga

SEQ ID NO: 346482 - RNA, 19 nt, Homo sapiens
gcaacucgcugacaaggau

SEQ ID NO: 346483 - RNA, 19 nt, Homo sapiens
gaaggcaguuccagucuca

SEQ ID NO: 346484 - RNA, 19 nt, Homo sapiens
gguaacagaucuuguaaac

SEQ ID NO: 346485 - RNA, 19 nt, Homo sapiens
gaacaagauccuuaaagau

SEQ ID NO: 346486 - RNA, 19 nt, Homo sapiens
ggaaauuauuguccugaau

SEQ ID NO: 346487 - RNA, 19 nt, Homo sapiens
uuaugucgcugaagcuuua

SEQ ID NO: 346488 - RNA, 19 nt, Homo sapiens
ugaaggaguugaagcagaa

SEQ ID NO: 346489 - RNA, 19 nt, Homo sapiens
gcaaagaggauucugaaag

SEQ ID NO: 346490 - RNA, 19 nt, Homo sapiens
gagaaggagugccucaugu

SEQ ID NO: 346491 - RNA, 19 nt, Homo sapiens
gaaauuauuguccugaaug

SEQ ID NO: 346492 - RNA, 19 nt, Homo sapiens
ucacagccaucauaucaga

SEQ ID NO: 346493 - RNA, 19 nt, Homo sapiens
aaagagaacaagauccuua

SEQ ID NO: 346494 - RNA, 19 nt, Homo sapiens
uaucaucagugcugugaaa

SEQ ID NO: 346495 - RNA, 19 nt, Homo sapiens
caaagaggcugagaacagu

SEQ ID NO: 346496 - RNA, 19 nt, Homo sapiens
acaagauccuuaaagauga

SEQ ID NO: 346497 - RNA, 19 nt, Homo sapiens
gaaagggucccacgaacug

SEQ ID NO: 346498 - RNA, 19 nt, Homo sapiens
gcagaaagggucccacgaa

SEQ ID NO: 346499 - RNA, 19 nt, Homo sapiens
guaagggacuggcagaaag

SEQ ID NO: 346500 - RNA, 19 nt, Homo sapiens
ggaaauacaaugugagaag

SEQ ID NO: 346501 - RNA, 19 nt, Homo sapiens
acaaagagagcuugaagaa

SEQ ID NO: 346502 - RNA, 19 nt, Homo sapiens
gaagaaacaccuacaacag

SEQ ID NO: 346503 - RNA, 19 nt, Homo sapiens
ccaagaauccaccucauug

SEQ ID NO: 346504 - RNA, 19 nt, Homo sapiens
uacagaagaugaugacuca

SEQ ID NO: 346505 - RNA, 19 nt, Homo sapiens
gcuagaacgcugugacaaa

SEQ ID NO: 346506 - RNA, 19 nt, Homo sapiens
gaccuugagcuggaaauua

SEQ ID NO: 346507 - RNA, 19 nt, Homo sapiens
uggagcagcugaaggaguu

SEQ ID NO: 346508 - RNA, 19 nt, Homo sapiens
ggagaaggagugccucaug

SEQ ID NO: 346509 - RNA, 19 nt, Homo sapiens
auuggaggcugaugaagua

SEQ ID NO: 346510 - RNA, 19 nt, Homo sapiens
gcuaugagcggaagaacau

SEQ ID NO: 346511 - RNA, 19 nt, Homo sapiens
gcagcgggaaucagcauaa

SEQ ID NO: 346512 - RNA, 19 nt, Homo sapiens
aaagacagccucugagcuu

SEQ ID NO: 346513 - RNA, 19 nt, Homo sapiens
ugaaugaccggguaacaga

SEQ ID NO: 346514 - RNA, 19 nt, Homo sapiens
ccaaagaggcugagaacag

SEQ ID NO: 346515 - RNA, 19 nt, Homo sapiens
ggaggccgacucagagaaa

SEQ ID NO: 346516 - RNA, 19 nt, Homo sapiens
agaggauucugaaagacua

SEQ ID NO: 346517 - RNA, 19 nt, Homo sapiens
cagaaaagcuggucucagu

SEQ ID NO: 346518 - RNA, 19 nt, Homo sapiens
cgaccucacagccaucaua

SEQ ID NO: 346519 - RNA, 19 nt, Homo sapiens
gaagaacaucgaccucaca

SEQ ID NO: 346520 - RNA, 19 nt, Homo sapiens
gagaugaacaaagagauug

SEQ ID NO: 346521 - RNA, 19 nt, Homo sapiens
gagaacaagauccuuaaag

SEQ ID NO: 346522 - RNA, 19 nt, Homo sapiens
aacaaacccuggaggagaa

SEQ ID NO: 346523 - RNA, 19 nt, Homo sapiens
gggaacagcacugcaaaga

SEQ ID NO: 346524 - RNA, 19 nt, Homo sapiens
ugcagaagcugagcacauu

SEQ ID NO: 346525 - RNA, 19 nt, Homo sapiens
ccucacagccaucauauca

SEQ ID NO: 346526 - RNA, 19 nt, Homo sapiens
aacaagauccuuaaagaug

SEQ ID NO: 346527 - RNA, 19 nt, Homo sapiens
ggaugauugacaacuauaa

SEQ ID NO: 346528 - RNA, 19 nt, Homo sapiens
gcaugaaggaggagaagga

SEQ ID NO: 346529 - RNA, 19 nt, Homo sapiens
ucaggucacuguaaaauga

SEQ ID NO: 346530 - RNA, 19 nt, Homo sapiens
gguaagggacuggcagaaa

SEQ ID NO: 346531 - RNA, 19 nt, Homo sapiens
cuagaacgcugugacaaag

SEQ ID NO: 346532 - RNA, 19 nt, Homo sapiens
caacaucgagcgcaugaag

SEQ ID NO: 346533 - RNA, 19 nt, Homo sapiens
gaugagaugaacaaagaga

SEQ ID NO: 346534 - RNA, 19 nt, Homo sapiens
uaacugugacgaaaucuca

SEQ ID NO: 346535 - RNA, 19 nt, Homo sapiens
ucagagaggacguuugaug

SEQ ID NO: 346536 - RNA, 19 nt, Homo sapiens
gcgguuaagugaccucucu

SEQ ID NO: 346537 - RNA, 19 nt, Homo sapiens
aagcaaagacagccucuga

SEQ ID NO: 346538 - RNA, 19 nt, Homo sapiens
ggacaucaacacccugaca

SEQ ID NO: 346539 - RNA, 19 nt, Homo sapiens
gauaagaagauugauaguc

SEQ ID NO: 346540 - RNA, 19 nt, Homo sapiens
ucacaagcgaggaaugaaa

SEQ ID NO: 346541 - RNA, 19 nt, Homo sapiens
ugaccucucuacagaagau

SEQ ID NO: 346542 - RNA, 19 nt, Homo sapiens
ugacaaagagaacaagauc

SEQ ID NO: 346543 - RNA, 19 nt, Homo sapiens
gagaagagcgaggaguaug

SEQ ID NO: 346544 - RNA, 19 nt, Homo sapiens
gccugugcaugcagauuaa

SEQ ID NO: 346545 - RNA, 19 nt, Homo sapiens
gcagaagcugagcacauuu

SEQ ID NO: 346546 - RNA, 19 nt, Homo sapiens
gaaaagcuggucucaguga

SEQ ID NO: 346547 - RNA, 19 nt, Homo sapiens
ggccagcuuugcuccaaug

SEQ ID NO: 346548 - RNA, 19 nt, Homo sapiens
ugagaugaacaaagagauu

SEQ ID NO: 346549 - RNA, 19 nt, Homo sapiens
accuugagcuggaaauuau

SEQ ID NO: 346550 - RNA, 19 nt, Homo sapiens
ccgagaagagcgaggagua

SEQ ID NO: 346551 - RNA, 19 nt, Homo sapiens
gacaaagagagcuugaaga

SEQ ID NO: 346552 - RNA, 19 nt, Homo sapiens
gcacagcuucgguccaaag

SEQ ID NO: 346553 - RNA, 19 nt, Homo sapiens
guguaacugugacgaaauc

SEQ ID NO: 346554 - RNA, 19 nt, Homo sapiens
caagauccuuaaagaugag

SEQ ID NO: 346555 - RNA, 19 nt, Homo sapiens
caggaaauacaaugugaga

SEQ ID NO: 346556 - RNA, 19 nt, Homo sapiens
gagggaacagcacugcaaa

SEQ ID NO: 346557 - RNA, 19 nt, Homo sapiens
agaagaaacaccuacaaca

SEQ ID NO: 346558 - RNA, 19 nt, Homo sapiens
uugguugucugaagucuga

SEQ ID NO: 346559 - RNA, 19 nt, Homo sapiens
ucagugcugugaaauaaaa

SEQ ID NO: 346560 - RNA, 19 nt, Homo sapiens
gauuggaggcugaugaagu

SEQ ID NO: 346561 - RNA, 19 nt, Homo sapiens
gggaugauugacaacuaua

SEQ ID NO: 346562 - RNA, 19 nt, Homo sapiens
ccggguaacagaucuugua

SEQ ID NO: 346563 - RNA, 19 nt, Homo sapiens
ucgcugacaaggaucuuua

SEQ ID NO: 346564 - RNA, 19 nt, Homo sapiens
gcacauuugaggagaccaa

SEQ ID NO: 346565 - RNA, 19 nt, Homo sapiens
ugaaggaggagaaggacuu

SEQ ID NO: 346566 - RNA, 19 nt, Homo sapiens
uaaaaggagugagcuauca

SEQ ID NO: 346567 - RNA, 19 nt, Homo sapiens
ccucagugaagaacuauga

SEQ ID NO: 346568 - RNA, 19 nt, Homo sapiens
gggaagaacggaguaacga

SEQ ID NO: 346569 - RNA, 19 nt, Homo sapiens
cagaagcugagcacauuug

SEQ ID NO: 346570 - RNA, 19 nt, Homo sapiens
gcgguugguugucugaagu

SEQ ID NO: 346571 - RNA, 19 nt, Homo sapiens
gcaagaaacuauauaggua

SEQ ID NO: 346572 - RNA, 19 nt, Homo sapiens
gaaagugaguguaucauuu

SEQ ID NO: 346573 - RNA, 19 nt, Homo sapiens
caagacaucccauauaaua

SEQ ID NO: 346574 - RNA, 19 nt, Homo sapiens
ggaaguagcauuagcagua

SEQ ID NO: 346575 - RNA, 19 nt, Homo sapiens
ggugacaucugcaucauuu

SEQ ID NO: 346576 - RNA, 19 nt, Homo sapiens
ccaauaagcucauacaucu

SEQ ID NO: 346577 - RNA, 19 nt, Homo sapiens
gaacaccuauaccuacaaa

SEQ ID NO: 346578 - RNA, 19 nt, Homo sapiens
gaaguagcauuagcaguaa

SEQ ID NO: 346579 - RNA, 19 nt, Homo sapiens
gaacaacgaagcacuaaug

SEQ ID NO: 346580 - RNA, 19 nt, Homo sapiens
gaagcaagcauucuauauu

SEQ ID NO: 346581 - RNA, 19 nt, Homo sapiens
uacaagacaucccauauaa

SEQ ID NO: 346582 - RNA, 19 nt, Homo sapiens
caaacuaucucauugcaau

SEQ ID NO: 346583 - RNA, 19 nt, Homo sapiens
caaugcaacucaucuuaaa

SEQ ID NO: 346584 - RNA, 19 nt, Homo sapiens
gcaacuauccuaaacaaug

SEQ ID NO: 346585 - RNA, 19 nt, Homo sapiens
ccacauagcacauagaaug

SEQ ID NO: 346586 - RNA, 19 nt, Homo sapiens
gaggaaggaaguagcauua

SEQ ID NO: 346587 - RNA, 19 nt, Homo sapiens
caucaucaauguacuguga

SEQ ID NO: 346588 - RNA, 19 nt, Homo sapiens
gguauacacuuacgacuuc

SEQ ID NO: 346589 - RNA, 19 nt, Homo sapiens
gaauuuccauuuccucuuc

SEQ ID NO: 346590 - RNA, 19 nt, Homo sapiens
ucaagacuaucccaaauau

SEQ ID NO: 346591 - RNA, 19 nt, Homo sapiens
ggucaaacaauacaacuaa

SEQ ID NO: 346592 - RNA, 19 nt, Homo sapiens
caacuauccuaaacaaugu

SEQ ID NO: 346593 - RNA, 19 nt, Homo sapiens
caaacaggauucccauuuc

SEQ ID NO: 346594 - RNA, 19 nt, Homo sapiens
gcagacaaaugcuauggau

SEQ ID NO: 346595 - RNA, 19 nt, Homo sapiens
caacuaacuuuccaucauc

SEQ ID NO: 346596 - RNA, 19 nt, Homo sapiens
gaaugcuucuguccaacua

SEQ ID NO: 346597 - RNA, 19 nt, Homo sapiens
gaaauaacugcuuuguuug

SEQ ID NO: 346598 - RNA, 19 nt, Homo sapiens
gcuguuauuuggacaacua

SEQ ID NO: 346599 - RNA, 19 nt, Homo sapiens
cauagcacauagaaugaua

SEQ ID NO: 346600 - RNA, 19 nt, Homo sapiens
ccaaacaggauucccauuu

SEQ ID NO: 346601 - RNA, 19 nt, Homo sapiens
cagcaacuauccuaaacaa

SEQ ID NO: 346602 - RNA, 19 nt, Homo sapiens
gcucauacaucuucuucug

SEQ ID NO: 346603 - RNA, 19 nt, Homo sapiens
guaagaggccauccaggua

SEQ ID NO: 346604 - RNA, 19 nt, Homo sapiens
acaggaagguauauuaaug

SEQ ID NO: 346605 - RNA, 19 nt, Homo sapiens
uaaaugacaggaagguaua

SEQ ID NO: 346606 - RNA, 19 nt, Homo sapiens
caagugggaaucauaaauu

SEQ ID NO: 346607 - RNA, 19 nt, Homo sapiens
cuacaagacaucccauaua

SEQ ID NO: 346608 - RNA, 19 nt, Homo sapiens
gauaaucgcaaacucaaga

SEQ ID NO: 346609 - RNA, 19 nt, Homo sapiens
acaccaaacuaucucauug

SEQ ID NO: 346610 - RNA, 19 nt, Homo sapiens
gcacuuugaccuucauuau

SEQ ID NO: 346611 - RNA, 19 nt, Homo sapiens
gaaauuuggaacaccuaua

SEQ ID NO: 346612 - RNA, 19 nt, Homo sapiens
ucagugggaugaagacuau

SEQ ID NO: 346613 - RNA, 19 nt, Homo sapiens
gagcagaagggcacuuuga

SEQ ID NO: 346614 - RNA, 19 nt, Homo sapiens
caauacaacuaaagacaca

SEQ ID NO: 346615 - RNA, 19 nt, Homo sapiens
gcacuaauggucaaacaau

SEQ ID NO: 346616 - RNA, 19 nt, Homo sapiens
aagcaagcauucuauauuc

SEQ ID NO: 346617 - RNA, 19 nt, Homo sapiens
ccucauauacacacuauuu

SEQ ID NO: 346618 - RNA, 19 nt, Homo sapiens
ccaacuaacuuuccaucau

SEQ ID NO: 346619 - RNA, 19 nt, Homo sapiens
gugaguguaucauuucuau

SEQ ID NO: 346620 - RNA, 19 nt, Homo sapiens
guacugugauaaucgcaaa

SEQ ID NO: 346621 - RNA, 19 nt, Homo sapiens
cuaagaaugucacacaaca

SEQ ID NO: 346622 - RNA, 19 nt, Homo sapiens
gguuugccuucuucacuua

SEQ ID NO: 346623 - RNA, 19 nt, Homo sapiens
gauugauuaugguguguuu

SEQ ID NO: 346624 - RNA, 19 nt, Homo sapiens
ggauucccauuucgucaaa

SEQ ID NO: 346625 - RNA, 19 nt, Homo sapiens
ugacaggaagguauauuaa

SEQ ID NO: 346626 - RNA, 19 nt, Homo sapiens
ggagauuuccagaugauga

SEQ ID NO: 346627 - RNA, 19 nt, Homo sapiens
ucuccaaacugcagacaaa

SEQ ID NO: 346628 - RNA, 19 nt, Homo sapiens
acagugauguguccuucua

SEQ ID NO: 346629 - RNA, 19 nt, Homo sapiens
cuaaaucucuggaaagacu

SEQ ID NO: 346630 - RNA, 19 nt, Homo sapiens
ccaaaucuacuacaacuuc

SEQ ID NO: 346631 - RNA, 19 nt, Homo sapiens
uagcagauuucagcaacua

SEQ ID NO: 346632 - RNA, 19 nt, Homo sapiens
ugacaagugggaaucauaa

SEQ ID NO: 346633 - RNA, 19 nt, Homo sapiens
ggauuagaacuuacucaaa

SEQ ID NO: 346634 - RNA, 19 nt, Homo sapiens
ggaugaagacuaugaccaa

SEQ ID NO: 346635 - RNA, 19 nt, Homo sapiens
uugcuaagcuuccaaaucu

SEQ ID NO: 346636 - RNA, 19 nt, Homo sapiens
cacuaauggucaaacaaua

SEQ ID NO: 346637 - RNA, 19 nt, Homo sapiens
cuauugacccacuacauua

SEQ ID NO: 346638 - RNA, 19 nt, Homo sapiens
acaaugaaaucuccaaacu

SEQ ID NO: 346639 - RNA, 19 nt, Homo sapiens
acucugaggacaauauuua

SEQ ID NO: 346640 - RNA, 19 nt, Homo sapiens
gaaggaaguagcauuagca

SEQ ID NO: 346641 - RNA, 19 nt, Homo sapiens
uaaagaaagugaguguauc

SEQ ID NO: 346642 - RNA, 19 nt, Homo sapiens
gaaccaauaagcucauaca

SEQ ID NO: 346643 - RNA, 19 nt, Homo sapiens
ggaaggaaguagcauuagc

SEQ ID NO: 346644 - RNA, 19 nt, Homo sapiens
gaccaugcuugaucucugu

SEQ ID NO: 346645 - RNA, 19 nt, Homo sapiens
cagcucaaccucugcagua

SEQ ID NO: 346646 - RNA, 19 nt, Homo sapiens
ucaaugcaacucaucuuaa

SEQ ID NO: 346647 - RNA, 19 nt, Homo sapiens
ucacgaugauccugacaau

SEQ ID NO: 346648 - RNA, 19 nt, Homo sapiens
cuacauuaccaccauuuaa

SEQ ID NO: 346649 - RNA, 19 nt, Homo sapiens
cagcaacucuaccuucagu

SEQ ID NO: 346650 - RNA, 19 nt, Homo sapiens
aaacuuaucagugggauga

SEQ ID NO: 346651 - RNA, 19 nt, Homo sapiens
caacaaacuacaagacauc

SEQ ID NO: 346652 - RNA, 19 nt, Homo sapiens
ucacuuauguaucugucuu

SEQ ID NO: 346653 - RNA, 19 nt, Homo sapiens
caaaucuacuacaacuuca

SEQ ID NO: 346654 - RNA, 19 nt, Homo sapiens
aaagcaaauugaacaggaa

SEQ ID NO: 346655 - RNA, 19 nt, Homo sapiens
ucaggagauuuccagauga

SEQ ID NO: 346656 - RNA, 19 nt, Homo sapiens
caaauugaagcaagcauuc

SEQ ID NO: 346657 - RNA, 19 nt, Homo sapiens
uggaugggcuaguaaacuu

SEQ ID NO: 346658 - RNA, 19 nt, Homo sapiens
ugaagacuaugaccaagag

SEQ ID NO: 346659 - RNA, 19 nt, Homo sapiens
gaaucaaugccuccugguu

SEQ ID NO: 346660 - RNA, 19 nt, Homo sapiens
ucaauguacugugauaauc

SEQ ID NO: 346661 - RNA, 19 nt, Homo sapiens
acaucugcaucauuucaua

SEQ ID NO: 346662 - RNA, 19 nt, Homo sapiens
cuucuucacuuauguaucu

SEQ ID NO: 346663 - RNA, 19 nt, Homo sapiens
ccacuacauuaccaccauu

SEQ ID NO: 346664 - RNA, 19 nt, Homo sapiens
aagaaugucacacaacaaa

SEQ ID NO: 346665 - RNA, 19 nt, Homo sapiens
cgacaaacuuccaaaacuu

SEQ ID NO: 346666 - RNA, 19 nt, Homo sapiens
aaucaaugccuccugguuu

SEQ ID NO: 346667 - RNA, 19 nt, Homo sapiens
cuucaugauucucugcuaa

SEQ ID NO: 346668 - RNA, 19 nt, Homo sapiens
aaauuaaccucagccacaa

SEQ ID NO: 346669 - RNA, 19 nt, Homo sapiens
aagacuaucccaaauauuc

SEQ ID NO: 346670 - RNA, 19 nt, Homo sapiens
ugagagcccagaacaagaa

SEQ ID NO: 346671 - RNA, 19 nt, Homo sapiens
ggacagaucugauuuauuu

SEQ ID NO: 346672 - RNA, 19 nt, Homo sapiens
gagaagaucuugcacauua

SEQ ID NO: 346673 - RNA, 19 nt, Homo sapiens
ugaaggaggugcagaagua

SEQ ID NO: 346674 - RNA, 19 nt, Homo sapiens
gaccaaagccgaacaguuu

SEQ ID NO: 346675 - RNA, 19 nt, Homo sapiens
uaggauagcuucaucuuga

SEQ ID NO: 346676 - RNA, 19 nt, Homo sapiens
ggacgugguugucgauuug

SEQ ID NO: 346677 - RNA, 19 nt, Homo sapiens
gcaauuggguuguugucaa

SEQ ID NO: 346678 - RNA, 19 nt, Homo sapiens
gagaagcgcuuuggucuag

SEQ ID NO: 346679 - RNA, 19 nt, Homo sapiens
gcuaggacauuucaacaga

SEQ ID NO: 346680 - RNA, 19 nt, Homo sapiens
cgacaucaaucagcuauau

SEQ ID NO: 346681 - RNA, 19 nt, Homo sapiens
ggacaggaaucagcacuuc

SEQ ID NO: 346682 - RNA, 19 nt, Homo sapiens
ugacaagucuagugagaau

SEQ ID NO: 346683 - RNA, 19 nt, Homo sapiens
gaagcgcuuuggucuagaa

SEQ ID NO: 346684 - RNA, 19 nt, Homo sapiens
gaugagggcuccggagaug

SEQ ID NO: 346685 - RNA, 19 nt, Homo sapiens
ggccugaccuggcacagaa

SEQ ID NO: 346686 - RNA, 19 nt, Homo sapiens
gaacgugcuugcaaauguc

SEQ ID NO: 346687 - RNA, 19 nt, Homo sapiens
caacagauucggugcuauu

SEQ ID NO: 346688 - RNA, 19 nt, Homo sapiens
gauaggaacugggccuugu

SEQ ID NO: 346689 - RNA, 19 nt, Homo sapiens
ccaccagucucacccacua

SEQ ID NO: 346690 - RNA, 19 nt, Homo sapiens
gcgcaaagcacgcgacaug

SEQ ID NO: 346691 - RNA, 19 nt, Homo sapiens
gagcgguucuugcagaugu

SEQ ID NO: 346692 - RNA, 19 nt, Homo sapiens
gaaggagggcauccacauu

SEQ ID NO: 346693 - RNA, 19 nt, Homo sapiens
ucaaccagccugaguauga

SEQ ID NO: 346694 - RNA, 19 nt, Homo sapiens
ucacgcagccgcucaugua

SEQ ID NO: 346695 - RNA, 19 nt, Homo sapiens
gaggagauguacugugcuu

SEQ ID NO: 346696 - RNA, 19 nt, Homo sapiens
gcaccggcaaaguguauua

SEQ ID NO: 346697 - RNA, 19 nt, Homo sapiens
gggcauggguccagaacau

SEQ ID NO: 346698 - RNA, 19 nt, Homo sapiens
ugaacgugcuugcaaaugu

SEQ ID NO: 346699 - RNA, 19 nt, Homo sapiens
guacugugcuuggcuggaa

SEQ ID NO: 346700 - RNA, 19 nt, Homo sapiens
ucagcgaccugccauccua

SEQ ID NO: 346701 - RNA, 19 nt, Homo sapiens
gaagugguccucugagaag

SEQ ID NO: 346702 - RNA, 19 nt, Homo sapiens
ggaagugguccucugagaa

SEQ ID NO: 346703 - RNA, 19 nt, Homo sapiens
gauacgagggcaccaugua

SEQ ID NO: 346704 - RNA, 19 nt, Homo sapiens
caauggagacuuucugaug

SEQ ID NO: 346705 - RNA, 19 nt, Homo sapiens
ggaagccguuaauuaucuu

SEQ ID NO: 346706 - RNA, 19 nt, Homo sapiens
guucacaaaugaggagaaa

SEQ ID NO: 346707 - RNA, 19 nt, Homo sapiens
gaguucauguucaucaaug

SEQ ID NO: 346708 - RNA, 19 nt, Homo sapiens
cagacaaacuuggguucua

SEQ ID NO: 346709 - RNA, 19 nt, Homo sapiens
guggaaaacuuuacuauuc

SEQ ID NO: 346710 - RNA, 19 nt, Homo sapiens
caaccacucuuucuuucuc

SEQ ID NO: 346711 - RNA, 19 nt, Homo sapiens
ccggcaaaguguauuauga

SEQ ID NO: 346712 - RNA, 19 nt, Homo sapiens
ggucauguccauccuguug

SEQ ID NO: 346713 - RNA, 19 nt, Homo sapiens
agacaaacuuggguucuau

SEQ ID NO: 346714 - RNA, 19 nt, Homo sapiens
cauaagucaugggacauuu

SEQ ID NO: 346715 - RNA, 19 nt, Homo sapiens
gaggccagauccagcuuug

SEQ ID NO: 346716 - RNA, 19 nt, Homo sapiens
gugcaacgaugacccagau

SEQ ID NO: 346717 - RNA, 19 nt, Homo sapiens
ggccaacccuucccaccuu

SEQ ID NO: 346718 - RNA, 19 nt, Homo sapiens
gaaccaaggcuacuaugac

SEQ ID NO: 346719 - RNA, 19 nt, Homo sapiens
uugcaaaugucaucaggaa

SEQ ID NO: 346720 - RNA, 19 nt, Homo sapiens
ggagacaggcaauugugaa

SEQ ID NO: 346721 - RNA, 19 nt, Homo sapiens
uaggacauuucaacagauu

SEQ ID NO: 346722 - RNA, 19 nt, Homo sapiens
agaagaucuugcacauuaa

SEQ ID NO: 346723 - RNA, 19 nt, Homo sapiens
gaucaugcaguucacaaau

SEQ ID NO: 346724 - RNA, 19 nt, Homo sapiens
caacaagaagacccacuga

SEQ ID NO: 346725 - RNA, 19 nt, Homo sapiens
cggaagccguuaauuaucu

SEQ ID NO: 346726 - RNA, 19 nt, Homo sapiens
gcagaauggcaucguguug

SEQ ID NO: 346727 - RNA, 19 nt, Homo sapiens
ccaagugggugcggcagaa

SEQ ID NO: 346728 - RNA, 19 nt, Homo sapiens
caagcagaagccuguguua

SEQ ID NO: 346729 - RNA, 19 nt, Homo sapiens
gagacaggcaauugugaaa

SEQ ID NO: 346730 - RNA, 19 nt, Homo sapiens
ccaccagguuugaggaguu

SEQ ID NO: 346731 - RNA, 19 nt, Homo sapiens
caagaaccaaggcuacuau

SEQ ID NO: 346732 - RNA, 19 nt, Homo sapiens
gcaagcagaagccuguguu

SEQ ID NO: 346733 - RNA, 19 nt, Homo sapiens
gaccugccauccuacacaa

SEQ ID NO: 346734 - RNA, 19 nt, Homo sapiens
caaaugucaucaggaagga

SEQ ID NO: 346735 - RNA, 19 nt, Homo sapiens
gcugacuucugagcaguuu

SEQ ID NO: 346736 - RNA, 19 nt, Homo sapiens
gaccaucauugacaagucu

SEQ ID NO: 346737 - RNA, 19 nt, Homo sapiens
ccgcugacauuaucucauc

SEQ ID NO: 346738 - RNA, 19 nt, Homo sapiens
gcaaagcacgcgacauggu

SEQ ID NO: 346739 - RNA, 19 nt, Homo sapiens
caacuucuuccacgugcua

SEQ ID NO: 346740 - RNA, 19 nt, Homo sapiens
cggaggauauucugacaca

SEQ ID NO: 346741 - RNA, 19 nt, Homo sapiens
uggcgacacugaagggaaa

SEQ ID NO: 346742 - RNA, 19 nt, Homo sapiens
ucuagaaggcugcgaggua

SEQ ID NO: 346743 - RNA, 19 nt, Homo sapiens
agacuaggauagcuucauc

SEQ ID NO: 346744 - RNA, 19 nt, Homo sapiens
gaggauauucugacacaca

SEQ ID NO: 346745 - RNA, 19 nt, Homo sapiens
gaagaucuugcacauuaag

SEQ ID NO: 346746 - RNA, 19 nt, Homo sapiens
cggaagugguccucugaga

SEQ ID NO: 346747 - RNA, 19 nt, Homo sapiens
ggaaaaccccaaaagugua

SEQ ID NO: 346748 - RNA, 19 nt, Homo sapiens
uuaacccaauggagacuuu

SEQ ID NO: 346749 - RNA, 19 nt, Homo sapiens
gaaagggcagcuucagucu

SEQ ID NO: 346750 - RNA, 19 nt, Homo sapiens
uugagcagcugucgccauu

SEQ ID NO: 346751 - RNA, 19 nt, Homo sapiens
ccagauccagcuuugauga

SEQ ID NO: 346752 - RNA, 19 nt, Homo sapiens
ugacugcaauuggguuguu

SEQ ID NO: 346753 - RNA, 19 nt, Homo sapiens
ucagcuauaugacugcaau

SEQ ID NO: 346754 - RNA, 19 nt, Homo sapiens
gcaacgaugacccagaugu

SEQ ID NO: 346755 - RNA, 19 nt, Homo sapiens
gacaggaacauuaccuugu

SEQ ID NO: 346756 - RNA, 19 nt, Homo sapiens
cccagacuguuaagacauu

SEQ ID NO: 346757 - RNA, 19 nt, Homo sapiens
cagggacagaucugauuua

SEQ ID NO: 346758 - RNA, 19 nt, Homo sapiens
ucucugcaguguccauuau

SEQ ID NO: 346759 - RNA, 19 nt, Homo sapiens
gcuccuguauuugagacua

SEQ ID NO: 346760 - RNA, 19 nt, Homo sapiens
ucaaaaggcuucucuucug

SEQ ID NO: 346761 - RNA, 19 nt, Homo sapiens
gccagauccugcugccauu

SEQ ID NO: 346762 - RNA, 19 nt, Homo sapiens
gaaccugcauccccaugaa

SEQ ID NO: 346763 - RNA, 19 nt, Homo sapiens
gccaggaggagcacaagaa

SEQ ID NO: 346764 - RNA, 19 nt, Homo sapiens
gauccagcuuugaugagau

SEQ ID NO: 346765 - RNA, 19 nt, Homo sapiens
caaguaugauaagaucugu

SEQ ID NO: 346766 - RNA, 19 nt, Homo sapiens
gagcagcugucgccauucc

SEQ ID NO: 346767 - RNA, 19 nt, Homo sapiens
uuccggaagccguuaauua

SEQ ID NO: 346768 - RNA, 19 nt, Homo sapiens
gacggaggauauucugaca

SEQ ID NO: 346769 - RNA, 19 nt, Homo sapiens
ggucaaccagccugaguau

SEQ ID NO: 346770 - RNA, 19 nt, Homo sapiens
acaggaacauuaccuuguc

SEQ ID NO: 346771 - RNA, 19 nt, Homo sapiens
gaucaaguauggacacuga

SEQ ID NO: 346772 - RNA, 19 nt, Homo sapiens
ggaaggacguggcucugaa

SEQ ID NO: 346773 - RNA, 19 nt, Homo sapiens
caggaaagccggagaauug

SEQ ID NO: 346774 - RNA, 19 nt, Homo sapiens
uaaauaauccauccuccua

SEQ ID NO: 346775 - RNA, 19 nt, Homo sapiens
gcagucaguuugcacaaca

SEQ ID NO: 346776 - RNA, 19 nt, Homo sapiens
guggaggaauuaagugaaa

SEQ ID NO: 346777 - RNA, 19 nt, Homo sapiens
gauggaguauggaagaaau

SEQ ID NO: 346778 - RNA, 19 nt, Homo sapiens
ucuccuagcucccugcuuu

SEQ ID NO: 346779 - RNA, 19 nt, Homo sapiens
caaaucaagcagucaguuu

SEQ ID NO: 346780 - RNA, 19 nt, Homo sapiens
gcagauggaguauggaaga

SEQ ID NO: 346781 - RNA, 19 nt, Homo sapiens
gaggaaagcaugagcagau

SEQ ID NO: 346782 - RNA, 19 nt, Homo sapiens
acaaggaacugggaaacuu

SEQ ID NO: 346783 - RNA, 19 nt, Homo sapiens
gaauaauacucuggagaca

SEQ ID NO: 346784 - RNA, 19 nt, Homo sapiens
gagaauggcccagauaaag

SEQ ID NO: 346785 - RNA, 19 nt, Homo sapiens
gcagaaaggguuccaaagg

SEQ ID NO: 346786 - RNA, 19 nt, Homo sapiens
ggaccuacaccucaggaaa

SEQ ID NO: 346787 - RNA, 19 nt, Homo sapiens
cagaagggaagaaauuaaa

SEQ ID NO: 346788 - RNA, 19 nt, Homo sapiens
gcaggagguggaggaauua

SEQ ID NO: 346789 - RNA, 19 nt, Homo sapiens
gaaaugagcggugguugag

SEQ ID NO: 346790 - RNA, 19 nt, Homo sapiens
agagguggcucagaaauuc

SEQ ID NO: 346791 - RNA, 19 nt, Homo sapiens
caaggaacugggaaacuuu

SEQ ID NO: 346792 - RNA, 19 nt, Homo sapiens
uccaagagguggcucagaa

SEQ ID NO: 346793 - RNA, 19 nt, Homo sapiens
ccagaagggaagaaauuaa

SEQ ID NO: 346794 - RNA, 19 nt, Homo sapiens
gaaagcaugagcagaugga

SEQ ID NO: 346795 - RNA, 19 nt, Homo sapiens
cuacgagaguccucauaug

SEQ ID NO: 346796 - RNA, 19 nt, Homo sapiens
gaaugccuuuucucuuuua

SEQ ID NO: 346797 - RNA, 19 nt, Homo sapiens
ugcaggagguggaggaauu

SEQ ID NO: 346798 - RNA, 19 nt, Homo sapiens
gagcagauggaguauggaa

SEQ ID NO: 346799 - RNA, 19 nt, Homo sapiens
gcgcagaaaggguuccaaa

SEQ ID NO: 346800 - RNA, 19 nt, Homo sapiens
uacccuggcucaacuguau

SEQ ID NO: 346801 - RNA, 19 nt, Homo sapiens
gcgcagaagagaauaauac

SEQ ID NO: 346802 - RNA, 19 nt, Homo sapiens
ggagguggaggaauuaagu

SEQ ID NO: 346803 - RNA, 19 nt, Homo sapiens
ggugagaauggcccagaua

SEQ ID NO: 346804 - RNA, 19 nt, Homo sapiens
ccacccugauuucucauug

SEQ ID NO: 346805 - RNA, 19 nt, Homo sapiens
ccaaaucccuaugcuaaaa

SEQ ID NO: 346806 - RNA, 19 nt, Homo sapiens
gagccauccuggaagaaca

SEQ ID NO: 346807 - RNA, 19 nt, Homo sapiens
ucgaaugccuuuucucuuu

SEQ ID NO: 346808 - RNA, 19 nt, Homo sapiens
ugaaaugagcggugguuga

SEQ ID NO: 346809 - RNA, 19 nt, Homo sapiens
gcccagauggaacucguua

SEQ ID NO: 346810 - RNA, 19 nt, Homo sapiens
gugagaauggcccagauaa

SEQ ID NO: 346811 - RNA, 19 nt, Homo sapiens
gcuacgagaguccucauau

SEQ ID NO: 346812 - RNA, 19 nt, Homo sapiens
cagcuccacugcacugugu

SEQ ID NO: 346813 - RNA, 19 nt, Homo sapiens
gguuuuaucuucccuuuau

SEQ ID NO: 346814 - RNA, 19 nt, Homo sapiens
uacgagaguccucauauga

SEQ ID NO: 346815 - RNA, 19 nt, Homo sapiens
ggucucagaggacgccuaa

SEQ ID NO: 346816 - RNA, 19 nt, Homo sapiens
ugagaauggcccagauaaa

SEQ ID NO: 346817 - RNA, 19 nt, Homo sapiens
acuugcagccugauaguua

SEQ ID NO: 346818 - RNA, 19 nt, Homo sapiens
gaauggcccagauaaaggu

SEQ ID NO: 346819 - RNA, 19 nt, Homo sapiens
caagagguggcucagaaau

SEQ ID NO: 346820 - RNA, 19 nt, Homo sapiens
ccaagagguggcucagaaa

SEQ ID NO: 346821 - RNA, 19 nt, Homo sapiens
auaaaggucaugucuccua

SEQ ID NO: 346822 - RNA, 19 nt, Homo sapiens
uggaagaaaugcccaagac

SEQ ID NO: 346823 - RNA, 19 nt, Homo sapiens
cagauggaguauggaagaa

SEQ ID NO: 346824 - RNA, 19 nt, Homo sapiens
aaaucaagcagucaguuug

SEQ ID NO: 346825 - RNA, 19 nt, Homo sapiens
ggaggaauuaagugaaaca

SEQ ID NO: 346826 - RNA, 19 nt, Homo sapiens
gaccuacaccucaggaaag

SEQ ID NO: 346827 - RNA, 19 nt, Homo sapiens
ccagauaaaggucaugucu

SEQ ID NO: 346828 - RNA, 19 nt, Homo sapiens
cuugcagccugauaguuaa

SEQ ID NO: 346829 - RNA, 19 nt, Homo sapiens
gggaaggacguggcucuga

SEQ ID NO: 346830 - RNA, 19 nt, Homo sapiens
auaauacucuggagacacu

SEQ ID NO: 346831 - RNA, 19 nt, Homo sapiens
cgaaugccuuuucucuuuu

SEQ ID NO: 346832 - RNA, 19 nt, Homo sapiens
gcagccugauaguuaagau

SEQ ID NO: 346833 - RNA, 19 nt, Homo sapiens
ccaacaaggaacugggaaa

SEQ ID NO: 346834 - RNA, 19 nt, Homo sapiens
cauaugaggaggcccacaa

SEQ ID NO: 346835 - RNA, 19 nt, Homo sapiens
gacaagaccccaucgaaug

SEQ ID NO: 346836 - RNA, 19 nt, Homo sapiens
gaaggacguggcucugaag

SEQ ID NO: 346837 - RNA, 19 nt, Homo sapiens
agcaugagcagauggagua

SEQ ID NO: 346838 - RNA, 19 nt, Homo sapiens
agacagcgcuaaggauggu

SEQ ID NO: 346839 - RNA, 19 nt, Homo sapiens
gguucugccuucuggacaa

SEQ ID NO: 346840 - RNA, 19 nt, Homo sapiens
gacuuggacucaaccugau

SEQ ID NO: 346841 - RNA, 19 nt, Homo sapiens
ccaaaucaagcagucaguu

SEQ ID NO: 346842 - RNA, 19 nt, Homo sapiens
aagagguggcucagaaauu

SEQ ID NO: 346843 - RNA, 19 nt, Homo sapiens
ggacucccacuuccaagag

SEQ ID NO: 346844 - RNA, 19 nt, Homo sapiens
uaaggaugguuuuaucuuc

SEQ ID NO: 346845 - RNA, 19 nt, Homo sapiens
gaagcugggccugggcuau

SEQ ID NO: 346846 - RNA, 19 nt, Homo sapiens
uccagaagggaagaaauua

SEQ ID NO: 346847 - RNA, 19 nt, Homo sapiens
gcagaagagaauaauacuc

SEQ ID NO: 346848 - RNA, 19 nt, Homo sapiens
gagcaaaguccugcacacu

SEQ ID NO: 346849 - RNA, 19 nt, Homo sapiens
gcaaagggcgaggcaugca

SEQ ID NO: 346850 - RNA, 19 nt, Homo sapiens
ucaggaaagccggagaauu

SEQ ID NO: 346851 - RNA, 19 nt, Homo sapiens
cuccagaagggaagaaauu

SEQ ID NO: 346852 - RNA, 19 nt, Homo sapiens
ucaguuugcacaacaagau

SEQ ID NO: 346853 - RNA, 19 nt, Homo sapiens
ccugauggcccuagacaag

SEQ ID NO: 346854 - RNA, 19 nt, Homo sapiens
gguggaggaauuaagugaa

SEQ ID NO: 346855 - RNA, 19 nt, Homo sapiens
ucucagaggacgccuaaag

SEQ ID NO: 346856 - RNA, 19 nt, Homo sapiens
caacaaggaacugggaaac

SEQ ID NO: 346857 - RNA, 19 nt, Homo sapiens
cagccugauaguuaagaua

SEQ ID NO: 346858 - RNA, 19 nt, Homo sapiens
ggaccugguucugccuucu

SEQ ID NO: 346859 - RNA, 19 nt, Homo sapiens
cgcccacccugauuucuca

SEQ ID NO: 346860 - RNA, 19 nt, Homo sapiens
aauaauccauccuccuacu

SEQ ID NO: 346861 - RNA, 19 nt, Homo sapiens
gauguuacccuggcucaac

SEQ ID NO: 346862 - RNA, 19 nt, Homo sapiens
acuagcggaucaaguaugg

SEQ ID NO: 346863 - RNA, 19 nt, Homo sapiens
cccgagccauccuggaaga

SEQ ID NO: 346864 - RNA, 19 nt, Homo sapiens
augagcagauggaguaugg

SEQ ID NO: 346865 - RNA, 19 nt, Homo sapiens
gaucaaguauggacacuga

SEQ ID NO: 346866 - RNA, 19 nt, Homo sapiens
ggaaggacguggcucugaa

SEQ ID NO: 346867 - RNA, 19 nt, Homo sapiens
caggaaagccggagaauug

SEQ ID NO: 346868 - RNA, 19 nt, Homo sapiens
uaaauaauccauccuccua

SEQ ID NO: 346869 - RNA, 19 nt, Homo sapiens
gcagucaguuugcacaaca

SEQ ID NO: 346870 - RNA, 19 nt, Homo sapiens
guggaggaauuaagugaaa

SEQ ID NO: 346871 - RNA, 19 nt, Homo sapiens
gauggaguauggaagaaau

SEQ ID NO: 346872 - RNA, 19 nt, Homo sapiens
ucuccuagcucccugcuuu

SEQ ID NO: 346873 - RNA, 19 nt, Homo sapiens
caaaucaagcagucaguuu

SEQ ID NO: 346874 - RNA, 19 nt, Homo sapiens
gcagauggaguauggaaga

SEQ ID NO: 346875 - RNA, 19 nt, Homo sapiens
gaggaaagcaugagcagau

SEQ ID NO: 346876 - RNA, 19 nt, Homo sapiens
acaaggaacugggaaacuu

SEQ ID NO: 346877 - RNA, 19 nt, Homo sapiens
gaauaauacucuggagaca

SEQ ID NO: 346878 - RNA, 19 nt, Homo sapiens
gagaauggcccagauaaag

SEQ ID NO: 346879 - RNA, 19 nt, Homo sapiens
gcagaaaggguuccaaagg

SEQ ID NO: 346880 - RNA, 19 nt, Homo sapiens
ggaccuacaccucaggaaa

SEQ ID NO: 346881 - RNA, 19 nt, Homo sapiens
cagaagggaagaaauuaaa

SEQ ID NO: 346882 - RNA, 19 nt, Homo sapiens
gcaggagguggaggaauua

SEQ ID NO: 346883 - RNA, 19 nt, Homo sapiens
gaaaugagcggugguugag

SEQ ID NO: 346884 - RNA, 19 nt, Homo sapiens
agagguggcucagaaauuc

SEQ ID NO: 346885 - RNA, 19 nt, Homo sapiens
caaggaacugggaaacuuu

SEQ ID NO: 346886 - RNA, 19 nt, Homo sapiens
uccaagagguggcucagaa

SEQ ID NO: 346887 - RNA, 19 nt, Homo sapiens
ccagaagggaagaaauuaa

SEQ ID NO: 346888 - RNA, 19 nt, Homo sapiens
gaaagcaugagcagaugga

SEQ ID NO: 346889 - RNA, 19 nt, Homo sapiens
cuacgagaguccucauaug

SEQ ID NO: 346890 - RNA, 19 nt, Homo sapiens
gaaugccuuuucucuuuua

SEQ ID NO: 346891 - RNA, 19 nt, Homo sapiens
ugcaggagguggaggaauu

SEQ ID NO: 346892 - RNA, 19 nt, Homo sapiens
gagcagauggaguauggaa

SEQ ID NO: 346893 - RNA, 19 nt, Homo sapiens
gcgcagaaaggguuccaaa

SEQ ID NO: 346894 - RNA, 19 nt, Homo sapiens
uacccuggcucaacuguau

SEQ ID NO: 346895 - RNA, 19 nt, Homo sapiens
gcgcagaagagaauaauac

SEQ ID NO: 346896 - RNA, 19 nt, Homo sapiens
ggagguggaggaauuaagu

SEQ ID NO: 346897 - RNA, 19 nt, Homo sapiens
ggugagaauggcccagaua

SEQ ID NO: 346898 - RNA, 19 nt, Homo sapiens
ccacccugauuucucauug

SEQ ID NO: 346899 - RNA, 19 nt, Homo sapiens
ccaaaucccuaugcuaaaa

SEQ ID NO: 346900 - RNA, 19 nt, Homo sapiens
gagccauccuggaagaaca

SEQ ID NO: 346901 - RNA, 19 nt, Homo sapiens
ucgaaugccuuuucucuuu

SEQ ID NO: 346902 - RNA, 19 nt, Homo sapiens
ugaaaugagcggugguuga

SEQ ID NO: 346903 - RNA, 19 nt, Homo sapiens
gcccagauggaacucguua

SEQ ID NO: 346904 - RNA, 19 nt, Homo sapiens
gugagaauggcccagauaa

SEQ ID NO: 346905 - RNA, 19 nt, Homo sapiens
gcuacgagaguccucauau

SEQ ID NO: 346906 - RNA, 19 nt, Homo sapiens
cagcuccacugcacugugu

SEQ ID NO: 346907 - RNA, 19 nt, Homo sapiens
gguuuuaucuucccuuuau

SEQ ID NO: 346908 - RNA, 19 nt, Homo sapiens
uacgagaguccucauauga

SEQ ID NO: 346909 - RNA, 19 nt, Homo sapiens
ggucucagaggacgccuaa

SEQ ID NO: 346910 - RNA, 19 nt, Homo sapiens
ugagaauggcccagauaaa

SEQ ID NO: 346911 - RNA, 19 nt, Homo sapiens
acuugcagccugauaguua

SEQ ID NO: 346912 - RNA, 19 nt, Homo sapiens
ccaacacugucacuagucu

SEQ ID NO: 346913 - RNA, 19 nt, Homo sapiens
gaauggcccagauaaaggu

SEQ ID NO: 346914 - RNA, 19 nt, Homo sapiens
caagagguggcucagaaau

SEQ ID NO: 346915 - RNA, 19 nt, Homo sapiens
ccaagagguggcucagaaa

SEQ ID NO: 346916 - RNA, 19 nt, Homo sapiens
auaaaggucaugucuccua

SEQ ID NO: 346917 - RNA, 19 nt, Homo sapiens
uggaagaaaugcccaagac

SEQ ID NO: 346918 - RNA, 19 nt, Homo sapiens
cagauggaguauggaagaa

SEQ ID NO: 346919 - RNA, 19 nt, Homo sapiens
aaaucaagcagucaguuug

SEQ ID NO: 346920 - RNA, 19 nt, Homo sapiens
ggaggaauuaagugaaaca

SEQ ID NO: 346921 - RNA, 19 nt, Homo sapiens
ccagauaaaggucaugucu

SEQ ID NO: 346922 - RNA, 19 nt, Homo sapiens
gaccuacaccucaggaaag

SEQ ID NO: 346923 - RNA, 19 nt, Homo sapiens
cuugcagccugauaguuaa

SEQ ID NO: 346924 - RNA, 19 nt, Homo sapiens
gggaaggacguggcucuga

SEQ ID NO: 346925 - RNA, 19 nt, Homo sapiens
auaauacucuggagacacu

SEQ ID NO: 346926 - RNA, 19 nt, Homo sapiens
cgaaugccuuuucucuuuu

SEQ ID NO: 346927 - RNA, 19 nt, Homo sapiens
gcagccugauaguuaagau

SEQ ID NO: 346928 - RNA, 19 nt, Homo sapiens
ccaacaaggaacugggaaa

SEQ ID NO: 346929 - RNA, 19 nt, Homo sapiens
cauaugaggaggcccacaa

SEQ ID NO: 346930 - RNA, 19 nt, Homo sapiens
gacaagaccccaucgaaug

SEQ ID NO: 346931 - RNA, 19 nt, Homo sapiens
gaaggacguggcucugaag

SEQ ID NO: 346932 - RNA, 19 nt, Homo sapiens
agcaugagcagauggagua

SEQ ID NO: 346933 - RNA, 19 nt, Homo sapiens
agacagcgcuaaggauggu

SEQ ID NO: 346934 - RNA, 19 nt, Homo sapiens
gguucugccuucuggacaa

SEQ ID NO: 346935 - RNA, 19 nt, Homo sapiens
gacuuggacucaaccugau

SEQ ID NO: 346936 - RNA, 19 nt, Homo sapiens
ccaaaucaagcagucaguu

SEQ ID NO: 346937 - RNA, 19 nt, Homo sapiens
aagagguggcucagaaauu

SEQ ID NO: 346938 - RNA, 19 nt, Homo sapiens
ggacucccacuuccaagag

SEQ ID NO: 346939 - RNA, 19 nt, Homo sapiens
uaaggaugguuuuaucuuc

SEQ ID NO: 346940 - RNA, 19 nt, Homo sapiens
uccagaagggaagaaauua

SEQ ID NO: 346941 - RNA, 19 nt, Homo sapiens
gaagcugggccugggcuau

SEQ ID NO: 346942 - RNA, 19 nt, Homo sapiens
gcagaagagaauaauacuc

SEQ ID NO: 346943 - RNA, 19 nt, Homo sapiens
gagcaaaguccugcacacu

SEQ ID NO: 346944 - RNA, 19 nt, Homo sapiens
gcaaagggcgaggcaugca

SEQ ID NO: 346945 - RNA, 19 nt, Homo sapiens
ucaggaaagccggagaauu

SEQ ID NO: 346946 - RNA, 19 nt, Homo sapiens
ucaguuugcacaacaagau

SEQ ID NO: 346947 - RNA, 19 nt, Homo sapiens
ucccaacacugucacuagu

SEQ ID NO: 346948 - RNA, 19 nt, Homo sapiens
ccugauggcccuagacaag

SEQ ID NO: 346949 - RNA, 19 nt, Homo sapiens
gguggaggaauuaagugaa

SEQ ID NO: 346950 - RNA, 19 nt, Homo sapiens
ucucagaggacgccuaaag

SEQ ID NO: 346951 - RNA, 19 nt, Homo sapiens
cuccagaagggaagaaauu

SEQ ID NO: 346952 - RNA, 19 nt, Homo sapiens
caacaaggaacugggaaac

SEQ ID NO: 346953 - RNA, 19 nt, Homo sapiens
cagccugauaguuaagaua

SEQ ID NO: 346954 - RNA, 19 nt, Homo sapiens
ggaccugguucugccuucu

SEQ ID NO: 346955 - RNA, 19 nt, Homo sapiens
cgcccacccugauuucuca

SEQ ID NO: 346956 - RNA, 19 nt, Homo sapiens
aauaauccauccuccuacu

SEQ ID NO: 346957 - RNA, 19 nt, Homo sapiens
gauguuacccuggcucaac

SEQ ID NO: 346958 - RNA, 19 nt, Homo sapiens
acuagcggaucaaguaugg

SEQ ID NO: 346959 - RNA, 19 nt, Homo sapiens
cagacccaguggacucuuc

SEQ ID NO: 346960 - RNA, 19 nt, Homo sapiens
cccgagccauccuggaaga

SEQ ID NO: 346961 - RNA, 19 nt, Homo sapiens
augagcagauggaguaugg

SEQ ID NO: 346962 - RNA, 19 nt, Homo sapiens
gaucaaguauggacacuga

SEQ ID NO: 346963 - RNA, 19 nt, Homo sapiens
ggaaggacguggcucugaa

SEQ ID NO: 346964 - RNA, 19 nt, Homo sapiens
caggaaagccggagaauug

SEQ ID NO: 346965 - RNA, 19 nt, Homo sapiens
uaaauaauccauccuccua

SEQ ID NO: 346966 - RNA, 19 nt, Homo sapiens
gcagucaguuugcacaaca

SEQ ID NO: 346967 - RNA, 19 nt, Homo sapiens
guggaggaauuaagugaaa

SEQ ID NO: 346968 - RNA, 19 nt, Homo sapiens
gauggaguauggaagaaau

SEQ ID NO: 346969 - RNA, 19 nt, Homo sapiens
ucuccuagcucccugcuuu

SEQ ID NO: 346970 - RNA, 19 nt, Homo sapiens
caaaucaagcagucaguuu

SEQ ID NO: 346971 - RNA, 19 nt, Homo sapiens
gcagauggaguauggaaga

SEQ ID NO: 346972 - RNA, 19 nt, Homo sapiens
gaggaaagcaugagcagau

SEQ ID NO: 346973 - RNA, 19 nt, Homo sapiens
acaaggaacugggaaacuu

SEQ ID NO: 346974 - RNA, 19 nt, Homo sapiens
gaauaauacucuggagaca

SEQ ID NO: 346975 - RNA, 19 nt, Homo sapiens
gagaauggcccagauaaag

SEQ ID NO: 346976 - RNA, 19 nt, Homo sapiens
gcagaaaggguuccaaagg

SEQ ID NO: 346977 - RNA, 19 nt, Homo sapiens
ggaccuacaccucaggaaa

SEQ ID NO: 346978 - RNA, 19 nt, Homo sapiens
cagaagggaagaaauuaaa

SEQ ID NO: 346979 - RNA, 19 nt, Homo sapiens
gcaggagguggaggaauua

SEQ ID NO: 346980 - RNA, 19 nt, Homo sapiens
gaaaugagcggugguugag

SEQ ID NO: 346981 - RNA, 19 nt, Homo sapiens
agagguggcucagaaauuc

SEQ ID NO: 346982 - RNA, 19 nt, Homo sapiens
caaggaacugggaaacuuu

SEQ ID NO: 346983 - RNA, 19 nt, Homo sapiens
uccaagagguggcucagaa

SEQ ID NO: 346984 - RNA, 19 nt, Homo sapiens
ccagaagggaagaaauuaa

SEQ ID NO: 346985 - RNA, 19 nt, Homo sapiens
gaaagcaugagcagaugga

SEQ ID NO: 346986 - RNA, 19 nt, Homo sapiens
cuacgagaguccucauaug

SEQ ID NO: 346987 - RNA, 19 nt, Homo sapiens
gaaugccuuuucucuuuua

SEQ ID NO: 346988 - RNA, 19 nt, Homo sapiens
ugcaggagguggaggaauu

SEQ ID NO: 346989 - RNA, 19 nt, Homo sapiens
gagcagauggaguauggaa

SEQ ID NO: 346990 - RNA, 19 nt, Homo sapiens
gcgcagaaaggguuccaaa

SEQ ID NO: 346991 - RNA, 19 nt, Homo sapiens
uacccuggcucaacuguau

SEQ ID NO: 346992 - RNA, 19 nt, Homo sapiens
gcgcagaagagaauaauac

SEQ ID NO: 346993 - RNA, 19 nt, Homo sapiens
ggagguggaggaauuaagu

SEQ ID NO: 346994 - RNA, 19 nt, Homo sapiens
ggugagaauggcccagaua

SEQ ID NO: 346995 - RNA, 19 nt, Homo sapiens
ccacccugauuucucauug

SEQ ID NO: 346996 - RNA, 19 nt, Homo sapiens
ccaaaucccuaugcuaaaa

SEQ ID NO: 346997 - RNA, 19 nt, Homo sapiens
gagccauccuggaagaaca

SEQ ID NO: 346998 - RNA, 19 nt, Homo sapiens
ucgaaugccuuuucucuuu

SEQ ID NO: 346999 - RNA, 19 nt, Homo sapiens
ugaaaugagcggugguuga

SEQ ID NO: 347000 - RNA, 19 nt, Homo sapiens
gcccagauggaacucguua

SEQ ID NO: 347001 - RNA, 19 nt, Homo sapiens
gugagaauggcccagauaa

SEQ ID NO: 347002 - RNA, 19 nt, Homo sapiens
gcuacgagaguccucauau

SEQ ID NO: 347003 - RNA, 19 nt, Homo sapiens
cagcuccacugcacugugu

SEQ ID NO: 347004 - RNA, 19 nt, Homo sapiens
gguuuuaucuucccuuuau

SEQ ID NO: 347005 - RNA, 19 nt, Homo sapiens
uacgagaguccucauauga

SEQ ID NO: 347006 - RNA, 19 nt, Homo sapiens
ggucucagaggacgccuaa

SEQ ID NO: 347007 - RNA, 19 nt, Homo sapiens
ugagaauggcccagauaaa

SEQ ID NO: 347008 - RNA, 19 nt, Homo sapiens
acuugcagccugauaguua

SEQ ID NO: 347009 - RNA, 19 nt, Homo sapiens
gaauggcccagauaaaggu

SEQ ID NO: 347010 - RNA, 19 nt, Homo sapiens
caagagguggcucagaaau

SEQ ID NO: 347011 - RNA, 19 nt, Homo sapiens
ccaagagguggcucagaaa

SEQ ID NO: 347012 - RNA, 19 nt, Homo sapiens
auaaaggucaugucuccua

SEQ ID NO: 347013 - RNA, 19 nt, Homo sapiens
uggaagaaaugcccaagac

SEQ ID NO: 347014 - RNA, 19 nt, Homo sapiens
cagauggaguauggaagaa

SEQ ID NO: 347015 - RNA, 19 nt, Homo sapiens
aaaucaagcagucaguuug

SEQ ID NO: 347016 - RNA, 19 nt, Homo sapiens
ggaggaauuaagugaaaca

SEQ ID NO: 347017 - RNA, 19 nt, Homo sapiens
gaccuacaccucaggaaag

SEQ ID NO: 347018 - RNA, 19 nt, Homo sapiens
ccagauaaaggucaugucu

SEQ ID NO: 347019 - RNA, 19 nt, Homo sapiens
cuugcagccugauaguuaa

SEQ ID NO: 347020 - RNA, 19 nt, Homo sapiens
gggaaggacguggcucuga

SEQ ID NO: 347021 - RNA, 19 nt, Homo sapiens
auaauacucuggagacacu

SEQ ID NO: 347022 - RNA, 19 nt, Homo sapiens
cgaaugccuuuucucuuuu

SEQ ID NO: 347023 - RNA, 19 nt, Homo sapiens
gcagccugauaguuaagau

SEQ ID NO: 347024 - RNA, 19 nt, Homo sapiens
ccaacaaggaacugggaaa

SEQ ID NO: 347025 - RNA, 19 nt, Homo sapiens
cauaugaggaggcccacaa

SEQ ID NO: 347026 - RNA, 19 nt, Homo sapiens
gacaagaccccaucgaaug

SEQ ID NO: 347027 - RNA, 19 nt, Homo sapiens
gaaggacguggcucugaag

SEQ ID NO: 347028 - RNA, 19 nt, Homo sapiens
agcaugagcagauggagua

SEQ ID NO: 347029 - RNA, 19 nt, Homo sapiens
agacagcgcuaaggauggu

SEQ ID NO: 347030 - RNA, 19 nt, Homo sapiens
gguucugccuucuggacaa

SEQ ID NO: 347031 - RNA, 19 nt, Homo sapiens
gacuuggacucaaccugau

SEQ ID NO: 347032 - RNA, 19 nt, Homo sapiens
ccaaaucaagcagucaguu

SEQ ID NO: 347033 - RNA, 19 nt, Homo sapiens
aagagguggcucagaaauu

SEQ ID NO: 347034 - RNA, 19 nt, Homo sapiens
ggacucccacuuccaagag

SEQ ID NO: 347035 - RNA, 19 nt, Homo sapiens
uaaggaugguuuuaucuuc

SEQ ID NO: 347036 - RNA, 19 nt, Homo sapiens
gaagcugggccugggcuau

SEQ ID NO: 347037 - RNA, 19 nt, Homo sapiens
uccagaagggaagaaauua

SEQ ID NO: 347038 - RNA, 19 nt, Homo sapiens
gcagaagagaauaauacuc

SEQ ID NO: 347039 - RNA, 19 nt, Homo sapiens
gagcaaaguccugcacacu

SEQ ID NO: 347040 - RNA, 19 nt, Homo sapiens
gcaaagggcgaggcaugca

SEQ ID NO: 347041 - RNA, 19 nt, Homo sapiens
ucaggaaagccggagaauu

SEQ ID NO: 347042 - RNA, 19 nt, Homo sapiens
cuccagaagggaagaaauu

SEQ ID NO: 347043 - RNA, 19 nt, Homo sapiens
ucaguuugcacaacaagau

SEQ ID NO: 347044 - RNA, 19 nt, Homo sapiens
ccugauggcccuagacaag

SEQ ID NO: 347045 - RNA, 19 nt, Homo sapiens
gguggaggaauuaagugaa

SEQ ID NO: 347046 - RNA, 19 nt, Homo sapiens
ucucagaggacgccuaaag

SEQ ID NO: 347047 - RNA, 19 nt, Homo sapiens
caacaaggaacugggaaac

SEQ ID NO: 347048 - RNA, 19 nt, Homo sapiens
cagccugauaguuaagaua

SEQ ID NO: 347049 - RNA, 19 nt, Homo sapiens
ggaccugguucugccuucu

SEQ ID NO: 347050 - RNA, 19 nt, Homo sapiens
cgcccacccugauuucuca

SEQ ID NO: 347051 - RNA, 19 nt, Homo sapiens
aauaauccauccuccuacu

SEQ ID NO: 347052 - RNA, 19 nt, Homo sapiens
gauguuacccuggcucaac

SEQ ID NO: 347053 - RNA, 19 nt, Homo sapiens
acuagcggaucaaguaugg

SEQ ID NO: 347054 - RNA, 19 nt, Homo sapiens
cccgagccauccuggaaga

SEQ ID NO: 347055 - RNA, 19 nt, Homo sapiens
augagcagauggaguaugg

SEQ ID NO: 347056 - RNA, 19 nt, Homo sapiens
gaucaaguauggacacuga

SEQ ID NO: 347057 - RNA, 19 nt, Homo sapiens
ccugagaaauggccaaaua

SEQ ID NO: 347058 - RNA, 19 nt, Homo sapiens
caggaaagccggagaauug

SEQ ID NO: 347059 - RNA, 19 nt, Homo sapiens
gagaaauggccaaauauau

SEQ ID NO: 347060 - RNA, 19 nt, Homo sapiens
cuaaaucaaucugcaguuu

SEQ ID NO: 347061 - RNA, 19 nt, Homo sapiens
gcuaauggcgaucaucuuu

SEQ ID NO: 347062 - RNA, 19 nt, Homo sapiens
gauguaagccuggagcuaa

SEQ ID NO: 347063 - RNA, 19 nt, Homo sapiens
ugagaaauggccaaauaua

SEQ ID NO: 347064 - RNA, 19 nt, Homo sapiens
uaaagaaccaucagcauca

SEQ ID NO: 347065 - RNA, 19 nt, Homo sapiens
gaaugagucuccuguugag

SEQ ID NO: 347066 - RNA, 19 nt, Homo sapiens
guggaggaauuaagugaaa

SEQ ID NO: 347067 - RNA, 19 nt, Homo sapiens
uggauuauguguacaguug

SEQ ID NO: 347068 - RNA, 19 nt, Homo sapiens
ggaccaaggacguggauga

SEQ ID NO: 347069 - RNA, 19 nt, Homo sapiens
acaaggaacugggaaacuu

SEQ ID NO: 347070 - RNA, 19 nt, Homo sapiens
ggaccuacaccucaggaaa

SEQ ID NO: 347071 - RNA, 19 nt, Homo sapiens
agucauggcuaauuuaaca

SEQ ID NO: 347072 - RNA, 19 nt, Homo sapiens
ggaaguccaaccugagaaa

SEQ ID NO: 347073 - RNA, 19 nt, Homo sapiens
gcaggagguggaggaauua

SEQ ID NO: 347074 - RNA, 19 nt, Homo sapiens
cagcuucugcguccucuua

SEQ ID NO: 347075 - RNA, 19 nt, Homo sapiens
ugauuuguaugcucauuga

SEQ ID NO: 347076 - RNA, 19 nt, Homo sapiens
gcuaauuuaacacccuuua

SEQ ID NO: 347077 - RNA, 19 nt, Homo sapiens
agagguggcucagaaauuc

SEQ ID NO: 347078 - RNA, 19 nt, Homo sapiens
gcucauugaacuuuaagaa

SEQ ID NO: 347079 - RNA, 19 nt, Homo sapiens
guaugcucauugaacuuua

SEQ ID NO: 347080 - RNA, 19 nt, Homo sapiens
caaggaacugggaaacuuu

SEQ ID NO: 347081 - RNA, 19 nt, Homo sapiens
uccaagagguggcucagaa

SEQ ID NO: 347082 - RNA, 19 nt, Homo sapiens
acaguugguucaucccuuu

SEQ ID NO: 347083 - RNA, 19 nt, Homo sapiens
cuacgagaguccucauaug

SEQ ID NO: 347084 - RNA, 19 nt, Homo sapiens
gaaugccuuuucucuuuua

SEQ ID NO: 347085 - RNA, 19 nt, Homo sapiens
ugcaggagguggaggaauu

SEQ ID NO: 347086 - RNA, 19 nt, Homo sapiens
uaauucgagucauggcuaa

SEQ ID NO: 347087 - RNA, 19 nt, Homo sapiens
uacccuggcucaacuguau

SEQ ID NO: 347088 - RNA, 19 nt, Homo sapiens
cuccagagauggucacaug

SEQ ID NO: 347089 - RNA, 19 nt, Homo sapiens
ggagguggaggaauuaagu

SEQ ID NO: 347090 - RNA, 19 nt, Homo sapiens
cgagucauggcuaauuuaa

SEQ ID NO: 347091 - RNA, 19 nt, Homo sapiens
ccccugggcuuuuggauua

SEQ ID NO: 347092 - RNA, 19 nt, Homo sapiens
gagccauccuggaagaaca

SEQ ID NO: 347093 - RNA, 19 nt, Homo sapiens
ucgaaugccuuuucucuuu

SEQ ID NO: 347094 - RNA, 19 nt, Homo sapiens
uaacacaaaggaaguccaa

SEQ ID NO: 347095 - RNA, 19 nt, Homo sapiens
agaaugagucuccuguuga

SEQ ID NO: 347096 - RNA, 19 nt, Homo sapiens
ccacaguaauuggucaugu

SEQ ID NO: 347097 - RNA, 19 nt, Homo sapiens
gcuacgagaguccucauau

SEQ ID NO: 347098 - RNA, 19 nt, Homo sapiens
cagcuccacugcacugugu

SEQ ID NO: 347099 - RNA, 19 nt, Homo sapiens
uacgagaguccucauauga

SEQ ID NO: 347100 - RNA, 19 nt, Homo sapiens
gggaaugaaauuaacacaa

SEQ ID NO: 347101 - RNA, 19 nt, Homo sapiens
acuagcacuuugagaauga

SEQ ID NO: 347102 - RNA, 19 nt, Homo sapiens
aguaauuggucaugugaug

SEQ ID NO: 347103 - RNA, 19 nt, Homo sapiens
gaaccuuaaagaaccauca

SEQ ID NO: 347104 - RNA, 19 nt, Homo sapiens
uaauggcgaucaucuuugc

SEQ ID NO: 347105 - RNA, 19 nt, Homo sapiens
caagagguggcucagaaau

SEQ ID NO: 347106 - RNA, 19 nt, Homo sapiens
ccaagagguggcucagaaa

SEQ ID NO: 347107 - RNA, 19 nt, Homo sapiens
gagcuaauggcgaucaucu

SEQ ID NO: 347108 - RNA, 19 nt, Homo sapiens
uaacacccuuuagaaccuu

SEQ ID NO: 347109 - RNA, 19 nt, Homo sapiens
ggauguaagccuggagcua

SEQ ID NO: 347110 - RNA, 19 nt, Homo sapiens
cauugaacuuuaagaagca

SEQ ID NO: 347111 - RNA, 19 nt, Homo sapiens
gauuauguguacaguuggu

SEQ ID NO: 347112 - RNA, 19 nt, Homo sapiens
gaccuacaccucaggaaag

SEQ ID NO: 347113 - RNA, 19 nt, Homo sapiens
ggaggaauuaagugaaaca

SEQ ID NO: 347114 - RNA, 19 nt, Homo sapiens
ggugauuuguaugcucauu

SEQ ID NO: 347115 - RNA, 19 nt, Homo sapiens
cagcuuacuagcacuuuga

SEQ ID NO: 347116 - RNA, 19 nt, Homo sapiens
cgaaugccuuuucucuuuu

SEQ ID NO: 347117 - RNA, 19 nt, Homo sapiens
ucaaucugcaguuuaacaa

SEQ ID NO: 347118 - RNA, 19 nt, Homo sapiens
ccaacaaggaacugggaaa

SEQ ID NO: 347119 - RNA, 19 nt, Homo sapiens
cauaugaggaggcccacaa

SEQ ID NO: 347120 - RNA, 19 nt, Homo sapiens
gacaagaccccaucgaaug

SEQ ID NO: 347121 - RNA, 19 nt, Homo sapiens
aagaagcaguguuuuagaa

SEQ ID NO: 347122 - RNA, 19 nt, Homo sapiens
gaaguccaaccugagaaau

SEQ ID NO: 347123 - RNA, 19 nt, Homo sapiens
gguucugccuucuggacaa

SEQ ID NO: 347124 - RNA, 19 nt, Homo sapiens
ccagcuuacuagcacuuug

SEQ ID NO: 347125 - RNA, 19 nt, Homo sapiens
gagaggggauucacaaggu

SEQ ID NO: 347126 - RNA, 19 nt, Homo sapiens
cuuacuagcacuuugagaa

SEQ ID NO: 347127 - RNA, 19 nt, Homo sapiens
aagagguggcucagaaauu

SEQ ID NO: 347128 - RNA, 19 nt, Homo sapiens
ggacucccacuuccaagag

SEQ ID NO: 347129 - RNA, 19 nt, Homo sapiens
caaucugcaguuuaacaaa

SEQ ID NO: 347130 - RNA, 19 nt, Homo sapiens
cagcaucacccgggaacuu

SEQ ID NO: 347131 - RNA, 19 nt, Homo sapiens
gagccugcuugggaaugaa

SEQ ID NO: 347132 - RNA, 19 nt, Homo sapiens
gaagcugggccugggcuau

SEQ ID NO: 347133 - RNA, 19 nt, Homo sapiens
gagcaaaguccugcacacu

SEQ ID NO: 347134 - RNA, 19 nt, Homo sapiens
ucgagucauggcuaauuua

SEQ ID NO: 347135 - RNA, 19 nt, Homo sapiens
gcaaagggcgaggcaugca

SEQ ID NO: 347136 - RNA, 19 nt, Homo sapiens
ucaggaaagccggagaauu

SEQ ID NO: 347137 - RNA, 19 nt, Homo sapiens
uuacuagcacuuugagaau

SEQ ID NO: 347138 - RNA, 19 nt, Homo sapiens
uucgagucauggcuaauuu

SEQ ID NO: 347139 - RNA, 19 nt, Homo sapiens
gcuugggaaugaaauuaac

SEQ ID NO: 347140 - RNA, 19 nt, Homo sapiens
acaguaauuggucauguga

SEQ ID NO: 347141 - RNA, 19 nt, Homo sapiens
ccugauggcccuagacaag

SEQ ID NO: 347142 - RNA, 19 nt, Homo sapiens
gguggaggaauuaagugaa

SEQ ID NO: 347143 - RNA, 19 nt, Homo sapiens
uguaugcucauugaacuuu

SEQ ID NO: 347144 - RNA, 19 nt, Homo sapiens
auccucaggugauuuguau

SEQ ID NO: 347145 - RNA, 19 nt, Homo sapiens
gcaaaaucucuacugcuuu

SEQ ID NO: 347146 - RNA, 19 nt, Homo sapiens
gcacuuugagaaugagucu

SEQ ID NO: 347147 - RNA, 19 nt, Homo sapiens
uacuagcacuuugagaaug

SEQ ID NO: 347148 - RNA, 19 nt, Homo sapiens
ggaccugguucugccuucu

SEQ ID NO: 347149 - RNA, 19 nt, Homo sapiens
caggaucaccuccgagaag

SEQ ID NO: 347150 - RNA, 19 nt, Homo sapiens
caacaaggaacugggaaac

SEQ ID NO: 347151 - RNA, 19 nt, Homo sapiens
acuagcggaucaaguaugg

SEQ ID NO: 347152 - RNA, 19 nt, Homo sapiens
gauguuacccuggcucaac

SEQ ID NO: 347153 - RNA, 19 nt, Homo sapiens
acuuuaagaagcaguguuu

SEQ ID NO: 347154 - RNA, 19 nt, Homo sapiens
cugcuugggaaugaaauua

SEQ ID NO: 347155 - RNA, 19 nt, Homo sapiens
agagccugcuugggaauga

SEQ ID NO: 347156 - RNA, 19 nt, Homo sapiens
gaucaaguauggacacuga

SEQ ID NO: 347157 - RNA, 19 nt, Homo sapiens
ccugagaaauggccaaaua

SEQ ID NO: 347158 - RNA, 19 nt, Homo sapiens
caggaaagccggagaauug

SEQ ID NO: 347159 - RNA, 19 nt, Homo sapiens
gagaaauggccaaauauau

SEQ ID NO: 347160 - RNA, 19 nt, Homo sapiens
cuaaaucaaucugcaguuu

SEQ ID NO: 347161 - RNA, 19 nt, Homo sapiens
gcuaauggcgaucaucuuu

SEQ ID NO: 347162 - RNA, 19 nt, Homo sapiens
gauguaagccuggagcuaa

SEQ ID NO: 347163 - RNA, 19 nt, Homo sapiens
ugagaaauggccaaauaua

SEQ ID NO: 347164 - RNA, 19 nt, Homo sapiens
uaaagaaccaucagcauca

SEQ ID NO: 347165 - RNA, 19 nt, Homo sapiens
gaaugagucuccuguugag

SEQ ID NO: 347166 - RNA, 19 nt, Homo sapiens
guggaggaauuaagugaaa

SEQ ID NO: 347167 - RNA, 19 nt, Homo sapiens
uggauuauguguacaguug

SEQ ID NO: 347168 - RNA, 19 nt, Homo sapiens
ggaccaaggacguggauga

SEQ ID NO: 347169 - RNA, 19 nt, Homo sapiens
agucauggcuaauuuaaca

SEQ ID NO: 347170 - RNA, 19 nt, Homo sapiens
ggaaguccaaccugagaaa

SEQ ID NO: 347171 - RNA, 19 nt, Homo sapiens
ggaccuacaccucaggaaa

SEQ ID NO: 347172 - RNA, 19 nt, Homo sapiens
gcaggagguggaggaauua

SEQ ID NO: 347173 - RNA, 19 nt, Homo sapiens
cagcuucugcguccucuua

SEQ ID NO: 347174 - RNA, 19 nt, Homo sapiens
ugauuuguaugcucauuga

SEQ ID NO: 347175 - RNA, 19 nt, Homo sapiens
gcuaauuuaacacccuuua

SEQ ID NO: 347176 - RNA, 19 nt, Homo sapiens
agagguggcucagaaauuc

SEQ ID NO: 347177 - RNA, 19 nt, Homo sapiens
gcucauugaacuuuaagaa

SEQ ID NO: 347178 - RNA, 19 nt, Homo sapiens
guaugcucauugaacuuua

SEQ ID NO: 347179 - RNA, 19 nt, Homo sapiens
uccaagagguggcucagaa

SEQ ID NO: 347180 - RNA, 19 nt, Homo sapiens
acaguugguucaucccuuu

SEQ ID NO: 347181 - RNA, 19 nt, Homo sapiens
cuacgagaguccucauaug

SEQ ID NO: 347182 - RNA, 19 nt, Homo sapiens
gaaugccuuuucucuuuua

SEQ ID NO: 347183 - RNA, 19 nt, Homo sapiens
ugcaggagguggaggaauu

SEQ ID NO: 347184 - RNA, 19 nt, Homo sapiens
uaauucgagucauggcuaa

SEQ ID NO: 347185 - RNA, 19 nt, Homo sapiens
uacccuggcucaacuguau

SEQ ID NO: 347186 - RNA, 19 nt, Homo sapiens
ggagguggaggaauuaagu

SEQ ID NO: 347187 - RNA, 19 nt, Homo sapiens
cuccagagauggucacaug

SEQ ID NO: 347188 - RNA, 19 nt, Homo sapiens
cgagucauggcuaauuuaa

SEQ ID NO: 347189 - RNA, 19 nt, Homo sapiens
ccccugggcuuuuggauua

SEQ ID NO: 347190 - RNA, 19 nt, Homo sapiens
gagccauccuggaagaaca

SEQ ID NO: 347191 - RNA, 19 nt, Homo sapiens
ucgaaugccuuuucucuuu

SEQ ID NO: 347192 - RNA, 19 nt, Homo sapiens
uaacacaaaggaaguccaa

SEQ ID NO: 347193 - RNA, 19 nt, Homo sapiens
agaaugagucuccuguuga

SEQ ID NO: 347194 - RNA, 19 nt, Homo sapiens
ccacaguaauuggucaugu

SEQ ID NO: 347195 - RNA, 19 nt, Homo sapiens
gcuacgagaguccucauau

SEQ ID NO: 347196 - RNA, 19 nt, Homo sapiens
cagcuccacugcacugugu

SEQ ID NO: 347197 - RNA, 19 nt, Homo sapiens
uacgagaguccucauauga

SEQ ID NO: 347198 - RNA, 19 nt, Homo sapiens
gggaaugaaauuaacacaa

SEQ ID NO: 347199 - RNA, 19 nt, Homo sapiens
acuagcacuuugagaauga

SEQ ID NO: 347200 - RNA, 19 nt, Homo sapiens
aguaauuggucaugugaug

SEQ ID NO: 347201 - RNA, 19 nt, Homo sapiens
gaaccuuaaagaaccauca

SEQ ID NO: 347202 - RNA, 19 nt, Homo sapiens
uaauggcgaucaucuuugc

SEQ ID NO: 347203 - RNA, 19 nt, Homo sapiens
caagagguggcucagaaau

SEQ ID NO: 347204 - RNA, 19 nt, Homo sapiens
ccaagagguggcucagaaa

SEQ ID NO: 347205 - RNA, 19 nt, Homo sapiens
gagcuaauggcgaucaucu

SEQ ID NO: 347206 - RNA, 19 nt, Homo sapiens
uaacacccuuuagaaccuu

SEQ ID NO: 347207 - RNA, 19 nt, Homo sapiens
ggauguaagccuggagcua

SEQ ID NO: 347208 - RNA, 19 nt, Homo sapiens
cauugaacuuuaagaagca

SEQ ID NO: 347209 - RNA, 19 nt, Homo sapiens
ggaggaauuaagugaaaca

SEQ ID NO: 347210 - RNA, 19 nt, Homo sapiens
gauuauguguacaguuggu

SEQ ID NO: 347211 - RNA, 19 nt, Homo sapiens
gaccuacaccucaggaaag

SEQ ID NO: 347212 - RNA, 19 nt, Homo sapiens
ggugauuuguaugcucauu

SEQ ID NO: 347213 - RNA, 19 nt, Homo sapiens
cagcuuacuagcacuuuga

SEQ ID NO: 347214 - RNA, 19 nt, Homo sapiens
cgaaugccuuuucucuuuu

SEQ ID NO: 347215 - RNA, 19 nt, Homo sapiens
ucaaucugcaguuuaacaa

SEQ ID NO: 347216 - RNA, 19 nt, Homo sapiens
cauaugaggaggcccacaa

SEQ ID NO: 347217 - RNA, 19 nt, Homo sapiens
gacaagaccccaucgaaug

SEQ ID NO: 347218 - RNA, 19 nt, Homo sapiens
aagaagcaguguuuuagaa

SEQ ID NO: 347219 - RNA, 19 nt, Homo sapiens
gguucugccuucuggacaa

SEQ ID NO: 347220 - RNA, 19 nt, Homo sapiens
ggagaacccagaagaacac

SEQ ID NO: 347221 - RNA, 19 nt, Homo sapiens
gaaguccaaccugagaaau

SEQ ID NO: 347222 - RNA, 19 nt, Homo sapiens
ccagcuuacuagcacuuug

SEQ ID NO: 347223 - RNA, 19 nt, Homo sapiens
gagaggggauucacaaggu

SEQ ID NO: 347224 - RNA, 19 nt, Homo sapiens
cuuacuagcacuuugagaa

SEQ ID NO: 347225 - RNA, 19 nt, Homo sapiens
aagagguggcucagaaauu

SEQ ID NO: 347226 - RNA, 19 nt, Homo sapiens
ggacucccacuuccaagag

SEQ ID NO: 347227 - RNA, 19 nt, Homo sapiens
caaucugcaguuuaacaaa

SEQ ID NO: 347228 - RNA, 19 nt, Homo sapiens
cagcaucacccgggaacuu

SEQ ID NO: 347229 - RNA, 19 nt, Homo sapiens
gagccugcuugggaaugaa

SEQ ID NO: 347230 - RNA, 19 nt, Homo sapiens
gaagcugggccugggcuau

SEQ ID NO: 347231 - RNA, 19 nt, Homo sapiens
ucgagucauggcuaauuua

SEQ ID NO: 347232 - RNA, 19 nt, Homo sapiens
gagcaaaguccugcacacu

SEQ ID NO: 347233 - RNA, 19 nt, Homo sapiens
gcaaagggcgaggcaugca

SEQ ID NO: 347234 - RNA, 19 nt, Homo sapiens
uuacuagcacuuugagaau

SEQ ID NO: 347235 - RNA, 19 nt, Homo sapiens
ucaggaaagccggagaauu

SEQ ID NO: 347236 - RNA, 19 nt, Homo sapiens
uucgagucauggcuaauuu

SEQ ID NO: 347237 - RNA, 19 nt, Homo sapiens
gcuugggaaugaaauuaac

SEQ ID NO: 347238 - RNA, 19 nt, Homo sapiens
acaguaauuggucauguga

SEQ ID NO: 347239 - RNA, 19 nt, Homo sapiens
gguggaggaauuaagugaa

SEQ ID NO: 347240 - RNA, 19 nt, Homo sapiens
uguaugcucauugaacuuu

SEQ ID NO: 347241 - RNA, 19 nt, Homo sapiens
auccucaggugauuuguau

SEQ ID NO: 347242 - RNA, 19 nt, Homo sapiens
gcaaaaucucuacugcuuu

SEQ ID NO: 347243 - RNA, 19 nt, Homo sapiens
ggaccugguucugccuucu

SEQ ID NO: 347244 - RNA, 19 nt, Homo sapiens
gcacuuugagaaugagucu

SEQ ID NO: 347245 - RNA, 19 nt, Homo sapiens
uacuagcacuuugagaaug

SEQ ID NO: 347246 - RNA, 19 nt, Homo sapiens
caggaucaccuccgagaag

SEQ ID NO: 347247 - RNA, 19 nt, Homo sapiens
gauguuacccuggcucaac

SEQ ID NO: 347248 - RNA, 19 nt, Homo sapiens
acuagcggaucaaguaugg

SEQ ID NO: 347249 - RNA, 19 nt, Homo sapiens
acuuuaagaagcaguguuu

SEQ ID NO: 347250 - RNA, 19 nt, Homo sapiens
cugcuugggaaugaaauua

SEQ ID NO: 347251 - RNA, 19 nt, Homo sapiens
agagccugcuugggaauga

SEQ ID NO: 347252 - RNA, 19 nt, Homo sapiens
cuaauggcgaucaucuuug

SEQ ID NO: 347253 - RNA, 19 nt, Homo sapiens
cccgagccauccuggaaga

SEQ ID NO: 347254 - RNA, 19 nt, Homo sapiens
gaucaaguauggacacuga

SEQ ID NO: 347255 - RNA, 19 nt, Homo sapiens
ccugagaaauggccaaaua

SEQ ID NO: 347256 - RNA, 19 nt, Homo sapiens
caggaaagccggagaauug

SEQ ID NO: 347257 - RNA, 19 nt, Homo sapiens
gagaaauggccaaauauau

SEQ ID NO: 347258 - RNA, 19 nt, Homo sapiens
cuaaaucaaucugcaguuu

SEQ ID NO: 347259 - RNA, 19 nt, Homo sapiens
gcuaauggcgaucaucuuu

SEQ ID NO: 347260 - RNA, 19 nt, Homo sapiens
gauguaagccuggagcuaa

SEQ ID NO: 347261 - RNA, 19 nt, Homo sapiens
ugagaaauggccaaauaua

SEQ ID NO: 347262 - RNA, 19 nt, Homo sapiens
uaaagaaccaucagcauca

SEQ ID NO: 347263 - RNA, 19 nt, Homo sapiens
gaaugagucuccuguugag

SEQ ID NO: 347264 - RNA, 19 nt, Homo sapiens
guggaggaauuaagugaaa

SEQ ID NO: 347265 - RNA, 19 nt, Homo sapiens
uggauuauguguacaguug

SEQ ID NO: 347266 - RNA, 19 nt, Homo sapiens
ggaccaaggacguggauga

SEQ ID NO: 347267 - RNA, 19 nt, Homo sapiens
agucauggcuaauuuaaca

SEQ ID NO: 347268 - RNA, 19 nt, Homo sapiens
ggaaguccaaccugagaaa

SEQ ID NO: 347269 - RNA, 19 nt, Homo sapiens
ggaccuacaccucaggaaa

SEQ ID NO: 347270 - RNA, 19 nt, Homo sapiens
gcaggagguggaggaauua

SEQ ID NO: 347271 - RNA, 19 nt, Homo sapiens
cagcuucugcguccucuua

SEQ ID NO: 347272 - RNA, 19 nt, Homo sapiens
ugauuuguaugcucauuga

SEQ ID NO: 347273 - RNA, 19 nt, Homo sapiens
gcuaauuuaacacccuuua

SEQ ID NO: 347274 - RNA, 19 nt, Homo sapiens
agagguggcucagaaauuc

SEQ ID NO: 347275 - RNA, 19 nt, Homo sapiens
gcucauugaacuuuaagaa

SEQ ID NO: 347276 - RNA, 19 nt, Homo sapiens
guaugcucauugaacuuua

SEQ ID NO: 347277 - RNA, 19 nt, Homo sapiens
uccaagagguggcucagaa

SEQ ID NO: 347278 - RNA, 19 nt, Homo sapiens
acaguugguucaucccuuu

SEQ ID NO: 347279 - RNA, 19 nt, Homo sapiens
gaaugccuuuucucuuuua

SEQ ID NO: 347280 - RNA, 19 nt, Homo sapiens
ugcaggagguggaggaauu

SEQ ID NO: 347281 - RNA, 19 nt, Homo sapiens
uaauucgagucauggcuaa

SEQ ID NO: 347282 - RNA, 19 nt, Homo sapiens
uacccuggcucaacuguau

SEQ ID NO: 347283 - RNA, 19 nt, Homo sapiens
ggagguggaggaauuaagu

SEQ ID NO: 347284 - RNA, 19 nt, Homo sapiens
cuccagagauggucacaug

SEQ ID NO: 347285 - RNA, 19 nt, Homo sapiens
cgagucauggcuaauuuaa

SEQ ID NO: 347286 - RNA, 19 nt, Homo sapiens
ccccugggcuuuuggauua

SEQ ID NO: 347287 - RNA, 19 nt, Homo sapiens
ucgaaugccuuuucucuuu

SEQ ID NO: 347288 - RNA, 19 nt, Homo sapiens
uaacacaaaggaaguccaa

SEQ ID NO: 347289 - RNA, 19 nt, Homo sapiens
agaaugagucuccuguuga

SEQ ID NO: 347290 - RNA, 19 nt, Homo sapiens
ccacaguaauuggucaugu

SEQ ID NO: 347291 - RNA, 19 nt, Homo sapiens
cagcuccacugcacugugu

SEQ ID NO: 347292 - RNA, 19 nt, Homo sapiens
gggaaugaaauuaacacaa

SEQ ID NO: 347293 - RNA, 19 nt, Homo sapiens
acuagcacuuugagaauga

SEQ ID NO: 347294 - RNA, 19 nt, Homo sapiens
aguaauuggucaugugaug

SEQ ID NO: 347295 - RNA, 19 nt, Homo sapiens
gaaccuuaaagaaccauca

SEQ ID NO: 347296 - RNA, 19 nt, Homo sapiens
uaauggcgaucaucuuugc

SEQ ID NO: 347297 - RNA, 19 nt, Homo sapiens
caagagguggcucagaaau

SEQ ID NO: 347298 - RNA, 19 nt, Homo sapiens
ccaagagguggcucagaaa

SEQ ID NO: 347299 - RNA, 19 nt, Homo sapiens
gagcuaauggcgaucaucu

SEQ ID NO: 347300 - RNA, 19 nt, Homo sapiens
uaacacccuuuagaaccuu

SEQ ID NO: 347301 - RNA, 19 nt, Homo sapiens
ggauguaagccuggagcua

SEQ ID NO: 347302 - RNA, 19 nt, Homo sapiens
cauugaacuuuaagaagca

SEQ ID NO: 347303 - RNA, 19 nt, Homo sapiens
gauuauguguacaguuggu

SEQ ID NO: 347304 - RNA, 19 nt, Homo sapiens
gaccuacaccucaggaaag

SEQ ID NO: 347305 - RNA, 19 nt, Homo sapiens
ggaggaauuaagugaaaca

SEQ ID NO: 347306 - RNA, 19 nt, Homo sapiens
ggugauuuguaugcucauu

SEQ ID NO: 347307 - RNA, 19 nt, Homo sapiens
cagcuuacuagcacuuuga

SEQ ID NO: 347308 - RNA, 19 nt, Homo sapiens
cgaaugccuuuucucuuuu

SEQ ID NO: 347309 - RNA, 19 nt, Homo sapiens
ucaaucugcaguuuaacaa

SEQ ID NO: 347310 - RNA, 19 nt, Homo sapiens
gacaagaccccaucgaaug

SEQ ID NO: 347311 - RNA, 19 nt, Homo sapiens
aagaagcaguguuuuagaa

SEQ ID NO: 347312 - RNA, 19 nt, Homo sapiens
gguucugccuucuggacaa

SEQ ID NO: 347313 - RNA, 19 nt, Homo sapiens
ggagaacccagaagaacac

SEQ ID NO: 347314 - RNA, 19 nt, Homo sapiens
gaaguccaaccugagaaau

SEQ ID NO: 347315 - RNA, 19 nt, Homo sapiens
ccagcuuacuagcacuuug

SEQ ID NO: 347316 - RNA, 19 nt, Homo sapiens
gagaggggauucacaaggu

SEQ ID NO: 347317 - RNA, 19 nt, Homo sapiens
cuuacuagcacuuugagaa

SEQ ID NO: 347318 - RNA, 19 nt, Homo sapiens
aagagguggcucagaaauu

SEQ ID NO: 347319 - RNA, 19 nt, Homo sapiens
ggacucccacuuccaagag

SEQ ID NO: 347320 - RNA, 19 nt, Homo sapiens
caaucugcaguuuaacaaa

SEQ ID NO: 347321 - RNA, 19 nt, Homo sapiens
cagcaucacccgggaacuu

SEQ ID NO: 347322 - RNA, 19 nt, Homo sapiens
gagccugcuugggaaugaa

SEQ ID NO: 347323 - RNA, 19 nt, Homo sapiens
ucaggaaagccggagaauu

SEQ ID NO: 347324 - RNA, 19 nt, Homo sapiens
ucgagucauggcuaauuua

SEQ ID NO: 347325 - RNA, 19 nt, Homo sapiens
gcaaagggcgaggcaugca

SEQ ID NO: 347326 - RNA, 19 nt, Homo sapiens
uuacuagcacuuugagaau

SEQ ID NO: 347327 - RNA, 19 nt, Homo sapiens
gagcaaaguccugcacacu

SEQ ID NO: 347328 - RNA, 19 nt, Homo sapiens
uucgagucauggcuaauuu

SEQ ID NO: 347329 - RNA, 19 nt, Homo sapiens
gcuugggaaugaaauuaac

SEQ ID NO: 347330 - RNA, 19 nt, Homo sapiens
acaguaauuggucauguga

SEQ ID NO: 347331 - RNA, 19 nt, Homo sapiens
gguggaggaauuaagugaa

SEQ ID NO: 347332 - RNA, 19 nt, Homo sapiens
uguaugcucauugaacuuu

SEQ ID NO: 347333 - RNA, 19 nt, Homo sapiens
auccucaggugauuuguau

SEQ ID NO: 347334 - RNA, 19 nt, Homo sapiens
gcaaaaucucuacugcuuu

SEQ ID NO: 347335 - RNA, 19 nt, Homo sapiens
ggaccugguucugccuucu

SEQ ID NO: 347336 - RNA, 19 nt, Homo sapiens
gcacuuugagaaugagucu

SEQ ID NO: 347337 - RNA, 19 nt, Homo sapiens
uacuagcacuuugagaaug

SEQ ID NO: 347338 - RNA, 19 nt, Homo sapiens
caggaucaccuccgagaag

SEQ ID NO: 347339 - RNA, 19 nt, Homo sapiens
acuagcggaucaaguaugg

SEQ ID NO: 347340 - RNA, 19 nt, Homo sapiens
gauguuacccuggcucaac

SEQ ID NO: 347341 - RNA, 19 nt, Homo sapiens
acuuuaagaagcaguguuu

SEQ ID NO: 347342 - RNA, 19 nt, Homo sapiens
cugcuugggaaugaaauua

SEQ ID NO: 347343 - RNA, 19 nt, Homo sapiens
agagccugcuugggaauga

SEQ ID NO: 347344 - RNA, 19 nt, Homo sapiens
cuaauggcgaucaucuuug

SEQ ID NO: 347345 - RNA, 19 nt, Homo sapiens
gaucaaguauggacacuga

SEQ ID NO: 347346 - RNA, 19 nt, Homo sapiens
ccugagaaauggccaaaua

SEQ ID NO: 347347 - RNA, 19 nt, Homo sapiens
caggaaagccggagaauug

SEQ ID NO: 347348 - RNA, 19 nt, Homo sapiens
gagaaauggccaaauauau

SEQ ID NO: 347349 - RNA, 19 nt, Homo sapiens
gaugccuccugaagaauua

SEQ ID NO: 347350 - RNA, 19 nt, Homo sapiens
cuaaaucaaucugcaguuu

SEQ ID NO: 347351 - RNA, 19 nt, Homo sapiens
gcuaauggcgaucaucuuu

SEQ ID NO: 347352 - RNA, 19 nt, Homo sapiens
gauguaagccuggagcuaa

SEQ ID NO: 347353 - RNA, 19 nt, Homo sapiens
ugagaaauggccaaauaua

SEQ ID NO: 347354 - RNA, 19 nt, Homo sapiens
uaaagaaccaucagcauca

SEQ ID NO: 347355 - RNA, 19 nt, Homo sapiens
gaaugagucuccuguugag

SEQ ID NO: 347356 - RNA, 19 nt, Homo sapiens
guggaggaauuaagugaaa

SEQ ID NO: 347357 - RNA, 19 nt, Homo sapiens
uggauuauguguacaguug

SEQ ID NO: 347358 - RNA, 19 nt, Homo sapiens
ggaccaaggacguggauga

SEQ ID NO: 347359 - RNA, 19 nt, Homo sapiens
acaaggaacugggaaacuu

SEQ ID NO: 347360 - RNA, 19 nt, Homo sapiens
ggaccuacaccucaggaaa

SEQ ID NO: 347361 - RNA, 19 nt, Homo sapiens
agucauggcuaauuuaaca

SEQ ID NO: 347362 - RNA, 19 nt, Homo sapiens
ggaaguccaaccugagaaa

SEQ ID NO: 347363 - RNA, 19 nt, Homo sapiens
uuacagacuucuuccucua

SEQ ID NO: 347364 - RNA, 19 nt, Homo sapiens
gcaggagguggaggaauua

SEQ ID NO: 347365 - RNA, 19 nt, Homo sapiens
cagcuucugcguccucuua

SEQ ID NO: 347366 - RNA, 19 nt, Homo sapiens
ugauuuguaugcucauuga

SEQ ID NO: 347367 - RNA, 19 nt, Homo sapiens
gcuaauuuaacacccuuua

SEQ ID NO: 347368 - RNA, 19 nt, Homo sapiens
agagguggcucagaaauuc

SEQ ID NO: 347369 - RNA, 19 nt, Homo sapiens
gcucauugaacuuuaagaa

SEQ ID NO: 347370 - RNA, 19 nt, Homo sapiens
guaugcucauugaacuuua

SEQ ID NO: 347371 - RNA, 19 nt, Homo sapiens
caaggaacugggaaacuuu

SEQ ID NO: 347372 - RNA, 19 nt, Homo sapiens
uccaagagguggcucagaa

SEQ ID NO: 347373 - RNA, 19 nt, Homo sapiens
acaguugguucaucccuuu

SEQ ID NO: 347374 - RNA, 19 nt, Homo sapiens
cuacgagaguccucauaug

SEQ ID NO: 347375 - RNA, 19 nt, Homo sapiens
gaaugccuuuucucuuuua

SEQ ID NO: 347376 - RNA, 19 nt, Homo sapiens
uaauucgagucauggcuaa

SEQ ID NO: 347377 - RNA, 19 nt, Homo sapiens
ugcaggagguggaggaauu

SEQ ID NO: 347378 - RNA, 19 nt, Homo sapiens
uacccuggcucaacuguau

SEQ ID NO: 347379 - RNA, 19 nt, Homo sapiens
ggagguggaggaauuaagu

SEQ ID NO: 347380 - RNA, 19 nt, Homo sapiens
cuccagagauggucacaug

SEQ ID NO: 347381 - RNA, 19 nt, Homo sapiens
cgagucauggcuaauuuaa

SEQ ID NO: 347382 - RNA, 19 nt, Homo sapiens
ccccugggcuuuuggauua

SEQ ID NO: 347383 - RNA, 19 nt, Homo sapiens
gagccauccuggaagaaca

SEQ ID NO: 347384 - RNA, 19 nt, Homo sapiens
ucgaaugccuuuucucuuu

SEQ ID NO: 347385 - RNA, 19 nt, Homo sapiens
uaacacaaaggaaguccaa

SEQ ID NO: 347386 - RNA, 19 nt, Homo sapiens
agaaugagucuccuguuga

SEQ ID NO: 347387 - RNA, 19 nt, Homo sapiens
ccacaguaauuggucaugu

SEQ ID NO: 347388 - RNA, 19 nt, Homo sapiens
gcuacgagaguccucauau

SEQ ID NO: 347389 - RNA, 19 nt, Homo sapiens
cagcuccacugcacugugu

SEQ ID NO: 347390 - RNA, 19 nt, Homo sapiens
ccugaagaauuacagacuu

SEQ ID NO: 347391 - RNA, 19 nt, Homo sapiens
uacgagaguccucauauga

SEQ ID NO: 347392 - RNA, 19 nt, Homo sapiens
gggaaugaaauuaacacaa

SEQ ID NO: 347393 - RNA, 19 nt, Homo sapiens
acuagcacuuugagaauga

SEQ ID NO: 347394 - RNA, 19 nt, Homo sapiens
aguaauuggucaugugaug

SEQ ID NO: 347395 - RNA, 19 nt, Homo sapiens
cccauaggcuggaucagau

SEQ ID NO: 347396 - RNA, 19 nt, Homo sapiens
gaaccuuaaagaaccauca

SEQ ID NO: 347397 - RNA, 19 nt, Homo sapiens
uaauggcgaucaucuuugc

SEQ ID NO: 347398 - RNA, 19 nt, Homo sapiens
gucaggucaucaccacuuu

SEQ ID NO: 347399 - RNA, 19 nt, Homo sapiens
caagagguggcucagaaau

SEQ ID NO: 347400 - RNA, 19 nt, Homo sapiens
ccaagagguggcucagaaa

SEQ ID NO: 347401 - RNA, 19 nt, Homo sapiens
gagcuaauggcgaucaucu

SEQ ID NO: 347402 - RNA, 19 nt, Homo sapiens
uaacacccuuuagaaccuu

SEQ ID NO: 347403 - RNA, 19 nt, Homo sapiens
ggauguaagccuggagcua

SEQ ID NO: 347404 - RNA, 19 nt, Homo sapiens
cauugaacuuuaagaagca

SEQ ID NO: 347405 - RNA, 19 nt, Homo sapiens
ggaggaauuaagugaaaca

SEQ ID NO: 347406 - RNA, 19 nt, Homo sapiens
gauuauguguacaguuggu

SEQ ID NO: 347407 - RNA, 19 nt, Homo sapiens
gaccuacaccucaggaaag

SEQ ID NO: 347408 - RNA, 19 nt, Homo sapiens
ggugauuuguaugcucauu

SEQ ID NO: 347409 - RNA, 19 nt, Homo sapiens
cagcuuacuagcacuuuga

SEQ ID NO: 347410 - RNA, 19 nt, Homo sapiens
acagacuucuuccucuaga

SEQ ID NO: 347411 - RNA, 19 nt, Homo sapiens
cgaaugccuuuucucuuuu

SEQ ID NO: 347412 - RNA, 19 nt, Homo sapiens
ucaaucugcaguuuaacaa

SEQ ID NO: 347413 - RNA, 19 nt, Homo sapiens
gauccugcuugggaaugaa

SEQ ID NO: 347414 - RNA, 19 nt, Homo sapiens
ccaacaaggaacugggaaa

SEQ ID NO: 347415 - RNA, 19 nt, Homo sapiens
cauaugaggaggcccacaa

SEQ ID NO: 347416 - RNA, 19 nt, Homo sapiens
gacaagaccccaucgaaug

SEQ ID NO: 347417 - RNA, 19 nt, Homo sapiens
aagaagcaguguuuuagaa

SEQ ID NO: 347418 - RNA, 19 nt, Homo sapiens
ggagaacccagaagaacac

SEQ ID NO: 347419 - RNA, 19 nt, Homo sapiens
gaaguccaaccugagaaau

SEQ ID NO: 347420 - RNA, 19 nt, Homo sapiens
gguucugccuucuggacaa

SEQ ID NO: 347421 - RNA, 19 nt, Homo sapiens
ccagcuuacuagcacuuug

SEQ ID NO: 347422 - RNA, 19 nt, Homo sapiens
gagaggggauucacaaggu

SEQ ID NO: 347423 - RNA, 19 nt, Homo sapiens
cuuacuagcacuuugagaa

SEQ ID NO: 347424 - RNA, 19 nt, Homo sapiens
aagagguggcucagaaauu

SEQ ID NO: 347425 - RNA, 19 nt, Homo sapiens
ggacucccacuuccaagag

SEQ ID NO: 347426 - RNA, 19 nt, Homo sapiens
caaucugcaguuuaacaaa

SEQ ID NO: 347427 - RNA, 19 nt, Homo sapiens
cagcaucacccgggaacuu

SEQ ID NO: 347428 - RNA, 19 nt, Homo sapiens
gaagcugggccugggcuau

SEQ ID NO: 347429 - RNA, 19 nt, Homo sapiens
gcaaagggcgaggcaugca

SEQ ID NO: 347430 - RNA, 19 nt, Homo sapiens
ucgagucauggcuaauuua

SEQ ID NO: 347431 - RNA, 19 nt, Homo sapiens
ucaggaaagccggagaauu

SEQ ID NO: 347432 - RNA, 19 nt, Homo sapiens
uuacuagcacuuugagaau

SEQ ID NO: 347433 - RNA, 19 nt, Homo sapiens
gagcaaaguccugcacacu

SEQ ID NO: 347434 - RNA, 19 nt, Homo sapiens
gguggaggaauuaagugaa

SEQ ID NO: 347435 - RNA, 19 nt, Homo sapiens
uucgagucauggcuaauuu

SEQ ID NO: 347436 - RNA, 19 nt, Homo sapiens
gcuugggaaugaaauuaac

SEQ ID NO: 347437 - RNA, 19 nt, Homo sapiens
acaguaauuggucauguga

SEQ ID NO: 347438 - RNA, 19 nt, Homo sapiens
ccugauggcccuagacaag

SEQ ID NO: 347439 - RNA, 19 nt, Homo sapiens
uguaugcucauugaacuuu

SEQ ID NO: 347440 - RNA, 19 nt, Homo sapiens
auccucaggugauuuguau

SEQ ID NO: 347441 - RNA, 19 nt, Homo sapiens
gcaaaaucucuacugcuuu

SEQ ID NO: 347442 - RNA, 19 nt, Homo sapiens
ggagauccugcuugggaau

SEQ ID NO: 347443 - RNA, 19 nt, Homo sapiens
gcacuuugagaaugagucu

SEQ ID NO: 347444 - RNA, 19 nt, Homo sapiens
uacuagcacuuugagaaug

SEQ ID NO: 347445 - RNA, 19 nt, Homo sapiens
gaucaaguauggacacuga

SEQ ID NO: 347446 - RNA, 19 nt, Homo sapiens
ccugagaaauggccaaaua

SEQ ID NO: 347447 - RNA, 19 nt, Homo sapiens
caggaaagccggagaauug

SEQ ID NO: 347448 - RNA, 19 nt, Homo sapiens
gagaaauggccaaauauau

SEQ ID NO: 347449 - RNA, 19 nt, Homo sapiens
gaugccuccugaagaauua

SEQ ID NO: 347450 - RNA, 19 nt, Homo sapiens
cuaaaucaaucugcaguuu

SEQ ID NO: 347451 - RNA, 19 nt, Homo sapiens
gcuaauggcgaucaucuuu

SEQ ID NO: 347452 - RNA, 19 nt, Homo sapiens
gauguaagccuggagcuaa

SEQ ID NO: 347453 - RNA, 19 nt, Homo sapiens
ugagaaauggccaaauaua

SEQ ID NO: 347454 - RNA, 19 nt, Homo sapiens
uaaagaaccaucagcauca

SEQ ID NO: 347455 - RNA, 19 nt, Homo sapiens
gaaugagucuccuguugag

SEQ ID NO: 347456 - RNA, 19 nt, Homo sapiens
guggaggaauuaagugaaa

SEQ ID NO: 347457 - RNA, 19 nt, Homo sapiens
uggauuauguguacaguug

SEQ ID NO: 347458 - RNA, 19 nt, Homo sapiens
ggaccaaggacguggauga

SEQ ID NO: 347459 - RNA, 19 nt, Homo sapiens
acaaggaacugggaaacuu

SEQ ID NO: 347460 - RNA, 19 nt, Homo sapiens
ggaccuacaccucaggaaa

SEQ ID NO: 347461 - RNA, 19 nt, Homo sapiens
agucauggcuaauuuaaca

SEQ ID NO: 347462 - RNA, 19 nt, Homo sapiens
ggaaguccaaccugagaaa

SEQ ID NO: 347463 - RNA, 19 nt, Homo sapiens
uuacagacuucuuccucua

SEQ ID NO: 347464 - RNA, 19 nt, Homo sapiens
ccaagcggcuggaucagau

SEQ ID NO: 347465 - RNA, 19 nt, Homo sapiens
gcaggagguggaggaauua

SEQ ID NO: 347466 - RNA, 19 nt, Homo sapiens
cagcuucugcguccucuua

SEQ ID NO: 347467 - RNA, 19 nt, Homo sapiens
ugauuuguaugcucauuga

SEQ ID NO: 347468 - RNA, 19 nt, Homo sapiens
gcuaauuuaacacccuuua

SEQ ID NO: 347469 - RNA, 19 nt, Homo sapiens
agagguggcucagaaauuc

SEQ ID NO: 347470 - RNA, 19 nt, Homo sapiens
gcucauugaacuuuaagaa

SEQ ID NO: 347471 - RNA, 19 nt, Homo sapiens
guaugcucauugaacuuua

SEQ ID NO: 347472 - RNA, 19 nt, Homo sapiens
caaggaacugggaaacuuu

SEQ ID NO: 347473 - RNA, 19 nt, Homo sapiens
uccaagagguggcucagaa

SEQ ID NO: 347474 - RNA, 19 nt, Homo sapiens
acaguugguucaucccuuu

SEQ ID NO: 347475 - RNA, 19 nt, Homo sapiens
cuacgagaguccucauaug

SEQ ID NO: 347476 - RNA, 19 nt, Homo sapiens
gaaugccuuuucucuuuua

SEQ ID NO: 347477 - RNA, 19 nt, Homo sapiens
uaauucgagucauggcuaa

SEQ ID NO: 347478 - RNA, 19 nt, Homo sapiens
ugcaggagguggaggaauu

SEQ ID NO: 347479 - RNA, 19 nt, Homo sapiens
uacccuggcucaacuguau

SEQ ID NO: 347480 - RNA, 19 nt, Homo sapiens
ggagguggaggaauuaagu

SEQ ID NO: 347481 - RNA, 19 nt, Homo sapiens
cuccagagauggucacaug

SEQ ID NO: 347482 - RNA, 19 nt, Homo sapiens
cgagucauggcuaauuuaa

SEQ ID NO: 347483 - RNA, 19 nt, Homo sapiens
ccccugggcuuuuggauua

SEQ ID NO: 347484 - RNA, 19 nt, Homo sapiens
gagccauccuggaagaaca

SEQ ID NO: 347485 - RNA, 19 nt, Homo sapiens
ucgaaugccuuuucucuuu

SEQ ID NO: 347486 - RNA, 19 nt, Homo sapiens
uaacacaaaggaaguccaa

SEQ ID NO: 347487 - RNA, 19 nt, Homo sapiens
agaaugagucuccuguuga

SEQ ID NO: 347488 - RNA, 19 nt, Homo sapiens
ccacaguaauuggucaugu

SEQ ID NO: 347489 - RNA, 19 nt, Homo sapiens
gcuacgagaguccucauau

SEQ ID NO: 347490 - RNA, 19 nt, Homo sapiens
cagcuccacugcacugugu

SEQ ID NO: 347491 - RNA, 19 nt, Homo sapiens
ccugaagaauuacagacuu

SEQ ID NO: 347492 - RNA, 19 nt, Homo sapiens
uacgagaguccucauauga

SEQ ID NO: 347493 - RNA, 19 nt, Homo sapiens
gggaaugaaauuaacacaa

SEQ ID NO: 347494 - RNA, 19 nt, Homo sapiens
acuagcacuuugagaauga

SEQ ID NO: 347495 - RNA, 19 nt, Homo sapiens
aguaauuggucaugugaug

SEQ ID NO: 347496 - RNA, 19 nt, Homo sapiens
gaaccuuaaagaaccauca

SEQ ID NO: 347497 - RNA, 19 nt, Homo sapiens
uaauggcgaucaucuuugc

SEQ ID NO: 347498 - RNA, 19 nt, Homo sapiens
caagagguggcucagaaau

SEQ ID NO: 347499 - RNA, 19 nt, Homo sapiens
ccaagagguggcucagaaa

SEQ ID NO: 347500 - RNA, 19 nt, Homo sapiens
gagcuaauggcgaucaucu

SEQ ID NO: 347501 - RNA, 19 nt, Homo sapiens
uaacacccuuuagaaccuu

SEQ ID NO: 347502 - RNA, 19 nt, Homo sapiens
ggauguaagccuggagcua

SEQ ID NO: 347503 - RNA, 19 nt, Homo sapiens
cauugaacuuuaagaagca

SEQ ID NO: 347504 - RNA, 19 nt, Homo sapiens
gauuauguguacaguuggu

SEQ ID NO: 347505 - RNA, 19 nt, Homo sapiens
gaccuacaccucaggaaag

SEQ ID NO: 347506 - RNA, 19 nt, Homo sapiens
ggaggaauuaagugaaaca

SEQ ID NO: 347507 - RNA, 19 nt, Homo sapiens
ggugauuuguaugcucauu

SEQ ID NO: 347508 - RNA, 19 nt, Homo sapiens
cagcuuacuagcacuuuga

SEQ ID NO: 347509 - RNA, 19 nt, Homo sapiens
acagacuucuuccucuaga

SEQ ID NO: 347510 - RNA, 19 nt, Homo sapiens
cgaaugccuuuucucuuuu

SEQ ID NO: 347511 - RNA, 19 nt, Homo sapiens
ucaaucugcaguuuaacaa

SEQ ID NO: 347512 - RNA, 19 nt, Homo sapiens
ccaacaaggaacugggaaa

SEQ ID NO: 347513 - RNA, 19 nt, Homo sapiens
cauaugaggaggcccacaa

SEQ ID NO: 347514 - RNA, 19 nt, Homo sapiens
gacaagaccccaucgaaug

SEQ ID NO: 347515 - RNA, 19 nt, Homo sapiens
aagaagcaguguuuuagaa

SEQ ID NO: 347516 - RNA, 19 nt, Homo sapiens
ggagaacccagaagaacac

SEQ ID NO: 347517 - RNA, 19 nt, Homo sapiens
gaaguccaaccugagaaau

SEQ ID NO: 347518 - RNA, 19 nt, Homo sapiens
gguucugccuucuggacaa

SEQ ID NO: 347519 - RNA, 19 nt, Homo sapiens
ccagcuuacuagcacuuug

SEQ ID NO: 347520 - RNA, 19 nt, Homo sapiens
gagaggggauucacaaggu

SEQ ID NO: 347521 - RNA, 19 nt, Homo sapiens
cuuacuagcacuuugagaa

SEQ ID NO: 347522 - RNA, 19 nt, Homo sapiens
aagagguggcucagaaauu

SEQ ID NO: 347523 - RNA, 19 nt, Homo sapiens
ggacucccacuuccaagag

SEQ ID NO: 347524 - RNA, 19 nt, Homo sapiens
caaucugcaguuuaacaaa

SEQ ID NO: 347525 - RNA, 19 nt, Homo sapiens
cagcaucacccgggaacuu

SEQ ID NO: 347526 - RNA, 19 nt, Homo sapiens
gagccugcuugggaaugaa

SEQ ID NO: 347527 - RNA, 19 nt, Homo sapiens
gaagcugggccugggcuau

SEQ ID NO: 347528 - RNA, 19 nt, Homo sapiens
gcaaagggcgaggcaugca

SEQ ID NO: 347529 - RNA, 19 nt, Homo sapiens
ucgagucauggcuaauuua

SEQ ID NO: 347530 - RNA, 19 nt, Homo sapiens
ucaggaaagccggagaauu

SEQ ID NO: 347531 - RNA, 19 nt, Homo sapiens
uuacuagcacuuugagaau

SEQ ID NO: 347532 - RNA, 19 nt, Homo sapiens
gagcaaaguccugcacacu

SEQ ID NO: 347533 - RNA, 19 nt, Homo sapiens
gguggaggaauuaagugaa

SEQ ID NO: 347534 - RNA, 19 nt, Homo sapiens
uucgagucauggcuaauuu

SEQ ID NO: 347535 - RNA, 19 nt, Homo sapiens
gcuugggaaugaaauuaac

SEQ ID NO: 347536 - RNA, 19 nt, Homo sapiens
acaguaauuggucauguga

SEQ ID NO: 347537 - RNA, 19 nt, Homo sapiens
ccugauggcccuagacaag

SEQ ID NO: 347538 - RNA, 19 nt, Homo sapiens
uguaugcucauugaacuuu

SEQ ID NO: 347539 - RNA, 19 nt, Homo sapiens
auccucaggugauuuguau

SEQ ID NO: 347540 - RNA, 19 nt, Homo sapiens
gcaaaaucucuacugcuuu

SEQ ID NO: 347541 - RNA, 19 nt, Homo sapiens
gcacuuugagaaugagucu

SEQ ID NO: 347542 - RNA, 19 nt, Homo sapiens
uacuagcacuuugagaaug

SEQ ID NO: 347543 - RNA, 19 nt, Homo sapiens
ggaccugguucugccuucu

SEQ ID NO: 347544 - RNA, 19 nt, Homo sapiens
caggaucaccuccgagaag

SEQ ID NO: 347545 - RNA, 19 nt, Homo sapiens
caauaaagcuucugaguaa

SEQ ID NO: 347546 - RNA, 19 nt, Homo sapiens
caacauagcuucaauuaca

SEQ ID NO: 347547 - RNA, 19 nt, Homo sapiens
gaucacagcuauuauacua

SEQ ID NO: 347548 - RNA, 19 nt, Homo sapiens
gaguaacacuuucugauua

SEQ ID NO: 347549 - RNA, 19 nt, Homo sapiens
gcacagacaugaacaucua

SEQ ID NO: 347550 - RNA, 19 nt, Homo sapiens
gcagauagucucauauuua

SEQ ID NO: 347551 - RNA, 19 nt, Homo sapiens
gaaaguacaccuacacuaa

SEQ ID NO: 347552 - RNA, 19 nt, Homo sapiens
gcaggccacuaguuuauua

SEQ ID NO: 347553 - RNA, 19 nt, Homo sapiens
cagcaggacucacgcauua

SEQ ID NO: 347554 - RNA, 19 nt, Homo sapiens
gaaaucaaguugucucugu

SEQ ID NO: 347555 - RNA, 19 nt, Homo sapiens
caaagcaaaugcauucaaa

SEQ ID NO: 347556 - RNA, 19 nt, Homo sapiens
agacauaccuaacuuaaga

SEQ ID NO: 347557 - RNA, 19 nt, Homo sapiens
gauaauacccaaugagaaa

SEQ ID NO: 347558 - RNA, 19 nt, Homo sapiens
caaggcagcuauuuuauua

SEQ ID NO: 347559 - RNA, 19 nt, Homo sapiens
guucauccauuucugauaa

SEQ ID NO: 347560 - RNA, 19 nt, Homo sapiens
gaacaucuauugaggaaaa

SEQ ID NO: 347561 - RNA, 19 nt, Homo sapiens
gugaagaaguugacauuga

SEQ ID NO: 347562 - RNA, 19 nt, Homo sapiens
ucacuuagucugagaaaua

SEQ ID NO: 347563 - RNA, 19 nt, Homo sapiens
auaaauaccuggauggaaa

SEQ ID NO: 347564 - RNA, 19 nt, Homo sapiens
ggaccgcauugaagagaua

SEQ ID NO: 347565 - RNA, 19 nt, Homo sapiens
gcacaauagugaguacauu

SEQ ID NO: 347566 - RNA, 19 nt, Homo sapiens
cgagauaacugcaaaauau

SEQ ID NO: 347567 - RNA, 19 nt, Homo sapiens
gcagacauaccuaacuuaa

SEQ ID NO: 347568 - RNA, 19 nt, Homo sapiens
gguaaugucuucaguaaaa

SEQ ID NO: 347569 - RNA, 19 nt, Homo sapiens
ccagaaagucuacguguaa

SEQ ID NO: 347570 - RNA, 19 nt, Homo sapiens
ggaaucagccuaucuuuac

SEQ ID NO: 347571 - RNA, 19 nt, Homo sapiens
cagauagucucauauuuag

SEQ ID NO: 347572 - RNA, 19 nt, Homo sapiens
uaacauuccucucacuugu

SEQ ID NO: 347573 - RNA, 19 nt, Homo sapiens
aauagcagauagucucaua

SEQ ID NO: 347574 - RNA, 19 nt, Homo sapiens
gaaagucuacguguaauuc

SEQ ID NO: 347575 - RNA, 19 nt, Homo sapiens
gaagauauagaagauggua

SEQ ID NO: 347576 - RNA, 19 nt, Homo sapiens
ccacgugucugcugugugu

SEQ ID NO: 347577 - RNA, 19 nt, Homo sapiens
aaacugacauggcuaacug

SEQ ID NO: 347578 - RNA, 19 nt, Homo sapiens
ccaaauuugagaugcauua

SEQ ID NO: 347579 - RNA, 19 nt, Homo sapiens
caggaaauuugauagaaga

SEQ ID NO: 347580 - RNA, 19 nt, Homo sapiens
ugaagaaguugacauugau

SEQ ID NO: 347581 - RNA, 19 nt, Homo sapiens
aaguacaccuacacuaaua

SEQ ID NO: 347582 - RNA, 19 nt, Homo sapiens
uagcuucaauuacagauga

SEQ ID NO: 347583 - RNA, 19 nt, Homo sapiens
gauaaacugacauggcuaa

SEQ ID NO: 347584 - RNA, 19 nt, Homo sapiens
gauguaaguacgaggauaa

SEQ ID NO: 347585 - RNA, 19 nt, Homo sapiens
ugagaugcauuauuccuau

SEQ ID NO: 347586 - RNA, 19 nt, Homo sapiens
ccucuuaauuuaccagaaa

SEQ ID NO: 347587 - RNA, 19 nt, Homo sapiens
gugaguacauuugaauuga

SEQ ID NO: 347588 - RNA, 19 nt, Homo sapiens
acaauaaagcuucugagua

SEQ ID NO: 347589 - RNA, 19 nt, Homo sapiens
gauagucucauauuuagga

SEQ ID NO: 347590 - RNA, 19 nt, Homo sapiens
cuaauagucugucucaaca

SEQ ID NO: 347591 - RNA, 19 nt, Homo sapiens
ggaaagcauccaaacaguu

SEQ ID NO: 347592 - RNA, 19 nt, Homo sapiens
ccuagaaugucagauguuu

SEQ ID NO: 347593 - RNA, 19 nt, Homo sapiens
uaacuaaugaucacagcua

SEQ ID NO: 347594 - RNA, 19 nt, Homo sapiens
gcaaggauguucaaaaucu

SEQ ID NO: 347595 - RNA, 19 nt, Homo sapiens
gggaaagcauccaaacagu

SEQ ID NO: 347596 - RNA, 19 nt, Homo sapiens
gagcuaauacagaaauguu

SEQ ID NO: 347597 - RNA, 19 nt, Homo sapiens
gagaugcauuauuccuauu

SEQ ID NO: 347598 - RNA, 19 nt, Homo sapiens
caacaacauagcuucaauu

SEQ ID NO: 347599 - RNA, 19 nt, Homo sapiens
cugguaaugucuucaguaa

SEQ ID NO: 347600 - RNA, 19 nt, Homo sapiens
cccaagcucacuuuauuua

SEQ ID NO: 347601 - RNA, 19 nt, Homo sapiens
ggacucacgcauuaucuau

SEQ ID NO: 347602 - RNA, 19 nt, Homo sapiens
ugaguaacacuuucugauu

SEQ ID NO: 347603 - RNA, 19 nt, Homo sapiens
gaaauagcagauagucuca

SEQ ID NO: 347604 - RNA, 19 nt, Homo sapiens
gaacuuuguuuuccuccua

SEQ ID NO: 347605 - RNA, 19 nt, Homo sapiens
guaaguacgaggauaaauc

SEQ ID NO: 347606 - RNA, 19 nt, Homo sapiens
ggaccauaaugcccuggaa

SEQ ID NO: 347607 - RNA, 19 nt, Homo sapiens
gauuaccgauagggucaua

SEQ ID NO: 347608 - RNA, 19 nt, Homo sapiens
uggaauccgugccucuuaa

SEQ ID NO: 347609 - RNA, 19 nt, Homo sapiens
uguauacugugaagaaguu

SEQ ID NO: 347610 - RNA, 19 nt, Homo sapiens
accauuaccucccaagaaa

SEQ ID NO: 347611 - RNA, 19 nt, Homo sapiens
uaagguacauguuccaaaa

SEQ ID NO: 347612 - RNA, 19 nt, Homo sapiens
cucccaagcucacuuuauu

SEQ ID NO: 347613 - RNA, 19 nt, Homo sapiens
uagcagauagucucauauu

SEQ ID NO: 347614 - RNA, 19 nt, Homo sapiens
gcuaaauguuucccaugau

SEQ ID NO: 347615 - RNA, 19 nt, Homo sapiens
ugucuacguucgaaacaaa

SEQ ID NO: 347616 - RNA, 19 nt, Homo sapiens
ucaacaacauagcuucaau

SEQ ID NO: 347617 - RNA, 19 nt, Homo sapiens
caucuucaguucaacaaca

SEQ ID NO: 347618 - RNA, 19 nt, Homo sapiens
auccgugccucuuaauuua

SEQ ID NO: 347619 - RNA, 19 nt, Homo sapiens
uagccaagauuaugaggau

SEQ ID NO: 347620 - RNA, 19 nt, Homo sapiens
cuaaauguuucccaugauc

SEQ ID NO: 347621 - RNA, 19 nt, Homo sapiens
aaagcugacugccaaagau

SEQ ID NO: 347622 - RNA, 19 nt, Homo sapiens
acucacgcauuaucuauga

SEQ ID NO: 347623 - RNA, 19 nt, Homo sapiens
aauacgagauaacugcaaa

SEQ ID NO: 347624 - RNA, 19 nt, Homo sapiens
gcauuuaagguacauguuc

SEQ ID NO: 347625 - RNA, 19 nt, Homo sapiens
aaucaaagcaaaugcauuc

SEQ ID NO: 347626 - RNA, 19 nt, Homo sapiens
ugacauugaugcuguacca

SEQ ID NO: 347627 - RNA, 19 nt, Homo sapiens
gauaaauaccuggauggaa

SEQ ID NO: 347628 - RNA, 19 nt, Homo sapiens
ucaguuaucuccccauuug

SEQ ID NO: 347629 - RNA, 19 nt, Homo sapiens
caaguugucucuguguaca

SEQ ID NO: 347630 - RNA, 19 nt, Homo sapiens
uggcuaacugcaagaauua

SEQ ID NO: 347631 - RNA, 19 nt, Homo sapiens
uaucaaggcagcuauuuua

SEQ ID NO: 347632 - RNA, 19 nt, Homo sapiens
aauuacagaugacacauuc

SEQ ID NO: 347633 - RNA, 19 nt, Homo sapiens
gaaucaaagcaaaugcauu

SEQ ID NO: 347634 - RNA, 19 nt, Homo sapiens
gcacgauucaacaaaauua

SEQ ID NO: 347635 - RNA, 19 nt, Homo sapiens
caauagugaguacauuuga

SEQ ID NO: 347636 - RNA, 19 nt, Homo sapiens
ucacagcuauuauacuacu

SEQ ID NO: 347637 - RNA, 19 nt, Homo sapiens
cugauaaaguucucuaugg

SEQ ID NO: 347638 - RNA, 19 nt, Homo sapiens
cgaaacaaaguaauaugga

SEQ ID NO: 347639 - RNA, 19 nt, Homo sapiens
gucuacacuucuccuguua

SEQ ID NO: 347640 - RNA, 19 nt, Homo sapiens
ugaauaaccucaccuuccu

SEQ ID NO: 347641 - RNA, 19 nt, Homo sapiens
ccauauuuagccaagauua

SEQ ID NO: 347642 - RNA, 19 nt, Homo sapiens
gugauaauacccaaugaga

SEQ ID NO: 347643 - RNA, 19 nt, Homo sapiens
cacgcauuaucuaugauua

SEQ ID NO: 347644 - RNA, 19 nt, Homo sapiens
cacaauagugaguacauuu

SEQ ID NO: 347645 - RNA, 19 nt, Homo sapiens
caauaaagcuucugaguaa

SEQ ID NO: 347646 - RNA, 19 nt, Homo sapiens
caacauagcuucaauuaca

SEQ ID NO: 347647 - RNA, 19 nt, Homo sapiens
gaucacagcuauuauacua

SEQ ID NO: 347648 - RNA, 19 nt, Homo sapiens
gaguaacacuuucugauua

SEQ ID NO: 347649 - RNA, 19 nt, Homo sapiens
gcacagacaugaacaucua

SEQ ID NO: 347650 - RNA, 19 nt, Homo sapiens
gcagauagucucauauuua

SEQ ID NO: 347651 - RNA, 19 nt, Homo sapiens
gaaaguacaccuacacuaa

SEQ ID NO: 347652 - RNA, 19 nt, Homo sapiens
gcaggccacuaguuuauua

SEQ ID NO: 347653 - RNA, 19 nt, Homo sapiens
cagcaggacucacgcauua

SEQ ID NO: 347654 - RNA, 19 nt, Homo sapiens
gaaaucaaguugucucugu

SEQ ID NO: 347655 - RNA, 19 nt, Homo sapiens
caaagcaaaugcauucaaa

SEQ ID NO: 347656 - RNA, 19 nt, Homo sapiens
agacauaccuaacuuaaga

SEQ ID NO: 347657 - RNA, 19 nt, Homo sapiens
gauaauacccaaugagaaa

SEQ ID NO: 347658 - RNA, 19 nt, Homo sapiens
caaggcagcuauuuuauua

SEQ ID NO: 347659 - RNA, 19 nt, Homo sapiens
guucauccauuucugauaa

SEQ ID NO: 347660 - RNA, 19 nt, Homo sapiens
gaacaucuauugaggaaaa

SEQ ID NO: 347661 - RNA, 19 nt, Homo sapiens
gugaagaaguugacauuga

SEQ ID NO: 347662 - RNA, 19 nt, Homo sapiens
ucacuuagucugagaaaua

SEQ ID NO: 347663 - RNA, 19 nt, Homo sapiens
auaaauaccuggauggaaa

SEQ ID NO: 347664 - RNA, 19 nt, Homo sapiens
ggaccgcauugaagagaua

SEQ ID NO: 347665 - RNA, 19 nt, Homo sapiens
gcacaauagugaguacauu

SEQ ID NO: 347666 - RNA, 19 nt, Homo sapiens
cgagauaacugcaaaauau

SEQ ID NO: 347667 - RNA, 19 nt, Homo sapiens
gcagacauaccuaacuuaa

SEQ ID NO: 347668 - RNA, 19 nt, Homo sapiens
gguaaugucuucaguaaaa

SEQ ID NO: 347669 - RNA, 19 nt, Homo sapiens
ccagaaagucuacguguaa

SEQ ID NO: 347670 - RNA, 19 nt, Homo sapiens
ggaaucagccuaucuuuac

SEQ ID NO: 347671 - RNA, 19 nt, Homo sapiens
cagauagucucauauuuag

SEQ ID NO: 347672 - RNA, 19 nt, Homo sapiens
uaacauuccucucacuugu

SEQ ID NO: 347673 - RNA, 19 nt, Homo sapiens
aauagcagauagucucaua

SEQ ID NO: 347674 - RNA, 19 nt, Homo sapiens
gaaagucuacguguaauuc

SEQ ID NO: 347675 - RNA, 19 nt, Homo sapiens
gaagauauagaagauggua

SEQ ID NO: 347676 - RNA, 19 nt, Homo sapiens
ccacgugucugcugugugu

SEQ ID NO: 347677 - RNA, 19 nt, Homo sapiens
aaacugacauggcuaacug

SEQ ID NO: 347678 - RNA, 19 nt, Homo sapiens
ccaaauuugagaugcauua

SEQ ID NO: 347679 - RNA, 19 nt, Homo sapiens
ugaagaaguugacauugau

SEQ ID NO: 347680 - RNA, 19 nt, Homo sapiens
aaguacaccuacacuaaua

SEQ ID NO: 347681 - RNA, 19 nt, Homo sapiens
uagcuucaauuacagauga

SEQ ID NO: 347682 - RNA, 19 nt, Homo sapiens
gauaaacugacauggcuaa

SEQ ID NO: 347683 - RNA, 19 nt, Homo sapiens
gauguaaguacgaggauaa

SEQ ID NO: 347684 - RNA, 19 nt, Homo sapiens
ugagaugcauuauuccuau

SEQ ID NO: 347685 - RNA, 19 nt, Homo sapiens
ccucuuaauuuaccagaaa

SEQ ID NO: 347686 - RNA, 19 nt, Homo sapiens
gugaguacauuugaauuga

SEQ ID NO: 347687 - RNA, 19 nt, Homo sapiens
acaauaaagcuucugagua

SEQ ID NO: 347688 - RNA, 19 nt, Homo sapiens
gauagucucauauuuagga

SEQ ID NO: 347689 - RNA, 19 nt, Homo sapiens
cuaauagucugucucaaca

SEQ ID NO: 347690 - RNA, 19 nt, Homo sapiens
ggaaagcauccaaacaguu

SEQ ID NO: 347691 - RNA, 19 nt, Homo sapiens
ccuagaaugucagauguuu

SEQ ID NO: 347692 - RNA, 19 nt, Homo sapiens
uaacuaaugaucacagcua

SEQ ID NO: 347693 - RNA, 19 nt, Homo sapiens
aaacagcuacaacggguua

SEQ ID NO: 347694 - RNA, 19 nt, Homo sapiens
gcaaggauguucaaaaucu

SEQ ID NO: 347695 - RNA, 19 nt, Homo sapiens
gggaaagcauccaaacagu

SEQ ID NO: 347696 - RNA, 19 nt, Homo sapiens
gagcuaauacagaaauguu

SEQ ID NO: 347697 - RNA, 19 nt, Homo sapiens
gagaugcauuauuccuauu

SEQ ID NO: 347698 - RNA, 19 nt, Homo sapiens
caacaacauagcuucaauu

SEQ ID NO: 347699 - RNA, 19 nt, Homo sapiens
cugguaaugucuucaguaa

SEQ ID NO: 347700 - RNA, 19 nt, Homo sapiens
cccaagcucacuuuauuua

SEQ ID NO: 347701 - RNA, 19 nt, Homo sapiens
ggacucacgcauuaucuau

SEQ ID NO: 347702 - RNA, 19 nt, Homo sapiens
ugaguaacacuuucugauu

SEQ ID NO: 347703 - RNA, 19 nt, Homo sapiens
gaaauagcagauagucuca

SEQ ID NO: 347704 - RNA, 19 nt, Homo sapiens
gaacuuuguuuuccuccua

SEQ ID NO: 347705 - RNA, 19 nt, Homo sapiens
guaaguacgaggauaaauc

SEQ ID NO: 347706 - RNA, 19 nt, Homo sapiens
ggaccauaaugcccuggaa

SEQ ID NO: 347707 - RNA, 19 nt, Homo sapiens
gauuaccgauagggucaua

SEQ ID NO: 347708 - RNA, 19 nt, Homo sapiens
uggaauccgugccucuuaa

SEQ ID NO: 347709 - RNA, 19 nt, Homo sapiens
cgggaaauuugauagaaga

SEQ ID NO: 347710 - RNA, 19 nt, Homo sapiens
uguauacugugaagaaguu

SEQ ID NO: 347711 - RNA, 19 nt, Homo sapiens
accauuaccucccaagaaa

SEQ ID NO: 347712 - RNA, 19 nt, Homo sapiens
uaagguacauguuccaaaa

SEQ ID NO: 347713 - RNA, 19 nt, Homo sapiens
cucccaagcucacuuuauu

SEQ ID NO: 347714 - RNA, 19 nt, Homo sapiens
uagcagauagucucauauu

SEQ ID NO: 347715 - RNA, 19 nt, Homo sapiens
gcuaaauguuucccaugau

SEQ ID NO: 347716 - RNA, 19 nt, Homo sapiens
ugucuacguucgaaacaaa

SEQ ID NO: 347717 - RNA, 19 nt, Homo sapiens
ucaacaacauagcuucaau

SEQ ID NO: 347718 - RNA, 19 nt, Homo sapiens
caucuucaguucaacaaca

SEQ ID NO: 347719 - RNA, 19 nt, Homo sapiens
auccgugccucuuaauuua

SEQ ID NO: 347720 - RNA, 19 nt, Homo sapiens
uagccaagauuaugaggau

SEQ ID NO: 347721 - RNA, 19 nt, Homo sapiens
cuaaauguuucccaugauc

SEQ ID NO: 347722 - RNA, 19 nt, Homo sapiens
aaagcugacugccaaagau

SEQ ID NO: 347723 - RNA, 19 nt, Homo sapiens
acucacgcauuaucuauga

SEQ ID NO: 347724 - RNA, 19 nt, Homo sapiens
aauacgagauaacugcaaa

SEQ ID NO: 347725 - RNA, 19 nt, Homo sapiens
gcauuuaagguacauguuc

SEQ ID NO: 347726 - RNA, 19 nt, Homo sapiens
aaucaaagcaaaugcauuc

SEQ ID NO: 347727 - RNA, 19 nt, Homo sapiens
ugacauugaugcuguacca

SEQ ID NO: 347728 - RNA, 19 nt, Homo sapiens
gauaaauaccuggauggaa

SEQ ID NO: 347729 - RNA, 19 nt, Homo sapiens
ucaguuaucuccccauuug

SEQ ID NO: 347730 - RNA, 19 nt, Homo sapiens
caaguugucucuguguaca

SEQ ID NO: 347731 - RNA, 19 nt, Homo sapiens
uggcuaacugcaagaauua

SEQ ID NO: 347732 - RNA, 19 nt, Homo sapiens
uaucaaggcagcuauuuua

SEQ ID NO: 347733 - RNA, 19 nt, Homo sapiens
aauuacagaugacacauuc

SEQ ID NO: 347734 - RNA, 19 nt, Homo sapiens
gaaucaaagcaaaugcauu

SEQ ID NO: 347735 - RNA, 19 nt, Homo sapiens
gcacgauucaacaaaauua

SEQ ID NO: 347736 - RNA, 19 nt, Homo sapiens
caauagugaguacauuuga

SEQ ID NO: 347737 - RNA, 19 nt, Homo sapiens
gucuacacuucuccuguua

SEQ ID NO: 347738 - RNA, 19 nt, Homo sapiens
ucacagcuauuauacuacu

SEQ ID NO: 347739 - RNA, 19 nt, Homo sapiens
cugauaaaguucucuaugg

SEQ ID NO: 347740 - RNA, 19 nt, Homo sapiens
ugaauaaccucaccuuccu

SEQ ID NO: 347741 - RNA, 19 nt, Homo sapiens
gugauaauacccaaugaga

SEQ ID NO: 347742 - RNA, 19 nt, Homo sapiens
ccauauuuagccaagauua

SEQ ID NO: 347743 - RNA, 19 nt, Homo sapiens
cacaauagugaguacauuu

SEQ ID NO: 347744 - RNA, 19 nt, Homo sapiens
aaucuucuaucugagagua

SEQ ID NO: 347745 - RNA, 19 nt, Homo sapiens
caauaaagcuucugaguaa

SEQ ID NO: 347746 - RNA, 19 nt, Homo sapiens
caacauagcuucaauuaca

SEQ ID NO: 347747 - RNA, 19 nt, Homo sapiens
gaucacagcuauuauacua

SEQ ID NO: 347748 - RNA, 19 nt, Homo sapiens
gaguaacacuuucugauua

SEQ ID NO: 347749 - RNA, 19 nt, Homo sapiens
gcacagacaugaacaucua

SEQ ID NO: 347750 - RNA, 19 nt, Homo sapiens
gcagauagucucauauuua

SEQ ID NO: 347751 - RNA, 19 nt, Homo sapiens
gaaaguacaccuacacuaa

SEQ ID NO: 347752 - RNA, 19 nt, Homo sapiens
gcaggccacuaguuuauua

SEQ ID NO: 347753 - RNA, 19 nt, Homo sapiens
cagcaggacucacgcauua

SEQ ID NO: 347754 - RNA, 19 nt, Homo sapiens
gaaaucaaguugucucugu

SEQ ID NO: 347755 - RNA, 19 nt, Homo sapiens
caaagcaaaugcauucaaa

SEQ ID NO: 347756 - RNA, 19 nt, Homo sapiens
agacauaccuaacuuaaga

SEQ ID NO: 347757 - RNA, 19 nt, Homo sapiens
gauaauacccaaugagaaa

SEQ ID NO: 347758 - RNA, 19 nt, Homo sapiens
caaggcagcuauuuuauua

SEQ ID NO: 347759 - RNA, 19 nt, Homo sapiens
guucauccauuucugauaa

SEQ ID NO: 347760 - RNA, 19 nt, Homo sapiens
gaacaucuauugaggaaaa

SEQ ID NO: 347761 - RNA, 19 nt, Homo sapiens
gugaagaaguugacauuga

SEQ ID NO: 347762 - RNA, 19 nt, Homo sapiens
ucacuuagucugagaaaua

SEQ ID NO: 347763 - RNA, 19 nt, Homo sapiens
auaaauaccuggauggaaa

SEQ ID NO: 347764 - RNA, 19 nt, Homo sapiens
gcuagcaucuaauuaaaga

SEQ ID NO: 347765 - RNA, 19 nt, Homo sapiens
ggaccgcauugaagagaua

SEQ ID NO: 347766 - RNA, 19 nt, Homo sapiens
gcacaauagugaguacauu

SEQ ID NO: 347767 - RNA, 19 nt, Homo sapiens
cgagauaacugcaaaauau

SEQ ID NO: 347768 - RNA, 19 nt, Homo sapiens
gcagacauaccuaacuuaa

SEQ ID NO: 347769 - RNA, 19 nt, Homo sapiens
gguaaugucuucaguaaaa

SEQ ID NO: 347770 - RNA, 19 nt, Homo sapiens
ccagaaagucuacguguaa

SEQ ID NO: 347771 - RNA, 19 nt, Homo sapiens
ggaaucagccuaucuuuac

SEQ ID NO: 347772 - RNA, 19 nt, Homo sapiens
cagauagucucauauuuag

SEQ ID NO: 347773 - RNA, 19 nt, Homo sapiens
cuacaacgguauccuaaga

SEQ ID NO: 347774 - RNA, 19 nt, Homo sapiens
uaacauuccucucacuugu

SEQ ID NO: 347775 - RNA, 19 nt, Homo sapiens
aauagcagauagucucaua

SEQ ID NO: 347776 - RNA, 19 nt, Homo sapiens
gaaagucuacguguaauuc

SEQ ID NO: 347777 - RNA, 19 nt, Homo sapiens
gaagauauagaagauggua

SEQ ID NO: 347778 - RNA, 19 nt, Homo sapiens
ccacgugucugcugugugu

SEQ ID NO: 347779 - RNA, 19 nt, Homo sapiens
aaacugacauggcuaacug

SEQ ID NO: 347780 - RNA, 19 nt, Homo sapiens
ccaaauuugagaugcauua

SEQ ID NO: 347781 - RNA, 19 nt, Homo sapiens
ugaagaaguugacauugau

SEQ ID NO: 347782 - RNA, 19 nt, Homo sapiens
aaguacaccuacacuaaua

SEQ ID NO: 347783 - RNA, 19 nt, Homo sapiens
uagcuucaauuacagauga

SEQ ID NO: 347784 - RNA, 19 nt, Homo sapiens
gauaaacugacauggcuaa

SEQ ID NO: 347785 - RNA, 19 nt, Homo sapiens
gauguaaguacgaggauaa

SEQ ID NO: 347786 - RNA, 19 nt, Homo sapiens
ugagaugcauuauuccuau

SEQ ID NO: 347787 - RNA, 19 nt, Homo sapiens
ccucuuaauuuaccagaaa

SEQ ID NO: 347788 - RNA, 19 nt, Homo sapiens
gugaguacauuugaauuga

SEQ ID NO: 347789 - RNA, 19 nt, Homo sapiens
acaauaaagcuucugagua

SEQ ID NO: 347790 - RNA, 19 nt, Homo sapiens
gauagucucauauuuagga

SEQ ID NO: 347791 - RNA, 19 nt, Homo sapiens
cuaauagucugucucaaca

SEQ ID NO: 347792 - RNA, 19 nt, Homo sapiens
ggaaagcauccaaacaguu

SEQ ID NO: 347793 - RNA, 19 nt, Homo sapiens
aaagaucacuaaggguuaa

SEQ ID NO: 347794 - RNA, 19 nt, Homo sapiens
ccuagaaugucagauguuu

SEQ ID NO: 347795 - RNA, 19 nt, Homo sapiens
uaaagaucacuaaggguua

SEQ ID NO: 347796 - RNA, 19 nt, Homo sapiens
uaacuaaugaucacagcua

SEQ ID NO: 347797 - RNA, 19 nt, Homo sapiens
gaucacuaaggguuaaaua

SEQ ID NO: 347798 - RNA, 19 nt, Homo sapiens
gcaaggauguucaaaaucu

SEQ ID NO: 347799 - RNA, 19 nt, Homo sapiens
gggaaagcauccaaacagu

SEQ ID NO: 347800 - RNA, 19 nt, Homo sapiens
gagcuaauacagaaauguu

SEQ ID NO: 347801 - RNA, 19 nt, Homo sapiens
gagaugcauuauuccuauu

SEQ ID NO: 347802 - RNA, 19 nt, Homo sapiens
caacaacauagcuucaauu

SEQ ID NO: 347803 - RNA, 19 nt, Homo sapiens
cugguaaugucuucaguaa

SEQ ID NO: 347804 - RNA, 19 nt, Homo sapiens
cccaagcucacuuuauuua

SEQ ID NO: 347805 - RNA, 19 nt, Homo sapiens
ggacucacgcauuaucuau

SEQ ID NO: 347806 - RNA, 19 nt, Homo sapiens
ugaguaacacuuucugauu

SEQ ID NO: 347807 - RNA, 19 nt, Homo sapiens
gaaauagcagauagucuca

SEQ ID NO: 347808 - RNA, 19 nt, Homo sapiens
gaacuuuguuuuccuccua

SEQ ID NO: 347809 - RNA, 19 nt, Homo sapiens
guaaguacgaggauaaauc

SEQ ID NO: 347810 - RNA, 19 nt, Homo sapiens
ggaccauaaugcccuggaa

SEQ ID NO: 347811 - RNA, 19 nt, Homo sapiens
caacgguauccuaagaaua

SEQ ID NO: 347812 - RNA, 19 nt, Homo sapiens
gauuaccgauagggucaua

SEQ ID NO: 347813 - RNA, 19 nt, Homo sapiens
uggaauccgugccucuuaa

SEQ ID NO: 347814 - RNA, 19 nt, Homo sapiens
cgggaaauuugauagaaga

SEQ ID NO: 347815 - RNA, 19 nt, Homo sapiens
uguauacugugaagaaguu

SEQ ID NO: 347816 - RNA, 19 nt, Homo sapiens
accauuaccucccaagaaa

SEQ ID NO: 347817 - RNA, 19 nt, Homo sapiens
aaacugcuagcaucuaauu

SEQ ID NO: 347818 - RNA, 19 nt, Homo sapiens
uaagguacauguuccaaaa

SEQ ID NO: 347819 - RNA, 19 nt, Homo sapiens
cucccaagcucacuuuauu

SEQ ID NO: 347820 - RNA, 19 nt, Homo sapiens
uagcagauagucucauauu

SEQ ID NO: 347821 - RNA, 19 nt, Homo sapiens
gcuaaauguuucccaugau

SEQ ID NO: 347822 - RNA, 19 nt, Homo sapiens
ugucuacguucgaaacaaa

SEQ ID NO: 347823 - RNA, 19 nt, Homo sapiens
ucaacaacauagcuucaau

SEQ ID NO: 347824 - RNA, 19 nt, Homo sapiens
caucuucaguucaacaaca

SEQ ID NO: 347825 - RNA, 19 nt, Homo sapiens
auccgugccucuuaauuua

SEQ ID NO: 347826 - RNA, 19 nt, Homo sapiens
uagccaagauuaugaggau

SEQ ID NO: 347827 - RNA, 19 nt, Homo sapiens
cuaaauguuucccaugauc

SEQ ID NO: 347828 - RNA, 19 nt, Homo sapiens
aaagcugacugccaaagau

SEQ ID NO: 347829 - RNA, 19 nt, Homo sapiens
acucacgcauuaucuauga

SEQ ID NO: 347830 - RNA, 19 nt, Homo sapiens
aauacgagauaacugcaaa

SEQ ID NO: 347831 - RNA, 19 nt, Homo sapiens
cugcuagcaucuaauuaaa

SEQ ID NO: 347832 - RNA, 19 nt, Homo sapiens
gcauuuaagguacauguuc

SEQ ID NO: 347833 - RNA, 19 nt, Homo sapiens
aaucaaagcaaaugcauuc

SEQ ID NO: 347834 - RNA, 19 nt, Homo sapiens
ugacauugaugcuguacca

SEQ ID NO: 347835 - RNA, 19 nt, Homo sapiens
gauaaauaccuggauggaa

SEQ ID NO: 347836 - RNA, 19 nt, Homo sapiens
ucaguuaucuccccauuug

SEQ ID NO: 347837 - RNA, 19 nt, Homo sapiens
caaguugucucuguguaca

SEQ ID NO: 347838 - RNA, 19 nt, Homo sapiens
uggcuaacugcaagaauua

SEQ ID NO: 347839 - RNA, 19 nt, Homo sapiens
uaucaaggcagcuauuuua

SEQ ID NO: 347840 - RNA, 19 nt, Homo sapiens
aauuacagaugacacauuc

SEQ ID NO: 347841 - RNA, 19 nt, Homo sapiens
gaaucaaagcaaaugcauu

SEQ ID NO: 347842 - RNA, 19 nt, Homo sapiens
gcacgauucaacaaaauua

SEQ ID NO: 347843 - RNA, 19 nt, Homo sapiens
caauagugaguacauuuga

SEQ ID NO: 347844 - RNA, 19 nt, Homo sapiens
ucacagcuauuauacuacu

SEQ ID NO: 347845 - RNA, 19 nt, Homo sapiens
gaacaugcauacuacaauu

SEQ ID NO: 347846 - RNA, 19 nt, Homo sapiens
gaggacagauuaauagauu

SEQ ID NO: 347847 - RNA, 19 nt, Homo sapiens
gaacauaccuuuuguagau

SEQ ID NO: 347848 - RNA, 19 nt, Homo sapiens
gaugagaagucaaauggaa

SEQ ID NO: 347849 - RNA, 19 nt, Homo sapiens
aaaccuaacucaccagaaa

SEQ ID NO: 347850 - RNA, 19 nt, Homo sapiens
gaagaaggcaaaccuaaga

SEQ ID NO: 347851 - RNA, 19 nt, Homo sapiens
ggauauaccacaauucauu

SEQ ID NO: 347852 - RNA, 19 nt, Homo sapiens
agaaacagauggaauuaga

SEQ ID NO: 347853 - RNA, 19 nt, Homo sapiens
gaacucuucucaacucugu

SEQ ID NO: 347854 - RNA, 19 nt, Homo sapiens
ggacgguucuccuuugaug

SEQ ID NO: 347855 - RNA, 19 nt, Homo sapiens
gagaagugcuugucuuugg

SEQ ID NO: 347856 - RNA, 19 nt, Homo sapiens
gcaauuuccuauuccaguu

SEQ ID NO: 347857 - RNA, 19 nt, Homo sapiens
gcaaauaucgcugaauaga

SEQ ID NO: 347858 - RNA, 19 nt, Homo sapiens
ggagaaaacuguuaccuau

SEQ ID NO: 347859 - RNA, 19 nt, Homo sapiens
gcagaacuccuuugcagaa

SEQ ID NO: 347860 - RNA, 19 nt, Homo sapiens
gaaucugaaucuccaagaa

SEQ ID NO: 347861 - RNA, 19 nt, Homo sapiens
gacagaacauggagaacuu

SEQ ID NO: 347862 - RNA, 19 nt, Homo sapiens
gaagagaguagcaaauugu

SEQ ID NO: 347863 - RNA, 19 nt, Homo sapiens
gcuauaauuccgaaacaua

SEQ ID NO: 347864 - RNA, 19 nt, Homo sapiens
gaugaacucuucucaacuc

SEQ ID NO: 347865 - RNA, 19 nt, Homo sapiens
gauucuagcuaucuguauu

SEQ ID NO: 347866 - RNA, 19 nt, Homo sapiens
aaauaaagcugcugugaac

SEQ ID NO: 347867 - RNA, 19 nt, Homo sapiens
ugaagacacucaaucuaga

SEQ ID NO: 347868 - RNA, 19 nt, Homo sapiens
cacaggcuauucuacuuua

SEQ ID NO: 347869 - RNA, 19 nt, Homo sapiens
gcuaauccacaaccuguua

SEQ ID NO: 347870 - RNA, 19 nt, Homo sapiens
augcaaauaucgcugaaua

SEQ ID NO: 347871 - RNA, 19 nt, Homo sapiens
ggaaauaugucugggaaaa

SEQ ID NO: 347872 - RNA, 19 nt, Homo sapiens
ugaagagaguagcaaauug

SEQ ID NO: 347873 - RNA, 19 nt, Homo sapiens
ucauaugucuccaucuuga

SEQ ID NO: 347874 - RNA, 19 nt, Homo sapiens
caaucuagcaggaaucuuu

SEQ ID NO: 347875 - RNA, 19 nt, Homo sapiens
cuaaaggucuucaguuucu

SEQ ID NO: 347876 - RNA, 19 nt, Homo sapiens
cuaaagauccagacuguga

SEQ ID NO: 347877 - RNA, 19 nt, Homo sapiens
ccaaguugcugaaaauuaa

SEQ ID NO: 347878 - RNA, 19 nt, Homo sapiens
ggauuaguagugaccauua

SEQ ID NO: 347879 - RNA, 19 nt, Homo sapiens
ggaccagccugaugagaag

SEQ ID NO: 347880 - RNA, 19 nt, Homo sapiens
caaauaaagcugcugugaa

SEQ ID NO: 347881 - RNA, 19 nt, Homo sapiens
gaagacacucaaucuagaa

SEQ ID NO: 347882 - RNA, 19 nt, Homo sapiens
gaacuucaccaccagaauc

SEQ ID NO: 347883 - RNA, 19 nt, Homo sapiens
uaaagcugcugugaacauu

SEQ ID NO: 347884 - RNA, 19 nt, Homo sapiens
uaagagcugugucauccuu

SEQ ID NO: 347885 - RNA, 19 nt, Homo sapiens
gagaguagcaaauuguuca

SEQ ID NO: 347886 - RNA, 19 nt, Homo sapiens
ucaaggaaaugauagaaac

SEQ ID NO: 347887 - RNA, 19 nt, Homo sapiens
ggacagacagacagacaga

SEQ ID NO: 347888 - RNA, 19 nt, Homo sapiens
gaacuccuuugcagaaacu

SEQ ID NO: 347889 - RNA, 19 nt, Homo sapiens
gauuaguagugaccauuau

SEQ ID NO: 347890 - RNA, 19 nt, Homo sapiens
gaaacagauggaauuagaa

SEQ ID NO: 347891 - RNA, 19 nt, Homo sapiens
gaauagaaacagauggaau

SEQ ID NO: 347892 - RNA, 19 nt, Homo sapiens
caaauaucgcugaauagaa

SEQ ID NO: 347893 - RNA, 19 nt, Homo sapiens
uagaugaacucuucucaac

SEQ ID NO: 347894 - RNA, 19 nt, Homo sapiens
ccagaaaacugucauuuag

SEQ ID NO: 347895 - RNA, 19 nt, Homo sapiens
cagcugaucuggacuucau

SEQ ID NO: 347896 - RNA, 19 nt, Homo sapiens
gcaaauuguucagcuccuu

SEQ ID NO: 347897 - RNA, 19 nt, Homo sapiens
ucacaaugcuccuccugau

SEQ ID NO: 347898 - RNA, 19 nt, Homo sapiens
guggagaacaugcauacua

SEQ ID NO: 347899 - RNA, 19 nt, Homo sapiens
cagaagaaggcaaaccuaa

SEQ ID NO: 347900 - RNA, 19 nt, Homo sapiens
aagaaacacugaagagagu

SEQ ID NO: 347901 - RNA, 19 nt, Homo sapiens
caagagcaagcaaaccuaa

SEQ ID NO: 347902 - RNA, 19 nt, Homo sapiens
ugaaggaccagccugauga

SEQ ID NO: 347903 - RNA, 19 nt, Homo sapiens
gacacucaaucuagaacaa

SEQ ID NO: 347904 - RNA, 19 nt, Homo sapiens
gaaaucaagaaacucaugu

SEQ ID NO: 347905 - RNA, 19 nt, Homo sapiens
gcaauuaucccaggugucu

SEQ ID NO: 347906 - RNA, 19 nt, Homo sapiens
gagaacaugcauacuacaa

SEQ ID NO: 347907 - RNA, 19 nt, Homo sapiens
gcugugucauccuuaugua

SEQ ID NO: 347908 - RNA, 19 nt, Homo sapiens
gcccagagguaagaauaga

SEQ ID NO: 347909 - RNA, 19 nt, Homo sapiens
uuagcugccuucaguauau

SEQ ID NO: 347910 - RNA, 19 nt, Homo sapiens
ugaaugagaaauccaaaga

SEQ ID NO: 347911 - RNA, 19 nt, Homo sapiens
ccagaggacagauuaauag

SEQ ID NO: 347912 - RNA, 19 nt, Homo sapiens
cccaagaaaguaauuagua

SEQ ID NO: 347913 - RNA, 19 nt, Homo sapiens
gaacucaaggaaaugauag

SEQ ID NO: 347914 - RNA, 19 nt, Homo sapiens
gcuauucuacuuuaaagga

SEQ ID NO: 347915 - RNA, 19 nt, Homo sapiens
gcacgugaagaaacaaaga

SEQ ID NO: 347916 - RNA, 19 nt, Homo sapiens
gcaacaagcagaagaagcu

SEQ ID NO: 347917 - RNA, 19 nt, Homo sapiens
uaacacaagagcaagcaaa

SEQ ID NO: 347918 - RNA, 19 nt, Homo sapiens
ugucugaccuccuaacaca

SEQ ID NO: 347919 - RNA, 19 nt, Homo sapiens
aauauucccuuguauggau

SEQ ID NO: 347920 - RNA, 19 nt, Homo sapiens
acaaugcuccuccugauga

SEQ ID NO: 347921 - RNA, 19 nt, Homo sapiens
gauuuaacccuucacaaca

SEQ ID NO: 347922 - RNA, 19 nt, Homo sapiens
ucuguaagcuaauccacaa

SEQ ID NO: 347923 - RNA, 19 nt, Homo sapiens
ccuaagagcacagugaauu

SEQ ID NO: 347924 - RNA, 19 nt, Homo sapiens
agcuaaaggucuucaguuu

SEQ ID NO: 347925 - RNA, 19 nt, Homo sapiens
aagcugcugugaacauuug

SEQ ID NO: 347926 - RNA, 19 nt, Homo sapiens
ggaaaugacuuuugaugac

SEQ ID NO: 347927 - RNA, 19 nt, Homo sapiens
uguugaauauucccuugua

SEQ ID NO: 347928 - RNA, 19 nt, Homo sapiens
caagagauguuugcuuuug

SEQ ID NO: 347929 - RNA, 19 nt, Homo sapiens
ugaguggucuuuucuguaa

SEQ ID NO: 347930 - RNA, 19 nt, Homo sapiens
cagaggccauuccgaaauc

SEQ ID NO: 347931 - RNA, 19 nt, Homo sapiens
gcucggaagcugaaugaga

SEQ ID NO: 347932 - RNA, 19 nt, Homo sapiens
cgaacucaaggaaaugaua

SEQ ID NO: 347933 - RNA, 19 nt, Homo sapiens
cccauuuacuuguugauga

SEQ ID NO: 347934 - RNA, 19 nt, Homo sapiens
cacaauucauuuacccauu

SEQ ID NO: 347935 - RNA, 19 nt, Homo sapiens
aaacaugagagcccagaaa

SEQ ID NO: 347936 - RNA, 19 nt, Homo sapiens
cuaagagcacagugaauuu

SEQ ID NO: 347937 - RNA, 19 nt, Homo sapiens
gcacagcugaucuggacuu

SEQ ID NO: 347938 - RNA, 19 nt, Homo sapiens
ugagaaauccaaagagcaa

SEQ ID NO: 347939 - RNA, 19 nt, Homo sapiens
gaaacuggagggacagauc

SEQ ID NO: 347940 - RNA, 19 nt, Homo sapiens
gacagaggccauuccgaaa

SEQ ID NO: 347941 - RNA, 19 nt, Homo sapiens
ugaaggcucuggaagaaaa

SEQ ID NO: 347942 - RNA, 19 nt, Homo sapiens
ccaaagagcaaauggaacu

SEQ ID NO: 347943 - RNA, 19 nt, Homo sapiens
cucggaagcugaaugagaa

SEQ ID NO: 347944 - RNA, 19 nt, Homo sapiens
ucauuuacccauuuacuug

SEQ ID NO: 347945 - RNA, 19 nt, Homo sapiens
gaagggagcuuuguuaguu

SEQ ID NO: 347946 - RNA, 19 nt, Homo sapiens
caacaaagcacaacccuua

SEQ ID NO: 347947 - RNA, 19 nt, Homo sapiens
gaagauacauccacagaga

SEQ ID NO: 347948 - RNA, 19 nt, Homo sapiens
gcacaacccuuaacuuaug

SEQ ID NO: 347949 - RNA, 19 nt, Homo sapiens
gcaaaugcuuggaaaguaa

SEQ ID NO: 347950 - RNA, 19 nt, Homo sapiens
gagauaacccuuuacaaua

SEQ ID NO: 347951 - RNA, 19 nt, Homo sapiens
gaaauuugcugcaguguca

SEQ ID NO: 347952 - RNA, 19 nt, Homo sapiens
gcucauaacugugucauuu

SEQ ID NO: 347953 - RNA, 19 nt, Homo sapiens
gcacugaaauauacagaaa

SEQ ID NO: 347954 - RNA, 19 nt, Homo sapiens
gcagaaacuugucuacauu

SEQ ID NO: 347955 - RNA, 19 nt, Homo sapiens
gaaagccagucuuaacauu

SEQ ID NO: 347956 - RNA, 19 nt, Homo sapiens
gaagacugcuuuaauaucu

SEQ ID NO: 347957 - RNA, 19 nt, Homo sapiens
gcagaugccuaaacuguau

SEQ ID NO: 347958 - RNA, 19 nt, Homo sapiens
ggauuuaccucaagcuuau

SEQ ID NO: 347959 - RNA, 19 nt, Homo sapiens
ggccaacucucaugcauaa

SEQ ID NO: 347960 - RNA, 19 nt, Homo sapiens
gaacaaaggaaacaacguu

SEQ ID NO: 347961 - RNA, 19 nt, Homo sapiens
caacaugcccuccaaacua

SEQ ID NO: 347962 - RNA, 19 nt, Homo sapiens
gaacaugucugcugcuaac

SEQ ID NO: 347963 - RNA, 19 nt, Homo sapiens
ccacagagacuaucaauuc

SEQ ID NO: 347964 - RNA, 19 nt, Homo sapiens
gcuuaucaguggaaucuua

SEQ ID NO: 347965 - RNA, 19 nt, Homo sapiens
ugacaaaucucacacaucu

SEQ ID NO: 347966 - RNA, 19 nt, Homo sapiens
cggguaagauguuauuuaa

SEQ ID NO: 347967 - RNA, 19 nt, Homo sapiens
gaagagacaaccacaaaug

SEQ ID NO: 347968 - RNA, 19 nt, Homo sapiens
ggacugcaagagaauauua

SEQ ID NO: 347969 - RNA, 19 nt, Homo sapiens
acaacgagguuuauugaaa

SEQ ID NO: 347970 - RNA, 19 nt, Homo sapiens
caacaacgagguuuauuga

SEQ ID NO: 347971 - RNA, 19 nt, Homo sapiens
uaagguaucccauccuaua

SEQ ID NO: 347972 - RNA, 19 nt, Homo sapiens
ggcaaaugcuuggaaagua

SEQ ID NO: 347973 - RNA, 19 nt, Homo sapiens
uuaaggcucuagaaagaua

SEQ ID NO: 347974 - RNA, 19 nt, Homo sapiens
uauuaaggcucuagaaaga

SEQ ID NO: 347975 - RNA, 19 nt, Homo sapiens
caagacgaccuuuaaguuu

SEQ ID NO: 347976 - RNA, 19 nt, Homo sapiens
gagacaaccacaaauguaa

SEQ ID NO: 347977 - RNA, 19 nt, Homo sapiens
aaugugagguuuauaggua

SEQ ID NO: 347978 - RNA, 19 nt, Homo sapiens
aagcacaacccuuaacuua

SEQ ID NO: 347979 - RNA, 19 nt, Homo sapiens
caaacaauaucgaacaaag

SEQ ID NO: 347980 - RNA, 19 nt, Homo sapiens
caauguauaugcacagaga

SEQ ID NO: 347981 - RNA, 19 nt, Homo sapiens
guccauaucuaaccaguga

SEQ ID NO: 347982 - RNA, 19 nt, Homo sapiens
uacauuaccugcagagauu

SEQ ID NO: 347983 - RNA, 19 nt, Homo sapiens
ugcaagagauaacccuuua

SEQ ID NO: 347984 - RNA, 19 nt, Homo sapiens
cauaagguaucccauccua

SEQ ID NO: 347985 - RNA, 19 nt, Homo sapiens
ggauuaagcauugacuaua

SEQ ID NO: 347986 - RNA, 19 nt, Homo sapiens
aaagucaacguuaggauua

SEQ ID NO: 347987 - RNA, 19 nt, Homo sapiens
aaagaaggguguaucuguu

SEQ ID NO: 347988 - RNA, 19 nt, Homo sapiens
gggaagagacaaccacaaa

SEQ ID NO: 347989 - RNA, 19 nt, Homo sapiens
ggaaaagguuguccucauu

SEQ ID NO: 347990 - RNA, 19 nt, Homo sapiens
caucuggacugcaagagaa

SEQ ID NO: 347991 - RNA, 19 nt, Homo sapiens
ucguggaccugucuaauaa

SEQ ID NO: 347992 - RNA, 19 nt, Homo sapiens
caaccucaguaguaacaaa

SEQ ID NO: 347993 - RNA, 19 nt, Homo sapiens
gugcaccucuugccauaaa

SEQ ID NO: 347994 - RNA, 19 nt, Homo sapiens
gugauucgagcuauauuua

SEQ ID NO: 347995 - RNA, 19 nt, Homo sapiens
acaaaucucacacaucuuu

SEQ ID NO: 347996 - RNA, 19 nt, Homo sapiens
ggcagaaacuugucuacau

SEQ ID NO: 347997 - RNA, 19 nt, Homo sapiens
ccuaaacuguauuugcaua

SEQ ID NO: 347998 - RNA, 19 nt, Homo sapiens
cuacaacugcaacuauuua

SEQ ID NO: 347999 - RNA, 19 nt, Homo sapiens
gaggcaauguuaaauaugg

SEQ ID NO: 348000 - RNA, 19 nt, Homo sapiens
ggaccugucuaauaauucu

SEQ ID NO: 348001 - RNA, 19 nt, Homo sapiens
caaccaacaugcccuccaa

SEQ ID NO: 348002 - RNA, 19 nt, Homo sapiens
aagccugccugcucacuua

SEQ ID NO: 348003 - RNA, 19 nt, Homo sapiens
ugaaaugccucaacaaagc

SEQ ID NO: 348004 - RNA, 19 nt, Homo sapiens
guucucaaccucaguagua

SEQ ID NO: 348005 - RNA, 19 nt, Homo sapiens
guuuauagguacuguguug

SEQ ID NO: 348006 - RNA, 19 nt, Homo sapiens
cagucacucuguaaauaua

SEQ ID NO: 348007 - RNA, 19 nt, Homo sapiens
ucauuuggcuuuccaguca

SEQ ID NO: 348008 - RNA, 19 nt, Homo sapiens
ucccacaccuucuggauuu

SEQ ID NO: 348009 - RNA, 19 nt, Homo sapiens
gauagggacuccauguucu

SEQ ID NO: 348010 - RNA, 19 nt, Homo sapiens
gcacaacaauaaguucaca

SEQ ID NO: 348011 - RNA, 19 nt, Homo sapiens
uucgaagacugcuuuaaua

SEQ ID NO: 348012 - RNA, 19 nt, Homo sapiens
gaacaagacgaccuuuaag

SEQ ID NO: 348013 - RNA, 19 nt, Homo sapiens
gcaguccuccuauguggua

SEQ ID NO: 348014 - RNA, 19 nt, Homo sapiens
ggguguaucuguuuguuuc

SEQ ID NO: 348015 - RNA, 19 nt, Homo sapiens
uaaaaggacucgacaacaa

SEQ ID NO: 348016 - RNA, 19 nt, Homo sapiens
agaacaagacgaccuuuaa

SEQ ID NO: 348017 - RNA, 19 nt, Homo sapiens
cacaaugucuugguacuug

SEQ ID NO: 348018 - RNA, 19 nt, Homo sapiens
gauucgagcuauauuuaag

SEQ ID NO: 348019 - RNA, 19 nt, Homo sapiens
ggaauggucacaaacacaa

SEQ ID NO: 348020 - RNA, 19 nt, Homo sapiens
gaaaagguuguccucauua

SEQ ID NO: 348021 - RNA, 19 nt, Homo sapiens
cagaaacuugucuacauua

SEQ ID NO: 348022 - RNA, 19 nt, Homo sapiens
gguacuugcugcuauuuua

SEQ ID NO: 348023 - RNA, 19 nt, Homo sapiens
ucaagcuuauucacuguaa

SEQ ID NO: 348024 - RNA, 19 nt, Homo sapiens
agagauaacccuuuacaau

SEQ ID NO: 348025 - RNA, 19 nt, Homo sapiens
acacaaauucuuccaggua

SEQ ID NO: 348026 - RNA, 19 nt, Homo sapiens
guggaccugucuaauaauu

SEQ ID NO: 348027 - RNA, 19 nt, Homo sapiens
acaaaucugauacugcuua

SEQ ID NO: 348028 - RNA, 19 nt, Homo sapiens
uuacugaucugcauaacca

SEQ ID NO: 348029 - RNA, 19 nt, Homo sapiens
uauaaccacuuuacugauc

SEQ ID NO: 348030 - RNA, 19 nt, Homo sapiens
gcaaaucagauauauaggu

SEQ ID NO: 348031 - RNA, 19 nt, Homo sapiens
caacgagguuuauugaaaa

SEQ ID NO: 348032 - RNA, 19 nt, Homo sapiens
guaagaaagcauaucauca

SEQ ID NO: 348033 - RNA, 19 nt, Homo sapiens
ugugguaacucaacccaaa

SEQ ID NO: 348034 - RNA, 19 nt, Homo sapiens
uaagugggaugcagacagu

SEQ ID NO: 348035 - RNA, 19 nt, Homo sapiens
gcugcuaacaacaacauua

SEQ ID NO: 348036 - RNA, 19 nt, Homo sapiens
ugaggacccuggacauuuc

SEQ ID NO: 348037 - RNA, 19 nt, Homo sapiens
aaaaugagaugcugauguu

SEQ ID NO: 348038 - RNA, 19 nt, Homo sapiens
cuacccaaauaucaucuuu

SEQ ID NO: 348039 - RNA, 19 nt, Homo sapiens
gagcuuuguuaguuuaauc

SEQ ID NO: 348040 - RNA, 19 nt, Homo sapiens
uaaaaugggcacugaaaua

SEQ ID NO: 348041 - RNA, 19 nt, Homo sapiens
aagauggaauggucacaaa

SEQ ID NO: 348042 - RNA, 19 nt, Homo sapiens
aauaacagguggucaugug

SEQ ID NO: 348043 - RNA, 19 nt, Homo sapiens
acuaagaagucucgagguu

SEQ ID NO: 348044 - RNA, 19 nt, Homo sapiens
caaaucugauacugcuuau

SEQ ID NO: 348045 - RNA, 19 nt, Homo sapiens
ggacucggaugccauagau

SEQ ID NO: 348046 - RNA, 19 nt, Homo sapiens
ggaggacucggaugccaua

SEQ ID NO: 348047 - RNA, 19 nt, Homo sapiens
ugucggaccuggccaagau

SEQ ID NO: 348048 - RNA, 19 nt, Homo sapiens
guacuuccucgucaccuuu

SEQ ID NO: 348049 - RNA, 19 nt, Homo sapiens
ccucaaggccuccgugguu

SEQ ID NO: 348050 - RNA, 19 nt, Homo sapiens
ucacaggcaccucgcagaa

SEQ ID NO: 348051 - RNA, 19 nt, Homo sapiens
cggaugccauagauuggaa

SEQ ID NO: 348052 - RNA, 19 nt, Homo sapiens
gaccucaccaaccucauga

SEQ ID NO: 348053 - RNA, 19 nt, Homo sapiens
gcaaggucauguacuuccu

SEQ ID NO: 348054 - RNA, 19 nt, Homo sapiens
cucaaggccuccgugguuu

SEQ ID NO: 348055 - RNA, 19 nt, Homo sapiens
acucggaugccauagauug

SEQ ID NO: 348056 - RNA, 19 nt, Homo sapiens
ggaccccacugccaucuuc

SEQ ID NO: 348057 - RNA, 19 nt, Homo sapiens
uccgcaaggucauguacuu

SEQ ID NO: 348058 - RNA, 19 nt, Homo sapiens
acaggcaccucgcagaacu

SEQ ID NO: 348059 - RNA, 19 nt, Homo sapiens
ugccauagauuggaaugag

SEQ ID NO: 348060 - RNA, 19 nt, Homo sapiens
gaaagagcaugaugacaua

SEQ ID NO: 348061 - RNA, 19 nt, Homo sapiens
gaacagcucugaaagcauu

SEQ ID NO: 348062 - RNA, 19 nt, Homo sapiens
gagaagauguugaaaugua

SEQ ID NO: 348063 - RNA, 19 nt, Homo sapiens
gaggagagcucuauuaugu

SEQ ID NO: 348064 - RNA, 19 nt, Homo sapiens
gaggacagcuugaggguua

SEQ ID NO: 348065 - RNA, 19 nt, Homo sapiens
gaaacugaauggaagaaua

SEQ ID NO: 348066 - RNA, 19 nt, Homo sapiens
aaagaaggcuguaccguua

SEQ ID NO: 348067 - RNA, 19 nt, Homo sapiens
aaacacagcucuggaauaa

SEQ ID NO: 348068 - RNA, 19 nt, Homo sapiens
ggacaaagcucuguaugga

SEQ ID NO: 348069 - RNA, 19 nt, Homo sapiens
ggacaggagugaauagaaa

SEQ ID NO: 348070 - RNA, 19 nt, Homo sapiens
gaagaaauuugccuuggaa

SEQ ID NO: 348071 - RNA, 19 nt, Homo sapiens
cagaagaccuuguaaaguu

SEQ ID NO: 348072 - RNA, 19 nt, Homo sapiens
gaacaacuguaaauagaug

SEQ ID NO: 348073 - RNA, 19 nt, Homo sapiens
ugaggaagauuaaggauaa

SEQ ID NO: 348074 - RNA, 19 nt, Homo sapiens
gcaaugauguggucuuguu

SEQ ID NO: 348075 - RNA, 19 nt, Homo sapiens
gaaauagaacuucgaauga

SEQ ID NO: 348076 - RNA, 19 nt, Homo sapiens
ggagggagaucuucauuuc

SEQ ID NO: 348077 - RNA, 19 nt, Homo sapiens
gaccauauccuuaaaugua

SEQ ID NO: 348078 - RNA, 19 nt, Homo sapiens
agaaagaccuucagcugua

SEQ ID NO: 348079 - RNA, 19 nt, Homo sapiens
ugacagagccaccggauua

SEQ ID NO: 348080 - RNA, 19 nt, Homo sapiens
gcaaugggaugcagcuauu

SEQ ID NO: 348081 - RNA, 19 nt, Homo sapiens
gcauacaucugaagaacaa

SEQ ID NO: 348082 - RNA, 19 nt, Homo sapiens
cagcuuaucuugcaaguga

SEQ ID NO: 348083 - RNA, 19 nt, Homo sapiens
uaaaggacauucaagcaaa

SEQ ID NO: 348084 - RNA, 19 nt, Homo sapiens
gaaaagcccuuccuaauuc

SEQ ID NO: 348085 - RNA, 19 nt, Homo sapiens
uaacguaugugaauagaug

SEQ ID NO: 348086 - RNA, 19 nt, Homo sapiens
gaagaacagugguaaugga

SEQ ID NO: 348087 - RNA, 19 nt, Homo sapiens
gaucauggcuauauguugu

SEQ ID NO: 348088 - RNA, 19 nt, Homo sapiens
ggagagcucuauuauguuc

SEQ ID NO: 348089 - RNA, 19 nt, Homo sapiens
gaaguuaggcgauuagaga

SEQ ID NO: 348090 - RNA, 19 nt, Homo sapiens
gaggagaucaguauuguaa

SEQ ID NO: 348091 - RNA, 19 nt, Homo sapiens
gauccaagcuugauuaagg

SEQ ID NO: 348092 - RNA, 19 nt, Homo sapiens
ggaagaaaguauuaaacga

SEQ ID NO: 348093 - RNA, 19 nt, Homo sapiens
gacaaaggcauucaucaua

SEQ ID NO: 348094 - RNA, 19 nt, Homo sapiens
acaauaaagucaugggaua

SEQ ID NO: 348095 - RNA, 19 nt, Homo sapiens
aaacagcucuaaaccauug

SEQ ID NO: 348096 - RNA, 19 nt, Homo sapiens
gaagaccucaagaaaguua

SEQ ID NO: 348097 - RNA, 19 nt, Homo sapiens
gcugaacgcaguauuguua

SEQ ID NO: 348098 - RNA, 19 nt, Homo sapiens
ugacauguauucugaaguu

SEQ ID NO: 348099 - RNA, 19 nt, Homo sapiens
gauggugcuuguugacuua

SEQ ID NO: 348100 - RNA, 19 nt, Homo sapiens
ggaaauccuucaacaaucu

SEQ ID NO: 348101 - RNA, 19 nt, Homo sapiens
gaaacacagcucuggaaua

SEQ ID NO: 348102 - RNA, 19 nt, Homo sapiens
ggacauccuuucagcaguu

SEQ ID NO: 348103 - RNA, 19 nt, Homo sapiens
uguuauagcucuagcagua

SEQ ID NO: 348104 - RNA, 19 nt, Homo sapiens
ccucucagcugaauaaaga

SEQ ID NO: 348105 - RNA, 19 nt, Homo sapiens
gaaacuauuugaccaugau

SEQ ID NO: 348106 - RNA, 19 nt, Homo sapiens
gcagauaauugaaggaaag

SEQ ID NO: 348107 - RNA, 19 nt, Homo sapiens
gcuauauguuguugagaua

SEQ ID NO: 348108 - RNA, 19 nt, Homo sapiens
ggaaagagcaugaugacau

SEQ ID NO: 348109 - RNA, 19 nt, Homo sapiens
ugaaagcauugaagcuaua

SEQ ID NO: 348110 - RNA, 19 nt, Homo sapiens
agaagaccuuguaaaguua

SEQ ID NO: 348111 - RNA, 19 nt, Homo sapiens
ucacuaagccuuuacuuug

SEQ ID NO: 348112 - RNA, 19 nt, Homo sapiens
ucacgaagcauuuaucauu

SEQ ID NO: 348113 - RNA, 19 nt, Homo sapiens
gcaguucucuucucugaca

SEQ ID NO: 348114 - RNA, 19 nt, Homo sapiens
cuugaaagcuagguauuua

SEQ ID NO: 348115 - RNA, 19 nt, Homo sapiens
uaauguggcuucuuucaug

SEQ ID NO: 348116 - RNA, 19 nt, Homo sapiens
gaaauuucaacccuucaua

SEQ ID NO: 348117 - RNA, 19 nt, Homo sapiens
guaugugucuguaguauuc

SEQ ID NO: 348118 - RNA, 19 nt, Homo sapiens
uuaaagagguauuggaaga

SEQ ID NO: 348119 - RNA, 19 nt, Homo sapiens
acaguaauguggcuucuuu

SEQ ID NO: 348120 - RNA, 19 nt, Homo sapiens
ccaagucaguaccagcuua

SEQ ID NO: 348121 - RNA, 19 nt, Homo sapiens
guacuaaagugacaaaucg

SEQ ID NO: 348122 - RNA, 19 nt, Homo sapiens
ggcaacaacuuacaaauac

SEQ ID NO: 348123 - RNA, 19 nt, Homo sapiens
gaagaccgauccauaucug

SEQ ID NO: 348124 - RNA, 19 nt, Homo sapiens
ugaccggaaugaacuauuu

SEQ ID NO: 348125 - RNA, 19 nt, Homo sapiens
caaugaaagcuuuagguua

SEQ ID NO: 348126 - RNA, 19 nt, Homo sapiens
ggaccuuagugaauauaaa

SEQ ID NO: 348127 - RNA, 19 nt, Homo sapiens
aaacugaaauucucuccaa

SEQ ID NO: 348128 - RNA, 19 nt, Homo sapiens
gcugguagaugcauaguca

SEQ ID NO: 348129 - RNA, 19 nt, Homo sapiens
cagcuuaccuauuugauuc

SEQ ID NO: 348130 - RNA, 19 nt, Homo sapiens
cggaagaccucaagaaagu

SEQ ID NO: 348131 - RNA, 19 nt, Homo sapiens
gcaucaaguuuauagaaga

SEQ ID NO: 348132 - RNA, 19 nt, Homo sapiens
gcacccagcuuaucuugca

SEQ ID NO: 348133 - RNA, 19 nt, Homo sapiens
ggaagaaucggacccaaga

SEQ ID NO: 348134 - RNA, 19 nt, Homo sapiens
ugaaauccuugaugaaguu

SEQ ID NO: 348135 - RNA, 19 nt, Homo sapiens
gcugauaguuucaaagcaa

SEQ ID NO: 348136 - RNA, 19 nt, Homo sapiens
gagaccauauccuuaaaug

SEQ ID NO: 348137 - RNA, 19 nt, Homo sapiens
ggaaauugaugaguauauc

SEQ ID NO: 348138 - RNA, 19 nt, Homo sapiens
guauguaucugaggaaaga

SEQ ID NO: 348139 - RNA, 19 nt, Homo sapiens
gauauugcccucuuuguau

SEQ ID NO: 348140 - RNA, 19 nt, Homo sapiens
gaaagaccuucagcuguau

SEQ ID NO: 348141 - RNA, 19 nt, Homo sapiens
guagauccaagcuugauua

SEQ ID NO: 348142 - RNA, 19 nt, Homo sapiens
uggagaagauguugaaaug

SEQ ID NO: 348143 - RNA, 19 nt, Homo sapiens
uaaagaggccguuaaggaa

SEQ ID NO: 348144 - RNA, 19 nt, Homo sapiens
aaaaguagguccagccuua

SEQ ID NO: 348145 - RNA, 19 nt, Homo sapiens
gaugacacguucuccaguu

SEQ ID NO: 348146 - RNA, 19 nt, Homo sapiens
cagcaguucucuucucuga

SEQ ID NO: 348147 - RNA, 19 nt, Homo sapiens
caaaggcauucaucauaga

SEQ ID NO: 348148 - RNA, 19 nt, Homo sapiens
cacauuacguguagauauu

SEQ ID NO: 348149 - RNA, 19 nt, Homo sapiens
guauggaaaugugcuuuaa

SEQ ID NO: 348150 - RNA, 19 nt, Homo sapiens
gaguaaacccugugucuug

SEQ ID NO: 348151 - RNA, 19 nt, Homo sapiens
gcauaacaauuacaacuac

SEQ ID NO: 348152 - RNA, 19 nt, Homo sapiens
aguaccagcuuaccuauuu

SEQ ID NO: 348153 - RNA, 19 nt, Homo sapiens
gggaugcagcuauuuauuu

SEQ ID NO: 348154 - RNA, 19 nt, Homo sapiens
ccaagugacuacaagaaau

SEQ ID NO: 348155 - RNA, 19 nt, Homo sapiens
gcaccagacuuugacaaga

SEQ ID NO: 348156 - RNA, 19 nt, Homo sapiens
gauaugauaccggaccuua

SEQ ID NO: 348157 - RNA, 19 nt, Homo sapiens
gaagacugaacaacuguaa

SEQ ID NO: 348158 - RNA, 19 nt, Homo sapiens
uaucacaucccuuuguaua

SEQ ID NO: 348159 - RNA, 19 nt, Homo sapiens
guuaucacaucccuuugua

SEQ ID NO: 348160 - RNA, 19 nt, Homo sapiens
gaaagagcaugaugacaua

SEQ ID NO: 348161 - RNA, 19 nt, Homo sapiens
gaacagcucugaaagcauu

SEQ ID NO: 348162 - RNA, 19 nt, Homo sapiens
gagaagauguugaaaugua

SEQ ID NO: 348163 - RNA, 19 nt, Homo sapiens
gaggagagcucuauuaugu

SEQ ID NO: 348164 - RNA, 19 nt, Homo sapiens
gaggacagcuugaggguua

SEQ ID NO: 348165 - RNA, 19 nt, Homo sapiens
gaaacugaauggaagaaua

SEQ ID NO: 348166 - RNA, 19 nt, Homo sapiens
aaagaaggcuguaccguua

SEQ ID NO: 348167 - RNA, 19 nt, Homo sapiens
aaacacagcucuggaauaa

SEQ ID NO: 348168 - RNA, 19 nt, Homo sapiens
ggacaaagcucuguaugga

SEQ ID NO: 348169 - RNA, 19 nt, Homo sapiens
ggacaggagugaauagaaa

SEQ ID NO: 348170 - RNA, 19 nt, Homo sapiens
gaagaaauuugccuuggaa

SEQ ID NO: 348171 - RNA, 19 nt, Homo sapiens
gaacaacuguaaauagaug

SEQ ID NO: 348172 - RNA, 19 nt, Homo sapiens
ugaggaagauuaaggauaa

SEQ ID NO: 348173 - RNA, 19 nt, Homo sapiens
gcaaugauguggucuuguu

SEQ ID NO: 348174 - RNA, 19 nt, Homo sapiens
gaaauagaacuucgaauga

SEQ ID NO: 348175 - RNA, 19 nt, Homo sapiens
ggagggagaucuucauuuc

SEQ ID NO: 348176 - RNA, 19 nt, Homo sapiens
gaccauauccuuaaaugua

SEQ ID NO: 348177 - RNA, 19 nt, Homo sapiens
agaaagaccuucagcugua

SEQ ID NO: 348178 - RNA, 19 nt, Homo sapiens
ugacagagccaccggauua

SEQ ID NO: 348179 - RNA, 19 nt, Homo sapiens
gcaaugggaugcagcuauu

SEQ ID NO: 348180 - RNA, 19 nt, Homo sapiens
gcauacaucugaagaacaa

SEQ ID NO: 348181 - RNA, 19 nt, Homo sapiens
cagcuuaucuugcaaguga

SEQ ID NO: 348182 - RNA, 19 nt, Homo sapiens
uaaaggacauucaagcaaa

SEQ ID NO: 348183 - RNA, 19 nt, Homo sapiens
uaacguaugugaauagaug

SEQ ID NO: 348184 - RNA, 19 nt, Homo sapiens
gaagaacagugguaaugga

SEQ ID NO: 348185 - RNA, 19 nt, Homo sapiens
gaucauggcuauauguugu

SEQ ID NO: 348186 - RNA, 19 nt, Homo sapiens
ggagagcucuauuauguuc

SEQ ID NO: 348187 - RNA, 19 nt, Homo sapiens
gaaguuaggcgauuagaga

SEQ ID NO: 348188 - RNA, 19 nt, Homo sapiens
gaggagaucaguauuguaa

SEQ ID NO: 348189 - RNA, 19 nt, Homo sapiens
gauccaagcuugauuaagg

SEQ ID NO: 348190 - RNA, 19 nt, Homo sapiens
ggaagaaaguauuaaacga

SEQ ID NO: 348191 - RNA, 19 nt, Homo sapiens
gacaaaggcauucaucaua

SEQ ID NO: 348192 - RNA, 19 nt, Homo sapiens
acaauaaagucaugggaua

SEQ ID NO: 348193 - RNA, 19 nt, Homo sapiens
aaacagcucuaaaccauug

SEQ ID NO: 348194 - RNA, 19 nt, Homo sapiens
gaagaccucaagaaaguua

SEQ ID NO: 348195 - RNA, 19 nt, Homo sapiens
gcugaacgcaguauuguua

SEQ ID NO: 348196 - RNA, 19 nt, Homo sapiens
ugacauguauucugaaguu

SEQ ID NO: 348197 - RNA, 19 nt, Homo sapiens
gauggugcuuguugacuua

SEQ ID NO: 348198 - RNA, 19 nt, Homo sapiens
gaaacacagcucuggaaua

SEQ ID NO: 348199 - RNA, 19 nt, Homo sapiens
ggaaauccuucaacaaucu

SEQ ID NO: 348200 - RNA, 19 nt, Homo sapiens
ggacauccuuucagcaguu

SEQ ID NO: 348201 - RNA, 19 nt, Homo sapiens
uguuauagcucuagcagua

SEQ ID NO: 348202 - RNA, 19 nt, Homo sapiens
ccucucagcugaauaaaga

SEQ ID NO: 348203 - RNA, 19 nt, Homo sapiens
gaaacuauuugaccaugau

SEQ ID NO: 348204 - RNA, 19 nt, Homo sapiens
gcagauaauugaaggaaag

SEQ ID NO: 348205 - RNA, 19 nt, Homo sapiens
gcuauauguuguugagaua

SEQ ID NO: 348206 - RNA, 19 nt, Homo sapiens
ggaaagagcaugaugacau

SEQ ID NO: 348207 - RNA, 19 nt, Homo sapiens
ugaaagcauugaagcuaua

SEQ ID NO: 348208 - RNA, 19 nt, Homo sapiens
ucacuaagccuuuacuuug

SEQ ID NO: 348209 - RNA, 19 nt, Homo sapiens
ucacgaagcauuuaucauu

SEQ ID NO: 348210 - RNA, 19 nt, Homo sapiens
gcaguucucuucucugaca

SEQ ID NO: 348211 - RNA, 19 nt, Homo sapiens
cuugaaagcuagguauuua

SEQ ID NO: 348212 - RNA, 19 nt, Homo sapiens
uaauguggcuucuuucaug

SEQ ID NO: 348213 - RNA, 19 nt, Homo sapiens
gaaauuucaacccuucaua

SEQ ID NO: 348214 - RNA, 19 nt, Homo sapiens
guaugugucuguaguauuc

SEQ ID NO: 348215 - RNA, 19 nt, Homo sapiens
uuaaagagguauuggaaga

SEQ ID NO: 348216 - RNA, 19 nt, Homo sapiens
acaguaauguggcuucuuu

SEQ ID NO: 348217 - RNA, 19 nt, Homo sapiens
ccaagucaguaccagcuua

SEQ ID NO: 348218 - RNA, 19 nt, Homo sapiens
guacuaaagugacaaaucg

SEQ ID NO: 348219 - RNA, 19 nt, Homo sapiens
ggcaacaacuuacaaauac

SEQ ID NO: 348220 - RNA, 19 nt, Homo sapiens
gaagaccgauccauaucug

SEQ ID NO: 348221 - RNA, 19 nt, Homo sapiens
ugaccggaaugaacuauuu

SEQ ID NO: 348222 - RNA, 19 nt, Homo sapiens
caaugaaagcuuuagguua

SEQ ID NO: 348223 - RNA, 19 nt, Homo sapiens
ggaccuuagugaauauaaa

SEQ ID NO: 348224 - RNA, 19 nt, Homo sapiens
aaacugaaauucucuccaa

SEQ ID NO: 348225 - RNA, 19 nt, Homo sapiens
gcugguagaugcauaguca

SEQ ID NO: 348226 - RNA, 19 nt, Homo sapiens
cagcuuaccuauuugauuc

SEQ ID NO: 348227 - RNA, 19 nt, Homo sapiens
cggaagaccucaagaaagu

SEQ ID NO: 348228 - RNA, 19 nt, Homo sapiens
gcaucaaguuuauagaaga

SEQ ID NO: 348229 - RNA, 19 nt, Homo sapiens
gcacccagcuuaucuugca

SEQ ID NO: 348230 - RNA, 19 nt, Homo sapiens
ggaagaaucggacccaaga

SEQ ID NO: 348231 - RNA, 19 nt, Homo sapiens
ugaaauccuugaugaaguu

SEQ ID NO: 348232 - RNA, 19 nt, Homo sapiens
gcugauaguuucaaagcaa

SEQ ID NO: 348233 - RNA, 19 nt, Homo sapiens
gagaccauauccuuaaaug

SEQ ID NO: 348234 - RNA, 19 nt, Homo sapiens
ggaaauugaugaguauauc

SEQ ID NO: 348235 - RNA, 19 nt, Homo sapiens
guauguaucugaggaaaga

SEQ ID NO: 348236 - RNA, 19 nt, Homo sapiens
gauauugcccucuuuguau

SEQ ID NO: 348237 - RNA, 19 nt, Homo sapiens
gaaagaccuucagcuguau

SEQ ID NO: 348238 - RNA, 19 nt, Homo sapiens
guagauccaagcuugauua

SEQ ID NO: 348239 - RNA, 19 nt, Homo sapiens
uggagaagauguugaaaug

SEQ ID NO: 348240 - RNA, 19 nt, Homo sapiens
uaaagaggccguuaaggaa

SEQ ID NO: 348241 - RNA, 19 nt, Homo sapiens
aaaaguagguccagccuua

SEQ ID NO: 348242 - RNA, 19 nt, Homo sapiens
gaugacacguucuccaguu

SEQ ID NO: 348243 - RNA, 19 nt, Homo sapiens
caaaggcauucaucauaga

SEQ ID NO: 348244 - RNA, 19 nt, Homo sapiens
cagcaguucucuucucuga

SEQ ID NO: 348245 - RNA, 19 nt, Homo sapiens
cacauuacguguagauauu

SEQ ID NO: 348246 - RNA, 19 nt, Homo sapiens
guauggaaaugugcuuuaa

SEQ ID NO: 348247 - RNA, 19 nt, Homo sapiens
gaguaaacccugugucuug

SEQ ID NO: 348248 - RNA, 19 nt, Homo sapiens
gcauaacaauuacaacuac

SEQ ID NO: 348249 - RNA, 19 nt, Homo sapiens
aguaccagcuuaccuauuu

SEQ ID NO: 348250 - RNA, 19 nt, Homo sapiens
gggaugcagcuauuuauuu

SEQ ID NO: 348251 - RNA, 19 nt, Homo sapiens
ccaagugacuacaagaaau

SEQ ID NO: 348252 - RNA, 19 nt, Homo sapiens
gauaugauaccggaccuua

SEQ ID NO: 348253 - RNA, 19 nt, Homo sapiens
gaagacugaacaacuguaa

SEQ ID NO: 348254 - RNA, 19 nt, Homo sapiens
uaucacaucccuuuguaua

SEQ ID NO: 348255 - RNA, 19 nt, Homo sapiens
guuaucacaucccuuugua

SEQ ID NO: 348256 - RNA, 19 nt, Homo sapiens
gcacagaugcgcugguaga

SEQ ID NO: 348257 - RNA, 19 nt, Homo sapiens
uaauaaagcaguagagguu

SEQ ID NO: 348258 - RNA, 19 nt, Homo sapiens
cauugaagcuauaagagaa

SEQ ID NO: 348259 - RNA, 19 nt, Homo sapiens
ggauucagcagauaauuga

SEQ ID NO: 348260 - RNA, 19 nt, Homo sapiens
gaaagagcaugaugacaua

SEQ ID NO: 348261 - RNA, 19 nt, Homo sapiens
gaacagcucugaaagcauu

SEQ ID NO: 348262 - RNA, 19 nt, Homo sapiens
gagaagauguugaaaugua

SEQ ID NO: 348263 - RNA, 19 nt, Homo sapiens
gaggagagcucuauuaugu

SEQ ID NO: 348264 - RNA, 19 nt, Homo sapiens
gaggacagcuugaggguua

SEQ ID NO: 348265 - RNA, 19 nt, Homo sapiens
gaaacugaauggaagaaua

SEQ ID NO: 348266 - RNA, 19 nt, Homo sapiens
aaagaaggcuguaccguua

SEQ ID NO: 348267 - RNA, 19 nt, Homo sapiens
aaacacagcucuggaauaa

SEQ ID NO: 348268 - RNA, 19 nt, Homo sapiens
ggacaaagcucuguaugga

SEQ ID NO: 348269 - RNA, 19 nt, Homo sapiens
ggacaggagugaauagaaa

SEQ ID NO: 348270 - RNA, 19 nt, Homo sapiens
gaagaaauuugccuuggaa

SEQ ID NO: 348271 - RNA, 19 nt, Homo sapiens
gaacaacuguaaauagaug

SEQ ID NO: 348272 - RNA, 19 nt, Homo sapiens
ugaggaagauuaaggauaa

SEQ ID NO: 348273 - RNA, 19 nt, Homo sapiens
gcaaugauguggucuuguu

SEQ ID NO: 348274 - RNA, 19 nt, Homo sapiens
gaaauagaacuucgaauga

SEQ ID NO: 348275 - RNA, 19 nt, Homo sapiens
ggagggagaucuucauuuc

SEQ ID NO: 348276 - RNA, 19 nt, Homo sapiens
gaccauauccuuaaaugua

SEQ ID NO: 348277 - RNA, 19 nt, Homo sapiens
agaaagaccuucagcugua

SEQ ID NO: 348278 - RNA, 19 nt, Homo sapiens
ugacagagccaccggauua

SEQ ID NO: 348279 - RNA, 19 nt, Homo sapiens
gcaaugggaugcagcuauu

SEQ ID NO: 348280 - RNA, 19 nt, Homo sapiens
gcauacaucugaagaacaa

SEQ ID NO: 348281 - RNA, 19 nt, Homo sapiens
cagcuuaucuugcaaguga

SEQ ID NO: 348282 - RNA, 19 nt, Homo sapiens
uaaaggacauucaagcaaa

SEQ ID NO: 348283 - RNA, 19 nt, Homo sapiens
uaacguaugugaauagaug

SEQ ID NO: 348284 - RNA, 19 nt, Homo sapiens
gaagaacagugguaaugga

SEQ ID NO: 348285 - RNA, 19 nt, Homo sapiens
gaucauggcuauauguugu

SEQ ID NO: 348286 - RNA, 19 nt, Homo sapiens
ggagagcucuauuauguuc

SEQ ID NO: 348287 - RNA, 19 nt, Homo sapiens
gaaguuaggcgauuagaga

SEQ ID NO: 348288 - RNA, 19 nt, Homo sapiens
gaggagaucaguauuguaa

SEQ ID NO: 348289 - RNA, 19 nt, Homo sapiens
gauccaagcuugauuaagg

SEQ ID NO: 348290 - RNA, 19 nt, Homo sapiens
ggaagaaaguauuaaacga

SEQ ID NO: 348291 - RNA, 19 nt, Homo sapiens
gacaaaggcauucaucaua

SEQ ID NO: 348292 - RNA, 19 nt, Homo sapiens
acaauaaagucaugggaua

SEQ ID NO: 348293 - RNA, 19 nt, Homo sapiens
aaacagcucuaaaccauug

SEQ ID NO: 348294 - RNA, 19 nt, Homo sapiens
gaagaccucaagaaaguua

SEQ ID NO: 348295 - RNA, 19 nt, Homo sapiens
gcugaacgcaguauuguua

SEQ ID NO: 348296 - RNA, 19 nt, Homo sapiens
ugacauguauucugaaguu

SEQ ID NO: 348297 - RNA, 19 nt, Homo sapiens
gauggugcuuguugacuua

SEQ ID NO: 348298 - RNA, 19 nt, Homo sapiens
gaaacacagcucuggaaua

SEQ ID NO: 348299 - RNA, 19 nt, Homo sapiens
ggaaauccuucaacaaucu

SEQ ID NO: 348300 - RNA, 19 nt, Homo sapiens
ugaccuacuucucuuguua

SEQ ID NO: 348301 - RNA, 19 nt, Homo sapiens
ggacauccuuucagcaguu

SEQ ID NO: 348302 - RNA, 19 nt, Homo sapiens
uguuauagcucuagcagua

SEQ ID NO: 348303 - RNA, 19 nt, Homo sapiens
ccucucagcugaauaaaga

SEQ ID NO: 348304 - RNA, 19 nt, Homo sapiens
gaaacuauuugaccaugau

SEQ ID NO: 348305 - RNA, 19 nt, Homo sapiens
gcagauaauugaaggaaag

SEQ ID NO: 348306 - RNA, 19 nt, Homo sapiens
gcuauauguuguugagaua

SEQ ID NO: 348307 - RNA, 19 nt, Homo sapiens
ggaaagagcaugaugacau

SEQ ID NO: 348308 - RNA, 19 nt, Homo sapiens
ugaaagcauugaagcuaua

SEQ ID NO: 348309 - RNA, 19 nt, Homo sapiens
ucacuaagccuuuacuuug

SEQ ID NO: 348310 - RNA, 19 nt, Homo sapiens
ucacgaagcauuuaucauu

SEQ ID NO: 348311 - RNA, 19 nt, Homo sapiens
gcaguucucuucucugaca

SEQ ID NO: 348312 - RNA, 19 nt, Homo sapiens
cuugaaagcuagguauuua

SEQ ID NO: 348313 - RNA, 19 nt, Homo sapiens
uaauguggcuucuuucaug

SEQ ID NO: 348314 - RNA, 19 nt, Homo sapiens
gaaauuucaacccuucaua

SEQ ID NO: 348315 - RNA, 19 nt, Homo sapiens
guaugugucuguaguauuc

SEQ ID NO: 348316 - RNA, 19 nt, Homo sapiens
uuaaagagguauuggaaga

SEQ ID NO: 348317 - RNA, 19 nt, Homo sapiens
acaguaauguggcuucuuu

SEQ ID NO: 348318 - RNA, 19 nt, Homo sapiens
ccaagucaguaccagcuua

SEQ ID NO: 348319 - RNA, 19 nt, Homo sapiens
guacuaaagugacaaaucg

SEQ ID NO: 348320 - RNA, 19 nt, Homo sapiens
ggcaacaacuuacaaauac

SEQ ID NO: 348321 - RNA, 19 nt, Homo sapiens
gaagaccgauccauaucug

SEQ ID NO: 348322 - RNA, 19 nt, Homo sapiens
ugaccggaaugaacuauuu

SEQ ID NO: 348323 - RNA, 19 nt, Homo sapiens
caaugaaagcuuuagguua

SEQ ID NO: 348324 - RNA, 19 nt, Homo sapiens
ggaccuuagugaauauaaa

SEQ ID NO: 348325 - RNA, 19 nt, Homo sapiens
aaacugaaauucucuccaa

SEQ ID NO: 348326 - RNA, 19 nt, Homo sapiens
gcugguagaugcauaguca

SEQ ID NO: 348327 - RNA, 19 nt, Homo sapiens
cagcuuaccuauuugauuc

SEQ ID NO: 348328 - RNA, 19 nt, Homo sapiens
cggaagaccucaagaaagu

SEQ ID NO: 348329 - RNA, 19 nt, Homo sapiens
gcaucaaguuuauagaaga

SEQ ID NO: 348330 - RNA, 19 nt, Homo sapiens
gcacccagcuuaucuugca

SEQ ID NO: 348331 - RNA, 19 nt, Homo sapiens
ggaagaaucggacccaaga

SEQ ID NO: 348332 - RNA, 19 nt, Homo sapiens
ugaaauccuugaugaaguu

SEQ ID NO: 348333 - RNA, 19 nt, Homo sapiens
gcugauaguuucaaagcaa

SEQ ID NO: 348334 - RNA, 19 nt, Homo sapiens
gagaccauauccuuaaaug

SEQ ID NO: 348335 - RNA, 19 nt, Homo sapiens
ggaaauugaugaguauauc

SEQ ID NO: 348336 - RNA, 19 nt, Homo sapiens
guauguaucugaggaaaga

SEQ ID NO: 348337 - RNA, 19 nt, Homo sapiens
gauauugcccucuuuguau

SEQ ID NO: 348338 - RNA, 19 nt, Homo sapiens
gaaagaccuucagcuguau

SEQ ID NO: 348339 - RNA, 19 nt, Homo sapiens
guagauccaagcuugauua

SEQ ID NO: 348340 - RNA, 19 nt, Homo sapiens
uggagaagauguugaaaug

SEQ ID NO: 348341 - RNA, 19 nt, Homo sapiens
uaaagaggccguuaaggaa

SEQ ID NO: 348342 - RNA, 19 nt, Homo sapiens
cuacuucucuuguuagguu

SEQ ID NO: 348343 - RNA, 19 nt, Homo sapiens
aaaaguagguccagccuua

SEQ ID NO: 348344 - RNA, 19 nt, Homo sapiens
gaugacacguucuccaguu

SEQ ID NO: 348345 - RNA, 19 nt, Homo sapiens
caaaggcauucaucauaga

SEQ ID NO: 348346 - RNA, 19 nt, Homo sapiens
cagcaguucucuucucuga

SEQ ID NO: 348347 - RNA, 19 nt, Homo sapiens
cacauuacguguagauauu

SEQ ID NO: 348348 - RNA, 19 nt, Homo sapiens
guauggaaaugugcuuuaa

SEQ ID NO: 348349 - RNA, 19 nt, Homo sapiens
gaguaaacccugugucuug

SEQ ID NO: 348350 - RNA, 19 nt, Homo sapiens
gcauaacaauuacaacuac

SEQ ID NO: 348351 - RNA, 19 nt, Homo sapiens
aguaccagcuuaccuauuu

SEQ ID NO: 348352 - RNA, 19 nt, Homo sapiens
gggaugcagcuauuuauuu

SEQ ID NO: 348353 - RNA, 19 nt, Homo sapiens
ccaagugacuacaagaaau

SEQ ID NO: 348354 - RNA, 19 nt, Homo sapiens
gauaugauaccggaccuua

SEQ ID NO: 348355 - RNA, 19 nt, Homo sapiens
gaagacugaacaacuguaa

SEQ ID NO: 348356 - RNA, 19 nt, Homo sapiens
uaucacaucccuuuguaua

SEQ ID NO: 348357 - RNA, 19 nt, Homo sapiens
guuaucacaucccuuugua

SEQ ID NO: 348358 - RNA, 19 nt, Homo sapiens
gcacagaugcgcugguaga

SEQ ID NO: 348359 - RNA, 19 nt, Homo sapiens
uaauaaagcaguagagguu

SEQ ID NO: 348360 - RNA, 19 nt, Homo sapiens
gaaagagcaugaugacaua

SEQ ID NO: 348361 - RNA, 19 nt, Homo sapiens
gaacagcucugaaagcauu

SEQ ID NO: 348362 - RNA, 19 nt, Homo sapiens
gagaagauguugaaaugua

SEQ ID NO: 348363 - RNA, 19 nt, Homo sapiens
gaggagagcucuauuaugu

SEQ ID NO: 348364 - RNA, 19 nt, Homo sapiens
gaggacagcuugaggguua

SEQ ID NO: 348365 - RNA, 19 nt, Homo sapiens
gaaacugaauggaagaaua

SEQ ID NO: 348366 - RNA, 19 nt, Homo sapiens
aaagaaggcuguaccguua

SEQ ID NO: 348367 - RNA, 19 nt, Homo sapiens
aaacacagcucuggaauaa

SEQ ID NO: 348368 - RNA, 19 nt, Homo sapiens
ggacaaagcucuguaugga

SEQ ID NO: 348369 - RNA, 19 nt, Homo sapiens
ggacaggagugaauagaaa

SEQ ID NO: 348370 - RNA, 19 nt, Homo sapiens
gaagaaauuugccuuggaa

SEQ ID NO: 348371 - RNA, 19 nt, Homo sapiens
gaacaacuguaaauagaug

SEQ ID NO: 348372 - RNA, 19 nt, Homo sapiens
ugaggaagauuaaggauaa

SEQ ID NO: 348373 - RNA, 19 nt, Homo sapiens
gcaaugauguggucuuguu

SEQ ID NO: 348374 - RNA, 19 nt, Homo sapiens
gaaauagaacuucgaauga

SEQ ID NO: 348375 - RNA, 19 nt, Homo sapiens
ggagggagaucuucauuuc

SEQ ID NO: 348376 - RNA, 19 nt, Homo sapiens
gaccauauccuuaaaugua

SEQ ID NO: 348377 - RNA, 19 nt, Homo sapiens
agaaagaccuucagcugua

SEQ ID NO: 348378 - RNA, 19 nt, Homo sapiens
ugacagagccaccggauua

SEQ ID NO: 348379 - RNA, 19 nt, Homo sapiens
gcaaugggaugcagcuauu

SEQ ID NO: 348380 - RNA, 19 nt, Homo sapiens
gcauacaucugaagaacaa

SEQ ID NO: 348381 - RNA, 19 nt, Homo sapiens
cagcuuaucuugcaaguga

SEQ ID NO: 348382 - RNA, 19 nt, Homo sapiens
uaaaggacauucaagcaaa

SEQ ID NO: 348383 - RNA, 19 nt, Homo sapiens
uaacguaugugaauagaug

SEQ ID NO: 348384 - RNA, 19 nt, Homo sapiens
gaagaacagugguaaugga

SEQ ID NO: 348385 - RNA, 19 nt, Homo sapiens
gaucauggcuauauguugu

SEQ ID NO: 348386 - RNA, 19 nt, Homo sapiens
ggagagcucuauuauguuc

SEQ ID NO: 348387 - RNA, 19 nt, Homo sapiens
gaaguuaggcgauuagaga

SEQ ID NO: 348388 - RNA, 19 nt, Homo sapiens
gaggagaucaguauuguaa

SEQ ID NO: 348389 - RNA, 19 nt, Homo sapiens
gauccaagcuugauuaagg

SEQ ID NO: 348390 - RNA, 19 nt, Homo sapiens
ggaagaaaguauuaaacga

SEQ ID NO: 348391 - RNA, 19 nt, Homo sapiens
gacaaaggcauucaucaua

SEQ ID NO: 348392 - RNA, 19 nt, Homo sapiens
acaauaaagucaugggaua

SEQ ID NO: 348393 - RNA, 19 nt, Homo sapiens
aaacagcucuaaaccauug

SEQ ID NO: 348394 - RNA, 19 nt, Homo sapiens
gaagaccucaagaaaguua

SEQ ID NO: 348395 - RNA, 19 nt, Homo sapiens
gcugaacgcaguauuguua

SEQ ID NO: 348396 - RNA, 19 nt, Homo sapiens
ugacauguauucugaaguu

SEQ ID NO: 348397 - RNA, 19 nt, Homo sapiens
gauggugcuuguugacuua

SEQ ID NO: 348398 - RNA, 19 nt, Homo sapiens
gaaacacagcucuggaaua

SEQ ID NO: 348399 - RNA, 19 nt, Homo sapiens
ggaaauccuucaacaaucu

SEQ ID NO: 348400 - RNA, 19 nt, Homo sapiens
ggacauccuuucagcaguu

SEQ ID NO: 348401 - RNA, 19 nt, Homo sapiens
uguuauagcucuagcagua

SEQ ID NO: 348402 - RNA, 19 nt, Homo sapiens
ccucucagcugaauaaaga

SEQ ID NO: 348403 - RNA, 19 nt, Homo sapiens
gaaacuauuugaccaugau

SEQ ID NO: 348404 - RNA, 19 nt, Homo sapiens
gcagauaauugaaggaaag

SEQ ID NO: 348405 - RNA, 19 nt, Homo sapiens
gcuauauguuguugagaua

SEQ ID NO: 348406 - RNA, 19 nt, Homo sapiens
ggaaagagcaugaugacau

SEQ ID NO: 348407 - RNA, 19 nt, Homo sapiens
ugaaagcauugaagcuaua

SEQ ID NO: 348408 - RNA, 19 nt, Homo sapiens
ucacuaagccuuuacuuug

SEQ ID NO: 348409 - RNA, 19 nt, Homo sapiens
ucacgaagcauuuaucauu

SEQ ID NO: 348410 - RNA, 19 nt, Homo sapiens
gcaguucucuucucugaca

SEQ ID NO: 348411 - RNA, 19 nt, Homo sapiens
cuugaaagcuagguauuua

SEQ ID NO: 348412 - RNA, 19 nt, Homo sapiens
uaauguggcuucuuucaug

SEQ ID NO: 348413 - RNA, 19 nt, Homo sapiens
gaaauuucaacccuucaua

SEQ ID NO: 348414 - RNA, 19 nt, Homo sapiens
guaugugucuguaguauuc

SEQ ID NO: 348415 - RNA, 19 nt, Homo sapiens
uuaaagagguauuggaaga

SEQ ID NO: 348416 - RNA, 19 nt, Homo sapiens
acaguaauguggcuucuuu

SEQ ID NO: 348417 - RNA, 19 nt, Homo sapiens
ccaagucaguaccagcuua

SEQ ID NO: 348418 - RNA, 19 nt, Homo sapiens
guacuaaagugacaaaucg

SEQ ID NO: 348419 - RNA, 19 nt, Homo sapiens
ggcaacaacuuacaaauac

SEQ ID NO: 348420 - RNA, 19 nt, Homo sapiens
gaagaccgauccauaucug

SEQ ID NO: 348421 - RNA, 19 nt, Homo sapiens
ugaccggaaugaacuauuu

SEQ ID NO: 348422 - RNA, 19 nt, Homo sapiens
caaugaaagcuuuagguua

SEQ ID NO: 348423 - RNA, 19 nt, Homo sapiens
ggaccuuagugaauauaaa

SEQ ID NO: 348424 - RNA, 19 nt, Homo sapiens
aaacugaaauucucuccaa

SEQ ID NO: 348425 - RNA, 19 nt, Homo sapiens
gcugguagaugcauaguca

SEQ ID NO: 348426 - RNA, 19 nt, Homo sapiens
cagcuuaccuauuugauuc

SEQ ID NO: 348427 - RNA, 19 nt, Homo sapiens
cggaagaccucaagaaagu

SEQ ID NO: 348428 - RNA, 19 nt, Homo sapiens
gcaucaaguuuauagaaga

SEQ ID NO: 348429 - RNA, 19 nt, Homo sapiens
gcacccagcuuaucuugca

SEQ ID NO: 348430 - RNA, 19 nt, Homo sapiens
ggaagaaucggacccaaga

SEQ ID NO: 348431 - RNA, 19 nt, Homo sapiens
ugaaauccuugaugaaguu

SEQ ID NO: 348432 - RNA, 19 nt, Homo sapiens
gcugauaguuucaaagcaa

SEQ ID NO: 348433 - RNA, 19 nt, Homo sapiens
gagaccauauccuuaaaug

SEQ ID NO: 348434 - RNA, 19 nt, Homo sapiens
ggaaauugaugaguauauc

SEQ ID NO: 348435 - RNA, 19 nt, Homo sapiens
guauguaucugaggaaaga

SEQ ID NO: 348436 - RNA, 19 nt, Homo sapiens
gauauugcccucuuuguau

SEQ ID NO: 348437 - RNA, 19 nt, Homo sapiens
gaaagaccuucagcuguau

SEQ ID NO: 348438 - RNA, 19 nt, Homo sapiens
guagauccaagcuugauua

SEQ ID NO: 348439 - RNA, 19 nt, Homo sapiens
uggagaagauguugaaaug

SEQ ID NO: 348440 - RNA, 19 nt, Homo sapiens
uaaagaggccguuaaggaa

SEQ ID NO: 348441 - RNA, 19 nt, Homo sapiens
aaaaguagguccagccuua

SEQ ID NO: 348442 - RNA, 19 nt, Homo sapiens
gaugacacguucuccaguu

SEQ ID NO: 348443 - RNA, 19 nt, Homo sapiens
caaaggcauucaucauaga

SEQ ID NO: 348444 - RNA, 19 nt, Homo sapiens
cagcaguucucuucucuga

SEQ ID NO: 348445 - RNA, 19 nt, Homo sapiens
cacauuacguguagauauu

SEQ ID NO: 348446 - RNA, 19 nt, Homo sapiens
guauggaaaugugcuuuaa

SEQ ID NO: 348447 - RNA, 19 nt, Homo sapiens
gaguaaacccugugucuug

SEQ ID NO: 348448 - RNA, 19 nt, Homo sapiens
gcauaacaauuacaacuac

SEQ ID NO: 348449 - RNA, 19 nt, Homo sapiens
aguaccagcuuaccuauuu

SEQ ID NO: 348450 - RNA, 19 nt, Homo sapiens
gggaugcagcuauuuauuu

SEQ ID NO: 348451 - RNA, 19 nt, Homo sapiens
ccaagugacuacaagaaau

SEQ ID NO: 348452 - RNA, 19 nt, Homo sapiens
cagagccgcuggccaauau

SEQ ID NO: 348453 - RNA, 19 nt, Homo sapiens
gauaugauaccggaccuua

SEQ ID NO: 348454 - RNA, 19 nt, Homo sapiens
gaagacugaacaacuguaa

SEQ ID NO: 348455 - RNA, 19 nt, Homo sapiens
uaucacaucccuuuguaua

SEQ ID NO: 348456 - RNA, 19 nt, Homo sapiens
guuaucacaucccuuugua

SEQ ID NO: 348457 - RNA, 19 nt, Homo sapiens
gcacagaugcgcugguaga

SEQ ID NO: 348458 - RNA, 19 nt, Homo sapiens
uaauaaagcaguagagguu

SEQ ID NO: 348459 - RNA, 19 nt, Homo sapiens
cauugaagcuauaagagaa

SEQ ID NO: 348460 - RNA, 19 nt, Homo sapiens
gaaagagcaugaugacaua

SEQ ID NO: 348461 - RNA, 19 nt, Homo sapiens
gaacagcucugaaagcauu

SEQ ID NO: 348462 - RNA, 19 nt, Homo sapiens
gagaagauguugaaaugua

SEQ ID NO: 348463 - RNA, 19 nt, Homo sapiens
gaggagagcucuauuaugu

SEQ ID NO: 348464 - RNA, 19 nt, Homo sapiens
gaggacagcuugaggguua

SEQ ID NO: 348465 - RNA, 19 nt, Homo sapiens
gaaacugaauggaagaaua

SEQ ID NO: 348466 - RNA, 19 nt, Homo sapiens
aaagaaggcuguaccguua

SEQ ID NO: 348467 - RNA, 19 nt, Homo sapiens
aaacacagcucuggaauaa

SEQ ID NO: 348468 - RNA, 19 nt, Homo sapiens
ggacaaagcucuguaugga

SEQ ID NO: 348469 - RNA, 19 nt, Homo sapiens
ggacaggagugaauagaaa

SEQ ID NO: 348470 - RNA, 19 nt, Homo sapiens
gaagaaauuugccuuggaa

SEQ ID NO: 348471 - RNA, 19 nt, Homo sapiens
cagaagaccuuguaaaguu

SEQ ID NO: 348472 - RNA, 19 nt, Homo sapiens
gaacaacuguaaauagaug

SEQ ID NO: 348473 - RNA, 19 nt, Homo sapiens
ugaggaagauuaaggauaa

SEQ ID NO: 348474 - RNA, 19 nt, Homo sapiens
gcaaugauguggucuuguu

SEQ ID NO: 348475 - RNA, 19 nt, Homo sapiens
gaaauagaacuucgaauga

SEQ ID NO: 348476 - RNA, 19 nt, Homo sapiens
ggagggagaucuucauuuc

SEQ ID NO: 348477 - RNA, 19 nt, Homo sapiens
gaccauauccuuaaaugua

SEQ ID NO: 348478 - RNA, 19 nt, Homo sapiens
agaaagaccuucagcugua

SEQ ID NO: 348479 - RNA, 19 nt, Homo sapiens
ugacagagccaccggauua

SEQ ID NO: 348480 - RNA, 19 nt, Homo sapiens
gcaaugggaugcagcuauu

SEQ ID NO: 348481 - RNA, 19 nt, Homo sapiens
gcauacaucugaagaacaa

SEQ ID NO: 348482 - RNA, 19 nt, Homo sapiens
cagcuuaucuugcaaguga

SEQ ID NO: 348483 - RNA, 19 nt, Homo sapiens
uaaaggacauucaagcaaa

SEQ ID NO: 348484 - RNA, 19 nt, Homo sapiens
gaaaagcccuuccuaauuc

SEQ ID NO: 348485 - RNA, 19 nt, Homo sapiens
uaacguaugugaauagaug

SEQ ID NO: 348486 - RNA, 19 nt, Homo sapiens
gaagaacagugguaaugga

SEQ ID NO: 348487 - RNA, 19 nt, Homo sapiens
gaucauggcuauauguugu

SEQ ID NO: 348488 - RNA, 19 nt, Homo sapiens
ggagagcucuauuauguuc

SEQ ID NO: 348489 - RNA, 19 nt, Homo sapiens
gaaguuaggcgauuagaga

SEQ ID NO: 348490 - RNA, 19 nt, Homo sapiens
gaggagaucaguauuguaa

SEQ ID NO: 348491 - RNA, 19 nt, Homo sapiens
gauccaagcuugauuaagg

SEQ ID NO: 348492 - RNA, 19 nt, Homo sapiens
ggaagaaaguauuaaacga

SEQ ID NO: 348493 - RNA, 19 nt, Homo sapiens
gacaaaggcauucaucaua

SEQ ID NO: 348494 - RNA, 19 nt, Homo sapiens
acaauaaagucaugggaua

SEQ ID NO: 348495 - RNA, 19 nt, Homo sapiens
aaacagcucuaaaccauug

SEQ ID NO: 348496 - RNA, 19 nt, Homo sapiens
gaagaccucaagaaaguua

SEQ ID NO: 348497 - RNA, 19 nt, Homo sapiens
gcugaacgcaguauuguua

SEQ ID NO: 348498 - RNA, 19 nt, Homo sapiens
ugacauguauucugaaguu

SEQ ID NO: 348499 - RNA, 19 nt, Homo sapiens
gauggugcuuguugacuua

SEQ ID NO: 348500 - RNA, 19 nt, Homo sapiens
ggaaauccuucaacaaucu

SEQ ID NO: 348501 - RNA, 19 nt, Homo sapiens
gaaacacagcucuggaaua

SEQ ID NO: 348502 - RNA, 19 nt, Homo sapiens
ugaccuacuucucuuguua

SEQ ID NO: 348503 - RNA, 19 nt, Homo sapiens
ggacauccuuucagcaguu

SEQ ID NO: 348504 - RNA, 19 nt, Homo sapiens
uguuauagcucuagcagua

SEQ ID NO: 348505 - RNA, 19 nt, Homo sapiens
ccucucagcugaauaaaga

SEQ ID NO: 348506 - RNA, 19 nt, Homo sapiens
gaaacuauuugaccaugau

SEQ ID NO: 348507 - RNA, 19 nt, Homo sapiens
gcagauaauugaaggaaag

SEQ ID NO: 348508 - RNA, 19 nt, Homo sapiens
gcuauauguuguugagaua

SEQ ID NO: 348509 - RNA, 19 nt, Homo sapiens
ggaaagagcaugaugacau

SEQ ID NO: 348510 - RNA, 19 nt, Homo sapiens
ugaaagcauugaagcuaua

SEQ ID NO: 348511 - RNA, 19 nt, Homo sapiens
agaagaccuuguaaaguua

SEQ ID NO: 348512 - RNA, 19 nt, Homo sapiens
ucacgaagcauuuaucauu

SEQ ID NO: 348513 - RNA, 19 nt, Homo sapiens
ucacuaagccuuuacuuug

SEQ ID NO: 348514 - RNA, 19 nt, Homo sapiens
gcaguucucuucucugaca

SEQ ID NO: 348515 - RNA, 19 nt, Homo sapiens
cuugaaagcuagguauuua

SEQ ID NO: 348516 - RNA, 19 nt, Homo sapiens
uaauguggcuucuuucaug

SEQ ID NO: 348517 - RNA, 19 nt, Homo sapiens
gaaauuucaacccuucaua

SEQ ID NO: 348518 - RNA, 19 nt, Homo sapiens
guaugugucuguaguauuc

SEQ ID NO: 348519 - RNA, 19 nt, Homo sapiens
uuaaagagguauuggaaga

SEQ ID NO: 348520 - RNA, 19 nt, Homo sapiens
acaguaauguggcuucuuu

SEQ ID NO: 348521 - RNA, 19 nt, Homo sapiens
ccaagucaguaccagcuua

SEQ ID NO: 348522 - RNA, 19 nt, Homo sapiens
guacuaaagugacaaaucg

SEQ ID NO: 348523 - RNA, 19 nt, Homo sapiens
ggcaacaacuuacaaauac

SEQ ID NO: 348524 - RNA, 19 nt, Homo sapiens
gaagaccgauccauaucug

SEQ ID NO: 348525 - RNA, 19 nt, Homo sapiens
ugaccggaaugaacuauuu

SEQ ID NO: 348526 - RNA, 19 nt, Homo sapiens
caaugaaagcuuuagguua

SEQ ID NO: 348527 - RNA, 19 nt, Homo sapiens
ggaccuuagugaauauaaa

SEQ ID NO: 348528 - RNA, 19 nt, Homo sapiens
aaacugaaauucucuccaa

SEQ ID NO: 348529 - RNA, 19 nt, Homo sapiens
gcugguagaugcauaguca

SEQ ID NO: 348530 - RNA, 19 nt, Homo sapiens
cagcuuaccuauuugauuc

SEQ ID NO: 348531 - RNA, 19 nt, Homo sapiens
cggaagaccucaagaaagu

SEQ ID NO: 348532 - RNA, 19 nt, Homo sapiens
gcaucaaguuuauagaaga

SEQ ID NO: 348533 - RNA, 19 nt, Homo sapiens
gcacccagcuuaucuugca

SEQ ID NO: 348534 - RNA, 19 nt, Homo sapiens
ggaagaaucggacccaaga

SEQ ID NO: 348535 - RNA, 19 nt, Homo sapiens
ugaaauccuugaugaaguu

SEQ ID NO: 348536 - RNA, 19 nt, Homo sapiens
gcugauaguuucaaagcaa

SEQ ID NO: 348537 - RNA, 19 nt, Homo sapiens
gagaccauauccuuaaaug

SEQ ID NO: 348538 - RNA, 19 nt, Homo sapiens
ggaaauugaugaguauauc

SEQ ID NO: 348539 - RNA, 19 nt, Homo sapiens
guauguaucugaggaaaga

SEQ ID NO: 348540 - RNA, 19 nt, Homo sapiens
gauauugcccucuuuguau

SEQ ID NO: 348541 - RNA, 19 nt, Homo sapiens
gaaagaccuucagcuguau

SEQ ID NO: 348542 - RNA, 19 nt, Homo sapiens
guagauccaagcuugauua

SEQ ID NO: 348543 - RNA, 19 nt, Homo sapiens
uggagaagauguugaaaug

SEQ ID NO: 348544 - RNA, 19 nt, Homo sapiens
uaaagaggccguuaaggaa

SEQ ID NO: 348545 - RNA, 19 nt, Homo sapiens
cuacuucucuuguuagguu

SEQ ID NO: 348546 - RNA, 19 nt, Homo sapiens
aaaaguagguccagccuua

SEQ ID NO: 348547 - RNA, 19 nt, Homo sapiens
gaugacacguucuccaguu

SEQ ID NO: 348548 - RNA, 19 nt, Homo sapiens
caaaggcauucaucauaga

SEQ ID NO: 348549 - RNA, 19 nt, Homo sapiens
cagcaguucucuucucuga

SEQ ID NO: 348550 - RNA, 19 nt, Homo sapiens
cacauuacguguagauauu

SEQ ID NO: 348551 - RNA, 19 nt, Homo sapiens
guauggaaaugugcuuuaa

SEQ ID NO: 348552 - RNA, 19 nt, Homo sapiens
gaguaaacccugugucuug

SEQ ID NO: 348553 - RNA, 19 nt, Homo sapiens
gcauaacaauuacaacuac

SEQ ID NO: 348554 - RNA, 19 nt, Homo sapiens
aguaccagcuuaccuauuu

SEQ ID NO: 348555 - RNA, 19 nt, Homo sapiens
gggaugcagcuauuuauuu

SEQ ID NO: 348556 - RNA, 19 nt, Homo sapiens
ccaagugacuacaagaaau

SEQ ID NO: 348557 - RNA, 19 nt, Homo sapiens
gcaccagacuuugacaaga

SEQ ID NO: 348558 - RNA, 19 nt, Homo sapiens
gauaugauaccggaccuua

SEQ ID NO: 348559 - RNA, 19 nt, Homo sapiens
gaagacugaacaacuguaa

SEQ ID NO: 348560 - RNA, 19 nt, Homo sapiens
gaaagagcaugaugacaua

SEQ ID NO: 348561 - RNA, 19 nt, Homo sapiens
gaacagcucugaaagcauu

SEQ ID NO: 348562 - RNA, 19 nt, Homo sapiens
gagaagauguugaaaugua

SEQ ID NO: 348563 - RNA, 19 nt, Homo sapiens
gaggagagcucuauuaugu

SEQ ID NO: 348564 - RNA, 19 nt, Homo sapiens
gaggacagcuugaggguua

SEQ ID NO: 348565 - RNA, 19 nt, Homo sapiens
gaaacugaauggaagaaua

SEQ ID NO: 348566 - RNA, 19 nt, Homo sapiens
aaagaaggcuguaccguua

SEQ ID NO: 348567 - RNA, 19 nt, Homo sapiens
aaacacagcucuggaauaa

SEQ ID NO: 348568 - RNA, 19 nt, Homo sapiens
ggacaaagcucuguaugga

SEQ ID NO: 348569 - RNA, 19 nt, Homo sapiens
ggacaggagugaauagaaa

SEQ ID NO: 348570 - RNA, 19 nt, Homo sapiens
gaagaaauuugccuuggaa

SEQ ID NO: 348571 - RNA, 19 nt, Homo sapiens
gaacaacuguaaauagaug

SEQ ID NO: 348572 - RNA, 19 nt, Homo sapiens
ugaggaagauuaaggauaa

SEQ ID NO: 348573 - RNA, 19 nt, Homo sapiens
gcaaugauguggucuuguu

SEQ ID NO: 348574 - RNA, 19 nt, Homo sapiens
gaaauagaacuucgaauga

SEQ ID NO: 348575 - RNA, 19 nt, Homo sapiens
ggagggagaucuucauuuc

SEQ ID NO: 348576 - RNA, 19 nt, Homo sapiens
gaccauauccuuaaaugua

SEQ ID NO: 348577 - RNA, 19 nt, Homo sapiens
agaaagaccuucagcugua

SEQ ID NO: 348578 - RNA, 19 nt, Homo sapiens
ugacagagccaccggauua

SEQ ID NO: 348579 - RNA, 19 nt, Homo sapiens
gcaaugggaugcagcuauu

SEQ ID NO: 348580 - RNA, 19 nt, Homo sapiens
gcauacaucugaagaacaa

SEQ ID NO: 348581 - RNA, 19 nt, Homo sapiens
cagcuuaucuugcaaguga

SEQ ID NO: 348582 - RNA, 19 nt, Homo sapiens
uaaaggacauucaagcaaa

SEQ ID NO: 348583 - RNA, 19 nt, Homo sapiens
uaacguaugugaauagaug

SEQ ID NO: 348584 - RNA, 19 nt, Homo sapiens
gaagaacagugguaaugga

SEQ ID NO: 348585 - RNA, 19 nt, Homo sapiens
gaucauggcuauauguugu

SEQ ID NO: 348586 - RNA, 19 nt, Homo sapiens
ggagagcucuauuauguuc

SEQ ID NO: 348587 - RNA, 19 nt, Homo sapiens
gaaguuaggcgauuagaga

SEQ ID NO: 348588 - RNA, 19 nt, Homo sapiens
gaggagaucaguauuguaa

SEQ ID NO: 348589 - RNA, 19 nt, Homo sapiens
gauccaagcuugauuaagg

SEQ ID NO: 348590 - RNA, 19 nt, Homo sapiens
ggaagaaaguauuaaacga

SEQ ID NO: 348591 - RNA, 19 nt, Homo sapiens
gacaaaggcauucaucaua

SEQ ID NO: 348592 - RNA, 19 nt, Homo sapiens
acaauaaagucaugggaua

SEQ ID NO: 348593 - RNA, 19 nt, Homo sapiens
aaacagcucuaaaccauug

SEQ ID NO: 348594 - RNA, 19 nt, Homo sapiens
gaagaccucaagaaaguua

SEQ ID NO: 348595 - RNA, 19 nt, Homo sapiens
gcugaacgcaguauuguua

SEQ ID NO: 348596 - RNA, 19 nt, Homo sapiens
ugacauguauucugaaguu

SEQ ID NO: 348597 - RNA, 19 nt, Homo sapiens
gauggugcuuguugacuua

SEQ ID NO: 348598 - RNA, 19 nt, Homo sapiens
gaaacacagcucuggaaua

SEQ ID NO: 348599 - RNA, 19 nt, Homo sapiens
ggaaauccuucaacaaucu

SEQ ID NO: 348600 - RNA, 19 nt, Homo sapiens
ugaccuacuucucuuguua

SEQ ID NO: 348601 - RNA, 19 nt, Homo sapiens
ggacauccuuucagcaguu

SEQ ID NO: 348602 - RNA, 19 nt, Homo sapiens
uguuauagcucuagcagua

SEQ ID NO: 348603 - RNA, 19 nt, Homo sapiens
ccucucagcugaauaaaga

SEQ ID NO: 348604 - RNA, 19 nt, Homo sapiens
gaaacuauuugaccaugau

SEQ ID NO: 348605 - RNA, 19 nt, Homo sapiens
gcagauaauugaaggaaag

SEQ ID NO: 348606 - RNA, 19 nt, Homo sapiens
gcuauauguuguugagaua

SEQ ID NO: 348607 - RNA, 19 nt, Homo sapiens
ggaaagagcaugaugacau

SEQ ID NO: 348608 - RNA, 19 nt, Homo sapiens
ugaaagcauugaagcuaua

SEQ ID NO: 348609 - RNA, 19 nt, Homo sapiens
ucacuaagccuuuacuuug

SEQ ID NO: 348610 - RNA, 19 nt, Homo sapiens
ucacgaagcauuuaucauu

SEQ ID NO: 348611 - RNA, 19 nt, Homo sapiens
gcaguucucuucucugaca

SEQ ID NO: 348612 - RNA, 19 nt, Homo sapiens
cuugaaagcuagguauuua

SEQ ID NO: 348613 - RNA, 19 nt, Homo sapiens
uaauguggcuucuuucaug

SEQ ID NO: 348614 - RNA, 19 nt, Homo sapiens
gaaauuucaacccuucaua

SEQ ID NO: 348615 - RNA, 19 nt, Homo sapiens
guaugugucuguaguauuc

SEQ ID NO: 348616 - RNA, 19 nt, Homo sapiens
uuaaagagguauuggaaga

SEQ ID NO: 348617 - RNA, 19 nt, Homo sapiens
acaguaauguggcuucuuu

SEQ ID NO: 348618 - RNA, 19 nt, Homo sapiens
ccaagucaguaccagcuua

SEQ ID NO: 348619 - RNA, 19 nt, Homo sapiens
guacuaaagugacaaaucg

SEQ ID NO: 348620 - RNA, 19 nt, Homo sapiens
ggcaacaacuuacaaauac

SEQ ID NO: 348621 - RNA, 19 nt, Homo sapiens
gaagaccgauccauaucug

SEQ ID NO: 348622 - RNA, 19 nt, Homo sapiens
ugaccggaaugaacuauuu

SEQ ID NO: 348623 - RNA, 19 nt, Homo sapiens
caaugaaagcuuuagguua

SEQ ID NO: 348624 - RNA, 19 nt, Homo sapiens
ggaccuuagugaauauaaa

SEQ ID NO: 348625 - RNA, 19 nt, Homo sapiens
aaacugaaauucucuccaa

SEQ ID NO: 348626 - RNA, 19 nt, Homo sapiens
gcugguagaugcauaguca

SEQ ID NO: 348627 - RNA, 19 nt, Homo sapiens
cagcuuaccuauuugauuc

SEQ ID NO: 348628 - RNA, 19 nt, Homo sapiens
cggaagaccucaagaaagu

SEQ ID NO: 348629 - RNA, 19 nt, Homo sapiens
gcaucaaguuuauagaaga

SEQ ID NO: 348630 - RNA, 19 nt, Homo sapiens
gcacccagcuuaucuugca

SEQ ID NO: 348631 - RNA, 19 nt, Homo sapiens
ggaagaaucggacccaaga

SEQ ID NO: 348632 - RNA, 19 nt, Homo sapiens
ugaaauccuugaugaaguu

SEQ ID NO: 348633 - RNA, 19 nt, Homo sapiens
gcugauaguuucaaagcaa

SEQ ID NO: 348634 - RNA, 19 nt, Homo sapiens
gagaccauauccuuaaaug

SEQ ID NO: 348635 - RNA, 19 nt, Homo sapiens
ggaaauugaugaguauauc

SEQ ID NO: 348636 - RNA, 19 nt, Homo sapiens
guauguaucugaggaaaga

SEQ ID NO: 348637 - RNA, 19 nt, Homo sapiens
gauauugcccucuuuguau

SEQ ID NO: 348638 - RNA, 19 nt, Homo sapiens
gaaagaccuucagcuguau

SEQ ID NO: 348639 - RNA, 19 nt, Homo sapiens
guagauccaagcuugauua

SEQ ID NO: 348640 - RNA, 19 nt, Homo sapiens
uggagaagauguugaaaug

SEQ ID NO: 348641 - RNA, 19 nt, Homo sapiens
uaaagaggccguuaaggaa

SEQ ID NO: 348642 - RNA, 19 nt, Homo sapiens
cuacuucucuuguuagguu

SEQ ID NO: 348643 - RNA, 19 nt, Homo sapiens
aaaaguagguccagccuua

SEQ ID NO: 348644 - RNA, 19 nt, Homo sapiens
gaugacacguucuccaguu

SEQ ID NO: 348645 - RNA, 19 nt, Homo sapiens
caaaggcauucaucauaga

SEQ ID NO: 348646 - RNA, 19 nt, Homo sapiens
cagcaguucucuucucuga

SEQ ID NO: 348647 - RNA, 19 nt, Homo sapiens
cacauuacguguagauauu

SEQ ID NO: 348648 - RNA, 19 nt, Homo sapiens
guauggaaaugugcuuuaa

SEQ ID NO: 348649 - RNA, 19 nt, Homo sapiens
gaguaaacccugugucuug

SEQ ID NO: 348650 - RNA, 19 nt, Homo sapiens
gcauaacaauuacaacuac

SEQ ID NO: 348651 - RNA, 19 nt, Homo sapiens
aguaccagcuuaccuauuu

SEQ ID NO: 348652 - RNA, 19 nt, Homo sapiens
gggaugcagcuauuuauuu

SEQ ID NO: 348653 - RNA, 19 nt, Homo sapiens
ccaagugacuacaagaaau

SEQ ID NO: 348654 - RNA, 19 nt, Homo sapiens
cagagccgcuggccaauau

SEQ ID NO: 348655 - RNA, 19 nt, Homo sapiens
gauaugauaccggaccuua

SEQ ID NO: 348656 - RNA, 19 nt, Homo sapiens
gaagacugaacaacuguaa

SEQ ID NO: 348657 - RNA, 19 nt, Homo sapiens
uaucacaucccuuuguaua

SEQ ID NO: 348658 - RNA, 19 nt, Homo sapiens
guuaucacaucccuuugua

SEQ ID NO: 348659 - RNA, 19 nt, Homo sapiens
gcacagaugcgcugguaga

SEQ ID NO: 348660 - RNA, 19 nt, Homo sapiens
gaaagagcaugaugacaua

SEQ ID NO: 348661 - RNA, 19 nt, Homo sapiens
gaacagcucugaaagcauu

SEQ ID NO: 348662 - RNA, 19 nt, Homo sapiens
gagaagauguugaaaugua

SEQ ID NO: 348663 - RNA, 19 nt, Homo sapiens
gaggagagcucuauuaugu

SEQ ID NO: 348664 - RNA, 19 nt, Homo sapiens
gaggacagcuugaggguua

SEQ ID NO: 348665 - RNA, 19 nt, Homo sapiens
gaaacugaauggaagaaua

SEQ ID NO: 348666 - RNA, 19 nt, Homo sapiens
aaagaaggcuguaccguua

SEQ ID NO: 348667 - RNA, 19 nt, Homo sapiens
aaacacagcucuggaauaa

SEQ ID NO: 348668 - RNA, 19 nt, Homo sapiens
ggacaaagcucuguaugga

SEQ ID NO: 348669 - RNA, 19 nt, Homo sapiens
ggacaggagugaauagaaa

SEQ ID NO: 348670 - RNA, 19 nt, Homo sapiens
gaagaaauuugccuuggaa

SEQ ID NO: 348671 - RNA, 19 nt, Homo sapiens
cagaagaccuuguaaaguu

SEQ ID NO: 348672 - RNA, 19 nt, Homo sapiens
gaacaacuguaaauagaug

SEQ ID NO: 348673 - RNA, 19 nt, Homo sapiens
ugaggaagauuaaggauaa

SEQ ID NO: 348674 - RNA, 19 nt, Homo sapiens
gcaaugauguggucuuguu

SEQ ID NO: 348675 - RNA, 19 nt, Homo sapiens
gaaauagaacuucgaauga

SEQ ID NO: 348676 - RNA, 19 nt, Homo sapiens
ggagggagaucuucauuuc

SEQ ID NO: 348677 - RNA, 19 nt, Homo sapiens
gaccauauccuuaaaugua

SEQ ID NO: 348678 - RNA, 19 nt, Homo sapiens
agaaagaccuucagcugua

SEQ ID NO: 348679 - RNA, 19 nt, Homo sapiens
ugacagagccaccggauua

SEQ ID NO: 348680 - RNA, 19 nt, Homo sapiens
gcaaugggaugcagcuauu

SEQ ID NO: 348681 - RNA, 19 nt, Homo sapiens
gcauacaucugaagaacaa

SEQ ID NO: 348682 - RNA, 19 nt, Homo sapiens
cagcuuaucuugcaaguga

SEQ ID NO: 348683 - RNA, 19 nt, Homo sapiens
uaaaggacauucaagcaaa

SEQ ID NO: 348684 - RNA, 19 nt, Homo sapiens
gaaaagcccuuccuaauuc

SEQ ID NO: 348685 - RNA, 19 nt, Homo sapiens
uaacguaugugaauagaug

SEQ ID NO: 348686 - RNA, 19 nt, Homo sapiens
gaagaacagugguaaugga

SEQ ID NO: 348687 - RNA, 19 nt, Homo sapiens
gaucauggcuauauguugu

SEQ ID NO: 348688 - RNA, 19 nt, Homo sapiens
ggagagcucuauuauguuc

SEQ ID NO: 348689 - RNA, 19 nt, Homo sapiens
gaaguuaggcgauuagaga

SEQ ID NO: 348690 - RNA, 19 nt, Homo sapiens
gaggagaucaguauuguaa

SEQ ID NO: 348691 - RNA, 19 nt, Homo sapiens
gauccaagcuugauuaagg

SEQ ID NO: 348692 - RNA, 19 nt, Homo sapiens
ggaagaaaguauuaaacga

SEQ ID NO: 348693 - RNA, 19 nt, Homo sapiens
gacaaaggcauucaucaua

SEQ ID NO: 348694 - RNA, 19 nt, Homo sapiens
acaauaaagucaugggaua

SEQ ID NO: 348695 - RNA, 19 nt, Homo sapiens
aaacagcucuaaaccauug

SEQ ID NO: 348696 - RNA, 19 nt, Homo sapiens
gaagaccucaagaaaguua

SEQ ID NO: 348697 - RNA, 19 nt, Homo sapiens
gcugaacgcaguauuguua

SEQ ID NO: 348698 - RNA, 19 nt, Homo sapiens
ugacauguauucugaaguu

SEQ ID NO: 348699 - RNA, 19 nt, Homo sapiens
gauggugcuuguugacuua

SEQ ID NO: 348700 - RNA, 19 nt, Homo sapiens
ggaaauccuucaacaaucu

SEQ ID NO: 348701 - RNA, 19 nt, Homo sapiens
gaaacacagcucuggaaua

SEQ ID NO: 348702 - RNA, 19 nt, Homo sapiens
ggacauccuuucagcaguu

SEQ ID NO: 348703 - RNA, 19 nt, Homo sapiens
uguuauagcucuagcagua

SEQ ID NO: 348704 - RNA, 19 nt, Homo sapiens
ccucucagcugaauaaaga

SEQ ID NO: 348705 - RNA, 19 nt, Homo sapiens
gaaacuauuugaccaugau

SEQ ID NO: 348706 - RNA, 19 nt, Homo sapiens
gcagauaauugaaggaaag

SEQ ID NO: 348707 - RNA, 19 nt, Homo sapiens
gcuauauguuguugagaua

SEQ ID NO: 348708 - RNA, 19 nt, Homo sapiens
ggaaagagcaugaugacau

SEQ ID NO: 348709 - RNA, 19 nt, Homo sapiens
ugaaagcauugaagcuaua

SEQ ID NO: 348710 - RNA, 19 nt, Homo sapiens
agaagaccuuguaaaguua

SEQ ID NO: 348711 - RNA, 19 nt, Homo sapiens
ucacuaagccuuuacuuug

SEQ ID NO: 348712 - RNA, 19 nt, Homo sapiens
ucacgaagcauuuaucauu

SEQ ID NO: 348713 - RNA, 19 nt, Homo sapiens
gcaguucucuucucugaca

SEQ ID NO: 348714 - RNA, 19 nt, Homo sapiens
cuugaaagcuagguauuua

SEQ ID NO: 348715 - RNA, 19 nt, Homo sapiens
uaauguggcuucuuucaug

SEQ ID NO: 348716 - RNA, 19 nt, Homo sapiens
gaaauuucaacccuucaua

SEQ ID NO: 348717 - RNA, 19 nt, Homo sapiens
guaugugucuguaguauuc

SEQ ID NO: 348718 - RNA, 19 nt, Homo sapiens
uuaaagagguauuggaaga

SEQ ID NO: 348719 - RNA, 19 nt, Homo sapiens
acaguaauguggcuucuuu

SEQ ID NO: 348720 - RNA, 19 nt, Homo sapiens
ccaagucaguaccagcuua

SEQ ID NO: 348721 - RNA, 19 nt, Homo sapiens
guacuaaagugacaaaucg

SEQ ID NO: 348722 - RNA, 19 nt, Homo sapiens
ggcaacaacuuacaaauac

SEQ ID NO: 348723 - RNA, 19 nt, Homo sapiens
gaagaccgauccauaucug

SEQ ID NO: 348724 - RNA, 19 nt, Homo sapiens
ugaccggaaugaacuauuu

SEQ ID NO: 348725 - RNA, 19 nt, Homo sapiens
caaugaaagcuuuagguua

SEQ ID NO: 348726 - RNA, 19 nt, Homo sapiens
ggaccuuagugaauauaaa

SEQ ID NO: 348727 - RNA, 19 nt, Homo sapiens
aaacugaaauucucuccaa

SEQ ID NO: 348728 - RNA, 19 nt, Homo sapiens
gcugguagaugcauaguca

SEQ ID NO: 348729 - RNA, 19 nt, Homo sapiens
cagcuuaccuauuugauuc

SEQ ID NO: 348730 - RNA, 19 nt, Homo sapiens
cggaagaccucaagaaagu

SEQ ID NO: 348731 - RNA, 19 nt, Homo sapiens
gcaucaaguuuauagaaga

SEQ ID NO: 348732 - RNA, 19 nt, Homo sapiens
gcacccagcuuaucuugca

SEQ ID NO: 348733 - RNA, 19 nt, Homo sapiens
ggaagaaucggacccaaga

SEQ ID NO: 348734 - RNA, 19 nt, Homo sapiens
ugaaauccuugaugaaguu

SEQ ID NO: 348735 - RNA, 19 nt, Homo sapiens
gcugauaguuucaaagcaa

SEQ ID NO: 348736 - RNA, 19 nt, Homo sapiens
gagaccauauccuuaaaug

SEQ ID NO: 348737 - RNA, 19 nt, Homo sapiens
ggaaauugaugaguauauc

SEQ ID NO: 348738 - RNA, 19 nt, Homo sapiens
guauguaucugaggaaaga

SEQ ID NO: 348739 - RNA, 19 nt, Homo sapiens
gauauugcccucuuuguau

SEQ ID NO: 348740 - RNA, 19 nt, Homo sapiens
gaaagaccuucagcuguau

SEQ ID NO: 348741 - RNA, 19 nt, Homo sapiens
guagauccaagcuugauua

SEQ ID NO: 348742 - RNA, 19 nt, Homo sapiens
uggagaagauguugaaaug

SEQ ID NO: 348743 - RNA, 19 nt, Homo sapiens
uaaagaggccguuaaggaa

SEQ ID NO: 348744 - RNA, 19 nt, Homo sapiens
aaaaguagguccagccuua

SEQ ID NO: 348745 - RNA, 19 nt, Homo sapiens
gaugacacguucuccaguu

SEQ ID NO: 348746 - RNA, 19 nt, Homo sapiens
cagcaguucucuucucuga

SEQ ID NO: 348747 - RNA, 19 nt, Homo sapiens
caaaggcauucaucauaga

SEQ ID NO: 348748 - RNA, 19 nt, Homo sapiens
cacauuacguguagauauu

SEQ ID NO: 348749 - RNA, 19 nt, Homo sapiens
guauggaaaugugcuuuaa

SEQ ID NO: 348750 - RNA, 19 nt, Homo sapiens
gaguaaacccugugucuug

SEQ ID NO: 348751 - RNA, 19 nt, Homo sapiens
gcauaacaauuacaacuac

SEQ ID NO: 348752 - RNA, 19 nt, Homo sapiens
aguaccagcuuaccuauuu

SEQ ID NO: 348753 - RNA, 19 nt, Homo sapiens
gggaugcagcuauuuauuu

SEQ ID NO: 348754 - RNA, 19 nt, Homo sapiens
ccaagugacuacaagaaau

SEQ ID NO: 348755 - RNA, 19 nt, Homo sapiens
cagagccgcuggccaauau

SEQ ID NO: 348756 - RNA, 19 nt, Homo sapiens
gcaccagacuuugacaaga

SEQ ID NO: 348757 - RNA, 19 nt, Homo sapiens
gauaugauaccggaccuua

SEQ ID NO: 348758 - RNA, 19 nt, Homo sapiens
gaagacugaacaacuguaa

SEQ ID NO: 348759 - RNA, 19 nt, Homo sapiens
uaucacaucccuuuguaua

SEQ ID NO: 348760 - RNA, 19 nt, Homo sapiens
gaaagagcaugaugacaua

SEQ ID NO: 348761 - RNA, 19 nt, Homo sapiens
gaacagcucugaaagcauu

SEQ ID NO: 348762 - RNA, 19 nt, Homo sapiens
gagaagauguugaaaugua

SEQ ID NO: 348763 - RNA, 19 nt, Homo sapiens
gaggagagcucuauuaugu

SEQ ID NO: 348764 - RNA, 19 nt, Homo sapiens
gaggacagcuugaggguua

SEQ ID NO: 348765 - RNA, 19 nt, Homo sapiens
gaaacugaauggaagaaua

SEQ ID NO: 348766 - RNA, 19 nt, Homo sapiens
aaagaaggcuguaccguua

SEQ ID NO: 348767 - RNA, 19 nt, Homo sapiens
aaacacagcucuggaauaa

SEQ ID NO: 348768 - RNA, 19 nt, Homo sapiens
ggacaaagcucuguaugga

SEQ ID NO: 348769 - RNA, 19 nt, Homo sapiens
ggacaggagugaauagaaa

SEQ ID NO: 348770 - RNA, 19 nt, Homo sapiens
gaagaaauuugccuuggaa

SEQ ID NO: 348771 - RNA, 19 nt, Homo sapiens
cagaagaccuuguaaaguu

SEQ ID NO: 348772 - RNA, 19 nt, Homo sapiens
gaacaacuguaaauagaug

SEQ ID NO: 348773 - RNA, 19 nt, Homo sapiens
ugaggaagauuaaggauaa

SEQ ID NO: 348774 - RNA, 19 nt, Homo sapiens
gcaaugauguggucuuguu

SEQ ID NO: 348775 - RNA, 19 nt, Homo sapiens
gaaauagaacuucgaauga

SEQ ID NO: 348776 - RNA, 19 nt, Homo sapiens
ggagggagaucuucauuuc

SEQ ID NO: 348777 - RNA, 19 nt, Homo sapiens
gaccauauccuuaaaugua

SEQ ID NO: 348778 - RNA, 19 nt, Homo sapiens
agaaagaccuucagcugua

SEQ ID NO: 348779 - RNA, 19 nt, Homo sapiens
ugacagagccaccggauua

SEQ ID NO: 348780 - RNA, 19 nt, Homo sapiens
gcaaugggaugcagcuauu

SEQ ID NO: 348781 - RNA, 19 nt, Homo sapiens
gcauacaucugaagaacaa

SEQ ID NO: 348782 - RNA, 19 nt, Homo sapiens
cagcuuaucuugcaaguga

SEQ ID NO: 348783 - RNA, 19 nt, Homo sapiens
uaaaggacauucaagcaaa

SEQ ID NO: 348784 - RNA, 19 nt, Homo sapiens
gaaaagcccuuccuaauuc

SEQ ID NO: 348785 - RNA, 19 nt, Homo sapiens
uaacguaugugaauagaug

SEQ ID NO: 348786 - RNA, 19 nt, Homo sapiens
gaagaacagugguaaugga

SEQ ID NO: 348787 - RNA, 19 nt, Homo sapiens
gaucauggcuauauguugu

SEQ ID NO: 348788 - RNA, 19 nt, Homo sapiens
ggagagcucuauuauguuc

SEQ ID NO: 348789 - RNA, 19 nt, Homo sapiens
gaaguuaggcgauuagaga

SEQ ID NO: 348790 - RNA, 19 nt, Homo sapiens
gaggagaucaguauuguaa

SEQ ID NO: 348791 - RNA, 19 nt, Homo sapiens
gauccaagcuugauuaagg

SEQ ID NO: 348792 - RNA, 19 nt, Homo sapiens
ggaagaaaguauuaaacga

SEQ ID NO: 348793 - RNA, 19 nt, Homo sapiens
gacaaaggcauucaucaua

SEQ ID NO: 348794 - RNA, 19 nt, Homo sapiens
acaauaaagucaugggaua

SEQ ID NO: 348795 - RNA, 19 nt, Homo sapiens
aaacagcucuaaaccauug

SEQ ID NO: 348796 - RNA, 19 nt, Homo sapiens
gaagaccucaagaaaguua

SEQ ID NO: 348797 - RNA, 19 nt, Homo sapiens
gcugaacgcaguauuguua

SEQ ID NO: 348798 - RNA, 19 nt, Homo sapiens
ugacauguauucugaaguu

SEQ ID NO: 348799 - RNA, 19 nt, Homo sapiens
gauggugcuuguugacuua

SEQ ID NO: 348800 - RNA, 19 nt, Homo sapiens
ggaaauccuucaacaaucu

SEQ ID NO: 348801 - RNA, 19 nt, Homo sapiens
gaaacacagcucuggaaua

SEQ ID NO: 348802 - RNA, 19 nt, Homo sapiens
ugaccuacuucucuuguua

SEQ ID NO: 348803 - RNA, 19 nt, Homo sapiens
ggacauccuuucagcaguu

SEQ ID NO: 348804 - RNA, 19 nt, Homo sapiens
uguuauagcucuagcagua

SEQ ID NO: 348805 - RNA, 19 nt, Homo sapiens
ccucucagcugaauaaaga

SEQ ID NO: 348806 - RNA, 19 nt, Homo sapiens
gaaacuauuugaccaugau

SEQ ID NO: 348807 - RNA, 19 nt, Homo sapiens
gcagauaauugaaggaaag

SEQ ID NO: 348808 - RNA, 19 nt, Homo sapiens
gcuauauguuguugagaua

SEQ ID NO: 348809 - RNA, 19 nt, Homo sapiens
ggaaagagcaugaugacau

SEQ ID NO: 348810 - RNA, 19 nt, Homo sapiens
ugaaagcauugaagcuaua

SEQ ID NO: 348811 - RNA, 19 nt, Homo sapiens
agaagaccuuguaaaguua

SEQ ID NO: 348812 - RNA, 19 nt, Homo sapiens
ucacgaagcauuuaucauu

SEQ ID NO: 348813 - RNA, 19 nt, Homo sapiens
ucacuaagccuuuacuuug

SEQ ID NO: 348814 - RNA, 19 nt, Homo sapiens
gcaguucucuucucugaca

SEQ ID NO: 348815 - RNA, 19 nt, Homo sapiens
cuugaaagcuagguauuua

SEQ ID NO: 348816 - RNA, 19 nt, Homo sapiens
uaauguggcuucuuucaug

SEQ ID NO: 348817 - RNA, 19 nt, Homo sapiens
gaaauuucaacccuucaua

SEQ ID NO: 348818 - RNA, 19 nt, Homo sapiens
guaugugucuguaguauuc

SEQ ID NO: 348819 - RNA, 19 nt, Homo sapiens
uuaaagagguauuggaaga

SEQ ID NO: 348820 - RNA, 19 nt, Homo sapiens
acaguaauguggcuucuuu

SEQ ID NO: 348821 - RNA, 19 nt, Homo sapiens
ccaagucaguaccagcuua

SEQ ID NO: 348822 - RNA, 19 nt, Homo sapiens
guacuaaagugacaaaucg

SEQ ID NO: 348823 - RNA, 19 nt, Homo sapiens
ggcaacaacuuacaaauac

SEQ ID NO: 348824 - RNA, 19 nt, Homo sapiens
gaagaccgauccauaucug

SEQ ID NO: 348825 - RNA, 19 nt, Homo sapiens
ugaccggaaugaacuauuu

SEQ ID NO: 348826 - RNA, 19 nt, Homo sapiens
caaugaaagcuuuagguua

SEQ ID NO: 348827 - RNA, 19 nt, Homo sapiens
ggaccuuagugaauauaaa

SEQ ID NO: 348828 - RNA, 19 nt, Homo sapiens
aaacugaaauucucuccaa

SEQ ID NO: 348829 - RNA, 19 nt, Homo sapiens
gcugguagaugcauaguca

SEQ ID NO: 348830 - RNA, 19 nt, Homo sapiens
cagcuuaccuauuugauuc

SEQ ID NO: 348831 - RNA, 19 nt, Homo sapiens
cggaagaccucaagaaagu

SEQ ID NO: 348832 - RNA, 19 nt, Homo sapiens
gcaucaaguuuauagaaga

SEQ ID NO: 348833 - RNA, 19 nt, Homo sapiens
gcacccagcuuaucuugca

SEQ ID NO: 348834 - RNA, 19 nt, Homo sapiens
ggaagaaucggacccaaga

SEQ ID NO: 348835 - RNA, 19 nt, Homo sapiens
ugaaauccuugaugaaguu

SEQ ID NO: 348836 - RNA, 19 nt, Homo sapiens
gcugauaguuucaaagcaa

SEQ ID NO: 348837 - RNA, 19 nt, Homo sapiens
gagaccauauccuuaaaug

SEQ ID NO: 348838 - RNA, 19 nt, Homo sapiens
ggaaauugaugaguauauc

SEQ ID NO: 348839 - RNA, 19 nt, Homo sapiens
guauguaucugaggaaaga

SEQ ID NO: 348840 - RNA, 19 nt, Homo sapiens
gauauugcccucuuuguau

SEQ ID NO: 348841 - RNA, 19 nt, Homo sapiens
gaaagaccuucagcuguau

SEQ ID NO: 348842 - RNA, 19 nt, Homo sapiens
guagauccaagcuugauua

SEQ ID NO: 348843 - RNA, 19 nt, Homo sapiens
uggagaagauguugaaaug

SEQ ID NO: 348844 - RNA, 19 nt, Homo sapiens
uaaagaggccguuaaggaa

SEQ ID NO: 348845 - RNA, 19 nt, Homo sapiens
cuacuucucuuguuagguu

SEQ ID NO: 348846 - RNA, 19 nt, Homo sapiens
aaaaguagguccagccuua

SEQ ID NO: 348847 - RNA, 19 nt, Homo sapiens
gaugacacguucuccaguu

SEQ ID NO: 348848 - RNA, 19 nt, Homo sapiens
caaaggcauucaucauaga

SEQ ID NO: 348849 - RNA, 19 nt, Homo sapiens
cagcaguucucuucucuga

SEQ ID NO: 348850 - RNA, 19 nt, Homo sapiens
cacauuacguguagauauu

SEQ ID NO: 348851 - RNA, 19 nt, Homo sapiens
guauggaaaugugcuuuaa

SEQ ID NO: 348852 - RNA, 19 nt, Homo sapiens
gaguaaacccugugucuug

SEQ ID NO: 348853 - RNA, 19 nt, Homo sapiens
gcauaacaauuacaacuac

SEQ ID NO: 348854 - RNA, 19 nt, Homo sapiens
aguaccagcuuaccuauuu

SEQ ID NO: 348855 - RNA, 19 nt, Homo sapiens
gggaugcagcuauuuauuu

SEQ ID NO: 348856 - RNA, 19 nt, Homo sapiens
ccaagugacuacaagaaau

SEQ ID NO: 348857 - RNA, 19 nt, Homo sapiens
cagagccgcuggccaauau

SEQ ID NO: 348858 - RNA, 19 nt, Homo sapiens
gcaccagacuuugacaaga

SEQ ID NO: 348859 - RNA, 19 nt, Homo sapiens
gauaugauaccggaccuua

SEQ ID NO: 348860 - RNA, 19 nt, Homo sapiens
agacacaacuugacuuaua

SEQ ID NO: 348861 - RNA, 19 nt, Homo sapiens
ccaacgaucucacagguua

SEQ ID NO: 348862 - RNA, 19 nt, Homo sapiens
caagcuaucuaucaaagua

SEQ ID NO: 348863 - RNA, 19 nt, Homo sapiens
gaagacacaacuugacuua

SEQ ID NO: 348864 - RNA, 19 nt, Homo sapiens
auagguggcugauuuauuu

SEQ ID NO: 348865 - RNA, 19 nt, Homo sapiens
gcaugaaacccaacacuaa

SEQ ID NO: 348866 - RNA, 19 nt, Homo sapiens
ggagaucucugacaucaag

SEQ ID NO: 348867 - RNA, 19 nt, Homo sapiens
uaacagauaggccaaagua

SEQ ID NO: 348868 - RNA, 19 nt, Homo sapiens
caaaguaaugguacaguua

SEQ ID NO: 348869 - RNA, 19 nt, Homo sapiens
gacacaacuugacuuauaa

SEQ ID NO: 348870 - RNA, 19 nt, Homo sapiens
uaaacuauccucccuauau

SEQ ID NO: 348871 - RNA, 19 nt, Homo sapiens
acacaacacugcaaacaga

SEQ ID NO: 348872 - RNA, 19 nt, Homo sapiens
gcagagauuugaaguuugg

SEQ ID NO: 348873 - RNA, 19 nt, Homo sapiens
uuacccaucuacucaaaua

SEQ ID NO: 348874 - RNA, 19 nt, Homo sapiens
gcaaguuccuccucagauc

SEQ ID NO: 348875 - RNA, 19 nt, Homo sapiens
ggacucauccagcaaaguu

SEQ ID NO: 348876 - RNA, 19 nt, Homo sapiens
cugcagagauuugaaguuu

SEQ ID NO: 348877 - RNA, 19 nt, Homo sapiens
gaaacccaacacuaaauuu

SEQ ID NO: 348878 - RNA, 19 nt, Homo sapiens
ggaagcagaucagccuaga

SEQ ID NO: 348879 - RNA, 19 nt, Homo sapiens
gaauaucuccucagacauc

SEQ ID NO: 348880 - RNA, 19 nt, Homo sapiens
gggacacuauccuacuaua

SEQ ID NO: 348881 - RNA, 19 nt, Homo sapiens
guaggauaaucauucauug

SEQ ID NO: 348882 - RNA, 19 nt, Homo sapiens
gaaggacucauccagcaaa

SEQ ID NO: 348883 - RNA, 19 nt, Homo sapiens
ucauaaacgugauugauag

SEQ ID NO: 348884 - RNA, 19 nt, Homo sapiens
gacagacaaucaucccaaa

SEQ ID NO: 348885 - RNA, 19 nt, Homo sapiens
ucaaaguaaugguacaguu

SEQ ID NO: 348886 - RNA, 19 nt, Homo sapiens
ccacuggucuggauggaau

SEQ ID NO: 348887 - RNA, 19 nt, Homo sapiens
gaccugcccugccucaguu

SEQ ID NO: 348888 - RNA, 19 nt, Homo sapiens
gaacuucaccagcucuuca

SEQ ID NO: 348889 - RNA, 19 nt, Homo sapiens
uaaacacccugaagacaca

SEQ ID NO: 348890 - RNA, 19 nt, Homo sapiens
ccacagagaggaugagaau

SEQ ID NO: 348891 - RNA, 19 nt, Homo sapiens
uugagcaacugacuuaauu

SEQ ID NO: 348892 - RNA, 19 nt, Homo sapiens
auugauagguggcugauuu

SEQ ID NO: 348893 - RNA, 19 nt, Homo sapiens
cauuaggguucacgucuuu

SEQ ID NO: 348894 - RNA, 19 nt, Homo sapiens
ucacagacuuuaaucuaca

SEQ ID NO: 348895 - RNA, 19 nt, Homo sapiens
guacaugucaggaaccuau

SEQ ID NO: 348896 - RNA, 19 nt, Homo sapiens
gcaagcuaaugaucaguca

SEQ ID NO: 348897 - RNA, 19 nt, Homo sapiens
gggagacacuaacagauag

SEQ ID NO: 348898 - RNA, 19 nt, Homo sapiens
ccaccugucuuccucucua

SEQ ID NO: 348899 - RNA, 19 nt, Homo sapiens
acauccaaguguccuauua

SEQ ID NO: 348900 - RNA, 19 nt, Homo sapiens
ggccagggcuuuguaagug

SEQ ID NO: 348901 - RNA, 19 nt, Homo sapiens
gcacuugauuaacacaaca

SEQ ID NO: 348902 - RNA, 19 nt, Homo sapiens
uaacacuccuuucuauucu

SEQ ID NO: 348903 - RNA, 19 nt, Homo sapiens
gauagguggcugauuuauu

SEQ ID NO: 348904 - RNA, 19 nt, Homo sapiens
gaaauccuagguccucuga

SEQ ID NO: 348905 - RNA, 19 nt, Homo sapiens
gcaacugacuuaauuuuca

SEQ ID NO: 348906 - RNA, 19 nt, Homo sapiens
gaaugaggauugaaaacaa

SEQ ID NO: 348907 - RNA, 19 nt, Homo sapiens
caaguguccuauuaucugu

SEQ ID NO: 348908 - RNA, 19 nt, Homo sapiens
gauggaaugaggauugaaa

SEQ ID NO: 348909 - RNA, 19 nt, Homo sapiens
aaacuauccucccuauauc

SEQ ID NO: 348910 - RNA, 19 nt, Homo sapiens
ggaaggccagggcuuugua

SEQ ID NO: 348911 - RNA, 19 nt, Homo sapiens
ucaugaauaucuccucaga

SEQ ID NO: 348912 - RNA, 19 nt, Homo sapiens
gcacugugguuuuccuuuu

SEQ ID NO: 348913 - RNA, 19 nt, Homo sapiens
gaucagucacucacuauuc

SEQ ID NO: 348914 - RNA, 19 nt, Homo sapiens
caagggagacacuaacaga

SEQ ID NO: 348915 - RNA, 19 nt, Homo sapiens
gaucucacagguuaacaaa

SEQ ID NO: 348916 - RNA, 19 nt, Homo sapiens
ccaaagcuauggacaacgu

SEQ ID NO: 348917 - RNA, 19 nt, Homo sapiens
gcauguccacucugacuuu

SEQ ID NO: 348918 - RNA, 19 nt, Homo sapiens
cauagacccucgugugauc

SEQ ID NO: 348919 - RNA, 19 nt, Homo sapiens
ccucuuagcccacuucuuc

SEQ ID NO: 348920 - RNA, 19 nt, Homo sapiens
guucugguuuaaucuguuu

SEQ ID NO: 348921 - RNA, 19 nt, Homo sapiens
gaaggccagggcuuuguaa

SEQ ID NO: 348922 - RNA, 19 nt, Homo sapiens
ucaauacaccaacccagua

SEQ ID NO: 348923 - RNA, 19 nt, Homo sapiens
caccagcucuucagguuca

SEQ ID NO: 348924 - RNA, 19 nt, Homo sapiens
gauggaggccaauuacaug

SEQ ID NO: 348925 - RNA, 19 nt, Homo sapiens
acacaucugucucugcaau

SEQ ID NO: 348926 - RNA, 19 nt, Homo sapiens
aagcagaucagccuagaaa

SEQ ID NO: 348927 - RNA, 19 nt, Homo sapiens
cuagcaaucuauuuacugu

SEQ ID NO: 348928 - RNA, 19 nt, Homo sapiens
caugaaacccaacacuaaa

SEQ ID NO: 348929 - RNA, 19 nt, Homo sapiens
ggacacuauccuacuauau

SEQ ID NO: 348930 - RNA, 19 nt, Homo sapiens
ucucauaucacagacuuua

SEQ ID NO: 348931 - RNA, 19 nt, Homo sapiens
ugacacaguuuccucugau

SEQ ID NO: 348932 - RNA, 19 nt, Homo sapiens
ucucaacccuucaagaaag

SEQ ID NO: 348933 - RNA, 19 nt, Homo sapiens
aaugaucagucacucacua

SEQ ID NO: 348934 - RNA, 19 nt, Homo sapiens
cccacuguauucauuuaua

SEQ ID NO: 348935 - RNA, 19 nt, Homo sapiens
cuacuacucacuaucaauu

SEQ ID NO: 348936 - RNA, 19 nt, Homo sapiens
acaauaaacacccugaaga

SEQ ID NO: 348937 - RNA, 19 nt, Homo sapiens
caaggaaggccagggcuuu

SEQ ID NO: 348938 - RNA, 19 nt, Homo sapiens
ggauguguaugacgaaggu

SEQ ID NO: 348939 - RNA, 19 nt, Homo sapiens
gaagggagaaagugucagu

SEQ ID NO: 348940 - RNA, 19 nt, Homo sapiens
gaaagccaacgaucucaca

SEQ ID NO: 348941 - RNA, 19 nt, Homo sapiens
cagcagacauuggcaucuu

SEQ ID NO: 348942 - RNA, 19 nt, Homo sapiens
gucuaacacuccuuucuau

SEQ ID NO: 348943 - RNA, 19 nt, Homo sapiens
ggccgcauguccacucuga

SEQ ID NO: 348944 - RNA, 19 nt, Homo sapiens
uguaaacuauccucccuau

SEQ ID NO: 348945 - RNA, 19 nt, Homo sapiens
gucccggguucaccuaaua

SEQ ID NO: 348946 - RNA, 19 nt, Homo sapiens
caaagcagacccagcauac

SEQ ID NO: 348947 - RNA, 19 nt, Homo sapiens
gacacuauccuacuauauc

SEQ ID NO: 348948 - RNA, 19 nt, Homo sapiens
uaugggaacuauacuugug

SEQ ID NO: 348949 - RNA, 19 nt, Homo sapiens
augaauaucuccucagaca

SEQ ID NO: 348950 - RNA, 19 nt, Homo sapiens
cuccucagaucaugaauau

SEQ ID NO: 348951 - RNA, 19 nt, Homo sapiens
caagagcugagccaccuuu

SEQ ID NO: 348952 - RNA, 19 nt, Homo sapiens
ucaaagcagacccagcaua

SEQ ID NO: 348953 - RNA, 19 nt, Homo sapiens
gugaucauccuggucaaua

SEQ ID NO: 348954 - RNA, 19 nt, Homo sapiens
gugacacaguuuccucuga

SEQ ID NO: 348955 - RNA, 19 nt, Homo sapiens
caacucugguauuuguuuc

SEQ ID NO: 348956 - RNA, 19 nt, Homo sapiens
ugaaacccaacacuaaauu

SEQ ID NO: 348957 - RNA, 19 nt, Homo sapiens
auugacaacucugguauuu

SEQ ID NO: 348958 - RNA, 19 nt, Homo sapiens
cuaacacuccuuucuauuc

SEQ ID NO: 348959 - RNA, 19 nt, Homo sapiens
guccuauuaucugugauua

SEQ ID NO: 348960 - RNA, 19 nt, Homo sapiens
aaagaaaggugcaaaguuu

SEQ ID NO: 348961 - RNA, 19 nt, Homo sapiens
gaaacgguaugacuuaauu

SEQ ID NO: 348962 - RNA, 19 nt, Homo sapiens
gagcugcccuccuggauuu

SEQ ID NO: 348963 - RNA, 19 nt, Homo sapiens
gcaaggagcugcaguacgu

SEQ ID NO: 348964 - RNA, 19 nt, Homo sapiens
cuacaaaguuuacgccuaa

SEQ ID NO: 348965 - RNA, 19 nt, Homo sapiens
ggacuaacaucuccuccaa

SEQ ID NO: 348966 - RNA, 19 nt, Homo sapiens
ucaagaagaucauccaaga

SEQ ID NO: 348967 - RNA, 19 nt, Homo sapiens
caacacagcucacaagaac

SEQ ID NO: 348968 - RNA, 19 nt, Homo sapiens
gggaaugucuaacuuaaau

SEQ ID NO: 348969 - RNA, 19 nt, Homo sapiens
uaacaucuccuccaauaaa

SEQ ID NO: 348970 - RNA, 19 nt, Homo sapiens
aaacaacacuguacagcaa

SEQ ID NO: 348971 - RNA, 19 nt, Homo sapiens
ggaccacaaugaacaaguu

SEQ ID NO: 348972 - RNA, 19 nt, Homo sapiens
aaagaaacgguaugacuua

SEQ ID NO: 348973 - RNA, 19 nt, Homo sapiens
acuaacaucuccuccaaua

SEQ ID NO: 348974 - RNA, 19 nt, Homo sapiens
gauauugaccucugugaaa

SEQ ID NO: 348975 - RNA, 19 nt, Homo sapiens
ucuaauagguacugccaua

SEQ ID NO: 348976 - RNA, 19 nt, Homo sapiens
gaagaucauccaagauauu

SEQ ID NO: 348977 - RNA, 19 nt, Homo sapiens
gagauagaguucugcuuga

SEQ ID NO: 348978 - RNA, 19 nt, Homo sapiens
gaguucugcuugaaacaua

SEQ ID NO: 348979 - RNA, 19 nt, Homo sapiens
uaaagaagaccaucagguu

SEQ ID NO: 348980 - RNA, 19 nt, Homo sapiens
aauauuagaugcucugaga

SEQ ID NO: 348981 - RNA, 19 nt, Homo sapiens
gcacuaaagcacucaaaga

SEQ ID NO: 348982 - RNA, 19 nt, Homo sapiens
cuucacagcuucacaaugu

SEQ ID NO: 348983 - RNA, 19 nt, Homo sapiens
cuucguagcuugauggaaa

SEQ ID NO: 348984 - RNA, 19 nt, Homo sapiens
gauggguucuucucaaaug

SEQ ID NO: 348985 - RNA, 19 nt, Homo sapiens
aagaagaucauccaagaua

SEQ ID NO: 348986 - RNA, 19 nt, Homo sapiens
gaaacuaugauguggagaa

SEQ ID NO: 348987 - RNA, 19 nt, Homo sapiens
gcuuugagauuucagcuau

SEQ ID NO: 348988 - RNA, 19 nt, Homo sapiens
caagauauagucaagaaga

SEQ ID NO: 348989 - RNA, 19 nt, Homo sapiens
cagauggguucuucucaaa

SEQ ID NO: 348990 - RNA, 19 nt, Homo sapiens
uagaugcucugagaaauug

SEQ ID NO: 348991 - RNA, 19 nt, Homo sapiens
aaacguuuccuccaaagua

SEQ ID NO: 348992 - RNA, 19 nt, Homo sapiens
uaaagaaacgguaugacuu

SEQ ID NO: 348993 - RNA, 19 nt, Homo sapiens
ggagaaaggacuaacaucu

SEQ ID NO: 348994 - RNA, 19 nt, Homo sapiens
uggaaaguuuguagcauuu

SEQ ID NO: 348995 - RNA, 19 nt, Homo sapiens
ccagauggguucuucucaa

SEQ ID NO: 348996 - RNA, 19 nt, Homo sapiens
cagcuaugcuagaggcuuu

SEQ ID NO: 348997 - RNA, 19 nt, Homo sapiens
aaacuaugauguggagaaa

SEQ ID NO: 348998 - RNA, 19 nt, Homo sapiens
gcuagaggcuuuuauuaga

SEQ ID NO: 348999 - RNA, 19 nt, Homo sapiens
guaaccagguccaaucagu

SEQ ID NO: 349000 - RNA, 19 nt, Homo sapiens
gcaacacagcucacaagaa

SEQ ID NO: 349001 - RNA, 19 nt, Homo sapiens
ccaaaguaccuucauuaug

SEQ ID NO: 349002 - RNA, 19 nt, Homo sapiens
caaaguaaacgcagagagu

SEQ ID NO: 349003 - RNA, 19 nt, Homo sapiens
uaacuggcuuagugucuug

SEQ ID NO: 349004 - RNA, 19 nt, Homo sapiens
gaaaugcaacacacgacaa

SEQ ID NO: 349005 - RNA, 19 nt, Homo sapiens
gcuucacaauguacaaauu

SEQ ID NO: 349006 - RNA, 19 nt, Homo sapiens
caacacacgacaacauaug

SEQ ID NO: 349007 - RNA, 19 nt, Homo sapiens
gccgggacgcuauauauaa

SEQ ID NO: 349008 - RNA, 19 nt, Homo sapiens
gauagaguucugcuugaaa

SEQ ID NO: 349009 - RNA, 19 nt, Homo sapiens
caucagcuguugugugaca

SEQ ID NO: 349010 - RNA, 19 nt, Homo sapiens
guagaaaacacacaaauug

SEQ ID NO: 349011 - RNA, 19 nt, Homo sapiens
cucaucagcuguuguguga

SEQ ID NO: 349012 - RNA, 19 nt, Homo sapiens
ggcuuucagugauaucuuu

SEQ ID NO: 349013 - RNA, 19 nt, Homo sapiens
gcucugagaaauugaaugu

SEQ ID NO: 349014 - RNA, 19 nt, Homo sapiens
agaagaucauccaagauau

SEQ ID NO: 349015 - RNA, 19 nt, Homo sapiens
ccagagcgaaauacaguuu

SEQ ID NO: 349016 - RNA, 19 nt, Homo sapiens
ggcgcuaccuugagauaga

SEQ ID NO: 349017 - RNA, 19 nt, Homo sapiens
aagaaacgguaugacuuaa

SEQ ID NO: 349018 - RNA, 19 nt, Homo sapiens
cuaaauaugggaaugucua

SEQ ID NO: 349019 - RNA, 19 nt, Homo sapiens
uaaccagguccaaucagua

SEQ ID NO: 349020 - RNA, 19 nt, Homo sapiens
gauauagucaagaagauca

SEQ ID NO: 349021 - RNA, 19 nt, Homo sapiens
gaggcauucuucagguuug

SEQ ID NO: 349022 - RNA, 19 nt, Homo sapiens
ggaggcauucuucagguuu

SEQ ID NO: 349023 - RNA, 19 nt, Homo sapiens
ccaaaugguuaauccaacu

SEQ ID NO: 349024 - RNA, 19 nt, Homo sapiens
gagaguguagagaggauaa

SEQ ID NO: 349025 - RNA, 19 nt, Homo sapiens
gcaacacacgacaacauau

SEQ ID NO: 349026 - RNA, 19 nt, Homo sapiens
cuaaagcacccuguagaaa

SEQ ID NO: 349027 - RNA, 19 nt, Homo sapiens
ucugagaaauugaauguac

SEQ ID NO: 349028 - RNA, 19 nt, Homo sapiens
aaaguuugguccaggauag

SEQ ID NO: 349029 - RNA, 19 nt, Homo sapiens
gaaagugggagcagaagac

SEQ ID NO: 349030 - RNA, 19 nt, Homo sapiens
gaaauacaguuugcaaaag

SEQ ID NO: 349031 - RNA, 19 nt, Homo sapiens
gugcugcgcgcucguguuu

SEQ ID NO: 349032 - RNA, 19 nt, Homo sapiens
gcucacaagaacagacuuu

SEQ ID NO: 349033 - RNA, 19 nt, Homo sapiens
aacagugaaucaacucaaa

SEQ ID NO: 349034 - RNA, 19 nt, Homo sapiens
gcgaaauacaguuugcaaa

SEQ ID NO: 349035 - RNA, 19 nt, Homo sapiens
uaugggaaugucuaacuua

SEQ ID NO: 349036 - RNA, 19 nt, Homo sapiens
ggaccacccaggaaacguu

SEQ ID NO: 349037 - RNA, 19 nt, Homo sapiens
cuugaggcuuucagugaua

SEQ ID NO: 349038 - RNA, 19 nt, Homo sapiens
aaagaaagugggagcagaa

SEQ ID NO: 349039 - RNA, 19 nt, Homo sapiens
aagcuuaccgggaaagaaa

SEQ ID NO: 349040 - RNA, 19 nt, Homo sapiens
ccuccaaaguaccuucauu

SEQ ID NO: 349041 - RNA, 19 nt, Homo sapiens
cuccaaaguaccuucauua

SEQ ID NO: 349042 - RNA, 19 nt, Homo sapiens
uauuagaugcucugagaaa

SEQ ID NO: 349043 - RNA, 19 nt, Homo sapiens
ucagugauaucuuucucau

SEQ ID NO: 349044 - RNA, 19 nt, Homo sapiens
uaaagcacucaaagacgua

SEQ ID NO: 349045 - RNA, 19 nt, Homo sapiens
gaaacagugaaucaacuca

SEQ ID NO: 349046 - RNA, 19 nt, Homo sapiens
ccaagauauugaccucugu

SEQ ID NO: 349047 - RNA, 19 nt, Homo sapiens
agauagaguucugcuugaa

SEQ ID NO: 349048 - RNA, 19 nt, Homo sapiens
uaauccaacugucagaucu

SEQ ID NO: 349049 - RNA, 19 nt, Homo sapiens
gcuguuuccucacaauugg

SEQ ID NO: 349050 - RNA, 19 nt, Homo sapiens
caaaggcaggcgauacuuc

SEQ ID NO: 349051 - RNA, 19 nt, Homo sapiens
caaacccagugaccagauc

SEQ ID NO: 349052 - RNA, 19 nt, Homo sapiens
gagcagaagacauugaaaa

SEQ ID NO: 349053 - RNA, 19 nt, Homo sapiens
gggagcagaagacauugaa

SEQ ID NO: 349054 - RNA, 19 nt, Homo sapiens
cgaagaaaccucucaucag

SEQ ID NO: 349055 - RNA, 19 nt, Homo sapiens
auggaaaguuuguagcauu

SEQ ID NO: 349056 - RNA, 19 nt, Homo sapiens
ucagguuccuucacagcuu

SEQ ID NO: 349057 - RNA, 19 nt, Homo sapiens
cgaaauacaguuugcaaaa

SEQ ID NO: 349058 - RNA, 19 nt, Homo sapiens
gcugcgcgcucguguuucu

SEQ ID NO: 349059 - RNA, 19 nt, Homo sapiens
gauuucagcuaugcuagag

SEQ ID NO: 349060 - RNA, 19 nt, Homo sapiens
gaaaugggcuuuaggaaua

SEQ ID NO: 349061 - RNA, 19 nt, Homo sapiens
ggucaaaucucuacaaauu

SEQ ID NO: 349062 - RNA, 19 nt, Homo sapiens
gaaagaaucucaguuacaa

SEQ ID NO: 349063 - RNA, 19 nt, Homo sapiens
gcgagaggcucaaguguua

SEQ ID NO: 349064 - RNA, 19 nt, Homo sapiens
gaaugaugguuuccaauuu

SEQ ID NO: 349065 - RNA, 19 nt, Homo sapiens
ggacaaaucugcaaagcau

SEQ ID NO: 349066 - RNA, 19 nt, Homo sapiens
gaacauagugguggaaaua

SEQ ID NO: 349067 - RNA, 19 nt, Homo sapiens
ccacagcacuugaguuaaa

SEQ ID NO: 349068 - RNA, 19 nt, Homo sapiens
ggaagagggugauaauaga

SEQ ID NO: 349069 - RNA, 19 nt, Homo sapiens
ggaaagagcaucaguacuu

SEQ ID NO: 349070 - RNA, 19 nt, Homo sapiens
aaaccaagauauccacuua

SEQ ID NO: 349071 - RNA, 19 nt, Homo sapiens
gaagggaaguugcuggaaa

SEQ ID NO: 349072 - RNA, 19 nt, Homo sapiens
ggaagugcaucaauauuau

SEQ ID NO: 349073 - RNA, 19 nt, Homo sapiens
gaacauguaaggccaagua

SEQ ID NO: 349074 - RNA, 19 nt, Homo sapiens
ccagaaaugucaugagauu

SEQ ID NO: 349075 - RNA, 19 nt, Homo sapiens
aaacugggcuggaagauau

SEQ ID NO: 349076 - RNA, 19 nt, Homo sapiens
gagagaacauagaucaauu

SEQ ID NO: 349077 - RNA, 19 nt, Homo sapiens
gcagaguauuucuaaagua

SEQ ID NO: 349078 - RNA, 19 nt, Homo sapiens
gaaaguaauugaguggaaa

SEQ ID NO: 349079 - RNA, 19 nt, Homo sapiens
gaaguucuuugauucugua

SEQ ID NO: 349080 - RNA, 19 nt, Homo sapiens
gaaacuugaugccauucua

SEQ ID NO: 349081 - RNA, 19 nt, Homo sapiens
gaaagagcaucaguacuug

SEQ ID NO: 349082 - RNA, 19 nt, Homo sapiens
ccaaagggaucaagacaga

SEQ ID NO: 349083 - RNA, 19 nt, Homo sapiens
gcuagugauuugcugauua

SEQ ID NO: 349084 - RNA, 19 nt, Homo sapiens
guaauugaguggaaacuug

SEQ ID NO: 349085 - RNA, 19 nt, Homo sapiens
ucaaagacguaaucaaaga

SEQ ID NO: 349086 - RNA, 19 nt, Homo sapiens
gaaaauaugucccagaaau

SEQ ID NO: 349087 - RNA, 19 nt, Homo sapiens
caacaugggaguaaucuuu

SEQ ID NO: 349088 - RNA, 19 nt, Homo sapiens
uaagguagcugcagauaag

SEQ ID NO: 349089 - RNA, 19 nt, Homo sapiens
gcaugacucuugacucuug

SEQ ID NO: 349090 - RNA, 19 nt, Homo sapiens
ggucuuaccuugaacugaa

SEQ ID NO: 349091 - RNA, 19 nt, Homo sapiens
ccaagaaguucaauauugu

SEQ ID NO: 349092 - RNA, 19 nt, Homo sapiens
ggcaauggaugaacugaaa

SEQ ID NO: 349093 - RNA, 19 nt, Homo sapiens
gagaugguaugcacaauuc

SEQ ID NO: 349094 - RNA, 19 nt, Homo sapiens
gagacacucugacugauga

SEQ ID NO: 349095 - RNA, 19 nt, Homo sapiens
caucaaagacguaaucaaa

SEQ ID NO: 349096 - RNA, 19 nt, Homo sapiens
uaaguggccuugacacauu

SEQ ID NO: 349097 - RNA, 19 nt, Homo sapiens
gcagacaggugugcagauu

SEQ ID NO: 349098 - RNA, 19 nt, Homo sapiens
ugagagagauagagaguga

SEQ ID NO: 349099 - RNA, 19 nt, Homo sapiens
ggaaagaaccuaucuacca

SEQ ID NO: 349100 - RNA, 19 nt, Homo sapiens
cuagaaagcugcugugauc

SEQ ID NO: 349101 - RNA, 19 nt, Homo sapiens
ggauuauucuuucuccuuu

SEQ ID NO: 349102 - RNA, 19 nt, Homo sapiens
gaaagaagcuccccagaca

SEQ ID NO: 349103 - RNA, 19 nt, Homo sapiens
gaagagauggaagaacuua

SEQ ID NO: 349104 - RNA, 19 nt, Homo sapiens
gaacagaggccacauuacu

SEQ ID NO: 349105 - RNA, 19 nt, Homo sapiens
ggagauaguccauaauguu

SEQ ID NO: 349106 - RNA, 19 nt, Homo sapiens
ccacuaaugugucaucuag

SEQ ID NO: 349107 - RNA, 19 nt, Homo sapiens
gaagggaauagaaauguuu

SEQ ID NO: 349108 - RNA, 19 nt, Homo sapiens
ggaagggaauagaaauguu

SEQ ID NO: 349109 - RNA, 19 nt, Homo sapiens
ggacaaaacuuagcaucua

SEQ ID NO: 349110 - RNA, 19 nt, Homo sapiens
caucaguacuuguuucuau

SEQ ID NO: 349111 - RNA, 19 nt, Homo sapiens
uauaagcccuugauuggaa

SEQ ID NO: 349112 - RNA, 19 nt, Homo sapiens
gaaccugucaugaccuaua

SEQ ID NO: 349113 - RNA, 19 nt, Homo sapiens
gcucuggucuauaccuuaa

SEQ ID NO: 349114 - RNA, 19 nt, Homo sapiens
ggccguagcuugucuguag

SEQ ID NO: 349115 - RNA, 19 nt, Homo sapiens
ccucacaggugucuccaua

SEQ ID NO: 349116 - RNA, 19 nt, Homo sapiens
gaaauuaacaucgcugaau

SEQ ID NO: 349117 - RNA, 19 nt, Homo sapiens
ccaacaaauucaucaaaga

SEQ ID NO: 349118 - RNA, 19 nt, Homo sapiens
gaaccaaagccagauauug

SEQ ID NO: 349119 - RNA, 19 nt, Homo sapiens
ccuauagacuucacaaaga

SEQ ID NO: 349120 - RNA, 19 nt, Homo sapiens
gucaggaagugcaucaaua

SEQ ID NO: 349121 - RNA, 19 nt, Homo sapiens
gaauauccugggugaaaua

SEQ ID NO: 349122 - RNA, 19 nt, Homo sapiens
gcuauucacucccugguau

SEQ ID NO: 349123 - RNA, 19 nt, Homo sapiens
gggaagagauggaagaacu

SEQ ID NO: 349124 - RNA, 19 nt, Homo sapiens
uccaagaaguucaauauug

SEQ ID NO: 349125 - RNA, 19 nt, Homo sapiens
acacaaugcuagugauuug

SEQ ID NO: 349126 - RNA, 19 nt, Homo sapiens
gcagguuaguuacauaugu

SEQ ID NO: 349127 - RNA, 19 nt, Homo sapiens
cacagucccuuuaaagaaa

SEQ ID NO: 349128 - RNA, 19 nt, Homo sapiens
uuacugaccucaccuagga

SEQ ID NO: 349129 - RNA, 19 nt, Homo sapiens
aauagugacugggacauua

SEQ ID NO: 349130 - RNA, 19 nt, Homo sapiens
gauggaagaacuuaagaaa

SEQ ID NO: 349131 - RNA, 19 nt, Homo sapiens
cuagugauuugcugauuaa

SEQ ID NO: 349132 - RNA, 19 nt, Homo sapiens
uaagaaugccaaagaauga

SEQ ID NO: 349133 - RNA, 19 nt, Homo sapiens
caucaaacaccgaauggua

SEQ ID NO: 349134 - RNA, 19 nt, Homo sapiens
caagagaaaugggcuuuag

SEQ ID NO: 349135 - RNA, 19 nt, Homo sapiens
ggagaggaccaacaaauuc

SEQ ID NO: 349136 - RNA, 19 nt, Homo sapiens
gaguuaggcuuucucuuca

SEQ ID NO: 349137 - RNA, 19 nt, Homo sapiens
gcacaauuccaugacaaua

SEQ ID NO: 349138 - RNA, 19 nt, Homo sapiens
gcagcaauauucagguuca

SEQ ID NO: 349139 - RNA, 19 nt, Homo sapiens
cauagucuguucauuucua

SEQ ID NO: 349140 - RNA, 19 nt, Homo sapiens
caugugaucucauuguuca

SEQ ID NO: 349141 - RNA, 19 nt, Homo sapiens
uagagaaucuggcaaugga

SEQ ID NO: 349142 - RNA, 19 nt, Homo sapiens
gaaaggcaguagucauuuu

SEQ ID NO: 349143 - RNA, 19 nt, Homo sapiens
uaagacacuuggucaaugu

SEQ ID NO: 349144 - RNA, 19 nt, Homo sapiens
guauauaagcuaccagaaa

SEQ ID NO: 349145 - RNA, 19 nt, Homo sapiens
gacaagagguucuguuuug

SEQ ID NO: 349146 - RNA, 19 nt, Homo sapiens
acaaggagaggcacaauuu

SEQ ID NO: 349147 - RNA, 19 nt, Homo sapiens
auauucagcuugcacauuu

SEQ ID NO: 349148 - RNA, 19 nt, Homo sapiens
guuaggcuuucucuucaua

SEQ ID NO: 349149 - RNA, 19 nt, Homo sapiens
gggaagagggugauaauag

SEQ ID NO: 349150 - RNA, 19 nt, Homo sapiens
ucacaccaguacaagauuu

SEQ ID NO: 349151 - RNA, 19 nt, Homo sapiens
gaaauggagcuaaaugaag

SEQ ID NO: 349152 - RNA, 19 nt, Homo sapiens
cauagaaacuaaugaaagg

SEQ ID NO: 349153 - RNA, 19 nt, Homo sapiens
gcagcaugauuuauacuca

SEQ ID NO: 349154 - RNA, 19 nt, Homo sapiens
aauaugcgguguuugguuu

SEQ ID NO: 349155 - RNA, 19 nt, Homo sapiens
gaagagggugauaauagaa

SEQ ID NO: 349156 - RNA, 19 nt, Homo sapiens
gcuaagaaaccaggaguaa

SEQ ID NO: 349157 - RNA, 19 nt, Homo sapiens
ugaaaguaauugaguggaa

SEQ ID NO: 349158 - RNA, 19 nt, Homo sapiens
gagcaucaguacuuguuuc

SEQ ID NO: 349159 - RNA, 19 nt, Homo sapiens
gauauccacuuaccugagu

SEQ ID NO: 349160 - RNA, 19 nt, Homo sapiens
gcaacgugcuugucauguu

SEQ ID NO: 349161 - RNA, 19 nt, Homo sapiens
cagcuucgguuucuaacuu

SEQ ID NO: 349162 - RNA, 19 nt, Homo sapiens
gagccggacuuucggaguu

SEQ ID NO: 349163 - RNA, 19 nt, Homo sapiens
caacgugcuugucauguuc

SEQ ID NO: 349164 - RNA, 19 nt, Homo sapiens
ccaccaacaucuacaucuu

SEQ ID NO: 349165 - RNA, 19 nt, Homo sapiens
gcagaggacagaucaaugg

SEQ ID NO: 349166 - RNA, 19 nt, Homo sapiens
gcaaggcugugcucuccau

SEQ ID NO: 349167 - RNA, 19 nt, Homo sapiens
gaagacggccaccaacauc

SEQ ID NO: 349168 - RNA, 19 nt, Homo sapiens
gcauggugcuggugguugu

SEQ ID NO: 349169 - RNA, 19 nt, Homo sapiens
ugagacagcuucgguuucu

SEQ ID NO: 349170 - RNA, 19 nt, Homo sapiens
gggacacggugaccaagau

SEQ ID NO: 349171 - RNA, 19 nt, Homo sapiens
caacugaguccuuaaacag

SEQ ID NO: 349172 - RNA, 19 nt, Homo sapiens
agacagcuucgguuucuaa

SEQ ID NO: 349173 - RNA, 19 nt, Homo sapiens
uaacuuggagccggacuuu

SEQ ID NO: 349174 - RNA, 19 nt, Homo sapiens
acaacugaguccuuaaaca

SEQ ID NO: 349175 - RNA, 19 nt, Homo sapiens
cuacaacugaguccuuaaa

SEQ ID NO: 349176 - RNA, 19 nt, Homo sapiens
ugaccaagaucugcguguu

SEQ ID NO: 349177 - RNA, 19 nt, Homo sapiens
ggacgcugguggacaucga

SEQ ID NO: 349178 - RNA, 19 nt, Homo sapiens
uccaucgacuacuacaaua

SEQ ID NO: 349179 - RNA, 19 nt, Homo sapiens
aggccaagcugaucaacau

SEQ ID NO: 349180 - RNA, 19 nt, Homo sapiens
cgacuacuacaauauguuc

SEQ ID NO: 349181 - RNA, 19 nt, Homo sapiens
caucgacuacuacaauaug

SEQ ID NO: 349182 - RNA, 19 nt, Homo sapiens
caacaucuacaucuucaac

SEQ ID NO: 349183 - RNA, 19 nt, Homo sapiens
gagacagcuucgguuucua

SEQ ID NO: 349184 - RNA, 19 nt, Homo sapiens
gaucugcguguuccucuuc

SEQ ID NO: 349185 - RNA, 19 nt, Homo sapiens
caucuucaaccuggccuua

SEQ ID NO: 349186 - RNA, 19 nt, Homo sapiens
gcgccuucgugguguguug

SEQ ID NO: 349187 - RNA, 19 nt, Homo sapiens
caucaucaccgugugcuau

SEQ ID NO: 349188 - RNA, 19 nt, Homo sapiens
ccaagcugaucaacaucug

SEQ ID NO: 349189 - RNA, 19 nt, Homo sapiens
gggcaacgugcuugucaug

SEQ ID NO: 349190 - RNA, 19 nt, Homo sapiens
gaccaagaucugcguguuc

SEQ ID NO: 349191 - RNA, 19 nt, Homo sapiens
gcucuacaacugaguccuu

SEQ ID NO: 349192 - RNA, 19 nt, Homo sapiens
gcaucguccgguacacuaa

SEQ ID NO: 349193 - RNA, 19 nt, Homo sapiens
aagcugaucaacaucugua

SEQ ID NO: 349194 - RNA, 19 nt, Homo sapiens
ucaccaugaugaguguuga

SEQ ID NO: 349195 - RNA, 19 nt, Homo sapiens
cucuacaacugaguccuua

SEQ ID NO: 349196 - RNA, 19 nt, Homo sapiens
ugaagacggccaccaacau

SEQ ID NO: 349197 - RNA, 19 nt, Homo sapiens
agacggccaccaacaucua

SEQ ID NO: 349198 - RNA, 19 nt, Homo sapiens
cgugugcuauggccucaug

SEQ ID NO: 349199 - RNA, 19 nt, Homo sapiens
cgaggcagaggacagauca

SEQ ID NO: 349200 - RNA, 19 nt, Homo sapiens
ggcaucguccgguacacua

SEQ ID NO: 349201 - RNA, 19 nt, Homo sapiens
accaacaucuacaucuuca

SEQ ID NO: 349202 - RNA, 19 nt, Homo sapiens
aacagggcaucuccaggaa

SEQ ID NO: 349203 - RNA, 19 nt, Homo sapiens
guacccggaggccacauga

SEQ ID NO: 349204 - RNA, 19 nt, Homo sapiens
ggcagaggacagaucaaug

SEQ ID NO: 349205 - RNA, 19 nt, Homo sapiens
ggaguggggccaguagaua

SEQ ID NO: 349206 - RNA, 19 nt, Homo sapiens
ucuggacgcugguggacau

SEQ ID NO: 349207 - RNA, 19 nt, Homo sapiens
gugcccauccucaucauca

SEQ ID NO: 349208 - RNA, 19 nt, Homo sapiens
ugucaaggcccuggacuuc

SEQ ID NO: 349209 - RNA, 19 nt, Homo sapiens
acaauauguucaccagcau

SEQ ID NO: 349210 - RNA, 19 nt, Homo sapiens
gcaacucgcuggucauguu

SEQ ID NO: 349211 - RNA, 19 nt, Homo sapiens
gaauaaaccaguaugacua

SEQ ID NO: 349212 - RNA, 19 nt, Homo sapiens
aggcaaagaucaucaauau

SEQ ID NO: 349213 - RNA, 19 nt, Homo sapiens
gaagacagcaaccaacauu

SEQ ID NO: 349214 - RNA, 19 nt, Homo sapiens
ggacucccauucacauauu

SEQ ID NO: 349215 - RNA, 19 nt, Homo sapiens
ggugggaccucuucaugaa

SEQ ID NO: 349216 - RNA, 19 nt, Homo sapiens
agacagcaaccaacauuua

SEQ ID NO: 349217 - RNA, 19 nt, Homo sapiens
gaucugcgucuucaucuuu

SEQ ID NO: 349218 - RNA, 19 nt, Homo sapiens
ggaagacgucgaugucauu

SEQ ID NO: 349219 - RNA, 19 nt, Homo sapiens
gcaaccaacauuuacauau

SEQ ID NO: 349220 - RNA, 19 nt, Homo sapiens
gcaccaaagucagggaaga

SEQ ID NO: 349221 - RNA, 19 nt, Homo sapiens
caacagcagcgccugguuu

SEQ ID NO: 349222 - RNA, 19 nt, Homo sapiens
cuacaaccaugcccuuuca

SEQ ID NO: 349223 - RNA, 19 nt, Homo sapiens
gaugugcugugcaagauag

SEQ ID NO: 349224 - RNA, 19 nt, Homo sapiens
gaugaauaaaccaguauga

SEQ ID NO: 349225 - RNA, 19 nt, Homo sapiens
gggaagacgucgaugucau

SEQ ID NO: 349226 - RNA, 19 nt, Homo sapiens
ucguggagaugucuucgua

SEQ ID NO: 349227 - RNA, 19 nt, Homo sapiens
uggcaucucugcaauaguc

SEQ ID NO: 349228 - RNA, 19 nt, Homo sapiens
uaaccuggcuuuggcagau

SEQ ID NO: 349229 - RNA, 19 nt, Homo sapiens
gcaagauaguaauuuccau

SEQ ID NO: 349230 - RNA, 19 nt, Homo sapiens
gggaugugcugugcaagau

SEQ ID NO: 349231 - RNA, 19 nt, Homo sapiens
gacuucugcuuuccacuga

SEQ ID NO: 349232 - RNA, 19 nt, Homo sapiens
ugggaugaauaaaccagua

SEQ ID NO: 349233 - RNA, 19 nt, Homo sapiens
guggagaugucuucguaca

SEQ ID NO: 349234 - RNA, 19 nt, Homo sapiens
accaugcccuuucagagua

SEQ ID NO: 349235 - RNA, 19 nt, Homo sapiens
cgugaucccuguccucauc

SEQ ID NO: 349236 - RNA, 19 nt, Homo sapiens
gaagacgucgaugucauug

SEQ ID NO: 349237 - RNA, 19 nt, Homo sapiens
gaaggcaaagaucaucaau

SEQ ID NO: 349238 - RNA, 19 nt, Homo sapiens
agacgucgaugucauugag

SEQ ID NO: 349239 - RNA, 19 nt, Homo sapiens
guuggcaucucugcaauag

SEQ ID NO: 349240 - RNA, 19 nt, Homo sapiens
ggaugugcugugcaagaua

SEQ ID NO: 349241 - RNA, 19 nt, Homo sapiens
ggcagaugcuuuaguuacu

SEQ ID NO: 349242 - RNA, 19 nt, Homo sapiens
ggcuuuggcagaugcuuua

SEQ ID NO: 349243 - RNA, 19 nt, Homo sapiens
gaucauccgauacacaaag

SEQ ID NO: 349244 - RNA, 19 nt, Homo sapiens
acuagcagaguccgaaaua

SEQ ID NO: 349245 - RNA, 19 nt, Homo sapiens
uuuggcagaugcuuuaguu

SEQ ID NO: 349246 - RNA, 19 nt, Homo sapiens
uagcagaguccgaaauaca

SEQ ID NO: 349247 - RNA, 19 nt, Homo sapiens
gcacuagcagaguccgaaa

SEQ ID NO: 349248 - RNA, 19 nt, Homo sapiens
ucaccagcaucuucaccuu

SEQ ID NO: 349249 - RNA, 19 nt, Homo sapiens
ugaauaaaccaguaugacu

SEQ ID NO: 349250 - RNA, 19 nt, Homo sapiens
gugaucauccgauacacaa

SEQ ID NO: 349251 - RNA, 19 nt, Homo sapiens
guucccagaugaugacuac

SEQ ID NO: 349252 - RNA, 19 nt, Homo sapiens
uuacuucugcaucgccuua

SEQ ID NO: 349253 - RNA, 19 nt, Homo sapiens
ugugcaagauaguaauuuc

SEQ ID NO: 349254 - RNA, 19 nt, Homo sapiens
cuacgccuuucuugaugaa

SEQ ID NO: 349255 - RNA, 19 nt, Homo sapiens
gugcugugcaagauaguaa

SEQ ID NO: 349256 - RNA, 19 nt, Homo sapiens
caucuuugccuucgugauc

SEQ ID NO: 349257 - RNA, 19 nt, Homo sapiens
accagcaucuucaccuuga

SEQ ID NO: 349258 - RNA, 19 nt, Homo sapiens
uaccaacaguagccugaau

SEQ ID NO: 349259 - RNA, 19 nt, Homo sapiens
gcugugcaagauaguaauu

SEQ ID NO: 349260 - RNA, 19 nt, Homo sapiens
gggaugaauaaaccaguau

SEQ ID NO: 349261 - RNA, 19 nt, Homo sapiens
cugaugauccugcgucuca

SEQ ID NO: 349262 - RNA, 19 nt, Homo sapiens
ccuugcaguucccagauga

SEQ ID NO: 349263 - RNA, 19 nt, Homo sapiens
gacagcaaccaacauuuac

SEQ ID NO: 349264 - RNA, 19 nt, Homo sapiens
ggaugaauaaaccaguaug

SEQ ID NO: 349265 - RNA, 19 nt, Homo sapiens
ucucuacgccuuucuugau

SEQ ID NO: 349266 - RNA, 19 nt, Homo sapiens
gcagaguccgaaauacagu

SEQ ID NO: 349267 - RNA, 19 nt, Homo sapiens
ucuacgccuuucuugauga

SEQ ID NO: 349268 - RNA, 19 nt, Homo sapiens
aaggcaaagaucaucaaua

SEQ ID NO: 349269 - RNA, 19 nt, Homo sapiens
acaaagaugaagacagcaa

SEQ ID NO: 349270 - RNA, 19 nt, Homo sapiens
gggcaacucgcuggucaug

SEQ ID NO: 349271 - RNA, 19 nt, Homo sapiens
cagcaaccaacauuuacau

SEQ ID NO: 349272 - RNA, 19 nt, Homo sapiens
aauaaaccaguaugacuag

SEQ ID NO: 349273 - RNA, 19 nt, Homo sapiens
ugaaggcaaagaucaucaa

SEQ ID NO: 349274 - RNA, 19 nt, Homo sapiens
cauguucaccagcaucuuc

SEQ ID NO: 349275 - RNA, 19 nt, Homo sapiens
cggucuacuugaugaauuc

SEQ ID NO: 349276 - RNA, 19 nt, Homo sapiens
ggaacugccuugucaugua

SEQ ID NO: 349277 - RNA, 19 nt, Homo sapiens
gaagacagccaccaauauu

SEQ ID NO: 349278 - RNA, 19 nt, Homo sapiens
ggucuugacugcucuguuu

SEQ ID NO: 349279 - RNA, 19 nt, Homo sapiens
gggcagcucuguucacaaa

SEQ ID NO: 349280 - RNA, 19 nt, Homo sapiens
caaggagguugcagaagua

SEQ ID NO: 349281 - RNA, 19 nt, Homo sapiens
ccaaggagguugcagaagu

SEQ ID NO: 349282 - RNA, 19 nt, Homo sapiens
gaguguggaucgcuaugua

SEQ ID NO: 349283 - RNA, 19 nt, Homo sapiens
agacagccaccaauauuua

SEQ ID NO: 349284 - RNA, 19 nt, Homo sapiens
gaacugccuugucauguac

SEQ ID NO: 349285 - RNA, 19 nt, Homo sapiens
gcggugcaaugaacuauau

SEQ ID NO: 349286 - RNA, 19 nt, Homo sapiens
ccaccaauauuuacaucuu

SEQ ID NO: 349287 - RNA, 19 nt, Homo sapiens
gcaggugucucaggacgaa

SEQ ID NO: 349288 - RNA, 19 nt, Homo sapiens
cggcacaggucgaggauga

SEQ ID NO: 349289 - RNA, 19 nt, Homo sapiens
ggaaugcgcugugcaagac

SEQ ID NO: 349290 - RNA, 19 nt, Homo sapiens
ggucgaggaugaagagauc

SEQ ID NO: 349291 - RNA, 19 nt, Homo sapiens
caaaguggaggccucguuu

SEQ ID NO: 349292 - RNA, 19 nt, Homo sapiens
gcagcucuguucacaaagu

SEQ ID NO: 349293 - RNA, 19 nt, Homo sapiens
agacagucauugccauuga

SEQ ID NO: 349294 - RNA, 19 nt, Homo sapiens
ucauugccauugacuacua

SEQ ID NO: 349295 - RNA, 19 nt, Homo sapiens
caucuacgcccaacacaga

SEQ ID NO: 349296 - RNA, 19 nt, Homo sapiens
gggaagcuguguggaagga

SEQ ID NO: 349297 - RNA, 19 nt, Homo sapiens
ugaagacagccaccaauau

SEQ ID NO: 349298 - RNA, 19 nt, Homo sapiens
ccucacagccucuccuuug

SEQ ID NO: 349299 - RNA, 19 nt, Homo sapiens
gcaggcagcuuuucuuugg

SEQ ID NO: 349300 - RNA, 19 nt, Homo sapiens
ugggacaggucaaagcauu

SEQ ID NO: 349301 - RNA, 19 nt, Homo sapiens
acaggucacugcucucuag

SEQ ID NO: 349302 - RNA, 19 nt, Homo sapiens
gccauugacuacuacaaca

SEQ ID NO: 349303 - RNA, 19 nt, Homo sapiens
gggacaggucaaagcauua

SEQ ID NO: 349304 - RNA, 19 nt, Homo sapiens
caagacagucauugccauu

SEQ ID NO: 349305 - RNA, 19 nt, Homo sapiens
caugugcugugugcuguuu

SEQ ID NO: 349306 - RNA, 19 nt, Homo sapiens
gcgccguucugggagguua

SEQ ID NO: 349307 - RNA, 19 nt, Homo sapiens
gggaaugcgcugugcaaga

SEQ ID NO: 349308 - RNA, 19 nt, Homo sapiens
gcaucuuccucuucuccuu

SEQ ID NO: 349309 - RNA, 19 nt, Homo sapiens
cacaaggaccuaccuggaa

SEQ ID NO: 349310 - RNA, 19 nt, Homo sapiens
ggacaggucaaagcauuag

SEQ ID NO: 349311 - RNA, 19 nt, Homo sapiens
cacccuaacugccaugagu

SEQ ID NO: 349312 - RNA, 19 nt, Homo sapiens
cuggaggacuugccuguuc

SEQ ID NO: 349313 - RNA, 19 nt, Homo sapiens
ggggacgccugcuucauuu

SEQ ID NO: 349314 - RNA, 19 nt, Homo sapiens
ccacaugggcagcucuguu

SEQ ID NO: 349315 - RNA, 19 nt, Homo sapiens
accagcaccuucacccuaa

SEQ ID NO: 349316 - RNA, 19 nt, Homo sapiens
aagacagccaccaauauuu

SEQ ID NO: 349317 - RNA, 19 nt, Homo sapiens
gcugccaccuggaggacuu

SEQ ID NO: 349318 - RNA, 19 nt, Homo sapiens
ggacgccugcuucauuuac

SEQ ID NO: 349319 - RNA, 19 nt, Homo sapiens
caucaugggacaggucaaa

SEQ ID NO: 349320 - RNA, 19 nt, Homo sapiens
gggacgccugcuucauuua

SEQ ID NO: 349321 - RNA, 19 nt, Homo sapiens
cacagccucuccuuugcuu

SEQ ID NO: 349322 - RNA, 19 nt, Homo sapiens
caguggccgugcuguguug

SEQ ID NO: 349323 - RNA, 19 nt, Homo sapiens
cagccucuccuuugcuuga

SEQ ID NO: 349324 - RNA, 19 nt, Homo sapiens
ccuggaagcagcugacaug

SEQ ID NO: 349325 - RNA, 19 nt, Homo sapiens
aggaggaccuagugacauc

SEQ ID NO: 349326 - RNA, 19 nt, Homo sapiens
ucgagugccugguggagau

SEQ ID NO: 349327 - RNA, 19 nt, Homo sapiens
ugacuacuacaacauguuc

SEQ ID NO: 349328 - RNA, 19 nt, Homo sapiens
cagcccugcuucucagugu

SEQ ID NO: 349329 - RNA, 19 nt, Homo sapiens
caaguucugcugugcaucu

SEQ ID NO: 349330 - RNA, 19 nt, Homo sapiens
augaagacagccaccaaua

SEQ ID NO: 349331 - RNA, 19 nt, Homo sapiens
ucaagauggcucuguguag

SEQ ID NO: 349332 - RNA, 19 nt, Homo sapiens
cagcucuguucacaaagug

SEQ ID NO: 349333 - RNA, 19 nt, Homo sapiens
agacugccguggccauucu

SEQ ID NO: 349334 - RNA, 19 nt, Homo sapiens
ccucuacgccuuccuggau

SEQ ID NO: 349335 - RNA, 19 nt, Homo sapiens
gcacaggucgaggaugaag

SEQ ID NO: 349336 - RNA, 19 nt, Homo sapiens
gacgccugcuucauuuaca

SEQ ID NO: 349337 - RNA, 19 nt, Homo sapiens
cacaugggcagcucuguuc

SEQ ID NO: 349338 - RNA, 19 nt, Homo sapiens
gggacgugcaggugucuga

SEQ ID NO: 349339 - RNA, 19 nt, Homo sapiens
ggugguaguggcuguguuc

SEQ ID NO: 349340 - RNA, 19 nt, Homo sapiens
ccgcaucugcugcucaaug

SEQ ID NO: 349341 - RNA, 19 nt, Homo sapiens
ccagaggaggaccuaguga

SEQ ID NO: 349342 - RNA, 19 nt, Homo sapiens
cacagcagagccagcauga

SEQ ID NO: 349343 - RNA, 19 nt, Homo sapiens
ucauuuacaagccucaaga

SEQ ID NO: 349344 - RNA, 19 nt, Homo sapiens
aaaugaagacagccaccaa

SEQ ID NO: 349345 - RNA, 19 nt, Homo sapiens
gggaacugccuugucaugu

SEQ ID NO: 349346 - RNA, 19 nt, Homo sapiens
gcauuagggccaccuccau

SEQ ID NO: 349347 - RNA, 19 nt, Homo sapiens
ggacucccauucacauuua

SEQ ID NO: 349348 - RNA, 19 nt, Homo sapiens
uaacaucucuuucaucuag

SEQ ID NO: 349349 - RNA, 19 nt, Homo sapiens
gaaacuuccuggucaugua

SEQ ID NO: 349350 - RNA, 19 nt, Homo sapiens
gagauuagcaugaaaggua

SEQ ID NO: 349351 - RNA, 19 nt, Homo sapiens
caaagcaccuugaauggaa

SEQ ID NO: 349352 - RNA, 19 nt, Homo sapiens
gaacuaaucaucagcuaga

SEQ ID NO: 349353 - RNA, 19 nt, Homo sapiens
caugaaagguaaucugaaa

SEQ ID NO: 349354 - RNA, 19 nt, Homo sapiens
gcagguugcuucaagaaug

SEQ ID NO: 349355 - RNA, 19 nt, Homo sapiens
ucaucuagcuccauaauug

SEQ ID NO: 349356 - RNA, 19 nt, Homo sapiens
gggaagagauuagcaugaa

SEQ ID NO: 349357 - RNA, 19 nt, Homo sapiens
caacaaaacuccacucgaa

SEQ ID NO: 349358 - RNA, 19 nt, Homo sapiens
gcaacuggauccucucuuc

SEQ ID NO: 349359 - RNA, 19 nt, Homo sapiens
ggaagagauuagcaugaaa

SEQ ID NO: 349360 - RNA, 19 nt, Homo sapiens
gauccucucuucagccauu

SEQ ID NO: 349361 - RNA, 19 nt, Homo sapiens
gcuauggacugaugaucuu

SEQ ID NO: 349362 - RNA, 19 nt, Homo sapiens
cguaguaacacauaaagua

SEQ ID NO: 349363 - RNA, 19 nt, Homo sapiens
caacaaagaagaaccaucu

SEQ ID NO: 349364 - RNA, 19 nt, Homo sapiens
uuuaugaccucaacaaaga

SEQ ID NO: 349365 - RNA, 19 nt, Homo sapiens
caacuugucccacuuagau

SEQ ID NO: 349366 - RNA, 19 nt, Homo sapiens
ggauagaacuaaucaucag

SEQ ID NO: 349367 - RNA, 19 nt, Homo sapiens
ggaaccauccuuugcaaga

SEQ ID NO: 349368 - RNA, 19 nt, Homo sapiens
uguaugugauugucagaua

SEQ ID NO: 349369 - RNA, 19 nt, Homo sapiens
aaaaguaaguggagcauuu

SEQ ID NO: 349370 - RNA, 19 nt, Homo sapiens
gaaccauccuuugcaagau

SEQ ID NO: 349371 - RNA, 19 nt, Homo sapiens
aaacgaugcuucagagagu

SEQ ID NO: 349372 - RNA, 19 nt, Homo sapiens
acacuaacauucucucauc

SEQ ID NO: 349373 - RNA, 19 nt, Homo sapiens
gaguguugaucgauacauu

SEQ ID NO: 349374 - RNA, 19 nt, Homo sapiens
ccaugaguguugaucgaua

SEQ ID NO: 349375 - RNA, 19 nt, Homo sapiens
guaggaggcucuaauucuc

SEQ ID NO: 349376 - RNA, 19 nt, Homo sapiens
uuccauagauuguacacua

SEQ ID NO: 349377 - RNA, 19 nt, Homo sapiens
caucuucgccuucauuaug

SEQ ID NO: 349378 - RNA, 19 nt, Homo sapiens
ggucaacuugucccacuua

SEQ ID NO: 349379 - RNA, 19 nt, Homo sapiens
gaagagauuagcaugaaag

SEQ ID NO: 349380 - RNA, 19 nt, Homo sapiens
gaagaucuguguuuucauc

SEQ ID NO: 349381 - RNA, 19 nt, Homo sapiens
gggaaaaccucgugaagau

SEQ ID NO: 349382 - RNA, 19 nt, Homo sapiens
ggcagucccuccaugauca

SEQ ID NO: 349383 - RNA, 19 nt, Homo sapiens
guaaguggagcauuuggaa

SEQ ID NO: 349384 - RNA, 19 nt, Homo sapiens
ucagauacaccaagaugaa

SEQ ID NO: 349385 - RNA, 19 nt, Homo sapiens
uaaguucaccguaguaaca

SEQ ID NO: 349386 - RNA, 19 nt, Homo sapiens
gugaauugaagucaucaua

SEQ ID NO: 349387 - RNA, 19 nt, Homo sapiens
aaccauccuuugcaagaua

SEQ ID NO: 349388 - RNA, 19 nt, Homo sapiens
gcucuagguuacacaaaca

SEQ ID NO: 349389 - RNA, 19 nt, Homo sapiens
uaacauguucaccagcaua

SEQ ID NO: 349390 - RNA, 19 nt, Homo sapiens
ccaccaacaucuacauuuu

SEQ ID NO: 349391 - RNA, 19 nt, Homo sapiens
uaaaugcuaccucugauca

SEQ ID NO: 349392 - RNA, 19 nt, Homo sapiens
ccacucugcucugcacauu

SEQ ID NO: 349393 - RNA, 19 nt, Homo sapiens
cccaaccucuuccaacauu

SEQ ID NO: 349394 - RNA, 19 nt, Homo sapiens
gaaaaggacaggaaucuuc

SEQ ID NO: 349395 - RNA, 19 nt, Homo sapiens
caggcaagguuccauagau

SEQ ID NO: 349396 - RNA, 19 nt, Homo sapiens
guucauggcuacaacaaaa

SEQ ID NO: 349397 - RNA, 19 nt, Homo sapiens
agauuagcaugaaagguaa

SEQ ID NO: 349398 - RNA, 19 nt, Homo sapiens
ucaccuccauuucuugguu

SEQ ID NO: 349399 - RNA, 19 nt, Homo sapiens
gcucuaauucucuaggaaa

SEQ ID NO: 349400 - RNA, 19 nt, Homo sapiens
ccaauacaguggauagaac

SEQ ID NO: 349401 - RNA, 19 nt, Homo sapiens
uuaaagccuugguuacaau

SEQ ID NO: 349402 - RNA, 19 nt, Homo sapiens
aggcaagguuccauagauu

SEQ ID NO: 349403 - RNA, 19 nt, Homo sapiens
ugucaaggccuuagauuuc

SEQ ID NO: 349404 - RNA, 19 nt, Homo sapiens
cacauuuacgucaucauua

SEQ ID NO: 349405 - RNA, 19 nt, Homo sapiens
ucacauuuacgucaucauu

SEQ ID NO: 349406 - RNA, 19 nt, Homo sapiens
ccauuggucuuccuguaau

SEQ ID NO: 349407 - RNA, 19 nt, Homo sapiens
ccuucugucuguaagauuu

SEQ ID NO: 349408 - RNA, 19 nt, Homo sapiens
gcaagguuccauagauugu

SEQ ID NO: 349409 - RNA, 19 nt, Homo sapiens
ggaacauggccauuuggaa

SEQ ID NO: 349410 - RNA, 19 nt, Homo sapiens
gcacuucugcauugcucua

SEQ ID NO: 349411 - RNA, 19 nt, Homo sapiens
gcauuuggaaggaaaggaa

SEQ ID NO: 349412 - RNA, 19 nt, Homo sapiens
cuaauucucuaggaaagug

SEQ ID NO: 349413 - RNA, 19 nt, Homo sapiens
uagaacuaaucaucagcua

SEQ ID NO: 349414 - RNA, 19 nt, Homo sapiens
ggugguggcuguguucauc

SEQ ID NO: 349415 - RNA, 19 nt, Homo sapiens
gccauuggucuuccuguaa

SEQ ID NO: 349416 - RNA, 19 nt, Homo sapiens
gaagacugccaccaacauc

SEQ ID NO: 349417 - RNA, 19 nt, Homo sapiens
cagaggagaaugucagaug

SEQ ID NO: 349418 - RNA, 19 nt, Homo sapiens
ucaccguaguaacacauaa

SEQ ID NO: 349419 - RNA, 19 nt, Homo sapiens
caugcucucuggcuccaaa

SEQ ID NO: 349420 - RNA, 19 nt, Homo sapiens
ugaaagguaaucugaaaca

SEQ ID NO: 349421 - RNA, 19 nt, Homo sapiens
gcaugaaagguaaucugaa

SEQ ID NO: 349422 - RNA, 19 nt, Homo sapiens
ggucauguaugugauuguc

SEQ ID NO: 349423 - RNA, 19 nt, Homo sapiens
caaccucuuccaacauuga

SEQ ID NO: 349424 - RNA, 19 nt, Homo sapiens
guuacaaucccagaaacua

SEQ ID NO: 349425 - RNA, 19 nt, Homo sapiens
ggccuuagauuuccguacu

SEQ ID NO: 349426 - RNA, 19 nt, Homo sapiens
gaaagguaaucugaaacac

SEQ ID NO: 349427 - RNA, 19 nt, Homo sapiens
gcaucuggcuaaggcauca

SEQ ID NO: 349428 - RNA, 19 nt, Homo sapiens
aaugcuaccucugaucaaa

SEQ ID NO: 349429 - RNA, 19 nt, Homo sapiens
gaaggaaaggaauauacca

SEQ ID NO: 349430 - RNA, 19 nt, Homo sapiens
cagguugcuucaagaaugu

SEQ ID NO: 349431 - RNA, 19 nt, Homo sapiens
cccaguccuuuaugcauuu

SEQ ID NO: 349432 - RNA, 19 nt, Homo sapiens
acaggaaucuucgaaggau

SEQ ID NO: 349433 - RNA, 19 nt, Homo sapiens
uccauagauuguacacuaa

SEQ ID NO: 349434 - RNA, 19 nt, Homo sapiens
uaugugaauugaagucauc

SEQ ID NO: 349435 - RNA, 19 nt, Homo sapiens
caucgugguaugugaauug

SEQ ID NO: 349436 - RNA, 19 nt, Homo sapiens
gaguccaguuugugcaaga

SEQ ID NO: 349437 - RNA, 19 nt, Homo sapiens
acaccgaggaguccaguuu

SEQ ID NO: 349438 - RNA, 19 nt, Homo sapiens
uagaagccaccauguaugu

SEQ ID NO: 349439 - RNA, 19 nt, Homo sapiens
cuuagaagccaccauguau

SEQ ID NO: 349440 - RNA, 19 nt, Homo sapiens
aacagggucucaugccauu

SEQ ID NO: 349441 - RNA, 19 nt, Homo sapiens
gaauucgucagaacacuag

SEQ ID NO: 349442 - RNA, 19 nt, Homo sapiens
cgaauucgucagaacacua

SEQ ID NO: 349443 - RNA, 19 nt, Homo sapiens
gacaggaaucuucgaagga

SEQ ID NO: 349444 - RNA, 19 nt, Homo sapiens
cuaacauucucucauccaa

SEQ ID NO: 349445 - RNA, 19 nt, Homo sapiens
cgugguaugugaauugaag

SEQ ID NO: 349446 - RNA, 19 nt, Homo sapiens
ccacucgaauucgucagaa

SEQ ID NO: 349447 - RNA, 19 nt, Homo sapiens
gaaaggacgcuguuacaua

SEQ ID NO: 349448 - RNA, 19 nt, Homo sapiens
ggaacuugcuguuucuaaa

SEQ ID NO: 349449 - RNA, 19 nt, Homo sapiens
aaaggacgcuguuacauau

SEQ ID NO: 349450 - RNA, 19 nt, Homo sapiens
gggcaaccuucuuaauuaa

SEQ ID NO: 349451 - RNA, 19 nt, Homo sapiens
ugggcaaccuucuuaauua

SEQ ID NO: 349452 - RNA, 19 nt, Homo sapiens
gaagcagauuccaguguaa

SEQ ID NO: 349453 - RNA, 19 nt, Homo sapiens
caugguagguuucucugua

SEQ ID NO: 349454 - RNA, 19 nt, Homo sapiens
agaagcagauuccagugua

SEQ ID NO: 349455 - RNA, 19 nt, Homo sapiens
uggagaagccaaacaauaa

SEQ ID NO: 349456 - RNA, 19 nt, Homo sapiens
ggagaagccaaacaauaaa

SEQ ID NO: 349457 - RNA, 19 nt, Homo sapiens
guggagaagccaaacaaua

SEQ ID NO: 349458 - RNA, 19 nt, Homo sapiens
ugagagaccugcaaaucca

SEQ ID NO: 349459 - RNA, 19 nt, Homo sapiens
ggacaaguaccgaguaagg

SEQ ID NO: 349460 - RNA, 19 nt, Homo sapiens
gaugagagaccugcaaauc

SEQ ID NO: 349461 - RNA, 19 nt, Homo sapiens
guggacaaguaccgaguaa

SEQ ID NO: 349462 - RNA, 19 nt, Homo sapiens
gcaacuaccgcgagcucua

SEQ ID NO: 349463 - RNA, 19 nt, Homo sapiens
gaagaugagagaccugcaa

SEQ ID NO: 349464 - RNA, 19 nt, Homo sapiens
cuagugggcaaccuucuua

SEQ ID NO: 349465 - RNA, 19 nt, Homo sapiens
gugggcaaccuucuuaauu

SEQ ID NO: 349466 - RNA, 19 nt, Homo sapiens
uuaagagaccgccauggua

SEQ ID NO: 349467 - RNA, 19 nt, Homo sapiens
gcugagaagcugcguggaa

SEQ ID NO: 349468 - RNA, 19 nt, Homo sapiens
gggaacuugcuguuucuaa

SEQ ID NO: 349469 - RNA, 19 nt, Homo sapiens
agaccgccaugguagguuu

SEQ ID NO: 349470 - RNA, 19 nt, Homo sapiens
ggaagagagcggcgaugug

SEQ ID NO: 349471 - RNA, 19 nt, Homo sapiens
cagcugcccaucuugaauu

SEQ ID NO: 349472 - RNA, 19 nt, Homo sapiens
cagauucucccauggguau

SEQ ID NO: 349473 - RNA, 19 nt, Homo sapiens
ccacguucuucuugcuuug

SEQ ID NO: 349474 - RNA, 19 nt, Homo sapiens
ugggaccuguggacaagua

SEQ ID NO: 349475 - RNA, 19 nt, Homo sapiens
gcucuaucauauccuggaa

SEQ ID NO: 349476 - RNA, 19 nt, Homo sapiens
guagguuucucuguagcuu

SEQ ID NO: 349477 - RNA, 19 nt, Homo sapiens
gcaccacguucuucuugcu

SEQ ID NO: 349478 - RNA, 19 nt, Homo sapiens
cagcaccacguucuucuug

SEQ ID NO: 349479 - RNA, 19 nt, Homo sapiens
uaugugagacccuggaaga

SEQ ID NO: 349480 - RNA, 19 nt, Homo sapiens
caacuaccgcgagcucuau

SEQ ID NO: 349481 - RNA, 19 nt, Homo sapiens
caucugaguugcccaucca

SEQ ID NO: 349482 - RNA, 19 nt, Homo sapiens
acaaguaccgaguaaggaa

SEQ ID NO: 349483 - RNA, 19 nt, Homo sapiens
accgcgagcucuaucauau

SEQ ID NO: 349484 - RNA, 19 nt, Homo sapiens
cgacagcgagugcgacauc

SEQ ID NO: 349485 - RNA, 19 nt, Homo sapiens
cagcgagugcgacaucuga

SEQ ID NO: 349486 - RNA, 19 nt, Homo sapiens
caaccuagugggcaaccuu

SEQ ID NO: 349487 - RNA, 19 nt, Homo sapiens
gacaaguaccgaguaagga

SEQ ID NO: 349488 - RNA, 19 nt, Homo sapiens
caugcaggcugguggugau

SEQ ID NO: 349489 - RNA, 19 nt, Homo sapiens
cugagcgccugcccagauu

SEQ ID NO: 349490 - RNA, 19 nt, Homo sapiens
cgagugcgacaucugaguu

SEQ ID NO: 349491 - RNA, 19 nt, Homo sapiens
caagaaugagucggugcua

SEQ ID NO: 349492 - RNA, 19 nt, Homo sapiens
gauucucccauggguauuu

SEQ ID NO: 349493 - RNA, 19 nt, Homo sapiens
cuacgcaggugggcaacug

SEQ ID NO: 349494 - RNA, 19 nt, Homo sapiens
ggacggcgaacagaagaca

SEQ ID NO: 349495 - RNA, 19 nt, Homo sapiens
gagaagccaaacaauaaaa

SEQ ID NO: 349496 - RNA, 19 nt, Homo sapiens
cgaaaggacgcuguuacau

SEQ ID NO: 349497 - RNA, 19 nt, Homo sapiens
cagaagcagauuccagugu

SEQ ID NO: 349498 - RNA, 19 nt, Homo sapiens
gugggcaacugguucaaaa

SEQ ID NO: 349499 - RNA, 19 nt, Homo sapiens
aggacgcuguuacauaugu

SEQ ID NO: 349500 - RNA, 19 nt, Homo sapiens
ugcaggauccauacccuaa

SEQ ID NO: 349501 - RNA, 19 nt, Homo sapiens
gguaccugcaggauccaua

SEQ ID NO: 349502 - RNA, 19 nt, Homo sapiens
ucgaaaggacgcuguuaca

SEQ ID NO: 349503 - RNA, 19 nt, Homo sapiens
gagugcgacaucugaguug

SEQ ID NO: 349504 - RNA, 19 nt, Homo sapiens
uaacaaagccaucuccuau

SEQ ID NO: 349505 - RNA, 19 nt, Homo sapiens
ucacugaccucuucuuugu

SEQ ID NO: 349506 - RNA, 19 nt, Homo sapiens
guuccaacauucagauuaa

SEQ ID NO: 349507 - RNA, 19 nt, Homo sapiens
gaagacuccuagauaaaca

SEQ ID NO: 349508 - RNA, 19 nt, Homo sapiens
ggauguuccuguccaugua

SEQ ID NO: 349509 - RNA, 19 nt, Homo sapiens
ugggaagacuccuagauaa

SEQ ID NO: 349510 - RNA, 19 nt, Homo sapiens
gaaaugugcucaucauccu

SEQ ID NO: 349511 - RNA, 19 nt, Homo sapiens
gggaagacuccuagauaaa

SEQ ID NO: 349512 - RNA, 19 nt, Homo sapiens
ccacagccaugagcccuaa

SEQ ID NO: 349513 - RNA, 19 nt, Homo sapiens
gcccuaagcucuguaucuu

SEQ ID NO: 349514 - RNA, 19 nt, Homo sapiens
ucugugagauguauguauu

SEQ ID NO: 349515 - RNA, 19 nt, Homo sapiens
gauggcauaugaccgcuau

SEQ ID NO: 349516 - RNA, 19 nt, Homo sapiens
uaucagagccauccucaga

SEQ ID NO: 349517 - RNA, 19 nt, Homo sapiens
acuccuagauaaacacuuu

SEQ ID NO: 349518 - RNA, 19 nt, Homo sapiens
ucagagccauccucagaau

SEQ ID NO: 349519 - RNA, 19 nt, Homo sapiens
gguccuauccguccucuau

SEQ ID NO: 349520 - RNA, 19 nt, Homo sapiens
cuccauaccuacucuguga

SEQ ID NO: 349521 - RNA, 19 nt, Homo sapiens
cagaauacccucagucucu

SEQ ID NO: 349522 - RNA, 19 nt, Homo sapiens
uggcugugauggcauauga

SEQ ID NO: 349523 - RNA, 19 nt, Homo sapiens
ggaagacuccuagauaaac

SEQ ID NO: 349524 - RNA, 19 nt, Homo sapiens
cacuacaucuucugugaga

SEQ ID NO: 349525 - RNA, 19 nt, Homo sapiens
acaaagccaucuccuaugc

SEQ ID NO: 349526 - RNA, 19 nt, Homo sapiens
agaauacccucagucucua

SEQ ID NO: 349527 - RNA, 19 nt, Homo sapiens
gauucgugaucauuuccua

SEQ ID NO: 349528 - RNA, 19 nt, Homo sapiens
auacacacccuccucauga

SEQ ID NO: 349529 - RNA, 19 nt, Homo sapiens
gauguaugcuguggugaca

SEQ ID NO: 349530 - RNA, 19 nt, Homo sapiens
gaauacccucagucucuaa

SEQ ID NO: 349531 - RNA, 19 nt, Homo sapiens
ggacacuuuguaugguaua

SEQ ID NO: 349532 - RNA, 19 nt, Homo sapiens
cugggaagacuccuagaua

SEQ ID NO: 349533 - RNA, 19 nt, Homo sapiens
ugggacacuuuguauggua

SEQ ID NO: 349534 - RNA, 19 nt, Homo sapiens
ccucagucucuaagaaaua

SEQ ID NO: 349535 - RNA, 19 nt, Homo sapiens
gccacaggcugcuucaucu

SEQ ID NO: 349536 - RNA, 19 nt, Homo sapiens
ccaagaugcuggugaaccu

SEQ ID NO: 349537 - RNA, 19 nt, Homo sapiens
gggacacuuuguaugguau

SEQ ID NO: 349538 - RNA, 19 nt, Homo sapiens
ccaccugugccucccauuu

SEQ ID NO: 349539 - RNA, 19 nt, Homo sapiens
cucuguaucuuacuccuuu

SEQ ID NO: 349540 - RNA, 19 nt, Homo sapiens
ugacgcagcucuacuuccu

SEQ ID NO: 349541 - RNA, 19 nt, Homo sapiens
ucacgguggugggaaaugu

SEQ ID NO: 349542 - RNA, 19 nt, Homo sapiens
uaaagccccuccauaccua

SEQ ID NO: 349543 - RNA, 19 nt, Homo sapiens
uccacuacaucuucuguga

SEQ ID NO: 349544 - RNA, 19 nt, Homo sapiens
ggugggaaaugugcucauc

SEQ ID NO: 349545 - RNA, 19 nt, Homo sapiens
uuuccuaugugcugauuau

SEQ ID NO: 349546 - RNA, 19 nt, Homo sapiens
ccaacauucagauuaauca

SEQ ID NO: 349547 - RNA, 19 nt, Homo sapiens
guaucuuacuccuuuccuu

SEQ ID NO: 349548 - RNA, 19 nt, Homo sapiens
gugaaccuccagucccaua

SEQ ID NO: 349549 - RNA, 19 nt, Homo sapiens
ggaggcaaccagagugaag

SEQ ID NO: 349550 - RNA, 19 nt, Homo sapiens
uacccucagucucuaagaa

SEQ ID NO: 349551 - RNA, 19 nt, Homo sapiens
ugacacccaugaugaaucc

SEQ ID NO: 349552 - RNA, 19 nt, Homo sapiens
ggauggaggcaaccagagu

SEQ ID NO: 349553 - RNA, 19 nt, Homo sapiens
ccuccagucccauaacaaa

SEQ ID NO: 349554 - RNA, 19 nt, Homo sapiens
ccucauucccuuuggauuc

SEQ ID NO: 349555 - RNA, 19 nt, Homo sapiens
ugggaaaugugcucaucau

SEQ ID NO: 349556 - RNA, 19 nt, Homo sapiens
caccugugccucccauuug

SEQ ID NO: 349557 - RNA, 19 nt, Homo sapiens
cagagccauccucagaaua

SEQ ID NO: 349558 - RNA, 19 nt, Homo sapiens
cgugaucauuuccuaugug

SEQ ID NO: 349559 - RNA, 19 nt, Homo sapiens
cauacacacccuccucaug

SEQ ID NO: 349560 - RNA, 19 nt, Homo sapiens
cuccuucacugaccucuuc

SEQ ID NO: 349561 - RNA, 19 nt, Homo sapiens
cagucucccucuucuaugg

SEQ ID NO: 349562 - RNA, 19 nt, Homo sapiens
gcagucucccucuucuaug

SEQ ID NO: 349563 - RNA, 19 nt, Homo sapiens
auaacaaagccaucuccua

SEQ ID NO: 349564 - RNA, 19 nt, Homo sapiens
uaugggacacuuuguaugg

SEQ ID NO: 349565 - RNA, 19 nt, Homo sapiens
gcauggggcucugggaaga

SEQ ID NO: 349566 - RNA, 19 nt, Homo sapiens
ggugcagucucccucuucu

SEQ ID NO: 349567 - RNA, 19 nt, Homo sapiens
gaaccuccagucccauaac

SEQ ID NO: 349568 - RNA, 19 nt, Homo sapiens
ucuaugggacacuuuguau

SEQ ID NO: 349569 - RNA, 19 nt, Homo sapiens
acacagauguauuucguuu

SEQ ID NO: 349570 - RNA, 19 nt, Homo sapiens
gcugauggcuccacucuca

SEQ ID NO: 349571 - RNA, 19 nt, Homo sapiens
ggacaaaccagucgagugu

SEQ ID NO: 349572 - RNA, 19 nt, Homo sapiens
ccaagaugcuggccaauca

SEQ ID NO: 349573 - RNA, 19 nt, Homo sapiens
gcuaaacccuuucaucuac

SEQ ID NO: 349574 - RNA, 19 nt, Homo sapiens
gcauguaccuggccacugu

SEQ ID NO: 349575 - RNA, 19 nt, Homo sapiens
gcagcagcaucuccucuuu

SEQ ID NO: 349576 - RNA, 19 nt, Homo sapiens
cauccuggcuucuuauaug

SEQ ID NO: 349577 - RNA, 19 nt, Homo sapiens
gauggccuaugaccacuuu

SEQ ID NO: 349578 - RNA, 19 nt, Homo sapiens
gcaccaucauugcugugua

SEQ ID NO: 349579 - RNA, 19 nt, Homo sapiens
gaugcuggccaaucacaua

SEQ ID NO: 349580 - RNA, 19 nt, Homo sapiens
uagcugugauggccuauga

SEQ ID NO: 349581 - RNA, 19 nt, Homo sapiens
ucacacagauguauuucgu

SEQ ID NO: 349582 - RNA, 19 nt, Homo sapiens
gcugguugcuggauuaugg

SEQ ID NO: 349583 - RNA, 19 nt, Homo sapiens
cauggacaauuuccuccua

SEQ ID NO: 349584 - RNA, 19 nt, Homo sapiens
ucguggacauggacaauuu

SEQ ID NO: 349585 - RNA, 19 nt, Homo sapiens
gaggaacagguacuugaaa

SEQ ID NO: 349586 - RNA, 19 nt, Homo sapiens
cacuauggcuacuguguug

SEQ ID NO: 349587 - RNA, 19 nt, Homo sapiens
gaaagacacuauggcuacu

SEQ ID NO: 349588 - RNA, 19 nt, Homo sapiens
cagcaucuccucuuugugu

SEQ ID NO: 349589 - RNA, 19 nt, Homo sapiens
guagugacucccaugcuaa

SEQ ID NO: 349590 - RNA, 19 nt, Homo sapiens
caccaucauugcuguguau

SEQ ID NO: 349591 - RNA, 19 nt, Homo sapiens
gaaggucccauccacaaag

SEQ ID NO: 349592 - RNA, 19 nt, Homo sapiens
ccugcugguugcuggauua

SEQ ID NO: 349593 - RNA, 19 nt, Homo sapiens
gacaucugcuucuccuuca

SEQ ID NO: 349594 - RNA, 19 nt, Homo sapiens
aguagugacucccaugcua

SEQ ID NO: 349595 - RNA, 19 nt, Homo sapiens
ugccaucacucacuucuuc

SEQ ID NO: 349596 - RNA, 19 nt, Homo sapiens
caaccugaauguccuucug

SEQ ID NO: 349597 - RNA, 19 nt, Homo sapiens
caucauugcuguguauuuu

SEQ ID NO: 349598 - RNA, 19 nt, Homo sapiens
acaaugccaucacucacuu

SEQ ID NO: 349599 - RNA, 19 nt, Homo sapiens
cauccuguccguaagcaua

SEQ ID NO: 349600 - RNA, 19 nt, Homo sapiens
cagcugagaaagacacuau

SEQ ID NO: 349601 - RNA, 19 nt, Homo sapiens
cagacacacaccucaauga

SEQ ID NO: 349602 - RNA, 19 nt, Homo sapiens
aaacucuccugcucagaca

SEQ ID NO: 349603 - RNA, 19 nt, Homo sapiens
caccugcacuguccugaag

SEQ ID NO: 349604 - RNA, 19 nt, Homo sapiens
uggcuacuguguuguauac

SEQ ID NO: 349605 - RNA, 19 nt, Homo sapiens
acaaaccagucgagugucu

SEQ ID NO: 349606 - RNA, 19 nt, Homo sapiens
uuugcauccuggcuucuua

SEQ ID NO: 349607 - RNA, 19 nt, Homo sapiens
gaggucauaauccuuagug

SEQ ID NO: 349608 - RNA, 19 nt, Homo sapiens
ugaggaacagguacuugaa

SEQ ID NO: 349609 - RNA, 19 nt, Homo sapiens
ugaaggucccauccacaaa

SEQ ID NO: 349610 - RNA, 19 nt, Homo sapiens
gcucagacacacaccucaa

SEQ ID NO: 349611 - RNA, 19 nt, Homo sapiens
cagacaaugccaucacuca

SEQ ID NO: 349612 - RNA, 19 nt, Homo sapiens
agacucagaccaucuccuu

SEQ ID NO: 349613 - RNA, 19 nt, Homo sapiens
aggaacagguacuugaaag

SEQ ID NO: 349614 - RNA, 19 nt, Homo sapiens
cuaaacccuuucaucuaca

SEQ ID NO: 349615 - RNA, 19 nt, Homo sapiens
gcagggugguguuuucugu

SEQ ID NO: 349616 - RNA, 19 nt, Homo sapiens
ggaacagguacuugaaagg

SEQ ID NO: 349617 - RNA, 19 nt, Homo sapiens
aagacacuauggcuacugu

SEQ ID NO: 349618 - RNA, 19 nt, Homo sapiens
gcugagaaagacacuaugg

SEQ ID NO: 349619 - RNA, 19 nt, Homo sapiens
ggaaccugcucaucauccu

SEQ ID NO: 349620 - RNA, 19 nt, Homo sapiens
cagcagcaucuccucuuug

SEQ ID NO: 349621 - RNA, 19 nt, Homo sapiens
gcauccuggcuucuuauau

SEQ ID NO: 349622 - RNA, 19 nt, Homo sapiens
gacaaugccaucacucacu

SEQ ID NO: 349623 - RNA, 19 nt, Homo sapiens
cauuacacagcaaagauga

SEQ ID NO: 349624 - RNA, 19 nt, Homo sapiens
ugcuaaacccuuucaucua

SEQ ID NO: 349625 - RNA, 19 nt, Homo sapiens
ccaucauugcuguguauuu

SEQ ID NO: 349626 - RNA, 19 nt, Homo sapiens
acaaagggaagguggaaag

SEQ ID NO: 349627 - RNA, 19 nt, Homo sapiens
agucgagugucuccgaguu

SEQ ID NO: 349628 - RNA, 19 nt, Homo sapiens
agcagcaucuccucuuugu

SEQ ID NO: 349629 - RNA, 19 nt, Homo sapiens
cugaggaacagguacuuga

SEQ ID NO: 349630 - RNA, 19 nt, Homo sapiens
cuauggcuacuguguugua

SEQ ID NO: 349631 - RNA, 19 nt, Homo sapiens
ucagcaaccugucuuuugu

SEQ ID NO: 349632 - RNA, 19 nt, Homo sapiens
guauuucguuuucauguuc

SEQ ID NO: 349633 - RNA, 19 nt, Homo sapiens
acagauguauuucguuuuc

SEQ ID NO: 349634 - RNA, 19 nt, Homo sapiens
ucagacacacaccucaaug

SEQ ID NO: 349635 - RNA, 19 nt, Homo sapiens
ggacaauuuccuccuagcu

SEQ ID NO: 349636 - RNA, 19 nt, Homo sapiens
gaacucaaccaucaucuug

SEQ ID NO: 349637 - RNA, 19 nt, Homo sapiens
uaacccagcucuaugucuu

SEQ ID NO: 349638 - RNA, 19 nt, Homo sapiens
gcaaguucauuucccuguu

SEQ ID NO: 349639 - RNA, 19 nt, Homo sapiens
gaccagggcaaguucauuu

SEQ ID NO: 349640 - RNA, 19 nt, Homo sapiens
caaccaggcugugcucaau

SEQ ID NO: 349641 - RNA, 19 nt, Homo sapiens
gcagggcuuuguucugaug

SEQ ID NO: 349642 - RNA, 19 nt, Homo sapiens
caaguucauuucccuguuc

SEQ ID NO: 349643 - RNA, 19 nt, Homo sapiens
cgaaaggcguucaauacgu

SEQ ID NO: 349644 - RNA, 19 nt, Homo sapiens
cgaggugccugccaugauc

SEQ ID NO: 349645 - RNA, 19 nt, Homo sapiens
gccauccucuucuccuauu

SEQ ID NO: 349646 - RNA, 19 nt, Homo sapiens
ucagcaaccucuccuccuu

SEQ ID NO: 349647 - RNA, 19 nt, Homo sapiens
uugcagggcuuuguucuga

SEQ ID NO: 349648 - RNA, 19 nt, Homo sapiens
cuugggaacucaaccauca

SEQ ID NO: 349649 - RNA, 19 nt, Homo sapiens
gaucuccuacugccucauu

SEQ ID NO: 349650 - RNA, 19 nt, Homo sapiens
caaccaucaucuugcuuuc

SEQ ID NO: 349651 - RNA, 19 nt, Homo sapiens
ggaacucaaccaucaucuu

SEQ ID NO: 349652 - RNA, 19 nt, Homo sapiens
ggcgaaaggcguucaauac

SEQ ID NO: 349653 - RNA, 19 nt, Homo sapiens
ggaccaggcaagaccauca

SEQ ID NO: 349654 - RNA, 19 nt, Homo sapiens
gggaaaggaagagaaguug

SEQ ID NO: 349655 - RNA, 19 nt, Homo sapiens
ucaaccaucaucuugcuuu

SEQ ID NO: 349656 - RNA, 19 nt, Homo sapiens
ggcaagaccaucagcuaug

SEQ ID NO: 349657 - RNA, 19 nt, Homo sapiens
gugauccagucaacauuca

SEQ ID NO: 349658 - RNA, 19 nt, Homo sapiens
uagccauccucuucuccua

SEQ ID NO: 349659 - RNA, 19 nt, Homo sapiens
ucauuucccuguucuacuc

SEQ ID NO: 349660 - RNA, 19 nt, Homo sapiens
ccagcucuaugucuuccuu

SEQ ID NO: 349661 - RNA, 19 nt, Homo sapiens
ggaccagggcaaguucauu

SEQ ID NO: 349662 - RNA, 19 nt, Homo sapiens
gcagucccacuaagcauca

SEQ ID NO: 349663 - RNA, 19 nt, Homo sapiens
ucacugcagucccacuaag

SEQ ID NO: 349664 - RNA, 19 nt, Homo sapiens
caggcaagaccaucagcua

SEQ ID NO: 349665 - RNA, 19 nt, Homo sapiens
auacgugccucucccaucu

SEQ ID NO: 349666 - RNA, 19 nt, Homo sapiens
cugcauaacccagcucuau

SEQ ID NO: 349667 - RNA, 19 nt, Homo sapiens
gcgaaaggcguucaauacg

SEQ ID NO: 349668 - RNA, 19 nt, Homo sapiens
aggcgaaaggcguucaaua

SEQ ID NO: 349669 - RNA, 19 nt, Homo sapiens
gacccuacuugggaacuca

SEQ ID NO: 349670 - RNA, 19 nt, Homo sapiens
gcgaggugccugccaugau

SEQ ID NO: 349671 - RNA, 19 nt, Homo sapiens
gcuacaccgccaucaugaa

SEQ ID NO: 349672 - RNA, 19 nt, Homo sapiens
ccgcuacaccgccaucaug

SEQ ID NO: 349673 - RNA, 19 nt, Homo sapiens
ugaaugauagcuccuugca

SEQ ID NO: 349674 - RNA, 19 nt, Homo sapiens
ggugguguuccucuucuau

SEQ ID NO: 349675 - RNA, 19 nt, Homo sapiens
gcuuuguucugaugagcau

SEQ ID NO: 349676 - RNA, 19 nt, Homo sapiens
ccuauuugcugacccuacu

SEQ ID NO: 349677 - RNA, 19 nt, Homo sapiens
ggauaaagcuguuggaauu

SEQ ID NO: 349678 - RNA, 19 nt, Homo sapiens
caaccaagcuuucagacaa

SEQ ID NO: 349679 - RNA, 19 nt, Homo sapiens
gaacagucauugcugaguu

SEQ ID NO: 349680 - RNA, 19 nt, Homo sapiens
guucagguaucuuuaacua

SEQ ID NO: 349681 - RNA, 19 nt, Homo sapiens
ucaaugagcugcugcuuuu

SEQ ID NO: 349682 - RNA, 19 nt, Homo sapiens
ucacugugguugccauauu

SEQ ID NO: 349683 - RNA, 19 nt, Homo sapiens
cagcgucacuguuccauca

SEQ ID NO: 349684 - RNA, 19 nt, Homo sapiens
ccaaucaucuacagcuuca

SEQ ID NO: 349685 - RNA, 19 nt, Homo sapiens
agacaaggauaaagcuguu

SEQ ID NO: 349686 - RNA, 19 nt, Homo sapiens
gauaaagcuguuggaauuu

SEQ ID NO: 349687 - RNA, 19 nt, Homo sapiens
ugaccgccauggccuauga

SEQ ID NO: 349688 - RNA, 19 nt, Homo sapiens
uuucaacacugucaucaau

SEQ ID NO: 349689 - RNA, 19 nt, Homo sapiens
uuacccagcucuucuucuu

SEQ ID NO: 349690 - RNA, 19 nt, Homo sapiens
gcagccaguugucuuugug

SEQ ID NO: 349691 - RNA, 19 nt, Homo sapiens
gaucaaucacuucuacugu

SEQ ID NO: 349692 - RNA, 19 nt, Homo sapiens
guagagggcaggaagaaag

SEQ ID NO: 349693 - RNA, 19 nt, Homo sapiens
guccugggcuugugcuuuc

SEQ ID NO: 349694 - RNA, 19 nt, Homo sapiens
gaaagccuucuccacaugu

SEQ ID NO: 349695 - RNA, 19 nt, Homo sapiens
gaaccuaucagugcuggau

SEQ ID NO: 349696 - RNA, 19 nt, Homo sapiens
ucauugucaucuccuauau

SEQ ID NO: 349697 - RNA, 19 nt, Homo sapiens
cauggccuaugaccaauuc

SEQ ID NO: 349698 - RNA, 19 nt, Homo sapiens
cuacagcacccgcaugagu

SEQ ID NO: 349699 - RNA, 19 nt, Homo sapiens
cauccuggcagcugucuug

SEQ ID NO: 349700 - RNA, 19 nt, Homo sapiens
gcugcagccaguugucuuu

SEQ ID NO: 349701 - RNA, 19 nt, Homo sapiens
guucaaccaagcuuucaga

SEQ ID NO: 349702 - RNA, 19 nt, Homo sapiens
uuugugcucuuccucuuug

SEQ ID NO: 349703 - RNA, 19 nt, Homo sapiens
ccauggcucucauugucau

SEQ ID NO: 349704 - RNA, 19 nt, Homo sapiens
gggcuugugcuuucaccaa

SEQ ID NO: 349705 - RNA, 19 nt, Homo sapiens
cgccauggccuaugaccaa

SEQ ID NO: 349706 - RNA, 19 nt, Homo sapiens
cacugugguugccauauuc

SEQ ID NO: 349707 - RNA, 19 nt, Homo sapiens
uguccacgcucaacuucug

SEQ ID NO: 349708 - RNA, 19 nt, Homo sapiens
ucacuguuccaucaauguu

SEQ ID NO: 349709 - RNA, 19 nt, Homo sapiens
cgucacuguuccaucaaug

SEQ ID NO: 349710 - RNA, 19 nt, Homo sapiens
ucaacacugucaucaaucc

SEQ ID NO: 349711 - RNA, 19 nt, Homo sapiens
agucauugcugaguucauc

SEQ ID NO: 349712 - RNA, 19 nt, Homo sapiens
ccagcacccaacucaauga

SEQ ID NO: 349713 - RNA, 19 nt, Homo sapiens
caacuucuguggccccaau

SEQ ID NO: 349714 - RNA, 19 nt, Homo sapiens
gcgucacuguuccaucaau

SEQ ID NO: 349715 - RNA, 19 nt, Homo sapiens
gugcaucagcgucacuguu

SEQ ID NO: 349716 - RNA, 19 nt, Homo sapiens
ggaacagucauugcugagu

SEQ ID NO: 349717 - RNA, 19 nt, Homo sapiens
ucaucaaucccaugcugaa

SEQ ID NO: 349718 - RNA, 19 nt, Homo sapiens
ccaaugaggucaaucacuu

SEQ ID NO: 349719 - RNA, 19 nt, Homo sapiens
gaagagaugcagccaguug

SEQ ID NO: 349720 - RNA, 19 nt, Homo sapiens
ggaccgcuguugcugaguu

SEQ ID NO: 349721 - RNA, 19 nt, Homo sapiens
gcugaacccucuuaucuac

SEQ ID NO: 349722 - RNA, 19 nt, Homo sapiens
ucccacaaguccacaauuu

SEQ ID NO: 349723 - RNA, 19 nt, Homo sapiens
agagguaucuucaacuaca

SEQ ID NO: 349724 - RNA, 19 nt, Homo sapiens
cguggcagcugcaguucua

SEQ ID NO: 349725 - RNA, 19 nt, Homo sapiens
ugaccgccauggccuauga

SEQ ID NO: 349726 - RNA, 19 nt, Homo sapiens
ggugcucuguggcaaauau

SEQ ID NO: 349727 - RNA, 19 nt, Homo sapiens
gcagccaguugucuuugug

SEQ ID NO: 349728 - RNA, 19 nt, Homo sapiens
agaggaggcuucagacaag

SEQ ID NO: 349729 - RNA, 19 nt, Homo sapiens
aauguugggucgucucuug

SEQ ID NO: 349730 - RNA, 19 nt, Homo sapiens
gaagcugggaccaauagga

SEQ ID NO: 349731 - RNA, 19 nt, Homo sapiens
guucagaggaggcuucaga

SEQ ID NO: 349732 - RNA, 19 nt, Homo sapiens
ccacguggcagcugcaguu

SEQ ID NO: 349733 - RNA, 19 nt, Homo sapiens
gaugcagccaguugucuuu

SEQ ID NO: 349734 - RNA, 19 nt, Homo sapiens
cagaggaggcuucagacaa

SEQ ID NO: 349735 - RNA, 19 nt, Homo sapiens
gcucuuugcuguggguuuc

SEQ ID NO: 349736 - RNA, 19 nt, Homo sapiens
cagcugcaguucuacgaau

SEQ ID NO: 349737 - RNA, 19 nt, Homo sapiens
gcacaccuuugguucucau

SEQ ID NO: 349738 - RNA, 19 nt, Homo sapiens
aguccacaauuuccuauga

SEQ ID NO: 349739 - RNA, 19 nt, Homo sapiens
acacuguuaucaacccuau

SEQ ID NO: 349740 - RNA, 19 nt, Homo sapiens
ugaggucaaucacuucuac

SEQ ID NO: 349741 - RNA, 19 nt, Homo sapiens
ucucccagcucuucuucuu

SEQ ID NO: 349742 - RNA, 19 nt, Homo sapiens
ucacuguuccugcaauguu

SEQ ID NO: 349743 - RNA, 19 nt, Homo sapiens
cuacugggccuagugcaaa

SEQ ID NO: 349744 - RNA, 19 nt, Homo sapiens
uaucuucaacuacaugaga

SEQ ID NO: 349745 - RNA, 19 nt, Homo sapiens
ggucaaucacuucuacugu

SEQ ID NO: 349746 - RNA, 19 nt, Homo sapiens
uaaagggguuggaguuuuc

SEQ ID NO: 349747 - RNA, 19 nt, Homo sapiens
cuacagcacccgcaugagu

SEQ ID NO: 349748 - RNA, 19 nt, Homo sapiens
gagguaucuucaacuacau

SEQ ID NO: 349749 - RNA, 19 nt, Homo sapiens
cagaagcugggaccaauag

SEQ ID NO: 349750 - RNA, 19 nt, Homo sapiens
uggcugggauggacugcuu

SEQ ID NO: 349751 - RNA, 19 nt, Homo sapiens
ugaacccucuuaucuacag

SEQ ID NO: 349752 - RNA, 19 nt, Homo sapiens
cauccuggcagccgucuug

SEQ ID NO: 349753 - RNA, 19 nt, Homo sapiens
gaaccugucagugcuggau

SEQ ID NO: 349754 - RNA, 19 nt, Homo sapiens
ccuaugcugaacccucuua

SEQ ID NO: 349755 - RNA, 19 nt, Homo sapiens
gggccuagugcaaacagaa

SEQ ID NO: 349756 - RNA, 19 nt, Homo sapiens
gcagcugcaguucuacgaa

SEQ ID NO: 349757 - RNA, 19 nt, Homo sapiens
uguccacgcucaacuucug

SEQ ID NO: 349758 - RNA, 19 nt, Homo sapiens
acaaguccacaauuuccua

SEQ ID NO: 349759 - RNA, 19 nt, Homo sapiens
cacuguuccugcaauguug

SEQ ID NO: 349760 - RNA, 19 nt, Homo sapiens
gaccgcuguugcugaguuc

SEQ ID NO: 349761 - RNA, 19 nt, Homo sapiens
gauaaagggguuggaguuu

SEQ ID NO: 349762 - RNA, 19 nt, Homo sapiens
ggauaaagggguuggaguu

SEQ ID NO: 349763 - RNA, 19 nt, Homo sapiens
acaugagacuggguucaga

SEQ ID NO: 349764 - RNA, 19 nt, Homo sapiens
ccagcacccaacucaauga

SEQ ID NO: 349765 - RNA, 19 nt, Homo sapiens
caaguccacaauuuccuau

SEQ ID NO: 349766 - RNA, 19 nt, Homo sapiens
gauguaucacugucacugu

SEQ ID NO: 349767 - RNA, 19 nt, Homo sapiens
caacuucuguggccccaau

SEQ ID NO: 349768 - RNA, 19 nt, Homo sapiens
uaucaacccuaugcugaac

SEQ ID NO: 349769 - RNA, 19 nt, Homo sapiens
ggcaggcacaccuuugguu

SEQ ID NO: 349770 - RNA, 19 nt, Homo sapiens
caaugaggucaaucacuuc

SEQ ID NO: 349771 - RNA, 19 nt, Homo sapiens
ccacaaguccacaauuucc

SEQ ID NO: 349772 - RNA, 19 nt, Homo sapiens
ggaaauggcucucauguau

SEQ ID NO: 349773 - RNA, 19 nt, Homo sapiens
ggaaguacauggaauuguu

SEQ ID NO: 349774 - RNA, 19 nt, Homo sapiens
gaacaggaauuccaagaca

SEQ ID NO: 349775 - RNA, 19 nt, Homo sapiens
uaagaaacgugcucgagua

SEQ ID NO: 349776 - RNA, 19 nt, Homo sapiens
ucacgaaggugccaaagaa

SEQ ID NO: 349777 - RNA, 19 nt, Homo sapiens
gagaucaccucaccuucua

SEQ ID NO: 349778 - RNA, 19 nt, Homo sapiens
gcagagagcccuucuugga

SEQ ID NO: 349779 - RNA, 19 nt, Homo sapiens
cuaaauugcuugaguuguu

SEQ ID NO: 349780 - RNA, 19 nt, Homo sapiens
uccaagacaucuacaauuu

SEQ ID NO: 349781 - RNA, 19 nt, Homo sapiens
cgacugaggcugcauguuu

SEQ ID NO: 349782 - RNA, 19 nt, Homo sapiens
cagcuucgguuucuaggua

SEQ ID NO: 349783 - RNA, 19 nt, Homo sapiens
agacagggcuucaccaugu

SEQ ID NO: 349784 - RNA, 19 nt, Homo sapiens
caacagauauauagucaac

SEQ ID NO: 349785 - RNA, 19 nt, Homo sapiens
uaccaaaccuauagagaaa

SEQ ID NO: 349786 - RNA, 19 nt, Homo sapiens
gaagccacguuucaacaga

SEQ ID NO: 349787 - RNA, 19 nt, Homo sapiens
ugaagucccugccuguaaa

SEQ ID NO: 349788 - RNA, 19 nt, Homo sapiens
gaagguagcagcacugucu

SEQ ID NO: 349789 - RNA, 19 nt, Homo sapiens
gcaaacuccuugaccauac

SEQ ID NO: 349790 - RNA, 19 nt, Homo sapiens
gcuggagcuuggcaacuua

SEQ ID NO: 349791 - RNA, 19 nt, Homo sapiens
aaacuauccuggaaugaga

SEQ ID NO: 349792 - RNA, 19 nt, Homo sapiens
gaaacgugcucgaguacag

SEQ ID NO: 349793 - RNA, 19 nt, Homo sapiens
gaaauggcucucauguauu

SEQ ID NO: 349794 - RNA, 19 nt, Homo sapiens
uaaaggggcuucacaaguu

SEQ ID NO: 349795 - RNA, 19 nt, Homo sapiens
ccaaaccuauagagaaaug

SEQ ID NO: 349796 - RNA, 19 nt, Homo sapiens
caucguauccgcagaaaga

SEQ ID NO: 349797 - RNA, 19 nt, Homo sapiens
caggaaauauucugguaug

SEQ ID NO: 349798 - RNA, 19 nt, Homo sapiens
ucacaaacaagacauaaug

SEQ ID NO: 349799 - RNA, 19 nt, Homo sapiens
gagcuuggcaacuuaggua

SEQ ID NO: 349800 - RNA, 19 nt, Homo sapiens
gagauucacauccagauug

SEQ ID NO: 349801 - RNA, 19 nt, Homo sapiens
agacuggacucucuuauac

SEQ ID NO: 349802 - RNA, 19 nt, Homo sapiens
gugaaacuauccuggaaug

SEQ ID NO: 349803 - RNA, 19 nt, Homo sapiens
cacaggaaauauucuggua

SEQ ID NO: 349804 - RNA, 19 nt, Homo sapiens
caccauagcccacucaaug

SEQ ID NO: 349805 - RNA, 19 nt, Homo sapiens
gacaguuuguguugauuga

SEQ ID NO: 349806 - RNA, 19 nt, Homo sapiens
gauauauagucaacaugug

SEQ ID NO: 349807 - RNA, 19 nt, Homo sapiens
gcccguaguuguagaagga

SEQ ID NO: 349808 - RNA, 19 nt, Homo sapiens
gaauggaaauggcucucau

SEQ ID NO: 349809 - RNA, 19 nt, Homo sapiens
ccagguggcugaaacuaca

SEQ ID NO: 349810 - RNA, 19 nt, Homo sapiens
caagacaucuacaauuuug

SEQ ID NO: 349811 - RNA, 19 nt, Homo sapiens
ccaagaagagaaagagauu

SEQ ID NO: 349812 - RNA, 19 nt, Homo sapiens
cugauaaacuucaaaccuu

SEQ ID NO: 349813 - RNA, 19 nt, Homo sapiens
gcacuccgccuccaaaucu

SEQ ID NO: 349814 - RNA, 19 nt, Homo sapiens
gaccaucauuggccuuguu

SEQ ID NO: 349815 - RNA, 19 nt, Homo sapiens
gaaguacauggaauuguug

SEQ ID NO: 349816 - RNA, 19 nt, Homo sapiens
ggaaaccaccguccugcuu

SEQ ID NO: 349817 - RNA, 19 nt, Homo sapiens
caccucaccuucuaagaga

SEQ ID NO: 349818 - RNA, 19 nt, Homo sapiens
ccacuuuccucagaacuau

SEQ ID NO: 349819 - RNA, 19 nt, Homo sapiens
guucgaagaugacucugau

SEQ ID NO: 349820 - RNA, 19 nt, Homo sapiens
cuacaaagcaucugauuuu

SEQ ID NO: 349821 - RNA, 19 nt, Homo sapiens
ccucagauccguagucgaa

SEQ ID NO: 349822 - RNA, 19 nt, Homo sapiens
caauggaagcuguggauga

SEQ ID NO: 349823 - RNA, 19 nt, Homo sapiens
gcaggcagcccaagccaau

SEQ ID NO: 349824 - RNA, 19 nt, Homo sapiens
ggaaauauucugguaugau

SEQ ID NO: 349825 - RNA, 19 nt, Homo sapiens
gagccauccucgcagaguu

SEQ ID NO: 349826 - RNA, 19 nt, Homo sapiens
caaugauguuccucccuuu

SEQ ID NO: 349827 - RNA, 19 nt, Homo sapiens
cggaagccauggcacacua

SEQ ID NO: 349828 - RNA, 19 nt, Homo sapiens
agaguucugucuugacuau

SEQ ID NO: 349829 - RNA, 19 nt, Homo sapiens
cuaccaaaccuauagagaa

SEQ ID NO: 349830 - RNA, 19 nt, Homo sapiens
gcuuccagcccuauacaua

SEQ ID NO: 349831 - RNA, 19 nt, Homo sapiens
gacugaggcugcauguuuc

SEQ ID NO: 349832 - RNA, 19 nt, Homo sapiens
ccaaggagagcacccagaa

SEQ ID NO: 349833 - RNA, 19 nt, Homo sapiens
aaagagggaugcaaaagaa

SEQ ID NO: 349834 - RNA, 19 nt, Homo sapiens
gugcagagagcccuucuug

SEQ ID NO: 349835 - RNA, 19 nt, Homo sapiens
gaaacuauccuggaaugag

SEQ ID NO: 349836 - RNA, 19 nt, Homo sapiens
uaaauugcuugaguuguuc

SEQ ID NO: 349837 - RNA, 19 nt, Homo sapiens
acccguauguugcuaaauu

SEQ ID NO: 349838 - RNA, 19 nt, Homo sapiens
gaugaaaacccguauguug

SEQ ID NO: 349839 - RNA, 19 nt, Homo sapiens
gaaguuuucuuuucuccuu

SEQ ID NO: 349840 - RNA, 19 nt, Homo sapiens
uugaagucauccuuacaua

SEQ ID NO: 349841 - RNA, 19 nt, Homo sapiens
agagaggagagaacacuua

SEQ ID NO: 349842 - RNA, 19 nt, Homo sapiens
ucaugugccuccuuggauu

SEQ ID NO: 349843 - RNA, 19 nt, Homo sapiens
guauguugcuaaauugcuu

SEQ ID NO: 349844 - RNA, 19 nt, Homo sapiens
ggaagacugccacuguuca

SEQ ID NO: 349845 - RNA, 19 nt, Homo sapiens
ggagaucaccucaccuucu

SEQ ID NO: 349846 - RNA, 19 nt, Homo sapiens
gugaagucccugccuguaa

SEQ ID NO: 349847 - RNA, 19 nt, Homo sapiens
ggacaguuuguguugauug

SEQ ID NO: 349848 - RNA, 19 nt, Homo sapiens
ggaggaagccacguuucaa

SEQ ID NO: 349849 - RNA, 19 nt, Homo sapiens
ggagagcacccagaacugu

SEQ ID NO: 349850 - RNA, 19 nt, Homo sapiens
ucaggccacuuuccucaga

SEQ ID NO: 349851 - RNA, 19 nt, Homo sapiens
ccaccgagauucacaucca

SEQ ID NO: 349852 - RNA, 19 nt, Homo sapiens
ccacguuucaacagauaua

SEQ ID NO: 349853 - RNA, 19 nt, Homo sapiens
uggaugagcucgaccuucu

SEQ ID NO: 349854 - RNA, 19 nt, Homo sapiens
gacagggcuucaccauguu

SEQ ID NO: 349855 - RNA, 19 nt, Homo sapiens
aaacccguauguugcuaaa

SEQ ID NO: 349856 - RNA, 19 nt, Homo sapiens
caccaugcccagcugauuu

SEQ ID NO: 349857 - RNA, 19 nt, Homo sapiens
ggaauuccaagacaucuac

SEQ ID NO: 349858 - RNA, 19 nt, Homo sapiens
auacugaggaugacaagaa

SEQ ID NO: 349859 - RNA, 19 nt, Homo sapiens
ucucuuauacugaggauga

SEQ ID NO: 349860 - RNA, 19 nt, Homo sapiens
gcacuaccaaaccuauaga

SEQ ID NO: 349861 - RNA, 19 nt, Homo sapiens
gauuggacaguuuguguug

SEQ ID NO: 349862 - RNA, 19 nt, Homo sapiens
acucugauccuccuccuaa

SEQ ID NO: 349863 - RNA, 19 nt, Homo sapiens
ccaggaugaugugcuguau

SEQ ID NO: 349864 - RNA, 19 nt, Homo sapiens
auacaucacggccaucaaa

SEQ ID NO: 349865 - RNA, 19 nt, Homo sapiens
gacugccacuguucaugaa

SEQ ID NO: 349866 - RNA, 19 nt, Homo sapiens
ggcuggagcuuggcaacuu

SEQ ID NO: 349867 - RNA, 19 nt, Homo sapiens
cuagugagacacacgcuuu

SEQ ID NO: 349868 - RNA, 19 nt, Homo sapiens
gacacucuuugugaaacua

SEQ ID NO: 349869 - RNA, 19 nt, Homo sapiens
gcagcacugucuggagaug

SEQ ID NO: 349870 - RNA, 19 nt, Homo sapiens
gcacaucuugcagaagcua

SEQ ID NO: 349871 - RNA, 19 nt, Homo sapiens
gaagucauccuuacauacc

SEQ ID NO: 349872 - RNA, 19 nt, Homo sapiens
gaagaaaccuccuaugaga

SEQ ID NO: 349873 - RNA, 19 nt, Homo sapiens
gaagggaacugauggagua

SEQ ID NO: 349874 - RNA, 19 nt, Homo sapiens
gggaagagauguucaagaa

SEQ ID NO: 349875 - RNA, 19 nt, Homo sapiens
gaagaaugauccugagauu

SEQ ID NO: 349876 - RNA, 19 nt, Homo sapiens
gaagagauguucaagaauc

SEQ ID NO: 349877 - RNA, 19 nt, Homo sapiens
ggauaacccuucuuacauu

SEQ ID NO: 349878 - RNA, 19 nt, Homo sapiens
gagggcaggucaucucuua

SEQ ID NO: 349879 - RNA, 19 nt, Homo sapiens
uaaagaagccagaauauga

SEQ ID NO: 349880 - RNA, 19 nt, Homo sapiens
gcaaaucauuggucaguug

SEQ ID NO: 349881 - RNA, 19 nt, Homo sapiens
gaagaaguccucgaucaua

SEQ ID NO: 349882 - RNA, 19 nt, Homo sapiens
ggacacuaaugcagucaua

SEQ ID NO: 349883 - RNA, 19 nt, Homo sapiens
gaacaaagaagggaacuga

SEQ ID NO: 349884 - RNA, 19 nt, Homo sapiens
gagaagagccagcaaauca

SEQ ID NO: 349885 - RNA, 19 nt, Homo sapiens
cagcuagacuggauaguaa

SEQ ID NO: 349886 - RNA, 19 nt, Homo sapiens
gaucagaacuauguggaaa

SEQ ID NO: 349887 - RNA, 19 nt, Homo sapiens
ggucaucucuuauuguuuc

SEQ ID NO: 349888 - RNA, 19 nt, Homo sapiens
gauaaacguuccucaaagu

SEQ ID NO: 349889 - RNA, 19 nt, Homo sapiens
ggaacaauacgucauauau

SEQ ID NO: 349890 - RNA, 19 nt, Homo sapiens
gaaccacuaugcugcaaga

SEQ ID NO: 349891 - RNA, 19 nt, Homo sapiens
ccacuuagcucccuuacuc

SEQ ID NO: 349892 - RNA, 19 nt, Homo sapiens
gagcuaaauugaagaagga

SEQ ID NO: 349893 - RNA, 19 nt, Homo sapiens
gaaauuaugggaagagaug

SEQ ID NO: 349894 - RNA, 19 nt, Homo sapiens
cagaauguguaguaccuua

SEQ ID NO: 349895 - RNA, 19 nt, Homo sapiens
aaagagagcuaaacuggau

SEQ ID NO: 349896 - RNA, 19 nt, Homo sapiens
gcagucauauucagccaaa

SEQ ID NO: 349897 - RNA, 19 nt, Homo sapiens
gaacauugacugauuucuu

SEQ ID NO: 349898 - RNA, 19 nt, Homo sapiens
gaacugauggaguagagua

SEQ ID NO: 349899 - RNA, 19 nt, Homo sapiens
ccacuaugcugcaagauuc

SEQ ID NO: 349900 - RNA, 19 nt, Homo sapiens
auaaauggaugcugcaauu

SEQ ID NO: 349901 - RNA, 19 nt, Homo sapiens
gauaacccuucuuacauug

SEQ ID NO: 349902 - RNA, 19 nt, Homo sapiens
cagaagaaguccucgauca

SEQ ID NO: 349903 - RNA, 19 nt, Homo sapiens
gaaggaggagcuaaauuga

SEQ ID NO: 349904 - RNA, 19 nt, Homo sapiens
gggauguccucaauuagaa

SEQ ID NO: 349905 - RNA, 19 nt, Homo sapiens
gaagagccagcaaaucauu

SEQ ID NO: 349906 - RNA, 19 nt, Homo sapiens
gaacacugcagaagcuaaa

SEQ ID NO: 349907 - RNA, 19 nt, Homo sapiens
gagauuuacuagaaagguu

SEQ ID NO: 349908 - RNA, 19 nt, Homo sapiens
gagaugaugauguucuuaa

SEQ ID NO: 349909 - RNA, 19 nt, Homo sapiens
ugucaucaauggcuucuuu

SEQ ID NO: 349910 - RNA, 19 nt, Homo sapiens
gguucaacauugugcuuua

SEQ ID NO: 349911 - RNA, 19 nt, Homo sapiens
agaaagcacaggaacaaua

SEQ ID NO: 349912 - RNA, 19 nt, Homo sapiens
ucagaacuauguggaaauu

SEQ ID NO: 349913 - RNA, 19 nt, Homo sapiens
ggauugaggcuauguacuu

SEQ ID NO: 349914 - RNA, 19 nt, Homo sapiens
caggucaucucuuauuguu

SEQ ID NO: 349915 - RNA, 19 nt, Homo sapiens
gaagaacaaugacaaaagu

SEQ ID NO: 349916 - RNA, 19 nt, Homo sapiens
gaagccagaauaugauuug

SEQ ID NO: 349917 - RNA, 19 nt, Homo sapiens
guguuuacaucugacauua

SEQ ID NO: 349918 - RNA, 19 nt, Homo sapiens
gaccacaagcuuauaagaa

SEQ ID NO: 349919 - RNA, 19 nt, Homo sapiens
gcucagggacuauuuggaa

SEQ ID NO: 349920 - RNA, 19 nt, Homo sapiens
caccuuggguucaacauug

SEQ ID NO: 349921 - RNA, 19 nt, Homo sapiens
gaaagcacaggaacaauac

SEQ ID NO: 349922 - RNA, 19 nt, Homo sapiens
ugauccagcuuucuccuuu

SEQ ID NO: 349923 - RNA, 19 nt, Homo sapiens
uuaacuggcucugguauga

SEQ ID NO: 349924 - RNA, 19 nt, Homo sapiens
ccucaaugcuccucucaug

SEQ ID NO: 349925 - RNA, 19 nt, Homo sapiens
ggagagaagagccagcaaa

SEQ ID NO: 349926 - RNA, 19 nt, Homo sapiens
guuauugucugugccauga

SEQ ID NO: 349927 - RNA, 19 nt, Homo sapiens
ggagacuucuugcuggaau

SEQ ID NO: 349928 - RNA, 19 nt, Homo sapiens
aacauugacugauuucuug

SEQ ID NO: 349929 - RNA, 19 nt, Homo sapiens
agaaggaggagcuaaauug

SEQ ID NO: 349930 - RNA, 19 nt, Homo sapiens
gauugaggcuauguacuug

SEQ ID NO: 349931 - RNA, 19 nt, Homo sapiens
gggcaggucaucucuuauu

SEQ ID NO: 349932 - RNA, 19 nt, Homo sapiens
gaauguguaguaccuuaaa

SEQ ID NO: 349933 - RNA, 19 nt, Homo sapiens
gagagaagagccagcaaau

SEQ ID NO: 349934 - RNA, 19 nt, Homo sapiens
aagaaguccucgaucauau

SEQ ID NO: 349935 - RNA, 19 nt, Homo sapiens
gaguaaaccagaauuaaag

SEQ ID NO: 349936 - RNA, 19 nt, Homo sapiens
acauugugcuuuaugguuu

SEQ ID NO: 349937 - RNA, 19 nt, Homo sapiens
caacucagaggaugaugaa

SEQ ID NO: 349938 - RNA, 19 nt, Homo sapiens
cgauaaacguuccucaaag

SEQ ID NO: 349939 - RNA, 19 nt, Homo sapiens
aagcuuuccuuuauucuug

SEQ ID NO: 349940 - RNA, 19 nt, Homo sapiens
caauuuggauagccagaug

SEQ ID NO: 349941 - RNA, 19 nt, Homo sapiens
gaacuauguggaaauuaug

SEQ ID NO: 349942 - RNA, 19 nt, Homo sapiens
ggaagaagaggaggcuuga

SEQ ID NO: 349943 - RNA, 19 nt, Homo sapiens
gaaucagugugaaaucagu

SEQ ID NO: 349944 - RNA, 19 nt, Homo sapiens
gagaaggaggagcuaaauu

SEQ ID NO: 349945 - RNA, 19 nt, Homo sapiens
uaaauggaugcugcaauua

SEQ ID NO: 349946 - RNA, 19 nt, Homo sapiens
caagggccauucugcuuca

SEQ ID NO: 349947 - RNA, 19 nt, Homo sapiens
cugaaaagauggcuaaauu

SEQ ID NO: 349948 - RNA, 19 nt, Homo sapiens
gggagaugaugauguucuu

SEQ ID NO: 349949 - RNA, 19 nt, Homo sapiens
ggcaggucaucucuuauug

SEQ ID NO: 349950 - RNA, 19 nt, Homo sapiens
ggaccacaagcuuauaaga

SEQ ID NO: 349951 - RNA, 19 nt, Homo sapiens
gcaagauuccauucacguu

SEQ ID NO: 349952 - RNA, 19 nt, Homo sapiens
ugugggagaugaugauguu

SEQ ID NO: 349953 - RNA, 19 nt, Homo sapiens
aauaugauuuggaggaaga

SEQ ID NO: 349954 - RNA, 19 nt, Homo sapiens
acaagaugcuggagguuca

SEQ ID NO: 349955 - RNA, 19 nt, Homo sapiens
gacaugggcaucacguaaa

SEQ ID NO: 349956 - RNA, 19 nt, Homo sapiens
ccacaagcuuauaagaaca

SEQ ID NO: 349957 - RNA, 19 nt, Homo sapiens
cugaagaaaccuccuauga

SEQ ID NO: 349958 - RNA, 19 nt, Homo sapiens
gaacaugaagaggacacua

SEQ ID NO: 349959 - RNA, 19 nt, Homo sapiens
gauccugagauuacgauaa

SEQ ID NO: 349960 - RNA, 19 nt, Homo sapiens
gaagcuuuccuuuauucuu

SEQ ID NO: 349961 - RNA, 19 nt, Homo sapiens
cugauggaguagaguauuu

SEQ ID NO: 349962 - RNA, 19 nt, Homo sapiens
caggauaacccuucuuaca

SEQ ID NO: 349963 - RNA, 19 nt, Homo sapiens
caaaguagcaagggccauu

SEQ ID NO: 349964 - RNA, 19 nt, Homo sapiens
gcugauuguuugcaagugu

SEQ ID NO: 349965 - RNA, 19 nt, Homo sapiens
gaaaguguuguguuuacau

SEQ ID NO: 349966 - RNA, 19 nt, Homo sapiens
ggagaugaugauguucuua

SEQ ID NO: 349967 - RNA, 19 nt, Homo sapiens
acaggaacaauacgucaua

SEQ ID NO: 349968 - RNA, 19 nt, Homo sapiens
ggugagugauccagcuuuc

SEQ ID NO: 349969 - RNA, 19 nt, Homo sapiens
ccagaguguggaaguauaa

SEQ ID NO: 349970 - RNA, 19 nt, Homo sapiens
gcgaauauucugcuuccaa

SEQ ID NO: 349971 - RNA, 19 nt, Homo sapiens
gcaccucguagucuaagaa

SEQ ID NO: 349972 - RNA, 19 nt, Homo sapiens
ggaaagaacuucaggaaau

SEQ ID NO: 349973 - RNA, 19 nt, Homo sapiens
gguaagcacugaaguauaa

SEQ ID NO: 349974 - RNA, 19 nt, Homo sapiens
ugaaugcucugcagaaaua

SEQ ID NO: 349975 - RNA, 19 nt, Homo sapiens
gaaaugagcagucguaaau

SEQ ID NO: 349976 - RNA, 19 nt, Homo sapiens
gaaagaacuucaggaaauu

SEQ ID NO: 349977 - RNA, 19 nt, Homo sapiens
gaaagcacauuccguuuau

SEQ ID NO: 349978 - RNA, 19 nt, Homo sapiens
ccaaggaguuugaagauuu

SEQ ID NO: 349979 - RNA, 19 nt, Homo sapiens
ucacuaagcugguuaugaa

SEQ ID NO: 349980 - RNA, 19 nt, Homo sapiens
guaaguagcuguucagaag

SEQ ID NO: 349981 - RNA, 19 nt, Homo sapiens
ugaaagaacucauggaaau

SEQ ID NO: 349982 - RNA, 19 nt, Homo sapiens
ggaaaacuauuguccauua

SEQ ID NO: 349983 - RNA, 19 nt, Homo sapiens
gcagaaauaucccaacugu

SEQ ID NO: 349984 - RNA, 19 nt, Homo sapiens
uauaaaggguggucucaua

SEQ ID NO: 349985 - RNA, 19 nt, Homo sapiens
gcacugaaguauaauaagu

SEQ ID NO: 349986 - RNA, 19 nt, Homo sapiens
gcugagaaguggaaugaaa

SEQ ID NO: 349987 - RNA, 19 nt, Homo sapiens
gcacauuccguuuauaauu

SEQ ID NO: 349988 - RNA, 19 nt, Homo sapiens
ccagugaucuucauauuag

SEQ ID NO: 349989 - RNA, 19 nt, Homo sapiens
gaaagaacucauggaaaua

SEQ ID NO: 349990 - RNA, 19 nt, Homo sapiens
guuaauaagucaugcuuug

SEQ ID NO: 349991 - RNA, 19 nt, Homo sapiens
gaauauaaccagugacuuc

SEQ ID NO: 349992 - RNA, 19 nt, Homo sapiens
gcagauacacuuaaugaau

SEQ ID NO: 349993 - RNA, 19 nt, Homo sapiens
gaagcaagccaacugugua

SEQ ID NO: 349994 - RNA, 19 nt, Homo sapiens
ggaaauagaagaagugagu

SEQ ID NO: 349995 - RNA, 19 nt, Homo sapiens
gaaauucacagagagagua

SEQ ID NO: 349996 - RNA, 19 nt, Homo sapiens
ggaaaucacaaggcaguua

SEQ ID NO: 349997 - RNA, 19 nt, Homo sapiens
caaauggucuauaaugagu

SEQ ID NO: 349998 - RNA, 19 nt, Homo sapiens
gaaaucacaaggcaguuaa

SEQ ID NO: 349999 - RNA, 19 nt, Homo sapiens
accaaacacuucucuauaa

SEQ ID NO: 350000 - RNA, 19 nt, Homo sapiens
aggaagagccauuuaauuu

SEQ ID NO: 350001 - RNA, 19 nt, Homo sapiens
ccauuaacaugauaugcua

SEQ ID NO: 350002 - RNA, 19 nt, Homo sapiens
guaacucuguccuuauuau

SEQ ID NO: 350003 - RNA, 19 nt, Homo sapiens
gaggaagagccauuuaauu

SEQ ID NO: 350004 - RNA, 19 nt, Homo sapiens
cuacagaagcauuucaaua

SEQ ID NO: 350005 - RNA, 19 nt, Homo sapiens
cagguuugcugcaguguuu

SEQ ID NO: 350006 - RNA, 19 nt, Homo sapiens
gcgauucggugaagcgauu

SEQ ID NO: 350007 - RNA, 19 nt, Homo sapiens
cagaagcauuucaauauca

SEQ ID NO: 350008 - RNA, 19 nt, Homo sapiens
ccaaacacuucucuauaau

SEQ ID NO: 350009 - RNA, 19 nt, Homo sapiens
gaagagccauuuaauuuuc

SEQ ID NO: 350010 - RNA, 19 nt, Homo sapiens
ggucuuacauguagauugg

SEQ ID NO: 350011 - RNA, 19 nt, Homo sapiens
gcccagugaucuucauauu

SEQ ID NO: 350012 - RNA, 19 nt, Homo sapiens
ucacagguacaaagaauuu

SEQ ID NO: 350013 - RNA, 19 nt, Homo sapiens
agucguaaaucaaagagua

SEQ ID NO: 350014 - RNA, 19 nt, Homo sapiens
gagaguaccagcugaugaa

SEQ ID NO: 350015 - RNA, 19 nt, Homo sapiens
uaauaaagcccauggaaag

SEQ ID NO: 350016 - RNA, 19 nt, Homo sapiens
cgucagaguccacauagua

SEQ ID NO: 350017 - RNA, 19 nt, Homo sapiens
aguaacagcuuaauucaca

SEQ ID NO: 350018 - RNA, 19 nt, Homo sapiens
gcauuucaauaucagcaaa

SEQ ID NO: 350019 - RNA, 19 nt, Homo sapiens
aaaggguggucucauaaga

SEQ ID NO: 350020 - RNA, 19 nt, Homo sapiens
cuaagcugguuaugaauau

SEQ ID NO: 350021 - RNA, 19 nt, Homo sapiens
aaagaacaguuaucucuac

SEQ ID NO: 350022 - RNA, 19 nt, Homo sapiens
gacuucaacuuuggcauuu

SEQ ID NO: 350023 - RNA, 19 nt, Homo sapiens
gcaucgcacccauuuauga

SEQ ID NO: 350024 - RNA, 19 nt, Homo sapiens
gaaguggaaugaaaauguu

SEQ ID NO: 350025 - RNA, 19 nt, Homo sapiens
ucacaaggcaguuaaaucu

SEQ ID NO: 350026 - RNA, 19 nt, Homo sapiens
ugaaacugcuuuuggauaa

SEQ ID NO: 350027 - RNA, 19 nt, Homo sapiens
uugaacaccugcagcaauu

SEQ ID NO: 350028 - RNA, 19 nt, Homo sapiens
cagcaucgcacccauuuau

SEQ ID NO: 350029 - RNA, 19 nt, Homo sapiens
gaaguacuacagaagcauu

SEQ ID NO: 350030 - RNA, 19 nt, Homo sapiens
uaagugagcugcugaaaag

SEQ ID NO: 350031 - RNA, 19 nt, Homo sapiens
uaaccuauuuggagugcaa

SEQ ID NO: 350032 - RNA, 19 nt, Homo sapiens
caaccuaacagcuagaugu

SEQ ID NO: 350033 - RNA, 19 nt, Homo sapiens
caaaaucgcccuaaaggaa

SEQ ID NO: 350034 - RNA, 19 nt, Homo sapiens
gccaaggaguuugaagauu

SEQ ID NO: 350035 - RNA, 19 nt, Homo sapiens
ucagaagacuaaccagcuu

SEQ ID NO: 350036 - RNA, 19 nt, Homo sapiens
aaacaaugguaagcacuga

SEQ ID NO: 350037 - RNA, 19 nt, Homo sapiens
ggacuagaccaugugcuuu

SEQ ID NO: 350038 - RNA, 19 nt, Homo sapiens
caugauaugcuaaacauuc

SEQ ID NO: 350039 - RNA, 19 nt, Homo sapiens
uaugaaugcucugcagaaa

SEQ ID NO: 350040 - RNA, 19 nt, Homo sapiens
ugaccuggauuugaauuug

SEQ ID NO: 350041 - RNA, 19 nt, Homo sapiens
ggaagcaagccaacugugu

SEQ ID NO: 350042 - RNA, 19 nt, Homo sapiens
gcaagaaguacuacagaag

SEQ ID NO: 350043 - RNA, 19 nt, Homo sapiens
aaaccaaacacuucucuau

SEQ ID NO: 350044 - RNA, 19 nt, Homo sapiens
guaguuggagauaaaguuu

SEQ ID NO: 350045 - RNA, 19 nt, Homo sapiens
gcagaucaaugacaaaauc

SEQ ID NO: 350046 - RNA, 19 nt, Homo sapiens
ucaaagaguaacagcuuaa

SEQ ID NO: 350047 - RNA, 19 nt, Homo sapiens
uaaguaaccuuugguacag

SEQ ID NO: 350048 - RNA, 19 nt, Homo sapiens
ccuaacagcuagaugucuu

SEQ ID NO: 350049 - RNA, 19 nt, Homo sapiens
ggaagagccauuuaauuuu

SEQ ID NO: 350050 - RNA, 19 nt, Homo sapiens
uauuguacauggucuauca

SEQ ID NO: 350051 - RNA, 19 nt, Homo sapiens
aaugagcagucguaaauca

SEQ ID NO: 350052 - RNA, 19 nt, Homo sapiens
gaacaccugcagcaauuag

SEQ ID NO: 350053 - RNA, 19 nt, Homo sapiens
ggacucgaaagcaaauauu

SEQ ID NO: 350054 - RNA, 19 nt, Homo sapiens
ugccguagaucuaauggaa

SEQ ID NO: 350055 - RNA, 19 nt, Homo sapiens
gaugcuugcuuuaaaucga

SEQ ID NO: 350056 - RNA, 19 nt, Homo sapiens
acagaagcauuucaauauc

SEQ ID NO: 350057 - RNA, 19 nt, Homo sapiens
cggcagauacacuuaauga

SEQ ID NO: 350058 - RNA, 19 nt, Homo sapiens
gaccuggauuugaauuugu

SEQ ID NO: 350059 - RNA, 19 nt, Homo sapiens
aagcacauuccguuuauaa

SEQ ID NO: 350060 - RNA, 19 nt, Homo sapiens
agauagaagugugcaagaa

SEQ ID NO: 350061 - RNA, 19 nt, Homo sapiens
guuauuggucuuacaugua

SEQ ID NO: 350062 - RNA, 19 nt, Homo sapiens
gaaaauguaguuggagaua

SEQ ID NO: 350063 - RNA, 19 nt, Homo sapiens
acagcuagaugucuuuaca

SEQ ID NO: 350064 - RNA, 19 nt, Homo sapiens
gcaacauccucacuaagcu

SEQ ID NO: 350065 - RNA, 19 nt, Homo sapiens
aagaguaacagcuuaauuc

SEQ ID NO: 350066 - RNA, 19 nt, Homo sapiens
aaccaaacacuucucuaua

SEQ ID NO: 350067 - RNA, 19 nt, Homo sapiens
uuuggaagcuuugcugaaa

SEQ ID NO: 350068 - RNA, 19 nt, Homo sapiens
uaacagcuagaugucuuua

SEQ ID NO: 350069 - RNA, 19 nt, Homo sapiens
ucuuugaccuggauuugaa

SEQ ID NO: 350070 - RNA, 19 nt, Homo sapiens
gaacuucaggaaauucaca

SEQ ID NO: 350071 - RNA, 19 nt, Homo sapiens
guacauggucuaucagucu

SEQ ID NO: 350072 - RNA, 19 nt, Homo sapiens
ggaagcaacguguuaauua

SEQ ID NO: 350073 - RNA, 19 nt, Homo sapiens
gaaauaaccugugaaacau

SEQ ID NO: 350074 - RNA, 19 nt, Homo sapiens
gaagcaacguguuaauuau

SEQ ID NO: 350075 - RNA, 19 nt, Homo sapiens
cagauuaccucucuaguga

SEQ ID NO: 350076 - RNA, 19 nt, Homo sapiens
cagcagcccuuguuuauau

SEQ ID NO: 350077 - RNA, 19 nt, Homo sapiens
ggugaacuuugacauaaua

SEQ ID NO: 350078 - RNA, 19 nt, Homo sapiens
cugcauaccuugcuucaua

SEQ ID NO: 350079 - RNA, 19 nt, Homo sapiens
gaacuuccauauuacucua

SEQ ID NO: 350080 - RNA, 19 nt, Homo sapiens
guauucagcugauuucuau

SEQ ID NO: 350081 - RNA, 19 nt, Homo sapiens
cuacuuagcuggccaagga

SEQ ID NO: 350082 - RNA, 19 nt, Homo sapiens
caaggacggugaacuuuga

SEQ ID NO: 350083 - RNA, 19 nt, Homo sapiens
gaagaaagcuaugcagacu

SEQ ID NO: 350084 - RNA, 19 nt, Homo sapiens
acacugaaauugccugaaa

SEQ ID NO: 350085 - RNA, 19 nt, Homo sapiens
aaaugugacuguucucuuu

SEQ ID NO: 350086 - RNA, 19 nt, Homo sapiens
ugaaauaaccugugaaaca

SEQ ID NO: 350087 - RNA, 19 nt, Homo sapiens
agaauuggcugacagaaau

SEQ ID NO: 350088 - RNA, 19 nt, Homo sapiens
gaucagacuguauauauug

SEQ ID NO: 350089 - RNA, 19 nt, Homo sapiens
gaauuguguugaaugcuuu

SEQ ID NO: 350090 - RNA, 19 nt, Homo sapiens
ugaaagagcucagacaucu

SEQ ID NO: 350091 - RNA, 19 nt, Homo sapiens
gaggauggauguucuacug

SEQ ID NO: 350092 - RNA, 19 nt, Homo sapiens
cgcaaacuguggagaaaua

SEQ ID NO: 350093 - RNA, 19 nt, Homo sapiens
ggagagagacaucauuuca

SEQ ID NO: 350094 - RNA, 19 nt, Homo sapiens
gaugugagcagaagacuau

SEQ ID NO: 350095 - RNA, 19 nt, Homo sapiens
gggaaaagcuacagaaaga

SEQ ID NO: 350096 - RNA, 19 nt, Homo sapiens
ccugaaacccauuuacuua

SEQ ID NO: 350097 - RNA, 19 nt, Homo sapiens
ggauggauguucuacugaa

SEQ ID NO: 350098 - RNA, 19 nt, Homo sapiens
guucuacucuuaaugaugu

SEQ ID NO: 350099 - RNA, 19 nt, Homo sapiens
cuacugaaauaaccuguga

SEQ ID NO: 350100 - RNA, 19 nt, Homo sapiens
acagaaagaugacacagau

SEQ ID NO: 350101 - RNA, 19 nt, Homo sapiens
gaaacccauuuacuuagga

SEQ ID NO: 350102 - RNA, 19 nt, Homo sapiens
cuagacagauuauuagcaa

SEQ ID NO: 350103 - RNA, 19 nt, Homo sapiens
ggaguucuuuggcucuauu

SEQ ID NO: 350104 - RNA, 19 nt, Homo sapiens
gaaccucauuugaagaaag

SEQ ID NO: 350105 - RNA, 19 nt, Homo sapiens
gccuggauuucuuagauua

SEQ ID NO: 350106 - RNA, 19 nt, Homo sapiens
gauauggaagcaaaucuuu

SEQ ID NO: 350107 - RNA, 19 nt, Homo sapiens
ugacuuuguucgcuuguuu

SEQ ID NO: 350108 - RNA, 19 nt, Homo sapiens
gacaagcaaucaucuccuu

SEQ ID NO: 350109 - RNA, 19 nt, Homo sapiens
ugaaucaucuuaguucuuc

SEQ ID NO: 350110 - RNA, 19 nt, Homo sapiens
ggaaagaccuauguaacac

SEQ ID NO: 350111 - RNA, 19 nt, Homo sapiens
acaaucuguucuacucuua

SEQ ID NO: 350112 - RNA, 19 nt, Homo sapiens
gaagcaagugaacgugaua

SEQ ID NO: 350113 - RNA, 19 nt, Homo sapiens
gauggauguucuacugaaa

SEQ ID NO: 350114 - RNA, 19 nt, Homo sapiens
uaacauucuucuuggaguu

SEQ ID NO: 350115 - RNA, 19 nt, Homo sapiens
gugagcagaagacuauuua

SEQ ID NO: 350116 - RNA, 19 nt, Homo sapiens
uggauguucuacugaaaua

SEQ ID NO: 350117 - RNA, 19 nt, Homo sapiens
gagacaucauuucagcuuu

SEQ ID NO: 350118 - RNA, 19 nt, Homo sapiens
gcaaggacggugaacuuug

SEQ ID NO: 350119 - RNA, 19 nt, Homo sapiens
gcuccaacagcaaauauuu

SEQ ID NO: 350120 - RNA, 19 nt, Homo sapiens
agaaagcuaugcagacugu

SEQ ID NO: 350121 - RNA, 19 nt, Homo sapiens
ugaauuguguugaaugcuu

SEQ ID NO: 350122 - RNA, 19 nt, Homo sapiens
gaaaugugacuguucucuu

SEQ ID NO: 350123 - RNA, 19 nt, Homo sapiens
uaaaggagaagcaagugaa

SEQ ID NO: 350124 - RNA, 19 nt, Homo sapiens
gguggugccugccagaaug

SEQ ID NO: 350125 - RNA, 19 nt, Homo sapiens
ccaaggagaggaguucuuu

SEQ ID NO: 350126 - RNA, 19 nt, Homo sapiens
aaauacaaaugcacagugu

SEQ ID NO: 350127 - RNA, 19 nt, Homo sapiens
ucagggaaauaucaaguuc

SEQ ID NO: 350128 - RNA, 19 nt, Homo sapiens
ucuaauugcugcauaccuu

SEQ ID NO: 350129 - RNA, 19 nt, Homo sapiens
ccauauuacucuaaguuca

SEQ ID NO: 350130 - RNA, 19 nt, Homo sapiens
guuuauaugcccauucuuu

SEQ ID NO: 350131 - RNA, 19 nt, Homo sapiens
cagcaggguuugagcacaa

SEQ ID NO: 350132 - RNA, 19 nt, Homo sapiens
caaguaaccacagcugaaa

SEQ ID NO: 350133 - RNA, 19 nt, Homo sapiens
acggugaacuuugacauaa

SEQ ID NO: 350134 - RNA, 19 nt, Homo sapiens
gacggugaacuuugacaua

SEQ ID NO: 350135 - RNA, 19 nt, Homo sapiens
cuuuagagcucccacaugu

SEQ ID NO: 350136 - RNA, 19 nt, Homo sapiens
aaagaccuauguaacacaa

SEQ ID NO: 350137 - RNA, 19 nt, Homo sapiens
gccagcagcccuuguuuau

SEQ ID NO: 350138 - RNA, 19 nt, Homo sapiens
gaggaguucuuuggcucua

SEQ ID NO: 350139 - RNA, 19 nt, Homo sapiens
uaaggccacuguuuuaaaa

SEQ ID NO: 350140 - RNA, 19 nt, Homo sapiens
aaacuguggagaaauauug

SEQ ID NO: 350141 - RNA, 19 nt, Homo sapiens
ccacuagacagauuauuag

SEQ ID NO: 350142 - RNA, 19 nt, Homo sapiens
uauugaaccucauuugaag

SEQ ID NO: 350143 - RNA, 19 nt, Homo sapiens
ggaguuuucuacacuguuu

SEQ ID NO: 350144 - RNA, 19 nt, Homo sapiens
agacaucauuucagcuuuc

SEQ ID NO: 350145 - RNA, 19 nt, Homo sapiens
cauggaaucugaugaaaau

SEQ ID NO: 350146 - RNA, 19 nt, Homo sapiens
uccacuagacagauuauua

SEQ ID NO: 350147 - RNA, 19 nt, Homo sapiens
gaaagaccuauguaacaca

SEQ ID NO: 350148 - RNA, 19 nt, Homo sapiens
uuucuaugcugccuacauu

SEQ ID NO: 350149 - RNA, 19 nt, Homo sapiens
caagaacugacaagagguu

SEQ ID NO: 350150 - RNA, 19 nt, Homo sapiens
cagcauggaaucugaugaa

SEQ ID NO: 350151 - RNA, 19 nt, Homo sapiens
gaaaagacaagcaaucauc

SEQ ID NO: 350152 - RNA, 19 nt, Homo sapiens
aaaggccucucagcgcaua

SEQ ID NO: 350153 - RNA, 19 nt, Homo sapiens
caucuggcaguacuuaauu

SEQ ID NO: 350154 - RNA, 19 nt, Homo sapiens
agacaucuggcaguacuua

SEQ ID NO: 350155 - RNA, 19 nt, Homo sapiens
cagaguauucagcugauuu

SEQ ID NO: 350156 - RNA, 19 nt, Homo sapiens
cagcauaggcaaccuucaa

SEQ ID NO: 350157 - RNA, 19 nt, Homo sapiens
ugaaacccauuuacuuagg

SEQ ID NO: 350158 - RNA, 19 nt, Homo sapiens
cacaaucuguucuacucuu

SEQ ID NO: 350159 - RNA, 19 nt, Homo sapiens
ccagauuaccucucuagug

SEQ ID NO: 350160 - RNA, 19 nt, Homo sapiens
aagcuaugcagacuguuua

SEQ ID NO: 350161 - RNA, 19 nt, Homo sapiens
ggcccagcauggaaucuga

SEQ ID NO: 350162 - RNA, 19 nt, Homo sapiens
caucuugcaguccuuguuu

SEQ ID NO: 350163 - RNA, 19 nt, Homo sapiens
uggaaagaccuauguaaca

SEQ ID NO: 350164 - RNA, 19 nt, Homo sapiens
auaccuugcuucauacaau

SEQ ID NO: 350165 - RNA, 19 nt, Homo sapiens
cagacuguauauauuguuc

SEQ ID NO: 350166 - RNA, 19 nt, Homo sapiens
ccaaaaccauuuccacuag

SEQ ID NO: 350167 - RNA, 19 nt, Homo sapiens
gaaaagcuacagaaagaug

SEQ ID NO: 350168 - RNA, 19 nt, Homo sapiens
gguuugagcacaaucuguu

SEQ ID NO: 350169 - RNA, 19 nt, Homo sapiens
guguucauccagcuacuua

SEQ ID NO: 350170 - RNA, 19 nt, Homo sapiens
guuugugaauuguguugaa

SEQ ID NO: 350171 - RNA, 19 nt, Homo sapiens
ugacuaagccaagcugugu

SEQ ID NO: 350172 - RNA, 19 nt, Homo sapiens
gaacuuaccugccucuuca

SEQ ID NO: 350173 - RNA, 19 nt, Homo sapiens
gacacagacuggcaauaaa

SEQ ID NO: 350174 - RNA, 19 nt, Homo sapiens
ccacagggcucuucauggu

SEQ ID NO: 350175 - RNA, 19 nt, Homo sapiens
agacacagacuggcaauaa

SEQ ID NO: 350176 - RNA, 19 nt, Homo sapiens
caauaaacuccuuccgaaa

SEQ ID NO: 350177 - RNA, 19 nt, Homo sapiens
gugcagguugcuaucaaua

SEQ ID NO: 350178 - RNA, 19 nt, Homo sapiens
ccucugcgccucuguacaa

SEQ ID NO: 350179 - RNA, 19 nt, Homo sapiens
ggaaacugggccuggauuc

SEQ ID NO: 350180 - RNA, 19 nt, Homo sapiens
ccaaaggggccaaaacuga

SEQ ID NO: 350181 - RNA, 19 nt, Homo sapiens
gcagguugcuaucaauacc

SEQ ID NO: 350182 - RNA, 19 nt, Homo sapiens
ggucuccgcguacgggauu

SEQ ID NO: 350183 - RNA, 19 nt, Homo sapiens
ggucauguucuccaucauc

SEQ ID NO: 350184 - RNA, 19 nt, Homo sapiens
cggaucaacuggacuuuug

SEQ ID NO: 350185 - RNA, 19 nt, Homo sapiens
uuaccugccucuucaugca

SEQ ID NO: 350186 - RNA, 19 nt, Homo sapiens
caucaucuccauggacuuc

SEQ ID NO: 350187 - RNA, 19 nt, Homo sapiens
gucauguucuccaucaucu

SEQ ID NO: 350188 - RNA, 19 nt, Homo sapiens
cuggcuaccucauguccuu

SEQ ID NO: 350189 - RNA, 19 nt, Homo sapiens
gguccucggucaucuugcu

SEQ ID NO: 350190 - RNA, 19 nt, Homo sapiens
uggugaagguggccuccaa

SEQ ID NO: 350191 - RNA, 19 nt, Homo sapiens
ugccagacgucccgaggau

SEQ ID NO: 350192 - RNA, 19 nt, Homo sapiens
gccuucggcuaccugcaaa

SEQ ID NO: 350193 - RNA, 19 nt, Homo sapiens
aaauagagcuugauuguug

SEQ ID NO: 350194 - RNA, 19 nt, Homo sapiens
caagauaacuggaaaaugu

SEQ ID NO: 350195 - RNA, 19 nt, Homo sapiens
cgacaguucugccggauga

SEQ ID NO: 350196 - RNA, 19 nt, Homo sapiens
gcagcaacauagaguacaa

SEQ ID NO: 350197 - RNA, 19 nt, Homo sapiens
gcaacauagaguacaaaua

SEQ ID NO: 350198 - RNA, 19 nt, Homo sapiens
ggaaaucggagagaccuuu

SEQ ID NO: 350199 - RNA, 19 nt, Homo sapiens
gcagaguccuuaacuuacu

SEQ ID NO: 350200 - RNA, 19 nt, Homo sapiens
aggcagaguccuuaacuua

SEQ ID NO: 350201 - RNA, 19 nt, Homo sapiens
guacagcguuccugacaac

SEQ ID NO: 350202 - RNA, 19 nt, Homo sapiens
gaagggcuuuggcucaucu

SEQ ID NO: 350203 - RNA, 19 nt, Homo sapiens
gaacaggcucagugugaau

SEQ ID NO: 350204 - RNA, 19 nt, Homo sapiens
gcagaggacuuccccaaau

SEQ ID NO: 350205 - RNA, 19 nt, Homo sapiens
gacaggacgugaacaugca

SEQ ID NO: 350206 - RNA, 19 nt, Homo sapiens
ugcaaaggcugguggaugu

SEQ ID NO: 350207 - RNA, 19 nt, Homo sapiens
gaggcagaguccuuaacuu

SEQ ID NO: 350208 - RNA, 19 nt, Homo sapiens
gaagcaaggcgacaguucu

SEQ ID NO: 350209 - RNA, 19 nt, Homo sapiens
ugaacaggcucagugugaa

SEQ ID NO: 350210 - RNA, 19 nt, Homo sapiens
auggagaacugcaugaaga

SEQ ID NO: 350211 - RNA, 19 nt, Homo sapiens
uaggcugggugaagaagaa

SEQ ID NO: 350212 - RNA, 19 nt, Homo sapiens
gcaaaggcugguggaugua

SEQ ID NO: 350213 - RNA, 19 nt, Homo sapiens
caucugggcucagguuugg

SEQ ID NO: 350214 - RNA, 19 nt, Homo sapiens
ugaagcagggccucaggua

SEQ ID NO: 350215 - RNA, 19 nt, Homo sapiens
ggaagggcuuuggcucauc

SEQ ID NO: 350216 - RNA, 19 nt, Homo sapiens
gcauucaccgcuucagaga

SEQ ID NO: 350217 - RNA, 19 nt, Homo sapiens
gugggaaaauugcccuuua

SEQ ID NO: 350218 - RNA, 19 nt, Homo sapiens
gagggaaugugggaaaauu

SEQ ID NO: 350219 - RNA, 19 nt, Homo sapiens
aagaagaaagcaaguggaa

SEQ ID NO: 350220 - RNA, 19 nt, Homo sapiens
gacgugaacaugcacacaa

SEQ ID NO: 350221 - RNA, 19 nt, Homo sapiens
ugugcaagauaacuggaaa

SEQ ID NO: 350222 - RNA, 19 nt, Homo sapiens
cagaggacuuccccaaauu

SEQ ID NO: 350223 - RNA, 19 nt, Homo sapiens
gcucaucugggcucagguu

SEQ ID NO: 350224 - RNA, 19 nt, Homo sapiens
ucacuggcacgauggagaa

SEQ ID NO: 350225 - RNA, 19 nt, Homo sapiens
gcagaaggcgcagaaagac

SEQ ID NO: 350226 - RNA, 19 nt, Homo sapiens
gcagaggaaaucggagaga

SEQ ID NO: 350227 - RNA, 19 nt, Homo sapiens
gcucagguuugggagagau

SEQ ID NO: 350228 - RNA, 19 nt, Homo sapiens
gagaagcaaggcgacaguu

SEQ ID NO: 350229 - RNA, 19 nt, Homo sapiens
gggcauucaccgcuucaga

SEQ ID NO: 350230 - RNA, 19 nt, Homo sapiens
ggaggaaggaagggcuuug

SEQ ID NO: 350231 - RNA, 19 nt, Homo sapiens
ccuuuaggcugggugaaga

SEQ ID NO: 350232 - RNA, 19 nt, Homo sapiens
caacuggugggaacuggau

SEQ ID NO: 350233 - RNA, 19 nt, Homo sapiens
gauggagaacugcaugaag

SEQ ID NO: 350234 - RNA, 19 nt, Homo sapiens
ccagaggcagaguccuuaa

SEQ ID NO: 350235 - RNA, 19 nt, Homo sapiens
aagaaugacaggacgugaa

SEQ ID NO: 350236 - RNA, 19 nt, Homo sapiens
cagcagaaggcgcagaaag

SEQ ID NO: 350237 - RNA, 19 nt, Homo sapiens
ugguggauguagugccuuu

SEQ ID NO: 350238 - RNA, 19 nt, Homo sapiens
gcacgauggagaacugcau

SEQ ID NO: 350239 - RNA, 19 nt, Homo sapiens
augaacaggcucaguguga

SEQ ID NO: 350240 - RNA, 19 nt, Homo sapiens
gaaaucggagagaccuuuu

SEQ ID NO: 350241 - RNA, 19 nt, Homo sapiens
caauaaagcuucuguguuu

SEQ ID NO: 350242 - RNA, 19 nt, Homo sapiens
gaaacgaggaguacaauaa

SEQ ID NO: 350243 - RNA, 19 nt, Homo sapiens
gauccaagcaaccuucuuu

SEQ ID NO: 350244 - RNA, 19 nt, Homo sapiens
gcgcuguccuggguucuua

SEQ ID NO: 350245 - RNA, 19 nt, Homo sapiens
caggaccagugcaucuaua

SEQ ID NO: 350246 - RNA, 19 nt, Homo sapiens
ucaauaaagcuucuguguu

SEQ ID NO: 350247 - RNA, 19 nt, Homo sapiens
ggacacgaucuuucucaga

SEQ ID NO: 350248 - RNA, 19 nt, Homo sapiens
gaccagugcaucuauaaca

SEQ ID NO: 350249 - RNA, 19 nt, Homo sapiens
ucacuugcaucaauaaagc

SEQ ID NO: 350250 - RNA, 19 nt, Homo sapiens
cgaaacgaggaguacaaua

SEQ ID NO: 350251 - RNA, 19 nt, Homo sapiens
ggacacagccuuggaucag

SEQ ID NO: 350252 - RNA, 19 nt, Homo sapiens
agacagaggacacgaucuu

SEQ ID NO: 350253 - RNA, 19 nt, Homo sapiens
auaagucgguucaggagau

SEQ ID NO: 350254 - RNA, 19 nt, Homo sapiens
agaagcagcacgagaagga

SEQ ID NO: 350255 - RNA, 19 nt, Homo sapiens
uaaagcuucuguguuugga

SEQ ID NO: 350256 - RNA, 19 nt, Homo sapiens
ucccucacuugcaucaaua

SEQ ID NO: 350257 - RNA, 19 nt, Homo sapiens
gcaucuauaacaccaccua

SEQ ID NO: 350258 - RNA, 19 nt, Homo sapiens
gaggacacgaucuuucuca

SEQ ID NO: 350259 - RNA, 19 nt, Homo sapiens
uggagaagcagcacgagaa

SEQ ID NO: 350260 - RNA, 19 nt, Homo sapiens
ccuccuaccucugcuggaa

SEQ ID NO: 350261 - RNA, 19 nt, Homo sapiens
gcaggacacagccuuggau

SEQ ID NO: 350262 - RNA, 19 nt, Homo sapiens
gacagaggacacgaucuuu

SEQ ID NO: 350263 - RNA, 19 nt, Homo sapiens
gugagccacuggagaagca

SEQ ID NO: 350264 - RNA, 19 nt, Homo sapiens
cccauugugugccaaccua

SEQ ID NO: 350265 - RNA, 19 nt, Homo sapiens
gcaucggccuuucgaaacg

SEQ ID NO: 350266 - RNA, 19 nt, Homo sapiens
gcacgagaaggagaggaaa

SEQ ID NO: 350267 - RNA, 19 nt, Homo sapiens
ggagaagcagcacgagaag

SEQ ID NO: 350268 - RNA, 19 nt, Homo sapiens
aaacgaggaguacaauaag

SEQ ID NO: 350269 - RNA, 19 nt, Homo sapiens
aauaaagcuucuguguuug

SEQ ID NO: 350270 - RNA, 19 nt, Homo sapiens
ggaucaggacagagacuug

SEQ ID NO: 350271 - RNA, 19 nt, Homo sapiens
ucgcaucggccuuucgaaa

SEQ ID NO: 350272 - RNA, 19 nt, Homo sapiens
ggaagcccagaucccauug

SEQ ID NO: 350273 - RNA, 19 nt, Homo sapiens
cagaggacacgaucuuucu

SEQ ID NO: 350274 - RNA, 19 nt, Homo sapiens
caagcaaccuucuuuuacu

SEQ ID NO: 350275 - RNA, 19 nt, Homo sapiens
aagcccagaucccauugug

SEQ ID NO: 350276 - RNA, 19 nt, Homo sapiens
ccuccaacccgacaugugu

SEQ ID NO: 350277 - RNA, 19 nt, Homo sapiens
uguccuggguucuuacagu

SEQ ID NO: 350278 - RNA, 19 nt, Homo sapiens
gaaacgaggaguacaauaa

SEQ ID NO: 350279 - RNA, 19 nt, Homo sapiens
gauccaagcaaccuucuuu

SEQ ID NO: 350280 - RNA, 19 nt, Homo sapiens
guuccuaccuggacgauga

SEQ ID NO: 350281 - RNA, 19 nt, Homo sapiens
gcgcuguccuggguucuua

SEQ ID NO: 350282 - RNA, 19 nt, Homo sapiens
gcucaccugcuguuccuua

SEQ ID NO: 350283 - RNA, 19 nt, Homo sapiens
gcaaccuucuuuuacuuua

SEQ ID NO: 350284 - RNA, 19 nt, Homo sapiens
ggacacgaucuuucucaga

SEQ ID NO: 350285 - RNA, 19 nt, Homo sapiens
cgaaacgaggaguacaaua

SEQ ID NO: 350286 - RNA, 19 nt, Homo sapiens
gaaccagugcuucuauaac

SEQ ID NO: 350287 - RNA, 19 nt, Homo sapiens
agacagaggacacgaucuu

SEQ ID NO: 350288 - RNA, 19 nt, Homo sapiens
auaagucgguucaggagau

SEQ ID NO: 350289 - RNA, 19 nt, Homo sapiens
agaagcagcacgagaagga

SEQ ID NO: 350290 - RNA, 19 nt, Homo sapiens
aaccagugcuucuauaacu

SEQ ID NO: 350291 - RNA, 19 nt, Homo sapiens
gaggacacgaucuuucuca

SEQ ID NO: 350292 - RNA, 19 nt, Homo sapiens
uggagaagcagcacgagaa

SEQ ID NO: 350293 - RNA, 19 nt, Homo sapiens
gagggaggccgagaacaug

SEQ ID NO: 350294 - RNA, 19 nt, Homo sapiens
gacagaggacacgaucuuu

SEQ ID NO: 350295 - RNA, 19 nt, Homo sapiens
ccuccuaccucugcuggaa

SEQ ID NO: 350296 - RNA, 19 nt, Homo sapiens
cccauugugugccaaccua

SEQ ID NO: 350297 - RNA, 19 nt, Homo sapiens
gugagccacuggagaagca

SEQ ID NO: 350298 - RNA, 19 nt, Homo sapiens
gcaucggccuuucgaaacg

SEQ ID NO: 350299 - RNA, 19 nt, Homo sapiens
gcacgagaaggagaggaaa

SEQ ID NO: 350300 - RNA, 19 nt, Homo sapiens
ggagaagcagcacgagaag

SEQ ID NO: 350301 - RNA, 19 nt, Homo sapiens
cgagggaggccgagaacau

SEQ ID NO: 350302 - RNA, 19 nt, Homo sapiens
aaacgaggaguacaauaag

SEQ ID NO: 350303 - RNA, 19 nt, Homo sapiens
ucgcaucggccuuucgaaa

SEQ ID NO: 350304 - RNA, 19 nt, Homo sapiens
ggaggccgagaacauguug

SEQ ID NO: 350305 - RNA, 19 nt, Homo sapiens
ggaagcccagaucccauug

SEQ ID NO: 350306 - RNA, 19 nt, Homo sapiens
cagaggacacgaucuuucu

SEQ ID NO: 350307 - RNA, 19 nt, Homo sapiens
caagcaaccuucuuuuacu

SEQ ID NO: 350308 - RNA, 19 nt, Homo sapiens
aagcccagaucccauugug

SEQ ID NO: 350309 - RNA, 19 nt, Homo sapiens
uguccuggguucuuacagu

SEQ ID NO: 350310 - RNA, 19 nt, Homo sapiens
augggaccgucuccagaua

SEQ ID NO: 350311 - RNA, 19 nt, Homo sapiens
gcaaauaccucuccauuau

SEQ ID NO: 350312 - RNA, 19 nt, Homo sapiens
ggagacaaguguaaucuua

SEQ ID NO: 350313 - RNA, 19 nt, Homo sapiens
gcaaugacuugauagcuaa

SEQ ID NO: 350314 - RNA, 19 nt, Homo sapiens
ggaauaccaugagcuguua

SEQ ID NO: 350315 - RNA, 19 nt, Homo sapiens
gaaaagaacucucuaagau

SEQ ID NO: 350316 - RNA, 19 nt, Homo sapiens
gaacgagccacacucuuua

SEQ ID NO: 350317 - RNA, 19 nt, Homo sapiens
ggaguuaacccauauuuau

SEQ ID NO: 350318 - RNA, 19 nt, Homo sapiens
gcagagauuuccucauguu

SEQ ID NO: 350319 - RNA, 19 nt, Homo sapiens
agacugagcugcagaauac

SEQ ID NO: 350320 - RNA, 19 nt, Homo sapiens
gaaagcuaguucagaaguu

SEQ ID NO: 350321 - RNA, 19 nt, Homo sapiens
ggaagaaaguuaccacaac

SEQ ID NO: 350322 - RNA, 19 nt, Homo sapiens
caaacuauagccucaauuu

SEQ ID NO: 350323 - RNA, 19 nt, Homo sapiens
ggccaaagcugugaagaug

SEQ ID NO: 350324 - RNA, 19 nt, Homo sapiens
ccacuacacuuggaagaaa

SEQ ID NO: 350325 - RNA, 19 nt, Homo sapiens
ccaaugagcuuccccaaaa

SEQ ID NO: 350326 - RNA, 19 nt, Homo sapiens
ccaaggaguuaacccauau

SEQ ID NO: 350327 - RNA, 19 nt, Homo sapiens
gccacacucuuuaggauaa

SEQ ID NO: 350328 - RNA, 19 nt, Homo sapiens
cgagagaaaugccaauauc

SEQ ID NO: 350329 - RNA, 19 nt, Homo sapiens
gagaauacugggaguguaa

SEQ ID NO: 350330 - RNA, 19 nt, Homo sapiens
ggagaauacugggagugua

SEQ ID NO: 350331 - RNA, 19 nt, Homo sapiens
gaccagagacugauggaaa

SEQ ID NO: 350332 - RNA, 19 nt, Homo sapiens
cgaugaagaugaugagaau

SEQ ID NO: 350333 - RNA, 19 nt, Homo sapiens
gacccucucuagcaaagua

SEQ ID NO: 350334 - RNA, 19 nt, Homo sapiens
gcgcauaaacugaaaugaa

SEQ ID NO: 350335 - RNA, 19 nt, Homo sapiens
ggcaaauaccucuccauua

SEQ ID NO: 350336 - RNA, 19 nt, Homo sapiens
caauguggguucugguaaa

SEQ ID NO: 350337 - RNA, 19 nt, Homo sapiens
gcagugacaucagccuuga

SEQ ID NO: 350338 - RNA, 19 nt, Homo sapiens
gaucaacgccugcagagau

SEQ ID NO: 350339 - RNA, 19 nt, Homo sapiens
cgaacgagccacacucuuu

SEQ ID NO: 350340 - RNA, 19 nt, Homo sapiens
ugaagagucugucucacaa

SEQ ID NO: 350341 - RNA, 19 nt, Homo sapiens
caaaguacagccagucauu

SEQ ID NO: 350342 - RNA, 19 nt, Homo sapiens
ggacauugcgucaggaaau

SEQ ID NO: 350343 - RNA, 19 nt, Homo sapiens
ggacaugagcgaugaagau

SEQ ID NO: 350344 - RNA, 19 nt, Homo sapiens
gaucaaacaggucaacgaa

SEQ ID NO: 350345 - RNA, 19 nt, Homo sapiens
gcuggaaacuucaggaaag

SEQ ID NO: 350346 - RNA, 19 nt, Homo sapiens
gagagaagcggaagcuaug

SEQ ID NO: 350347 - RNA, 19 nt, Homo sapiens
cugcagagauuuccucaug

SEQ ID NO: 350348 - RNA, 19 nt, Homo sapiens
cgcauaaacugaaaugaau

SEQ ID NO: 350349 - RNA, 19 nt, Homo sapiens
ugacagauccaucaggaaa

SEQ ID NO: 350350 - RNA, 19 nt, Homo sapiens
ggaagugacagauccauca

SEQ ID NO: 350351 - RNA, 19 nt, Homo sapiens
gcaccaugcugaguccaaa

SEQ ID NO: 350352 - RNA, 19 nt, Homo sapiens
gaacugcauuggaaaagaa

SEQ ID NO: 350353 - RNA, 19 nt, Homo sapiens
caccauaugaucccuauaa

SEQ ID NO: 350354 - RNA, 19 nt, Homo sapiens
ggaauccuuuaccgaagaa

SEQ ID NO: 350355 - RNA, 19 nt, Homo sapiens
ccugagcgcuggaaacuuc

SEQ ID NO: 350356 - RNA, 19 nt, Homo sapiens
cuacuucucucgggaugua

SEQ ID NO: 350357 - RNA, 19 nt, Homo sapiens
gaacaggugagucaucauc

SEQ ID NO: 350358 - RNA, 19 nt, Homo sapiens
gagccacacucuuuaggau

SEQ ID NO: 350359 - RNA, 19 nt, Homo sapiens
ugggaaagcuggaaguugu

SEQ ID NO: 350360 - RNA, 19 nt, Homo sapiens
guuacgaccugaccagaga

SEQ ID NO: 350361 - RNA, 19 nt, Homo sapiens
gagacaaguguaaucuuaa

SEQ ID NO: 350362 - RNA, 19 nt, Homo sapiens
augaagaacugcauuggaa

SEQ ID NO: 350363 - RNA, 19 nt, Homo sapiens
gaaaagagaaccagaauac

SEQ ID NO: 350364 - RNA, 19 nt, Homo sapiens
ugcaaugacuugauagcua

SEQ ID NO: 350365 - RNA, 19 nt, Homo sapiens
ggaaguugugacucucuua

SEQ ID NO: 350366 - RNA, 19 nt, Homo sapiens
gcaauguggguucugguaa

SEQ ID NO: 350367 - RNA, 19 nt, Homo sapiens
ggcaaacacuccuggcaau

SEQ ID NO: 350368 - RNA, 19 nt, Homo sapiens
gcaacuucaucauuuccaa

SEQ ID NO: 350369 - RNA, 19 nt, Homo sapiens
aaacauguacuacuucuca

SEQ ID NO: 350370 - RNA, 19 nt, Homo sapiens
cacgugcaaugacuugaua

SEQ ID NO: 350371 - RNA, 19 nt, Homo sapiens
acugggcgcuguagaauga

SEQ ID NO: 350372 - RNA, 19 nt, Homo sapiens
ccuuugagcuggaccgauu

SEQ ID NO: 350373 - RNA, 19 nt, Homo sapiens
caugagcgaugaagaugau

SEQ ID NO: 350374 - RNA, 19 nt, Homo sapiens
caaauggaccaauuauauc

SEQ ID NO: 350375 - RNA, 19 nt, Homo sapiens
aaacaggacuggagcucau

SEQ ID NO: 350376 - RNA, 19 nt, Homo sapiens
gcagggucaugcuguggaa

SEQ ID NO: 350377 - RNA, 19 nt, Homo sapiens
caacuguacacaacauuau

SEQ ID NO: 350378 - RNA, 19 nt, Homo sapiens
ccacaacuguacacaacau

SEQ ID NO: 350379 - RNA, 19 nt, Homo sapiens
cagcaaguuucgaggcaaa

SEQ ID NO: 350380 - RNA, 19 nt, Homo sapiens
ucuguuauguugcagcuuu

SEQ ID NO: 350381 - RNA, 19 nt, Homo sapiens
uuacugaagaucuggaaua

SEQ ID NO: 350382 - RNA, 19 nt, Homo sapiens
gcaaguuucgaggcaaaua

SEQ ID NO: 350383 - RNA, 19 nt, Homo sapiens
aaacguacuggcagcaaua

SEQ ID NO: 350384 - RNA, 19 nt, Homo sapiens
aaaagucacuacaguauga

SEQ ID NO: 350385 - RNA, 19 nt, Homo sapiens
gagcuggagucccugaagu

SEQ ID NO: 350386 - RNA, 19 nt, Homo sapiens
gaucaaaggcagaaaugag

SEQ ID NO: 350387 - RNA, 19 nt, Homo sapiens
gagcauauaauggagaaga

SEQ ID NO: 350388 - RNA, 19 nt, Homo sapiens
gugaacaggugagucauca

SEQ ID NO: 350389 - RNA, 19 nt, Homo sapiens
cugaagaucuggaauacca

SEQ ID NO: 350390 - RNA, 19 nt, Homo sapiens
uauggagcaucaugaagaa

SEQ ID NO: 350391 - RNA, 19 nt, Homo sapiens
acuauagccucaauuuaug

SEQ ID NO: 350392 - RNA, 19 nt, Homo sapiens
gugacucucuuaccaagug

SEQ ID NO: 350393 - RNA, 19 nt, Homo sapiens
ugaaaugaauggcggaaac

SEQ ID NO: 350394 - RNA, 19 nt, Homo sapiens
caaaaucaccagcaaguuu

SEQ ID NO: 350395 - RNA, 19 nt, Homo sapiens
guaccgaucccucugugaa

SEQ ID NO: 350396 - RNA, 19 nt, Homo sapiens
ggaaaagaacucucuaaga

SEQ ID NO: 350397 - RNA, 19 nt, Homo sapiens
caaacguacuggcagcaau

SEQ ID NO: 350398 - RNA, 19 nt, Homo sapiens
ggaagaaggacccuguuac

SEQ ID NO: 350399 - RNA, 19 nt, Homo sapiens
ugauuggccuuuaucugaa

SEQ ID NO: 350400 - RNA, 19 nt, Homo sapiens
cagaaaacauguacuacuu

SEQ ID NO: 350401 - RNA, 19 nt, Homo sapiens
caagacaggagacaagugu

SEQ ID NO: 350402 - RNA, 19 nt, Homo sapiens
aaagcuaguucagaaguug

SEQ ID NO: 350403 - RNA, 19 nt, Homo sapiens
gccuuuaucugaaccaauc

SEQ ID NO: 350404 - RNA, 19 nt, Homo sapiens
agaucagucuggcgaaauu

SEQ ID NO: 350405 - RNA, 19 nt, Homo sapiens
caaauaccucuccauuaug

SEQ ID NO: 350406 - RNA, 19 nt, Homo sapiens
ugaagaugaugagaaugaa

SEQ ID NO: 350407 - RNA, 19 nt, Homo sapiens
aaacacuccuggcaaugug

SEQ ID NO: 350408 - RNA, 19 nt, Homo sapiens
gcaaaagucacuacaguau

SEQ ID NO: 350409 - RNA, 19 nt, Homo sapiens
gaagagucugucucacaaa

SEQ ID NO: 350410 - RNA, 19 nt, Homo sapiens
gaaaugaauggcggaaaca

SEQ ID NO: 350411 - RNA, 19 nt, Homo sapiens
ggagggacaugacuaauuu

SEQ ID NO: 350412 - RNA, 19 nt, Homo sapiens
gacguaagguggauauuaa

SEQ ID NO: 350413 - RNA, 19 nt, Homo sapiens
ggacaugacuaauuuaucg

SEQ ID NO: 350414 - RNA, 19 nt, Homo sapiens
gcacagacuggccgacuua

SEQ ID NO: 350415 - RNA, 19 nt, Homo sapiens
acacggaggucucuguaaa

SEQ ID NO: 350416 - RNA, 19 nt, Homo sapiens
ggugguggauccuggaauu

SEQ ID NO: 350417 - RNA, 19 nt, Homo sapiens
ggaacaacaucuacugcau

SEQ ID NO: 350418 - RNA, 19 nt, Homo sapiens
gaccagacccuccaggaaa

SEQ ID NO: 350419 - RNA, 19 nt, Homo sapiens
ggaguuagaggcuguacaa

SEQ ID NO: 350420 - RNA, 19 nt, Homo sapiens
ugacguaagguggauauua

SEQ ID NO: 350421 - RNA, 19 nt, Homo sapiens
ggucugggcugaacaucga

SEQ ID NO: 350422 - RNA, 19 nt, Homo sapiens
gaccgacuuuccauugauu

SEQ ID NO: 350423 - RNA, 19 nt, Homo sapiens
ggaccgacuuuccauugau

SEQ ID NO: 350424 - RNA, 19 nt, Homo sapiens
gcacuccuguuuccaagca

SEQ ID NO: 350425 - RNA, 19 nt, Homo sapiens
caggacagguggugcaaau

SEQ ID NO: 350426 - RNA, 19 nt, Homo sapiens
gggaccgacuuuccauuga

SEQ ID NO: 350427 - RNA, 19 nt, Homo sapiens
ggauguuccuaaacugaga

SEQ ID NO: 350428 - RNA, 19 nt, Homo sapiens
ggaccagacccuccaggaa

SEQ ID NO: 350429 - RNA, 19 nt, Homo sapiens
ugacacaggcugacucaug

SEQ ID NO: 350430 - RNA, 19 nt, Homo sapiens
gaagcagacagaucucaug

SEQ ID NO: 350431 - RNA, 19 nt, Homo sapiens
ggacagguggugcaaaugg

SEQ ID NO: 350432 - RNA, 19 nt, Homo sapiens
gaaaggcaagagacucaug

SEQ ID NO: 350433 - RNA, 19 nt, Homo sapiens
ggagaggucugggcugaac

SEQ ID NO: 350434 - RNA, 19 nt, Homo sapiens
agccugagcuggccuccua

SEQ ID NO: 350435 - RNA, 19 nt, Homo sapiens
agaggacgcugcucagucu

SEQ ID NO: 350436 - RNA, 19 nt, Homo sapiens
gcaggugcucuguggauga

SEQ ID NO: 350437 - RNA, 19 nt, Homo sapiens
gagggacaugacuaauuua

SEQ ID NO: 350438 - RNA, 19 nt, Homo sapiens
ggaggucucuguaaaagca

SEQ ID NO: 350439 - RNA, 19 nt, Homo sapiens
uugugaagcuagggaguua

SEQ ID NO: 350440 - RNA, 19 nt, Homo sapiens
gcagcugcucgaaagagua

SEQ ID NO: 350441 - RNA, 19 nt, Homo sapiens
gguccuugcacuccuguuu

SEQ ID NO: 350442 - RNA, 19 nt, Homo sapiens
auaggcagcugcucgaaag

SEQ ID NO: 350443 - RNA, 19 nt, Homo sapiens
gaugacacaggcugacuca

SEQ ID NO: 350444 - RNA, 19 nt, Homo sapiens
uggagggacaugacuaauu

SEQ ID NO: 350445 - RNA, 19 nt, Homo sapiens
uggauucccugacguaagg

SEQ ID NO: 350446 - RNA, 19 nt, Homo sapiens
uggcuaccaucgcuucaug

SEQ ID NO: 350447 - RNA, 19 nt, Homo sapiens
ggccuccuaugccucauca

SEQ ID NO: 350448 - RNA, 19 nt, Homo sapiens
aaaggcaagagacucauga

SEQ ID NO: 350449 - RNA, 19 nt, Homo sapiens
gcuuggauucccugacgua

SEQ ID NO: 350450 - RNA, 19 nt, Homo sapiens
ggcagcugcucgaaagagu

SEQ ID NO: 350451 - RNA, 19 nt, Homo sapiens
ggcugaacaucgaggacuu

SEQ ID NO: 350452 - RNA, 19 nt, Homo sapiens
aggccuggauguuccuaaa

SEQ ID NO: 350453 - RNA, 19 nt, Homo sapiens
gugaagcuagggaguuaga

SEQ ID NO: 350454 - RNA, 19 nt, Homo sapiens
gcucaggaacaacaucuac

SEQ ID NO: 350455 - RNA, 19 nt, Homo sapiens
gccuggauguuccuaaacu

SEQ ID NO: 350456 - RNA, 19 nt, Homo sapiens
uauaggcagcugcucgaaa

SEQ ID NO: 350457 - RNA, 19 nt, Homo sapiens
ggaccuguuuucucuuugu

SEQ ID NO: 350458 - RNA, 19 nt, Homo sapiens
uuaccucuguggaccuguu

SEQ ID NO: 350459 - RNA, 19 nt, Homo sapiens
cuuccuccuuuccguguuu

SEQ ID NO: 350460 - RNA, 19 nt, Homo sapiens
guccuucccucucaugacu

SEQ ID NO: 350461 - RNA, 19 nt, Homo sapiens
cagacuggccgacuuagag

SEQ ID NO: 350462 - RNA, 19 nt, Homo sapiens
caacugaacacauuucuua

SEQ ID NO: 350463 - RNA, 19 nt, Homo sapiens
ucaaugggcugucagauuu

SEQ ID NO: 350464 - RNA, 19 nt, Homo sapiens
cagcagaucugaaauuuag

SEQ ID NO: 350465 - RNA, 19 nt, Homo sapiens
gcauggaggcaauguauua

SEQ ID NO: 350466 - RNA, 19 nt, Homo sapiens
gagaguauuugccuuuauu

SEQ ID NO: 350467 - RNA, 19 nt, Homo sapiens
cagaagaaguggaugauga

SEQ ID NO: 350468 - RNA, 19 nt, Homo sapiens
gaagcaauguuggucagua

SEQ ID NO: 350469 - RNA, 19 nt, Homo sapiens
caagaaagaagcaauguug

SEQ ID NO: 350470 - RNA, 19 nt, Homo sapiens
ggacacccuugcuaaagaa

SEQ ID NO: 350471 - RNA, 19 nt, Homo sapiens
ggaggcaauguauuaauua

SEQ ID NO: 350472 - RNA, 19 nt, Homo sapiens
gaagcauccaucccaauua

SEQ ID NO: 350473 - RNA, 19 nt, Homo sapiens
guacaugcgugugacagua

SEQ ID NO: 350474 - RNA, 19 nt, Homo sapiens
ggcauagaaucguccuuua

SEQ ID NO: 350475 - RNA, 19 nt, Homo sapiens
gcagugccuugcauauauu

SEQ ID NO: 350476 - RNA, 19 nt, Homo sapiens
guggaaagacuggcaauua

SEQ ID NO: 350477 - RNA, 19 nt, Homo sapiens
gcuccaagcuuuccaaggu

SEQ ID NO: 350478 - RNA, 19 nt, Homo sapiens
cauggcagaugcaguauug

SEQ ID NO: 350479 - RNA, 19 nt, Homo sapiens
aaugaagacugcuaaaguu

SEQ ID NO: 350480 - RNA, 19 nt, Homo sapiens
ggacaaccacuacaaaaua

SEQ ID NO: 350481 - RNA, 19 nt, Homo sapiens
gauguuguguuacuuguca

SEQ ID NO: 350482 - RNA, 19 nt, Homo sapiens
ccacacaagauauucauuu

SEQ ID NO: 350483 - RNA, 19 nt, Homo sapiens
ggagaguauuugccuuuau

SEQ ID NO: 350484 - RNA, 19 nt, Homo sapiens
uguaauacgugcuuaacuu

SEQ ID NO: 350485 - RNA, 19 nt, Homo sapiens
gaaguacucgaacaagauu

SEQ ID NO: 350486 - RNA, 19 nt, Homo sapiens
agaaugaguugguuuaugg

SEQ ID NO: 350487 - RNA, 19 nt, Homo sapiens
ggaaagacuggcaauuaga

SEQ ID NO: 350488 - RNA, 19 nt, Homo sapiens
guaauacgugcuuaacuuu

SEQ ID NO: 350489 - RNA, 19 nt, Homo sapiens
ccagggcacuucuauuugu

SEQ ID NO: 350490 - RNA, 19 nt, Homo sapiens
gaaaagaaguacucgaaca

SEQ ID NO: 350491 - RNA, 19 nt, Homo sapiens
uacuauaccuucucuauca

SEQ ID NO: 350492 - RNA, 19 nt, Homo sapiens
aaugaguacuugucaauug

SEQ ID NO: 350493 - RNA, 19 nt, Homo sapiens
uggaggcaauguauuaauu

SEQ ID NO: 350494 - RNA, 19 nt, Homo sapiens
gauauucauuuggguguga

SEQ ID NO: 350495 - RNA, 19 nt, Homo sapiens
gaaucguccuuuacacaau

SEQ ID NO: 350496 - RNA, 19 nt, Homo sapiens
aguauuggcucgaguguau

SEQ ID NO: 350497 - RNA, 19 nt, Homo sapiens
gggaaguccuuaggcauga

SEQ ID NO: 350498 - RNA, 19 nt, Homo sapiens
gcagugccaauuugcauuu

SEQ ID NO: 350499 - RNA, 19 nt, Homo sapiens
cacacaagauauucauuug

SEQ ID NO: 350500 - RNA, 19 nt, Homo sapiens
gaaauggucacaacuucau

SEQ ID NO: 350501 - RNA, 19 nt, Homo sapiens
uagaaauggucacaacuuc

SEQ ID NO: 350502 - RNA, 19 nt, Homo sapiens
cugaacacauuucuuaguu

SEQ ID NO: 350503 - RNA, 19 nt, Homo sapiens
uggaaagacuggcaauuag

SEQ ID NO: 350504 - RNA, 19 nt, Homo sapiens
aagcaauguuggucaguaa

SEQ ID NO: 350505 - RNA, 19 nt, Homo sapiens
cacuauagcucucugaaag

SEQ ID NO: 350506 - RNA, 19 nt, Homo sapiens
aagcauccaucccaauuau

SEQ ID NO: 350507 - RNA, 19 nt, Homo sapiens
gacaaccacuacaaaauaa

SEQ ID NO: 350508 - RNA, 19 nt, Homo sapiens
gauaugcuuugccauugug

SEQ ID NO: 350509 - RNA, 19 nt, Homo sapiens
agaaguggaugaugaaguc

SEQ ID NO: 350510 - RNA, 19 nt, Homo sapiens
caaugaagacugcuaaagu

SEQ ID NO: 350511 - RNA, 19 nt, Homo sapiens
gagcuuggcauaaaguuca

SEQ ID NO: 350512 - RNA, 19 nt, Homo sapiens
cgcagugccuugcauauau

SEQ ID NO: 350513 - RNA, 19 nt, Homo sapiens
caauuuaagugcugaugca

SEQ ID NO: 350514 - RNA, 19 nt, Homo sapiens
ccagaaagccagaagaagu

SEQ ID NO: 350515 - RNA, 19 nt, Homo sapiens
aagaaguacucgaacaaga

SEQ ID NO: 350516 - RNA, 19 nt, Homo sapiens
gaggaggccaggcaauaaa

SEQ ID NO: 350517 - RNA, 19 nt, Homo sapiens
gcgugugacaguauaaaua

SEQ ID NO: 350518 - RNA, 19 nt, Homo sapiens
uccuuaagccuucaauuua

SEQ ID NO: 350519 - RNA, 19 nt, Homo sapiens
gaaaagagaagagaaucua

SEQ ID NO: 350520 - RNA, 19 nt, Homo sapiens
cagcuacuccaaaggguua

SEQ ID NO: 350521 - RNA, 19 nt, Homo sapiens
cagaaugaguugguuuaug

SEQ ID NO: 350522 - RNA, 19 nt, Homo sapiens
uaacagaaugaguugguuu

SEQ ID NO: 350523 - RNA, 19 nt, Homo sapiens
uuacacugcuugcccagaa

SEQ ID NO: 350524 - RNA, 19 nt, Homo sapiens
ggucuuacccucagcuguu

SEQ ID NO: 350525 - RNA, 19 nt, Homo sapiens
gcucgaguguauaaacaau

SEQ ID NO: 350526 - RNA, 19 nt, Homo sapiens
gaaagacuggcaauuagag

SEQ ID NO: 350527 - RNA, 19 nt, Homo sapiens
gggcauagaaucguccuuu

SEQ ID NO: 350528 - RNA, 19 nt, Homo sapiens
aacagaaaguggacaauca

SEQ ID NO: 350529 - RNA, 19 nt, Homo sapiens
gaagacugcuaaaguugcu

SEQ ID NO: 350530 - RNA, 19 nt, Homo sapiens
aaacuuuaccggagaagaa

SEQ ID NO: 350531 - RNA, 19 nt, Homo sapiens
gaguacuugucaauugauu

SEQ ID NO: 350532 - RNA, 19 nt, Homo sapiens
uaccuucucuaucaucuug

SEQ ID NO: 350533 - RNA, 19 nt, Homo sapiens
gcgcauggaggcaauguau

SEQ ID NO: 350534 - RNA, 19 nt, Homo sapiens
gcauccaucccaauuauca

SEQ ID NO: 350535 - RNA, 19 nt, Homo sapiens
guaacagaaugaguugguu

SEQ ID NO: 350536 - RNA, 19 nt, Homo sapiens
gaugagcgcagcgaaauuc

SEQ ID NO: 350537 - RNA, 19 nt, Homo sapiens
ccggagaagaaauuaaaua

SEQ ID NO: 350538 - RNA, 19 nt, Homo sapiens
gaagcugaagggugauauu

SEQ ID NO: 350539 - RNA, 19 nt, Homo sapiens
guuaccaaguuacaaugaa

SEQ ID NO: 350540 - RNA, 19 nt, Homo sapiens
uuuccaagguuaccaaguu

SEQ ID NO: 350541 - RNA, 19 nt, Homo sapiens
uccaagcuuuccaagguua

SEQ ID NO: 350542 - RNA, 19 nt, Homo sapiens
gaggcaauguauuaauuac

SEQ ID NO: 350543 - RNA, 19 nt, Homo sapiens
ccaagcuguugcugacaaa

SEQ ID NO: 350544 - RNA, 19 nt, Homo sapiens
gcaguaugccaaagagaau

SEQ ID NO: 350545 - RNA, 19 nt, Homo sapiens
aagauugucuacagaaaca

SEQ ID NO: 350546 - RNA, 19 nt, Homo sapiens
caaugcagcuuuuagaaau

SEQ ID NO: 350547 - RNA, 19 nt, Homo sapiens
ccagaagccuaaauuuuga

SEQ ID NO: 350548 - RNA, 19 nt, Homo sapiens
gcagaucugaaauuuagga

SEQ ID NO: 350549 - RNA, 19 nt, Homo sapiens
aagaagaugcuguuuaauc

SEQ ID NO: 350550 - RNA, 19 nt, Homo sapiens
gaacacuauagcucucuga

SEQ ID NO: 350551 - RNA, 19 nt, Homo sapiens
uggacacccuugcuaaaga

SEQ ID NO: 350552 - RNA, 19 nt, Homo sapiens
aaucguccuuuacacaauu

SEQ ID NO: 350553 - RNA, 19 nt, Homo sapiens
cgguggagcuuggcauaaa

SEQ ID NO: 350554 - RNA, 19 nt, Homo sapiens
gagucaggauuucuuccaa

SEQ ID NO: 350555 - RNA, 19 nt, Homo sapiens
acucagggcugucacaucu

SEQ ID NO: 350556 - RNA, 19 nt, Homo sapiens
gcuccagaagccuaaauuu

SEQ ID NO: 350557 - RNA, 19 nt, Homo sapiens
gcccagaaagccagaagaa

SEQ ID NO: 350558 - RNA, 19 nt, Homo sapiens
uuccaagguuaccaaguua

SEQ ID NO: 350559 - RNA, 19 nt, Homo sapiens
ccaaagagaaugguaccaa

SEQ ID NO: 350560 - RNA, 19 nt, Homo sapiens
ucaggcagcuacuccaaag

SEQ ID NO: 350561 - RNA, 19 nt, Homo sapiens
cacugcaacugaacacauu

SEQ ID NO: 350562 - RNA, 19 nt, Homo sapiens
gaagagugcccacguauaa

SEQ ID NO: 350563 - RNA, 19 nt, Homo sapiens
gcccaggccuuuggugaaa

SEQ ID NO: 350564 - RNA, 19 nt, Homo sapiens
cgaagagugcccacguaua

SEQ ID NO: 350565 - RNA, 19 nt, Homo sapiens
gugaccaccuccaccaaug

SEQ ID NO: 350566 - RNA, 19 nt, Homo sapiens
gcgaagagugcccacguau

SEQ ID NO: 350567 - RNA, 19 nt, Homo sapiens
uaaagccaaaggucuagaa

SEQ ID NO: 350568 - RNA, 19 nt, Homo sapiens
ugacuguucuucccugcau

SEQ ID NO: 350569 - RNA, 19 nt, Homo sapiens
ccaaaggucuagaaaagca

SEQ ID NO: 350570 - RNA, 19 nt, Homo sapiens
ggagaugcccaggccuuug

SEQ ID NO: 350571 - RNA, 19 nt, Homo sapiens
uagguuugcucgucacagu

SEQ ID NO: 350572 - RNA, 19 nt, Homo sapiens
ugcgaagagugcccacgua

SEQ ID NO: 350573 - RNA, 19 nt, Homo sapiens
cagaggugcuguagaugcu

SEQ ID NO: 350574 - RNA, 19 nt, Homo sapiens
agagugcccacguauaaga

SEQ ID NO: 350575 - RNA, 19 nt, Homo sapiens
gagaugcccaggccuuugg

SEQ ID NO: 350576 - RNA, 19 nt, Homo sapiens
agaccaccaucgugagcuu

SEQ ID NO: 350577 - RNA, 19 nt, Homo sapiens
ugaccaccuccaccaauga

SEQ ID NO: 350578 - RNA, 19 nt, Homo sapiens
gcucucugcgcccuuguug

SEQ ID NO: 350579 - RNA, 19 nt, Homo sapiens
caggagagauguauuauuu

SEQ ID NO: 350580 - RNA, 19 nt, Homo sapiens
gaacauaucuugucuuagc

SEQ ID NO: 350581 - RNA, 19 nt, Homo sapiens
ggacagcuauuaagcacuu

SEQ ID NO: 350582 - RNA, 19 nt, Homo sapiens
gcccaacacuuuaauuuau

SEQ ID NO: 350583 - RNA, 19 nt, Homo sapiens
caugaugucuuaccucaaa

SEQ ID NO: 350584 - RNA, 19 nt, Homo sapiens
cugaacauaucuugucuua

SEQ ID NO: 350585 - RNA, 19 nt, Homo sapiens
cgaaagcaguggccaauuc

SEQ ID NO: 350586 - RNA, 19 nt, Homo sapiens
ggaaacagaacuuuaagau

SEQ ID NO: 350587 - RNA, 19 nt, Homo sapiens
gaacugaacauaucuuguc

SEQ ID NO: 350588 - RNA, 19 nt, Homo sapiens
gcacacuacuccaaaucaa

SEQ ID NO: 350589 - RNA, 19 nt, Homo sapiens
ccaggaaacagaacuuuaa

SEQ ID NO: 350590 - RNA, 19 nt, Homo sapiens
gcucugggcuugccuucaa

SEQ ID NO: 350591 - RNA, 19 nt, Homo sapiens
gagcccaacacuuuaauuu

SEQ ID NO: 350592 - RNA, 19 nt, Homo sapiens
gcucugauccgcuguuuga

SEQ ID NO: 350593 - RNA, 19 nt, Homo sapiens
ccgacugucuggacuauaa

SEQ ID NO: 350594 - RNA, 19 nt, Homo sapiens
gucacuaacuggcguguuu

SEQ ID NO: 350595 - RNA, 19 nt, Homo sapiens
gaaugaaagaggagaagaa

SEQ ID NO: 350596 - RNA, 19 nt, Homo sapiens
gcccuccucuuccuacuuu

SEQ ID NO: 350597 - RNA, 19 nt, Homo sapiens
ggacugcagcucauaccua

SEQ ID NO: 350598 - RNA, 19 nt, Homo sapiens
ggagagauguauuauuucc

SEQ ID NO: 350599 - RNA, 19 nt, Homo sapiens
ggaacgcuguacauaguca

SEQ ID NO: 350600 - RNA, 19 nt, Homo sapiens
gaaagcaguggccaauuca

SEQ ID NO: 350601 - RNA, 19 nt, Homo sapiens
ccuggaaacucaacuucaa

SEQ ID NO: 350602 - RNA, 19 nt, Homo sapiens
caggcuacauuuccaauca

SEQ ID NO: 350603 - RNA, 19 nt, Homo sapiens
cgggaacgcuguacauagu

SEQ ID NO: 350604 - RNA, 19 nt, Homo sapiens
ccucuuaucccauguccua

SEQ ID NO: 350605 - RNA, 19 nt, Homo sapiens
ugugagagauccagguaga

SEQ ID NO: 350606 - RNA, 19 nt, Homo sapiens
ccagggaccacuuaaacuu

SEQ ID NO: 350607 - RNA, 19 nt, Homo sapiens
ccagcugccucaucuaucu

SEQ ID NO: 350608 - RNA, 19 nt, Homo sapiens
ggagguggcgcucaagauc

SEQ ID NO: 350609 - RNA, 19 nt, Homo sapiens
ucgcuacccugacaucuuc

SEQ ID NO: 350610 - RNA, 19 nt, Homo sapiens
cuguuagcaugaugucuua

SEQ ID NO: 350611 - RNA, 19 nt, Homo sapiens
acacuggagucacuaacug

SEQ ID NO: 350612 - RNA, 19 nt, Homo sapiens
gcuguuagcaugaugucuu

SEQ ID NO: 350613 - RNA, 19 nt, Homo sapiens
cagggaccacuuaaacuuu

SEQ ID NO: 350614 - RNA, 19 nt, Homo sapiens
ugucuuagcacccaggaaa

SEQ ID NO: 350615 - RNA, 19 nt, Homo sapiens
ggaaugaaagaggagaaga

SEQ ID NO: 350616 - RNA, 19 nt, Homo sapiens
cuacauuuccaaucaccua

SEQ ID NO: 350617 - RNA, 19 nt, Homo sapiens
gcgcucugauccgcuguuu

SEQ ID NO: 350618 - RNA, 19 nt, Homo sapiens
cggcuuggccuacacauuc

SEQ ID NO: 350619 - RNA, 19 nt, Homo sapiens
ggagaagaaacgcaacuac

SEQ ID NO: 350620 - RNA, 19 nt, Homo sapiens
caucaucaccacccacaug

SEQ ID NO: 350621 - RNA, 19 nt, Homo sapiens
ugguugaacugaacauauc

SEQ ID NO: 350622 - RNA, 19 nt, Homo sapiens
ugaaagaggagaagaaacg

SEQ ID NO: 350623 - RNA, 19 nt, Homo sapiens
ccaccgcagcagccucuua

SEQ ID NO: 350624 - RNA, 19 nt, Homo sapiens
cccaggaaacagaacuuua

SEQ ID NO: 350625 - RNA, 19 nt, Homo sapiens
aaacaaccgagcaagacaa

SEQ ID NO: 350626 - RNA, 19 nt, Homo sapiens
guugguugguugaacugaa

SEQ ID NO: 350627 - RNA, 19 nt, Homo sapiens
ccuaaacaaccgagcaaga

SEQ ID NO: 350628 - RNA, 19 nt, Homo sapiens
agcccaacacuuuaauuua

SEQ ID NO: 350629 - RNA, 19 nt, Homo sapiens
gcgggaacgcuguacauag

SEQ ID NO: 350630 - RNA, 19 nt, Homo sapiens
ugagagauccagguagaug

SEQ ID NO: 350631 - RNA, 19 nt, Homo sapiens
aaugaaagaggagaagaaa

SEQ ID NO: 350632 - RNA, 19 nt, Homo sapiens
cuugugagcccaggaauga

SEQ ID NO: 350633 - RNA, 19 nt, Homo sapiens
gagguggcgcucaagauca

SEQ ID NO: 350634 - RNA, 19 nt, Homo sapiens
gcuguugguugguugaacu

SEQ ID NO: 350635 - RNA, 19 nt, Homo sapiens
ggcgggaacgcuguacaua

SEQ ID NO: 350636 - RNA, 19 nt, Homo sapiens
cuucagcugcccucgauuu

SEQ ID NO: 350637 - RNA, 19 nt, Homo sapiens
guuugagcccaacacuuua

SEQ ID NO: 350638 - RNA, 19 nt, Homo sapiens
uaaacaaccgagcaagaca

SEQ ID NO: 350639 - RNA, 19 nt, Homo sapiens
guacaccagcugccucauc

SEQ ID NO: 350640 - RNA, 19 nt, Homo sapiens
gaggagguggcgcucaaga

SEQ ID NO: 350641 - RNA, 19 nt, Homo sapiens
agacaagccacuccgacaa

SEQ ID NO: 350642 - RNA, 19 nt, Homo sapiens
caccagcugccucaucuau

SEQ ID NO: 350643 - RNA, 19 nt, Homo sapiens
uacaccagcugccucaucu

SEQ ID NO: 350644 - RNA, 19 nt, Homo sapiens
gacaagccacuccgacaag

SEQ ID NO: 350645 - RNA, 19 nt, Homo sapiens
caaaucaaaaccacuaaga

SEQ ID NO: 350646 - RNA, 19 nt, Homo sapiens
aagacucgcuacccugaca

SEQ ID NO: 350647 - RNA, 19 nt, Homo sapiens
cacacuacuccaaaucaaa

SEQ ID NO: 350648 - RNA, 19 nt, Homo sapiens
cagucuuucuggacagcua

SEQ ID NO: 350649 - RNA, 19 nt, Homo sapiens
acaggagagauguauuauu

SEQ ID NO: 350650 - RNA, 19 nt, Homo sapiens
ugugagcccaggaaugaaa

SEQ ID NO: 350651 - RNA, 19 nt, Homo sapiens
ggccuacacauucuauaca

SEQ ID NO: 350652 - RNA, 19 nt, Homo sapiens
ggucuugugagcccaggaa

SEQ ID NO: 350653 - RNA, 19 nt, Homo sapiens
gcgguuccaggucuuguga

SEQ ID NO: 350654 - RNA, 19 nt, Homo sapiens
gagcugcacugaaacuuua

SEQ ID NO: 350655 - RNA, 19 nt, Homo sapiens
gaggugagcugcacugaaa

SEQ ID NO: 350656 - RNA, 19 nt, Homo sapiens
ggacaaaccaaucugcuua

SEQ ID NO: 350657 - RNA, 19 nt, Homo sapiens
aaacugugaucuccuguua

SEQ ID NO: 350658 - RNA, 19 nt, Homo sapiens
gcagagguguuccauuguu

SEQ ID NO: 350659 - RNA, 19 nt, Homo sapiens
gagaggagguggcacugaa

SEQ ID NO: 350660 - RNA, 19 nt, Homo sapiens
ggacacuaauucaucugua

SEQ ID NO: 350661 - RNA, 19 nt, Homo sapiens
aagcagagguguuccauug

SEQ ID NO: 350662 - RNA, 19 nt, Homo sapiens
ccaaacaaccuuagcauga

SEQ ID NO: 350663 - RNA, 19 nt, Homo sapiens
ugacccugaugaauuauua

SEQ ID NO: 350664 - RNA, 19 nt, Homo sapiens
gacacuaauucaucuguaa

SEQ ID NO: 350665 - RNA, 19 nt, Homo sapiens
gaauggaggucaaaacaaa

SEQ ID NO: 350666 - RNA, 19 nt, Homo sapiens
ggacaaagagagucagaga

SEQ ID NO: 350667 - RNA, 19 nt, Homo sapiens
ugaauugugugacugauug

SEQ ID NO: 350668 - RNA, 19 nt, Homo sapiens
gguugaaucuuaggaauga

SEQ ID NO: 350669 - RNA, 19 nt, Homo sapiens
gcucugacccugaugaauu

SEQ ID NO: 350670 - RNA, 19 nt, Homo sapiens
ggaagugaguucagagagu

SEQ ID NO: 350671 - RNA, 19 nt, Homo sapiens
gugcagguaugguuuaaga

SEQ ID NO: 350672 - RNA, 19 nt, Homo sapiens
uggcucaacuuccuacuuu

SEQ ID NO: 350673 - RNA, 19 nt, Homo sapiens
agcaugaugucuuaucuua

SEQ ID NO: 350674 - RNA, 19 nt, Homo sapiens
gcaacugaguacugaucua

SEQ ID NO: 350675 - RNA, 19 nt, Homo sapiens
cuacaaaccagcaacauga

SEQ ID NO: 350676 - RNA, 19 nt, Homo sapiens
ccacugauugcuuggauua

SEQ ID NO: 350677 - RNA, 19 nt, Homo sapiens
cgccacaucuacuuugaua

SEQ ID NO: 350678 - RNA, 19 nt, Homo sapiens
agacucaucugaucaaagu

SEQ ID NO: 350679 - RNA, 19 nt, Homo sapiens
gcugacugcuuggauuaua

SEQ ID NO: 350680 - RNA, 19 nt, Homo sapiens
caaacaaccuuagcaugau

SEQ ID NO: 350681 - RNA, 19 nt, Homo sapiens
gacuguggaucauauuuga

SEQ ID NO: 350682 - RNA, 19 nt, Homo sapiens
gcagugcuccugugucuau

SEQ ID NO: 350683 - RNA, 19 nt, Homo sapiens
ggauuuggcagauauguau

SEQ ID NO: 350684 - RNA, 19 nt, Homo sapiens
caaagagagucagagaaga

SEQ ID NO: 350685 - RNA, 19 nt, Homo sapiens
aauccuugguugaaucuua

SEQ ID NO: 350686 - RNA, 19 nt, Homo sapiens
caacugaguacugaucuaa

SEQ ID NO: 350687 - RNA, 19 nt, Homo sapiens
ggagucaauauguaguuua

SEQ ID NO: 350688 - RNA, 19 nt, Homo sapiens
uuaagauccugucauaguu

SEQ ID NO: 350689 - RNA, 19 nt, Homo sapiens
gaaauggacaaaccaaucu

SEQ ID NO: 350690 - RNA, 19 nt, Homo sapiens
ugagaucauugucguuuau

SEQ ID NO: 350691 - RNA, 19 nt, Homo sapiens
guaaagagacauuggucaa

SEQ ID NO: 350692 - RNA, 19 nt, Homo sapiens
cagagcaacugaguacuga

SEQ ID NO: 350693 - RNA, 19 nt, Homo sapiens
gaucuccuguuauuguaug

SEQ ID NO: 350694 - RNA, 19 nt, Homo sapiens
cagagguguuccauuguuu

SEQ ID NO: 350695 - RNA, 19 nt, Homo sapiens
acugugaucuccuguuauu

SEQ ID NO: 350696 - RNA, 19 nt, Homo sapiens
ggacuguggaucauauuug

SEQ ID NO: 350697 - RNA, 19 nt, Homo sapiens
uugcagauguuaaauggaa

SEQ ID NO: 350698 - RNA, 19 nt, Homo sapiens
gcagguaugguuuaagaau

SEQ ID NO: 350699 - RNA, 19 nt, Homo sapiens
gaagcacuguuugccaaga

SEQ ID NO: 350700 - RNA, 19 nt, Homo sapiens
gugaucuccuguuauugua

SEQ ID NO: 350701 - RNA, 19 nt, Homo sapiens
cgagaggcauagaaggaaa

SEQ ID NO: 350702 - RNA, 19 nt, Homo sapiens
cugauugcuuggauuauaa

SEQ ID NO: 350703 - RNA, 19 nt, Homo sapiens
ccagggauauggagcuuca

SEQ ID NO: 350704 - RNA, 19 nt, Homo sapiens
acaaucagugugugucuua

SEQ ID NO: 350705 - RNA, 19 nt, Homo sapiens
aaacaaccuuagcaugaug

SEQ ID NO: 350706 - RNA, 19 nt, Homo sapiens
ugcuuaagauccugucaua

SEQ ID NO: 350707 - RNA, 19 nt, Homo sapiens
uggaacaaguggccaauuc

SEQ ID NO: 350708 - RNA, 19 nt, Homo sapiens
gcuugcagauguuaaaugg

SEQ ID NO: 350709 - RNA, 19 nt, Homo sapiens
gacaaaccaaucugcuuaa

SEQ ID NO: 350710 - RNA, 19 nt, Homo sapiens
acugauugcuuggauuaua

SEQ ID NO: 350711 - RNA, 19 nt, Homo sapiens
cauggacuguggaucauau

SEQ ID NO: 350712 - RNA, 19 nt, Homo sapiens
gggcauggacuguggauca

SEQ ID NO: 350713 - RNA, 19 nt, Homo sapiens
cucugacccugaugaauua

SEQ ID NO: 350714 - RNA, 19 nt, Homo sapiens
uaagauccugucauaguuu

SEQ ID NO: 350715 - RNA, 19 nt, Homo sapiens
agaguuagaugggaugaug

SEQ ID NO: 350716 - RNA, 19 nt, Homo sapiens
gaucauauuugaccccuau

SEQ ID NO: 350717 - RNA, 19 nt, Homo sapiens
auacucaggcuucagguua

SEQ ID NO: 350718 - RNA, 19 nt, Homo sapiens
acugaaacuuuacgacaaa

SEQ ID NO: 350719 - RNA, 19 nt, Homo sapiens
uaagagacaaucagugugu

SEQ ID NO: 350720 - RNA, 19 nt, Homo sapiens
uguccuagaugcacuacuu

SEQ ID NO: 350721 - RNA, 19 nt, Homo sapiens
ggaacaaguggccaauuca

SEQ ID NO: 350722 - RNA, 19 nt, Homo sapiens
aaaggacacuaauucaucu

SEQ ID NO: 350723 - RNA, 19 nt, Homo sapiens
gcaccuccaaacaaccuua

SEQ ID NO: 350724 - RNA, 19 nt, Homo sapiens
guucauaaggagucaauau

SEQ ID NO: 350725 - RNA, 19 nt, Homo sapiens
cugcuuggauuauaaagau

SEQ ID NO: 350726 - RNA, 19 nt, Homo sapiens
caauugcucugacccugau

SEQ ID NO: 350727 - RNA, 19 nt, Homo sapiens
cuagaugcacuacuuuauu

SEQ ID NO: 350728 - RNA, 19 nt, Homo sapiens
ggaaugaacagugucucaa

SEQ ID NO: 350729 - RNA, 19 nt, Homo sapiens
gggaugaugcucagacuca

SEQ ID NO: 350730 - RNA, 19 nt, Homo sapiens
cagagguccuaucccauga

SEQ ID NO: 350731 - RNA, 19 nt, Homo sapiens
cacugaaacuuuacgacaa

SEQ ID NO: 350732 - RNA, 19 nt, Homo sapiens
cagugugugucuuauaaau

SEQ ID NO: 350733 - RNA, 19 nt, Homo sapiens
caaaccaaucugcuuaaga

SEQ ID NO: 350734 - RNA, 19 nt, Homo sapiens
gcagucaccagccaucuca

SEQ ID NO: 350735 - RNA, 19 nt, Homo sapiens
uaaaaugguucuagcacaa

SEQ ID NO: 350736 - RNA, 19 nt, Homo sapiens
cugagaucauugucguuua

SEQ ID NO: 350737 - RNA, 19 nt, Homo sapiens
gcaugaugucuuaucuuaa

SEQ ID NO: 350738 - RNA, 19 nt, Homo sapiens
gugugugucuuauaaaugg

SEQ ID NO: 350739 - RNA, 19 nt, Homo sapiens
caagcucauucacguuuca

SEQ ID NO: 350740 - RNA, 19 nt, Homo sapiens
caaaccagcaacaugaaau

SEQ ID NO: 350741 - RNA, 19 nt, Homo sapiens
cagguuauagucaaggaua

SEQ ID NO: 350742 - RNA, 19 nt, Homo sapiens
gaaugaacagugucucaag

SEQ ID NO: 350743 - RNA, 19 nt, Homo sapiens
caaaguuccgagaggcaua

SEQ ID NO: 350744 - RNA, 19 nt, Homo sapiens
caaagugagaccugccaaa

SEQ ID NO: 350745 - RNA, 19 nt, Homo sapiens
guugguaagccuagcagua

SEQ ID NO: 350746 - RNA, 19 nt, Homo sapiens
acaaagagagucagagaag

SEQ ID NO: 350747 - RNA, 19 nt, Homo sapiens
ugaaauggacaaaccaauc

SEQ ID NO: 350748 - RNA, 19 nt, Homo sapiens
gaaauuccagguuuuguga

SEQ ID NO: 350749 - RNA, 19 nt, Homo sapiens
gacaaagagagucagagaa

SEQ ID NO: 350750 - RNA, 19 nt, Homo sapiens
gcaaagugaucaaaagcau

SEQ ID NO: 350751 - RNA, 19 nt, Homo sapiens
gucaaugggcugagucuga

SEQ ID NO: 350752 - RNA, 19 nt, Homo sapiens
gcaccucagucccgaccau

SEQ ID NO: 350753 - RNA, 19 nt, Homo sapiens
gagaagagaagcaaaagga

SEQ ID NO: 350754 - RNA, 19 nt, Homo sapiens
gagcugcacugaaacuuua

SEQ ID NO: 350755 - RNA, 19 nt, Homo sapiens
gaggugagcugcacugaaa

SEQ ID NO: 350756 - RNA, 19 nt, Homo sapiens
ggacaaaccaaucugcuua

SEQ ID NO: 350757 - RNA, 19 nt, Homo sapiens
aaacugugaucuccuguua

SEQ ID NO: 350758 - RNA, 19 nt, Homo sapiens
gcagagguguuccauuguu

SEQ ID NO: 350759 - RNA, 19 nt, Homo sapiens
gagaggagguggcacugaa

SEQ ID NO: 350760 - RNA, 19 nt, Homo sapiens
ggacacuaauucaucugua

SEQ ID NO: 350761 - RNA, 19 nt, Homo sapiens
aagcagagguguuccauug

SEQ ID NO: 350762 - RNA, 19 nt, Homo sapiens
ccaaacaaccuuagcauga

SEQ ID NO: 350763 - RNA, 19 nt, Homo sapiens
ugacccugaugaauuauua

SEQ ID NO: 350764 - RNA, 19 nt, Homo sapiens
gacacuaauucaucuguaa

SEQ ID NO: 350765 - RNA, 19 nt, Homo sapiens
gaauggaggucaaaacaaa

SEQ ID NO: 350766 - RNA, 19 nt, Homo sapiens
ggacaaagagagucagaga

SEQ ID NO: 350767 - RNA, 19 nt, Homo sapiens
ugaauugugugacugauug

SEQ ID NO: 350768 - RNA, 19 nt, Homo sapiens
gguugaaucuuaggaauga

SEQ ID NO: 350769 - RNA, 19 nt, Homo sapiens
gcucugacccugaugaauu

SEQ ID NO: 350770 - RNA, 19 nt, Homo sapiens
ggaagugaguucagagagu

SEQ ID NO: 350771 - RNA, 19 nt, Homo sapiens
gugcagguaugguuuaaga

SEQ ID NO: 350772 - RNA, 19 nt, Homo sapiens
uggcucaacuuccuacuuu

SEQ ID NO: 350773 - RNA, 19 nt, Homo sapiens
agcaugaugucuuaucuua

SEQ ID NO: 350774 - RNA, 19 nt, Homo sapiens
gcaacugaguacugaucua

SEQ ID NO: 350775 - RNA, 19 nt, Homo sapiens
cuacaaaccagcaacauga

SEQ ID NO: 350776 - RNA, 19 nt, Homo sapiens
ccacugauugcuuggauua

SEQ ID NO: 350777 - RNA, 19 nt, Homo sapiens
agacucaucugaucaaagu

SEQ ID NO: 350778 - RNA, 19 nt, Homo sapiens
gcugacugcuuggauuaua

SEQ ID NO: 350779 - RNA, 19 nt, Homo sapiens
caaacaaccuuagcaugau

SEQ ID NO: 350780 - RNA, 19 nt, Homo sapiens
gacuguggaucauauuuga

SEQ ID NO: 350781 - RNA, 19 nt, Homo sapiens
gcagugcuccugugucuau

SEQ ID NO: 350782 - RNA, 19 nt, Homo sapiens
ggauuuggcagauauguau

SEQ ID NO: 350783 - RNA, 19 nt, Homo sapiens
caaagagagucagagaaga

SEQ ID NO: 350784 - RNA, 19 nt, Homo sapiens
aauccuugguugaaucuua

SEQ ID NO: 350785 - RNA, 19 nt, Homo sapiens
caacugaguacugaucuaa

SEQ ID NO: 350786 - RNA, 19 nt, Homo sapiens
ggagucaauauguaguuua

SEQ ID NO: 350787 - RNA, 19 nt, Homo sapiens
uuaagauccugucauaguu

SEQ ID NO: 350788 - RNA, 19 nt, Homo sapiens
gaaauggacaaaccaaucu

SEQ ID NO: 350789 - RNA, 19 nt, Homo sapiens
ugagaucauugucguuuau

SEQ ID NO: 350790 - RNA, 19 nt, Homo sapiens
guaaagagacauuggucaa

SEQ ID NO: 350791 - RNA, 19 nt, Homo sapiens
cagagcaacugaguacuga

SEQ ID NO: 350792 - RNA, 19 nt, Homo sapiens
gaucuccuguuauuguaug

SEQ ID NO: 350793 - RNA, 19 nt, Homo sapiens
cagagguguuccauuguuu

SEQ ID NO: 350794 - RNA, 19 nt, Homo sapiens
acugugaucuccuguuauu

SEQ ID NO: 350795 - RNA, 19 nt, Homo sapiens
ggacuguggaucauauuug

SEQ ID NO: 350796 - RNA, 19 nt, Homo sapiens
uugcagauguuaaauggaa

SEQ ID NO: 350797 - RNA, 19 nt, Homo sapiens
gcagguaugguuuaagaau

SEQ ID NO: 350798 - RNA, 19 nt, Homo sapiens
gaagcacuguuugccaaga

SEQ ID NO: 350799 - RNA, 19 nt, Homo sapiens
gugaucuccuguuauugua

SEQ ID NO: 350800 - RNA, 19 nt, Homo sapiens
cgagaggcauagaaggaaa

SEQ ID NO: 350801 - RNA, 19 nt, Homo sapiens
cugauugcuuggauuauaa

SEQ ID NO: 350802 - RNA, 19 nt, Homo sapiens
ccagggauauggagcuuca

SEQ ID NO: 350803 - RNA, 19 nt, Homo sapiens
acaaucagugugugucuua

SEQ ID NO: 350804 - RNA, 19 nt, Homo sapiens
aaacaaccuuagcaugaug

SEQ ID NO: 350805 - RNA, 19 nt, Homo sapiens
ugcuuaagauccugucaua

SEQ ID NO: 350806 - RNA, 19 nt, Homo sapiens
uggaacaaguggccaauuc

SEQ ID NO: 350807 - RNA, 19 nt, Homo sapiens
gcuugcagauguuaaaugg

SEQ ID NO: 350808 - RNA, 19 nt, Homo sapiens
gacaaaccaaucugcuuaa

SEQ ID NO: 350809 - RNA, 19 nt, Homo sapiens
acugauugcuuggauuaua

SEQ ID NO: 350810 - RNA, 19 nt, Homo sapiens
cauggacuguggaucauau

SEQ ID NO: 350811 - RNA, 19 nt, Homo sapiens
gggcauggacuguggauca

SEQ ID NO: 350812 - RNA, 19 nt, Homo sapiens
cucugacccugaugaauua

SEQ ID NO: 350813 - RNA, 19 nt, Homo sapiens
uaagauccugucauaguuu

SEQ ID NO: 350814 - RNA, 19 nt, Homo sapiens
agaguuagaugggaugaug

SEQ ID NO: 350815 - RNA, 19 nt, Homo sapiens
gaucauauuugaccccuau

SEQ ID NO: 350816 - RNA, 19 nt, Homo sapiens
auacucaggcuucagguua

SEQ ID NO: 350817 - RNA, 19 nt, Homo sapiens
acugaaacuuuacgacaaa

SEQ ID NO: 350818 - RNA, 19 nt, Homo sapiens
uaagagacaaucagugugu

SEQ ID NO: 350819 - RNA, 19 nt, Homo sapiens
uguccuagaugcacuacuu

SEQ ID NO: 350820 - RNA, 19 nt, Homo sapiens
ggaacaaguggccaauuca

SEQ ID NO: 350821 - RNA, 19 nt, Homo sapiens
gcaccuccaaacaaccuua

SEQ ID NO: 350822 - RNA, 19 nt, Homo sapiens
aaaggacacuaauucaucu

SEQ ID NO: 350823 - RNA, 19 nt, Homo sapiens
guucauaaggagucaauau

SEQ ID NO: 350824 - RNA, 19 nt, Homo sapiens
cugcuuggauuauaaagau

SEQ ID NO: 350825 - RNA, 19 nt, Homo sapiens
caauugcucugacccugau

SEQ ID NO: 350826 - RNA, 19 nt, Homo sapiens
cuagaugcacuacuuuauu

SEQ ID NO: 350827 - RNA, 19 nt, Homo sapiens
ggaaugaacagugucucaa

SEQ ID NO: 350828 - RNA, 19 nt, Homo sapiens
gggaugaugcucagacuca

SEQ ID NO: 350829 - RNA, 19 nt, Homo sapiens
cagagguccuaucccauga

SEQ ID NO: 350830 - RNA, 19 nt, Homo sapiens
cacugaaacuuuacgacaa

SEQ ID NO: 350831 - RNA, 19 nt, Homo sapiens
cagugugugucuuauaaau

SEQ ID NO: 350832 - RNA, 19 nt, Homo sapiens
caaaccaaucugcuuaaga

SEQ ID NO: 350833 - RNA, 19 nt, Homo sapiens
gcagucaccagccaucuca

SEQ ID NO: 350834 - RNA, 19 nt, Homo sapiens
uaaaaugguucuagcacaa

SEQ ID NO: 350835 - RNA, 19 nt, Homo sapiens
cugagaucauugucguuua

SEQ ID NO: 350836 - RNA, 19 nt, Homo sapiens
gugugugucuuauaaaugg

SEQ ID NO: 350837 - RNA, 19 nt, Homo sapiens
caagcucauucacguuuca

SEQ ID NO: 350838 - RNA, 19 nt, Homo sapiens
caaaccagcaacaugaaau

SEQ ID NO: 350839 - RNA, 19 nt, Homo sapiens
gcaugaugucuuaucuuaa

SEQ ID NO: 350840 - RNA, 19 nt, Homo sapiens
cagguuauagucaaggaua

SEQ ID NO: 350841 - RNA, 19 nt, Homo sapiens
gaaugaacagugucucaag

SEQ ID NO: 350842 - RNA, 19 nt, Homo sapiens
caaaguuccgagaggcaua

SEQ ID NO: 350843 - RNA, 19 nt, Homo sapiens
caaagugagaccugccaaa

SEQ ID NO: 350844 - RNA, 19 nt, Homo sapiens
guugguaagccuagcagua

SEQ ID NO: 350845 - RNA, 19 nt, Homo sapiens
acaaagagagucagagaag

SEQ ID NO: 350846 - RNA, 19 nt, Homo sapiens
ugaaauggacaaaccaauc

SEQ ID NO: 350847 - RNA, 19 nt, Homo sapiens
gaaauuccagguuuuguga

SEQ ID NO: 350848 - RNA, 19 nt, Homo sapiens
gucaaugggcugagucuga

SEQ ID NO: 350849 - RNA, 19 nt, Homo sapiens
gacaaagagagucagagaa

SEQ ID NO: 350850 - RNA, 19 nt, Homo sapiens
gcaaagugaucaaaagcau

SEQ ID NO: 350851 - RNA, 19 nt, Homo sapiens
gcaccucagucccgaccau

SEQ ID NO: 350852 - RNA, 19 nt, Homo sapiens
gagaagagaagcaaaagga

SEQ ID NO: 350853 - RNA, 19 nt, Homo sapiens
gagcaacugaguacugauc

SEQ ID NO: 350854 - RNA, 19 nt, Homo sapiens
cccauaaacucguguguua

SEQ ID NO: 350855 - RNA, 19 nt, Homo sapiens
ugucuugucuuaugacuua

SEQ ID NO: 350856 - RNA, 19 nt, Homo sapiens
gaugugcgcuuucuaggaa

SEQ ID NO: 350857 - RNA, 19 nt, Homo sapiens
cuaaggaucuccaggauga

SEQ ID NO: 350858 - RNA, 19 nt, Homo sapiens
gaaacuguaucccuuggaa

SEQ ID NO: 350859 - RNA, 19 nt, Homo sapiens
uaacuugggucuucagaug

SEQ ID NO: 350860 - RNA, 19 nt, Homo sapiens
ucacugagauccacggaaa

SEQ ID NO: 350861 - RNA, 19 nt, Homo sapiens
gggcaaagcaggcaucaaa

SEQ ID NO: 350862 - RNA, 19 nt, Homo sapiens
uacaaggcaugguuuauaa

SEQ ID NO: 350863 - RNA, 19 nt, Homo sapiens
gaacaaacuccucuagcuu

SEQ ID NO: 350864 - RNA, 19 nt, Homo sapiens
aagaagcacuggauugauu

SEQ ID NO: 350865 - RNA, 19 nt, Homo sapiens
ucaucaaugucuugucuua

SEQ ID NO: 350866 - RNA, 19 nt, Homo sapiens
caaguccucuuucucuaaa

SEQ ID NO: 350867 - RNA, 19 nt, Homo sapiens
ggaacaaacuccucuagcu

SEQ ID NO: 350868 - RNA, 19 nt, Homo sapiens
ggaaguacaccaagcaaga

SEQ ID NO: 350869 - RNA, 19 nt, Homo sapiens
gccaaucucuuuuccauua

SEQ ID NO: 350870 - RNA, 19 nt, Homo sapiens
caacuucuuuaccacaauu

SEQ ID NO: 350871 - RNA, 19 nt, Homo sapiens
ggacauuggacauggauga

SEQ ID NO: 350872 - RNA, 19 nt, Homo sapiens
ccucaaagccucuaagaau

SEQ ID NO: 350873 - RNA, 19 nt, Homo sapiens
gaaagguucacaggacaua

SEQ ID NO: 350874 - RNA, 19 nt, Homo sapiens
gccaucagcuucaguuaca

SEQ ID NO: 350875 - RNA, 19 nt, Homo sapiens
gcuaugaauuauuggagaa

SEQ ID NO: 350876 - RNA, 19 nt, Homo sapiens
agaauaggccaaucucuuu

SEQ ID NO: 350877 - RNA, 19 nt, Homo sapiens
gaagacuccuggauuucau

SEQ ID NO: 350878 - RNA, 19 nt, Homo sapiens
gaggacacaugacuuugau

SEQ ID NO: 350879 - RNA, 19 nt, Homo sapiens
uaaaggagaggaacagaga

SEQ ID NO: 350880 - RNA, 19 nt, Homo sapiens
gcugucaucugcugugaau

SEQ ID NO: 350881 - RNA, 19 nt, Homo sapiens
gcacccaccugauauuugc

SEQ ID NO: 350882 - RNA, 19 nt, Homo sapiens
cgaagaagcacuggauuga

SEQ ID NO: 350883 - RNA, 19 nt, Homo sapiens
ucaaugucuugucuuauga

SEQ ID NO: 350884 - RNA, 19 nt, Homo sapiens
ucaaacaaguccucuuucu

SEQ ID NO: 350885 - RNA, 19 nt, Homo sapiens
gcauggaccacugauagua

SEQ ID NO: 350886 - RNA, 19 nt, Homo sapiens
caucugcugugaauucuuc

SEQ ID NO: 350887 - RNA, 19 nt, Homo sapiens
uuacaaggcaugguuuaua

SEQ ID NO: 350888 - RNA, 19 nt, Homo sapiens
gaaagaguggguuggcuau

SEQ ID NO: 350889 - RNA, 19 nt, Homo sapiens
gaaguacaccaagcaagaa

SEQ ID NO: 350890 - RNA, 19 nt, Homo sapiens
agaagacccugaccucugu

SEQ ID NO: 350891 - RNA, 19 nt, Homo sapiens
gaccacugauaguaagauu

SEQ ID NO: 350892 - RNA, 19 nt, Homo sapiens
aaacucguguguuauuuca

SEQ ID NO: 350893 - RNA, 19 nt, Homo sapiens
gaacuuuggcaccucaaga

SEQ ID NO: 350894 - RNA, 19 nt, Homo sapiens
ggaagacuccuggauuuca

SEQ ID NO: 350895 - RNA, 19 nt, Homo sapiens
cuucuuauauccuggacua

SEQ ID NO: 350896 - RNA, 19 nt, Homo sapiens
gcgaagaagcacuggauug

SEQ ID NO: 350897 - RNA, 19 nt, Homo sapiens
aaacaaguccucuuucucu

SEQ ID NO: 350898 - RNA, 19 nt, Homo sapiens
ccucaaacaaguccucuuu

SEQ ID NO: 350899 - RNA, 19 nt, Homo sapiens
aaagcacacuguagcucua

SEQ ID NO: 350900 - RNA, 19 nt, Homo sapiens
ggacuuuucucuucuuaau

SEQ ID NO: 350901 - RNA, 19 nt, Homo sapiens
cagaauaggccaaucucuu

SEQ ID NO: 350902 - RNA, 19 nt, Homo sapiens
gagauuuguuccuuugucu

SEQ ID NO: 350903 - RNA, 19 nt, Homo sapiens
ccucaagauucaccacuau

SEQ ID NO: 350904 - RNA, 19 nt, Homo sapiens
aagaguggguuggcuauga

SEQ ID NO: 350905 - RNA, 19 nt, Homo sapiens
ucuuaugacuuacauggaa

SEQ ID NO: 350906 - RNA, 19 nt, Homo sapiens
ucaaugaacaacaaucaga

SEQ ID NO: 350907 - RNA, 19 nt, Homo sapiens
uugaagagcuccuguuugc

SEQ ID NO: 350908 - RNA, 19 nt, Homo sapiens
ggguugggcugguucuugu

SEQ ID NO: 350909 - RNA, 19 nt, Homo sapiens
gagcgaagaagcacuggau

SEQ ID NO: 350910 - RNA, 19 nt, Homo sapiens
cucaaagccucuaagaaug

SEQ ID NO: 350911 - RNA, 19 nt, Homo sapiens
aaacucugcuguggaugaa

SEQ ID NO: 350912 - RNA, 19 nt, Homo sapiens
ccauuccucugucaacuca

SEQ ID NO: 350913 - RNA, 19 nt, Homo sapiens
ggagagaagacugagauca

SEQ ID NO: 350914 - RNA, 19 nt, Homo sapiens
gucuacguauugaaugaua

SEQ ID NO: 350915 - RNA, 19 nt, Homo sapiens
gaagaagcacuggauugau

SEQ ID NO: 350916 - RNA, 19 nt, Homo sapiens
caagauucaccacuauguu

SEQ ID NO: 350917 - RNA, 19 nt, Homo sapiens
agaagcacuggauugauua

SEQ ID NO: 350918 - RNA, 19 nt, Homo sapiens
ucucugcacccaccugaua

SEQ ID NO: 350919 - RNA, 19 nt, Homo sapiens
ccacacaucguccaaacau

SEQ ID NO: 350920 - RNA, 19 nt, Homo sapiens
aacaaacuccucuagcuuu

SEQ ID NO: 350921 - RNA, 19 nt, Homo sapiens
cauggaccacugauaguaa

SEQ ID NO: 350922 - RNA, 19 nt, Homo sapiens
cagcaucuccagggaagua

SEQ ID NO: 350923 - RNA, 19 nt, Homo sapiens
gaacagagagcugaaaaca

SEQ ID NO: 350924 - RNA, 19 nt, Homo sapiens
acaaguccucuuucucuaa

SEQ ID NO: 350925 - RNA, 19 nt, Homo sapiens
agacugagacccuuagaca

SEQ ID NO: 350926 - RNA, 19 nt, Homo sapiens
ggauugauuaccaguaugu

SEQ ID NO: 350927 - RNA, 19 nt, Homo sapiens
caccugauauuugccuuug

SEQ ID NO: 350928 - RNA, 19 nt, Homo sapiens
gacaaugccaucagcuuca

SEQ ID NO: 350929 - RNA, 19 nt, Homo sapiens
uuacauggaaguugggaaa

SEQ ID NO: 350930 - RNA, 19 nt, Homo sapiens
ugaggacacaugacuuuga

SEQ ID NO: 350931 - RNA, 19 nt, Homo sapiens
aacaaguccucuuucucua

SEQ ID NO: 350932 - RNA, 19 nt, Homo sapiens
gcugcugucugcugcuguu

SEQ ID NO: 350933 - RNA, 19 nt, Homo sapiens
ucagauuguugcuaaggau

SEQ ID NO: 350934 - RNA, 19 nt, Homo sapiens
gaaaccauuccucugucaa

SEQ ID NO: 350935 - RNA, 19 nt, Homo sapiens
aucaaugucuugucuuaug

SEQ ID NO: 350936 - RNA, 19 nt, Homo sapiens
gagagaagacugagaucac

SEQ ID NO: 350937 - RNA, 19 nt, Homo sapiens
ccacugauaguaagauuuu

SEQ ID NO: 350938 - RNA, 19 nt, Homo sapiens
uuauaaggcgagagcauuu

SEQ ID NO: 350939 - RNA, 19 nt, Homo sapiens
uuugagauuuguuccuuug

SEQ ID NO: 350940 - RNA, 19 nt, Homo sapiens
ucugaggacacaugacuuu

SEQ ID NO: 350941 - RNA, 19 nt, Homo sapiens
ccgcuuuguucccaucuau

SEQ ID NO: 350942 - RNA, 19 nt, Homo sapiens
ugucaucugcugugaauuc

SEQ ID NO: 350943 - RNA, 19 nt, Homo sapiens
ugagauuuguuccuuuguc

SEQ ID NO: 350944 - RNA, 19 nt, Homo sapiens
ucaaagccucuaagaaugg

SEQ ID NO: 350945 - RNA, 19 nt, Homo sapiens
ucaagauucaccacuaugu

SEQ ID NO: 350946 - RNA, 19 nt, Homo sapiens
acugagacccuuagacaga

SEQ ID NO: 350947 - RNA, 19 nt, Homo sapiens
uaaacucguguguuauuuc

SEQ ID NO: 350948 - RNA, 19 nt, Homo sapiens
gccuuugccucaaugaaca

SEQ ID NO: 350949 - RNA, 19 nt, Homo sapiens
uuaccaguaugucccguau

SEQ ID NO: 350950 - RNA, 19 nt, Homo sapiens
ggauuucaucaaugucuug

SEQ ID NO: 350951 - RNA, 19 nt, Homo sapiens
aagauucaccacuauguug

SEQ ID NO: 350952 - RNA, 19 nt, Homo sapiens
caaacaaguccucuuucuc

SEQ ID NO: 350953 - RNA, 19 nt, Homo sapiens
cuacccagaguucaacaaa

SEQ ID NO: 350954 - RNA, 19 nt, Homo sapiens
cauaucaccucauuucuaa

SEQ ID NO: 350955 - RNA, 19 nt, Homo sapiens
gaugacaaauguacagaug

SEQ ID NO: 350956 - RNA, 19 nt, Homo sapiens
ugacaaauguacagauguu

SEQ ID NO: 350957 - RNA, 19 nt, Homo sapiens
ccacauaucaccucauuuc

SEQ ID NO: 350958 - RNA, 19 nt, Homo sapiens
gcaaggagaggcacacaug

SEQ ID NO: 350959 - RNA, 19 nt, Homo sapiens
guaccuaugucaagagaag

SEQ ID NO: 350960 - RNA, 19 nt, Homo sapiens
gaagauguaccuaugucaa

SEQ ID NO: 350961 - RNA, 19 nt, Homo sapiens
gaagguggccguggcacua

SEQ ID NO: 350962 - RNA, 19 nt, Homo sapiens
gaagacaugggccacuuga

SEQ ID NO: 350963 - RNA, 19 nt, Homo sapiens
gggaagauguaccuauguc

SEQ ID NO: 350964 - RNA, 19 nt, Homo sapiens
gcacgcacaggaagccuuu

SEQ ID NO: 350965 - RNA, 19 nt, Homo sapiens
ucucauggcuagggaaguu

SEQ ID NO: 350966 - RNA, 19 nt, Homo sapiens
gcugcucucuggagucuca

SEQ ID NO: 350967 - RNA, 19 nt, Homo sapiens
ccaagccucucaccugucu

SEQ ID NO: 350968 - RNA, 19 nt, Homo sapiens
gacaaauguacagauguua

SEQ ID NO: 350969 - RNA, 19 nt, Homo sapiens
acauaucaccucauuucua

SEQ ID NO: 350970 - RNA, 19 nt, Homo sapiens
gcgcaagaccuccaagaag

SEQ ID NO: 350971 - RNA, 19 nt, Homo sapiens
caaggugccaagaagguuu

SEQ ID NO: 350972 - RNA, 19 nt, Homo sapiens
uaucaccucauuucuaaga

SEQ ID NO: 350973 - RNA, 19 nt, Homo sapiens
agucucaccucaagaagau

SEQ ID NO: 350974 - RNA, 19 nt, Homo sapiens
ccgcuggcuuugaacauga

SEQ ID NO: 350975 - RNA, 19 nt, Homo sapiens
gcuaagacacaaauuacuc

SEQ ID NO: 350976 - RNA, 19 nt, Homo sapiens
ggaagauguaccuauguca

SEQ ID NO: 350977 - RNA, 19 nt, Homo sapiens
ucacucaggcccagcaaug

SEQ ID NO: 350978 - RNA, 19 nt, Homo sapiens
caagagacacguccgaacu

SEQ ID NO: 350979 - RNA, 19 nt, Homo sapiens
guucugagccugggaagau

SEQ ID NO: 350980 - RNA, 19 nt, Homo sapiens
cugggaagauguaccuaug

SEQ ID NO: 350981 - RNA, 19 nt, Homo sapiens
gcuggcaucaccugcaauu

SEQ ID NO: 350982 - RNA, 19 nt, Homo sapiens
uuccacauaucaccucauu

SEQ ID NO: 350983 - RNA, 19 nt, Homo sapiens
uggcagggcuucuaaugcu

SEQ ID NO: 350984 - RNA, 19 nt, Homo sapiens
agacaugggccacuugaca

SEQ ID NO: 350985 - RNA, 19 nt, Homo sapiens
gcugcccucugaagacaug

SEQ ID NO: 350986 - RNA, 19 nt, Homo sapiens
agauguaccuaugucaaga

SEQ ID NO: 350987 - RNA, 19 nt, Homo sapiens
gcgcugcucucuggagucu

SEQ ID NO: 350988 - RNA, 19 nt, Homo sapiens
cagcugcccucugaagaca

SEQ ID NO: 350989 - RNA, 19 nt, Homo sapiens
guucgguccucccaguuuc

SEQ ID NO: 350990 - RNA, 19 nt, Homo sapiens
ugugugcacugcugugugu

SEQ ID NO: 350991 - RNA, 19 nt, Homo sapiens
ccaguggacaucagaguca

SEQ ID NO: 350992 - RNA, 19 nt, Homo sapiens
ccagaggagguucgagcua

SEQ ID NO: 350993 - RNA, 19 nt, Homo sapiens
ccucucaccugucuguucu

SEQ ID NO: 350994 - RNA, 19 nt, Homo sapiens
gagucucaccucaagaaga

SEQ ID NO: 350995 - RNA, 19 nt, Homo sapiens
cuaagacacaaauuacuca

SEQ ID NO: 350996 - RNA, 19 nt, Homo sapiens
ccaagaagguuuuauuucc

SEQ ID NO: 350997 - RNA, 19 nt, Homo sapiens
agagacacguccgaacuca

SEQ ID NO: 350998 - RNA, 19 nt, Homo sapiens
ucaccugcaauuaccuuaa

SEQ ID NO: 350999 - RNA, 19 nt, Homo sapiens
acuacaaggugccaagaag

SEQ ID NO: 351000 - RNA, 19 nt, Homo sapiens
agaaaacuccggagggaua

SEQ ID NO: 351001 - RNA, 19 nt, Homo sapiens
caccuucgaccucaagaga

SEQ ID NO: 351002 - RNA, 19 nt, Homo sapiens
caaggagaggcacacaugu

SEQ ID NO: 351003 - RNA, 19 nt, Homo sapiens
gauaauuggcagggcaguu

SEQ ID NO: 351004 - RNA, 19 nt, Homo sapiens
aaacuccggagggauaauu

SEQ ID NO: 351005 - RNA, 19 nt, Homo sapiens
cuucgagacucuagcuaca

SEQ ID NO: 351006 - RNA, 19 nt, Homo sapiens
agacacguccgaacucaca

SEQ ID NO: 351007 - RNA, 19 nt, Homo sapiens
caugagccuucgagacucu

SEQ ID NO: 351008 - RNA, 19 nt, Homo sapiens
uccgcuaagacacaaauua

SEQ ID NO: 351009 - RNA, 19 nt, Homo sapiens
uggagucucaccucaagaa

SEQ ID NO: 351010 - RNA, 19 nt, Homo sapiens
ucuggagucucaccucaag

SEQ ID NO: 351011 - RNA, 19 nt, Homo sapiens
acaagugcagccuguguga

SEQ ID NO: 351012 - RNA, 19 nt, Homo sapiens
augcugaaccgccacauga

SEQ ID NO: 351013 - RNA, 19 nt, Homo sapiens
cugaagacaugggccacuu

SEQ ID NO: 351014 - RNA, 19 nt, Homo sapiens
ccugcccgcuggcuuugaa

SEQ ID NO: 351015 - RNA, 19 nt, Homo sapiens
ccgcuaagacacaaauuac

SEQ ID NO: 351016 - RNA, 19 nt, Homo sapiens
uggcaucaccugcaauuac

SEQ ID NO: 351017 - RNA, 19 nt, Homo sapiens
ccuucgaccucaagagaca

SEQ ID NO: 351018 - RNA, 19 nt, Homo sapiens
ccacaugaagugucacaac

SEQ ID NO: 351019 - RNA, 19 nt, Homo sapiens
gaaccgccacaugaagugu

SEQ ID NO: 351020 - RNA, 19 nt, Homo sapiens
gagaccauauugaguauua

SEQ ID NO: 351021 - RNA, 19 nt, Homo sapiens
uaacguggcuuuacagauu

SEQ ID NO: 351022 - RNA, 19 nt, Homo sapiens
ccacaacccucuccuacaa

SEQ ID NO: 351023 - RNA, 19 nt, Homo sapiens
ccucggagauggcacuuua

SEQ ID NO: 351024 - RNA, 19 nt, Homo sapiens
gaacaacgcaugcggaauc

SEQ ID NO: 351025 - RNA, 19 nt, Homo sapiens
uacaugaccuggacaaauu

SEQ ID NO: 351026 - RNA, 19 nt, Homo sapiens
ccacggcaguguuuaugua

SEQ ID NO: 351027 - RNA, 19 nt, Homo sapiens
cugauaaccuugcccauaa

SEQ ID NO: 351028 - RNA, 19 nt, Homo sapiens
gcaaaccaaagucaaagua

SEQ ID NO: 351029 - RNA, 19 nt, Homo sapiens
ugagaaaugucaucagaau

SEQ ID NO: 351030 - RNA, 19 nt, Homo sapiens
gagcagagcuucgcugaac

SEQ ID NO: 351031 - RNA, 19 nt, Homo sapiens
aaucagagaggccaaguua

SEQ ID NO: 351032 - RNA, 19 nt, Homo sapiens
cacaaucacuugccagaga

SEQ ID NO: 351033 - RNA, 19 nt, Homo sapiens
aaggauaacccucccaaua

SEQ ID NO: 351034 - RNA, 19 nt, Homo sapiens
ggacugauccagaauuuac

SEQ ID NO: 351035 - RNA, 19 nt, Homo sapiens
cuacaauucuggcuucaug

SEQ ID NO: 351036 - RNA, 19 nt, Homo sapiens
gauggcacuuuaccagaaa

SEQ ID NO: 351037 - RNA, 19 nt, Homo sapiens
ugccagagauccagaaguu

SEQ ID NO: 351038 - RNA, 19 nt, Homo sapiens
gccaagcuccguucucuuu

SEQ ID NO: 351039 - RNA, 19 nt, Homo sapiens
caggagaccauauugagua

SEQ ID NO: 351040 - RNA, 19 nt, Homo sapiens
gaccuucaguggaugagaa

SEQ ID NO: 351041 - RNA, 19 nt, Homo sapiens
uggagagacugcagaugua

SEQ ID NO: 351042 - RNA, 19 nt, Homo sapiens
agacaggugugcaaaguuc

SEQ ID NO: 351043 - RNA, 19 nt, Homo sapiens
gaucccaucuacauauuac

SEQ ID NO: 351044 - RNA, 19 nt, Homo sapiens
cagccaggauccacaauca

SEQ ID NO: 351045 - RNA, 19 nt, Homo sapiens
guaccucugcuaucucuuu

SEQ ID NO: 351046 - RNA, 19 nt, Homo sapiens
aaaccaaagucaaaguauc

SEQ ID NO: 351047 - RNA, 19 nt, Homo sapiens
guacaugaccuggacaaau

SEQ ID NO: 351048 - RNA, 19 nt, Homo sapiens
caagcuccguucucuuuua

SEQ ID NO: 351049 - RNA, 19 nt, Homo sapiens
gcucuccuccaauuuguuu

SEQ ID NO: 351050 - RNA, 19 nt, Homo sapiens
gaucuacggcuacaauucu

SEQ ID NO: 351051 - RNA, 19 nt, Homo sapiens
cuauaaaccucucauucuc

SEQ ID NO: 351052 - RNA, 19 nt, Homo sapiens
caaguuagcaggagaccau

SEQ ID NO: 351053 - RNA, 19 nt, Homo sapiens
ggccauugcugcauguaca

SEQ ID NO: 351054 - RNA, 19 nt, Homo sapiens
ugagacaggugugcaaagu

SEQ ID NO: 351055 - RNA, 19 nt, Homo sapiens
agauggcacuuuaccagaa

SEQ ID NO: 351056 - RNA, 19 nt, Homo sapiens
ugggacugauccagaauuu

SEQ ID NO: 351057 - RNA, 19 nt, Homo sapiens
caaaccaaagucaaaguau

SEQ ID NO: 351058 - RNA, 19 nt, Homo sapiens
aggauaacccucccaauau

SEQ ID NO: 351059 - RNA, 19 nt, Homo sapiens
ccuacaaccuggaaaggau

SEQ ID NO: 351060 - RNA, 19 nt, Homo sapiens
ugagcuaggugcugagaca

SEQ ID NO: 351061 - RNA, 19 nt, Homo sapiens
gguauccgaucccaucuac

SEQ ID NO: 351062 - RNA, 19 nt, Homo sapiens
ugagagagauggccaaccu

SEQ ID NO: 351063 - RNA, 19 nt, Homo sapiens
cuucaucuccuucuucauu

SEQ ID NO: 351064 - RNA, 19 nt, Homo sapiens
gaucugggccuaccuuggu

SEQ ID NO: 351065 - RNA, 19 nt, Homo sapiens
ccugauaaccuugcccaua

SEQ ID NO: 351066 - RNA, 19 nt, Homo sapiens
caaugugggcuguucuuga

SEQ ID NO: 351067 - RNA, 19 nt, Homo sapiens
uggaauuuaugcauguuga

SEQ ID NO: 351068 - RNA, 19 nt, Homo sapiens
gcagauguaguccaaacug

SEQ ID NO: 351069 - RNA, 19 nt, Homo sapiens
gacagaccuuuacccacaa

SEQ ID NO: 351070 - RNA, 19 nt, Homo sapiens
gcuacaaugugggcuguuc

SEQ ID NO: 351071 - RNA, 19 nt, Homo sapiens
ccgaucccaucuacauauu

SEQ ID NO: 351072 - RNA, 19 nt, Homo sapiens
gcaggagaccauauugagu

SEQ ID NO: 351073 - RNA, 19 nt, Homo sapiens
gagaaaugucaucagaaug

SEQ ID NO: 351074 - RNA, 19 nt, Homo sapiens
cuucugcgcuugcuacagu

SEQ ID NO: 351075 - RNA, 19 nt, Homo sapiens
caacgcaugcggaaucagu

SEQ ID NO: 351076 - RNA, 19 nt, Homo sapiens
uguacuggcucuccuccaa

SEQ ID NO: 351077 - RNA, 19 nt, Homo sapiens
gaccacacggcuccuauuc

SEQ ID NO: 351078 - RNA, 19 nt, Homo sapiens
cuacaaccuggaaaggaua

SEQ ID NO: 351079 - RNA, 19 nt, Homo sapiens
guuagcaggagaccauauu

SEQ ID NO: 351080 - RNA, 19 nt, Homo sapiens
gagacaggugugcaaaguu

SEQ ID NO: 351081 - RNA, 19 nt, Homo sapiens
gaauuuaugcauguugauc

SEQ ID NO: 351082 - RNA, 19 nt, Homo sapiens
gcagagcuucgcugaacug

SEQ ID NO: 351083 - RNA, 19 nt, Homo sapiens
uugcagaaguccagguuca

SEQ ID NO: 351084 - RNA, 19 nt, Homo sapiens
ucuauaaaccucucauucu

SEQ ID NO: 351085 - RNA, 19 nt, Homo sapiens
uagcaggagaccauauuga

SEQ ID NO: 351086 - RNA, 19 nt, Homo sapiens
gaaucagagaggccaaguu

SEQ ID NO: 351087 - RNA, 19 nt, Homo sapiens
uacuggcucuccuccaauu

SEQ ID NO: 351088 - RNA, 19 nt, Homo sapiens
gcccauaaccaugcauuuc

SEQ ID NO: 351089 - RNA, 19 nt, Homo sapiens
aaugugggcuguucuugag

SEQ ID NO: 351090 - RNA, 19 nt, Homo sapiens
ccagagauccagaaguuuu

SEQ ID NO: 351091 - RNA, 19 nt, Homo sapiens
acaaucacuugccagagau

SEQ ID NO: 351092 - RNA, 19 nt, Homo sapiens
gggacugauccagaauuua

SEQ ID NO: 351093 - RNA, 19 nt, Homo sapiens
cgaucccaucuacauauua

SEQ ID NO: 351094 - RNA, 19 nt, Homo sapiens
cagguggccucuggugguu

SEQ ID NO: 351095 - RNA, 19 nt, Homo sapiens
acaugaccuggacaaauua

SEQ ID NO: 351096 - RNA, 19 nt, Homo sapiens
uccaggaucucacgguauc

SEQ ID NO: 351097 - RNA, 19 nt, Homo sapiens
cuucuucauugcuuugaga

SEQ ID NO: 351098 - RNA, 19 nt, Homo sapiens
aacguggcuuuacagauuu

SEQ ID NO: 351099 - RNA, 19 nt, Homo sapiens
ggagagacugcagauguag

SEQ ID NO: 351100 - RNA, 19 nt, Homo sapiens
caguaccucugcuaucucu

SEQ ID NO: 351101 - RNA, 19 nt, Homo sapiens
gagguggcuucuggagaga

SEQ ID NO: 351102 - RNA, 19 nt, Homo sapiens
aggagaccauauugaguau

SEQ ID NO: 351103 - RNA, 19 nt, Homo sapiens
caggauccacaaucacuug

SEQ ID NO: 351104 - RNA, 19 nt, Homo sapiens
ccgccaagcuccguucucu

SEQ ID NO: 351105 - RNA, 19 nt, Homo sapiens
cccagcguguuguacauga

SEQ ID NO: 351106 - RNA, 19 nt, Homo sapiens
uauccgaucccaucuacau

SEQ ID NO: 351107 - RNA, 19 nt, Homo sapiens
gaccauauugaguauuaca

SEQ ID NO: 351108 - RNA, 19 nt, Homo sapiens
uuacccacuucaaauaugg

SEQ ID NO: 351109 - RNA, 19 nt, Homo sapiens
uaaccuugcccauaaccau

SEQ ID NO: 351110 - RNA, 19 nt, Homo sapiens
caaucuucaucuccuucuu

SEQ ID NO: 351111 - RNA, 19 nt, Homo sapiens
ucagagaggccaaguuagc

SEQ ID NO: 351112 - RNA, 19 nt, Homo sapiens
uuugcccgcugccugauuu

SEQ ID NO: 351113 - RNA, 19 nt, Homo sapiens
gcaaaagcaaguccucuuc

SEQ ID NO: 351114 - RNA, 19 nt, Homo sapiens
gcugcgagagcgugaacaa

SEQ ID NO: 351115 - RNA, 19 nt, Homo sapiens
agaaugaugccccugauaa

SEQ ID NO: 351116 - RNA, 19 nt, Homo sapiens
gcagccaggauccacaauc

SEQ ID NO: 351117 - RNA, 19 nt, Homo sapiens
cuggagagacugcagaugu

SEQ ID NO: 351118 - RNA, 19 nt, Homo sapiens
ggaauuuaugcauguugau

SEQ ID NO: 351119 - RNA, 19 nt, Homo sapiens
ccuuuacgacagaccuuua

SEQ ID NO: 351120 - RNA, 19 nt, Homo sapiens
guacuuaucuggugaauua

SEQ ID NO: 351121 - RNA, 19 nt, Homo sapiens
gaaaggacaucaauaauca

SEQ ID NO: 351122 - RNA, 19 nt, Homo sapiens
gaagagggcuagaaaccua

SEQ ID NO: 351123 - RNA, 19 nt, Homo sapiens
gaggaucgcccaucaaaua

SEQ ID NO: 351124 - RNA, 19 nt, Homo sapiens
gaagggcccuagaaauuga

SEQ ID NO: 351125 - RNA, 19 nt, Homo sapiens
caaguuccauagaguaaua

SEQ ID NO: 351126 - RNA, 19 nt, Homo sapiens
gagaguugcugucaugauu

SEQ ID NO: 351127 - RNA, 19 nt, Homo sapiens
ugauguggcuuuccucuua

SEQ ID NO: 351128 - RNA, 19 nt, Homo sapiens
ggacaagucuaggauuuga

SEQ ID NO: 351129 - RNA, 19 nt, Homo sapiens
gaagauggcggcucucaaa

SEQ ID NO: 351130 - RNA, 19 nt, Homo sapiens
cauauaaacuguucucuag

SEQ ID NO: 351131 - RNA, 19 nt, Homo sapiens
cgaugcagguuuccaaaua

SEQ ID NO: 351132 - RNA, 19 nt, Homo sapiens
gaaggaggaucgcccauca

SEQ ID NO: 351133 - RNA, 19 nt, Homo sapiens
caaagacuaaggcguauua

SEQ ID NO: 351134 - RNA, 19 nt, Homo sapiens
ccacaugguuaaaugcaua

SEQ ID NO: 351135 - RNA, 19 nt, Homo sapiens
cauugaaacucacuucuuu

SEQ ID NO: 351136 - RNA, 19 nt, Homo sapiens
gguagagguugaagaaauu

SEQ ID NO: 351137 - RNA, 19 nt, Homo sapiens
ggaaacaguuacuauucuu

SEQ ID NO: 351138 - RNA, 19 nt, Homo sapiens
gaaaagaauugagcguuua

SEQ ID NO: 351139 - RNA, 19 nt, Homo sapiens
gaagggcugugggauaauu

SEQ ID NO: 351140 - RNA, 19 nt, Homo sapiens
gaucgcaaauugaaauaug

SEQ ID NO: 351141 - RNA, 19 nt, Homo sapiens
uuaaacagaugcccaagaa

SEQ ID NO: 351142 - RNA, 19 nt, Homo sapiens
aaagggaaaugcacauaaa

SEQ ID NO: 351143 - RNA, 19 nt, Homo sapiens
gaugauaccugggaagaug

SEQ ID NO: 351144 - RNA, 19 nt, Homo sapiens
gcuagaaaccuaacugauu

SEQ ID NO: 351145 - RNA, 19 nt, Homo sapiens
caaaccaacuaucuaucua

SEQ ID NO: 351146 - RNA, 19 nt, Homo sapiens
caagagaggugagggaguu

SEQ ID NO: 351147 - RNA, 19 nt, Homo sapiens
aaacaugguggguagauua

SEQ ID NO: 351148 - RNA, 19 nt, Homo sapiens
caagaagggcugugggaua

SEQ ID NO: 351149 - RNA, 19 nt, Homo sapiens
cuagaaaccuaacugauuc

SEQ ID NO: 351150 - RNA, 19 nt, Homo sapiens
uaacgaagugccuuuaauu

SEQ ID NO: 351151 - RNA, 19 nt, Homo sapiens
aagaagggcugugggauaa

SEQ ID NO: 351152 - RNA, 19 nt, Homo sapiens
aagaaaggguugacucuga

SEQ ID NO: 351153 - RNA, 19 nt, Homo sapiens
ggaagauggugaaaggaau

SEQ ID NO: 351154 - RNA, 19 nt, Homo sapiens
gcaaggaaacaguuacuau

SEQ ID NO: 351155 - RNA, 19 nt, Homo sapiens
gaagaaauuguggauauug

SEQ ID NO: 351156 - RNA, 19 nt, Homo sapiens
ggacagagguaggcauagu

SEQ ID NO: 351157 - RNA, 19 nt, Homo sapiens
gcaaaaggagcauuuauaa

SEQ ID NO: 351158 - RNA, 19 nt, Homo sapiens
gacaguggaugacguacaa

SEQ ID NO: 351159 - RNA, 19 nt, Homo sapiens
gggaggugcuauggauuua

SEQ ID NO: 351160 - RNA, 19 nt, Homo sapiens
guaacacacaccauauaua

SEQ ID NO: 351161 - RNA, 19 nt, Homo sapiens
gaugcagguuuccaaauau

SEQ ID NO: 351162 - RNA, 19 nt, Homo sapiens
gaacgacaguacuuaucug

SEQ ID NO: 351163 - RNA, 19 nt, Homo sapiens
aaagagugcuauacauguu

SEQ ID NO: 351164 - RNA, 19 nt, Homo sapiens
aagaagggcccuagaaauu

SEQ ID NO: 351165 - RNA, 19 nt, Homo sapiens
caaggaaacaguuacuauu

SEQ ID NO: 351166 - RNA, 19 nt, Homo sapiens
gaguaacacacaccauaua

SEQ ID NO: 351167 - RNA, 19 nt, Homo sapiens
caaagggaaaugcacauaa

SEQ ID NO: 351168 - RNA, 19 nt, Homo sapiens
gcaaagggaaaugcacaua

SEQ ID NO: 351169 - RNA, 19 nt, Homo sapiens
gaaaaugacccuucuuaga

SEQ ID NO: 351170 - RNA, 19 nt, Homo sapiens
ggagaaauaacuaguucaa

SEQ ID NO: 351171 - RNA, 19 nt, Homo sapiens
gcagaucgcaaauugaaau

SEQ ID NO: 351172 - RNA, 19 nt, Homo sapiens
uuauguacaucgccuuaua

SEQ ID NO: 351173 - RNA, 19 nt, Homo sapiens
gauguggcuuuccucuuaa

SEQ ID NO: 351174 - RNA, 19 nt, Homo sapiens
gaauaugguauguaugcua

SEQ ID NO: 351175 - RNA, 19 nt, Homo sapiens
gaucgcccaucaaauacaa

SEQ ID NO: 351176 - RNA, 19 nt, Homo sapiens
uuauacagauccaguagaa

SEQ ID NO: 351177 - RNA, 19 nt, Homo sapiens
aaaccuaacugauucuucu

SEQ ID NO: 351178 - RNA, 19 nt, Homo sapiens
agacuaaggcguauuauag

SEQ ID NO: 351179 - RNA, 19 nt, Homo sapiens
ccaagaagggcccuagaaa

SEQ ID NO: 351180 - RNA, 19 nt, Homo sapiens
gaaaugcauuaaggaauac

SEQ ID NO: 351181 - RNA, 19 nt, Homo sapiens
gggauguguuuguuccuuu

SEQ ID NO: 351182 - RNA, 19 nt, Homo sapiens
cagcagaucgcaaauugaa

SEQ ID NO: 351183 - RNA, 19 nt, Homo sapiens
ugugucaaccgcauuauua

SEQ ID NO: 351184 - RNA, 19 nt, Homo sapiens
gcaaugacagcagaguuaa

SEQ ID NO: 351185 - RNA, 19 nt, Homo sapiens
caagaagggcccuagaaau

SEQ ID NO: 351186 - RNA, 19 nt, Homo sapiens
gcaggcaaggaaacaguua

SEQ ID NO: 351187 - RNA, 19 nt, Homo sapiens
guggguagauuagguuuga

SEQ ID NO: 351188 - RNA, 19 nt, Homo sapiens
gggauaauuuaccaugaau

SEQ ID NO: 351189 - RNA, 19 nt, Homo sapiens
uaggagaguugcugucaug

SEQ ID NO: 351190 - RNA, 19 nt, Homo sapiens
gcccaaauauaacuguuca

SEQ ID NO: 351191 - RNA, 19 nt, Homo sapiens
guucaauggucagcacuuu

SEQ ID NO: 351192 - RNA, 19 nt, Homo sapiens
uggcuuuccucuuaaauau

SEQ ID NO: 351193 - RNA, 19 nt, Homo sapiens
ugaaaggacaucaauaauc

SEQ ID NO: 351194 - RNA, 19 nt, Homo sapiens
acaugaagcugaugcagau

SEQ ID NO: 351195 - RNA, 19 nt, Homo sapiens
ccagaagacauccauauuc

SEQ ID NO: 351196 - RNA, 19 nt, Homo sapiens
ugaaugacacuucuacaga

SEQ ID NO: 351197 - RNA, 19 nt, Homo sapiens
gggcuggaguuccugcauu

SEQ ID NO: 351198 - RNA, 19 nt, Homo sapiens
cgaagugccuuuaauucag

SEQ ID NO: 351199 - RNA, 19 nt, Homo sapiens
gcagccauauaaacuguuc

SEQ ID NO: 351200 - RNA, 19 nt, Homo sapiens
uaacugcagucagcaacaa

SEQ ID NO: 351201 - RNA, 19 nt, Homo sapiens
guucaaaccaacuaucuau

SEQ ID NO: 351202 - RNA, 19 nt, Homo sapiens
gaggugcuauggauuuagu

SEQ ID NO: 351203 - RNA, 19 nt, Homo sapiens
gaagauggugaaaggaaug

SEQ ID NO: 351204 - RNA, 19 nt, Homo sapiens
gggaagauggugaaaggaa

SEQ ID NO: 351205 - RNA, 19 nt, Homo sapiens
ggcuggaguuccugcauuu

SEQ ID NO: 351206 - RNA, 19 nt, Homo sapiens
cauggucucuucauaugug

SEQ ID NO: 351207 - RNA, 19 nt, Homo sapiens
uaaagagugcuauacaugu

SEQ ID NO: 351208 - RNA, 19 nt, Homo sapiens
gauuaaagagugcuauaca

SEQ ID NO: 351209 - RNA, 19 nt, Homo sapiens
guugauaguuacaucuuca

SEQ ID NO: 351210 - RNA, 19 nt, Homo sapiens
acaguacgauauaucauuc

SEQ ID NO: 351211 - RNA, 19 nt, Homo sapiens
gggcagggagaaauaacua

SEQ ID NO: 351212 - RNA, 19 nt, Homo sapiens
gggagggcagggagaaaua

SEQ ID NO: 351213 - RNA, 19 nt, Homo sapiens
gauggcggcucucaaacuc

SEQ ID NO: 351214 - RNA, 19 nt, Homo sapiens
ccauauaaacuguucucua

SEQ ID NO: 351215 - RNA, 19 nt, Homo sapiens
ugcagcagaucgcaaauug

SEQ ID NO: 351216 - RNA, 19 nt, Homo sapiens
ucaaccgcauuauuacuga

SEQ ID NO: 351217 - RNA, 19 nt, Homo sapiens
guaagggaacgaaucauca

SEQ ID NO: 351218 - RNA, 19 nt, Homo sapiens
uaaacaugguggguagauu

SEQ ID NO: 351219 - RNA, 19 nt, Homo sapiens
gaguugcugucaugauugu

SEQ ID NO: 351220 - RNA, 19 nt, Homo sapiens
ucccagcgcugaaacuuga

SEQ ID NO: 351221 - RNA, 19 nt, Homo sapiens
cggaagagcugggcugcuu

SEQ ID NO: 351222 - RNA, 19 nt, Homo sapiens
ccagaaauggugaaaauaa

SEQ ID NO: 351223 - RNA, 19 nt, Homo sapiens
gaccuccgccugcuacauc

SEQ ID NO: 351224 - RNA, 19 nt, Homo sapiens
ccccagaaauggugaaaau

SEQ ID NO: 351225 - RNA, 19 nt, Homo sapiens
gcugccaggaggagaacua

SEQ ID NO: 351226 - RNA, 19 nt, Homo sapiens
ccugcuacauccagaacug

SEQ ID NO: 351227 - RNA, 19 nt, Homo sapiens
guacagauaugaacacuua

SEQ ID NO: 351228 - RNA, 19 nt, Homo sapiens
gaacaaaguugguggauuc

SEQ ID NO: 351229 - RNA, 19 nt, Homo sapiens
gaauagacauuucuccaaa

SEQ ID NO: 351230 - RNA, 19 nt, Homo sapiens
ggaaagacauccuguguuc

SEQ ID NO: 351231 - RNA, 19 nt, Homo sapiens
acaaugagauuccaguuua

SEQ ID NO: 351232 - RNA, 19 nt, Homo sapiens
ggacccagauauccaaaua

SEQ ID NO: 351233 - RNA, 19 nt, Homo sapiens
gcaauacuauccuaacuga

SEQ ID NO: 351234 - RNA, 19 nt, Homo sapiens
gaauauagauuagcguuug

SEQ ID NO: 351235 - RNA, 19 nt, Homo sapiens
gaugaggcaugacuacuaa

SEQ ID NO: 351236 - RNA, 19 nt, Homo sapiens
gaaaugaaguacucacaca

SEQ ID NO: 351237 - RNA, 19 nt, Homo sapiens
ccaaaugucuaccaacuga

SEQ ID NO: 351238 - RNA, 19 nt, Homo sapiens
caaagaagauaugcaaaug

SEQ ID NO: 351239 - RNA, 19 nt, Homo sapiens
gcuuguaucuggaauauau

SEQ ID NO: 351240 - RNA, 19 nt, Homo sapiens
gcacacagcuauuagaacu

SEQ ID NO: 351241 - RNA, 19 nt, Homo sapiens
gaaaagacccuaucaagaa

SEQ ID NO: 351242 - RNA, 19 nt, Homo sapiens
uaacugacaugcagauuca

SEQ ID NO: 351243 - RNA, 19 nt, Homo sapiens
caacauggaugagccuuga

SEQ ID NO: 351244 - RNA, 19 nt, Homo sapiens
gaucagacuuaguauuguu

SEQ ID NO: 351245 - RNA, 19 nt, Homo sapiens
gaaagaagccaggugcaaa

SEQ ID NO: 351246 - RNA, 19 nt, Homo sapiens
aaacguacauacacacaaa

SEQ ID NO: 351247 - RNA, 19 nt, Homo sapiens
uaagguaccuaucaguuug

SEQ ID NO: 351248 - RNA, 19 nt, Homo sapiens
uagagaaacugguagaaau

SEQ ID NO: 351249 - RNA, 19 nt, Homo sapiens
caagacaauucaauagaga

SEQ ID NO: 351250 - RNA, 19 nt, Homo sapiens
gaaacaacccaaaugucua

SEQ ID NO: 351251 - RNA, 19 nt, Homo sapiens
caagagaaaugaaaacgua

SEQ ID NO: 351252 - RNA, 19 nt, Homo sapiens
ucaagaaggugaaaagaua

SEQ ID NO: 351253 - RNA, 19 nt, Homo sapiens
cauauugucugacugcauu

SEQ ID NO: 351254 - RNA, 19 nt, Homo sapiens
gcagugguuucuuagauau

SEQ ID NO: 351255 - RNA, 19 nt, Homo sapiens
ggcagugguuucuuagaua

SEQ ID NO: 351256 - RNA, 19 nt, Homo sapiens
gauucacacuuccugauuu

SEQ ID NO: 351257 - RNA, 19 nt, Homo sapiens
ggaaacaacccaaaugucu

SEQ ID NO: 351258 - RNA, 19 nt, Homo sapiens
guaaucagcucaguguguu

SEQ ID NO: 351259 - RNA, 19 nt, Homo sapiens
gaaagaaacauaggcauag

SEQ ID NO: 351260 - RNA, 19 nt, Homo sapiens
ggaaugccacuccuaggua

SEQ ID NO: 351261 - RNA, 19 nt, Homo sapiens
gaaugccacuccuagguau

SEQ ID NO: 351262 - RNA, 19 nt, Homo sapiens
aaagauaaccugcagaaug

SEQ ID NO: 351263 - RNA, 19 nt, Homo sapiens
gaaggguggugcuaagauc

SEQ ID NO: 351264 - RNA, 19 nt, Homo sapiens
ucacuaggauggcuacaau

SEQ ID NO: 351265 - RNA, 19 nt, Homo sapiens
gagcaacucguccuccuuu

SEQ ID NO: 351266 - RNA, 19 nt, Homo sapiens
gagaaacugguagaaauuu

SEQ ID NO: 351267 - RNA, 19 nt, Homo sapiens
caaaguugguggauucaca

SEQ ID NO: 351268 - RNA, 19 nt, Homo sapiens
gagaguggccuccaugaug

SEQ ID NO: 351269 - RNA, 19 nt, Homo sapiens
gacauacggagcagaauaa

SEQ ID NO: 351270 - RNA, 19 nt, Homo sapiens
cgaaauuaguggugauugu

SEQ ID NO: 351271 - RNA, 19 nt, Homo sapiens
aagauaaccugcagaaugg

SEQ ID NO: 351272 - RNA, 19 nt, Homo sapiens
ccuauuagaacuuggguua

SEQ ID NO: 351273 - RNA, 19 nt, Homo sapiens
ggcagugaguggcuuguuu

SEQ ID NO: 351274 - RNA, 19 nt, Homo sapiens
ggacucagccaucagacaa

SEQ ID NO: 351275 - RNA, 19 nt, Homo sapiens
aaacguagagugaccauau

SEQ ID NO: 351276 - RNA, 19 nt, Homo sapiens
agaaagaaacauaggcaua

SEQ ID NO: 351277 - RNA, 19 nt, Homo sapiens
ccaagacaauucaauagag

SEQ ID NO: 351278 - RNA, 19 nt, Homo sapiens
cauaagugcucugcuccua

SEQ ID NO: 351279 - RNA, 19 nt, Homo sapiens
gaaauaaaauguggucugu

SEQ ID NO: 351280 - RNA, 19 nt, Homo sapiens
caacccaaaugucuaccaa

SEQ ID NO: 351281 - RNA, 19 nt, Homo sapiens
aaaguuaaacguagaguga

SEQ ID NO: 351282 - RNA, 19 nt, Homo sapiens
ccaaagaagauaugcaaau

SEQ ID NO: 351283 - RNA, 19 nt, Homo sapiens
gggcuuguaucuggaauau

SEQ ID NO: 351284 - RNA, 19 nt, Homo sapiens
guagagaaacugguagaaa

SEQ ID NO: 351285 - RNA, 19 nt, Homo sapiens
aaacauaggcauagaucuu

SEQ ID NO: 351286 - RNA, 19 nt, Homo sapiens
gcaccgagacaaugauaug

SEQ ID NO: 351287 - RNA, 19 nt, Homo sapiens
ggaaucaacuuaacaaaac

SEQ ID NO: 351288 - RNA, 19 nt, Homo sapiens
uuaagaagcauuugggaaa

SEQ ID NO: 351289 - RNA, 19 nt, Homo sapiens
gauggcguauguuugugua

SEQ ID NO: 351290 - RNA, 19 nt, Homo sapiens
ggauguagagaaacuggua

SEQ ID NO: 351291 - RNA, 19 nt, Homo sapiens
ugacaagguucccaagaca

SEQ ID NO: 351292 - RNA, 19 nt, Homo sapiens
ggcguauguuuguguauaa

SEQ ID NO: 351293 - RNA, 19 nt, Homo sapiens
gcauagaucuuuguaaccu

SEQ ID NO: 351294 - RNA, 19 nt, Homo sapiens
gguuggaccuuuacucaca

SEQ ID NO: 351295 - RNA, 19 nt, Homo sapiens
cacacuuccugauuucaua

SEQ ID NO: 351296 - RNA, 19 nt, Homo sapiens
gugaaaagcgguaaauaua

SEQ ID NO: 351297 - RNA, 19 nt, Homo sapiens
guaauuucacuccaguaua

SEQ ID NO: 351298 - RNA, 19 nt, Homo sapiens
gaaauuaguggugauugug

SEQ ID NO: 351299 - RNA, 19 nt, Homo sapiens
cagcuuagcaucacauuag

SEQ ID NO: 351300 - RNA, 19 nt, Homo sapiens
auacggagcagaauaaaga

SEQ ID NO: 351301 - RNA, 19 nt, Homo sapiens
uugauaagcuagucccaaa

SEQ ID NO: 351302 - RNA, 19 nt, Homo sapiens
ucagugcaauccuuaugaa

SEQ ID NO: 351303 - RNA, 19 nt, Homo sapiens
ucauggaucagacuuagua

SEQ ID NO: 351304 - RNA, 19 nt, Homo sapiens
ggaucacgcuagcugucua

SEQ ID NO: 351305 - RNA, 19 nt, Homo sapiens
gaaaagauaaccugcagaa

SEQ ID NO: 351306 - RNA, 19 nt, Homo sapiens
aaagaaacauaggcauaga

SEQ ID NO: 351307 - RNA, 19 nt, Homo sapiens
gaccuuuacucacacuaug

SEQ ID NO: 351308 - RNA, 19 nt, Homo sapiens
gcgucaagcucaucuccaa

SEQ ID NO: 351309 - RNA, 19 nt, Homo sapiens
gagugucggugaggaugua

SEQ ID NO: 351310 - RNA, 19 nt, Homo sapiens
guuaagauggcaauacuau

SEQ ID NO: 351311 - RNA, 19 nt, Homo sapiens
gaaaagcgguaaauauagg

SEQ ID NO: 351312 - RNA, 19 nt, Homo sapiens
gcaugacuacuaaggguuu

SEQ ID NO: 351313 - RNA, 19 nt, Homo sapiens
ugugagagaugaggcauga

SEQ ID NO: 351314 - RNA, 19 nt, Homo sapiens
auuaggcagugguuucuua

SEQ ID NO: 351315 - RNA, 19 nt, Homo sapiens
gaggauucccgcucauuug

SEQ ID NO: 351316 - RNA, 19 nt, Homo sapiens
agacauacggagcagaaua

SEQ ID NO: 351317 - RNA, 19 nt, Homo sapiens
gcuacggccuuaucagcuu

SEQ ID NO: 351318 - RNA, 19 nt, Homo sapiens
acaccaauguucauagcaa

SEQ ID NO: 351319 - RNA, 19 nt, Homo sapiens
acacaacaauaaggagaaa

SEQ ID NO: 351320 - RNA, 19 nt, Homo sapiens
ggauucacacuuccugauu

SEQ ID NO: 351321 - RNA, 19 nt, Homo sapiens
guugguggauucacacuuc

SEQ ID NO: 351322 - RNA, 19 nt, Homo sapiens
uggcguauguuuguguaua

SEQ ID NO: 351323 - RNA, 19 nt, Homo sapiens
ggaucagacuuaguauugu

SEQ ID NO: 351324 - RNA, 19 nt, Homo sapiens
uccgcaagguuucaagaua

SEQ ID NO: 351325 - RNA, 19 nt, Homo sapiens
gaacucacacacacacaca

SEQ ID NO: 351326 - RNA, 19 nt, Homo sapiens
cuccugaccucaaagugua

SEQ ID NO: 351327 - RNA, 19 nt, Homo sapiens
gccgagaacuucacucuuu

SEQ ID NO: 351328 - RNA, 19 nt, Homo sapiens
ggagagaccugugcaaauc

SEQ ID NO: 351329 - RNA, 19 nt, Homo sapiens
gggaaaggcuucucuccaa

SEQ ID NO: 351330 - RNA, 19 nt, Homo sapiens
aaccauaggugacuaaauu

SEQ ID NO: 351331 - RNA, 19 nt, Homo sapiens
caaauacgcugaggacaug

SEQ ID NO: 351332 - RNA, 19 nt, Homo sapiens
ucaaacaccuucagcaugu

SEQ ID NO: 351333 - RNA, 19 nt, Homo sapiens
gaccuaaguuuaagaagug

SEQ ID NO: 351334 - RNA, 19 nt, Homo sapiens
ggaccuaaguuuaagaagu

SEQ ID NO: 351335 - RNA, 19 nt, Homo sapiens
gaacuuaucgacaaugcaa

SEQ ID NO: 351336 - RNA, 19 nt, Homo sapiens
gaucugugcucuccgaugu

SEQ ID NO: 351337 - RNA, 19 nt, Homo sapiens
gcauggugcuggugcguaa

SEQ ID NO: 351338 - RNA, 19 nt, Homo sapiens
acugagagcuuuaucuuug

SEQ ID NO: 351339 - RNA, 19 nt, Homo sapiens
caacuaccgucaccucuuc

SEQ ID NO: 351340 - RNA, 19 nt, Homo sapiens
gcagacccaucuaugaguu

SEQ ID NO: 351341 - RNA, 19 nt, Homo sapiens
gcaaguguguggccuucaa

SEQ ID NO: 351342 - RNA, 19 nt, Homo sapiens
ggcguuaucuuccgacuga

SEQ ID NO: 351343 - RNA, 19 nt, Homo sapiens
gaacuucacucuuuucauc

SEQ ID NO: 351344 - RNA, 19 nt, Homo sapiens
uaaagggaaugaggacaaa

SEQ ID NO: 351345 - RNA, 19 nt, Homo sapiens
ugagaaggguggagugguu

SEQ ID NO: 351346 - RNA, 19 nt, Homo sapiens
ggugaaugcugcccacaug

SEQ ID NO: 351347 - RNA, 19 nt, Homo sapiens
ggagucgacugagagcuuu

SEQ ID NO: 351348 - RNA, 19 nt, Homo sapiens
ggaguacaauaaagggaau

SEQ ID NO: 351349 - RNA, 19 nt, Homo sapiens
guagauacgugugguuagu

SEQ ID NO: 351350 - RNA, 19 nt, Homo sapiens
gaacuagccacauuucaac

SEQ ID NO: 351351 - RNA, 19 nt, Homo sapiens
gagagcaguuugccagaag

SEQ ID NO: 351352 - RNA, 19 nt, Homo sapiens
ggaagcgacggguggagua

SEQ ID NO: 351353 - RNA, 19 nt, Homo sapiens
ucccagccaugaauccuua

SEQ ID NO: 351354 - RNA, 19 nt, Homo sapiens
ccaucuaucuuugggaauu

SEQ ID NO: 351355 - RNA, 19 nt, Homo sapiens
ccaacccgcugccuccauu

SEQ ID NO: 351356 - RNA, 19 nt, Homo sapiens
gguggguguuucucuauga

SEQ ID NO: 351357 - RNA, 19 nt, Homo sapiens
acacaaccaucuacacaca

SEQ ID NO: 351358 - RNA, 19 nt, Homo sapiens
gaagugccguccucgaacu

SEQ ID NO: 351359 - RNA, 19 nt, Homo sapiens
gaagucuccuacccucuca

SEQ ID NO: 351360 - RNA, 19 nt, Homo sapiens
gcagaagaaguucaaauac

SEQ ID NO: 351361 - RNA, 19 nt, Homo sapiens
ggaaugaggacaaacaaaa

SEQ ID NO: 351362 - RNA, 19 nt, Homo sapiens
caagaacagcaucagcuuu

SEQ ID NO: 351363 - RNA, 19 nt, Homo sapiens
cagaagaaguucaaauacg

SEQ ID NO: 351364 - RNA, 19 nt, Homo sapiens
cgacugagagcuuuaucuu

SEQ ID NO: 351365 - RNA, 19 nt, Homo sapiens
gcacugcagacccaucuau

SEQ ID NO: 351366 - RNA, 19 nt, Homo sapiens
gaaaggcuucucuccaagu

SEQ ID NO: 351367 - RNA, 19 nt, Homo sapiens
ccauaggugacuaaauuaa

SEQ ID NO: 351368 - RNA, 19 nt, Homo sapiens
cuaagaggcacuacuacaa

SEQ ID NO: 351369 - RNA, 19 nt, Homo sapiens
aaacacaaccaucuacaca

SEQ ID NO: 351370 - RNA, 19 nt, Homo sapiens
gcaaacacaaccaucuaca

SEQ ID NO: 351371 - RNA, 19 nt, Homo sapiens
cagcauccuuccacacugu

SEQ ID NO: 351372 - RNA, 19 nt, Homo sapiens
caucuaucuuugggaauuu

SEQ ID NO: 351373 - RNA, 19 nt, Homo sapiens
uccaugggcuguacgaaga

SEQ ID NO: 351374 - RNA, 19 nt, Homo sapiens
agcagaagaaguucaaaua

SEQ ID NO: 351375 - RNA, 19 nt, Homo sapiens
agaccugccucuuucacaa

SEQ ID NO: 351376 - RNA, 19 nt, Homo sapiens
caccaucggcucuggaauu

SEQ ID NO: 351377 - RNA, 19 nt, Homo sapiens
ccaggcacuuuguggagaa

SEQ ID NO: 351378 - RNA, 19 nt, Homo sapiens
ccagaccuccugaaccaaa

SEQ ID NO: 351379 - RNA, 19 nt, Homo sapiens
ggcuucaacuucagguuug

SEQ ID NO: 351380 - RNA, 19 nt, Homo sapiens
gggaaugaggacaaacaaa

SEQ ID NO: 351381 - RNA, 19 nt, Homo sapiens
caguagauacgugugguua

SEQ ID NO: 351382 - RNA, 19 nt, Homo sapiens
gagcgugaccucgcagcua

SEQ ID NO: 351383 - RNA, 19 nt, Homo sapiens
ucaaauacgcugaggacau

SEQ ID NO: 351384 - RNA, 19 nt, Homo sapiens
cuucacauccugccuaaga

SEQ ID NO: 351385 - RNA, 19 nt, Homo sapiens
gugaagacgugugagaucu

SEQ ID NO: 351386 - RNA, 19 nt, Homo sapiens
ucugggauguggcugacua

SEQ ID NO: 351387 - RNA, 19 nt, Homo sapiens
cgacggguggaguacaaua

SEQ ID NO: 351388 - RNA, 19 nt, Homo sapiens
gacugagagcuuuaucuuu

SEQ ID NO: 351389 - RNA, 19 nt, Homo sapiens
gacggguggaguacaauaa

SEQ ID NO: 351390 - RNA, 19 nt, Homo sapiens
aaaggcuucucuccaagug

SEQ ID NO: 351391 - RNA, 19 nt, Homo sapiens
ccgccuuccucuucgagua

SEQ ID NO: 351392 - RNA, 19 nt, Homo sapiens
aagcucagggugcauagua

SEQ ID NO: 351393 - RNA, 19 nt, Homo sapiens
ugacaucaucccuacaaug

SEQ ID NO: 351394 - RNA, 19 nt, Homo sapiens
cgaacuuucugacucuaag

SEQ ID NO: 351395 - RNA, 19 nt, Homo sapiens
cagaagcucagggugcaua

SEQ ID NO: 351396 - RNA, 19 nt, Homo sapiens
uaagaggcacuacuacaag

SEQ ID NO: 351397 - RNA, 19 nt, Homo sapiens
gcucuggaauuggcaucuu

SEQ ID NO: 351398 - RNA, 19 nt, Homo sapiens
gcaagagucaggccagaac

SEQ ID NO: 351399 - RNA, 19 nt, Homo sapiens
aauaagaaggugggcguua

SEQ ID NO: 351400 - RNA, 19 nt, Homo sapiens
acaaccaucuacacacauc

SEQ ID NO: 351401 - RNA, 19 nt, Homo sapiens
caauuccucggcugaacua

SEQ ID NO: 351402 - RNA, 19 nt, Homo sapiens
agagagcaguuugccagaa

SEQ ID NO: 351403 - RNA, 19 nt, Homo sapiens
gugcuggugcguaauaaga

SEQ ID NO: 351404 - RNA, 19 nt, Homo sapiens
ugaaugcugcccacaugaa

SEQ ID NO: 351405 - RNA, 19 nt, Homo sapiens
cagcagugucucugugaaa

SEQ ID NO: 351406 - RNA, 19 nt, Homo sapiens
gggaacuuaucgacaaugc

SEQ ID NO: 351407 - RNA, 19 nt, Homo sapiens
acuacaagcagaagaaguu

SEQ ID NO: 351408 - RNA, 19 nt, Homo sapiens
aagaacagcaucagcuuuc

SEQ ID NO: 351409 - RNA, 19 nt, Homo sapiens
aagaagugccguccucgaa

SEQ ID NO: 351410 - RNA, 19 nt, Homo sapiens
ucaagaacagcaucagcuu

SEQ ID NO: 351411 - RNA, 19 nt, Homo sapiens
ccucgaacuuucugacucu

SEQ ID NO: 351412 - RNA, 19 nt, Homo sapiens
auucugggaccuaaguuua

SEQ ID NO: 351413 - RNA, 19 nt, Homo sapiens
gccgggaaguuugacauca

SEQ ID NO: 351414 - RNA, 19 nt, Homo sapiens
ggagaacgggaccaacuac

SEQ ID NO: 351415 - RNA, 19 nt, Homo sapiens
gaaugcugcccacaugaag

SEQ ID NO: 351416 - RNA, 19 nt, Homo sapiens
gaacagcaucagcuuucca

SEQ ID NO: 351417 - RNA, 19 nt, Homo sapiens
gagccugcacuuccuguuc

SEQ ID NO: 351418 - RNA, 19 nt, Homo sapiens
ucucuccggacucucauua

SEQ ID NO: 351419 - RNA, 19 nt, Homo sapiens
uaggagagaccugugcaaa

SEQ ID NO: 351420 - RNA, 19 nt, Homo sapiens
ucggguggguguuucucua

SEQ ID NO: 351421 - RNA, 19 nt, Homo sapiens
agccaugaauccuuacuca

SEQ ID NO: 351422 - RNA, 19 nt, Homo sapiens
cauuuucacugucaaagaa

SEQ ID NO: 351423 - RNA, 19 nt, Homo sapiens
ggacagcucggggcauuuu

SEQ ID NO: 351424 - RNA, 19 nt, Homo sapiens
gcugaacuagccacauuuc

SEQ ID NO: 351425 - RNA, 19 nt, Homo sapiens
ucagcagugucucugugaa

SEQ ID NO: 351426 - RNA, 19 nt, Homo sapiens
ggguggguguuucucuaug

SEQ ID NO: 351427 - RNA, 19 nt, Homo sapiens
gcugagaacuucacuauuu

SEQ ID NO: 351428 - RNA, 19 nt, Homo sapiens
gaucaucuccuacuuugua

SEQ ID NO: 351429 - RNA, 19 nt, Homo sapiens
guacaaagccaagaaguuu

SEQ ID NO: 351430 - RNA, 19 nt, Homo sapiens
ucauggaugugucugauua

SEQ ID NO: 351431 - RNA, 19 nt, Homo sapiens
ccaagaugauuguuacuga

SEQ ID NO: 351432 - RNA, 19 nt, Homo sapiens
gagaagcaguccaccgauu

SEQ ID NO: 351433 - RNA, 19 nt, Homo sapiens
ggagaaauaccgcugugua

SEQ ID NO: 351434 - RNA, 19 nt, Homo sapiens
gaucaucaaccgaguaguu

SEQ ID NO: 351435 - RNA, 19 nt, Homo sapiens
gaaugagacuacgcugaaa

SEQ ID NO: 351436 - RNA, 19 nt, Homo sapiens
caagaugauuguuacugaa

SEQ ID NO: 351437 - RNA, 19 nt, Homo sapiens
ccaagucggugguugugaa

SEQ ID NO: 351438 - RNA, 19 nt, Homo sapiens
gaacuucacuauuuucauc

SEQ ID NO: 351439 - RNA, 19 nt, Homo sapiens
gcacccuccugaaggcuuu

SEQ ID NO: 351440 - RNA, 19 nt, Homo sapiens
ucaccaagaugauuguuac

SEQ ID NO: 351441 - RNA, 19 nt, Homo sapiens
ugaaugagacuacgcugaa

SEQ ID NO: 351442 - RNA, 19 nt, Homo sapiens
gcuggcaaguucaacauca

SEQ ID NO: 351443 - RNA, 19 nt, Homo sapiens
ggcuacaacuucagguuug

SEQ ID NO: 351444 - RNA, 19 nt, Homo sapiens
cagagagugaggagaaaua

SEQ ID NO: 351445 - RNA, 19 nt, Homo sapiens
gaagggcuccggacucuac

SEQ ID NO: 351446 - RNA, 19 nt, Homo sapiens
ggaguucugggcauuaaga

SEQ ID NO: 351447 - RNA, 19 nt, Homo sapiens
gcaccucggucuuugucau

SEQ ID NO: 351448 - RNA, 19 nt, Homo sapiens
ccaacagagucauggaugu

SEQ ID NO: 351449 - RNA, 19 nt, Homo sapiens
gcuucgacgugcugguaua

SEQ ID NO: 351450 - RNA, 19 nt, Homo sapiens
gaacugcauauccgacuuc

SEQ ID NO: 351451 - RNA, 19 nt, Homo sapiens
ucaagaacagcauccguuu

SEQ ID NO: 351452 - RNA, 19 nt, Homo sapiens
cugaucaucuccuacuuug

SEQ ID NO: 351453 - RNA, 19 nt, Homo sapiens
cgggaaugcuggcaaguuc

SEQ ID NO: 351454 - RNA, 19 nt, Homo sapiens
guggaaacgcccaucauga

SEQ ID NO: 351455 - RNA, 19 nt, Homo sapiens
ggagguggacacaguggaa

SEQ ID NO: 351456 - RNA, 19 nt, Homo sapiens
gcccagagagugaggagaa

SEQ ID NO: 351457 - RNA, 19 nt, Homo sapiens
cugcauauccgacuucuuc

SEQ ID NO: 351458 - RNA, 19 nt, Homo sapiens
ggaaugcuggcaaguucaa

SEQ ID NO: 351459 - RNA, 19 nt, Homo sapiens
uauccgacuucuucaccua

SEQ ID NO: 351460 - RNA, 19 nt, Homo sapiens
gugaagggcuccggacucu

SEQ ID NO: 351461 - RNA, 19 nt, Homo sapiens
aagcugagaacuucacuau

SEQ ID NO: 351462 - RNA, 19 nt, Homo sapiens
caacagagucauggaugug

SEQ ID NO: 351463 - RNA, 19 nt, Homo sapiens
guacgggacacagccauug

SEQ ID NO: 351464 - RNA, 19 nt, Homo sapiens
gaaaccuccuucccaaccu

SEQ ID NO: 351465 - RNA, 19 nt, Homo sapiens
uggaaacgcccaucaugau

SEQ ID NO: 351466 - RNA, 19 nt, Homo sapiens
caaccgaguaguucagcuu

SEQ ID NO: 351467 - RNA, 19 nt, Homo sapiens
ccuaugagaccaccaaguc

SEQ ID NO: 351468 - RNA, 19 nt, Homo sapiens
caagaacagcauccguuuc

SEQ ID NO: 351469 - RNA, 19 nt, Homo sapiens
ugacagccagggacaugaa

SEQ ID NO: 351470 - RNA, 19 nt, Homo sapiens
gaaguuugaggaggugaau

SEQ ID NO: 351471 - RNA, 19 nt, Homo sapiens
cagggcaccucggucuuug

SEQ ID NO: 351472 - RNA, 19 nt, Homo sapiens
ucagggcaccucggucuuu

SEQ ID NO: 351473 - RNA, 19 nt, Homo sapiens
ugaacugcauauccgacuu

SEQ ID NO: 351474 - RNA, 19 nt, Homo sapiens
gaaaaucagaugcaaggau

SEQ ID NO: 351475 - RNA, 19 nt, Homo sapiens
gacaucauccugcucaacu

SEQ ID NO: 351476 - RNA, 19 nt, Homo sapiens
ugauggaagcugagaacuu

SEQ ID NO: 351477 - RNA, 19 nt, Homo sapiens
gagcacucucucagcauga

SEQ ID NO: 351478 - RNA, 19 nt, Homo sapiens
guaccgcacccuccugaag

SEQ ID NO: 351479 - RNA, 19 nt, Homo sapiens
ucagguuugccaaguacua

SEQ ID NO: 351480 - RNA, 19 nt, Homo sapiens
ucugaucaucuccuacuuu

SEQ ID NO: 351481 - RNA, 19 nt, Homo sapiens
agaagcaguccaccgauuc

SEQ ID NO: 351482 - RNA, 19 nt, Homo sapiens
ccgacuucuucaccuauga

SEQ ID NO: 351483 - RNA, 19 nt, Homo sapiens
gagguggacacaguggaaa

SEQ ID NO: 351484 - RNA, 19 nt, Homo sapiens
gggaucaucaaccgaguag

SEQ ID NO: 351485 - RNA, 19 nt, Homo sapiens
gcagaaaacuucacucuuu

SEQ ID NO: 351486 - RNA, 19 nt, Homo sapiens
gaccaacacuucuaaacuu

SEQ ID NO: 351487 - RNA, 19 nt, Homo sapiens
caucugguaucccaaauuu

SEQ ID NO: 351488 - RNA, 19 nt, Homo sapiens
gaaaagggcuaccaggaaa

SEQ ID NO: 351489 - RNA, 19 nt, Homo sapiens
gaucgaggaccagacauua

SEQ ID NO: 351490 - RNA, 19 nt, Homo sapiens
gcagggaaauuugacauca

SEQ ID NO: 351491 - RNA, 19 nt, Homo sapiens
gagaagcgcugugcuaagg

SEQ ID NO: 351492 - RNA, 19 nt, Homo sapiens
cggcagagcuggcauuucu

SEQ ID NO: 351493 - RNA, 19 nt, Homo sapiens
gaauauccuucccaacauc

SEQ ID NO: 351494 - RNA, 19 nt, Homo sapiens
gauaccagcucaggaggaa

SEQ ID NO: 351495 - RNA, 19 nt, Homo sapiens
ucugggauguggcggauua

SEQ ID NO: 351496 - RNA, 19 nt, Homo sapiens
ggucagcagucuguucuug

SEQ ID NO: 351497 - RNA, 19 nt, Homo sapiens
ggaaggcagggaaauuuga

SEQ ID NO: 351498 - RNA, 19 nt, Homo sapiens
aaacuuggauuccggaucu

SEQ ID NO: 351499 - RNA, 19 nt, Homo sapiens
caacacuucuaaacuugga

SEQ ID NO: 351500 - RNA, 19 nt, Homo sapiens
cauauuccgucuuggcaaa

SEQ ID NO: 351501 - RNA, 19 nt, Homo sapiens
caacaucugguaucccaaa

SEQ ID NO: 351502 - RNA, 19 nt, Homo sapiens
cagcagcuccuguguguug

SEQ ID NO: 351503 - RNA, 19 nt, Homo sapiens
ucugguaucccaaauuuaa

SEQ ID NO: 351504 - RNA, 19 nt, Homo sapiens
ggaggaggagggagaaaug

SEQ ID NO: 351505 - RNA, 19 nt, Homo sapiens
uaccucaagucgugcauuu

SEQ ID NO: 351506 - RNA, 19 nt, Homo sapiens
uggcuacaauuucagguuu

SEQ ID NO: 351507 - RNA, 19 nt, Homo sapiens
gaagaaaagacucuacuau

SEQ ID NO: 351508 - RNA, 19 nt, Homo sapiens
gcaggugcguagcuuucaa

SEQ ID NO: 351509 - RNA, 19 nt, Homo sapiens
ucaagucgugcauuuauga

SEQ ID NO: 351510 - RNA, 19 nt, Homo sapiens
ccaacaucaccacuacuua

SEQ ID NO: 351511 - RNA, 19 nt, Homo sapiens
uguggcggauuaugugaua

SEQ ID NO: 351512 - RNA, 19 nt, Homo sapiens
ucagagaagcgcugugcua

SEQ ID NO: 351513 - RNA, 19 nt, Homo sapiens
gcacugcuguggcuuucag

SEQ ID NO: 351514 - RNA, 19 nt, Homo sapiens
agaaauggccaccacauca

SEQ ID NO: 351515 - RNA, 19 nt, Homo sapiens
aaacuucacucuuuugguu

SEQ ID NO: 351516 - RNA, 19 nt, Homo sapiens
cagagaagcgcugugcuaa

SEQ ID NO: 351517 - RNA, 19 nt, Homo sapiens
caacaucaccacuacuuac

SEQ ID NO: 351518 - RNA, 19 nt, Homo sapiens
uuaagaacaacaucuggua

SEQ ID NO: 351519 - RNA, 19 nt, Homo sapiens
ccacagcaacggagucuca

SEQ ID NO: 351520 - RNA, 19 nt, Homo sapiens
ggaaaagggcuaccaggaa

SEQ ID NO: 351521 - RNA, 19 nt, Homo sapiens
gagaaauggccaccacauc

SEQ ID NO: 351522 - RNA, 19 nt, Homo sapiens
cgugcugugugacaucaua

SEQ ID NO: 351523 - RNA, 19 nt, Homo sapiens
gggaaggcagggaaauuug

SEQ ID NO: 351524 - RNA, 19 nt, Homo sapiens
cccagcagcuccugugugu

SEQ ID NO: 351525 - RNA, 19 nt, Homo sapiens
ggauguggcggauuaugug

SEQ ID NO: 351526 - RNA, 19 nt, Homo sapiens
ccucaagucgugcauuuau

SEQ ID NO: 351527 - RNA, 19 nt, Homo sapiens
gcuggcauuucuccucaga

SEQ ID NO: 351528 - RNA, 19 nt, Homo sapiens
gcucuguucaagcacuuua

SEQ ID NO: 351529 - RNA, 19 nt, Homo sapiens
gcucagaagccuccugucu

SEQ ID NO: 351530 - RNA, 19 nt, Homo sapiens
ggagaaauggccaccacau

SEQ ID NO: 351531 - RNA, 19 nt, Homo sapiens
uaagaacaacaucugguau

SEQ ID NO: 351532 - RNA, 19 nt, Homo sapiens
ucgaggaccagacauuaaa

SEQ ID NO: 351533 - RNA, 19 nt, Homo sapiens
gacaggcccaguccucuga

SEQ ID NO: 351534 - RNA, 19 nt, Homo sapiens
ggacugcaaccuggacaga

SEQ ID NO: 351535 - RNA, 19 nt, Homo sapiens
ggcauccgcuucgacauca

SEQ ID NO: 351536 - RNA, 19 nt, Homo sapiens
ucuccuggcuacaauuuca

SEQ ID NO: 351537 - RNA, 19 nt, Homo sapiens
cggccuuccuguucgagua

SEQ ID NO: 351538 - RNA, 19 nt, Homo sapiens
gcuucgacaucauuguguu

SEQ ID NO: 351539 - RNA, 19 nt, Homo sapiens
gcugugaccaacacuucua

SEQ ID NO: 351540 - RNA, 19 nt, Homo sapiens
gggauguggcggauuaugu

SEQ ID NO: 351541 - RNA, 19 nt, Homo sapiens
ccacaucaccccagagaaa

SEQ ID NO: 351542 - RNA, 19 nt, Homo sapiens
uggcgaccgugcuguguga

SEQ ID NO: 351543 - RNA, 19 nt, Homo sapiens
ggaggucagcagucuguuc

SEQ ID NO: 351544 - RNA, 19 nt, Homo sapiens
gaaauggccaccacaucac

SEQ ID NO: 351545 - RNA, 19 nt, Homo sapiens
ugggaaggcagggaaauuu

SEQ ID NO: 351546 - RNA, 19 nt, Homo sapiens
guggucagcuccguuacga

SEQ ID NO: 351547 - RNA, 19 nt, Homo sapiens
accaacacuucuaaacuug

SEQ ID NO: 351548 - RNA, 19 nt, Homo sapiens
cagggaaauuugacaucau

SEQ ID NO: 351549 - RNA, 19 nt, Homo sapiens
ggcuacaauuucagguuug

SEQ ID NO: 351550 - RNA, 19 nt, Homo sapiens
uaucuccuggcuacaauuu

SEQ ID NO: 351551 - RNA, 19 nt, Homo sapiens
guucuuggcugggucaacu

SEQ ID NO: 351552 - RNA, 19 nt, Homo sapiens
uaucgggagaagaaauaua

SEQ ID NO: 351553 - RNA, 19 nt, Homo sapiens
agaaaagacucuacuaucg

SEQ ID NO: 351554 - RNA, 19 nt, Homo sapiens
auaguccucuacugcauga

SEQ ID NO: 351555 - RNA, 19 nt, Homo sapiens
cacgggacguugagcacaa

SEQ ID NO: 351556 - RNA, 19 nt, Homo sapiens
gacauuaaagcgugauuuu

SEQ ID NO: 351557 - RNA, 19 nt, Homo sapiens
acuaucgggagaagaaaua

SEQ ID NO: 351558 - RNA, 19 nt, Homo sapiens
ucuacuaucgggagaagaa

SEQ ID NO: 351559 - RNA, 19 nt, Homo sapiens
agggaaauuugacaucauc

SEQ ID NO: 351560 - RNA, 19 nt, Homo sapiens
gcgcugugcuaaggugauc

SEQ ID NO: 351561 - RNA, 19 nt, Homo sapiens
cauccuggccuacgucauc

SEQ ID NO: 351562 - RNA, 19 nt, Homo sapiens
ucauaguccucuacugcau

SEQ ID NO: 351563 - RNA, 19 nt, Homo sapiens
gauguggcggauuauguga

SEQ ID NO: 351564 - RNA, 19 nt, Homo sapiens
gcucauccgcagccgcaaa

SEQ ID NO: 351565 - RNA, 19 nt, Homo sapiens
cagcaacggagucucaaca

SEQ ID NO: 351566 - RNA, 19 nt, Homo sapiens
gaggucagcagucuguucu

SEQ ID NO: 351567 - RNA, 19 nt, Homo sapiens
ugaccaacacuucuaaacu

SEQ ID NO: 351568 - RNA, 19 nt, Homo sapiens
ucagguuugccaaguacua

SEQ ID NO: 351569 - RNA, 19 nt, Homo sapiens
cguaucuccuggcuacaau

SEQ ID NO: 351570 - RNA, 19 nt, Homo sapiens
caccacuacuuaccucaag

SEQ ID NO: 351571 - RNA, 19 nt, Homo sapiens
aauuucagcaagaggaaua

SEQ ID NO: 351572 - RNA, 19 nt, Homo sapiens
ucagcuccguuacgaccaa

SEQ ID NO: 351573 - RNA, 19 nt, Homo sapiens
guccucuacugcaugaaga

SEQ ID NO: 351574 - RNA, 19 nt, Homo sapiens
ucagaugccagcuguacug

SEQ ID NO: 351575 - RNA, 19 nt, Homo sapiens
ggugaucgaggaccagaca

SEQ ID NO: 351576 - RNA, 19 nt, Homo sapiens
cgggagaagaaauauaaau

SEQ ID NO: 351577 - RNA, 19 nt, Homo sapiens
cgucaucggguggguguuu

SEQ ID NO: 351578 - RNA, 19 nt, Homo sapiens
ggcuggagcuggcuuugcu

SEQ ID NO: 351579 - RNA, 19 nt, Homo sapiens
caggaggucagcagucugu

SEQ ID NO: 351580 - RNA, 19 nt, Homo sapiens
ccacagccccaucaaagaa

SEQ ID NO: 351581 - RNA, 19 nt, Homo sapiens
gcagaaaacuucacucuuu

SEQ ID NO: 351582 - RNA, 19 nt, Homo sapiens
caucugguaucccaaauuu

SEQ ID NO: 351583 - RNA, 19 nt, Homo sapiens
gaucgaggaccagacauua

SEQ ID NO: 351584 - RNA, 19 nt, Homo sapiens
gcagggaaauuugacauca

SEQ ID NO: 351585 - RNA, 19 nt, Homo sapiens
gagaagcgcugugcuaagg

SEQ ID NO: 351586 - RNA, 19 nt, Homo sapiens
cggcagagcuggcauuucu

SEQ ID NO: 351587 - RNA, 19 nt, Homo sapiens
gaauauccuucccaacauc

SEQ ID NO: 351588 - RNA, 19 nt, Homo sapiens
ggucagcagucuguucuug

SEQ ID NO: 351589 - RNA, 19 nt, Homo sapiens
ggaaggcagggaaauuuga

SEQ ID NO: 351590 - RNA, 19 nt, Homo sapiens
cauauuccgucuuggcaaa

SEQ ID NO: 351591 - RNA, 19 nt, Homo sapiens
caacaucugguaucccaaa

SEQ ID NO: 351592 - RNA, 19 nt, Homo sapiens
cagcagcuccuguguguug

SEQ ID NO: 351593 - RNA, 19 nt, Homo sapiens
ucugguaucccaaauuuaa

SEQ ID NO: 351594 - RNA, 19 nt, Homo sapiens
ggaggaggagggagaaaug

SEQ ID NO: 351595 - RNA, 19 nt, Homo sapiens
uaccucaagucgugcauuu

SEQ ID NO: 351596 - RNA, 19 nt, Homo sapiens
uggcuacaauuucagguuu

SEQ ID NO: 351597 - RNA, 19 nt, Homo sapiens
gaagaaaagacucuacuau

SEQ ID NO: 351598 - RNA, 19 nt, Homo sapiens
gcaggugcguagcuuucaa

SEQ ID NO: 351599 - RNA, 19 nt, Homo sapiens
ucaagucgugcauuuauga

SEQ ID NO: 351600 - RNA, 19 nt, Homo sapiens
ccaacaucaccacuacuua

SEQ ID NO: 351601 - RNA, 19 nt, Homo sapiens
ucagagaagcgcugugcua

SEQ ID NO: 351602 - RNA, 19 nt, Homo sapiens
gcacugcuguggcuuucag

SEQ ID NO: 351603 - RNA, 19 nt, Homo sapiens
agaaauggccaccacauca

SEQ ID NO: 351604 - RNA, 19 nt, Homo sapiens
aaacuucacucuuuugguu

SEQ ID NO: 351605 - RNA, 19 nt, Homo sapiens
cagagaagcgcugugcuaa

SEQ ID NO: 351606 - RNA, 19 nt, Homo sapiens
caacaucaccacuacuuac

SEQ ID NO: 351607 - RNA, 19 nt, Homo sapiens
uuaagaacaacaucuggua

SEQ ID NO: 351608 - RNA, 19 nt, Homo sapiens
ccacagcaacggagucuca

SEQ ID NO: 351609 - RNA, 19 nt, Homo sapiens
gagaaauggccaccacauc

SEQ ID NO: 351610 - RNA, 19 nt, Homo sapiens
cgugcugugugacaucaua

SEQ ID NO: 351611 - RNA, 19 nt, Homo sapiens
gggaaggcagggaaauuug

SEQ ID NO: 351612 - RNA, 19 nt, Homo sapiens
cccagcagcuccugugugu

SEQ ID NO: 351613 - RNA, 19 nt, Homo sapiens
ccucaagucgugcauuuau

SEQ ID NO: 351614 - RNA, 19 nt, Homo sapiens
gcuggcauuucuccucaga

SEQ ID NO: 351615 - RNA, 19 nt, Homo sapiens
gcucuguucaagcacuuua

SEQ ID NO: 351616 - RNA, 19 nt, Homo sapiens
gcucagaagccuccugucu

SEQ ID NO: 351617 - RNA, 19 nt, Homo sapiens
ggagaaauggccaccacau

SEQ ID NO: 351618 - RNA, 19 nt, Homo sapiens
uaagaacaacaucugguau

SEQ ID NO: 351619 - RNA, 19 nt, Homo sapiens
ucgaggaccagacauuaaa

SEQ ID NO: 351620 - RNA, 19 nt, Homo sapiens
gacaggcccaguccucuga

SEQ ID NO: 351621 - RNA, 19 nt, Homo sapiens
ggacugcaaccuggacaga

SEQ ID NO: 351622 - RNA, 19 nt, Homo sapiens
cggccuuccuguucgagua

SEQ ID NO: 351623 - RNA, 19 nt, Homo sapiens
ggcauccgcuucgacauca

SEQ ID NO: 351624 - RNA, 19 nt, Homo sapiens
ucuccuggcuacaauuuca

SEQ ID NO: 351625 - RNA, 19 nt, Homo sapiens
gcuucgacaucauuguguu

SEQ ID NO: 351626 - RNA, 19 nt, Homo sapiens
ccacaucaccccagagaaa

SEQ ID NO: 351627 - RNA, 19 nt, Homo sapiens
uggcgaccgugcuguguga

SEQ ID NO: 351628 - RNA, 19 nt, Homo sapiens
ggaggucagcagucuguuc

SEQ ID NO: 351629 - RNA, 19 nt, Homo sapiens
gaaauggccaccacaucac

SEQ ID NO: 351630 - RNA, 19 nt, Homo sapiens
ugggaaggcagggaaauuu

SEQ ID NO: 351631 - RNA, 19 nt, Homo sapiens
cagggaaauuugacaucau

SEQ ID NO: 351632 - RNA, 19 nt, Homo sapiens
ggcuacaauuucagguuug

SEQ ID NO: 351633 - RNA, 19 nt, Homo sapiens
uaucuccuggcuacaauuu

SEQ ID NO: 351634 - RNA, 19 nt, Homo sapiens
guucuuggcugggucaacu

SEQ ID NO: 351635 - RNA, 19 nt, Homo sapiens
uaucgggagaagaaauaua

SEQ ID NO: 351636 - RNA, 19 nt, Homo sapiens
agaaaagacucuacuaucg

SEQ ID NO: 351637 - RNA, 19 nt, Homo sapiens
auaguccucuacugcauga

SEQ ID NO: 351638 - RNA, 19 nt, Homo sapiens
cacgggacguugagcacaa

SEQ ID NO: 351639 - RNA, 19 nt, Homo sapiens
gacauuaaagcgugauuuu

SEQ ID NO: 351640 - RNA, 19 nt, Homo sapiens
acuaucgggagaagaaaua

SEQ ID NO: 351641 - RNA, 19 nt, Homo sapiens
ucuacuaucgggagaagaa

SEQ ID NO: 351642 - RNA, 19 nt, Homo sapiens
agggaaauuugacaucauc

SEQ ID NO: 351643 - RNA, 19 nt, Homo sapiens
gcgcugugcuaaggugauc

SEQ ID NO: 351644 - RNA, 19 nt, Homo sapiens
gcucauccgcagccgcaaa

SEQ ID NO: 351645 - RNA, 19 nt, Homo sapiens
ucauaguccucuacugcau

SEQ ID NO: 351646 - RNA, 19 nt, Homo sapiens
cagcaacggagucucaaca

SEQ ID NO: 351647 - RNA, 19 nt, Homo sapiens
cauccuggccuacgucauc

SEQ ID NO: 351648 - RNA, 19 nt, Homo sapiens
gaggucagcagucuguucu

SEQ ID NO: 351649 - RNA, 19 nt, Homo sapiens
ucagguuugccaaguacua

SEQ ID NO: 351650 - RNA, 19 nt, Homo sapiens
cguaucuccuggcuacaau

SEQ ID NO: 351651 - RNA, 19 nt, Homo sapiens
caccacuacuuaccucaag

SEQ ID NO: 351652 - RNA, 19 nt, Homo sapiens
aauuucagcaagaggaaua

SEQ ID NO: 351653 - RNA, 19 nt, Homo sapiens
guccucuacugcaugaaga

SEQ ID NO: 351654 - RNA, 19 nt, Homo sapiens
ucagaugccagcuguacug

SEQ ID NO: 351655 - RNA, 19 nt, Homo sapiens
ggugaucgaggaccagaca

SEQ ID NO: 351656 - RNA, 19 nt, Homo sapiens
cgggagaagaaauauaaau

SEQ ID NO: 351657 - RNA, 19 nt, Homo sapiens
ggcuggagcuggcuuugcu

SEQ ID NO: 351658 - RNA, 19 nt, Homo sapiens
caggaggucagcagucugu

SEQ ID NO: 351659 - RNA, 19 nt, Homo sapiens
ccacagccccaucaaagaa

SEQ ID NO: 351660 - RNA, 19 nt, Homo sapiens
gcagaaaacuucacucuuu

SEQ ID NO: 351661 - RNA, 19 nt, Homo sapiens
gaccaacacuucuaaacuu

SEQ ID NO: 351662 - RNA, 19 nt, Homo sapiens
caucugguaucccaaauuu

SEQ ID NO: 351663 - RNA, 19 nt, Homo sapiens
gaaaagggcuaccaggaaa

SEQ ID NO: 351664 - RNA, 19 nt, Homo sapiens
gaucgaggaccagacauua

SEQ ID NO: 351665 - RNA, 19 nt, Homo sapiens
gcagggaaauuugacauca

SEQ ID NO: 351666 - RNA, 19 nt, Homo sapiens
gagaagcgcugugcuaagg

SEQ ID NO: 351667 - RNA, 19 nt, Homo sapiens
cggcagagcuggcauuucu

SEQ ID NO: 351668 - RNA, 19 nt, Homo sapiens
gaauauccuucccaacauc

SEQ ID NO: 351669 - RNA, 19 nt, Homo sapiens
gauaccagcucaggaggaa

SEQ ID NO: 351670 - RNA, 19 nt, Homo sapiens
ucugggauguggcggauua

SEQ ID NO: 351671 - RNA, 19 nt, Homo sapiens
ggucagcagucuguucuug

SEQ ID NO: 351672 - RNA, 19 nt, Homo sapiens
ggaaggcagggaaauuuga

SEQ ID NO: 351673 - RNA, 19 nt, Homo sapiens
aaacuuggauuccggaucu

SEQ ID NO: 351674 - RNA, 19 nt, Homo sapiens
caacacuucuaaacuugga

SEQ ID NO: 351675 - RNA, 19 nt, Homo sapiens
cauauuccgucuuggcaaa

SEQ ID NO: 351676 - RNA, 19 nt, Homo sapiens
caacaucugguaucccaaa

SEQ ID NO: 351677 - RNA, 19 nt, Homo sapiens
cagcagcuccuguguguug

SEQ ID NO: 351678 - RNA, 19 nt, Homo sapiens
ucugguaucccaaauuuaa

SEQ ID NO: 351679 - RNA, 19 nt, Homo sapiens
ggaggaggagggagaaaug

SEQ ID NO: 351680 - RNA, 19 nt, Homo sapiens
uaccucaagucgugcauuu

SEQ ID NO: 351681 - RNA, 19 nt, Homo sapiens
uggcuacaauuucagguuu

SEQ ID NO: 351682 - RNA, 19 nt, Homo sapiens
gaagaaaagacucuacuau

SEQ ID NO: 351683 - RNA, 19 nt, Homo sapiens
ucaagucgugcauuuauga

SEQ ID NO: 351684 - RNA, 19 nt, Homo sapiens
ccaacaucaccacuacuua

SEQ ID NO: 351685 - RNA, 19 nt, Homo sapiens
uguggcggauuaugugaua

SEQ ID NO: 351686 - RNA, 19 nt, Homo sapiens
ucagagaagcgcugugcua

SEQ ID NO: 351687 - RNA, 19 nt, Homo sapiens
gcacugcuguggcuuucag

SEQ ID NO: 351688 - RNA, 19 nt, Homo sapiens
agaaauggccaccacauca

SEQ ID NO: 351689 - RNA, 19 nt, Homo sapiens
aaacuucacucuuuugguu

SEQ ID NO: 351690 - RNA, 19 nt, Homo sapiens
cagagaagcgcugugcuaa

SEQ ID NO: 351691 - RNA, 19 nt, Homo sapiens
caacaucaccacuacuuac

SEQ ID NO: 351692 - RNA, 19 nt, Homo sapiens
uuaagaacaacaucuggua

SEQ ID NO: 351693 - RNA, 19 nt, Homo sapiens
gagaaauggccaccacauc

SEQ ID NO: 351694 - RNA, 19 nt, Homo sapiens
cgugcugugugacaucaua

SEQ ID NO: 351695 - RNA, 19 nt, Homo sapiens
gggaaggcagggaaauuug

SEQ ID NO: 351696 - RNA, 19 nt, Homo sapiens
ggaaaagggcuaccaggaa

SEQ ID NO: 351697 - RNA, 19 nt, Homo sapiens
cccagcagcuccugugugu

SEQ ID NO: 351698 - RNA, 19 nt, Homo sapiens
ggauguggcggauuaugug

SEQ ID NO: 351699 - RNA, 19 nt, Homo sapiens
ccucaagucgugcauuuau

SEQ ID NO: 351700 - RNA, 19 nt, Homo sapiens
gcuggcauuucuccucaga

SEQ ID NO: 351701 - RNA, 19 nt, Homo sapiens
gcucuguucaagcacuuua

SEQ ID NO: 351702 - RNA, 19 nt, Homo sapiens
gcucagaagccuccugucu

SEQ ID NO: 351703 - RNA, 19 nt, Homo sapiens
ggagaaauggccaccacau

SEQ ID NO: 351704 - RNA, 19 nt, Homo sapiens
uaagaacaacaucugguau

SEQ ID NO: 351705 - RNA, 19 nt, Homo sapiens
ucgaggaccagacauuaaa

SEQ ID NO: 351706 - RNA, 19 nt, Homo sapiens
gacaggcccaguccucuga

SEQ ID NO: 351707 - RNA, 19 nt, Homo sapiens
ggacugcaaccuggacaga

SEQ ID NO: 351708 - RNA, 19 nt, Homo sapiens
ggcauccgcuucgacauca

SEQ ID NO: 351709 - RNA, 19 nt, Homo sapiens
ucuccuggcuacaauuuca

SEQ ID NO: 351710 - RNA, 19 nt, Homo sapiens
cggccuuccuguucgagua

SEQ ID NO: 351711 - RNA, 19 nt, Homo sapiens
gcuucgacaucauuguguu

SEQ ID NO: 351712 - RNA, 19 nt, Homo sapiens
cgaccacuguguguaaauc

SEQ ID NO: 351713 - RNA, 19 nt, Homo sapiens
gcugugaccaacacuucua

SEQ ID NO: 351714 - RNA, 19 nt, Homo sapiens
gggauguggcggauuaugu

SEQ ID NO: 351715 - RNA, 19 nt, Homo sapiens
ccacaucaccccagagaaa

SEQ ID NO: 351716 - RNA, 19 nt, Homo sapiens
uggcgaccgugcuguguga

SEQ ID NO: 351717 - RNA, 19 nt, Homo sapiens
guggucagcuccguuacga

SEQ ID NO: 351718 - RNA, 19 nt, Homo sapiens
ggaggucagcagucuguuc

SEQ ID NO: 351719 - RNA, 19 nt, Homo sapiens
gaaauggccaccacaucac

SEQ ID NO: 351720 - RNA, 19 nt, Homo sapiens
ugggaaggcagggaaauuu

SEQ ID NO: 351721 - RNA, 19 nt, Homo sapiens
accaacacuucuaaacuug

SEQ ID NO: 351722 - RNA, 19 nt, Homo sapiens
cagggaaauuugacaucau

SEQ ID NO: 351723 - RNA, 19 nt, Homo sapiens
ggcuacaauuucagguuug

SEQ ID NO: 351724 - RNA, 19 nt, Homo sapiens
uaucuccuggcuacaauuu

SEQ ID NO: 351725 - RNA, 19 nt, Homo sapiens
guucuuggcugggucaacu

SEQ ID NO: 351726 - RNA, 19 nt, Homo sapiens
uaucgggagaagaaauaua

SEQ ID NO: 351727 - RNA, 19 nt, Homo sapiens
agaaaagacucuacuaucg

SEQ ID NO: 351728 - RNA, 19 nt, Homo sapiens
auaguccucuacugcauga

SEQ ID NO: 351729 - RNA, 19 nt, Homo sapiens
cacgggacguugagcacaa

SEQ ID NO: 351730 - RNA, 19 nt, Homo sapiens
gacauuaaagcgugauuuu

SEQ ID NO: 351731 - RNA, 19 nt, Homo sapiens
acuaucgggagaagaaaua

SEQ ID NO: 351732 - RNA, 19 nt, Homo sapiens
ucuacuaucgggagaagaa

SEQ ID NO: 351733 - RNA, 19 nt, Homo sapiens
agggaaauuugacaucauc

SEQ ID NO: 351734 - RNA, 19 nt, Homo sapiens
gcgcugugcuaaggugauc

SEQ ID NO: 351735 - RNA, 19 nt, Homo sapiens
gauguggcggauuauguga

SEQ ID NO: 351736 - RNA, 19 nt, Homo sapiens
cauccuggccuacgucauc

SEQ ID NO: 351737 - RNA, 19 nt, Homo sapiens
ucauaguccucuacugcau

SEQ ID NO: 351738 - RNA, 19 nt, Homo sapiens
gcucauccgcagccgcaaa

SEQ ID NO: 351739 - RNA, 19 nt, Homo sapiens
gaggucagcagucuguucu

SEQ ID NO: 351740 - RNA, 19 nt, Homo sapiens
ugaccaacacuucuaaacu

SEQ ID NO: 351741 - RNA, 19 nt, Homo sapiens
ucagguuugccaaguacua

SEQ ID NO: 351742 - RNA, 19 nt, Homo sapiens
cguaucuccuggcuacaau

SEQ ID NO: 351743 - RNA, 19 nt, Homo sapiens
caccacuacuuaccucaag

SEQ ID NO: 351744 - RNA, 19 nt, Homo sapiens
aauuucagcaagaggaaua

SEQ ID NO: 351745 - RNA, 19 nt, Homo sapiens
gaugcgaccacugugugua

SEQ ID NO: 351746 - RNA, 19 nt, Homo sapiens
ucagcuccguuacgaccaa

SEQ ID NO: 351747 - RNA, 19 nt, Homo sapiens
guccucuacugcaugaaga

SEQ ID NO: 351748 - RNA, 19 nt, Homo sapiens
ucagaugccagcuguacug

SEQ ID NO: 351749 - RNA, 19 nt, Homo sapiens
ggugaucgaggaccagaca

SEQ ID NO: 351750 - RNA, 19 nt, Homo sapiens
cgggagaagaaauauaaau

SEQ ID NO: 351751 - RNA, 19 nt, Homo sapiens
cgucaucggguggguguuu

SEQ ID NO: 351752 - RNA, 19 nt, Homo sapiens
ccacuguguguaaaucaga

SEQ ID NO: 351753 - RNA, 19 nt, Homo sapiens
ggcuggagcuggcuuugcu

SEQ ID NO: 351754 - RNA, 19 nt, Homo sapiens
caggaggucagcagucugu

SEQ ID NO: 351755 - RNA, 19 nt, Homo sapiens
ccacagccccaucaaagaa

SEQ ID NO: 351756 - RNA, 19 nt, Homo sapiens
gaacugugaucuugauaaa

SEQ ID NO: 351757 - RNA, 19 nt, Homo sapiens
caagauauguauucucuga

SEQ ID NO: 351758 - RNA, 19 nt, Homo sapiens
caaguacucucucuccuaa

SEQ ID NO: 351759 - RNA, 19 nt, Homo sapiens
gaauggaacugugaucuug

SEQ ID NO: 351760 - RNA, 19 nt, Homo sapiens
gaacgucugugcugagaau

SEQ ID NO: 351761 - RNA, 19 nt, Homo sapiens
gcagugcccuguagaguuc

SEQ ID NO: 351762 - RNA, 19 nt, Homo sapiens
guacucaucuaccucauca

SEQ ID NO: 351763 - RNA, 19 nt, Homo sapiens
ggguacaacuucagauuug

SEQ ID NO: 351764 - RNA, 19 nt, Homo sapiens
uaaagaaccacauccguuu

SEQ ID NO: 351765 - RNA, 19 nt, Homo sapiens
gaaaagggcuccauuuggu

SEQ ID NO: 351766 - RNA, 19 nt, Homo sapiens
gggagcgacuuccaggaua

SEQ ID NO: 351767 - RNA, 19 nt, Homo sapiens
guauggguguuccugauaa

SEQ ID NO: 351768 - RNA, 19 nt, Homo sapiens
cuguagaguuccuagauua

SEQ ID NO: 351769 - RNA, 19 nt, Homo sapiens
uaaagaaggguuaccaaga

SEQ ID NO: 351770 - RNA, 19 nt, Homo sapiens
caaauucaacuucuccaaa

SEQ ID NO: 351771 - RNA, 19 nt, Homo sapiens
gggaacggguuguaaaugg

SEQ ID NO: 351772 - RNA, 19 nt, Homo sapiens
ccagugaucccaugccuuu

SEQ ID NO: 351773 - RNA, 19 nt, Homo sapiens
ggagcgacuuccaggauau

SEQ ID NO: 351774 - RNA, 19 nt, Homo sapiens
ggaacugugaucuugauaa

SEQ ID NO: 351775 - RNA, 19 nt, Homo sapiens
ggaggaggaagaagaggua

SEQ ID NO: 351776 - RNA, 19 nt, Homo sapiens
cagcuucccucagagcaua

SEQ ID NO: 351777 - RNA, 19 nt, Homo sapiens
ggagauggcagacgcuuuc

SEQ ID NO: 351778 - RNA, 19 nt, Homo sapiens
cacaggagcacgugaauug

SEQ ID NO: 351779 - RNA, 19 nt, Homo sapiens
ggcgugauaggaauuaaua

SEQ ID NO: 351780 - RNA, 19 nt, Homo sapiens
ccuggaggguggcgugaua

SEQ ID NO: 351781 - RNA, 19 nt, Homo sapiens
ccugaaaucaugccacuuu

SEQ ID NO: 351782 - RNA, 19 nt, Homo sapiens
gggcaccugugagaucuuu

SEQ ID NO: 351783 - RNA, 19 nt, Homo sapiens
aaagaaggguuaccaagac

SEQ ID NO: 351784 - RNA, 19 nt, Homo sapiens
cuucagauuugccagauau

SEQ ID NO: 351785 - RNA, 19 nt, Homo sapiens
uuagccgucuggacaauaa

SEQ ID NO: 351786 - RNA, 19 nt, Homo sapiens
ggguguuccugauaaagaa

SEQ ID NO: 351787 - RNA, 19 nt, Homo sapiens
ucagauuugccagauauua

SEQ ID NO: 351788 - RNA, 19 nt, Homo sapiens
ccaaguacucucucuccua

SEQ ID NO: 351789 - RNA, 19 nt, Homo sapiens
gauaaagaaggguuaccaa

SEQ ID NO: 351790 - RNA, 19 nt, Homo sapiens
gaggguggcgugauaggaa

SEQ ID NO: 351791 - RNA, 19 nt, Homo sapiens
cccaagauauguauucucu

SEQ ID NO: 351792 - RNA, 19 nt, Homo sapiens
ccagggagagaacgucuuu

SEQ ID NO: 351793 - RNA, 19 nt, Homo sapiens
ccuguagaguuccuagauu

SEQ ID NO: 351794 - RNA, 19 nt, Homo sapiens
gcuuugacgugauggugaa

SEQ ID NO: 351795 - RNA, 19 nt, Homo sapiens
gauccgcuuugacgugaug

SEQ ID NO: 351796 - RNA, 19 nt, Homo sapiens
ugaaggaggccgaagacuu

SEQ ID NO: 351797 - RNA, 19 nt, Homo sapiens
uggcguaccuggucguaug

SEQ ID NO: 351798 - RNA, 19 nt, Homo sapiens
cuacaagaccgagaaguau

SEQ ID NO: 351799 - RNA, 19 nt, Homo sapiens
gccaguacacagaauuaaa

SEQ ID NO: 351800 - RNA, 19 nt, Homo sapiens
guuccuagauuaccucacu

SEQ ID NO: 351801 - RNA, 19 nt, Homo sapiens
gagcgacuuccaggauaua

SEQ ID NO: 351802 - RNA, 19 nt, Homo sapiens
acuacaagaccgagaagua

SEQ ID NO: 351803 - RNA, 19 nt, Homo sapiens
ucucugacacucuuauuug

SEQ ID NO: 351804 - RNA, 19 nt, Homo sapiens
uguauucucugacacucuu

SEQ ID NO: 351805 - RNA, 19 nt, Homo sapiens
agauauguauucucugaca

SEQ ID NO: 351806 - RNA, 19 nt, Homo sapiens
gaccugcccaagauaugua

SEQ ID NO: 351807 - RNA, 19 nt, Homo sapiens
acacucuuauuuggucaua

SEQ ID NO: 351808 - RNA, 19 nt, Homo sapiens
ccaguacacagaauuaaag

SEQ ID NO: 351809 - RNA, 19 nt, Homo sapiens
ugccgcagcuucccucaga

SEQ ID NO: 351810 - RNA, 19 nt, Homo sapiens
gcccaacgggaaauuugua

SEQ ID NO: 351811 - RNA, 19 nt, Homo sapiens
ggaggaggaggaggaagaa

SEQ ID NO: 351812 - RNA, 19 nt, Homo sapiens
cgggaaauuuguacauugg

SEQ ID NO: 351813 - RNA, 19 nt, Homo sapiens
ccacauccguuuccccaaa

SEQ ID NO: 351814 - RNA, 19 nt, Homo sapiens
cgucugugcugagaaugaa

SEQ ID NO: 351815 - RNA, 19 nt, Homo sapiens
cuagggaacggguuguaaa

SEQ ID NO: 351816 - RNA, 19 nt, Homo sapiens
uauggguguuccugauaaa

SEQ ID NO: 351817 - RNA, 19 nt, Homo sapiens
caucaggacggacccauca

SEQ ID NO: 351818 - RNA, 19 nt, Homo sapiens
acgggaaauuuguacauug

SEQ ID NO: 351819 - RNA, 19 nt, Homo sapiens
caacgggaaauuuguacau

SEQ ID NO: 351820 - RNA, 19 nt, Homo sapiens
ugccagcuguuugcccuua

SEQ ID NO: 351821 - RNA, 19 nt, Homo sapiens
gauuaccucacugggaaua

SEQ ID NO: 351822 - RNA, 19 nt, Homo sapiens
cgucuggacaauaaacuuu

SEQ ID NO: 351823 - RNA, 19 nt, Homo sapiens
ggaccugcccaagauaugu

SEQ ID NO: 351824 - RNA, 19 nt, Homo sapiens
ggaggaggaggaagaagag

SEQ ID NO: 351825 - RNA, 19 nt, Homo sapiens
ggacgucaaggacagaucu

SEQ ID NO: 351826 - RNA, 19 nt, Homo sapiens
ucucaaccgcgucaauaaa

SEQ ID NO: 351827 - RNA, 19 nt, Homo sapiens
ggcguggccuucaccaaca

SEQ ID NO: 351828 - RNA, 19 nt, Homo sapiens
agagugcugucaucaccaa

SEQ ID NO: 351829 - RNA, 19 nt, Homo sapiens
ugccgucaguucuuccuuu

SEQ ID NO: 351830 - RNA, 19 nt, Homo sapiens
ugaauggaacugugaucuu

SEQ ID NO: 351831 - RNA, 19 nt, Homo sapiens
gaaggugggccugcuguac

SEQ ID NO: 351832 - RNA, 19 nt, Homo sapiens
cguauggguguuccugaua

SEQ ID NO: 351833 - RNA, 19 nt, Homo sapiens
cguggaagcagcagucaga

SEQ ID NO: 351834 - RNA, 19 nt, Homo sapiens
acucaucuaccucaucaaa

SEQ ID NO: 351835 - RNA, 19 nt, Homo sapiens
gaguuccgcacccugauga

SEQ ID NO: 351836 - RNA, 19 nt, Homo sapiens
cggguacaacuucagauuu

SEQ ID NO: 351837 - RNA, 19 nt, Homo sapiens
gugccacccucacuauucu

SEQ ID NO: 351838 - RNA, 19 nt, Homo sapiens
acugugaucuugauaaagc

SEQ ID NO: 351839 - RNA, 19 nt, Homo sapiens
gcugucaucaccaaaguca

SEQ ID NO: 351840 - RNA, 19 nt, Homo sapiens
ggaaaagggcuccauuugg

SEQ ID NO: 351841 - RNA, 19 nt, Homo sapiens
cauugugcguguccggaaa

SEQ ID NO: 351842 - RNA, 19 nt, Homo sapiens
ucacagggaccagccauca

SEQ ID NO: 351843 - RNA, 19 nt, Homo sapiens
aacgggaaauuuguacauu

SEQ ID NO: 351844 - RNA, 19 nt, Homo sapiens
gugcugucaucaccaaagu

SEQ ID NO: 351845 - RNA, 19 nt, Homo sapiens
cacccucacuauucuuuua

SEQ ID NO: 351846 - RNA, 19 nt, Homo sapiens
cugaaaucaugccacuuug

SEQ ID NO: 351847 - RNA, 19 nt, Homo sapiens
aguacucucucuccuaaag

SEQ ID NO: 351848 - RNA, 19 nt, Homo sapiens
gccgucaguucuuccuuuc

SEQ ID NO: 351849 - RNA, 19 nt, Homo sapiens
cgugaauugccucugcuua

SEQ ID NO: 351850 - RNA, 19 nt, Homo sapiens
ggaguuccgcacccugaug

SEQ ID NO: 351851 - RNA, 19 nt, Homo sapiens
ggccaguacacagaauuaa

SEQ ID NO: 351852 - RNA, 19 nt, Homo sapiens
cgucaguucuuccuuucuc

SEQ ID NO: 351853 - RNA, 19 nt, Homo sapiens
ccacaggagcacgugaauu

SEQ ID NO: 351854 - RNA, 19 nt, Homo sapiens
ccuacgggauccgcuuuga

SEQ ID NO: 351855 - RNA, 19 nt, Homo sapiens
accaacaccucggaucuug

SEQ ID NO: 351856 - RNA, 19 nt, Homo sapiens
gaacugugaucuugauaaa

SEQ ID NO: 351857 - RNA, 19 nt, Homo sapiens
caagauauguauucucuga

SEQ ID NO: 351858 - RNA, 19 nt, Homo sapiens
caaguacucucucuccuaa

SEQ ID NO: 351859 - RNA, 19 nt, Homo sapiens
gaauggaacugugaucuug

SEQ ID NO: 351860 - RNA, 19 nt, Homo sapiens
gcagugcccuguagaguuc

SEQ ID NO: 351861 - RNA, 19 nt, Homo sapiens
guacucaucuaccucauca

SEQ ID NO: 351862 - RNA, 19 nt, Homo sapiens
ggguacaacuucagauuug

SEQ ID NO: 351863 - RNA, 19 nt, Homo sapiens
uaaagaaccacauccguuu

SEQ ID NO: 351864 - RNA, 19 nt, Homo sapiens
gaaaagggcuccauuuggu

SEQ ID NO: 351865 - RNA, 19 nt, Homo sapiens
gggagcgacuuccaggaua

SEQ ID NO: 351866 - RNA, 19 nt, Homo sapiens
guauggguguuccugauaa

SEQ ID NO: 351867 - RNA, 19 nt, Homo sapiens
cuguagaguuccuagauua

SEQ ID NO: 351868 - RNA, 19 nt, Homo sapiens
uaaagaaggguuaccaaga

SEQ ID NO: 351869 - RNA, 19 nt, Homo sapiens
gggaacggguuguaaaugg

SEQ ID NO: 351870 - RNA, 19 nt, Homo sapiens
ccagugaucccaugccuuu

SEQ ID NO: 351871 - RNA, 19 nt, Homo sapiens
ggagcgacuuccaggauau

SEQ ID NO: 351872 - RNA, 19 nt, Homo sapiens
ggaacugugaucuugauaa

SEQ ID NO: 351873 - RNA, 19 nt, Homo sapiens
ggaggaggaagaagaggua

SEQ ID NO: 351874 - RNA, 19 nt, Homo sapiens
cagcuucccucagagcaua

SEQ ID NO: 351875 - RNA, 19 nt, Homo sapiens
ggagauggcagacgcuuuc

SEQ ID NO: 351876 - RNA, 19 nt, Homo sapiens
cacaggagcacgugaauug

SEQ ID NO: 351877 - RNA, 19 nt, Homo sapiens
ggcgugauaggaauuaaua

SEQ ID NO: 351878 - RNA, 19 nt, Homo sapiens
ccuggaggguggcgugaua

SEQ ID NO: 351879 - RNA, 19 nt, Homo sapiens
ccugaaaucaugccacuuu

SEQ ID NO: 351880 - RNA, 19 nt, Homo sapiens
gggcaccugugagaucuuu

SEQ ID NO: 351881 - RNA, 19 nt, Homo sapiens
aaagaaggguuaccaagac

SEQ ID NO: 351882 - RNA, 19 nt, Homo sapiens
cuucagauuugccagauau

SEQ ID NO: 351883 - RNA, 19 nt, Homo sapiens
aaauucaacuucuccaaca

SEQ ID NO: 351884 - RNA, 19 nt, Homo sapiens
uuagccgucuggacaauaa

SEQ ID NO: 351885 - RNA, 19 nt, Homo sapiens
ggguguuccugauaaagaa

SEQ ID NO: 351886 - RNA, 19 nt, Homo sapiens
ucagauuugccagauauua

SEQ ID NO: 351887 - RNA, 19 nt, Homo sapiens
ccaaguacucucucuccua

SEQ ID NO: 351888 - RNA, 19 nt, Homo sapiens
caacuucuccaacaaugug

SEQ ID NO: 351889 - RNA, 19 nt, Homo sapiens
gauaaagaaggguuaccaa

SEQ ID NO: 351890 - RNA, 19 nt, Homo sapiens
gaggguggcgugauaggaa

SEQ ID NO: 351891 - RNA, 19 nt, Homo sapiens
cccaagauauguauucucu

SEQ ID NO: 351892 - RNA, 19 nt, Homo sapiens
ccuguagaguuccuagauu

SEQ ID NO: 351893 - RNA, 19 nt, Homo sapiens
gcuuugacgugauggugaa

SEQ ID NO: 351894 - RNA, 19 nt, Homo sapiens
gauccgcuuugacgugaug

SEQ ID NO: 351895 - RNA, 19 nt, Homo sapiens
ugaaggaggccgaagacuu

SEQ ID NO: 351896 - RNA, 19 nt, Homo sapiens
uggcguaccuggucguaug

SEQ ID NO: 351897 - RNA, 19 nt, Homo sapiens
cuacaagaccgagaaguau

SEQ ID NO: 351898 - RNA, 19 nt, Homo sapiens
gccaguacacagaauuaaa

SEQ ID NO: 351899 - RNA, 19 nt, Homo sapiens
guuccuagauuaccucacu

SEQ ID NO: 351900 - RNA, 19 nt, Homo sapiens
gagcgacuuccaggauaua

SEQ ID NO: 351901 - RNA, 19 nt, Homo sapiens
acuacaagaccgagaagua

SEQ ID NO: 351902 - RNA, 19 nt, Homo sapiens
ucucugacacucuuauuug

SEQ ID NO: 351903 - RNA, 19 nt, Homo sapiens
uguauucucugacacucuu

SEQ ID NO: 351904 - RNA, 19 nt, Homo sapiens
agauauguauucucugaca

SEQ ID NO: 351905 - RNA, 19 nt, Homo sapiens
gaccugcccaagauaugua

SEQ ID NO: 351906 - RNA, 19 nt, Homo sapiens
acacucuuauuuggucaua

SEQ ID NO: 351907 - RNA, 19 nt, Homo sapiens
ccaguacacagaauuaaag

SEQ ID NO: 351908 - RNA, 19 nt, Homo sapiens
ugccgcagcuucccucaga

SEQ ID NO: 351909 - RNA, 19 nt, Homo sapiens
gcccaacgggaaauuugua

SEQ ID NO: 351910 - RNA, 19 nt, Homo sapiens
ggaggaggaggaggaagaa

SEQ ID NO: 351911 - RNA, 19 nt, Homo sapiens
cgggaaauuuguacauugg

SEQ ID NO: 351912 - RNA, 19 nt, Homo sapiens
ccacauccguuuccccaaa

SEQ ID NO: 351913 - RNA, 19 nt, Homo sapiens
cuagggaacggguuguaaa

SEQ ID NO: 351914 - RNA, 19 nt, Homo sapiens
caucaggacggacccauca

SEQ ID NO: 351915 - RNA, 19 nt, Homo sapiens
acgggaaauuuguacauug

SEQ ID NO: 351916 - RNA, 19 nt, Homo sapiens
uauggguguuccugauaaa

SEQ ID NO: 351917 - RNA, 19 nt, Homo sapiens
caacgggaaauuuguacau

SEQ ID NO: 351918 - RNA, 19 nt, Homo sapiens
ugccagcuguuugcccuua

SEQ ID NO: 351919 - RNA, 19 nt, Homo sapiens
gauuaccucacugggaaua

SEQ ID NO: 351920 - RNA, 19 nt, Homo sapiens
cgucuggacaauaaacuuu

SEQ ID NO: 351921 - RNA, 19 nt, Homo sapiens
acaaugugauggacgucaa

SEQ ID NO: 351922 - RNA, 19 nt, Homo sapiens
ggaccugcccaagauaugu

SEQ ID NO: 351923 - RNA, 19 nt, Homo sapiens
ucucaaccgcgucaauaaa

SEQ ID NO: 351924 - RNA, 19 nt, Homo sapiens
ggaggaggaggaagaagag

SEQ ID NO: 351925 - RNA, 19 nt, Homo sapiens
ggacgucaaggacagaucu

SEQ ID NO: 351926 - RNA, 19 nt, Homo sapiens
ggcguggccuucaccaaca

SEQ ID NO: 351927 - RNA, 19 nt, Homo sapiens
agagugcugucaucaccaa

SEQ ID NO: 351928 - RNA, 19 nt, Homo sapiens
gaaggugggccugcuguac

SEQ ID NO: 351929 - RNA, 19 nt, Homo sapiens
cguauggguguuccugaua

SEQ ID NO: 351930 - RNA, 19 nt, Homo sapiens
ugccgucaguucuuccuuu

SEQ ID NO: 351931 - RNA, 19 nt, Homo sapiens
ugaauggaacugugaucuu

SEQ ID NO: 351932 - RNA, 19 nt, Homo sapiens
cguggaagcagcagucaga

SEQ ID NO: 351933 - RNA, 19 nt, Homo sapiens
acucaucuaccucaucaaa

SEQ ID NO: 351934 - RNA, 19 nt, Homo sapiens
gaguuccgcacccugauga

SEQ ID NO: 351935 - RNA, 19 nt, Homo sapiens
cggguacaacuucagauuu

SEQ ID NO: 351936 - RNA, 19 nt, Homo sapiens
gugccacccucacuauucu

SEQ ID NO: 351937 - RNA, 19 nt, Homo sapiens
acugugaucuugauaaagc

SEQ ID NO: 351938 - RNA, 19 nt, Homo sapiens
gcugucaucaccaaaguca

SEQ ID NO: 351939 - RNA, 19 nt, Homo sapiens
ggaaaagggcuccauuugg

SEQ ID NO: 351940 - RNA, 19 nt, Homo sapiens
cauugugcguguccggaaa

SEQ ID NO: 351941 - RNA, 19 nt, Homo sapiens
ucacagggaccagccauca

SEQ ID NO: 351942 - RNA, 19 nt, Homo sapiens
aacgggaaauuuguacauu

SEQ ID NO: 351943 - RNA, 19 nt, Homo sapiens
cacccucacuauucuuuua

SEQ ID NO: 351944 - RNA, 19 nt, Homo sapiens
gugcugucaucaccaaagu

SEQ ID NO: 351945 - RNA, 19 nt, Homo sapiens
cugaaaucaugccacuuug

SEQ ID NO: 351946 - RNA, 19 nt, Homo sapiens
aguacucucucuccuaaag

SEQ ID NO: 351947 - RNA, 19 nt, Homo sapiens
gccgucaguucuuccuuuc

SEQ ID NO: 351948 - RNA, 19 nt, Homo sapiens
cgugaauugccucugcuua

SEQ ID NO: 351949 - RNA, 19 nt, Homo sapiens
ggaguuccgcacccugaug

SEQ ID NO: 351950 - RNA, 19 nt, Homo sapiens
ggccaguacacagaauuaa

SEQ ID NO: 351951 - RNA, 19 nt, Homo sapiens
accaacaccucggaucuug

SEQ ID NO: 351952 - RNA, 19 nt, Homo sapiens
cgucaguucuuccuuucuc

SEQ ID NO: 351953 - RNA, 19 nt, Homo sapiens
ccacaggagcacgugaauu

SEQ ID NO: 351954 - RNA, 19 nt, Homo sapiens
ccuacgggauccgcuuuga

SEQ ID NO: 351955 - RNA, 19 nt, Homo sapiens
ccaaauucaacuucuccaa

SEQ ID NO: 351956 - RNA, 19 nt, Homo sapiens
gaacgucugugcugagaau

SEQ ID NO: 351957 - RNA, 19 nt, Homo sapiens
guauggguguuccugauaa

SEQ ID NO: 351958 - RNA, 19 nt, Homo sapiens
uaaagaaggguuaccaaga

SEQ ID NO: 351959 - RNA, 19 nt, Homo sapiens
ggaggaggaagaagaggua

SEQ ID NO: 351960 - RNA, 19 nt, Homo sapiens
gggcaccugugagaucuuu

SEQ ID NO: 351961 - RNA, 19 nt, Homo sapiens
aaagaaggguuaccaagac

SEQ ID NO: 351962 - RNA, 19 nt, Homo sapiens
ggguguuccugauaaagaa

SEQ ID NO: 351963 - RNA, 19 nt, Homo sapiens
gauaaagaaggguuaccaa

SEQ ID NO: 351964 - RNA, 19 nt, Homo sapiens
ccagggagagaacgucuuu

SEQ ID NO: 351965 - RNA, 19 nt, Homo sapiens
uggcguaccuggucguaug

SEQ ID NO: 351966 - RNA, 19 nt, Homo sapiens
cuacaagaccgagaaguau

SEQ ID NO: 351967 - RNA, 19 nt, Homo sapiens
acuacaagaccgagaagua

SEQ ID NO: 351968 - RNA, 19 nt, Homo sapiens
cgucugugcugagaaugaa

SEQ ID NO: 351969 - RNA, 19 nt, Homo sapiens
ggaggaggaggaggaagaa

SEQ ID NO: 351970 - RNA, 19 nt, Homo sapiens
uauggguguuccugauaaa

SEQ ID NO: 351971 - RNA, 19 nt, Homo sapiens
ggcguggccuucaccaaca

SEQ ID NO: 351972 - RNA, 19 nt, Homo sapiens
agagugcugucaucaccaa

SEQ ID NO: 351973 - RNA, 19 nt, Homo sapiens
ggaggaggaggaagaagag

SEQ ID NO: 351974 - RNA, 19 nt, Homo sapiens
ucucaaccgcgucaauaaa

SEQ ID NO: 351975 - RNA, 19 nt, Homo sapiens
cguauggguguuccugaua

SEQ ID NO: 351976 - RNA, 19 nt, Homo sapiens
gaaggugggccugcuguac

SEQ ID NO: 351977 - RNA, 19 nt, Homo sapiens
gcugucaucaccaaaguca

SEQ ID NO: 351978 - RNA, 19 nt, Homo sapiens
gugcugucaucaccaaagu

SEQ ID NO: 351979 - RNA, 19 nt, Homo sapiens
accaacaccucggaucuug

SEQ ID NO: 351980 - RNA, 19 nt, Homo sapiens
gcuggaaacggagugaaga

SEQ ID NO: 351981 - RNA, 19 nt, Homo sapiens
ggaggaggaggaggaggaa

SEQ ID NO: 351982 - RNA, 19 nt, Homo sapiens
aguaugucaucgccaagaa

SEQ ID NO: 351983 - RNA, 19 nt, Homo sapiens
gaagagguagcggcaaggu

SEQ ID NO: 351984 - RNA, 19 nt, Homo sapiens
acaagaccgagaaguaugu

SEQ ID NO: 351985 - RNA, 19 nt, Homo sapiens
gaaaagagauugagaugua

SEQ ID NO: 351986 - RNA, 19 nt, Homo sapiens
ggagacaucuuccgagaaa

SEQ ID NO: 351987 - RNA, 19 nt, Homo sapiens
gaaaccguaucucuaauaa

SEQ ID NO: 351988 - RNA, 19 nt, Homo sapiens
guaaagaucuacaugaaug

SEQ ID NO: 351989 - RNA, 19 nt, Homo sapiens
gaaagagccugucaucagu

SEQ ID NO: 351990 - RNA, 19 nt, Homo sapiens
ggagaagucugcaagaugu

SEQ ID NO: 351991 - RNA, 19 nt, Homo sapiens
gaaauccugucuguacuaa

SEQ ID NO: 351992 - RNA, 19 nt, Homo sapiens
ccucagagcuguucaggaa

SEQ ID NO: 351993 - RNA, 19 nt, Homo sapiens
gcgauggacuucacagauu

SEQ ID NO: 351994 - RNA, 19 nt, Homo sapiens
aaagugaccugguuaaaca

SEQ ID NO: 351995 - RNA, 19 nt, Homo sapiens
gcucaacccucuccuacuu

SEQ ID NO: 351996 - RNA, 19 nt, Homo sapiens
gagaaacggacucugauaa

SEQ ID NO: 351997 - RNA, 19 nt, Homo sapiens
gagaaacaggcgauaauuu

SEQ ID NO: 351998 - RNA, 19 nt, Homo sapiens
ucacugugcucaucaagaa

SEQ ID NO: 351999 - RNA, 19 nt, Homo sapiens
gaagcugccucccaucuca

SEQ ID NO: 352000 - RNA, 19 nt, Homo sapiens
ggugaaaccguaucucuaa

SEQ ID NO: 352001 - RNA, 19 nt, Homo sapiens
gaagccagacgccauuuaa

SEQ ID NO: 352002 - RNA, 19 nt, Homo sapiens
ccaccaacguguccuugua

SEQ ID NO: 352003 - RNA, 19 nt, Homo sapiens
ggaaagagccugucaucag

SEQ ID NO: 352004 - RNA, 19 nt, Homo sapiens
ggaggaaaauuugacauua

SEQ ID NO: 352005 - RNA, 19 nt, Homo sapiens
gaauauggguggcucugau

SEQ ID NO: 352006 - RNA, 19 nt, Homo sapiens
gagcaaagugaccugguua

SEQ ID NO: 352007 - RNA, 19 nt, Homo sapiens
caagaacaauaucgacuuc

SEQ ID NO: 352008 - RNA, 19 nt, Homo sapiens
gcacaugaacugucuuuua

SEQ ID NO: 352009 - RNA, 19 nt, Homo sapiens
cagaaucccucuacaugga

SEQ ID NO: 352010 - RNA, 19 nt, Homo sapiens
aaagaguccuuaccaauag

SEQ ID NO: 352011 - RNA, 19 nt, Homo sapiens
gaugacaaacuuucucaaa

SEQ ID NO: 352012 - RNA, 19 nt, Homo sapiens
ggauccagagcaugaauua

SEQ ID NO: 352013 - RNA, 19 nt, Homo sapiens
gcagugauguuuuccagua

SEQ ID NO: 352014 - RNA, 19 nt, Homo sapiens
caaagccgacauuaaagua

SEQ ID NO: 352015 - RNA, 19 nt, Homo sapiens
cauccuggcuggagaaugu

SEQ ID NO: 352016 - RNA, 19 nt, Homo sapiens
cgauggacuucacagauuu

SEQ ID NO: 352017 - RNA, 19 nt, Homo sapiens
gagccaaagccgacauuaa

SEQ ID NO: 352018 - RNA, 19 nt, Homo sapiens
gaauacuacuacaggaaga

SEQ ID NO: 352019 - RNA, 19 nt, Homo sapiens
gaaacggacucugauaaaa

SEQ ID NO: 352020 - RNA, 19 nt, Homo sapiens
agaauggagugaagaaguu

SEQ ID NO: 352021 - RNA, 19 nt, Homo sapiens
uggagaauguggagaacua

SEQ ID NO: 352022 - RNA, 19 nt, Homo sapiens
gaggacaaauugagacagu

SEQ ID NO: 352023 - RNA, 19 nt, Homo sapiens
ggaagccagacgccauuua

SEQ ID NO: 352024 - RNA, 19 nt, Homo sapiens
cuacauggacucagagaaa

SEQ ID NO: 352025 - RNA, 19 nt, Homo sapiens
ucagauacgccaaguacua

SEQ ID NO: 352026 - RNA, 19 nt, Homo sapiens
aagaggagaucguggagaa

SEQ ID NO: 352027 - RNA, 19 nt, Homo sapiens
gcaaagugaccugguuaaa

SEQ ID NO: 352028 - RNA, 19 nt, Homo sapiens
gaacuucaccugcaaagcu

SEQ ID NO: 352029 - RNA, 19 nt, Homo sapiens
gcgggcaccuguaguccua

SEQ ID NO: 352030 - RNA, 19 nt, Homo sapiens
ugaaaccguaucucuaaua

SEQ ID NO: 352031 - RNA, 19 nt, Homo sapiens
gcuuugcucuggugaguga

SEQ ID NO: 352032 - RNA, 19 nt, Homo sapiens
ggguggcucugauugcuuu

SEQ ID NO: 352033 - RNA, 19 nt, Homo sapiens
gcaguacaguggcuucaag

SEQ ID NO: 352034 - RNA, 19 nt, Homo sapiens
ucugauugcuuuauccaaa

SEQ ID NO: 352035 - RNA, 19 nt, Homo sapiens
cacaugaacugucuuuuaa

SEQ ID NO: 352036 - RNA, 19 nt, Homo sapiens
gguuuaaacaucacuugua

SEQ ID NO: 352037 - RNA, 19 nt, Homo sapiens
ggaaccagaagaccuguga

SEQ ID NO: 352038 - RNA, 19 nt, Homo sapiens
ggagguggagguugcauug

SEQ ID NO: 352039 - RNA, 19 nt, Homo sapiens
cuucaagaguccuuacuga

SEQ ID NO: 352040 - RNA, 19 nt, Homo sapiens
gaagaagugcgaguccauu

SEQ ID NO: 352041 - RNA, 19 nt, Homo sapiens
gaacagugccgaaaacuuc

SEQ ID NO: 352042 - RNA, 19 nt, Homo sapiens
uaaagguggccacaaauuc

SEQ ID NO: 352043 - RNA, 19 nt, Homo sapiens
aggauaauguccaacuaaa

SEQ ID NO: 352044 - RNA, 19 nt, Homo sapiens
ccuguguggucaacgaaua

SEQ ID NO: 352045 - RNA, 19 nt, Homo sapiens
gccaaguacuacaaggaaa

SEQ ID NO: 352046 - RNA, 19 nt, Homo sapiens
aaacuucacugugcucauc

SEQ ID NO: 352047 - RNA, 19 nt, Homo sapiens
gagaauggagugaagaagu

SEQ ID NO: 352048 - RNA, 19 nt, Homo sapiens
agccaaagccgacauuaaa

SEQ ID NO: 352049 - RNA, 19 nt, Homo sapiens
gaagugcgaguccauugug

SEQ ID NO: 352050 - RNA, 19 nt, Homo sapiens
agaaacggacucugauaaa

SEQ ID NO: 352051 - RNA, 19 nt, Homo sapiens
aacuaaagguggccacaaa

SEQ ID NO: 352052 - RNA, 19 nt, Homo sapiens
gaacuaaagguggccacaa

SEQ ID NO: 352053 - RNA, 19 nt, Homo sapiens
agacuaggauaauguccaa

SEQ ID NO: 352054 - RNA, 19 nt, Homo sapiens
ugcugucgcucccauauuu

SEQ ID NO: 352055 - RNA, 19 nt, Homo sapiens
ugagaaacggacucugaua

SEQ ID NO: 352056 - RNA, 19 nt, Homo sapiens
ucacugccgucccaaauac

SEQ ID NO: 352057 - RNA, 19 nt, Homo sapiens
uuucagauguggcaauuca

SEQ ID NO: 352058 - RNA, 19 nt, Homo sapiens
gcgguugugucccgaguau

SEQ ID NO: 352059 - RNA, 19 nt, Homo sapiens
cuaaagguggccacaaauu

SEQ ID NO: 352060 - RNA, 19 nt, Homo sapiens
cuaggauaauguccaacua

SEQ ID NO: 352061 - RNA, 19 nt, Homo sapiens
cgaaauccugucuguacua

SEQ ID NO: 352062 - RNA, 19 nt, Homo sapiens
gcuggaggauccggaaaga

SEQ ID NO: 352063 - RNA, 19 nt, Homo sapiens
gggagaagucugcaagaug

SEQ ID NO: 352064 - RNA, 19 nt, Homo sapiens
guugagaaacggacucuga

SEQ ID NO: 352065 - RNA, 19 nt, Homo sapiens
guuuaaacaucacuuguac

SEQ ID NO: 352066 - RNA, 19 nt, Homo sapiens
ggucagacuaggauaaugu

SEQ ID NO: 352067 - RNA, 19 nt, Homo sapiens
gagcugugcugccggaaaa

SEQ ID NO: 352068 - RNA, 19 nt, Homo sapiens
ggauagcagaggugaaaga

SEQ ID NO: 352069 - RNA, 19 nt, Homo sapiens
cgagaaacaggcgauaauu

SEQ ID NO: 352070 - RNA, 19 nt, Homo sapiens
ggauggacccgcagagcaa

SEQ ID NO: 352071 - RNA, 19 nt, Homo sapiens
aaaagaguccuuaccaaua

SEQ ID NO: 352072 - RNA, 19 nt, Homo sapiens
guagugagcccagauugug

SEQ ID NO: 352073 - RNA, 19 nt, Homo sapiens
ggaggcagagguuguagug

SEQ ID NO: 352074 - RNA, 19 nt, Homo sapiens
aauccacagugucccauuu

SEQ ID NO: 352075 - RNA, 19 nt, Homo sapiens
ccacaagacucagaaucca

SEQ ID NO: 352076 - RNA, 19 nt, Homo sapiens
gagaauguggagaacuaaa

SEQ ID NO: 352077 - RNA, 19 nt, Homo sapiens
gaggagaucguggagaaug

SEQ ID NO: 352078 - RNA, 19 nt, Homo sapiens
gugcucaucaagaacaaua

SEQ ID NO: 352079 - RNA, 19 nt, Homo sapiens
ccagaagaccugugaaguc

SEQ ID NO: 352080 - RNA, 19 nt, Homo sapiens
ggaacucuuucuucgugau

SEQ ID NO: 352081 - RNA, 19 nt, Homo sapiens
gaggauccggaaagaguuu

SEQ ID NO: 352082 - RNA, 19 nt, Homo sapiens
uuauccagcugguugugua

SEQ ID NO: 352083 - RNA, 19 nt, Homo sapiens
ggagggaggcugucaccau

SEQ ID NO: 352084 - RNA, 19 nt, Homo sapiens
agaaguuggugcacagugu

SEQ ID NO: 352085 - RNA, 19 nt, Homo sapiens
agaaauaucuagcauggua

SEQ ID NO: 352086 - RNA, 19 nt, Homo sapiens
gaccaaagauugaguaaag

SEQ ID NO: 352087 - RNA, 19 nt, Homo sapiens
gggaaagccugcauauauu

SEQ ID NO: 352088 - RNA, 19 nt, Homo sapiens
gcacaagaaucuccaaaca

SEQ ID NO: 352089 - RNA, 19 nt, Homo sapiens
ggaaagccugcauauauua

SEQ ID NO: 352090 - RNA, 19 nt, Homo sapiens
gacaugacccucaauauuu

SEQ ID NO: 352091 - RNA, 19 nt, Homo sapiens
gaugauaguugacugaguu

SEQ ID NO: 352092 - RNA, 19 nt, Homo sapiens
gaagaagugaggcaaauuu

SEQ ID NO: 352093 - RNA, 19 nt, Homo sapiens
ggagauacuuucagaagga

SEQ ID NO: 352094 - RNA, 19 nt, Homo sapiens
aaugagggcuuuaguuuaa

SEQ ID NO: 352095 - RNA, 19 nt, Homo sapiens
ccaauuaaguugaucuuug

SEQ ID NO: 352096 - RNA, 19 nt, Homo sapiens
gaaugagggcuuuaguuua

SEQ ID NO: 352097 - RNA, 19 nt, Homo sapiens
acaccucucuguuguaaua

SEQ ID NO: 352098 - RNA, 19 nt, Homo sapiens
guuaguaaguugaaggaua

SEQ ID NO: 352099 - RNA, 19 nt, Homo sapiens
gaagacaugacccucaaua

SEQ ID NO: 352100 - RNA, 19 nt, Homo sapiens
aagcauagaugauaguuga

SEQ ID NO: 352101 - RNA, 19 nt, Homo sapiens
gacaagaggucuagcaagu

SEQ ID NO: 352102 - RNA, 19 nt, Homo sapiens
caaguauacucucaaaugu

SEQ ID NO: 352103 - RNA, 19 nt, Homo sapiens
ggcauagccuccaaguaua

SEQ ID NO: 352104 - RNA, 19 nt, Homo sapiens
gaauagacaaguaaagcua

SEQ ID NO: 352105 - RNA, 19 nt, Homo sapiens
gaaguuauuucaucuacag

SEQ ID NO: 352106 - RNA, 19 nt, Homo sapiens
guaggaugcuuaacagaau

SEQ ID NO: 352107 - RNA, 19 nt, Homo sapiens
ggcagcaucuuguuucuga

SEQ ID NO: 352108 - RNA, 19 nt, Homo sapiens
ggacaggaggacaguauuu

SEQ ID NO: 352109 - RNA, 19 nt, Homo sapiens
acaaagaucuggacaacuc

SEQ ID NO: 352110 - RNA, 19 nt, Homo sapiens
uauauugggugcuaaaugu

SEQ ID NO: 352111 - RNA, 19 nt, Homo sapiens
ccaaguauacucucaaaug

SEQ ID NO: 352112 - RNA, 19 nt, Homo sapiens
ccaagaaaauagugaguua

SEQ ID NO: 352113 - RNA, 19 nt, Homo sapiens
ggaggacaguauuucagaa

SEQ ID NO: 352114 - RNA, 19 nt, Homo sapiens
ucuuagacaucuugugaua

SEQ ID NO: 352115 - RNA, 19 nt, Homo sapiens
ggcauugaauagacaagua

SEQ ID NO: 352116 - RNA, 19 nt, Homo sapiens
acgaguaccugcgaaguua

SEQ ID NO: 352117 - RNA, 19 nt, Homo sapiens
ccguguacauguucaauuu

SEQ ID NO: 352118 - RNA, 19 nt, Homo sapiens
ggaaagcgcagucggaaag

SEQ ID NO: 352119 - RNA, 19 nt, Homo sapiens
agaaugagggcuuuaguuu

SEQ ID NO: 352120 - RNA, 19 nt, Homo sapiens
agacaugacccucaauauu

SEQ ID NO: 352121 - RNA, 19 nt, Homo sapiens
caagacgggcuuccaguuu

SEQ ID NO: 352122 - RNA, 19 nt, Homo sapiens
uggaaaaggucucauuaua

SEQ ID NO: 352123 - RNA, 19 nt, Homo sapiens
caagaggucuagcaagucu

SEQ ID NO: 352124 - RNA, 19 nt, Homo sapiens
gaaagccugcauauauuau

SEQ ID NO: 352125 - RNA, 19 nt, Homo sapiens
acaaaaccaucaccuguua

SEQ ID NO: 352126 - RNA, 19 nt, Homo sapiens
gcauugaauagacaaguaa

SEQ ID NO: 352127 - RNA, 19 nt, Homo sapiens
ugagagcuuugauuuacaa

SEQ ID NO: 352128 - RNA, 19 nt, Homo sapiens
guugcuggcuugcccgaua

SEQ ID NO: 352129 - RNA, 19 nt, Homo sapiens
ggaaaaggucucauuauau

SEQ ID NO: 352130 - RNA, 19 nt, Homo sapiens
gguaggaugcuuaacagaa

SEQ ID NO: 352131 - RNA, 19 nt, Homo sapiens
ucaaauguaugaagcaacu

SEQ ID NO: 352132 - RNA, 19 nt, Homo sapiens
gcauguauuuuccuuguaa

SEQ ID NO: 352133 - RNA, 19 nt, Homo sapiens
ggagauacaagccugugaa

SEQ ID NO: 352134 - RNA, 19 nt, Homo sapiens
gugaagacaugacccucaa

SEQ ID NO: 352135 - RNA, 19 nt, Homo sapiens
caaugugugcuuucaauga

SEQ ID NO: 352136 - RNA, 19 nt, Homo sapiens
ucugggcuguuacggauua

SEQ ID NO: 352137 - RNA, 19 nt, Homo sapiens
cugcagagguucaucuuuc

SEQ ID NO: 352138 - RNA, 19 nt, Homo sapiens
uguguaaacugcagagguu

SEQ ID NO: 352139 - RNA, 19 nt, Homo sapiens
gaucuucuacuacuucaau

SEQ ID NO: 352140 - RNA, 19 nt, Homo sapiens
gcugcacguuucuaaggua

SEQ ID NO: 352141 - RNA, 19 nt, Homo sapiens
uaauaugguaggaugcuua

SEQ ID NO: 352142 - RNA, 19 nt, Homo sapiens
cauuauauauugggugcua

SEQ ID NO: 352143 - RNA, 19 nt, Homo sapiens
uagaagaagugaggcaaau

SEQ ID NO: 352144 - RNA, 19 nt, Homo sapiens
gcgaaguuauuucaucuac

SEQ ID NO: 352145 - RNA, 19 nt, Homo sapiens
uuaaaagccugaaaaguga

SEQ ID NO: 352146 - RNA, 19 nt, Homo sapiens
gcugugcaaugccuuagga

SEQ ID NO: 352147 - RNA, 19 nt, Homo sapiens
caugagcucucuuagacau

SEQ ID NO: 352148 - RNA, 19 nt, Homo sapiens
ggggaaagccugcauauau

SEQ ID NO: 352149 - RNA, 19 nt, Homo sapiens
uaccugaguucaagcagaa

SEQ ID NO: 352150 - RNA, 19 nt, Homo sapiens
cuggacaacucuccucuga

SEQ ID NO: 352151 - RNA, 19 nt, Homo sapiens
gugcugguguggcucauug

SEQ ID NO: 352152 - RNA, 19 nt, Homo sapiens
agaagaaugcgaucuguau

SEQ ID NO: 352153 - RNA, 19 nt, Homo sapiens
ugcaaugccuuaggacuuu

SEQ ID NO: 352154 - RNA, 19 nt, Homo sapiens
ggcgggagauacuuucaga

SEQ ID NO: 352155 - RNA, 19 nt, Homo sapiens
ugugagagcuuugauuuac

SEQ ID NO: 352156 - RNA, 19 nt, Homo sapiens
gcaucuccguguacauguu

SEQ ID NO: 352157 - RNA, 19 nt, Homo sapiens
uuaaagucaugguggagaa

SEQ ID NO: 352158 - RNA, 19 nt, Homo sapiens
gauuaauugugagagcuuu

SEQ ID NO: 352159 - RNA, 19 nt, Homo sapiens
ggacuuuguuuguguucca

SEQ ID NO: 352160 - RNA, 19 nt, Homo sapiens
caagcagaauggagauaca

SEQ ID NO: 352161 - RNA, 19 nt, Homo sapiens
uuacaaagaucuggacaac

SEQ ID NO: 352162 - RNA, 19 nt, Homo sapiens
aaagaagaaugcgaucugu

SEQ ID NO: 352163 - RNA, 19 nt, Homo sapiens
ugccagcccugaucuucua

SEQ ID NO: 352164 - RNA, 19 nt, Homo sapiens
gaaaacacaaaaugcgaua

SEQ ID NO: 352165 - RNA, 19 nt, Homo sapiens
acaaggaaagcuucuagaa

SEQ ID NO: 352166 - RNA, 19 nt, Homo sapiens
gaagaaugcgaucuguauc

SEQ ID NO: 352167 - RNA, 19 nt, Homo sapiens
gcaaugccuuaggacuuug

SEQ ID NO: 352168 - RNA, 19 nt, Homo sapiens
aagcgcagucggaaaguua

SEQ ID NO: 352169 - RNA, 19 nt, Homo sapiens
gcccugaucuucuacuacu

SEQ ID NO: 352170 - RNA, 19 nt, Homo sapiens
gcaacagcguggccaucug

SEQ ID NO: 352171 - RNA, 19 nt, Homo sapiens
cagucucucuuccuucuga

SEQ ID NO: 352172 - RNA, 19 nt, Homo sapiens
uguuacggauuaauuguga

SEQ ID NO: 352173 - RNA, 19 nt, Homo sapiens
gggcuguuacggauuaauu

SEQ ID NO: 352174 - RNA, 19 nt, Homo sapiens
agacaaguaaagcuaauga

SEQ ID NO: 352175 - RNA, 19 nt, Homo sapiens
gaaauaucuagcaugguau

SEQ ID NO: 352176 - RNA, 19 nt, Homo sapiens
ccacguaucaggugacaag

SEQ ID NO: 352177 - RNA, 19 nt, Homo sapiens
ucucuuagacaucuuguga

SEQ ID NO: 352178 - RNA, 19 nt, Homo sapiens
ugguuuaucuagccuuuau

SEQ ID NO: 352179 - RNA, 19 nt, Homo sapiens
cauccacacuuagcuuguu

SEQ ID NO: 352180 - RNA, 19 nt, Homo sapiens
gcaaugugugcuuucaaug

SEQ ID NO: 352181 - RNA, 19 nt, Homo sapiens
cagagcgaguuucccuuga

SEQ ID NO: 352182 - RNA, 19 nt, Homo sapiens
gaguaaagucaaauaacug

SEQ ID NO: 352183 - RNA, 19 nt, Homo sapiens
gacgaguaccugcgaaguu

SEQ ID NO: 352184 - RNA, 19 nt, Homo sapiens
gcaucuuguuucugacaug

SEQ ID NO: 352185 - RNA, 19 nt, Homo sapiens
gaagguggcuuaccaagau

SEQ ID NO: 352186 - RNA, 19 nt, Homo sapiens
gaugucaacuuccuuguaa

SEQ ID NO: 352187 - RNA, 19 nt, Homo sapiens
gaacugacaugcagaggau

SEQ ID NO: 352188 - RNA, 19 nt, Homo sapiens
caacauggccuacaagguu

SEQ ID NO: 352189 - RNA, 19 nt, Homo sapiens
ggaaugcguccaccacaua

SEQ ID NO: 352190 - RNA, 19 nt, Homo sapiens
ggcaagagcucaaggucaa

SEQ ID NO: 352191 - RNA, 19 nt, Homo sapiens
uaacuggagcuccgauuua

SEQ ID NO: 352192 - RNA, 19 nt, Homo sapiens
gaggauagaagauguguug

SEQ ID NO: 352193 - RNA, 19 nt, Homo sapiens
gcugagcugugcccuauug

SEQ ID NO: 352194 - RNA, 19 nt, Homo sapiens
caagucaaauggagaaaca

SEQ ID NO: 352195 - RNA, 19 nt, Homo sapiens
agagucaacuguucccaua

SEQ ID NO: 352196 - RNA, 19 nt, Homo sapiens
gaacaucuggggacuaaua

SEQ ID NO: 352197 - RNA, 19 nt, Homo sapiens
ggcuguaacuuauacuaaa

SEQ ID NO: 352198 - RNA, 19 nt, Homo sapiens
gcacaguggucuggaaugg

SEQ ID NO: 352199 - RNA, 19 nt, Homo sapiens
ggccaaauucaaacuauaa

SEQ ID NO: 352200 - RNA, 19 nt, Homo sapiens
agaaaacccugguaaguaa

SEQ ID NO: 352201 - RNA, 19 nt, Homo sapiens
cgagaacacuaaggacauu

SEQ ID NO: 352202 - RNA, 19 nt, Homo sapiens
cuugagauuucccaguuua

SEQ ID NO: 352203 - RNA, 19 nt, Homo sapiens
aaacucuuauggccaaauu

SEQ ID NO: 352204 - RNA, 19 nt, Homo sapiens
ucucaggaguagucucaua

SEQ ID NO: 352205 - RNA, 19 nt, Homo sapiens
ggagaaacaggcccagaga

SEQ ID NO: 352206 - RNA, 19 nt, Homo sapiens
ccaccugccuucucacuag

SEQ ID NO: 352207 - RNA, 19 nt, Homo sapiens
ggaagguggcuuaccaaga

SEQ ID NO: 352208 - RNA, 19 nt, Homo sapiens
gucaugugcugguaaaugu

SEQ ID NO: 352209 - RNA, 19 nt, Homo sapiens
ugccgcugcuggucuauua

SEQ ID NO: 352210 - RNA, 19 nt, Homo sapiens
cuaaggacauucggcugua

SEQ ID NO: 352211 - RNA, 19 nt, Homo sapiens
aacauggccuacaagguua

SEQ ID NO: 352212 - RNA, 19 nt, Homo sapiens
gagcugugcccuauugugu

SEQ ID NO: 352213 - RNA, 19 nt, Homo sapiens
agugugaggcuguaacuua

SEQ ID NO: 352214 - RNA, 19 nt, Homo sapiens
gugugaggcuguaacuuau

SEQ ID NO: 352215 - RNA, 19 nt, Homo sapiens
gggaugagcugggcuacag

SEQ ID NO: 352216 - RNA, 19 nt, Homo sapiens
caggaguagucucauauca

SEQ ID NO: 352217 - RNA, 19 nt, Homo sapiens
cagagaggaagguggcuua

SEQ ID NO: 352218 - RNA, 19 nt, Homo sapiens
agucaucguuuguguguau

SEQ ID NO: 352219 - RNA, 19 nt, Homo sapiens
uggccaaauucaaacuaua

SEQ ID NO: 352220 - RNA, 19 nt, Homo sapiens
caugugcugguaaauguua

SEQ ID NO: 352221 - RNA, 19 nt, Homo sapiens
gauauggcagggaagcuuu

SEQ ID NO: 352222 - RNA, 19 nt, Homo sapiens
gcuguaacuuauacuaaag

SEQ ID NO: 352223 - RNA, 19 nt, Homo sapiens
caagaucacauaccagagu

SEQ ID NO: 352224 - RNA, 19 nt, Homo sapiens
gguccagagucaacuguuc

SEQ ID NO: 352225 - RNA, 19 nt, Homo sapiens
aaacaggcccagagaggaa

SEQ ID NO: 352226 - RNA, 19 nt, Homo sapiens
gcugguagcgagaacacua

SEQ ID NO: 352227 - RNA, 19 nt, Homo sapiens
guaaugagggcugaguuug

SEQ ID NO: 352228 - RNA, 19 nt, Homo sapiens
uuaccaagaucacauacca

SEQ ID NO: 352229 - RNA, 19 nt, Homo sapiens
gggaauuaaguuucaagaa

SEQ ID NO: 352230 - RNA, 19 nt, Homo sapiens
gcgcagauccgacagaacu

SEQ ID NO: 352231 - RNA, 19 nt, Homo sapiens
aacuggagcuccgauuuaa

SEQ ID NO: 352232 - RNA, 19 nt, Homo sapiens
agaggaagguggcuuacca

SEQ ID NO: 352233 - RNA, 19 nt, Homo sapiens
gaaugcguccaccacauau

SEQ ID NO: 352234 - RNA, 19 nt, Homo sapiens
cugcugagcugugcccuau

SEQ ID NO: 352235 - RNA, 19 nt, Homo sapiens
guagcgagaacacuaagga

SEQ ID NO: 352236 - RNA, 19 nt, Homo sapiens
gcagauccgacagaacuga

SEQ ID NO: 352237 - RNA, 19 nt, Homo sapiens
ccucaacgccaucaacaug

SEQ ID NO: 352238 - RNA, 19 nt, Homo sapiens
uuguagaacugcccauuuc

SEQ ID NO: 352239 - RNA, 19 nt, Homo sapiens
uguaggagcagaacacuuc

SEQ ID NO: 352240 - RNA, 19 nt, Homo sapiens
ccgucauccuugucuguua

SEQ ID NO: 352241 - RNA, 19 nt, Homo sapiens
ccaggcgugugcauucaug

SEQ ID NO: 352242 - RNA, 19 nt, Homo sapiens
cagaaaacccugguaagua

SEQ ID NO: 352243 - RNA, 19 nt, Homo sapiens
ggugauggccagucaugug

SEQ ID NO: 352244 - RNA, 19 nt, Homo sapiens
gaggcuguaacuuauacua

SEQ ID NO: 352245 - RNA, 19 nt, Homo sapiens
gugaggcuguaacuuauac

SEQ ID NO: 352246 - RNA, 19 nt, Homo sapiens
gcaaguccgugcgcaccau

SEQ ID NO: 352247 - RNA, 19 nt, Homo sapiens
agcacuaccugcccagaaa

SEQ ID NO: 352248 - RNA, 19 nt, Homo sapiens
gcucuucgcggugcccuuu

SEQ ID NO: 352249 - RNA, 19 nt, Homo sapiens
cgugugcauucaugaguga

SEQ ID NO: 352250 - RNA, 19 nt, Homo sapiens
ggauauggcagggaagcuu

SEQ ID NO: 352251 - RNA, 19 nt, Homo sapiens
ccaccuggcugugucugau

SEQ ID NO: 352252 - RNA, 19 nt, Homo sapiens
gacaggggcucaggauauu

SEQ ID NO: 352253 - RNA, 19 nt, Homo sapiens
ugaugucaacuuccuugua

SEQ ID NO: 352254 - RNA, 19 nt, Homo sapiens
ucuuauggccaaauucaaa

SEQ ID NO: 352255 - RNA, 19 nt, Homo sapiens
uauacuaaagguuguguug

SEQ ID NO: 352256 - RNA, 19 nt, Homo sapiens
ucguuuguguguauaaguu

SEQ ID NO: 352257 - RNA, 19 nt, Homo sapiens
gguccaggcgugugcauuc

SEQ ID NO: 352258 - RNA, 19 nt, Homo sapiens
ccuugagauuucccaguuu

SEQ ID NO: 352259 - RNA, 19 nt, Homo sapiens
ucccaguccuugagauuuc

SEQ ID NO: 352260 - RNA, 19 nt, Homo sapiens
cucaggauauucacucugu

SEQ ID NO: 352261 - RNA, 19 nt, Homo sapiens
gcgagaacacuaaggacau

SEQ ID NO: 352262 - RNA, 19 nt, Homo sapiens
gcagaggauagaagaugug

SEQ ID NO: 352263 - RNA, 19 nt, Homo sapiens
gggaaccccuucuuuguag

SEQ ID NO: 352264 - RNA, 19 nt, Homo sapiens
uuaacuggagcuccgauuu

SEQ ID NO: 352265 - RNA, 19 nt, Homo sapiens
gucacagguuggccagaaa

SEQ ID NO: 352266 - RNA, 19 nt, Homo sapiens
agucacagguuggccagaa

SEQ ID NO: 352267 - RNA, 19 nt, Homo sapiens
ccagccuaaucaagucaaa

SEQ ID NO: 352268 - RNA, 19 nt, Homo sapiens
gggcagcagugaggacucu

SEQ ID NO: 352269 - RNA, 19 nt, Homo sapiens
ccguggcgcucuacaucuu

SEQ ID NO: 352270 - RNA, 19 nt, Homo sapiens
uccuugagauuucccaguu

SEQ ID NO: 352271 - RNA, 19 nt, Homo sapiens
uggaaugacaccaucaaug

SEQ ID NO: 352272 - RNA, 19 nt, Homo sapiens
gaggaagguggcuuaccaa

SEQ ID NO: 352273 - RNA, 19 nt, Homo sapiens
ggcuacaggugccgcuuca

SEQ ID NO: 352274 - RNA, 19 nt, Homo sapiens
gccacagucuccccagaua

SEQ ID NO: 352275 - RNA, 19 nt, Homo sapiens
gagauuucccaguuuaggu

SEQ ID NO: 352276 - RNA, 19 nt, Homo sapiens
aaugagggcugaguuugca

SEQ ID NO: 352277 - RNA, 19 nt, Homo sapiens
aaacccugguaaguaauga

SEQ ID NO: 352278 - RNA, 19 nt, Homo sapiens
aaucaagucaaauggagaa

SEQ ID NO: 352279 - RNA, 19 nt, Homo sapiens
gaguccagccuaaucaagu

SEQ ID NO: 352280 - RNA, 19 nt, Homo sapiens
gagucaacuguucccauaa

SEQ ID NO: 352281 - RNA, 19 nt, Homo sapiens
cccaugcuccgucauuuga

SEQ ID NO: 352282 - RNA, 19 nt, Homo sapiens
cugccaagguaccuagguu

SEQ ID NO: 352283 - RNA, 19 nt, Homo sapiens
caagagcucaaggucaaug

SEQ ID NO: 352284 - RNA, 19 nt, Homo sapiens
uaaggacauucggcuguag

SEQ ID NO: 352285 - RNA, 19 nt, Homo sapiens
gcacugagaucugcaaguu

SEQ ID NO: 352286 - RNA, 19 nt, Homo sapiens
gagcuggacuguugguuug

SEQ ID NO: 352287 - RNA, 19 nt, Homo sapiens
ccacccucaucuacuauua

SEQ ID NO: 352288 - RNA, 19 nt, Homo sapiens
gugcugggcuugggccuua

SEQ ID NO: 352289 - RNA, 19 nt, Homo sapiens
gagcuaugcaguugucuuu

SEQ ID NO: 352290 - RNA, 19 nt, Homo sapiens
gaagcugacugccgaguac

SEQ ID NO: 352291 - RNA, 19 nt, Homo sapiens
cugaagaguuugaccacua

SEQ ID NO: 352292 - RNA, 19 nt, Homo sapiens
gcuaugcaguugucuuugu

SEQ ID NO: 352293 - RNA, 19 nt, Homo sapiens
ugagggaacccaauaguga

SEQ ID NO: 352294 - RNA, 19 nt, Homo sapiens
uagggcagauagauuguaa

SEQ ID NO: 352295 - RNA, 19 nt, Homo sapiens
ccacaucacccgcaccauu

SEQ ID NO: 352296 - RNA, 19 nt, Homo sapiens
gaugaggauuucaaguuca

SEQ ID NO: 352297 - RNA, 19 nt, Homo sapiens
gaggugagggaacccaaua

SEQ ID NO: 352298 - RNA, 19 nt, Homo sapiens
ugaagaguuugaccacuau

SEQ ID NO: 352299 - RNA, 19 nt, Homo sapiens
caacguggucuauaaagug

SEQ ID NO: 352300 - RNA, 19 nt, Homo sapiens
ggagcuggacuguugguuu

SEQ ID NO: 352301 - RNA, 19 nt, Homo sapiens
ugaugaggauuucaaguuc

SEQ ID NO: 352302 - RNA, 19 nt, Homo sapiens
ggaagcugacugccgagua

SEQ ID NO: 352303 - RNA, 19 nt, Homo sapiens
caacggccaccuacauguu

SEQ ID NO: 352304 - RNA, 19 nt, Homo sapiens
ccugugagcuaugcaguug

SEQ ID NO: 352305 - RNA, 19 nt, Homo sapiens
cacaaccacuggcccuuug

SEQ ID NO: 352306 - RNA, 19 nt, Homo sapiens
ucaacguggucuauaaagu

SEQ ID NO: 352307 - RNA, 19 nt, Homo sapiens
gccgaguacugaacauugu

SEQ ID NO: 352308 - RNA, 19 nt, Homo sapiens
cacaucacccgcaccauuu

SEQ ID NO: 352309 - RNA, 19 nt, Homo sapiens
agguggagcuggacuguug

SEQ ID NO: 352310 - RNA, 19 nt, Homo sapiens
gggcagauagauuguaaca

SEQ ID NO: 352311 - RNA, 19 nt, Homo sapiens
gcaacggccaccuacaugu

SEQ ID NO: 352312 - RNA, 19 nt, Homo sapiens
ugacaccacucggccugaa

SEQ ID NO: 352313 - RNA, 19 nt, Homo sapiens
ccacaaccacuggcccuuu

SEQ ID NO: 352314 - RNA, 19 nt, Homo sapiens
ugucacaaccagcaacaaa

SEQ ID NO: 352315 - RNA, 19 nt, Homo sapiens
aacguggucuauaaaguga

SEQ ID NO: 352316 - RNA, 19 nt, Homo sapiens
uagcuguggugcugacugu

SEQ ID NO: 352317 - RNA, 19 nt, Homo sapiens
gcucugcacagucgucuuc

SEQ ID NO: 352318 - RNA, 19 nt, Homo sapiens
ggucacucuuguuugcuau

SEQ ID NO: 352319 - RNA, 19 nt, Homo sapiens
ccaccguccugugccauga

SEQ ID NO: 352320 - RNA, 19 nt, Homo sapiens
cccuauggcucuucaucuu

SEQ ID NO: 352321 - RNA, 19 nt, Homo sapiens
uaaggugcuucuuccucuu

SEQ ID NO: 352322 - RNA, 19 nt, Homo sapiens
caaguucguccgcuuucuu

SEQ ID NO: 352323 - RNA, 19 nt, Homo sapiens
gcaaguucguccgcuuucu

SEQ ID NO: 352324 - RNA, 19 nt, Homo sapiens
ugcccacccucaucuacua

SEQ ID NO: 352325 - RNA, 19 nt, Homo sapiens
gggaugcaacggccaccua

SEQ ID NO: 352326 - RNA, 19 nt, Homo sapiens
gagggaacccaauagugau

SEQ ID NO: 352327 - RNA, 19 nt, Homo sapiens
uugucaacguggucuauaa

SEQ ID NO: 352328 - RNA, 19 nt, Homo sapiens
cuucgugccuuuccacauc

SEQ ID NO: 352329 - RNA, 19 nt, Homo sapiens
ugcccaaccuguucuuugu

SEQ ID NO: 352330 - RNA, 19 nt, Homo sapiens
gggaagccgggaagugaga

SEQ ID NO: 352331 - RNA, 19 nt, Homo sapiens
ccucuucccuggcacuagu

SEQ ID NO: 352332 - RNA, 19 nt, Homo sapiens
ugaccacuaugugcacuuc

SEQ ID NO: 352333 - RNA, 19 nt, Homo sapiens
cccaaccuguucuuuguca

SEQ ID NO: 352334 - RNA, 19 nt, Homo sapiens
ccaacccuauggcucuuca

SEQ ID NO: 352335 - RNA, 19 nt, Homo sapiens
ugucaacguggucuauaaa

SEQ ID NO: 352336 - RNA, 19 nt, Homo sapiens
ucugucagcucucccuagu

SEQ ID NO: 352337 - RNA, 19 nt, Homo sapiens
cuaugcaguugucuuugug

SEQ ID NO: 352338 - RNA, 19 nt, Homo sapiens
gcagggaggcagggauauc

SEQ ID NO: 352339 - RNA, 19 nt, Homo sapiens
acaucacccgcaccauuua

SEQ ID NO: 352340 - RNA, 19 nt, Homo sapiens
uggucacucuuguuugcua

SEQ ID NO: 352341 - RNA, 19 nt, Homo sapiens
ccuggucacucuuguuugc

SEQ ID NO: 352342 - RNA, 19 nt, Homo sapiens
caaccuguucuuugucaca

SEQ ID NO: 352343 - RNA, 19 nt, Homo sapiens
gugcccaaccuguucuuug

SEQ ID NO: 352344 - RNA, 19 nt, Homo sapiens
acccucaucuacuauuaug

SEQ ID NO: 352345 - RNA, 19 nt, Homo sapiens
gugagggaacccaauagug

SEQ ID NO: 352346 - RNA, 19 nt, Homo sapiens
ggugagggaacccaauagu

SEQ ID NO: 352347 - RNA, 19 nt, Homo sapiens
uggauccugugcucuacuu

SEQ ID NO: 352348 - RNA, 19 nt, Homo sapiens
gcugacugccgaguacuga

SEQ ID NO: 352349 - RNA, 19 nt, Homo sapiens
ucacccgcaccauuuacua

SEQ ID NO: 352350 - RNA, 19 nt, Homo sapiens
ucacaaccagcaacaaagg

SEQ ID NO: 352351 - RNA, 19 nt, Homo sapiens
gcuggacuguugguuugau

SEQ ID NO: 352352 - RNA, 19 nt, Homo sapiens
ggagugauauuccauuuau

SEQ ID NO: 352353 - RNA, 19 nt, Homo sapiens
gcucaugccuguaaucuca

SEQ ID NO: 352354 - RNA, 19 nt, Homo sapiens
guaaaggacuggagcuuca

SEQ ID NO: 352355 - RNA, 19 nt, Homo sapiens
caaaccaugcggagaauua

SEQ ID NO: 352356 - RNA, 19 nt, Homo sapiens
gaggagugauauuccauuu

SEQ ID NO: 352357 - RNA, 19 nt, Homo sapiens
cacaugagcuccuacagaa

SEQ ID NO: 352358 - RNA, 19 nt, Homo sapiens
ccacaggcauccagcguaa

SEQ ID NO: 352359 - RNA, 19 nt, Homo sapiens
ggugguggcugcugccuuu

SEQ ID NO: 352360 - RNA, 19 nt, Homo sapiens
ccuguaaucucagcaauuu

SEQ ID NO: 352361 - RNA, 19 nt, Homo sapiens
cugaacaucugugucauua

SEQ ID NO: 352362 - RNA, 19 nt, Homo sapiens
guaagacccuguuucuaca

SEQ ID NO: 352363 - RNA, 19 nt, Homo sapiens
ggaagccaauggagggauu

SEQ ID NO: 352364 - RNA, 19 nt, Homo sapiens
ggugaucacuggcccuuug

SEQ ID NO: 352365 - RNA, 19 nt, Homo sapiens
acauuaaggugcucacaaa

SEQ ID NO: 352366 - RNA, 19 nt, Homo sapiens
gaacaucugugucauuacc

SEQ ID NO: 352367 - RNA, 19 nt, Homo sapiens
uaaccgcacugucugcuau

SEQ ID NO: 352368 - RNA, 19 nt, Homo sapiens
gaacauugcacgcgacagu

SEQ ID NO: 352369 - RNA, 19 nt, Homo sapiens
cagacaagggcaagaguua

SEQ ID NO: 352370 - RNA, 19 nt, Homo sapiens
gcucaggccuguguugguu

SEQ ID NO: 352371 - RNA, 19 nt, Homo sapiens
ggagaggagugauauucca

SEQ ID NO: 352372 - RNA, 19 nt, Homo sapiens
gaaacucacagccaaaugg

SEQ ID NO: 352373 - RNA, 19 nt, Homo sapiens
ggcaagaguuagccagaug

SEQ ID NO: 352374 - RNA, 19 nt, Homo sapiens
ucugugcuguggcaaguua

SEQ ID NO: 352375 - RNA, 19 nt, Homo sapiens
gcgaggcacuugcuaacuc

SEQ ID NO: 352376 - RNA, 19 nt, Homo sapiens
ccacaugagcuccuacaga

SEQ ID NO: 352377 - RNA, 19 nt, Homo sapiens
cuacaacuaugcccaaggu

SEQ ID NO: 352378 - RNA, 19 nt, Homo sapiens
cagcuacccuccagacaag

SEQ ID NO: 352379 - RNA, 19 nt, Homo sapiens
caaggaaggaggaaugcuu

SEQ ID NO: 352380 - RNA, 19 nt, Homo sapiens
acacagacagugcccauga

SEQ ID NO: 352381 - RNA, 19 nt, Homo sapiens
cugggcagccuucauauuu

SEQ ID NO: 352382 - RNA, 19 nt, Homo sapiens
uggcugaccugcuauaugc

SEQ ID NO: 352383 - RNA, 19 nt, Homo sapiens
gcucccaacugcuggaagu

SEQ ID NO: 352384 - RNA, 19 nt, Homo sapiens
ggaguuaagaucccucaca

SEQ ID NO: 352385 - RNA, 19 nt, Homo sapiens
gcauggcucucacugucau

SEQ ID NO: 352386 - RNA, 19 nt, Homo sapiens
caacuaugcccaaggugau

SEQ ID NO: 352387 - RNA, 19 nt, Homo sapiens
gaagccaauggagggauua

SEQ ID NO: 352388 - RNA, 19 nt, Homo sapiens
cuucauauuugccauugug

SEQ ID NO: 352389 - RNA, 19 nt, Homo sapiens
guccugggcagccuucaua

SEQ ID NO: 352390 - RNA, 19 nt, Homo sapiens
gcgagaacuucaagcaacu

SEQ ID NO: 352391 - RNA, 19 nt, Homo sapiens
gggcaagaguuagccagau

SEQ ID NO: 352392 - RNA, 19 nt, Homo sapiens
gcugaacaucugugucauu

SEQ ID NO: 352393 - RNA, 19 nt, Homo sapiens
guacagacuggcacagcaa

SEQ ID NO: 352394 - RNA, 19 nt, Homo sapiens
ccuagaagaaccaguccua

SEQ ID NO: 352395 - RNA, 19 nt, Homo sapiens
gcacggcagcauccucuuc

SEQ ID NO: 352396 - RNA, 19 nt, Homo sapiens
gcagugggaagccaaugga

SEQ ID NO: 352397 - RNA, 19 nt, Homo sapiens
gacguguacugucaucaag

SEQ ID NO: 352398 - RNA, 19 nt, Homo sapiens
gggcagccuucauauuugc

SEQ ID NO: 352399 - RNA, 19 nt, Homo sapiens
cuucaggguucucgggauu

SEQ ID NO: 352400 - RNA, 19 nt, Homo sapiens
gcucugugcuguggcaagu

SEQ ID NO: 352401 - RNA, 19 nt, Homo sapiens
gaaaaugggagcugugcuu

SEQ ID NO: 352402 - RNA, 19 nt, Homo sapiens
ggacccagaagcucaccaa

SEQ ID NO: 352403 - RNA, 19 nt, Homo sapiens
ugggcagccuucauauuug

SEQ ID NO: 352404 - RNA, 19 nt, Homo sapiens
cagcguaaccgcacugucu

SEQ ID NO: 352405 - RNA, 19 nt, Homo sapiens
ugugaaagcugagaaaaug

SEQ ID NO: 352406 - RNA, 19 nt, Homo sapiens
ugaagcgggugagggaaga

SEQ ID NO: 352407 - RNA, 19 nt, Homo sapiens
aguaagacccuguuucuac

SEQ ID NO: 352408 - RNA, 19 nt, Homo sapiens
ggggagcacuuuaaugcaa

SEQ ID NO: 352409 - RNA, 19 nt, Homo sapiens
gguaugcuccaugcuuuga

SEQ ID NO: 352410 - RNA, 19 nt, Homo sapiens
cagcugggcauggaguuaa

SEQ ID NO: 352411 - RNA, 19 nt, Homo sapiens
gggguaugcuccaugcuuu

SEQ ID NO: 352412 - RNA, 19 nt, Homo sapiens
gcgaccacaugagcuccua

SEQ ID NO: 352413 - RNA, 19 nt, Homo sapiens
gcccuggccacccacuaua

SEQ ID NO: 352414 - RNA, 19 nt, Homo sapiens
ccgcugaacaucuguguca

SEQ ID NO: 352415 - RNA, 19 nt, Homo sapiens
aagacccuguuucuacaaa

SEQ ID NO: 352416 - RNA, 19 nt, Homo sapiens
ggccaaggaaggaggaaug

SEQ ID NO: 352417 - RNA, 19 nt, Homo sapiens
ccagacaagggcaagaguu

SEQ ID NO: 352418 - RNA, 19 nt, Homo sapiens
acaucaggguugugacaga

SEQ ID NO: 352419 - RNA, 19 nt, Homo sapiens
gggcauuugagcuggguuu

SEQ ID NO: 352420 - RNA, 19 nt, Homo sapiens
gcugcugccuuugccauca

SEQ ID NO: 352421 - RNA, 19 nt, Homo sapiens
ucagcuacccuccagacaa

SEQ ID NO: 352422 - RNA, 19 nt, Homo sapiens
cgaggcacuugcuaacucu

SEQ ID NO: 352423 - RNA, 19 nt, Homo sapiens
cauuugagcuggguuuuga

SEQ ID NO: 352424 - RNA, 19 nt, Homo sapiens
cugcucaucuacaacuaug

SEQ ID NO: 352425 - RNA, 19 nt, Homo sapiens
ccaucagcuuccugccuuu

SEQ ID NO: 352426 - RNA, 19 nt, Homo sapiens
gacaguuucaggcacagaa

SEQ ID NO: 352427 - RNA, 19 nt, Homo sapiens
caguggcucaugccuguaa

SEQ ID NO: 352428 - RNA, 19 nt, Homo sapiens
ccagagcagaggacacaug

SEQ ID NO: 352429 - RNA, 19 nt, Homo sapiens
ggccagagcagaggacaca

SEQ ID NO: 352430 - RNA, 19 nt, Homo sapiens
uccaaggagucaggaaaga

SEQ ID NO: 352431 - RNA, 19 nt, Homo sapiens
acauugcacgcgacaguuu

SEQ ID NO: 352432 - RNA, 19 nt, Homo sapiens
cagaaacucacagccaaau

SEQ ID NO: 352433 - RNA, 19 nt, Homo sapiens
cccacuauaugcccuaugg

SEQ ID NO: 352434 - RNA, 19 nt, Homo sapiens
guaaccgcacugucugcua

SEQ ID NO: 352435 - RNA, 19 nt, Homo sapiens
cagccugggcaacacagua

SEQ ID NO: 352436 - RNA, 19 nt, Homo sapiens
gccuucauauuugccauug

SEQ ID NO: 352437 - RNA, 19 nt, Homo sapiens
gagcuccuacagaaacuca

SEQ ID NO: 352438 - RNA, 19 nt, Homo sapiens
caugagcuccuacagaaac

SEQ ID NO: 352439 - RNA, 19 nt, Homo sapiens
cccauccucuucuacuuca

SEQ ID NO: 352440 - RNA, 19 nt, Homo sapiens
caguaagacccuguuucua

SEQ ID NO: 352441 - RNA, 19 nt, Homo sapiens
caccugggcagccauggaa

SEQ ID NO: 352442 - RNA, 19 nt, Homo sapiens
aggagugauauuccauuua

SEQ ID NO: 352443 - RNA, 19 nt, Homo sapiens
gagaggagugauauuccau

SEQ ID NO: 352444 - RNA, 19 nt, Homo sapiens
ugcuuugagucaccaauga

SEQ ID NO: 352445 - RNA, 19 nt, Homo sapiens
gcggagaauuagaguucag

SEQ ID NO: 352446 - RNA, 19 nt, Homo sapiens
gaguggagcugcuuuauug

SEQ ID NO: 352447 - RNA, 19 nt, Homo sapiens
gagcugagccaaugaugug

SEQ ID NO: 352448 - RNA, 19 nt, Homo sapiens
gaggguggcagguauaaga

SEQ ID NO: 352449 - RNA, 19 nt, Homo sapiens
gcaugacuguggccgagaa

SEQ ID NO: 352450 - RNA, 19 nt, Homo sapiens
ggcaggagcagucgccuuu

SEQ ID NO: 352451 - RNA, 19 nt, Homo sapiens
gguggcagguauaagacuu

SEQ ID NO: 352452 - RNA, 19 nt, Homo sapiens
ccagugguguggcccucua

SEQ ID NO: 352453 - RNA, 19 nt, Homo sapiens
guccugcccugccaacuuc

SEQ ID NO: 352454 - RNA, 19 nt, Homo sapiens
cccgagcuuugcagacaua

SEQ ID NO: 352455 - RNA, 19 nt, Homo sapiens
cuggagcgcuuccucuuca

SEQ ID NO: 352456 - RNA, 19 nt, Homo sapiens
ccauacuggugguugaguu

SEQ ID NO: 352457 - RNA, 19 nt, Homo sapiens
gcuccuaugugcccuacca

SEQ ID NO: 352458 - RNA, 19 nt, Homo sapiens
gagaguggagcugcuuuau

SEQ ID NO: 352459 - RNA, 19 nt, Homo sapiens
cuacgcagcccaggcauga

SEQ ID NO: 352460 - RNA, 19 nt, Homo sapiens
cccaagcacuggcgcuaug

SEQ ID NO: 352461 - RNA, 19 nt, Homo sapiens
agagaguggagcugcuuua

SEQ ID NO: 352462 - RNA, 19 nt, Homo sapiens
gagagaguggagcugcuuu

SEQ ID NO: 352463 - RNA, 19 nt, Homo sapiens
cccgugagcugagccaaug

SEQ ID NO: 352464 - RNA, 19 nt, Homo sapiens
ggcccauacuggugguuga

SEQ ID NO: 352465 - RNA, 19 nt, Homo sapiens
gggaggguggcagguauaa

SEQ ID NO: 352466 - RNA, 19 nt, Homo sapiens
ggacuuccuguggcccaua

SEQ ID NO: 352467 - RNA, 19 nt, Homo sapiens
agaguggagcugcuuuauu

SEQ ID NO: 352468 - RNA, 19 nt, Homo sapiens
ccuagguguugcuggagaa

SEQ ID NO: 352469 - RNA, 19 nt, Homo sapiens
gacuggagacgcaagaaca

SEQ ID NO: 352470 - RNA, 19 nt, Homo sapiens
cucggaggcugucuucugu

SEQ ID NO: 352471 - RNA, 19 nt, Homo sapiens
ggacuggagacgcaagaac

SEQ ID NO: 352472 - RNA, 19 nt, Homo sapiens
ccucuacgccagcuccuau

SEQ ID NO: 352473 - RNA, 19 nt, Homo sapiens
cccgaggccugcaucaagu

SEQ ID NO: 352474 - RNA, 19 nt, Homo sapiens
gcuaauaccuugccucuua

SEQ ID NO: 352475 - RNA, 19 nt, Homo sapiens
ggacaagccucguauuauu

SEQ ID NO: 352476 - RNA, 19 nt, Homo sapiens
ugacuucucugaaagauua

SEQ ID NO: 352477 - RNA, 19 nt, Homo sapiens
gaaauagaauugcuacaug

SEQ ID NO: 352478 - RNA, 19 nt, Homo sapiens
ugacaacaaugaccuauuu

SEQ ID NO: 352479 - RNA, 19 nt, Homo sapiens
cauaugaucuucuaaguug

SEQ ID NO: 352480 - RNA, 19 nt, Homo sapiens
ggaaaguccugcauaacaa

SEQ ID NO: 352481 - RNA, 19 nt, Homo sapiens
acaaauggguauccaauaa

SEQ ID NO: 352482 - RNA, 19 nt, Homo sapiens
gaccaguacuuucuaauga

SEQ ID NO: 352483 - RNA, 19 nt, Homo sapiens
gaucugaagacuaguaaua

SEQ ID NO: 352484 - RNA, 19 nt, Homo sapiens
agaaagaucuggugacuuc

SEQ ID NO: 352485 - RNA, 19 nt, Homo sapiens
ggacaaguuagaacaaaua

SEQ ID NO: 352486 - RNA, 19 nt, Homo sapiens
uaaagucucuguucuagau

SEQ ID NO: 352487 - RNA, 19 nt, Homo sapiens
ugaaacgucugaauacuga

SEQ ID NO: 352488 - RNA, 19 nt, Homo sapiens
guacaaguccuuucaguga

SEQ ID NO: 352489 - RNA, 19 nt, Homo sapiens
guaauaaacuaggacacua

SEQ ID NO: 352490 - RNA, 19 nt, Homo sapiens
gauuaaauacugugccuua

SEQ ID NO: 352491 - RNA, 19 nt, Homo sapiens
gaaguuggagcuaguguuu

SEQ ID NO: 352492 - RNA, 19 nt, Homo sapiens
gagagcuaaugguaacuua

SEQ ID NO: 352493 - RNA, 19 nt, Homo sapiens
gauaaagucucuguucuag

SEQ ID NO: 352494 - RNA, 19 nt, Homo sapiens
caaaguggccuauacagaa

SEQ ID NO: 352495 - RNA, 19 nt, Homo sapiens
ggagugaguuggagaaucu

SEQ ID NO: 352496 - RNA, 19 nt, Homo sapiens
ggagaaggagauuauagua

SEQ ID NO: 352497 - RNA, 19 nt, Homo sapiens
acaaaugccuuacagaugu

SEQ ID NO: 352498 - RNA, 19 nt, Homo sapiens
ggaaacaaaugccuuacag

SEQ ID NO: 352499 - RNA, 19 nt, Homo sapiens
ggacaagaauuucgaagac

SEQ ID NO: 352500 - RNA, 19 nt, Homo sapiens
uuaggagacuggaaguuua

SEQ ID NO: 352501 - RNA, 19 nt, Homo sapiens
uaaauacugugccuuagga

SEQ ID NO: 352502 - RNA, 19 nt, Homo sapiens
gugccuagguguucuguuu

SEQ ID NO: 352503 - RNA, 19 nt, Homo sapiens
gaacugcuguuuucuggua

SEQ ID NO: 352504 - RNA, 19 nt, Homo sapiens
ugauugcccuuucauauga

SEQ ID NO: 352505 - RNA, 19 nt, Homo sapiens
gauggaaaccguaauccua

SEQ ID NO: 352506 - RNA, 19 nt, Homo sapiens
gaagcagauuauuaccaua

SEQ ID NO: 352507 - RNA, 19 nt, Homo sapiens
uggagaaucugguccuuaa

SEQ ID NO: 352508 - RNA, 19 nt, Homo sapiens
cuaaaaugcucaccacuua

SEQ ID NO: 352509 - RNA, 19 nt, Homo sapiens
cuacauggcuguuuuauau

SEQ ID NO: 352510 - RNA, 19 nt, Homo sapiens
ccuguggugucucgaauua

SEQ ID NO: 352511 - RNA, 19 nt, Homo sapiens
auuauucgcuuccaugaua

SEQ ID NO: 352512 - RNA, 19 nt, Homo sapiens
caucagagagcuaauggua

SEQ ID NO: 352513 - RNA, 19 nt, Homo sapiens
ggcuuuaucucuaaccuaa

SEQ ID NO: 352514 - RNA, 19 nt, Homo sapiens
gaggacaaguuagaacaaa

SEQ ID NO: 352515 - RNA, 19 nt, Homo sapiens
gguagcaaauuauggaguu

SEQ ID NO: 352516 - RNA, 19 nt, Homo sapiens
gagcuaaugguaacuuaaa

SEQ ID NO: 352517 - RNA, 19 nt, Homo sapiens
ggcagaagaggacaaguua

SEQ ID NO: 352518 - RNA, 19 nt, Homo sapiens
caacaaugaccuauuuaug

SEQ ID NO: 352519 - RNA, 19 nt, Homo sapiens
gaagacaaggcagaguuua

SEQ ID NO: 352520 - RNA, 19 nt, Homo sapiens
gaauuucgaagaccuugua

SEQ ID NO: 352521 - RNA, 19 nt, Homo sapiens
gagaauacaagaucuaaca

SEQ ID NO: 352522 - RNA, 19 nt, Homo sapiens
gcaaaguggccuauacaga

SEQ ID NO: 352523 - RNA, 19 nt, Homo sapiens
gagugaaacacaaaucuuu

SEQ ID NO: 352524 - RNA, 19 nt, Homo sapiens
uagaaugggcugugugaua

SEQ ID NO: 352525 - RNA, 19 nt, Homo sapiens
agaaggagauuauaguaca

SEQ ID NO: 352526 - RNA, 19 nt, Homo sapiens
ggaauuacagguagcaaau

SEQ ID NO: 352527 - RNA, 19 nt, Homo sapiens
ccaugaacguggacaagaa

SEQ ID NO: 352528 - RNA, 19 nt, Homo sapiens
gaauuaaacguacuugagu

SEQ ID NO: 352529 - RNA, 19 nt, Homo sapiens
acacauuuccauagucuua

SEQ ID NO: 352530 - RNA, 19 nt, Homo sapiens
ggaaauagaauugcuacau

SEQ ID NO: 352531 - RNA, 19 nt, Homo sapiens
gaacaucagagagcuaaug

SEQ ID NO: 352532 - RNA, 19 nt, Homo sapiens
ggauaugucagauggcuuu

SEQ ID NO: 352533 - RNA, 19 nt, Homo sapiens
ugaacuagauccugaacau

SEQ ID NO: 352534 - RNA, 19 nt, Homo sapiens
cuaacuggguuccauguga

SEQ ID NO: 352535 - RNA, 19 nt, Homo sapiens
guggacaauugcuuacuuu

SEQ ID NO: 352536 - RNA, 19 nt, Homo sapiens
gcaggaggagccacuguuu

SEQ ID NO: 352537 - RNA, 19 nt, Homo sapiens
gaaaccguaauccuaaauu

SEQ ID NO: 352538 - RNA, 19 nt, Homo sapiens
gacaaaagauccagaagga

SEQ ID NO: 352539 - RNA, 19 nt, Homo sapiens
caaauggguauccaauaaa

SEQ ID NO: 352540 - RNA, 19 nt, Homo sapiens
caacaaauggguauccaau

SEQ ID NO: 352541 - RNA, 19 nt, Homo sapiens
gcugaggacugcuuugagu

SEQ ID NO: 352542 - RNA, 19 nt, Homo sapiens
cuguuuaccuagugucuua

SEQ ID NO: 352543 - RNA, 19 nt, Homo sapiens
gaaacaaaugccuuacaga

SEQ ID NO: 352544 - RNA, 19 nt, Homo sapiens
uuucaggaguuuacaauug

SEQ ID NO: 352545 - RNA, 19 nt, Homo sapiens
gauauacacauuuccauag

SEQ ID NO: 352546 - RNA, 19 nt, Homo sapiens
gaauuggaaugacaaacag

SEQ ID NO: 352547 - RNA, 19 nt, Homo sapiens
ugagccagaugcuuucaaa

SEQ ID NO: 352548 - RNA, 19 nt, Homo sapiens
gaugaaggcgagauuucua

SEQ ID NO: 352549 - RNA, 19 nt, Homo sapiens
caggauaccuacaauuugg

SEQ ID NO: 352550 - RNA, 19 nt, Homo sapiens
gguaauauuggcauucuga

SEQ ID NO: 352551 - RNA, 19 nt, Homo sapiens
aaacaaaugccuuacagau

SEQ ID NO: 352552 - RNA, 19 nt, Homo sapiens
cagaagaggacaaguuaga

SEQ ID NO: 352553 - RNA, 19 nt, Homo sapiens
ucagagagcuaaugguaac

SEQ ID NO: 352554 - RNA, 19 nt, Homo sapiens
guugguggguguuaagcua

SEQ ID NO: 352555 - RNA, 19 nt, Homo sapiens
guaacacgaaaucaucaua

SEQ ID NO: 352556 - RNA, 19 nt, Homo sapiens
uuucaucuguggacaauug

SEQ ID NO: 352557 - RNA, 19 nt, Homo sapiens
ggaguuuacaauugacuaa

SEQ ID NO: 352558 - RNA, 19 nt, Homo sapiens
acucuuaugugucugauau

SEQ ID NO: 352559 - RNA, 19 nt, Homo sapiens
gaacguggacaagaauuuc

SEQ ID NO: 352560 - RNA, 19 nt, Homo sapiens
cagcuaaacaggaggauga

SEQ ID NO: 352561 - RNA, 19 nt, Homo sapiens
uccaguaaaugcauucaaa

SEQ ID NO: 352562 - RNA, 19 nt, Homo sapiens
ugacugauuugauccauac

SEQ ID NO: 352563 - RNA, 19 nt, Homo sapiens
agaaugggcugugugauag

SEQ ID NO: 352564 - RNA, 19 nt, Homo sapiens
uaaccuaaccauucagaga

SEQ ID NO: 352565 - RNA, 19 nt, Homo sapiens
ucucuaaccuaaccauuca

SEQ ID NO: 352566 - RNA, 19 nt, Homo sapiens
gacaacaaugaccuauuua

SEQ ID NO: 352567 - RNA, 19 nt, Homo sapiens
ccuagugucuuacucuguu

SEQ ID NO: 352568 - RNA, 19 nt, Homo sapiens
ucgcuuccaugauauuauu

SEQ ID NO: 352569 - RNA, 19 nt, Homo sapiens
ccaguacuuucuaaugaug

SEQ ID NO: 352570 - RNA, 19 nt, Homo sapiens
ucuggugacuucucugaaa

SEQ ID NO: 352571 - RNA, 19 nt, Homo sapiens
aagaugagccagaugcuuu

SEQ ID NO: 352572 - RNA, 19 nt, Homo sapiens
agaagcagauuauuaccau

SEQ ID NO: 352573 - RNA, 19 nt, Homo sapiens
gugaugagggaauugauuu

SEQ ID NO: 352574 - RNA, 19 nt, Homo sapiens
gaucauggcucuugcauuu

SEQ ID NO: 352575 - RNA, 19 nt, Homo sapiens
ggaagacgaugaucagaaa

SEQ ID NO: 352576 - RNA, 19 nt, Homo sapiens
gaacacauuggccaaauaa

SEQ ID NO: 352577 - RNA, 19 nt, Homo sapiens
ugugaaagaugaacuguaa

SEQ ID NO: 352578 - RNA, 19 nt, Homo sapiens
gaaccucucugaagugaca

SEQ ID NO: 352579 - RNA, 19 nt, Homo sapiens
ucagaaagcugugaaagau

SEQ ID NO: 352580 - RNA, 19 nt, Homo sapiens
agaaagcugugaaagauga

SEQ ID NO: 352581 - RNA, 19 nt, Homo sapiens
gaggugaaaucaagacuca

SEQ ID NO: 352582 - RNA, 19 nt, Homo sapiens
aggaggagaugaccaagua

SEQ ID NO: 352583 - RNA, 19 nt, Homo sapiens
ccaagagugugucugacua

SEQ ID NO: 352584 - RNA, 19 nt, Homo sapiens
ugaacacauuggccaaaua

SEQ ID NO: 352585 - RNA, 19 nt, Homo sapiens
cagcagaggccaucgauga

SEQ ID NO: 352586 - RNA, 19 nt, Homo sapiens
caaggaugcuggagcugaa

SEQ ID NO: 352587 - RNA, 19 nt, Homo sapiens
cagagaggaucacagaguu

SEQ ID NO: 352588 - RNA, 19 nt, Homo sapiens
gggaaccucucugaaguga

SEQ ID NO: 352589 - RNA, 19 nt, Homo sapiens
aauaccagcucgacaaaga

SEQ ID NO: 352590 - RNA, 19 nt, Homo sapiens
gcagaagguuccgagauca

SEQ ID NO: 352591 - RNA, 19 nt, Homo sapiens
ccaaauaccagcucgacaa

SEQ ID NO: 352592 - RNA, 19 nt, Homo sapiens
gcagagaggcugaugacau

SEQ ID NO: 352593 - RNA, 19 nt, Homo sapiens
gcagagaggaucacagagu

SEQ ID NO: 352594 - RNA, 19 nt, Homo sapiens
ggcagaagguuccgagauc

SEQ ID NO: 352595 - RNA, 19 nt, Homo sapiens
gcagaaccacgacccuuga

SEQ ID NO: 352596 - RNA, 19 nt, Homo sapiens
caaauaccagcucgacaaa

SEQ ID NO: 352597 - RNA, 19 nt, Homo sapiens
cagggaaccucucugaagu

SEQ ID NO: 352598 - RNA, 19 nt, Homo sapiens
gugacguguucuccaaaua

SEQ ID NO: 352599 - RNA, 19 nt, Homo sapiens
gagaaccugcuggacuuua

SEQ ID NO: 352600 - RNA, 19 nt, Homo sapiens
acaguuggcucccauuugg

SEQ ID NO: 352601 - RNA, 19 nt, Homo sapiens
ggccaucgaugacauacca

SEQ ID NO: 352602 - RNA, 19 nt, Homo sapiens
ccaucaaguucuucaggaa

SEQ ID NO: 352603 - RNA, 19 nt, Homo sapiens
guacaaggaccaugagaac

SEQ ID NO: 352604 - RNA, 19 nt, Homo sapiens
cugaaaccaugauguacuu

SEQ ID NO: 352605 - RNA, 19 nt, Homo sapiens
gaacgcacgcuggaugguu

SEQ ID NO: 352606 - RNA, 19 nt, Homo sapiens
gaugaaggccggaacaacu

SEQ ID NO: 352607 - RNA, 19 nt, Homo sapiens
gacuggacauggucacuca

SEQ ID NO: 352608 - RNA, 19 nt, Homo sapiens
gaaagaugaacuguaauac

SEQ ID NO: 352609 - RNA, 19 nt, Homo sapiens
acagugacguguucuccaa

SEQ ID NO: 352610 - RNA, 19 nt, Homo sapiens
gacauaccauuugggauca

SEQ ID NO: 352611 - RNA, 19 nt, Homo sapiens
caaacugagcaacuucaaa

SEQ ID NO: 352612 - RNA, 19 nt, Homo sapiens
ggacauggucacucaguac

SEQ ID NO: 352613 - RNA, 19 nt, Homo sapiens
gguggaggccgucaaagug

SEQ ID NO: 352614 - RNA, 19 nt, Homo sapiens
gagccggacuggacauggu

SEQ ID NO: 352615 - RNA, 19 nt, Homo sapiens
ggaggaagacgaugaucag

SEQ ID NO: 352616 - RNA, 19 nt, Homo sapiens
aaacaguuggcucccauuu

SEQ ID NO: 352617 - RNA, 19 nt, Homo sapiens
agacucacauccugcuguu

SEQ ID NO: 352618 - RNA, 19 nt, Homo sapiens
agaaccugcuggacuuuau

SEQ ID NO: 352619 - RNA, 19 nt, Homo sapiens
aggagaaccugcuggacuu

SEQ ID NO: 352620 - RNA, 19 nt, Homo sapiens
ugacugaucauggcucuug

SEQ ID NO: 352621 - RNA, 19 nt, Homo sapiens
cagaggagccagacaugga

SEQ ID NO: 352622 - RNA, 19 nt, Homo sapiens
caaggaccaugagaacauc

SEQ ID NO: 352623 - RNA, 19 nt, Homo sapiens
gcaaacugagcaacuucaa

SEQ ID NO: 352624 - RNA, 19 nt, Homo sapiens
ccagggaaccucucugaag

SEQ ID NO: 352625 - RNA, 19 nt, Homo sapiens
agacguacaaggaccauga

SEQ ID NO: 352626 - RNA, 19 nt, Homo sapiens
cggcagagaggaucacaga

SEQ ID NO: 352627 - RNA, 19 nt, Homo sapiens
gacuaugacggcaaacuga

SEQ ID NO: 352628 - RNA, 19 nt, Homo sapiens
caucgaugacauaccauuu

SEQ ID NO: 352629 - RNA, 19 nt, Homo sapiens
ugggaucacuuccaacagu

SEQ ID NO: 352630 - RNA, 19 nt, Homo sapiens
acacauuggccaaauaaag

SEQ ID NO: 352631 - RNA, 19 nt, Homo sapiens
gaucagaaagcugugaaag

SEQ ID NO: 352632 - RNA, 19 nt, Homo sapiens
agccagacauggaggaaga

SEQ ID NO: 352633 - RNA, 19 nt, Homo sapiens
aaacgucuuuguggaguuc

SEQ ID NO: 352634 - RNA, 19 nt, Homo sapiens
acaagcagccugucaaggu

SEQ ID NO: 352635 - RNA, 19 nt, Homo sapiens
caagagugugucugacuau

SEQ ID NO: 352636 - RNA, 19 nt, Homo sapiens
ggagaaccugcuggacuuu

SEQ ID NO: 352637 - RNA, 19 nt, Homo sapiens
gcuaucccaccaucaaguu

SEQ ID NO: 352638 - RNA, 19 nt, Homo sapiens
aaacagcagccgagagcuu

SEQ ID NO: 352639 - RNA, 19 nt, Homo sapiens
gagugugucugacuaugac

SEQ ID NO: 352640 - RNA, 19 nt, Homo sapiens
cacauuggccaaauaaagu

SEQ ID NO: 352641 - RNA, 19 nt, Homo sapiens
uggacauggucacucagua

SEQ ID NO: 352642 - RNA, 19 nt, Homo sapiens
gaacuguaauacgcaaagc

SEQ ID NO: 352643 - RNA, 19 nt, Homo sapiens
aacgcacgcuggaugguuu

SEQ ID NO: 352644 - RNA, 19 nt, Homo sapiens
ugggagagacguacaagga

SEQ ID NO: 352645 - RNA, 19 nt, Homo sapiens
ggagaugaccaaguacaag

SEQ ID NO: 352646 - RNA, 19 nt, Homo sapiens
gcgcauccucgaguucuuu

SEQ ID NO: 352647 - RNA, 19 nt, Homo sapiens
aaacugagcaacuucaaaa

SEQ ID NO: 352648 - RNA, 19 nt, Homo sapiens
gaaggccggaacaacuuug

SEQ ID NO: 352649 - RNA, 19 nt, Homo sapiens
ggccaaauaaaguugaaau

SEQ ID NO: 352650 - RNA, 19 nt, Homo sapiens
cgagguggaggccgucaaa

SEQ ID NO: 352651 - RNA, 19 nt, Homo sapiens
acaaggaccaugagaacau

SEQ ID NO: 352652 - RNA, 19 nt, Homo sapiens
ccaaguacaagcccgaauc

SEQ ID NO: 352653 - RNA, 19 nt, Homo sapiens
gaggagaugaccaaguaca

SEQ ID NO: 352654 - RNA, 19 nt, Homo sapiens
gcagacagccccgaagauu

SEQ ID NO: 352655 - RNA, 19 nt, Homo sapiens
ugucgugggcucauuguga

SEQ ID NO: 352656 - RNA, 19 nt, Homo sapiens
gaaaccaugauguacuuuu

SEQ ID NO: 352657 - RNA, 19 nt, Homo sapiens
gaaagcugugaaagaugaa

SEQ ID NO: 352658 - RNA, 19 nt, Homo sapiens
gcagaggccaucgaugaca

SEQ ID NO: 352659 - RNA, 19 nt, Homo sapiens
cagaggccaucgaugacau

SEQ ID NO: 352660 - RNA, 19 nt, Homo sapiens
cgaguucuuuggccugaag

SEQ ID NO: 352661 - RNA, 19 nt, Homo sapiens
uuggguaaauggagacuuc

SEQ ID NO: 352662 - RNA, 19 nt, Homo sapiens
gcuggaugguuuuaagaaa

SEQ ID NO: 352663 - RNA, 19 nt, Homo sapiens
agacagccccgaagauuuu

SEQ ID NO: 352664 - RNA, 19 nt, Homo sapiens
gaaccugcuggacuuuauc

SEQ ID NO: 352665 - RNA, 19 nt, Homo sapiens
ugaaggccggaacaacuuu

SEQ ID NO: 352666 - RNA, 19 nt, Homo sapiens
ucgaugacauaccauuugg

SEQ ID NO: 352667 - RNA, 19 nt, Homo sapiens
gagcuucaagggcaagauc

SEQ ID NO: 352668 - RNA, 19 nt, Homo sapiens
gcggcuaucccaccaucaa

SEQ ID NO: 352669 - RNA, 19 nt, Homo sapiens
cugcuggacuuuaucaaac

SEQ ID NO: 352670 - RNA, 19 nt, Homo sapiens
agacauggaggaagacgau

SEQ ID NO: 352671 - RNA, 19 nt, Homo sapiens
gaggaagacgaugaucaga

SEQ ID NO: 352672 - RNA, 19 nt, Homo sapiens
caucaaguucuucaggaau

SEQ ID NO: 352673 - RNA, 19 nt, Homo sapiens
gaagcugaaggcagaaggu

SEQ ID NO: 352674 - RNA, 19 nt, Homo sapiens
gaacaaaguugcccacuca

SEQ ID NO: 352675 - RNA, 19 nt, Homo sapiens
ggacagagaaccacuauuu

SEQ ID NO: 352676 - RNA, 19 nt, Homo sapiens
gaaagcagauguuauuaag

SEQ ID NO: 352677 - RNA, 19 nt, Homo sapiens
gaaaggugaugccaugauu

SEQ ID NO: 352678 - RNA, 19 nt, Homo sapiens
gaaggagggugaauuuguu

SEQ ID NO: 352679 - RNA, 19 nt, Homo sapiens
gaagacuacuuuaaacgaa

SEQ ID NO: 352680 - RNA, 19 nt, Homo sapiens
gaacugcugcaaccauuua

SEQ ID NO: 352681 - RNA, 19 nt, Homo sapiens
gagaaccacuauuuacaaa

SEQ ID NO: 352682 - RNA, 19 nt, Homo sapiens
gaggaaagcagauguuauu

SEQ ID NO: 352683 - RNA, 19 nt, Homo sapiens
ggaaagcagauguuauuaa

SEQ ID NO: 352684 - RNA, 19 nt, Homo sapiens
guaaauaacuguguauguc

SEQ ID NO: 352685 - RNA, 19 nt, Homo sapiens
ugagguacaugaaguauau

SEQ ID NO: 352686 - RNA, 19 nt, Homo sapiens
caaaguugcccacucauuu

SEQ ID NO: 352687 - RNA, 19 nt, Homo sapiens
uaagagcauuugaagauga

SEQ ID NO: 352688 - RNA, 19 nt, Homo sapiens
gacagagaaccacuauuua

SEQ ID NO: 352689 - RNA, 19 nt, Homo sapiens
ccacagaccagcagaagaa

SEQ ID NO: 352690 - RNA, 19 nt, Homo sapiens
gccaugccguuuacuuuaa

SEQ ID NO: 352691 - RNA, 19 nt, Homo sapiens
gaaaugaagaaagguauug

SEQ ID NO: 352692 - RNA, 19 nt, Homo sapiens
ggucaaaccuggaaaucag

SEQ ID NO: 352693 - RNA, 19 nt, Homo sapiens
gaagagcgaccaggauuau

SEQ ID NO: 352694 - RNA, 19 nt, Homo sapiens
ugaauuuguugcccaguuu

SEQ ID NO: 352695 - RNA, 19 nt, Homo sapiens
gaaccacuauuuacaaacg

SEQ ID NO: 352696 - RNA, 19 nt, Homo sapiens
gaaaucagaacacacaagu

SEQ ID NO: 352697 - RNA, 19 nt, Homo sapiens
ugaaguauaugcuguggau

SEQ ID NO: 352698 - RNA, 19 nt, Homo sapiens
gacagaagccuggaacaaa

SEQ ID NO: 352699 - RNA, 19 nt, Homo sapiens
ccacggaagacuacuuuaa

SEQ ID NO: 352700 - RNA, 19 nt, Homo sapiens
aaaguugcccacucauuua

SEQ ID NO: 352701 - RNA, 19 nt, Homo sapiens
uaauguagcucacacuuuu

SEQ ID NO: 352702 - RNA, 19 nt, Homo sapiens
ugagaaggagggugaauuu

SEQ ID NO: 352703 - RNA, 19 nt, Homo sapiens
gcaucuagcucaggugugu

SEQ ID NO: 352704 - RNA, 19 nt, Homo sapiens
acagaacagggcuaaauua

SEQ ID NO: 352705 - RNA, 19 nt, Homo sapiens
ggaagacuacuuuaaacga

SEQ ID NO: 352706 - RNA, 19 nt, Homo sapiens
ggagugcgccaaacaugaa

SEQ ID NO: 352707 - RNA, 19 nt, Homo sapiens
gaagcagcaugucaucgau

SEQ ID NO: 352708 - RNA, 19 nt, Homo sapiens
uaacugcacgccaauagaa

SEQ ID NO: 352709 - RNA, 19 nt, Homo sapiens
gguccaggaugcagagcua

SEQ ID NO: 352710 - RNA, 19 nt, Homo sapiens
ggaaaugaagaaagguauu

SEQ ID NO: 352711 - RNA, 19 nt, Homo sapiens
gaacacacaagugacagaa

SEQ ID NO: 352712 - RNA, 19 nt, Homo sapiens
gaauuuguugcccaguuua

SEQ ID NO: 352713 - RNA, 19 nt, Homo sapiens
gcacgccaauagaagguau

SEQ ID NO: 352714 - RNA, 19 nt, Homo sapiens
aaucagaacacacaaguga

SEQ ID NO: 352715 - RNA, 19 nt, Homo sapiens
ccaacugacucuggucuug

SEQ ID NO: 352716 - RNA, 19 nt, Homo sapiens
guugcccaguuuaaauuua

SEQ ID NO: 352717 - RNA, 19 nt, Homo sapiens
gggaggaaagcagauguua

SEQ ID NO: 352718 - RNA, 19 nt, Homo sapiens
ccaccagcauuucgguaaa

SEQ ID NO: 352719 - RNA, 19 nt, Homo sapiens
aggauuauauucucaagga

SEQ ID NO: 352720 - RNA, 19 nt, Homo sapiens
gaccaggauuauauucuca

SEQ ID NO: 352721 - RNA, 19 nt, Homo sapiens
ugaagagcgaccaggauua

SEQ ID NO: 352722 - RNA, 19 nt, Homo sapiens
gcagaagaaggaccaugaa

SEQ ID NO: 352723 - RNA, 19 nt, Homo sapiens
acagaagccuggaacaaag

SEQ ID NO: 352724 - RNA, 19 nt, Homo sapiens
ggaggaaagcagauguuau

SEQ ID NO: 352725 - RNA, 19 nt, Homo sapiens
uagaagguaugcugucaca

SEQ ID NO: 352726 - RNA, 19 nt, Homo sapiens
ggauuauauucucaaggaa

SEQ ID NO: 352727 - RNA, 19 nt, Homo sapiens
gagcgaccaggauuauauu

SEQ ID NO: 352728 - RNA, 19 nt, Homo sapiens
gguaaauaacuguguaugu

SEQ ID NO: 352729 - RNA, 19 nt, Homo sapiens
gagcaacaggagcaaacua

SEQ ID NO: 352730 - RNA, 19 nt, Homo sapiens
gugaauuuguugcccaguu

SEQ ID NO: 352731 - RNA, 19 nt, Homo sapiens
cacggaagacuacuuuaaa

SEQ ID NO: 352732 - RNA, 19 nt, Homo sapiens
cuacagaacagggcuaaau

SEQ ID NO: 352733 - RNA, 19 nt, Homo sapiens
cagaagaaggaccaugaaa

SEQ ID NO: 352734 - RNA, 19 nt, Homo sapiens
aaaggugaugccaugauua

SEQ ID NO: 352735 - RNA, 19 nt, Homo sapiens
cgaccaggauuauauucuc

SEQ ID NO: 352736 - RNA, 19 nt, Homo sapiens
cagagaaccacuauuuaca

SEQ ID NO: 352737 - RNA, 19 nt, Homo sapiens
gcaggacagagaaccacua

SEQ ID NO: 352738 - RNA, 19 nt, Homo sapiens
ccaaguaacagggaggaaa

SEQ ID NO: 352739 - RNA, 19 nt, Homo sapiens
ugaaaacucagccgaauuu

SEQ ID NO: 352740 - RNA, 19 nt, Homo sapiens
caacaaccagcuccaacug

SEQ ID NO: 352741 - RNA, 19 nt, Homo sapiens
ccaacccacucccuuccaa

SEQ ID NO: 352742 - RNA, 19 nt, Homo sapiens
agaaggagggugaauuugu

SEQ ID NO: 352743 - RNA, 19 nt, Homo sapiens
gagaaggagggugaauuug

SEQ ID NO: 352744 - RNA, 19 nt, Homo sapiens
caaggaugcaggacagaga

SEQ ID NO: 352745 - RNA, 19 nt, Homo sapiens
ugacagaagccuggaacaa

SEQ ID NO: 352746 - RNA, 19 nt, Homo sapiens
ggaaaucagaacacacaag

SEQ ID NO: 352747 - RNA, 19 nt, Homo sapiens
caacaacaaccagcuccaa

SEQ ID NO: 352748 - RNA, 19 nt, Homo sapiens
aaagaaggccuccaagacu

SEQ ID NO: 352749 - RNA, 19 nt, Homo sapiens
uuaagagcauuugaagaug

SEQ ID NO: 352750 - RNA, 19 nt, Homo sapiens
ugccaugccguuuacuuua

SEQ ID NO: 352751 - RNA, 19 nt, Homo sapiens
agagaaccacuauuuacaa

SEQ ID NO: 352752 - RNA, 19 nt, Homo sapiens
aauagaagguaugcuguca

SEQ ID NO: 352753 - RNA, 19 nt, Homo sapiens
cuaauguagcucacacuuu

SEQ ID NO: 352754 - RNA, 19 nt, Homo sapiens
gaagaaacagggaaaaucu

SEQ ID NO: 352755 - RNA, 19 nt, Homo sapiens
caaaauucaucgucuucaa

SEQ ID NO: 352756 - RNA, 19 nt, Homo sapiens
ggggaaacauuagaagaaa

SEQ ID NO: 352757 - RNA, 19 nt, Homo sapiens
cuccaagacugcagagaau

SEQ ID NO: 352758 - RNA, 19 nt, Homo sapiens
gaaagaaaaggaaaugaag

SEQ ID NO: 352759 - RNA, 19 nt, Homo sapiens
caacaggagcaaacuaucg

SEQ ID NO: 352760 - RNA, 19 nt, Homo sapiens
ggacugaaaaugaaaacuu

SEQ ID NO: 352761 - RNA, 19 nt, Homo sapiens
uacagaacagggcuaaauu

SEQ ID NO: 352762 - RNA, 19 nt, Homo sapiens
aaaaggaaaugaagaaagg

SEQ ID NO: 352763 - RNA, 19 nt, Homo sapiens
gagccugaccucuacaagu

SEQ ID NO: 352764 - RNA, 19 nt, Homo sapiens
aaacuucacgugccuucuu

SEQ ID NO: 352765 - RNA, 19 nt, Homo sapiens
acagagaaccacuauuuac

SEQ ID NO: 352766 - RNA, 19 nt, Homo sapiens
gaauuugagguacaugaag

SEQ ID NO: 352767 - RNA, 19 nt, Homo sapiens
agagcgaccaggauuauau

SEQ ID NO: 352768 - RNA, 19 nt, Homo sapiens
acaaaguugcccacucauu

SEQ ID NO: 352769 - RNA, 19 nt, Homo sapiens
gcucaggugugucgguacu

SEQ ID NO: 352770 - RNA, 19 nt, Homo sapiens
caaguaacagggaggaaag

SEQ ID NO: 352771 - RNA, 19 nt, Homo sapiens
gcaacaggagcaaacuauc

SEQ ID NO: 352772 - RNA, 19 nt, Homo sapiens
gaaaaggaaaugaagaaag

SEQ ID NO: 352773 - RNA, 19 nt, Homo sapiens
ucugugaagugcaguucuu

SEQ ID NO: 352774 - RNA, 19 nt, Homo sapiens
gcacaguccucuccgauua

SEQ ID NO: 352775 - RNA, 19 nt, Homo sapiens
gcaggaaggaucccaaaua

SEQ ID NO: 352776 - RNA, 19 nt, Homo sapiens
gagcaaagcaucaaagaau

SEQ ID NO: 352777 - RNA, 19 nt, Homo sapiens
gaggaaaccugagaucugu

SEQ ID NO: 352778 - RNA, 19 nt, Homo sapiens
gaauagacccaccagcauu

SEQ ID NO: 352779 - RNA, 19 nt, Homo sapiens
ccagucagaugguaguuga

SEQ ID NO: 352780 - RNA, 19 nt, Homo sapiens
cagggaagcucuacaccuu

SEQ ID NO: 352781 - RNA, 19 nt, Homo sapiens
ccacccagguuaagaauag

SEQ ID NO: 352782 - RNA, 19 nt, Homo sapiens
gcuguuugcuuguaguuga

SEQ ID NO: 352783 - RNA, 19 nt, Homo sapiens
ugccuggccuuuauaauuu

SEQ ID NO: 352784 - RNA, 19 nt, Homo sapiens
uaauagauuucuccucuuc

SEQ ID NO: 352785 - RNA, 19 nt, Homo sapiens
ggaaggaucccaaauacag

SEQ ID NO: 352786 - RNA, 19 nt, Homo sapiens
aaagagcaauccuggaaga

SEQ ID NO: 352787 - RNA, 19 nt, Homo sapiens
guucaguguugcauguaua

SEQ ID NO: 352788 - RNA, 19 nt, Homo sapiens
ggacaggccgcuaaagugu

SEQ ID NO: 352789 - RNA, 19 nt, Homo sapiens
gaaaauagcaacccagaau

SEQ ID NO: 352790 - RNA, 19 nt, Homo sapiens
gagcaggacaggccgcuaa

SEQ ID NO: 352791 - RNA, 19 nt, Homo sapiens
caggaaggaucccaaauac

SEQ ID NO: 352792 - RNA, 19 nt, Homo sapiens
ggucuggaguugcugaaug

SEQ ID NO: 352793 - RNA, 19 nt, Homo sapiens
ccagaaugguacacaaugu

SEQ ID NO: 352794 - RNA, 19 nt, Homo sapiens
ggaggaaaccugagaucug

SEQ ID NO: 352795 - RNA, 19 nt, Homo sapiens
guugggacauggcaaucua

SEQ ID NO: 352796 - RNA, 19 nt, Homo sapiens
cgagugggaugacuaugug

SEQ ID NO: 352797 - RNA, 19 nt, Homo sapiens
caacacagugcaucucaga

SEQ ID NO: 352798 - RNA, 19 nt, Homo sapiens
uuaaagagcaauccuggaa

SEQ ID NO: 352799 - RNA, 19 nt, Homo sapiens
ucacucuggucccuuuaaa

SEQ ID NO: 352800 - RNA, 19 nt, Homo sapiens
gauccugaguccagaaugg

SEQ ID NO: 352801 - RNA, 19 nt, Homo sapiens
ccaguucaguguugcaugu

SEQ ID NO: 352802 - RNA, 19 nt, Homo sapiens
gaaggaucccaaauacaga

SEQ ID NO: 352803 - RNA, 19 nt, Homo sapiens
gaucccaaauacagagaau

SEQ ID NO: 352804 - RNA, 19 nt, Homo sapiens
gcaaagcaucaaagaaucu

SEQ ID NO: 352805 - RNA, 19 nt, Homo sapiens
gcagcugucugggaaguag

SEQ ID NO: 352806 - RNA, 19 nt, Homo sapiens
caguguugcauguauaaua

SEQ ID NO: 352807 - RNA, 19 nt, Homo sapiens
ggaugacuaugugcccaaa

SEQ ID NO: 352808 - RNA, 19 nt, Homo sapiens
acaggccgcuaaaguguga

SEQ ID NO: 352809 - RNA, 19 nt, Homo sapiens
ucaguaggcaucaguaugu

SEQ ID NO: 352810 - RNA, 19 nt, Homo sapiens
gagcagcugucugggaagu

SEQ ID NO: 352811 - RNA, 19 nt, Homo sapiens
ggaaaccugagaucugugu

SEQ ID NO: 352812 - RNA, 19 nt, Homo sapiens
aaauugaucguucuucaug

SEQ ID NO: 352813 - RNA, 19 nt, Homo sapiens
gauagagcaaagcaucaaa

SEQ ID NO: 352814 - RNA, 19 nt, Homo sapiens
uagcaacccagaauguaaa

SEQ ID NO: 352815 - RNA, 19 nt, Homo sapiens
gguaguugagggugacuuu

SEQ ID NO: 352816 - RNA, 19 nt, Homo sapiens
ucacucaccuagacaacca

SEQ ID NO: 352817 - RNA, 19 nt, Homo sapiens
gcauuaauugugcuguuug

SEQ ID NO: 352818 - RNA, 19 nt, Homo sapiens
cugccuggccuuuauaauu

SEQ ID NO: 352819 - RNA, 19 nt, Homo sapiens
cgcuaugucuggcugguuu

SEQ ID NO: 352820 - RNA, 19 nt, Homo sapiens
aauagacccaccagcauuu

SEQ ID NO: 352821 - RNA, 19 nt, Homo sapiens
aaauagcaacccagaaugu

SEQ ID NO: 352822 - RNA, 19 nt, Homo sapiens
ugcauuaauugugcuguuu

SEQ ID NO: 352823 - RNA, 19 nt, Homo sapiens
gaaaagcuggucuggaguu

SEQ ID NO: 352824 - RNA, 19 nt, Homo sapiens
aggcuggcauugaggcuaa

SEQ ID NO: 352825 - RNA, 19 nt, Homo sapiens
gugggauggucuugauuca

SEQ ID NO: 352826 - RNA, 19 nt, Homo sapiens
aguguugcauguauaauag

SEQ ID NO: 352827 - RNA, 19 nt, Homo sapiens
acaccuugguccugacaga

SEQ ID NO: 352828 - RNA, 19 nt, Homo sapiens
cacucacucugauuuaugu

SEQ ID NO: 352829 - RNA, 19 nt, Homo sapiens
gucuggaguugcugaaugu

SEQ ID NO: 352830 - RNA, 19 nt, Homo sapiens
acucuggucccuuuaaaga

SEQ ID NO: 352831 - RNA, 19 nt, Homo sapiens
aauagcaacccagaaugua

SEQ ID NO: 352832 - RNA, 19 nt, Homo sapiens
ccugcugccuggccuuuau

SEQ ID NO: 352833 - RNA, 19 nt, Homo sapiens
auagcaacccagaauguaa

SEQ ID NO: 352834 - RNA, 19 nt, Homo sapiens
ucacucacucugauuuaug

SEQ ID NO: 352835 - RNA, 19 nt, Homo sapiens
caggacaggccgcuaaagu

SEQ ID NO: 352836 - RNA, 19 nt, Homo sapiens
ggacgagcugggcaaagug

SEQ ID NO: 352837 - RNA, 19 nt, Homo sapiens
ugaugucacucaccuagac

SEQ ID NO: 352838 - RNA, 19 nt, Homo sapiens
uagagcaaagcaucaaaga

SEQ ID NO: 352839 - RNA, 19 nt, Homo sapiens
cagcaggaaggaucccaaa

SEQ ID NO: 352840 - RNA, 19 nt, Homo sapiens
gguugccucugccuuugug

SEQ ID NO: 352841 - RNA, 19 nt, Homo sapiens
agcaaagcaucaaagaauc

SEQ ID NO: 352842 - RNA, 19 nt, Homo sapiens
gcuaugucuggcugguuua

SEQ ID NO: 352843 - RNA, 19 nt, Homo sapiens
uuaauugugcuguuugcuu

SEQ ID NO: 352844 - RNA, 19 nt, Homo sapiens
ugacgcccacccagguuaa

SEQ ID NO: 352845 - RNA, 19 nt, Homo sapiens
acaguccucuccgauuaug

SEQ ID NO: 352846 - RNA, 19 nt, Homo sapiens
acucacucacucugauuua

SEQ ID NO: 352847 - RNA, 19 nt, Homo sapiens
acuaugugcccaaacugua

SEQ ID NO: 352848 - RNA, 19 nt, Homo sapiens
gguggcguccuuccguaaa

SEQ ID NO: 352849 - RNA, 19 nt, Homo sapiens
aaucuuuaagggagguuua

SEQ ID NO: 352850 - RNA, 19 nt, Homo sapiens
gaacggcucuuuccucuua

SEQ ID NO: 352851 - RNA, 19 nt, Homo sapiens
gaaaggagcucaauggaaa

SEQ ID NO: 352852 - RNA, 19 nt, Homo sapiens
gaaaugaacgguagaauug

SEQ ID NO: 352853 - RNA, 19 nt, Homo sapiens
gagaagacauggaugauga

SEQ ID NO: 352854 - RNA, 19 nt, Homo sapiens
ccaaauugcucgacuaaga

SEQ ID NO: 352855 - RNA, 19 nt, Homo sapiens
gaacagaugaagcaagaua

SEQ ID NO: 352856 - RNA, 19 nt, Homo sapiens
gaacuuaagcgcacauuug

SEQ ID NO: 352857 - RNA, 19 nt, Homo sapiens
gaaaaucacuggcauguug

SEQ ID NO: 352858 - RNA, 19 nt, Homo sapiens
uaaagaggcuacccagaaa

SEQ ID NO: 352859 - RNA, 19 nt, Homo sapiens
guaacauccuuucguguaa

SEQ ID NO: 352860 - RNA, 19 nt, Homo sapiens
ggagauugauaauucagaa

SEQ ID NO: 352861 - RNA, 19 nt, Homo sapiens
uagaugagaugaauggaaa

SEQ ID NO: 352862 - RNA, 19 nt, Homo sapiens
gccauuguauguagcuuua

SEQ ID NO: 352863 - RNA, 19 nt, Homo sapiens
gugcaaagguuaugaugga

SEQ ID NO: 352864 - RNA, 19 nt, Homo sapiens
gcuaacacaucaacacaga

SEQ ID NO: 352865 - RNA, 19 nt, Homo sapiens
ggaagguggucgcagcaaa

SEQ ID NO: 352866 - RNA, 19 nt, Homo sapiens
ccuaaauggucgcaaagua

SEQ ID NO: 352867 - RNA, 19 nt, Homo sapiens
uaacgugguuugugaugaa

SEQ ID NO: 352868 - RNA, 19 nt, Homo sapiens
uaaagcaguuacagaaaug

SEQ ID NO: 352869 - RNA, 19 nt, Homo sapiens
gcuccuagaguaccauuua

SEQ ID NO: 352870 - RNA, 19 nt, Homo sapiens
ggaaaggagcucaauggaa

SEQ ID NO: 352871 - RNA, 19 nt, Homo sapiens
caaggguuauggauuugua

SEQ ID NO: 352872 - RNA, 19 nt, Homo sapiens
gguaacauccuuucgugua

SEQ ID NO: 352873 - RNA, 19 nt, Homo sapiens
aagaagagcgccaggcuua

SEQ ID NO: 352874 - RNA, 19 nt, Homo sapiens
ugaaaguaaugaccgauga

SEQ ID NO: 352875 - RNA, 19 nt, Homo sapiens
caaggucuagcaaauauaa

SEQ ID NO: 352876 - RNA, 19 nt, Homo sapiens
cuaaagcaguuacagaaau

SEQ ID NO: 352877 - RNA, 19 nt, Homo sapiens
gaacggcagacggaacuua

SEQ ID NO: 352878 - RNA, 19 nt, Homo sapiens
caaaagaguuccccaaugu

SEQ ID NO: 352879 - RNA, 19 nt, Homo sapiens
gcucgagucuccagaguca

SEQ ID NO: 352880 - RNA, 19 nt, Homo sapiens
aguccuagauuacuuauug

SEQ ID NO: 352881 - RNA, 19 nt, Homo sapiens
uaagguugaugaagcugua

SEQ ID NO: 352882 - RNA, 19 nt, Homo sapiens
cuaaagaggcuacccagaa

SEQ ID NO: 352883 - RNA, 19 nt, Homo sapiens
uaaauaugcugcgggaguu

SEQ ID NO: 352884 - RNA, 19 nt, Homo sapiens
gcuccuaaauggucgcaaa

SEQ ID NO: 352885 - RNA, 19 nt, Homo sapiens
guaacagaauugauaacug

SEQ ID NO: 352886 - RNA, 19 nt, Homo sapiens
gcgcacauuugaacagaug

SEQ ID NO: 352887 - RNA, 19 nt, Homo sapiens
acacgaagcagcugaaaga

SEQ ID NO: 352888 - RNA, 19 nt, Homo sapiens
ccagaaagcaguuaacagu

SEQ ID NO: 352889 - RNA, 19 nt, Homo sapiens
gcauguuguuggagauuga

SEQ ID NO: 352890 - RNA, 19 nt, Homo sapiens
gcucuuuccucuuauucaa

SEQ ID NO: 352891 - RNA, 19 nt, Homo sapiens
gcagagaauggcaagugua

SEQ ID NO: 352892 - RNA, 19 nt, Homo sapiens
gaaaguaaugaccgaugaa

SEQ ID NO: 352893 - RNA, 19 nt, Homo sapiens
gcaaaagaguuccccaaug

SEQ ID NO: 352894 - RNA, 19 nt, Homo sapiens
acgagaagcugaacuugga

SEQ ID NO: 352895 - RNA, 19 nt, Homo sapiens
uaaauggucgcaaaguauu

SEQ ID NO: 352896 - RNA, 19 nt, Homo sapiens
cguguaacgugguuuguga

SEQ ID NO: 352897 - RNA, 19 nt, Homo sapiens
uguuggagauugauaauuc

SEQ ID NO: 352898 - RNA, 19 nt, Homo sapiens
ugccagaccucauccauuc

SEQ ID NO: 352899 - RNA, 19 nt, Homo sapiens
agaaaugaacgguagaauu

SEQ ID NO: 352900 - RNA, 19 nt, Homo sapiens
ugcaaggucuagcaaauau

SEQ ID NO: 352901 - RNA, 19 nt, Homo sapiens
ccucauccauuccaaaaua

SEQ ID NO: 352902 - RNA, 19 nt, Homo sapiens
gagaauggcaaguguacga

SEQ ID NO: 352903 - RNA, 19 nt, Homo sapiens
gaacgagaagcugaacuug

SEQ ID NO: 352904 - RNA, 19 nt, Homo sapiens
gcaaggucuagcaaauaua

SEQ ID NO: 352905 - RNA, 19 nt, Homo sapiens
gcacgguuccacgguauaa

SEQ ID NO: 352906 - RNA, 19 nt, Homo sapiens
uugaacagaugaagcaaga

SEQ ID NO: 352907 - RNA, 19 nt, Homo sapiens
guaacgugguuugugauga

SEQ ID NO: 352908 - RNA, 19 nt, Homo sapiens
gcaaaugcaaggucuagca

SEQ ID NO: 352909 - RNA, 19 nt, Homo sapiens
ucacuggcauguuguugga

SEQ ID NO: 352910 - RNA, 19 nt, Homo sapiens
ugacugaggcgaugcucua

SEQ ID NO: 352911 - RNA, 19 nt, Homo sapiens
cuaaauggucgcaaaguau

SEQ ID NO: 352912 - RNA, 19 nt, Homo sapiens
gcucuggacaccaugaauu

SEQ ID NO: 352913 - RNA, 19 nt, Homo sapiens
ccuagaguaccauuuagua

SEQ ID NO: 352914 - RNA, 19 nt, Homo sapiens
ugaugaacgucuccggaaa

SEQ ID NO: 352915 - RNA, 19 nt, Homo sapiens
cccaggugcuccuagagua

SEQ ID NO: 352916 - RNA, 19 nt, Homo sapiens
ccacuaaagcaguuacaga

SEQ ID NO: 352917 - RNA, 19 nt, Homo sapiens
ggauuuguaagcuuugaaa

SEQ ID NO: 352918 - RNA, 19 nt, Homo sapiens
caacuacgcguaugugaac

SEQ ID NO: 352919 - RNA, 19 nt, Homo sapiens
caaaauaagcccagugcua

SEQ ID NO: 352920 - RNA, 19 nt, Homo sapiens
uaacgaguauaugcagaga

SEQ ID NO: 352921 - RNA, 19 nt, Homo sapiens
aggcuuaccucacuaacga

SEQ ID NO: 352922 - RNA, 19 nt, Homo sapiens
ggagaagacauggaugaug

SEQ ID NO: 352923 - RNA, 19 nt, Homo sapiens
cuaaacaucgagaaacuau

SEQ ID NO: 352924 - RNA, 19 nt, Homo sapiens
uacaaggucaggaaacuuu

SEQ ID NO: 352925 - RNA, 19 nt, Homo sapiens
gcgcacgguuccacgguau

SEQ ID NO: 352926 - RNA, 19 nt, Homo sapiens
agaagaagccacuaaagca

SEQ ID NO: 352927 - RNA, 19 nt, Homo sapiens
guagaugagaugaauggaa

SEQ ID NO: 352928 - RNA, 19 nt, Homo sapiens
uaaagaacgagaagcugaa

SEQ ID NO: 352929 - RNA, 19 nt, Homo sapiens
uuaccucacuaacgaguau

SEQ ID NO: 352930 - RNA, 19 nt, Homo sapiens
ggaacuuaagcgcacauuu

SEQ ID NO: 352931 - RNA, 19 nt, Homo sapiens
gugggcaacauauucguua

SEQ ID NO: 352932 - RNA, 19 nt, Homo sapiens
uagccaaauugcucgacua

SEQ ID NO: 352933 - RNA, 19 nt, Homo sapiens
acgaguauaugcagagaau

SEQ ID NO: 352934 - RNA, 19 nt, Homo sapiens
agaagccacuaaagcaguu

SEQ ID NO: 352935 - RNA, 19 nt, Homo sapiens
ccagguuguuaaucuuuau

SEQ ID NO: 352936 - RNA, 19 nt, Homo sapiens
agaaagcuguagaugagau

SEQ ID NO: 352937 - RNA, 19 nt, Homo sapiens
ggacaauuuaagucucgua

SEQ ID NO: 352938 - RNA, 19 nt, Homo sapiens
gcugaaagagcuauuaaaa

SEQ ID NO: 352939 - RNA, 19 nt, Homo sapiens
aaugcaaggucuagcaaau

SEQ ID NO: 352940 - RNA, 19 nt, Homo sapiens
cuacaagcccaccaagcua

SEQ ID NO: 352941 - RNA, 19 nt, Homo sapiens
gccaugcacccuacucuug

SEQ ID NO: 352942 - RNA, 19 nt, Homo sapiens
gcacagccacaaguuacaa

SEQ ID NO: 352943 - RNA, 19 nt, Homo sapiens
guuccacgguauaaauaug

SEQ ID NO: 352944 - RNA, 19 nt, Homo sapiens
uaacacaucaacacagaca

SEQ ID NO: 352945 - RNA, 19 nt, Homo sapiens
gggcaacauauucguuaaa

SEQ ID NO: 352946 - RNA, 19 nt, Homo sapiens
gaagguggucgcagcaaag

SEQ ID NO: 352947 - RNA, 19 nt, Homo sapiens
gauuuggauuuguaagcuu

SEQ ID NO: 352948 - RNA, 19 nt, Homo sapiens
gacaauuuaagucucguaa

SEQ ID NO: 352949 - RNA, 19 nt, Homo sapiens
gaucagagaccacgaaaag

SEQ ID NO: 352950 - RNA, 19 nt, Homo sapiens
gagauaauguuagagguuu

SEQ ID NO: 352951 - RNA, 19 nt, Homo sapiens
gauuaaacgugcagacuau

SEQ ID NO: 352952 - RNA, 19 nt, Homo sapiens
ggacuaaacgggacgugua

SEQ ID NO: 352953 - RNA, 19 nt, Homo sapiens
ggacuuggcaggcaauuau

SEQ ID NO: 352954 - RNA, 19 nt, Homo sapiens
gcagauggguuuaaugacu

SEQ ID NO: 352955 - RNA, 19 nt, Homo sapiens
gggcugggcuccaucuuug

SEQ ID NO: 352956 - RNA, 19 nt, Homo sapiens
cagcugcgcucuggcuuua

SEQ ID NO: 352957 - RNA, 19 nt, Homo sapiens
acacacagaugaaugacaa

SEQ ID NO: 352958 - RNA, 19 nt, Homo sapiens
gaggaccgccuuuaucaaa

SEQ ID NO: 352959 - RNA, 19 nt, Homo sapiens
gagaggaccgccuuuauca

SEQ ID NO: 352960 - RNA, 19 nt, Homo sapiens
gcauugcugguucuauuua

SEQ ID NO: 352961 - RNA, 19 nt, Homo sapiens
gcaaagcgacggacuaaac

SEQ ID NO: 352962 - RNA, 19 nt, Homo sapiens
ggaagugcaucaucgacau

SEQ ID NO: 352963 - RNA, 19 nt, Homo sapiens
ugacaucuguguuucaagu

SEQ ID NO: 352964 - RNA, 19 nt, Homo sapiens
gcauguugcugaggaguga

SEQ ID NO: 352965 - RNA, 19 nt, Homo sapiens
gaagccagcccaccucaau

SEQ ID NO: 352966 - RNA, 19 nt, Homo sapiens
gaacaugacagcugcaacu

SEQ ID NO: 352967 - RNA, 19 nt, Homo sapiens
uaauggacaugagauaaug

SEQ ID NO: 352968 - RNA, 19 nt, Homo sapiens
cagcgaagccaacaacuau

SEQ ID NO: 352969 - RNA, 19 nt, Homo sapiens
ccaauaagaaccucacaug

SEQ ID NO: 352970 - RNA, 19 nt, Homo sapiens
ccaaccacauccacaucua

SEQ ID NO: 352971 - RNA, 19 nt, Homo sapiens
gaagaaccacccggacuug

SEQ ID NO: 352972 - RNA, 19 nt, Homo sapiens
gcugacaucuguguuucaa

SEQ ID NO: 352973 - RNA, 19 nt, Homo sapiens
ggagcuggauggugaaggu

SEQ ID NO: 352974 - RNA, 19 nt, Homo sapiens
gcgaguggguccuagagau

SEQ ID NO: 352975 - RNA, 19 nt, Homo sapiens
gcaguggcaaccagaauga

SEQ ID NO: 352976 - RNA, 19 nt, Homo sapiens
ccaagucccuguuuucuga

SEQ ID NO: 352977 - RNA, 19 nt, Homo sapiens
uuaaacaggcccagcauug

SEQ ID NO: 352978 - RNA, 19 nt, Homo sapiens
uuuagaugcugaugauuug

SEQ ID NO: 352979 - RNA, 19 nt, Homo sapiens
gcuguuugaggauauauuu

SEQ ID NO: 352980 - RNA, 19 nt, Homo sapiens
ccgcagauggguuuaauga

SEQ ID NO: 352981 - RNA, 19 nt, Homo sapiens
ggcucacccuguccuauaa

SEQ ID NO: 352982 - RNA, 19 nt, Homo sapiens
gguacacacagaugaauga

SEQ ID NO: 352983 - RNA, 19 nt, Homo sapiens
gcccuucccugucccucua

SEQ ID NO: 352984 - RNA, 19 nt, Homo sapiens
ucauauggcuacgggcuuu

SEQ ID NO: 352985 - RNA, 19 nt, Homo sapiens
cagcuggacuacccacguu

SEQ ID NO: 352986 - RNA, 19 nt, Homo sapiens
cagcgggaccugaauguga

SEQ ID NO: 352987 - RNA, 19 nt, Homo sapiens
gcugaggagugaggaauag

SEQ ID NO: 352988 - RNA, 19 nt, Homo sapiens
gcgagaggaccgccuuuau

SEQ ID NO: 352989 - RNA, 19 nt, Homo sapiens
ugacugggccuucaugaca

SEQ ID NO: 352990 - RNA, 19 nt, Homo sapiens
gcccaaagacaucgggaaa

SEQ ID NO: 352991 - RNA, 19 nt, Homo sapiens
guaccugucuggugucacu

SEQ ID NO: 352992 - RNA, 19 nt, Homo sapiens
gaggagugaggaauaguug

SEQ ID NO: 352993 - RNA, 19 nt, Homo sapiens
gcccguaccuccagaaagc

SEQ ID NO: 352994 - RNA, 19 nt, Homo sapiens
ccaaagacaucgggaaacg

SEQ ID NO: 352995 - RNA, 19 nt, Homo sapiens
cgacugacuugcggcagaa

SEQ ID NO: 352996 - RNA, 19 nt, Homo sapiens
cauugcugguucuauuuaa

SEQ ID NO: 352997 - RNA, 19 nt, Homo sapiens
gggcuggccuaggagauau

SEQ ID NO: 352998 - RNA, 19 nt, Homo sapiens
gcauuguggucuccauucu

SEQ ID NO: 352999 - RNA, 19 nt, Homo sapiens
agaaugacguggagaccau

SEQ ID NO: 353000 - RNA, 19 nt, Homo sapiens
ccagcgaagccaacaacua

SEQ ID NO: 353001 - RNA, 19 nt, Homo sapiens
ugauuaaacgugcagacua

SEQ ID NO: 353002 - RNA, 19 nt, Homo sapiens
ggcggcagcagccaucaua

SEQ ID NO: 353003 - RNA, 19 nt, Homo sapiens
gacugggccuucaugacaa

SEQ ID NO: 353004 - RNA, 19 nt, Homo sapiens
cagcagcgccacgcaguuu

SEQ ID NO: 353005 - RNA, 19 nt, Homo sapiens
agaugcugaugauuuguuu

SEQ ID NO: 353006 - RNA, 19 nt, Homo sapiens
gcagcagccaucauaggaa

SEQ ID NO: 353007 - RNA, 19 nt, Homo sapiens
cgagaggaccgccuuuauc

SEQ ID NO: 353008 - RNA, 19 nt, Homo sapiens
cggcucacccuguccuaua

SEQ ID NO: 353009 - RNA, 19 nt, Homo sapiens
gcaaccagaaugagaagca

SEQ ID NO: 353010 - RNA, 19 nt, Homo sapiens
caacggugucuguggugua

SEQ ID NO: 353011 - RNA, 19 nt, Homo sapiens
ggaguccccuuuucuuuuc

SEQ ID NO: 353012 - RNA, 19 nt, Homo sapiens
cagaguuccugcggaguga

SEQ ID NO: 353013 - RNA, 19 nt, Homo sapiens
ugagauaauguuagagguu

SEQ ID NO: 353014 - RNA, 19 nt, Homo sapiens
cacuuuagaugcugaugau

SEQ ID NO: 353015 - RNA, 19 nt, Homo sapiens
gcagcugcgcucuggcuuu

SEQ ID NO: 353016 - RNA, 19 nt, Homo sapiens
cgaguggguccuagagauu

SEQ ID NO: 353017 - RNA, 19 nt, Homo sapiens
gcccuugcuuguugggauu

SEQ ID NO: 353018 - RNA, 19 nt, Homo sapiens
caaguucacccucguacuc

SEQ ID NO: 353019 - RNA, 19 nt, Homo sapiens
cuacuccgcagauggguuu

SEQ ID NO: 353020 - RNA, 19 nt, Homo sapiens
cuuagcagccggcaucauu

SEQ ID NO: 353021 - RNA, 19 nt, Homo sapiens
cuuuagaugcugaugauuu

SEQ ID NO: 353022 - RNA, 19 nt, Homo sapiens
ucaccgagcccaaagacau

SEQ ID NO: 353023 - RNA, 19 nt, Homo sapiens
cagccucgguacacacaga

SEQ ID NO: 353024 - RNA, 19 nt, Homo sapiens
guuagagguuuuaaaguga

SEQ ID NO: 353025 - RNA, 19 nt, Homo sapiens
ggcagcagccaucauagga

SEQ ID NO: 353026 - RNA, 19 nt, Homo sapiens
gcugcgcucuggcuuuagu

SEQ ID NO: 353027 - RNA, 19 nt, Homo sapiens
cuacacagggcacggcauu

SEQ ID NO: 353028 - RNA, 19 nt, Homo sapiens
uggaacagcagguggcaaa

SEQ ID NO: 353029 - RNA, 19 nt, Homo sapiens
gaccaaguucacccucgua

SEQ ID NO: 353030 - RNA, 19 nt, Homo sapiens
augggacgcugaccaaguu

SEQ ID NO: 353031 - RNA, 19 nt, Homo sapiens
uggcaaagcgacggacuaa

SEQ ID NO: 353032 - RNA, 19 nt, Homo sapiens
cugaggcccugguugcuau

SEQ ID NO: 353033 - RNA, 19 nt, Homo sapiens
ggagugaggaauaguugag

SEQ ID NO: 353034 - RNA, 19 nt, Homo sapiens
gcgaagccaacaacuaugg

SEQ ID NO: 353035 - RNA, 19 nt, Homo sapiens
gggccuucaugacaacuca

SEQ ID NO: 353036 - RNA, 19 nt, Homo sapiens
ccacacuggccacgaccua

SEQ ID NO: 353037 - RNA, 19 nt, Homo sapiens
gcugaggcccugguugcua

SEQ ID NO: 353038 - RNA, 19 nt, Homo sapiens
gcacuauagcaccgagaau

SEQ ID NO: 353039 - RNA, 19 nt, Homo sapiens
agaagaaccacccggacuu

SEQ ID NO: 353040 - RNA, 19 nt, Homo sapiens
gaagugcaucaucgacauc

SEQ ID NO: 353041 - RNA, 19 nt, Homo sapiens
gaguggguccuagagauug

SEQ ID NO: 353042 - RNA, 19 nt, Homo sapiens
cagccaggccacaugacua

SEQ ID NO: 353043 - RNA, 19 nt, Homo sapiens
ccacauccacaucuacagu

SEQ ID NO: 353044 - RNA, 19 nt, Homo sapiens
caggcugacaucuguguuu

SEQ ID NO: 353045 - RNA, 19 nt, Homo sapiens
gaacagcagguggcaaagc

SEQ ID NO: 353046 - RNA, 19 nt, Homo sapiens
acugugcccugguggagaa

SEQ ID NO: 353047 - RNA, 19 nt, Homo sapiens
ucacuuuagaugcugauga

SEQ ID NO: 353048 - RNA, 19 nt, Homo sapiens
acuauagcaccgagaauga

SEQ ID NO: 353049 - RNA, 19 nt, Homo sapiens
ggccaacaacggugucugu

SEQ ID NO: 353050 - RNA, 19 nt, Homo sapiens
ggaaguaacauuugccuua

SEQ ID NO: 353051 - RNA, 19 nt, Homo sapiens
gaaauguacugucuguaaa

SEQ ID NO: 353052 - RNA, 19 nt, Homo sapiens
gaacccagauguuguuuau

SEQ ID NO: 353053 - RNA, 19 nt, Homo sapiens
ccaacuacaucgacauuua

SEQ ID NO: 353054 - RNA, 19 nt, Homo sapiens
gaaguaacauuugccuuaa

SEQ ID NO: 353055 - RNA, 19 nt, Homo sapiens
gaccauaaguuuacugaau

SEQ ID NO: 353056 - RNA, 19 nt, Homo sapiens
ugaagcaaguacaauguua

SEQ ID NO: 353057 - RNA, 19 nt, Homo sapiens
gaauagggaaguaacauuu

SEQ ID NO: 353058 - RNA, 19 nt, Homo sapiens
gaaagaauggagccucaua

SEQ ID NO: 353059 - RNA, 19 nt, Homo sapiens
ugacacaguuggauuuauu

SEQ ID NO: 353060 - RNA, 19 nt, Homo sapiens
uuggaaaccuggaagauua

SEQ ID NO: 353061 - RNA, 19 nt, Homo sapiens
gaauggagccucauacugu

SEQ ID NO: 353062 - RNA, 19 nt, Homo sapiens
ugaaauggcuccagcaaca

SEQ ID NO: 353063 - RNA, 19 nt, Homo sapiens
caagggaaguugaaagaau

SEQ ID NO: 353064 - RNA, 19 nt, Homo sapiens
ggaugaaccugagaaaugu

SEQ ID NO: 353065 - RNA, 19 nt, Homo sapiens
ccgcagcgcucuccuuuga

SEQ ID NO: 353066 - RNA, 19 nt, Homo sapiens
ggugauauccucucaaaug

SEQ ID NO: 353067 - RNA, 19 nt, Homo sapiens
gaagcaaacagccaguuaa

SEQ ID NO: 353068 - RNA, 19 nt, Homo sapiens
ggacggcgaugucacagau

SEQ ID NO: 353069 - RNA, 19 nt, Homo sapiens
ggagagaacccagauguug

SEQ ID NO: 353070 - RNA, 19 nt, Homo sapiens
gaccucgucuuucuccaua

SEQ ID NO: 353071 - RNA, 19 nt, Homo sapiens
ccacagcucuggcuuugga

SEQ ID NO: 353072 - RNA, 19 nt, Homo sapiens
gcaccuacuuugacucaga

SEQ ID NO: 353073 - RNA, 19 nt, Homo sapiens
gaagcaaguacaauguuaa

SEQ ID NO: 353074 - RNA, 19 nt, Homo sapiens
gaaaugcacagaucugcuu

SEQ ID NO: 353075 - RNA, 19 nt, Homo sapiens
gcuccagucuuccgacaaa

SEQ ID NO: 353076 - RNA, 19 nt, Homo sapiens
gaacggcaaugauuaugac

SEQ ID NO: 353077 - RNA, 19 nt, Homo sapiens
gcgagcgacuggaaaguga

SEQ ID NO: 353078 - RNA, 19 nt, Homo sapiens
guacaauguuaacccuaaa

SEQ ID NO: 353079 - RNA, 19 nt, Homo sapiens
agaaauguacugucuguaa

SEQ ID NO: 353080 - RNA, 19 nt, Homo sapiens
gauaugaugccagcaauga

SEQ ID NO: 353081 - RNA, 19 nt, Homo sapiens
ccucacaccuuccucagaa

SEQ ID NO: 353082 - RNA, 19 nt, Homo sapiens
ccaaaccuguguaggcauu

SEQ ID NO: 353083 - RNA, 19 nt, Homo sapiens
gugccuagcugcccacaga

SEQ ID NO: 353084 - RNA, 19 nt, Homo sapiens
ugacccaucuccacgauau

SEQ ID NO: 353085 - RNA, 19 nt, Homo sapiens
acccagauguuguuuauug

SEQ ID NO: 353086 - RNA, 19 nt, Homo sapiens
ugagaaauguacugucugu

SEQ ID NO: 353087 - RNA, 19 nt, Homo sapiens
ccaaugaaggguuuacaaa

SEQ ID NO: 353088 - RNA, 19 nt, Homo sapiens
caaagagguugcuggaucu

SEQ ID NO: 353089 - RNA, 19 nt, Homo sapiens
gguggaaacuccugugucu

SEQ ID NO: 353090 - RNA, 19 nt, Homo sapiens
agaaaucaaugaagcaagu

SEQ ID NO: 353091 - RNA, 19 nt, Homo sapiens
gaaagagaaaucaaugaag

SEQ ID NO: 353092 - RNA, 19 nt, Homo sapiens
ggucagacuauaaauaaga

SEQ ID NO: 353093 - RNA, 19 nt, Homo sapiens
gucauaaaguuagccauuu

SEQ ID NO: 353094 - RNA, 19 nt, Homo sapiens
ggucauaaaguuagccauu

SEQ ID NO: 353095 - RNA, 19 nt, Homo sapiens
aagccgagcucuccuuguu

SEQ ID NO: 353096 - RNA, 19 nt, Homo sapiens
caacaggaagugaaacgaa

SEQ ID NO: 353097 - RNA, 19 nt, Homo sapiens
aaacuccugugucugugua

SEQ ID NO: 353098 - RNA, 19 nt, Homo sapiens
gaaaggcgcuuggcaucac

SEQ ID NO: 353099 - RNA, 19 nt, Homo sapiens
gaaagcgagcgacuggaaa

SEQ ID NO: 353100 - RNA, 19 nt, Homo sapiens
agccagccaugcauuguua

SEQ ID NO: 353101 - RNA, 19 nt, Homo sapiens
cugaagaugaggaagauua

SEQ ID NO: 353102 - RNA, 19 nt, Homo sapiens
ucauaaaguuagccauuuc

SEQ ID NO: 353103 - RNA, 19 nt, Homo sapiens
ggacgcagaagcucucguu

SEQ ID NO: 353104 - RNA, 19 nt, Homo sapiens
aaaguuagccauuucuaug

SEQ ID NO: 353105 - RNA, 19 nt, Homo sapiens
gaaaucaaugaagcaagua

SEQ ID NO: 353106 - RNA, 19 nt, Homo sapiens
gccaagcaauuccucugaa

SEQ ID NO: 353107 - RNA, 19 nt, Homo sapiens
cgcagaagcucucguugug

SEQ ID NO: 353108 - RNA, 19 nt, Homo sapiens
caaugaagcaaguacaaug

SEQ ID NO: 353109 - RNA, 19 nt, Homo sapiens
gaccaaagcagaaaagaaa

SEQ ID NO: 353110 - RNA, 19 nt, Homo sapiens
cccaggcucugcuaauauu

SEQ ID NO: 353111 - RNA, 19 nt, Homo sapiens
gcaaacagccaguuaaccu

SEQ ID NO: 353112 - RNA, 19 nt, Homo sapiens
gagagaacccagauguugu

SEQ ID NO: 353113 - RNA, 19 nt, Homo sapiens
ggugggugguggcucuuaa

SEQ ID NO: 353114 - RNA, 19 nt, Homo sapiens
aauggagccucauacugua

SEQ ID NO: 353115 - RNA, 19 nt, Homo sapiens
gagaagcaagggaaguuga

SEQ ID NO: 353116 - RNA, 19 nt, Homo sapiens
agagacaggugcgaaguga

SEQ ID NO: 353117 - RNA, 19 nt, Homo sapiens
gacgugaacggcaaugauu

SEQ ID NO: 353118 - RNA, 19 nt, Homo sapiens
gaugauggcauagagagaa

SEQ ID NO: 353119 - RNA, 19 nt, Homo sapiens
aguacaauguuaacccuaa

SEQ ID NO: 353120 - RNA, 19 nt, Homo sapiens
uggaugaaccugagaaaug

SEQ ID NO: 353121 - RNA, 19 nt, Homo sapiens
guaaagccagccaugcauu

SEQ ID NO: 353122 - RNA, 19 nt, Homo sapiens
gccggaguaucuauuucua

SEQ ID NO: 353123 - RNA, 19 nt, Homo sapiens
gcucguugccugccacuga

SEQ ID NO: 353124 - RNA, 19 nt, Homo sapiens
gcgagauggugaaguccaa

SEQ ID NO: 353125 - RNA, 19 nt, Homo sapiens
aagggaaguugaaagaaug

SEQ ID NO: 353126 - RNA, 19 nt, Homo sapiens
agaagcaaacagccaguua

SEQ ID NO: 353127 - RNA, 19 nt, Homo sapiens
cagauguggucgaggcaaa

SEQ ID NO: 353128 - RNA, 19 nt, Homo sapiens
cggaguaucuauuucuaca

SEQ ID NO: 353129 - RNA, 19 nt, Homo sapiens
ucucaaaugcugcuuguug

SEQ ID NO: 353130 - RNA, 19 nt, Homo sapiens
gcaagggaaguugaaagaa

SEQ ID NO: 353131 - RNA, 19 nt, Homo sapiens
agucucaacuucuggcaaa

SEQ ID NO: 353132 - RNA, 19 nt, Homo sapiens
caaagucgcugggcaucag

SEQ ID NO: 353133 - RNA, 19 nt, Homo sapiens
uagaaaguccaauuccaaa

SEQ ID NO: 353134 - RNA, 19 nt, Homo sapiens
ccugagaaauguacugucu

SEQ ID NO: 353135 - RNA, 19 nt, Homo sapiens
gcagaccagugcuugaacu

SEQ ID NO: 353136 - RNA, 19 nt, Homo sapiens
gaagcaagggaaguugaaa

SEQ ID NO: 353137 - RNA, 19 nt, Homo sapiens
gaaacgaagggugaagaga

SEQ ID NO: 353138 - RNA, 19 nt, Homo sapiens
caucagacccaacuacauc

SEQ ID NO: 353139 - RNA, 19 nt, Homo sapiens
caucacacaucacucuucu

SEQ ID NO: 353140 - RNA, 19 nt, Homo sapiens
gcaccugacagcuuuaucu

SEQ ID NO: 353141 - RNA, 19 nt, Homo sapiens
gaagauuacacagcucaau

SEQ ID NO: 353142 - RNA, 19 nt, Homo sapiens
ccugugagcuggagagaac

SEQ ID NO: 353143 - RNA, 19 nt, Homo sapiens
ccucgucuuucuccauauu

SEQ ID NO: 353144 - RNA, 19 nt, Homo sapiens
gaaaguccaauuccaaagc

SEQ ID NO: 353145 - RNA, 19 nt, Homo sapiens
cuacauagucagcuacuuc

SEQ ID NO: 353146 - RNA, 19 nt, Homo sapiens
gcagagaagagugcauuca

SEQ ID NO: 353147 - RNA, 19 nt, Homo sapiens
gagccaggcaccuacuuug

SEQ ID NO: 353148 - RNA, 19 nt, Homo sapiens
gcaggaagugcgugagugu

SEQ ID NO: 353149 - RNA, 19 nt, Homo sapiens
gcaguggaccuuggaaauc

SEQ ID NO: 353150 - RNA, 19 nt, Homo sapiens
ggaaguaacauuugccuua

SEQ ID NO: 353151 - RNA, 19 nt, Homo sapiens
gaaauguacugucuguaaa

SEQ ID NO: 353152 - RNA, 19 nt, Homo sapiens
gaacccagauguuguuuau

SEQ ID NO: 353153 - RNA, 19 nt, Homo sapiens
ccaacuacaucgacauuua

SEQ ID NO: 353154 - RNA, 19 nt, Homo sapiens
gaaguaacauuugccuuaa

SEQ ID NO: 353155 - RNA, 19 nt, Homo sapiens
gaccauaaguuuacugaau

SEQ ID NO: 353156 - RNA, 19 nt, Homo sapiens
ugaagcaaguacaauguua

SEQ ID NO: 353157 - RNA, 19 nt, Homo sapiens
gaauagggaaguaacauuu

SEQ ID NO: 353158 - RNA, 19 nt, Homo sapiens
gaaagaauggagccucaua

SEQ ID NO: 353159 - RNA, 19 nt, Homo sapiens
ugacacaguuggauuuauu

SEQ ID NO: 353160 - RNA, 19 nt, Homo sapiens
uuggaaaccuggaagauua

SEQ ID NO: 353161 - RNA, 19 nt, Homo sapiens
gaauggagccucauacugu

SEQ ID NO: 353162 - RNA, 19 nt, Homo sapiens
ugaaauggcuccagcaaca

SEQ ID NO: 353163 - RNA, 19 nt, Homo sapiens
caagggaaguugaaagaau

SEQ ID NO: 353164 - RNA, 19 nt, Homo sapiens
ggaugaaccugagaaaugu

SEQ ID NO: 353165 - RNA, 19 nt, Homo sapiens
ccgcagcgcucuccuuuga

SEQ ID NO: 353166 - RNA, 19 nt, Homo sapiens
ggugauauccucucaaaug

SEQ ID NO: 353167 - RNA, 19 nt, Homo sapiens
gaagcaaacagccaguuaa

SEQ ID NO: 353168 - RNA, 19 nt, Homo sapiens
ggacggcgaugucacagau

SEQ ID NO: 353169 - RNA, 19 nt, Homo sapiens
ggagagaacccagauguug

SEQ ID NO: 353170 - RNA, 19 nt, Homo sapiens
gaccucgucuuucuccaua

SEQ ID NO: 353171 - RNA, 19 nt, Homo sapiens
ccacagcucuggcuuugga

SEQ ID NO: 353172 - RNA, 19 nt, Homo sapiens
gcaccuacuuugacucaga

SEQ ID NO: 353173 - RNA, 19 nt, Homo sapiens
gaagcaaguacaauguuaa

SEQ ID NO: 353174 - RNA, 19 nt, Homo sapiens
gaaaugcacagaucugcuu

SEQ ID NO: 353175 - RNA, 19 nt, Homo sapiens
gcuccagucuuccgacaaa

SEQ ID NO: 353176 - RNA, 19 nt, Homo sapiens
gaacggcaaugauuaugac

SEQ ID NO: 353177 - RNA, 19 nt, Homo sapiens
gcgagcgacuggaaaguga

SEQ ID NO: 353178 - RNA, 19 nt, Homo sapiens
guacaauguuaacccuaaa

SEQ ID NO: 353179 - RNA, 19 nt, Homo sapiens
agaaauguacugucuguaa

SEQ ID NO: 353180 - RNA, 19 nt, Homo sapiens
gauaugaugccagcaauga

SEQ ID NO: 353181 - RNA, 19 nt, Homo sapiens
ccucacaccuuccucagaa

SEQ ID NO: 353182 - RNA, 19 nt, Homo sapiens
ccaaaccuguguaggcauu

SEQ ID NO: 353183 - RNA, 19 nt, Homo sapiens
gugccuagcugcccacaga

SEQ ID NO: 353184 - RNA, 19 nt, Homo sapiens
ugacccaucuccacgauau

SEQ ID NO: 353185 - RNA, 19 nt, Homo sapiens
acccagauguuguuuauug

SEQ ID NO: 353186 - RNA, 19 nt, Homo sapiens
ugagaaauguacugucugu

SEQ ID NO: 353187 - RNA, 19 nt, Homo sapiens
ccaaugaaggguuuacaaa

SEQ ID NO: 353188 - RNA, 19 nt, Homo sapiens
caaagagguugcuggaucu

SEQ ID NO: 353189 - RNA, 19 nt, Homo sapiens
gguggaaacuccugugucu

SEQ ID NO: 353190 - RNA, 19 nt, Homo sapiens
agaaaucaaugaagcaagu

SEQ ID NO: 353191 - RNA, 19 nt, Homo sapiens
gaaagagaaaucaaugaag

SEQ ID NO: 353192 - RNA, 19 nt, Homo sapiens
ggucagacuauaaauaaga

SEQ ID NO: 353193 - RNA, 19 nt, Homo sapiens
gucauaaaguuagccauuu

SEQ ID NO: 353194 - RNA, 19 nt, Homo sapiens
ggucauaaaguuagccauu

SEQ ID NO: 353195 - RNA, 19 nt, Homo sapiens
aagccgagcucuccuuguu

SEQ ID NO: 353196 - RNA, 19 nt, Homo sapiens
caacaggaagugaaacgaa

SEQ ID NO: 353197 - RNA, 19 nt, Homo sapiens
aaacuccugugucugugua

SEQ ID NO: 353198 - RNA, 19 nt, Homo sapiens
gaaaggcgcuuggcaucac

SEQ ID NO: 353199 - RNA, 19 nt, Homo sapiens
gaaagcgagcgacuggaaa

SEQ ID NO: 353200 - RNA, 19 nt, Homo sapiens
agccagccaugcauuguua

SEQ ID NO: 353201 - RNA, 19 nt, Homo sapiens
cugaagaugaggaagauua

SEQ ID NO: 353202 - RNA, 19 nt, Homo sapiens
ucauaaaguuagccauuuc

SEQ ID NO: 353203 - RNA, 19 nt, Homo sapiens
ggacgcagaagcucucguu

SEQ ID NO: 353204 - RNA, 19 nt, Homo sapiens
aaaguuagccauuucuaug

SEQ ID NO: 353205 - RNA, 19 nt, Homo sapiens
gaaaucaaugaagcaagua

SEQ ID NO: 353206 - RNA, 19 nt, Homo sapiens
gccaagcaauuccucugaa

SEQ ID NO: 353207 - RNA, 19 nt, Homo sapiens
cgcagaagcucucguugug

SEQ ID NO: 353208 - RNA, 19 nt, Homo sapiens
caaugaagcaaguacaaug

SEQ ID NO: 353209 - RNA, 19 nt, Homo sapiens
gaccaaagcagaaaagaaa

SEQ ID NO: 353210 - RNA, 19 nt, Homo sapiens
gcaaacagccaguuaaccu

SEQ ID NO: 353211 - RNA, 19 nt, Homo sapiens
gagagaacccagauguugu

SEQ ID NO: 353212 - RNA, 19 nt, Homo sapiens
agagacaggugcgaaguga

SEQ ID NO: 353213 - RNA, 19 nt, Homo sapiens
ggugggugguggcucuuaa

SEQ ID NO: 353214 - RNA, 19 nt, Homo sapiens
aauggagccucauacugua

SEQ ID NO: 353215 - RNA, 19 nt, Homo sapiens
gagaagcaagggaaguuga

SEQ ID NO: 353216 - RNA, 19 nt, Homo sapiens
gacgugaacggcaaugauu

SEQ ID NO: 353217 - RNA, 19 nt, Homo sapiens
gaugauggcauagagagaa

SEQ ID NO: 353218 - RNA, 19 nt, Homo sapiens
aguacaauguuaacccuaa

SEQ ID NO: 353219 - RNA, 19 nt, Homo sapiens
uggaugaaccugagaaaug

SEQ ID NO: 353220 - RNA, 19 nt, Homo sapiens
guaaagccagccaugcauu

SEQ ID NO: 353221 - RNA, 19 nt, Homo sapiens
gccggaguaucuauuucua

SEQ ID NO: 353222 - RNA, 19 nt, Homo sapiens
gcucguugccugccacuga

SEQ ID NO: 353223 - RNA, 19 nt, Homo sapiens
gcgagauggugaaguccaa

SEQ ID NO: 353224 - RNA, 19 nt, Homo sapiens
aagggaaguugaaagaaug

SEQ ID NO: 353225 - RNA, 19 nt, Homo sapiens
agaagcaaacagccaguua

SEQ ID NO: 353226 - RNA, 19 nt, Homo sapiens
cagauguggucgaggcaaa

SEQ ID NO: 353227 - RNA, 19 nt, Homo sapiens
cggaguaucuauuucuaca

SEQ ID NO: 353228 - RNA, 19 nt, Homo sapiens
ucucaaaugcugcuuguug

SEQ ID NO: 353229 - RNA, 19 nt, Homo sapiens
gcaagggaaguugaaagaa

SEQ ID NO: 353230 - RNA, 19 nt, Homo sapiens
agucucaacuucuggcaaa

SEQ ID NO: 353231 - RNA, 19 nt, Homo sapiens
caaagucgcugggcaucag

SEQ ID NO: 353232 - RNA, 19 nt, Homo sapiens
uagaaaguccaauuccaaa

SEQ ID NO: 353233 - RNA, 19 nt, Homo sapiens
ccugagaaauguacugucu

SEQ ID NO: 353234 - RNA, 19 nt, Homo sapiens
gcagaccagugcuugaacu

SEQ ID NO: 353235 - RNA, 19 nt, Homo sapiens
gaagcaagggaaguugaaa

SEQ ID NO: 353236 - RNA, 19 nt, Homo sapiens
gaaacgaagggugaagaga

SEQ ID NO: 353237 - RNA, 19 nt, Homo sapiens
caucagacccaacuacauc

SEQ ID NO: 353238 - RNA, 19 nt, Homo sapiens
caucacacaucacucuucu

SEQ ID NO: 353239 - RNA, 19 nt, Homo sapiens
gcaccugacagcuuuaucu

SEQ ID NO: 353240 - RNA, 19 nt, Homo sapiens
ccugugagcuggagagaac

SEQ ID NO: 353241 - RNA, 19 nt, Homo sapiens
ccucgucuuucuccauauu

SEQ ID NO: 353242 - RNA, 19 nt, Homo sapiens
gaaaguccaauuccaaagc

SEQ ID NO: 353243 - RNA, 19 nt, Homo sapiens
cuacauagucagcuacuuc

SEQ ID NO: 353244 - RNA, 19 nt, Homo sapiens
gcagagaagagugcauuca

SEQ ID NO: 353245 - RNA, 19 nt, Homo sapiens
gagccaggcaccuacuuug

SEQ ID NO: 353246 - RNA, 19 nt, Homo sapiens
gcaggaagugcgugagugu

SEQ ID NO: 353247 - RNA, 19 nt, Homo sapiens
gcaguggaccuuggaaauc

SEQ ID NO: 353248 - RNA, 19 nt, Homo sapiens
ugaaagcgagcgacuggaa

SEQ ID NO: 353249 - RNA, 19 nt, Homo sapiens
aagccuacaugacacaguu

SEQ ID NO: 353250 - RNA, 19 nt, Homo sapiens
gaaauguacugucuguaaa

SEQ ID NO: 353251 - RNA, 19 nt, Homo sapiens
ccaacuacaucgacauuua

SEQ ID NO: 353252 - RNA, 19 nt, Homo sapiens
gaaagaauggagccucaua

SEQ ID NO: 353253 - RNA, 19 nt, Homo sapiens
uuggaaaccuggaagauua

SEQ ID NO: 353254 - RNA, 19 nt, Homo sapiens
gaauggagccucauacugu

SEQ ID NO: 353255 - RNA, 19 nt, Homo sapiens
ugaaauggcuccagcaaca

SEQ ID NO: 353256 - RNA, 19 nt, Homo sapiens
caagggaaguugaaagaau

SEQ ID NO: 353257 - RNA, 19 nt, Homo sapiens
ggaugaaccugagaaaugu

SEQ ID NO: 353258 - RNA, 19 nt, Homo sapiens
gaagcaaacagccaguuaa

SEQ ID NO: 353259 - RNA, 19 nt, Homo sapiens
ggacggcgaugucacagau

SEQ ID NO: 353260 - RNA, 19 nt, Homo sapiens
gcaccuacuuugacucaga

SEQ ID NO: 353261 - RNA, 19 nt, Homo sapiens
gaacggcaaugauuaugac

SEQ ID NO: 353262 - RNA, 19 nt, Homo sapiens
gauaagaugggaagcagaa

SEQ ID NO: 353263 - RNA, 19 nt, Homo sapiens
gcgagcgacuggaaaguga

SEQ ID NO: 353264 - RNA, 19 nt, Homo sapiens
agaaauguacugucuguaa

SEQ ID NO: 353265 - RNA, 19 nt, Homo sapiens
gauaugaugccagcaauga

SEQ ID NO: 353266 - RNA, 19 nt, Homo sapiens
ccucacaccuuccucagaa

SEQ ID NO: 353267 - RNA, 19 nt, Homo sapiens
ugacccaucuccacgauau

SEQ ID NO: 353268 - RNA, 19 nt, Homo sapiens
ugagaaauguacugucugu

SEQ ID NO: 353269 - RNA, 19 nt, Homo sapiens
ccaaugaaggguuuacaaa

SEQ ID NO: 353270 - RNA, 19 nt, Homo sapiens
caaagagguugcuggaucu

SEQ ID NO: 353271 - RNA, 19 nt, Homo sapiens
uaagaugggaagcagaaua

SEQ ID NO: 353272 - RNA, 19 nt, Homo sapiens
gucauaaaguuagccauuu

SEQ ID NO: 353273 - RNA, 19 nt, Homo sapiens
ggucauaaaguuagccauu

SEQ ID NO: 353274 - RNA, 19 nt, Homo sapiens
caacaggaagugaaacgaa

SEQ ID NO: 353275 - RNA, 19 nt, Homo sapiens
ggacaggagcccauuuaca

SEQ ID NO: 353276 - RNA, 19 nt, Homo sapiens
gaaagcgagcgacuggaaa

SEQ ID NO: 353277 - RNA, 19 nt, Homo sapiens
cugaagaugaggaagauua

SEQ ID NO: 353278 - RNA, 19 nt, Homo sapiens
ucauaaaguuagccauuuc

SEQ ID NO: 353279 - RNA, 19 nt, Homo sapiens
gggagggcauguugcauca

SEQ ID NO: 353280 - RNA, 19 nt, Homo sapiens
ggacgcagaagcucucguu

SEQ ID NO: 353281 - RNA, 19 nt, Homo sapiens
aaaguuagccauuucuaug

SEQ ID NO: 353282 - RNA, 19 nt, Homo sapiens
cgcagaagcucucguugug

SEQ ID NO: 353283 - RNA, 19 nt, Homo sapiens
cccaggcucugcuaauauu

SEQ ID NO: 353284 - RNA, 19 nt, Homo sapiens
gcaaacagccaguuaaccu

SEQ ID NO: 353285 - RNA, 19 nt, Homo sapiens
guggacaggagcccauuua

SEQ ID NO: 353286 - RNA, 19 nt, Homo sapiens
aauggagccucauacugua

SEQ ID NO: 353287 - RNA, 19 nt, Homo sapiens
gagaagcaagggaaguuga

SEQ ID NO: 353288 - RNA, 19 nt, Homo sapiens
gacgugaacggcaaugauu

SEQ ID NO: 353289 - RNA, 19 nt, Homo sapiens
gaugauggcauagagagaa

SEQ ID NO: 353290 - RNA, 19 nt, Homo sapiens
agagacaggugcgaaguga

SEQ ID NO: 353291 - RNA, 19 nt, Homo sapiens
gacaggagcccauuuacag

SEQ ID NO: 353292 - RNA, 19 nt, Homo sapiens
uggaugaaccugagaaaug

SEQ ID NO: 353293 - RNA, 19 nt, Homo sapiens
aagggaaguugaaagaaug

SEQ ID NO: 353294 - RNA, 19 nt, Homo sapiens
agaagcaaacagccaguua

SEQ ID NO: 353295 - RNA, 19 nt, Homo sapiens
cagauguggucgaggcaaa

SEQ ID NO: 353296 - RNA, 19 nt, Homo sapiens
uuuguucacuggaugcaua

SEQ ID NO: 353297 - RNA, 19 nt, Homo sapiens
gcaagggaaguugaaagaa

SEQ ID NO: 353298 - RNA, 19 nt, Homo sapiens
agucucaacuucuggcaaa

SEQ ID NO: 353299 - RNA, 19 nt, Homo sapiens
caaagucgcugggcaucag

SEQ ID NO: 353300 - RNA, 19 nt, Homo sapiens
ccugagaaauguacugucu

SEQ ID NO: 353301 - RNA, 19 nt, Homo sapiens
gcagaccagugcuugaacu

SEQ ID NO: 353302 - RNA, 19 nt, Homo sapiens
gaagcaagggaaguugaaa

SEQ ID NO: 353303 - RNA, 19 nt, Homo sapiens
caucagacccaacuacauc

SEQ ID NO: 353304 - RNA, 19 nt, Homo sapiens
gaaacgaagggugaagaga

SEQ ID NO: 353305 - RNA, 19 nt, Homo sapiens
gaagauuacacagcucaau

SEQ ID NO: 353306 - RNA, 19 nt, Homo sapiens
gcagagaagagugcauuca

SEQ ID NO: 353307 - RNA, 19 nt, Homo sapiens
gagccaggcaccuacuuug

SEQ ID NO: 353308 - RNA, 19 nt, Homo sapiens
gcaggaagugcgugagugu

SEQ ID NO: 353309 - RNA, 19 nt, Homo sapiens
gcaguggaccuuggaaauc

SEQ ID NO: 353310 - RNA, 19 nt, Homo sapiens
ugaaagcgagcgacuggaa

SEQ ID NO: 353311 - RNA, 19 nt, Homo sapiens
agagguugcuggaucuuuc

SEQ ID NO: 353312 - RNA, 19 nt, Homo sapiens
ccuggaagauuacuaccau

SEQ ID NO: 353313 - RNA, 19 nt, Homo sapiens
gaagagacaggugcgaagu

SEQ ID NO: 353314 - RNA, 19 nt, Homo sapiens
caucaucgccuuggcucua

SEQ ID NO: 353315 - RNA, 19 nt, Homo sapiens
uuucgaguauggcauuaaa

SEQ ID NO: 353316 - RNA, 19 nt, Homo sapiens
uaugaugccagcaaugaaa

SEQ ID NO: 353317 - RNA, 19 nt, Homo sapiens
gaaaccuggaagauuacua

SEQ ID NO: 353318 - RNA, 19 nt, Homo sapiens
guucacuggaugcauauuu

SEQ ID NO: 353319 - RNA, 19 nt, Homo sapiens
uggaagauuacuaccauuu

SEQ ID NO: 353320 - RNA, 19 nt, Homo sapiens
cgccuuggcucuagaagca

SEQ ID NO: 353321 - RNA, 19 nt, Homo sapiens
gcaguggggccuuuuauga

SEQ ID NO: 353322 - RNA, 19 nt, Homo sapiens
acccaaggcugcccuguca

SEQ ID NO: 353323 - RNA, 19 nt, Homo sapiens
ggagaagcaagggaaguug

SEQ ID NO: 353324 - RNA, 19 nt, Homo sapiens
gcgcggagcggcuuuaaaa

SEQ ID NO: 353325 - RNA, 19 nt, Homo sapiens
gcgcucagcaugcauccuu

SEQ ID NO: 353326 - RNA, 19 nt, Homo sapiens
cagcagagcacccguacca

SEQ ID NO: 353327 - RNA, 19 nt, Homo sapiens
cagcagcgccaccgagaau

SEQ ID NO: 353328 - RNA, 19 nt, Homo sapiens
cagcaaacaauuccuacug

SEQ ID NO: 353329 - RNA, 19 nt, Homo sapiens
cagcugcauuccugacugu

SEQ ID NO: 353330 - RNA, 19 nt, Homo sapiens
gaugaaccugagaaaugua

SEQ ID NO: 353331 - RNA, 19 nt, Homo sapiens
ggaagauuacuaccauuuu

SEQ ID NO: 353332 - RNA, 19 nt, Homo sapiens
caacuacaucgacauuuac

SEQ ID NO: 353333 - RNA, 19 nt, Homo sapiens
caacuugggccagauugga

SEQ ID NO: 353334 - RNA, 19 nt, Homo sapiens
aaacacggcacucguugug

SEQ ID NO: 353335 - RNA, 19 nt, Homo sapiens
ugaacggcaaugauuauga

SEQ ID NO: 353336 - RNA, 19 nt, Homo sapiens
gaucugcgucagcgcugua

SEQ ID NO: 353337 - RNA, 19 nt, Homo sapiens
ccuuugcacugucgauaau

SEQ ID NO: 353338 - RNA, 19 nt, Homo sapiens
cgcaggcccuuuacuucaa

SEQ ID NO: 353339 - RNA, 19 nt, Homo sapiens
ccaacagcaucuacaccau

SEQ ID NO: 353340 - RNA, 19 nt, Homo sapiens
cuacaucgacauuuacagu

SEQ ID NO: 353341 - RNA, 19 nt, Homo sapiens
ggaagcagaauagcaaggu

SEQ ID NO: 353342 - RNA, 19 nt, Homo sapiens
uguacugucuguaaagaag

SEQ ID NO: 353343 - RNA, 19 nt, Homo sapiens
ccagcaacaggaagugaaa

SEQ ID NO: 353344 - RNA, 19 nt, Homo sapiens
gcuuucgaguauggcauua

SEQ ID NO: 353345 - RNA, 19 nt, Homo sapiens
caacaugugguaccugcau

SEQ ID NO: 353346 - RNA, 19 nt, Homo sapiens
aauaaacacggcacucguu

SEQ ID NO: 353347 - RNA, 19 nt, Homo sapiens
caaugauuaugacccaucu

SEQ ID NO: 353348 - RNA, 19 nt, Homo sapiens
ccaggcaccuacuuugacu

SEQ ID NO: 353349 - RNA, 19 nt, Homo sapiens
aauguacugucuguaaaga

SEQ ID NO: 353350 - RNA, 19 nt, Homo sapiens
gaaauguacugucuguaaa

SEQ ID NO: 353351 - RNA, 19 nt, Homo sapiens
ccaacuacaucgacauuua

SEQ ID NO: 353352 - RNA, 19 nt, Homo sapiens
gaaagaauggagccucaua

SEQ ID NO: 353353 - RNA, 19 nt, Homo sapiens
uuggaaaccuggaagauua

SEQ ID NO: 353354 - RNA, 19 nt, Homo sapiens
gaauggagccucauacugu

SEQ ID NO: 353355 - RNA, 19 nt, Homo sapiens
ugaaauggcuccagcaaca

SEQ ID NO: 353356 - RNA, 19 nt, Homo sapiens
caagggaaguugaaagaau

SEQ ID NO: 353357 - RNA, 19 nt, Homo sapiens
ggaugaaccugagaaaugu

SEQ ID NO: 353358 - RNA, 19 nt, Homo sapiens
gaagcaaacagccaguuaa

SEQ ID NO: 353359 - RNA, 19 nt, Homo sapiens
ggacggcgaugucacagau

SEQ ID NO: 353360 - RNA, 19 nt, Homo sapiens
gcaccuacuuugacucaga

SEQ ID NO: 353361 - RNA, 19 nt, Homo sapiens
gaacggcaaugauuaugac

SEQ ID NO: 353362 - RNA, 19 nt, Homo sapiens
gauaagaugggaagcagaa

SEQ ID NO: 353363 - RNA, 19 nt, Homo sapiens
gcgagcgacuggaaaguga

SEQ ID NO: 353364 - RNA, 19 nt, Homo sapiens
agaaauguacugucuguaa

SEQ ID NO: 353365 - RNA, 19 nt, Homo sapiens
gauaugaugccagcaauga

SEQ ID NO: 353366 - RNA, 19 nt, Homo sapiens
ccucacaccuuccucagaa

SEQ ID NO: 353367 - RNA, 19 nt, Homo sapiens
ugacccaucuccacgauau

SEQ ID NO: 353368 - RNA, 19 nt, Homo sapiens
ugagaaauguacugucugu

SEQ ID NO: 353369 - RNA, 19 nt, Homo sapiens
ccaaugaaggguuuacaaa

SEQ ID NO: 353370 - RNA, 19 nt, Homo sapiens
caaagagguugcuggaucu

SEQ ID NO: 353371 - RNA, 19 nt, Homo sapiens
uaagaugggaagcagaaua

SEQ ID NO: 353372 - RNA, 19 nt, Homo sapiens
gucauaaaguuagccauuu

SEQ ID NO: 353373 - RNA, 19 nt, Homo sapiens
ggucauaaaguuagccauu

SEQ ID NO: 353374 - RNA, 19 nt, Homo sapiens
caacaggaagugaaacgaa

SEQ ID NO: 353375 - RNA, 19 nt, Homo sapiens
ggacaggagcccauuuaca

SEQ ID NO: 353376 - RNA, 19 nt, Homo sapiens
gaaagcgagcgacuggaaa

SEQ ID NO: 353377 - RNA, 19 nt, Homo sapiens
cugaagaugaggaagauua

SEQ ID NO: 353378 - RNA, 19 nt, Homo sapiens
ucauaaaguuagccauuuc

SEQ ID NO: 353379 - RNA, 19 nt, Homo sapiens
gggagggcauguugcauca

SEQ ID NO: 353380 - RNA, 19 nt, Homo sapiens
ggacgcagaagcucucguu

SEQ ID NO: 353381 - RNA, 19 nt, Homo sapiens
aaaguuagccauuucuaug

SEQ ID NO: 353382 - RNA, 19 nt, Homo sapiens
cgcagaagcucucguugug

SEQ ID NO: 353383 - RNA, 19 nt, Homo sapiens
gcaaacagccaguuaaccu

SEQ ID NO: 353384 - RNA, 19 nt, Homo sapiens
guggacaggagcccauuua

SEQ ID NO: 353385 - RNA, 19 nt, Homo sapiens
aauggagccucauacugua

SEQ ID NO: 353386 - RNA, 19 nt, Homo sapiens
gagaagcaagggaaguuga

SEQ ID NO: 353387 - RNA, 19 nt, Homo sapiens
gacgugaacggcaaugauu

SEQ ID NO: 353388 - RNA, 19 nt, Homo sapiens
gaugauggcauagagagaa

SEQ ID NO: 353389 - RNA, 19 nt, Homo sapiens
agagacaggugcgaaguga

SEQ ID NO: 353390 - RNA, 19 nt, Homo sapiens
gacaggagcccauuuacag

SEQ ID NO: 353391 - RNA, 19 nt, Homo sapiens
uggaugaaccugagaaaug

SEQ ID NO: 353392 - RNA, 19 nt, Homo sapiens
aagggaaguugaaagaaug

SEQ ID NO: 353393 - RNA, 19 nt, Homo sapiens
agaagcaaacagccaguua

SEQ ID NO: 353394 - RNA, 19 nt, Homo sapiens
cagauguggucgaggcaaa

SEQ ID NO: 353395 - RNA, 19 nt, Homo sapiens
uuuguucacuggaugcaua

SEQ ID NO: 353396 - RNA, 19 nt, Homo sapiens
gcaagggaaguugaaagaa

SEQ ID NO: 353397 - RNA, 19 nt, Homo sapiens
agucucaacuucuggcaaa

SEQ ID NO: 353398 - RNA, 19 nt, Homo sapiens
caaagucgcugggcaucag

SEQ ID NO: 353399 - RNA, 19 nt, Homo sapiens
ccugagaaauguacugucu

SEQ ID NO: 353400 - RNA, 19 nt, Homo sapiens
gcagaccagugcuugaacu

SEQ ID NO: 353401 - RNA, 19 nt, Homo sapiens
gaagcaagggaaguugaaa

SEQ ID NO: 353402 - RNA, 19 nt, Homo sapiens
caucagacccaacuacauc

SEQ ID NO: 353403 - RNA, 19 nt, Homo sapiens
gaaacgaagggugaagaga

SEQ ID NO: 353404 - RNA, 19 nt, Homo sapiens
gcagagaagagugcauuca

SEQ ID NO: 353405 - RNA, 19 nt, Homo sapiens
gagccaggcaccuacuuug

SEQ ID NO: 353406 - RNA, 19 nt, Homo sapiens
gcaggaagugcgugagugu

SEQ ID NO: 353407 - RNA, 19 nt, Homo sapiens
gcaguggaccuuggaaauc

SEQ ID NO: 353408 - RNA, 19 nt, Homo sapiens
ugaaagcgagcgacuggaa

SEQ ID NO: 353409 - RNA, 19 nt, Homo sapiens
agagguugcuggaucuuuc

SEQ ID NO: 353410 - RNA, 19 nt, Homo sapiens
gaagagacaggugcgaagu

SEQ ID NO: 353411 - RNA, 19 nt, Homo sapiens
caucaucgccuuggcucua

SEQ ID NO: 353412 - RNA, 19 nt, Homo sapiens
uuucgaguauggcauuaaa

SEQ ID NO: 353413 - RNA, 19 nt, Homo sapiens
ccuggaagauuacuaccau

SEQ ID NO: 353414 - RNA, 19 nt, Homo sapiens
uaugaugccagcaaugaaa

SEQ ID NO: 353415 - RNA, 19 nt, Homo sapiens
gaaaccuggaagauuacua

SEQ ID NO: 353416 - RNA, 19 nt, Homo sapiens
guucacuggaugcauauuu

SEQ ID NO: 353417 - RNA, 19 nt, Homo sapiens
uggaagauuacuaccauuu

SEQ ID NO: 353418 - RNA, 19 nt, Homo sapiens
cgccuuggcucuagaagca

SEQ ID NO: 353419 - RNA, 19 nt, Homo sapiens
gcaguggggccuuuuauga

SEQ ID NO: 353420 - RNA, 19 nt, Homo sapiens
acccaaggcugcccuguca

SEQ ID NO: 353421 - RNA, 19 nt, Homo sapiens
ggagaagcaagggaaguug

SEQ ID NO: 353422 - RNA, 19 nt, Homo sapiens
gcgcggagcggcuuuaaaa

SEQ ID NO: 353423 - RNA, 19 nt, Homo sapiens
gcgcucagcaugcauccuu

SEQ ID NO: 353424 - RNA, 19 nt, Homo sapiens
cagcagagcacccguacca

SEQ ID NO: 353425 - RNA, 19 nt, Homo sapiens
cagcagcgccaccgagaau

SEQ ID NO: 353426 - RNA, 19 nt, Homo sapiens
cagcaaacaauuccuacug

SEQ ID NO: 353427 - RNA, 19 nt, Homo sapiens
cagcugcauuccugacugu

SEQ ID NO: 353428 - RNA, 19 nt, Homo sapiens
gaugaaccugagaaaugua

SEQ ID NO: 353429 - RNA, 19 nt, Homo sapiens
ggaagauuacuaccauuuu

SEQ ID NO: 353430 - RNA, 19 nt, Homo sapiens
caacuacaucgacauuuac

SEQ ID NO: 353431 - RNA, 19 nt, Homo sapiens
caacuugggccagauugga

SEQ ID NO: 353432 - RNA, 19 nt, Homo sapiens
aaacacggcacucguugug

SEQ ID NO: 353433 - RNA, 19 nt, Homo sapiens
ugaacggcaaugauuauga

SEQ ID NO: 353434 - RNA, 19 nt, Homo sapiens
gaucugcgucagcgcugua

SEQ ID NO: 353435 - RNA, 19 nt, Homo sapiens
ccuuugcacugucgauaau

SEQ ID NO: 353436 - RNA, 19 nt, Homo sapiens
cgcaggcccuuuacuucaa

SEQ ID NO: 353437 - RNA, 19 nt, Homo sapiens
ccaacagcaucuacaccau

SEQ ID NO: 353438 - RNA, 19 nt, Homo sapiens
cuacaucgacauuuacagu

SEQ ID NO: 353439 - RNA, 19 nt, Homo sapiens
ggaagcagaauagcaaggu

SEQ ID NO: 353440 - RNA, 19 nt, Homo sapiens
uguacugucuguaaagaag

SEQ ID NO: 353441 - RNA, 19 nt, Homo sapiens
caacaugugguaccugcau

SEQ ID NO: 353442 - RNA, 19 nt, Homo sapiens
gcuuucgaguauggcauua

SEQ ID NO: 353443 - RNA, 19 nt, Homo sapiens
ccagcaacaggaagugaaa

SEQ ID NO: 353444 - RNA, 19 nt, Homo sapiens
aauaaacacggcacucguu

SEQ ID NO: 353445 - RNA, 19 nt, Homo sapiens
caaugauuaugacccaucu

SEQ ID NO: 353446 - RNA, 19 nt, Homo sapiens
ggugaaauggcuccagcaa

SEQ ID NO: 353447 - RNA, 19 nt, Homo sapiens
ccaggcaccuacuuugacu

SEQ ID NO: 353448 - RNA, 19 nt, Homo sapiens
aauguacugucuguaaaga

SEQ ID NO: 353449 - RNA, 19 nt, Homo sapiens
gaaccugagaaauguacug

SEQ ID NO: 353450 - RNA, 19 nt, Homo sapiens
ccaacuacaucgacauuua

SEQ ID NO: 353451 - RNA, 19 nt, Homo sapiens
uaaaaggacucuccaaaua

SEQ ID NO: 353452 - RNA, 19 nt, Homo sapiens
uaaaaggacucuccaaaua

SEQ ID NO: 353453 - RNA, 19 nt, Homo sapiens
gcaaugacgugugccuaua

SEQ ID NO: 353454 - RNA, 19 nt, Homo sapiens
ccaaauagcauuaguuguu

SEQ ID NO: 353455 - RNA, 19 nt, Homo sapiens
ccaaauagcauuaguuguu

SEQ ID NO: 353456 - RNA, 19 nt, Homo sapiens
uuggaaaccuggaagauua

SEQ ID NO: 353457 - RNA, 19 nt, Homo sapiens
ccaccuauaccaauauuua

SEQ ID NO: 353458 - RNA, 19 nt, Homo sapiens
ugaaauggcuccagcaaca

SEQ ID NO: 353459 - RNA, 19 nt, Homo sapiens
gaagaacccucaggucaca

SEQ ID NO: 353460 - RNA, 19 nt, Homo sapiens
gaagcaaacagccaguuaa

SEQ ID NO: 353461 - RNA, 19 nt, Homo sapiens
ggacggcgaugucacagau

SEQ ID NO: 353462 - RNA, 19 nt, Homo sapiens
gacaccaccuauaccaaua

SEQ ID NO: 353463 - RNA, 19 nt, Homo sapiens
gaacggcaaugauuaugac

SEQ ID NO: 353464 - RNA, 19 nt, Homo sapiens
gcgagcgacuggaaaguga

SEQ ID NO: 353465 - RNA, 19 nt, Homo sapiens
gauaugaugccagcaauga

SEQ ID NO: 353466 - RNA, 19 nt, Homo sapiens
ccucacaccuuccucagaa

SEQ ID NO: 353467 - RNA, 19 nt, Homo sapiens
aaacgcaugugcagcuauu

SEQ ID NO: 353468 - RNA, 19 nt, Homo sapiens
ugacccaucuccacgauau

SEQ ID NO: 353469 - RNA, 19 nt, Homo sapiens
gcaggacuccaucucuuaa

SEQ ID NO: 353470 - RNA, 19 nt, Homo sapiens
acagugacauuacggaaga

SEQ ID NO: 353471 - RNA, 19 nt, Homo sapiens
caacaggaagugaaacgaa

SEQ ID NO: 353472 - RNA, 19 nt, Homo sapiens
cagcaggacuccaucucuu

SEQ ID NO: 353473 - RNA, 19 nt, Homo sapiens
gaaagcgagcgacuggaaa

SEQ ID NO: 353474 - RNA, 19 nt, Homo sapiens
gaaggggugucaugaauuc

SEQ ID NO: 353475 - RNA, 19 nt, Homo sapiens
caacacagcaggacuccau

SEQ ID NO: 353476 - RNA, 19 nt, Homo sapiens
gcaaacagccaguuaaccu

SEQ ID NO: 353477 - RNA, 19 nt, Homo sapiens
gacgugaacggcaaugauu

SEQ ID NO: 353478 - RNA, 19 nt, Homo sapiens
gaugauggcauagagagaa

SEQ ID NO: 353479 - RNA, 19 nt, Homo sapiens
agagacaggugcgaaguga

SEQ ID NO: 353480 - RNA, 19 nt, Homo sapiens
acucauaguucucuuuaag

SEQ ID NO: 353481 - RNA, 19 nt, Homo sapiens
agaagcaaacagccaguua

SEQ ID NO: 353482 - RNA, 19 nt, Homo sapiens
cagauguggucgaggcaaa

SEQ ID NO: 353483 - RNA, 19 nt, Homo sapiens
caaagucgcugggcaucag

SEQ ID NO: 353484 - RNA, 19 nt, Homo sapiens
caucagacccaacuacauc

SEQ ID NO: 353485 - RNA, 19 nt, Homo sapiens
gaaacgaagggugaagaga

SEQ ID NO: 353486 - RNA, 19 nt, Homo sapiens
ugaaagcgagcgacuggaa

SEQ ID NO: 353487 - RNA, 19 nt, Homo sapiens
gugcagcuauuuaagaaaa

SEQ ID NO: 353488 - RNA, 19 nt, Homo sapiens
caccaccuauaccaauauu

SEQ ID NO: 353489 - RNA, 19 nt, Homo sapiens
ccuggaagauuacuaccau

SEQ ID NO: 353490 - RNA, 19 nt, Homo sapiens
caucaucgccuuggcucua

SEQ ID NO: 353491 - RNA, 19 nt, Homo sapiens
uuucgaguauggcauuaaa

SEQ ID NO: 353492 - RNA, 19 nt, Homo sapiens
uaugaugccagcaaugaaa

SEQ ID NO: 353493 - RNA, 19 nt, Homo sapiens
gaagagacaggugcgaagu

SEQ ID NO: 353494 - RNA, 19 nt, Homo sapiens
gcccaggaauuugagucua

SEQ ID NO: 353495 - RNA, 19 nt, Homo sapiens
ggguggcccuggaaugugu

SEQ ID NO: 353496 - RNA, 19 nt, Homo sapiens
uggaagauuacuaccauuu

SEQ ID NO: 353497 - RNA, 19 nt, Homo sapiens
cgccuuggcucuagaagca

SEQ ID NO: 353498 - RNA, 19 nt, Homo sapiens
gcaguggggccuuuuauga

SEQ ID NO: 353499 - RNA, 19 nt, Homo sapiens
gaaaccuggaagauuacua

SEQ ID NO: 353500 - RNA, 19 nt, Homo sapiens
aaaggacucuccaaauagc

SEQ ID NO: 353501 - RNA, 19 nt, Homo sapiens
gcgcggagcggcuuuaaaa

SEQ ID NO: 353502 - RNA, 19 nt, Homo sapiens
aaaggacucuccaaauagc

SEQ ID NO: 353503 - RNA, 19 nt, Homo sapiens
caugugcagcuauuuaaga

SEQ ID NO: 353504 - RNA, 19 nt, Homo sapiens
cagcagcgccaccgagaau

SEQ ID NO: 353505 - RNA, 19 nt, Homo sapiens
cagcaaacaauuccuacug

SEQ ID NO: 353506 - RNA, 19 nt, Homo sapiens
caacuugggccagauugga

SEQ ID NO: 353507 - RNA, 19 nt, Homo sapiens
caacuacaucgacauuuac

SEQ ID NO: 353508 - RNA, 19 nt, Homo sapiens
aaacacggcacucguugug

SEQ ID NO: 353509 - RNA, 19 nt, Homo sapiens
ugaacggcaaugauuauga

SEQ ID NO: 353510 - RNA, 19 nt, Homo sapiens
ggaagauuacuaccauuuu

SEQ ID NO: 353511 - RNA, 19 nt, Homo sapiens
acgcaugugcagcuauuua

SEQ ID NO: 353512 - RNA, 19 nt, Homo sapiens
gaucugcgucagcgcugua

SEQ ID NO: 353513 - RNA, 19 nt, Homo sapiens
ccaacagcaucuacaccau

SEQ ID NO: 353514 - RNA, 19 nt, Homo sapiens
cuacaucgacauuuacagu

SEQ ID NO: 353515 - RNA, 19 nt, Homo sapiens
cgcaggcccuuuacuucaa

SEQ ID NO: 353516 - RNA, 19 nt, Homo sapiens
ccagcaacaggaagugaaa

SEQ ID NO: 353517 - RNA, 19 nt, Homo sapiens
gcuuucgaguauggcauua

SEQ ID NO: 353518 - RNA, 19 nt, Homo sapiens
aauaaacacggcacucguu

SEQ ID NO: 353519 - RNA, 19 nt, Homo sapiens
caaugauuaugacccaucu

SEQ ID NO: 353520 - RNA, 19 nt, Homo sapiens
caacaugugguaccugcau

SEQ ID NO: 353521 - RNA, 19 nt, Homo sapiens
gcccuggaauguguaggaa

SEQ ID NO: 353522 - RNA, 19 nt, Homo sapiens
ggugaaauggcuccagcaa

SEQ ID NO: 353523 - RNA, 19 nt, Homo sapiens
gcaaagucgcugggcauca

SEQ ID NO: 353524 - RNA, 19 nt, Homo sapiens
cccaggaauuugagucuag

SEQ ID NO: 353525 - RNA, 19 nt, Homo sapiens
agacaccaccuauaccaau

SEQ ID NO: 353526 - RNA, 19 nt, Homo sapiens
gagacaccaccuauaccaa

SEQ ID NO: 353527 - RNA, 19 nt, Homo sapiens
caccgagacaccaccuaua

SEQ ID NO: 353528 - RNA, 19 nt, Homo sapiens
gguuugauauguaguuacg

SEQ ID NO: 353529 - RNA, 19 nt, Homo sapiens
uaucacagcaaaaccuuua

SEQ ID NO: 353530 - RNA, 19 nt, Homo sapiens
ggacucuccaaauagcauu

SEQ ID NO: 353531 - RNA, 19 nt, Homo sapiens
ggacucuccaaauagcauu

SEQ ID NO: 353532 - RNA, 19 nt, Homo sapiens
caaacaauuccuacugcau

SEQ ID NO: 353533 - RNA, 19 nt, Homo sapiens
gcaggcccuuuacuucaac

SEQ ID NO: 353534 - RNA, 19 nt, Homo sapiens
cgcaugugcagcuauuuaa

SEQ ID NO: 353535 - RNA, 19 nt, Homo sapiens
gcaucagacccaacuacau

SEQ ID NO: 353536 - RNA, 19 nt, Homo sapiens
guacaaugccaaaauagga

SEQ ID NO: 353537 - RNA, 19 nt, Homo sapiens
aacgaagggugaagagaca

SEQ ID NO: 353538 - RNA, 19 nt, Homo sapiens
ccgcaggcccuuuacuuca

SEQ ID NO: 353539 - RNA, 19 nt, Homo sapiens
caccgagaauggcuacaag

SEQ ID NO: 353540 - RNA, 19 nt, Homo sapiens
cgugaacggcaaugauuau

SEQ ID NO: 353541 - RNA, 19 nt, Homo sapiens
cgacgugaacggcaaugau

SEQ ID NO: 353542 - RNA, 19 nt, Homo sapiens
caaugacgugugccuauag

SEQ ID NO: 353543 - RNA, 19 nt, Homo sapiens
augugcagcuauuuaagaa

SEQ ID NO: 353544 - RNA, 19 nt, Homo sapiens
gcaacaggaagugaaacga

SEQ ID NO: 353545 - RNA, 19 nt, Homo sapiens
ccuuggcucuagaagcaaa

SEQ ID NO: 353546 - RNA, 19 nt, Homo sapiens
gugacccgcaggcccuuua

SEQ ID NO: 353547 - RNA, 19 nt, Homo sapiens
agcaggacuccaucucuua

SEQ ID NO: 353548 - RNA, 19 nt, Homo sapiens
cgagacaccaccuauacca

SEQ ID NO: 353549 - RNA, 19 nt, Homo sapiens
cuccaaauagcauuaguug

SEQ ID NO: 353550 - RNA, 19 nt, Homo sapiens
gagcauaacuguucucauu

SEQ ID NO: 353551 - RNA, 19 nt, Homo sapiens
aaacagagcugaagaacuu

SEQ ID NO: 353552 - RNA, 19 nt, Homo sapiens
gagcuaaucuucauuucua

SEQ ID NO: 353553 - RNA, 19 nt, Homo sapiens
gcaugaaccuuguuuaaau

SEQ ID NO: 353554 - RNA, 19 nt, Homo sapiens
ccaacuacaucgacauuua

SEQ ID NO: 353555 - RNA, 19 nt, Homo sapiens
ggacauggcucacaaacag

SEQ ID NO: 353556 - RNA, 19 nt, Homo sapiens
gaccaaagccaccacauuu

SEQ ID NO: 353557 - RNA, 19 nt, Homo sapiens
uuggaaaccuggaagauua

SEQ ID NO: 353558 - RNA, 19 nt, Homo sapiens
gaaaggaagacagauuuaa

SEQ ID NO: 353559 - RNA, 19 nt, Homo sapiens
ugaaauggcuccagcaaca

SEQ ID NO: 353560 - RNA, 19 nt, Homo sapiens
ucacuaaacucucauuucu

SEQ ID NO: 353561 - RNA, 19 nt, Homo sapiens
gaagcaaacagccaguuaa

SEQ ID NO: 353562 - RNA, 19 nt, Homo sapiens
ggacggcgaugucacagau

SEQ ID NO: 353563 - RNA, 19 nt, Homo sapiens
gaacaagagcuuugguaau

SEQ ID NO: 353564 - RNA, 19 nt, Homo sapiens
cauacacacuguugucaaa

SEQ ID NO: 353565 - RNA, 19 nt, Homo sapiens
gguaaucucugugaaauac

SEQ ID NO: 353566 - RNA, 19 nt, Homo sapiens
gcauuaauauugcagucaa

SEQ ID NO: 353567 - RNA, 19 nt, Homo sapiens
aaaguuccaugaauucuug

SEQ ID NO: 353568 - RNA, 19 nt, Homo sapiens
ucuggaaagugcaauuaua

SEQ ID NO: 353569 - RNA, 19 nt, Homo sapiens
gaacggcaaugauuaugac

SEQ ID NO: 353570 - RNA, 19 nt, Homo sapiens
uaaagcacaugccuucugu

SEQ ID NO: 353571 - RNA, 19 nt, Homo sapiens
gcgagcgacuggaaaguga

SEQ ID NO: 353572 - RNA, 19 nt, Homo sapiens
gcucagcacuuuggacaug

SEQ ID NO: 353573 - RNA, 19 nt, Homo sapiens
gguggcagauugaacaaga

SEQ ID NO: 353574 - RNA, 19 nt, Homo sapiens
gauaugaugccagcaauga

SEQ ID NO: 353575 - RNA, 19 nt, Homo sapiens
ccucacaccuuccucagaa

SEQ ID NO: 353576 - RNA, 19 nt, Homo sapiens
ugucucaccucauagcuaa

SEQ ID NO: 353577 - RNA, 19 nt, Homo sapiens
ugacccaucuccacgauau

SEQ ID NO: 353578 - RNA, 19 nt, Homo sapiens
gcauaacuguucucauuuu

SEQ ID NO: 353579 - RNA, 19 nt, Homo sapiens
aacaagagcuuugguaauc

SEQ ID NO: 353580 - RNA, 19 nt, Homo sapiens
ccaaugaaggguuuacaaa

SEQ ID NO: 353581 - RNA, 19 nt, Homo sapiens
caaagagguugcuggaucu

SEQ ID NO: 353582 - RNA, 19 nt, Homo sapiens
cugcugcugugcacauuua

SEQ ID NO: 353583 - RNA, 19 nt, Homo sapiens
gaaagugcaauuauagagu

SEQ ID NO: 353584 - RNA, 19 nt, Homo sapiens
uagaaaggaagacagauuu

SEQ ID NO: 353585 - RNA, 19 nt, Homo sapiens
gauaagaguugagauuuug

SEQ ID NO: 353586 - RNA, 19 nt, Homo sapiens
gucauaaaguuagccauuu

SEQ ID NO: 353587 - RNA, 19 nt, Homo sapiens
ggucauaaaguuagccauu

SEQ ID NO: 353588 - RNA, 19 nt, Homo sapiens
gcaagggaaccuggacuaa

SEQ ID NO: 353589 - RNA, 19 nt, Homo sapiens
caacaggaagugaaacgaa

SEQ ID NO: 353590 - RNA, 19 nt, Homo sapiens
ugacaucucuuuugagcua

SEQ ID NO: 353591 - RNA, 19 nt, Homo sapiens
gagcuuugguaaucucugu

SEQ ID NO: 353592 - RNA, 19 nt, Homo sapiens
gaaagcgagcgacuggaaa

SEQ ID NO: 353593 - RNA, 19 nt, Homo sapiens
ucauaaaguuagccauuuc

SEQ ID NO: 353594 - RNA, 19 nt, Homo sapiens
gaaucacaguauuguuuag

SEQ ID NO: 353595 - RNA, 19 nt, Homo sapiens
agaaaggaagacagauuua

SEQ ID NO: 353596 - RNA, 19 nt, Homo sapiens
ggacgcagaagcucucguu

SEQ ID NO: 353597 - RNA, 19 nt, Homo sapiens
aaaguuagccauuucuaug

SEQ ID NO: 353598 - RNA, 19 nt, Homo sapiens
ggagaaaugcaaccaacug

SEQ ID NO: 353599 - RNA, 19 nt, Homo sapiens
ggaaagugcaauuauagag

SEQ ID NO: 353600 - RNA, 19 nt, Homo sapiens
caugaaccuuguuuaaauc

SEQ ID NO: 353601 - RNA, 19 nt, Homo sapiens
ugaacaagagcuuugguaa

SEQ ID NO: 353602 - RNA, 19 nt, Homo sapiens
cgcagaagcucucguugug

SEQ ID NO: 353603 - RNA, 19 nt, Homo sapiens
aagcaugaaccuuguuuaa

SEQ ID NO: 353604 - RNA, 19 nt, Homo sapiens
gaacuuuggcugccuuugg

SEQ ID NO: 353605 - RNA, 19 nt, Homo sapiens
caagggaaccuggacuaaa

SEQ ID NO: 353606 - RNA, 19 nt, Homo sapiens
gcaaacagccaguuaaccu

SEQ ID NO: 353607 - RNA, 19 nt, Homo sapiens
gacgugaacggcaaugauu

SEQ ID NO: 353608 - RNA, 19 nt, Homo sapiens
gaugauggcauagagagaa

SEQ ID NO: 353609 - RNA, 19 nt, Homo sapiens
agagacaggugcgaaguga

SEQ ID NO: 353610 - RNA, 19 nt, Homo sapiens
gugcaauuauagaguauca

SEQ ID NO: 353611 - RNA, 19 nt, Homo sapiens
caaucuauccugugcuuga

SEQ ID NO: 353612 - RNA, 19 nt, Homo sapiens
ccaccacauuuagaacuuu

SEQ ID NO: 353613 - RNA, 19 nt, Homo sapiens
ggaagacagauuuaaagca

SEQ ID NO: 353614 - RNA, 19 nt, Homo sapiens
cccagaggcucagcacuuu

SEQ ID NO: 353615 - RNA, 19 nt, Homo sapiens
ccaaagccaccacauuuag

SEQ ID NO: 353616 - RNA, 19 nt, Homo sapiens
agaagcaaacagccaguua

SEQ ID NO: 353617 - RNA, 19 nt, Homo sapiens
cagauguggucgaggcaaa

SEQ ID NO: 353618 - RNA, 19 nt, Homo sapiens
uaaacucucauuucuggaa

SEQ ID NO: 353619 - RNA, 19 nt, Homo sapiens
agucucaacuucuggcaaa

SEQ ID NO: 353620 - RNA, 19 nt, Homo sapiens
caaagucgcugggcaucag

SEQ ID NO: 353621 - RNA, 19 nt, Homo sapiens
auuagucucuucuguguga

SEQ ID NO: 353622 - RNA, 19 nt, Homo sapiens
agauuagucucuucugugu

SEQ ID NO: 353623 - RNA, 19 nt, Homo sapiens
caaagccaccacauuuaga

SEQ ID NO: 353624 - RNA, 19 nt, Homo sapiens
caucagacccaacuacauc

SEQ ID NO: 353625 - RNA, 19 nt, Homo sapiens
gaaacgaagggugaagaga

SEQ ID NO: 353626 - RNA, 19 nt, Homo sapiens
cuagaaaggaagacagauu

SEQ ID NO: 353627 - RNA, 19 nt, Homo sapiens
cccaagagcauaacuguuc

SEQ ID NO: 353628 - RNA, 19 nt, Homo sapiens
gcuugaugcuagaaaggaa

SEQ ID NO: 353629 - RNA, 19 nt, Homo sapiens
uugauugacugcaugaaug

SEQ ID NO: 353630 - RNA, 19 nt, Homo sapiens
caagagcuuugguaaucuc

SEQ ID NO: 353631 - RNA, 19 nt, Homo sapiens
gcaguggaccuuggaaauc

SEQ ID NO: 353632 - RNA, 19 nt, Homo sapiens
ugaaagcgagcgacuggaa

SEQ ID NO: 353633 - RNA, 19 nt, Homo sapiens
ugugccggcuuucaaguuu

SEQ ID NO: 353634 - RNA, 19 nt, Homo sapiens
ugaccaaagccaccacauu

SEQ ID NO: 353635 - RNA, 19 nt, Homo sapiens
gcagauugaacaagagcuu

SEQ ID NO: 353636 - RNA, 19 nt, Homo sapiens
agagguugcuggaucuuuc

SEQ ID NO: 353637 - RNA, 19 nt, Homo sapiens
caguagaaagcauaacaaa

SEQ ID NO: 353638 - RNA, 19 nt, Homo sapiens
gaagagacaggugcgaagu

SEQ ID NO: 353639 - RNA, 19 nt, Homo sapiens
caguggcccuuucaacaau

SEQ ID NO: 353640 - RNA, 19 nt, Homo sapiens
gccaccacauuuagaacuu

SEQ ID NO: 353641 - RNA, 19 nt, Homo sapiens
caucaucgccuuggcucua

SEQ ID NO: 353642 - RNA, 19 nt, Homo sapiens
uuucgaguauggcauuaaa

SEQ ID NO: 353643 - RNA, 19 nt, Homo sapiens
uaugaugccagcaaugaaa

SEQ ID NO: 353644 - RNA, 19 nt, Homo sapiens
ccuggaagauuacuaccau

SEQ ID NO: 353645 - RNA, 19 nt, Homo sapiens
uggaagauuacuaccauuu

SEQ ID NO: 353646 - RNA, 19 nt, Homo sapiens
gaaacagagcugaagaacu

SEQ ID NO: 353647 - RNA, 19 nt, Homo sapiens
gcaauuauagaguaucacu

SEQ ID NO: 353648 - RNA, 19 nt, Homo sapiens
agacagauuuaaagcacau

SEQ ID NO: 353649 - RNA, 19 nt, Homo sapiens
gaaaccuggaagauuacua

SEQ ID NO: 353650 - RNA, 19 nt, Homo sapiens
gagcauaacuguucucauu

SEQ ID NO: 353651 - RNA, 19 nt, Homo sapiens
aaacagagcugaagaacuu

SEQ ID NO: 353652 - RNA, 19 nt, Homo sapiens
gagcuaaucuucauuucua

SEQ ID NO: 353653 - RNA, 19 nt, Homo sapiens
gcaugaaccuuguuuaaau

SEQ ID NO: 353654 - RNA, 19 nt, Homo sapiens
ccaacuacaucgacauuua

SEQ ID NO: 353655 - RNA, 19 nt, Homo sapiens
ggacauggcucacaaacag

SEQ ID NO: 353656 - RNA, 19 nt, Homo sapiens
caaaucaacugaccacaga

SEQ ID NO: 353657 - RNA, 19 nt, Homo sapiens
gaccaaagccaccacauuu

SEQ ID NO: 353658 - RNA, 19 nt, Homo sapiens
uuggaaaccuggaagauua

SEQ ID NO: 353659 - RNA, 19 nt, Homo sapiens
gaaaggaagacagauuuaa

SEQ ID NO: 353660 - RNA, 19 nt, Homo sapiens
ugaaauggcuccagcaaca

SEQ ID NO: 353661 - RNA, 19 nt, Homo sapiens
ucacuaaacucucauuucu

SEQ ID NO: 353662 - RNA, 19 nt, Homo sapiens
gaagcaaacagccaguuaa

SEQ ID NO: 353663 - RNA, 19 nt, Homo sapiens
ggacggcgaugucacagau

SEQ ID NO: 353664 - RNA, 19 nt, Homo sapiens
gaacaagagcuuugguaau

SEQ ID NO: 353665 - RNA, 19 nt, Homo sapiens
cauacacacuguugucaaa

SEQ ID NO: 353666 - RNA, 19 nt, Homo sapiens
gguaaucucugugaaauac

SEQ ID NO: 353667 - RNA, 19 nt, Homo sapiens
gcauuaauauugcagucaa

SEQ ID NO: 353668 - RNA, 19 nt, Homo sapiens
aaaguuccaugaauucuug

SEQ ID NO: 353669 - RNA, 19 nt, Homo sapiens
ucuggaaagugcaauuaua

SEQ ID NO: 353670 - RNA, 19 nt, Homo sapiens
gaacggcaaugauuaugac

SEQ ID NO: 353671 - RNA, 19 nt, Homo sapiens
uaaagcacaugccuucugu

SEQ ID NO: 353672 - RNA, 19 nt, Homo sapiens
gagggaaccuggacuaaaa

SEQ ID NO: 353673 - RNA, 19 nt, Homo sapiens
gcgagcgacuggaaaguga

SEQ ID NO: 353674 - RNA, 19 nt, Homo sapiens
gcucagcacuuuggacaug

SEQ ID NO: 353675 - RNA, 19 nt, Homo sapiens
gguggcagauugaacaaga

SEQ ID NO: 353676 - RNA, 19 nt, Homo sapiens
gauaugaugccagcaauga

SEQ ID NO: 353677 - RNA, 19 nt, Homo sapiens
ccucacaccuuccucagaa

SEQ ID NO: 353678 - RNA, 19 nt, Homo sapiens
ugucucaccucauagcuaa

SEQ ID NO: 353679 - RNA, 19 nt, Homo sapiens
ugacccaucuccacgauau

SEQ ID NO: 353680 - RNA, 19 nt, Homo sapiens
gcauaacuguucucauuuu

SEQ ID NO: 353681 - RNA, 19 nt, Homo sapiens
aacaagagcuuugguaauc

SEQ ID NO: 353682 - RNA, 19 nt, Homo sapiens
ccaaugaaggguuuacaaa

SEQ ID NO: 353683 - RNA, 19 nt, Homo sapiens
caaagagguugcuggaucu

SEQ ID NO: 353684 - RNA, 19 nt, Homo sapiens
cugcugcugugcacauuua

SEQ ID NO: 353685 - RNA, 19 nt, Homo sapiens
gaaagugcaauuauagagu

SEQ ID NO: 353686 - RNA, 19 nt, Homo sapiens
uagaaaggaagacagauuu

SEQ ID NO: 353687 - RNA, 19 nt, Homo sapiens
gauaagaguugagauuuug

SEQ ID NO: 353688 - RNA, 19 nt, Homo sapiens
gucauaaaguuagccauuu

SEQ ID NO: 353689 - RNA, 19 nt, Homo sapiens
ggucauaaaguuagccauu

SEQ ID NO: 353690 - RNA, 19 nt, Homo sapiens
caacaggaagugaaacgaa

SEQ ID NO: 353691 - RNA, 19 nt, Homo sapiens
ugacaucucuuuugagcua

SEQ ID NO: 353692 - RNA, 19 nt, Homo sapiens
gagcuuugguaaucucugu

SEQ ID NO: 353693 - RNA, 19 nt, Homo sapiens
gaaagcgagcgacuggaaa

SEQ ID NO: 353694 - RNA, 19 nt, Homo sapiens
ucauaaaguuagccauuuc

SEQ ID NO: 353695 - RNA, 19 nt, Homo sapiens
gaaucacaguauuguuuag

SEQ ID NO: 353696 - RNA, 19 nt, Homo sapiens
agaaaggaagacagauuua

SEQ ID NO: 353697 - RNA, 19 nt, Homo sapiens
ggacgcagaagcucucguu

SEQ ID NO: 353698 - RNA, 19 nt, Homo sapiens
aaaguuagccauuucuaug

SEQ ID NO: 353699 - RNA, 19 nt, Homo sapiens
ggagaaaugcaaccaacug

SEQ ID NO: 353700 - RNA, 19 nt, Homo sapiens
ggaaagugcaauuauagag

SEQ ID NO: 353701 - RNA, 19 nt, Homo sapiens
caugaaccuuguuuaaauc

SEQ ID NO: 353702 - RNA, 19 nt, Homo sapiens
ugaacaagagcuuugguaa

SEQ ID NO: 353703 - RNA, 19 nt, Homo sapiens
cgcagaagcucucguugug

SEQ ID NO: 353704 - RNA, 19 nt, Homo sapiens
aagcaugaaccuuguuuaa

SEQ ID NO: 353705 - RNA, 19 nt, Homo sapiens
gaacuuuggcugccuuugg

SEQ ID NO: 353706 - RNA, 19 nt, Homo sapiens
caacugaccacagaagaga

SEQ ID NO: 353707 - RNA, 19 nt, Homo sapiens
gcaaacagccaguuaaccu

SEQ ID NO: 353708 - RNA, 19 nt, Homo sapiens
gacgugaacggcaaugauu

SEQ ID NO: 353709 - RNA, 19 nt, Homo sapiens
gaugauggcauagagagaa

SEQ ID NO: 353710 - RNA, 19 nt, Homo sapiens
agagacaggugcgaaguga

SEQ ID NO: 353711 - RNA, 19 nt, Homo sapiens
gugcaauuauagaguauca

SEQ ID NO: 353712 - RNA, 19 nt, Homo sapiens
caaucuauccugugcuuga

SEQ ID NO: 353713 - RNA, 19 nt, Homo sapiens
ccaccacauuuagaacuuu

SEQ ID NO: 353714 - RNA, 19 nt, Homo sapiens
ggaagacagauuuaaagca

SEQ ID NO: 353715 - RNA, 19 nt, Homo sapiens
cccagaggcucagcacuuu

SEQ ID NO: 353716 - RNA, 19 nt, Homo sapiens
ccaaagccaccacauuuag

SEQ ID NO: 353717 - RNA, 19 nt, Homo sapiens
agacuccuguugcaaauca

SEQ ID NO: 353718 - RNA, 19 nt, Homo sapiens
agaagcaaacagccaguua

SEQ ID NO: 353719 - RNA, 19 nt, Homo sapiens
cagauguggucgaggcaaa

SEQ ID NO: 353720 - RNA, 19 nt, Homo sapiens
uaaacucucauuucuggaa

SEQ ID NO: 353721 - RNA, 19 nt, Homo sapiens
gaucuugagacuccuguug

SEQ ID NO: 353722 - RNA, 19 nt, Homo sapiens
agucucaacuucuggcaaa

SEQ ID NO: 353723 - RNA, 19 nt, Homo sapiens
caaagucgcugggcaucag

SEQ ID NO: 353724 - RNA, 19 nt, Homo sapiens
auuagucucuucuguguga

SEQ ID NO: 353725 - RNA, 19 nt, Homo sapiens
agauuagucucuucugugu

SEQ ID NO: 353726 - RNA, 19 nt, Homo sapiens
caaagccaccacauuuaga

SEQ ID NO: 353727 - RNA, 19 nt, Homo sapiens
gagagggaaccuggacuaa

SEQ ID NO: 353728 - RNA, 19 nt, Homo sapiens
gaaacgaagggugaagaga

SEQ ID NO: 353729 - RNA, 19 nt, Homo sapiens
caucagacccaacuacauc

SEQ ID NO: 353730 - RNA, 19 nt, Homo sapiens
cuagaaaggaagacagauu

SEQ ID NO: 353731 - RNA, 19 nt, Homo sapiens
cccaagagcauaacuguuc

SEQ ID NO: 353732 - RNA, 19 nt, Homo sapiens
gcuugaugcuagaaaggaa

SEQ ID NO: 353733 - RNA, 19 nt, Homo sapiens
uugauugacugcaugaaug

SEQ ID NO: 353734 - RNA, 19 nt, Homo sapiens
caagagcuuugguaaucuc

SEQ ID NO: 353735 - RNA, 19 nt, Homo sapiens
ugagacuccuguugcaaau

SEQ ID NO: 353736 - RNA, 19 nt, Homo sapiens
gcaguggaccuuggaaauc

SEQ ID NO: 353737 - RNA, 19 nt, Homo sapiens
ugaaagcgagcgacuggaa

SEQ ID NO: 353738 - RNA, 19 nt, Homo sapiens
ugugccggcuuucaaguuu

SEQ ID NO: 353739 - RNA, 19 nt, Homo sapiens
ugaccaaagccaccacauu

SEQ ID NO: 353740 - RNA, 19 nt, Homo sapiens
gcagauugaacaagagcuu

SEQ ID NO: 353741 - RNA, 19 nt, Homo sapiens
agagguugcuggaucuuuc

SEQ ID NO: 353742 - RNA, 19 nt, Homo sapiens
caguagaaagcauaacaaa

SEQ ID NO: 353743 - RNA, 19 nt, Homo sapiens
caguggcccuuucaacaau

SEQ ID NO: 353744 - RNA, 19 nt, Homo sapiens
ccuggaagauuacuaccau

SEQ ID NO: 353745 - RNA, 19 nt, Homo sapiens
gccaccacauuuagaacuu

SEQ ID NO: 353746 - RNA, 19 nt, Homo sapiens
ggagaagcaaggugaucuu

SEQ ID NO: 353747 - RNA, 19 nt, Homo sapiens
caucaucgccuuggcucua

SEQ ID NO: 353748 - RNA, 19 nt, Homo sapiens
uuucgaguauggcauuaaa

SEQ ID NO: 353749 - RNA, 19 nt, Homo sapiens
uaugaugccagcaaugaaa

SEQ ID NO: 353750 - RNA, 19 nt, Homo sapiens
ccaacuacaucgacauuua

SEQ ID NO: 353751 - RNA, 19 nt, Homo sapiens
caaaucaacugaccacaga

SEQ ID NO: 353752 - RNA, 19 nt, Homo sapiens
uuggaaaccuggaagauua

SEQ ID NO: 353753 - RNA, 19 nt, Homo sapiens
ugaaauggcuccagcaaca

SEQ ID NO: 353754 - RNA, 19 nt, Homo sapiens
gaagcaaacagccaguuaa

SEQ ID NO: 353755 - RNA, 19 nt, Homo sapiens
ggacggcgaugucacagau

SEQ ID NO: 353756 - RNA, 19 nt, Homo sapiens
gaagagagguucguuucca

SEQ ID NO: 353757 - RNA, 19 nt, Homo sapiens
ccauuggucuguauaucua

SEQ ID NO: 353758 - RNA, 19 nt, Homo sapiens
gaacggcaaugauuaugac

SEQ ID NO: 353759 - RNA, 19 nt, Homo sapiens
gcgagcgacuggaaaguga

SEQ ID NO: 353760 - RNA, 19 nt, Homo sapiens
gauaugaugccagcaauga

SEQ ID NO: 353761 - RNA, 19 nt, Homo sapiens
ccucacaccuuccucagaa

SEQ ID NO: 353762 - RNA, 19 nt, Homo sapiens
cacuguagcuuuguaguaa

SEQ ID NO: 353763 - RNA, 19 nt, Homo sapiens
ugacccaucuccacgauau

SEQ ID NO: 353764 - RNA, 19 nt, Homo sapiens
ccaaugaaggguuuacaaa

SEQ ID NO: 353765 - RNA, 19 nt, Homo sapiens
caaagagguugcuggaucu

SEQ ID NO: 353766 - RNA, 19 nt, Homo sapiens
gucauaaaguuagccauuu

SEQ ID NO: 353767 - RNA, 19 nt, Homo sapiens
ggucauaaaguuagccauu

SEQ ID NO: 353768 - RNA, 19 nt, Homo sapiens
caacaggaagugaaacgaa

SEQ ID NO: 353769 - RNA, 19 nt, Homo sapiens
gaaagcgagcgacuggaaa

SEQ ID NO: 353770 - RNA, 19 nt, Homo sapiens
ucauaaaguuagccauuuc

SEQ ID NO: 353771 - RNA, 19 nt, Homo sapiens
ggacgcagaagcucucguu

SEQ ID NO: 353772 - RNA, 19 nt, Homo sapiens
aaaguuagccauuucuaug

SEQ ID NO: 353773 - RNA, 19 nt, Homo sapiens
cgcagaagcucucguugug

SEQ ID NO: 353774 - RNA, 19 nt, Homo sapiens
caacugaccacagaagaga

SEQ ID NO: 353775 - RNA, 19 nt, Homo sapiens
gcaaacagccaguuaaccu

SEQ ID NO: 353776 - RNA, 19 nt, Homo sapiens
gacgugaacggcaaugauu

SEQ ID NO: 353777 - RNA, 19 nt, Homo sapiens
gaugauggcauagagagaa

SEQ ID NO: 353778 - RNA, 19 nt, Homo sapiens
agagacaggugcgaaguga

SEQ ID NO: 353779 - RNA, 19 nt, Homo sapiens
gaaagugcgaguccuccaa

SEQ ID NO: 353780 - RNA, 19 nt, Homo sapiens
guagcuuuguaguaaguuu

SEQ ID NO: 353781 - RNA, 19 nt, Homo sapiens
ucacuguagcuuuguagua

SEQ ID NO: 353782 - RNA, 19 nt, Homo sapiens
agacuccuguugcaaauca

SEQ ID NO: 353783 - RNA, 19 nt, Homo sapiens
agaagcaaacagccaguua

SEQ ID NO: 353784 - RNA, 19 nt, Homo sapiens
cagauguggucgaggcaaa

SEQ ID NO: 353785 - RNA, 19 nt, Homo sapiens
ucucgauucuguuccauug

SEQ ID NO: 353786 - RNA, 19 nt, Homo sapiens
gaucuugagacuccuguug

SEQ ID NO: 353787 - RNA, 19 nt, Homo sapiens
agucucaacuucuggcaaa

SEQ ID NO: 353788 - RNA, 19 nt, Homo sapiens
caaagucgcugggcaucag

SEQ ID NO: 353789 - RNA, 19 nt, Homo sapiens
cagaagagagguucguuuc

SEQ ID NO: 353790 - RNA, 19 nt, Homo sapiens
caucagacccaacuacauc

SEQ ID NO: 353791 - RNA, 19 nt, Homo sapiens
gaaacgaagggugaagaga

SEQ ID NO: 353792 - RNA, 19 nt, Homo sapiens
uuugaucacuguagcuuug

SEQ ID NO: 353793 - RNA, 19 nt, Homo sapiens
uggagucaguaccauauug

SEQ ID NO: 353794 - RNA, 19 nt, Homo sapiens
ugagacuccuguugcaaau

SEQ ID NO: 353795 - RNA, 19 nt, Homo sapiens
gcaguggaccuuggaaauc

SEQ ID NO: 353796 - RNA, 19 nt, Homo sapiens
ugaaagcgagcgacuggaa

SEQ ID NO: 353797 - RNA, 19 nt, Homo sapiens
agagguugcuggaucuuuc

SEQ ID NO: 353798 - RNA, 19 nt, Homo sapiens
ccuggaagauuacuaccau

SEQ ID NO: 353799 - RNA, 19 nt, Homo sapiens
ggagaagcaaggugaucuu

SEQ ID NO: 353800 - RNA, 19 nt, Homo sapiens
caucaucgccuuggcucua

SEQ ID NO: 353801 - RNA, 19 nt, Homo sapiens
uuucgaguauggcauuaaa

SEQ ID NO: 353802 - RNA, 19 nt, Homo sapiens
uaugaugccagcaaugaaa

SEQ ID NO: 353803 - RNA, 19 nt, Homo sapiens
gaagagacaggugcgaagu

SEQ ID NO: 353804 - RNA, 19 nt, Homo sapiens
ggagucaguaccauauugu

SEQ ID NO: 353805 - RNA, 19 nt, Homo sapiens
gaaaccuggaagauuacua

SEQ ID NO: 353806 - RNA, 19 nt, Homo sapiens
cgccuuggcucuagaagca

SEQ ID NO: 353807 - RNA, 19 nt, Homo sapiens
gcaguggggccuuuuauga

SEQ ID NO: 353808 - RNA, 19 nt, Homo sapiens
uggaagauuacuaccauuu

SEQ ID NO: 353809 - RNA, 19 nt, Homo sapiens
gcgcggagcggcuuuaaaa

SEQ ID NO: 353810 - RNA, 19 nt, Homo sapiens
cagcagcgccaccgagaau

SEQ ID NO: 353811 - RNA, 19 nt, Homo sapiens
cagcaaacaauuccuacug

SEQ ID NO: 353812 - RNA, 19 nt, Homo sapiens
caacuugggccagauugga

SEQ ID NO: 353813 - RNA, 19 nt, Homo sapiens
caacuacaucgacauuuac

SEQ ID NO: 353814 - RNA, 19 nt, Homo sapiens
aaacacggcacucguugug

SEQ ID NO: 353815 - RNA, 19 nt, Homo sapiens
ugaacggcaaugauuauga

SEQ ID NO: 353816 - RNA, 19 nt, Homo sapiens
ggaagauuacuaccauuuu

SEQ ID NO: 353817 - RNA, 19 nt, Homo sapiens
gaucugcgucagcgcugua

SEQ ID NO: 353818 - RNA, 19 nt, Homo sapiens
ccaacagcaucuacaccau

SEQ ID NO: 353819 - RNA, 19 nt, Homo sapiens
cuacaucgacauuuacagu

SEQ ID NO: 353820 - RNA, 19 nt, Homo sapiens
cgcaggcccuuuacuucaa

SEQ ID NO: 353821 - RNA, 19 nt, Homo sapiens
ccagcaacaggaagugaaa

SEQ ID NO: 353822 - RNA, 19 nt, Homo sapiens
gcuuucgaguauggcauua

SEQ ID NO: 353823 - RNA, 19 nt, Homo sapiens
aauaaacacggcacucguu

SEQ ID NO: 353824 - RNA, 19 nt, Homo sapiens
caaugauuaugacccaucu

SEQ ID NO: 353825 - RNA, 19 nt, Homo sapiens
caacaugugguaccugcau

SEQ ID NO: 353826 - RNA, 19 nt, Homo sapiens
ugaucacuguagcuuugua

SEQ ID NO: 353827 - RNA, 19 nt, Homo sapiens
ggugaaauggcuccagcaa

SEQ ID NO: 353828 - RNA, 19 nt, Homo sapiens
gcaaagucgcugggcauca

SEQ ID NO: 353829 - RNA, 19 nt, Homo sapiens
aaagugcgaguccuccaaa

SEQ ID NO: 353830 - RNA, 19 nt, Homo sapiens
ggcaguggaccuuggaaau

SEQ ID NO: 353831 - RNA, 19 nt, Homo sapiens
uaucacagcaaaaccuuua

SEQ ID NO: 353832 - RNA, 19 nt, Homo sapiens
agucaguaccauauuguuu

SEQ ID NO: 353833 - RNA, 19 nt, Homo sapiens
acagaagagagguucguuu

SEQ ID NO: 353834 - RNA, 19 nt, Homo sapiens
gggcaguggaccuuggaaa

SEQ ID NO: 353835 - RNA, 19 nt, Homo sapiens
caaacaauuccuacugcau

SEQ ID NO: 353836 - RNA, 19 nt, Homo sapiens
uuuacaaacugggaauuca

SEQ ID NO: 353837 - RNA, 19 nt, Homo sapiens
ccgcaggcccuuuacuuca

SEQ ID NO: 353838 - RNA, 19 nt, Homo sapiens
gcaggcccuuuacuucaac

SEQ ID NO: 353839 - RNA, 19 nt, Homo sapiens
gcaucagacccaacuacau

SEQ ID NO: 353840 - RNA, 19 nt, Homo sapiens
guacaaugccaaaauagga

SEQ ID NO: 353841 - RNA, 19 nt, Homo sapiens
aacgaagggugaagagaca

SEQ ID NO: 353842 - RNA, 19 nt, Homo sapiens
caccgagaauggcuacaag

SEQ ID NO: 353843 - RNA, 19 nt, Homo sapiens
cgugaacggcaaugauuau

SEQ ID NO: 353844 - RNA, 19 nt, Homo sapiens
cgacgugaacggcaaugau

SEQ ID NO: 353845 - RNA, 19 nt, Homo sapiens
ccuuggcucuagaagcaaa

SEQ ID NO: 353846 - RNA, 19 nt, Homo sapiens
gcaacaggaagugaaacga

SEQ ID NO: 353847 - RNA, 19 nt, Homo sapiens
gugacccgcaggcccuuua

SEQ ID NO: 353848 - RNA, 19 nt, Homo sapiens
ccaccgagaauggcuacaa

SEQ ID NO: 353849 - RNA, 19 nt, Homo sapiens
ugcgauggcuacaccaaca

SEQ ID NO: 353850 - RNA, 19 nt, Homo sapiens
ccaaagaaguucaagauca

SEQ ID NO: 353851 - RNA, 19 nt, Homo sapiens
caaagaaguucaagaucaa

SEQ ID NO: 353852 - RNA, 19 nt, Homo sapiens
cuacgacaauuuccuguuu

SEQ ID NO: 353853 - RNA, 19 nt, Homo sapiens
gaagagccgugccguuucu

SEQ ID NO: 353854 - RNA, 19 nt, Homo sapiens
ccacaucaccucacuguug

SEQ ID NO: 353855 - RNA, 19 nt, Homo sapiens
ccacgcugcucgauacuga

SEQ ID NO: 353856 - RNA, 19 nt, Homo sapiens
gguacuugcuggacuugaa

SEQ ID NO: 353857 - RNA, 19 nt, Homo sapiens
gauacugacuacgacaauu

SEQ ID NO: 353858 - RNA, 19 nt, Homo sapiens
gaauaaccacagcucagaa

SEQ ID NO: 353859 - RNA, 19 nt, Homo sapiens
caacaacaucucccucaug

SEQ ID NO: 353860 - RNA, 19 nt, Homo sapiens
ggaagagccgugccguuuc

SEQ ID NO: 353861 - RNA, 19 nt, Homo sapiens
uggaagagccgugccguuu

SEQ ID NO: 353862 - RNA, 19 nt, Homo sapiens
gagaagacugggaauccaa

SEQ ID NO: 353863 - RNA, 19 nt, Homo sapiens
uugcuggacuugaaacaga

SEQ ID NO: 353864 - RNA, 19 nt, Homo sapiens
gaucaugcagggauucauc

SEQ ID NO: 353865 - RNA, 19 nt, Homo sapiens
acagcuguguugagaagaa

SEQ ID NO: 353866 - RNA, 19 nt, Homo sapiens
ccacagcucagaagacgau

SEQ ID NO: 353867 - RNA, 19 nt, Homo sapiens
guacuugcuggacuugaaa

SEQ ID NO: 353868 - RNA, 19 nt, Homo sapiens
agacugggaauccaaagaa

SEQ ID NO: 353869 - RNA, 19 nt, Homo sapiens
ggacuugaaacagauggaa

SEQ ID NO: 353870 - RNA, 19 nt, Homo sapiens
gacaauuuccuguuucucu

SEQ ID NO: 353871 - RNA, 19 nt, Homo sapiens
auacugacuacgacaauuu

SEQ ID NO: 353872 - RNA, 19 nt, Homo sapiens
ccaacaacaucucccucau

SEQ ID NO: 353873 - RNA, 19 nt, Homo sapiens
ggaauccaaagaaguucaa

SEQ ID NO: 353874 - RNA, 19 nt, Homo sapiens
ccaggcaccuaugguacuu

SEQ ID NO: 353875 - RNA, 19 nt, Homo sapiens
accuggagcucccaaaguu

SEQ ID NO: 353876 - RNA, 19 nt, Homo sapiens
ggagagaagacugggaauc

SEQ ID NO: 353877 - RNA, 19 nt, Homo sapiens
uaugguacuugcuggacuu

SEQ ID NO: 353878 - RNA, 19 nt, Homo sapiens
gcacagaugggagaacaac

SEQ ID NO: 353879 - RNA, 19 nt, Homo sapiens
agaauaaccacagcucaga

SEQ ID NO: 353880 - RNA, 19 nt, Homo sapiens
gaggccacgcugcucgaua

SEQ ID NO: 353881 - RNA, 19 nt, Homo sapiens
ggacaaccuggagaucguu

SEQ ID NO: 353882 - RNA, 19 nt, Homo sapiens
acuauacgguggcgaacga

SEQ ID NO: 353883 - RNA, 19 nt, Homo sapiens
gagagaagacugggaaucc

SEQ ID NO: 353884 - RNA, 19 nt, Homo sapiens
uaauaaacccuuggagcau

SEQ ID NO: 353885 - RNA, 19 nt, Homo sapiens
ggaccuggagcucccaaag

SEQ ID NO: 353886 - RNA, 19 nt, Homo sapiens
gacugggaauccaaagaag

SEQ ID NO: 353887 - RNA, 19 nt, Homo sapiens
gguggaggacgaugagauc

SEQ ID NO: 353888 - RNA, 19 nt, Homo sapiens
gaccuggagcucccaaagu

SEQ ID NO: 353889 - RNA, 19 nt, Homo sapiens
gcugcucgauacugacuac

SEQ ID NO: 353890 - RNA, 19 nt, Homo sapiens
ggauucaucagggcuuuca

SEQ ID NO: 353891 - RNA, 19 nt, Homo sapiens
gagcaugaugugccaguac

SEQ ID NO: 353892 - RNA, 19 nt, Homo sapiens
cugggaauccaaagaaguu

SEQ ID NO: 353893 - RNA, 19 nt, Homo sapiens
agaagacugggaauccaaa

SEQ ID NO: 353894 - RNA, 19 nt, Homo sapiens
gaacguugcugaaguggua

SEQ ID NO: 353895 - RNA, 19 nt, Homo sapiens
gaaugaaucuuacuuguug

SEQ ID NO: 353896 - RNA, 19 nt, Homo sapiens
ggacauacuucuaguugua

SEQ ID NO: 353897 - RNA, 19 nt, Homo sapiens
gaagaggcauauucaguuu

SEQ ID NO: 353898 - RNA, 19 nt, Homo sapiens
auaaagagcugguagaauu

SEQ ID NO: 353899 - RNA, 19 nt, Homo sapiens
gagacuaggccguauauua

SEQ ID NO: 353900 - RNA, 19 nt, Homo sapiens
caaagaaucuccugguaga

SEQ ID NO: 353901 - RNA, 19 nt, Homo sapiens
ggaaugccaugcuuuagaa

SEQ ID NO: 353902 - RNA, 19 nt, Homo sapiens
caauuaaggugugggauua

SEQ ID NO: 353903 - RNA, 19 nt, Homo sapiens
caacaugaaucugauauug

SEQ ID NO: 353904 - RNA, 19 nt, Homo sapiens
gaaaggagugggaggaaua

SEQ ID NO: 353905 - RNA, 19 nt, Homo sapiens
cagcguagaucaaacagua

SEQ ID NO: 353906 - RNA, 19 nt, Homo sapiens
aaaggaagcugaauuagau

SEQ ID NO: 353907 - RNA, 19 nt, Homo sapiens
uaauauugcucucguguuu

SEQ ID NO: 353908 - RNA, 19 nt, Homo sapiens
ucacaacccugcuuacauu

SEQ ID NO: 353909 - RNA, 19 nt, Homo sapiens
gcacuuaaauugguuacuu

SEQ ID NO: 353910 - RNA, 19 nt, Homo sapiens
ggaauuagaaucaaagcua

SEQ ID NO: 353911 - RNA, 19 nt, Homo sapiens
ggauguagauugagcuuau

SEQ ID NO: 353912 - RNA, 19 nt, Homo sapiens
aaugagcccuguuuaauaa

SEQ ID NO: 353913 - RNA, 19 nt, Homo sapiens
gaaaaucacuuccguuaug

SEQ ID NO: 353914 - RNA, 19 nt, Homo sapiens
ggagggacauaccacuaua

SEQ ID NO: 353915 - RNA, 19 nt, Homo sapiens
ccaagagaguuauuugaaa

SEQ ID NO: 353916 - RNA, 19 nt, Homo sapiens
uuacauacguugucuagaa

SEQ ID NO: 353917 - RNA, 19 nt, Homo sapiens
caaacuggcuacuguguga

SEQ ID NO: 353918 - RNA, 19 nt, Homo sapiens
caauggagaucauauagug

SEQ ID NO: 353919 - RNA, 19 nt, Homo sapiens
cagauaagcuugacauuac

SEQ ID NO: 353920 - RNA, 19 nt, Homo sapiens
agacaaagggugagaguua

SEQ ID NO: 353921 - RNA, 19 nt, Homo sapiens
guacaaaucacuauucguu

SEQ ID NO: 353922 - RNA, 19 nt, Homo sapiens
gguaauaucacucguuaaa

SEQ ID NO: 353923 - RNA, 19 nt, Homo sapiens
ccacaauguuucuucagua

SEQ ID NO: 353924 - RNA, 19 nt, Homo sapiens
guagagaagcgacauguaa

SEQ ID NO: 353925 - RNA, 19 nt, Homo sapiens
caaauuggccacuuaagaa

SEQ ID NO: 353926 - RNA, 19 nt, Homo sapiens
ugaacuaaaucgagcuaua

SEQ ID NO: 353927 - RNA, 19 nt, Homo sapiens
ugaacgaacucuuaaagga

SEQ ID NO: 353928 - RNA, 19 nt, Homo sapiens
gaaaacaguuccccagauu

SEQ ID NO: 353929 - RNA, 19 nt, Homo sapiens
ggccguauauuaacuagaa

SEQ ID NO: 353930 - RNA, 19 nt, Homo sapiens
gaaguaccauaggguuuaa

SEQ ID NO: 353931 - RNA, 19 nt, Homo sapiens
ccauugagcucuguuuaaa

SEQ ID NO: 353932 - RNA, 19 nt, Homo sapiens
gaacugcguuuuauucauu

SEQ ID NO: 353933 - RNA, 19 nt, Homo sapiens
cugcagauaugaccauuaa

SEQ ID NO: 353934 - RNA, 19 nt, Homo sapiens
guauauaaguccagugugu

SEQ ID NO: 353935 - RNA, 19 nt, Homo sapiens
uaaugagcccuguuuaaua

SEQ ID NO: 353936 - RNA, 19 nt, Homo sapiens
agacuaggccguauauuaa

SEQ ID NO: 353937 - RNA, 19 nt, Homo sapiens
gagauaacagugacaguuu

SEQ ID NO: 353938 - RNA, 19 nt, Homo sapiens
cauccuguguucaguguua

SEQ ID NO: 353939 - RNA, 19 nt, Homo sapiens
acaacgagaugaacuaaau

SEQ ID NO: 353940 - RNA, 19 nt, Homo sapiens
aaacggacaaguagaauaa

SEQ ID NO: 353941 - RNA, 19 nt, Homo sapiens
ggaaugaaucuuacuuguu

SEQ ID NO: 353942 - RNA, 19 nt, Homo sapiens
ccgguaauaucacucguua

SEQ ID NO: 353943 - RNA, 19 nt, Homo sapiens
gaaauaaagagcugguaga

SEQ ID NO: 353944 - RNA, 19 nt, Homo sapiens
gagguucacugcugcuuug

SEQ ID NO: 353945 - RNA, 19 nt, Homo sapiens
gaaaauugguuccugcaaa

SEQ ID NO: 353946 - RNA, 19 nt, Homo sapiens
acagguagguuuaagagaa

SEQ ID NO: 353947 - RNA, 19 nt, Homo sapiens
ggaauacagcaguuuguuu

SEQ ID NO: 353948 - RNA, 19 nt, Homo sapiens
agacaagacuauuaagaug

SEQ ID NO: 353949 - RNA, 19 nt, Homo sapiens
caacaggaucugagacuaa

SEQ ID NO: 353950 - RNA, 19 nt, Homo sapiens
gcacggccaugaccacaau

SEQ ID NO: 353951 - RNA, 19 nt, Homo sapiens
gaagcugaauuagauguga

SEQ ID NO: 353952 - RNA, 19 nt, Homo sapiens
ggaaaaggcacuuaaauug

SEQ ID NO: 353953 - RNA, 19 nt, Homo sapiens
uagaaauggugcaucuuaa

SEQ ID NO: 353954 - RNA, 19 nt, Homo sapiens
uauaugggccuaucuguaa

SEQ ID NO: 353955 - RNA, 19 nt, Homo sapiens
gaaggcagaaguugaauca

SEQ ID NO: 353956 - RNA, 19 nt, Homo sapiens
gcaacaggaucugagacua

SEQ ID NO: 353957 - RNA, 19 nt, Homo sapiens
caacuggguccacauguaa

SEQ ID NO: 353958 - RNA, 19 nt, Homo sapiens
agauaacagugacaguuua

SEQ ID NO: 353959 - RNA, 19 nt, Homo sapiens
guagugaugugacuuccaa

SEQ ID NO: 353960 - RNA, 19 nt, Homo sapiens
gacuguaaaucucaagaaa

SEQ ID NO: 353961 - RNA, 19 nt, Homo sapiens
ucagauaagcuugacauua

SEQ ID NO: 353962 - RNA, 19 nt, Homo sapiens
guaaugagcccuguuuaau

SEQ ID NO: 353963 - RNA, 19 nt, Homo sapiens
cagcgaacauugaaucuca

SEQ ID NO: 353964 - RNA, 19 nt, Homo sapiens
acuauuccauugucaguua

SEQ ID NO: 353965 - RNA, 19 nt, Homo sapiens
ccaaaucaguaggauauau

SEQ ID NO: 353966 - RNA, 19 nt, Homo sapiens
gagaagcagcgaacauuga

SEQ ID NO: 353967 - RNA, 19 nt, Homo sapiens
guuacuaguuggauucauu

SEQ ID NO: 353968 - RNA, 19 nt, Homo sapiens
ggagugccguugauugugu

SEQ ID NO: 353969 - RNA, 19 nt, Homo sapiens
ccagagacaagacuauuaa

SEQ ID NO: 353970 - RNA, 19 nt, Homo sapiens
cacggcaucuugcacuuua

SEQ ID NO: 353971 - RNA, 19 nt, Homo sapiens
gaaaaugacuguaaaucuc

SEQ ID NO: 353972 - RNA, 19 nt, Homo sapiens
gaugauaaggcuacaauuc

SEQ ID NO: 353973 - RNA, 19 nt, Homo sapiens
gaaaaguggugguuauuag

SEQ ID NO: 353974 - RNA, 19 nt, Homo sapiens
gagacaagacuauuaagau

SEQ ID NO: 353975 - RNA, 19 nt, Homo sapiens
ccagaaagcucauauuccu

SEQ ID NO: 353976 - RNA, 19 nt, Homo sapiens
cagaggaugcuacaauuaa

SEQ ID NO: 353977 - RNA, 19 nt, Homo sapiens
gaacuaaaucgagcuauag

SEQ ID NO: 353978 - RNA, 19 nt, Homo sapiens
uaaggacaaugaugagguu

SEQ ID NO: 353979 - RNA, 19 nt, Homo sapiens
gggauaaggacaaugauga

SEQ ID NO: 353980 - RNA, 19 nt, Homo sapiens
caacccugcuuacauugaa

SEQ ID NO: 353981 - RNA, 19 nt, Homo sapiens
ggacaauauugccucacaa

SEQ ID NO: 353982 - RNA, 19 nt, Homo sapiens
gaggcuagugguauauuua

SEQ ID NO: 353983 - RNA, 19 nt, Homo sapiens
uaagaaggcagaaguugaa

SEQ ID NO: 353984 - RNA, 19 nt, Homo sapiens
gacaagacccuacgcguau

SEQ ID NO: 353985 - RNA, 19 nt, Homo sapiens
gaacuuucccgguaauauc

SEQ ID NO: 353986 - RNA, 19 nt, Homo sapiens
gaaauggugcaucuuaaca

SEQ ID NO: 353987 - RNA, 19 nt, Homo sapiens
gauaacagugacaguuuaa

SEQ ID NO: 353988 - RNA, 19 nt, Homo sapiens
ggacaaguagaauaaaugu

SEQ ID NO: 353989 - RNA, 19 nt, Homo sapiens
ugacagaaauacugagaag

SEQ ID NO: 353990 - RNA, 19 nt, Homo sapiens
gaauccaaauuguauacug

SEQ ID NO: 353991 - RNA, 19 nt, Homo sapiens
caagauggcacucugauag

SEQ ID NO: 353992 - RNA, 19 nt, Homo sapiens
acaacuggguccacaugua

SEQ ID NO: 353993 - RNA, 19 nt, Homo sapiens
aggaaacgauuacucugua

SEQ ID NO: 353994 - RNA, 19 nt, Homo sapiens
caaggaagauuguuguuua

SEQ ID NO: 353995 - RNA, 19 nt, Homo sapiens
ggaaacaccugaggagaaa

SEQ ID NO: 353996 - RNA, 19 nt, Homo sapiens
guacauagaagguuuguuu

SEQ ID NO: 353997 - RNA, 19 nt, Homo sapiens
guucauaucuaguguuuga

SEQ ID NO: 353998 - RNA, 19 nt, Homo sapiens
gauuuaaacugguccugua

SEQ ID NO: 353999 - RNA, 19 nt, Homo sapiens
ggagaacuggagaauauua

SEQ ID NO: 354000 - RNA, 19 nt, Homo sapiens
caucaagccuaaauacuga

SEQ ID NO: 354001 - RNA, 19 nt, Homo sapiens
caaagagccugauguacug

SEQ ID NO: 354002 - RNA, 19 nt, Homo sapiens
gcucuuaucaguguuaaua

SEQ ID NO: 354003 - RNA, 19 nt, Homo sapiens
gggacaacaucaagccuaa

SEQ ID NO: 354004 - RNA, 19 nt, Homo sapiens
gcacggacccucuacuuca

SEQ ID NO: 354005 - RNA, 19 nt, Homo sapiens
gccacgacauguuugauuu

SEQ ID NO: 354006 - RNA, 19 nt, Homo sapiens
aaauacagcagaagaagua

SEQ ID NO: 354007 - RNA, 19 nt, Homo sapiens
uggagaauauuaagccuaa

SEQ ID NO: 354008 - RNA, 19 nt, Homo sapiens
ggagaugaccgauggaugu

SEQ ID NO: 354009 - RNA, 19 nt, Homo sapiens
uaaggcacuuugcauugua

SEQ ID NO: 354010 - RNA, 19 nt, Homo sapiens
gaauccuucucuuucuuaa

SEQ ID NO: 354011 - RNA, 19 nt, Homo sapiens
ggagauacaacaagacaug

SEQ ID NO: 354012 - RNA, 19 nt, Homo sapiens
agacaaagagccugaugua

SEQ ID NO: 354013 - RNA, 19 nt, Homo sapiens
gaauguuccuggauguuca

SEQ ID NO: 354014 - RNA, 19 nt, Homo sapiens
gaacaaauaaccacgaaaa

SEQ ID NO: 354015 - RNA, 19 nt, Homo sapiens
gugagaaacccaauccuuu

SEQ ID NO: 354016 - RNA, 19 nt, Homo sapiens
gcaugcagcagaagauauu

SEQ ID NO: 354017 - RNA, 19 nt, Homo sapiens
gagaaacccaauccuuuga

SEQ ID NO: 354018 - RNA, 19 nt, Homo sapiens
gaucgaggccauuguacaa

SEQ ID NO: 354019 - RNA, 19 nt, Homo sapiens
guuaauagcaucucagcuu

SEQ ID NO: 354020 - RNA, 19 nt, Homo sapiens
gagaaacaaaccaccauug

SEQ ID NO: 354021 - RNA, 19 nt, Homo sapiens
gccuaaauacugaacaaua

SEQ ID NO: 354022 - RNA, 19 nt, Homo sapiens
gagaacuggagaauauuaa

SEQ ID NO: 354023 - RNA, 19 nt, Homo sapiens
auggagaacuggagaauau

SEQ ID NO: 354024 - RNA, 19 nt, Homo sapiens
guagaauguuccuggaugu

SEQ ID NO: 354025 - RNA, 19 nt, Homo sapiens
gagacuccauggugcaguu

SEQ ID NO: 354026 - RNA, 19 nt, Homo sapiens
caacaucaagccuaaauac

SEQ ID NO: 354027 - RNA, 19 nt, Homo sapiens
ccucagaucaguucuauca

SEQ ID NO: 354028 - RNA, 19 nt, Homo sapiens
ggagaaacaaaccaccauu

SEQ ID NO: 354029 - RNA, 19 nt, Homo sapiens
ugagaaacccaauccuuug

SEQ ID NO: 354030 - RNA, 19 nt, Homo sapiens
ccaaggaagauuguuguuu

SEQ ID NO: 354031 - RNA, 19 nt, Homo sapiens
aaacugguccuguacauag

SEQ ID NO: 354032 - RNA, 19 nt, Homo sapiens
gaagauauucaaggagaug

SEQ ID NO: 354033 - RNA, 19 nt, Homo sapiens
gacaacaucaagccuaaau

SEQ ID NO: 354034 - RNA, 19 nt, Homo sapiens
ugaaccaacuccucaaggu

SEQ ID NO: 354035 - RNA, 19 nt, Homo sapiens
gcacuuugcauuguagaau

SEQ ID NO: 354036 - RNA, 19 nt, Homo sapiens
acaaagagccugauguacu

SEQ ID NO: 354037 - RNA, 19 nt, Homo sapiens
gcaguuaaugcagcaauau

SEQ ID NO: 354038 - RNA, 19 nt, Homo sapiens
uaaacugguccuguacaua

SEQ ID NO: 354039 - RNA, 19 nt, Homo sapiens
ggaggagggauuuaaacug

SEQ ID NO: 354040 - RNA, 19 nt, Homo sapiens
uuaaggcacuuugcauugu

SEQ ID NO: 354041 - RNA, 19 nt, Homo sapiens
ggugagaaacccaauccuu

SEQ ID NO: 354042 - RNA, 19 nt, Homo sapiens
gaauggagaacuggagaau

SEQ ID NO: 354043 - RNA, 19 nt, Homo sapiens
guuccuggauguucauauc

SEQ ID NO: 354044 - RNA, 19 nt, Homo sapiens
ucagaucaguucuaucacu

SEQ ID NO: 354045 - RNA, 19 nt, Homo sapiens
cauuguauuggguuuguua

SEQ ID NO: 354046 - RNA, 19 nt, Homo sapiens
ggauguucauaucuagugu

SEQ ID NO: 354047 - RNA, 19 nt, Homo sapiens
guacaacuuaucaacacaa

SEQ ID NO: 354048 - RNA, 19 nt, Homo sapiens
gaggccauuguacaacuua

SEQ ID NO: 354049 - RNA, 19 nt, Homo sapiens
auagaagguuuguuugaca

SEQ ID NO: 354050 - RNA, 19 nt, Homo sapiens
cauagaagguuuguuugac

SEQ ID NO: 354051 - RNA, 19 nt, Homo sapiens
aagccuaaauacugaacaa

SEQ ID NO: 354052 - RNA, 19 nt, Homo sapiens
acauagaagguuuguuuga

SEQ ID NO: 354053 - RNA, 19 nt, Homo sapiens
ugucucagcacaacagauu

SEQ ID NO: 354054 - RNA, 19 nt, Homo sapiens
caaauaaccacgaaaauac

SEQ ID NO: 354055 - RNA, 19 nt, Homo sapiens
acuaaagaauggagaacug

SEQ ID NO: 354056 - RNA, 19 nt, Homo sapiens
gagauauggcgagagcuuu

SEQ ID NO: 354057 - RNA, 19 nt, Homo sapiens
gccuuucuguggauuaugu

SEQ ID NO: 354058 - RNA, 19 nt, Homo sapiens
ggaacaaauaaccacgaaa

SEQ ID NO: 354059 - RNA, 19 nt, Homo sapiens
uauuaagccuaaggucauu

SEQ ID NO: 354060 - RNA, 19 nt, Homo sapiens
agcagaagauauucaagga

SEQ ID NO: 354061 - RNA, 19 nt, Homo sapiens
gagacuaaagaauggagaa

SEQ ID NO: 354062 - RNA, 19 nt, Homo sapiens
ggacaacaucaagccuaaa

SEQ ID NO: 354063 - RNA, 19 nt, Homo sapiens
ccacgaaaauacagcagaa

SEQ ID NO: 354064 - RNA, 19 nt, Homo sapiens
aggaacaaauaaccacgaa

SEQ ID NO: 354065 - RNA, 19 nt, Homo sapiens
gaacuggagaauauuaagc

SEQ ID NO: 354066 - RNA, 19 nt, Homo sapiens
uuaaacugguccuguacau

SEQ ID NO: 354067 - RNA, 19 nt, Homo sapiens
gcaaaccccugcaugaacu

SEQ ID NO: 354068 - RNA, 19 nt, Homo sapiens
ugccgaagcuugccaacgu

SEQ ID NO: 354069 - RNA, 19 nt, Homo sapiens
cgaggccauuguacaacuu

SEQ ID NO: 354070 - RNA, 19 nt, Homo sapiens
gagaauauuaagccuaagg

SEQ ID NO: 354071 - RNA, 19 nt, Homo sapiens
agccuaaggucauuguugu

SEQ ID NO: 354072 - RNA, 19 nt, Homo sapiens
gacccucuacuucagugua

SEQ ID NO: 354073 - RNA, 19 nt, Homo sapiens
cuuaaggcacuuugcauug

SEQ ID NO: 354074 - RNA, 19 nt, Homo sapiens
aggaaacaccugaggagaa

SEQ ID NO: 354075 - RNA, 19 nt, Homo sapiens
acaucaagccuaaauacug

SEQ ID NO: 354076 - RNA, 19 nt, Homo sapiens
acaacaucaagccuaaaua

SEQ ID NO: 354077 - RNA, 19 nt, Homo sapiens
gccauuguacaacuuauca

SEQ ID NO: 354078 - RNA, 19 nt, Homo sapiens
ggaucgaggccauuguaca

SEQ ID NO: 354079 - RNA, 19 nt, Homo sapiens
ugagauauggcgagagcuu

SEQ ID NO: 354080 - RNA, 19 nt, Homo sapiens
ggacuguaaagacaaagag

SEQ ID NO: 354081 - RNA, 19 nt, Homo sapiens
uguggagacuaaagaaugg

SEQ ID NO: 354082 - RNA, 19 nt, Homo sapiens
ucacuggcacuacagaauc

SEQ ID NO: 354083 - RNA, 19 nt, Homo sapiens
gagccaaggagacucaaac

SEQ ID NO: 354084 - RNA, 19 nt, Homo sapiens
gggaggagggauuuaaacu

SEQ ID NO: 354085 - RNA, 19 nt, Homo sapiens
uccuggauguucauaucua

SEQ ID NO: 354086 - RNA, 19 nt, Homo sapiens
gcaucucagcuuccucaga

SEQ ID NO: 354087 - RNA, 19 nt, Homo sapiens
aaaccaccauugccugacu

SEQ ID NO: 354088 - RNA, 19 nt, Homo sapiens
aaacaccugaggagaaaca

SEQ ID NO: 354089 - RNA, 19 nt, Homo sapiens
gaaaauacagcagaagaag

SEQ ID NO: 354090 - RNA, 19 nt, Homo sapiens
acucaaacccagcagcuau

SEQ ID NO: 354091 - RNA, 19 nt, Homo sapiens
agaagauauucaaggagau

SEQ ID NO: 354092 - RNA, 19 nt, Homo sapiens
caacgugcagcuccuggau

SEQ ID NO: 354093 - RNA, 19 nt, Homo sapiens
gagauacaacaagacaugu

SEQ ID NO: 354094 - RNA, 19 nt, Homo sapiens
gcacuuaacuuuggcauug

SEQ ID NO: 354095 - RNA, 19 nt, Homo sapiens
ccaccuaccuccuaaguga

SEQ ID NO: 354096 - RNA, 19 nt, Homo sapiens
aagcgaagguuccugauuc

SEQ ID NO: 354097 - RNA, 19 nt, Homo sapiens
gaagcgaagguuccugauu

SEQ ID NO: 354098 - RNA, 19 nt, Homo sapiens
gcucuucucuccucugcau

SEQ ID NO: 354099 - RNA, 19 nt, Homo sapiens
caacaucccaacccacuuc

SEQ ID NO: 354100 - RNA, 19 nt, Homo sapiens
caacaaccacggacacaca

SEQ ID NO: 354101 - RNA, 19 nt, Homo sapiens
gauuccaccuaccuccuaa

SEQ ID NO: 354102 - RNA, 19 nt, Homo sapiens
caucaaggccauugugcaa

SEQ ID NO: 354103 - RNA, 19 nt, Homo sapiens
ugacagcaaagauaaggaa

SEQ ID NO: 354104 - RNA, 19 nt, Homo sapiens
uaaacucuccuuccucagu

SEQ ID NO: 354105 - RNA, 19 nt, Homo sapiens
uugugcaacuggugaauga

SEQ ID NO: 354106 - RNA, 19 nt, Homo sapiens
ucaaggccauugugcaacu

SEQ ID NO: 354107 - RNA, 19 nt, Homo sapiens
ccaacccacuucgggagaa

SEQ ID NO: 354108 - RNA, 19 nt, Homo sapiens
gcaccaucagccaucauga

SEQ ID NO: 354109 - RNA, 19 nt, Homo sapiens
ugacggcacacagcaugua

SEQ ID NO: 354110 - RNA, 19 nt, Homo sapiens
ugcaugcacuuaacuuugg

SEQ ID NO: 354111 - RNA, 19 nt, Homo sapiens
cauguaugauuaccugcau

SEQ ID NO: 354112 - RNA, 19 nt, Homo sapiens
ggugacugguggcaucaag

SEQ ID NO: 354113 - RNA, 19 nt, Homo sapiens
agaagaaccgacaggugaa

SEQ ID NO: 354114 - RNA, 19 nt, Homo sapiens
uguggcggcuggagaaugg

SEQ ID NO: 354115 - RNA, 19 nt, Homo sapiens
ugccuucccacaacauuaa

SEQ ID NO: 354116 - RNA, 19 nt, Homo sapiens
gagaaggaauuucauguuc

SEQ ID NO: 354117 - RNA, 19 nt, Homo sapiens
gaagauaugugcccagcau

SEQ ID NO: 354118 - RNA, 19 nt, Homo sapiens
gcuuggaucugaugacuuu

SEQ ID NO: 354119 - RNA, 19 nt, Homo sapiens
ccgaguaccugcaguuuaa

SEQ ID NO: 354120 - RNA, 19 nt, Homo sapiens
ccacagcuauucuggcuuu

SEQ ID NO: 354121 - RNA, 19 nt, Homo sapiens
caacuugauugguaaauuc

SEQ ID NO: 354122 - RNA, 19 nt, Homo sapiens
gaaguaguuuggucagcua

SEQ ID NO: 354123 - RNA, 19 nt, Homo sapiens
ggaccuguguucuuuauca

SEQ ID NO: 354124 - RNA, 19 nt, Homo sapiens
ucacacugcugcuuggaua

SEQ ID NO: 354125 - RNA, 19 nt, Homo sapiens
gcaacuugauugguaaauu

SEQ ID NO: 354126 - RNA, 19 nt, Homo sapiens
gcacaggccuuugccacaa

SEQ ID NO: 354127 - RNA, 19 nt, Homo sapiens
caauggagagugucaauuu

SEQ ID NO: 354128 - RNA, 19 nt, Homo sapiens
gaaaaucccuaccuucaga

SEQ ID NO: 354129 - RNA, 19 nt, Homo sapiens
uggaagagaugaagccaaa

SEQ ID NO: 354130 - RNA, 19 nt, Homo sapiens
guaaauucuucuccacuga

SEQ ID NO: 354131 - RNA, 19 nt, Homo sapiens
gaugggacauucauuugga

SEQ ID NO: 354132 - RNA, 19 nt, Homo sapiens
gcaggcagaucacuuaagg

SEQ ID NO: 354133 - RNA, 19 nt, Homo sapiens
gaacagucuaggaucauaa

SEQ ID NO: 354134 - RNA, 19 nt, Homo sapiens
gcagaagaaucacuugaac

SEQ ID NO: 354135 - RNA, 19 nt, Homo sapiens
gaucauaaccguucuuggu

SEQ ID NO: 354136 - RNA, 19 nt, Homo sapiens
ggagaaggaauuucauguu

SEQ ID NO: 354137 - RNA, 19 nt, Homo sapiens
caacagagaaguaguuugg

SEQ ID NO: 354138 - RNA, 19 nt, Homo sapiens
gaggaccuguguucuuuau

SEQ ID NO: 354139 - RNA, 19 nt, Homo sapiens
agacaaaggacucuggaua

SEQ ID NO: 354140 - RNA, 19 nt, Homo sapiens
ccuguguucuuuaucaaua

SEQ ID NO: 354141 - RNA, 19 nt, Homo sapiens
ccgaggaccuguguucuuu

SEQ ID NO: 354142 - RNA, 19 nt, Homo sapiens
ggaauuucauguucggaau

SEQ ID NO: 354143 - RNA, 19 nt, Homo sapiens
caaccagucugugggcuuu

SEQ ID NO: 354144 - RNA, 19 nt, Homo sapiens
gagcuucuuucgacucuuc

SEQ ID NO: 354145 - RNA, 19 nt, Homo sapiens
gagcuccuaucaagaagug

SEQ ID NO: 354146 - RNA, 19 nt, Homo sapiens
ccaacaccaucucuuccua

SEQ ID NO: 354147 - RNA, 19 nt, Homo sapiens
ugaacagucuaggaucaua

SEQ ID NO: 354148 - RNA, 19 nt, Homo sapiens
gaagaugacagaacaacag

SEQ ID NO: 354149 - RNA, 19 nt, Homo sapiens
caugagcuccuaucaagaa

SEQ ID NO: 354150 - RNA, 19 nt, Homo sapiens
caugaacagucuaggauca

SEQ ID NO: 354151 - RNA, 19 nt, Homo sapiens
gaaccagcccaccaaugaa

SEQ ID NO: 354152 - RNA, 19 nt, Homo sapiens
aggcacaacuggccauuug

SEQ ID NO: 354153 - RNA, 19 nt, Homo sapiens
ugggaucccuugcugauug

SEQ ID NO: 354154 - RNA, 19 nt, Homo sapiens
uuggauaacuggguacuuu

SEQ ID NO: 354155 - RNA, 19 nt, Homo sapiens
caacuggccauuuguaaag

SEQ ID NO: 354156 - RNA, 19 nt, Homo sapiens
ucucauuuccgucgaguua

SEQ ID NO: 354157 - RNA, 19 nt, Homo sapiens
ccacaacagagaaguaguu

SEQ ID NO: 354158 - RNA, 19 nt, Homo sapiens
cccaugagcuccuaucaag

SEQ ID NO: 354159 - RNA, 19 nt, Homo sapiens
agaagcaccucgaccugaa

SEQ ID NO: 354160 - RNA, 19 nt, Homo sapiens
agaaccagcccaccaauga

SEQ ID NO: 354161 - RNA, 19 nt, Homo sapiens
gaagaaucacuugaaccua

SEQ ID NO: 354162 - RNA, 19 nt, Homo sapiens
caagucuucucauuguaug

SEQ ID NO: 354163 - RNA, 19 nt, Homo sapiens
ggauaacuggguacuuuga

SEQ ID NO: 354164 - RNA, 19 nt, Homo sapiens
gaaaccccgucucuacuaa

SEQ ID NO: 354165 - RNA, 19 nt, Homo sapiens
agucugagcacuuuaugua

SEQ ID NO: 354166 - RNA, 19 nt, Homo sapiens
ucauuuccgucgaguuaaa

SEQ ID NO: 354167 - RNA, 19 nt, Homo sapiens
cagcggcaaccaccuauuu

SEQ ID NO: 354168 - RNA, 19 nt, Homo sapiens
gaugacagaacaacagugu

SEQ ID NO: 354169 - RNA, 19 nt, Homo sapiens
gcagacagcauggcucuca

SEQ ID NO: 354170 - RNA, 19 nt, Homo sapiens
ggccagugcugcugcuuca

SEQ ID NO: 354171 - RNA, 19 nt, Homo sapiens
acuggcaacuugauuggua

SEQ ID NO: 354172 - RNA, 19 nt, Homo sapiens
gaagggcaacauugacaug

SEQ ID NO: 354173 - RNA, 19 nt, Homo sapiens
gaaacuacgacgaccaaag

SEQ ID NO: 354174 - RNA, 19 nt, Homo sapiens
gccaaaggacagaaugaaa

SEQ ID NO: 354175 - RNA, 19 nt, Homo sapiens
gaagagaugaagccaaagg

SEQ ID NO: 354176 - RNA, 19 nt, Homo sapiens
gcaccucgaccugaaagaa

SEQ ID NO: 354177 - RNA, 19 nt, Homo sapiens
gaguaccugcaguuuaaua

SEQ ID NO: 354178 - RNA, 19 nt, Homo sapiens
gaaugaaaaucccuaccuu

SEQ ID NO: 354179 - RNA, 19 nt, Homo sapiens
agaagacuauaaucaaugg

SEQ ID NO: 354180 - RNA, 19 nt, Homo sapiens
gagaaauuccagacaaugg

SEQ ID NO: 354181 - RNA, 19 nt, Homo sapiens
ggccaaggagacccaauuu

SEQ ID NO: 354182 - RNA, 19 nt, Homo sapiens
gacaaaggacucuggauac

SEQ ID NO: 354183 - RNA, 19 nt, Homo sapiens
gggaucccuugcugauuga

SEQ ID NO: 354184 - RNA, 19 nt, Homo sapiens
aaauucuucuccacugaaa

SEQ ID NO: 354185 - RNA, 19 nt, Homo sapiens
gaccuguguucuuuaucaa

SEQ ID NO: 354186 - RNA, 19 nt, Homo sapiens
ccugguggcuuggaucuga

SEQ ID NO: 354187 - RNA, 19 nt, Homo sapiens
cuaggagccuucaggacuu

SEQ ID NO: 354188 - RNA, 19 nt, Homo sapiens
ccaagucuucucauuguau

SEQ ID NO: 354189 - RNA, 19 nt, Homo sapiens
gaagcaccucgaccugaaa

SEQ ID NO: 354190 - RNA, 19 nt, Homo sapiens
aauggagagugucaauuug

SEQ ID NO: 354191 - RNA, 19 nt, Homo sapiens
guuccugggucguuucuca

SEQ ID NO: 354192 - RNA, 19 nt, Homo sapiens
gccgaguaccugcaguuua

SEQ ID NO: 354193 - RNA, 19 nt, Homo sapiens
gauaugugcccagcaugaa

SEQ ID NO: 354194 - RNA, 19 nt, Homo sapiens
uguugaagauccugcaaga

SEQ ID NO: 354195 - RNA, 19 nt, Homo sapiens
gcggguaagcgaguguuua

SEQ ID NO: 354196 - RNA, 19 nt, Homo sapiens
ggucagcggcaaccaccua

SEQ ID NO: 354197 - RNA, 19 nt, Homo sapiens
cuucaggacuuuguauuca

SEQ ID NO: 354198 - RNA, 19 nt, Homo sapiens
guucagcuccggcaaguca

SEQ ID NO: 354199 - RNA, 19 nt, Homo sapiens
acugagaaauuccagacaa

SEQ ID NO: 354200 - RNA, 19 nt, Homo sapiens
ucuugucgccugccuguua

SEQ ID NO: 354201 - RNA, 19 nt, Homo sapiens
gaagcagaagaaucacuug

SEQ ID NO: 354202 - RNA, 19 nt, Homo sapiens
gcugcagccuggacaguag

SEQ ID NO: 354203 - RNA, 19 nt, Homo sapiens
ggaagaugacagaacaaca

SEQ ID NO: 354204 - RNA, 19 nt, Homo sapiens
gaagccaaaggacagaaug

SEQ ID NO: 354205 - RNA, 19 nt, Homo sapiens
auugaaagguguaaucaca

SEQ ID NO: 354206 - RNA, 19 nt, Homo sapiens
ucaauggaacaaccuuauu

SEQ ID NO: 354207 - RNA, 19 nt, Homo sapiens
ccaaggagacccaauuucg

SEQ ID NO: 354208 - RNA, 19 nt, Homo sapiens
gggagaaggaauuucaugu

SEQ ID NO: 354209 - RNA, 19 nt, Homo sapiens
gagaaccagcccaccaaug

SEQ ID NO: 354210 - RNA, 19 nt, Homo sapiens
ggccaaggcaggcagauca

SEQ ID NO: 354211 - RNA, 19 nt, Homo sapiens
ugugaggccuggaugugaa

SEQ ID NO: 354212 - RNA, 19 nt, Homo sapiens
ccugaaagaagacuauaau

SEQ ID NO: 354213 - RNA, 19 nt, Homo sapiens
ucuggaugcuuggauguuu

SEQ ID NO: 354214 - RNA, 19 nt, Homo sapiens
ggcugaagcagaagaauca

SEQ ID NO: 354215 - RNA, 19 nt, Homo sapiens
uaauggcaggcgccuauaa

SEQ ID NO: 354216 - RNA, 19 nt, Homo sapiens
gaacauuccuuugguauca

SEQ ID NO: 354217 - RNA, 19 nt, Homo sapiens
ccacggagaucauugcuuu

SEQ ID NO: 354218 - RNA, 19 nt, Homo sapiens
gauggucaguuuaaagaua

SEQ ID NO: 354219 - RNA, 19 nt, Homo sapiens
aaacucaacugccaaguga

SEQ ID NO: 354220 - RNA, 19 nt, Homo sapiens
gagcaacccauuaaucuuu

SEQ ID NO: 354221 - RNA, 19 nt, Homo sapiens
caaaaccucuucuguauuu

SEQ ID NO: 354222 - RNA, 19 nt, Homo sapiens
gaacaaaaccucuucugua

SEQ ID NO: 354223 - RNA, 19 nt, Homo sapiens
guaaaugaccucccuguug

SEQ ID NO: 354224 - RNA, 19 nt, Homo sapiens
acacaagacuucagauuca

SEQ ID NO: 354225 - RNA, 19 nt, Homo sapiens
gcagaagaauuuaagaaac

SEQ ID NO: 354226 - RNA, 19 nt, Homo sapiens
gaugagacuuugagacuag

SEQ ID NO: 354227 - RNA, 19 nt, Homo sapiens
gcagaucacuguaaaugac

SEQ ID NO: 354228 - RNA, 19 nt, Homo sapiens
gaccagccuuucuuccuuu

SEQ ID NO: 354229 - RNA, 19 nt, Homo sapiens
ggaugagacuuugagacua

SEQ ID NO: 354230 - RNA, 19 nt, Homo sapiens
ugauagggcagaagaauuu

SEQ ID NO: 354231 - RNA, 19 nt, Homo sapiens
gcaggcuacugguuuguau

SEQ ID NO: 354232 - RNA, 19 nt, Homo sapiens
gccgaauuguggugucuua

SEQ ID NO: 354233 - RNA, 19 nt, Homo sapiens
ggagaucauugcuuucagu

SEQ ID NO: 354234 - RNA, 19 nt, Homo sapiens
gcaccauugcucaggauua

SEQ ID NO: 354235 - RNA, 19 nt, Homo sapiens
caugaacauuccuuuggua

SEQ ID NO: 354236 - RNA, 19 nt, Homo sapiens
cagccugucugacuacaaa

SEQ ID NO: 354237 - RNA, 19 nt, Homo sapiens
ggagagaccagccuuucuu

SEQ ID NO: 354238 - RNA, 19 nt, Homo sapiens
caucuagcaugggucaaua

SEQ ID NO: 354239 - RNA, 19 nt, Homo sapiens
gggcagccaugagaacaaa

SEQ ID NO: 354240 - RNA, 19 nt, Homo sapiens
guucaggccuuccaguuca

SEQ ID NO: 354241 - RNA, 19 nt, Homo sapiens
gaugauaaggguauucuuc

SEQ ID NO: 354242 - RNA, 19 nt, Homo sapiens
caauacaccuaagaaacaa

SEQ ID NO: 354243 - RNA, 19 nt, Homo sapiens
gaaacucaacugccaagug

SEQ ID NO: 354244 - RNA, 19 nt, Homo sapiens
ggcagaagaauuuaagaaa

SEQ ID NO: 354245 - RNA, 19 nt, Homo sapiens
ccucuugacuucaccuuug

SEQ ID NO: 354246 - RNA, 19 nt, Homo sapiens
ucaauacaccuaagaaaca

SEQ ID NO: 354247 - RNA, 19 nt, Homo sapiens
gcuacugguuuguaugaug

SEQ ID NO: 354248 - RNA, 19 nt, Homo sapiens
aaacacaagacuucagauu

SEQ ID NO: 354249 - RNA, 19 nt, Homo sapiens
gggcagaagaauuuaagaa

SEQ ID NO: 354250 - RNA, 19 nt, Homo sapiens
uaugccagauggucaguuu

SEQ ID NO: 354251 - RNA, 19 nt, Homo sapiens
ggucaauacaccuaagaaa

SEQ ID NO: 354252 - RNA, 19 nt, Homo sapiens
ucacuucugucaucuagca

SEQ ID NO: 354253 - RNA, 19 nt, Homo sapiens
guagagcaacccauuaauc

SEQ ID NO: 354254 - RNA, 19 nt, Homo sapiens
caccauugcucaggauuau

SEQ ID NO: 354255 - RNA, 19 nt, Homo sapiens
cagauggucaguuuaaaga

SEQ ID NO: 354256 - RNA, 19 nt, Homo sapiens
gugcuucuguggauucuca

SEQ ID NO: 354257 - RNA, 19 nt, Homo sapiens
gauuggugcuucuguggau

SEQ ID NO: 354258 - RNA, 19 nt, Homo sapiens
uaguagagcaacccauuaa

SEQ ID NO: 354259 - RNA, 19 nt, Homo sapiens
gauucucacuucugucauc

SEQ ID NO: 354260 - RNA, 19 nt, Homo sapiens
cuacugguuuguaugaugu

SEQ ID NO: 354261 - RNA, 19 nt, Homo sapiens
guaggaauggccugaguug

SEQ ID NO: 354262 - RNA, 19 nt, Homo sapiens
ggucuuaaaggcugaugaa

SEQ ID NO: 354263 - RNA, 19 nt, Homo sapiens
gauagggcagaagaauuua

SEQ ID NO: 354264 - RNA, 19 nt, Homo sapiens
agugagcgcugggcuguuu

SEQ ID NO: 354265 - RNA, 19 nt, Homo sapiens
ggccugaguuggcguugug

SEQ ID NO: 354266 - RNA, 19 nt, Homo sapiens
agaccagccuuucuuccuu

SEQ ID NO: 354267 - RNA, 19 nt, Homo sapiens
gcgcugggcuguuuuagug

SEQ ID NO: 354268 - RNA, 19 nt, Homo sapiens
caaagccacagcuguuaug

SEQ ID NO: 354269 - RNA, 19 nt, Homo sapiens
gccagauggucaguuuaaa

SEQ ID NO: 354270 - RNA, 19 nt, Homo sapiens
uggugucggugguuaguuu

SEQ ID NO: 354271 - RNA, 19 nt, Homo sapiens
gcuggaaaccuggcaguga

SEQ ID NO: 354272 - RNA, 19 nt, Homo sapiens
gcucuguggaugagacuuu

SEQ ID NO: 354273 - RNA, 19 nt, Homo sapiens
aacaaaaccucuucuguau

SEQ ID NO: 354274 - RNA, 19 nt, Homo sapiens
ccaugaacauuccuuuggu

SEQ ID NO: 354275 - RNA, 19 nt, Homo sapiens
uagagcaacccauuaaucu

SEQ ID NO: 354276 - RNA, 19 nt, Homo sapiens
uuaguagagcaacccauua

SEQ ID NO: 354277 - RNA, 19 nt, Homo sapiens
gagagaccagccuuucuuc

SEQ ID NO: 354278 - RNA, 19 nt, Homo sapiens
cggcagaucacuguaaaug

SEQ ID NO: 354279 - RNA, 19 nt, Homo sapiens
gugauagggcagaagaauu

SEQ ID NO: 354280 - RNA, 19 nt, Homo sapiens
gacccgaagcgcaccauug

SEQ ID NO: 354281 - RNA, 19 nt, Homo sapiens
gcaugggucaauacaccua

SEQ ID NO: 354282 - RNA, 19 nt, Homo sapiens
cuucaaagccacagcuguu

SEQ ID NO: 354283 - RNA, 19 nt, Homo sapiens
ggcagaucacuguaaauga

SEQ ID NO: 354284 - RNA, 19 nt, Homo sapiens
ugccagauggucaguuuaa

SEQ ID NO: 354285 - RNA, 19 nt, Homo sapiens
cuggaaaccuggcagugau

SEQ ID NO: 354286 - RNA, 19 nt, Homo sapiens
ucucacuucugucaucuag

SEQ ID NO: 354287 - RNA, 19 nt, Homo sapiens
ucaaagccacagcuguuau

SEQ ID NO: 354288 - RNA, 19 nt, Homo sapiens
ccagauggucaguuuaaag

SEQ ID NO: 354289 - RNA, 19 nt, Homo sapiens
gcgcaccauugcucaggau

SEQ ID NO: 354290 - RNA, 19 nt, Homo sapiens
gugggcaggcuacugguuu

SEQ ID NO: 354291 - RNA, 19 nt, Homo sapiens
ggacugcugauaggaagau

SEQ ID NO: 354292 - RNA, 19 nt, Homo sapiens
ucagugauagggcagaaga

SEQ ID NO: 354293 - RNA, 19 nt, Homo sapiens
gguaggaauggccugaguu

SEQ ID NO: 354294 - RNA, 19 nt, Homo sapiens
gguauucuucggcagauca

SEQ ID NO: 354295 - RNA, 19 nt, Homo sapiens
cgaauuguggugucuuaca

SEQ ID NO: 354296 - RNA, 19 nt, Homo sapiens
ccaaaagagcaaagaauau

SEQ ID NO: 354297 - RNA, 19 nt, Homo sapiens
ugacaaacauggggaagug

SEQ ID NO: 354298 - RNA, 19 nt, Homo sapiens
acucaacugccaagugauu

SEQ ID NO: 354299 - RNA, 19 nt, Homo sapiens
aggaaaauauguuguguuc

SEQ ID NO: 354300 - RNA, 19 nt, Homo sapiens
uguggauucucacuucugu

SEQ ID NO: 354301 - RNA, 19 nt, Homo sapiens
uggaaaccuggcagugaua

SEQ ID NO: 354302 - RNA, 19 nt, Homo sapiens
guuaguuucugcgacuugu

SEQ ID NO: 354303 - RNA, 19 nt, Homo sapiens
gacccaugaacauuccuuu

SEQ ID NO: 354304 - RNA, 19 nt, Homo sapiens
gucaauacaccuaagaaac

SEQ ID NO: 354305 - RNA, 19 nt, Homo sapiens
gaacuuugcugccacaaua

SEQ ID NO: 354306 - RNA, 19 nt, Homo sapiens
gaagacaacugcaaucaaa

SEQ ID NO: 354307 - RNA, 19 nt, Homo sapiens
gcauugaacuucuuuagua

SEQ ID NO: 354308 - RNA, 19 nt, Homo sapiens
gcagagaacucauaaagga

SEQ ID NO: 354309 - RNA, 19 nt, Homo sapiens
gaaacaagcuauauugaag

SEQ ID NO: 354310 - RNA, 19 nt, Homo sapiens
ucaguaaucugucgcauuu

SEQ ID NO: 354311 - RNA, 19 nt, Homo sapiens
gaaacucucugacuuugga

SEQ ID NO: 354312 - RNA, 19 nt, Homo sapiens
gcaggaaacucucugacuu

SEQ ID NO: 354313 - RNA, 19 nt, Homo sapiens
ugacaaacaucaucaagau

SEQ ID NO: 354314 - RNA, 19 nt, Homo sapiens
ucacugaucuucucacuca

SEQ ID NO: 354315 - RNA, 19 nt, Homo sapiens
caagagacacccuuuguaa

SEQ ID NO: 354316 - RNA, 19 nt, Homo sapiens
gcaaaucuguauaaaugug

SEQ ID NO: 354317 - RNA, 19 nt, Homo sapiens
gacaauacccagcagcuua

SEQ ID NO: 354318 - RNA, 19 nt, Homo sapiens
ggaaacaagcuauauugaa

SEQ ID NO: 354319 - RNA, 19 nt, Homo sapiens
acacaagacugucauuaga

SEQ ID NO: 354320 - RNA, 19 nt, Homo sapiens
guaaagccauggacagaau

SEQ ID NO: 354321 - RNA, 19 nt, Homo sapiens
ggauugaggucuuggacaa

SEQ ID NO: 354322 - RNA, 19 nt, Homo sapiens
caaaguauugcgcuuauuu

SEQ ID NO: 354323 - RNA, 19 nt, Homo sapiens
ggacaggaaacaagcuaua

SEQ ID NO: 354324 - RNA, 19 nt, Homo sapiens
gcaagagacacccuuugua

SEQ ID NO: 354325 - RNA, 19 nt, Homo sapiens
cagcagauguugacuaaag

SEQ ID NO: 354326 - RNA, 19 nt, Homo sapiens
gcauauaaggcuaaaugua

SEQ ID NO: 354327 - RNA, 19 nt, Homo sapiens
gagcauauaaggcuaaaug

SEQ ID NO: 354328 - RNA, 19 nt, Homo sapiens
aaucugaaaugacaggaua

SEQ ID NO: 354329 - RNA, 19 nt, Homo sapiens
ugaauuacaguacugcuua

SEQ ID NO: 354330 - RNA, 19 nt, Homo sapiens
caagcuauauugaagacaa

SEQ ID NO: 354331 - RNA, 19 nt, Homo sapiens
gaaacacuuugaggacauu

SEQ ID NO: 354332 - RNA, 19 nt, Homo sapiens
gaaaugacaggauaugagu

SEQ ID NO: 354333 - RNA, 19 nt, Homo sapiens
ggagaaacaacaaauaagu

SEQ ID NO: 354334 - RNA, 19 nt, Homo sapiens
gauccaagcccauguauac

SEQ ID NO: 354335 - RNA, 19 nt, Homo sapiens
gauggagaaacaacaaaua

SEQ ID NO: 354336 - RNA, 19 nt, Homo sapiens
agacagccauccaaaauua

SEQ ID NO: 354337 - RNA, 19 nt, Homo sapiens
uucaagagcuggacagauu

SEQ ID NO: 354338 - RNA, 19 nt, Homo sapiens
caugagcuuucacgagaua

SEQ ID NO: 354339 - RNA, 19 nt, Homo sapiens
ggaaacacuuugaggacau

SEQ ID NO: 354340 - RNA, 19 nt, Homo sapiens
cauucaagcuucauauaug

SEQ ID NO: 354341 - RNA, 19 nt, Homo sapiens
gaauuacaguacugcuuau

SEQ ID NO: 354342 - RNA, 19 nt, Homo sapiens
ccaacuauuucuuucauca

SEQ ID NO: 354343 - RNA, 19 nt, Homo sapiens
gagacuccauaaaggcaua

SEQ ID NO: 354344 - RNA, 19 nt, Homo sapiens
gagauccaacuauuucuuu

SEQ ID NO: 354345 - RNA, 19 nt, Homo sapiens
gcccaucccucgaguggaa

SEQ ID NO: 354346 - RNA, 19 nt, Homo sapiens
acuaaaggcuugguuggua

SEQ ID NO: 354347 - RNA, 19 nt, Homo sapiens
gagaagacagccauccaaa

SEQ ID NO: 354348 - RNA, 19 nt, Homo sapiens
uggaauacauggaggaaga

SEQ ID NO: 354349 - RNA, 19 nt, Homo sapiens
gaaauuggaauccuuugca

SEQ ID NO: 354350 - RNA, 19 nt, Homo sapiens
guugguagauauucaggaa

SEQ ID NO: 354351 - RNA, 19 nt, Homo sapiens
aaucguaaccuaugaaguu

SEQ ID NO: 354352 - RNA, 19 nt, Homo sapiens
aaacacaagacugucauua

SEQ ID NO: 354353 - RNA, 19 nt, Homo sapiens
gccaaaguauugcgcuuau

SEQ ID NO: 354354 - RNA, 19 nt, Homo sapiens
gucauccuuuggugaauua

SEQ ID NO: 354355 - RNA, 19 nt, Homo sapiens
acaagacugucauuagaau

SEQ ID NO: 354356 - RNA, 19 nt, Homo sapiens
ggucaucuuugauuuagag

SEQ ID NO: 354357 - RNA, 19 nt, Homo sapiens
ccaaaggauugaggucuug

SEQ ID NO: 354358 - RNA, 19 nt, Homo sapiens
ugcagcagauguugacuaa

SEQ ID NO: 354359 - RNA, 19 nt, Homo sapiens
cguaaccuaugaaguuuau

SEQ ID NO: 354360 - RNA, 19 nt, Homo sapiens
cauauaugcuuugcagaga

SEQ ID NO: 354361 - RNA, 19 nt, Homo sapiens
ggagaugcaccacgcaaga

SEQ ID NO: 354362 - RNA, 19 nt, Homo sapiens
gccacaauuuacugguuua

SEQ ID NO: 354363 - RNA, 19 nt, Homo sapiens
caggaaacaagcuauauug

SEQ ID NO: 354364 - RNA, 19 nt, Homo sapiens
gggcuuaauauaaaucgua

SEQ ID NO: 354365 - RNA, 19 nt, Homo sapiens
uagagaugauaaucccaua

SEQ ID NO: 354366 - RNA, 19 nt, Homo sapiens
gugcugggcuccugucauc

SEQ ID NO: 354367 - RNA, 19 nt, Homo sapiens
gauaaucccauacucucaa

SEQ ID NO: 354368 - RNA, 19 nt, Homo sapiens
gaagacagccauccaaaau

SEQ ID NO: 354369 - RNA, 19 nt, Homo sapiens
ggagaagacagccauccaa

SEQ ID NO: 354370 - RNA, 19 nt, Homo sapiens
gaacucauaaaggagcaua

SEQ ID NO: 354371 - RNA, 19 nt, Homo sapiens
acaauuuacugguuuacug

SEQ ID NO: 354372 - RNA, 19 nt, Homo sapiens
ccugaugaauacauugaaa

SEQ ID NO: 354373 - RNA, 19 nt, Homo sapiens
caggaaacucucugacuuu

SEQ ID NO: 354374 - RNA, 19 nt, Homo sapiens
ucgcauuucaucaagauua

SEQ ID NO: 354375 - RNA, 19 nt, Homo sapiens
gcagugcccuccagaaaau

SEQ ID NO: 354376 - RNA, 19 nt, Homo sapiens
gcacacaguacaucagaca

SEQ ID NO: 354377 - RNA, 19 nt, Homo sapiens
gaucuugaggcaugacauu

SEQ ID NO: 354378 - RNA, 19 nt, Homo sapiens
caaacaucaucaagaucuu

SEQ ID NO: 354379 - RNA, 19 nt, Homo sapiens
gagaaacaacaaauaaguc

SEQ ID NO: 354380 - RNA, 19 nt, Homo sapiens
caagauggagaaacaacaa

SEQ ID NO: 354381 - RNA, 19 nt, Homo sapiens
gccuaaaccugucuaaucg

SEQ ID NO: 354382 - RNA, 19 nt, Homo sapiens
ggagauccaacuauuucuu

SEQ ID NO: 354383 - RNA, 19 nt, Homo sapiens
cugauuccauuaacaguga

SEQ ID NO: 354384 - RNA, 19 nt, Homo sapiens
ccaaaguauugcgcuuauu

SEQ ID NO: 354385 - RNA, 19 nt, Homo sapiens
cauuaacagugaaauugga

SEQ ID NO: 354386 - RNA, 19 nt, Homo sapiens
gauuuuggcugauuccauu

SEQ ID NO: 354387 - RNA, 19 nt, Homo sapiens
gggugcaccugaugaauac

SEQ ID NO: 354388 - RNA, 19 nt, Homo sapiens
ugacauugccuacaacuac

SEQ ID NO: 354389 - RNA, 19 nt, Homo sapiens
gcgcuuauuugaggagaau

SEQ ID NO: 354390 - RNA, 19 nt, Homo sapiens
cgcauuucaucaagauuaa

SEQ ID NO: 354391 - RNA, 19 nt, Homo sapiens
guacuguggcuuccaugaa

SEQ ID NO: 354392 - RNA, 19 nt, Homo sapiens
cccauaacuuccaguauca

SEQ ID NO: 354393 - RNA, 19 nt, Homo sapiens
uaauaaaacucugcaccua

SEQ ID NO: 354394 - RNA, 19 nt, Homo sapiens
aguaaucugucgcauuuca

SEQ ID NO: 354395 - RNA, 19 nt, Homo sapiens
gaugauaaucccauacucu

SEQ ID NO: 354396 - RNA, 19 nt, Homo sapiens
gggcuccugucauccuuug

SEQ ID NO: 354397 - RNA, 19 nt, Homo sapiens
cgccacaauuuacugguuu

SEQ ID NO: 354398 - RNA, 19 nt, Homo sapiens
guaaaccugacccacauug

SEQ ID NO: 354399 - RNA, 19 nt, Homo sapiens
ggccaaaguauugcgcuua

SEQ ID NO: 354400 - RNA, 19 nt, Homo sapiens
ugguagauauucaggaaau

SEQ ID NO: 354401 - RNA, 19 nt, Homo sapiens
uuacaagcauugaacuucu

SEQ ID NO: 354402 - RNA, 19 nt, Homo sapiens
uuuacaagauggagaaaca

SEQ ID NO: 354403 - RNA, 19 nt, Homo sapiens
ccacugcgguccuggaaaa

SEQ ID NO: 354404 - RNA, 19 nt, Homo sapiens
acaauacccagcagcuuaa

SEQ ID NO: 354405 - RNA, 19 nt, Homo sapiens
ggacagacccuuccucuuu

SEQ ID NO: 354406 - RNA, 19 nt, Homo sapiens
gaguguaggugacuuguuu

SEQ ID NO: 354407 - RNA, 19 nt, Homo sapiens
gcuaugggauucaagauug

SEQ ID NO: 354408 - RNA, 19 nt, Homo sapiens
guuaaugacucuuucugaa

SEQ ID NO: 354409 - RNA, 19 nt, Homo sapiens
uaaacucgcuccuaguguu

SEQ ID NO: 354410 - RNA, 19 nt, Homo sapiens
agaagaaacuccgaagaaa

SEQ ID NO: 354411 - RNA, 19 nt, Homo sapiens
ggagagagccagauucauc

SEQ ID NO: 354412 - RNA, 19 nt, Homo sapiens
ggagaugcaucgggaaaga

SEQ ID NO: 354413 - RNA, 19 nt, Homo sapiens
ggacagaacuuuccccaau

SEQ ID NO: 354414 - RNA, 19 nt, Homo sapiens
ccaauguguucaauagauu

SEQ ID NO: 354415 - RNA, 19 nt, Homo sapiens
gacagacccuuccucuuug

SEQ ID NO: 354416 - RNA, 19 nt, Homo sapiens
gaaggaagagaagacauuu

SEQ ID NO: 354417 - RNA, 19 nt, Homo sapiens
ggauucaacuaccuuagau

SEQ ID NO: 354418 - RNA, 19 nt, Homo sapiens
ggacaaaacuggagaugca

SEQ ID NO: 354419 - RNA, 19 nt, Homo sapiens
ggaaagacgccuucaucug

SEQ ID NO: 354420 - RNA, 19 nt, Homo sapiens
ggacagagugguuuccaau

SEQ ID NO: 354421 - RNA, 19 nt, Homo sapiens
guaggugacuuguuuacuc

SEQ ID NO: 354422 - RNA, 19 nt, Homo sapiens
gggaaugaccgacauguuc

SEQ ID NO: 354423 - RNA, 19 nt, Homo sapiens
gagaauugcacacagaugu

SEQ ID NO: 354424 - RNA, 19 nt, Homo sapiens
ccgaggagaucaucaugga

SEQ ID NO: 354425 - RNA, 19 nt, Homo sapiens
ggaaugaccgacauguuca

SEQ ID NO: 354426 - RNA, 19 nt, Homo sapiens
cuagagaaccugggaauga

SEQ ID NO: 354427 - RNA, 19 nt, Homo sapiens
acagagugguuuccaaugu

SEQ ID NO: 354428 - RNA, 19 nt, Homo sapiens
ggagggguguaccuaaaua

SEQ ID NO: 354429 - RNA, 19 nt, Homo sapiens
ugacuuguuuacucauuga

SEQ ID NO: 354430 - RNA, 19 nt, Homo sapiens
ggagcacggucaagcaagu

SEQ ID NO: 354431 - RNA, 19 nt, Homo sapiens
aagaagaaacuccgaagaa

SEQ ID NO: 354432 - RNA, 19 nt, Homo sapiens
ucaagcagcuaugggauuc

SEQ ID NO: 354433 - RNA, 19 nt, Homo sapiens
gaagaaacuccgaagaaaa

SEQ ID NO: 354434 - RNA, 19 nt, Homo sapiens
ggugacuuguuuacucauu

SEQ ID NO: 354435 - RNA, 19 nt, Homo sapiens
ugaaggaagagaagacauu

SEQ ID NO: 354436 - RNA, 19 nt, Homo sapiens
gagagagccagauucauca

SEQ ID NO: 354437 - RNA, 19 nt, Homo sapiens
aagcacaacucccuuaagg

SEQ ID NO: 354438 - RNA, 19 nt, Homo sapiens
cgacauguucagacaguuu

SEQ ID NO: 354439 - RNA, 19 nt, Homo sapiens
caacuugcuugggaaagga

SEQ ID NO: 354440 - RNA, 19 nt, Homo sapiens
caaaagguaugaucagcaa

SEQ ID NO: 354441 - RNA, 19 nt, Homo sapiens
aaacagugugcauggguua

SEQ ID NO: 354442 - RNA, 19 nt, Homo sapiens
ugaccgacauguucagaca

SEQ ID NO: 354443 - RNA, 19 nt, Homo sapiens
acagaacuuuccccaauua

SEQ ID NO: 354444 - RNA, 19 nt, Homo sapiens
gcucaucagccacuggaaa

SEQ ID NO: 354445 - RNA, 19 nt, Homo sapiens
gcaaggcaccucugagaac

SEQ ID NO: 354446 - RNA, 19 nt, Homo sapiens
cagagugguuuccaaugug

SEQ ID NO: 354447 - RNA, 19 nt, Homo sapiens
cuugagugcuuguuagaga

SEQ ID NO: 354448 - RNA, 19 nt, Homo sapiens
agagaagacauuugccuuu

SEQ ID NO: 354449 - RNA, 19 nt, Homo sapiens
ggugaaugcccucuacuuc

SEQ ID NO: 354450 - RNA, 19 nt, Homo sapiens
gagaaacccagcagcagau

SEQ ID NO: 354451 - RNA, 19 nt, Homo sapiens
ccaccuggccucagacuuc

SEQ ID NO: 354452 - RNA, 19 nt, Homo sapiens
gagccagauucaucaucaa

SEQ ID NO: 354453 - RNA, 19 nt, Homo sapiens
gagacaggcagcucggauu

SEQ ID NO: 354454 - RNA, 19 nt, Homo sapiens
gaugaggacagagugguuu

SEQ ID NO: 354455 - RNA, 19 nt, Homo sapiens
uaggugacuuguuuacuca

SEQ ID NO: 354456 - RNA, 19 nt, Homo sapiens
ccaaaggccaguggaagaa

SEQ ID NO: 354457 - RNA, 19 nt, Homo sapiens
gccaaaggccaguggaaga

SEQ ID NO: 354458 - RNA, 19 nt, Homo sapiens
gcagcuaugggauucaaga

SEQ ID NO: 354459 - RNA, 19 nt, Homo sapiens
cagugugcauggguuauuu

SEQ ID NO: 354460 - RNA, 19 nt, Homo sapiens
gcucagaccaacaaguuca

SEQ ID NO: 354461 - RNA, 19 nt, Homo sapiens
agagccagauucaucauca

SEQ ID NO: 354462 - RNA, 19 nt, Homo sapiens
gcagguggcagagugaaug

SEQ ID NO: 354463 - RNA, 19 nt, Homo sapiens
gcugacaacaggaggagaa

SEQ ID NO: 354464 - RNA, 19 nt, Homo sapiens
uccaauguguucaauagau

SEQ ID NO: 354465 - RNA, 19 nt, Homo sapiens
agagaaguuugaagcacaa

SEQ ID NO: 354466 - RNA, 19 nt, Homo sapiens
ugggagaauugcacacaga

SEQ ID NO: 354467 - RNA, 19 nt, Homo sapiens
gugacuuguuuacucauug

SEQ ID NO: 354468 - RNA, 19 nt, Homo sapiens
ugccaucacucuuguacug

SEQ ID NO: 354469 - RNA, 19 nt, Homo sapiens
gggacacccucagcauguu

SEQ ID NO: 354470 - RNA, 19 nt, Homo sapiens
gauucaacuaccuuagaua

SEQ ID NO: 354471 - RNA, 19 nt, Homo sapiens
uuuccaauguguucaauag

SEQ ID NO: 354472 - RNA, 19 nt, Homo sapiens
gggugaagacacacacaaa

SEQ ID NO: 354473 - RNA, 19 nt, Homo sapiens
acaggcagcucggauucaa

SEQ ID NO: 354474 - RNA, 19 nt, Homo sapiens
gacagaacuuuccccaauu

SEQ ID NO: 354475 - RNA, 19 nt, Homo sapiens
gaagcacaacucccuuaag

SEQ ID NO: 354476 - RNA, 19 nt, Homo sapiens
ugaagcacaacucccuuaa

SEQ ID NO: 354477 - RNA, 19 nt, Homo sapiens
caaggcaccucugagaacu

SEQ ID NO: 354478 - RNA, 19 nt, Homo sapiens
aagugaagaucgaggugaa

SEQ ID NO: 354479 - RNA, 19 nt, Homo sapiens
aaacccagcagcagauuca

SEQ ID NO: 354480 - RNA, 19 nt, Homo sapiens
ggagaauugcacacagaug

SEQ ID NO: 354481 - RNA, 19 nt, Homo sapiens
gcccuugagugcuuguuag

SEQ ID NO: 354482 - RNA, 19 nt, Homo sapiens
caaaggccaguggaagaaa

SEQ ID NO: 354483 - RNA, 19 nt, Homo sapiens
aaagaagaaacuccgaaga

SEQ ID NO: 354484 - RNA, 19 nt, Homo sapiens
gggaaagacgccuucaucu

SEQ ID NO: 354485 - RNA, 19 nt, Homo sapiens
acaauuucauccuccuuca

SEQ ID NO: 354486 - RNA, 19 nt, Homo sapiens
gcuggugaaugcccucuac

SEQ ID NO: 354487 - RNA, 19 nt, Homo sapiens
guggagagagccagauuca

SEQ ID NO: 354488 - RNA, 19 nt, Homo sapiens
gaacuucaggaugcagaug

SEQ ID NO: 354489 - RNA, 19 nt, Homo sapiens
uuauaggaauagaggaaga

SEQ ID NO: 354490 - RNA, 19 nt, Homo sapiens
ucucugcccucaccaacau

SEQ ID NO: 354491 - RNA, 19 nt, Homo sapiens
gaaacccagcagcagauuc

SEQ ID NO: 354492 - RNA, 19 nt, Homo sapiens
gcccuugucuuuggugaag

SEQ ID NO: 354493 - RNA, 19 nt, Homo sapiens
uggcucagaccaacaaguu

SEQ ID NO: 354494 - RNA, 19 nt, Homo sapiens
agagugguuuccaaugugu

SEQ ID NO: 354495 - RNA, 19 nt, Homo sapiens
ucgcaaggcaccucugaga

SEQ ID NO: 354496 - RNA, 19 nt, Homo sapiens
ggggagggguguaccuaaa

SEQ ID NO: 354497 - RNA, 19 nt, Homo sapiens
gugcauggguuauuuugga

SEQ ID NO: 354498 - RNA, 19 nt, Homo sapiens
cacauugccaucacucuug

SEQ ID NO: 354499 - RNA, 19 nt, Homo sapiens
gagaugcaucgggaaagaa

SEQ ID NO: 354500 - RNA, 19 nt, Homo sapiens
gcuccuaguguuucuuugu

SEQ ID NO: 354501 - RNA, 19 nt, Homo sapiens
ucacauugccaucacucuu

SEQ ID NO: 354502 - RNA, 19 nt, Homo sapiens
cagaccugguucccacuga

SEQ ID NO: 354503 - RNA, 19 nt, Homo sapiens
auccacagcugucauaguc

SEQ ID NO: 354504 - RNA, 19 nt, Homo sapiens
ccacuggaaaggcaacaug

SEQ ID NO: 354505 - RNA, 19 nt, Homo sapiens
ggaaugaccuguuucuuuc

SEQ ID NO: 354506 - RNA, 19 nt, Homo sapiens
ggagaggaaugaccuguuu

SEQ ID NO: 354507 - RNA, 19 nt, Homo sapiens
ccaaggugcuucaguuuaa

SEQ ID NO: 354508 - RNA, 19 nt, Homo sapiens
gcuaaacauuggauacaua

SEQ ID NO: 354509 - RNA, 19 nt, Homo sapiens
uaacaugacaacccuauua

SEQ ID NO: 354510 - RNA, 19 nt, Homo sapiens
ggucaagacucaaaccaaa

SEQ ID NO: 354511 - RNA, 19 nt, Homo sapiens
gcaguagacuuccuagaau

SEQ ID NO: 354512 - RNA, 19 nt, Homo sapiens
aaauaaaccugcuuccaaa

SEQ ID NO: 354513 - RNA, 19 nt, Homo sapiens
ggcacaagcugcagauaaa

SEQ ID NO: 354514 - RNA, 19 nt, Homo sapiens
caaaauggcugaagaugaa

SEQ ID NO: 354515 - RNA, 19 nt, Homo sapiens
gacagcaacucagagaaua

SEQ ID NO: 354516 - RNA, 19 nt, Homo sapiens
gaaauaaccuaugacaaac

SEQ ID NO: 354517 - RNA, 19 nt, Homo sapiens
gagaauaaccagagaacaa

SEQ ID NO: 354518 - RNA, 19 nt, Homo sapiens
gcgcacaccuguacagaug

SEQ ID NO: 354519 - RNA, 19 nt, Homo sapiens
gagaacaaccagauugaaa

SEQ ID NO: 354520 - RNA, 19 nt, Homo sapiens
gaucaugcccauuuagauu

SEQ ID NO: 354521 - RNA, 19 nt, Homo sapiens
uaaauaaaccugcuuccaa

SEQ ID NO: 354522 - RNA, 19 nt, Homo sapiens
aagaugaaguugagguaua

SEQ ID NO: 354523 - RNA, 19 nt, Homo sapiens
ggugaaugcugucuacuuc

SEQ ID NO: 354524 - RNA, 19 nt, Homo sapiens
ggaauuauuuacuggaaag

SEQ ID NO: 354525 - RNA, 19 nt, Homo sapiens
ccuaaaggcucagauucua

SEQ ID NO: 354526 - RNA, 19 nt, Homo sapiens
ccuagaaugugcagaagaa

SEQ ID NO: 354527 - RNA, 19 nt, Homo sapiens
gaaauauuacuccucagaa

SEQ ID NO: 354528 - RNA, 19 nt, Homo sapiens
cagaugaaauugccgaugu

SEQ ID NO: 354529 - RNA, 19 nt, Homo sapiens
gaacaaccagauugaaaca

SEQ ID NO: 354530 - RNA, 19 nt, Homo sapiens
gaaagugaaauaaccuaug

SEQ ID NO: 354531 - RNA, 19 nt, Homo sapiens
gccuuuaauuguucucaua

SEQ ID NO: 354532 - RNA, 19 nt, Homo sapiens
uaaaccugcuuccaaacaa

SEQ ID NO: 354533 - RNA, 19 nt, Homo sapiens
ccucagaauugcuauuuca

SEQ ID NO: 354534 - RNA, 19 nt, Homo sapiens
gaagagcauuaugaacuca

SEQ ID NO: 354535 - RNA, 19 nt, Homo sapiens
gauguuagcauguucuugu

SEQ ID NO: 354536 - RNA, 19 nt, Homo sapiens
ggcaguagacuuccuagaa

SEQ ID NO: 354537 - RNA, 19 nt, Homo sapiens
gggaauuauuuacuggaaa

SEQ ID NO: 354538 - RNA, 19 nt, Homo sapiens
gcucacugccuauuuaaug

SEQ ID NO: 354539 - RNA, 19 nt, Homo sapiens
ugacaacccuauuaaucau

SEQ ID NO: 354540 - RNA, 19 nt, Homo sapiens
caacuucugcuacccacua

SEQ ID NO: 354541 - RNA, 19 nt, Homo sapiens
gcuuggagcugcuggaaag

SEQ ID NO: 354542 - RNA, 19 nt, Homo sapiens
ucucagcucugcaaucaau

SEQ ID NO: 354543 - RNA, 19 nt, Homo sapiens
gccaaggugcuucaguuua

SEQ ID NO: 354544 - RNA, 19 nt, Homo sapiens
ggaggacgccuucaacaag

SEQ ID NO: 354545 - RNA, 19 nt, Homo sapiens
gcacaccuguacagaugau

SEQ ID NO: 354546 - RNA, 19 nt, Homo sapiens
aaacuccauuugagaagaa

SEQ ID NO: 354547 - RNA, 19 nt, Homo sapiens
caaaaucccaaacuuguua

SEQ ID NO: 354548 - RNA, 19 nt, Homo sapiens
cacaggagguguuaugaca

SEQ ID NO: 354549 - RNA, 19 nt, Homo sapiens
gaaacaauggaggaucuuu

SEQ ID NO: 354550 - RNA, 19 nt, Homo sapiens
cuacauauuucugcucuuc

SEQ ID NO: 354551 - RNA, 19 nt, Homo sapiens
ccagagaacaaccagauug

SEQ ID NO: 354552 - RNA, 19 nt, Homo sapiens
ugaaguugagguauacaua

SEQ ID NO: 354553 - RNA, 19 nt, Homo sapiens
gaaggguaguuauccugau

SEQ ID NO: 354554 - RNA, 19 nt, Homo sapiens
gcugugugccucagaauug

SEQ ID NO: 354555 - RNA, 19 nt, Homo sapiens
aggaaugaccuguuucuuu

SEQ ID NO: 354556 - RNA, 19 nt, Homo sapiens
gagcauugcccgucagaca

SEQ ID NO: 354557 - RNA, 19 nt, Homo sapiens
ggaaagugaaauaaccuau

SEQ ID NO: 354558 - RNA, 19 nt, Homo sapiens
caugacaacccuauuaauc

SEQ ID NO: 354559 - RNA, 19 nt, Homo sapiens
acaagggacgggccaauuu

SEQ ID NO: 354560 - RNA, 19 nt, Homo sapiens
acucuuugcccucaauuua

SEQ ID NO: 354561 - RNA, 19 nt, Homo sapiens
ggacauggaggcccacagu

SEQ ID NO: 354562 - RNA, 19 nt, Homo sapiens
ucucucagcucugcaauca

SEQ ID NO: 354563 - RNA, 19 nt, Homo sapiens
gaagaugaaguugagguau

SEQ ID NO: 354564 - RNA, 19 nt, Homo sapiens
gcuuuauccuuuccgugua

SEQ ID NO: 354565 - RNA, 19 nt, Homo sapiens
uaaaggcucagauucuaga

SEQ ID NO: 354566 - RNA, 19 nt, Homo sapiens
caguagacuuccuagaaug

SEQ ID NO: 354567 - RNA, 19 nt, Homo sapiens
uagaagagcauuaugaacu

SEQ ID NO: 354568 - RNA, 19 nt, Homo sapiens
guuaugugcauuucuagaa

SEQ ID NO: 354569 - RNA, 19 nt, Homo sapiens
cagagaacaaccagauuga

SEQ ID NO: 354570 - RNA, 19 nt, Homo sapiens
ucuuugcccucaauuuauu

SEQ ID NO: 354571 - RNA, 19 nt, Homo sapiens
ggaaaacuccauuugagaa

SEQ ID NO: 354572 - RNA, 19 nt, Homo sapiens
gcugucuacuucaaaggaa

SEQ ID NO: 354573 - RNA, 19 nt, Homo sapiens
gaugaucuguuaauuuccu

SEQ ID NO: 354574 - RNA, 19 nt, Homo sapiens
caauggaggaucuuugugu

SEQ ID NO: 354575 - RNA, 19 nt, Homo sapiens
uuucugcucuucugaacaa

SEQ ID NO: 354576 - RNA, 19 nt, Homo sapiens
uggccaaggugcuucaguu

SEQ ID NO: 354577 - RNA, 19 nt, Homo sapiens
agggagaacuggacaugga

SEQ ID NO: 354578 - RNA, 19 nt, Homo sapiens
guacuugcgugaaaagcua

SEQ ID NO: 354579 - RNA, 19 nt, Homo sapiens
auugcucacugccuauuua

SEQ ID NO: 354580 - RNA, 19 nt, Homo sapiens
caacaaguggaccagcaaa

SEQ ID NO: 354581 - RNA, 19 nt, Homo sapiens
auacauagaagaccuaaag

SEQ ID NO: 354582 - RNA, 19 nt, Homo sapiens
gugaaaagcuaaacauugg

SEQ ID NO: 354583 - RNA, 19 nt, Homo sapiens
ggaugguccuggugaaugc

SEQ ID NO: 354584 - RNA, 19 nt, Homo sapiens
acauggaggcccacaguuu

SEQ ID NO: 354585 - RNA, 19 nt, Homo sapiens
agaagagcauuaugaacuc

SEQ ID NO: 354586 - RNA, 19 nt, Homo sapiens
ugaagaugaaguugaggua

SEQ ID NO: 354587 - RNA, 19 nt, Homo sapiens
cccauaugcuggagauguu

SEQ ID NO: 354588 - RNA, 19 nt, Homo sapiens
ccaaacuuguuaccugaag

SEQ ID NO: 354589 - RNA, 19 nt, Homo sapiens
cacagggaauuauuuacug

SEQ ID NO: 354590 - RNA, 19 nt, Homo sapiens
aaacaauggaggaucuuug

SEQ ID NO: 354591 - RNA, 19 nt, Homo sapiens
caaggugcuucaguuuaau

SEQ ID NO: 354592 - RNA, 19 nt, Homo sapiens
gggaucaugcccauuuaga

SEQ ID NO: 354593 - RNA, 19 nt, Homo sapiens
ggccaaggugcuucaguuu

SEQ ID NO: 354594 - RNA, 19 nt, Homo sapiens
gaaugaggagggcacugaa

SEQ ID NO: 354595 - RNA, 19 nt, Homo sapiens
uggagcugcuggaaaguga

SEQ ID NO: 354596 - RNA, 19 nt, Homo sapiens
gaccuaaaggcucagauuc

SEQ ID NO: 354597 - RNA, 19 nt, Homo sapiens
gcucagcgcacaccuguac

SEQ ID NO: 354598 - RNA, 19 nt, Homo sapiens
agaaauauuacuccucaga

SEQ ID NO: 354599 - RNA, 19 nt, Homo sapiens
aauaagcuguuuggugaga

SEQ ID NO: 354600 - RNA, 19 nt, Homo sapiens
cauccacagggaauuauuu

SEQ ID NO: 354601 - RNA, 19 nt, Homo sapiens
cauggaggcccacaguuug

SEQ ID NO: 354602 - RNA, 19 nt, Homo sapiens
gccaauuucucagggaugu

SEQ ID NO: 354603 - RNA, 19 nt, Homo sapiens
gauucuagaacucccauau

SEQ ID NO: 354604 - RNA, 19 nt, Homo sapiens
gaaugcugucuacuucaaa

SEQ ID NO: 354605 - RNA, 19 nt, Homo sapiens
gaagagagguucagcuaaa

SEQ ID NO: 354606 - RNA, 19 nt, Homo sapiens
gaagagaacugcaacugaa

SEQ ID NO: 354607 - RNA, 19 nt, Homo sapiens
gaagaaauauacacgguuu

SEQ ID NO: 354608 - RNA, 19 nt, Homo sapiens
uacaugagcuuuacagaua

SEQ ID NO: 354609 - RNA, 19 nt, Homo sapiens
ugaauuacuuggacaguua

SEQ ID NO: 354610 - RNA, 19 nt, Homo sapiens
gacaggagguggccauuaa

SEQ ID NO: 354611 - RNA, 19 nt, Homo sapiens
caacaaagaacaaucacua

SEQ ID NO: 354612 - RNA, 19 nt, Homo sapiens
gagggugguuuaugauuaa

SEQ ID NO: 354613 - RNA, 19 nt, Homo sapiens
gcaacugaaugacuaauca

SEQ ID NO: 354614 - RNA, 19 nt, Homo sapiens
acccaaacauugugaauua

SEQ ID NO: 354615 - RNA, 19 nt, Homo sapiens
gaugagcuguggguuguua

SEQ ID NO: 354616 - RNA, 19 nt, Homo sapiens
ugagggugguuuaugauua

SEQ ID NO: 354617 - RNA, 19 nt, Homo sapiens
caucaagagugacaauauu

SEQ ID NO: 354618 - RNA, 19 nt, Homo sapiens
ugacagauguggugacaga

SEQ ID NO: 354619 - RNA, 19 nt, Homo sapiens
gaggagaucuuggagaaau

SEQ ID NO: 354620 - RNA, 19 nt, Homo sapiens
caucaaauaucacuaaguc

SEQ ID NO: 354621 - RNA, 19 nt, Homo sapiens
gagaagagagguucagcua

SEQ ID NO: 354622 - RNA, 19 nt, Homo sapiens
gaaccgcugucucgauaug

SEQ ID NO: 354623 - RNA, 19 nt, Homo sapiens
ggauggcucugucaagcua

SEQ ID NO: 354624 - RNA, 19 nt, Homo sapiens
gacagaaacuugcauggau

SEQ ID NO: 354625 - RNA, 19 nt, Homo sapiens
caagcuaacugacuuugga

SEQ ID NO: 354626 - RNA, 19 nt, Homo sapiens
acagagacaucaagaguga

SEQ ID NO: 354627 - RNA, 19 nt, Homo sapiens
gagaugagcuguggguugu

SEQ ID NO: 354628 - RNA, 19 nt, Homo sapiens
ucuaaugccuugaauguga

SEQ ID NO: 354629 - RNA, 19 nt, Homo sapiens
agaaauaccagcacuauga

SEQ ID NO: 354630 - RNA, 19 nt, Homo sapiens
gccaagcucugugagauaa

SEQ ID NO: 354631 - RNA, 19 nt, Homo sapiens
ggagaaauuacgaagcaua

SEQ ID NO: 354632 - RNA, 19 nt, Homo sapiens
cuucagacaucaaauauca

SEQ ID NO: 354633 - RNA, 19 nt, Homo sapiens
gaugauggccauuucuaaa

SEQ ID NO: 354634 - RNA, 19 nt, Homo sapiens
cagcaucaauuccugaaga

SEQ ID NO: 354635 - RNA, 19 nt, Homo sapiens
gaaauuacgaagcauagug

SEQ ID NO: 354636 - RNA, 19 nt, Homo sapiens
ggagaucuuggagaaauua

SEQ ID NO: 354637 - RNA, 19 nt, Homo sapiens
caagaaagagcugauuauu

SEQ ID NO: 354638 - RNA, 19 nt, Homo sapiens
ggacaggagguggccauua

SEQ ID NO: 354639 - RNA, 19 nt, Homo sapiens
uaacaccacuccaccagau

SEQ ID NO: 354640 - RNA, 19 nt, Homo sapiens
aaacaagaacccaaacauu

SEQ ID NO: 354641 - RNA, 19 nt, Homo sapiens
gaaagagcggccagagauu

SEQ ID NO: 354642 - RNA, 19 nt, Homo sapiens
cuaaaccucugccuccaaa

SEQ ID NO: 354643 - RNA, 19 nt, Homo sapiens
gaaauuccaacuccugaug

SEQ ID NO: 354644 - RNA, 19 nt, Homo sapiens
cugaaccgcugucucgaua

SEQ ID NO: 354645 - RNA, 19 nt, Homo sapiens
gcucuggaguucuugcauu

SEQ ID NO: 354646 - RNA, 19 nt, Homo sapiens
uagcacuccucaagacuuu

SEQ ID NO: 354647 - RNA, 19 nt, Homo sapiens
caucauggccaucgaaaug

SEQ ID NO: 354648 - RNA, 19 nt, Homo sapiens
cagaaauacaugagcuuua

SEQ ID NO: 354649 - RNA, 19 nt, Homo sapiens
cagccucacuccacugauu

SEQ ID NO: 354650 - RNA, 19 nt, Homo sapiens
gguuuaugauuaaggguuu

SEQ ID NO: 354651 - RNA, 19 nt, Homo sapiens
agacuuugauccuuggaaa

SEQ ID NO: 354652 - RNA, 19 nt, Homo sapiens
guggcuacaucucccauuu

SEQ ID NO: 354653 - RNA, 19 nt, Homo sapiens
cagaagaugaggaugauga

SEQ ID NO: 354654 - RNA, 19 nt, Homo sapiens
uaagucagcugaggauuac

SEQ ID NO: 354655 - RNA, 19 nt, Homo sapiens
gaaauaccagcacuaugau

SEQ ID NO: 354656 - RNA, 19 nt, Homo sapiens
gagaacugcaacugaauga

SEQ ID NO: 354657 - RNA, 19 nt, Homo sapiens
gagugacaauauucuguug

SEQ ID NO: 354658 - RNA, 19 nt, Homo sapiens
gcuguggguuguuauggaa

SEQ ID NO: 354659 - RNA, 19 nt, Homo sapiens
aacaagaacccaaacauug

SEQ ID NO: 354660 - RNA, 19 nt, Homo sapiens
ccaagaaagagcugauuau

SEQ ID NO: 354661 - RNA, 19 nt, Homo sapiens
cagcugaggauuacaauuc

SEQ ID NO: 354662 - RNA, 19 nt, Homo sapiens
ucaaauaacggccuagaca

SEQ ID NO: 354663 - RNA, 19 nt, Homo sapiens
cuaaggaggcaacaaagaa

SEQ ID NO: 354664 - RNA, 19 nt, Homo sapiens
ggaugaugaugaugaugau

SEQ ID NO: 354665 - RNA, 19 nt, Homo sapiens
agaaauacaugagcuuuac

SEQ ID NO: 354666 - RNA, 19 nt, Homo sapiens
cauccaacagccagaaaua

SEQ ID NO: 354667 - RNA, 19 nt, Homo sapiens
gagaaagagcggccagaga

SEQ ID NO: 354668 - RNA, 19 nt, Homo sapiens
gaacugcaacugaaugacu

SEQ ID NO: 354669 - RNA, 19 nt, Homo sapiens
cagcuaaggaggcaacaaa

SEQ ID NO: 354670 - RNA, 19 nt, Homo sapiens
gcgauccuaagaagaaaua

SEQ ID NO: 354671 - RNA, 19 nt, Homo sapiens
gagaggaggagccgagaga

SEQ ID NO: 354672 - RNA, 19 nt, Homo sapiens
gaagaagccuaaaaugucu

SEQ ID NO: 354673 - RNA, 19 nt, Homo sapiens
auaugagggugguuuauga

SEQ ID NO: 354674 - RNA, 19 nt, Homo sapiens
gaucuagcacuccucaaga

SEQ ID NO: 354675 - RNA, 19 nt, Homo sapiens
aaauaacggccuagacauu

SEQ ID NO: 354676 - RNA, 19 nt, Homo sapiens
auaagucagcugaggauua

SEQ ID NO: 354677 - RNA, 19 nt, Homo sapiens
gaacuucagaacccagaga

SEQ ID NO: 354678 - RNA, 19 nt, Homo sapiens
gaacccaaacauugugaau

SEQ ID NO: 354679 - RNA, 19 nt, Homo sapiens
aaauauacacgguuugaga

SEQ ID NO: 354680 - RNA, 19 nt, Homo sapiens
ggcuacaucucccauuuca

SEQ ID NO: 354681 - RNA, 19 nt, Homo sapiens
ccuagacauucaagacaaa

SEQ ID NO: 354682 - RNA, 19 nt, Homo sapiens
gaagguugggcgacacuug

SEQ ID NO: 354683 - RNA, 19 nt, Homo sapiens
gauaugagggugguuuaug

SEQ ID NO: 354684 - RNA, 19 nt, Homo sapiens
ugaagagaacugcaacuga

SEQ ID NO: 354685 - RNA, 19 nt, Homo sapiens
gcuaaggaggcaacaaaga

SEQ ID NO: 354686 - RNA, 19 nt, Homo sapiens
gaaccaggucauucacaga

SEQ ID NO: 354687 - RNA, 19 nt, Homo sapiens
gugaauuacuuggacaguu

SEQ ID NO: 354688 - RNA, 19 nt, Homo sapiens
gagaaauuacgaagcauag

SEQ ID NO: 354689 - RNA, 19 nt, Homo sapiens
ucacuaagucggagcagaa

SEQ ID NO: 354690 - RNA, 19 nt, Homo sapiens
agaaagagcggccagagau

SEQ ID NO: 354691 - RNA, 19 nt, Homo sapiens
gccuagacauucaagacaa

SEQ ID NO: 354692 - RNA, 19 nt, Homo sapiens
caagcucugugagauaaau

SEQ ID NO: 354693 - RNA, 19 nt, Homo sapiens
ucacagagacaucaagagu

SEQ ID NO: 354694 - RNA, 19 nt, Homo sapiens
agauuucucucccuucaga

SEQ ID NO: 354695 - RNA, 19 nt, Homo sapiens
aaagagcggccagagauuu

SEQ ID NO: 354696 - RNA, 19 nt, Homo sapiens
gaaaccguguguccagcau

SEQ ID NO: 354697 - RNA, 19 nt, Homo sapiens
cugagaagcagaagaagaa

SEQ ID NO: 354698 - RNA, 19 nt, Homo sapiens
acaugagcuuuacagauaa

SEQ ID NO: 354699 - RNA, 19 nt, Homo sapiens
gagccuccauaccucaaug

SEQ ID NO: 354700 - RNA, 19 nt, Homo sapiens
ggaugaaggccaaauugca

SEQ ID NO: 354701 - RNA, 19 nt, Homo sapiens
aagaugaggaugaugauga

SEQ ID NO: 354702 - RNA, 19 nt, Homo sapiens
caacagccagaaauacaug

SEQ ID NO: 354703 - RNA, 19 nt, Homo sapiens
augaggagaucuuggagaa

SEQ ID NO: 354704 - RNA, 19 nt, Homo sapiens
gagcuuuacagauaaguca

SEQ ID NO: 354705 - RNA, 19 nt, Homo sapiens
gguaggagaugaauuguuu

SEQ ID NO: 354706 - RNA, 19 nt, Homo sapiens
agaaggaacugaucauuaa

SEQ ID NO: 354707 - RNA, 19 nt, Homo sapiens
gaugacagaugaagagauu

SEQ ID NO: 354708 - RNA, 19 nt, Homo sapiens
cuacagaccuccaauauca

SEQ ID NO: 354709 - RNA, 19 nt, Homo sapiens
gaaacuggccaaaccguua

SEQ ID NO: 354710 - RNA, 19 nt, Homo sapiens
ggaggaggaugaugaugaa

SEQ ID NO: 354711 - RNA, 19 nt, Homo sapiens
ucacuaggcuuaggucuuu

SEQ ID NO: 354712 - RNA, 19 nt, Homo sapiens
gaucauggcagcuaaagaa

SEQ ID NO: 354713 - RNA, 19 nt, Homo sapiens
ggaauggaaggaucuguua

SEQ ID NO: 354714 - RNA, 19 nt, Homo sapiens
gagcagagcaaacgcagua

SEQ ID NO: 354715 - RNA, 19 nt, Homo sapiens
gaaauggucugcauaaccu

SEQ ID NO: 354716 - RNA, 19 nt, Homo sapiens
acagugggcucgauuacua

SEQ ID NO: 354717 - RNA, 19 nt, Homo sapiens
caagaagccuuuuaguaua

SEQ ID NO: 354718 - RNA, 19 nt, Homo sapiens
aagaagcaaugaagaguaa

SEQ ID NO: 354719 - RNA, 19 nt, Homo sapiens
agaaacagcuugcauggau

SEQ ID NO: 354720 - RNA, 19 nt, Homo sapiens
ggagguugcuaucaaacaa

SEQ ID NO: 354721 - RNA, 19 nt, Homo sapiens
gguaugacuuuguuaugaa

SEQ ID NO: 354722 - RNA, 19 nt, Homo sapiens
uaucauggcuauugagaug

SEQ ID NO: 354723 - RNA, 19 nt, Homo sapiens
ucacugaugugguaacaga

SEQ ID NO: 354724 - RNA, 19 nt, Homo sapiens
gacaggagguugcuaucaa

SEQ ID NO: 354725 - RNA, 19 nt, Homo sapiens
acggagaacuggaagauaa

SEQ ID NO: 354726 - RNA, 19 nt, Homo sapiens
gcacagagaaaggaaguaa

SEQ ID NO: 354727 - RNA, 19 nt, Homo sapiens
gggcauuuaucauguguga

SEQ ID NO: 354728 - RNA, 19 nt, Homo sapiens
ggguucagccaaagaauua

SEQ ID NO: 354729 - RNA, 19 nt, Homo sapiens
aaagaaauggucugcauaa

SEQ ID NO: 354730 - RNA, 19 nt, Homo sapiens
agaaauaucugagcuuuac

SEQ ID NO: 354731 - RNA, 19 nt, Homo sapiens
gagcacaccauccauguug

SEQ ID NO: 354732 - RNA, 19 nt, Homo sapiens
aagaaggaacugaucauua

SEQ ID NO: 354733 - RNA, 19 nt, Homo sapiens
gcauuuaucaugugugaga

SEQ ID NO: 354734 - RNA, 19 nt, Homo sapiens
caucaaaagugacaaugua

SEQ ID NO: 354735 - RNA, 19 nt, Homo sapiens
ugacagaggaggaggauga

SEQ ID NO: 354736 - RNA, 19 nt, Homo sapiens
gaagggauuugugggacuu

SEQ ID NO: 354737 - RNA, 19 nt, Homo sapiens
uaaagaaauggucugcaua

SEQ ID NO: 354738 - RNA, 19 nt, Homo sapiens
augaagagauuauggagaa

SEQ ID NO: 354739 - RNA, 19 nt, Homo sapiens
caccauccauguuggcuuu

SEQ ID NO: 354740 - RNA, 19 nt, Homo sapiens
cugcauaaccugaaugaaa

SEQ ID NO: 354741 - RNA, 19 nt, Homo sapiens
ggaggaugaugaugaagag

SEQ ID NO: 354742 - RNA, 19 nt, Homo sapiens
ucacugcugugggcucaua

SEQ ID NO: 354743 - RNA, 19 nt, Homo sapiens
acacagugaagcagaaaua

SEQ ID NO: 354744 - RNA, 19 nt, Homo sapiens
uuaaagaaauggucugcau

SEQ ID NO: 354745 - RNA, 19 nt, Homo sapiens
gcugugggcucauacucuu

SEQ ID NO: 354746 - RNA, 19 nt, Homo sapiens
gaauggaaggaucuguuaa

SEQ ID NO: 354747 - RNA, 19 nt, Homo sapiens
ccaacacagugaagcagaa

SEQ ID NO: 354748 - RNA, 19 nt, Homo sapiens
agaaacagccaaagaagga

SEQ ID NO: 354749 - RNA, 19 nt, Homo sapiens
uaagaacuaucgugagcau

SEQ ID NO: 354750 - RNA, 19 nt, Homo sapiens
gaacuucagaauccagaga

SEQ ID NO: 354751 - RNA, 19 nt, Homo sapiens
gagaguguuuacaggcauu

SEQ ID NO: 354752 - RNA, 19 nt, Homo sapiens
acaggagguugcuaucaaa

SEQ ID NO: 354753 - RNA, 19 nt, Homo sapiens
agccuaagaugacagauga

SEQ ID NO: 354754 - RNA, 19 nt, Homo sapiens
gaaaaggaacggccagaaa

SEQ ID NO: 354755 - RNA, 19 nt, Homo sapiens
gucacucacugauguggua

SEQ ID NO: 354756 - RNA, 19 nt, Homo sapiens
cgaaugagcagcaccaucu

SEQ ID NO: 354757 - RNA, 19 nt, Homo sapiens
caagguaugacuuuguuau

SEQ ID NO: 354758 - RNA, 19 nt, Homo sapiens
ugaagacaaccaagagaaa

SEQ ID NO: 354759 - RNA, 19 nt, Homo sapiens
aaagaagcaaugaagagua

SEQ ID NO: 354760 - RNA, 19 nt, Homo sapiens
gaagagauuauggagaaau

SEQ ID NO: 354761 - RNA, 19 nt, Homo sapiens
gaccggaucauacgaaauc

SEQ ID NO: 354762 - RNA, 19 nt, Homo sapiens
gaacagugggcucgauuac

SEQ ID NO: 354763 - RNA, 19 nt, Homo sapiens
guggauagacccaugaaug

SEQ ID NO: 354764 - RNA, 19 nt, Homo sapiens
cagaggaggaggaugauga

SEQ ID NO: 354765 - RNA, 19 nt, Homo sapiens
gcuaaagaagcaaugaaga

SEQ ID NO: 354766 - RNA, 19 nt, Homo sapiens
ggugaugaaagaauugaaa

SEQ ID NO: 354767 - RNA, 19 nt, Homo sapiens
aaaggaacggccagaaauu

SEQ ID NO: 354768 - RNA, 19 nt, Homo sapiens
cauggcagcuaaagaagca

SEQ ID NO: 354769 - RNA, 19 nt, Homo sapiens
ccaaaccguuaucuagcuu

SEQ ID NO: 354770 - RNA, 19 nt, Homo sapiens
caagugauccacagagaca

SEQ ID NO: 354771 - RNA, 19 nt, Homo sapiens
uuacagaaacagccaaaga

SEQ ID NO: 354772 - RNA, 19 nt, Homo sapiens
ggacaggagguugcuauca

SEQ ID NO: 354773 - RNA, 19 nt, Homo sapiens
ugacagaugaagagauuau

SEQ ID NO: 354774 - RNA, 19 nt, Homo sapiens
gcgaccggaucauacgaaa

SEQ ID NO: 354775 - RNA, 19 nt, Homo sapiens
gauucuacuugggugauuu

SEQ ID NO: 354776 - RNA, 19 nt, Homo sapiens
uugagggccuuguaccuaa

SEQ ID NO: 354777 - RNA, 19 nt, Homo sapiens
ccaaagaaggaacugauca

SEQ ID NO: 354778 - RNA, 19 nt, Homo sapiens
aaauuucuccuccaucuga

SEQ ID NO: 354779 - RNA, 19 nt, Homo sapiens
ugcauaaccugaaugaaag

SEQ ID NO: 354780 - RNA, 19 nt, Homo sapiens
ccuaauagcaacuaaugga

SEQ ID NO: 354781 - RNA, 19 nt, Homo sapiens
gagccuccauaccucaaug

SEQ ID NO: 354782 - RNA, 19 nt, Homo sapiens
aaagauggccuuccuucug

SEQ ID NO: 354783 - RNA, 19 nt, Homo sapiens
gaaagauggccuuccuucu

SEQ ID NO: 354784 - RNA, 19 nt, Homo sapiens
ggauucuacuugggugauu

SEQ ID NO: 354785 - RNA, 19 nt, Homo sapiens
ugugugagauuggauucua

SEQ ID NO: 354786 - RNA, 19 nt, Homo sapiens
acagagacaucaaaaguga

SEQ ID NO: 354787 - RNA, 19 nt, Homo sapiens
uaacgagauucuggugaug

SEQ ID NO: 354788 - RNA, 19 nt, Homo sapiens
acaagaagccuuuuaguau

SEQ ID NO: 354789 - RNA, 19 nt, Homo sapiens
ccacugaucauggcagcua

SEQ ID NO: 354790 - RNA, 19 nt, Homo sapiens
aaaccguuaucuagcuuga

SEQ ID NO: 354791 - RNA, 19 nt, Homo sapiens
cagaauccagagaaacuuu

SEQ ID NO: 354792 - RNA, 19 nt, Homo sapiens
uaagcucacugacuuuggu

SEQ ID NO: 354793 - RNA, 19 nt, Homo sapiens
uuaacgagauucuggugau

SEQ ID NO: 354794 - RNA, 19 nt, Homo sapiens
ggacaaggggcuucuggua

SEQ ID NO: 354795 - RNA, 19 nt, Homo sapiens
ggccauuucauaauucuga

SEQ ID NO: 354796 - RNA, 19 nt, Homo sapiens
uaagaugacagaugaagag

SEQ ID NO: 354797 - RNA, 19 nt, Homo sapiens
aaagaagccuaagaugaca

SEQ ID NO: 354798 - RNA, 19 nt, Homo sapiens
agguaugacuuuguuauga

SEQ ID NO: 354799 - RNA, 19 nt, Homo sapiens
ugaaaccuuugcccucugu

SEQ ID NO: 354800 - RNA, 19 nt, Homo sapiens
cuguuaagcucacugacuu

SEQ ID NO: 354801 - RNA, 19 nt, Homo sapiens
gggaauggaaggaucuguu

SEQ ID NO: 354802 - RNA, 19 nt, Homo sapiens
uaacagaaacagcuugcau

SEQ ID NO: 354803 - RNA, 19 nt, Homo sapiens
uacagaaacagccaaagaa

SEQ ID NO: 354804 - RNA, 19 nt, Homo sapiens
gagacugcuccucccguua

SEQ ID NO: 354805 - RNA, 19 nt, Homo sapiens
gaacacagaucggcaaaga

SEQ ID NO: 354806 - RNA, 19 nt, Homo sapiens
gacaagagguggccauaaa

SEQ ID NO: 354807 - RNA, 19 nt, Homo sapiens
ggauggcucuguuaaauug

SEQ ID NO: 354808 - RNA, 19 nt, Homo sapiens
gagagugccugcaagcuuu

SEQ ID NO: 354809 - RNA, 19 nt, Homo sapiens
gauuaucgcugcaaaggaa

SEQ ID NO: 354810 - RNA, 19 nt, Homo sapiens
uuaaaucgcugucuugaga

SEQ ID NO: 354811 - RNA, 19 nt, Homo sapiens
guugauaucuggucucuug

SEQ ID NO: 354812 - RNA, 19 nt, Homo sapiens
agaagaagaugaagaggaa

SEQ ID NO: 354813 - RNA, 19 nt, Homo sapiens
ccacugaggaugaauagua

SEQ ID NO: 354814 - RNA, 19 nt, Homo sapiens
gcaaaggaagcaauuaaga

SEQ ID NO: 354815 - RNA, 19 nt, Homo sapiens
caaaguaaacgaagcacua

SEQ ID NO: 354816 - RNA, 19 nt, Homo sapiens
ggugauccauagagauaua

SEQ ID NO: 354817 - RNA, 19 nt, Homo sapiens
ggaagaagaagaagaagau

SEQ ID NO: 354818 - RNA, 19 nt, Homo sapiens
uaucuggucucuuggaauu

SEQ ID NO: 354819 - RNA, 19 nt, Homo sapiens
caaaggaagcaauuaagaa

SEQ ID NO: 354820 - RNA, 19 nt, Homo sapiens
caaaccaggugauccauag

SEQ ID NO: 354821 - RNA, 19 nt, Homo sapiens
uaagaagcauugugagugu

SEQ ID NO: 354822 - RNA, 19 nt, Homo sapiens
acuccaaacuuccaacaua

SEQ ID NO: 354823 - RNA, 19 nt, Homo sapiens
ccagaucacuccugagcaa

SEQ ID NO: 354824 - RNA, 19 nt, Homo sapiens
caccagcaguaccaaauaa

SEQ ID NO: 354825 - RNA, 19 nt, Homo sapiens
aauccaagaugacagauga

SEQ ID NO: 354826 - RNA, 19 nt, Homo sapiens
acacagaucggcaaagaaa

SEQ ID NO: 354827 - RNA, 19 nt, Homo sapiens
gcaccaagaccagagcaua

SEQ ID NO: 354828 - RNA, 19 nt, Homo sapiens
gaagaacccacaagcuguu

SEQ ID NO: 354829 - RNA, 19 nt, Homo sapiens
ccauagagauauaaagagu

SEQ ID NO: 354830 - RNA, 19 nt, Homo sapiens
ccaauaagaagaaggagaa

SEQ ID NO: 354831 - RNA, 19 nt, Homo sapiens
gauaucuggucucuuggaa

SEQ ID NO: 354832 - RNA, 19 nt, Homo sapiens
gggcaucagguacuguuua

SEQ ID NO: 354833 - RNA, 19 nt, Homo sapiens
gagaagcuaagaagcauug

SEQ ID NO: 354834 - RNA, 19 nt, Homo sapiens
cagaaauacaugagcuuua

SEQ ID NO: 354835 - RNA, 19 nt, Homo sapiens
ccaaagaaacagucaacaa

SEQ ID NO: 354836 - RNA, 19 nt, Homo sapiens
cagccugacuccucugauu

SEQ ID NO: 354837 - RNA, 19 nt, Homo sapiens
gagagacugucagcuguau

SEQ ID NO: 354838 - RNA, 19 nt, Homo sapiens
caggugauccauagagaua

SEQ ID NO: 354839 - RNA, 19 nt, Homo sapiens
gaagagaagaauaagaaag

SEQ ID NO: 354840 - RNA, 19 nt, Homo sapiens
ggacaagagguggccauaa

SEQ ID NO: 354841 - RNA, 19 nt, Homo sapiens
gaugacagaugaggagauc

SEQ ID NO: 354842 - RNA, 19 nt, Homo sapiens
cccaagaaggaauuaauua

SEQ ID NO: 354843 - RNA, 19 nt, Homo sapiens
cacugaggaugaauaguaa

SEQ ID NO: 354844 - RNA, 19 nt, Homo sapiens
ggcaucagguacuguuuau

SEQ ID NO: 354845 - RNA, 19 nt, Homo sapiens
gaaaaugccaauuccagua

SEQ ID NO: 354846 - RNA, 19 nt, Homo sapiens
gaaagagcgcccagagauc

SEQ ID NO: 354847 - RNA, 19 nt, Homo sapiens
caaagaaacagucaacaac

SEQ ID NO: 354848 - RNA, 19 nt, Homo sapiens
cuccaaacuuccaacauaa

SEQ ID NO: 354849 - RNA, 19 nt, Homo sapiens
gcaaugggcacgauuacuc

SEQ ID NO: 354850 - RNA, 19 nt, Homo sapiens
ccaauuccaguacuuugua

SEQ ID NO: 354851 - RNA, 19 nt, Homo sapiens
agaaauacaugagcuuuac

SEQ ID NO: 354852 - RNA, 19 nt, Homo sapiens
gagaaagagcgcccagaga

SEQ ID NO: 354853 - RNA, 19 nt, Homo sapiens
guaacaaccgggauucuuc

SEQ ID NO: 354854 - RNA, 19 nt, Homo sapiens
gaagaagaagaagaugaaa

SEQ ID NO: 354855 - RNA, 19 nt, Homo sapiens
cacaagcuguucuagaugu

SEQ ID NO: 354856 - RNA, 19 nt, Homo sapiens
cccacaagcuguucuagau

SEQ ID NO: 354857 - RNA, 19 nt, Homo sapiens
ggauggauggcucuguuaa

SEQ ID NO: 354858 - RNA, 19 nt, Homo sapiens
agaagaagaagaagaugaa

SEQ ID NO: 354859 - RNA, 19 nt, Homo sapiens
ugaagaggaagaagaagaa

SEQ ID NO: 354860 - RNA, 19 nt, Homo sapiens
cugacggucuggauaauga

SEQ ID NO: 354861 - RNA, 19 nt, Homo sapiens
uauggguagucauggaaua

SEQ ID NO: 354862 - RNA, 19 nt, Homo sapiens
gcacgauuacuccaaacuu

SEQ ID NO: 354863 - RNA, 19 nt, Homo sapiens
cugaagagaagaauaagaa

SEQ ID NO: 354864 - RNA, 19 nt, Homo sapiens
gcuccagaauccugagaga

SEQ ID NO: 354865 - RNA, 19 nt, Homo sapiens
uacaugagcuuuacaucag

SEQ ID NO: 354866 - RNA, 19 nt, Homo sapiens
caacaaccagaaauacaug

SEQ ID NO: 354867 - RNA, 19 nt, Homo sapiens
gaagaagaacccacaagcu

SEQ ID NO: 354868 - RNA, 19 nt, Homo sapiens
agaaagagcgcccagagau

SEQ ID NO: 354869 - RNA, 19 nt, Homo sapiens
gagacugucagcuguauuc

SEQ ID NO: 354870 - RNA, 19 nt, Homo sapiens
gaucacuccugagcaaagu

SEQ ID NO: 354871 - RNA, 19 nt, Homo sapiens
gauggauggcucuguuaaa

SEQ ID NO: 354872 - RNA, 19 nt, Homo sapiens
uggauuuccugcacucaaa

SEQ ID NO: 354873 - RNA, 19 nt, Homo sapiens
augaggagaucuuagagaa

SEQ ID NO: 354874 - RNA, 19 nt, Homo sapiens
gaggaugaauaguaacaac

SEQ ID NO: 354875 - RNA, 19 nt, Homo sapiens
gaacuccagagcuccagaa

SEQ ID NO: 354876 - RNA, 19 nt, Homo sapiens
auaagaagaaggagaaaga

SEQ ID NO: 354877 - RNA, 19 nt, Homo sapiens
agaggaagaagaagaagaa

SEQ ID NO: 354878 - RNA, 19 nt, Homo sapiens
gcccauccuucgaguacaa

SEQ ID NO: 354879 - RNA, 19 nt, Homo sapiens
gggauggauggcucuguua

SEQ ID NO: 354880 - RNA, 19 nt, Homo sapiens
cuuggugggugaugaacua

SEQ ID NO: 354881 - RNA, 19 nt, Homo sapiens
aagcuaagaagcauuguga

SEQ ID NO: 354882 - RNA, 19 nt, Homo sapiens
ucaccagcaguaccaaaua

SEQ ID NO: 354883 - RNA, 19 nt, Homo sapiens
aaugagccaccaccaguua

SEQ ID NO: 354884 - RNA, 19 nt, Homo sapiens
aagugcacauggauacaua

SEQ ID NO: 354885 - RNA, 19 nt, Homo sapiens
uguucuagauguucucaaa

SEQ ID NO: 354886 - RNA, 19 nt, Homo sapiens
cacgauuacuccaaacuuc

SEQ ID NO: 354887 - RNA, 19 nt, Homo sapiens
caucagguacuguuuauac

SEQ ID NO: 354888 - RNA, 19 nt, Homo sapiens
gaugaggagaucuuagaga

SEQ ID NO: 354889 - RNA, 19 nt, Homo sapiens
cagcaguaccaaauaaaga

SEQ ID NO: 354890 - RNA, 19 nt, Homo sapiens
uaagaacagcagccgcuaa

SEQ ID NO: 354891 - RNA, 19 nt, Homo sapiens
gauagccacuaauggaacu

SEQ ID NO: 354892 - RNA, 19 nt, Homo sapiens
gagcaaaguaaacgaagca

SEQ ID NO: 354893 - RNA, 19 nt, Homo sapiens
ggugggugaugaacuaugg

SEQ ID NO: 354894 - RNA, 19 nt, Homo sapiens
caagaccagagcauacaaa

SEQ ID NO: 354895 - RNA, 19 nt, Homo sapiens
ugaagaagaagaugaagag

SEQ ID NO: 354896 - RNA, 19 nt, Homo sapiens
ccagaaauacaugagcuuu

SEQ ID NO: 354897 - RNA, 19 nt, Homo sapiens
cugcaaaggaagcaauuaa

SEQ ID NO: 354898 - RNA, 19 nt, Homo sapiens
ccugcaagcuuuggauuuc

SEQ ID NO: 354899 - RNA, 19 nt, Homo sapiens
uuauacagcacuagacauu

SEQ ID NO: 354900 - RNA, 19 nt, Homo sapiens
gcuaagaagcauugugagu

SEQ ID NO: 354901 - RNA, 19 nt, Homo sapiens
cgggauggauggcucuguu

SEQ ID NO: 354902 - RNA, 19 nt, Homo sapiens
ucaaaccaggugauccaua

SEQ ID NO: 354903 - RNA, 19 nt, Homo sapiens
uagagaagcuaagaagcau

SEQ ID NO: 354904 - RNA, 19 nt, Homo sapiens
acaccacccucugcugaaa

SEQ ID NO: 354905 - RNA, 19 nt, Homo sapiens
agacagagguggugaugaa

SEQ ID NO: 354906 - RNA, 19 nt, Homo sapiens
gaagugcccuugcuauaac

SEQ ID NO: 354907 - RNA, 19 nt, Homo sapiens
gaagaagcaccguuguaaa

SEQ ID NO: 354908 - RNA, 19 nt, Homo sapiens
gugcugggccuucaagaua

SEQ ID NO: 354909 - RNA, 19 nt, Homo sapiens
ugaagaagcaccguuguaa

SEQ ID NO: 354910 - RNA, 19 nt, Homo sapiens
gagcaggagacccucauuu

SEQ ID NO: 354911 - RNA, 19 nt, Homo sapiens
gaagcaccguuguaaaugc

SEQ ID NO: 354912 - RNA, 19 nt, Homo sapiens
ugaagugcccuugcuauaa

SEQ ID NO: 354913 - RNA, 19 nt, Homo sapiens
ggacgaacucauccacaaa

SEQ ID NO: 354914 - RNA, 19 nt, Homo sapiens
uguaaaugcugcuccauca

SEQ ID NO: 354915 - RNA, 19 nt, Homo sapiens
cagagguggugaugaauuc

SEQ ID NO: 354916 - RNA, 19 nt, Homo sapiens
gcaaauaaacagcgugaac

SEQ ID NO: 354917 - RNA, 19 nt, Homo sapiens
ggaagccucuuggguugga

SEQ ID NO: 354918 - RNA, 19 nt, Homo sapiens
ggacuuggcguguuguuac

SEQ ID NO: 354919 - RNA, 19 nt, Homo sapiens
cccaggaccucgacaugaa

SEQ ID NO: 354920 - RNA, 19 nt, Homo sapiens
caaauaaacagcgugaaca

SEQ ID NO: 354921 - RNA, 19 nt, Homo sapiens
ccagagaagcaaauaaaca

SEQ ID NO: 354922 - RNA, 19 nt, Homo sapiens
aggcggagaucgagaacaa

SEQ ID NO: 354923 - RNA, 19 nt, Homo sapiens
uaaaugcugcuccaucaug

SEQ ID NO: 354924 - RNA, 19 nt, Homo sapiens
aagaagcaccguuguaaau

SEQ ID NO: 354925 - RNA, 19 nt, Homo sapiens
ccagagccgugcacuugug

SEQ ID NO: 354926 - RNA, 19 nt, Homo sapiens
acauguuccuuccgaguuu

SEQ ID NO: 354927 - RNA, 19 nt, Homo sapiens
gaugaaggcagccauguac

SEQ ID NO: 354928 - RNA, 19 nt, Homo sapiens
gaaccagagccgugcacuu

SEQ ID NO: 354929 - RNA, 19 nt, Homo sapiens
gguuggagaaggaaauuga

SEQ ID NO: 354930 - RNA, 19 nt, Homo sapiens
ugagaucacuguggagaag

SEQ ID NO: 354931 - RNA, 19 nt, Homo sapiens
cugaagugcccuugcuaua

SEQ ID NO: 354932 - RNA, 19 nt, Homo sapiens
ucccagagaagcaaauaaa

SEQ ID NO: 354933 - RNA, 19 nt, Homo sapiens
gcaggagacccucauuugc

SEQ ID NO: 354934 - RNA, 19 nt, Homo sapiens
aaaugcugcuccaucaugu

SEQ ID NO: 354935 - RNA, 19 nt, Homo sapiens
ugaugaaggcagccaugua

SEQ ID NO: 354936 - RNA, 19 nt, Homo sapiens
gaugaggccgagaccaaga

SEQ ID NO: 354937 - RNA, 19 nt, Homo sapiens
accagaacguggaggauga

SEQ ID NO: 354938 - RNA, 19 nt, Homo sapiens
gacaagcgagucuccaaca

SEQ ID NO: 354939 - RNA, 19 nt, Homo sapiens
aaccagagccgugcacuug

SEQ ID NO: 354940 - RNA, 19 nt, Homo sapiens
caagacagagguggugaug

SEQ ID NO: 354941 - RNA, 19 nt, Homo sapiens
gcugaagugcccuugcuau

SEQ ID NO: 354942 - RNA, 19 nt, Homo sapiens
cagagaagcaaauaaacag

SEQ ID NO: 354943 - RNA, 19 nt, Homo sapiens
cuucauggguuaccagaac

SEQ ID NO: 354944 - RNA, 19 nt, Homo sapiens
uaccugugccuuucucuga

SEQ ID NO: 354945 - RNA, 19 nt, Homo sapiens
ggagaaggacaaggugaca

SEQ ID NO: 354946 - RNA, 19 nt, Homo sapiens
gccauguacucgguugaga

SEQ ID NO: 354947 - RNA, 19 nt, Homo sapiens
ggagcaggagacccucauu

SEQ ID NO: 354948 - RNA, 19 nt, Homo sapiens
gacaggacagacccgcuuu

SEQ ID NO: 354949 - RNA, 19 nt, Homo sapiens
ggacgacgagcagaagaca

SEQ ID NO: 354950 - RNA, 19 nt, Homo sapiens
acagagguggugaugaauu

SEQ ID NO: 354951 - RNA, 19 nt, Homo sapiens
cgagguggacgaacucauc

SEQ ID NO: 354952 - RNA, 19 nt, Homo sapiens
caaggaggagcgcaagaca

SEQ ID NO: 354953 - RNA, 19 nt, Homo sapiens
gacuuggcguguuguuaca

SEQ ID NO: 354954 - RNA, 19 nt, Homo sapiens
gacgaacucauccacaaag

SEQ ID NO: 354955 - RNA, 19 nt, Homo sapiens
ugcagcaccugaaguccaa

SEQ ID NO: 354956 - RNA, 19 nt, Homo sapiens
cgucucacacguuggcuuu

SEQ ID NO: 354957 - RNA, 19 nt, Homo sapiens
gcaagacagagguggugau

SEQ ID NO: 354958 - RNA, 19 nt, Homo sapiens
ggcguguuguuacauguuc

SEQ ID NO: 354959 - RNA, 19 nt, Homo sapiens
uccaggacuuggcguguug

SEQ ID NO: 354960 - RNA, 19 nt, Homo sapiens
aggaggagcgcaagacaga

SEQ ID NO: 354961 - RNA, 19 nt, Homo sapiens
ccuccuaccugugccuuuc

SEQ ID NO: 354962 - RNA, 19 nt, Homo sapiens
agaagcaccguuguaaaug

SEQ ID NO: 354963 - RNA, 19 nt, Homo sapiens
ggagcugguggucaucgaa

SEQ ID NO: 354964 - RNA, 19 nt, Homo sapiens
gcaggacgacgagcagaag

SEQ ID NO: 354965 - RNA, 19 nt, Homo sapiens
gaaggaaccuguacagaua

SEQ ID NO: 354966 - RNA, 19 nt, Homo sapiens
uaaagaaggcccuguauua

SEQ ID NO: 354967 - RNA, 19 nt, Homo sapiens
gaauguagcuccagauaug

SEQ ID NO: 354968 - RNA, 19 nt, Homo sapiens
cgacaaagcugcuaaaucu

SEQ ID NO: 354969 - RNA, 19 nt, Homo sapiens
ccacauggcuugaguauag

SEQ ID NO: 354970 - RNA, 19 nt, Homo sapiens
gaaagaggaugauggaagu

SEQ ID NO: 354971 - RNA, 19 nt, Homo sapiens
gagcagaguuuucucauua

SEQ ID NO: 354972 - RNA, 19 nt, Homo sapiens
guaaguggauacagaguaa

SEQ ID NO: 354973 - RNA, 19 nt, Homo sapiens
gcuuaaaccuugguaauuu

SEQ ID NO: 354974 - RNA, 19 nt, Homo sapiens
ccaagaaccuguacaagga

SEQ ID NO: 354975 - RNA, 19 nt, Homo sapiens
gaugaaaugugcaacuuau

SEQ ID NO: 354976 - RNA, 19 nt, Homo sapiens
gaacaucgaucaguuaaaa

SEQ ID NO: 354977 - RNA, 19 nt, Homo sapiens
ugagagagauuaagcauuc

SEQ ID NO: 354978 - RNA, 19 nt, Homo sapiens
gaagaguacugggaagauu

SEQ ID NO: 354979 - RNA, 19 nt, Homo sapiens
gcacaaauauaauccuaca

SEQ ID NO: 354980 - RNA, 19 nt, Homo sapiens
gaaacuuugugcuacauga

SEQ ID NO: 354981 - RNA, 19 nt, Homo sapiens
ucagauuccuuucccuuua

SEQ ID NO: 354982 - RNA, 19 nt, Homo sapiens
aaagggaaguggaggcuua

SEQ ID NO: 354983 - RNA, 19 nt, Homo sapiens
gggaagauguuguucaugu

SEQ ID NO: 354984 - RNA, 19 nt, Homo sapiens
uggaagauuugcccauuua

SEQ ID NO: 354985 - RNA, 19 nt, Homo sapiens
gcauugagguccaggaaau

SEQ ID NO: 354986 - RNA, 19 nt, Homo sapiens
uagcugagauugcaaaugu

SEQ ID NO: 354987 - RNA, 19 nt, Homo sapiens
agaagaagaagaaguguua

SEQ ID NO: 354988 - RNA, 19 nt, Homo sapiens
gguaguaaguggauacaga

SEQ ID NO: 354989 - RNA, 19 nt, Homo sapiens
gaaauuggaacaucgauca

SEQ ID NO: 354990 - RNA, 19 nt, Homo sapiens
caaacuggauccaaacaau

SEQ ID NO: 354991 - RNA, 19 nt, Homo sapiens
gacauuucaugccauuaua

SEQ ID NO: 354992 - RNA, 19 nt, Homo sapiens
gccauugucuuuauaugaa

SEQ ID NO: 354993 - RNA, 19 nt, Homo sapiens
uaacagugccauugucuuu

SEQ ID NO: 354994 - RNA, 19 nt, Homo sapiens
ccacagaggugaccauguc

SEQ ID NO: 354995 - RNA, 19 nt, Homo sapiens
gcauguaccuuaugauguc

SEQ ID NO: 354996 - RNA, 19 nt, Homo sapiens
guaaauaaccccauucuuu

SEQ ID NO: 354997 - RNA, 19 nt, Homo sapiens
gaacauagacuagagaaac

SEQ ID NO: 354998 - RNA, 19 nt, Homo sapiens
uaaguuggcuucuguuucu

SEQ ID NO: 354999 - RNA, 19 nt, Homo sapiens
aaaccaagcuuugauuuag

SEQ ID NO: 355000 - RNA, 19 nt, Homo sapiens
uuagaugguuacacuguua

SEQ ID NO: 355001 - RNA, 19 nt, Homo sapiens
gaggagagacuggaaguaa

SEQ ID NO: 355002 - RNA, 19 nt, Homo sapiens
gguguuggauucagaguug

SEQ ID NO: 355003 - RNA, 19 nt, Homo sapiens
caaagaagccgaggcaguu

SEQ ID NO: 355004 - RNA, 19 nt, Homo sapiens
caaauuccacagacuagua

SEQ ID NO: 355005 - RNA, 19 nt, Homo sapiens
gacagaagccacacacauu

SEQ ID NO: 355006 - RNA, 19 nt, Homo sapiens
guacagauaaagccaauau

SEQ ID NO: 355007 - RNA, 19 nt, Homo sapiens
aaacugacaccaaagaauu

SEQ ID NO: 355008 - RNA, 19 nt, Homo sapiens
aaagaaggcccuguauuaa

SEQ ID NO: 355009 - RNA, 19 nt, Homo sapiens
ggauuggccuggaguauac

SEQ ID NO: 355010 - RNA, 19 nt, Homo sapiens
cuaaacaguccgauacaua

SEQ ID NO: 355011 - RNA, 19 nt, Homo sapiens
agaaggcccuguauuaauc

SEQ ID NO: 355012 - RNA, 19 nt, Homo sapiens
ccauuuagguaagguagua

SEQ ID NO: 355013 - RNA, 19 nt, Homo sapiens
caaagguguuggauucaga

SEQ ID NO: 355014 - RNA, 19 nt, Homo sapiens
gcacuggagccauuuaugu

SEQ ID NO: 355015 - RNA, 19 nt, Homo sapiens
agaauaaccuggugauuuu

SEQ ID NO: 355016 - RNA, 19 nt, Homo sapiens
cacaggagauuuccacaug

SEQ ID NO: 355017 - RNA, 19 nt, Homo sapiens
ggaagauguuguucaugug

SEQ ID NO: 355018 - RNA, 19 nt, Homo sapiens
ggauacagaguaagaaaug

SEQ ID NO: 355019 - RNA, 19 nt, Homo sapiens
cguaagggcuacagucgaa

SEQ ID NO: 355020 - RNA, 19 nt, Homo sapiens
ggacuguacacacuuuauu

SEQ ID NO: 355021 - RNA, 19 nt, Homo sapiens
gcagugaccaagagaaaga

SEQ ID NO: 355022 - RNA, 19 nt, Homo sapiens
ccucacagcuuggcucuug

SEQ ID NO: 355023 - RNA, 19 nt, Homo sapiens
gugcacaaauauaauccua

SEQ ID NO: 355024 - RNA, 19 nt, Homo sapiens
ggaccaagaaccuguacaa

SEQ ID NO: 355025 - RNA, 19 nt, Homo sapiens
gaauuugugagagagauua

SEQ ID NO: 355026 - RNA, 19 nt, Homo sapiens
caauaaagaaggcccugua

SEQ ID NO: 355027 - RNA, 19 nt, Homo sapiens
cgugaagucugauaugguu

SEQ ID NO: 355028 - RNA, 19 nt, Homo sapiens
aagaauaaccuggugauuu

SEQ ID NO: 355029 - RNA, 19 nt, Homo sapiens
agacuaguaucuaccuuga

SEQ ID NO: 355030 - RNA, 19 nt, Homo sapiens
gauaagauuccuuuacuac

SEQ ID NO: 355031 - RNA, 19 nt, Homo sapiens
ggacagaagccacacacau

SEQ ID NO: 355032 - RNA, 19 nt, Homo sapiens
ggagagacuggaaguaaau

SEQ ID NO: 355033 - RNA, 19 nt, Homo sapiens
gaaacuaccagaccauuuu

SEQ ID NO: 355034 - RNA, 19 nt, Homo sapiens
caccuugacugagaaauug

SEQ ID NO: 355035 - RNA, 19 nt, Homo sapiens
aaacuggauccaaacaaua

SEQ ID NO: 355036 - RNA, 19 nt, Homo sapiens
ggaauuauugggucacaga

SEQ ID NO: 355037 - RNA, 19 nt, Homo sapiens
ucacaaauuccacagacua

SEQ ID NO: 355038 - RNA, 19 nt, Homo sapiens
gaaaugugcaacuuauaca

SEQ ID NO: 355039 - RNA, 19 nt, Homo sapiens
gcuggcauguaccuuauga

SEQ ID NO: 355040 - RNA, 19 nt, Homo sapiens
gcaccuuccuccuccugaa

SEQ ID NO: 355041 - RNA, 19 nt, Homo sapiens
aaacccaccuccucagaau

SEQ ID NO: 355042 - RNA, 19 nt, Homo sapiens
ggaaguucaccuugacuga

SEQ ID NO: 355043 - RNA, 19 nt, Homo sapiens
gaagcccacuuucugucuu

SEQ ID NO: 355044 - RNA, 19 nt, Homo sapiens
agaccagggugauuucuau

SEQ ID NO: 355045 - RNA, 19 nt, Homo sapiens
uaagauuccuuuacuacag

SEQ ID NO: 355046 - RNA, 19 nt, Homo sapiens
gauaaagccaauauucugu

SEQ ID NO: 355047 - RNA, 19 nt, Homo sapiens
guggaaaguucaucacaca

SEQ ID NO: 355048 - RNA, 19 nt, Homo sapiens
cagaauguagcuccagaua

SEQ ID NO: 355049 - RNA, 19 nt, Homo sapiens
gcaugucuuugccuauaga

SEQ ID NO: 355050 - RNA, 19 nt, Homo sapiens
ccucagaauugcagaagau

SEQ ID NO: 355051 - RNA, 19 nt, Homo sapiens
guucaugugcacaaauaua

SEQ ID NO: 355052 - RNA, 19 nt, Homo sapiens
ggagaaagggaagauguug

SEQ ID NO: 355053 - RNA, 19 nt, Homo sapiens
ccagggugauuucuauuca

SEQ ID NO: 355054 - RNA, 19 nt, Homo sapiens
gaagauuugcccauuuaca

SEQ ID NO: 355055 - RNA, 19 nt, Homo sapiens
gggaagauuuagaggaaag

SEQ ID NO: 355056 - RNA, 19 nt, Homo sapiens
gcagaagaugcaagagaaa

SEQ ID NO: 355057 - RNA, 19 nt, Homo sapiens
gagccagcauggauacugu

SEQ ID NO: 355058 - RNA, 19 nt, Homo sapiens
cgagacgaguucaggaaga

SEQ ID NO: 355059 - RNA, 19 nt, Homo sapiens
cagcaggauugugcaguuu

SEQ ID NO: 355060 - RNA, 19 nt, Homo sapiens
caaguuuguuuaccagcaa

SEQ ID NO: 355061 - RNA, 19 nt, Homo sapiens
caauucccgugaagucuga

SEQ ID NO: 355062 - RNA, 19 nt, Homo sapiens
ugaaggaaccuguacagau

SEQ ID NO: 355063 - RNA, 19 nt, Homo sapiens
acagugccauugucuuuau

SEQ ID NO: 355064 - RNA, 19 nt, Homo sapiens
aaacuguacuagucugugu

SEQ ID NO: 355065 - RNA, 19 nt, Homo sapiens
gaaggaaccuguacagaua

SEQ ID NO: 355066 - RNA, 19 nt, Homo sapiens
uaaagaaggcccuguauua

SEQ ID NO: 355067 - RNA, 19 nt, Homo sapiens
gaauguagcuccagauaug

SEQ ID NO: 355068 - RNA, 19 nt, Homo sapiens
cgacaaagcugcuaaaucu

SEQ ID NO: 355069 - RNA, 19 nt, Homo sapiens
ccacauggcuugaguauag

SEQ ID NO: 355070 - RNA, 19 nt, Homo sapiens
gaaagaggaugauggaagu

SEQ ID NO: 355071 - RNA, 19 nt, Homo sapiens
caaagauucugaacacaaa

SEQ ID NO: 355072 - RNA, 19 nt, Homo sapiens
gagcagaguuuucucauua

SEQ ID NO: 355073 - RNA, 19 nt, Homo sapiens
guaaguggauacagaguaa

SEQ ID NO: 355074 - RNA, 19 nt, Homo sapiens
gcuuaaaccuugguaauuu

SEQ ID NO: 355075 - RNA, 19 nt, Homo sapiens
ccaagaaccuguacaagga

SEQ ID NO: 355076 - RNA, 19 nt, Homo sapiens
gaugaaaugugcaacuuau

SEQ ID NO: 355077 - RNA, 19 nt, Homo sapiens
gaacaucgaucaguuaaaa

SEQ ID NO: 355078 - RNA, 19 nt, Homo sapiens
ugagagagauuaagcauuc

SEQ ID NO: 355079 - RNA, 19 nt, Homo sapiens
gaagaguacugggaagauu

SEQ ID NO: 355080 - RNA, 19 nt, Homo sapiens
gcacaaauauaauccuaca

SEQ ID NO: 355081 - RNA, 19 nt, Homo sapiens
gaaacuuugugcuacauga

SEQ ID NO: 355082 - RNA, 19 nt, Homo sapiens
ucagauuccuuucccuuua

SEQ ID NO: 355083 - RNA, 19 nt, Homo sapiens
aaagggaaguggaggcuua

SEQ ID NO: 355084 - RNA, 19 nt, Homo sapiens
gggaagauguuguucaugu

SEQ ID NO: 355085 - RNA, 19 nt, Homo sapiens
uggaagauuugcccauuua

SEQ ID NO: 355086 - RNA, 19 nt, Homo sapiens
gcauugagguccaggaaau

SEQ ID NO: 355087 - RNA, 19 nt, Homo sapiens
uagcugagauugcaaaugu

SEQ ID NO: 355088 - RNA, 19 nt, Homo sapiens
agaagaagaagaaguguua

SEQ ID NO: 355089 - RNA, 19 nt, Homo sapiens
gguaguaaguggauacaga

SEQ ID NO: 355090 - RNA, 19 nt, Homo sapiens
gaaauuggaacaucgauca

SEQ ID NO: 355091 - RNA, 19 nt, Homo sapiens
caaacuggauccaaacaau

SEQ ID NO: 355092 - RNA, 19 nt, Homo sapiens
gacauuucaugccauuaua

SEQ ID NO: 355093 - RNA, 19 nt, Homo sapiens
gccauugucuuuauaugaa

SEQ ID NO: 355094 - RNA, 19 nt, Homo sapiens
uaacagugccauugucuuu

SEQ ID NO: 355095 - RNA, 19 nt, Homo sapiens
ccacagaggugaccauguc

SEQ ID NO: 355096 - RNA, 19 nt, Homo sapiens
gcauguaccuuaugauguc

SEQ ID NO: 355097 - RNA, 19 nt, Homo sapiens
guaaauaaccccauucuuu

SEQ ID NO: 355098 - RNA, 19 nt, Homo sapiens
gaacauagacuagagaaac

SEQ ID NO: 355099 - RNA, 19 nt, Homo sapiens
uaaguuggcuucuguuucu

SEQ ID NO: 355100 - RNA, 19 nt, Homo sapiens
aaaccaagcuuugauuuag

SEQ ID NO: 355101 - RNA, 19 nt, Homo sapiens
uuagaugguuacacuguua

SEQ ID NO: 355102 - RNA, 19 nt, Homo sapiens
gaggagagacuggaaguaa

SEQ ID NO: 355103 - RNA, 19 nt, Homo sapiens
gguguuggauucagaguug

SEQ ID NO: 355104 - RNA, 19 nt, Homo sapiens
caaauuccacagacuagua

SEQ ID NO: 355105 - RNA, 19 nt, Homo sapiens
gacagaagccacacacauu

SEQ ID NO: 355106 - RNA, 19 nt, Homo sapiens
guacagauaaagccaauau

SEQ ID NO: 355107 - RNA, 19 nt, Homo sapiens
aaacugacaccaaagaauu

SEQ ID NO: 355108 - RNA, 19 nt, Homo sapiens
aaagaaggcccuguauuaa

SEQ ID NO: 355109 - RNA, 19 nt, Homo sapiens
ggauuggccuggaguauac

SEQ ID NO: 355110 - RNA, 19 nt, Homo sapiens
cuaaacaguccgauacaua

SEQ ID NO: 355111 - RNA, 19 nt, Homo sapiens
agaaggcccuguauuaauc

SEQ ID NO: 355112 - RNA, 19 nt, Homo sapiens
ccauuuagguaagguagua

SEQ ID NO: 355113 - RNA, 19 nt, Homo sapiens
caaagguguuggauucaga

SEQ ID NO: 355114 - RNA, 19 nt, Homo sapiens
gcacuggagccauuuaugu

SEQ ID NO: 355115 - RNA, 19 nt, Homo sapiens
agaauaaccuggugauuuu

SEQ ID NO: 355116 - RNA, 19 nt, Homo sapiens
cacaggagauuuccacaug

SEQ ID NO: 355117 - RNA, 19 nt, Homo sapiens
ggaagauguuguucaugug

SEQ ID NO: 355118 - RNA, 19 nt, Homo sapiens
ggauacagaguaagaaaug

SEQ ID NO: 355119 - RNA, 19 nt, Homo sapiens
cguaagggcuacagucgaa

SEQ ID NO: 355120 - RNA, 19 nt, Homo sapiens
ggacuguacacacuuuauu

SEQ ID NO: 355121 - RNA, 19 nt, Homo sapiens
gcagugaccaagagaaaga

SEQ ID NO: 355122 - RNA, 19 nt, Homo sapiens
ccucacagcuuggcucuug

SEQ ID NO: 355123 - RNA, 19 nt, Homo sapiens
gugcacaaauauaauccua

SEQ ID NO: 355124 - RNA, 19 nt, Homo sapiens
ggaccaagaaccuguacaa

SEQ ID NO: 355125 - RNA, 19 nt, Homo sapiens
gaauuugugagagagauua

SEQ ID NO: 355126 - RNA, 19 nt, Homo sapiens
caauaaagaaggcccugua

SEQ ID NO: 355127 - RNA, 19 nt, Homo sapiens
cgugaagucugauaugguu

SEQ ID NO: 355128 - RNA, 19 nt, Homo sapiens
aagaauaaccuggugauuu

SEQ ID NO: 355129 - RNA, 19 nt, Homo sapiens
agacuaguaucuaccuuga

SEQ ID NO: 355130 - RNA, 19 nt, Homo sapiens
gauaagauuccuuuacuac

SEQ ID NO: 355131 - RNA, 19 nt, Homo sapiens
ggacagaagccacacacau

SEQ ID NO: 355132 - RNA, 19 nt, Homo sapiens
ggagagacuggaaguaaau

SEQ ID NO: 355133 - RNA, 19 nt, Homo sapiens
gaaacuaccagaccauuuu

SEQ ID NO: 355134 - RNA, 19 nt, Homo sapiens
caccuugacugagaaauug

SEQ ID NO: 355135 - RNA, 19 nt, Homo sapiens
aaacuggauccaaacaaua

SEQ ID NO: 355136 - RNA, 19 nt, Homo sapiens
ggaauuauugggucacaga

SEQ ID NO: 355137 - RNA, 19 nt, Homo sapiens
ucacaaauuccacagacua

SEQ ID NO: 355138 - RNA, 19 nt, Homo sapiens
gaaaugugcaacuuauaca

SEQ ID NO: 355139 - RNA, 19 nt, Homo sapiens
gcuggcauguaccuuauga

SEQ ID NO: 355140 - RNA, 19 nt, Homo sapiens
gaagcccacuuucugucuu

SEQ ID NO: 355141 - RNA, 19 nt, Homo sapiens
gcaccuuccuccuccugaa

SEQ ID NO: 355142 - RNA, 19 nt, Homo sapiens
ggaaguucaccuugacuga

SEQ ID NO: 355143 - RNA, 19 nt, Homo sapiens
agaccagggugauuucuau

SEQ ID NO: 355144 - RNA, 19 nt, Homo sapiens
uaagauuccuuuacuacag

SEQ ID NO: 355145 - RNA, 19 nt, Homo sapiens
gauaaagccaauauucugu

SEQ ID NO: 355146 - RNA, 19 nt, Homo sapiens
guggaaaguucaucacaca

SEQ ID NO: 355147 - RNA, 19 nt, Homo sapiens
cagaauguagcuccagaua

SEQ ID NO: 355148 - RNA, 19 nt, Homo sapiens
gcaugucuuugccuauaga

SEQ ID NO: 355149 - RNA, 19 nt, Homo sapiens
guucaugugcacaaauaua

SEQ ID NO: 355150 - RNA, 19 nt, Homo sapiens
ggagaaagggaagauguug

SEQ ID NO: 355151 - RNA, 19 nt, Homo sapiens
ccagggugauuucuauuca

SEQ ID NO: 355152 - RNA, 19 nt, Homo sapiens
gaagauuugcccauuuaca

SEQ ID NO: 355153 - RNA, 19 nt, Homo sapiens
gggaagauuuagaggaaag

SEQ ID NO: 355154 - RNA, 19 nt, Homo sapiens
gagccagcauggauacugu

SEQ ID NO: 355155 - RNA, 19 nt, Homo sapiens
cgagacgaguucaggaaga

SEQ ID NO: 355156 - RNA, 19 nt, Homo sapiens
cagcaggauugugcaguuu

SEQ ID NO: 355157 - RNA, 19 nt, Homo sapiens
caaguuuguuuaccagcaa

SEQ ID NO: 355158 - RNA, 19 nt, Homo sapiens
caauucccgugaagucuga

SEQ ID NO: 355159 - RNA, 19 nt, Homo sapiens
ugaaggaaccuguacagau

SEQ ID NO: 355160 - RNA, 19 nt, Homo sapiens
acagugccauugucuuuau

SEQ ID NO: 355161 - RNA, 19 nt, Homo sapiens
aaacuguacuagucugugu

SEQ ID NO: 355162 - RNA, 19 nt, Homo sapiens
gggcagugaccaagagaaa

SEQ ID NO: 355163 - RNA, 19 nt, Homo sapiens
gcauucaucauuuggaaga

SEQ ID NO: 355164 - RNA, 19 nt, Homo sapiens
ggaaaguucaucacacagu

SEQ ID NO: 355165 - RNA, 19 nt, Homo sapiens
gaaggaaccuguacagaua

SEQ ID NO: 355166 - RNA, 19 nt, Homo sapiens
uaaagaaggcccuguauua

SEQ ID NO: 355167 - RNA, 19 nt, Homo sapiens
gaauguagcuccagauaug

SEQ ID NO: 355168 - RNA, 19 nt, Homo sapiens
cgacaaagcugcuaaaucu

SEQ ID NO: 355169 - RNA, 19 nt, Homo sapiens
ccacauggcuugaguauag

SEQ ID NO: 355170 - RNA, 19 nt, Homo sapiens
gaaagaggaugauggaagu

SEQ ID NO: 355171 - RNA, 19 nt, Homo sapiens
guaaguggauacagaguaa

SEQ ID NO: 355172 - RNA, 19 nt, Homo sapiens
gcuuaaaccuugguaauuu

SEQ ID NO: 355173 - RNA, 19 nt, Homo sapiens
ccaagaaccuguacaagga

SEQ ID NO: 355174 - RNA, 19 nt, Homo sapiens
gaugaaaugugcaacuuau

SEQ ID NO: 355175 - RNA, 19 nt, Homo sapiens
gaacaucgaucaguuaaaa

SEQ ID NO: 355176 - RNA, 19 nt, Homo sapiens
ugagagagauuaagcauuc

SEQ ID NO: 355177 - RNA, 19 nt, Homo sapiens
gaagaguacugggaagauu

SEQ ID NO: 355178 - RNA, 19 nt, Homo sapiens
gaaacuuugugcuacauga

SEQ ID NO: 355179 - RNA, 19 nt, Homo sapiens
ucagauuccuuucccuuua

SEQ ID NO: 355180 - RNA, 19 nt, Homo sapiens
aaagggaaguggaggcuua

SEQ ID NO: 355181 - RNA, 19 nt, Homo sapiens
uggaagauuugcccauuua

SEQ ID NO: 355182 - RNA, 19 nt, Homo sapiens
gcauugagguccaggaaau

SEQ ID NO: 355183 - RNA, 19 nt, Homo sapiens
agaagaagaagaaguguua

SEQ ID NO: 355184 - RNA, 19 nt, Homo sapiens
gguaguaaguggauacaga

SEQ ID NO: 355185 - RNA, 19 nt, Homo sapiens
gaaauuggaacaucgauca

SEQ ID NO: 355186 - RNA, 19 nt, Homo sapiens
caaacuggauccaaacaau

SEQ ID NO: 355187 - RNA, 19 nt, Homo sapiens
gacauuucaugccauuaua

SEQ ID NO: 355188 - RNA, 19 nt, Homo sapiens
gccauugucuuuauaugaa

SEQ ID NO: 355189 - RNA, 19 nt, Homo sapiens
uaacagugccauugucuuu

SEQ ID NO: 355190 - RNA, 19 nt, Homo sapiens
ccacagaggugaccauguc

SEQ ID NO: 355191 - RNA, 19 nt, Homo sapiens
gcauguaccuuaugauguc

SEQ ID NO: 355192 - RNA, 19 nt, Homo sapiens
guaaauaaccccauucuuu

SEQ ID NO: 355193 - RNA, 19 nt, Homo sapiens
gaacauagacuagagaaac

SEQ ID NO: 355194 - RNA, 19 nt, Homo sapiens
uaaguuggcuucuguuucu

SEQ ID NO: 355195 - RNA, 19 nt, Homo sapiens
aaaccaagcuuugauuuag

SEQ ID NO: 355196 - RNA, 19 nt, Homo sapiens
uuagaugguuacacuguua

SEQ ID NO: 355197 - RNA, 19 nt, Homo sapiens
gaggagagacuggaaguaa

SEQ ID NO: 355198 - RNA, 19 nt, Homo sapiens
gguguuggauucagaguug

SEQ ID NO: 355199 - RNA, 19 nt, Homo sapiens
caaagaagccgaggcaguu

SEQ ID NO: 355200 - RNA, 19 nt, Homo sapiens
gacagaagccacacacauu

SEQ ID NO: 355201 - RNA, 19 nt, Homo sapiens
guacagauaaagccaauau

SEQ ID NO: 355202 - RNA, 19 nt, Homo sapiens
aaacugacaccaaagaauu

SEQ ID NO: 355203 - RNA, 19 nt, Homo sapiens
aaagaaggcccuguauuaa

SEQ ID NO: 355204 - RNA, 19 nt, Homo sapiens
ggauuggccuggaguauac

SEQ ID NO: 355205 - RNA, 19 nt, Homo sapiens
cuaaacaguccgauacaua

SEQ ID NO: 355206 - RNA, 19 nt, Homo sapiens
agaaggcccuguauuaauc

SEQ ID NO: 355207 - RNA, 19 nt, Homo sapiens
ccauuuagguaagguagua

SEQ ID NO: 355208 - RNA, 19 nt, Homo sapiens
caaagguguuggauucaga

SEQ ID NO: 355209 - RNA, 19 nt, Homo sapiens
gcacuggagccauuuaugu

SEQ ID NO: 355210 - RNA, 19 nt, Homo sapiens
agaauaaccuggugauuuu

SEQ ID NO: 355211 - RNA, 19 nt, Homo sapiens
ggauacagaguaagaaaug

SEQ ID NO: 355212 - RNA, 19 nt, Homo sapiens
cguaagggcuacagucgaa

SEQ ID NO: 355213 - RNA, 19 nt, Homo sapiens
ggacuguacacacuuuauu

SEQ ID NO: 355214 - RNA, 19 nt, Homo sapiens
gcagugaccaagagaaaga

SEQ ID NO: 355215 - RNA, 19 nt, Homo sapiens
ccucacagcuuggcucuug

SEQ ID NO: 355216 - RNA, 19 nt, Homo sapiens
ggaccaagaaccuguacaa

SEQ ID NO: 355217 - RNA, 19 nt, Homo sapiens
gaauuugugagagagauua

SEQ ID NO: 355218 - RNA, 19 nt, Homo sapiens
caauaaagaaggcccugua

SEQ ID NO: 355219 - RNA, 19 nt, Homo sapiens
cgugaagucugauaugguu

SEQ ID NO: 355220 - RNA, 19 nt, Homo sapiens
aagaauaaccuggugauuu

SEQ ID NO: 355221 - RNA, 19 nt, Homo sapiens
gaaacuaccagaccauuuu

SEQ ID NO: 355222 - RNA, 19 nt, Homo sapiens
gauaagauuccuuuacuac

SEQ ID NO: 355223 - RNA, 19 nt, Homo sapiens
ggacagaagccacacacau

SEQ ID NO: 355224 - RNA, 19 nt, Homo sapiens
ggagagacuggaaguaaau

SEQ ID NO: 355225 - RNA, 19 nt, Homo sapiens
caccuugacugagaaauug

SEQ ID NO: 355226 - RNA, 19 nt, Homo sapiens
aaacuggauccaaacaaua

SEQ ID NO: 355227 - RNA, 19 nt, Homo sapiens
ggaauuauugggucacaga

SEQ ID NO: 355228 - RNA, 19 nt, Homo sapiens
gaaaugugcaacuuauaca

SEQ ID NO: 355229 - RNA, 19 nt, Homo sapiens
gcuggcauguaccuuauga

SEQ ID NO: 355230 - RNA, 19 nt, Homo sapiens
gaagcccacuuucugucuu

SEQ ID NO: 355231 - RNA, 19 nt, Homo sapiens
gcaccuuccuccuccugaa

SEQ ID NO: 355232 - RNA, 19 nt, Homo sapiens
aaacccaccuccucagaau

SEQ ID NO: 355233 - RNA, 19 nt, Homo sapiens
ggaaguucaccuugacuga

SEQ ID NO: 355234 - RNA, 19 nt, Homo sapiens
uaagauuccuuuacuacag

SEQ ID NO: 355235 - RNA, 19 nt, Homo sapiens
gauaaagccaauauucugu

SEQ ID NO: 355236 - RNA, 19 nt, Homo sapiens
guggaaaguucaucacaca

SEQ ID NO: 355237 - RNA, 19 nt, Homo sapiens
cagaauguagcuccagaua

SEQ ID NO: 355238 - RNA, 19 nt, Homo sapiens
gcaugucuuugccuauaga

SEQ ID NO: 355239 - RNA, 19 nt, Homo sapiens
ccucagaauugcagaagau

SEQ ID NO: 355240 - RNA, 19 nt, Homo sapiens
gaagauuugcccauuuaca

SEQ ID NO: 355241 - RNA, 19 nt, Homo sapiens
gggaagauuuagaggaaag

SEQ ID NO: 355242 - RNA, 19 nt, Homo sapiens
gcagaagaugcaagagaaa

SEQ ID NO: 355243 - RNA, 19 nt, Homo sapiens
gagccagcauggauacugu

SEQ ID NO: 355244 - RNA, 19 nt, Homo sapiens
cgagacgaguucaggaaga

SEQ ID NO: 355245 - RNA, 19 nt, Homo sapiens
cagcaggauugugcaguuu

SEQ ID NO: 355246 - RNA, 19 nt, Homo sapiens
caaguuuguuuaccagcaa

SEQ ID NO: 355247 - RNA, 19 nt, Homo sapiens
caauucccgugaagucuga

SEQ ID NO: 355248 - RNA, 19 nt, Homo sapiens
ugaaggaaccuguacagau

SEQ ID NO: 355249 - RNA, 19 nt, Homo sapiens
acagugccauugucuuuau

SEQ ID NO: 355250 - RNA, 19 nt, Homo sapiens
aaacuguacuagucugugu

SEQ ID NO: 355251 - RNA, 19 nt, Homo sapiens
gggcagugaccaagagaaa

SEQ ID NO: 355252 - RNA, 19 nt, Homo sapiens
uggagauucugaacacaaa

SEQ ID NO: 355253 - RNA, 19 nt, Homo sapiens
gcauucaucauuuggaaga

SEQ ID NO: 355254 - RNA, 19 nt, Homo sapiens
ggaaaguucaucacacagu

SEQ ID NO: 355255 - RNA, 19 nt, Homo sapiens
ccaagcaugcaguuucuuu

SEQ ID NO: 355256 - RNA, 19 nt, Homo sapiens
gugaugaaaugugcaacuu

SEQ ID NO: 355257 - RNA, 19 nt, Homo sapiens
gcacgucuagugaugaaau

SEQ ID NO: 355258 - RNA, 19 nt, Homo sapiens
gacuguacacacuuuauuu

SEQ ID NO: 355259 - RNA, 19 nt, Homo sapiens
cguuuaaaguucuguguau

SEQ ID NO: 355260 - RNA, 19 nt, Homo sapiens
gaaaaccaagcuuugauuu

SEQ ID NO: 355261 - RNA, 19 nt, Homo sapiens
cugggaagauuuagaggaa

SEQ ID NO: 355262 - RNA, 19 nt, Homo sapiens
auaccaggcuugcucuuug

SEQ ID NO: 355263 - RNA, 19 nt, Homo sapiens
agaccaggauuuccacaug

SEQ ID NO: 355264 - RNA, 19 nt, Homo sapiens
ccuacuggcugcaagaugu

SEQ ID NO: 355265 - RNA, 19 nt, Homo sapiens
gaaggaaccuguacagaua

SEQ ID NO: 355266 - RNA, 19 nt, Homo sapiens
uaaagaaggcccuguauua

SEQ ID NO: 355267 - RNA, 19 nt, Homo sapiens
gaauguagcuccagauaug

SEQ ID NO: 355268 - RNA, 19 nt, Homo sapiens
cgacaaagcugcuaaaucu

SEQ ID NO: 355269 - RNA, 19 nt, Homo sapiens
ccacauggcuugaguauag

SEQ ID NO: 355270 - RNA, 19 nt, Homo sapiens
gaaagaggaugauggaagu

SEQ ID NO: 355271 - RNA, 19 nt, Homo sapiens
gagcagaguuuucucauua

SEQ ID NO: 355272 - RNA, 19 nt, Homo sapiens
guaaguggauacagaguaa

SEQ ID NO: 355273 - RNA, 19 nt, Homo sapiens
gcuuaaaccuugguaauuu

SEQ ID NO: 355274 - RNA, 19 nt, Homo sapiens
ccaagaaccuguacaagga

SEQ ID NO: 355275 - RNA, 19 nt, Homo sapiens
gaugaaaugugcaacuuau

SEQ ID NO: 355276 - RNA, 19 nt, Homo sapiens
gaacaucgaucaguuaaaa

SEQ ID NO: 355277 - RNA, 19 nt, Homo sapiens
ugagagagauuaagcauuc

SEQ ID NO: 355278 - RNA, 19 nt, Homo sapiens
gcacaaauauaauccuaca

SEQ ID NO: 355279 - RNA, 19 nt, Homo sapiens
gaaacuuugugcuacauga

SEQ ID NO: 355280 - RNA, 19 nt, Homo sapiens
ucagauuccuuucccuuua

SEQ ID NO: 355281 - RNA, 19 nt, Homo sapiens
aaagggaaguggaggcuua

SEQ ID NO: 355282 - RNA, 19 nt, Homo sapiens
gggaagauguuguucaugu

SEQ ID NO: 355283 - RNA, 19 nt, Homo sapiens
uggaagauuugcccauuua

SEQ ID NO: 355284 - RNA, 19 nt, Homo sapiens
gcauugagguccaggaaau

SEQ ID NO: 355285 - RNA, 19 nt, Homo sapiens
uagcugagauugcaaaugu

SEQ ID NO: 355286 - RNA, 19 nt, Homo sapiens
agaagaagaagaaguguua

SEQ ID NO: 355287 - RNA, 19 nt, Homo sapiens
gguaguaaguggauacaga

SEQ ID NO: 355288 - RNA, 19 nt, Homo sapiens
gaaauuggaacaucgauca

SEQ ID NO: 355289 - RNA, 19 nt, Homo sapiens
caaacuggauccaaacaau

SEQ ID NO: 355290 - RNA, 19 nt, Homo sapiens
gacauuucaugccauuaua

SEQ ID NO: 355291 - RNA, 19 nt, Homo sapiens
gccauugucuuuauaugaa

SEQ ID NO: 355292 - RNA, 19 nt, Homo sapiens
uaacagugccauugucuuu

SEQ ID NO: 355293 - RNA, 19 nt, Homo sapiens
ccacagaggugaccauguc

SEQ ID NO: 355294 - RNA, 19 nt, Homo sapiens
gcauguaccuuaugauguc

SEQ ID NO: 355295 - RNA, 19 nt, Homo sapiens
guaaauaaccccauucuuu

SEQ ID NO: 355296 - RNA, 19 nt, Homo sapiens
gaacauagacuagagaaac

SEQ ID NO: 355297 - RNA, 19 nt, Homo sapiens
uaaguuggcuucuguuucu

SEQ ID NO: 355298 - RNA, 19 nt, Homo sapiens
aaaccaagcuuugauuuag

SEQ ID NO: 355299 - RNA, 19 nt, Homo sapiens
uuagaugguuacacuguua

SEQ ID NO: 355300 - RNA, 19 nt, Homo sapiens
gaggagagacuggaaguaa

SEQ ID NO: 355301 - RNA, 19 nt, Homo sapiens
gguguuggauucagaguug

SEQ ID NO: 355302 - RNA, 19 nt, Homo sapiens
caaauuccacagacuagua

SEQ ID NO: 355303 - RNA, 19 nt, Homo sapiens
gacagaagccacacacauu

SEQ ID NO: 355304 - RNA, 19 nt, Homo sapiens
guacagauaaagccaauau

SEQ ID NO: 355305 - RNA, 19 nt, Homo sapiens
aaacugacaccaaagaauu

SEQ ID NO: 355306 - RNA, 19 nt, Homo sapiens
aaagaaggcccuguauuaa

SEQ ID NO: 355307 - RNA, 19 nt, Homo sapiens
ggauuggccuggaguauac

SEQ ID NO: 355308 - RNA, 19 nt, Homo sapiens
cuaaacaguccgauacaua

SEQ ID NO: 355309 - RNA, 19 nt, Homo sapiens
agaaggcccuguauuaauc

SEQ ID NO: 355310 - RNA, 19 nt, Homo sapiens
ccauuuagguaagguagua

SEQ ID NO: 355311 - RNA, 19 nt, Homo sapiens
caaagguguuggauucaga

SEQ ID NO: 355312 - RNA, 19 nt, Homo sapiens
gcacuggagccauuuaugu

SEQ ID NO: 355313 - RNA, 19 nt, Homo sapiens
agaauaaccuggugauuuu

SEQ ID NO: 355314 - RNA, 19 nt, Homo sapiens
cacaggagauuuccacaug

SEQ ID NO: 355315 - RNA, 19 nt, Homo sapiens
ggaagauguuguucaugug

SEQ ID NO: 355316 - RNA, 19 nt, Homo sapiens
ggauacagaguaagaaaug

SEQ ID NO: 355317 - RNA, 19 nt, Homo sapiens
cguaagggcuacagucgaa

SEQ ID NO: 355318 - RNA, 19 nt, Homo sapiens
ggacuguacacacuuuauu

SEQ ID NO: 355319 - RNA, 19 nt, Homo sapiens
gcagugaccaagagaaaga

SEQ ID NO: 355320 - RNA, 19 nt, Homo sapiens
ccucacagcuuggcucuug

SEQ ID NO: 355321 - RNA, 19 nt, Homo sapiens
gugcacaaauauaauccua

SEQ ID NO: 355322 - RNA, 19 nt, Homo sapiens
ggaccaagaaccuguacaa

SEQ ID NO: 355323 - RNA, 19 nt, Homo sapiens
gaauuugugagagagauua

SEQ ID NO: 355324 - RNA, 19 nt, Homo sapiens
caauaaagaaggcccugua

SEQ ID NO: 355325 - RNA, 19 nt, Homo sapiens
cgugaagucugauaugguu

SEQ ID NO: 355326 - RNA, 19 nt, Homo sapiens
aagaauaaccuggugauuu

SEQ ID NO: 355327 - RNA, 19 nt, Homo sapiens
agacuaguaucuaccuuga

SEQ ID NO: 355328 - RNA, 19 nt, Homo sapiens
gaaacuaccagaccauuuu

SEQ ID NO: 355329 - RNA, 19 nt, Homo sapiens
gauaagauuccuuuacuac

SEQ ID NO: 355330 - RNA, 19 nt, Homo sapiens
ggacagaagccacacacau

SEQ ID NO: 355331 - RNA, 19 nt, Homo sapiens
ggagagacuggaaguaaau

SEQ ID NO: 355332 - RNA, 19 nt, Homo sapiens
caccuugacugagaaauug

SEQ ID NO: 355333 - RNA, 19 nt, Homo sapiens
aaacuggauccaaacaaua

SEQ ID NO: 355334 - RNA, 19 nt, Homo sapiens
ggaauuauugggucacaga

SEQ ID NO: 355335 - RNA, 19 nt, Homo sapiens
ucacaaauuccacagacua

SEQ ID NO: 355336 - RNA, 19 nt, Homo sapiens
gaaaugugcaacuuauaca

SEQ ID NO: 355337 - RNA, 19 nt, Homo sapiens
gcuggcauguaccuuauga

SEQ ID NO: 355338 - RNA, 19 nt, Homo sapiens
gcaccuuccuccuccugaa

SEQ ID NO: 355339 - RNA, 19 nt, Homo sapiens
ggaaguucaccuugacuga

SEQ ID NO: 355340 - RNA, 19 nt, Homo sapiens
agaccagggugauuucuau

SEQ ID NO: 355341 - RNA, 19 nt, Homo sapiens
uaagauuccuuuacuacag

SEQ ID NO: 355342 - RNA, 19 nt, Homo sapiens
gaagcccacuuucugucuu

SEQ ID NO: 355343 - RNA, 19 nt, Homo sapiens
gauaaagccaauauucugu

SEQ ID NO: 355344 - RNA, 19 nt, Homo sapiens
guggaaaguucaucacaca

SEQ ID NO: 355345 - RNA, 19 nt, Homo sapiens
cagaauguagcuccagaua

SEQ ID NO: 355346 - RNA, 19 nt, Homo sapiens
gcaugucuuugccuauaga

SEQ ID NO: 355347 - RNA, 19 nt, Homo sapiens
guucaugugcacaaauaua

SEQ ID NO: 355348 - RNA, 19 nt, Homo sapiens
ggagaaagggaagauguug

SEQ ID NO: 355349 - RNA, 19 nt, Homo sapiens
ccagggugauuucuauuca

SEQ ID NO: 355350 - RNA, 19 nt, Homo sapiens
gaagauuugcccauuuaca

SEQ ID NO: 355351 - RNA, 19 nt, Homo sapiens
gagccagcauggauacugu

SEQ ID NO: 355352 - RNA, 19 nt, Homo sapiens
cagcaggauugugcaguuu

SEQ ID NO: 355353 - RNA, 19 nt, Homo sapiens
caaguuuguuuaccagcaa

SEQ ID NO: 355354 - RNA, 19 nt, Homo sapiens
caauucccgugaagucuga

SEQ ID NO: 355355 - RNA, 19 nt, Homo sapiens
ugaaggaaccuguacagau

SEQ ID NO: 355356 - RNA, 19 nt, Homo sapiens
acagugccauugucuuuau

SEQ ID NO: 355357 - RNA, 19 nt, Homo sapiens
aaacuguacuagucugugu

SEQ ID NO: 355358 - RNA, 19 nt, Homo sapiens
gggcagugaccaagagaaa

SEQ ID NO: 355359 - RNA, 19 nt, Homo sapiens
gcauucaucauuuggaaga

SEQ ID NO: 355360 - RNA, 19 nt, Homo sapiens
ggaaaguucaucacacagu

SEQ ID NO: 355361 - RNA, 19 nt, Homo sapiens
gauugcaaauguaguccaa

SEQ ID NO: 355362 - RNA, 19 nt, Homo sapiens
ccaagcaugcaguuucuuu

SEQ ID NO: 355363 - RNA, 19 nt, Homo sapiens
gugaugaaaugugcaacuu

SEQ ID NO: 355364 - RNA, 19 nt, Homo sapiens
gcacgucuagugaugaaau

SEQ ID NO: 355365 - RNA, 19 nt, Homo sapiens
gcagugaugugaugaauua

SEQ ID NO: 355366 - RNA, 19 nt, Homo sapiens
ggaagagaauauucgcuua

SEQ ID NO: 355367 - RNA, 19 nt, Homo sapiens
ccacugcuaugccuuguuu

SEQ ID NO: 355368 - RNA, 19 nt, Homo sapiens
gaagagaauauucgcuuaa

SEQ ID NO: 355369 - RNA, 19 nt, Homo sapiens
guggaaagauuauaacugu

SEQ ID NO: 355370 - RNA, 19 nt, Homo sapiens
ccaccucauucuuaucuuu

SEQ ID NO: 355371 - RNA, 19 nt, Homo sapiens
gaagucagcagccuguguu

SEQ ID NO: 355372 - RNA, 19 nt, Homo sapiens
gaguagcagugaugugaug

SEQ ID NO: 355373 - RNA, 19 nt, Homo sapiens
agaaaucccuccaccaucu

SEQ ID NO: 355374 - RNA, 19 nt, Homo sapiens
gugaugugaugaauuacuu

SEQ ID NO: 355375 - RNA, 19 nt, Homo sapiens
ucauuucagucucuucauu

SEQ ID NO: 355376 - RNA, 19 nt, Homo sapiens
gguaacagcuacucauacg

SEQ ID NO: 355377 - RNA, 19 nt, Homo sapiens
ccugaccaccucauucuua

SEQ ID NO: 355378 - RNA, 19 nt, Homo sapiens
ggacucacccuggaagaga

SEQ ID NO: 355379 - RNA, 19 nt, Homo sapiens
uaucuuggaugcugcuuuc

SEQ ID NO: 355380 - RNA, 19 nt, Homo sapiens
cuggaaaccuggugucugu

SEQ ID NO: 355381 - RNA, 19 nt, Homo sapiens
ugagguggaaagauuauaa

SEQ ID NO: 355382 - RNA, 19 nt, Homo sapiens
aaugugagguuacccuaug

SEQ ID NO: 355383 - RNA, 19 nt, Homo sapiens
cagcauuucugagguggaa

SEQ ID NO: 355384 - RNA, 19 nt, Homo sapiens
uaccauaucccaccagaga

SEQ ID NO: 355385 - RNA, 19 nt, Homo sapiens
gaagguugggaguggagua

SEQ ID NO: 355386 - RNA, 19 nt, Homo sapiens
gugaagagcauugguaaca

SEQ ID NO: 355387 - RNA, 19 nt, Homo sapiens
gggcaugagaccaguguga

SEQ ID NO: 355388 - RNA, 19 nt, Homo sapiens
ucaagucgcagacacuaug

SEQ ID NO: 355389 - RNA, 19 nt, Homo sapiens
gugcgagccugucgagaag

SEQ ID NO: 355390 - RNA, 19 nt, Homo sapiens
gaugugaugaauuacuuug

SEQ ID NO: 355391 - RNA, 19 nt, Homo sapiens
caaccugaccaccucauuc

SEQ ID NO: 355392 - RNA, 19 nt, Homo sapiens
ggaagucagcagccugugu

SEQ ID NO: 355393 - RNA, 19 nt, Homo sapiens
ggaguggaguagcagugau

SEQ ID NO: 355394 - RNA, 19 nt, Homo sapiens
ccaaaauccuggacagaug

SEQ ID NO: 355395 - RNA, 19 nt, Homo sapiens
gacucacccuggaagagaa

SEQ ID NO: 355396 - RNA, 19 nt, Homo sapiens
uagcagugaugugaugaau

SEQ ID NO: 355397 - RNA, 19 nt, Homo sapiens
cauuucagucucuucauuu

SEQ ID NO: 355398 - RNA, 19 nt, Homo sapiens
ucugcaaguucacugacua

SEQ ID NO: 355399 - RNA, 19 nt, Homo sapiens
gaccaccucauucuuaucu

SEQ ID NO: 355400 - RNA, 19 nt, Homo sapiens
cuacucauacgucuggauu

SEQ ID NO: 355401 - RNA, 19 nt, Homo sapiens
cggauccgcugucccaaag

SEQ ID NO: 355402 - RNA, 19 nt, Homo sapiens
agagaaaucccuccaccau

SEQ ID NO: 355403 - RNA, 19 nt, Homo sapiens
cugauugccuccucaaguc

SEQ ID NO: 355404 - RNA, 19 nt, Homo sapiens
cugaccaccucauucuuau

SEQ ID NO: 355405 - RNA, 19 nt, Homo sapiens
uggaguagcagugauguga

SEQ ID NO: 355406 - RNA, 19 nt, Homo sapiens
cuaaggcuuuaaagagcaa

SEQ ID NO: 355407 - RNA, 19 nt, Homo sapiens
gguggaaagauuauaacug

SEQ ID NO: 355408 - RNA, 19 nt, Homo sapiens
gucgagaagcacagcauuu

SEQ ID NO: 355409 - RNA, 19 nt, Homo sapiens
gcgagccugucgagaagca

SEQ ID NO: 355410 - RNA, 19 nt, Homo sapiens
gugaugaauuacuuugcau

SEQ ID NO: 355411 - RNA, 19 nt, Homo sapiens
ugugaugaauuacuuugca

SEQ ID NO: 355412 - RNA, 19 nt, Homo sapiens
uacccuaugucugcaaguu

SEQ ID NO: 355413 - RNA, 19 nt, Homo sapiens
gggaguggaguagcaguga

SEQ ID NO: 355414 - RNA, 19 nt, Homo sapiens
gcugcugucucagguucaa

SEQ ID NO: 355415 - RNA, 19 nt, Homo sapiens
gaguggaguagcagugaug

SEQ ID NO: 355416 - RNA, 19 nt, Homo sapiens
cccuaugucugcaaguuca

SEQ ID NO: 355417 - RNA, 19 nt, Homo sapiens
gguugggaguggaguagca

SEQ ID NO: 355418 - RNA, 19 nt, Homo sapiens
ugaagagcauugguaacag

SEQ ID NO: 355419 - RNA, 19 nt, Homo sapiens
gcagugaugugaugaauua

SEQ ID NO: 355420 - RNA, 19 nt, Homo sapiens
ggaagagaauauucgcuua

SEQ ID NO: 355421 - RNA, 19 nt, Homo sapiens
ccacugcuaugccuuguuu

SEQ ID NO: 355422 - RNA, 19 nt, Homo sapiens
gaagagaauauucgcuuaa

SEQ ID NO: 355423 - RNA, 19 nt, Homo sapiens
guggaaagauuauaacugu

SEQ ID NO: 355424 - RNA, 19 nt, Homo sapiens
ccaccucauucuuaucuuu

SEQ ID NO: 355425 - RNA, 19 nt, Homo sapiens
gaagucagcagccuguguu

SEQ ID NO: 355426 - RNA, 19 nt, Homo sapiens
gaguagcagugaugugaug

SEQ ID NO: 355427 - RNA, 19 nt, Homo sapiens
agaaaucccuccaccaucu

SEQ ID NO: 355428 - RNA, 19 nt, Homo sapiens
gugaugugaugaauuacuu

SEQ ID NO: 355429 - RNA, 19 nt, Homo sapiens
ucauuucagucucuucauu

SEQ ID NO: 355430 - RNA, 19 nt, Homo sapiens
gguaacagcuacucauacg

SEQ ID NO: 355431 - RNA, 19 nt, Homo sapiens
ccugaccaccucauucuua

SEQ ID NO: 355432 - RNA, 19 nt, Homo sapiens
ggacucacccuggaagaga

SEQ ID NO: 355433 - RNA, 19 nt, Homo sapiens
uaucuuggaugcugcuuuc

SEQ ID NO: 355434 - RNA, 19 nt, Homo sapiens
gagagucgcagacacuaug

SEQ ID NO: 355435 - RNA, 19 nt, Homo sapiens
cuggaaaccuggugucugu

SEQ ID NO: 355436 - RNA, 19 nt, Homo sapiens
ugagguggaaagauuauaa

SEQ ID NO: 355437 - RNA, 19 nt, Homo sapiens
aaugugagguuacccuaug

SEQ ID NO: 355438 - RNA, 19 nt, Homo sapiens
cagcauuucugagguggaa

SEQ ID NO: 355439 - RNA, 19 nt, Homo sapiens
uaccauaucccaccagaga

SEQ ID NO: 355440 - RNA, 19 nt, Homo sapiens
gaagguugggaguggagua

SEQ ID NO: 355441 - RNA, 19 nt, Homo sapiens
gugaagagcauugguaaca

SEQ ID NO: 355442 - RNA, 19 nt, Homo sapiens
gggcaugagaccaguguga

SEQ ID NO: 355443 - RNA, 19 nt, Homo sapiens
gugcgagccugucgagaag

SEQ ID NO: 355444 - RNA, 19 nt, Homo sapiens
gaugugaugaauuacuuug

SEQ ID NO: 355445 - RNA, 19 nt, Homo sapiens
caaccugaccaccucauuc

SEQ ID NO: 355446 - RNA, 19 nt, Homo sapiens
ggaagucagcagccugugu

SEQ ID NO: 355447 - RNA, 19 nt, Homo sapiens
ggaguggaguagcagugau

SEQ ID NO: 355448 - RNA, 19 nt, Homo sapiens
ccaaaauccuggacagaug

SEQ ID NO: 355449 - RNA, 19 nt, Homo sapiens
gacucacccuggaagagaa

SEQ ID NO: 355450 - RNA, 19 nt, Homo sapiens
uagcagugaugugaugaau

SEQ ID NO: 355451 - RNA, 19 nt, Homo sapiens
cauuucagucucuucauuu

SEQ ID NO: 355452 - RNA, 19 nt, Homo sapiens
ucugcaaguucacugacua

SEQ ID NO: 355453 - RNA, 19 nt, Homo sapiens
gaccaccucauucuuaucu

SEQ ID NO: 355454 - RNA, 19 nt, Homo sapiens
cuacucauacgucuggauu

SEQ ID NO: 355455 - RNA, 19 nt, Homo sapiens
cggauccgcugucccaaag

SEQ ID NO: 355456 - RNA, 19 nt, Homo sapiens
agagaaaucccuccaccau

SEQ ID NO: 355457 - RNA, 19 nt, Homo sapiens
cugaccaccucauucuuau

SEQ ID NO: 355458 - RNA, 19 nt, Homo sapiens
uggaguagcagugauguga

SEQ ID NO: 355459 - RNA, 19 nt, Homo sapiens
cuaaggcuuuaaagagcaa

SEQ ID NO: 355460 - RNA, 19 nt, Homo sapiens
gguggaaagauuauaacug

SEQ ID NO: 355461 - RNA, 19 nt, Homo sapiens
gucgagaagcacagcauuu

SEQ ID NO: 355462 - RNA, 19 nt, Homo sapiens
gcgagccugucgagaagca

SEQ ID NO: 355463 - RNA, 19 nt, Homo sapiens
gugaugaauuacuuugcau

SEQ ID NO: 355464 - RNA, 19 nt, Homo sapiens
ugugaugaauuacuuugca

SEQ ID NO: 355465 - RNA, 19 nt, Homo sapiens
uacccuaugucugcaaguu

SEQ ID NO: 355466 - RNA, 19 nt, Homo sapiens
gggaguggaguagcaguga

SEQ ID NO: 355467 - RNA, 19 nt, Homo sapiens
ccagagagucgcagacacu

SEQ ID NO: 355468 - RNA, 19 nt, Homo sapiens
gcugcugucucagguucaa

SEQ ID NO: 355469 - RNA, 19 nt, Homo sapiens
gaguggaguagcagugaug

SEQ ID NO: 355470 - RNA, 19 nt, Homo sapiens
cccuaugucugcaaguuca

SEQ ID NO: 355471 - RNA, 19 nt, Homo sapiens
gguugggaguggaguagca

SEQ ID NO: 355472 - RNA, 19 nt, Homo sapiens
ugaagagcauugguaacag

SEQ ID NO: 355473 - RNA, 19 nt, Homo sapiens
gcagugaugugaugaauua

SEQ ID NO: 355474 - RNA, 19 nt, Homo sapiens
ggaagagaauauucgcuua

SEQ ID NO: 355475 - RNA, 19 nt, Homo sapiens
caagaucacuuuaguccua

SEQ ID NO: 355476 - RNA, 19 nt, Homo sapiens
ccacugcuaugccuuguuu

SEQ ID NO: 355477 - RNA, 19 nt, Homo sapiens
gaagagaauauucgcuuaa

SEQ ID NO: 355478 - RNA, 19 nt, Homo sapiens
guggaaagauuauaacugu

SEQ ID NO: 355479 - RNA, 19 nt, Homo sapiens
guacacagauucacaacuc

SEQ ID NO: 355480 - RNA, 19 nt, Homo sapiens
ccaccucauucuuaucuuu

SEQ ID NO: 355481 - RNA, 19 nt, Homo sapiens
gaagucagcagccuguguu

SEQ ID NO: 355482 - RNA, 19 nt, Homo sapiens
ugaccaagaucacuuuagu

SEQ ID NO: 355483 - RNA, 19 nt, Homo sapiens
uguagaagaugauggaugu

SEQ ID NO: 355484 - RNA, 19 nt, Homo sapiens
ucagaacuguagaagauga

SEQ ID NO: 355485 - RNA, 19 nt, Homo sapiens
gaguagcagugaugugaug

SEQ ID NO: 355486 - RNA, 19 nt, Homo sapiens
ugaccacgcuuucuuuagu

SEQ ID NO: 355487 - RNA, 19 nt, Homo sapiens
agaaaucccuccaccaucu

SEQ ID NO: 355488 - RNA, 19 nt, Homo sapiens
auucagaacuguagaagau

SEQ ID NO: 355489 - RNA, 19 nt, Homo sapiens
gugaugugaugaauuacuu

SEQ ID NO: 355490 - RNA, 19 nt, Homo sapiens
ucauuucagucucuucauu

SEQ ID NO: 355491 - RNA, 19 nt, Homo sapiens
gguaacagcuacucauacg

SEQ ID NO: 355492 - RNA, 19 nt, Homo sapiens
ccugaccaccucauucuua

SEQ ID NO: 355493 - RNA, 19 nt, Homo sapiens
ggacucacccuggaagaga

SEQ ID NO: 355494 - RNA, 19 nt, Homo sapiens
uaucuuggaugcugcuuuc

SEQ ID NO: 355495 - RNA, 19 nt, Homo sapiens
auucacaacucauucagaa

SEQ ID NO: 355496 - RNA, 19 nt, Homo sapiens
cuggaaaccuggugucugu

SEQ ID NO: 355497 - RNA, 19 nt, Homo sapiens
ugagguggaaagauuauaa

SEQ ID NO: 355498 - RNA, 19 nt, Homo sapiens
aaugugagguuacccuaug

SEQ ID NO: 355499 - RNA, 19 nt, Homo sapiens
cagcauuucugagguggaa

SEQ ID NO: 355500 - RNA, 19 nt, Homo sapiens
gaccacgcuuucuuuagug

SEQ ID NO: 355501 - RNA, 19 nt, Homo sapiens
ugauggaugugaccaagau

SEQ ID NO: 355502 - RNA, 19 nt, Homo sapiens
gaagguugggaguggagua

SEQ ID NO: 355503 - RNA, 19 nt, Homo sapiens
gugaagagcauugguaaca

SEQ ID NO: 355504 - RNA, 19 nt, Homo sapiens
gagcacaggaacucugaga

SEQ ID NO: 355505 - RNA, 19 nt, Homo sapiens
gcacaggaacucugagacu

SEQ ID NO: 355506 - RNA, 19 nt, Homo sapiens
ccacugaccacgcuuucuu

SEQ ID NO: 355507 - RNA, 19 nt, Homo sapiens
gagaguacacagauucaca

SEQ ID NO: 355508 - RNA, 19 nt, Homo sapiens
caacucauucagaacugua

SEQ ID NO: 355509 - RNA, 19 nt, Homo sapiens
gggcaugagaccaguguga

SEQ ID NO: 355510 - RNA, 19 nt, Homo sapiens
gaugggagaguacacagau

SEQ ID NO: 355511 - RNA, 19 nt, Homo sapiens
gugcgagccugucgagaag

SEQ ID NO: 355512 - RNA, 19 nt, Homo sapiens
gaugugaugaauuacuuug

SEQ ID NO: 355513 - RNA, 19 nt, Homo sapiens
ucaagucgcagacacuaug

SEQ ID NO: 355514 - RNA, 19 nt, Homo sapiens
caaccugaccaccucauuc

SEQ ID NO: 355515 - RNA, 19 nt, Homo sapiens
ggaagucagcagccugugu

SEQ ID NO: 355516 - RNA, 19 nt, Homo sapiens
ggaguggaguagcagugau

SEQ ID NO: 355517 - RNA, 19 nt, Homo sapiens
ccaaaauccuggacagaug

SEQ ID NO: 355518 - RNA, 19 nt, Homo sapiens
gacucacccuggaagagaa

SEQ ID NO: 355519 - RNA, 19 nt, Homo sapiens
uagcagugaugugaugaau

SEQ ID NO: 355520 - RNA, 19 nt, Homo sapiens
cauuucagucucuucauuu

SEQ ID NO: 355521 - RNA, 19 nt, Homo sapiens
ucugcaaguucacugacua

SEQ ID NO: 355522 - RNA, 19 nt, Homo sapiens
gaccaccucauucuuaucu

SEQ ID NO: 355523 - RNA, 19 nt, Homo sapiens
uagaagaugauggauguga

SEQ ID NO: 355524 - RNA, 19 nt, Homo sapiens
cuacucauacgucuggauu

SEQ ID NO: 355525 - RNA, 19 nt, Homo sapiens
cggauccgcugucccaaag

SEQ ID NO: 355526 - RNA, 19 nt, Homo sapiens
agagaaaucccuccaccau

SEQ ID NO: 355527 - RNA, 19 nt, Homo sapiens
gggagcacaggaacucuga

SEQ ID NO: 355528 - RNA, 19 nt, Homo sapiens
cugauugccuccucaaguc

SEQ ID NO: 355529 - RNA, 19 nt, Homo sapiens
cugaccaccucauucuuau

SEQ ID NO: 355530 - RNA, 19 nt, Homo sapiens
ucacaacucauucagaacu

SEQ ID NO: 355531 - RNA, 19 nt, Homo sapiens
uggaguagcagugauguga

SEQ ID NO: 355532 - RNA, 19 nt, Homo sapiens
cuaaggcuuuaaagagcaa

SEQ ID NO: 355533 - RNA, 19 nt, Homo sapiens
gguggaaagauuauaacug

SEQ ID NO: 355534 - RNA, 19 nt, Homo sapiens
gucgagaagcacagcauuu

SEQ ID NO: 355535 - RNA, 19 nt, Homo sapiens
gcgagccugucgagaagca

SEQ ID NO: 355536 - RNA, 19 nt, Homo sapiens
gugaugaauuacuuugcau

SEQ ID NO: 355537 - RNA, 19 nt, Homo sapiens
ugugaugaauuacuuugca

SEQ ID NO: 355538 - RNA, 19 nt, Homo sapiens
uacccuaugucugcaaguu

SEQ ID NO: 355539 - RNA, 19 nt, Homo sapiens
ggaugggagaguacacaga

SEQ ID NO: 355540 - RNA, 19 nt, Homo sapiens
cagauucacaacucauuca

SEQ ID NO: 355541 - RNA, 19 nt, Homo sapiens
gggaguggaguagcaguga

SEQ ID NO: 355542 - RNA, 19 nt, Homo sapiens
gacuagagaaggaaaauga

SEQ ID NO: 355543 - RNA, 19 nt, Homo sapiens
gaguggaguagcagugaug

SEQ ID NO: 355544 - RNA, 19 nt, Homo sapiens
gcugcugucucagguucaa

SEQ ID NO: 355545 - RNA, 19 nt, Homo sapiens
gggagaguacacagauuca

SEQ ID NO: 355546 - RNA, 19 nt, Homo sapiens
cccuaugucugcaaguuca

SEQ ID NO: 355547 - RNA, 19 nt, Homo sapiens
gguugggaguggaguagca

SEQ ID NO: 355548 - RNA, 19 nt, Homo sapiens
ugaagagcauugguaacag

SEQ ID NO: 355549 - RNA, 19 nt, Homo sapiens
gauucacaacucauucaga

SEQ ID NO: 355550 - RNA, 19 nt, Homo sapiens
gcucggggaugggagagua

SEQ ID NO: 355551 - RNA, 19 nt, Homo sapiens
ggagaccucugcaaugaua

SEQ ID NO: 355552 - RNA, 19 nt, Homo sapiens
acaaucagcucucaaguuu

SEQ ID NO: 355553 - RNA, 19 nt, Homo sapiens
ggacagacauugugugaca

SEQ ID NO: 355554 - RNA, 19 nt, Homo sapiens
gaaccaaggugauagaucu

SEQ ID NO: 355555 - RNA, 19 nt, Homo sapiens
caaacgagcucaacagcaa

SEQ ID NO: 355556 - RNA, 19 nt, Homo sapiens
ggagaauccuggugcagua

SEQ ID NO: 355557 - RNA, 19 nt, Homo sapiens
ccacaucccuuugguauug

SEQ ID NO: 355558 - RNA, 19 nt, Homo sapiens
ggugauggcugcucccuuu

SEQ ID NO: 355559 - RNA, 19 nt, Homo sapiens
gaucgaugcugccauguug

SEQ ID NO: 355560 - RNA, 19 nt, Homo sapiens
gcacuuagguggcauuguc

SEQ ID NO: 355561 - RNA, 19 nt, Homo sapiens
gcacuucgcaugugagaaa

SEQ ID NO: 355562 - RNA, 19 nt, Homo sapiens
gaucaacacaucucaauau

SEQ ID NO: 355563 - RNA, 19 nt, Homo sapiens
gcaaagugcucauguuagg

SEQ ID NO: 355564 - RNA, 19 nt, Homo sapiens
ggugauagaucucagugaa

SEQ ID NO: 355565 - RNA, 19 nt, Homo sapiens
uaaauuggauggaucaaca

SEQ ID NO: 355566 - RNA, 19 nt, Homo sapiens
uuaaugagcugaagaacau

SEQ ID NO: 355567 - RNA, 19 nt, Homo sapiens
gcagugcccugauggcuau

SEQ ID NO: 355568 - RNA, 19 nt, Homo sapiens
ugacggaugggacauauua

SEQ ID NO: 355569 - RNA, 19 nt, Homo sapiens
gcagugcccugaaucacaa

SEQ ID NO: 355570 - RNA, 19 nt, Homo sapiens
gaggaaagcgagaaagaaa

SEQ ID NO: 355571 - RNA, 19 nt, Homo sapiens
gaacccagccggugcuauu

SEQ ID NO: 355572 - RNA, 19 nt, Homo sapiens
gaucaagugugaagacagu

SEQ ID NO: 355573 - RNA, 19 nt, Homo sapiens
gagccuacuuggauguuaa

SEQ ID NO: 355574 - RNA, 19 nt, Homo sapiens
ggaaagaccuccggggaua

SEQ ID NO: 355575 - RNA, 19 nt, Homo sapiens
agacauggaucuaaaucuu

SEQ ID NO: 355576 - RNA, 19 nt, Homo sapiens
ucaaugacaucaaacuguu

SEQ ID NO: 355577 - RNA, 19 nt, Homo sapiens
ucaugaagcucuaugugaa

SEQ ID NO: 355578 - RNA, 19 nt, Homo sapiens
ugagauggauugcauauac

SEQ ID NO: 355579 - RNA, 19 nt, Homo sapiens
caaccggucugccuuuaau

SEQ ID NO: 355580 - RNA, 19 nt, Homo sapiens
ggaaagauggcaccuggaa

SEQ ID NO: 355581 - RNA, 19 nt, Homo sapiens
ggagcgagaaaucauauaa

SEQ ID NO: 355582 - RNA, 19 nt, Homo sapiens
gugcaaagugcucauguua

SEQ ID NO: 355583 - RNA, 19 nt, Homo sapiens
ggaucagcaugucaucuuu

SEQ ID NO: 355584 - RNA, 19 nt, Homo sapiens
uuucauagcuucuucaaca

SEQ ID NO: 355585 - RNA, 19 nt, Homo sapiens
ggaaggcaaccagcuguua

SEQ ID NO: 355586 - RNA, 19 nt, Homo sapiens
guacagagggcaaguggaa

SEQ ID NO: 355587 - RNA, 19 nt, Homo sapiens
acaaguggguggcauauuc

SEQ ID NO: 355588 - RNA, 19 nt, Homo sapiens
guaccaguauugggucaua

SEQ ID NO: 355589 - RNA, 19 nt, Homo sapiens
gacauggacugcaacuaug

SEQ ID NO: 355590 - RNA, 19 nt, Homo sapiens
ggagggagcuuguguuccu

SEQ ID NO: 355591 - RNA, 19 nt, Homo sapiens
ggaaauucguagacaugga

SEQ ID NO: 355592 - RNA, 19 nt, Homo sapiens
guaagccccugaaguauaa

SEQ ID NO: 355593 - RNA, 19 nt, Homo sapiens
ggagguguauggcauccaa

SEQ ID NO: 355594 - RNA, 19 nt, Homo sapiens
ugacauggacugcaacuau

SEQ ID NO: 355595 - RNA, 19 nt, Homo sapiens
gcgacgacaugaauaagau

SEQ ID NO: 355596 - RNA, 19 nt, Homo sapiens
gaacaaugcgacgacauga

SEQ ID NO: 355597 - RNA, 19 nt, Homo sapiens
ccaaucaagucgccagaau

SEQ ID NO: 355598 - RNA, 19 nt, Homo sapiens
ggacaaggaggcccugaug

SEQ ID NO: 355599 - RNA, 19 nt, Homo sapiens
acacagagccuacuuggau

SEQ ID NO: 355600 - RNA, 19 nt, Homo sapiens
ggaacaaguggguggcaua

SEQ ID NO: 355601 - RNA, 19 nt, Homo sapiens
gaacggcuccuuccauguc

SEQ ID NO: 355602 - RNA, 19 nt, Homo sapiens
caaagaaacgggccuucaa

SEQ ID NO: 355603 - RNA, 19 nt, Homo sapiens
gcugaggccuucaagcaau

SEQ ID NO: 355604 - RNA, 19 nt, Homo sapiens
caggagaacugggacaaug

SEQ ID NO: 355605 - RNA, 19 nt, Homo sapiens
gagauggauugcauauaca

SEQ ID NO: 355606 - RNA, 19 nt, Homo sapiens
gguauugauuucacaguca

SEQ ID NO: 355607 - RNA, 19 nt, Homo sapiens
caaccucuaugaagaugau

SEQ ID NO: 355608 - RNA, 19 nt, Homo sapiens
aaaguggaauucagcaaug

SEQ ID NO: 355609 - RNA, 19 nt, Homo sapiens
gaacugggacaaugugaag

SEQ ID NO: 355610 - RNA, 19 nt, Homo sapiens
gaacaaguggguggcauau

SEQ ID NO: 355611 - RNA, 19 nt, Homo sapiens
auaccuagcugccaccuau

SEQ ID NO: 355612 - RNA, 19 nt, Homo sapiens
caagugaccaccaucaaug

SEQ ID NO: 355613 - RNA, 19 nt, Homo sapiens
gcaagugaccaccaucaau

SEQ ID NO: 355614 - RNA, 19 nt, Homo sapiens
aaacugcagugcccugaug

SEQ ID NO: 355615 - RNA, 19 nt, Homo sapiens
ggacuugggagcaauguca

SEQ ID NO: 355616 - RNA, 19 nt, Homo sapiens
acuaauggcuuccaguuca

SEQ ID NO: 355617 - RNA, 19 nt, Homo sapiens
gaaacgggccuucaagacu

SEQ ID NO: 355618 - RNA, 19 nt, Homo sapiens
gagcgagaaaucauauaaa

SEQ ID NO: 355619 - RNA, 19 nt, Homo sapiens
gaaauucguagacauggau

SEQ ID NO: 355620 - RNA, 19 nt, Homo sapiens
caacacuccuuacaacaac

SEQ ID NO: 355621 - RNA, 19 nt, Homo sapiens
ggaucaacacaucucaaua

SEQ ID NO: 355622 - RNA, 19 nt, Homo sapiens
ggaggaaagcgagaaagaa

SEQ ID NO: 355623 - RNA, 19 nt, Homo sapiens
caaagucugagauggauug

SEQ ID NO: 355624 - RNA, 19 nt, Homo sapiens
caugcuggaugaugaaaug

SEQ ID NO: 355625 - RNA, 19 nt, Homo sapiens
cugcuggucucaaguggua

SEQ ID NO: 355626 - RNA, 19 nt, Homo sapiens
caacagcaaccucaaacug

SEQ ID NO: 355627 - RNA, 19 nt, Homo sapiens
guacuaauggcuuccaguu

SEQ ID NO: 355628 - RNA, 19 nt, Homo sapiens
aguauugggucauaacuau

SEQ ID NO: 355629 - RNA, 19 nt, Homo sapiens
cagcggaucagucuuaaga

SEQ ID NO: 355630 - RNA, 19 nt, Homo sapiens
gcagcugcuugauaccaaa

SEQ ID NO: 355631 - RNA, 19 nt, Homo sapiens
cgacaugaauaagaucaau

SEQ ID NO: 355632 - RNA, 19 nt, Homo sapiens
ggcgauggcauuauacaaa

SEQ ID NO: 355633 - RNA, 19 nt, Homo sapiens
ucgccagaaugcacuguua

SEQ ID NO: 355634 - RNA, 19 nt, Homo sapiens
cuggagaccucugcaauga

SEQ ID NO: 355635 - RNA, 19 nt, Homo sapiens
caacagcgaguccaucauc

SEQ ID NO: 355636 - RNA, 19 nt, Homo sapiens
cugagucucugaccauuug

SEQ ID NO: 355637 - RNA, 19 nt, Homo sapiens
gaaagagaauugggaucag

SEQ ID NO: 355638 - RNA, 19 nt, Homo sapiens
acaacaacuucaugagcua

SEQ ID NO: 355639 - RNA, 19 nt, Homo sapiens
cagcaaugcccacggcuuu

SEQ ID NO: 355640 - RNA, 19 nt, Homo sapiens
aaauaaggcagauaaagga

SEQ ID NO: 355641 - RNA, 19 nt, Homo sapiens
ccauuugggugaccuuugu

SEQ ID NO: 355642 - RNA, 19 nt, Homo sapiens
gcaccuggagcccaaauuc

SEQ ID NO: 355643 - RNA, 19 nt, Homo sapiens
agacagagcccuccuucga

SEQ ID NO: 355644 - RNA, 19 nt, Homo sapiens
cuacuuggauguuaaugag

SEQ ID NO: 355645 - RNA, 19 nt, Homo sapiens
caucaacaaccgagccuuu

SEQ ID NO: 355646 - RNA, 19 nt, Homo sapiens
gauccucucggaagucaaa

SEQ ID NO: 355647 - RNA, 19 nt, Homo sapiens
acagagggcaaguggaaua

SEQ ID NO: 355648 - RNA, 19 nt, Homo sapiens
gaauucagcggaucagucu

SEQ ID NO: 355649 - RNA, 19 nt, Homo sapiens
agaccaaggugaacaaugc

SEQ ID NO: 355650 - RNA, 19 nt, Homo sapiens
caucaccugcugucacaua

SEQ ID NO: 355651 - RNA, 19 nt, Homo sapiens
ggaaggagcugaggaauga

SEQ ID NO: 355652 - RNA, 19 nt, Homo sapiens
gaaagcaucuauucccaaa

SEQ ID NO: 355653 - RNA, 19 nt, Homo sapiens
gaagcagccuccaaagaaa

SEQ ID NO: 355654 - RNA, 19 nt, Homo sapiens
ggaagcagccuccaaagaa

SEQ ID NO: 355655 - RNA, 19 nt, Homo sapiens
ucaaggaggugguugcuaa

SEQ ID NO: 355656 - RNA, 19 nt, Homo sapiens
gggaagaaaucaaguuaau

SEQ ID NO: 355657 - RNA, 19 nt, Homo sapiens
uuaaagagcuccaucacuu

SEQ ID NO: 355658 - RNA, 19 nt, Homo sapiens
gaacaucacuugcauuacg

SEQ ID NO: 355659 - RNA, 19 nt, Homo sapiens
caaucaaacuuucagcuuu

SEQ ID NO: 355660 - RNA, 19 nt, Homo sapiens
caaagaaaccaucaagaaa

SEQ ID NO: 355661 - RNA, 19 nt, Homo sapiens
gcagagcauuguucacauu

SEQ ID NO: 355662 - RNA, 19 nt, Homo sapiens
guaaagaagcguaccauga

SEQ ID NO: 355663 - RNA, 19 nt, Homo sapiens
gagaaaaggucaagaaaug

SEQ ID NO: 355664 - RNA, 19 nt, Homo sapiens
uaaagugccuauaaaggaa

SEQ ID NO: 355665 - RNA, 19 nt, Homo sapiens
ccaaagaaaccaucaagaa

SEQ ID NO: 355666 - RNA, 19 nt, Homo sapiens
gacaagguguuucucugua

SEQ ID NO: 355667 - RNA, 19 nt, Homo sapiens
uaaagaagcguaccaugaa

SEQ ID NO: 355668 - RNA, 19 nt, Homo sapiens
gaaauaccaacuaugugua

SEQ ID NO: 355669 - RNA, 19 nt, Homo sapiens
acauuuggcuccacuguaa

SEQ ID NO: 355670 - RNA, 19 nt, Homo sapiens
auucauggcuuuaacagua

SEQ ID NO: 355671 - RNA, 19 nt, Homo sapiens
ggaaacaccaguagcuuug

SEQ ID NO: 355672 - RNA, 19 nt, Homo sapiens
gaaaguacaaccacuaucu

SEQ ID NO: 355673 - RNA, 19 nt, Homo sapiens
acaguaaacucacuagaau

SEQ ID NO: 355674 - RNA, 19 nt, Homo sapiens
uggcuccacuguaaauuua

SEQ ID NO: 355675 - RNA, 19 nt, Homo sapiens
ugucccaacuccuugauua

SEQ ID NO: 355676 - RNA, 19 nt, Homo sapiens
ggacugugcagaauuguga

SEQ ID NO: 355677 - RNA, 19 nt, Homo sapiens
ccaacuauguguaaaucaa

SEQ ID NO: 355678 - RNA, 19 nt, Homo sapiens
aaacuagauucauggcuuu

SEQ ID NO: 355679 - RNA, 19 nt, Homo sapiens
cuuagacuguuuccacuua

SEQ ID NO: 355680 - RNA, 19 nt, Homo sapiens
ugacauggauuggauuuca

SEQ ID NO: 355681 - RNA, 19 nt, Homo sapiens
cggaacaucacuugcauua

SEQ ID NO: 355682 - RNA, 19 nt, Homo sapiens
caccugaucgcaacaaaua

SEQ ID NO: 355683 - RNA, 19 nt, Homo sapiens
gacaguaaacucacuagaa

SEQ ID NO: 355684 - RNA, 19 nt, Homo sapiens
aagcaucuauucccaaaga

SEQ ID NO: 355685 - RNA, 19 nt, Homo sapiens
cauuuaauauccugccuuu

SEQ ID NO: 355686 - RNA, 19 nt, Homo sapiens
gagacaggcagaaucagua

SEQ ID NO: 355687 - RNA, 19 nt, Homo sapiens
agaagaagcuccugaaucc

SEQ ID NO: 355688 - RNA, 19 nt, Homo sapiens
gaauauuccuuauguugac

SEQ ID NO: 355689 - RNA, 19 nt, Homo sapiens
caagguguuucucuguaaa

SEQ ID NO: 355690 - RNA, 19 nt, Homo sapiens
ucaggaagaucgugaacau

SEQ ID NO: 355691 - RNA, 19 nt, Homo sapiens
guacuuucauucccuuuca

SEQ ID NO: 355692 - RNA, 19 nt, Homo sapiens
caguggaggucgauucuga

SEQ ID NO: 355693 - RNA, 19 nt, Homo sapiens
acaagguguuucucuguaa

SEQ ID NO: 355694 - RNA, 19 nt, Homo sapiens
cgaaauaccaacuaugugu

SEQ ID NO: 355695 - RNA, 19 nt, Homo sapiens
gcacacacacucuucaagu

SEQ ID NO: 355696 - RNA, 19 nt, Homo sapiens
ccaacuccuugauuaaaga

SEQ ID NO: 355697 - RNA, 19 nt, Homo sapiens
gagaaaguacaaccacuau

SEQ ID NO: 355698 - RNA, 19 nt, Homo sapiens
cagggaagaaaucaaguua

SEQ ID NO: 355699 - RNA, 19 nt, Homo sapiens
gcagaauugugaccuggau

SEQ ID NO: 355700 - RNA, 19 nt, Homo sapiens
gagcauacccagugucuac

SEQ ID NO: 355701 - RNA, 19 nt, Homo sapiens
aggaagaucgugaacauaa

SEQ ID NO: 355702 - RNA, 19 nt, Homo sapiens
uguauugucugacuucuca

SEQ ID NO: 355703 - RNA, 19 nt, Homo sapiens
gcaguggguucuccaaacu

SEQ ID NO: 355704 - RNA, 19 nt, Homo sapiens
cagccaaauugcagaagaa

SEQ ID NO: 355705 - RNA, 19 nt, Homo sapiens
acaaauagucggaacauca

SEQ ID NO: 355706 - RNA, 19 nt, Homo sapiens
gauaaagugccuauaaagg

SEQ ID NO: 355707 - RNA, 19 nt, Homo sapiens
cacacacacucuucaaguu

SEQ ID NO: 355708 - RNA, 19 nt, Homo sapiens
acacuacgcagaagagaaa

SEQ ID NO: 355709 - RNA, 19 nt, Homo sapiens
aagaggagccuuuccagaa

SEQ ID NO: 355710 - RNA, 19 nt, Homo sapiens
caagugcaauccauguauc

SEQ ID NO: 355711 - RNA, 19 nt, Homo sapiens
guucucagccuccggauga

SEQ ID NO: 355712 - RNA, 19 nt, Homo sapiens
gcuacucccugccuugugu

SEQ ID NO: 355713 - RNA, 19 nt, Homo sapiens
uagacuguuuccacuuaua

SEQ ID NO: 355714 - RNA, 19 nt, Homo sapiens
caacagcuuuuauguguau

SEQ ID NO: 355715 - RNA, 19 nt, Homo sapiens
gugcagagaccguggagaa

SEQ ID NO: 355716 - RNA, 19 nt, Homo sapiens
gcugaccaguugcguguga

SEQ ID NO: 355717 - RNA, 19 nt, Homo sapiens
ggaagaucgugaacauaac

SEQ ID NO: 355718 - RNA, 19 nt, Homo sapiens
ggaagaaaucaaguuaaug

SEQ ID NO: 355719 - RNA, 19 nt, Homo sapiens
ggcaacagggcuucucuuu

SEQ ID NO: 355720 - RNA, 19 nt, Homo sapiens
ggauuggauuucaguucaa

SEQ ID NO: 355721 - RNA, 19 nt, Homo sapiens
gggaagcagccuccaaaga

SEQ ID NO: 355722 - RNA, 19 nt, Homo sapiens
acacacacucuucaaguuu

SEQ ID NO: 355723 - RNA, 19 nt, Homo sapiens
ucaaugaucggcaguuugu

SEQ ID NO: 355724 - RNA, 19 nt, Homo sapiens
ccacuuauacugugugaca

SEQ ID NO: 355725 - RNA, 19 nt, Homo sapiens
ugacaaggaaacaccagua

SEQ ID NO: 355726 - RNA, 19 nt, Homo sapiens
ugacuggacugugcagaau

SEQ ID NO: 355727 - RNA, 19 nt, Homo sapiens
gcaaaccgcaugcucuuac

SEQ ID NO: 355728 - RNA, 19 nt, Homo sapiens
ucaguaaacaccaugaaga

SEQ ID NO: 355729 - RNA, 19 nt, Homo sapiens
gaucagcagagcauuguuc

SEQ ID NO: 355730 - RNA, 19 nt, Homo sapiens
caacacugcaugcggcaaa

SEQ ID NO: 355731 - RNA, 19 nt, Homo sapiens
gcauuaaucgaaauaccaa

SEQ ID NO: 355732 - RNA, 19 nt, Homo sapiens
ccuuaagaauuccaucuau

SEQ ID NO: 355733 - RNA, 19 nt, Homo sapiens
gaaacuccuggaucccuuu

SEQ ID NO: 355734 - RNA, 19 nt, Homo sapiens
auaaagugccuauaaagga

SEQ ID NO: 355735 - RNA, 19 nt, Homo sapiens
gaauuacagggaagaaauc

SEQ ID NO: 355736 - RNA, 19 nt, Homo sapiens
caaagaaccccaggcaaua

SEQ ID NO: 355737 - RNA, 19 nt, Homo sapiens
ugcaauccauguaucugua

SEQ ID NO: 355738 - RNA, 19 nt, Homo sapiens
gaaaaggucaagaaaugaa

SEQ ID NO: 355739 - RNA, 19 nt, Homo sapiens
uggauuggauuucaguuca

SEQ ID NO: 355740 - RNA, 19 nt, Homo sapiens
gaccuucucuuaggacagu

SEQ ID NO: 355741 - RNA, 19 nt, Homo sapiens
ucuccaaacuagauucaug

SEQ ID NO: 355742 - RNA, 19 nt, Homo sapiens
cagaagaagcuccugaauc

SEQ ID NO: 355743 - RNA, 19 nt, Homo sapiens
ccagugaccaugauagugu

SEQ ID NO: 355744 - RNA, 19 nt, Homo sapiens
uaacugagggcaugagucu

SEQ ID NO: 355745 - RNA, 19 nt, Homo sapiens
ccgacucucuccaucagaa

SEQ ID NO: 355746 - RNA, 19 nt, Homo sapiens
gcuccacuguaaauuuaau

SEQ ID NO: 355747 - RNA, 19 nt, Homo sapiens
ugaauuacagggaagaaau

SEQ ID NO: 355748 - RNA, 19 nt, Homo sapiens
ccaaauugcagaagaaacu

SEQ ID NO: 355749 - RNA, 19 nt, Homo sapiens
ggacaguaaacucacuaga

SEQ ID NO: 355750 - RNA, 19 nt, Homo sapiens
gggaaggagcugaggaaug

SEQ ID NO: 355751 - RNA, 19 nt, Homo sapiens
ggaaggagcugaggaauga

SEQ ID NO: 355752 - RNA, 19 nt, Homo sapiens
gaaagcaucuauucccaaa

SEQ ID NO: 355753 - RNA, 19 nt, Homo sapiens
gaagcagccuccaaagaaa

SEQ ID NO: 355754 - RNA, 19 nt, Homo sapiens
ggaagcagccuccaaagaa

SEQ ID NO: 355755 - RNA, 19 nt, Homo sapiens
ucaaggaggugguugcuaa

SEQ ID NO: 355756 - RNA, 19 nt, Homo sapiens
gggaagaaaucaaguuaau

SEQ ID NO: 355757 - RNA, 19 nt, Homo sapiens
uuaaagagcuccaucacuu

SEQ ID NO: 355758 - RNA, 19 nt, Homo sapiens
gaacaucacuugcauuacg

SEQ ID NO: 355759 - RNA, 19 nt, Homo sapiens
caaucaaacuuucagcuuu

SEQ ID NO: 355760 - RNA, 19 nt, Homo sapiens
caaagaaaccaucaagaaa

SEQ ID NO: 355761 - RNA, 19 nt, Homo sapiens
gcagagcauuguucacauu

SEQ ID NO: 355762 - RNA, 19 nt, Homo sapiens
guaaagaagcguaccauga

SEQ ID NO: 355763 - RNA, 19 nt, Homo sapiens
gagaaaaggucaagaaaug

SEQ ID NO: 355764 - RNA, 19 nt, Homo sapiens
uaaagugccuauaaaggaa

SEQ ID NO: 355765 - RNA, 19 nt, Homo sapiens
ccaaagaaaccaucaagaa

SEQ ID NO: 355766 - RNA, 19 nt, Homo sapiens
gacaagguguuucucugua

SEQ ID NO: 355767 - RNA, 19 nt, Homo sapiens
uaaagaagcguaccaugaa

SEQ ID NO: 355768 - RNA, 19 nt, Homo sapiens
gaaauaccaacuaugugua

SEQ ID NO: 355769 - RNA, 19 nt, Homo sapiens
acauuuggcuccacuguaa

SEQ ID NO: 355770 - RNA, 19 nt, Homo sapiens
auucauggcuuuaacagua

SEQ ID NO: 355771 - RNA, 19 nt, Homo sapiens
ggaaacaccaguagcuuug

SEQ ID NO: 355772 - RNA, 19 nt, Homo sapiens
gaaaguacaaccacuaucu

SEQ ID NO: 355773 - RNA, 19 nt, Homo sapiens
acaguaaacucacuagaau

SEQ ID NO: 355774 - RNA, 19 nt, Homo sapiens
uggcuccacuguaaauuua

SEQ ID NO: 355775 - RNA, 19 nt, Homo sapiens
ugucccaacuccuugauua

SEQ ID NO: 355776 - RNA, 19 nt, Homo sapiens
ggacugugcagaauuguga

SEQ ID NO: 355777 - RNA, 19 nt, Homo sapiens
ccaacuauguguaaaucaa

SEQ ID NO: 355778 - RNA, 19 nt, Homo sapiens
aaacuagauucauggcuuu

SEQ ID NO: 355779 - RNA, 19 nt, Homo sapiens
cuuagacuguuuccacuua

SEQ ID NO: 355780 - RNA, 19 nt, Homo sapiens
ugacauggauuggauuuca

SEQ ID NO: 355781 - RNA, 19 nt, Homo sapiens
cggaacaucacuugcauua

SEQ ID NO: 355782 - RNA, 19 nt, Homo sapiens
caccugaucgcaacaaaua

SEQ ID NO: 355783 - RNA, 19 nt, Homo sapiens
gacaguaaacucacuagaa

SEQ ID NO: 355784 - RNA, 19 nt, Homo sapiens
aagcaucuauucccaaaga

SEQ ID NO: 355785 - RNA, 19 nt, Homo sapiens
cauuuaauauccugccuuu

SEQ ID NO: 355786 - RNA, 19 nt, Homo sapiens
gagacaggcagaaucagua

SEQ ID NO: 355787 - RNA, 19 nt, Homo sapiens
agaagaagcuccugaaucc

SEQ ID NO: 355788 - RNA, 19 nt, Homo sapiens
gaauauuccuuauguugac

SEQ ID NO: 355789 - RNA, 19 nt, Homo sapiens
caagguguuucucuguaaa

SEQ ID NO: 355790 - RNA, 19 nt, Homo sapiens
ucaggaagaucgugaacau

SEQ ID NO: 355791 - RNA, 19 nt, Homo sapiens
guacuuucauucccuuuca

SEQ ID NO: 355792 - RNA, 19 nt, Homo sapiens
caguggaggucgauucuga

SEQ ID NO: 355793 - RNA, 19 nt, Homo sapiens
acaagguguuucucuguaa

SEQ ID NO: 355794 - RNA, 19 nt, Homo sapiens
cgaaauaccaacuaugugu

SEQ ID NO: 355795 - RNA, 19 nt, Homo sapiens
gcacacacacucuucaagu

SEQ ID NO: 355796 - RNA, 19 nt, Homo sapiens
ccaacuccuugauuaaaga

SEQ ID NO: 355797 - RNA, 19 nt, Homo sapiens
gagaaaguacaaccacuau

SEQ ID NO: 355798 - RNA, 19 nt, Homo sapiens
cagggaagaaaucaaguua

SEQ ID NO: 355799 - RNA, 19 nt, Homo sapiens
gcagaauugugaccuggau

SEQ ID NO: 355800 - RNA, 19 nt, Homo sapiens
gagcauacccagugucuac

SEQ ID NO: 355801 - RNA, 19 nt, Homo sapiens
aggaagaucgugaacauaa

SEQ ID NO: 355802 - RNA, 19 nt, Homo sapiens
uguauugucugacuucuca

SEQ ID NO: 355803 - RNA, 19 nt, Homo sapiens
gcaguggguucuccaaacu

SEQ ID NO: 355804 - RNA, 19 nt, Homo sapiens
cagccaaauugcagaagaa

SEQ ID NO: 355805 - RNA, 19 nt, Homo sapiens
acaaauagucggaacauca

SEQ ID NO: 355806 - RNA, 19 nt, Homo sapiens
gauaaagugccuauaaagg

SEQ ID NO: 355807 - RNA, 19 nt, Homo sapiens
cacacacacucuucaaguu

SEQ ID NO: 355808 - RNA, 19 nt, Homo sapiens
acacuacgcagaagagaaa

SEQ ID NO: 355809 - RNA, 19 nt, Homo sapiens
aagaggagccuuuccagaa

SEQ ID NO: 355810 - RNA, 19 nt, Homo sapiens
caagugcaauccauguauc

SEQ ID NO: 355811 - RNA, 19 nt, Homo sapiens
guucucagccuccggauga

SEQ ID NO: 355812 - RNA, 19 nt, Homo sapiens
gcuacucccugccuugugu

SEQ ID NO: 355813 - RNA, 19 nt, Homo sapiens
uagacuguuuccacuuaua

SEQ ID NO: 355814 - RNA, 19 nt, Homo sapiens
caacagcuuuuauguguau

SEQ ID NO: 355815 - RNA, 19 nt, Homo sapiens
gugcagagaccguggagaa

SEQ ID NO: 355816 - RNA, 19 nt, Homo sapiens
gcugaccaguugcguguga

SEQ ID NO: 355817 - RNA, 19 nt, Homo sapiens
ggaagaucgugaacauaac

SEQ ID NO: 355818 - RNA, 19 nt, Homo sapiens
ggaagaaaucaaguuaaug

SEQ ID NO: 355819 - RNA, 19 nt, Homo sapiens
ggcaacagggcuucucuuu

SEQ ID NO: 355820 - RNA, 19 nt, Homo sapiens
ggauuggauuucaguucaa

SEQ ID NO: 355821 - RNA, 19 nt, Homo sapiens
gggaagcagccuccaaaga

SEQ ID NO: 355822 - RNA, 19 nt, Homo sapiens
acacacacucuucaaguuu

SEQ ID NO: 355823 - RNA, 19 nt, Homo sapiens
ucaaugaucggcaguuugu

SEQ ID NO: 355824 - RNA, 19 nt, Homo sapiens
ccacuuauacugugugaca

SEQ ID NO: 355825 - RNA, 19 nt, Homo sapiens
ugacaaggaaacaccagua

SEQ ID NO: 355826 - RNA, 19 nt, Homo sapiens
ugacuggacugugcagaau

SEQ ID NO: 355827 - RNA, 19 nt, Homo sapiens
gcaaaccgcaugcucuuac

SEQ ID NO: 355828 - RNA, 19 nt, Homo sapiens
ucaguaaacaccaugaaga

SEQ ID NO: 355829 - RNA, 19 nt, Homo sapiens
gaucagcagagcauuguuc

SEQ ID NO: 355830 - RNA, 19 nt, Homo sapiens
caacacugcaugcggcaaa

SEQ ID NO: 355831 - RNA, 19 nt, Homo sapiens
gcauuaaucgaaauaccaa

SEQ ID NO: 355832 - RNA, 19 nt, Homo sapiens
ccuuaagaauuccaucuau

SEQ ID NO: 355833 - RNA, 19 nt, Homo sapiens
gaaacuccuggaucccuuu

SEQ ID NO: 355834 - RNA, 19 nt, Homo sapiens
auaaagugccuauaaagga

SEQ ID NO: 355835 - RNA, 19 nt, Homo sapiens
gaauuacagggaagaaauc

SEQ ID NO: 355836 - RNA, 19 nt, Homo sapiens
caaagaaccccaggcaaua

SEQ ID NO: 355837 - RNA, 19 nt, Homo sapiens
ugcaauccauguaucugua

SEQ ID NO: 355838 - RNA, 19 nt, Homo sapiens
gaaaaggucaagaaaugaa

SEQ ID NO: 355839 - RNA, 19 nt, Homo sapiens
uggauuggauuucaguuca

SEQ ID NO: 355840 - RNA, 19 nt, Homo sapiens
gaccuucucuuaggacagu

SEQ ID NO: 355841 - RNA, 19 nt, Homo sapiens
ucuccaaacuagauucaug

SEQ ID NO: 355842 - RNA, 19 nt, Homo sapiens
cagaagaagcuccugaauc

SEQ ID NO: 355843 - RNA, 19 nt, Homo sapiens
ccagugaccaugauagugu

SEQ ID NO: 355844 - RNA, 19 nt, Homo sapiens
uaacugagggcaugagucu

SEQ ID NO: 355845 - RNA, 19 nt, Homo sapiens
ccgacucucuccaucagaa

SEQ ID NO: 355846 - RNA, 19 nt, Homo sapiens
gcuccacuguaaauuuaau

SEQ ID NO: 355847 - RNA, 19 nt, Homo sapiens
ugaauuacagggaagaaau

SEQ ID NO: 355848 - RNA, 19 nt, Homo sapiens
ccaaauugcagaagaaacu

SEQ ID NO: 355849 - RNA, 19 nt, Homo sapiens
ggacaguaaacucacuaga

SEQ ID NO: 355850 - RNA, 19 nt, Homo sapiens
gggaaggagcugaggaaug

SEQ ID NO: 355851 - RNA, 19 nt, Homo sapiens
ggaaggagcugaggaauga

SEQ ID NO: 355852 - RNA, 19 nt, Homo sapiens
gaaagcaucuauucccaaa

SEQ ID NO: 355853 - RNA, 19 nt, Homo sapiens
gaagcagccuccaaagaaa

SEQ ID NO: 355854 - RNA, 19 nt, Homo sapiens
ggaagcagccuccaaagaa

SEQ ID NO: 355855 - RNA, 19 nt, Homo sapiens
ucaaggaggugguugcuaa

SEQ ID NO: 355856 - RNA, 19 nt, Homo sapiens
gggaagaaaucaaguuaau

SEQ ID NO: 355857 - RNA, 19 nt, Homo sapiens
uuaaagagcuccaucacuu

SEQ ID NO: 355858 - RNA, 19 nt, Homo sapiens
gaacaucacuugcauuacg

SEQ ID NO: 355859 - RNA, 19 nt, Homo sapiens
caaucaaacuuucagcuuu

SEQ ID NO: 355860 - RNA, 19 nt, Homo sapiens
caaagaaaccaucaagaaa

SEQ ID NO: 355861 - RNA, 19 nt, Homo sapiens
guaaagaagcguaccauga

SEQ ID NO: 355862 - RNA, 19 nt, Homo sapiens
uaaagugccuauaaaggaa

SEQ ID NO: 355863 - RNA, 19 nt, Homo sapiens
ccaaagaaaccaucaagaa

SEQ ID NO: 355864 - RNA, 19 nt, Homo sapiens
gacaagguguuucucugua

SEQ ID NO: 355865 - RNA, 19 nt, Homo sapiens
uaaagaagcguaccaugaa

SEQ ID NO: 355866 - RNA, 19 nt, Homo sapiens
gaaauaccaacuaugugua

SEQ ID NO: 355867 - RNA, 19 nt, Homo sapiens
acauuuggcuccacuguaa

SEQ ID NO: 355868 - RNA, 19 nt, Homo sapiens
auucauggcuuuaacagua

SEQ ID NO: 355869 - RNA, 19 nt, Homo sapiens
ggaaacaccaguagcuuug

SEQ ID NO: 355870 - RNA, 19 nt, Homo sapiens
gaaaguacaaccacuaucu

SEQ ID NO: 355871 - RNA, 19 nt, Homo sapiens
acaguaaacucacuagaau

SEQ ID NO: 355872 - RNA, 19 nt, Homo sapiens
uggcuccacuguaaauuua

SEQ ID NO: 355873 - RNA, 19 nt, Homo sapiens
ugucccaacuccuugauua

SEQ ID NO: 355874 - RNA, 19 nt, Homo sapiens
ccaacuauguguaaaucaa

SEQ ID NO: 355875 - RNA, 19 nt, Homo sapiens
aaacuagauucauggcuuu

SEQ ID NO: 355876 - RNA, 19 nt, Homo sapiens
cuuagacuguuuccacuua

SEQ ID NO: 355877 - RNA, 19 nt, Homo sapiens
ugacauggauuggauuuca

SEQ ID NO: 355878 - RNA, 19 nt, Homo sapiens
cggaacaucacuugcauua

SEQ ID NO: 355879 - RNA, 19 nt, Homo sapiens
caccugaucgcaacaaaua

SEQ ID NO: 355880 - RNA, 19 nt, Homo sapiens
gacaguaaacucacuagaa

SEQ ID NO: 355881 - RNA, 19 nt, Homo sapiens
aagcaucuauucccaaaga

SEQ ID NO: 355882 - RNA, 19 nt, Homo sapiens
cauuuaauauccugccuuu

SEQ ID NO: 355883 - RNA, 19 nt, Homo sapiens
gagacaggcagaaucagua

SEQ ID NO: 355884 - RNA, 19 nt, Homo sapiens
agaagaagcuccugaaucc

SEQ ID NO: 355885 - RNA, 19 nt, Homo sapiens
gaauauuccuuauguugac

SEQ ID NO: 355886 - RNA, 19 nt, Homo sapiens
caagguguuucucuguaaa

SEQ ID NO: 355887 - RNA, 19 nt, Homo sapiens
ucaggaagaucgugaacau

SEQ ID NO: 355888 - RNA, 19 nt, Homo sapiens
guacuuucauucccuuuca

SEQ ID NO: 355889 - RNA, 19 nt, Homo sapiens
caguggaggucgauucuga

SEQ ID NO: 355890 - RNA, 19 nt, Homo sapiens
acaagguguuucucuguaa

SEQ ID NO: 355891 - RNA, 19 nt, Homo sapiens
cgaaauaccaacuaugugu

SEQ ID NO: 355892 - RNA, 19 nt, Homo sapiens
gcacacacacucuucaagu

SEQ ID NO: 355893 - RNA, 19 nt, Homo sapiens
ccaacuccuugauuaaaga

SEQ ID NO: 355894 - RNA, 19 nt, Homo sapiens
gagaaaguacaaccacuau

SEQ ID NO: 355895 - RNA, 19 nt, Homo sapiens
cagggaagaaaucaaguua

SEQ ID NO: 355896 - RNA, 19 nt, Homo sapiens
gagcauacccagugucuac

SEQ ID NO: 355897 - RNA, 19 nt, Homo sapiens
aggaagaucgugaacauaa

SEQ ID NO: 355898 - RNA, 19 nt, Homo sapiens
uguauugucugacuucuca

SEQ ID NO: 355899 - RNA, 19 nt, Homo sapiens
gcaguggguucuccaaacu

SEQ ID NO: 355900 - RNA, 19 nt, Homo sapiens
cagccaaauugcagaagaa

SEQ ID NO: 355901 - RNA, 19 nt, Homo sapiens
acaaauagucggaacauca

SEQ ID NO: 355902 - RNA, 19 nt, Homo sapiens
gauaaagugccuauaaagg

SEQ ID NO: 355903 - RNA, 19 nt, Homo sapiens
cacacacacucuucaaguu

SEQ ID NO: 355904 - RNA, 19 nt, Homo sapiens
acacuacgcagaagagaaa

SEQ ID NO: 355905 - RNA, 19 nt, Homo sapiens
aagaggagccuuuccagaa

SEQ ID NO: 355906 - RNA, 19 nt, Homo sapiens
gcugaccaguugcguguga

SEQ ID NO: 355907 - RNA, 19 nt, Homo sapiens
caagugcaauccauguauc

SEQ ID NO: 355908 - RNA, 19 nt, Homo sapiens
guucucagccuccggauga

SEQ ID NO: 355909 - RNA, 19 nt, Homo sapiens
gcuacucccugccuugugu

SEQ ID NO: 355910 - RNA, 19 nt, Homo sapiens
uagacuguuuccacuuaua

SEQ ID NO: 355911 - RNA, 19 nt, Homo sapiens
ggaagaucgugaacauaac

SEQ ID NO: 355912 - RNA, 19 nt, Homo sapiens
ggaagaaaucaaguuaaug

SEQ ID NO: 355913 - RNA, 19 nt, Homo sapiens
ugacuggacugugcaggaa

SEQ ID NO: 355914 - RNA, 19 nt, Homo sapiens
ggcaacagggcuucucuuu

SEQ ID NO: 355915 - RNA, 19 nt, Homo sapiens
ggauuggauuucaguucaa

SEQ ID NO: 355916 - RNA, 19 nt, Homo sapiens
gggaagcagccuccaaaga

SEQ ID NO: 355917 - RNA, 19 nt, Homo sapiens
acacacacucuucaaguuu

SEQ ID NO: 355918 - RNA, 19 nt, Homo sapiens
ucaaugaucggcaguuugu

SEQ ID NO: 355919 - RNA, 19 nt, Homo sapiens
ccacuuauacugugugaca

SEQ ID NO: 355920 - RNA, 19 nt, Homo sapiens
ugacaaggaaacaccagua

SEQ ID NO: 355921 - RNA, 19 nt, Homo sapiens
gcaaaccgcaugcucuuac

SEQ ID NO: 355922 - RNA, 19 nt, Homo sapiens
ucaguaaacaccaugaaga

SEQ ID NO: 355923 - RNA, 19 nt, Homo sapiens
caacacugcaugcggcaaa

SEQ ID NO: 355924 - RNA, 19 nt, Homo sapiens
gcauuaaucgaaauaccaa

SEQ ID NO: 355925 - RNA, 19 nt, Homo sapiens
ccuuaagaauuccaucuau

SEQ ID NO: 355926 - RNA, 19 nt, Homo sapiens
gaaacuccuggaucccuuu

SEQ ID NO: 355927 - RNA, 19 nt, Homo sapiens
auaaagugccuauaaagga

SEQ ID NO: 355928 - RNA, 19 nt, Homo sapiens
gaauuacagggaagaaauc

SEQ ID NO: 355929 - RNA, 19 nt, Homo sapiens
caaagaaccccaggcaaua

SEQ ID NO: 355930 - RNA, 19 nt, Homo sapiens
ugcaauccauguaucugua

SEQ ID NO: 355931 - RNA, 19 nt, Homo sapiens
uggauuggauuucaguuca

SEQ ID NO: 355932 - RNA, 19 nt, Homo sapiens
gaccuucucuuaggacagu

SEQ ID NO: 355933 - RNA, 19 nt, Homo sapiens
ucuccaaacuagauucaug

SEQ ID NO: 355934 - RNA, 19 nt, Homo sapiens
cagaagaagcuccugaauc

SEQ ID NO: 355935 - RNA, 19 nt, Homo sapiens
ccagugaccaugauagugu

SEQ ID NO: 355936 - RNA, 19 nt, Homo sapiens
uaacugagggcaugagucu

SEQ ID NO: 355937 - RNA, 19 nt, Homo sapiens
ccgacucucuccaucagaa

SEQ ID NO: 355938 - RNA, 19 nt, Homo sapiens
gcuccacuguaaauuuaau

SEQ ID NO: 355939 - RNA, 19 nt, Homo sapiens
ugaauuacagggaagaaau

SEQ ID NO: 355940 - RNA, 19 nt, Homo sapiens
ccaaauugcagaagaaacu

SEQ ID NO: 355941 - RNA, 19 nt, Homo sapiens
ggacaguaaacucacuaga

SEQ ID NO: 355942 - RNA, 19 nt, Homo sapiens
cuccaucacuucaggauuc

SEQ ID NO: 355943 - RNA, 19 nt, Homo sapiens
gggaaggagcugaggaaug

SEQ ID NO: 355944 - RNA, 19 nt, Homo sapiens
guucacgacccucaacuug

SEQ ID NO: 355945 - RNA, 19 nt, Homo sapiens
caacaaauagucggaacau

SEQ ID NO: 355946 - RNA, 19 nt, Homo sapiens
gaagaucgugaacauaacu

SEQ ID NO: 355947 - RNA, 19 nt, Homo sapiens
agagaaaguacaaccacua

SEQ ID NO: 355948 - RNA, 19 nt, Homo sapiens
aucaguagcuggagagaga

SEQ ID NO: 355949 - RNA, 19 nt, Homo sapiens
cccagugucuaccuucauu

SEQ ID NO: 355950 - RNA, 19 nt, Homo sapiens
gugauuugcuuagacuguu

SEQ ID NO: 355951 - RNA, 19 nt, Homo sapiens
caaaguagaugaagaagaa

SEQ ID NO: 355952 - RNA, 19 nt, Homo sapiens
gcagaaacaugccaaagaa

SEQ ID NO: 355953 - RNA, 19 nt, Homo sapiens
ggaagaagaaagacaguua

SEQ ID NO: 355954 - RNA, 19 nt, Homo sapiens
gcacacaguucaucaguuc

SEQ ID NO: 355955 - RNA, 19 nt, Homo sapiens
gaagagagcagcagaaaca

SEQ ID NO: 355956 - RNA, 19 nt, Homo sapiens
ggaagcaucucgaagaaca

SEQ ID NO: 355957 - RNA, 19 nt, Homo sapiens
uuaaagagaugacaacaug

SEQ ID NO: 355958 - RNA, 19 nt, Homo sapiens
cuacacagauucaaaguau

SEQ ID NO: 355959 - RNA, 19 nt, Homo sapiens
gaaaagcgguuaaaagaga

SEQ ID NO: 355960 - RNA, 19 nt, Homo sapiens
uaagagagcaguaugauga

SEQ ID NO: 355961 - RNA, 19 nt, Homo sapiens
ugucagagcuccagcauug

SEQ ID NO: 355962 - RNA, 19 nt, Homo sapiens
ccaauuaccuagguucuuu

SEQ ID NO: 355963 - RNA, 19 nt, Homo sapiens
gcauucauguugagacuuu

SEQ ID NO: 355964 - RNA, 19 nt, Homo sapiens
gaaugaugcugugggauuu

SEQ ID NO: 355965 - RNA, 19 nt, Homo sapiens
gcaaauaugcagaaagcua

SEQ ID NO: 355966 - RNA, 19 nt, Homo sapiens
gaaaguggacugaagauag

SEQ ID NO: 355967 - RNA, 19 nt, Homo sapiens
ccaaaccuaugcugaauau

SEQ ID NO: 355968 - RNA, 19 nt, Homo sapiens
acacaucccuugcggaauu

SEQ ID NO: 355969 - RNA, 19 nt, Homo sapiens
cgaaaggcauucauguuga

SEQ ID NO: 355970 - RNA, 19 nt, Homo sapiens
ucagauagaucauuguuag

SEQ ID NO: 355971 - RNA, 19 nt, Homo sapiens
gaagaagaaagacaguuaa

SEQ ID NO: 355972 - RNA, 19 nt, Homo sapiens
gagauaaucaggagcaauu

SEQ ID NO: 355973 - RNA, 19 nt, Homo sapiens
caaaguauauaacgaaguc

SEQ ID NO: 355974 - RNA, 19 nt, Homo sapiens
gaccagacuugcagccuaa

SEQ ID NO: 355975 - RNA, 19 nt, Homo sapiens
aaggagcgauauauaguua

SEQ ID NO: 355976 - RNA, 19 nt, Homo sapiens
gaagaaagacaguuaagag

SEQ ID NO: 355977 - RNA, 19 nt, Homo sapiens
gugcaaaucuacaacaugu

SEQ ID NO: 355978 - RNA, 19 nt, Homo sapiens
gcaggaagcaucucgaaga

SEQ ID NO: 355979 - RNA, 19 nt, Homo sapiens
ggaagccgcacuguauuua

SEQ ID NO: 355980 - RNA, 19 nt, Homo sapiens
agaguaaucuucacaaagu

SEQ ID NO: 355981 - RNA, 19 nt, Homo sapiens
ucaggaagauguccacuca

SEQ ID NO: 355982 - RNA, 19 nt, Homo sapiens
ugacacagccucugaacaa

SEQ ID NO: 355983 - RNA, 19 nt, Homo sapiens
aaagaaggagcgauauaua

SEQ ID NO: 355984 - RNA, 19 nt, Homo sapiens
gaggauuuauuacaaagug

SEQ ID NO: 355985 - RNA, 19 nt, Homo sapiens
uaaucuaacugccuguuga

SEQ ID NO: 355986 - RNA, 19 nt, Homo sapiens
guaccggguuccaaagaaa

SEQ ID NO: 355987 - RNA, 19 nt, Homo sapiens
ugagagggcuugccguaug

SEQ ID NO: 355988 - RNA, 19 nt, Homo sapiens
gcuaucggauccaaaccua

SEQ ID NO: 355989 - RNA, 19 nt, Homo sapiens
gaaaggcauucauguugag

SEQ ID NO: 355990 - RNA, 19 nt, Homo sapiens
gaaguuuauugaccaagug

SEQ ID NO: 355991 - RNA, 19 nt, Homo sapiens
ggagcucuguccuauguau

SEQ ID NO: 355992 - RNA, 19 nt, Homo sapiens
caccagaugucaaauuugu

SEQ ID NO: 355993 - RNA, 19 nt, Homo sapiens
ccgaaacccuucaauagau

SEQ ID NO: 355994 - RNA, 19 nt, Homo sapiens
cuaacugccuguugacauu

SEQ ID NO: 355995 - RNA, 19 nt, Homo sapiens
gaaggagcgauauauaguu

SEQ ID NO: 355996 - RNA, 19 nt, Homo sapiens
gaaauuugaguccuaguca

SEQ ID NO: 355997 - RNA, 19 nt, Homo sapiens
ucaucuccauggccaauua

SEQ ID NO: 355998 - RNA, 19 nt, Homo sapiens
guuguaggcugucaugaau

SEQ ID NO: 355999 - RNA, 19 nt, Homo sapiens
caggaagcaucucgaagaa

SEQ ID NO: 356000 - RNA, 19 nt, Homo sapiens
uagaguuccuuucuccuaa

SEQ ID NO: 356001 - RNA, 19 nt, Homo sapiens
gaaaagaaggagcgauaua

SEQ ID NO: 356002 - RNA, 19 nt, Homo sapiens
caccauagcugccugaaaa

SEQ ID NO: 356003 - RNA, 19 nt, Homo sapiens
uuucaacccuccuaaaguu

SEQ ID NO: 356004 - RNA, 19 nt, Homo sapiens
ccagaugucaaauuuguuu

SEQ ID NO: 356005 - RNA, 19 nt, Homo sapiens
gaccuucagucucugcauu

SEQ ID NO: 356006 - RNA, 19 nt, Homo sapiens
guaggaaagagaaauuuga

SEQ ID NO: 356007 - RNA, 19 nt, Homo sapiens
gauccaaaccuaugcugaa

SEQ ID NO: 356008 - RNA, 19 nt, Homo sapiens
caaauaugcagaaagcuau

SEQ ID NO: 356009 - RNA, 19 nt, Homo sapiens
cagcaaauaugcagaaagc

SEQ ID NO: 356010 - RNA, 19 nt, Homo sapiens
cagaagagagguaucagaa

SEQ ID NO: 356011 - RNA, 19 nt, Homo sapiens
cugcugugaucaugaauuu

SEQ ID NO: 356012 - RNA, 19 nt, Homo sapiens
guacgugcuuaaccaguga

SEQ ID NO: 356013 - RNA, 19 nt, Homo sapiens
cagcaaaguagaugaagaa

SEQ ID NO: 356014 - RNA, 19 nt, Homo sapiens
caauagauccucaccagau

SEQ ID NO: 356015 - RNA, 19 nt, Homo sapiens
gacccagugugcuuaagaa

SEQ ID NO: 356016 - RNA, 19 nt, Homo sapiens
gaagccgcacuguauuuaa

SEQ ID NO: 356017 - RNA, 19 nt, Homo sapiens
gaaugaagaaggagcuuuc

SEQ ID NO: 356018 - RNA, 19 nt, Homo sapiens
gacacaauaugcucuugga

SEQ ID NO: 356019 - RNA, 19 nt, Homo sapiens
caacaugucccagcccauu

SEQ ID NO: 356020 - RNA, 19 nt, Homo sapiens
gugaaaucgugcaaaucua

SEQ ID NO: 356021 - RNA, 19 nt, Homo sapiens
guuaacuucuguucuuaug

SEQ ID NO: 356022 - RNA, 19 nt, Homo sapiens
aagguuaacuucuguucuu

SEQ ID NO: 356023 - RNA, 19 nt, Homo sapiens
guagaguuccuuucuccua

SEQ ID NO: 356024 - RNA, 19 nt, Homo sapiens
aagagaaauuugaguccua

SEQ ID NO: 356025 - RNA, 19 nt, Homo sapiens
ggagcaauuuuaagaguaa

SEQ ID NO: 356026 - RNA, 19 nt, Homo sapiens
gaacaggaggagcugaaug

SEQ ID NO: 356027 - RNA, 19 nt, Homo sapiens
acucuuggauacuaaauug

SEQ ID NO: 356028 - RNA, 19 nt, Homo sapiens
gcaaaguagaugaagaaga

SEQ ID NO: 356029 - RNA, 19 nt, Homo sapiens
ugacacaucagcauuuguu

SEQ ID NO: 356030 - RNA, 19 nt, Homo sapiens
gccuaaacgugaucauguu

SEQ ID NO: 356031 - RNA, 19 nt, Homo sapiens
ccgaaaggcauucauguug

SEQ ID NO: 356032 - RNA, 19 nt, Homo sapiens
aggaagauguccacucaug

SEQ ID NO: 356033 - RNA, 19 nt, Homo sapiens
gugcuuaaccagugaauuc

SEQ ID NO: 356034 - RNA, 19 nt, Homo sapiens
gaagagaagcagaucaaaa

SEQ ID NO: 356035 - RNA, 19 nt, Homo sapiens
ggauaucauuaacaacaca

SEQ ID NO: 356036 - RNA, 19 nt, Homo sapiens
ugaaugaugcugugggauu

SEQ ID NO: 356037 - RNA, 19 nt, Homo sapiens
gaagaagaacgcaaaagaa

SEQ ID NO: 356038 - RNA, 19 nt, Homo sapiens
caaaguguaccaggccaua

SEQ ID NO: 356039 - RNA, 19 nt, Homo sapiens
agagccggcuggcacauuu

SEQ ID NO: 356040 - RNA, 19 nt, Homo sapiens
ccagacucuuggauacuaa

SEQ ID NO: 356041 - RNA, 19 nt, Homo sapiens
ccuacacccugcagaauca

SEQ ID NO: 356042 - RNA, 19 nt, Homo sapiens
aaagaaaguggacugaaga

SEQ ID NO: 356043 - RNA, 19 nt, Homo sapiens
agagguaucagaagcuuaa

SEQ ID NO: 356044 - RNA, 19 nt, Homo sapiens
cucaccagaugucaaauuu

SEQ ID NO: 356045 - RNA, 19 nt, Homo sapiens
cgaaacccuucaauagauc

SEQ ID NO: 356046 - RNA, 19 nt, Homo sapiens
gcacaguaggaaagagaaa

SEQ ID NO: 356047 - RNA, 19 nt, Homo sapiens
ggacugaagauagcuggaa

SEQ ID NO: 356048 - RNA, 19 nt, Homo sapiens
ggaagagaagcagaucaaa

SEQ ID NO: 356049 - RNA, 19 nt, Homo sapiens
ugauggaccuucagucucu

SEQ ID NO: 356050 - RNA, 19 nt, Homo sapiens
gcaagccagggauuugauu

SEQ ID NO: 356051 - RNA, 19 nt, Homo sapiens
gaaugaagcuguaaacuua

SEQ ID NO: 356052 - RNA, 19 nt, Homo sapiens
gaagaugucucaaguagau

SEQ ID NO: 356053 - RNA, 19 nt, Homo sapiens
gaaguggguucccuagaua

SEQ ID NO: 356054 - RNA, 19 nt, Homo sapiens
ggucaaugcuagcacaaua

SEQ ID NO: 356055 - RNA, 19 nt, Homo sapiens
ccaacgagcucaacaacaa

SEQ ID NO: 356056 - RNA, 19 nt, Homo sapiens
guacgaagaugaugaagca

SEQ ID NO: 356057 - RNA, 19 nt, Homo sapiens
caacagaacacuauucaga

SEQ ID NO: 356058 - RNA, 19 nt, Homo sapiens
gaaacgagaagaugcaauu

SEQ ID NO: 356059 - RNA, 19 nt, Homo sapiens
ucaaguagauauucucgaa

SEQ ID NO: 356060 - RNA, 19 nt, Homo sapiens
gaagaagaugucucaagua

SEQ ID NO: 356061 - RNA, 19 nt, Homo sapiens
ucacagccguuugaauaua

SEQ ID NO: 356062 - RNA, 19 nt, Homo sapiens
agaccuagaugacauagaa

SEQ ID NO: 356063 - RNA, 19 nt, Homo sapiens
ugaagaagaugucucaagu

SEQ ID NO: 356064 - RNA, 19 nt, Homo sapiens
ucacaugucccuauacuga

SEQ ID NO: 356065 - RNA, 19 nt, Homo sapiens
gaugcaagauaaagaggaa

SEQ ID NO: 356066 - RNA, 19 nt, Homo sapiens
gcacaaccagugucucuga

SEQ ID NO: 356067 - RNA, 19 nt, Homo sapiens
uagaugacauagaagauga

SEQ ID NO: 356068 - RNA, 19 nt, Homo sapiens
ugagacugaugcaagauaa

SEQ ID NO: 356069 - RNA, 19 nt, Homo sapiens
ucaaguagcacacuggaaa

SEQ ID NO: 356070 - RNA, 19 nt, Homo sapiens
caaccagugucucugaaga

SEQ ID NO: 356071 - RNA, 19 nt, Homo sapiens
gcagagugcuuagaugagu

SEQ ID NO: 356072 - RNA, 19 nt, Homo sapiens
agucacagccguuugaaua

SEQ ID NO: 356073 - RNA, 19 nt, Homo sapiens
aagaagaugucucaaguag

SEQ ID NO: 356074 - RNA, 19 nt, Homo sapiens
guagaggauucaagacuca

SEQ ID NO: 356075 - RNA, 19 nt, Homo sapiens
gaacagcuaaagcaggaaa

SEQ ID NO: 356076 - RNA, 19 nt, Homo sapiens
aagaggaaaugauuggaaa

SEQ ID NO: 356077 - RNA, 19 nt, Homo sapiens
gauauaacagggaugcaaa

SEQ ID NO: 356078 - RNA, 19 nt, Homo sapiens
ggagccaccuagaacaguu

SEQ ID NO: 356079 - RNA, 19 nt, Homo sapiens
gugcuuagaugaguacgaa

SEQ ID NO: 356080 - RNA, 19 nt, Homo sapiens
uaaagucacagccguuuga

SEQ ID NO: 356081 - RNA, 19 nt, Homo sapiens
gcaauuacacaacagaaca

SEQ ID NO: 356082 - RNA, 19 nt, Homo sapiens
gauaaagaggaaaugauug

SEQ ID NO: 356083 - RNA, 19 nt, Homo sapiens
agaaguggguucccuagau

SEQ ID NO: 356084 - RNA, 19 nt, Homo sapiens
gagaagaugcaauuacaca

SEQ ID NO: 356085 - RNA, 19 nt, Homo sapiens
uacaugaguuccaauacuu

SEQ ID NO: 356086 - RNA, 19 nt, Homo sapiens
cauagucuuuguuuacaug

SEQ ID NO: 356087 - RNA, 19 nt, Homo sapiens
uaaauagagaccuagauga

SEQ ID NO: 356088 - RNA, 19 nt, Homo sapiens
caagauaaagaggaaauga

SEQ ID NO: 356089 - RNA, 19 nt, Homo sapiens
agaggaagcugcgggagaa

SEQ ID NO: 356090 - RNA, 19 nt, Homo sapiens
gaauguuaauggucaaugc

SEQ ID NO: 356091 - RNA, 19 nt, Homo sapiens
gcaaauguuucagguacuc

SEQ ID NO: 356092 - RNA, 19 nt, Homo sapiens
gaacaguuucaggcagaua

SEQ ID NO: 356093 - RNA, 19 nt, Homo sapiens
gaaagagcggaaacgagaa

SEQ ID NO: 356094 - RNA, 19 nt, Homo sapiens
agaaugaagcuguaaacuu

SEQ ID NO: 356095 - RNA, 19 nt, Homo sapiens
cacagccguuugaauauau

SEQ ID NO: 356096 - RNA, 19 nt, Homo sapiens
ccagguagaggauucaaga

SEQ ID NO: 356097 - RNA, 19 nt, Homo sapiens
uuacacaacagaacacuau

SEQ ID NO: 356098 - RNA, 19 nt, Homo sapiens
acgagaagaugcaauuaca

SEQ ID NO: 356099 - RNA, 19 nt, Homo sapiens
cagagugcuuagaugagua

SEQ ID NO: 356100 - RNA, 19 nt, Homo sapiens
gaagaugcaauuacacaac

SEQ ID NO: 356101 - RNA, 19 nt, Homo sapiens
gcagaaagagcggaaacga

SEQ ID NO: 356102 - RNA, 19 nt, Homo sapiens
ccuaugcugcaauacauua

SEQ ID NO: 356103 - RNA, 19 nt, Homo sapiens
cagguacucugguuucaag

SEQ ID NO: 356104 - RNA, 19 nt, Homo sapiens
aaacgagaagaugcaauua

SEQ ID NO: 356105 - RNA, 19 nt, Homo sapiens
gauauucucgaacagauag

SEQ ID NO: 356106 - RNA, 19 nt, Homo sapiens
cagugucucugaagaagau

SEQ ID NO: 356107 - RNA, 19 nt, Homo sapiens
cuacaggagccaccuagaa

SEQ ID NO: 356108 - RNA, 19 nt, Homo sapiens
ggaauauacauagucuuug

SEQ ID NO: 356109 - RNA, 19 nt, Homo sapiens
uuaaauagagaccuagaug

SEQ ID NO: 356110 - RNA, 19 nt, Homo sapiens
uagauauucucgaacagau

SEQ ID NO: 356111 - RNA, 19 nt, Homo sapiens
ucaaugcuagcacaauauu

SEQ ID NO: 356112 - RNA, 19 nt, Homo sapiens
uuacaugaguuccaauacu

SEQ ID NO: 356113 - RNA, 19 nt, Homo sapiens
guagauauucucgaacaga

SEQ ID NO: 356114 - RNA, 19 nt, Homo sapiens
uagaugaguacgaagauga

SEQ ID NO: 356115 - RNA, 19 nt, Homo sapiens
gagcggaaacgagaagaug

SEQ ID NO: 356116 - RNA, 19 nt, Homo sapiens
ccgcagagugcuuagauga

SEQ ID NO: 356117 - RNA, 19 nt, Homo sapiens
gugagacugaugcaagaua

SEQ ID NO: 356118 - RNA, 19 nt, Homo sapiens
gaugcaaauguuucaggua

SEQ ID NO: 356119 - RNA, 19 nt, Homo sapiens
aaguagauauucucgaaca

SEQ ID NO: 356120 - RNA, 19 nt, Homo sapiens
aagaugcaauuacacaaca

SEQ ID NO: 356121 - RNA, 19 nt, Homo sapiens
aaagaggaaaugauuggaa

SEQ ID NO: 356122 - RNA, 19 nt, Homo sapiens
gaaaaccuaagacuuguga

SEQ ID NO: 356123 - RNA, 19 nt, Homo sapiens
guagcacacuggaaaagaa

SEQ ID NO: 356124 - RNA, 19 nt, Homo sapiens
acugaugugugccaccuuu

SEQ ID NO: 356125 - RNA, 19 nt, Homo sapiens
auagagaccuagaugacau

SEQ ID NO: 356126 - RNA, 19 nt, Homo sapiens
ggaaaugauuggaaaacuc

SEQ ID NO: 356127 - RNA, 19 nt, Homo sapiens
gaaaugauuggaaaacuca

SEQ ID NO: 356128 - RNA, 19 nt, Homo sapiens
guuuacaugaguuccaaua

SEQ ID NO: 356129 - RNA, 19 nt, Homo sapiens
gcauuauccuuuuaucuca

SEQ ID NO: 356130 - RNA, 19 nt, Homo sapiens
aaaccuaagacuugugaga

SEQ ID NO: 356131 - RNA, 19 nt, Homo sapiens
acaugucccuauacugaug

SEQ ID NO: 356132 - RNA, 19 nt, Homo sapiens
caauauuccuaugcugcaa

SEQ ID NO: 356133 - RNA, 19 nt, Homo sapiens
gcaagauaaagaggaaaug

SEQ ID NO: 356134 - RNA, 19 nt, Homo sapiens
gaaagacaagaaaaccuaa

SEQ ID NO: 356135 - RNA, 19 nt, Homo sapiens
uugaagaucuugaaaagga

SEQ ID NO: 356136 - RNA, 19 nt, Homo sapiens
gcuuagaugaguacgaaga

SEQ ID NO: 356137 - RNA, 19 nt, Homo sapiens
cacaacagaacacuauuca

SEQ ID NO: 356138 - RNA, 19 nt, Homo sapiens
gcaaggggcagaucgagaa

SEQ ID NO: 356139 - RNA, 19 nt, Homo sapiens
ucccuuaggaauauacaua

SEQ ID NO: 356140 - RNA, 19 nt, Homo sapiens
gcuagcacaauauuccuau

SEQ ID NO: 356141 - RNA, 19 nt, Homo sapiens
gcaggaaaauaaaacucuu

SEQ ID NO: 356142 - RNA, 19 nt, Homo sapiens
ugaguacgaagaugaugaa

SEQ ID NO: 356143 - RNA, 19 nt, Homo sapiens
cacaaccagugucucugaa

SEQ ID NO: 356144 - RNA, 19 nt, Homo sapiens
gagacugaugcaagauaaa

SEQ ID NO: 356145 - RNA, 19 nt, Homo sapiens
gagccaccuagaacaguuu

SEQ ID NO: 356146 - RNA, 19 nt, Homo sapiens
ccucacaugucccuauacu

SEQ ID NO: 356147 - RNA, 19 nt, Homo sapiens
gaugacauagaagaugaaa

SEQ ID NO: 356148 - RNA, 19 nt, Homo sapiens
ugaugaagcagggcagaaa

SEQ ID NO: 356149 - RNA, 19 nt, Homo sapiens
gauccaggcaguuccuauc

SEQ ID NO: 356150 - RNA, 19 nt, Homo sapiens
acccucacaugucccuaua

SEQ ID NO: 356151 - RNA, 19 nt, Homo sapiens
ccaccacacuuccuuuauu

SEQ ID NO: 356152 - RNA, 19 nt, Homo sapiens
agagaaaccugccuuagag

SEQ ID NO: 356153 - RNA, 19 nt, Homo sapiens
caccacacuuccuuuauug

SEQ ID NO: 356154 - RNA, 19 nt, Homo sapiens
gccauccgcuugcgcauug

SEQ ID NO: 356155 - RNA, 19 nt, Homo sapiens
gacauuaaauacacucagu

SEQ ID NO: 356156 - RNA, 19 nt, Homo sapiens
caacgagaccggcuccauu

SEQ ID NO: 356157 - RNA, 19 nt, Homo sapiens
acaaccacaucuaccagua

SEQ ID NO: 356158 - RNA, 19 nt, Homo sapiens
aggagacccuggcaucuuu

SEQ ID NO: 356159 - RNA, 19 nt, Homo sapiens
ggaacucgcggcagcaaug

SEQ ID NO: 356160 - RNA, 19 nt, Homo sapiens
uagagaaaccugccuuaga

SEQ ID NO: 356161 - RNA, 19 nt, Homo sapiens
gaccguacgaggcaaguaa

SEQ ID NO: 356162 - RNA, 19 nt, Homo sapiens
uagaggcagacauuaaaua

SEQ ID NO: 356163 - RNA, 19 nt, Homo sapiens
gcuagagaaaccugccuua

SEQ ID NO: 356164 - RNA, 19 nt, Homo sapiens
ucucugaacuuggguuuua

SEQ ID NO: 356165 - RNA, 19 nt, Homo sapiens
cggcagcaaugaccuucaa

SEQ ID NO: 356166 - RNA, 19 nt, Homo sapiens
gaacucgcggcagcaauga

SEQ ID NO: 356167 - RNA, 19 nt, Homo sapiens
gcacauccgggacuacaag

SEQ ID NO: 356168 - RNA, 19 nt, Homo sapiens
ucaagcacauccgggacua

SEQ ID NO: 356169 - RNA, 19 nt, Homo sapiens
ggacgcccucaguagcuua

SEQ ID NO: 356170 - RNA, 19 nt, Homo sapiens
gcagugaaugggcuagaga

SEQ ID NO: 356171 - RNA, 19 nt, Homo sapiens
ccuuagaggcagacauuaa

SEQ ID NO: 356172 - RNA, 19 nt, Homo sapiens
ugaaugggcuagagaaacc

SEQ ID NO: 356173 - RNA, 19 nt, Homo sapiens
ggacccaccacacuuccuu

SEQ ID NO: 356174 - RNA, 19 nt, Homo sapiens
cuuagaggcagacauuaaa

SEQ ID NO: 356175 - RNA, 19 nt, Homo sapiens
cgaaggcaccgcuuacucu

SEQ ID NO: 356176 - RNA, 19 nt, Homo sapiens
agccuacgcugcccuacaa

SEQ ID NO: 356177 - RNA, 19 nt, Homo sapiens
cauccgacccugugacauc

SEQ ID NO: 356178 - RNA, 19 nt, Homo sapiens
aggcagacauuaaauacac

SEQ ID NO: 356179 - RNA, 19 nt, Homo sapiens
cagcaaugaccuucaagca

SEQ ID NO: 356180 - RNA, 19 nt, Homo sapiens
gaggcagacauuaaauaca

SEQ ID NO: 356181 - RNA, 19 nt, Homo sapiens
ccaacguggucaagcacau

SEQ ID NO: 356182 - RNA, 19 nt, Homo sapiens
cugggcauccggacguuua

SEQ ID NO: 356183 - RNA, 19 nt, Homo sapiens
cggcgucugugacaaguac

SEQ ID NO: 356184 - RNA, 19 nt, Homo sapiens
ccacacuuccuuuauuggu

SEQ ID NO: 356185 - RNA, 19 nt, Homo sapiens
ggaccguacgaggcaagua

SEQ ID NO: 356186 - RNA, 19 nt, Homo sapiens
ccaaggagauuaagaagaa

SEQ ID NO: 356187 - RNA, 19 nt, Homo sapiens
caagauugcugaauacaaa

SEQ ID NO: 356188 - RNA, 19 nt, Homo sapiens
gaagucaagucgagucuau

SEQ ID NO: 356189 - RNA, 19 nt, Homo sapiens
guucugagcuggcgucuga

SEQ ID NO: 356190 - RNA, 19 nt, Homo sapiens
gaggaaacgugaugaagau

SEQ ID NO: 356191 - RNA, 19 nt, Homo sapiens
gaacugaacagaaccacaa

SEQ ID NO: 356192 - RNA, 19 nt, Homo sapiens
ggacaagauugcugaauac

SEQ ID NO: 356193 - RNA, 19 nt, Homo sapiens
caacgaggcuuggagauuc

SEQ ID NO: 356194 - RNA, 19 nt, Homo sapiens
cgacagaacccgacuaugu

SEQ ID NO: 356195 - RNA, 19 nt, Homo sapiens
uggacaagauugcugaaua

SEQ ID NO: 356196 - RNA, 19 nt, Homo sapiens
gaaacgugaugaagaugug

SEQ ID NO: 356197 - RNA, 19 nt, Homo sapiens
ugacuccucuggccuguuu

SEQ ID NO: 356198 - RNA, 19 nt, Homo sapiens
caucagagcacaucaaauc

SEQ ID NO: 356199 - RNA, 19 nt, Homo sapiens
uagcgaacauggucuguga

SEQ ID NO: 356200 - RNA, 19 nt, Homo sapiens
ccaccaggcugcugcuuug

SEQ ID NO: 356201 - RNA, 19 nt, Homo sapiens
ccaaagugguggacaagau

SEQ ID NO: 356202 - RNA, 19 nt, Homo sapiens
cuacuucucugccaacuuc

SEQ ID NO: 356203 - RNA, 19 nt, Homo sapiens
caauggagauucccagagu

SEQ ID NO: 356204 - RNA, 19 nt, Homo sapiens
gaagaggaaacgugaugaa

SEQ ID NO: 356205 - RNA, 19 nt, Homo sapiens
gacagaacccgacuauguu

SEQ ID NO: 356206 - RNA, 19 nt, Homo sapiens
guccugaaguugaguuuga

SEQ ID NO: 356207 - RNA, 19 nt, Homo sapiens
gaaacccgguguacauaac

SEQ ID NO: 356208 - RNA, 19 nt, Homo sapiens
cagagcacaucaaaucaga

SEQ ID NO: 356209 - RNA, 19 nt, Homo sapiens
gagaagaggaaacgugaug

SEQ ID NO: 356210 - RNA, 19 nt, Homo sapiens
cgacacagacucucaaucu

SEQ ID NO: 356211 - RNA, 19 nt, Homo sapiens
ggugugcccugucccagaa

SEQ ID NO: 356212 - RNA, 19 nt, Homo sapiens
agagugguguggacaguuu

SEQ ID NO: 356213 - RNA, 19 nt, Homo sapiens
gagggcaucugugacaaug

SEQ ID NO: 356214 - RNA, 19 nt, Homo sapiens
caaagugguggacaagauu

SEQ ID NO: 356215 - RNA, 19 nt, Homo sapiens
gcgaaacccgguguacaua

SEQ ID NO: 356216 - RNA, 19 nt, Homo sapiens
gacggugugugucguguga

SEQ ID NO: 356217 - RNA, 19 nt, Homo sapiens
gaacaaaacaacacaaaag

SEQ ID NO: 356218 - RNA, 19 nt, Homo sapiens
ggcaggaacugaacagaac

SEQ ID NO: 356219 - RNA, 19 nt, Homo sapiens
cgucaggucuuuccaaggu

SEQ ID NO: 356220 - RNA, 19 nt, Homo sapiens
cgaaacccgguguacauaa

SEQ ID NO: 356221 - RNA, 19 nt, Homo sapiens
gggccaaggagauuaagaa

SEQ ID NO: 356222 - RNA, 19 nt, Homo sapiens
ggaaacgugaugaagaugu

SEQ ID NO: 356223 - RNA, 19 nt, Homo sapiens
caaggagauuaagaagaaa

SEQ ID NO: 356224 - RNA, 19 nt, Homo sapiens
ucucuguaauuccguguuu

SEQ ID NO: 356225 - RNA, 19 nt, Homo sapiens
gcacaucaaaucagaacag

SEQ ID NO: 356226 - RNA, 19 nt, Homo sapiens
cagcgucucuuccaucaac

SEQ ID NO: 356227 - RNA, 19 nt, Homo sapiens
cagcuacacgcccauuaaa

SEQ ID NO: 356228 - RNA, 19 nt, Homo sapiens
guggaaagacggugugugu

SEQ ID NO: 356229 - RNA, 19 nt, Homo sapiens
caggaccaguuuccauaga

SEQ ID NO: 356230 - RNA, 19 nt, Homo sapiens
ccuaugaccgccacuaguu

SEQ ID NO: 356231 - RNA, 19 nt, Homo sapiens
gugaugaagaugugucuga

SEQ ID NO: 356232 - RNA, 19 nt, Homo sapiens
gggcaucugugacaaugac

SEQ ID NO: 356233 - RNA, 19 nt, Homo sapiens
ggaccaguuuccauagacu

SEQ ID NO: 356234 - RNA, 19 nt, Homo sapiens
agaggaaacgugaugaaga

SEQ ID NO: 356235 - RNA, 19 nt, Homo sapiens
ucucuuccaucaacagaau

SEQ ID NO: 356236 - RNA, 19 nt, Homo sapiens
ggucuuccuccagcaguua

SEQ ID NO: 356237 - RNA, 19 nt, Homo sapiens
gggaccacaucaagcuuca

SEQ ID NO: 356238 - RNA, 19 nt, Homo sapiens
cuaugaccgccacuaguua

SEQ ID NO: 356239 - RNA, 19 nt, Homo sapiens
ggcaucagagcacaucaaa

SEQ ID NO: 356240 - RNA, 19 nt, Homo sapiens
ggauccuacuccaucaaug

SEQ ID NO: 356241 - RNA, 19 nt, Homo sapiens
uguuggcucuuucucugua

SEQ ID NO: 356242 - RNA, 19 nt, Homo sapiens
ccucucggaugaccagguu

SEQ ID NO: 356243 - RNA, 19 nt, Homo sapiens
gaaggcgaaacccggugua

SEQ ID NO: 356244 - RNA, 19 nt, Homo sapiens
gcaggaccaguuuccauag

SEQ ID NO: 356245 - RNA, 19 nt, Homo sapiens
gaagagcccgcugccgaau

SEQ ID NO: 356246 - RNA, 19 nt, Homo sapiens
acagcuacacgcccauuaa

SEQ ID NO: 356247 - RNA, 19 nt, Homo sapiens
cgcaggaccaguuuccaua

SEQ ID NO: 356248 - RNA, 19 nt, Homo sapiens
ccaauggugagaagaggaa

SEQ ID NO: 356249 - RNA, 19 nt, Homo sapiens
ggcgaaacccgguguacau

SEQ ID NO: 356250 - RNA, 19 nt, Homo sapiens
ggaacaaaacaacacaaaa

SEQ ID NO: 356251 - RNA, 19 nt, Homo sapiens
gagcacaucaaaucagaac

SEQ ID NO: 356252 - RNA, 19 nt, Homo sapiens
uuacgaagaaagaaucuca

SEQ ID NO: 356253 - RNA, 19 nt, Homo sapiens
uuaauaugauggucuuugc

SEQ ID NO: 356254 - RNA, 19 nt, Homo sapiens
gccaaggagauuaagaaga

SEQ ID NO: 356255 - RNA, 19 nt, Homo sapiens
gcugggccaaggagauuaa

SEQ ID NO: 356256 - RNA, 19 nt, Homo sapiens
gggcugggccaaggagauu

SEQ ID NO: 356257 - RNA, 19 nt, Homo sapiens
ccuccuggccugccuaguu

SEQ ID NO: 356258 - RNA, 19 nt, Homo sapiens
caacucgccagcacuugga

SEQ ID NO: 356259 - RNA, 19 nt, Homo sapiens
cggcaggaacugaacagaa

SEQ ID NO: 356260 - RNA, 19 nt, Homo sapiens
cuccagcaguuacuugaug

SEQ ID NO: 356261 - RNA, 19 nt, Homo sapiens
acaacgaggcuuggagauu

SEQ ID NO: 356262 - RNA, 19 nt, Homo sapiens
agaaucauccggaccaaag

SEQ ID NO: 356263 - RNA, 19 nt, Homo sapiens
gcuacacgcccauuaaagc

SEQ ID NO: 356264 - RNA, 19 nt, Homo sapiens
uauguucgccugggagauu

SEQ ID NO: 356265 - RNA, 19 nt, Homo sapiens
cuccucaaguccugaaguu

SEQ ID NO: 356266 - RNA, 19 nt, Homo sapiens
ccagagugguguggacagu

SEQ ID NO: 356267 - RNA, 19 nt, Homo sapiens
cccagcgucucuuccauca

SEQ ID NO: 356268 - RNA, 19 nt, Homo sapiens
auaugauggucuuugcaaa

SEQ ID NO: 356269 - RNA, 19 nt, Homo sapiens
acaagauugcugaauacaa

SEQ ID NO: 356270 - RNA, 19 nt, Homo sapiens
guuggcucuuucucuguaa

SEQ ID NO: 356271 - RNA, 19 nt, Homo sapiens
ccgcaacccuucacaucac

SEQ ID NO: 356272 - RNA, 19 nt, Homo sapiens
cagcuucggccuccacauc

SEQ ID NO: 356273 - RNA, 19 nt, Homo sapiens
ccacuggccagggaagcua

SEQ ID NO: 356274 - RNA, 19 nt, Homo sapiens
ucuuugagcguccuuccua

SEQ ID NO: 356275 - RNA, 19 nt, Homo sapiens
gggauccuacuccaucaau

SEQ ID NO: 356276 - RNA, 19 nt, Homo sapiens
ccaaggagauuaagaagaa

SEQ ID NO: 356277 - RNA, 19 nt, Homo sapiens
caagauugcugaauacaaa

SEQ ID NO: 356278 - RNA, 19 nt, Homo sapiens
gaggaaacgugaugaaguu

SEQ ID NO: 356279 - RNA, 19 nt, Homo sapiens
gaagucaagucgagucuau

SEQ ID NO: 356280 - RNA, 19 nt, Homo sapiens
guucugagcuggcgucuga

SEQ ID NO: 356281 - RNA, 19 nt, Homo sapiens
caucuggucuggacuuuaa

SEQ ID NO: 356282 - RNA, 19 nt, Homo sapiens
gaacugaacagaaccacaa

SEQ ID NO: 356283 - RNA, 19 nt, Homo sapiens
ggacaagauugcugaauac

SEQ ID NO: 356284 - RNA, 19 nt, Homo sapiens
gugaugaaguugagguaua

SEQ ID NO: 356285 - RNA, 19 nt, Homo sapiens
caacgaggcuuggagauuc

SEQ ID NO: 356286 - RNA, 19 nt, Homo sapiens
cgacagaacccgacuaugu

SEQ ID NO: 356287 - RNA, 19 nt, Homo sapiens
uggacaagauugcugaaua

SEQ ID NO: 356288 - RNA, 19 nt, Homo sapiens
ugacuccucuggccuguuu

SEQ ID NO: 356289 - RNA, 19 nt, Homo sapiens
caucagagcacaucaaauc

SEQ ID NO: 356290 - RNA, 19 nt, Homo sapiens
uagcgaacauggucuguga

SEQ ID NO: 356291 - RNA, 19 nt, Homo sapiens
ccaccaggcugcugcuuug

SEQ ID NO: 356292 - RNA, 19 nt, Homo sapiens
ggucuggacuuuaagagau

SEQ ID NO: 356293 - RNA, 19 nt, Homo sapiens
ccaaagugguggacaagau

SEQ ID NO: 356294 - RNA, 19 nt, Homo sapiens
cuacuucucugccaacuuc

SEQ ID NO: 356295 - RNA, 19 nt, Homo sapiens
caauggagauucccagagu

SEQ ID NO: 356296 - RNA, 19 nt, Homo sapiens
uagaggagguggagguuug

SEQ ID NO: 356297 - RNA, 19 nt, Homo sapiens
gaagaggaaacgugaugaa

SEQ ID NO: 356298 - RNA, 19 nt, Homo sapiens
gaaacgugaugaaguugag

SEQ ID NO: 356299 - RNA, 19 nt, Homo sapiens
gacagaacccgacuauguu

SEQ ID NO: 356300 - RNA, 19 nt, Homo sapiens
guccugaaguugaguuuga

SEQ ID NO: 356301 - RNA, 19 nt, Homo sapiens
gaaacccgguguacauaac

SEQ ID NO: 356302 - RNA, 19 nt, Homo sapiens
cagagcacaucaaaucaga

SEQ ID NO: 356303 - RNA, 19 nt, Homo sapiens
gagaagaggaaacgugaug

SEQ ID NO: 356304 - RNA, 19 nt, Homo sapiens
cgacacagacucucaaucu

SEQ ID NO: 356305 - RNA, 19 nt, Homo sapiens
ggugugcccugucccagaa

SEQ ID NO: 356306 - RNA, 19 nt, Homo sapiens
agagugguguggacaguuu

SEQ ID NO: 356307 - RNA, 19 nt, Homo sapiens
gagggcaucugugacaaug

SEQ ID NO: 356308 - RNA, 19 nt, Homo sapiens
caaagugguggacaagauu

SEQ ID NO: 356309 - RNA, 19 nt, Homo sapiens
gcgaaacccgguguacaua

SEQ ID NO: 356310 - RNA, 19 nt, Homo sapiens
gacggugugugucguguga

SEQ ID NO: 356311 - RNA, 19 nt, Homo sapiens
gaacaaaacaacacaaaag

SEQ ID NO: 356312 - RNA, 19 nt, Homo sapiens
ggaaacgugaugaaguuga

SEQ ID NO: 356313 - RNA, 19 nt, Homo sapiens
ggcaggaacugaacagaac

SEQ ID NO: 356314 - RNA, 19 nt, Homo sapiens
cgucaggucuuuccaaggu

SEQ ID NO: 356315 - RNA, 19 nt, Homo sapiens
cgaaacccgguguacauaa

SEQ ID NO: 356316 - RNA, 19 nt, Homo sapiens
gggccaaggagauuaagaa

SEQ ID NO: 356317 - RNA, 19 nt, Homo sapiens
caaggagauuaagaagaaa

SEQ ID NO: 356318 - RNA, 19 nt, Homo sapiens
ucucuguaauuccguguuu

SEQ ID NO: 356319 - RNA, 19 nt, Homo sapiens
aaguugagguauacacuga

SEQ ID NO: 356320 - RNA, 19 nt, Homo sapiens
gcacaucaaaucagaacag

SEQ ID NO: 356321 - RNA, 19 nt, Homo sapiens
cagcgucucuuccaucaac

SEQ ID NO: 356322 - RNA, 19 nt, Homo sapiens
cagcuacacgcccauuaaa

SEQ ID NO: 356323 - RNA, 19 nt, Homo sapiens
guggaaagacggugugugu

SEQ ID NO: 356324 - RNA, 19 nt, Homo sapiens
caggaccaguuuccauaga

SEQ ID NO: 356325 - RNA, 19 nt, Homo sapiens
ccuaugaccgccacuaguu

SEQ ID NO: 356326 - RNA, 19 nt, Homo sapiens
gggcaucugugacaaugac

SEQ ID NO: 356327 - RNA, 19 nt, Homo sapiens
ggaccaguuuccauagacu

SEQ ID NO: 356328 - RNA, 19 nt, Homo sapiens
ucucuuccaucaacagaau

SEQ ID NO: 356329 - RNA, 19 nt, Homo sapiens
ggucuuccuccagcaguua

SEQ ID NO: 356330 - RNA, 19 nt, Homo sapiens
gggaccacaucaagcuuca

SEQ ID NO: 356331 - RNA, 19 nt, Homo sapiens
cuaugaccgccacuaguua

SEQ ID NO: 356332 - RNA, 19 nt, Homo sapiens
ggcaucagagcacaucaaa

SEQ ID NO: 356333 - RNA, 19 nt, Homo sapiens
ggauccuacuccaucaaug

SEQ ID NO: 356334 - RNA, 19 nt, Homo sapiens
uguuggcucuuucucugua

SEQ ID NO: 356335 - RNA, 19 nt, Homo sapiens
gaaggcgaaacccggugua

SEQ ID NO: 356336 - RNA, 19 nt, Homo sapiens
ccucucggaugaccagguu

SEQ ID NO: 356337 - RNA, 19 nt, Homo sapiens
gcaggaccaguuuccauag

SEQ ID NO: 356338 - RNA, 19 nt, Homo sapiens
gaagagcccgcugccgaau

SEQ ID NO: 356339 - RNA, 19 nt, Homo sapiens
acagcuacacgcccauuaa

SEQ ID NO: 356340 - RNA, 19 nt, Homo sapiens
cgcaggaccaguuuccaua

SEQ ID NO: 356341 - RNA, 19 nt, Homo sapiens
ugaugaaguugagguauac

SEQ ID NO: 356342 - RNA, 19 nt, Homo sapiens
ccaauggugagaagaggaa

SEQ ID NO: 356343 - RNA, 19 nt, Homo sapiens
ggcgaaacccgguguacau

SEQ ID NO: 356344 - RNA, 19 nt, Homo sapiens
ggaacaaaacaacacaaaa

SEQ ID NO: 356345 - RNA, 19 nt, Homo sapiens
gagcacaucaaaucagaac

SEQ ID NO: 356346 - RNA, 19 nt, Homo sapiens
guugagguauacacugauc

SEQ ID NO: 356347 - RNA, 19 nt, Homo sapiens
uuacgaagaaagaaucuca

SEQ ID NO: 356348 - RNA, 19 nt, Homo sapiens
uuaauaugauggucuuugc

SEQ ID NO: 356349 - RNA, 19 nt, Homo sapiens
gccaaggagauuaagaaga

SEQ ID NO: 356350 - RNA, 19 nt, Homo sapiens
gcugggccaaggagauuaa

SEQ ID NO: 356351 - RNA, 19 nt, Homo sapiens
gggcugggccaaggagauu

SEQ ID NO: 356352 - RNA, 19 nt, Homo sapiens
gcaucuggucuggacuuua

SEQ ID NO: 356353 - RNA, 19 nt, Homo sapiens
ccuccuggccugccuaguu

SEQ ID NO: 356354 - RNA, 19 nt, Homo sapiens
cggcaggaacugaacagaa

SEQ ID NO: 356355 - RNA, 19 nt, Homo sapiens
cuccagcaguuacuugaug

SEQ ID NO: 356356 - RNA, 19 nt, Homo sapiens
caacucgccagcacuugga

SEQ ID NO: 356357 - RNA, 19 nt, Homo sapiens
acaacgaggcuuggagauu

SEQ ID NO: 356358 - RNA, 19 nt, Homo sapiens
acacugauccugcccacau

SEQ ID NO: 356359 - RNA, 19 nt, Homo sapiens
agaaucauccggaccaaag

SEQ ID NO: 356360 - RNA, 19 nt, Homo sapiens
gcuacacgcccauuaaagc

SEQ ID NO: 356361 - RNA, 19 nt, Homo sapiens
uauguucgccugggagauu

SEQ ID NO: 356362 - RNA, 19 nt, Homo sapiens
cuccucaaguccugaaguu

SEQ ID NO: 356363 - RNA, 19 nt, Homo sapiens
ccagagugguguggacagu

SEQ ID NO: 356364 - RNA, 19 nt, Homo sapiens
agaggaaacgugaugaagu

SEQ ID NO: 356365 - RNA, 19 nt, Homo sapiens
cccagcgucucuuccauca

SEQ ID NO: 356366 - RNA, 19 nt, Homo sapiens
acaagauugcugaauacaa

SEQ ID NO: 356367 - RNA, 19 nt, Homo sapiens
auaugauggucuuugcaaa

SEQ ID NO: 356368 - RNA, 19 nt, Homo sapiens
guuggcucuuucucuguaa

SEQ ID NO: 356369 - RNA, 19 nt, Homo sapiens
ccgcaacccuucacaucac

SEQ ID NO: 356370 - RNA, 19 nt, Homo sapiens
cagcuucggccuccacauc

SEQ ID NO: 356371 - RNA, 19 nt, Homo sapiens
ccacuggccagggaagcua

SEQ ID NO: 356372 - RNA, 19 nt, Homo sapiens
ucuuugagcguccuuccua

SEQ ID NO: 356373 - RNA, 19 nt, Homo sapiens
gauccugcccacauuagag

SEQ ID NO: 356374 - RNA, 19 nt, Homo sapiens
cacugauccugcccacauu

SEQ ID NO: 356375 - RNA, 19 nt, Homo sapiens
gggauccuacuccaucaau

SEQ ID NO: 356376 - RNA, 19 nt, Homo sapiens
ccaaggagauuaagaagaa

SEQ ID NO: 356377 - RNA, 19 nt, Homo sapiens
caagauugcugaauacaaa

SEQ ID NO: 356378 - RNA, 19 nt, Homo sapiens
ggaggaagcuugcagaagu

SEQ ID NO: 356379 - RNA, 19 nt, Homo sapiens
gaagucaagucgagucuau

SEQ ID NO: 356380 - RNA, 19 nt, Homo sapiens
guucugagcuggcgucuga

SEQ ID NO: 356381 - RNA, 19 nt, Homo sapiens
gaggaaacgugaugaagau

SEQ ID NO: 356382 - RNA, 19 nt, Homo sapiens
gaacugaacagaaccacaa

SEQ ID NO: 356383 - RNA, 19 nt, Homo sapiens
ggacaagauugcugaauac

SEQ ID NO: 356384 - RNA, 19 nt, Homo sapiens
caacgaggcuuggagauuc

SEQ ID NO: 356385 - RNA, 19 nt, Homo sapiens
cgacagaacccgacuaugu

SEQ ID NO: 356386 - RNA, 19 nt, Homo sapiens
uggacaagauugcugaaua

SEQ ID NO: 356387 - RNA, 19 nt, Homo sapiens
gaaacgugaugaagaugug

SEQ ID NO: 356388 - RNA, 19 nt, Homo sapiens
ugacuccucuggccuguuu

SEQ ID NO: 356389 - RNA, 19 nt, Homo sapiens
caucagagcacaucaaauc

SEQ ID NO: 356390 - RNA, 19 nt, Homo sapiens
uagcgaacauggucuguga

SEQ ID NO: 356391 - RNA, 19 nt, Homo sapiens
ccaccaggcugcugcuuug

SEQ ID NO: 356392 - RNA, 19 nt, Homo sapiens
ccaaagugguggacaagau

SEQ ID NO: 356393 - RNA, 19 nt, Homo sapiens
cuacuucucugccaacuuc

SEQ ID NO: 356394 - RNA, 19 nt, Homo sapiens
caauggagauucccagagu

SEQ ID NO: 356395 - RNA, 19 nt, Homo sapiens
ccacuuccccuuauuauua

SEQ ID NO: 356396 - RNA, 19 nt, Homo sapiens
gaagaggaaacgugaugaa

SEQ ID NO: 356397 - RNA, 19 nt, Homo sapiens
gacagaacccgacuauguu

SEQ ID NO: 356398 - RNA, 19 nt, Homo sapiens
guccugaaguugaguuuga

SEQ ID NO: 356399 - RNA, 19 nt, Homo sapiens
gaaacccgguguacauaac

SEQ ID NO: 356400 - RNA, 19 nt, Homo sapiens
cagagcacaucaaaucaga

SEQ ID NO: 356401 - RNA, 19 nt, Homo sapiens
gagaagaggaaacgugaug

SEQ ID NO: 356402 - RNA, 19 nt, Homo sapiens
gaggaagcuugcagaagug

SEQ ID NO: 356403 - RNA, 19 nt, Homo sapiens
cgacacagacucucaaucu

SEQ ID NO: 356404 - RNA, 19 nt, Homo sapiens
ggugugcccugucccagaa

SEQ ID NO: 356405 - RNA, 19 nt, Homo sapiens
agagugguguggacaguuu

SEQ ID NO: 356406 - RNA, 19 nt, Homo sapiens
gagggcaucugugacaaug

SEQ ID NO: 356407 - RNA, 19 nt, Homo sapiens
caaagugguggacaagauu

SEQ ID NO: 356408 - RNA, 19 nt, Homo sapiens
gcgaaacccgguguacaua

SEQ ID NO: 356409 - RNA, 19 nt, Homo sapiens
gacggugugugucguguga

SEQ ID NO: 356410 - RNA, 19 nt, Homo sapiens
gaacaaaacaacacaaaag

SEQ ID NO: 356411 - RNA, 19 nt, Homo sapiens
ggcaggaacugaacagaac

SEQ ID NO: 356412 - RNA, 19 nt, Homo sapiens
cgucaggucuuuccaaggu

SEQ ID NO: 356413 - RNA, 19 nt, Homo sapiens
cgaaacccgguguacauaa

SEQ ID NO: 356414 - RNA, 19 nt, Homo sapiens
gggccaaggagauuaagaa

SEQ ID NO: 356415 - RNA, 19 nt, Homo sapiens
ggaaacgugaugaagaugu

SEQ ID NO: 356416 - RNA, 19 nt, Homo sapiens
caaggagauuaagaagaaa

SEQ ID NO: 356417 - RNA, 19 nt, Homo sapiens
ucucuguaauuccguguuu

SEQ ID NO: 356418 - RNA, 19 nt, Homo sapiens
cauccucccucaugagcaa

SEQ ID NO: 356419 - RNA, 19 nt, Homo sapiens
gcacaucaaaucagaacag

SEQ ID NO: 356420 - RNA, 19 nt, Homo sapiens
cagcgucucuuccaucaac

SEQ ID NO: 356421 - RNA, 19 nt, Homo sapiens
cagcuacacgcccauuaaa

SEQ ID NO: 356422 - RNA, 19 nt, Homo sapiens
guggaaagacggugugugu

SEQ ID NO: 356423 - RNA, 19 nt, Homo sapiens
caggaccaguuuccauaga

SEQ ID NO: 356424 - RNA, 19 nt, Homo sapiens
ccuaugaccgccacuaguu

SEQ ID NO: 356425 - RNA, 19 nt, Homo sapiens
gugaugaagaugugucuga

SEQ ID NO: 356426 - RNA, 19 nt, Homo sapiens
gggcaucugugacaaugac

SEQ ID NO: 356427 - RNA, 19 nt, Homo sapiens
ggaccaguuuccauagacu

SEQ ID NO: 356428 - RNA, 19 nt, Homo sapiens
agaggaaacgugaugaaga

SEQ ID NO: 356429 - RNA, 19 nt, Homo sapiens
ucucuuccaucaacagaau

SEQ ID NO: 356430 - RNA, 19 nt, Homo sapiens
ggucuuccuccagcaguua

SEQ ID NO: 356431 - RNA, 19 nt, Homo sapiens
gggaccacaucaagcuuca

SEQ ID NO: 356432 - RNA, 19 nt, Homo sapiens
cuaugaccgccacuaguua

SEQ ID NO: 356433 - RNA, 19 nt, Homo sapiens
ggcaucagagcacaucaaa

SEQ ID NO: 356434 - RNA, 19 nt, Homo sapiens
ggauccuacuccaucaaug

SEQ ID NO: 356435 - RNA, 19 nt, Homo sapiens
uguuggcucuuucucugua

SEQ ID NO: 356436 - RNA, 19 nt, Homo sapiens
gaaggcgaaacccggugua

SEQ ID NO: 356437 - RNA, 19 nt, Homo sapiens
ccucucggaugaccagguu

SEQ ID NO: 356438 - RNA, 19 nt, Homo sapiens
gcaggaccaguuuccauag

SEQ ID NO: 356439 - RNA, 19 nt, Homo sapiens
gaagagcccgcugccgaau

SEQ ID NO: 356440 - RNA, 19 nt, Homo sapiens
acagcuacacgcccauuaa

SEQ ID NO: 356441 - RNA, 19 nt, Homo sapiens
cgcaggaccaguuuccaua

SEQ ID NO: 356442 - RNA, 19 nt, Homo sapiens
ccaauggugagaagaggaa

SEQ ID NO: 356443 - RNA, 19 nt, Homo sapiens
ggcgaaacccgguguacau

SEQ ID NO: 356444 - RNA, 19 nt, Homo sapiens
ggaacaaaacaacacaaaa

SEQ ID NO: 356445 - RNA, 19 nt, Homo sapiens
gagcacaucaaaucagaac

SEQ ID NO: 356446 - RNA, 19 nt, Homo sapiens
uuacgaagaaagaaucuca

SEQ ID NO: 356447 - RNA, 19 nt, Homo sapiens
uuaauaugauggucuuugc

SEQ ID NO: 356448 - RNA, 19 nt, Homo sapiens
gccaaggagauuaagaaga

SEQ ID NO: 356449 - RNA, 19 nt, Homo sapiens
gcugggccaaggagauuaa

SEQ ID NO: 356450 - RNA, 19 nt, Homo sapiens
gggcugggccaaggagauu

SEQ ID NO: 356451 - RNA, 19 nt, Homo sapiens
ccuccuggccugccuaguu

SEQ ID NO: 356452 - RNA, 19 nt, Homo sapiens
cggcaggaacugaacagaa

SEQ ID NO: 356453 - RNA, 19 nt, Homo sapiens
cuccagcaguuacuugaug

SEQ ID NO: 356454 - RNA, 19 nt, Homo sapiens
gcaacccacuuccccuuau

SEQ ID NO: 356455 - RNA, 19 nt, Homo sapiens
caacucgccagcacuugga

SEQ ID NO: 356456 - RNA, 19 nt, Homo sapiens
acaacgaggcuuggagauu

SEQ ID NO: 356457 - RNA, 19 nt, Homo sapiens
agaaucauccggaccaaag

SEQ ID NO: 356458 - RNA, 19 nt, Homo sapiens
gcuacacgcccauuaaagc

SEQ ID NO: 356459 - RNA, 19 nt, Homo sapiens
uauguucgccugggagauu

SEQ ID NO: 356460 - RNA, 19 nt, Homo sapiens
cuccucaaguccugaaguu

SEQ ID NO: 356461 - RNA, 19 nt, Homo sapiens
ccagagugguguggacagu

SEQ ID NO: 356462 - RNA, 19 nt, Homo sapiens
cccagcgucucuuccauca

SEQ ID NO: 356463 - RNA, 19 nt, Homo sapiens
acaagauugcugaauacaa

SEQ ID NO: 356464 - RNA, 19 nt, Homo sapiens
auaugauggucuuugcaaa

SEQ ID NO: 356465 - RNA, 19 nt, Homo sapiens
guuggcucuuucucuguaa

SEQ ID NO: 356466 - RNA, 19 nt, Homo sapiens
ccgcaacccuucacaucac

SEQ ID NO: 356467 - RNA, 19 nt, Homo sapiens
cagcuucggccuccacauc

SEQ ID NO: 356468 - RNA, 19 nt, Homo sapiens
caacccacuuccccuuauu

SEQ ID NO: 356469 - RNA, 19 nt, Homo sapiens
ccacuggccagggaagcua

SEQ ID NO: 356470 - RNA, 19 nt, Homo sapiens
ucuuugagcguccuuccua

SEQ ID NO: 356471 - RNA, 19 nt, Homo sapiens
gggauccuacuccaucaau

SEQ ID NO: 356472 - RNA, 19 nt, Homo sapiens
ccaaggagauuaagaagaa

SEQ ID NO: 356473 - RNA, 19 nt, Homo sapiens
caagauugcugaauacaaa

SEQ ID NO: 356474 - RNA, 19 nt, Homo sapiens
gaggaaacgugaugaaguu

SEQ ID NO: 356475 - RNA, 19 nt, Homo sapiens
gaagucaagucgagucuau

SEQ ID NO: 356476 - RNA, 19 nt, Homo sapiens
guucugagcuggcgucuga

SEQ ID NO: 356477 - RNA, 19 nt, Homo sapiens
caucuggucuggacuuuaa

SEQ ID NO: 356478 - RNA, 19 nt, Homo sapiens
gaacugaacagaaccacaa

SEQ ID NO: 356479 - RNA, 19 nt, Homo sapiens
ggacaagauugcugaauac

SEQ ID NO: 356480 - RNA, 19 nt, Homo sapiens
gugaugaaguugagguaua

SEQ ID NO: 356481 - RNA, 19 nt, Homo sapiens
caacgaggcuuggagauuc

SEQ ID NO: 356482 - RNA, 19 nt, Homo sapiens
cgacagaacccgacuaugu

SEQ ID NO: 356483 - RNA, 19 nt, Homo sapiens
uggacaagauugcugaaua

SEQ ID NO: 356484 - RNA, 19 nt, Homo sapiens
ugacuccucuggccuguuu

SEQ ID NO: 356485 - RNA, 19 nt, Homo sapiens
caucagagcacaucaaauc

SEQ ID NO: 356486 - RNA, 19 nt, Homo sapiens
uagcgaacauggucuguga

SEQ ID NO: 356487 - RNA, 19 nt, Homo sapiens
ccaccaggcugcugcuuug

SEQ ID NO: 356488 - RNA, 19 nt, Homo sapiens
ggucuggacuuuaagagau

SEQ ID NO: 356489 - RNA, 19 nt, Homo sapiens
ccaaagugguggacaagau

SEQ ID NO: 356490 - RNA, 19 nt, Homo sapiens
cuacuucucugccaacuuc

SEQ ID NO: 356491 - RNA, 19 nt, Homo sapiens
caauggagauucccagagu

SEQ ID NO: 356492 - RNA, 19 nt, Homo sapiens
uagaggagguggagguuug

SEQ ID NO: 356493 - RNA, 19 nt, Homo sapiens
gaagaggaaacgugaugaa

SEQ ID NO: 356494 - RNA, 19 nt, Homo sapiens
gaaacgugaugaaguugag

SEQ ID NO: 356495 - RNA, 19 nt, Homo sapiens
gacagaacccgacuauguu

SEQ ID NO: 356496 - RNA, 19 nt, Homo sapiens
guccugaaguugaguuuga

SEQ ID NO: 356497 - RNA, 19 nt, Homo sapiens
gaaacccgguguacauaac

SEQ ID NO: 356498 - RNA, 19 nt, Homo sapiens
cagagcacaucaaaucaga

SEQ ID NO: 356499 - RNA, 19 nt, Homo sapiens
gagaagaggaaacgugaug

SEQ ID NO: 356500 - RNA, 19 nt, Homo sapiens
cgacacagacucucaaucu

SEQ ID NO: 356501 - RNA, 19 nt, Homo sapiens
ggugugcccugucccagaa

SEQ ID NO: 356502 - RNA, 19 nt, Homo sapiens
agagugguguggacaguuu

SEQ ID NO: 356503 - RNA, 19 nt, Homo sapiens
gagggcaucugugacaaug

SEQ ID NO: 356504 - RNA, 19 nt, Homo sapiens
caaagugguggacaagauu

SEQ ID NO: 356505 - RNA, 19 nt, Homo sapiens
gcgaaacccgguguacaua

SEQ ID NO: 356506 - RNA, 19 nt, Homo sapiens
gacggugugugucguguga

SEQ ID NO: 356507 - RNA, 19 nt, Homo sapiens
gaacaaaacaacacaaaag

SEQ ID NO: 356508 - RNA, 19 nt, Homo sapiens
ggaaacgugaugaaguuga

SEQ ID NO: 356509 - RNA, 19 nt, Homo sapiens
ggcaggaacugaacagaac

SEQ ID NO: 356510 - RNA, 19 nt, Homo sapiens
cgucaggucuuuccaaggu

SEQ ID NO: 356511 - RNA, 19 nt, Homo sapiens
cgaaacccgguguacauaa

SEQ ID NO: 356512 - RNA, 19 nt, Homo sapiens
gggccaaggagauuaagaa

SEQ ID NO: 356513 - RNA, 19 nt, Homo sapiens
caaggagauuaagaagaaa

SEQ ID NO: 356514 - RNA, 19 nt, Homo sapiens
ucucuguaauuccguguuu

SEQ ID NO: 356515 - RNA, 19 nt, Homo sapiens
aaguugagguauacacuga

SEQ ID NO: 356516 - RNA, 19 nt, Homo sapiens
gcacaucaaaucagaacag

SEQ ID NO: 356517 - RNA, 19 nt, Homo sapiens
cagcgucucuuccaucaac

SEQ ID NO: 356518 - RNA, 19 nt, Homo sapiens
cagcuacacgcccauuaaa

SEQ ID NO: 356519 - RNA, 19 nt, Homo sapiens
guggaaagacggugugugu

SEQ ID NO: 356520 - RNA, 19 nt, Homo sapiens
caggaccaguuuccauaga

SEQ ID NO: 356521 - RNA, 19 nt, Homo sapiens
ccuaugaccgccacuaguu

SEQ ID NO: 356522 - RNA, 19 nt, Homo sapiens
gggcaucugugacaaugac

SEQ ID NO: 356523 - RNA, 19 nt, Homo sapiens
ggaccaguuuccauagacu

SEQ ID NO: 356524 - RNA, 19 nt, Homo sapiens
ucucuuccaucaacagaau

SEQ ID NO: 356525 - RNA, 19 nt, Homo sapiens
ggucuuccuccagcaguua

SEQ ID NO: 356526 - RNA, 19 nt, Homo sapiens
gggaccacaucaagcuuca

SEQ ID NO: 356527 - RNA, 19 nt, Homo sapiens
cuaugaccgccacuaguua

SEQ ID NO: 356528 - RNA, 19 nt, Homo sapiens
ggcaucagagcacaucaaa

SEQ ID NO: 356529 - RNA, 19 nt, Homo sapiens
ggauccuacuccaucaaug

SEQ ID NO: 356530 - RNA, 19 nt, Homo sapiens
uguuggcucuuucucugua

SEQ ID NO: 356531 - RNA, 19 nt, Homo sapiens
gaaggcgaaacccggugua

SEQ ID NO: 356532 - RNA, 19 nt, Homo sapiens
ccucucggaugaccagguu

SEQ ID NO: 356533 - RNA, 19 nt, Homo sapiens
gcaggaccaguuuccauag

SEQ ID NO: 356534 - RNA, 19 nt, Homo sapiens
gaagagcccgcugccgaau

SEQ ID NO: 356535 - RNA, 19 nt, Homo sapiens
acagcuacacgcccauuaa

SEQ ID NO: 356536 - RNA, 19 nt, Homo sapiens
cgcaggaccaguuuccaua

SEQ ID NO: 356537 - RNA, 19 nt, Homo sapiens
ugaugaaguugagguauac

SEQ ID NO: 356538 - RNA, 19 nt, Homo sapiens
ccaauggugagaagaggaa

SEQ ID NO: 356539 - RNA, 19 nt, Homo sapiens
ggcgaaacccgguguacau

SEQ ID NO: 356540 - RNA, 19 nt, Homo sapiens
ggaacaaaacaacacaaaa

SEQ ID NO: 356541 - RNA, 19 nt, Homo sapiens
gagcacaucaaaucagaac

SEQ ID NO: 356542 - RNA, 19 nt, Homo sapiens
guugagguauacacugauc

SEQ ID NO: 356543 - RNA, 19 nt, Homo sapiens
uuacgaagaaagaaucuca

SEQ ID NO: 356544 - RNA, 19 nt, Homo sapiens
uuaauaugauggucuuugc

SEQ ID NO: 356545 - RNA, 19 nt, Homo sapiens
gccaaggagauuaagaaga

SEQ ID NO: 356546 - RNA, 19 nt, Homo sapiens
gcugggccaaggagauuaa

SEQ ID NO: 356547 - RNA, 19 nt, Homo sapiens
gggcugggccaaggagauu

SEQ ID NO: 356548 - RNA, 19 nt, Homo sapiens
gcaucuggucuggacuuua

SEQ ID NO: 356549 - RNA, 19 nt, Homo sapiens
ccuccuggccugccuaguu

SEQ ID NO: 356550 - RNA, 19 nt, Homo sapiens
cggcaggaacugaacagaa

SEQ ID NO: 356551 - RNA, 19 nt, Homo sapiens
cuccagcaguuacuugaug

SEQ ID NO: 356552 - RNA, 19 nt, Homo sapiens
caacucgccagcacuugga

SEQ ID NO: 356553 - RNA, 19 nt, Homo sapiens
acaacgaggcuuggagauu

SEQ ID NO: 356554 - RNA, 19 nt, Homo sapiens
acacugauccugcccacau

SEQ ID NO: 356555 - RNA, 19 nt, Homo sapiens
agaaucauccggaccaaag

SEQ ID NO: 356556 - RNA, 19 nt, Homo sapiens
gcuacacgcccauuaaagc

SEQ ID NO: 356557 - RNA, 19 nt, Homo sapiens
uauguucgccugggagauu

SEQ ID NO: 356558 - RNA, 19 nt, Homo sapiens
cuccucaaguccugaaguu

SEQ ID NO: 356559 - RNA, 19 nt, Homo sapiens
ccagagugguguggacagu

SEQ ID NO: 356560 - RNA, 19 nt, Homo sapiens
agaggaaacgugaugaagu

SEQ ID NO: 356561 - RNA, 19 nt, Homo sapiens
cccagcgucucuuccauca

SEQ ID NO: 356562 - RNA, 19 nt, Homo sapiens
acaagauugcugaauacaa

SEQ ID NO: 356563 - RNA, 19 nt, Homo sapiens
auaugauggucuuugcaaa

SEQ ID NO: 356564 - RNA, 19 nt, Homo sapiens
guuggcucuuucucuguaa

SEQ ID NO: 356565 - RNA, 19 nt, Homo sapiens
ccgcaacccuucacaucac

SEQ ID NO: 356566 - RNA, 19 nt, Homo sapiens
cagcuucggccuccacauc

SEQ ID NO: 356567 - RNA, 19 nt, Homo sapiens
ccacuggccagggaagcua

SEQ ID NO: 356568 - RNA, 19 nt, Homo sapiens
ucuuugagcguccuuccua

SEQ ID NO: 356569 - RNA, 19 nt, Homo sapiens
gauccugcccacauuagag

SEQ ID NO: 356570 - RNA, 19 nt, Homo sapiens
cacugauccugcccacauu

SEQ ID NO: 356571 - RNA, 19 nt, Homo sapiens
gggauccuacuccaucaau

SEQ ID NO: 356572 - RNA, 19 nt, Homo sapiens
ccaaggagauuaagaagaa

SEQ ID NO: 356573 - RNA, 19 nt, Homo sapiens
caagauugcugaauacaaa

SEQ ID NO: 356574 - RNA, 19 nt, Homo sapiens
gaagucaagucgagucuau

SEQ ID NO: 356575 - RNA, 19 nt, Homo sapiens
guucugagcuggcgucuga

SEQ ID NO: 356576 - RNA, 19 nt, Homo sapiens
gaggaaacgugaugaagau

SEQ ID NO: 356577 - RNA, 19 nt, Homo sapiens
gaacugaacagaaccacaa

SEQ ID NO: 356578 - RNA, 19 nt, Homo sapiens
ggacaagauugcugaauac

SEQ ID NO: 356579 - RNA, 19 nt, Homo sapiens
caacgaggcuuggagauuc

SEQ ID NO: 356580 - RNA, 19 nt, Homo sapiens
cgacagaacccgacuaugu

SEQ ID NO: 356581 - RNA, 19 nt, Homo sapiens
uggacaagauugcugaaua

SEQ ID NO: 356582 - RNA, 19 nt, Homo sapiens
gaaacgugaugaagaugug

SEQ ID NO: 356583 - RNA, 19 nt, Homo sapiens
ugacuccucuggccuguuu

SEQ ID NO: 356584 - RNA, 19 nt, Homo sapiens
caucagagcacaucaaauc

SEQ ID NO: 356585 - RNA, 19 nt, Homo sapiens
uagcgaacauggucuguga

SEQ ID NO: 356586 - RNA, 19 nt, Homo sapiens
ccaccaggcugcugcuuug

SEQ ID NO: 356587 - RNA, 19 nt, Homo sapiens
ccaaagugguggacaagau

SEQ ID NO: 356588 - RNA, 19 nt, Homo sapiens
cuacuucucugccaacuuc

SEQ ID NO: 356589 - RNA, 19 nt, Homo sapiens
caauggagauucccagagu

SEQ ID NO: 356590 - RNA, 19 nt, Homo sapiens
gaagaggaaacgugaugaa

SEQ ID NO: 356591 - RNA, 19 nt, Homo sapiens
gacagaacccgacuauguu

SEQ ID NO: 356592 - RNA, 19 nt, Homo sapiens
guccugaaguugaguuuga

SEQ ID NO: 356593 - RNA, 19 nt, Homo sapiens
gaaacccgguguacauaac

SEQ ID NO: 356594 - RNA, 19 nt, Homo sapiens
cagagcacaucaaaucaga

SEQ ID NO: 356595 - RNA, 19 nt, Homo sapiens
gagaagaggaaacgugaug

SEQ ID NO: 356596 - RNA, 19 nt, Homo sapiens
cgacacagacucucaaucu

SEQ ID NO: 356597 - RNA, 19 nt, Homo sapiens
ggugugcccugucccagaa

SEQ ID NO: 356598 - RNA, 19 nt, Homo sapiens
agagugguguggacaguuu

SEQ ID NO: 356599 - RNA, 19 nt, Homo sapiens
gagggcaucugugacaaug

SEQ ID NO: 356600 - RNA, 19 nt, Homo sapiens
caaagugguggacaagauu

SEQ ID NO: 356601 - RNA, 19 nt, Homo sapiens
gcgaaacccgguguacaua

SEQ ID NO: 356602 - RNA, 19 nt, Homo sapiens
gacggugugugucguguga

SEQ ID NO: 356603 - RNA, 19 nt, Homo sapiens
gaacaaaacaacacaaaag

SEQ ID NO: 356604 - RNA, 19 nt, Homo sapiens
ggcaggaacugaacagaac

SEQ ID NO: 356605 - RNA, 19 nt, Homo sapiens
cgucaggucuuuccaaggu

SEQ ID NO: 356606 - RNA, 19 nt, Homo sapiens
cgaaacccgguguacauaa

SEQ ID NO: 356607 - RNA, 19 nt, Homo sapiens
gggccaaggagauuaagaa

SEQ ID NO: 356608 - RNA, 19 nt, Homo sapiens
ggaaacgugaugaagaugu

SEQ ID NO: 356609 - RNA, 19 nt, Homo sapiens
caaggagauuaagaagaaa

SEQ ID NO: 356610 - RNA, 19 nt, Homo sapiens
ucucuguaauuccguguuu

SEQ ID NO: 356611 - RNA, 19 nt, Homo sapiens
gcacaucaaaucagaacag

SEQ ID NO: 356612 - RNA, 19 nt, Homo sapiens
cagcgucucuuccaucaac

SEQ ID NO: 356613 - RNA, 19 nt, Homo sapiens
cagcuacacgcccauuaaa

SEQ ID NO: 356614 - RNA, 19 nt, Homo sapiens
guggaaagacggugugugu

SEQ ID NO: 356615 - RNA, 19 nt, Homo sapiens
caggaccaguuuccauaga

SEQ ID NO: 356616 - RNA, 19 nt, Homo sapiens
ccuaugaccgccacuaguu

SEQ ID NO: 356617 - RNA, 19 nt, Homo sapiens
gugaugaagaugugucuga

SEQ ID NO: 356618 - RNA, 19 nt, Homo sapiens
gggcaucugugacaaugac

SEQ ID NO: 356619 - RNA, 19 nt, Homo sapiens
ggaccaguuuccauagacu

SEQ ID NO: 356620 - RNA, 19 nt, Homo sapiens
agaggaaacgugaugaaga

SEQ ID NO: 356621 - RNA, 19 nt, Homo sapiens
ucucuuccaucaacagaau

SEQ ID NO: 356622 - RNA, 19 nt, Homo sapiens
ggucuuccuccagcaguua

SEQ ID NO: 356623 - RNA, 19 nt, Homo sapiens
gggaccacaucaagcuuca

SEQ ID NO: 356624 - RNA, 19 nt, Homo sapiens
cuaugaccgccacuaguua

SEQ ID NO: 356625 - RNA, 19 nt, Homo sapiens
ggcaucagagcacaucaaa

SEQ ID NO: 356626 - RNA, 19 nt, Homo sapiens
ggauccuacuccaucaaug

SEQ ID NO: 356627 - RNA, 19 nt, Homo sapiens
uguuggcucuuucucugua

SEQ ID NO: 356628 - RNA, 19 nt, Homo sapiens
ccucucggaugaccagguu

SEQ ID NO: 356629 - RNA, 19 nt, Homo sapiens
gaaggcgaaacccggugua

SEQ ID NO: 356630 - RNA, 19 nt, Homo sapiens
gcaggaccaguuuccauag

SEQ ID NO: 356631 - RNA, 19 nt, Homo sapiens
gaagagcccgcugccgaau

SEQ ID NO: 356632 - RNA, 19 nt, Homo sapiens
acagcuacacgcccauuaa

SEQ ID NO: 356633 - RNA, 19 nt, Homo sapiens
cgcaggaccaguuuccaua

SEQ ID NO: 356634 - RNA, 19 nt, Homo sapiens
ccaauggugagaagaggaa

SEQ ID NO: 356635 - RNA, 19 nt, Homo sapiens
ggcgaaacccgguguacau

SEQ ID NO: 356636 - RNA, 19 nt, Homo sapiens
ggaacaaaacaacacaaaa

SEQ ID NO: 356637 - RNA, 19 nt, Homo sapiens
gagcacaucaaaucagaac

SEQ ID NO: 356638 - RNA, 19 nt, Homo sapiens
uuacgaagaaagaaucuca

SEQ ID NO: 356639 - RNA, 19 nt, Homo sapiens
uuaauaugauggucuuugc

SEQ ID NO: 356640 - RNA, 19 nt, Homo sapiens
gccaaggagauuaagaaga

SEQ ID NO: 356641 - RNA, 19 nt, Homo sapiens
gcugggccaaggagauuaa

SEQ ID NO: 356642 - RNA, 19 nt, Homo sapiens
gggcugggccaaggagauu

SEQ ID NO: 356643 - RNA, 19 nt, Homo sapiens
ccuccuggccugccuaguu

SEQ ID NO: 356644 - RNA, 19 nt, Homo sapiens
caacucgccagcacuugga

SEQ ID NO: 356645 - RNA, 19 nt, Homo sapiens
cggcaggaacugaacagaa

SEQ ID NO: 356646 - RNA, 19 nt, Homo sapiens
cuccagcaguuacuugaug

SEQ ID NO: 356647 - RNA, 19 nt, Homo sapiens
acaacgaggcuuggagauu

SEQ ID NO: 356648 - RNA, 19 nt, Homo sapiens
agaaucauccggaccaaag

SEQ ID NO: 356649 - RNA, 19 nt, Homo sapiens
gcuacacgcccauuaaagc

SEQ ID NO: 356650 - RNA, 19 nt, Homo sapiens
uauguucgccugggagauu

SEQ ID NO: 356651 - RNA, 19 nt, Homo sapiens
cuccucaaguccugaaguu

SEQ ID NO: 356652 - RNA, 19 nt, Homo sapiens
ccagagugguguggacagu

SEQ ID NO: 356653 - RNA, 19 nt, Homo sapiens
cccagcgucucuuccauca

SEQ ID NO: 356654 - RNA, 19 nt, Homo sapiens
auaugauggucuuugcaaa

SEQ ID NO: 356655 - RNA, 19 nt, Homo sapiens
acaagauugcugaauacaa

SEQ ID NO: 356656 - RNA, 19 nt, Homo sapiens
guuggcucuuucucuguaa

SEQ ID NO: 356657 - RNA, 19 nt, Homo sapiens
ccgcaacccuucacaucac

SEQ ID NO: 356658 - RNA, 19 nt, Homo sapiens
cagcuucggccuccacauc

SEQ ID NO: 356659 - RNA, 19 nt, Homo sapiens
ccacuggccagggaagcua

SEQ ID NO: 356660 - RNA, 19 nt, Homo sapiens
ucuuugagcguccuuccua

SEQ ID NO: 356661 - RNA, 19 nt, Homo sapiens
gggauccuacuccaucaau

SEQ ID NO: 356662 - RNA, 19 nt, Homo sapiens
ggaaauccgagacaaauua

SEQ ID NO: 356663 - RNA, 19 nt, Homo sapiens
cacauuggcugccuuauaa

SEQ ID NO: 356664 - RNA, 19 nt, Homo sapiens
ggaguuuccucgcauuaaa

SEQ ID NO: 356665 - RNA, 19 nt, Homo sapiens
gggcaucucugagcaauug

SEQ ID NO: 356666 - RNA, 19 nt, Homo sapiens
gggaagcucucacucuguu

SEQ ID NO: 356667 - RNA, 19 nt, Homo sapiens
gcacucgccuuuccguuuc

SEQ ID NO: 356668 - RNA, 19 nt, Homo sapiens
ccacauuggcugccuuaua

SEQ ID NO: 356669 - RNA, 19 nt, Homo sapiens
guaacgacauggaacugaa

SEQ ID NO: 356670 - RNA, 19 nt, Homo sapiens
gauagaggguacuugaauc

SEQ ID NO: 356671 - RNA, 19 nt, Homo sapiens
caacggcccuccaaaauug

SEQ ID NO: 356672 - RNA, 19 nt, Homo sapiens
gaauugugcucuguuguag

SEQ ID NO: 356673 - RNA, 19 nt, Homo sapiens
gaaacaccgugccgucagu

SEQ ID NO: 356674 - RNA, 19 nt, Homo sapiens
ggauagaggguacuugaau

SEQ ID NO: 356675 - RNA, 19 nt, Homo sapiens
gaaguaaauucgggaaagg

SEQ ID NO: 356676 - RNA, 19 nt, Homo sapiens
gagacaaauuacucaagga

SEQ ID NO: 356677 - RNA, 19 nt, Homo sapiens
aaauaugucuguguguuga

SEQ ID NO: 356678 - RNA, 19 nt, Homo sapiens
gaccagaggacacuaggaa

SEQ ID NO: 356679 - RNA, 19 nt, Homo sapiens
ugaauugugcucuguugua

SEQ ID NO: 356680 - RNA, 19 nt, Homo sapiens
ggaaggaggcagaggaaag

SEQ ID NO: 356681 - RNA, 19 nt, Homo sapiens
gcccuggucuccggaguuu

SEQ ID NO: 356682 - RNA, 19 nt, Homo sapiens
gagaagaaggccaaacaca

SEQ ID NO: 356683 - RNA, 19 nt, Homo sapiens
uaaauaugucuguguguug

SEQ ID NO: 356684 - RNA, 19 nt, Homo sapiens
ucaaggacgcggucuguga

SEQ ID NO: 356685 - RNA, 19 nt, Homo sapiens
gaagaaaauugaggaauac

SEQ ID NO: 356686 - RNA, 19 nt, Homo sapiens
ucacucuguugccauuaaa

SEQ ID NO: 356687 - RNA, 19 nt, Homo sapiens
gcgagaagaaggccaaaca

SEQ ID NO: 356688 - RNA, 19 nt, Homo sapiens
cgccugacguggagaagaa

SEQ ID NO: 356689 - RNA, 19 nt, Homo sapiens
gaggaaggaggcagaggaa

SEQ ID NO: 356690 - RNA, 19 nt, Homo sapiens
gggaaauccgagacaaauu

SEQ ID NO: 356691 - RNA, 19 nt, Homo sapiens
agaggguacuugaaucuuc

SEQ ID NO: 356692 - RNA, 19 nt, Homo sapiens
gcacuugcugggugacuug

SEQ ID NO: 356693 - RNA, 19 nt, Homo sapiens
cagaggaaagcgagaagaa

SEQ ID NO: 356694 - RNA, 19 nt, Homo sapiens
gagaaguaaauucgggaaa

SEQ ID NO: 356695 - RNA, 19 nt, Homo sapiens
gaaauccgagacaaauuac

SEQ ID NO: 356696 - RNA, 19 nt, Homo sapiens
agaaguaaauucgggaaag

SEQ ID NO: 356697 - RNA, 19 nt, Homo sapiens
gaggacacuaggaaucaaa

SEQ ID NO: 356698 - RNA, 19 nt, Homo sapiens
uaacgacauggaacugaaa

SEQ ID NO: 356699 - RNA, 19 nt, Homo sapiens
gccuucaccuggauauaau

SEQ ID NO: 356700 - RNA, 19 nt, Homo sapiens
gcaacggcccuccaaaauu

SEQ ID NO: 356701 - RNA, 19 nt, Homo sapiens
uaaaggagagagagaguac

SEQ ID NO: 356702 - RNA, 19 nt, Homo sapiens
gaaguugaaguagcuuuua

SEQ ID NO: 356703 - RNA, 19 nt, Homo sapiens
gaaagaccagaggacacua

SEQ ID NO: 356704 - RNA, 19 nt, Homo sapiens
ccacauccgccacaagauc

SEQ ID NO: 356705 - RNA, 19 nt, Homo sapiens
gcugggaaauccgagacaa

SEQ ID NO: 356706 - RNA, 19 nt, Homo sapiens
uuggcugccuuauaaauau

SEQ ID NO: 356707 - RNA, 19 nt, Homo sapiens
gcauuaaaggagagagaga

SEQ ID NO: 356708 - RNA, 19 nt, Homo sapiens
gcucuccacgcuccggaua

SEQ ID NO: 356709 - RNA, 19 nt, Homo sapiens
ugugaauugugcucuguug

SEQ ID NO: 356710 - RNA, 19 nt, Homo sapiens
ccagaggacacuaggaauc

SEQ ID NO: 356711 - RNA, 19 nt, Homo sapiens
uaaauucgggaaaggugaa

SEQ ID NO: 356712 - RNA, 19 nt, Homo sapiens
gcaucucugagcaauugua

SEQ ID NO: 356713 - RNA, 19 nt, Homo sapiens
cagaggacacuaggaauca

SEQ ID NO: 356714 - RNA, 19 nt, Homo sapiens
gcgccugaguaacgacaug

SEQ ID NO: 356715 - RNA, 19 nt, Homo sapiens
gcagaggaaagcgagaaga

SEQ ID NO: 356716 - RNA, 19 nt, Homo sapiens
cgccuucaccuggauauaa

SEQ ID NO: 356717 - RNA, 19 nt, Homo sapiens
gggauagaggguacuugaa

SEQ ID NO: 356718 - RNA, 19 nt, Homo sapiens
uagcugacauuggugaucu

SEQ ID NO: 356719 - RNA, 19 nt, Homo sapiens
gaaggaggcagaggaaagc

SEQ ID NO: 356720 - RNA, 19 nt, Homo sapiens
caaggacgcggucugugau

SEQ ID NO: 356721 - RNA, 19 nt, Homo sapiens
gacgcggucugugaucgaa

SEQ ID NO: 356722 - RNA, 19 nt, Homo sapiens
ugggauagaggguacuuga

SEQ ID NO: 356723 - RNA, 19 nt, Homo sapiens
acauuucuauucugcuuag

SEQ ID NO: 356724 - RNA, 19 nt, Homo sapiens
cucacucuguugccauuaa

SEQ ID NO: 356725 - RNA, 19 nt, Homo sapiens
ucggcuagcugacauuggu

SEQ ID NO: 356726 - RNA, 19 nt, Homo sapiens
uuaaaggagagagagagua

SEQ ID NO: 356727 - RNA, 19 nt, Homo sapiens
aaccacauccgccacaaga

SEQ ID NO: 356728 - RNA, 19 nt, Homo sapiens
caacgccugacguggagaa

SEQ ID NO: 356729 - RNA, 19 nt, Homo sapiens
gccgcauccugagaaguaa

SEQ ID NO: 356730 - RNA, 19 nt, Homo sapiens
agccgcauccugagaagua

SEQ ID NO: 356731 - RNA, 19 nt, Homo sapiens
cgcacucgccuuuccguuu

SEQ ID NO: 356732 - RNA, 19 nt, Homo sapiens
ccaaccacauccgccacaa

SEQ ID NO: 356733 - RNA, 19 nt, Homo sapiens
cuuucuuucuuaccacuuu

SEQ ID NO: 356734 - RNA, 19 nt, Homo sapiens
ggcaucggcuagcugacau

SEQ ID NO: 356735 - RNA, 19 nt, Homo sapiens
gggcaucggcuagcugaca

SEQ ID NO: 356736 - RNA, 19 nt, Homo sapiens
ggacgcggucugugaucga

SEQ ID NO: 356737 - RNA, 19 nt, Homo sapiens
ggaaauccgagacaaauua

SEQ ID NO: 356738 - RNA, 19 nt, Homo sapiens
cacauuggcugccuuauaa

SEQ ID NO: 356739 - RNA, 19 nt, Homo sapiens
ggaguuuccucgcauuaaa

SEQ ID NO: 356740 - RNA, 19 nt, Homo sapiens
gcacucgccuuuccguuuc

SEQ ID NO: 356741 - RNA, 19 nt, Homo sapiens
ccacauuggcugccuuaua

SEQ ID NO: 356742 - RNA, 19 nt, Homo sapiens
caacggcccuccaaaauug

SEQ ID NO: 356743 - RNA, 19 nt, Homo sapiens
gaaacaccgugccgucagu

SEQ ID NO: 356744 - RNA, 19 nt, Homo sapiens
gaaguaaauucgggaaagg

SEQ ID NO: 356745 - RNA, 19 nt, Homo sapiens
gagacaaauuacucaagga

SEQ ID NO: 356746 - RNA, 19 nt, Homo sapiens
aaauaugucuguguguuga

SEQ ID NO: 356747 - RNA, 19 nt, Homo sapiens
ggaaggaggcagaggaaag

SEQ ID NO: 356748 - RNA, 19 nt, Homo sapiens
gcccuggucuccggaguuu

SEQ ID NO: 356749 - RNA, 19 nt, Homo sapiens
gagaagaaggccaaacaca

SEQ ID NO: 356750 - RNA, 19 nt, Homo sapiens
uaaauaugucuguguguug

SEQ ID NO: 356751 - RNA, 19 nt, Homo sapiens
ucaaggacgcggucuguga

SEQ ID NO: 356752 - RNA, 19 nt, Homo sapiens
gaagaaaauugaggaauac

SEQ ID NO: 356753 - RNA, 19 nt, Homo sapiens
gcgagaagaaggccaaaca

SEQ ID NO: 356754 - RNA, 19 nt, Homo sapiens
cgccugacguggagaagaa

SEQ ID NO: 356755 - RNA, 19 nt, Homo sapiens
gaggaaggaggcagaggaa

SEQ ID NO: 356756 - RNA, 19 nt, Homo sapiens
gggaaauccgagacaaauu

SEQ ID NO: 356757 - RNA, 19 nt, Homo sapiens
cagaggaaagcgagaagaa

SEQ ID NO: 356758 - RNA, 19 nt, Homo sapiens
gagaaguaaauucgggaaa

SEQ ID NO: 356759 - RNA, 19 nt, Homo sapiens
gaaauccgagacaaauuac

SEQ ID NO: 356760 - RNA, 19 nt, Homo sapiens
agaaguaaauucgggaaag

SEQ ID NO: 356761 - RNA, 19 nt, Homo sapiens
gccuucaccuggauauaau

SEQ ID NO: 356762 - RNA, 19 nt, Homo sapiens
gcaacggcccuccaaaauu

SEQ ID NO: 356763 - RNA, 19 nt, Homo sapiens
uaaaggagagagagaguac

SEQ ID NO: 356764 - RNA, 19 nt, Homo sapiens
gcugggaaauccgagacaa

SEQ ID NO: 356765 - RNA, 19 nt, Homo sapiens
ccacauccgccacaagauc

SEQ ID NO: 356766 - RNA, 19 nt, Homo sapiens
uuggcugccuuauaaauau

SEQ ID NO: 356767 - RNA, 19 nt, Homo sapiens
gcauuaaaggagagagaga

SEQ ID NO: 356768 - RNA, 19 nt, Homo sapiens
gcucuccacgcuccggaua

SEQ ID NO: 356769 - RNA, 19 nt, Homo sapiens
uaaauucgggaaaggugaa

SEQ ID NO: 356770 - RNA, 19 nt, Homo sapiens
gcagaggaaagcgagaaga

SEQ ID NO: 356771 - RNA, 19 nt, Homo sapiens
gaaggaggcagaggaaagc

SEQ ID NO: 356772 - RNA, 19 nt, Homo sapiens
caaggacgcggucugugau

SEQ ID NO: 356773 - RNA, 19 nt, Homo sapiens
cgccuucaccuggauauaa

SEQ ID NO: 356774 - RNA, 19 nt, Homo sapiens
gacgcggucugugaucgaa

SEQ ID NO: 356775 - RNA, 19 nt, Homo sapiens
uuaaaggagagagagagua

SEQ ID NO: 356776 - RNA, 19 nt, Homo sapiens
aaccacauccgccacaaga

SEQ ID NO: 356777 - RNA, 19 nt, Homo sapiens
gccgcauccugagaaguaa

SEQ ID NO: 356778 - RNA, 19 nt, Homo sapiens
agccgcauccugagaagua

SEQ ID NO: 356779 - RNA, 19 nt, Homo sapiens
caacgccugacguggagaa

SEQ ID NO: 356780 - RNA, 19 nt, Homo sapiens
cgcacucgccuuuccguuu

SEQ ID NO: 356781 - RNA, 19 nt, Homo sapiens
ccaaccacauccgccacaa

SEQ ID NO: 356782 - RNA, 19 nt, Homo sapiens
ggacgcggucugugaucga

SEQ ID NO: 356783 - RNA, 19 nt, Homo sapiens
ggaaggagauggcauagag

SEQ ID NO: 356784 - RNA, 19 nt, Homo sapiens
caauuugcccuaucauuua

SEQ ID NO: 356785 - RNA, 19 nt, Homo sapiens
caauuuaccuacucuaugu

SEQ ID NO: 356786 - RNA, 19 nt, Homo sapiens
caucuaaucuaugcaugua

SEQ ID NO: 356787 - RNA, 19 nt, Homo sapiens
cuauguaucuaccaucuaa

SEQ ID NO: 356788 - RNA, 19 nt, Homo sapiens
cagaggcacuggagaaaga

SEQ ID NO: 356789 - RNA, 19 nt, Homo sapiens
gcaagauccuagggcguua

SEQ ID NO: 356790 - RNA, 19 nt, Homo sapiens
gaaauccaacgccagcuuu

SEQ ID NO: 356791 - RNA, 19 nt, Homo sapiens
guaugcaucuauaugugua

SEQ ID NO: 356792 - RNA, 19 nt, Homo sapiens
acaauuugcccuaucauuu

SEQ ID NO: 356793 - RNA, 19 nt, Homo sapiens
guaguucuguuguccauca

SEQ ID NO: 356794 - RNA, 19 nt, Homo sapiens
ggacugcuuugccuuccuu

SEQ ID NO: 356795 - RNA, 19 nt, Homo sapiens
gagaggugguguguggaua

SEQ ID NO: 356796 - RNA, 19 nt, Homo sapiens
caacagaagagccaaaugg

SEQ ID NO: 356797 - RNA, 19 nt, Homo sapiens
ucacggauccuuaagguau

SEQ ID NO: 356798 - RNA, 19 nt, Homo sapiens
gagauggcauagagaagau

SEQ ID NO: 356799 - RNA, 19 nt, Homo sapiens
ggagauggcauagagaaga

SEQ ID NO: 356800 - RNA, 19 nt, Homo sapiens
ugucauagcagcaaacaga

SEQ ID NO: 356801 - RNA, 19 nt, Homo sapiens
acacacacacacauugaua

SEQ ID NO: 356802 - RNA, 19 nt, Homo sapiens
ccagggaucagcagcauga

SEQ ID NO: 356803 - RNA, 19 nt, Homo sapiens
gagaagcucaagugggaaa

SEQ ID NO: 356804 - RNA, 19 nt, Homo sapiens
caauguauuugucaaugca

SEQ ID NO: 356805 - RNA, 19 nt, Homo sapiens
ucuaaucuaugcauguaug

SEQ ID NO: 356806 - RNA, 19 nt, Homo sapiens
uagacaauuugcccuauca

SEQ ID NO: 356807 - RNA, 19 nt, Homo sapiens
ggaaauccaacgccagcuu

SEQ ID NO: 356808 - RNA, 19 nt, Homo sapiens
gacaauuugcccuaucauu

SEQ ID NO: 356809 - RNA, 19 nt, Homo sapiens
gcacacacacacacacaca

SEQ ID NO: 356810 - RNA, 19 nt, Homo sapiens
ggcaagagaagcucaagug

SEQ ID NO: 356811 - RNA, 19 nt, Homo sapiens
ggccuccacucagcaguaa

SEQ ID NO: 356812 - RNA, 19 nt, Homo sapiens
ccaaauggcgucggcaaga

SEQ ID NO: 356813 - RNA, 19 nt, Homo sapiens
guaucuaccaucuaaucua

SEQ ID NO: 356814 - RNA, 19 nt, Homo sapiens
ccacucagcaguaauaaaa

SEQ ID NO: 356815 - RNA, 19 nt, Homo sapiens
cagcaaacagagugaaaug

SEQ ID NO: 356816 - RNA, 19 nt, Homo sapiens
acacacacacauugauauu

SEQ ID NO: 356817 - RNA, 19 nt, Homo sapiens
gaaggagauggcauagaga

SEQ ID NO: 356818 - RNA, 19 nt, Homo sapiens
cacacacacauugauauua

SEQ ID NO: 356819 - RNA, 19 nt, Homo sapiens
uaugcccacucuaauauuc

SEQ ID NO: 356820 - RNA, 19 nt, Homo sapiens
ccuccacucagcaguaaua

SEQ ID NO: 356821 - RNA, 19 nt, Homo sapiens
caaauggcgucggcaagag

SEQ ID NO: 356822 - RNA, 19 nt, Homo sapiens
ccacucuaauauucaacaa

SEQ ID NO: 356823 - RNA, 19 nt, Homo sapiens
ccuaugcccacucuaauau

SEQ ID NO: 356824 - RNA, 19 nt, Homo sapiens
gugggaaggagauggcaua

SEQ ID NO: 356825 - RNA, 19 nt, Homo sapiens
acacacacacacacauuga

SEQ ID NO: 356826 - RNA, 19 nt, Homo sapiens
caaugcaucaauuuaccua

SEQ ID NO: 356827 - RNA, 19 nt, Homo sapiens
cccagugucuccuccauca

SEQ ID NO: 356828 - RNA, 19 nt, Homo sapiens
gcagcaaacagagugaaau

SEQ ID NO: 356829 - RNA, 19 nt, Homo sapiens
acacacacacacacacauu

SEQ ID NO: 356830 - RNA, 19 nt, Homo sapiens
ucaauuuaccuacucuaug

SEQ ID NO: 356831 - RNA, 19 nt, Homo sapiens
gcccuaucauuuauuuaca

SEQ ID NO: 356832 - RNA, 19 nt, Homo sapiens
cuuaagaggccuccacuca

SEQ ID NO: 356833 - RNA, 19 nt, Homo sapiens
gcucaggucaccagcuguu

SEQ ID NO: 356834 - RNA, 19 nt, Homo sapiens
guucuguuguccaucaugu

SEQ ID NO: 356835 - RNA, 19 nt, Homo sapiens
ggaaucggacuaucuucuc

SEQ ID NO: 356836 - RNA, 19 nt, Homo sapiens
gauccuagggcguuacuac

SEQ ID NO: 356837 - RNA, 19 nt, Homo sapiens
aagcagaggcacuggagaa

SEQ ID NO: 356838 - RNA, 19 nt, Homo sapiens
gacaucucacggauccuua

SEQ ID NO: 356839 - RNA, 19 nt, Homo sapiens
gcaucaauuuaccuacucu

SEQ ID NO: 356840 - RNA, 19 nt, Homo sapiens
ucucacggauccuuaaggu

SEQ ID NO: 356841 - RNA, 19 nt, Homo sapiens
ggagaggugguguguggau

SEQ ID NO: 356842 - RNA, 19 nt, Homo sapiens
ggcaacagcaccagaaagg

SEQ ID NO: 356843 - RNA, 19 nt, Homo sapiens
cucuauguaugcaucuaua

SEQ ID NO: 356844 - RNA, 19 nt, Homo sapiens
gaagcucaagugggaaaug

SEQ ID NO: 356845 - RNA, 19 nt, Homo sapiens
ccaccuaaagccugucuca

SEQ ID NO: 356846 - RNA, 19 nt, Homo sapiens
ucuguuguccaucauguuu

SEQ ID NO: 356847 - RNA, 19 nt, Homo sapiens
uagcaguaguucuguuguc

SEQ ID NO: 356848 - RNA, 19 nt, Homo sapiens
gaagaucuaauaccauccu

SEQ ID NO: 356849 - RNA, 19 nt, Homo sapiens
agccagcucucaaagaaag

SEQ ID NO: 356850 - RNA, 19 nt, Homo sapiens
cccuaugcccacucuaaua

SEQ ID NO: 356851 - RNA, 19 nt, Homo sapiens
cgugggcaguauccugauu

SEQ ID NO: 356852 - RNA, 19 nt, Homo sapiens
gauacccggcagcagauug

SEQ ID NO: 356853 - RNA, 19 nt, Homo sapiens
aauaccauccugcccauug

SEQ ID NO: 356854 - RNA, 19 nt, Homo sapiens
gcagaggcacuggagaaag

SEQ ID NO: 356855 - RNA, 19 nt, Homo sapiens
ugaguguccagcccucuuu

SEQ ID NO: 356856 - RNA, 19 nt, Homo sapiens
gcuagcagucaguggaaug

SEQ ID NO: 356857 - RNA, 19 nt, Homo sapiens
caguaguucuguuguccau

SEQ ID NO: 356858 - RNA, 19 nt, Homo sapiens
uauuagcaguaguucuguu

SEQ ID NO: 356859 - RNA, 19 nt, Homo sapiens
gcccagggaucagcagcau

SEQ ID NO: 356860 - RNA, 19 nt, Homo sapiens
aaggagauggcauagagaa

SEQ ID NO: 356861 - RNA, 19 nt, Homo sapiens
gcaggagugggaaggagau

SEQ ID NO: 356862 - RNA, 19 nt, Homo sapiens
guaaauaccuucuugcuuu

SEQ ID NO: 356863 - RNA, 19 nt, Homo sapiens
gcucaucccuccuucuuua

SEQ ID NO: 356864 - RNA, 19 nt, Homo sapiens
gcgagaagcucuuuaguuc

SEQ ID NO: 356865 - RNA, 19 nt, Homo sapiens
gcggaaggcuugaauuauu

SEQ ID NO: 356866 - RNA, 19 nt, Homo sapiens
gaucaaagaacucaaagaa

SEQ ID NO: 356867 - RNA, 19 nt, Homo sapiens
gugaggagcugcuguguga

SEQ ID NO: 356868 - RNA, 19 nt, Homo sapiens
gagcggaaggcuugaauua

SEQ ID NO: 356869 - RNA, 19 nt, Homo sapiens
caagagagacgaagguauu

SEQ ID NO: 356870 - RNA, 19 nt, Homo sapiens
gaagcucuuuaguuccuua

SEQ ID NO: 356871 - RNA, 19 nt, Homo sapiens
gacuauccauccaucauaa

SEQ ID NO: 356872 - RNA, 19 nt, Homo sapiens
ccaauagacuguccugcaa

SEQ ID NO: 356873 - RNA, 19 nt, Homo sapiens
caccugaggcccaauaaua

SEQ ID NO: 356874 - RNA, 19 nt, Homo sapiens
ggccuuaauuccuugcaua

SEQ ID NO: 356875 - RNA, 19 nt, Homo sapiens
ucuggaugcuugucuauuu

SEQ ID NO: 356876 - RNA, 19 nt, Homo sapiens
ggagauuccucagcuacuu

SEQ ID NO: 356877 - RNA, 19 nt, Homo sapiens
gcacuacucagacaucuuc

SEQ ID NO: 356878 - RNA, 19 nt, Homo sapiens
gcagcagggucaucuguag

SEQ ID NO: 356879 - RNA, 19 nt, Homo sapiens
ccggugauguagacaauaa

SEQ ID NO: 356880 - RNA, 19 nt, Homo sapiens
guagagcccuuguccaaac

SEQ ID NO: 356881 - RNA, 19 nt, Homo sapiens
caggugccaucaucucuuu

SEQ ID NO: 356882 - RNA, 19 nt, Homo sapiens
gagcuguccucaagaugga

SEQ ID NO: 356883 - RNA, 19 nt, Homo sapiens
ccauguaaauaccuucuug

SEQ ID NO: 356884 - RNA, 19 nt, Homo sapiens
gagaagcucuuuaguuccu

SEQ ID NO: 356885 - RNA, 19 nt, Homo sapiens
ggagagggagcuuggagaa

SEQ ID NO: 356886 - RNA, 19 nt, Homo sapiens
cagaaugucauccgaggua

SEQ ID NO: 356887 - RNA, 19 nt, Homo sapiens
cagcagcacccauguaaau

SEQ ID NO: 356888 - RNA, 19 nt, Homo sapiens
gcaaaauucuuggcaggua

SEQ ID NO: 356889 - RNA, 19 nt, Homo sapiens
gcacccauguaaauaccuu

SEQ ID NO: 356890 - RNA, 19 nt, Homo sapiens
uagacuguccugcaaauaa

SEQ ID NO: 356891 - RNA, 19 nt, Homo sapiens
gagcagaccacagaguauu

SEQ ID NO: 356892 - RNA, 19 nt, Homo sapiens
ccaacaagcgcaagagaga

SEQ ID NO: 356893 - RNA, 19 nt, Homo sapiens
aaacacugauggcaccuau

SEQ ID NO: 356894 - RNA, 19 nt, Homo sapiens
gcucuuuaguuccuuaauc

SEQ ID NO: 356895 - RNA, 19 nt, Homo sapiens
caucccuccuucuuuagua

SEQ ID NO: 356896 - RNA, 19 nt, Homo sapiens
ucagagcuguccucaagau

SEQ ID NO: 356897 - RNA, 19 nt, Homo sapiens
uaguggaacuugcucauca

SEQ ID NO: 356898 - RNA, 19 nt, Homo sapiens
gcagagagagacuggacuu

SEQ ID NO: 356899 - RNA, 19 nt, Homo sapiens
ugacuauccauccaucaua

SEQ ID NO: 356900 - RNA, 19 nt, Homo sapiens
ccagaucaaagaacucaaa

SEQ ID NO: 356901 - RNA, 19 nt, Homo sapiens
gagcgggugugugacaaug

SEQ ID NO: 356902 - RNA, 19 nt, Homo sapiens
uggcagagcggguguguga

SEQ ID NO: 356903 - RNA, 19 nt, Homo sapiens
guccaaaccugggcugaau

SEQ ID NO: 356904 - RNA, 19 nt, Homo sapiens
ggcgagaagcucuuuaguu

SEQ ID NO: 356905 - RNA, 19 nt, Homo sapiens
ggaugcuugucuauuucua

SEQ ID NO: 356906 - RNA, 19 nt, Homo sapiens
gcaagagagacgaagguau

SEQ ID NO: 356907 - RNA, 19 nt, Homo sapiens
gagauuccucagcuacuuu

SEQ ID NO: 356908 - RNA, 19 nt, Homo sapiens
ggacaucuuagaccuaugg

SEQ ID NO: 356909 - RNA, 19 nt, Homo sapiens
ggaaggagagcuugcuuuu

SEQ ID NO: 356910 - RNA, 19 nt, Homo sapiens
acacugauggcaccuauug

SEQ ID NO: 356911 - RNA, 19 nt, Homo sapiens
gggcuuggccuucuuaggu

SEQ ID NO: 356912 - RNA, 19 nt, Homo sapiens
ccaaaccugggcugaauga

SEQ ID NO: 356913 - RNA, 19 nt, Homo sapiens
gcaagccuguuccggugau

SEQ ID NO: 356914 - RNA, 19 nt, Homo sapiens
gaauauaaacgccaaaauc

SEQ ID NO: 356915 - RNA, 19 nt, Homo sapiens
ggugauguagacaauaauu

SEQ ID NO: 356916 - RNA, 19 nt, Homo sapiens
cauccgagguauugauuac

SEQ ID NO: 356917 - RNA, 19 nt, Homo sapiens
gggaaggagagcuugcuuu

SEQ ID NO: 356918 - RNA, 19 nt, Homo sapiens
gccacugggucucugcaaa

SEQ ID NO: 356919 - RNA, 19 nt, Homo sapiens
ggacauggaggagugaauc

SEQ ID NO: 356920 - RNA, 19 nt, Homo sapiens
gcagagcgggugugugaca

SEQ ID NO: 356921 - RNA, 19 nt, Homo sapiens
gaaugucauccgagguauu

SEQ ID NO: 356922 - RNA, 19 nt, Homo sapiens
ccaagaggagcacacuuug

SEQ ID NO: 356923 - RNA, 19 nt, Homo sapiens
aauagacuguccugcaaau

SEQ ID NO: 356924 - RNA, 19 nt, Homo sapiens
gaugcuugucuauuucuaa

SEQ ID NO: 356925 - RNA, 19 nt, Homo sapiens
ugcauagucucucuuguca

SEQ ID NO: 356926 - RNA, 19 nt, Homo sapiens
cuacagccacccucaguau

SEQ ID NO: 356927 - RNA, 19 nt, Homo sapiens
ucaguuccaucaacaggau

SEQ ID NO: 356928 - RNA, 19 nt, Homo sapiens
uggcagguauuaugagaca

SEQ ID NO: 356929 - RNA, 19 nt, Homo sapiens
gaccaagugggaaacaaga

SEQ ID NO: 356930 - RNA, 19 nt, Homo sapiens
cuuaauuccuugcauaguc

SEQ ID NO: 356931 - RNA, 19 nt, Homo sapiens
uccaagaggagcacacuuu

SEQ ID NO: 356932 - RNA, 19 nt, Homo sapiens
ucuaaaagccaaucuauga

SEQ ID NO: 356933 - RNA, 19 nt, Homo sapiens
ccgagcagaccacagagua

SEQ ID NO: 356934 - RNA, 19 nt, Homo sapiens
caucaagccugggguaauu

SEQ ID NO: 356935 - RNA, 19 nt, Homo sapiens
gcccuccacuuccaagcaa

SEQ ID NO: 356936 - RNA, 19 nt, Homo sapiens
uugauuacauuguggacuu

SEQ ID NO: 356937 - RNA, 19 nt, Homo sapiens
ugggaccgaugcaguauca

SEQ ID NO: 356938 - RNA, 19 nt, Homo sapiens
ccggacaucuuagaccuau

SEQ ID NO: 356939 - RNA, 19 nt, Homo sapiens
gcagcacccauguaaauac

SEQ ID NO: 356940 - RNA, 19 nt, Homo sapiens
aaggagagcuugcuuuugu

SEQ ID NO: 356941 - RNA, 19 nt, Homo sapiens
caauagacuguccugcaaa

SEQ ID NO: 356942 - RNA, 19 nt, Homo sapiens
aaaggucgccacacccaaa

SEQ ID NO: 356943 - RNA, 19 nt, Homo sapiens
ggaccaagugggaaacaag

SEQ ID NO: 356944 - RNA, 19 nt, Homo sapiens
gugcaucaccggacaucuu

SEQ ID NO: 356945 - RNA, 19 nt, Homo sapiens
uagcccaacuucccuugug

SEQ ID NO: 356946 - RNA, 19 nt, Homo sapiens
caccugccauggacacuuc

SEQ ID NO: 356947 - RNA, 19 nt, Homo sapiens
ugauuacauuguggacuuu

SEQ ID NO: 356948 - RNA, 19 nt, Homo sapiens
gguagagcccuuguccaaa

SEQ ID NO: 356949 - RNA, 19 nt, Homo sapiens
agagggagcuuggagaacu

SEQ ID NO: 356950 - RNA, 19 nt, Homo sapiens
ccgagguauugauuacauu

SEQ ID NO: 356951 - RNA, 19 nt, Homo sapiens
ugcaucaccggacaucuua

SEQ ID NO: 356952 - RNA, 19 nt, Homo sapiens
ggugcuggaccgcguguuu

SEQ ID NO: 356953 - RNA, 19 nt, Homo sapiens
ggagcggaaggcuugaauu

SEQ ID NO: 356954 - RNA, 19 nt, Homo sapiens
aacaggacaugaucucaca

SEQ ID NO: 356955 - RNA, 19 nt, Homo sapiens
ggugccaggugccaucauc

SEQ ID NO: 356956 - RNA, 19 nt, Homo sapiens
ugaugcaucucgcacucuu

SEQ ID NO: 356957 - RNA, 19 nt, Homo sapiens
gcagaccacagaguauuca

SEQ ID NO: 356958 - RNA, 19 nt, Homo sapiens
aaucagaagagccuggaaa

SEQ ID NO: 356959 - RNA, 19 nt, Homo sapiens
gaacuuggagagggagcuu

SEQ ID NO: 356960 - RNA, 19 nt, Homo sapiens
gaagguccgacugagaaga

SEQ ID NO: 356961 - RNA, 19 nt, Homo sapiens
agacuguccugcaaauaac

SEQ ID NO: 356962 - RNA, 19 nt, Homo sapiens
ggacagacauccgagauuu

SEQ ID NO: 356963 - RNA, 19 nt, Homo sapiens
caacacaccuagucauauu

SEQ ID NO: 356964 - RNA, 19 nt, Homo sapiens
gaacauccuuuacccaaga

SEQ ID NO: 356965 - RNA, 19 nt, Homo sapiens
cagaaaggaugccucauaa

SEQ ID NO: 356966 - RNA, 19 nt, Homo sapiens
caaauaaccugccuaugca

SEQ ID NO: 356967 - RNA, 19 nt, Homo sapiens
gcaaauaaccugccuaugc

SEQ ID NO: 356968 - RNA, 19 nt, Homo sapiens
ccaagcgugucaucaauaa

SEQ ID NO: 356969 - RNA, 19 nt, Homo sapiens
gcagaagauuguagagcua

SEQ ID NO: 356970 - RNA, 19 nt, Homo sapiens
gaaaggaugccucauaaag

SEQ ID NO: 356971 - RNA, 19 nt, Homo sapiens
ggagaaagaguuugagaga

SEQ ID NO: 356972 - RNA, 19 nt, Homo sapiens
caaaauagaucuaccugaa

SEQ ID NO: 356973 - RNA, 19 nt, Homo sapiens
ccagaaaggaugccucaua

SEQ ID NO: 356974 - RNA, 19 nt, Homo sapiens
caacggaugugugaguaaa

SEQ ID NO: 356975 - RNA, 19 nt, Homo sapiens
gaagugaaccugauauguc

SEQ ID NO: 356976 - RNA, 19 nt, Homo sapiens
gagaaagaguuugagagaa

SEQ ID NO: 356977 - RNA, 19 nt, Homo sapiens
gcagaugugugaggccuuu

SEQ ID NO: 356978 - RNA, 19 nt, Homo sapiens
ggcaaucggugguaguaaa

SEQ ID NO: 356979 - RNA, 19 nt, Homo sapiens
aaacaaaacucuugacaga

SEQ ID NO: 356980 - RNA, 19 nt, Homo sapiens
aaccugauaugucucaaua

SEQ ID NO: 356981 - RNA, 19 nt, Homo sapiens
gcauaggaaucugagaauu

SEQ ID NO: 356982 - RNA, 19 nt, Homo sapiens
gagaauaccaacuccauca

SEQ ID NO: 356983 - RNA, 19 nt, Homo sapiens
ggagugcccguccaucuuu

SEQ ID NO: 356984 - RNA, 19 nt, Homo sapiens
agacacacaugaacaguca

SEQ ID NO: 356985 - RNA, 19 nt, Homo sapiens
ucaauacuggccaagauua

SEQ ID NO: 356986 - RNA, 19 nt, Homo sapiens
gagaacccauuauccagau

SEQ ID NO: 356987 - RNA, 19 nt, Homo sapiens
gauaaacuaaggauguuga

SEQ ID NO: 356988 - RNA, 19 nt, Homo sapiens
ccacaccgguuuccuccuu

SEQ ID NO: 356989 - RNA, 19 nt, Homo sapiens
agaaagaguuugagagaac

SEQ ID NO: 356990 - RNA, 19 nt, Homo sapiens
uaacauaccaagcguguca

SEQ ID NO: 356991 - RNA, 19 nt, Homo sapiens
ucagcucgguggugucuuu

SEQ ID NO: 356992 - RNA, 19 nt, Homo sapiens
gcuucaccauggcaaauaa

SEQ ID NO: 356993 - RNA, 19 nt, Homo sapiens
gaaauagaacauccuuuac

SEQ ID NO: 356994 - RNA, 19 nt, Homo sapiens
cauaggaaucugagaauug

SEQ ID NO: 356995 - RNA, 19 nt, Homo sapiens
gcaacacaccuagucauau

SEQ ID NO: 356996 - RNA, 19 nt, Homo sapiens
gcacacacacauuaacaca

SEQ ID NO: 356997 - RNA, 19 nt, Homo sapiens
ggaagugaaccugauaugu

SEQ ID NO: 356998 - RNA, 19 nt, Homo sapiens
uaacacacuugagccauca

SEQ ID NO: 356999 - RNA, 19 nt, Homo sapiens
agcggaagcugcaaagaaa

SEQ ID NO: 357000 - RNA, 19 nt, Homo sapiens
gcaaaauagcccaguauaa

SEQ ID NO: 357001 - RNA, 19 nt, Homo sapiens
ggucaggcuucgcuaaugg

SEQ ID NO: 357002 - RNA, 19 nt, Homo sapiens
cggaagcugcaaagaaaua

SEQ ID NO: 357003 - RNA, 19 nt, Homo sapiens
ugaaugggcggaguuauga

SEQ ID NO: 357004 - RNA, 19 nt, Homo sapiens
caucuuugcuugggaaauc

SEQ ID NO: 357005 - RNA, 19 nt, Homo sapiens
gguaguaaaccgagaguag

SEQ ID NO: 357006 - RNA, 19 nt, Homo sapiens
agaucuaccugaagcaaga

SEQ ID NO: 357007 - RNA, 19 nt, Homo sapiens
ccagccagaccuccucaua

SEQ ID NO: 357008 - RNA, 19 nt, Homo sapiens
caaauggagaagagaagaa

SEQ ID NO: 357009 - RNA, 19 nt, Homo sapiens
cagcauaggaaucugagaa

SEQ ID NO: 357010 - RNA, 19 nt, Homo sapiens
gggcagguauuacgagacu

SEQ ID NO: 357011 - RNA, 19 nt, Homo sapiens
gugcgacauuucccgaauu

SEQ ID NO: 357012 - RNA, 19 nt, Homo sapiens
acacacacauuaacacacu

SEQ ID NO: 357013 - RNA, 19 nt, Homo sapiens
gagagaauaccaacuccau

SEQ ID NO: 357014 - RNA, 19 nt, Homo sapiens
uccagaaguuguaagcaaa

SEQ ID NO: 357015 - RNA, 19 nt, Homo sapiens
ucucaauacuggccaagau

SEQ ID NO: 357016 - RNA, 19 nt, Homo sapiens
ccacauaugcagacacaca

SEQ ID NO: 357017 - RNA, 19 nt, Homo sapiens
ucaauaaacagaguucuuc

SEQ ID NO: 357018 - RNA, 19 nt, Homo sapiens
guaaaauucugggcaggua

SEQ ID NO: 357019 - RNA, 19 nt, Homo sapiens
gcaacaacagcagcacaaa

SEQ ID NO: 357020 - RNA, 19 nt, Homo sapiens
gugaaugggcggaguuaug

SEQ ID NO: 357021 - RNA, 19 nt, Homo sapiens
ucaccaaucagcauaggaa

SEQ ID NO: 357022 - RNA, 19 nt, Homo sapiens
uaccaagcgugucaucaau

SEQ ID NO: 357023 - RNA, 19 nt, Homo sapiens
gcagguguccaacggaugu

SEQ ID NO: 357024 - RNA, 19 nt, Homo sapiens
acacagcccucacaaacac

SEQ ID NO: 357025 - RNA, 19 nt, Homo sapiens
cagcaccagugucuaccaa

SEQ ID NO: 357026 - RNA, 19 nt, Homo sapiens
uugaggcccuggagaaaga

SEQ ID NO: 357027 - RNA, 19 nt, Homo sapiens
ccugauaugucucaauacu

SEQ ID NO: 357028 - RNA, 19 nt, Homo sapiens
gaaccugauaugucucaau

SEQ ID NO: 357029 - RNA, 19 nt, Homo sapiens
aaauugaggcccuggagaa

SEQ ID NO: 357030 - RNA, 19 nt, Homo sapiens
caaaauagcccaguauaag

SEQ ID NO: 357031 - RNA, 19 nt, Homo sapiens
caccagcaacuccuuuaaa

SEQ ID NO: 357032 - RNA, 19 nt, Homo sapiens
gaagcugugacaaccagaa

SEQ ID NO: 357033 - RNA, 19 nt, Homo sapiens
gaauaccaacuccaucagu

SEQ ID NO: 357034 - RNA, 19 nt, Homo sapiens
caugaacagucagccaaug

SEQ ID NO: 357035 - RNA, 19 nt, Homo sapiens
agacacagcccucacaaac

SEQ ID NO: 357036 - RNA, 19 nt, Homo sapiens
cuugagccaucaccaauca

SEQ ID NO: 357037 - RNA, 19 nt, Homo sapiens
gaacccauuauccagaugu

SEQ ID NO: 357038 - RNA, 19 nt, Homo sapiens
ugagagaacccauuaucca

SEQ ID NO: 357039 - RNA, 19 nt, Homo sapiens
cuccagaaguuguaagcaa

SEQ ID NO: 357040 - RNA, 19 nt, Homo sapiens
aguagcgacuccagaaguu

SEQ ID NO: 357041 - RNA, 19 nt, Homo sapiens
caacauccguggagaaaac

SEQ ID NO: 357042 - RNA, 19 nt, Homo sapiens
ccuaucagcaguaguuuca

SEQ ID NO: 357043 - RNA, 19 nt, Homo sapiens
aagcggaagcugcaaagaa

SEQ ID NO: 357044 - RNA, 19 nt, Homo sapiens
ccaaucagcauaggaaucu

SEQ ID NO: 357045 - RNA, 19 nt, Homo sapiens
aagugaaccugauaugucu

SEQ ID NO: 357046 - RNA, 19 nt, Homo sapiens
cgacauuucccgaauucug

SEQ ID NO: 357047 - RNA, 19 nt, Homo sapiens
gcucgguggugucuuuguc

SEQ ID NO: 357048 - RNA, 19 nt, Homo sapiens
cauaugcagacacacauga

SEQ ID NO: 357049 - RNA, 19 nt, Homo sapiens
gaagcugcaaagaaauaga

SEQ ID NO: 357050 - RNA, 19 nt, Homo sapiens
agaaaacucucaccagcaa

SEQ ID NO: 357051 - RNA, 19 nt, Homo sapiens
gaggucaggcuucgcuaau

SEQ ID NO: 357052 - RNA, 19 nt, Homo sapiens
gacacagcccucacaaaca

SEQ ID NO: 357053 - RNA, 19 nt, Homo sapiens
ugaagcaagaauacaggua

SEQ ID NO: 357054 - RNA, 19 nt, Homo sapiens
agaaagacuagcagccaaa

SEQ ID NO: 357055 - RNA, 19 nt, Homo sapiens
ccauuauccagauguguuu

SEQ ID NO: 357056 - RNA, 19 nt, Homo sapiens
ugucaucaauaaacagagu

SEQ ID NO: 357057 - RNA, 19 nt, Homo sapiens
gggagugcccguccaucuu

SEQ ID NO: 357058 - RNA, 19 nt, Homo sapiens
gagccagcaugcagaacag

SEQ ID NO: 357059 - RNA, 19 nt, Homo sapiens
acaaaacucuugacagaag

SEQ ID NO: 357060 - RNA, 19 nt, Homo sapiens
gccaucaccaaucagcaua

SEQ ID NO: 357061 - RNA, 19 nt, Homo sapiens
cgaagggccaaauggagaa

SEQ ID NO: 357062 - RNA, 19 nt, Homo sapiens
ggacagacauccgagauuu

SEQ ID NO: 357063 - RNA, 19 nt, Homo sapiens
caacacaccuagucauauu

SEQ ID NO: 357064 - RNA, 19 nt, Homo sapiens
gaacauccuuuacccaaga

SEQ ID NO: 357065 - RNA, 19 nt, Homo sapiens
cagaaaggaugccucauaa

SEQ ID NO: 357066 - RNA, 19 nt, Homo sapiens
caaauaaccugccuaugca

SEQ ID NO: 357067 - RNA, 19 nt, Homo sapiens
gcaaauaaccugccuaugc

SEQ ID NO: 357068 - RNA, 19 nt, Homo sapiens
ccaagcgugucaucaauaa

SEQ ID NO: 357069 - RNA, 19 nt, Homo sapiens
gcagaagauuguagagcua

SEQ ID NO: 357070 - RNA, 19 nt, Homo sapiens
gaaaggaugccucauaaag

SEQ ID NO: 357071 - RNA, 19 nt, Homo sapiens
ggagaaagaguuugagaga

SEQ ID NO: 357072 - RNA, 19 nt, Homo sapiens
caaaauagaucuaccugaa

SEQ ID NO: 357073 - RNA, 19 nt, Homo sapiens
ccagaaaggaugccucaua

SEQ ID NO: 357074 - RNA, 19 nt, Homo sapiens
caacggaugugugaguaaa

SEQ ID NO: 357075 - RNA, 19 nt, Homo sapiens
gaagugaaccugauauguc

SEQ ID NO: 357076 - RNA, 19 nt, Homo sapiens
gagaaagaguuugagagaa

SEQ ID NO: 357077 - RNA, 19 nt, Homo sapiens
gcagaugugugaggccuuu

SEQ ID NO: 357078 - RNA, 19 nt, Homo sapiens
ggcaaucggugguaguaaa

SEQ ID NO: 357079 - RNA, 19 nt, Homo sapiens
aaacaaaacucuugacaga

SEQ ID NO: 357080 - RNA, 19 nt, Homo sapiens
aaccugauaugucucaaua

SEQ ID NO: 357081 - RNA, 19 nt, Homo sapiens
gcauaggaaucugagaauu

SEQ ID NO: 357082 - RNA, 19 nt, Homo sapiens
gagaauaccaacuccauca

SEQ ID NO: 357083 - RNA, 19 nt, Homo sapiens
ggagugcccguccaucuuu

SEQ ID NO: 357084 - RNA, 19 nt, Homo sapiens
agacacacaugaacaguca

SEQ ID NO: 357085 - RNA, 19 nt, Homo sapiens
ucaauacuggccaagauua

SEQ ID NO: 357086 - RNA, 19 nt, Homo sapiens
gagaacccauuauccagau

SEQ ID NO: 357087 - RNA, 19 nt, Homo sapiens
gauaaacuaaggauguuga

SEQ ID NO: 357088 - RNA, 19 nt, Homo sapiens
ccacaccgguuuccuccuu

SEQ ID NO: 357089 - RNA, 19 nt, Homo sapiens
agaaagaguuugagagaac

SEQ ID NO: 357090 - RNA, 19 nt, Homo sapiens
uaacauaccaagcguguca

SEQ ID NO: 357091 - RNA, 19 nt, Homo sapiens
ucagcucgguggugucuuu

SEQ ID NO: 357092 - RNA, 19 nt, Homo sapiens
gcuucaccauggcaaauaa

SEQ ID NO: 357093 - RNA, 19 nt, Homo sapiens
gaaauagaacauccuuuac

SEQ ID NO: 357094 - RNA, 19 nt, Homo sapiens
cauaggaaucugagaauug

SEQ ID NO: 357095 - RNA, 19 nt, Homo sapiens
gcaacacaccuagucauau

SEQ ID NO: 357096 - RNA, 19 nt, Homo sapiens
gcacacacacauuaacaca

SEQ ID NO: 357097 - RNA, 19 nt, Homo sapiens
ggaagugaaccugauaugu

SEQ ID NO: 357098 - RNA, 19 nt, Homo sapiens
uaacacacuugagccauca

SEQ ID NO: 357099 - RNA, 19 nt, Homo sapiens
agcggaagcugcaaagaaa

SEQ ID NO: 357100 - RNA, 19 nt, Homo sapiens
gcaaaauagcccaguauaa

SEQ ID NO: 357101 - RNA, 19 nt, Homo sapiens
ggucaggcuucgcuaaugg

SEQ ID NO: 357102 - RNA, 19 nt, Homo sapiens
cggaagcugcaaagaaaua

SEQ ID NO: 357103 - RNA, 19 nt, Homo sapiens
ugaaugggcggaguuauga

SEQ ID NO: 357104 - RNA, 19 nt, Homo sapiens
caucuuugcuugggaaauc

SEQ ID NO: 357105 - RNA, 19 nt, Homo sapiens
gguaguaaaccgagaguag

SEQ ID NO: 357106 - RNA, 19 nt, Homo sapiens
agaucuaccugaagcaaga

SEQ ID NO: 357107 - RNA, 19 nt, Homo sapiens
ccagccagaccuccucaua

SEQ ID NO: 357108 - RNA, 19 nt, Homo sapiens
caaauggagaagagaagaa

SEQ ID NO: 357109 - RNA, 19 nt, Homo sapiens
cagcauaggaaucugagaa

SEQ ID NO: 357110 - RNA, 19 nt, Homo sapiens
gggcagguauuacgagacu

SEQ ID NO: 357111 - RNA, 19 nt, Homo sapiens
gugcgacauuucccgaauu

SEQ ID NO: 357112 - RNA, 19 nt, Homo sapiens
acacacacauuaacacacu

SEQ ID NO: 357113 - RNA, 19 nt, Homo sapiens
gagagaauaccaacuccau

SEQ ID NO: 357114 - RNA, 19 nt, Homo sapiens
uccagaaguuguaagcaaa

SEQ ID NO: 357115 - RNA, 19 nt, Homo sapiens
ucucaauacuggccaagau

SEQ ID NO: 357116 - RNA, 19 nt, Homo sapiens
ccacauaugcagacacaca

SEQ ID NO: 357117 - RNA, 19 nt, Homo sapiens
ucaauaaacagaguucuuc

SEQ ID NO: 357118 - RNA, 19 nt, Homo sapiens
guaaaauucugggcaggua

SEQ ID NO: 357119 - RNA, 19 nt, Homo sapiens
gcaacaacagcagcacaaa

SEQ ID NO: 357120 - RNA, 19 nt, Homo sapiens
gugaaugggcggaguuaug

SEQ ID NO: 357121 - RNA, 19 nt, Homo sapiens
ucaccaaucagcauaggaa

SEQ ID NO: 357122 - RNA, 19 nt, Homo sapiens
uaccaagcgugucaucaau

SEQ ID NO: 357123 - RNA, 19 nt, Homo sapiens
acacagcccucacaaacac

SEQ ID NO: 357124 - RNA, 19 nt, Homo sapiens
cagcaccagugucuaccaa

SEQ ID NO: 357125 - RNA, 19 nt, Homo sapiens
uugaggcccuggagaaaga

SEQ ID NO: 357126 - RNA, 19 nt, Homo sapiens
ccugauaugucucaauacu

SEQ ID NO: 357127 - RNA, 19 nt, Homo sapiens
gaaccugauaugucucaau

SEQ ID NO: 357128 - RNA, 19 nt, Homo sapiens
aaauugaggcccuggagaa

SEQ ID NO: 357129 - RNA, 19 nt, Homo sapiens
caaaauagcccaguauaag

SEQ ID NO: 357130 - RNA, 19 nt, Homo sapiens
caccagcaacuccuuuaaa

SEQ ID NO: 357131 - RNA, 19 nt, Homo sapiens
gaagcugugacaaccagaa

SEQ ID NO: 357132 - RNA, 19 nt, Homo sapiens
gaauaccaacuccaucagu

SEQ ID NO: 357133 - RNA, 19 nt, Homo sapiens
caugaacagucagccaaug

SEQ ID NO: 357134 - RNA, 19 nt, Homo sapiens
agacacagcccucacaaac

SEQ ID NO: 357135 - RNA, 19 nt, Homo sapiens
cuugagccaucaccaauca

SEQ ID NO: 357136 - RNA, 19 nt, Homo sapiens
gaacccauuauccagaugu

SEQ ID NO: 357137 - RNA, 19 nt, Homo sapiens
ugagagaacccauuaucca

SEQ ID NO: 357138 - RNA, 19 nt, Homo sapiens
cuccagaaguuguaagcaa

SEQ ID NO: 357139 - RNA, 19 nt, Homo sapiens
aguagcgacuccagaaguu

SEQ ID NO: 357140 - RNA, 19 nt, Homo sapiens
caacauccguggagaaaac

SEQ ID NO: 357141 - RNA, 19 nt, Homo sapiens
ccuaucagcaguaguuuca

SEQ ID NO: 357142 - RNA, 19 nt, Homo sapiens
aagcggaagcugcaaagaa

SEQ ID NO: 357143 - RNA, 19 nt, Homo sapiens
ccaaucagcauaggaaucu

SEQ ID NO: 357144 - RNA, 19 nt, Homo sapiens
aagugaaccugauaugucu

SEQ ID NO: 357145 - RNA, 19 nt, Homo sapiens
aaacguguccaacggaugu

SEQ ID NO: 357146 - RNA, 19 nt, Homo sapiens
cgacauuucccgaauucug

SEQ ID NO: 357147 - RNA, 19 nt, Homo sapiens
gcucgguggugucuuuguc

SEQ ID NO: 357148 - RNA, 19 nt, Homo sapiens
cauaugcagacacacauga

SEQ ID NO: 357149 - RNA, 19 nt, Homo sapiens
gaagcugcaaagaaauaga

SEQ ID NO: 357150 - RNA, 19 nt, Homo sapiens
caagugcuggacaaucaaa

SEQ ID NO: 357151 - RNA, 19 nt, Homo sapiens
agaaaacucucaccagcaa

SEQ ID NO: 357152 - RNA, 19 nt, Homo sapiens
gaggucaggcuucgcuaau

SEQ ID NO: 357153 - RNA, 19 nt, Homo sapiens
gacacagcccucacaaaca

SEQ ID NO: 357154 - RNA, 19 nt, Homo sapiens
ugaagcaagaauacaggua

SEQ ID NO: 357155 - RNA, 19 nt, Homo sapiens
agaaagacuagcagccaaa

SEQ ID NO: 357156 - RNA, 19 nt, Homo sapiens
ccauuauccagauguguuu

SEQ ID NO: 357157 - RNA, 19 nt, Homo sapiens
ugucaucaauaaacagagu

SEQ ID NO: 357158 - RNA, 19 nt, Homo sapiens
gggagugcccguccaucuu

SEQ ID NO: 357159 - RNA, 19 nt, Homo sapiens
gagccagcaugcagaacag

SEQ ID NO: 357160 - RNA, 19 nt, Homo sapiens
acaaaacucuugacagaag

SEQ ID NO: 357161 - RNA, 19 nt, Homo sapiens
gccaucaccaaucagcaua

SEQ ID NO: 357162 - RNA, 19 nt, Homo sapiens
gugcaggucugguucagua

SEQ ID NO: 357163 - RNA, 19 nt, Homo sapiens
cgaagaagacggaaagaaa

SEQ ID NO: 357164 - RNA, 19 nt, Homo sapiens
gaaccugaccucccacuga

SEQ ID NO: 357165 - RNA, 19 nt, Homo sapiens
ccacauccgccacaagaua

SEQ ID NO: 357166 - RNA, 19 nt, Homo sapiens
gaaucaaguucgggaagaa

SEQ ID NO: 357167 - RNA, 19 nt, Homo sapiens
gaagaagacggaaagaaag

SEQ ID NO: 357168 - RNA, 19 nt, Homo sapiens
gggacaggcugcugaagga

SEQ ID NO: 357169 - RNA, 19 nt, Homo sapiens
gagagcgagagaauaaaua

SEQ ID NO: 357170 - RNA, 19 nt, Homo sapiens
gaaagaaggcguggagaag

SEQ ID NO: 357171 - RNA, 19 nt, Homo sapiens
gaaauccacuccgcagucu

SEQ ID NO: 357172 - RNA, 19 nt, Homo sapiens
agaaagaggaggaggauga

SEQ ID NO: 357173 - RNA, 19 nt, Homo sapiens
gagcgagagaauaaauaua

SEQ ID NO: 357174 - RNA, 19 nt, Homo sapiens
ucugacagcuucaugaauc

SEQ ID NO: 357175 - RNA, 19 nt, Homo sapiens
gaaagaggaggaggaugaa

SEQ ID NO: 357176 - RNA, 19 nt, Homo sapiens
gaagaaagaggaggaggau

SEQ ID NO: 357177 - RNA, 19 nt, Homo sapiens
auacacagcacaaauauca

SEQ ID NO: 357178 - RNA, 19 nt, Homo sapiens
ggagggagaagagguuaaa

SEQ ID NO: 357179 - RNA, 19 nt, Homo sapiens
ccagccagauggaacaguu

SEQ ID NO: 357180 - RNA, 19 nt, Homo sapiens
gaagacggaaagaaagaga

SEQ ID NO: 357181 - RNA, 19 nt, Homo sapiens
uacuauggcuccaacagaa

SEQ ID NO: 357182 - RNA, 19 nt, Homo sapiens
ggaugaagcggacaagaag

SEQ ID NO: 357183 - RNA, 19 nt, Homo sapiens
gagcgagagcgagagaaua

SEQ ID NO: 357184 - RNA, 19 nt, Homo sapiens
ccaccaccaucucccaaga

SEQ ID NO: 357185 - RNA, 19 nt, Homo sapiens
ggaggggucuucaucaaug

SEQ ID NO: 357186 - RNA, 19 nt, Homo sapiens
acacagcacaaauaucaaa

SEQ ID NO: 357187 - RNA, 19 nt, Homo sapiens
guacuauggcuccaacaga

SEQ ID NO: 357188 - RNA, 19 nt, Homo sapiens
gcugaaggaugggcacugu

SEQ ID NO: 357189 - RNA, 19 nt, Homo sapiens
gguuuagugaguucgauua

SEQ ID NO: 357190 - RNA, 19 nt, Homo sapiens
ugaaggaugggcacuguga

SEQ ID NO: 357191 - RNA, 19 nt, Homo sapiens
uaaauacgagaacgaaauc

SEQ ID NO: 357192 - RNA, 19 nt, Homo sapiens
gacccacuacccagacaua

SEQ ID NO: 357193 - RNA, 19 nt, Homo sapiens
ggagcgagagcgagagaau

SEQ ID NO: 357194 - RNA, 19 nt, Homo sapiens
ccacuacccagacauauac

SEQ ID NO: 357195 - RNA, 19 nt, Homo sapiens
aaccugaccucccacugaa

SEQ ID NO: 357196 - RNA, 19 nt, Homo sapiens
gaaaagaaggccaaacaca

SEQ ID NO: 357197 - RNA, 19 nt, Homo sapiens
agaaagaaggcguggagaa

SEQ ID NO: 357198 - RNA, 19 nt, Homo sapiens
gagcggacgggaagcgauu

SEQ ID NO: 357199 - RNA, 19 nt, Homo sapiens
ggguuggaguguuuguuug

SEQ ID NO: 357200 - RNA, 19 nt, Homo sapiens
ggacaucuccuggcuaagc

SEQ ID NO: 357201 - RNA, 19 nt, Homo sapiens
cgagagcgagagaauaaau

SEQ ID NO: 357202 - RNA, 19 nt, Homo sapiens
agaaucaaguucgggaaga

SEQ ID NO: 357203 - RNA, 19 nt, Homo sapiens
gguggcgacuccggaugua

SEQ ID NO: 357204 - RNA, 19 nt, Homo sapiens
caucagcccgcacaacuuc

SEQ ID NO: 357205 - RNA, 19 nt, Homo sapiens
cgagugugguccggagaaa

SEQ ID NO: 357206 - RNA, 19 nt, Homo sapiens
aaagaaggcguggagaaga

SEQ ID NO: 357207 - RNA, 19 nt, Homo sapiens
gcuuguuuauggagagcua

SEQ ID NO: 357208 - RNA, 19 nt, Homo sapiens
uuggaguguuuguuuguuu

SEQ ID NO: 357209 - RNA, 19 nt, Homo sapiens
ggaaaacccaggcauguuc

SEQ ID NO: 357210 - RNA, 19 nt, Homo sapiens
gacuccggauguagagaaa

SEQ ID NO: 357211 - RNA, 19 nt, Homo sapiens
gcaucagcccgcacaacuu

SEQ ID NO: 357212 - RNA, 19 nt, Homo sapiens
agcgagagcgagagaauaa

SEQ ID NO: 357213 - RNA, 19 nt, Homo sapiens
aagaaggcguggagaagag

SEQ ID NO: 357214 - RNA, 19 nt, Homo sapiens
uggaguguuuguuuguuug

SEQ ID NO: 357215 - RNA, 19 nt, Homo sapiens
ggaguguuuguuuguuuga

SEQ ID NO: 357216 - RNA, 19 nt, Homo sapiens
aagaagacggaaagaaaga

SEQ ID NO: 357217 - RNA, 19 nt, Homo sapiens
gaguguuuguuuguuugaa

SEQ ID NO: 357218 - RNA, 19 nt, Homo sapiens
cccacuacccagacauaua

SEQ ID NO: 357219 - RNA, 19 nt, Homo sapiens
guuggaguguuuguuuguu

SEQ ID NO: 357220 - RNA, 19 nt, Homo sapiens
gccaguacggccagaguga

SEQ ID NO: 357221 - RNA, 19 nt, Homo sapiens
gcagaggaccaagcugaca

SEQ ID NO: 357222 - RNA, 19 nt, Homo sapiens
cgacuccggauguagagaa

SEQ ID NO: 357223 - RNA, 19 nt, Homo sapiens
agagcgagagaauaaauau

SEQ ID NO: 357224 - RNA, 19 nt, Homo sapiens
caggcugacuucuccaucu

SEQ ID NO: 357225 - RNA, 19 nt, Homo sapiens
cacugugcccucagguuua

SEQ ID NO: 357226 - RNA, 19 nt, Homo sapiens
agacgaagaagacggaaag

SEQ ID NO: 357227 - RNA, 19 nt, Homo sapiens
aggaugaagcggacaagaa

SEQ ID NO: 357228 - RNA, 19 nt, Homo sapiens
gaggaguacaagagggaaa

SEQ ID NO: 357229 - RNA, 19 nt, Homo sapiens
gcacgguaccgagaaugau

SEQ ID NO: 357230 - RNA, 19 nt, Homo sapiens
ggcacgguaccgagaauga

SEQ ID NO: 357231 - RNA, 19 nt, Homo sapiens
ggucagcaacggccugucu

SEQ ID NO: 357232 - RNA, 19 nt, Homo sapiens
aaccacauccgccacaaga

SEQ ID NO: 357233 - RNA, 19 nt, Homo sapiens
agccucugcuuccguacua

SEQ ID NO: 357234 - RNA, 19 nt, Homo sapiens
gcgaaaagaaggccaaaca

SEQ ID NO: 357235 - RNA, 19 nt, Homo sapiens
ucaaguucgggaagaaaga

SEQ ID NO: 357236 - RNA, 19 nt, Homo sapiens
ggcugcgucuccaagauuc

SEQ ID NO: 357237 - RNA, 19 nt, Homo sapiens
gugcaggucugguucagua

SEQ ID NO: 357238 - RNA, 19 nt, Homo sapiens
cgaagaagacggaaagaaa

SEQ ID NO: 357239 - RNA, 19 nt, Homo sapiens
gaaccugaccucccacuga

SEQ ID NO: 357240 - RNA, 19 nt, Homo sapiens
ccacauccgccacaagaua

SEQ ID NO: 357241 - RNA, 19 nt, Homo sapiens
gaaucaaguucgggaagaa

SEQ ID NO: 357242 - RNA, 19 nt, Homo sapiens
gaagaagacggaaagaaag

SEQ ID NO: 357243 - RNA, 19 nt, Homo sapiens
gggacaggcugcugaagga

SEQ ID NO: 357244 - RNA, 19 nt, Homo sapiens
gagagcgagagaauaaaua

SEQ ID NO: 357245 - RNA, 19 nt, Homo sapiens
gaaagaaggcguggagaag

SEQ ID NO: 357246 - RNA, 19 nt, Homo sapiens
gaaauccacuccgcagucu

SEQ ID NO: 357247 - RNA, 19 nt, Homo sapiens
agaaagaggaggaggauga

SEQ ID NO: 357248 - RNA, 19 nt, Homo sapiens
gagcgagagaauaaauaua

SEQ ID NO: 357249 - RNA, 19 nt, Homo sapiens
ucugacagcuucaugaauc

SEQ ID NO: 357250 - RNA, 19 nt, Homo sapiens
gaaagaggaggaggaugaa

SEQ ID NO: 357251 - RNA, 19 nt, Homo sapiens
gaagaaagaggaggaggau

SEQ ID NO: 357252 - RNA, 19 nt, Homo sapiens
auacacagcacaaauauca

SEQ ID NO: 357253 - RNA, 19 nt, Homo sapiens
ggagggagaagagguuaaa

SEQ ID NO: 357254 - RNA, 19 nt, Homo sapiens
ccagccagauggaacaguu

SEQ ID NO: 357255 - RNA, 19 nt, Homo sapiens
gaagacggaaagaaagaga

SEQ ID NO: 357256 - RNA, 19 nt, Homo sapiens
uacuauggcuccaacagaa

SEQ ID NO: 357257 - RNA, 19 nt, Homo sapiens
ggaugaagcggacaagaag

SEQ ID NO: 357258 - RNA, 19 nt, Homo sapiens
gagcgagagcgagagaaua

SEQ ID NO: 357259 - RNA, 19 nt, Homo sapiens
ccaccaccaucucccaaga

SEQ ID NO: 357260 - RNA, 19 nt, Homo sapiens
ggaggggucuucaucaaug

SEQ ID NO: 357261 - RNA, 19 nt, Homo sapiens
guacuauggcuccaacaga

SEQ ID NO: 357262 - RNA, 19 nt, Homo sapiens
gcugaaggaugggcacugu

SEQ ID NO: 357263 - RNA, 19 nt, Homo sapiens
ugaaggaugggcacuguga

SEQ ID NO: 357264 - RNA, 19 nt, Homo sapiens
uaaauacgagaacgaaauc

SEQ ID NO: 357265 - RNA, 19 nt, Homo sapiens
gacccacuacccagacaua

SEQ ID NO: 357266 - RNA, 19 nt, Homo sapiens
ggagcgagagcgagagaau

SEQ ID NO: 357267 - RNA, 19 nt, Homo sapiens
ccacuacccagacauauac

SEQ ID NO: 357268 - RNA, 19 nt, Homo sapiens
aaccugaccucccacugaa

SEQ ID NO: 357269 - RNA, 19 nt, Homo sapiens
gaaaagaaggccaaacaca

SEQ ID NO: 357270 - RNA, 19 nt, Homo sapiens
agaaagaaggcguggagaa

SEQ ID NO: 357271 - RNA, 19 nt, Homo sapiens
gagcggacgggaagcgauu

SEQ ID NO: 357272 - RNA, 19 nt, Homo sapiens
ggguuggaguguuuguuug

SEQ ID NO: 357273 - RNA, 19 nt, Homo sapiens
ggacaucuccuggcuaagc

SEQ ID NO: 357274 - RNA, 19 nt, Homo sapiens
cgagagcgagagaauaaau

SEQ ID NO: 357275 - RNA, 19 nt, Homo sapiens
agaaucaaguucgggaaga

SEQ ID NO: 357276 - RNA, 19 nt, Homo sapiens
gguggcgacuccggaugua

SEQ ID NO: 357277 - RNA, 19 nt, Homo sapiens
caucagcccgcacaacuuc

SEQ ID NO: 357278 - RNA, 19 nt, Homo sapiens
cgagugugguccggagaaa

SEQ ID NO: 357279 - RNA, 19 nt, Homo sapiens
aaagaaggcguggagaaga

SEQ ID NO: 357280 - RNA, 19 nt, Homo sapiens
gcuuguuuauggagagcua

SEQ ID NO: 357281 - RNA, 19 nt, Homo sapiens
uuggaguguuuguuuguuu

SEQ ID NO: 357282 - RNA, 19 nt, Homo sapiens
ggaaaacccaggcauguuc

SEQ ID NO: 357283 - RNA, 19 nt, Homo sapiens
gacuccggauguagagaaa

SEQ ID NO: 357284 - RNA, 19 nt, Homo sapiens
agcgagagcgagagaauaa

SEQ ID NO: 357285 - RNA, 19 nt, Homo sapiens
uggaguguuuguuuguuug

SEQ ID NO: 357286 - RNA, 19 nt, Homo sapiens
ggaguguuuguuuguuuga

SEQ ID NO: 357287 - RNA, 19 nt, Homo sapiens
aagaaggcguggagaagag

SEQ ID NO: 357288 - RNA, 19 nt, Homo sapiens
gcaucagcccgcacaacuu

SEQ ID NO: 357289 - RNA, 19 nt, Homo sapiens
aagaagacggaaagaaaga

SEQ ID NO: 357290 - RNA, 19 nt, Homo sapiens
gaguguuuguuuguuugaa

SEQ ID NO: 357291 - RNA, 19 nt, Homo sapiens
cccacuacccagacauaua

SEQ ID NO: 357292 - RNA, 19 nt, Homo sapiens
gccaguacggccagaguga

SEQ ID NO: 357293 - RNA, 19 nt, Homo sapiens
gcagaggaccaagcugaca

SEQ ID NO: 357294 - RNA, 19 nt, Homo sapiens
guuggaguguuuguuuguu

SEQ ID NO: 357295 - RNA, 19 nt, Homo sapiens
cgacuccggauguagagaa

SEQ ID NO: 357296 - RNA, 19 nt, Homo sapiens
agagcgagagaauaaauau

SEQ ID NO: 357297 - RNA, 19 nt, Homo sapiens
caggcugacuucuccaucu

SEQ ID NO: 357298 - RNA, 19 nt, Homo sapiens
agacgaagaagacggaaag

SEQ ID NO: 357299 - RNA, 19 nt, Homo sapiens
aggaugaagcggacaagaa

SEQ ID NO: 357300 - RNA, 19 nt, Homo sapiens
gaggaguacaagagggaaa

SEQ ID NO: 357301 - RNA, 19 nt, Homo sapiens
gcacgguaccgagaaugau

SEQ ID NO: 357302 - RNA, 19 nt, Homo sapiens
ggcacgguaccgagaauga

SEQ ID NO: 357303 - RNA, 19 nt, Homo sapiens
ggucagcaacggccugucu

SEQ ID NO: 357304 - RNA, 19 nt, Homo sapiens
aaccacauccgccacaaga

SEQ ID NO: 357305 - RNA, 19 nt, Homo sapiens
agccucugcuuccguacua

SEQ ID NO: 357306 - RNA, 19 nt, Homo sapiens
gcgaaaagaaggccaaaca

SEQ ID NO: 357307 - RNA, 19 nt, Homo sapiens
ucaaguucgggaagaaaga

SEQ ID NO: 357308 - RNA, 19 nt, Homo sapiens
ggcugcgucuccaagauuc

SEQ ID NO: 357309 - RNA, 19 nt, Homo sapiens
gcauauagauuucucauug

SEQ ID NO: 357310 - RNA, 19 nt, Homo sapiens
ggaaauagauugaacugau

SEQ ID NO: 357311 - RNA, 19 nt, Homo sapiens
gaaauugucuucagaugau

SEQ ID NO: 357312 - RNA, 19 nt, Homo sapiens
gggagaaacugcaguacua

SEQ ID NO: 357313 - RNA, 19 nt, Homo sapiens
gugaagagcucaguuauug

SEQ ID NO: 357314 - RNA, 19 nt, Homo sapiens
ggaauugacuaacuguaaa

SEQ ID NO: 357315 - RNA, 19 nt, Homo sapiens
uaagaaagcucguuguagu

SEQ ID NO: 357316 - RNA, 19 nt, Homo sapiens
ugacaucucuguuauuguu

SEQ ID NO: 357317 - RNA, 19 nt, Homo sapiens
ccacugcucuuccucuuaa

SEQ ID NO: 357318 - RNA, 19 nt, Homo sapiens
caggaaggguugaugcuua

SEQ ID NO: 357319 - RNA, 19 nt, Homo sapiens
gaagacaaguaguuuaugg

SEQ ID NO: 357320 - RNA, 19 nt, Homo sapiens
ccaagaugaugaagaguuu

SEQ ID NO: 357321 - RNA, 19 nt, Homo sapiens
caacaaacagggugcauuu

SEQ ID NO: 357322 - RNA, 19 nt, Homo sapiens
gaaggaguuugccauaaug

SEQ ID NO: 357323 - RNA, 19 nt, Homo sapiens
ggaccaagaugaugaagag

SEQ ID NO: 357324 - RNA, 19 nt, Homo sapiens
uggaaaggcugaucaagaa

SEQ ID NO: 357325 - RNA, 19 nt, Homo sapiens
gaaggcaucucaguuaaca

SEQ ID NO: 357326 - RNA, 19 nt, Homo sapiens
ccaccagggucuuguuuaa

SEQ ID NO: 357327 - RNA, 19 nt, Homo sapiens
gcgaaggcaucucaguuaa

SEQ ID NO: 357328 - RNA, 19 nt, Homo sapiens
guacccagcugucaaguuc

SEQ ID NO: 357329 - RNA, 19 nt, Homo sapiens
ugaccacccuugaugauaa

SEQ ID NO: 357330 - RNA, 19 nt, Homo sapiens
ggaaauguaaucuggaauu

SEQ ID NO: 357331 - RNA, 19 nt, Homo sapiens
uagaaaggguggaauguau

SEQ ID NO: 357332 - RNA, 19 nt, Homo sapiens
gaagaucagugggaagaug

SEQ ID NO: 357333 - RNA, 19 nt, Homo sapiens
uuacaaagcauccuaaaga

SEQ ID NO: 357334 - RNA, 19 nt, Homo sapiens
ggaauacaccauuguuuau

SEQ ID NO: 357335 - RNA, 19 nt, Homo sapiens
ggaaauugucuucagauga

SEQ ID NO: 357336 - RNA, 19 nt, Homo sapiens
caaaaggugugaucaauga

SEQ ID NO: 357337 - RNA, 19 nt, Homo sapiens
uuacugaccuggugauguu

SEQ ID NO: 357338 - RNA, 19 nt, Homo sapiens
gacagggucuuggaaauug

SEQ ID NO: 357339 - RNA, 19 nt, Homo sapiens
ggauagcgaccuggaaaua

SEQ ID NO: 357340 - RNA, 19 nt, Homo sapiens
ugaaggaguuugccauaau

SEQ ID NO: 357341 - RNA, 19 nt, Homo sapiens
ucugugcucuuccuuauuu

SEQ ID NO: 357342 - RNA, 19 nt, Homo sapiens
guaaucaguuccauagcuu

SEQ ID NO: 357343 - RNA, 19 nt, Homo sapiens
ggucaaggcugcagugaac

SEQ ID NO: 357344 - RNA, 19 nt, Homo sapiens
gaaaggguggaauguauug

SEQ ID NO: 357345 - RNA, 19 nt, Homo sapiens
cuugaugguugucuucuua

SEQ ID NO: 357346 - RNA, 19 nt, Homo sapiens
guguauacauggauauuug

SEQ ID NO: 357347 - RNA, 19 nt, Homo sapiens
gacaaguaguuuauggauu

SEQ ID NO: 357348 - RNA, 19 nt, Homo sapiens
gguauuguguuauuugcaa

SEQ ID NO: 357349 - RNA, 19 nt, Homo sapiens
uggaauacaccauuguuua

SEQ ID NO: 357350 - RNA, 19 nt, Homo sapiens
ggcgaaggcaucucaguua

SEQ ID NO: 357351 - RNA, 19 nt, Homo sapiens
gcagggaaguauuguuagu

SEQ ID NO: 357352 - RNA, 19 nt, Homo sapiens
ugauagauguucauuguag

SEQ ID NO: 357353 - RNA, 19 nt, Homo sapiens
agaaagugcuccauuccuu

SEQ ID NO: 357354 - RNA, 19 nt, Homo sapiens
gaaagcucguuguaguaga

SEQ ID NO: 357355 - RNA, 19 nt, Homo sapiens
uuaagaaagugcuccauuc

SEQ ID NO: 357356 - RNA, 19 nt, Homo sapiens
ggugugacaucucuguuau

SEQ ID NO: 357357 - RNA, 19 nt, Homo sapiens
gaaaagcauugucaucaug

SEQ ID NO: 357358 - RNA, 19 nt, Homo sapiens
gcacgguguuguaccucua

SEQ ID NO: 357359 - RNA, 19 nt, Homo sapiens
aagcagggaaguauuguua

SEQ ID NO: 357360 - RNA, 19 nt, Homo sapiens
gauagauguucauuguaga

SEQ ID NO: 357361 - RNA, 19 nt, Homo sapiens
agauugaacugauagucua

SEQ ID NO: 357362 - RNA, 19 nt, Homo sapiens
gaggauagcgaccuggaaa

SEQ ID NO: 357363 - RNA, 19 nt, Homo sapiens
ggaagcagcgaauggaaga

SEQ ID NO: 357364 - RNA, 19 nt, Homo sapiens
guagaaaggguggaaugua

SEQ ID NO: 357365 - RNA, 19 nt, Homo sapiens
ugaaugaggaccaagauga

SEQ ID NO: 357366 - RNA, 19 nt, Homo sapiens
ggaagaugacucugaagga

SEQ ID NO: 357367 - RNA, 19 nt, Homo sapiens
ucaagcaguuggagacaga

SEQ ID NO: 357368 - RNA, 19 nt, Homo sapiens
guucugugcucuuccuuau

SEQ ID NO: 357369 - RNA, 19 nt, Homo sapiens
agugauagauguucauugu

SEQ ID NO: 357370 - RNA, 19 nt, Homo sapiens
gagaagaucagugggaaga

SEQ ID NO: 357371 - RNA, 19 nt, Homo sapiens
uucaguggcuucauaauau

SEQ ID NO: 357372 - RNA, 19 nt, Homo sapiens
ggaaguauuguuagucuag

SEQ ID NO: 357373 - RNA, 19 nt, Homo sapiens
ggccucugcugcuggauuu

SEQ ID NO: 357374 - RNA, 19 nt, Homo sapiens
gcagccaguucaccaggaa

SEQ ID NO: 357375 - RNA, 19 nt, Homo sapiens
gauguuagaagacaaguag

SEQ ID NO: 357376 - RNA, 19 nt, Homo sapiens
gaguguaauucuguaggua

SEQ ID NO: 357377 - RNA, 19 nt, Homo sapiens
ugugacaucucuguuauug

SEQ ID NO: 357378 - RNA, 19 nt, Homo sapiens
gugggaagaugacucugaa

SEQ ID NO: 357379 - RNA, 19 nt, Homo sapiens
ggaguacaauagcgugauc

SEQ ID NO: 357380 - RNA, 19 nt, Homo sapiens
ucaguggcuucauaauauu

SEQ ID NO: 357381 - RNA, 19 nt, Homo sapiens
aaagcucguuguaguagaa

SEQ ID NO: 357382 - RNA, 19 nt, Homo sapiens
gauagucuaguugcauaua

SEQ ID NO: 357383 - RNA, 19 nt, Homo sapiens
cugauagucuaguugcaua

SEQ ID NO: 357384 - RNA, 19 nt, Homo sapiens
gaggaaaacugaccaaaac

SEQ ID NO: 357385 - RNA, 19 nt, Homo sapiens
gaacagaaaagcauuguca

SEQ ID NO: 357386 - RNA, 19 nt, Homo sapiens
ggaguuugccauaaugaau

SEQ ID NO: 357387 - RNA, 19 nt, Homo sapiens
uagucuagcuuauuuccuu

SEQ ID NO: 357388 - RNA, 19 nt, Homo sapiens
gggaaguauuguuagucua

SEQ ID NO: 357389 - RNA, 19 nt, Homo sapiens
ucucuaauccuacuaccua

SEQ ID NO: 357390 - RNA, 19 nt, Homo sapiens
gaaugaggaccaagaugau

SEQ ID NO: 357391 - RNA, 19 nt, Homo sapiens
cuuuugagcuguuuacuua

SEQ ID NO: 357392 - RNA, 19 nt, Homo sapiens
ggugaagagcucaguuauu

SEQ ID NO: 357393 - RNA, 19 nt, Homo sapiens
ucuauaguauggucagcua

SEQ ID NO: 357394 - RNA, 19 nt, Homo sapiens
uuuagacggugguuagauu

SEQ ID NO: 357395 - RNA, 19 nt, Homo sapiens
uguguuauuugcaacguaa

SEQ ID NO: 357396 - RNA, 19 nt, Homo sapiens
guagguauuguguuauuug

SEQ ID NO: 357397 - RNA, 19 nt, Homo sapiens
guaauucuguagguauugu

SEQ ID NO: 357398 - RNA, 19 nt, Homo sapiens
guuagaagacaaguaguuu

SEQ ID NO: 357399 - RNA, 19 nt, Homo sapiens
gcuguuuacuuaagauucu

SEQ ID NO: 357400 - RNA, 19 nt, Homo sapiens
cauaaugaaugaggaccaa

SEQ ID NO: 357401 - RNA, 19 nt, Homo sapiens
gaagaggaggagcaacaga

SEQ ID NO: 357402 - RNA, 19 nt, Homo sapiens
uagcuuauuuccuuucagu

SEQ ID NO: 357403 - RNA, 19 nt, Homo sapiens
auaguauggucagcuaaua

SEQ ID NO: 357404 - RNA, 19 nt, Homo sapiens
guguaauucuguagguauu

SEQ ID NO: 357405 - RNA, 19 nt, Homo sapiens
uuucaguggcuucauaaua

SEQ ID NO: 357406 - RNA, 19 nt, Homo sapiens
auagcgaccuggaaauaga

SEQ ID NO: 357407 - RNA, 19 nt, Homo sapiens
ccaggaauuuggauuacuc

SEQ ID NO: 357408 - RNA, 19 nt, Homo sapiens
cugaaggaguuugccauaa

SEQ ID NO: 357409 - RNA, 19 nt, Homo sapiens
ugacaugacuuuaggauuu

SEQ ID NO: 357410 - RNA, 19 nt, Homo sapiens
gcaagauccuggcgcgaua

SEQ ID NO: 357411 - RNA, 19 nt, Homo sapiens
ccacguugcugcuuagauu

SEQ ID NO: 357412 - RNA, 19 nt, Homo sapiens
gcaacaagaucggcaacuu

SEQ ID NO: 357413 - RNA, 19 nt, Homo sapiens
ggagcuagccugaaagaga

SEQ ID NO: 357414 - RNA, 19 nt, Homo sapiens
gcagaacucaagccucuuu

SEQ ID NO: 357415 - RNA, 19 nt, Homo sapiens
gcuaaugacacuuacauau

SEQ ID NO: 357416 - RNA, 19 nt, Homo sapiens
gaagguagucauucuguca

SEQ ID NO: 357417 - RNA, 19 nt, Homo sapiens
cauccagcauggcuccuua

SEQ ID NO: 357418 - RNA, 19 nt, Homo sapiens
aaacugacaugacuuuagg

SEQ ID NO: 357419 - RNA, 19 nt, Homo sapiens
caacccuucugccuugaaa

SEQ ID NO: 357420 - RNA, 19 nt, Homo sapiens
cggcaucgcuggcguucaa

SEQ ID NO: 357421 - RNA, 19 nt, Homo sapiens
gugcugcuccuucugguua

SEQ ID NO: 357422 - RNA, 19 nt, Homo sapiens
cagcccaagugucgccuua

SEQ ID NO: 357423 - RNA, 19 nt, Homo sapiens
acaaccacaucuacucgua

SEQ ID NO: 357424 - RNA, 19 nt, Homo sapiens
gcagggucauuacgacuca

SEQ ID NO: 357425 - RNA, 19 nt, Homo sapiens
ugaaacacauccggaccua

SEQ ID NO: 357426 - RNA, 19 nt, Homo sapiens
gaaagagacagcggaagga

SEQ ID NO: 357427 - RNA, 19 nt, Homo sapiens
gaacucaagccucuuucau

SEQ ID NO: 357428 - RNA, 19 nt, Homo sapiens
gggcacagacuuccuuuua

SEQ ID NO: 357429 - RNA, 19 nt, Homo sapiens
ggaccuacaagcagagaga

SEQ ID NO: 357430 - RNA, 19 nt, Homo sapiens
guacggacucacauccuuu

SEQ ID NO: 357431 - RNA, 19 nt, Homo sapiens
cuacagugcugcuccuucu

SEQ ID NO: 357432 - RNA, 19 nt, Homo sapiens
ccaagugucgccuuacaug

SEQ ID NO: 357433 - RNA, 19 nt, Homo sapiens
cugcuuagauugaaaugca

SEQ ID NO: 357434 - RNA, 19 nt, Homo sapiens
gaaugcaggcagccagaga

SEQ ID NO: 357435 - RNA, 19 nt, Homo sapiens
gcccaagugucgccuuaca

SEQ ID NO: 357436 - RNA, 19 nt, Homo sapiens
aaacacauccggaccuaca

SEQ ID NO: 357437 - RNA, 19 nt, Homo sapiens
ugacaucagccgccagcua

SEQ ID NO: 357438 - RNA, 19 nt, Homo sapiens
gcaggcagccagagaaggu

SEQ ID NO: 357439 - RNA, 19 nt, Homo sapiens
agccagcgcugcccuacaa

SEQ ID NO: 357440 - RNA, 19 nt, Homo sapiens
ugccauaacuuuucucuug

SEQ ID NO: 357441 - RNA, 19 nt, Homo sapiens
caagugucgccuuacauga

SEQ ID NO: 357442 - RNA, 19 nt, Homo sapiens
agagacagcggaaggaguu

SEQ ID NO: 357443 - RNA, 19 nt, Homo sapiens
gcacagacuuccuuuuacu

SEQ ID NO: 357444 - RNA, 19 nt, Homo sapiens
gaggcggugcggaaaguuu

SEQ ID NO: 357445 - RNA, 19 nt, Homo sapiens
gcgcucugaugggaaauuc

SEQ ID NO: 357446 - RNA, 19 nt, Homo sapiens
gacacuuacauauuucuug

SEQ ID NO: 357447 - RNA, 19 nt, Homo sapiens
ccaauucccaggucucaca

SEQ ID NO: 357448 - RNA, 19 nt, Homo sapiens
agauugaaaugcagaacuc

SEQ ID NO: 357449 - RNA, 19 nt, Homo sapiens
uguacggacucacauccuu

SEQ ID NO: 357450 - RNA, 19 nt, Homo sapiens
ccagagaagguagucauuc

SEQ ID NO: 357451 - RNA, 19 nt, Homo sapiens
ucaccgacccgcaccaauc

SEQ ID NO: 357452 - RNA, 19 nt, Homo sapiens
guggggagcuagccugaaa

SEQ ID NO: 357453 - RNA, 19 nt, Homo sapiens
acauauuucuugccauaac

SEQ ID NO: 357454 - RNA, 19 nt, Homo sapiens
gccagagaagguagucauu

SEQ ID NO: 357455 - RNA, 19 nt, Homo sapiens
ugggaggaguguucgugaa

SEQ ID NO: 357456 - RNA, 19 nt, Homo sapiens
cauauuucuugccauaacu

SEQ ID NO: 357457 - RNA, 19 nt, Homo sapiens
gauccuggcgcgauacaac

SEQ ID NO: 357458 - RNA, 19 nt, Homo sapiens
gucauuacgacucauacaa

SEQ ID NO: 357459 - RNA, 19 nt, Homo sapiens
gcauucugcgcaacaagau

SEQ ID NO: 357460 - RNA, 19 nt, Homo sapiens
cgacagaaauccugaauga

SEQ ID NO: 357461 - RNA, 19 nt, Homo sapiens
auacggagcuggagaaaua

SEQ ID NO: 357462 - RNA, 19 nt, Homo sapiens
cagaaauccugaaugaaua

SEQ ID NO: 357463 - RNA, 19 nt, Homo sapiens
gcaaucagcaaacacaaua

SEQ ID NO: 357464 - RNA, 19 nt, Homo sapiens
caacugaucucccagcaau

SEQ ID NO: 357465 - RNA, 19 nt, Homo sapiens
gaaugaagccugccuuguu

SEQ ID NO: 357466 - RNA, 19 nt, Homo sapiens
aagacaagcuugaaggaua

SEQ ID NO: 357467 - RNA, 19 nt, Homo sapiens
ggacacuucuuuauacucu

SEQ ID NO: 357468 - RNA, 19 nt, Homo sapiens
caagaggaagccaauauuu

SEQ ID NO: 357469 - RNA, 19 nt, Homo sapiens
gagccaaacucucacagau

SEQ ID NO: 357470 - RNA, 19 nt, Homo sapiens
agacaagcuugaaggauaa

SEQ ID NO: 357471 - RNA, 19 nt, Homo sapiens
gauccugcguucccgauuu

SEQ ID NO: 357472 - RNA, 19 nt, Homo sapiens
gccaaacucucacagauca

SEQ ID NO: 357473 - RNA, 19 nt, Homo sapiens
aaugaagccugccuuguuu

SEQ ID NO: 357474 - RNA, 19 nt, Homo sapiens
gcuuuaaacugccacagaa

SEQ ID NO: 357475 - RNA, 19 nt, Homo sapiens
gcaggacauuggagacauu

SEQ ID NO: 357476 - RNA, 19 nt, Homo sapiens
caguggagcauucagauua

SEQ ID NO: 357477 - RNA, 19 nt, Homo sapiens
aagaggaagccaauauuua

SEQ ID NO: 357478 - RNA, 19 nt, Homo sapiens
cagccaaucuggacacuuc

SEQ ID NO: 357479 - RNA, 19 nt, Homo sapiens
gggcaucagugcuaaugga

SEQ ID NO: 357480 - RNA, 19 nt, Homo sapiens
caauauuuaugcugccaaa

SEQ ID NO: 357481 - RNA, 19 nt, Homo sapiens
caagcuaacucgcccucaa

SEQ ID NO: 357482 - RNA, 19 nt, Homo sapiens
acaagaagaacauagguaa

SEQ ID NO: 357483 - RNA, 19 nt, Homo sapiens
ggaagagacggaauuucaa

SEQ ID NO: 357484 - RNA, 19 nt, Homo sapiens
gaaaaggauuugaagacaa

SEQ ID NO: 357485 - RNA, 19 nt, Homo sapiens
gagccaacgugcaaucaca

SEQ ID NO: 357486 - RNA, 19 nt, Homo sapiens
acagaaauccugaaugaau

SEQ ID NO: 357487 - RNA, 19 nt, Homo sapiens
gaagcaaucagcaaacaca

SEQ ID NO: 357488 - RNA, 19 nt, Homo sapiens
ggaggaagcaggacauugg

SEQ ID NO: 357489 - RNA, 19 nt, Homo sapiens
agaggaagccaauauuuau

SEQ ID NO: 357490 - RNA, 19 nt, Homo sapiens
ggaguuagccaagaagugu

SEQ ID NO: 357491 - RNA, 19 nt, Homo sapiens
ggacauuggagacauuuua

SEQ ID NO: 357492 - RNA, 19 nt, Homo sapiens
ggucgaagcaaucagcaaa

SEQ ID NO: 357493 - RNA, 19 nt, Homo sapiens
cgaauccgguacaagaaga

SEQ ID NO: 357494 - RNA, 19 nt, Homo sapiens
gcaaacacaauaagagucu

SEQ ID NO: 357495 - RNA, 19 nt, Homo sapiens
ucagacaaaucuaccauac

SEQ ID NO: 357496 - RNA, 19 nt, Homo sapiens
caagaagaacauagguaaa

SEQ ID NO: 357497 - RNA, 19 nt, Homo sapiens
gagacggaauuucaacaag

SEQ ID NO: 357498 - RNA, 19 nt, Homo sapiens
cggaagagacggaauuuca

SEQ ID NO: 357499 - RNA, 19 nt, Homo sapiens
caucacagucucccaggua

SEQ ID NO: 357500 - RNA, 19 nt, Homo sapiens
aagaggaguuagccaagaa

SEQ ID NO: 357501 - RNA, 19 nt, Homo sapiens
ggaagccaaagaggaguua

SEQ ID NO: 357502 - RNA, 19 nt, Homo sapiens
aagccugccuuguuuaaug

SEQ ID NO: 357503 - RNA, 19 nt, Homo sapiens
agaaggcccuggcaguguu

SEQ ID NO: 357504 - RNA, 19 nt, Homo sapiens
ucaagaggaagccaauauu

SEQ ID NO: 357505 - RNA, 19 nt, Homo sapiens
aaagaggaguuagccaaga

SEQ ID NO: 357506 - RNA, 19 nt, Homo sapiens
uguuuaauguguuguguga

SEQ ID NO: 357507 - RNA, 19 nt, Homo sapiens
gaaaacaugcuuuaaacug

SEQ ID NO: 357508 - RNA, 19 nt, Homo sapiens
caaucuggacacuucuuua

SEQ ID NO: 357509 - RNA, 19 nt, Homo sapiens
gacuggaggucgaagcaau

SEQ ID NO: 357510 - RNA, 19 nt, Homo sapiens
gaggaagccaauauuuaug

SEQ ID NO: 357511 - RNA, 19 nt, Homo sapiens
ggagacauuuuacagcaaa

SEQ ID NO: 357512 - RNA, 19 nt, Homo sapiens
gacggaauuucaacaagca

SEQ ID NO: 357513 - RNA, 19 nt, Homo sapiens
uguguugugugaaaucaaa

SEQ ID NO: 357514 - RNA, 19 nt, Homo sapiens
gaagacaagcuugaaggau

SEQ ID NO: 357515 - RNA, 19 nt, Homo sapiens
ucugauaccuccaacugau

SEQ ID NO: 357516 - RNA, 19 nt, Homo sapiens
ggauacccuucgccauguu

SEQ ID NO: 357517 - RNA, 19 nt, Homo sapiens
caagcaagcgacagaaauc

SEQ ID NO: 357518 - RNA, 19 nt, Homo sapiens
gaagagacggaauuucaac

SEQ ID NO: 357519 - RNA, 19 nt, Homo sapiens
gauacccuucgccauguua

SEQ ID NO: 357520 - RNA, 19 nt, Homo sapiens
ccacccacgugaugaaucu

SEQ ID NO: 357521 - RNA, 19 nt, Homo sapiens
agaggaauuuaaagaggaa

SEQ ID NO: 357522 - RNA, 19 nt, Homo sapiens
ucuggacacuucuuuauac

SEQ ID NO: 357523 - RNA, 19 nt, Homo sapiens
caauaagagucuccuucuc

SEQ ID NO: 357524 - RNA, 19 nt, Homo sapiens
aagcgaauccgguacaaga

SEQ ID NO: 357525 - RNA, 19 nt, Homo sapiens
ucucacagaucagacaaau

SEQ ID NO: 357526 - RNA, 19 nt, Homo sapiens
ugaagccugccuuguuuaa

SEQ ID NO: 357527 - RNA, 19 nt, Homo sapiens
ccgaggagcagaagaggaa

SEQ ID NO: 357528 - RNA, 19 nt, Homo sapiens
uuaaacugccacagaauga

SEQ ID NO: 357529 - RNA, 19 nt, Homo sapiens
uaauggagguuggcaggau

SEQ ID NO: 357530 - RNA, 19 nt, Homo sapiens
acaggaggauacagugaug

SEQ ID NO: 357531 - RNA, 19 nt, Homo sapiens
ccagaaaacaugcuuuaaa

SEQ ID NO: 357532 - RNA, 19 nt, Homo sapiens
ccgcagggcaucagugcua

SEQ ID NO: 357533 - RNA, 19 nt, Homo sapiens
ccagugaggaagccaaaga

SEQ ID NO: 357534 - RNA, 19 nt, Homo sapiens
acaacucaguggagcauuc

SEQ ID NO: 357535 - RNA, 19 nt, Homo sapiens
cagaaaacaugcuuuaaac

SEQ ID NO: 357536 - RNA, 19 nt, Homo sapiens
ucaacaagcaagcgacaga

SEQ ID NO: 357537 - RNA, 19 nt, Homo sapiens
caucauccaccgcaaguuc

SEQ ID NO: 357538 - RNA, 19 nt, Homo sapiens
gauuugaagacaagcuuga

SEQ ID NO: 357539 - RNA, 19 nt, Homo sapiens
cagcaaauuaugaccauca

SEQ ID NO: 357540 - RNA, 19 nt, Homo sapiens
ccaaucuggacacuucuuu

SEQ ID NO: 357541 - RNA, 19 nt, Homo sapiens
cagcaaacacaauaagagu

SEQ ID NO: 357542 - RNA, 19 nt, Homo sapiens
ggaagccaauauuuaugcu

SEQ ID NO: 357543 - RNA, 19 nt, Homo sapiens
caacaagcaagcgacagaa

SEQ ID NO: 357544 - RNA, 19 nt, Homo sapiens
ucacagaccagaguuugga

SEQ ID NO: 357545 - RNA, 19 nt, Homo sapiens
gcccauggaagccaagcua

SEQ ID NO: 357546 - RNA, 19 nt, Homo sapiens
caucacagaccagaguuug

SEQ ID NO: 357547 - RNA, 19 nt, Homo sapiens
gaucagacaaaucuaccau

SEQ ID NO: 357548 - RNA, 19 nt, Homo sapiens
uacaagaagaacauaggua

SEQ ID NO: 357549 - RNA, 19 nt, Homo sapiens
gaccaucacagaccagagu

SEQ ID NO: 357550 - RNA, 19 nt, Homo sapiens
ucuggagauuuguucauga

SEQ ID NO: 357551 - RNA, 19 nt, Homo sapiens
ggagcauucagauuacaga

SEQ ID NO: 357552 - RNA, 19 nt, Homo sapiens
aaucuggacacuucuuuau

SEQ ID NO: 357553 - RNA, 19 nt, Homo sapiens
caaucagcaaacacaauaa

SEQ ID NO: 357554 - RNA, 19 nt, Homo sapiens
gagcgugcagucacucaau

SEQ ID NO: 357555 - RNA, 19 nt, Homo sapiens
guacaagaagaacauaggu

SEQ ID NO: 357556 - RNA, 19 nt, Homo sapiens
caaacucucacagaucaga

SEQ ID NO: 357557 - RNA, 19 nt, Homo sapiens
ugaugcggcuggacaacau

SEQ ID NO: 357558 - RNA, 19 nt, Homo sapiens
gaugcuauuucagccaauc

SEQ ID NO: 357559 - RNA, 19 nt, Homo sapiens
ucuuugggaugcuauuuca

SEQ ID NO: 357560 - RNA, 19 nt, Homo sapiens
ccacugagguccuaaauga

SEQ ID NO: 357561 - RNA, 19 nt, Homo sapiens
gcaguucucuccucacuug

SEQ ID NO: 357562 - RNA, 19 nt, Homo sapiens
aaacagaacugguaaagag

SEQ ID NO: 357563 - RNA, 19 nt, Homo sapiens
gaagggaguuauugccaaa

SEQ ID NO: 357564 - RNA, 19 nt, Homo sapiens
caacggagauuccuauucu

SEQ ID NO: 357565 - RNA, 19 nt, Homo sapiens
gggaguuucugcuacuuua

SEQ ID NO: 357566 - RNA, 19 nt, Homo sapiens
ugaacuagcuaccaucuga

SEQ ID NO: 357567 - RNA, 19 nt, Homo sapiens
gggcuggacucaguaauuu

SEQ ID NO: 357568 - RNA, 19 nt, Homo sapiens
acucggagcuggagaagua

SEQ ID NO: 357569 - RNA, 19 nt, Homo sapiens
gcaaacaucuaugcuguca

SEQ ID NO: 357570 - RNA, 19 nt, Homo sapiens
auacgcagcucaucuuaaa

SEQ ID NO: 357571 - RNA, 19 nt, Homo sapiens
ggacaaacagaacugguaa

SEQ ID NO: 357572 - RNA, 19 nt, Homo sapiens
aaugaagccugcucucuuu

SEQ ID NO: 357573 - RNA, 19 nt, Homo sapiens
aaaguaacaucaacacugu

SEQ ID NO: 357574 - RNA, 19 nt, Homo sapiens
gagcaggcauguaaugagu

SEQ ID NO: 357575 - RNA, 19 nt, Homo sapiens
gaaugaagccugcucucuu

SEQ ID NO: 357576 - RNA, 19 nt, Homo sapiens
ccacuuguaugcucuggaa

SEQ ID NO: 357577 - RNA, 19 nt, Homo sapiens
caucauccaucgaaaguuc

SEQ ID NO: 357578 - RNA, 19 nt, Homo sapiens
ggagauuccuauucugcuu

SEQ ID NO: 357579 - RNA, 19 nt, Homo sapiens
ugagugacaugucuuuaau

SEQ ID NO: 357580 - RNA, 19 nt, Homo sapiens
aaacaucuaugcugucaag

SEQ ID NO: 357581 - RNA, 19 nt, Homo sapiens
cgaaagcgccguaacuuca

SEQ ID NO: 357582 - RNA, 19 nt, Homo sapiens
cagcucaucuuaaaccaau

SEQ ID NO: 357583 - RNA, 19 nt, Homo sapiens
gcaggcauguaaugaguuc

SEQ ID NO: 357584 - RNA, 19 nt, Homo sapiens
gcccagauccgucacauau

SEQ ID NO: 357585 - RNA, 19 nt, Homo sapiens
ccagauccgucacauauac

SEQ ID NO: 357586 - RNA, 19 nt, Homo sapiens
ccauaaaugagguaucuuu

SEQ ID NO: 357587 - RNA, 19 nt, Homo sapiens
ccaagaaacacgcccuaaa

SEQ ID NO: 357588 - RNA, 19 nt, Homo sapiens
guucucuccucacuuguaa

SEQ ID NO: 357589 - RNA, 19 nt, Homo sapiens
ggacagguuggaaguguga

SEQ ID NO: 357590 - RNA, 19 nt, Homo sapiens
gaacgcauggugagcauca

SEQ ID NO: 357591 - RNA, 19 nt, Homo sapiens
gggacaaacagaacuggua

SEQ ID NO: 357592 - RNA, 19 nt, Homo sapiens
ccucagacauucucaggau

SEQ ID NO: 357593 - RNA, 19 nt, Homo sapiens
guauauguaucuuccucaa

SEQ ID NO: 357594 - RNA, 19 nt, Homo sapiens
uuacagggcaccaagcuuu

SEQ ID NO: 357595 - RNA, 19 nt, Homo sapiens
caagaaacacgcccuaaac

SEQ ID NO: 357596 - RNA, 19 nt, Homo sapiens
gugagugacaugucuuuaa

SEQ ID NO: 357597 - RNA, 19 nt, Homo sapiens
ggagggaguuucugcuacu

SEQ ID NO: 357598 - RNA, 19 nt, Homo sapiens
aguaugagcaggcauguaa

SEQ ID NO: 357599 - RNA, 19 nt, Homo sapiens
gagaagcacaagacagaga

SEQ ID NO: 357600 - RNA, 19 nt, Homo sapiens
gaaugggaagggaguuauu

SEQ ID NO: 357601 - RNA, 19 nt, Homo sapiens
uguaugcucuggaaucugu

SEQ ID NO: 357602 - RNA, 19 nt, Homo sapiens
uuacauggcaggaagaaug

SEQ ID NO: 357603 - RNA, 19 nt, Homo sapiens
ucagacauucucaggauuu

SEQ ID NO: 357604 - RNA, 19 nt, Homo sapiens
gacuaucgcagcaaacuug

SEQ ID NO: 357605 - RNA, 19 nt, Homo sapiens
ugugugaaaucaaggagaa

SEQ ID NO: 357606 - RNA, 19 nt, Homo sapiens
ucccuuagguguucuuugu

SEQ ID NO: 357607 - RNA, 19 nt, Homo sapiens
acacacauacucccacuug

SEQ ID NO: 357608 - RNA, 19 nt, Homo sapiens
gcucaacggagauuccuau

SEQ ID NO: 357609 - RNA, 19 nt, Homo sapiens
ccaccugaguaacccauau

SEQ ID NO: 357610 - RNA, 19 nt, Homo sapiens
uaaaaucccuuagguguuc

SEQ ID NO: 357611 - RNA, 19 nt, Homo sapiens
ucugauaccuccaacugau

SEQ ID NO: 357612 - RNA, 19 nt, Homo sapiens
cagcagauaaugaccauca

SEQ ID NO: 357613 - RNA, 19 nt, Homo sapiens
ucuccucacuuguaaacuu

SEQ ID NO: 357614 - RNA, 19 nt, Homo sapiens
gcaacuauucuguuucucu

SEQ ID NO: 357615 - RNA, 19 nt, Homo sapiens
cuaaacugccaccgaauga

SEQ ID NO: 357616 - RNA, 19 nt, Homo sapiens
cugaguaacccauauccua

SEQ ID NO: 357617 - RNA, 19 nt, Homo sapiens
gacgaaagcgccguaacuu

SEQ ID NO: 357618 - RNA, 19 nt, Homo sapiens
gggcaguucucuccucacu

SEQ ID NO: 357619 - RNA, 19 nt, Homo sapiens
ugguggugguucuuaauuu

SEQ ID NO: 357620 - RNA, 19 nt, Homo sapiens
cucaggaucuggagacaug

SEQ ID NO: 357621 - RNA, 19 nt, Homo sapiens
gcccugaacuagcuaccau

SEQ ID NO: 357622 - RNA, 19 nt, Homo sapiens
gcagggcuggacucaguaa

SEQ ID NO: 357623 - RNA, 19 nt, Homo sapiens
gcuccaggccuguccauca

SEQ ID NO: 357624 - RNA, 19 nt, Homo sapiens
caaacagaacugguaaaga

SEQ ID NO: 357625 - RNA, 19 nt, Homo sapiens
gguggugguucuuaauuuu

SEQ ID NO: 357626 - RNA, 19 nt, Homo sapiens
gaagccugcucucuuuagc

SEQ ID NO: 357627 - RNA, 19 nt, Homo sapiens
caauacaggagaagcacaa

SEQ ID NO: 357628 - RNA, 19 nt, Homo sapiens
ccuuagguguucuuuguuc

SEQ ID NO: 357629 - RNA, 19 nt, Homo sapiens
gagcaucauccaucgaaag

SEQ ID NO: 357630 - RNA, 19 nt, Homo sapiens
cugcuacuuuagggaauua

SEQ ID NO: 357631 - RNA, 19 nt, Homo sapiens
ccuccggacggcuuacuua

SEQ ID NO: 357632 - RNA, 19 nt, Homo sapiens
acuugcaacuauucuguuu

SEQ ID NO: 357633 - RNA, 19 nt, Homo sapiens
cugagguccuaaaugagua

SEQ ID NO: 357634 - RNA, 19 nt, Homo sapiens
gagggaguuucugcuacuu

SEQ ID NO: 357635 - RNA, 19 nt, Homo sapiens
ucauacgcagcucaucuua

SEQ ID NO: 357636 - RNA, 19 nt, Homo sapiens
aagaggaggcaaacaucua

SEQ ID NO: 357637 - RNA, 19 nt, Homo sapiens
cgccguaacuucagcaaac

SEQ ID NO: 357638 - RNA, 19 nt, Homo sapiens
ggacuaucgcagcaaacuu

SEQ ID NO: 357639 - RNA, 19 nt, Homo sapiens
gaaccccucccauuaaaga

SEQ ID NO: 357640 - RNA, 19 nt, Homo sapiens
gaacuagcuaccaucugau

SEQ ID NO: 357641 - RNA, 19 nt, Homo sapiens
gagugacaugucuuuaauu

SEQ ID NO: 357642 - RNA, 19 nt, Homo sapiens
cuacuuuagggaauuauug

SEQ ID NO: 357643 - RNA, 19 nt, Homo sapiens
ccacuugcaacuauucugu

SEQ ID NO: 357644 - RNA, 19 nt, Homo sapiens
aggagaagcacaagacaga

SEQ ID NO: 357645 - RNA, 19 nt, Homo sapiens
ccaagaggaggcaaacauc

SEQ ID NO: 357646 - RNA, 19 nt, Homo sapiens
gacaaacagaacugguaaa

SEQ ID NO: 357647 - RNA, 19 nt, Homo sapiens
caaagggguucugguaaga

SEQ ID NO: 357648 - RNA, 19 nt, Homo sapiens
cauacgcagcucaucuuaa

SEQ ID NO: 357649 - RNA, 19 nt, Homo sapiens
uaucccaggucucccuuca

SEQ ID NO: 357650 - RNA, 19 nt, Homo sapiens
aaacuggccucagcauucg

SEQ ID NO: 357651 - RNA, 19 nt, Homo sapiens
acggcuuacuuaccucaua

SEQ ID NO: 357652 - RNA, 19 nt, Homo sapiens
ggagggaccagggaguguu

SEQ ID NO: 357653 - RNA, 19 nt, Homo sapiens
caucgaacacucggacuau

SEQ ID NO: 357654 - RNA, 19 nt, Homo sapiens
gaaagcgccguaacuucag

SEQ ID NO: 357655 - RNA, 19 nt, Homo sapiens
gugagcaucauccaucgaa

SEQ ID NO: 357656 - RNA, 19 nt, Homo sapiens
agaaacacgcccuaaacug

SEQ ID NO: 357657 - RNA, 19 nt, Homo sapiens
aagaaugggaagggaguua

SEQ ID NO: 357658 - RNA, 19 nt, Homo sapiens
gaagaaugggaagggaguu

SEQ ID NO: 357659 - RNA, 19 nt, Homo sapiens
agacagagaagggccaaug

SEQ ID NO: 357660 - RNA, 19 nt, Homo sapiens
guucagaucucuuauguua

SEQ ID NO: 357661 - RNA, 19 nt, Homo sapiens
acacagaacuggagaaaua

SEQ ID NO: 357662 - RNA, 19 nt, Homo sapiens
ccacagaaaucuugaauga

SEQ ID NO: 357663 - RNA, 19 nt, Homo sapiens
gaacaauacucacgcugua

SEQ ID NO: 357664 - RNA, 19 nt, Homo sapiens
gaagaacauuggcaaguuu

SEQ ID NO: 357665 - RNA, 19 nt, Homo sapiens
gaacaggcauguaaugaau

SEQ ID NO: 357666 - RNA, 19 nt, Homo sapiens
ccaauuaggccaagauuua

SEQ ID NO: 357667 - RNA, 19 nt, Homo sapiens
gaacucauacaaaccaaua

SEQ ID NO: 357668 - RNA, 19 nt, Homo sapiens
ggaagaagccaaccucuau

SEQ ID NO: 357669 - RNA, 19 nt, Homo sapiens
guacaguccacauaauuua

SEQ ID NO: 357670 - RNA, 19 nt, Homo sapiens
caacauguucuguagcuua

SEQ ID NO: 357671 - RNA, 19 nt, Homo sapiens
cacuaaaccucaaccguua

SEQ ID NO: 357672 - RNA, 19 nt, Homo sapiens
uaaugagacuggacaauau

SEQ ID NO: 357673 - RNA, 19 nt, Homo sapiens
cuacaugccuugauaagug

SEQ ID NO: 357674 - RNA, 19 nt, Homo sapiens
aagaggagcuggccaagaa

SEQ ID NO: 357675 - RNA, 19 nt, Homo sapiens
gaagauacuugcugcugau

SEQ ID NO: 357676 - RNA, 19 nt, Homo sapiens
guggaaacauugggucuua

SEQ ID NO: 357677 - RNA, 19 nt, Homo sapiens
ccaauagaauuucaacaug

SEQ ID NO: 357678 - RNA, 19 nt, Homo sapiens
gaacuugguaaaucuguuu

SEQ ID NO: 357679 - RNA, 19 nt, Homo sapiens
aaacacagcuuuauuaccu

SEQ ID NO: 357680 - RNA, 19 nt, Homo sapiens
gauacuugcugcugauaga

SEQ ID NO: 357681 - RNA, 19 nt, Homo sapiens
ucagauaacucuauugaac

SEQ ID NO: 357682 - RNA, 19 nt, Homo sapiens
ugagcuacaugccuugaua

SEQ ID NO: 357683 - RNA, 19 nt, Homo sapiens
acaaaucuaucacacagaa

SEQ ID NO: 357684 - RNA, 19 nt, Homo sapiens
cgaaucagguacaagaaga

SEQ ID NO: 357685 - RNA, 19 nt, Homo sapiens
gcaacaaacgaaucaggua

SEQ ID NO: 357686 - RNA, 19 nt, Homo sapiens
ggauugucuuucuuucaua

SEQ ID NO: 357687 - RNA, 19 nt, Homo sapiens
gauacccuccgucauguua

SEQ ID NO: 357688 - RNA, 19 nt, Homo sapiens
guaaacaggccacagaaau

SEQ ID NO: 357689 - RNA, 19 nt, Homo sapiens
aaauucaccucaccuaaau

SEQ ID NO: 357690 - RNA, 19 nt, Homo sapiens
guaguuugucucuuucuua

SEQ ID NO: 357691 - RNA, 19 nt, Homo sapiens
uaauggaguuggaauaaag

SEQ ID NO: 357692 - RNA, 19 nt, Homo sapiens
caaagaaacaugcccugaa

SEQ ID NO: 357693 - RNA, 19 nt, Homo sapiens
caacaacuccaucuucugu

SEQ ID NO: 357694 - RNA, 19 nt, Homo sapiens
ugucacagguauccaauug

SEQ ID NO: 357695 - RNA, 19 nt, Homo sapiens
cuaaugagacuggacaaua

SEQ ID NO: 357696 - RNA, 19 nt, Homo sapiens
acaggcauguaaugaauuu

SEQ ID NO: 357697 - RNA, 19 nt, Homo sapiens
cuauugaacacucagauua

SEQ ID NO: 357698 - RNA, 19 nt, Homo sapiens
ggauaccucuaacuaaucu

SEQ ID NO: 357699 - RNA, 19 nt, Homo sapiens
caucauccaucgaaaauuu

SEQ ID NO: 357700 - RNA, 19 nt, Homo sapiens
gaaacauugggucuuaauu

SEQ ID NO: 357701 - RNA, 19 nt, Homo sapiens
ugacuuggauugucuuucu

SEQ ID NO: 357702 - RNA, 19 nt, Homo sapiens
agaagaacauuggcaaguu

SEQ ID NO: 357703 - RNA, 19 nt, Homo sapiens
aaacgaaucagguacaaga

SEQ ID NO: 357704 - RNA, 19 nt, Homo sapiens
gaauuuacuacacauguga

SEQ ID NO: 357705 - RNA, 19 nt, Homo sapiens
gaaucuuccucgucacguu

SEQ ID NO: 357706 - RNA, 19 nt, Homo sapiens
guuucacaguugccaauua

SEQ ID NO: 357707 - RNA, 19 nt, Homo sapiens
ucauaucacuaauggaguu

SEQ ID NO: 357708 - RNA, 19 nt, Homo sapiens
aauaugaacaggcauguaa

SEQ ID NO: 357709 - RNA, 19 nt, Homo sapiens
ugugugagaucaaagagaa

SEQ ID NO: 357710 - RNA, 19 nt, Homo sapiens
aaagaaacaugcccugaac

SEQ ID NO: 357711 - RNA, 19 nt, Homo sapiens
aggccaagauuuaacauug

SEQ ID NO: 357712 - RNA, 19 nt, Homo sapiens
ucggauaccucuaacuaau

SEQ ID NO: 357713 - RNA, 19 nt, Homo sapiens
gaaagaauggugggcauca

SEQ ID NO: 357714 - RNA, 19 nt, Homo sapiens
ucucuggaguguuguauau

SEQ ID NO: 357715 - RNA, 19 nt, Homo sapiens
cuaauggaguuggaauaaa

SEQ ID NO: 357716 - RNA, 19 nt, Homo sapiens
caaauugacccagaucaga

SEQ ID NO: 357717 - RNA, 19 nt, Homo sapiens
gauuacagagccaaauuga

SEQ ID NO: 357718 - RNA, 19 nt, Homo sapiens
caauuaggccaagauuuaa

SEQ ID NO: 357719 - RNA, 19 nt, Homo sapiens
cagaacaaccagaccaauu

SEQ ID NO: 357720 - RNA, 19 nt, Homo sapiens
gaagaagccaaccucuaug

SEQ ID NO: 357721 - RNA, 19 nt, Homo sapiens
ggacgaggcgcaagcaaag

SEQ ID NO: 357722 - RNA, 19 nt, Homo sapiens
aaacauugggucuuaauuc

SEQ ID NO: 357723 - RNA, 19 nt, Homo sapiens
ggaaacauugggucuuaau

SEQ ID NO: 357724 - RNA, 19 nt, Homo sapiens
ggaguguuguauauagugu

SEQ ID NO: 357725 - RNA, 19 nt, Homo sapiens
ggccaagauuuaacauugu

SEQ ID NO: 357726 - RNA, 19 nt, Homo sapiens
guaaaaccuugucuuauuc

SEQ ID NO: 357727 - RNA, 19 nt, Homo sapiens
cuugauaagugcauucaga

SEQ ID NO: 357728 - RNA, 19 nt, Homo sapiens
acaacuccaucuucuguga

SEQ ID NO: 357729 - RNA, 19 nt, Homo sapiens
caaccucuaugcugcaaag

SEQ ID NO: 357730 - RNA, 19 nt, Homo sapiens
gaguagaacacgucccauu

SEQ ID NO: 357731 - RNA, 19 nt, Homo sapiens
ucacagguauccaauuggu

SEQ ID NO: 357732 - RNA, 19 nt, Homo sapiens
guagaacacgucccauuuc

SEQ ID NO: 357733 - RNA, 19 nt, Homo sapiens
agagucugcucgguaauaa

SEQ ID NO: 357734 - RNA, 19 nt, Homo sapiens
caucguuucucucucugaa

SEQ ID NO: 357735 - RNA, 19 nt, Homo sapiens
guguucagaucucuuaugu

SEQ ID NO: 357736 - RNA, 19 nt, Homo sapiens
cauuaaugguuucacaguu

SEQ ID NO: 357737 - RNA, 19 nt, Homo sapiens
gagcuacaugccuugauaa

SEQ ID NO: 357738 - RNA, 19 nt, Homo sapiens
gagccaaauugacccagau

SEQ ID NO: 357739 - RNA, 19 nt, Homo sapiens
gaaacaugcccugaacugu

SEQ ID NO: 357740 - RNA, 19 nt, Homo sapiens
gugaagcaguuaugauuuu

SEQ ID NO: 357741 - RNA, 19 nt, Homo sapiens
acagguauccaauugguuu

SEQ ID NO: 357742 - RNA, 19 nt, Homo sapiens
uaaacaggccacagaaauc

SEQ ID NO: 357743 - RNA, 19 nt, Homo sapiens
gaaaaggcguaacuucagu

SEQ ID NO: 357744 - RNA, 19 nt, Homo sapiens
ugaauuuacuacacaugug

SEQ ID NO: 357745 - RNA, 19 nt, Homo sapiens
aacauugggucuuaauuca

SEQ ID NO: 357746 - RNA, 19 nt, Homo sapiens
ggaauaaagagcuguuugc

SEQ ID NO: 357747 - RNA, 19 nt, Homo sapiens
ucaccuaaauugaacuucu

SEQ ID NO: 357748 - RNA, 19 nt, Homo sapiens
gaaugaaaccagcgcucuu

SEQ ID NO: 357749 - RNA, 19 nt, Homo sapiens
guuugucucuuucuuaucu

SEQ ID NO: 357750 - RNA, 19 nt, Homo sapiens
uagcaucguuucucucucu

SEQ ID NO: 357751 - RNA, 19 nt, Homo sapiens
gaucagagacugguagcau

SEQ ID NO: 357752 - RNA, 19 nt, Homo sapiens
caccuaaauugaacuucuu

SEQ ID NO: 357753 - RNA, 19 nt, Homo sapiens
auuaaugguuucacaguug

SEQ ID NO: 357754 - RNA, 19 nt, Homo sapiens
guggauacccuccgucaug

SEQ ID NO: 357755 - RNA, 19 nt, Homo sapiens
caucacagugucacaggua

SEQ ID NO: 357756 - RNA, 19 nt, Homo sapiens
ccaggaugcugcagacucu

SEQ ID NO: 357757 - RNA, 19 nt, Homo sapiens
aggcguaacuucaguaaac

SEQ ID NO: 357758 - RNA, 19 nt, Homo sapiens
agaugcagcucaaacaaag

SEQ ID NO: 357759 - RNA, 19 nt, Homo sapiens
aauuauggauccagauugu

SEQ ID NO: 357760 - RNA, 19 nt, Homo sapiens
guucaucucuugccaaaua

SEQ ID NO: 357761 - RNA, 19 nt, Homo sapiens
gaaagcagaugaagccuau

SEQ ID NO: 357762 - RNA, 19 nt, Homo sapiens
ggacuucacugccaccuuu

SEQ ID NO: 357763 - RNA, 19 nt, Homo sapiens
ucaagacucucuaauauga

SEQ ID NO: 357764 - RNA, 19 nt, Homo sapiens
gcaagacgcugcacaucaa

SEQ ID NO: 357765 - RNA, 19 nt, Homo sapiens
guucaagacucucuaauau

SEQ ID NO: 357766 - RNA, 19 nt, Homo sapiens
gcggacagcugcuuacaug

SEQ ID NO: 357767 - RNA, 19 nt, Homo sapiens
gagcugaugugguggaugu

SEQ ID NO: 357768 - RNA, 19 nt, Homo sapiens
gcucuaagguacugaagga

SEQ ID NO: 357769 - RNA, 19 nt, Homo sapiens
ggaaauggccaaaagaaua

SEQ ID NO: 357770 - RNA, 19 nt, Homo sapiens
ggaacauccugcaccugua

SEQ ID NO: 357771 - RNA, 19 nt, Homo sapiens
ggacagcugcuuacauguu

SEQ ID NO: 357772 - RNA, 19 nt, Homo sapiens
acacagaggugcccaugga

SEQ ID NO: 357773 - RNA, 19 nt, Homo sapiens
caaagagaauggcauggau

SEQ ID NO: 357774 - RNA, 19 nt, Homo sapiens
gaauaaaccauuuccucuu

SEQ ID NO: 357775 - RNA, 19 nt, Homo sapiens
caagaucgcagaggaguuu

SEQ ID NO: 357776 - RNA, 19 nt, Homo sapiens
gguggaggcugccaucuca

SEQ ID NO: 357777 - RNA, 19 nt, Homo sapiens
gcaacucggacguguauga

SEQ ID NO: 357778 - RNA, 19 nt, Homo sapiens
cugggaaguuuacucaaua

SEQ ID NO: 357779 - RNA, 19 nt, Homo sapiens
gcacaucccagacaucauc

SEQ ID NO: 357780 - RNA, 19 nt, Homo sapiens
cuggagagcugaccaaaca

SEQ ID NO: 357781 - RNA, 19 nt, Homo sapiens
agaggcaggucuucuuuga

SEQ ID NO: 357782 - RNA, 19 nt, Homo sapiens
gaaauggccaaaagaauaa

SEQ ID NO: 357783 - RNA, 19 nt, Homo sapiens
gccaugcgcuuccuguaug

SEQ ID NO: 357784 - RNA, 19 nt, Homo sapiens
acgaggagcuggaggagaa

SEQ ID NO: 357785 - RNA, 19 nt, Homo sapiens
gacagcugcuuacauguuc

SEQ ID NO: 357786 - RNA, 19 nt, Homo sapiens
aguauaagcccaucaagaa

SEQ ID NO: 357787 - RNA, 19 nt, Homo sapiens
ccauuugccuccgcagaua

SEQ ID NO: 357788 - RNA, 19 nt, Homo sapiens
gaguauaagcccaucaaga

SEQ ID NO: 357789 - RNA, 19 nt, Homo sapiens
ccucuuacuuaccgaauga

SEQ ID NO: 357790 - RNA, 19 nt, Homo sapiens
caacguggucuucaaguuc

SEQ ID NO: 357791 - RNA, 19 nt, Homo sapiens
uggagaaguucaucgagaa

SEQ ID NO: 357792 - RNA, 19 nt, Homo sapiens
gcaugaggcccacgaguuc

SEQ ID NO: 357793 - RNA, 19 nt, Homo sapiens
gcuacggguuccucucuga

SEQ ID NO: 357794 - RNA, 19 nt, Homo sapiens
guauaagcccaucaagaaa

SEQ ID NO: 357795 - RNA, 19 nt, Homo sapiens
aaccauuuccucuuacuua

SEQ ID NO: 357796 - RNA, 19 nt, Homo sapiens
ucagcaagcucuucagcau

SEQ ID NO: 357797 - RNA, 19 nt, Homo sapiens
cacuaaggaugcugaaguu

SEQ ID NO: 357798 - RNA, 19 nt, Homo sapiens
gguggaagaugggaaaugg

SEQ ID NO: 357799 - RNA, 19 nt, Homo sapiens
ccauggagcgcguguuuga

SEQ ID NO: 357800 - RNA, 19 nt, Homo sapiens
ugggaaguuuacucaauaa

SEQ ID NO: 357801 - RNA, 19 nt, Homo sapiens
ccaaggagaacaacguaga

SEQ ID NO: 357802 - RNA, 19 nt, Homo sapiens
ucugugaaguggccaaaga

SEQ ID NO: 357803 - RNA, 19 nt, Homo sapiens
cccaaaagcuguugcacua

SEQ ID NO: 357804 - RNA, 19 nt, Homo sapiens
ggagaucaccgacguagac

SEQ ID NO: 357805 - RNA, 19 nt, Homo sapiens
uaauaugauuccaccuguu

SEQ ID NO: 357806 - RNA, 19 nt, Homo sapiens
ccugggaaguuuacucaau

SEQ ID NO: 357807 - RNA, 19 nt, Homo sapiens
ccagaggcaggucuucuuu

SEQ ID NO: 357808 - RNA, 19 nt, Homo sapiens
ugaaguggccaaagagaau

SEQ ID NO: 357809 - RNA, 19 nt, Homo sapiens
acaacguggucuucaaguu

SEQ ID NO: 357810 - RNA, 19 nt, Homo sapiens
cguucaagacucucuaaua

SEQ ID NO: 357811 - RNA, 19 nt, Homo sapiens
agaaugugcucaacaacca

SEQ ID NO: 357812 - RNA, 19 nt, Homo sapiens
cuaaacaggugggcuacga

SEQ ID NO: 357813 - RNA, 19 nt, Homo sapiens
gcugggcgaucucaucaag

SEQ ID NO: 357814 - RNA, 19 nt, Homo sapiens
ggaugucuuccguguguuu

SEQ ID NO: 357815 - RNA, 19 nt, Homo sapiens
gcacggcaagcacuacuuc

SEQ ID NO: 357816 - RNA, 19 nt, Homo sapiens
caccagcgacucugugaaa

SEQ ID NO: 357817 - RNA, 19 nt, Homo sapiens
gaacauccugcaccuguac

SEQ ID NO: 357818 - RNA, 19 nt, Homo sapiens
ucaucaagguggccaagga

SEQ ID NO: 357819 - RNA, 19 nt, Homo sapiens
gagauugccauccgugugu

SEQ ID NO: 357820 - RNA, 19 nt, Homo sapiens
gcccauggagcgcguguuu

SEQ ID NO: 357821 - RNA, 19 nt, Homo sapiens
ggaccaguaugggaacauc

SEQ ID NO: 357822 - RNA, 19 nt, Homo sapiens
ggagaacaacguagaugca

SEQ ID NO: 357823 - RNA, 19 nt, Homo sapiens
gcaagguucaugugaccaa

SEQ ID NO: 357824 - RNA, 19 nt, Homo sapiens
gcacggccaccaugaaguc

SEQ ID NO: 357825 - RNA, 19 nt, Homo sapiens
ugaggguggugcacagcua

SEQ ID NO: 357826 - RNA, 19 nt, Homo sapiens
gcuuacauguucaucucuu

SEQ ID NO: 357827 - RNA, 19 nt, Homo sapiens
ggacaugacacuggaaggu

SEQ ID NO: 357828 - RNA, 19 nt, Homo sapiens
ggcaagacgcugcacauca

SEQ ID NO: 357829 - RNA, 19 nt, Homo sapiens
gugacgcccuccuccaaga

SEQ ID NO: 357830 - RNA, 19 nt, Homo sapiens
gagaauggcauggaugucu

SEQ ID NO: 357831 - RNA, 19 nt, Homo sapiens
ccaaagagaauggcaugga

SEQ ID NO: 357832 - RNA, 19 nt, Homo sapiens
caggagaacauccgcauca

SEQ ID NO: 357833 - RNA, 19 nt, Homo sapiens
ccugaauacucgccucuuc

SEQ ID NO: 357834 - RNA, 19 nt, Homo sapiens
ggacuccccuggacacaga

SEQ ID NO: 357835 - RNA, 19 nt, Homo sapiens
ugcagaaugugcucaacaa

SEQ ID NO: 357836 - RNA, 19 nt, Homo sapiens
gccggaagaugugcucuca

SEQ ID NO: 357837 - RNA, 19 nt, Homo sapiens
gcgcacccacgaucucaaa

SEQ ID NO: 357838 - RNA, 19 nt, Homo sapiens
gagagcugaccaaacacua

SEQ ID NO: 357839 - RNA, 19 nt, Homo sapiens
gcucucagcagcuauguac

SEQ ID NO: 357840 - RNA, 19 nt, Homo sapiens
ugucugggaugacuucaca

SEQ ID NO: 357841 - RNA, 19 nt, Homo sapiens
ucaacuacuugcccaacau

SEQ ID NO: 357842 - RNA, 19 nt, Homo sapiens
agaauggcauggaugucuu

SEQ ID NO: 357843 - RNA, 19 nt, Homo sapiens
ccagaagguggucgagauu

SEQ ID NO: 357844 - RNA, 19 nt, Homo sapiens
gcagggguccgguuuauug

SEQ ID NO: 357845 - RNA, 19 nt, Homo sapiens
gcgcguguuugacuacagu

SEQ ID NO: 357846 - RNA, 19 nt, Homo sapiens
cugugaaacucgcuaaaca

SEQ ID NO: 357847 - RNA, 19 nt, Homo sapiens
ggccaaggagaacaacgua

SEQ ID NO: 357848 - RNA, 19 nt, Homo sapiens
caacucggacguguaugaa

SEQ ID NO: 357849 - RNA, 19 nt, Homo sapiens
gaaguggccaaagagaaug

SEQ ID NO: 357850 - RNA, 19 nt, Homo sapiens
gcugugggcuacaccaacu

SEQ ID NO: 357851 - RNA, 19 nt, Homo sapiens
ccaugcgcuuccuguauga

SEQ ID NO: 357852 - RNA, 19 nt, Homo sapiens
cagaagugguccgcaagau

SEQ ID NO: 357853 - RNA, 19 nt, Homo sapiens
gaugggaaauggccaaaag

SEQ ID NO: 357854 - RNA, 19 nt, Homo sapiens
gugaaguggccaaagagaa

SEQ ID NO: 357855 - RNA, 19 nt, Homo sapiens
ucccagacaucaucaaggu

SEQ ID NO: 357856 - RNA, 19 nt, Homo sapiens
cgccugcggugguucauuc

SEQ ID NO: 357857 - RNA, 19 nt, Homo sapiens
ggacgugaagggccagauc

SEQ ID NO: 357858 - RNA, 19 nt, Homo sapiens
guugggcucuuucuuccau

SEQ ID NO: 357859 - RNA, 19 nt, Homo sapiens
caacuacuugcccaacaug

SEQ ID NO: 357860 - RNA, 19 nt, Homo sapiens
guucaucucuugccaaaua

SEQ ID NO: 357861 - RNA, 19 nt, Homo sapiens
gaaagcagaugaagccuau

SEQ ID NO: 357862 - RNA, 19 nt, Homo sapiens
ggacuucacugccaccuuu

SEQ ID NO: 357863 - RNA, 19 nt, Homo sapiens
gcaagacgcugcacaucaa

SEQ ID NO: 357864 - RNA, 19 nt, Homo sapiens
ggauuaaccuagaacauca

SEQ ID NO: 357865 - RNA, 19 nt, Homo sapiens
gcggacagcugcuuacaug

SEQ ID NO: 357866 - RNA, 19 nt, Homo sapiens
gagcugaugugguggaugu

SEQ ID NO: 357867 - RNA, 19 nt, Homo sapiens
gcucuaagguacugaagga

SEQ ID NO: 357868 - RNA, 19 nt, Homo sapiens
ggaacauccugcaccugua

SEQ ID NO: 357869 - RNA, 19 nt, Homo sapiens
ggacagcugcuuacauguu

SEQ ID NO: 357870 - RNA, 19 nt, Homo sapiens
acacagaggugcccaugga

SEQ ID NO: 357871 - RNA, 19 nt, Homo sapiens
caaagagaauggcauggau

SEQ ID NO: 357872 - RNA, 19 nt, Homo sapiens
caagaucgcagaggaguuu

SEQ ID NO: 357873 - RNA, 19 nt, Homo sapiens
gguggaggcugccaucuca

SEQ ID NO: 357874 - RNA, 19 nt, Homo sapiens
gcaacucggacguguauga

SEQ ID NO: 357875 - RNA, 19 nt, Homo sapiens
cugggaaguuuacucaaua

SEQ ID NO: 357876 - RNA, 19 nt, Homo sapiens
gcacaucccagacaucauc

SEQ ID NO: 357877 - RNA, 19 nt, Homo sapiens
agaggcaggucuucuuuga

SEQ ID NO: 357878 - RNA, 19 nt, Homo sapiens
gccaugcgcuuccuguaug

SEQ ID NO: 357879 - RNA, 19 nt, Homo sapiens
acgaggagcuggaggagaa

SEQ ID NO: 357880 - RNA, 19 nt, Homo sapiens
gacagcugcuuacauguuc

SEQ ID NO: 357881 - RNA, 19 nt, Homo sapiens
aguauaagcccaucaagaa

SEQ ID NO: 357882 - RNA, 19 nt, Homo sapiens
gaguauaagcccaucaaga

SEQ ID NO: 357883 - RNA, 19 nt, Homo sapiens
caacguggucuucaaguuc

SEQ ID NO: 357884 - RNA, 19 nt, Homo sapiens
uggagaaguucaucgagaa

SEQ ID NO: 357885 - RNA, 19 nt, Homo sapiens
gcaugaggcccacgaguuc

SEQ ID NO: 357886 - RNA, 19 nt, Homo sapiens
gcuacggguuccucucuga

SEQ ID NO: 357887 - RNA, 19 nt, Homo sapiens
guauaagcccaucaagaaa

SEQ ID NO: 357888 - RNA, 19 nt, Homo sapiens
ucagcaagcucuucagcau

SEQ ID NO: 357889 - RNA, 19 nt, Homo sapiens
ggaacaguguggccucucu

SEQ ID NO: 357890 - RNA, 19 nt, Homo sapiens
ccauggagcgcguguuuga

SEQ ID NO: 357891 - RNA, 19 nt, Homo sapiens
ugggaaguuuacucaauaa

SEQ ID NO: 357892 - RNA, 19 nt, Homo sapiens
ccaaggagaacaacguaga

SEQ ID NO: 357893 - RNA, 19 nt, Homo sapiens
ucugugaaguggccaaaga

SEQ ID NO: 357894 - RNA, 19 nt, Homo sapiens
cccaaaagcuguugcacua

SEQ ID NO: 357895 - RNA, 19 nt, Homo sapiens
ggagaucaccgacguagac

SEQ ID NO: 357896 - RNA, 19 nt, Homo sapiens
ccugggaaguuuacucaau

SEQ ID NO: 357897 - RNA, 19 nt, Homo sapiens
ccagaggcaggucuucuuu

SEQ ID NO: 357898 - RNA, 19 nt, Homo sapiens
ugaaguggccaaagagaau

SEQ ID NO: 357899 - RNA, 19 nt, Homo sapiens
acaacguggucuucaaguu

SEQ ID NO: 357900 - RNA, 19 nt, Homo sapiens
agaaugugcucaacaacca

SEQ ID NO: 357901 - RNA, 19 nt, Homo sapiens
cuaaacaggugggcuacga

SEQ ID NO: 357902 - RNA, 19 nt, Homo sapiens
gcugggcgaucucaucaag

SEQ ID NO: 357903 - RNA, 19 nt, Homo sapiens
ggaugucuuccguguguuu

SEQ ID NO: 357904 - RNA, 19 nt, Homo sapiens
gcacggcaagcacuacuuc

SEQ ID NO: 357905 - RNA, 19 nt, Homo sapiens
caccagcgacucugugaaa

SEQ ID NO: 357906 - RNA, 19 nt, Homo sapiens
gaacauccugcaccuguac

SEQ ID NO: 357907 - RNA, 19 nt, Homo sapiens
cagaccaccugccgugaug

SEQ ID NO: 357908 - RNA, 19 nt, Homo sapiens
ucaucaagguggccaagga

SEQ ID NO: 357909 - RNA, 19 nt, Homo sapiens
gagauugccauccgugugu

SEQ ID NO: 357910 - RNA, 19 nt, Homo sapiens
gggauuaaccuagaacauc

SEQ ID NO: 357911 - RNA, 19 nt, Homo sapiens
gcccauggagcgcguguuu

SEQ ID NO: 357912 - RNA, 19 nt, Homo sapiens
ggaccaguaugggaacauc

SEQ ID NO: 357913 - RNA, 19 nt, Homo sapiens
ggagaacaacguagaugca

SEQ ID NO: 357914 - RNA, 19 nt, Homo sapiens
gcaagguucaugugaccaa

SEQ ID NO: 357915 - RNA, 19 nt, Homo sapiens
gcacggccaccaugaaguc

SEQ ID NO: 357916 - RNA, 19 nt, Homo sapiens
ugaggguggugcacagcua

SEQ ID NO: 357917 - RNA, 19 nt, Homo sapiens
gcuuacauguucaucucuu

SEQ ID NO: 357918 - RNA, 19 nt, Homo sapiens
ggacaugacacuggaaggu

SEQ ID NO: 357919 - RNA, 19 nt, Homo sapiens
ggcaagacgcugcacauca

SEQ ID NO: 357920 - RNA, 19 nt, Homo sapiens
gugacgcccuccuccaaga

SEQ ID NO: 357921 - RNA, 19 nt, Homo sapiens
gagaauggcauggaugucu

SEQ ID NO: 357922 - RNA, 19 nt, Homo sapiens
ccaaagagaauggcaugga

SEQ ID NO: 357923 - RNA, 19 nt, Homo sapiens
caggagaacauccgcauca

SEQ ID NO: 357924 - RNA, 19 nt, Homo sapiens
ccugaauacucgccucuuc

SEQ ID NO: 357925 - RNA, 19 nt, Homo sapiens
ggacuccccuggacacaga

SEQ ID NO: 357926 - RNA, 19 nt, Homo sapiens
ugcagaaugugcucaacaa

SEQ ID NO: 357927 - RNA, 19 nt, Homo sapiens
gccggaagaugugcucuca

SEQ ID NO: 357928 - RNA, 19 nt, Homo sapiens
gcgcacccacgaucucaaa

SEQ ID NO: 357929 - RNA, 19 nt, Homo sapiens
gcucucagcagcuauguac

SEQ ID NO: 357930 - RNA, 19 nt, Homo sapiens
ugucugggaugacuucaca

SEQ ID NO: 357931 - RNA, 19 nt, Homo sapiens
ucaacuacuugcccaacau

SEQ ID NO: 357932 - RNA, 19 nt, Homo sapiens
agaauggcauggaugucuu

SEQ ID NO: 357933 - RNA, 19 nt, Homo sapiens
ccagaagguggucgagauu

SEQ ID NO: 357934 - RNA, 19 nt, Homo sapiens
gcagggguccgguuuauug

SEQ ID NO: 357935 - RNA, 19 nt, Homo sapiens
gcgcguguuugacuacagu

SEQ ID NO: 357936 - RNA, 19 nt, Homo sapiens
cugugaaacucgcuaaaca

SEQ ID NO: 357937 - RNA, 19 nt, Homo sapiens
ggccaaggagaacaacgua

SEQ ID NO: 357938 - RNA, 19 nt, Homo sapiens
caacucggacguguaugaa

SEQ ID NO: 357939 - RNA, 19 nt, Homo sapiens
gaaguggccaaagagaaug

SEQ ID NO: 357940 - RNA, 19 nt, Homo sapiens
gcugugggcuacaccaacu

SEQ ID NO: 357941 - RNA, 19 nt, Homo sapiens
ccaugcgcuuccuguauga

SEQ ID NO: 357942 - RNA, 19 nt, Homo sapiens
cagaagugguccgcaagau

SEQ ID NO: 357943 - RNA, 19 nt, Homo sapiens
ucccagacaucaucaaggu

SEQ ID NO: 357944 - RNA, 19 nt, Homo sapiens
gugaaguggccaaagagaa

SEQ ID NO: 357945 - RNA, 19 nt, Homo sapiens
cgccugcggugguucauuc

SEQ ID NO: 357946 - RNA, 19 nt, Homo sapiens
ggacgugaagggccagauc

SEQ ID NO: 357947 - RNA, 19 nt, Homo sapiens
caacuacuugcccaacaug

SEQ ID NO: 357948 - RNA, 19 nt, Homo sapiens
ugcaggcacuggagaagga

SEQ ID NO: 357949 - RNA, 19 nt, Homo sapiens
ggacguguaugaaaaugag

SEQ ID NO: 357950 - RNA, 19 nt, Homo sapiens
gauuccaugucugggauga

SEQ ID NO: 357951 - RNA, 19 nt, Homo sapiens
gcccacgaguucuccaaca

SEQ ID NO: 357952 - RNA, 19 nt, Homo sapiens
uauaagcccaucaagaaag

SEQ ID NO: 357953 - RNA, 19 nt, Homo sapiens
cgauguguuugcccacuuc

SEQ ID NO: 357954 - RNA, 19 nt, Homo sapiens
caaggagaacaacguagau

SEQ ID NO: 357955 - RNA, 19 nt, Homo sapiens
uggaggcugccaucucaua

SEQ ID NO: 357956 - RNA, 19 nt, Homo sapiens
ggccaacagaggugagauu

SEQ ID NO: 357957 - RNA, 19 nt, Homo sapiens
cagcgacucugugaaacuc

SEQ ID NO: 357958 - RNA, 19 nt, Homo sapiens
acaucgaggugcagaucuu

SEQ ID NO: 357959 - RNA, 19 nt, Homo sapiens
gggcgcuguuuguggagaa

SEQ ID NO: 357960 - RNA, 19 nt, Homo sapiens
caacuucccagcaacaaua

SEQ ID NO: 357961 - RNA, 19 nt, Homo sapiens
ugaauaaacucuccccuuu

SEQ ID NO: 357962 - RNA, 19 nt, Homo sapiens
caagcaguuucauuucaaa

SEQ ID NO: 357963 - RNA, 19 nt, Homo sapiens
gguuuaacguguacaacaa

SEQ ID NO: 357964 - RNA, 19 nt, Homo sapiens
ucaagcaguuucauuucaa

SEQ ID NO: 357965 - RNA, 19 nt, Homo sapiens
acauaaaccuggccagcuu

SEQ ID NO: 357966 - RNA, 19 nt, Homo sapiens
cugaaugguuuaacgugua

SEQ ID NO: 357967 - RNA, 19 nt, Homo sapiens
ccagcaacaauaaugauuu

SEQ ID NO: 357968 - RNA, 19 nt, Homo sapiens
ccaccaacaccaggaauuu

SEQ ID NO: 357969 - RNA, 19 nt, Homo sapiens
caccaggaauuuagaccuu

SEQ ID NO: 357970 - RNA, 19 nt, Homo sapiens
gacccugcccuuccucuuu

SEQ ID NO: 357971 - RNA, 19 nt, Homo sapiens
gcaguuucauuucaaagac

SEQ ID NO: 357972 - RNA, 19 nt, Homo sapiens
caccaacaccaggaauuua

SEQ ID NO: 357973 - RNA, 19 nt, Homo sapiens
cagcuucaucgaacaagua

SEQ ID NO: 357974 - RNA, 19 nt, Homo sapiens
caaguagcaguguccauga

SEQ ID NO: 357975 - RNA, 19 nt, Homo sapiens
gggcucuguuacacuaauu

SEQ ID NO: 357976 - RNA, 19 nt, Homo sapiens
gcaccacucucuucauccu

SEQ ID NO: 357977 - RNA, 19 nt, Homo sapiens
gcugagcacccaugagugu

SEQ ID NO: 357978 - RNA, 19 nt, Homo sapiens
uuucagaacgggacauaaa

SEQ ID NO: 357979 - RNA, 19 nt, Homo sapiens
guacaacaagguccacauc

SEQ ID NO: 357980 - RNA, 19 nt, Homo sapiens
uaaacucuccccuuucuuu

SEQ ID NO: 357981 - RNA, 19 nt, Homo sapiens
gccuuuggguucaugacaa

SEQ ID NO: 357982 - RNA, 19 nt, Homo sapiens
gcaacuucccagcaacaau

SEQ ID NO: 357983 - RNA, 19 nt, Homo sapiens
ucuucaagcaguuucauuu

SEQ ID NO: 357984 - RNA, 19 nt, Homo sapiens
cugcaccacucucuucauc

SEQ ID NO: 357985 - RNA, 19 nt, Homo sapiens
ugaaugguuuaacguguac

SEQ ID NO: 357986 - RNA, 19 nt, Homo sapiens
gagcuggaaggccgugaug

SEQ ID NO: 357987 - RNA, 19 nt, Homo sapiens
uucaagcaguuucauuuca

SEQ ID NO: 357988 - RNA, 19 nt, Homo sapiens
gcucuguuacacuaauuug

SEQ ID NO: 357989 - RNA, 19 nt, Homo sapiens
gaaacuggaccaccauccu

SEQ ID NO: 357990 - RNA, 19 nt, Homo sapiens
ccaacaccaggaauuuaga

SEQ ID NO: 357991 - RNA, 19 nt, Homo sapiens
aaaccuggccagcuucauc

SEQ ID NO: 357992 - RNA, 19 nt, Homo sapiens
ccaggaauuuagaccuuuu

SEQ ID NO: 357993 - RNA, 19 nt, Homo sapiens
gcccuuccucuuugaauuc

SEQ ID NO: 357994 - RNA, 19 nt, Homo sapiens
acaacaagguccacaucac

SEQ ID NO: 357995 - RNA, 19 nt, Homo sapiens
acccugcccuuccucuuug

SEQ ID NO: 357996 - RNA, 19 nt, Homo sapiens
cauccugaaugguuuaacg

SEQ ID NO: 357997 - RNA, 19 nt, Homo sapiens
gaacucaccauuccaaaua

SEQ ID NO: 357998 - RNA, 19 nt, Homo sapiens
gaaaguggacuaaauguga

SEQ ID NO: 357999 - RNA, 19 nt, Homo sapiens
uaacuuaauuggcugcaua

SEQ ID NO: 358000 - RNA, 19 nt, Homo sapiens
ccaaagacuugaccacgua

SEQ ID NO: 358001 - RNA, 19 nt, Homo sapiens
guggaaggcuccucuggua

SEQ ID NO: 358002 - RNA, 19 nt, Homo sapiens
ggucagugauuccagguuu

SEQ ID NO: 358003 - RNA, 19 nt, Homo sapiens
gaaguaggaagcaucauug

SEQ ID NO: 358004 - RNA, 19 nt, Homo sapiens
ggaaguaggaagcaucauu

SEQ ID NO: 358005 - RNA, 19 nt, Homo sapiens
gguguaagaucaaagagau

SEQ ID NO: 358006 - RNA, 19 nt, Homo sapiens
ggaauuguccggagagaau

SEQ ID NO: 358007 - RNA, 19 nt, Homo sapiens
uaucauccgcuaagaauuu

SEQ ID NO: 358008 - RNA, 19 nt, Homo sapiens
gaaaggcuauugggcaagu

SEQ ID NO: 358009 - RNA, 19 nt, Homo sapiens
gggaaaggcggguguaaga

SEQ ID NO: 358010 - RNA, 19 nt, Homo sapiens
gauaucaacagcuccauga

SEQ ID NO: 358011 - RNA, 19 nt, Homo sapiens
ccaccaaugccaucuuuaa

SEQ ID NO: 358012 - RNA, 19 nt, Homo sapiens
augcugggauccauauuua

SEQ ID NO: 358013 - RNA, 19 nt, Homo sapiens
uguaauuucuggucaguga

SEQ ID NO: 358014 - RNA, 19 nt, Homo sapiens
uuaauuggcugcauaaucg

SEQ ID NO: 358015 - RNA, 19 nt, Homo sapiens
gcacggaaaggaaguagga

SEQ ID NO: 358016 - RNA, 19 nt, Homo sapiens
gaaaggcggguguaagauc

SEQ ID NO: 358017 - RNA, 19 nt, Homo sapiens
gaaaggaaguaggaagcau

SEQ ID NO: 358018 - RNA, 19 nt, Homo sapiens
gacugaaaguggacuaaau

SEQ ID NO: 358019 - RNA, 19 nt, Homo sapiens
aaagagauccgcgagagua

SEQ ID NO: 358020 - RNA, 19 nt, Homo sapiens
ucgacaagcuggaggaaga

SEQ ID NO: 358021 - RNA, 19 nt, Homo sapiens
gggagucgguuaagaggau

SEQ ID NO: 358022 - RNA, 19 nt, Homo sapiens
ggacuaaaugugacucuca

SEQ ID NO: 358023 - RNA, 19 nt, Homo sapiens
ugauccaacuguguaauuu

SEQ ID NO: 358024 - RNA, 19 nt, Homo sapiens
gcgccaacauuaaugagau

SEQ ID NO: 358025 - RNA, 19 nt, Homo sapiens
cuagaugccuacucgauuc

SEQ ID NO: 358026 - RNA, 19 nt, Homo sapiens
gaagcaucauugggaagaa

SEQ ID NO: 358027 - RNA, 19 nt, Homo sapiens
ucaguuuaguucuguaaug

SEQ ID NO: 358028 - RNA, 19 nt, Homo sapiens
ugggauccauauuuaguuu

SEQ ID NO: 358029 - RNA, 19 nt, Homo sapiens
caguguagguucccucaau

SEQ ID NO: 358030 - RNA, 19 nt, Homo sapiens
caaggacaacacaccauuu

SEQ ID NO: 358031 - RNA, 19 nt, Homo sapiens
ggacaacacaccauuucuc

SEQ ID NO: 358032 - RNA, 19 nt, Homo sapiens
gggauaugcugcccaacuc

SEQ ID NO: 358033 - RNA, 19 nt, Homo sapiens
aaaggcggguguaagauca

SEQ ID NO: 358034 - RNA, 19 nt, Homo sapiens
ggaagcaucauugggaaga

SEQ ID NO: 358035 - RNA, 19 nt, Homo sapiens
guuuaguucuguaauguca

SEQ ID NO: 358036 - RNA, 19 nt, Homo sapiens
uguaagaguggaauguuaa

SEQ ID NO: 358037 - RNA, 19 nt, Homo sapiens
caccauuccaaauaacuua

SEQ ID NO: 358038 - RNA, 19 nt, Homo sapiens
auguaagaguggaauguua

SEQ ID NO: 358039 - RNA, 19 nt, Homo sapiens
aguguagguucccucaaua

SEQ ID NO: 358040 - RNA, 19 nt, Homo sapiens
ugaaccagguggcaagaca

SEQ ID NO: 358041 - RNA, 19 nt, Homo sapiens
caguuuaguucuguaaugu

SEQ ID NO: 358042 - RNA, 19 nt, Homo sapiens
uuaaugagauccgccagau

SEQ ID NO: 358043 - RNA, 19 nt, Homo sapiens
cagugcggcucccugauug

SEQ ID NO: 358044 - RNA, 19 nt, Homo sapiens
ccagugcggcucccugauu

SEQ ID NO: 358045 - RNA, 19 nt, Homo sapiens
cuacucaaaccacccauga

SEQ ID NO: 358046 - RNA, 19 nt, Homo sapiens
ucaaggacaacacaccauu

SEQ ID NO: 358047 - RNA, 19 nt, Homo sapiens
uuggaugcaucuacucaaa

SEQ ID NO: 358048 - RNA, 19 nt, Homo sapiens
gaaccagguggcaagacaa

SEQ ID NO: 358049 - RNA, 19 nt, Homo sapiens
gggagagucaugaccauuc

SEQ ID NO: 358050 - RNA, 19 nt, Homo sapiens
ccauucggcuucuuaugca

SEQ ID NO: 358051 - RNA, 19 nt, Homo sapiens
cuuuaaggcuuucgcuaug

SEQ ID NO: 358052 - RNA, 19 nt, Homo sapiens
cccaguaucuaaucaaugc

SEQ ID NO: 358053 - RNA, 19 nt, Homo sapiens
ggcccaguaucuaaucaau

SEQ ID NO: 358054 - RNA, 19 nt, Homo sapiens
aaugagauccgccagaugu

SEQ ID NO: 358055 - RNA, 19 nt, Homo sapiens
gagugugucaagcagauuu

SEQ ID NO: 358056 - RNA, 19 nt, Homo sapiens
aagcaucauugggaagaaa

SEQ ID NO: 358057 - RNA, 19 nt, Homo sapiens
gguaggcagguuacuauca

SEQ ID NO: 358058 - RNA, 19 nt, Homo sapiens
ggaaaggcggguguaagau

SEQ ID NO: 358059 - RNA, 19 nt, Homo sapiens
uauaagcuuuucccuguuu

SEQ ID NO: 358060 - RNA, 19 nt, Homo sapiens
aaaaucacauucucuguuc

SEQ ID NO: 358061 - RNA, 19 nt, Homo sapiens
gauccaacuguguaauuuc

SEQ ID NO: 358062 - RNA, 19 nt, Homo sapiens
guaggcagguuacuaucac

SEQ ID NO: 358063 - RNA, 19 nt, Homo sapiens
ggagagucaugaccauucc

SEQ ID NO: 358064 - RNA, 19 nt, Homo sapiens
ggaaaggaaguaggaagca

SEQ ID NO: 358065 - RNA, 19 nt, Homo sapiens
gcugggauccauauuuagu

SEQ ID NO: 358066 - RNA, 19 nt, Homo sapiens
caaagacuugaccacguaa

SEQ ID NO: 358067 - RNA, 19 nt, Homo sapiens
gccaggcuuuccucugaga

SEQ ID NO: 358068 - RNA, 19 nt, Homo sapiens
augccaggcuuuccucuga

SEQ ID NO: 358069 - RNA, 19 nt, Homo sapiens
guuaaugcugggauccaua

SEQ ID NO: 358070 - RNA, 19 nt, Homo sapiens
caacuuuaucauccgcuaa

SEQ ID NO: 358071 - RNA, 19 nt, Homo sapiens
ggaugcaucuacucaaacc

SEQ ID NO: 358072 - RNA, 19 nt, Homo sapiens
guaagaguggaauguuaau

SEQ ID NO: 358073 - RNA, 19 nt, Homo sapiens
uaauuucuggucagugauu

SEQ ID NO: 358074 - RNA, 19 nt, Homo sapiens
guguagguucccucaauaa

SEQ ID NO: 358075 - RNA, 19 nt, Homo sapiens
caugaacucaccauuccaa

SEQ ID NO: 358076 - RNA, 19 nt, Homo sapiens
ggaugccggugugacugaa

SEQ ID NO: 358077 - RNA, 19 nt, Homo sapiens
uguaaguguucaguuucua

SEQ ID NO: 358078 - RNA, 19 nt, Homo sapiens
ugaaaguggacuaaaugug

SEQ ID NO: 358079 - RNA, 19 nt, Homo sapiens
ucaaaccacccaugaacuc

SEQ ID NO: 358080 - RNA, 19 nt, Homo sapiens
ccgagugugucaagcagau

SEQ ID NO: 358081 - RNA, 19 nt, Homo sapiens
gacaagcuggaggaagaua

SEQ ID NO: 358082 - RNA, 19 nt, Homo sapiens
ucgcuaugaucaucgacaa

SEQ ID NO: 358083 - RNA, 19 nt, Homo sapiens
uuuaaggcuuucgcuauga

SEQ ID NO: 358084 - RNA, 19 nt, Homo sapiens
cccaugauccaacugugua

SEQ ID NO: 358085 - RNA, 19 nt, Homo sapiens
aacucaccauuccaaauaa

SEQ ID NO: 358086 - RNA, 19 nt, Homo sapiens
ugacugaaaguggacuaaa

SEQ ID NO: 358087 - RNA, 19 nt, Homo sapiens
gcggguguaagaucaaaga

SEQ ID NO: 358088 - RNA, 19 nt, Homo sapiens
uuaaggcuuucgcuaugau

SEQ ID NO: 358089 - RNA, 19 nt, Homo sapiens
cauccgcuaagaauuuaaa

SEQ ID NO: 358090 - RNA, 19 nt, Homo sapiens
ugaacucaccauuccaaau

SEQ ID NO: 358091 - RNA, 19 nt, Homo sapiens
cagucucacuuugccauga

SEQ ID NO: 358092 - RNA, 19 nt, Homo sapiens
gacaacagucucacuuugc

SEQ ID NO: 358093 - RNA, 19 nt, Homo sapiens
cuacucgauucaaggacaa

SEQ ID NO: 358094 - RNA, 19 nt, Homo sapiens
ucuagaugccuacucgauu

SEQ ID NO: 358095 - RNA, 19 nt, Homo sapiens
gcagauuugccuggucaug

SEQ ID NO: 358096 - RNA, 19 nt, Homo sapiens
caaagagauccgcgagagu

SEQ ID NO: 358097 - RNA, 19 nt, Homo sapiens
gaagguggauuaaauguca

SEQ ID NO: 358098 - RNA, 19 nt, Homo sapiens
gaaaggaaguuggcaguau

SEQ ID NO: 358099 - RNA, 19 nt, Homo sapiens
gaacacugcucgacaugga

SEQ ID NO: 358100 - RNA, 19 nt, Homo sapiens
gagaaucaguuaagaagau

SEQ ID NO: 358101 - RNA, 19 nt, Homo sapiens
gaagggaauuguccugaga

SEQ ID NO: 358102 - RNA, 19 nt, Homo sapiens
gauugaagguggauuaaau

SEQ ID NO: 358103 - RNA, 19 nt, Homo sapiens
caaugcagauucauccaua

SEQ ID NO: 358104 - RNA, 19 nt, Homo sapiens
guggaaggaucuacugaua

SEQ ID NO: 358105 - RNA, 19 nt, Homo sapiens
ugaccaagcugcaccaguu

SEQ ID NO: 358106 - RNA, 19 nt, Homo sapiens
ggaaggaucuacugauagg

SEQ ID NO: 358107 - RNA, 19 nt, Homo sapiens
gaaaggagaaucaguuaag

SEQ ID NO: 358108 - RNA, 19 nt, Homo sapiens
ccaaagacuugaccacuca

SEQ ID NO: 358109 - RNA, 19 nt, Homo sapiens
gaugcaagaucaaggaaau

SEQ ID NO: 358110 - RNA, 19 nt, Homo sapiens
ggaauuguccugagagaau

SEQ ID NO: 358111 - RNA, 19 nt, Homo sapiens
gggagcagcuagaacaaug

SEQ ID NO: 358112 - RNA, 19 nt, Homo sapiens
uagcacagcugccaguaga

SEQ ID NO: 358113 - RNA, 19 nt, Homo sapiens
aaagguggaugcaagauca

SEQ ID NO: 358114 - RNA, 19 nt, Homo sapiens
caguguggcucucucauug

SEQ ID NO: 358115 - RNA, 19 nt, Homo sapiens
aaagaaaggagaaucaguu

SEQ ID NO: 358116 - RNA, 19 nt, Homo sapiens
agucagcgauuccagguuu

SEQ ID NO: 358117 - RNA, 19 nt, Homo sapiens
cuagaacaaugcagauuca

SEQ ID NO: 358118 - RNA, 19 nt, Homo sapiens
ugagagaauuaucacuuug

SEQ ID NO: 358119 - RNA, 19 nt, Homo sapiens
cugagagaauuaucacuuu

SEQ ID NO: 358120 - RNA, 19 nt, Homo sapiens
ggaaaggaaguuggcagua

SEQ ID NO: 358121 - RNA, 19 nt, Homo sapiens
caacaucucagaagggaau

SEQ ID NO: 358122 - RNA, 19 nt, Homo sapiens
ggagaguggugcacguauc

SEQ ID NO: 358123 - RNA, 19 nt, Homo sapiens
gaaagaaaggagaaucagu

SEQ ID NO: 358124 - RNA, 19 nt, Homo sapiens
ccagaacacugcucgacau

SEQ ID NO: 358125 - RNA, 19 nt, Homo sapiens
ucaaugagauccgucagau

SEQ ID NO: 358126 - RNA, 19 nt, Homo sapiens
gcaguaucaucggaaagaa

SEQ ID NO: 358127 - RNA, 19 nt, Homo sapiens
cuagaggccuauaccauuc

SEQ ID NO: 358128 - RNA, 19 nt, Homo sapiens
aagaaaggagaaucaguua

SEQ ID NO: 358129 - RNA, 19 nt, Homo sapiens
aaaggagaaucaguuaaga

SEQ ID NO: 358130 - RNA, 19 nt, Homo sapiens
ucagacuacuucucaugaa

SEQ ID NO: 358131 - RNA, 19 nt, Homo sapiens
gaucauugacaaacuggaa

SEQ ID NO: 358132 - RNA, 19 nt, Homo sapiens
cgauuugauuggcugcaua

SEQ ID NO: 358133 - RNA, 19 nt, Homo sapiens
gaacucaccauuccaaacg

SEQ ID NO: 358134 - RNA, 19 nt, Homo sapiens
ccacuaaugccaucuucaa

SEQ ID NO: 358135 - RNA, 19 nt, Homo sapiens
aaaggaaguuggcaguauc

SEQ ID NO: 358136 - RNA, 19 nt, Homo sapiens
caaacuggaagaggacaua

SEQ ID NO: 358137 - RNA, 19 nt, Homo sapiens
ggagaaucaguuaagaaga

SEQ ID NO: 358138 - RNA, 19 nt, Homo sapiens
gcuagaacaaugcagauuc

SEQ ID NO: 358139 - RNA, 19 nt, Homo sapiens
gaucugcguggucauguug

SEQ ID NO: 358140 - RNA, 19 nt, Homo sapiens
ugauccaucuguguaguuu

SEQ ID NO: 358141 - RNA, 19 nt, Homo sapiens
gauuugauuggcugcauaa

SEQ ID NO: 358142 - RNA, 19 nt, Homo sapiens
gaaauacgagagaguacag

SEQ ID NO: 358143 - RNA, 19 nt, Homo sapiens
caagaucaaggaaauacga

SEQ ID NO: 358144 - RNA, 19 nt, Homo sapiens
guggcucucucauuggaaa

SEQ ID NO: 358145 - RNA, 19 nt, Homo sapiens
gagaguggugcacguauca

SEQ ID NO: 358146 - RNA, 19 nt, Homo sapiens
uguaguuucugaacaguca

SEQ ID NO: 358147 - RNA, 19 nt, Homo sapiens
aaugagauccgucagaugu

SEQ ID NO: 358148 - RNA, 19 nt, Homo sapiens
ucaaggacaguaugccauu

SEQ ID NO: 358149 - RNA, 19 nt, Homo sapiens
ucuagaggccuauaccauu

SEQ ID NO: 358150 - RNA, 19 nt, Homo sapiens
ggaaauacgagagaguaca

SEQ ID NO: 358151 - RNA, 19 nt, Homo sapiens
gaggagaguggugcacgua

SEQ ID NO: 358152 - RNA, 19 nt, Homo sapiens
gcucagacuacuucucaug

SEQ ID NO: 358153 - RNA, 19 nt, Homo sapiens
gggauaugcuacccaacuc

SEQ ID NO: 358154 - RNA, 19 nt, Homo sapiens
gauaggcagguuaccauca

SEQ ID NO: 358155 - RNA, 19 nt, Homo sapiens
cagcgacagugcgagcuuu

SEQ ID NO: 358156 - RNA, 19 nt, Homo sapiens
ccuuugcuaugaucauuga

SEQ ID NO: 358157 - RNA, 19 nt, Homo sapiens
ggaaguuggcaguaucauc

SEQ ID NO: 358158 - RNA, 19 nt, Homo sapiens
caaggacaguaugccauuc

SEQ ID NO: 358159 - RNA, 19 nt, Homo sapiens
ggauuaaaugucacucuca

SEQ ID NO: 358160 - RNA, 19 nt, Homo sapiens
gauaugcuacccaacucaa

SEQ ID NO: 358161 - RNA, 19 nt, Homo sapiens
uaugaucauugacaaacug

SEQ ID NO: 358162 - RNA, 19 nt, Homo sapiens
cuaaugccaucuucaaagc

SEQ ID NO: 358163 - RNA, 19 nt, Homo sapiens
ugugauugaagguggauua

SEQ ID NO: 358164 - RNA, 19 nt, Homo sapiens
cccaaccagugaccaaaga

SEQ ID NO: 358165 - RNA, 19 nt, Homo sapiens
gaggacauaagcagcucua

SEQ ID NO: 358166 - RNA, 19 nt, Homo sapiens
gagagaauuaucacuuugg

SEQ ID NO: 358167 - RNA, 19 nt, Homo sapiens
gaagaugcgcgaggagagu

SEQ ID NO: 358168 - RNA, 19 nt, Homo sapiens
ccaucuguguaguuucuga

SEQ ID NO: 358169 - RNA, 19 nt, Homo sapiens
aaugcagauucauccauaa

SEQ ID NO: 358170 - RNA, 19 nt, Homo sapiens
agaaaggagaaucaguuaa

SEQ ID NO: 358171 - RNA, 19 nt, Homo sapiens
ggcaguaucaucggaaaga

SEQ ID NO: 358172 - RNA, 19 nt, Homo sapiens
gcucuccggucaucuuugc

SEQ ID NO: 358173 - RNA, 19 nt, Homo sapiens
ggaugcaagaucaaggaaa

SEQ ID NO: 358174 - RNA, 19 nt, Homo sapiens
cuacacacuuuaucaucca

SEQ ID NO: 358175 - RNA, 19 nt, Homo sapiens
auucauccauaaucccuuu

SEQ ID NO: 358176 - RNA, 19 nt, Homo sapiens
ucaccauuccaaacgauuu

SEQ ID NO: 358177 - RNA, 19 nt, Homo sapiens
agaaucaguuaagaagaug

SEQ ID NO: 358178 - RNA, 19 nt, Homo sapiens
ccugagagaauuaucacuu

SEQ ID NO: 358179 - RNA, 19 nt, Homo sapiens
gaacccaguggaaggaucu

SEQ ID NO: 358180 - RNA, 19 nt, Homo sapiens
aaggaaauacgagagagua

SEQ ID NO: 358181 - RNA, 19 nt, Homo sapiens
ggaaagaaaggagaaucag

SEQ ID NO: 358182 - RNA, 19 nt, Homo sapiens
caugaacucaccauuccaa

SEQ ID NO: 358183 - RNA, 19 nt, Homo sapiens
cggaaagaaaggagaauca

SEQ ID NO: 358184 - RNA, 19 nt, Homo sapiens
cagguggucaggacaggua

SEQ ID NO: 358185 - RNA, 19 nt, Homo sapiens
caucacuauugcuggcauu

SEQ ID NO: 358186 - RNA, 19 nt, Homo sapiens
guguggcucucucauugga

SEQ ID NO: 358187 - RNA, 19 nt, Homo sapiens
ucaguguggcucucucauu

SEQ ID NO: 358188 - RNA, 19 nt, Homo sapiens
gauuccagguuuuaaauag

SEQ ID NO: 358189 - RNA, 19 nt, Homo sapiens
cccaugauccaucugugua

SEQ ID NO: 358190 - RNA, 19 nt, Homo sapiens
uaaucaaugucaggcuuuc

SEQ ID NO: 358191 - RNA, 19 nt, Homo sapiens
gaccaagcugcaccaguug

SEQ ID NO: 358192 - RNA, 19 nt, Homo sapiens
ccauuccacagccagauuu

SEQ ID NO: 358193 - RNA, 19 nt, Homo sapiens
ugagauccgucagaugucu

SEQ ID NO: 358194 - RNA, 19 nt, Homo sapiens
ucucaugaacucaccauuc

SEQ ID NO: 358195 - RNA, 19 nt, Homo sapiens
cagacuacuucucaugaac

SEQ ID NO: 358196 - RNA, 19 nt, Homo sapiens
ggauaugcuacccaacuca

SEQ ID NO: 358197 - RNA, 19 nt, Homo sapiens
gaagguggauuaaauguca

SEQ ID NO: 358198 - RNA, 19 nt, Homo sapiens
gaaaggaaguuggcaguau

SEQ ID NO: 358199 - RNA, 19 nt, Homo sapiens
gaacacugcucgacaugga

SEQ ID NO: 358200 - RNA, 19 nt, Homo sapiens
gagaaucaguuaagaagau

SEQ ID NO: 358201 - RNA, 19 nt, Homo sapiens
gaagggaauuguccugaga

SEQ ID NO: 358202 - RNA, 19 nt, Homo sapiens
gauugaagguggauuaaau

SEQ ID NO: 358203 - RNA, 19 nt, Homo sapiens
caaugcagauucauccaua

SEQ ID NO: 358204 - RNA, 19 nt, Homo sapiens
guggaaggaucuacugaua

SEQ ID NO: 358205 - RNA, 19 nt, Homo sapiens
ugaccaagcugcaccaguu

SEQ ID NO: 358206 - RNA, 19 nt, Homo sapiens
ggaaggaucuacugauagg

SEQ ID NO: 358207 - RNA, 19 nt, Homo sapiens
gaaaggagaaucaguuaag

SEQ ID NO: 358208 - RNA, 19 nt, Homo sapiens
ccaaagacuugaccacuca

SEQ ID NO: 358209 - RNA, 19 nt, Homo sapiens
gaugcaagaucaaggaaau

SEQ ID NO: 358210 - RNA, 19 nt, Homo sapiens
ggaauuguccugagagaau

SEQ ID NO: 358211 - RNA, 19 nt, Homo sapiens
gggagcagcuagaacaaug

SEQ ID NO: 358212 - RNA, 19 nt, Homo sapiens
uagcacagcugccaguaga

SEQ ID NO: 358213 - RNA, 19 nt, Homo sapiens
aaagguggaugcaagauca

SEQ ID NO: 358214 - RNA, 19 nt, Homo sapiens
caguguggcucucucauug

SEQ ID NO: 358215 - RNA, 19 nt, Homo sapiens
aaagaaaggagaaucaguu

SEQ ID NO: 358216 - RNA, 19 nt, Homo sapiens
agucagcgauuccagguuu

SEQ ID NO: 358217 - RNA, 19 nt, Homo sapiens
cuagaacaaugcagauuca

SEQ ID NO: 358218 - RNA, 19 nt, Homo sapiens
ugagagaauuaucacuuug

SEQ ID NO: 358219 - RNA, 19 nt, Homo sapiens
cugagagaauuaucacuuu

SEQ ID NO: 358220 - RNA, 19 nt, Homo sapiens
ggaaaggaaguuggcagua

SEQ ID NO: 358221 - RNA, 19 nt, Homo sapiens
caacaucucagaagggaau

SEQ ID NO: 358222 - RNA, 19 nt, Homo sapiens
ggagaguggugcacguauc

SEQ ID NO: 358223 - RNA, 19 nt, Homo sapiens
gaaagaaaggagaaucagu

SEQ ID NO: 358224 - RNA, 19 nt, Homo sapiens
ccagaacacugcucgacau

SEQ ID NO: 358225 - RNA, 19 nt, Homo sapiens
ucaaugagauccgucagau

SEQ ID NO: 358226 - RNA, 19 nt, Homo sapiens
gcaguaucaucggaaagaa

SEQ ID NO: 358227 - RNA, 19 nt, Homo sapiens
cuagaggccuauaccauuc

SEQ ID NO: 358228 - RNA, 19 nt, Homo sapiens
aagaaaggagaaucaguua

SEQ ID NO: 358229 - RNA, 19 nt, Homo sapiens
aaaggagaaucaguuaaga

SEQ ID NO: 358230 - RNA, 19 nt, Homo sapiens
ucagacuacuucucaugaa

SEQ ID NO: 358231 - RNA, 19 nt, Homo sapiens
gaucauugacaaacuggaa

SEQ ID NO: 358232 - RNA, 19 nt, Homo sapiens
cgauuugauuggcugcaua

SEQ ID NO: 358233 - RNA, 19 nt, Homo sapiens
gaacucaccauuccaaacg

SEQ ID NO: 358234 - RNA, 19 nt, Homo sapiens
ccacuaaugccaucuucaa

SEQ ID NO: 358235 - RNA, 19 nt, Homo sapiens
aaaggaaguuggcaguauc

SEQ ID NO: 358236 - RNA, 19 nt, Homo sapiens
caaacuggaagaggacaua

SEQ ID NO: 358237 - RNA, 19 nt, Homo sapiens
ggagaaucaguuaagaaga

SEQ ID NO: 358238 - RNA, 19 nt, Homo sapiens
gcuagaacaaugcagauuc

SEQ ID NO: 358239 - RNA, 19 nt, Homo sapiens
gaucugcguggucauguug

SEQ ID NO: 358240 - RNA, 19 nt, Homo sapiens
ugauccaucuguguaguuu

SEQ ID NO: 358241 - RNA, 19 nt, Homo sapiens
gauuugauuggcugcauaa

SEQ ID NO: 358242 - RNA, 19 nt, Homo sapiens
gaaauacgagagaguacag

SEQ ID NO: 358243 - RNA, 19 nt, Homo sapiens
caagaucaaggaaauacga

SEQ ID NO: 358244 - RNA, 19 nt, Homo sapiens
guggcucucucauuggaaa

SEQ ID NO: 358245 - RNA, 19 nt, Homo sapiens
gagaguggugcacguauca

SEQ ID NO: 358246 - RNA, 19 nt, Homo sapiens
uguaguuucugaacaguca

SEQ ID NO: 358247 - RNA, 19 nt, Homo sapiens
aaugagauccgucagaugu

SEQ ID NO: 358248 - RNA, 19 nt, Homo sapiens
ucaaggacaguaugccauu

SEQ ID NO: 358249 - RNA, 19 nt, Homo sapiens
ucuagaggccuauaccauu

SEQ ID NO: 358250 - RNA, 19 nt, Homo sapiens
ggaaauacgagagaguaca

SEQ ID NO: 358251 - RNA, 19 nt, Homo sapiens
gaggagaguggugcacgua

SEQ ID NO: 358252 - RNA, 19 nt, Homo sapiens
gcucagacuacuucucaug

SEQ ID NO: 358253 - RNA, 19 nt, Homo sapiens
gggauaugcuacccaacuc

SEQ ID NO: 358254 - RNA, 19 nt, Homo sapiens
gauaggcagguuaccauca

SEQ ID NO: 358255 - RNA, 19 nt, Homo sapiens
cagcgacagugcgagcuuu

SEQ ID NO: 358256 - RNA, 19 nt, Homo sapiens
ccuuugcuaugaucauuga

SEQ ID NO: 358257 - RNA, 19 nt, Homo sapiens
ggaaguuggcaguaucauc

SEQ ID NO: 358258 - RNA, 19 nt, Homo sapiens
caaggacaguaugccauuc

SEQ ID NO: 358259 - RNA, 19 nt, Homo sapiens
ggauuaaaugucacucuca

SEQ ID NO: 358260 - RNA, 19 nt, Homo sapiens
gauaugcuacccaacucaa

SEQ ID NO: 358261 - RNA, 19 nt, Homo sapiens
uaugaucauugacaaacug

SEQ ID NO: 358262 - RNA, 19 nt, Homo sapiens
cuaaugccaucuucaaagc

SEQ ID NO: 358263 - RNA, 19 nt, Homo sapiens
ugugauugaagguggauua

SEQ ID NO: 358264 - RNA, 19 nt, Homo sapiens
cccaaccagugaccaaaga

SEQ ID NO: 358265 - RNA, 19 nt, Homo sapiens
gaggacauaagcagcucua

SEQ ID NO: 358266 - RNA, 19 nt, Homo sapiens
gagagaauuaucacuuugg

SEQ ID NO: 358267 - RNA, 19 nt, Homo sapiens
gaagaugcgcgaggagagu

SEQ ID NO: 358268 - RNA, 19 nt, Homo sapiens
ccaucuguguaguuucuga

SEQ ID NO: 358269 - RNA, 19 nt, Homo sapiens
aaugcagauucauccauaa

SEQ ID NO: 358270 - RNA, 19 nt, Homo sapiens
agaaaggagaaucaguuaa

SEQ ID NO: 358271 - RNA, 19 nt, Homo sapiens
ggcaguaucaucggaaaga

SEQ ID NO: 358272 - RNA, 19 nt, Homo sapiens
gcucuccggucaucuuugc

SEQ ID NO: 358273 - RNA, 19 nt, Homo sapiens
ggaugcaagaucaaggaaa

SEQ ID NO: 358274 - RNA, 19 nt, Homo sapiens
cuacacacuuuaucaucca

SEQ ID NO: 358275 - RNA, 19 nt, Homo sapiens
auucauccauaaucccuuu

SEQ ID NO: 358276 - RNA, 19 nt, Homo sapiens
ucaccauuccaaacgauuu

SEQ ID NO: 358277 - RNA, 19 nt, Homo sapiens
agaaucaguuaagaagaug

SEQ ID NO: 358278 - RNA, 19 nt, Homo sapiens
ccugagagaauuaucacuu

SEQ ID NO: 358279 - RNA, 19 nt, Homo sapiens
gaacccaguggaaggaucu

SEQ ID NO: 358280 - RNA, 19 nt, Homo sapiens
aaggaaauacgagagagua

SEQ ID NO: 358281 - RNA, 19 nt, Homo sapiens
ggaaagaaaggagaaucag

SEQ ID NO: 358282 - RNA, 19 nt, Homo sapiens
caugaacucaccauuccaa

SEQ ID NO: 358283 - RNA, 19 nt, Homo sapiens
cggaaagaaaggagaauca

SEQ ID NO: 358284 - RNA, 19 nt, Homo sapiens
cagguggucaggacaggua

SEQ ID NO: 358285 - RNA, 19 nt, Homo sapiens
caucacuauugcuggcauu

SEQ ID NO: 358286 - RNA, 19 nt, Homo sapiens
guguggcucucucauugga

SEQ ID NO: 358287 - RNA, 19 nt, Homo sapiens
ucaguguggcucucucauu

SEQ ID NO: 358288 - RNA, 19 nt, Homo sapiens
gauuccagguuuuaaauag

SEQ ID NO: 358289 - RNA, 19 nt, Homo sapiens
cccaugauccaucugugua

SEQ ID NO: 358290 - RNA, 19 nt, Homo sapiens
uaaucaaugucaggcuuuc

SEQ ID NO: 358291 - RNA, 19 nt, Homo sapiens
gaccaagcugcaccaguug

SEQ ID NO: 358292 - RNA, 19 nt, Homo sapiens
ccauuccacagccagauuu

SEQ ID NO: 358293 - RNA, 19 nt, Homo sapiens
ugagauccgucagaugucu

SEQ ID NO: 358294 - RNA, 19 nt, Homo sapiens
ucucaugaacucaccauuc

SEQ ID NO: 358295 - RNA, 19 nt, Homo sapiens
cagacuacuucucaugaac

SEQ ID NO: 358296 - RNA, 19 nt, Homo sapiens
ggauaugcuacccaacuca

SEQ ID NO: 358297 - RNA, 19 nt, Homo sapiens
gaaauugcaugucggguua

SEQ ID NO: 358298 - RNA, 19 nt, Homo sapiens
gcaagaagaugggcauuaa

SEQ ID NO: 358299 - RNA, 19 nt, Homo sapiens
gaaagagagugcucaauuc

SEQ ID NO: 358300 - RNA, 19 nt, Homo sapiens
gaaauuggcuacccuguca

SEQ ID NO: 358301 - RNA, 19 nt, Homo sapiens
gaaccuggcuucgcccuua

SEQ ID NO: 358302 - RNA, 19 nt, Homo sapiens
agaagaagcugucagaauu

SEQ ID NO: 358303 - RNA, 19 nt, Homo sapiens
gagcuggaaugaaggauuu

SEQ ID NO: 358304 - RNA, 19 nt, Homo sapiens
caagaaugccuguuauuaa

SEQ ID NO: 358305 - RNA, 19 nt, Homo sapiens
gaacaaauuuaugcuggaa

SEQ ID NO: 358306 - RNA, 19 nt, Homo sapiens
gaaaugauccguguugcua

SEQ ID NO: 358307 - RNA, 19 nt, Homo sapiens
gggaaugcuuuauggcuua

SEQ ID NO: 358308 - RNA, 19 nt, Homo sapiens
gaugauagacuacuaauag

SEQ ID NO: 358309 - RNA, 19 nt, Homo sapiens
gagauucccuagugucaaa

SEQ ID NO: 358310 - RNA, 19 nt, Homo sapiens
gcacaaacaagcugauauu

SEQ ID NO: 358311 - RNA, 19 nt, Homo sapiens
cagaugcacuggauaacua

SEQ ID NO: 358312 - RNA, 19 nt, Homo sapiens
gcaguugaaugucggguuu

SEQ ID NO: 358313 - RNA, 19 nt, Homo sapiens
guugaugggucgaaacuaa

SEQ ID NO: 358314 - RNA, 19 nt, Homo sapiens
caagaaauuugugugauug

SEQ ID NO: 358315 - RNA, 19 nt, Homo sapiens
ucaagaaugccuguuauua

SEQ ID NO: 358316 - RNA, 19 nt, Homo sapiens
ugaagcauguucuguacua

SEQ ID NO: 358317 - RNA, 19 nt, Homo sapiens
aagcagagguuaauacaau

SEQ ID NO: 358318 - RNA, 19 nt, Homo sapiens
guacaaggugaauaucuua

SEQ ID NO: 358319 - RNA, 19 nt, Homo sapiens
gauaaucaacucacgcuuu

SEQ ID NO: 358320 - RNA, 19 nt, Homo sapiens
gaagagcgaugggagaaca

SEQ ID NO: 358321 - RNA, 19 nt, Homo sapiens
ugauaauccucgucauaua

SEQ ID NO: 358322 - RNA, 19 nt, Homo sapiens
ggaugaggcugucuguguu

SEQ ID NO: 358323 - RNA, 19 nt, Homo sapiens
ggaggaagcaccaagcauu

SEQ ID NO: 358324 - RNA, 19 nt, Homo sapiens
cgacaagauugaaagcaaa

SEQ ID NO: 358325 - RNA, 19 nt, Homo sapiens
gcugugagauucccuagug

SEQ ID NO: 358326 - RNA, 19 nt, Homo sapiens
uaaaguucauaccguagua

SEQ ID NO: 358327 - RNA, 19 nt, Homo sapiens
ggacacaugcuaaccaaga

SEQ ID NO: 358328 - RNA, 19 nt, Homo sapiens
ugaaagagagugcucaauu

SEQ ID NO: 358329 - RNA, 19 nt, Homo sapiens
cuacaagucuuuugguuua

SEQ ID NO: 358330 - RNA, 19 nt, Homo sapiens
ugaaaucugugcacuguca

SEQ ID NO: 358331 - RNA, 19 nt, Homo sapiens
ggagacaucagcacuaaau

SEQ ID NO: 358332 - RNA, 19 nt, Homo sapiens
gaagaagcugucagaauug

SEQ ID NO: 358333 - RNA, 19 nt, Homo sapiens
gcgacaagauugaaagcaa

SEQ ID NO: 358334 - RNA, 19 nt, Homo sapiens
guaguagcaucaaacaaug

SEQ ID NO: 358335 - RNA, 19 nt, Homo sapiens
gaaagcagagguuaauaca

SEQ ID NO: 358336 - RNA, 19 nt, Homo sapiens
gcuaauagaggagaaauug

SEQ ID NO: 358337 - RNA, 19 nt, Homo sapiens
ggugaaaucugugcacugu

SEQ ID NO: 358338 - RNA, 19 nt, Homo sapiens
caaccaggaagugauauua

SEQ ID NO: 358339 - RNA, 19 nt, Homo sapiens
caagaaccguuacaucuac

SEQ ID NO: 358340 - RNA, 19 nt, Homo sapiens
gaacugaggcacugaagag

SEQ ID NO: 358341 - RNA, 19 nt, Homo sapiens
ggaagugauauuagcauuu

SEQ ID NO: 358342 - RNA, 19 nt, Homo sapiens
ccaagaaccguuacaucua

SEQ ID NO: 358343 - RNA, 19 nt, Homo sapiens
ugacacacaugcuauucaa

SEQ ID NO: 358344 - RNA, 19 nt, Homo sapiens
ggaaguugaugggucgaaa

SEQ ID NO: 358345 - RNA, 19 nt, Homo sapiens
cuaaauuucucuccgaugu

SEQ ID NO: 358346 - RNA, 19 nt, Homo sapiens
auacaagacuccagguuga

SEQ ID NO: 358347 - RNA, 19 nt, Homo sapiens
gaggaagcaccaagcauuu

SEQ ID NO: 358348 - RNA, 19 nt, Homo sapiens
agagagugcucaauucaga

SEQ ID NO: 358349 - RNA, 19 nt, Homo sapiens
gagaagaaccaguuauugg

SEQ ID NO: 358350 - RNA, 19 nt, Homo sapiens
gggaaaggcaugcgcauug

SEQ ID NO: 358351 - RNA, 19 nt, Homo sapiens
gaagaugggcauuaagaca

SEQ ID NO: 358352 - RNA, 19 nt, Homo sapiens
ucagucaucacccaauuua

SEQ ID NO: 358353 - RNA, 19 nt, Homo sapiens
gcagaaggucaagaaauuu

SEQ ID NO: 358354 - RNA, 19 nt, Homo sapiens
agcagaaggucaagaaauu

SEQ ID NO: 358355 - RNA, 19 nt, Homo sapiens
agaagcagguggaaacaug

SEQ ID NO: 358356 - RNA, 19 nt, Homo sapiens
uaaccaagagugagaagaa

SEQ ID NO: 358357 - RNA, 19 nt, Homo sapiens
acauauggcucugauagaa

SEQ ID NO: 358358 - RNA, 19 nt, Homo sapiens
agucaaggaugcagaagaa

SEQ ID NO: 358359 - RNA, 19 nt, Homo sapiens
ggaaugcuuuauggcuuaa

SEQ ID NO: 358360 - RNA, 19 nt, Homo sapiens
gcuaagaaagcagagguua

SEQ ID NO: 358361 - RNA, 19 nt, Homo sapiens
aaagcuaccucaacaugga

SEQ ID NO: 358362 - RNA, 19 nt, Homo sapiens
guacuucugcugugagauu

SEQ ID NO: 358363 - RNA, 19 nt, Homo sapiens
agaccaauauucugccaaa

SEQ ID NO: 358364 - RNA, 19 nt, Homo sapiens
agacaucagcacuaaauuu

SEQ ID NO: 358365 - RNA, 19 nt, Homo sapiens
gauaauccucgucauauag

SEQ ID NO: 358366 - RNA, 19 nt, Homo sapiens
auaaucaacucacgcuuug

SEQ ID NO: 358367 - RNA, 19 nt, Homo sapiens
uauuagaacuugcaagaag

SEQ ID NO: 358368 - RNA, 19 nt, Homo sapiens
uaagaaagcagagguuaau

SEQ ID NO: 358369 - RNA, 19 nt, Homo sapiens
ucaagacagugcuuaaugg

SEQ ID NO: 358370 - RNA, 19 nt, Homo sapiens
caucauuguuuguggcauu

SEQ ID NO: 358371 - RNA, 19 nt, Homo sapiens
gacaucagcacuaaauuuc

SEQ ID NO: 358372 - RNA, 19 nt, Homo sapiens
gaugggagaacaagcugua

SEQ ID NO: 358373 - RNA, 19 nt, Homo sapiens
gcuuaauggugucccguaa

SEQ ID NO: 358374 - RNA, 19 nt, Homo sapiens
gcccagcucccaccaguaa

SEQ ID NO: 358375 - RNA, 19 nt, Homo sapiens
ggucaagaaauuuguguga

SEQ ID NO: 358376 - RNA, 19 nt, Homo sapiens
caauaaaacugagcauuug

SEQ ID NO: 358377 - RNA, 19 nt, Homo sapiens
aaggagacaucagcacuaa

SEQ ID NO: 358378 - RNA, 19 nt, Homo sapiens
gaagaugucguuuucauug

SEQ ID NO: 358379 - RNA, 19 nt, Homo sapiens
gaaacaugagcauucaguu

SEQ ID NO: 358380 - RNA, 19 nt, Homo sapiens
gcaugucggguuauuagaa

SEQ ID NO: 358381 - RNA, 19 nt, Homo sapiens
ggaccugacacacaugcua

SEQ ID NO: 358382 - RNA, 19 nt, Homo sapiens
ggaaacaugagcauucagu

SEQ ID NO: 358383 - RNA, 19 nt, Homo sapiens
gugagaagaaccaguuauu

SEQ ID NO: 358384 - RNA, 19 nt, Homo sapiens
gaauacaagacuccagguu

SEQ ID NO: 358385 - RNA, 19 nt, Homo sapiens
gaagcauguucuguacuau

SEQ ID NO: 358386 - RNA, 19 nt, Homo sapiens
cagaagaagcugucagaau

SEQ ID NO: 358387 - RNA, 19 nt, Homo sapiens
guuaagagcacaacauuuu

SEQ ID NO: 358388 - RNA, 19 nt, Homo sapiens
guuuguggcauuccaguua

SEQ ID NO: 358389 - RNA, 19 nt, Homo sapiens
guuauuagaacuugcaaga

SEQ ID NO: 358390 - RNA, 19 nt, Homo sapiens
gaacaccccugugcagcua

SEQ ID NO: 358391 - RNA, 19 nt, Homo sapiens
gaagcagguggaaacauga

SEQ ID NO: 358392 - RNA, 19 nt, Homo sapiens
cguaguagcaucaaacaau

SEQ ID NO: 358393 - RNA, 19 nt, Homo sapiens
ggaaaggcaugcgcauugc

SEQ ID NO: 358394 - RNA, 19 nt, Homo sapiens
gaugcuaguucuguucaug

SEQ ID NO: 358395 - RNA, 19 nt, Homo sapiens
gguagcagaaggucaagaa

SEQ ID NO: 358396 - RNA, 19 nt, Homo sapiens
uguacaaggugaauaucuu

SEQ ID NO: 358397 - RNA, 19 nt, Homo sapiens
caaaagaucugcaaaauca

SEQ ID NO: 358398 - RNA, 19 nt, Homo sapiens
ucaggaugcuuggauauua

SEQ ID NO: 358399 - RNA, 19 nt, Homo sapiens
gaaaccaagaacugaauua

SEQ ID NO: 358400 - RNA, 19 nt, Homo sapiens
ggagucaucccucagauuu

SEQ ID NO: 358401 - RNA, 19 nt, Homo sapiens
ugaagucugucaccaauga

SEQ ID NO: 358402 - RNA, 19 nt, Homo sapiens
ggacgaggccgaaucaaug

SEQ ID NO: 358403 - RNA, 19 nt, Homo sapiens
cagaguacaucgagaaguu

SEQ ID NO: 358404 - RNA, 19 nt, Homo sapiens
caacaugguggacaucaua

SEQ ID NO: 358405 - RNA, 19 nt, Homo sapiens
caggaugcuuggauauuaa

SEQ ID NO: 358406 - RNA, 19 nt, Homo sapiens
ucaaagggcaugagaaugu

SEQ ID NO: 358407 - RNA, 19 nt, Homo sapiens
guugaugccuuguguaauc

SEQ ID NO: 358408 - RNA, 19 nt, Homo sapiens
ggacaccuccuaccuguuc

SEQ ID NO: 358409 - RNA, 19 nt, Homo sapiens
uaacagacuucacguucau

SEQ ID NO: 358410 - RNA, 19 nt, Homo sapiens
ugaggcaacuguacccaaa

SEQ ID NO: 358411 - RNA, 19 nt, Homo sapiens
ggagaaaacaugcaaauau

SEQ ID NO: 358412 - RNA, 19 nt, Homo sapiens
gaaaggggcucguuuuguc

SEQ ID NO: 358413 - RNA, 19 nt, Homo sapiens
gcacaagcgaggaaagcua

SEQ ID NO: 358414 - RNA, 19 nt, Homo sapiens
caaauagguuggauaagcu

SEQ ID NO: 358415 - RNA, 19 nt, Homo sapiens
gaauuacugucugcccauu

SEQ ID NO: 358416 - RNA, 19 nt, Homo sapiens
guacaacguccuuggagaa

SEQ ID NO: 358417 - RNA, 19 nt, Homo sapiens
caucauacacucuguuguu

SEQ ID NO: 358418 - RNA, 19 nt, Homo sapiens
ggccaccucuguuaacgaa

SEQ ID NO: 358419 - RNA, 19 nt, Homo sapiens
gcugugaccuggaugucuu

SEQ ID NO: 358420 - RNA, 19 nt, Homo sapiens
ugggaggacuguuggaauu

SEQ ID NO: 358421 - RNA, 19 nt, Homo sapiens
gaaaagaaaccaagaacug

SEQ ID NO: 358422 - RNA, 19 nt, Homo sapiens
gcuuggauauuaauucauc

SEQ ID NO: 358423 - RNA, 19 nt, Homo sapiens
ggaggugccuaugauguca

SEQ ID NO: 358424 - RNA, 19 nt, Homo sapiens
ucacagucaucaccaggaa

SEQ ID NO: 358425 - RNA, 19 nt, Homo sapiens
ugugaugcauucaauauuc

SEQ ID NO: 358426 - RNA, 19 nt, Homo sapiens
caugauaccuggcaaucca

SEQ ID NO: 358427 - RNA, 19 nt, Homo sapiens
ccaagcuucucuacgcauu

SEQ ID NO: 358428 - RNA, 19 nt, Homo sapiens
ugaugucccuggcuuucua

SEQ ID NO: 358429 - RNA, 19 nt, Homo sapiens
ggaggacuguuggaauugu

SEQ ID NO: 358430 - RNA, 19 nt, Homo sapiens
aaccaaagccuacaacaug

SEQ ID NO: 358431 - RNA, 19 nt, Homo sapiens
gagaucaugcccaauuaug

SEQ ID NO: 358432 - RNA, 19 nt, Homo sapiens
uugagaucaugcccaauua

SEQ ID NO: 358433 - RNA, 19 nt, Homo sapiens
gacuucacguucaugguaa

SEQ ID NO: 358434 - RNA, 19 nt, Homo sapiens
accaagaacugaauuacug

SEQ ID NO: 358435 - RNA, 19 nt, Homo sapiens
gaaguuugccaacccuuuc

SEQ ID NO: 358436 - RNA, 19 nt, Homo sapiens
caaagggcaugagaaugug

SEQ ID NO: 358437 - RNA, 19 nt, Homo sapiens
gcccugauguugugaaguc

SEQ ID NO: 358438 - RNA, 19 nt, Homo sapiens
ccaauuaugccaagaacau

SEQ ID NO: 358439 - RNA, 19 nt, Homo sapiens
cauacacucuguuguugau

SEQ ID NO: 358440 - RNA, 19 nt, Homo sapiens
gcaacuguacccaaaguca

SEQ ID NO: 358441 - RNA, 19 nt, Homo sapiens
gaggacuguuggaauuguu

SEQ ID NO: 358442 - RNA, 19 nt, Homo sapiens
ucacguucaugguaaagga

SEQ ID NO: 358443 - RNA, 19 nt, Homo sapiens
agacuucacguucauggua

SEQ ID NO: 358444 - RNA, 19 nt, Homo sapiens
cuaacagacuucacguuca

SEQ ID NO: 358445 - RNA, 19 nt, Homo sapiens
gggcaaggcucagcguucu

SEQ ID NO: 358446 - RNA, 19 nt, Homo sapiens
uuccugagcuugacacaau

SEQ ID NO: 358447 - RNA, 19 nt, Homo sapiens
ccgcagagauugcagucau

SEQ ID NO: 358448 - RNA, 19 nt, Homo sapiens
ggacaucauacacucuguu

SEQ ID NO: 358449 - RNA, 19 nt, Homo sapiens
aauggaagauugguuuaug

SEQ ID NO: 358450 - RNA, 19 nt, Homo sapiens
aaagaaaccaagaacugaa

SEQ ID NO: 358451 - RNA, 19 nt, Homo sapiens
auauuccacucaucacuuu

SEQ ID NO: 358452 - RNA, 19 nt, Homo sapiens
caaccaaagccuacaacau

SEQ ID NO: 358453 - RNA, 19 nt, Homo sapiens
aaagggcgcuguggagauc

SEQ ID NO: 358454 - RNA, 19 nt, Homo sapiens
acacaauugucccuuugga

SEQ ID NO: 358455 - RNA, 19 nt, Homo sapiens
guugagagcgacauguuug

SEQ ID NO: 358456 - RNA, 19 nt, Homo sapiens
cuauggaggugccuaugau

SEQ ID NO: 358457 - RNA, 19 nt, Homo sapiens
ccuggcagcuuuguugaga

SEQ ID NO: 358458 - RNA, 19 nt, Homo sapiens
cacaagcgaggaaagcuaa

SEQ ID NO: 358459 - RNA, 19 nt, Homo sapiens
gacccuggcagcuuuguug

SEQ ID NO: 358460 - RNA, 19 nt, Homo sapiens
auaccuggcaauccaaaua

SEQ ID NO: 358461 - RNA, 19 nt, Homo sapiens
uacacucuguuguugauga

SEQ ID NO: 358462 - RNA, 19 nt, Homo sapiens
gccucaggaugcuuggaua

SEQ ID NO: 358463 - RNA, 19 nt, Homo sapiens
gacaucauacacucuguug

SEQ ID NO: 358464 - RNA, 19 nt, Homo sapiens
acaugcaaauauuccauug

SEQ ID NO: 358465 - RNA, 19 nt, Homo sapiens
acaauugucccuuuggaau

SEQ ID NO: 358466 - RNA, 19 nt, Homo sapiens
caaagggcgcuguggagau

SEQ ID NO: 358467 - RNA, 19 nt, Homo sapiens
aagcuucucuacgcauuug

SEQ ID NO: 358468 - RNA, 19 nt, Homo sapiens
gacaucauccaaccuucuu

SEQ ID NO: 358469 - RNA, 19 nt, Homo sapiens
gaguacaucgagaaguuug

SEQ ID NO: 358470 - RNA, 19 nt, Homo sapiens
ugauguugaugccuugugu

SEQ ID NO: 358471 - RNA, 19 nt, Homo sapiens
ucacuggcccugauguugu

SEQ ID NO: 358472 - RNA, 19 nt, Homo sapiens
ugguuuaugucuucaguca

SEQ ID NO: 358473 - RNA, 19 nt, Homo sapiens
gaugcuuggauauuaauuc

SEQ ID NO: 358474 - RNA, 19 nt, Homo sapiens
gaaugaaugggaggacugu

SEQ ID NO: 358475 - RNA, 19 nt, Homo sapiens
uccgggauuucuucaacua

SEQ ID NO: 358476 - RNA, 19 nt, Homo sapiens
uggcuaugcagacaucuuu

SEQ ID NO: 358477 - RNA, 19 nt, Homo sapiens
gcgcagcacaagcgaggaa

SEQ ID NO: 358478 - RNA, 19 nt, Homo sapiens
ugcgaggguuuguggauga

SEQ ID NO: 358479 - RNA, 19 nt, Homo sapiens
cuucaaagggcaugagaau

SEQ ID NO: 358480 - RNA, 19 nt, Homo sapiens
ggaagauugguuuaugucu

SEQ ID NO: 358481 - RNA, 19 nt, Homo sapiens
caugagcucuaagcaccuu

SEQ ID NO: 358482 - RNA, 19 nt, Homo sapiens
gagcgacauguuuguggaa

SEQ ID NO: 358483 - RNA, 19 nt, Homo sapiens
guuaacgaacgcaucgaaa

SEQ ID NO: 358484 - RNA, 19 nt, Homo sapiens
uaacagccagggagaggau

SEQ ID NO: 358485 - RNA, 19 nt, Homo sapiens
uuugagaucaugcccaauu

SEQ ID NO: 358486 - RNA, 19 nt, Homo sapiens
gccaggccaccucuguuaa

SEQ ID NO: 358487 - RNA, 19 nt, Homo sapiens
gaggguuuguggaugacau

SEQ ID NO: 358488 - RNA, 19 nt, Homo sapiens
guauugacgcgcagcacaa

SEQ ID NO: 358489 - RNA, 19 nt, Homo sapiens
gauguugaugccuugugua

SEQ ID NO: 358490 - RNA, 19 nt, Homo sapiens
agccaggccaccucuguua

SEQ ID NO: 358491 - RNA, 19 nt, Homo sapiens
agacaucuuucugaggaau

SEQ ID NO: 358492 - RNA, 19 nt, Homo sapiens
ccaagaacugaauuacugu

SEQ ID NO: 358493 - RNA, 19 nt, Homo sapiens
aaucugcugugaccuggau

SEQ ID NO: 358494 - RNA, 19 nt, Homo sapiens
gggaggacuguuggaauug

SEQ ID NO: 358495 - RNA, 19 nt, Homo sapiens
aauugucccuuuggaauca

SEQ ID NO: 358496 - RNA, 19 nt, Homo sapiens
agaaguuugccaacccuuu

SEQ ID NO: 358497 - RNA, 19 nt, Homo sapiens
caacaagccuggugaagug

SEQ ID NO: 358498 - RNA, 19 nt, Homo sapiens
ucacagaccucgugcagaa

SEQ ID NO: 358499 - RNA, 19 nt, Homo sapiens
gcaccugucuucacucaga

SEQ ID NO: 358500 - RNA, 19 nt, Homo sapiens
gguaagaagucuacuccaa

SEQ ID NO: 358501 - RNA, 19 nt, Homo sapiens
gaagucuacuccaaaccua

SEQ ID NO: 358502 - RNA, 19 nt, Homo sapiens
gcauagggcuagugacuca

SEQ ID NO: 358503 - RNA, 19 nt, Homo sapiens
ggagggaaauggguaagaa

SEQ ID NO: 358504 - RNA, 19 nt, Homo sapiens
ggucaaagacuacaccauu

SEQ ID NO: 358505 - RNA, 19 nt, Homo sapiens
gcuagugacucaucaagau

SEQ ID NO: 358506 - RNA, 19 nt, Homo sapiens
ggauuaggcugagugaaga

SEQ ID NO: 358507 - RNA, 19 nt, Homo sapiens
gcagaagucccucaaguuc

SEQ ID NO: 358508 - RNA, 19 nt, Homo sapiens
ugaaggacaugaaugacaa

SEQ ID NO: 358509 - RNA, 19 nt, Homo sapiens
caacaucggcucacucuuc

SEQ ID NO: 358510 - RNA, 19 nt, Homo sapiens
guaagaagucuacuccaaa

SEQ ID NO: 358511 - RNA, 19 nt, Homo sapiens
ggagagaccugugauuugc

SEQ ID NO: 358512 - RNA, 19 nt, Homo sapiens
ucaaugugcuggacgagaa

SEQ ID NO: 358513 - RNA, 19 nt, Homo sapiens
ccacuguccuugucaaugu

SEQ ID NO: 358514 - RNA, 19 nt, Homo sapiens
gcaggugucugaccgagau

SEQ ID NO: 358515 - RNA, 19 nt, Homo sapiens
acacgccgcuggauauuga

SEQ ID NO: 358516 - RNA, 19 nt, Homo sapiens
gaacaugccagcacugagu

SEQ ID NO: 358517 - RNA, 19 nt, Homo sapiens
ggaaauggguaagaagucu

SEQ ID NO: 358518 - RNA, 19 nt, Homo sapiens
gagggcaccuucccauugu

SEQ ID NO: 358519 - RNA, 19 nt, Homo sapiens
gcaggacaacggugacuuu

SEQ ID NO: 358520 - RNA, 19 nt, Homo sapiens
acacuggacuuaucacugu

SEQ ID NO: 358521 - RNA, 19 nt, Homo sapiens
gacaggaacacuggacuua

SEQ ID NO: 358522 - RNA, 19 nt, Homo sapiens
ggagggcaccuucccauug

SEQ ID NO: 358523 - RNA, 19 nt, Homo sapiens
caacgcaccugucuucacu

SEQ ID NO: 358524 - RNA, 19 nt, Homo sapiens
gcagugacagcaagaagaa

SEQ ID NO: 358525 - RNA, 19 nt, Homo sapiens
guaagaaggagaccaagga

SEQ ID NO: 358526 - RNA, 19 nt, Homo sapiens
gcacagccuugguccaucu

SEQ ID NO: 358527 - RNA, 19 nt, Homo sapiens
gagcuuugaucgagagcaa

SEQ ID NO: 358528 - RNA, 19 nt, Homo sapiens
ggcuacaacuucucaguga

SEQ ID NO: 358529 - RNA, 19 nt, Homo sapiens
ccuaugaccucaccaucaa

SEQ ID NO: 358530 - RNA, 19 nt, Homo sapiens
ucaaugugcuggacugcaa

SEQ ID NO: 358531 - RNA, 19 nt, Homo sapiens
gucaaagacuacaccauug

SEQ ID NO: 358532 - RNA, 19 nt, Homo sapiens
acgagaaggucaaagacua

SEQ ID NO: 358533 - RNA, 19 nt, Homo sapiens
agaagucccucaaguucaa

SEQ ID NO: 358534 - RNA, 19 nt, Homo sapiens
cagccuugguccaucuuua

SEQ ID NO: 358535 - RNA, 19 nt, Homo sapiens
gacaaugaccccaaauuua

SEQ ID NO: 358536 - RNA, 19 nt, Homo sapiens
uacaagacaucaaugacaa

SEQ ID NO: 358537 - RNA, 19 nt, Homo sapiens
agaccuaggugcuucucua

SEQ ID NO: 358538 - RNA, 19 nt, Homo sapiens
aaaccuaggucucuauguc

SEQ ID NO: 358539 - RNA, 19 nt, Homo sapiens
caagcagcguggcaacauu

SEQ ID NO: 358540 - RNA, 19 nt, Homo sapiens
gggaacagcgggagagcua

SEQ ID NO: 358541 - RNA, 19 nt, Homo sapiens
caggaacacuggacuuauc

SEQ ID NO: 358542 - RNA, 19 nt, Homo sapiens
gccgaacuaucugagaaua

SEQ ID NO: 358543 - RNA, 19 nt, Homo sapiens
agacaucaaugacaacaca

SEQ ID NO: 358544 - RNA, 19 nt, Homo sapiens
guacaagacaucaaugaca

SEQ ID NO: 358545 - RNA, 19 nt, Homo sapiens
gggagagaccugugauuug

SEQ ID NO: 358546 - RNA, 19 nt, Homo sapiens
ucucagugcuugcuaagga

SEQ ID NO: 358547 - RNA, 19 nt, Homo sapiens
uaagaagucuacuccaaac

SEQ ID NO: 358548 - RNA, 19 nt, Homo sapiens
gcagguaggccagcccuuu

SEQ ID NO: 358549 - RNA, 19 nt, Homo sapiens
ggacugcaaugacaaugac

SEQ ID NO: 358550 - RNA, 19 nt, Homo sapiens
ggagagcuaugaguugaag

SEQ ID NO: 358551 - RNA, 19 nt, Homo sapiens
ggagagauccaggugaaga

SEQ ID NO: 358552 - RNA, 19 nt, Homo sapiens
gaacagcgggagagcuaug

SEQ ID NO: 358553 - RNA, 19 nt, Homo sapiens
gaagcaaccacagcucauu

SEQ ID NO: 358554 - RNA, 19 nt, Homo sapiens
gcaaaggcaagaagagcaa

SEQ ID NO: 358555 - RNA, 19 nt, Homo sapiens
caagacaggugacauuuuc

SEQ ID NO: 358556 - RNA, 19 nt, Homo sapiens
gaaauggguaagaagucua

SEQ ID NO: 358557 - RNA, 19 nt, Homo sapiens
acagcaagaagaaguauuu

SEQ ID NO: 358558 - RNA, 19 nt, Homo sapiens
gcagaaaucgaauacacau

SEQ ID NO: 358559 - RNA, 19 nt, Homo sapiens
ccaacgguguggcauccua

SEQ ID NO: 358560 - RNA, 19 nt, Homo sapiens
gugcuggacugcaaugaca

SEQ ID NO: 358561 - RNA, 19 nt, Homo sapiens
cgggagagcuaugaguuga

SEQ ID NO: 358562 - RNA, 19 nt, Homo sapiens
gauagaaguacaagacauc

SEQ ID NO: 358563 - RNA, 19 nt, Homo sapiens
ugacaacgcacccuauauc

SEQ ID NO: 358564 - RNA, 19 nt, Homo sapiens
gagaacaugccagcacuga

SEQ ID NO: 358565 - RNA, 19 nt, Homo sapiens
ccaaugcagaaaucgaaua

SEQ ID NO: 358566 - RNA, 19 nt, Homo sapiens
ccuugacccugacaauaaa

SEQ ID NO: 358567 - RNA, 19 nt, Homo sapiens
uaggcugagugaagauuaa

SEQ ID NO: 358568 - RNA, 19 nt, Homo sapiens
ggagugauggagcagguuu

SEQ ID NO: 358569 - RNA, 19 nt, Homo sapiens
gcacaggcaccauccuauc

SEQ ID NO: 358570 - RNA, 19 nt, Homo sapiens
gugaagugauugcugagau

SEQ ID NO: 358571 - RNA, 19 nt, Homo sapiens
gcacuaacucccucaaggu

SEQ ID NO: 358572 - RNA, 19 nt, Homo sapiens
ggacaggaacacuggacuu

SEQ ID NO: 358573 - RNA, 19 nt, Homo sapiens
ggugaaggccaaugacuca

SEQ ID NO: 358574 - RNA, 19 nt, Homo sapiens
ugacaacacacccaacuuc

SEQ ID NO: 358575 - RNA, 19 nt, Homo sapiens
gaaguacaagacaucaaug

SEQ ID NO: 358576 - RNA, 19 nt, Homo sapiens
cuguguguauugugcauua

SEQ ID NO: 358577 - RNA, 19 nt, Homo sapiens
gaaugacaacgcacccuau

SEQ ID NO: 358578 - RNA, 19 nt, Homo sapiens
caagccuggugaagugauu

SEQ ID NO: 358579 - RNA, 19 nt, Homo sapiens
gcaaggccuccaagggaaa

SEQ ID NO: 358580 - RNA, 19 nt, Homo sapiens
ggacacgccgcuggauauu

SEQ ID NO: 358581 - RNA, 19 nt, Homo sapiens
gcagguggcaacccuuaug

SEQ ID NO: 358582 - RNA, 19 nt, Homo sapiens
ucaccgugcuugacaccaa

SEQ ID NO: 358583 - RNA, 19 nt, Homo sapiens
gcugcuagagggccagaua

SEQ ID NO: 358584 - RNA, 19 nt, Homo sapiens
gagccucgcagccgacuau

SEQ ID NO: 358585 - RNA, 19 nt, Homo sapiens
caacgcacccuauaucacu

SEQ ID NO: 358586 - RNA, 19 nt, Homo sapiens
caacggugacuuuguuauc

SEQ ID NO: 358587 - RNA, 19 nt, Homo sapiens
cuaaugcugagcugguuua

SEQ ID NO: 358588 - RNA, 19 nt, Homo sapiens
agacuacaccauugagauu

SEQ ID NO: 358589 - RNA, 19 nt, Homo sapiens
cauugugccuucugugugu

SEQ ID NO: 358590 - RNA, 19 nt, Homo sapiens
gagcaguacuccgacuaca

SEQ ID NO: 358591 - RNA, 19 nt, Homo sapiens
gguggcagccgaggacuuu

SEQ ID NO: 358592 - RNA, 19 nt, Homo sapiens
cuaagggccucuucaccau

SEQ ID NO: 358593 - RNA, 19 nt, Homo sapiens
ugaagugauugcugagauc

SEQ ID NO: 358594 - RNA, 19 nt, Homo sapiens
gcccuugacccugacaaua

SEQ ID NO: 358595 - RNA, 19 nt, Homo sapiens
gacaacgcacccuauauca

SEQ ID NO: 358596 - RNA, 19 nt, Homo sapiens
gcaagaagaaguauuuccu

SEQ ID NO: 358597 - RNA, 19 nt, Homo sapiens
caacaagccuggugaagug

SEQ ID NO: 358598 - RNA, 19 nt, Homo sapiens
ucacagaccucgugcagaa

SEQ ID NO: 358599 - RNA, 19 nt, Homo sapiens
gggauagcaugcccaauuu

SEQ ID NO: 358600 - RNA, 19 nt, Homo sapiens
gagcugggcuuuuauuuaa

SEQ ID NO: 358601 - RNA, 19 nt, Homo sapiens
gcaccugucuucacucaga

SEQ ID NO: 358602 - RNA, 19 nt, Homo sapiens
gcauagggcuagugacuca

SEQ ID NO: 358603 - RNA, 19 nt, Homo sapiens
ggucaaagacuacaccauu

SEQ ID NO: 358604 - RNA, 19 nt, Homo sapiens
gcuagugacucaucaagau

SEQ ID NO: 358605 - RNA, 19 nt, Homo sapiens
gcagaagucccucaaguuc

SEQ ID NO: 358606 - RNA, 19 nt, Homo sapiens
ugaaggacaugaaugacaa

SEQ ID NO: 358607 - RNA, 19 nt, Homo sapiens
caacaucggcucacucuuc

SEQ ID NO: 358608 - RNA, 19 nt, Homo sapiens
ucaaugugcuggacgagaa

SEQ ID NO: 358609 - RNA, 19 nt, Homo sapiens
ccacuguccuugucaaugu

SEQ ID NO: 358610 - RNA, 19 nt, Homo sapiens
gcaggugucugaccgagau

SEQ ID NO: 358611 - RNA, 19 nt, Homo sapiens
agaaugaccuucgcccuuu

SEQ ID NO: 358612 - RNA, 19 nt, Homo sapiens
acacgccgcuggauauuga

SEQ ID NO: 358613 - RNA, 19 nt, Homo sapiens
gaacaugccagcacugagu

SEQ ID NO: 358614 - RNA, 19 nt, Homo sapiens
gcaggacaacggugacuuu

SEQ ID NO: 358615 - RNA, 19 nt, Homo sapiens
acacuggacuuaucacugu

SEQ ID NO: 358616 - RNA, 19 nt, Homo sapiens
gacaggaacacuggacuua

SEQ ID NO: 358617 - RNA, 19 nt, Homo sapiens
caacgcaccugucuucacu

SEQ ID NO: 358618 - RNA, 19 nt, Homo sapiens
gcagugacagcaagaagaa

SEQ ID NO: 358619 - RNA, 19 nt, Homo sapiens
guaagaaggagaccaagga

SEQ ID NO: 358620 - RNA, 19 nt, Homo sapiens
gcacagccuugguccaucu

SEQ ID NO: 358621 - RNA, 19 nt, Homo sapiens
gagcuuugaucgagagcaa

SEQ ID NO: 358622 - RNA, 19 nt, Homo sapiens
ggcuacaacuucucaguga

SEQ ID NO: 358623 - RNA, 19 nt, Homo sapiens
ccuaugaccucaccaucaa

SEQ ID NO: 358624 - RNA, 19 nt, Homo sapiens
gcagcguacuucuaacuca

SEQ ID NO: 358625 - RNA, 19 nt, Homo sapiens
ggguaucacugaccucaug

SEQ ID NO: 358626 - RNA, 19 nt, Homo sapiens
ucaaugugcuggacugcaa

SEQ ID NO: 358627 - RNA, 19 nt, Homo sapiens
gucaaagacuacaccauug

SEQ ID NO: 358628 - RNA, 19 nt, Homo sapiens
acgagaaggucaaagacua

SEQ ID NO: 358629 - RNA, 19 nt, Homo sapiens
agaagucccucaaguucaa

SEQ ID NO: 358630 - RNA, 19 nt, Homo sapiens
cagccuugguccaucuuua

SEQ ID NO: 358631 - RNA, 19 nt, Homo sapiens
gacaaugaccccaaauuua

SEQ ID NO: 358632 - RNA, 19 nt, Homo sapiens
uacaagacaucaaugacaa

SEQ ID NO: 358633 - RNA, 19 nt, Homo sapiens
gaaugaccuucgcccuuug

SEQ ID NO: 358634 - RNA, 19 nt, Homo sapiens
caagcagcguggcaacauu

SEQ ID NO: 358635 - RNA, 19 nt, Homo sapiens
gggaacagcgggagagcua

SEQ ID NO: 358636 - RNA, 19 nt, Homo sapiens
caggaacacuggacuuauc

SEQ ID NO: 358637 - RNA, 19 nt, Homo sapiens
gccgaacuaucugagaaua

SEQ ID NO: 358638 - RNA, 19 nt, Homo sapiens
agacaucaaugacaacaca

SEQ ID NO: 358639 - RNA, 19 nt, Homo sapiens
guacaagacaucaaugaca

SEQ ID NO: 358640 - RNA, 19 nt, Homo sapiens
ucucagugcuugcuaagga

SEQ ID NO: 358641 - RNA, 19 nt, Homo sapiens
gagcagcgcccucaaacuc

SEQ ID NO: 358642 - RNA, 19 nt, Homo sapiens
ggacugcaaugacaaugac

SEQ ID NO: 358643 - RNA, 19 nt, Homo sapiens
ggagagcuaugaguugaag

SEQ ID NO: 358644 - RNA, 19 nt, Homo sapiens
ggagagauccaggugaaga

SEQ ID NO: 358645 - RNA, 19 nt, Homo sapiens
caagagcagcgcccucaaa

SEQ ID NO: 358646 - RNA, 19 nt, Homo sapiens
gaacagcgggagagcuaug

SEQ ID NO: 358647 - RNA, 19 nt, Homo sapiens
gaagcaaccacagcucauu

SEQ ID NO: 358648 - RNA, 19 nt, Homo sapiens
gucaugcagugucuguaua

SEQ ID NO: 358649 - RNA, 19 nt, Homo sapiens
caagacaggugacauuuuc

SEQ ID NO: 358650 - RNA, 19 nt, Homo sapiens
gcaaaggcaagaagagcaa

SEQ ID NO: 358651 - RNA, 19 nt, Homo sapiens
acagcaagaagaaguauuu

SEQ ID NO: 358652 - RNA, 19 nt, Homo sapiens
gcagaaaucgaauacacau

SEQ ID NO: 358653 - RNA, 19 nt, Homo sapiens
ccaacgguguggcauccua

SEQ ID NO: 358654 - RNA, 19 nt, Homo sapiens
ggguaacauuugccuauca

SEQ ID NO: 358655 - RNA, 19 nt, Homo sapiens
gugcuggacugcaaugaca

SEQ ID NO: 358656 - RNA, 19 nt, Homo sapiens
cgggagagcuaugaguuga

SEQ ID NO: 358657 - RNA, 19 nt, Homo sapiens
gauagaaguacaagacauc

SEQ ID NO: 358658 - RNA, 19 nt, Homo sapiens
gauagcaugcccaauuuua

SEQ ID NO: 358659 - RNA, 19 nt, Homo sapiens
gcacaguuacuaugacagu

SEQ ID NO: 358660 - RNA, 19 nt, Homo sapiens
ugacaacgcacccuauauc

SEQ ID NO: 358661 - RNA, 19 nt, Homo sapiens
gagaacaugccagcacuga

SEQ ID NO: 358662 - RNA, 19 nt, Homo sapiens
ccaaugcagaaaucgaaua

SEQ ID NO: 358663 - RNA, 19 nt, Homo sapiens
guacuucuaacucauuguu

SEQ ID NO: 358664 - RNA, 19 nt, Homo sapiens
gcacaggcaccauccuauc

SEQ ID NO: 358665 - RNA, 19 nt, Homo sapiens
gugaagugauugcugagau

SEQ ID NO: 358666 - RNA, 19 nt, Homo sapiens
gcacuaacucccucaaggu

SEQ ID NO: 358667 - RNA, 19 nt, Homo sapiens
ggacaggaacacuggacuu

SEQ ID NO: 358668 - RNA, 19 nt, Homo sapiens
ggugaaggccaaugacuca

SEQ ID NO: 358669 - RNA, 19 nt, Homo sapiens
ugacaacacacccaacuuc

SEQ ID NO: 358670 - RNA, 19 nt, Homo sapiens
gaaguacaagacaucaaug

SEQ ID NO: 358671 - RNA, 19 nt, Homo sapiens
cagcacaguuacuaugaca

SEQ ID NO: 358672 - RNA, 19 nt, Homo sapiens
gaaugacaacgcacccuau

SEQ ID NO: 358673 - RNA, 19 nt, Homo sapiens
caagccuggugaagugauu

SEQ ID NO: 358674 - RNA, 19 nt, Homo sapiens
gugggcagcguacuucuaa

SEQ ID NO: 358675 - RNA, 19 nt, Homo sapiens
gcugcuagagggccagaua

SEQ ID NO: 358676 - RNA, 19 nt, Homo sapiens
gcaaggccuccaagggaaa

SEQ ID NO: 358677 - RNA, 19 nt, Homo sapiens
ggacacgccgcuggauauu

SEQ ID NO: 358678 - RNA, 19 nt, Homo sapiens
gcagguggcaacccuuaug

SEQ ID NO: 358679 - RNA, 19 nt, Homo sapiens
ucaccgugcuugacaccaa

SEQ ID NO: 358680 - RNA, 19 nt, Homo sapiens
caacccaggccucuauugu

SEQ ID NO: 358681 - RNA, 19 nt, Homo sapiens
ggucaugcagugucuguau

SEQ ID NO: 358682 - RNA, 19 nt, Homo sapiens
caacgcacccuauaucacu

SEQ ID NO: 358683 - RNA, 19 nt, Homo sapiens
caacggugacuuuguuauc

SEQ ID NO: 358684 - RNA, 19 nt, Homo sapiens
cuaaugcugagcugguuua

SEQ ID NO: 358685 - RNA, 19 nt, Homo sapiens
agacuacaccauugagauu

SEQ ID NO: 358686 - RNA, 19 nt, Homo sapiens
gagccucgcagccgacuau

SEQ ID NO: 358687 - RNA, 19 nt, Homo sapiens
ccucuauuguuccauguug

SEQ ID NO: 358688 - RNA, 19 nt, Homo sapiens
caugcagugucuguauaua

SEQ ID NO: 358689 - RNA, 19 nt, Homo sapiens
gagcaguacuccgacuaca

SEQ ID NO: 358690 - RNA, 19 nt, Homo sapiens
gguggcagccgaggacuuu

SEQ ID NO: 358691 - RNA, 19 nt, Homo sapiens
cuaagggccucuucaccau

SEQ ID NO: 358692 - RNA, 19 nt, Homo sapiens
ugaagugauugcugagauc

SEQ ID NO: 358693 - RNA, 19 nt, Homo sapiens
gacaacgcacccuauauca

SEQ ID NO: 358694 - RNA, 19 nt, Homo sapiens
gcaagaagaaguauuuccu

SEQ ID NO: 358695 - RNA, 19 nt, Homo sapiens
ggagaccaaggaccuguau

SEQ ID NO: 358696 - RNA, 19 nt, Homo sapiens
ccaucacccuggagaagga

SEQ ID NO: 358697 - RNA, 19 nt, Homo sapiens
ggacaaagcuugacacauc

SEQ ID NO: 358698 - RNA, 19 nt, Homo sapiens
ggaagcaacucuuuacaaa

SEQ ID NO: 358699 - RNA, 19 nt, Homo sapiens
guacugacuucuccuauaa

SEQ ID NO: 358700 - RNA, 19 nt, Homo sapiens
gcaagaaggagaagaagua

SEQ ID NO: 358701 - RNA, 19 nt, Homo sapiens
gaacauauuugucacugau

SEQ ID NO: 358702 - RNA, 19 nt, Homo sapiens
gagccgaaaugaauacuuu

SEQ ID NO: 358703 - RNA, 19 nt, Homo sapiens
ggauuaaacuggcauuuca

SEQ ID NO: 358704 - RNA, 19 nt, Homo sapiens
uaacaggaccaauggauua

SEQ ID NO: 358705 - RNA, 19 nt, Homo sapiens
caagaucaaugcucaaguu

SEQ ID NO: 358706 - RNA, 19 nt, Homo sapiens
gagcugagccgaaaugaau

SEQ ID NO: 358707 - RNA, 19 nt, Homo sapiens
gggagacugugccagaaua

SEQ ID NO: 358708 - RNA, 19 nt, Homo sapiens
gaauacaaccucagcauca

SEQ ID NO: 358709 - RNA, 19 nt, Homo sapiens
ugacaacccuccacaaucu

SEQ ID NO: 358710 - RNA, 19 nt, Homo sapiens
gaagcucgaagcagguuua

SEQ ID NO: 358711 - RNA, 19 nt, Homo sapiens
gaucaaugcucaaguuuug

SEQ ID NO: 358712 - RNA, 19 nt, Homo sapiens
caacaucagcgugaacaua

SEQ ID NO: 358713 - RNA, 19 nt, Homo sapiens
cacaauaaaucgugacaau

SEQ ID NO: 358714 - RNA, 19 nt, Homo sapiens
cgaaggagcacauugcaaa

SEQ ID NO: 358715 - RNA, 19 nt, Homo sapiens
ggacaucaacgacaacaau

SEQ ID NO: 358716 - RNA, 19 nt, Homo sapiens
uagaauagccaguagugua

SEQ ID NO: 358717 - RNA, 19 nt, Homo sapiens
gaauuaacagcucauauca

SEQ ID NO: 358718 - RNA, 19 nt, Homo sapiens
gcuagugggucgcuauuuc

SEQ ID NO: 358719 - RNA, 19 nt, Homo sapiens
cgacaacaauccugcuuuc

SEQ ID NO: 358720 - RNA, 19 nt, Homo sapiens
ccucucagcccuuacaaua

SEQ ID NO: 358721 - RNA, 19 nt, Homo sapiens
ggaguaaucauauucaaag

SEQ ID NO: 358722 - RNA, 19 nt, Homo sapiens
ccaaacuccaugagauuua

SEQ ID NO: 358723 - RNA, 19 nt, Homo sapiens
gggaccaaaugaacagaaa

SEQ ID NO: 358724 - RNA, 19 nt, Homo sapiens
gcucgaagcagguuuagga

SEQ ID NO: 358725 - RNA, 19 nt, Homo sapiens
gcaauggcaacaagaagaa

SEQ ID NO: 358726 - RNA, 19 nt, Homo sapiens
cguacugacuucuccuaua

SEQ ID NO: 358727 - RNA, 19 nt, Homo sapiens
gacaaagcuugacacauca

SEQ ID NO: 358728 - RNA, 19 nt, Homo sapiens
cagcugaacuccuccaucu

SEQ ID NO: 358729 - RNA, 19 nt, Homo sapiens
uaaccgggaugcugacaau

SEQ ID NO: 358730 - RNA, 19 nt, Homo sapiens
ccuaugagcugagccgaaa

SEQ ID NO: 358731 - RNA, 19 nt, Homo sapiens
gcaacucuuuacaaaccua

SEQ ID NO: 358732 - RNA, 19 nt, Homo sapiens
ggaaaugaaauuggagauu

SEQ ID NO: 358733 - RNA, 19 nt, Homo sapiens
gacaacauccuccagauuc

SEQ ID NO: 358734 - RNA, 19 nt, Homo sapiens
gcgacccgcugcugaagaa

SEQ ID NO: 358735 - RNA, 19 nt, Homo sapiens
caauaaaucgugacaaugg

SEQ ID NO: 358736 - RNA, 19 nt, Homo sapiens
cuacgacguuuacauugaa

SEQ ID NO: 358737 - RNA, 19 nt, Homo sapiens
ggacuucgaggacaccaaa

SEQ ID NO: 358738 - RNA, 19 nt, Homo sapiens
ccggagagauguuugugaa

SEQ ID NO: 358739 - RNA, 19 nt, Homo sapiens
gccauagccugguuaaagu

SEQ ID NO: 358740 - RNA, 19 nt, Homo sapiens
agaaacaagugcccaguca

SEQ ID NO: 358741 - RNA, 19 nt, Homo sapiens
gaagaagucgggcaagaag

SEQ ID NO: 358742 - RNA, 19 nt, Homo sapiens
gaaagucucagcccaggau

SEQ ID NO: 358743 - RNA, 19 nt, Homo sapiens
ggaggaggcucuguauguc

SEQ ID NO: 358744 - RNA, 19 nt, Homo sapiens
ggucucccuuucagccuua

SEQ ID NO: 358745 - RNA, 19 nt, Homo sapiens
ggaccagucuucuguuuug

SEQ ID NO: 358746 - RNA, 19 nt, Homo sapiens
gcuccaauacuaaaccuaa

SEQ ID NO: 358747 - RNA, 19 nt, Homo sapiens
ccuacgacguuuacauuga

SEQ ID NO: 358748 - RNA, 19 nt, Homo sapiens
ggagcuagccgaagauucu

SEQ ID NO: 358749 - RNA, 19 nt, Homo sapiens
gcugugauccgguguucua

SEQ ID NO: 358750 - RNA, 19 nt, Homo sapiens
uaccucagcuggccaccua

SEQ ID NO: 358751 - RNA, 19 nt, Homo sapiens
gagaugcugccucgaggua

SEQ ID NO: 358752 - RNA, 19 nt, Homo sapiens
acaccaaacuccaugagau

SEQ ID NO: 358753 - RNA, 19 nt, Homo sapiens
gggaggacagcaccaagua

SEQ ID NO: 358754 - RNA, 19 nt, Homo sapiens
ugaugucgccgcaccuuua

SEQ ID NO: 358755 - RNA, 19 nt, Homo sapiens
gaacgaccgucuggaucga

SEQ ID NO: 358756 - RNA, 19 nt, Homo sapiens
gagagauguuugugaacga

SEQ ID NO: 358757 - RNA, 19 nt, Homo sapiens
gcuaacccgcugaaaguuu

SEQ ID NO: 358758 - RNA, 19 nt, Homo sapiens
ggacccuucccacuacaua

SEQ ID NO: 358759 - RNA, 19 nt, Homo sapiens
gcgcuaacccgcugaaagu

SEQ ID NO: 358760 - RNA, 19 nt, Homo sapiens
cuacaagccuccuaguucu

SEQ ID NO: 358761 - RNA, 19 nt, Homo sapiens
gaacuccuccaucuuccaa

SEQ ID NO: 358762 - RNA, 19 nt, Homo sapiens
gggaagcaacucuuuacaa

SEQ ID NO: 358763 - RNA, 19 nt, Homo sapiens
guguugaaguaccaaguaa

SEQ ID NO: 358764 - RNA, 19 nt, Homo sapiens
gugauccgguguucuauag

SEQ ID NO: 358765 - RNA, 19 nt, Homo sapiens
gaacugcuuuugagugaga

SEQ ID NO: 358766 - RNA, 19 nt, Homo sapiens
ugaauuaacagcucauauc

SEQ ID NO: 358767 - RNA, 19 nt, Homo sapiens
uggcauagugucauccuua

SEQ ID NO: 358768 - RNA, 19 nt, Homo sapiens
gugggacacugcccucuug

SEQ ID NO: 358769 - RNA, 19 nt, Homo sapiens
gaccugcccuuacaguagu

SEQ ID NO: 358770 - RNA, 19 nt, Homo sapiens
ugaaguaccaaguaaccua

SEQ ID NO: 358771 - RNA, 19 nt, Homo sapiens
gcugaacuccuccaucuuc

SEQ ID NO: 358772 - RNA, 19 nt, Homo sapiens
gcacccaggccucagaguu

SEQ ID NO: 358773 - RNA, 19 nt, Homo sapiens
caagaaggagaagaaguaa

SEQ ID NO: 358774 - RNA, 19 nt, Homo sapiens
ggucacaguguucggagua

SEQ ID NO: 358775 - RNA, 19 nt, Homo sapiens
gcugcacacuggucaaauc

SEQ ID NO: 358776 - RNA, 19 nt, Homo sapiens
caucagcgugaacauauuu

SEQ ID NO: 358777 - RNA, 19 nt, Homo sapiens
ucucagcccuuacaauagu

SEQ ID NO: 358778 - RNA, 19 nt, Homo sapiens
caagaauuacuucacuuug

SEQ ID NO: 358779 - RNA, 19 nt, Homo sapiens
ccuauaagcgcuucucuuc

SEQ ID NO: 358780 - RNA, 19 nt, Homo sapiens
ggccauagccugguuaaag

SEQ ID NO: 358781 - RNA, 19 nt, Homo sapiens
ggagaagaaguaacaugga

SEQ ID NO: 358782 - RNA, 19 nt, Homo sapiens
ccacaaucuucucaaucuu

SEQ ID NO: 358783 - RNA, 19 nt, Homo sapiens
ggagcacauugcaaagugu

SEQ ID NO: 358784 - RNA, 19 nt, Homo sapiens
guagugcggugugcuuuua

SEQ ID NO: 358785 - RNA, 19 nt, Homo sapiens
caacaaccaguuugacaca

SEQ ID NO: 358786 - RNA, 19 nt, Homo sapiens
ucacugaucgcaaugacaa

SEQ ID NO: 358787 - RNA, 19 nt, Homo sapiens
gggcauggacaaagcuuga

SEQ ID NO: 358788 - RNA, 19 nt, Homo sapiens
gagcuaacaggaccaaugg

SEQ ID NO: 358789 - RNA, 19 nt, Homo sapiens
gccauaaaccaauaacuag

SEQ ID NO: 358790 - RNA, 19 nt, Homo sapiens
ugacaacauccuccagauu

SEQ ID NO: 358791 - RNA, 19 nt, Homo sapiens
gguguugaaguaccaagua

SEQ ID NO: 358792 - RNA, 19 nt, Homo sapiens
agaaggagaagaaguaaca

SEQ ID NO: 358793 - RNA, 19 nt, Homo sapiens
aagaagaagucgggcaaga

SEQ ID NO: 358794 - RNA, 19 nt, Homo sapiens
gcaccuggcccaacaacca

SEQ ID NO: 358795 - RNA, 19 nt, Homo sapiens
gagcugugauccgguguuc

SEQ ID NO: 358796 - RNA, 19 nt, Homo sapiens
ggagaccggagagauguuu

SEQ ID NO: 358797 - RNA, 19 nt, Homo sapiens
ggaagcaacucuuuacaaa

SEQ ID NO: 358798 - RNA, 19 nt, Homo sapiens
gaacauauuugucacugau

SEQ ID NO: 358799 - RNA, 19 nt, Homo sapiens
gagccgaaaugaauacuuu

SEQ ID NO: 358800 - RNA, 19 nt, Homo sapiens
gagcugagccgaaaugaau

SEQ ID NO: 358801 - RNA, 19 nt, Homo sapiens
gggagacugugccagaaua

SEQ ID NO: 358802 - RNA, 19 nt, Homo sapiens
ggaagauacuugacucauc

SEQ ID NO: 358803 - RNA, 19 nt, Homo sapiens
gaauacaaccucagcauca

SEQ ID NO: 358804 - RNA, 19 nt, Homo sapiens
ugacaacccuccacaaucu

SEQ ID NO: 358805 - RNA, 19 nt, Homo sapiens
caacaucagcgugaacaua

SEQ ID NO: 358806 - RNA, 19 nt, Homo sapiens
cacaauaaaucgugacaau

SEQ ID NO: 358807 - RNA, 19 nt, Homo sapiens
cgaaggagcacauugcaaa

SEQ ID NO: 358808 - RNA, 19 nt, Homo sapiens
ggacaucaacgacaacaau

SEQ ID NO: 358809 - RNA, 19 nt, Homo sapiens
gaauuaacagcucauauca

SEQ ID NO: 358810 - RNA, 19 nt, Homo sapiens
gcuagugggucgcuauuuc

SEQ ID NO: 358811 - RNA, 19 nt, Homo sapiens
cgacaacaauccugcuuuc

SEQ ID NO: 358812 - RNA, 19 nt, Homo sapiens
ccucucagcccuuacaaua

SEQ ID NO: 358813 - RNA, 19 nt, Homo sapiens
ggaguaaucauauucaaag

SEQ ID NO: 358814 - RNA, 19 nt, Homo sapiens
ccaaacuccaugagauuua

SEQ ID NO: 358815 - RNA, 19 nt, Homo sapiens
uaaccgggaugcugacaau

SEQ ID NO: 358816 - RNA, 19 nt, Homo sapiens
ccuaugagcugagccgaaa

SEQ ID NO: 358817 - RNA, 19 nt, Homo sapiens
gcaacucuuuacaaaccua

SEQ ID NO: 358818 - RNA, 19 nt, Homo sapiens
ggaaaugaaauuggagauu

SEQ ID NO: 358819 - RNA, 19 nt, Homo sapiens
gcgacccgcugcugaagaa

SEQ ID NO: 358820 - RNA, 19 nt, Homo sapiens
caauaaaucgugacaaugg

SEQ ID NO: 358821 - RNA, 19 nt, Homo sapiens
cuacgacguuuacauugaa

SEQ ID NO: 358822 - RNA, 19 nt, Homo sapiens
ggacuucgaggacaccaaa

SEQ ID NO: 358823 - RNA, 19 nt, Homo sapiens
ccggagagauguuugugaa

SEQ ID NO: 358824 - RNA, 19 nt, Homo sapiens
ugacucaucuguggaccua

SEQ ID NO: 358825 - RNA, 19 nt, Homo sapiens
cagguaagguuuagcaagu

SEQ ID NO: 358826 - RNA, 19 nt, Homo sapiens
caacuggcccuuccuagau

SEQ ID NO: 358827 - RNA, 19 nt, Homo sapiens
ggucucccuuucagccuua

SEQ ID NO: 358828 - RNA, 19 nt, Homo sapiens
gcuccaauacuaaaccuaa

SEQ ID NO: 358829 - RNA, 19 nt, Homo sapiens
ccuacgacguuuacauuga

SEQ ID NO: 358830 - RNA, 19 nt, Homo sapiens
ggagcuagccgaagauucu

SEQ ID NO: 358831 - RNA, 19 nt, Homo sapiens
gcugugauccgguguucua

SEQ ID NO: 358832 - RNA, 19 nt, Homo sapiens
uaccucagcuggccaccua

SEQ ID NO: 358833 - RNA, 19 nt, Homo sapiens
gagaugcugccucgaggua

SEQ ID NO: 358834 - RNA, 19 nt, Homo sapiens
acaccaaacuccaugagau

SEQ ID NO: 358835 - RNA, 19 nt, Homo sapiens
gggaggacagcaccaagua

SEQ ID NO: 358836 - RNA, 19 nt, Homo sapiens
ugaugucgccgcaccuuua

SEQ ID NO: 358837 - RNA, 19 nt, Homo sapiens
gaacgaccgucuggaucga

SEQ ID NO: 358838 - RNA, 19 nt, Homo sapiens
gagagauguuugugaacga

SEQ ID NO: 358839 - RNA, 19 nt, Homo sapiens
gcuaacccgcugaaaguuu

SEQ ID NO: 358840 - RNA, 19 nt, Homo sapiens
gcgcuaacccgcugaaagu

SEQ ID NO: 358841 - RNA, 19 nt, Homo sapiens
gggaagcaacucuuuacaa

SEQ ID NO: 358842 - RNA, 19 nt, Homo sapiens
ggaaggaauggagcuguuu

SEQ ID NO: 358843 - RNA, 19 nt, Homo sapiens
gguaagguuuagcaaguca

SEQ ID NO: 358844 - RNA, 19 nt, Homo sapiens
gugauccgguguucuauag

SEQ ID NO: 358845 - RNA, 19 nt, Homo sapiens
gaacugcuuuugagugaga

SEQ ID NO: 358846 - RNA, 19 nt, Homo sapiens
ggacagguaagguuuagca

SEQ ID NO: 358847 - RNA, 19 nt, Homo sapiens
ugaauuaacagcucauauc

SEQ ID NO: 358848 - RNA, 19 nt, Homo sapiens
uggcauagugucauccuua

SEQ ID NO: 358849 - RNA, 19 nt, Homo sapiens
gugggacacugcccucuug

SEQ ID NO: 358850 - RNA, 19 nt, Homo sapiens
ggucacaguguucggagua

SEQ ID NO: 358851 - RNA, 19 nt, Homo sapiens
gcugcacacuggucaaauc

SEQ ID NO: 358852 - RNA, 19 nt, Homo sapiens
caucagcgugaacauauuu

SEQ ID NO: 358853 - RNA, 19 nt, Homo sapiens
ucucagcccuuacaauagu

SEQ ID NO: 358854 - RNA, 19 nt, Homo sapiens
caagaauuacuucacuuug

SEQ ID NO: 358855 - RNA, 19 nt, Homo sapiens
ccacaaucuucucaaucuu

SEQ ID NO: 358856 - RNA, 19 nt, Homo sapiens
ggagcacauugcaaagugu

SEQ ID NO: 358857 - RNA, 19 nt, Homo sapiens
ucacugaucgcaaugacaa

SEQ ID NO: 358858 - RNA, 19 nt, Homo sapiens
gagcugugauccgguguuc

SEQ ID NO: 358859 - RNA, 19 nt, Homo sapiens
gugggucgcuauuucacaa

SEQ ID NO: 358860 - RNA, 19 nt, Homo sapiens
ggagaccggagagauguuu

SEQ ID NO: 358861 - RNA, 19 nt, Homo sapiens
gcucggcuuucuuucuuuc

SEQ ID NO: 358862 - RNA, 19 nt, Homo sapiens
gcuggugaccugcgaaguu

SEQ ID NO: 358863 - RNA, 19 nt, Homo sapiens
acaaugcgccugucuucaa

SEQ ID NO: 358864 - RNA, 19 nt, Homo sapiens
uggaggagcggacugguaa

SEQ ID NO: 358865 - RNA, 19 nt, Homo sapiens
aauagugcguguucaagug

SEQ ID NO: 358866 - RNA, 19 nt, Homo sapiens
ugaacauauuugucacuga

SEQ ID NO: 358867 - RNA, 19 nt, Homo sapiens
ggaucucgguagccucuca

SEQ ID NO: 358868 - RNA, 19 nt, Homo sapiens
gagaggaacugcuuuugag

SEQ ID NO: 358869 - RNA, 19 nt, Homo sapiens
ugucaucgcuuugcucagu

SEQ ID NO: 358870 - RNA, 19 nt, Homo sapiens
caaacuccaugagauuuac

SEQ ID NO: 358871 - RNA, 19 nt, Homo sapiens
caccaaacuccaugagauu

SEQ ID NO: 358872 - RNA, 19 nt, Homo sapiens
cccaggaaaugaaauugga

SEQ ID NO: 358873 - RNA, 19 nt, Homo sapiens
gaacaccagggcccuccuu

SEQ ID NO: 358874 - RNA, 19 nt, Homo sapiens
ccaccaacaucagcgugaa

SEQ ID NO: 358875 - RNA, 19 nt, Homo sapiens
ggcauagugucauccuuag

SEQ ID NO: 358876 - RNA, 19 nt, Homo sapiens
ccucaagaauuacuucacu

SEQ ID NO: 358877 - RNA, 19 nt, Homo sapiens
guuagugccuuugugagau

SEQ ID NO: 358878 - RNA, 19 nt, Homo sapiens
cuuccuagaucaaaguuag

SEQ ID NO: 358879 - RNA, 19 nt, Homo sapiens
cgccgcaccuuuaccauca

SEQ ID NO: 358880 - RNA, 19 nt, Homo sapiens
cauagugucauccuuagug

SEQ ID NO: 358881 - RNA, 19 nt, Homo sapiens
uccacaaucuucucaaucu

SEQ ID NO: 358882 - RNA, 19 nt, Homo sapiens
gaaggagcacauugcaaag

SEQ ID NO: 358883 - RNA, 19 nt, Homo sapiens
aagcaacucuuuacaaacc

SEQ ID NO: 358884 - RNA, 19 nt, Homo sapiens
gaagcaacucuuuacaaac

SEQ ID NO: 358885 - RNA, 19 nt, Homo sapiens
ucaacuggcccuuccuaga

SEQ ID NO: 358886 - RNA, 19 nt, Homo sapiens
gguccuagccaccaacauc

SEQ ID NO: 358887 - RNA, 19 nt, Homo sapiens
auacuaaaccuaagugucu

SEQ ID NO: 358888 - RNA, 19 nt, Homo sapiens
gguuuguggucccauuuca

SEQ ID NO: 358889 - RNA, 19 nt, Homo sapiens
gcauucacacuuucaacug

SEQ ID NO: 358890 - RNA, 19 nt, Homo sapiens
cuuccacggucauucacua

SEQ ID NO: 358891 - RNA, 19 nt, Homo sapiens
ggacugucaucgcuuugcu

SEQ ID NO: 358892 - RNA, 19 nt, Homo sapiens
agaacccgcuggagcuguu

SEQ ID NO: 358893 - RNA, 19 nt, Homo sapiens
acaauggcauagugucauc

SEQ ID NO: 358894 - RNA, 19 nt, Homo sapiens
gucuggagcuagccgaaga

SEQ ID NO: 358895 - RNA, 19 nt, Homo sapiens
gagcacauugcaaaguguu

SEQ ID NO: 358896 - RNA, 19 nt, Homo sapiens
gagccuagucuccaguuag

SEQ ID NO: 358897 - RNA, 19 nt, Homo sapiens
ggacaaagcuugacacauc

SEQ ID NO: 358898 - RNA, 19 nt, Homo sapiens
guacugacuucuccuauaa

SEQ ID NO: 358899 - RNA, 19 nt, Homo sapiens
gcaagaaggagaagaagua

SEQ ID NO: 358900 - RNA, 19 nt, Homo sapiens
ggauuaaacuggcauuuca

SEQ ID NO: 358901 - RNA, 19 nt, Homo sapiens
uaacaggaccaauggauua

SEQ ID NO: 358902 - RNA, 19 nt, Homo sapiens
caagaucaaugcucaaguu

SEQ ID NO: 358903 - RNA, 19 nt, Homo sapiens
gaagcucgaagcagguuua

SEQ ID NO: 358904 - RNA, 19 nt, Homo sapiens
gaucaaugcucaaguuuug

SEQ ID NO: 358905 - RNA, 19 nt, Homo sapiens
uagaauagccaguagugua

SEQ ID NO: 358906 - RNA, 19 nt, Homo sapiens
gggaccaaaugaacagaaa

SEQ ID NO: 358907 - RNA, 19 nt, Homo sapiens
gcucgaagcagguuuagga

SEQ ID NO: 358908 - RNA, 19 nt, Homo sapiens
gcaauggcaacaagaagaa

SEQ ID NO: 358909 - RNA, 19 nt, Homo sapiens
cguacugacuucuccuaua

SEQ ID NO: 358910 - RNA, 19 nt, Homo sapiens
gacaaagcuugacacauca

SEQ ID NO: 358911 - RNA, 19 nt, Homo sapiens
cagcugaacuccuccaucu

SEQ ID NO: 358912 - RNA, 19 nt, Homo sapiens
gacaacauccuccagauuc

SEQ ID NO: 358913 - RNA, 19 nt, Homo sapiens
gccauagccugguuaaagu

SEQ ID NO: 358914 - RNA, 19 nt, Homo sapiens
agaaacaagugcccaguca

SEQ ID NO: 358915 - RNA, 19 nt, Homo sapiens
gaagaagucgggcaagaag

SEQ ID NO: 358916 - RNA, 19 nt, Homo sapiens
gaaagucucagcccaggau

SEQ ID NO: 358917 - RNA, 19 nt, Homo sapiens
ggaggaggcucuguauguc

SEQ ID NO: 358918 - RNA, 19 nt, Homo sapiens
ggaccagucuucuguuuug

SEQ ID NO: 358919 - RNA, 19 nt, Homo sapiens
ggacccuucccacuacaua

SEQ ID NO: 358920 - RNA, 19 nt, Homo sapiens
gcgcuaacccgcugaaagu

SEQ ID NO: 358921 - RNA, 19 nt, Homo sapiens
cuacaagccuccuaguucu

SEQ ID NO: 358922 - RNA, 19 nt, Homo sapiens
gaacuccuccaucuuccaa

SEQ ID NO: 358923 - RNA, 19 nt, Homo sapiens
gcuaacccgcugaaaguuu

SEQ ID NO: 358924 - RNA, 19 nt, Homo sapiens
guguugaaguaccaaguaa

SEQ ID NO: 358925 - RNA, 19 nt, Homo sapiens
gaacugcuuuugagugaga

SEQ ID NO: 358926 - RNA, 19 nt, Homo sapiens
gaccugcccuuacaguagu

SEQ ID NO: 358927 - RNA, 19 nt, Homo sapiens
ugaaguaccaaguaaccua

SEQ ID NO: 358928 - RNA, 19 nt, Homo sapiens
gcugaacuccuccaucuuc

SEQ ID NO: 358929 - RNA, 19 nt, Homo sapiens
gcacccaggccucagaguu

SEQ ID NO: 358930 - RNA, 19 nt, Homo sapiens
caagaaggagaagaaguaa

SEQ ID NO: 358931 - RNA, 19 nt, Homo sapiens
ccuauaagcgcuucucuuc

SEQ ID NO: 358932 - RNA, 19 nt, Homo sapiens
ggccauagccugguuaaag

SEQ ID NO: 358933 - RNA, 19 nt, Homo sapiens
ggagaagaaguaacaugga

SEQ ID NO: 358934 - RNA, 19 nt, Homo sapiens
guagugcggugugcuuuua

SEQ ID NO: 358935 - RNA, 19 nt, Homo sapiens
caacaaccaguuugacaca

SEQ ID NO: 358936 - RNA, 19 nt, Homo sapiens
gggcauggacaaagcuuga

SEQ ID NO: 358937 - RNA, 19 nt, Homo sapiens
gagcuaacaggaccaaugg

SEQ ID NO: 358938 - RNA, 19 nt, Homo sapiens
gccauaaaccaauaacuag

SEQ ID NO: 358939 - RNA, 19 nt, Homo sapiens
ugacaacauccuccagauu

SEQ ID NO: 358940 - RNA, 19 nt, Homo sapiens
gguguugaaguaccaagua

SEQ ID NO: 358941 - RNA, 19 nt, Homo sapiens
gcaccuggcccaacaacca

SEQ ID NO: 358942 - RNA, 19 nt, Homo sapiens
agaaggagaagaaguaaca

SEQ ID NO: 358943 - RNA, 19 nt, Homo sapiens
aagaagaagucgggcaaga

SEQ ID NO: 358944 - RNA, 19 nt, Homo sapiens
gcagccgucuguccuugau

SEQ ID NO: 358945 - RNA, 19 nt, Homo sapiens
gcuggacccuucccacuac

SEQ ID NO: 358946 - RNA, 19 nt, Homo sapiens
acaaccaguuugacacaga

SEQ ID NO: 358947 - RNA, 19 nt, Homo sapiens
acaagagacuccacugcau

SEQ ID NO: 358948 - RNA, 19 nt, Homo sapiens
guuccucuuucccgaguaa

SEQ ID NO: 358949 - RNA, 19 nt, Homo sapiens
gcgcuucucuucgcauagu

SEQ ID NO: 358950 - RNA, 19 nt, Homo sapiens
gcuuugggcugagcuaaca

SEQ ID NO: 358951 - RNA, 19 nt, Homo sapiens
ccuacaagccuccuaguuc

SEQ ID NO: 358952 - RNA, 19 nt, Homo sapiens
guagacaccaagaaccauu

SEQ ID NO: 358953 - RNA, 19 nt, Homo sapiens
gagaggaacugcuuuugag

SEQ ID NO: 358954 - RNA, 19 nt, Homo sapiens
ggauuuagggagggcauuu

SEQ ID NO: 358955 - RNA, 19 nt, Homo sapiens
gaugcuugcuggauuuagg

SEQ ID NO: 358956 - RNA, 19 nt, Homo sapiens
cacccaggccucagaguuu

SEQ ID NO: 358957 - RNA, 19 nt, Homo sapiens
ggcaauggcaacaagaaga

SEQ ID NO: 358958 - RNA, 19 nt, Homo sapiens
aagcgcuucucuucgcaua

SEQ ID NO: 358959 - RNA, 19 nt, Homo sapiens
gaccaaaugaacagaaagu

SEQ ID NO: 358960 - RNA, 19 nt, Homo sapiens
agccauaaaccaauaacua

SEQ ID NO: 358961 - RNA, 19 nt, Homo sapiens
ccucuuggccucuccuuug

SEQ ID NO: 358962 - RNA, 19 nt, Homo sapiens
cagcccagcuucuccuuac

SEQ ID NO: 358963 - RNA, 19 nt, Homo sapiens
gcaaugccacacugaccaa

SEQ ID NO: 358964 - RNA, 19 nt, Homo sapiens
gguguagaauagccaguag

SEQ ID NO: 358965 - RNA, 19 nt, Homo sapiens
ggauggggcuucuucaaca

SEQ ID NO: 358966 - RNA, 19 nt, Homo sapiens
gcuaacaggaccaauggau

SEQ ID NO: 358967 - RNA, 19 nt, Homo sapiens
ugacacaucaaguuaucaa

SEQ ID NO: 358968 - RNA, 19 nt, Homo sapiens
acugaugcuugcuggauuu

SEQ ID NO: 358969 - RNA, 19 nt, Homo sapiens
uuccagccauaaaccaaua

SEQ ID NO: 358970 - RNA, 19 nt, Homo sapiens
uggaggaggcucuguaugu

SEQ ID NO: 358971 - RNA, 19 nt, Homo sapiens
ggaagggaaguguguggau

SEQ ID NO: 358972 - RNA, 19 nt, Homo sapiens
ucuuucggcugguguagaa

SEQ ID NO: 358973 - RNA, 19 nt, Homo sapiens
ggaccaauggauuaaacug

SEQ ID NO: 358974 - RNA, 19 nt, Homo sapiens
gugcauagaccuucuucuc

SEQ ID NO: 358975 - RNA, 19 nt, Homo sapiens
ccaaaugaacagaaagucu

SEQ ID NO: 358976 - RNA, 19 nt, Homo sapiens
gagacuccacugcauguuc

SEQ ID NO: 358977 - RNA, 19 nt, Homo sapiens
gggcagggaccaaaugaac

SEQ ID NO: 358978 - RNA, 19 nt, Homo sapiens
caggaccaauggauuaaac

SEQ ID NO: 358979 - RNA, 19 nt, Homo sapiens
cuaacaggaccaauggauu

SEQ ID NO: 358980 - RNA, 19 nt, Homo sapiens
ccuccagauuccagccaua

SEQ ID NO: 358981 - RNA, 19 nt, Homo sapiens
guacugaugcuugcuggau

SEQ ID NO: 358982 - RNA, 19 nt, Homo sapiens
agaagaagucgggcaagaa

SEQ ID NO: 358983 - RNA, 19 nt, Homo sapiens
agaauagccaguaguguag

SEQ ID NO: 358984 - RNA, 19 nt, Homo sapiens
ccaggugccguuucucuuc

SEQ ID NO: 358985 - RNA, 19 nt, Homo sapiens
gcagggaccaaaugaacag

SEQ ID NO: 358986 - RNA, 19 nt, Homo sapiens
ccagucuucuguuuuguuu

SEQ ID NO: 358987 - RNA, 19 nt, Homo sapiens
ccagagcccaagaucaaug

SEQ ID NO: 358988 - RNA, 19 nt, Homo sapiens
cuuggccucuccuuugauu

SEQ ID NO: 358989 - RNA, 19 nt, Homo sapiens
cauccaaucaacugcugua

SEQ ID NO: 358990 - RNA, 19 nt, Homo sapiens
gacccuucccacuacauaa

SEQ ID NO: 358991 - RNA, 19 nt, Homo sapiens
caacacggacuggcguuuc

SEQ ID NO: 358992 - RNA, 19 nt, Homo sapiens
guagugggguuacuguaga

SEQ ID NO: 358993 - RNA, 19 nt, Homo sapiens
gccagccaggccauucuua

SEQ ID NO: 358994 - RNA, 19 nt, Homo sapiens
ugagcuaacaggaccaaug

SEQ ID NO: 358995 - RNA, 19 nt, Homo sapiens
aguauggggugguaagaua

SEQ ID NO: 358996 - RNA, 19 nt, Homo sapiens
uggaggacaugaucaccau

SEQ ID NO: 358997 - RNA, 19 nt, Homo sapiens
gaauuccacucuaauauga

SEQ ID NO: 358998 - RNA, 19 nt, Homo sapiens
gacccaagcuaugaaauua

SEQ ID NO: 358999 - RNA, 19 nt, Homo sapiens
gcgcagaguuguuaagaaa

SEQ ID NO: 359000 - RNA, 19 nt, Homo sapiens
ccagauagcuagaaguuug

SEQ ID NO: 359001 - RNA, 19 nt, Homo sapiens
aaacagagacucaguauug

SEQ ID NO: 359002 - RNA, 19 nt, Homo sapiens
gaaaugugcuacuaaugga

SEQ ID NO: 359003 - RNA, 19 nt, Homo sapiens
gcagaaaugugcuacuaau

SEQ ID NO: 359004 - RNA, 19 nt, Homo sapiens
ggacagagguaugauagug

SEQ ID NO: 359005 - RNA, 19 nt, Homo sapiens
gacaaugacccuaaguuua

SEQ ID NO: 359006 - RNA, 19 nt, Homo sapiens
ggagacaacauuucaauug

SEQ ID NO: 359007 - RNA, 19 nt, Homo sapiens
gaaauucagccucuuaugu

SEQ ID NO: 359008 - RNA, 19 nt, Homo sapiens
gaccugaacuacagcauug

SEQ ID NO: 359009 - RNA, 19 nt, Homo sapiens
gagaugagccuguacauag

SEQ ID NO: 359010 - RNA, 19 nt, Homo sapiens
gaggagaacaauaacauuu

SEQ ID NO: 359011 - RNA, 19 nt, Homo sapiens
gcacguguuugucaaugaa

SEQ ID NO: 359012 - RNA, 19 nt, Homo sapiens
ugacaaugcucccacaguu

SEQ ID NO: 359013 - RNA, 19 nt, Homo sapiens
ggaagcgacucacguuugu

SEQ ID NO: 359014 - RNA, 19 nt, Homo sapiens
aacaauaacuuucggaaga

SEQ ID NO: 359015 - RNA, 19 nt, Homo sapiens
guacagcugucaaaccaau

SEQ ID NO: 359016 - RNA, 19 nt, Homo sapiens
gcaaggcauuacaaaucua

SEQ ID NO: 359017 - RNA, 19 nt, Homo sapiens
gggaacaucagaccacaua

SEQ ID NO: 359018 - RNA, 19 nt, Homo sapiens
gcaaacagaugcgucuaca

SEQ ID NO: 359019 - RNA, 19 nt, Homo sapiens
gcgauugacucccagauag

SEQ ID NO: 359020 - RNA, 19 nt, Homo sapiens
ugacagguaugaguuuaaa

SEQ ID NO: 359021 - RNA, 19 nt, Homo sapiens
gcacccauugcaugaauua

SEQ ID NO: 359022 - RNA, 19 nt, Homo sapiens
gagacaacauuucaauugg

SEQ ID NO: 359023 - RNA, 19 nt, Homo sapiens
gcaaacagagacucaguau

SEQ ID NO: 359024 - RNA, 19 nt, Homo sapiens
gaguacagcugucaaacca

SEQ ID NO: 359025 - RNA, 19 nt, Homo sapiens
gguaugauagugucaauga

SEQ ID NO: 359026 - RNA, 19 nt, Homo sapiens
gaaaucccuucaagcuguu

SEQ ID NO: 359027 - RNA, 19 nt, Homo sapiens
acaaugacccuaaguuuau

SEQ ID NO: 359028 - RNA, 19 nt, Homo sapiens
gagcaacaacucccugauu

SEQ ID NO: 359029 - RNA, 19 nt, Homo sapiens
gacaaugcucccacaguua

SEQ ID NO: 359030 - RNA, 19 nt, Homo sapiens
gaacgugaauuggacucaa

SEQ ID NO: 359031 - RNA, 19 nt, Homo sapiens
gaaauugaucccacuagug

SEQ ID NO: 359032 - RNA, 19 nt, Homo sapiens
ugacaaugacccuaaguuu

SEQ ID NO: 359033 - RNA, 19 nt, Homo sapiens
gagacucaguauugucauu

SEQ ID NO: 359034 - RNA, 19 nt, Homo sapiens
gaacaucagaccacauaca

SEQ ID NO: 359035 - RNA, 19 nt, Homo sapiens
acauagaggagaacaauaa

SEQ ID NO: 359036 - RNA, 19 nt, Homo sapiens
gagguuuacuucccugaga

SEQ ID NO: 359037 - RNA, 19 nt, Homo sapiens
gcugaauuccacucuaaua

SEQ ID NO: 359038 - RNA, 19 nt, Homo sapiens
gcagaucgaauacguguuc

SEQ ID NO: 359039 - RNA, 19 nt, Homo sapiens
caaauggacagagguauga

SEQ ID NO: 359040 - RNA, 19 nt, Homo sapiens
ggaagaagcaggaggaaaa

SEQ ID NO: 359041 - RNA, 19 nt, Homo sapiens
gcaggaagcgacucacguu

SEQ ID NO: 359042 - RNA, 19 nt, Homo sapiens
uggcugaauuccacucuaa

SEQ ID NO: 359043 - RNA, 19 nt, Homo sapiens
gacaacauuucaauuggau

SEQ ID NO: 359044 - RNA, 19 nt, Homo sapiens
ggcaaggcauuacaaaucu

SEQ ID NO: 359045 - RNA, 19 nt, Homo sapiens
ccacauacacuuucagagu

SEQ ID NO: 359046 - RNA, 19 nt, Homo sapiens
guacauagaggagaacaau

SEQ ID NO: 359047 - RNA, 19 nt, Homo sapiens
gcaggacgucuucaccuuu

SEQ ID NO: 359048 - RNA, 19 nt, Homo sapiens
gggcagcacuacggugauu

SEQ ID NO: 359049 - RNA, 19 nt, Homo sapiens
gcgagcagacugacaggua

SEQ ID NO: 359050 - RNA, 19 nt, Homo sapiens
ucaacgggcagaucgaaua

SEQ ID NO: 359051 - RNA, 19 nt, Homo sapiens
cccauugcaugaauuauga

SEQ ID NO: 359052 - RNA, 19 nt, Homo sapiens
gagccuggguuuggaguga

SEQ ID NO: 359053 - RNA, 19 nt, Homo sapiens
gcgguuagcaccuauuaga

SEQ ID NO: 359054 - RNA, 19 nt, Homo sapiens
gagcagagccuggguuugg

SEQ ID NO: 359055 - RNA, 19 nt, Homo sapiens
acaauaacuuucggaagaa

SEQ ID NO: 359056 - RNA, 19 nt, Homo sapiens
agacaacauuucaauugga

SEQ ID NO: 359057 - RNA, 19 nt, Homo sapiens
caacgugccguccauugaa

SEQ ID NO: 359058 - RNA, 19 nt, Homo sapiens
caacucgaguagcagcaaa

SEQ ID NO: 359059 - RNA, 19 nt, Homo sapiens
gcgucuacauccauacauu

SEQ ID NO: 359060 - RNA, 19 nt, Homo sapiens
ucaaugagaagcugucaga

SEQ ID NO: 359061 - RNA, 19 nt, Homo sapiens
gaggaaaucccuucaagcu

SEQ ID NO: 359062 - RNA, 19 nt, Homo sapiens
ucgcuggacuccucuguga

SEQ ID NO: 359063 - RNA, 19 nt, Homo sapiens
ccaacagcaugacaaaucu

SEQ ID NO: 359064 - RNA, 19 nt, Homo sapiens
ugaaauugaucccacuagu

SEQ ID NO: 359065 - RNA, 19 nt, Homo sapiens
caucagaccacauacacuu

SEQ ID NO: 359066 - RNA, 19 nt, Homo sapiens
cgagcagacugacagguau

SEQ ID NO: 359067 - RNA, 19 nt, Homo sapiens
ccgaguaccugaagaucga

SEQ ID NO: 359068 - RNA, 19 nt, Homo sapiens
ggaguccgguuccgaguac

SEQ ID NO: 359069 - RNA, 19 nt, Homo sapiens
gaucgggugaggugacuuu

SEQ ID NO: 359070 - RNA, 19 nt, Homo sapiens
ggaaauucagccucuuaug

SEQ ID NO: 359071 - RNA, 19 nt, Homo sapiens
cuacauccauacauuacug

SEQ ID NO: 359072 - RNA, 19 nt, Homo sapiens
gagguaugauagugucaau

SEQ ID NO: 359073 - RNA, 19 nt, Homo sapiens
caacauuucaauuggauca

SEQ ID NO: 359074 - RNA, 19 nt, Homo sapiens
agcaacaacucccugauug

SEQ ID NO: 359075 - RNA, 19 nt, Homo sapiens
gagcuggguggaccuguuu

SEQ ID NO: 359076 - RNA, 19 nt, Homo sapiens
ccucuuaugucuuugucuu

SEQ ID NO: 359077 - RNA, 19 nt, Homo sapiens
cgucuacauccauacauua

SEQ ID NO: 359078 - RNA, 19 nt, Homo sapiens
gagcaggagacaacauuuc

SEQ ID NO: 359079 - RNA, 19 nt, Homo sapiens
gaagaucgacaaccucacu

SEQ ID NO: 359080 - RNA, 19 nt, Homo sapiens
caguauuaaugcagaaaug

SEQ ID NO: 359081 - RNA, 19 nt, Homo sapiens
agaugagccuguacauaga

SEQ ID NO: 359082 - RNA, 19 nt, Homo sapiens
ugaauuccacucuaauaug

SEQ ID NO: 359083 - RNA, 19 nt, Homo sapiens
ccaauaacaaguacagcaa

SEQ ID NO: 359084 - RNA, 19 nt, Homo sapiens
gucaaaccaauaacaagua

SEQ ID NO: 359085 - RNA, 19 nt, Homo sapiens
gaucacugcucugaguaca

SEQ ID NO: 359086 - RNA, 19 nt, Homo sapiens
ggagcaggagacaacauuu

SEQ ID NO: 359087 - RNA, 19 nt, Homo sapiens
ugacccaagcuaugaaauu

SEQ ID NO: 359088 - RNA, 19 nt, Homo sapiens
caaugacccuaaguuuaug

SEQ ID NO: 359089 - RNA, 19 nt, Homo sapiens
uagcaccuauuagacguaa

SEQ ID NO: 359090 - RNA, 19 nt, Homo sapiens
gagcagagucggaguugag

SEQ ID NO: 359091 - RNA, 19 nt, Homo sapiens
caauaacaaguacagcaaa

SEQ ID NO: 359092 - RNA, 19 nt, Homo sapiens
gggagcaggagacaacauu

SEQ ID NO: 359093 - RNA, 19 nt, Homo sapiens
ccaaauggacagagguaug

SEQ ID NO: 359094 - RNA, 19 nt, Homo sapiens
gcugcuucgugacuaauga

SEQ ID NO: 359095 - RNA, 19 nt, Homo sapiens
gcgauuagcacccauugca

SEQ ID NO: 359096 - RNA, 19 nt, Homo sapiens
ucaaaccaauaacaaguac

SEQ ID NO: 359097 - RNA, 19 nt, Homo sapiens
gcaacuaaguggauaauua

SEQ ID NO: 359098 - RNA, 19 nt, Homo sapiens
gacccaagcuaugaaauua

SEQ ID NO: 359099 - RNA, 19 nt, Homo sapiens
gaaagaaguauucagagua

SEQ ID NO: 359100 - RNA, 19 nt, Homo sapiens
gcgcagaguuguuaagaaa

SEQ ID NO: 359101 - RNA, 19 nt, Homo sapiens
ccagauagcuagaaguuug

SEQ ID NO: 359102 - RNA, 19 nt, Homo sapiens
gaauuaagguucacuaaac

SEQ ID NO: 359103 - RNA, 19 nt, Homo sapiens
aaacagagacucaguauug

SEQ ID NO: 359104 - RNA, 19 nt, Homo sapiens
gauaugcaauuaccauuug

SEQ ID NO: 359105 - RNA, 19 nt, Homo sapiens
ucacuaaacuacugaaaga

SEQ ID NO: 359106 - RNA, 19 nt, Homo sapiens
ggacagagguaugauagug

SEQ ID NO: 359107 - RNA, 19 nt, Homo sapiens
gacaaugacccuaaguuua

SEQ ID NO: 359108 - RNA, 19 nt, Homo sapiens
gcaaacagguaagauguau

SEQ ID NO: 359109 - RNA, 19 nt, Homo sapiens
ggagacaacauuucaauug

SEQ ID NO: 359110 - RNA, 19 nt, Homo sapiens
gcacuugacaucccuaauu

SEQ ID NO: 359111 - RNA, 19 nt, Homo sapiens
gaccugaacuacagcauug

SEQ ID NO: 359112 - RNA, 19 nt, Homo sapiens
gagaugagccuguacauag

SEQ ID NO: 359113 - RNA, 19 nt, Homo sapiens
gaaauacugacuacuuuga

SEQ ID NO: 359114 - RNA, 19 nt, Homo sapiens
gcaguucucuuugcacuug

SEQ ID NO: 359115 - RNA, 19 nt, Homo sapiens
gaggagaacaauaacauuu

SEQ ID NO: 359116 - RNA, 19 nt, Homo sapiens
guacuaagucugagauauu

SEQ ID NO: 359117 - RNA, 19 nt, Homo sapiens
gcacguguuugucaaugaa

SEQ ID NO: 359118 - RNA, 19 nt, Homo sapiens
ugacaaugcucccacaguu

SEQ ID NO: 359119 - RNA, 19 nt, Homo sapiens
ggaagcgacucacguuugu

SEQ ID NO: 359120 - RNA, 19 nt, Homo sapiens
gcaaaggccaucuacaaga

SEQ ID NO: 359121 - RNA, 19 nt, Homo sapiens
gguaagauguaucccaaau

SEQ ID NO: 359122 - RNA, 19 nt, Homo sapiens
aacaauaacuuucggaaga

SEQ ID NO: 359123 - RNA, 19 nt, Homo sapiens
caagagguauaccacugua

SEQ ID NO: 359124 - RNA, 19 nt, Homo sapiens
guacagcugucaaaccaau

SEQ ID NO: 359125 - RNA, 19 nt, Homo sapiens
gcaaggcauuacaaaucua

SEQ ID NO: 359126 - RNA, 19 nt, Homo sapiens
gggaacaucagaccacaua

SEQ ID NO: 359127 - RNA, 19 nt, Homo sapiens
gcgauugacucccagauag

SEQ ID NO: 359128 - RNA, 19 nt, Homo sapiens
ugacagguaugaguuuaaa

SEQ ID NO: 359129 - RNA, 19 nt, Homo sapiens
gcacccauugcaugaauua

SEQ ID NO: 359130 - RNA, 19 nt, Homo sapiens
aaagaaguauucagaguag

SEQ ID NO: 359131 - RNA, 19 nt, Homo sapiens
gagacaacauuucaauugg

SEQ ID NO: 359132 - RNA, 19 nt, Homo sapiens
gcaaacagagacucaguau

SEQ ID NO: 359133 - RNA, 19 nt, Homo sapiens
ucaugcagauguaguacua

SEQ ID NO: 359134 - RNA, 19 nt, Homo sapiens
gaguacagcugucaaacca

SEQ ID NO: 359135 - RNA, 19 nt, Homo sapiens
gguaugauagugucaauga

SEQ ID NO: 359136 - RNA, 19 nt, Homo sapiens
gaaaucccuucaagcuguu

SEQ ID NO: 359137 - RNA, 19 nt, Homo sapiens
acaaugacccuaaguuuau

SEQ ID NO: 359138 - RNA, 19 nt, Homo sapiens
gagcaacaacucccugauu

SEQ ID NO: 359139 - RNA, 19 nt, Homo sapiens
gacaaugcucccacaguua

SEQ ID NO: 359140 - RNA, 19 nt, Homo sapiens
gaacgugaauuggacucaa

SEQ ID NO: 359141 - RNA, 19 nt, Homo sapiens
gcugauucaugcagaugua

SEQ ID NO: 359142 - RNA, 19 nt, Homo sapiens
ugacaucccuaauucauac

SEQ ID NO: 359143 - RNA, 19 nt, Homo sapiens
caaaggccaucuacaagag

SEQ ID NO: 359144 - RNA, 19 nt, Homo sapiens
gaaauugaucccacuagug

SEQ ID NO: 359145 - RNA, 19 nt, Homo sapiens
ugacaaugacccuaaguuu

SEQ ID NO: 359146 - RNA, 19 nt, Homo sapiens
aaacuccacuuucaaucuu

SEQ ID NO: 359147 - RNA, 19 nt, Homo sapiens
gagacucaguauugucauu

SEQ ID NO: 359148 - RNA, 19 nt, Homo sapiens
gaacaucagaccacauaca

SEQ ID NO: 359149 - RNA, 19 nt, Homo sapiens
acauagaggagaacaauaa

SEQ ID NO: 359150 - RNA, 19 nt, Homo sapiens
gagguuuacuucccugaga

SEQ ID NO: 359151 - RNA, 19 nt, Homo sapiens
guaagauguaucccaaaua

SEQ ID NO: 359152 - RNA, 19 nt, Homo sapiens
gcagaucgaauacguguuc

SEQ ID NO: 359153 - RNA, 19 nt, Homo sapiens
gauaauuacauccagagaa

SEQ ID NO: 359154 - RNA, 19 nt, Homo sapiens
uagcaaaggccaucuacaa

SEQ ID NO: 359155 - RNA, 19 nt, Homo sapiens
caaauggacagagguauga

SEQ ID NO: 359156 - RNA, 19 nt, Homo sapiens
ggaagaagcaggaggaaaa

SEQ ID NO: 359157 - RNA, 19 nt, Homo sapiens
gcaggaagcgacucacguu

SEQ ID NO: 359158 - RNA, 19 nt, Homo sapiens
cuacuggugucuaugcaaa

SEQ ID NO: 359159 - RNA, 19 nt, Homo sapiens
gacaacauuucaauuggau

SEQ ID NO: 359160 - RNA, 19 nt, Homo sapiens
gauguaguacuaagucuga

SEQ ID NO: 359161 - RNA, 19 nt, Homo sapiens
ggcaaggcauuacaaaucu

SEQ ID NO: 359162 - RNA, 19 nt, Homo sapiens
ccacauacacuuucagagu

SEQ ID NO: 359163 - RNA, 19 nt, Homo sapiens
guacauagaggagaacaau

SEQ ID NO: 359164 - RNA, 19 nt, Homo sapiens
gcaggacgucuucaccuuu

SEQ ID NO: 359165 - RNA, 19 nt, Homo sapiens
gggcagcacuacggugauu

SEQ ID NO: 359166 - RNA, 19 nt, Homo sapiens
gcgagcagacugacaggua

SEQ ID NO: 359167 - RNA, 19 nt, Homo sapiens
ucaacgggcagaucgaaua

SEQ ID NO: 359168 - RNA, 19 nt, Homo sapiens
cccauugcaugaauuauga

SEQ ID NO: 359169 - RNA, 19 nt, Homo sapiens
gagccuggguuuggaguga

SEQ ID NO: 359170 - RNA, 19 nt, Homo sapiens
gagcagagccuggguuugg

SEQ ID NO: 359171 - RNA, 19 nt, Homo sapiens
cuaaguggauaauuacauc

SEQ ID NO: 359172 - RNA, 19 nt, Homo sapiens
acaauaacuuucggaagaa

SEQ ID NO: 359173 - RNA, 19 nt, Homo sapiens
caacuaaguggauaauuac

SEQ ID NO: 359174 - RNA, 19 nt, Homo sapiens
agacaacauuucaauugga

SEQ ID NO: 359175 - RNA, 19 nt, Homo sapiens
caacgugccguccauugaa

SEQ ID NO: 359176 - RNA, 19 nt, Homo sapiens
caacucgaguagcagcaaa

SEQ ID NO: 359177 - RNA, 19 nt, Homo sapiens
ucaaugagaagcugucaga

SEQ ID NO: 359178 - RNA, 19 nt, Homo sapiens
gaggaaaucccuucaagcu

SEQ ID NO: 359179 - RNA, 19 nt, Homo sapiens
ucgcuggacuccucuguga

SEQ ID NO: 359180 - RNA, 19 nt, Homo sapiens
uuacugauaugcaaauguc

SEQ ID NO: 359181 - RNA, 19 nt, Homo sapiens
ggagggcuaauaacucuga

SEQ ID NO: 359182 - RNA, 19 nt, Homo sapiens
ccaacagcaugacaaaucu

SEQ ID NO: 359183 - RNA, 19 nt, Homo sapiens
ugaaauugaucccacuagu

SEQ ID NO: 359184 - RNA, 19 nt, Homo sapiens
caucagaccacauacacuu

SEQ ID NO: 359185 - RNA, 19 nt, Homo sapiens
cgagcagacugacagguau

SEQ ID NO: 359186 - RNA, 19 nt, Homo sapiens
ccgaguaccugaagaucga

SEQ ID NO: 359187 - RNA, 19 nt, Homo sapiens
ggaguccgguuccgaguac

SEQ ID NO: 359188 - RNA, 19 nt, Homo sapiens
gaucgggugaggugacuuu

SEQ ID NO: 359189 - RNA, 19 nt, Homo sapiens
gagguaugauagugucaau

SEQ ID NO: 359190 - RNA, 19 nt, Homo sapiens
ccauuugcauucuuucugu

SEQ ID NO: 359191 - RNA, 19 nt, Homo sapiens
aaauagaugcugauucaug

SEQ ID NO: 359192 - RNA, 19 nt, Homo sapiens
cuaaacuacugaaagaagu

SEQ ID NO: 359193 - RNA, 19 nt, Homo sapiens
caaguacagcaaacaggua

SEQ ID NO: 359194 - RNA, 19 nt, Homo sapiens
caacauuucaauuggauca

SEQ ID NO: 359195 - RNA, 19 nt, Homo sapiens
agcaacaacucccugauug

SEQ ID NO: 359196 - RNA, 19 nt, Homo sapiens
gagcuggguggaccuguuu

SEQ ID NO: 359197 - RNA, 19 nt, Homo sapiens
gaagagaaguuuaccugua

SEQ ID NO: 359198 - RNA, 19 nt, Homo sapiens
guagaaaccauccuuguua

SEQ ID NO: 359199 - RNA, 19 nt, Homo sapiens
gacccaagcuaugaaauua

SEQ ID NO: 359200 - RNA, 19 nt, Homo sapiens
gcgcagaguuguuaagaaa

SEQ ID NO: 359201 - RNA, 19 nt, Homo sapiens
ccagauagcuagaaguuug

SEQ ID NO: 359202 - RNA, 19 nt, Homo sapiens
aaacagagacucaguauug

SEQ ID NO: 359203 - RNA, 19 nt, Homo sapiens
ggacagagguaugauagug

SEQ ID NO: 359204 - RNA, 19 nt, Homo sapiens
gacaaugacccuaaguuua

SEQ ID NO: 359205 - RNA, 19 nt, Homo sapiens
ggagacaacauuucaauug

SEQ ID NO: 359206 - RNA, 19 nt, Homo sapiens
gaccugaacuacagcauug

SEQ ID NO: 359207 - RNA, 19 nt, Homo sapiens
gagaugagccuguacauag

SEQ ID NO: 359208 - RNA, 19 nt, Homo sapiens
ggaagaagagccagccuaa

SEQ ID NO: 359209 - RNA, 19 nt, Homo sapiens
acagaaaccuccugaacaa

SEQ ID NO: 359210 - RNA, 19 nt, Homo sapiens
gaggagaacaauaacauuu

SEQ ID NO: 359211 - RNA, 19 nt, Homo sapiens
gcacguguuugucaaugaa

SEQ ID NO: 359212 - RNA, 19 nt, Homo sapiens
ugacaaugcucccacaguu

SEQ ID NO: 359213 - RNA, 19 nt, Homo sapiens
ggaagcgacucacguuugu

SEQ ID NO: 359214 - RNA, 19 nt, Homo sapiens
aacaauaacuuucggaaga

SEQ ID NO: 359215 - RNA, 19 nt, Homo sapiens
guacagcugucaaaccaau

SEQ ID NO: 359216 - RNA, 19 nt, Homo sapiens
gcaaggcauuacaaaucua

SEQ ID NO: 359217 - RNA, 19 nt, Homo sapiens
gggaacaucagaccacaua

SEQ ID NO: 359218 - RNA, 19 nt, Homo sapiens
gaacgaggaagccaggaaa

SEQ ID NO: 359219 - RNA, 19 nt, Homo sapiens
gcgauugacucccagauag

SEQ ID NO: 359220 - RNA, 19 nt, Homo sapiens
ugacagguaugaguuuaaa

SEQ ID NO: 359221 - RNA, 19 nt, Homo sapiens
gcacccauugcaugaauua

SEQ ID NO: 359222 - RNA, 19 nt, Homo sapiens
gagacaacauuucaauugg

SEQ ID NO: 359223 - RNA, 19 nt, Homo sapiens
gcaaacagagacucaguau

SEQ ID NO: 359224 - RNA, 19 nt, Homo sapiens
ucaauacucucacuagaag

SEQ ID NO: 359225 - RNA, 19 nt, Homo sapiens
gaguacagcugucaaacca

SEQ ID NO: 359226 - RNA, 19 nt, Homo sapiens
gguaugauagugucaauga

SEQ ID NO: 359227 - RNA, 19 nt, Homo sapiens
gaaaucccuucaagcuguu

SEQ ID NO: 359228 - RNA, 19 nt, Homo sapiens
acaaugacccuaaguuuau

SEQ ID NO: 359229 - RNA, 19 nt, Homo sapiens
gagcaacaacucccugauu

SEQ ID NO: 359230 - RNA, 19 nt, Homo sapiens
gacaaugcucccacaguua

SEQ ID NO: 359231 - RNA, 19 nt, Homo sapiens
gaacgugaauuggacucaa

SEQ ID NO: 359232 - RNA, 19 nt, Homo sapiens
ucagaaacaccaagcagua

SEQ ID NO: 359233 - RNA, 19 nt, Homo sapiens
gaaauugaucccacuagug

SEQ ID NO: 359234 - RNA, 19 nt, Homo sapiens
ugacaaugacccuaaguuu

SEQ ID NO: 359235 - RNA, 19 nt, Homo sapiens
aaaccauccuuguuacuug

SEQ ID NO: 359236 - RNA, 19 nt, Homo sapiens
gagacucaguauugucauu

SEQ ID NO: 359237 - RNA, 19 nt, Homo sapiens
gaacaucagaccacauaca

SEQ ID NO: 359238 - RNA, 19 nt, Homo sapiens
acauagaggagaacaauaa

SEQ ID NO: 359239 - RNA, 19 nt, Homo sapiens
gagguuuacuucccugaga

SEQ ID NO: 359240 - RNA, 19 nt, Homo sapiens
gaaaccauccuuguuacuu

SEQ ID NO: 359241 - RNA, 19 nt, Homo sapiens
gcaaaacguuuaaucacaa

SEQ ID NO: 359242 - RNA, 19 nt, Homo sapiens
agccuaaacuguccacuuu

SEQ ID NO: 359243 - RNA, 19 nt, Homo sapiens
gaggacaacuaugaaagga

SEQ ID NO: 359244 - RNA, 19 nt, Homo sapiens
aaacagccauuucguagag

SEQ ID NO: 359245 - RNA, 19 nt, Homo sapiens
gcagaucgaauacguguuc

SEQ ID NO: 359246 - RNA, 19 nt, Homo sapiens
caaggccucuuccagaugu

SEQ ID NO: 359247 - RNA, 19 nt, Homo sapiens
ggauggcaguguugauuca

SEQ ID NO: 359248 - RNA, 19 nt, Homo sapiens
gaaacaccaagcaguaaga

SEQ ID NO: 359249 - RNA, 19 nt, Homo sapiens
caaauggacagagguauga

SEQ ID NO: 359250 - RNA, 19 nt, Homo sapiens
ggaagaagcaggaggaaaa

SEQ ID NO: 359251 - RNA, 19 nt, Homo sapiens
gcaggaagcgacucacguu

SEQ ID NO: 359252 - RNA, 19 nt, Homo sapiens
uaagccaucuccugucaau

SEQ ID NO: 359253 - RNA, 19 nt, Homo sapiens
uauaagccaucuccuguca

SEQ ID NO: 359254 - RNA, 19 nt, Homo sapiens
gacaacauuucaauuggau

SEQ ID NO: 359255 - RNA, 19 nt, Homo sapiens
ggcaaggcauuacaaaucu

SEQ ID NO: 359256 - RNA, 19 nt, Homo sapiens
ccacauacacuuucagagu

SEQ ID NO: 359257 - RNA, 19 nt, Homo sapiens
guacauagaggagaacaau

SEQ ID NO: 359258 - RNA, 19 nt, Homo sapiens
gcaggacgucuucaccuuu

SEQ ID NO: 359259 - RNA, 19 nt, Homo sapiens
gggcagcacuacggugauu

SEQ ID NO: 359260 - RNA, 19 nt, Homo sapiens
gcgagcagacugacaggua

SEQ ID NO: 359261 - RNA, 19 nt, Homo sapiens
ucaacgggcagaucgaaua

SEQ ID NO: 359262 - RNA, 19 nt, Homo sapiens
cccauugcaugaauuauga

SEQ ID NO: 359263 - RNA, 19 nt, Homo sapiens
gagccuggguuuggaguga

SEQ ID NO: 359264 - RNA, 19 nt, Homo sapiens
gaagccaacccugaggaua

SEQ ID NO: 359265 - RNA, 19 nt, Homo sapiens
ccuaaacuguccacuuuca

SEQ ID NO: 359266 - RNA, 19 nt, Homo sapiens
gagcagagccuggguuugg

SEQ ID NO: 359267 - RNA, 19 nt, Homo sapiens
aagagaaguuuaccuguag

SEQ ID NO: 359268 - RNA, 19 nt, Homo sapiens
caacagaaaccuccugaac

SEQ ID NO: 359269 - RNA, 19 nt, Homo sapiens
gaagaagagccagccuaaa

SEQ ID NO: 359270 - RNA, 19 nt, Homo sapiens
acaauaacuuucggaagaa

SEQ ID NO: 359271 - RNA, 19 nt, Homo sapiens
ccacuuucaugccuguuga

SEQ ID NO: 359272 - RNA, 19 nt, Homo sapiens
agacaacauuucaauugga

SEQ ID NO: 359273 - RNA, 19 nt, Homo sapiens
caacgugccguccauugaa

SEQ ID NO: 359274 - RNA, 19 nt, Homo sapiens
caacucgaguagcagcaaa

SEQ ID NO: 359275 - RNA, 19 nt, Homo sapiens
cagaucaggccuuuaguga

SEQ ID NO: 359276 - RNA, 19 nt, Homo sapiens
ucaaugagaagcugucaga

SEQ ID NO: 359277 - RNA, 19 nt, Homo sapiens
gaggaaaucccuucaagcu

SEQ ID NO: 359278 - RNA, 19 nt, Homo sapiens
ucgcuggacuccucuguga

SEQ ID NO: 359279 - RNA, 19 nt, Homo sapiens
gcagcuaguuucagcaaaa

SEQ ID NO: 359280 - RNA, 19 nt, Homo sapiens
ccaacagcaugacaaaucu

SEQ ID NO: 359281 - RNA, 19 nt, Homo sapiens
ugaaauugaucccacuagu

SEQ ID NO: 359282 - RNA, 19 nt, Homo sapiens
caucagaccacauacacuu

SEQ ID NO: 359283 - RNA, 19 nt, Homo sapiens
cgagcagacugacagguau

SEQ ID NO: 359284 - RNA, 19 nt, Homo sapiens
ccgaguaccugaagaucga

SEQ ID NO: 359285 - RNA, 19 nt, Homo sapiens
ggaguccgguuccgaguac

SEQ ID NO: 359286 - RNA, 19 nt, Homo sapiens
gaucgggugaggugacuuu

SEQ ID NO: 359287 - RNA, 19 nt, Homo sapiens
uaaaggagcaacagcaaag

SEQ ID NO: 359288 - RNA, 19 nt, Homo sapiens
gaagagccagccuaaacug

SEQ ID NO: 359289 - RNA, 19 nt, Homo sapiens
guacagcaaacagccauuu

SEQ ID NO: 359290 - RNA, 19 nt, Homo sapiens
gagguaugauagugucaau

SEQ ID NO: 359291 - RNA, 19 nt, Homo sapiens
caacauuucaauuggauca

SEQ ID NO: 359292 - RNA, 19 nt, Homo sapiens
agcaacaacucccugauug

SEQ ID NO: 359293 - RNA, 19 nt, Homo sapiens
gagcuggguggaccuguuu

SEQ ID NO: 359294 - RNA, 19 nt, Homo sapiens
gagcaggagacaacauuuc

SEQ ID NO: 359295 - RNA, 19 nt, Homo sapiens
gaagaucgacaaccucacu

SEQ ID NO: 359296 - RNA, 19 nt, Homo sapiens
aaguuuaccuguaggcuau

SEQ ID NO: 359297 - RNA, 19 nt, Homo sapiens
gcacagggcucgcaaagag

SEQ ID NO: 359298 - RNA, 19 nt, Homo sapiens
ggaaagcgccugucacuuc

SEQ ID NO: 359299 - RNA, 19 nt, Homo sapiens
caaaggaacugucuguaag

SEQ ID NO: 359300 - RNA, 19 nt, Homo sapiens
gagcgucuaugagaaagua

SEQ ID NO: 359301 - RNA, 19 nt, Homo sapiens
uaaaccgugucacuuauaa

SEQ ID NO: 359302 - RNA, 19 nt, Homo sapiens
gaaaguaucgggugacaca

SEQ ID NO: 359303 - RNA, 19 nt, Homo sapiens
ccaaaggaacugucuguaa

SEQ ID NO: 359304 - RNA, 19 nt, Homo sapiens
gaagcuauuuccaaucaca

SEQ ID NO: 359305 - RNA, 19 nt, Homo sapiens
gaagaagggagccaaugaa

SEQ ID NO: 359306 - RNA, 19 nt, Homo sapiens
cgacagcgauuccgacauc

SEQ ID NO: 359307 - RNA, 19 nt, Homo sapiens
gcagagcgucuaugagaaa

SEQ ID NO: 359308 - RNA, 19 nt, Homo sapiens
gcagagaagcagagaaguu

SEQ ID NO: 359309 - RNA, 19 nt, Homo sapiens
gcuauugacuuugauuuca

SEQ ID NO: 359310 - RNA, 19 nt, Homo sapiens
ggaccugcauaugaaagua

SEQ ID NO: 359311 - RNA, 19 nt, Homo sapiens
ccgaggaccugcauaugaa

SEQ ID NO: 359312 - RNA, 19 nt, Homo sapiens
ucacuuauaagcacaguaa

SEQ ID NO: 359313 - RNA, 19 nt, Homo sapiens
ggaaguuauugccaaagga

SEQ ID NO: 359314 - RNA, 19 nt, Homo sapiens
agaaaguacugcacagaga

SEQ ID NO: 359315 - RNA, 19 nt, Homo sapiens
guaaaccgugucacuuaua

SEQ ID NO: 359316 - RNA, 19 nt, Homo sapiens
gaaguuauugccaaaggaa

SEQ ID NO: 359317 - RNA, 19 nt, Homo sapiens
caaccuaguguuugagaaa

SEQ ID NO: 359318 - RNA, 19 nt, Homo sapiens
cgaagaagggagccaauga

SEQ ID NO: 359319 - RNA, 19 nt, Homo sapiens
ugugguagauuucaaguuc

SEQ ID NO: 359320 - RNA, 19 nt, Homo sapiens
aagcuaaaguggaaguuau

SEQ ID NO: 359321 - RNA, 19 nt, Homo sapiens
caagaugugccuuacaaug

SEQ ID NO: 359322 - RNA, 19 nt, Homo sapiens
uaugaaaugugugcaguau

SEQ ID NO: 359323 - RNA, 19 nt, Homo sapiens
gaagggagccaaugaaaau

SEQ ID NO: 359324 - RNA, 19 nt, Homo sapiens
ccguaaaccgugucacuua

SEQ ID NO: 359325 - RNA, 19 nt, Homo sapiens
cguaaaccgugucacuuau

SEQ ID NO: 359326 - RNA, 19 nt, Homo sapiens
ccuaguguuugagaaauuu

SEQ ID NO: 359327 - RNA, 19 nt, Homo sapiens
cuuaugcuauugacuuuga

SEQ ID NO: 359328 - RNA, 19 nt, Homo sapiens
gccgaggaccugcauauga

SEQ ID NO: 359329 - RNA, 19 nt, Homo sapiens
agaugugccuuacaaugaa

SEQ ID NO: 359330 - RNA, 19 nt, Homo sapiens
aagaugugccuuacaauga

SEQ ID NO: 359331 - RNA, 19 nt, Homo sapiens
ugcaagaugugccuuacaa

SEQ ID NO: 359332 - RNA, 19 nt, Homo sapiens
ugucauguguuugaagaaa

SEQ ID NO: 359333 - RNA, 19 nt, Homo sapiens
gaaguuguuggaagcuauu

SEQ ID NO: 359334 - RNA, 19 nt, Homo sapiens
ugaaguuguuggaagcuau

SEQ ID NO: 359335 - RNA, 19 nt, Homo sapiens
ccgagaagccccuaaguua

SEQ ID NO: 359336 - RNA, 19 nt, Homo sapiens
cagcagcgcccuagugcaa

SEQ ID NO: 359337 - RNA, 19 nt, Homo sapiens
aaguggagcuggcggaaga

SEQ ID NO: 359338 - RNA, 19 nt, Homo sapiens
gagaagccccuaaguuauu

SEQ ID NO: 359339 - RNA, 19 nt, Homo sapiens
gcccagaugucaaccuucu

SEQ ID NO: 359340 - RNA, 19 nt, Homo sapiens
cgacgugguguucgcauuu

SEQ ID NO: 359341 - RNA, 19 nt, Homo sapiens
uuguauaucuugacucugu

SEQ ID NO: 359342 - RNA, 19 nt, Homo sapiens
ucacauugguacuguuugg

SEQ ID NO: 359343 - RNA, 19 nt, Homo sapiens
ggaggcaugaguccuguga

SEQ ID NO: 359344 - RNA, 19 nt, Homo sapiens
cuaaguuauugaccgguuu

SEQ ID NO: 359345 - RNA, 19 nt, Homo sapiens
cugcagagcgucuaugaga

SEQ ID NO: 359346 - RNA, 19 nt, Homo sapiens
gacguucgcauccaagcua

SEQ ID NO: 359347 - RNA, 19 nt, Homo sapiens
ugacaacgcacccgacauc

SEQ ID NO: 359348 - RNA, 19 nt, Homo sapiens
aaagcuaaaguggaaguua

SEQ ID NO: 359349 - RNA, 19 nt, Homo sapiens
caauugcggcuugccauuu

SEQ ID NO: 359350 - RNA, 19 nt, Homo sapiens
cgguuucaguguuguauau

SEQ ID NO: 359351 - RNA, 19 nt, Homo sapiens
cagcccagaugucaaccuu

SEQ ID NO: 359352 - RNA, 19 nt, Homo sapiens
gcaaagacagcgguaaagg

SEQ ID NO: 359353 - RNA, 19 nt, Homo sapiens
caauggcucccuagaagug

SEQ ID NO: 359354 - RNA, 19 nt, Homo sapiens
gcagcgcccuagugcaagu

SEQ ID NO: 359355 - RNA, 19 nt, Homo sapiens
ucccagaccugcaggagau

SEQ ID NO: 359356 - RNA, 19 nt, Homo sapiens
uccgagagccugagacuga

SEQ ID NO: 359357 - RNA, 19 nt, Homo sapiens
cagagaagcagagaaguuc

SEQ ID NO: 359358 - RNA, 19 nt, Homo sapiens
aagaagggagccaaugaaa

SEQ ID NO: 359359 - RNA, 19 nt, Homo sapiens
aaaaggaucucaucaacca

SEQ ID NO: 359360 - RNA, 19 nt, Homo sapiens
cggcaaagacagcgguaaa

SEQ ID NO: 359361 - RNA, 19 nt, Homo sapiens
gaaguucagcggcaaagac

SEQ ID NO: 359362 - RNA, 19 nt, Homo sapiens
agaaggaggugcgcaaagg

SEQ ID NO: 359363 - RNA, 19 nt, Homo sapiens
gacgugguguucgcauuug

SEQ ID NO: 359364 - RNA, 19 nt, Homo sapiens
gcaagaugugccuuacaau

SEQ ID NO: 359365 - RNA, 19 nt, Homo sapiens
gaugucaaccuucuguaag

SEQ ID NO: 359366 - RNA, 19 nt, Homo sapiens
acugucagcuucgugguaa

SEQ ID NO: 359367 - RNA, 19 nt, Homo sapiens
guagauuucaaguucaaug

SEQ ID NO: 359368 - RNA, 19 nt, Homo sapiens
aaaggaacugucuguaaga

SEQ ID NO: 359369 - RNA, 19 nt, Homo sapiens
cauugguacuguuugguau

SEQ ID NO: 359370 - RNA, 19 nt, Homo sapiens
gcagggacaauuacuacca

SEQ ID NO: 359371 - RNA, 19 nt, Homo sapiens
caagaaggaggugcgcaaa

SEQ ID NO: 359372 - RNA, 19 nt, Homo sapiens
uugacucugugguagauuu

SEQ ID NO: 359373 - RNA, 19 nt, Homo sapiens
gcuaaaguggaaguuauug

SEQ ID NO: 359374 - RNA, 19 nt, Homo sapiens
gcgcagggacaauuacuac

SEQ ID NO: 359375 - RNA, 19 nt, Homo sapiens
gaacgcaucgccgaguaca

SEQ ID NO: 359376 - RNA, 19 nt, Homo sapiens
aaucacauugguacuguuu

SEQ ID NO: 359377 - RNA, 19 nt, Homo sapiens
gaugugccuuacaaugaag

SEQ ID NO: 359378 - RNA, 19 nt, Homo sapiens
guuauugaccgguuucagu

SEQ ID NO: 359379 - RNA, 19 nt, Homo sapiens
uaacggcgacgugguguuc

SEQ ID NO: 359380 - RNA, 19 nt, Homo sapiens
gauuugucauguguuugaa

SEQ ID NO: 359381 - RNA, 19 nt, Homo sapiens
caaaacauguuggaauuac

SEQ ID NO: 359382 - RNA, 19 nt, Homo sapiens
uugguacuguuugguauuu

SEQ ID NO: 359383 - RNA, 19 nt, Homo sapiens
agaugucaaccuucuguaa

SEQ ID NO: 359384 - RNA, 19 nt, Homo sapiens
gggcgcuccuggucauauc

SEQ ID NO: 359385 - RNA, 19 nt, Homo sapiens
agauuugucauguguuuga

SEQ ID NO: 359386 - RNA, 19 nt, Homo sapiens
ugguagauuucaaguucaa

SEQ ID NO: 359387 - RNA, 19 nt, Homo sapiens
aguggaaguuauugccaaa

SEQ ID NO: 359388 - RNA, 19 nt, Homo sapiens
auacaggucacuccgagaa

SEQ ID NO: 359389 - RNA, 19 nt, Homo sapiens
acggagaggcgcagaguga

SEQ ID NO: 359390 - RNA, 19 nt, Homo sapiens
gcccaggcccaacauguuc

SEQ ID NO: 359391 - RNA, 19 nt, Homo sapiens
gugguagauuucaaguuca

SEQ ID NO: 359392 - RNA, 19 nt, Homo sapiens
acauugguacuguuuggua

SEQ ID NO: 359393 - RNA, 19 nt, Homo sapiens
gaccugcauaugaaaguau

SEQ ID NO: 359394 - RNA, 19 nt, Homo sapiens
gugcaccgcugaguguaag

SEQ ID NO: 359395 - RNA, 19 nt, Homo sapiens
acacgccgcugaucgucau

SEQ ID NO: 359396 - RNA, 19 nt, Homo sapiens
gcgcauccgagacgucaau

SEQ ID NO: 359397 - RNA, 19 nt, Homo sapiens
gcacagggcucgcaaagag

SEQ ID NO: 359398 - RNA, 19 nt, Homo sapiens
caaaggaacugucuguaag

SEQ ID NO: 359399 - RNA, 19 nt, Homo sapiens
gagcgucuaugagaaagua

SEQ ID NO: 359400 - RNA, 19 nt, Homo sapiens
uaaaccgugucacuuauaa

SEQ ID NO: 359401 - RNA, 19 nt, Homo sapiens
gaaaguaucgggugacaca

SEQ ID NO: 359402 - RNA, 19 nt, Homo sapiens
ccaaaggaacugucuguaa

SEQ ID NO: 359403 - RNA, 19 nt, Homo sapiens
gaagcuauuuccaaucaca

SEQ ID NO: 359404 - RNA, 19 nt, Homo sapiens
gaagaagggagccaaugaa

SEQ ID NO: 359405 - RNA, 19 nt, Homo sapiens
cgacagcgauuccgacauc

SEQ ID NO: 359406 - RNA, 19 nt, Homo sapiens
gcagagcgucuaugagaaa

SEQ ID NO: 359407 - RNA, 19 nt, Homo sapiens
gcagagaagcagagaaguu

SEQ ID NO: 359408 - RNA, 19 nt, Homo sapiens
gcuauugacuuugauuuca

SEQ ID NO: 359409 - RNA, 19 nt, Homo sapiens
ggaccugcauaugaaagua

SEQ ID NO: 359410 - RNA, 19 nt, Homo sapiens
ccgaggaccugcauaugaa

SEQ ID NO: 359411 - RNA, 19 nt, Homo sapiens
ucacuuauaagcacaguaa

SEQ ID NO: 359412 - RNA, 19 nt, Homo sapiens
ggaaguuauugccaaagga

SEQ ID NO: 359413 - RNA, 19 nt, Homo sapiens
agaaaguacugcacagaga

SEQ ID NO: 359414 - RNA, 19 nt, Homo sapiens
guaaaccgugucacuuaua

SEQ ID NO: 359415 - RNA, 19 nt, Homo sapiens
gaaguuauugccaaaggaa

SEQ ID NO: 359416 - RNA, 19 nt, Homo sapiens
caaccuaguguuugagaaa

SEQ ID NO: 359417 - RNA, 19 nt, Homo sapiens
cgaagaagggagccaauga

SEQ ID NO: 359418 - RNA, 19 nt, Homo sapiens
ugugguagauuucaaguuc

SEQ ID NO: 359419 - RNA, 19 nt, Homo sapiens
aagcuaaaguggaaguuau

SEQ ID NO: 359420 - RNA, 19 nt, Homo sapiens
caagaugugccuuacaaug

SEQ ID NO: 359421 - RNA, 19 nt, Homo sapiens
uaugaaaugugugcaguau

SEQ ID NO: 359422 - RNA, 19 nt, Homo sapiens
gaagggagccaaugaaaau

SEQ ID NO: 359423 - RNA, 19 nt, Homo sapiens
ccguaaaccgugucacuua

SEQ ID NO: 359424 - RNA, 19 nt, Homo sapiens
cguaaaccgugucacuuau

SEQ ID NO: 359425 - RNA, 19 nt, Homo sapiens
ccuaguguuugagaaauuu

SEQ ID NO: 359426 - RNA, 19 nt, Homo sapiens
cuuaugcuauugacuuuga

SEQ ID NO: 359427 - RNA, 19 nt, Homo sapiens
gccgaggaccugcauauga

SEQ ID NO: 359428 - RNA, 19 nt, Homo sapiens
agaugugccuuacaaugaa

SEQ ID NO: 359429 - RNA, 19 nt, Homo sapiens
aagaugugccuuacaauga

SEQ ID NO: 359430 - RNA, 19 nt, Homo sapiens
ugcaagaugugccuuacaa

SEQ ID NO: 359431 - RNA, 19 nt, Homo sapiens
ugucauguguuugaagaaa

SEQ ID NO: 359432 - RNA, 19 nt, Homo sapiens
gaaguuguuggaagcuauu

SEQ ID NO: 359433 - RNA, 19 nt, Homo sapiens
ugaaguuguuggaagcuau

SEQ ID NO: 359434 - RNA, 19 nt, Homo sapiens
ccgagaagccccuaaguua

SEQ ID NO: 359435 - RNA, 19 nt, Homo sapiens
cagcagcgcccuagugcaa

SEQ ID NO: 359436 - RNA, 19 nt, Homo sapiens
aaguggagcuggcggaaga

SEQ ID NO: 359437 - RNA, 19 nt, Homo sapiens
gagaagccccuaaguuauu

SEQ ID NO: 359438 - RNA, 19 nt, Homo sapiens
gcccagaugucaaccuucu

SEQ ID NO: 359439 - RNA, 19 nt, Homo sapiens
cgacgugguguucgcauuu

SEQ ID NO: 359440 - RNA, 19 nt, Homo sapiens
uuguauaucuugacucugu

SEQ ID NO: 359441 - RNA, 19 nt, Homo sapiens
ggaggcaugaguccuguga

SEQ ID NO: 359442 - RNA, 19 nt, Homo sapiens
ucacauugguacuguuugg

SEQ ID NO: 359443 - RNA, 19 nt, Homo sapiens
cuaaguuauugaccgguuu

SEQ ID NO: 359444 - RNA, 19 nt, Homo sapiens
cugcagagcgucuaugaga

SEQ ID NO: 359445 - RNA, 19 nt, Homo sapiens
gacguucgcauccaagcua

SEQ ID NO: 359446 - RNA, 19 nt, Homo sapiens
ugacaacgcacccgacauc

SEQ ID NO: 359447 - RNA, 19 nt, Homo sapiens
aaagcuaaaguggaaguua

SEQ ID NO: 359448 - RNA, 19 nt, Homo sapiens
caauugcggcuugccauuu

SEQ ID NO: 359449 - RNA, 19 nt, Homo sapiens
cgguuucaguguuguauau

SEQ ID NO: 359450 - RNA, 19 nt, Homo sapiens
cagcccagaugucaaccuu

SEQ ID NO: 359451 - RNA, 19 nt, Homo sapiens
gcaaagacagcgguaaagg

SEQ ID NO: 359452 - RNA, 19 nt, Homo sapiens
caauggcucccuagaagug

SEQ ID NO: 359453 - RNA, 19 nt, Homo sapiens
gcagcgcccuagugcaagu

SEQ ID NO: 359454 - RNA, 19 nt, Homo sapiens
ucccagaccugcaggagau

SEQ ID NO: 359455 - RNA, 19 nt, Homo sapiens
uccgagagccugagacuga

SEQ ID NO: 359456 - RNA, 19 nt, Homo sapiens
cagagaagcagagaaguuc

SEQ ID NO: 359457 - RNA, 19 nt, Homo sapiens
aagaagggagccaaugaaa

SEQ ID NO: 359458 - RNA, 19 nt, Homo sapiens
aaaaggaucucaucaacca

SEQ ID NO: 359459 - RNA, 19 nt, Homo sapiens
cggcaaagacagcgguaaa

SEQ ID NO: 359460 - RNA, 19 nt, Homo sapiens
gaaguucagcggcaaagac

SEQ ID NO: 359461 - RNA, 19 nt, Homo sapiens
gacgugguguucgcauuug

SEQ ID NO: 359462 - RNA, 19 nt, Homo sapiens
gcaagaugugccuuacaau

SEQ ID NO: 359463 - RNA, 19 nt, Homo sapiens
gaugucaaccuucuguaag

SEQ ID NO: 359464 - RNA, 19 nt, Homo sapiens
acugucagcuucgugguaa

SEQ ID NO: 359465 - RNA, 19 nt, Homo sapiens
guagauuucaaguucaaug

SEQ ID NO: 359466 - RNA, 19 nt, Homo sapiens
aaaggaacugucuguaaga

SEQ ID NO: 359467 - RNA, 19 nt, Homo sapiens
cauugguacuguuugguau

SEQ ID NO: 359468 - RNA, 19 nt, Homo sapiens
gcagggacaauuacuacca

SEQ ID NO: 359469 - RNA, 19 nt, Homo sapiens
uugacucugugguagauuu

SEQ ID NO: 359470 - RNA, 19 nt, Homo sapiens
gcuaaaguggaaguuauug

SEQ ID NO: 359471 - RNA, 19 nt, Homo sapiens
gcgcagggacaauuacuac

SEQ ID NO: 359472 - RNA, 19 nt, Homo sapiens
gaacgcaucgccgaguaca

SEQ ID NO: 359473 - RNA, 19 nt, Homo sapiens
aaucacauugguacuguuu

SEQ ID NO: 359474 - RNA, 19 nt, Homo sapiens
gaugugccuuacaaugaag

SEQ ID NO: 359475 - RNA, 19 nt, Homo sapiens
guuauugaccgguuucagu

SEQ ID NO: 359476 - RNA, 19 nt, Homo sapiens
uaacggcgacgugguguuc

SEQ ID NO: 359477 - RNA, 19 nt, Homo sapiens
gauuugucauguguuugaa

SEQ ID NO: 359478 - RNA, 19 nt, Homo sapiens
caaaacauguuggaauuac

SEQ ID NO: 359479 - RNA, 19 nt, Homo sapiens
uugguacuguuugguauuu

SEQ ID NO: 359480 - RNA, 19 nt, Homo sapiens
agaugucaaccuucuguaa

SEQ ID NO: 359481 - RNA, 19 nt, Homo sapiens
gggcgcuccuggucauauc

SEQ ID NO: 359482 - RNA, 19 nt, Homo sapiens
agauuugucauguguuuga

SEQ ID NO: 359483 - RNA, 19 nt, Homo sapiens
ugguagauuucaaguucaa

SEQ ID NO: 359484 - RNA, 19 nt, Homo sapiens
acggagaggcgcagaguga

SEQ ID NO: 359485 - RNA, 19 nt, Homo sapiens
aguggaaguuauugccaaa

SEQ ID NO: 359486 - RNA, 19 nt, Homo sapiens
auacaggucacuccgagaa

SEQ ID NO: 359487 - RNA, 19 nt, Homo sapiens
gugguagauuucaaguuca

SEQ ID NO: 359488 - RNA, 19 nt, Homo sapiens
acauugguacuguuuggua

SEQ ID NO: 359489 - RNA, 19 nt, Homo sapiens
gugcaccgcugaguguaag

SEQ ID NO: 359490 - RNA, 19 nt, Homo sapiens
gaccugcauaugaaaguau

SEQ ID NO: 359491 - RNA, 19 nt, Homo sapiens
acacgccgcugaucgucau

SEQ ID NO: 359492 - RNA, 19 nt, Homo sapiens
gcgcauccgagacgucaau

SEQ ID NO: 359493 - RNA, 19 nt, Homo sapiens
uuugucauguguuugaaga

SEQ ID NO: 359494 - RNA, 19 nt, Homo sapiens
gccaaaggaacugucugua

SEQ ID NO: 359495 - RNA, 19 nt, Homo sapiens
ucaauugcggcuugccauu

SEQ ID NO: 359496 - RNA, 19 nt, Homo sapiens
gagcaaaacaguccgauac

SEQ ID NO: 359497 - RNA, 19 nt, Homo sapiens
gaacauuucucacaucaau

SEQ ID NO: 359498 - RNA, 19 nt, Homo sapiens
uggcaaaucugaagucuua

SEQ ID NO: 359499 - RNA, 19 nt, Homo sapiens
gaacaagaacgauucauuu

SEQ ID NO: 359500 - RNA, 19 nt, Homo sapiens
caaaggaucugaacauuuc

SEQ ID NO: 359501 - RNA, 19 nt, Homo sapiens
guucagagguccuuagaua

SEQ ID NO: 359502 - RNA, 19 nt, Homo sapiens
ggaaaugccuccuauaucu

SEQ ID NO: 359503 - RNA, 19 nt, Homo sapiens
ccaauaaaguggcaacuaa

SEQ ID NO: 359504 - RNA, 19 nt, Homo sapiens
guaaauagcaguucacauu

SEQ ID NO: 359505 - RNA, 19 nt, Homo sapiens
cgucagagcuuuauguauu

SEQ ID NO: 359506 - RNA, 19 nt, Homo sapiens
caacaacauucaagccuaa

SEQ ID NO: 359507 - RNA, 19 nt, Homo sapiens
gaauaaagcugugacucuu

SEQ ID NO: 359508 - RNA, 19 nt, Homo sapiens
gagauaagcauuaaaccua

SEQ ID NO: 359509 - RNA, 19 nt, Homo sapiens
cgacguggguuauacuuaa

SEQ ID NO: 359510 - RNA, 19 nt, Homo sapiens
gaaagauccugucaauaca

SEQ ID NO: 359511 - RNA, 19 nt, Homo sapiens
ugauaacccuccuaauaua

SEQ ID NO: 359512 - RNA, 19 nt, Homo sapiens
caaacaaucucaagcacuu

SEQ ID NO: 359513 - RNA, 19 nt, Homo sapiens
ggguuaagcuugaggauga

SEQ ID NO: 359514 - RNA, 19 nt, Homo sapiens
ugaaagaaguggaaguuau

SEQ ID NO: 359515 - RNA, 19 nt, Homo sapiens
gaagcaagcuauuauuaac

SEQ ID NO: 359516 - RNA, 19 nt, Homo sapiens
aaagagaggucccauuuca

SEQ ID NO: 359517 - RNA, 19 nt, Homo sapiens
gagcaacgguuaccaucaa

SEQ ID NO: 359518 - RNA, 19 nt, Homo sapiens
ggaaauaaagggauaaauc

SEQ ID NO: 359519 - RNA, 19 nt, Homo sapiens
caaggaggcuucaagacaa

SEQ ID NO: 359520 - RNA, 19 nt, Homo sapiens
ugagaaagauccugucaau

SEQ ID NO: 359521 - RNA, 19 nt, Homo sapiens
ugacagugcuggcuaguga

SEQ ID NO: 359522 - RNA, 19 nt, Homo sapiens
gaaugaguguuucuuugaa

SEQ ID NO: 359523 - RNA, 19 nt, Homo sapiens
ggagacagccauucacaaa

SEQ ID NO: 359524 - RNA, 19 nt, Homo sapiens
ggaaugaacgcugaacuaa

SEQ ID NO: 359525 - RNA, 19 nt, Homo sapiens
cugagaaucugccaaagua

SEQ ID NO: 359526 - RNA, 19 nt, Homo sapiens
uaauugagcugucaguuuc

SEQ ID NO: 359527 - RNA, 19 nt, Homo sapiens
guagguaccucuguaauuc

SEQ ID NO: 359528 - RNA, 19 nt, Homo sapiens
cgcaauagcucaagaacuu

SEQ ID NO: 359529 - RNA, 19 nt, Homo sapiens
gaacuuuguuacuaucgaa

SEQ ID NO: 359530 - RNA, 19 nt, Homo sapiens
uaacgacacugcuggaaau

SEQ ID NO: 359531 - RNA, 19 nt, Homo sapiens
aaugauaacccuccuaaua

SEQ ID NO: 359532 - RNA, 19 nt, Homo sapiens
gcaaacaaauccaaauucg

SEQ ID NO: 359533 - RNA, 19 nt, Homo sapiens
gucaaucaguguuaaagua

SEQ ID NO: 359534 - RNA, 19 nt, Homo sapiens
caacauaugagagaagaua

SEQ ID NO: 359535 - RNA, 19 nt, Homo sapiens
gcaaaucugaagucuuaua

SEQ ID NO: 359536 - RNA, 19 nt, Homo sapiens
ucuaaacgcucuuccacua

SEQ ID NO: 359537 - RNA, 19 nt, Homo sapiens
uaacauuacucuggaagaa

SEQ ID NO: 359538 - RNA, 19 nt, Homo sapiens
gagaaucugccaaaguaua

SEQ ID NO: 359539 - RNA, 19 nt, Homo sapiens
gcaaaugugugucuacaac

SEQ ID NO: 359540 - RNA, 19 nt, Homo sapiens
caagaggacugaagcagau

SEQ ID NO: 359541 - RNA, 19 nt, Homo sapiens
caggaaagcugcagugaca

SEQ ID NO: 359542 - RNA, 19 nt, Homo sapiens
ugaaagagaggucccauuu

SEQ ID NO: 359543 - RNA, 19 nt, Homo sapiens
aaagauaccuaugugauga

SEQ ID NO: 359544 - RNA, 19 nt, Homo sapiens
gaaagauaccuaugugaug

SEQ ID NO: 359545 - RNA, 19 nt, Homo sapiens
ucacuuaggucaaaccaau

SEQ ID NO: 359546 - RNA, 19 nt, Homo sapiens
uaugggaccuaauaacuuu

SEQ ID NO: 359547 - RNA, 19 nt, Homo sapiens
acaaagauugcccuaauua

SEQ ID NO: 359548 - RNA, 19 nt, Homo sapiens
guacuugucacucauguaa

SEQ ID NO: 359549 - RNA, 19 nt, Homo sapiens
gcagauauaggcaguaaug

SEQ ID NO: 359550 - RNA, 19 nt, Homo sapiens
ucaaggauaccaaugauaa

SEQ ID NO: 359551 - RNA, 19 nt, Homo sapiens
guaagucaaucaguguuaa

SEQ ID NO: 359552 - RNA, 19 nt, Homo sapiens
ucaccgauguaaaugauaa

SEQ ID NO: 359553 - RNA, 19 nt, Homo sapiens
guuaaggcaugacagauga

SEQ ID NO: 359554 - RNA, 19 nt, Homo sapiens
ccaguaacagguaacauua

SEQ ID NO: 359555 - RNA, 19 nt, Homo sapiens
ugacagagaagaacaagaa

SEQ ID NO: 359556 - RNA, 19 nt, Homo sapiens
gaaguggaaguuaucuuaa

SEQ ID NO: 359557 - RNA, 19 nt, Homo sapiens
gaaagaaguggaaguuauc

SEQ ID NO: 359558 - RNA, 19 nt, Homo sapiens
gaauaugcauuuggaaagu

SEQ ID NO: 359559 - RNA, 19 nt, Homo sapiens
gaaaugccuccuauaucua

SEQ ID NO: 359560 - RNA, 19 nt, Homo sapiens
gacaauagccccaaguuua

SEQ ID NO: 359561 - RNA, 19 nt, Homo sapiens
guaauugagcugucaguuu

SEQ ID NO: 359562 - RNA, 19 nt, Homo sapiens
gaaguggccacaacugauu

SEQ ID NO: 359563 - RNA, 19 nt, Homo sapiens
gaacuggaggagcaaagua

SEQ ID NO: 359564 - RNA, 19 nt, Homo sapiens
gaacagaaagauaccuaug

SEQ ID NO: 359565 - RNA, 19 nt, Homo sapiens
caacagccgcuuuccaauu

SEQ ID NO: 359566 - RNA, 19 nt, Homo sapiens
gaaugaacgcugaacuaaa

SEQ ID NO: 359567 - RNA, 19 nt, Homo sapiens
gagaagaacaagaacgauu

SEQ ID NO: 359568 - RNA, 19 nt, Homo sapiens
gauagagaacagaaagaua

SEQ ID NO: 359569 - RNA, 19 nt, Homo sapiens
ggagagaaguggccacaac

SEQ ID NO: 359570 - RNA, 19 nt, Homo sapiens
agaaguggaaguuaucuua

SEQ ID NO: 359571 - RNA, 19 nt, Homo sapiens
ucugaaaucuugcuucuca

SEQ ID NO: 359572 - RNA, 19 nt, Homo sapiens
gugagguguuucuguguua

SEQ ID NO: 359573 - RNA, 19 nt, Homo sapiens
ucaaugaccguaagcagua

SEQ ID NO: 359574 - RNA, 19 nt, Homo sapiens
cuacagagaugugcacuca

SEQ ID NO: 359575 - RNA, 19 nt, Homo sapiens
ggagcaaaguauaggaaga

SEQ ID NO: 359576 - RNA, 19 nt, Homo sapiens
cagcagaguuccuacacuu

SEQ ID NO: 359577 - RNA, 19 nt, Homo sapiens
auacaaagauugcccuaau

SEQ ID NO: 359578 - RNA, 19 nt, Homo sapiens
cacaguaagugauguaaau

SEQ ID NO: 359579 - RNA, 19 nt, Homo sapiens
gcagggauaccuauaacuu

SEQ ID NO: 359580 - RNA, 19 nt, Homo sapiens
caagcaaggugccgaaugg

SEQ ID NO: 359581 - RNA, 19 nt, Homo sapiens
uggaaacaauaaaggcuua

SEQ ID NO: 359582 - RNA, 19 nt, Homo sapiens
uaaaugauaacccuccuaa

SEQ ID NO: 359583 - RNA, 19 nt, Homo sapiens
gaaauccaguacggccaua

SEQ ID NO: 359584 - RNA, 19 nt, Homo sapiens
aaugaacgcugaacuaaag

SEQ ID NO: 359585 - RNA, 19 nt, Homo sapiens
agaaagauccugucaauac

SEQ ID NO: 359586 - RNA, 19 nt, Homo sapiens
ccaaaggaucugaacauuu

SEQ ID NO: 359587 - RNA, 19 nt, Homo sapiens
gugcauugcuuauugaagu

SEQ ID NO: 359588 - RNA, 19 nt, Homo sapiens
cuucucauaugauagcuua

SEQ ID NO: 359589 - RNA, 19 nt, Homo sapiens
aagaaugggugaagaagga

SEQ ID NO: 359590 - RNA, 19 nt, Homo sapiens
gcagcgccguguuacguuu

SEQ ID NO: 359591 - RNA, 19 nt, Homo sapiens
cagaguauuugacagagaa

SEQ ID NO: 359592 - RNA, 19 nt, Homo sapiens
ccgaaugccuccuucuuug

SEQ ID NO: 359593 - RNA, 19 nt, Homo sapiens
caugacagaugauuuaaac

SEQ ID NO: 359594 - RNA, 19 nt, Homo sapiens
uaucauaguuggucaaugc

SEQ ID NO: 359595 - RNA, 19 nt, Homo sapiens
ccuguuggcugcucugauu

SEQ ID NO: 359596 - RNA, 19 nt, Homo sapiens
caaacccgaugaugcaguu

SEQ ID NO: 359597 - RNA, 19 nt, Homo sapiens
ggaaguggcuuaagauguu

SEQ ID NO: 359598 - RNA, 19 nt, Homo sapiens
gcugguagcuagugauuua

SEQ ID NO: 359599 - RNA, 19 nt, Homo sapiens
caagugccauucauccuuu

SEQ ID NO: 359600 - RNA, 19 nt, Homo sapiens
gggacaaucuucacuuuca

SEQ ID NO: 359601 - RNA, 19 nt, Homo sapiens
gcacaaagaugcagauccu

SEQ ID NO: 359602 - RNA, 19 nt, Homo sapiens
gagccuccguuuccucaua

SEQ ID NO: 359603 - RNA, 19 nt, Homo sapiens
caacaggcccuuucugaug

SEQ ID NO: 359604 - RNA, 19 nt, Homo sapiens
gagaauggacugagugaga

SEQ ID NO: 359605 - RNA, 19 nt, Homo sapiens
ggaaugggagucugaaaug

SEQ ID NO: 359606 - RNA, 19 nt, Homo sapiens
gcaaugcggucgugaucau

SEQ ID NO: 359607 - RNA, 19 nt, Homo sapiens
ugaauucuauguuggcauu

SEQ ID NO: 359608 - RNA, 19 nt, Homo sapiens
gcaaagagagguccagagu

SEQ ID NO: 359609 - RNA, 19 nt, Homo sapiens
ccaugaagcagaucaauga

SEQ ID NO: 359610 - RNA, 19 nt, Homo sapiens
gaacuccugaaaucauaua

SEQ ID NO: 359611 - RNA, 19 nt, Homo sapiens
aagaacuccugaaaucaua

SEQ ID NO: 359612 - RNA, 19 nt, Homo sapiens
cccaagaacuccugaaauc

SEQ ID NO: 359613 - RNA, 19 nt, Homo sapiens
cagagaggcuggaugacuu

SEQ ID NO: 359614 - RNA, 19 nt, Homo sapiens
uggagaacauucaaucuug

SEQ ID NO: 359615 - RNA, 19 nt, Homo sapiens
ccuaucagcuggagaaagu

SEQ ID NO: 359616 - RNA, 19 nt, Homo sapiens
gcgaggaucaguaucacua

SEQ ID NO: 359617 - RNA, 19 nt, Homo sapiens
gaucagauucuugcuguga

SEQ ID NO: 359618 - RNA, 19 nt, Homo sapiens
gacauugggacaacacuuu

SEQ ID NO: 359619 - RNA, 19 nt, Homo sapiens
gggcuucuccugaaaucua

SEQ ID NO: 359620 - RNA, 19 nt, Homo sapiens
gcaaugccacggcuuuguu

SEQ ID NO: 359621 - RNA, 19 nt, Homo sapiens
gcaaacgaagggcaagauu

SEQ ID NO: 359622 - RNA, 19 nt, Homo sapiens
gcaggacaccuucguaagu

SEQ ID NO: 359623 - RNA, 19 nt, Homo sapiens
caaaggcacccaagagcaa

SEQ ID NO: 359624 - RNA, 19 nt, Homo sapiens
ccauucauccuuuaagaaa

SEQ ID NO: 359625 - RNA, 19 nt, Homo sapiens
gaccuuaugcuccacacua

SEQ ID NO: 359626 - RNA, 19 nt, Homo sapiens
caaauauccaggugucuga

SEQ ID NO: 359627 - RNA, 19 nt, Homo sapiens
gaccucaguuucccucugu

SEQ ID NO: 359628 - RNA, 19 nt, Homo sapiens
caagaacuccugaaaucau

SEQ ID NO: 359629 - RNA, 19 nt, Homo sapiens
gaaugggagucugaaaugg

SEQ ID NO: 359630 - RNA, 19 nt, Homo sapiens
ugucugagauggugcacaa

SEQ ID NO: 359631 - RNA, 19 nt, Homo sapiens
cugaggaaguggcuuaaga

SEQ ID NO: 359632 - RNA, 19 nt, Homo sapiens
agaauggacugagugagaa

SEQ ID NO: 359633 - RNA, 19 nt, Homo sapiens
cauggugaauuacaucuuc

SEQ ID NO: 359634 - RNA, 19 nt, Homo sapiens
caaacgaagggcaagauug

SEQ ID NO: 359635 - RNA, 19 nt, Homo sapiens
cuccugaaaucauauagaa

SEQ ID NO: 359636 - RNA, 19 nt, Homo sapiens
ugauguucauuguggauaa

SEQ ID NO: 359637 - RNA, 19 nt, Homo sapiens
aaacgaagggcaagauugu

SEQ ID NO: 359638 - RNA, 19 nt, Homo sapiens
gauuuacacagguuuaguu

SEQ ID NO: 359639 - RNA, 19 nt, Homo sapiens
gaaguggcuuaagauguuc

SEQ ID NO: 359640 - RNA, 19 nt, Homo sapiens
gagcuuuaccuucccaaau

SEQ ID NO: 359641 - RNA, 19 nt, Homo sapiens
caggacaccuucguaagug

SEQ ID NO: 359642 - RNA, 19 nt, Homo sapiens
gacccaagaacuccugaaa

SEQ ID NO: 359643 - RNA, 19 nt, Homo sapiens
ucagcaaccacucaaauau

SEQ ID NO: 359644 - RNA, 19 nt, Homo sapiens
agacaagcuucaaccacaa

SEQ ID NO: 359645 - RNA, 19 nt, Homo sapiens
aauaguagagugucaguug

SEQ ID NO: 359646 - RNA, 19 nt, Homo sapiens
gacaacacuuucccucucu

SEQ ID NO: 359647 - RNA, 19 nt, Homo sapiens
ccacaaaggcacccaagag

SEQ ID NO: 359648 - RNA, 19 nt, Homo sapiens
ggacacauuucagguaucc

SEQ ID NO: 359649 - RNA, 19 nt, Homo sapiens
cccgagcucugugaccuua

SEQ ID NO: 359650 - RNA, 19 nt, Homo sapiens
uuacacagguuuaguugac

SEQ ID NO: 359651 - RNA, 19 nt, Homo sapiens
ggacaaucuucacuuucag

SEQ ID NO: 359652 - RNA, 19 nt, Homo sapiens
ucgugaucauggugaauua

SEQ ID NO: 359653 - RNA, 19 nt, Homo sapiens
ccugugagcaucuccauga

SEQ ID NO: 359654 - RNA, 19 nt, Homo sapiens
auacaaggaucagauucuu

SEQ ID NO: 359655 - RNA, 19 nt, Homo sapiens
uaacaacauccucuuccuu

SEQ ID NO: 359656 - RNA, 19 nt, Homo sapiens
agcuuuaccuucccaaauu

SEQ ID NO: 359657 - RNA, 19 nt, Homo sapiens
cgggacacauuucagguau

SEQ ID NO: 359658 - RNA, 19 nt, Homo sapiens
ggaugagggccaccaggaa

SEQ ID NO: 359659 - RNA, 19 nt, Homo sapiens
gcuuuaccuucccaaauuc

SEQ ID NO: 359660 - RNA, 19 nt, Homo sapiens
ccucauagaacaaagaaca

SEQ ID NO: 359661 - RNA, 19 nt, Homo sapiens
gaauggacugagugagaaa

SEQ ID NO: 359662 - RNA, 19 nt, Homo sapiens
gggaagccuuuugcaaaua

SEQ ID NO: 359663 - RNA, 19 nt, Homo sapiens
cgagcucugugaccuuaug

SEQ ID NO: 359664 - RNA, 19 nt, Homo sapiens
cuagugauuuacacagguu

SEQ ID NO: 359665 - RNA, 19 nt, Homo sapiens
caucagcaaccacucaaau

SEQ ID NO: 359666 - RNA, 19 nt, Homo sapiens
gaggaaguggcuuaagaug

SEQ ID NO: 359667 - RNA, 19 nt, Homo sapiens
ccacggcuuuguucauucu

SEQ ID NO: 359668 - RNA, 19 nt, Homo sapiens
ggugaauuacaucuucuuu

SEQ ID NO: 359669 - RNA, 19 nt, Homo sapiens
cagcugagccucggcaaug

SEQ ID NO: 359670 - RNA, 19 nt, Homo sapiens
guggagaacauucaaucuu

SEQ ID NO: 359671 - RNA, 19 nt, Homo sapiens
ccaagaacuccugaaauca

SEQ ID NO: 359672 - RNA, 19 nt, Homo sapiens
ccauugagggcuccuauca

SEQ ID NO: 359673 - RNA, 19 nt, Homo sapiens
gguggagaauggacugagu

SEQ ID NO: 359674 - RNA, 19 nt, Homo sapiens
ucaaugauuauguggcaaa

SEQ ID NO: 359675 - RNA, 19 nt, Homo sapiens
guaccuggcagacacuuuc

SEQ ID NO: 359676 - RNA, 19 nt, Homo sapiens
acacuuaucagcagcaaca

SEQ ID NO: 359677 - RNA, 19 nt, Homo sapiens
aacaggcccuuucugaugu

SEQ ID NO: 359678 - RNA, 19 nt, Homo sapiens
ugccacggcuuuguucauu

SEQ ID NO: 359679 - RNA, 19 nt, Homo sapiens
cccaagagcaagacuucua

SEQ ID NO: 359680 - RNA, 19 nt, Homo sapiens
gacaagcuucaaccacaaa

SEQ ID NO: 359681 - RNA, 19 nt, Homo sapiens
gaucauggugaauuacauc

SEQ ID NO: 359682 - RNA, 19 nt, Homo sapiens
gauuauguggcaaagcaaa

SEQ ID NO: 359683 - RNA, 19 nt, Homo sapiens
ugccauucauccuuuaaga

SEQ ID NO: 359684 - RNA, 19 nt, Homo sapiens
gcuggucccacacuuauca

SEQ ID NO: 359685 - RNA, 19 nt, Homo sapiens
caaggcuggucccacacuu

SEQ ID NO: 359686 - RNA, 19 nt, Homo sapiens
cagcaaccacucaaauauc

SEQ ID NO: 359687 - RNA, 19 nt, Homo sapiens
gagccgcgaggaucaguau

SEQ ID NO: 359688 - RNA, 19 nt, Homo sapiens
auuguggacuugcuuaaga

SEQ ID NO: 359689 - RNA, 19 nt, Homo sapiens
ggauaucaagguggaaaug

SEQ ID NO: 359690 - RNA, 19 nt, Homo sapiens
ggaagccuuuugcaaauag

SEQ ID NO: 359691 - RNA, 19 nt, Homo sapiens
gccauucauccuuuaagaa

SEQ ID NO: 359692 - RNA, 19 nt, Homo sapiens
ucaagugccauucauccuu

SEQ ID NO: 359693 - RNA, 19 nt, Homo sapiens
gcaugguaguggcaaagag

SEQ ID NO: 359694 - RNA, 19 nt, Homo sapiens
caaucuugccgucacuauu

SEQ ID NO: 359695 - RNA, 19 nt, Homo sapiens
guaugcugguagcuaguga

SEQ ID NO: 359696 - RNA, 19 nt, Homo sapiens
ucagcuacgggacacauuu

SEQ ID NO: 359697 - RNA, 19 nt, Homo sapiens
gguaguagcuaaugaaauu

SEQ ID NO: 359698 - RNA, 19 nt, Homo sapiens
caagaugaccuacuaguuu

SEQ ID NO: 359699 - RNA, 19 nt, Homo sapiens
gggcaaguguucccaaauu

SEQ ID NO: 359700 - RNA, 19 nt, Homo sapiens
gaauaacgcugagcugugu

SEQ ID NO: 359701 - RNA, 19 nt, Homo sapiens
gaaagaaaccuguggaucu

SEQ ID NO: 359702 - RNA, 19 nt, Homo sapiens
uggaagacaucgagaagua

SEQ ID NO: 359703 - RNA, 19 nt, Homo sapiens
gcucucagcuggcaacaug

SEQ ID NO: 359704 - RNA, 19 nt, Homo sapiens
gcaucgagcugacggauuc

SEQ ID NO: 359705 - RNA, 19 nt, Homo sapiens
ggaagagcccggaaagaaa

SEQ ID NO: 359706 - RNA, 19 nt, Homo sapiens
ccugagugcuuuaccuuua

SEQ ID NO: 359707 - RNA, 19 nt, Homo sapiens
gagaauaagccagauguaa

SEQ ID NO: 359708 - RNA, 19 nt, Homo sapiens
ggacaaggaaggcaaauuc

SEQ ID NO: 359709 - RNA, 19 nt, Homo sapiens
ucacuuagcuauguggauu

SEQ ID NO: 359710 - RNA, 19 nt, Homo sapiens
gagagauccuugccuugaa

SEQ ID NO: 359711 - RNA, 19 nt, Homo sapiens
gggaagagcccggaaagaa

SEQ ID NO: 359712 - RNA, 19 nt, Homo sapiens
ucaagaccauccagaagaa

SEQ ID NO: 359713 - RNA, 19 nt, Homo sapiens
gcaagaugaccuacuaguu

SEQ ID NO: 359714 - RNA, 19 nt, Homo sapiens
gaacacaaucuuuaccaau

SEQ ID NO: 359715 - RNA, 19 nt, Homo sapiens
gaauaagccagauguaauc

SEQ ID NO: 359716 - RNA, 19 nt, Homo sapiens
gaauaagccagauguaauc

SEQ ID NO: 359717 - RNA, 19 nt, Homo sapiens
uauacaccauuguuccuua

SEQ ID NO: 359718 - RNA, 19 nt, Homo sapiens
cccaagaucuuccauguca

SEQ ID NO: 359719 - RNA, 19 nt, Homo sapiens
gcuacaacuucggcaaaua

SEQ ID NO: 359720 - RNA, 19 nt, Homo sapiens
gaaccucucggccaaaguu

SEQ ID NO: 359721 - RNA, 19 nt, Homo sapiens
gaacauaaaggcaaaauca

SEQ ID NO: 359722 - RNA, 19 nt, Homo sapiens
aaauugacgccaccuaaua

SEQ ID NO: 359723 - RNA, 19 nt, Homo sapiens
gcaaguguucccaaauuga

SEQ ID NO: 359724 - RNA, 19 nt, Homo sapiens
caagagagggcaaguguuc

SEQ ID NO: 359725 - RNA, 19 nt, Homo sapiens
ggcaaguguucccaaauug

SEQ ID NO: 359726 - RNA, 19 nt, Homo sapiens
gacauugccuggaugaagu

SEQ ID NO: 359727 - RNA, 19 nt, Homo sapiens
ugaaggcacacuuugauuu

SEQ ID NO: 359728 - RNA, 19 nt, Homo sapiens
gagggcaaguguucccaaa

SEQ ID NO: 359729 - RNA, 19 nt, Homo sapiens
ugaaaggucgcaccaugua

SEQ ID NO: 359730 - RNA, 19 nt, Homo sapiens
ccaaauugacgccaccuaa

SEQ ID NO: 359731 - RNA, 19 nt, Homo sapiens
cagccaaacugcccaagau

SEQ ID NO: 359732 - RNA, 19 nt, Homo sapiens
gggaugacauugccuggau

SEQ ID NO: 359733 - RNA, 19 nt, Homo sapiens
caaagaauaagccagaugu

SEQ ID NO: 359734 - RNA, 19 nt, Homo sapiens
gaugaaguuugacgcacaa

SEQ ID NO: 359735 - RNA, 19 nt, Homo sapiens
ccauguacgucaucccauu

SEQ ID NO: 359736 - RNA, 19 nt, Homo sapiens
gcauugaucuuuucagugu

SEQ ID NO: 359737 - RNA, 19 nt, Homo sapiens
gcaaagaauaagccagaug

SEQ ID NO: 359738 - RNA, 19 nt, Homo sapiens
gaaggacaaggaaggcaaa

SEQ ID NO: 359739 - RNA, 19 nt, Homo sapiens
uaagguuacucaggcauug

SEQ ID NO: 359740 - RNA, 19 nt, Homo sapiens
gaucugaaggcacacuuug

SEQ ID NO: 359741 - RNA, 19 nt, Homo sapiens
gaucauccaaagagaagaa

SEQ ID NO: 359742 - RNA, 19 nt, Homo sapiens
aacacaaucuuuaccaaug

SEQ ID NO: 359743 - RNA, 19 nt, Homo sapiens
gaagagcccggaaagaaac

SEQ ID NO: 359744 - RNA, 19 nt, Homo sapiens
ugggcaagaugaccuacua

SEQ ID NO: 359745 - RNA, 19 nt, Homo sapiens
agaauaagccagauguaau

SEQ ID NO: 359746 - RNA, 19 nt, Homo sapiens
agaauaagccagauguaau

SEQ ID NO: 359747 - RNA, 19 nt, Homo sapiens
gaagacaucgagaaguauc

SEQ ID NO: 359748 - RNA, 19 nt, Homo sapiens
caaggaggaugcccugaac

SEQ ID NO: 359749 - RNA, 19 nt, Homo sapiens
acacaaucuuuaccaaugu

SEQ ID NO: 359750 - RNA, 19 nt, Homo sapiens
ccauuguuccuuaccuuua

SEQ ID NO: 359751 - RNA, 19 nt, Homo sapiens
uccauaaggugcaguagga

SEQ ID NO: 359752 - RNA, 19 nt, Homo sapiens
aagaauaagccagauguaa

SEQ ID NO: 359753 - RNA, 19 nt, Homo sapiens
ccugugaaaucgagagaga

SEQ ID NO: 359754 - RNA, 19 nt, Homo sapiens
gauaagaaccacagaacac

SEQ ID NO: 359755 - RNA, 19 nt, Homo sapiens
gaaggcacacuuugauuuu

SEQ ID NO: 359756 - RNA, 19 nt, Homo sapiens
caaauugacgccaccuaau

SEQ ID NO: 359757 - RNA, 19 nt, Homo sapiens
aaagaaaccuguggaucuc

SEQ ID NO: 359758 - RNA, 19 nt, Homo sapiens
cauugaaggcauuaucuuu

SEQ ID NO: 359759 - RNA, 19 nt, Homo sapiens
agaccaaccuggccaugau

SEQ ID NO: 359760 - RNA, 19 nt, Homo sapiens
ugacgccaccuaauaauca

SEQ ID NO: 359761 - RNA, 19 nt, Homo sapiens
ucaaccggaucgauggaaa

SEQ ID NO: 359762 - RNA, 19 nt, Homo sapiens
ccaaugccaucaagaccau

SEQ ID NO: 359763 - RNA, 19 nt, Homo sapiens
gaaguuugacgcacaaggu

SEQ ID NO: 359764 - RNA, 19 nt, Homo sapiens
ccagggauguggccaggau

SEQ ID NO: 359765 - RNA, 19 nt, Homo sapiens
ugugauauuugguaugugu

SEQ ID NO: 359766 - RNA, 19 nt, Homo sapiens
ggaugucagaggaggauuu

SEQ ID NO: 359767 - RNA, 19 nt, Homo sapiens
gaacacuggguaguagcua

SEQ ID NO: 359768 - RNA, 19 nt, Homo sapiens
acagaacacuggguaguag

SEQ ID NO: 359769 - RNA, 19 nt, Homo sapiens
ggauaagaaccacagaaca

SEQ ID NO: 359770 - RNA, 19 nt, Homo sapiens
cugagugcuuuaccuuuaa

SEQ ID NO: 359771 - RNA, 19 nt, Homo sapiens
gcacccagcagccaaacug

SEQ ID NO: 359772 - RNA, 19 nt, Homo sapiens
aagaagugcuuugcucuca

SEQ ID NO: 359773 - RNA, 19 nt, Homo sapiens
uagcuagaaugcacaccaa

SEQ ID NO: 359774 - RNA, 19 nt, Homo sapiens
gagaucauccaaagagaag

SEQ ID NO: 359775 - RNA, 19 nt, Homo sapiens
ucacguccuggaagaauaa

SEQ ID NO: 359776 - RNA, 19 nt, Homo sapiens
agaacacaaucuuuaccaa

SEQ ID NO: 359777 - RNA, 19 nt, Homo sapiens
guuccuuaccuuuacauaa

SEQ ID NO: 359778 - RNA, 19 nt, Homo sapiens
cuauguggauuagcuagaa

SEQ ID NO: 359779 - RNA, 19 nt, Homo sapiens
gagaagggaaaucuuagca

SEQ ID NO: 359780 - RNA, 19 nt, Homo sapiens
gcucugaggaggagaaugg

SEQ ID NO: 359781 - RNA, 19 nt, Homo sapiens
ggaagacaucgagaaguau

SEQ ID NO: 359782 - RNA, 19 nt, Homo sapiens
ccaaggaggaugcccugaa

SEQ ID NO: 359783 - RNA, 19 nt, Homo sapiens
ccaaacugcccaagaucuu

SEQ ID NO: 359784 - RNA, 19 nt, Homo sapiens
gcaagagagggcaaguguu

SEQ ID NO: 359785 - RNA, 19 nt, Homo sapiens
gauguggccaggaucgaaa

SEQ ID NO: 359786 - RNA, 19 nt, Homo sapiens
aaaagauacuugagcugua

SEQ ID NO: 359787 - RNA, 19 nt, Homo sapiens
gaagguguucccauugaag

SEQ ID NO: 359788 - RNA, 19 nt, Homo sapiens
gaugacauugccuggauga

SEQ ID NO: 359789 - RNA, 19 nt, Homo sapiens
aaucuuagcaugccuccaa

SEQ ID NO: 359790 - RNA, 19 nt, Homo sapiens
gaaauugagaagggaaauc

SEQ ID NO: 359791 - RNA, 19 nt, Homo sapiens
aauugacgccaccuaauaa

SEQ ID NO: 359792 - RNA, 19 nt, Homo sapiens
cgagaucauccaaagagaa

SEQ ID NO: 359793 - RNA, 19 nt, Homo sapiens
gccuugaagcaaagaauaa

SEQ ID NO: 359794 - RNA, 19 nt, Homo sapiens
agagagauccuugccuuga

SEQ ID NO: 359795 - RNA, 19 nt, Homo sapiens
cuggcaacauggagucuuu

SEQ ID NO: 359796 - RNA, 19 nt, Homo sapiens
ugugugauauuugguaugu

SEQ ID NO: 359797 - RNA, 19 nt, Homo sapiens
caaagacuguccaauaaua

SEQ ID NO: 359798 - RNA, 19 nt, Homo sapiens
ccacaaagacuguccaaua

SEQ ID NO: 359799 - RNA, 19 nt, Homo sapiens
cacaaagacuguccaauaa

SEQ ID NO: 359800 - RNA, 19 nt, Homo sapiens
gaacugaggcugagaauac

SEQ ID NO: 359801 - RNA, 19 nt, Homo sapiens
ccauagaccuucccacaaa

SEQ ID NO: 359802 - RNA, 19 nt, Homo sapiens
ggagagacgugugcacaaa

SEQ ID NO: 359803 - RNA, 19 nt, Homo sapiens
gcaagcaugcguauuauga

SEQ ID NO: 359804 - RNA, 19 nt, Homo sapiens
ggacauagcacccucaucu

SEQ ID NO: 359805 - RNA, 19 nt, Homo sapiens
ggagaaugcucgggugcua

SEQ ID NO: 359806 - RNA, 19 nt, Homo sapiens
gaacacaaagggaagauca

SEQ ID NO: 359807 - RNA, 19 nt, Homo sapiens
ggaugagguuugacaguga

SEQ ID NO: 359808 - RNA, 19 nt, Homo sapiens
ccugggagauggugacuuu

SEQ ID NO: 359809 - RNA, 19 nt, Homo sapiens
gggaugauauugcuuggau

SEQ ID NO: 359810 - RNA, 19 nt, Homo sapiens
guggcaagcaugcguauua

SEQ ID NO: 359811 - RNA, 19 nt, Homo sapiens
gcaagacggugauuguaac

SEQ ID NO: 359812 - RNA, 19 nt, Homo sapiens
ccacuggcauucgagauuu

SEQ ID NO: 359813 - RNA, 19 nt, Homo sapiens
ggacagugcccgagagaca

SEQ ID NO: 359814 - RNA, 19 nt, Homo sapiens
ccauguaugugcuuccauu

SEQ ID NO: 359815 - RNA, 19 nt, Homo sapiens
gagaauacugccacacuga

SEQ ID NO: 359816 - RNA, 19 nt, Homo sapiens
gaugagguuugacagugaa

SEQ ID NO: 359817 - RNA, 19 nt, Homo sapiens
gaugauauugcuuggauga

SEQ ID NO: 359818 - RNA, 19 nt, Homo sapiens
gcuggaaaguggagugugu

SEQ ID NO: 359819 - RNA, 19 nt, Homo sapiens
gagcaagacggugauugua

SEQ ID NO: 359820 - RNA, 19 nt, Homo sapiens
caucaugcacgacccauuu

SEQ ID NO: 359821 - RNA, 19 nt, Homo sapiens
uggcuacaauccagaguaa

SEQ ID NO: 359822 - RNA, 19 nt, Homo sapiens
caaccaggaucugcccaaa

SEQ ID NO: 359823 - RNA, 19 nt, Homo sapiens
agaccaaccuggcuaugau

SEQ ID NO: 359824 - RNA, 19 nt, Homo sapiens
cagaaaauaugagcaauug

SEQ ID NO: 359825 - RNA, 19 nt, Homo sapiens
gcacagaccccaaggaugu

SEQ ID NO: 359826 - RNA, 19 nt, Homo sapiens
acaggagguucgugacauu

SEQ ID NO: 359827 - RNA, 19 nt, Homo sapiens
accaggaucugcccaaaga

SEQ ID NO: 359828 - RNA, 19 nt, Homo sapiens
ggaaaccuggugacaagga

SEQ ID NO: 359829 - RNA, 19 nt, Homo sapiens
gcacccucaucugggaaua

SEQ ID NO: 359830 - RNA, 19 nt, Homo sapiens
gcacaucccaacucucgau

SEQ ID NO: 359831 - RNA, 19 nt, Homo sapiens
ccaacgccauggcuacaau

SEQ ID NO: 359832 - RNA, 19 nt, Homo sapiens
ggaacugaggcugagaaua

SEQ ID NO: 359833 - RNA, 19 nt, Homo sapiens
gcaagaccaaccuggcuau

SEQ ID NO: 359834 - RNA, 19 nt, Homo sapiens
gcuacaauccagaguaaca

SEQ ID NO: 359835 - RNA, 19 nt, Homo sapiens
agacaccacucagcuguuc

SEQ ID NO: 359836 - RNA, 19 nt, Homo sapiens
cauugacgccaucaucuuu

SEQ ID NO: 359837 - RNA, 19 nt, Homo sapiens
cuggaaaccuggugacaag

SEQ ID NO: 359838 - RNA, 19 nt, Homo sapiens
uccgaaagcuccccaagua

SEQ ID NO: 359839 - RNA, 19 nt, Homo sapiens
gggagauggugacuuuguc

SEQ ID NO: 359840 - RNA, 19 nt, Homo sapiens
caucuucaaugugccauag

SEQ ID NO: 359841 - RNA, 19 nt, Homo sapiens
ccaaggacuucugggaaca

SEQ ID NO: 359842 - RNA, 19 nt, Homo sapiens
aagggaagaucaucaugca

SEQ ID NO: 359843 - RNA, 19 nt, Homo sapiens
caucccaacucucgauuuu

SEQ ID NO: 359844 - RNA, 19 nt, Homo sapiens
gcacgaguagagagcaaga

SEQ ID NO: 359845 - RNA, 19 nt, Homo sapiens
gcuacaacuucgggcacua

SEQ ID NO: 359846 - RNA, 19 nt, Homo sapiens
gcagaacacaaagggaaga

SEQ ID NO: 359847 - RNA, 19 nt, Homo sapiens
gggaagaaggcgcuaugug

SEQ ID NO: 359848 - RNA, 19 nt, Homo sapiens
caaagggaagaucaucaug

SEQ ID NO: 359849 - RNA, 19 nt, Homo sapiens
gccuucaacuggcgucaug

SEQ ID NO: 359850 - RNA, 19 nt, Homo sapiens
uggcaagcaugcguauuau

SEQ ID NO: 359851 - RNA, 19 nt, Homo sapiens
ccagagggcauccacaucu

SEQ ID NO: 359852 - RNA, 19 nt, Homo sapiens
caggugccauggccgcauu

SEQ ID NO: 359853 - RNA, 19 nt, Homo sapiens
acaaagacuguccaauaau

SEQ ID NO: 359854 - RNA, 19 nt, Homo sapiens
gcagaaaauaugagcaauu

SEQ ID NO: 359855 - RNA, 19 nt, Homo sapiens
ggauguggcacgaguagag

SEQ ID NO: 359856 - RNA, 19 nt, Homo sapiens
gguguuggcugagcuugag

SEQ ID NO: 359857 - RNA, 19 nt, Homo sapiens
cauagaccuucccacaaag

SEQ ID NO: 359858 - RNA, 19 nt, Homo sapiens
caauccagaguaacacuau

SEQ ID NO: 359859 - RNA, 19 nt, Homo sapiens
gagcuguggaugagagguu

SEQ ID NO: 359860 - RNA, 19 nt, Homo sapiens
ccaauaauaagagaugcuu

SEQ ID NO: 359861 - RNA, 19 nt, Homo sapiens
gccauagaccuucccacaa

SEQ ID NO: 359862 - RNA, 19 nt, Homo sapiens
gaggacagugcccgagaga

SEQ ID NO: 359863 - RNA, 19 nt, Homo sapiens
caaggauguggcacgagua

SEQ ID NO: 359864 - RNA, 19 nt, Homo sapiens
caaggagcccugugcacau

SEQ ID NO: 359865 - RNA, 19 nt, Homo sapiens
uugcuuggaugagguuuga

SEQ ID NO: 359866 - RNA, 19 nt, Homo sapiens
ucaaugugccauagaccuu

SEQ ID NO: 359867 - RNA, 19 nt, Homo sapiens
gagagcaagacggugauug

SEQ ID NO: 359868 - RNA, 19 nt, Homo sapiens
agcaagacggugauuguaa

SEQ ID NO: 359869 - RNA, 19 nt, Homo sapiens
uauacgaggccuucaacug

SEQ ID NO: 359870 - RNA, 19 nt, Homo sapiens
ccauugacgccaucaucuu

SEQ ID NO: 359871 - RNA, 19 nt, Homo sapiens
agcagggccucauccgaaa

SEQ ID NO: 359872 - RNA, 19 nt, Homo sapiens
aauccagaguaacacuauu

SEQ ID NO: 359873 - RNA, 19 nt, Homo sapiens
agagcaagacggugauugu

SEQ ID NO: 359874 - RNA, 19 nt, Homo sapiens
agacuguccaauaauaaga

SEQ ID NO: 359875 - RNA, 19 nt, Homo sapiens
gagcuauagacaccacuca

SEQ ID NO: 359876 - RNA, 19 nt, Homo sapiens
acaaagggaagaucaucau

SEQ ID NO: 359877 - RNA, 19 nt, Homo sapiens
gaccaaccuggcuaugaug

SEQ ID NO: 359878 - RNA, 19 nt, Homo sapiens
ggacaaggggagccaguga

SEQ ID NO: 359879 - RNA, 19 nt, Homo sapiens
gcaaauagaucaucagaaa

SEQ ID NO: 359880 - RNA, 19 nt, Homo sapiens
ucacuuagaucaagcauua

SEQ ID NO: 359881 - RNA, 19 nt, Homo sapiens
gaaagcaguuccucuauug

SEQ ID NO: 359882 - RNA, 19 nt, Homo sapiens
gaacaaacgucagacauga

SEQ ID NO: 359883 - RNA, 19 nt, Homo sapiens
gaacaaauccagcuaaaga

SEQ ID NO: 359884 - RNA, 19 nt, Homo sapiens
gaaagaaacugauugacau

SEQ ID NO: 359885 - RNA, 19 nt, Homo sapiens
ggaaguauauuacaggauu

SEQ ID NO: 359886 - RNA, 19 nt, Homo sapiens
gaaaugagaagacaugaaa

SEQ ID NO: 359887 - RNA, 19 nt, Homo sapiens
gggaagaucuuguagagaa

SEQ ID NO: 359888 - RNA, 19 nt, Homo sapiens
ggaaacagcuuugaagugu

SEQ ID NO: 359889 - RNA, 19 nt, Homo sapiens
gcagagaaaccaaggaaua

SEQ ID NO: 359890 - RNA, 19 nt, Homo sapiens
aaacgugccuccuucuuua

SEQ ID NO: 359891 - RNA, 19 nt, Homo sapiens
gcaucaaacucagaacuua

SEQ ID NO: 359892 - RNA, 19 nt, Homo sapiens
gaacaaagacuccacauac

SEQ ID NO: 359893 - RNA, 19 nt, Homo sapiens
gagaaaccauuuaucaaga

SEQ ID NO: 359894 - RNA, 19 nt, Homo sapiens
ggaaugaaguaaauaguca

SEQ ID NO: 359895 - RNA, 19 nt, Homo sapiens
gaagaaagcaaauagauca

SEQ ID NO: 359896 - RNA, 19 nt, Homo sapiens
gaaagacuguggagaagau

SEQ ID NO: 359897 - RNA, 19 nt, Homo sapiens
gcacauggaugaaguaugc

SEQ ID NO: 359898 - RNA, 19 nt, Homo sapiens
agagauaucugaaguguug

SEQ ID NO: 359899 - RNA, 19 nt, Homo sapiens
gaagaaagaaagaaacuga

SEQ ID NO: 359900 - RNA, 19 nt, Homo sapiens
gaaguuaaaugaaguucga

SEQ ID NO: 359901 - RNA, 19 nt, Homo sapiens
gaaagcaaauagaucauca

SEQ ID NO: 359902 - RNA, 19 nt, Homo sapiens
uaacauggcaacagaauaa

SEQ ID NO: 359903 - RNA, 19 nt, Homo sapiens
agaagaaacucccguuauu

SEQ ID NO: 359904 - RNA, 19 nt, Homo sapiens
ugaagaaacugaagaguca

SEQ ID NO: 359905 - RNA, 19 nt, Homo sapiens
ugagagaucugcuaauguu

SEQ ID NO: 359906 - RNA, 19 nt, Homo sapiens
gaugagcaaccuuuaaaua

SEQ ID NO: 359907 - RNA, 19 nt, Homo sapiens
agaagcaacuggagugaua

SEQ ID NO: 359908 - RNA, 19 nt, Homo sapiens
gacauaguauccagacaua

SEQ ID NO: 359909 - RNA, 19 nt, Homo sapiens
gaacaagagaagucauaua

SEQ ID NO: 359910 - RNA, 19 nt, Homo sapiens
guacuuggauagcaucaaa

SEQ ID NO: 359911 - RNA, 19 nt, Homo sapiens
cuggaaagcuuuagcagua

SEQ ID NO: 359912 - RNA, 19 nt, Homo sapiens
gaacuuaugcgccaacgaa

SEQ ID NO: 359913 - RNA, 19 nt, Homo sapiens
cggauaaacuucagugauu

SEQ ID NO: 359914 - RNA, 19 nt, Homo sapiens
gaugacaggcucaacaaua

SEQ ID NO: 359915 - RNA, 19 nt, Homo sapiens
gaagaagacgccaguuuga

SEQ ID NO: 359916 - RNA, 19 nt, Homo sapiens
gaauuucagcccuuuauuu

SEQ ID NO: 359917 - RNA, 19 nt, Homo sapiens
ugaaugagcuaagagaauu

SEQ ID NO: 359918 - RNA, 19 nt, Homo sapiens
ggauaaacuucagugauuu

SEQ ID NO: 359919 - RNA, 19 nt, Homo sapiens
gaaagaaaaugguagaaga

SEQ ID NO: 359920 - RNA, 19 nt, Homo sapiens
gaagaugagcaaccuuuaa

SEQ ID NO: 359921 - RNA, 19 nt, Homo sapiens
gaacgagaagccacuagua

SEQ ID NO: 359922 - RNA, 19 nt, Homo sapiens
ggagcagucugguugauga

SEQ ID NO: 359923 - RNA, 19 nt, Homo sapiens
uauaugagaugucuucaga

SEQ ID NO: 359924 - RNA, 19 nt, Homo sapiens
gaaugacuaugaagcagaa

SEQ ID NO: 359925 - RNA, 19 nt, Homo sapiens
gaugaagaaucacuggaaa

SEQ ID NO: 359926 - RNA, 19 nt, Homo sapiens
ggaagaagacgccaguuug

SEQ ID NO: 359927 - RNA, 19 nt, Homo sapiens
gcgccuuacucaucuaaua

SEQ ID NO: 359928 - RNA, 19 nt, Homo sapiens
guaaugagaauguugauga

SEQ ID NO: 359929 - RNA, 19 nt, Homo sapiens
ccaguuaccucaauaucuu

SEQ ID NO: 359930 - RNA, 19 nt, Homo sapiens
ugaauuggcuuucuuuaag

SEQ ID NO: 359931 - RNA, 19 nt, Homo sapiens
gaaagaaagaaacugauug

SEQ ID NO: 359932 - RNA, 19 nt, Homo sapiens
caucugaacuaaaugaaga

SEQ ID NO: 359933 - RNA, 19 nt, Homo sapiens
gaagauggcaugaaugauc

SEQ ID NO: 359934 - RNA, 19 nt, Homo sapiens
gagcaaccuuuaaauagug

SEQ ID NO: 359935 - RNA, 19 nt, Homo sapiens
gaaacucccguuauugaaa

SEQ ID NO: 359936 - RNA, 19 nt, Homo sapiens
gaagaagacaccaagcaaa

SEQ ID NO: 359937 - RNA, 19 nt, Homo sapiens
gagagcagccagauuguaa

SEQ ID NO: 359938 - RNA, 19 nt, Homo sapiens
cagcuggaccggcaaauua

SEQ ID NO: 359939 - RNA, 19 nt, Homo sapiens
gaacuuacuccuagugaga

SEQ ID NO: 359940 - RNA, 19 nt, Homo sapiens
guagagaaaccauuuauca

SEQ ID NO: 359941 - RNA, 19 nt, Homo sapiens
gaaguagagaaaccauuua

SEQ ID NO: 359942 - RNA, 19 nt, Homo sapiens
uccagaagaugcugaauuu

SEQ ID NO: 359943 - RNA, 19 nt, Homo sapiens
ggaaagaugaagaaacuga

SEQ ID NO: 359944 - RNA, 19 nt, Homo sapiens
cacugaaacugacaauaua

SEQ ID NO: 359945 - RNA, 19 nt, Homo sapiens
aaacucaggcuuuaacuaa

SEQ ID NO: 359946 - RNA, 19 nt, Homo sapiens
caauauaccuggauuuacu

SEQ ID NO: 359947 - RNA, 19 nt, Homo sapiens
aaucauaacuccuacaauc

SEQ ID NO: 359948 - RNA, 19 nt, Homo sapiens
uagaggaaaugccaauaaa

SEQ ID NO: 359949 - RNA, 19 nt, Homo sapiens
cagaagaucaaccgacuua

SEQ ID NO: 359950 - RNA, 19 nt, Homo sapiens
guaaugaccucuugcaaaa

SEQ ID NO: 359951 - RNA, 19 nt, Homo sapiens
gaucagagaagcauuggaa

SEQ ID NO: 359952 - RNA, 19 nt, Homo sapiens
ucaaacaucugagguguau

SEQ ID NO: 359953 - RNA, 19 nt, Homo sapiens
gaagaaacucccguuauug

SEQ ID NO: 359954 - RNA, 19 nt, Homo sapiens
cuacagaaauaucuucaga

SEQ ID NO: 359955 - RNA, 19 nt, Homo sapiens
gaugccaguuccaaugaua

SEQ ID NO: 359956 - RNA, 19 nt, Homo sapiens
ggcgaacaguuaauucuaa

SEQ ID NO: 359957 - RNA, 19 nt, Homo sapiens
ggaagaucuuguagagaaa

SEQ ID NO: 359958 - RNA, 19 nt, Homo sapiens
ccacauacguucccacaca

SEQ ID NO: 359959 - RNA, 19 nt, Homo sapiens
ccacugaaacugacaauau

SEQ ID NO: 359960 - RNA, 19 nt, Homo sapiens
gauguccagugucuauuaa

SEQ ID NO: 359961 - RNA, 19 nt, Homo sapiens
ugaagaaagugaaggaugu

SEQ ID NO: 359962 - RNA, 19 nt, Homo sapiens
gaaagugccaguaugucua

SEQ ID NO: 359963 - RNA, 19 nt, Homo sapiens
ugaaagcaguuccucuauu

SEQ ID NO: 359964 - RNA, 19 nt, Homo sapiens
agaauaauguucagagguu

SEQ ID NO: 359965 - RNA, 19 nt, Homo sapiens
gaagaucaaccgacuuaug

SEQ ID NO: 359966 - RNA, 19 nt, Homo sapiens
caacagaagaaagcaaaua

SEQ ID NO: 359967 - RNA, 19 nt, Homo sapiens
ggaagaugagcaaccuuua

SEQ ID NO: 359968 - RNA, 19 nt, Homo sapiens
caugaaugaucaggauuua

SEQ ID NO: 359969 - RNA, 19 nt, Homo sapiens
gaagaacaauugcccuuuu

SEQ ID NO: 359970 - RNA, 19 nt, Homo sapiens
cagaucugcugccaacaua

SEQ ID NO: 359971 - RNA, 19 nt, Homo sapiens
agacaaggaugaaacugaa

SEQ ID NO: 359972 - RNA, 19 nt, Homo sapiens
caacuggagugauacaauc

SEQ ID NO: 359973 - RNA, 19 nt, Homo sapiens
agacugaggcugaaaguaa

SEQ ID NO: 359974 - RNA, 19 nt, Homo sapiens
gaagacgccaguuugauga

SEQ ID NO: 359975 - RNA, 19 nt, Homo sapiens
gaaagaacaauggcaagaa

SEQ ID NO: 359976 - RNA, 19 nt, Homo sapiens
ucaaauaacacuagaggaa

SEQ ID NO: 359977 - RNA, 19 nt, Homo sapiens
agaagaugcugaauuugaa

SEQ ID NO: 359978 - RNA, 19 nt, Homo sapiens
gagauugaaugagcuaaga

SEQ ID NO: 359979 - RNA, 19 nt, Homo sapiens
uuaaagagcuaguagauga

SEQ ID NO: 359980 - RNA, 19 nt, Homo sapiens
gaacuuaacaugcugugua

SEQ ID NO: 359981 - RNA, 19 nt, Homo sapiens
ggacuuuguuacacuguua

SEQ ID NO: 359982 - RNA, 19 nt, Homo sapiens
ggaaggaugcaaaguauaa

SEQ ID NO: 359983 - RNA, 19 nt, Homo sapiens
gauguggugucauagaaua

SEQ ID NO: 359984 - RNA, 19 nt, Homo sapiens
gaggaaggaugcaaaguau

SEQ ID NO: 359985 - RNA, 19 nt, Homo sapiens
gaaggacgauccaacacuu

SEQ ID NO: 359986 - RNA, 19 nt, Homo sapiens
acacucagcuguucagauu

SEQ ID NO: 359987 - RNA, 19 nt, Homo sapiens
gcuaauagaucaguuaaag

SEQ ID NO: 359988 - RNA, 19 nt, Homo sapiens
ggaggaagauugauauugc

SEQ ID NO: 359989 - RNA, 19 nt, Homo sapiens
ggaaucaucaagacagaua

SEQ ID NO: 359990 - RNA, 19 nt, Homo sapiens
gaacuucuauuugaucagu

SEQ ID NO: 359991 - RNA, 19 nt, Homo sapiens
uaaauaaugucaggaagga

SEQ ID NO: 359992 - RNA, 19 nt, Homo sapiens
caucaagacagauaaagua

SEQ ID NO: 359993 - RNA, 19 nt, Homo sapiens
cauaggaauugaucacauu

SEQ ID NO: 359994 - RNA, 19 nt, Homo sapiens
auaggagacuuguaguuua

SEQ ID NO: 359995 - RNA, 19 nt, Homo sapiens
cagcugcuuuguuaccuua

SEQ ID NO: 359996 - RNA, 19 nt, Homo sapiens
ugcaagggaugaauuguaa

SEQ ID NO: 359997 - RNA, 19 nt, Homo sapiens
aacaucagcuugaccagua

SEQ ID NO: 359998 - RNA, 19 nt, Homo sapiens
ggagcaguaugacaagcua

SEQ ID NO: 359999 - RNA, 19 nt, Homo sapiens
gguauuuggauaucuguua

SEQ ID NO: 360000 - RNA, 19 nt, Homo sapiens
uagaauagcauguuguaga

SEQ ID NO: 360001 - RNA, 19 nt, Homo sapiens
caccaccauucacaaguua

SEQ ID NO: 360002 - RNA, 19 nt, Homo sapiens
gcucaucucaguccucaaa

SEQ ID NO: 360003 - RNA, 19 nt, Homo sapiens
ggugauauacgugccuuua

SEQ ID NO: 360004 - RNA, 19 nt, Homo sapiens
gcacguaugguuggaugua

SEQ ID NO: 360005 - RNA, 19 nt, Homo sapiens
aaucagugcuccacacaug

SEQ ID NO: 360006 - RNA, 19 nt, Homo sapiens
ucaauagguuuccaagcaa

SEQ ID NO: 360007 - RNA, 19 nt, Homo sapiens
uguaagcuguguccuaguu

SEQ ID NO: 360008 - RNA, 19 nt, Homo sapiens
agaauagcauguuguagau

SEQ ID NO: 360009 - RNA, 19 nt, Homo sapiens
cauagaauagcauguugua

SEQ ID NO: 360010 - RNA, 19 nt, Homo sapiens
ucucaguccucaaagcuuu

SEQ ID NO: 360011 - RNA, 19 nt, Homo sapiens
agauugauauugccuguug

SEQ ID NO: 360012 - RNA, 19 nt, Homo sapiens
aaugggauaugcugaagaa

SEQ ID NO: 360013 - RNA, 19 nt, Homo sapiens
gauguaggaucuggaagug

SEQ ID NO: 360014 - RNA, 19 nt, Homo sapiens
uauaggagacuuguaguuu

SEQ ID NO: 360015 - RNA, 19 nt, Homo sapiens
gauacaaucagcugcuuug

SEQ ID NO: 360016 - RNA, 19 nt, Homo sapiens
gauaacaccaccauucaca

SEQ ID NO: 360017 - RNA, 19 nt, Homo sapiens
gcuuagcgauggccuggaa

SEQ ID NO: 360018 - RNA, 19 nt, Homo sapiens
agaggaaggaugcaaagua

SEQ ID NO: 360019 - RNA, 19 nt, Homo sapiens
gaauagcauguuguagaua

SEQ ID NO: 360020 - RNA, 19 nt, Homo sapiens
ggaaguggaauccuuacug

SEQ ID NO: 360021 - RNA, 19 nt, Homo sapiens
cuacagaccgcucccacua

SEQ ID NO: 360022 - RNA, 19 nt, Homo sapiens
ggagacuuguaguuuagug

SEQ ID NO: 360023 - RNA, 19 nt, Homo sapiens
uaggagacuuguaguuuag

SEQ ID NO: 360024 - RNA, 19 nt, Homo sapiens
gauuggacauaacugacuu

SEQ ID NO: 360025 - RNA, 19 nt, Homo sapiens
aaauagagaugagcuuucu

SEQ ID NO: 360026 - RNA, 19 nt, Homo sapiens
acaccaccauucacaaguu

SEQ ID NO: 360027 - RNA, 19 nt, Homo sapiens
gaaggaugcaaaguauaaa

SEQ ID NO: 360028 - RNA, 19 nt, Homo sapiens
guucuucccuucucucucu

SEQ ID NO: 360029 - RNA, 19 nt, Homo sapiens
gaaaauagagaugagcuuu

SEQ ID NO: 360030 - RNA, 19 nt, Homo sapiens
caucacagcuuguuuugga

SEQ ID NO: 360031 - RNA, 19 nt, Homo sapiens
cuucugcucuuucuucuuc

SEQ ID NO: 360032 - RNA, 19 nt, Homo sapiens
gaagaagccccuuaugaug

SEQ ID NO: 360033 - RNA, 19 nt, Homo sapiens
acagaccgcucccacuaug

SEQ ID NO: 360034 - RNA, 19 nt, Homo sapiens
guauuuggauaucuguuag

SEQ ID NO: 360035 - RNA, 19 nt, Homo sapiens
gauucuugguauuuggaua

SEQ ID NO: 360036 - RNA, 19 nt, Homo sapiens
guggauugcucaucucagu

SEQ ID NO: 360037 - RNA, 19 nt, Homo sapiens
guuaaagcccggaggaaga

SEQ ID NO: 360038 - RNA, 19 nt, Homo sapiens
acucggagcuaauccacaa

SEQ ID NO: 360039 - RNA, 19 nt, Homo sapiens
auacgugccuuuaacagau

SEQ ID NO: 360040 - RNA, 19 nt, Homo sapiens
gcgcuaauagaucaguuaa

SEQ ID NO: 360041 - RNA, 19 nt, Homo sapiens
aacuuaacaugcuguguaa

SEQ ID NO: 360042 - RNA, 19 nt, Homo sapiens
gauauacgugccuuuaaca

SEQ ID NO: 360043 - RNA, 19 nt, Homo sapiens
gcccggaggaagauugaua

SEQ ID NO: 360044 - RNA, 19 nt, Homo sapiens
ggaauugaucacauuaaag

SEQ ID NO: 360045 - RNA, 19 nt, Homo sapiens
ugauauacgugccuuuaac

SEQ ID NO: 360046 - RNA, 19 nt, Homo sapiens
gagaguacagcuuguugug

SEQ ID NO: 360047 - RNA, 19 nt, Homo sapiens
gaaaagucauaggaauuga

SEQ ID NO: 360048 - RNA, 19 nt, Homo sapiens
ggaaaagucauaggaauug

SEQ ID NO: 360049 - RNA, 19 nt, Homo sapiens
auagagaugagcuuucuuu

SEQ ID NO: 360050 - RNA, 19 nt, Homo sapiens
gcuguguccuaguucuuga

SEQ ID NO: 360051 - RNA, 19 nt, Homo sapiens
gauguccuguaaacacuca

SEQ ID NO: 360052 - RNA, 19 nt, Homo sapiens
uaagauggcaggugauguc

SEQ ID NO: 360053 - RNA, 19 nt, Homo sapiens
gcugcuuuguuaccuuaaa

SEQ ID NO: 360054 - RNA, 19 nt, Homo sapiens
gucauagaauagcauguug

SEQ ID NO: 360055 - RNA, 19 nt, Homo sapiens
gguagaggaaggaugcaaa

SEQ ID NO: 360056 - RNA, 19 nt, Homo sapiens
uacgugccuuuaacagaua

SEQ ID NO: 360057 - RNA, 19 nt, Homo sapiens
cccaggcgcuaauagauca

SEQ ID NO: 360058 - RNA, 19 nt, Homo sapiens
gaaucaucaagacagauaa

SEQ ID NO: 360059 - RNA, 19 nt, Homo sapiens
gaaaggguucuguaaaaug

SEQ ID NO: 360060 - RNA, 19 nt, Homo sapiens
gugauauacgugccuuuaa

SEQ ID NO: 360061 - RNA, 19 nt, Homo sapiens
cauuaaagagcuaguagau

SEQ ID NO: 360062 - RNA, 19 nt, Homo sapiens
uaaagcucuugauguagga

SEQ ID NO: 360063 - RNA, 19 nt, Homo sapiens
cugcugauaauguauauga

SEQ ID NO: 360064 - RNA, 19 nt, Homo sapiens
aauagcauguuguagauac

SEQ ID NO: 360065 - RNA, 19 nt, Homo sapiens
gauggaagaaugggauaug

SEQ ID NO: 360066 - RNA, 19 nt, Homo sapiens
ggagaguacagcuuguugu

SEQ ID NO: 360067 - RNA, 19 nt, Homo sapiens
acuuuaacaugcccauauu

SEQ ID NO: 360068 - RNA, 19 nt, Homo sapiens
gcaagggaugaauuguaaa

SEQ ID NO: 360069 - RNA, 19 nt, Homo sapiens
uauuugaucaguugcauga

SEQ ID NO: 360070 - RNA, 19 nt, Homo sapiens
gauccaacacuucugucuu

SEQ ID NO: 360071 - RNA, 19 nt, Homo sapiens
ggaaggacgauccaacacu

SEQ ID NO: 360072 - RNA, 19 nt, Homo sapiens
ucauaggaauugaucacau

SEQ ID NO: 360073 - RNA, 19 nt, Homo sapiens
cgcugaaggugguucugua

SEQ ID NO: 360074 - RNA, 19 nt, Homo sapiens
uugauguggugucauagaa

SEQ ID NO: 360075 - RNA, 19 nt, Homo sapiens
uaacaccaccauucacaag

SEQ ID NO: 360076 - RNA, 19 nt, Homo sapiens
gccagccacucggagcuaa

SEQ ID NO: 360077 - RNA, 19 nt, Homo sapiens
gcccauauuuuacuuggaa

SEQ ID NO: 360078 - RNA, 19 nt, Homo sapiens
uacaguggauugcucaucu

SEQ ID NO: 360079 - RNA, 19 nt, Homo sapiens
ggaggaagcuguuaccaua

SEQ ID NO: 360080 - RNA, 19 nt, Homo sapiens
gaaaugaaguugauggauu

SEQ ID NO: 360081 - RNA, 19 nt, Homo sapiens
aaacuaagcucuuugagaa

SEQ ID NO: 360082 - RNA, 19 nt, Homo sapiens
caaguaaugucgauaaaga

SEQ ID NO: 360083 - RNA, 19 nt, Homo sapiens
gaucgaggaugaagaagga

SEQ ID NO: 360084 - RNA, 19 nt, Homo sapiens
gcacguauaugccgagauc

SEQ ID NO: 360085 - RNA, 19 nt, Homo sapiens
gaucuuaggcauucuuaaa

SEQ ID NO: 360086 - RNA, 19 nt, Homo sapiens
gagaugcuguuguaauuuc

SEQ ID NO: 360087 - RNA, 19 nt, Homo sapiens
ucaaggaccucaucaacga

SEQ ID NO: 360088 - RNA, 19 nt, Homo sapiens
caguaugucugcagaugua

SEQ ID NO: 360089 - RNA, 19 nt, Homo sapiens
uaccugaacuucuuuacaa

SEQ ID NO: 360090 - RNA, 19 nt, Homo sapiens
aaagaugccuucuggugaa

SEQ ID NO: 360091 - RNA, 19 nt, Homo sapiens
guugauggauuuagauguu

SEQ ID NO: 360092 - RNA, 19 nt, Homo sapiens
gcacugagguaccugaacu

SEQ ID NO: 360093 - RNA, 19 nt, Homo sapiens
ugagguaccugaacuucuu

SEQ ID NO: 360094 - RNA, 19 nt, Homo sapiens
uggagaugcuguuguaauu

SEQ ID NO: 360095 - RNA, 19 nt, Homo sapiens
caagaucgaggaugaagaa

SEQ ID NO: 360096 - RNA, 19 nt, Homo sapiens
uauuggagaugcuguugua

SEQ ID NO: 360097 - RNA, 19 nt, Homo sapiens
agucugaucuggucuaguu

SEQ ID NO: 360098 - RNA, 19 nt, Homo sapiens
ugaaguugauggauuuaga

SEQ ID NO: 360099 - RNA, 19 nt, Homo sapiens
gaugccuucuggugaauuu

SEQ ID NO: 360100 - RNA, 19 nt, Homo sapiens
gaggccugcugggauauua

SEQ ID NO: 360101 - RNA, 19 nt, Homo sapiens
agaaggaucuuaggcauuc

SEQ ID NO: 360102 - RNA, 19 nt, Homo sapiens
ggucuugacucuaaaugca

SEQ ID NO: 360103 - RNA, 19 nt, Homo sapiens
aaaagggucuugacucuaa

SEQ ID NO: 360104 - RNA, 19 nt, Homo sapiens
cgagaucucagccauauug

SEQ ID NO: 360105 - RNA, 19 nt, Homo sapiens
agaauaaaguccaaagucu

SEQ ID NO: 360106 - RNA, 19 nt, Homo sapiens
gccgagaucucagccauau

SEQ ID NO: 360107 - RNA, 19 nt, Homo sapiens
agagaugaaugaaccaguu

SEQ ID NO: 360108 - RNA, 19 nt, Homo sapiens
caccaaauuuguaccucua

SEQ ID NO: 360109 - RNA, 19 nt, Homo sapiens
guggagaacuuggaaaugg

SEQ ID NO: 360110 - RNA, 19 nt, Homo sapiens
ggagaugcuguuguaauuu

SEQ ID NO: 360111 - RNA, 19 nt, Homo sapiens
uagcuagacuuuccuccuu

SEQ ID NO: 360112 - RNA, 19 nt, Homo sapiens
uaccuuggcgcuaguauuu

SEQ ID NO: 360113 - RNA, 19 nt, Homo sapiens
gcggauaugggacacuuaa

SEQ ID NO: 360114 - RNA, 19 nt, Homo sapiens
aauaaaguccaaagucuga

SEQ ID NO: 360115 - RNA, 19 nt, Homo sapiens
gaacuuggaaauggaaaca

SEQ ID NO: 360116 - RNA, 19 nt, Homo sapiens
gaaguugauggauuuagau

SEQ ID NO: 360117 - RNA, 19 nt, Homo sapiens
gaucuggucuaguuaaccu

SEQ ID NO: 360118 - RNA, 19 nt, Homo sapiens
ggagaacuuggaaauggaa

SEQ ID NO: 360119 - RNA, 19 nt, Homo sapiens
aacgaggccugcugggaua

SEQ ID NO: 360120 - RNA, 19 nt, Homo sapiens
acacuaagggccgaagaua

SEQ ID NO: 360121 - RNA, 19 nt, Homo sapiens
cagcauauacugaagucuu

SEQ ID NO: 360122 - RNA, 19 nt, Homo sapiens
ccacuccacucucuucaac

SEQ ID NO: 360123 - RNA, 19 nt, Homo sapiens
ccuuggcgcuaguauuuga

SEQ ID NO: 360124 - RNA, 19 nt, Homo sapiens
caaagucugaucuggucua

SEQ ID NO: 360125 - RNA, 19 nt, Homo sapiens
agcauauacugaagucuuu

SEQ ID NO: 360126 - RNA, 19 nt, Homo sapiens
aggaagcuguuaccauaga

SEQ ID NO: 360127 - RNA, 19 nt, Homo sapiens
caacggugacacucaguau

SEQ ID NO: 360128 - RNA, 19 nt, Homo sapiens
ccgaaacuagcuagacuuu

SEQ ID NO: 360129 - RNA, 19 nt, Homo sapiens
caacuaacuuuugcacuga

SEQ ID NO: 360130 - RNA, 19 nt, Homo sapiens
gcuguuaccauagagauga

SEQ ID NO: 360131 - RNA, 19 nt, Homo sapiens
uaaagaggaggaagcuguu

SEQ ID NO: 360132 - RNA, 19 nt, Homo sapiens
guuguaauuuccugugcaa

SEQ ID NO: 360133 - RNA, 19 nt, Homo sapiens
caaaagacggagugaaauu

SEQ ID NO: 360134 - RNA, 19 nt, Homo sapiens
caccaaaccaggagaaagu

SEQ ID NO: 360135 - RNA, 19 nt, Homo sapiens
gaagauaacgcggauaccu

SEQ ID NO: 360136 - RNA, 19 nt, Homo sapiens
ugauggauuuagauguuga

SEQ ID NO: 360137 - RNA, 19 nt, Homo sapiens
ccaaauuuguaccucuaag

SEQ ID NO: 360138 - RNA, 19 nt, Homo sapiens
cucccaagaucgaggauga

SEQ ID NO: 360139 - RNA, 19 nt, Homo sapiens
ggauaugggacacuuaaaa

SEQ ID NO: 360140 - RNA, 19 nt, Homo sapiens
gcacucaaggaccucauca

SEQ ID NO: 360141 - RNA, 19 nt, Homo sapiens
uggugaauuugcacguaua

SEQ ID NO: 360142 - RNA, 19 nt, Homo sapiens
cacuaagggccgaagauaa

SEQ ID NO: 360143 - RNA, 19 nt, Homo sapiens
caaauuuguaccucuaagu

SEQ ID NO: 360144 - RNA, 19 nt, Homo sapiens
gcuccauccucaagaaggu

SEQ ID NO: 360145 - RNA, 19 nt, Homo sapiens
ggaagcuguuaccauagag

SEQ ID NO: 360146 - RNA, 19 nt, Homo sapiens
uggagaacuuggaaaugga

SEQ ID NO: 360147 - RNA, 19 nt, Homo sapiens
aaagggucuugacucuaaa

SEQ ID NO: 360148 - RNA, 19 nt, Homo sapiens
guaccugaacuucuuuaca

SEQ ID NO: 360149 - RNA, 19 nt, Homo sapiens
gaagcuguuaccauagaga

SEQ ID NO: 360150 - RNA, 19 nt, Homo sapiens
ccacuccgccaccauguuc

SEQ ID NO: 360151 - RNA, 19 nt, Homo sapiens
aaagaggaggaagcuguua

SEQ ID NO: 360152 - RNA, 19 nt, Homo sapiens
gaauuccagaacaggagua

SEQ ID NO: 360153 - RNA, 19 nt, Homo sapiens
aagaauaaaguccaaaguc

SEQ ID NO: 360154 - RNA, 19 nt, Homo sapiens
gccagcauauacugaaguc

SEQ ID NO: 360155 - RNA, 19 nt, Homo sapiens
gcagauguaccccuuguug

SEQ ID NO: 360156 - RNA, 19 nt, Homo sapiens
gcaccaaaccaggagaaag

SEQ ID NO: 360157 - RNA, 19 nt, Homo sapiens
ugaauuugcacguauaugc

SEQ ID NO: 360158 - RNA, 19 nt, Homo sapiens
gagguaccugaacuucuuu

SEQ ID NO: 360159 - RNA, 19 nt, Homo sapiens
ucuggugaauuugcacgua

SEQ ID NO: 360160 - RNA, 19 nt, Homo sapiens
guaguaaagaugccuucug

SEQ ID NO: 360161 - RNA, 19 nt, Homo sapiens
gacuaugaaaugaaguuga

SEQ ID NO: 360162 - RNA, 19 nt, Homo sapiens
cagacuaugaaaugaaguu

SEQ ID NO: 360163 - RNA, 19 nt, Homo sapiens
gauaugggacacuuaaaau

SEQ ID NO: 360164 - RNA, 19 nt, Homo sapiens
ucaacggugacacucagua

SEQ ID NO: 360165 - RNA, 19 nt, Homo sapiens
gaggaagcuguuaccauag

SEQ ID NO: 360166 - RNA, 19 nt, Homo sapiens
acaaaagggucuugacucu

SEQ ID NO: 360167 - RNA, 19 nt, Homo sapiens
aagauaacgcggauaccuu

SEQ ID NO: 360168 - RNA, 19 nt, Homo sapiens
ggugaauuugcacguauau

SEQ ID NO: 360169 - RNA, 19 nt, Homo sapiens
cuggugaauuugcacguau

SEQ ID NO: 360170 - RNA, 19 nt, Homo sapiens
gaaacggacuggaaaguua

SEQ ID NO: 360171 - RNA, 19 nt, Homo sapiens
gcaaagaacugucugcaaa

SEQ ID NO: 360172 - RNA, 19 nt, Homo sapiens
gaugaaaggugacuuagaa

SEQ ID NO: 360173 - RNA, 19 nt, Homo sapiens
guaaagagaucaccgagaa

SEQ ID NO: 360174 - RNA, 19 nt, Homo sapiens
ggacgaagcuugcucacuu

SEQ ID NO: 360175 - RNA, 19 nt, Homo sapiens
gaaacacucuccaugauug

SEQ ID NO: 360176 - RNA, 19 nt, Homo sapiens
ggagaaagaugucgaagau

SEQ ID NO: 360177 - RNA, 19 nt, Homo sapiens
gaagaaauacuacaucuga

SEQ ID NO: 360178 - RNA, 19 nt, Homo sapiens
gaaaggagcucuggcacaa

SEQ ID NO: 360179 - RNA, 19 nt, Homo sapiens
ggaagaagcacgccaaauu

SEQ ID NO: 360180 - RNA, 19 nt, Homo sapiens
gaggagaaguuaacauuga

SEQ ID NO: 360181 - RNA, 19 nt, Homo sapiens
agaaagaugucgaagauuu

SEQ ID NO: 360182 - RNA, 19 nt, Homo sapiens
gaaauuagcagccacaugu

SEQ ID NO: 360183 - RNA, 19 nt, Homo sapiens
gagaauggcuuccuguugu

SEQ ID NO: 360184 - RNA, 19 nt, Homo sapiens
gaacauuccuugacagagu

SEQ ID NO: 360185 - RNA, 19 nt, Homo sapiens
cagaguauauucaccauuu

SEQ ID NO: 360186 - RNA, 19 nt, Homo sapiens
agacugagcucaaagaaga

SEQ ID NO: 360187 - RNA, 19 nt, Homo sapiens
gagagcagcuggagugaug

SEQ ID NO: 360188 - RNA, 19 nt, Homo sapiens
ugaauuggcuauacagaaa

SEQ ID NO: 360189 - RNA, 19 nt, Homo sapiens
aaacaggaauuccaaagaa

SEQ ID NO: 360190 - RNA, 19 nt, Homo sapiens
ggagaaagcagaggaaauu

SEQ ID NO: 360191 - RNA, 19 nt, Homo sapiens
ucagagaacuugaggaaga

SEQ ID NO: 360192 - RNA, 19 nt, Homo sapiens
agacugagcugaugaaaca

SEQ ID NO: 360193 - RNA, 19 nt, Homo sapiens
ugucuaagcuugagaaguu

SEQ ID NO: 360194 - RNA, 19 nt, Homo sapiens
gaagagaacacgagcuuga

SEQ ID NO: 360195 - RNA, 19 nt, Homo sapiens
gguggucauugcaauauua

SEQ ID NO: 360196 - RNA, 19 nt, Homo sapiens
ggacggcuguggagaaaga

SEQ ID NO: 360197 - RNA, 19 nt, Homo sapiens
gagaagagccugacauauc

SEQ ID NO: 360198 - RNA, 19 nt, Homo sapiens
uaacauugaugcuacuuga

SEQ ID NO: 360199 - RNA, 19 nt, Homo sapiens
uaaagacccugaaggaaga

SEQ ID NO: 360200 - RNA, 19 nt, Homo sapiens
gaagagagaggacuuggaa

SEQ ID NO: 360201 - RNA, 19 nt, Homo sapiens
gagcagagagcuuuagaaa

SEQ ID NO: 360202 - RNA, 19 nt, Homo sapiens
gcaggaagaagaaauuaaa

SEQ ID NO: 360203 - RNA, 19 nt, Homo sapiens
guuaagggaugcugagaaa

SEQ ID NO: 360204 - RNA, 19 nt, Homo sapiens
ugagagaccuggagucgaa

SEQ ID NO: 360205 - RNA, 19 nt, Homo sapiens
caacauccuuugauucuca

SEQ ID NO: 360206 - RNA, 19 nt, Homo sapiens
aaauugggauuccuugaua

SEQ ID NO: 360207 - RNA, 19 nt, Homo sapiens
gaggagauguggucugaug

SEQ ID NO: 360208 - RNA, 19 nt, Homo sapiens
gaaauucagugcggaacaa

SEQ ID NO: 360209 - RNA, 19 nt, Homo sapiens
gaaguuacaaucagaaaug

SEQ ID NO: 360210 - RNA, 19 nt, Homo sapiens
gaaagcagaggaaauugaa

SEQ ID NO: 360211 - RNA, 19 nt, Homo sapiens
gagcugaguuggagaagau

SEQ ID NO: 360212 - RNA, 19 nt, Homo sapiens
aaagccagcuggagcauuu

SEQ ID NO: 360213 - RNA, 19 nt, Homo sapiens
uaagaaauggcaagaagua

SEQ ID NO: 360214 - RNA, 19 nt, Homo sapiens
caagaaacacucuccauga

SEQ ID NO: 360215 - RNA, 19 nt, Homo sapiens
uggaggagcugaagucuga

SEQ ID NO: 360216 - RNA, 19 nt, Homo sapiens
ggaaggaaguggaggaucu

SEQ ID NO: 360217 - RNA, 19 nt, Homo sapiens
gaagaagcacgccaaauuc

SEQ ID NO: 360218 - RNA, 19 nt, Homo sapiens
ggagaagcugcgagaauua

SEQ ID NO: 360219 - RNA, 19 nt, Homo sapiens
gaacaucaacaucaggaaa

SEQ ID NO: 360220 - RNA, 19 nt, Homo sapiens
cagcgugacuugcauaaga

SEQ ID NO: 360221 - RNA, 19 nt, Homo sapiens
gagaaaaguuggaugaauu

SEQ ID NO: 360222 - RNA, 19 nt, Homo sapiens
gcaugaaacucgucugaag

SEQ ID NO: 360223 - RNA, 19 nt, Homo sapiens
gaaagagucggcagauaga

SEQ ID NO: 360224 - RNA, 19 nt, Homo sapiens
gaaccgaagugagcacaga

SEQ ID NO: 360225 - RNA, 19 nt, Homo sapiens
gaaguuaacauugaugcua

SEQ ID NO: 360226 - RNA, 19 nt, Homo sapiens
gaaacaggaauuccaaaga

SEQ ID NO: 360227 - RNA, 19 nt, Homo sapiens
gaagugauccagcaaagau

SEQ ID NO: 360228 - RNA, 19 nt, Homo sapiens
gugcauugcuggugacuug

SEQ ID NO: 360229 - RNA, 19 nt, Homo sapiens
agaagagccugacauauca

SEQ ID NO: 360230 - RNA, 19 nt, Homo sapiens
gagcagacuuugaggaaca

SEQ ID NO: 360231 - RNA, 19 nt, Homo sapiens
ugagggagauggaaguuga

SEQ ID NO: 360232 - RNA, 19 nt, Homo sapiens
cagcacagguugucaggaa

SEQ ID NO: 360233 - RNA, 19 nt, Homo sapiens
gaagcacgccaaauucauu

SEQ ID NO: 360234 - RNA, 19 nt, Homo sapiens
gagaaacagaccaucauaa

SEQ ID NO: 360235 - RNA, 19 nt, Homo sapiens
gcagauagacaaguguuaa

SEQ ID NO: 360236 - RNA, 19 nt, Homo sapiens
gaagaaauugaacuccuaa

SEQ ID NO: 360237 - RNA, 19 nt, Homo sapiens
ccagaugccuugaauuaag

SEQ ID NO: 360238 - RNA, 19 nt, Homo sapiens
cagaugaaaugccagauuc

SEQ ID NO: 360239 - RNA, 19 nt, Homo sapiens
uggaggaucugaccaaaga

SEQ ID NO: 360240 - RNA, 19 nt, Homo sapiens
gcgcaaaccuccucuccau

SEQ ID NO: 360241 - RNA, 19 nt, Homo sapiens
aaacagaccaucauaaaca

SEQ ID NO: 360242 - RNA, 19 nt, Homo sapiens
gaagagaucaggcgcuugu

SEQ ID NO: 360243 - RNA, 19 nt, Homo sapiens
ucaaagagagcgagaaaga

SEQ ID NO: 360244 - RNA, 19 nt, Homo sapiens
gcacacaccagcaauguca

SEQ ID NO: 360245 - RNA, 19 nt, Homo sapiens
cgaaacggcuccacagagu

SEQ ID NO: 360246 - RNA, 19 nt, Homo sapiens
gagcugcaguuccaguuug

SEQ ID NO: 360247 - RNA, 19 nt, Homo sapiens
gaggacggcuguggagaaa

SEQ ID NO: 360248 - RNA, 19 nt, Homo sapiens
gaaggucgaucucguagcu

SEQ ID NO: 360249 - RNA, 19 nt, Homo sapiens
gauaaagagguguuaaaga

SEQ ID NO: 360250 - RNA, 19 nt, Homo sapiens
gcaagaaguagaucggaaa

SEQ ID NO: 360251 - RNA, 19 nt, Homo sapiens
gaacaacuccaugaaguca

SEQ ID NO: 360252 - RNA, 19 nt, Homo sapiens
gcugaaagccacuauugaa

SEQ ID NO: 360253 - RNA, 19 nt, Homo sapiens
gagcugaaagccacuauug

SEQ ID NO: 360254 - RNA, 19 nt, Homo sapiens
ggucauauauaccagaagu

SEQ ID NO: 360255 - RNA, 19 nt, Homo sapiens
cagaaagagucggcagaua

SEQ ID NO: 360256 - RNA, 19 nt, Homo sapiens
agaagaaauugaacuccua

SEQ ID NO: 360257 - RNA, 19 nt, Homo sapiens
aaagagagcgagaaagaaa

SEQ ID NO: 360258 - RNA, 19 nt, Homo sapiens
caaggaggauacacagaga

SEQ ID NO: 360259 - RNA, 19 nt, Homo sapiens
uaaguguccucaccuuuau

SEQ ID NO: 360260 - RNA, 19 nt, Homo sapiens
guuaagaaauggcaagaag

SEQ ID NO: 360261 - RNA, 19 nt, Homo sapiens
gcaaaggaagcgacgauug

SEQ ID NO: 360262 - RNA, 19 nt, Homo sapiens
gcuugaaggucauauauac

SEQ ID NO: 360263 - RNA, 19 nt, Homo sapiens
aaagaugaaaggugacuua

SEQ ID NO: 360264 - RNA, 19 nt, Homo sapiens
ggaagcaggcugagaagga

SEQ ID NO: 360265 - RNA, 19 nt, Homo sapiens
agaaacagaccaucauaaa

SEQ ID NO: 360266 - RNA, 19 nt, Homo sapiens
gaaggacgauuuggagaag

SEQ ID NO: 360267 - RNA, 19 nt, Homo sapiens
cguagagacuucagcauug

SEQ ID NO: 360268 - RNA, 19 nt, Homo sapiens
ugagaaaacuuaccaagaa

SEQ ID NO: 360269 - RNA, 19 nt, Homo sapiens
gcucagguguggacaggaa

SEQ ID NO: 360270 - RNA, 19 nt, Homo sapiens
gaacugagccuaaagucaa

SEQ ID NO: 360271 - RNA, 19 nt, Homo sapiens
ccucaggccucucuucuua

SEQ ID NO: 360272 - RNA, 19 nt, Homo sapiens
gaagaaaggagucaguuau

SEQ ID NO: 360273 - RNA, 19 nt, Homo sapiens
gagugcaucuggaccauaa

SEQ ID NO: 360274 - RNA, 19 nt, Homo sapiens
cagguuacguggcaaguga

SEQ ID NO: 360275 - RNA, 19 nt, Homo sapiens
ugaagaaaggagucaguua

SEQ ID NO: 360276 - RNA, 19 nt, Homo sapiens
gaaaggagucaguuaucug

SEQ ID NO: 360277 - RNA, 19 nt, Homo sapiens
gaggcuuccugcucuggua

SEQ ID NO: 360278 - RNA, 19 nt, Homo sapiens
ggaacugagccuaaaguca

SEQ ID NO: 360279 - RNA, 19 nt, Homo sapiens
ggacaccuacugccgcuau

SEQ ID NO: 360280 - RNA, 19 nt, Homo sapiens
ggacuggaccugccaacuc

SEQ ID NO: 360281 - RNA, 19 nt, Homo sapiens
agaaaggagucaguuaucu

SEQ ID NO: 360282 - RNA, 19 nt, Homo sapiens
gugccucccugaaguuuua

SEQ ID NO: 360283 - RNA, 19 nt, Homo sapiens
ucaggccucucuucuuauc

SEQ ID NO: 360284 - RNA, 19 nt, Homo sapiens
gcugaugggccagguagaa

SEQ ID NO: 360285 - RNA, 19 nt, Homo sapiens
gucccaaccuccggagaaa

SEQ ID NO: 360286 - RNA, 19 nt, Homo sapiens
ccucucuucuuauccaaau

SEQ ID NO: 360287 - RNA, 19 nt, Homo sapiens
ucagucuuauuggugcuua

SEQ ID NO: 360288 - RNA, 19 nt, Homo sapiens
ggagugcaucuggaccaua

SEQ ID NO: 360289 - RNA, 19 nt, Homo sapiens
cagauccucaccaaccuaa

SEQ ID NO: 360290 - RNA, 19 nt, Homo sapiens
gcugcugccucugucuuga

SEQ ID NO: 360291 - RNA, 19 nt, Homo sapiens
ucaccaaccuaagcaagag

SEQ ID NO: 360292 - RNA, 19 nt, Homo sapiens
ccagguagaagagaacaga

SEQ ID NO: 360293 - RNA, 19 nt, Homo sapiens
gacagugaaguccaugguu

SEQ ID NO: 360294 - RNA, 19 nt, Homo sapiens
ugaggaugacgacggauga

SEQ ID NO: 360295 - RNA, 19 nt, Homo sapiens
ccacuggugccucccugaa

SEQ ID NO: 360296 - RNA, 19 nt, Homo sapiens
ucaucgcgcugaccuucga

SEQ ID NO: 360297 - RNA, 19 nt, Homo sapiens
gacugugucccucucauuc

SEQ ID NO: 360298 - RNA, 19 nt, Homo sapiens
aagaaaggagucaguuauc

SEQ ID NO: 360299 - RNA, 19 nt, Homo sapiens
cagaaggucuccucaguga

SEQ ID NO: 360300 - RNA, 19 nt, Homo sapiens
uggagaagcuggccaagaa

SEQ ID NO: 360301 - RNA, 19 nt, Homo sapiens
gaaggucuccucagugaug

SEQ ID NO: 360302 - RNA, 19 nt, Homo sapiens
ucacucagauccacauuca

SEQ ID NO: 360303 - RNA, 19 nt, Homo sapiens
ccaagaaggcggagaagga

SEQ ID NO: 360304 - RNA, 19 nt, Homo sapiens
gguguugaguuucugcaaa

SEQ ID NO: 360305 - RNA, 19 nt, Homo sapiens
gcagaucgccgaggagaau

SEQ ID NO: 360306 - RNA, 19 nt, Homo sapiens
cagcagcucuugggaagga

SEQ ID NO: 360307 - RNA, 19 nt, Homo sapiens
gagugcugcuccugucauu

SEQ ID NO: 360308 - RNA, 19 nt, Homo sapiens
gacagaaccgucacucaga

SEQ ID NO: 360309 - RNA, 19 nt, Homo sapiens
gaagaacgaaggugugaac

SEQ ID NO: 360310 - RNA, 19 nt, Homo sapiens
gauacccuguuccaguuga

SEQ ID NO: 360311 - RNA, 19 nt, Homo sapiens
ucuugaggcuuccagguuu

SEQ ID NO: 360312 - RNA, 19 nt, Homo sapiens
ccucagugauggacagguu

SEQ ID NO: 360313 - RNA, 19 nt, Homo sapiens
gaccaaagcccuggacaag

SEQ ID NO: 360314 - RNA, 19 nt, Homo sapiens
cuggugguauuuacaauga

SEQ ID NO: 360315 - RNA, 19 nt, Homo sapiens
gagaacgccauccgcaaga

SEQ ID NO: 360316 - RNA, 19 nt, Homo sapiens
guguugaguuucugcaaau

SEQ ID NO: 360317 - RNA, 19 nt, Homo sapiens
acgauacccuguuccaguu

SEQ ID NO: 360318 - RNA, 19 nt, Homo sapiens
cccaaugccuucccagcuu

SEQ ID NO: 360319 - RNA, 19 nt, Homo sapiens
caugugcugugcuguuugu

SEQ ID NO: 360320 - RNA, 19 nt, Homo sapiens
ggugguauuuacaaugaca

SEQ ID NO: 360321 - RNA, 19 nt, Homo sapiens
cauggacgauacccuguuc

SEQ ID NO: 360322 - RNA, 19 nt, Homo sapiens
acagaaccgucacucagau

SEQ ID NO: 360323 - RNA, 19 nt, Homo sapiens
gguuguuccuguucuuuua

SEQ ID NO: 360324 - RNA, 19 nt, Homo sapiens
gcaggaggucccaccaugu

SEQ ID NO: 360325 - RNA, 19 nt, Homo sapiens
cggcgaagcagcuggagaa

SEQ ID NO: 360326 - RNA, 19 nt, Homo sapiens
guugaguuucugcaaauuu

SEQ ID NO: 360327 - RNA, 19 nt, Homo sapiens
gaggaaaaccugccauugu

SEQ ID NO: 360328 - RNA, 19 nt, Homo sapiens
ggaggcaccacaggucuau

SEQ ID NO: 360329 - RNA, 19 nt, Homo sapiens
ggagcaggccaaagugaag

SEQ ID NO: 360330 - RNA, 19 nt, Homo sapiens
gugcugcuccugucauugu

SEQ ID NO: 360331 - RNA, 19 nt, Homo sapiens
uugaguuucugcaaauuuc

SEQ ID NO: 360332 - RNA, 19 nt, Homo sapiens
caccgcgucuugccuuugu

SEQ ID NO: 360333 - RNA, 19 nt, Homo sapiens
gcagguggacagccucauc

SEQ ID NO: 360334 - RNA, 19 nt, Homo sapiens
ugcagaaggucuccucagu

SEQ ID NO: 360335 - RNA, 19 nt, Homo sapiens
uaccaucuguaaacaacug

SEQ ID NO: 360336 - RNA, 19 nt, Homo sapiens
ggaguuggcgucccuucuc

SEQ ID NO: 360337 - RNA, 19 nt, Homo sapiens
gagcaggccaaagugaaga

SEQ ID NO: 360338 - RNA, 19 nt, Homo sapiens
ccucuaccaucuguaaaca

SEQ ID NO: 360339 - RNA, 19 nt, Homo sapiens
gcggagcaggccaaaguga

SEQ ID NO: 360340 - RNA, 19 nt, Homo sapiens
gcaccauggaccugcagaa

SEQ ID NO: 360341 - RNA, 19 nt, Homo sapiens
gaacgccauccgcaagaag

SEQ ID NO: 360342 - RNA, 19 nt, Homo sapiens
agagugugcccguguguau

SEQ ID NO: 360343 - RNA, 19 nt, Homo sapiens
ucagauccacauucaagug

SEQ ID NO: 360344 - RNA, 19 nt, Homo sapiens
agaacgccauccgcaagaa

SEQ ID NO: 360345 - RNA, 19 nt, Homo sapiens
ccaaagcugcccaguccau

SEQ ID NO: 360346 - RNA, 19 nt, Homo sapiens
caggaggucccaccaugug

SEQ ID NO: 360347 - RNA, 19 nt, Homo sapiens
aagaagaacgaagguguga

SEQ ID NO: 360348 - RNA, 19 nt, Homo sapiens
ucuaccaucuguaaacaac

SEQ ID NO: 360349 - RNA, 19 nt, Homo sapiens
cacccucuaccaucuguaa

SEQ ID NO: 360350 - RNA, 19 nt, Homo sapiens
cuccugcgcucccucacuu

SEQ ID NO: 360351 - RNA, 19 nt, Homo sapiens
ccuuaggguuguuccuguu

SEQ ID NO: 360352 - RNA, 19 nt, Homo sapiens
ugaccaaagcccuggacaa

SEQ ID NO: 360353 - RNA, 19 nt, Homo sapiens
acgcuguccuggugguauu

SEQ ID NO: 360354 - RNA, 19 nt, Homo sapiens
gguggacagccucaucaug

SEQ ID NO: 360355 - RNA, 19 nt, Homo sapiens
gcagcuuggucgguucgau

SEQ ID NO: 360356 - RNA, 19 nt, Homo sapiens
ggacugagcuguugaguua

SEQ ID NO: 360357 - RNA, 19 nt, Homo sapiens
gaagaaaguucaagaagaa

SEQ ID NO: 360358 - RNA, 19 nt, Homo sapiens
gaacaacacccuagagaga

SEQ ID NO: 360359 - RNA, 19 nt, Homo sapiens
gugaguagcuuaaucucua

SEQ ID NO: 360360 - RNA, 19 nt, Homo sapiens
caucaucugucaagaaauu

SEQ ID NO: 360361 - RNA, 19 nt, Homo sapiens
caagaagaauuugacauug

SEQ ID NO: 360362 - RNA, 19 nt, Homo sapiens
gacaagacaucuggugaaa

SEQ ID NO: 360363 - RNA, 19 nt, Homo sapiens
guaggaagguauagacaau

SEQ ID NO: 360364 - RNA, 19 nt, Homo sapiens
agaagaaaguucaagaaga

SEQ ID NO: 360365 - RNA, 19 nt, Homo sapiens
uagcaaaccuccaaugcau

SEQ ID NO: 360366 - RNA, 19 nt, Homo sapiens
caagacaucuggugaaaau

SEQ ID NO: 360367 - RNA, 19 nt, Homo sapiens
gaagucauccacacacaau

SEQ ID NO: 360368 - RNA, 19 nt, Homo sapiens
caacaugagugagcgacaa

SEQ ID NO: 360369 - RNA, 19 nt, Homo sapiens
gaagguauagacaauggaa

SEQ ID NO: 360370 - RNA, 19 nt, Homo sapiens
cagaaaccugugauauuua

SEQ ID NO: 360371 - RNA, 19 nt, Homo sapiens
gagaagucauccacacaca

SEQ ID NO: 360372 - RNA, 19 nt, Homo sapiens
gcaaaccuccaaugcaugu

SEQ ID NO: 360373 - RNA, 19 nt, Homo sapiens
gugcagcgguggccauuca

SEQ ID NO: 360374 - RNA, 19 nt, Homo sapiens
ugaguuagagccaacauga

SEQ ID NO: 360375 - RNA, 19 nt, Homo sapiens
gaaaauuccagaagaagaa

SEQ ID NO: 360376 - RNA, 19 nt, Homo sapiens
uccaaugcauguacagaaa

SEQ ID NO: 360377 - RNA, 19 nt, Homo sapiens
accaucaucugucaagaaa

SEQ ID NO: 360378 - RNA, 19 nt, Homo sapiens
gacagaagaaaguucaaga

SEQ ID NO: 360379 - RNA, 19 nt, Homo sapiens
gcaacuauuuuccuugaug

SEQ ID NO: 360380 - RNA, 19 nt, Homo sapiens
guagcuuaaucucuauguu

SEQ ID NO: 360381 - RNA, 19 nt, Homo sapiens
ucagaaaauuccagaagaa

SEQ ID NO: 360382 - RNA, 19 nt, Homo sapiens
gccauucagucucaguuca

SEQ ID NO: 360383 - RNA, 19 nt, Homo sapiens
ugaguagcuuaaucucuau

SEQ ID NO: 360384 - RNA, 19 nt, Homo sapiens
gagagaagucauccacaca

SEQ ID NO: 360385 - RNA, 19 nt, Homo sapiens
gcauagcaaaccuccaaug

SEQ ID NO: 360386 - RNA, 19 nt, Homo sapiens
cagaagaaaguucaagaag

SEQ ID NO: 360387 - RNA, 19 nt, Homo sapiens
caaccaucaucugucaaga

SEQ ID NO: 360388 - RNA, 19 nt, Homo sapiens
acagaagaaaguucaagaa

SEQ ID NO: 360389 - RNA, 19 nt, Homo sapiens
agacaagacaucuggugaa

SEQ ID NO: 360390 - RNA, 19 nt, Homo sapiens
ggacagaagaaaguucaag

SEQ ID NO: 360391 - RNA, 19 nt, Homo sapiens
aaaugaaguuacgaugaga

SEQ ID NO: 360392 - RNA, 19 nt, Homo sapiens
agaagaauuugacauugac

SEQ ID NO: 360393 - RNA, 19 nt, Homo sapiens
aagaacaacacccuagaga

SEQ ID NO: 360394 - RNA, 19 nt, Homo sapiens
aauuugacauugacaugga

SEQ ID NO: 360395 - RNA, 19 nt, Homo sapiens
gaaaaugauggacagaaga

SEQ ID NO: 360396 - RNA, 19 nt, Homo sapiens
acugagcuguugaguuaga

SEQ ID NO: 360397 - RNA, 19 nt, Homo sapiens
cacaauccacacacgcaua

SEQ ID NO: 360398 - RNA, 19 nt, Homo sapiens
agaagaaggcugggucuca

SEQ ID NO: 360399 - RNA, 19 nt, Homo sapiens
acaacacccuagagagaag

SEQ ID NO: 360400 - RNA, 19 nt, Homo sapiens
aaaaugaaguuacgaugag

SEQ ID NO: 360401 - RNA, 19 nt, Homo sapiens
aggaagguauagacaaugg

SEQ ID NO: 360402 - RNA, 19 nt, Homo sapiens
ccuccuaguccaccugaaa

SEQ ID NO: 360403 - RNA, 19 nt, Homo sapiens
gaagaauuugacauugaca

SEQ ID NO: 360404 - RNA, 19 nt, Homo sapiens
gggacugagcuguugaguu

SEQ ID NO: 360405 - RNA, 19 nt, Homo sapiens
uuagagccaacaugaguga

SEQ ID NO: 360406 - RNA, 19 nt, Homo sapiens
gugcugggccaaccaaugg

SEQ ID NO: 360407 - RNA, 19 nt, Homo sapiens
agcuuaaucucuauguuuc

SEQ ID NO: 360408 - RNA, 19 nt, Homo sapiens
ugaaaaugauggacagaag

SEQ ID NO: 360409 - RNA, 19 nt, Homo sapiens
ggaugcaccagagacagaa

SEQ ID NO: 360410 - RNA, 19 nt, Homo sapiens
agaauuugacauugacaug

SEQ ID NO: 360411 - RNA, 19 nt, Homo sapiens
gaacaaaccuucccagcuu

SEQ ID NO: 360412 - RNA, 19 nt, Homo sapiens
ccaaagcucugguggauuu

SEQ ID NO: 360413 - RNA, 19 nt, Homo sapiens
ggcaggaucuguacaauaa

SEQ ID NO: 360414 - RNA, 19 nt, Homo sapiens
gaagaaagaguguguugua

SEQ ID NO: 360415 - RNA, 19 nt, Homo sapiens
ggagagaacccuauaggua

SEQ ID NO: 360416 - RNA, 19 nt, Homo sapiens
ggaaaccacuuaucacaug

SEQ ID NO: 360417 - RNA, 19 nt, Homo sapiens
gcgcugaccugcacaauga

SEQ ID NO: 360418 - RNA, 19 nt, Homo sapiens
gaaagaguguguuguaaag

SEQ ID NO: 360419 - RNA, 19 nt, Homo sapiens
ggaaucacacggacauuua

SEQ ID NO: 360420 - RNA, 19 nt, Homo sapiens
gauaugaaguguuagauag

SEQ ID NO: 360421 - RNA, 19 nt, Homo sapiens
gcaagcaaauaaucacaaa

SEQ ID NO: 360422 - RNA, 19 nt, Homo sapiens
ggacauuuaugccaacuau

SEQ ID NO: 360423 - RNA, 19 nt, Homo sapiens
ccaaagcaaucaccaaaga

SEQ ID NO: 360424 - RNA, 19 nt, Homo sapiens
gaagaauugugaacuggaa

SEQ ID NO: 360425 - RNA, 19 nt, Homo sapiens
gcaaugcccguaaugcuua

SEQ ID NO: 360426 - RNA, 19 nt, Homo sapiens
ccagagcccugaaagcuaa

SEQ ID NO: 360427 - RNA, 19 nt, Homo sapiens
ccagagaauucuuagauug

SEQ ID NO: 360428 - RNA, 19 nt, Homo sapiens
gcaaauuccuagucacaau

SEQ ID NO: 360429 - RNA, 19 nt, Homo sapiens
cacuaaaucucuucaauga

SEQ ID NO: 360430 - RNA, 19 nt, Homo sapiens
aguagcagcugccugauua

SEQ ID NO: 360431 - RNA, 19 nt, Homo sapiens
gaaagcuaauggagaaguu

SEQ ID NO: 360432 - RNA, 19 nt, Homo sapiens
caauaacccuggauggaaa

SEQ ID NO: 360433 - RNA, 19 nt, Homo sapiens
caggaucuguacaauaaua

SEQ ID NO: 360434 - RNA, 19 nt, Homo sapiens
ccaaauugcuccuaagcuu

SEQ ID NO: 360435 - RNA, 19 nt, Homo sapiens
agaaacagaucuugaaauc

SEQ ID NO: 360436 - RNA, 19 nt, Homo sapiens
gucaaaagcuggauuauuu

SEQ ID NO: 360437 - RNA, 19 nt, Homo sapiens
caaugguacuugcaagaua

SEQ ID NO: 360438 - RNA, 19 nt, Homo sapiens
gaccagaugugcaggagaa

SEQ ID NO: 360439 - RNA, 19 nt, Homo sapiens
ccacugaguuugcuguuug

SEQ ID NO: 360440 - RNA, 19 nt, Homo sapiens
cuaaaucucuucaaugauc

SEQ ID NO: 360441 - RNA, 19 nt, Homo sapiens
ucaccuggaugaucacuaa

SEQ ID NO: 360442 - RNA, 19 nt, Homo sapiens
gaagcaaacccaaaucuca

SEQ ID NO: 360443 - RNA, 19 nt, Homo sapiens
gcauacaauuccaaaguug

SEQ ID NO: 360444 - RNA, 19 nt, Homo sapiens
aaacacaucuuuccugucu

SEQ ID NO: 360445 - RNA, 19 nt, Homo sapiens
uaaagacucugaagacagu

SEQ ID NO: 360446 - RNA, 19 nt, Homo sapiens
gauaugggcugaacaacag

SEQ ID NO: 360447 - RNA, 19 nt, Homo sapiens
ggagaaaccaagagaaguu

SEQ ID NO: 360448 - RNA, 19 nt, Homo sapiens
ccugaaagcuaauggagaa

SEQ ID NO: 360449 - RNA, 19 nt, Homo sapiens
gagcgugccugagaagaaa

SEQ ID NO: 360450 - RNA, 19 nt, Homo sapiens
gauggugaauagucgauuu

SEQ ID NO: 360451 - RNA, 19 nt, Homo sapiens
gcagcugccugauuagaug

SEQ ID NO: 360452 - RNA, 19 nt, Homo sapiens
ccugggauaucaauuaauu

SEQ ID NO: 360453 - RNA, 19 nt, Homo sapiens
aaaccugggauaucaauua

SEQ ID NO: 360454 - RNA, 19 nt, Homo sapiens
ccagaaggcuuuugaauau

SEQ ID NO: 360455 - RNA, 19 nt, Homo sapiens
ucuccuaucuugcuucuuu

SEQ ID NO: 360456 - RNA, 19 nt, Homo sapiens
gagcugggcuaugaccuuu

SEQ ID NO: 360457 - RNA, 19 nt, Homo sapiens
gaauggagcaggcuugaug

SEQ ID NO: 360458 - RNA, 19 nt, Homo sapiens
gauaugaucccacaaacga

SEQ ID NO: 360459 - RNA, 19 nt, Homo sapiens
uaagguaauucauggcauu

SEQ ID NO: 360460 - RNA, 19 nt, Homo sapiens
ucaauaugcuuacaaaguc

SEQ ID NO: 360461 - RNA, 19 nt, Homo sapiens
ccaacuguguucauuagaa

SEQ ID NO: 360462 - RNA, 19 nt, Homo sapiens
gaaauauucaugcuucuuc

SEQ ID NO: 360463 - RNA, 19 nt, Homo sapiens
gcacuaaaucucuucaaug

SEQ ID NO: 360464 - RNA, 19 nt, Homo sapiens
ccgaggagcugggcuauga

SEQ ID NO: 360465 - RNA, 19 nt, Homo sapiens
gaaaggccaauaaagaguu

SEQ ID NO: 360466 - RNA, 19 nt, Homo sapiens
gcagagcaaugcccguaau

SEQ ID NO: 360467 - RNA, 19 nt, Homo sapiens
ugaguuugcuuauguaauc

SEQ ID NO: 360468 - RNA, 19 nt, Homo sapiens
auggagaccuaauguaaua

SEQ ID NO: 360469 - RNA, 19 nt, Homo sapiens
cagaauugaucauagguau

SEQ ID NO: 360470 - RNA, 19 nt, Homo sapiens
gaacugggacuucaugucu

SEQ ID NO: 360471 - RNA, 19 nt, Homo sapiens
aaaggcaauuugucaauga

SEQ ID NO: 360472 - RNA, 19 nt, Homo sapiens
aaaggccaauaaagaguua

SEQ ID NO: 360473 - RNA, 19 nt, Homo sapiens
gaaucacucuguccuugga

SEQ ID NO: 360474 - RNA, 19 nt, Homo sapiens
ccaugugguucuucaaauu

SEQ ID NO: 360475 - RNA, 19 nt, Homo sapiens
gaagcagccucguguguac

SEQ ID NO: 360476 - RNA, 19 nt, Homo sapiens
cuaagggacucagcacuaa

SEQ ID NO: 360477 - RNA, 19 nt, Homo sapiens
aaagaacacuagagucugu

SEQ ID NO: 360478 - RNA, 19 nt, Homo sapiens
ggacccaucuuugcucaug

SEQ ID NO: 360479 - RNA, 19 nt, Homo sapiens
ggaggagcgugccugagaa

SEQ ID NO: 360480 - RNA, 19 nt, Homo sapiens
ucaaugaucccauguggaa

SEQ ID NO: 360481 - RNA, 19 nt, Homo sapiens
caacauguagcugaguuua

SEQ ID NO: 360482 - RNA, 19 nt, Homo sapiens
cgggauacaucuccuaaug

SEQ ID NO: 360483 - RNA, 19 nt, Homo sapiens
ucaagucccuggagcaugu

SEQ ID NO: 360484 - RNA, 19 nt, Homo sapiens
ccuaauggcuuuaagaacu

SEQ ID NO: 360485 - RNA, 19 nt, Homo sapiens
cuggacacguggauauuua

SEQ ID NO: 360486 - RNA, 19 nt, Homo sapiens
gcuggaccuucaugugaua

SEQ ID NO: 360487 - RNA, 19 nt, Homo sapiens
gaccagagaauucuuagau

SEQ ID NO: 360488 - RNA, 19 nt, Homo sapiens
guacuuggacuuugagaau

SEQ ID NO: 360489 - RNA, 19 nt, Homo sapiens
ccuggagcauguacaauuu

SEQ ID NO: 360490 - RNA, 19 nt, Homo sapiens
gagaagaaagaguguguug

SEQ ID NO: 360491 - RNA, 19 nt, Homo sapiens
agaaagaaguaaacguuca

SEQ ID NO: 360492 - RNA, 19 nt, Homo sapiens
uaacauguguggucuuggu

SEQ ID NO: 360493 - RNA, 19 nt, Homo sapiens
gcgaauguguacaaagugu

SEQ ID NO: 360494 - RNA, 19 nt, Homo sapiens
cugcacaagugaaguguuu

SEQ ID NO: 360495 - RNA, 19 nt, Homo sapiens
gaagagggguggagaagau

SEQ ID NO: 360496 - RNA, 19 nt, Homo sapiens
gaauagucgauuuggauuu

SEQ ID NO: 360497 - RNA, 19 nt, Homo sapiens
gagcaggcuugauggugaa

SEQ ID NO: 360498 - RNA, 19 nt, Homo sapiens
gcaaaggaguuguuaucac

SEQ ID NO: 360499 - RNA, 19 nt, Homo sapiens
ugaugaugaucgugugaua

SEQ ID NO: 360500 - RNA, 19 nt, Homo sapiens
caaccuggaguauaauauu

SEQ ID NO: 360501 - RNA, 19 nt, Homo sapiens
caaagucuccagucaccua

SEQ ID NO: 360502 - RNA, 19 nt, Homo sapiens
gaaggagucagaaacuguu

SEQ ID NO: 360503 - RNA, 19 nt, Homo sapiens
gcucuuacacuacauuaga

SEQ ID NO: 360504 - RNA, 19 nt, Homo sapiens
gaaauuccaacaagagcuu

SEQ ID NO: 360505 - RNA, 19 nt, Homo sapiens
ggagaaguuaucauugaaa

SEQ ID NO: 360506 - RNA, 19 nt, Homo sapiens
aagaaagaguguguuguaa

SEQ ID NO: 360507 - RNA, 19 nt, Homo sapiens
ccacacuggccaccucuua

SEQ ID NO: 360508 - RNA, 19 nt, Homo sapiens
gggcugaacaacaguauga

SEQ ID NO: 360509 - RNA, 19 nt, Homo sapiens
cuacccgcaucuucuguua

SEQ ID NO: 360510 - RNA, 19 nt, Homo sapiens
cauuagagcccauuucaau

SEQ ID NO: 360511 - RNA, 19 nt, Homo sapiens
ggacaaagagggauuauga

SEQ ID NO: 360512 - RNA, 19 nt, Homo sapiens
ggaacuaggucucagcuuu

SEQ ID NO: 360513 - RNA, 19 nt, Homo sapiens
gugcagagcuguaguauca

SEQ ID NO: 360514 - RNA, 19 nt, Homo sapiens
gaggagaccuggccaucua

SEQ ID NO: 360515 - RNA, 19 nt, Homo sapiens
ccuguagacuuauagauua

SEQ ID NO: 360516 - RNA, 19 nt, Homo sapiens
gaagauggacgguauuuca

SEQ ID NO: 360517 - RNA, 19 nt, Homo sapiens
gcagugagguuggcuguga

SEQ ID NO: 360518 - RNA, 19 nt, Homo sapiens
gauacucccucucagcuaa

SEQ ID NO: 360519 - RNA, 19 nt, Homo sapiens
gcagagggacccacaguuu

SEQ ID NO: 360520 - RNA, 19 nt, Homo sapiens
cugcaaauauggauacuuu

SEQ ID NO: 360521 - RNA, 19 nt, Homo sapiens
caagacauguacugaauuc

SEQ ID NO: 360522 - RNA, 19 nt, Homo sapiens
aaagagggauuaugacuuc

SEQ ID NO: 360523 - RNA, 19 nt, Homo sapiens
uaccauagcaggacgauua

SEQ ID NO: 360524 - RNA, 19 nt, Homo sapiens
ggagagacguacagcaugu

SEQ ID NO: 360525 - RNA, 19 nt, Homo sapiens
ccagguaaauugaaagaau

SEQ ID NO: 360526 - RNA, 19 nt, Homo sapiens
gcagugcgcuccaucuaca

SEQ ID NO: 360527 - RNA, 19 nt, Homo sapiens
gaacgcuaaugacuggaaa

SEQ ID NO: 360528 - RNA, 19 nt, Homo sapiens
guacugaauuccauaacug

SEQ ID NO: 360529 - RNA, 19 nt, Homo sapiens
gauacuuucugaaugaaga

SEQ ID NO: 360530 - RNA, 19 nt, Homo sapiens
ggacaugguugaagcaaaa

SEQ ID NO: 360531 - RNA, 19 nt, Homo sapiens
ccaacaggcuauuugauca

SEQ ID NO: 360532 - RNA, 19 nt, Homo sapiens
gcagaaagcggaaagaaac

SEQ ID NO: 360533 - RNA, 19 nt, Homo sapiens
ccacugcaaugacuguuug

SEQ ID NO: 360534 - RNA, 19 nt, Homo sapiens
gcacagaccgacaaaucaa

SEQ ID NO: 360535 - RNA, 19 nt, Homo sapiens
gagcacagaccgacaaauc

SEQ ID NO: 360536 - RNA, 19 nt, Homo sapiens
guacggauucaucaacaua

SEQ ID NO: 360537 - RNA, 19 nt, Homo sapiens
ugacaugaauaucgaagga

SEQ ID NO: 360538 - RNA, 19 nt, Homo sapiens
guggguaucucuuagacuu

SEQ ID NO: 360539 - RNA, 19 nt, Homo sapiens
gaccacugcuccugugaug

SEQ ID NO: 360540 - RNA, 19 nt, Homo sapiens
gcaaggaugcaacggaaga

SEQ ID NO: 360541 - RNA, 19 nt, Homo sapiens
gcacagagggcuacuucau

SEQ ID NO: 360542 - RNA, 19 nt, Homo sapiens
gcuucaggcugcucggaua

SEQ ID NO: 360543 - RNA, 19 nt, Homo sapiens
gcugaugggugcauuaacu

SEQ ID NO: 360544 - RNA, 19 nt, Homo sapiens
gaccagaccacugcaauga

SEQ ID NO: 360545 - RNA, 19 nt, Homo sapiens
uguacaagcugcccuagug

SEQ ID NO: 360546 - RNA, 19 nt, Homo sapiens
gcaaauauggauacuuucu

SEQ ID NO: 360547 - RNA, 19 nt, Homo sapiens
aagaagcgcugcaggaagu

SEQ ID NO: 360548 - RNA, 19 nt, Homo sapiens
cauauucaccaaccaauga

SEQ ID NO: 360549 - RNA, 19 nt, Homo sapiens
cagguaaauugaaagaaug

SEQ ID NO: 360550 - RNA, 19 nt, Homo sapiens
cccagcacgugcacauuua

SEQ ID NO: 360551 - RNA, 19 nt, Homo sapiens
cgaaggagccuggaagaga

SEQ ID NO: 360552 - RNA, 19 nt, Homo sapiens
gcaagacauguacugaauu

SEQ ID NO: 360553 - RNA, 19 nt, Homo sapiens
gcgcaggccggagaaguua

SEQ ID NO: 360554 - RNA, 19 nt, Homo sapiens
ccauaacuguacagaaugu

SEQ ID NO: 360555 - RNA, 19 nt, Homo sapiens
gcggaaagaaaccuuggua

SEQ ID NO: 360556 - RNA, 19 nt, Homo sapiens
gauccaacagcaaguggua

SEQ ID NO: 360557 - RNA, 19 nt, Homo sapiens
uuccauaacuguacagaau

SEQ ID NO: 360558 - RNA, 19 nt, Homo sapiens
ggaguccuacgauaagaaa

SEQ ID NO: 360559 - RNA, 19 nt, Homo sapiens
gaaagaaaccuugguaccu

SEQ ID NO: 360560 - RNA, 19 nt, Homo sapiens
caaagagggauuaugacuu

SEQ ID NO: 360561 - RNA, 19 nt, Homo sapiens
uuaggaaugugucaaaugg

SEQ ID NO: 360562 - RNA, 19 nt, Homo sapiens
gagcugaugggugcauuaa

SEQ ID NO: 360563 - RNA, 19 nt, Homo sapiens
ucaagacaauccgcccuaa

SEQ ID NO: 360564 - RNA, 19 nt, Homo sapiens
gagagaacccauccagauc

SEQ ID NO: 360565 - RNA, 19 nt, Homo sapiens
aaccaaagguggaauggau

SEQ ID NO: 360566 - RNA, 19 nt, Homo sapiens
ggagagcacagaccgacaa

SEQ ID NO: 360567 - RNA, 19 nt, Homo sapiens
ggacuacuaccacuucuac

SEQ ID NO: 360568 - RNA, 19 nt, Homo sapiens
gagaacccauccagaucug

SEQ ID NO: 360569 - RNA, 19 nt, Homo sapiens
gacccacaguuucauuuca

SEQ ID NO: 360570 - RNA, 19 nt, Homo sapiens
ugcaagacauguacugaau

SEQ ID NO: 360571 - RNA, 19 nt, Homo sapiens
caacugugaguccugcuuu

SEQ ID NO: 360572 - RNA, 19 nt, Homo sapiens
caaccgccaugucaacuac

SEQ ID NO: 360573 - RNA, 19 nt, Homo sapiens
gaagccaauccguuucuga

SEQ ID NO: 360574 - RNA, 19 nt, Homo sapiens
ugagagaacccauccagau

SEQ ID NO: 360575 - RNA, 19 nt, Homo sapiens
ugugauaucaguuguuuga

SEQ ID NO: 360576 - RNA, 19 nt, Homo sapiens
guuacucacugcccugaug

SEQ ID NO: 360577 - RNA, 19 nt, Homo sapiens
caucaacauaggacagaua

SEQ ID NO: 360578 - RNA, 19 nt, Homo sapiens
cagcuaaggaacuuuaaga

SEQ ID NO: 360579 - RNA, 19 nt, Homo sapiens
gcaaguacggauucaucaa

SEQ ID NO: 360580 - RNA, 19 nt, Homo sapiens
acgaugcucuggcaaguug

SEQ ID NO: 360581 - RNA, 19 nt, Homo sapiens
gaauguagggauggguuaa

SEQ ID NO: 360582 - RNA, 19 nt, Homo sapiens
gacauguacugaauuccau

SEQ ID NO: 360583 - RNA, 19 nt, Homo sapiens
uauggauacuuucugaaug

SEQ ID NO: 360584 - RNA, 19 nt, Homo sapiens
gggaguucaugaccauuca

SEQ ID NO: 360585 - RNA, 19 nt, Homo sapiens
gaacuaggucucagcuuuu

SEQ ID NO: 360586 - RNA, 19 nt, Homo sapiens
cuuuguuccuguagacuua

SEQ ID NO: 360587 - RNA, 19 nt, Homo sapiens
ggagcugaugggugcauua

SEQ ID NO: 360588 - RNA, 19 nt, Homo sapiens
ugccggaaaugcagugaaa

SEQ ID NO: 360589 - RNA, 19 nt, Homo sapiens
auggauacuuucugaauga

SEQ ID NO: 360590 - RNA, 19 nt, Homo sapiens
uaaggugagccaucuuuau

SEQ ID NO: 360591 - RNA, 19 nt, Homo sapiens
uacuaccacuucuaccaua

SEQ ID NO: 360592 - RNA, 19 nt, Homo sapiens
ucucuuagacuuaggaaug

SEQ ID NO: 360593 - RNA, 19 nt, Homo sapiens
ggugcucugucuccuguga

SEQ ID NO: 360594 - RNA, 19 nt, Homo sapiens
ggaccagaccacugcaaug

SEQ ID NO: 360595 - RNA, 19 nt, Homo sapiens
uaagacuccagguaaauug

SEQ ID NO: 360596 - RNA, 19 nt, Homo sapiens
cgggacauuugaacgcuaa

SEQ ID NO: 360597 - RNA, 19 nt, Homo sapiens
guacagcauguuauuguca

SEQ ID NO: 360598 - RNA, 19 nt, Homo sapiens
agacguacagcauguuauu

SEQ ID NO: 360599 - RNA, 19 nt, Homo sapiens
gcacagucggaauugcuuu

SEQ ID NO: 360600 - RNA, 19 nt, Homo sapiens
gaacauuguggucacuauc

SEQ ID NO: 360601 - RNA, 19 nt, Homo sapiens
ggaauggauccaacagcaa

SEQ ID NO: 360602 - RNA, 19 nt, Homo sapiens
acuggguccuugaaguuua

SEQ ID NO: 360603 - RNA, 19 nt, Homo sapiens
ugacuggguccuugaaguu

SEQ ID NO: 360604 - RNA, 19 nt, Homo sapiens
gaaagcggaaagaaaccuu

SEQ ID NO: 360605 - RNA, 19 nt, Homo sapiens
cccaaugccucguuaugau

SEQ ID NO: 360606 - RNA, 19 nt, Homo sapiens
ccagaccacugcaaugacu

SEQ ID NO: 360607 - RNA, 19 nt, Homo sapiens
gacuccagguaaauugaaa

SEQ ID NO: 360608 - RNA, 19 nt, Homo sapiens
ccuggaagccaauccguuu

SEQ ID NO: 360609 - RNA, 19 nt, Homo sapiens
cagucuaccuauuucaaug

SEQ ID NO: 360610 - RNA, 19 nt, Homo sapiens
gugcagccauauucaccaa

SEQ ID NO: 360611 - RNA, 19 nt, Homo sapiens
ggacaaagcucgccaaguu

SEQ ID NO: 360612 - RNA, 19 nt, Homo sapiens
gaaagcaacuuaucagcua

SEQ ID NO: 360613 - RNA, 19 nt, Homo sapiens
uaagagaaauggcaaguuu

SEQ ID NO: 360614 - RNA, 19 nt, Homo sapiens
guacacagaugacugguuu

SEQ ID NO: 360615 - RNA, 19 nt, Homo sapiens
gcacauccauucccaagaa

SEQ ID NO: 360616 - RNA, 19 nt, Homo sapiens
ggaauuuaaucaccucuuu

SEQ ID NO: 360617 - RNA, 19 nt, Homo sapiens
ucacauaguucuccaguug

SEQ ID NO: 360618 - RNA, 19 nt, Homo sapiens
uuaggaggcucaacaauaa

SEQ ID NO: 360619 - RNA, 19 nt, Homo sapiens
gaggagaccugaacaucaa

SEQ ID NO: 360620 - RNA, 19 nt, Homo sapiens
cgaggcagcugguguguuu

SEQ ID NO: 360621 - RNA, 19 nt, Homo sapiens
caacuuaucagcuacuuaa

SEQ ID NO: 360622 - RNA, 19 nt, Homo sapiens
ggauuucugucuucucuaa

SEQ ID NO: 360623 - RNA, 19 nt, Homo sapiens
gggcuuugauuuccaagua

SEQ ID NO: 360624 - RNA, 19 nt, Homo sapiens
gaccuggccuccaacuaua

SEQ ID NO: 360625 - RNA, 19 nt, Homo sapiens
ggaaagguguuaccauugg

SEQ ID NO: 360626 - RNA, 19 nt, Homo sapiens
gauccuaacugaagagaca

SEQ ID NO: 360627 - RNA, 19 nt, Homo sapiens
ucaaugagaucgacaucaa

SEQ ID NO: 360628 - RNA, 19 nt, Homo sapiens
aaauaugucucgcuaguga

SEQ ID NO: 360629 - RNA, 19 nt, Homo sapiens
uaccagggauguagauuaa

SEQ ID NO: 360630 - RNA, 19 nt, Homo sapiens
ggugugguguaauuuauaa

SEQ ID NO: 360631 - RNA, 19 nt, Homo sapiens
ugaagaaacagauaccaua

SEQ ID NO: 360632 - RNA, 19 nt, Homo sapiens
acaaagcagugguaucuga

SEQ ID NO: 360633 - RNA, 19 nt, Homo sapiens
ggauguagauuaaggugau

SEQ ID NO: 360634 - RNA, 19 nt, Homo sapiens
aagaggagcuggaggaaga

SEQ ID NO: 360635 - RNA, 19 nt, Homo sapiens
ggacgaagccguggagaga

SEQ ID NO: 360636 - RNA, 19 nt, Homo sapiens
gguguuaccauuggaauua

SEQ ID NO: 360637 - RNA, 19 nt, Homo sapiens
agauuaaggugaugugauu

SEQ ID NO: 360638 - RNA, 19 nt, Homo sapiens
gagacacugugcuauaaau

SEQ ID NO: 360639 - RNA, 19 nt, Homo sapiens
ggaccuggccuccaacuau

SEQ ID NO: 360640 - RNA, 19 nt, Homo sapiens
acagauaccauacucauuu

SEQ ID NO: 360641 - RNA, 19 nt, Homo sapiens
caaacaagaaugucccuuu

SEQ ID NO: 360642 - RNA, 19 nt, Homo sapiens
ucauagagagcccuaguua

SEQ ID NO: 360643 - RNA, 19 nt, Homo sapiens
ggagcgauguuuugaauuu

SEQ ID NO: 360644 - RNA, 19 nt, Homo sapiens
acagaugacugguuuaaca

SEQ ID NO: 360645 - RNA, 19 nt, Homo sapiens
cugaagagacaguuauuua

SEQ ID NO: 360646 - RNA, 19 nt, Homo sapiens
cuugugaccuucucuauau

SEQ ID NO: 360647 - RNA, 19 nt, Homo sapiens
aaagugaccuacccagaga

SEQ ID NO: 360648 - RNA, 19 nt, Homo sapiens
ugaaggaggugagagaaga

SEQ ID NO: 360649 - RNA, 19 nt, Homo sapiens
cgagcgcuaucuucacaua

SEQ ID NO: 360650 - RNA, 19 nt, Homo sapiens
gaccugaacaucaacauga

SEQ ID NO: 360651 - RNA, 19 nt, Homo sapiens
ggagaacacacacugauuc

SEQ ID NO: 360652 - RNA, 19 nt, Homo sapiens
gaaagguguuaccauugga

SEQ ID NO: 360653 - RNA, 19 nt, Homo sapiens
gugcauguguguauaagug

SEQ ID NO: 360654 - RNA, 19 nt, Homo sapiens
gaccuacacucgcucuuuc

SEQ ID NO: 360655 - RNA, 19 nt, Homo sapiens
gcaccuagcaauuccauca

SEQ ID NO: 360656 - RNA, 19 nt, Homo sapiens
gggauuaccaguccaaguu

SEQ ID NO: 360657 - RNA, 19 nt, Homo sapiens
ggaaggauuugaccgaaaa

SEQ ID NO: 360658 - RNA, 19 nt, Homo sapiens
ucauuaauguguugggaaa

SEQ ID NO: 360659 - RNA, 19 nt, Homo sapiens
agacaagccuggcaacaca

SEQ ID NO: 360660 - RNA, 19 nt, Homo sapiens
caauaucuguggaguugga

SEQ ID NO: 360661 - RNA, 19 nt, Homo sapiens
aacaauaucuguggaguug

SEQ ID NO: 360662 - RNA, 19 nt, Homo sapiens
acaaggggcuguuacauaa

SEQ ID NO: 360663 - RNA, 19 nt, Homo sapiens
acagagacaucaaugagau

SEQ ID NO: 360664 - RNA, 19 nt, Homo sapiens
gaagaaacagauaccauac

SEQ ID NO: 360665 - RNA, 19 nt, Homo sapiens
acauaguucuccaguugua

SEQ ID NO: 360666 - RNA, 19 nt, Homo sapiens
caagauaauucacucuacu

SEQ ID NO: 360667 - RNA, 19 nt, Homo sapiens
aaagcauccuuaacaagaa

SEQ ID NO: 360668 - RNA, 19 nt, Homo sapiens
ugacugugcucaccuccaa

SEQ ID NO: 360669 - RNA, 19 nt, Homo sapiens
gcaacgaccccuauccuua

SEQ ID NO: 360670 - RNA, 19 nt, Homo sapiens
gcagugguaucugaucaau

SEQ ID NO: 360671 - RNA, 19 nt, Homo sapiens
gaaauggcaaguuuugaua

SEQ ID NO: 360672 - RNA, 19 nt, Homo sapiens
caggagacacugugcuaua

SEQ ID NO: 360673 - RNA, 19 nt, Homo sapiens
gugugacucuaaauucuuu

SEQ ID NO: 360674 - RNA, 19 nt, Homo sapiens
caacuauaaugccgaagca

SEQ ID NO: 360675 - RNA, 19 nt, Homo sapiens
agggaaagguguuaccauu

SEQ ID NO: 360676 - RNA, 19 nt, Homo sapiens
uaaauuaggaggcucaaca

SEQ ID NO: 360677 - RNA, 19 nt, Homo sapiens
ucagcucucuguauaaaca

SEQ ID NO: 360678 - RNA, 19 nt, Homo sapiens
ucuaacaccuugugaccuu

SEQ ID NO: 360679 - RNA, 19 nt, Homo sapiens
ucacauagcuacccaaaag

SEQ ID NO: 360680 - RNA, 19 nt, Homo sapiens
caacaugacuuccccuaug

SEQ ID NO: 360681 - RNA, 19 nt, Homo sapiens
gcaaguuggugcugacacu

SEQ ID NO: 360682 - RNA, 19 nt, Homo sapiens
gggucggccuggaauuuaa

SEQ ID NO: 360683 - RNA, 19 nt, Homo sapiens
gacccgaugugcaggagaa

SEQ ID NO: 360684 - RNA, 19 nt, Homo sapiens
gcuagagcagcccaaauuu

SEQ ID NO: 360685 - RNA, 19 nt, Homo sapiens
aggagacacugugcuauaa

SEQ ID NO: 360686 - RNA, 19 nt, Homo sapiens
gaaagaggagcuggaggaa

SEQ ID NO: 360687 - RNA, 19 nt, Homo sapiens
gacaaguggccuuucauga

SEQ ID NO: 360688 - RNA, 19 nt, Homo sapiens
gagaucgacaucaacauga

SEQ ID NO: 360689 - RNA, 19 nt, Homo sapiens
gauaccauacucauuucua

SEQ ID NO: 360690 - RNA, 19 nt, Homo sapiens
aaacaagaaugucccuuuu

SEQ ID NO: 360691 - RNA, 19 nt, Homo sapiens
ggagacacugugcuauaaa

SEQ ID NO: 360692 - RNA, 19 nt, Homo sapiens
acacacagcuccccacauu

SEQ ID NO: 360693 - RNA, 19 nt, Homo sapiens
gcacuccuggccuugauuu

SEQ ID NO: 360694 - RNA, 19 nt, Homo sapiens
cgaccggucuucacgaauc

SEQ ID NO: 360695 - RNA, 19 nt, Homo sapiens
caggugugguguaauuuau

SEQ ID NO: 360696 - RNA, 19 nt, Homo sapiens
ugcaucaccucuguaauuu

SEQ ID NO: 360697 - RNA, 19 nt, Homo sapiens
caacuagacauuaccaaag

SEQ ID NO: 360698 - RNA, 19 nt, Homo sapiens
ccaacuagacauuaccaaa

SEQ ID NO: 360699 - RNA, 19 nt, Homo sapiens
gaaagcacacagucaccuu

SEQ ID NO: 360700 - RNA, 19 nt, Homo sapiens
caagagagggccaugcaau

SEQ ID NO: 360701 - RNA, 19 nt, Homo sapiens
ggacagcuuuccccucauu

SEQ ID NO: 360702 - RNA, 19 nt, Homo sapiens
agaaacagauaccauacuc

SEQ ID NO: 360703 - RNA, 19 nt, Homo sapiens
caugagugcuggauauuuu

SEQ ID NO: 360704 - RNA, 19 nt, Homo sapiens
gcaugagugcuggauauuu

SEQ ID NO: 360705 - RNA, 19 nt, Homo sapiens
aaauauagcguucccaaca

SEQ ID NO: 360706 - RNA, 19 nt, Homo sapiens
gaauuuaaucaccucuuug

SEQ ID NO: 360707 - RNA, 19 nt, Homo sapiens
caacaugaacgauccucuu

SEQ ID NO: 360708 - RNA, 19 nt, Homo sapiens
gcaacuuaucagcuacuua

SEQ ID NO: 360709 - RNA, 19 nt, Homo sapiens
ugucuuauauagcagcaaa

SEQ ID NO: 360710 - RNA, 19 nt, Homo sapiens
cagauaccauacucauuuc

SEQ ID NO: 360711 - RNA, 19 nt, Homo sapiens
uaacaaagcucucaucacu

SEQ ID NO: 360712 - RNA, 19 nt, Homo sapiens
gacaaugccuugagucuga

SEQ ID NO: 360713 - RNA, 19 nt, Homo sapiens
acaaggaccugaagcagua

SEQ ID NO: 360714 - RNA, 19 nt, Homo sapiens
ucaccaagcuguugcaguu

SEQ ID NO: 360715 - RNA, 19 nt, Homo sapiens
uaaaggagauucagcuaca

SEQ ID NO: 360716 - RNA, 19 nt, Homo sapiens
ccaagucaaucccaacaaa

SEQ ID NO: 360717 - RNA, 19 nt, Homo sapiens
caugaaacauccauucuuc

SEQ ID NO: 360718 - RNA, 19 nt, Homo sapiens
caacaaagacauacuccaa

SEQ ID NO: 360719 - RNA, 19 nt, Homo sapiens
aaagcaagcucacagacaa

SEQ ID NO: 360720 - RNA, 19 nt, Homo sapiens
ggacuacuccacucagauu

SEQ ID NO: 360721 - RNA, 19 nt, Homo sapiens
ccacucagauugacaugug

SEQ ID NO: 360722 - RNA, 19 nt, Homo sapiens
gagaagcugacccucaaua

SEQ ID NO: 360723 - RNA, 19 nt, Homo sapiens
acaaagacauacuccaaug

SEQ ID NO: 360724 - RNA, 19 nt, Homo sapiens
caacaagcgccuaucacua

SEQ ID NO: 360725 - RNA, 19 nt, Homo sapiens
acgaggaguucaagacaua

SEQ ID NO: 360726 - RNA, 19 nt, Homo sapiens
gaggugcagucuccaguga

SEQ ID NO: 360727 - RNA, 19 nt, Homo sapiens
cagacaagauggugacaau

SEQ ID NO: 360728 - RNA, 19 nt, Homo sapiens
ccaaugagguggugacacu

SEQ ID NO: 360729 - RNA, 19 nt, Homo sapiens
caacaugcacaacgugaaa

SEQ ID NO: 360730 - RNA, 19 nt, Homo sapiens
aaacuggagaccuacauua

SEQ ID NO: 360731 - RNA, 19 nt, Homo sapiens
gagcggauccacaaacuuc

SEQ ID NO: 360732 - RNA, 19 nt, Homo sapiens
gaaacuggagaccuacauu

SEQ ID NO: 360733 - RNA, 19 nt, Homo sapiens
gagauuggcuuugggaaac

SEQ ID NO: 360734 - RNA, 19 nt, Homo sapiens
guuccugaaugcaccauaa

SEQ ID NO: 360735 - RNA, 19 nt, Homo sapiens
gaucucgacucagacaaga

SEQ ID NO: 360736 - RNA, 19 nt, Homo sapiens
gaacagcuacacuucaucu

SEQ ID NO: 360737 - RNA, 19 nt, Homo sapiens
acauuaagcuggacaaacu

SEQ ID NO: 360738 - RNA, 19 nt, Homo sapiens
ccaccugccucauauugug

SEQ ID NO: 360739 - RNA, 19 nt, Homo sapiens
caaagacauacuccaauga

SEQ ID NO: 360740 - RNA, 19 nt, Homo sapiens
ccacugaggacaucaacaa

SEQ ID NO: 360741 - RNA, 19 nt, Homo sapiens
ucucaucacuccuucacuu

SEQ ID NO: 360742 - RNA, 19 nt, Homo sapiens
gaucagacuggaacaugaa

SEQ ID NO: 360743 - RNA, 19 nt, Homo sapiens
aaacggcagcugucaauga

SEQ ID NO: 360744 - RNA, 19 nt, Homo sapiens
caucuucccugcuuacucu

SEQ ID NO: 360745 - RNA, 19 nt, Homo sapiens
caaacacgccaacaucguu

SEQ ID NO: 360746 - RNA, 19 nt, Homo sapiens
uggagaagcugacccucaa

SEQ ID NO: 360747 - RNA, 19 nt, Homo sapiens
gcacgaggacuugaagaug

SEQ ID NO: 360748 - RNA, 19 nt, Homo sapiens
ggaggaacagcuacacuuc

SEQ ID NO: 360749 - RNA, 19 nt, Homo sapiens
aaacacgccaacaucguua

SEQ ID NO: 360750 - RNA, 19 nt, Homo sapiens
gcacaacgugaaacuguuc

SEQ ID NO: 360751 - RNA, 19 nt, Homo sapiens
uugaguaccuggacaagga

SEQ ID NO: 360752 - RNA, 19 nt, Homo sapiens
cacgcaagaucuccacuga

SEQ ID NO: 360753 - RNA, 19 nt, Homo sapiens
cgcagaggaugccaugaaa

SEQ ID NO: 360754 - RNA, 19 nt, Homo sapiens
ccaagcuguugcaguuuga

SEQ ID NO: 360755 - RNA, 19 nt, Homo sapiens
aaccauggcugaagacuac

SEQ ID NO: 360756 - RNA, 19 nt, Homo sapiens
agaagucccucacccuugu

SEQ ID NO: 360757 - RNA, 19 nt, Homo sapiens
gcauagacaagaccaaugg

SEQ ID NO: 360758 - RNA, 19 nt, Homo sapiens
caucuuccguaucuuagga

SEQ ID NO: 360759 - RNA, 19 nt, Homo sapiens
ggugugggcugcaucuucu

SEQ ID NO: 360760 - RNA, 19 nt, Homo sapiens
caacaucguuacgcuacau

SEQ ID NO: 360761 - RNA, 19 nt, Homo sapiens
gcucccagccuuucagaga

SEQ ID NO: 360762 - RNA, 19 nt, Homo sapiens
ccauggaucggaugaagaa

SEQ ID NO: 360763 - RNA, 19 nt, Homo sapiens
cccagaaccugcucaucaa

SEQ ID NO: 360764 - RNA, 19 nt, Homo sapiens
caacgaggaguucaagaca

SEQ ID NO: 360765 - RNA, 19 nt, Homo sapiens
gaucuccacugaggacauc

SEQ ID NO: 360766 - RNA, 19 nt, Homo sapiens
cuucaucuuccguaucuua

SEQ ID NO: 360767 - RNA, 19 nt, Homo sapiens
ggcugcaucuucuaugaga

SEQ ID NO: 360768 - RNA, 19 nt, Homo sapiens
ggaacaucaucaacaugca

SEQ ID NO: 360769 - RNA, 19 nt, Homo sapiens
agaucagacuggaacauga

SEQ ID NO: 360770 - RNA, 19 nt, Homo sapiens
gagaucagacuggaacaug

SEQ ID NO: 360771 - RNA, 19 nt, Homo sapiens
uugggaaacuggagaccua

SEQ ID NO: 360772 - RNA, 19 nt, Homo sapiens
gcgaacaggaggagaagga

SEQ ID NO: 360773 - RNA, 19 nt, Homo sapiens
gggauuggcuaugggaaag

SEQ ID NO: 360774 - RNA, 19 nt, Homo sapiens
ugcaauaucucuguauaca

SEQ ID NO: 360775 - RNA, 19 nt, Homo sapiens
gucugucucugucuuggua

SEQ ID NO: 360776 - RNA, 19 nt, Homo sapiens
gcuaacaaagcucucauca

SEQ ID NO: 360777 - RNA, 19 nt, Homo sapiens
caaccauggcugaagacua

SEQ ID NO: 360778 - RNA, 19 nt, Homo sapiens
gugggaacaucaucaacau

SEQ ID NO: 360779 - RNA, 19 nt, Homo sapiens
ucaaacggcagcugucaau

SEQ ID NO: 360780 - RNA, 19 nt, Homo sapiens
cagaggaugccaugaaaca

SEQ ID NO: 360781 - RNA, 19 nt, Homo sapiens
gcucaagcuggcugacuuu

SEQ ID NO: 360782 - RNA, 19 nt, Homo sapiens
guaccuaugccaccgucua

SEQ ID NO: 360783 - RNA, 19 nt, Homo sapiens
gaggagccauaaugugcau

SEQ ID NO: 360784 - RNA, 19 nt, Homo sapiens
ggacacagccccuauuugg

SEQ ID NO: 360785 - RNA, 19 nt, Homo sapiens
gcagauaggccuggaugag

SEQ ID NO: 360786 - RNA, 19 nt, Homo sapiens
gaggaacagcuacacuuca

SEQ ID NO: 360787 - RNA, 19 nt, Homo sapiens
gaucaaacggcagcuguca

SEQ ID NO: 360788 - RNA, 19 nt, Homo sapiens
gggagcggauccacaaacu

SEQ ID NO: 360789 - RNA, 19 nt, Homo sapiens
ggaagugucccugcucaag

SEQ ID NO: 360790 - RNA, 19 nt, Homo sapiens
gacaagauggugacaaugc

SEQ ID NO: 360791 - RNA, 19 nt, Homo sapiens
caucaacaagcgccuauca

SEQ ID NO: 360792 - RNA, 19 nt, Homo sapiens
gagcccuccuaguggguuu

SEQ ID NO: 360793 - RNA, 19 nt, Homo sapiens
ggagccauaaugugcauau

SEQ ID NO: 360794 - RNA, 19 nt, Homo sapiens
cagauaggccuggaugaga

SEQ ID NO: 360795 - RNA, 19 nt, Homo sapiens
ccgcagaggaugccaugaa

SEQ ID NO: 360796 - RNA, 19 nt, Homo sapiens
ucacccuugucuuugagua

SEQ ID NO: 360797 - RNA, 19 nt, Homo sapiens
ugagauuggcuuugggaaa

SEQ ID NO: 360798 - RNA, 19 nt, Homo sapiens
uggaucggaugaagaagau

SEQ ID NO: 360799 - RNA, 19 nt, Homo sapiens
gucccuggaugggugguua

SEQ ID NO: 360800 - RNA, 19 nt, Homo sapiens
ucugcugggugcuaacaaa

SEQ ID NO: 360801 - RNA, 19 nt, Homo sapiens
ccaugaaacauccauucuu

SEQ ID NO: 360802 - RNA, 19 nt, Homo sapiens
gcaguuugagggucgaaau

SEQ ID NO: 360803 - RNA, 19 nt, Homo sapiens
guucaagacauacaacuac

SEQ ID NO: 360804 - RNA, 19 nt, Homo sapiens
ugaagcaguaccuggauga

SEQ ID NO: 360805 - RNA, 19 nt, Homo sapiens
cagcgaggagccauaaugu

SEQ ID NO: 360806 - RNA, 19 nt, Homo sapiens
ggaugaagaagaucaaacg

SEQ ID NO: 360807 - RNA, 19 nt, Homo sapiens
gccgugagcacucggauuc

SEQ ID NO: 360808 - RNA, 19 nt, Homo sapiens
aggaacagcuacacuucau

SEQ ID NO: 360809 - RNA, 19 nt, Homo sapiens
ugggcugcaucuucuauga

SEQ ID NO: 360810 - RNA, 19 nt, Homo sapiens
ccucaaacacgccaacauc

SEQ ID NO: 360811 - RNA, 19 nt, Homo sapiens
gaucggaacugaguacuaa

SEQ ID NO: 360812 - RNA, 19 nt, Homo sapiens
uaacaaagcucucaucacu

SEQ ID NO: 360813 - RNA, 19 nt, Homo sapiens
gacaaugccuugagucuga

SEQ ID NO: 360814 - RNA, 19 nt, Homo sapiens
acaaggaccugaagcagua

SEQ ID NO: 360815 - RNA, 19 nt, Homo sapiens
gaacugagugcuucauuug

SEQ ID NO: 360816 - RNA, 19 nt, Homo sapiens
ucaccaagcuguugcaguu

SEQ ID NO: 360817 - RNA, 19 nt, Homo sapiens
uaaaggagauucagcuaca

SEQ ID NO: 360818 - RNA, 19 nt, Homo sapiens
ccaagucaaucccaacaaa

SEQ ID NO: 360819 - RNA, 19 nt, Homo sapiens
caugaaacauccauucuuc

SEQ ID NO: 360820 - RNA, 19 nt, Homo sapiens
caacaaagacauacuccaa

SEQ ID NO: 360821 - RNA, 19 nt, Homo sapiens
gcaaacuucugccaagauc

SEQ ID NO: 360822 - RNA, 19 nt, Homo sapiens
aaagcaagcucacagacaa

SEQ ID NO: 360823 - RNA, 19 nt, Homo sapiens
ggacuacuccacucagauu

SEQ ID NO: 360824 - RNA, 19 nt, Homo sapiens
ccacucagauugacaugug

SEQ ID NO: 360825 - RNA, 19 nt, Homo sapiens
gagaagcugacccucaaua

SEQ ID NO: 360826 - RNA, 19 nt, Homo sapiens
uaaacagccuccacaguuc

SEQ ID NO: 360827 - RNA, 19 nt, Homo sapiens
acaaagacauacuccaaug

SEQ ID NO: 360828 - RNA, 19 nt, Homo sapiens
caacaagcgccuaucacua

SEQ ID NO: 360829 - RNA, 19 nt, Homo sapiens
acgaggaguucaagacaua

SEQ ID NO: 360830 - RNA, 19 nt, Homo sapiens
gaggugcagucuccaguga

SEQ ID NO: 360831 - RNA, 19 nt, Homo sapiens
gggaacgaguggugauuga

SEQ ID NO: 360832 - RNA, 19 nt, Homo sapiens
cagacaagauggugacaau

SEQ ID NO: 360833 - RNA, 19 nt, Homo sapiens
cuaaacagccuccacaguu

SEQ ID NO: 360834 - RNA, 19 nt, Homo sapiens
ccaaugagguggugacacu

SEQ ID NO: 360835 - RNA, 19 nt, Homo sapiens
caacaugcacaacgugaaa

SEQ ID NO: 360836 - RNA, 19 nt, Homo sapiens
aaacuggagaccuacauua

SEQ ID NO: 360837 - RNA, 19 nt, Homo sapiens
agaacugagugcuucauuu

SEQ ID NO: 360838 - RNA, 19 nt, Homo sapiens
gagcggauccacaaacuuc

SEQ ID NO: 360839 - RNA, 19 nt, Homo sapiens
gaaacuggagaccuacauu

SEQ ID NO: 360840 - RNA, 19 nt, Homo sapiens
gagauuggcuuugggaaac

SEQ ID NO: 360841 - RNA, 19 nt, Homo sapiens
guuccugaaugcaccauaa

SEQ ID NO: 360842 - RNA, 19 nt, Homo sapiens
gaucucgacucagacaaga

SEQ ID NO: 360843 - RNA, 19 nt, Homo sapiens
gaacagcuacacuucaucu

SEQ ID NO: 360844 - RNA, 19 nt, Homo sapiens
acauuaagcuggacaaacu

SEQ ID NO: 360845 - RNA, 19 nt, Homo sapiens
ccaccugccucauauugug

SEQ ID NO: 360846 - RNA, 19 nt, Homo sapiens
caaagacauacuccaauga

SEQ ID NO: 360847 - RNA, 19 nt, Homo sapiens
ccacugaggacaucaacaa

SEQ ID NO: 360848 - RNA, 19 nt, Homo sapiens
ucucaucacuccuucacuu

SEQ ID NO: 360849 - RNA, 19 nt, Homo sapiens
gaucagacuggaacaugaa

SEQ ID NO: 360850 - RNA, 19 nt, Homo sapiens
aaacggcagcugucaauga

SEQ ID NO: 360851 - RNA, 19 nt, Homo sapiens
caucuucccugcuuacucu

SEQ ID NO: 360852 - RNA, 19 nt, Homo sapiens
caaacacgccaacaucguu

SEQ ID NO: 360853 - RNA, 19 nt, Homo sapiens
uggagaagcugacccucaa

SEQ ID NO: 360854 - RNA, 19 nt, Homo sapiens
ggacuagaacugagugcuu

SEQ ID NO: 360855 - RNA, 19 nt, Homo sapiens
gcacgaggacuugaagaug

SEQ ID NO: 360856 - RNA, 19 nt, Homo sapiens
ggaggaacagcuacacuuc

SEQ ID NO: 360857 - RNA, 19 nt, Homo sapiens
gguaaaggccaauaacucu

SEQ ID NO: 360858 - RNA, 19 nt, Homo sapiens
aaacacgccaacaucguua

SEQ ID NO: 360859 - RNA, 19 nt, Homo sapiens
cguccuagcuaagguggua

SEQ ID NO: 360860 - RNA, 19 nt, Homo sapiens
gcacaacgugaaacuguuc

SEQ ID NO: 360861 - RNA, 19 nt, Homo sapiens
uugaguaccuggacaagga

SEQ ID NO: 360862 - RNA, 19 nt, Homo sapiens
cacgcaagaucuccacuga

SEQ ID NO: 360863 - RNA, 19 nt, Homo sapiens
cgcagaggaugccaugaaa

SEQ ID NO: 360864 - RNA, 19 nt, Homo sapiens
ccaagcuguugcaguuuga

SEQ ID NO: 360865 - RNA, 19 nt, Homo sapiens
agaagucccucacccuugu

SEQ ID NO: 360866 - RNA, 19 nt, Homo sapiens
caucuuccguaucuuagga

SEQ ID NO: 360867 - RNA, 19 nt, Homo sapiens
ggugugggcugcaucuucu

SEQ ID NO: 360868 - RNA, 19 nt, Homo sapiens
caacaucguuacgcuacau

SEQ ID NO: 360869 - RNA, 19 nt, Homo sapiens
gcauagacaagaccaaugg

SEQ ID NO: 360870 - RNA, 19 nt, Homo sapiens
gcucccagccuuucagaga

SEQ ID NO: 360871 - RNA, 19 nt, Homo sapiens
cccagaaccugcucaucaa

SEQ ID NO: 360872 - RNA, 19 nt, Homo sapiens
ccauggaucggaugaagaa

SEQ ID NO: 360873 - RNA, 19 nt, Homo sapiens
caacgaggaguucaagaca

SEQ ID NO: 360874 - RNA, 19 nt, Homo sapiens
gcaccucaagggacuagaa

SEQ ID NO: 360875 - RNA, 19 nt, Homo sapiens
gaucuccacugaggacauc

SEQ ID NO: 360876 - RNA, 19 nt, Homo sapiens
uagcaaacuucugccaaga

SEQ ID NO: 360877 - RNA, 19 nt, Homo sapiens
caucuucucgcgaaccuuu

SEQ ID NO: 360878 - RNA, 19 nt, Homo sapiens
cuucaucuuccguaucuua

SEQ ID NO: 360879 - RNA, 19 nt, Homo sapiens
ggcugcaucuucuaugaga

SEQ ID NO: 360880 - RNA, 19 nt, Homo sapiens
ggaacaucaucaacaugca

SEQ ID NO: 360881 - RNA, 19 nt, Homo sapiens
agaucagacuggaacauga

SEQ ID NO: 360882 - RNA, 19 nt, Homo sapiens
gagaucagacuggaacaug

SEQ ID NO: 360883 - RNA, 19 nt, Homo sapiens
uugggaaacuggagaccua

SEQ ID NO: 360884 - RNA, 19 nt, Homo sapiens
ggaacugaguacuaaacag

SEQ ID NO: 360885 - RNA, 19 nt, Homo sapiens
ugauugacgcgccagguua

SEQ ID NO: 360886 - RNA, 19 nt, Homo sapiens
gggauuggcuaugggaaag

SEQ ID NO: 360887 - RNA, 19 nt, Homo sapiens
ugcaauaucucuguauaca

SEQ ID NO: 360888 - RNA, 19 nt, Homo sapiens
gucugucucugucuuggua

SEQ ID NO: 360889 - RNA, 19 nt, Homo sapiens
gcuaacaaagcucucauca

SEQ ID NO: 360890 - RNA, 19 nt, Homo sapiens
gugggaacaucaucaacau

SEQ ID NO: 360891 - RNA, 19 nt, Homo sapiens
cagaggaugccaugaaaca

SEQ ID NO: 360892 - RNA, 19 nt, Homo sapiens
gcucaagcuggcugacuuu

SEQ ID NO: 360893 - RNA, 19 nt, Homo sapiens
guaccuaugccaccgucua

SEQ ID NO: 360894 - RNA, 19 nt, Homo sapiens
uaaaggccaauaacucuuc

SEQ ID NO: 360895 - RNA, 19 nt, Homo sapiens
ucaaacggcagcugucaau

SEQ ID NO: 360896 - RNA, 19 nt, Homo sapiens
gaggagccauaaugugcau

SEQ ID NO: 360897 - RNA, 19 nt, Homo sapiens
ggacacagccccuauuugg

SEQ ID NO: 360898 - RNA, 19 nt, Homo sapiens
gaggaacagcuacacuuca

SEQ ID NO: 360899 - RNA, 19 nt, Homo sapiens
gcagauaggccuggaugag

SEQ ID NO: 360900 - RNA, 19 nt, Homo sapiens
gaucaaacggcagcuguca

SEQ ID NO: 360901 - RNA, 19 nt, Homo sapiens
gggagcggauccacaaacu

SEQ ID NO: 360902 - RNA, 19 nt, Homo sapiens
guaaaggccaauaacucuu

SEQ ID NO: 360903 - RNA, 19 nt, Homo sapiens
ggaagugucccugcucaag

SEQ ID NO: 360904 - RNA, 19 nt, Homo sapiens
gacaagauggugacaaugc

SEQ ID NO: 360905 - RNA, 19 nt, Homo sapiens
caucaacaagcgccuauca

SEQ ID NO: 360906 - RNA, 19 nt, Homo sapiens
gccaagaucggaacugagu

SEQ ID NO: 360907 - RNA, 19 nt, Homo sapiens
gagcccuccuaguggguuu

SEQ ID NO: 360908 - RNA, 19 nt, Homo sapiens
ggagccauaaugugcauau

SEQ ID NO: 360909 - RNA, 19 nt, Homo sapiens
ccgcagaggaugccaugaa

SEQ ID NO: 360910 - RNA, 19 nt, Homo sapiens
ucacccuugucuuugagua

SEQ ID NO: 360911 - RNA, 19 nt, Homo sapiens
uaacaaagcucucaucacu

SEQ ID NO: 360912 - RNA, 19 nt, Homo sapiens
gacaaugccuugagucuga

SEQ ID NO: 360913 - RNA, 19 nt, Homo sapiens
acaaggaccugaagcagua

SEQ ID NO: 360914 - RNA, 19 nt, Homo sapiens
ucaccaagcuguugcaguu

SEQ ID NO: 360915 - RNA, 19 nt, Homo sapiens
uaaaggagauucagcuaca

SEQ ID NO: 360916 - RNA, 19 nt, Homo sapiens
ccaagucaaucccaacaaa

SEQ ID NO: 360917 - RNA, 19 nt, Homo sapiens
caugaaacauccauucuuc

SEQ ID NO: 360918 - RNA, 19 nt, Homo sapiens
caacaaagacauacuccaa

SEQ ID NO: 360919 - RNA, 19 nt, Homo sapiens
aaagcaagcucacagacaa

SEQ ID NO: 360920 - RNA, 19 nt, Homo sapiens
ggacuacuccacucagauu

SEQ ID NO: 360921 - RNA, 19 nt, Homo sapiens
ccacucagauugacaugug

SEQ ID NO: 360922 - RNA, 19 nt, Homo sapiens
gagaagcugacccucaaua

SEQ ID NO: 360923 - RNA, 19 nt, Homo sapiens
acaaagacauacuccaaug

SEQ ID NO: 360924 - RNA, 19 nt, Homo sapiens
caacaagcgccuaucacua

SEQ ID NO: 360925 - RNA, 19 nt, Homo sapiens
acgaggaguucaagacaua

SEQ ID NO: 360926 - RNA, 19 nt, Homo sapiens
gaggugcagucuccaguga

SEQ ID NO: 360927 - RNA, 19 nt, Homo sapiens
cagacaagauggugacaau

SEQ ID NO: 360928 - RNA, 19 nt, Homo sapiens
ccaaugagguggugacacu

SEQ ID NO: 360929 - RNA, 19 nt, Homo sapiens
caacaugcacaacgugaaa

SEQ ID NO: 360930 - RNA, 19 nt, Homo sapiens
aaacuggagaccuacauua

SEQ ID NO: 360931 - RNA, 19 nt, Homo sapiens
gagcggauccacaaacuuc

SEQ ID NO: 360932 - RNA, 19 nt, Homo sapiens
gaaacuggagaccuacauu

SEQ ID NO: 360933 - RNA, 19 nt, Homo sapiens
gagauuggcuuugggaaac

SEQ ID NO: 360934 - RNA, 19 nt, Homo sapiens
guuccugaaugcaccauaa

SEQ ID NO: 360935 - RNA, 19 nt, Homo sapiens
gaucucgacucagacaaga

SEQ ID NO: 360936 - RNA, 19 nt, Homo sapiens
gaacagcuacacuucaucu

SEQ ID NO: 360937 - RNA, 19 nt, Homo sapiens
acauuaagcuggacaaacu

SEQ ID NO: 360938 - RNA, 19 nt, Homo sapiens
ccaccugccucauauugug

SEQ ID NO: 360939 - RNA, 19 nt, Homo sapiens
caaagacauacuccaauga

SEQ ID NO: 360940 - RNA, 19 nt, Homo sapiens
ccacugaggacaucaacaa

SEQ ID NO: 360941 - RNA, 19 nt, Homo sapiens
ucucaucacuccuucacuu

SEQ ID NO: 360942 - RNA, 19 nt, Homo sapiens
gaucagacuggaacaugaa

SEQ ID NO: 360943 - RNA, 19 nt, Homo sapiens
aaacggcagcugucaauga

SEQ ID NO: 360944 - RNA, 19 nt, Homo sapiens
caucuucccugcuuacucu

SEQ ID NO: 360945 - RNA, 19 nt, Homo sapiens
caaacacgccaacaucguu

SEQ ID NO: 360946 - RNA, 19 nt, Homo sapiens
uggagaagcugacccucaa

SEQ ID NO: 360947 - RNA, 19 nt, Homo sapiens
gcacgaggacuugaagaug

SEQ ID NO: 360948 - RNA, 19 nt, Homo sapiens
ggaggaacagcuacacuuc

SEQ ID NO: 360949 - RNA, 19 nt, Homo sapiens
aaacacgccaacaucguua

SEQ ID NO: 360950 - RNA, 19 nt, Homo sapiens
gcacaacgugaaacuguuc

SEQ ID NO: 360951 - RNA, 19 nt, Homo sapiens
uugaguaccuggacaagga

SEQ ID NO: 360952 - RNA, 19 nt, Homo sapiens
cacgcaagaucuccacuga

SEQ ID NO: 360953 - RNA, 19 nt, Homo sapiens
cgcagaggaugccaugaaa

SEQ ID NO: 360954 - RNA, 19 nt, Homo sapiens
ccaagcuguugcaguuuga

SEQ ID NO: 360955 - RNA, 19 nt, Homo sapiens
aaccauggcugaagacuac

SEQ ID NO: 360956 - RNA, 19 nt, Homo sapiens
agaagucccucacccuugu

SEQ ID NO: 360957 - RNA, 19 nt, Homo sapiens
caucuuccguaucuuagga

SEQ ID NO: 360958 - RNA, 19 nt, Homo sapiens
ggugugggcugcaucuucu

SEQ ID NO: 360959 - RNA, 19 nt, Homo sapiens
caacaucguuacgcuacau

SEQ ID NO: 360960 - RNA, 19 nt, Homo sapiens
gcucccagccuuucagaga

SEQ ID NO: 360961 - RNA, 19 nt, Homo sapiens
ccauggaucggaugaagaa

SEQ ID NO: 360962 - RNA, 19 nt, Homo sapiens
cccagaaccugcucaucaa

SEQ ID NO: 360963 - RNA, 19 nt, Homo sapiens
caacgaggaguucaagaca

SEQ ID NO: 360964 - RNA, 19 nt, Homo sapiens
gaucuccacugaggacauc

SEQ ID NO: 360965 - RNA, 19 nt, Homo sapiens
cuucaucuuccguaucuua

SEQ ID NO: 360966 - RNA, 19 nt, Homo sapiens
ggcugcaucuucuaugaga

SEQ ID NO: 360967 - RNA, 19 nt, Homo sapiens
gcgaacaggaggagaagga

SEQ ID NO: 360968 - RNA, 19 nt, Homo sapiens
ggaacaucaucaacaugca

SEQ ID NO: 360969 - RNA, 19 nt, Homo sapiens
agaucagacuggaacauga

SEQ ID NO: 360970 - RNA, 19 nt, Homo sapiens
gagaucagacuggaacaug

SEQ ID NO: 360971 - RNA, 19 nt, Homo sapiens
uugggaaacuggagaccua

SEQ ID NO: 360972 - RNA, 19 nt, Homo sapiens
gggauuggcuaugggaaag

SEQ ID NO: 360973 - RNA, 19 nt, Homo sapiens
ugcaauaucucuguauaca

SEQ ID NO: 360974 - RNA, 19 nt, Homo sapiens
gucugucucugucuuggua

SEQ ID NO: 360975 - RNA, 19 nt, Homo sapiens
gcuaacaaagcucucauca

SEQ ID NO: 360976 - RNA, 19 nt, Homo sapiens
caaccauggcugaagacua

SEQ ID NO: 360977 - RNA, 19 nt, Homo sapiens
gugggaacaucaucaacau

SEQ ID NO: 360978 - RNA, 19 nt, Homo sapiens
ucaaacggcagcugucaau

SEQ ID NO: 360979 - RNA, 19 nt, Homo sapiens
cagaggaugccaugaaaca

SEQ ID NO: 360980 - RNA, 19 nt, Homo sapiens
gcucaagcuggcugacuuu

SEQ ID NO: 360981 - RNA, 19 nt, Homo sapiens
guaccuaugccaccgucua

SEQ ID NO: 360982 - RNA, 19 nt, Homo sapiens
gaggagccauaaugugcau

SEQ ID NO: 360983 - RNA, 19 nt, Homo sapiens
ggacacagccccuauuugg

SEQ ID NO: 360984 - RNA, 19 nt, Homo sapiens
gaggaacagcuacacuuca

SEQ ID NO: 360985 - RNA, 19 nt, Homo sapiens
gaucaaacggcagcuguca

SEQ ID NO: 360986 - RNA, 19 nt, Homo sapiens
gggagcggauccacaaacu

SEQ ID NO: 360987 - RNA, 19 nt, Homo sapiens
ggaagugucccugcucaag

SEQ ID NO: 360988 - RNA, 19 nt, Homo sapiens
gacaagauggugacaaugc

SEQ ID NO: 360989 - RNA, 19 nt, Homo sapiens
caucaacaagcgccuauca

SEQ ID NO: 360990 - RNA, 19 nt, Homo sapiens
gagcccuccuaguggguuu

SEQ ID NO: 360991 - RNA, 19 nt, Homo sapiens
ggagccauaaugugcauau

SEQ ID NO: 360992 - RNA, 19 nt, Homo sapiens
ccgcagaggaugccaugaa

SEQ ID NO: 360993 - RNA, 19 nt, Homo sapiens
ucacccuugucuuugagua

SEQ ID NO: 360994 - RNA, 19 nt, Homo sapiens
ugagauuggcuuugggaaa

SEQ ID NO: 360995 - RNA, 19 nt, Homo sapiens
uggaucggaugaagaagau

SEQ ID NO: 360996 - RNA, 19 nt, Homo sapiens
gucccuggaugggugguua

SEQ ID NO: 360997 - RNA, 19 nt, Homo sapiens
ucugcugggugcuaacaaa

SEQ ID NO: 360998 - RNA, 19 nt, Homo sapiens
ccaugaaacauccauucuu

SEQ ID NO: 360999 - RNA, 19 nt, Homo sapiens
gcaguuugagggucgaaau

SEQ ID NO: 361000 - RNA, 19 nt, Homo sapiens
guucaagacauacaacuac

SEQ ID NO: 361001 - RNA, 19 nt, Homo sapiens
ugaagcaguaccuggauga

SEQ ID NO: 361002 - RNA, 19 nt, Homo sapiens
cagcgaggagccauaaugu

SEQ ID NO: 361003 - RNA, 19 nt, Homo sapiens
ggaugaagaagaucaaacg

SEQ ID NO: 361004 - RNA, 19 nt, Homo sapiens
gccgugagcacucggauuc

SEQ ID NO: 361005 - RNA, 19 nt, Homo sapiens
aggaacagcuacacuucau

SEQ ID NO: 361006 - RNA, 19 nt, Homo sapiens
ugggcugcaucuucuauga

SEQ ID NO: 361007 - RNA, 19 nt, Homo sapiens
ccucaaacacgccaacauc

SEQ ID NO: 361008 - RNA, 19 nt, Homo sapiens
ggaaacuggagaccuacau

SEQ ID NO: 361009 - RNA, 19 nt, Homo sapiens
caucacuccuucacuuggu

SEQ ID NO: 361010 - RNA, 19 nt, Homo sapiens
aaaggagauucagcuacaa

SEQ ID NO: 361011 - RNA, 19 nt, Homo sapiens
gaacugaaggcaauuauuu

SEQ ID NO: 361012 - RNA, 19 nt, Homo sapiens
ccacagaaccuccucauua

SEQ ID NO: 361013 - RNA, 19 nt, Homo sapiens
gauaaacaguccaccauuu

SEQ ID NO: 361014 - RNA, 19 nt, Homo sapiens
ggaauugaguugauaagaa

SEQ ID NO: 361015 - RNA, 19 nt, Homo sapiens
ggaagcagauuagauauug

SEQ ID NO: 361016 - RNA, 19 nt, Homo sapiens
cagaauaccugauggauau

SEQ ID NO: 361017 - RNA, 19 nt, Homo sapiens
gaaaggagaauuaaagcua

SEQ ID NO: 361018 - RNA, 19 nt, Homo sapiens
gaaguaaauugacagagaa

SEQ ID NO: 361019 - RNA, 19 nt, Homo sapiens
auaaagaccugaaacagua

SEQ ID NO: 361020 - RNA, 19 nt, Homo sapiens
ugaauuggcugaacaaaug

SEQ ID NO: 361021 - RNA, 19 nt, Homo sapiens
gaucaaccguggaagauga

SEQ ID NO: 361022 - RNA, 19 nt, Homo sapiens
acaaagaccuacucaaaug

SEQ ID NO: 361023 - RNA, 19 nt, Homo sapiens
ccacaaagaccuacucaaa

SEQ ID NO: 361024 - RNA, 19 nt, Homo sapiens
gaagaugaacugcacuuaa

SEQ ID NO: 361025 - RNA, 19 nt, Homo sapiens
cacagaaccuccucauuaa

SEQ ID NO: 361026 - RNA, 19 nt, Homo sapiens
caaaugaggaguucaagaa

SEQ ID NO: 361027 - RNA, 19 nt, Homo sapiens
guacauaugcaacaguaua

SEQ ID NO: 361028 - RNA, 19 nt, Homo sapiens
gaacaaaugacuauugaag

SEQ ID NO: 361029 - RNA, 19 nt, Homo sapiens
ggauuuaaauaagcgguua

SEQ ID NO: 361030 - RNA, 19 nt, Homo sapiens
guuagacucugaaggaauu

SEQ ID NO: 361031 - RNA, 19 nt, Homo sapiens
gauaaauccuugacuuugg

SEQ ID NO: 361032 - RNA, 19 nt, Homo sapiens
gauaaugagccuauuguga

SEQ ID NO: 361033 - RNA, 19 nt, Homo sapiens
ccaagucaguucccacaaa

SEQ ID NO: 361034 - RNA, 19 nt, Homo sapiens
ugacuuugguguuugagua

SEQ ID NO: 361035 - RNA, 19 nt, Homo sapiens
agaaguaaauugacagaga

SEQ ID NO: 361036 - RNA, 19 nt, Homo sapiens
gaaaacagcagcaaggaua

SEQ ID NO: 361037 - RNA, 19 nt, Homo sapiens
gaccaagaauacaugcuuu

SEQ ID NO: 361038 - RNA, 19 nt, Homo sapiens
ugaaggaauugaguugaua

SEQ ID NO: 361039 - RNA, 19 nt, Homo sapiens
ggaacuccaucucaggaaa

SEQ ID NO: 361040 - RNA, 19 nt, Homo sapiens
ggccagguauuucuucaaa

SEQ ID NO: 361041 - RNA, 19 nt, Homo sapiens
caaaugaaguugucacacu

SEQ ID NO: 361042 - RNA, 19 nt, Homo sapiens
guggaaacaucaugaguau

SEQ ID NO: 361043 - RNA, 19 nt, Homo sapiens
gcaacaguauauaaaggaa

SEQ ID NO: 361044 - RNA, 19 nt, Homo sapiens
gaugaacugcacuuaauuu

SEQ ID NO: 361045 - RNA, 19 nt, Homo sapiens
gguauugcaucgagacuug

SEQ ID NO: 361046 - RNA, 19 nt, Homo sapiens
gaucagauggugagaguga

SEQ ID NO: 361047 - RNA, 19 nt, Homo sapiens
aaacauguguacuuucgaa

SEQ ID NO: 361048 - RNA, 19 nt, Homo sapiens
ggaaaccuacaucaaauug

SEQ ID NO: 361049 - RNA, 19 nt, Homo sapiens
ucguagagcuuccuuauca

SEQ ID NO: 361050 - RNA, 19 nt, Homo sapiens
ggaucucaauggaggauuu

SEQ ID NO: 361051 - RNA, 19 nt, Homo sapiens
gaaggaauugaguugauaa

SEQ ID NO: 361052 - RNA, 19 nt, Homo sapiens
aagaugaacugcacuuaau

SEQ ID NO: 361053 - RNA, 19 nt, Homo sapiens
ccagaaaguguaucaauau

SEQ ID NO: 361054 - RNA, 19 nt, Homo sapiens
gauaaagaccugaaacagu

SEQ ID NO: 361055 - RNA, 19 nt, Homo sapiens
ggguacauaugcaacagua

SEQ ID NO: 361056 - RNA, 19 nt, Homo sapiens
gaaagagauucaguugcaa

SEQ ID NO: 361057 - RNA, 19 nt, Homo sapiens
aaaugaaguugucacacua

SEQ ID NO: 361058 - RNA, 19 nt, Homo sapiens
gggaagaacagaagacaga

SEQ ID NO: 361059 - RNA, 19 nt, Homo sapiens
gaaacuuggccagguauuu

SEQ ID NO: 361060 - RNA, 19 nt, Homo sapiens
caggaaacuuggccaggua

SEQ ID NO: 361061 - RNA, 19 nt, Homo sapiens
acguaaagcuguuucugua

SEQ ID NO: 361062 - RNA, 19 nt, Homo sapiens
ggaaacaucaugaguaugc

SEQ ID NO: 361063 - RNA, 19 nt, Homo sapiens
acagauaaauccuugacuu

SEQ ID NO: 361064 - RNA, 19 nt, Homo sapiens
agaauuugguggcauuaaa

SEQ ID NO: 361065 - RNA, 19 nt, Homo sapiens
gcaaugcccagaaauggaa

SEQ ID NO: 361066 - RNA, 19 nt, Homo sapiens
aaaccuacaucaaauugga

SEQ ID NO: 361067 - RNA, 19 nt, Homo sapiens
ggaagaugaacugcacuua

SEQ ID NO: 361068 - RNA, 19 nt, Homo sapiens
gaauuaaagcuagcagauu

SEQ ID NO: 361069 - RNA, 19 nt, Homo sapiens
gcauauugccauagaagaa

SEQ ID NO: 361070 - RNA, 19 nt, Homo sapiens
gcaaggauaaugagccuau

SEQ ID NO: 361071 - RNA, 19 nt, Homo sapiens
aauggaagcagauuagaua

SEQ ID NO: 361072 - RNA, 19 nt, Homo sapiens
ggacaugggaagaacagaa

SEQ ID NO: 361073 - RNA, 19 nt, Homo sapiens
accagaaaguguaucaaua

SEQ ID NO: 361074 - RNA, 19 nt, Homo sapiens
gaagaaguaaauugacaga

SEQ ID NO: 361075 - RNA, 19 nt, Homo sapiens
cugaacaaaugacuauuga

SEQ ID NO: 361076 - RNA, 19 nt, Homo sapiens
cagauaaauccuugacuuu

SEQ ID NO: 361077 - RNA, 19 nt, Homo sapiens
cagagaauuugguggcauu

SEQ ID NO: 361078 - RNA, 19 nt, Homo sapiens
ccugauggauaucuugaaa

SEQ ID NO: 361079 - RNA, 19 nt, Homo sapiens
cugcacagcuauaagagaa

SEQ ID NO: 361080 - RNA, 19 nt, Homo sapiens
ucagaaaucguauacauag

SEQ ID NO: 361081 - RNA, 19 nt, Homo sapiens
gggaucagauggugagagu

SEQ ID NO: 361082 - RNA, 19 nt, Homo sapiens
ggaccaagaauacaugcuu

SEQ ID NO: 361083 - RNA, 19 nt, Homo sapiens
gcacagcuauaagagaagu

SEQ ID NO: 361084 - RNA, 19 nt, Homo sapiens
auacaugcuuuaccagaaa

SEQ ID NO: 361085 - RNA, 19 nt, Homo sapiens
caaagaccuacucaaauga

SEQ ID NO: 361086 - RNA, 19 nt, Homo sapiens
ucucagaaaucguauacau

SEQ ID NO: 361087 - RNA, 19 nt, Homo sapiens
gaugaaguccagucaccua

SEQ ID NO: 361088 - RNA, 19 nt, Homo sapiens
gaagcagauuagauauugu

SEQ ID NO: 361089 - RNA, 19 nt, Homo sapiens
gaacuacaacuuuccaaaa

SEQ ID NO: 361090 - RNA, 19 nt, Homo sapiens
auaaugagccuauugugaa

SEQ ID NO: 361091 - RNA, 19 nt, Homo sapiens
caagucaguucccacaaag

SEQ ID NO: 361092 - RNA, 19 nt, Homo sapiens
ccuccaacgucucacagua

SEQ ID NO: 361093 - RNA, 19 nt, Homo sapiens
gagauccgauuggaacaug

SEQ ID NO: 361094 - RNA, 19 nt, Homo sapiens
aagaauacaugcuuuacca

SEQ ID NO: 361095 - RNA, 19 nt, Homo sapiens
ugagaaaggagaauuaaag

SEQ ID NO: 361096 - RNA, 19 nt, Homo sapiens
cagaaccuccucauuaaug

SEQ ID NO: 361097 - RNA, 19 nt, Homo sapiens
gcugaacaaaugacuauug

SEQ ID NO: 361098 - RNA, 19 nt, Homo sapiens
gagcuuccuuaucagaaau

SEQ ID NO: 361099 - RNA, 19 nt, Homo sapiens
gaaauggaagcagauuaga

SEQ ID NO: 361100 - RNA, 19 nt, Homo sapiens
cagccuuucuuaccaauca

SEQ ID NO: 361101 - RNA, 19 nt, Homo sapiens
gcacaacguaaagcuguuu

SEQ ID NO: 361102 - RNA, 19 nt, Homo sapiens
ugaaacaguacauggauga

SEQ ID NO: 361103 - RNA, 19 nt, Homo sapiens
aauggaaaccuacaucaaa

SEQ ID NO: 361104 - RNA, 19 nt, Homo sapiens
cagaaauggaagcagauua

SEQ ID NO: 361105 - RNA, 19 nt, Homo sapiens
guacacaggaucuuucaag

SEQ ID NO: 361106 - RNA, 19 nt, Homo sapiens
uaaacaguccaccauuuga

SEQ ID NO: 361107 - RNA, 19 nt, Homo sapiens
aauacaugcuuuaccagaa

SEQ ID NO: 361108 - RNA, 19 nt, Homo sapiens
ugacauuguucacacagau

SEQ ID NO: 361109 - RNA, 19 nt, Homo sapiens
aaccuuacaugacauuguu

SEQ ID NO: 361110 - RNA, 19 nt, Homo sapiens
caagccacauucaauugau

SEQ ID NO: 361111 - RNA, 19 nt, Homo sapiens
ggagaggguugacaaagua

SEQ ID NO: 361112 - RNA, 19 nt, Homo sapiens
gaagauggaugcacagugu

SEQ ID NO: 361113 - RNA, 19 nt, Homo sapiens
gcauugaccucauucagaa

SEQ ID NO: 361114 - RNA, 19 nt, Homo sapiens
gcagugaugauguuuauaa

SEQ ID NO: 361115 - RNA, 19 nt, Homo sapiens
ugaaacauaugcugaaaga

SEQ ID NO: 361116 - RNA, 19 nt, Homo sapiens
gaaggagcacugaaacaua

SEQ ID NO: 361117 - RNA, 19 nt, Homo sapiens
gagcgugaguugcaguuaa

SEQ ID NO: 361118 - RNA, 19 nt, Homo sapiens
gaagguaucuccacaucag

SEQ ID NO: 361119 - RNA, 19 nt, Homo sapiens
ggagaagucccgagaauuc

SEQ ID NO: 361120 - RNA, 19 nt, Homo sapiens
gagaauucauuggaaguuu

SEQ ID NO: 361121 - RNA, 19 nt, Homo sapiens
gaggagaagucccgagaau

SEQ ID NO: 361122 - RNA, 19 nt, Homo sapiens
gaacgagaaugagcgcuau

SEQ ID NO: 361123 - RNA, 19 nt, Homo sapiens
gaagaagacuaauguuucc

SEQ ID NO: 361124 - RNA, 19 nt, Homo sapiens
gaagaagccagcagaggaa

SEQ ID NO: 361125 - RNA, 19 nt, Homo sapiens
gcaaaggagcucaauguca

SEQ ID NO: 361126 - RNA, 19 nt, Homo sapiens
gaauugugcgggauuauga

SEQ ID NO: 361127 - RNA, 19 nt, Homo sapiens
caaggaggcaggcauguuu

SEQ ID NO: 361128 - RNA, 19 nt, Homo sapiens
cgaagaaccuuuucccuaa

SEQ ID NO: 361129 - RNA, 19 nt, Homo sapiens
ccuaauacguaccucauug

SEQ ID NO: 361130 - RNA, 19 nt, Homo sapiens
uaaaggagaaagugaaaga

SEQ ID NO: 361131 - RNA, 19 nt, Homo sapiens
ggaugaagaagacuaaugu

SEQ ID NO: 361132 - RNA, 19 nt, Homo sapiens
aaggagcacugaaacauau

SEQ ID NO: 361133 - RNA, 19 nt, Homo sapiens
gugaugauguuuauaagca

SEQ ID NO: 361134 - RNA, 19 nt, Homo sapiens
ugaagaagacuaauguuuc

SEQ ID NO: 361135 - RNA, 19 nt, Homo sapiens
ugaaagauguggaggaaaa

SEQ ID NO: 361136 - RNA, 19 nt, Homo sapiens
ggaaggagcacugaaacau

SEQ ID NO: 361137 - RNA, 19 nt, Homo sapiens
cagcaaaggagcucaaugu

SEQ ID NO: 361138 - RNA, 19 nt, Homo sapiens
uggaugagguggugaggaa

SEQ ID NO: 361139 - RNA, 19 nt, Homo sapiens
aaggacagcuacaaaggaa

SEQ ID NO: 361140 - RNA, 19 nt, Homo sapiens
gacaucaucacccgaauug

SEQ ID NO: 361141 - RNA, 19 nt, Homo sapiens
cagaagguaucuccacauc

SEQ ID NO: 361142 - RNA, 19 nt, Homo sapiens
uuaugccgauggaauauuu

SEQ ID NO: 361143 - RNA, 19 nt, Homo sapiens
cugaugaaauugaaguuga

SEQ ID NO: 361144 - RNA, 19 nt, Homo sapiens
gaggaaaagucaaaagaau

SEQ ID NO: 361145 - RNA, 19 nt, Homo sapiens
caggguaacuauggaagaa

SEQ ID NO: 361146 - RNA, 19 nt, Homo sapiens
uggcagugaugauguuuau

SEQ ID NO: 361147 - RNA, 19 nt, Homo sapiens
cgauggaauauuugacuua

SEQ ID NO: 361148 - RNA, 19 nt, Homo sapiens
ccgaacaccggauugauuu

SEQ ID NO: 361149 - RNA, 19 nt, Homo sapiens
gagaguuuaugccgaugga

SEQ ID NO: 361150 - RNA, 19 nt, Homo sapiens
gaagucccgagaauucauu

SEQ ID NO: 361151 - RNA, 19 nt, Homo sapiens
gcucacacacaacuucaaa

SEQ ID NO: 361152 - RNA, 19 nt, Homo sapiens
ggacagcuacaaaggaaag

SEQ ID NO: 361153 - RNA, 19 nt, Homo sapiens
ggagaaagugaaagaugug

SEQ ID NO: 361154 - RNA, 19 nt, Homo sapiens
gcaggagaggguugacaaa

SEQ ID NO: 361155 - RNA, 19 nt, Homo sapiens
gcaggcauguuugcuccaa

SEQ ID NO: 361156 - RNA, 19 nt, Homo sapiens
caaaguaaaggagaaagug

SEQ ID NO: 361157 - RNA, 19 nt, Homo sapiens
gcgggauuaugauguguau

SEQ ID NO: 361158 - RNA, 19 nt, Homo sapiens
caucaucacccgaauugug

SEQ ID NO: 361159 - RNA, 19 nt, Homo sapiens
acacagaggacagaaggua

SEQ ID NO: 361160 - RNA, 19 nt, Homo sapiens
aggagaaagugaaagaugu

SEQ ID NO: 361161 - RNA, 19 nt, Homo sapiens
cgagaagaaauaccacuug

SEQ ID NO: 361162 - RNA, 19 nt, Homo sapiens
gccgaacaccggauugauu

SEQ ID NO: 361163 - RNA, 19 nt, Homo sapiens
gauauuccuuauucaucug

SEQ ID NO: 361164 - RNA, 19 nt, Homo sapiens
ucagugaggaugaagaaga

SEQ ID NO: 361165 - RNA, 19 nt, Homo sapiens
gaagaaccuuuucccuaau

SEQ ID NO: 361166 - RNA, 19 nt, Homo sapiens
gagcgaccugugagaguuu

SEQ ID NO: 361167 - RNA, 19 nt, Homo sapiens
ugagcgaccugugagaguu

SEQ ID NO: 361168 - RNA, 19 nt, Homo sapiens
uaaggacagcuacaaagga

SEQ ID NO: 361169 - RNA, 19 nt, Homo sapiens
aauguuuccucccuccuuu

SEQ ID NO: 361170 - RNA, 19 nt, Homo sapiens
agugaaagauguggaggaa

SEQ ID NO: 361171 - RNA, 19 nt, Homo sapiens
cccaugaugauauuccuua

SEQ ID NO: 361172 - RNA, 19 nt, Homo sapiens
gagaagucccgagaauuca

SEQ ID NO: 361173 - RNA, 19 nt, Homo sapiens
aaaguaaaggagaaaguga

SEQ ID NO: 361174 - RNA, 19 nt, Homo sapiens
gcacugccgcuacguggau

SEQ ID NO: 361175 - RNA, 19 nt, Homo sapiens
gaugaagaagacuaauguu

SEQ ID NO: 361176 - RNA, 19 nt, Homo sapiens
gagaggguugacaaaguaa

SEQ ID NO: 361177 - RNA, 19 nt, Homo sapiens
uuuauaagcacaucaagga

SEQ ID NO: 361178 - RNA, 19 nt, Homo sapiens
uguagcccaugaugauauu

SEQ ID NO: 361179 - RNA, 19 nt, Homo sapiens
ugauaucagugaggaugaa

SEQ ID NO: 361180 - RNA, 19 nt, Homo sapiens
ggaggagaagucccgagaa

SEQ ID NO: 361181 - RNA, 19 nt, Homo sapiens
ugacaaaguaaaggagaaa

SEQ ID NO: 361182 - RNA, 19 nt, Homo sapiens
gaugagguggugaggaaug

SEQ ID NO: 361183 - RNA, 19 nt, Homo sapiens
cucccuuucugucccauua

SEQ ID NO: 361184 - RNA, 19 nt, Homo sapiens
ugaggaugaagaagacuaa

SEQ ID NO: 361185 - RNA, 19 nt, Homo sapiens
uaucagugaggaugaagaa

SEQ ID NO: 361186 - RNA, 19 nt, Homo sapiens
aggagaggguugacaaagu

SEQ ID NO: 361187 - RNA, 19 nt, Homo sapiens
ggagcgugaguugcaguua

SEQ ID NO: 361188 - RNA, 19 nt, Homo sapiens
ccaugaugauauuccuuau

SEQ ID NO: 361189 - RNA, 19 nt, Homo sapiens
cagccuaugauaucaguga

SEQ ID NO: 361190 - RNA, 19 nt, Homo sapiens
ggaggaaaagucaaaagaa

SEQ ID NO: 361191 - RNA, 19 nt, Homo sapiens
aaagacaacuggggaaaga

SEQ ID NO: 361192 - RNA, 19 nt, Homo sapiens
aagaauuuguucagaaggu

SEQ ID NO: 361193 - RNA, 19 nt, Homo sapiens
gggauuaugauguguaugc

SEQ ID NO: 361194 - RNA, 19 nt, Homo sapiens
gcgcugugcagugggcuua

SEQ ID NO: 361195 - RNA, 19 nt, Homo sapiens
gcugcagccuaugauauca

SEQ ID NO: 361196 - RNA, 19 nt, Homo sapiens
acugaaacauaugcugaaa

SEQ ID NO: 361197 - RNA, 19 nt, Homo sapiens
guaccucauugugggaguu

SEQ ID NO: 361198 - RNA, 19 nt, Homo sapiens
ccgauggaauauuugacuu

SEQ ID NO: 361199 - RNA, 19 nt, Homo sapiens
gaguuuaugccgauggaau

SEQ ID NO: 361200 - RNA, 19 nt, Homo sapiens
ucagcuuuaucaacgagaa

SEQ ID NO: 361201 - RNA, 19 nt, Homo sapiens
agcgugaguugcaguuaaa

SEQ ID NO: 361202 - RNA, 19 nt, Homo sapiens
cgagaauucauuggaaguu

SEQ ID NO: 361203 - RNA, 19 nt, Homo sapiens
ucccgagaauucauuggaa

SEQ ID NO: 361204 - RNA, 19 nt, Homo sapiens
gaugagcucacacacaacu

SEQ ID NO: 361205 - RNA, 19 nt, Homo sapiens
gagcucacacacaacuuca

SEQ ID NO: 361206 - RNA, 19 nt, Homo sapiens
aagaaccuuuucccuaaua

SEQ ID NO: 361207 - RNA, 19 nt, Homo sapiens
cagugaugauguuuauaag

SEQ ID NO: 361208 - RNA, 19 nt, Homo sapiens
gaacaccggauugauuuug

SEQ ID NO: 361209 - RNA, 19 nt, Homo sapiens
cuaaaccuaaggacagcua

SEQ ID NO: 361210 - RNA, 19 nt, Homo sapiens
aaggagaaagugaaagaug

SEQ ID NO: 361211 - RNA, 19 nt, Homo sapiens
gcacagagauccaaacuau

SEQ ID NO: 361212 - RNA, 19 nt, Homo sapiens
agaagaagauguugaauga

SEQ ID NO: 361213 - RNA, 19 nt, Homo sapiens
gcagaauacccuauaguua

SEQ ID NO: 361214 - RNA, 19 nt, Homo sapiens
gauauggguuuguguauga

SEQ ID NO: 361215 - RNA, 19 nt, Homo sapiens
gaacuaauccauaaagaga

SEQ ID NO: 361216 - RNA, 19 nt, Homo sapiens
cuacacugcucaucuauaa

SEQ ID NO: 361217 - RNA, 19 nt, Homo sapiens
gcagaaagaugagcauuca

SEQ ID NO: 361218 - RNA, 19 nt, Homo sapiens
ccaaaggaguaauaaauga

SEQ ID NO: 361219 - RNA, 19 nt, Homo sapiens
gcacggcuaugcuaacuug

SEQ ID NO: 361220 - RNA, 19 nt, Homo sapiens
acagagauccaaacuauua

SEQ ID NO: 361221 - RNA, 19 nt, Homo sapiens
cagaauacccuauaguuaa

SEQ ID NO: 361222 - RNA, 19 nt, Homo sapiens
ccucaucacuguuauuauu

SEQ ID NO: 361223 - RNA, 19 nt, Homo sapiens
acaguuugcugaagaauuu

SEQ ID NO: 361224 - RNA, 19 nt, Homo sapiens
gaacgagucagcagaaaga

SEQ ID NO: 361225 - RNA, 19 nt, Homo sapiens
gguaguaucuauauugcuu

SEQ ID NO: 361226 - RNA, 19 nt, Homo sapiens
gaagaucaccacaauuguu

SEQ ID NO: 361227 - RNA, 19 nt, Homo sapiens
gaugaaaacugccuucgua

SEQ ID NO: 361228 - RNA, 19 nt, Homo sapiens
uggcaaagauucaaaggaa

SEQ ID NO: 361229 - RNA, 19 nt, Homo sapiens
gauguggagucuuuccuaa

SEQ ID NO: 361230 - RNA, 19 nt, Homo sapiens
ucaagacagugauucaauu

SEQ ID NO: 361231 - RNA, 19 nt, Homo sapiens
ggaggaagacuuugaagga

SEQ ID NO: 361232 - RNA, 19 nt, Homo sapiens
gaggauguggauaauauua

SEQ ID NO: 361233 - RNA, 19 nt, Homo sapiens
acaaagaggauguggauaa

SEQ ID NO: 361234 - RNA, 19 nt, Homo sapiens
aagaggauguggauaauau

SEQ ID NO: 361235 - RNA, 19 nt, Homo sapiens
caaagaggauguggauaau

SEQ ID NO: 361236 - RNA, 19 nt, Homo sapiens
guacauguccuagagcaua

SEQ ID NO: 361237 - RNA, 19 nt, Homo sapiens
gcuggaaacuggaaagcaa

SEQ ID NO: 361238 - RNA, 19 nt, Homo sapiens
gaaagcaauuccuagaaac

SEQ ID NO: 361239 - RNA, 19 nt, Homo sapiens
gaacugaagaucaccacaa

SEQ ID NO: 361240 - RNA, 19 nt, Homo sapiens
gaaggacaggccacacaua

SEQ ID NO: 361241 - RNA, 19 nt, Homo sapiens
auacaaugcuugacuacaa

SEQ ID NO: 361242 - RNA, 19 nt, Homo sapiens
gacaguguaugcaggauau

SEQ ID NO: 361243 - RNA, 19 nt, Homo sapiens
gaaagaugagcauucaaga

SEQ ID NO: 361244 - RNA, 19 nt, Homo sapiens
gaagauucacuaugucaau

SEQ ID NO: 361245 - RNA, 19 nt, Homo sapiens
uaucaaauccagucccuaa

SEQ ID NO: 361246 - RNA, 19 nt, Homo sapiens
aagaagauguugaaugaag

SEQ ID NO: 361247 - RNA, 19 nt, Homo sapiens
uaaauaccguagacagugu

SEQ ID NO: 361248 - RNA, 19 nt, Homo sapiens
gaguaggaauggcaaagau

SEQ ID NO: 361249 - RNA, 19 nt, Homo sapiens
cgagucagcagaaagauga

SEQ ID NO: 361250 - RNA, 19 nt, Homo sapiens
ucagcaacauuauuaguag

SEQ ID NO: 361251 - RNA, 19 nt, Homo sapiens
gcaacaaucgaguuauuag

SEQ ID NO: 361252 - RNA, 19 nt, Homo sapiens
caaaugucuucuccucaga

SEQ ID NO: 361253 - RNA, 19 nt, Homo sapiens
gcagcagaauacccuauag

SEQ ID NO: 361254 - RNA, 19 nt, Homo sapiens
caaucgaguuauuagcauu

SEQ ID NO: 361255 - RNA, 19 nt, Homo sapiens
uacaaugcuugacuacaaa

SEQ ID NO: 361256 - RNA, 19 nt, Homo sapiens
gguauuggaugaugguuuu

SEQ ID NO: 361257 - RNA, 19 nt, Homo sapiens
cugaagaucaccacaauug

SEQ ID NO: 361258 - RNA, 19 nt, Homo sapiens
aaacugccuucguaaauac

SEQ ID NO: 361259 - RNA, 19 nt, Homo sapiens
gaaaacugccuucguaaau

SEQ ID NO: 361260 - RNA, 19 nt, Homo sapiens
agaagaagaagauguugaa

SEQ ID NO: 361261 - RNA, 19 nt, Homo sapiens
ugaacaguuugcugaagaa

SEQ ID NO: 361262 - RNA, 19 nt, Homo sapiens
gugaugcucuaaacaguag

SEQ ID NO: 361263 - RNA, 19 nt, Homo sapiens
gaaaaggaacugaagauca

SEQ ID NO: 361264 - RNA, 19 nt, Homo sapiens
ggacccaaaggaguaauaa

SEQ ID NO: 361265 - RNA, 19 nt, Homo sapiens
ccuaaaugaauauggguua

SEQ ID NO: 361266 - RNA, 19 nt, Homo sapiens
uggagucuuuccuaaauga

SEQ ID NO: 361267 - RNA, 19 nt, Homo sapiens
uguggagucuuuccuaaau

SEQ ID NO: 361268 - RNA, 19 nt, Homo sapiens
agaauacccuauaguuaag

SEQ ID NO: 361269 - RNA, 19 nt, Homo sapiens
agaagauguugaaugaaga

SEQ ID NO: 361270 - RNA, 19 nt, Homo sapiens
gaugaugguuuugguagua

SEQ ID NO: 361271 - RNA, 19 nt, Homo sapiens
gggaacucauaagcaauuu

SEQ ID NO: 361272 - RNA, 19 nt, Homo sapiens
aaaacugccuucguaaaua

SEQ ID NO: 361273 - RNA, 19 nt, Homo sapiens
ggacaggccacacauacag

SEQ ID NO: 361274 - RNA, 19 nt, Homo sapiens
ggauguggagucuuuccua

SEQ ID NO: 361275 - RNA, 19 nt, Homo sapiens
cugaacaguuugcugaaga

SEQ ID NO: 361276 - RNA, 19 nt, Homo sapiens
gguauuaaggguugugaug

SEQ ID NO: 361277 - RNA, 19 nt, Homo sapiens
caagacagugauucaauuc

SEQ ID NO: 361278 - RNA, 19 nt, Homo sapiens
cagcaacauuauuaguaga

SEQ ID NO: 361279 - RNA, 19 nt, Homo sapiens
gcuaugcuaacuugacaaa

SEQ ID NO: 361280 - RNA, 19 nt, Homo sapiens
gaagauguugaaugaagau

SEQ ID NO: 361281 - RNA, 19 nt, Homo sapiens
gaagaagauguugaaugaa

SEQ ID NO: 361282 - RNA, 19 nt, Homo sapiens
ugaaagagagguacauguc

SEQ ID NO: 361283 - RNA, 19 nt, Homo sapiens
cuagauauggguuugugua

SEQ ID NO: 361284 - RNA, 19 nt, Homo sapiens
auaaagagaaagaggauga

SEQ ID NO: 361285 - RNA, 19 nt, Homo sapiens
aaagaugagcauucaagaa

SEQ ID NO: 361286 - RNA, 19 nt, Homo sapiens
uaaggguugugaugcucua

SEQ ID NO: 361287 - RNA, 19 nt, Homo sapiens
ucacauuuaugaagauggu

SEQ ID NO: 361288 - RNA, 19 nt, Homo sapiens
agacaaagaggauguggau

SEQ ID NO: 361289 - RNA, 19 nt, Homo sapiens
gcaacauuauuaguagaca

SEQ ID NO: 361290 - RNA, 19 nt, Homo sapiens
augcaacaaucgaguuauu

SEQ ID NO: 361291 - RNA, 19 nt, Homo sapiens
gucuucagcaacauuauua

SEQ ID NO: 361292 - RNA, 19 nt, Homo sapiens
cuauauugcuuuagugaac

SEQ ID NO: 361293 - RNA, 19 nt, Homo sapiens
agagguacauguccuagag

SEQ ID NO: 361294 - RNA, 19 nt, Homo sapiens
gggccuagauauggguuug

SEQ ID NO: 361295 - RNA, 19 nt, Homo sapiens
ugaugcaacaaucgaguua

SEQ ID NO: 361296 - RNA, 19 nt, Homo sapiens
gauucacuaugucaauauc

SEQ ID NO: 361297 - RNA, 19 nt, Homo sapiens
ucaauuccaccuagcaaga

SEQ ID NO: 361298 - RNA, 19 nt, Homo sapiens
aaagaggauguggauaaua

SEQ ID NO: 361299 - RNA, 19 nt, Homo sapiens
uugauacaaugcuugacua

SEQ ID NO: 361300 - RNA, 19 nt, Homo sapiens
gaagaagaagauguugaau

SEQ ID NO: 361301 - RNA, 19 nt, Homo sapiens
gagagucaagacagugauu

SEQ ID NO: 361302 - RNA, 19 nt, Homo sapiens
uacaggacccaaaggagua

SEQ ID NO: 361303 - RNA, 19 nt, Homo sapiens
aagaagaagauguugaaug

SEQ ID NO: 361304 - RNA, 19 nt, Homo sapiens
caaauccagucccuaaaau

SEQ ID NO: 361305 - RNA, 19 nt, Homo sapiens
agacagugauucaauucca

SEQ ID NO: 361306 - RNA, 19 nt, Homo sapiens
guuuauccuuuagguauug

SEQ ID NO: 361307 - RNA, 19 nt, Homo sapiens
uaaauuagagagucaagac

SEQ ID NO: 361308 - RNA, 19 nt, Homo sapiens
cccaaaggaguaauaaaug

SEQ ID NO: 361309 - RNA, 19 nt, Homo sapiens
guggagucuuuccuaaaug

SEQ ID NO: 361310 - RNA, 19 nt, Homo sapiens
uagaagaagaagauguuga

SEQ ID NO: 361311 - RNA, 19 nt, Homo sapiens
agaagaagauguugaauga

SEQ ID NO: 361312 - RNA, 19 nt, Homo sapiens
gcagaauacccuauaguua

SEQ ID NO: 361313 - RNA, 19 nt, Homo sapiens
gauauggguuuguguauga

SEQ ID NO: 361314 - RNA, 19 nt, Homo sapiens
gaacuaauccauaaagaga

SEQ ID NO: 361315 - RNA, 19 nt, Homo sapiens
cuacacugcucaucuauaa

SEQ ID NO: 361316 - RNA, 19 nt, Homo sapiens
gcagaaagaugagcauuca

SEQ ID NO: 361317 - RNA, 19 nt, Homo sapiens
ccaaaggaguaauaaauga

SEQ ID NO: 361318 - RNA, 19 nt, Homo sapiens
gaaaucucaugaggaaaua

SEQ ID NO: 361319 - RNA, 19 nt, Homo sapiens
gcacggcuaugcuaacuug

SEQ ID NO: 361320 - RNA, 19 nt, Homo sapiens
cagaauacccuauaguuaa

SEQ ID NO: 361321 - RNA, 19 nt, Homo sapiens
ccucaucacuguuauuauu

SEQ ID NO: 361322 - RNA, 19 nt, Homo sapiens
acaguuugcugaagaauuu

SEQ ID NO: 361323 - RNA, 19 nt, Homo sapiens
gaacgagucagcagaaaga

SEQ ID NO: 361324 - RNA, 19 nt, Homo sapiens
gguaguaucuauauugcuu

SEQ ID NO: 361325 - RNA, 19 nt, Homo sapiens
gaagaucaccacaauuguu

SEQ ID NO: 361326 - RNA, 19 nt, Homo sapiens
gaugaaaacugccuucgua

SEQ ID NO: 361327 - RNA, 19 nt, Homo sapiens
uggcaaagauucaaaggaa

SEQ ID NO: 361328 - RNA, 19 nt, Homo sapiens
gauguggagucuuuccuaa

SEQ ID NO: 361329 - RNA, 19 nt, Homo sapiens
ucaagacagugauucaauu

SEQ ID NO: 361330 - RNA, 19 nt, Homo sapiens
gaggauguggauaauauua

SEQ ID NO: 361331 - RNA, 19 nt, Homo sapiens
acaaagaggauguggauaa

SEQ ID NO: 361332 - RNA, 19 nt, Homo sapiens
aagaggauguggauaauau

SEQ ID NO: 361333 - RNA, 19 nt, Homo sapiens
caaagaggauguggauaau

SEQ ID NO: 361334 - RNA, 19 nt, Homo sapiens
guacauguccuagagcaua

SEQ ID NO: 361335 - RNA, 19 nt, Homo sapiens
gcuggaaacuggaaagcaa

SEQ ID NO: 361336 - RNA, 19 nt, Homo sapiens
gaaagcaauuccuagaaac

SEQ ID NO: 361337 - RNA, 19 nt, Homo sapiens
gaacugaagaucaccacaa

SEQ ID NO: 361338 - RNA, 19 nt, Homo sapiens
auacaaugcuugacuacaa

SEQ ID NO: 361339 - RNA, 19 nt, Homo sapiens
gacaguguaugcaggauau

SEQ ID NO: 361340 - RNA, 19 nt, Homo sapiens
gaaagaugagcauucaaga

SEQ ID NO: 361341 - RNA, 19 nt, Homo sapiens
gaagauucacuaugucaau

SEQ ID NO: 361342 - RNA, 19 nt, Homo sapiens
aagaagauguugaaugaag

SEQ ID NO: 361343 - RNA, 19 nt, Homo sapiens
uaaauaccguagacagugu

SEQ ID NO: 361344 - RNA, 19 nt, Homo sapiens
gaguaggaauggcaaagau

SEQ ID NO: 361345 - RNA, 19 nt, Homo sapiens
cgagucagcagaaagauga

SEQ ID NO: 361346 - RNA, 19 nt, Homo sapiens
ucagcaacauuauuaguag

SEQ ID NO: 361347 - RNA, 19 nt, Homo sapiens
gcaacaaucgaguuauuag

SEQ ID NO: 361348 - RNA, 19 nt, Homo sapiens
caaaugucuucuccucaga

SEQ ID NO: 361349 - RNA, 19 nt, Homo sapiens
gcagcagaauacccuauag

SEQ ID NO: 361350 - RNA, 19 nt, Homo sapiens
ugaaaucucaugaggaaau

SEQ ID NO: 361351 - RNA, 19 nt, Homo sapiens
caaucgaguuauuagcauu

SEQ ID NO: 361352 - RNA, 19 nt, Homo sapiens
uacaaugcuugacuacaaa

SEQ ID NO: 361353 - RNA, 19 nt, Homo sapiens
gguauuggaugaugguuuu

SEQ ID NO: 361354 - RNA, 19 nt, Homo sapiens
cugaagaucaccacaauug

SEQ ID NO: 361355 - RNA, 19 nt, Homo sapiens
aaacugccuucguaaauac

SEQ ID NO: 361356 - RNA, 19 nt, Homo sapiens
gaaaacugccuucguaaau

SEQ ID NO: 361357 - RNA, 19 nt, Homo sapiens
agaagaagaagauguugaa

SEQ ID NO: 361358 - RNA, 19 nt, Homo sapiens
ggacccaaaggaguaauaa

SEQ ID NO: 361359 - RNA, 19 nt, Homo sapiens
ugaacaguuugcugaagaa

SEQ ID NO: 361360 - RNA, 19 nt, Homo sapiens
gugaugcucuaaacaguag

SEQ ID NO: 361361 - RNA, 19 nt, Homo sapiens
gaaaaggaacugaagauca

SEQ ID NO: 361362 - RNA, 19 nt, Homo sapiens
ccuaaaugaauauggguua

SEQ ID NO: 361363 - RNA, 19 nt, Homo sapiens
uggagucuuuccuaaauga

SEQ ID NO: 361364 - RNA, 19 nt, Homo sapiens
uguggagucuuuccuaaau

SEQ ID NO: 361365 - RNA, 19 nt, Homo sapiens
agaauacccuauaguuaag

SEQ ID NO: 361366 - RNA, 19 nt, Homo sapiens
agaagauguugaaugaaga

SEQ ID NO: 361367 - RNA, 19 nt, Homo sapiens
gaugaugguuuugguagua

SEQ ID NO: 361368 - RNA, 19 nt, Homo sapiens
gggaacucauaagcaauuu

SEQ ID NO: 361369 - RNA, 19 nt, Homo sapiens
aaaacugccuucguaaaua

SEQ ID NO: 361370 - RNA, 19 nt, Homo sapiens
gaauaccuuccuaauuaug

SEQ ID NO: 361371 - RNA, 19 nt, Homo sapiens
caagacagugauucaauuc

SEQ ID NO: 361372 - RNA, 19 nt, Homo sapiens
ggauguggagucuuuccua

SEQ ID NO: 361373 - RNA, 19 nt, Homo sapiens
cugaacaguuugcugaaga

SEQ ID NO: 361374 - RNA, 19 nt, Homo sapiens
gguauuaaggguugugaug

SEQ ID NO: 361375 - RNA, 19 nt, Homo sapiens
cagcaacauuauuaguaga

SEQ ID NO: 361376 - RNA, 19 nt, Homo sapiens
gcuaugcuaacuugacaaa

SEQ ID NO: 361377 - RNA, 19 nt, Homo sapiens
gaagauguugaaugaagau

SEQ ID NO: 361378 - RNA, 19 nt, Homo sapiens
gaagaagauguugaaugaa

SEQ ID NO: 361379 - RNA, 19 nt, Homo sapiens
ugaaagagagguacauguc

SEQ ID NO: 361380 - RNA, 19 nt, Homo sapiens
cuagauauggguuugugua

SEQ ID NO: 361381 - RNA, 19 nt, Homo sapiens
auaaagagaaagaggauga

SEQ ID NO: 361382 - RNA, 19 nt, Homo sapiens
aaagaugagcauucaagaa

SEQ ID NO: 361383 - RNA, 19 nt, Homo sapiens
gcaaugugaggaauaccuu

SEQ ID NO: 361384 - RNA, 19 nt, Homo sapiens
uaaggguugugaugcucua

SEQ ID NO: 361385 - RNA, 19 nt, Homo sapiens
ucacauuuaugaagauggu

SEQ ID NO: 361386 - RNA, 19 nt, Homo sapiens
agacaaagaggauguggau

SEQ ID NO: 361387 - RNA, 19 nt, Homo sapiens
gcaacauuauuaguagaca

SEQ ID NO: 361388 - RNA, 19 nt, Homo sapiens
augcaacaaucgaguuauu

SEQ ID NO: 361389 - RNA, 19 nt, Homo sapiens
gucuucagcaacauuauua

SEQ ID NO: 361390 - RNA, 19 nt, Homo sapiens
cuauauugcuuuagugaac

SEQ ID NO: 361391 - RNA, 19 nt, Homo sapiens
agagguacauguccuagag

SEQ ID NO: 361392 - RNA, 19 nt, Homo sapiens
gggccuagauauggguuug

SEQ ID NO: 361393 - RNA, 19 nt, Homo sapiens
ugaugcaacaaucgaguua

SEQ ID NO: 361394 - RNA, 19 nt, Homo sapiens
gauucacuaugucaauauc

SEQ ID NO: 361395 - RNA, 19 nt, Homo sapiens
ucaauuccaccuagcaaga

SEQ ID NO: 361396 - RNA, 19 nt, Homo sapiens
aaagaggauguggauaaua

SEQ ID NO: 361397 - RNA, 19 nt, Homo sapiens
gagagucaagacagugauu

SEQ ID NO: 361398 - RNA, 19 nt, Homo sapiens
uugauacaaugcuugacua

SEQ ID NO: 361399 - RNA, 19 nt, Homo sapiens
gaagaagaagauguugaau

SEQ ID NO: 361400 - RNA, 19 nt, Homo sapiens
aagaagaagauguugaaug

SEQ ID NO: 361401 - RNA, 19 nt, Homo sapiens
uaauagcaaugugaggaau

SEQ ID NO: 361402 - RNA, 19 nt, Homo sapiens
agacagugauucaauucca

SEQ ID NO: 361403 - RNA, 19 nt, Homo sapiens
guuuauccuuuagguauug

SEQ ID NO: 361404 - RNA, 19 nt, Homo sapiens
uaaauuagagagucaagac

SEQ ID NO: 361405 - RNA, 19 nt, Homo sapiens
guggagucuuuccuaaaug

SEQ ID NO: 361406 - RNA, 19 nt, Homo sapiens
cccaaaggaguaauaaaug

SEQ ID NO: 361407 - RNA, 19 nt, Homo sapiens
ggaacgagucagcagaaag

SEQ ID NO: 361408 - RNA, 19 nt, Homo sapiens
agaaagaugagcauucaag

SEQ ID NO: 361409 - RNA, 19 nt, Homo sapiens
uagaagaagaagauguuga

SEQ ID NO: 361410 - RNA, 19 nt, Homo sapiens
gcugaacaguuugcugaag

SEQ ID NO: 361411 - RNA, 19 nt, Homo sapiens
ccacaggacucaugucuca

SEQ ID NO: 361412 - RNA, 19 nt, Homo sapiens
gggcgugacuuccacauga

SEQ ID NO: 361413 - RNA, 19 nt, Homo sapiens
gaacccauuccugaaauua

SEQ ID NO: 361414 - RNA, 19 nt, Homo sapiens
cagggaagcugaggcagua

SEQ ID NO: 361415 - RNA, 19 nt, Homo sapiens
ccaaggcgcagaucaaaga

SEQ ID NO: 361416 - RNA, 19 nt, Homo sapiens
ucggagagcuucgugcuaa

SEQ ID NO: 361417 - RNA, 19 nt, Homo sapiens
ggaaaccccucccaccuuu

SEQ ID NO: 361418 - RNA, 19 nt, Homo sapiens
gguuggagauggccuugga

SEQ ID NO: 361419 - RNA, 19 nt, Homo sapiens
ucccugugguucuauuaua

SEQ ID NO: 361420 - RNA, 19 nt, Homo sapiens
gacggaguaugccaccauu

SEQ ID NO: 361421 - RNA, 19 nt, Homo sapiens
cugcaggccuagagaaguu

SEQ ID NO: 361422 - RNA, 19 nt, Homo sapiens
gagcucagggugacagaga

SEQ ID NO: 361423 - RNA, 19 nt, Homo sapiens
gcaaugacagcggcaccua

SEQ ID NO: 361424 - RNA, 19 nt, Homo sapiens
cuaaacugguaccgcauga

SEQ ID NO: 361425 - RNA, 19 nt, Homo sapiens
acccauuccugaaauuauu

SEQ ID NO: 361426 - RNA, 19 nt, Homo sapiens
ccucccaccuuuacacaug

SEQ ID NO: 361427 - RNA, 19 nt, Homo sapiens
gcaguggcaucccgaaacg

SEQ ID NO: 361428 - RNA, 19 nt, Homo sapiens
ugcagacccuccaccauga

SEQ ID NO: 361429 - RNA, 19 nt, Homo sapiens
gcuucgugcuaaacuggua

SEQ ID NO: 361430 - RNA, 19 nt, Homo sapiens
gacugccgcuuccguguca

SEQ ID NO: 361431 - RNA, 19 nt, Homo sapiens
gauuuccaguggcgagaga

SEQ ID NO: 361432 - RNA, 19 nt, Homo sapiens
guaugccaccauugucuuu

SEQ ID NO: 361433 - RNA, 19 nt, Homo sapiens
ccuauccacuccucacauc

SEQ ID NO: 361434 - RNA, 19 nt, Homo sapiens
gcguccagcucccugaauc

SEQ ID NO: 361435 - RNA, 19 nt, Homo sapiens
ucccugagcagacggagua

SEQ ID NO: 361436 - RNA, 19 nt, Homo sapiens
ccaggaugguucuuagacu

SEQ ID NO: 361437 - RNA, 19 nt, Homo sapiens
cuacagggagggccagaug

SEQ ID NO: 361438 - RNA, 19 nt, Homo sapiens
uguguucucuguggacuau

SEQ ID NO: 361439 - RNA, 19 nt, Homo sapiens
cagcggcaccuaccucugu

SEQ ID NO: 361440 - RNA, 19 nt, Homo sapiens
gcaaccagacggacaagcu

SEQ ID NO: 361441 - RNA, 19 nt, Homo sapiens
cggagagcuucgugcuaaa

SEQ ID NO: 361442 - RNA, 19 nt, Homo sapiens
cccugugguucuauuauau

SEQ ID NO: 361443 - RNA, 19 nt, Homo sapiens
ggaguaugccaccauuguc

SEQ ID NO: 361444 - RNA, 19 nt, Homo sapiens
caggacucaugucucaaug

SEQ ID NO: 361445 - RNA, 19 nt, Homo sapiens
gaggauggacacugcucuu

SEQ ID NO: 361446 - RNA, 19 nt, Homo sapiens
agagagaagggcagaagug

SEQ ID NO: 361447 - RNA, 19 nt, Homo sapiens
gaguaugccaccauugucu

SEQ ID NO: 361448 - RNA, 19 nt, Homo sapiens
cggaguaugccaccauugu

SEQ ID NO: 361449 - RNA, 19 nt, Homo sapiens
cggccaggaugguucuuag

SEQ ID NO: 361450 - RNA, 19 nt, Homo sapiens
gcggccaggaugguucuua

SEQ ID NO: 361451 - RNA, 19 nt, Homo sapiens
gaagauuacucagagauua

SEQ ID NO: 361452 - RNA, 19 nt, Homo sapiens
gaacagauucuuagauaug

SEQ ID NO: 361453 - RNA, 19 nt, Homo sapiens
gcucaucucugcaggguuu

SEQ ID NO: 361454 - RNA, 19 nt, Homo sapiens
ggaaucaacuacccaggaa

SEQ ID NO: 361455 - RNA, 19 nt, Homo sapiens
gagcaugggugaagcacuu

SEQ ID NO: 361456 - RNA, 19 nt, Homo sapiens
aaauagaggugcagagaug

SEQ ID NO: 361457 - RNA, 19 nt, Homo sapiens
gaagcaggauguaacagau

SEQ ID NO: 361458 - RNA, 19 nt, Homo sapiens
cagaagaauuuguguggaa

SEQ ID NO: 361459 - RNA, 19 nt, Homo sapiens
gugaagcacuugaggaaga

SEQ ID NO: 361460 - RNA, 19 nt, Homo sapiens
gaucaucuggaccauauaa

SEQ ID NO: 361461 - RNA, 19 nt, Homo sapiens
ggucaugccucagcuccua

SEQ ID NO: 361462 - RNA, 19 nt, Homo sapiens
gacuggagauugggacaua

SEQ ID NO: 361463 - RNA, 19 nt, Homo sapiens
cauaugagccaccuucuga

SEQ ID NO: 361464 - RNA, 19 nt, Homo sapiens
aaacucagauagcccuuga

SEQ ID NO: 361465 - RNA, 19 nt, Homo sapiens
aaacaaaaguguccaguga

SEQ ID NO: 361466 - RNA, 19 nt, Homo sapiens
ggaagcaggauguaacaga

SEQ ID NO: 361467 - RNA, 19 nt, Homo sapiens
ggaagauuacucagagauu

SEQ ID NO: 361468 - RNA, 19 nt, Homo sapiens
ugccucagcuccuaaacua

SEQ ID NO: 361469 - RNA, 19 nt, Homo sapiens
gaaacagaagaugagauua

SEQ ID NO: 361470 - RNA, 19 nt, Homo sapiens
uaacagauacaccguaaag

SEQ ID NO: 361471 - RNA, 19 nt, Homo sapiens
aaaaggauauuccagauug

SEQ ID NO: 361472 - RNA, 19 nt, Homo sapiens
agaaacagaagaugagauu

SEQ ID NO: 361473 - RNA, 19 nt, Homo sapiens
cagugugucuccagcuuaa

SEQ ID NO: 361474 - RNA, 19 nt, Homo sapiens
ucagauagcccuugaacca

SEQ ID NO: 361475 - RNA, 19 nt, Homo sapiens
gguacuggcuauacagaag

SEQ ID NO: 361476 - RNA, 19 nt, Homo sapiens
gauagcccuugaaccagaa

SEQ ID NO: 361477 - RNA, 19 nt, Homo sapiens
caggguuuguggcuguuua

SEQ ID NO: 361478 - RNA, 19 nt, Homo sapiens
gauuaugccugagguugug

SEQ ID NO: 361479 - RNA, 19 nt, Homo sapiens
gaaacaggagaaucagugu

SEQ ID NO: 361480 - RNA, 19 nt, Homo sapiens
ccagugacagggaauuaaa

SEQ ID NO: 361481 - RNA, 19 nt, Homo sapiens
gugaaaauauuccucaaga

SEQ ID NO: 361482 - RNA, 19 nt, Homo sapiens
caucuggaccauauaauuc

SEQ ID NO: 361483 - RNA, 19 nt, Homo sapiens
cacagugucuacuuauuag

SEQ ID NO: 361484 - RNA, 19 nt, Homo sapiens
cagcuuggguacuggcuau

SEQ ID NO: 361485 - RNA, 19 nt, Homo sapiens
ugaagcacuugaggaagaa

SEQ ID NO: 361486 - RNA, 19 nt, Homo sapiens
aacagaagaugagauuaug

SEQ ID NO: 361487 - RNA, 19 nt, Homo sapiens
gaaaaggauauuccagauu

SEQ ID NO: 361488 - RNA, 19 nt, Homo sapiens
gggugaagcacuugaggaa

SEQ ID NO: 361489 - RNA, 19 nt, Homo sapiens
ggaaaaggaagauuacuca

SEQ ID NO: 361490 - RNA, 19 nt, Homo sapiens
caucuggauuucuggugaa

SEQ ID NO: 361491 - RNA, 19 nt, Homo sapiens
caauuccauuucugggauu

SEQ ID NO: 361492 - RNA, 19 nt, Homo sapiens
gugacagggaauuaaauaa

SEQ ID NO: 361493 - RNA, 19 nt, Homo sapiens
ucaucuggaccauauaauu

SEQ ID NO: 361494 - RNA, 19 nt, Homo sapiens
gacccuagacuggagauug

SEQ ID NO: 361495 - RNA, 19 nt, Homo sapiens
uggcuauacagaagaauuu

SEQ ID NO: 361496 - RNA, 19 nt, Homo sapiens
gcuuaagucuggugcucau

SEQ ID NO: 361497 - RNA, 19 nt, Homo sapiens
agugacagggaauuaaaua

SEQ ID NO: 361498 - RNA, 19 nt, Homo sapiens
caccguaaaggcaucuuaa

SEQ ID NO: 361499 - RNA, 19 nt, Homo sapiens
agacugggcaagagcauug

SEQ ID NO: 361500 - RNA, 19 nt, Homo sapiens
aagcaggauguaacagaua

SEQ ID NO: 361501 - RNA, 19 nt, Homo sapiens
gaaucaacuacccaggaaa

SEQ ID NO: 361502 - RNA, 19 nt, Homo sapiens
ucagugugucuccagcuua

SEQ ID NO: 361503 - RNA, 19 nt, Homo sapiens
guacuggcuauacagaaga

SEQ ID NO: 361504 - RNA, 19 nt, Homo sapiens
agauauggcagagguauug

SEQ ID NO: 361505 - RNA, 19 nt, Homo sapiens
guaauagaaacagaagaug

SEQ ID NO: 361506 - RNA, 19 nt, Homo sapiens
cccagaaacaggagaauca

SEQ ID NO: 361507 - RNA, 19 nt, Homo sapiens
ccagaccacaacuuccuuu

SEQ ID NO: 361508 - RNA, 19 nt, Homo sapiens
guccagugacagggaauua

SEQ ID NO: 361509 - RNA, 19 nt, Homo sapiens
cguaaaggcaucuuaaagc

SEQ ID NO: 361510 - RNA, 19 nt, Homo sapiens
gcugacagacugggcaaga

SEQ ID NO: 361511 - RNA, 19 nt, Homo sapiens
gcuccuaaacuaccugaag

SEQ ID NO: 361512 - RNA, 19 nt, Homo sapiens
ugaauccagggaagauaaa

SEQ ID NO: 361513 - RNA, 19 nt, Homo sapiens
agugucuacuuauuaguga

SEQ ID NO: 361514 - RNA, 19 nt, Homo sapiens
caugaauccagggaagaua

SEQ ID NO: 361515 - RNA, 19 nt, Homo sapiens
ggagauugggacauaagca

SEQ ID NO: 361516 - RNA, 19 nt, Homo sapiens
ccuugaaccagaacagauu

SEQ ID NO: 361517 - RNA, 19 nt, Homo sapiens
ccagggaagauaaaauuuu

SEQ ID NO: 361518 - RNA, 19 nt, Homo sapiens
uaugagccaccuucugaga

SEQ ID NO: 361519 - RNA, 19 nt, Homo sapiens
aaggaagauuacucagaga

SEQ ID NO: 361520 - RNA, 19 nt, Homo sapiens
acaccguaaaggcaucuua

SEQ ID NO: 361521 - RNA, 19 nt, Homo sapiens
gcuauacagaagaauuugu

SEQ ID NO: 361522 - RNA, 19 nt, Homo sapiens
gcacuuaccuuauauaaag

SEQ ID NO: 361523 - RNA, 19 nt, Homo sapiens
gaagauuacucagagauua

SEQ ID NO: 361524 - RNA, 19 nt, Homo sapiens
gaaaggagagccuagagua

SEQ ID NO: 361525 - RNA, 19 nt, Homo sapiens
gaauaugcccugagaauga

SEQ ID NO: 361526 - RNA, 19 nt, Homo sapiens
cuucaaauaugccuuguua

SEQ ID NO: 361527 - RNA, 19 nt, Homo sapiens
gcucaucucugcaggguuu

SEQ ID NO: 361528 - RNA, 19 nt, Homo sapiens
ggaaucaacuacccaggaa

SEQ ID NO: 361529 - RNA, 19 nt, Homo sapiens
guucaugccuauacgauaa

SEQ ID NO: 361530 - RNA, 19 nt, Homo sapiens
ggacaguacaucucuagua

SEQ ID NO: 361531 - RNA, 19 nt, Homo sapiens
uggaggagcccaaauaaua

SEQ ID NO: 361532 - RNA, 19 nt, Homo sapiens
gaaagcuggacuucaaaua

SEQ ID NO: 361533 - RNA, 19 nt, Homo sapiens
gagcauggguaagcaguuu

SEQ ID NO: 361534 - RNA, 19 nt, Homo sapiens
gaggaagacucacuuugga

SEQ ID NO: 361535 - RNA, 19 nt, Homo sapiens
gaguagggcugcacaagau

SEQ ID NO: 361536 - RNA, 19 nt, Homo sapiens
gacaguacaucucuaguag

SEQ ID NO: 361537 - RNA, 19 nt, Homo sapiens
gaagaaagggcuccaugug

SEQ ID NO: 361538 - RNA, 19 nt, Homo sapiens
guagcaggaucaaggauga

SEQ ID NO: 361539 - RNA, 19 nt, Homo sapiens
caacauuuauccagcacuu

SEQ ID NO: 361540 - RNA, 19 nt, Homo sapiens
aaauaugccuuguuagugu

SEQ ID NO: 361541 - RNA, 19 nt, Homo sapiens
gaucaucuggaccauauaa

SEQ ID NO: 361542 - RNA, 19 nt, Homo sapiens
ggaggagcccaaauaauau

SEQ ID NO: 361543 - RNA, 19 nt, Homo sapiens
ggaaguuaaaguccauaua

SEQ ID NO: 361544 - RNA, 19 nt, Homo sapiens
aacaucagcuuacugguuu

SEQ ID NO: 361545 - RNA, 19 nt, Homo sapiens
guaagcaguuucaggacuu

SEQ ID NO: 361546 - RNA, 19 nt, Homo sapiens
cauauaaccacacuaagaa

SEQ ID NO: 361547 - RNA, 19 nt, Homo sapiens
aaauugagguucuggguau

SEQ ID NO: 361548 - RNA, 19 nt, Homo sapiens
cauaugagccaccuucuga

SEQ ID NO: 361549 - RNA, 19 nt, Homo sapiens
gacuggagauugggacaua

SEQ ID NO: 361550 - RNA, 19 nt, Homo sapiens
gcuggaggcuugguaaguu

SEQ ID NO: 361551 - RNA, 19 nt, Homo sapiens
cauaauacuuggaagaaag

SEQ ID NO: 361552 - RNA, 19 nt, Homo sapiens
uuucaggacuucauucauu

SEQ ID NO: 361553 - RNA, 19 nt, Homo sapiens
caaaaccaccacaaaauua

SEQ ID NO: 361554 - RNA, 19 nt, Homo sapiens
ggguauaacuuucuuuggu

SEQ ID NO: 361555 - RNA, 19 nt, Homo sapiens
gugcugaccaaguaucuua

SEQ ID NO: 361556 - RNA, 19 nt, Homo sapiens
ggaagauuacucagagauu

SEQ ID NO: 361557 - RNA, 19 nt, Homo sapiens
gaaacagaagaugagauua

SEQ ID NO: 361558 - RNA, 19 nt, Homo sapiens
aagcuggacuucaaauaug

SEQ ID NO: 361559 - RNA, 19 nt, Homo sapiens
caaguaucuuagaggcuua

SEQ ID NO: 361560 - RNA, 19 nt, Homo sapiens
guccauauaaugacugaua

SEQ ID NO: 361561 - RNA, 19 nt, Homo sapiens
gcagaccaaugagugagaa

SEQ ID NO: 361562 - RNA, 19 nt, Homo sapiens
ggaagaaagggcuccaugu

SEQ ID NO: 361563 - RNA, 19 nt, Homo sapiens
ucauauaaccacacuaaga

SEQ ID NO: 361564 - RNA, 19 nt, Homo sapiens
gauauugccucagguaaaa

SEQ ID NO: 361565 - RNA, 19 nt, Homo sapiens
agaaacagaagaugagauu

SEQ ID NO: 361566 - RNA, 19 nt, Homo sapiens
ucaaauaugccuuguuagu

SEQ ID NO: 361567 - RNA, 19 nt, Homo sapiens
aaacaucagcuuacugguu

SEQ ID NO: 361568 - RNA, 19 nt, Homo sapiens
gugagaaacugccccauuu

SEQ ID NO: 361569 - RNA, 19 nt, Homo sapiens
cagugugucuccagcuuaa

SEQ ID NO: 361570 - RNA, 19 nt, Homo sapiens
caaauaugccuuguuagug

SEQ ID NO: 361571 - RNA, 19 nt, Homo sapiens
augcuuaucuuuaggagaa

SEQ ID NO: 361572 - RNA, 19 nt, Homo sapiens
auccagcacuuaccuuaua

SEQ ID NO: 361573 - RNA, 19 nt, Homo sapiens
cuguggaacuguaugagua

SEQ ID NO: 361574 - RNA, 19 nt, Homo sapiens
gauaacagggauauaaugg

SEQ ID NO: 361575 - RNA, 19 nt, Homo sapiens
aaauauacuuccuggacuu

SEQ ID NO: 361576 - RNA, 19 nt, Homo sapiens
uucaggacuucauucauua

SEQ ID NO: 361577 - RNA, 19 nt, Homo sapiens
caggguuuguggcuguuua

SEQ ID NO: 361578 - RNA, 19 nt, Homo sapiens
gagaggaagacucacuuug

SEQ ID NO: 361579 - RNA, 19 nt, Homo sapiens
uagaagagagguacugaga

SEQ ID NO: 361580 - RNA, 19 nt, Homo sapiens
gauauaaugggaagcaaca

SEQ ID NO: 361581 - RNA, 19 nt, Homo sapiens
cagcacuuaccuuauauaa

SEQ ID NO: 361582 - RNA, 19 nt, Homo sapiens
aaagcuggacuucaaauau

SEQ ID NO: 361583 - RNA, 19 nt, Homo sapiens
gaaacaggagaaucagugu

SEQ ID NO: 361584 - RNA, 19 nt, Homo sapiens
cgugacagcagaccaauga

SEQ ID NO: 361585 - RNA, 19 nt, Homo sapiens
gauuaugccugagguugug

SEQ ID NO: 361586 - RNA, 19 nt, Homo sapiens
uagaauaugcccugagaau

SEQ ID NO: 361587 - RNA, 19 nt, Homo sapiens
ugccugaccuugugcuuga

SEQ ID NO: 361588 - RNA, 19 nt, Homo sapiens
ucuuucaucuggccaguuu

SEQ ID NO: 361589 - RNA, 19 nt, Homo sapiens
caucuggaccauauaauuc

SEQ ID NO: 361590 - RNA, 19 nt, Homo sapiens
aguagaauaugcccugaga

SEQ ID NO: 361591 - RNA, 19 nt, Homo sapiens
ggagaaaggagagccuaga

SEQ ID NO: 361592 - RNA, 19 nt, Homo sapiens
agucauauaaccacacuaa

SEQ ID NO: 361593 - RNA, 19 nt, Homo sapiens
ggaacuguaugaguauuuu

SEQ ID NO: 361594 - RNA, 19 nt, Homo sapiens
ucagaugcucacagucuua

SEQ ID NO: 361595 - RNA, 19 nt, Homo sapiens
guucauaccagucauacau

SEQ ID NO: 361596 - RNA, 19 nt, Homo sapiens
guaguucauaccagucaua

SEQ ID NO: 361597 - RNA, 19 nt, Homo sapiens
gaaaagaauguaacagugu

SEQ ID NO: 361598 - RNA, 19 nt, Homo sapiens
aauaugccuuguuagugua

SEQ ID NO: 361599 - RNA, 19 nt, Homo sapiens
uuauggaggagcccaaaua

SEQ ID NO: 361600 - RNA, 19 nt, Homo sapiens
ggucagaugcucacagucu

SEQ ID NO: 361601 - RNA, 19 nt, Homo sapiens
ucagauauugccucaggua

SEQ ID NO: 361602 - RNA, 19 nt, Homo sapiens
aauaugcccugagaaugaa

SEQ ID NO: 361603 - RNA, 19 nt, Homo sapiens
uauggaggagcccaaauaa

SEQ ID NO: 361604 - RNA, 19 nt, Homo sapiens
gugaggaaauugagguucu

SEQ ID NO: 361605 - RNA, 19 nt, Homo sapiens
aacagaagaugagauuaug

SEQ ID NO: 361606 - RNA, 19 nt, Homo sapiens
aaacauaggacaguacauc

SEQ ID NO: 361607 - RNA, 19 nt, Homo sapiens
ccuauacgauaaacaugau

SEQ ID NO: 361608 - RNA, 19 nt, Homo sapiens
cuugauaacagggauauaa

SEQ ID NO: 361609 - RNA, 19 nt, Homo sapiens
ucauaccagucauacauuc

SEQ ID NO: 361610 - RNA, 19 nt, Homo sapiens
ggaaaaggaagauuacuca

SEQ ID NO: 361611 - RNA, 19 nt, Homo sapiens
gaaacugccccauuuugaa

SEQ ID NO: 361612 - RNA, 19 nt, Homo sapiens
aauaauaucuggggaaguu

SEQ ID NO: 361613 - RNA, 19 nt, Homo sapiens
gcaguuucaggacuucauu

SEQ ID NO: 361614 - RNA, 19 nt, Homo sapiens
caggugacuucaaaacaua

SEQ ID NO: 361615 - RNA, 19 nt, Homo sapiens
ucaucuggaccauauaauu

SEQ ID NO: 361616 - RNA, 19 nt, Homo sapiens
cuucauucauuaagugguu

SEQ ID NO: 361617 - RNA, 19 nt, Homo sapiens
gacccuagacuggagauug

SEQ ID NO: 361618 - RNA, 19 nt, Homo sapiens
gaaaaugcuuaucuuuagg

SEQ ID NO: 361619 - RNA, 19 nt, Homo sapiens
guggucagaugcucacagu

SEQ ID NO: 361620 - RNA, 19 nt, Homo sapiens
ucagcuuacugguuuguag

SEQ ID NO: 361621 - RNA, 19 nt, Homo sapiens
gcuuaagucuggugcucau

SEQ ID NO: 361622 - RNA, 19 nt, Homo sapiens
gcacuaagacgaucaaaua

SEQ ID NO: 361623 - RNA, 19 nt, Homo sapiens
ccacagagauugaagaauu

SEQ ID NO: 361624 - RNA, 19 nt, Homo sapiens
gaaacugacuguaacugua

SEQ ID NO: 361625 - RNA, 19 nt, Homo sapiens
uaaauggucuuucgaugua

SEQ ID NO: 361626 - RNA, 19 nt, Homo sapiens
gaacucagaagacuuagua

SEQ ID NO: 361627 - RNA, 19 nt, Homo sapiens
gagcauagucugaaguuua

SEQ ID NO: 361628 - RNA, 19 nt, Homo sapiens
ggaaagaggugauguuaac

SEQ ID NO: 361629 - RNA, 19 nt, Homo sapiens
cgaaacaccuuaaagacuu

SEQ ID NO: 361630 - RNA, 19 nt, Homo sapiens
caaauagguuucaucgauu

SEQ ID NO: 361631 - RNA, 19 nt, Homo sapiens
uaagagaggcuacuguaua

SEQ ID NO: 361632 - RNA, 19 nt, Homo sapiens
acaaacaacuuucacauuc

SEQ ID NO: 361633 - RNA, 19 nt, Homo sapiens
uaguaacucuggccaaaua

SEQ ID NO: 361634 - RNA, 19 nt, Homo sapiens
acaaauagguuucaucgau

SEQ ID NO: 361635 - RNA, 19 nt, Homo sapiens
aagagaggcuacuguauaa

SEQ ID NO: 361636 - RNA, 19 nt, Homo sapiens
gauaagagaggcuacugua

SEQ ID NO: 361637 - RNA, 19 nt, Homo sapiens
gcaagaagaagaaaugaau

SEQ ID NO: 361638 - RNA, 19 nt, Homo sapiens
ggaagcaguuuauaucgau

SEQ ID NO: 361639 - RNA, 19 nt, Homo sapiens
acacauugcugaugcacua

SEQ ID NO: 361640 - RNA, 19 nt, Homo sapiens
ccaaauaaauacacucaag

SEQ ID NO: 361641 - RNA, 19 nt, Homo sapiens
aaagagagguggaaagagu

SEQ ID NO: 361642 - RNA, 19 nt, Homo sapiens
cuaagacgaucaaauacaa

SEQ ID NO: 361643 - RNA, 19 nt, Homo sapiens
ugcagaagcuuuagaaguu

SEQ ID NO: 361644 - RNA, 19 nt, Homo sapiens
caguggaccugaagaguuu

SEQ ID NO: 361645 - RNA, 19 nt, Homo sapiens
caaacaacuuucacauuca

SEQ ID NO: 361646 - RNA, 19 nt, Homo sapiens
uaucaaccguuucaagauu

SEQ ID NO: 361647 - RNA, 19 nt, Homo sapiens
gcuaguaacucuggccaaa

SEQ ID NO: 361648 - RNA, 19 nt, Homo sapiens
cuuaaagacuucugucauu

SEQ ID NO: 361649 - RNA, 19 nt, Homo sapiens
ucagaagacuuaguaaaug

SEQ ID NO: 361650 - RNA, 19 nt, Homo sapiens
ucacugaacuggaaauuuu

SEQ ID NO: 361651 - RNA, 19 nt, Homo sapiens
ugaauuagggcuuccauuu

SEQ ID NO: 361652 - RNA, 19 nt, Homo sapiens
ucacucaaacugugcauua

SEQ ID NO: 361653 - RNA, 19 nt, Homo sapiens
gaacaaagagagguggaaa

SEQ ID NO: 361654 - RNA, 19 nt, Homo sapiens
caaucaagccagauaaauu

SEQ ID NO: 361655 - RNA, 19 nt, Homo sapiens
gcagcagccugaagggauu

SEQ ID NO: 361656 - RNA, 19 nt, Homo sapiens
ggucuuugcugcugccauu

SEQ ID NO: 361657 - RNA, 19 nt, Homo sapiens
gcagaagcuuuagaaguug

SEQ ID NO: 361658 - RNA, 19 nt, Homo sapiens
cauaguagagccaacauuu

SEQ ID NO: 361659 - RNA, 19 nt, Homo sapiens
gcucuguccuugagaauca

SEQ ID NO: 361660 - RNA, 19 nt, Homo sapiens
caaagucaauagcaaaucu

SEQ ID NO: 361661 - RNA, 19 nt, Homo sapiens
caauacaugugcagaagau

SEQ ID NO: 361662 - RNA, 19 nt, Homo sapiens
ccacaaagcuauggcucuu

SEQ ID NO: 361663 - RNA, 19 nt, Homo sapiens
gaaacaccuuaaagacuuc

SEQ ID NO: 361664 - RNA, 19 nt, Homo sapiens
gagugcagcuuaucgacuu

SEQ ID NO: 361665 - RNA, 19 nt, Homo sapiens
ggucagauguugccauuuu

SEQ ID NO: 361666 - RNA, 19 nt, Homo sapiens
ugaaaggaauacuaagaug

SEQ ID NO: 361667 - RNA, 19 nt, Homo sapiens
agaguuagcugcacaaggu

SEQ ID NO: 361668 - RNA, 19 nt, Homo sapiens
ggacaacaaacaacuuuca

SEQ ID NO: 361669 - RNA, 19 nt, Homo sapiens
gaauuggauugggccauuu

SEQ ID NO: 361670 - RNA, 19 nt, Homo sapiens
cauccuaaauucucaacuu

SEQ ID NO: 361671 - RNA, 19 nt, Homo sapiens
ggucacuuccagcaaauua

SEQ ID NO: 361672 - RNA, 19 nt, Homo sapiens
gaaccuagugauugaaaug

SEQ ID NO: 361673 - RNA, 19 nt, Homo sapiens
cugcugccauucaugauua

SEQ ID NO: 361674 - RNA, 19 nt, Homo sapiens
gaaguugguuacagcaagu

SEQ ID NO: 361675 - RNA, 19 nt, Homo sapiens
ggccagugcuucugccauu

SEQ ID NO: 361676 - RNA, 19 nt, Homo sapiens
cuuaguaaaugcugaagaa

SEQ ID NO: 361677 - RNA, 19 nt, Homo sapiens
gcagggagauaaagaagcu

SEQ ID NO: 361678 - RNA, 19 nt, Homo sapiens
ucaggucacuuccagcaaa

SEQ ID NO: 361679 - RNA, 19 nt, Homo sapiens
gauauaugccugucaaagu

SEQ ID NO: 361680 - RNA, 19 nt, Homo sapiens
gcaguggaccugaagaguu

SEQ ID NO: 361681 - RNA, 19 nt, Homo sapiens
gagcauacagggacaacaa

SEQ ID NO: 361682 - RNA, 19 nt, Homo sapiens
ggugagcaguggauauaug

SEQ ID NO: 361683 - RNA, 19 nt, Homo sapiens
gaagaugagcucagugaca

SEQ ID NO: 361684 - RNA, 19 nt, Homo sapiens
ugcagaagaugagguauuu

SEQ ID NO: 361685 - RNA, 19 nt, Homo sapiens
aaacaugagaggacaauga

SEQ ID NO: 361686 - RNA, 19 nt, Homo sapiens
gcucuucuuucaacauaga

SEQ ID NO: 361687 - RNA, 19 nt, Homo sapiens
caauuuggccuucuucaau

SEQ ID NO: 361688 - RNA, 19 nt, Homo sapiens
cgaaacuucuuccuaugug

SEQ ID NO: 361689 - RNA, 19 nt, Homo sapiens
ccacgugagugcagcuuau

SEQ ID NO: 361690 - RNA, 19 nt, Homo sapiens
acaaugaaaucagcaugaa

SEQ ID NO: 361691 - RNA, 19 nt, Homo sapiens
cauaagaacucagaagacu

SEQ ID NO: 361692 - RNA, 19 nt, Homo sapiens
gagauaaagaagcugaauu

SEQ ID NO: 361693 - RNA, 19 nt, Homo sapiens
cagacaaggucagauguug

SEQ ID NO: 361694 - RNA, 19 nt, Homo sapiens
caaacugugcauuacauaa

SEQ ID NO: 361695 - RNA, 19 nt, Homo sapiens
gaucuuaucaaccguuuca

SEQ ID NO: 361696 - RNA, 19 nt, Homo sapiens
gcugucaucguaacauuaa

SEQ ID NO: 361697 - RNA, 19 nt, Homo sapiens
gacuguaacuguauugucu

SEQ ID NO: 361698 - RNA, 19 nt, Homo sapiens
guaauggacugaggaaugc

SEQ ID NO: 361699 - RNA, 19 nt, Homo sapiens
gacaaaagccagacaguuu

SEQ ID NO: 361700 - RNA, 19 nt, Homo sapiens
caacaaacaacuuucacau

SEQ ID NO: 361701 - RNA, 19 nt, Homo sapiens
uggaaagaauguaccgaaa

SEQ ID NO: 361702 - RNA, 19 nt, Homo sapiens
cugguuggcuucuaccuuu

SEQ ID NO: 361703 - RNA, 19 nt, Homo sapiens
cacagagauugaagaauug

SEQ ID NO: 361704 - RNA, 19 nt, Homo sapiens
uaacuguauugucuuagga

SEQ ID NO: 361705 - RNA, 19 nt, Homo sapiens
caacauagaauuggauugg

SEQ ID NO: 361706 - RNA, 19 nt, Homo sapiens
gacaaugaaaucagcauga

SEQ ID NO: 361707 - RNA, 19 nt, Homo sapiens
caaggugaaucugaucuuc

SEQ ID NO: 361708 - RNA, 19 nt, Homo sapiens
ccuggaagcugcauuaucg

SEQ ID NO: 361709 - RNA, 19 nt, Homo sapiens
uggcucuucuuucaacaua

SEQ ID NO: 361710 - RNA, 19 nt, Homo sapiens
gcacuguuuugauagauaa

SEQ ID NO: 361711 - RNA, 19 nt, Homo sapiens
gcccgaaacaccuuaaaga

SEQ ID NO: 361712 - RNA, 19 nt, Homo sapiens
gagagcauagucugaaguu

SEQ ID NO: 361713 - RNA, 19 nt, Homo sapiens
cagcugucaucguaacauu

SEQ ID NO: 361714 - RNA, 19 nt, Homo sapiens
cguaaugacugugcaauac

SEQ ID NO: 361715 - RNA, 19 nt, Homo sapiens
guggauauaugccugucaa

SEQ ID NO: 361716 - RNA, 19 nt, Homo sapiens
ccuaaucaccuuugcagaa

SEQ ID NO: 361717 - RNA, 19 nt, Homo sapiens
gcuggaagcaguuuauauc

SEQ ID NO: 361718 - RNA, 19 nt, Homo sapiens
agaauuggauugggccauu

SEQ ID NO: 361719 - RNA, 19 nt, Homo sapiens
auucucaacuuuccacaaa

SEQ ID NO: 361720 - RNA, 19 nt, Homo sapiens
cagaagacuuaguaaaugc

SEQ ID NO: 361721 - RNA, 19 nt, Homo sapiens
ggaaccuagugauugaaau

SEQ ID NO: 361722 - RNA, 19 nt, Homo sapiens
ccaaggagauugaagaauu

SEQ ID NO: 361723 - RNA, 19 nt, Homo sapiens
gaucaugcacugaaauuua

SEQ ID NO: 361724 - RNA, 19 nt, Homo sapiens
gaugaaaccucucaaacug

SEQ ID NO: 361725 - RNA, 19 nt, Homo sapiens
caucaucgcuggacaaugu

SEQ ID NO: 361726 - RNA, 19 nt, Homo sapiens
ccacagauaugucuuguca

SEQ ID NO: 361727 - RNA, 19 nt, Homo sapiens
caaggagauugaagaauuu

SEQ ID NO: 361728 - RNA, 19 nt, Homo sapiens
ggacagaggcguucgaguu

SEQ ID NO: 361729 - RNA, 19 nt, Homo sapiens
caaguagguuucauugauu

SEQ ID NO: 361730 - RNA, 19 nt, Homo sapiens
caauuuccuuucagacuua

SEQ ID NO: 361731 - RNA, 19 nt, Homo sapiens
uaaaggauguggacaagug

SEQ ID NO: 361732 - RNA, 19 nt, Homo sapiens
gaaaacagaugauucacaa

SEQ ID NO: 361733 - RNA, 19 nt, Homo sapiens
gaucaacaauucugucauc

SEQ ID NO: 361734 - RNA, 19 nt, Homo sapiens
gaucuguacuggagaauca

SEQ ID NO: 361735 - RNA, 19 nt, Homo sapiens
cagcuauucuguauaauga

SEQ ID NO: 361736 - RNA, 19 nt, Homo sapiens
gaucuuugcuauaaucuuc

SEQ ID NO: 361737 - RNA, 19 nt, Homo sapiens
ugacggagcuggagaucuu

SEQ ID NO: 361738 - RNA, 19 nt, Homo sapiens
ugcauuaccuccucuauaa

SEQ ID NO: 361739 - RNA, 19 nt, Homo sapiens
ggagaucuuugcuauaauc

SEQ ID NO: 361740 - RNA, 19 nt, Homo sapiens
ugacaacccucgugggaaa

SEQ ID NO: 361741 - RNA, 19 nt, Homo sapiens
ccaaaagccuuaucccuua

SEQ ID NO: 361742 - RNA, 19 nt, Homo sapiens
ggauuucccuucccuccua

SEQ ID NO: 361743 - RNA, 19 nt, Homo sapiens
gagcaacucucugaaauac

SEQ ID NO: 361744 - RNA, 19 nt, Homo sapiens
ucaaugccguuacuuuaaa

SEQ ID NO: 361745 - RNA, 19 nt, Homo sapiens
caacaaaucaaagcaauga

SEQ ID NO: 361746 - RNA, 19 nt, Homo sapiens
gaacuacucacacguuaug

SEQ ID NO: 361747 - RNA, 19 nt, Homo sapiens
gcacaucaaucgggagaga

SEQ ID NO: 361748 - RNA, 19 nt, Homo sapiens
ggacaugaccgagaagauu

SEQ ID NO: 361749 - RNA, 19 nt, Homo sapiens
cuaaugaccuggcuuucaa

SEQ ID NO: 361750 - RNA, 19 nt, Homo sapiens
guacaacuuucaaacacaa

SEQ ID NO: 361751 - RNA, 19 nt, Homo sapiens
gcaacagaauggugacuuc

SEQ ID NO: 361752 - RNA, 19 nt, Homo sapiens
gaaccuugguaauugaaau

SEQ ID NO: 361753 - RNA, 19 nt, Homo sapiens
ggagaagguguacaacuuu

SEQ ID NO: 361754 - RNA, 19 nt, Homo sapiens
gccagugucuugcaucauu

SEQ ID NO: 361755 - RNA, 19 nt, Homo sapiens
gaagauugugaguccauua

SEQ ID NO: 361756 - RNA, 19 nt, Homo sapiens
acaaguagguuucauugau

SEQ ID NO: 361757 - RNA, 19 nt, Homo sapiens
cuggagaucuuugcuauaa

SEQ ID NO: 361758 - RNA, 19 nt, Homo sapiens
cggaaaugauucaaagaaa

SEQ ID NO: 361759 - RNA, 19 nt, Homo sapiens
gauauuagccauccagcaa

SEQ ID NO: 361760 - RNA, 19 nt, Homo sapiens
ugauuaaccucucaaagga

SEQ ID NO: 361761 - RNA, 19 nt, Homo sapiens
ggacggaaguggugcacau

SEQ ID NO: 361762 - RNA, 19 nt, Homo sapiens
gagaaucaccauuuaagug

SEQ ID NO: 361763 - RNA, 19 nt, Homo sapiens
aaacaaacaacgugagauu

SEQ ID NO: 361764 - RNA, 19 nt, Homo sapiens
caccaacaauuuccacauu

SEQ ID NO: 361765 - RNA, 19 nt, Homo sapiens
uuacacagacagugcauua

SEQ ID NO: 361766 - RNA, 19 nt, Homo sapiens
gcuugaaucuguguauauu

SEQ ID NO: 361767 - RNA, 19 nt, Homo sapiens
gagaagguguacaacuuuc

SEQ ID NO: 361768 - RNA, 19 nt, Homo sapiens
gaccgaaaguccacuaugg

SEQ ID NO: 361769 - RNA, 19 nt, Homo sapiens
ccaauuuccuuucagacuu

SEQ ID NO: 361770 - RNA, 19 nt, Homo sapiens
acaagaaggaucacucuaa

SEQ ID NO: 361771 - RNA, 19 nt, Homo sapiens
gacagaggcguucgaguuu

SEQ ID NO: 361772 - RNA, 19 nt, Homo sapiens
acagaauggugacuucaaa

SEQ ID NO: 361773 - RNA, 19 nt, Homo sapiens
gggccaagguacccaaaga

SEQ ID NO: 361774 - RNA, 19 nt, Homo sapiens
uggagaagguguacaacuu

SEQ ID NO: 361775 - RNA, 19 nt, Homo sapiens
caucggaaaugauucaaag

SEQ ID NO: 361776 - RNA, 19 nt, Homo sapiens
caagaaggaucacucuaac

SEQ ID NO: 361777 - RNA, 19 nt, Homo sapiens
gaaaacgucccagagauua

SEQ ID NO: 361778 - RNA, 19 nt, Homo sapiens
ugucaaugccguuacuuua

SEQ ID NO: 361779 - RNA, 19 nt, Homo sapiens
aaacagaugauucacaaga

SEQ ID NO: 361780 - RNA, 19 nt, Homo sapiens
ccaacaauuuccacauuca

SEQ ID NO: 361781 - RNA, 19 nt, Homo sapiens
ggauauuuguggagagaau

SEQ ID NO: 361782 - RNA, 19 nt, Homo sapiens
ccacaaagacccauaucug

SEQ ID NO: 361783 - RNA, 19 nt, Homo sapiens
cagaggcguucgaguuuga

SEQ ID NO: 361784 - RNA, 19 nt, Homo sapiens
agauaugucuugucacuuc

SEQ ID NO: 361785 - RNA, 19 nt, Homo sapiens
gaaucuguguauauugaug

SEQ ID NO: 361786 - RNA, 19 nt, Homo sapiens
ggucaaacaauuagagaga

SEQ ID NO: 361787 - RNA, 19 nt, Homo sapiens
ugacauucaucaccgcaaa

SEQ ID NO: 361788 - RNA, 19 nt, Homo sapiens
gccguuacuuuaaauguug

SEQ ID NO: 361789 - RNA, 19 nt, Homo sapiens
gaaacuaagaaucaaguca

SEQ ID NO: 361790 - RNA, 19 nt, Homo sapiens
gcaacucucugaaauaccu

SEQ ID NO: 361791 - RNA, 19 nt, Homo sapiens
uuacggacaugaccgagaa

SEQ ID NO: 361792 - RNA, 19 nt, Homo sapiens
caaccaaggagauugaaga

SEQ ID NO: 361793 - RNA, 19 nt, Homo sapiens
ggagggaguuucgaaccuu

SEQ ID NO: 361794 - RNA, 19 nt, Homo sapiens
gagaacagcaacagaaugg

SEQ ID NO: 361795 - RNA, 19 nt, Homo sapiens
ucaucuccguugacuauaa

SEQ ID NO: 361796 - RNA, 19 nt, Homo sapiens
caaaucaaagcaaugaaga

SEQ ID NO: 361797 - RNA, 19 nt, Homo sapiens
cagcugccauccaugacua

SEQ ID NO: 361798 - RNA, 19 nt, Homo sapiens
caagaaggaagcagaggaa

SEQ ID NO: 361799 - RNA, 19 nt, Homo sapiens
ggagaaggccaagaaggaa

SEQ ID NO: 361800 - RNA, 19 nt, Homo sapiens
uuucgaaccuugguaauug

SEQ ID NO: 361801 - RNA, 19 nt, Homo sapiens
acuggagaaucaccauuua

SEQ ID NO: 361802 - RNA, 19 nt, Homo sapiens
gggcugaggaaauauaaga

SEQ ID NO: 361803 - RNA, 19 nt, Homo sapiens
gcuauucuguauaaugaca

SEQ ID NO: 361804 - RNA, 19 nt, Homo sapiens
gugcuugaaucuguguaua

SEQ ID NO: 361805 - RNA, 19 nt, Homo sapiens
gaugaugauuccagucucu

SEQ ID NO: 361806 - RNA, 19 nt, Homo sapiens
agaagaauuuggaauaugc

SEQ ID NO: 361807 - RNA, 19 nt, Homo sapiens
gucaaugccguuacuuuaa

SEQ ID NO: 361808 - RNA, 19 nt, Homo sapiens
gaaggggcauccucaaaau

SEQ ID NO: 361809 - RNA, 19 nt, Homo sapiens
uaacaucggaaaugauuca

SEQ ID NO: 361810 - RNA, 19 nt, Homo sapiens
ucacaaguagguuucauug

SEQ ID NO: 361811 - RNA, 19 nt, Homo sapiens
cagacagggugacagagaa

SEQ ID NO: 361812 - RNA, 19 nt, Homo sapiens
gugcauuaccuccucuaua

SEQ ID NO: 361813 - RNA, 19 nt, Homo sapiens
uuucugcacuugucucauu

SEQ ID NO: 361814 - RNA, 19 nt, Homo sapiens
aauggugacuucaaagaug

SEQ ID NO: 361815 - RNA, 19 nt, Homo sapiens
ggagaacagcaacagaaug

SEQ ID NO: 361816 - RNA, 19 nt, Homo sapiens
aaagacgucuggagaaacu

SEQ ID NO: 361817 - RNA, 19 nt, Homo sapiens
gacaugaccgagaagauug

SEQ ID NO: 361818 - RNA, 19 nt, Homo sapiens
ggagaaucaccauuuaagu

SEQ ID NO: 361819 - RNA, 19 nt, Homo sapiens
gaagguguacaacuuucaa

SEQ ID NO: 361820 - RNA, 19 nt, Homo sapiens
acucuaacaucggaaauga

SEQ ID NO: 361821 - RNA, 19 nt, Homo sapiens
gaauggugacuucaaagau

SEQ ID NO: 361822 - RNA, 19 nt, Homo sapiens
gaacaucccugacgcauau

SEQ ID NO: 361823 - RNA, 19 nt, Homo sapiens
ccaaugagaugaugaugua

SEQ ID NO: 361824 - RNA, 19 nt, Homo sapiens
gagcugaucuacaaagaau

SEQ ID NO: 361825 - RNA, 19 nt, Homo sapiens
caacaucuuugaucauuuc

SEQ ID NO: 361826 - RNA, 19 nt, Homo sapiens
gaggucagcuuucccuuga

SEQ ID NO: 361827 - RNA, 19 nt, Homo sapiens
gacaauccaugcucuaaga

SEQ ID NO: 361828 - RNA, 19 nt, Homo sapiens
ucacggagacuuuguaauu

SEQ ID NO: 361829 - RNA, 19 nt, Homo sapiens
gcacaggggugaccaauga

SEQ ID NO: 361830 - RNA, 19 nt, Homo sapiens
ucaaggaccuccagaagau

SEQ ID NO: 361831 - RNA, 19 nt, Homo sapiens
cgagaucuuugccuuguuu

SEQ ID NO: 361832 - RNA, 19 nt, Homo sapiens
cagaggcuauggaauguuu

SEQ ID NO: 361833 - RNA, 19 nt, Homo sapiens
gcaacaucuuugaucauuu

SEQ ID NO: 361834 - RNA, 19 nt, Homo sapiens
ucgcggagcugaucuacaa

SEQ ID NO: 361835 - RNA, 19 nt, Homo sapiens
aacagaaacucaaguguga

SEQ ID NO: 361836 - RNA, 19 nt, Homo sapiens
auaccaaacuucuccauga

SEQ ID NO: 361837 - RNA, 19 nt, Homo sapiens
ugaguugccuuuagagaga

SEQ ID NO: 361838 - RNA, 19 nt, Homo sapiens
cugagcagcuugaugguuu

SEQ ID NO: 361839 - RNA, 19 nt, Homo sapiens
gcuggaagacuacgagaaa

SEQ ID NO: 361840 - RNA, 19 nt, Homo sapiens
cagcagaggcuauggaaug

SEQ ID NO: 361841 - RNA, 19 nt, Homo sapiens
cguggcagcugucaucuug

SEQ ID NO: 361842 - RNA, 19 nt, Homo sapiens
gaaacaguccuuaguucug

SEQ ID NO: 361843 - RNA, 19 nt, Homo sapiens
cacggagacuuuguaauuu

SEQ ID NO: 361844 - RNA, 19 nt, Homo sapiens
gaucuuugccuuguuuauu

SEQ ID NO: 361845 - RNA, 19 nt, Homo sapiens
gugugacccuggacaagua

SEQ ID NO: 361846 - RNA, 19 nt, Homo sapiens
gcuaccugcucuacaagaa

SEQ ID NO: 361847 - RNA, 19 nt, Homo sapiens
gugcaacugucguauaugg

SEQ ID NO: 361848 - RNA, 19 nt, Homo sapiens
gcugcaacaucuuugauca

SEQ ID NO: 361849 - RNA, 19 nt, Homo sapiens
ccaacuaccucgaggacau

SEQ ID NO: 361850 - RNA, 19 nt, Homo sapiens
gcauaugcccauccgcuuu

SEQ ID NO: 361851 - RNA, 19 nt, Homo sapiens
gcaaugggcugggcuucuc

SEQ ID NO: 361852 - RNA, 19 nt, Homo sapiens
gcugaccgcuuuguacaug

SEQ ID NO: 361853 - RNA, 19 nt, Homo sapiens
gagacaggcccagguauga

SEQ ID NO: 361854 - RNA, 19 nt, Homo sapiens
gcaacaggccgauggagau

SEQ ID NO: 361855 - RNA, 19 nt, Homo sapiens
uggaaacugucuacaccua

SEQ ID NO: 361856 - RNA, 19 nt, Homo sapiens
ugccuuaccuuucugaguu

SEQ ID NO: 361857 - RNA, 19 nt, Homo sapiens
ggagacaggcccagguaug

SEQ ID NO: 361858 - RNA, 19 nt, Homo sapiens
gaagcaggaugggauugau

SEQ ID NO: 361859 - RNA, 19 nt, Homo sapiens
gaggaccacuacuauacug

SEQ ID NO: 361860 - RNA, 19 nt, Homo sapiens
caaggugucccacaaguuc

SEQ ID NO: 361861 - RNA, 19 nt, Homo sapiens
uggccgagcuggugaacaa

SEQ ID NO: 361862 - RNA, 19 nt, Homo sapiens
ggaaacaguccuuaguucu

SEQ ID NO: 361863 - RNA, 19 nt, Homo sapiens
caccagaucuuugcuccuu

SEQ ID NO: 361864 - RNA, 19 nt, Homo sapiens
accaagggcuggaagacua

SEQ ID NO: 361865 - RNA, 19 nt, Homo sapiens
cgacggccuucuccaucua

SEQ ID NO: 361866 - RNA, 19 nt, Homo sapiens
gcuagaaggagacuuguuc

SEQ ID NO: 361867 - RNA, 19 nt, Homo sapiens
gcugagugauaaugaggaa

SEQ ID NO: 361868 - RNA, 19 nt, Homo sapiens
uggcagcgcucucuucaag

SEQ ID NO: 361869 - RNA, 19 nt, Homo sapiens
cgaggugccugaucuggau

SEQ ID NO: 361870 - RNA, 19 nt, Homo sapiens
caacaagcagcaccacaga

SEQ ID NO: 361871 - RNA, 19 nt, Homo sapiens
uggaaacaguccuuaguuc

SEQ ID NO: 361872 - RNA, 19 nt, Homo sapiens
ccaaagcggcagagcugua

SEQ ID NO: 361873 - RNA, 19 nt, Homo sapiens
gcacaaacaacucuuucca

SEQ ID NO: 361874 - RNA, 19 nt, Homo sapiens
cccauucucuccuauacaa

SEQ ID NO: 361875 - RNA, 19 nt, Homo sapiens
ggaaaguccgggaggcuau

SEQ ID NO: 361876 - RNA, 19 nt, Homo sapiens
ucaaagugcuccaauaccu

SEQ ID NO: 361877 - RNA, 19 nt, Homo sapiens
ccaccugccuuaccuuucu

SEQ ID NO: 361878 - RNA, 19 nt, Homo sapiens
ggagaagcaggaugggauu

SEQ ID NO: 361879 - RNA, 19 nt, Homo sapiens
gaccacuacuauacugaug

SEQ ID NO: 361880 - RNA, 19 nt, Homo sapiens
cagaugcacugggaacaga

SEQ ID NO: 361881 - RNA, 19 nt, Homo sapiens
ugcaacaucuuugaucauu

SEQ ID NO: 361882 - RNA, 19 nt, Homo sapiens
guggccagcugagugauaa

SEQ ID NO: 361883 - RNA, 19 nt, Homo sapiens
ccagaucuuugcuccuuuc

SEQ ID NO: 361884 - RNA, 19 nt, Homo sapiens
gaaggucuccgacgaugag

SEQ ID NO: 361885 - RNA, 19 nt, Homo sapiens
ggccaugguucagcaaguu

SEQ ID NO: 361886 - RNA, 19 nt, Homo sapiens
gugccaggcucuucuccaa

SEQ ID NO: 361887 - RNA, 19 nt, Homo sapiens
uacaacagcugcagagcau

SEQ ID NO: 361888 - RNA, 19 nt, Homo sapiens
gaggacaaucuccagcuuu

SEQ ID NO: 361889 - RNA, 19 nt, Homo sapiens
gcucaaagugcuccaauac

SEQ ID NO: 361890 - RNA, 19 nt, Homo sapiens
ggucaucggagacaaagug

SEQ ID NO: 361891 - RNA, 19 nt, Homo sapiens
ccaaacagggagcggguaa

SEQ ID NO: 361892 - RNA, 19 nt, Homo sapiens
gggaaggugagacaucuga

SEQ ID NO: 361893 - RNA, 19 nt, Homo sapiens
acggagacuuuguaauuug

SEQ ID NO: 361894 - RNA, 19 nt, Homo sapiens
gccaggcucuucuccaagu

SEQ ID NO: 361895 - RNA, 19 nt, Homo sapiens
ggaagacuacgagaaagau

SEQ ID NO: 361896 - RNA, 19 nt, Homo sapiens
ccacggcugcaacaucuuu

SEQ ID NO: 361897 - RNA, 19 nt, Homo sapiens
caucgcccauucucuccua

SEQ ID NO: 361898 - RNA, 19 nt, Homo sapiens
gcaucagcaucgcccauuc

SEQ ID NO: 361899 - RNA, 19 nt, Homo sapiens
agucccagcugguguguga

SEQ ID NO: 361900 - RNA, 19 nt, Homo sapiens
gaugaugagagcuaugaga

SEQ ID NO: 361901 - RNA, 19 nt, Homo sapiens
ccaccuggaugacgucucu

SEQ ID NO: 361902 - RNA, 19 nt, Homo sapiens
gaaggaacagaaacucaag

SEQ ID NO: 361903 - RNA, 19 nt, Homo sapiens
caacagcugcagagcaugu

SEQ ID NO: 361904 - RNA, 19 nt, Homo sapiens
agaaguccauccagcugaa

SEQ ID NO: 361905 - RNA, 19 nt, Homo sapiens
uuucugaguugccuuuaga

SEQ ID NO: 361906 - RNA, 19 nt, Homo sapiens
gaguguggcaucuuggaaa

SEQ ID NO: 361907 - RNA, 19 nt, Homo sapiens
ucagcuuucucgucuguau

SEQ ID NO: 361908 - RNA, 19 nt, Homo sapiens
gcugaucuacaaagaauuc

SEQ ID NO: 361909 - RNA, 19 nt, Homo sapiens
gaccacagaggcacaaaca

SEQ ID NO: 361910 - RNA, 19 nt, Homo sapiens
gcaaggucaucggagacaa

SEQ ID NO: 361911 - RNA, 19 nt, Homo sapiens
gacaaucuccagcuuucuu

SEQ ID NO: 361912 - RNA, 19 nt, Homo sapiens
gcuuuguacaugagaauaa

SEQ ID NO: 361913 - RNA, 19 nt, Homo sapiens
gagccaacccugagugucu

SEQ ID NO: 361914 - RNA, 19 nt, Homo sapiens
uaacaacucgcuggacuuc

SEQ ID NO: 361915 - RNA, 19 nt, Homo sapiens
ggagcugaucuacaaagaa

SEQ ID NO: 361916 - RNA, 19 nt, Homo sapiens
gaggacaucgagaucuuug

SEQ ID NO: 361917 - RNA, 19 nt, Homo sapiens
caaggucaucggagacaaa

SEQ ID NO: 361918 - RNA, 19 nt, Homo sapiens
gaaugagccagccaugcuu

SEQ ID NO: 361919 - RNA, 19 nt, Homo sapiens
ggacggcggaagaccagaa

SEQ ID NO: 361920 - RNA, 19 nt, Homo sapiens
ccacagaggcacaaacaac

SEQ ID NO: 361921 - RNA, 19 nt, Homo sapiens
accuggagcucaccaacua

SEQ ID NO: 361922 - RNA, 19 nt, Homo sapiens
ggaaauaugugguagagaa

SEQ ID NO: 361923 - RNA, 19 nt, Homo sapiens
gcaaaugacugaauacaug

SEQ ID NO: 361924 - RNA, 19 nt, Homo sapiens
ucacaacacuguagaaauu

SEQ ID NO: 361925 - RNA, 19 nt, Homo sapiens
ggaagaaagucauugaaga

SEQ ID NO: 361926 - RNA, 19 nt, Homo sapiens
gaagauaucccgguguuua

SEQ ID NO: 361927 - RNA, 19 nt, Homo sapiens
cagaauagcuguagcaaau

SEQ ID NO: 361928 - RNA, 19 nt, Homo sapiens
gaauagcuguagcaaauga

SEQ ID NO: 361929 - RNA, 19 nt, Homo sapiens
gauagccugugucuucuua

SEQ ID NO: 361930 - RNA, 19 nt, Homo sapiens
gcacacacauacacacuga

SEQ ID NO: 361931 - RNA, 19 nt, Homo sapiens
gagauuggauauagggaua

SEQ ID NO: 361932 - RNA, 19 nt, Homo sapiens
gcagugacauuguacagaa

SEQ ID NO: 361933 - RNA, 19 nt, Homo sapiens
gaauacaugugaacaaaca

SEQ ID NO: 361934 - RNA, 19 nt, Homo sapiens
gaaaccaaaucacaaagga

SEQ ID NO: 361935 - RNA, 19 nt, Homo sapiens
ggaagaagaagaagagaaa

SEQ ID NO: 361936 - RNA, 19 nt, Homo sapiens
ccacugaccugaagaaaca

SEQ ID NO: 361937 - RNA, 19 nt, Homo sapiens
ggaugucacucaacuaaga

SEQ ID NO: 361938 - RNA, 19 nt, Homo sapiens
acagugagguacauuguua

SEQ ID NO: 361939 - RNA, 19 nt, Homo sapiens
caagguaaaugaugauguu

SEQ ID NO: 361940 - RNA, 19 nt, Homo sapiens
uauauaagcucccacauag

SEQ ID NO: 361941 - RNA, 19 nt, Homo sapiens
guauaaaguuggcugauau

SEQ ID NO: 361942 - RNA, 19 nt, Homo sapiens
caaauuuaauggcaaggua

SEQ ID NO: 361943 - RNA, 19 nt, Homo sapiens
aaauguagguuaccaacua

SEQ ID NO: 361944 - RNA, 19 nt, Homo sapiens
ugacacaacugccaaacaa

SEQ ID NO: 361945 - RNA, 19 nt, Homo sapiens
gcacacagcucaccuucca

SEQ ID NO: 361946 - RNA, 19 nt, Homo sapiens
gaacagauccaggcuauca

SEQ ID NO: 361947 - RNA, 19 nt, Homo sapiens
ugacagcagugacauugua

SEQ ID NO: 361948 - RNA, 19 nt, Homo sapiens
gguauuacauuacugcuau

SEQ ID NO: 361949 - RNA, 19 nt, Homo sapiens
aaaguuggcugauaucaau

SEQ ID NO: 361950 - RNA, 19 nt, Homo sapiens
caaguuaccucugauuaug

SEQ ID NO: 361951 - RNA, 19 nt, Homo sapiens
gaggaaaccugugaaaaua

SEQ ID NO: 361952 - RNA, 19 nt, Homo sapiens
uaauuaaccuugaccaugu

SEQ ID NO: 361953 - RNA, 19 nt, Homo sapiens
ggaccucccugcccuguau

SEQ ID NO: 361954 - RNA, 19 nt, Homo sapiens
agagaaggcuugggaaauu

SEQ ID NO: 361955 - RNA, 19 nt, Homo sapiens
cagaagggaugguuugaga

SEQ ID NO: 361956 - RNA, 19 nt, Homo sapiens
guauauaagcucccacaua

SEQ ID NO: 361957 - RNA, 19 nt, Homo sapiens
aaauguggccguauucuua

SEQ ID NO: 361958 - RNA, 19 nt, Homo sapiens
gccagaguauaacuucuua

SEQ ID NO: 361959 - RNA, 19 nt, Homo sapiens
gacaguggauuuacacaug

SEQ ID NO: 361960 - RNA, 19 nt, Homo sapiens
gaacaagcccguccacagu

SEQ ID NO: 361961 - RNA, 19 nt, Homo sapiens
ccaaacagauugacuuguc

SEQ ID NO: 361962 - RNA, 19 nt, Homo sapiens
gauccaggcuaucaaggaa

SEQ ID NO: 361963 - RNA, 19 nt, Homo sapiens
gggaagcgcucguccagau

SEQ ID NO: 361964 - RNA, 19 nt, Homo sapiens
cguauaaugugacagauga

SEQ ID NO: 361965 - RNA, 19 nt, Homo sapiens
ucucaacugugauuaauga

SEQ ID NO: 361966 - RNA, 19 nt, Homo sapiens
gccugugucuucuuaauuu

SEQ ID NO: 361967 - RNA, 19 nt, Homo sapiens
ggugauagccugugucuuc

SEQ ID NO: 361968 - RNA, 19 nt, Homo sapiens
gaagaggaaaccugugaaa

SEQ ID NO: 361969 - RNA, 19 nt, Homo sapiens
ucagguaucuuacagacuu

SEQ ID NO: 361970 - RNA, 19 nt, Homo sapiens
gauagaaugggcuguguuu

SEQ ID NO: 361971 - RNA, 19 nt, Homo sapiens
cagaacagauccaggcuau

SEQ ID NO: 361972 - RNA, 19 nt, Homo sapiens
ccaaagcgccugagaagga

SEQ ID NO: 361973 - RNA, 19 nt, Homo sapiens
gagaaggcuugggaaauug

SEQ ID NO: 361974 - RNA, 19 nt, Homo sapiens
gcauuuagaucacaacacu

SEQ ID NO: 361975 - RNA, 19 nt, Homo sapiens
gaagagaaagggaaaccaa

SEQ ID NO: 361976 - RNA, 19 nt, Homo sapiens
gcagugcaguuuccagaau

SEQ ID NO: 361977 - RNA, 19 nt, Homo sapiens
gaacaaacagaaggaaguu

SEQ ID NO: 361978 - RNA, 19 nt, Homo sapiens
gguaaaugaugauguugga

SEQ ID NO: 361979 - RNA, 19 nt, Homo sapiens
gauaaccuggacucaauua

SEQ ID NO: 361980 - RNA, 19 nt, Homo sapiens
gcagauccuuuacuucauc

SEQ ID NO: 361981 - RNA, 19 nt, Homo sapiens
ggaauaauccagugaugau

SEQ ID NO: 361982 - RNA, 19 nt, Homo sapiens
ggccacguguuugguauua

SEQ ID NO: 361983 - RNA, 19 nt, Homo sapiens
uguagcaaaugacugaaua

SEQ ID NO: 361984 - RNA, 19 nt, Homo sapiens
ugaaaguuccagagcauua

SEQ ID NO: 361985 - RNA, 19 nt, Homo sapiens
gaugaaaguuccagagcau

SEQ ID NO: 361986 - RNA, 19 nt, Homo sapiens
gaaauaugugguagagaaa

SEQ ID NO: 361987 - RNA, 19 nt, Homo sapiens
uaggaacugucuaugagua

SEQ ID NO: 361988 - RNA, 19 nt, Homo sapiens
gaagaaagucauugaagag

SEQ ID NO: 361989 - RNA, 19 nt, Homo sapiens
ggaugucugucugggaaua

SEQ ID NO: 361990 - RNA, 19 nt, Homo sapiens
gaagucaggucuuuuaauc

SEQ ID NO: 361991 - RNA, 19 nt, Homo sapiens
cuacuugccuaaugaaugu

SEQ ID NO: 361992 - RNA, 19 nt, Homo sapiens
aaacagugcaggaaaugua

SEQ ID NO: 361993 - RNA, 19 nt, Homo sapiens
gcuaaaauuucaccucuuu

SEQ ID NO: 361994 - RNA, 19 nt, Homo sapiens
gaugaugacccucaccaaa

SEQ ID NO: 361995 - RNA, 19 nt, Homo sapiens
ccagguacguggaacaaau

SEQ ID NO: 361996 - RNA, 19 nt, Homo sapiens
gaggagauaccaacccaaa

SEQ ID NO: 361997 - RNA, 19 nt, Homo sapiens
uguauaaaguuggcugaua

SEQ ID NO: 361998 - RNA, 19 nt, Homo sapiens
gggauggcauucuuuauac

SEQ ID NO: 361999 - RNA, 19 nt, Homo sapiens
ucacucaacuaagaucaaa

SEQ ID NO: 362000 - RNA, 19 nt, Homo sapiens
ccagagcauuauuugaauu

SEQ ID NO: 362001 - RNA, 19 nt, Homo sapiens
gacuaaugcuuuccugguu

SEQ ID NO: 362002 - RNA, 19 nt, Homo sapiens
gaugacacugcucaaguua

SEQ ID NO: 362003 - RNA, 19 nt, Homo sapiens
ggaggcaggcuauuccaaa

SEQ ID NO: 362004 - RNA, 19 nt, Homo sapiens
guacguggaacaaaucuug

SEQ ID NO: 362005 - RNA, 19 nt, Homo sapiens
gaucacaacacuguagaaa

SEQ ID NO: 362006 - RNA, 19 nt, Homo sapiens
gcacaagcauuuagaucac

SEQ ID NO: 362007 - RNA, 19 nt, Homo sapiens
caagccagcacaagcauuu

SEQ ID NO: 362008 - RNA, 19 nt, Homo sapiens
ccaggccucucaacuguga

SEQ ID NO: 362009 - RNA, 19 nt, Homo sapiens
uggagcagcuaaauacuug

SEQ ID NO: 362010 - RNA, 19 nt, Homo sapiens
uggauaaccuggacucaau

SEQ ID NO: 362011 - RNA, 19 nt, Homo sapiens
cguguuugguauuacauua

SEQ ID NO: 362012 - RNA, 19 nt, Homo sapiens
gagaugguguggcuuagca

SEQ ID NO: 362013 - RNA, 19 nt, Homo sapiens
uaucaaugguccagcuaaa

SEQ ID NO: 362014 - RNA, 19 nt, Homo sapiens
gaggcaggcuauuccaaau

SEQ ID NO: 362015 - RNA, 19 nt, Homo sapiens
uaaaggaaaccaaaucaca

SEQ ID NO: 362016 - RNA, 19 nt, Homo sapiens
uaugggauauguauucuca

SEQ ID NO: 362017 - RNA, 19 nt, Homo sapiens
gauuaaugaucaugguuca

SEQ ID NO: 362018 - RNA, 19 nt, Homo sapiens
caugcuguuugguaucuua

SEQ ID NO: 362019 - RNA, 19 nt, Homo sapiens
gcagcuaaauacuuggaau

SEQ ID NO: 362020 - RNA, 19 nt, Homo sapiens
ggaagacagcgaugaguca

SEQ ID NO: 362021 - RNA, 19 nt, Homo sapiens
gcugcugcauggaaucuuu

SEQ ID NO: 362022 - RNA, 19 nt, Homo sapiens
ugaagacggugaagaauua

SEQ ID NO: 362023 - RNA, 19 nt, Homo sapiens
gaauacaacuuccuucuuc

SEQ ID NO: 362024 - RNA, 19 nt, Homo sapiens
gacaucaaaugcugaaaua

SEQ ID NO: 362025 - RNA, 19 nt, Homo sapiens
gaacagcaaacaaauauug

SEQ ID NO: 362026 - RNA, 19 nt, Homo sapiens
ucaagacacugguuuauug

SEQ ID NO: 362027 - RNA, 19 nt, Homo sapiens
aaacauuccugcauuagaa

SEQ ID NO: 362028 - RNA, 19 nt, Homo sapiens
gaucacuucuuucaaauca

SEQ ID NO: 362029 - RNA, 19 nt, Homo sapiens
gcagggagaugaagaagca

SEQ ID NO: 362030 - RNA, 19 nt, Homo sapiens
gcaucaaacuggcagauau

SEQ ID NO: 362031 - RNA, 19 nt, Homo sapiens
cagcugccaugcaugauua

SEQ ID NO: 362032 - RNA, 19 nt, Homo sapiens
gcaaaggucaucuucugua

SEQ ID NO: 362033 - RNA, 19 nt, Homo sapiens
ggagagaaaucaggaagga

SEQ ID NO: 362034 - RNA, 19 nt, Homo sapiens
uauggaaacucaacaagaa

SEQ ID NO: 362035 - RNA, 19 nt, Homo sapiens
caaggcaaaugauguaaau

SEQ ID NO: 362036 - RNA, 19 nt, Homo sapiens
gaacaggaaaugaaacaga

SEQ ID NO: 362037 - RNA, 19 nt, Homo sapiens
caaggaugcuaucuaaaug

SEQ ID NO: 362038 - RNA, 19 nt, Homo sapiens
ggaaauggaguugaucuuu

SEQ ID NO: 362039 - RNA, 19 nt, Homo sapiens
gcgaauugcuuauauuucu

SEQ ID NO: 362040 - RNA, 19 nt, Homo sapiens
uacagaagaugaagaaaug

SEQ ID NO: 362041 - RNA, 19 nt, Homo sapiens
guucgagacuugcauuuga

SEQ ID NO: 362042 - RNA, 19 nt, Homo sapiens
gaaaauggcuaucgagaca

SEQ ID NO: 362043 - RNA, 19 nt, Homo sapiens
agucaaggaugcuaucuaa

SEQ ID NO: 362044 - RNA, 19 nt, Homo sapiens
cacaagauauggaaggaaa

SEQ ID NO: 362045 - RNA, 19 nt, Homo sapiens
gaacuauuuucgugcauua

SEQ ID NO: 362046 - RNA, 19 nt, Homo sapiens
gcaaacaaauauugaacag

SEQ ID NO: 362047 - RNA, 19 nt, Homo sapiens
uaacagcuguggacaucaa

SEQ ID NO: 362048 - RNA, 19 nt, Homo sapiens
caaaggucaucuucuguau

SEQ ID NO: 362049 - RNA, 19 nt, Homo sapiens
cagaugagauucagguaau

SEQ ID NO: 362050 - RNA, 19 nt, Homo sapiens
ugaaaguggugaugaugaa

SEQ ID NO: 362051 - RNA, 19 nt, Homo sapiens
cagaagagcugguguuuug

SEQ ID NO: 362052 - RNA, 19 nt, Homo sapiens
caaaaggccucaccaagaa

SEQ ID NO: 362053 - RNA, 19 nt, Homo sapiens
gaaagacagcagaaaauua

SEQ ID NO: 362054 - RNA, 19 nt, Homo sapiens
gcaauauggugucagaucu

SEQ ID NO: 362055 - RNA, 19 nt, Homo sapiens
ccauguaggucucagaaga

SEQ ID NO: 362056 - RNA, 19 nt, Homo sapiens
uaaaugaggcucgcaauau

SEQ ID NO: 362057 - RNA, 19 nt, Homo sapiens
gaaggaaaucguagaggaa

SEQ ID NO: 362058 - RNA, 19 nt, Homo sapiens
gcagaagaggauaaugaua

SEQ ID NO: 362059 - RNA, 19 nt, Homo sapiens
caaacuggcagauauaaau

SEQ ID NO: 362060 - RNA, 19 nt, Homo sapiens
agacauuccuuaucacaau

SEQ ID NO: 362061 - RNA, 19 nt, Homo sapiens
aaaugaggcucgcaauaug

SEQ ID NO: 362062 - RNA, 19 nt, Homo sapiens
gcagaugagauucagguaa

SEQ ID NO: 362063 - RNA, 19 nt, Homo sapiens
caggaaggauucucaguca

SEQ ID NO: 362064 - RNA, 19 nt, Homo sapiens
ugaaucagaugguacagau

SEQ ID NO: 362065 - RNA, 19 nt, Homo sapiens
ucuacuggcucucuaacua

SEQ ID NO: 362066 - RNA, 19 nt, Homo sapiens
ggauaaugauacugaaagu

SEQ ID NO: 362067 - RNA, 19 nt, Homo sapiens
caacuuccuucuucaucuu

SEQ ID NO: 362068 - RNA, 19 nt, Homo sapiens
gcacagagugaacagcaaa

SEQ ID NO: 362069 - RNA, 19 nt, Homo sapiens
caucaaaugcugaaauaug

SEQ ID NO: 362070 - RNA, 19 nt, Homo sapiens
ggacaucaaaugcugaaau

SEQ ID NO: 362071 - RNA, 19 nt, Homo sapiens
gaaaggggauagaaaacuu

SEQ ID NO: 362072 - RNA, 19 nt, Homo sapiens
guaaagcugaugggaauaa

SEQ ID NO: 362073 - RNA, 19 nt, Homo sapiens
gaagaugaagaaauggaaa

SEQ ID NO: 362074 - RNA, 19 nt, Homo sapiens
ggcauagaauggaguaaug

SEQ ID NO: 362075 - RNA, 19 nt, Homo sapiens
gggcgaauugcuuauauuu

SEQ ID NO: 362076 - RNA, 19 nt, Homo sapiens
ucagucagguuauguauac

SEQ ID NO: 362077 - RNA, 19 nt, Homo sapiens
gaagaaagacagcagaaaa

SEQ ID NO: 362078 - RNA, 19 nt, Homo sapiens
acagauugcugcaguggaa

SEQ ID NO: 362079 - RNA, 19 nt, Homo sapiens
gaauuuggcauuucaaguc

SEQ ID NO: 362080 - RNA, 19 nt, Homo sapiens
gauauggaaggaaaucgua

SEQ ID NO: 362081 - RNA, 19 nt, Homo sapiens
gugaagaauuagauacaga

SEQ ID NO: 362082 - RNA, 19 nt, Homo sapiens
cuucaaacauuccugcauu

SEQ ID NO: 362083 - RNA, 19 nt, Homo sapiens
cccauagaauuuccugaua

SEQ ID NO: 362084 - RNA, 19 nt, Homo sapiens
ucaaggaugcuaucuaaau

SEQ ID NO: 362085 - RNA, 19 nt, Homo sapiens
acaagggacuaaauaggaa

SEQ ID NO: 362086 - RNA, 19 nt, Homo sapiens
gaccgucguugccuuguau

SEQ ID NO: 362087 - RNA, 19 nt, Homo sapiens
caucaaacuggcagauaua

SEQ ID NO: 362088 - RNA, 19 nt, Homo sapiens
gugaacagcaaacaaauau

SEQ ID NO: 362089 - RNA, 19 nt, Homo sapiens
aaauggaguugaucuuuca

SEQ ID NO: 362090 - RNA, 19 nt, Homo sapiens
cagaagaggcacagaguga

SEQ ID NO: 362091 - RNA, 19 nt, Homo sapiens
auaaguggcuaacagaaga

SEQ ID NO: 362092 - RNA, 19 nt, Homo sapiens
aagcaaaggucaucuucug

SEQ ID NO: 362093 - RNA, 19 nt, Homo sapiens
gcccaucaguccauucaug

SEQ ID NO: 362094 - RNA, 19 nt, Homo sapiens
gacacugguuuauuggaaa

SEQ ID NO: 362095 - RNA, 19 nt, Homo sapiens
gcaaaaggccucaccaaga

SEQ ID NO: 362096 - RNA, 19 nt, Homo sapiens
uuggaucacuucuuucaaa

SEQ ID NO: 362097 - RNA, 19 nt, Homo sapiens
ggaaaucguagaggaagaa

SEQ ID NO: 362098 - RNA, 19 nt, Homo sapiens
gcaguuugguaucugacaa

SEQ ID NO: 362099 - RNA, 19 nt, Homo sapiens
aaggucaucuucuguauca

SEQ ID NO: 362100 - RNA, 19 nt, Homo sapiens
aagcagacggcgaauauuu

SEQ ID NO: 362101 - RNA, 19 nt, Homo sapiens
ggcaaaugauguaaauagu

SEQ ID NO: 362102 - RNA, 19 nt, Homo sapiens
cagcagauccacaaugguu

SEQ ID NO: 362103 - RNA, 19 nt, Homo sapiens
ggugauaaguggcuaacag

SEQ ID NO: 362104 - RNA, 19 nt, Homo sapiens
gagaagaaagacagcagaa

SEQ ID NO: 362105 - RNA, 19 nt, Homo sapiens
aaaaucaggugaagaagaa

SEQ ID NO: 362106 - RNA, 19 nt, Homo sapiens
caccuaauacuccagauuu

SEQ ID NO: 362107 - RNA, 19 nt, Homo sapiens
caaggugggaucguaauaa

SEQ ID NO: 362108 - RNA, 19 nt, Homo sapiens
cuuaaugggugcuuucuca

SEQ ID NO: 362109 - RNA, 19 nt, Homo sapiens
cuaaaugaggcucgcaaua

SEQ ID NO: 362110 - RNA, 19 nt, Homo sapiens
agaggcagaugaagaggaa

SEQ ID NO: 362111 - RNA, 19 nt, Homo sapiens
uaaagcugaugggaauaaa

SEQ ID NO: 362112 - RNA, 19 nt, Homo sapiens
gaauucaagcgcuuucguu

SEQ ID NO: 362113 - RNA, 19 nt, Homo sapiens
agacacugguuuauuggaa

SEQ ID NO: 362114 - RNA, 19 nt, Homo sapiens
cucaggaacuucaggauug

SEQ ID NO: 362115 - RNA, 19 nt, Homo sapiens
uuaauccucucacaccauu

SEQ ID NO: 362116 - RNA, 19 nt, Homo sapiens
aagcagaagaggauaauga

SEQ ID NO: 362117 - RNA, 19 nt, Homo sapiens
cgaccuggcugccuuuguc

SEQ ID NO: 362118 - RNA, 19 nt, Homo sapiens
ucaaacuuauggaaacuca

SEQ ID NO: 362119 - RNA, 19 nt, Homo sapiens
gcaccuaauacuccagauu

SEQ ID NO: 362120 - RNA, 19 nt, Homo sapiens
ccauagaauuuccugauac

SEQ ID NO: 362121 - RNA, 19 nt, Homo sapiens
aaacuuaacaagggacuaa

SEQ ID NO: 362122 - RNA, 19 nt, Homo sapiens
gaaaccaggucucagagua

SEQ ID NO: 362123 - RNA, 19 nt, Homo sapiens
gaucuugucuccaauuaaa

SEQ ID NO: 362124 - RNA, 19 nt, Homo sapiens
ggaagaggaggaagaaaua

SEQ ID NO: 362125 - RNA, 19 nt, Homo sapiens
caacauuccuggacaaaca

SEQ ID NO: 362126 - RNA, 19 nt, Homo sapiens
gaagaccgaucaagaagag

SEQ ID NO: 362127 - RNA, 19 nt, Homo sapiens
ucacacaccugucagaaau

SEQ ID NO: 362128 - RNA, 19 nt, Homo sapiens
ggaggacccugucuguuuc

SEQ ID NO: 362129 - RNA, 19 nt, Homo sapiens
ccaagccgcuggagcugua

SEQ ID NO: 362130 - RNA, 19 nt, Homo sapiens
ccaauuaaaccgaggcuuu

SEQ ID NO: 362131 - RNA, 19 nt, Homo sapiens
ggacaacugcgacaucuuc

SEQ ID NO: 362132 - RNA, 19 nt, Homo sapiens
ucacucaccugcaucaugu

SEQ ID NO: 362133 - RNA, 19 nt, Homo sapiens
ggacaaacagaaugaagug

SEQ ID NO: 362134 - RNA, 19 nt, Homo sapiens
gaaagaaacacagcaacug

SEQ ID NO: 362135 - RNA, 19 nt, Homo sapiens
ucacggaccuggagauucu

SEQ ID NO: 362136 - RNA, 19 nt, Homo sapiens
gggaccugcugaagaaauu

SEQ ID NO: 362137 - RNA, 19 nt, Homo sapiens
caauaauccuucgaucuug

SEQ ID NO: 362138 - RNA, 19 nt, Homo sapiens
ucaauaauccuucgaucuu

SEQ ID NO: 362139 - RNA, 19 nt, Homo sapiens
uggagaaccugaacaagug

SEQ ID NO: 362140 - RNA, 19 nt, Homo sapiens
ggugaagaccgaucaagaa

SEQ ID NO: 362141 - RNA, 19 nt, Homo sapiens
cugaacaacucuaacauuc

SEQ ID NO: 362142 - RNA, 19 nt, Homo sapiens
ggacucaccgcuguuguuu

SEQ ID NO: 362143 - RNA, 19 nt, Homo sapiens
gggaagucgugucauccua

SEQ ID NO: 362144 - RNA, 19 nt, Homo sapiens
guacaggguucauauuuug

SEQ ID NO: 362145 - RNA, 19 nt, Homo sapiens
ggaggaagaaauaucaaug

SEQ ID NO: 362146 - RNA, 19 nt, Homo sapiens
gcuguucacuuuaggauac

SEQ ID NO: 362147 - RNA, 19 nt, Homo sapiens
cggcagagccuacgcaaga

SEQ ID NO: 362148 - RNA, 19 nt, Homo sapiens
ccacaacauuccuggacaa

SEQ ID NO: 362149 - RNA, 19 nt, Homo sapiens
gcaauacggcagacagaug

SEQ ID NO: 362150 - RNA, 19 nt, Homo sapiens
gaagcaauaaugguguaua

SEQ ID NO: 362151 - RNA, 19 nt, Homo sapiens
ggaauucgugguugcugua

SEQ ID NO: 362152 - RNA, 19 nt, Homo sapiens
gggcuuuucuucugaauuu

SEQ ID NO: 362153 - RNA, 19 nt, Homo sapiens
uggacacgauggugacaua

SEQ ID NO: 362154 - RNA, 19 nt, Homo sapiens
guaacagccugaacaacuc

SEQ ID NO: 362155 - RNA, 19 nt, Homo sapiens
gcacagcccaagaggcauu

SEQ ID NO: 362156 - RNA, 19 nt, Homo sapiens
caggagaucuuggacacuu

SEQ ID NO: 362157 - RNA, 19 nt, Homo sapiens
ucgaucuugucuccaauua

SEQ ID NO: 362158 - RNA, 19 nt, Homo sapiens
ggaggaagaggaggaagaa

SEQ ID NO: 362159 - RNA, 19 nt, Homo sapiens
gagcgggaccugcugaaga

SEQ ID NO: 362160 - RNA, 19 nt, Homo sapiens
ucuuguuucugccuuaaua

SEQ ID NO: 362161 - RNA, 19 nt, Homo sapiens
caggagucguuggaaguua

SEQ ID NO: 362162 - RNA, 19 nt, Homo sapiens
acacaccugucagaaauga

SEQ ID NO: 362163 - RNA, 19 nt, Homo sapiens
guacauuuccacaacauuc

SEQ ID NO: 362164 - RNA, 19 nt, Homo sapiens
uggaggacccugucuguuu

SEQ ID NO: 362165 - RNA, 19 nt, Homo sapiens
cgaggaagcucuggaugca

SEQ ID NO: 362166 - RNA, 19 nt, Homo sapiens
gaagaggaggaagaaauau

SEQ ID NO: 362167 - RNA, 19 nt, Homo sapiens
gaggacaacugcgacaucu

SEQ ID NO: 362168 - RNA, 19 nt, Homo sapiens
ccaaaucacaggguugaaa

SEQ ID NO: 362169 - RNA, 19 nt, Homo sapiens
ucuagaacguggucaggaa

SEQ ID NO: 362170 - RNA, 19 nt, Homo sapiens
cagaguacauuuccacaac

SEQ ID NO: 362171 - RNA, 19 nt, Homo sapiens
gagcguggcauggaaauca

SEQ ID NO: 362172 - RNA, 19 nt, Homo sapiens
gggcuaagucuccaagaug

SEQ ID NO: 362173 - RNA, 19 nt, Homo sapiens
guuucugccuuaauaauuc

SEQ ID NO: 362174 - RNA, 19 nt, Homo sapiens
uggcgauacugacuagaaa

SEQ ID NO: 362175 - RNA, 19 nt, Homo sapiens
acucaccgcuguuguuuua

SEQ ID NO: 362176 - RNA, 19 nt, Homo sapiens
guaccauaguccugggaaa

SEQ ID NO: 362177 - RNA, 19 nt, Homo sapiens
gagcaauacggcagacaga

SEQ ID NO: 362178 - RNA, 19 nt, Homo sapiens
gcccuaggaggaagcaaua

SEQ ID NO: 362179 - RNA, 19 nt, Homo sapiens
ccaaccaguuccucaucaa

SEQ ID NO: 362180 - RNA, 19 nt, Homo sapiens
ggccacgccugcacuagau

SEQ ID NO: 362181 - RNA, 19 nt, Homo sapiens
gacguggccuaccauaaca

SEQ ID NO: 362182 - RNA, 19 nt, Homo sapiens
acuguaagguugguuugua

SEQ ID NO: 362183 - RNA, 19 nt, Homo sapiens
gcacucacacucccuugau

SEQ ID NO: 362184 - RNA, 19 nt, Homo sapiens
cagcuggaccgaccucauu

SEQ ID NO: 362185 - RNA, 19 nt, Homo sapiens
ccugacaaguuccaguuug

SEQ ID NO: 362186 - RNA, 19 nt, Homo sapiens
cagcccaugucccaaauca

SEQ ID NO: 362187 - RNA, 19 nt, Homo sapiens
gaguacauuuccacaacau

SEQ ID NO: 362188 - RNA, 19 nt, Homo sapiens
cuguaagguugguuuguaa

SEQ ID NO: 362189 - RNA, 19 nt, Homo sapiens
gacagaugcaagaccauuu

SEQ ID NO: 362190 - RNA, 19 nt, Homo sapiens
cacuuuggguucacuuuga

SEQ ID NO: 362191 - RNA, 19 nt, Homo sapiens
aaauaucaauggcccagau

SEQ ID NO: 362192 - RNA, 19 nt, Homo sapiens
cugacaaguuccaguuuga

SEQ ID NO: 362193 - RNA, 19 nt, Homo sapiens
ucgguccguugaucaauaa

SEQ ID NO: 362194 - RNA, 19 nt, Homo sapiens
guguauacccucauucuca

SEQ ID NO: 362195 - RNA, 19 nt, Homo sapiens
gaggaagaaauaucaaugg

SEQ ID NO: 362196 - RNA, 19 nt, Homo sapiens
gggacuguuuggaaggaaa

SEQ ID NO: 362197 - RNA, 19 nt, Homo sapiens
aaagaaagaaacacagcaa

SEQ ID NO: 362198 - RNA, 19 nt, Homo sapiens
ugaggucccggaaggauuu

SEQ ID NO: 362199 - RNA, 19 nt, Homo sapiens
ggagaucuuggacacuuug

SEQ ID NO: 362200 - RNA, 19 nt, Homo sapiens
agucggugcucgagaauca

SEQ ID NO: 362201 - RNA, 19 nt, Homo sapiens
uaugggaagucgugucauc

SEQ ID NO: 362202 - RNA, 19 nt, Homo sapiens
aagcaauaaugguguauac

SEQ ID NO: 362203 - RNA, 19 nt, Homo sapiens
cauaguaacagccugaaca

SEQ ID NO: 362204 - RNA, 19 nt, Homo sapiens
aggaagcaauaauggugua

SEQ ID NO: 362205 - RNA, 19 nt, Homo sapiens
ccucgggccugggauuuga

SEQ ID NO: 362206 - RNA, 19 nt, Homo sapiens
agaagucucagguggguuu

SEQ ID NO: 362207 - RNA, 19 nt, Homo sapiens
guggagaccaagaaaguga

SEQ ID NO: 362208 - RNA, 19 nt, Homo sapiens
gaacuggagaaccugaaca

SEQ ID NO: 362209 - RNA, 19 nt, Homo sapiens
gggugaagaccgaucaaga

SEQ ID NO: 362210 - RNA, 19 nt, Homo sapiens
guaagguugguuuguaaau

SEQ ID NO: 362211 - RNA, 19 nt, Homo sapiens
aaagucuuccgcuugauuu

SEQ ID NO: 362212 - RNA, 19 nt, Homo sapiens
gcccaugucccaaaucaca

SEQ ID NO: 362213 - RNA, 19 nt, Homo sapiens
ccucugcccuggcucuuca

SEQ ID NO: 362214 - RNA, 19 nt, Homo sapiens
uggcugaccugaagaccau

SEQ ID NO: 362215 - RNA, 19 nt, Homo sapiens
acacgauggugacauacau

SEQ ID NO: 362216 - RNA, 19 nt, Homo sapiens
aauaauccuucgaucuugu

SEQ ID NO: 362217 - RNA, 19 nt, Homo sapiens
gcuuguguauuguccacuu

SEQ ID NO: 362218 - RNA, 19 nt, Homo sapiens
cucuguuccugcuguauua

SEQ ID NO: 362219 - RNA, 19 nt, Homo sapiens
ucuugucccuccugagaaa

SEQ ID NO: 362220 - RNA, 19 nt, Homo sapiens
guggagacccuaccugauc

SEQ ID NO: 362221 - RNA, 19 nt, Homo sapiens
ggaggacaacugcgacauc

SEQ ID NO: 362222 - RNA, 19 nt, Homo sapiens
caccaaagcuucacucaua

SEQ ID NO: 362223 - RNA, 19 nt, Homo sapiens
ucacaucugucacuuaauu

SEQ ID NO: 362224 - RNA, 19 nt, Homo sapiens
gcuaucauauucagcauuu

SEQ ID NO: 362225 - RNA, 19 nt, Homo sapiens
ggaaccagguguccgagua

SEQ ID NO: 362226 - RNA, 19 nt, Homo sapiens
ggacgggccugacagauuc

SEQ ID NO: 362227 - RNA, 19 nt, Homo sapiens
ccacagacauguccaaaca

SEQ ID NO: 362228 - RNA, 19 nt, Homo sapiens
caaucaagcucuuaguuau

SEQ ID NO: 362229 - RNA, 19 nt, Homo sapiens
gcagugagccgacaucaug

SEQ ID NO: 362230 - RNA, 19 nt, Homo sapiens
agagacagcuuuagccaaa

SEQ ID NO: 362231 - RNA, 19 nt, Homo sapiens
ggaguugccugacacugaa

SEQ ID NO: 362232 - RNA, 19 nt, Homo sapiens
ccaaccaguuucugauuaa

SEQ ID NO: 362233 - RNA, 19 nt, Homo sapiens
ccucacagcuaucauauuc

SEQ ID NO: 362234 - RNA, 19 nt, Homo sapiens
gcaagagcauggaaaugug

SEQ ID NO: 362235 - RNA, 19 nt, Homo sapiens
ggaagaggaugaggaggaa

SEQ ID NO: 362236 - RNA, 19 nt, Homo sapiens
gcaggagaaucacuugaau

SEQ ID NO: 362237 - RNA, 19 nt, Homo sapiens
ggagaggacaugauuguga

SEQ ID NO: 362238 - RNA, 19 nt, Homo sapiens
gaauccaggucuugcagaa

SEQ ID NO: 362239 - RNA, 19 nt, Homo sapiens
ggcagaagcuggcauugga

SEQ ID NO: 362240 - RNA, 19 nt, Homo sapiens
gagauggccuccaacaagu

SEQ ID NO: 362241 - RNA, 19 nt, Homo sapiens
agucacaucugucacuuaa

SEQ ID NO: 362242 - RNA, 19 nt, Homo sapiens
acaaucaagcucuuaguua

SEQ ID NO: 362243 - RNA, 19 nt, Homo sapiens
ggcaaggcauaguggcuua

SEQ ID NO: 362244 - RNA, 19 nt, Homo sapiens
gaaaagagaaggaaaggaa

SEQ ID NO: 362245 - RNA, 19 nt, Homo sapiens
caaagaggccuuggaguug

SEQ ID NO: 362246 - RNA, 19 nt, Homo sapiens
aauccuggcugcccucuuu

SEQ ID NO: 362247 - RNA, 19 nt, Homo sapiens
uccaaccaguuucugauua

SEQ ID NO: 362248 - RNA, 19 nt, Homo sapiens
gaggugggaggacugcuua

SEQ ID NO: 362249 - RNA, 19 nt, Homo sapiens
ccugacagauuccaguuug

SEQ ID NO: 362250 - RNA, 19 nt, Homo sapiens
gaaaccccaucucuacuaa

SEQ ID NO: 362251 - RNA, 19 nt, Homo sapiens
acgaugcccuggugucuuu

SEQ ID NO: 362252 - RNA, 19 nt, Homo sapiens
ggagacaaucaagcucuua

SEQ ID NO: 362253 - RNA, 19 nt, Homo sapiens
gagaaggaaaggaaagaga

SEQ ID NO: 362254 - RNA, 19 nt, Homo sapiens
gcaggaagaggagcagaaa

SEQ ID NO: 362255 - RNA, 19 nt, Homo sapiens
ucacuuucccacccauuua

SEQ ID NO: 362256 - RNA, 19 nt, Homo sapiens
cagacacacuggccaccua

SEQ ID NO: 362257 - RNA, 19 nt, Homo sapiens
gagcgggaccugcugaaga

SEQ ID NO: 362258 - RNA, 19 nt, Homo sapiens
gacaaucaagcucuuaguu

SEQ ID NO: 362259 - RNA, 19 nt, Homo sapiens
ccauguggcuccugcuuca

SEQ ID NO: 362260 - RNA, 19 nt, Homo sapiens
gggaccugcugaagacauu

SEQ ID NO: 362261 - RNA, 19 nt, Homo sapiens
ccuauaaucccagcacuuu

SEQ ID NO: 362262 - RNA, 19 nt, Homo sapiens
gggacgggccugacagauu

SEQ ID NO: 362263 - RNA, 19 nt, Homo sapiens
uagaagacaccaacaagug

SEQ ID NO: 362264 - RNA, 19 nt, Homo sapiens
aaaggcaucucccugucuu

SEQ ID NO: 362265 - RNA, 19 nt, Homo sapiens
caagagcauggaaauguga

SEQ ID NO: 362266 - RNA, 19 nt, Homo sapiens
gggagacaaucaagcucuu

SEQ ID NO: 362267 - RNA, 19 nt, Homo sapiens
ucacagcuaucauauucag

SEQ ID NO: 362268 - RNA, 19 nt, Homo sapiens
caagguggcggacguaagu

SEQ ID NO: 362269 - RNA, 19 nt, Homo sapiens
ccagcuuucugccucugua

SEQ ID NO: 362270 - RNA, 19 nt, Homo sapiens
ggguuucauugacuacauu

SEQ ID NO: 362271 - RNA, 19 nt, Homo sapiens
caucauggccgaguucuuc

SEQ ID NO: 362272 - RNA, 19 nt, Homo sapiens
acagacauguccaaacaca

SEQ ID NO: 362273 - RNA, 19 nt, Homo sapiens
acucagacguggcgcuuau

SEQ ID NO: 362274 - RNA, 19 nt, Homo sapiens
gcaacuggccaaggagcua

SEQ ID NO: 362275 - RNA, 19 nt, Homo sapiens
ugcuuaagcucaggaguuu

SEQ ID NO: 362276 - RNA, 19 nt, Homo sapiens
uguaguagcccugcacaaa

SEQ ID NO: 362277 - RNA, 19 nt, Homo sapiens
ccaccuaccugcugaugcu

SEQ ID NO: 362278 - RNA, 19 nt, Homo sapiens
ggcaggagaaucacuugaa

SEQ ID NO: 362279 - RNA, 19 nt, Homo sapiens
gcuagaagacaccaacaag

SEQ ID NO: 362280 - RNA, 19 nt, Homo sapiens
gagucacaucugucacuua

SEQ ID NO: 362281 - RNA, 19 nt, Homo sapiens
gcucuuggcaggcagacuu

SEQ ID NO: 362282 - RNA, 19 nt, Homo sapiens
ccuguaaucccgguacuuu

SEQ ID NO: 362283 - RNA, 19 nt, Homo sapiens
guaguagcccugcacaaag

SEQ ID NO: 362284 - RNA, 19 nt, Homo sapiens
gcuuucugccucuguagua

SEQ ID NO: 362285 - RNA, 19 nt, Homo sapiens
ccaggaagaggcuccaugu

SEQ ID NO: 362286 - RNA, 19 nt, Homo sapiens
ugacagauuccaguuugaa

SEQ ID NO: 362287 - RNA, 19 nt, Homo sapiens
aggagcaacuggccaagga

SEQ ID NO: 362288 - RNA, 19 nt, Homo sapiens
caggagaaucacuugaauu

SEQ ID NO: 362289 - RNA, 19 nt, Homo sapiens
cagcuacucagaagguuga

SEQ ID NO: 362290 - RNA, 19 nt, Homo sapiens
gaagaggagcagaaaagaa

SEQ ID NO: 362291 - RNA, 19 nt, Homo sapiens
gucaggagaccaucccaaa

SEQ ID NO: 362292 - RNA, 19 nt, Homo sapiens
ccagguggguuucauugac

SEQ ID NO: 362293 - RNA, 19 nt, Homo sapiens
ggaguuggaggcugaagag

SEQ ID NO: 362294 - RNA, 19 nt, Homo sapiens
ggaggcagaggaagaggau

SEQ ID NO: 362295 - RNA, 19 nt, Homo sapiens
uggacacgcuggaggacaa

SEQ ID NO: 362296 - RNA, 19 nt, Homo sapiens
ugauuaacaccaacucaga

SEQ ID NO: 362297 - RNA, 19 nt, Homo sapiens
gcugaagacauuccagauc

SEQ ID NO: 362298 - RNA, 19 nt, Homo sapiens
caguggcccaugccuauaa

SEQ ID NO: 362299 - RNA, 19 nt, Homo sapiens
cacaguggcccaugccuau

SEQ ID NO: 362300 - RNA, 19 nt, Homo sapiens
ucagaagguugagacaaag

SEQ ID NO: 362301 - RNA, 19 nt, Homo sapiens
caccugagaaucccagcua

SEQ ID NO: 362302 - RNA, 19 nt, Homo sapiens
cuuaagcucaggaguuuga

SEQ ID NO: 362303 - RNA, 19 nt, Homo sapiens
gcaccaaagcuucacucau

SEQ ID NO: 362304 - RNA, 19 nt, Homo sapiens
ccauuuagggagacaauca

SEQ ID NO: 362305 - RNA, 19 nt, Homo sapiens
uccaacagcgcuucuauuc

SEQ ID NO: 362306 - RNA, 19 nt, Homo sapiens
acauggugcuggccacaga

SEQ ID NO: 362307 - RNA, 19 nt, Homo sapiens
ucacagacuuggaaauccu

SEQ ID NO: 362308 - RNA, 19 nt, Homo sapiens
guucacagacuuggaaauc

SEQ ID NO: 362309 - RNA, 19 nt, Homo sapiens
uaguagcccugcacaaagg

SEQ ID NO: 362310 - RNA, 19 nt, Homo sapiens
gacccuagacuugccuaaa

SEQ ID NO: 362311 - RNA, 19 nt, Homo sapiens
gagacaaucaagcucuuag

SEQ ID NO: 362312 - RNA, 19 nt, Homo sapiens
agagaacugcgauaucuuc

SEQ ID NO: 362313 - RNA, 19 nt, Homo sapiens
acguggcgcuuauguacaa

SEQ ID NO: 362314 - RNA, 19 nt, Homo sapiens
ugacccaccuguccgaaac

SEQ ID NO: 362315 - RNA, 19 nt, Homo sapiens
ggccagcgaccuacaugga

SEQ ID NO: 362316 - RNA, 19 nt, Homo sapiens
gcgcgaguccuuccuguac

SEQ ID NO: 362317 - RNA, 19 nt, Homo sapiens
cagcccaugucccggauca

SEQ ID NO: 362318 - RNA, 19 nt, Homo sapiens
gaaccagguguccgaguac

SEQ ID NO: 362319 - RNA, 19 nt, Homo sapiens
uggaguugccugacacuga

SEQ ID NO: 362320 - RNA, 19 nt, Homo sapiens
ccagaucccagcagacaca

SEQ ID NO: 362321 - RNA, 19 nt, Homo sapiens
gguggcgggugccuguaau

SEQ ID NO: 362322 - RNA, 19 nt, Homo sapiens
gcaauuaacugauuuguag

SEQ ID NO: 362323 - RNA, 19 nt, Homo sapiens
ggagaugacuugauuguga

SEQ ID NO: 362324 - RNA, 19 nt, Homo sapiens
gaaaucaagugucagaguu

SEQ ID NO: 362325 - RNA, 19 nt, Homo sapiens
aaacaacuuugcugcauua

SEQ ID NO: 362326 - RNA, 19 nt, Homo sapiens
ggacauagcacgaaucugu

SEQ ID NO: 362327 - RNA, 19 nt, Homo sapiens
gaagaaaacugugacauuu

SEQ ID NO: 362328 - RNA, 19 nt, Homo sapiens
gaacuugccuugauguaca

SEQ ID NO: 362329 - RNA, 19 nt, Homo sapiens
gcacugaccucuacauuuu

SEQ ID NO: 362330 - RNA, 19 nt, Homo sapiens
gaaacaacuuugcugcauu

SEQ ID NO: 362331 - RNA, 19 nt, Homo sapiens
caacaaauaugucaagaac

SEQ ID NO: 362332 - RNA, 19 nt, Homo sapiens
caacaaagccaccauaaca

SEQ ID NO: 362333 - RNA, 19 nt, Homo sapiens
uagaagaugugaacaaaug

SEQ ID NO: 362334 - RNA, 19 nt, Homo sapiens
gccauagacuacuuuauuu

SEQ ID NO: 362335 - RNA, 19 nt, Homo sapiens
ccugauacaugacugaaua

SEQ ID NO: 362336 - RNA, 19 nt, Homo sapiens
gaacguggcauggagauaa

SEQ ID NO: 362337 - RNA, 19 nt, Homo sapiens
gaaaugagucggucuggaa

SEQ ID NO: 362338 - RNA, 19 nt, Homo sapiens
acacggagaugacuugauu

SEQ ID NO: 362339 - RNA, 19 nt, Homo sapiens
ggaauaucguaaccaguuu

SEQ ID NO: 362340 - RNA, 19 nt, Homo sapiens
ccaaggaacuagaagaugu

SEQ ID NO: 362341 - RNA, 19 nt, Homo sapiens
caaagccucuccagcugua

SEQ ID NO: 362342 - RNA, 19 nt, Homo sapiens
ggacgaagcaacaaauaug

SEQ ID NO: 362343 - RNA, 19 nt, Homo sapiens
caacuuugcugcauuaacu

SEQ ID NO: 362344 - RNA, 19 nt, Homo sapiens
gcagucaaguggaagaaga

SEQ ID NO: 362345 - RNA, 19 nt, Homo sapiens
agacuaugguugaaacuaa

SEQ ID NO: 362346 - RNA, 19 nt, Homo sapiens
accaaugacuuccauauuu

SEQ ID NO: 362347 - RNA, 19 nt, Homo sapiens
gacaagcucuggaguucuu

SEQ ID NO: 362348 - RNA, 19 nt, Homo sapiens
gcacagagugaacuuaaug

SEQ ID NO: 362349 - RNA, 19 nt, Homo sapiens
aaacugaccuugacuacuc

SEQ ID NO: 362350 - RNA, 19 nt, Homo sapiens
gaaaggcauugcacagagu

SEQ ID NO: 362351 - RNA, 19 nt, Homo sapiens
ucaggaacgggauuuauua

SEQ ID NO: 362352 - RNA, 19 nt, Homo sapiens
guucauagcaauuaacuga

SEQ ID NO: 362353 - RNA, 19 nt, Homo sapiens
caacagauaugucaaaaca

SEQ ID NO: 362354 - RNA, 19 nt, Homo sapiens
ucaguggagucaagaaauu

SEQ ID NO: 362355 - RNA, 19 nt, Homo sapiens
gaaauuccuucuccaacuc

SEQ ID NO: 362356 - RNA, 19 nt, Homo sapiens
gagauggccuccaacaagu

SEQ ID NO: 362357 - RNA, 19 nt, Homo sapiens
ggaguucuucuucuugaua

SEQ ID NO: 362358 - RNA, 19 nt, Homo sapiens
gaauuuuacuugcaccuua

SEQ ID NO: 362359 - RNA, 19 nt, Homo sapiens
auacaugacugaauagugu

SEQ ID NO: 362360 - RNA, 19 nt, Homo sapiens
gaacaggacauagcacgaa

SEQ ID NO: 362361 - RNA, 19 nt, Homo sapiens
gaacaaaacugaccuugac

SEQ ID NO: 362362 - RNA, 19 nt, Homo sapiens
ggaggacaaucgugaaugg

SEQ ID NO: 362363 - RNA, 19 nt, Homo sapiens
gagcugcacugaccucuac

SEQ ID NO: 362364 - RNA, 19 nt, Homo sapiens
caaugauuccucagucuua

SEQ ID NO: 362365 - RNA, 19 nt, Homo sapiens
uaagcaacaugaaguggaa

SEQ ID NO: 362366 - RNA, 19 nt, Homo sapiens
gaguucuucuucuugauaa

SEQ ID NO: 362367 - RNA, 19 nt, Homo sapiens
ugagucaacugaauucugu

SEQ ID NO: 362368 - RNA, 19 nt, Homo sapiens
guacaaaucugugcuacac

SEQ ID NO: 362369 - RNA, 19 nt, Homo sapiens
gcccuugacuguuaucaug

SEQ ID NO: 362370 - RNA, 19 nt, Homo sapiens
ucaaguaucccaagguuug

SEQ ID NO: 362371 - RNA, 19 nt, Homo sapiens
acaaauaugucaagaacag

SEQ ID NO: 362372 - RNA, 19 nt, Homo sapiens
gaugaucguucuccugaca

SEQ ID NO: 362373 - RNA, 19 nt, Homo sapiens
agaggaagauggugaguca

SEQ ID NO: 362374 - RNA, 19 nt, Homo sapiens
ggacggaccggauaaugga

SEQ ID NO: 362375 - RNA, 19 nt, Homo sapiens
gaucugagcaacccaacaa

SEQ ID NO: 362376 - RNA, 19 nt, Homo sapiens
aaucaagugucagaguuua

SEQ ID NO: 362377 - RNA, 19 nt, Homo sapiens
guccagcgcucaggaauau

SEQ ID NO: 362378 - RNA, 19 nt, Homo sapiens
ucacuaaaccauccaauca

SEQ ID NO: 362379 - RNA, 19 nt, Homo sapiens
ucagugagauggccuccaa

SEQ ID NO: 362380 - RNA, 19 nt, Homo sapiens
gcaacaaauaugucaagaa

SEQ ID NO: 362381 - RNA, 19 nt, Homo sapiens
gagcugacaaagcagauaa

SEQ ID NO: 362382 - RNA, 19 nt, Homo sapiens
augcacagcucuagucuga

SEQ ID NO: 362383 - RNA, 19 nt, Homo sapiens
ucacccaucucucugaaau

SEQ ID NO: 362384 - RNA, 19 nt, Homo sapiens
guuucacucuuuccagaua

SEQ ID NO: 362385 - RNA, 19 nt, Homo sapiens
ccaaugacuuccauauuuu

SEQ ID NO: 362386 - RNA, 19 nt, Homo sapiens
gaacuuaauggacgaagca

SEQ ID NO: 362387 - RNA, 19 nt, Homo sapiens
gcugugggcuuuaaauugc

SEQ ID NO: 362388 - RNA, 19 nt, Homo sapiens
gaucaguggagucaagaaa

SEQ ID NO: 362389 - RNA, 19 nt, Homo sapiens
gauccgacagcgauuauga

SEQ ID NO: 362390 - RNA, 19 nt, Homo sapiens
gauuuguagugauucauug

SEQ ID NO: 362391 - RNA, 19 nt, Homo sapiens
caauauccaugcugcagau

SEQ ID NO: 362392 - RNA, 19 nt, Homo sapiens
cgaaacaacuuugcugcau

SEQ ID NO: 362393 - RNA, 19 nt, Homo sapiens
cgagcaagguggacaucuu

SEQ ID NO: 362394 - RNA, 19 nt, Homo sapiens
aauacaaacucugaacuug

SEQ ID NO: 362395 - RNA, 19 nt, Homo sapiens
acuagaagaugugaacaaa

SEQ ID NO: 362396 - RNA, 19 nt, Homo sapiens
gaacuguacgaaacaacuu

SEQ ID NO: 362397 - RNA, 19 nt, Homo sapiens
guggacaucuucacgaaca

SEQ ID NO: 362398 - RNA, 19 nt, Homo sapiens
ggucacaccucacugucau

SEQ ID NO: 362399 - RNA, 19 nt, Homo sapiens
gugacaagcucuggaguuc

SEQ ID NO: 362400 - RNA, 19 nt, Homo sapiens
caaauggggucuucauguu

SEQ ID NO: 362401 - RNA, 19 nt, Homo sapiens
ggaaaucaagugucagagu

SEQ ID NO: 362402 - RNA, 19 nt, Homo sapiens
gauaauuauuccgauagga

SEQ ID NO: 362403 - RNA, 19 nt, Homo sapiens
ggaagaaaacugugacauu

SEQ ID NO: 362404 - RNA, 19 nt, Homo sapiens
ucauuuggcugugggcuuu

SEQ ID NO: 362405 - RNA, 19 nt, Homo sapiens
ugguagagcugacaaagca

SEQ ID NO: 362406 - RNA, 19 nt, Homo sapiens
caauacaaacucugaacuu

SEQ ID NO: 362407 - RNA, 19 nt, Homo sapiens
uuacagauuuggagauucu

SEQ ID NO: 362408 - RNA, 19 nt, Homo sapiens
cuacucaugugcuauuauc

SEQ ID NO: 362409 - RNA, 19 nt, Homo sapiens
caacaugaaguggaaauuc

SEQ ID NO: 362410 - RNA, 19 nt, Homo sapiens
ucaagugucagaguuuaua

SEQ ID NO: 362411 - RNA, 19 nt, Homo sapiens
ucccggaacuccuccauug

SEQ ID NO: 362412 - RNA, 19 nt, Homo sapiens
guuuacagauuuggagauu

SEQ ID NO: 362413 - RNA, 19 nt, Homo sapiens
gcucacccaucucucugaa

SEQ ID NO: 362414 - RNA, 19 nt, Homo sapiens
auuaugaccucucuccaaa

SEQ ID NO: 362415 - RNA, 19 nt, Homo sapiens
gaauagugugguucaguga

SEQ ID NO: 362416 - RNA, 19 nt, Homo sapiens
aggaugagccacagaaauu

SEQ ID NO: 362417 - RNA, 19 nt, Homo sapiens
ggacaguggcagucaagug

SEQ ID NO: 362418 - RNA, 19 nt, Homo sapiens
cugagaaauuccaguuuga

SEQ ID NO: 362419 - RNA, 19 nt, Homo sapiens
gggucaaacugagaaauuc

SEQ ID NO: 362420 - RNA, 19 nt, Homo sapiens
uggcugauuugaagacuau

SEQ ID NO: 362421 - RNA, 19 nt, Homo sapiens
ccagucuacucaugugcua

SEQ ID NO: 362422 - RNA, 19 nt, Homo sapiens
caagagagaugaagagauu

SEQ ID NO: 362423 - RNA, 19 nt, Homo sapiens
ggaaggcgcuugcugauga

SEQ ID NO: 362424 - RNA, 19 nt, Homo sapiens
ccacacaccuugagaagua

SEQ ID NO: 362425 - RNA, 19 nt, Homo sapiens
gaacaagaaggaagaaauu

SEQ ID NO: 362426 - RNA, 19 nt, Homo sapiens
gaaagcuguuagagaauuu

SEQ ID NO: 362427 - RNA, 19 nt, Homo sapiens
ucaaagugguggauaaauu

SEQ ID NO: 362428 - RNA, 19 nt, Homo sapiens
gaacaggaguggacacagu

SEQ ID NO: 362429 - RNA, 19 nt, Homo sapiens
aaugauagcuguugaacuu

SEQ ID NO: 362430 - RNA, 19 nt, Homo sapiens
ccaauaaccucuaccagau

SEQ ID NO: 362431 - RNA, 19 nt, Homo sapiens
gagucuggauggaugauua

SEQ ID NO: 362432 - RNA, 19 nt, Homo sapiens
gaaagaaccucuggaugag

SEQ ID NO: 362433 - RNA, 19 nt, Homo sapiens
gcaaagaggacaucaaagu

SEQ ID NO: 362434 - RNA, 19 nt, Homo sapiens
cagaggagguggagaaguu

SEQ ID NO: 362435 - RNA, 19 nt, Homo sapiens
guagaagagucauaggauu

SEQ ID NO: 362436 - RNA, 19 nt, Homo sapiens
gggcuggucugucuuaaau

SEQ ID NO: 362437 - RNA, 19 nt, Homo sapiens
gcugguggcugcugaauuc

SEQ ID NO: 362438 - RNA, 19 nt, Homo sapiens
caaagugguggauaaauuu

SEQ ID NO: 362439 - RNA, 19 nt, Homo sapiens
gggaagcccuuugaugaaa

SEQ ID NO: 362440 - RNA, 19 nt, Homo sapiens
ccaggacuguucaaucuuu

SEQ ID NO: 362441 - RNA, 19 nt, Homo sapiens
agaaagaaccucuggauga

SEQ ID NO: 362442 - RNA, 19 nt, Homo sapiens
agaaaugcaucuucaaugu

SEQ ID NO: 362443 - RNA, 19 nt, Homo sapiens
aaucauggcugugaauaaa

SEQ ID NO: 362444 - RNA, 19 nt, Homo sapiens
gcaaaacacugcucagaga

SEQ ID NO: 362445 - RNA, 19 nt, Homo sapiens
guggauaaauuucacauuc

SEQ ID NO: 362446 - RNA, 19 nt, Homo sapiens
ggacucgaauauuggcuuu

SEQ ID NO: 362447 - RNA, 19 nt, Homo sapiens
uuugaaagcuguuagagaa

SEQ ID NO: 362448 - RNA, 19 nt, Homo sapiens
ugaaagcuguuagagaauu

SEQ ID NO: 362449 - RNA, 19 nt, Homo sapiens
gagcagacacggaaggaaa

SEQ ID NO: 362450 - RNA, 19 nt, Homo sapiens
ggagagcgaaaucaucuuu

SEQ ID NO: 362451 - RNA, 19 nt, Homo sapiens
ugucuugggucacacauaa

SEQ ID NO: 362452 - RNA, 19 nt, Homo sapiens
gagcauuucugugacuuug

SEQ ID NO: 362453 - RNA, 19 nt, Homo sapiens
gaagagucauaggauuuga

SEQ ID NO: 362454 - RNA, 19 nt, Homo sapiens
gauggacauugcaaucauu

SEQ ID NO: 362455 - RNA, 19 nt, Homo sapiens
gacgagagccugaauaucu

SEQ ID NO: 362456 - RNA, 19 nt, Homo sapiens
ugauagcuguugaacuuaa

SEQ ID NO: 362457 - RNA, 19 nt, Homo sapiens
gaccacagaggcaccaaua

SEQ ID NO: 362458 - RNA, 19 nt, Homo sapiens
gagaaaugcaucuucaaug

SEQ ID NO: 362459 - RNA, 19 nt, Homo sapiens
gauagcuguugaacuuaaa

SEQ ID NO: 362460 - RNA, 19 nt, Homo sapiens
acaaggaauucucccguuu

SEQ ID NO: 362461 - RNA, 19 nt, Homo sapiens
aaacaaagcagaugaacuc

SEQ ID NO: 362462 - RNA, 19 nt, Homo sapiens
ggacagaaacaaagcagau

SEQ ID NO: 362463 - RNA, 19 nt, Homo sapiens
caagaaggaagaaauuguu

SEQ ID NO: 362464 - RNA, 19 nt, Homo sapiens
cuaagaagauugcuaacgu

SEQ ID NO: 362465 - RNA, 19 nt, Homo sapiens
gagacgagagccugaauau

SEQ ID NO: 362466 - RNA, 19 nt, Homo sapiens
gaagugugacaaugaagaa

SEQ ID NO: 362467 - RNA, 19 nt, Homo sapiens
gaaggaagaaauuguugga

SEQ ID NO: 362468 - RNA, 19 nt, Homo sapiens
aaaugcaucuucaauguca

SEQ ID NO: 362469 - RNA, 19 nt, Homo sapiens
gaagcccuuugaugaaaug

SEQ ID NO: 362470 - RNA, 19 nt, Homo sapiens
ggaagcccuuugaugaaau

SEQ ID NO: 362471 - RNA, 19 nt, Homo sapiens
agaauggccugauuugcaa

SEQ ID NO: 362472 - RNA, 19 nt, Homo sapiens
caaaucuaaucaugaagug

SEQ ID NO: 362473 - RNA, 19 nt, Homo sapiens
acagagaaaugcaucuuca

SEQ ID NO: 362474 - RNA, 19 nt, Homo sapiens
uagaagagucauaggauuu

SEQ ID NO: 362475 - RNA, 19 nt, Homo sapiens
ugaguacgaugccaagaug

SEQ ID NO: 362476 - RNA, 19 nt, Homo sapiens
aagaggagcuggcugagau

SEQ ID NO: 362477 - RNA, 19 nt, Homo sapiens
aauaucaugugaaguguga

SEQ ID NO: 362478 - RNA, 19 nt, Homo sapiens
ugaccaagcagaaggaauu

SEQ ID NO: 362479 - RNA, 19 nt, Homo sapiens
ccacaaagcccuguacaca

SEQ ID NO: 362480 - RNA, 19 nt, Homo sapiens
gcaaaucuaaucaugaagu

SEQ ID NO: 362481 - RNA, 19 nt, Homo sapiens
cagaggaggaugagcauuu

SEQ ID NO: 362482 - RNA, 19 nt, Homo sapiens
gaauuuacagacagagaaa

SEQ ID NO: 362483 - RNA, 19 nt, Homo sapiens
ggauaaauuucacauucca

SEQ ID NO: 362484 - RNA, 19 nt, Homo sapiens
gugcuuuccucaacuguga

SEQ ID NO: 362485 - RNA, 19 nt, Homo sapiens
gcauuucugugacuuugug

SEQ ID NO: 362486 - RNA, 19 nt, Homo sapiens
gagaucgucuucccuuugg

SEQ ID NO: 362487 - RNA, 19 nt, Homo sapiens
cagaugaacucccuaagcu

SEQ ID NO: 362488 - RNA, 19 nt, Homo sapiens
ccuaugagucaaugaauaa

SEQ ID NO: 362489 - RNA, 19 nt, Homo sapiens
agagcgaaaucaucuuuga

SEQ ID NO: 362490 - RNA, 19 nt, Homo sapiens
ggacuuucaggagaauuua

SEQ ID NO: 362491 - RNA, 19 nt, Homo sapiens
uaagacauaugagagugaa

SEQ ID NO: 362492 - RNA, 19 nt, Homo sapiens
aauaaccucuaccagauga

SEQ ID NO: 362493 - RNA, 19 nt, Homo sapiens
ccgcuuauguugcccagaa

SEQ ID NO: 362494 - RNA, 19 nt, Homo sapiens
gaccauugggcuuuaguaa

SEQ ID NO: 362495 - RNA, 19 nt, Homo sapiens
gugugacaaugaagaaauu

SEQ ID NO: 362496 - RNA, 19 nt, Homo sapiens
agaaguuccuggacucgaa

SEQ ID NO: 362497 - RNA, 19 nt, Homo sapiens
ucaagaagaggacgauguu

SEQ ID NO: 362498 - RNA, 19 nt, Homo sapiens
gauguauuaugagcucaaa

SEQ ID NO: 362499 - RNA, 19 nt, Homo sapiens
gaaaugcaucuucaauguc

SEQ ID NO: 362500 - RNA, 19 nt, Homo sapiens
gagaaguagaagagucaua

SEQ ID NO: 362501 - RNA, 19 nt, Homo sapiens
gaauccaccuccugaccau

SEQ ID NO: 362502 - RNA, 19 nt, Homo sapiens
gaggagagcgaaaucaucu

SEQ ID NO: 362503 - RNA, 19 nt, Homo sapiens
ggaucccacuucaccaaga

SEQ ID NO: 362504 - RNA, 19 nt, Homo sapiens
gcagacaagacccagagaa

SEQ ID NO: 362505 - RNA, 19 nt, Homo sapiens
aguaagggcuaccgcaaga

SEQ ID NO: 362506 - RNA, 19 nt, Homo sapiens
gacaagacccagagaaguc

SEQ ID NO: 362507 - RNA, 19 nt, Homo sapiens
gaagaggagcuggcugaga

SEQ ID NO: 362508 - RNA, 19 nt, Homo sapiens
gaugggaagcccuuugaug

SEQ ID NO: 362509 - RNA, 19 nt, Homo sapiens
uggcaaagaggacaucaaa

SEQ ID NO: 362510 - RNA, 19 nt, Homo sapiens
gggccacauuggaagaauu

SEQ ID NO: 362511 - RNA, 19 nt, Homo sapiens
ggaagaccacacaccuuga

SEQ ID NO: 362512 - RNA, 19 nt, Homo sapiens
gcucaucuccgaccuccuu

SEQ ID NO: 362513 - RNA, 19 nt, Homo sapiens
cagaauggccugauuugca

SEQ ID NO: 362514 - RNA, 19 nt, Homo sapiens
caaagaggacaucaaaguc

SEQ ID NO: 362515 - RNA, 19 nt, Homo sapiens
cagcagaggagguggagaa

SEQ ID NO: 362516 - RNA, 19 nt, Homo sapiens
caugauggacagaaacaaa

SEQ ID NO: 362517 - RNA, 19 nt, Homo sapiens
cauggucacugcugcuuuc

SEQ ID NO: 362518 - RNA, 19 nt, Homo sapiens
caagaucaccuaccacaac

SEQ ID NO: 362519 - RNA, 19 nt, Homo sapiens
gcucaaagugguggauaaa

SEQ ID NO: 362520 - RNA, 19 nt, Homo sapiens
ugccagaugcagauaaaua

SEQ ID NO: 362521 - RNA, 19 nt, Homo sapiens
cagaaaaucuugaaaacca

SEQ ID NO: 362522 - RNA, 19 nt, Homo sapiens
caacugaccuggcuuuaua

SEQ ID NO: 362523 - RNA, 19 nt, Homo sapiens
gaucauaucugaacuguga

SEQ ID NO: 362524 - RNA, 19 nt, Homo sapiens
gaaaggaccuguagacgaa

SEQ ID NO: 362525 - RNA, 19 nt, Homo sapiens
ggauuuaucuguaacauga

SEQ ID NO: 362526 - RNA, 19 nt, Homo sapiens
caagagaaguuaaauguug

SEQ ID NO: 362527 - RNA, 19 nt, Homo sapiens
cagcagaacuguacgaauu

SEQ ID NO: 362528 - RNA, 19 nt, Homo sapiens
gaaacugguugggucauua

SEQ ID NO: 362529 - RNA, 19 nt, Homo sapiens
gaaauccacgucuccauua

SEQ ID NO: 362530 - RNA, 19 nt, Homo sapiens
ugaguggucuucagaauaa

SEQ ID NO: 362531 - RNA, 19 nt, Homo sapiens
caaaguaaaugcaucugaa

SEQ ID NO: 362532 - RNA, 19 nt, Homo sapiens
gagcacggauugauuaaau

SEQ ID NO: 362533 - RNA, 19 nt, Homo sapiens
agaaauaccuggaggagaa

SEQ ID NO: 362534 - RNA, 19 nt, Homo sapiens
ggucuaaacuucaaauauc

SEQ ID NO: 362535 - RNA, 19 nt, Homo sapiens
uaaaugugguggagaaauu

SEQ ID NO: 362536 - RNA, 19 nt, Homo sapiens
cgaagaagccagauccuua

SEQ ID NO: 362537 - RNA, 19 nt, Homo sapiens
gaucauggcaguuaacaaa

SEQ ID NO: 362538 - RNA, 19 nt, Homo sapiens
uaaauaagcggcaguuuga

SEQ ID NO: 362539 - RNA, 19 nt, Homo sapiens
guaacaggaucuucagaaa

SEQ ID NO: 362540 - RNA, 19 nt, Homo sapiens
caacaacccauuccuauga

SEQ ID NO: 362541 - RNA, 19 nt, Homo sapiens
ggaagaagaagccaucaaa

SEQ ID NO: 362542 - RNA, 19 nt, Homo sapiens
gaaaugcucaugaaccaaa

SEQ ID NO: 362543 - RNA, 19 nt, Homo sapiens
gcaugugacuugucugcua

SEQ ID NO: 362544 - RNA, 19 nt, Homo sapiens
acaaagaaaucacaccuau

SEQ ID NO: 362545 - RNA, 19 nt, Homo sapiens
gaagaagccaucaaauaug

SEQ ID NO: 362546 - RNA, 19 nt, Homo sapiens
gcagaccacuggacacuca

SEQ ID NO: 362547 - RNA, 19 nt, Homo sapiens
gaagaaaacucauaauguc

SEQ ID NO: 362548 - RNA, 19 nt, Homo sapiens
aagaagaagccaucaaaua

SEQ ID NO: 362549 - RNA, 19 nt, Homo sapiens
ugaccuggcuuuauauuuc

SEQ ID NO: 362550 - RNA, 19 nt, Homo sapiens
gaaauucaaaguaccugua

SEQ ID NO: 362551 - RNA, 19 nt, Homo sapiens
gauuaaauguggaauacga

SEQ ID NO: 362552 - RNA, 19 nt, Homo sapiens
gaaguuguguuuccauugg

SEQ ID NO: 362553 - RNA, 19 nt, Homo sapiens
cuucaugguucuucuauuu

SEQ ID NO: 362554 - RNA, 19 nt, Homo sapiens
gcugaugacaggaagauua

SEQ ID NO: 362555 - RNA, 19 nt, Homo sapiens
gaagccagauccuuaugug

SEQ ID NO: 362556 - RNA, 19 nt, Homo sapiens
ccagcuacauguacaauau

SEQ ID NO: 362557 - RNA, 19 nt, Homo sapiens
agaagaagccaucaaauau

SEQ ID NO: 362558 - RNA, 19 nt, Homo sapiens
ccagauggauguacacugu

SEQ ID NO: 362559 - RNA, 19 nt, Homo sapiens
aaauaaaugugguggagaa

SEQ ID NO: 362560 - RNA, 19 nt, Homo sapiens
gaagaagccagauccuuau

SEQ ID NO: 362561 - RNA, 19 nt, Homo sapiens
uaacuggucuaaacuucaa

SEQ ID NO: 362562 - RNA, 19 nt, Homo sapiens
guaccgagcugucacuuac

SEQ ID NO: 362563 - RNA, 19 nt, Homo sapiens
gaacaaacgcagcaaagca

SEQ ID NO: 362564 - RNA, 19 nt, Homo sapiens
gagggaccauuuacgguuu

SEQ ID NO: 362565 - RNA, 19 nt, Homo sapiens
ggcagaccauguuuacuuu

SEQ ID NO: 362566 - RNA, 19 nt, Homo sapiens
gaaggaauucuacgaugaa

SEQ ID NO: 362567 - RNA, 19 nt, Homo sapiens
gaacuucaacaaaucauca

SEQ ID NO: 362568 - RNA, 19 nt, Homo sapiens
gaagaacucacagauguug

SEQ ID NO: 362569 - RNA, 19 nt, Homo sapiens
gaagccaucaaauauguaa

SEQ ID NO: 362570 - RNA, 19 nt, Homo sapiens
caagaaagaagauauugug

SEQ ID NO: 362571 - RNA, 19 nt, Homo sapiens
ggugggcccugacaaagaa

SEQ ID NO: 362572 - RNA, 19 nt, Homo sapiens
ccaauaauuuguaccagau

SEQ ID NO: 362573 - RNA, 19 nt, Homo sapiens
gagcaugaugaauacauua

SEQ ID NO: 362574 - RNA, 19 nt, Homo sapiens
ucgaugagcaugaugaaua

SEQ ID NO: 362575 - RNA, 19 nt, Homo sapiens
caagaaagagauuaucaug

SEQ ID NO: 362576 - RNA, 19 nt, Homo sapiens
gaccacagaggcaccaaua

SEQ ID NO: 362577 - RNA, 19 nt, Homo sapiens
gagaaguagagccuuauaa

SEQ ID NO: 362578 - RNA, 19 nt, Homo sapiens
aaucaagcuuggagaagua

SEQ ID NO: 362579 - RNA, 19 nt, Homo sapiens
gaagaagaagccaucaaau

SEQ ID NO: 362580 - RNA, 19 nt, Homo sapiens
gauguacacugugaggaaa

SEQ ID NO: 362581 - RNA, 19 nt, Homo sapiens
acagagcacggauugauua

SEQ ID NO: 362582 - RNA, 19 nt, Homo sapiens
gaaguagagccuuauaaag

SEQ ID NO: 362583 - RNA, 19 nt, Homo sapiens
aagaagccaucaaauaugu

SEQ ID NO: 362584 - RNA, 19 nt, Homo sapiens
caggaagauuaaagaagua

SEQ ID NO: 362585 - RNA, 19 nt, Homo sapiens
acaggaagauuaaagaagu

SEQ ID NO: 362586 - RNA, 19 nt, Homo sapiens
gggcagaccauguuuacuu

SEQ ID NO: 362587 - RNA, 19 nt, Homo sapiens
ggagaaguagagccuuaua

SEQ ID NO: 362588 - RNA, 19 nt, Homo sapiens
guuuaaacaucuuccagaa

SEQ ID NO: 362589 - RNA, 19 nt, Homo sapiens
gaauuccgcuucagugacu

SEQ ID NO: 362590 - RNA, 19 nt, Homo sapiens
aaagcgcucuacacgguua

SEQ ID NO: 362591 - RNA, 19 nt, Homo sapiens
uugaagaacucacagaugu

SEQ ID NO: 362592 - RNA, 19 nt, Homo sapiens
gcugcuuucugccaugaua

SEQ ID NO: 362593 - RNA, 19 nt, Homo sapiens
gagcgacaguuucacaaag

SEQ ID NO: 362594 - RNA, 19 nt, Homo sapiens
cauggcaguuaacaaagua

SEQ ID NO: 362595 - RNA, 19 nt, Homo sapiens
agaaguagagccuuauaaa

SEQ ID NO: 362596 - RNA, 19 nt, Homo sapiens
acaaggagaucuggagaga

SEQ ID NO: 362597 - RNA, 19 nt, Homo sapiens
gcacuuaugguugcaaaug

SEQ ID NO: 362598 - RNA, 19 nt, Homo sapiens
guugaugccugugaacaaa

SEQ ID NO: 362599 - RNA, 19 nt, Homo sapiens
guucgaggucgcaauaaua

SEQ ID NO: 362600 - RNA, 19 nt, Homo sapiens
acagaggcaccaauaauuu

SEQ ID NO: 362601 - RNA, 19 nt, Homo sapiens
ccacagaggcaccaauaau

SEQ ID NO: 362602 - RNA, 19 nt, Homo sapiens
uaaagaaguacuacacaga

SEQ ID NO: 362603 - RNA, 19 nt, Homo sapiens
aauauugaaucccgaagaa

SEQ ID NO: 362604 - RNA, 19 nt, Homo sapiens
gagaugaauuaccuaaacu

SEQ ID NO: 362605 - RNA, 19 nt, Homo sapiens
guggagaaauucaaaguac

SEQ ID NO: 362606 - RNA, 19 nt, Homo sapiens
uuucuuggauggucucuuu

SEQ ID NO: 362607 - RNA, 19 nt, Homo sapiens
uuauaaagguccaaagaca

SEQ ID NO: 362608 - RNA, 19 nt, Homo sapiens
gcugugaucauggcaguua

SEQ ID NO: 362609 - RNA, 19 nt, Homo sapiens
caacaaaucaucacguaac

SEQ ID NO: 362610 - RNA, 19 nt, Homo sapiens
gaugacggcaugugacuug

SEQ ID NO: 362611 - RNA, 19 nt, Homo sapiens
cuaaauaagcggcaguuug

SEQ ID NO: 362612 - RNA, 19 nt, Homo sapiens
guacuacacagaucucgaa

SEQ ID NO: 362613 - RNA, 19 nt, Homo sapiens
gcaguuaacaaaguaaaug

SEQ ID NO: 362614 - RNA, 19 nt, Homo sapiens
gcaacaacccauuccuaug

SEQ ID NO: 362615 - RNA, 19 nt, Homo sapiens
ucagguagcacuuaugguu

SEQ ID NO: 362616 - RNA, 19 nt, Homo sapiens
caaccaagaaagagauuau

SEQ ID NO: 362617 - RNA, 19 nt, Homo sapiens
gaccuggcuuuauauuuca

SEQ ID NO: 362618 - RNA, 19 nt, Homo sapiens
gcucaugaaccaaaccaaa

SEQ ID NO: 362619 - RNA, 19 nt, Homo sapiens
caaacuggguaugucacua

SEQ ID NO: 362620 - RNA, 19 nt, Homo sapiens
ggauguacacugugaggaa

SEQ ID NO: 362621 - RNA, 19 nt, Homo sapiens
caaucaagcuuggagaagu

SEQ ID NO: 362622 - RNA, 19 nt, Homo sapiens
ugacgacgaucuucuugua

SEQ ID NO: 362623 - RNA, 19 nt, Homo sapiens
guaagcacauccagaguga

SEQ ID NO: 362624 - RNA, 19 nt, Homo sapiens
gaaagaagaauguguguac

SEQ ID NO: 362625 - RNA, 19 nt, Homo sapiens
gaccagcucuguguaggua

SEQ ID NO: 362626 - RNA, 19 nt, Homo sapiens
ccacaaaccgguaacugua

SEQ ID NO: 362627 - RNA, 19 nt, Homo sapiens
ucaaguccuucccagcaua

SEQ ID NO: 362628 - RNA, 19 nt, Homo sapiens
gcacccgagucccagauga

SEQ ID NO: 362629 - RNA, 19 nt, Homo sapiens
ggcagugucucgagaacuu

SEQ ID NO: 362630 - RNA, 19 nt, Homo sapiens
gaaugguucuucgaguuug

SEQ ID NO: 362631 - RNA, 19 nt, Homo sapiens
aagauacucuggcaaggaa

SEQ ID NO: 362632 - RNA, 19 nt, Homo sapiens
gaagauacucuggcaagga

SEQ ID NO: 362633 - RNA, 19 nt, Homo sapiens
gaugccagcaagcgucuua

SEQ ID NO: 362634 - RNA, 19 nt, Homo sapiens
ggagggaggaggaaacugu

SEQ ID NO: 362635 - RNA, 19 nt, Homo sapiens
cgucuuaacugggaacguu

SEQ ID NO: 362636 - RNA, 19 nt, Homo sapiens
ccugacccauguuuaguuu

SEQ ID NO: 362637 - RNA, 19 nt, Homo sapiens
aucccuaacuccacaaaua

SEQ ID NO: 362638 - RNA, 19 nt, Homo sapiens
aaacaaacacauaccacaa

SEQ ID NO: 362639 - RNA, 19 nt, Homo sapiens
caaacuaaauuggaugaac

SEQ ID NO: 362640 - RNA, 19 nt, Homo sapiens
ccuacaggcuacacaucua

SEQ ID NO: 362641 - RNA, 19 nt, Homo sapiens
acagggaaacaaacacaua

SEQ ID NO: 362642 - RNA, 19 nt, Homo sapiens
guguguacauuucaagaau

SEQ ID NO: 362643 - RNA, 19 nt, Homo sapiens
ccaagaaaauccucaagug

SEQ ID NO: 362644 - RNA, 19 nt, Homo sapiens
guaaccagauggcucuuuu

SEQ ID NO: 362645 - RNA, 19 nt, Homo sapiens
ggaacguuaucauagaaac

SEQ ID NO: 362646 - RNA, 19 nt, Homo sapiens
cagcauacacacagggaaa

SEQ ID NO: 362647 - RNA, 19 nt, Homo sapiens
gaacguuaucauagaaaca

SEQ ID NO: 362648 - RNA, 19 nt, Homo sapiens
gagcaugaagcccguguuc

SEQ ID NO: 362649 - RNA, 19 nt, Homo sapiens
gcuucaaacuaaauuggau

SEQ ID NO: 362650 - RNA, 19 nt, Homo sapiens
ugggaacguuaucauagaa

SEQ ID NO: 362651 - RNA, 19 nt, Homo sapiens
guucuucgaguuuggcuuu

SEQ ID NO: 362652 - RNA, 19 nt, Homo sapiens
ggcuacacaucuaccuuug

SEQ ID NO: 362653 - RNA, 19 nt, Homo sapiens
gagugagacuuuucuaugu

SEQ ID NO: 362654 - RNA, 19 nt, Homo sapiens
gcagugucucgagaacuua

SEQ ID NO: 362655 - RNA, 19 nt, Homo sapiens
cugggaacguuaucauaga

SEQ ID NO: 362656 - RNA, 19 nt, Homo sapiens
aaagaagaauguguguaca

SEQ ID NO: 362657 - RNA, 19 nt, Homo sapiens
cugaggggcuucaaacuaa

SEQ ID NO: 362658 - RNA, 19 nt, Homo sapiens
ccagcaagcgucuuaacug

SEQ ID NO: 362659 - RNA, 19 nt, Homo sapiens
gcaaugccuagaagaaugg

SEQ ID NO: 362660 - RNA, 19 nt, Homo sapiens
acaaacacauaccacaaac

SEQ ID NO: 362661 - RNA, 19 nt, Homo sapiens
aacaaacacauaccacaaa

SEQ ID NO: 362662 - RNA, 19 nt, Homo sapiens
gacgacgaucuucuuguaa

SEQ ID NO: 362663 - RNA, 19 nt, Homo sapiens
cgacagaacaaauggaaaa

SEQ ID NO: 362664 - RNA, 19 nt, Homo sapiens
guacauuucaagaauuugg

SEQ ID NO: 362665 - RNA, 19 nt, Homo sapiens
ugaaagaagaaugugugua

SEQ ID NO: 362666 - RNA, 19 nt, Homo sapiens
gggaacguuaucauagaaa

SEQ ID NO: 362667 - RNA, 19 nt, Homo sapiens
caaggcagugucucgagaa

SEQ ID NO: 362668 - RNA, 19 nt, Homo sapiens
auacacacagggaaacaaa

SEQ ID NO: 362669 - RNA, 19 nt, Homo sapiens
cagcugaccagacuaaacu

SEQ ID NO: 362670 - RNA, 19 nt, Homo sapiens
gagggaggaggaaacuguu

SEQ ID NO: 362671 - RNA, 19 nt, Homo sapiens
gugagacuuuucuauguuu

SEQ ID NO: 362672 - RNA, 19 nt, Homo sapiens
acacacagggaaacaaaca

SEQ ID NO: 362673 - RNA, 19 nt, Homo sapiens
aagcacauccagagugaga

SEQ ID NO: 362674 - RNA, 19 nt, Homo sapiens
gcugagacagggaagauac

SEQ ID NO: 362675 - RNA, 19 nt, Homo sapiens
ucccugguguggagcauga

SEQ ID NO: 362676 - RNA, 19 nt, Homo sapiens
gguaaccagauggcucuuu

SEQ ID NO: 362677 - RNA, 19 nt, Homo sapiens
acgacgaucuucuuguaag

SEQ ID NO: 362678 - RNA, 19 nt, Homo sapiens
gggaaacaaacacauacca

SEQ ID NO: 362679 - RNA, 19 nt, Homo sapiens
acacauacaccccuaauuc

SEQ ID NO: 362680 - RNA, 19 nt, Homo sapiens
caaauaccuggcaguccuu

SEQ ID NO: 362681 - RNA, 19 nt, Homo sapiens
guuccugacccauguuuag

SEQ ID NO: 362682 - RNA, 19 nt, Homo sapiens
agaaaauccucaagugcaa

SEQ ID NO: 362683 - RNA, 19 nt, Homo sapiens
gcacauccagagugagacu

SEQ ID NO: 362684 - RNA, 19 nt, Homo sapiens
gaaaggcguucaaggguuu

SEQ ID NO: 362685 - RNA, 19 nt, Homo sapiens
gaacagacaucacagucau

SEQ ID NO: 362686 - RNA, 19 nt, Homo sapiens
cgacaucccuggaauggaa

SEQ ID NO: 362687 - RNA, 19 nt, Homo sapiens
ugcacgagcuggcccaaua

SEQ ID NO: 362688 - RNA, 19 nt, Homo sapiens
gccugucuguggcauauuu

SEQ ID NO: 362689 - RNA, 19 nt, Homo sapiens
ggaacagacaucacaguca

SEQ ID NO: 362690 - RNA, 19 nt, Homo sapiens
cgacagaccaggcaguuca

SEQ ID NO: 362691 - RNA, 19 nt, Homo sapiens
ccaggcaguucaagagcaa

SEQ ID NO: 362692 - RNA, 19 nt, Homo sapiens
gcacgagcuggcccaauau

SEQ ID NO: 362693 - RNA, 19 nt, Homo sapiens
ccucaguccugcccacaga

SEQ ID NO: 362694 - RNA, 19 nt, Homo sapiens
ggacgacaucccuggaaug

SEQ ID NO: 362695 - RNA, 19 nt, Homo sapiens
gggcucacacucucacuga

SEQ ID NO: 362696 - RNA, 19 nt, Homo sapiens
gggccauccuucucaauac

SEQ ID NO: 362697 - RNA, 19 nt, Homo sapiens
ggccauccuucucaauaca

SEQ ID NO: 362698 - RNA, 19 nt, Homo sapiens
ggcccaauauggcaucauc

SEQ ID NO: 362699 - RNA, 19 nt, Homo sapiens
gcccuugcagucccuauuu

SEQ ID NO: 362700 - RNA, 19 nt, Homo sapiens
gaguugagccggagcacau

SEQ ID NO: 362701 - RNA, 19 nt, Homo sapiens
aauauggcaucaucuagca

SEQ ID NO: 362702 - RNA, 19 nt, Homo sapiens
uggaaggccugggaacaga

SEQ ID NO: 362703 - RNA, 19 nt, Homo sapiens
cccaauauggcaucaucua

SEQ ID NO: 362704 - RNA, 19 nt, Homo sapiens
ccaauauggcaucaucuag

SEQ ID NO: 362705 - RNA, 19 nt, Homo sapiens
ccaaagaaaggcguucaag

SEQ ID NO: 362706 - RNA, 19 nt, Homo sapiens
aaauuuaagcagcgacaga

SEQ ID NO: 362707 - RNA, 19 nt, Homo sapiens
uugcagucccuauuucaaa

SEQ ID NO: 362708 - RNA, 19 nt, Homo sapiens
acgaggcccugcugaaguc

SEQ ID NO: 362709 - RNA, 19 nt, Homo sapiens
gaaggccugggaacagaca

SEQ ID NO: 362710 - RNA, 19 nt, Homo sapiens
gacgacaucccuggaaugg

SEQ ID NO: 362711 - RNA, 19 nt, Homo sapiens
gaguaaaccuccaaagaaa

SEQ ID NO: 362712 - RNA, 19 nt, Homo sapiens
cagaaucucucuugcagua

SEQ ID NO: 362713 - RNA, 19 nt, Homo sapiens
ggagauauuuaccuugaaa

SEQ ID NO: 362714 - RNA, 19 nt, Homo sapiens
gauuggaagugguuucuuu

SEQ ID NO: 362715 - RNA, 19 nt, Homo sapiens
gcaaaggcccucccaaguu

SEQ ID NO: 362716 - RNA, 19 nt, Homo sapiens
caaaggcccucccaaguuc

SEQ ID NO: 362717 - RNA, 19 nt, Homo sapiens
ggucauucccuaucaguua

SEQ ID NO: 362718 - RNA, 19 nt, Homo sapiens
gaaauucagcugauuggaa

SEQ ID NO: 362719 - RNA, 19 nt, Homo sapiens
aaugacaucugcuguaauu

SEQ ID NO: 362720 - RNA, 19 nt, Homo sapiens
ucaaugacaucugcuguaa

SEQ ID NO: 362721 - RNA, 19 nt, Homo sapiens
aaagaaaggugugaaagga

SEQ ID NO: 362722 - RNA, 19 nt, Homo sapiens
gaaaggauuuggagaugac

SEQ ID NO: 362723 - RNA, 19 nt, Homo sapiens
agaaaggugugaaaggauu

SEQ ID NO: 362724 - RNA, 19 nt, Homo sapiens
ggaagugguuucuuugacu

SEQ ID NO: 362725 - RNA, 19 nt, Homo sapiens
gaggcagacucgccaauuc

SEQ ID NO: 362726 - RNA, 19 nt, Homo sapiens
gaaucucucuugcaguaca

SEQ ID NO: 362727 - RNA, 19 nt, Homo sapiens
agaguaaaccuccaaagaa

SEQ ID NO: 362728 - RNA, 19 nt, Homo sapiens
gaaaggugugaaaggauuu

SEQ ID NO: 362729 - RNA, 19 nt, Homo sapiens
ugaaaggauuuggagauga

SEQ ID NO: 362730 - RNA, 19 nt, Homo sapiens
gugaaaggauuuggagaug

SEQ ID NO: 362731 - RNA, 19 nt, Homo sapiens
guggaugcauuucaaacuu

SEQ ID NO: 362732 - RNA, 19 nt, Homo sapiens
ucaaggucauucccuauca

SEQ ID NO: 362733 - RNA, 19 nt, Homo sapiens
aauaguggaugcauuucaa

SEQ ID NO: 362734 - RNA, 19 nt, Homo sapiens
gcuaggaacagauaucaca

SEQ ID NO: 362735 - RNA, 19 nt, Homo sapiens
caaagaaaggugugaaagg

SEQ ID NO: 362736 - RNA, 19 nt, Homo sapiens
cccuaucaguuacuacuaa

SEQ ID NO: 362737 - RNA, 19 nt, Homo sapiens
gcugauaggaacaacauuc

SEQ ID NO: 362738 - RNA, 19 nt, Homo sapiens
guucugccacucucaauga

SEQ ID NO: 362739 - RNA, 19 nt, Homo sapiens
aagaguaaaccuccaaaga

SEQ ID NO: 362740 - RNA, 19 nt, Homo sapiens
uggaugcauuucaaacuug

SEQ ID NO: 362741 - RNA, 19 nt, Homo sapiens
cuaguuagaagucaucaau

SEQ ID NO: 362742 - RNA, 19 nt, Homo sapiens
guaaaccuccaaagaaagg

SEQ ID NO: 362743 - RNA, 19 nt, Homo sapiens
gaagucaucaauauuucuc

SEQ ID NO: 362744 - RNA, 19 nt, Homo sapiens
gacaucugcuguaauuuug

SEQ ID NO: 362745 - RNA, 19 nt, Homo sapiens
cugccggagucuugaaauu

SEQ ID NO: 362746 - RNA, 19 nt, Homo sapiens
ugacaucugcuguaauuuu

SEQ ID NO: 362747 - RNA, 19 nt, Homo sapiens
ccuaccagcuaguuagaag

SEQ ID NO: 362748 - RNA, 19 nt, Homo sapiens
cagacucgccaauucaaga

SEQ ID NO: 362749 - RNA, 19 nt, Homo sapiens
ccaaagaaaggugugaaag

SEQ ID NO: 362750 - RNA, 19 nt, Homo sapiens
gggcuaggaacagauauca

SEQ ID NO: 362751 - RNA, 19 nt, Homo sapiens
guuuaucuguaaguccuuu

SEQ ID NO: 362752 - RNA, 19 nt, Homo sapiens
ucaaaauaguggaugcauu

SEQ ID NO: 362753 - RNA, 19 nt, Homo sapiens
ucagccaccuggaauugca

SEQ ID NO: 362754 - RNA, 19 nt, Homo sapiens
cccaccuccucauauuuaa

SEQ ID NO: 362755 - RNA, 19 nt, Homo sapiens
ucaguuacuacuaagaguu

SEQ ID NO: 362756 - RNA, 19 nt, Homo sapiens
caaggucauucccuaucag

SEQ ID NO: 362757 - RNA, 19 nt, Homo sapiens
ucuguaaguccuuuaaauc

SEQ ID NO: 362758 - RNA, 19 nt, Homo sapiens
ucgcucaguuugggauuau

SEQ ID NO: 362759 - RNA, 19 nt, Homo sapiens
caguacagcucaaaauagu

SEQ ID NO: 362760 - RNA, 19 nt, Homo sapiens
cagcugauaggaacaacau

SEQ ID NO: 362761 - RNA, 19 nt, Homo sapiens
gaucugccggagucuugaa

SEQ ID NO: 362762 - RNA, 19 nt, Homo sapiens
gcaguacagcucaaaauag

SEQ ID NO: 362763 - RNA, 19 nt, Homo sapiens
cagcugauuggaagugguu

SEQ ID NO: 362764 - RNA, 19 nt, Homo sapiens
gaugaaacuucguagauuu

SEQ ID NO: 362765 - RNA, 19 nt, Homo sapiens
gaaauagucuaguaagcuu

SEQ ID NO: 362766 - RNA, 19 nt, Homo sapiens
guacugcgguuucaaauuc

SEQ ID NO: 362767 - RNA, 19 nt, Homo sapiens
ucagaaggcuacuaaguuu

SEQ ID NO: 362768 - RNA, 19 nt, Homo sapiens
ggaagggacugcagagaga

SEQ ID NO: 362769 - RNA, 19 nt, Homo sapiens
gaguaucugucuuuguuua

SEQ ID NO: 362770 - RNA, 19 nt, Homo sapiens
gcuaggagauguacgugua

SEQ ID NO: 362771 - RNA, 19 nt, Homo sapiens
ucaaguggaucaccucuaa

SEQ ID NO: 362772 - RNA, 19 nt, Homo sapiens
ggauagaggugauuuaugc

SEQ ID NO: 362773 - RNA, 19 nt, Homo sapiens
gauaggugcucugauacua

SEQ ID NO: 362774 - RNA, 19 nt, Homo sapiens
guacuuccauuuagauaug

SEQ ID NO: 362775 - RNA, 19 nt, Homo sapiens
cuaguaagcuuaaccuuuc

SEQ ID NO: 362776 - RNA, 19 nt, Homo sapiens
cagccagcauuauuuauuu

SEQ ID NO: 362777 - RNA, 19 nt, Homo sapiens
gccaugcacuguuacuuaa

SEQ ID NO: 362778 - RNA, 19 nt, Homo sapiens
ucaagaagauuaccacagu

SEQ ID NO: 362779 - RNA, 19 nt, Homo sapiens
aaccuaagcuugccaauuc

SEQ ID NO: 362780 - RNA, 19 nt, Homo sapiens
gaagauuaccacagucaaa

SEQ ID NO: 362781 - RNA, 19 nt, Homo sapiens
gaagagguucucacccaua

SEQ ID NO: 362782 - RNA, 19 nt, Homo sapiens
cauuugaacccacuuguua

SEQ ID NO: 362783 - RNA, 19 nt, Homo sapiens
cgggacagcugguauuuau

SEQ ID NO: 362784 - RNA, 19 nt, Homo sapiens
ggacagcugguauuuauca

SEQ ID NO: 362785 - RNA, 19 nt, Homo sapiens
ugaacccacuuguuaauug

SEQ ID NO: 362786 - RNA, 19 nt, Homo sapiens
guggagcuauuuccuauga

SEQ ID NO: 362787 - RNA, 19 nt, Homo sapiens
acagauggcuuugaaaugu

SEQ ID NO: 362788 - RNA, 19 nt, Homo sapiens
guuaaucaaccuuuccuua

SEQ ID NO: 362789 - RNA, 19 nt, Homo sapiens
gcaauaugaauuuggcuuu

SEQ ID NO: 362790 - RNA, 19 nt, Homo sapiens
gaaagcaggcaacaaaugg

SEQ ID NO: 362791 - RNA, 19 nt, Homo sapiens
ggccaugcacuguuacuua

SEQ ID NO: 362792 - RNA, 19 nt, Homo sapiens
uaagaggcguggagcuauu

SEQ ID NO: 362793 - RNA, 19 nt, Homo sapiens
gaaccuaagcuugccaauu

SEQ ID NO: 362794 - RNA, 19 nt, Homo sapiens
ucuuagaucuucacgcuuu

SEQ ID NO: 362795 - RNA, 19 nt, Homo sapiens
gcuuugaaaugugcugaua

SEQ ID NO: 362796 - RNA, 19 nt, Homo sapiens
gaaugaguaucugucuuug

SEQ ID NO: 362797 - RNA, 19 nt, Homo sapiens
uuagaaagcaggcaacaaa

SEQ ID NO: 362798 - RNA, 19 nt, Homo sapiens
ucucacaucugccauuaga

SEQ ID NO: 362799 - RNA, 19 nt, Homo sapiens
ugaugaaacuucguagauu

SEQ ID NO: 362800 - RNA, 19 nt, Homo sapiens
gauaugaugaaacuucgua

SEQ ID NO: 362801 - RNA, 19 nt, Homo sapiens
guauuuaucagacuccuaa

SEQ ID NO: 362802 - RNA, 19 nt, Homo sapiens
gaucugcagugggcuuauu

SEQ ID NO: 362803 - RNA, 19 nt, Homo sapiens
gcguggagcuauuuccuau

SEQ ID NO: 362804 - RNA, 19 nt, Homo sapiens
ugucuggccuugguucuua

SEQ ID NO: 362805 - RNA, 19 nt, Homo sapiens
ucacaucugccauuagaaa

SEQ ID NO: 362806 - RNA, 19 nt, Homo sapiens
auacaagaauaccucagua

SEQ ID NO: 362807 - RNA, 19 nt, Homo sapiens
gagccgagcaggauuugaa

SEQ ID NO: 362808 - RNA, 19 nt, Homo sapiens
acacagacauuugguuuua

SEQ ID NO: 362809 - RNA, 19 nt, Homo sapiens
caacaaauggagacacaga

SEQ ID NO: 362810 - RNA, 19 nt, Homo sapiens
ggagcuauuuccuaugaca

SEQ ID NO: 362811 - RNA, 19 nt, Homo sapiens
gagguucucacccauauau

SEQ ID NO: 362812 - RNA, 19 nt, Homo sapiens
cuaguggagccuuuauuua

SEQ ID NO: 362813 - RNA, 19 nt, Homo sapiens
agaaugaguaucugucuuu

SEQ ID NO: 362814 - RNA, 19 nt, Homo sapiens
agacaucagucgccagaau

SEQ ID NO: 362815 - RNA, 19 nt, Homo sapiens
gcacuguuacuuaaaggaa

SEQ ID NO: 362816 - RNA, 19 nt, Homo sapiens
gcagcgggcuuuugauuga

SEQ ID NO: 362817 - RNA, 19 nt, Homo sapiens
gaacccacuuguuaauugc

SEQ ID NO: 362818 - RNA, 19 nt, Homo sapiens
gauuuccucuguuggauca

SEQ ID NO: 362819 - RNA, 19 nt, Homo sapiens
acaaauggagacacagaua

SEQ ID NO: 362820 - RNA, 19 nt, Homo sapiens
gaauaccucaguacuggaa

SEQ ID NO: 362821 - RNA, 19 nt, Homo sapiens
gaaauugaagugucugucu

SEQ ID NO: 362822 - RNA, 19 nt, Homo sapiens
gauacuagccacagacauc

SEQ ID NO: 362823 - RNA, 19 nt, Homo sapiens
gagccuuuauuuacagaau

SEQ ID NO: 362824 - RNA, 19 nt, Homo sapiens
agacacagacauuugguuu

SEQ ID NO: 362825 - RNA, 19 nt, Homo sapiens
augaguaucugucuuuguu

SEQ ID NO: 362826 - RNA, 19 nt, Homo sapiens
ggcaacaaauggagacaca

SEQ ID NO: 362827 - RNA, 19 nt, Homo sapiens
cuucauggauuaauugagu

SEQ ID NO: 362828 - RNA, 19 nt, Homo sapiens
ggaaauagucuaguaagcu

SEQ ID NO: 362829 - RNA, 19 nt, Homo sapiens
gauagacuaacaaauggaa

SEQ ID NO: 362830 - RNA, 19 nt, Homo sapiens
ccuaguggagccuuuauuu

SEQ ID NO: 362831 - RNA, 19 nt, Homo sapiens
caucaaggagauauagaaa

SEQ ID NO: 362832 - RNA, 19 nt, Homo sapiens
cagacugcauuauacauuc

SEQ ID NO: 362833 - RNA, 19 nt, Homo sapiens
caagauuuccucuguugga

SEQ ID NO: 362834 - RNA, 19 nt, Homo sapiens
ccagccagcauuauuuauu

SEQ ID NO: 362835 - RNA, 19 nt, Homo sapiens
gagaacagucgagcaguga

SEQ ID NO: 362836 - RNA, 19 nt, Homo sapiens
guaaggagccgagcaggau

SEQ ID NO: 362837 - RNA, 19 nt, Homo sapiens
uccaagauuuccucuguug

SEQ ID NO: 362838 - RNA, 19 nt, Homo sapiens
ugucggacgugggaauuaa

SEQ ID NO: 362839 - RNA, 19 nt, Homo sapiens
caagaauaccucaguacug

SEQ ID NO: 362840 - RNA, 19 nt, Homo sapiens
gaucagacugcauuauaca

SEQ ID NO: 362841 - RNA, 19 nt, Homo sapiens
ggacaagccaaguguaugc

SEQ ID NO: 362842 - RNA, 19 nt, Homo sapiens
ggagauguacguguaagga

SEQ ID NO: 362843 - RNA, 19 nt, Homo sapiens
cugaucagacugcauuaua

SEQ ID NO: 362844 - RNA, 19 nt, Homo sapiens
cucaggccaugcacuguua

SEQ ID NO: 362845 - RNA, 19 nt, Homo sapiens
ucuaguaagcuuaaccuuu

SEQ ID NO: 362846 - RNA, 19 nt, Homo sapiens
aagagguucucacccauau

SEQ ID NO: 362847 - RNA, 19 nt, Homo sapiens
ugccaagguuuccaaguga

SEQ ID NO: 362848 - RNA, 19 nt, Homo sapiens
acaaggcuaucccagacaa

SEQ ID NO: 362849 - RNA, 19 nt, Homo sapiens
gaguacuuccauuuagaua

SEQ ID NO: 362850 - RNA, 19 nt, Homo sapiens
aauaucagaaggcuacuaa

SEQ ID NO: 362851 - RNA, 19 nt, Homo sapiens
guucucacccauauauuga

SEQ ID NO: 362852 - RNA, 19 nt, Homo sapiens
gaucgucacacugaaucua

SEQ ID NO: 362853 - RNA, 19 nt, Homo sapiens
ggacgugggaauuaagcaa

SEQ ID NO: 362854 - RNA, 19 nt, Homo sapiens
caaauggagacacagauag

SEQ ID NO: 362855 - RNA, 19 nt, Homo sapiens
uggcaacuuuauacaagaa

SEQ ID NO: 362856 - RNA, 19 nt, Homo sapiens
ccaaguguaugcuggaaaa

SEQ ID NO: 362857 - RNA, 19 nt, Homo sapiens
acccgaacauacagcaaua

SEQ ID NO: 362858 - RNA, 19 nt, Homo sapiens
uaagcaagcaguggaguga

SEQ ID NO: 362859 - RNA, 19 nt, Homo sapiens
accauuacuuggcaacuuu

SEQ ID NO: 362860 - RNA, 19 nt, Homo sapiens
gucaaaauccuuaccauaa

SEQ ID NO: 362861 - RNA, 19 nt, Homo sapiens
uuacagauggcuuugaaau

SEQ ID NO: 362862 - RNA, 19 nt, Homo sapiens
ggugauuuaugccuagaag

SEQ ID NO: 362863 - RNA, 19 nt, Homo sapiens
ucucacccauauauugauu

SEQ ID NO: 362864 - RNA, 19 nt, Homo sapiens
gaugaaacuucguagauuu

SEQ ID NO: 362865 - RNA, 19 nt, Homo sapiens
gaaauagucuaguaagcuu

SEQ ID NO: 362866 - RNA, 19 nt, Homo sapiens
ccacugagccugaucauaa

SEQ ID NO: 362867 - RNA, 19 nt, Homo sapiens
agauauagcugguuagaaa

SEQ ID NO: 362868 - RNA, 19 nt, Homo sapiens
guacugcgguuucaaauuc

SEQ ID NO: 362869 - RNA, 19 nt, Homo sapiens
ucagaaggcuacuaaguuu

SEQ ID NO: 362870 - RNA, 19 nt, Homo sapiens
gaacuguggccauacuuua

SEQ ID NO: 362871 - RNA, 19 nt, Homo sapiens
cuaagaagguagcacaaua

SEQ ID NO: 362872 - RNA, 19 nt, Homo sapiens
gaguaucugucuuuguuua

SEQ ID NO: 362873 - RNA, 19 nt, Homo sapiens
gcuaggagauguacgugua

SEQ ID NO: 362874 - RNA, 19 nt, Homo sapiens
gcaauaacuuguuucuguu

SEQ ID NO: 362875 - RNA, 19 nt, Homo sapiens
ggauagaggugauuuaugc

SEQ ID NO: 362876 - RNA, 19 nt, Homo sapiens
ggcaguagcucaacaagga

SEQ ID NO: 362877 - RNA, 19 nt, Homo sapiens
ugaaauaugugcccaaagu

SEQ ID NO: 362878 - RNA, 19 nt, Homo sapiens
gaauagggccuuugagaau

SEQ ID NO: 362879 - RNA, 19 nt, Homo sapiens
gauaggugcucugauacua

SEQ ID NO: 362880 - RNA, 19 nt, Homo sapiens
guacuuccauuuagauaug

SEQ ID NO: 362881 - RNA, 19 nt, Homo sapiens
gauaugcuuugucuugauu

SEQ ID NO: 362882 - RNA, 19 nt, Homo sapiens
gaacaggcagcagcaauaa

SEQ ID NO: 362883 - RNA, 19 nt, Homo sapiens
cuaguaagcuuaaccuuuc

SEQ ID NO: 362884 - RNA, 19 nt, Homo sapiens
gccaugcacuguuacuuaa

SEQ ID NO: 362885 - RNA, 19 nt, Homo sapiens
ucaagaagauuaccacagu

SEQ ID NO: 362886 - RNA, 19 nt, Homo sapiens
cagcagcaauaacuuguuu

SEQ ID NO: 362887 - RNA, 19 nt, Homo sapiens
uguuauggcucuucuaauu

SEQ ID NO: 362888 - RNA, 19 nt, Homo sapiens
aaccuaagcuugccaauuc

SEQ ID NO: 362889 - RNA, 19 nt, Homo sapiens
gaagauuaccacagucaaa

SEQ ID NO: 362890 - RNA, 19 nt, Homo sapiens
gaagagguucucacccaua

SEQ ID NO: 362891 - RNA, 19 nt, Homo sapiens
ggaagagcguguagaacug

SEQ ID NO: 362892 - RNA, 19 nt, Homo sapiens
gaaaauguccugugacuga

SEQ ID NO: 362893 - RNA, 19 nt, Homo sapiens
guggagcuauuuccuauga

SEQ ID NO: 362894 - RNA, 19 nt, Homo sapiens
ugacuaggauugagugugu

SEQ ID NO: 362895 - RNA, 19 nt, Homo sapiens
ugagugaacuaauaacugu

SEQ ID NO: 362896 - RNA, 19 nt, Homo sapiens
caacuucccucucauuugc

SEQ ID NO: 362897 - RNA, 19 nt, Homo sapiens
aaggauagguaaacaaaga

SEQ ID NO: 362898 - RNA, 19 nt, Homo sapiens
acagauggcuuugaaaugu

SEQ ID NO: 362899 - RNA, 19 nt, Homo sapiens
guuaaucaaccuuuccuua

SEQ ID NO: 362900 - RNA, 19 nt, Homo sapiens
ccagauaugcuuugucuug

SEQ ID NO: 362901 - RNA, 19 nt, Homo sapiens
cgauuugccuucagaguga

SEQ ID NO: 362902 - RNA, 19 nt, Homo sapiens
gacaggcccuuauaaucuu

SEQ ID NO: 362903 - RNA, 19 nt, Homo sapiens
gaaaguugacuaggauuga

SEQ ID NO: 362904 - RNA, 19 nt, Homo sapiens
gaaagcaggcaacaaaugg

SEQ ID NO: 362905 - RNA, 19 nt, Homo sapiens
ggccaugcacuguuacuua

SEQ ID NO: 362906 - RNA, 19 nt, Homo sapiens
ugaaguauguguagcuugu

SEQ ID NO: 362907 - RNA, 19 nt, Homo sapiens
uguguugagugaacuaaua

SEQ ID NO: 362908 - RNA, 19 nt, Homo sapiens
gaagaggcagcucaaaugu

SEQ ID NO: 362909 - RNA, 19 nt, Homo sapiens
gaaccuaagcuugccaauu

SEQ ID NO: 362910 - RNA, 19 nt, Homo sapiens
ucuuagaucuucacgcuuu

SEQ ID NO: 362911 - RNA, 19 nt, Homo sapiens
agaggcagcucaaauguca

SEQ ID NO: 362912 - RNA, 19 nt, Homo sapiens
gcuuugaaaugugcugaua

SEQ ID NO: 362913 - RNA, 19 nt, Homo sapiens
ucgggacgcuucuguguuu

SEQ ID NO: 362914 - RNA, 19 nt, Homo sapiens
gaaugaguaucugucuuug

SEQ ID NO: 362915 - RNA, 19 nt, Homo sapiens
uuagaaagcaggcaacaaa

SEQ ID NO: 362916 - RNA, 19 nt, Homo sapiens
ucucacaucugccauuaga

SEQ ID NO: 362917 - RNA, 19 nt, Homo sapiens
ugaugaaacuucguagauu

SEQ ID NO: 362918 - RNA, 19 nt, Homo sapiens
gauaugaugaaacuucgua

SEQ ID NO: 362919 - RNA, 19 nt, Homo sapiens
gaaauaugugcccaaaguu

SEQ ID NO: 362920 - RNA, 19 nt, Homo sapiens
gaucugcagugggcuuauu

SEQ ID NO: 362921 - RNA, 19 nt, Homo sapiens
gcguggagcuauuuccuau

SEQ ID NO: 362922 - RNA, 19 nt, Homo sapiens
ugaacacagugaaauaugu

SEQ ID NO: 362923 - RNA, 19 nt, Homo sapiens
ucacaucugccauuagaaa

SEQ ID NO: 362924 - RNA, 19 nt, Homo sapiens
guguagaacuguggccaua

SEQ ID NO: 362925 - RNA, 19 nt, Homo sapiens
gcucaaaugucaccuucuc

SEQ ID NO: 362926 - RNA, 19 nt, Homo sapiens
agcaauaacuuguuucugu

SEQ ID NO: 362927 - RNA, 19 nt, Homo sapiens
gagccgagcaggauuugaa

SEQ ID NO: 362928 - RNA, 19 nt, Homo sapiens
auacaagaauaccucagua

SEQ ID NO: 362929 - RNA, 19 nt, Homo sapiens
ccaaaguucagaaagauga

SEQ ID NO: 362930 - RNA, 19 nt, Homo sapiens
ggaaaguugacuaggauug

SEQ ID NO: 362931 - RNA, 19 nt, Homo sapiens
caggaaaguugacuaggau

SEQ ID NO: 362932 - RNA, 19 nt, Homo sapiens
acaggaaaguugacuagga

SEQ ID NO: 362933 - RNA, 19 nt, Homo sapiens
acacagacauuugguuuua

SEQ ID NO: 362934 - RNA, 19 nt, Homo sapiens
caacaaauggagacacaga

SEQ ID NO: 362935 - RNA, 19 nt, Homo sapiens
ggagcuauuuccuaugaca

SEQ ID NO: 362936 - RNA, 19 nt, Homo sapiens
gagguucucacccauauau

SEQ ID NO: 362937 - RNA, 19 nt, Homo sapiens
cagauaugcuuugucuuga

SEQ ID NO: 362938 - RNA, 19 nt, Homo sapiens
gcaauggauacucaugaaa

SEQ ID NO: 362939 - RNA, 19 nt, Homo sapiens
uaagaagguagcacaauau

SEQ ID NO: 362940 - RNA, 19 nt, Homo sapiens
ugaagaggcagcucaaaug

SEQ ID NO: 362941 - RNA, 19 nt, Homo sapiens
gcucuucuaauucucauuu

SEQ ID NO: 362942 - RNA, 19 nt, Homo sapiens
agaaugaguaucugucuuu

SEQ ID NO: 362943 - RNA, 19 nt, Homo sapiens
agacaucagucgccagaau

SEQ ID NO: 362944 - RNA, 19 nt, Homo sapiens
gcacuguuacuuaaaggaa

SEQ ID NO: 362945 - RNA, 19 nt, Homo sapiens
gcccaaaguucagaaagau

SEQ ID NO: 362946 - RNA, 19 nt, Homo sapiens
gcacgaggcccuugagaac

SEQ ID NO: 362947 - RNA, 19 nt, Homo sapiens
ccaugugccucguagaguu

SEQ ID NO: 362948 - RNA, 19 nt, Homo sapiens
acaaauggagacacagaua

SEQ ID NO: 362949 - RNA, 19 nt, Homo sapiens
gaauaccucaguacuggaa

SEQ ID NO: 362950 - RNA, 19 nt, Homo sapiens
gaaauugaagugucugucu

SEQ ID NO: 362951 - RNA, 19 nt, Homo sapiens
caauuuagaaccagauaug

SEQ ID NO: 362952 - RNA, 19 nt, Homo sapiens
ccagaaauucagaaacgua

SEQ ID NO: 362953 - RNA, 19 nt, Homo sapiens
uuugguagcugguguugaa

SEQ ID NO: 362954 - RNA, 19 nt, Homo sapiens
agaagcugcucuccacuug

SEQ ID NO: 362955 - RNA, 19 nt, Homo sapiens
ucagaggcguggagcuauu

SEQ ID NO: 362956 - RNA, 19 nt, Homo sapiens
gauacuagccacagacauc

SEQ ID NO: 362957 - RNA, 19 nt, Homo sapiens
agaacuguguguugaguga

SEQ ID NO: 362958 - RNA, 19 nt, Homo sapiens
cauuugggacugccauuua

SEQ ID NO: 362959 - RNA, 19 nt, Homo sapiens
agacacagacauuugguuu

SEQ ID NO: 362960 - RNA, 19 nt, Homo sapiens
ugaauagggccuuugagaa

SEQ ID NO: 362961 - RNA, 19 nt, Homo sapiens
gguagcugguguugaauag

SEQ ID NO: 362962 - RNA, 19 nt, Homo sapiens
uaccacugccuguugauua

SEQ ID NO: 362963 - RNA, 19 nt, Homo sapiens
augaguaucugucuuuguu

SEQ ID NO: 362964 - RNA, 19 nt, Homo sapiens
ggacaaacaucaugacauu

SEQ ID NO: 362965 - RNA, 19 nt, Homo sapiens
gauaauaccugucauugga

SEQ ID NO: 362966 - RNA, 19 nt, Homo sapiens
ggaaaggacuggacgaaau

SEQ ID NO: 362967 - RNA, 19 nt, Homo sapiens
gaagauaaccaauguaaug

SEQ ID NO: 362968 - RNA, 19 nt, Homo sapiens
caaagaagauaaccaaugu

SEQ ID NO: 362969 - RNA, 19 nt, Homo sapiens
gaagugagcuggccauuuu

SEQ ID NO: 362970 - RNA, 19 nt, Homo sapiens
ucagucaggugaauuaaua

SEQ ID NO: 362971 - RNA, 19 nt, Homo sapiens
caaaugguuucaagcaaua

SEQ ID NO: 362972 - RNA, 19 nt, Homo sapiens
gagaagugccuauaaauga

SEQ ID NO: 362973 - RNA, 19 nt, Homo sapiens
acaauaggccuuugauuua

SEQ ID NO: 362974 - RNA, 19 nt, Homo sapiens
ggguuuaaguguacaguua

SEQ ID NO: 362975 - RNA, 19 nt, Homo sapiens
ccaaaucucuuucauugau

SEQ ID NO: 362976 - RNA, 19 nt, Homo sapiens
gagaagaguuguccguaau

SEQ ID NO: 362977 - RNA, 19 nt, Homo sapiens
ucaaacgaaugcugauuaa

SEQ ID NO: 362978 - RNA, 19 nt, Homo sapiens
ccacagaaaugacaaagca

SEQ ID NO: 362979 - RNA, 19 nt, Homo sapiens
gaaccggacccuaaucaaa

SEQ ID NO: 362980 - RNA, 19 nt, Homo sapiens
gaagauaauaccugucauu

SEQ ID NO: 362981 - RNA, 19 nt, Homo sapiens
gaggugcgaucacaacuga

SEQ ID NO: 362982 - RNA, 19 nt, Homo sapiens
ucaccaagguaaucaauau

SEQ ID NO: 362983 - RNA, 19 nt, Homo sapiens
ucccaaaucucuuucauug

SEQ ID NO: 362984 - RNA, 19 nt, Homo sapiens
cacaauaggccuuugauuu

SEQ ID NO: 362985 - RNA, 19 nt, Homo sapiens
uaagaaccacugaguuaua

SEQ ID NO: 362986 - RNA, 19 nt, Homo sapiens
gcaaggaauuuacuaugca

SEQ ID NO: 362987 - RNA, 19 nt, Homo sapiens
gugauaaacacuaugcuua

SEQ ID NO: 362988 - RNA, 19 nt, Homo sapiens
caauaggccuuugauuuau

SEQ ID NO: 362989 - RNA, 19 nt, Homo sapiens
caauaaggcugagaaaaua

SEQ ID NO: 362990 - RNA, 19 nt, Homo sapiens
ccagagcccugaagcuuug

SEQ ID NO: 362991 - RNA, 19 nt, Homo sapiens
ucuaagaaccacugaguua

SEQ ID NO: 362992 - RNA, 19 nt, Homo sapiens
gaaaauauccgaauguguu

SEQ ID NO: 362993 - RNA, 19 nt, Homo sapiens
ggagaagugccuauaaaug

SEQ ID NO: 362994 - RNA, 19 nt, Homo sapiens
caucaaaacucucagaaaa

SEQ ID NO: 362995 - RNA, 19 nt, Homo sapiens
gauuaaaugugcugaugug

SEQ ID NO: 362996 - RNA, 19 nt, Homo sapiens
ccagagaaccggacccuaa

SEQ ID NO: 362997 - RNA, 19 nt, Homo sapiens
ggucuuagccacagaaaug

SEQ ID NO: 362998 - RNA, 19 nt, Homo sapiens
gaaaggacuggacgaaaug

SEQ ID NO: 362999 - RNA, 19 nt, Homo sapiens
cgagugggcugcacgcauu

SEQ ID NO: 363000 - RNA, 19 nt, Homo sapiens
gggaaugaauauguucuuu

SEQ ID NO: 363001 - RNA, 19 nt, Homo sapiens
gauaaccaauguaauggau

SEQ ID NO: 363002 - RNA, 19 nt, Homo sapiens
ccaaaucccaaaucucuuu

SEQ ID NO: 363003 - RNA, 19 nt, Homo sapiens
gaagguagcaguagcugau

SEQ ID NO: 363004 - RNA, 19 nt, Homo sapiens
ucaaaugguuucaagcaau

SEQ ID NO: 363005 - RNA, 19 nt, Homo sapiens
uaucaaugcugcccaggaa

SEQ ID NO: 363006 - RNA, 19 nt, Homo sapiens
aaacaacaaugggcuauca

SEQ ID NO: 363007 - RNA, 19 nt, Homo sapiens
caucauagaccacagaaau

SEQ ID NO: 363008 - RNA, 19 nt, Homo sapiens
uaaccaauguaauggauuc

SEQ ID NO: 363009 - RNA, 19 nt, Homo sapiens
gggcuuaccuguggugaug

SEQ ID NO: 363010 - RNA, 19 nt, Homo sapiens
gagcaugucaacaaauuug

SEQ ID NO: 363011 - RNA, 19 nt, Homo sapiens
agagaagaguuguccguaa

SEQ ID NO: 363012 - RNA, 19 nt, Homo sapiens
agaccugccugauuuaaug

SEQ ID NO: 363013 - RNA, 19 nt, Homo sapiens
gaaccacugaguuauauuc

SEQ ID NO: 363014 - RNA, 19 nt, Homo sapiens
agaagugccuauaaaugaa

SEQ ID NO: 363015 - RNA, 19 nt, Homo sapiens
cagugaagaugcaauugaa

SEQ ID NO: 363016 - RNA, 19 nt, Homo sapiens
gcauuucggaagaauauuu

SEQ ID NO: 363017 - RNA, 19 nt, Homo sapiens
gaaaauggggaaacugaua

SEQ ID NO: 363018 - RNA, 19 nt, Homo sapiens
caacaaacccuuggcaaca

SEQ ID NO: 363019 - RNA, 19 nt, Homo sapiens
cuuaaugucugaugguuug

SEQ ID NO: 363020 - RNA, 19 nt, Homo sapiens
aguauucacugcauuagaa

SEQ ID NO: 363021 - RNA, 19 nt, Homo sapiens
acucagggcuuguaacuca

SEQ ID NO: 363022 - RNA, 19 nt, Homo sapiens
aaagcaggguuuaagugua

SEQ ID NO: 363023 - RNA, 19 nt, Homo sapiens
ccaaagaagauaaccaaug

SEQ ID NO: 363024 - RNA, 19 nt, Homo sapiens
ccaacuccuuccuguguaa

SEQ ID NO: 363025 - RNA, 19 nt, Homo sapiens
caucauggccugcuacaau

SEQ ID NO: 363026 - RNA, 19 nt, Homo sapiens
acaaggagguauguagaaa

SEQ ID NO: 363027 - RNA, 19 nt, Homo sapiens
gagauuucaucaagaucaa

SEQ ID NO: 363028 - RNA, 19 nt, Homo sapiens
ggagaugauaaaugcaaua

SEQ ID NO: 363029 - RNA, 19 nt, Homo sapiens
caaggaauuuacuaugcaa

SEQ ID NO: 363030 - RNA, 19 nt, Homo sapiens
gaagugccuauaaaugaaa

SEQ ID NO: 363031 - RNA, 19 nt, Homo sapiens
gugcaggucuaucagauca

SEQ ID NO: 363032 - RNA, 19 nt, Homo sapiens
ccaaggagaggauaaagga

SEQ ID NO: 363033 - RNA, 19 nt, Homo sapiens
ccaauuaucauuccuccaa

SEQ ID NO: 363034 - RNA, 19 nt, Homo sapiens
cuaagaucaugguuacaaa

SEQ ID NO: 363035 - RNA, 19 nt, Homo sapiens
gcucgauacuauaaauuca

SEQ ID NO: 363036 - RNA, 19 nt, Homo sapiens
uuucauuucugcuggauuu

SEQ ID NO: 363037 - RNA, 19 nt, Homo sapiens
ggaagugagcuggccauuu

SEQ ID NO: 363038 - RNA, 19 nt, Homo sapiens
uuguagaccugccugauuu

SEQ ID NO: 363039 - RNA, 19 nt, Homo sapiens
gauuaucgacauggucuua

SEQ ID NO: 363040 - RNA, 19 nt, Homo sapiens
acauggagaggaaugauua

SEQ ID NO: 363041 - RNA, 19 nt, Homo sapiens
aaucagacaggcaaacaua

SEQ ID NO: 363042 - RNA, 19 nt, Homo sapiens
gcaacaauaaggcugagaa

SEQ ID NO: 363043 - RNA, 19 nt, Homo sapiens
ggaaggaguuaggagaagu

SEQ ID NO: 363044 - RNA, 19 nt, Homo sapiens
aacgaaugcugauuaaaug

SEQ ID NO: 363045 - RNA, 19 nt, Homo sapiens
ccacaauucuacacauucu

SEQ ID NO: 363046 - RNA, 19 nt, Homo sapiens
gcuaagaucaugguuacaa

SEQ ID NO: 363047 - RNA, 19 nt, Homo sapiens
gaggaauacugggacuuug

SEQ ID NO: 363048 - RNA, 19 nt, Homo sapiens
ggaaugaauauguucuuuc

SEQ ID NO: 363049 - RNA, 19 nt, Homo sapiens
aagaaccacugaguuauau

SEQ ID NO: 363050 - RNA, 19 nt, Homo sapiens
caacaauaaggcugagaaa

SEQ ID NO: 363051 - RNA, 19 nt, Homo sapiens
ggcaaggaguggcaaggaa

SEQ ID NO: 363052 - RNA, 19 nt, Homo sapiens
gcuuguaacucaguauuca

SEQ ID NO: 363053 - RNA, 19 nt, Homo sapiens
caucuugacaacaacuuua

SEQ ID NO: 363054 - RNA, 19 nt, Homo sapiens
gauaaacacuaugcuuagg

SEQ ID NO: 363055 - RNA, 19 nt, Homo sapiens
uacauuccaugacaauuga

SEQ ID NO: 363056 - RNA, 19 nt, Homo sapiens
gcacgcauuucggaagaau

SEQ ID NO: 363057 - RNA, 19 nt, Homo sapiens
ggcaaggaauuuacuaugc

SEQ ID NO: 363058 - RNA, 19 nt, Homo sapiens
uaccacaauucuacacauu

SEQ ID NO: 363059 - RNA, 19 nt, Homo sapiens
aaacagugaagaugcaauu

SEQ ID NO: 363060 - RNA, 19 nt, Homo sapiens
gaagaguuguccguaaugc

SEQ ID NO: 363061 - RNA, 19 nt, Homo sapiens
caaacaucaugacauuauc

SEQ ID NO: 363062 - RNA, 19 nt, Homo sapiens
gagaaccggacccuaauca

SEQ ID NO: 363063 - RNA, 19 nt, Homo sapiens
gaaacuuuagauccaauug

SEQ ID NO: 363064 - RNA, 19 nt, Homo sapiens
ggacaucgauggacgcauu

SEQ ID NO: 363065 - RNA, 19 nt, Homo sapiens
ggcaagacaugcagaaauu

SEQ ID NO: 363066 - RNA, 19 nt, Homo sapiens
ggagguggcuguucugugu

SEQ ID NO: 363067 - RNA, 19 nt, Homo sapiens
ugaaagaguuacagaagaa

SEQ ID NO: 363068 - RNA, 19 nt, Homo sapiens
ggaaggagcauuugaaagu

SEQ ID NO: 363069 - RNA, 19 nt, Homo sapiens
gacgcgauguucccacuua

SEQ ID NO: 363070 - RNA, 19 nt, Homo sapiens
gcgcaucccuccagagaga

SEQ ID NO: 363071 - RNA, 19 nt, Homo sapiens
gaaggagcauuugaaagug

SEQ ID NO: 363072 - RNA, 19 nt, Homo sapiens
gcagagcaguucucaagag

SEQ ID NO: 363073 - RNA, 19 nt, Homo sapiens
gagagaagcagagauguga

SEQ ID NO: 363074 - RNA, 19 nt, Homo sapiens
gcaagacaugcagaaauua

SEQ ID NO: 363075 - RNA, 19 nt, Homo sapiens
gcaagagugacauuaagaa

SEQ ID NO: 363076 - RNA, 19 nt, Homo sapiens
ucacuuggcuguccuagag

SEQ ID NO: 363077 - RNA, 19 nt, Homo sapiens
ccacugacauggcaagaca

SEQ ID NO: 363078 - RNA, 19 nt, Homo sapiens
aagcugaaguugcaaauca

SEQ ID NO: 363079 - RNA, 19 nt, Homo sapiens
gcugugauaucucuaacga

SEQ ID NO: 363080 - RNA, 19 nt, Homo sapiens
gagaagcagagaugugaaa

SEQ ID NO: 363081 - RNA, 19 nt, Homo sapiens
gagcaguucucaagagcau

SEQ ID NO: 363082 - RNA, 19 nt, Homo sapiens
agagugacauuaagaagau

SEQ ID NO: 363083 - RNA, 19 nt, Homo sapiens
gauagaugacgccaugaaa

SEQ ID NO: 363084 - RNA, 19 nt, Homo sapiens
gagcugaagcggauagaug

SEQ ID NO: 363085 - RNA, 19 nt, Homo sapiens
caacaacacguaccagauc

SEQ ID NO: 363086 - RNA, 19 nt, Homo sapiens
cagauuggguucaucaagu

SEQ ID NO: 363087 - RNA, 19 nt, Homo sapiens
guucauggaccgagacaaa

SEQ ID NO: 363088 - RNA, 19 nt, Homo sapiens
caagacaugcagaaauuau

SEQ ID NO: 363089 - RNA, 19 nt, Homo sapiens
uaaaagugguggagauuga

SEQ ID NO: 363090 - RNA, 19 nt, Homo sapiens
gagggaaggagcauuugaa

SEQ ID NO: 363091 - RNA, 19 nt, Homo sapiens
ggauagaugacgccaugaa

SEQ ID NO: 363092 - RNA, 19 nt, Homo sapiens
gauauccugauccuaauga

SEQ ID NO: 363093 - RNA, 19 nt, Homo sapiens
gaaacgcguggaauuggaa

SEQ ID NO: 363094 - RNA, 19 nt, Homo sapiens
acugaaagcugaaguugca

SEQ ID NO: 363095 - RNA, 19 nt, Homo sapiens
ccagagagagaagaauuaa

SEQ ID NO: 363096 - RNA, 19 nt, Homo sapiens
gcagagcgaccgugagaag

SEQ ID NO: 363097 - RNA, 19 nt, Homo sapiens
aagguaaucuucagcaagu

SEQ ID NO: 363098 - RNA, 19 nt, Homo sapiens
uagagaaacgcguggaauu

SEQ ID NO: 363099 - RNA, 19 nt, Homo sapiens
agagagagaagaauuaauc

SEQ ID NO: 363100 - RNA, 19 nt, Homo sapiens
gcacaugacccugcugaag

SEQ ID NO: 363101 - RNA, 19 nt, Homo sapiens
augcagaaauuauggauuc

SEQ ID NO: 363102 - RNA, 19 nt, Homo sapiens
ggacgcauucagaagguaa

SEQ ID NO: 363103 - RNA, 19 nt, Homo sapiens
ugguggagauugagaaaug

SEQ ID NO: 363104 - RNA, 19 nt, Homo sapiens
ggaauuggaaggacuaaaa

SEQ ID NO: 363105 - RNA, 19 nt, Homo sapiens
uagaugacgccaugaaaga

SEQ ID NO: 363106 - RNA, 19 nt, Homo sapiens
gagcgaccgugagaaguca

SEQ ID NO: 363107 - RNA, 19 nt, Homo sapiens
caacaucuucuccaacauc

SEQ ID NO: 363108 - RNA, 19 nt, Homo sapiens
gaaagcugaaguugcaaau

SEQ ID NO: 363109 - RNA, 19 nt, Homo sapiens
ggagggaaggagcauuuga

SEQ ID NO: 363110 - RNA, 19 nt, Homo sapiens
agaagaagacugacagcuu

SEQ ID NO: 363111 - RNA, 19 nt, Homo sapiens
gucagggacuucagcauca

SEQ ID NO: 363112 - RNA, 19 nt, Homo sapiens
gauaaccacaagaaguuga

SEQ ID NO: 363113 - RNA, 19 nt, Homo sapiens
gguggacuguuuauuagag

SEQ ID NO: 363114 - RNA, 19 nt, Homo sapiens
uuggguggacuguuuauua

SEQ ID NO: 363115 - RNA, 19 nt, Homo sapiens
cacgacaacuacagaaaca

SEQ ID NO: 363116 - RNA, 19 nt, Homo sapiens
gaacgcacuccguacaaag

SEQ ID NO: 363117 - RNA, 19 nt, Homo sapiens
agauuggguucaucaaguu

SEQ ID NO: 363118 - RNA, 19 nt, Homo sapiens
agaacgcacuccguacaaa

SEQ ID NO: 363119 - RNA, 19 nt, Homo sapiens
ccgcuacaaugacaucuca

SEQ ID NO: 363120 - RNA, 19 nt, Homo sapiens
cgagaaguccagagagaga

SEQ ID NO: 363121 - RNA, 19 nt, Homo sapiens
cacaugacccugcugaaga

SEQ ID NO: 363122 - RNA, 19 nt, Homo sapiens
gagccugagugcaacaucu

SEQ ID NO: 363123 - RNA, 19 nt, Homo sapiens
acaaacggauauccugauc

SEQ ID NO: 363124 - RNA, 19 nt, Homo sapiens
uggauaaccacaagaaguu

SEQ ID NO: 363125 - RNA, 19 nt, Homo sapiens
gcaguucucaagagcauuc

SEQ ID NO: 363126 - RNA, 19 nt, Homo sapiens
ucauggaccuguucugcau

SEQ ID NO: 363127 - RNA, 19 nt, Homo sapiens
uaacgagguccguccaaug

SEQ ID NO: 363128 - RNA, 19 nt, Homo sapiens
ugcaacaucuucuccaaca

SEQ ID NO: 363129 - RNA, 19 nt, Homo sapiens
gaaacaaccccuuccacaa

SEQ ID NO: 363130 - RNA, 19 nt, Homo sapiens
agaaacgcguggaauugga

SEQ ID NO: 363131 - RNA, 19 nt, Homo sapiens
gagaaacgcguggaauugg

SEQ ID NO: 363132 - RNA, 19 nt, Homo sapiens
agagagagaagcagagaug

SEQ ID NO: 363133 - RNA, 19 nt, Homo sapiens
caugaaagaguuacagaag

SEQ ID NO: 363134 - RNA, 19 nt, Homo sapiens
guccugaucccaauguuug

SEQ ID NO: 363135 - RNA, 19 nt, Homo sapiens
agccuuggguggacuguuu

SEQ ID NO: 363136 - RNA, 19 nt, Homo sapiens
gagaaaugcaagagugaca

SEQ ID NO: 363137 - RNA, 19 nt, Homo sapiens
uggguggacuguuuauuag

SEQ ID NO: 363138 - RNA, 19 nt, Homo sapiens
agagaaacgcguggaauug

SEQ ID NO: 363139 - RNA, 19 nt, Homo sapiens
ccaucuaccuggacaucga

SEQ ID NO: 363140 - RNA, 19 nt, Homo sapiens
ucaagagcauucaaaauca

SEQ ID NO: 363141 - RNA, 19 nt, Homo sapiens
ccaccgagaaguccagaga

SEQ ID NO: 363142 - RNA, 19 nt, Homo sapiens
augaaagaguuacagaaga

SEQ ID NO: 363143 - RNA, 19 nt, Homo sapiens
caacuccagcgacaucaug

SEQ ID NO: 363144 - RNA, 19 nt, Homo sapiens
acaugacccugcugaagau

SEQ ID NO: 363145 - RNA, 19 nt, Homo sapiens
gcaacaucuucuccaacau

SEQ ID NO: 363146 - RNA, 19 nt, Homo sapiens
gcauucagaagguaaucuu

SEQ ID NO: 363147 - RNA, 19 nt, Homo sapiens
gagauugagaaaugcaaga

SEQ ID NO: 363148 - RNA, 19 nt, Homo sapiens
cagcgcaucccuccagaga

SEQ ID NO: 363149 - RNA, 19 nt, Homo sapiens
caaggccacagcccagauu

SEQ ID NO: 363150 - RNA, 19 nt, Homo sapiens
ggacuguuuauuagaggaa

SEQ ID NO: 363151 - RNA, 19 nt, Homo sapiens
ugagaccuguggccaucaa

SEQ ID NO: 363152 - RNA, 19 nt, Homo sapiens
gaccaucccggcuacaaca

SEQ ID NO: 363153 - RNA, 19 nt, Homo sapiens
uccagagagagaagaauua

SEQ ID NO: 363154 - RNA, 19 nt, Homo sapiens
cgacagggaaugaucacau

SEQ ID NO: 363155 - RNA, 19 nt, Homo sapiens
caacacguaccagaucaau

SEQ ID NO: 363156 - RNA, 19 nt, Homo sapiens
ggauaaccacaagaaguug

SEQ ID NO: 363157 - RNA, 19 nt, Homo sapiens
caagagugacauuaagaag

SEQ ID NO: 363158 - RNA, 19 nt, Homo sapiens
gagaaguccagagagagaa

SEQ ID NO: 363159 - RNA, 19 nt, Homo sapiens
uggccagucugcugagaga

SEQ ID NO: 363160 - RNA, 19 nt, Homo sapiens
ccaugaaagaguuacagaa

SEQ ID NO: 363161 - RNA, 19 nt, Homo sapiens
cuaacgagguccguccaau

SEQ ID NO: 363162 - RNA, 19 nt, Homo sapiens
gaggacaagagaaccacaa

SEQ ID NO: 363163 - RNA, 19 nt, Homo sapiens
caagagcauucaaaaucaa

SEQ ID NO: 363164 - RNA, 19 nt, Homo sapiens
gcaagaagauguggauuaa

SEQ ID NO: 363165 - RNA, 19 nt, Homo sapiens
caaagcaccuucagaaugu

SEQ ID NO: 363166 - RNA, 19 nt, Homo sapiens
ggaaguacaagaauccuua

SEQ ID NO: 363167 - RNA, 19 nt, Homo sapiens
gggaagggcuggaauagga

SEQ ID NO: 363168 - RNA, 19 nt, Homo sapiens
gcaaagcaccuucagaaug

SEQ ID NO: 363169 - RNA, 19 nt, Homo sapiens
gcuggaagccgucuacaua

SEQ ID NO: 363170 - RNA, 19 nt, Homo sapiens
ccacauccauggucuccua

SEQ ID NO: 363171 - RNA, 19 nt, Homo sapiens
guucagugcuggagaauca

SEQ ID NO: 363172 - RNA, 19 nt, Homo sapiens
ccaaccagauguccauuga

SEQ ID NO: 363173 - RNA, 19 nt, Homo sapiens
cugcagcuauccaugauua

SEQ ID NO: 363174 - RNA, 19 nt, Homo sapiens
gacaguccauugcuucuug

SEQ ID NO: 363175 - RNA, 19 nt, Homo sapiens
gaguaauccugcauugcua

SEQ ID NO: 363176 - RNA, 19 nt, Homo sapiens
cagcaaagcaccuucagaa

SEQ ID NO: 363177 - RNA, 19 nt, Homo sapiens
ugacugacguggcagagaa

SEQ ID NO: 363178 - RNA, 19 nt, Homo sapiens
guucucaacugucucaaga

SEQ ID NO: 363179 - RNA, 19 nt, Homo sapiens
ggauuaagcuucggucucu

SEQ ID NO: 363180 - RNA, 19 nt, Homo sapiens
agaauaagcagaaauggaa

SEQ ID NO: 363181 - RNA, 19 nt, Homo sapiens
gaugaugagaugaacauuu

SEQ ID NO: 363182 - RNA, 19 nt, Homo sapiens
uaccaaccaugcauuugua

SEQ ID NO: 363183 - RNA, 19 nt, Homo sapiens
caugguaccuuucuaggau

SEQ ID NO: 363184 - RNA, 19 nt, Homo sapiens
caccaaggaugaguuugua

SEQ ID NO: 363185 - RNA, 19 nt, Homo sapiens
gaugcaggaugaugagaug

SEQ ID NO: 363186 - RNA, 19 nt, Homo sapiens
ugacugcccuccuucuuuc

SEQ ID NO: 363187 - RNA, 19 nt, Homo sapiens
gagaauaagcagaaaugga

SEQ ID NO: 363188 - RNA, 19 nt, Homo sapiens
caagauucccacuguguuu

SEQ ID NO: 363189 - RNA, 19 nt, Homo sapiens
gcccaggucuucauugagu

SEQ ID NO: 363190 - RNA, 19 nt, Homo sapiens
caagaauccuuaccacaac

SEQ ID NO: 363191 - RNA, 19 nt, Homo sapiens
ggugaguaauccugcauug

SEQ ID NO: 363192 - RNA, 19 nt, Homo sapiens
gaucucuggugcuuugaug

SEQ ID NO: 363193 - RNA, 19 nt, Homo sapiens
ggaccaaggcccucaugga

SEQ ID NO: 363194 - RNA, 19 nt, Homo sapiens
gaagacagccuugcaacag

SEQ ID NO: 363195 - RNA, 19 nt, Homo sapiens
gaugagacacggcaaaucu

SEQ ID NO: 363196 - RNA, 19 nt, Homo sapiens
ugaagcaguuggagaaugg

SEQ ID NO: 363197 - RNA, 19 nt, Homo sapiens
gaagggcuggaauaggaua

SEQ ID NO: 363198 - RNA, 19 nt, Homo sapiens
ccacuggggugcacuuuaa

SEQ ID NO: 363199 - RNA, 19 nt, Homo sapiens
acaagaauccuuaccacaa

SEQ ID NO: 363200 - RNA, 19 nt, Homo sapiens
ugaccgcacuuccacucua

SEQ ID NO: 363201 - RNA, 19 nt, Homo sapiens
gcuccuggccaucaucuuu

SEQ ID NO: 363202 - RNA, 19 nt, Homo sapiens
gcuaugggaaguacaagaa

SEQ ID NO: 363203 - RNA, 19 nt, Homo sapiens
gcccugaggaccauuguuu

SEQ ID NO: 363204 - RNA, 19 nt, Homo sapiens
cuacugcgguucucaacug

SEQ ID NO: 363205 - RNA, 19 nt, Homo sapiens
ccaggugacugcccuccuu

SEQ ID NO: 363206 - RNA, 19 nt, Homo sapiens
ugacaaggaggcagaguug

SEQ ID NO: 363207 - RNA, 19 nt, Homo sapiens
acagacauguccugccauu

SEQ ID NO: 363208 - RNA, 19 nt, Homo sapiens
ucaucaaccucaccaagga

SEQ ID NO: 363209 - RNA, 19 nt, Homo sapiens
gaccguggcugagcaugga

SEQ ID NO: 363210 - RNA, 19 nt, Homo sapiens
ggagcguggucguggaaga

SEQ ID NO: 363211 - RNA, 19 nt, Homo sapiens
caagugaagaccaugaaga

SEQ ID NO: 363212 - RNA, 19 nt, Homo sapiens
agacauguccugccauuuc

SEQ ID NO: 363213 - RNA, 19 nt, Homo sapiens
cgaccaaugucuguaaagu

SEQ ID NO: 363214 - RNA, 19 nt, Homo sapiens
gaagauguggauuaagcuu

SEQ ID NO: 363215 - RNA, 19 nt, Homo sapiens
gcuucaagauucccacugu

SEQ ID NO: 363216 - RNA, 19 nt, Homo sapiens
caucagccgcuucaagauu

SEQ ID NO: 363217 - RNA, 19 nt, Homo sapiens
guaaauaccaaccaugcau

SEQ ID NO: 363218 - RNA, 19 nt, Homo sapiens
aagaagauguggauuaagc

SEQ ID NO: 363219 - RNA, 19 nt, Homo sapiens
ucaagcgcauucaggagaa

SEQ ID NO: 363220 - RNA, 19 nt, Homo sapiens
gcuacauggugaagcaguu

SEQ ID NO: 363221 - RNA, 19 nt, Homo sapiens
caccacaucagcucuguuu

SEQ ID NO: 363222 - RNA, 19 nt, Homo sapiens
caucuuugcugcagcuauc

SEQ ID NO: 363223 - RNA, 19 nt, Homo sapiens
cagaggagaagcccaaguu

SEQ ID NO: 363224 - RNA, 19 nt, Homo sapiens
gcaaaaggagccauuguga

SEQ ID NO: 363225 - RNA, 19 nt, Homo sapiens
caacagcuggagaggauug

SEQ ID NO: 363226 - RNA, 19 nt, Homo sapiens
caaggaugaguuuguagaa

SEQ ID NO: 363227 - RNA, 19 nt, Homo sapiens
cagaaugugccaucgugua

SEQ ID NO: 363228 - RNA, 19 nt, Homo sapiens
uaaauaccaaccaugcauu

SEQ ID NO: 363229 - RNA, 19 nt, Homo sapiens
caaguggcaucaccaacca

SEQ ID NO: 363230 - RNA, 19 nt, Homo sapiens
gaaggaacgggcagcaagu

SEQ ID NO: 363231 - RNA, 19 nt, Homo sapiens
gcuccaugcugcugacauc

SEQ ID NO: 363232 - RNA, 19 nt, Homo sapiens
gaugaacacaaccagaaug

SEQ ID NO: 363233 - RNA, 19 nt, Homo sapiens
cagcuauccaugauuauga

SEQ ID NO: 363234 - RNA, 19 nt, Homo sapiens
gugaaaggcagauggacaa

SEQ ID NO: 363235 - RNA, 19 nt, Homo sapiens
gggcuggaauaggauagaa

SEQ ID NO: 363236 - RNA, 19 nt, Homo sapiens
gauguggucagcuuucguu

SEQ ID NO: 363237 - RNA, 19 nt, Homo sapiens
guucaucgacuucauugug

SEQ ID NO: 363238 - RNA, 19 nt, Homo sapiens
ugcaacagcuggagaggau

SEQ ID NO: 363239 - RNA, 19 nt, Homo sapiens
gauccacgcagccgauguu

SEQ ID NO: 363240 - RNA, 19 nt, Homo sapiens
gugaagcaguuggagaaug

SEQ ID NO: 363241 - RNA, 19 nt, Homo sapiens
ccagagaacaauaaagaag

SEQ ID NO: 363242 - RNA, 19 nt, Homo sapiens
caaugucuguaaagugcuu

SEQ ID NO: 363243 - RNA, 19 nt, Homo sapiens
ccuccaaguuucuaagcaa

SEQ ID NO: 363244 - RNA, 19 nt, Homo sapiens
agcaagaagauguggauua

SEQ ID NO: 363245 - RNA, 19 nt, Homo sapiens
ccaaggcccugucucuacu

SEQ ID NO: 363246 - RNA, 19 nt, Homo sapiens
ccaaggaugaguuuguaga

SEQ ID NO: 363247 - RNA, 19 nt, Homo sapiens
gcuggagaaucaccacauc

SEQ ID NO: 363248 - RNA, 19 nt, Homo sapiens
cuggaucucuggugcuuug

SEQ ID NO: 363249 - RNA, 19 nt, Homo sapiens
cagagacgcaugugacuca

SEQ ID NO: 363250 - RNA, 19 nt, Homo sapiens
gaagggcagagacgcaugu

SEQ ID NO: 363251 - RNA, 19 nt, Homo sapiens
gugacugcccuccuucuuu

SEQ ID NO: 363252 - RNA, 19 nt, Homo sapiens
gcaugguaccuuucuagga

SEQ ID NO: 363253 - RNA, 19 nt, Homo sapiens
ggucuucauugaguccaaa

SEQ ID NO: 363254 - RNA, 19 nt, Homo sapiens
uggcccaggucuucauuga

SEQ ID NO: 363255 - RNA, 19 nt, Homo sapiens
gauugaugcaggaugauga

SEQ ID NO: 363256 - RNA, 19 nt, Homo sapiens
gugccaucguguacaauga

SEQ ID NO: 363257 - RNA, 19 nt, Homo sapiens
gagacaggcuaugggaagu

SEQ ID NO: 363258 - RNA, 19 nt, Homo sapiens
aaagaagggagaccaggaa

SEQ ID NO: 363259 - RNA, 19 nt, Homo sapiens
ccaaguuucuaagcaauac

SEQ ID NO: 363260 - RNA, 19 nt, Homo sapiens
agaaacaacccaccugaag

SEQ ID NO: 363261 - RNA, 19 nt, Homo sapiens
aagaugaacacaaccagaa

SEQ ID NO: 363262 - RNA, 19 nt, Homo sapiens
gaccgcacuuccacucuag

SEQ ID NO: 363263 - RNA, 19 nt, Homo sapiens
uccgagcccuggucauuga

SEQ ID NO: 363264 - RNA, 19 nt, Homo sapiens
gguaagauauugugcuuua

SEQ ID NO: 363265 - RNA, 19 nt, Homo sapiens
guaagaagcuuccuuguca

SEQ ID NO: 363266 - RNA, 19 nt, Homo sapiens
ccgcaaauaugcagaauua

SEQ ID NO: 363267 - RNA, 19 nt, Homo sapiens
ggauguacauggcguguua

SEQ ID NO: 363268 - RNA, 19 nt, Homo sapiens
ggugaaguuuguauguuua

SEQ ID NO: 363269 - RNA, 19 nt, Homo sapiens
guacauggcguguuacauu

SEQ ID NO: 363270 - RNA, 19 nt, Homo sapiens
gggcugauguccgcaaaua

SEQ ID NO: 363271 - RNA, 19 nt, Homo sapiens
ccuccucgcuguaguauuu

SEQ ID NO: 363272 - RNA, 19 nt, Homo sapiens
cuagcaagaugcaaacuaa

SEQ ID NO: 363273 - RNA, 19 nt, Homo sapiens
caucaaagcaaguauugua

SEQ ID NO: 363274 - RNA, 19 nt, Homo sapiens
gcggauaccucgcccaugu

SEQ ID NO: 363275 - RNA, 19 nt, Homo sapiens
gcaagaugcaaacuaauga

SEQ ID NO: 363276 - RNA, 19 nt, Homo sapiens
gaagagaagcaucgaggaa

SEQ ID NO: 363277 - RNA, 19 nt, Homo sapiens
gaugcaaacuaaugagaug

SEQ ID NO: 363278 - RNA, 19 nt, Homo sapiens
gaugacauuuacaccgaua

SEQ ID NO: 363279 - RNA, 19 nt, Homo sapiens
uauguacggugcuuuauug

SEQ ID NO: 363280 - RNA, 19 nt, Homo sapiens
ggaagaagccaaaauuaaa

SEQ ID NO: 363281 - RNA, 19 nt, Homo sapiens
gcaggaaugucuuggaaac

SEQ ID NO: 363282 - RNA, 19 nt, Homo sapiens
gcaaacuaaugagauguau

SEQ ID NO: 363283 - RNA, 19 nt, Homo sapiens
gaacuaugcgucaaccaau

SEQ ID NO: 363284 - RNA, 19 nt, Homo sapiens
aaagagacagugcacauuu

SEQ ID NO: 363285 - RNA, 19 nt, Homo sapiens
ggacagugcgacgguauuu

SEQ ID NO: 363286 - RNA, 19 nt, Homo sapiens
caaagcaaguauuguagca

SEQ ID NO: 363287 - RNA, 19 nt, Homo sapiens
gcagucagauccacagcau

SEQ ID NO: 363288 - RNA, 19 nt, Homo sapiens
gcaggaagcaggaaugucu

SEQ ID NO: 363289 - RNA, 19 nt, Homo sapiens
agacagugcacauuuguuu

SEQ ID NO: 363290 - RNA, 19 nt, Homo sapiens
ggacggucauuuacgagau

SEQ ID NO: 363291 - RNA, 19 nt, Homo sapiens
ccuaagggaugguacugaa

SEQ ID NO: 363292 - RNA, 19 nt, Homo sapiens
ccaggacggucauuuacga

SEQ ID NO: 363293 - RNA, 19 nt, Homo sapiens
ggagugaggauucuuugga

SEQ ID NO: 363294 - RNA, 19 nt, Homo sapiens
ugaaagaacuaugcgucaa

SEQ ID NO: 363295 - RNA, 19 nt, Homo sapiens
ccuaaauguuucuggcuuu

SEQ ID NO: 363296 - RNA, 19 nt, Homo sapiens
ccugagagccugcuauguu

SEQ ID NO: 363297 - RNA, 19 nt, Homo sapiens
aagcaggaaugucuuggaa

SEQ ID NO: 363298 - RNA, 19 nt, Homo sapiens
gacagugcacauuuguuua

SEQ ID NO: 363299 - RNA, 19 nt, Homo sapiens
uggaauacgucaggaagaa

SEQ ID NO: 363300 - RNA, 19 nt, Homo sapiens
gcuuuguguuucucccuua

SEQ ID NO: 363301 - RNA, 19 nt, Homo sapiens
gaaaacaaaaccacaaaug

SEQ ID NO: 363302 - RNA, 19 nt, Homo sapiens
gcugauguccgcaaauaug

SEQ ID NO: 363303 - RNA, 19 nt, Homo sapiens
uaagggaugguacugaauu

SEQ ID NO: 363304 - RNA, 19 nt, Homo sapiens
gaaaugugugugugugguu

SEQ ID NO: 363305 - RNA, 19 nt, Homo sapiens
gcagugcacaccuagaaug

SEQ ID NO: 363306 - RNA, 19 nt, Homo sapiens
uacccugcuuuauuuguua

SEQ ID NO: 363307 - RNA, 19 nt, Homo sapiens
cccuuacccugcuuuauuu

SEQ ID NO: 363308 - RNA, 19 nt, Homo sapiens
gacaucaaagcaaguauug

SEQ ID NO: 363309 - RNA, 19 nt, Homo sapiens
gacggucauuuacgagauu

SEQ ID NO: 363310 - RNA, 19 nt, Homo sapiens
cuaagcaugugcccgagaa

SEQ ID NO: 363311 - RNA, 19 nt, Homo sapiens
guaaaggugaaguuuguau

SEQ ID NO: 363312 - RNA, 19 nt, Homo sapiens
uauuuaagcccauacagaa

SEQ ID NO: 363313 - RNA, 19 nt, Homo sapiens
aagagacagugcacauuug

SEQ ID NO: 363314 - RNA, 19 nt, Homo sapiens
caaagagacagugcacauu

SEQ ID NO: 363315 - RNA, 19 nt, Homo sapiens
uaagaagcuuccuugucaa

SEQ ID NO: 363316 - RNA, 19 nt, Homo sapiens
gugugugugugguuuguuu

SEQ ID NO: 363317 - RNA, 19 nt, Homo sapiens
ggaacgcaccgaggaagaa

SEQ ID NO: 363318 - RNA, 19 nt, Homo sapiens
acagugcacauuuguuuaa

SEQ ID NO: 363319 - RNA, 19 nt, Homo sapiens
aggugaaguuuguauguuu

SEQ ID NO: 363320 - RNA, 19 nt, Homo sapiens
aaacccaccuaagauguga

SEQ ID NO: 363321 - RNA, 19 nt, Homo sapiens
gaaagaacuaugcgucaac

SEQ ID NO: 363322 - RNA, 19 nt, Homo sapiens
cugagagccuuaagugguu

SEQ ID NO: 363323 - RNA, 19 nt, Homo sapiens
gaugugaggugaggaugag

SEQ ID NO: 363324 - RNA, 19 nt, Homo sapiens
gggaaggccuagggaguca

SEQ ID NO: 363325 - RNA, 19 nt, Homo sapiens
aagggaugguacugaauuu

SEQ ID NO: 363326 - RNA, 19 nt, Homo sapiens
aaagagagagagagagaga

SEQ ID NO: 363327 - RNA, 19 nt, Homo sapiens
ugacaucaaagcaaguauu

SEQ ID NO: 363328 - RNA, 19 nt, Homo sapiens
gagguuagaggagcauuug

SEQ ID NO: 363329 - RNA, 19 nt, Homo sapiens
caccuagaaugcuguguuc

SEQ ID NO: 363330 - RNA, 19 nt, Homo sapiens
cuaaauguuucuggcuuug

SEQ ID NO: 363331 - RNA, 19 nt, Homo sapiens
gaagcaggaaugucuugga

SEQ ID NO: 363332 - RNA, 19 nt, Homo sapiens
cugagagccugcuauguuc

SEQ ID NO: 363333 - RNA, 19 nt, Homo sapiens
auauugugcuuuaccugua

SEQ ID NO: 363334 - RNA, 19 nt, Homo sapiens
ucucuuggaugacauuuac

SEQ ID NO: 363335 - RNA, 19 nt, Homo sapiens
uacagaaaccuuccugaga

SEQ ID NO: 363336 - RNA, 19 nt, Homo sapiens
gaaaccgccacgcgaacuu

SEQ ID NO: 363337 - RNA, 19 nt, Homo sapiens
agagagagagagagagaaa

SEQ ID NO: 363338 - RNA, 19 nt, Homo sapiens
uuguaaaggugaaguuugu

SEQ ID NO: 363339 - RNA, 19 nt, Homo sapiens
uuacccugcuuuauuuguu

SEQ ID NO: 363340 - RNA, 19 nt, Homo sapiens
gcaaauaugcagaauuacc

SEQ ID NO: 363341 - RNA, 19 nt, Homo sapiens
aaaugugugugugugguuu

SEQ ID NO: 363342 - RNA, 19 nt, Homo sapiens
cauugccgcuucugucugu

SEQ ID NO: 363343 - RNA, 19 nt, Homo sapiens
uacauggcguguuacauuc

SEQ ID NO: 363344 - RNA, 19 nt, Homo sapiens
ugcuuuaccuguauuaaca

SEQ ID NO: 363345 - RNA, 19 nt, Homo sapiens
ucccuuacccugcuuuauu

SEQ ID NO: 363346 - RNA, 19 nt, Homo sapiens
aaauguuucuggcuuugug

SEQ ID NO: 363347 - RNA, 19 nt, Homo sapiens
gaacacucgggagaacaaa

SEQ ID NO: 363348 - RNA, 19 nt, Homo sapiens
gcuauguucuucuuuuguu

SEQ ID NO: 363349 - RNA, 19 nt, Homo sapiens
gagaugcauugccgcuucu

SEQ ID NO: 363350 - RNA, 19 nt, Homo sapiens
aaggugaaguuuguauguu

SEQ ID NO: 363351 - RNA, 19 nt, Homo sapiens
ggauaccucgcccauguuc

SEQ ID NO: 363352 - RNA, 19 nt, Homo sapiens
gcuucugucuguguuguug

SEQ ID NO: 363353 - RNA, 19 nt, Homo sapiens
aaaggugaaguuuguaugu

SEQ ID NO: 363354 - RNA, 19 nt, Homo sapiens
uaaaggugaaguuuguaug

SEQ ID NO: 363355 - RNA, 19 nt, Homo sapiens
guggcugagugacaacuug

SEQ ID NO: 363356 - RNA, 19 nt, Homo sapiens
uguaguauuuaagcccaua

SEQ ID NO: 363357 - RNA, 19 nt, Homo sapiens
uuccugaaccuacuaugua

SEQ ID NO: 363358 - RNA, 19 nt, Homo sapiens
caagguggccaagguggaa

SEQ ID NO: 363359 - RNA, 19 nt, Homo sapiens
gguuagaggagcauuugga

SEQ ID NO: 363360 - RNA, 19 nt, Homo sapiens
ccgcagugcacaccuagaa

SEQ ID NO: 363361 - RNA, 19 nt, Homo sapiens
gagaaaacaaaaccacaaa

SEQ ID NO: 363362 - RNA, 19 nt, Homo sapiens
acaaagagacagugcacau

SEQ ID NO: 363363 - RNA, 19 nt, Homo sapiens
ugagagccuuaagugguuu

SEQ ID NO: 363364 - RNA, 19 nt, Homo sapiens
gguaagauauugugcuuua

SEQ ID NO: 363365 - RNA, 19 nt, Homo sapiens
guaagaagcuuccuuguca

SEQ ID NO: 363366 - RNA, 19 nt, Homo sapiens
ccgcaaauaugcagaauua

SEQ ID NO: 363367 - RNA, 19 nt, Homo sapiens
ggauguacauggcguguua

SEQ ID NO: 363368 - RNA, 19 nt, Homo sapiens
ggugaaguuuguauguuua

SEQ ID NO: 363369 - RNA, 19 nt, Homo sapiens
guacauggcguguuacauu

SEQ ID NO: 363370 - RNA, 19 nt, Homo sapiens
gggcugauguccgcaaaua

SEQ ID NO: 363371 - RNA, 19 nt, Homo sapiens
ccuccucgcuguaguauuu

SEQ ID NO: 363372 - RNA, 19 nt, Homo sapiens
cuagcaagaugcaaacuaa

SEQ ID NO: 363373 - RNA, 19 nt, Homo sapiens
caucaaagcaaguauugua

SEQ ID NO: 363374 - RNA, 19 nt, Homo sapiens
gcggauaccucgcccaugu

SEQ ID NO: 363375 - RNA, 19 nt, Homo sapiens
gcaagaugcaaacuaauga

SEQ ID NO: 363376 - RNA, 19 nt, Homo sapiens
gaagagaagcaucgaggaa

SEQ ID NO: 363377 - RNA, 19 nt, Homo sapiens
gaugcaaacuaaugagaug

SEQ ID NO: 363378 - RNA, 19 nt, Homo sapiens
gaugacauuuacaccgaua

SEQ ID NO: 363379 - RNA, 19 nt, Homo sapiens
uauguacggugcuuuauug

SEQ ID NO: 363380 - RNA, 19 nt, Homo sapiens
ggaagaagccaaaauuaaa

SEQ ID NO: 363381 - RNA, 19 nt, Homo sapiens
gcaggaaugucuuggaaac

SEQ ID NO: 363382 - RNA, 19 nt, Homo sapiens
gcaaacuaaugagauguau

SEQ ID NO: 363383 - RNA, 19 nt, Homo sapiens
gaacuaugcgucaaccaau

SEQ ID NO: 363384 - RNA, 19 nt, Homo sapiens
aaagagacagugcacauuu

SEQ ID NO: 363385 - RNA, 19 nt, Homo sapiens
gaagaggacacggauguga

SEQ ID NO: 363386 - RNA, 19 nt, Homo sapiens
ggacagugcgacgguauuu

SEQ ID NO: 363387 - RNA, 19 nt, Homo sapiens
caaagcaaguauuguagca

SEQ ID NO: 363388 - RNA, 19 nt, Homo sapiens
gcagucagauccacagcau

SEQ ID NO: 363389 - RNA, 19 nt, Homo sapiens
gcaggaagcaggaaugucu

SEQ ID NO: 363390 - RNA, 19 nt, Homo sapiens
agacagugcacauuuguuu

SEQ ID NO: 363391 - RNA, 19 nt, Homo sapiens
ggacggucauuuacgagau

SEQ ID NO: 363392 - RNA, 19 nt, Homo sapiens
ccuaagggaugguacugaa

SEQ ID NO: 363393 - RNA, 19 nt, Homo sapiens
ccaggacggucauuuacga

SEQ ID NO: 363394 - RNA, 19 nt, Homo sapiens
ggagugaggauucuuugga

SEQ ID NO: 363395 - RNA, 19 nt, Homo sapiens
ugaaagaacuaugcgucaa

SEQ ID NO: 363396 - RNA, 19 nt, Homo sapiens
ccuaaauguuucuggcuuu

SEQ ID NO: 363397 - RNA, 19 nt, Homo sapiens
ccugagagccugcuauguu

SEQ ID NO: 363398 - RNA, 19 nt, Homo sapiens
aagcaggaaugucuuggaa

SEQ ID NO: 363399 - RNA, 19 nt, Homo sapiens
gacagugcacauuuguuua

SEQ ID NO: 363400 - RNA, 19 nt, Homo sapiens
uggaauacgucaggaagaa

SEQ ID NO: 363401 - RNA, 19 nt, Homo sapiens
gcuuuguguuucucccuua

SEQ ID NO: 363402 - RNA, 19 nt, Homo sapiens
gaaaacaaaaccacaaaug

SEQ ID NO: 363403 - RNA, 19 nt, Homo sapiens
uaagggaugguacugaauu

SEQ ID NO: 363404 - RNA, 19 nt, Homo sapiens
gcugauguccgcaaauaug

SEQ ID NO: 363405 - RNA, 19 nt, Homo sapiens
gaaaugugugugugugguu

SEQ ID NO: 363406 - RNA, 19 nt, Homo sapiens
gcagugcacaccuagaaug

SEQ ID NO: 363407 - RNA, 19 nt, Homo sapiens
uacccugcuuuauuuguua

SEQ ID NO: 363408 - RNA, 19 nt, Homo sapiens
cccuuacccugcuuuauuu

SEQ ID NO: 363409 - RNA, 19 nt, Homo sapiens
gacaucaaagcaaguauug

SEQ ID NO: 363410 - RNA, 19 nt, Homo sapiens
gggaagaggacacggaugu

SEQ ID NO: 363411 - RNA, 19 nt, Homo sapiens
gacggucauuuacgagauu

SEQ ID NO: 363412 - RNA, 19 nt, Homo sapiens
cuaagcaugugcccgagaa

SEQ ID NO: 363413 - RNA, 19 nt, Homo sapiens
guaaaggugaaguuuguau

SEQ ID NO: 363414 - RNA, 19 nt, Homo sapiens
uauuuaagcccauacagaa

SEQ ID NO: 363415 - RNA, 19 nt, Homo sapiens
aagagacagugcacauuug

SEQ ID NO: 363416 - RNA, 19 nt, Homo sapiens
caaagagacagugcacauu

SEQ ID NO: 363417 - RNA, 19 nt, Homo sapiens
uaagaagcuuccuugucaa

SEQ ID NO: 363418 - RNA, 19 nt, Homo sapiens
gugugugugugguuuguuu

SEQ ID NO: 363419 - RNA, 19 nt, Homo sapiens
ggaacgcaccgaggaagaa

SEQ ID NO: 363420 - RNA, 19 nt, Homo sapiens
acagugcacauuuguuuaa

SEQ ID NO: 363421 - RNA, 19 nt, Homo sapiens
aggugaaguuuguauguuu

SEQ ID NO: 363422 - RNA, 19 nt, Homo sapiens
gaaagaacuaugcgucaac

SEQ ID NO: 363423 - RNA, 19 nt, Homo sapiens
cugagagccuuaagugguu

SEQ ID NO: 363424 - RNA, 19 nt, Homo sapiens
gaugugaggugaggaugag

SEQ ID NO: 363425 - RNA, 19 nt, Homo sapiens
aaagagagagagagagaga

SEQ ID NO: 363426 - RNA, 19 nt, Homo sapiens
ugacaucaaagcaaguauu

SEQ ID NO: 363427 - RNA, 19 nt, Homo sapiens
aagggaugguacugaauuu

SEQ ID NO: 363428 - RNA, 19 nt, Homo sapiens
gagguuagaggagcauuug

SEQ ID NO: 363429 - RNA, 19 nt, Homo sapiens
caccuagaaugcuguguuc

SEQ ID NO: 363430 - RNA, 19 nt, Homo sapiens
cuaaauguuucuggcuuug

SEQ ID NO: 363431 - RNA, 19 nt, Homo sapiens
gaagcaggaaugucuugga

SEQ ID NO: 363432 - RNA, 19 nt, Homo sapiens
cugagagccugcuauguuc

SEQ ID NO: 363433 - RNA, 19 nt, Homo sapiens
auauugugcuuuaccugua

SEQ ID NO: 363434 - RNA, 19 nt, Homo sapiens
ucucuuggaugacauuuac

SEQ ID NO: 363435 - RNA, 19 nt, Homo sapiens
uacagaaaccuuccugaga

SEQ ID NO: 363436 - RNA, 19 nt, Homo sapiens
gaaaccgccacgcgaacuu

SEQ ID NO: 363437 - RNA, 19 nt, Homo sapiens
agagagagagagagagaaa

SEQ ID NO: 363438 - RNA, 19 nt, Homo sapiens
uuguaaaggugaaguuugu

SEQ ID NO: 363439 - RNA, 19 nt, Homo sapiens
uuacccugcuuuauuuguu

SEQ ID NO: 363440 - RNA, 19 nt, Homo sapiens
gcaaauaugcagaauuacc

SEQ ID NO: 363441 - RNA, 19 nt, Homo sapiens
aaaugugugugugugguuu

SEQ ID NO: 363442 - RNA, 19 nt, Homo sapiens
cauugccgcuucugucugu

SEQ ID NO: 363443 - RNA, 19 nt, Homo sapiens
uacauggcguguuacauuc

SEQ ID NO: 363444 - RNA, 19 nt, Homo sapiens
ugcuuuaccuguauuaaca

SEQ ID NO: 363445 - RNA, 19 nt, Homo sapiens
ucccuuacccugcuuuauu

SEQ ID NO: 363446 - RNA, 19 nt, Homo sapiens
aaauguuucuggcuuugug

SEQ ID NO: 363447 - RNA, 19 nt, Homo sapiens
gaacacucgggagaacaaa

SEQ ID NO: 363448 - RNA, 19 nt, Homo sapiens
ggaugugaggugaggauga

SEQ ID NO: 363449 - RNA, 19 nt, Homo sapiens
gcuauguucuucuuuuguu

SEQ ID NO: 363450 - RNA, 19 nt, Homo sapiens
gagaugcauugccgcuucu

SEQ ID NO: 363451 - RNA, 19 nt, Homo sapiens
aaggugaaguuuguauguu

SEQ ID NO: 363452 - RNA, 19 nt, Homo sapiens
gcuucugucuguguuguug

SEQ ID NO: 363453 - RNA, 19 nt, Homo sapiens
ggauaccucgcccauguuc

SEQ ID NO: 363454 - RNA, 19 nt, Homo sapiens
aaaggugaaguuuguaugu

SEQ ID NO: 363455 - RNA, 19 nt, Homo sapiens
uaaaggugaaguuuguaug

SEQ ID NO: 363456 - RNA, 19 nt, Homo sapiens
guggcugagugacaacuug

SEQ ID NO: 363457 - RNA, 19 nt, Homo sapiens
uguaguauuuaagcccaua

SEQ ID NO: 363458 - RNA, 19 nt, Homo sapiens
caagguggccaagguggaa

SEQ ID NO: 363459 - RNA, 19 nt, Homo sapiens
uuccugaaccuacuaugua

SEQ ID NO: 363460 - RNA, 19 nt, Homo sapiens
gguuagaggagcauuugga

SEQ ID NO: 363461 - RNA, 19 nt, Homo sapiens
ccgcagugcacaccuagaa

SEQ ID NO: 363462 - RNA, 19 nt, Homo sapiens
gagaaaacaaaaccacaaa

SEQ ID NO: 363463 - RNA, 19 nt, Homo sapiens
acaaagagacagugcacau

SEQ ID NO: 363464 - RNA, 19 nt, Homo sapiens
ugagaaagaucgagauugu

SEQ ID NO: 363465 - RNA, 19 nt, Homo sapiens
gcuccgcgcuuuccgauuu

SEQ ID NO: 363466 - RNA, 19 nt, Homo sapiens
caacacugcuguccacaug

SEQ ID NO: 363467 - RNA, 19 nt, Homo sapiens
gagcacuguucacaucaua

SEQ ID NO: 363468 - RNA, 19 nt, Homo sapiens
gaacuugggauaagagugu

SEQ ID NO: 363469 - RNA, 19 nt, Homo sapiens
ccgaggagcuuuaugagau

SEQ ID NO: 363470 - RNA, 19 nt, Homo sapiens
caagggaccugcucaucau

SEQ ID NO: 363471 - RNA, 19 nt, Homo sapiens
gcaagggaccugcucauca

SEQ ID NO: 363472 - RNA, 19 nt, Homo sapiens
gauaagagugugagagaga

SEQ ID NO: 363473 - RNA, 19 nt, Homo sapiens
gagauggaguuugcuguug

SEQ ID NO: 363474 - RNA, 19 nt, Homo sapiens
uaugguauuugcuguauug

SEQ ID NO: 363475 - RNA, 19 nt, Homo sapiens
uuuaugagaugcugaguga

SEQ ID NO: 363476 - RNA, 19 nt, Homo sapiens
ccaccucccuucccaccua

SEQ ID NO: 363477 - RNA, 19 nt, Homo sapiens
cagcauagccugccugauc

SEQ ID NO: 363478 - RNA, 19 nt, Homo sapiens
gcaagcaccggaaauucaa

SEQ ID NO: 363479 - RNA, 19 nt, Homo sapiens
guaaagucggugauuauau

SEQ ID NO: 363480 - RNA, 19 nt, Homo sapiens
ggagugauaauauuguuuc

SEQ ID NO: 363481 - RNA, 19 nt, Homo sapiens
gggaccugcucaucauauu

SEQ ID NO: 363482 - RNA, 19 nt, Homo sapiens
gggauaagagugugagaga

SEQ ID NO: 363483 - RNA, 19 nt, Homo sapiens
cccagcagcucaaagaaga

SEQ ID NO: 363484 - RNA, 19 nt, Homo sapiens
gcacuguucacaucauaga

SEQ ID NO: 363485 - RNA, 19 nt, Homo sapiens
gguuagagauggaguuugc

SEQ ID NO: 363486 - RNA, 19 nt, Homo sapiens
caaauaggagggagacugu

SEQ ID NO: 363487 - RNA, 19 nt, Homo sapiens
gaguuggaccugaacauga

SEQ ID NO: 363488 - RNA, 19 nt, Homo sapiens
uuuguaaagucggugauua

SEQ ID NO: 363489 - RNA, 19 nt, Homo sapiens
agauguagguaaagaggaa

SEQ ID NO: 363490 - RNA, 19 nt, Homo sapiens
agauggaguuugcuguuga

SEQ ID NO: 363491 - RNA, 19 nt, Homo sapiens
ccacagacgggcacacaga

SEQ ID NO: 363492 - RNA, 19 nt, Homo sapiens
cgaggagcuuuaugagaug

SEQ ID NO: 363493 - RNA, 19 nt, Homo sapiens
gcgcgcacacacauacaua

SEQ ID NO: 363494 - RNA, 19 nt, Homo sapiens
gaacuccaucgccaucuuc

SEQ ID NO: 363495 - RNA, 19 nt, Homo sapiens
aagaaggacugaacuccau

SEQ ID NO: 363496 - RNA, 19 nt, Homo sapiens
ggcaagcaccggaaauuca

SEQ ID NO: 363497 - RNA, 19 nt, Homo sapiens
gggccgaguuggaccugaa

SEQ ID NO: 363498 - RNA, 19 nt, Homo sapiens
ucgauccgcuccuuugaug

SEQ ID NO: 363499 - RNA, 19 nt, Homo sapiens
gcagggagcacuguucaca

SEQ ID NO: 363500 - RNA, 19 nt, Homo sapiens
gcucuugaaccccuuauua

SEQ ID NO: 363501 - RNA, 19 nt, Homo sapiens
aaaccugcuuccuucaguu

SEQ ID NO: 363502 - RNA, 19 nt, Homo sapiens
uggcagauguagguaaaga

SEQ ID NO: 363503 - RNA, 19 nt, Homo sapiens
ggagcacuguucacaucau

SEQ ID NO: 363504 - RNA, 19 nt, Homo sapiens
agccacgacugccauguaa

SEQ ID NO: 363505 - RNA, 19 nt, Homo sapiens
cuucuucccuuaacuccaa

SEQ ID NO: 363506 - RNA, 19 nt, Homo sapiens
ggugagaaagaucgagauu

SEQ ID NO: 363507 - RNA, 19 nt, Homo sapiens
uguaaagucggugauuaua

SEQ ID NO: 363508 - RNA, 19 nt, Homo sapiens
caaacucgggugaccauuc

SEQ ID NO: 363509 - RNA, 19 nt, Homo sapiens
cuguucacaucauagauaa

SEQ ID NO: 363510 - RNA, 19 nt, Homo sapiens
gcacacagacuggagaaaa

SEQ ID NO: 363511 - RNA, 19 nt, Homo sapiens
ccugagcgcuguggacugu

SEQ ID NO: 363512 - RNA, 19 nt, Homo sapiens
gauccgcuccuuugaugau

SEQ ID NO: 363513 - RNA, 19 nt, Homo sapiens
gacguggacuccucuuggu

SEQ ID NO: 363514 - RNA, 19 nt, Homo sapiens
ugaacuccaucgccaucuu

SEQ ID NO: 363515 - RNA, 19 nt, Homo sapiens
cagccacgacugccaugua

SEQ ID NO: 363516 - RNA, 19 nt, Homo sapiens
cccagucacuccucucuag

SEQ ID NO: 363517 - RNA, 19 nt, Homo sapiens
ugaccuccauuucccaaag

SEQ ID NO: 363518 - RNA, 19 nt, Homo sapiens
ggaccugcucaucauauuc

SEQ ID NO: 363519 - RNA, 19 nt, Homo sapiens
ccacucugauucaccucuu

SEQ ID NO: 363520 - RNA, 19 nt, Homo sapiens
cgacugccguguuccuuuu

SEQ ID NO: 363521 - RNA, 19 nt, Homo sapiens
guccuuggagugauaauau

SEQ ID NO: 363522 - RNA, 19 nt, Homo sapiens
ccaccuggcaugcaagugu

SEQ ID NO: 363523 - RNA, 19 nt, Homo sapiens
gaccuccauuucccaaagu

SEQ ID NO: 363524 - RNA, 19 nt, Homo sapiens
gagugugugggcaggguua

SEQ ID NO: 363525 - RNA, 19 nt, Homo sapiens
ugacaagacggcacugaag

SEQ ID NO: 363526 - RNA, 19 nt, Homo sapiens
gggcaagcaccggaaauuc

SEQ ID NO: 363527 - RNA, 19 nt, Homo sapiens
aaacucgggugaccauucg

SEQ ID NO: 363528 - RNA, 19 nt, Homo sapiens
ccacaugaccuccauuucc

SEQ ID NO: 363529 - RNA, 19 nt, Homo sapiens
gauggaguuugcuguugag

SEQ ID NO: 363530 - RNA, 19 nt, Homo sapiens
acuguucacaucauagaua

SEQ ID NO: 363531 - RNA, 19 nt, Homo sapiens
agggagcacuguucacauc

SEQ ID NO: 363532 - RNA, 19 nt, Homo sapiens
guacugcacaaggacauug

SEQ ID NO: 363533 - RNA, 19 nt, Homo sapiens
cuaccuccacccugcauuu

SEQ ID NO: 363534 - RNA, 19 nt, Homo sapiens
ugugcacaguggcuucuuu

SEQ ID NO: 363535 - RNA, 19 nt, Homo sapiens
ucccuuaacuccaagaacu

SEQ ID NO: 363536 - RNA, 19 nt, Homo sapiens
gaagaccaccuggcaugca

SEQ ID NO: 363537 - RNA, 19 nt, Homo sapiens
ccacggugacgcuggaaga

SEQ ID NO: 363538 - RNA, 19 nt, Homo sapiens
guccacaugaccuccauuu

SEQ ID NO: 363539 - RNA, 19 nt, Homo sapiens
aagaccaccuggcaugcaa

SEQ ID NO: 363540 - RNA, 19 nt, Homo sapiens
guucacaucauagauaaag

SEQ ID NO: 363541 - RNA, 19 nt, Homo sapiens
cuguugaggugguguagau

SEQ ID NO: 363542 - RNA, 19 nt, Homo sapiens
gguccuuggagugauaaua

SEQ ID NO: 363543 - RNA, 19 nt, Homo sapiens
ucaagcacacgcaugacaa

SEQ ID NO: 363544 - RNA, 19 nt, Homo sapiens
caagggcaagcaccggaaa

SEQ ID NO: 363545 - RNA, 19 nt, Homo sapiens
cagcagcucaaagaagaaa

SEQ ID NO: 363546 - RNA, 19 nt, Homo sapiens
cuagacgccucggcugguu

SEQ ID NO: 363547 - RNA, 19 nt, Homo sapiens
gagaaagaucgagauugug

SEQ ID NO: 363548 - RNA, 19 nt, Homo sapiens
gcaacacugcuguccacau

SEQ ID NO: 363549 - RNA, 19 nt, Homo sapiens
ccucggacuccauggcuaa

SEQ ID NO: 363550 - RNA, 19 nt, Homo sapiens
cauagauaaagcugauuug

SEQ ID NO: 363551 - RNA, 19 nt, Homo sapiens
ccacgacugccauguaagg

SEQ ID NO: 363552 - RNA, 19 nt, Homo sapiens
agagauggaguuugcuguu

SEQ ID NO: 363553 - RNA, 19 nt, Homo sapiens
acaagacggcacugaagga

SEQ ID NO: 363554 - RNA, 19 nt, Homo sapiens
gcccggagucggcaugaau

SEQ ID NO: 363555 - RNA, 19 nt, Homo sapiens
cgaguuggaccugaacaug

SEQ ID NO: 363556 - RNA, 19 nt, Homo sapiens
gugugggcaggguuauuua

SEQ ID NO: 363557 - RNA, 19 nt, Homo sapiens
ugugugggcaggguuauuu

SEQ ID NO: 363558 - RNA, 19 nt, Homo sapiens
gugagaaagaucgagauug

SEQ ID NO: 363559 - RNA, 19 nt, Homo sapiens
ugagaaagaucgagauugu

SEQ ID NO: 363560 - RNA, 19 nt, Homo sapiens
caacacugcuguccacaug

SEQ ID NO: 363561 - RNA, 19 nt, Homo sapiens
gagcacuguucacaucaua

SEQ ID NO: 363562 - RNA, 19 nt, Homo sapiens
gagcaggaauggugagaug

SEQ ID NO: 363563 - RNA, 19 nt, Homo sapiens
gaacuugggauaagagugu

SEQ ID NO: 363564 - RNA, 19 nt, Homo sapiens
ccgaggagcuuuaugagau

SEQ ID NO: 363565 - RNA, 19 nt, Homo sapiens
caagggaccugcucaucau

SEQ ID NO: 363566 - RNA, 19 nt, Homo sapiens
gcaagggaccugcucauca

SEQ ID NO: 363567 - RNA, 19 nt, Homo sapiens
gauaagagugugagagaga

SEQ ID NO: 363568 - RNA, 19 nt, Homo sapiens
gagauggaguuugcuguug

SEQ ID NO: 363569 - RNA, 19 nt, Homo sapiens
uaugguauuugcuguauug

SEQ ID NO: 363570 - RNA, 19 nt, Homo sapiens
uuuaugagaugcugaguga

SEQ ID NO: 363571 - RNA, 19 nt, Homo sapiens
ccaccucccuucccaccua

SEQ ID NO: 363572 - RNA, 19 nt, Homo sapiens
cagcauagccugccugauc

SEQ ID NO: 363573 - RNA, 19 nt, Homo sapiens
ggaauggugagauguuuau

SEQ ID NO: 363574 - RNA, 19 nt, Homo sapiens
gcaagcaccggaaauucaa

SEQ ID NO: 363575 - RNA, 19 nt, Homo sapiens
guaaagucggugauuauau

SEQ ID NO: 363576 - RNA, 19 nt, Homo sapiens
ggagugauaauauuguuuc

SEQ ID NO: 363577 - RNA, 19 nt, Homo sapiens
gagacugacugagcaggaa

SEQ ID NO: 363578 - RNA, 19 nt, Homo sapiens
gggaccugcucaucauauu

SEQ ID NO: 363579 - RNA, 19 nt, Homo sapiens
gggauaagagugugagaga

SEQ ID NO: 363580 - RNA, 19 nt, Homo sapiens
cccagcagcucaaagaaga

SEQ ID NO: 363581 - RNA, 19 nt, Homo sapiens
gcacuguucacaucauaga

SEQ ID NO: 363582 - RNA, 19 nt, Homo sapiens
caggaauggugagauguuu

SEQ ID NO: 363583 - RNA, 19 nt, Homo sapiens
gguuagagauggaguuugc

SEQ ID NO: 363584 - RNA, 19 nt, Homo sapiens
gcaggaauggugagauguu

SEQ ID NO: 363585 - RNA, 19 nt, Homo sapiens
caaauaggagggagacugu

SEQ ID NO: 363586 - RNA, 19 nt, Homo sapiens
gaguuggaccugaacauga

SEQ ID NO: 363587 - RNA, 19 nt, Homo sapiens
uuuguaaagucggugauua

SEQ ID NO: 363588 - RNA, 19 nt, Homo sapiens
agauguagguaaagaggaa

SEQ ID NO: 363589 - RNA, 19 nt, Homo sapiens
agauggaguuugcuguuga

SEQ ID NO: 363590 - RNA, 19 nt, Homo sapiens
ccacagacgggcacacaga

SEQ ID NO: 363591 - RNA, 19 nt, Homo sapiens
cgaggagcuuuaugagaug

SEQ ID NO: 363592 - RNA, 19 nt, Homo sapiens
gaacuccaucgccaucuuc

SEQ ID NO: 363593 - RNA, 19 nt, Homo sapiens
aagaaggacugaacuccau

SEQ ID NO: 363594 - RNA, 19 nt, Homo sapiens
ggcaagcaccggaaauuca

SEQ ID NO: 363595 - RNA, 19 nt, Homo sapiens
gggccgaguuggaccugaa

SEQ ID NO: 363596 - RNA, 19 nt, Homo sapiens
ucgauccgcuccuuugaug

SEQ ID NO: 363597 - RNA, 19 nt, Homo sapiens
gcagggagcacuguucaca

SEQ ID NO: 363598 - RNA, 19 nt, Homo sapiens
gcucuugaaccccuuauua

SEQ ID NO: 363599 - RNA, 19 nt, Homo sapiens
aaaccugcuuccuucaguu

SEQ ID NO: 363600 - RNA, 19 nt, Homo sapiens
uggcagauguagguaaaga

SEQ ID NO: 363601 - RNA, 19 nt, Homo sapiens
ggagcacuguucacaucau

SEQ ID NO: 363602 - RNA, 19 nt, Homo sapiens
agccacgacugccauguaa

SEQ ID NO: 363603 - RNA, 19 nt, Homo sapiens
cuucuucccuuaacuccaa

SEQ ID NO: 363604 - RNA, 19 nt, Homo sapiens
ggugagaaagaucgagauu

SEQ ID NO: 363605 - RNA, 19 nt, Homo sapiens
uguaaagucggugauuaua

SEQ ID NO: 363606 - RNA, 19 nt, Homo sapiens
agagagagagacugacuga

SEQ ID NO: 363607 - RNA, 19 nt, Homo sapiens
agagagagagagagacuga

SEQ ID NO: 363608 - RNA, 19 nt, Homo sapiens
caaacucgggugaccauuc

SEQ ID NO: 363609 - RNA, 19 nt, Homo sapiens
cuguucacaucauagauaa

SEQ ID NO: 363610 - RNA, 19 nt, Homo sapiens
gcacacagacuggagaaaa

SEQ ID NO: 363611 - RNA, 19 nt, Homo sapiens
ccugagcgcuguggacugu

SEQ ID NO: 363612 - RNA, 19 nt, Homo sapiens
ugagagagagagagagaga

SEQ ID NO: 363613 - RNA, 19 nt, Homo sapiens
gauccgcuccuuugaugau

SEQ ID NO: 363614 - RNA, 19 nt, Homo sapiens
gacguggacuccucuuggu

SEQ ID NO: 363615 - RNA, 19 nt, Homo sapiens
ugaacuccaucgccaucuu

SEQ ID NO: 363616 - RNA, 19 nt, Homo sapiens
cagccacgacugccaugua

SEQ ID NO: 363617 - RNA, 19 nt, Homo sapiens
cccagucacuccucucuag

SEQ ID NO: 363618 - RNA, 19 nt, Homo sapiens
ugaccuccauuucccaaag

SEQ ID NO: 363619 - RNA, 19 nt, Homo sapiens
caucugagagagagagaga

SEQ ID NO: 363620 - RNA, 19 nt, Homo sapiens
ggaccugcucaucauauuc

SEQ ID NO: 363621 - RNA, 19 nt, Homo sapiens
ccacucugauucaccucuu

SEQ ID NO: 363622 - RNA, 19 nt, Homo sapiens
guccuuggagugauaauau

SEQ ID NO: 363623 - RNA, 19 nt, Homo sapiens
ccaccuggcaugcaagugu

SEQ ID NO: 363624 - RNA, 19 nt, Homo sapiens
gaccuccauuucccaaagu

SEQ ID NO: 363625 - RNA, 19 nt, Homo sapiens
gagugugugggcaggguua

SEQ ID NO: 363626 - RNA, 19 nt, Homo sapiens
ugacaagacggcacugaag

SEQ ID NO: 363627 - RNA, 19 nt, Homo sapiens
gggcaagcaccggaaauuc

SEQ ID NO: 363628 - RNA, 19 nt, Homo sapiens
aaacucgggugaccauucg

SEQ ID NO: 363629 - RNA, 19 nt, Homo sapiens
ccacaugaccuccauuucc

SEQ ID NO: 363630 - RNA, 19 nt, Homo sapiens
gauggaguuugcuguugag

SEQ ID NO: 363631 - RNA, 19 nt, Homo sapiens
agagagagagagagagaga

SEQ ID NO: 363632 - RNA, 19 nt, Homo sapiens
acuguucacaucauagaua

SEQ ID NO: 363633 - RNA, 19 nt, Homo sapiens
agggagcacuguucacauc

SEQ ID NO: 363634 - RNA, 19 nt, Homo sapiens
guacugcacaaggacauug

SEQ ID NO: 363635 - RNA, 19 nt, Homo sapiens
agagagagagagagagaga

SEQ ID NO: 363636 - RNA, 19 nt, Homo sapiens
agagagagagagagagaga

SEQ ID NO: 363637 - RNA, 19 nt, Homo sapiens
cuaccuccacccugcauuu

SEQ ID NO: 363638 - RNA, 19 nt, Homo sapiens
ugugcacaguggcuucuuu

SEQ ID NO: 363639 - RNA, 19 nt, Homo sapiens
ucccuuaacuccaagaacu

SEQ ID NO: 363640 - RNA, 19 nt, Homo sapiens
gaagaccaccuggcaugca

SEQ ID NO: 363641 - RNA, 19 nt, Homo sapiens
ccacggugacgcuggaaga

SEQ ID NO: 363642 - RNA, 19 nt, Homo sapiens
guccacaugaccuccauuu

SEQ ID NO: 363643 - RNA, 19 nt, Homo sapiens
aagaccaccuggcaugcaa

SEQ ID NO: 363644 - RNA, 19 nt, Homo sapiens
guucacaucauagauaaag

SEQ ID NO: 363645 - RNA, 19 nt, Homo sapiens
cuguugaggugguguagau

SEQ ID NO: 363646 - RNA, 19 nt, Homo sapiens
gguccuuggagugauaaua

SEQ ID NO: 363647 - RNA, 19 nt, Homo sapiens
ucaagcacacgcaugacaa

SEQ ID NO: 363648 - RNA, 19 nt, Homo sapiens
caagggcaagcaccggaaa

SEQ ID NO: 363649 - RNA, 19 nt, Homo sapiens
cagcagcucaaagaagaaa

SEQ ID NO: 363650 - RNA, 19 nt, Homo sapiens
gagaaagaucgagauugug

SEQ ID NO: 363651 - RNA, 19 nt, Homo sapiens
gcaacacugcuguccacau

SEQ ID NO: 363652 - RNA, 19 nt, Homo sapiens
ccucggacuccauggcuaa

SEQ ID NO: 363653 - RNA, 19 nt, Homo sapiens
cauagauaaagcugauuug

SEQ ID NO: 363654 - RNA, 19 nt, Homo sapiens
ccacgacugccauguaagg

SEQ ID NO: 363655 - RNA, 19 nt, Homo sapiens
cgaguuggaccugaacaug

SEQ ID NO: 363656 - RNA, 19 nt, Homo sapiens
agagauggaguuugcuguu

SEQ ID NO: 363657 - RNA, 19 nt, Homo sapiens
acaagacggcacugaagga

SEQ ID NO: 363658 - RNA, 19 nt, Homo sapiens
gugagaaagaucgagauug

SEQ ID NO: 363659 - RNA, 19 nt, Homo sapiens
gcaggaagccuacuauuua

SEQ ID NO: 363660 - RNA, 19 nt, Homo sapiens
gguaauagcuuuagugaau

SEQ ID NO: 363661 - RNA, 19 nt, Homo sapiens
gaaacuuccuggacuauuu

SEQ ID NO: 363662 - RNA, 19 nt, Homo sapiens
cgacagaacuucagcauug

SEQ ID NO: 363663 - RNA, 19 nt, Homo sapiens
ggacuugguugauguuuaa

SEQ ID NO: 363664 - RNA, 19 nt, Homo sapiens
gaaagauacuuacauguuc

SEQ ID NO: 363665 - RNA, 19 nt, Homo sapiens
gagauuuggucaacuauuu

SEQ ID NO: 363666 - RNA, 19 nt, Homo sapiens
gaaauaagguaucgaagca

SEQ ID NO: 363667 - RNA, 19 nt, Homo sapiens
gaacaggguuggaauucaa

SEQ ID NO: 363668 - RNA, 19 nt, Homo sapiens
cuaaguaggugaugaguuu

SEQ ID NO: 363669 - RNA, 19 nt, Homo sapiens
uaacugcccucugaaauaa

SEQ ID NO: 363670 - RNA, 19 nt, Homo sapiens
gcagggaguuugagagaaa

SEQ ID NO: 363671 - RNA, 19 nt, Homo sapiens
gaagagggacauaagauaa

SEQ ID NO: 363672 - RNA, 19 nt, Homo sapiens
gcacgccgcuuccugauau

SEQ ID NO: 363673 - RNA, 19 nt, Homo sapiens
caucagagcuggaucuaga

SEQ ID NO: 363674 - RNA, 19 nt, Homo sapiens
ccugacagcuauuuacuua

SEQ ID NO: 363675 - RNA, 19 nt, Homo sapiens
ggauggacaugaauauauu

SEQ ID NO: 363676 - RNA, 19 nt, Homo sapiens
cagaaggccuuacuuuauu

SEQ ID NO: 363677 - RNA, 19 nt, Homo sapiens
ucacugagaucaccacuga

SEQ ID NO: 363678 - RNA, 19 nt, Homo sapiens
ucaaauugguguacacuuu

SEQ ID NO: 363679 - RNA, 19 nt, Homo sapiens
uuagaaggauggacuauaa

SEQ ID NO: 363680 - RNA, 19 nt, Homo sapiens
acaauuaacugcccucuga

SEQ ID NO: 363681 - RNA, 19 nt, Homo sapiens
gaaagaaguuccagaccau

SEQ ID NO: 363682 - RNA, 19 nt, Homo sapiens
gagcauagagaacaaagua

SEQ ID NO: 363683 - RNA, 19 nt, Homo sapiens
acacggagcuauguuauuu

SEQ ID NO: 363684 - RNA, 19 nt, Homo sapiens
uaaaguacuugacuaccua

SEQ ID NO: 363685 - RNA, 19 nt, Homo sapiens
ggaagaugcagaagcaaua

SEQ ID NO: 363686 - RNA, 19 nt, Homo sapiens
gugaugaguuugacaguuu

SEQ ID NO: 363687 - RNA, 19 nt, Homo sapiens
gaacuucagcauuguaauu

SEQ ID NO: 363688 - RNA, 19 nt, Homo sapiens
gaagacaguggccauuaua

SEQ ID NO: 363689 - RNA, 19 nt, Homo sapiens
gaaagacaguggagauuac

SEQ ID NO: 363690 - RNA, 19 nt, Homo sapiens
gcucaagcauucuguuuau

SEQ ID NO: 363691 - RNA, 19 nt, Homo sapiens
cgaugcagcugccuuauga

SEQ ID NO: 363692 - RNA, 19 nt, Homo sapiens
gcaggcacauuuacaucua

SEQ ID NO: 363693 - RNA, 19 nt, Homo sapiens
ccagagaaagcacaauuua

SEQ ID NO: 363694 - RNA, 19 nt, Homo sapiens
gaugaugauucugccauua

SEQ ID NO: 363695 - RNA, 19 nt, Homo sapiens
uggaugauaugcaaagaua

SEQ ID NO: 363696 - RNA, 19 nt, Homo sapiens
ucacaaugcuggaagaaau

SEQ ID NO: 363697 - RNA, 19 nt, Homo sapiens
ugacagcuauuuacuuaga

SEQ ID NO: 363698 - RNA, 19 nt, Homo sapiens
gcugauaccauaugaauga

SEQ ID NO: 363699 - RNA, 19 nt, Homo sapiens
caggaagccuacuauuuaa

SEQ ID NO: 363700 - RNA, 19 nt, Homo sapiens
gaagcaggcugauacuaca

SEQ ID NO: 363701 - RNA, 19 nt, Homo sapiens
ugagaaagcuaaaguuugg

SEQ ID NO: 363702 - RNA, 19 nt, Homo sapiens
gacaucagccuccuucuuu

SEQ ID NO: 363703 - RNA, 19 nt, Homo sapiens
uaacuguacugaauagguu

SEQ ID NO: 363704 - RNA, 19 nt, Homo sapiens
gcucccaccugaauuugua

SEQ ID NO: 363705 - RNA, 19 nt, Homo sapiens
aaucacagcucaagcauuc

SEQ ID NO: 363706 - RNA, 19 nt, Homo sapiens
gcaauucaguguuccaagu

SEQ ID NO: 363707 - RNA, 19 nt, Homo sapiens
ugagugagauuguggagaa

SEQ ID NO: 363708 - RNA, 19 nt, Homo sapiens
ugagugaugucuggucuua

SEQ ID NO: 363709 - RNA, 19 nt, Homo sapiens
ggaacagccuauggauuaa

SEQ ID NO: 363710 - RNA, 19 nt, Homo sapiens
gaugggaguuuccaagaga

SEQ ID NO: 363711 - RNA, 19 nt, Homo sapiens
caaccugcaugaagucaaa

SEQ ID NO: 363712 - RNA, 19 nt, Homo sapiens
gauuagugauguccuuaaa

SEQ ID NO: 363713 - RNA, 19 nt, Homo sapiens
cuuaauugcugauaccaua

SEQ ID NO: 363714 - RNA, 19 nt, Homo sapiens
gaagagagugccauugaga

SEQ ID NO: 363715 - RNA, 19 nt, Homo sapiens
gaaggugguugaaggaaca

SEQ ID NO: 363716 - RNA, 19 nt, Homo sapiens
ccagggaggucaaagaaau

SEQ ID NO: 363717 - RNA, 19 nt, Homo sapiens
cgagacuccuguaaccuua

SEQ ID NO: 363718 - RNA, 19 nt, Homo sapiens
gcagcugaauucauccuuu

SEQ ID NO: 363719 - RNA, 19 nt, Homo sapiens
gagcuucaccuaucaaguu

SEQ ID NO: 363720 - RNA, 19 nt, Homo sapiens
aaacaauggugacuacaug

SEQ ID NO: 363721 - RNA, 19 nt, Homo sapiens
gcauagagaacaaaguaaa

SEQ ID NO: 363722 - RNA, 19 nt, Homo sapiens
gaaaaccacuuuauugcaa

SEQ ID NO: 363723 - RNA, 19 nt, Homo sapiens
gacaguggcuacaucauuc

SEQ ID NO: 363724 - RNA, 19 nt, Homo sapiens
aggaacagccuauggauua

SEQ ID NO: 363725 - RNA, 19 nt, Homo sapiens
ggaaacagaaaccgaggua

SEQ ID NO: 363726 - RNA, 19 nt, Homo sapiens
guauaugacugcauuugug

SEQ ID NO: 363727 - RNA, 19 nt, Homo sapiens
caccugaauuuguauauga

SEQ ID NO: 363728 - RNA, 19 nt, Homo sapiens
gauccucaguucucaaaug

SEQ ID NO: 363729 - RNA, 19 nt, Homo sapiens
gugaagaucugugacuuug

SEQ ID NO: 363730 - RNA, 19 nt, Homo sapiens
gcagcugccuuaugacuca

SEQ ID NO: 363731 - RNA, 19 nt, Homo sapiens
caacagacacaauuuauac

SEQ ID NO: 363732 - RNA, 19 nt, Homo sapiens
ggaauaauaggccacagaa

SEQ ID NO: 363733 - RNA, 19 nt, Homo sapiens
gaugguggauucuacuuuc

SEQ ID NO: 363734 - RNA, 19 nt, Homo sapiens
ucagaaggccuuacuuuau

SEQ ID NO: 363735 - RNA, 19 nt, Homo sapiens
ggaaaagauucaggaaaua

SEQ ID NO: 363736 - RNA, 19 nt, Homo sapiens
acacaggguuguacacuug

SEQ ID NO: 363737 - RNA, 19 nt, Homo sapiens
gaaacacuauuugugacuu

SEQ ID NO: 363738 - RNA, 19 nt, Homo sapiens
ugagaaacacuauuuguga

SEQ ID NO: 363739 - RNA, 19 nt, Homo sapiens
ucacaucuauccacacugu

SEQ ID NO: 363740 - RNA, 19 nt, Homo sapiens
cagagaagccaaagaaaga

SEQ ID NO: 363741 - RNA, 19 nt, Homo sapiens
caaagucccauccaucaaa

SEQ ID NO: 363742 - RNA, 19 nt, Homo sapiens
ggaaaucagaaaugaagaa

SEQ ID NO: 363743 - RNA, 19 nt, Homo sapiens
gauagggucuaccaauaca

SEQ ID NO: 363744 - RNA, 19 nt, Homo sapiens
cacauuaacuguugcacuu

SEQ ID NO: 363745 - RNA, 19 nt, Homo sapiens
ugucugaacugaagauaau

SEQ ID NO: 363746 - RNA, 19 nt, Homo sapiens
ugaaagacaguggagauua

SEQ ID NO: 363747 - RNA, 19 nt, Homo sapiens
ucacugccuucguuuauau

SEQ ID NO: 363748 - RNA, 19 nt, Homo sapiens
gcugagaaagcuaaaguuu

SEQ ID NO: 363749 - RNA, 19 nt, Homo sapiens
gaggaggacuugguugaug

SEQ ID NO: 363750 - RNA, 19 nt, Homo sapiens
caaagaaagagcuggauau

SEQ ID NO: 363751 - RNA, 19 nt, Homo sapiens
ccauuuacaucaucacaga

SEQ ID NO: 363752 - RNA, 19 nt, Homo sapiens
gacaguggccauuauacua

SEQ ID NO: 363753 - RNA, 19 nt, Homo sapiens
uaacaucggaggagaaguu

SEQ ID NO: 363754 - RNA, 19 nt, Homo sapiens
gaaaucaaacccaccuuca

SEQ ID NO: 363755 - RNA, 19 nt, Homo sapiens
ugaugauucugccauuaua

SEQ ID NO: 363756 - RNA, 19 nt, Homo sapiens
gaagaugcagaagcaauaa

SEQ ID NO: 363757 - RNA, 19 nt, Homo sapiens
ggaacaggguuggaauuca

SEQ ID NO: 363758 - RNA, 19 nt, Homo sapiens
ccaacagacacaauuuaua

SEQ ID NO: 363759 - RNA, 19 nt, Homo sapiens
gaacggacauuguuuauga

SEQ ID NO: 363760 - RNA, 19 nt, Homo sapiens
guaaugaacuuauggaaag

SEQ ID NO: 363761 - RNA, 19 nt, Homo sapiens
ggacauuguuuaugacaug

SEQ ID NO: 363762 - RNA, 19 nt, Homo sapiens
gagaauagaaucaaaccua

SEQ ID NO: 363763 - RNA, 19 nt, Homo sapiens
gaacaagcguccaaaagaa

SEQ ID NO: 363764 - RNA, 19 nt, Homo sapiens
gccaacaccuucccaagaa

SEQ ID NO: 363765 - RNA, 19 nt, Homo sapiens
gaugcaggauauuacauuu

SEQ ID NO: 363766 - RNA, 19 nt, Homo sapiens
ggagaacucuuuguaccuu

SEQ ID NO: 363767 - RNA, 19 nt, Homo sapiens
gaagucauccagucuauuc

SEQ ID NO: 363768 - RNA, 19 nt, Homo sapiens
ggacagaccacaguagcua

SEQ ID NO: 363769 - RNA, 19 nt, Homo sapiens
gaaucaaaccuaccaacaa

SEQ ID NO: 363770 - RNA, 19 nt, Homo sapiens
gacgauugaugcaggauau

SEQ ID NO: 363771 - RNA, 19 nt, Homo sapiens
ggacacaccacgagaaucu

SEQ ID NO: 363772 - RNA, 19 nt, Homo sapiens
ggacagggacucagccaau

SEQ ID NO: 363773 - RNA, 19 nt, Homo sapiens
ggaaagcccauuuguguac

SEQ ID NO: 363774 - RNA, 19 nt, Homo sapiens
caucuuggcuucuucaaac

SEQ ID NO: 363775 - RNA, 19 nt, Homo sapiens
gacagggacucagccaauu

SEQ ID NO: 363776 - RNA, 19 nt, Homo sapiens
gaaccaggagagaauagaa

SEQ ID NO: 363777 - RNA, 19 nt, Homo sapiens
acccagacauccaaacuaa

SEQ ID NO: 363778 - RNA, 19 nt, Homo sapiens
cuguagagcuucgauguaa

SEQ ID NO: 363779 - RNA, 19 nt, Homo sapiens
cuacauacguguuccuagu

SEQ ID NO: 363780 - RNA, 19 nt, Homo sapiens
ugaugcaagugcuggauaa

SEQ ID NO: 363781 - RNA, 19 nt, Homo sapiens
aaucaaaccuaccaacaag

SEQ ID NO: 363782 - RNA, 19 nt, Homo sapiens
ucuauucacagaaguguua

SEQ ID NO: 363783 - RNA, 19 nt, Homo sapiens
gccagaggcugaugucaag

SEQ ID NO: 363784 - RNA, 19 nt, Homo sapiens
cuacuucgauguugucuac

SEQ ID NO: 363785 - RNA, 19 nt, Homo sapiens
gcacugcucagaaucuuca

SEQ ID NO: 363786 - RNA, 19 nt, Homo sapiens
aaaggucgcuuccagaaac

SEQ ID NO: 363787 - RNA, 19 nt, Homo sapiens
gggcuccaccuacaucuuu

SEQ ID NO: 363788 - RNA, 19 nt, Homo sapiens
acgaagcgcuggaggaugu

SEQ ID NO: 363789 - RNA, 19 nt, Homo sapiens
gaaagcccauuuguguaca

SEQ ID NO: 363790 - RNA, 19 nt, Homo sapiens
gguccgagguucccgagau

SEQ ID NO: 363791 - RNA, 19 nt, Homo sapiens
ggagcuacccugcguaucu

SEQ ID NO: 363792 - RNA, 19 nt, Homo sapiens
acauacguguuccuaguuu

SEQ ID NO: 363793 - RNA, 19 nt, Homo sapiens
ggagaucccagccaaugga

SEQ ID NO: 363794 - RNA, 19 nt, Homo sapiens
cauccagucuauucacaga

SEQ ID NO: 363795 - RNA, 19 nt, Homo sapiens
cgauugaugcaggauauua

SEQ ID NO: 363796 - RNA, 19 nt, Homo sapiens
gcacgaagcgcuggaggau

SEQ ID NO: 363797 - RNA, 19 nt, Homo sapiens
ucaaaccuaccaacaagaa

SEQ ID NO: 363798 - RNA, 19 nt, Homo sapiens
ucaaguaccagcugcucua

SEQ ID NO: 363799 - RNA, 19 nt, Homo sapiens
uguaaagggaguagaauug

SEQ ID NO: 363800 - RNA, 19 nt, Homo sapiens
ggccaacaccuucccaaga

SEQ ID NO: 363801 - RNA, 19 nt, Homo sapiens
cauuugcacugcucagaau

SEQ ID NO: 363802 - RNA, 19 nt, Homo sapiens
ggaguucaccuggaucuuc

SEQ ID NO: 363803 - RNA, 19 nt, Homo sapiens
cugcguaucuggacaccuu

SEQ ID NO: 363804 - RNA, 19 nt, Homo sapiens
gagcuacccugcguaucug

SEQ ID NO: 363805 - RNA, 19 nt, Homo sapiens
gaaagcaugauuuugauug

SEQ ID NO: 363806 - RNA, 19 nt, Homo sapiens
ucuauuaaaugagcacguu

SEQ ID NO: 363807 - RNA, 19 nt, Homo sapiens
ucucagaucuccgucaagu

SEQ ID NO: 363808 - RNA, 19 nt, Homo sapiens
uaaaggucgcuuccagaaa

SEQ ID NO: 363809 - RNA, 19 nt, Homo sapiens
gacauuguuuaugacauga

SEQ ID NO: 363810 - RNA, 19 nt, Homo sapiens
gacccagacauccaaacua

SEQ ID NO: 363811 - RNA, 19 nt, Homo sapiens
gacgcagucuaucaugaug

SEQ ID NO: 363812 - RNA, 19 nt, Homo sapiens
gcccaaaauuccuaaaaug

SEQ ID NO: 363813 - RNA, 19 nt, Homo sapiens
ggagagaauagaaucaaac

SEQ ID NO: 363814 - RNA, 19 nt, Homo sapiens
ucaaggacagaccacagua

SEQ ID NO: 363815 - RNA, 19 nt, Homo sapiens
caaccaucuuggcuucuuc

SEQ ID NO: 363816 - RNA, 19 nt, Homo sapiens
aaagaaccaggagagaaua

SEQ ID NO: 363817 - RNA, 19 nt, Homo sapiens
ggaacggacauuguuuaug

SEQ ID NO: 363818 - RNA, 19 nt, Homo sapiens
acagaaagcaugauuuuga

SEQ ID NO: 363819 - RNA, 19 nt, Homo sapiens
ggaagucauccagucuauu

SEQ ID NO: 363820 - RNA, 19 nt, Homo sapiens
ucagaucuccgucaaguac

SEQ ID NO: 363821 - RNA, 19 nt, Homo sapiens
aggagagaauagaaucaaa

SEQ ID NO: 363822 - RNA, 19 nt, Homo sapiens
cgauguaaagggaguagaa

SEQ ID NO: 363823 - RNA, 19 nt, Homo sapiens
guagagcuucgauguaaag

SEQ ID NO: 363824 - RNA, 19 nt, Homo sapiens
gaagcgcuggaggauguua

SEQ ID NO: 363825 - RNA, 19 nt, Homo sapiens
ucauuacaguggaagacuu

SEQ ID NO: 363826 - RNA, 19 nt, Homo sapiens
gcaugauuuugauugcuua

SEQ ID NO: 363827 - RNA, 19 nt, Homo sapiens
cuaacagaaagcaugauuu

SEQ ID NO: 363828 - RNA, 19 nt, Homo sapiens
ggaaaaggaaauguaauga

SEQ ID NO: 363829 - RNA, 19 nt, Homo sapiens
ccagcuacuucgauguugu

SEQ ID NO: 363830 - RNA, 19 nt, Homo sapiens
ggcagacacaggugaauuc

SEQ ID NO: 363831 - RNA, 19 nt, Homo sapiens
guaaagggaguagaauugg

SEQ ID NO: 363832 - RNA, 19 nt, Homo sapiens
gaaggugaagcccaaaauu

SEQ ID NO: 363833 - RNA, 19 nt, Homo sapiens
uggaaagcccauuugugua

SEQ ID NO: 363834 - RNA, 19 nt, Homo sapiens
gagugucauuacaguggaa

SEQ ID NO: 363835 - RNA, 19 nt, Homo sapiens
gcagacacaggugaauuca

SEQ ID NO: 363836 - RNA, 19 nt, Homo sapiens
uguagagcuucgauguaaa

SEQ ID NO: 363837 - RNA, 19 nt, Homo sapiens
auaaaggucgcuuccagaa

SEQ ID NO: 363838 - RNA, 19 nt, Homo sapiens
uugauugcuuaccuacaua

SEQ ID NO: 363839 - RNA, 19 nt, Homo sapiens
aggaagucauccagucuau

SEQ ID NO: 363840 - RNA, 19 nt, Homo sapiens
ccagacauccaaacuaaaa

SEQ ID NO: 363841 - RNA, 19 nt, Homo sapiens
ugaugcaggauauuacauu

SEQ ID NO: 363842 - RNA, 19 nt, Homo sapiens
ugcaagugcuggauaaagg

SEQ ID NO: 363843 - RNA, 19 nt, Homo sapiens
uuugauugcuuaccuacau

SEQ ID NO: 363844 - RNA, 19 nt, Homo sapiens
caacaccuucccaagaaca

SEQ ID NO: 363845 - RNA, 19 nt, Homo sapiens
gcggcuacaucugcaggaa

SEQ ID NO: 363846 - RNA, 19 nt, Homo sapiens
ucuaacagaaagcaugauu

SEQ ID NO: 363847 - RNA, 19 nt, Homo sapiens
acaaccaucuuggcuucuu

SEQ ID NO: 363848 - RNA, 19 nt, Homo sapiens
ucgauguugucuacuugaa

SEQ ID NO: 363849 - RNA, 19 nt, Homo sapiens
cuucgauguugucuacuug

SEQ ID NO: 363850 - RNA, 19 nt, Homo sapiens
ccaagaacaagcguccaaa

SEQ ID NO: 363851 - RNA, 19 nt, Homo sapiens
gcaagugcuggauaaaggu

SEQ ID NO: 363852 - RNA, 19 nt, Homo sapiens
caaaagaaccaggagagaa

SEQ ID NO: 363853 - RNA, 19 nt, Homo sapiens
gauguaaagggaguagaau

SEQ ID NO: 363854 - RNA, 19 nt, Homo sapiens
guccgagguucccgagaug

SEQ ID NO: 363855 - RNA, 19 nt, Homo sapiens
uagcuaccacuguugaguu

SEQ ID NO: 363856 - RNA, 19 nt, Homo sapiens
gcaggauauuacauuugca

SEQ ID NO: 363857 - RNA, 19 nt, Homo sapiens
ucccagggcagaaggauga

SEQ ID NO: 363858 - RNA, 19 nt, Homo sapiens
gcguaucuggacaccuuua

SEQ ID NO: 363859 - RNA, 19 nt, Homo sapiens
ggaaggcgcuggcugauga

SEQ ID NO: 363860 - RNA, 19 nt, Homo sapiens
gaaaguaggcacagaaauu

SEQ ID NO: 363861 - RNA, 19 nt, Homo sapiens
gcacagaaauuugcaaugg

SEQ ID NO: 363862 - RNA, 19 nt, Homo sapiens
gaagagauccugcccaugu

SEQ ID NO: 363863 - RNA, 19 nt, Homo sapiens
cuacauuacucauccauuu

SEQ ID NO: 363864 - RNA, 19 nt, Homo sapiens
gaagccaacugugaauaaa

SEQ ID NO: 363865 - RNA, 19 nt, Homo sapiens
gaagaucauucuggauauu

SEQ ID NO: 363866 - RNA, 19 nt, Homo sapiens
ugaaaucacugagaacauu

SEQ ID NO: 363867 - RNA, 19 nt, Homo sapiens
gcacauucguguacaagga

SEQ ID NO: 363868 - RNA, 19 nt, Homo sapiens
guacacagguagacagaug

SEQ ID NO: 363869 - RNA, 19 nt, Homo sapiens
acaaggaguucucucguuu

SEQ ID NO: 363870 - RNA, 19 nt, Homo sapiens
ggacacaggccguuucuca

SEQ ID NO: 363871 - RNA, 19 nt, Homo sapiens
ugaaggcucuggaggagaa

SEQ ID NO: 363872 - RNA, 19 nt, Homo sapiens
ccaacaaccuguaccagau

SEQ ID NO: 363873 - RNA, 19 nt, Homo sapiens
ccacguggcucagaccaaa

SEQ ID NO: 363874 - RNA, 19 nt, Homo sapiens
agagagcgauguuucagaa

SEQ ID NO: 363875 - RNA, 19 nt, Homo sapiens
aaacugaagccaacuguga

SEQ ID NO: 363876 - RNA, 19 nt, Homo sapiens
cauuugacaucuacgaauu

SEQ ID NO: 363877 - RNA, 19 nt, Homo sapiens
gcugcagccucuucaugua

SEQ ID NO: 363878 - RNA, 19 nt, Homo sapiens
ggaaaggacagucuuggau

SEQ ID NO: 363879 - RNA, 19 nt, Homo sapiens
ccaccacacaugcuaauuu

SEQ ID NO: 363880 - RNA, 19 nt, Homo sapiens
ggacaggcagccaccauga

SEQ ID NO: 363881 - RNA, 19 nt, Homo sapiens
gaucagcagcccauuccua

SEQ ID NO: 363882 - RNA, 19 nt, Homo sapiens
ggacaucgcacaggacaug

SEQ ID NO: 363883 - RNA, 19 nt, Homo sapiens
ccggguggcucaucaagaa

SEQ ID NO: 363884 - RNA, 19 nt, Homo sapiens
caagaaaguaggcacagaa

SEQ ID NO: 363885 - RNA, 19 nt, Homo sapiens
ugaagaucauucuggauau

SEQ ID NO: 363886 - RNA, 19 nt, Homo sapiens
aaaguaggcacagaaauuu

SEQ ID NO: 363887 - RNA, 19 nt, Homo sapiens
gcaaggaggagaucaaggu

SEQ ID NO: 363888 - RNA, 19 nt, Homo sapiens
cagcagcccauuccuauga

SEQ ID NO: 363889 - RNA, 19 nt, Homo sapiens
gagcgauguuucagaagau

SEQ ID NO: 363890 - RNA, 19 nt, Homo sapiens
gaggagacccugaacaucu

SEQ ID NO: 363891 - RNA, 19 nt, Homo sapiens
aaacugagcccugagaaug

SEQ ID NO: 363892 - RNA, 19 nt, Homo sapiens
cugacgaaauguucaaauu

SEQ ID NO: 363893 - RNA, 19 nt, Homo sapiens
gccgggaaauugucuucua

SEQ ID NO: 363894 - RNA, 19 nt, Homo sapiens
cugacgagcucacugacua

SEQ ID NO: 363895 - RNA, 19 nt, Homo sapiens
cguuguaccugaagaucua

SEQ ID NO: 363896 - RNA, 19 nt, Homo sapiens
caacugugaauaaacugua

SEQ ID NO: 363897 - RNA, 19 nt, Homo sapiens
ugaagccaacugugaauaa

SEQ ID NO: 363898 - RNA, 19 nt, Homo sapiens
gaaacugagcccugagaau

SEQ ID NO: 363899 - RNA, 19 nt, Homo sapiens
cugaagaucauucuggaua

SEQ ID NO: 363900 - RNA, 19 nt, Homo sapiens
aaaggacagucuuggauca

SEQ ID NO: 363901 - RNA, 19 nt, Homo sapiens
ucucguggcugcugaguuc

SEQ ID NO: 363902 - RNA, 19 nt, Homo sapiens
ucaagaaugugcuguccau

SEQ ID NO: 363903 - RNA, 19 nt, Homo sapiens
gcucaacggcccauucuuc

SEQ ID NO: 363904 - RNA, 19 nt, Homo sapiens
caugaacucugaaaucacu

SEQ ID NO: 363905 - RNA, 19 nt, Homo sapiens
gagaaucaccuaccacaac

SEQ ID NO: 363906 - RNA, 19 nt, Homo sapiens
ccagcggccuuccaagcua

SEQ ID NO: 363907 - RNA, 19 nt, Homo sapiens
ccaagaaaaugacugaaga

SEQ ID NO: 363908 - RNA, 19 nt, Homo sapiens
ccaagaaaguaggcacaga

SEQ ID NO: 363909 - RNA, 19 nt, Homo sapiens
ccaccacauuugacaucua

SEQ ID NO: 363910 - RNA, 19 nt, Homo sapiens
caagcuacguggcagaaag

SEQ ID NO: 363911 - RNA, 19 nt, Homo sapiens
acaaagugaucgacuacau

SEQ ID NO: 363912 - RNA, 19 nt, Homo sapiens
acucugaaaucacugagaa

SEQ ID NO: 363913 - RNA, 19 nt, Homo sapiens
ggcgcuggcugaugaguau

SEQ ID NO: 363914 - RNA, 19 nt, Homo sapiens
gaacuaccaggacaagaag

SEQ ID NO: 363915 - RNA, 19 nt, Homo sapiens
cuccacggcuccucgauuu

SEQ ID NO: 363916 - RNA, 19 nt, Homo sapiens
ccggcaaacugaagagcua

SEQ ID NO: 363917 - RNA, 19 nt, Homo sapiens
ugagcuaccuccacaacug

SEQ ID NO: 363918 - RNA, 19 nt, Homo sapiens
ggaagcccuuugacgaaca

SEQ ID NO: 363919 - RNA, 19 nt, Homo sapiens
ucuacaaagugaucgacua

SEQ ID NO: 363920 - RNA, 19 nt, Homo sapiens
gcagaacaauaggaaagag

SEQ ID NO: 363921 - RNA, 19 nt, Homo sapiens
uacaaggaguucucucguu

SEQ ID NO: 363922 - RNA, 19 nt, Homo sapiens
uucagaagaucguggauga

SEQ ID NO: 363923 - RNA, 19 nt, Homo sapiens
gcucaugaccggcaaacug

SEQ ID NO: 363924 - RNA, 19 nt, Homo sapiens
caacaagaaggaggagauu

SEQ ID NO: 363925 - RNA, 19 nt, Homo sapiens
caucaugaauggcaaagac

SEQ ID NO: 363926 - RNA, 19 nt, Homo sapiens
ggccguuucucauccaguu

SEQ ID NO: 363927 - RNA, 19 nt, Homo sapiens
uccaugaacucugaaauca

SEQ ID NO: 363928 - RNA, 19 nt, Homo sapiens
gaccgacugcagaacaaua

SEQ ID NO: 363929 - RNA, 19 nt, Homo sapiens
agagcgauguuucagaaga

SEQ ID NO: 363930 - RNA, 19 nt, Homo sapiens
ggaccuggcccuguacuuc

SEQ ID NO: 363931 - RNA, 19 nt, Homo sapiens
gacuacaagacaaagaaua

SEQ ID NO: 363932 - RNA, 19 nt, Homo sapiens
aggagacccugaacaucua

SEQ ID NO: 363933 - RNA, 19 nt, Homo sapiens
uggagucccugacacaguu

SEQ ID NO: 363934 - RNA, 19 nt, Homo sapiens
gaccaaggagaaggaauuu

SEQ ID NO: 363935 - RNA, 19 nt, Homo sapiens
ugaccaaggagaaggaauu

SEQ ID NO: 363936 - RNA, 19 nt, Homo sapiens
gaacauuugcagccacaca

SEQ ID NO: 363937 - RNA, 19 nt, Homo sapiens
caagaagagagcgauguuu

SEQ ID NO: 363938 - RNA, 19 nt, Homo sapiens
gccaguacuuugggaagaa

SEQ ID NO: 363939 - RNA, 19 nt, Homo sapiens
gcacgugauccaccugaug

SEQ ID NO: 363940 - RNA, 19 nt, Homo sapiens
gcaaacugaagagcuacua

SEQ ID NO: 363941 - RNA, 19 nt, Homo sapiens
cgaagacgaagauguguuc

SEQ ID NO: 363942 - RNA, 19 nt, Homo sapiens
gaucauggcagugaacaag

SEQ ID NO: 363943 - RNA, 19 nt, Homo sapiens
cgagcucacugacuacaag

SEQ ID NO: 363944 - RNA, 19 nt, Homo sapiens
agaacuaccaggacaagaa

SEQ ID NO: 363945 - RNA, 19 nt, Homo sapiens
caacaaccuguaccagaug

SEQ ID NO: 363946 - RNA, 19 nt, Homo sapiens
cagcgaagacgaagaugug

SEQ ID NO: 363947 - RNA, 19 nt, Homo sapiens
ccaguacuuugggaagaaa

SEQ ID NO: 363948 - RNA, 19 nt, Homo sapiens
ucacugacuacaagacaaa

SEQ ID NO: 363949 - RNA, 19 nt, Homo sapiens
gcccagcacccaagucuuc

SEQ ID NO: 363950 - RNA, 19 nt, Homo sapiens
gaagagagcgauguuucag

SEQ ID NO: 363951 - RNA, 19 nt, Homo sapiens
ggagaaucaccuaccacaa

SEQ ID NO: 363952 - RNA, 19 nt, Homo sapiens
ggcuuuauuuguaacauca

SEQ ID NO: 363953 - RNA, 19 nt, Homo sapiens
ggacaugaccaaggagaag

SEQ ID NO: 363954 - RNA, 19 nt, Homo sapiens
aaggguccaugaacucuga

SEQ ID NO: 363955 - RNA, 19 nt, Homo sapiens
ucaagaagagagcgauguu

SEQ ID NO: 363956 - RNA, 19 nt, Homo sapiens
caccacacaugcuaauuuu

SEQ ID NO: 363957 - RNA, 19 nt, Homo sapiens
gagguuaggaagcccaaga

SEQ ID NO: 363958 - RNA, 19 nt, Homo sapiens
ccacuaggauuuggguucu

SEQ ID NO: 363959 - RNA, 19 nt, Homo sapiens
gcacuaacauucuagagua

SEQ ID NO: 363960 - RNA, 19 nt, Homo sapiens
gaaaggagacgucaaauau

SEQ ID NO: 363961 - RNA, 19 nt, Homo sapiens
ggaaugagguggucaacuu

SEQ ID NO: 363962 - RNA, 19 nt, Homo sapiens
gcacaggccuugacuuaga

SEQ ID NO: 363963 - RNA, 19 nt, Homo sapiens
ggacaaagagggcaaauga

SEQ ID NO: 363964 - RNA, 19 nt, Homo sapiens
gaagagaaguuugagauuc

SEQ ID NO: 363965 - RNA, 19 nt, Homo sapiens
ggaaacggcucuacaucuu

SEQ ID NO: 363966 - RNA, 19 nt, Homo sapiens
ccaaagauauaaucaccua

SEQ ID NO: 363967 - RNA, 19 nt, Homo sapiens
gaaaguggccgucaagaug

SEQ ID NO: 363968 - RNA, 19 nt, Homo sapiens
caacgagucuccagugcua

SEQ ID NO: 363969 - RNA, 19 nt, Homo sapiens
ggaacgugcucaucuguga

SEQ ID NO: 363970 - RNA, 19 nt, Homo sapiens
gauauaaucaccuagguuu

SEQ ID NO: 363971 - RNA, 19 nt, Homo sapiens
gcacauuuguccagaugaa

SEQ ID NO: 363972 - RNA, 19 nt, Homo sapiens
gcaaggccauauacccuaa

SEQ ID NO: 363973 - RNA, 19 nt, Homo sapiens
gcagguggaugaggaguuu

SEQ ID NO: 363974 - RNA, 19 nt, Homo sapiens
gcgcggagcucuacagcaa

SEQ ID NO: 363975 - RNA, 19 nt, Homo sapiens
gagaggaccugccgagcaa

SEQ ID NO: 363976 - RNA, 19 nt, Homo sapiens
ccacacuccuugcccuuua

SEQ ID NO: 363977 - RNA, 19 nt, Homo sapiens
ccaugcagcugcccuauga

SEQ ID NO: 363978 - RNA, 19 nt, Homo sapiens
ccagcagucuuucugauaa

SEQ ID NO: 363979 - RNA, 19 nt, Homo sapiens
ggaaggugauugagucugu

SEQ ID NO: 363980 - RNA, 19 nt, Homo sapiens
ggauaugccuuaccacauc

SEQ ID NO: 363981 - RNA, 19 nt, Homo sapiens
caacguggcuuuucuggua

SEQ ID NO: 363982 - RNA, 19 nt, Homo sapiens
ggacccaucuauaucauca

SEQ ID NO: 363983 - RNA, 19 nt, Homo sapiens
ggacucacguuaacucaca

SEQ ID NO: 363984 - RNA, 19 nt, Homo sapiens
ggccagagcuuguccucaa

SEQ ID NO: 363985 - RNA, 19 nt, Homo sapiens
gagcgacgguggcuacaug

SEQ ID NO: 363986 - RNA, 19 nt, Homo sapiens
cacguuaacucacauuuau

SEQ ID NO: 363987 - RNA, 19 nt, Homo sapiens
gaggaacuauucaucuuuc

SEQ ID NO: 363988 - RNA, 19 nt, Homo sapiens
acaagaagcuucagauggu

SEQ ID NO: 363989 - RNA, 19 nt, Homo sapiens
cgaauuacaucuccaaagg

SEQ ID NO: 363990 - RNA, 19 nt, Homo sapiens
acagggagguggauucuga

SEQ ID NO: 363991 - RNA, 19 nt, Homo sapiens
guugcugucucuccuguua

SEQ ID NO: 363992 - RNA, 19 nt, Homo sapiens
ugaaaggagacgucaaaua

SEQ ID NO: 363993 - RNA, 19 nt, Homo sapiens
caaaggaggacccaucuau

SEQ ID NO: 363994 - RNA, 19 nt, Homo sapiens
gaacuauucaucuuucuca

SEQ ID NO: 363995 - RNA, 19 nt, Homo sapiens
gagcaacuuugaucaacga

SEQ ID NO: 363996 - RNA, 19 nt, Homo sapiens
gaaacggcucuacaucuuu

SEQ ID NO: 363997 - RNA, 19 nt, Homo sapiens
ggaagagaaguuugagauu

SEQ ID NO: 363998 - RNA, 19 nt, Homo sapiens
agagccagcuggagacuaa

SEQ ID NO: 363999 - RNA, 19 nt, Homo sapiens
caagaagcuucagauggua

SEQ ID NO: 364000 - RNA, 19 nt, Homo sapiens
guucuacaaugccaucaaa

SEQ ID NO: 364001 - RNA, 19 nt, Homo sapiens
ugacggagagugugaauga

SEQ ID NO: 364002 - RNA, 19 nt, Homo sapiens
aaacggcucuacaucuuug

SEQ ID NO: 364003 - RNA, 19 nt, Homo sapiens
uaacugagaucaccauucc

SEQ ID NO: 364004 - RNA, 19 nt, Homo sapiens
gaugaagcaaggccauaua

SEQ ID NO: 364005 - RNA, 19 nt, Homo sapiens
cgucaaauaugcagacauc

SEQ ID NO: 364006 - RNA, 19 nt, Homo sapiens
ccaucuauaucaucacuga

SEQ ID NO: 364007 - RNA, 19 nt, Homo sapiens
ccaggugguugcacauuug

SEQ ID NO: 364008 - RNA, 19 nt, Homo sapiens
ggaaaguuaggcuugauga

SEQ ID NO: 364009 - RNA, 19 nt, Homo sapiens
uauguaagaugggaaaguu

SEQ ID NO: 364010 - RNA, 19 nt, Homo sapiens
ccucaaccaucuccuguga

SEQ ID NO: 364011 - RNA, 19 nt, Homo sapiens
ggaggacccaucuauauca

SEQ ID NO: 364012 - RNA, 19 nt, Homo sapiens
gaagccacguuacgagauc

SEQ ID NO: 364013 - RNA, 19 nt, Homo sapiens
ggagaccgaugagcggaaa

SEQ ID NO: 364014 - RNA, 19 nt, Homo sapiens
ucacguuaacucacauuua

SEQ ID NO: 364015 - RNA, 19 nt, Homo sapiens
ucaauacgguaccaaagau

SEQ ID NO: 364016 - RNA, 19 nt, Homo sapiens
cacgggaccucuuucacua

SEQ ID NO: 364017 - RNA, 19 nt, Homo sapiens
ggcagaagaagccacguua

SEQ ID NO: 364018 - RNA, 19 nt, Homo sapiens
gcggagcucuacagcaaug

SEQ ID NO: 364019 - RNA, 19 nt, Homo sapiens
acaaagagggcaaaugaga

SEQ ID NO: 364020 - RNA, 19 nt, Homo sapiens
ccacgugugugugccagua

SEQ ID NO: 364021 - RNA, 19 nt, Homo sapiens
acccagagcugcccaugaa

SEQ ID NO: 364022 - RNA, 19 nt, Homo sapiens
caugaaaggagacgucaaa

SEQ ID NO: 364023 - RNA, 19 nt, Homo sapiens
ggugggcacacuacaauuu

SEQ ID NO: 364024 - RNA, 19 nt, Homo sapiens
cugcacaggccuugacuua

SEQ ID NO: 364025 - RNA, 19 nt, Homo sapiens
ugacaacgacuauaucauc

SEQ ID NO: 364026 - RNA, 19 nt, Homo sapiens
cagaagugcugggaagaga

SEQ ID NO: 364027 - RNA, 19 nt, Homo sapiens
aaaggaggacccaucuaua

SEQ ID NO: 364028 - RNA, 19 nt, Homo sapiens
ggauucugaugccuacuau

SEQ ID NO: 364029 - RNA, 19 nt, Homo sapiens
ucacauuuauacagcagaa

SEQ ID NO: 364030 - RNA, 19 nt, Homo sapiens
ggacagugaggacaguuau

SEQ ID NO: 364031 - RNA, 19 nt, Homo sapiens
gugaugagaauguaaaugu

SEQ ID NO: 364032 - RNA, 19 nt, Homo sapiens
gggaagagaaguuugagau

SEQ ID NO: 364033 - RNA, 19 nt, Homo sapiens
gagaagcaagcccuuaugu

SEQ ID NO: 364034 - RNA, 19 nt, Homo sapiens
ucacggaaauaacugagau

SEQ ID NO: 364035 - RNA, 19 nt, Homo sapiens
gauuccagaucacacauca

SEQ ID NO: 364036 - RNA, 19 nt, Homo sapiens
ggccauauacccuaaacuu

SEQ ID NO: 364037 - RNA, 19 nt, Homo sapiens
acggagaccugguggacua

SEQ ID NO: 364038 - RNA, 19 nt, Homo sapiens
ugacugacuuccucuugga

SEQ ID NO: 364039 - RNA, 19 nt, Homo sapiens
ccgaggaacuauucaucuu

SEQ ID NO: 364040 - RNA, 19 nt, Homo sapiens
gccagucuccucccuauga

SEQ ID NO: 364041 - RNA, 19 nt, Homo sapiens
caagaacugcguccacaga

SEQ ID NO: 364042 - RNA, 19 nt, Homo sapiens
ccaauggcauggaguuucu

SEQ ID NO: 364043 - RNA, 19 nt, Homo sapiens
ugucggagcugaagaucau

SEQ ID NO: 364044 - RNA, 19 nt, Homo sapiens
gcaaugugacggagagugu

SEQ ID NO: 364045 - RNA, 19 nt, Homo sapiens
uuuaucacccucagucuua

SEQ ID NO: 364046 - RNA, 19 nt, Homo sapiens
ucaaccaucuccugugaca

SEQ ID NO: 364047 - RNA, 19 nt, Homo sapiens
ggaccugccgagcaacuuu

SEQ ID NO: 364048 - RNA, 19 nt, Homo sapiens
gaccagcagucuuucugau

SEQ ID NO: 364049 - RNA, 19 nt, Homo sapiens
caucaucucccuuaucauc

SEQ ID NO: 364050 - RNA, 19 nt, Homo sapiens
gaaaaggccaucaacauca

SEQ ID NO: 364051 - RNA, 19 nt, Homo sapiens
cagcaagucucaagaacac

SEQ ID NO: 364052 - RNA, 19 nt, Homo sapiens
gaagucaacaccuccucaa

SEQ ID NO: 364053 - RNA, 19 nt, Homo sapiens
gcuccacccugaaugaagu

SEQ ID NO: 364054 - RNA, 19 nt, Homo sapiens
gcaagcuggucaagaucug

SEQ ID NO: 364055 - RNA, 19 nt, Homo sapiens
aaggcaagcuggucaagau

SEQ ID NO: 364056 - RNA, 19 nt, Homo sapiens
ccaacuacauggccccuua

SEQ ID NO: 364057 - RNA, 19 nt, Homo sapiens
gagcuuguccucaaugucu

SEQ ID NO: 364058 - RNA, 19 nt, Homo sapiens
gcucugacggccaugagua

SEQ ID NO: 364059 - RNA, 19 nt, Homo sapiens
gcaugcaguuuguacauua

SEQ ID NO: 364060 - RNA, 19 nt, Homo sapiens
gaggaucgaugcacaugua

SEQ ID NO: 364061 - RNA, 19 nt, Homo sapiens
gaaagcagaucagcuguau

SEQ ID NO: 364062 - RNA, 19 nt, Homo sapiens
gcucuagccuguaaguaua

SEQ ID NO: 364063 - RNA, 19 nt, Homo sapiens
gagaagaaauucaggaagu

SEQ ID NO: 364064 - RNA, 19 nt, Homo sapiens
caagagaggcgauuucauu

SEQ ID NO: 364065 - RNA, 19 nt, Homo sapiens
gaagaaggcccuccuguca

SEQ ID NO: 364066 - RNA, 19 nt, Homo sapiens
gaaauucucgcagagcuua

SEQ ID NO: 364067 - RNA, 19 nt, Homo sapiens
cagaucagcuguauaaaca

SEQ ID NO: 364068 - RNA, 19 nt, Homo sapiens
gcucacggcuuuacuuuca

SEQ ID NO: 364069 - RNA, 19 nt, Homo sapiens
ggauugcucuagccuguaa

SEQ ID NO: 364070 - RNA, 19 nt, Homo sapiens
ggaaauugauguggaagug

SEQ ID NO: 364071 - RNA, 19 nt, Homo sapiens
gaaguaagagugacccuau

SEQ ID NO: 364072 - RNA, 19 nt, Homo sapiens
guaauugcaugcaguuugu

SEQ ID NO: 364073 - RNA, 19 nt, Homo sapiens
gaugaggucugccugacuu

SEQ ID NO: 364074 - RNA, 19 nt, Homo sapiens
gcacauguaugccaagaac

SEQ ID NO: 364075 - RNA, 19 nt, Homo sapiens
gaacuaaaggaaauugaug

SEQ ID NO: 364076 - RNA, 19 nt, Homo sapiens
gaagaaauucaggaaguaa

SEQ ID NO: 364077 - RNA, 19 nt, Homo sapiens
gagaguggauggaauggau

SEQ ID NO: 364078 - RNA, 19 nt, Homo sapiens
gggaacgucuguugagaga

SEQ ID NO: 364079 - RNA, 19 nt, Homo sapiens
aagcagaucagcuguauaa

SEQ ID NO: 364080 - RNA, 19 nt, Homo sapiens
ugaggaugcugcccaguuu

SEQ ID NO: 364081 - RNA, 19 nt, Homo sapiens
gagaauaaucgcuauggaa

SEQ ID NO: 364082 - RNA, 19 nt, Homo sapiens
aggaugggcucaaauacua

SEQ ID NO: 364083 - RNA, 19 nt, Homo sapiens
agaagaaauucaggaagua

SEQ ID NO: 364084 - RNA, 19 nt, Homo sapiens
ggaaugggaacgucuguug

SEQ ID NO: 364085 - RNA, 19 nt, Homo sapiens
gggaggaugggcucaaaua

SEQ ID NO: 364086 - RNA, 19 nt, Homo sapiens
aaaggaaauugauguggaa

SEQ ID NO: 364087 - RNA, 19 nt, Homo sapiens
gagcugggcuaccacaucu

SEQ ID NO: 364088 - RNA, 19 nt, Homo sapiens
cuaccgggcucacggcuuu

SEQ ID NO: 364089 - RNA, 19 nt, Homo sapiens
cauuaaguguguagauuga

SEQ ID NO: 364090 - RNA, 19 nt, Homo sapiens
gaugaauuauugagugcuu

SEQ ID NO: 364091 - RNA, 19 nt, Homo sapiens
auucgaagcuuacaacaug

SEQ ID NO: 364092 - RNA, 19 nt, Homo sapiens
agacaguguucucaacuug

SEQ ID NO: 364093 - RNA, 19 nt, Homo sapiens
ggaucaaguuuaagucagu

SEQ ID NO: 364094 - RNA, 19 nt, Homo sapiens
aaaaggagguugugcuaaa

SEQ ID NO: 364095 - RNA, 19 nt, Homo sapiens
gaagugaggaaggagauug

SEQ ID NO: 364096 - RNA, 19 nt, Homo sapiens
cauggcagcuuuguggaaa

SEQ ID NO: 364097 - RNA, 19 nt, Homo sapiens
caacuugguuaaggaggaa

SEQ ID NO: 364098 - RNA, 19 nt, Homo sapiens
gaaauucaggaaguaagaa

SEQ ID NO: 364099 - RNA, 19 nt, Homo sapiens
gaauaaucgcuauggaaug

SEQ ID NO: 364100 - RNA, 19 nt, Homo sapiens
gcagaucagcuguauaaac

SEQ ID NO: 364101 - RNA, 19 nt, Homo sapiens
gaaauugauguggaaguga

SEQ ID NO: 364102 - RNA, 19 nt, Homo sapiens
gaaugggaacgucuguuga

SEQ ID NO: 364103 - RNA, 19 nt, Homo sapiens
gccagauauucgaagcuua

SEQ ID NO: 364104 - RNA, 19 nt, Homo sapiens
cuauuaugcuucucaagga

SEQ ID NO: 364105 - RNA, 19 nt, Homo sapiens
aguaagagugacccuauua

SEQ ID NO: 364106 - RNA, 19 nt, Homo sapiens
gccaaucaguggaucaagu

SEQ ID NO: 364107 - RNA, 19 nt, Homo sapiens
gaagaaaacccagucaaug

SEQ ID NO: 364108 - RNA, 19 nt, Homo sapiens
agaaggcccuccugucaca

SEQ ID NO: 364109 - RNA, 19 nt, Homo sapiens
gagugacccuauuaugcuu

SEQ ID NO: 364110 - RNA, 19 nt, Homo sapiens
uaagagugacccuauuaug

SEQ ID NO: 364111 - RNA, 19 nt, Homo sapiens
guaagagugacccuauuau

SEQ ID NO: 364112 - RNA, 19 nt, Homo sapiens
aauaaucgcuauggaaugg

SEQ ID NO: 364113 - RNA, 19 nt, Homo sapiens
ggccagauauucgaagcuu

SEQ ID NO: 364114 - RNA, 19 nt, Homo sapiens
ggaaguaagaaguaagagu

SEQ ID NO: 364115 - RNA, 19 nt, Homo sapiens
cagacaguguucucaacuu

SEQ ID NO: 364116 - RNA, 19 nt, Homo sapiens
gggaggagaaggagagguu

SEQ ID NO: 364117 - RNA, 19 nt, Homo sapiens
ccaaucaguggaucaaguu

SEQ ID NO: 364118 - RNA, 19 nt, Homo sapiens
ggaggagaaggagagguua

SEQ ID NO: 364119 - RNA, 19 nt, Homo sapiens
gagaggcgauuucauuccu

SEQ ID NO: 364120 - RNA, 19 nt, Homo sapiens
gcacugauuacuacaagag

SEQ ID NO: 364121 - RNA, 19 nt, Homo sapiens
cggcagccagcacugauua

SEQ ID NO: 364122 - RNA, 19 nt, Homo sapiens
ugagaauaaucgcuaugga

SEQ ID NO: 364123 - RNA, 19 nt, Homo sapiens
cuuacaacauggcagcuuu

SEQ ID NO: 364124 - RNA, 19 nt, Homo sapiens
guagauugagcagguagua

SEQ ID NO: 364125 - RNA, 19 nt, Homo sapiens
aaucaguggaucaaguuua

SEQ ID NO: 364126 - RNA, 19 nt, Homo sapiens
agaauaaucgcuauggaau

SEQ ID NO: 364127 - RNA, 19 nt, Homo sapiens
gggcucacggcuuuacuuu

SEQ ID NO: 364128 - RNA, 19 nt, Homo sapiens
ugaaagcagaucagcugua

SEQ ID NO: 364129 - RNA, 19 nt, Homo sapiens
aucaguggaucaaguuuaa

SEQ ID NO: 364130 - RNA, 19 nt, Homo sapiens
gauugagcagguaguaauu

SEQ ID NO: 364131 - RNA, 19 nt, Homo sapiens
ccauuaaguguguagauug

SEQ ID NO: 364132 - RNA, 19 nt, Homo sapiens
uggaagagcugggcuacca

SEQ ID NO: 364133 - RNA, 19 nt, Homo sapiens
cagcacugauuacuacaag

SEQ ID NO: 364134 - RNA, 19 nt, Homo sapiens
cagggaggaugggcucaaa

SEQ ID NO: 364135 - RNA, 19 nt, Homo sapiens
gaggucugccugacuuuau

SEQ ID NO: 364136 - RNA, 19 nt, Homo sapiens
aaacccagucaaugaaauu

SEQ ID NO: 364137 - RNA, 19 nt, Homo sapiens
gaaaacccagucaaugaaa

SEQ ID NO: 364138 - RNA, 19 nt, Homo sapiens
cgacccaccuuuugaaguu

SEQ ID NO: 364139 - RNA, 19 nt, Homo sapiens
gcugagaguggauggaaug

SEQ ID NO: 364140 - RNA, 19 nt, Homo sapiens
gcagcuuuguggaaauuac

SEQ ID NO: 364141 - RNA, 19 nt, Homo sapiens
gcugguagcaucccguaau

SEQ ID NO: 364142 - RNA, 19 nt, Homo sapiens
guaguaauugcaugcaguu

SEQ ID NO: 364143 - RNA, 19 nt, Homo sapiens
uccauuaaguguguagauu

SEQ ID NO: 364144 - RNA, 19 nt, Homo sapiens
guucucaacuugguuaagg

SEQ ID NO: 364145 - RNA, 19 nt, Homo sapiens
gcugcugccuauuguagau

SEQ ID NO: 364146 - RNA, 19 nt, Homo sapiens
gccuguaaguauaauggaa

SEQ ID NO: 364147 - RNA, 19 nt, Homo sapiens
ggaagaaaacccagucaau

SEQ ID NO: 364148 - RNA, 19 nt, Homo sapiens
cugguagcaucccguaauu

SEQ ID NO: 364149 - RNA, 19 nt, Homo sapiens
caggaaguaagaaguaaga

SEQ ID NO: 364150 - RNA, 19 nt, Homo sapiens
uuguggaaauuaccuugua

SEQ ID NO: 364151 - RNA, 19 nt, Homo sapiens
uggcagcuuuguggaaauu

SEQ ID NO: 364152 - RNA, 19 nt, Homo sapiens
gauauucgaagcuuacaac

SEQ ID NO: 364153 - RNA, 19 nt, Homo sapiens
gaggaugggcucaaauacu

SEQ ID NO: 364154 - RNA, 19 nt, Homo sapiens
gaucgaugcacauguaugc

SEQ ID NO: 364155 - RNA, 19 nt, Homo sapiens
gaggagaaggagagguuau

SEQ ID NO: 364156 - RNA, 19 nt, Homo sapiens
gguagcaucccguaauuuu

SEQ ID NO: 364157 - RNA, 19 nt, Homo sapiens
aagguuugcugcugccuau

SEQ ID NO: 364158 - RNA, 19 nt, Homo sapiens
guuuguacauuagugcauu

SEQ ID NO: 364159 - RNA, 19 nt, Homo sapiens
uaagagggauccuauaaua

SEQ ID NO: 364160 - RNA, 19 nt, Homo sapiens
gcucuggccuguaaauaua

SEQ ID NO: 364161 - RNA, 19 nt, Homo sapiens
gaggaucgaugcauaugua

SEQ ID NO: 364162 - RNA, 19 nt, Homo sapiens
gagaauaaccuauauggaa

SEQ ID NO: 364163 - RNA, 19 nt, Homo sapiens
gaugagaucuguuugacuu

SEQ ID NO: 364164 - RNA, 19 nt, Homo sapiens
gagaagaaauucaggaagu

SEQ ID NO: 364165 - RNA, 19 nt, Homo sapiens
gcauugcucuggccuguaa

SEQ ID NO: 364166 - RNA, 19 nt, Homo sapiens
gcagauagccgaagcuuuc

SEQ ID NO: 364167 - RNA, 19 nt, Homo sapiens
gaauggauguucugugugu

SEQ ID NO: 364168 - RNA, 19 nt, Homo sapiens
gaaaugugaucuuuaucug

SEQ ID NO: 364169 - RNA, 19 nt, Homo sapiens
cagaucagcuguacaaaca

SEQ ID NO: 364170 - RNA, 19 nt, Homo sapiens
aaaggaggaucgaugcaua

SEQ ID NO: 364171 - RNA, 19 nt, Homo sapiens
ugauggagcugcaaaccua

SEQ ID NO: 364172 - RNA, 19 nt, Homo sapiens
gaaagaaauugaugaugcu

SEQ ID NO: 364173 - RNA, 19 nt, Homo sapiens
gagggauccuauaauaauu

SEQ ID NO: 364174 - RNA, 19 nt, Homo sapiens
gaaguaagagggauccuau

SEQ ID NO: 364175 - RNA, 19 nt, Homo sapiens
gggaacaucuacugagaga

SEQ ID NO: 364176 - RNA, 19 nt, Homo sapiens
ugagaucuguuugacuuua

SEQ ID NO: 364177 - RNA, 19 nt, Homo sapiens
gaagaaauucaggaaguaa

SEQ ID NO: 364178 - RNA, 19 nt, Homo sapiens
gggcugaggugaggaaaga

SEQ ID NO: 364179 - RNA, 19 nt, Homo sapiens
uauggcagcuuuauggaaa

SEQ ID NO: 364180 - RNA, 19 nt, Homo sapiens
agaagaaauucaggaagua

SEQ ID NO: 364181 - RNA, 19 nt, Homo sapiens
aagaggagguugugcuaaa

SEQ ID NO: 364182 - RNA, 19 nt, Homo sapiens
gaggcgaguugcccagaaa

SEQ ID NO: 364183 - RNA, 19 nt, Homo sapiens
gaaggcagaucagcuguac

SEQ ID NO: 364184 - RNA, 19 nt, Homo sapiens
ugaugaugcugcccaguuu

SEQ ID NO: 364185 - RNA, 19 nt, Homo sapiens
guggaagaauuaaaggaaa

SEQ ID NO: 364186 - RNA, 19 nt, Homo sapiens
gagaucuguuugacuuuau

SEQ ID NO: 364187 - RNA, 19 nt, Homo sapiens
caagauagaaugguaaaca

SEQ ID NO: 364188 - RNA, 19 nt, Homo sapiens
uggaauggauguucugugu

SEQ ID NO: 364189 - RNA, 19 nt, Homo sapiens
ucccguaacuccucaaaug

SEQ ID NO: 364190 - RNA, 19 nt, Homo sapiens
ucuccaagauagaauggua

SEQ ID NO: 364191 - RNA, 19 nt, Homo sapiens
agccgaagcuuucaauaug

SEQ ID NO: 364192 - RNA, 19 nt, Homo sapiens
uaaaggaaacgaugagauc

SEQ ID NO: 364193 - RNA, 19 nt, Homo sapiens
caauauggcagcuuuaugg

SEQ ID NO: 364194 - RNA, 19 nt, Homo sapiens
gaagaggagguugugcuaa

SEQ ID NO: 364195 - RNA, 19 nt, Homo sapiens
aaaggucgauggaauggau

SEQ ID NO: 364196 - RNA, 19 nt, Homo sapiens
cagcagccagcccugauua

SEQ ID NO: 364197 - RNA, 19 nt, Homo sapiens
ggaaugggaacaucuacug

SEQ ID NO: 364198 - RNA, 19 nt, Homo sapiens
cuacagcagugauucaucu

SEQ ID NO: 364199 - RNA, 19 nt, Homo sapiens
gaaauucaggaaguaagaa

SEQ ID NO: 364200 - RNA, 19 nt, Homo sapiens
ggacacaguaugagugauc

SEQ ID NO: 364201 - RNA, 19 nt, Homo sapiens
gcucauggugugugcuaua

SEQ ID NO: 364202 - RNA, 19 nt, Homo sapiens
gaauuaggccaucacaucu

SEQ ID NO: 364203 - RNA, 19 nt, Homo sapiens
gaaugggaacaucuacuga

SEQ ID NO: 364204 - RNA, 19 nt, Homo sapiens
gaucgaugcauauguauac

SEQ ID NO: 364205 - RNA, 19 nt, Homo sapiens
guaagagggauccuauaau

SEQ ID NO: 364206 - RNA, 19 nt, Homo sapiens
gcuaaaggucgauggaaug

SEQ ID NO: 364207 - RNA, 19 nt, Homo sapiens
ggcuaaaggucgauggaau

SEQ ID NO: 364208 - RNA, 19 nt, Homo sapiens
agagggauccuauaauaau

SEQ ID NO: 364209 - RNA, 19 nt, Homo sapiens
aguaagagggauccuauaa

SEQ ID NO: 364210 - RNA, 19 nt, Homo sapiens
cuuaaauacuacaggauga

SEQ ID NO: 364211 - RNA, 19 nt, Homo sapiens
gaauaaccuauauggaaug

SEQ ID NO: 364212 - RNA, 19 nt, Homo sapiens
gaggaaagaaauugaugau

SEQ ID NO: 364213 - RNA, 19 nt, Homo sapiens
gcauauguauaccaagaac

SEQ ID NO: 364214 - RNA, 19 nt, Homo sapiens
ggaucgaugcauauguaua

SEQ ID NO: 364215 - RNA, 19 nt, Homo sapiens
agaauuaggccaucacauc

SEQ ID NO: 364216 - RNA, 19 nt, Homo sapiens
ggaagaagaggagguugug

SEQ ID NO: 364217 - RNA, 19 nt, Homo sapiens
cugcaaaccuaccguuauc

SEQ ID NO: 364218 - RNA, 19 nt, Homo sapiens
cggaggggcuuaaauacua

SEQ ID NO: 364219 - RNA, 19 nt, Homo sapiens
cgaugcauauguauaccaa

SEQ ID NO: 364220 - RNA, 19 nt, Homo sapiens
gagguugugcuaaaggaaa

SEQ ID NO: 364221 - RNA, 19 nt, Homo sapiens
agaaauucauucgcgguuu

SEQ ID NO: 364222 - RNA, 19 nt, Homo sapiens
ugaaguucguggugcaaau

SEQ ID NO: 364223 - RNA, 19 nt, Homo sapiens
gaggugaggaaagaaauug

SEQ ID NO: 364224 - RNA, 19 nt, Homo sapiens
gcagcuuuauggaaauuac

SEQ ID NO: 364225 - RNA, 19 nt, Homo sapiens
gaagaauuaggccaucaca

SEQ ID NO: 364226 - RNA, 19 nt, Homo sapiens
gcagaucagcuguacaaac

SEQ ID NO: 364227 - RNA, 19 nt, Homo sapiens
gcaaaccuaccguuaucau

SEQ ID NO: 364228 - RNA, 19 nt, Homo sapiens
cagccagcccugauuacua

SEQ ID NO: 364229 - RNA, 19 nt, Homo sapiens
uagccgaagcuuucaauau

SEQ ID NO: 364230 - RNA, 19 nt, Homo sapiens
gccuguaaauauaaaggaa

SEQ ID NO: 364231 - RNA, 19 nt, Homo sapiens
aagagggauccuauaauaa

SEQ ID NO: 364232 - RNA, 19 nt, Homo sapiens
cagcagugauucaucuuuu

SEQ ID NO: 364233 - RNA, 19 nt, Homo sapiens
gcugcaaaccuaccguuau

SEQ ID NO: 364234 - RNA, 19 nt, Homo sapiens
gcagcagccagcccugauu

SEQ ID NO: 364235 - RNA, 19 nt, Homo sapiens
ucugugagaauaaccuaua

SEQ ID NO: 364236 - RNA, 19 nt, Homo sapiens
ucacgucauuacauccuau

SEQ ID NO: 364237 - RNA, 19 nt, Homo sapiens
gcugaggugaggaaagaaa

SEQ ID NO: 364238 - RNA, 19 nt, Homo sapiens
uuauggaaauuaccuugug

SEQ ID NO: 364239 - RNA, 19 nt, Homo sapiens
gggcggaggggcuuaaaua

SEQ ID NO: 364240 - RNA, 19 nt, Homo sapiens
augcauauguauaccaaga

SEQ ID NO: 364241 - RNA, 19 nt, Homo sapiens
caggaaguaagaaguaaga

SEQ ID NO: 364242 - RNA, 19 nt, Homo sapiens
gccgaagcuuucaauaugg

SEQ ID NO: 364243 - RNA, 19 nt, Homo sapiens
gauagccgaagcuuucaau

SEQ ID NO: 364244 - RNA, 19 nt, Homo sapiens
cggaucacgucauuacauc

SEQ ID NO: 364245 - RNA, 19 nt, Homo sapiens
ugaggaaagaaauugauga

SEQ ID NO: 364246 - RNA, 19 nt, Homo sapiens
ggaaauuaccuuguguuuu

SEQ ID NO: 364247 - RNA, 19 nt, Homo sapiens
uggaaauuaccuuguguuu

SEQ ID NO: 364248 - RNA, 19 nt, Homo sapiens
gcgaguugcccagaaauca

SEQ ID NO: 364249 - RNA, 19 nt, Homo sapiens
gggauggcgcugcgaauca

SEQ ID NO: 364250 - RNA, 19 nt, Homo sapiens
gggaagaagaggagguugu

SEQ ID NO: 364251 - RNA, 19 nt, Homo sapiens
gcagagcugacgggaagaa

SEQ ID NO: 364252 - RNA, 19 nt, Homo sapiens
gaaguucguggugcaaauc

SEQ ID NO: 364253 - RNA, 19 nt, Homo sapiens
gggauccuauaauaauucu

SEQ ID NO: 364254 - RNA, 19 nt, Homo sapiens
ggagucaguuaucguacac

SEQ ID NO: 364255 - RNA, 19 nt, Homo sapiens
gagugauccuggagucagu

SEQ ID NO: 364256 - RNA, 19 nt, Homo sapiens
gcauaaaccccucggauca

SEQ ID NO: 364257 - RNA, 19 nt, Homo sapiens
agaagaggagguugugcua

SEQ ID NO: 364258 - RNA, 19 nt, Homo sapiens
aguuuaaguccgucaguua

SEQ ID NO: 364259 - RNA, 19 nt, Homo sapiens
ggaaagagaugagaaggua

SEQ ID NO: 364260 - RNA, 19 nt, Homo sapiens
gagaagaaguugcccagua

SEQ ID NO: 364261 - RNA, 19 nt, Homo sapiens
gaagaaauauggagacaag

SEQ ID NO: 364262 - RNA, 19 nt, Homo sapiens
caaaucaucuuguaacugu

SEQ ID NO: 364263 - RNA, 19 nt, Homo sapiens
ggucaaagacaucauauuu

SEQ ID NO: 364264 - RNA, 19 nt, Homo sapiens
gaaaggcaaggaacacaua

SEQ ID NO: 364265 - RNA, 19 nt, Homo sapiens
gagaaugaauugauguaug

SEQ ID NO: 364266 - RNA, 19 nt, Homo sapiens
gaaugugaggugauaaaua

SEQ ID NO: 364267 - RNA, 19 nt, Homo sapiens
gaugcuaaaggacuuauua

SEQ ID NO: 364268 - RNA, 19 nt, Homo sapiens
gagaugggcuuugcuggaa

SEQ ID NO: 364269 - RNA, 19 nt, Homo sapiens
ugaaagauguauccaaaca

SEQ ID NO: 364270 - RNA, 19 nt, Homo sapiens
guacagggaaguuuaaaug

SEQ ID NO: 364271 - RNA, 19 nt, Homo sapiens
uaaagaaggaguugaaugu

SEQ ID NO: 364272 - RNA, 19 nt, Homo sapiens
gcuagagaaugaauugaug

SEQ ID NO: 364273 - RNA, 19 nt, Homo sapiens
gccaagaccuacuacaugu

SEQ ID NO: 364274 - RNA, 19 nt, Homo sapiens
ggagacaagaggauuauug

SEQ ID NO: 364275 - RNA, 19 nt, Homo sapiens
agaagaaguugcccaguau

SEQ ID NO: 364276 - RNA, 19 nt, Homo sapiens
uaacugugguuucccauuc

SEQ ID NO: 364277 - RNA, 19 nt, Homo sapiens
gcaaggaacacauauaacu

SEQ ID NO: 364278 - RNA, 19 nt, Homo sapiens
gcagugcuaucuaaagaag

SEQ ID NO: 364279 - RNA, 19 nt, Homo sapiens
gagacaagaggauuauuga

SEQ ID NO: 364280 - RNA, 19 nt, Homo sapiens
aguaggagcugaaaucugu

SEQ ID NO: 364281 - RNA, 19 nt, Homo sapiens
aagaaggaguugaauguga

SEQ ID NO: 364282 - RNA, 19 nt, Homo sapiens
gaagguauuucugcuugga

SEQ ID NO: 364283 - RNA, 19 nt, Homo sapiens
ggaauucagaggaugcuaa

SEQ ID NO: 364284 - RNA, 19 nt, Homo sapiens
caaagauucuagaggacaa

SEQ ID NO: 364285 - RNA, 19 nt, Homo sapiens
uaaaucaggguauggauga

SEQ ID NO: 364286 - RNA, 19 nt, Homo sapiens
gaaguugcccaguaugaug

SEQ ID NO: 364287 - RNA, 19 nt, Homo sapiens
gacaguucgugaugcuaua

SEQ ID NO: 364288 - RNA, 19 nt, Homo sapiens
uaaauguguuuguguaugg

SEQ ID NO: 364289 - RNA, 19 nt, Homo sapiens
cagggaaguuuaaaugugu

SEQ ID NO: 364290 - RNA, 19 nt, Homo sapiens
ugcaagaccugacuauuca

SEQ ID NO: 364291 - RNA, 19 nt, Homo sapiens
aaagauguauccaaacaag

SEQ ID NO: 364292 - RNA, 19 nt, Homo sapiens
agaaugaauugauguaugg

SEQ ID NO: 364293 - RNA, 19 nt, Homo sapiens
gaugggcuuugcuggaauu

SEQ ID NO: 364294 - RNA, 19 nt, Homo sapiens
uagaugccaugcuuccuuu

SEQ ID NO: 364295 - RNA, 19 nt, Homo sapiens
caagaccugacuauucaua

SEQ ID NO: 364296 - RNA, 19 nt, Homo sapiens
ggaagguccugcguucaau

SEQ ID NO: 364297 - RNA, 19 nt, Homo sapiens
gaauucagaggaugcuaaa

SEQ ID NO: 364298 - RNA, 19 nt, Homo sapiens
gcaagccauugaccagguu

SEQ ID NO: 364299 - RNA, 19 nt, Homo sapiens
gaaagauguauccaaacaa

SEQ ID NO: 364300 - RNA, 19 nt, Homo sapiens
gacaagaggauuauugaca

SEQ ID NO: 364301 - RNA, 19 nt, Homo sapiens
cauagaagccagugucaug

SEQ ID NO: 364302 - RNA, 19 nt, Homo sapiens
uaaagcaacagcagguauu

SEQ ID NO: 364303 - RNA, 19 nt, Homo sapiens
augaggagcuggaaagaga

SEQ ID NO: 364304 - RNA, 19 nt, Homo sapiens
acagggaaguuuaaaugug

SEQ ID NO: 364305 - RNA, 19 nt, Homo sapiens
aaucagccauucgggauaa

SEQ ID NO: 364306 - RNA, 19 nt, Homo sapiens
gcacugcccaggcuuaaag

SEQ ID NO: 364307 - RNA, 19 nt, Homo sapiens
gugcuuugcugccugguau

SEQ ID NO: 364308 - RNA, 19 nt, Homo sapiens
gcccauuugugaauuuaug

SEQ ID NO: 364309 - RNA, 19 nt, Homo sapiens
uaaauaugcguaccauuag

SEQ ID NO: 364310 - RNA, 19 nt, Homo sapiens
gaagcucagucaaaagauu

SEQ ID NO: 364311 - RNA, 19 nt, Homo sapiens
ccauugaccagguuauaaa

SEQ ID NO: 364312 - RNA, 19 nt, Homo sapiens
uauugacacucccauauca

SEQ ID NO: 364313 - RNA, 19 nt, Homo sapiens
gcacugcaccuggauuugu

SEQ ID NO: 364314 - RNA, 19 nt, Homo sapiens
ccacaaggacaaaguaugg

SEQ ID NO: 364315 - RNA, 19 nt, Homo sapiens
gaagguccugcguucaauu

SEQ ID NO: 364316 - RNA, 19 nt, Homo sapiens
aaagagaugagaagguauu

SEQ ID NO: 364317 - RNA, 19 nt, Homo sapiens
cgagggcuguggaagaaau

SEQ ID NO: 364318 - RNA, 19 nt, Homo sapiens
aaauaugcguaccauuaga

SEQ ID NO: 364319 - RNA, 19 nt, Homo sapiens
aggcaaggaacacauauaa

SEQ ID NO: 364320 - RNA, 19 nt, Homo sapiens
cacugcaccuggauuugua

SEQ ID NO: 364321 - RNA, 19 nt, Homo sapiens
gucgagggcuguggaagaa

SEQ ID NO: 364322 - RNA, 19 nt, Homo sapiens
ggaaaagccaaaauagaaa

SEQ ID NO: 364323 - RNA, 19 nt, Homo sapiens
ucaggucaaagacaucaua

SEQ ID NO: 364324 - RNA, 19 nt, Homo sapiens
gaagaaguugcccaguaug

SEQ ID NO: 364325 - RNA, 19 nt, Homo sapiens
caaggaacacauauaacug

SEQ ID NO: 364326 - RNA, 19 nt, Homo sapiens
gauuauugacacucccaua

SEQ ID NO: 364327 - RNA, 19 nt, Homo sapiens
gaaagagaugagaagguau

SEQ ID NO: 364328 - RNA, 19 nt, Homo sapiens
gaagccagugucaugaaga

SEQ ID NO: 364329 - RNA, 19 nt, Homo sapiens
uaucagagaugggcuuugc

SEQ ID NO: 364330 - RNA, 19 nt, Homo sapiens
ugaccagguuauaaacuca

SEQ ID NO: 364331 - RNA, 19 nt, Homo sapiens
gccauugaccagguuauaa

SEQ ID NO: 364332 - RNA, 19 nt, Homo sapiens
uauggagacaagaggauua

SEQ ID NO: 364333 - RNA, 19 nt, Homo sapiens
cugcaagaccugacuauuc

SEQ ID NO: 364334 - RNA, 19 nt, Homo sapiens
ggugcuagagaaugaauug

SEQ ID NO: 364335 - RNA, 19 nt, Homo sapiens
ucaccacaaggacaaagua

SEQ ID NO: 364336 - RNA, 19 nt, Homo sapiens
aguuuggacuugaauauca

SEQ ID NO: 364337 - RNA, 19 nt, Homo sapiens
cuaaagaaggaguugaaug

SEQ ID NO: 364338 - RNA, 19 nt, Homo sapiens
cuuauuaaaucagccauuc

SEQ ID NO: 364339 - RNA, 19 nt, Homo sapiens
gggcuuugcuggaauugcu

SEQ ID NO: 364340 - RNA, 19 nt, Homo sapiens
caagaggauuauugacacu

SEQ ID NO: 364341 - RNA, 19 nt, Homo sapiens
gauggggcauacaagguua

SEQ ID NO: 364342 - RNA, 19 nt, Homo sapiens
cggcccauuugugaauuua

SEQ ID NO: 364343 - RNA, 19 nt, Homo sapiens
uauccucucucaccacaag

SEQ ID NO: 364344 - RNA, 19 nt, Homo sapiens
ugccauguucuuugaauaa

SEQ ID NO: 364345 - RNA, 19 nt, Homo sapiens
gauaaauaugcguaccauu

SEQ ID NO: 364346 - RNA, 19 nt, Homo sapiens
ggaagaaauauggagacaa

SEQ ID NO: 364347 - RNA, 19 nt, Homo sapiens
gaaaucugugccaggauca

SEQ ID NO: 364348 - RNA, 19 nt, Homo sapiens
ugacaguucgugaugcuau

SEQ ID NO: 364349 - RNA, 19 nt, Homo sapiens
agaggaugcuaaaggacuu

SEQ ID NO: 364350 - RNA, 19 nt, Homo sapiens
gguggucagucccuggaau

SEQ ID NO: 364351 - RNA, 19 nt, Homo sapiens
cgguugccauguucuuuga

SEQ ID NO: 364352 - RNA, 19 nt, Homo sapiens
aaagcaacagcagguauuu

SEQ ID NO: 364353 - RNA, 19 nt, Homo sapiens
guacugcaagaccugacua

SEQ ID NO: 364354 - RNA, 19 nt, Homo sapiens
gagggcuguggaagaaaua

SEQ ID NO: 364355 - RNA, 19 nt, Homo sapiens
ugauaaauaugcguaccau

SEQ ID NO: 364356 - RNA, 19 nt, Homo sapiens
aagaaguugcccaguauga

SEQ ID NO: 364357 - RNA, 19 nt, Homo sapiens
gaggaugcuaaaggacuua

SEQ ID NO: 364358 - RNA, 19 nt, Homo sapiens
guugccauguucuuugaau

SEQ ID NO: 364359 - RNA, 19 nt, Homo sapiens
gaaaagaccucauuuaugu

SEQ ID NO: 364360 - RNA, 19 nt, Homo sapiens
guacaaagcugguauaucc

SEQ ID NO: 364361 - RNA, 19 nt, Homo sapiens
ccaaagacaugacgacguu

SEQ ID NO: 364362 - RNA, 19 nt, Homo sapiens
ggaaguccaucucaucgaa

SEQ ID NO: 364363 - RNA, 19 nt, Homo sapiens
gaaagacucccaguguaua

SEQ ID NO: 364364 - RNA, 19 nt, Homo sapiens
gcaguuaucuacauuaagg

SEQ ID NO: 364365 - RNA, 19 nt, Homo sapiens
ucaacagacucaauagaaa

SEQ ID NO: 364366 - RNA, 19 nt, Homo sapiens
caauacaagugguuuaugu

SEQ ID NO: 364367 - RNA, 19 nt, Homo sapiens
uagaaagacucccagugua

SEQ ID NO: 364368 - RNA, 19 nt, Homo sapiens
ucagcacucuuuauuguuu

SEQ ID NO: 364369 - RNA, 19 nt, Homo sapiens
gcaccaagaccucguguug

SEQ ID NO: 364370 - RNA, 19 nt, Homo sapiens
aaacugcaauguacuugaa

SEQ ID NO: 364371 - RNA, 19 nt, Homo sapiens
ggaacaccaugccaacaga

SEQ ID NO: 364372 - RNA, 19 nt, Homo sapiens
gaucagaaaccgacacaau

SEQ ID NO: 364373 - RNA, 19 nt, Homo sapiens
uucaggagcuucuugauuu

SEQ ID NO: 364374 - RNA, 19 nt, Homo sapiens
gaagguaugguguucagaa

SEQ ID NO: 364375 - RNA, 19 nt, Homo sapiens
aaggagaccugaagcugua

SEQ ID NO: 364376 - RNA, 19 nt, Homo sapiens
uaagucuccuuccagauaa

SEQ ID NO: 364377 - RNA, 19 nt, Homo sapiens
guauucaacugcaccaaga

SEQ ID NO: 364378 - RNA, 19 nt, Homo sapiens
ggagguggcguuccuuuga

SEQ ID NO: 364379 - RNA, 19 nt, Homo sapiens
gcaaugagagccacuaugg

SEQ ID NO: 364380 - RNA, 19 nt, Homo sapiens
gaacuugaagaacuaaaug

SEQ ID NO: 364381 - RNA, 19 nt, Homo sapiens
aaucagcacucuuuauugu

SEQ ID NO: 364382 - RNA, 19 nt, Homo sapiens
gcagagaacccaaagacau

SEQ ID NO: 364383 - RNA, 19 nt, Homo sapiens
uauuaacucucccgaacua

SEQ ID NO: 364384 - RNA, 19 nt, Homo sapiens
cacuuuaccuggcuaauug

SEQ ID NO: 364385 - RNA, 19 nt, Homo sapiens
ucaaucagcacucuuuauu

SEQ ID NO: 364386 - RNA, 19 nt, Homo sapiens
gccagaauguucaguacuu

SEQ ID NO: 364387 - RNA, 19 nt, Homo sapiens
ccaaguacuuuauuuaucg

SEQ ID NO: 364388 - RNA, 19 nt, Homo sapiens
guaaugaggauuugacugu

SEQ ID NO: 364389 - RNA, 19 nt, Homo sapiens
cuacaugagucgcauuuca

SEQ ID NO: 364390 - RNA, 19 nt, Homo sapiens
ggauuugacugugaagaug

SEQ ID NO: 364391 - RNA, 19 nt, Homo sapiens
gcauaaauccaaacugcaa

SEQ ID NO: 364392 - RNA, 19 nt, Homo sapiens
caaaggaaguccaucucau

SEQ ID NO: 364393 - RNA, 19 nt, Homo sapiens
gaagcuguauucccuagag

SEQ ID NO: 364394 - RNA, 19 nt, Homo sapiens
gcaaaggaaguccaucuca

SEQ ID NO: 364395 - RNA, 19 nt, Homo sapiens
cgaacuagaacuugaagaa

SEQ ID NO: 364396 - RNA, 19 nt, Homo sapiens
ucagaaaccgacacaauga

SEQ ID NO: 364397 - RNA, 19 nt, Homo sapiens
ccagaauguucaguacuuu

SEQ ID NO: 364398 - RNA, 19 nt, Homo sapiens
ggacaaaagugcugaggau

SEQ ID NO: 364399 - RNA, 19 nt, Homo sapiens
gaucagugaaugcuuguga

SEQ ID NO: 364400 - RNA, 19 nt, Homo sapiens
ggacuucggaucagugaau

SEQ ID NO: 364401 - RNA, 19 nt, Homo sapiens
ggacaccauccguucaauu

SEQ ID NO: 364402 - RNA, 19 nt, Homo sapiens
auaagucuccuuccagaua

SEQ ID NO: 364403 - RNA, 19 nt, Homo sapiens
aaacacauuggaagcauaa

SEQ ID NO: 364404 - RNA, 19 nt, Homo sapiens
gacaccauccguucaauug

SEQ ID NO: 364405 - RNA, 19 nt, Homo sapiens
acuagaacuugaagaacua

SEQ ID NO: 364406 - RNA, 19 nt, Homo sapiens
augagucgcauuucaauua

SEQ ID NO: 364407 - RNA, 19 nt, Homo sapiens
cccagggugugauugaaua

SEQ ID NO: 364408 - RNA, 19 nt, Homo sapiens
agaaauaagucuccuucca

SEQ ID NO: 364409 - RNA, 19 nt, Homo sapiens
aaagcugccuggaagcauu

SEQ ID NO: 364410 - RNA, 19 nt, Homo sapiens
ucuaucacaugguguuuga

SEQ ID NO: 364411 - RNA, 19 nt, Homo sapiens
ugaggaugcuaaagcuauu

SEQ ID NO: 364412 - RNA, 19 nt, Homo sapiens
gaaagaaauaagucuccuu

SEQ ID NO: 364413 - RNA, 19 nt, Homo sapiens
gucaacagacucaauagaa

SEQ ID NO: 364414 - RNA, 19 nt, Homo sapiens
cgggaaaccuggcguacug

SEQ ID NO: 364415 - RNA, 19 nt, Homo sapiens
uuggaucgauucuacauga

SEQ ID NO: 364416 - RNA, 19 nt, Homo sapiens
ugaagcaguuccuggacuu

SEQ ID NO: 364417 - RNA, 19 nt, Homo sapiens
gaaaccgacacaaugaugu

SEQ ID NO: 364418 - RNA, 19 nt, Homo sapiens
ucaacuacauguauucaac

SEQ ID NO: 364419 - RNA, 19 nt, Homo sapiens
cacaugguguuugaacuuu

SEQ ID NO: 364420 - RNA, 19 nt, Homo sapiens
caacagacucaauagaaag

SEQ ID NO: 364421 - RNA, 19 nt, Homo sapiens
aauccaaacugcaauguac

SEQ ID NO: 364422 - RNA, 19 nt, Homo sapiens
agaaagacucccaguguau

SEQ ID NO: 364423 - RNA, 19 nt, Homo sapiens
gaugcaguuaucuacauua

SEQ ID NO: 364424 - RNA, 19 nt, Homo sapiens
cagagaacccaaagacaug

SEQ ID NO: 364425 - RNA, 19 nt, Homo sapiens
aaugaggauuugacuguga

SEQ ID NO: 364426 - RNA, 19 nt, Homo sapiens
aaugagagccacuauggaa

SEQ ID NO: 364427 - RNA, 19 nt, Homo sapiens
uuucaagaaugcaaugaga

SEQ ID NO: 364428 - RNA, 19 nt, Homo sapiens
ccacuuuaccuggcuaauu

SEQ ID NO: 364429 - RNA, 19 nt, Homo sapiens
aaagacucccaguguauaa

SEQ ID NO: 364430 - RNA, 19 nt, Homo sapiens
cauuaaggcucugucaaca

SEQ ID NO: 364431 - RNA, 19 nt, Homo sapiens
uaacucucccgaacuagaa

SEQ ID NO: 364432 - RNA, 19 nt, Homo sapiens
cuaggcgucugugugauuu

SEQ ID NO: 364433 - RNA, 19 nt, Homo sapiens
gcuaggcgucugugugauu

SEQ ID NO: 364434 - RNA, 19 nt, Homo sapiens
gaaguccaucucaucgaaa

SEQ ID NO: 364435 - RNA, 19 nt, Homo sapiens
cgggacagaugcaguuauc

SEQ ID NO: 364436 - RNA, 19 nt, Homo sapiens
ucacaugguguuugaacuu

SEQ ID NO: 364437 - RNA, 19 nt, Homo sapiens
gaacuagaacuugaagaac

SEQ ID NO: 364438 - RNA, 19 nt, Homo sapiens
gaauacaaggagagcuuug

SEQ ID NO: 364439 - RNA, 19 nt, Homo sapiens
ugucagacuggcaaauaua

SEQ ID NO: 364440 - RNA, 19 nt, Homo sapiens
uuaccuggcuaauugaagu

SEQ ID NO: 364441 - RNA, 19 nt, Homo sapiens
gcccauaucacgucuuuac

SEQ ID NO: 364442 - RNA, 19 nt, Homo sapiens
caucccaucucuaucacau

SEQ ID NO: 364443 - RNA, 19 nt, Homo sapiens
caaacugcaauguacuuga

SEQ ID NO: 364444 - RNA, 19 nt, Homo sapiens
ugagucgcauuucaauuag

SEQ ID NO: 364445 - RNA, 19 nt, Homo sapiens
auagaaagacucccagugu

SEQ ID NO: 364446 - RNA, 19 nt, Homo sapiens
aaagauggcuaugaaaaug

SEQ ID NO: 364447 - RNA, 19 nt, Homo sapiens
gaaaacacauuggaagcau

SEQ ID NO: 364448 - RNA, 19 nt, Homo sapiens
agucgcauuucaauuagaa

SEQ ID NO: 364449 - RNA, 19 nt, Homo sapiens
ggaagcauuacaacaccaa

SEQ ID NO: 364450 - RNA, 19 nt, Homo sapiens
gugaaaagaccucauuuau

SEQ ID NO: 364451 - RNA, 19 nt, Homo sapiens
gucagacuggcaaauauaa

SEQ ID NO: 364452 - RNA, 19 nt, Homo sapiens
gaggaaaauugacagacuu

SEQ ID NO: 364453 - RNA, 19 nt, Homo sapiens
gauuugacugugaagauga

SEQ ID NO: 364454 - RNA, 19 nt, Homo sapiens
gcgucugugugauuuguau

SEQ ID NO: 364455 - RNA, 19 nt, Homo sapiens
cagugccucuggcugguuu

SEQ ID NO: 364456 - RNA, 19 nt, Homo sapiens
gagguggcguuccuuugag

SEQ ID NO: 364457 - RNA, 19 nt, Homo sapiens
cuggcuaauugaaguguaa

SEQ ID NO: 364458 - RNA, 19 nt, Homo sapiens
cagacuggcaaauauaaug

SEQ ID NO: 364459 - RNA, 19 nt, Homo sapiens
gaagaucuguccaucaaga

SEQ ID NO: 364460 - RNA, 19 nt, Homo sapiens
ucacagggcccaacucuaa

SEQ ID NO: 364461 - RNA, 19 nt, Homo sapiens
uggcuaagcuccuguguga

SEQ ID NO: 364462 - RNA, 19 nt, Homo sapiens
guaaagaggagacugaaug

SEQ ID NO: 364463 - RNA, 19 nt, Homo sapiens
ccuaggaccuucuguguau

SEQ ID NO: 364464 - RNA, 19 nt, Homo sapiens
gcaguggccuuggcaaugu

SEQ ID NO: 364465 - RNA, 19 nt, Homo sapiens
ucucugagguggucaaaga

SEQ ID NO: 364466 - RNA, 19 nt, Homo sapiens
ggucugugauggucccuaa

SEQ ID NO: 364467 - RNA, 19 nt, Homo sapiens
gcccaacucuaaaguggaa

SEQ ID NO: 364468 - RNA, 19 nt, Homo sapiens
caaagaugccuacgacaug

SEQ ID NO: 364469 - RNA, 19 nt, Homo sapiens
gaccagggcugucacuuuu

SEQ ID NO: 364470 - RNA, 19 nt, Homo sapiens
gggcgaugccugaggguua

SEQ ID NO: 364471 - RNA, 19 nt, Homo sapiens
aggaagaucuguccaucaa

SEQ ID NO: 364472 - RNA, 19 nt, Homo sapiens
caacccagcccaucccaaa

SEQ ID NO: 364473 - RNA, 19 nt, Homo sapiens
cagcaaugccugugagaaa

SEQ ID NO: 364474 - RNA, 19 nt, Homo sapiens
uaaagaggagacugaauga

SEQ ID NO: 364475 - RNA, 19 nt, Homo sapiens
gcacggagcccaagaacac

SEQ ID NO: 364476 - RNA, 19 nt, Homo sapiens
gaugucccguugccuuauu

SEQ ID NO: 364477 - RNA, 19 nt, Homo sapiens
ccaaacagccgauucacau

SEQ ID NO: 364478 - RNA, 19 nt, Homo sapiens
aagaggagacugaaugaaa

SEQ ID NO: 364479 - RNA, 19 nt, Homo sapiens
gaccuucuguguauauagu

SEQ ID NO: 364480 - RNA, 19 nt, Homo sapiens
gguggguucucccugauga

SEQ ID NO: 364481 - RNA, 19 nt, Homo sapiens
gcuccugugugacaaguau

SEQ ID NO: 364482 - RNA, 19 nt, Homo sapiens
ugaagcaguuucuggacuu

SEQ ID NO: 364483 - RNA, 19 nt, Homo sapiens
ccacguaccgcgucagcua

SEQ ID NO: 364484 - RNA, 19 nt, Homo sapiens
ugugggcgcugcugaagaa

SEQ ID NO: 364485 - RNA, 19 nt, Homo sapiens
cagcacacccucaucuuug

SEQ ID NO: 364486 - RNA, 19 nt, Homo sapiens
gcuaagcuccugugugaca

SEQ ID NO: 364487 - RNA, 19 nt, Homo sapiens
uggccaacaucaugaaaga

SEQ ID NO: 364488 - RNA, 19 nt, Homo sapiens
uggcaguccuccucucuga

SEQ ID NO: 364489 - RNA, 19 nt, Homo sapiens
ccagcacacccucaucuuu

SEQ ID NO: 364490 - RNA, 19 nt, Homo sapiens
ggacuucggauccagcaau

SEQ ID NO: 364491 - RNA, 19 nt, Homo sapiens
caaugcagccaacuccaaa

SEQ ID NO: 364492 - RNA, 19 nt, Homo sapiens
ccaaccagaacauccagua

SEQ ID NO: 364493 - RNA, 19 nt, Homo sapiens
gccaacaucaugaaagaga

SEQ ID NO: 364494 - RNA, 19 nt, Homo sapiens
gaaagagaucaaccugcuu

SEQ ID NO: 364495 - RNA, 19 nt, Homo sapiens
ucauggaguuccuggacaa

SEQ ID NO: 364496 - RNA, 19 nt, Homo sapiens
uaaaguggaagaaccuugu

SEQ ID NO: 364497 - RNA, 19 nt, Homo sapiens
gaccagguucugucucuau

SEQ ID NO: 364498 - RNA, 19 nt, Homo sapiens
ucaaagaugccuacgacau

SEQ ID NO: 364499 - RNA, 19 nt, Homo sapiens
ccuucuguguauauaguua

SEQ ID NO: 364500 - RNA, 19 nt, Homo sapiens
agaccagggcugucacuuu

SEQ ID NO: 364501 - RNA, 19 nt, Homo sapiens
acauagagcacuucagcaa

SEQ ID NO: 364502 - RNA, 19 nt, Homo sapiens
gaggaagaucuguccauca

SEQ ID NO: 364503 - RNA, 19 nt, Homo sapiens
gggcgcugcugaagaaugc

SEQ ID NO: 364504 - RNA, 19 nt, Homo sapiens
ucuaccacaugcucuuuga

SEQ ID NO: 364505 - RNA, 19 nt, Homo sapiens
ccaacaucaugaaagagau

SEQ ID NO: 364506 - RNA, 19 nt, Homo sapiens
ccaaacacaucggcagcau

SEQ ID NO: 364507 - RNA, 19 nt, Homo sapiens
agaggagacugaaugaaaa

SEQ ID NO: 364508 - RNA, 19 nt, Homo sapiens
gacuucggauccagcaaug

SEQ ID NO: 364509 - RNA, 19 nt, Homo sapiens
gcugaaguguuaggaagag

SEQ ID NO: 364510 - RNA, 19 nt, Homo sapiens
ggaugucuccacccugaug

SEQ ID NO: 364511 - RNA, 19 nt, Homo sapiens
cagcacaggccuuccaagu

SEQ ID NO: 364512 - RNA, 19 nt, Homo sapiens
gauccagcaaugccuguga

SEQ ID NO: 364513 - RNA, 19 nt, Homo sapiens
gcgccugccugucuacaac

SEQ ID NO: 364514 - RNA, 19 nt, Homo sapiens
ggccuugggugaggaagau

SEQ ID NO: 364515 - RNA, 19 nt, Homo sapiens
caaacagccgauucacaug

SEQ ID NO: 364516 - RNA, 19 nt, Homo sapiens
cuaggaccuucuguguaua

SEQ ID NO: 364517 - RNA, 19 nt, Homo sapiens
accagaacauccaguacuu

SEQ ID NO: 364518 - RNA, 19 nt, Homo sapiens
guggaagaaccuuguuaga

SEQ ID NO: 364519 - RNA, 19 nt, Homo sapiens
uggaugucccguugccuua

SEQ ID NO: 364520 - RNA, 19 nt, Homo sapiens
agggagaccugcagcucuu

SEQ ID NO: 364521 - RNA, 19 nt, Homo sapiens
acacccacacccacaguaa

SEQ ID NO: 364522 - RNA, 19 nt, Homo sapiens
gcgccuggccaacaucaug

SEQ ID NO: 364523 - RNA, 19 nt, Homo sapiens
uugagcgacucuucagcua

SEQ ID NO: 364524 - RNA, 19 nt, Homo sapiens
caacaucaugaaagagauc

SEQ ID NO: 364525 - RNA, 19 nt, Homo sapiens
caugagggcgacuguggaa

SEQ ID NO: 364526 - RNA, 19 nt, Homo sapiens
ucaaugcagccaacuccaa

SEQ ID NO: 364527 - RNA, 19 nt, Homo sapiens
cagguucugucucuaugca

SEQ ID NO: 364528 - RNA, 19 nt, Homo sapiens
gcagcucuucuccauggaa

SEQ ID NO: 364529 - RNA, 19 nt, Homo sapiens
ccaacugcaacgucucuga

SEQ ID NO: 364530 - RNA, 19 nt, Homo sapiens
aaggcgugcuugaguacaa

SEQ ID NO: 364531 - RNA, 19 nt, Homo sapiens
agcacacccucaucuuuga

SEQ ID NO: 364532 - RNA, 19 nt, Homo sapiens
ccacugugcccagacaugu

SEQ ID NO: 364533 - RNA, 19 nt, Homo sapiens
ugaccagguucugucucua

SEQ ID NO: 364534 - RNA, 19 nt, Homo sapiens
ggcgaugccugaggguuag

SEQ ID NO: 364535 - RNA, 19 nt, Homo sapiens
cgauucacauggucuacgu

SEQ ID NO: 364536 - RNA, 19 nt, Homo sapiens
uggagcgccugccugucua

SEQ ID NO: 364537 - RNA, 19 nt, Homo sapiens
gcacacccucaucuuugau

SEQ ID NO: 364538 - RNA, 19 nt, Homo sapiens
gcacuaacauccaauauuu

SEQ ID NO: 364539 - RNA, 19 nt, Homo sapiens
caacaugggugaaucuuga

SEQ ID NO: 364540 - RNA, 19 nt, Homo sapiens
guacugaugcugucauuua

SEQ ID NO: 364541 - RNA, 19 nt, Homo sapiens
ggugaaagaugcauaugaa

SEQ ID NO: 364542 - RNA, 19 nt, Homo sapiens
gguuaugguuugccaauuu

SEQ ID NO: 364543 - RNA, 19 nt, Homo sapiens
gaaauagacacaaugaugu

SEQ ID NO: 364544 - RNA, 19 nt, Homo sapiens
gggcuacccugcuguuaaa

SEQ ID NO: 364545 - RNA, 19 nt, Homo sapiens
cacaaggagugauugaaua

SEQ ID NO: 364546 - RNA, 19 nt, Homo sapiens
ccucacaucuguuucauau

SEQ ID NO: 364547 - RNA, 19 nt, Homo sapiens
gaaagaugcauaugaaaca

SEQ ID NO: 364548 - RNA, 19 nt, Homo sapiens
caauuaaguuugcaguuug

SEQ ID NO: 364549 - RNA, 19 nt, Homo sapiens
aaggagaucugaaacugua

SEQ ID NO: 364550 - RNA, 19 nt, Homo sapiens
gcuggaaguugaagaauuc

SEQ ID NO: 364551 - RNA, 19 nt, Homo sapiens
ggagagauaaugcauguga

SEQ ID NO: 364552 - RNA, 19 nt, Homo sapiens
guugguauaugcagaguuu

SEQ ID NO: 364553 - RNA, 19 nt, Homo sapiens
cauaaacguuguagguuga

SEQ ID NO: 364554 - RNA, 19 nt, Homo sapiens
ggucuuggauaacuuucua

SEQ ID NO: 364555 - RNA, 19 nt, Homo sapiens
gcacaaggagugauugaau

SEQ ID NO: 364556 - RNA, 19 nt, Homo sapiens
aaaggaaggacaucugaua

SEQ ID NO: 364557 - RNA, 19 nt, Homo sapiens
cugaugcugucauuuauuu

SEQ ID NO: 364558 - RNA, 19 nt, Homo sapiens
ucacaucuguuucauaugc

SEQ ID NO: 364559 - RNA, 19 nt, Homo sapiens
guucagaguugguauaugc

SEQ ID NO: 364560 - RNA, 19 nt, Homo sapiens
caggaauucuugcagugua

SEQ ID NO: 364561 - RNA, 19 nt, Homo sapiens
cguuguagguugaaacuga

SEQ ID NO: 364562 - RNA, 19 nt, Homo sapiens
ucaaggagaucugaaacug

SEQ ID NO: 364563 - RNA, 19 nt, Homo sapiens
uaagaucagugaccuaggu

SEQ ID NO: 364564 - RNA, 19 nt, Homo sapiens
agaaauagacacaaugaug

SEQ ID NO: 364565 - RNA, 19 nt, Homo sapiens
uuaaaacccucguuacuuu

SEQ ID NO: 364566 - RNA, 19 nt, Homo sapiens
cuaauccuguucauccuaa

SEQ ID NO: 364567 - RNA, 19 nt, Homo sapiens
ucaaugagagcgacaguug

SEQ ID NO: 364568 - RNA, 19 nt, Homo sapiens
guaucgaucccaccuguaa

SEQ ID NO: 364569 - RNA, 19 nt, Homo sapiens
ccacaggucuuggauaacu

SEQ ID NO: 364570 - RNA, 19 nt, Homo sapiens
ucaaacaauuccuggacuu

SEQ ID NO: 364571 - RNA, 19 nt, Homo sapiens
uuaaucuucugccggauaa

SEQ ID NO: 364572 - RNA, 19 nt, Homo sapiens
ggugaucuauccauccaau

SEQ ID NO: 364573 - RNA, 19 nt, Homo sapiens
guagagguauucacaacag

SEQ ID NO: 364574 - RNA, 19 nt, Homo sapiens
ugaacucuaugaagacaga

SEQ ID NO: 364575 - RNA, 19 nt, Homo sapiens
guaauauaccaccuugauu

SEQ ID NO: 364576 - RNA, 19 nt, Homo sapiens
cuauucaggugguuuaugu

SEQ ID NO: 364577 - RNA, 19 nt, Homo sapiens
uggcggauguggugaaaga

SEQ ID NO: 364578 - RNA, 19 nt, Homo sapiens
ucagaaauagacacaauga

SEQ ID NO: 364579 - RNA, 19 nt, Homo sapiens
ggugaaucuugaagucauu

SEQ ID NO: 364580 - RNA, 19 nt, Homo sapiens
caacagcaagcagggauuu

SEQ ID NO: 364581 - RNA, 19 nt, Homo sapiens
cgggagagauaaugcaugu

SEQ ID NO: 364582 - RNA, 19 nt, Homo sapiens
ggagcaaucccagcaguga

SEQ ID NO: 364583 - RNA, 19 nt, Homo sapiens
gaugcugucauuuauuuga

SEQ ID NO: 364584 - RNA, 19 nt, Homo sapiens
guaaagaagacuuauccau

SEQ ID NO: 364585 - RNA, 19 nt, Homo sapiens
ccaagaugcugugugaaca

SEQ ID NO: 364586 - RNA, 19 nt, Homo sapiens
ugauuugucugaauaaagg

SEQ ID NO: 364587 - RNA, 19 nt, Homo sapiens
gaaggaguggguacugaug

SEQ ID NO: 364588 - RNA, 19 nt, Homo sapiens
cuaaacacauaggaaguau

SEQ ID NO: 364589 - RNA, 19 nt, Homo sapiens
gauaaugcaugugagaaaa

SEQ ID NO: 364590 - RNA, 19 nt, Homo sapiens
gaagucauuaugcuaagug

SEQ ID NO: 364591 - RNA, 19 nt, Homo sapiens
ggagaaguuuggguuugau

SEQ ID NO: 364592 - RNA, 19 nt, Homo sapiens
uuggauaacuuucuacaag

SEQ ID NO: 364593 - RNA, 19 nt, Homo sapiens
gucauuaugcuaagugaaa

SEQ ID NO: 364594 - RNA, 19 nt, Homo sapiens
caucugauaugugcugcaa

SEQ ID NO: 364595 - RNA, 19 nt, Homo sapiens
uuugagagacuuccaguuu

SEQ ID NO: 364596 - RNA, 19 nt, Homo sapiens
gcggcuggcuaacacaaug

SEQ ID NO: 364597 - RNA, 19 nt, Homo sapiens
gguuugauccuuucauuag

SEQ ID NO: 364598 - RNA, 19 nt, Homo sapiens
caaggagaaguuuggguuu

SEQ ID NO: 364599 - RNA, 19 nt, Homo sapiens
aaggagugauugaauacaa

SEQ ID NO: 364600 - RNA, 19 nt, Homo sapiens
gcaacaugggugaaucuug

SEQ ID NO: 364601 - RNA, 19 nt, Homo sapiens
ggacuucgggagagauaau

SEQ ID NO: 364602 - RNA, 19 nt, Homo sapiens
ggagaucugaaacuguauu

SEQ ID NO: 364603 - RNA, 19 nt, Homo sapiens
guuaugguuugccaauuuc

SEQ ID NO: 364604 - RNA, 19 nt, Homo sapiens
gaauacaaggagaaguuug

SEQ ID NO: 364605 - RNA, 19 nt, Homo sapiens
agucagaaauagacacaau

SEQ ID NO: 364606 - RNA, 19 nt, Homo sapiens
ggguuugauccuuucauua

SEQ ID NO: 364607 - RNA, 19 nt, Homo sapiens
ucagugggauugguucaga

SEQ ID NO: 364608 - RNA, 19 nt, Homo sapiens
gugaaauaaaccagacaua

SEQ ID NO: 364609 - RNA, 19 nt, Homo sapiens
ucugauaugugcugcaaca

SEQ ID NO: 364610 - RNA, 19 nt, Homo sapiens
ggguacugaugcugucauu

SEQ ID NO: 364611 - RNA, 19 nt, Homo sapiens
gaucugaaacuguauucca

SEQ ID NO: 364612 - RNA, 19 nt, Homo sapiens
ugccaaagcgccagacaaa

SEQ ID NO: 364613 - RNA, 19 nt, Homo sapiens
guuaaucuucugccggaua

SEQ ID NO: 364614 - RNA, 19 nt, Homo sapiens
caaguucugauuaaaguca

SEQ ID NO: 364615 - RNA, 19 nt, Homo sapiens
gggugaaucuugaagucau

SEQ ID NO: 364616 - RNA, 19 nt, Homo sapiens
ccaccuugauuuccauuac

SEQ ID NO: 364617 - RNA, 19 nt, Homo sapiens
ccagggaugcuucaaaaua

SEQ ID NO: 364618 - RNA, 19 nt, Homo sapiens
cagcacacacuucuguuug

SEQ ID NO: 364619 - RNA, 19 nt, Homo sapiens
gagauaaugcaugugagaa

SEQ ID NO: 364620 - RNA, 19 nt, Homo sapiens
ugggauugguucagaguug

SEQ ID NO: 364621 - RNA, 19 nt, Homo sapiens
uaacacaaugagagaaguu

SEQ ID NO: 364622 - RNA, 19 nt, Homo sapiens
guuguagguugaaacugaa

SEQ ID NO: 364623 - RNA, 19 nt, Homo sapiens
ggaaggaguggguacugau

SEQ ID NO: 364624 - RNA, 19 nt, Homo sapiens
gccaauuucccgucuguau

SEQ ID NO: 364625 - RNA, 19 nt, Homo sapiens
uggauuugguuaugguuug

SEQ ID NO: 364626 - RNA, 19 nt, Homo sapiens
ugaugugguuccuacaaug

SEQ ID NO: 364627 - RNA, 19 nt, Homo sapiens
gcaaaacaguaauauacca

SEQ ID NO: 364628 - RNA, 19 nt, Homo sapiens
cgucgccgcucuccaucaa

SEQ ID NO: 364629 - RNA, 19 nt, Homo sapiens
auaccaaccgcaucucuuu

SEQ ID NO: 364630 - RNA, 19 nt, Homo sapiens
gauccuuucauuagcacua

SEQ ID NO: 364631 - RNA, 19 nt, Homo sapiens
uggguuugauccuuucauu

SEQ ID NO: 364632 - RNA, 19 nt, Homo sapiens
aaggagaaguuuggguuug

SEQ ID NO: 364633 - RNA, 19 nt, Homo sapiens
uaccagagcugccccuuug

SEQ ID NO: 364634 - RNA, 19 nt, Homo sapiens
cauaugcuauuugaguugu

SEQ ID NO: 364635 - RNA, 19 nt, Homo sapiens
ccuguaacguggcggaugu

SEQ ID NO: 364636 - RNA, 19 nt, Homo sapiens
ucuuuccgcaugcuuauua

SEQ ID NO: 364637 - RNA, 19 nt, Homo sapiens
aggagaaguuuggguuuga

SEQ ID NO: 364638 - RNA, 19 nt, Homo sapiens
gaauggagcuuguuucugu

SEQ ID NO: 364639 - RNA, 19 nt, Homo sapiens
aagaagaccuuaccauuaa

SEQ ID NO: 364640 - RNA, 19 nt, Homo sapiens
aaagaagaccuuaccauua

SEQ ID NO: 364641 - RNA, 19 nt, Homo sapiens
gaaauagacaccauaaugu

SEQ ID NO: 364642 - RNA, 19 nt, Homo sapiens
caucaaaguucgaaauaga

SEQ ID NO: 364643 - RNA, 19 nt, Homo sapiens
gguuacggcuugccaauuu

SEQ ID NO: 364644 - RNA, 19 nt, Homo sapiens
aaagaugccuguacaguug

SEQ ID NO: 364645 - RNA, 19 nt, Homo sapiens
cgacaagaauugccuguga

SEQ ID NO: 364646 - RNA, 19 nt, Homo sapiens
gaccgccucuuuaguuaua

SEQ ID NO: 364647 - RNA, 19 nt, Homo sapiens
caacgccugugauggauaa

SEQ ID NO: 364648 - RNA, 19 nt, Homo sapiens
gaagaaauaagccucaguu

SEQ ID NO: 364649 - RNA, 19 nt, Homo sapiens
gaacuugaaucucgaacca

SEQ ID NO: 364650 - RNA, 19 nt, Homo sapiens
guucaaggaugcucuguga

SEQ ID NO: 364651 - RNA, 19 nt, Homo sapiens
gcauugauccuaacuguga

SEQ ID NO: 364652 - RNA, 19 nt, Homo sapiens
cgaaauagacaccauaaug

SEQ ID NO: 364653 - RNA, 19 nt, Homo sapiens
caaagaaccuggcaaaaga

SEQ ID NO: 364654 - RNA, 19 nt, Homo sapiens
gaaccagcacauucuuaua

SEQ ID NO: 364655 - RNA, 19 nt, Homo sapiens
uaacaagucagccuucaaa

SEQ ID NO: 364656 - RNA, 19 nt, Homo sapiens
cacaaggaaucauagagua

SEQ ID NO: 364657 - RNA, 19 nt, Homo sapiens
guauaaagaugccuguaca

SEQ ID NO: 364658 - RNA, 19 nt, Homo sapiens
gaaagggagugagugugaa

SEQ ID NO: 364659 - RNA, 19 nt, Homo sapiens
gaaaaucagccuucccuua

SEQ ID NO: 364660 - RNA, 19 nt, Homo sapiens
gaaaaugcaugugaaagaa

SEQ ID NO: 364661 - RNA, 19 nt, Homo sapiens
caagaugccuuugaguguu

SEQ ID NO: 364662 - RNA, 19 nt, Homo sapiens
ccagcacauucuuauauuu

SEQ ID NO: 364663 - RNA, 19 nt, Homo sapiens
cuacaggaguuaacagaug

SEQ ID NO: 364664 - RNA, 19 nt, Homo sapiens
gaaaacuccuuaaucagaa

SEQ ID NO: 364665 - RNA, 19 nt, Homo sapiens
gccaauuucucgucuguau

SEQ ID NO: 364666 - RNA, 19 nt, Homo sapiens
uuacacaagugaauggaaa

SEQ ID NO: 364667 - RNA, 19 nt, Homo sapiens
uacagagccugauggauuu

SEQ ID NO: 364668 - RNA, 19 nt, Homo sapiens
cauaugcucuuugaacuau

SEQ ID NO: 364669 - RNA, 19 nt, Homo sapiens
uagauacacucaucaaagu

SEQ ID NO: 364670 - RNA, 19 nt, Homo sapiens
guuaaaagcugguauauac

SEQ ID NO: 364671 - RNA, 19 nt, Homo sapiens
cuucaaacauuaucagaug

SEQ ID NO: 364672 - RNA, 19 nt, Homo sapiens
agucagccuucaaacauua

SEQ ID NO: 364673 - RNA, 19 nt, Homo sapiens
cccgagagguggagcauuu

SEQ ID NO: 364674 - RNA, 19 nt, Homo sapiens
caaggaaucauagaguaua

SEQ ID NO: 364675 - RNA, 19 nt, Homo sapiens
auacagagccugauggauu

SEQ ID NO: 364676 - RNA, 19 nt, Homo sapiens
gcacaaggaaucauagagu

SEQ ID NO: 364677 - RNA, 19 nt, Homo sapiens
uaaagaugccuguacaguu

SEQ ID NO: 364678 - RNA, 19 nt, Homo sapiens
ugaagcagcuacuggacuu

SEQ ID NO: 364679 - RNA, 19 nt, Homo sapiens
gugcaagacuacaggaguu

SEQ ID NO: 364680 - RNA, 19 nt, Homo sapiens
gaauuaaagcuuacacaag

SEQ ID NO: 364681 - RNA, 19 nt, Homo sapiens
gagcauuucucgcgcuaca

SEQ ID NO: 364682 - RNA, 19 nt, Homo sapiens
gcuaucaucuacuuaaagg

SEQ ID NO: 364683 - RNA, 19 nt, Homo sapiens
acagauggccagcuccuua

SEQ ID NO: 364684 - RNA, 19 nt, Homo sapiens
caagucagccuucaaacau

SEQ ID NO: 364685 - RNA, 19 nt, Homo sapiens
gaugcucugugaucaguau

SEQ ID NO: 364686 - RNA, 19 nt, Homo sapiens
caaggaugcucugugauca

SEQ ID NO: 364687 - RNA, 19 nt, Homo sapiens
ucuccagaauuaaagcuua

SEQ ID NO: 364688 - RNA, 19 nt, Homo sapiens
ggacacucaggacacuuua

SEQ ID NO: 364689 - RNA, 19 nt, Homo sapiens
cugaaucucuacucuuuau

SEQ ID NO: 364690 - RNA, 19 nt, Homo sapiens
guagauacacucaucaaag

SEQ ID NO: 364691 - RNA, 19 nt, Homo sapiens
ccaacauucugaaggaaau

SEQ ID NO: 364692 - RNA, 19 nt, Homo sapiens
ggacuuugguucagaaaau

SEQ ID NO: 364693 - RNA, 19 nt, Homo sapiens
gaaucucuacucuuuauca

SEQ ID NO: 364694 - RNA, 19 nt, Homo sapiens
caaaagaaguggccaugug

SEQ ID NO: 364695 - RNA, 19 nt, Homo sapiens
ggaaacccaagccacauug

SEQ ID NO: 364696 - RNA, 19 nt, Homo sapiens
cuucucaccuccaucauau

SEQ ID NO: 364697 - RNA, 19 nt, Homo sapiens
gcucugugaucaguauuau

SEQ ID NO: 364698 - RNA, 19 nt, Homo sapiens
cuacucggaugcugaugaa

SEQ ID NO: 364699 - RNA, 19 nt, Homo sapiens
ugauggauuugguggaauu

SEQ ID NO: 364700 - RNA, 19 nt, Homo sapiens
cuccugaguuuauaucaaa

SEQ ID NO: 364701 - RNA, 19 nt, Homo sapiens
gauggccagcuccuuauuu

SEQ ID NO: 364702 - RNA, 19 nt, Homo sapiens
uacaugaaccguauuucua

SEQ ID NO: 364703 - RNA, 19 nt, Homo sapiens
gcugaugacugguguaucc

SEQ ID NO: 364704 - RNA, 19 nt, Homo sapiens
ccaagaugccuuugagugu

SEQ ID NO: 364705 - RNA, 19 nt, Homo sapiens
gguccaagaugccuuugag

SEQ ID NO: 364706 - RNA, 19 nt, Homo sapiens
cagaugaccagaaagcauu

SEQ ID NO: 364707 - RNA, 19 nt, Homo sapiens
aaauaccucuucagugcaa

SEQ ID NO: 364708 - RNA, 19 nt, Homo sapiens
agaaagggagugaguguga

SEQ ID NO: 364709 - RNA, 19 nt, Homo sapiens
gaacccuuguuuccuccaa

SEQ ID NO: 364710 - RNA, 19 nt, Homo sapiens
gaaguggccaugugaagag

SEQ ID NO: 364711 - RNA, 19 nt, Homo sapiens
aagcauugauccuaacugu

SEQ ID NO: 364712 - RNA, 19 nt, Homo sapiens
cagaaagcauuaucagacu

SEQ ID NO: 364713 - RNA, 19 nt, Homo sapiens
gauacacucaucaaaguuc

SEQ ID NO: 364714 - RNA, 19 nt, Homo sapiens
uaagaaagggagugagugu

SEQ ID NO: 364715 - RNA, 19 nt, Homo sapiens
acacugauccaaugaggaa

SEQ ID NO: 364716 - RNA, 19 nt, Homo sapiens
ggaaucauagaguauaaag

SEQ ID NO: 364717 - RNA, 19 nt, Homo sapiens
aagcccagaugaccagaaa

SEQ ID NO: 364718 - RNA, 19 nt, Homo sapiens
gcaagacuacaggaguuaa

SEQ ID NO: 364719 - RNA, 19 nt, Homo sapiens
gaugagcucugaggcugau

SEQ ID NO: 364720 - RNA, 19 nt, Homo sapiens
uugaccgccucuuuaguua

SEQ ID NO: 364721 - RNA, 19 nt, Homo sapiens
caauauuucuuggaucgau

SEQ ID NO: 364722 - RNA, 19 nt, Homo sapiens
ccugaauguuuguguguga

SEQ ID NO: 364723 - RNA, 19 nt, Homo sapiens
gguguuccccugagaauua

SEQ ID NO: 364724 - RNA, 19 nt, Homo sapiens
cauuaagauuucagacaga

SEQ ID NO: 364725 - RNA, 19 nt, Homo sapiens
gauggugguuagcaguuuc

SEQ ID NO: 364726 - RNA, 19 nt, Homo sapiens
gggagugagugugaagaug

SEQ ID NO: 364727 - RNA, 19 nt, Homo sapiens
gggacacucaggacacuuu

SEQ ID NO: 364728 - RNA, 19 nt, Homo sapiens
gauauggaacagaugcuau

SEQ ID NO: 364729 - RNA, 19 nt, Homo sapiens
ggauauggaacagaugcua

SEQ ID NO: 364730 - RNA, 19 nt, Homo sapiens
gaucugaaucucuacucuu

SEQ ID NO: 364731 - RNA, 19 nt, Homo sapiens
uaacugugaugugguagca

SEQ ID NO: 364732 - RNA, 19 nt, Homo sapiens
gcugcuuccugaauguuug

SEQ ID NO: 364733 - RNA, 19 nt, Homo sapiens
caucauaugcucuuugaac

SEQ ID NO: 364734 - RNA, 19 nt, Homo sapiens
uccaucauaugcucuuuga

SEQ ID NO: 364735 - RNA, 19 nt, Homo sapiens
uuggaagcauugauccuaa

SEQ ID NO: 364736 - RNA, 19 nt, Homo sapiens
agaaagcauuaucagacuu

SEQ ID NO: 364737 - RNA, 19 nt, Homo sapiens
ccugauggauuugguggaa

SEQ ID NO: 364738 - RNA, 19 nt, Homo sapiens
gaucagauguggaaauuaa

SEQ ID NO: 364739 - RNA, 19 nt, Homo sapiens
caagaagacugauauguuu

SEQ ID NO: 364740 - RNA, 19 nt, Homo sapiens
cuaacaagcuguaaagaua

SEQ ID NO: 364741 - RNA, 19 nt, Homo sapiens
gaaaggaaauauuguggaa

SEQ ID NO: 364742 - RNA, 19 nt, Homo sapiens
gaacauauauggacuugca

SEQ ID NO: 364743 - RNA, 19 nt, Homo sapiens
gagggacgaucuuugaaua

SEQ ID NO: 364744 - RNA, 19 nt, Homo sapiens
gaauugagcccuugacauu

SEQ ID NO: 364745 - RNA, 19 nt, Homo sapiens
gcaugaaacuuuacccuau

SEQ ID NO: 364746 - RNA, 19 nt, Homo sapiens
ccaacucacuucuuuauug

SEQ ID NO: 364747 - RNA, 19 nt, Homo sapiens
ugaaagagcugaacuugca

SEQ ID NO: 364748 - RNA, 19 nt, Homo sapiens
ggacucagcuucuaucaac

SEQ ID NO: 364749 - RNA, 19 nt, Homo sapiens
gggacgaucuuugaauaua

SEQ ID NO: 364750 - RNA, 19 nt, Homo sapiens
gcagaagagaagauuauua

SEQ ID NO: 364751 - RNA, 19 nt, Homo sapiens
gagcugaacuugcacagau

SEQ ID NO: 364752 - RNA, 19 nt, Homo sapiens
agaaguagcugugaacauu

SEQ ID NO: 364753 - RNA, 19 nt, Homo sapiens
gcgaaaguaugcugaagaa

SEQ ID NO: 364754 - RNA, 19 nt, Homo sapiens
caaauauagugccaaugua

SEQ ID NO: 364755 - RNA, 19 nt, Homo sapiens
uaacggaacucauggaagu

SEQ ID NO: 364756 - RNA, 19 nt, Homo sapiens
guacaaaggagaaccaauu

SEQ ID NO: 364757 - RNA, 19 nt, Homo sapiens
ccucaagucuggcacauuu

SEQ ID NO: 364758 - RNA, 19 nt, Homo sapiens
gcugauggauggucugaaa

SEQ ID NO: 364759 - RNA, 19 nt, Homo sapiens
caaacacaguucaaucuga

SEQ ID NO: 364760 - RNA, 19 nt, Homo sapiens
aaaguaugcugaagaaaga

SEQ ID NO: 364761 - RNA, 19 nt, Homo sapiens
ccaaacaccaugaaucuuu

SEQ ID NO: 364762 - RNA, 19 nt, Homo sapiens
agaaagaaauggugucaau

SEQ ID NO: 364763 - RNA, 19 nt, Homo sapiens
gaaaguaugcugaagaaag

SEQ ID NO: 364764 - RNA, 19 nt, Homo sapiens
aaccuuaccugaaacauuu

SEQ ID NO: 364765 - RNA, 19 nt, Homo sapiens
caauuugggucacagcuaa

SEQ ID NO: 364766 - RNA, 19 nt, Homo sapiens
uauauggacuugcaacaaa

SEQ ID NO: 364767 - RNA, 19 nt, Homo sapiens
aaagaagagucauccguaa

SEQ ID NO: 364768 - RNA, 19 nt, Homo sapiens
ggacuucuuccuguuauua

SEQ ID NO: 364769 - RNA, 19 nt, Homo sapiens
ccucauggguugaagaauu

SEQ ID NO: 364770 - RNA, 19 nt, Homo sapiens
cauagaaccagaacauaua

SEQ ID NO: 364771 - RNA, 19 nt, Homo sapiens
gugacuaucuuuaugagaa

SEQ ID NO: 364772 - RNA, 19 nt, Homo sapiens
ggcaaacaguagacuuaua

SEQ ID NO: 364773 - RNA, 19 nt, Homo sapiens
gauuccaacucacuucuuu

SEQ ID NO: 364774 - RNA, 19 nt, Homo sapiens
gagaaaagguugaccagaa

SEQ ID NO: 364775 - RNA, 19 nt, Homo sapiens
gcauagaaccagaacauau

SEQ ID NO: 364776 - RNA, 19 nt, Homo sapiens
ccaagaagacugauauguu

SEQ ID NO: 364777 - RNA, 19 nt, Homo sapiens
gcagaggguugaugguaug

SEQ ID NO: 364778 - RNA, 19 nt, Homo sapiens
cagaauauuuacacacuug

SEQ ID NO: 364779 - RNA, 19 nt, Homo sapiens
gcaaacaguagacuuauag

SEQ ID NO: 364780 - RNA, 19 nt, Homo sapiens
caacucacuucuuuauugu

SEQ ID NO: 364781 - RNA, 19 nt, Homo sapiens
uaccaggacuuuagaauuc

SEQ ID NO: 364782 - RNA, 19 nt, Homo sapiens
ggcuacagcuuccuaaaga

SEQ ID NO: 364783 - RNA, 19 nt, Homo sapiens
ccaaagaaguuaaaaguug

SEQ ID NO: 364784 - RNA, 19 nt, Homo sapiens
ggagaguguuccuguugaa

SEQ ID NO: 364785 - RNA, 19 nt, Homo sapiens
cagcuucuaucaacaaaga

SEQ ID NO: 364786 - RNA, 19 nt, Homo sapiens
gccaaagcaucccaaagaa

SEQ ID NO: 364787 - RNA, 19 nt, Homo sapiens
caaggcaguuguaagaaau

SEQ ID NO: 364788 - RNA, 19 nt, Homo sapiens
caaaaugaaugcuuccuuu

SEQ ID NO: 364789 - RNA, 19 nt, Homo sapiens
gacuuuagaauuccucuua

SEQ ID NO: 364790 - RNA, 19 nt, Homo sapiens
ugacaccggcuccuaauaa

SEQ ID NO: 364791 - RNA, 19 nt, Homo sapiens
gcagugaagucaucaaagc

SEQ ID NO: 364792 - RNA, 19 nt, Homo sapiens
uccagaaucucauggcaua

SEQ ID NO: 364793 - RNA, 19 nt, Homo sapiens
uuaaagugguucuggauau

SEQ ID NO: 364794 - RNA, 19 nt, Homo sapiens
cauugaggcugacaccuuu

SEQ ID NO: 364795 - RNA, 19 nt, Homo sapiens
ucauggcucugacaaugua

SEQ ID NO: 364796 - RNA, 19 nt, Homo sapiens
ucugagaccuuguuucaau

SEQ ID NO: 364797 - RNA, 19 nt, Homo sapiens
aaaguacucucgcugguau

SEQ ID NO: 364798 - RNA, 19 nt, Homo sapiens
uagcuacacuauugcauug

SEQ ID NO: 364799 - RNA, 19 nt, Homo sapiens
cgucagugguccuguguuu

SEQ ID NO: 364800 - RNA, 19 nt, Homo sapiens
gaagagaagauuauuaagc

SEQ ID NO: 364801 - RNA, 19 nt, Homo sapiens
aaccuuggcugcucaugua

SEQ ID NO: 364802 - RNA, 19 nt, Homo sapiens
gcuaagagugauagaauug

SEQ ID NO: 364803 - RNA, 19 nt, Homo sapiens
gaaccaaaccagcacuuca

SEQ ID NO: 364804 - RNA, 19 nt, Homo sapiens
ggucacagcuaaguaucaa

SEQ ID NO: 364805 - RNA, 19 nt, Homo sapiens
ggacgaucuuugaauauac

SEQ ID NO: 364806 - RNA, 19 nt, Homo sapiens
gauaccagauauuugaauc

SEQ ID NO: 364807 - RNA, 19 nt, Homo sapiens
aaagacagaccacaccuaa

SEQ ID NO: 364808 - RNA, 19 nt, Homo sapiens
cuacaaauauagugccaau

SEQ ID NO: 364809 - RNA, 19 nt, Homo sapiens
guaccaggacuuuagaauu

SEQ ID NO: 364810 - RNA, 19 nt, Homo sapiens
ucauguaacccuucgauuu

SEQ ID NO: 364811 - RNA, 19 nt, Homo sapiens
ggaacucauggaagucuua

SEQ ID NO: 364812 - RNA, 19 nt, Homo sapiens
gcagaauauuuacacacuu

SEQ ID NO: 364813 - RNA, 19 nt, Homo sapiens
gguagcccauguuauguga

SEQ ID NO: 364814 - RNA, 19 nt, Homo sapiens
gaagaaagaaaugguguca

SEQ ID NO: 364815 - RNA, 19 nt, Homo sapiens
gaaaccaagcugugccaaa

SEQ ID NO: 364816 - RNA, 19 nt, Homo sapiens
uaccagaguuuucaaguua

SEQ ID NO: 364817 - RNA, 19 nt, Homo sapiens
gaggguugaugguaugguu

SEQ ID NO: 364818 - RNA, 19 nt, Homo sapiens
caugugagagcauuaauga

SEQ ID NO: 364819 - RNA, 19 nt, Homo sapiens
cauguuaugugacuaucuu

SEQ ID NO: 364820 - RNA, 19 nt, Homo sapiens
gaaucuuucuuacuauugg

SEQ ID NO: 364821 - RNA, 19 nt, Homo sapiens
aaacacauuugccaaccuu

SEQ ID NO: 364822 - RNA, 19 nt, Homo sapiens
ucacuggacucagcuucua

SEQ ID NO: 364823 - RNA, 19 nt, Homo sapiens
ugacuuugauuaugaugga

SEQ ID NO: 364824 - RNA, 19 nt, Homo sapiens
caaagcaucccaaagaagu

SEQ ID NO: 364825 - RNA, 19 nt, Homo sapiens
gaccuuguuucaaucuuug

SEQ ID NO: 364826 - RNA, 19 nt, Homo sapiens
gcuacacuauugcauuguu

SEQ ID NO: 364827 - RNA, 19 nt, Homo sapiens
caccuuagcuuucauuuug

SEQ ID NO: 364828 - RNA, 19 nt, Homo sapiens
ccucagaaaggaaauauug

SEQ ID NO: 364829 - RNA, 19 nt, Homo sapiens
gaaucuugcacauauuuga

SEQ ID NO: 364830 - RNA, 19 nt, Homo sapiens
aaaccaagcugugccaaag

SEQ ID NO: 364831 - RNA, 19 nt, Homo sapiens
ggacaucucagggaaacuu

SEQ ID NO: 364832 - RNA, 19 nt, Homo sapiens
gaaccaugugagagcauua

SEQ ID NO: 364833 - RNA, 19 nt, Homo sapiens
uguugaaucuugcacauau

SEQ ID NO: 364834 - RNA, 19 nt, Homo sapiens
aaagaaauggugucaaugu

SEQ ID NO: 364835 - RNA, 19 nt, Homo sapiens
acaaauauagugccaaugu

SEQ ID NO: 364836 - RNA, 19 nt, Homo sapiens
caugaaacuuuacccuaug

SEQ ID NO: 364837 - RNA, 19 nt, Homo sapiens
ccuaagcguuugcacuuug

SEQ ID NO: 364838 - RNA, 19 nt, Homo sapiens
gaguagagcuuguaauaaa

SEQ ID NO: 364839 - RNA, 19 nt, Homo sapiens
agacauaccugcauacaua

SEQ ID NO: 364840 - RNA, 19 nt, Homo sapiens
gaacgcagauggcauguug

SEQ ID NO: 364841 - RNA, 19 nt, Homo sapiens
gaaauaugcuucggaaaga

SEQ ID NO: 364842 - RNA, 19 nt, Homo sapiens
gaaagugguuauagugaaa

SEQ ID NO: 364843 - RNA, 19 nt, Homo sapiens
ggugaaagcuggaacauuc

SEQ ID NO: 364844 - RNA, 19 nt, Homo sapiens
gcaaagucaugccuaauau

SEQ ID NO: 364845 - RNA, 19 nt, Homo sapiens
uaauaucccuguucacuuu

SEQ ID NO: 364846 - RNA, 19 nt, Homo sapiens
gaagccagcuccuaauaau

SEQ ID NO: 364847 - RNA, 19 nt, Homo sapiens
ggaaagaaauggaguuaac

SEQ ID NO: 364848 - RNA, 19 nt, Homo sapiens
ucaaacgggucuggaauua

SEQ ID NO: 364849 - RNA, 19 nt, Homo sapiens
gcaacaaugcuaaauauga

SEQ ID NO: 364850 - RNA, 19 nt, Homo sapiens
ggagacugcuguaccaauu

SEQ ID NO: 364851 - RNA, 19 nt, Homo sapiens
acaaacggcuucauacaaa

SEQ ID NO: 364852 - RNA, 19 nt, Homo sapiens
uaaagugccuccauuugaa

SEQ ID NO: 364853 - RNA, 19 nt, Homo sapiens
gaauugaggauauccauuu

SEQ ID NO: 364854 - RNA, 19 nt, Homo sapiens
uagaagaacucaugaagau

SEQ ID NO: 364855 - RNA, 19 nt, Homo sapiens
aaacgggucuggaauuauu

SEQ ID NO: 364856 - RNA, 19 nt, Homo sapiens
gaaguuaccagacccaauu

SEQ ID NO: 364857 - RNA, 19 nt, Homo sapiens
uacauaggauggaucauua

SEQ ID NO: 364858 - RNA, 19 nt, Homo sapiens
gcagcaaagucaugccuaa

SEQ ID NO: 364859 - RNA, 19 nt, Homo sapiens
gguuauggcccaacauuua

SEQ ID NO: 364860 - RNA, 19 nt, Homo sapiens
ccaauaugguuccaaugua

SEQ ID NO: 364861 - RNA, 19 nt, Homo sapiens
gaaauggaguuaacgugau

SEQ ID NO: 364862 - RNA, 19 nt, Homo sapiens
gcaaaaggcuuccaagaau

SEQ ID NO: 364863 - RNA, 19 nt, Homo sapiens
cauaugagagcgagauuua

SEQ ID NO: 364864 - RNA, 19 nt, Homo sapiens
caauaugguuccaauguau

SEQ ID NO: 364865 - RNA, 19 nt, Homo sapiens
ggucaaccgcuauggauua

SEQ ID NO: 364866 - RNA, 19 nt, Homo sapiens
gaugagcuguguuugaaga

SEQ ID NO: 364867 - RNA, 19 nt, Homo sapiens
uguaagagcuauaccaguu

SEQ ID NO: 364868 - RNA, 19 nt, Homo sapiens
caucugcaguacagucuua

SEQ ID NO: 364869 - RNA, 19 nt, Homo sapiens
ggaaauaaaggccgcagaa

SEQ ID NO: 364870 - RNA, 19 nt, Homo sapiens
cugaaugacuccacuguuu

SEQ ID NO: 364871 - RNA, 19 nt, Homo sapiens
uaugaugcauuccuuguaa

SEQ ID NO: 364872 - RNA, 19 nt, Homo sapiens
ggagaccacggauuugaua

SEQ ID NO: 364873 - RNA, 19 nt, Homo sapiens
gaagaaaggcagcaaaguc

SEQ ID NO: 364874 - RNA, 19 nt, Homo sapiens
gaugaugacugugaggaaa

SEQ ID NO: 364875 - RNA, 19 nt, Homo sapiens
ggaccaaucuucgacuaug

SEQ ID NO: 364876 - RNA, 19 nt, Homo sapiens
caccagaggcuaaauauga

SEQ ID NO: 364877 - RNA, 19 nt, Homo sapiens
uaagagaccuaagaggaaa

SEQ ID NO: 364878 - RNA, 19 nt, Homo sapiens
ggaguuaacgugauaagug

SEQ ID NO: 364879 - RNA, 19 nt, Homo sapiens
gcagauguccuacggauuc

SEQ ID NO: 364880 - RNA, 19 nt, Homo sapiens
caaagaacaaguuggauga

SEQ ID NO: 364881 - RNA, 19 nt, Homo sapiens
gcucagaggacgaaucaaa

SEQ ID NO: 364882 - RNA, 19 nt, Homo sapiens
aaauggaguuaacgugaua

SEQ ID NO: 364883 - RNA, 19 nt, Homo sapiens
ccagaaauccugacacuca

SEQ ID NO: 364884 - RNA, 19 nt, Homo sapiens
uaugauggcuuacaugaca

SEQ ID NO: 364885 - RNA, 19 nt, Homo sapiens
ugaaagugguuauagugaa

SEQ ID NO: 364886 - RNA, 19 nt, Homo sapiens
acacaaauauggcccuuuc

SEQ ID NO: 364887 - RNA, 19 nt, Homo sapiens
ccaagugguuugcaaagga

SEQ ID NO: 364888 - RNA, 19 nt, Homo sapiens
agacuaaagugccuccauu

SEQ ID NO: 364889 - RNA, 19 nt, Homo sapiens
gaccaaucuucgacuauga

SEQ ID NO: 364890 - RNA, 19 nt, Homo sapiens
gaccugggcugcacuugug

SEQ ID NO: 364891 - RNA, 19 nt, Homo sapiens
ccagggagaccacggauuu

SEQ ID NO: 364892 - RNA, 19 nt, Homo sapiens
acagaagaauugaggauau

SEQ ID NO: 364893 - RNA, 19 nt, Homo sapiens
caacaaugcuaaauaugac

SEQ ID NO: 364894 - RNA, 19 nt, Homo sapiens
ggaagaauucgauccaaau

SEQ ID NO: 364895 - RNA, 19 nt, Homo sapiens
ugauuucucuggacacaaa

SEQ ID NO: 364896 - RNA, 19 nt, Homo sapiens
gcaaaggagagucgcauug

SEQ ID NO: 364897 - RNA, 19 nt, Homo sapiens
caaaggguauuggugaaga

SEQ ID NO: 364898 - RNA, 19 nt, Homo sapiens
gauggcauguugcaaggaa

SEQ ID NO: 364899 - RNA, 19 nt, Homo sapiens
gauugaagccagcuccuaa

SEQ ID NO: 364900 - RNA, 19 nt, Homo sapiens
cuaaagugccuccauuuga

SEQ ID NO: 364901 - RNA, 19 nt, Homo sapiens
cuaugacuaugauggcuua

SEQ ID NO: 364902 - RNA, 19 nt, Homo sapiens
gcacuaugccaacaacaga

SEQ ID NO: 364903 - RNA, 19 nt, Homo sapiens
gaaacagcaccuucccaaa

SEQ ID NO: 364904 - RNA, 19 nt, Homo sapiens
agaaucacauggaauuguu

SEQ ID NO: 364905 - RNA, 19 nt, Homo sapiens
aauaaauacugcagcuuga

SEQ ID NO: 364906 - RNA, 19 nt, Homo sapiens
ccagucgugucagauaaua

SEQ ID NO: 364907 - RNA, 19 nt, Homo sapiens
gggcugcacuugugaugau

SEQ ID NO: 364908 - RNA, 19 nt, Homo sapiens
ccacggauuugauaacaag

SEQ ID NO: 364909 - RNA, 19 nt, Homo sapiens
gccaacaacagaagaauug

SEQ ID NO: 364910 - RNA, 19 nt, Homo sapiens
ggaaacucgucaggacaaa

SEQ ID NO: 364911 - RNA, 19 nt, Homo sapiens
gaaaggcagcaaagucaug

SEQ ID NO: 364912 - RNA, 19 nt, Homo sapiens
gcaguacagucuuaucaac

SEQ ID NO: 364913 - RNA, 19 nt, Homo sapiens
ggcuaaauaugaugcauuc

SEQ ID NO: 364914 - RNA, 19 nt, Homo sapiens
caacaaacggcuucauaca

SEQ ID NO: 364915 - RNA, 19 nt, Homo sapiens
gaggauauccauuuauugg

SEQ ID NO: 364916 - RNA, 19 nt, Homo sapiens
uguaugauccuguauuuga

SEQ ID NO: 364917 - RNA, 19 nt, Homo sapiens
cugaguagagcuuguaaua

SEQ ID NO: 364918 - RNA, 19 nt, Homo sapiens
aaagagaacacgcugcaaa

SEQ ID NO: 364919 - RNA, 19 nt, Homo sapiens
guagaagaacucaugaaga

SEQ ID NO: 364920 - RNA, 19 nt, Homo sapiens
caucauauacuguuuccaa

SEQ ID NO: 364921 - RNA, 19 nt, Homo sapiens
gcagugcuuuaucggacua

SEQ ID NO: 364922 - RNA, 19 nt, Homo sapiens
gcccaacauuuaaguacaa

SEQ ID NO: 364923 - RNA, 19 nt, Homo sapiens
uauaagaaaccaucaggaa

SEQ ID NO: 364924 - RNA, 19 nt, Homo sapiens
uugccaaucucacguguaa

SEQ ID NO: 364925 - RNA, 19 nt, Homo sapiens
gagacugcuguaccaauua

SEQ ID NO: 364926 - RNA, 19 nt, Homo sapiens
aguggaagcuucuaaaugg

SEQ ID NO: 364927 - RNA, 19 nt, Homo sapiens
caauguauccugcuuucaa

SEQ ID NO: 364928 - RNA, 19 nt, Homo sapiens
ggauuccucuuuccuccuu

SEQ ID NO: 364929 - RNA, 19 nt, Homo sapiens
cauggaaguuugaaucauc

SEQ ID NO: 364930 - RNA, 19 nt, Homo sapiens
gauccaaauuuagcaacaa

SEQ ID NO: 364931 - RNA, 19 nt, Homo sapiens
auuaauggauggacugaaa

SEQ ID NO: 364932 - RNA, 19 nt, Homo sapiens
gaaauaaaggccgcagaau

SEQ ID NO: 364933 - RNA, 19 nt, Homo sapiens
guaccaaaucugacauauu

SEQ ID NO: 364934 - RNA, 19 nt, Homo sapiens
gucaguaucugcuuaggau

SEQ ID NO: 364935 - RNA, 19 nt, Homo sapiens
gggauuauguaccuucagu

SEQ ID NO: 364936 - RNA, 19 nt, Homo sapiens
ugagaggccuucggucuau

SEQ ID NO: 364937 - RNA, 19 nt, Homo sapiens
aaagucaugccuaauauug

SEQ ID NO: 364938 - RNA, 19 nt, Homo sapiens
gaauauggaugugcaauaa

SEQ ID NO: 364939 - RNA, 19 nt, Homo sapiens
gaucagaaguggcuauaaa

SEQ ID NO: 364940 - RNA, 19 nt, Homo sapiens
cauccgagcucauaauaua

SEQ ID NO: 364941 - RNA, 19 nt, Homo sapiens
caacggaagugucccauuu

SEQ ID NO: 364942 - RNA, 19 nt, Homo sapiens
uggaauacaugacugauua

SEQ ID NO: 364943 - RNA, 19 nt, Homo sapiens
ggaaucaacucgaauaugg

SEQ ID NO: 364944 - RNA, 19 nt, Homo sapiens
gaucaugucacuuggauua

SEQ ID NO: 364945 - RNA, 19 nt, Homo sapiens
gaggauuucuacacuguua

SEQ ID NO: 364946 - RNA, 19 nt, Homo sapiens
gaaauaacagcaacaguga

SEQ ID NO: 364947 - RNA, 19 nt, Homo sapiens
ccacaguguucuucuuaua

SEQ ID NO: 364948 - RNA, 19 nt, Homo sapiens
gcaauuugguaccuaugua

SEQ ID NO: 364949 - RNA, 19 nt, Homo sapiens
ucacugggcuugacuucua

SEQ ID NO: 364950 - RNA, 19 nt, Homo sapiens
cagaggaggugucaaaguu

SEQ ID NO: 364951 - RNA, 19 nt, Homo sapiens
caaggcagcugcaggaaga

SEQ ID NO: 364952 - RNA, 19 nt, Homo sapiens
guacucagcuggaacaagu

SEQ ID NO: 364953 - RNA, 19 nt, Homo sapiens
gaauggaccagacuuauug

SEQ ID NO: 364954 - RNA, 19 nt, Homo sapiens
ggugugauguggcauguaa

SEQ ID NO: 364955 - RNA, 19 nt, Homo sapiens
gaacaucagauagccaaua

SEQ ID NO: 364956 - RNA, 19 nt, Homo sapiens
gaaguugaaccauuugaaa

SEQ ID NO: 364957 - RNA, 19 nt, Homo sapiens
guaacaagauggaauacau

SEQ ID NO: 364958 - RNA, 19 nt, Homo sapiens
uagccaauaugaugcuuua

SEQ ID NO: 364959 - RNA, 19 nt, Homo sapiens
gcauuguucuucuugcuuu

SEQ ID NO: 364960 - RNA, 19 nt, Homo sapiens
gagcauggaggcuaucuuu

SEQ ID NO: 364961 - RNA, 19 nt, Homo sapiens
cagaguaauuaaagccuua

SEQ ID NO: 364962 - RNA, 19 nt, Homo sapiens
cagaugaaauuaccaaaca

SEQ ID NO: 364963 - RNA, 19 nt, Homo sapiens
gaaucuacguugacuuuag

SEQ ID NO: 364964 - RNA, 19 nt, Homo sapiens
gacugaaguugaaccauuu

SEQ ID NO: 364965 - RNA, 19 nt, Homo sapiens
gcacauggacccaguuuua

SEQ ID NO: 364966 - RNA, 19 nt, Homo sapiens
gagaggauuucuacacugu

SEQ ID NO: 364967 - RNA, 19 nt, Homo sapiens
ccauauacaugccuuacaa

SEQ ID NO: 364968 - RNA, 19 nt, Homo sapiens
ggaauggaccagacuuauu

SEQ ID NO: 364969 - RNA, 19 nt, Homo sapiens
gagcuguccugaagguaaa

SEQ ID NO: 364970 - RNA, 19 nt, Homo sapiens
gggaauaugucaguggauu

SEQ ID NO: 364971 - RNA, 19 nt, Homo sapiens
cagcaacagugaaaguaaa

SEQ ID NO: 364972 - RNA, 19 nt, Homo sapiens
agagaagacugaaguugaa

SEQ ID NO: 364973 - RNA, 19 nt, Homo sapiens
ucuauaaccuaauguguga

SEQ ID NO: 364974 - RNA, 19 nt, Homo sapiens
agacugaaguugaaccauu

SEQ ID NO: 364975 - RNA, 19 nt, Homo sapiens
auaaauggcuccuuuccuu

SEQ ID NO: 364976 - RNA, 19 nt, Homo sapiens
ccaaaucauuacaccauug

SEQ ID NO: 364977 - RNA, 19 nt, Homo sapiens
ggugauugcugcugggauu

SEQ ID NO: 364978 - RNA, 19 nt, Homo sapiens
caucagauagccaauauga

SEQ ID NO: 364979 - RNA, 19 nt, Homo sapiens
guggagagcuguccugaag

SEQ ID NO: 364980 - RNA, 19 nt, Homo sapiens
ucagauagccaauaugaug

SEQ ID NO: 364981 - RNA, 19 nt, Homo sapiens
cagccugucucugaaauuu

SEQ ID NO: 364982 - RNA, 19 nt, Homo sapiens
ggagagcuguccugaaggu

SEQ ID NO: 364983 - RNA, 19 nt, Homo sapiens
guggaccaauauuugauua

SEQ ID NO: 364984 - RNA, 19 nt, Homo sapiens
ccuaaugugugaucuucua

SEQ ID NO: 364985 - RNA, 19 nt, Homo sapiens
gaaagaaauggaguaaaug

SEQ ID NO: 364986 - RNA, 19 nt, Homo sapiens
ugaagucuauaaccuaaug

SEQ ID NO: 364987 - RNA, 19 nt, Homo sapiens
gaccagacuuauuguaaca

SEQ ID NO: 364988 - RNA, 19 nt, Homo sapiens
gguaguagaucaugcuuuu

SEQ ID NO: 364989 - RNA, 19 nt, Homo sapiens
aauuaaagccuuacaggua

SEQ ID NO: 364990 - RNA, 19 nt, Homo sapiens
gaaagacccagguuuuaua

SEQ ID NO: 364991 - RNA, 19 nt, Homo sapiens
cugaggaaauuguuagaaa

SEQ ID NO: 364992 - RNA, 19 nt, Homo sapiens
aaacaggucuaugcagcua

SEQ ID NO: 364993 - RNA, 19 nt, Homo sapiens
ggaagugucccauuugaag

SEQ ID NO: 364994 - RNA, 19 nt, Homo sapiens
ggcuauaaauggcuccuuu

SEQ ID NO: 364995 - RNA, 19 nt, Homo sapiens
cagaagcucuuuggguuga

SEQ ID NO: 364996 - RNA, 19 nt, Homo sapiens
caaagcgacugcacuaugc

SEQ ID NO: 364997 - RNA, 19 nt, Homo sapiens
gaacgucagaaucgacaaa

SEQ ID NO: 364998 - RNA, 19 nt, Homo sapiens
ggaccagacuuauuguaac

SEQ ID NO: 364999 - RNA, 19 nt, Homo sapiens
ccaguuaucuuguuuucua

SEQ ID NO: 365000 - RNA, 19 nt, Homo sapiens
gaauaugucaguggauuug

SEQ ID NO: 365001 - RNA, 19 nt, Homo sapiens
acaauggaaucuacguuga

SEQ ID NO: 365002 - RNA, 19 nt, Homo sapiens
cuauuugacuccugauuug

SEQ ID NO: 365003 - RNA, 19 nt, Homo sapiens
ggaauaugucaguggauuu

SEQ ID NO: 365004 - RNA, 19 nt, Homo sapiens
uggaacccaugguaguuua

SEQ ID NO: 365005 - RNA, 19 nt, Homo sapiens
gaagagaggauuucuacac

SEQ ID NO: 365006 - RNA, 19 nt, Homo sapiens
agcaauguaucaagguuua

SEQ ID NO: 365007 - RNA, 19 nt, Homo sapiens
gggcuuguauccagaguca

SEQ ID NO: 365008 - RNA, 19 nt, Homo sapiens
uaagaguguuugccaagga

SEQ ID NO: 365009 - RNA, 19 nt, Homo sapiens
gaaaacauguggaauucau

SEQ ID NO: 365010 - RNA, 19 nt, Homo sapiens
cgaauauggaugugcaaua

SEQ ID NO: 365011 - RNA, 19 nt, Homo sapiens
gaagaagugcuuugaugca

SEQ ID NO: 365012 - RNA, 19 nt, Homo sapiens
ggaccacugucuccuuuac

SEQ ID NO: 365013 - RNA, 19 nt, Homo sapiens
cacaugggauacuuuaaug

SEQ ID NO: 365014 - RNA, 19 nt, Homo sapiens
gcaggaagaagugcuuuga

SEQ ID NO: 365015 - RNA, 19 nt, Homo sapiens
aggaagaagugcuuugaug

SEQ ID NO: 365016 - RNA, 19 nt, Homo sapiens
gcaauagaacaucagauag

SEQ ID NO: 365017 - RNA, 19 nt, Homo sapiens
gaagugucccauuugaaga

SEQ ID NO: 365018 - RNA, 19 nt, Homo sapiens
gauguaaaucucaacaaga

SEQ ID NO: 365019 - RNA, 19 nt, Homo sapiens
ggauuuagagcugaauauu

SEQ ID NO: 365020 - RNA, 19 nt, Homo sapiens
guaaagaccgaggugauug

SEQ ID NO: 365021 - RNA, 19 nt, Homo sapiens
guuaguggaccaauauuug

SEQ ID NO: 365022 - RNA, 19 nt, Homo sapiens
ccaaagcgacugcacuaug

SEQ ID NO: 365023 - RNA, 19 nt, Homo sapiens
ucacauggcaucauugaca

SEQ ID NO: 365024 - RNA, 19 nt, Homo sapiens
agagucacauggcaucauu

SEQ ID NO: 365025 - RNA, 19 nt, Homo sapiens
aaaccuucccaaaucauua

SEQ ID NO: 365026 - RNA, 19 nt, Homo sapiens
caaaauacaugagagcuau

SEQ ID NO: 365027 - RNA, 19 nt, Homo sapiens
cuaggguacugcagaagaa

SEQ ID NO: 365028 - RNA, 19 nt, Homo sapiens
ggacucaggaaacuggaaa

SEQ ID NO: 365029 - RNA, 19 nt, Homo sapiens
ccucauggcuggaagaaaa

SEQ ID NO: 365030 - RNA, 19 nt, Homo sapiens
gaugacuguuugcagaaga

SEQ ID NO: 365031 - RNA, 19 nt, Homo sapiens
caagugaaucagaugcuaa

SEQ ID NO: 365032 - RNA, 19 nt, Homo sapiens
ggaaucuacguugacuuua

SEQ ID NO: 365033 - RNA, 19 nt, Homo sapiens
gcuccuuuccuuccauaua

SEQ ID NO: 365034 - RNA, 19 nt, Homo sapiens
gagaacugccggugugaug

SEQ ID NO: 365035 - RNA, 19 nt, Homo sapiens
uuagaggacuggagaacug

SEQ ID NO: 365036 - RNA, 19 nt, Homo sapiens
aaacaugccacagaaagaa

SEQ ID NO: 365037 - RNA, 19 nt, Homo sapiens
guaccuauguaugaagaau

SEQ ID NO: 365038 - RNA, 19 nt, Homo sapiens
caagagaccucguggagaa

SEQ ID NO: 365039 - RNA, 19 nt, Homo sapiens
gaccagaggccaagaauuu

SEQ ID NO: 365040 - RNA, 19 nt, Homo sapiens
ggaaacgaguaucuuauau

SEQ ID NO: 365041 - RNA, 19 nt, Homo sapiens
gcucuuggaugcauaauau

SEQ ID NO: 365042 - RNA, 19 nt, Homo sapiens
ggacugcuauggcaauuau

SEQ ID NO: 365043 - RNA, 19 nt, Homo sapiens
gcggaaaccuugcagcauu

SEQ ID NO: 365044 - RNA, 19 nt, Homo sapiens
gaacagcgcaguacguuuc

SEQ ID NO: 365045 - RNA, 19 nt, Homo sapiens
gagaagcgacauaucauaa

SEQ ID NO: 365046 - RNA, 19 nt, Homo sapiens
gaaggauacggaccucuua

SEQ ID NO: 365047 - RNA, 19 nt, Homo sapiens
gaucaccccuucuuuguua

SEQ ID NO: 365048 - RNA, 19 nt, Homo sapiens
gugaggaaauggaaggaua

SEQ ID NO: 365049 - RNA, 19 nt, Homo sapiens
caacaaaguucugaaaggu

SEQ ID NO: 365050 - RNA, 19 nt, Homo sapiens
gcagcaacauagagcagua

SEQ ID NO: 365051 - RNA, 19 nt, Homo sapiens
ggagaagcgacauaucaua

SEQ ID NO: 365052 - RNA, 19 nt, Homo sapiens
caacauagagcaguacauu

SEQ ID NO: 365053 - RNA, 19 nt, Homo sapiens
ggaccacauuuauauuaug

SEQ ID NO: 365054 - RNA, 19 nt, Homo sapiens
cagaaggaccacauuuaua

SEQ ID NO: 365055 - RNA, 19 nt, Homo sapiens
cagagaauaugcgauuaaa

SEQ ID NO: 365056 - RNA, 19 nt, Homo sapiens
gaaggaccacauuuauauu

SEQ ID NO: 365057 - RNA, 19 nt, Homo sapiens
gaagaucauuaaguuggaa

SEQ ID NO: 365058 - RNA, 19 nt, Homo sapiens
gcuggaaacgaguaucuua

SEQ ID NO: 365059 - RNA, 19 nt, Homo sapiens
gaagcaggcuggcggaaac

SEQ ID NO: 365060 - RNA, 19 nt, Homo sapiens
agaaggaccacauuuauau

SEQ ID NO: 365061 - RNA, 19 nt, Homo sapiens
cacagaaggaccacauuua

SEQ ID NO: 365062 - RNA, 19 nt, Homo sapiens
gaagcgacauaucauaaaa

SEQ ID NO: 365063 - RNA, 19 nt, Homo sapiens
cggaaaccuugcagcauuu

SEQ ID NO: 365064 - RNA, 19 nt, Homo sapiens
gaaguccgccuguaagagu

SEQ ID NO: 365065 - RNA, 19 nt, Homo sapiens
auacggaccucuuaaagca

SEQ ID NO: 365066 - RNA, 19 nt, Homo sapiens
uguaagaguucagaccuuu

SEQ ID NO: 365067 - RNA, 19 nt, Homo sapiens
gaacaagguccccuaugua

SEQ ID NO: 365068 - RNA, 19 nt, Homo sapiens
ccagagaauaugcgauuaa

SEQ ID NO: 365069 - RNA, 19 nt, Homo sapiens
gcggaaggguuuauuugca

SEQ ID NO: 365070 - RNA, 19 nt, Homo sapiens
gaggucaggcagcaacaua

SEQ ID NO: 365071 - RNA, 19 nt, Homo sapiens
ccgcuuaccugccggcuau

SEQ ID NO: 365072 - RNA, 19 nt, Homo sapiens
ucacagaaggaccacauuu

SEQ ID NO: 365073 - RNA, 19 nt, Homo sapiens
uggaaacgaguaucuuaua

SEQ ID NO: 365074 - RNA, 19 nt, Homo sapiens
gaucacagauuuuggaaca

SEQ ID NO: 365075 - RNA, 19 nt, Homo sapiens
gauaugcacauccagauca

SEQ ID NO: 365076 - RNA, 19 nt, Homo sapiens
ucaacaaaguucugaaagg

SEQ ID NO: 365077 - RNA, 19 nt, Homo sapiens
ggaaggauacggaccucuu

SEQ ID NO: 365078 - RNA, 19 nt, Homo sapiens
gagaaguccgccuguaaga

SEQ ID NO: 365079 - RNA, 19 nt, Homo sapiens
uggcaggacucccaccauu

SEQ ID NO: 365080 - RNA, 19 nt, Homo sapiens
gcacggcaagggcaucauu

SEQ ID NO: 365081 - RNA, 19 nt, Homo sapiens
cggaaggguuuauuugcaa

SEQ ID NO: 365082 - RNA, 19 nt, Homo sapiens
acauccagaucacagauuu

SEQ ID NO: 365083 - RNA, 19 nt, Homo sapiens
ugaaauuccuuggucacaa

SEQ ID NO: 365084 - RNA, 19 nt, Homo sapiens
ggacucgaacuccuuugaa

SEQ ID NO: 365085 - RNA, 19 nt, Homo sapiens
ugagaccuguacccgauuu

SEQ ID NO: 365086 - RNA, 19 nt, Homo sapiens
ggacguauuaucugaugga

SEQ ID NO: 365087 - RNA, 19 nt, Homo sapiens
uaacaggacguauuaucug

SEQ ID NO: 365088 - RNA, 19 nt, Homo sapiens
cgccuaacaggacguauua

SEQ ID NO: 365089 - RNA, 19 nt, Homo sapiens
acagaaggaccacauuuau

SEQ ID NO: 365090 - RNA, 19 nt, Homo sapiens
uggauaagcggaaggguuu

SEQ ID NO: 365091 - RNA, 19 nt, Homo sapiens
gaggacugcuauggcaauu

SEQ ID NO: 365092 - RNA, 19 nt, Homo sapiens
agaagagguuguuguugga

SEQ ID NO: 365093 - RNA, 19 nt, Homo sapiens
gcaguacauucacgaucug

SEQ ID NO: 365094 - RNA, 19 nt, Homo sapiens
gcgguuaggcugugaggaa

SEQ ID NO: 365095 - RNA, 19 nt, Homo sapiens
ggagaaguccgccuguaag

SEQ ID NO: 365096 - RNA, 19 nt, Homo sapiens
aagcuuuacuucacauuuc

SEQ ID NO: 365097 - RNA, 19 nt, Homo sapiens
ggaagauccaggagguuug

SEQ ID NO: 365098 - RNA, 19 nt, Homo sapiens
cacaaguggugcaggaaga

SEQ ID NO: 365099 - RNA, 19 nt, Homo sapiens
caggacguauuaucugaug

SEQ ID NO: 365100 - RNA, 19 nt, Homo sapiens
acauagagcaguacauuca

SEQ ID NO: 365101 - RNA, 19 nt, Homo sapiens
aacaggacguauuaucuga

SEQ ID NO: 365102 - RNA, 19 nt, Homo sapiens
uaagcggaaggguuuauuu

SEQ ID NO: 365103 - RNA, 19 nt, Homo sapiens
ggauacggaccucuuaaag

SEQ ID NO: 365104 - RNA, 19 nt, Homo sapiens
cgacauaucauaaaagaga

SEQ ID NO: 365105 - RNA, 19 nt, Homo sapiens
gaugagaagagguuguugu

SEQ ID NO: 365106 - RNA, 19 nt, Homo sapiens
ggaacagcgcaguacguuu

SEQ ID NO: 365107 - RNA, 19 nt, Homo sapiens
ccuuugaacuggacuuaca

SEQ ID NO: 365108 - RNA, 19 nt, Homo sapiens
caaagcgguuaggcuguga

SEQ ID NO: 365109 - RNA, 19 nt, Homo sapiens
gaagaugagaagagguugu

SEQ ID NO: 365110 - RNA, 19 nt, Homo sapiens
guuaggcugugaggaaaug

SEQ ID NO: 365111 - RNA, 19 nt, Homo sapiens
agaagaucauuaaguugga

SEQ ID NO: 365112 - RNA, 19 nt, Homo sapiens
gggaacagcgcaguacguu

SEQ ID NO: 365113 - RNA, 19 nt, Homo sapiens
guauuucggccuuaguuau

SEQ ID NO: 365114 - RNA, 19 nt, Homo sapiens
uguggauccugucaacaaa

SEQ ID NO: 365115 - RNA, 19 nt, Homo sapiens
cuauggcaauuaugacaau

SEQ ID NO: 365116 - RNA, 19 nt, Homo sapiens
ggcaaccuccagagaauau

SEQ ID NO: 365117 - RNA, 19 nt, Homo sapiens
ccagcgugguguuauguuc

SEQ ID NO: 365118 - RNA, 19 nt, Homo sapiens
gcacauccagaucacagau

SEQ ID NO: 365119 - RNA, 19 nt, Homo sapiens
ggcaagggcaucauucaca

SEQ ID NO: 365120 - RNA, 19 nt, Homo sapiens
ggucaggcagcaacauaga

SEQ ID NO: 365121 - RNA, 19 nt, Homo sapiens
agaagcgacauaucauaaa

SEQ ID NO: 365122 - RNA, 19 nt, Homo sapiens
gcaccaguuuguagaaaau

SEQ ID NO: 365123 - RNA, 19 nt, Homo sapiens
cauaauauaccagcuugug

SEQ ID NO: 365124 - RNA, 19 nt, Homo sapiens
aaaugaagauaugcacauc

SEQ ID NO: 365125 - RNA, 19 nt, Homo sapiens
ccagagagcgggaugucau

SEQ ID NO: 365126 - RNA, 19 nt, Homo sapiens
gaaggguuuauuugcaaga

SEQ ID NO: 365127 - RNA, 19 nt, Homo sapiens
ggacgacgagaagcuguau

SEQ ID NO: 365128 - RNA, 19 nt, Homo sapiens
aagaugggcccaguggaua

SEQ ID NO: 365129 - RNA, 19 nt, Homo sapiens
aaagaugggcccaguggau

SEQ ID NO: 365130 - RNA, 19 nt, Homo sapiens
ccgaagaugagaagagguu

SEQ ID NO: 365131 - RNA, 19 nt, Homo sapiens
uguccuggcucgagaacug

SEQ ID NO: 365132 - RNA, 19 nt, Homo sapiens
acgacgagaagcuguauuu

SEQ ID NO: 365133 - RNA, 19 nt, Homo sapiens
ugucaacaaaguucugaaa

SEQ ID NO: 365134 - RNA, 19 nt, Homo sapiens
gauccugucaacaaaguuc

SEQ ID NO: 365135 - RNA, 19 nt, Homo sapiens
uccagagaauaugcgauua

SEQ ID NO: 365136 - RNA, 19 nt, Homo sapiens
ggauaagcggaaggguuua

SEQ ID NO: 365137 - RNA, 19 nt, Homo sapiens
agagguuguuguuggagaa

SEQ ID NO: 365138 - RNA, 19 nt, Homo sapiens
gcauaucucuguucaguua

SEQ ID NO: 365139 - RNA, 19 nt, Homo sapiens
ggaauuaaaugaucgguuu

SEQ ID NO: 365140 - RNA, 19 nt, Homo sapiens
gagaaugucuugcuugauu

SEQ ID NO: 365141 - RNA, 19 nt, Homo sapiens
aaacagagcugacggaaga

SEQ ID NO: 365142 - RNA, 19 nt, Homo sapiens
caaaucaucucgcuaaaga

SEQ ID NO: 365143 - RNA, 19 nt, Homo sapiens
gaaccaggccaauauauuu

SEQ ID NO: 365144 - RNA, 19 nt, Homo sapiens
gaauugaugugaaugugua

SEQ ID NO: 365145 - RNA, 19 nt, Homo sapiens
caucacagauuugcuaaua

SEQ ID NO: 365146 - RNA, 19 nt, Homo sapiens
ggaauacugucucuucuau

SEQ ID NO: 365147 - RNA, 19 nt, Homo sapiens
caacaaaucaucucgcuaa

SEQ ID NO: 365148 - RNA, 19 nt, Homo sapiens
guaagcugguguuauaaua

SEQ ID NO: 365149 - RNA, 19 nt, Homo sapiens
gaaggaaaugccaaaguua

SEQ ID NO: 365150 - RNA, 19 nt, Homo sapiens
guaaagauacccuugaauu

SEQ ID NO: 365151 - RNA, 19 nt, Homo sapiens
ggaguucucucuauuaucu

SEQ ID NO: 365152 - RNA, 19 nt, Homo sapiens
gauaauugcuacugccauu

SEQ ID NO: 365153 - RNA, 19 nt, Homo sapiens
uugcaucacuucaagauua

SEQ ID NO: 365154 - RNA, 19 nt, Homo sapiens
gcuguuaucuggguguuua

SEQ ID NO: 365155 - RNA, 19 nt, Homo sapiens
ggauaagauuccaguauug

SEQ ID NO: 365156 - RNA, 19 nt, Homo sapiens
ugaaggaaaugccaaaguu

SEQ ID NO: 365157 - RNA, 19 nt, Homo sapiens
ccaaagaauugaugugaau

SEQ ID NO: 365158 - RNA, 19 nt, Homo sapiens
cagauuggauucauaguga

SEQ ID NO: 365159 - RNA, 19 nt, Homo sapiens
gcacuaagacugcuucuag

SEQ ID NO: 365160 - RNA, 19 nt, Homo sapiens
gaaguaauugugacgauaa

SEQ ID NO: 365161 - RNA, 19 nt, Homo sapiens
ggaaauagagauucaagug

SEQ ID NO: 365162 - RNA, 19 nt, Homo sapiens
gcaauggaacuguauuaaa

SEQ ID NO: 365163 - RNA, 19 nt, Homo sapiens
aggguaagcugguguuaua

SEQ ID NO: 365164 - RNA, 19 nt, Homo sapiens
ggagagcacuggaggaaag

SEQ ID NO: 365165 - RNA, 19 nt, Homo sapiens
gauagacacugcagcuaga

SEQ ID NO: 365166 - RNA, 19 nt, Homo sapiens
gaauugaggaucucuuuga

SEQ ID NO: 365167 - RNA, 19 nt, Homo sapiens
gaaacgaucacucucauuc

SEQ ID NO: 365168 - RNA, 19 nt, Homo sapiens
ggagacagaauaagauuga

SEQ ID NO: 365169 - RNA, 19 nt, Homo sapiens
caucaucucugcugcgauu

SEQ ID NO: 365170 - RNA, 19 nt, Homo sapiens
uaaaucugguuacagcaua

SEQ ID NO: 365171 - RNA, 19 nt, Homo sapiens
aauaugcacugcucacuuu

SEQ ID NO: 365172 - RNA, 19 nt, Homo sapiens
acugaacucugaccacuua

SEQ ID NO: 365173 - RNA, 19 nt, Homo sapiens
uagcacagauaucuacaaa

SEQ ID NO: 365174 - RNA, 19 nt, Homo sapiens
uuuacuagcuggccuuaua

SEQ ID NO: 365175 - RNA, 19 nt, Homo sapiens
gaauaagauugaugcuguu

SEQ ID NO: 365176 - RNA, 19 nt, Homo sapiens
auaauacgcugcugaucua

SEQ ID NO: 365177 - RNA, 19 nt, Homo sapiens
ugaaagagaagcacuaaga

SEQ ID NO: 365178 - RNA, 19 nt, Homo sapiens
gcuauacucuaucuacaga

SEQ ID NO: 365179 - RNA, 19 nt, Homo sapiens
gcacagauaucuacaaaag

SEQ ID NO: 365180 - RNA, 19 nt, Homo sapiens
caauggaguucucucuauu

SEQ ID NO: 365181 - RNA, 19 nt, Homo sapiens
aggaauggcugcuuaguga

SEQ ID NO: 365182 - RNA, 19 nt, Homo sapiens
ccaaggaaauagagauuca

SEQ ID NO: 365183 - RNA, 19 nt, Homo sapiens
cagcagcaauggaacugua

SEQ ID NO: 365184 - RNA, 19 nt, Homo sapiens
gucaaggaauggcugcuua

SEQ ID NO: 365185 - RNA, 19 nt, Homo sapiens
guaauagucuugcagaaaa

SEQ ID NO: 365186 - RNA, 19 nt, Homo sapiens
cauccuggcuaacauggua

SEQ ID NO: 365187 - RNA, 19 nt, Homo sapiens
caacacaggcuuugaucuu

SEQ ID NO: 365188 - RNA, 19 nt, Homo sapiens
gcaaggaauacaagacaaa

SEQ ID NO: 365189 - RNA, 19 nt, Homo sapiens
ggacguuguuggagugaga

SEQ ID NO: 365190 - RNA, 19 nt, Homo sapiens
agaauggcaucauaaguga

SEQ ID NO: 365191 - RNA, 19 nt, Homo sapiens
aacaaagaauggcaucaua

SEQ ID NO: 365192 - RNA, 19 nt, Homo sapiens
ugaaagggauguuuaugca

SEQ ID NO: 365193 - RNA, 19 nt, Homo sapiens
ugacauacuuuaucuuugg

SEQ ID NO: 365194 - RNA, 19 nt, Homo sapiens
gauaggaucgguugggaaa

SEQ ID NO: 365195 - RNA, 19 nt, Homo sapiens
gacaucaucccuugguaua

SEQ ID NO: 365196 - RNA, 19 nt, Homo sapiens
gucaaagaauuccaaagaa

SEQ ID NO: 365197 - RNA, 19 nt, Homo sapiens
ucagcaaacugcgggaaua

SEQ ID NO: 365198 - RNA, 19 nt, Homo sapiens
ggcuagaguuuguaaauuc

SEQ ID NO: 365199 - RNA, 19 nt, Homo sapiens
gaaauacaaccagaaacaa

SEQ ID NO: 365200 - RNA, 19 nt, Homo sapiens
acauaaccauggugauuaa

SEQ ID NO: 365201 - RNA, 19 nt, Homo sapiens
cauaagugaugcuguuuca

SEQ ID NO: 365202 - RNA, 19 nt, Homo sapiens
uaagauugaugcuguuauc

SEQ ID NO: 365203 - RNA, 19 nt, Homo sapiens
gccaagugcugcaguuguu

SEQ ID NO: 365204 - RNA, 19 nt, Homo sapiens
gcacuacuugcuuauauug

SEQ ID NO: 365205 - RNA, 19 nt, Homo sapiens
caaauggguuaauccugaa

SEQ ID NO: 365206 - RNA, 19 nt, Homo sapiens
caauuaagagcaacaaaga

SEQ ID NO: 365207 - RNA, 19 nt, Homo sapiens
cuuggcagcuguuguaauu

SEQ ID NO: 365208 - RNA, 19 nt, Homo sapiens
guauggcaguuaaggaauu

SEQ ID NO: 365209 - RNA, 19 nt, Homo sapiens
aaacagugcuauucugagu

SEQ ID NO: 365210 - RNA, 19 nt, Homo sapiens
guauagguaugaucugugu

SEQ ID NO: 365211 - RNA, 19 nt, Homo sapiens
ucaagcgagucacgaauga

SEQ ID NO: 365212 - RNA, 19 nt, Homo sapiens
gacgguccaugaugcuaua

SEQ ID NO: 365213 - RNA, 19 nt, Homo sapiens
gaguucaguuuccuucuug

SEQ ID NO: 365214 - RNA, 19 nt, Homo sapiens
aggauaagauuccaguauu

SEQ ID NO: 365215 - RNA, 19 nt, Homo sapiens
gagcugcacugaucaccau

SEQ ID NO: 365216 - RNA, 19 nt, Homo sapiens
ggucuuggcagcuguugua

SEQ ID NO: 365217 - RNA, 19 nt, Homo sapiens
ugauuucacugcuggauug

SEQ ID NO: 365218 - RNA, 19 nt, Homo sapiens
acaauggaguucucucuau

SEQ ID NO: 365219 - RNA, 19 nt, Homo sapiens
guacuuggcagauccuuug

SEQ ID NO: 365220 - RNA, 19 nt, Homo sapiens
gaauucugguuguaaaucu

SEQ ID NO: 365221 - RNA, 19 nt, Homo sapiens
ggaagaagaacuugauguc

SEQ ID NO: 365222 - RNA, 19 nt, Homo sapiens
ucucacagcuaaagauugu

SEQ ID NO: 365223 - RNA, 19 nt, Homo sapiens
caaugugucuauuucugaa

SEQ ID NO: 365224 - RNA, 19 nt, Homo sapiens
uagaaaagcuggagcaaug

SEQ ID NO: 365225 - RNA, 19 nt, Homo sapiens
agaaguaauugugacgaua

SEQ ID NO: 365226 - RNA, 19 nt, Homo sapiens
ggacuuuucccauauauuu

SEQ ID NO: 365227 - RNA, 19 nt, Homo sapiens
ccaaauaccgagucaagga

SEQ ID NO: 365228 - RNA, 19 nt, Homo sapiens
caaagugaacguucccaaa

SEQ ID NO: 365229 - RNA, 19 nt, Homo sapiens
cagcaauggaacuguauua

SEQ ID NO: 365230 - RNA, 19 nt, Homo sapiens
ggugggaucuguuguucug

SEQ ID NO: 365231 - RNA, 19 nt, Homo sapiens
cagaaacaaugugucuauu

SEQ ID NO: 365232 - RNA, 19 nt, Homo sapiens
gaugcagacaaaugaaaua

SEQ ID NO: 365233 - RNA, 19 nt, Homo sapiens
cuacagaaccaggccaaua

SEQ ID NO: 365234 - RNA, 19 nt, Homo sapiens
uguaaggucacauuuagua

SEQ ID NO: 365235 - RNA, 19 nt, Homo sapiens
agacaaaacuuccucaaug

SEQ ID NO: 365236 - RNA, 19 nt, Homo sapiens
acaaagaauggcaucauaa

SEQ ID NO: 365237 - RNA, 19 nt, Homo sapiens
ggaauggccuuggaagcau

SEQ ID NO: 365238 - RNA, 19 nt, Homo sapiens
ggaauuugcuuagccuuua

SEQ ID NO: 365239 - RNA, 19 nt, Homo sapiens
caaaugaguucccuugauu

SEQ ID NO: 365240 - RNA, 19 nt, Homo sapiens
gcuuaaacauugccuuaua

SEQ ID NO: 365241 - RNA, 19 nt, Homo sapiens
gcaagagccuggaggagaa

SEQ ID NO: 365242 - RNA, 19 nt, Homo sapiens
gagaaaggcaaaccaauuu

SEQ ID NO: 365243 - RNA, 19 nt, Homo sapiens
acacagaaauccuaacauu

SEQ ID NO: 365244 - RNA, 19 nt, Homo sapiens
gcaaguuucucccaaguau

SEQ ID NO: 365245 - RNA, 19 nt, Homo sapiens
ucuaugauguccaaacuua

SEQ ID NO: 365246 - RNA, 19 nt, Homo sapiens
gcagagugcaggucauuua

SEQ ID NO: 365247 - RNA, 19 nt, Homo sapiens
gcagagaccuccugauguc

SEQ ID NO: 365248 - RNA, 19 nt, Homo sapiens
gagucaagcugaugaaguu

SEQ ID NO: 365249 - RNA, 19 nt, Homo sapiens
ccagguaucugaugauguu

SEQ ID NO: 365250 - RNA, 19 nt, Homo sapiens
gcuugagucuggauaauuu

SEQ ID NO: 365251 - RNA, 19 nt, Homo sapiens
ggagaaaggcaaaccaauu

SEQ ID NO: 365252 - RNA, 19 nt, Homo sapiens
gacagugccuaacuccuua

SEQ ID NO: 365253 - RNA, 19 nt, Homo sapiens
ccaaguaucucaacaaagg

SEQ ID NO: 365254 - RNA, 19 nt, Homo sapiens
ucauuuaucuucaggcuuu

SEQ ID NO: 365255 - RNA, 19 nt, Homo sapiens
guucugaaauggauagauu

SEQ ID NO: 365256 - RNA, 19 nt, Homo sapiens
guucacagcugccucuuug

SEQ ID NO: 365257 - RNA, 19 nt, Homo sapiens
gaacugacuuccugaacuc

SEQ ID NO: 365258 - RNA, 19 nt, Homo sapiens
ucacgugacuccucaauuc

SEQ ID NO: 365259 - RNA, 19 nt, Homo sapiens
gaauuugcuuagccuuuaa

SEQ ID NO: 365260 - RNA, 19 nt, Homo sapiens
ccagagcgauguguucuuu

SEQ ID NO: 365261 - RNA, 19 nt, Homo sapiens
cuaguggguuuaauguuua

SEQ ID NO: 365262 - RNA, 19 nt, Homo sapiens
gcacaaccauguucuugag

SEQ ID NO: 365263 - RNA, 19 nt, Homo sapiens
ucuaguggguuuaauguuu

SEQ ID NO: 365264 - RNA, 19 nt, Homo sapiens
uaaugcuucuuuccucuua

SEQ ID NO: 365265 - RNA, 19 nt, Homo sapiens
gggaagggcccuacaguga

SEQ ID NO: 365266 - RNA, 19 nt, Homo sapiens
guaagggacuccagaagca

SEQ ID NO: 365267 - RNA, 19 nt, Homo sapiens
ggacagugccuaacuccuu

SEQ ID NO: 365268 - RNA, 19 nt, Homo sapiens
gcagauaguauacacauca

SEQ ID NO: 365269 - RNA, 19 nt, Homo sapiens
gggaguauguuauuucucu

SEQ ID NO: 365270 - RNA, 19 nt, Homo sapiens
ccaaaugaguucccuugau

SEQ ID NO: 365271 - RNA, 19 nt, Homo sapiens
ggaguagagucaggagaaa

SEQ ID NO: 365272 - RNA, 19 nt, Homo sapiens
aggaagauccgaaugcuua

SEQ ID NO: 365273 - RNA, 19 nt, Homo sapiens
gaagaaauaugagcaugcu

SEQ ID NO: 365274 - RNA, 19 nt, Homo sapiens
gugccuaacuccuuacaga

SEQ ID NO: 365275 - RNA, 19 nt, Homo sapiens
caacaaaggagaacacucu

SEQ ID NO: 365276 - RNA, 19 nt, Homo sapiens
gagacgaugcuuuagguaa

SEQ ID NO: 365277 - RNA, 19 nt, Homo sapiens
aaacuuaacagaucacaug

SEQ ID NO: 365278 - RNA, 19 nt, Homo sapiens
ggagagaugccagagcuuu

SEQ ID NO: 365279 - RNA, 19 nt, Homo sapiens
gcaacaaacucaaaaugug

SEQ ID NO: 365280 - RNA, 19 nt, Homo sapiens
caggaacccuuacaguaga

SEQ ID NO: 365281 - RNA, 19 nt, Homo sapiens
cacagaaauccuaacauua

SEQ ID NO: 365282 - RNA, 19 nt, Homo sapiens
gaacugaagcagagucaag

SEQ ID NO: 365283 - RNA, 19 nt, Homo sapiens
ccucuugaaugcuuaaaug

SEQ ID NO: 365284 - RNA, 19 nt, Homo sapiens
cugaugauguucugaaaug

SEQ ID NO: 365285 - RNA, 19 nt, Homo sapiens
gagugcaggucauuuaucu

SEQ ID NO: 365286 - RNA, 19 nt, Homo sapiens
guaggucuaugauguccaa

SEQ ID NO: 365287 - RNA, 19 nt, Homo sapiens
aaacauugccuuauauugg

SEQ ID NO: 365288 - RNA, 19 nt, Homo sapiens
gagaugaggcuggauagga

SEQ ID NO: 365289 - RNA, 19 nt, Homo sapiens
gcauucauucauccucuua

SEQ ID NO: 365290 - RNA, 19 nt, Homo sapiens
ugaaggagcuggagaaaag

SEQ ID NO: 365291 - RNA, 19 nt, Homo sapiens
gagucuggauaauuuguau

SEQ ID NO: 365292 - RNA, 19 nt, Homo sapiens
ugucuugguuuccaucaaa

SEQ ID NO: 365293 - RNA, 19 nt, Homo sapiens
gaagcagagucaagcugau

SEQ ID NO: 365294 - RNA, 19 nt, Homo sapiens
ccucagcccucauuaaacu

SEQ ID NO: 365295 - RNA, 19 nt, Homo sapiens
gguuuaauguuuagucagu

SEQ ID NO: 365296 - RNA, 19 nt, Homo sapiens
gagaacacucugagcaaga

SEQ ID NO: 365297 - RNA, 19 nt, Homo sapiens
ucccaaguaucucaacaaa

SEQ ID NO: 365298 - RNA, 19 nt, Homo sapiens
gaagcagcagcuagaaaga

SEQ ID NO: 365299 - RNA, 19 nt, Homo sapiens
aagcuuaaacauugccuua

SEQ ID NO: 365300 - RNA, 19 nt, Homo sapiens
caucauaaacaaagaguag

SEQ ID NO: 365301 - RNA, 19 nt, Homo sapiens
uguccaaacuuaacagauc

SEQ ID NO: 365302 - RNA, 19 nt, Homo sapiens
gcagccucuugaaugcuua

SEQ ID NO: 365303 - RNA, 19 nt, Homo sapiens
ucaggaacccuuacaguag

SEQ ID NO: 365304 - RNA, 19 nt, Homo sapiens
gaucaggaacccuuacagu

SEQ ID NO: 365305 - RNA, 19 nt, Homo sapiens
ggucuaugauguccaaacu

SEQ ID NO: 365306 - RNA, 19 nt, Homo sapiens
cacaauaggcuuagugcuu

SEQ ID NO: 365307 - RNA, 19 nt, Homo sapiens
caagcucucugggucauuc

SEQ ID NO: 365308 - RNA, 19 nt, Homo sapiens
gaucaaggagggagaaagg

SEQ ID NO: 365309 - RNA, 19 nt, Homo sapiens
gcucagcucagcauugugu

SEQ ID NO: 365310 - RNA, 19 nt, Homo sapiens
cugaugaaguuaagcacaa

SEQ ID NO: 365311 - RNA, 19 nt, Homo sapiens
cuugaaugcuuaaaugauc

SEQ ID NO: 365312 - RNA, 19 nt, Homo sapiens
aacauugccuuauauugga

SEQ ID NO: 365313 - RNA, 19 nt, Homo sapiens
gcucagacaccuagacucu

SEQ ID NO: 365314 - RNA, 19 nt, Homo sapiens
gggucucucugacggguuu

SEQ ID NO: 365315 - RNA, 19 nt, Homo sapiens
caggagaugaggcuggaua

SEQ ID NO: 365316 - RNA, 19 nt, Homo sapiens
gugcaggucauuuaucuuc

SEQ ID NO: 365317 - RNA, 19 nt, Homo sapiens
ggagacgaugcuuuaggua

SEQ ID NO: 365318 - RNA, 19 nt, Homo sapiens
guccaaacuuaacagauca

SEQ ID NO: 365319 - RNA, 19 nt, Homo sapiens
gagcgauguguucuuugua

SEQ ID NO: 365320 - RNA, 19 nt, Homo sapiens
gcuuagugcuuggcucaga

SEQ ID NO: 365321 - RNA, 19 nt, Homo sapiens
augcuuaaaugaucaagga

SEQ ID NO: 365322 - RNA, 19 nt, Homo sapiens
ccagucuucuaguggguuu

SEQ ID NO: 365323 - RNA, 19 nt, Homo sapiens
agagcgauguguucuuugu

SEQ ID NO: 365324 - RNA, 19 nt, Homo sapiens
gaagcgcuauggcgguuuu

SEQ ID NO: 365325 - RNA, 19 nt, Homo sapiens
gaugauguucugaaaugga

SEQ ID NO: 365326 - RNA, 19 nt, Homo sapiens
ggaaccagagcgauguguu

SEQ ID NO: 365327 - RNA, 19 nt, Homo sapiens
gcaggucauuuaucuucag

SEQ ID NO: 365328 - RNA, 19 nt, Homo sapiens
gcgugggaguauguuauuu

SEQ ID NO: 365329 - RNA, 19 nt, Homo sapiens
ccaaggagcaggucaaacg

SEQ ID NO: 365330 - RNA, 19 nt, Homo sapiens
cagaagcagcagcuagaaa

SEQ ID NO: 365331 - RNA, 19 nt, Homo sapiens
gagcaggucaaacgcuaug

SEQ ID NO: 365332 - RNA, 19 nt, Homo sapiens
ucaagcugaugaaguuaag

SEQ ID NO: 365333 - RNA, 19 nt, Homo sapiens
gcagagucaagcugaugaa

SEQ ID NO: 365334 - RNA, 19 nt, Homo sapiens
gauggucccaaaccuauca

SEQ ID NO: 365335 - RNA, 19 nt, Homo sapiens
aguagaggguccagucuuc

SEQ ID NO: 365336 - RNA, 19 nt, Homo sapiens
ucauucauccucuuauaug

SEQ ID NO: 365337 - RNA, 19 nt, Homo sapiens
ucaagugggacaaccagaa

SEQ ID NO: 365338 - RNA, 19 nt, Homo sapiens
gaaagaaggccuaugauua

SEQ ID NO: 365339 - RNA, 19 nt, Homo sapiens
gaagaacaaugaucuggua

SEQ ID NO: 365340 - RNA, 19 nt, Homo sapiens
gaaaugaccuccaccuuca

SEQ ID NO: 365341 - RNA, 19 nt, Homo sapiens
ggacauagauucuggaagu

SEQ ID NO: 365342 - RNA, 19 nt, Homo sapiens
gagcaagguuugagugaua

SEQ ID NO: 365343 - RNA, 19 nt, Homo sapiens
ggugacagcugcuuauaaa

SEQ ID NO: 365344 - RNA, 19 nt, Homo sapiens
gaacaaugaucugguaguu

SEQ ID NO: 365345 - RNA, 19 nt, Homo sapiens
gaacagaaaggucaaauca

SEQ ID NO: 365346 - RNA, 19 nt, Homo sapiens
guacaugacugauauuaca

SEQ ID NO: 365347 - RNA, 19 nt, Homo sapiens
ggacaaagaagaacauaug

SEQ ID NO: 365348 - RNA, 19 nt, Homo sapiens
ggaaagaaggccuaugauu

SEQ ID NO: 365349 - RNA, 19 nt, Homo sapiens
gaaggccuaugauuauuuc

SEQ ID NO: 365350 - RNA, 19 nt, Homo sapiens
cagaggaaguagaucauaa

SEQ ID NO: 365351 - RNA, 19 nt, Homo sapiens
uaauagcuuuggcuguuua

SEQ ID NO: 365352 - RNA, 19 nt, Homo sapiens
aaagaaggccuaugauuau

SEQ ID NO: 365353 - RNA, 19 nt, Homo sapiens
ggcuauggcuuucacuuaa

SEQ ID NO: 365354 - RNA, 19 nt, Homo sapiens
gaucaauggugucuuugug

SEQ ID NO: 365355 - RNA, 19 nt, Homo sapiens
gcagacggcuaauuuaugc

SEQ ID NO: 365356 - RNA, 19 nt, Homo sapiens
auacagagaugugaugaaa

SEQ ID NO: 365357 - RNA, 19 nt, Homo sapiens
acagaaaggucaaaucauc

SEQ ID NO: 365358 - RNA, 19 nt, Homo sapiens
gaaaggaagcaauggcuau

SEQ ID NO: 365359 - RNA, 19 nt, Homo sapiens
gaugaugucucuuacuucu

SEQ ID NO: 365360 - RNA, 19 nt, Homo sapiens
uggaaacccuggaucauga

SEQ ID NO: 365361 - RNA, 19 nt, Homo sapiens
aaacacggguggacuugaa

SEQ ID NO: 365362 - RNA, 19 nt, Homo sapiens
uaggaucaauggugucuuu

SEQ ID NO: 365363 - RNA, 19 nt, Homo sapiens
ggaauucagugacuuuacu

SEQ ID NO: 365364 - RNA, 19 nt, Homo sapiens
uuuccaagcuucaacuuaa

SEQ ID NO: 365365 - RNA, 19 nt, Homo sapiens
guaauagcuuuggcuguuu

SEQ ID NO: 365366 - RNA, 19 nt, Homo sapiens
gcuauggcuuucacuuaaa

SEQ ID NO: 365367 - RNA, 19 nt, Homo sapiens
gaaggaaggaggcagcuau

SEQ ID NO: 365368 - RNA, 19 nt, Homo sapiens
guugugaccuguuuacugu

SEQ ID NO: 365369 - RNA, 19 nt, Homo sapiens
gucaagaacugcccaaugg

SEQ ID NO: 365370 - RNA, 19 nt, Homo sapiens
ccauuucucuacuaucaaa

SEQ ID NO: 365371 - RNA, 19 nt, Homo sapiens
caauggcuaugguuucuau

SEQ ID NO: 365372 - RNA, 19 nt, Homo sapiens
gagcagaagauacaauuca

SEQ ID NO: 365373 - RNA, 19 nt, Homo sapiens
uaugagagcuggaguucug

SEQ ID NO: 365374 - RNA, 19 nt, Homo sapiens
gcagauaagccuauuaaaa

SEQ ID NO: 365375 - RNA, 19 nt, Homo sapiens
gaucauaagccuaaacucu

SEQ ID NO: 365376 - RNA, 19 nt, Homo sapiens
gaagcaauggcuaugguuu

SEQ ID NO: 365377 - RNA, 19 nt, Homo sapiens
ggagacagaguucuuagga

SEQ ID NO: 365378 - RNA, 19 nt, Homo sapiens
acauuucucuguaugauga

SEQ ID NO: 365379 - RNA, 19 nt, Homo sapiens
ggaaaccauucaccaugug

SEQ ID NO: 365380 - RNA, 19 nt, Homo sapiens
gggugaaugugcuagauga

SEQ ID NO: 365381 - RNA, 19 nt, Homo sapiens
ggacaaagaaacugacaag

SEQ ID NO: 365382 - RNA, 19 nt, Homo sapiens
gaauggaggugugcaaacu

SEQ ID NO: 365383 - RNA, 19 nt, Homo sapiens
ccuguuuacugucucuuua

SEQ ID NO: 365384 - RNA, 19 nt, Homo sapiens
gaggcuggcuugaagaaca

SEQ ID NO: 365385 - RNA, 19 nt, Homo sapiens
gcaaaacuauggcuucuuc

SEQ ID NO: 365386 - RNA, 19 nt, Homo sapiens
uagcagauaagccuauuaa

SEQ ID NO: 365387 - RNA, 19 nt, Homo sapiens
ucacauucuucuuccaauu

SEQ ID NO: 365388 - RNA, 19 nt, Homo sapiens
ugaagugaauggagagaau

SEQ ID NO: 365389 - RNA, 19 nt, Homo sapiens
ggguguacaugacugauau

SEQ ID NO: 365390 - RNA, 19 nt, Homo sapiens
gcagaagauacaauucaaa

SEQ ID NO: 365391 - RNA, 19 nt, Homo sapiens
gauggagacagaguucuua

SEQ ID NO: 365392 - RNA, 19 nt, Homo sapiens
aguaauagcuuuggcuguu

SEQ ID NO: 365393 - RNA, 19 nt, Homo sapiens
uagaugaacccuaugagaa

SEQ ID NO: 365394 - RNA, 19 nt, Homo sapiens
uguacagacuggcucauuu

SEQ ID NO: 365395 - RNA, 19 nt, Homo sapiens
caaagagacggacaacaug

SEQ ID NO: 365396 - RNA, 19 nt, Homo sapiens
ucagugacuuuacuaguuc

SEQ ID NO: 365397 - RNA, 19 nt, Homo sapiens
guggaaagaaggccuauga

SEQ ID NO: 365398 - RNA, 19 nt, Homo sapiens
gagaucagacuucacuguu

SEQ ID NO: 365399 - RNA, 19 nt, Homo sapiens
uguaugaugaugucucuua

SEQ ID NO: 365400 - RNA, 19 nt, Homo sapiens
ugucuucuguuaucauuug

SEQ ID NO: 365401 - RNA, 19 nt, Homo sapiens
ugaaagaguugggucaaag

SEQ ID NO: 365402 - RNA, 19 nt, Homo sapiens
gacggcuaauuuaugcuua

SEQ ID NO: 365403 - RNA, 19 nt, Homo sapiens
uagcuuuggcuguuuauuu

SEQ ID NO: 365404 - RNA, 19 nt, Homo sapiens
gaaagagugggaauucagu

SEQ ID NO: 365405 - RNA, 19 nt, Homo sapiens
ggcuaugguuucuaucuga

SEQ ID NO: 365406 - RNA, 19 nt, Homo sapiens
aauguaaacuguccaagca

SEQ ID NO: 365407 - RNA, 19 nt, Homo sapiens
gagacagaguucuuaggau

SEQ ID NO: 365408 - RNA, 19 nt, Homo sapiens
uggcugggcuagaggauga

SEQ ID NO: 365409 - RNA, 19 nt, Homo sapiens
acaaagagacggacaacau

SEQ ID NO: 365410 - RNA, 19 nt, Homo sapiens
gaauuguggagaugaagaa

SEQ ID NO: 365411 - RNA, 19 nt, Homo sapiens
gaauucagugacuuuacua

SEQ ID NO: 365412 - RNA, 19 nt, Homo sapiens
aagaaggccuaugauuauu

SEQ ID NO: 365413 - RNA, 19 nt, Homo sapiens
gaaagaguugggucaaagu

SEQ ID NO: 365414 - RNA, 19 nt, Homo sapiens
gaagauacagagaugugau

SEQ ID NO: 365415 - RNA, 19 nt, Homo sapiens
guagaaaugauuagaaagg

SEQ ID NO: 365416 - RNA, 19 nt, Homo sapiens
caacggcgagucuguggaa

SEQ ID NO: 365417 - RNA, 19 nt, Homo sapiens
ugaaaacuguccaagguaa

SEQ ID NO: 365418 - RNA, 19 nt, Homo sapiens
ggagcaagguuugagugau

SEQ ID NO: 365419 - RNA, 19 nt, Homo sapiens
cagaaagagugggaauuca

SEQ ID NO: 365420 - RNA, 19 nt, Homo sapiens
uaaggcaagagcuagauuu

SEQ ID NO: 365421 - RNA, 19 nt, Homo sapiens
aaugaguugugaccuguuu

SEQ ID NO: 365422 - RNA, 19 nt, Homo sapiens
ggccuaugauuauuuccaa

SEQ ID NO: 365423 - RNA, 19 nt, Homo sapiens
gaaugucacacuucuaguc

SEQ ID NO: 365424 - RNA, 19 nt, Homo sapiens
ggagaucagacuucacugu

SEQ ID NO: 365425 - RNA, 19 nt, Homo sapiens
gcucugcuaucucgugaag

SEQ ID NO: 365426 - RNA, 19 nt, Homo sapiens
caagcuucaacuuaacuua

SEQ ID NO: 365427 - RNA, 19 nt, Homo sapiens
uggaaaccauucaccaugu

SEQ ID NO: 365428 - RNA, 19 nt, Homo sapiens
gauagcuguuucuggguau

SEQ ID NO: 365429 - RNA, 19 nt, Homo sapiens
agaaggugguggauagaau

SEQ ID NO: 365430 - RNA, 19 nt, Homo sapiens
ugacuuggcugggcuagag

SEQ ID NO: 365431 - RNA, 19 nt, Homo sapiens
caucaaagagguacagaag

SEQ ID NO: 365432 - RNA, 19 nt, Homo sapiens
agaggaggcuggcuugaag

SEQ ID NO: 365433 - RNA, 19 nt, Homo sapiens
gcaagaagggcaaaacuau

SEQ ID NO: 365434 - RNA, 19 nt, Homo sapiens
ucucuuacuucuacagguu

SEQ ID NO: 365435 - RNA, 19 nt, Homo sapiens
ugaugucucuuacuucuac

SEQ ID NO: 365436 - RNA, 19 nt, Homo sapiens
gcuauggcuucucucugaa

SEQ ID NO: 365437 - RNA, 19 nt, Homo sapiens
gaaggugguggauagaauc

SEQ ID NO: 365438 - RNA, 19 nt, Homo sapiens
gaacuuugccuauuucuua

SEQ ID NO: 365439 - RNA, 19 nt, Homo sapiens
gaaagcagauacucuagaa

SEQ ID NO: 365440 - RNA, 19 nt, Homo sapiens
gcaaugaaaccaauaaaug

SEQ ID NO: 365441 - RNA, 19 nt, Homo sapiens
caacaaggcuguguacuca

SEQ ID NO: 365442 - RNA, 19 nt, Homo sapiens
caagaccucugugcacuua

SEQ ID NO: 365443 - RNA, 19 nt, Homo sapiens
ucacaaagaucuaggaaag

SEQ ID NO: 365444 - RNA, 19 nt, Homo sapiens
ggcaaacccuucuaucaaa

SEQ ID NO: 365445 - RNA, 19 nt, Homo sapiens
gaagugaccagagcaauuu

SEQ ID NO: 365446 - RNA, 19 nt, Homo sapiens
caacagacauggcaacaag

SEQ ID NO: 365447 - RNA, 19 nt, Homo sapiens
gaacauccuuggaaauugg

SEQ ID NO: 365448 - RNA, 19 nt, Homo sapiens
gcaaugugcugugaaugaa

SEQ ID NO: 365449 - RNA, 19 nt, Homo sapiens
caaaugauccugcgguauu

SEQ ID NO: 365450 - RNA, 19 nt, Homo sapiens
acaaagaucuaggaaagaa

SEQ ID NO: 365451 - RNA, 19 nt, Homo sapiens
gcaaggccauugggauauu

SEQ ID NO: 365452 - RNA, 19 nt, Homo sapiens
ggaacauccuuggaaauug

SEQ ID NO: 365453 - RNA, 19 nt, Homo sapiens
gcaaacccuucuaucaaau

SEQ ID NO: 365454 - RNA, 19 nt, Homo sapiens
gaaggaagauacgauugug

SEQ ID NO: 365455 - RNA, 19 nt, Homo sapiens
gaagaaaggacuuauugca

SEQ ID NO: 365456 - RNA, 19 nt, Homo sapiens
guaccaagaacucaaauga

SEQ ID NO: 365457 - RNA, 19 nt, Homo sapiens
gggauauucugaaacuuga

SEQ ID NO: 365458 - RNA, 19 nt, Homo sapiens
ccagaaaucauaauucaga

SEQ ID NO: 365459 - RNA, 19 nt, Homo sapiens
uacaacaucuccuccauga

SEQ ID NO: 365460 - RNA, 19 nt, Homo sapiens
ucaccaagauagccucaaa

SEQ ID NO: 365461 - RNA, 19 nt, Homo sapiens
gggcaaggccauugggaua

SEQ ID NO: 365462 - RNA, 19 nt, Homo sapiens
ucugugcacuuauuuauga

SEQ ID NO: 365463 - RNA, 19 nt, Homo sapiens
gaaagaggccauccaaggu

SEQ ID NO: 365464 - RNA, 19 nt, Homo sapiens
gggcaaacccuucuaucaa

SEQ ID NO: 365465 - RNA, 19 nt, Homo sapiens
gugcagagauaaagaccuu

SEQ ID NO: 365466 - RNA, 19 nt, Homo sapiens
cagaggggcuguugaauuu

SEQ ID NO: 365467 - RNA, 19 nt, Homo sapiens
ccacugaagacgucgaaua

SEQ ID NO: 365468 - RNA, 19 nt, Homo sapiens
cagagacaguguacaguga

SEQ ID NO: 365469 - RNA, 19 nt, Homo sapiens
gaucuggucccaucaccua

SEQ ID NO: 365470 - RNA, 19 nt, Homo sapiens
caacaucuccuccaugaag

SEQ ID NO: 365471 - RNA, 19 nt, Homo sapiens
ggaaagaaggacacagaga

SEQ ID NO: 365472 - RNA, 19 nt, Homo sapiens
aauccauccugcuaaguua

SEQ ID NO: 365473 - RNA, 19 nt, Homo sapiens
ggacuuauugcagugguua

SEQ ID NO: 365474 - RNA, 19 nt, Homo sapiens
gcacagagaguuauuuuau

SEQ ID NO: 365475 - RNA, 19 nt, Homo sapiens
gcacaaaacagaaaaugaa

SEQ ID NO: 365476 - RNA, 19 nt, Homo sapiens
ccauugggauauucugaaa

SEQ ID NO: 365477 - RNA, 19 nt, Homo sapiens
gaacuccaacaacgagaaa

SEQ ID NO: 365478 - RNA, 19 nt, Homo sapiens
gcaacacaguccagauagu

SEQ ID NO: 365479 - RNA, 19 nt, Homo sapiens
caagaaagaggccauccaa

SEQ ID NO: 365480 - RNA, 19 nt, Homo sapiens
gggugacacuggacaagaa

SEQ ID NO: 365481 - RNA, 19 nt, Homo sapiens
aagcacagauguucuucaa

SEQ ID NO: 365482 - RNA, 19 nt, Homo sapiens
ccacagaacacagcaauuc

SEQ ID NO: 365483 - RNA, 19 nt, Homo sapiens
gaugagguccagauuucua

SEQ ID NO: 365484 - RNA, 19 nt, Homo sapiens
cacauuaagugcaccauuc

SEQ ID NO: 365485 - RNA, 19 nt, Homo sapiens
accagaugcuguucuauaa

SEQ ID NO: 365486 - RNA, 19 nt, Homo sapiens
acacagugcugaccagaca

SEQ ID NO: 365487 - RNA, 19 nt, Homo sapiens
guuggaacauccuuggaaa

SEQ ID NO: 365488 - RNA, 19 nt, Homo sapiens
ggaaagcagauacucuaga

SEQ ID NO: 365489 - RNA, 19 nt, Homo sapiens
ugucacagacucaagauuu

SEQ ID NO: 365490 - RNA, 19 nt, Homo sapiens
caacuacacgugcaaagug

SEQ ID NO: 365491 - RNA, 19 nt, Homo sapiens
gaaaaccacugcagaguac

SEQ ID NO: 365492 - RNA, 19 nt, Homo sapiens
caccagaugcuguucuaua

SEQ ID NO: 365493 - RNA, 19 nt, Homo sapiens
ugaaauaccaaccugaaga

SEQ ID NO: 365494 - RNA, 19 nt, Homo sapiens
ucuaucaaaugaccucaaa

SEQ ID NO: 365495 - RNA, 19 nt, Homo sapiens
ccagauuucuauccuguca

SEQ ID NO: 365496 - RNA, 19 nt, Homo sapiens
gaagagcacagagaguuau

SEQ ID NO: 365497 - RNA, 19 nt, Homo sapiens
ugaagagcacagagaguua

SEQ ID NO: 365498 - RNA, 19 nt, Homo sapiens
caaguaaaguuuuggagaa

SEQ ID NO: 365499 - RNA, 19 nt, Homo sapiens
gaaucuuccuucacacauc

SEQ ID NO: 365500 - RNA, 19 nt, Homo sapiens
cagaaucuaccaagaguga

SEQ ID NO: 365501 - RNA, 19 nt, Homo sapiens
ccggaaagcugucccugau

SEQ ID NO: 365502 - RNA, 19 nt, Homo sapiens
gaacaggagggagaguauu

SEQ ID NO: 365503 - RNA, 19 nt, Homo sapiens
guggaaagcagauacucua

SEQ ID NO: 365504 - RNA, 19 nt, Homo sapiens
uaucaaaugaccucaaaug

SEQ ID NO: 365505 - RNA, 19 nt, Homo sapiens
aagcaacacaguccagaua

SEQ ID NO: 365506 - RNA, 19 nt, Homo sapiens
cagcaucguggucaacaua

SEQ ID NO: 365507 - RNA, 19 nt, Homo sapiens
gcaacaaggcuguguacuc

SEQ ID NO: 365508 - RNA, 19 nt, Homo sapiens
uaaauguacugugauugug

SEQ ID NO: 365509 - RNA, 19 nt, Homo sapiens
gcagaugccaguggaaaug

SEQ ID NO: 365510 - RNA, 19 nt, Homo sapiens
ggaacaggagggagaguau

SEQ ID NO: 365511 - RNA, 19 nt, Homo sapiens
aaacccuucuaucaaauga

SEQ ID NO: 365512 - RNA, 19 nt, Homo sapiens
accaagaacucaaaugauc

SEQ ID NO: 365513 - RNA, 19 nt, Homo sapiens
aguggaacuuugccuauuu

SEQ ID NO: 365514 - RNA, 19 nt, Homo sapiens
gaagagcacaagaggagau

SEQ ID NO: 365515 - RNA, 19 nt, Homo sapiens
cagcaauuccucaggcuaa

SEQ ID NO: 365516 - RNA, 19 nt, Homo sapiens
gaacucagacgugcaguac

SEQ ID NO: 365517 - RNA, 19 nt, Homo sapiens
uuucuauccugucaaguaa

SEQ ID NO: 365518 - RNA, 19 nt, Homo sapiens
ugaccucgcccuccacaaa

SEQ ID NO: 365519 - RNA, 19 nt, Homo sapiens
agaccucugugcacuuauu

SEQ ID NO: 365520 - RNA, 19 nt, Homo sapiens
gauggaacuuagacagcaa

SEQ ID NO: 365521 - RNA, 19 nt, Homo sapiens
uggaagaaaggacuuauug

SEQ ID NO: 365522 - RNA, 19 nt, Homo sapiens
gcugcaaugugcugugaau

SEQ ID NO: 365523 - RNA, 19 nt, Homo sapiens
ggaacaggaccgcguuuua

SEQ ID NO: 365524 - RNA, 19 nt, Homo sapiens
cuucaaaggcuuguaguuu

SEQ ID NO: 365525 - RNA, 19 nt, Homo sapiens
gcaguacacggaaguucaa

SEQ ID NO: 365526 - RNA, 19 nt, Homo sapiens
ucccaucaccuauaaguuu

SEQ ID NO: 365527 - RNA, 19 nt, Homo sapiens
ccagaaggaagauacgauu

SEQ ID NO: 365528 - RNA, 19 nt, Homo sapiens
gaaauuggaagagcacaag

SEQ ID NO: 365529 - RNA, 19 nt, Homo sapiens
guacacggaaguucaagug

SEQ ID NO: 365530 - RNA, 19 nt, Homo sapiens
aaugucagaucccaauaug

SEQ ID NO: 365531 - RNA, 19 nt, Homo sapiens
cagaugcuguucuauaagg

SEQ ID NO: 365532 - RNA, 19 nt, Homo sapiens
gcucagcuccacauuaagu

SEQ ID NO: 365533 - RNA, 19 nt, Homo sapiens
cccaauacacuucacaauu

SEQ ID NO: 365534 - RNA, 19 nt, Homo sapiens
guacagugaaguccggaaa

SEQ ID NO: 365535 - RNA, 19 nt, Homo sapiens
ugucagaucccaauaugga

SEQ ID NO: 365536 - RNA, 19 nt, Homo sapiens
aacaggagggagaguauua

SEQ ID NO: 365537 - RNA, 19 nt, Homo sapiens
gagaauaguaccaagaacu

SEQ ID NO: 365538 - RNA, 19 nt, Homo sapiens
gagaagaagcugcgcauaa

SEQ ID NO: 365539 - RNA, 19 nt, Homo sapiens
agaagaagcugcgcauaaa

SEQ ID NO: 365540 - RNA, 19 nt, Homo sapiens
agacuucccucgaggauuu

SEQ ID NO: 365541 - RNA, 19 nt, Homo sapiens
gaaagugacccagaauuug

SEQ ID NO: 365542 - RNA, 19 nt, Homo sapiens
uaaccagccuuucaucuuc

SEQ ID NO: 365543 - RNA, 19 nt, Homo sapiens
ugaaagugacccagaauuu

SEQ ID NO: 365544 - RNA, 19 nt, Homo sapiens
ucaccgggcucucuacuau

SEQ ID NO: 365545 - RNA, 19 nt, Homo sapiens
ccgcuggacuaucaccuua

SEQ ID NO: 365546 - RNA, 19 nt, Homo sapiens
ucaccagacuuuagcaaga

SEQ ID NO: 365547 - RNA, 19 nt, Homo sapiens
ccucgaggauuucuacuug

SEQ ID NO: 365548 - RNA, 19 nt, Homo sapiens
agaugaagcugcaauccuu

SEQ ID NO: 365549 - RNA, 19 nt, Homo sapiens
ccaagucccugcaggagau

SEQ ID NO: 365550 - RNA, 19 nt, Homo sapiens
agacauccaugguaccuau

SEQ ID NO: 365551 - RNA, 19 nt, Homo sapiens
gcgaacagaauccaucauu

SEQ ID NO: 365552 - RNA, 19 nt, Homo sapiens
uguaagguuucaaugcaua

SEQ ID NO: 365553 - RNA, 19 nt, Homo sapiens
ugacauagaccgagaacug

SEQ ID NO: 365554 - RNA, 19 nt, Homo sapiens
gaagcugcaauccuuguuu

SEQ ID NO: 365555 - RNA, 19 nt, Homo sapiens
aaagugacccagaauuuga

SEQ ID NO: 365556 - RNA, 19 nt, Homo sapiens
ggcaguggguaacaaaguu

SEQ ID NO: 365557 - RNA, 19 nt, Homo sapiens
gcuauggcuuggauucaga

SEQ ID NO: 365558 - RNA, 19 nt, Homo sapiens
ugcaagagaucaacaacug

SEQ ID NO: 365559 - RNA, 19 nt, Homo sapiens
gagcggagcagcgaacaga

SEQ ID NO: 365560 - RNA, 19 nt, Homo sapiens
gcaguggguaacaaaguuu

SEQ ID NO: 365561 - RNA, 19 nt, Homo sapiens
gaaauucccgaugagauca

SEQ ID NO: 365562 - RNA, 19 nt, Homo sapiens
gggcuggcuuugaguggaa

SEQ ID NO: 365563 - RNA, 19 nt, Homo sapiens
aaguuugacuccagaaaga

SEQ ID NO: 365564 - RNA, 19 nt, Homo sapiens
gaucagcauucuccuucuc

SEQ ID NO: 365565 - RNA, 19 nt, Homo sapiens
ccuaauaucccaguuuaau

SEQ ID NO: 365566 - RNA, 19 nt, Homo sapiens
gcuccugucuccucucagu

SEQ ID NO: 365567 - RNA, 19 nt, Homo sapiens
ccuguaagguuucaaugca

SEQ ID NO: 365568 - RNA, 19 nt, Homo sapiens
gacauagaccgagaacuga

SEQ ID NO: 365569 - RNA, 19 nt, Homo sapiens
gaucagcagcccagacauc

SEQ ID NO: 365570 - RNA, 19 nt, Homo sapiens
gaacaccgggcuggcuuug

SEQ ID NO: 365571 - RNA, 19 nt, Homo sapiens
aagcugcaauccuuguuug

SEQ ID NO: 365572 - RNA, 19 nt, Homo sapiens
gaauuugaccuugauagag

SEQ ID NO: 365573 - RNA, 19 nt, Homo sapiens
gagccucaccuccgaguuc

SEQ ID NO: 365574 - RNA, 19 nt, Homo sapiens
ucagaucucagcugcaaga

SEQ ID NO: 365575 - RNA, 19 nt, Homo sapiens
ggaacaccgggcuggcuuu

SEQ ID NO: 365576 - RNA, 19 nt, Homo sapiens
caccagacuuuagcaagau

SEQ ID NO: 365577 - RNA, 19 nt, Homo sapiens
agaauuugaccuugauaga

SEQ ID NO: 365578 - RNA, 19 nt, Homo sapiens
ucucuacuaugacuugauc

SEQ ID NO: 365579 - RNA, 19 nt, Homo sapiens
ccgaugagaucagcauucu

SEQ ID NO: 365580 - RNA, 19 nt, Homo sapiens
accgggcucucuacuauga

SEQ ID NO: 365581 - RNA, 19 nt, Homo sapiens
ucgaggauuucuacuugga

SEQ ID NO: 365582 - RNA, 19 nt, Homo sapiens
gaagaagcugcgcauaaaa

SEQ ID NO: 365583 - RNA, 19 nt, Homo sapiens
ccccuaauaucccaguuua

SEQ ID NO: 365584 - RNA, 19 nt, Homo sapiens
acccagaauuugaccuuga

SEQ ID NO: 365585 - RNA, 19 nt, Homo sapiens
ccucccggaucgucuuuga

SEQ ID NO: 365586 - RNA, 19 nt, Homo sapiens
uuaaccagccuuucaucuu

SEQ ID NO: 365587 - RNA, 19 nt, Homo sapiens
gcuggacuaucaccuuaac

SEQ ID NO: 365588 - RNA, 19 nt, Homo sapiens
ccagaagaaccucaagagu

SEQ ID NO: 365589 - RNA, 19 nt, Homo sapiens
acaccgggcuggcuuugag

SEQ ID NO: 365590 - RNA, 19 nt, Homo sapiens
caccuuaaccagccuuuca

SEQ ID NO: 365591 - RNA, 19 nt, Homo sapiens
auucagaucucagcugcaa

SEQ ID NO: 365592 - RNA, 19 nt, Homo sapiens
ggauuucuacuuggaugaa

SEQ ID NO: 365593 - RNA, 19 nt, Homo sapiens
gguuucaaugcauacaaua

SEQ ID NO: 365594 - RNA, 19 nt, Homo sapiens
gugcuccugucuccucuca

SEQ ID NO: 365595 - RNA, 19 nt, Homo sapiens
gcggagcagcgaacagaau

SEQ ID NO: 365596 - RNA, 19 nt, Homo sapiens
gggcaguggguaacaaagu

SEQ ID NO: 365597 - RNA, 19 nt, Homo sapiens
gcgcauaaaauccagcuuu

SEQ ID NO: 365598 - RNA, 19 nt, Homo sapiens
gcucucuacuaugacuuga

SEQ ID NO: 365599 - RNA, 19 nt, Homo sapiens
cacgaaggcugccccugua

SEQ ID NO: 365600 - RNA, 19 nt, Homo sapiens
gaaggcgaagucaccaagu

SEQ ID NO: 365601 - RNA, 19 nt, Homo sapiens
ccagaauuugaccuugaua

SEQ ID NO: 365602 - RNA, 19 nt, Homo sapiens
cccagaauuugaccuugau

SEQ ID NO: 365603 - RNA, 19 nt, Homo sapiens
caaagaaguuccugaaaug

SEQ ID NO: 365604 - RNA, 19 nt, Homo sapiens
ccaaagaaguuccugaaau

SEQ ID NO: 365605 - RNA, 19 nt, Homo sapiens
gaaaguuacuccaaagaag

SEQ ID NO: 365606 - RNA, 19 nt, Homo sapiens
uaaacugccuucucugaaa

SEQ ID NO: 365607 - RNA, 19 nt, Homo sapiens
ggaagaaagccauuugcua

SEQ ID NO: 365608 - RNA, 19 nt, Homo sapiens
gaagugagcaagagauaug

SEQ ID NO: 365609 - RNA, 19 nt, Homo sapiens
gaaaauggaugagcuuuau

SEQ ID NO: 365610 - RNA, 19 nt, Homo sapiens
guaauggaaugugaaggua

SEQ ID NO: 365611 - RNA, 19 nt, Homo sapiens
aaccagagcuuccucaaga

SEQ ID NO: 365612 - RNA, 19 nt, Homo sapiens
gcacuuggcugcuguugcu

SEQ ID NO: 365613 - RNA, 19 nt, Homo sapiens
uaaaagagcuucuggaaac

SEQ ID NO: 365614 - RNA, 19 nt, Homo sapiens
gaagaagaggccaauggaa

SEQ ID NO: 365615 - RNA, 19 nt, Homo sapiens
guauggagguuuccugaag

SEQ ID NO: 365616 - RNA, 19 nt, Homo sapiens
caugagaggcuuaaagaga

SEQ ID NO: 365617 - RNA, 19 nt, Homo sapiens
gguaaacugccuucucuga

SEQ ID NO: 365618 - RNA, 19 nt, Homo sapiens
gcagugauaaugaggaaga

SEQ ID NO: 365619 - RNA, 19 nt, Homo sapiens
cgaaaguuacuccaaagaa

SEQ ID NO: 365620 - RNA, 19 nt, Homo sapiens
ggaagaagugagcaagaga

SEQ ID NO: 365621 - RNA, 19 nt, Homo sapiens
gaagaagugagcaagagau

SEQ ID NO: 365622 - RNA, 19 nt, Homo sapiens
ccucagaccugcuaaaaga

SEQ ID NO: 365623 - RNA, 19 nt, Homo sapiens
guaaacugccuucucugaa

SEQ ID NO: 365624 - RNA, 19 nt, Homo sapiens
aauggaaugugaagguaaa

SEQ ID NO: 365625 - RNA, 19 nt, Homo sapiens
augagaggcuuaaagagaa

SEQ ID NO: 365626 - RNA, 19 nt, Homo sapiens
gcgcgguuccugacacuuu

SEQ ID NO: 365627 - RNA, 19 nt, Homo sapiens
acuggaagaugaagccaaa

SEQ ID NO: 365628 - RNA, 19 nt, Homo sapiens
cuuccuggcuugcguaaug

SEQ ID NO: 365629 - RNA, 19 nt, Homo sapiens
cagaaacgguauggagguu

SEQ ID NO: 365630 - RNA, 19 nt, Homo sapiens
guggauggacuaccagaaa

SEQ ID NO: 365631 - RNA, 19 nt, Homo sapiens
ccauggagccagaagaaga

SEQ ID NO: 365632 - RNA, 19 nt, Homo sapiens
ggauggcagugauaaugag

SEQ ID NO: 365633 - RNA, 19 nt, Homo sapiens
ggaaugugaagguaaacug

SEQ ID NO: 365634 - RNA, 19 nt, Homo sapiens
gaggaagaagugagcaaga

SEQ ID NO: 365635 - RNA, 19 nt, Homo sapiens
acgacucgcuggccaauuc

SEQ ID NO: 365636 - RNA, 19 nt, Homo sapiens
gaagaggccaauggaagug

SEQ ID NO: 365637 - RNA, 19 nt, Homo sapiens
cggaggauuuaugagauuu

SEQ ID NO: 365638 - RNA, 19 nt, Homo sapiens
aagaagugagcaagagaua

SEQ ID NO: 365639 - RNA, 19 nt, Homo sapiens
gcaccagcacccucagaga

SEQ ID NO: 365640 - RNA, 19 nt, Homo sapiens
gauaaugaggaagaaguga

SEQ ID NO: 365641 - RNA, 19 nt, Homo sapiens
ccaccaggauggcagugau

SEQ ID NO: 365642 - RNA, 19 nt, Homo sapiens
caccagcacccucagagaa

SEQ ID NO: 365643 - RNA, 19 nt, Homo sapiens
auacggaggauuuaugaga

SEQ ID NO: 365644 - RNA, 19 nt, Homo sapiens
ggaagaugaagccaaagag

SEQ ID NO: 365645 - RNA, 19 nt, Homo sapiens
uggcagugauaaugaggaa

SEQ ID NO: 365646 - RNA, 19 nt, Homo sapiens
caggauggcagugauaaug

SEQ ID NO: 365647 - RNA, 19 nt, Homo sapiens
uaauggaaugugaagguaa

SEQ ID NO: 365648 - RNA, 19 nt, Homo sapiens
cagaagaagaggccaaugg

SEQ ID NO: 365649 - RNA, 19 nt, Homo sapiens
agaagaagaggccaaugga

SEQ ID NO: 365650 - RNA, 19 nt, Homo sapiens
acggaggauuuaugagauu

SEQ ID NO: 365651 - RNA, 19 nt, Homo sapiens
gcuaaaagagcuucuggaa

SEQ ID NO: 365652 - RNA, 19 nt, Homo sapiens
uacggaggauuuaugagau

SEQ ID NO: 365653 - RNA, 19 nt, Homo sapiens
gguauggaggcuucaugaa

SEQ ID NO: 365654 - RNA, 19 nt, Homo sapiens
aaacugccuucucugaaaa

SEQ ID NO: 365655 - RNA, 19 nt, Homo sapiens
agauacggaggauuuauga

SEQ ID NO: 365656 - RNA, 19 nt, Homo sapiens
ccagagcuuccucaagaug

SEQ ID NO: 365657 - RNA, 19 nt, Homo sapiens
aaaguuacuccaaagaagu

SEQ ID NO: 365658 - RNA, 19 nt, Homo sapiens
agaagaggccaauggaagu

SEQ ID NO: 365659 - RNA, 19 nt, Homo sapiens
uagcaaaccggaagaaagc

SEQ ID NO: 365660 - RNA, 19 nt, Homo sapiens
ugagaggcuuaaagagaag

SEQ ID NO: 365661 - RNA, 19 nt, Homo sapiens
caauuccucagaccugcua

SEQ ID NO: 365662 - RNA, 19 nt, Homo sapiens
caaaccagagcuuccucaa

SEQ ID NO: 365663 - RNA, 19 nt, Homo sapiens
gggcuucaugagaggcuua

SEQ ID NO: 365664 - RNA, 19 nt, Homo sapiens
gugcagcuaccgccuagug

SEQ ID NO: 365665 - RNA, 19 nt, Homo sapiens
caccaggauggcagugaua

SEQ ID NO: 365666 - RNA, 19 nt, Homo sapiens
ggacgacucgcuggccaau

SEQ ID NO: 365667 - RNA, 19 nt, Homo sapiens
gaagaaaauggaugagcuu

SEQ ID NO: 365668 - RNA, 19 nt, Homo sapiens
aaagauacggaggauuuau

SEQ ID NO: 365669 - RNA, 19 nt, Homo sapiens
aagaaguuccugaaaugga

SEQ ID NO: 365670 - RNA, 19 nt, Homo sapiens
uggaagaugaagccaaaga

SEQ ID NO: 365671 - RNA, 19 nt, Homo sapiens
uggcuugcguaauggaaug

SEQ ID NO: 365672 - RNA, 19 nt, Homo sapiens
gguauggagguuuccugaa

SEQ ID NO: 365673 - RNA, 19 nt, Homo sapiens
cagagugguggauggacua

SEQ ID NO: 365674 - RNA, 19 nt, Homo sapiens
gugauaaugaggaagaagu

SEQ ID NO: 365675 - RNA, 19 nt, Homo sapiens
ccgaaugcagccaggauug

SEQ ID NO: 365676 - RNA, 19 nt, Homo sapiens
cguaauggaaugugaaggu

SEQ ID NO: 365677 - RNA, 19 nt, Homo sapiens
gaaagaauauggguuggaa

SEQ ID NO: 365678 - RNA, 19 nt, Homo sapiens
guucugcgcuauaccaaua

SEQ ID NO: 365679 - RNA, 19 nt, Homo sapiens
gaucccagcuucggcauuu

SEQ ID NO: 365680 - RNA, 19 nt, Homo sapiens
cgacaucaccugcuccuuu

SEQ ID NO: 365681 - RNA, 19 nt, Homo sapiens
auaaugcuguccuuuagua

SEQ ID NO: 365682 - RNA, 19 nt, Homo sapiens
ccaaggagcacuucaagga

SEQ ID NO: 365683 - RNA, 19 nt, Homo sapiens
aaauaaugcuguccuuuag

SEQ ID NO: 365684 - RNA, 19 nt, Homo sapiens
gaaagauccauuccaagga

SEQ ID NO: 365685 - RNA, 19 nt, Homo sapiens
ggaagucgacccuguuugu

SEQ ID NO: 365686 - RNA, 19 nt, Homo sapiens
gacaucaccugcuccuuuc

SEQ ID NO: 365687 - RNA, 19 nt, Homo sapiens
ggaaugaaacccugaaggu

SEQ ID NO: 365688 - RNA, 19 nt, Homo sapiens
cgacaugggcggugaguau

SEQ ID NO: 365689 - RNA, 19 nt, Homo sapiens
gaagucaacaauaccauuc

SEQ ID NO: 365690 - RNA, 19 nt, Homo sapiens
gcuauggugucaucgaugu

SEQ ID NO: 365691 - RNA, 19 nt, Homo sapiens
ucugauacuuucugucaaa

SEQ ID NO: 365692 - RNA, 19 nt, Homo sapiens
ccucuguccuccucacuuu

SEQ ID NO: 365693 - RNA, 19 nt, Homo sapiens
gcacuccaguagcgagaga

SEQ ID NO: 365694 - RNA, 19 nt, Homo sapiens
gaagcauuucugauacuuu

SEQ ID NO: 365695 - RNA, 19 nt, Homo sapiens
aagcauuucugauacuuuc

SEQ ID NO: 365696 - RNA, 19 nt, Homo sapiens
gcaggcaccaccuuuaauc

SEQ ID NO: 365697 - RNA, 19 nt, Homo sapiens
gcaauaaaagguuuccuaa

SEQ ID NO: 365698 - RNA, 19 nt, Homo sapiens
aagugggaaugaaagaaua

SEQ ID NO: 365699 - RNA, 19 nt, Homo sapiens
aaaucaauaugcagaaugg

SEQ ID NO: 365700 - RNA, 19 nt, Homo sapiens
caaguucgaagucaacaau

SEQ ID NO: 365701 - RNA, 19 nt, Homo sapiens
ggugaucgacagcggcaua

SEQ ID NO: 365702 - RNA, 19 nt, Homo sapiens
gcacuguggaagagauuga

SEQ ID NO: 365703 - RNA, 19 nt, Homo sapiens
gugagcggcugcggaagaa

SEQ ID NO: 365704 - RNA, 19 nt, Homo sapiens
gaacucagccgugcuacac

SEQ ID NO: 365705 - RNA, 19 nt, Homo sapiens
uggaggagcuggcccacau

SEQ ID NO: 365706 - RNA, 19 nt, Homo sapiens
ucgaccaccuccuggauga

SEQ ID NO: 365707 - RNA, 19 nt, Homo sapiens
ccagaaggccgucuaugag

SEQ ID NO: 365708 - RNA, 19 nt, Homo sapiens
acucagccgugcuacacua

SEQ ID NO: 365709 - RNA, 19 nt, Homo sapiens
ccaccuggaugggaaagau

SEQ ID NO: 365710 - RNA, 19 nt, Homo sapiens
gaaaauaaugcuguccuuu

SEQ ID NO: 365711 - RNA, 19 nt, Homo sapiens
cgaagucaacaauaccauu

SEQ ID NO: 365712 - RNA, 19 nt, Homo sapiens
gucuugcugucauuuauau

SEQ ID NO: 365713 - RNA, 19 nt, Homo sapiens
gagacggcacccagaauca

SEQ ID NO: 365714 - RNA, 19 nt, Homo sapiens
gagagacggcacccagaau

SEQ ID NO: 365715 - RNA, 19 nt, Homo sapiens
cgagagacggcacccagaa

SEQ ID NO: 365716 - RNA, 19 nt, Homo sapiens
aaguagagccagccagaaa

SEQ ID NO: 365717 - RNA, 19 nt, Homo sapiens
ucacgggcuuggccacuuc

SEQ ID NO: 365718 - RNA, 19 nt, Homo sapiens
ucaacaauaccauucuuca

SEQ ID NO: 365719 - RNA, 19 nt, Homo sapiens
ucagcaaguucgaagucaa

SEQ ID NO: 365720 - RNA, 19 nt, Homo sapiens
gugucuugcugucauuuau

SEQ ID NO: 365721 - RNA, 19 nt, Homo sapiens
guccuuuaguagcaaguaa

SEQ ID NO: 365722 - RNA, 19 nt, Homo sapiens
gaccgaacgauccagaaug

SEQ ID NO: 365723 - RNA, 19 nt, Homo sapiens
guagagccagccagaaauc

SEQ ID NO: 365724 - RNA, 19 nt, Homo sapiens
gaagucgacccuguuugug

SEQ ID NO: 365725 - RNA, 19 nt, Homo sapiens
aaagugggaaugaaagaau

SEQ ID NO: 365726 - RNA, 19 nt, Homo sapiens
aaugaaggcuguaaaagug

SEQ ID NO: 365727 - RNA, 19 nt, Homo sapiens
ccaguacguagaugagauu

SEQ ID NO: 365728 - RNA, 19 nt, Homo sapiens
gcugucauuuauauuccuu

SEQ ID NO: 365729 - RNA, 19 nt, Homo sapiens
acaugggcggugaguauua

SEQ ID NO: 365730 - RNA, 19 nt, Homo sapiens
gagguaaugaaggcuguaa

SEQ ID NO: 365731 - RNA, 19 nt, Homo sapiens
aaaugugucuugcugucau

SEQ ID NO: 365732 - RNA, 19 nt, Homo sapiens
gaucgacagcggcauagag

SEQ ID NO: 365733 - RNA, 19 nt, Homo sapiens
accagaaggccgucuauga

SEQ ID NO: 365734 - RNA, 19 nt, Homo sapiens
gacaugggcggugaguauu

SEQ ID NO: 365735 - RNA, 19 nt, Homo sapiens
ggauauggagcuggagguu

SEQ ID NO: 365736 - RNA, 19 nt, Homo sapiens
cuuauuaaaugagcgacuu

SEQ ID NO: 365737 - RNA, 19 nt, Homo sapiens
cagcuucggcauuugauca

SEQ ID NO: 365738 - RNA, 19 nt, Homo sapiens
auauggagcuggagguucu

SEQ ID NO: 365739 - RNA, 19 nt, Homo sapiens
agucaacaauaccauucuu

SEQ ID NO: 365740 - RNA, 19 nt, Homo sapiens
gcaaguucgaagucaacaa

SEQ ID NO: 365741 - RNA, 19 nt, Homo sapiens
cgaccgaacgauccagaau

SEQ ID NO: 365742 - RNA, 19 nt, Homo sapiens
gguaaugaaggcuguaaaa

SEQ ID NO: 365743 - RNA, 19 nt, Homo sapiens
uugcaggcaccaccuuuaa

SEQ ID NO: 365744 - RNA, 19 nt, Homo sapiens
gcuggagguucugcgcuau

SEQ ID NO: 365745 - RNA, 19 nt, Homo sapiens
caaguagagccagccagaa

SEQ ID NO: 365746 - RNA, 19 nt, Homo sapiens
ugucuugcugucauuuaua

SEQ ID NO: 365747 - RNA, 19 nt, Homo sapiens
gacggcacccagaaucaga

SEQ ID NO: 365748 - RNA, 19 nt, Homo sapiens
aagaauauggguuggaaag

SEQ ID NO: 365749 - RNA, 19 nt, Homo sapiens
caucagcaaguucgaaguc

SEQ ID NO: 365750 - RNA, 19 nt, Homo sapiens
gggcugcacuuauuuauug

SEQ ID NO: 365751 - RNA, 19 nt, Homo sapiens
ggacaaaguugcugacaag

SEQ ID NO: 365752 - RNA, 19 nt, Homo sapiens
gggaccaggugauuaagua

SEQ ID NO: 365753 - RNA, 19 nt, Homo sapiens
gaacucagauguggcuaga

SEQ ID NO: 365754 - RNA, 19 nt, Homo sapiens
gaaccaggauaccuucuca

SEQ ID NO: 365755 - RNA, 19 nt, Homo sapiens
caacagcaaugguucaagu

SEQ ID NO: 365756 - RNA, 19 nt, Homo sapiens
cagcugagccugaaucuga

SEQ ID NO: 365757 - RNA, 19 nt, Homo sapiens
ccacacaagcaaauacuuu

SEQ ID NO: 365758 - RNA, 19 nt, Homo sapiens
gaagcgcccugcuaugucu

SEQ ID NO: 365759 - RNA, 19 nt, Homo sapiens
gggaguaugucaccaugga

SEQ ID NO: 365760 - RNA, 19 nt, Homo sapiens
gaacuucucaacccucaga

SEQ ID NO: 365761 - RNA, 19 nt, Homo sapiens
ccaauaaggcggagagugu

SEQ ID NO: 365762 - RNA, 19 nt, Homo sapiens
ccagugacuuuccaacaga

SEQ ID NO: 365763 - RNA, 19 nt, Homo sapiens
ggccgaaucgucuacauuu

SEQ ID NO: 365764 - RNA, 19 nt, Homo sapiens
gcacaucacgucugaguac

SEQ ID NO: 365765 - RNA, 19 nt, Homo sapiens
ccagggacaugaccucugu

SEQ ID NO: 365766 - RNA, 19 nt, Homo sapiens
gccgauggcauuuguguuu

SEQ ID NO: 365767 - RNA, 19 nt, Homo sapiens
gccugaaucugacucuuga

SEQ ID NO: 365768 - RNA, 19 nt, Homo sapiens
gguacuggcugugaucgaa

SEQ ID NO: 365769 - RNA, 19 nt, Homo sapiens
uuacgaagcuccccggaua

SEQ ID NO: 365770 - RNA, 19 nt, Homo sapiens
ggcaaggacucagaaggaa

SEQ ID NO: 365771 - RNA, 19 nt, Homo sapiens
gggcaaggacucagaagga

SEQ ID NO: 365772 - RNA, 19 nt, Homo sapiens
ucacugaguccuccaauca

SEQ ID NO: 365773 - RNA, 19 nt, Homo sapiens
gugggagucuucuaugguu

SEQ ID NO: 365774 - RNA, 19 nt, Homo sapiens
gaagaaggcaggagcucau

SEQ ID NO: 365775 - RNA, 19 nt, Homo sapiens
ccagugaccugcucgaacu

SEQ ID NO: 365776 - RNA, 19 nt, Homo sapiens
gcaguuccauugccuacag

SEQ ID NO: 365777 - RNA, 19 nt, Homo sapiens
uaccagccauuccgccuaa

SEQ ID NO: 365778 - RNA, 19 nt, Homo sapiens
ccucagagacuuagaucuu

SEQ ID NO: 365779 - RNA, 19 nt, Homo sapiens
ggcugccucuggccucuua

SEQ ID NO: 365780 - RNA, 19 nt, Homo sapiens
caacgggcaugagucuaga

SEQ ID NO: 365781 - RNA, 19 nt, Homo sapiens
ggaaacugcaccagcuaga

SEQ ID NO: 365782 - RNA, 19 nt, Homo sapiens
gagcacaucacgucugagu

SEQ ID NO: 365783 - RNA, 19 nt, Homo sapiens
ccacccagcaguuccauug

SEQ ID NO: 365784 - RNA, 19 nt, Homo sapiens
gagcagccacacaagcaaa

SEQ ID NO: 365785 - RNA, 19 nt, Homo sapiens
ccagaacccucgggcugaa

SEQ ID NO: 365786 - RNA, 19 nt, Homo sapiens
uggaggagcuggagcacau

SEQ ID NO: 365787 - RNA, 19 nt, Homo sapiens
ccauccagcuauccuuaug

SEQ ID NO: 365788 - RNA, 19 nt, Homo sapiens
ggaugugggagucuucuau

SEQ ID NO: 365789 - RNA, 19 nt, Homo sapiens
gaacucaugacagcacuuc

SEQ ID NO: 365790 - RNA, 19 nt, Homo sapiens
gcuccaggaucccauuugg

SEQ ID NO: 365791 - RNA, 19 nt, Homo sapiens
uggagcacaucacgucuga

SEQ ID NO: 365792 - RNA, 19 nt, Homo sapiens
gaggcuuucuucuccuaug

SEQ ID NO: 365793 - RNA, 19 nt, Homo sapiens
gaagcagcagccucgguuu

SEQ ID NO: 365794 - RNA, 19 nt, Homo sapiens
gcucuccacuccagcucaa

SEQ ID NO: 365795 - RNA, 19 nt, Homo sapiens
ccuuggugcucccuaacua

SEQ ID NO: 365796 - RNA, 19 nt, Homo sapiens
cgacaccacugccgaucca

SEQ ID NO: 365797 - RNA, 19 nt, Homo sapiens
gcuccaccaucguccaugu

SEQ ID NO: 365798 - RNA, 19 nt, Homo sapiens
gccagugacuuuccaacag

SEQ ID NO: 365799 - RNA, 19 nt, Homo sapiens
guucaggccucagggacuu

SEQ ID NO: 365800 - RNA, 19 nt, Homo sapiens
gagagcagcaagagcacaa

SEQ ID NO: 365801 - RNA, 19 nt, Homo sapiens
gcagccacacaagcaaaua

SEQ ID NO: 365802 - RNA, 19 nt, Homo sapiens
caccagggccagcagcuuu

SEQ ID NO: 365803 - RNA, 19 nt, Homo sapiens
caucacgucugaguacaca

SEQ ID NO: 365804 - RNA, 19 nt, Homo sapiens
agugucaccucccaccuuu

SEQ ID NO: 365805 - RNA, 19 nt, Homo sapiens
ugccuucucuguucuguuc

SEQ ID NO: 365806 - RNA, 19 nt, Homo sapiens
gcucgaacuucugcugcaa

SEQ ID NO: 365807 - RNA, 19 nt, Homo sapiens
cagcaccacuaagcguaaa

SEQ ID NO: 365808 - RNA, 19 nt, Homo sapiens
ucucaggacuuggcuaugg

SEQ ID NO: 365809 - RNA, 19 nt, Homo sapiens
ggagucggacaucaucaug

SEQ ID NO: 365810 - RNA, 19 nt, Homo sapiens
ucaacugccuggacagcau

SEQ ID NO: 365811 - RNA, 19 nt, Homo sapiens
gacaagaggauuuucacua

SEQ ID NO: 365812 - RNA, 19 nt, Homo sapiens
gccgaaucgucuacauuuc

SEQ ID NO: 365813 - RNA, 19 nt, Homo sapiens
gggagcagcacccaagauc

SEQ ID NO: 365814 - RNA, 19 nt, Homo sapiens
ucgaacuucugcugcaaga

SEQ ID NO: 365815 - RNA, 19 nt, Homo sapiens
ccaacgggcaugagucuag

SEQ ID NO: 365816 - RNA, 19 nt, Homo sapiens
uggacagcauccucaggua

SEQ ID NO: 365817 - RNA, 19 nt, Homo sapiens
uggacaaaguugcugacaa

SEQ ID NO: 365818 - RNA, 19 nt, Homo sapiens
gcucucaggacuuggcuau

SEQ ID NO: 365819 - RNA, 19 nt, Homo sapiens
gcugugaucgaacuucuca

SEQ ID NO: 365820 - RNA, 19 nt, Homo sapiens
uugcagagcgcauccauuc

SEQ ID NO: 365821 - RNA, 19 nt, Homo sapiens
gaugugggagucuucuaug

SEQ ID NO: 365822 - RNA, 19 nt, Homo sapiens
gggccgaaucgucuacauu

SEQ ID NO: 365823 - RNA, 19 nt, Homo sapiens
ggacucagaaggaacucau

SEQ ID NO: 365824 - RNA, 19 nt, Homo sapiens
gcagcaagagcacaaacuc

SEQ ID NO: 365825 - RNA, 19 nt, Homo sapiens
gguuggggcugcacuuauu

SEQ ID NO: 365826 - RNA, 19 nt, Homo sapiens
ccaaucaggacgcacuuuc

SEQ ID NO: 365827 - RNA, 19 nt, Homo sapiens
cuucuccuaugucccaauu

SEQ ID NO: 365828 - RNA, 19 nt, Homo sapiens
gaugccaacagcaaugguu

SEQ ID NO: 365829 - RNA, 19 nt, Homo sapiens
gcucacgccaccaccagaa

SEQ ID NO: 365830 - RNA, 19 nt, Homo sapiens
gcaccacuaagcguaaaug

SEQ ID NO: 365831 - RNA, 19 nt, Homo sapiens
caugcuggcuauccacaag

SEQ ID NO: 365832 - RNA, 19 nt, Homo sapiens
ucagaaggaacucaugaca

SEQ ID NO: 365833 - RNA, 19 nt, Homo sapiens
uugugucuguuacuacuuu

SEQ ID NO: 365834 - RNA, 19 nt, Homo sapiens
gaaggcaggagcucaucca

SEQ ID NO: 365835 - RNA, 19 nt, Homo sapiens
ccagcaccacuaagcguaa

SEQ ID NO: 365836 - RNA, 19 nt, Homo sapiens
gcgcauccauucggguuac

SEQ ID NO: 365837 - RNA, 19 nt, Homo sapiens
caagauccgggucucagau

SEQ ID NO: 365838 - RNA, 19 nt, Homo sapiens
ggacuuuacccaggagaag

SEQ ID NO: 365839 - RNA, 19 nt, Homo sapiens
gagccugaaucugacucuu

SEQ ID NO: 365840 - RNA, 19 nt, Homo sapiens
cagagcagccacacaagca

SEQ ID NO: 365841 - RNA, 19 nt, Homo sapiens
ugaggaggccgagaggaaa

SEQ ID NO: 365842 - RNA, 19 nt, Homo sapiens
ccaagauccgggucucaga

SEQ ID NO: 365843 - RNA, 19 nt, Homo sapiens
gagugucaccucccaccuu

SEQ ID NO: 365844 - RNA, 19 nt, Homo sapiens
cccagcuucucccaccaua

SEQ ID NO: 365845 - RNA, 19 nt, Homo sapiens
cucauccaguccagccuua

SEQ ID NO: 365846 - RNA, 19 nt, Homo sapiens
gagcagcacccaagauccu

SEQ ID NO: 365847 - RNA, 19 nt, Homo sapiens
cccggacucuccacuguuc

SEQ ID NO: 365848 - RNA, 19 nt, Homo sapiens
caaguggcaaugaguccaa

SEQ ID NO: 365849 - RNA, 19 nt, Homo sapiens
ucuccuaugucccaauucu

SEQ ID NO: 365850 - RNA, 19 nt, Homo sapiens
caaaugggcugcuguggua

SEQ ID NO: 365851 - RNA, 19 nt, Homo sapiens
gaacacagcuucacuuugc

SEQ ID NO: 365852 - RNA, 19 nt, Homo sapiens
gaggaaaggugaacacaaa

SEQ ID NO: 365853 - RNA, 19 nt, Homo sapiens
gagaguggaugccaauaua

SEQ ID NO: 365854 - RNA, 19 nt, Homo sapiens
gaacgaaacacgcucauuu

SEQ ID NO: 365855 - RNA, 19 nt, Homo sapiens
gcucugaacugccacauaa

SEQ ID NO: 365856 - RNA, 19 nt, Homo sapiens
gaacggaagugaagaaucu

SEQ ID NO: 365857 - RNA, 19 nt, Homo sapiens
gagagaagcuuguccaaca

SEQ ID NO: 365858 - RNA, 19 nt, Homo sapiens
guaacaccuucuuguauua

SEQ ID NO: 365859 - RNA, 19 nt, Homo sapiens
ggaaauucaugcccagauu

SEQ ID NO: 365860 - RNA, 19 nt, Homo sapiens
agaagaagcugucauugug

SEQ ID NO: 365861 - RNA, 19 nt, Homo sapiens
ggaguaacaccuucuugua

SEQ ID NO: 365862 - RNA, 19 nt, Homo sapiens
cagcagugguuaaggagua

SEQ ID NO: 365863 - RNA, 19 nt, Homo sapiens
gaaauucagaggcaaauca

SEQ ID NO: 365864 - RNA, 19 nt, Homo sapiens
gcagauccagucaugauaa

SEQ ID NO: 365865 - RNA, 19 nt, Homo sapiens
cagcagaggcucccaauug

SEQ ID NO: 365866 - RNA, 19 nt, Homo sapiens
gaggugaaauucugaacga

SEQ ID NO: 365867 - RNA, 19 nt, Homo sapiens
aaugggagcuugauauaug

SEQ ID NO: 365868 - RNA, 19 nt, Homo sapiens
ccugcaggcuaccaaauua

SEQ ID NO: 365869 - RNA, 19 nt, Homo sapiens
ccacagcuauggcguuaau

SEQ ID NO: 365870 - RNA, 19 nt, Homo sapiens
gagaagaagcugucauugu

SEQ ID NO: 365871 - RNA, 19 nt, Homo sapiens
ugaagaaucucaacagcau

SEQ ID NO: 365872 - RNA, 19 nt, Homo sapiens
gaacgaagucggccuacug

SEQ ID NO: 365873 - RNA, 19 nt, Homo sapiens
ccacagcaagugaucaaua

SEQ ID NO: 365874 - RNA, 19 nt, Homo sapiens
gaaagcugaugcccaugug

SEQ ID NO: 365875 - RNA, 19 nt, Homo sapiens
ugacaggccuggcucugaa

SEQ ID NO: 365876 - RNA, 19 nt, Homo sapiens
aaacaggacuacagguuca

SEQ ID NO: 365877 - RNA, 19 nt, Homo sapiens
gaagaagcugucauuguga

SEQ ID NO: 365878 - RNA, 19 nt, Homo sapiens
cgacauguccuguggagaa

SEQ ID NO: 365879 - RNA, 19 nt, Homo sapiens
gggcugcugugguagguuu

SEQ ID NO: 365880 - RNA, 19 nt, Homo sapiens
cucagacgcucauugauuu

SEQ ID NO: 365881 - RNA, 19 nt, Homo sapiens
ugaaugggagcuugauaua

SEQ ID NO: 365882 - RNA, 19 nt, Homo sapiens
aguaacaccuucuuguauu

SEQ ID NO: 365883 - RNA, 19 nt, Homo sapiens
gaguaacaccuucuuguau

SEQ ID NO: 365884 - RNA, 19 nt, Homo sapiens
caacaggagguguguagaa

SEQ ID NO: 365885 - RNA, 19 nt, Homo sapiens
cacagcaagugaucaauau

SEQ ID NO: 365886 - RNA, 19 nt, Homo sapiens
gcaaaagccuccacgacaa

SEQ ID NO: 365887 - RNA, 19 nt, Homo sapiens
gagcagauccagucaugau

SEQ ID NO: 365888 - RNA, 19 nt, Homo sapiens
ggaaaggugaacacaaaug

SEQ ID NO: 365889 - RNA, 19 nt, Homo sapiens
cagauccagucaugauaaa

SEQ ID NO: 365890 - RNA, 19 nt, Homo sapiens
cagggcagauuguuucaga

SEQ ID NO: 365891 - RNA, 19 nt, Homo sapiens
gaaaggugaacacaaaugg

SEQ ID NO: 365892 - RNA, 19 nt, Homo sapiens
ucuaaacucuucucuggau

SEQ ID NO: 365893 - RNA, 19 nt, Homo sapiens
ugugguagguuuggaaauu

SEQ ID NO: 365894 - RNA, 19 nt, Homo sapiens
cagcaagugaucaauauug

SEQ ID NO: 365895 - RNA, 19 nt, Homo sapiens
cagauuuccuccaacucua

SEQ ID NO: 365896 - RNA, 19 nt, Homo sapiens
gaaugggagcuugauauau

SEQ ID NO: 365897 - RNA, 19 nt, Homo sapiens
gaacugccacauaaacaag

SEQ ID NO: 365898 - RNA, 19 nt, Homo sapiens
gcguuaaugucaccagugu

SEQ ID NO: 365899 - RNA, 19 nt, Homo sapiens
ccagagcuauaaauaaacu

SEQ ID NO: 365900 - RNA, 19 nt, Homo sapiens
gguaauggaugugaagaac

SEQ ID NO: 365901 - RNA, 19 nt, Homo sapiens
ggaacacagcuucacuuug

SEQ ID NO: 365902 - RNA, 19 nt, Homo sapiens
ggugaaauucugaacgaaa

SEQ ID NO: 365903 - RNA, 19 nt, Homo sapiens
cagcaccuccaaauucuuu

SEQ ID NO: 365904 - RNA, 19 nt, Homo sapiens
ccaguguucucacccucua

SEQ ID NO: 365905 - RNA, 19 nt, Homo sapiens
ccgagcagauccagucaug

SEQ ID NO: 365906 - RNA, 19 nt, Homo sapiens
cuggacagcagaacaauuu

SEQ ID NO: 365907 - RNA, 19 nt, Homo sapiens
gaaaacaggacuacagguu

SEQ ID NO: 365908 - RNA, 19 nt, Homo sapiens
gaagugaagaaucucaaca

SEQ ID NO: 365909 - RNA, 19 nt, Homo sapiens
ggagcaagacaguggcaaa

SEQ ID NO: 365910 - RNA, 19 nt, Homo sapiens
ccaagacggugaggaucaa

SEQ ID NO: 365911 - RNA, 19 nt, Homo sapiens
caagggacaacaacaaaca

SEQ ID NO: 365912 - RNA, 19 nt, Homo sapiens
ucucagacgcucauugauu

SEQ ID NO: 365913 - RNA, 19 nt, Homo sapiens
ccccagagcuauaaauaaa

SEQ ID NO: 365914 - RNA, 19 nt, Homo sapiens
uaauggaugugaagaacag

SEQ ID NO: 365915 - RNA, 19 nt, Homo sapiens
gaagagggaaggcaagacu

SEQ ID NO: 365916 - RNA, 19 nt, Homo sapiens
gugaaauucugaacgaaac

SEQ ID NO: 365917 - RNA, 19 nt, Homo sapiens
aagaaguccuuguuugaca

SEQ ID NO: 365918 - RNA, 19 nt, Homo sapiens
uguuggagauacuguuaaa

SEQ ID NO: 365919 - RNA, 19 nt, Homo sapiens
ggagaagaagcugucauug

SEQ ID NO: 365920 - RNA, 19 nt, Homo sapiens
ggcccauccucaaguggua

SEQ ID NO: 365921 - RNA, 19 nt, Homo sapiens
gaagcagagucaggugauc

SEQ ID NO: 365922 - RNA, 19 nt, Homo sapiens
cuugauauauggcgucugu

SEQ ID NO: 365923 - RNA, 19 nt, Homo sapiens
gugaaugggagcuugauau

SEQ ID NO: 365924 - RNA, 19 nt, Homo sapiens
uauguuggagauacuguua

SEQ ID NO: 365925 - RNA, 19 nt, Homo sapiens
guuaaugucaccaguguuc

SEQ ID NO: 365926 - RNA, 19 nt, Homo sapiens
gaagcuuguccaacaguau

SEQ ID NO: 365927 - RNA, 19 nt, Homo sapiens
ugagaauggaggugaaauu

SEQ ID NO: 365928 - RNA, 19 nt, Homo sapiens
agaagcuuguccaacagua

SEQ ID NO: 365929 - RNA, 19 nt, Homo sapiens
gcagacccacagcaaguga

SEQ ID NO: 365930 - RNA, 19 nt, Homo sapiens
caaugaacuugagaaugga

SEQ ID NO: 365931 - RNA, 19 nt, Homo sapiens
ggaagacguugggcuuucg

SEQ ID NO: 365932 - RNA, 19 nt, Homo sapiens
ccacauccaaccagauuag

SEQ ID NO: 365933 - RNA, 19 nt, Homo sapiens
uggagaagaagcugucauu

SEQ ID NO: 365934 - RNA, 19 nt, Homo sapiens
gcccagauuuccuccaacu

SEQ ID NO: 365935 - RNA, 19 nt, Homo sapiens
aaugagagacaaagaagga

SEQ ID NO: 365936 - RNA, 19 nt, Homo sapiens
ugagaguggaugccaauau

SEQ ID NO: 365937 - RNA, 19 nt, Homo sapiens
gcucccaauugcugugaau

SEQ ID NO: 365938 - RNA, 19 nt, Homo sapiens
gcccaagggacaacaacaa

SEQ ID NO: 365939 - RNA, 19 nt, Homo sapiens
gggugcaccaugucaauga

SEQ ID NO: 365940 - RNA, 19 nt, Homo sapiens
uuucagcaccuccaaauuc

SEQ ID NO: 365941 - RNA, 19 nt, Homo sapiens
gaguggaugccaauauauc

SEQ ID NO: 365942 - RNA, 19 nt, Homo sapiens
cuccaacucuaaacucuuc

SEQ ID NO: 365943 - RNA, 19 nt, Homo sapiens
gugguagguuuggaaauuc

SEQ ID NO: 365944 - RNA, 19 nt, Homo sapiens
gcucugccacucugugaug

SEQ ID NO: 365945 - RNA, 19 nt, Homo sapiens
uggaacacagcuucacuuu

SEQ ID NO: 365946 - RNA, 19 nt, Homo sapiens
ugagagacaaagaaggaaa

SEQ ID NO: 365947 - RNA, 19 nt, Homo sapiens
guccacauccaaccagauu

SEQ ID NO: 365948 - RNA, 19 nt, Homo sapiens
ugaacugccacauaaacaa

SEQ ID NO: 365949 - RNA, 19 nt, Homo sapiens
gauccagucaugauaaagg

SEQ ID NO: 365950 - RNA, 19 nt, Homo sapiens
gaacaaagaugugaaauuc

SEQ ID NO: 365951 - RNA, 19 nt, Homo sapiens
gaagaugacuggaagaauu

SEQ ID NO: 365952 - RNA, 19 nt, Homo sapiens
ggaauggacuugaagaauu

SEQ ID NO: 365953 - RNA, 19 nt, Homo sapiens
ggacaagauugguggguua

SEQ ID NO: 365954 - RNA, 19 nt, Homo sapiens
gaaauuaacagacaaguug

SEQ ID NO: 365955 - RNA, 19 nt, Homo sapiens
ucaaggaguucacauauuu

SEQ ID NO: 365956 - RNA, 19 nt, Homo sapiens
gaugugaaauucuguguaa

SEQ ID NO: 365957 - RNA, 19 nt, Homo sapiens
ggagagaguugacuguaaa

SEQ ID NO: 365958 - RNA, 19 nt, Homo sapiens
gaacaaugccaucaaauau

SEQ ID NO: 365959 - RNA, 19 nt, Homo sapiens
ccaaauuguugcacuaaua

SEQ ID NO: 365960 - RNA, 19 nt, Homo sapiens
gaacaaagagaucaacuga

SEQ ID NO: 365961 - RNA, 19 nt, Homo sapiens
uccaagaucucuaaaguua

SEQ ID NO: 365962 - RNA, 19 nt, Homo sapiens
ggaagagacuaaauauaga

SEQ ID NO: 365963 - RNA, 19 nt, Homo sapiens
gaauggacuugaagaauug

SEQ ID NO: 365964 - RNA, 19 nt, Homo sapiens
gcaaguuuauggacuauga

SEQ ID NO: 365965 - RNA, 19 nt, Homo sapiens
ggauugagauuaauacugu

SEQ ID NO: 365966 - RNA, 19 nt, Homo sapiens
gcagaagacuacaauacaa

SEQ ID NO: 365967 - RNA, 19 nt, Homo sapiens
gaaucaagcuauagaagug

SEQ ID NO: 365968 - RNA, 19 nt, Homo sapiens
ccaagcaacuucagucaaa

SEQ ID NO: 365969 - RNA, 19 nt, Homo sapiens
gccaagaacuuacacaaga

SEQ ID NO: 365970 - RNA, 19 nt, Homo sapiens
gagcccagcuuuacuguga

SEQ ID NO: 365971 - RNA, 19 nt, Homo sapiens
gaucaggugucacgucuug

SEQ ID NO: 365972 - RNA, 19 nt, Homo sapiens
ccaguuaccugccaaguau

SEQ ID NO: 365973 - RNA, 19 nt, Homo sapiens
gaaauggaaccucuucuga

SEQ ID NO: 365974 - RNA, 19 nt, Homo sapiens
ggaauucccaguuguauau

SEQ ID NO: 365975 - RNA, 19 nt, Homo sapiens
caaagcaacagcaaaguaa

SEQ ID NO: 365976 - RNA, 19 nt, Homo sapiens
gggaaucacugaaucuaau

SEQ ID NO: 365977 - RNA, 19 nt, Homo sapiens
agaaaggaaugaugaaaga

SEQ ID NO: 365978 - RNA, 19 nt, Homo sapiens
gcuggaaacugacaccaaa

SEQ ID NO: 365979 - RNA, 19 nt, Homo sapiens
gcauguagcuaaagaaacu

SEQ ID NO: 365980 - RNA, 19 nt, Homo sapiens
cuacauccuuuacuuguuu

SEQ ID NO: 365981 - RNA, 19 nt, Homo sapiens
gggcagauaucaguauuau

SEQ ID NO: 365982 - RNA, 19 nt, Homo sapiens
ugccaaguauccagaauua

SEQ ID NO: 365983 - RNA, 19 nt, Homo sapiens
caagaucucuaaaguuaca

SEQ ID NO: 365984 - RNA, 19 nt, Homo sapiens
gaagagaccagaaaggaau

SEQ ID NO: 365985 - RNA, 19 nt, Homo sapiens
ggaacaaagaugugaaauu

SEQ ID NO: 365986 - RNA, 19 nt, Homo sapiens
gaaguuaggcagauacuca

SEQ ID NO: 365987 - RNA, 19 nt, Homo sapiens
ccaaagcaaucuguaaaga

SEQ ID NO: 365988 - RNA, 19 nt, Homo sapiens
cagcugaugucucuuguug

SEQ ID NO: 365989 - RNA, 19 nt, Homo sapiens
gugaggaaauugacuuuau

SEQ ID NO: 365990 - RNA, 19 nt, Homo sapiens
caucaucaguagcaaguuu

SEQ ID NO: 365991 - RNA, 19 nt, Homo sapiens
gaacuuacacaagaacaaa

SEQ ID NO: 365992 - RNA, 19 nt, Homo sapiens
gauuugagcucacaauguc

SEQ ID NO: 365993 - RNA, 19 nt, Homo sapiens
ccaaguauccagaauuauu

SEQ ID NO: 365994 - RNA, 19 nt, Homo sapiens
ugaacaaugccaucaaaua

SEQ ID NO: 365995 - RNA, 19 nt, Homo sapiens
guagcaaguuuauggacua

SEQ ID NO: 365996 - RNA, 19 nt, Homo sapiens
uggaagcucuuaugaauca

SEQ ID NO: 365997 - RNA, 19 nt, Homo sapiens
ggguuuaacugaaaucaau

SEQ ID NO: 365998 - RNA, 19 nt, Homo sapiens
guaaugaucaggauugaga

SEQ ID NO: 365999 - RNA, 19 nt, Homo sapiens
ccaagaacuuacacaagaa

SEQ ID NO: 366000 - RNA, 19 nt, Homo sapiens
gaauguggcuuagaucagu

SEQ ID NO: 366001 - RNA, 19 nt, Homo sapiens
ggugucacgucuugaaauu

SEQ ID NO: 366002 - RNA, 19 nt, Homo sapiens
ucaguuggauggaguagaa

SEQ ID NO: 366003 - RNA, 19 nt, Homo sapiens
acaagaggguugccaagaa

SEQ ID NO: 366004 - RNA, 19 nt, Homo sapiens
aauggaaccucuucugauu

SEQ ID NO: 366005 - RNA, 19 nt, Homo sapiens
gaggaagagacuaaauaua

SEQ ID NO: 366006 - RNA, 19 nt, Homo sapiens
acaccaaacuccuuauuca

SEQ ID NO: 366007 - RNA, 19 nt, Homo sapiens
uuagaucagucccuuguuu

SEQ ID NO: 366008 - RNA, 19 nt, Homo sapiens
gcacgagagaguagaauga

SEQ ID NO: 366009 - RNA, 19 nt, Homo sapiens
acaaagaugugaaauucug

SEQ ID NO: 366010 - RNA, 19 nt, Homo sapiens
aagauggacugaaggaauu

SEQ ID NO: 366011 - RNA, 19 nt, Homo sapiens
agucagagauuccaguuga

SEQ ID NO: 366012 - RNA, 19 nt, Homo sapiens
ccaaaugguggaacuaauu

SEQ ID NO: 366013 - RNA, 19 nt, Homo sapiens
gaaaauguggcugaaauua

SEQ ID NO: 366014 - RNA, 19 nt, Homo sapiens
gaaguuaccccuaaaauuc

SEQ ID NO: 366015 - RNA, 19 nt, Homo sapiens
ccaaagcaacagcaaagua

SEQ ID NO: 366016 - RNA, 19 nt, Homo sapiens
caucaccuuuguagcauuu

SEQ ID NO: 366017 - RNA, 19 nt, Homo sapiens
gagggcagauaucaguauu

SEQ ID NO: 366018 - RNA, 19 nt, Homo sapiens
ucaccagccugcauucuug

SEQ ID NO: 366019 - RNA, 19 nt, Homo sapiens
ggacugugauauaaacaag

SEQ ID NO: 366020 - RNA, 19 nt, Homo sapiens
gaaguuugguugcacugau

SEQ ID NO: 366021 - RNA, 19 nt, Homo sapiens
caauacaaguccuucuaga

SEQ ID NO: 366022 - RNA, 19 nt, Homo sapiens
ucucuaaaguuacaaccua

SEQ ID NO: 366023 - RNA, 19 nt, Homo sapiens
cauaaacacugugccauuc

SEQ ID NO: 366024 - RNA, 19 nt, Homo sapiens
ggaagagaccagaaaggaa

SEQ ID NO: 366025 - RNA, 19 nt, Homo sapiens
aaacuuggacucucaaaug

SEQ ID NO: 366026 - RNA, 19 nt, Homo sapiens
cacacaagaccauccauua

SEQ ID NO: 366027 - RNA, 19 nt, Homo sapiens
gauagugaccuaagucugu

SEQ ID NO: 366028 - RNA, 19 nt, Homo sapiens
ggauggaguagaaggcuua

SEQ ID NO: 366029 - RNA, 19 nt, Homo sapiens
caaacuggaugcccaugug

SEQ ID NO: 366030 - RNA, 19 nt, Homo sapiens
aaagcaaucuguaaagaag

SEQ ID NO: 366031 - RNA, 19 nt, Homo sapiens
gcuggaaacuaaagaugga

SEQ ID NO: 366032 - RNA, 19 nt, Homo sapiens
gaggaagaauuuauuaagc

SEQ ID NO: 366033 - RNA, 19 nt, Homo sapiens
gguaauaucagaggaagaa

SEQ ID NO: 366034 - RNA, 19 nt, Homo sapiens
cuagagagaauuuaccuaa

SEQ ID NO: 366035 - RNA, 19 nt, Homo sapiens
caugggaccaggaauauuu

SEQ ID NO: 366036 - RNA, 19 nt, Homo sapiens
gaccagaaaggaaugauga

SEQ ID NO: 366037 - RNA, 19 nt, Homo sapiens
aagcugaugcugaauauaa

SEQ ID NO: 366038 - RNA, 19 nt, Homo sapiens
gaucaacaaacguacauau

SEQ ID NO: 366039 - RNA, 19 nt, Homo sapiens
ugaucaggauugagauuaa

SEQ ID NO: 366040 - RNA, 19 nt, Homo sapiens
gaaccaaccaggaccaauc

SEQ ID NO: 366041 - RNA, 19 nt, Homo sapiens
gcuuaggccuggucgacua

SEQ ID NO: 366042 - RNA, 19 nt, Homo sapiens
gagagaguagaaugaauuu

SEQ ID NO: 366043 - RNA, 19 nt, Homo sapiens
guaaagaagcauuugacaa

SEQ ID NO: 366044 - RNA, 19 nt, Homo sapiens
caaagcaaucuguaaagaa

SEQ ID NO: 366045 - RNA, 19 nt, Homo sapiens
aaucagaacuuggaaaugg

SEQ ID NO: 366046 - RNA, 19 nt, Homo sapiens
uacuggagcugaucugaaa

SEQ ID NO: 366047 - RNA, 19 nt, Homo sapiens
cagaugauguugaccuuca

SEQ ID NO: 366048 - RNA, 19 nt, Homo sapiens
caaauacauuggagcaagu

SEQ ID NO: 366049 - RNA, 19 nt, Homo sapiens
uaaacaaguucaccgaucu

SEQ ID NO: 366050 - RNA, 19 nt, Homo sapiens
ggaaggaaguccagagaaa

SEQ ID NO: 366051 - RNA, 19 nt, Homo sapiens
ggccagagcucauuaacau

SEQ ID NO: 366052 - RNA, 19 nt, Homo sapiens
uaugacagcugcccucaaa

SEQ ID NO: 366053 - RNA, 19 nt, Homo sapiens
agcaacagcucaagagaua

SEQ ID NO: 366054 - RNA, 19 nt, Homo sapiens
caaaggaagcugcucauug

SEQ ID NO: 366055 - RNA, 19 nt, Homo sapiens
uugaugaacuggacucuuu

SEQ ID NO: 366056 - RNA, 19 nt, Homo sapiens
gauaucuccugccuacuug

SEQ ID NO: 366057 - RNA, 19 nt, Homo sapiens
gcugggaccucucugauag

SEQ ID NO: 366058 - RNA, 19 nt, Homo sapiens
ggaccugccugcugaugug

SEQ ID NO: 366059 - RNA, 19 nt, Homo sapiens
cuacagcacuaauggaaau

SEQ ID NO: 366060 - RNA, 19 nt, Homo sapiens
aaaggaagcugcucauugc

SEQ ID NO: 366061 - RNA, 19 nt, Homo sapiens
gggagggacuggagauuca

SEQ ID NO: 366062 - RNA, 19 nt, Homo sapiens
ggagagcucagaauucaga

SEQ ID NO: 366063 - RNA, 19 nt, Homo sapiens
gcaaguagagauccuggaa

SEQ ID NO: 366064 - RNA, 19 nt, Homo sapiens
gagaaaggcccaucuacuc

SEQ ID NO: 366065 - RNA, 19 nt, Homo sapiens
gcgcggaccucuacucucu

SEQ ID NO: 366066 - RNA, 19 nt, Homo sapiens
gaucaagaacucagguuug

SEQ ID NO: 366067 - RNA, 19 nt, Homo sapiens
gcaccaggaucaagaacuc

SEQ ID NO: 366068 - RNA, 19 nt, Homo sapiens
agacagcauuuccucauga

SEQ ID NO: 366069 - RNA, 19 nt, Homo sapiens
ggaaggggauguucuaugu

SEQ ID NO: 366070 - RNA, 19 nt, Homo sapiens
gaaaugggagagcucagaa

SEQ ID NO: 366071 - RNA, 19 nt, Homo sapiens
agagagaucugggaaggaa

SEQ ID NO: 366072 - RNA, 19 nt, Homo sapiens
ugcauuaucuucuuugaug

SEQ ID NO: 366073 - RNA, 19 nt, Homo sapiens
gcugugugcugccggcuuu

SEQ ID NO: 366074 - RNA, 19 nt, Homo sapiens
gcauuaucuucuuugauga

SEQ ID NO: 366075 - RNA, 19 nt, Homo sapiens
cgaggugccugcucuguca

SEQ ID NO: 366076 - RNA, 19 nt, Homo sapiens
gcacucaggauguguuugu

SEQ ID NO: 366077 - RNA, 19 nt, Homo sapiens
gcagcuccaugcauuaucu

SEQ ID NO: 366078 - RNA, 19 nt, Homo sapiens
gaaugugcgggaaguguuu

SEQ ID NO: 366079 - RNA, 19 nt, Homo sapiens
uaagagaaaggcccaucua

SEQ ID NO: 366080 - RNA, 19 nt, Homo sapiens
gaacuuggcacagcuagca

SEQ ID NO: 366081 - RNA, 19 nt, Homo sapiens
ugggagagcucagaauuca

SEQ ID NO: 366082 - RNA, 19 nt, Homo sapiens
ggaucaagaacucagguuu

SEQ ID NO: 366083 - RNA, 19 nt, Homo sapiens
gggaagaccacaguaguug

SEQ ID NO: 366084 - RNA, 19 nt, Homo sapiens
ggaaaugggagagcucaga

SEQ ID NO: 366085 - RNA, 19 nt, Homo sapiens
ccagagaguuacacaucga

SEQ ID NO: 366086 - RNA, 19 nt, Homo sapiens
caggauguguuugugauug

SEQ ID NO: 366087 - RNA, 19 nt, Homo sapiens
ugguaaacgugcuagauug

SEQ ID NO: 366088 - RNA, 19 nt, Homo sapiens
caacagcucaagagauauc

SEQ ID NO: 366089 - RNA, 19 nt, Homo sapiens
cagagcucauuaacaugua

SEQ ID NO: 366090 - RNA, 19 nt, Homo sapiens
gaauucagagguacuugga

SEQ ID NO: 366091 - RNA, 19 nt, Homo sapiens
gcuugucccugccacuuug

SEQ ID NO: 366092 - RNA, 19 nt, Homo sapiens
gcaaaguggcauugagaca

SEQ ID NO: 366093 - RNA, 19 nt, Homo sapiens
ccagagcucauuaacaugu

SEQ ID NO: 366094 - RNA, 19 nt, Homo sapiens
gcagacagcauuuccucau

SEQ ID NO: 366095 - RNA, 19 nt, Homo sapiens
ggcugcagguaccuugaua

SEQ ID NO: 366096 - RNA, 19 nt, Homo sapiens
ugcaggaggugaagaagga

SEQ ID NO: 366097 - RNA, 19 nt, Homo sapiens
ucaguguccuggcaugaug

SEQ ID NO: 366098 - RNA, 19 nt, Homo sapiens
agaguuacacaucgaaauu

SEQ ID NO: 366099 - RNA, 19 nt, Homo sapiens
cagcuacgcguucuaagug

SEQ ID NO: 366100 - RNA, 19 nt, Homo sapiens
cagacagcauuuccucaug

SEQ ID NO: 366101 - RNA, 19 nt, Homo sapiens
uuccauggcucccuucaga

SEQ ID NO: 366102 - RNA, 19 nt, Homo sapiens
ggagaucccagggugcaaa

SEQ ID NO: 366103 - RNA, 19 nt, Homo sapiens
ucucugcucugaugcuaug

SEQ ID NO: 366104 - RNA, 19 nt, Homo sapiens
gcagcaacagcucaagaga

SEQ ID NO: 366105 - RNA, 19 nt, Homo sapiens
gugcaaaguggcauugaga

SEQ ID NO: 366106 - RNA, 19 nt, Homo sapiens
ggagcacccugagcuacug

SEQ ID NO: 366107 - RNA, 19 nt, Homo sapiens
ccacccauaccuccuugua

SEQ ID NO: 366108 - RNA, 19 nt, Homo sapiens
ccagguggcgggaaauguu

SEQ ID NO: 366109 - RNA, 19 nt, Homo sapiens
gaaauuaugacgguguucu

SEQ ID NO: 366110 - RNA, 19 nt, Homo sapiens
gagaguuacacaucgaaau

SEQ ID NO: 366111 - RNA, 19 nt, Homo sapiens
gagagucaucgaacacuuc

SEQ ID NO: 366112 - RNA, 19 nt, Homo sapiens
gaacuagcaguguccuucu

SEQ ID NO: 366113 - RNA, 19 nt, Homo sapiens
agaaaggcccaucuacuca

SEQ ID NO: 366114 - RNA, 19 nt, Homo sapiens
gccagagagucaucgaaca

SEQ ID NO: 366115 - RNA, 19 nt, Homo sapiens
uaucuucuuugaugaacug

SEQ ID NO: 366116 - RNA, 19 nt, Homo sapiens
caugcauuaucuucuuuga

SEQ ID NO: 366117 - RNA, 19 nt, Homo sapiens
gggccaaagugaggagaau

SEQ ID NO: 366118 - RNA, 19 nt, Homo sapiens
gaaggaaguccagagaaac

SEQ ID NO: 366119 - RNA, 19 nt, Homo sapiens
acaucgaaauugugucuuc

SEQ ID NO: 366120 - RNA, 19 nt, Homo sapiens
gaguuacacaucgaaauug

SEQ ID NO: 366121 - RNA, 19 nt, Homo sapiens
gcccaucuacucaggaaga

SEQ ID NO: 366122 - RNA, 19 nt, Homo sapiens
gagaaugugcgggaagugu

SEQ ID NO: 366123 - RNA, 19 nt, Homo sapiens
ucaccuugggcuccacuua

SEQ ID NO: 366124 - RNA, 19 nt, Homo sapiens
caacaauugggcaaguaga

SEQ ID NO: 366125 - RNA, 19 nt, Homo sapiens
uaccggcacuuucagauac

SEQ ID NO: 366126 - RNA, 19 nt, Homo sapiens
gguggugucucagcuccuu

SEQ ID NO: 366127 - RNA, 19 nt, Homo sapiens
acccauaccuccuuguaca

SEQ ID NO: 366128 - RNA, 19 nt, Homo sapiens
uuaccggcacuuucagaua

SEQ ID NO: 366129 - RNA, 19 nt, Homo sapiens
ucaaacgcaggguucauga

SEQ ID NO: 366130 - RNA, 19 nt, Homo sapiens
agauaucuccugccuacuu

SEQ ID NO: 366131 - RNA, 19 nt, Homo sapiens
gaucccagggugcaaagug

SEQ ID NO: 366132 - RNA, 19 nt, Homo sapiens
ggauguguuugugauugga

SEQ ID NO: 366133 - RNA, 19 nt, Homo sapiens
gccagacuguguccagagu

SEQ ID NO: 366134 - RNA, 19 nt, Homo sapiens
agagagucaucgaacacuu

SEQ ID NO: 366135 - RNA, 19 nt, Homo sapiens
cuuggugucugaacucugu

SEQ ID NO: 366136 - RNA, 19 nt, Homo sapiens
uccauuugccagagaguua

SEQ ID NO: 366137 - RNA, 19 nt, Homo sapiens
ucuacucucucugcucuga

SEQ ID NO: 366138 - RNA, 19 nt, Homo sapiens
gcggaccucuacucucucu

SEQ ID NO: 366139 - RNA, 19 nt, Homo sapiens
gccaaagugaggagaaugu

SEQ ID NO: 366140 - RNA, 19 nt, Homo sapiens
ggcaggcacuggagcaacu

SEQ ID NO: 366141 - RNA, 19 nt, Homo sapiens
ggaucucuaugcccuucug

SEQ ID NO: 366142 - RNA, 19 nt, Homo sapiens
gaagaccacaguaguugcu

SEQ ID NO: 366143 - RNA, 19 nt, Homo sapiens
aaugggagagcucagaauu

SEQ ID NO: 366144 - RNA, 19 nt, Homo sapiens
uggaaauuaugacgguguu

SEQ ID NO: 366145 - RNA, 19 nt, Homo sapiens
cagcaacagcucaagagau

SEQ ID NO: 366146 - RNA, 19 nt, Homo sapiens
ggugcaaaguggcauugag

SEQ ID NO: 366147 - RNA, 19 nt, Homo sapiens
gacagcauuuccucaugag

SEQ ID NO: 366148 - RNA, 19 nt, Homo sapiens
gaccagccagugccuacuu

SEQ ID NO: 366149 - RNA, 19 nt, Homo sapiens
uccaugcauuaucuucuuu

SEQ ID NO: 366150 - RNA, 19 nt, Homo sapiens
gcagaaaucuugaguugug

SEQ ID NO: 366151 - RNA, 19 nt, Homo sapiens
gacuuuagcugacucguua

SEQ ID NO: 366152 - RNA, 19 nt, Homo sapiens
ggaucaaacugucaaauug

SEQ ID NO: 366153 - RNA, 19 nt, Homo sapiens
gaaagucucugugcaccuu

SEQ ID NO: 366154 - RNA, 19 nt, Homo sapiens
gaaggcagcaggaguaaga

SEQ ID NO: 366155 - RNA, 19 nt, Homo sapiens
caacgaacauguccucauc

SEQ ID NO: 366156 - RNA, 19 nt, Homo sapiens
ggaaugaugguuuguuuga

SEQ ID NO: 366157 - RNA, 19 nt, Homo sapiens
gauguuggcugaagaacug

SEQ ID NO: 366158 - RNA, 19 nt, Homo sapiens
gcgguugacuguaguuuga

SEQ ID NO: 366159 - RNA, 19 nt, Homo sapiens
cguuaagccugauacauaa

SEQ ID NO: 366160 - RNA, 19 nt, Homo sapiens
gaugugacuuggagugaga

SEQ ID NO: 366161 - RNA, 19 nt, Homo sapiens
ugagggagcugauaaagac

SEQ ID NO: 366162 - RNA, 19 nt, Homo sapiens
guggaacccuacuaauauu

SEQ ID NO: 366163 - RNA, 19 nt, Homo sapiens
aggcagaaaucuugaguug

SEQ ID NO: 366164 - RNA, 19 nt, Homo sapiens
gaaacaguggagcaucaua

SEQ ID NO: 366165 - RNA, 19 nt, Homo sapiens
gggaucaaacugucaaauu

SEQ ID NO: 366166 - RNA, 19 nt, Homo sapiens
ugacuggaaugaugguuug

SEQ ID NO: 366167 - RNA, 19 nt, Homo sapiens
ccacaucccugguuguuuu

SEQ ID NO: 366168 - RNA, 19 nt, Homo sapiens
ggccaugaaaguauuauuu

SEQ ID NO: 366169 - RNA, 19 nt, Homo sapiens
aauauuggauccagaugaa

SEQ ID NO: 366170 - RNA, 19 nt, Homo sapiens
gaucaaacugucaaauugu

SEQ ID NO: 366171 - RNA, 19 nt, Homo sapiens
gaacccuacuaauauugga

SEQ ID NO: 366172 - RNA, 19 nt, Homo sapiens
ucguuaagccugauacaua

SEQ ID NO: 366173 - RNA, 19 nt, Homo sapiens
acacuacuuuggucagaaa

SEQ ID NO: 366174 - RNA, 19 nt, Homo sapiens
ggagcaucauacagaguuu

SEQ ID NO: 366175 - RNA, 19 nt, Homo sapiens
ggagaucaguagguuauac

SEQ ID NO: 366176 - RNA, 19 nt, Homo sapiens
ggagugagaacaacgaaca

SEQ ID NO: 366177 - RNA, 19 nt, Homo sapiens
gagaauaugggaugugaag

SEQ ID NO: 366178 - RNA, 19 nt, Homo sapiens
ggagguguauaguguugau

SEQ ID NO: 366179 - RNA, 19 nt, Homo sapiens
guaagauucuggaacuuuu

SEQ ID NO: 366180 - RNA, 19 nt, Homo sapiens
uagaggccaugaaaguauu

SEQ ID NO: 366181 - RNA, 19 nt, Homo sapiens
caaccaguguuugaacuuc

SEQ ID NO: 366182 - RNA, 19 nt, Homo sapiens
aaccagaggugaacagcuu

SEQ ID NO: 366183 - RNA, 19 nt, Homo sapiens
caggagguguauaguguug

SEQ ID NO: 366184 - RNA, 19 nt, Homo sapiens
cuggaaugaugguuuguuu

SEQ ID NO: 366185 - RNA, 19 nt, Homo sapiens
gcaagucuauaaagaacac

SEQ ID NO: 366186 - RNA, 19 nt, Homo sapiens
gacccugcuugucuuacua

SEQ ID NO: 366187 - RNA, 19 nt, Homo sapiens
gaaugaugguuuguuugau

SEQ ID NO: 366188 - RNA, 19 nt, Homo sapiens
aaugaugguuuguuugaug

SEQ ID NO: 366189 - RNA, 19 nt, Homo sapiens
gagcaucauacagaguuua

SEQ ID NO: 366190 - RNA, 19 nt, Homo sapiens
aagccugacucucuucuug

SEQ ID NO: 366191 - RNA, 19 nt, Homo sapiens
gaugguuuguuugauguga

SEQ ID NO: 366192 - RNA, 19 nt, Homo sapiens
ggacuuaaggaauguacga

SEQ ID NO: 366193 - RNA, 19 nt, Homo sapiens
uguggaacccuacuaauau

SEQ ID NO: 366194 - RNA, 19 nt, Homo sapiens
uaugggagaucaguagguu

SEQ ID NO: 366195 - RNA, 19 nt, Homo sapiens
cugaagaacugccuaacag

SEQ ID NO: 366196 - RNA, 19 nt, Homo sapiens
ggucagaaacagaggaugu

SEQ ID NO: 366197 - RNA, 19 nt, Homo sapiens
gggaugaaacaauaaagau

SEQ ID NO: 366198 - RNA, 19 nt, Homo sapiens
gcucaugggaucaaacugu

SEQ ID NO: 366199 - RNA, 19 nt, Homo sapiens
agaacugccuaacagcaaa

SEQ ID NO: 366200 - RNA, 19 nt, Homo sapiens
ggaugaaacaauaaagauc

SEQ ID NO: 366201 - RNA, 19 nt, Homo sapiens
ugacuguucuugggaugaa

SEQ ID NO: 366202 - RNA, 19 nt, Homo sapiens
gcuggccucuugcucguau

SEQ ID NO: 366203 - RNA, 19 nt, Homo sapiens
cuguggaacccuacuaaua

SEQ ID NO: 366204 - RNA, 19 nt, Homo sapiens
uuagaagcuuugacuggaa

SEQ ID NO: 366205 - RNA, 19 nt, Homo sapiens
gccugacucucuucuugaa

SEQ ID NO: 366206 - RNA, 19 nt, Homo sapiens
cuucugugcuggccucuug

SEQ ID NO: 366207 - RNA, 19 nt, Homo sapiens
cauacagaguuuacuugug

SEQ ID NO: 366208 - RNA, 19 nt, Homo sapiens
caucauacagaguuuacuu

SEQ ID NO: 366209 - RNA, 19 nt, Homo sapiens
cuuaaggaauguacgacaa

SEQ ID NO: 366210 - RNA, 19 nt, Homo sapiens
uagaagcuuugacuggaau

SEQ ID NO: 366211 - RNA, 19 nt, Homo sapiens
ugacuuggagugagaacaa

SEQ ID NO: 366212 - RNA, 19 nt, Homo sapiens
cugagaauaugggauguga

SEQ ID NO: 366213 - RNA, 19 nt, Homo sapiens
gagccaaaccagaggugaa

SEQ ID NO: 366214 - RNA, 19 nt, Homo sapiens
ccugauacauaagccauau

SEQ ID NO: 366215 - RNA, 19 nt, Homo sapiens
gacaaccaguguuugaacu

SEQ ID NO: 366216 - RNA, 19 nt, Homo sapiens
ggcugggacuuaaggaaug

SEQ ID NO: 366217 - RNA, 19 nt, Homo sapiens
uugagaggcugggacuuaa

SEQ ID NO: 366218 - RNA, 19 nt, Homo sapiens
cagaaaucuugaguuguga

SEQ ID NO: 366219 - RNA, 19 nt, Homo sapiens
uaauauuggauccagauga

SEQ ID NO: 366220 - RNA, 19 nt, Homo sapiens
cucaggagguguauagugu

SEQ ID NO: 366221 - RNA, 19 nt, Homo sapiens
gcugaagaacugccuaaca

SEQ ID NO: 366222 - RNA, 19 nt, Homo sapiens
gaggauguuggcugaagaa

SEQ ID NO: 366223 - RNA, 19 nt, Homo sapiens
gcacaucaggcagaaaucu

SEQ ID NO: 366224 - RNA, 19 nt, Homo sapiens
gaacugccuaacagcaaau

SEQ ID NO: 366225 - RNA, 19 nt, Homo sapiens
caguggagcaucauacaga

SEQ ID NO: 366226 - RNA, 19 nt, Homo sapiens
ggccacugcaagucuauaa

SEQ ID NO: 366227 - RNA, 19 nt, Homo sapiens
ugugaaggcagcaggagua

SEQ ID NO: 366228 - RNA, 19 nt, Homo sapiens
gcucaggagguguauagug

SEQ ID NO: 366229 - RNA, 19 nt, Homo sapiens
cacugcaagucuauaaaga

SEQ ID NO: 366230 - RNA, 19 nt, Homo sapiens
ccaauuuacccuggaauca

SEQ ID NO: 366231 - RNA, 19 nt, Homo sapiens
cagggccacugcaagucua

SEQ ID NO: 366232 - RNA, 19 nt, Homo sapiens
uugaaacaguggagcauca

SEQ ID NO: 366233 - RNA, 19 nt, Homo sapiens
uuucaaagccugacucucu

SEQ ID NO: 366234 - RNA, 19 nt, Homo sapiens
uuugagaggcugggacuua

SEQ ID NO: 366235 - RNA, 19 nt, Homo sapiens
uuagaggccaugaaaguau

SEQ ID NO: 366236 - RNA, 19 nt, Homo sapiens
cagaggauguuggcugaag

SEQ ID NO: 366237 - RNA, 19 nt, Homo sapiens
ugagauacacuacuuuggu

SEQ ID NO: 366238 - RNA, 19 nt, Homo sapiens
gaucuaugacccugcuugu

SEQ ID NO: 366239 - RNA, 19 nt, Homo sapiens
uguaagauucuggaacuuu

SEQ ID NO: 366240 - RNA, 19 nt, Homo sapiens
gccucuugcucguaugauu

SEQ ID NO: 366241 - RNA, 19 nt, Homo sapiens
gcuauuaggagggugaaau

SEQ ID NO: 366242 - RNA, 19 nt, Homo sapiens
gguugacuguaguuugaga

SEQ ID NO: 366243 - RNA, 19 nt, Homo sapiens
gcucugggacacugccaaa

SEQ ID NO: 366244 - RNA, 19 nt, Homo sapiens
ccacugcaagucuauaaag

SEQ ID NO: 366245 - RNA, 19 nt, Homo sapiens
agaugaagcugggcuaagg

SEQ ID NO: 366246 - RNA, 19 nt, Homo sapiens
uucuugggaugaaacaaua

SEQ ID NO: 366247 - RNA, 19 nt, Homo sapiens
cuauuaggagggugaaauu

SEQ ID NO: 366248 - RNA, 19 nt, Homo sapiens
guacgacaaccaguguuug

SEQ ID NO: 366249 - RNA, 19 nt, Homo sapiens
ccucuugcucguaugauuu

SEQ ID NO: 366250 - RNA, 19 nt, Homo sapiens
gaagacacuuuauucguuu

SEQ ID NO: 366251 - RNA, 19 nt, Homo sapiens
gagaaguaauucagaagua

SEQ ID NO: 366252 - RNA, 19 nt, Homo sapiens
ggacacagaugaccucuac

SEQ ID NO: 366253 - RNA, 19 nt, Homo sapiens
agaagacacuuuauucguu

SEQ ID NO: 366254 - RNA, 19 nt, Homo sapiens
gauuuagucucaggauuaa

SEQ ID NO: 366255 - RNA, 19 nt, Homo sapiens
cauguaagauacuaaccua

SEQ ID NO: 366256 - RNA, 19 nt, Homo sapiens
gcacagaaguuagaacacu

SEQ ID NO: 366257 - RNA, 19 nt, Homo sapiens
uaaccuugcuugcacagaa

SEQ ID NO: 366258 - RNA, 19 nt, Homo sapiens
gcacacacaccuucaauac

SEQ ID NO: 366259 - RNA, 19 nt, Homo sapiens
uaaacuaacuccagcaaaa

SEQ ID NO: 366260 - RNA, 19 nt, Homo sapiens
ccguaggcaucuuuaauaa

SEQ ID NO: 366261 - RNA, 19 nt, Homo sapiens
caaggucgcuuccaguuuu

SEQ ID NO: 366262 - RNA, 19 nt, Homo sapiens
guugagaaguaauucagaa

SEQ ID NO: 366263 - RNA, 19 nt, Homo sapiens
ccauacaguugagaaguaa

SEQ ID NO: 366264 - RNA, 19 nt, Homo sapiens
guuagaacacucucaguuu

SEQ ID NO: 366265 - RNA, 19 nt, Homo sapiens
ggacucagccacuucuuca

SEQ ID NO: 366266 - RNA, 19 nt, Homo sapiens
agauuuagucucaggauua

SEQ ID NO: 366267 - RNA, 19 nt, Homo sapiens
ucucagauguggccuacuu

SEQ ID NO: 366268 - RNA, 19 nt, Homo sapiens
gcagagagaaaccaaccaa

SEQ ID NO: 366269 - RNA, 19 nt, Homo sapiens
ggcugcagcuguacgguuu

SEQ ID NO: 366270 - RNA, 19 nt, Homo sapiens
cauuugauguuuccagguu

SEQ ID NO: 366271 - RNA, 19 nt, Homo sapiens
ggaauuucacuuauuugga

SEQ ID NO: 366272 - RNA, 19 nt, Homo sapiens
gagagagccguuuccagaa

SEQ ID NO: 366273 - RNA, 19 nt, Homo sapiens
gccagaagacacuuuauuc

SEQ ID NO: 366274 - RNA, 19 nt, Homo sapiens
acacacaccuucaauacac

SEQ ID NO: 366275 - RNA, 19 nt, Homo sapiens
ggccagaagacacuuuauu

SEQ ID NO: 366276 - RNA, 19 nt, Homo sapiens
uuaaggcaauggacugaau

SEQ ID NO: 366277 - RNA, 19 nt, Homo sapiens
cuucaggaauuucacuuau

SEQ ID NO: 366278 - RNA, 19 nt, Homo sapiens
accauacaguugagaagua

SEQ ID NO: 366279 - RNA, 19 nt, Homo sapiens
gcuacauguugccugguuu

SEQ ID NO: 366280 - RNA, 19 nt, Homo sapiens
ccaucaggcuuguguuaag

SEQ ID NO: 366281 - RNA, 19 nt, Homo sapiens
agaaguaauucagaaguag

SEQ ID NO: 366282 - RNA, 19 nt, Homo sapiens
acgccaagauuuagucuca

SEQ ID NO: 366283 - RNA, 19 nt, Homo sapiens
gaaguucccuccccagaag

SEQ ID NO: 366284 - RNA, 19 nt, Homo sapiens
aaauguggguacguuacua

SEQ ID NO: 366285 - RNA, 19 nt, Homo sapiens
uuagaacacucucaguuuu

SEQ ID NO: 366286 - RNA, 19 nt, Homo sapiens
gcagaaggacgaguacuac

SEQ ID NO: 366287 - RNA, 19 nt, Homo sapiens
cacggucacugcuguguuc

SEQ ID NO: 366288 - RNA, 19 nt, Homo sapiens
ggcacacacaccuucaaua

SEQ ID NO: 366289 - RNA, 19 nt, Homo sapiens
caaaccauacaguugagaa

SEQ ID NO: 366290 - RNA, 19 nt, Homo sapiens
ucaucuaccuucggcacua

SEQ ID NO: 366291 - RNA, 19 nt, Homo sapiens
cauccacggugucuucuac

SEQ ID NO: 366292 - RNA, 19 nt, Homo sapiens
gcaaaauguggguacguua

SEQ ID NO: 366293 - RNA, 19 nt, Homo sapiens
ucaaggucgcuuccaguuu

SEQ ID NO: 366294 - RNA, 19 nt, Homo sapiens
ggcaauggacugaaugagu

SEQ ID NO: 366295 - RNA, 19 nt, Homo sapiens
ggcuacauguugccugguu

SEQ ID NO: 366296 - RNA, 19 nt, Homo sapiens
gccugaacccagaacauuu

SEQ ID NO: 366297 - RNA, 19 nt, Homo sapiens
aagauuuagucucaggauu

SEQ ID NO: 366298 - RNA, 19 nt, Homo sapiens
gaggaguacgucagcauca

SEQ ID NO: 366299 - RNA, 19 nt, Homo sapiens
cccagaagcucaucuaccu

SEQ ID NO: 366300 - RNA, 19 nt, Homo sapiens
accguaggcaucuuuaaua

SEQ ID NO: 366301 - RNA, 19 nt, Homo sapiens
ccgccuccauuugauguuu

SEQ ID NO: 366302 - RNA, 19 nt, Homo sapiens
cagaagacacuuuauucgu

SEQ ID NO: 366303 - RNA, 19 nt, Homo sapiens
acccagaacauuucccuaa

SEQ ID NO: 366304 - RNA, 19 nt, Homo sapiens
uuacauccacggugucuuc

SEQ ID NO: 366305 - RNA, 19 nt, Homo sapiens
cgcagaaggacgaguacua

SEQ ID NO: 366306 - RNA, 19 nt, Homo sapiens
guucaccguaggcaucuuu

SEQ ID NO: 366307 - RNA, 19 nt, Homo sapiens
ggacgggauuuuagguuuc

SEQ ID NO: 366308 - RNA, 19 nt, Homo sapiens
caccguaggcaucuuuaau

SEQ ID NO: 366309 - RNA, 19 nt, Homo sapiens
cuauuucccgccuccauuu

SEQ ID NO: 366310 - RNA, 19 nt, Homo sapiens
ggaguacgucagcaucauc

SEQ ID NO: 366311 - RNA, 19 nt, Homo sapiens
ccagaagacacuuuauucg

SEQ ID NO: 366312 - RNA, 19 nt, Homo sapiens
ucagaaguaggccagaaga

SEQ ID NO: 366313 - RNA, 19 nt, Homo sapiens
ucagccacuucuucaggaa

SEQ ID NO: 366314 - RNA, 19 nt, Homo sapiens
acacggccacccugacuga

SEQ ID NO: 366315 - RNA, 19 nt, Homo sapiens
ccauggggcugcagcugua

SEQ ID NO: 366316 - RNA, 19 nt, Homo sapiens
uaggccagaagacacuuua

SEQ ID NO: 366317 - RNA, 19 nt, Homo sapiens
ucagauguggccuacuuug

SEQ ID NO: 366318 - RNA, 19 nt, Homo sapiens
gucaaggucgcuuccaguu

SEQ ID NO: 366319 - RNA, 19 nt, Homo sapiens
caucaggcuuguguuaagg

SEQ ID NO: 366320 - RNA, 19 nt, Homo sapiens
cggcgcagaaggacgagua

SEQ ID NO: 366321 - RNA, 19 nt, Homo sapiens
agaaguaggccagaagaca

SEQ ID NO: 366322 - RNA, 19 nt, Homo sapiens
agccacuucuucaggaauu

SEQ ID NO: 366323 - RNA, 19 nt, Homo sapiens
ccagaacauuucccuaacc

SEQ ID NO: 366324 - RNA, 19 nt, Homo sapiens
uagccacccugggagagaa

SEQ ID NO: 366325 - RNA, 19 nt, Homo sapiens
caagauuuagucucaggau

SEQ ID NO: 366326 - RNA, 19 nt, Homo sapiens
ugagaaguaauucagaagu

SEQ ID NO: 366327 - RNA, 19 nt, Homo sapiens
gccacuucuucaggaauuu

SEQ ID NO: 366328 - RNA, 19 nt, Homo sapiens
ccugaacccagaacauuuc

SEQ ID NO: 366329 - RNA, 19 nt, Homo sapiens
ugcccuaccugcuggacaa

SEQ ID NO: 366330 - RNA, 19 nt, Homo sapiens
gaagacacuuuauucguuu

SEQ ID NO: 366331 - RNA, 19 nt, Homo sapiens
gagaaguaauucagaagua

SEQ ID NO: 366332 - RNA, 19 nt, Homo sapiens
ggacacagaugaccucuac

SEQ ID NO: 366333 - RNA, 19 nt, Homo sapiens
agaagacacuuuauucguu

SEQ ID NO: 366334 - RNA, 19 nt, Homo sapiens
gauuuagucucaggauuaa

SEQ ID NO: 366335 - RNA, 19 nt, Homo sapiens
cauguaagauacuaaccua

SEQ ID NO: 366336 - RNA, 19 nt, Homo sapiens
gcacagaaguuagaacacu

SEQ ID NO: 366337 - RNA, 19 nt, Homo sapiens
uaaccuugcuugcacagaa

SEQ ID NO: 366338 - RNA, 19 nt, Homo sapiens
gcacacacaccuucaauac

SEQ ID NO: 366339 - RNA, 19 nt, Homo sapiens
uaaacuaacuccagcaaaa

SEQ ID NO: 366340 - RNA, 19 nt, Homo sapiens
ccguaggcaucuuuaauaa

SEQ ID NO: 366341 - RNA, 19 nt, Homo sapiens
caaggucgcuuccaguuuu

SEQ ID NO: 366342 - RNA, 19 nt, Homo sapiens
guugagaaguaauucagaa

SEQ ID NO: 366343 - RNA, 19 nt, Homo sapiens
ccauacaguugagaaguaa

SEQ ID NO: 366344 - RNA, 19 nt, Homo sapiens
guuagaacacucucaguuu

SEQ ID NO: 366345 - RNA, 19 nt, Homo sapiens
ggacucagccacuucuuca

SEQ ID NO: 366346 - RNA, 19 nt, Homo sapiens
agauuuagucucaggauua

SEQ ID NO: 366347 - RNA, 19 nt, Homo sapiens
ucucagauguggccuacuu

SEQ ID NO: 366348 - RNA, 19 nt, Homo sapiens
gcagagagaaaccaaccaa

SEQ ID NO: 366349 - RNA, 19 nt, Homo sapiens
ggcugcagcuguacgguuu

SEQ ID NO: 366350 - RNA, 19 nt, Homo sapiens
cauuugauguuuccagguu

SEQ ID NO: 366351 - RNA, 19 nt, Homo sapiens
ggaauuucacuuauuugga

SEQ ID NO: 366352 - RNA, 19 nt, Homo sapiens
gagagagccguuuccagaa

SEQ ID NO: 366353 - RNA, 19 nt, Homo sapiens
gccagaagacacuuuauuc

SEQ ID NO: 366354 - RNA, 19 nt, Homo sapiens
acacacaccuucaauacac

SEQ ID NO: 366355 - RNA, 19 nt, Homo sapiens
ggccagaagacacuuuauu

SEQ ID NO: 366356 - RNA, 19 nt, Homo sapiens
uuaaggcaauggacugaau

SEQ ID NO: 366357 - RNA, 19 nt, Homo sapiens
cuucaggaauuucacuuau

SEQ ID NO: 366358 - RNA, 19 nt, Homo sapiens
accauacaguugagaagua

SEQ ID NO: 366359 - RNA, 19 nt, Homo sapiens
gcuacauguugccugguuu

SEQ ID NO: 366360 - RNA, 19 nt, Homo sapiens
ccaucaggcuuguguuaag

SEQ ID NO: 366361 - RNA, 19 nt, Homo sapiens
agaaguaauucagaaguag

SEQ ID NO: 366362 - RNA, 19 nt, Homo sapiens
acgccaagauuuagucuca

SEQ ID NO: 366363 - RNA, 19 nt, Homo sapiens
gaaguucccuccccagaag

SEQ ID NO: 366364 - RNA, 19 nt, Homo sapiens
aaauguggguacguuacua

SEQ ID NO: 366365 - RNA, 19 nt, Homo sapiens
uuagaacacucucaguuuu

SEQ ID NO: 366366 - RNA, 19 nt, Homo sapiens
gcagaaggacgaguacuac

SEQ ID NO: 366367 - RNA, 19 nt, Homo sapiens
cacggucacugcuguguuc

SEQ ID NO: 366368 - RNA, 19 nt, Homo sapiens
ggcacacacaccuucaaua

SEQ ID NO: 366369 - RNA, 19 nt, Homo sapiens
caaaccauacaguugagaa

SEQ ID NO: 366370 - RNA, 19 nt, Homo sapiens
ucaucuaccuucggcacua

SEQ ID NO: 366371 - RNA, 19 nt, Homo sapiens
cauccacggugucuucuac

SEQ ID NO: 366372 - RNA, 19 nt, Homo sapiens
gcaaaauguggguacguua

SEQ ID NO: 366373 - RNA, 19 nt, Homo sapiens
ucaaggucgcuuccaguuu

SEQ ID NO: 366374 - RNA, 19 nt, Homo sapiens
ggcaauggacugaaugagu

SEQ ID NO: 366375 - RNA, 19 nt, Homo sapiens
ggcuacauguugccugguu

SEQ ID NO: 366376 - RNA, 19 nt, Homo sapiens
gccugaacccagaacauuu

SEQ ID NO: 366377 - RNA, 19 nt, Homo sapiens
aagauuuagucucaggauu

SEQ ID NO: 366378 - RNA, 19 nt, Homo sapiens
gaggaguacgucagcauca

SEQ ID NO: 366379 - RNA, 19 nt, Homo sapiens
cccagaagcucaucuaccu

SEQ ID NO: 366380 - RNA, 19 nt, Homo sapiens
accguaggcaucuuuaaua

SEQ ID NO: 366381 - RNA, 19 nt, Homo sapiens
ccgccuccauuugauguuu

SEQ ID NO: 366382 - RNA, 19 nt, Homo sapiens
cagaagacacuuuauucgu

SEQ ID NO: 366383 - RNA, 19 nt, Homo sapiens
acccagaacauuucccuaa

SEQ ID NO: 366384 - RNA, 19 nt, Homo sapiens
uuacauccacggugucuuc

SEQ ID NO: 366385 - RNA, 19 nt, Homo sapiens
cgcagaaggacgaguacua

SEQ ID NO: 366386 - RNA, 19 nt, Homo sapiens
guucaccguaggcaucuuu

SEQ ID NO: 366387 - RNA, 19 nt, Homo sapiens
ggacgggauuuuagguuuc

SEQ ID NO: 366388 - RNA, 19 nt, Homo sapiens
caccguaggcaucuuuaau

SEQ ID NO: 366389 - RNA, 19 nt, Homo sapiens
cuauuucccgccuccauuu

SEQ ID NO: 366390 - RNA, 19 nt, Homo sapiens
ggaguacgucagcaucauc

SEQ ID NO: 366391 - RNA, 19 nt, Homo sapiens
ccagaagacacuuuauucg

SEQ ID NO: 366392 - RNA, 19 nt, Homo sapiens
ucagaaguaggccagaaga

SEQ ID NO: 366393 - RNA, 19 nt, Homo sapiens
ucagccacuucuucaggaa

SEQ ID NO: 366394 - RNA, 19 nt, Homo sapiens
acacggccacccugacuga

SEQ ID NO: 366395 - RNA, 19 nt, Homo sapiens
ccauggggcugcagcugua

SEQ ID NO: 366396 - RNA, 19 nt, Homo sapiens
uaggccagaagacacuuua

SEQ ID NO: 366397 - RNA, 19 nt, Homo sapiens
ucagauguggccuacuuug

SEQ ID NO: 366398 - RNA, 19 nt, Homo sapiens
gucaaggucgcuuccaguu

SEQ ID NO: 366399 - RNA, 19 nt, Homo sapiens
caucaggcuuguguuaagg

SEQ ID NO: 366400 - RNA, 19 nt, Homo sapiens
cggcgcagaaggacgagua

SEQ ID NO: 366401 - RNA, 19 nt, Homo sapiens
agaaguaggccagaagaca

SEQ ID NO: 366402 - RNA, 19 nt, Homo sapiens
agccacuucuucaggaauu

SEQ ID NO: 366403 - RNA, 19 nt, Homo sapiens
ccagaacauuucccuaacc

SEQ ID NO: 366404 - RNA, 19 nt, Homo sapiens
uagccacccugggagagaa

SEQ ID NO: 366405 - RNA, 19 nt, Homo sapiens
caagauuuagucucaggau

SEQ ID NO: 366406 - RNA, 19 nt, Homo sapiens
ugagaaguaauucagaagu

SEQ ID NO: 366407 - RNA, 19 nt, Homo sapiens
gccacuucuucaggaauuu

SEQ ID NO: 366408 - RNA, 19 nt, Homo sapiens
ccugaacccagaacauuuc

SEQ ID NO: 366409 - RNA, 19 nt, Homo sapiens
ugcccuaccugcuggacaa

SEQ ID NO: 366410 - RNA, 19 nt, Homo sapiens
gaaagggaaucaugucuua

SEQ ID NO: 366411 - RNA, 19 nt, Homo sapiens
uaaaggagcucuuacgaaa

SEQ ID NO: 366412 - RNA, 19 nt, Homo sapiens
gauaagaaaugcagacuug

SEQ ID NO: 366413 - RNA, 19 nt, Homo sapiens
cgaguuaacuuuguucuua

SEQ ID NO: 366414 - RNA, 19 nt, Homo sapiens
gcacaggacaguuuaauga

SEQ ID NO: 366415 - RNA, 19 nt, Homo sapiens
gaaguacaacaucugauua

SEQ ID NO: 366416 - RNA, 19 nt, Homo sapiens
gggcaggucucccuucaaa

SEQ ID NO: 366417 - RNA, 19 nt, Homo sapiens
gagaagaggaugaauauuc

SEQ ID NO: 366418 - RNA, 19 nt, Homo sapiens
gaacauggccugggaagga

SEQ ID NO: 366419 - RNA, 19 nt, Homo sapiens
gagagaagaggaugaauau

SEQ ID NO: 366420 - RNA, 19 nt, Homo sapiens
ggaaggaugguuucuugua

SEQ ID NO: 366421 - RNA, 19 nt, Homo sapiens
cgagagaguuugugggaaa

SEQ ID NO: 366422 - RNA, 19 nt, Homo sapiens
caacagaaguacaacaucu

SEQ ID NO: 366423 - RNA, 19 nt, Homo sapiens
guggaaauuucaucaguuu

SEQ ID NO: 366424 - RNA, 19 nt, Homo sapiens
gaacugaaagggaaucaug

SEQ ID NO: 366425 - RNA, 19 nt, Homo sapiens
guauugcgcuguaauguca

SEQ ID NO: 366426 - RNA, 19 nt, Homo sapiens
gaacccuacuuacaguuga

SEQ ID NO: 366427 - RNA, 19 nt, Homo sapiens
ggaggugguuugaugaaau

SEQ ID NO: 366428 - RNA, 19 nt, Homo sapiens
aagcaaagcuaacaagcaa

SEQ ID NO: 366429 - RNA, 19 nt, Homo sapiens
guguagagauuaaacagaa

SEQ ID NO: 366430 - RNA, 19 nt, Homo sapiens
gaaggaugguuucuuguac

SEQ ID NO: 366431 - RNA, 19 nt, Homo sapiens
gcccugacgugcagcauuu

SEQ ID NO: 366432 - RNA, 19 nt, Homo sapiens
caucacagguuauccaaca

SEQ ID NO: 366433 - RNA, 19 nt, Homo sapiens
caaccagccaggaguguua

SEQ ID NO: 366434 - RNA, 19 nt, Homo sapiens
gcacccaucugauacucuu

SEQ ID NO: 366435 - RNA, 19 nt, Homo sapiens
ugagacauuuguuaaguga

SEQ ID NO: 366436 - RNA, 19 nt, Homo sapiens
gacuugcucuugauagaaa

SEQ ID NO: 366437 - RNA, 19 nt, Homo sapiens
gguauugaguugacacuuc

SEQ ID NO: 366438 - RNA, 19 nt, Homo sapiens
aagaaaccaucaagucauu

SEQ ID NO: 366439 - RNA, 19 nt, Homo sapiens
gaccagccauccaucuuug

SEQ ID NO: 366440 - RNA, 19 nt, Homo sapiens
gagaguagucugaagauuc

SEQ ID NO: 366441 - RNA, 19 nt, Homo sapiens
aagauugaguuucgaguuu

SEQ ID NO: 366442 - RNA, 19 nt, Homo sapiens
gcaaagcuaacaagcaaug

SEQ ID NO: 366443 - RNA, 19 nt, Homo sapiens
cauauacugugagacauuu

SEQ ID NO: 366444 - RNA, 19 nt, Homo sapiens
ugagagaagaggaugaaua

SEQ ID NO: 366445 - RNA, 19 nt, Homo sapiens
gauaucaugcagaaaguuu

SEQ ID NO: 366446 - RNA, 19 nt, Homo sapiens
agaaauaaaggagcucuua

SEQ ID NO: 366447 - RNA, 19 nt, Homo sapiens
gccuaucccuuuccuuaaa

SEQ ID NO: 366448 - RNA, 19 nt, Homo sapiens
uagaaccagugccucauuu

SEQ ID NO: 366449 - RNA, 19 nt, Homo sapiens
gugguuugaugaaaucuuu

SEQ ID NO: 366450 - RNA, 19 nt, Homo sapiens
aaagauuacuugagguguu

SEQ ID NO: 366451 - RNA, 19 nt, Homo sapiens
gguggaaauuucaucaguu

SEQ ID NO: 366452 - RNA, 19 nt, Homo sapiens
cagccucaauucauaacua

SEQ ID NO: 366453 - RNA, 19 nt, Homo sapiens
cagcagcuuuggaaaucua

SEQ ID NO: 366454 - RNA, 19 nt, Homo sapiens
ugaaaucuuuacucugcua

SEQ ID NO: 366455 - RNA, 19 nt, Homo sapiens
guucuuaaccuucuugaga

SEQ ID NO: 366456 - RNA, 19 nt, Homo sapiens
gugcagcauuugacaaguu

SEQ ID NO: 366457 - RNA, 19 nt, Homo sapiens
gaugguuucuuguacaaca

SEQ ID NO: 366458 - RNA, 19 nt, Homo sapiens
aaucaaaucccacccacua

SEQ ID NO: 366459 - RNA, 19 nt, Homo sapiens
agacugagcacccaucuga

SEQ ID NO: 366460 - RNA, 19 nt, Homo sapiens
gcaaugaagacaugaagca

SEQ ID NO: 366461 - RNA, 19 nt, Homo sapiens
caacauuaucugucuagaa

SEQ ID NO: 366462 - RNA, 19 nt, Homo sapiens
uuucagauaucaugcagaa

SEQ ID NO: 366463 - RNA, 19 nt, Homo sapiens
gaguuucgaguuucagaua

SEQ ID NO: 366464 - RNA, 19 nt, Homo sapiens
cagacuugcucuugauaga

SEQ ID NO: 366465 - RNA, 19 nt, Homo sapiens
gaaauuucaucaguuugca

SEQ ID NO: 366466 - RNA, 19 nt, Homo sapiens
ucuguaagguggaaauuuc

SEQ ID NO: 366467 - RNA, 19 nt, Homo sapiens
gauaugagggccaguguag

SEQ ID NO: 366468 - RNA, 19 nt, Homo sapiens
ugggaaggaugguuucuug

SEQ ID NO: 366469 - RNA, 19 nt, Homo sapiens
gggccaguguagagauuaa

SEQ ID NO: 366470 - RNA, 19 nt, Homo sapiens
gagggccaguguagagauu

SEQ ID NO: 366471 - RNA, 19 nt, Homo sapiens
ucaagaaaccaucaaguca

SEQ ID NO: 366472 - RNA, 19 nt, Homo sapiens
guacaacaacuucgauaca

SEQ ID NO: 366473 - RNA, 19 nt, Homo sapiens
guucgcagcuccagaggau

SEQ ID NO: 366474 - RNA, 19 nt, Homo sapiens
gaggugguuugaugaaauc

SEQ ID NO: 366475 - RNA, 19 nt, Homo sapiens
gaagaggaugaauauucua

SEQ ID NO: 366476 - RNA, 19 nt, Homo sapiens
cuguacaccuagacuauaa

SEQ ID NO: 366477 - RNA, 19 nt, Homo sapiens
cagcuuuggaaaucuauua

SEQ ID NO: 366478 - RNA, 19 nt, Homo sapiens
gcacggggcucacuucaca

SEQ ID NO: 366479 - RNA, 19 nt, Homo sapiens
gaagacaugaagcaaaaua

SEQ ID NO: 366480 - RNA, 19 nt, Homo sapiens
aaaaggauaugcccauuug

SEQ ID NO: 366481 - RNA, 19 nt, Homo sapiens
guacucaucugaaaaucaa

SEQ ID NO: 366482 - RNA, 19 nt, Homo sapiens
gacccgcucuucagcaugu

SEQ ID NO: 366483 - RNA, 19 nt, Homo sapiens
gguagcacaggacaguuua

SEQ ID NO: 366484 - RNA, 19 nt, Homo sapiens
aagauuacuugagguguuu

SEQ ID NO: 366485 - RNA, 19 nt, Homo sapiens
ucugaagauuccuguguaa

SEQ ID NO: 366486 - RNA, 19 nt, Homo sapiens
gcuguguguuucauuaugu

SEQ ID NO: 366487 - RNA, 19 nt, Homo sapiens
ugcagcauuugacaaguua

SEQ ID NO: 366488 - RNA, 19 nt, Homo sapiens
gaaauaaaggagcucuuac

SEQ ID NO: 366489 - RNA, 19 nt, Homo sapiens
caacaucugauuaaacucu

SEQ ID NO: 366490 - RNA, 19 nt, Homo sapiens
ccacguccgaguuaacuuu

SEQ ID NO: 366491 - RNA, 19 nt, Homo sapiens
gucugaagauuccugugua

SEQ ID NO: 366492 - RNA, 19 nt, Homo sapiens
agacauuuguuaagugaca

SEQ ID NO: 366493 - RNA, 19 nt, Homo sapiens
gaaaugcagacuugcucuu

SEQ ID NO: 366494 - RNA, 19 nt, Homo sapiens
agaaguacaacaucugauu

SEQ ID NO: 366495 - RNA, 19 nt, Homo sapiens
gaguguuagugagaagaua

SEQ ID NO: 366496 - RNA, 19 nt, Homo sapiens
gcagugagacccgcucuuc

SEQ ID NO: 366497 - RNA, 19 nt, Homo sapiens
gugagacauuuguuaagug

SEQ ID NO: 366498 - RNA, 19 nt, Homo sapiens
ggaaauuucaucaguuugc

SEQ ID NO: 366499 - RNA, 19 nt, Homo sapiens
cuagaacccuacuuacagu

SEQ ID NO: 366500 - RNA, 19 nt, Homo sapiens
guauugaguugacacuucu

SEQ ID NO: 366501 - RNA, 19 nt, Homo sapiens
ugucuuauccucacaacaa

SEQ ID NO: 366502 - RNA, 19 nt, Homo sapiens
caagaaaccaucaagucau

SEQ ID NO: 366503 - RNA, 19 nt, Homo sapiens
ccagcaacauuaucugucu

SEQ ID NO: 366504 - RNA, 19 nt, Homo sapiens
gaauaaugaguacacaagu

SEQ ID NO: 366505 - RNA, 19 nt, Homo sapiens
ucagauaucaugcagaaag

SEQ ID NO: 366506 - RNA, 19 nt, Homo sapiens
guacaacaucugauuaaac

SEQ ID NO: 366507 - RNA, 19 nt, Homo sapiens
gauugaguuucgaguuuca

SEQ ID NO: 366508 - RNA, 19 nt, Homo sapiens
ggugaaugauacuguucuu

SEQ ID NO: 366509 - RNA, 19 nt, Homo sapiens
ccuggcagccuacccauuu

SEQ ID NO: 366510 - RNA, 19 nt, Homo sapiens
gaacuuagcucucaaagaa

SEQ ID NO: 366511 - RNA, 19 nt, Homo sapiens
gauguuagguuuaagaaga

SEQ ID NO: 366512 - RNA, 19 nt, Homo sapiens
gaugauggaugcuaccuuu

SEQ ID NO: 366513 - RNA, 19 nt, Homo sapiens
ccaaacaacaggacuuaua

SEQ ID NO: 366514 - RNA, 19 nt, Homo sapiens
acaggaagcugccuuugaa

SEQ ID NO: 366515 - RNA, 19 nt, Homo sapiens
caaguaaaguuuccaagca

SEQ ID NO: 366516 - RNA, 19 nt, Homo sapiens
ccaauauucuuguucuuug

SEQ ID NO: 366517 - RNA, 19 nt, Homo sapiens
ggauguagcaaaucacuuu

SEQ ID NO: 366518 - RNA, 19 nt, Homo sapiens
ugauuuggguccuacuuua

SEQ ID NO: 366519 - RNA, 19 nt, Homo sapiens
gacaagaccuggacaacca

SEQ ID NO: 366520 - RNA, 19 nt, Homo sapiens
gcauuugccucugucagua

SEQ ID NO: 366521 - RNA, 19 nt, Homo sapiens
gcaguugaacaauacuuua

SEQ ID NO: 366522 - RNA, 19 nt, Homo sapiens
cagcggauguuagguuuaa

SEQ ID NO: 366523 - RNA, 19 nt, Homo sapiens
ggacuuauaccugcgaauu

SEQ ID NO: 366524 - RNA, 19 nt, Homo sapiens
guccuuaccucauuuggaa

SEQ ID NO: 366525 - RNA, 19 nt, Homo sapiens
gagccacgguugcugauuc

SEQ ID NO: 366526 - RNA, 19 nt, Homo sapiens
ccaagcagcaacaaucuuu

SEQ ID NO: 366527 - RNA, 19 nt, Homo sapiens
caaagaacaacaacccaaa

SEQ ID NO: 366528 - RNA, 19 nt, Homo sapiens
ggaaacuauugucuacuca

SEQ ID NO: 366529 - RNA, 19 nt, Homo sapiens
gaauguacaauccaaugaa

SEQ ID NO: 366530 - RNA, 19 nt, Homo sapiens
ugccguaucugaagaagaa

SEQ ID NO: 366531 - RNA, 19 nt, Homo sapiens
ggaaguagcagugugaaca

SEQ ID NO: 366532 - RNA, 19 nt, Homo sapiens
gacuuauaccugcgaauua

SEQ ID NO: 366533 - RNA, 19 nt, Homo sapiens
guucuuugcuguuauccuu

SEQ ID NO: 366534 - RNA, 19 nt, Homo sapiens
ggaaaacgguggaaucaag

SEQ ID NO: 366535 - RNA, 19 nt, Homo sapiens
gagcagcuaccucagcaaa

SEQ ID NO: 366536 - RNA, 19 nt, Homo sapiens
gaaguaacagacagcauca

SEQ ID NO: 366537 - RNA, 19 nt, Homo sapiens
gauauggugccuauggaaa

SEQ ID NO: 366538 - RNA, 19 nt, Homo sapiens
uguauuggauguagcaaau

SEQ ID NO: 366539 - RNA, 19 nt, Homo sapiens
gaagcugccuuugaaucug

SEQ ID NO: 366540 - RNA, 19 nt, Homo sapiens
ggaagcugccuuugaaucu

SEQ ID NO: 366541 - RNA, 19 nt, Homo sapiens
gguccuacuuuaaugacaa

SEQ ID NO: 366542 - RNA, 19 nt, Homo sapiens
uaacagacagcaucaacug

SEQ ID NO: 366543 - RNA, 19 nt, Homo sapiens
gaugaucuuccacccagua

SEQ ID NO: 366544 - RNA, 19 nt, Homo sapiens
gaacaggaagcugccuuug

SEQ ID NO: 366545 - RNA, 19 nt, Homo sapiens
caacccaacacuaacuaaa

SEQ ID NO: 366546 - RNA, 19 nt, Homo sapiens
ggccaaacaacaggacuua

SEQ ID NO: 366547 - RNA, 19 nt, Homo sapiens
gcaaaaucuuggccaauau

SEQ ID NO: 366548 - RNA, 19 nt, Homo sapiens
gauuuggguccuacuuuaa

SEQ ID NO: 366549 - RNA, 19 nt, Homo sapiens
gagaggaggcggaggagau

SEQ ID NO: 366550 - RNA, 19 nt, Homo sapiens
gaaaguauugugcaugcau

SEQ ID NO: 366551 - RNA, 19 nt, Homo sapiens
agaaaugaauguacaaucc

SEQ ID NO: 366552 - RNA, 19 nt, Homo sapiens
ugccugcaguugaacaaua

SEQ ID NO: 366553 - RNA, 19 nt, Homo sapiens
gccaauauucuuguucuuu

SEQ ID NO: 366554 - RNA, 19 nt, Homo sapiens
uuucagggcuguauuggau

SEQ ID NO: 366555 - RNA, 19 nt, Homo sapiens
gaaaugaauguacaaucca

SEQ ID NO: 366556 - RNA, 19 nt, Homo sapiens
gguggaaucaaguaaaguu

SEQ ID NO: 366557 - RNA, 19 nt, Homo sapiens
aaacuauugucuacucaca

SEQ ID NO: 366558 - RNA, 19 nt, Homo sapiens
aaaguauugugcaugcauu

SEQ ID NO: 366559 - RNA, 19 nt, Homo sapiens
caaacaacaggacuuauac

SEQ ID NO: 366560 - RNA, 19 nt, Homo sapiens
ggugguccuuaccucauuu

SEQ ID NO: 366561 - RNA, 19 nt, Homo sapiens
uaauaagguuccaguugca

SEQ ID NO: 366562 - RNA, 19 nt, Homo sapiens
ccacgguugcugauucuuu

SEQ ID NO: 366563 - RNA, 19 nt, Homo sapiens
uacagcggauguuagguuu

SEQ ID NO: 366564 - RNA, 19 nt, Homo sapiens
auaaugggcugggcuacaa

SEQ ID NO: 366565 - RNA, 19 nt, Homo sapiens
ggugauaugcugaacuuag

SEQ ID NO: 366566 - RNA, 19 nt, Homo sapiens
ccagagcagaauaugauuu

SEQ ID NO: 366567 - RNA, 19 nt, Homo sapiens
caguagauuuguucagcaa

SEQ ID NO: 366568 - RNA, 19 nt, Homo sapiens
uauggaggcuauaguccuu

SEQ ID NO: 366569 - RNA, 19 nt, Homo sapiens
cacgguugcugauucuuug

SEQ ID NO: 366570 - RNA, 19 nt, Homo sapiens
gaggaugaccauguaguug

SEQ ID NO: 366571 - RNA, 19 nt, Homo sapiens
gggcaaguggugaggauga

SEQ ID NO: 366572 - RNA, 19 nt, Homo sapiens
uauggugccuauggaaauu

SEQ ID NO: 366573 - RNA, 19 nt, Homo sapiens
uauuggauguagcaaauca

SEQ ID NO: 366574 - RNA, 19 nt, Homo sapiens
guccuuauaguuauggaua

SEQ ID NO: 366575 - RNA, 19 nt, Homo sapiens
ggauauggugccuauggaa

SEQ ID NO: 366576 - RNA, 19 nt, Homo sapiens
ggacaaccagcacuuacca

SEQ ID NO: 366577 - RNA, 19 nt, Homo sapiens
cuacagcggauguuagguu

SEQ ID NO: 366578 - RNA, 19 nt, Homo sapiens
ugaauguacaauccaauga

SEQ ID NO: 366579 - RNA, 19 nt, Homo sapiens
acuuauaccugcgaauuau

SEQ ID NO: 366580 - RNA, 19 nt, Homo sapiens
ucacagcagacaggaagua

SEQ ID NO: 366581 - RNA, 19 nt, Homo sapiens
aaccagcacuuaccagagu

SEQ ID NO: 366582 - RNA, 19 nt, Homo sapiens
uaccucauuuggaaacuau

SEQ ID NO: 366583 - RNA, 19 nt, Homo sapiens
gcagcuaccucagcaaaau

SEQ ID NO: 366584 - RNA, 19 nt, Homo sapiens
guugaacaauacuuuagag

SEQ ID NO: 366585 - RNA, 19 nt, Homo sapiens
cuggugauaugcugaacuu

SEQ ID NO: 366586 - RNA, 19 nt, Homo sapiens
uggaaacuauugucuacuc

SEQ ID NO: 366587 - RNA, 19 nt, Homo sapiens
gugcauuucaguccauuga

SEQ ID NO: 366588 - RNA, 19 nt, Homo sapiens
aaacgguggaaucaaguaa

SEQ ID NO: 366589 - RNA, 19 nt, Homo sapiens
ucaguccauugaaaguauu

SEQ ID NO: 366590 - RNA, 19 nt, Homo sapiens
acuaauaagguuccaguug

SEQ ID NO: 366591 - RNA, 19 nt, Homo sapiens
gugauaugcugaacuuagc

SEQ ID NO: 366592 - RNA, 19 nt, Homo sapiens
cauguuugccugcaguuga

SEQ ID NO: 366593 - RNA, 19 nt, Homo sapiens
ugaggaugaccauguaguu

SEQ ID NO: 366594 - RNA, 19 nt, Homo sapiens
ggccaauauucuuguucuu

SEQ ID NO: 366595 - RNA, 19 nt, Homo sapiens
ucagggcuguauuggaugu

SEQ ID NO: 366596 - RNA, 19 nt, Homo sapiens
ugaacaggaagcugccuuu

SEQ ID NO: 366597 - RNA, 19 nt, Homo sapiens
gcugaacuuagcucucaaa

SEQ ID NO: 366598 - RNA, 19 nt, Homo sapiens
uuuccgggcuggugauaug

SEQ ID NO: 366599 - RNA, 19 nt, Homo sapiens
gcggauguuagguuuaaga

SEQ ID NO: 366600 - RNA, 19 nt, Homo sapiens
cagcagacaggaaguagca

SEQ ID NO: 366601 - RNA, 19 nt, Homo sapiens
acaggaaguagcaguguga

SEQ ID NO: 366602 - RNA, 19 nt, Homo sapiens
caauauucuuguucuuugc

SEQ ID NO: 366603 - RNA, 19 nt, Homo sapiens
aaucuuggccaauauucuu

SEQ ID NO: 366604 - RNA, 19 nt, Homo sapiens
aagcugccuuugaaucugu

SEQ ID NO: 366605 - RNA, 19 nt, Homo sapiens
ccaacccaacacuaacuaa

SEQ ID NO: 366606 - RNA, 19 nt, Homo sapiens
guggaaucaaguaaaguuu

SEQ ID NO: 366607 - RNA, 19 nt, Homo sapiens
uagccuugauggccaaaca

SEQ ID NO: 366608 - RNA, 19 nt, Homo sapiens
acuuagcucucaaagaaca

SEQ ID NO: 366609 - RNA, 19 nt, Homo sapiens
uuaccucauuuggaaacua

SEQ ID NO: 366610 - RNA, 19 nt, Homo sapiens
gaacucaaguccgaaauua

SEQ ID NO: 366611 - RNA, 19 nt, Homo sapiens
gaaauuaacuccuugaaag

SEQ ID NO: 366612 - RNA, 19 nt, Homo sapiens
gaaagcagcuggagaggau

SEQ ID NO: 366613 - RNA, 19 nt, Homo sapiens
gaagauaggacuguauaua

SEQ ID NO: 366614 - RNA, 19 nt, Homo sapiens
agaaagggcugacagauga

SEQ ID NO: 366615 - RNA, 19 nt, Homo sapiens
gcagugaaguuucuacaga

SEQ ID NO: 366616 - RNA, 19 nt, Homo sapiens
gcugacagaugaagagauu

SEQ ID NO: 366617 - RNA, 19 nt, Homo sapiens
ucauuugugugaucaugua

SEQ ID NO: 366618 - RNA, 19 nt, Homo sapiens
gcagaucccagucaaguca

SEQ ID NO: 366619 - RNA, 19 nt, Homo sapiens
cgaaauuaacuccuugaaa

SEQ ID NO: 366620 - RNA, 19 nt, Homo sapiens
gaagaaagggcugacagau

SEQ ID NO: 366621 - RNA, 19 nt, Homo sapiens
caggagagcauuucuaaag

SEQ ID NO: 366622 - RNA, 19 nt, Homo sapiens
gaauaucaacgaacucaag

SEQ ID NO: 366623 - RNA, 19 nt, Homo sapiens
uccaggagcugcugauuca

SEQ ID NO: 366624 - RNA, 19 nt, Homo sapiens
gaacggaagauaggacugu

SEQ ID NO: 366625 - RNA, 19 nt, Homo sapiens
caccagcucuacaagaaau

SEQ ID NO: 366626 - RNA, 19 nt, Homo sapiens
ugaggaggaugaugaugug

SEQ ID NO: 366627 - RNA, 19 nt, Homo sapiens
ccagacagugacucaguua

SEQ ID NO: 366628 - RNA, 19 nt, Homo sapiens
ccucauaucucagccauac

SEQ ID NO: 366629 - RNA, 19 nt, Homo sapiens
cggaagauaggacuguaua

SEQ ID NO: 366630 - RNA, 19 nt, Homo sapiens
ugacagaugaagagauuga

SEQ ID NO: 366631 - RNA, 19 nt, Homo sapiens
aaauaccaguugccacuau

SEQ ID NO: 366632 - RNA, 19 nt, Homo sapiens
ccacggcagugaaguuucu

SEQ ID NO: 366633 - RNA, 19 nt, Homo sapiens
cagaugaagagauugauau

SEQ ID NO: 366634 - RNA, 19 nt, Homo sapiens
ucaacgagcagguggagaa

SEQ ID NO: 366635 - RNA, 19 nt, Homo sapiens
aggagagcauuucuaaaga

SEQ ID NO: 366636 - RNA, 19 nt, Homo sapiens
ggaagauaggacuguauau

SEQ ID NO: 366637 - RNA, 19 nt, Homo sapiens
ccgaugagccuucguccuu

SEQ ID NO: 366638 - RNA, 19 nt, Homo sapiens
gaccucagaacggaagaua

SEQ ID NO: 366639 - RNA, 19 nt, Homo sapiens
cgaacucaaguccgaaauu

SEQ ID NO: 366640 - RNA, 19 nt, Homo sapiens
gggaugggcagaucaacga

SEQ ID NO: 366641 - RNA, 19 nt, Homo sapiens
gauggaggccggucucucu

SEQ ID NO: 366642 - RNA, 19 nt, Homo sapiens
gaaagggcugacagaugaa

SEQ ID NO: 366643 - RNA, 19 nt, Homo sapiens
cuaaucccauggcgagaug

SEQ ID NO: 366644 - RNA, 19 nt, Homo sapiens
cgccagagcccacuugcaa

SEQ ID NO: 366645 - RNA, 19 nt, Homo sapiens
acagaugaagagauugaua

SEQ ID NO: 366646 - RNA, 19 nt, Homo sapiens
gacagugacucaguuacag

SEQ ID NO: 366647 - RNA, 19 nt, Homo sapiens
gcauugcauuuggcuuuca

SEQ ID NO: 366648 - RNA, 19 nt, Homo sapiens
cauggcaggcauugcauuu

SEQ ID NO: 366649 - RNA, 19 nt, Homo sapiens
aagaaagggcugacagaug

SEQ ID NO: 366650 - RNA, 19 nt, Homo sapiens
guucauuugugugaucaug

SEQ ID NO: 366651 - RNA, 19 nt, Homo sapiens
uguaaugguucagcuaauc

SEQ ID NO: 366652 - RNA, 19 nt, Homo sapiens
gccuuuggcuuugaucuca

SEQ ID NO: 366653 - RNA, 19 nt, Homo sapiens
uucaccagcucuacaagaa

SEQ ID NO: 366654 - RNA, 19 nt, Homo sapiens
ccagcugccuuuggcuuug

SEQ ID NO: 366655 - RNA, 19 nt, Homo sapiens
gcuccacggucaccuacca

SEQ ID NO: 366656 - RNA, 19 nt, Homo sapiens
cagcagcagcgacaucuca

SEQ ID NO: 366657 - RNA, 19 nt, Homo sapiens
cagaauaucaacgaacuca

SEQ ID NO: 366658 - RNA, 19 nt, Homo sapiens
caucauggcaggcauugca

SEQ ID NO: 366659 - RNA, 19 nt, Homo sapiens
cagcugccuuuggcuuuga

SEQ ID NO: 366660 - RNA, 19 nt, Homo sapiens
cgaggaggaugaggaggau

SEQ ID NO: 366661 - RNA, 19 nt, Homo sapiens
agaagaaagggcugacaga

SEQ ID NO: 366662 - RNA, 19 nt, Homo sapiens
uaaauaccaguugccacua

SEQ ID NO: 366663 - RNA, 19 nt, Homo sapiens
uggcaggcauugcauuugg

SEQ ID NO: 366664 - RNA, 19 nt, Homo sapiens
gcucuacuccaggaaguga

SEQ ID NO: 366665 - RNA, 19 nt, Homo sapiens
cccagacagugacucaguu

SEQ ID NO: 366666 - RNA, 19 nt, Homo sapiens
gcaaccaggagagcauuuc

SEQ ID NO: 366667 - RNA, 19 nt, Homo sapiens
guguaaugguucagcuaau

SEQ ID NO: 366668 - RNA, 19 nt, Homo sapiens
cguguaaugguucagcuaa

SEQ ID NO: 366669 - RNA, 19 nt, Homo sapiens
ccacgcauggccagagcua

SEQ ID NO: 366670 - RNA, 19 nt, Homo sapiens
gcagcuuggagcccaggua

SEQ ID NO: 366671 - RNA, 19 nt, Homo sapiens
ggaugaggaggaugaugau

SEQ ID NO: 366672 - RNA, 19 nt, Homo sapiens
aggaugaggaggaugauga

SEQ ID NO: 366673 - RNA, 19 nt, Homo sapiens
aguccgaaauuaacuccuu

SEQ ID NO: 366674 - RNA, 19 nt, Homo sapiens
ugauucagcagcagcagaa

SEQ ID NO: 366675 - RNA, 19 nt, Homo sapiens
accaggagagcauuucuaa

SEQ ID NO: 366676 - RNA, 19 nt, Homo sapiens
agacagugacucaguuaca

SEQ ID NO: 366677 - RNA, 19 nt, Homo sapiens
aggcauugcauuuggcuuu

SEQ ID NO: 366678 - RNA, 19 nt, Homo sapiens
ccaggagagcauuucuaaa

SEQ ID NO: 366679 - RNA, 19 nt, Homo sapiens
cguccucccagacaaauga

SEQ ID NO: 366680 - RNA, 19 nt, Homo sapiens
agaagagggaggacaagga

SEQ ID NO: 366681 - RNA, 19 nt, Homo sapiens
cccagaauaucaacgaacu

SEQ ID NO: 366682 - RNA, 19 nt, Homo sapiens
ggcauugcauuuggcuuuc

SEQ ID NO: 366683 - RNA, 19 nt, Homo sapiens
gaugaagagauugauaugg

SEQ ID NO: 366684 - RNA, 19 nt, Homo sapiens
uuugugugaucauguauag

SEQ ID NO: 366685 - RNA, 19 nt, Homo sapiens
cacggucaccuaccacuug

SEQ ID NO: 366686 - RNA, 19 nt, Homo sapiens
ucaccagcucuacaagaaa

SEQ ID NO: 366687 - RNA, 19 nt, Homo sapiens
ccucagaacggaagauagg

SEQ ID NO: 366688 - RNA, 19 nt, Homo sapiens
ggguguguuugcugagugu

SEQ ID NO: 366689 - RNA, 19 nt, Homo sapiens
gcaaggcgaggaggagaag

SEQ ID NO: 366690 - RNA, 19 nt, Homo sapiens
caaucuaacugugaaagaa

SEQ ID NO: 366691 - RNA, 19 nt, Homo sapiens
uagccacgcugaagaaugg

SEQ ID NO: 366692 - RNA, 19 nt, Homo sapiens
gcgcugaagcugaagaaga

SEQ ID NO: 366693 - RNA, 19 nt, Homo sapiens
ugugugcauuugcuauaua

SEQ ID NO: 366694 - RNA, 19 nt, Homo sapiens
cgcugaagcugaagaagau

SEQ ID NO: 366695 - RNA, 19 nt, Homo sapiens
ugauagccacgcugaagaa

SEQ ID NO: 366696 - RNA, 19 nt, Homo sapiens
cugcagugccuguguguga

SEQ ID NO: 366697 - RNA, 19 nt, Homo sapiens
uaacugugaaagaaacuuc

SEQ ID NO: 366698 - RNA, 19 nt, Homo sapiens
gugugugcauuugcuauau

SEQ ID NO: 366699 - RNA, 19 nt, Homo sapiens
ucaaucuaacugugaaaga

SEQ ID NO: 366700 - RNA, 19 nt, Homo sapiens
gugugcauuugcuauauag

SEQ ID NO: 366701 - RNA, 19 nt, Homo sapiens
cgugugugcauuugcuaua

SEQ ID NO: 366702 - RNA, 19 nt, Homo sapiens
ggaccugcagugccugugu

SEQ ID NO: 366703 - RNA, 19 nt, Homo sapiens
uuggagaguuagcuacuag

SEQ ID NO: 366704 - RNA, 19 nt, Homo sapiens
acaauuagcuugccaauaa

SEQ ID NO: 366705 - RNA, 19 nt, Homo sapiens
uaguagcucuuaagcauua

SEQ ID NO: 366706 - RNA, 19 nt, Homo sapiens
gaaggaaggcuugguuuaa

SEQ ID NO: 366707 - RNA, 19 nt, Homo sapiens
ggaaggcuugguuuaauaa

SEQ ID NO: 366708 - RNA, 19 nt, Homo sapiens
caaucuaacugugaaagaa

SEQ ID NO: 366709 - RNA, 19 nt, Homo sapiens
aaauaaugcugacacauca

SEQ ID NO: 366710 - RNA, 19 nt, Homo sapiens
gcugacacaucacaauuuc

SEQ ID NO: 366711 - RNA, 19 nt, Homo sapiens
gcugauacauauuuguuca

SEQ ID NO: 366712 - RNA, 19 nt, Homo sapiens
aggaacauuuggagaguua

SEQ ID NO: 366713 - RNA, 19 nt, Homo sapiens
aggaaggcuugguuuaaua

SEQ ID NO: 366714 - RNA, 19 nt, Homo sapiens
caauuagcuugccaauaaa

SEQ ID NO: 366715 - RNA, 19 nt, Homo sapiens
ugaaggaaggcuugguuua

SEQ ID NO: 366716 - RNA, 19 nt, Homo sapiens
aaccucagcugcaacauga

SEQ ID NO: 366717 - RNA, 19 nt, Homo sapiens
gccaggagaugcuguucuu

SEQ ID NO: 366718 - RNA, 19 nt, Homo sapiens
gaaccucagcugcaacaug

SEQ ID NO: 366719 - RNA, 19 nt, Homo sapiens
uagccacgcugaagaaugg

SEQ ID NO: 366720 - RNA, 19 nt, Homo sapiens
uaaggaacauuuggagagu

SEQ ID NO: 366721 - RNA, 19 nt, Homo sapiens
uugcaguacuuuauagcua

SEQ ID NO: 366722 - RNA, 19 nt, Homo sapiens
gugauugcaguacuuuaua

SEQ ID NO: 366723 - RNA, 19 nt, Homo sapiens
aaggaaggcuugguuuaau

SEQ ID NO: 366724 - RNA, 19 nt, Homo sapiens
gcugaagaaugggaggaaa

SEQ ID NO: 366725 - RNA, 19 nt, Homo sapiens
ugcaagcccugcuguacaa

SEQ ID NO: 366726 - RNA, 19 nt, Homo sapiens
auuaguagcucuuaagcau

SEQ ID NO: 366727 - RNA, 19 nt, Homo sapiens
ccuugaauguuacaauuag

SEQ ID NO: 366728 - RNA, 19 nt, Homo sapiens
gcaguacuuuauagcuaca

SEQ ID NO: 366729 - RNA, 19 nt, Homo sapiens
gugugcacuuucaaucuaa

SEQ ID NO: 366730 - RNA, 19 nt, Homo sapiens
guuagcugauacauauuug

SEQ ID NO: 366731 - RNA, 19 nt, Homo sapiens
gcacuuucaaucuaacugu

SEQ ID NO: 366732 - RNA, 19 nt, Homo sapiens
ugauugcaguacuuuauag

SEQ ID NO: 366733 - RNA, 19 nt, Homo sapiens
gcuacauauuuaccuugaa

SEQ ID NO: 366734 - RNA, 19 nt, Homo sapiens
ugacacaucacaauuucau

SEQ ID NO: 366735 - RNA, 19 nt, Homo sapiens
aaaucaaguugugguauag

SEQ ID NO: 366736 - RNA, 19 nt, Homo sapiens
gcucuuaagcauuacaucu

SEQ ID NO: 366737 - RNA, 19 nt, Homo sapiens
aagcccugcuguacaagaa

SEQ ID NO: 366738 - RNA, 19 nt, Homo sapiens
gaggaaaauuugcuuggau

SEQ ID NO: 366739 - RNA, 19 nt, Homo sapiens
guucaguguuauauguuag

SEQ ID NO: 366740 - RNA, 19 nt, Homo sapiens
ucauagccacgcugaagaa

SEQ ID NO: 366741 - RNA, 19 nt, Homo sapiens
cugcagugccuguguguga

SEQ ID NO: 366742 - RNA, 19 nt, Homo sapiens
gacacaucacaauuucaua

SEQ ID NO: 366743 - RNA, 19 nt, Homo sapiens
ggaggaaaauuugcuugga

SEQ ID NO: 366744 - RNA, 19 nt, Homo sapiens
agcauuacaucugcaaaga

SEQ ID NO: 366745 - RNA, 19 nt, Homo sapiens
guugugguauagucaaucu

SEQ ID NO: 366746 - RNA, 19 nt, Homo sapiens
ucaaucuaacugugaaaga

SEQ ID NO: 366747 - RNA, 19 nt, Homo sapiens
uaugaaggaaggcuugguu

SEQ ID NO: 366748 - RNA, 19 nt, Homo sapiens
ggaccugcagugccugugu

SEQ ID NO: 366749 - RNA, 19 nt, Homo sapiens
ugugauugcaguacuuuau

SEQ ID NO: 366750 - RNA, 19 nt, Homo sapiens
caaguugugguauagucaa

SEQ ID NO: 366751 - RNA, 19 nt, Homo sapiens
uuggagaguuagcuacuag

SEQ ID NO: 366752 - RNA, 19 nt, Homo sapiens
aagaaugggaggaaaauuu

SEQ ID NO: 366753 - RNA, 19 nt, Homo sapiens
gcaaagacccugaggaaga

SEQ ID NO: 366754 - RNA, 19 nt, Homo sapiens
gaacaacggacgugcaauc

SEQ ID NO: 366755 - RNA, 19 nt, Homo sapiens
gcagugcuguccugagaug

SEQ ID NO: 366756 - RNA, 19 nt, Homo sapiens
caucagcugucaagaaauc

SEQ ID NO: 366757 - RNA, 19 nt, Homo sapiens
acacgugccugcuugcaaa

SEQ ID NO: 366758 - RNA, 19 nt, Homo sapiens
uccaucagcugucaagaaa

SEQ ID NO: 366759 - RNA, 19 nt, Homo sapiens
gaagaauccuccggcaagu

SEQ ID NO: 366760 - RNA, 19 nt, Homo sapiens
ggagaaacgaccaugucua

SEQ ID NO: 366761 - RNA, 19 nt, Homo sapiens
gagaaacgaccaugucuac

SEQ ID NO: 366762 - RNA, 19 nt, Homo sapiens
gggcaguacucaacaugau

SEQ ID NO: 366763 - RNA, 19 nt, Homo sapiens
caaagacccugaggaagag

SEQ ID NO: 366764 - RNA, 19 nt, Homo sapiens
ucacacggcuaggaaguug

SEQ ID NO: 366765 - RNA, 19 nt, Homo sapiens
gaggaacucuaacacuucu

SEQ ID NO: 366766 - RNA, 19 nt, Homo sapiens
gcucagggguguuaaguga

SEQ ID NO: 366767 - RNA, 19 nt, Homo sapiens
gaaccuaaggagacacgaa

SEQ ID NO: 366768 - RNA, 19 nt, Homo sapiens
ccacgaaccuaaggagaca

SEQ ID NO: 366769 - RNA, 19 nt, Homo sapiens
caccugagcccucccagaa

SEQ ID NO: 366770 - RNA, 19 nt, Homo sapiens
gaaacgaccaugucuacac

SEQ ID NO: 366771 - RNA, 19 nt, Homo sapiens
gcaguacucaacaugauca

SEQ ID NO: 366772 - RNA, 19 nt, Homo sapiens
gacggaacaugaaguccau

SEQ ID NO: 366773 - RNA, 19 nt, Homo sapiens
gggcagugcucuggaaagg

SEQ ID NO: 366774 - RNA, 19 nt, Homo sapiens
gaggagaaacgaccauguc

SEQ ID NO: 366775 - RNA, 19 nt, Homo sapiens
ugaaguccaucagcuguca

SEQ ID NO: 366776 - RNA, 19 nt, Homo sapiens
gaccuuccaaaccucaaua

SEQ ID NO: 366777 - RNA, 19 nt, Homo sapiens
gacaggcacaggaaucaga

SEQ ID NO: 366778 - RNA, 19 nt, Homo sapiens
gcaggccccucgauuguug

SEQ ID NO: 366779 - RNA, 19 nt, Homo sapiens
gcaccgcacacucacuuca

SEQ ID NO: 366780 - RNA, 19 nt, Homo sapiens
uugcaaagacccugaggaa

SEQ ID NO: 366781 - RNA, 19 nt, Homo sapiens
ggaggagaaacgaccaugu

SEQ ID NO: 366782 - RNA, 19 nt, Homo sapiens
guccaucagcugucaagaa

SEQ ID NO: 366783 - RNA, 19 nt, Homo sapiens
ucacccugcucccaagugu

SEQ ID NO: 366784 - RNA, 19 nt, Homo sapiens
acgcuccuaugcuccauuu

SEQ ID NO: 366785 - RNA, 19 nt, Homo sapiens
gaaggucagggcgagaaga

SEQ ID NO: 366786 - RNA, 19 nt, Homo sapiens
ggaacucuaacacuucucu

SEQ ID NO: 366787 - RNA, 19 nt, Homo sapiens
aaaggaucauggucagagu

SEQ ID NO: 366788 - RNA, 19 nt, Homo sapiens
ccugagcccucccagaaac

SEQ ID NO: 366789 - RNA, 19 nt, Homo sapiens
aaugggcagugcucuggaa

SEQ ID NO: 366790 - RNA, 19 nt, Homo sapiens
cgggaccuccucucuggua

SEQ ID NO: 366791 - RNA, 19 nt, Homo sapiens
cuucucuccuccacucuga

SEQ ID NO: 366792 - RNA, 19 nt, Homo sapiens
caaguuugacggacaucga

SEQ ID NO: 366793 - RNA, 19 nt, Homo sapiens
ucugucaccugcuccaaag

SEQ ID NO: 366794 - RNA, 19 nt, Homo sapiens
ggaccuccucucugguaga

SEQ ID NO: 366795 - RNA, 19 nt, Homo sapiens
caaggucacacggcuagga

SEQ ID NO: 366796 - RNA, 19 nt, Homo sapiens
ucacuucacccugguucaa

SEQ ID NO: 366797 - RNA, 19 nt, Homo sapiens
auacagagaucaugacuuu

SEQ ID NO: 366798 - RNA, 19 nt, Homo sapiens
uaacauguaugaaggugua

SEQ ID NO: 366799 - RNA, 19 nt, Homo sapiens
aaaggaaguucaacaguaa

SEQ ID NO: 366800 - RNA, 19 nt, Homo sapiens
gaucaugacuuugguagau

SEQ ID NO: 366801 - RNA, 19 nt, Homo sapiens
guaugaagguguaggaaga

SEQ ID NO: 366802 - RNA, 19 nt, Homo sapiens
gauggaugcuuuauuugga

SEQ ID NO: 366803 - RNA, 19 nt, Homo sapiens
ucaaacacagccauuauaa

SEQ ID NO: 366804 - RNA, 19 nt, Homo sapiens
gcaagccaguugucaaaca

SEQ ID NO: 366805 - RNA, 19 nt, Homo sapiens
cccgauggaugcuuuauuu

SEQ ID NO: 366806 - RNA, 19 nt, Homo sapiens
uagaugagacuaacaugua

SEQ ID NO: 366807 - RNA, 19 nt, Homo sapiens
ccaaaguuauugacacuca

SEQ ID NO: 366808 - RNA, 19 nt, Homo sapiens
caucagagcccuuccuuuc

SEQ ID NO: 366809 - RNA, 19 nt, Homo sapiens
gaaucucagugaacagaau

SEQ ID NO: 366810 - RNA, 19 nt, Homo sapiens
gacagaagaggaagaaaga

SEQ ID NO: 366811 - RNA, 19 nt, Homo sapiens
ucagagcccuuccuuucuu

SEQ ID NO: 366812 - RNA, 19 nt, Homo sapiens
aaaaggaaguucaacagua

SEQ ID NO: 366813 - RNA, 19 nt, Homo sapiens
guaagcagcaccuccaaga

SEQ ID NO: 366814 - RNA, 19 nt, Homo sapiens
ucgcagacauacagauuga

SEQ ID NO: 366815 - RNA, 19 nt, Homo sapiens
uaaggaagcugaggacaac

SEQ ID NO: 366816 - RNA, 19 nt, Homo sapiens
gcaguagacagaagaggaa

SEQ ID NO: 366817 - RNA, 19 nt, Homo sapiens
gccuugcccucuucucuuu

SEQ ID NO: 366818 - RNA, 19 nt, Homo sapiens
gaacagcuaaacagaacga

SEQ ID NO: 366819 - RNA, 19 nt, Homo sapiens
gucaaacacagccauuaua

SEQ ID NO: 366820 - RNA, 19 nt, Homo sapiens
ugccugagcuuuccacuag

SEQ ID NO: 366821 - RNA, 19 nt, Homo sapiens
ccaggugggccaauuauuc

SEQ ID NO: 366822 - RNA, 19 nt, Homo sapiens
caaggaagcaauucacagu

SEQ ID NO: 366823 - RNA, 19 nt, Homo sapiens
gagacuaacauguaugaag

SEQ ID NO: 366824 - RNA, 19 nt, Homo sapiens
caaacacagccauuauaau

SEQ ID NO: 366825 - RNA, 19 nt, Homo sapiens
gcucgcagacauacagauu

SEQ ID NO: 366826 - RNA, 19 nt, Homo sapiens
ggugaagcucgcagacaua

SEQ ID NO: 366827 - RNA, 19 nt, Homo sapiens
agaugagacuaacauguau

SEQ ID NO: 366828 - RNA, 19 nt, Homo sapiens
guagacagaagaggaagaa

SEQ ID NO: 366829 - RNA, 19 nt, Homo sapiens
cauacagauugaacagcua

SEQ ID NO: 366830 - RNA, 19 nt, Homo sapiens
gaggaagaaagaacagaug

SEQ ID NO: 366831 - RNA, 19 nt, Homo sapiens
aggaagcaauucacaguca

SEQ ID NO: 366832 - RNA, 19 nt, Homo sapiens
guagaugagacuaacaugu

SEQ ID NO: 366833 - RNA, 19 nt, Homo sapiens
aggagugucugcagggaaa

SEQ ID NO: 366834 - RNA, 19 nt, Homo sapiens
gaagcucgcagacauacag

SEQ ID NO: 366835 - RNA, 19 nt, Homo sapiens
gauugaacagcuaaacaga

SEQ ID NO: 366836 - RNA, 19 nt, Homo sapiens
gaugggagccagggcaaga

SEQ ID NO: 366837 - RNA, 19 nt, Homo sapiens
cagagcccuuccuuucuug

SEQ ID NO: 366838 - RNA, 19 nt, Homo sapiens
acagauacagagaucauga

SEQ ID NO: 366839 - RNA, 19 nt, Homo sapiens
ucaaaaugcaucccuaaaa

SEQ ID NO: 366840 - RNA, 19 nt, Homo sapiens
acagagaucaugacuuugg

SEQ ID NO: 366841 - RNA, 19 nt, Homo sapiens
gcagacauacagauugaac

SEQ ID NO: 366842 - RNA, 19 nt, Homo sapiens
ugucaaacacagccauuau

SEQ ID NO: 366843 - RNA, 19 nt, Homo sapiens
gaagaggaagaaagaacag

SEQ ID NO: 366844 - RNA, 19 nt, Homo sapiens
gcaucagagcccuuccuuu

SEQ ID NO: 366845 - RNA, 19 nt, Homo sapiens
caggugggccaauuauuca

SEQ ID NO: 366846 - RNA, 19 nt, Homo sapiens
uugaacagcuaaacagaac

SEQ ID NO: 366847 - RNA, 19 nt, Homo sapiens
gcagaaaauagcagaagaa

SEQ ID NO: 366848 - RNA, 19 nt, Homo sapiens
agacagaagaggaagaaag

SEQ ID NO: 366849 - RNA, 19 nt, Homo sapiens
gcaugcaguagacagaaga

SEQ ID NO: 366850 - RNA, 19 nt, Homo sapiens
uuaaggaagcugaggacaa

SEQ ID NO: 366851 - RNA, 19 nt, Homo sapiens
acacucaacagaaggugaa

SEQ ID NO: 366852 - RNA, 19 nt, Homo sapiens
gcuguuagagaagcagaaa

SEQ ID NO: 366853 - RNA, 19 nt, Homo sapiens
gaugagacuaacauguaug

SEQ ID NO: 366854 - RNA, 19 nt, Homo sapiens
cagcuaaacagaacgaaaa

SEQ ID NO: 366855 - RNA, 19 nt, Homo sapiens
caagccaguugucaaacac

SEQ ID NO: 366856 - RNA, 19 nt, Homo sapiens
aaucucagugaacagaaua

SEQ ID NO: 366857 - RNA, 19 nt, Homo sapiens
gauacagagaucaugacuu

SEQ ID NO: 366858 - RNA, 19 nt, Homo sapiens
agaagaggaagaaagaaca

SEQ ID NO: 366859 - RNA, 19 nt, Homo sapiens
cgauggaugcuuuauuugg

SEQ ID NO: 366860 - RNA, 19 nt, Homo sapiens
ccguggaucuagagcugaa

SEQ ID NO: 366861 - RNA, 19 nt, Homo sapiens
uugcaagccaguugucaaa

SEQ ID NO: 366862 - RNA, 19 nt, Homo sapiens
cagaagaggaagaaagaac

SEQ ID NO: 366863 - RNA, 19 nt, Homo sapiens
auacagauugaacagcuaa

SEQ ID NO: 366864 - RNA, 19 nt, Homo sapiens
cgggaugugugaugaacuc

SEQ ID NO: 366865 - RNA, 19 nt, Homo sapiens
ggaagcugaggacaacauc

SEQ ID NO: 366866 - RNA, 19 nt, Homo sapiens
cagauugaacagcuaaaca

SEQ ID NO: 366867 - RNA, 19 nt, Homo sapiens
cagagaucaugacuuuggu

SEQ ID NO: 366868 - RNA, 19 nt, Homo sapiens
cacgccagccagaccaaua

SEQ ID NO: 366869 - RNA, 19 nt, Homo sapiens
caucacauuuucugcauca

SEQ ID NO: 366870 - RNA, 19 nt, Homo sapiens
gaccaaggccuuugcauuu

SEQ ID NO: 366871 - RNA, 19 nt, Homo sapiens
gaacaacaaggagcagaua

SEQ ID NO: 366872 - RNA, 19 nt, Homo sapiens
ggagcgaacugucaaagag

SEQ ID NO: 366873 - RNA, 19 nt, Homo sapiens
ggaccaaggccuuugcauu

SEQ ID NO: 366874 - RNA, 19 nt, Homo sapiens
cacagcagcuucaggcaaa

SEQ ID NO: 366875 - RNA, 19 nt, Homo sapiens
gagcagauacagaagauca

SEQ ID NO: 366876 - RNA, 19 nt, Homo sapiens
ccacuucuaauuucucuuu

SEQ ID NO: 366877 - RNA, 19 nt, Homo sapiens
cggcgaagauggcggagaa

SEQ ID NO: 366878 - RNA, 19 nt, Homo sapiens
acaaggagcagauacagaa

SEQ ID NO: 366879 - RNA, 19 nt, Homo sapiens
gaagccagcagccaaggaa

SEQ ID NO: 366880 - RNA, 19 nt, Homo sapiens
cagcugaguuggagaugga

SEQ ID NO: 366881 - RNA, 19 nt, Homo sapiens
ugacucccacuucuaauuu

SEQ ID NO: 366882 - RNA, 19 nt, Homo sapiens
ugaaggagguagaugaaac

SEQ ID NO: 366883 - RNA, 19 nt, Homo sapiens
gcagauacagaagaucauu

SEQ ID NO: 366884 - RNA, 19 nt, Homo sapiens
aagaggugcugcccgcuuu

SEQ ID NO: 366885 - RNA, 19 nt, Homo sapiens
ggugauugcuggcuucaac

SEQ ID NO: 366886 - RNA, 19 nt, Homo sapiens
guagaugaaacucguaagu

SEQ ID NO: 366887 - RNA, 19 nt, Homo sapiens
gaaggagguagaugaaacu

SEQ ID NO: 366888 - RNA, 19 nt, Homo sapiens
auacagaagaucauugaga

SEQ ID NO: 366889 - RNA, 19 nt, Homo sapiens
gggaaaagaacuaaaugaa

SEQ ID NO: 366890 - RNA, 19 nt, Homo sapiens
agauacagaagaucauuga

SEQ ID NO: 366891 - RNA, 19 nt, Homo sapiens
uaagugcuaccgcaugguu

SEQ ID NO: 366892 - RNA, 19 nt, Homo sapiens
gaaugagcacagccuagug

SEQ ID NO: 366893 - RNA, 19 nt, Homo sapiens
aguuggagauggaguugaa

SEQ ID NO: 366894 - RNA, 19 nt, Homo sapiens
gacucccacuucuaauuuc

SEQ ID NO: 366895 - RNA, 19 nt, Homo sapiens
gcaaagggaaaagaacuaa

SEQ ID NO: 366896 - RNA, 19 nt, Homo sapiens
gaucauugagacacugaca

SEQ ID NO: 366897 - RNA, 19 nt, Homo sapiens
aaugagcacagccuaguga

SEQ ID NO: 366898 - RNA, 19 nt, Homo sapiens
caaccgccuucggcaggaa

SEQ ID NO: 366899 - RNA, 19 nt, Homo sapiens
aggagcagauacagaagau

SEQ ID NO: 366900 - RNA, 19 nt, Homo sapiens
caacaaggagcagauacag

SEQ ID NO: 366901 - RNA, 19 nt, Homo sapiens
ccgcagagcaggugauugc

SEQ ID NO: 366902 - RNA, 19 nt, Homo sapiens
ggagauggaguugaaugag

SEQ ID NO: 366903 - RNA, 19 nt, Homo sapiens
uagaugaaacucguaagug

SEQ ID NO: 366904 - RNA, 19 nt, Homo sapiens
auccaaagcagcugaguug

SEQ ID NO: 366905 - RNA, 19 nt, Homo sapiens
cagauacagaagaucauug

SEQ ID NO: 366906 - RNA, 19 nt, Homo sapiens
gagguagaugaaacucgua

SEQ ID NO: 366907 - RNA, 19 nt, Homo sapiens
ugaaugagcacagccuagu

SEQ ID NO: 366908 - RNA, 19 nt, Homo sapiens
ucacaugucugcuuauuua

SEQ ID NO: 366909 - RNA, 19 nt, Homo sapiens
ucacagagcugaaggaaga

SEQ ID NO: 366910 - RNA, 19 nt, Homo sapiens
caagagaugugcagaaaga

SEQ ID NO: 366911 - RNA, 19 nt, Homo sapiens
caacuaaagcuuugucaua

SEQ ID NO: 366912 - RNA, 19 nt, Homo sapiens
gaaggaagaaauagaagua

SEQ ID NO: 366913 - RNA, 19 nt, Homo sapiens
ggaggcauguggagcuuua

SEQ ID NO: 366914 - RNA, 19 nt, Homo sapiens
gaugaugauugcuuaauga

SEQ ID NO: 366915 - RNA, 19 nt, Homo sapiens
caaaugacauggaaagcaa

SEQ ID NO: 366916 - RNA, 19 nt, Homo sapiens
gaaguuaaacagcuaugua

SEQ ID NO: 366917 - RNA, 19 nt, Homo sapiens
gaaggcggcugcagaagau

SEQ ID NO: 366918 - RNA, 19 nt, Homo sapiens
agaagaaauugacgccuua

SEQ ID NO: 366919 - RNA, 19 nt, Homo sapiens
gaugauugcuuaaugauac

SEQ ID NO: 366920 - RNA, 19 nt, Homo sapiens
gaagaaggcggcugcagaa

SEQ ID NO: 366921 - RNA, 19 nt, Homo sapiens
gaaauugacgccuuagaau

SEQ ID NO: 366922 - RNA, 19 nt, Homo sapiens
gcagaagaugucaauguua

SEQ ID NO: 366923 - RNA, 19 nt, Homo sapiens
uaucagagauuuggguaaa

SEQ ID NO: 366924 - RNA, 19 nt, Homo sapiens
gcaagaaauguuagaagaa

SEQ ID NO: 366925 - RNA, 19 nt, Homo sapiens
ucaaauuggugaugucuuc

SEQ ID NO: 366926 - RNA, 19 nt, Homo sapiens
gaauacaaguagaaucaca

SEQ ID NO: 366927 - RNA, 19 nt, Homo sapiens
ugauaaagauguggaaguu

SEQ ID NO: 366928 - RNA, 19 nt, Homo sapiens
caagaaauguuagaagaag

SEQ ID NO: 366929 - RNA, 19 nt, Homo sapiens
aaacaaauuugcacggaau

SEQ ID NO: 366930 - RNA, 19 nt, Homo sapiens
gggcagaaccacagaagaa

SEQ ID NO: 366931 - RNA, 19 nt, Homo sapiens
ggagcaacauaaaccuuga

SEQ ID NO: 366932 - RNA, 19 nt, Homo sapiens
gaagaaacgcaagaaaugu

SEQ ID NO: 366933 - RNA, 19 nt, Homo sapiens
gaagacaguauucaccuau

SEQ ID NO: 366934 - RNA, 19 nt, Homo sapiens
gcacggaauacaaguagaa

SEQ ID NO: 366935 - RNA, 19 nt, Homo sapiens
cagaagaugucaauguuac

SEQ ID NO: 366936 - RNA, 19 nt, Homo sapiens
cgcaagaaauguuagaaga

SEQ ID NO: 366937 - RNA, 19 nt, Homo sapiens
gauaaagauguggaaguua

SEQ ID NO: 366938 - RNA, 19 nt, Homo sapiens
ugaagcugaugaaaguuaa

SEQ ID NO: 366939 - RNA, 19 nt, Homo sapiens
guuagcagauuugaaaguu

SEQ ID NO: 366940 - RNA, 19 nt, Homo sapiens
gaagaugcuugugaugaca

SEQ ID NO: 366941 - RNA, 19 nt, Homo sapiens
caauguuacuuucgaagau

SEQ ID NO: 366942 - RNA, 19 nt, Homo sapiens
caacauaaaccuugaagcu

SEQ ID NO: 366943 - RNA, 19 nt, Homo sapiens
gugcagaaagaaauguuua

SEQ ID NO: 366944 - RNA, 19 nt, Homo sapiens
ccuugaagcugaugaaagu

SEQ ID NO: 366945 - RNA, 19 nt, Homo sapiens
guuagaagaagcaaagaaa

SEQ ID NO: 366946 - RNA, 19 nt, Homo sapiens
agaagaaacgcaagaaaug

SEQ ID NO: 366947 - RNA, 19 nt, Homo sapiens
caagaagaaacgcaagaaa

SEQ ID NO: 366948 - RNA, 19 nt, Homo sapiens
gcugaaggaagaaauagaa

SEQ ID NO: 366949 - RNA, 19 nt, Homo sapiens
aaaguucaguuguaugcaa

SEQ ID NO: 366950 - RNA, 19 nt, Homo sapiens
gaagaugucaauguuacuu

SEQ ID NO: 366951 - RNA, 19 nt, Homo sapiens
agaaacgcaagaaauguua

SEQ ID NO: 366952 - RNA, 19 nt, Homo sapiens
ugcagaagaugucaauguu

SEQ ID NO: 366953 - RNA, 19 nt, Homo sapiens
aauccugcauccuugcuua

SEQ ID NO: 366954 - RNA, 19 nt, Homo sapiens
guuaaacagcuauguaugu

SEQ ID NO: 366955 - RNA, 19 nt, Homo sapiens
gagaugugcagaaagaaau

SEQ ID NO: 366956 - RNA, 19 nt, Homo sapiens
agaagacaguauucaccua

SEQ ID NO: 366957 - RNA, 19 nt, Homo sapiens
ccuagaagaugcuugugau

SEQ ID NO: 366958 - RNA, 19 nt, Homo sapiens
auguggagcuuuauacaaa

SEQ ID NO: 366959 - RNA, 19 nt, Homo sapiens
cauccuugcuuauuucaca

SEQ ID NO: 366960 - RNA, 19 nt, Homo sapiens
agaaauugacgccuuagaa

SEQ ID NO: 366961 - RNA, 19 nt, Homo sapiens
ugcagaugaugauugcuua

SEQ ID NO: 366962 - RNA, 19 nt, Homo sapiens
gaaccacagaagaacguuu

SEQ ID NO: 366963 - RNA, 19 nt, Homo sapiens
ccugcauccuugcuuauuu

SEQ ID NO: 366964 - RNA, 19 nt, Homo sapiens
acgauuauaucaagucuag

SEQ ID NO: 366965 - RNA, 19 nt, Homo sapiens
acaguugugucauguuguu

SEQ ID NO: 366966 - RNA, 19 nt, Homo sapiens
gacaguauucaccuaugua

SEQ ID NO: 366967 - RNA, 19 nt, Homo sapiens
agacaguauucaccuaugu

SEQ ID NO: 366968 - RNA, 19 nt, Homo sapiens
cggaauacaaguagaauca

SEQ ID NO: 366969 - RNA, 19 nt, Homo sapiens
accaagagaugugcagaaa

SEQ ID NO: 366970 - RNA, 19 nt, Homo sapiens
uuucacaacuaaagcuuug

SEQ ID NO: 366971 - RNA, 19 nt, Homo sapiens
cagcgaguguuagcagauu

SEQ ID NO: 366972 - RNA, 19 nt, Homo sapiens
gcagaugaugauugcuuaa

SEQ ID NO: 366973 - RNA, 19 nt, Homo sapiens
uagaagaugcuugugauga

SEQ ID NO: 366974 - RNA, 19 nt, Homo sapiens
aagaagaaacgcaagaaau

SEQ ID NO: 366975 - RNA, 19 nt, Homo sapiens
agaugaugauugcuuaaug

SEQ ID NO: 366976 - RNA, 19 nt, Homo sapiens
gcagaaagaaauguuuagu

SEQ ID NO: 366977 - RNA, 19 nt, Homo sapiens
guaaaagaauggguaaugu

SEQ ID NO: 366978 - RNA, 19 nt, Homo sapiens
cagaaagaaauguuuagug

SEQ ID NO: 366979 - RNA, 19 nt, Homo sapiens
aacuaaagcuuugucauag

SEQ ID NO: 366980 - RNA, 19 nt, Homo sapiens
aguguuagcagauuugaaa

SEQ ID NO: 366981 - RNA, 19 nt, Homo sapiens
cagaagaacguuuuagaaa

SEQ ID NO: 366982 - RNA, 19 nt, Homo sapiens
uguuguuucugucugauuu

SEQ ID NO: 366983 - RNA, 19 nt, Homo sapiens
cauaaaccuugaagcugau

SEQ ID NO: 366984 - RNA, 19 nt, Homo sapiens
uguggaaguuaaacagcua

SEQ ID NO: 366985 - RNA, 19 nt, Homo sapiens
cuaaagcuuugucauagac

SEQ ID NO: 366986 - RNA, 19 nt, Homo sapiens
acuaaagcuuugucauaga

SEQ ID NO: 366987 - RNA, 19 nt, Homo sapiens
ucauguuguuucugucuga

SEQ ID NO: 366988 - RNA, 19 nt, Homo sapiens
uugaagcugaugaaaguua

SEQ ID NO: 366989 - RNA, 19 nt, Homo sapiens
gaaacaacuccaaaaccua

SEQ ID NO: 366990 - RNA, 19 nt, Homo sapiens
gaauggguaauguuuaaac

SEQ ID NO: 366991 - RNA, 19 nt, Homo sapiens
aagaaacgcaagaaauguu

SEQ ID NO: 366992 - RNA, 19 nt, Homo sapiens
gaagcugaugaaaguuaaa

SEQ ID NO: 366993 - RNA, 19 nt, Homo sapiens
agaagaugcuugugaugac

SEQ ID NO: 366994 - RNA, 19 nt, Homo sapiens
gcauguggagcuuuauaca

SEQ ID NO: 366995 - RNA, 19 nt, Homo sapiens
ucaagaagaaacgcaagaa

SEQ ID NO: 366996 - RNA, 19 nt, Homo sapiens
ucaauguuacuuucgaaga

SEQ ID NO: 366997 - RNA, 19 nt, Homo sapiens
agaaggcggcugcagaaga

SEQ ID NO: 366998 - RNA, 19 nt, Homo sapiens
cugcauccuugcuuauuuc

SEQ ID NO: 366999 - RNA, 19 nt, Homo sapiens
aaaccuagaagaugcuugu

SEQ ID NO: 367000 - RNA, 19 nt, Homo sapiens
uuucacaugucugcuuauu

SEQ ID NO: 367001 - RNA, 19 nt, Homo sapiens
gagcaacauaaaccuugaa

SEQ ID NO: 367002 - RNA, 19 nt, Homo sapiens
gaaacgcaagaaauguuag

SEQ ID NO: 367003 - RNA, 19 nt, Homo sapiens
agagaugugcagaaagaaa

SEQ ID NO: 367004 - RNA, 19 nt, Homo sapiens
guggagcuuuauacaaaca

SEQ ID NO: 367005 - RNA, 19 nt, Homo sapiens
agagcugaaggaagaaaua

SEQ ID NO: 367006 - RNA, 19 nt, Homo sapiens
gcuugcagaugaugauugc

SEQ ID NO: 367007 - RNA, 19 nt, Homo sapiens
ugucaauguuacuuucgaa

SEQ ID NO: 367008 - RNA, 19 nt, Homo sapiens
ggaagggucuuguguuuua

SEQ ID NO: 367009 - RNA, 19 nt, Homo sapiens
gaaaugaugagucagaaga

SEQ ID NO: 367010 - RNA, 19 nt, Homo sapiens
gaaacaggccgucauggaa

SEQ ID NO: 367011 - RNA, 19 nt, Homo sapiens
gaagcugcaugauguggaa

SEQ ID NO: 367012 - RNA, 19 nt, Homo sapiens
ggaacuggguacuauguag

SEQ ID NO: 367013 - RNA, 19 nt, Homo sapiens
ggagaagcacgccaugaaa

SEQ ID NO: 367014 - RNA, 19 nt, Homo sapiens
ugggaagggucuuguguuu

SEQ ID NO: 367015 - RNA, 19 nt, Homo sapiens
uaaccaagcagauggagaa

SEQ ID NO: 367016 - RNA, 19 nt, Homo sapiens
gaauuacucgucccacuga

SEQ ID NO: 367017 - RNA, 19 nt, Homo sapiens
ucaagaggaagauagauuu

SEQ ID NO: 367018 - RNA, 19 nt, Homo sapiens
caacauggcgcagucuauu

SEQ ID NO: 367019 - RNA, 19 nt, Homo sapiens
gaacuggguacuauguaga

SEQ ID NO: 367020 - RNA, 19 nt, Homo sapiens
uagaaaugcucaagaacca

SEQ ID NO: 367021 - RNA, 19 nt, Homo sapiens
aaacaggccgucauggaaa

SEQ ID NO: 367022 - RNA, 19 nt, Homo sapiens
aaccagcucuucaggagaa

SEQ ID NO: 367023 - RNA, 19 nt, Homo sapiens
cugggaagcugcaugaugu

SEQ ID NO: 367024 - RNA, 19 nt, Homo sapiens
cagcucaggcuacugcuaa

SEQ ID NO: 367025 - RNA, 19 nt, Homo sapiens
ccacugacgaguucuaugu

SEQ ID NO: 367026 - RNA, 19 nt, Homo sapiens
guccauugcucagcucaaa

SEQ ID NO: 367027 - RNA, 19 nt, Homo sapiens
ccaagcagauggagaaaau

SEQ ID NO: 367028 - RNA, 19 nt, Homo sapiens
caacgaggggaaagaauua

SEQ ID NO: 367029 - RNA, 19 nt, Homo sapiens
ugaaacaggccgucaugga

SEQ ID NO: 367030 - RNA, 19 nt, Homo sapiens
ugaacgugcugaacaagag

SEQ ID NO: 367031 - RNA, 19 nt, Homo sapiens
gcuaaggccugagaguuuu

SEQ ID NO: 367032 - RNA, 19 nt, Homo sapiens
aaugaugagucagaagauu

SEQ ID NO: 367033 - RNA, 19 nt, Homo sapiens
gcucaucgaugugggaacu

SEQ ID NO: 367034 - RNA, 19 nt, Homo sapiens
uaacaucacggagcugaau

SEQ ID NO: 367035 - RNA, 19 nt, Homo sapiens
gagaagcacgccaugaaac

SEQ ID NO: 367036 - RNA, 19 nt, Homo sapiens
acauggcgcagucuauuaa

SEQ ID NO: 367037 - RNA, 19 nt, Homo sapiens
ugugggaacuggguacuau

SEQ ID NO: 367038 - RNA, 19 nt, Homo sapiens
cagcugaggaugccaagga

SEQ ID NO: 367039 - RNA, 19 nt, Homo sapiens
gggaacuggguacuaugua

SEQ ID NO: 367040 - RNA, 19 nt, Homo sapiens
gaugggaagggucuugugu

SEQ ID NO: 367041 - RNA, 19 nt, Homo sapiens
ugacgaguucuauguaugu

SEQ ID NO: 367042 - RNA, 19 nt, Homo sapiens
uaagucggccuucccaaca

SEQ ID NO: 367043 - RNA, 19 nt, Homo sapiens
uggaaaugaugagucagaa

SEQ ID NO: 367044 - RNA, 19 nt, Homo sapiens
gguacuauguagagaagac

SEQ ID NO: 367045 - RNA, 19 nt, Homo sapiens
gcaacgaggggaaagaauu

SEQ ID NO: 367046 - RNA, 19 nt, Homo sapiens
agcuagaaaugcucaagaa

SEQ ID NO: 367047 - RNA, 19 nt, Homo sapiens
aacauggcgcagucuauua

SEQ ID NO: 367048 - RNA, 19 nt, Homo sapiens
ggaaaugaugagucagaag

SEQ ID NO: 367049 - RNA, 19 nt, Homo sapiens
gaagggucuuguguuuuaa

SEQ ID NO: 367050 - RNA, 19 nt, Homo sapiens
ugcuaaggccugagaguuu

SEQ ID NO: 367051 - RNA, 19 nt, Homo sapiens
ccaacauggcgcagucuau

SEQ ID NO: 367052 - RNA, 19 nt, Homo sapiens
aggagaagcacgccaugaa

SEQ ID NO: 367053 - RNA, 19 nt, Homo sapiens
acugacgaguucuauguau

SEQ ID NO: 367054 - RNA, 19 nt, Homo sapiens
gucugaacgugcugaacaa

SEQ ID NO: 367055 - RNA, 19 nt, Homo sapiens
uggaacacgugcucaucga

SEQ ID NO: 367056 - RNA, 19 nt, Homo sapiens
cugacgaguucuauguaug

SEQ ID NO: 367057 - RNA, 19 nt, Homo sapiens
cagcuagaaaugcucaaga

SEQ ID NO: 367058 - RNA, 19 nt, Homo sapiens
agaagcacgccaugaaaca

SEQ ID NO: 367059 - RNA, 19 nt, Homo sapiens
ggaccaggaaguggaguuc

SEQ ID NO: 367060 - RNA, 19 nt, Homo sapiens
ccaggaaguggaguucuug

SEQ ID NO: 367061 - RNA, 19 nt, Homo sapiens
ggaacacgugcucaucgau

SEQ ID NO: 367062 - RNA, 19 nt, Homo sapiens
ggaagggucuuguguuuua

SEQ ID NO: 367063 - RNA, 19 nt, Homo sapiens
gaaaugaugagucagaaga

SEQ ID NO: 367064 - RNA, 19 nt, Homo sapiens
gaaacaggccgucauggaa

SEQ ID NO: 367065 - RNA, 19 nt, Homo sapiens
gaagcugcaugauguggaa

SEQ ID NO: 367066 - RNA, 19 nt, Homo sapiens
ggaacuggguacuauguag

SEQ ID NO: 367067 - RNA, 19 nt, Homo sapiens
ggagaagcacgccaugaaa

SEQ ID NO: 367068 - RNA, 19 nt, Homo sapiens
gagcaacgaggauguaugu

SEQ ID NO: 367069 - RNA, 19 nt, Homo sapiens
ugggaagggucuuguguuu

SEQ ID NO: 367070 - RNA, 19 nt, Homo sapiens
uaaccaagcagauggagaa

SEQ ID NO: 367071 - RNA, 19 nt, Homo sapiens
ucaagaggaagauagauuu

SEQ ID NO: 367072 - RNA, 19 nt, Homo sapiens
caacauggcgcagucuauu

SEQ ID NO: 367073 - RNA, 19 nt, Homo sapiens
gaacuggguacuauguaga

SEQ ID NO: 367074 - RNA, 19 nt, Homo sapiens
gaacaagagcaacgaggau

SEQ ID NO: 367075 - RNA, 19 nt, Homo sapiens
uagaaaugcucaagaacca

SEQ ID NO: 367076 - RNA, 19 nt, Homo sapiens
aaacaggccgucauggaaa

SEQ ID NO: 367077 - RNA, 19 nt, Homo sapiens
aaccagcucuucaggagaa

SEQ ID NO: 367078 - RNA, 19 nt, Homo sapiens
cugggaagcugcaugaugu

SEQ ID NO: 367079 - RNA, 19 nt, Homo sapiens
cagcucaggcuacugcuaa

SEQ ID NO: 367080 - RNA, 19 nt, Homo sapiens
caagagcaacgaggaugua

SEQ ID NO: 367081 - RNA, 19 nt, Homo sapiens
guccauugcucagcucaaa

SEQ ID NO: 367082 - RNA, 19 nt, Homo sapiens
ccaagcagauggagaaaau

SEQ ID NO: 367083 - RNA, 19 nt, Homo sapiens
ugaaacaggccgucaugga

SEQ ID NO: 367084 - RNA, 19 nt, Homo sapiens
ugaacgugcugaacaagag

SEQ ID NO: 367085 - RNA, 19 nt, Homo sapiens
gcuaaggccugagaguuuu

SEQ ID NO: 367086 - RNA, 19 nt, Homo sapiens
uaacaucacggagcugaau

SEQ ID NO: 367087 - RNA, 19 nt, Homo sapiens
aaugaugagucagaagauu

SEQ ID NO: 367088 - RNA, 19 nt, Homo sapiens
gcucaucgaugugggaacu

SEQ ID NO: 367089 - RNA, 19 nt, Homo sapiens
gagaagcacgccaugaaac

SEQ ID NO: 367090 - RNA, 19 nt, Homo sapiens
acauggcgcagucuauuaa

SEQ ID NO: 367091 - RNA, 19 nt, Homo sapiens
ugugggaacuggguacuau

SEQ ID NO: 367092 - RNA, 19 nt, Homo sapiens
cagcugaggaugccaagga

SEQ ID NO: 367093 - RNA, 19 nt, Homo sapiens
gggaacuggguacuaugua

SEQ ID NO: 367094 - RNA, 19 nt, Homo sapiens
gaugggaagggucuugugu

SEQ ID NO: 367095 - RNA, 19 nt, Homo sapiens
uaagucggccuucccaaca

SEQ ID NO: 367096 - RNA, 19 nt, Homo sapiens
uggaaaugaugagucagaa

SEQ ID NO: 367097 - RNA, 19 nt, Homo sapiens
gguacuauguagagaagac

SEQ ID NO: 367098 - RNA, 19 nt, Homo sapiens
agcuagaaaugcucaagaa

SEQ ID NO: 367099 - RNA, 19 nt, Homo sapiens
aacauggcgcagucuauua

SEQ ID NO: 367100 - RNA, 19 nt, Homo sapiens
ggaaaugaugagucagaag

SEQ ID NO: 367101 - RNA, 19 nt, Homo sapiens
gaagggucuuguguuuuaa

SEQ ID NO: 367102 - RNA, 19 nt, Homo sapiens
ugcuaaggccugagaguuu

SEQ ID NO: 367103 - RNA, 19 nt, Homo sapiens
aggagaagcacgccaugaa

SEQ ID NO: 367104 - RNA, 19 nt, Homo sapiens
ccaacauggcgcagucuau

SEQ ID NO: 367105 - RNA, 19 nt, Homo sapiens
gucugaacgugcugaacaa

SEQ ID NO: 367106 - RNA, 19 nt, Homo sapiens
uggaacacgugcucaucga

SEQ ID NO: 367107 - RNA, 19 nt, Homo sapiens
cagcuagaaaugcucaaga

SEQ ID NO: 367108 - RNA, 19 nt, Homo sapiens
agaagcacgccaugaaaca

SEQ ID NO: 367109 - RNA, 19 nt, Homo sapiens
ggaccaggaaguggaguuc

SEQ ID NO: 367110 - RNA, 19 nt, Homo sapiens
ccaggaaguggaguucuug

SEQ ID NO: 367111 - RNA, 19 nt, Homo sapiens
ggaacacgugcucaucgau

SEQ ID NO: 367112 - RNA, 19 nt, Homo sapiens
ggaagggucuuguguuuua

SEQ ID NO: 367113 - RNA, 19 nt, Homo sapiens
gaaaugaugagucagaaga

SEQ ID NO: 367114 - RNA, 19 nt, Homo sapiens
gaaacaggccgucauggaa

SEQ ID NO: 367115 - RNA, 19 nt, Homo sapiens
gaagcugcaugauguggaa

SEQ ID NO: 367116 - RNA, 19 nt, Homo sapiens
ggaacuggguacuauguag

SEQ ID NO: 367117 - RNA, 19 nt, Homo sapiens
ggagaagcacgccaugaaa

SEQ ID NO: 367118 - RNA, 19 nt, Homo sapiens
ugggaagggucuuguguuu

SEQ ID NO: 367119 - RNA, 19 nt, Homo sapiens
uaaccaagcagauggagaa

SEQ ID NO: 367120 - RNA, 19 nt, Homo sapiens
ucaagaggaagauagauuu

SEQ ID NO: 367121 - RNA, 19 nt, Homo sapiens
caacauggcgcagucuauu

SEQ ID NO: 367122 - RNA, 19 nt, Homo sapiens
gaacuggguacuauguaga

SEQ ID NO: 367123 - RNA, 19 nt, Homo sapiens
uagaaaugcucaagaacca

SEQ ID NO: 367124 - RNA, 19 nt, Homo sapiens
aaacaggccgucauggaaa

SEQ ID NO: 367125 - RNA, 19 nt, Homo sapiens
aaccagcucuucaggagaa

SEQ ID NO: 367126 - RNA, 19 nt, Homo sapiens
cugggaagcugcaugaugu

SEQ ID NO: 367127 - RNA, 19 nt, Homo sapiens
cagcucaggcuacugcuaa

SEQ ID NO: 367128 - RNA, 19 nt, Homo sapiens
ccaagcagauggagaaaau

SEQ ID NO: 367129 - RNA, 19 nt, Homo sapiens
ugaaacaggccgucaugga

SEQ ID NO: 367130 - RNA, 19 nt, Homo sapiens
gcuaaggccugagaguuuu

SEQ ID NO: 367131 - RNA, 19 nt, Homo sapiens
aaugaugagucagaagauu

SEQ ID NO: 367132 - RNA, 19 nt, Homo sapiens
uaacaucacggagcugaau

SEQ ID NO: 367133 - RNA, 19 nt, Homo sapiens
gcucaucgaugugggaacu

SEQ ID NO: 367134 - RNA, 19 nt, Homo sapiens
gagaagcacgccaugaaac

SEQ ID NO: 367135 - RNA, 19 nt, Homo sapiens
acauggcgcagucuauuaa

SEQ ID NO: 367136 - RNA, 19 nt, Homo sapiens
ugugggaacuggguacuau

SEQ ID NO: 367137 - RNA, 19 nt, Homo sapiens
cagcugaggaugccaagga

SEQ ID NO: 367138 - RNA, 19 nt, Homo sapiens
gggaacuggguacuaugua

SEQ ID NO: 367139 - RNA, 19 nt, Homo sapiens
gaugggaagggucuugugu

SEQ ID NO: 367140 - RNA, 19 nt, Homo sapiens
uaagucggccuucccaaca

SEQ ID NO: 367141 - RNA, 19 nt, Homo sapiens
uggaaaugaugagucagaa

SEQ ID NO: 367142 - RNA, 19 nt, Homo sapiens
gguacuauguagagaagac

SEQ ID NO: 367143 - RNA, 19 nt, Homo sapiens
agcuagaaaugcucaagaa

SEQ ID NO: 367144 - RNA, 19 nt, Homo sapiens
aacauggcgcagucuauua

SEQ ID NO: 367145 - RNA, 19 nt, Homo sapiens
ggaaaugaugagucagaag

SEQ ID NO: 367146 - RNA, 19 nt, Homo sapiens
gaagggucuuguguuuuaa

SEQ ID NO: 367147 - RNA, 19 nt, Homo sapiens
ugcuaaggccugagaguuu

SEQ ID NO: 367148 - RNA, 19 nt, Homo sapiens
ccaacauggcgcagucuau

SEQ ID NO: 367149 - RNA, 19 nt, Homo sapiens
aggagaagcacgccaugaa

SEQ ID NO: 367150 - RNA, 19 nt, Homo sapiens
uggaacacgugcucaucga

SEQ ID NO: 367151 - RNA, 19 nt, Homo sapiens
agaagcacgccaugaaaca

SEQ ID NO: 367152 - RNA, 19 nt, Homo sapiens
cagcuagaaaugcucaaga

SEQ ID NO: 367153 - RNA, 19 nt, Homo sapiens
ggaacacgugcucaucgau

SEQ ID NO: 367154 - RNA, 19 nt, Homo sapiens
ggacgaagcucuggauaaa

SEQ ID NO: 367155 - RNA, 19 nt, Homo sapiens
gaaauaagauucugaagcu

SEQ ID NO: 367156 - RNA, 19 nt, Homo sapiens
uaagagagcagccaauuua

SEQ ID NO: 367157 - RNA, 19 nt, Homo sapiens
gaaagaaauucaaguugga

SEQ ID NO: 367158 - RNA, 19 nt, Homo sapiens
caaagagacuuacuauuca

SEQ ID NO: 367159 - RNA, 19 nt, Homo sapiens
ggacggagaaaccaauuua

SEQ ID NO: 367160 - RNA, 19 nt, Homo sapiens
gcauuuaccuuuauaccaa

SEQ ID NO: 367161 - RNA, 19 nt, Homo sapiens
gaaaggacuuacaauguuc

SEQ ID NO: 367162 - RNA, 19 nt, Homo sapiens
ugaaaggacuuacaauguu

SEQ ID NO: 367163 - RNA, 19 nt, Homo sapiens
gaaagagacucagaaacga

SEQ ID NO: 367164 - RNA, 19 nt, Homo sapiens
guacaacgcauuuaccuuu

SEQ ID NO: 367165 - RNA, 19 nt, Homo sapiens
gagaguaaauaugcgaaua

SEQ ID NO: 367166 - RNA, 19 nt, Homo sapiens
gaauguacauggcaaguca

SEQ ID NO: 367167 - RNA, 19 nt, Homo sapiens
ggaaacugcugaaaauaua

SEQ ID NO: 367168 - RNA, 19 nt, Homo sapiens
uggaauacauguucucuuu

SEQ ID NO: 367169 - RNA, 19 nt, Homo sapiens
ggacaaagagacuuacuau

SEQ ID NO: 367170 - RNA, 19 nt, Homo sapiens
gaagauacauuggcuacau

SEQ ID NO: 367171 - RNA, 19 nt, Homo sapiens
caacgcauuuaccuuuaua

SEQ ID NO: 367172 - RNA, 19 nt, Homo sapiens
gaucaaaacugcccacauu

SEQ ID NO: 367173 - RNA, 19 nt, Homo sapiens
gauggcagguucaaaguug

SEQ ID NO: 367174 - RNA, 19 nt, Homo sapiens
gagcagccaauuuauauuu

SEQ ID NO: 367175 - RNA, 19 nt, Homo sapiens
ccaaagagaagauacauug

SEQ ID NO: 367176 - RNA, 19 nt, Homo sapiens
gggcgucacugcaaucaaa

SEQ ID NO: 367177 - RNA, 19 nt, Homo sapiens
gcaaaugaaacucuuagaa

SEQ ID NO: 367178 - RNA, 19 nt, Homo sapiens
gagagcagccaauuuauau

SEQ ID NO: 367179 - RNA, 19 nt, Homo sapiens
uaacaucgaugauccucuu

SEQ ID NO: 367180 - RNA, 19 nt, Homo sapiens
acaaagagacuuacuauuc

SEQ ID NO: 367181 - RNA, 19 nt, Homo sapiens
cuagauaaguuuacaggaa

SEQ ID NO: 367182 - RNA, 19 nt, Homo sapiens
aaaggaggcuagaagcuaa

SEQ ID NO: 367183 - RNA, 19 nt, Homo sapiens
uggaauaaguggacaagaa

SEQ ID NO: 367184 - RNA, 19 nt, Homo sapiens
gugcugacacuguuauuua

SEQ ID NO: 367185 - RNA, 19 nt, Homo sapiens
cgaugaaggugcccuggua

SEQ ID NO: 367186 - RNA, 19 nt, Homo sapiens
ggauaucuuugcaaaugaa

SEQ ID NO: 367187 - RNA, 19 nt, Homo sapiens
gaaugaauccuacuaagca

SEQ ID NO: 367188 - RNA, 19 nt, Homo sapiens
uaaaggugcugacacuguu

SEQ ID NO: 367189 - RNA, 19 nt, Homo sapiens
ccaucugcauuucaauuua

SEQ ID NO: 367190 - RNA, 19 nt, Homo sapiens
ccaauaaccgacuagauaa

SEQ ID NO: 367191 - RNA, 19 nt, Homo sapiens
gagacuuacuauucaacua

SEQ ID NO: 367192 - RNA, 19 nt, Homo sapiens
ccacauuggcguuggaaua

SEQ ID NO: 367193 - RNA, 19 nt, Homo sapiens
ggacagagucacuucauca

SEQ ID NO: 367194 - RNA, 19 nt, Homo sapiens
ccaaugacgugaacaugau

SEQ ID NO: 367195 - RNA, 19 nt, Homo sapiens
cccaauaaccgacuagaua

SEQ ID NO: 367196 - RNA, 19 nt, Homo sapiens
guaaauaugcgaauaaugc

SEQ ID NO: 367197 - RNA, 19 nt, Homo sapiens
gggaggauauuaauucucu

SEQ ID NO: 367198 - RNA, 19 nt, Homo sapiens
gcacugaaaggacuuacaa

SEQ ID NO: 367199 - RNA, 19 nt, Homo sapiens
gugauaagauccagaagca

SEQ ID NO: 367200 - RNA, 19 nt, Homo sapiens
ccauacauuugguuaacua

SEQ ID NO: 367201 - RNA, 19 nt, Homo sapiens
gaaagagccagaaguacga

SEQ ID NO: 367202 - RNA, 19 nt, Homo sapiens
ggaagugauucgucuugga

SEQ ID NO: 367203 - RNA, 19 nt, Homo sapiens
gaacgguuacaucgaauga

SEQ ID NO: 367204 - RNA, 19 nt, Homo sapiens
uaugaacgguuacaucgaa

SEQ ID NO: 367205 - RNA, 19 nt, Homo sapiens
gaacugggcacugaaagga

SEQ ID NO: 367206 - RNA, 19 nt, Homo sapiens
caaaguugcuaaguggaaa

SEQ ID NO: 367207 - RNA, 19 nt, Homo sapiens
cagauuggcuuggauacuu

SEQ ID NO: 367208 - RNA, 19 nt, Homo sapiens
ggccgauggucuuacauaa

SEQ ID NO: 367209 - RNA, 19 nt, Homo sapiens
cuacagugaugaugaaaca

SEQ ID NO: 367210 - RNA, 19 nt, Homo sapiens
gaaccaccacacucaauga

SEQ ID NO: 367211 - RNA, 19 nt, Homo sapiens
guacccaucucucucuaug

SEQ ID NO: 367212 - RNA, 19 nt, Homo sapiens
uaccguggauuccucauuu

SEQ ID NO: 367213 - RNA, 19 nt, Homo sapiens
guaccucuaugauggagaa

SEQ ID NO: 367214 - RNA, 19 nt, Homo sapiens
aagcugaaguucccaagaa

SEQ ID NO: 367215 - RNA, 19 nt, Homo sapiens
cuacagcuauugaagacaa

SEQ ID NO: 367216 - RNA, 19 nt, Homo sapiens
gcaaauccagucagggaaa

SEQ ID NO: 367217 - RNA, 19 nt, Homo sapiens
uacaacgcauuuaccuuua

SEQ ID NO: 367218 - RNA, 19 nt, Homo sapiens
gugaagagguacaagaaag

SEQ ID NO: 367219 - RNA, 19 nt, Homo sapiens
gcuagaagcuaagaaagag

SEQ ID NO: 367220 - RNA, 19 nt, Homo sapiens
uaugaccacuaucuuauug

SEQ ID NO: 367221 - RNA, 19 nt, Homo sapiens
gagaggcaccuuccgacua

SEQ ID NO: 367222 - RNA, 19 nt, Homo sapiens
aaacagaagaugaacuuga

SEQ ID NO: 367223 - RNA, 19 nt, Homo sapiens
cuugugaacuucugacuga

SEQ ID NO: 367224 - RNA, 19 nt, Homo sapiens
aaggcaauaucaagcuuua

SEQ ID NO: 367225 - RNA, 19 nt, Homo sapiens
ugagacagccauacauuug

SEQ ID NO: 367226 - RNA, 19 nt, Homo sapiens
gaauacauguucucuuucc

SEQ ID NO: 367227 - RNA, 19 nt, Homo sapiens
aaacuuugccuuuacuuug

SEQ ID NO: 367228 - RNA, 19 nt, Homo sapiens
ccaccacacucaaugaaca

SEQ ID NO: 367229 - RNA, 19 nt, Homo sapiens
ggacgugugaagucauuaa

SEQ ID NO: 367230 - RNA, 19 nt, Homo sapiens
uaacuaucauccugacugu

SEQ ID NO: 367231 - RNA, 19 nt, Homo sapiens
gaagcauugcacuuuauuu

SEQ ID NO: 367232 - RNA, 19 nt, Homo sapiens
uccauuauaucuucucuga

SEQ ID NO: 367233 - RNA, 19 nt, Homo sapiens
acugggaccugcaaaugua

SEQ ID NO: 367234 - RNA, 19 nt, Homo sapiens
uaagaugucacuugaaauc

SEQ ID NO: 367235 - RNA, 19 nt, Homo sapiens
ucauaccucuuggagcuua

SEQ ID NO: 367236 - RNA, 19 nt, Homo sapiens
ggaauaaguggacaagaag

SEQ ID NO: 367237 - RNA, 19 nt, Homo sapiens
guucuugguugaaugaaau

SEQ ID NO: 367238 - RNA, 19 nt, Homo sapiens
ggaaaccgugccuuaauca

SEQ ID NO: 367239 - RNA, 19 nt, Homo sapiens
caaaugaaacucuuagaac

SEQ ID NO: 367240 - RNA, 19 nt, Homo sapiens
gaaggcaauaucaagcuuu

SEQ ID NO: 367241 - RNA, 19 nt, Homo sapiens
uugaugaacuacaugguuu

SEQ ID NO: 367242 - RNA, 19 nt, Homo sapiens
guaauuaggaacaccgauu

SEQ ID NO: 367243 - RNA, 19 nt, Homo sapiens
gaaugugaagaacccaaua

SEQ ID NO: 367244 - RNA, 19 nt, Homo sapiens
guugcuaaguggaaagaaa

SEQ ID NO: 367245 - RNA, 19 nt, Homo sapiens
gaaucuguuugagcaguuu

SEQ ID NO: 367246 - RNA, 19 nt, Homo sapiens
gaaccgggagccauucaga

SEQ ID NO: 367247 - RNA, 19 nt, Homo sapiens
ggaagcauugcacuuuauu

SEQ ID NO: 367248 - RNA, 19 nt, Homo sapiens
ggaugugagugacaaacug

SEQ ID NO: 367249 - RNA, 19 nt, Homo sapiens
cuggauaucuuugcaaaug

SEQ ID NO: 367250 - RNA, 19 nt, Homo sapiens
guaaaggugcugacacugu

SEQ ID NO: 367251 - RNA, 19 nt, Homo sapiens
ggaagcgaaugucuaucau

SEQ ID NO: 367252 - RNA, 19 nt, Homo sapiens
caaauguacuaugcugaga

SEQ ID NO: 367253 - RNA, 19 nt, Homo sapiens
gggaaaaccagauuuaaaa

SEQ ID NO: 367254 - RNA, 19 nt, Homo sapiens
ccacaaagcucacacgaua

SEQ ID NO: 367255 - RNA, 19 nt, Homo sapiens
gugaggagaugaccuauga

SEQ ID NO: 367256 - RNA, 19 nt, Homo sapiens
ggagaugaccuaugaagaa

SEQ ID NO: 367257 - RNA, 19 nt, Homo sapiens
gagaugaccuaugaagaaa

SEQ ID NO: 367258 - RNA, 19 nt, Homo sapiens
uaaagagaauugagugcua

SEQ ID NO: 367259 - RNA, 19 nt, Homo sapiens
gaagaaauccaggaacauu

SEQ ID NO: 367260 - RNA, 19 nt, Homo sapiens
ggaaggcccugaaugagau

SEQ ID NO: 367261 - RNA, 19 nt, Homo sapiens
uggcagcccugauuauaua

SEQ ID NO: 367262 - RNA, 19 nt, Homo sapiens
uaaugacccuggcauaauu

SEQ ID NO: 367263 - RNA, 19 nt, Homo sapiens
gaaggauguucacaacuau

SEQ ID NO: 367264 - RNA, 19 nt, Homo sapiens
gggagaagccugagaaugu

SEQ ID NO: 367265 - RNA, 19 nt, Homo sapiens
acauuacccugaagaauuu

SEQ ID NO: 367266 - RNA, 19 nt, Homo sapiens
gcagugagcuacaagaacu

SEQ ID NO: 367267 - RNA, 19 nt, Homo sapiens
guaguaagauaggaaguga

SEQ ID NO: 367268 - RNA, 19 nt, Homo sapiens
ucuacuaccucaugaauau

SEQ ID NO: 367269 - RNA, 19 nt, Homo sapiens
gauaggaacaccaacuaaa

SEQ ID NO: 367270 - RNA, 19 nt, Homo sapiens
ggagaagccugagaaugug

SEQ ID NO: 367271 - RNA, 19 nt, Homo sapiens
uaucuuugcucuucuccua

SEQ ID NO: 367272 - RNA, 19 nt, Homo sapiens
gcacugcgagaccaagaua

SEQ ID NO: 367273 - RNA, 19 nt, Homo sapiens
gcuaugaggucaacuacca

SEQ ID NO: 367274 - RNA, 19 nt, Homo sapiens
gaugaccuaugaagaaauc

SEQ ID NO: 367275 - RNA, 19 nt, Homo sapiens
agaccuauaucuccacaaa

SEQ ID NO: 367276 - RNA, 19 nt, Homo sapiens
gaauccaucuaccugaaug

SEQ ID NO: 367277 - RNA, 19 nt, Homo sapiens
gaacauuacccugaagaau

SEQ ID NO: 367278 - RNA, 19 nt, Homo sapiens
ccggacagguaguaagaua

SEQ ID NO: 367279 - RNA, 19 nt, Homo sapiens
gggaaaagguucuggaaga

SEQ ID NO: 367280 - RNA, 19 nt, Homo sapiens
gaaaacaucaggcaaguga

SEQ ID NO: 367281 - RNA, 19 nt, Homo sapiens
acaacuaucucagccauga

SEQ ID NO: 367282 - RNA, 19 nt, Homo sapiens
gaagaggaccauccagaca

SEQ ID NO: 367283 - RNA, 19 nt, Homo sapiens
cacgauaucucaacuggau

SEQ ID NO: 367284 - RNA, 19 nt, Homo sapiens
gaagaaguccuccgcaacu

SEQ ID NO: 367285 - RNA, 19 nt, Homo sapiens
gaagucaaacugccugugu

SEQ ID NO: 367286 - RNA, 19 nt, Homo sapiens
aaacuuggcagcccugauu

SEQ ID NO: 367287 - RNA, 19 nt, Homo sapiens
cuacaagaacuaugaauuc

SEQ ID NO: 367288 - RNA, 19 nt, Homo sapiens
gcuacaagaacuaugaauu

SEQ ID NO: 367289 - RNA, 19 nt, Homo sapiens
ggauaggaacaccaacuaa

SEQ ID NO: 367290 - RNA, 19 nt, Homo sapiens
gauaauggagcuagaacga

SEQ ID NO: 367291 - RNA, 19 nt, Homo sapiens
guucagaugagcuuccaua

SEQ ID NO: 367292 - RNA, 19 nt, Homo sapiens
guaaugacccuggcauaau

SEQ ID NO: 367293 - RNA, 19 nt, Homo sapiens
caccaacacuaccagagaa

SEQ ID NO: 367294 - RNA, 19 nt, Homo sapiens
aagaaauccaggaacauua

SEQ ID NO: 367295 - RNA, 19 nt, Homo sapiens
aaacaucaggcaagugaaa

SEQ ID NO: 367296 - RNA, 19 nt, Homo sapiens
ucauugaguccauuuguaa

SEQ ID NO: 367297 - RNA, 19 nt, Homo sapiens
ucugacgaauaaagacuua

SEQ ID NO: 367298 - RNA, 19 nt, Homo sapiens
gagcuuccauaucucaagu

SEQ ID NO: 367299 - RNA, 19 nt, Homo sapiens
aaagagaauugagugcuau

SEQ ID NO: 367300 - RNA, 19 nt, Homo sapiens
cugauuauauagacuguga

SEQ ID NO: 367301 - RNA, 19 nt, Homo sapiens
caacauggaagcccugcaa

SEQ ID NO: 367302 - RNA, 19 nt, Homo sapiens
gagaggcagugagcuacaa

SEQ ID NO: 367303 - RNA, 19 nt, Homo sapiens
ccacaauggugaucauggu

SEQ ID NO: 367304 - RNA, 19 nt, Homo sapiens
acugagcccuuuccaagaa

SEQ ID NO: 367305 - RNA, 19 nt, Homo sapiens
caaccaaggagcuaucuag

SEQ ID NO: 367306 - RNA, 19 nt, Homo sapiens
ccuaugcccuggccaacuu

SEQ ID NO: 367307 - RNA, 19 nt, Homo sapiens
gcucgaggcaagaccuaua

SEQ ID NO: 367308 - RNA, 19 nt, Homo sapiens
cuuaauuccuauucucuga

SEQ ID NO: 367309 - RNA, 19 nt, Homo sapiens
uggcagcccugaaggaugu

SEQ ID NO: 367310 - RNA, 19 nt, Homo sapiens
aaauaucgcuaccgcuauc

SEQ ID NO: 367311 - RNA, 19 nt, Homo sapiens
gcgagaccaagauaaauau

SEQ ID NO: 367312 - RNA, 19 nt, Homo sapiens
aacauuacccugaagaauu

SEQ ID NO: 367313 - RNA, 19 nt, Homo sapiens
ggaacauuacccugaagaa

SEQ ID NO: 367314 - RNA, 19 nt, Homo sapiens
uggccuauuuccuggauaa

SEQ ID NO: 367315 - RNA, 19 nt, Homo sapiens
ccaagggagaguccuauga

SEQ ID NO: 367316 - RNA, 19 nt, Homo sapiens
gacgagaggcagugagcua

SEQ ID NO: 367317 - RNA, 19 nt, Homo sapiens
aggaagcccuggauacugu

SEQ ID NO: 367318 - RNA, 19 nt, Homo sapiens
gaacacacaccgggagaag

SEQ ID NO: 367319 - RNA, 19 nt, Homo sapiens
agagaacgacggucacuga

SEQ ID NO: 367320 - RNA, 19 nt, Homo sapiens
ggugccuccuggccuauuu

SEQ ID NO: 367321 - RNA, 19 nt, Homo sapiens
gagaaggggcucauccaua

SEQ ID NO: 367322 - RNA, 19 nt, Homo sapiens
ggacagguaguaagauagg

SEQ ID NO: 367323 - RNA, 19 nt, Homo sapiens
ccaccaacacuaccagaga

SEQ ID NO: 367324 - RNA, 19 nt, Homo sapiens
cuaucuagcucuggaggaa

SEQ ID NO: 367325 - RNA, 19 nt, Homo sapiens
ccucaucgccuuccaccuu

SEQ ID NO: 367326 - RNA, 19 nt, Homo sapiens
uguaaugacccuggcauaa

SEQ ID NO: 367327 - RNA, 19 nt, Homo sapiens
ucacuccuguggcuuaugg

SEQ ID NO: 367328 - RNA, 19 nt, Homo sapiens
ggagagcucacccaaacca

SEQ ID NO: 367329 - RNA, 19 nt, Homo sapiens
ugcgagaccaagauaaaua

SEQ ID NO: 367330 - RNA, 19 nt, Homo sapiens
gaggagaugaccuaugaag

SEQ ID NO: 367331 - RNA, 19 nt, Homo sapiens
ugagcuacaagaacuauga

SEQ ID NO: 367332 - RNA, 19 nt, Homo sapiens
ggaauccaucuaccugaau

SEQ ID NO: 367333 - RNA, 19 nt, Homo sapiens
gaacgacaggagaauguac

SEQ ID NO: 367334 - RNA, 19 nt, Homo sapiens
agaauguacuggugaucug

SEQ ID NO: 367335 - RNA, 19 nt, Homo sapiens
ucacaccucgcuccaucua

SEQ ID NO: 367336 - RNA, 19 nt, Homo sapiens
gauguucacaacuaucuca

SEQ ID NO: 367337 - RNA, 19 nt, Homo sapiens
cauggaagcccugcaaauc

SEQ ID NO: 367338 - RNA, 19 nt, Homo sapiens
ggauaaaaguucagaugag

SEQ ID NO: 367339 - RNA, 19 nt, Homo sapiens
augaagaaauccaggaaca

SEQ ID NO: 367340 - RNA, 19 nt, Homo sapiens
gcaagcaguaugccuaugc

SEQ ID NO: 367341 - RNA, 19 nt, Homo sapiens
aaaagaacaugguuacaag

SEQ ID NO: 367342 - RNA, 19 nt, Homo sapiens
caaaagaacaugguuacaa

SEQ ID NO: 367343 - RNA, 19 nt, Homo sapiens
gagcuacaagaacuaugaa

SEQ ID NO: 367344 - RNA, 19 nt, Homo sapiens
ucaucgccuuccaccuuua

SEQ ID NO: 367345 - RNA, 19 nt, Homo sapiens
acaaagcucacacgauauc

SEQ ID NO: 367346 - RNA, 19 nt, Homo sapiens
uaaauaucgcuaccgcuau

SEQ ID NO: 367347 - RNA, 19 nt, Homo sapiens
ugugggcagugaugucauu

SEQ ID NO: 367348 - RNA, 19 nt, Homo sapiens
uggaaggcccugaaugaga

SEQ ID NO: 367349 - RNA, 19 nt, Homo sapiens
uguccuacaucaagaucuu

SEQ ID NO: 367350 - RNA, 19 nt, Homo sapiens
uucauugaguccauuugua

SEQ ID NO: 367351 - RNA, 19 nt, Homo sapiens
aaugcuaucuuugcucuuc

SEQ ID NO: 367352 - RNA, 19 nt, Homo sapiens
caagggagaguccuaugag

SEQ ID NO: 367353 - RNA, 19 nt, Homo sapiens
aguggaaggcccugaauga

SEQ ID NO: 367354 - RNA, 19 nt, Homo sapiens
gaacuuugcugaacagaau

SEQ ID NO: 367355 - RNA, 19 nt, Homo sapiens
ggaaauaacagaccucaaa

SEQ ID NO: 367356 - RNA, 19 nt, Homo sapiens
cauaccaucuucaaacuua

SEQ ID NO: 367357 - RNA, 19 nt, Homo sapiens
caacagcuaugaaaccaaa

SEQ ID NO: 367358 - RNA, 19 nt, Homo sapiens
ggaaauuucuggaggaaca

SEQ ID NO: 367359 - RNA, 19 nt, Homo sapiens
gaacagagagaacgugaug

SEQ ID NO: 367360 - RNA, 19 nt, Homo sapiens
cagaugagcuaccauacuu

SEQ ID NO: 367361 - RNA, 19 nt, Homo sapiens
ggagggaucuuaggagaga

SEQ ID NO: 367362 - RNA, 19 nt, Homo sapiens
ccaauauucuggagguuaa

SEQ ID NO: 367363 - RNA, 19 nt, Homo sapiens
gagguuaugugugcaaauu

SEQ ID NO: 367364 - RNA, 19 nt, Homo sapiens
ugacaaggaucuuucuuuc

SEQ ID NO: 367365 - RNA, 19 nt, Homo sapiens
ucacuaauguccucauguu

SEQ ID NO: 367366 - RNA, 19 nt, Homo sapiens
gaacaacaacagcuaugaa

SEQ ID NO: 367367 - RNA, 19 nt, Homo sapiens
ugaagagaauugaaugcua

SEQ ID NO: 367368 - RNA, 19 nt, Homo sapiens
gcagucaaguccuauaagu

SEQ ID NO: 367369 - RNA, 19 nt, Homo sapiens
aaaccuacguguccaagaa

SEQ ID NO: 367370 - RNA, 19 nt, Homo sapiens
ccaagaaauuacaguguug

SEQ ID NO: 367371 - RNA, 19 nt, Homo sapiens
gcaaaguggaaacaauuaa

SEQ ID NO: 367372 - RNA, 19 nt, Homo sapiens
gaugaccuaugcagagauu

SEQ ID NO: 367373 - RNA, 19 nt, Homo sapiens
gaaagcgaguucaaucucu

SEQ ID NO: 367374 - RNA, 19 nt, Homo sapiens
ucuacuaccucaugaauau

SEQ ID NO: 367375 - RNA, 19 nt, Homo sapiens
gagaugaccuaugcagaga

SEQ ID NO: 367376 - RNA, 19 nt, Homo sapiens
gugaagagaugaccuaugc

SEQ ID NO: 367377 - RNA, 19 nt, Homo sapiens
caauaaggcguccaagaaa

SEQ ID NO: 367378 - RNA, 19 nt, Homo sapiens
ggagaaagcgaguucaauc

SEQ ID NO: 367379 - RNA, 19 nt, Homo sapiens
gguuaugugugcaaauuga

SEQ ID NO: 367380 - RNA, 19 nt, Homo sapiens
caagagaaguaucuguauc

SEQ ID NO: 367381 - RNA, 19 nt, Homo sapiens
gagaggagggacaugauuu

SEQ ID NO: 367382 - RNA, 19 nt, Homo sapiens
ccaccaaaguguuuaaucu

SEQ ID NO: 367383 - RNA, 19 nt, Homo sapiens
uuacuugacugcuuucuuc

SEQ ID NO: 367384 - RNA, 19 nt, Homo sapiens
gagaaacgguacccagaag

SEQ ID NO: 367385 - RNA, 19 nt, Homo sapiens
acaaggaucuuucuuucau

SEQ ID NO: 367386 - RNA, 19 nt, Homo sapiens
gagaauugaaugcuacaaa

SEQ ID NO: 367387 - RNA, 19 nt, Homo sapiens
gugaagcagucaaguccua

SEQ ID NO: 367388 - RNA, 19 nt, Homo sapiens
acaauaaggcguccaagaa

SEQ ID NO: 367389 - RNA, 19 nt, Homo sapiens
uaacacagaacaugagguu

SEQ ID NO: 367390 - RNA, 19 nt, Homo sapiens
uaggacagauucucagaug

SEQ ID NO: 367391 - RNA, 19 nt, Homo sapiens
caagccaacuaacaacuuc

SEQ ID NO: 367392 - RNA, 19 nt, Homo sapiens
gcuggagccugucaucaug

SEQ ID NO: 367393 - RNA, 19 nt, Homo sapiens
ugaggagaauggucagauu

SEQ ID NO: 367394 - RNA, 19 nt, Homo sapiens
cugaagagcugccaugucu

SEQ ID NO: 367395 - RNA, 19 nt, Homo sapiens
ggacaagccaugugaagag

SEQ ID NO: 367396 - RNA, 19 nt, Homo sapiens
gauugaugcuggugugugu

SEQ ID NO: 367397 - RNA, 19 nt, Homo sapiens
gaaauaacagaccucaaag

SEQ ID NO: 367398 - RNA, 19 nt, Homo sapiens
ggacaugauuuugaacuuu

SEQ ID NO: 367399 - RNA, 19 nt, Homo sapiens
gcauuguggugucugucua

SEQ ID NO: 367400 - RNA, 19 nt, Homo sapiens
ccuggugucuucacuaaug

SEQ ID NO: 367401 - RNA, 19 nt, Homo sapiens
ggaggaacaggaaauaaca

SEQ ID NO: 367402 - RNA, 19 nt, Homo sapiens
agacaacuaugacaaggau

SEQ ID NO: 367403 - RNA, 19 nt, Homo sapiens
ggagaggagggacaugauu

SEQ ID NO: 367404 - RNA, 19 nt, Homo sapiens
gaagauccgcaaacagugu

SEQ ID NO: 367405 - RNA, 19 nt, Homo sapiens
gaagcagucaaguccuaua

SEQ ID NO: 367406 - RNA, 19 nt, Homo sapiens
acacagaacaugagguuau

SEQ ID NO: 367407 - RNA, 19 nt, Homo sapiens
gaugagcuaccauacuuga

SEQ ID NO: 367408 - RNA, 19 nt, Homo sapiens
gcaauguccucgucaucuc

SEQ ID NO: 367409 - RNA, 19 nt, Homo sapiens
gcaguuugcccaagcucua

SEQ ID NO: 367410 - RNA, 19 nt, Homo sapiens
ggagggacaugauuuugaa

SEQ ID NO: 367411 - RNA, 19 nt, Homo sapiens
gugcaaaguggaaacaauu

SEQ ID NO: 367412 - RNA, 19 nt, Homo sapiens
ggacgcagaugagcuacca

SEQ ID NO: 367413 - RNA, 19 nt, Homo sapiens
uaaggacgcagaugagcua

SEQ ID NO: 367414 - RNA, 19 nt, Homo sapiens
caagguauucuuuguggaa

SEQ ID NO: 367415 - RNA, 19 nt, Homo sapiens
gaaugucagagaagaaaug

SEQ ID NO: 367416 - RNA, 19 nt, Homo sapiens
caaauugagucuuuuagga

SEQ ID NO: 367417 - RNA, 19 nt, Homo sapiens
gaugagaaggaacagcuuu

SEQ ID NO: 367418 - RNA, 19 nt, Homo sapiens
ggugcaaaguggaaacaau

SEQ ID NO: 367419 - RNA, 19 nt, Homo sapiens
gagcuaccauacuugagau

SEQ ID NO: 367420 - RNA, 19 nt, Homo sapiens
gcacuucgagaucaagaga

SEQ ID NO: 367421 - RNA, 19 nt, Homo sapiens
cauacagacugcugaaucu

SEQ ID NO: 367422 - RNA, 19 nt, Homo sapiens
gugugcaaauugagucuuu

SEQ ID NO: 367423 - RNA, 19 nt, Homo sapiens
uaaggcguccaagaaauua

SEQ ID NO: 367424 - RNA, 19 nt, Homo sapiens
aauaaggcguccaagaaau

SEQ ID NO: 367425 - RNA, 19 nt, Homo sapiens
uaugagcaguggaagauuc

SEQ ID NO: 367426 - RNA, 19 nt, Homo sapiens
gaagaggaccauacagacu

SEQ ID NO: 367427 - RNA, 19 nt, Homo sapiens
gugaagaggaccauacaga

SEQ ID NO: 367428 - RNA, 19 nt, Homo sapiens
ugcccaagcucuaaggaaa

SEQ ID NO: 367429 - RNA, 19 nt, Homo sapiens
ccucagaacagaacaacaa

SEQ ID NO: 367430 - RNA, 19 nt, Homo sapiens
gaucguaggacaucugaag

SEQ ID NO: 367431 - RNA, 19 nt, Homo sapiens
agaauugaaugcuacaaag

SEQ ID NO: 367432 - RNA, 19 nt, Homo sapiens
gaggagaauggucagauug

SEQ ID NO: 367433 - RNA, 19 nt, Homo sapiens
ggagagaucguaggacauc

SEQ ID NO: 367434 - RNA, 19 nt, Homo sapiens
gaagacccaagucagcauu

SEQ ID NO: 367435 - RNA, 19 nt, Homo sapiens
uccaagaaauuacaguguu

SEQ ID NO: 367436 - RNA, 19 nt, Homo sapiens
ccaugaagauccgcaaaca

SEQ ID NO: 367437 - RNA, 19 nt, Homo sapiens
ccaaggagucauuaacuuc

SEQ ID NO: 367438 - RNA, 19 nt, Homo sapiens
gaauugaaugcuacaaagu

SEQ ID NO: 367439 - RNA, 19 nt, Homo sapiens
gcagggagggaucuuagga

SEQ ID NO: 367440 - RNA, 19 nt, Homo sapiens
gccaauauucuggagguua

SEQ ID NO: 367441 - RNA, 19 nt, Homo sapiens
cuccugcccuugucacuaa

SEQ ID NO: 367442 - RNA, 19 nt, Homo sapiens
uggccuacuucuuggauaa

SEQ ID NO: 367443 - RNA, 19 nt, Homo sapiens
accaaaguguuuaaucuug

SEQ ID NO: 367444 - RNA, 19 nt, Homo sapiens
ucauguuggugaaguguug

SEQ ID NO: 367445 - RNA, 19 nt, Homo sapiens
cccaagcucuaaggaaauu

SEQ ID NO: 367446 - RNA, 19 nt, Homo sapiens
gagaaagcgaguucaaucu

SEQ ID NO: 367447 - RNA, 19 nt, Homo sapiens
ggaucuuucuuucaucaag

SEQ ID NO: 367448 - RNA, 19 nt, Homo sapiens
gauguuaaggcguaucuca

SEQ ID NO: 367449 - RNA, 19 nt, Homo sapiens
guaaggaugagaaggaaca

SEQ ID NO: 367450 - RNA, 19 nt, Homo sapiens
gaaacgguacccagaagag

SEQ ID NO: 367451 - RNA, 19 nt, Homo sapiens
aauaacagaccucaaagug

SEQ ID NO: 367452 - RNA, 19 nt, Homo sapiens
aaacgugggccagcgauuu

SEQ ID NO: 367453 - RNA, 19 nt, Homo sapiens
gguaucaagcccugacuau

SEQ ID NO: 367454 - RNA, 19 nt, Homo sapiens
gggcaaagcucuuccauuu

SEQ ID NO: 367455 - RNA, 19 nt, Homo sapiens
uguagaagcuguagagaua

SEQ ID NO: 367456 - RNA, 19 nt, Homo sapiens
gagauaggcuucaguuguu

SEQ ID NO: 367457 - RNA, 19 nt, Homo sapiens
ggagggagauacuauagaa

SEQ ID NO: 367458 - RNA, 19 nt, Homo sapiens
gcagaugugcuauuuauuu

SEQ ID NO: 367459 - RNA, 19 nt, Homo sapiens
ggagagagguaacaugaau

SEQ ID NO: 367460 - RNA, 19 nt, Homo sapiens
gaagagccguugcuguuug

SEQ ID NO: 367461 - RNA, 19 nt, Homo sapiens
uuaaugaccugggauauaa

SEQ ID NO: 367462 - RNA, 19 nt, Homo sapiens
ucucaaagcuugugccaaa

SEQ ID NO: 367463 - RNA, 19 nt, Homo sapiens
gagaagagccguugcuguu

SEQ ID NO: 367464 - RNA, 19 nt, Homo sapiens
gcagaagugugaccugaga

SEQ ID NO: 367465 - RNA, 19 nt, Homo sapiens
gaacugaggcugugcuuca

SEQ ID NO: 367466 - RNA, 19 nt, Homo sapiens
ggagaugcccuaccugaaa

SEQ ID NO: 367467 - RNA, 19 nt, Homo sapiens
gcaguugccagaccaauaa

SEQ ID NO: 367468 - RNA, 19 nt, Homo sapiens
gagcugagacgcaaaguug

SEQ ID NO: 367469 - RNA, 19 nt, Homo sapiens
ggaccuaacccgcucauga

SEQ ID NO: 367470 - RNA, 19 nt, Homo sapiens
gaggaucaguugcuaugaa

SEQ ID NO: 367471 - RNA, 19 nt, Homo sapiens
ggaagucccugagcugaga

SEQ ID NO: 367472 - RNA, 19 nt, Homo sapiens
ggagacacaugauccuuca

SEQ ID NO: 367473 - RNA, 19 nt, Homo sapiens
ggagaugccuucagaaagc

SEQ ID NO: 367474 - RNA, 19 nt, Homo sapiens
gaaccacaccaaugauauu

SEQ ID NO: 367475 - RNA, 19 nt, Homo sapiens
ggaugucucugucgcauuc

SEQ ID NO: 367476 - RNA, 19 nt, Homo sapiens
aaagcuaccuggcgaaaga

SEQ ID NO: 367477 - RNA, 19 nt, Homo sapiens
ggccaaagcugaccaacuc

SEQ ID NO: 367478 - RNA, 19 nt, Homo sapiens
gaauuaaugaccugggaua

SEQ ID NO: 367479 - RNA, 19 nt, Homo sapiens
gugaggagcugaccuacga

SEQ ID NO: 367480 - RNA, 19 nt, Homo sapiens
ccaauaucauggaaguuaa

SEQ ID NO: 367481 - RNA, 19 nt, Homo sapiens
guacagcuccuacaacuuc

SEQ ID NO: 367482 - RNA, 19 nt, Homo sapiens
ccuaguugcugaaaguuaa

SEQ ID NO: 367483 - RNA, 19 nt, Homo sapiens
ggucagaggaugcaaagaa

SEQ ID NO: 367484 - RNA, 19 nt, Homo sapiens
gugcuuaacuugguuguau

SEQ ID NO: 367485 - RNA, 19 nt, Homo sapiens
ggaauugaguaggaacuga

SEQ ID NO: 367486 - RNA, 19 nt, Homo sapiens
gagaugcccuaccugaaau

SEQ ID NO: 367487 - RNA, 19 nt, Homo sapiens
gggaggcugugaagcagua

SEQ ID NO: 367488 - RNA, 19 nt, Homo sapiens
gaccugggauauaaagcua

SEQ ID NO: 367489 - RNA, 19 nt, Homo sapiens
ugaaauacauggacgaaaa

SEQ ID NO: 367490 - RNA, 19 nt, Homo sapiens
agaccuacaucuccaagaa

SEQ ID NO: 367491 - RNA, 19 nt, Homo sapiens
gaaaguuaaggaaugugua

SEQ ID NO: 367492 - RNA, 19 nt, Homo sapiens
caugggaccugucgucuca

SEQ ID NO: 367493 - RNA, 19 nt, Homo sapiens
gaagcaaugugccuuagcu

SEQ ID NO: 367494 - RNA, 19 nt, Homo sapiens
ugaagaggaucaguugcua

SEQ ID NO: 367495 - RNA, 19 nt, Homo sapiens
guuguggccuccaauauca

SEQ ID NO: 367496 - RNA, 19 nt, Homo sapiens
ugccuuagcugccuugaga

SEQ ID NO: 367497 - RNA, 19 nt, Homo sapiens
ggaaccacaccaaugauau

SEQ ID NO: 367498 - RNA, 19 nt, Homo sapiens
gcugaaaguuaaggaaugu

SEQ ID NO: 367499 - RNA, 19 nt, Homo sapiens
guagagauaggcuucaguu

SEQ ID NO: 367500 - RNA, 19 nt, Homo sapiens
gggcuuagauagggagaga

SEQ ID NO: 367501 - RNA, 19 nt, Homo sapiens
gcaugauugugcuuaacuu

SEQ ID NO: 367502 - RNA, 19 nt, Homo sapiens
ggugagggugggagauuua

SEQ ID NO: 367503 - RNA, 19 nt, Homo sapiens
caggagaugccuucagaaa

SEQ ID NO: 367504 - RNA, 19 nt, Homo sapiens
aggcuucaguuguuaauug

SEQ ID NO: 367505 - RNA, 19 nt, Homo sapiens
caaagccagugaccuccuu

SEQ ID NO: 367506 - RNA, 19 nt, Homo sapiens
gcacgccucauucuuugaa

SEQ ID NO: 367507 - RNA, 19 nt, Homo sapiens
cagaugaaaccauuuggaa

SEQ ID NO: 367508 - RNA, 19 nt, Homo sapiens
cggaacaccuggcauccuu

SEQ ID NO: 367509 - RNA, 19 nt, Homo sapiens
gagcaggacaaguacuauu

SEQ ID NO: 367510 - RNA, 19 nt, Homo sapiens
cagaagccauggacgacuu

SEQ ID NO: 367511 - RNA, 19 nt, Homo sapiens
cgacgacccuacaguugug

SEQ ID NO: 367512 - RNA, 19 nt, Homo sapiens
aacaggagaugccuucaga

SEQ ID NO: 367513 - RNA, 19 nt, Homo sapiens
acagaagccuuggucuaaa

SEQ ID NO: 367514 - RNA, 19 nt, Homo sapiens
uacagaagccuuggucuaa

SEQ ID NO: 367515 - RNA, 19 nt, Homo sapiens
gcucagcucgcgcagguuu

SEQ ID NO: 367516 - RNA, 19 nt, Homo sapiens
gaugaaaccauuuggaaac

SEQ ID NO: 367517 - RNA, 19 nt, Homo sapiens
cgucucagccuguugguuu

SEQ ID NO: 367518 - RNA, 19 nt, Homo sapiens
acaccuacccugaggagua

SEQ ID NO: 367519 - RNA, 19 nt, Homo sapiens
ccgcgaagaugccguugga

SEQ ID NO: 367520 - RNA, 19 nt, Homo sapiens
gcuuugcucuagagaauag

SEQ ID NO: 367521 - RNA, 19 nt, Homo sapiens
ggugcaugauugugcuuaa

SEQ ID NO: 367522 - RNA, 19 nt, Homo sapiens
cauggcgucuagacacuuu

SEQ ID NO: 367523 - RNA, 19 nt, Homo sapiens
ccucggagaccuucacaaa

SEQ ID NO: 367524 - RNA, 19 nt, Homo sapiens
agagagaggagacacauga

SEQ ID NO: 367525 - RNA, 19 nt, Homo sapiens
ccauuauucuguccugaga

SEQ ID NO: 367526 - RNA, 19 nt, Homo sapiens
cuuugaaccucaucucuga

SEQ ID NO: 367527 - RNA, 19 nt, Homo sapiens
gugcccagaugaaaccauu

SEQ ID NO: 367528 - RNA, 19 nt, Homo sapiens
gggagcaggacaaguacua

SEQ ID NO: 367529 - RNA, 19 nt, Homo sapiens
gaagaggaucaguugcuau

SEQ ID NO: 367530 - RNA, 19 nt, Homo sapiens
ccaccaauacuacuagaga

SEQ ID NO: 367531 - RNA, 19 nt, Homo sapiens
uaugcuagcuuucaaacag

SEQ ID NO: 367532 - RNA, 19 nt, Homo sapiens
agauaggcuucaguuguua

SEQ ID NO: 367533 - RNA, 19 nt, Homo sapiens
gaaacugggcguggagaga

SEQ ID NO: 367534 - RNA, 19 nt, Homo sapiens
ccagugaccuccuuuugaa

SEQ ID NO: 367535 - RNA, 19 nt, Homo sapiens
gaagaugccguuggaacug

SEQ ID NO: 367536 - RNA, 19 nt, Homo sapiens
uaccugaaaugcccucuuc

SEQ ID NO: 367537 - RNA, 19 nt, Homo sapiens
ugagagaugucaaaagcua

SEQ ID NO: 367538 - RNA, 19 nt, Homo sapiens
cuucagaaagcuuuguaua

SEQ ID NO: 367539 - RNA, 19 nt, Homo sapiens
ggagauacuauagaaagga

SEQ ID NO: 367540 - RNA, 19 nt, Homo sapiens
ucgcacgccucauucuuug

SEQ ID NO: 367541 - RNA, 19 nt, Homo sapiens
caguacagcuccuacaacu

SEQ ID NO: 367542 - RNA, 19 nt, Homo sapiens
gggugagggugggagauuu

SEQ ID NO: 367543 - RNA, 19 nt, Homo sapiens
ggcagaauccuaaaauuaa

SEQ ID NO: 367544 - RNA, 19 nt, Homo sapiens
uguacuaccugaugaacau

SEQ ID NO: 367545 - RNA, 19 nt, Homo sapiens
caaugaggaagccaugaaa

SEQ ID NO: 367546 - RNA, 19 nt, Homo sapiens
gauaggcuucaguuguuaa

SEQ ID NO: 367547 - RNA, 19 nt, Homo sapiens
agagauaggcuucaguugu

SEQ ID NO: 367548 - RNA, 19 nt, Homo sapiens
uaacggggaccaauauuuu

SEQ ID NO: 367549 - RNA, 19 nt, Homo sapiens
gggagauacuauagaaagg

SEQ ID NO: 367550 - RNA, 19 nt, Homo sapiens
gcuuaacuugguuguauuu

SEQ ID NO: 367551 - RNA, 19 nt, Homo sapiens
ggacagguguuggguugac

SEQ ID NO: 367552 - RNA, 19 nt, Homo sapiens
gauacuauagaaaggagaa

SEQ ID NO: 367553 - RNA, 19 nt, Homo sapiens
uuagauagggagagaggua

SEQ ID NO: 367554 - RNA, 19 nt, Homo sapiens
ccaagaagcugacucgaua

SEQ ID NO: 367555 - RNA, 19 nt, Homo sapiens
gagcgaccaucuuuaauuu

SEQ ID NO: 367556 - RNA, 19 nt, Homo sapiens
ggucauagcugccaacauc

SEQ ID NO: 367557 - RNA, 19 nt, Homo sapiens
gaaaugaccuacgaggaaa

SEQ ID NO: 367558 - RNA, 19 nt, Homo sapiens
gcauguacccggcuacuua

SEQ ID NO: 367559 - RNA, 19 nt, Homo sapiens
gaacguggcugcugugaac

SEQ ID NO: 367560 - RNA, 19 nt, Homo sapiens
ggagagcgaccaucuuuaa

SEQ ID NO: 367561 - RNA, 19 nt, Homo sapiens
ggaaaugaccuacgaggaa

SEQ ID NO: 367562 - RNA, 19 nt, Homo sapiens
ggagaaggcagaacccaua

SEQ ID NO: 367563 - RNA, 19 nt, Homo sapiens
gaaagugcuugcugugaug

SEQ ID NO: 367564 - RNA, 19 nt, Homo sapiens
ggaaagugcuugcugugau

SEQ ID NO: 367565 - RNA, 19 nt, Homo sapiens
cagaauggaugguauugaa

SEQ ID NO: 367566 - RNA, 19 nt, Homo sapiens
aaacaugcauuugccauaa

SEQ ID NO: 367567 - RNA, 19 nt, Homo sapiens
gcacagccuuccauucaug

SEQ ID NO: 367568 - RNA, 19 nt, Homo sapiens
gaaacaugcauuugccaua

SEQ ID NO: 367569 - RNA, 19 nt, Homo sapiens
gaacagaauggcuacaaga

SEQ ID NO: 367570 - RNA, 19 nt, Homo sapiens
ccaccuggcucuuuguuga

SEQ ID NO: 367571 - RNA, 19 nt, Homo sapiens
uggacacacucauuuguua

SEQ ID NO: 367572 - RNA, 19 nt, Homo sapiens
gugaaacccuacaauguga

SEQ ID NO: 367573 - RNA, 19 nt, Homo sapiens
caucguauauuaccucaug

SEQ ID NO: 367574 - RNA, 19 nt, Homo sapiens
gcacgugagucuggugaaa

SEQ ID NO: 367575 - RNA, 19 nt, Homo sapiens
gcucuuagguguucacucu

SEQ ID NO: 367576 - RNA, 19 nt, Homo sapiens
gaacguggacaucucaaga

SEQ ID NO: 367577 - RNA, 19 nt, Homo sapiens
cagacuggcuggcaaguug

SEQ ID NO: 367578 - RNA, 19 nt, Homo sapiens
ggaagguccucaacgagau

SEQ ID NO: 367579 - RNA, 19 nt, Homo sapiens
gcagggaguuugccaagag

SEQ ID NO: 367580 - RNA, 19 nt, Homo sapiens
gcauggaccuggugacucu

SEQ ID NO: 367581 - RNA, 19 nt, Homo sapiens
acgaggaaauucaggauaa

SEQ ID NO: 367582 - RNA, 19 nt, Homo sapiens
caacaucgugcaagugaaa

SEQ ID NO: 367583 - RNA, 19 nt, Homo sapiens
gaagagggccugaaaauca

SEQ ID NO: 367584 - RNA, 19 nt, Homo sapiens
cauuaggacugcagccuuu

SEQ ID NO: 367585 - RNA, 19 nt, Homo sapiens
caagauccuuccagacuca

SEQ ID NO: 367586 - RNA, 19 nt, Homo sapiens
ccaagagucuagcccaguu

SEQ ID NO: 367587 - RNA, 19 nt, Homo sapiens
ccacgggaauugacacaga

SEQ ID NO: 367588 - RNA, 19 nt, Homo sapiens
gaacggagagcgaccaucu

SEQ ID NO: 367589 - RNA, 19 nt, Homo sapiens
agaccuacaucuccaagaa

SEQ ID NO: 367590 - RNA, 19 nt, Homo sapiens
gcugugauguuccuacugu

SEQ ID NO: 367591 - RNA, 19 nt, Homo sapiens
gcgcagcucuuagguguuc

SEQ ID NO: 367592 - RNA, 19 nt, Homo sapiens
cagcacagccuuccauuca

SEQ ID NO: 367593 - RNA, 19 nt, Homo sapiens
acacuuguaugguccugua

SEQ ID NO: 367594 - RNA, 19 nt, Homo sapiens
ccagcauucuuugcaauaa

SEQ ID NO: 367595 - RNA, 19 nt, Homo sapiens
gggcugagguguagcugau

SEQ ID NO: 367596 - RNA, 19 nt, Homo sapiens
ggacaagccagaugaagag

SEQ ID NO: 367597 - RNA, 19 nt, Homo sapiens
cagcauucuuugcaauaaa

SEQ ID NO: 367598 - RNA, 19 nt, Homo sapiens
gaucccaaguccuuugugu

SEQ ID NO: 367599 - RNA, 19 nt, Homo sapiens
agagccgcaucguauauua

SEQ ID NO: 367600 - RNA, 19 nt, Homo sapiens
gcugagguguagcugauug

SEQ ID NO: 367601 - RNA, 19 nt, Homo sapiens
gugaggaaaugaccuacga

SEQ ID NO: 367602 - RNA, 19 nt, Homo sapiens
gcagauauuuucccgaguu

SEQ ID NO: 367603 - RNA, 19 nt, Homo sapiens
ccuacaaugugaaaggaaa

SEQ ID NO: 367604 - RNA, 19 nt, Homo sapiens
caaugaagagggccugaaa

SEQ ID NO: 367605 - RNA, 19 nt, Homo sapiens
acauugggaugcacagaaa

SEQ ID NO: 367606 - RNA, 19 nt, Homo sapiens
gaccuguccuauaucaaga

SEQ ID NO: 367607 - RNA, 19 nt, Homo sapiens
guucaauguuggccaguau

SEQ ID NO: 367608 - RNA, 19 nt, Homo sapiens
gaauggaugguauugaauc

SEQ ID NO: 367609 - RNA, 19 nt, Homo sapiens
gcauguaccucuggauguc

SEQ ID NO: 367610 - RNA, 19 nt, Homo sapiens
gguggucucucauccuugu

SEQ ID NO: 367611 - RNA, 19 nt, Homo sapiens
gaaacccuacaaugugaaa

SEQ ID NO: 367612 - RNA, 19 nt, Homo sapiens
caacugcccaacucucauu

SEQ ID NO: 367613 - RNA, 19 nt, Homo sapiens
ggcauaugguuguaaagug

SEQ ID NO: 367614 - RNA, 19 nt, Homo sapiens
gggcauucaugaaagcaau

SEQ ID NO: 367615 - RNA, 19 nt, Homo sapiens
cagaacagcugcccuaccu

SEQ ID NO: 367616 - RNA, 19 nt, Homo sapiens
ggagagcccuucccauccu

SEQ ID NO: 367617 - RNA, 19 nt, Homo sapiens
ucaguuggcuuugugaagu

SEQ ID NO: 367618 - RNA, 19 nt, Homo sapiens
gcauugagugcuaugagaa

SEQ ID NO: 367619 - RNA, 19 nt, Homo sapiens
gccaacaucgugcaaguga

SEQ ID NO: 367620 - RNA, 19 nt, Homo sapiens
gggcgucugugaggaaaug

SEQ ID NO: 367621 - RNA, 19 nt, Homo sapiens
gagaacagaauggcuacaa

SEQ ID NO: 367622 - RNA, 19 nt, Homo sapiens
gcccaacucucauugucau

SEQ ID NO: 367623 - RNA, 19 nt, Homo sapiens
gaucugaaggucuggacaa

SEQ ID NO: 367624 - RNA, 19 nt, Homo sapiens
gcuaugagaacuccuacga

SEQ ID NO: 367625 - RNA, 19 nt, Homo sapiens
gaaguccagugucugucau

SEQ ID NO: 367626 - RNA, 19 nt, Homo sapiens
gaaaauggccuugugaagu

SEQ ID NO: 367627 - RNA, 19 nt, Homo sapiens
gcuccugaccugcugcuaa

SEQ ID NO: 367628 - RNA, 19 nt, Homo sapiens
agaaugugcuggucaucug

SEQ ID NO: 367629 - RNA, 19 nt, Homo sapiens
uagcccaguucaucaguga

SEQ ID NO: 367630 - RNA, 19 nt, Homo sapiens
uggaugguauugaaucuca

SEQ ID NO: 367631 - RNA, 19 nt, Homo sapiens
gaccaugccuuugggacau

SEQ ID NO: 367632 - RNA, 19 nt, Homo sapiens
guugugggcauucaugaaa

SEQ ID NO: 367633 - RNA, 19 nt, Homo sapiens
cagcucaguuggcuuugug

SEQ ID NO: 367634 - RNA, 19 nt, Homo sapiens
cgaggaaauucaggauaau

SEQ ID NO: 367635 - RNA, 19 nt, Homo sapiens
agagcgaccaucuuuaauu

SEQ ID NO: 367636 - RNA, 19 nt, Homo sapiens
gcgaccaucuuuaauuuug

SEQ ID NO: 367637 - RNA, 19 nt, Homo sapiens
gugcccauguugcagauau

SEQ ID NO: 367638 - RNA, 19 nt, Homo sapiens
cauaguggguucccuuggu

SEQ ID NO: 367639 - RNA, 19 nt, Homo sapiens
guacacugguggcagaaac

SEQ ID NO: 367640 - RNA, 19 nt, Homo sapiens
caagacagggcaggaaguu

SEQ ID NO: 367641 - RNA, 19 nt, Homo sapiens
ggacacacucauuuguuag

SEQ ID NO: 367642 - RNA, 19 nt, Homo sapiens
ccauguucauccacuguga

SEQ ID NO: 367643 - RNA, 19 nt, Homo sapiens
gaagugugaaacccuacaa

SEQ ID NO: 367644 - RNA, 19 nt, Homo sapiens
ugacuccuguggcauaugg

SEQ ID NO: 367645 - RNA, 19 nt, Homo sapiens
cgacaaggcagcagaacag

SEQ ID NO: 367646 - RNA, 19 nt, Homo sapiens
ccagagccgcaucguauau

SEQ ID NO: 367647 - RNA, 19 nt, Homo sapiens
caccuggacacacucauuu

SEQ ID NO: 367648 - RNA, 19 nt, Homo sapiens
cuucaggccugcucucaca

SEQ ID NO: 367649 - RNA, 19 nt, Homo sapiens
ccucuaccauccucucugu

SEQ ID NO: 367650 - RNA, 19 nt, Homo sapiens
gugugaaacccuacaaugu

SEQ ID NO: 367651 - RNA, 19 nt, Homo sapiens
ugaggcgcauugagugcua

SEQ ID NO: 367652 - RNA, 19 nt, Homo sapiens
ccgcaugggcugaggugua

SEQ ID NO: 367653 - RNA, 19 nt, Homo sapiens
uugcuggacuggaugcauu

SEQ ID NO: 367654 - RNA, 19 nt, Homo sapiens
gagaacaacuggaacauuu

SEQ ID NO: 367655 - RNA, 19 nt, Homo sapiens
ucacugagcucaagaaaga

SEQ ID NO: 367656 - RNA, 19 nt, Homo sapiens
ugaagaugcuggcacaaua

SEQ ID NO: 367657 - RNA, 19 nt, Homo sapiens
gcacaauaccgcaucagua

SEQ ID NO: 367658 - RNA, 19 nt, Homo sapiens
cuagugggcuccaucgaua

SEQ ID NO: 367659 - RNA, 19 nt, Homo sapiens
ccacggaguuccuguacaa

SEQ ID NO: 367660 - RNA, 19 nt, Homo sapiens
gggagaacuucauguguga

SEQ ID NO: 367661 - RNA, 19 nt, Homo sapiens
gaagugccaugacuacuac

SEQ ID NO: 367662 - RNA, 19 nt, Homo sapiens
cggagaagaugaagacaga

SEQ ID NO: 367663 - RNA, 19 nt, Homo sapiens
ggagggaggugagaacauc

SEQ ID NO: 367664 - RNA, 19 nt, Homo sapiens
gugcaucggucuccggaaa

SEQ ID NO: 367665 - RNA, 19 nt, Homo sapiens
gaagaugaagacagacauu

SEQ ID NO: 367666 - RNA, 19 nt, Homo sapiens
gagaacauccgcaucuaug

SEQ ID NO: 367667 - RNA, 19 nt, Homo sapiens
ucaagaaagacacugauuu

SEQ ID NO: 367668 - RNA, 19 nt, Homo sapiens
caacauccacgacuuaaag

SEQ ID NO: 367669 - RNA, 19 nt, Homo sapiens
cgacugaacaucaucauca

SEQ ID NO: 367670 - RNA, 19 nt, Homo sapiens
gccaaagucuuccucaucu

SEQ ID NO: 367671 - RNA, 19 nt, Homo sapiens
cgaggacccuuucaacauc

SEQ ID NO: 367672 - RNA, 19 nt, Homo sapiens
ccaaagucuuccucaucua

SEQ ID NO: 367673 - RNA, 19 nt, Homo sapiens
ggacggguguucgccaaug

SEQ ID NO: 367674 - RNA, 19 nt, Homo sapiens
agaaagccauggaugacaa

SEQ ID NO: 367675 - RNA, 19 nt, Homo sapiens
ccagagaggcccugugguu

SEQ ID NO: 367676 - RNA, 19 nt, Homo sapiens
ggugggagcuucgagaaca

SEQ ID NO: 367677 - RNA, 19 nt, Homo sapiens
ugaaggccaugcugugguu

SEQ ID NO: 367678 - RNA, 19 nt, Homo sapiens
gcacaugacggagaagaug

SEQ ID NO: 367679 - RNA, 19 nt, Homo sapiens
ggagaacauccgcaucuau

SEQ ID NO: 367680 - RNA, 19 nt, Homo sapiens
ccaaggaagugcagaaagc

SEQ ID NO: 367681 - RNA, 19 nt, Homo sapiens
gcagcaagaugggcaugga

SEQ ID NO: 367682 - RNA, 19 nt, Homo sapiens
gaacaacuggaacauuuac

SEQ ID NO: 367683 - RNA, 19 nt, Homo sapiens
ugacgcgcaugggcauuua

SEQ ID NO: 367684 - RNA, 19 nt, Homo sapiens
ggaacgagaagugccauga

SEQ ID NO: 367685 - RNA, 19 nt, Homo sapiens
gagaggcccugugguugga

SEQ ID NO: 367686 - RNA, 19 nt, Homo sapiens
gagcugugaccgcaucaaa

SEQ ID NO: 367687 - RNA, 19 nt, Homo sapiens
ggaugagaagcauguguaa

SEQ ID NO: 367688 - RNA, 19 nt, Homo sapiens
ggccugggcuguugugucu

SEQ ID NO: 367689 - RNA, 19 nt, Homo sapiens
gaacauccgcaucuauggu

SEQ ID NO: 367690 - RNA, 19 nt, Homo sapiens
gcgccuagguuguguugag

SEQ ID NO: 367691 - RNA, 19 nt, Homo sapiens
gaagaugcuggcacaauac

SEQ ID NO: 367692 - RNA, 19 nt, Homo sapiens
ugaucggccugaagaagaa

SEQ ID NO: 367693 - RNA, 19 nt, Homo sapiens
agaagugccaugacuacua

SEQ ID NO: 367694 - RNA, 19 nt, Homo sapiens
ggugcacgauggcuucgaa

SEQ ID NO: 367695 - RNA, 19 nt, Homo sapiens
agaacaacuggaacauuua

SEQ ID NO: 367696 - RNA, 19 nt, Homo sapiens
gcgugcagaugaccaagga

SEQ ID NO: 367697 - RNA, 19 nt, Homo sapiens
ggagagcggaugagaagca

SEQ ID NO: 367698 - RNA, 19 nt, Homo sapiens
gagaagcugcgcgagguuu

SEQ ID NO: 367699 - RNA, 19 nt, Homo sapiens
gagcggaugagaagcaugu

SEQ ID NO: 367700 - RNA, 19 nt, Homo sapiens
gagaagaugaagacagaca

SEQ ID NO: 367701 - RNA, 19 nt, Homo sapiens
gcagaugaccaaggaagug

SEQ ID NO: 367702 - RNA, 19 nt, Homo sapiens
gaggugagaacaucaagca

SEQ ID NO: 367703 - RNA, 19 nt, Homo sapiens
ggacaggaaagaggaagug

SEQ ID NO: 367704 - RNA, 19 nt, Homo sapiens
ggaccaagcgccguguguu

SEQ ID NO: 367705 - RNA, 19 nt, Homo sapiens
gcugugaccgcaucaaaca

SEQ ID NO: 367706 - RNA, 19 nt, Homo sapiens
ccaagggucaggugcaaga

SEQ ID NO: 367707 - RNA, 19 nt, Homo sapiens
gagaacuucaugugugaga

SEQ ID NO: 367708 - RNA, 19 nt, Homo sapiens
cggaugagaagcaugugua

SEQ ID NO: 367709 - RNA, 19 nt, Homo sapiens
gaccaaggaagugcagaaa

SEQ ID NO: 367710 - RNA, 19 nt, Homo sapiens
gagcgucuccaacaucauc

SEQ ID NO: 367711 - RNA, 19 nt, Homo sapiens
cgagaacaacuggaacauu

SEQ ID NO: 367712 - RNA, 19 nt, Homo sapiens
augcugggcucacuacaug

SEQ ID NO: 367713 - RNA, 19 nt, Homo sapiens
gugaucggccugaagaaga

SEQ ID NO: 367714 - RNA, 19 nt, Homo sapiens
gaccaagcgccguguguuc

SEQ ID NO: 367715 - RNA, 19 nt, Homo sapiens
gcuccgacacugcuguaaa

SEQ ID NO: 367716 - RNA, 19 nt, Homo sapiens
caacuggaacauuuacaag

SEQ ID NO: 367717 - RNA, 19 nt, Homo sapiens
gcagaaagccauggaugac

SEQ ID NO: 367718 - RNA, 19 nt, Homo sapiens
gcgcaugggcauuuaugug

SEQ ID NO: 367719 - RNA, 19 nt, Homo sapiens
gacugaacaucaucaucau

SEQ ID NO: 367720 - RNA, 19 nt, Homo sapiens
ggaccuacucgcaccugaa

SEQ ID NO: 367721 - RNA, 19 nt, Homo sapiens
uuucaacauccacgacuua

SEQ ID NO: 367722 - RNA, 19 nt, Homo sapiens
cuccgacacugcuguaaau

SEQ ID NO: 367723 - RNA, 19 nt, Homo sapiens
uggagaacauccgcaucua

SEQ ID NO: 367724 - RNA, 19 nt, Homo sapiens
uggagcacaugacggagaa

SEQ ID NO: 367725 - RNA, 19 nt, Homo sapiens
caaagucuuccucaucuac

SEQ ID NO: 367726 - RNA, 19 nt, Homo sapiens
agaagcugcgcgagguuua

SEQ ID NO: 367727 - RNA, 19 nt, Homo sapiens
ccuuacaggugccaacauc

SEQ ID NO: 367728 - RNA, 19 nt, Homo sapiens
ggagaagcugcgcgagguu

SEQ ID NO: 367729 - RNA, 19 nt, Homo sapiens
gagagcggaugagaagcau

SEQ ID NO: 367730 - RNA, 19 nt, Homo sapiens
gcugggagaacuucaugug

SEQ ID NO: 367731 - RNA, 19 nt, Homo sapiens
caucauggaggucaucgau

SEQ ID NO: 367732 - RNA, 19 nt, Homo sapiens
ggcggaagguaagaucuca

SEQ ID NO: 367733 - RNA, 19 nt, Homo sapiens
gaacgagaagugccaugac

SEQ ID NO: 367734 - RNA, 19 nt, Homo sapiens
gagcacaugacggagaaga

SEQ ID NO: 367735 - RNA, 19 nt, Homo sapiens
caucucccauggacacaca

SEQ ID NO: 367736 - RNA, 19 nt, Homo sapiens
cguggcaccucaccucaca

SEQ ID NO: 367737 - RNA, 19 nt, Homo sapiens
cgagaagugccaugacuac

SEQ ID NO: 367738 - RNA, 19 nt, Homo sapiens
cugagcgucuccaacauca

SEQ ID NO: 367739 - RNA, 19 nt, Homo sapiens
gcugguggucgguggguuu

SEQ ID NO: 367740 - RNA, 19 nt, Homo sapiens
ggugauggcgcugcuggaa

SEQ ID NO: 367741 - RNA, 19 nt, Homo sapiens
ucgcugagggugccauuga

SEQ ID NO: 367742 - RNA, 19 nt, Homo sapiens
cuccaucgauaacgacuuc

SEQ ID NO: 367743 - RNA, 19 nt, Homo sapiens
ugacggagaagaugaagac

SEQ ID NO: 367744 - RNA, 19 nt, Homo sapiens
ugagaagcauguguaacca

SEQ ID NO: 367745 - RNA, 19 nt, Homo sapiens
acaacuggaacauuuacaa

SEQ ID NO: 367746 - RNA, 19 nt, Homo sapiens
gaaagccauggaugacaag

SEQ ID NO: 367747 - RNA, 19 nt, Homo sapiens
ggucccgacugaacaucau

SEQ ID NO: 367748 - RNA, 19 nt, Homo sapiens
ggaacuaugggaccaagcu

SEQ ID NO: 367749 - RNA, 19 nt, Homo sapiens
ucaacauccacgacuuaaa

SEQ ID NO: 367750 - RNA, 19 nt, Homo sapiens
ucgaggacccuuucaacau

SEQ ID NO: 367751 - RNA, 19 nt, Homo sapiens
uuaugugggugccaaaguc

SEQ ID NO: 367752 - RNA, 19 nt, Homo sapiens
gugggagcuucgagaacaa

SEQ ID NO: 367753 - RNA, 19 nt, Homo sapiens
gagcugguggcggaaggua

SEQ ID NO: 367754 - RNA, 19 nt, Homo sapiens
gaaggcaucuguuauugaa

SEQ ID NO: 367755 - RNA, 19 nt, Homo sapiens
ucacaaacguauagaauga

SEQ ID NO: 367756 - RNA, 19 nt, Homo sapiens
gaagacagccauagagaaa

SEQ ID NO: 367757 - RNA, 19 nt, Homo sapiens
gaggaggacuuucuaaugu

SEQ ID NO: 367758 - RNA, 19 nt, Homo sapiens
ggaggaggcuucaagacuu

SEQ ID NO: 367759 - RNA, 19 nt, Homo sapiens
ugaugggacuguucgauua

SEQ ID NO: 367760 - RNA, 19 nt, Homo sapiens
ugaccaaccucaccaaaga

SEQ ID NO: 367761 - RNA, 19 nt, Homo sapiens
ggacuguuguucucacuau

SEQ ID NO: 367762 - RNA, 19 nt, Homo sapiens
gaagguugcuggacagucu

SEQ ID NO: 367763 - RNA, 19 nt, Homo sapiens
gauccugaguucauuguga

SEQ ID NO: 367764 - RNA, 19 nt, Homo sapiens
ucgauuagcuccucugaga

SEQ ID NO: 367765 - RNA, 19 nt, Homo sapiens
gauccaaacugcaaaauug

SEQ ID NO: 367766 - RNA, 19 nt, Homo sapiens
gaaacggcaaagaagauua

SEQ ID NO: 367767 - RNA, 19 nt, Homo sapiens
gaucaacugcgaugucaaa

SEQ ID NO: 367768 - RNA, 19 nt, Homo sapiens
caaagccaauggaaacaga

SEQ ID NO: 367769 - RNA, 19 nt, Homo sapiens
caggaaagccuaagggaaa

SEQ ID NO: 367770 - RNA, 19 nt, Homo sapiens
uggaguacauucaaacaaa

SEQ ID NO: 367771 - RNA, 19 nt, Homo sapiens
aaacaagggugucauucug

SEQ ID NO: 367772 - RNA, 19 nt, Homo sapiens
gaacaaacggcuucuacuc

SEQ ID NO: 367773 - RNA, 19 nt, Homo sapiens
gaugggagcaccagcauug

SEQ ID NO: 367774 - RNA, 19 nt, Homo sapiens
gaucacaaacguauagaau

SEQ ID NO: 367775 - RNA, 19 nt, Homo sapiens
caacccugcuacucacuuu

SEQ ID NO: 367776 - RNA, 19 nt, Homo sapiens
gagauggacucauggaaac

SEQ ID NO: 367777 - RNA, 19 nt, Homo sapiens
acaaagaaacggcaaagaa

SEQ ID NO: 367778 - RNA, 19 nt, Homo sapiens
ggaggacuuucuaauguag

SEQ ID NO: 367779 - RNA, 19 nt, Homo sapiens
caucagcucuuacauacuc

SEQ ID NO: 367780 - RNA, 19 nt, Homo sapiens
ugaagggagugaucaccua

SEQ ID NO: 367781 - RNA, 19 nt, Homo sapiens
uaucagaggccaccuauuc

SEQ ID NO: 367782 - RNA, 19 nt, Homo sapiens
gcaagugcugcuuuacuaa

SEQ ID NO: 367783 - RNA, 19 nt, Homo sapiens
caaccucaccaaagaguuu

SEQ ID NO: 367784 - RNA, 19 nt, Homo sapiens
gaauugagcacacagucuu

SEQ ID NO: 367785 - RNA, 19 nt, Homo sapiens
gagaauccuuuaucgucuu

SEQ ID NO: 367786 - RNA, 19 nt, Homo sapiens
acaguggugugcuugauaa

SEQ ID NO: 367787 - RNA, 19 nt, Homo sapiens
ugacuggaguacauucaaa

SEQ ID NO: 367788 - RNA, 19 nt, Homo sapiens
gcacagccggucacucuga

SEQ ID NO: 367789 - RNA, 19 nt, Homo sapiens
guggugugcuugauaauuc

SEQ ID NO: 367790 - RNA, 19 nt, Homo sapiens
caaagaaacggcaaagaag

SEQ ID NO: 367791 - RNA, 19 nt, Homo sapiens
caaagaugaucacaaacgu

SEQ ID NO: 367792 - RNA, 19 nt, Homo sapiens
gcaccguccuccaguuugu

SEQ ID NO: 367793 - RNA, 19 nt, Homo sapiens
ggaguacauucaaacaaag

SEQ ID NO: 367794 - RNA, 19 nt, Homo sapiens
gagacaacccugcuacuca

SEQ ID NO: 367795 - RNA, 19 nt, Homo sapiens
ggugucauucugauauuua

SEQ ID NO: 367796 - RNA, 19 nt, Homo sapiens
ugggagagauggacucaug

SEQ ID NO: 367797 - RNA, 19 nt, Homo sapiens
agaauccuuuaucgucuua

SEQ ID NO: 367798 - RNA, 19 nt, Homo sapiens
ucaugacaauguaggaauu

SEQ ID NO: 367799 - RNA, 19 nt, Homo sapiens
gaauacagugcagcccuua

SEQ ID NO: 367800 - RNA, 19 nt, Homo sapiens
gagcccaacuuugcaaaca

SEQ ID NO: 367801 - RNA, 19 nt, Homo sapiens
gcuucuggcugucacugua

SEQ ID NO: 367802 - RNA, 19 nt, Homo sapiens
uugacaaccuccaucagua

SEQ ID NO: 367803 - RNA, 19 nt, Homo sapiens
aaacggcaaagaagauuaa

SEQ ID NO: 367804 - RNA, 19 nt, Homo sapiens
uaugaaggcaucuguuauu

SEQ ID NO: 367805 - RNA, 19 nt, Homo sapiens
uuuacuaacugacguguug

SEQ ID NO: 367806 - RNA, 19 nt, Homo sapiens
agagaccacuccuucuuug

SEQ ID NO: 367807 - RNA, 19 nt, Homo sapiens
gagaggaggacuuucuaau

SEQ ID NO: 367808 - RNA, 19 nt, Homo sapiens
gauggguguuguccaguau

SEQ ID NO: 367809 - RNA, 19 nt, Homo sapiens
gaugaucacaaacguauag

SEQ ID NO: 367810 - RNA, 19 nt, Homo sapiens
aaaccuggaucgguccuuu

SEQ ID NO: 367811 - RNA, 19 nt, Homo sapiens
ugucaaagccggaaagauc

SEQ ID NO: 367812 - RNA, 19 nt, Homo sapiens
aggaggacuuucuaaugua

SEQ ID NO: 367813 - RNA, 19 nt, Homo sapiens
ugauggguguuguccagua

SEQ ID NO: 367814 - RNA, 19 nt, Homo sapiens
uggacagucugguuacaaa

SEQ ID NO: 367815 - RNA, 19 nt, Homo sapiens
cagaucaacugcgauguca

SEQ ID NO: 367816 - RNA, 19 nt, Homo sapiens
gcuggugacuggaguacau

SEQ ID NO: 367817 - RNA, 19 nt, Homo sapiens
cagaacauuuguacagagu

SEQ ID NO: 367818 - RNA, 19 nt, Homo sapiens
gaagggagugaucaccuau

SEQ ID NO: 367819 - RNA, 19 nt, Homo sapiens
cauugaaggugcugcugaa

SEQ ID NO: 367820 - RNA, 19 nt, Homo sapiens
gcgagagagucaggaauca

SEQ ID NO: 367821 - RNA, 19 nt, Homo sapiens
ucaagacacacacgaauuc

SEQ ID NO: 367822 - RNA, 19 nt, Homo sapiens
gaucgguccuuuuagauga

SEQ ID NO: 367823 - RNA, 19 nt, Homo sapiens
ggagcugccuuccagaaac

SEQ ID NO: 367824 - RNA, 19 nt, Homo sapiens
gcucuuacauacucaucau

SEQ ID NO: 367825 - RNA, 19 nt, Homo sapiens
aaagaaacggcaaagaaga

SEQ ID NO: 367826 - RNA, 19 nt, Homo sapiens
ggaguuacaaagaugauca

SEQ ID NO: 367827 - RNA, 19 nt, Homo sapiens
cagagaccacuccuucuuu

SEQ ID NO: 367828 - RNA, 19 nt, Homo sapiens
augaaggacuuguuccaaa

SEQ ID NO: 367829 - RNA, 19 nt, Homo sapiens
cgauggagagaauccuuua

SEQ ID NO: 367830 - RNA, 19 nt, Homo sapiens
cuaccacgauggagagaau

SEQ ID NO: 367831 - RNA, 19 nt, Homo sapiens
caucgauccugaguucauu

SEQ ID NO: 367832 - RNA, 19 nt, Homo sapiens
gggcauggagaaacaaaug

SEQ ID NO: 367833 - RNA, 19 nt, Homo sapiens
ccaacaagaggaaguuaau

SEQ ID NO: 367834 - RNA, 19 nt, Homo sapiens
uaauuuggaugggauuugu

SEQ ID NO: 367835 - RNA, 19 nt, Homo sapiens
ccagagaccacuccuucuu

SEQ ID NO: 367836 - RNA, 19 nt, Homo sapiens
cccaucagcucuuacauac

SEQ ID NO: 367837 - RNA, 19 nt, Homo sapiens
aggcaucuguuauugaaau

SEQ ID NO: 367838 - RNA, 19 nt, Homo sapiens
acuaugaaggcaucuguua

SEQ ID NO: 367839 - RNA, 19 nt, Homo sapiens
uagaagucauugccacuca

SEQ ID NO: 367840 - RNA, 19 nt, Homo sapiens
agagauggacucauggaaa

SEQ ID NO: 367841 - RNA, 19 nt, Homo sapiens
cuuagaaaguaaacccaaa

SEQ ID NO: 367842 - RNA, 19 nt, Homo sapiens
gggugucauucugauauuu

SEQ ID NO: 367843 - RNA, 19 nt, Homo sapiens
uuauggcacugacguguau

SEQ ID NO: 367844 - RNA, 19 nt, Homo sapiens
caagaggaaguuaaugauc

SEQ ID NO: 367845 - RNA, 19 nt, Homo sapiens
caaacaagggugucauucu

SEQ ID NO: 367846 - RNA, 19 nt, Homo sapiens
caagggugucauucugaua

SEQ ID NO: 367847 - RNA, 19 nt, Homo sapiens
ggcagggcauggagaaaca

SEQ ID NO: 367848 - RNA, 19 nt, Homo sapiens
ugacaaccuccaucaguau

SEQ ID NO: 367849 - RNA, 19 nt, Homo sapiens
aacaagaggaaguuaauga

SEQ ID NO: 367850 - RNA, 19 nt, Homo sapiens
gcaguacaccuacgaacag

SEQ ID NO: 367851 - RNA, 19 nt, Homo sapiens
ggagagauggacucaugga

SEQ ID NO: 367852 - RNA, 19 nt, Homo sapiens
gaugucagccugggagaga

SEQ ID NO: 367853 - RNA, 19 nt, Homo sapiens
gugcugcuuuacuaacuga

SEQ ID NO: 367854 - RNA, 19 nt, Homo sapiens
gaacagaucagugccaaua

SEQ ID NO: 367855 - RNA, 19 nt, Homo sapiens
ucaagaaucuggugguuaa

SEQ ID NO: 367856 - RNA, 19 nt, Homo sapiens
gcucuaaacuugggacuaa

SEQ ID NO: 367857 - RNA, 19 nt, Homo sapiens
gggaauagauuaccugauc

SEQ ID NO: 367858 - RNA, 19 nt, Homo sapiens
gauaucacuuacucaguua

SEQ ID NO: 367859 - RNA, 19 nt, Homo sapiens
gggcggaucuuugccaaua

SEQ ID NO: 367860 - RNA, 19 nt, Homo sapiens
gcaggaagcaguuugauga

SEQ ID NO: 367861 - RNA, 19 nt, Homo sapiens
ggagugacuuguugaguga

SEQ ID NO: 367862 - RNA, 19 nt, Homo sapiens
caaagccauugcugucuua

SEQ ID NO: 367863 - RNA, 19 nt, Homo sapiens
acacagcacucaauacuau

SEQ ID NO: 367864 - RNA, 19 nt, Homo sapiens
guagugagccucucuggua

SEQ ID NO: 367865 - RNA, 19 nt, Homo sapiens
cagguaagaucacagauga

SEQ ID NO: 367866 - RNA, 19 nt, Homo sapiens
gcuguucgcuccacuguga

SEQ ID NO: 367867 - RNA, 19 nt, Homo sapiens
gaggagcccuucaccauuc

SEQ ID NO: 367868 - RNA, 19 nt, Homo sapiens
gaagagcuuugaacagauc

SEQ ID NO: 367869 - RNA, 19 nt, Homo sapiens
ccagaggacauuuguguua

SEQ ID NO: 367870 - RNA, 19 nt, Homo sapiens
acagaucagugccaauaua

SEQ ID NO: 367871 - RNA, 19 nt, Homo sapiens
gaacagugguggcugaaac

SEQ ID NO: 367872 - RNA, 19 nt, Homo sapiens
aagaagagcuuugaacaga

SEQ ID NO: 367873 - RNA, 19 nt, Homo sapiens
cagaagacaucaagaaucu

SEQ ID NO: 367874 - RNA, 19 nt, Homo sapiens
ggacauuuguguuagaagu

SEQ ID NO: 367875 - RNA, 19 nt, Homo sapiens
uuacuacagugacaaauug

SEQ ID NO: 367876 - RNA, 19 nt, Homo sapiens
ggccggagcuucaugaaca

SEQ ID NO: 367877 - RNA, 19 nt, Homo sapiens
ggauaugacacccggguua

SEQ ID NO: 367878 - RNA, 19 nt, Homo sapiens
gaaagcagguaagaucaca

SEQ ID NO: 367879 - RNA, 19 nt, Homo sapiens
ugaaggaccagacagauuu

SEQ ID NO: 367880 - RNA, 19 nt, Homo sapiens
ggaauagauuaccugauca

SEQ ID NO: 367881 - RNA, 19 nt, Homo sapiens
gaaaaggggcuugguguua

SEQ ID NO: 367882 - RNA, 19 nt, Homo sapiens
gcuucuagcucaugucaga

SEQ ID NO: 367883 - RNA, 19 nt, Homo sapiens
ccagcuaccugaacauugu

SEQ ID NO: 367884 - RNA, 19 nt, Homo sapiens
ccuaauaaguccacaucuu

SEQ ID NO: 367885 - RNA, 19 nt, Homo sapiens
gagauugacuuggacacuu

SEQ ID NO: 367886 - RNA, 19 nt, Homo sapiens
gcuacagucuccaacaaug

SEQ ID NO: 367887 - RNA, 19 nt, Homo sapiens
aaaggacucuacccaagaa

SEQ ID NO: 367888 - RNA, 19 nt, Homo sapiens
ccaaggccauggaugagaa

SEQ ID NO: 367889 - RNA, 19 nt, Homo sapiens
ggagagcguuucgaugaug

SEQ ID NO: 367890 - RNA, 19 nt, Homo sapiens
agauaucacuuacucaguu

SEQ ID NO: 367891 - RNA, 19 nt, Homo sapiens
ggccauggaugagaagaaa

SEQ ID NO: 367892 - RNA, 19 nt, Homo sapiens
ccacaucuucucaguguuu

SEQ ID NO: 367893 - RNA, 19 nt, Homo sapiens
gaacuauaccacugacuuc

SEQ ID NO: 367894 - RNA, 19 nt, Homo sapiens
ggccgaugcugccuacauu

SEQ ID NO: 367895 - RNA, 19 nt, Homo sapiens
gaaaaccaaucaccucaga

SEQ ID NO: 367896 - RNA, 19 nt, Homo sapiens
gcaauugacaagaauggaa

SEQ ID NO: 367897 - RNA, 19 nt, Homo sapiens
gaggacauuuguguuagaa

SEQ ID NO: 367898 - RNA, 19 nt, Homo sapiens
ccagaaagcagguaagauc

SEQ ID NO: 367899 - RNA, 19 nt, Homo sapiens
ggagaugcccaagguauga

SEQ ID NO: 367900 - RNA, 19 nt, Homo sapiens
gaaaacaacugugaaaagg

SEQ ID NO: 367901 - RNA, 19 nt, Homo sapiens
gaauuuaacaugacuucug

SEQ ID NO: 367902 - RNA, 19 nt, Homo sapiens
uagauuaccugaucauggu

SEQ ID NO: 367903 - RNA, 19 nt, Homo sapiens
guccacaucuucucagugu

SEQ ID NO: 367904 - RNA, 19 nt, Homo sapiens
cuaaaccucucuggaguga

SEQ ID NO: 367905 - RNA, 19 nt, Homo sapiens
cuauaccacugacuucauu

SEQ ID NO: 367906 - RNA, 19 nt, Homo sapiens
ugaguggagugacuuguug

SEQ ID NO: 367907 - RNA, 19 nt, Homo sapiens
guggauaccuggcccuugu

SEQ ID NO: 367908 - RNA, 19 nt, Homo sapiens
gcucacacccuaauaaguc

SEQ ID NO: 367909 - RNA, 19 nt, Homo sapiens
ccaaggcuaugaacuggau

SEQ ID NO: 367910 - RNA, 19 nt, Homo sapiens
cgucggguguuuaucauug

SEQ ID NO: 367911 - RNA, 19 nt, Homo sapiens
cagaucagugccaauauaa

SEQ ID NO: 367912 - RNA, 19 nt, Homo sapiens
ccaaucaccucagaagaca

SEQ ID NO: 367913 - RNA, 19 nt, Homo sapiens
gaucauggaaauuguagau

SEQ ID NO: 367914 - RNA, 19 nt, Homo sapiens
gaacauugugggccugguu

SEQ ID NO: 367915 - RNA, 19 nt, Homo sapiens
gcagguaagaucacagaug

SEQ ID NO: 367916 - RNA, 19 nt, Homo sapiens
gaacuggaugucugggaaa

SEQ ID NO: 367917 - RNA, 19 nt, Homo sapiens
gacuauggguggcuacugu

SEQ ID NO: 367918 - RNA, 19 nt, Homo sapiens
ugaccaaggccauggauga

SEQ ID NO: 367919 - RNA, 19 nt, Homo sapiens
caucagccuuugacagaau

SEQ ID NO: 367920 - RNA, 19 nt, Homo sapiens
gcugacaccuuccguucug

SEQ ID NO: 367921 - RNA, 19 nt, Homo sapiens
ccaagaagagcuuugaaca

SEQ ID NO: 367922 - RNA, 19 nt, Homo sapiens
caucaagaaucuggugguu

SEQ ID NO: 367923 - RNA, 19 nt, Homo sapiens
cuaauaaguccacaucuuc

SEQ ID NO: 367924 - RNA, 19 nt, Homo sapiens
gccaucagccuuugacaga

SEQ ID NO: 367925 - RNA, 19 nt, Homo sapiens
uuaagcgucugggauauga

SEQ ID NO: 367926 - RNA, 19 nt, Homo sapiens
ugagugaccuccagaaagc

SEQ ID NO: 367927 - RNA, 19 nt, Homo sapiens
aaagugcaaugagaacuau

SEQ ID NO: 367928 - RNA, 19 nt, Homo sapiens
gaucagugccaauauaacu

SEQ ID NO: 367929 - RNA, 19 nt, Homo sapiens
gacugagaguggaucauga

SEQ ID NO: 367930 - RNA, 19 nt, Homo sapiens
caucggaucauggaaauug

SEQ ID NO: 367931 - RNA, 19 nt, Homo sapiens
gaacaucuggugcaaaaga

SEQ ID NO: 367932 - RNA, 19 nt, Homo sapiens
uagugagccucucugguaa

SEQ ID NO: 367933 - RNA, 19 nt, Homo sapiens
ucaaaauccuagccaagua

SEQ ID NO: 367934 - RNA, 19 nt, Homo sapiens
ugggagagcguuucgauga

SEQ ID NO: 367935 - RNA, 19 nt, Homo sapiens
gggagagcguuucgaugau

SEQ ID NO: 367936 - RNA, 19 nt, Homo sapiens
agucuugguuccucuacua

SEQ ID NO: 367937 - RNA, 19 nt, Homo sapiens
ucagggccuugucaucauu

SEQ ID NO: 367938 - RNA, 19 nt, Homo sapiens
uggaugagaagaaauuuga

SEQ ID NO: 367939 - RNA, 19 nt, Homo sapiens
ccauggaugagaagaaauu

SEQ ID NO: 367940 - RNA, 19 nt, Homo sapiens
ccucagaagacaucaagaa

SEQ ID NO: 367941 - RNA, 19 nt, Homo sapiens
caauugacaagaauggaaa

SEQ ID NO: 367942 - RNA, 19 nt, Homo sapiens
gacauuuguguuagaagua

SEQ ID NO: 367943 - RNA, 19 nt, Homo sapiens
ucagcucacacccuaauaa

SEQ ID NO: 367944 - RNA, 19 nt, Homo sapiens
aaaaggggcuugguguuaa

SEQ ID NO: 367945 - RNA, 19 nt, Homo sapiens
ucagugccaauauaacuaa

SEQ ID NO: 367946 - RNA, 19 nt, Homo sapiens
gcguuucgaugaugcuuca

SEQ ID NO: 367947 - RNA, 19 nt, Homo sapiens
gagacaaggacccgugguu

SEQ ID NO: 367948 - RNA, 19 nt, Homo sapiens
guggagaucacaucaagga

SEQ ID NO: 367949 - RNA, 19 nt, Homo sapiens
gacacagcacucaauacua

SEQ ID NO: 367950 - RNA, 19 nt, Homo sapiens
gguucgaguugguaucuuc

SEQ ID NO: 367951 - RNA, 19 nt, Homo sapiens
cagaggacauuuguguuag

SEQ ID NO: 367952 - RNA, 19 nt, Homo sapiens
cagaugaggaggcuacgaa

SEQ ID NO: 367953 - RNA, 19 nt, Homo sapiens
gguagaauuuaacaugacu

SEQ ID NO: 367954 - RNA, 19 nt, Homo sapiens
gaaaucggcuggacagaug

SEQ ID NO: 367955 - RNA, 19 nt, Homo sapiens
gagaggagauuucaagaug

SEQ ID NO: 367956 - RNA, 19 nt, Homo sapiens
gcacaggauucccaaagaa

SEQ ID NO: 367957 - RNA, 19 nt, Homo sapiens
caacguagcugucaucaac

SEQ ID NO: 367958 - RNA, 19 nt, Homo sapiens
aaugagagcugcagugaaa

SEQ ID NO: 367959 - RNA, 19 nt, Homo sapiens
gaagagaucgccacacaga

SEQ ID NO: 367960 - RNA, 19 nt, Homo sapiens
gugcauaugagcagaauua

SEQ ID NO: 367961 - RNA, 19 nt, Homo sapiens
gaaaugagagcugcaguga

SEQ ID NO: 367962 - RNA, 19 nt, Homo sapiens
ggaaguacuuggaagagau

SEQ ID NO: 367963 - RNA, 19 nt, Homo sapiens
ucacgcagcugggcuauga

SEQ ID NO: 367964 - RNA, 19 nt, Homo sapiens
ggagaaccgugcccggaaa

SEQ ID NO: 367965 - RNA, 19 nt, Homo sapiens
gcacuuuaugcacguauua

SEQ ID NO: 367966 - RNA, 19 nt, Homo sapiens
gauagaaacuuuggaacca

SEQ ID NO: 367967 - RNA, 19 nt, Homo sapiens
aaagaccaauugcaacgua

SEQ ID NO: 367968 - RNA, 19 nt, Homo sapiens
gcagaugacucaggaugug

SEQ ID NO: 367969 - RNA, 19 nt, Homo sapiens
ggacggaggcucaaacauc

SEQ ID NO: 367970 - RNA, 19 nt, Homo sapiens
gcagaugugugucaaacuc

SEQ ID NO: 367971 - RNA, 19 nt, Homo sapiens
gcugaaggagcaauugaua

SEQ ID NO: 367972 - RNA, 19 nt, Homo sapiens
ggaacggccagaucgauaa

SEQ ID NO: 367973 - RNA, 19 nt, Homo sapiens
ucagggaucugcaguccaa

SEQ ID NO: 367974 - RNA, 19 nt, Homo sapiens
uggaggagcuggccaggaa

SEQ ID NO: 367975 - RNA, 19 nt, Homo sapiens
gaaguacgccuaccucaac

SEQ ID NO: 367976 - RNA, 19 nt, Homo sapiens
gaagaccaccauccagaga

SEQ ID NO: 367977 - RNA, 19 nt, Homo sapiens
gggagaagcacgaggaguu

SEQ ID NO: 367978 - RNA, 19 nt, Homo sapiens
gagcagaugugugucaaac

SEQ ID NO: 367979 - RNA, 19 nt, Homo sapiens
gagugugucucaugcuuuc

SEQ ID NO: 367980 - RNA, 19 nt, Homo sapiens
uggaagagaucgccacaca

SEQ ID NO: 367981 - RNA, 19 nt, Homo sapiens
gggaaguacuuggaagaga

SEQ ID NO: 367982 - RNA, 19 nt, Homo sapiens
ugaaaauccuggccaagua

SEQ ID NO: 367983 - RNA, 19 nt, Homo sapiens
gggaggagcagaugugugu

SEQ ID NO: 367984 - RNA, 19 nt, Homo sapiens
acaccgcccugaacacuau

SEQ ID NO: 367985 - RNA, 19 nt, Homo sapiens
ccagagcuauggaguggau

SEQ ID NO: 367986 - RNA, 19 nt, Homo sapiens
gcuacuguguccaacaaug

SEQ ID NO: 367987 - RNA, 19 nt, Homo sapiens
ccaagggccagaucaaaga

SEQ ID NO: 367988 - RNA, 19 nt, Homo sapiens
cuacaccaccgacuucauu

SEQ ID NO: 367989 - RNA, 19 nt, Homo sapiens
gggccaagguguacuucau

SEQ ID NO: 367990 - RNA, 19 nt, Homo sapiens
auaaacccaucaccucuga

SEQ ID NO: 367991 - RNA, 19 nt, Homo sapiens
gugcagcccuggagugucu

SEQ ID NO: 367992 - RNA, 19 nt, Homo sapiens
ggagugugucucaugcuuu

SEQ ID NO: 367993 - RNA, 19 nt, Homo sapiens
caggccagcuggaacaugu

SEQ ID NO: 367994 - RNA, 19 nt, Homo sapiens
ggacucaggccagcuggaa

SEQ ID NO: 367995 - RNA, 19 nt, Homo sapiens
ccaaguacaaggccagcua

SEQ ID NO: 367996 - RNA, 19 nt, Homo sapiens
uaccaccgaugauuccauu

SEQ ID NO: 367997 - RNA, 19 nt, Homo sapiens
cgggcaaccugaacaccua

SEQ ID NO: 367998 - RNA, 19 nt, Homo sapiens
gcagacaccgcccugaaca

SEQ ID NO: 367999 - RNA, 19 nt, Homo sapiens
ucaacgcgcugcugaucau

SEQ ID NO: 368000 - RNA, 19 nt, Homo sapiens
gagcacaggauucccaaag

SEQ ID NO: 368001 - RNA, 19 nt, Homo sapiens
gaacgugcugggucacaug

SEQ ID NO: 368002 - RNA, 19 nt, Homo sapiens
uuuaccagcuguauucaga

SEQ ID NO: 368003 - RNA, 19 nt, Homo sapiens
uggagcaccugacggagaa

SEQ ID NO: 368004 - RNA, 19 nt, Homo sapiens
gcauaugagcagaauuaau

SEQ ID NO: 368005 - RNA, 19 nt, Homo sapiens
guguuugacugcaggaaga

SEQ ID NO: 368006 - RNA, 19 nt, Homo sapiens
ucauuuaccagcuguauuc

SEQ ID NO: 368007 - RNA, 19 nt, Homo sapiens
aggaggccgugcagaagua

SEQ ID NO: 368008 - RNA, 19 nt, Homo sapiens
gcaauugauacccaaaaua

SEQ ID NO: 368009 - RNA, 19 nt, Homo sapiens
ccgcuacuguguccaacaa

SEQ ID NO: 368010 - RNA, 19 nt, Homo sapiens
gcuccauucuugggacaaa

SEQ ID NO: 368011 - RNA, 19 nt, Homo sapiens
ccaccgaugauuccauuug

SEQ ID NO: 368012 - RNA, 19 nt, Homo sapiens
aaacuacaccaccgacuuc

SEQ ID NO: 368013 - RNA, 19 nt, Homo sapiens
gccuugugcucagaaauga

SEQ ID NO: 368014 - RNA, 19 nt, Homo sapiens
gagaggccuugugcucaga

SEQ ID NO: 368015 - RNA, 19 nt, Homo sapiens
gcuuucagaugugcauaug

SEQ ID NO: 368016 - RNA, 19 nt, Homo sapiens
guacaaggccagcuaugac

SEQ ID NO: 368017 - RNA, 19 nt, Homo sapiens
caccgaugauuccauuugu

SEQ ID NO: 368018 - RNA, 19 nt, Homo sapiens
ccucuccauuugauagaaa

SEQ ID NO: 368019 - RNA, 19 nt, Homo sapiens
ccaccgacuucauuuacca

SEQ ID NO: 368020 - RNA, 19 nt, Homo sapiens
ggagaagcacgaggaguuc

SEQ ID NO: 368021 - RNA, 19 nt, Homo sapiens
gacgagaggagauuucaag

SEQ ID NO: 368022 - RNA, 19 nt, Homo sapiens
acaccaccgacuucauuua

SEQ ID NO: 368023 - RNA, 19 nt, Homo sapiens
agagaucgccacacagaug

SEQ ID NO: 368024 - RNA, 19 nt, Homo sapiens
gaaguacuuggaagagauc

SEQ ID NO: 368025 - RNA, 19 nt, Homo sapiens
ugacucaggaugugcagaa

SEQ ID NO: 368026 - RNA, 19 nt, Homo sapiens
auaaggaggccgugcagaa

SEQ ID NO: 368027 - RNA, 19 nt, Homo sapiens
caagguguacuucaucuac

SEQ ID NO: 368028 - RNA, 19 nt, Homo sapiens
gguguuccuuccagaaucu

SEQ ID NO: 368029 - RNA, 19 nt, Homo sapiens
ggucaugguucccgcuacu

SEQ ID NO: 368030 - RNA, 19 nt, Homo sapiens
gcagcugggcuaugacaca

SEQ ID NO: 368031 - RNA, 19 nt, Homo sapiens
gccaagguguacuucaucu

SEQ ID NO: 368032 - RNA, 19 nt, Homo sapiens
gaggagcagauguguguca

SEQ ID NO: 368033 - RNA, 19 nt, Homo sapiens
ccauuugugugcugggaau

SEQ ID NO: 368034 - RNA, 19 nt, Homo sapiens
gcacccucuccauuugaua

SEQ ID NO: 368035 - RNA, 19 nt, Homo sapiens
ccagcuguauucagaagag

SEQ ID NO: 368036 - RNA, 19 nt, Homo sapiens
gaacggccagaucgauaag

SEQ ID NO: 368037 - RNA, 19 nt, Homo sapiens
uuucagaugugcauaugag

SEQ ID NO: 368038 - RNA, 19 nt, Homo sapiens
aaauuuaccaccgaugauu

SEQ ID NO: 368039 - RNA, 19 nt, Homo sapiens
ggccuugugcucagaaaug

SEQ ID NO: 368040 - RNA, 19 nt, Homo sapiens
gaacaccuacaagcgacuu

SEQ ID NO: 368041 - RNA, 19 nt, Homo sapiens
cgagaggagauuucaagau

SEQ ID NO: 368042 - RNA, 19 nt, Homo sapiens
ggacgagaggagauuucaa

SEQ ID NO: 368043 - RNA, 19 nt, Homo sapiens
ucucaugcuuucagaugug

SEQ ID NO: 368044 - RNA, 19 nt, Homo sapiens
caaguacaaggccagcuau

SEQ ID NO: 368045 - RNA, 19 nt, Homo sapiens
caagggccagaucaaagaa

SEQ ID NO: 368046 - RNA, 19 nt, Homo sapiens
gccaagggccagaucaaag

SEQ ID NO: 368047 - RNA, 19 nt, Homo sapiens
ucccaaagaccaauugcaa

SEQ ID NO: 368048 - RNA, 19 nt, Homo sapiens
ggugaugggacgacacugu

SEQ ID NO: 368049 - RNA, 19 nt, Homo sapiens
gaggccuugugcucagaaa

SEQ ID NO: 368050 - RNA, 19 nt, Homo sapiens
aaacccaucaccucugaga

SEQ ID NO: 368051 - RNA, 19 nt, Homo sapiens
uggagugugucucaugcuu

SEQ ID NO: 368052 - RNA, 19 nt, Homo sapiens
gggcacccucuccauuuga

SEQ ID NO: 368053 - RNA, 19 nt, Homo sapiens
ggagcagaugugugucaaa

SEQ ID NO: 368054 - RNA, 19 nt, Homo sapiens
gaauuuagcauggaucuuc

SEQ ID NO: 368055 - RNA, 19 nt, Homo sapiens
gcauggaucuucguaccaa

SEQ ID NO: 368056 - RNA, 19 nt, Homo sapiens
ccauaucccucccgugugu

SEQ ID NO: 368057 - RNA, 19 nt, Homo sapiens
ccagaaauguucggugauc

SEQ ID NO: 368058 - RNA, 19 nt, Homo sapiens
gugguuugaucaacaagaa

SEQ ID NO: 368059 - RNA, 19 nt, Homo sapiens
gugaaugggcugacacuug

SEQ ID NO: 368060 - RNA, 19 nt, Homo sapiens
ugagguggguguccugguu

SEQ ID NO: 368061 - RNA, 19 nt, Homo sapiens
ggaaaacguucgucaacau

SEQ ID NO: 368062 - RNA, 19 nt, Homo sapiens
auacacacacaaaccauuu

SEQ ID NO: 368063 - RNA, 19 nt, Homo sapiens
cuacaucgacaaccucaug

SEQ ID NO: 368064 - RNA, 19 nt, Homo sapiens
ucacugucaccaagacuga

SEQ ID NO: 368065 - RNA, 19 nt, Homo sapiens
cauacacacacaaaccauu

SEQ ID NO: 368066 - RNA, 19 nt, Homo sapiens
gguuugaucaacaagaaau

SEQ ID NO: 368067 - RNA, 19 nt, Homo sapiens
ucaccaagacugacaagac

SEQ ID NO: 368068 - RNA, 19 nt, Homo sapiens
cacggugguuugaucaaca

SEQ ID NO: 368069 - RNA, 19 nt, Homo sapiens
gcugaugggcaaagaaggu

SEQ ID NO: 368070 - RNA, 19 nt, Homo sapiens
gaacgccuacaucgacaac

SEQ ID NO: 368071 - RNA, 19 nt, Homo sapiens
ggacuuggcugucuuguga

SEQ ID NO: 368072 - RNA, 19 nt, Homo sapiens
cauaugaacucgcuuuaua

SEQ ID NO: 368073 - RNA, 19 nt, Homo sapiens
gaggaggucugauguguaa

SEQ ID NO: 368074 - RNA, 19 nt, Homo sapiens
gagcagagacaaaccuuua

SEQ ID NO: 368075 - RNA, 19 nt, Homo sapiens
gcacauaggcauuugguuu

SEQ ID NO: 368076 - RNA, 19 nt, Homo sapiens
gcgaagaaaugcucaguga

SEQ ID NO: 368077 - RNA, 19 nt, Homo sapiens
gcauuuacuuggcucauuu

SEQ ID NO: 368078 - RNA, 19 nt, Homo sapiens
caacauaauugcagcacaa

SEQ ID NO: 368079 - RNA, 19 nt, Homo sapiens
gcaacugucuucaucaaca

SEQ ID NO: 368080 - RNA, 19 nt, Homo sapiens
gaagaaaugcucagugauc

SEQ ID NO: 368081 - RNA, 19 nt, Homo sapiens
ccagggacauuccaucauu

SEQ ID NO: 368082 - RNA, 19 nt, Homo sapiens
gaggcacacuuaacaagaa

SEQ ID NO: 368083 - RNA, 19 nt, Homo sapiens
caugauaccuugaaauugg

SEQ ID NO: 368084 - RNA, 19 nt, Homo sapiens
caacaacccuaauuauggu

SEQ ID NO: 368085 - RNA, 19 nt, Homo sapiens
guaaaaggcugccauuaug

SEQ ID NO: 368086 - RNA, 19 nt, Homo sapiens
cauuagguaucccaacaua

SEQ ID NO: 368087 - RNA, 19 nt, Homo sapiens
cacaccagcucuacucuuu

SEQ ID NO: 368088 - RNA, 19 nt, Homo sapiens
gcacaauaaugauuugcau

SEQ ID NO: 368089 - RNA, 19 nt, Homo sapiens
caagaaagcauaugaacuc

SEQ ID NO: 368090 - RNA, 19 nt, Homo sapiens
gauggugacugcacaaugg

SEQ ID NO: 368091 - RNA, 19 nt, Homo sapiens
gaaaagaccgggaagguuu

SEQ ID NO: 368092 - RNA, 19 nt, Homo sapiens
uuacuuggcucauuuaguc

SEQ ID NO: 368093 - RNA, 19 nt, Homo sapiens
gacaaaccuuuauucauag

SEQ ID NO: 368094 - RNA, 19 nt, Homo sapiens
caucauuccuucacucuuc

SEQ ID NO: 368095 - RNA, 19 nt, Homo sapiens
acccuuaucuggcaacaua

SEQ ID NO: 368096 - RNA, 19 nt, Homo sapiens
gacauuagguaucccaaca

SEQ ID NO: 368097 - RNA, 19 nt, Homo sapiens
gcagcacaauaaugauuug

SEQ ID NO: 368098 - RNA, 19 nt, Homo sapiens
gcugguagagcauugguua

SEQ ID NO: 368099 - RNA, 19 nt, Homo sapiens
gcagagacaaaccuuuauu

SEQ ID NO: 368100 - RNA, 19 nt, Homo sapiens
cacuuugucuuagcaauua

SEQ ID NO: 368101 - RNA, 19 nt, Homo sapiens
uggcagagcuacguggaua

SEQ ID NO: 368102 - RNA, 19 nt, Homo sapiens
auugagagcugcaguaguu

SEQ ID NO: 368103 - RNA, 19 nt, Homo sapiens
gaaaugcucagugaucaga

SEQ ID NO: 368104 - RNA, 19 nt, Homo sapiens
cagucuaacucaucugauu

SEQ ID NO: 368105 - RNA, 19 nt, Homo sapiens
gagcauuacgccaauagaa

SEQ ID NO: 368106 - RNA, 19 nt, Homo sapiens
uacaaucucugaucagugu

SEQ ID NO: 368107 - RNA, 19 nt, Homo sapiens
ucacaaugcuaccaaacug

SEQ ID NO: 368108 - RNA, 19 nt, Homo sapiens
uagggacauucuaguauuu

SEQ ID NO: 368109 - RNA, 19 nt, Homo sapiens
guuugggccuuguggauaa

SEQ ID NO: 368110 - RNA, 19 nt, Homo sapiens
gcacuugagcagagacaaa

SEQ ID NO: 368111 - RNA, 19 nt, Homo sapiens
caacugucuucaucaacaa

SEQ ID NO: 368112 - RNA, 19 nt, Homo sapiens
caauggacauccggacaaa

SEQ ID NO: 368113 - RNA, 19 nt, Homo sapiens
gggaagguuucuuuaccaa

SEQ ID NO: 368114 - RNA, 19 nt, Homo sapiens
uuagggacauucuaguauu

SEQ ID NO: 368115 - RNA, 19 nt, Homo sapiens
gcugucuugugaugaauuu

SEQ ID NO: 368116 - RNA, 19 nt, Homo sapiens
gggcaucacuuugucuuag

SEQ ID NO: 368117 - RNA, 19 nt, Homo sapiens
gagcauugguuauagucau

SEQ ID NO: 368118 - RNA, 19 nt, Homo sapiens
gcacuacuuuagggacauu

SEQ ID NO: 368119 - RNA, 19 nt, Homo sapiens
gacauuccaucauugcaau

SEQ ID NO: 368120 - RNA, 19 nt, Homo sapiens
ggacauuccaucauugcaa

SEQ ID NO: 368121 - RNA, 19 nt, Homo sapiens
gauacagucuaacucaucu

SEQ ID NO: 368122 - RNA, 19 nt, Homo sapiens
gcauuacgccaauagaaau

SEQ ID NO: 368123 - RNA, 19 nt, Homo sapiens
gcacuuugagcauuuacuu

SEQ ID NO: 368124 - RNA, 19 nt, Homo sapiens
uguagaugguagcuaauuu

SEQ ID NO: 368125 - RNA, 19 nt, Homo sapiens
caucaacaacccuaauuau

SEQ ID NO: 368126 - RNA, 19 nt, Homo sapiens
uagcaacugucuucaucaa

SEQ ID NO: 368127 - RNA, 19 nt, Homo sapiens
guagagcauugguuauagu

SEQ ID NO: 368128 - RNA, 19 nt, Homo sapiens
ugagauggauuuuaacuga

SEQ ID NO: 368129 - RNA, 19 nt, Homo sapiens
uaagcaaggugccgguugu

SEQ ID NO: 368130 - RNA, 19 nt, Homo sapiens
ggaggcacacuuaacaaga

SEQ ID NO: 368131 - RNA, 19 nt, Homo sapiens
gguagagcauugguuauag

SEQ ID NO: 368132 - RNA, 19 nt, Homo sapiens
gcuauugugagauggauuu

SEQ ID NO: 368133 - RNA, 19 nt, Homo sapiens
gagacaaaccuuuauucau

SEQ ID NO: 368134 - RNA, 19 nt, Homo sapiens
gagcugcaguaguuugcuu

SEQ ID NO: 368135 - RNA, 19 nt, Homo sapiens
cuacguggauaaccugaug

SEQ ID NO: 368136 - RNA, 19 nt, Homo sapiens
ucaacaacccuaauuaugg

SEQ ID NO: 368137 - RNA, 19 nt, Homo sapiens
gcgcaugguugggaggaaa

SEQ ID NO: 368138 - RNA, 19 nt, Homo sapiens
ucaucaacaacccuaauua

SEQ ID NO: 368139 - RNA, 19 nt, Homo sapiens
ccuagcaacugucuucauc

SEQ ID NO: 368140 - RNA, 19 nt, Homo sapiens
caccagcucuacucuuuag

SEQ ID NO: 368141 - RNA, 19 nt, Homo sapiens
gaccgggaagguuucuuua

SEQ ID NO: 368142 - RNA, 19 nt, Homo sapiens
gcucagugaucagagauag

SEQ ID NO: 368143 - RNA, 19 nt, Homo sapiens
gccaauagaaauagauaug

SEQ ID NO: 368144 - RNA, 19 nt, Homo sapiens
aagaaaugcucagugauca

SEQ ID NO: 368145 - RNA, 19 nt, Homo sapiens
uuccuucacucuucucuuu

SEQ ID NO: 368146 - RNA, 19 nt, Homo sapiens
uugguuugcuuccaucuuu

SEQ ID NO: 368147 - RNA, 19 nt, Homo sapiens
gcauuugguuugcuuccau

SEQ ID NO: 368148 - RNA, 19 nt, Homo sapiens
guuguacaaucucugauca

SEQ ID NO: 368149 - RNA, 19 nt, Homo sapiens
gcaaggugccgguuguaca

SEQ ID NO: 368150 - RNA, 19 nt, Homo sapiens
ggauacagucuaacucauc

SEQ ID NO: 368151 - RNA, 19 nt, Homo sapiens
guggauaauguacagauuu

SEQ ID NO: 368152 - RNA, 19 nt, Homo sapiens
aaugaacuguugcuauugu

SEQ ID NO: 368153 - RNA, 19 nt, Homo sapiens
gcaugauaccuugaaauug

SEQ ID NO: 368154 - RNA, 19 nt, Homo sapiens
aacuguagaugguagcuaa

SEQ ID NO: 368155 - RNA, 19 nt, Homo sapiens
gucuaacucaucugauuua

SEQ ID NO: 368156 - RNA, 19 nt, Homo sapiens
guauuguuguugcacuuga

SEQ ID NO: 368157 - RNA, 19 nt, Homo sapiens
ucagcacuuugagcauuua

SEQ ID NO: 368158 - RNA, 19 nt, Homo sapiens
caaggugccgguuguacaa

SEQ ID NO: 368159 - RNA, 19 nt, Homo sapiens
gugccauacuauuguuaaa

SEQ ID NO: 368160 - RNA, 19 nt, Homo sapiens
ucagagcauuacgccaaua

SEQ ID NO: 368161 - RNA, 19 nt, Homo sapiens
cagggacauuccaucauug

SEQ ID NO: 368162 - RNA, 19 nt, Homo sapiens
guaaccauacugauugaau

SEQ ID NO: 368163 - RNA, 19 nt, Homo sapiens
gcuauugagagcugcagua

SEQ ID NO: 368164 - RNA, 19 nt, Homo sapiens
guauguaaccaacccuuau

SEQ ID NO: 368165 - RNA, 19 nt, Homo sapiens
ccaucuaccuagcaacugu

SEQ ID NO: 368166 - RNA, 19 nt, Homo sapiens
gcauaugaacucgcuuuau

SEQ ID NO: 368167 - RNA, 19 nt, Homo sapiens
gcuacugcgacgccaaaua

SEQ ID NO: 368168 - RNA, 19 nt, Homo sapiens
gcucauuuagucuuccuuu

SEQ ID NO: 368169 - RNA, 19 nt, Homo sapiens
uauguuaaccacuguaugu

SEQ ID NO: 368170 - RNA, 19 nt, Homo sapiens
uauuaaggguuucuuucga

SEQ ID NO: 368171 - RNA, 19 nt, Homo sapiens
ggacuuggcugucuuguga

SEQ ID NO: 368172 - RNA, 19 nt, Homo sapiens
cauaugaacucgcuuuaua

SEQ ID NO: 368173 - RNA, 19 nt, Homo sapiens
gaggaggucugauguguaa

SEQ ID NO: 368174 - RNA, 19 nt, Homo sapiens
gagcagagacaaaccuuua

SEQ ID NO: 368175 - RNA, 19 nt, Homo sapiens
gcacauaggcauuugguuu

SEQ ID NO: 368176 - RNA, 19 nt, Homo sapiens
ggcagacuguuaaguauua

SEQ ID NO: 368177 - RNA, 19 nt, Homo sapiens
gcgaagaaaugcucaguga

SEQ ID NO: 368178 - RNA, 19 nt, Homo sapiens
gcauuuacuuggcucauuu

SEQ ID NO: 368179 - RNA, 19 nt, Homo sapiens
caacauaauugcagcacaa

SEQ ID NO: 368180 - RNA, 19 nt, Homo sapiens
ggaggcggauugaauaaga

SEQ ID NO: 368181 - RNA, 19 nt, Homo sapiens
gcaacugucuucaucaaca

SEQ ID NO: 368182 - RNA, 19 nt, Homo sapiens
gaagaaaugcucagugauc

SEQ ID NO: 368183 - RNA, 19 nt, Homo sapiens
gaaccugugucuccuuugu

SEQ ID NO: 368184 - RNA, 19 nt, Homo sapiens
ccagggacauuccaucauu

SEQ ID NO: 368185 - RNA, 19 nt, Homo sapiens
gaggcacacuuaacaagaa

SEQ ID NO: 368186 - RNA, 19 nt, Homo sapiens
caugauaccuugaaauugg

SEQ ID NO: 368187 - RNA, 19 nt, Homo sapiens
caacaacccuaauuauggu

SEQ ID NO: 368188 - RNA, 19 nt, Homo sapiens
guaaaaggcugccauuaug

SEQ ID NO: 368189 - RNA, 19 nt, Homo sapiens
cauuagguaucccaacaua

SEQ ID NO: 368190 - RNA, 19 nt, Homo sapiens
cacaccagcucuacucuuu

SEQ ID NO: 368191 - RNA, 19 nt, Homo sapiens
gcacaauaaugauuugcau

SEQ ID NO: 368192 - RNA, 19 nt, Homo sapiens
caagaaagcauaugaacuc

SEQ ID NO: 368193 - RNA, 19 nt, Homo sapiens
gauggugacugcacaaugg

SEQ ID NO: 368194 - RNA, 19 nt, Homo sapiens
gaaaagaccgggaagguuu

SEQ ID NO: 368195 - RNA, 19 nt, Homo sapiens
uuacuuggcucauuuaguc

SEQ ID NO: 368196 - RNA, 19 nt, Homo sapiens
gacaaaccuuuauucauag

SEQ ID NO: 368197 - RNA, 19 nt, Homo sapiens
caucauuccuucacucuuc

SEQ ID NO: 368198 - RNA, 19 nt, Homo sapiens
acccuuaucuggcaacaua

SEQ ID NO: 368199 - RNA, 19 nt, Homo sapiens
gacauuagguaucccaaca

SEQ ID NO: 368200 - RNA, 19 nt, Homo sapiens
gcagcacaauaaugauuug

SEQ ID NO: 368201 - RNA, 19 nt, Homo sapiens
uaagaaggcauacucaaug

SEQ ID NO: 368202 - RNA, 19 nt, Homo sapiens
gcagagacaaaccuuuauu

SEQ ID NO: 368203 - RNA, 19 nt, Homo sapiens
cacuuugucuuagcaauua

SEQ ID NO: 368204 - RNA, 19 nt, Homo sapiens
uggcagagcuacguggaua

SEQ ID NO: 368205 - RNA, 19 nt, Homo sapiens
auugagagcugcaguaguu

SEQ ID NO: 368206 - RNA, 19 nt, Homo sapiens
gaaaugcucagugaucaga

SEQ ID NO: 368207 - RNA, 19 nt, Homo sapiens
cagucuaacucaucugauu

SEQ ID NO: 368208 - RNA, 19 nt, Homo sapiens
gagcauuacgccaauagaa

SEQ ID NO: 368209 - RNA, 19 nt, Homo sapiens
uacaaucucugaucagugu

SEQ ID NO: 368210 - RNA, 19 nt, Homo sapiens
ucacaaugcuaccaaacug

SEQ ID NO: 368211 - RNA, 19 nt, Homo sapiens
uagggacauucuaguauuu

SEQ ID NO: 368212 - RNA, 19 nt, Homo sapiens
gguagagucuuggucuuug

SEQ ID NO: 368213 - RNA, 19 nt, Homo sapiens
guuugggccuuguggauaa

SEQ ID NO: 368214 - RNA, 19 nt, Homo sapiens
gcacuugagcagagacaaa

SEQ ID NO: 368215 - RNA, 19 nt, Homo sapiens
caacugucuucaucaacaa

SEQ ID NO: 368216 - RNA, 19 nt, Homo sapiens
caauggacauccggacaaa

SEQ ID NO: 368217 - RNA, 19 nt, Homo sapiens
gggaagguuucuuuaccaa

SEQ ID NO: 368218 - RNA, 19 nt, Homo sapiens
uuagggacauucuaguauu

SEQ ID NO: 368219 - RNA, 19 nt, Homo sapiens
gcugucuugugaugaauuu

SEQ ID NO: 368220 - RNA, 19 nt, Homo sapiens
gggcaucacuuugucuuag

SEQ ID NO: 368221 - RNA, 19 nt, Homo sapiens
cauggaggcggauugaaua

SEQ ID NO: 368222 - RNA, 19 nt, Homo sapiens
gcacuacuuuagggacauu

SEQ ID NO: 368223 - RNA, 19 nt, Homo sapiens
gacauuccaucauugcaau

SEQ ID NO: 368224 - RNA, 19 nt, Homo sapiens
ggacauuccaucauugcaa

SEQ ID NO: 368225 - RNA, 19 nt, Homo sapiens
cuaggcagacuguuaagua

SEQ ID NO: 368226 - RNA, 19 nt, Homo sapiens
gaauaagaaggcauacuca

SEQ ID NO: 368227 - RNA, 19 nt, Homo sapiens
gauacagucuaacucaucu

SEQ ID NO: 368228 - RNA, 19 nt, Homo sapiens
gcacuuugagcauuuacuu

SEQ ID NO: 368229 - RNA, 19 nt, Homo sapiens
uguagaugguagcuaauuu

SEQ ID NO: 368230 - RNA, 19 nt, Homo sapiens
caucaacaacccuaauuau

SEQ ID NO: 368231 - RNA, 19 nt, Homo sapiens
uagcaacugucuucaucaa

SEQ ID NO: 368232 - RNA, 19 nt, Homo sapiens
gcauuacgccaauagaaau

SEQ ID NO: 368233 - RNA, 19 nt, Homo sapiens
ugagauggauuuuaacuga

SEQ ID NO: 368234 - RNA, 19 nt, Homo sapiens
uaagcaaggugccgguugu

SEQ ID NO: 368235 - RNA, 19 nt, Homo sapiens
ggaggcacacuuaacaaga

SEQ ID NO: 368236 - RNA, 19 nt, Homo sapiens
gauugaauaagaaggcaua

SEQ ID NO: 368237 - RNA, 19 nt, Homo sapiens
gcuauugugagauggauuu

SEQ ID NO: 368238 - RNA, 19 nt, Homo sapiens
gagacaaaccuuuauucau

SEQ ID NO: 368239 - RNA, 19 nt, Homo sapiens
gagcugcaguaguuugcuu

SEQ ID NO: 368240 - RNA, 19 nt, Homo sapiens
ucaacaacccuaauuaugg

SEQ ID NO: 368241 - RNA, 19 nt, Homo sapiens
gaggcggauugaauaagaa

SEQ ID NO: 368242 - RNA, 19 nt, Homo sapiens
cuacguggauaaccugaug

SEQ ID NO: 368243 - RNA, 19 nt, Homo sapiens
gcgcaugguugggaggaaa

SEQ ID NO: 368244 - RNA, 19 nt, Homo sapiens
ucaucaacaacccuaauua

SEQ ID NO: 368245 - RNA, 19 nt, Homo sapiens
ccuagcaacugucuucauc

SEQ ID NO: 368246 - RNA, 19 nt, Homo sapiens
caccagcucuacucuuuag

SEQ ID NO: 368247 - RNA, 19 nt, Homo sapiens
uaggcagacuguuaaguau

SEQ ID NO: 368248 - RNA, 19 nt, Homo sapiens
gcucagugaucagagauag

SEQ ID NO: 368249 - RNA, 19 nt, Homo sapiens
gaccgggaagguuucuuua

SEQ ID NO: 368250 - RNA, 19 nt, Homo sapiens
gccaauagaaauagauaug

SEQ ID NO: 368251 - RNA, 19 nt, Homo sapiens
uuccuucacucuucucuuu

SEQ ID NO: 368252 - RNA, 19 nt, Homo sapiens
aagaaaugcucagugauca

SEQ ID NO: 368253 - RNA, 19 nt, Homo sapiens
uugguuugcuuccaucuuu

SEQ ID NO: 368254 - RNA, 19 nt, Homo sapiens
gcauuugguuugcuuccau

SEQ ID NO: 368255 - RNA, 19 nt, Homo sapiens
guuguacaaucucugauca

SEQ ID NO: 368256 - RNA, 19 nt, Homo sapiens
gcaaggugccgguuguaca

SEQ ID NO: 368257 - RNA, 19 nt, Homo sapiens
ggauacagucuaacucauc

SEQ ID NO: 368258 - RNA, 19 nt, Homo sapiens
guggauaauguacagauuu

SEQ ID NO: 368259 - RNA, 19 nt, Homo sapiens
aaugaacuguugcuauugu

SEQ ID NO: 368260 - RNA, 19 nt, Homo sapiens
gcaugauaccuugaaauug

SEQ ID NO: 368261 - RNA, 19 nt, Homo sapiens
aacuguagaugguagcuaa

SEQ ID NO: 368262 - RNA, 19 nt, Homo sapiens
aaacuuuccuagcuauaag

SEQ ID NO: 368263 - RNA, 19 nt, Homo sapiens
cauacucaauggcaaaaua

SEQ ID NO: 368264 - RNA, 19 nt, Homo sapiens
guagagucuuggucuuugu

SEQ ID NO: 368265 - RNA, 19 nt, Homo sapiens
gucuaacucaucugauuua

SEQ ID NO: 368266 - RNA, 19 nt, Homo sapiens
guauuguuguugcacuuga

SEQ ID NO: 368267 - RNA, 19 nt, Homo sapiens
ucagcacuuugagcauuua

SEQ ID NO: 368268 - RNA, 19 nt, Homo sapiens
caaggugccgguuguacaa

SEQ ID NO: 368269 - RNA, 19 nt, Homo sapiens
gugccauacuauuguuaaa

SEQ ID NO: 368270 - RNA, 19 nt, Homo sapiens
cagggacauuccaucauug

SEQ ID NO: 368271 - RNA, 19 nt, Homo sapiens
gaaaccagcuaaucaagua

SEQ ID NO: 368272 - RNA, 19 nt, Homo sapiens
gcaggaaucuugcuuuaaa

SEQ ID NO: 368273 - RNA, 19 nt, Homo sapiens
gcacugagauguguacuuu

SEQ ID NO: 368274 - RNA, 19 nt, Homo sapiens
ggaauagccugaacucaaa

SEQ ID NO: 368275 - RNA, 19 nt, Homo sapiens
uaagacaucuccuggaaua

SEQ ID NO: 368276 - RNA, 19 nt, Homo sapiens
gggaguagguugcaucuuu

SEQ ID NO: 368277 - RNA, 19 nt, Homo sapiens
gaaaggagauuugacacuu

SEQ ID NO: 368278 - RNA, 19 nt, Homo sapiens
ggagaagucuguuuuguua

SEQ ID NO: 368279 - RNA, 19 nt, Homo sapiens
ccacauagcaugacuguuu

SEQ ID NO: 368280 - RNA, 19 nt, Homo sapiens
ggaauaaaguauagcagaa

SEQ ID NO: 368281 - RNA, 19 nt, Homo sapiens
agaaagcacuggaauguuu

SEQ ID NO: 368282 - RNA, 19 nt, Homo sapiens
ggaaggaucuuaugcuaca

SEQ ID NO: 368283 - RNA, 19 nt, Homo sapiens
gcacaucacugcacacaca

SEQ ID NO: 368284 - RNA, 19 nt, Homo sapiens
gcaaggaauuauuuacuga

SEQ ID NO: 368285 - RNA, 19 nt, Homo sapiens
ggauuaaguugucaucauu

SEQ ID NO: 368286 - RNA, 19 nt, Homo sapiens
ggaaauaccuuuguguaca

SEQ ID NO: 368287 - RNA, 19 nt, Homo sapiens
uaaagagggugcauucuga

SEQ ID NO: 368288 - RNA, 19 nt, Homo sapiens
caagagcaacugaugauua

SEQ ID NO: 368289 - RNA, 19 nt, Homo sapiens
gaagaggcaugaccuuugu

SEQ ID NO: 368290 - RNA, 19 nt, Homo sapiens
uggaauaacuguucaaaug

SEQ ID NO: 368291 - RNA, 19 nt, Homo sapiens
gaacaaagacagggauaaa

SEQ ID NO: 368292 - RNA, 19 nt, Homo sapiens
gccaacaagucccaaauuu

SEQ ID NO: 368293 - RNA, 19 nt, Homo sapiens
ggguaaagcuuuucuauaa

SEQ ID NO: 368294 - RNA, 19 nt, Homo sapiens
gaagaggccaauaauauga

SEQ ID NO: 368295 - RNA, 19 nt, Homo sapiens
guacagaccuccagauguc

SEQ ID NO: 368296 - RNA, 19 nt, Homo sapiens
ucaaacagaugguaagaau

SEQ ID NO: 368297 - RNA, 19 nt, Homo sapiens
gaucuuaugcuacaguaua

SEQ ID NO: 368298 - RNA, 19 nt, Homo sapiens
ucggagaagugaaauauaa

SEQ ID NO: 368299 - RNA, 19 nt, Homo sapiens
gggauaaauugcuuacauu

SEQ ID NO: 368300 - RNA, 19 nt, Homo sapiens
gacagcauaugcacgguua

SEQ ID NO: 368301 - RNA, 19 nt, Homo sapiens
gaggaaacuguauauguua

SEQ ID NO: 368302 - RNA, 19 nt, Homo sapiens
aaaggagauuugacacuua

SEQ ID NO: 368303 - RNA, 19 nt, Homo sapiens
gauguagcauucaugguaa

SEQ ID NO: 368304 - RNA, 19 nt, Homo sapiens
gaaaugauccaaggaguug

SEQ ID NO: 368305 - RNA, 19 nt, Homo sapiens
ggaauggacucagugauca

SEQ ID NO: 368306 - RNA, 19 nt, Homo sapiens
gacaguguguugugaauug

SEQ ID NO: 368307 - RNA, 19 nt, Homo sapiens
ugaaagauguaaugguuug

SEQ ID NO: 368308 - RNA, 19 nt, Homo sapiens
aaaccuacauucucuaguu

SEQ ID NO: 368309 - RNA, 19 nt, Homo sapiens
aagagcaacugaugauuaa

SEQ ID NO: 368310 - RNA, 19 nt, Homo sapiens
gaauugccuugacagcaua

SEQ ID NO: 368311 - RNA, 19 nt, Homo sapiens
gcaaucuucuauucucauu

SEQ ID NO: 368312 - RNA, 19 nt, Homo sapiens
ggaucaagacuaggaauua

SEQ ID NO: 368313 - RNA, 19 nt, Homo sapiens
agaacuacgugaagauuaa

SEQ ID NO: 368314 - RNA, 19 nt, Homo sapiens
ccaauaauaugaagggaau

SEQ ID NO: 368315 - RNA, 19 nt, Homo sapiens
agaggaaacuguauauguu

SEQ ID NO: 368316 - RNA, 19 nt, Homo sapiens
gcaaaucaauaucuuucug

SEQ ID NO: 368317 - RNA, 19 nt, Homo sapiens
gaacucaaacagaugguaa

SEQ ID NO: 368318 - RNA, 19 nt, Homo sapiens
uguuagggcuuacaaagua

SEQ ID NO: 368319 - RNA, 19 nt, Homo sapiens
aguuaaagcuggcagauuu

SEQ ID NO: 368320 - RNA, 19 nt, Homo sapiens
cagauaaugugaaguuguu

SEQ ID NO: 368321 - RNA, 19 nt, Homo sapiens
cagggaagcuucucuuuua

SEQ ID NO: 368322 - RNA, 19 nt, Homo sapiens
gaaaaucaauucagacugu

SEQ ID NO: 368323 - RNA, 19 nt, Homo sapiens
gaauaacuguucaaaugca

SEQ ID NO: 368324 - RNA, 19 nt, Homo sapiens
gcauuuggauaccuuguga

SEQ ID NO: 368325 - RNA, 19 nt, Homo sapiens
ggaguagguugcaucuuug

SEQ ID NO: 368326 - RNA, 19 nt, Homo sapiens
gcauauuuguuaccaguug

SEQ ID NO: 368327 - RNA, 19 nt, Homo sapiens
ugagauguguacuuucuaa

SEQ ID NO: 368328 - RNA, 19 nt, Homo sapiens
gcuaagcaaggaauuauuu

SEQ ID NO: 368329 - RNA, 19 nt, Homo sapiens
caagguaaaugggaaguug

SEQ ID NO: 368330 - RNA, 19 nt, Homo sapiens
uacaggaaauccaaaguuu

SEQ ID NO: 368331 - RNA, 19 nt, Homo sapiens
ggaauuauuuacugauugg

SEQ ID NO: 368332 - RNA, 19 nt, Homo sapiens
guucacacuucuucaguaa

SEQ ID NO: 368333 - RNA, 19 nt, Homo sapiens
gaaaugugucauacuguuu

SEQ ID NO: 368334 - RNA, 19 nt, Homo sapiens
aaagcugacucauaugaaa

SEQ ID NO: 368335 - RNA, 19 nt, Homo sapiens
gagaauggaauaauacaug

SEQ ID NO: 368336 - RNA, 19 nt, Homo sapiens
ugaaaugugucauacuguu

SEQ ID NO: 368337 - RNA, 19 nt, Homo sapiens
gaaauaccuuuguguacag

SEQ ID NO: 368338 - RNA, 19 nt, Homo sapiens
caaagagucaccuaaaguu

SEQ ID NO: 368339 - RNA, 19 nt, Homo sapiens
gcaaagagucaccuaaagu

SEQ ID NO: 368340 - RNA, 19 nt, Homo sapiens
gcauaugcacgguuacuuu

SEQ ID NO: 368341 - RNA, 19 nt, Homo sapiens
gaucaagacuaggaauuag

SEQ ID NO: 368342 - RNA, 19 nt, Homo sapiens
agacaucauuggguucuua

SEQ ID NO: 368343 - RNA, 19 nt, Homo sapiens
ugaauagguuggaauugaa

SEQ ID NO: 368344 - RNA, 19 nt, Homo sapiens
ucacacuucuucaguaaug

SEQ ID NO: 368345 - RNA, 19 nt, Homo sapiens
gaauaguacaaacaccuua

SEQ ID NO: 368346 - RNA, 19 nt, Homo sapiens
ggaagucuuuagagguauu

SEQ ID NO: 368347 - RNA, 19 nt, Homo sapiens
ggagccagguugacaagga

SEQ ID NO: 368348 - RNA, 19 nt, Homo sapiens
ucauuggguucuuacuuua

SEQ ID NO: 368349 - RNA, 19 nt, Homo sapiens
cagcgucucuguaaagguu

SEQ ID NO: 368350 - RNA, 19 nt, Homo sapiens
ggacaccuuucacagcuau

SEQ ID NO: 368351 - RNA, 19 nt, Homo sapiens
aagagugacuagaaaguuu

SEQ ID NO: 368352 - RNA, 19 nt, Homo sapiens
caaagacagggauaaauug

SEQ ID NO: 368353 - RNA, 19 nt, Homo sapiens
ggccuggaguucauucuuu

SEQ ID NO: 368354 - RNA, 19 nt, Homo sapiens
ggacuuuccugugauuugu

SEQ ID NO: 368355 - RNA, 19 nt, Homo sapiens
acaaagacagggauaaauu

SEQ ID NO: 368356 - RNA, 19 nt, Homo sapiens
gcaaaccccuguucucuga

SEQ ID NO: 368357 - RNA, 19 nt, Homo sapiens
gcacgcauuuggauaccuu

SEQ ID NO: 368358 - RNA, 19 nt, Homo sapiens
ucaccgacaugucuucuau

SEQ ID NO: 368359 - RNA, 19 nt, Homo sapiens
ccuccaagcuccuacaaug

SEQ ID NO: 368360 - RNA, 19 nt, Homo sapiens
gccuggaguucauucuuua

SEQ ID NO: 368361 - RNA, 19 nt, Homo sapiens
gaaagacauucaggaucaa

SEQ ID NO: 368362 - RNA, 19 nt, Homo sapiens
aaagugaggccucuuggua

SEQ ID NO: 368363 - RNA, 19 nt, Homo sapiens
aaacagaugguaagaauag

SEQ ID NO: 368364 - RNA, 19 nt, Homo sapiens
ggagaaaacuuuacaugca

SEQ ID NO: 368365 - RNA, 19 nt, Homo sapiens
aguaaugucugaacuugaa

SEQ ID NO: 368366 - RNA, 19 nt, Homo sapiens
gcacacaggauuaaguugu

SEQ ID NO: 368367 - RNA, 19 nt, Homo sapiens
caacuugaacgaauauuuc

SEQ ID NO: 368368 - RNA, 19 nt, Homo sapiens
aaagagucaccuaaaguua

SEQ ID NO: 368369 - RNA, 19 nt, Homo sapiens
ccuccaggcuugcaaagaa

SEQ ID NO: 368370 - RNA, 19 nt, Homo sapiens
ggagauuugacacuuaauu

SEQ ID NO: 368371 - RNA, 19 nt, Homo sapiens
gaacucagauggcgacaug

SEQ ID NO: 368372 - RNA, 19 nt, Homo sapiens
ggauuucaccgucgucuuu

SEQ ID NO: 368373 - RNA, 19 nt, Homo sapiens
gauccugggugaugucuuc

SEQ ID NO: 368374 - RNA, 19 nt, Homo sapiens
gacaucgucuucaccauca

SEQ ID NO: 368375 - RNA, 19 nt, Homo sapiens
gcauugacucuucuuacua

SEQ ID NO: 368376 - RNA, 19 nt, Homo sapiens
agaacuaccuggauaugga

SEQ ID NO: 368377 - RNA, 19 nt, Homo sapiens
cuggagaacuaccuggaua

SEQ ID NO: 368378 - RNA, 19 nt, Homo sapiens
gaggguuacuggcagauca

SEQ ID NO: 368379 - RNA, 19 nt, Homo sapiens
ccacacccgucuuugacaa

SEQ ID NO: 368380 - RNA, 19 nt, Homo sapiens
ggugaucuuugguggcauu

SEQ ID NO: 368381 - RNA, 19 nt, Homo sapiens
guauuaugcucccuucgau

SEQ ID NO: 368382 - RNA, 19 nt, Homo sapiens
ugaagaagcacaaccucaa

SEQ ID NO: 368383 - RNA, 19 nt, Homo sapiens
cuaauucuccugacuguuc

SEQ ID NO: 368384 - RNA, 19 nt, Homo sapiens
guggacagcaucaccauga

SEQ ID NO: 368385 - RNA, 19 nt, Homo sapiens
uaugcccacuuuagaugua

SEQ ID NO: 368386 - RNA, 19 nt, Homo sapiens
ggcauugacucuucuuacu

SEQ ID NO: 368387 - RNA, 19 nt, Homo sapiens
ggagaacuaccuggauaug

SEQ ID NO: 368388 - RNA, 19 nt, Homo sapiens
ugacaccaaucagaucuuc

SEQ ID NO: 368389 - RNA, 19 nt, Homo sapiens
cauugacucuucuuacuac

SEQ ID NO: 368390 - RNA, 19 nt, Homo sapiens
gaucuuugguggcauugac

SEQ ID NO: 368391 - RNA, 19 nt, Homo sapiens
gcagcguggugaucuuugg

SEQ ID NO: 368392 - RNA, 19 nt, Homo sapiens
aggcaucucugacaccaau

SEQ ID NO: 368393 - RNA, 19 nt, Homo sapiens
gggccacacccgucuuuga

SEQ ID NO: 368394 - RNA, 19 nt, Homo sapiens
gaagaagcacaaccucaac

SEQ ID NO: 368395 - RNA, 19 nt, Homo sapiens
caggaccucuucucugucu

SEQ ID NO: 368396 - RNA, 19 nt, Homo sapiens
cucaggaccucuucucugu

SEQ ID NO: 368397 - RNA, 19 nt, Homo sapiens
gcuccuuccuguauuaugc

SEQ ID NO: 368398 - RNA, 19 nt, Homo sapiens
caacccagccagaaaguac

SEQ ID NO: 368399 - RNA, 19 nt, Homo sapiens
cugagugcaucauguacaa

SEQ ID NO: 368400 - RNA, 19 nt, Homo sapiens
cuggcuccuuccuguauua

SEQ ID NO: 368401 - RNA, 19 nt, Homo sapiens
gaaggucuuggcccuguuc

SEQ ID NO: 368402 - RNA, 19 nt, Homo sapiens
cagcgccgaugacaagagu

SEQ ID NO: 368403 - RNA, 19 nt, Homo sapiens
ugaacugggugccuguuac

SEQ ID NO: 368404 - RNA, 19 nt, Homo sapiens
ccucagcgccgaugacaag

SEQ ID NO: 368405 - RNA, 19 nt, Homo sapiens
ucucugagugcaucaugua

SEQ ID NO: 368406 - RNA, 19 nt, Homo sapiens
ucagaaagaaguccuugag

SEQ ID NO: 368407 - RNA, 19 nt, Homo sapiens
ugacucuucuuacuacacu

SEQ ID NO: 368408 - RNA, 19 nt, Homo sapiens
cuguuaccgucgaggguua

SEQ ID NO: 368409 - RNA, 19 nt, Homo sapiens
gcuucaacccugaggauuc

SEQ ID NO: 368410 - RNA, 19 nt, Homo sapiens
gacccgggaagaaccauga

SEQ ID NO: 368411 - RNA, 19 nt, Homo sapiens
gagaacuaccuggauaugg

SEQ ID NO: 368412 - RNA, 19 nt, Homo sapiens
ccuaugcccacuuuagaug

SEQ ID NO: 368413 - RNA, 19 nt, Homo sapiens
guccuaugcccacuuuaga

SEQ ID NO: 368414 - RNA, 19 nt, Homo sapiens
caucggagccagcgagaac

SEQ ID NO: 368415 - RNA, 19 nt, Homo sapiens
ggacagcaucaccaugaac

SEQ ID NO: 368416 - RNA, 19 nt, Homo sapiens
uggacagcaucaccaugaa

SEQ ID NO: 368417 - RNA, 19 nt, Homo sapiens
uggaguacuucggcacuau

SEQ ID NO: 368418 - RNA, 19 nt, Homo sapiens
ccuguucccuguccuacca

SEQ ID NO: 368419 - RNA, 19 nt, Homo sapiens
guaucuaauucuccugacu

SEQ ID NO: 368420 - RNA, 19 nt, Homo sapiens
gcugccaggccauuguuga

SEQ ID NO: 368421 - RNA, 19 nt, Homo sapiens
ggaccucuucucugucuac

SEQ ID NO: 368422 - RNA, 19 nt, Homo sapiens
gcaucucugacaccaauca

SEQ ID NO: 368423 - RNA, 19 nt, Homo sapiens
cucccacccugguagauga

SEQ ID NO: 368424 - RNA, 19 nt, Homo sapiens
gagcauaacuguacuaaau

SEQ ID NO: 368425 - RNA, 19 nt, Homo sapiens
guagacaucuugaguugua

SEQ ID NO: 368426 - RNA, 19 nt, Homo sapiens
agaaauagcauuccucaua

SEQ ID NO: 368427 - RNA, 19 nt, Homo sapiens
gaaauagcauuccucauac

SEQ ID NO: 368428 - RNA, 19 nt, Homo sapiens
ggacuuggcgccucaauga

SEQ ID NO: 368429 - RNA, 19 nt, Homo sapiens
gcuaagccaugaccaguga

SEQ ID NO: 368430 - RNA, 19 nt, Homo sapiens
gcacagguucucagucuaa

SEQ ID NO: 368431 - RNA, 19 nt, Homo sapiens
ggucuaaccggucucaaua

SEQ ID NO: 368432 - RNA, 19 nt, Homo sapiens
gagcacagguucucagucu

SEQ ID NO: 368433 - RNA, 19 nt, Homo sapiens
gaccacaucuguagacauc

SEQ ID NO: 368434 - RNA, 19 nt, Homo sapiens
cgagugcuuuguuuacuaa

SEQ ID NO: 368435 - RNA, 19 nt, Homo sapiens
caacagaguuuaaaaguag

SEQ ID NO: 368436 - RNA, 19 nt, Homo sapiens
gcucugcccuucuggaaug

SEQ ID NO: 368437 - RNA, 19 nt, Homo sapiens
gcgagugcuuuguuuacua

SEQ ID NO: 368438 - RNA, 19 nt, Homo sapiens
gcuacgagaugcuggcuau

SEQ ID NO: 368439 - RNA, 19 nt, Homo sapiens
cauacaaucuagucagaau

SEQ ID NO: 368440 - RNA, 19 nt, Homo sapiens
cagcuacccuccugugaga

SEQ ID NO: 368441 - RNA, 19 nt, Homo sapiens
gcuaugaguuugacaucug

SEQ ID NO: 368442 - RNA, 19 nt, Homo sapiens
cauguggucaucagaaaua

SEQ ID NO: 368443 - RNA, 19 nt, Homo sapiens
gaucaauccugaauuucgu

SEQ ID NO: 368444 - RNA, 19 nt, Homo sapiens
ucuaaccggucucaauaaa

SEQ ID NO: 368445 - RNA, 19 nt, Homo sapiens
ccacaucuguagacaucuu

SEQ ID NO: 368446 - RNA, 19 nt, Homo sapiens
ucuaugaauuggacaagaa

SEQ ID NO: 368447 - RNA, 19 nt, Homo sapiens
gaagagacggugcgcaaag

SEQ ID NO: 368448 - RNA, 19 nt, Homo sapiens
ucaaugagcggcacuaugg

SEQ ID NO: 368449 - RNA, 19 nt, Homo sapiens
guguaucuuucacugauuu

SEQ ID NO: 368450 - RNA, 19 nt, Homo sapiens
augcagaccucacagaaga

SEQ ID NO: 368451 - RNA, 19 nt, Homo sapiens
uaaccggucucaauaaagc

SEQ ID NO: 368452 - RNA, 19 nt, Homo sapiens
cacauguggucaucagaaa

SEQ ID NO: 368453 - RNA, 19 nt, Homo sapiens
gugagagucugaaggauac

SEQ ID NO: 368454 - RNA, 19 nt, Homo sapiens
uagcauuccucauaccaau

SEQ ID NO: 368455 - RNA, 19 nt, Homo sapiens
ccaacagaguuuaaaagua

SEQ ID NO: 368456 - RNA, 19 nt, Homo sapiens
ggaaacguguacugauugc

SEQ ID NO: 368457 - RNA, 19 nt, Homo sapiens
caguaaggaucgcagguau

SEQ ID NO: 368458 - RNA, 19 nt, Homo sapiens
gcauuccucauaccaauau

SEQ ID NO: 368459 - RNA, 19 nt, Homo sapiens
ggugaugugacaacuguuu

SEQ ID NO: 368460 - RNA, 19 nt, Homo sapiens
guggugaugugacaacugu

SEQ ID NO: 368461 - RNA, 19 nt, Homo sapiens
ggaccaguggcucccauuu

SEQ ID NO: 368462 - RNA, 19 nt, Homo sapiens
gggaaacguguacugauug

SEQ ID NO: 368463 - RNA, 19 nt, Homo sapiens
auaaaggagugaugugcaa

SEQ ID NO: 368464 - RNA, 19 nt, Homo sapiens
gggcaaggccaagaaguga

SEQ ID NO: 368465 - RNA, 19 nt, Homo sapiens
uggagggucucucugaaga

SEQ ID NO: 368466 - RNA, 19 nt, Homo sapiens
ggggaaacguguacugauu

SEQ ID NO: 368467 - RNA, 19 nt, Homo sapiens
gaugcuggcuaugaguuug

SEQ ID NO: 368468 - RNA, 19 nt, Homo sapiens
gcauaacuguacuaaaucc

SEQ ID NO: 368469 - RNA, 19 nt, Homo sapiens
uaaccugcguggugaugug

SEQ ID NO: 368470 - RNA, 19 nt, Homo sapiens
gugcuuuguuuacuaagga

SEQ ID NO: 368471 - RNA, 19 nt, Homo sapiens
cuguagacaucuugaguug

SEQ ID NO: 368472 - RNA, 19 nt, Homo sapiens
gcgcauggaaccuggagaa

SEQ ID NO: 368473 - RNA, 19 nt, Homo sapiens
ugugagagucugaaggaua

SEQ ID NO: 368474 - RNA, 19 nt, Homo sapiens
gcucuagguugggaucaau

SEQ ID NO: 368475 - RNA, 19 nt, Homo sapiens
uagaugccauugaucagau

SEQ ID NO: 368476 - RNA, 19 nt, Homo sapiens
gagcucugcccuucuggaa

SEQ ID NO: 368477 - RNA, 19 nt, Homo sapiens
gagaugcuggcuaugaguu

SEQ ID NO: 368478 - RNA, 19 nt, Homo sapiens
acacugaccacaucuguag

SEQ ID NO: 368479 - RNA, 19 nt, Homo sapiens
guaugcagaccucacagaa

SEQ ID NO: 368480 - RNA, 19 nt, Homo sapiens
ccuacaaacuggugcugau

SEQ ID NO: 368481 - RNA, 19 nt, Homo sapiens
aauccugaauuucguuaug

SEQ ID NO: 368482 - RNA, 19 nt, Homo sapiens
gaggaucuggcucuagguu

SEQ ID NO: 368483 - RNA, 19 nt, Homo sapiens
uggaaaagcuccccuuauc

SEQ ID NO: 368484 - RNA, 19 nt, Homo sapiens
uaucaagcccaugcaguuu

SEQ ID NO: 368485 - RNA, 19 nt, Homo sapiens
ccucacagaagaucagcua

SEQ ID NO: 368486 - RNA, 19 nt, Homo sapiens
ccacucccuucauacaauc

SEQ ID NO: 368487 - RNA, 19 nt, Homo sapiens
gcaaggccaagaagugaag

SEQ ID NO: 368488 - RNA, 19 nt, Homo sapiens
ggucaucagaaauagcauu

SEQ ID NO: 368489 - RNA, 19 nt, Homo sapiens
cugaagaggcuaucaugga

SEQ ID NO: 368490 - RNA, 19 nt, Homo sapiens
ucaguaaggaucgcaggua

SEQ ID NO: 368491 - RNA, 19 nt, Homo sapiens
cuuccugccuuguuucaug

SEQ ID NO: 368492 - RNA, 19 nt, Homo sapiens
ucaauccugaauuucguua

SEQ ID NO: 368493 - RNA, 19 nt, Homo sapiens
cuaucaagcccaugcaguu

SEQ ID NO: 368494 - RNA, 19 nt, Homo sapiens
ucauaccaauauaggauca

SEQ ID NO: 368495 - RNA, 19 nt, Homo sapiens
caucagaaauagcauuccu

SEQ ID NO: 368496 - RNA, 19 nt, Homo sapiens
caguggaagacgaauguaa

SEQ ID NO: 368497 - RNA, 19 nt, Homo sapiens
gaaaagcuccccuuaucca

SEQ ID NO: 368498 - RNA, 19 nt, Homo sapiens
guaaggaucgcagguaugc

SEQ ID NO: 368499 - RNA, 19 nt, Homo sapiens
gcccgaccauccuuucuac

SEQ ID NO: 368500 - RNA, 19 nt, Homo sapiens
ucaccucagugcagaagag

SEQ ID NO: 368501 - RNA, 19 nt, Homo sapiens
ugcacccacucccuucaua

SEQ ID NO: 368502 - RNA, 19 nt, Homo sapiens
ucaagcccaugcaguuucu

SEQ ID NO: 368503 - RNA, 19 nt, Homo sapiens
ccucauaccaauauaggau

SEQ ID NO: 368504 - RNA, 19 nt, Homo sapiens
gguucucagucuaagcuau

SEQ ID NO: 368505 - RNA, 19 nt, Homo sapiens
cccacucccuucauacaau

SEQ ID NO: 368506 - RNA, 19 nt, Homo sapiens
acagcaacaucaguaagga

SEQ ID NO: 368507 - RNA, 19 nt, Homo sapiens
cuuccugguguguguauua

SEQ ID NO: 368508 - RNA, 19 nt, Homo sapiens
gcgcaaagccauggaagcu

SEQ ID NO: 368509 - RNA, 19 nt, Homo sapiens
ucuggagggucucucugaa

SEQ ID NO: 368510 - RNA, 19 nt, Homo sapiens
gguaugcagaccucacaga

SEQ ID NO: 368511 - RNA, 19 nt, Homo sapiens
uacaaucuagucagaauag

SEQ ID NO: 368512 - RNA, 19 nt, Homo sapiens
ucacacugaccacaucugu

SEQ ID NO: 368513 - RNA, 19 nt, Homo sapiens
gagagucugaaggauacua

SEQ ID NO: 368514 - RNA, 19 nt, Homo sapiens
gaguuugacaucugcuuca

SEQ ID NO: 368515 - RNA, 19 nt, Homo sapiens
uacgagaugcuggcuauga

SEQ ID NO: 368516 - RNA, 19 nt, Homo sapiens
uucauacaaucuagucaga

SEQ ID NO: 368517 - RNA, 19 nt, Homo sapiens
cauccuuucuacagcaaca

SEQ ID NO: 368518 - RNA, 19 nt, Homo sapiens
gggucuaaccggucucaau

SEQ ID NO: 368519 - RNA, 19 nt, Homo sapiens
ccugugagagucugaagga

SEQ ID NO: 368520 - RNA, 19 nt, Homo sapiens
gcagaccucacagaagauc

SEQ ID NO: 368521 - RNA, 19 nt, Homo sapiens
uguaugagcugaacaagga

SEQ ID NO: 368522 - RNA, 19 nt, Homo sapiens
gagccaaggccaucaagga

SEQ ID NO: 368523 - RNA, 19 nt, Homo sapiens
ggaaccaggagaaccguuu

SEQ ID NO: 368524 - RNA, 19 nt, Homo sapiens
cgacauggaaccaggagaa

SEQ ID NO: 368525 - RNA, 19 nt, Homo sapiens
gggaggagcagguaagauc

SEQ ID NO: 368526 - RNA, 19 nt, Homo sapiens
ggugggcuuugggcaauaa

SEQ ID NO: 368527 - RNA, 19 nt, Homo sapiens
gagcagguaagaucuugga

SEQ ID NO: 368528 - RNA, 19 nt, Homo sapiens
ggcaagcgagugcucauug

SEQ ID NO: 368529 - RNA, 19 nt, Homo sapiens
ucaaggaugccaagaugga

SEQ ID NO: 368530 - RNA, 19 nt, Homo sapiens
augccaagauggaguuuga

SEQ ID NO: 368531 - RNA, 19 nt, Homo sapiens
gaaccaggagaaccguuuc

SEQ ID NO: 368532 - RNA, 19 nt, Homo sapiens
gaugcagagcugagugaaa

SEQ ID NO: 368533 - RNA, 19 nt, Homo sapiens
uacuacaacuccauuagca

SEQ ID NO: 368534 - RNA, 19 nt, Homo sapiens
gaggagcagguaagaucuu

SEQ ID NO: 368535 - RNA, 19 nt, Homo sapiens
gggugggcuuugggcaaua

SEQ ID NO: 368536 - RNA, 19 nt, Homo sapiens
acaacuccauuagcaagga

SEQ ID NO: 368537 - RNA, 19 nt, Homo sapiens
gcaccuggaagggauguca

SEQ ID NO: 368538 - RNA, 19 nt, Homo sapiens
gagccucaaggacaccauu

SEQ ID NO: 368539 - RNA, 19 nt, Homo sapiens
ggaggagcagguaagaucu

SEQ ID NO: 368540 - RNA, 19 nt, Homo sapiens
ccagggcaaggccaaguga

SEQ ID NO: 368541 - RNA, 19 nt, Homo sapiens
gaacucuacuggcagauug

SEQ ID NO: 368542 - RNA, 19 nt, Homo sapiens
ggaugaguauggacaguuu

SEQ ID NO: 368543 - RNA, 19 nt, Homo sapiens
gcaccucucugcuaacugu

SEQ ID NO: 368544 - RNA, 19 nt, Homo sapiens
cauggaugcugccuacuuu

SEQ ID NO: 368545 - RNA, 19 nt, Homo sapiens
ggaccagcaucaugaagug

SEQ ID NO: 368546 - RNA, 19 nt, Homo sapiens
ccuccuauauccucaguaa

SEQ ID NO: 368547 - RNA, 19 nt, Homo sapiens
caacaacagaguaggcuuu

SEQ ID NO: 368548 - RNA, 19 nt, Homo sapiens
guacaugagugcucuucug

SEQ ID NO: 368549 - RNA, 19 nt, Homo sapiens
acaggcaccucucugcuaa

SEQ ID NO: 368550 - RNA, 19 nt, Homo sapiens
gaguucggcuugagugaga

SEQ ID NO: 368551 - RNA, 19 nt, Homo sapiens
ucuggacuuucucuaauaa

SEQ ID NO: 368552 - RNA, 19 nt, Homo sapiens
gugagaccaugaaggagaa

SEQ ID NO: 368553 - RNA, 19 nt, Homo sapiens
gaugaggccaccacagcua

SEQ ID NO: 368554 - RNA, 19 nt, Homo sapiens
ggaggcagcaguggucaaa

SEQ ID NO: 368555 - RNA, 19 nt, Homo sapiens
guaccaacuucgucuaugc

SEQ ID NO: 368556 - RNA, 19 nt, Homo sapiens
gcuaugacacccugacugu

SEQ ID NO: 368557 - RNA, 19 nt, Homo sapiens
ugaggacccacaaguauga

SEQ ID NO: 368558 - RNA, 19 nt, Homo sapiens
gggcauuguaucugucuuu

SEQ ID NO: 368559 - RNA, 19 nt, Homo sapiens
caucaaugguguggaguuc

SEQ ID NO: 368560 - RNA, 19 nt, Homo sapiens
gauuggcauugaagaguuc

SEQ ID NO: 368561 - RNA, 19 nt, Homo sapiens
ccuagggcauuguaucugu

SEQ ID NO: 368562 - RNA, 19 nt, Homo sapiens
ccacugccgccuagacuug

SEQ ID NO: 368563 - RNA, 19 nt, Homo sapiens
guaucugucuuuccacucu

SEQ ID NO: 368564 - RNA, 19 nt, Homo sapiens
cgacuugggcaacaacaga

SEQ ID NO: 368565 - RNA, 19 nt, Homo sapiens
ccaggaggaugaguaugga

SEQ ID NO: 368566 - RNA, 19 nt, Homo sapiens
ggaacucuacuggcagauu

SEQ ID NO: 368567 - RNA, 19 nt, Homo sapiens
agaaugagccugguaccaa

SEQ ID NO: 368568 - RNA, 19 nt, Homo sapiens
uuucuggacucuggacuuu

SEQ ID NO: 368569 - RNA, 19 nt, Homo sapiens
cauuguaucugucuuucca

SEQ ID NO: 368570 - RNA, 19 nt, Homo sapiens
gguaccaacuucgucuaug

SEQ ID NO: 368571 - RNA, 19 nt, Homo sapiens
gcuuggaaguaccgcuuug

SEQ ID NO: 368572 - RNA, 19 nt, Homo sapiens
acucuggacuuucucuaau

SEQ ID NO: 368573 - RNA, 19 nt, Homo sapiens
cagcuugaccuucaucauc

SEQ ID NO: 368574 - RNA, 19 nt, Homo sapiens
agauuggcauugaagaguu

SEQ ID NO: 368575 - RNA, 19 nt, Homo sapiens
aguaugauccugcuuggaa

SEQ ID NO: 368576 - RNA, 19 nt, Homo sapiens
gacucuggacuuucucuaa

SEQ ID NO: 368577 - RNA, 19 nt, Homo sapiens
ccugaggacccacaaguau

SEQ ID NO: 368578 - RNA, 19 nt, Homo sapiens
cucuggacuuucucuaaua

SEQ ID NO: 368579 - RNA, 19 nt, Homo sapiens
ccuauauccucaguaacaa

SEQ ID NO: 368580 - RNA, 19 nt, Homo sapiens
gcagauuggcauugaagag

SEQ ID NO: 368581 - RNA, 19 nt, Homo sapiens
gaccuucucccugcaguau

SEQ ID NO: 368582 - RNA, 19 nt, Homo sapiens
ggacucuggacuuucucua

SEQ ID NO: 368583 - RNA, 19 nt, Homo sapiens
ugaccuucaucaucaaugg

SEQ ID NO: 368584 - RNA, 19 nt, Homo sapiens
gaggaugaguauggacagu

SEQ ID NO: 368585 - RNA, 19 nt, Homo sapiens
ggauggugguggucuuggu

SEQ ID NO: 368586 - RNA, 19 nt, Homo sapiens
aggcagcaguggucaaagu

SEQ ID NO: 368587 - RNA, 19 nt, Homo sapiens
gggcccaggaggaugagua

SEQ ID NO: 368588 - RNA, 19 nt, Homo sapiens
cacaggcaccucucugcua

SEQ ID NO: 368589 - RNA, 19 nt, Homo sapiens
guggauagcagccuguaca

SEQ ID NO: 368590 - RNA, 19 nt, Homo sapiens
cuucgucuaugcgcaguuu

SEQ ID NO: 368591 - RNA, 19 nt, Homo sapiens
caccggcuccuccaacuug

SEQ ID NO: 368592 - RNA, 19 nt, Homo sapiens
ggcauuguaucugucuuuc

SEQ ID NO: 368593 - RNA, 19 nt, Homo sapiens
ccagcgagucguccaccua

SEQ ID NO: 368594 - RNA, 19 nt, Homo sapiens
ccaccuuccuccuauaucc

SEQ ID NO: 368595 - RNA, 19 nt, Homo sapiens
cugcccagcuugaccuuca

SEQ ID NO: 368596 - RNA, 19 nt, Homo sapiens
ucaaagugccccugaagaa

SEQ ID NO: 368597 - RNA, 19 nt, Homo sapiens
gacaccggcuccuccaacu

SEQ ID NO: 368598 - RNA, 19 nt, Homo sapiens
guccuacuauuccgucuac

SEQ ID NO: 368599 - RNA, 19 nt, Homo sapiens
gggaccagcaucaugaagu

SEQ ID NO: 368600 - RNA, 19 nt, Homo sapiens
ucuggacucuggacuuucu

SEQ ID NO: 368601 - RNA, 19 nt, Homo sapiens
acuauuccgucuacgacuu

SEQ ID NO: 368602 - RNA, 19 nt, Homo sapiens
uuccucagguccuacuauu

SEQ ID NO: 368603 - RNA, 19 nt, Homo sapiens
ccaaugggcagaccuucuc

SEQ ID NO: 368604 - RNA, 19 nt, Homo sapiens
agcuugaccuucaucauca

SEQ ID NO: 368605 - RNA, 19 nt, Homo sapiens
gcaaacaccugcugccaaa

SEQ ID NO: 368606 - RNA, 19 nt, Homo sapiens
agacagagcuagacucauu

SEQ ID NO: 368607 - RNA, 19 nt, Homo sapiens
gauaaaggaugcauuugau

SEQ ID NO: 368608 - RNA, 19 nt, Homo sapiens
gaacuuaauucugaacaug

SEQ ID NO: 368609 - RNA, 19 nt, Homo sapiens
gaucaucucuuacgcucaa

SEQ ID NO: 368610 - RNA, 19 nt, Homo sapiens
uaauaggacugucuccaaa

SEQ ID NO: 368611 - RNA, 19 nt, Homo sapiens
ccacugcccucuccuucua

SEQ ID NO: 368612 - RNA, 19 nt, Homo sapiens
gaaaucacagccaauauuc

SEQ ID NO: 368613 - RNA, 19 nt, Homo sapiens
gaaauugguaccauuguug

SEQ ID NO: 368614 - RNA, 19 nt, Homo sapiens
ggcaagcuguggaugauuu

SEQ ID NO: 368615 - RNA, 19 nt, Homo sapiens
gaugagagaauucaagcua

SEQ ID NO: 368616 - RNA, 19 nt, Homo sapiens
guacagacaugagaugcuu

SEQ ID NO: 368617 - RNA, 19 nt, Homo sapiens
cauuagaaguguauuccua

SEQ ID NO: 368618 - RNA, 19 nt, Homo sapiens
gcaggcagccaccgaguuu

SEQ ID NO: 368619 - RNA, 19 nt, Homo sapiens
cagccaauauucucaaguu

SEQ ID NO: 368620 - RNA, 19 nt, Homo sapiens
ggaauaagacagagcuaga

SEQ ID NO: 368621 - RNA, 19 nt, Homo sapiens
ucacaccuaugaacucuug

SEQ ID NO: 368622 - RNA, 19 nt, Homo sapiens
cauaccaccugaugaaaga

SEQ ID NO: 368623 - RNA, 19 nt, Homo sapiens
ggagaacccugcugugacu

SEQ ID NO: 368624 - RNA, 19 nt, Homo sapiens
ugaaaucacagccaauauu

SEQ ID NO: 368625 - RNA, 19 nt, Homo sapiens
gcacaacgggauagaguau

SEQ ID NO: 368626 - RNA, 19 nt, Homo sapiens
gcuggacucucaauuaugg

SEQ ID NO: 368627 - RNA, 19 nt, Homo sapiens
acaugcagcugaucuguga

SEQ ID NO: 368628 - RNA, 19 nt, Homo sapiens
ugagggagcaggccacuuu

SEQ ID NO: 368629 - RNA, 19 nt, Homo sapiens
gaaagauaaaggaugcauu

SEQ ID NO: 368630 - RNA, 19 nt, Homo sapiens
gcaggccacuuugugaaga

SEQ ID NO: 368631 - RNA, 19 nt, Homo sapiens
gaauauagggacaccacaa

SEQ ID NO: 368632 - RNA, 19 nt, Homo sapiens
uggcuggacucucaauuau

SEQ ID NO: 368633 - RNA, 19 nt, Homo sapiens
gaucgaaacccggaacuuc

SEQ ID NO: 368634 - RNA, 19 nt, Homo sapiens
ggagcaggccacuuuguga

SEQ ID NO: 368635 - RNA, 19 nt, Homo sapiens
gcaagggaauuuuauuugu

SEQ ID NO: 368636 - RNA, 19 nt, Homo sapiens
agaaauugguaccauuguu

SEQ ID NO: 368637 - RNA, 19 nt, Homo sapiens
cccagaaguuccaguuuga

SEQ ID NO: 368638 - RNA, 19 nt, Homo sapiens
gcuagacucauuccugauu

SEQ ID NO: 368639 - RNA, 19 nt, Homo sapiens
cgucaugggccagaacuua

SEQ ID NO: 368640 - RNA, 19 nt, Homo sapiens
ugucuuugcucggugcuua

SEQ ID NO: 368641 - RNA, 19 nt, Homo sapiens
gagcaggccacuuugugaa

SEQ ID NO: 368642 - RNA, 19 nt, Homo sapiens
gcccaggccuuugaggauu

SEQ ID NO: 368643 - RNA, 19 nt, Homo sapiens
uaagacagagcuagacuca

SEQ ID NO: 368644 - RNA, 19 nt, Homo sapiens
ggauacuggugacaucauc

SEQ ID NO: 368645 - RNA, 19 nt, Homo sapiens
agauaaaggaugcauuuga

SEQ ID NO: 368646 - RNA, 19 nt, Homo sapiens
cgagaaauugguaccauug

SEQ ID NO: 368647 - RNA, 19 nt, Homo sapiens
cuacuggacgacuucuuua

SEQ ID NO: 368648 - RNA, 19 nt, Homo sapiens
ccaauauucucaaguucca

SEQ ID NO: 368649 - RNA, 19 nt, Homo sapiens
cuggugacaucaucauuga

SEQ ID NO: 368650 - RNA, 19 nt, Homo sapiens
acucuacgcuuccaagauc

SEQ ID NO: 368651 - RNA, 19 nt, Homo sapiens
ucugaaggaugagagaauu

SEQ ID NO: 368652 - RNA, 19 nt, Homo sapiens
ucgagaaauugguaccauu

SEQ ID NO: 368653 - RNA, 19 nt, Homo sapiens
guuugauggugauaagaaa

SEQ ID NO: 368654 - RNA, 19 nt, Homo sapiens
ccaguuugauggugauaag

SEQ ID NO: 368655 - RNA, 19 nt, Homo sapiens
gcucggugcuuaucaucuc

SEQ ID NO: 368656 - RNA, 19 nt, Homo sapiens
aaacaccugcugccaaaga

SEQ ID NO: 368657 - RNA, 19 nt, Homo sapiens
acucauuccugauugaaau

SEQ ID NO: 368658 - RNA, 19 nt, Homo sapiens
gcucacaccuaugaacucu

SEQ ID NO: 368659 - RNA, 19 nt, Homo sapiens
gagaauucaagcuagcaaa

SEQ ID NO: 368660 - RNA, 19 nt, Homo sapiens
caaaggcaagggaauuuua

SEQ ID NO: 368661 - RNA, 19 nt, Homo sapiens
uggagaagcugucuuugcu

SEQ ID NO: 368662 - RNA, 19 nt, Homo sapiens
cauuggagaagcugucuuu

SEQ ID NO: 368663 - RNA, 19 nt, Homo sapiens
uaagucagcuguugaaaac

SEQ ID NO: 368664 - RNA, 19 nt, Homo sapiens
uagacucauuccugauuga

SEQ ID NO: 368665 - RNA, 19 nt, Homo sapiens
cuagacucauuccugauug

SEQ ID NO: 368666 - RNA, 19 nt, Homo sapiens
gcauaccaccugaugaaag

SEQ ID NO: 368667 - RNA, 19 nt, Homo sapiens
aggacugucuccaaaguug

SEQ ID NO: 368668 - RNA, 19 nt, Homo sapiens
ggacugucuccaaaguuga

SEQ ID NO: 368669 - RNA, 19 nt, Homo sapiens
gaaugaccacggcuuugug

SEQ ID NO: 368670 - RNA, 19 nt, Homo sapiens
acaucgcgcugaucggauu

SEQ ID NO: 368671 - RNA, 19 nt, Homo sapiens
ggacaugcagcugaucugu

SEQ ID NO: 368672 - RNA, 19 nt, Homo sapiens
gauggugcacaacgggaua

SEQ ID NO: 368673 - RNA, 19 nt, Homo sapiens
gagaaauugguaccauugu

SEQ ID NO: 368674 - RNA, 19 nt, Homo sapiens
ccuacuggacgacuucuuu

SEQ ID NO: 368675 - RNA, 19 nt, Homo sapiens
gaaacccggaacuucagaa

SEQ ID NO: 368676 - RNA, 19 nt, Homo sapiens
ggugaaggcugggcaagcu

SEQ ID NO: 368677 - RNA, 19 nt, Homo sapiens
gcacucuacgcuuccaaga

SEQ ID NO: 368678 - RNA, 19 nt, Homo sapiens
ggaaguggaccgccaucuc

SEQ ID NO: 368679 - RNA, 19 nt, Homo sapiens
caugaaugaccacggcuuu

SEQ ID NO: 368680 - RNA, 19 nt, Homo sapiens
gaccaucuuccaaggcauu

SEQ ID NO: 368681 - RNA, 19 nt, Homo sapiens
caucauugacggaggaaau

SEQ ID NO: 368682 - RNA, 19 nt, Homo sapiens
ggaugcauuugaucgaaac

SEQ ID NO: 368683 - RNA, 19 nt, Homo sapiens
gucaugggccagaacuuaa

SEQ ID NO: 368684 - RNA, 19 nt, Homo sapiens
gaaguuccaguuugauggu

SEQ ID NO: 368685 - RNA, 19 nt, Homo sapiens
gaaggaugagagaauucaa

SEQ ID NO: 368686 - RNA, 19 nt, Homo sapiens
gaucggauuggccgucaug

SEQ ID NO: 368687 - RNA, 19 nt, Homo sapiens
uugguaccauuguuggaua

SEQ ID NO: 368688 - RNA, 19 nt, Homo sapiens
acaacgggauagaguaugg

SEQ ID NO: 368689 - RNA, 19 nt, Homo sapiens
gugacugggugggagauga

SEQ ID NO: 368690 - RNA, 19 nt, Homo sapiens
gccaggagggaacaaagaa

SEQ ID NO: 368691 - RNA, 19 nt, Homo sapiens
caagggaauuuuauuugug

SEQ ID NO: 368692 - RNA, 19 nt, Homo sapiens
cgucauacaaugccugaug

SEQ ID NO: 368693 - RNA, 19 nt, Homo sapiens
uaugacggguacagacaug

SEQ ID NO: 368694 - RNA, 19 nt, Homo sapiens
uuaauaggacugucuccaa

SEQ ID NO: 368695 - RNA, 19 nt, Homo sapiens
gugcuuaucaucucugaag

SEQ ID NO: 368696 - RNA, 19 nt, Homo sapiens
agucagugguggagaggaa

SEQ ID NO: 368697 - RNA, 19 nt, Homo sapiens
ccucaaaggcaagggaauu

SEQ ID NO: 368698 - RNA, 19 nt, Homo sapiens
cagaaguuccaguuugaug

SEQ ID NO: 368699 - RNA, 19 nt, Homo sapiens
uuugaggauuggaauaaga

SEQ ID NO: 368700 - RNA, 19 nt, Homo sapiens
gggagcaggccacuuugug

SEQ ID NO: 368701 - RNA, 19 nt, Homo sapiens
ugacggaggaaauucugaa

SEQ ID NO: 368702 - RNA, 19 nt, Homo sapiens
guuggauacuggugacauc

SEQ ID NO: 368703 - RNA, 19 nt, Homo sapiens
aaggaugcauuugaucgaa

SEQ ID NO: 368704 - RNA, 19 nt, Homo sapiens
ggaaagauaaaggaugcau

SEQ ID NO: 368705 - RNA, 19 nt, Homo sapiens
gcacccggcucguguauuu

SEQ ID NO: 368706 - RNA, 19 nt, Homo sapiens
gcugguaccugcccucuau

SEQ ID NO: 368707 - RNA, 19 nt, Homo sapiens
gagagaagccagccacaga

SEQ ID NO: 368708 - RNA, 19 nt, Homo sapiens
gacaggacccucaggaauu

SEQ ID NO: 368709 - RNA, 19 nt, Homo sapiens
ggacaggacccucaggaau

SEQ ID NO: 368710 - RNA, 19 nt, Homo sapiens
ggaauucagugccuucaac

SEQ ID NO: 368711 - RNA, 19 nt, Homo sapiens
ccaugcagcuccuaaagau

SEQ ID NO: 368712 - RNA, 19 nt, Homo sapiens
ccugggagcuuccgcuuug

SEQ ID NO: 368713 - RNA, 19 nt, Homo sapiens
uaccugcccucuauuuauu

SEQ ID NO: 368714 - RNA, 19 nt, Homo sapiens
gagaagaugccggucauga

SEQ ID NO: 368715 - RNA, 19 nt, Homo sapiens
gaaagagcugccuggauga

SEQ ID NO: 368716 - RNA, 19 nt, Homo sapiens
guaccugcccucuauuuau

SEQ ID NO: 368717 - RNA, 19 nt, Homo sapiens
gggaagaggaggagagaga

SEQ ID NO: 368718 - RNA, 19 nt, Homo sapiens
caacaacgugagagaaaga

SEQ ID NO: 368719 - RNA, 19 nt, Homo sapiens
gguaccugcccucuauuua

SEQ ID NO: 368720 - RNA, 19 nt, Homo sapiens
gggaugagcauggugguuu

SEQ ID NO: 368721 - RNA, 19 nt, Homo sapiens
ccucacacuuugccauuug

SEQ ID NO: 368722 - RNA, 19 nt, Homo sapiens
aaaguauucuaguguggaa

SEQ ID NO: 368723 - RNA, 19 nt, Homo sapiens
gagaagaugaagccggaaa

SEQ ID NO: 368724 - RNA, 19 nt, Homo sapiens
uuucggagcuccuguccaa

SEQ ID NO: 368725 - RNA, 19 nt, Homo sapiens
gagcuccuguccaaaagua

SEQ ID NO: 368726 - RNA, 19 nt, Homo sapiens
gagaaagagcugccuggau

SEQ ID NO: 368727 - RNA, 19 nt, Homo sapiens
ggaagaggaggagagagaa

SEQ ID NO: 368728 - RNA, 19 nt, Homo sapiens
guacugggacauuguucuu

SEQ ID NO: 368729 - RNA, 19 nt, Homo sapiens
acaggacccucaggaauuc

SEQ ID NO: 368730 - RNA, 19 nt, Homo sapiens
augagaaucugcacugugu

SEQ ID NO: 368731 - RNA, 19 nt, Homo sapiens
agagcugccuggaugagaa

SEQ ID NO: 368732 - RNA, 19 nt, Homo sapiens
uaagagacacauacagagu

SEQ ID NO: 368733 - RNA, 19 nt, Homo sapiens
ccagcgagguggagcacau

SEQ ID NO: 368734 - RNA, 19 nt, Homo sapiens
ggaugagcauggugguuuu

SEQ ID NO: 368735 - RNA, 19 nt, Homo sapiens
gagcugccuggaugagaaa

SEQ ID NO: 368736 - RNA, 19 nt, Homo sapiens
gaucuccccucacacuuug

SEQ ID NO: 368737 - RNA, 19 nt, Homo sapiens
gaauucagugccuucaaca

SEQ ID NO: 368738 - RNA, 19 nt, Homo sapiens
gaagaggaggagagagaag

SEQ ID NO: 368739 - RNA, 19 nt, Homo sapiens
ucaacaacgugagagaaag

SEQ ID NO: 368740 - RNA, 19 nt, Homo sapiens
gggagcuuccgcuuugaaa

SEQ ID NO: 368741 - RNA, 19 nt, Homo sapiens
gaggagagagaagcagaga

SEQ ID NO: 368742 - RNA, 19 nt, Homo sapiens
ccggcucguguauuuauua

SEQ ID NO: 368743 - RNA, 19 nt, Homo sapiens
gaagaugaagccggaaagg

SEQ ID NO: 368744 - RNA, 19 nt, Homo sapiens
gcugcugucugcggaggaa

SEQ ID NO: 368745 - RNA, 19 nt, Homo sapiens
cgagguggagcacauguuc

SEQ ID NO: 368746 - RNA, 19 nt, Homo sapiens
acugggacauuguucuuuc

SEQ ID NO: 368747 - RNA, 19 nt, Homo sapiens
uuuauuagccaacuguuuc

SEQ ID NO: 368748 - RNA, 19 nt, Homo sapiens
cucaggcucugcacaguca

SEQ ID NO: 368749 - RNA, 19 nt, Homo sapiens
gaaugccucgcucccuuca

SEQ ID NO: 368750 - RNA, 19 nt, Homo sapiens
cgaugagaaucugcacugu

SEQ ID NO: 368751 - RNA, 19 nt, Homo sapiens
auaaagaggugguguauaa

SEQ ID NO: 368752 - RNA, 19 nt, Homo sapiens
ggaggaaaguggaauuugu

SEQ ID NO: 368753 - RNA, 19 nt, Homo sapiens
gagcuggacuugaaucuca

SEQ ID NO: 368754 - RNA, 19 nt, Homo sapiens
gaaaacagaugaccauaau

SEQ ID NO: 368755 - RNA, 19 nt, Homo sapiens
gaauugaacaggauaaaga

SEQ ID NO: 368756 - RNA, 19 nt, Homo sapiens
guacugugcuuccuguauu

SEQ ID NO: 368757 - RNA, 19 nt, Homo sapiens
guagacaccuguuauucuu

SEQ ID NO: 368758 - RNA, 19 nt, Homo sapiens
guacauaucuccacaugac

SEQ ID NO: 368759 - RNA, 19 nt, Homo sapiens
acaagcagguugacaauug

SEQ ID NO: 368760 - RNA, 19 nt, Homo sapiens
gaaaguggaauuuguaaag

SEQ ID NO: 368761 - RNA, 19 nt, Homo sapiens
ggacacaaauuuucaaguu

SEQ ID NO: 368762 - RNA, 19 nt, Homo sapiens
gguagagucuuacaaucaa

SEQ ID NO: 368763 - RNA, 19 nt, Homo sapiens
acagggagcuggacuugaa

SEQ ID NO: 368764 - RNA, 19 nt, Homo sapiens
cagugcaaauuguaucuua

SEQ ID NO: 368765 - RNA, 19 nt, Homo sapiens
uagcauaacuguagcucaa

SEQ ID NO: 368766 - RNA, 19 nt, Homo sapiens
gcucagagaauguacauau

SEQ ID NO: 368767 - RNA, 19 nt, Homo sapiens
gagcaacucugaagcuucu

SEQ ID NO: 368768 - RNA, 19 nt, Homo sapiens
gagagcggcuggauuucuu

SEQ ID NO: 368769 - RNA, 19 nt, Homo sapiens
gaggaaaguggaauuugua

SEQ ID NO: 368770 - RNA, 19 nt, Homo sapiens
uaucauggaagaccuaaua

SEQ ID NO: 368771 - RNA, 19 nt, Homo sapiens
aaacaaugcucagagaaug

SEQ ID NO: 368772 - RNA, 19 nt, Homo sapiens
gacuuaagccgaguaaaua

SEQ ID NO: 368773 - RNA, 19 nt, Homo sapiens
uggaacagcucauccuuau

SEQ ID NO: 368774 - RNA, 19 nt, Homo sapiens
uaucugggauuauucuuug

SEQ ID NO: 368775 - RNA, 19 nt, Homo sapiens
gccaucaccuauauuagaa

SEQ ID NO: 368776 - RNA, 19 nt, Homo sapiens
gcuauaugcucaacaacug

SEQ ID NO: 368777 - RNA, 19 nt, Homo sapiens
aaagccaucaccuauauua

SEQ ID NO: 368778 - RNA, 19 nt, Homo sapiens
gaccuacacuggccucuca

SEQ ID NO: 368779 - RNA, 19 nt, Homo sapiens
gcaaauuaacuguaugugu

SEQ ID NO: 368780 - RNA, 19 nt, Homo sapiens
ugaggcaaauuaacuguau

SEQ ID NO: 368781 - RNA, 19 nt, Homo sapiens
cgacuuaagccgaguaaau

SEQ ID NO: 368782 - RNA, 19 nt, Homo sapiens
ccacaugacugauuuuaga

SEQ ID NO: 368783 - RNA, 19 nt, Homo sapiens
gcucacugcugaucguaga

SEQ ID NO: 368784 - RNA, 19 nt, Homo sapiens
caaggacucuaaacaaugc

SEQ ID NO: 368785 - RNA, 19 nt, Homo sapiens
aagaggugguguauaauga

SEQ ID NO: 368786 - RNA, 19 nt, Homo sapiens
ggugaacaaagaugauaua

SEQ ID NO: 368787 - RNA, 19 nt, Homo sapiens
gcagguccuucccacagaa

SEQ ID NO: 368788 - RNA, 19 nt, Homo sapiens
uagauguggugaacaaaga

SEQ ID NO: 368789 - RNA, 19 nt, Homo sapiens
ggauauguuggauuccuua

SEQ ID NO: 368790 - RNA, 19 nt, Homo sapiens
cacuaugucugauggguaa

SEQ ID NO: 368791 - RNA, 19 nt, Homo sapiens
ggaaaguggaauuuguaaa

SEQ ID NO: 368792 - RNA, 19 nt, Homo sapiens
gagacaagcagguugacaa

SEQ ID NO: 368793 - RNA, 19 nt, Homo sapiens
ucuaaacaaugcucagaga

SEQ ID NO: 368794 - RNA, 19 nt, Homo sapiens
ccaauacacuaacuuugag

SEQ ID NO: 368795 - RNA, 19 nt, Homo sapiens
guagagucuuacaaucaaa

SEQ ID NO: 368796 - RNA, 19 nt, Homo sapiens
ggauaaagaggugguguau

SEQ ID NO: 368797 - RNA, 19 nt, Homo sapiens
gcacagggagcuggacuug

SEQ ID NO: 368798 - RNA, 19 nt, Homo sapiens
ggccucucaugcuuaguua

SEQ ID NO: 368799 - RNA, 19 nt, Homo sapiens
uauguuggauuccuuagau

SEQ ID NO: 368800 - RNA, 19 nt, Homo sapiens
gcauaacuguagcucaagu

SEQ ID NO: 368801 - RNA, 19 nt, Homo sapiens
gauaaagaggugguguaua

SEQ ID NO: 368802 - RNA, 19 nt, Homo sapiens
acacuggccucucaugcuu

SEQ ID NO: 368803 - RNA, 19 nt, Homo sapiens
uaaacaaugcucagagaau

SEQ ID NO: 368804 - RNA, 19 nt, Homo sapiens
ucugauggguaaacuagaa

SEQ ID NO: 368805 - RNA, 19 nt, Homo sapiens
caucaaagcuggaaaacca

SEQ ID NO: 368806 - RNA, 19 nt, Homo sapiens
caaaaugguuaucauggaa

SEQ ID NO: 368807 - RNA, 19 nt, Homo sapiens
ccacagaagacagaucaaa

SEQ ID NO: 368808 - RNA, 19 nt, Homo sapiens
ccaaggacucuaaacaaug

SEQ ID NO: 368809 - RNA, 19 nt, Homo sapiens
ccuuagauguggugaacaa

SEQ ID NO: 368810 - RNA, 19 nt, Homo sapiens
ugucgugguucuuaaaugu

SEQ ID NO: 368811 - RNA, 19 nt, Homo sapiens
ugauuucacuuugggauau

SEQ ID NO: 368812 - RNA, 19 nt, Homo sapiens
aaagguagagucuuacaau

SEQ ID NO: 368813 - RNA, 19 nt, Homo sapiens
ccaaguggccagacaguca

SEQ ID NO: 368814 - RNA, 19 nt, Homo sapiens
gcaacucugaagcuucuaa

SEQ ID NO: 368815 - RNA, 19 nt, Homo sapiens
gggagcaacucugaagcuu

SEQ ID NO: 368816 - RNA, 19 nt, Homo sapiens
gguauuccguucaauccau

SEQ ID NO: 368817 - RNA, 19 nt, Homo sapiens
ggaaaaccaaggacucuaa

SEQ ID NO: 368818 - RNA, 19 nt, Homo sapiens
ucuccgggcuggauauguu

SEQ ID NO: 368819 - RNA, 19 nt, Homo sapiens
accaaggacucuaaacaau

SEQ ID NO: 368820 - RNA, 19 nt, Homo sapiens
aaaccaaggacucuaaaca

SEQ ID NO: 368821 - RNA, 19 nt, Homo sapiens
uccaauacacuaacuuuga

SEQ ID NO: 368822 - RNA, 19 nt, Homo sapiens
aaagaggugguguauaaug

SEQ ID NO: 368823 - RNA, 19 nt, Homo sapiens
guaucugggauuauucuuu

SEQ ID NO: 368824 - RNA, 19 nt, Homo sapiens
ggcuggauauguuggauuc

SEQ ID NO: 368825 - RNA, 19 nt, Homo sapiens
agggagagcggcuggauuu

SEQ ID NO: 368826 - RNA, 19 nt, Homo sapiens
gcacucuccgggcuggaua

SEQ ID NO: 368827 - RNA, 19 nt, Homo sapiens
uaagccgaguaaauaaaga

SEQ ID NO: 368828 - RNA, 19 nt, Homo sapiens
ucgugguucuuaaauguuu

SEQ ID NO: 368829 - RNA, 19 nt, Homo sapiens
gcagguugacaauugcauu

SEQ ID NO: 368830 - RNA, 19 nt, Homo sapiens
gaggcaaauuaacuguaug

SEQ ID NO: 368831 - RNA, 19 nt, Homo sapiens
guugaaguuugaaccacaa

SEQ ID NO: 368832 - RNA, 19 nt, Homo sapiens
cuaaaucgcugugguuucc

SEQ ID NO: 368833 - RNA, 19 nt, Homo sapiens
gaagagugacuuauuuugu

SEQ ID NO: 368834 - RNA, 19 nt, Homo sapiens
gcaacaaaaugguuaucau

SEQ ID NO: 368835 - RNA, 19 nt, Homo sapiens
uaagcacacggacuucuga

SEQ ID NO: 368836 - RNA, 19 nt, Homo sapiens
aaaugguuaucauggaaga

SEQ ID NO: 368837 - RNA, 19 nt, Homo sapiens
acagaagacagaucaaauc

SEQ ID NO: 368838 - RNA, 19 nt, Homo sapiens
cagguugacaauugcauuu

SEQ ID NO: 368839 - RNA, 19 nt, Homo sapiens
gccagacagucauccagau

SEQ ID NO: 368840 - RNA, 19 nt, Homo sapiens
gaccuaauaagccuguaga

SEQ ID NO: 368841 - RNA, 19 nt, Homo sapiens
uggguaaacuagaagaagu

SEQ ID NO: 368842 - RNA, 19 nt, Homo sapiens
guaccugaaggcagugaaa

SEQ ID NO: 368843 - RNA, 19 nt, Homo sapiens
ccucucaugcuuaguuauu

SEQ ID NO: 368844 - RNA, 19 nt, Homo sapiens
uaaaagccauguauaacca

SEQ ID NO: 368845 - RNA, 19 nt, Homo sapiens
ggauuuguagcauaacugu

SEQ ID NO: 368846 - RNA, 19 nt, Homo sapiens
caagcagguugacaauugc

SEQ ID NO: 368847 - RNA, 19 nt, Homo sapiens
caacucugaagcuucuaaa

SEQ ID NO: 368848 - RNA, 19 nt, Homo sapiens
uguauaaugaggcaacaaa

SEQ ID NO: 368849 - RNA, 19 nt, Homo sapiens
ugaaucucauggaggauca

SEQ ID NO: 368850 - RNA, 19 nt, Homo sapiens
acaaugcucagagaaugua

SEQ ID NO: 368851 - RNA, 19 nt, Homo sapiens
gcacuucucuguuugauga

SEQ ID NO: 368852 - RNA, 19 nt, Homo sapiens
ccacauauauuuccacuuc

SEQ ID NO: 368853 - RNA, 19 nt, Homo sapiens
gagccaagauugucaaaga

SEQ ID NO: 368854 - RNA, 19 nt, Homo sapiens
gaacggaucagaugucuau

SEQ ID NO: 368855 - RNA, 19 nt, Homo sapiens
gcaaggauguucuguucuu

SEQ ID NO: 368856 - RNA, 19 nt, Homo sapiens
gaaacaagaugaaauucca

SEQ ID NO: 368857 - RNA, 19 nt, Homo sapiens
caagaucccauuugaauuu

SEQ ID NO: 368858 - RNA, 19 nt, Homo sapiens
agaaggagcugaacuacuu

SEQ ID NO: 368859 - RNA, 19 nt, Homo sapiens
gaagaauggugugaagauu

SEQ ID NO: 368860 - RNA, 19 nt, Homo sapiens
guauauaccuccauguuuc

SEQ ID NO: 368861 - RNA, 19 nt, Homo sapiens
gauuggcacuucucuguuu

SEQ ID NO: 368862 - RNA, 19 nt, Homo sapiens
agucaaggcuuauaacaaa

SEQ ID NO: 368863 - RNA, 19 nt, Homo sapiens
gagcugaacuacuuugcaa

SEQ ID NO: 368864 - RNA, 19 nt, Homo sapiens
gaucagaugucuauauugc

SEQ ID NO: 368865 - RNA, 19 nt, Homo sapiens
ucaaagaccuaauguccaa

SEQ ID NO: 368866 - RNA, 19 nt, Homo sapiens
gagcuaaaguugcagacaa

SEQ ID NO: 368867 - RNA, 19 nt, Homo sapiens
acagaaggcugguggguuu

SEQ ID NO: 368868 - RNA, 19 nt, Homo sapiens
gggcaaggauguucuguuc

SEQ ID NO: 368869 - RNA, 19 nt, Homo sapiens
gaagagggagccaagauug

SEQ ID NO: 368870 - RNA, 19 nt, Homo sapiens
caaagucaaugagaugauu

SEQ ID NO: 368871 - RNA, 19 nt, Homo sapiens
gagaugggacaauuagaua

SEQ ID NO: 368872 - RNA, 19 nt, Homo sapiens
aagauuaccuugccuguug

SEQ ID NO: 368873 - RNA, 19 nt, Homo sapiens
gauaaagucagccauguga

SEQ ID NO: 368874 - RNA, 19 nt, Homo sapiens
ggacaaagucaaugagaug

SEQ ID NO: 368875 - RNA, 19 nt, Homo sapiens
acaaacaaccagaggauua

SEQ ID NO: 368876 - RNA, 19 nt, Homo sapiens
aaaugucgcuuucuaacaa

SEQ ID NO: 368877 - RNA, 19 nt, Homo sapiens
ucaauaauaugcuggacaa

SEQ ID NO: 368878 - RNA, 19 nt, Homo sapiens
agauccagcucaucaauaa

SEQ ID NO: 368879 - RNA, 19 nt, Homo sapiens
caggaacccuuaaacaguu

SEQ ID NO: 368880 - RNA, 19 nt, Homo sapiens
gaugauccauuaaguaaac

SEQ ID NO: 368881 - RNA, 19 nt, Homo sapiens
cggaucagaugucuauauu

SEQ ID NO: 368882 - RNA, 19 nt, Homo sapiens
uggacaagcuggacguuaa

SEQ ID NO: 368883 - RNA, 19 nt, Homo sapiens
cuaagcagauuguguggaa

SEQ ID NO: 368884 - RNA, 19 nt, Homo sapiens
gaaagcagcaagaaguaug

SEQ ID NO: 368885 - RNA, 19 nt, Homo sapiens
gagcaguguuagcuuaguu

SEQ ID NO: 368886 - RNA, 19 nt, Homo sapiens
uaccuugccuguugacuuu

SEQ ID NO: 368887 - RNA, 19 nt, Homo sapiens
guccaaagcugagaagaau

SEQ ID NO: 368888 - RNA, 19 nt, Homo sapiens
gcuaaaaccuuccauguca

SEQ ID NO: 368889 - RNA, 19 nt, Homo sapiens
aaccaaagcucucauggau

SEQ ID NO: 368890 - RNA, 19 nt, Homo sapiens
gaaccaaagcucucaugga

SEQ ID NO: 368891 - RNA, 19 nt, Homo sapiens
guggagagaugggacaauu

SEQ ID NO: 368892 - RNA, 19 nt, Homo sapiens
agaauagaaucuugaggaa

SEQ ID NO: 368893 - RNA, 19 nt, Homo sapiens
ugacaaguuugaugagaau

SEQ ID NO: 368894 - RNA, 19 nt, Homo sapiens
ugaagaaggagcugaacua

SEQ ID NO: 368895 - RNA, 19 nt, Homo sapiens
gagagucgacuucaauguu

SEQ ID NO: 368896 - RNA, 19 nt, Homo sapiens
gaacacggaggauaaaguc

SEQ ID NO: 368897 - RNA, 19 nt, Homo sapiens
gggcggagcuaaaguugca

SEQ ID NO: 368898 - RNA, 19 nt, Homo sapiens
caaacaaccagaggauuaa

SEQ ID NO: 368899 - RNA, 19 nt, Homo sapiens
cgacuucaauguuccuaug

SEQ ID NO: 368900 - RNA, 19 nt, Homo sapiens
ccacuuggcauuagcuaaa

SEQ ID NO: 368901 - RNA, 19 nt, Homo sapiens
gauuauuggugguggaaug

SEQ ID NO: 368902 - RNA, 19 nt, Homo sapiens
ccaagucgguaguccuuau

SEQ ID NO: 368903 - RNA, 19 nt, Homo sapiens
gaugggacaauuagauaaa

SEQ ID NO: 368904 - RNA, 19 nt, Homo sapiens
ggagagaugggacaauuag

SEQ ID NO: 368905 - RNA, 19 nt, Homo sapiens
ugucauacuuuguuaggaa

SEQ ID NO: 368906 - RNA, 19 nt, Homo sapiens
gacaagauccagcucauca

SEQ ID NO: 368907 - RNA, 19 nt, Homo sapiens
gaagaacaaccagauaaca

SEQ ID NO: 368908 - RNA, 19 nt, Homo sapiens
ggacaagcuggacguuaaa

SEQ ID NO: 368909 - RNA, 19 nt, Homo sapiens
ggauuugcauacauucuuc

SEQ ID NO: 368910 - RNA, 19 nt, Homo sapiens
cagcagcaguggagagaug

SEQ ID NO: 368911 - RNA, 19 nt, Homo sapiens
gcagugccaggaacccuua

SEQ ID NO: 368912 - RNA, 19 nt, Homo sapiens
ggaugucuaugucaaugau

SEQ ID NO: 368913 - RNA, 19 nt, Homo sapiens
gagaaccuccgcuuucaug

SEQ ID NO: 368914 - RNA, 19 nt, Homo sapiens
ucaagggccuacuuuaugg

SEQ ID NO: 368915 - RNA, 19 nt, Homo sapiens
ggaagcgggucguuaugag

SEQ ID NO: 368916 - RNA, 19 nt, Homo sapiens
aagaauggugugaagauua

SEQ ID NO: 368917 - RNA, 19 nt, Homo sapiens
agugagcaguguuagcuua

SEQ ID NO: 368918 - RNA, 19 nt, Homo sapiens
cacuguggcuucuggcaua

SEQ ID NO: 368919 - RNA, 19 nt, Homo sapiens
gcccaugccugacaaguac

SEQ ID NO: 368920 - RNA, 19 nt, Homo sapiens
uaucaagggccuacuuuau

SEQ ID NO: 368921 - RNA, 19 nt, Homo sapiens
auaauaugcuggacaaagu

SEQ ID NO: 368922 - RNA, 19 nt, Homo sapiens
ucaauguuccuaugaagaa

SEQ ID NO: 368923 - RNA, 19 nt, Homo sapiens
gcugagcuauguaguaugc

SEQ ID NO: 368924 - RNA, 19 nt, Homo sapiens
uaacaaacaaccagaggau

SEQ ID NO: 368925 - RNA, 19 nt, Homo sapiens
aagaaagugagcaguguua

SEQ ID NO: 368926 - RNA, 19 nt, Homo sapiens
gcugacaaguuugaugaga

SEQ ID NO: 368927 - RNA, 19 nt, Homo sapiens
ggugaccacuuucaacucu

SEQ ID NO: 368928 - RNA, 19 nt, Homo sapiens
agaacaaccagauaacaaa

SEQ ID NO: 368929 - RNA, 19 nt, Homo sapiens
ggaagggugagaauagaau

SEQ ID NO: 368930 - RNA, 19 nt, Homo sapiens
ugagaagaauggugugaag

SEQ ID NO: 368931 - RNA, 19 nt, Homo sapiens
ucaacaacauggagauugg

SEQ ID NO: 368932 - RNA, 19 nt, Homo sapiens
ugagcuauguaguaugcua

SEQ ID NO: 368933 - RNA, 19 nt, Homo sapiens
gauuagcuuugucacuguu

SEQ ID NO: 368934 - RNA, 19 nt, Homo sapiens
acaaccagauaacaaacaa

SEQ ID NO: 368935 - RNA, 19 nt, Homo sapiens
gaagauuaccuugccuguu

SEQ ID NO: 368936 - RNA, 19 nt, Homo sapiens
uuaaggugcucaacaacau

SEQ ID NO: 368937 - RNA, 19 nt, Homo sapiens
gaaggagcugaacuacuuu

SEQ ID NO: 368938 - RNA, 19 nt, Homo sapiens
gaucaaaagucuacauaac

SEQ ID NO: 368939 - RNA, 19 nt, Homo sapiens
ugaccacuuucaacucuug

SEQ ID NO: 368940 - RNA, 19 nt, Homo sapiens
gcccauuccucccauucaa

SEQ ID NO: 368941 - RNA, 19 nt, Homo sapiens
ccaggaacccuuaaacagu

SEQ ID NO: 368942 - RNA, 19 nt, Homo sapiens
gaagcgggucguuaugaga

SEQ ID NO: 368943 - RNA, 19 nt, Homo sapiens
gaaccuccgcuuucaugug

SEQ ID NO: 368944 - RNA, 19 nt, Homo sapiens
acuaaaccauugugcauuc

SEQ ID NO: 368945 - RNA, 19 nt, Homo sapiens
agagucgacuucaauguuc

SEQ ID NO: 368946 - RNA, 19 nt, Homo sapiens
gaacaaccagauaacaaac

SEQ ID NO: 368947 - RNA, 19 nt, Homo sapiens
ggaacacggaggauaaagu

SEQ ID NO: 368948 - RNA, 19 nt, Homo sapiens
agaauggugugaagauuac

SEQ ID NO: 368949 - RNA, 19 nt, Homo sapiens
gcccagaaguggagaaagc

SEQ ID NO: 368950 - RNA, 19 nt, Homo sapiens
gcuauguaguaugcuauga

SEQ ID NO: 368951 - RNA, 19 nt, Homo sapiens
gagccaagaucguuaaaga

SEQ ID NO: 368952 - RNA, 19 nt, Homo sapiens
gaacuagauuacuuugcua

SEQ ID NO: 368953 - RNA, 19 nt, Homo sapiens
gcagacaagauccaacuua

SEQ ID NO: 368954 - RNA, 19 nt, Homo sapiens
gccaagaucguuaaagaua

SEQ ID NO: 368955 - RNA, 19 nt, Homo sapiens
caagaucccucuggaaaga

SEQ ID NO: 368956 - RNA, 19 nt, Homo sapiens
ugacaaauauuccuuagca

SEQ ID NO: 368957 - RNA, 19 nt, Homo sapiens
gggcaaggauguucuguuc

SEQ ID NO: 368958 - RNA, 19 nt, Homo sapiens
gaaggaacuagauuacuuu

SEQ ID NO: 368959 - RNA, 19 nt, Homo sapiens
gagaguagacuucaauguu

SEQ ID NO: 368960 - RNA, 19 nt, Homo sapiens
caagcaaggcuaauuguuu

SEQ ID NO: 368961 - RNA, 19 nt, Homo sapiens
caacaagaaucaugcucaa

SEQ ID NO: 368962 - RNA, 19 nt, Homo sapiens
caaagucaaugagaugauu

SEQ ID NO: 368963 - RNA, 19 nt, Homo sapiens
caagaaucaugcucaaguu

SEQ ID NO: 368964 - RNA, 19 nt, Homo sapiens
gauuggugcuucccuguuu

SEQ ID NO: 368965 - RNA, 19 nt, Homo sapiens
ggacaaagucaaugagaug

SEQ ID NO: 368966 - RNA, 19 nt, Homo sapiens
ugaagaaggaacuagauua

SEQ ID NO: 368967 - RNA, 19 nt, Homo sapiens
ggacgucuaugucaaugau

SEQ ID NO: 368968 - RNA, 19 nt, Homo sapiens
gacaagauccaacuuauca

SEQ ID NO: 368969 - RNA, 19 nt, Homo sapiens
agaaggaacuagauuacuu

SEQ ID NO: 368970 - RNA, 19 nt, Homo sapiens
gcacaccgcgcucauaguu

SEQ ID NO: 368971 - RNA, 19 nt, Homo sapiens
gugcuucccuguuugauga

SEQ ID NO: 368972 - RNA, 19 nt, Homo sapiens
gagcaucacuuuccaagcu

SEQ ID NO: 368973 - RNA, 19 nt, Homo sapiens
ggaacuagauuacuuugcu

SEQ ID NO: 368974 - RNA, 19 nt, Homo sapiens
gauuaaagcugagccagau

SEQ ID NO: 368975 - RNA, 19 nt, Homo sapiens
uaaagcauccggauucuug

SEQ ID NO: 368976 - RNA, 19 nt, Homo sapiens
aagcaaggcuaauuguuug

SEQ ID NO: 368977 - RNA, 19 nt, Homo sapiens
aaagaaugguguaaggauu

SEQ ID NO: 368978 - RNA, 19 nt, Homo sapiens
cagacaagauccaacuuau

SEQ ID NO: 368979 - RNA, 19 nt, Homo sapiens
ccaagaucguuaaagauau

SEQ ID NO: 368980 - RNA, 19 nt, Homo sapiens
gaaucaugcucaaguugug

SEQ ID NO: 368981 - RNA, 19 nt, Homo sapiens
caagaucguuaaagauauc

SEQ ID NO: 368982 - RNA, 19 nt, Homo sapiens
gaagaaggaacuagauuac

SEQ ID NO: 368983 - RNA, 19 nt, Homo sapiens
gauaaagucagccauguca

SEQ ID NO: 368984 - RNA, 19 nt, Homo sapiens
gggacaaguuugacgagaa

SEQ ID NO: 368985 - RNA, 19 nt, Homo sapiens
gaaugggccguuaggagua

SEQ ID NO: 368986 - RNA, 19 nt, Homo sapiens
ggacaaguuugacgagaac

SEQ ID NO: 368987 - RNA, 19 nt, Homo sapiens
agaagaaccagauuacaaa

SEQ ID NO: 368988 - RNA, 19 nt, Homo sapiens
caagauccaacuuaucaaa

SEQ ID NO: 368989 - RNA, 19 nt, Homo sapiens
agaguagacuucaauguuc

SEQ ID NO: 368990 - RNA, 19 nt, Homo sapiens
ucccaugccugacaaauau

SEQ ID NO: 368991 - RNA, 19 nt, Homo sapiens
gaaccaaagcccucaugga

SEQ ID NO: 368992 - RNA, 19 nt, Homo sapiens
gauuauuggugguggaaug

SEQ ID NO: 368993 - RNA, 19 nt, Homo sapiens
agaaccagauuacaaacaa

SEQ ID NO: 368994 - RNA, 19 nt, Homo sapiens
gccaagaucccucuggaaa

SEQ ID NO: 368995 - RNA, 19 nt, Homo sapiens
cgagaacgcucagguugga

SEQ ID NO: 368996 - RNA, 19 nt, Homo sapiens
ccaaauggaacacugaaga

SEQ ID NO: 368997 - RNA, 19 nt, Homo sapiens
caaaguggcagacaagauc

SEQ ID NO: 368998 - RNA, 19 nt, Homo sapiens
ccauaaagcauccggauuc

SEQ ID NO: 368999 - RNA, 19 nt, Homo sapiens
gagugaaucugccccauaa

SEQ ID NO: 369000 - RNA, 19 nt, Homo sapiens
gcgcagaaguggagaaagc

SEQ ID NO: 369001 - RNA, 19 nt, Homo sapiens
aagaaugguguaaggauua

SEQ ID NO: 369002 - RNA, 19 nt, Homo sapiens
gcucaagcaaggcuaauug

SEQ ID NO: 369003 - RNA, 19 nt, Homo sapiens
uagacaaacuggauguuag

SEQ ID NO: 369004 - RNA, 19 nt, Homo sapiens
ggcaguaguucuuaugagu

SEQ ID NO: 369005 - RNA, 19 nt, Homo sapiens
gaacacugaagauaaaguc

SEQ ID NO: 369006 - RNA, 19 nt, Homo sapiens
ccaaggcaguaguucuuau

SEQ ID NO: 369007 - RNA, 19 nt, Homo sapiens
uaaaauccuuccuggagua

SEQ ID NO: 369008 - RNA, 19 nt, Homo sapiens
gaagaagaaccagauuaca

SEQ ID NO: 369009 - RNA, 19 nt, Homo sapiens
aagaagaaccagauuacaa

SEQ ID NO: 369010 - RNA, 19 nt, Homo sapiens
ucaacaacauggagauugg

SEQ ID NO: 369011 - RNA, 19 nt, Homo sapiens
ucaauguucccaugaagaa

SEQ ID NO: 369012 - RNA, 19 nt, Homo sapiens
caaggcuaauuguuuggaa

SEQ ID NO: 369013 - RNA, 19 nt, Homo sapiens
caauggagccaaggcagua

SEQ ID NO: 369014 - RNA, 19 nt, Homo sapiens
gagggagccaagaucguua

SEQ ID NO: 369015 - RNA, 19 nt, Homo sapiens
gaagggaagggccaagauc

SEQ ID NO: 369016 - RNA, 19 nt, Homo sapiens
auggaacacugaagauaaa

SEQ ID NO: 369017 - RNA, 19 nt, Homo sapiens
gaaccugcgcuuucaugug

SEQ ID NO: 369018 - RNA, 19 nt, Homo sapiens
caguaguucuuaugaguca

SEQ ID NO: 369019 - RNA, 19 nt, Homo sapiens
aauggaacacugaagauaa

SEQ ID NO: 369020 - RNA, 19 nt, Homo sapiens
uguagcaucuggcauaucu

SEQ ID NO: 369021 - RNA, 19 nt, Homo sapiens
gaaccagauuacaaacaac

SEQ ID NO: 369022 - RNA, 19 nt, Homo sapiens
aaauggaacacugaagaua

SEQ ID NO: 369023 - RNA, 19 nt, Homo sapiens
uuaaagcugagccagauaa

SEQ ID NO: 369024 - RNA, 19 nt, Homo sapiens
uuagacaaacuggauguua

SEQ ID NO: 369025 - RNA, 19 nt, Homo sapiens
caaauggaacacugaagau

SEQ ID NO: 369026 - RNA, 19 nt, Homo sapiens
guggagacacugcuacuug

SEQ ID NO: 369027 - RNA, 19 nt, Homo sapiens
gagagcaacaagaaucaug

SEQ ID NO: 369028 - RNA, 19 nt, Homo sapiens
gagaaccugcgcuuucaug

SEQ ID NO: 369029 - RNA, 19 nt, Homo sapiens
gaugaagaaggaacuagau

SEQ ID NO: 369030 - RNA, 19 nt, Homo sapiens
gcuuucauguggaggaaga

SEQ ID NO: 369031 - RNA, 19 nt, Homo sapiens
uaucauggccaaagcacaa

SEQ ID NO: 369032 - RNA, 19 nt, Homo sapiens
uuaagguacucaacaacau

SEQ ID NO: 369033 - RNA, 19 nt, Homo sapiens
uggcuuauaccuuccuuaa

SEQ ID NO: 369034 - RNA, 19 nt, Homo sapiens
acaaacaaccagaggauca

SEQ ID NO: 369035 - RNA, 19 nt, Homo sapiens
ugaagaagaaccagauuac

SEQ ID NO: 369036 - RNA, 19 nt, Homo sapiens
gccaaggcaguaguucuua

SEQ ID NO: 369037 - RNA, 19 nt, Homo sapiens
aaaauaugcuggacaaagu

SEQ ID NO: 369038 - RNA, 19 nt, Homo sapiens
gcuacuugcugugccaaau

SEQ ID NO: 369039 - RNA, 19 nt, Homo sapiens
uggagaaccugcgcuuuca

SEQ ID NO: 369040 - RNA, 19 nt, Homo sapiens
aagauaaagucagccaugu

SEQ ID NO: 369041 - RNA, 19 nt, Homo sapiens
aaccaaagcccucauggau

SEQ ID NO: 369042 - RNA, 19 nt, Homo sapiens
ugaaugggaugccuuugcu

SEQ ID NO: 369043 - RNA, 19 nt, Homo sapiens
acaagaaucaugcucaagu

SEQ ID NO: 369044 - RNA, 19 nt, Homo sapiens
gacaaagucaaugagauga

SEQ ID NO: 369045 - RNA, 19 nt, Homo sapiens
gggcugcaucacuguuaua

SEQ ID NO: 369046 - RNA, 19 nt, Homo sapiens
guccugagagcaacaagaa

SEQ ID NO: 369047 - RNA, 19 nt, Homo sapiens
cacuguagcaucuggcaua

SEQ ID NO: 369048 - RNA, 19 nt, Homo sapiens
gaagaaccagauuacaaac

SEQ ID NO: 369049 - RNA, 19 nt, Homo sapiens
agacaaacuggauguuaga

SEQ ID NO: 369050 - RNA, 19 nt, Homo sapiens
caaggcaguaguucuuaug

SEQ ID NO: 369051 - RNA, 19 nt, Homo sapiens
gcaagacaauugaagaaua

SEQ ID NO: 369052 - RNA, 19 nt, Homo sapiens
uaaagaagauccucuguga

SEQ ID NO: 369053 - RNA, 19 nt, Homo sapiens
ggagaaggccgauaacuuu

SEQ ID NO: 369054 - RNA, 19 nt, Homo sapiens
gaaggacguugccaagauu

SEQ ID NO: 369055 - RNA, 19 nt, Homo sapiens
gaaaguagaccuugguguu

SEQ ID NO: 369056 - RNA, 19 nt, Homo sapiens
caagucaucugauugaaga

SEQ ID NO: 369057 - RNA, 19 nt, Homo sapiens
guacuuggcuacagauuuc

SEQ ID NO: 369058 - RNA, 19 nt, Homo sapiens
ggaagcaguucucagcaaa

SEQ ID NO: 369059 - RNA, 19 nt, Homo sapiens
ugagaagcaucuuugauuu

SEQ ID NO: 369060 - RNA, 19 nt, Homo sapiens
gcuguauccugcaucauua

SEQ ID NO: 369061 - RNA, 19 nt, Homo sapiens
gugaagaucgugacaguua

SEQ ID NO: 369062 - RNA, 19 nt, Homo sapiens
agacaggccugauguggua

SEQ ID NO: 369063 - RNA, 19 nt, Homo sapiens
gauggaagcauuucaagaa

SEQ ID NO: 369064 - RNA, 19 nt, Homo sapiens
gaaagcagcaguuugacuu

SEQ ID NO: 369065 - RNA, 19 nt, Homo sapiens
cagaagcaauaacugauaa

SEQ ID NO: 369066 - RNA, 19 nt, Homo sapiens
gaaaugauggugcaaguuc

SEQ ID NO: 369067 - RNA, 19 nt, Homo sapiens
caaaucagcaagacaauug

SEQ ID NO: 369068 - RNA, 19 nt, Homo sapiens
ggaauuucuucaccaggua

SEQ ID NO: 369069 - RNA, 19 nt, Homo sapiens
gaaggccgauaacuuugaa

SEQ ID NO: 369070 - RNA, 19 nt, Homo sapiens
cgaaucgucuuccgacuga

SEQ ID NO: 369071 - RNA, 19 nt, Homo sapiens
cagcaaaugacaaaguuua

SEQ ID NO: 369072 - RNA, 19 nt, Homo sapiens
gccaacaucuucagcauuc

SEQ ID NO: 369073 - RNA, 19 nt, Homo sapiens
aagcauggguucuuuguga

SEQ ID NO: 369074 - RNA, 19 nt, Homo sapiens
gaagauccucugugaagaa

SEQ ID NO: 369075 - RNA, 19 nt, Homo sapiens
gauguuugaucgcuccuuu

SEQ ID NO: 369076 - RNA, 19 nt, Homo sapiens
ggaagcgggugaagguguu

SEQ ID NO: 369077 - RNA, 19 nt, Homo sapiens
gggcaagcauggguucuuu

SEQ ID NO: 369078 - RNA, 19 nt, Homo sapiens
guggguauuugucuccuua

SEQ ID NO: 369079 - RNA, 19 nt, Homo sapiens
gcccugaccugaaaguaga

SEQ ID NO: 369080 - RNA, 19 nt, Homo sapiens
guacaucgauagcuaugag

SEQ ID NO: 369081 - RNA, 19 nt, Homo sapiens
ggaggacauucucaaagau

SEQ ID NO: 369082 - RNA, 19 nt, Homo sapiens
gaccguauguaaagaagau

SEQ ID NO: 369083 - RNA, 19 nt, Homo sapiens
gcaaguuccuuucucuuuu

SEQ ID NO: 369084 - RNA, 19 nt, Homo sapiens
aagaggaccugcgggcuua

SEQ ID NO: 369085 - RNA, 19 nt, Homo sapiens
gggaagcaguucucagcaa

SEQ ID NO: 369086 - RNA, 19 nt, Homo sapiens
acacagauauuuugggaua

SEQ ID NO: 369087 - RNA, 19 nt, Homo sapiens
ccacugucaucaccuaaga

SEQ ID NO: 369088 - RNA, 19 nt, Homo sapiens
uggaggacauucucaaaga

SEQ ID NO: 369089 - RNA, 19 nt, Homo sapiens
uggauucgguagaagcuua

SEQ ID NO: 369090 - RNA, 19 nt, Homo sapiens
ccagaagcaauaacugaua

SEQ ID NO: 369091 - RNA, 19 nt, Homo sapiens
ugaagaucgugacaguuaa

SEQ ID NO: 369092 - RNA, 19 nt, Homo sapiens
agaaggacguugccaagau

SEQ ID NO: 369093 - RNA, 19 nt, Homo sapiens
ugaagaauaugcaguuugc

SEQ ID NO: 369094 - RNA, 19 nt, Homo sapiens
gccgauaacuuugaauaca

SEQ ID NO: 369095 - RNA, 19 nt, Homo sapiens
agaagcaucuuugauuuca

SEQ ID NO: 369096 - RNA, 19 nt, Homo sapiens
uggaggcccugauguuuga

SEQ ID NO: 369097 - RNA, 19 nt, Homo sapiens
ccacauccgugagaaagau

SEQ ID NO: 369098 - RNA, 19 nt, Homo sapiens
gagaagcaucuuugauuuc

SEQ ID NO: 369099 - RNA, 19 nt, Homo sapiens
agacguacuuggcuacaga

SEQ ID NO: 369100 - RNA, 19 nt, Homo sapiens
gagcaucagcagugaguga

SEQ ID NO: 369101 - RNA, 19 nt, Homo sapiens
gcagcaguuugacuuggaa

SEQ ID NO: 369102 - RNA, 19 nt, Homo sapiens
uauccugcaucauuagaaa

SEQ ID NO: 369103 - RNA, 19 nt, Homo sapiens
ggacuuggaggcccugaug

SEQ ID NO: 369104 - RNA, 19 nt, Homo sapiens
caaacaaaaugaugaagga

SEQ ID NO: 369105 - RNA, 19 nt, Homo sapiens
gagaacuucauccagagua

SEQ ID NO: 369106 - RNA, 19 nt, Homo sapiens
uugaagagcaugacagaaa

SEQ ID NO: 369107 - RNA, 19 nt, Homo sapiens
gagaaggccgauaacuuug

SEQ ID NO: 369108 - RNA, 19 nt, Homo sapiens
gacgagcagugcauuuaca

SEQ ID NO: 369109 - RNA, 19 nt, Homo sapiens
cugagaagcaucuuugauu

SEQ ID NO: 369110 - RNA, 19 nt, Homo sapiens
caguggaaauuguggauuc

SEQ ID NO: 369111 - RNA, 19 nt, Homo sapiens
cuuaggauguggcaaugaa

SEQ ID NO: 369112 - RNA, 19 nt, Homo sapiens
uaagaagacaggccugaug

SEQ ID NO: 369113 - RNA, 19 nt, Homo sapiens
ggcuagugcuacaaagauu

SEQ ID NO: 369114 - RNA, 19 nt, Homo sapiens
ugucauugcugccaacauc

SEQ ID NO: 369115 - RNA, 19 nt, Homo sapiens
gcaagcauggguucuuugu

SEQ ID NO: 369116 - RNA, 19 nt, Homo sapiens
caacuacgcggagaacuuc

SEQ ID NO: 369117 - RNA, 19 nt, Homo sapiens
gggccaaaccgacugaaga

SEQ ID NO: 369118 - RNA, 19 nt, Homo sapiens
ugggaaagcagcaguuuga

SEQ ID NO: 369119 - RNA, 19 nt, Homo sapiens
cagcaagacaauugaagaa

SEQ ID NO: 369120 - RNA, 19 nt, Homo sapiens
gauugaagagcaugacaga

SEQ ID NO: 369121 - RNA, 19 nt, Homo sapiens
ggcuguacaucgauagcua

SEQ ID NO: 369122 - RNA, 19 nt, Homo sapiens
gcaaaaguauggccggaau

SEQ ID NO: 369123 - RNA, 19 nt, Homo sapiens
ggauguggcaaugaaauga

SEQ ID NO: 369124 - RNA, 19 nt, Homo sapiens
ggauggaagcauuucaaga

SEQ ID NO: 369125 - RNA, 19 nt, Homo sapiens
gcaaaugacaaaguuuaca

SEQ ID NO: 369126 - RNA, 19 nt, Homo sapiens
gcgagcaaacugucccuuu

SEQ ID NO: 369127 - RNA, 19 nt, Homo sapiens
guugugggaccguauguaa

SEQ ID NO: 369128 - RNA, 19 nt, Homo sapiens
cgggaucggucgcuugguu

SEQ ID NO: 369129 - RNA, 19 nt, Homo sapiens
cauuuccuguuuacaugua

SEQ ID NO: 369130 - RNA, 19 nt, Homo sapiens
ccauccaagucaucugauu

SEQ ID NO: 369131 - RNA, 19 nt, Homo sapiens
gagaaggacguugccaaga

SEQ ID NO: 369132 - RNA, 19 nt, Homo sapiens
guucucagcaaaugacaaa

SEQ ID NO: 369133 - RNA, 19 nt, Homo sapiens
gaccgguucugaccacauc

SEQ ID NO: 369134 - RNA, 19 nt, Homo sapiens
gauccucugugaagaacuc

SEQ ID NO: 369135 - RNA, 19 nt, Homo sapiens
aagaagauccucugugaag

SEQ ID NO: 369136 - RNA, 19 nt, Homo sapiens
aggccauucuucauccuua

SEQ ID NO: 369137 - RNA, 19 nt, Homo sapiens
gaucaaucucaauuccuuu

SEQ ID NO: 369138 - RNA, 19 nt, Homo sapiens
gagcaugacagaaacaaaa

SEQ ID NO: 369139 - RNA, 19 nt, Homo sapiens
ugaagagcaugacagaaac

SEQ ID NO: 369140 - RNA, 19 nt, Homo sapiens
aagcaguucucagcaaaug

SEQ ID NO: 369141 - RNA, 19 nt, Homo sapiens
ucagguacaguuuacacua

SEQ ID NO: 369142 - RNA, 19 nt, Homo sapiens
gaagagcaugacagaaaca

SEQ ID NO: 369143 - RNA, 19 nt, Homo sapiens
gaagaucgugacaguuaag

SEQ ID NO: 369144 - RNA, 19 nt, Homo sapiens
cccaguggauggaagcauu

SEQ ID NO: 369145 - RNA, 19 nt, Homo sapiens
aagauugcuuuguaugaga

SEQ ID NO: 369146 - RNA, 19 nt, Homo sapiens
ggugcaaguuccuuucucu

SEQ ID NO: 369147 - RNA, 19 nt, Homo sapiens
ccaaaucagcaagacaauu

SEQ ID NO: 369148 - RNA, 19 nt, Homo sapiens
ugagugaggccauucuuca

SEQ ID NO: 369149 - RNA, 19 nt, Homo sapiens
gguggagcaucagcaguga

SEQ ID NO: 369150 - RNA, 19 nt, Homo sapiens
gcacugcacccacugucau

SEQ ID NO: 369151 - RNA, 19 nt, Homo sapiens
ggagaaaguuugaauauug

SEQ ID NO: 369152 - RNA, 19 nt, Homo sapiens
ccacaaggcucaagaguuu

SEQ ID NO: 369153 - RNA, 19 nt, Homo sapiens
caagaugccuuuguaguua

SEQ ID NO: 369154 - RNA, 19 nt, Homo sapiens
gaagugagcuuggcaguau

SEQ ID NO: 369155 - RNA, 19 nt, Homo sapiens
ggacuuaaguauacaauuc

SEQ ID NO: 369156 - RNA, 19 nt, Homo sapiens
cagaacaacuggaagauaa

SEQ ID NO: 369157 - RNA, 19 nt, Homo sapiens
gaaagaagcugugaaucug

SEQ ID NO: 369158 - RNA, 19 nt, Homo sapiens
gaagcagacucacaagaaa

SEQ ID NO: 369159 - RNA, 19 nt, Homo sapiens
ucaaugaccuggugaagaa

SEQ ID NO: 369160 - RNA, 19 nt, Homo sapiens
gaagcaaucuuggcucuga

SEQ ID NO: 369161 - RNA, 19 nt, Homo sapiens
gaagguaccugucuauugc

SEQ ID NO: 369162 - RNA, 19 nt, Homo sapiens
gaauauugguguuguacaa

SEQ ID NO: 369163 - RNA, 19 nt, Homo sapiens
guacagcuguugaaaugaa

SEQ ID NO: 369164 - RNA, 19 nt, Homo sapiens
gcauggcacugcacuguuu

SEQ ID NO: 369165 - RNA, 19 nt, Homo sapiens
gaauacagaucacuuaagg

SEQ ID NO: 369166 - RNA, 19 nt, Homo sapiens
gaggucaauuccaugauua

SEQ ID NO: 369167 - RNA, 19 nt, Homo sapiens
gcacugcacuguuuaguac

SEQ ID NO: 369168 - RNA, 19 nt, Homo sapiens
ggaggucaauuccaugauu

SEQ ID NO: 369169 - RNA, 19 nt, Homo sapiens
gcagacaggagaguuauua

SEQ ID NO: 369170 - RNA, 19 nt, Homo sapiens
uaagggaaauggaacacua

SEQ ID NO: 369171 - RNA, 19 nt, Homo sapiens
ggauuuaggugcuauuaca

SEQ ID NO: 369172 - RNA, 19 nt, Homo sapiens
caguucagcuguuuaauga

SEQ ID NO: 369173 - RNA, 19 nt, Homo sapiens
gaagaugucguccgaguau

SEQ ID NO: 369174 - RNA, 19 nt, Homo sapiens
cagaucaccuugcacauga

SEQ ID NO: 369175 - RNA, 19 nt, Homo sapiens
gggaugcucucuauacaga

SEQ ID NO: 369176 - RNA, 19 nt, Homo sapiens
gaugaauacagaucacuua

SEQ ID NO: 369177 - RNA, 19 nt, Homo sapiens
ccacagggaauggaaauua

SEQ ID NO: 369178 - RNA, 19 nt, Homo sapiens
gugaagaaguacaagcuuu

SEQ ID NO: 369179 - RNA, 19 nt, Homo sapiens
caagauagcaacguuaauu

SEQ ID NO: 369180 - RNA, 19 nt, Homo sapiens
gagacaagauagcaacguu

SEQ ID NO: 369181 - RNA, 19 nt, Homo sapiens
ggaaauggaacacuacuuc

SEQ ID NO: 369182 - RNA, 19 nt, Homo sapiens
gggcaaacucaaucauuua

SEQ ID NO: 369183 - RNA, 19 nt, Homo sapiens
uaguacagcuguugaaaug

SEQ ID NO: 369184 - RNA, 19 nt, Homo sapiens
acagaucacuuaagguuga

SEQ ID NO: 369185 - RNA, 19 nt, Homo sapiens
gcacuaagacugguguaaa

SEQ ID NO: 369186 - RNA, 19 nt, Homo sapiens
caacguuaauuagcaguuu

SEQ ID NO: 369187 - RNA, 19 nt, Homo sapiens
ggaacaagauaugcagaga

SEQ ID NO: 369188 - RNA, 19 nt, Homo sapiens
ggaagacaaugguguaaaa

SEQ ID NO: 369189 - RNA, 19 nt, Homo sapiens
gagaaaguuugaauauugg

SEQ ID NO: 369190 - RNA, 19 nt, Homo sapiens
ccaauggacugauccuuca

SEQ ID NO: 369191 - RNA, 19 nt, Homo sapiens
gcagaacaacuggaagaua

SEQ ID NO: 369192 - RNA, 19 nt, Homo sapiens
guaccugucuauugcacua

SEQ ID NO: 369193 - RNA, 19 nt, Homo sapiens
aaacacggguggccgauau

SEQ ID NO: 369194 - RNA, 19 nt, Homo sapiens
gaacgaaggcagaacaucu

SEQ ID NO: 369195 - RNA, 19 nt, Homo sapiens
gcugaaagacaagcaguua

SEQ ID NO: 369196 - RNA, 19 nt, Homo sapiens
auacgggacugcuggauuu

SEQ ID NO: 369197 - RNA, 19 nt, Homo sapiens
guucagcuguuuaaugaug

SEQ ID NO: 369198 - RNA, 19 nt, Homo sapiens
gcaggcuacuggaaaauua

SEQ ID NO: 369199 - RNA, 19 nt, Homo sapiens
ugaagaaguuaugaaggua

SEQ ID NO: 369200 - RNA, 19 nt, Homo sapiens
gacaagauagcaacguuaa

SEQ ID NO: 369201 - RNA, 19 nt, Homo sapiens
cacagggaauggaaauuaa

SEQ ID NO: 369202 - RNA, 19 nt, Homo sapiens
ugaugcagauggccacuuu

SEQ ID NO: 369203 - RNA, 19 nt, Homo sapiens
gcagacagaauuguuuauu

SEQ ID NO: 369204 - RNA, 19 nt, Homo sapiens
guaguuauugguagagaua

SEQ ID NO: 369205 - RNA, 19 nt, Homo sapiens
ugauggagaugcagacaga

SEQ ID NO: 369206 - RNA, 19 nt, Homo sapiens
caguggagaugaauacaga

SEQ ID NO: 369207 - RNA, 19 nt, Homo sapiens
auacagaucuuccaaacag

SEQ ID NO: 369208 - RNA, 19 nt, Homo sapiens
gccuuacacuuguuaaaga

SEQ ID NO: 369209 - RNA, 19 nt, Homo sapiens
aauaauggcaguacuaaga

SEQ ID NO: 369210 - RNA, 19 nt, Homo sapiens
gaacaacuggaagauaaga

SEQ ID NO: 369211 - RNA, 19 nt, Homo sapiens
ggaaauuaaguccaaugaa

SEQ ID NO: 369212 - RNA, 19 nt, Homo sapiens
ccagguuucugaagauaau

SEQ ID NO: 369213 - RNA, 19 nt, Homo sapiens
gaagcuaagggaaauggaa

SEQ ID NO: 369214 - RNA, 19 nt, Homo sapiens
caaugcagccuacuggauu

SEQ ID NO: 369215 - RNA, 19 nt, Homo sapiens
acagugggaugcucucuau

SEQ ID NO: 369216 - RNA, 19 nt, Homo sapiens
aagaaaagcugcuaagaug

SEQ ID NO: 369217 - RNA, 19 nt, Homo sapiens
ggagaugcagacagaauug

SEQ ID NO: 369218 - RNA, 19 nt, Homo sapiens
agggcaaacucaaucauuu

SEQ ID NO: 369219 - RNA, 19 nt, Homo sapiens
aggcaacuauagaagguua

SEQ ID NO: 369220 - RNA, 19 nt, Homo sapiens
ggacugauccuucaauacg

SEQ ID NO: 369221 - RNA, 19 nt, Homo sapiens
gguaacagcgucccacaau

SEQ ID NO: 369222 - RNA, 19 nt, Homo sapiens
gcagaucaccuugcacaug

SEQ ID NO: 369223 - RNA, 19 nt, Homo sapiens
ccaaacagacaacuuaaag

SEQ ID NO: 369224 - RNA, 19 nt, Homo sapiens
gagauuggagaaaguuuga

SEQ ID NO: 369225 - RNA, 19 nt, Homo sapiens
gaagguuacuaccagaaac

SEQ ID NO: 369226 - RNA, 19 nt, Homo sapiens
cgagaaagaagcugugaau

SEQ ID NO: 369227 - RNA, 19 nt, Homo sapiens
ugaagguaccugucuauug

SEQ ID NO: 369228 - RNA, 19 nt, Homo sapiens
gaugcagacagaauuguuu

SEQ ID NO: 369229 - RNA, 19 nt, Homo sapiens
uguaauagauggugugacu

SEQ ID NO: 369230 - RNA, 19 nt, Homo sapiens
gaaggcagaacaucuugau

SEQ ID NO: 369231 - RNA, 19 nt, Homo sapiens
ggaaaggcaacuauagaag

SEQ ID NO: 369232 - RNA, 19 nt, Homo sapiens
gauugucucuagaucuguu

SEQ ID NO: 369233 - RNA, 19 nt, Homo sapiens
agaagcagacucacaagaa

SEQ ID NO: 369234 - RNA, 19 nt, Homo sapiens
ggagauuggagaaaguuug

SEQ ID NO: 369235 - RNA, 19 nt, Homo sapiens
cugaagggcuugacuguac

SEQ ID NO: 369236 - RNA, 19 nt, Homo sapiens
auacagaucacuuaagguu

SEQ ID NO: 369237 - RNA, 19 nt, Homo sapiens
gauauggaaaggcaacuau

SEQ ID NO: 369238 - RNA, 19 nt, Homo sapiens
gaaacacggguggccgaua

SEQ ID NO: 369239 - RNA, 19 nt, Homo sapiens
agaaagaagcugugaaucu

SEQ ID NO: 369240 - RNA, 19 nt, Homo sapiens
ugaccgagacauggauuua

SEQ ID NO: 369241 - RNA, 19 nt, Homo sapiens
guauacaauucagucacua

SEQ ID NO: 369242 - RNA, 19 nt, Homo sapiens
ccgaguauaugcagaagca

SEQ ID NO: 369243 - RNA, 19 nt, Homo sapiens
cuuccaaacagacaacuua

SEQ ID NO: 369244 - RNA, 19 nt, Homo sapiens
gaugcucucuauacagauc

SEQ ID NO: 369245 - RNA, 19 nt, Homo sapiens
gcuguugaaaugaagauaa

SEQ ID NO: 369246 - RNA, 19 nt, Homo sapiens
guaacagcgucccacaauc

SEQ ID NO: 369247 - RNA, 19 nt, Homo sapiens
aaaggcaacuauagaaggu

SEQ ID NO: 369248 - RNA, 19 nt, Homo sapiens
agagagugcuuauugacau

SEQ ID NO: 369249 - RNA, 19 nt, Homo sapiens
gauaugcagagagugcuua

SEQ ID NO: 369250 - RNA, 19 nt, Homo sapiens
caaaugcugaggaacaaga

SEQ ID NO: 369251 - RNA, 19 nt, Homo sapiens
ggagugaaguuuaauguug

SEQ ID NO: 369252 - RNA, 19 nt, Homo sapiens
gcaaaacgauugaggaaua

SEQ ID NO: 369253 - RNA, 19 nt, Homo sapiens
caaugaaggucccuguaua

SEQ ID NO: 369254 - RNA, 19 nt, Homo sapiens
gaaaggaggagaauaugga

SEQ ID NO: 369255 - RNA, 19 nt, Homo sapiens
gggauuggacgacugauua

SEQ ID NO: 369256 - RNA, 19 nt, Homo sapiens
ccacuacuauugcagguuu

SEQ ID NO: 369257 - RNA, 19 nt, Homo sapiens
gaaggucccuguauaugag

SEQ ID NO: 369258 - RNA, 19 nt, Homo sapiens
ggacagaguggccaaauca

SEQ ID NO: 369259 - RNA, 19 nt, Homo sapiens
caaggcagcugguggaauc

SEQ ID NO: 369260 - RNA, 19 nt, Homo sapiens
acaagaauuugaccuagaa

SEQ ID NO: 369261 - RNA, 19 nt, Homo sapiens
gacaagaauuugaccuaga

SEQ ID NO: 369262 - RNA, 19 nt, Homo sapiens
aaacagggccuaaggauca

SEQ ID NO: 369263 - RNA, 19 nt, Homo sapiens
ucucuugcauuccauauuu

SEQ ID NO: 369264 - RNA, 19 nt, Homo sapiens
gaaguuuaauguugccaau

SEQ ID NO: 369265 - RNA, 19 nt, Homo sapiens
acagacaaauccuucauug

SEQ ID NO: 369266 - RNA, 19 nt, Homo sapiens
gaaaaguucugugugauga

SEQ ID NO: 369267 - RNA, 19 nt, Homo sapiens
uaugggaccuuaugugaga

SEQ ID NO: 369268 - RNA, 19 nt, Homo sapiens
caacugaagauucgcauug

SEQ ID NO: 369269 - RNA, 19 nt, Homo sapiens
ggaggaaauuguccgagau

SEQ ID NO: 369270 - RNA, 19 nt, Homo sapiens
gacaaaaucuaccaaauca

SEQ ID NO: 369271 - RNA, 19 nt, Homo sapiens
gccaaccucucuugcauuc

SEQ ID NO: 369272 - RNA, 19 nt, Homo sapiens
ccugcggucuccugcauua

SEQ ID NO: 369273 - RNA, 19 nt, Homo sapiens
ggaggagaauauggauuug

SEQ ID NO: 369274 - RNA, 19 nt, Homo sapiens
gaguuuggagugaaguuua

SEQ ID NO: 369275 - RNA, 19 nt, Homo sapiens
gcacugugaccaagaaaca

SEQ ID NO: 369276 - RNA, 19 nt, Homo sapiens
ggacccagccaacugaaga

SEQ ID NO: 369277 - RNA, 19 nt, Homo sapiens
cgagaucacugggccaaau

SEQ ID NO: 369278 - RNA, 19 nt, Homo sapiens
ugaaggucccuguauauga

SEQ ID NO: 369279 - RNA, 19 nt, Homo sapiens
caaauucaaaccauucaga

SEQ ID NO: 369280 - RNA, 19 nt, Homo sapiens
gaagcagaguguggaggaa

SEQ ID NO: 369281 - RNA, 19 nt, Homo sapiens
gcauggcccuggacagagu

SEQ ID NO: 369282 - RNA, 19 nt, Homo sapiens
ggaguuaugggaccuuaug

SEQ ID NO: 369283 - RNA, 19 nt, Homo sapiens
gaagacggauaguuuugaa

SEQ ID NO: 369284 - RNA, 19 nt, Homo sapiens
uggcgaagacggauaguuu

SEQ ID NO: 369285 - RNA, 19 nt, Homo sapiens
ggacagaauggcaucuugu

SEQ ID NO: 369286 - RNA, 19 nt, Homo sapiens
caaccucucuugcauucca

SEQ ID NO: 369287 - RNA, 19 nt, Homo sapiens
guuaugggaccuuauguga

SEQ ID NO: 369288 - RNA, 19 nt, Homo sapiens
gauugaggaauaugcuaua

SEQ ID NO: 369289 - RNA, 19 nt, Homo sapiens
aaugaaaggaggagaauau

SEQ ID NO: 369290 - RNA, 19 nt, Homo sapiens
gacccaaaccugacauaug

SEQ ID NO: 369291 - RNA, 19 nt, Homo sapiens
aaauaucccagauucauga

SEQ ID NO: 369292 - RNA, 19 nt, Homo sapiens
gaaauuguccgagaucacu

SEQ ID NO: 369293 - RNA, 19 nt, Homo sapiens
ggaccaucuuugacuuuca

SEQ ID NO: 369294 - RNA, 19 nt, Homo sapiens
cccaagacgacauauuaua

SEQ ID NO: 369295 - RNA, 19 nt, Homo sapiens
ggacucaggacguugcaau

SEQ ID NO: 369296 - RNA, 19 nt, Homo sapiens
gcaaugaaaggaggagaau

SEQ ID NO: 369297 - RNA, 19 nt, Homo sapiens
gucuggcucuccauuauug

SEQ ID NO: 369298 - RNA, 19 nt, Homo sapiens
ucaggacguugcaaucugu

SEQ ID NO: 369299 - RNA, 19 nt, Homo sapiens
ucaaugaaggucccuguau

SEQ ID NO: 369300 - RNA, 19 nt, Homo sapiens
gcagcacccugacccaaac

SEQ ID NO: 369301 - RNA, 19 nt, Homo sapiens
ccagccaauucugcaauaa

SEQ ID NO: 369302 - RNA, 19 nt, Homo sapiens
gaccaucuuugacuuucau

SEQ ID NO: 369303 - RNA, 19 nt, Homo sapiens
gauaguggacccaguggau

SEQ ID NO: 369304 - RNA, 19 nt, Homo sapiens
ggacggccaucgagaucgu

SEQ ID NO: 369305 - RNA, 19 nt, Homo sapiens
gagaucacugggccaaauu

SEQ ID NO: 369306 - RNA, 19 nt, Homo sapiens
cagaguggccaaaucaaug

SEQ ID NO: 369307 - RNA, 19 nt, Homo sapiens
ggacccaguggauaucuau

SEQ ID NO: 369308 - RNA, 19 nt, Homo sapiens
gaaaauaucccagauucau

SEQ ID NO: 369309 - RNA, 19 nt, Homo sapiens
gcggucuccugcauuauca

SEQ ID NO: 369310 - RNA, 19 nt, Homo sapiens
cgacuaggaagacaagaau

SEQ ID NO: 369311 - RNA, 19 nt, Homo sapiens
gggccacccucagacugua

SEQ ID NO: 369312 - RNA, 19 nt, Homo sapiens
gaucacugggccaaauuug

SEQ ID NO: 369313 - RNA, 19 nt, Homo sapiens
aggagaauauggauuugga

SEQ ID NO: 369314 - RNA, 19 nt, Homo sapiens
aggaggagaauauggauuu

SEQ ID NO: 369315 - RNA, 19 nt, Homo sapiens
cccagccaauucugcaaua

SEQ ID NO: 369316 - RNA, 19 nt, Homo sapiens
gcaaugcacggaguuaugg

SEQ ID NO: 369317 - RNA, 19 nt, Homo sapiens
acuaggaagacaagaauuu

SEQ ID NO: 369318 - RNA, 19 nt, Homo sapiens
caagaaacagggccuaagg

SEQ ID NO: 369319 - RNA, 19 nt, Homo sapiens
uggaggcccuggucacaga

SEQ ID NO: 369320 - RNA, 19 nt, Homo sapiens
gcaggacggccaucgagau

SEQ ID NO: 369321 - RNA, 19 nt, Homo sapiens
uauaugauccuaggccaaa

SEQ ID NO: 369322 - RNA, 19 nt, Homo sapiens
cacccgauguugucucaga

SEQ ID NO: 369323 - RNA, 19 nt, Homo sapiens
gauuuggagcugcauuuga

SEQ ID NO: 369324 - RNA, 19 nt, Homo sapiens
acccaaaccugacauaugc

SEQ ID NO: 369325 - RNA, 19 nt, Homo sapiens
ucauagccaucgcacugaa

SEQ ID NO: 369326 - RNA, 19 nt, Homo sapiens
ggcagcugguggaaucauu

SEQ ID NO: 369327 - RNA, 19 nt, Homo sapiens
cagcauggcccuggacaga

SEQ ID NO: 369328 - RNA, 19 nt, Homo sapiens
ggaccguuauaugauccua

SEQ ID NO: 369329 - RNA, 19 nt, Homo sapiens
ggauuggacgacugauuau

SEQ ID NO: 369330 - RNA, 19 nt, Homo sapiens
gaucccaagacgacauauu

SEQ ID NO: 369331 - RNA, 19 nt, Homo sapiens
gacggcagguacuuuagca

SEQ ID NO: 369332 - RNA, 19 nt, Homo sapiens
ccagcuggauggagauucu

SEQ ID NO: 369333 - RNA, 19 nt, Homo sapiens
gggagaguuuggagugaag

SEQ ID NO: 369334 - RNA, 19 nt, Homo sapiens
ugcaacgacucuucuggaa

SEQ ID NO: 369335 - RNA, 19 nt, Homo sapiens
aucccaagacgacauauua

SEQ ID NO: 369336 - RNA, 19 nt, Homo sapiens
gcagaguguggaggaaauu

SEQ ID NO: 369337 - RNA, 19 nt, Homo sapiens
ggucuggcucuccauuauu

SEQ ID NO: 369338 - RNA, 19 nt, Homo sapiens
cagccaauucugcaauaaa

SEQ ID NO: 369339 - RNA, 19 nt, Homo sapiens
caucaaggguuugcugacu

SEQ ID NO: 369340 - RNA, 19 nt, Homo sapiens
ugacuuucaugccaucaag

SEQ ID NO: 369341 - RNA, 19 nt, Homo sapiens
uaugcuauauguccugauc

SEQ ID NO: 369342 - RNA, 19 nt, Homo sapiens
aaugaaggucccuguauau

SEQ ID NO: 369343 - RNA, 19 nt, Homo sapiens
gauggggaccguuauauga

SEQ ID NO: 369344 - RNA, 19 nt, Homo sapiens
ugacauaugcaacgacucu

SEQ ID NO: 369345 - RNA, 19 nt, Homo sapiens
aguuuggagugaaguuuaa

SEQ ID NO: 369346 - RNA, 19 nt, Homo sapiens
gaggaaauuguccgagauc

SEQ ID NO: 369347 - RNA, 19 nt, Homo sapiens
caaugaaaggaggagaaua

SEQ ID NO: 369348 - RNA, 19 nt, Homo sapiens
uggacagaauggcaucuug

SEQ ID NO: 369349 - RNA, 19 nt, Homo sapiens
uaggaagacaagaauuuga

SEQ ID NO: 369350 - RNA, 19 nt, Homo sapiens
ggauuuggagcugcauuug

SEQ ID NO: 369351 - RNA, 19 nt, Homo sapiens
gaaaugaugucugaaguua

SEQ ID NO: 369352 - RNA, 19 nt, Homo sapiens
gcuguaaggucuucuuuaa

SEQ ID NO: 369353 - RNA, 19 nt, Homo sapiens
ugacugagcugaaggcaaa

SEQ ID NO: 369354 - RNA, 19 nt, Homo sapiens
caaguggucuaaaucauug

SEQ ID NO: 369355 - RNA, 19 nt, Homo sapiens
caucuguacugcuugaaua

SEQ ID NO: 369356 - RNA, 19 nt, Homo sapiens
gaacagcggaugaaagaau

SEQ ID NO: 369357 - RNA, 19 nt, Homo sapiens
cagcguuucuaucaacuua

SEQ ID NO: 369358 - RNA, 19 nt, Homo sapiens
gagaugaggucaagcuaca

SEQ ID NO: 369359 - RNA, 19 nt, Homo sapiens
agauaacucucauucagua

SEQ ID NO: 369360 - RNA, 19 nt, Homo sapiens
gugggcagaugcuguauuu

SEQ ID NO: 369361 - RNA, 19 nt, Homo sapiens
gcaucaggcugucauuaug

SEQ ID NO: 369362 - RNA, 19 nt, Homo sapiens
guagucaaguggucuaaau

SEQ ID NO: 369363 - RNA, 19 nt, Homo sapiens
gcucacagcguuucuauca

SEQ ID NO: 369364 - RNA, 19 nt, Homo sapiens
gaagggcuacgaagucaaa

SEQ ID NO: 369365 - RNA, 19 nt, Homo sapiens
cuacuuaugugcuggaaga

SEQ ID NO: 369366 - RNA, 19 nt, Homo sapiens
gaggcaacuucuuucagua

SEQ ID NO: 369367 - RNA, 19 nt, Homo sapiens
ugacaagucuuaaucaacu

SEQ ID NO: 369368 - RNA, 19 nt, Homo sapiens
gcacaauuacccaagauau

SEQ ID NO: 369369 - RNA, 19 nt, Homo sapiens
cuaaaucauugccagguuu

SEQ ID NO: 369370 - RNA, 19 nt, Homo sapiens
gaaaugacugcaucguuga

SEQ ID NO: 369371 - RNA, 19 nt, Homo sapiens
caccugaucuaauacuaaa

SEQ ID NO: 369372 - RNA, 19 nt, Homo sapiens
ccagauaacucucauucag

SEQ ID NO: 369373 - RNA, 19 nt, Homo sapiens
acauauugaugaccagaua

SEQ ID NO: 369374 - RNA, 19 nt, Homo sapiens
gcaccugaucuaauacuaa

SEQ ID NO: 369375 - RNA, 19 nt, Homo sapiens
gcugacaagucuuaaucaa

SEQ ID NO: 369376 - RNA, 19 nt, Homo sapiens
gucauuaccucagaagauu

SEQ ID NO: 369377 - RNA, 19 nt, Homo sapiens
gcagaucccacaggaguuu

SEQ ID NO: 369378 - RNA, 19 nt, Homo sapiens
uaacucucauucaguauuc

SEQ ID NO: 369379 - RNA, 19 nt, Homo sapiens
ccucagaagauuuguuuaa

SEQ ID NO: 369380 - RNA, 19 nt, Homo sapiens
uaacuugcaugaucuuguc

SEQ ID NO: 369381 - RNA, 19 nt, Homo sapiens
ccacugaucaaccuguuaa

SEQ ID NO: 369382 - RNA, 19 nt, Homo sapiens
cuugauaacuugcaugauc

SEQ ID NO: 369383 - RNA, 19 nt, Homo sapiens
gacaagucuuaaucaacua

SEQ ID NO: 369384 - RNA, 19 nt, Homo sapiens
ggacguggagggcgcauau

SEQ ID NO: 369385 - RNA, 19 nt, Homo sapiens
ugcaugaucuugucaaaca

SEQ ID NO: 369386 - RNA, 19 nt, Homo sapiens
caacuucuuucaguaguca

SEQ ID NO: 369387 - RNA, 19 nt, Homo sapiens
ucaaguggucuaaaucauu

SEQ ID NO: 369388 - RNA, 19 nt, Homo sapiens
gaccagauaacucucauuc

SEQ ID NO: 369389 - RNA, 19 nt, Homo sapiens
ucaauaaagucagaguugu

SEQ ID NO: 369390 - RNA, 19 nt, Homo sapiens
ucacagcguuucuaucaac

SEQ ID NO: 369391 - RNA, 19 nt, Homo sapiens
gaugaggucaagcuacauu

SEQ ID NO: 369392 - RNA, 19 nt, Homo sapiens
cauuaugccuuaccaugug

SEQ ID NO: 369393 - RNA, 19 nt, Homo sapiens
ggcgagaggcaacuucuuu

SEQ ID NO: 369394 - RNA, 19 nt, Homo sapiens
uaaaugaacagcggaugaa

SEQ ID NO: 369395 - RNA, 19 nt, Homo sapiens
ggaggcagcaguucuaguc

SEQ ID NO: 369396 - RNA, 19 nt, Homo sapiens
guucuuugcugacaagucu

SEQ ID NO: 369397 - RNA, 19 nt, Homo sapiens
caagacauacaguugauuc

SEQ ID NO: 369398 - RNA, 19 nt, Homo sapiens
ccgcagccuucccggauuu

SEQ ID NO: 369399 - RNA, 19 nt, Homo sapiens
gcagcacaacuacuuaugu

SEQ ID NO: 369400 - RNA, 19 nt, Homo sapiens
caucaaggcaauugguuug

SEQ ID NO: 369401 - RNA, 19 nt, Homo sapiens
agaggcaacuucuuucagu

SEQ ID NO: 369402 - RNA, 19 nt, Homo sapiens
cugaucaaccuguuaauga

SEQ ID NO: 369403 - RNA, 19 nt, Homo sapiens
gcccuaagccagagauuca

SEQ ID NO: 369404 - RNA, 19 nt, Homo sapiens
caauacagcuucgagucau

SEQ ID NO: 369405 - RNA, 19 nt, Homo sapiens
ggugaaaccccuucucuuu

SEQ ID NO: 369406 - RNA, 19 nt, Homo sapiens
cacaauuacccaagauauu

SEQ ID NO: 369407 - RNA, 19 nt, Homo sapiens
ccugacaccuccaguucuu

SEQ ID NO: 369408 - RNA, 19 nt, Homo sapiens
uggaagggcagcacaacua

SEQ ID NO: 369409 - RNA, 19 nt, Homo sapiens
gagcuguaaggucuucuuu

SEQ ID NO: 369410 - RNA, 19 nt, Homo sapiens
ggucgacccuggagugcau

SEQ ID NO: 369411 - RNA, 19 nt, Homo sapiens
gauaaaggaggaggaggaa

SEQ ID NO: 369412 - RNA, 19 nt, Homo sapiens
gagcucacagcguuucuau

SEQ ID NO: 369413 - RNA, 19 nt, Homo sapiens
gaggucaagcuacauuaga

SEQ ID NO: 369414 - RNA, 19 nt, Homo sapiens
gaguuccucuguaugaaag

SEQ ID NO: 369415 - RNA, 19 nt, Homo sapiens
cuuaugugcuggaagaaau

SEQ ID NO: 369416 - RNA, 19 nt, Homo sapiens
gcugcacaauuacccaaga

SEQ ID NO: 369417 - RNA, 19 nt, Homo sapiens
guacugcuugaauacauuu

SEQ ID NO: 369418 - RNA, 19 nt, Homo sapiens
ggacaccuugccugaaguu

SEQ ID NO: 369419 - RNA, 19 nt, Homo sapiens
caaguuagccaagaagagu

SEQ ID NO: 369420 - RNA, 19 nt, Homo sapiens
gcaacuucuuucaguaguc

SEQ ID NO: 369421 - RNA, 19 nt, Homo sapiens
uaaagucagaguugugaga

SEQ ID NO: 369422 - RNA, 19 nt, Homo sapiens
gaaguuucggccauaccua

SEQ ID NO: 369423 - RNA, 19 nt, Homo sapiens
gcuucaaguuagccaagaa

SEQ ID NO: 369424 - RNA, 19 nt, Homo sapiens
cuaaaugaacagcggauga

SEQ ID NO: 369425 - RNA, 19 nt, Homo sapiens
ccacggugauggauuucau

SEQ ID NO: 369426 - RNA, 19 nt, Homo sapiens
ucagugggcagaugcugua

SEQ ID NO: 369427 - RNA, 19 nt, Homo sapiens
caauaaagucagaguugug

SEQ ID NO: 369428 - RNA, 19 nt, Homo sapiens
gagcucaucaaggcaauug

SEQ ID NO: 369429 - RNA, 19 nt, Homo sapiens
ucuaaaucauugccagguu

SEQ ID NO: 369430 - RNA, 19 nt, Homo sapiens
ugacugcaucguugauaaa

SEQ ID NO: 369431 - RNA, 19 nt, Homo sapiens
gcguuucuaucaacuuaca

SEQ ID NO: 369432 - RNA, 19 nt, Homo sapiens
uaccucagaagauuuguuu

SEQ ID NO: 369433 - RNA, 19 nt, Homo sapiens
uggaagggcuacgaaguca

SEQ ID NO: 369434 - RNA, 19 nt, Homo sapiens
guuccucuguaugaaagua

SEQ ID NO: 369435 - RNA, 19 nt, Homo sapiens
gcauugaaccagaugugau

SEQ ID NO: 369436 - RNA, 19 nt, Homo sapiens
gagcauugaaccagaugug

SEQ ID NO: 369437 - RNA, 19 nt, Homo sapiens
ugaucaaccuguuaaugag

SEQ ID NO: 369438 - RNA, 19 nt, Homo sapiens
aaugaaagccaagcccuaa

SEQ ID NO: 369439 - RNA, 19 nt, Homo sapiens
ccuuggaggucgaaaauuu

SEQ ID NO: 369440 - RNA, 19 nt, Homo sapiens
ccagccagagcccacaaua

SEQ ID NO: 369441 - RNA, 19 nt, Homo sapiens
uggagugcauccuguacaa

SEQ ID NO: 369442 - RNA, 19 nt, Homo sapiens
agaaaugaugucugaaguu

SEQ ID NO: 369443 - RNA, 19 nt, Homo sapiens
cgucaugacugagcugaag

SEQ ID NO: 369444 - RNA, 19 nt, Homo sapiens
ggaugagcuuaaugguguu

SEQ ID NO: 369445 - RNA, 19 nt, Homo sapiens
uaagccagagauucacuuu

SEQ ID NO: 369446 - RNA, 19 nt, Homo sapiens
gggcagcacaacuacuuau

SEQ ID NO: 369447 - RNA, 19 nt, Homo sapiens
gccucucaaucacgccuua

SEQ ID NO: 369448 - RNA, 19 nt, Homo sapiens
cuucaucuguacugcuuga

SEQ ID NO: 369449 - RNA, 19 nt, Homo sapiens
gagagcucaucaaggcaau

SEQ ID NO: 369450 - RNA, 19 nt, Homo sapiens
ccaguucuuugcugacaag

SEQ ID NO: 369451 - RNA, 19 nt, Homo sapiens
gcacacaucuuuggaauua

SEQ ID NO: 369452 - RNA, 19 nt, Homo sapiens
gaaacugccucauaaauuu

SEQ ID NO: 369453 - RNA, 19 nt, Homo sapiens
agaaagaacuugaaaggua

SEQ ID NO: 369454 - RNA, 19 nt, Homo sapiens
gacaagcacugaaagauaa

SEQ ID NO: 369455 - RNA, 19 nt, Homo sapiens
gaaaguauaccuccaguuu

SEQ ID NO: 369456 - RNA, 19 nt, Homo sapiens
gagcagaaguuugaacaua

SEQ ID NO: 369457 - RNA, 19 nt, Homo sapiens
ggaaaugucuucaaaugau

SEQ ID NO: 369458 - RNA, 19 nt, Homo sapiens
gaaaggcauuuacuucaaa

SEQ ID NO: 369459 - RNA, 19 nt, Homo sapiens
gcacaaaccagauaauauu

SEQ ID NO: 369460 - RNA, 19 nt, Homo sapiens
gaccauaaauguaagguuu

SEQ ID NO: 369461 - RNA, 19 nt, Homo sapiens
uagaagaucugaugucaaa

SEQ ID NO: 369462 - RNA, 19 nt, Homo sapiens
ugagaaagcugucaaggaa

SEQ ID NO: 369463 - RNA, 19 nt, Homo sapiens
gaaauguucacuucaguua

SEQ ID NO: 369464 - RNA, 19 nt, Homo sapiens
gaagaucgcuacugaagca

SEQ ID NO: 369465 - RNA, 19 nt, Homo sapiens
gagauaggcugguuugaug

SEQ ID NO: 369466 - RNA, 19 nt, Homo sapiens
ggacaagcacugaaagaua

SEQ ID NO: 369467 - RNA, 19 nt, Homo sapiens
caacauacaugccuucauc

SEQ ID NO: 369468 - RNA, 19 nt, Homo sapiens
gagcuuaacacccgacuua

SEQ ID NO: 369469 - RNA, 19 nt, Homo sapiens
ugacagauaucuuugcaaa

SEQ ID NO: 369470 - RNA, 19 nt, Homo sapiens
gaaauaaagcgacugaaug

SEQ ID NO: 369471 - RNA, 19 nt, Homo sapiens
ccagguaugccuauuauua

SEQ ID NO: 369472 - RNA, 19 nt, Homo sapiens
ucagagacuucguaauuaa

SEQ ID NO: 369473 - RNA, 19 nt, Homo sapiens
gauucaagauccagucuaa

SEQ ID NO: 369474 - RNA, 19 nt, Homo sapiens
gaagcuaacccuugugauu

SEQ ID NO: 369475 - RNA, 19 nt, Homo sapiens
gauacaggguucuucauga

SEQ ID NO: 369476 - RNA, 19 nt, Homo sapiens
gaacaaagcgccagugaac

SEQ ID NO: 369477 - RNA, 19 nt, Homo sapiens
gaucgcuacugaagcaaua

SEQ ID NO: 369478 - RNA, 19 nt, Homo sapiens
ggacaggaauaauuauauc

SEQ ID NO: 369479 - RNA, 19 nt, Homo sapiens
gaacugugauugcauuugg

SEQ ID NO: 369480 - RNA, 19 nt, Homo sapiens
gauccagucuaauaagaaa

SEQ ID NO: 369481 - RNA, 19 nt, Homo sapiens
gcagaaguuugaacauaug

SEQ ID NO: 369482 - RNA, 19 nt, Homo sapiens
aaacaccacuggagcauug

SEQ ID NO: 369483 - RNA, 19 nt, Homo sapiens
gauauuaggaccauaaaug

SEQ ID NO: 369484 - RNA, 19 nt, Homo sapiens
gaugugaguugguuugaug

SEQ ID NO: 369485 - RNA, 19 nt, Homo sapiens
caaccagcauuugcaauaa

SEQ ID NO: 369486 - RNA, 19 nt, Homo sapiens
ggacaaguacucacuguau

SEQ ID NO: 369487 - RNA, 19 nt, Homo sapiens
guaacugacugccuugcua

SEQ ID NO: 369488 - RNA, 19 nt, Homo sapiens
ccagaaugcagacuuaaua

SEQ ID NO: 369489 - RNA, 19 nt, Homo sapiens
ucgagucacugccuaauaa

SEQ ID NO: 369490 - RNA, 19 nt, Homo sapiens
ggacaggcaucuccaagca

SEQ ID NO: 369491 - RNA, 19 nt, Homo sapiens
acagauaucuuugcaaaug

SEQ ID NO: 369492 - RNA, 19 nt, Homo sapiens
gagcaaagaagaagaacuu

SEQ ID NO: 369493 - RNA, 19 nt, Homo sapiens
gcacagaaaggcaucuauu

SEQ ID NO: 369494 - RNA, 19 nt, Homo sapiens
gaaacaacgcauugccaua

SEQ ID NO: 369495 - RNA, 19 nt, Homo sapiens
guaauuacccagaauauag

SEQ ID NO: 369496 - RNA, 19 nt, Homo sapiens
ugugauagcucaucguuug

SEQ ID NO: 369497 - RNA, 19 nt, Homo sapiens
gaccagguaugccuauuau

SEQ ID NO: 369498 - RNA, 19 nt, Homo sapiens
cauccagaaugcagacuua

SEQ ID NO: 369499 - RNA, 19 nt, Homo sapiens
caaugaugcugcucaaguu

SEQ ID NO: 369500 - RNA, 19 nt, Homo sapiens
cuaccaggcucgccaauga

SEQ ID NO: 369501 - RNA, 19 nt, Homo sapiens
gcagacagcaggaaaugaa

SEQ ID NO: 369502 - RNA, 19 nt, Homo sapiens
gacaaguacucacuguauu

SEQ ID NO: 369503 - RNA, 19 nt, Homo sapiens
ggaauguucuuucagucaa

SEQ ID NO: 369504 - RNA, 19 nt, Homo sapiens
ugagagacaucaucaagug

SEQ ID NO: 369505 - RNA, 19 nt, Homo sapiens
ugaaauugaugccuuggaa

SEQ ID NO: 369506 - RNA, 19 nt, Homo sapiens
ugucaaacaucacuaauag

SEQ ID NO: 369507 - RNA, 19 nt, Homo sapiens
gaaaugacagauaucuuug

SEQ ID NO: 369508 - RNA, 19 nt, Homo sapiens
caaaggaacucagcucucu

SEQ ID NO: 369509 - RNA, 19 nt, Homo sapiens
uggcaaagcuggagagauc

SEQ ID NO: 369510 - RNA, 19 nt, Homo sapiens
uaacugaauggccuuauuu

SEQ ID NO: 369511 - RNA, 19 nt, Homo sapiens
acagaaagcuuaguaccaa

SEQ ID NO: 369512 - RNA, 19 nt, Homo sapiens
gagaaaggcauuuacuuca

SEQ ID NO: 369513 - RNA, 19 nt, Homo sapiens
gcacaacaguccagcugau

SEQ ID NO: 369514 - RNA, 19 nt, Homo sapiens
gcugguugcugcuuacauu

SEQ ID NO: 369515 - RNA, 19 nt, Homo sapiens
cagaaacucuuugaggaaa

SEQ ID NO: 369516 - RNA, 19 nt, Homo sapiens
caagacagaaagcuuagua

SEQ ID NO: 369517 - RNA, 19 nt, Homo sapiens
gccaaugccuaugacuuua

SEQ ID NO: 369518 - RNA, 19 nt, Homo sapiens
gaaugcagacuuaauagug

SEQ ID NO: 369519 - RNA, 19 nt, Homo sapiens
ccaagaagcccuggacaaa

SEQ ID NO: 369520 - RNA, 19 nt, Homo sapiens
ggaggauuaugaagcuaaa

SEQ ID NO: 369521 - RNA, 19 nt, Homo sapiens
ugaaacugccucauaaauu

SEQ ID NO: 369522 - RNA, 19 nt, Homo sapiens
cacauaaacucaugagcuu

SEQ ID NO: 369523 - RNA, 19 nt, Homo sapiens
gaaacaaaacgacagaaua

SEQ ID NO: 369524 - RNA, 19 nt, Homo sapiens
ugaaagagaaaggcauuua

SEQ ID NO: 369525 - RNA, 19 nt, Homo sapiens
ucaugaaucuggaggaaga

SEQ ID NO: 369526 - RNA, 19 nt, Homo sapiens
uaaaguaggagacaaagga

SEQ ID NO: 369527 - RNA, 19 nt, Homo sapiens
caaaggaggccaacauaca

SEQ ID NO: 369528 - RNA, 19 nt, Homo sapiens
ggcauuuacuucaaacuug

SEQ ID NO: 369529 - RNA, 19 nt, Homo sapiens
gcugaucuaugcaucuuau

SEQ ID NO: 369530 - RNA, 19 nt, Homo sapiens
gaagaucugaugucaaaca

SEQ ID NO: 369531 - RNA, 19 nt, Homo sapiens
uaauagugguguuucagaa

SEQ ID NO: 369532 - RNA, 19 nt, Homo sapiens
gcacuaaaguaggagacaa

SEQ ID NO: 369533 - RNA, 19 nt, Homo sapiens
caaggaagccaaugccuau

SEQ ID NO: 369534 - RNA, 19 nt, Homo sapiens
ugaagggucugaaccugaa

SEQ ID NO: 369535 - RNA, 19 nt, Homo sapiens
gggcacaaaccagauaaua

SEQ ID NO: 369536 - RNA, 19 nt, Homo sapiens
aggaagacaugaccaggua

SEQ ID NO: 369537 - RNA, 19 nt, Homo sapiens
gaacagagugagagacauc

SEQ ID NO: 369538 - RNA, 19 nt, Homo sapiens
cuucagagacuucguaauu

SEQ ID NO: 369539 - RNA, 19 nt, Homo sapiens
gaagagguaucuguuuaac

SEQ ID NO: 369540 - RNA, 19 nt, Homo sapiens
ggccgcaccugcauuguga

SEQ ID NO: 369541 - RNA, 19 nt, Homo sapiens
gaacacauuggaaggaaau

SEQ ID NO: 369542 - RNA, 19 nt, Homo sapiens
cagaauauagcaaaucuug

SEQ ID NO: 369543 - RNA, 19 nt, Homo sapiens
gauauucuccagauuccua

SEQ ID NO: 369544 - RNA, 19 nt, Homo sapiens
gcauuuacuucaaacuugu

SEQ ID NO: 369545 - RNA, 19 nt, Homo sapiens
agaaaggcauuuacuucaa

SEQ ID NO: 369546 - RNA, 19 nt, Homo sapiens
gaaaagaaaccaacuguca

SEQ ID NO: 369547 - RNA, 19 nt, Homo sapiens
gcccaagacagaaagcuua

SEQ ID NO: 369548 - RNA, 19 nt, Homo sapiens
gaacucugacuguaugaga

SEQ ID NO: 369549 - RNA, 19 nt, Homo sapiens
gaaggccgcaccugcauug

SEQ ID NO: 369550 - RNA, 19 nt, Homo sapiens
gcucuggccuucugguaug

SEQ ID NO: 369551 - RNA, 19 nt, Homo sapiens
gcacacaucuauggaauua

SEQ ID NO: 369552 - RNA, 19 nt, Homo sapiens
gaauugaucuuuggacuua

SEQ ID NO: 369553 - RNA, 19 nt, Homo sapiens
acaaagagcuggaaaggua

SEQ ID NO: 369554 - RNA, 19 nt, Homo sapiens
gcaaagagaggcaugaaua

SEQ ID NO: 369555 - RNA, 19 nt, Homo sapiens
gcugaagccugauaaauuu

SEQ ID NO: 369556 - RNA, 19 nt, Homo sapiens
gaauauagcuaaccuugga

SEQ ID NO: 369557 - RNA, 19 nt, Homo sapiens
acaaagaacuagcugcuua

SEQ ID NO: 369558 - RNA, 19 nt, Homo sapiens
gaaauaggaugguuugaca

SEQ ID NO: 369559 - RNA, 19 nt, Homo sapiens
ggaaauugaugauauagga

SEQ ID NO: 369560 - RNA, 19 nt, Homo sapiens
gaacagagaauugaucuuu

SEQ ID NO: 369561 - RNA, 19 nt, Homo sapiens
ccacaagccuucuuucaaa

SEQ ID NO: 369562 - RNA, 19 nt, Homo sapiens
ccacaaauaugaaacaaga

SEQ ID NO: 369563 - RNA, 19 nt, Homo sapiens
agagaugacugacaaauuu

SEQ ID NO: 369564 - RNA, 19 nt, Homo sapiens
caacauacauccuuucauc

SEQ ID NO: 369565 - RNA, 19 nt, Homo sapiens
gacaugagcugguuugaug

SEQ ID NO: 369566 - RNA, 19 nt, Homo sapiens
gauaguggcuugcaugaug

SEQ ID NO: 369567 - RNA, 19 nt, Homo sapiens
acacagaacuuaugaacuu

SEQ ID NO: 369568 - RNA, 19 nt, Homo sapiens
gaacugguauuaucauauc

SEQ ID NO: 369569 - RNA, 19 nt, Homo sapiens
ggaaaccgauggacuugaa

SEQ ID NO: 369570 - RNA, 19 nt, Homo sapiens
aaagaaagcugucaaagag

SEQ ID NO: 369571 - RNA, 19 nt, Homo sapiens
cagcauaugugaucuuuga

SEQ ID NO: 369572 - RNA, 19 nt, Homo sapiens
caagucaaguuccaccuua

SEQ ID NO: 369573 - RNA, 19 nt, Homo sapiens
ggaugaacaugcaaacaaa

SEQ ID NO: 369574 - RNA, 19 nt, Homo sapiens
ggaagcugcuggaaagauu

SEQ ID NO: 369575 - RNA, 19 nt, Homo sapiens
gcaacaagauuuccugaca

SEQ ID NO: 369576 - RNA, 19 nt, Homo sapiens
gguauugccuuccuguuaa

SEQ ID NO: 369577 - RNA, 19 nt, Homo sapiens
ggccauagcucacggauca

SEQ ID NO: 369578 - RNA, 19 nt, Homo sapiens
aagcagagauuaucaguga

SEQ ID NO: 369579 - RNA, 19 nt, Homo sapiens
gcaguuaacccuauugcua

SEQ ID NO: 369580 - RNA, 19 nt, Homo sapiens
gguaggagguuauggaguu

SEQ ID NO: 369581 - RNA, 19 nt, Homo sapiens
gaugggaucuacaggauga

SEQ ID NO: 369582 - RNA, 19 nt, Homo sapiens
gugcauaucucauugugaa

SEQ ID NO: 369583 - RNA, 19 nt, Homo sapiens
gaagagccuugauguggaa

SEQ ID NO: 369584 - RNA, 19 nt, Homo sapiens
agccaaagcugccaacaua

SEQ ID NO: 369585 - RNA, 19 nt, Homo sapiens
cagcagaagugcaacauau

SEQ ID NO: 369586 - RNA, 19 nt, Homo sapiens
ggaaaugcaaugacaguuu

SEQ ID NO: 369587 - RNA, 19 nt, Homo sapiens
gauggaagcucacccuugu

SEQ ID NO: 369588 - RNA, 19 nt, Homo sapiens
gaagaaaggccagacacua

SEQ ID NO: 369589 - RNA, 19 nt, Homo sapiens
gaaaguaaaggcaacaaga

SEQ ID NO: 369590 - RNA, 19 nt, Homo sapiens
guucaaugauguucacuuu

SEQ ID NO: 369591 - RNA, 19 nt, Homo sapiens
gcacuggccuucugguaug

SEQ ID NO: 369592 - RNA, 19 nt, Homo sapiens
gaagaaaugacuagauaug

SEQ ID NO: 369593 - RNA, 19 nt, Homo sapiens
ggacaugccaguucauuug

SEQ ID NO: 369594 - RNA, 19 nt, Homo sapiens
gaagccagauccagucaga

SEQ ID NO: 369595 - RNA, 19 nt, Homo sapiens
gauaguauuuggagagaug

SEQ ID NO: 369596 - RNA, 19 nt, Homo sapiens
caacaggaauugaagaagu

SEQ ID NO: 369597 - RNA, 19 nt, Homo sapiens
gaaacaagagugggagaua

SEQ ID NO: 369598 - RNA, 19 nt, Homo sapiens
cauaugcgcuucagagaug

SEQ ID NO: 369599 - RNA, 19 nt, Homo sapiens
gcagaaggcacacaucuau

SEQ ID NO: 369600 - RNA, 19 nt, Homo sapiens
gagcuaacgucaagaucuu

SEQ ID NO: 369601 - RNA, 19 nt, Homo sapiens
caaagauacucucggcauu

SEQ ID NO: 369602 - RNA, 19 nt, Homo sapiens
agacugauauggagagaaa

SEQ ID NO: 369603 - RNA, 19 nt, Homo sapiens
aagaugcacuuguguuuaa

SEQ ID NO: 369604 - RNA, 19 nt, Homo sapiens
ccagaaugcagacuuaaua

SEQ ID NO: 369605 - RNA, 19 nt, Homo sapiens
aaacaagagugggagauaa

SEQ ID NO: 369606 - RNA, 19 nt, Homo sapiens
gcacaacgguccagcugau

SEQ ID NO: 369607 - RNA, 19 nt, Homo sapiens
gaagaauggcuccuuguga

SEQ ID NO: 369608 - RNA, 19 nt, Homo sapiens
ggaaagaucaaacuucugu

SEQ ID NO: 369609 - RNA, 19 nt, Homo sapiens
caaaggagacugaggaaga

SEQ ID NO: 369610 - RNA, 19 nt, Homo sapiens
gcacagaaaggcaucuauu

SEQ ID NO: 369611 - RNA, 19 nt, Homo sapiens
uaaagaaagcugucaaaga

SEQ ID NO: 369612 - RNA, 19 nt, Homo sapiens
gaaaugcaaugacaguuuu

SEQ ID NO: 369613 - RNA, 19 nt, Homo sapiens
cauccagaaugcagacuua

SEQ ID NO: 369614 - RNA, 19 nt, Homo sapiens
ccaaauggcuggaaaucuc

SEQ ID NO: 369615 - RNA, 19 nt, Homo sapiens
cgacagaucaggaaaauua

SEQ ID NO: 369616 - RNA, 19 nt, Homo sapiens
gaaaacagacgauaugaaa

SEQ ID NO: 369617 - RNA, 19 nt, Homo sapiens
gcacgguaauuuagcagaa

SEQ ID NO: 369618 - RNA, 19 nt, Homo sapiens
ugacagaaguggcgagaau

SEQ ID NO: 369619 - RNA, 19 nt, Homo sapiens
caaagaugcacuuguguuu

SEQ ID NO: 369620 - RNA, 19 nt, Homo sapiens
ggccaacgccuaugaguuu

SEQ ID NO: 369621 - RNA, 19 nt, Homo sapiens
gaaauguaaccauggauga

SEQ ID NO: 369622 - RNA, 19 nt, Homo sapiens
ggacagaaagggaagaaug

SEQ ID NO: 369623 - RNA, 19 nt, Homo sapiens
caguuuagcuccaaaggaa

SEQ ID NO: 369624 - RNA, 19 nt, Homo sapiens
ucagaaagacagagugaua

SEQ ID NO: 369625 - RNA, 19 nt, Homo sapiens
gaggaagagugaucaggaa

SEQ ID NO: 369626 - RNA, 19 nt, Homo sapiens
ggaauuuggaguucaauga

SEQ ID NO: 369627 - RNA, 19 nt, Homo sapiens
ggaaagguaucagaaacau

SEQ ID NO: 369628 - RNA, 19 nt, Homo sapiens
ugacaagguuggaauguuc

SEQ ID NO: 369629 - RNA, 19 nt, Homo sapiens
gauccagucagaagaauuu

SEQ ID NO: 369630 - RNA, 19 nt, Homo sapiens
uaaacuaucugagggaaau

SEQ ID NO: 369631 - RNA, 19 nt, Homo sapiens
gcauaugugaucuuugaua

SEQ ID NO: 369632 - RNA, 19 nt, Homo sapiens
aagauacucucggcauuua

SEQ ID NO: 369633 - RNA, 19 nt, Homo sapiens
aagaauggcuccuugugaa

SEQ ID NO: 369634 - RNA, 19 nt, Homo sapiens
gagaacaacaggaauugaa

SEQ ID NO: 369635 - RNA, 19 nt, Homo sapiens
gaaugcagacuuaauagug

SEQ ID NO: 369636 - RNA, 19 nt, Homo sapiens
ccaagaagcccuggacaaa

SEQ ID NO: 369637 - RNA, 19 nt, Homo sapiens
gauaaagaaagcugucaaa

SEQ ID NO: 369638 - RNA, 19 nt, Homo sapiens
caaaaucagugaaggaauu

SEQ ID NO: 369639 - RNA, 19 nt, Homo sapiens
ugacaccacugaacucaau

SEQ ID NO: 369640 - RNA, 19 nt, Homo sapiens
gagagaugacugacaaauu

SEQ ID NO: 369641 - RNA, 19 nt, Homo sapiens
gaacaacaggaauugaaga

SEQ ID NO: 369642 - RNA, 19 nt, Homo sapiens
guauggaccuuacaggaau

SEQ ID NO: 369643 - RNA, 19 nt, Homo sapiens
acagcgaacugaugaagaa

SEQ ID NO: 369644 - RNA, 19 nt, Homo sapiens
ggguauugccuuccuguua

SEQ ID NO: 369645 - RNA, 19 nt, Homo sapiens
gagcagguuaggcauguua

SEQ ID NO: 369646 - RNA, 19 nt, Homo sapiens
gaagaagaaaugacuagau

SEQ ID NO: 369647 - RNA, 19 nt, Homo sapiens
caagauuuccugacagauu

SEQ ID NO: 369648 - RNA, 19 nt, Homo sapiens
gaacagaauuugagaaaac

SEQ ID NO: 369649 - RNA, 19 nt, Homo sapiens
aaacagaggauugcuauug

SEQ ID NO: 369650 - RNA, 19 nt, Homo sapiens
gaacaaagagcuggaaagg

SEQ ID NO: 369651 - RNA, 19 nt, Homo sapiens
gcacacaucuauggaauua

SEQ ID NO: 369652 - RNA, 19 nt, Homo sapiens
gaauugaucuuuggacuua

SEQ ID NO: 369653 - RNA, 19 nt, Homo sapiens
acaaagagcuggaaaggua

SEQ ID NO: 369654 - RNA, 19 nt, Homo sapiens
gcaaagagaggcaugaaua

SEQ ID NO: 369655 - RNA, 19 nt, Homo sapiens
gcugaagccugauaaauuu

SEQ ID NO: 369656 - RNA, 19 nt, Homo sapiens
gaauauagcuaaccuugga

SEQ ID NO: 369657 - RNA, 19 nt, Homo sapiens
acaaagaacuagcugcuua

SEQ ID NO: 369658 - RNA, 19 nt, Homo sapiens
gaaauaggaugguuugaca

SEQ ID NO: 369659 - RNA, 19 nt, Homo sapiens
ggaaauugaugauauagga

SEQ ID NO: 369660 - RNA, 19 nt, Homo sapiens
gaacagagaauugaucuuu

SEQ ID NO: 369661 - RNA, 19 nt, Homo sapiens
ccacaagccuucuuucaaa

SEQ ID NO: 369662 - RNA, 19 nt, Homo sapiens
ccacaaauaugaaacaaga

SEQ ID NO: 369663 - RNA, 19 nt, Homo sapiens
agagaugacugacaaauuu

SEQ ID NO: 369664 - RNA, 19 nt, Homo sapiens
caacauacauccuuucauc

SEQ ID NO: 369665 - RNA, 19 nt, Homo sapiens
gacaugagcugguuugaug

SEQ ID NO: 369666 - RNA, 19 nt, Homo sapiens
gauaguggcuugcaugaug

SEQ ID NO: 369667 - RNA, 19 nt, Homo sapiens
acacagaacuuaugaacuu

SEQ ID NO: 369668 - RNA, 19 nt, Homo sapiens
gaacugguauuaucauauc

SEQ ID NO: 369669 - RNA, 19 nt, Homo sapiens
ggaaaccgauggacuugaa

SEQ ID NO: 369670 - RNA, 19 nt, Homo sapiens
aaagaaagcugucaaagag

SEQ ID NO: 369671 - RNA, 19 nt, Homo sapiens
cagcauaugugaucuuuga

SEQ ID NO: 369672 - RNA, 19 nt, Homo sapiens
caagucaaguuccaccuua

SEQ ID NO: 369673 - RNA, 19 nt, Homo sapiens
ggaugaacaugcaaacaaa

SEQ ID NO: 369674 - RNA, 19 nt, Homo sapiens
ggaagcugcuggaaagauu

SEQ ID NO: 369675 - RNA, 19 nt, Homo sapiens
gcaacaagauuuccugaca

SEQ ID NO: 369676 - RNA, 19 nt, Homo sapiens
gguauugccuuccuguuaa

SEQ ID NO: 369677 - RNA, 19 nt, Homo sapiens
ggccauagcucacggauca

SEQ ID NO: 369678 - RNA, 19 nt, Homo sapiens
aagcagagauuaucaguga

SEQ ID NO: 369679 - RNA, 19 nt, Homo sapiens
gcaguuaacccuauugcua

SEQ ID NO: 369680 - RNA, 19 nt, Homo sapiens
gguaggagguuauggaguu

SEQ ID NO: 369681 - RNA, 19 nt, Homo sapiens
gaugggaucuacaggauga

SEQ ID NO: 369682 - RNA, 19 nt, Homo sapiens
gugcauaucucauugugaa

SEQ ID NO: 369683 - RNA, 19 nt, Homo sapiens
gaagagccuugauguggaa

SEQ ID NO: 369684 - RNA, 19 nt, Homo sapiens
agccaaagcugccaacaua

SEQ ID NO: 369685 - RNA, 19 nt, Homo sapiens
cagcagaagugcaacauau

SEQ ID NO: 369686 - RNA, 19 nt, Homo sapiens
ggaaaugcaaugacaguuu

SEQ ID NO: 369687 - RNA, 19 nt, Homo sapiens
gauggaagcucacccuugu

SEQ ID NO: 369688 - RNA, 19 nt, Homo sapiens
gaagaaaggccagacacua

SEQ ID NO: 369689 - RNA, 19 nt, Homo sapiens
gaaaguaaaggcaacaaga

SEQ ID NO: 369690 - RNA, 19 nt, Homo sapiens
guucaaugauguucacuuu

SEQ ID NO: 369691 - RNA, 19 nt, Homo sapiens
gcacuggccuucugguaug

SEQ ID NO: 369692 - RNA, 19 nt, Homo sapiens
gaagaaaugacuagauaug

SEQ ID NO: 369693 - RNA, 19 nt, Homo sapiens
ggacaugccaguucauuug

SEQ ID NO: 369694 - RNA, 19 nt, Homo sapiens
gaagccagauccagucaga

SEQ ID NO: 369695 - RNA, 19 nt, Homo sapiens
gauaguauuuggagagaug

SEQ ID NO: 369696 - RNA, 19 nt, Homo sapiens
caacaggaauugaagaagu

SEQ ID NO: 369697 - RNA, 19 nt, Homo sapiens
gaaacaagagugggagaua

SEQ ID NO: 369698 - RNA, 19 nt, Homo sapiens
cauaugcgcuucagagaug

SEQ ID NO: 369699 - RNA, 19 nt, Homo sapiens
gcagaaggcacacaucuau

SEQ ID NO: 369700 - RNA, 19 nt, Homo sapiens
gagcuaacgucaagaucuu

SEQ ID NO: 369701 - RNA, 19 nt, Homo sapiens
caaagauacucucggcauu

SEQ ID NO: 369702 - RNA, 19 nt, Homo sapiens
agacugauauggagagaaa

SEQ ID NO: 369703 - RNA, 19 nt, Homo sapiens
aagaugcacuuguguuuaa

SEQ ID NO: 369704 - RNA, 19 nt, Homo sapiens
ccagaaugcagacuuaaua

SEQ ID NO: 369705 - RNA, 19 nt, Homo sapiens
aaacaagagugggagauaa

SEQ ID NO: 369706 - RNA, 19 nt, Homo sapiens
gcacaacgguccagcugau

SEQ ID NO: 369707 - RNA, 19 nt, Homo sapiens
gaagaauggcuccuuguga

SEQ ID NO: 369708 - RNA, 19 nt, Homo sapiens
ggaaagaucaaacuucugu

SEQ ID NO: 369709 - RNA, 19 nt, Homo sapiens
caaaggagacugaggaaga

SEQ ID NO: 369710 - RNA, 19 nt, Homo sapiens
gcacagaaaggcaucuauu

SEQ ID NO: 369711 - RNA, 19 nt, Homo sapiens
uaaagaaagcugucaaaga

SEQ ID NO: 369712 - RNA, 19 nt, Homo sapiens
gaaaugcaaugacaguuuu

SEQ ID NO: 369713 - RNA, 19 nt, Homo sapiens
cauccagaaugcagacuua

SEQ ID NO: 369714 - RNA, 19 nt, Homo sapiens
ccaaauggcuggaaaucuc

SEQ ID NO: 369715 - RNA, 19 nt, Homo sapiens
cgacagaucaggaaaauua

SEQ ID NO: 369716 - RNA, 19 nt, Homo sapiens
gaaaacagacgauaugaaa

SEQ ID NO: 369717 - RNA, 19 nt, Homo sapiens
gcacgguaauuuagcagaa

SEQ ID NO: 369718 - RNA, 19 nt, Homo sapiens
ugacagaaguggcgagaau

SEQ ID NO: 369719 - RNA, 19 nt, Homo sapiens
caaagaugcacuuguguuu

SEQ ID NO: 369720 - RNA, 19 nt, Homo sapiens
ggccaacgccuaugaguuu

SEQ ID NO: 369721 - RNA, 19 nt, Homo sapiens
gaaauguaaccauggauga

SEQ ID NO: 369722 - RNA, 19 nt, Homo sapiens
ggacagaaagggaagaaug

SEQ ID NO: 369723 - RNA, 19 nt, Homo sapiens
caguuuagcuccaaaggaa

SEQ ID NO: 369724 - RNA, 19 nt, Homo sapiens
ucagaaagacagagugaua

SEQ ID NO: 369725 - RNA, 19 nt, Homo sapiens
gaggaagagugaucaggaa

SEQ ID NO: 369726 - RNA, 19 nt, Homo sapiens
ggacaguguuuguggacuu

SEQ ID NO: 369727 - RNA, 19 nt, Homo sapiens
ggaauuuggaguucaauga

SEQ ID NO: 369728 - RNA, 19 nt, Homo sapiens
ggaaagguaucagaaacau

SEQ ID NO: 369729 - RNA, 19 nt, Homo sapiens
ugacaagguuggaauguuc

SEQ ID NO: 369730 - RNA, 19 nt, Homo sapiens
gauccagucagaagaauuu

SEQ ID NO: 369731 - RNA, 19 nt, Homo sapiens
uaaacuaucugagggaaau

SEQ ID NO: 369732 - RNA, 19 nt, Homo sapiens
gcauaugugaucuuugaua

SEQ ID NO: 369733 - RNA, 19 nt, Homo sapiens
aagauacucucggcauuua

SEQ ID NO: 369734 - RNA, 19 nt, Homo sapiens
aagaauggcuccuugugaa

SEQ ID NO: 369735 - RNA, 19 nt, Homo sapiens
gagaacaacaggaauugaa

SEQ ID NO: 369736 - RNA, 19 nt, Homo sapiens
gaaugcagacuuaauagug

SEQ ID NO: 369737 - RNA, 19 nt, Homo sapiens
ccaagaagcccuggacaaa

SEQ ID NO: 369738 - RNA, 19 nt, Homo sapiens
gauaaagaaagcugucaaa

SEQ ID NO: 369739 - RNA, 19 nt, Homo sapiens
caaaaucagugaaggaauu

SEQ ID NO: 369740 - RNA, 19 nt, Homo sapiens
ugacaccacugaacucaau

SEQ ID NO: 369741 - RNA, 19 nt, Homo sapiens
gagagaugacugacaaauu

SEQ ID NO: 369742 - RNA, 19 nt, Homo sapiens
gaacaacaggaauugaaga

SEQ ID NO: 369743 - RNA, 19 nt, Homo sapiens
guauggaccuuacaggaau

SEQ ID NO: 369744 - RNA, 19 nt, Homo sapiens
acagcgaacugaugaagaa

SEQ ID NO: 369745 - RNA, 19 nt, Homo sapiens
gagcagguuaggcauguua

SEQ ID NO: 369746 - RNA, 19 nt, Homo sapiens
ggguauugccuuccuguua

SEQ ID NO: 369747 - RNA, 19 nt, Homo sapiens
gaagaagaaaugacuagau

SEQ ID NO: 369748 - RNA, 19 nt, Homo sapiens
caagauuuccugacagauu

SEQ ID NO: 369749 - RNA, 19 nt, Homo sapiens
gaacagaauuugagaaaac

SEQ ID NO: 369750 - RNA, 19 nt, Homo sapiens
aaacagaggauugcuauug

SEQ ID NO: 369751 - RNA, 19 nt, Homo sapiens
gaauugaucuuuggacuua

SEQ ID NO: 369752 - RNA, 19 nt, Homo sapiens
acaaagagcuggaaaggua

SEQ ID NO: 369753 - RNA, 19 nt, Homo sapiens
gcaaagagaggcaugaaua

SEQ ID NO: 369754 - RNA, 19 nt, Homo sapiens
gcugaagccugauaaauuu

SEQ ID NO: 369755 - RNA, 19 nt, Homo sapiens
gaauauagcuaaccuugga

SEQ ID NO: 369756 - RNA, 19 nt, Homo sapiens
acaaagaacuagcugcuua

SEQ ID NO: 369757 - RNA, 19 nt, Homo sapiens
gaaauaggaugguuugaca

SEQ ID NO: 369758 - RNA, 19 nt, Homo sapiens
ggaaauugaugauauagga

SEQ ID NO: 369759 - RNA, 19 nt, Homo sapiens
gaacagagaauugaucuuu

SEQ ID NO: 369760 - RNA, 19 nt, Homo sapiens
ccacaagccuucuuucaaa

SEQ ID NO: 369761 - RNA, 19 nt, Homo sapiens
ccacaaauaugaaacaaga

SEQ ID NO: 369762 - RNA, 19 nt, Homo sapiens
agagaugacugacaaauuu

SEQ ID NO: 369763 - RNA, 19 nt, Homo sapiens
caacauacauccuuucauc

SEQ ID NO: 369764 - RNA, 19 nt, Homo sapiens
gacaugagcugguuugaug

SEQ ID NO: 369765 - RNA, 19 nt, Homo sapiens
gauaguggcuugcaugaug

SEQ ID NO: 369766 - RNA, 19 nt, Homo sapiens
acacagaacuuaugaacuu

SEQ ID NO: 369767 - RNA, 19 nt, Homo sapiens
gaacugguauuaucauauc

SEQ ID NO: 369768 - RNA, 19 nt, Homo sapiens
ggaaaccgauggacuugaa

SEQ ID NO: 369769 - RNA, 19 nt, Homo sapiens
aaagaaagcugucaaagag

SEQ ID NO: 369770 - RNA, 19 nt, Homo sapiens
cagcauaugugaucuuuga

SEQ ID NO: 369771 - RNA, 19 nt, Homo sapiens
caagucaaguuccaccuua

SEQ ID NO: 369772 - RNA, 19 nt, Homo sapiens
ggaugaacaugcaaacaaa

SEQ ID NO: 369773 - RNA, 19 nt, Homo sapiens
ggaagcugcuggaaagauu

SEQ ID NO: 369774 - RNA, 19 nt, Homo sapiens
gcaacaagauuuccugaca

SEQ ID NO: 369775 - RNA, 19 nt, Homo sapiens
gguauugccuuccuguuaa

SEQ ID NO: 369776 - RNA, 19 nt, Homo sapiens
ggccauagcucacggauca

SEQ ID NO: 369777 - RNA, 19 nt, Homo sapiens
aagcagagauuaucaguga

SEQ ID NO: 369778 - RNA, 19 nt, Homo sapiens
gcaguuaacccuauugcua

SEQ ID NO: 369779 - RNA, 19 nt, Homo sapiens
gguaggagguuauggaguu

SEQ ID NO: 369780 - RNA, 19 nt, Homo sapiens
gaugggaucuacaggauga

SEQ ID NO: 369781 - RNA, 19 nt, Homo sapiens
gaagagccuugauguggaa

SEQ ID NO: 369782 - RNA, 19 nt, Homo sapiens
agccaaagcugccaacaua

SEQ ID NO: 369783 - RNA, 19 nt, Homo sapiens
cagcagaagugcaacauau

SEQ ID NO: 369784 - RNA, 19 nt, Homo sapiens
ggaaaugcaaugacaguuu

SEQ ID NO: 369785 - RNA, 19 nt, Homo sapiens
gauggaagcucacccuugu

SEQ ID NO: 369786 - RNA, 19 nt, Homo sapiens
gaagaaaggccagacacua

SEQ ID NO: 369787 - RNA, 19 nt, Homo sapiens
guucaaugauguucacuuu

SEQ ID NO: 369788 - RNA, 19 nt, Homo sapiens
gcacuggccuucugguaug

SEQ ID NO: 369789 - RNA, 19 nt, Homo sapiens
gaaaguaaaggcaacaaga

SEQ ID NO: 369790 - RNA, 19 nt, Homo sapiens
gaagaaaugacuagauaug

SEQ ID NO: 369791 - RNA, 19 nt, Homo sapiens
ggacaugccaguucauuug

SEQ ID NO: 369792 - RNA, 19 nt, Homo sapiens
gaagccagauccagucaga

SEQ ID NO: 369793 - RNA, 19 nt, Homo sapiens
gauaguauuuggagagaug

SEQ ID NO: 369794 - RNA, 19 nt, Homo sapiens
caacaggaauugaagaagu

SEQ ID NO: 369795 - RNA, 19 nt, Homo sapiens
gaaacaagagugggagaua

SEQ ID NO: 369796 - RNA, 19 nt, Homo sapiens
gagcuaacgucaagaucuu

SEQ ID NO: 369797 - RNA, 19 nt, Homo sapiens
caaagauacucucggcauu

SEQ ID NO: 369798 - RNA, 19 nt, Homo sapiens
agacugauauggagagaaa

SEQ ID NO: 369799 - RNA, 19 nt, Homo sapiens
aagaugcacuuguguuuaa

SEQ ID NO: 369800 - RNA, 19 nt, Homo sapiens
ccagaaugcagacuuaaua

SEQ ID NO: 369801 - RNA, 19 nt, Homo sapiens
aaacaagagugggagauaa

SEQ ID NO: 369802 - RNA, 19 nt, Homo sapiens
gcacaacgguccagcugau

SEQ ID NO: 369803 - RNA, 19 nt, Homo sapiens
gaagaauggcuccuuguga

SEQ ID NO: 369804 - RNA, 19 nt, Homo sapiens
ggaaagaucaaacuucugu

SEQ ID NO: 369805 - RNA, 19 nt, Homo sapiens
caaaggagacugaggaaga

SEQ ID NO: 369806 - RNA, 19 nt, Homo sapiens
gcacagaaaggcaucuauu

SEQ ID NO: 369807 - RNA, 19 nt, Homo sapiens
uaaagaaagcugucaaaga

SEQ ID NO: 369808 - RNA, 19 nt, Homo sapiens
gaaaugcaaugacaguuuu

SEQ ID NO: 369809 - RNA, 19 nt, Homo sapiens
cauccagaaugcagacuua

SEQ ID NO: 369810 - RNA, 19 nt, Homo sapiens
ccaaauggcuggaaaucuc

SEQ ID NO: 369811 - RNA, 19 nt, Homo sapiens
cgacagaucaggaaaauua

SEQ ID NO: 369812 - RNA, 19 nt, Homo sapiens
gaaaacagacgauaugaaa

SEQ ID NO: 369813 - RNA, 19 nt, Homo sapiens
gcacgguaauuuagcagaa

SEQ ID NO: 369814 - RNA, 19 nt, Homo sapiens
ugacagaaguggcgagaau

SEQ ID NO: 369815 - RNA, 19 nt, Homo sapiens
caaagaugcacuuguguuu

SEQ ID NO: 369816 - RNA, 19 nt, Homo sapiens
ggccaacgccuaugaguuu

SEQ ID NO: 369817 - RNA, 19 nt, Homo sapiens
gaaauguaaccauggauga

SEQ ID NO: 369818 - RNA, 19 nt, Homo sapiens
ggacagaaagggaagaaug

SEQ ID NO: 369819 - RNA, 19 nt, Homo sapiens
caguuuagcuccaaaggaa

SEQ ID NO: 369820 - RNA, 19 nt, Homo sapiens
ucagaaagacagagugaua

SEQ ID NO: 369821 - RNA, 19 nt, Homo sapiens
gaggaagagugaucaggaa

SEQ ID NO: 369822 - RNA, 19 nt, Homo sapiens
ggaauuuggaguucaauga

SEQ ID NO: 369823 - RNA, 19 nt, Homo sapiens
ggaaagguaucagaaacau

SEQ ID NO: 369824 - RNA, 19 nt, Homo sapiens
ugacaagguuggaauguuc

SEQ ID NO: 369825 - RNA, 19 nt, Homo sapiens
gauccagucagaagaauuu

SEQ ID NO: 369826 - RNA, 19 nt, Homo sapiens
uaaacuaucugagggaaau

SEQ ID NO: 369827 - RNA, 19 nt, Homo sapiens
gcauaugugaucuuugaua

SEQ ID NO: 369828 - RNA, 19 nt, Homo sapiens
aagauacucucggcauuua

SEQ ID NO: 369829 - RNA, 19 nt, Homo sapiens
aagaauggcuccuugugaa

SEQ ID NO: 369830 - RNA, 19 nt, Homo sapiens
gagaacaacaggaauugaa

SEQ ID NO: 369831 - RNA, 19 nt, Homo sapiens
gaaugcagacuuaauagug

SEQ ID NO: 369832 - RNA, 19 nt, Homo sapiens
ccaagaagcccuggacaaa

SEQ ID NO: 369833 - RNA, 19 nt, Homo sapiens
gauaaagaaagcugucaaa

SEQ ID NO: 369834 - RNA, 19 nt, Homo sapiens
caaaaucagugaaggaauu

SEQ ID NO: 369835 - RNA, 19 nt, Homo sapiens
ugacaccacugaacucaau

SEQ ID NO: 369836 - RNA, 19 nt, Homo sapiens
gagagaugacugacaaauu

SEQ ID NO: 369837 - RNA, 19 nt, Homo sapiens
gaacaacaggaauugaaga

SEQ ID NO: 369838 - RNA, 19 nt, Homo sapiens
caagauuuccugacagauu

SEQ ID NO: 369839 - RNA, 19 nt, Homo sapiens
acagcgaacugaugaagaa

SEQ ID NO: 369840 - RNA, 19 nt, Homo sapiens
ggguauugccuuccuguua

SEQ ID NO: 369841 - RNA, 19 nt, Homo sapiens
gaagaagaaaugacuagau

SEQ ID NO: 369842 - RNA, 19 nt, Homo sapiens
gaacagaauuugagaaaac

SEQ ID NO: 369843 - RNA, 19 nt, Homo sapiens
gagcagguuaggcauguua

SEQ ID NO: 369844 - RNA, 19 nt, Homo sapiens
aaacagaggauugcuauug

SEQ ID NO: 369845 - RNA, 19 nt, Homo sapiens
gaacaaagagcuggaaagg

SEQ ID NO: 369846 - RNA, 19 nt, Homo sapiens
caaguaagggauccaauga

SEQ ID NO: 369847 - RNA, 19 nt, Homo sapiens
uaauagugguguuucagaa

SEQ ID NO: 369848 - RNA, 19 nt, Homo sapiens
aaacaguacuggugcacuu

SEQ ID NO: 369849 - RNA, 19 nt, Homo sapiens
ggaacaguaugugccauug

SEQ ID NO: 369850 - RNA, 19 nt, Homo sapiens
gcaaaugugccaccagugu

SEQ ID NO: 369851 - RNA, 19 nt, Homo sapiens
gcaaagauuuacagaaugu

SEQ ID NO: 369852 - RNA, 19 nt, Homo sapiens
aaacuuggauggacuugua

SEQ ID NO: 369853 - RNA, 19 nt, Homo sapiens
ggaaguggucugucuguua

SEQ ID NO: 369854 - RNA, 19 nt, Homo sapiens
ggugaacucugccuuauau

SEQ ID NO: 369855 - RNA, 19 nt, Homo sapiens
ggaaacaggugugugugaa

SEQ ID NO: 369856 - RNA, 19 nt, Homo sapiens
aaacugcugucaauaaaug

SEQ ID NO: 369857 - RNA, 19 nt, Homo sapiens
gaaggaaacaaauguguau

SEQ ID NO: 369858 - RNA, 19 nt, Homo sapiens
cacuucagaucucuaauua

SEQ ID NO: 369859 - RNA, 19 nt, Homo sapiens
ggacuuguauagugagaga

SEQ ID NO: 369860 - RNA, 19 nt, Homo sapiens
ggauggacuuguauaguga

SEQ ID NO: 369861 - RNA, 19 nt, Homo sapiens
gaaguggucugucuguuac

SEQ ID NO: 369862 - RNA, 19 nt, Homo sapiens
gcagagagggccagauuug

SEQ ID NO: 369863 - RNA, 19 nt, Homo sapiens
ggaaggaaacaaaugugua

SEQ ID NO: 369864 - RNA, 19 nt, Homo sapiens
guacagaaaccaauuaucu

SEQ ID NO: 369865 - RNA, 19 nt, Homo sapiens
gaacucugccuuauauaau

SEQ ID NO: 369866 - RNA, 19 nt, Homo sapiens
gcacugggaaggaaacaaa

SEQ ID NO: 369867 - RNA, 19 nt, Homo sapiens
uguauaaacugcugucaau

SEQ ID NO: 369868 - RNA, 19 nt, Homo sapiens
gaacugggcacagauugaa

SEQ ID NO: 369869 - RNA, 19 nt, Homo sapiens
gagaggaaguggucugucu

SEQ ID NO: 369870 - RNA, 19 nt, Homo sapiens
cuucagaucucuaauuagu

SEQ ID NO: 369871 - RNA, 19 nt, Homo sapiens
gcacaggugucugccuaga

SEQ ID NO: 369872 - RNA, 19 nt, Homo sapiens
uaacacagccuuccuucug

SEQ ID NO: 369873 - RNA, 19 nt, Homo sapiens
ucagauacccaguggaauu

SEQ ID NO: 369874 - RNA, 19 nt, Homo sapiens
ccauaagucugauucucuu

SEQ ID NO: 369875 - RNA, 19 nt, Homo sapiens
ugaacucugccuuauauaa

SEQ ID NO: 369876 - RNA, 19 nt, Homo sapiens
gggaaggaguucacagaag

SEQ ID NO: 369877 - RNA, 19 nt, Homo sapiens
agucaucacugguagcaaa

SEQ ID NO: 369878 - RNA, 19 nt, Homo sapiens
ggaauuccaacuugaagga

SEQ ID NO: 369879 - RNA, 19 nt, Homo sapiens
ucagaucucuaauuagucu

SEQ ID NO: 369880 - RNA, 19 nt, Homo sapiens
gugagaggguccagcagaa

SEQ ID NO: 369881 - RNA, 19 nt, Homo sapiens
uggauggacuuguauagug

SEQ ID NO: 369882 - RNA, 19 nt, Homo sapiens
uaaaugacacccagaccuu

SEQ ID NO: 369883 - RNA, 19 nt, Homo sapiens
ucacuucagaucucuaauu

SEQ ID NO: 369884 - RNA, 19 nt, Homo sapiens
ucacugguagcaaagauuu

SEQ ID NO: 369885 - RNA, 19 nt, Homo sapiens
ucucacauccaucuacuuu

SEQ ID NO: 369886 - RNA, 19 nt, Homo sapiens
gugaaggaaauaaagguaa

SEQ ID NO: 369887 - RNA, 19 nt, Homo sapiens
caugauuggcuuaaaguga

SEQ ID NO: 369888 - RNA, 19 nt, Homo sapiens
ugaguccauuggcaaguuu

SEQ ID NO: 369889 - RNA, 19 nt, Homo sapiens
ggcuuaaagugaaggaaau

SEQ ID NO: 369890 - RNA, 19 nt, Homo sapiens
augauuggcuuaaagugaa

SEQ ID NO: 369891 - RNA, 19 nt, Homo sapiens
guggugaacucugccuuau

SEQ ID NO: 369892 - RNA, 19 nt, Homo sapiens
guauaaacugcugucaaua

SEQ ID NO: 369893 - RNA, 19 nt, Homo sapiens
ugucacugauggaagguuu

SEQ ID NO: 369894 - RNA, 19 nt, Homo sapiens
acaggugucugccuagauc

SEQ ID NO: 369895 - RNA, 19 nt, Homo sapiens
ggccagauuugugguggaa

SEQ ID NO: 369896 - RNA, 19 nt, Homo sapiens
aagcagagagggccagauu

SEQ ID NO: 369897 - RNA, 19 nt, Homo sapiens
acagguggcucagcaggaa

SEQ ID NO: 369898 - RNA, 19 nt, Homo sapiens
ugaacaugccugccaaaga

SEQ ID NO: 369899 - RNA, 19 nt, Homo sapiens
cagaggacaucgcguacca

SEQ ID NO: 369900 - RNA, 19 nt, Homo sapiens
ggaaaaggcugagcaacag

SEQ ID NO: 369901 - RNA, 19 nt, Homo sapiens
gaaaccaauuaucuuugac

SEQ ID NO: 369902 - RNA, 19 nt, Homo sapiens
cagaaaccaauuaucuuug

SEQ ID NO: 369903 - RNA, 19 nt, Homo sapiens
uaaaaucacuucagaucuc

SEQ ID NO: 369904 - RNA, 19 nt, Homo sapiens
gcuuaaagugaaggaaaua

SEQ ID NO: 369905 - RNA, 19 nt, Homo sapiens
agagcgagccgccaccuuu

SEQ ID NO: 369906 - RNA, 19 nt, Homo sapiens
guagcaaagauuuacagaa

SEQ ID NO: 369907 - RNA, 19 nt, Homo sapiens
gggaaggaaacaaaugugu

SEQ ID NO: 369908 - RNA, 19 nt, Homo sapiens
ugaagaaucugccccuguu

SEQ ID NO: 369909 - RNA, 19 nt, Homo sapiens
gagaugugaguccuguuga

SEQ ID NO: 369910 - RNA, 19 nt, Homo sapiens
cgagaugugaguccuguug

SEQ ID NO: 369911 - RNA, 19 nt, Homo sapiens
ucucagauacccaguggaa

SEQ ID NO: 369912 - RNA, 19 nt, Homo sapiens
ggaagggacucauuuucuc

SEQ ID NO: 369913 - RNA, 19 nt, Homo sapiens
ccagcuuccucgcaucuuc

SEQ ID NO: 369914 - RNA, 19 nt, Homo sapiens
ucuguuaccauaagucuga

SEQ ID NO: 369915 - RNA, 19 nt, Homo sapiens
ccuaugcaaaccagcuuua

SEQ ID NO: 369916 - RNA, 19 nt, Homo sapiens
cuuugaugcuggagaacua

SEQ ID NO: 369917 - RNA, 19 nt, Homo sapiens
gugcugccguccaucacaa

SEQ ID NO: 369918 - RNA, 19 nt, Homo sapiens
caucacugguagcaaagau

SEQ ID NO: 369919 - RNA, 19 nt, Homo sapiens
aaacaggugugugugaacu

SEQ ID NO: 369920 - RNA, 19 nt, Homo sapiens
ucgcuuugaugcuggagaa

SEQ ID NO: 369921 - RNA, 19 nt, Homo sapiens
agaugugaguccuguugaa

SEQ ID NO: 369922 - RNA, 19 nt, Homo sapiens
gaggaaguggucugucugu

SEQ ID NO: 369923 - RNA, 19 nt, Homo sapiens
ggugagcgacgaccuuaca

SEQ ID NO: 369924 - RNA, 19 nt, Homo sapiens
ugaacugggcacagauuga

SEQ ID NO: 369925 - RNA, 19 nt, Homo sapiens
cguggugaacucugccuua

SEQ ID NO: 369926 - RNA, 19 nt, Homo sapiens
ugccguccaucacaacuga

SEQ ID NO: 369927 - RNA, 19 nt, Homo sapiens
ccacguaaugugccaguca

SEQ ID NO: 369928 - RNA, 19 nt, Homo sapiens
aauuccaacuugaaggauu

SEQ ID NO: 369929 - RNA, 19 nt, Homo sapiens
gaaacaggugugugugaac

SEQ ID NO: 369930 - RNA, 19 nt, Homo sapiens
aaucacuucagaucucuaa

SEQ ID NO: 369931 - RNA, 19 nt, Homo sapiens
gcucucggaacaucaccua

SEQ ID NO: 369932 - RNA, 19 nt, Homo sapiens
cggaaacagguguguguga

SEQ ID NO: 369933 - RNA, 19 nt, Homo sapiens
gagggcaugugcggcugaa

SEQ ID NO: 369934 - RNA, 19 nt, Homo sapiens
uuucaugauuggcuuaaag

SEQ ID NO: 369935 - RNA, 19 nt, Homo sapiens
ccagauuugugguggaaaa

SEQ ID NO: 369936 - RNA, 19 nt, Homo sapiens
agagagggccagauuugug

SEQ ID NO: 369937 - RNA, 19 nt, Homo sapiens
gguaaaaucacuucagauc

SEQ ID NO: 369938 - RNA, 19 nt, Homo sapiens
gaugcuggagaacuaauca

SEQ ID NO: 369939 - RNA, 19 nt, Homo sapiens
agugguggcucgcuuugau

SEQ ID NO: 369940 - RNA, 19 nt, Homo sapiens
agcaaagauuuacagaaug

SEQ ID NO: 369941 - RNA, 19 nt, Homo sapiens
gguagcaaagauuuacaga

SEQ ID NO: 369942 - RNA, 19 nt, Homo sapiens
caggaggcguggugaacuc

SEQ ID NO: 369943 - RNA, 19 nt, Homo sapiens
ugggugggccugacuguug

SEQ ID NO: 369944 - RNA, 19 nt, Homo sapiens
ggucugucuguuaccauaa

SEQ ID NO: 369945 - RNA, 19 nt, Homo sapiens
auggaagguuugcggauga

SEQ ID NO: 369946 - RNA, 19 nt, Homo sapiens
ggguacagaaaccaauuau

SEQ ID NO: 369947 - RNA, 19 nt, Homo sapiens
cagauacccaguggaauuc

SEQ ID NO: 369948 - RNA, 19 nt, Homo sapiens
aacucugccuuauauaaug

SEQ ID NO: 369949 - RNA, 19 nt, Homo sapiens
uggcuuaaagugaaggaaa

SEQ ID NO: 369950 - RNA, 19 nt, Homo sapiens
uggguacagaaaccaauua

SEQ ID NO: 369951 - RNA, 19 nt, Homo sapiens
uuacauagcuggagucuuu

SEQ ID NO: 369952 - RNA, 19 nt, Homo sapiens
ggcaagaguuucagauuua

SEQ ID NO: 369953 - RNA, 19 nt, Homo sapiens
gaaauaaacccaacuguuc

SEQ ID NO: 369954 - RNA, 19 nt, Homo sapiens
guaguuagaucaaagcaaa

SEQ ID NO: 369955 - RNA, 19 nt, Homo sapiens
gaaauugucuauuccugau

SEQ ID NO: 369956 - RNA, 19 nt, Homo sapiens
gaaguucgccugcuuugaa

SEQ ID NO: 369957 - RNA, 19 nt, Homo sapiens
gcagcugguuguaacauuu

SEQ ID NO: 369958 - RNA, 19 nt, Homo sapiens
uauggaagcugcuaagguu

SEQ ID NO: 369959 - RNA, 19 nt, Homo sapiens
gaaguauuaugcacugugu

SEQ ID NO: 369960 - RNA, 19 nt, Homo sapiens
caaagcaaauguggacuga

SEQ ID NO: 369961 - RNA, 19 nt, Homo sapiens
ggacugaaucugcuuguug

SEQ ID NO: 369962 - RNA, 19 nt, Homo sapiens
aaacccaacuguucaugaa

SEQ ID NO: 369963 - RNA, 19 nt, Homo sapiens
gacugaaucugcuuguuga

SEQ ID NO: 369964 - RNA, 19 nt, Homo sapiens
guaguacucuugcuuaagg

SEQ ID NO: 369965 - RNA, 19 nt, Homo sapiens
uguaggaaauugucuauuc

SEQ ID NO: 369966 - RNA, 19 nt, Homo sapiens
ugaauucuuugcugacauu

SEQ ID NO: 369967 - RNA, 19 nt, Homo sapiens
gggcauauuuaacggauuc

SEQ ID NO: 369968 - RNA, 19 nt, Homo sapiens
gaagcacuguacaaguuug

SEQ ID NO: 369969 - RNA, 19 nt, Homo sapiens
gaauuuggcuccgcgaagu

SEQ ID NO: 369970 - RNA, 19 nt, Homo sapiens
gaucaguguuugaagaaag

SEQ ID NO: 369971 - RNA, 19 nt, Homo sapiens
aagcaaauguggacugaau

SEQ ID NO: 369972 - RNA, 19 nt, Homo sapiens
ugccagugcugaauucuuu

SEQ ID NO: 369973 - RNA, 19 nt, Homo sapiens
gcgcacaucacuauauuug

SEQ ID NO: 369974 - RNA, 19 nt, Homo sapiens
aggcaagaguuucagauuu

SEQ ID NO: 369975 - RNA, 19 nt, Homo sapiens
ugaaucugcuuguugauca

SEQ ID NO: 369976 - RNA, 19 nt, Homo sapiens
uacagugguuuaucuauga

SEQ ID NO: 369977 - RNA, 19 nt, Homo sapiens
gagaggagaauacuuaucu

SEQ ID NO: 369978 - RNA, 19 nt, Homo sapiens
uugaagcacuguacaaguu

SEQ ID NO: 369979 - RNA, 19 nt, Homo sapiens
ugaaauaaacccaacuguu

SEQ ID NO: 369980 - RNA, 19 nt, Homo sapiens
ugguaucuguguugaauaa

SEQ ID NO: 369981 - RNA, 19 nt, Homo sapiens
ggaugagacagauaccaua

SEQ ID NO: 369982 - RNA, 19 nt, Homo sapiens
guugaucaguguuugaaga

SEQ ID NO: 369983 - RNA, 19 nt, Homo sapiens
cuacagugguuuaucuaug

SEQ ID NO: 369984 - RNA, 19 nt, Homo sapiens
gauucucaguuacacuuaa

SEQ ID NO: 369985 - RNA, 19 nt, Homo sapiens
cauacaccaugaugaaguu

SEQ ID NO: 369986 - RNA, 19 nt, Homo sapiens
cagauaccauacaccauga

SEQ ID NO: 369987 - RNA, 19 nt, Homo sapiens
ggaugcagcucccaaaaug

SEQ ID NO: 369988 - RNA, 19 nt, Homo sapiens
gcuaagguucgaauucaaa

SEQ ID NO: 369989 - RNA, 19 nt, Homo sapiens
ugaagucuuuaaagucuug

SEQ ID NO: 369990 - RNA, 19 nt, Homo sapiens
cagggacucugcaaguuug

SEQ ID NO: 369991 - RNA, 19 nt, Homo sapiens
cagguuaugccaacacuuu

SEQ ID NO: 369992 - RNA, 19 nt, Homo sapiens
uaaagaggaugguguucgu

SEQ ID NO: 369993 - RNA, 19 nt, Homo sapiens
caagggagugguuguguga

SEQ ID NO: 369994 - RNA, 19 nt, Homo sapiens
aaaguacaagggcauauuu

SEQ ID NO: 369995 - RNA, 19 nt, Homo sapiens
gcaagaguuucagauuuac

SEQ ID NO: 369996 - RNA, 19 nt, Homo sapiens
uuggagaggagaauacuua

SEQ ID NO: 369997 - RNA, 19 nt, Homo sapiens
gaugaaguucgccugcuuu

SEQ ID NO: 369998 - RNA, 19 nt, Homo sapiens
gaagaaagugcaaaaggaa

SEQ ID NO: 369999 - RNA, 19 nt, Homo sapiens
gcaaauguggacugaaucu

SEQ ID NO: 370000 - RNA, 19 nt, Homo sapiens
cagagcagcugguuguaac

SEQ ID NO: 370001 - RNA, 19 nt, Homo sapiens
uggcgcacaucacuauauu

SEQ ID NO: 370002 - RNA, 19 nt, Homo sapiens
ggaugguguucgugguuug

SEQ ID NO: 370003 - RNA, 19 nt, Homo sapiens
gugcuucucugguccucaa

SEQ ID NO: 370004 - RNA, 19 nt, Homo sapiens
guaucuguguugaauaaag

SEQ ID NO: 370005 - RNA, 19 nt, Homo sapiens
ugaagaaagugcaaaagga

SEQ ID NO: 370006 - RNA, 19 nt, Homo sapiens
gauuuaaagguguauggaa

SEQ ID NO: 370007 - RNA, 19 nt, Homo sapiens
gaagaaggccuaaaagcau

SEQ ID NO: 370008 - RNA, 19 nt, Homo sapiens
guacaagggcauauuuaac

SEQ ID NO: 370009 - RNA, 19 nt, Homo sapiens
aagcuuggguuaacucagu

SEQ ID NO: 370010 - RNA, 19 nt, Homo sapiens
aaauaaacccaacuguuca

SEQ ID NO: 370011 - RNA, 19 nt, Homo sapiens
ugaugaaguucgccugcuu

SEQ ID NO: 370012 - RNA, 19 nt, Homo sapiens
uaccauacaccaugaugaa

SEQ ID NO: 370013 - RNA, 19 nt, Homo sapiens
ggauucucaguuacacuua

SEQ ID NO: 370014 - RNA, 19 nt, Homo sapiens
uuagugaaaugccguaugc

SEQ ID NO: 370015 - RNA, 19 nt, Homo sapiens
ugaacguacuguugaagca

SEQ ID NO: 370016 - RNA, 19 nt, Homo sapiens
gcuuugaacguacuguuga

SEQ ID NO: 370017 - RNA, 19 nt, Homo sapiens
ggaagaaggccuaaaagca

SEQ ID NO: 370018 - RNA, 19 nt, Homo sapiens
cugcuaagguucgaauuca

SEQ ID NO: 370019 - RNA, 19 nt, Homo sapiens
gcugaauucuuugcugaca

SEQ ID NO: 370020 - RNA, 19 nt, Homo sapiens
aaggaugggcuccgacuuu

SEQ ID NO: 370021 - RNA, 19 nt, Homo sapiens
uaaacccaacuguucauga

SEQ ID NO: 370022 - RNA, 19 nt, Homo sapiens
aguuucagauuuacuguug

SEQ ID NO: 370023 - RNA, 19 nt, Homo sapiens
ugugguaucuguguugaau

SEQ ID NO: 370024 - RNA, 19 nt, Homo sapiens
ugaagcacuguacaaguuu

SEQ ID NO: 370025 - RNA, 19 nt, Homo sapiens
gaggaugguguucgugguu

SEQ ID NO: 370026 - RNA, 19 nt, Homo sapiens
acauugcccuggcuccuau

SEQ ID NO: 370027 - RNA, 19 nt, Homo sapiens
cuguaguacucuugcuuaa

SEQ ID NO: 370028 - RNA, 19 nt, Homo sapiens
aguacaagggcauauuuaa

SEQ ID NO: 370029 - RNA, 19 nt, Homo sapiens
uaaggaagaaggccuaaaa

SEQ ID NO: 370030 - RNA, 19 nt, Homo sapiens
ggaagcugcuaagguucga

SEQ ID NO: 370031 - RNA, 19 nt, Homo sapiens
aaguacaagggcauauuua

SEQ ID NO: 370032 - RNA, 19 nt, Homo sapiens
ggagaggagaauacuuauc

SEQ ID NO: 370033 - RNA, 19 nt, Homo sapiens
cugauucugugguaucugu

SEQ ID NO: 370034 - RNA, 19 nt, Homo sapiens
ugagacagauaccauacac

SEQ ID NO: 370035 - RNA, 19 nt, Homo sapiens
gaugagacagauaccauac

SEQ ID NO: 370036 - RNA, 19 nt, Homo sapiens
gacauugcccuggcuccua

SEQ ID NO: 370037 - RNA, 19 nt, Homo sapiens
gcuuaaggcaagaguuuca

SEQ ID NO: 370038 - RNA, 19 nt, Homo sapiens
ccugauauaauuacuguag

SEQ ID NO: 370039 - RNA, 19 nt, Homo sapiens
gguuguaacauuuguagca

SEQ ID NO: 370040 - RNA, 19 nt, Homo sapiens
gguuaugccaacacuuuga

SEQ ID NO: 370041 - RNA, 19 nt, Homo sapiens
ugcccuggcuccuauggaa

SEQ ID NO: 370042 - RNA, 19 nt, Homo sapiens
ggacuguuugcccguauca

SEQ ID NO: 370043 - RNA, 19 nt, Homo sapiens
guauggaagggacuguuug

SEQ ID NO: 370044 - RNA, 19 nt, Homo sapiens
gauaccauacaccaugaug

SEQ ID NO: 370045 - RNA, 19 nt, Homo sapiens
gaucgccaucuuagggaaa

SEQ ID NO: 370046 - RNA, 19 nt, Homo sapiens
gcugcuaagguucgaauuc

SEQ ID NO: 370047 - RNA, 19 nt, Homo sapiens
guucgugguuuggcuaaag

SEQ ID NO: 370048 - RNA, 19 nt, Homo sapiens
cgacuuuccuuggcuacuc

SEQ ID NO: 370049 - RNA, 19 nt, Homo sapiens
ugaucaguguuugaagaaa

SEQ ID NO: 370050 - RNA, 19 nt, Homo sapiens
acucaguaguuagaucaaa

SEQ ID NO: 370051 - RNA, 19 nt, Homo sapiens
uuacauagcuggagucuuu

SEQ ID NO: 370052 - RNA, 19 nt, Homo sapiens
ggcaagaguuucagauuua

SEQ ID NO: 370053 - RNA, 19 nt, Homo sapiens
ggacuuggaggaauuauua

SEQ ID NO: 370054 - RNA, 19 nt, Homo sapiens
gaaauaaacccaacuguuc

SEQ ID NO: 370055 - RNA, 19 nt, Homo sapiens
guaguuagaucaaagcaaa

SEQ ID NO: 370056 - RNA, 19 nt, Homo sapiens
gaaauugucuauuccugau

SEQ ID NO: 370057 - RNA, 19 nt, Homo sapiens
gaaguucgccugcuuugaa

SEQ ID NO: 370058 - RNA, 19 nt, Homo sapiens
gcagcugguuguaacauuu

SEQ ID NO: 370059 - RNA, 19 nt, Homo sapiens
gcacaacacauacagcauu

SEQ ID NO: 370060 - RNA, 19 nt, Homo sapiens
uauggaagcugcuaagguu

SEQ ID NO: 370061 - RNA, 19 nt, Homo sapiens
caaagcaaauguggacuga

SEQ ID NO: 370062 - RNA, 19 nt, Homo sapiens
ggacugaaucugcuuguug

SEQ ID NO: 370063 - RNA, 19 nt, Homo sapiens
aaacccaacuguucaugaa

SEQ ID NO: 370064 - RNA, 19 nt, Homo sapiens
gacugaaucugcuuguuga

SEQ ID NO: 370065 - RNA, 19 nt, Homo sapiens
guaguacucuugcuuaagg

SEQ ID NO: 370066 - RNA, 19 nt, Homo sapiens
uguaggaaauugucuauuc

SEQ ID NO: 370067 - RNA, 19 nt, Homo sapiens
gcagauucuuuauccuuug

SEQ ID NO: 370068 - RNA, 19 nt, Homo sapiens
ugaauucuuugcugacauu

SEQ ID NO: 370069 - RNA, 19 nt, Homo sapiens
gggcauauuuaacggauuc

SEQ ID NO: 370070 - RNA, 19 nt, Homo sapiens
ggcagauucuuuauccuuu

SEQ ID NO: 370071 - RNA, 19 nt, Homo sapiens
gaagcacuguacaaguuug

SEQ ID NO: 370072 - RNA, 19 nt, Homo sapiens
gaucaguguuugaagaaag

SEQ ID NO: 370073 - RNA, 19 nt, Homo sapiens
aagcaaauguggacugaau

SEQ ID NO: 370074 - RNA, 19 nt, Homo sapiens
ugccagugcugaauucuuu

SEQ ID NO: 370075 - RNA, 19 nt, Homo sapiens
gcgcacaucacuauauuug

SEQ ID NO: 370076 - RNA, 19 nt, Homo sapiens
aggcaagaguuucagauuu

SEQ ID NO: 370077 - RNA, 19 nt, Homo sapiens
ugaaucugcuuguugauca

SEQ ID NO: 370078 - RNA, 19 nt, Homo sapiens
uacagugguuuaucuauga

SEQ ID NO: 370079 - RNA, 19 nt, Homo sapiens
gagaggagaauacuuaucu

SEQ ID NO: 370080 - RNA, 19 nt, Homo sapiens
uugaagcacuguacaaguu

SEQ ID NO: 370081 - RNA, 19 nt, Homo sapiens
ugaaauaaacccaacuguu

SEQ ID NO: 370082 - RNA, 19 nt, Homo sapiens
ugguaucuguguugaauaa

SEQ ID NO: 370083 - RNA, 19 nt, Homo sapiens
ggaugagacagauaccaua

SEQ ID NO: 370084 - RNA, 19 nt, Homo sapiens
guugaucaguguuugaaga

SEQ ID NO: 370085 - RNA, 19 nt, Homo sapiens
cuacagugguuuaucuaug

SEQ ID NO: 370086 - RNA, 19 nt, Homo sapiens
gauucucaguuacacuuaa

SEQ ID NO: 370087 - RNA, 19 nt, Homo sapiens
cauacaccaugaugaaguu

SEQ ID NO: 370088 - RNA, 19 nt, Homo sapiens
cagauaccauacaccauga

SEQ ID NO: 370089 - RNA, 19 nt, Homo sapiens
ggaugcagcucccaaaaug

SEQ ID NO: 370090 - RNA, 19 nt, Homo sapiens
gcuaagguucgaauucaaa

SEQ ID NO: 370091 - RNA, 19 nt, Homo sapiens
ugaagucuuuaaagucuug

SEQ ID NO: 370092 - RNA, 19 nt, Homo sapiens
cagggacucugcaaguuug

SEQ ID NO: 370093 - RNA, 19 nt, Homo sapiens
cagguuaugccaacacuuu

SEQ ID NO: 370094 - RNA, 19 nt, Homo sapiens
uaaagaggaugguguucgu

SEQ ID NO: 370095 - RNA, 19 nt, Homo sapiens
cagcauugguuccucuaga

SEQ ID NO: 370096 - RNA, 19 nt, Homo sapiens
caagggagugguuguguga

SEQ ID NO: 370097 - RNA, 19 nt, Homo sapiens
aaaguacaagggcauauuu

SEQ ID NO: 370098 - RNA, 19 nt, Homo sapiens
cacaacacauacagcauug

SEQ ID NO: 370099 - RNA, 19 nt, Homo sapiens
gcaagaguuucagauuuac

SEQ ID NO: 370100 - RNA, 19 nt, Homo sapiens
uuggagaggagaauacuua

SEQ ID NO: 370101 - RNA, 19 nt, Homo sapiens
gaugaaguucgccugcuuu

SEQ ID NO: 370102 - RNA, 19 nt, Homo sapiens
cucuagaucugguuaaaug

SEQ ID NO: 370103 - RNA, 19 nt, Homo sapiens
gaagaaagugcaaaaggaa

SEQ ID NO: 370104 - RNA, 19 nt, Homo sapiens
gcaaauguggacugaaucu

SEQ ID NO: 370105 - RNA, 19 nt, Homo sapiens
cagagcagcugguuguaac

SEQ ID NO: 370106 - RNA, 19 nt, Homo sapiens
uggcgcacaucacuauauu

SEQ ID NO: 370107 - RNA, 19 nt, Homo sapiens
ggaugguguucgugguuug

SEQ ID NO: 370108 - RNA, 19 nt, Homo sapiens
gugcuucucugguccucaa

SEQ ID NO: 370109 - RNA, 19 nt, Homo sapiens
guaucuguguugaauaaag

SEQ ID NO: 370110 - RNA, 19 nt, Homo sapiens
ugaagaaagugcaaaagga

SEQ ID NO: 370111 - RNA, 19 nt, Homo sapiens
gauuuaaagguguauggaa

SEQ ID NO: 370112 - RNA, 19 nt, Homo sapiens
gaagaaggccuaaaagcau

SEQ ID NO: 370113 - RNA, 19 nt, Homo sapiens
guacaagggcauauuuaac

SEQ ID NO: 370114 - RNA, 19 nt, Homo sapiens
aagcuuggguuaacucagu

SEQ ID NO: 370115 - RNA, 19 nt, Homo sapiens
aaauaaacccaacuguuca

SEQ ID NO: 370116 - RNA, 19 nt, Homo sapiens
ugaugaaguucgccugcuu

SEQ ID NO: 370117 - RNA, 19 nt, Homo sapiens
uaccauacaccaugaugaa

SEQ ID NO: 370118 - RNA, 19 nt, Homo sapiens
ggauucucaguuacacuua

SEQ ID NO: 370119 - RNA, 19 nt, Homo sapiens
ugaacguacuguugaagca

SEQ ID NO: 370120 - RNA, 19 nt, Homo sapiens
gcuuugaacguacuguuga

SEQ ID NO: 370121 - RNA, 19 nt, Homo sapiens
ggaagaaggccuaaaagca

SEQ ID NO: 370122 - RNA, 19 nt, Homo sapiens
cugcuaagguucgaauuca

SEQ ID NO: 370123 - RNA, 19 nt, Homo sapiens
gcugaauucuuugcugaca

SEQ ID NO: 370124 - RNA, 19 nt, Homo sapiens
aaggaugggcuccgacuuu

SEQ ID NO: 370125 - RNA, 19 nt, Homo sapiens
uaaacccaacuguucauga

SEQ ID NO: 370126 - RNA, 19 nt, Homo sapiens
aguuucagauuuacuguug

SEQ ID NO: 370127 - RNA, 19 nt, Homo sapiens
ugugguaucuguguugaau

SEQ ID NO: 370128 - RNA, 19 nt, Homo sapiens
ugaagcacuguacaaguuu

SEQ ID NO: 370129 - RNA, 19 nt, Homo sapiens
cagauucuuuauccuuugu

SEQ ID NO: 370130 - RNA, 19 nt, Homo sapiens
gaggaugguguucgugguu

SEQ ID NO: 370131 - RNA, 19 nt, Homo sapiens
acauugcccuggcuccuau

SEQ ID NO: 370132 - RNA, 19 nt, Homo sapiens
cuguaguacucuugcuuaa

SEQ ID NO: 370133 - RNA, 19 nt, Homo sapiens
aguacaagggcauauuuaa

SEQ ID NO: 370134 - RNA, 19 nt, Homo sapiens
caacacauacagcauuggu

SEQ ID NO: 370135 - RNA, 19 nt, Homo sapiens
uaaggaagaaggccuaaaa

SEQ ID NO: 370136 - RNA, 19 nt, Homo sapiens
ggaagcugcuaagguucga

SEQ ID NO: 370137 - RNA, 19 nt, Homo sapiens
aaguacaagggcauauuua

SEQ ID NO: 370138 - RNA, 19 nt, Homo sapiens
ggagaggagaauacuuauc

SEQ ID NO: 370139 - RNA, 19 nt, Homo sapiens
cugauucugugguaucugu

SEQ ID NO: 370140 - RNA, 19 nt, Homo sapiens
ugagacagauaccauacac

SEQ ID NO: 370141 - RNA, 19 nt, Homo sapiens
gaugagacagauaccauac

SEQ ID NO: 370142 - RNA, 19 nt, Homo sapiens
gacauugcccuggcuccua

SEQ ID NO: 370143 - RNA, 19 nt, Homo sapiens
gcuuaaggcaagaguuuca

SEQ ID NO: 370144 - RNA, 19 nt, Homo sapiens
ccugauauaauuacuguag

SEQ ID NO: 370145 - RNA, 19 nt, Homo sapiens
gguuguaacauuuguagca

SEQ ID NO: 370146 - RNA, 19 nt, Homo sapiens
gguuaugccaacacuuuga

SEQ ID NO: 370147 - RNA, 19 nt, Homo sapiens
ugcccuggcuccuauggaa

SEQ ID NO: 370148 - RNA, 19 nt, Homo sapiens
ggacuguuugcccguauca

SEQ ID NO: 370149 - RNA, 19 nt, Homo sapiens
guauggaagggacuguuug

SEQ ID NO: 370150 - RNA, 19 nt, Homo sapiens
gauaccauacaccaugaug

SEQ ID NO: 370151 - RNA, 19 nt, Homo sapiens
ggacaaauguguaaacuuu

SEQ ID NO: 370152 - RNA, 19 nt, Homo sapiens
uaagauagcugagauaaug

SEQ ID NO: 370153 - RNA, 19 nt, Homo sapiens
guacagaagccaagucuua

SEQ ID NO: 370154 - RNA, 19 nt, Homo sapiens
ccucaaagcuaucaaguuu

SEQ ID NO: 370155 - RNA, 19 nt, Homo sapiens
gaacauuucugaacugagu

SEQ ID NO: 370156 - RNA, 19 nt, Homo sapiens
ggaaagauguuuguagaug

SEQ ID NO: 370157 - RNA, 19 nt, Homo sapiens
gaaagauguuuguagaugu

SEQ ID NO: 370158 - RNA, 19 nt, Homo sapiens
gugcucagauuggaaauua

SEQ ID NO: 370159 - RNA, 19 nt, Homo sapiens
caacuuugcugccucaaug

SEQ ID NO: 370160 - RNA, 19 nt, Homo sapiens
gggaugcccuuuacaaguu

SEQ ID NO: 370161 - RNA, 19 nt, Homo sapiens
gauaaugauuccacaugaa

SEQ ID NO: 370162 - RNA, 19 nt, Homo sapiens
gcagacacuugcaacguuu

SEQ ID NO: 370163 - RNA, 19 nt, Homo sapiens
caacagaggcacucgaauu

SEQ ID NO: 370164 - RNA, 19 nt, Homo sapiens
gaaagugcccucccuuaug

SEQ ID NO: 370165 - RNA, 19 nt, Homo sapiens
gaagaccauugccaacuau

SEQ ID NO: 370166 - RNA, 19 nt, Homo sapiens
gaagauaugccaagcuaug

SEQ ID NO: 370167 - RNA, 19 nt, Homo sapiens
gaacugagugcuaugauuc

SEQ ID NO: 370168 - RNA, 19 nt, Homo sapiens
ugacaaagcauccaaugaa

SEQ ID NO: 370169 - RNA, 19 nt, Homo sapiens
gugcuugaaucuaauauug

SEQ ID NO: 370170 - RNA, 19 nt, Homo sapiens
gaauugcccuggucguguu

SEQ ID NO: 370171 - RNA, 19 nt, Homo sapiens
gaagauaagaaggaaauga

SEQ ID NO: 370172 - RNA, 19 nt, Homo sapiens
ccgaagauaugccaagcua

SEQ ID NO: 370173 - RNA, 19 nt, Homo sapiens
ccagaaagcuuuuaacugu

SEQ ID NO: 370174 - RNA, 19 nt, Homo sapiens
gcaguacuuuaaagauuug

SEQ ID NO: 370175 - RNA, 19 nt, Homo sapiens
ugaagucagugcucagauu

SEQ ID NO: 370176 - RNA, 19 nt, Homo sapiens
ccaaugaacauaucuugaa

SEQ ID NO: 370177 - RNA, 19 nt, Homo sapiens
aaagugcccucccuuaugu

SEQ ID NO: 370178 - RNA, 19 nt, Homo sapiens
gauauuagggucugagaga

SEQ ID NO: 370179 - RNA, 19 nt, Homo sapiens
ccgcaguacuuuaaagauu

SEQ ID NO: 370180 - RNA, 19 nt, Homo sapiens
gaaauuaagauagcugaga

SEQ ID NO: 370181 - RNA, 19 nt, Homo sapiens
agaagaccauugccaacua

SEQ ID NO: 370182 - RNA, 19 nt, Homo sapiens
ccuacaaacucgcaaguau

SEQ ID NO: 370183 - RNA, 19 nt, Homo sapiens
gaggugcaauuccuacaga

SEQ ID NO: 370184 - RNA, 19 nt, Homo sapiens
uacaggaaauggauaaaug

SEQ ID NO: 370185 - RNA, 19 nt, Homo sapiens
ggagaaaucaaucaguaga

SEQ ID NO: 370186 - RNA, 19 nt, Homo sapiens
gcacgauccucuuucuagu

SEQ ID NO: 370187 - RNA, 19 nt, Homo sapiens
gaagaggacccugggagaa

SEQ ID NO: 370188 - RNA, 19 nt, Homo sapiens
gaauauccucgaucucuga

SEQ ID NO: 370189 - RNA, 19 nt, Homo sapiens
ggcccgugcuugaaucuaa

SEQ ID NO: 370190 - RNA, 19 nt, Homo sapiens
cgcaguacuuuaaagauuu

SEQ ID NO: 370191 - RNA, 19 nt, Homo sapiens
ugaacugagugcuaugauu

SEQ ID NO: 370192 - RNA, 19 nt, Homo sapiens
gaagucagugcucagauug

SEQ ID NO: 370193 - RNA, 19 nt, Homo sapiens
gggaagacuaccuugauaa

SEQ ID NO: 370194 - RNA, 19 nt, Homo sapiens
gagucaaggucucuuaagu

SEQ ID NO: 370195 - RNA, 19 nt, Homo sapiens
ggucaauggugcaauuagu

SEQ ID NO: 370196 - RNA, 19 nt, Homo sapiens
gcgaggccauguacaacaa

SEQ ID NO: 370197 - RNA, 19 nt, Homo sapiens
uuggagaaaucaaucagua

SEQ ID NO: 370198 - RNA, 19 nt, Homo sapiens
uacaaacucgcaaguauuu

SEQ ID NO: 370199 - RNA, 19 nt, Homo sapiens
ggcguucgcugggccuuua

SEQ ID NO: 370200 - RNA, 19 nt, Homo sapiens
gagauaaugauuccacaug

SEQ ID NO: 370201 - RNA, 19 nt, Homo sapiens
gggcuuauaaaguggaaua

SEQ ID NO: 370202 - RNA, 19 nt, Homo sapiens
gaagaauuccagaaagcuu

SEQ ID NO: 370203 - RNA, 19 nt, Homo sapiens
uuacaaauccgacgacugu

SEQ ID NO: 370204 - RNA, 19 nt, Homo sapiens
caguauagauggcuggaau

SEQ ID NO: 370205 - RNA, 19 nt, Homo sapiens
ccaggaagauaagaaggaa

SEQ ID NO: 370206 - RNA, 19 nt, Homo sapiens
gaccauugccaacuauuug

SEQ ID NO: 370207 - RNA, 19 nt, Homo sapiens
agauaaugauuccacauga

SEQ ID NO: 370208 - RNA, 19 nt, Homo sapiens
ugaaggaacuuuuggagaa

SEQ ID NO: 370209 - RNA, 19 nt, Homo sapiens
augaagaccucaaagcuau

SEQ ID NO: 370210 - RNA, 19 nt, Homo sapiens
aaaguuggcuauccagagu

SEQ ID NO: 370211 - RNA, 19 nt, Homo sapiens
agggaagacuaccuugaua

SEQ ID NO: 370212 - RNA, 19 nt, Homo sapiens
ucuuaagucuccaagcuaa

SEQ ID NO: 370213 - RNA, 19 nt, Homo sapiens
cgagaacaaguccaaauug

SEQ ID NO: 370214 - RNA, 19 nt, Homo sapiens
caacaaccagcucuucuuc

SEQ ID NO: 370215 - RNA, 19 nt, Homo sapiens
acagagugguuuacaaauc

SEQ ID NO: 370216 - RNA, 19 nt, Homo sapiens
ggaaaugauggaggaauug

SEQ ID NO: 370217 - RNA, 19 nt, Homo sapiens
agcaggcgcuuucaguaua

SEQ ID NO: 370218 - RNA, 19 nt, Homo sapiens
gaaccagcgaggccaugua

SEQ ID NO: 370219 - RNA, 19 nt, Homo sapiens
caaugaacauaucuugaag

SEQ ID NO: 370220 - RNA, 19 nt, Homo sapiens
gacaaagcauccaaugaac

SEQ ID NO: 370221 - RNA, 19 nt, Homo sapiens
cuacacauccuacggcauu

SEQ ID NO: 370222 - RNA, 19 nt, Homo sapiens
gagaaaucaaucaguagaa

SEQ ID NO: 370223 - RNA, 19 nt, Homo sapiens
gcugccaucuuaaguaaag

SEQ ID NO: 370224 - RNA, 19 nt, Homo sapiens
ucguagggcuuauaaagug

SEQ ID NO: 370225 - RNA, 19 nt, Homo sapiens
gaguuauggugcuauagga

SEQ ID NO: 370226 - RNA, 19 nt, Homo sapiens
ggaacagaauauccucgau

SEQ ID NO: 370227 - RNA, 19 nt, Homo sapiens
ucugauuucuucuggcuaa

SEQ ID NO: 370228 - RNA, 19 nt, Homo sapiens
aaagauguuuguagaugug

SEQ ID NO: 370229 - RNA, 19 nt, Homo sapiens
gcaggcgcuuucaguauag

SEQ ID NO: 370230 - RNA, 19 nt, Homo sapiens
caccgaagccauacagaaa

SEQ ID NO: 370231 - RNA, 19 nt, Homo sapiens
cuacggcccuucugaugga

SEQ ID NO: 370232 - RNA, 19 nt, Homo sapiens
cugcugccaucuuaaguaa

SEQ ID NO: 370233 - RNA, 19 nt, Homo sapiens
cuucaucgcccauugcuuu

SEQ ID NO: 370234 - RNA, 19 nt, Homo sapiens
uagcugggacgcugguuua

SEQ ID NO: 370235 - RNA, 19 nt, Homo sapiens
ucaauggugcaauuaguaa

SEQ ID NO: 370236 - RNA, 19 nt, Homo sapiens
gaauuuacacauggauuug

SEQ ID NO: 370237 - RNA, 19 nt, Homo sapiens
gagagaaagaagaccauug

SEQ ID NO: 370238 - RNA, 19 nt, Homo sapiens
ugaaugagaaagcgauuga

SEQ ID NO: 370239 - RNA, 19 nt, Homo sapiens
gaagccagaaugcaucgaa

SEQ ID NO: 370240 - RNA, 19 nt, Homo sapiens
ugugauggcuggauaagca

SEQ ID NO: 370241 - RNA, 19 nt, Homo sapiens
ccacccaauuccacgauga

SEQ ID NO: 370242 - RNA, 19 nt, Homo sapiens
gcaauuaguaacuuugaag

SEQ ID NO: 370243 - RNA, 19 nt, Homo sapiens
gaaauggauaaaugacaga

SEQ ID NO: 370244 - RNA, 19 nt, Homo sapiens
gaaaaggaaagccaaagaa

SEQ ID NO: 370245 - RNA, 19 nt, Homo sapiens
aggaaaugauggaggaauu

SEQ ID NO: 370246 - RNA, 19 nt, Homo sapiens
uuggaaagauguuuguaga

SEQ ID NO: 370247 - RNA, 19 nt, Homo sapiens
ugaaagugcccucccuuau

SEQ ID NO: 370248 - RNA, 19 nt, Homo sapiens
gucaaggucucuuaagucu

SEQ ID NO: 370249 - RNA, 19 nt, Homo sapiens
gagggaagacuaccuugau

SEQ ID NO: 370250 - RNA, 19 nt, Homo sapiens
caacguuucguggucaaua

SEQ ID NO: 370251 - RNA, 19 nt, Homo sapiens
ggauguaccuggagagaua

SEQ ID NO: 370252 - RNA, 19 nt, Homo sapiens
ggagagagauuaagaagag

SEQ ID NO: 370253 - RNA, 19 nt, Homo sapiens
ggacagguucuaugaauuu

SEQ ID NO: 370254 - RNA, 19 nt, Homo sapiens
gaagaggaaauguuuguuu

SEQ ID NO: 370255 - RNA, 19 nt, Homo sapiens
gaacuccucuguugugucu

SEQ ID NO: 370256 - RNA, 19 nt, Homo sapiens
gaauuugaaugcugugugu

SEQ ID NO: 370257 - RNA, 19 nt, Homo sapiens
ggacugaugggcugcuaua

SEQ ID NO: 370258 - RNA, 19 nt, Homo sapiens
ccacaaggaccguuucauu

SEQ ID NO: 370259 - RNA, 19 nt, Homo sapiens
caaggaccguuucauuuca

SEQ ID NO: 370260 - RNA, 19 nt, Homo sapiens
ggacugggaugcuggacau

SEQ ID NO: 370261 - RNA, 19 nt, Homo sapiens
gcaaccgacagcagaguua

SEQ ID NO: 370262 - RNA, 19 nt, Homo sapiens
aagaggaaauguuuguuug

SEQ ID NO: 370263 - RNA, 19 nt, Homo sapiens
cacaaggaccguuucauuu

SEQ ID NO: 370264 - RNA, 19 nt, Homo sapiens
gggacagguucuaugaauu

SEQ ID NO: 370265 - RNA, 19 nt, Homo sapiens
gaagcuuucucugccauau

SEQ ID NO: 370266 - RNA, 19 nt, Homo sapiens
ucucuacccuccuucauga

SEQ ID NO: 370267 - RNA, 19 nt, Homo sapiens
caccaggacugccauguuc

SEQ ID NO: 370268 - RNA, 19 nt, Homo sapiens
cagguucuaugaauuugaa

SEQ ID NO: 370269 - RNA, 19 nt, Homo sapiens
gaggaaauguuuguuuggu

SEQ ID NO: 370270 - RNA, 19 nt, Homo sapiens
cugaugggcugcuauacuu

SEQ ID NO: 370271 - RNA, 19 nt, Homo sapiens
agaagugucgccaugcuua

SEQ ID NO: 370272 - RNA, 19 nt, Homo sapiens
gaggaugauucgcaguuuc

SEQ ID NO: 370273 - RNA, 19 nt, Homo sapiens
aagcuccucucugcucuua

SEQ ID NO: 370274 - RNA, 19 nt, Homo sapiens
gcuguaagaagaaauacuu

SEQ ID NO: 370275 - RNA, 19 nt, Homo sapiens
ucuggugccuccucacuuu

SEQ ID NO: 370276 - RNA, 19 nt, Homo sapiens
gagggcacauccuggguau

SEQ ID NO: 370277 - RNA, 19 nt, Homo sapiens
auacuuggguaccaucaaa

SEQ ID NO: 370278 - RNA, 19 nt, Homo sapiens
cccauuuccuuugauguua

SEQ ID NO: 370279 - RNA, 19 nt, Homo sapiens
gaucccggacucuguauga

SEQ ID NO: 370280 - RNA, 19 nt, Homo sapiens
gguccuugcucggagagua

SEQ ID NO: 370281 - RNA, 19 nt, Homo sapiens
ggucagcugugagaagugu

SEQ ID NO: 370282 - RNA, 19 nt, Homo sapiens
ccacagacaucccuaaaag

SEQ ID NO: 370283 - RNA, 19 nt, Homo sapiens
gcagaguuacuguuacugu

SEQ ID NO: 370284 - RNA, 19 nt, Homo sapiens
ugaggaugauucgcaguuu

SEQ ID NO: 370285 - RNA, 19 nt, Homo sapiens
acaaggaccguuucauuuc

SEQ ID NO: 370286 - RNA, 19 nt, Homo sapiens
acacaccggcacuuucaua

SEQ ID NO: 370287 - RNA, 19 nt, Homo sapiens
gagauuaagaagaggaaau

SEQ ID NO: 370288 - RNA, 19 nt, Homo sapiens
gacagguucuaugaauuug

SEQ ID NO: 370289 - RNA, 19 nt, Homo sapiens
aagaugugcuggccagaug

SEQ ID NO: 370290 - RNA, 19 nt, Homo sapiens
cagcagaguuacuguuacu

SEQ ID NO: 370291 - RNA, 19 nt, Homo sapiens
ugaggagggaggaugauaa

SEQ ID NO: 370292 - RNA, 19 nt, Homo sapiens
ccucugaccucaccuacag

SEQ ID NO: 370293 - RNA, 19 nt, Homo sapiens
gaagugucgccaugcuuau

SEQ ID NO: 370294 - RNA, 19 nt, Homo sapiens
cccggacucuguaugauug

SEQ ID NO: 370295 - RNA, 19 nt, Homo sapiens
ggacucuguaugauugaaa

SEQ ID NO: 370296 - RNA, 19 nt, Homo sapiens
ccauuuccuuugauguuau

SEQ ID NO: 370297 - RNA, 19 nt, Homo sapiens
ucacacacaccggcacuuu

SEQ ID NO: 370298 - RNA, 19 nt, Homo sapiens
ucagggagagagauuaaga

SEQ ID NO: 370299 - RNA, 19 nt, Homo sapiens
gcuccucucugcucuuaac

SEQ ID NO: 370300 - RNA, 19 nt, Homo sapiens
uggcccaucuuguccugua

SEQ ID NO: 370301 - RNA, 19 nt, Homo sapiens
ugccucaucuuccucaguu

SEQ ID NO: 370302 - RNA, 19 nt, Homo sapiens
aguguuugcuguaagaaga

SEQ ID NO: 370303 - RNA, 19 nt, Homo sapiens
ccucagcagugcgcaauca

SEQ ID NO: 370304 - RNA, 19 nt, Homo sapiens
uguaucaccucaguguuug

SEQ ID NO: 370305 - RNA, 19 nt, Homo sapiens
gggccaugcuggguaugaa

SEQ ID NO: 370306 - RNA, 19 nt, Homo sapiens
ccucccauccuucccauuu

SEQ ID NO: 370307 - RNA, 19 nt, Homo sapiens
acacacaccggcacuuuca

SEQ ID NO: 370308 - RNA, 19 nt, Homo sapiens
gcaagccccuccucuaugg

SEQ ID NO: 370309 - RNA, 19 nt, Homo sapiens
gaggagggaggaugauaag

SEQ ID NO: 370310 - RNA, 19 nt, Homo sapiens
ccucuucucuacccuccuu

SEQ ID NO: 370311 - RNA, 19 nt, Homo sapiens
uucauacccugaccucuga

SEQ ID NO: 370312 - RNA, 19 nt, Homo sapiens
uaagaagaggaaauguuug

SEQ ID NO: 370313 - RNA, 19 nt, Homo sapiens
gggagagagauuaagaaga

SEQ ID NO: 370314 - RNA, 19 nt, Homo sapiens
gacucuguaugauugaaau

SEQ ID NO: 370315 - RNA, 19 nt, Homo sapiens
gagagauuaagaagaggaa

SEQ ID NO: 370316 - RNA, 19 nt, Homo sapiens
ggggacagguucuaugaau

SEQ ID NO: 370317 - RNA, 19 nt, Homo sapiens
gagcaagccccuccucuau

SEQ ID NO: 370318 - RNA, 19 nt, Homo sapiens
gagaagugucgccaugcuu

SEQ ID NO: 370319 - RNA, 19 nt, Homo sapiens
aagaagaggaaauguuugu

SEQ ID NO: 370320 - RNA, 19 nt, Homo sapiens
gaacuucacauugguuucc

SEQ ID NO: 370321 - RNA, 19 nt, Homo sapiens
cuguaucaccucaguguuu

SEQ ID NO: 370322 - RNA, 19 nt, Homo sapiens
ucaccaggacugccauguu

SEQ ID NO: 370323 - RNA, 19 nt, Homo sapiens
cuacccuccuucaugauuc

SEQ ID NO: 370324 - RNA, 19 nt, Homo sapiens
gcacccagugucugagcaa

SEQ ID NO: 370325 - RNA, 19 nt, Homo sapiens
ucugagaauugggacaguu

SEQ ID NO: 370326 - RNA, 19 nt, Homo sapiens
guucuauggaaagacauua

SEQ ID NO: 370327 - RNA, 19 nt, Homo sapiens
ugagaagugucgccaugcu

SEQ ID NO: 370328 - RNA, 19 nt, Homo sapiens
cagggagagagauuaagaa

SEQ ID NO: 370329 - RNA, 19 nt, Homo sapiens
cgcaguuucugguucuaug

SEQ ID NO: 370330 - RNA, 19 nt, Homo sapiens
gggcacauccuggguaugc

SEQ ID NO: 370331 - RNA, 19 nt, Homo sapiens
ggauguaccuggagagaua

SEQ ID NO: 370332 - RNA, 19 nt, Homo sapiens
ggagagagauuaagaagag

SEQ ID NO: 370333 - RNA, 19 nt, Homo sapiens
ggacagguucuaugaauuu

SEQ ID NO: 370334 - RNA, 19 nt, Homo sapiens
gaagaggaaauguuuguuu

SEQ ID NO: 370335 - RNA, 19 nt, Homo sapiens
gaacuccucuguugugucu

SEQ ID NO: 370336 - RNA, 19 nt, Homo sapiens
gaauuugaaugcugugugu

SEQ ID NO: 370337 - RNA, 19 nt, Homo sapiens
ggacugaugggcugcuaua

SEQ ID NO: 370338 - RNA, 19 nt, Homo sapiens
ccacaaggaccguuucauu

SEQ ID NO: 370339 - RNA, 19 nt, Homo sapiens
caaggaccguuucauuuca

SEQ ID NO: 370340 - RNA, 19 nt, Homo sapiens
ggacugggaugcuggacau

SEQ ID NO: 370341 - RNA, 19 nt, Homo sapiens
gcaaccgacagcagaguua

SEQ ID NO: 370342 - RNA, 19 nt, Homo sapiens
aagaggaaauguuuguuug

SEQ ID NO: 370343 - RNA, 19 nt, Homo sapiens
cacaaggaccguuucauuu

SEQ ID NO: 370344 - RNA, 19 nt, Homo sapiens
gggacagguucuaugaauu

SEQ ID NO: 370345 - RNA, 19 nt, Homo sapiens
gaagcuuucucugccauau

SEQ ID NO: 370346 - RNA, 19 nt, Homo sapiens
ucucuacccuccuucauga

SEQ ID NO: 370347 - RNA, 19 nt, Homo sapiens
caccaggacugccauguuc

SEQ ID NO: 370348 - RNA, 19 nt, Homo sapiens
cagguucuaugaauuugaa

SEQ ID NO: 370349 - RNA, 19 nt, Homo sapiens
gaggaaauguuuguuuggu

SEQ ID NO: 370350 - RNA, 19 nt, Homo sapiens
cugaugggcugcuauacuu

SEQ ID NO: 370351 - RNA, 19 nt, Homo sapiens
agaagugucgccaugcuua

SEQ ID NO: 370352 - RNA, 19 nt, Homo sapiens
gaggaugauucgcaguuuc

SEQ ID NO: 370353 - RNA, 19 nt, Homo sapiens
aagcuccucucugcucuua

SEQ ID NO: 370354 - RNA, 19 nt, Homo sapiens
gcuguaagaagaaauacuu

SEQ ID NO: 370355 - RNA, 19 nt, Homo sapiens
gagggcacauccuggguau

SEQ ID NO: 370356 - RNA, 19 nt, Homo sapiens
ucuggugccuccucacuuu

SEQ ID NO: 370357 - RNA, 19 nt, Homo sapiens
auacuuggguaccaucaaa

SEQ ID NO: 370358 - RNA, 19 nt, Homo sapiens
cccauuuccuuugauguua

SEQ ID NO: 370359 - RNA, 19 nt, Homo sapiens
gaucccggacucuguauga

SEQ ID NO: 370360 - RNA, 19 nt, Homo sapiens
gguccuugcucggagagua

SEQ ID NO: 370361 - RNA, 19 nt, Homo sapiens
ggucagcugugagaagugu

SEQ ID NO: 370362 - RNA, 19 nt, Homo sapiens
ccacagacaucccuaaaag

SEQ ID NO: 370363 - RNA, 19 nt, Homo sapiens
gcagaguuacuguuacugu

SEQ ID NO: 370364 - RNA, 19 nt, Homo sapiens
ugaggaugauucgcaguuu

SEQ ID NO: 370365 - RNA, 19 nt, Homo sapiens
acaaggaccguuucauuuc

SEQ ID NO: 370366 - RNA, 19 nt, Homo sapiens
acacaccggcacuuucaua

SEQ ID NO: 370367 - RNA, 19 nt, Homo sapiens
cagcagcggcuacaacuuc

SEQ ID NO: 370368 - RNA, 19 nt, Homo sapiens
gagauuaagaagaggaaau

SEQ ID NO: 370369 - RNA, 19 nt, Homo sapiens
aagaugugcuggccagaug

SEQ ID NO: 370370 - RNA, 19 nt, Homo sapiens
gacagguucuaugaauuug

SEQ ID NO: 370371 - RNA, 19 nt, Homo sapiens
cagcagaguuacuguuacu

SEQ ID NO: 370372 - RNA, 19 nt, Homo sapiens
ugaggagggaggaugauaa

SEQ ID NO: 370373 - RNA, 19 nt, Homo sapiens
ccucugaccucaccuacag

SEQ ID NO: 370374 - RNA, 19 nt, Homo sapiens
gaagugucgccaugcuuau

SEQ ID NO: 370375 - RNA, 19 nt, Homo sapiens
cccggacucuguaugauug

SEQ ID NO: 370376 - RNA, 19 nt, Homo sapiens
ggacucuguaugauugaaa

SEQ ID NO: 370377 - RNA, 19 nt, Homo sapiens
ccauuuccuuugauguuau

SEQ ID NO: 370378 - RNA, 19 nt, Homo sapiens
ucacacacaccggcacuuu

SEQ ID NO: 370379 - RNA, 19 nt, Homo sapiens
ucagggagagagauuaaga

SEQ ID NO: 370380 - RNA, 19 nt, Homo sapiens
gcuccucucugcucuuaac

SEQ ID NO: 370381 - RNA, 19 nt, Homo sapiens
uggcccaucuuguccugua

SEQ ID NO: 370382 - RNA, 19 nt, Homo sapiens
ugccucaucuuccucaguu

SEQ ID NO: 370383 - RNA, 19 nt, Homo sapiens
aguguuugcuguaagaaga

SEQ ID NO: 370384 - RNA, 19 nt, Homo sapiens
ccucagcagugcgcaauca

SEQ ID NO: 370385 - RNA, 19 nt, Homo sapiens
uguaucaccucaguguuug

SEQ ID NO: 370386 - RNA, 19 nt, Homo sapiens
gggccaugcuggguaugaa

SEQ ID NO: 370387 - RNA, 19 nt, Homo sapiens
ccucccauccuucccauuu

SEQ ID NO: 370388 - RNA, 19 nt, Homo sapiens
acacacaccggcacuuuca

SEQ ID NO: 370389 - RNA, 19 nt, Homo sapiens
gcaagccccuccucuaugg

SEQ ID NO: 370390 - RNA, 19 nt, Homo sapiens
gaggagggaggaugauaag

SEQ ID NO: 370391 - RNA, 19 nt, Homo sapiens
ccucuucucuacccuccuu

SEQ ID NO: 370392 - RNA, 19 nt, Homo sapiens
uucauacccugaccucuga

SEQ ID NO: 370393 - RNA, 19 nt, Homo sapiens
uaagaagaggaaauguuug

SEQ ID NO: 370394 - RNA, 19 nt, Homo sapiens
gggagagagauuaagaaga

SEQ ID NO: 370395 - RNA, 19 nt, Homo sapiens
gacucuguaugauugaaau

SEQ ID NO: 370396 - RNA, 19 nt, Homo sapiens
gagagauuaagaagaggaa

SEQ ID NO: 370397 - RNA, 19 nt, Homo sapiens
ggggacagguucuaugaau

SEQ ID NO: 370398 - RNA, 19 nt, Homo sapiens
gagcaagccccuccucuau

SEQ ID NO: 370399 - RNA, 19 nt, Homo sapiens
gagaagugucgccaugcuu

SEQ ID NO: 370400 - RNA, 19 nt, Homo sapiens
aagaagaggaaauguuugu

SEQ ID NO: 370401 - RNA, 19 nt, Homo sapiens
gaacuucacauugguuucc

SEQ ID NO: 370402 - RNA, 19 nt, Homo sapiens
cuguaucaccucaguguuu

SEQ ID NO: 370403 - RNA, 19 nt, Homo sapiens
ucaccaggacugccauguu

SEQ ID NO: 370404 - RNA, 19 nt, Homo sapiens
cuacccuccuucaugauuc

SEQ ID NO: 370405 - RNA, 19 nt, Homo sapiens
gcacccagugucugagcaa

SEQ ID NO: 370406 - RNA, 19 nt, Homo sapiens
ucugagaauugggacaguu

SEQ ID NO: 370407 - RNA, 19 nt, Homo sapiens
guucuauggaaagacauua

SEQ ID NO: 370408 - RNA, 19 nt, Homo sapiens
cgcaguuucugguucuaug

SEQ ID NO: 370409 - RNA, 19 nt, Homo sapiens
cagggagagagauuaagaa

SEQ ID NO: 370410 - RNA, 19 nt, Homo sapiens
ugagaagugucgccaugcu

SEQ ID NO: 370411 - RNA, 19 nt, Homo sapiens
gggcacauccuggguaugc

SEQ ID NO: 370412 - RNA, 19 nt, Homo sapiens
cagcaaaccugacuccuua

SEQ ID NO: 370413 - RNA, 19 nt, Homo sapiens
ucaaagaccuggccaaaga

SEQ ID NO: 370414 - RNA, 19 nt, Homo sapiens
ggaaacuacuccuuuaaga

SEQ ID NO: 370415 - RNA, 19 nt, Homo sapiens
caacaccgcugccaaagga

SEQ ID NO: 370416 - RNA, 19 nt, Homo sapiens
gaagagggcugccaagaac

SEQ ID NO: 370417 - RNA, 19 nt, Homo sapiens
gaauguagcguguaaauag

SEQ ID NO: 370418 - RNA, 19 nt, Homo sapiens
cagaaggacugcaagauga

SEQ ID NO: 370419 - RNA, 19 nt, Homo sapiens
caaaggcucucacaaaucu

SEQ ID NO: 370420 - RNA, 19 nt, Homo sapiens
ggagccaccugacauugua

SEQ ID NO: 370421 - RNA, 19 nt, Homo sapiens
guacauuucuuaugagcuu

SEQ ID NO: 370422 - RNA, 19 nt, Homo sapiens
cagcuggguugguguguua

SEQ ID NO: 370423 - RNA, 19 nt, Homo sapiens
gcaaacgacugcugaagag

SEQ ID NO: 370424 - RNA, 19 nt, Homo sapiens
cauagaauguagcguguaa

SEQ ID NO: 370425 - RNA, 19 nt, Homo sapiens
gaugagagcauaugaagug

SEQ ID NO: 370426 - RNA, 19 nt, Homo sapiens
ugaaggaguuuguggacua

SEQ ID NO: 370427 - RNA, 19 nt, Homo sapiens
gagagcauaugaaguggaa

SEQ ID NO: 370428 - RNA, 19 nt, Homo sapiens
aaaccugacuccuuacuga

SEQ ID NO: 370429 - RNA, 19 nt, Homo sapiens
cuucaaaccuucacagcua

SEQ ID NO: 370430 - RNA, 19 nt, Homo sapiens
gcagccagcucuucaucaa

SEQ ID NO: 370431 - RNA, 19 nt, Homo sapiens
caacaacaccgcugccaaa

SEQ ID NO: 370432 - RNA, 19 nt, Homo sapiens
ggaaguccaccuuaaagaa

SEQ ID NO: 370433 - RNA, 19 nt, Homo sapiens
caaagaguguccugagugu

SEQ ID NO: 370434 - RNA, 19 nt, Homo sapiens
ucagugacgucgagaacua

SEQ ID NO: 370435 - RNA, 19 nt, Homo sapiens
caccugacauuguaaagaa

SEQ ID NO: 370436 - RNA, 19 nt, Homo sapiens
ggucggcacuucucuguuc

SEQ ID NO: 370437 - RNA, 19 nt, Homo sapiens
gcaagugggauguuuaugu

SEQ ID NO: 370438 - RNA, 19 nt, Homo sapiens
gaccggaagugaauacugu

SEQ ID NO: 370439 - RNA, 19 nt, Homo sapiens
cuucacagcuaaucaaaga

SEQ ID NO: 370440 - RNA, 19 nt, Homo sapiens
agaugaagcugaaggaguu

SEQ ID NO: 370441 - RNA, 19 nt, Homo sapiens
ugagucagauggacaguug

SEQ ID NO: 370442 - RNA, 19 nt, Homo sapiens
gaaacuacuccuuuaagau

SEQ ID NO: 370443 - RNA, 19 nt, Homo sapiens
ggagucagaugaagacaac

SEQ ID NO: 370444 - RNA, 19 nt, Homo sapiens
caugggaaguccaccuuaa

SEQ ID NO: 370445 - RNA, 19 nt, Homo sapiens
gugaaguguuuccguguuu

SEQ ID NO: 370446 - RNA, 19 nt, Homo sapiens
caagugggauguuuauguc

SEQ ID NO: 370447 - RNA, 19 nt, Homo sapiens
gaaggaguuuguggacuau

SEQ ID NO: 370448 - RNA, 19 nt, Homo sapiens
aaucuaaccuggacaucaa

SEQ ID NO: 370449 - RNA, 19 nt, Homo sapiens
ggagcaagugggauguuua

SEQ ID NO: 370450 - RNA, 19 nt, Homo sapiens
gacgagcccugguguguuc

SEQ ID NO: 370451 - RNA, 19 nt, Homo sapiens
gaacggaguguggauguga

SEQ ID NO: 370452 - RNA, 19 nt, Homo sapiens
gcaagcgccugacgucaag

SEQ ID NO: 370453 - RNA, 19 nt, Homo sapiens
gccucuagcuggaaacaaa

SEQ ID NO: 370454 - RNA, 19 nt, Homo sapiens
gccaacaucucccuguaug

SEQ ID NO: 370455 - RNA, 19 nt, Homo sapiens
gcaaagaacacagaaagag

SEQ ID NO: 370456 - RNA, 19 nt, Homo sapiens
gaaacugcgugcugguaca

SEQ ID NO: 370457 - RNA, 19 nt, Homo sapiens
ggcaacauguacauuucua

SEQ ID NO: 370458 - RNA, 19 nt, Homo sapiens
gaagcaaauaguacacaaa

SEQ ID NO: 370459 - RNA, 19 nt, Homo sapiens
ggacucagacuacguuuac

SEQ ID NO: 370460 - RNA, 19 nt, Homo sapiens
ggaaguacaagaacagcaa

SEQ ID NO: 370461 - RNA, 19 nt, Homo sapiens
gaagaagucccgggaguca

SEQ ID NO: 370462 - RNA, 19 nt, Homo sapiens
gacguuacccgcuucauga

SEQ ID NO: 370463 - RNA, 19 nt, Homo sapiens
ugaugucugugcagccuua

SEQ ID NO: 370464 - RNA, 19 nt, Homo sapiens
ggaauuucuuucuauagag

SEQ ID NO: 370465 - RNA, 19 nt, Homo sapiens
gaccgcuuauuccacuuua

SEQ ID NO: 370466 - RNA, 19 nt, Homo sapiens
caacaaagaugugguucac

SEQ ID NO: 370467 - RNA, 19 nt, Homo sapiens
aggaguuuguggacuauua

SEQ ID NO: 370468 - RNA, 19 nt, Homo sapiens
acgggaaacuacuccuuua

SEQ ID NO: 370469 - RNA, 19 nt, Homo sapiens
gcaagaagaaagggaagaa

SEQ ID NO: 370470 - RNA, 19 nt, Homo sapiens
gaaacugucauggguagaa

SEQ ID NO: 370471 - RNA, 19 nt, Homo sapiens
gcaaauaguacacaaaaga

SEQ ID NO: 370472 - RNA, 19 nt, Homo sapiens
gagcaagugggauguuuau

SEQ ID NO: 370473 - RNA, 19 nt, Homo sapiens
ggaaacaaagacaauaagu

SEQ ID NO: 370474 - RNA, 19 nt, Homo sapiens
ccaaguggaaguacaagaa

SEQ ID NO: 370475 - RNA, 19 nt, Homo sapiens
gaaguccaccuuaaagaag

SEQ ID NO: 370476 - RNA, 19 nt, Homo sapiens
acuaagguauugccugaaa

SEQ ID NO: 370477 - RNA, 19 nt, Homo sapiens
gcucaagaucgacgaguuu

SEQ ID NO: 370478 - RNA, 19 nt, Homo sapiens
gcagaugagagcauaugaa

SEQ ID NO: 370479 - RNA, 19 nt, Homo sapiens
gaaaacuacuggccagaug

SEQ ID NO: 370480 - RNA, 19 nt, Homo sapiens
gcugagagcaugaguccuu

SEQ ID NO: 370481 - RNA, 19 nt, Homo sapiens
gcacacaggaagccauuca

SEQ ID NO: 370482 - RNA, 19 nt, Homo sapiens
gcaacauguacauuucuaa

SEQ ID NO: 370483 - RNA, 19 nt, Homo sapiens
gaaagaggaggagcaagug

SEQ ID NO: 370484 - RNA, 19 nt, Homo sapiens
caaguuugaggaccgcuua

SEQ ID NO: 370485 - RNA, 19 nt, Homo sapiens
gaacgggaaacuacuccuu

SEQ ID NO: 370486 - RNA, 19 nt, Homo sapiens
guacacggguggcuuccau

SEQ ID NO: 370487 - RNA, 19 nt, Homo sapiens
gagcuaaaauucucaaugg

SEQ ID NO: 370488 - RNA, 19 nt, Homo sapiens
gaaguggaaaggagguuga

SEQ ID NO: 370489 - RNA, 19 nt, Homo sapiens
gcaagcggguccucaacgu

SEQ ID NO: 370490 - RNA, 19 nt, Homo sapiens
gggcuggauuuguuucuca

SEQ ID NO: 370491 - RNA, 19 nt, Homo sapiens
gcccaucggugccaagaca

SEQ ID NO: 370492 - RNA, 19 nt, Homo sapiens
ugaagagggcugccaagaa

SEQ ID NO: 370493 - RNA, 19 nt, Homo sapiens
gcuguucucucucucucuu

SEQ ID NO: 370494 - RNA, 19 nt, Homo sapiens
gccuuacacucugucuuua

SEQ ID NO: 370495 - RNA, 19 nt, Homo sapiens
uguauuuccugaagcauau

SEQ ID NO: 370496 - RNA, 19 nt, Homo sapiens
gagcaaaccaagagcaagu

SEQ ID NO: 370497 - RNA, 19 nt, Homo sapiens
ggacgucuuuucucaaguu

SEQ ID NO: 370498 - RNA, 19 nt, Homo sapiens
gcaaugccagagucaagaa

SEQ ID NO: 370499 - RNA, 19 nt, Homo sapiens
gaaguacaagaacagcaaa

SEQ ID NO: 370500 - RNA, 19 nt, Homo sapiens
ccaaaacgcugaagcucaa

SEQ ID NO: 370501 - RNA, 19 nt, Homo sapiens
cgcccgacaucgacauaua

SEQ ID NO: 370502 - RNA, 19 nt, Homo sapiens
gcaagaugaagcugaagga

SEQ ID NO: 370503 - RNA, 19 nt, Homo sapiens
uaauaccagcucuuuguuu

SEQ ID NO: 370504 - RNA, 19 nt, Homo sapiens
ggaagaggagcagaagcua

SEQ ID NO: 370505 - RNA, 19 nt, Homo sapiens
gcuggaaauucgagagcaa

SEQ ID NO: 370506 - RNA, 19 nt, Homo sapiens
uucaaaggcucucacaaau

SEQ ID NO: 370507 - RNA, 19 nt, Homo sapiens
gaagcggaccuggcacaaa

SEQ ID NO: 370508 - RNA, 19 nt, Homo sapiens
gggaaguccaccuuaaaga

SEQ ID NO: 370509 - RNA, 19 nt, Homo sapiens
caaggacucagacuacguu

SEQ ID NO: 370510 - RNA, 19 nt, Homo sapiens
ggcaaacgacugcugaaga

SEQ ID NO: 370511 - RNA, 19 nt, Homo sapiens
gaaauucgagagcaaacca

SEQ ID NO: 370512 - RNA, 19 nt, Homo sapiens
cagcaaaccugacuccuua

SEQ ID NO: 370513 - RNA, 19 nt, Homo sapiens
ucaaagaccuggccaaaga

SEQ ID NO: 370514 - RNA, 19 nt, Homo sapiens
ggaaacuacuccuuuaaga

SEQ ID NO: 370515 - RNA, 19 nt, Homo sapiens
caacaccgcugccaaagga

SEQ ID NO: 370516 - RNA, 19 nt, Homo sapiens
gaagagggcugccaagaac

SEQ ID NO: 370517 - RNA, 19 nt, Homo sapiens
gaauguagcguguaaauag

SEQ ID NO: 370518 - RNA, 19 nt, Homo sapiens
cagaaggacugcaagauga

SEQ ID NO: 370519 - RNA, 19 nt, Homo sapiens
caaaggcucucacaaaucu

SEQ ID NO: 370520 - RNA, 19 nt, Homo sapiens
ggagccaccugacauugua

SEQ ID NO: 370521 - RNA, 19 nt, Homo sapiens
guacauuucuuaugagcuu

SEQ ID NO: 370522 - RNA, 19 nt, Homo sapiens
cagcuggguugguguguua

SEQ ID NO: 370523 - RNA, 19 nt, Homo sapiens
gcaaacgacugcugaagag

SEQ ID NO: 370524 - RNA, 19 nt, Homo sapiens
cauagaauguagcguguaa

SEQ ID NO: 370525 - RNA, 19 nt, Homo sapiens
gaugagagcauaugaagug

SEQ ID NO: 370526 - RNA, 19 nt, Homo sapiens
ugaaggaguuuguggacua

SEQ ID NO: 370527 - RNA, 19 nt, Homo sapiens
gagagcauaugaaguggaa

SEQ ID NO: 370528 - RNA, 19 nt, Homo sapiens
aaaccugacuccuuacuga

SEQ ID NO: 370529 - RNA, 19 nt, Homo sapiens
cuucaaaccuucacagcua

SEQ ID NO: 370530 - RNA, 19 nt, Homo sapiens
gcagccagcucuucaucaa

SEQ ID NO: 370531 - RNA, 19 nt, Homo sapiens
caacaacaccgcugccaaa

SEQ ID NO: 370532 - RNA, 19 nt, Homo sapiens
caugggaaguccacaguaa

SEQ ID NO: 370533 - RNA, 19 nt, Homo sapiens
caaagaguguccugagugu

SEQ ID NO: 370534 - RNA, 19 nt, Homo sapiens
ucagugacgucgagaacua

SEQ ID NO: 370535 - RNA, 19 nt, Homo sapiens
caccugacauuguaaagaa

SEQ ID NO: 370536 - RNA, 19 nt, Homo sapiens
ggucggcacuucucuguuc

SEQ ID NO: 370537 - RNA, 19 nt, Homo sapiens
gcaagugggauguuuaugu

SEQ ID NO: 370538 - RNA, 19 nt, Homo sapiens
gaccggaagugaauacugu

SEQ ID NO: 370539 - RNA, 19 nt, Homo sapiens
cuucacagcuaaucaaaga

SEQ ID NO: 370540 - RNA, 19 nt, Homo sapiens
agaugaagcugaaggaguu

SEQ ID NO: 370541 - RNA, 19 nt, Homo sapiens
ugagucagauggacaguug

SEQ ID NO: 370542 - RNA, 19 nt, Homo sapiens
gaaacuacuccuuuaagau

SEQ ID NO: 370543 - RNA, 19 nt, Homo sapiens
ggagucagaugaagacaac

SEQ ID NO: 370544 - RNA, 19 nt, Homo sapiens
gugaaguguuuccguguuu

SEQ ID NO: 370545 - RNA, 19 nt, Homo sapiens
caagugggauguuuauguc

SEQ ID NO: 370546 - RNA, 19 nt, Homo sapiens
gaaggaguuuguggacuau

SEQ ID NO: 370547 - RNA, 19 nt, Homo sapiens
aaucuaaccuggacaucaa

SEQ ID NO: 370548 - RNA, 19 nt, Homo sapiens
ggagcaagugggauguuua

SEQ ID NO: 370549 - RNA, 19 nt, Homo sapiens
gacgagcccugguguguuc

SEQ ID NO: 370550 - RNA, 19 nt, Homo sapiens
gaacggaguguggauguga

SEQ ID NO: 370551 - RNA, 19 nt, Homo sapiens
gcaagcgccugacgucaag

SEQ ID NO: 370552 - RNA, 19 nt, Homo sapiens
gccucuagcuggaaacaaa

SEQ ID NO: 370553 - RNA, 19 nt, Homo sapiens
ggaaguccacaguaaagaa

SEQ ID NO: 370554 - RNA, 19 nt, Homo sapiens
gccaacaucucccuguaug

SEQ ID NO: 370555 - RNA, 19 nt, Homo sapiens
gcaaagaacacagaaagag

SEQ ID NO: 370556 - RNA, 19 nt, Homo sapiens
gaaacugcgugcugguaca

SEQ ID NO: 370557 - RNA, 19 nt, Homo sapiens
ggcaacauguacauuucua

SEQ ID NO: 370558 - RNA, 19 nt, Homo sapiens
gaagcaaauaguacacaaa

SEQ ID NO: 370559 - RNA, 19 nt, Homo sapiens
ggacucagacuacguuuac

SEQ ID NO: 370560 - RNA, 19 nt, Homo sapiens
ggaaguacaagaacagcaa

SEQ ID NO: 370561 - RNA, 19 nt, Homo sapiens
gaagaagucccgggaguca

SEQ ID NO: 370562 - RNA, 19 nt, Homo sapiens
ugaugucugugcagccuua

SEQ ID NO: 370563 - RNA, 19 nt, Homo sapiens
ggaauuucuuucuauagag

SEQ ID NO: 370564 - RNA, 19 nt, Homo sapiens
gaccgcuuauuccacuuua

SEQ ID NO: 370565 - RNA, 19 nt, Homo sapiens
caacaaagaugugguucac

SEQ ID NO: 370566 - RNA, 19 nt, Homo sapiens
aggaguuuguggacuauua

SEQ ID NO: 370567 - RNA, 19 nt, Homo sapiens
acgggaaacuacuccuuua

SEQ ID NO: 370568 - RNA, 19 nt, Homo sapiens
gcaagaagaaagggaagaa

SEQ ID NO: 370569 - RNA, 19 nt, Homo sapiens
gaaacugucauggguagaa

SEQ ID NO: 370570 - RNA, 19 nt, Homo sapiens
gcaaauaguacacaaaaga

SEQ ID NO: 370571 - RNA, 19 nt, Homo sapiens
gagcaagugggauguuuau

SEQ ID NO: 370572 - RNA, 19 nt, Homo sapiens
ggaaacaaagacaauaagu

SEQ ID NO: 370573 - RNA, 19 nt, Homo sapiens
ccaaguggaaguacaagaa

SEQ ID NO: 370574 - RNA, 19 nt, Homo sapiens
acuaagguauugccugaaa

SEQ ID NO: 370575 - RNA, 19 nt, Homo sapiens
gcucaagaucgacgaguuu

SEQ ID NO: 370576 - RNA, 19 nt, Homo sapiens
gcagaugagagcauaugaa

SEQ ID NO: 370577 - RNA, 19 nt, Homo sapiens
gaaaacuacuggccagaug

SEQ ID NO: 370578 - RNA, 19 nt, Homo sapiens
gcugagagcaugaguccuu

SEQ ID NO: 370579 - RNA, 19 nt, Homo sapiens
gcacacaggaagccauuca

SEQ ID NO: 370580 - RNA, 19 nt, Homo sapiens
gcaacauguacauuucuaa

SEQ ID NO: 370581 - RNA, 19 nt, Homo sapiens
gaaagaggaggagcaagug

SEQ ID NO: 370582 - RNA, 19 nt, Homo sapiens
caaguuugaggaccgcuua

SEQ ID NO: 370583 - RNA, 19 nt, Homo sapiens
gaacgggaaacuacuccuu

SEQ ID NO: 370584 - RNA, 19 nt, Homo sapiens
guacacggguggcuuccau

SEQ ID NO: 370585 - RNA, 19 nt, Homo sapiens
gagcuaaaauucucaaugg

SEQ ID NO: 370586 - RNA, 19 nt, Homo sapiens
gaaguggaaaggagguuga

SEQ ID NO: 370587 - RNA, 19 nt, Homo sapiens
gcaagcggguccucaacgu

SEQ ID NO: 370588 - RNA, 19 nt, Homo sapiens
gggcuggauuuguuucuca

SEQ ID NO: 370589 - RNA, 19 nt, Homo sapiens
gcccaucggugccaagaca

SEQ ID NO: 370590 - RNA, 19 nt, Homo sapiens
ugaagagggcugccaagaa

SEQ ID NO: 370591 - RNA, 19 nt, Homo sapiens
gcuguucucucucucucuu

SEQ ID NO: 370592 - RNA, 19 nt, Homo sapiens
gccuuacacucugucuuua

SEQ ID NO: 370593 - RNA, 19 nt, Homo sapiens
uguauuuccugaagcauau

SEQ ID NO: 370594 - RNA, 19 nt, Homo sapiens
gagcaaaccaagagcaagu

SEQ ID NO: 370595 - RNA, 19 nt, Homo sapiens
ggacgucuuuucucaaguu

SEQ ID NO: 370596 - RNA, 19 nt, Homo sapiens
cgcccgacaucgacauaua

SEQ ID NO: 370597 - RNA, 19 nt, Homo sapiens
gcaaugccagagucaagaa

SEQ ID NO: 370598 - RNA, 19 nt, Homo sapiens
gaaguacaagaacagcaaa

SEQ ID NO: 370599 - RNA, 19 nt, Homo sapiens
ccaaaacgcugaagcucaa

SEQ ID NO: 370600 - RNA, 19 nt, Homo sapiens
gcaagaugaagcugaagga

SEQ ID NO: 370601 - RNA, 19 nt, Homo sapiens
uaauaccagcucuuuguuu

SEQ ID NO: 370602 - RNA, 19 nt, Homo sapiens
gaagcggaccuggcacaaa

SEQ ID NO: 370603 - RNA, 19 nt, Homo sapiens
ggaagaggagcagaagcua

SEQ ID NO: 370604 - RNA, 19 nt, Homo sapiens
gcuggaaauucgagagcaa

SEQ ID NO: 370605 - RNA, 19 nt, Homo sapiens
uucaaaggcucucacaaau

SEQ ID NO: 370606 - RNA, 19 nt, Homo sapiens
caaggacucagacuacguu

SEQ ID NO: 370607 - RNA, 19 nt, Homo sapiens
ggcaaacgacugcugaaga

SEQ ID NO: 370608 - RNA, 19 nt, Homo sapiens
gaaauucgagagcaaacca

SEQ ID NO: 370609 - RNA, 19 nt, Homo sapiens
ccggagcacuucaaaccuu

SEQ ID NO: 370610 - RNA, 19 nt, Homo sapiens
gaccaaguacugccuaauc

SEQ ID NO: 370611 - RNA, 19 nt, Homo sapiens
aaacugucauggguagaaa

SEQ ID NO: 370612 - RNA, 19 nt, Homo sapiens
gcaacuggaugaaugauua

SEQ ID NO: 370613 - RNA, 19 nt, Homo sapiens
gcaaacaaccugcgacuua

SEQ ID NO: 370614 - RNA, 19 nt, Homo sapiens
ggacauacuuuauucuuga

SEQ ID NO: 370615 - RNA, 19 nt, Homo sapiens
ugaaguugcucguuauuua

SEQ ID NO: 370616 - RNA, 19 nt, Homo sapiens
gaaggagaccucaagcuua

SEQ ID NO: 370617 - RNA, 19 nt, Homo sapiens
ucacucagcugauagauga

SEQ ID NO: 370618 - RNA, 19 nt, Homo sapiens
gaacagaccucuccuaccu

SEQ ID NO: 370619 - RNA, 19 nt, Homo sapiens
cagaaaguauggaaaguuu

SEQ ID NO: 370620 - RNA, 19 nt, Homo sapiens
ggucugaucauacaaguua

SEQ ID NO: 370621 - RNA, 19 nt, Homo sapiens
ccaaucgucuguacuauga

SEQ ID NO: 370622 - RNA, 19 nt, Homo sapiens
gugaugaaguugcucguua

SEQ ID NO: 370623 - RNA, 19 nt, Homo sapiens
gagcagcguuggauacuug

SEQ ID NO: 370624 - RNA, 19 nt, Homo sapiens
cauugaagcugcauauaaa

SEQ ID NO: 370625 - RNA, 19 nt, Homo sapiens
ugaagaaucuccugcauca

SEQ ID NO: 370626 - RNA, 19 nt, Homo sapiens
gaagucaauuucauacaga

SEQ ID NO: 370627 - RNA, 19 nt, Homo sapiens
caaacaaccugcgacuuaa

SEQ ID NO: 370628 - RNA, 19 nt, Homo sapiens
uaaauucucuguucaugug

SEQ ID NO: 370629 - RNA, 19 nt, Homo sapiens
gaauuggucugaucauaca

SEQ ID NO: 370630 - RNA, 19 nt, Homo sapiens
ccagaaacauuugacagua

SEQ ID NO: 370631 - RNA, 19 nt, Homo sapiens
ggagcaaguguuaauaaua

SEQ ID NO: 370632 - RNA, 19 nt, Homo sapiens
gaucagcagucaucuaaag

SEQ ID NO: 370633 - RNA, 19 nt, Homo sapiens
caacuaugauuaccuggaa

SEQ ID NO: 370634 - RNA, 19 nt, Homo sapiens
gcauggaacuaaaauguua

SEQ ID NO: 370635 - RNA, 19 nt, Homo sapiens
gaacggagugcuacaguga

SEQ ID NO: 370636 - RNA, 19 nt, Homo sapiens
gugacaaucuuaugaguau

SEQ ID NO: 370637 - RNA, 19 nt, Homo sapiens
ccucuuugcugaaauguuu

SEQ ID NO: 370638 - RNA, 19 nt, Homo sapiens
ggcaaaggccuaugaauug

SEQ ID NO: 370639 - RNA, 19 nt, Homo sapiens
agaaauacaucuuccuaga

SEQ ID NO: 370640 - RNA, 19 nt, Homo sapiens
ucaaacagguaaauuguca

SEQ ID NO: 370641 - RNA, 19 nt, Homo sapiens
gaagauggaacaagcuuga

SEQ ID NO: 370642 - RNA, 19 nt, Homo sapiens
caagggaucucagaguuga

SEQ ID NO: 370643 - RNA, 19 nt, Homo sapiens
cuagaucuguuaccaauau

SEQ ID NO: 370644 - RNA, 19 nt, Homo sapiens
gcuggcagauauugaaauu

SEQ ID NO: 370645 - RNA, 19 nt, Homo sapiens
aaauacaucuuccuagaga

SEQ ID NO: 370646 - RNA, 19 nt, Homo sapiens
ccaaggaacugcauguaca

SEQ ID NO: 370647 - RNA, 19 nt, Homo sapiens
guucaagucuccauucuag

SEQ ID NO: 370648 - RNA, 19 nt, Homo sapiens
ggaaauugccucacaugug

SEQ ID NO: 370649 - RNA, 19 nt, Homo sapiens
ggaacugcauguacagaau

SEQ ID NO: 370650 - RNA, 19 nt, Homo sapiens
ggagaccauugcugaggua

SEQ ID NO: 370651 - RNA, 19 nt, Homo sapiens
gagauaauguguacagcau

SEQ ID NO: 370652 - RNA, 19 nt, Homo sapiens
gagagucagucaccuggaa

SEQ ID NO: 370653 - RNA, 19 nt, Homo sapiens
cagggucgaugaagaauau

SEQ ID NO: 370654 - RNA, 19 nt, Homo sapiens
auacauuucugggaucuua

SEQ ID NO: 370655 - RNA, 19 nt, Homo sapiens
ggccugauccgauacauuu

SEQ ID NO: 370656 - RNA, 19 nt, Homo sapiens
ggacgacccuacagacaca

SEQ ID NO: 370657 - RNA, 19 nt, Homo sapiens
uguccuggcugaugaagua

SEQ ID NO: 370658 - RNA, 19 nt, Homo sapiens
gaauuuacguggagaccau

SEQ ID NO: 370659 - RNA, 19 nt, Homo sapiens
gaagcccgauguugugguu

SEQ ID NO: 370660 - RNA, 19 nt, Homo sapiens
guuggauacuuguuccuua

SEQ ID NO: 370661 - RNA, 19 nt, Homo sapiens
ucagacagguggauaaagu

SEQ ID NO: 370662 - RNA, 19 nt, Homo sapiens
gcaaaggccuaugaauugg

SEQ ID NO: 370663 - RNA, 19 nt, Homo sapiens
cacaggaaauaaugguaua

SEQ ID NO: 370664 - RNA, 19 nt, Homo sapiens
aggguaagcuguacaguga

SEQ ID NO: 370665 - RNA, 19 nt, Homo sapiens
ucuacgagauggauauaaa

SEQ ID NO: 370666 - RNA, 19 nt, Homo sapiens
gggagcaaguguuaauaau

SEQ ID NO: 370667 - RNA, 19 nt, Homo sapiens
ucuguacucuucuguauga

SEQ ID NO: 370668 - RNA, 19 nt, Homo sapiens
caucuguacucuucuguau

SEQ ID NO: 370669 - RNA, 19 nt, Homo sapiens
guagaaauacaucuuccua

SEQ ID NO: 370670 - RNA, 19 nt, Homo sapiens
cagccuagaugaagucaau

SEQ ID NO: 370671 - RNA, 19 nt, Homo sapiens
ucucagaggacaauuagua

SEQ ID NO: 370672 - RNA, 19 nt, Homo sapiens
ucacggacuuucuguugaa

SEQ ID NO: 370673 - RNA, 19 nt, Homo sapiens
gauaaagcagguggaauuu

SEQ ID NO: 370674 - RNA, 19 nt, Homo sapiens
acauguaucuuccuacgaa

SEQ ID NO: 370675 - RNA, 19 nt, Homo sapiens
guuccaagcugcugugcaa

SEQ ID NO: 370676 - RNA, 19 nt, Homo sapiens
gcuguacagugaagauuau

SEQ ID NO: 370677 - RNA, 19 nt, Homo sapiens
cagaagaaaucaagaccau

SEQ ID NO: 370678 - RNA, 19 nt, Homo sapiens
gaugaagaauaucagaauc

SEQ ID NO: 370679 - RNA, 19 nt, Homo sapiens
ugccagagcuguacagugu

SEQ ID NO: 370680 - RNA, 19 nt, Homo sapiens
gauaauguguacagcaucu

SEQ ID NO: 370681 - RNA, 19 nt, Homo sapiens
ccaaugacuuguuccuuca

SEQ ID NO: 370682 - RNA, 19 nt, Homo sapiens
ggaacacugaauuguauaa

SEQ ID NO: 370683 - RNA, 19 nt, Homo sapiens
gccagucuauccuaaauuc

SEQ ID NO: 370684 - RNA, 19 nt, Homo sapiens
uacagaaccuuguguuuua

SEQ ID NO: 370685 - RNA, 19 nt, Homo sapiens
ggaauuucguagacuguca

SEQ ID NO: 370686 - RNA, 19 nt, Homo sapiens
gcauuucaauccuuacaca

SEQ ID NO: 370687 - RNA, 19 nt, Homo sapiens
gaaaggugggccucaauca

SEQ ID NO: 370688 - RNA, 19 nt, Homo sapiens
ccaccuacgugcaggaguu

SEQ ID NO: 370689 - RNA, 19 nt, Homo sapiens
ucaccaugcuggcagauau

SEQ ID NO: 370690 - RNA, 19 nt, Homo sapiens
uaaagcagguggaauuucg

SEQ ID NO: 370691 - RNA, 19 nt, Homo sapiens
ccacagagggccugaugaa

SEQ ID NO: 370692 - RNA, 19 nt, Homo sapiens
gauaugagcauuucaaucc

SEQ ID NO: 370693 - RNA, 19 nt, Homo sapiens
ugaaaggaccugacuggaa

SEQ ID NO: 370694 - RNA, 19 nt, Homo sapiens
guucacauguaucuuccua

SEQ ID NO: 370695 - RNA, 19 nt, Homo sapiens
gauugugcauggaacuaaa

SEQ ID NO: 370696 - RNA, 19 nt, Homo sapiens
gaccauugcugagguauac

SEQ ID NO: 370697 - RNA, 19 nt, Homo sapiens
ucgauaaacuaacuacugu

SEQ ID NO: 370698 - RNA, 19 nt, Homo sapiens
caaggaguuuggaguggaa

SEQ ID NO: 370699 - RNA, 19 nt, Homo sapiens
cagagggccugaugaaucu

SEQ ID NO: 370700 - RNA, 19 nt, Homo sapiens
ugguauaucuagccaugua

SEQ ID NO: 370701 - RNA, 19 nt, Homo sapiens
cagaaacauuugacaguag

SEQ ID NO: 370702 - RNA, 19 nt, Homo sapiens
agauaaagcagguggaauu

SEQ ID NO: 370703 - RNA, 19 nt, Homo sapiens
ucaaaugucaguccugcua

SEQ ID NO: 370704 - RNA, 19 nt, Homo sapiens
cuggaacacugaauuguau

SEQ ID NO: 370705 - RNA, 19 nt, Homo sapiens
gaaauacaucuuccuagag

SEQ ID NO: 370706 - RNA, 19 nt, Homo sapiens
gauggaacaagcuugaauu

SEQ ID NO: 370707 - RNA, 19 nt, Homo sapiens
cauacagcaugcuugauga

SEQ ID NO: 370708 - RNA, 19 nt, Homo sapiens
guacaaccagcucguauuc

SEQ ID NO: 370709 - RNA, 19 nt, Homo sapiens
acagguggauaaaguagaa

SEQ ID NO: 370710 - RNA, 19 nt, Homo sapiens
gaucagacagguggauaaa

SEQ ID NO: 370711 - RNA, 19 nt, Homo sapiens
gaacugcauguacagaaug

SEQ ID NO: 370712 - RNA, 19 nt, Homo sapiens
gcagagaguuacagaaaua

SEQ ID NO: 370713 - RNA, 19 nt, Homo sapiens
gaacugagacgccagcuua

SEQ ID NO: 370714 - RNA, 19 nt, Homo sapiens
cauagaagcugcauauaaa

SEQ ID NO: 370715 - RNA, 19 nt, Homo sapiens
ggacuucuuuccauuauuu

SEQ ID NO: 370716 - RNA, 19 nt, Homo sapiens
cauauaaagucgcugauua

SEQ ID NO: 370717 - RNA, 19 nt, Homo sapiens
ccacaucguucuacacaua

SEQ ID NO: 370718 - RNA, 19 nt, Homo sapiens
ggacauacuuucugugaug

SEQ ID NO: 370719 - RNA, 19 nt, Homo sapiens
gaagacaccuguaaucaag

SEQ ID NO: 370720 - RNA, 19 nt, Homo sapiens
gcaccaugcucacaaauga

SEQ ID NO: 370721 - RNA, 19 nt, Homo sapiens
ggaaccaaaucuuuacuuu

SEQ ID NO: 370722 - RNA, 19 nt, Homo sapiens
gaaagcaugucccaucaga

SEQ ID NO: 370723 - RNA, 19 nt, Homo sapiens
guaaaucacugaaucuugu

SEQ ID NO: 370724 - RNA, 19 nt, Homo sapiens
ugaaaucgaucccuuaaau

SEQ ID NO: 370725 - RNA, 19 nt, Homo sapiens
caagaauccucacacagua

SEQ ID NO: 370726 - RNA, 19 nt, Homo sapiens
uaaagucgcugauuaugga

SEQ ID NO: 370727 - RNA, 19 nt, Homo sapiens
gcaccaaacucuucaccaa

SEQ ID NO: 370728 - RNA, 19 nt, Homo sapiens
ggaaagaguuuggcguuga

SEQ ID NO: 370729 - RNA, 19 nt, Homo sapiens
gaacuugaccauuauauca

SEQ ID NO: 370730 - RNA, 19 nt, Homo sapiens
uauaauagauggagucuuc

SEQ ID NO: 370731 - RNA, 19 nt, Homo sapiens
aagacgaacuugaccauua

SEQ ID NO: 370732 - RNA, 19 nt, Homo sapiens
gaaaugaaacagaugacua

SEQ ID NO: 370733 - RNA, 19 nt, Homo sapiens
gaaagaguuuggcguugaa

SEQ ID NO: 370734 - RNA, 19 nt, Homo sapiens
gaaaucgaucccuuaaaua

SEQ ID NO: 370735 - RNA, 19 nt, Homo sapiens
gggauaacaucuacaguau

SEQ ID NO: 370736 - RNA, 19 nt, Homo sapiens
gcaagucagugauucaugu

SEQ ID NO: 370737 - RNA, 19 nt, Homo sapiens
agucaaaccugauguugua

SEQ ID NO: 370738 - RNA, 19 nt, Homo sapiens
gagcaguggcuucuuauuu

SEQ ID NO: 370739 - RNA, 19 nt, Homo sapiens
ggagugaaaugaaacagau

SEQ ID NO: 370740 - RNA, 19 nt, Homo sapiens
gaugagaaguuguuugaca

SEQ ID NO: 370741 - RNA, 19 nt, Homo sapiens
gcacucacccugaaacuga

SEQ ID NO: 370742 - RNA, 19 nt, Homo sapiens
caagguagaugaagaguac

SEQ ID NO: 370743 - RNA, 19 nt, Homo sapiens
ggaagauccuccagaagug

SEQ ID NO: 370744 - RNA, 19 nt, Homo sapiens
gcacaucguugagguccua

SEQ ID NO: 370745 - RNA, 19 nt, Homo sapiens
ucacauauaugccaagcuu

SEQ ID NO: 370746 - RNA, 19 nt, Homo sapiens
ggacauucauccaauucaa

SEQ ID NO: 370747 - RNA, 19 nt, Homo sapiens
ggauuggacugaucauuca

SEQ ID NO: 370748 - RNA, 19 nt, Homo sapiens
ucauuucucuggaacauuu

SEQ ID NO: 370749 - RNA, 19 nt, Homo sapiens
cgcaggagauugugguuua

SEQ ID NO: 370750 - RNA, 19 nt, Homo sapiens
caaaccugauguuguagua

SEQ ID NO: 370751 - RNA, 19 nt, Homo sapiens
gaacucaagcucuucgaaa

SEQ ID NO: 370752 - RNA, 19 nt, Homo sapiens
gaagauguaaaccuuguaa

SEQ ID NO: 370753 - RNA, 19 nt, Homo sapiens
gacauucuguacauucuuu

SEQ ID NO: 370754 - RNA, 19 nt, Homo sapiens
guacaagaauccucacaca

SEQ ID NO: 370755 - RNA, 19 nt, Homo sapiens
ccaaacucuucaccaaaua

SEQ ID NO: 370756 - RNA, 19 nt, Homo sapiens
gagguggccuucauacaga

SEQ ID NO: 370757 - RNA, 19 nt, Homo sapiens
ggucucaccuggaaacaug

SEQ ID NO: 370758 - RNA, 19 nt, Homo sapiens
uagggaaccuuucggaauu

SEQ ID NO: 370759 - RNA, 19 nt, Homo sapiens
ggaaauuggucucuuuuga

SEQ ID NO: 370760 - RNA, 19 nt, Homo sapiens
ggaagacaccuguaaucaa

SEQ ID NO: 370761 - RNA, 19 nt, Homo sapiens
caagagcgucgacaucuaa

SEQ ID NO: 370762 - RNA, 19 nt, Homo sapiens
cauacagaaucuugucuuu

SEQ ID NO: 370763 - RNA, 19 nt, Homo sapiens
gcagaaaacaaucacauua

SEQ ID NO: 370764 - RNA, 19 nt, Homo sapiens
gauguaaaccuuguaaaug

SEQ ID NO: 370765 - RNA, 19 nt, Homo sapiens
ccaagagcgucgacaucua

SEQ ID NO: 370766 - RNA, 19 nt, Homo sapiens
gaaugugaguggccugugu

SEQ ID NO: 370767 - RNA, 19 nt, Homo sapiens
gaaaauuccucuucguuca

SEQ ID NO: 370768 - RNA, 19 nt, Homo sapiens
gggcgaccguaucgacaua

SEQ ID NO: 370769 - RNA, 19 nt, Homo sapiens
ggacggaauaagaauauga

SEQ ID NO: 370770 - RNA, 19 nt, Homo sapiens
gucgacaucuaaagaaauu

SEQ ID NO: 370771 - RNA, 19 nt, Homo sapiens
ggacgcaagucagugauuc

SEQ ID NO: 370772 - RNA, 19 nt, Homo sapiens
ccucagcccuuucgauaug

SEQ ID NO: 370773 - RNA, 19 nt, Homo sapiens
ccuacgagcuggagcagaa

SEQ ID NO: 370774 - RNA, 19 nt, Homo sapiens
acauagaagcugcauauaa

SEQ ID NO: 370775 - RNA, 19 nt, Homo sapiens
uauccuggcugucuaugaa

SEQ ID NO: 370776 - RNA, 19 nt, Homo sapiens
cagcuuaaauuggcucuug

SEQ ID NO: 370777 - RNA, 19 nt, Homo sapiens
agacgaacuugaccauuau

SEQ ID NO: 370778 - RNA, 19 nt, Homo sapiens
ugauagugauucagauuug

SEQ ID NO: 370779 - RNA, 19 nt, Homo sapiens
cuaacaagguagaugaaga

SEQ ID NO: 370780 - RNA, 19 nt, Homo sapiens
ugagacagguggccaaagu

SEQ ID NO: 370781 - RNA, 19 nt, Homo sapiens
ccagucagcuguucuugca

SEQ ID NO: 370782 - RNA, 19 nt, Homo sapiens
caaguuugcuguccauguc

SEQ ID NO: 370783 - RNA, 19 nt, Homo sapiens
cgacuaaggcugugagugu

SEQ ID NO: 370784 - RNA, 19 nt, Homo sapiens
agcaaaccauccuguguua

SEQ ID NO: 370785 - RNA, 19 nt, Homo sapiens
gaugaagaguacaagaauc

SEQ ID NO: 370786 - RNA, 19 nt, Homo sapiens
gaacugcucaggagaagag

SEQ ID NO: 370787 - RNA, 19 nt, Homo sapiens
gauccagacugugaugaga

SEQ ID NO: 370788 - RNA, 19 nt, Homo sapiens
cuuggaaccucuaaacuau

SEQ ID NO: 370789 - RNA, 19 nt, Homo sapiens
uuacauagaagcugcauau

SEQ ID NO: 370790 - RNA, 19 nt, Homo sapiens
ucacaaaacucaucuacga

SEQ ID NO: 370791 - RNA, 19 nt, Homo sapiens
ucucaggccuucucaggaa

SEQ ID NO: 370792 - RNA, 19 nt, Homo sapiens
cgccaugucuucagugcua

SEQ ID NO: 370793 - RNA, 19 nt, Homo sapiens
uggaaccucuaaacuauau

SEQ ID NO: 370794 - RNA, 19 nt, Homo sapiens
gagcgucgacaucuaaaga

SEQ ID NO: 370795 - RNA, 19 nt, Homo sapiens
gagaguuacagaaauaguu

SEQ ID NO: 370796 - RNA, 19 nt, Homo sapiens
gcccagagaugaccauggu

SEQ ID NO: 370797 - RNA, 19 nt, Homo sapiens
ggugaaaucgaucccuuaa

SEQ ID NO: 370798 - RNA, 19 nt, Homo sapiens
agaaauugaugcuggacuu

SEQ ID NO: 370799 - RNA, 19 nt, Homo sapiens
ggaggacgcaagucaguga

SEQ ID NO: 370800 - RNA, 19 nt, Homo sapiens
guggagaaguucaaacaca

SEQ ID NO: 370801 - RNA, 19 nt, Homo sapiens
gaucaaguuugcuguccau

SEQ ID NO: 370802 - RNA, 19 nt, Homo sapiens
gugaugagaaguuguuuga

SEQ ID NO: 370803 - RNA, 19 nt, Homo sapiens
uguuaaagccacagagaua

SEQ ID NO: 370804 - RNA, 19 nt, Homo sapiens
aauagggucucaccuggaa

SEQ ID NO: 370805 - RNA, 19 nt, Homo sapiens
ugaugaaccucagcccuuu

SEQ ID NO: 370806 - RNA, 19 nt, Homo sapiens
gggcaggacaucagcauug

SEQ ID NO: 370807 - RNA, 19 nt, Homo sapiens
cgggauaacaucuacagua

SEQ ID NO: 370808 - RNA, 19 nt, Homo sapiens
ggcauggccuaccguaaga

SEQ ID NO: 370809 - RNA, 19 nt, Homo sapiens
gggugaacguccagaguau

SEQ ID NO: 370810 - RNA, 19 nt, Homo sapiens
acaaucacauuaaggacuu

SEQ ID NO: 370811 - RNA, 19 nt, Homo sapiens
gcgucgacaucuaaagaaa

SEQ ID NO: 370812 - RNA, 19 nt, Homo sapiens
gaaagacugugguuuguua

SEQ ID NO: 370813 - RNA, 19 nt, Homo sapiens
gcucacaccugaaaucuua

SEQ ID NO: 370814 - RNA, 19 nt, Homo sapiens
gaaguuaucucuaauccuu

SEQ ID NO: 370815 - RNA, 19 nt, Homo sapiens
gaagacacguugggaaaua

SEQ ID NO: 370816 - RNA, 19 nt, Homo sapiens
caaaguagaucuagacaga

SEQ ID NO: 370817 - RNA, 19 nt, Homo sapiens
gggauaaguuggaccauua

SEQ ID NO: 370818 - RNA, 19 nt, Homo sapiens
ggacugaauucuuaccaua

SEQ ID NO: 370819 - RNA, 19 nt, Homo sapiens
gaacacauaugguauucaa

SEQ ID NO: 370820 - RNA, 19 nt, Homo sapiens
ggaauucucuacugcuaua

SEQ ID NO: 370821 - RNA, 19 nt, Homo sapiens
caacauugcugcuguauca

SEQ ID NO: 370822 - RNA, 19 nt, Homo sapiens
gaaagaggaagcaaauaua

SEQ ID NO: 370823 - RNA, 19 nt, Homo sapiens
caacaugucuucacucugu

SEQ ID NO: 370824 - RNA, 19 nt, Homo sapiens
gaacuucucuuagugguau

SEQ ID NO: 370825 - RNA, 19 nt, Homo sapiens
gaacuggucauccauauug

SEQ ID NO: 370826 - RNA, 19 nt, Homo sapiens
gagaugaguugcuuuccua

SEQ ID NO: 370827 - RNA, 19 nt, Homo sapiens
gaauuucucucuccuuguu

SEQ ID NO: 370828 - RNA, 19 nt, Homo sapiens
gaugacccgugucugauua

SEQ ID NO: 370829 - RNA, 19 nt, Homo sapiens
ggaaagaggaagcaaauau

SEQ ID NO: 370830 - RNA, 19 nt, Homo sapiens
gcugauagaugacauaaag

SEQ ID NO: 370831 - RNA, 19 nt, Homo sapiens
acagaucguuguagaguua

SEQ ID NO: 370832 - RNA, 19 nt, Homo sapiens
caaccaacccugucagaua

SEQ ID NO: 370833 - RNA, 19 nt, Homo sapiens
gaaugugaauuucccauau

SEQ ID NO: 370834 - RNA, 19 nt, Homo sapiens
gcagaaagccaaagacuuc

SEQ ID NO: 370835 - RNA, 19 nt, Homo sapiens
ggacaugucuaugauuguu

SEQ ID NO: 370836 - RNA, 19 nt, Homo sapiens
ggacaagcacuuuauauca

SEQ ID NO: 370837 - RNA, 19 nt, Homo sapiens
gauaagguccagcaguuua

SEQ ID NO: 370838 - RNA, 19 nt, Homo sapiens
gcuagaauuucaagacaaa

SEQ ID NO: 370839 - RNA, 19 nt, Homo sapiens
cagcugacuuuguagaaua

SEQ ID NO: 370840 - RNA, 19 nt, Homo sapiens
caaggcagccauuaauaua

SEQ ID NO: 370841 - RNA, 19 nt, Homo sapiens
guaggaagcucuguugaga

SEQ ID NO: 370842 - RNA, 19 nt, Homo sapiens
ucaaacuccucaacaagua

SEQ ID NO: 370843 - RNA, 19 nt, Homo sapiens
caaaggcggugaugaaucu

SEQ ID NO: 370844 - RNA, 19 nt, Homo sapiens
gaggaauucucuacugcua

SEQ ID NO: 370845 - RNA, 19 nt, Homo sapiens
ggacaaacccacccacgaa

SEQ ID NO: 370846 - RNA, 19 nt, Homo sapiens
gaaacucucugggauaagu

SEQ ID NO: 370847 - RNA, 19 nt, Homo sapiens
ucagauaaaugcaguguca

SEQ ID NO: 370848 - RNA, 19 nt, Homo sapiens
ggaccauuauuacagaauu

SEQ ID NO: 370849 - RNA, 19 nt, Homo sapiens
caacuugauuuccuacgaa

SEQ ID NO: 370850 - RNA, 19 nt, Homo sapiens
gaagacaauauaagaggua

SEQ ID NO: 370851 - RNA, 19 nt, Homo sapiens
gauaugaccauguaugaga

SEQ ID NO: 370852 - RNA, 19 nt, Homo sapiens
gacaagcacuuuauaucau

SEQ ID NO: 370853 - RNA, 19 nt, Homo sapiens
caucaguuauccugcauuu

SEQ ID NO: 370854 - RNA, 19 nt, Homo sapiens
gaauggugaacuucucuua

SEQ ID NO: 370855 - RNA, 19 nt, Homo sapiens
gaacaggcgucagaucgau

SEQ ID NO: 370856 - RNA, 19 nt, Homo sapiens
gaaaaugacuugguaguuc

SEQ ID NO: 370857 - RNA, 19 nt, Homo sapiens
gagcuagaauuucaagaca

SEQ ID NO: 370858 - RNA, 19 nt, Homo sapiens
ccucaggacuccagauuau

SEQ ID NO: 370859 - RNA, 19 nt, Homo sapiens
gaagaagaaguuaucucua

SEQ ID NO: 370860 - RNA, 19 nt, Homo sapiens
gaagguaccguuucugauc

SEQ ID NO: 370861 - RNA, 19 nt, Homo sapiens
gauauccuguuguaccaaa

SEQ ID NO: 370862 - RNA, 19 nt, Homo sapiens
cuaagcaaguacaggaaua

SEQ ID NO: 370863 - RNA, 19 nt, Homo sapiens
caagccagcugaaauuaag

SEQ ID NO: 370864 - RNA, 19 nt, Homo sapiens
ucuuuggacugaauucuua

SEQ ID NO: 370865 - RNA, 19 nt, Homo sapiens
ugacaaaggcggugaugaa

SEQ ID NO: 370866 - RNA, 19 nt, Homo sapiens
cauauuggcuggaucaucu

SEQ ID NO: 370867 - RNA, 19 nt, Homo sapiens
ucaaagauuuaucgcauuc

SEQ ID NO: 370868 - RNA, 19 nt, Homo sapiens
caagaucacauaauacaga

SEQ ID NO: 370869 - RNA, 19 nt, Homo sapiens
uccaagaccugauaaugaa

SEQ ID NO: 370870 - RNA, 19 nt, Homo sapiens
ggucaaagaagcauuuaau

SEQ ID NO: 370871 - RNA, 19 nt, Homo sapiens
ggacuuguaucagcuguca

SEQ ID NO: 370872 - RNA, 19 nt, Homo sapiens
gcuauuugauggcauugaa

SEQ ID NO: 370873 - RNA, 19 nt, Homo sapiens
caacagaugcuacuacaag

SEQ ID NO: 370874 - RNA, 19 nt, Homo sapiens
aaacguuucuugagagaug

SEQ ID NO: 370875 - RNA, 19 nt, Homo sapiens
gaagucaagccaaacaaug

SEQ ID NO: 370876 - RNA, 19 nt, Homo sapiens
uuacagaauugucaaguca

SEQ ID NO: 370877 - RNA, 19 nt, Homo sapiens
gagagagucuauagaagag

SEQ ID NO: 370878 - RNA, 19 nt, Homo sapiens
gagaaucaagaucacauaa

SEQ ID NO: 370879 - RNA, 19 nt, Homo sapiens
agacacauguucugaagug

SEQ ID NO: 370880 - RNA, 19 nt, Homo sapiens
cauaugguauucaaacuca

SEQ ID NO: 370881 - RNA, 19 nt, Homo sapiens
ggauuuaaacguuucuuga

SEQ ID NO: 370882 - RNA, 19 nt, Homo sapiens
gaugaggucucuuuuauuc

SEQ ID NO: 370883 - RNA, 19 nt, Homo sapiens
ccgauaagguccagcaguu

SEQ ID NO: 370884 - RNA, 19 nt, Homo sapiens
gaagcucuguugagacaca

SEQ ID NO: 370885 - RNA, 19 nt, Homo sapiens
ggaacuagaaccucccaaa

SEQ ID NO: 370886 - RNA, 19 nt, Homo sapiens
guauagaacaucauuggaa

SEQ ID NO: 370887 - RNA, 19 nt, Homo sapiens
uaggacaugucuaugauug

SEQ ID NO: 370888 - RNA, 19 nt, Homo sapiens
uaauaguaauccucacuga

SEQ ID NO: 370889 - RNA, 19 nt, Homo sapiens
gcagcuggguaucaaugaa

SEQ ID NO: 370890 - RNA, 19 nt, Homo sapiens
guagaacccauucagauau

SEQ ID NO: 370891 - RNA, 19 nt, Homo sapiens
ggaacaugcagcuauuuga

SEQ ID NO: 370892 - RNA, 19 nt, Homo sapiens
caagaacuggucauccaua

SEQ ID NO: 370893 - RNA, 19 nt, Homo sapiens
uaaagaaugcgcugcaguu

SEQ ID NO: 370894 - RNA, 19 nt, Homo sapiens
cuacaagccagcugaaauu

SEQ ID NO: 370895 - RNA, 19 nt, Homo sapiens
gcgaauugaugaugacaag

SEQ ID NO: 370896 - RNA, 19 nt, Homo sapiens
gcauacaggcgaauugaug

SEQ ID NO: 370897 - RNA, 19 nt, Homo sapiens
ucugaaguguguuguguuu

SEQ ID NO: 370898 - RNA, 19 nt, Homo sapiens
uagacagacuggucaaaga

SEQ ID NO: 370899 - RNA, 19 nt, Homo sapiens
ccauuguacuggaaagaaa

SEQ ID NO: 370900 - RNA, 19 nt, Homo sapiens
gaagaaguuaucucuaauc

SEQ ID NO: 370901 - RNA, 19 nt, Homo sapiens
guacaugggaaacagguaa

SEQ ID NO: 370902 - RNA, 19 nt, Homo sapiens
gaccauuauuacagaauug

SEQ ID NO: 370903 - RNA, 19 nt, Homo sapiens
ugaggaggcugaggcauga

SEQ ID NO: 370904 - RNA, 19 nt, Homo sapiens
acagagcuauucuacaguu

SEQ ID NO: 370905 - RNA, 19 nt, Homo sapiens
auacagagcuauucuacag

SEQ ID NO: 370906 - RNA, 19 nt, Homo sapiens
acagacagaucguuguaga

SEQ ID NO: 370907 - RNA, 19 nt, Homo sapiens
ccuaagugauuucuacaug

SEQ ID NO: 370908 - RNA, 19 nt, Homo sapiens
cgaccuaagugauuucuac

SEQ ID NO: 370909 - RNA, 19 nt, Homo sapiens
uaagcuauuugauggcauu

SEQ ID NO: 370910 - RNA, 19 nt, Homo sapiens
ugaggaauauggucaucuu

SEQ ID NO: 370911 - RNA, 19 nt, Homo sapiens
gcauacaggagaugaguug

SEQ ID NO: 370912 - RNA, 19 nt, Homo sapiens
gcacaggacuucuaugaga

SEQ ID NO: 370913 - RNA, 19 nt, Homo sapiens
ggaaagagguggacaugug

SEQ ID NO: 370914 - RNA, 19 nt, Homo sapiens
gcacuggcgucaucaugua

SEQ ID NO: 370915 - RNA, 19 nt, Homo sapiens
gaccaacacuuucuucuuc

SEQ ID NO: 370916 - RNA, 19 nt, Homo sapiens
gaaggaaaccagaaagauc

SEQ ID NO: 370917 - RNA, 19 nt, Homo sapiens
gcucacagacuuuggcuuu

SEQ ID NO: 370918 - RNA, 19 nt, Homo sapiens
gaggggagcucuuugacua

SEQ ID NO: 370919 - RNA, 19 nt, Homo sapiens
gggaagccauggaaauaca

SEQ ID NO: 370920 - RNA, 19 nt, Homo sapiens
gagaaggaaaccagaaaga

SEQ ID NO: 370921 - RNA, 19 nt, Homo sapiens
agaguucccucacugaaga

SEQ ID NO: 370922 - RNA, 19 nt, Homo sapiens
cuuaugagaccaacacuuu

SEQ ID NO: 370923 - RNA, 19 nt, Homo sapiens
gagaagccacgcugaagga

SEQ ID NO: 370924 - RNA, 19 nt, Homo sapiens
ucucuuggaugacaacaug

SEQ ID NO: 370925 - RNA, 19 nt, Homo sapiens
acaucaagcucacagacuu

SEQ ID NO: 370926 - RNA, 19 nt, Homo sapiens
agaauuaugagcccaaaga

SEQ ID NO: 370927 - RNA, 19 nt, Homo sapiens
gaucaugagcggcaacuac

SEQ ID NO: 370928 - RNA, 19 nt, Homo sapiens
guggagcacuggcgucauc

SEQ ID NO: 370929 - RNA, 19 nt, Homo sapiens
gagcucugcuggaggugau

SEQ ID NO: 370930 - RNA, 19 nt, Homo sapiens
cgccuacgcuuuccgaauc

SEQ ID NO: 370931 - RNA, 19 nt, Homo sapiens
caacacuuucuucuucuug

SEQ ID NO: 370932 - RNA, 19 nt, Homo sapiens
ccaacacuuucuucuucuu

SEQ ID NO: 370933 - RNA, 19 nt, Homo sapiens
caucgacgccuacgcuuuc

SEQ ID NO: 370934 - RNA, 19 nt, Homo sapiens
gcuuugggauucuugucaa

SEQ ID NO: 370935 - RNA, 19 nt, Homo sapiens
gcacugccggacucucauu

SEQ ID NO: 370936 - RNA, 19 nt, Homo sapiens
gugagaaggaaaccagaaa

SEQ ID NO: 370937 - RNA, 19 nt, Homo sapiens
caucaagcucacagacuuu

SEQ ID NO: 370938 - RNA, 19 nt, Homo sapiens
ccauggaaauacaagucaa

SEQ ID NO: 370939 - RNA, 19 nt, Homo sapiens
ugaccgugcuggcuucagu

SEQ ID NO: 370940 - RNA, 19 nt, Homo sapiens
gagcacuggcgucaucaug

SEQ ID NO: 370941 - RNA, 19 nt, Homo sapiens
aaggaaaccagaaagauca

SEQ ID NO: 370942 - RNA, 19 nt, Homo sapiens
ugagaauuaugagcccaaa

SEQ ID NO: 370943 - RNA, 19 nt, Homo sapiens
cugcacaggacuucuauga

SEQ ID NO: 370944 - RNA, 19 nt, Homo sapiens
ggaagccauggaaauacaa

SEQ ID NO: 370945 - RNA, 19 nt, Homo sapiens
gcaccuugcacaaacucaa

SEQ ID NO: 370946 - RNA, 19 nt, Homo sapiens
cauggaaauacaagucaaa

SEQ ID NO: 370947 - RNA, 19 nt, Homo sapiens
uaaccagccacccagaguu

SEQ ID NO: 370948 - RNA, 19 nt, Homo sapiens
uguuugaccugaugaagag

SEQ ID NO: 370949 - RNA, 19 nt, Homo sapiens
ccagaguucccucacugaa

SEQ ID NO: 370950 - RNA, 19 nt, Homo sapiens
cuucagugcggaucuacua

SEQ ID NO: 370951 - RNA, 19 nt, Homo sapiens
uugucaagcuccuucaaga

SEQ ID NO: 370952 - RNA, 19 nt, Homo sapiens
ggccgaggaggacuacuga

SEQ ID NO: 370953 - RNA, 19 nt, Homo sapiens
gaauuaugagcccaaagag

SEQ ID NO: 370954 - RNA, 19 nt, Homo sapiens
agaaggaaaccagaaagau

SEQ ID NO: 370955 - RNA, 19 nt, Homo sapiens
agaccaacacuuucuucuu

SEQ ID NO: 370956 - RNA, 19 nt, Homo sapiens
cugaaggacacuuaugaga

SEQ ID NO: 370957 - RNA, 19 nt, Homo sapiens
ccaacaucauacagcugaa

SEQ ID NO: 370958 - RNA, 19 nt, Homo sapiens
gcgagaagccacgcugaag

SEQ ID NO: 370959 - RNA, 19 nt, Homo sapiens
auuaugagcccaaagagau

SEQ ID NO: 370960 - RNA, 19 nt, Homo sapiens
ggaaaccagaaagaucaug

SEQ ID NO: 370961 - RNA, 19 nt, Homo sapiens
guguuugaccugaugaaga

SEQ ID NO: 370962 - RNA, 19 nt, Homo sapiens
gcagaacucuccagaagaa

SEQ ID NO: 370963 - RNA, 19 nt, Homo sapiens
gggagacucugcugcuaua

SEQ ID NO: 370964 - RNA, 19 nt, Homo sapiens
gaccaagaaugcacuguug

SEQ ID NO: 370965 - RNA, 19 nt, Homo sapiens
gcgagaagcuucgagaguu

SEQ ID NO: 370966 - RNA, 19 nt, Homo sapiens
cgccagagauccuuaaaug

SEQ ID NO: 370967 - RNA, 19 nt, Homo sapiens
gaagguggcccucucugaa

SEQ ID NO: 370968 - RNA, 19 nt, Homo sapiens
agggagagcuguuugacua

SEQ ID NO: 370969 - RNA, 19 nt, Homo sapiens
gaucugaagcccgagaaua

SEQ ID NO: 370970 - RNA, 19 nt, Homo sapiens
gauccgacuuucagauuuc

SEQ ID NO: 370971 - RNA, 19 nt, Homo sapiens
aagcagaacucuccagaag

SEQ ID NO: 370972 - RNA, 19 nt, Homo sapiens
cgagaagcuucgagaguug

SEQ ID NO: 370973 - RNA, 19 nt, Homo sapiens
ccaaagaguuuuaccagaa

SEQ ID NO: 370974 - RNA, 19 nt, Homo sapiens
gaucagagcugggguggaa

SEQ ID NO: 370975 - RNA, 19 nt, Homo sapiens
gcacugcauaugaaauaaa

SEQ ID NO: 370976 - RNA, 19 nt, Homo sapiens
gagggagacucugcugcua

SEQ ID NO: 370977 - RNA, 19 nt, Homo sapiens
ggaagggagagcuguuuga

SEQ ID NO: 370978 - RNA, 19 nt, Homo sapiens
gaagaaggguuuugaucau

SEQ ID NO: 370979 - RNA, 19 nt, Homo sapiens
ucuccuagaugacaauaug

SEQ ID NO: 370980 - RNA, 19 nt, Homo sapiens
gaagcagaacucuccagaa

SEQ ID NO: 370981 - RNA, 19 nt, Homo sapiens
ggagagcuguuugacuauc

SEQ ID NO: 370982 - RNA, 19 nt, Homo sapiens
gaguuugcggugaagauua

SEQ ID NO: 370983 - RNA, 19 nt, Homo sapiens
ggccaggacucugagauca

SEQ ID NO: 370984 - RNA, 19 nt, Homo sapiens
ucauguuccugguguuuga

SEQ ID NO: 370985 - RNA, 19 nt, Homo sapiens
ccuaagcacccaucgugua

SEQ ID NO: 370986 - RNA, 19 nt, Homo sapiens
ggaaaccagguccaucaug

SEQ ID NO: 370987 - RNA, 19 nt, Homo sapiens
ccacuggccaggacucuga

SEQ ID NO: 370988 - RNA, 19 nt, Homo sapiens
gugagcgacugcaggcaaa

SEQ ID NO: 370989 - RNA, 19 nt, Homo sapiens
ggcggcagauccugauguu

SEQ ID NO: 370990 - RNA, 19 nt, Homo sapiens
guacggccacugaccaaga

SEQ ID NO: 370991 - RNA, 19 nt, Homo sapiens
gagagcuguuugacuaucu

SEQ ID NO: 370992 - RNA, 19 nt, Homo sapiens
caucaucacccucaucgau

SEQ ID NO: 370993 - RNA, 19 nt, Homo sapiens
gaucauggagggccaguac

SEQ ID NO: 370994 - RNA, 19 nt, Homo sapiens
ccagagauccuuaaaugcu

SEQ ID NO: 370995 - RNA, 19 nt, Homo sapiens
agauccgacuuucagauuu

SEQ ID NO: 370996 - RNA, 19 nt, Homo sapiens
cagauccgacuuucagauu

SEQ ID NO: 370997 - RNA, 19 nt, Homo sapiens
gaagccacacggcgagaga

SEQ ID NO: 370998 - RNA, 19 nt, Homo sapiens
gccaguaccaguucaguuc

SEQ ID NO: 370999 - RNA, 19 nt, Homo sapiens
gcagauccgacuuucagau

SEQ ID NO: 371000 - RNA, 19 nt, Homo sapiens
uuaaaugcuccauggauga

SEQ ID NO: 371001 - RNA, 19 nt, Homo sapiens
ucaucacccucaucgauuc

SEQ ID NO: 371002 - RNA, 19 nt, Homo sapiens
cggugaagauuauggaagu

SEQ ID NO: 371003 - RNA, 19 nt, Homo sapiens
agacucugcugcuauaacu

SEQ ID NO: 371004 - RNA, 19 nt, Homo sapiens
uaaaugcuccauggaugaa

SEQ ID NO: 371005 - RNA, 19 nt, Homo sapiens
gccacgaguuugcggugaa

SEQ ID NO: 371006 - RNA, 19 nt, Homo sapiens
gaaauaaaaucugcuacac

SEQ ID NO: 371007 - RNA, 19 nt, Homo sapiens
caucguguacggccacuga

SEQ ID NO: 371008 - RNA, 19 nt, Homo sapiens
gaagauuauggaagugaca

SEQ ID NO: 371009 - RNA, 19 nt, Homo sapiens
caucaugggcccugaagag

SEQ ID NO: 371010 - RNA, 19 nt, Homo sapiens
cggcagauccugauguuac

SEQ ID NO: 371011 - RNA, 19 nt, Homo sapiens
gagcuacuggccacgaguu

SEQ ID NO: 371012 - RNA, 19 nt, Homo sapiens
gcaccucaucgacaacugu

SEQ ID NO: 371013 - RNA, 19 nt, Homo sapiens
ggacgaguggcccuaagca

SEQ ID NO: 371014 - RNA, 19 nt, Homo sapiens
ggagggccaguaccaguuc

SEQ ID NO: 371015 - RNA, 19 nt, Homo sapiens
gcggaagggagagcuguuu

SEQ ID NO: 371016 - RNA, 19 nt, Homo sapiens
cgagucuucuagcuucaug

SEQ ID NO: 371017 - RNA, 19 nt, Homo sapiens
agaaguacgacccuaagga

SEQ ID NO: 371018 - RNA, 19 nt, Homo sapiens
ugaccaagaaugcacuguu

SEQ ID NO: 371019 - RNA, 19 nt, Homo sapiens
gcgagagacacacauccuu

SEQ ID NO: 371020 - RNA, 19 nt, Homo sapiens
uacggccacugaccaagaa

SEQ ID NO: 371021 - RNA, 19 nt, Homo sapiens
caacauugugcaucgagau

SEQ ID NO: 371022 - RNA, 19 nt, Homo sapiens
auccugauguuacgcauga

SEQ ID NO: 371023 - RNA, 19 nt, Homo sapiens
aaggaaaccagguccauca

SEQ ID NO: 371024 - RNA, 19 nt, Homo sapiens
ggaugaggccgugcuugug

SEQ ID NO: 371025 - RNA, 19 nt, Homo sapiens
aguuugcggugaagauuau

SEQ ID NO: 371026 - RNA, 19 nt, Homo sapiens
cagcugagcaggcccuaca

SEQ ID NO: 371027 - RNA, 19 nt, Homo sapiens
gaaacccacccaggcuaug

SEQ ID NO: 371028 - RNA, 19 nt, Homo sapiens
cuuggaaccuggcgagaag

SEQ ID NO: 371029 - RNA, 19 nt, Homo sapiens
aauaugcagauccgacuuu

SEQ ID NO: 371030 - RNA, 19 nt, Homo sapiens
gugaagauuauggaaguga

SEQ ID NO: 371031 - RNA, 19 nt, Homo sapiens
ggugaagauuauggaagug

SEQ ID NO: 371032 - RNA, 19 nt, Homo sapiens
agaagguggcccucucuga

SEQ ID NO: 371033 - RNA, 19 nt, Homo sapiens
uacgggcacuggguaaaga

SEQ ID NO: 371034 - RNA, 19 nt, Homo sapiens
ugaaacccacccaggcuau

SEQ ID NO: 371035 - RNA, 19 nt, Homo sapiens
gaagggagagcuguuugac

SEQ ID NO: 371036 - RNA, 19 nt, Homo sapiens
ucacccucaucgauuccua

SEQ ID NO: 371037 - RNA, 19 nt, Homo sapiens
cgaguuugcggugaagauu

SEQ ID NO: 371038 - RNA, 19 nt, Homo sapiens
aagguggcccucucugaaa

SEQ ID NO: 371039 - RNA, 19 nt, Homo sapiens
caaagaguuuuaccagaag

SEQ ID NO: 371040 - RNA, 19 nt, Homo sapiens
ccaagaaugcacuguugag

SEQ ID NO: 371041 - RNA, 19 nt, Homo sapiens
ccacacggcgagagacaca

SEQ ID NO: 371042 - RNA, 19 nt, Homo sapiens
guuccagcacugucaaaga

SEQ ID NO: 371043 - RNA, 19 nt, Homo sapiens
cggguucuccugccacuug

SEQ ID NO: 371044 - RNA, 19 nt, Homo sapiens
uagaugacaauaugcagau

SEQ ID NO: 371045 - RNA, 19 nt, Homo sapiens
caugcggucucugcuggaa

SEQ ID NO: 371046 - RNA, 19 nt, Homo sapiens
gggagagcuguuugacuau

SEQ ID NO: 371047 - RNA, 19 nt, Homo sapiens
gaaggaaguuguaggaaua

SEQ ID NO: 371048 - RNA, 19 nt, Homo sapiens
gaaaggaggugaaaccauu

SEQ ID NO: 371049 - RNA, 19 nt, Homo sapiens
gcacaaugguguugcuuua

SEQ ID NO: 371050 - RNA, 19 nt, Homo sapiens
gaaccaaucuuugaaauag

SEQ ID NO: 371051 - RNA, 19 nt, Homo sapiens
auaaggagcucuucagaua

SEQ ID NO: 371052 - RNA, 19 nt, Homo sapiens
ucacgaagguccaggauuu

SEQ ID NO: 371053 - RNA, 19 nt, Homo sapiens
ggugaaaccauuaggauua

SEQ ID NO: 371054 - RNA, 19 nt, Homo sapiens
gaacaacggcugucugguu

SEQ ID NO: 371055 - RNA, 19 nt, Homo sapiens
aaacaaaccuccagauucu

SEQ ID NO: 371056 - RNA, 19 nt, Homo sapiens
caaacgaaaugucuaagga

SEQ ID NO: 371057 - RNA, 19 nt, Homo sapiens
ccauuaggauuaacaguaa

SEQ ID NO: 371058 - RNA, 19 nt, Homo sapiens
gaaaauagcgugaacuuga

SEQ ID NO: 371059 - RNA, 19 nt, Homo sapiens
ggugguuggugucuaauuu

SEQ ID NO: 371060 - RNA, 19 nt, Homo sapiens
gagaagggcgacacuguuu

SEQ ID NO: 371061 - RNA, 19 nt, Homo sapiens
ccucaacaauuccaguaua

SEQ ID NO: 371062 - RNA, 19 nt, Homo sapiens
ugagagaugugaccauuuc

SEQ ID NO: 371063 - RNA, 19 nt, Homo sapiens
aaaggugguuggugucuaa

SEQ ID NO: 371064 - RNA, 19 nt, Homo sapiens
guacuuaauugcauagagu

SEQ ID NO: 371065 - RNA, 19 nt, Homo sapiens
gauguaaccuuuucuauca

SEQ ID NO: 371066 - RNA, 19 nt, Homo sapiens
gaaggauauuuggauguuu

SEQ ID NO: 371067 - RNA, 19 nt, Homo sapiens
gugaaaccauuaggauuaa

SEQ ID NO: 371068 - RNA, 19 nt, Homo sapiens
gaagggcaccagucaagaa

SEQ ID NO: 371069 - RNA, 19 nt, Homo sapiens
cuauaacucuuucaacaga

SEQ ID NO: 371070 - RNA, 19 nt, Homo sapiens
gaaaggagaaagaaccaau

SEQ ID NO: 371071 - RNA, 19 nt, Homo sapiens
uaaacaaaccuccagauuc

SEQ ID NO: 371072 - RNA, 19 nt, Homo sapiens
ggacggcgauggagcacau

SEQ ID NO: 371073 - RNA, 19 nt, Homo sapiens
aaacauguaucagguacuu

SEQ ID NO: 371074 - RNA, 19 nt, Homo sapiens
ugaaggauauuuggauguu

SEQ ID NO: 371075 - RNA, 19 nt, Homo sapiens
caagaagaagugaaugauu

SEQ ID NO: 371076 - RNA, 19 nt, Homo sapiens
ucagguacuuaauugcaua

SEQ ID NO: 371077 - RNA, 19 nt, Homo sapiens
uguaucagguacuuaauug

SEQ ID NO: 371078 - RNA, 19 nt, Homo sapiens
ucacuggaccuaauauuau

SEQ ID NO: 371079 - RNA, 19 nt, Homo sapiens
gugaaugauuuggagcuua

SEQ ID NO: 371080 - RNA, 19 nt, Homo sapiens
uaaauucuuuggagcugaa

SEQ ID NO: 371081 - RNA, 19 nt, Homo sapiens
gcaauuuccugccauuucg

SEQ ID NO: 371082 - RNA, 19 nt, Homo sapiens
gagcucgacuugugaaagg

SEQ ID NO: 371083 - RNA, 19 nt, Homo sapiens
agaaggaaguuguaggaau

SEQ ID NO: 371084 - RNA, 19 nt, Homo sapiens
gaacuugaaggauauuugg

SEQ ID NO: 371085 - RNA, 19 nt, Homo sapiens
ggagaagggcgacacuguu

SEQ ID NO: 371086 - RNA, 19 nt, Homo sapiens
ucauucaguuagcucuuua

SEQ ID NO: 371087 - RNA, 19 nt, Homo sapiens
acaaugguguugcuuuaau

SEQ ID NO: 371088 - RNA, 19 nt, Homo sapiens
ccaaaucuagaacaaugua

SEQ ID NO: 371089 - RNA, 19 nt, Homo sapiens
ugaaugauuuggagcuuag

SEQ ID NO: 371090 - RNA, 19 nt, Homo sapiens
caaugguguugcuuuaaug

SEQ ID NO: 371091 - RNA, 19 nt, Homo sapiens
guaggaauagcacauaaau

SEQ ID NO: 371092 - RNA, 19 nt, Homo sapiens
ccgagauucugaaauaugu

SEQ ID NO: 371093 - RNA, 19 nt, Homo sapiens
gaauaugcuccaagugaga

SEQ ID NO: 371094 - RNA, 19 nt, Homo sapiens
ccgaauaugcuccaaguga

SEQ ID NO: 371095 - RNA, 19 nt, Homo sapiens
uaacaguaaugagagaugu

SEQ ID NO: 371096 - RNA, 19 nt, Homo sapiens
gguguugcuuuaauggaaa

SEQ ID NO: 371097 - RNA, 19 nt, Homo sapiens
aacgaaaugucuaaggaaa

SEQ ID NO: 371098 - RNA, 19 nt, Homo sapiens
gauaaggagcucuucagau

SEQ ID NO: 371099 - RNA, 19 nt, Homo sapiens
gagaugugaccauuucgaa

SEQ ID NO: 371100 - RNA, 19 nt, Homo sapiens
gcgugaacuugaaggauau

SEQ ID NO: 371101 - RNA, 19 nt, Homo sapiens
agcgugaacuugaaggaua

SEQ ID NO: 371102 - RNA, 19 nt, Homo sapiens
guuggugucuaauuuaagu

SEQ ID NO: 371103 - RNA, 19 nt, Homo sapiens
uaaaggugguuggugucua

SEQ ID NO: 371104 - RNA, 19 nt, Homo sapiens
uuaaugagaugauguaacc

SEQ ID NO: 371105 - RNA, 19 nt, Homo sapiens
gcauaggaacggugucaug

SEQ ID NO: 371106 - RNA, 19 nt, Homo sapiens
gauccaggacuacgaggaa

SEQ ID NO: 371107 - RNA, 19 nt, Homo sapiens
gaaaccauuaggauuaaca

SEQ ID NO: 371108 - RNA, 19 nt, Homo sapiens
cgagaaggaaguuguagga

SEQ ID NO: 371109 - RNA, 19 nt, Homo sapiens
gagcacaucagccggaaca

SEQ ID NO: 371110 - RNA, 19 nt, Homo sapiens
ccacuacauugacgugaag

SEQ ID NO: 371111 - RNA, 19 nt, Homo sapiens
gccacuacauugacgugaa

SEQ ID NO: 371112 - RNA, 19 nt, Homo sapiens
gauaaacaaaccuccagau

SEQ ID NO: 371113 - RNA, 19 nt, Homo sapiens
gaggugaaaccauuaggau

SEQ ID NO: 371114 - RNA, 19 nt, Homo sapiens
gugguuggugucuaauuua

SEQ ID NO: 371115 - RNA, 19 nt, Homo sapiens
gagaugauguaaccuuuuc

SEQ ID NO: 371116 - RNA, 19 nt, Homo sapiens
aaggauauuuggauguuuc

SEQ ID NO: 371117 - RNA, 19 nt, Homo sapiens
caguauacucuggauaaua

SEQ ID NO: 371118 - RNA, 19 nt, Homo sapiens
auaaacaaaccuccagauu

SEQ ID NO: 371119 - RNA, 19 nt, Homo sapiens
ggaggugaaaccauuagga

SEQ ID NO: 371120 - RNA, 19 nt, Homo sapiens
aaaggaggugaaaccauua

SEQ ID NO: 371121 - RNA, 19 nt, Homo sapiens
ugguuggugucuaauuuaa

SEQ ID NO: 371122 - RNA, 19 nt, Homo sapiens
aaacgaaaugucuaaggaa

SEQ ID NO: 371123 - RNA, 19 nt, Homo sapiens
caucugcuauaacucuuuc

SEQ ID NO: 371124 - RNA, 19 nt, Homo sapiens
acauguaucagguacuuaa

SEQ ID NO: 371125 - RNA, 19 nt, Homo sapiens
caacaauuccaguauacuc

SEQ ID NO: 371126 - RNA, 19 nt, Homo sapiens
cacuggaccuaauauuaug

SEQ ID NO: 371127 - RNA, 19 nt, Homo sapiens
gcagaaaggaggugaaacc

SEQ ID NO: 371128 - RNA, 19 nt, Homo sapiens
ugcuauaacucuuucaaca

SEQ ID NO: 371129 - RNA, 19 nt, Homo sapiens
agaagaugaucacgaaggu

SEQ ID NO: 371130 - RNA, 19 nt, Homo sapiens
gagcuuaggguauguuuug

SEQ ID NO: 371131 - RNA, 19 nt, Homo sapiens
ggauaauaauguucuaacc

SEQ ID NO: 371132 - RNA, 19 nt, Homo sapiens
cgaaaugucuaaggaaaau

SEQ ID NO: 371133 - RNA, 19 nt, Homo sapiens
aaauggguuucuaguaauc

SEQ ID NO: 371134 - RNA, 19 nt, Homo sapiens
gagaaggaaguuguaggaa

SEQ ID NO: 371135 - RNA, 19 nt, Homo sapiens
caucgagaaggaaguugua

SEQ ID NO: 371136 - RNA, 19 nt, Homo sapiens
agaagaagugaaugauuug

SEQ ID NO: 371137 - RNA, 19 nt, Homo sapiens
guuaaaagcagaaaacaug

SEQ ID NO: 371138 - RNA, 19 nt, Homo sapiens
aaaccaaacgaaaugucua

SEQ ID NO: 371139 - RNA, 19 nt, Homo sapiens
gggcgacacuguuuucuuc

SEQ ID NO: 371140 - RNA, 19 nt, Homo sapiens
caguuuccauccucaacaa

SEQ ID NO: 371141 - RNA, 19 nt, Homo sapiens
aaaauagcgugaacuugaa

SEQ ID NO: 371142 - RNA, 19 nt, Homo sapiens
aaacaucgagaaggaaguu

SEQ ID NO: 371143 - RNA, 19 nt, Homo sapiens
uucacuggaccuaauauua

SEQ ID NO: 371144 - RNA, 19 nt, Homo sapiens
ccaagaagaagugaaugau

SEQ ID NO: 371145 - RNA, 19 nt, Homo sapiens
ugguguugcuuuaauggaa

SEQ ID NO: 371146 - RNA, 19 nt, Homo sapiens
ccacuucagggacuauuuc

SEQ ID NO: 371147 - RNA, 19 nt, Homo sapiens
agaaacagaucaacgauua

SEQ ID NO: 371148 - RNA, 19 nt, Homo sapiens
gagcaucgcuacagccuuu

SEQ ID NO: 371149 - RNA, 19 nt, Homo sapiens
gaaggguacucaagggaaa

SEQ ID NO: 371150 - RNA, 19 nt, Homo sapiens
ucacuaaggucuucagcaa

SEQ ID NO: 371151 - RNA, 19 nt, Homo sapiens
cagcuuacauuuacccaaa

SEQ ID NO: 371152 - RNA, 19 nt, Homo sapiens
gaagcuaguggauaaguuu

SEQ ID NO: 371153 - RNA, 19 nt, Homo sapiens
uggauccacugcuuaaaua

SEQ ID NO: 371154 - RNA, 19 nt, Homo sapiens
gccugaagcuaguggauaa

SEQ ID NO: 371155 - RNA, 19 nt, Homo sapiens
caacagcaccaauaucuuc

SEQ ID NO: 371156 - RNA, 19 nt, Homo sapiens
gggugcugcugaugaaaua

SEQ ID NO: 371157 - RNA, 19 nt, Homo sapiens
ugaaauaccugggcaaugc

SEQ ID NO: 371158 - RNA, 19 nt, Homo sapiens
ggaccaaggcugacacuca

SEQ ID NO: 371159 - RNA, 19 nt, Homo sapiens
gaaacuacagcaccuggaa

SEQ ID NO: 371160 - RNA, 19 nt, Homo sapiens
gaagaggccaagaaacaga

SEQ ID NO: 371161 - RNA, 19 nt, Homo sapiens
gcaccaauaucuucuucuc

SEQ ID NO: 371162 - RNA, 19 nt, Homo sapiens
gaacucacccacgauauca

SEQ ID NO: 371163 - RNA, 19 nt, Homo sapiens
gaaggugccuaugaugaag

SEQ ID NO: 371164 - RNA, 19 nt, Homo sapiens
cacccaaccuucaacaaga

SEQ ID NO: 371165 - RNA, 19 nt, Homo sapiens
acuaaggucuucagcaaug

SEQ ID NO: 371166 - RNA, 19 nt, Homo sapiens
gcugggugcugcugaugaa

SEQ ID NO: 371167 - RNA, 19 nt, Homo sapiens
cgacaaugccgucuucugu

SEQ ID NO: 371168 - RNA, 19 nt, Homo sapiens
ccuguuugcuccuccgaua

SEQ ID NO: 371169 - RNA, 19 nt, Homo sapiens
ccaagaaacagaucaacga

SEQ ID NO: 371170 - RNA, 19 nt, Homo sapiens
gggcaucacuaaggucuuc

SEQ ID NO: 371171 - RNA, 19 nt, Homo sapiens
ggggugaccuugguuaaua

SEQ ID NO: 371172 - RNA, 19 nt, Homo sapiens
caacugggcaucacuaagg

SEQ ID NO: 371173 - RNA, 19 nt, Homo sapiens
ugaccuugguuaauauuca

SEQ ID NO: 371174 - RNA, 19 nt, Homo sapiens
gggagaugcugcccagaag

SEQ ID NO: 371175 - RNA, 19 nt, Homo sapiens
ugaaggugccuaugaugaa

SEQ ID NO: 371176 - RNA, 19 nt, Homo sapiens
ccgaagaggccaagaaaca

SEQ ID NO: 371177 - RNA, 19 nt, Homo sapiens
gacagugaaucgacaaugc

SEQ ID NO: 371178 - RNA, 19 nt, Homo sapiens
caaguucaacaaacccuuu

SEQ ID NO: 371179 - RNA, 19 nt, Homo sapiens
gaggucaaguucaacaaac

SEQ ID NO: 371180 - RNA, 19 nt, Homo sapiens
uuacccaaacuguccauua

SEQ ID NO: 371181 - RNA, 19 nt, Homo sapiens
ggucugccagcuuacauuu

SEQ ID NO: 371182 - RNA, 19 nt, Homo sapiens
gugaaggugccuaugauga

SEQ ID NO: 371183 - RNA, 19 nt, Homo sapiens
ugaagcuaguggauaaguu

SEQ ID NO: 371184 - RNA, 19 nt, Homo sapiens
gggugaccuugguuaauau

SEQ ID NO: 371185 - RNA, 19 nt, Homo sapiens
ucaaggacaccgaggaaga

SEQ ID NO: 371186 - RNA, 19 nt, Homo sapiens
gcgagggccugaagcuagu

SEQ ID NO: 371187 - RNA, 19 nt, Homo sapiens
gaguucgccuucagccuau

SEQ ID NO: 371188 - RNA, 19 nt, Homo sapiens
caucuucuuuaaaggcaaa

SEQ ID NO: 371189 - RNA, 19 nt, Homo sapiens
cagcaccaauaucuucuuc

SEQ ID NO: 371190 - RNA, 19 nt, Homo sapiens
ggucaacugggcaucacua

SEQ ID NO: 371191 - RNA, 19 nt, Homo sapiens
ggugaauuacaucuucuuu

SEQ ID NO: 371192 - RNA, 19 nt, Homo sapiens
ggacagugaaucgacaaug

SEQ ID NO: 371193 - RNA, 19 nt, Homo sapiens
caagaaacagaucaacgau

SEQ ID NO: 371194 - RNA, 19 nt, Homo sapiens
ggcugacacucacgaugaa

SEQ ID NO: 371195 - RNA, 19 nt, Homo sapiens
aaucgacaaugccgucuuc

SEQ ID NO: 371196 - RNA, 19 nt, Homo sapiens
uacccaaacuguccauuac

SEQ ID NO: 371197 - RNA, 19 nt, Homo sapiens
caccgaagaggccaagaaa

SEQ ID NO: 371198 - RNA, 19 nt, Homo sapiens
cgaggucaaguucaacaaa

SEQ ID NO: 371199 - RNA, 19 nt, Homo sapiens
acaaugccgucuucugucu

SEQ ID NO: 371200 - RNA, 19 nt, Homo sapiens
gaugaaauaccugggcaau

SEQ ID NO: 371201 - RNA, 19 nt, Homo sapiens
aaaguuguaccacucagaa

SEQ ID NO: 371202 - RNA, 19 nt, Homo sapiens
aaugaacucacccacgaua

SEQ ID NO: 371203 - RNA, 19 nt, Homo sapiens
ggagaugcugcccagaaga

SEQ ID NO: 371204 - RNA, 19 nt, Homo sapiens
cccaaacuguccauuacug

SEQ ID NO: 371205 - RNA, 19 nt, Homo sapiens
ucuggugaauuacaucuuc

SEQ ID NO: 371206 - RNA, 19 nt, Homo sapiens
gaucccagccaguggacuu

SEQ ID NO: 371207 - RNA, 19 nt, Homo sapiens
ggacuuagccccuguuugc

SEQ ID NO: 371208 - RNA, 19 nt, Homo sapiens
aagaaggguugagcuggaa

SEQ ID NO: 371209 - RNA, 19 nt, Homo sapiens
gaagcguuuaggcauguuu

SEQ ID NO: 371210 - RNA, 19 nt, Homo sapiens
ugccuaugaugaagcguuu

SEQ ID NO: 371211 - RNA, 19 nt, Homo sapiens
ggcccugucuccucagcuu

SEQ ID NO: 371212 - RNA, 19 nt, Homo sapiens
ggccugaagcuaguggaua

SEQ ID NO: 371213 - RNA, 19 nt, Homo sapiens
uacagcaccuggaaaauga

SEQ ID NO: 371214 - RNA, 19 nt, Homo sapiens
gcuacagccuuugcaaugc

SEQ ID NO: 371215 - RNA, 19 nt, Homo sapiens
caggaucacccaaccuuca

SEQ ID NO: 371216 - RNA, 19 nt, Homo sapiens
gaaggucugccagcuuaca

SEQ ID NO: 371217 - RNA, 19 nt, Homo sapiens
aaacuacagcaccuggaaa

SEQ ID NO: 371218 - RNA, 19 nt, Homo sapiens
gaaacagaucaacgauuac

SEQ ID NO: 371219 - RNA, 19 nt, Homo sapiens
agccuucacugucaacuuc

SEQ ID NO: 371220 - RNA, 19 nt, Homo sapiens
cagauacaucccaccauga

SEQ ID NO: 371221 - RNA, 19 nt, Homo sapiens
cucccuggaugacauuaaa

SEQ ID NO: 371222 - RNA, 19 nt, Homo sapiens
acuggaaccuaugaucuga

SEQ ID NO: 371223 - RNA, 19 nt, Homo sapiens
ucugccagcuuacauuuac

SEQ ID NO: 371224 - RNA, 19 nt, Homo sapiens
acgauaucaucaccaaguu

SEQ ID NO: 371225 - RNA, 19 nt, Homo sapiens
ccucuggauccacugcuua

SEQ ID NO: 371226 - RNA, 19 nt, Homo sapiens
ccgugaaggugccuaugau

SEQ ID NO: 371227 - RNA, 19 nt, Homo sapiens
auacaucccaccaugauca

SEQ ID NO: 371228 - RNA, 19 nt, Homo sapiens
gaucacccaaccuucaaca

SEQ ID NO: 371229 - RNA, 19 nt, Homo sapiens
ugaacucacccacgauauc

SEQ ID NO: 371230 - RNA, 19 nt, Homo sapiens
cggaggcucagauccauga

SEQ ID NO: 371231 - RNA, 19 nt, Homo sapiens
uggaaccuaugaucugaag

SEQ ID NO: 371232 - RNA, 19 nt, Homo sapiens
cacgauaucaucaccaagu

SEQ ID NO: 371233 - RNA, 19 nt, Homo sapiens
cccacgauaucaucaccaa

SEQ ID NO: 371234 - RNA, 19 nt, Homo sapiens
aagaaacagaucaacgauu

SEQ ID NO: 371235 - RNA, 19 nt, Homo sapiens
ccaacagcaccaauaucuu

SEQ ID NO: 371236 - RNA, 19 nt, Homo sapiens
uuacauuuacccaaacugu

SEQ ID NO: 371237 - RNA, 19 nt, Homo sapiens
ucacccaaccuucaacaag

SEQ ID NO: 371238 - RNA, 19 nt, Homo sapiens
aggcugacacucacgauga

SEQ ID NO: 371239 - RNA, 19 nt, Homo sapiens
ggaauuaucccuuguaaau

SEQ ID NO: 371240 - RNA, 19 nt, Homo sapiens
gguauggccuuagcucuua

SEQ ID NO: 371241 - RNA, 19 nt, Homo sapiens
caaaggccguguuccauuc

SEQ ID NO: 371242 - RNA, 19 nt, Homo sapiens
gauacugacugcccaggaa

SEQ ID NO: 371243 - RNA, 19 nt, Homo sapiens
ggacaaguuucaguuaaag

SEQ ID NO: 371244 - RNA, 19 nt, Homo sapiens
ucacgggaguuccuguuaa

SEQ ID NO: 371245 - RNA, 19 nt, Homo sapiens
aagcuggacugcauaaaga

SEQ ID NO: 371246 - RNA, 19 nt, Homo sapiens
gacaagaucccguuaaagg

SEQ ID NO: 371247 - RNA, 19 nt, Homo sapiens
ucaguuaaaggucaagaua

SEQ ID NO: 371248 - RNA, 19 nt, Homo sapiens
aaggacaaguuucaguuaa

SEQ ID NO: 371249 - RNA, 19 nt, Homo sapiens
aaaggacaaguuucaguua

SEQ ID NO: 371250 - RNA, 19 nt, Homo sapiens
uggacaagaucccguuaaa

SEQ ID NO: 371251 - RNA, 19 nt, Homo sapiens
gcccaggaaucaagaagug

SEQ ID NO: 371252 - RNA, 19 nt, Homo sapiens
uaaaggacaaguuucaguu

SEQ ID NO: 371253 - RNA, 19 nt, Homo sapiens
aaagauugguauggccuua

SEQ ID NO: 371254 - RNA, 19 nt, Homo sapiens
gcucuuagccaaacaccuu

SEQ ID NO: 371255 - RNA, 19 nt, Homo sapiens
cucauccacuuuccaauaa

SEQ ID NO: 371256 - RNA, 19 nt, Homo sapiens
cacgggaguuccuguuaaa

SEQ ID NO: 371257 - RNA, 19 nt, Homo sapiens
ucucauccacuuuccaaua

SEQ ID NO: 371258 - RNA, 19 nt, Homo sapiens
ccuaaccgcugcuugaaag

SEQ ID NO: 371259 - RNA, 19 nt, Homo sapiens
gggaguuccuguuaaaggu

SEQ ID NO: 371260 - RNA, 19 nt, Homo sapiens
aaccgcugcuugaaagaua

SEQ ID NO: 371261 - RNA, 19 nt, Homo sapiens
gcaagagccagucaaaggu

SEQ ID NO: 371262 - RNA, 19 nt, Homo sapiens
ucaaaggccguguuccauu

SEQ ID NO: 371263 - RNA, 19 nt, Homo sapiens
aggacaaguuucaguuaaa

SEQ ID NO: 371264 - RNA, 19 nt, Homo sapiens
gaaucaagaagugcuguga

SEQ ID NO: 371265 - RNA, 19 nt, Homo sapiens
caguuaaaggucaagauaa

SEQ ID NO: 371266 - RNA, 19 nt, Homo sapiens
cgggauggccuguuucguu

SEQ ID NO: 371267 - RNA, 19 nt, Homo sapiens
ggacaagaucccguuaaag

SEQ ID NO: 371268 - RNA, 19 nt, Homo sapiens
caagcuggacugcauaaag

SEQ ID NO: 371269 - RNA, 19 nt, Homo sapiens
gccaaacaccuuccugaca

SEQ ID NO: 371270 - RNA, 19 nt, Homo sapiens
gguccagucuccacuaagc

SEQ ID NO: 371271 - RNA, 19 nt, Homo sapiens
gauccggugcgccauguug

SEQ ID NO: 371272 - RNA, 19 nt, Homo sapiens
aagguccagucuccacuaa

SEQ ID NO: 371273 - RNA, 19 nt, Homo sapiens
ucauccacuuuccaauaaa

SEQ ID NO: 371274 - RNA, 19 nt, Homo sapiens
acaagaucccguuaaagga

SEQ ID NO: 371275 - RNA, 19 nt, Homo sapiens
uguuaaaggucaagacacu

SEQ ID NO: 371276 - RNA, 19 nt, Homo sapiens
cugggacgcugguucuaga

SEQ ID NO: 371277 - RNA, 19 nt, Homo sapiens
cuugcgggauggccuguuu

SEQ ID NO: 371278 - RNA, 19 nt, Homo sapiens
gccaagcuggacugcauaa

SEQ ID NO: 371279 - RNA, 19 nt, Homo sapiens
gcuggacugcauaaagauu

SEQ ID NO: 371280 - RNA, 19 nt, Homo sapiens
gucacgggaguuccuguua

SEQ ID NO: 371281 - RNA, 19 nt, Homo sapiens
cguuaaaggacaaguuuca

SEQ ID NO: 371282 - RNA, 19 nt, Homo sapiens
aggucaagauaaagucaaa

SEQ ID NO: 371283 - RNA, 19 nt, Homo sapiens
aggccaagcuggacugcau

SEQ ID NO: 371284 - RNA, 19 nt, Homo sapiens
uuaaaggucaagacacugu

SEQ ID NO: 371285 - RNA, 19 nt, Homo sapiens
cgcaagagccagucaaagg

SEQ ID NO: 371286 - RNA, 19 nt, Homo sapiens
aaagguccagucuccacua

SEQ ID NO: 371287 - RNA, 19 nt, Homo sapiens
ggccaagcuggacugcaua

SEQ ID NO: 371288 - RNA, 19 nt, Homo sapiens
gagggaagauuguggauuu

SEQ ID NO: 371289 - RNA, 19 nt, Homo sapiens
gagcaucacugguaucuuc

SEQ ID NO: 371290 - RNA, 19 nt, Homo sapiens
gugaguagcucuguguuua

SEQ ID NO: 371291 - RNA, 19 nt, Homo sapiens
ugauggugcuggugaauua

SEQ ID NO: 371292 - RNA, 19 nt, Homo sapiens
ucagugagcucaagaagga

SEQ ID NO: 371293 - RNA, 19 nt, Homo sapiens
ggaugcaucuuaucgacua

SEQ ID NO: 371294 - RNA, 19 nt, Homo sapiens
ucacggaucuguucuccaa

SEQ ID NO: 371295 - RNA, 19 nt, Homo sapiens
ggugagaguugcaguaaca

SEQ ID NO: 371296 - RNA, 19 nt, Homo sapiens
gaaacucgagggaagauug

SEQ ID NO: 371297 - RNA, 19 nt, Homo sapiens
caauccagcuuaucaacga

SEQ ID NO: 371298 - RNA, 19 nt, Homo sapiens
acaacacgaugccaugaaa

SEQ ID NO: 371299 - RNA, 19 nt, Homo sapiens
ucaaagcccugugggagaa

SEQ ID NO: 371300 - RNA, 19 nt, Homo sapiens
gaguagcucuguguuuaga

SEQ ID NO: 371301 - RNA, 19 nt, Homo sapiens
acaagaagcuagaguugca

SEQ ID NO: 371302 - RNA, 19 nt, Homo sapiens
cuaaugagguggaacaacu

SEQ ID NO: 371303 - RNA, 19 nt, Homo sapiens
gcacaauccagcuuaucaa

SEQ ID NO: 371304 - RNA, 19 nt, Homo sapiens
ggaagauuguggauuuggu

SEQ ID NO: 371305 - RNA, 19 nt, Homo sapiens
gagggagauugaagagguu

SEQ ID NO: 371306 - RNA, 19 nt, Homo sapiens
gaaguuccuugcaaaauuc

SEQ ID NO: 371307 - RNA, 19 nt, Homo sapiens
ggaccacucccaaagacuu

SEQ ID NO: 371308 - RNA, 19 nt, Homo sapiens
caaggaccacucccaaaga

SEQ ID NO: 371309 - RNA, 19 nt, Homo sapiens
ugggagaaaccauucauuu

SEQ ID NO: 371310 - RNA, 19 nt, Homo sapiens
gcuggugaauuacauuuac

SEQ ID NO: 371311 - RNA, 19 nt, Homo sapiens
cuaugaggcuaaacucuuc

SEQ ID NO: 371312 - RNA, 19 nt, Homo sapiens
ggagugaguagcucugugu

SEQ ID NO: 371313 - RNA, 19 nt, Homo sapiens
ucaacgaccacgucaagaa

SEQ ID NO: 371314 - RNA, 19 nt, Homo sapiens
ugaaguuccuugcaaaauu

SEQ ID NO: 371315 - RNA, 19 nt, Homo sapiens
acggauggauuacaaagga

SEQ ID NO: 371316 - RNA, 19 nt, Homo sapiens
aagcuagaguugcaucuuc

SEQ ID NO: 371317 - RNA, 19 nt, Homo sapiens
agaaggacgucuugauggu

SEQ ID NO: 371318 - RNA, 19 nt, Homo sapiens
gauggugagaguugcagua

SEQ ID NO: 371319 - RNA, 19 nt, Homo sapiens
cagcuucgcgaucaaauuc

SEQ ID NO: 371320 - RNA, 19 nt, Homo sapiens
gaagcuagaguugcaucuu

SEQ ID NO: 371321 - RNA, 19 nt, Homo sapiens
caucacugguaucuucaug

SEQ ID NO: 371322 - RNA, 19 nt, Homo sapiens
cuacuggcccuuucucaug

SEQ ID NO: 371323 - RNA, 19 nt, Homo sapiens
ccagaccaaucgccacauc

SEQ ID NO: 371324 - RNA, 19 nt, Homo sapiens
cuucccaaguucuccauuu

SEQ ID NO: 371325 - RNA, 19 nt, Homo sapiens
uuacaagaagcuagaguug

SEQ ID NO: 371326 - RNA, 19 nt, Homo sapiens
caacgaccacgucaagaag

SEQ ID NO: 371327 - RNA, 19 nt, Homo sapiens
caagauagccccugccaau

SEQ ID NO: 371328 - RNA, 19 nt, Homo sapiens
gggcuucacggaucuguuc

SEQ ID NO: 371329 - RNA, 19 nt, Homo sapiens
gauuguggauuuggucagu

SEQ ID NO: 371330 - RNA, 19 nt, Homo sapiens
aaacaacacgaugccauga

SEQ ID NO: 371331 - RNA, 19 nt, Homo sapiens
cagggcugcucaucuguuc

SEQ ID NO: 371332 - RNA, 19 nt, Homo sapiens
ggcacaauccagcuuauca

SEQ ID NO: 371333 - RNA, 19 nt, Homo sapiens
aaccugaaguuccuugcaa

SEQ ID NO: 371334 - RNA, 19 nt, Homo sapiens
gagcauccgaccucuugga

SEQ ID NO: 371335 - RNA, 19 nt, Homo sapiens
gcuucgcgaucaaauucuu

SEQ ID NO: 371336 - RNA, 19 nt, Homo sapiens
gccaccagcuucgcgauca

SEQ ID NO: 371337 - RNA, 19 nt, Homo sapiens
gcaaaaugagggagauuga

SEQ ID NO: 371338 - RNA, 19 nt, Homo sapiens
ucaaggaccacucccaaag

SEQ ID NO: 371339 - RNA, 19 nt, Homo sapiens
guuccaagcaggaggaugu

SEQ ID NO: 371340 - RNA, 19 nt, Homo sapiens
ucacugguaucuucaugac

SEQ ID NO: 371341 - RNA, 19 nt, Homo sapiens
uauccggcaucaccaaaca

SEQ ID NO: 371342 - RNA, 19 nt, Homo sapiens
aguugcaucuucccaaguu

SEQ ID NO: 371343 - RNA, 19 nt, Homo sapiens
cuccagagaugcuaaugag

SEQ ID NO: 371344 - RNA, 19 nt, Homo sapiens
gcagaggaugcaucuuauc

SEQ ID NO: 371345 - RNA, 19 nt, Homo sapiens
uaucaacgaccacgucaag

SEQ ID NO: 371346 - RNA, 19 nt, Homo sapiens
ucccagggcugcucaucug

SEQ ID NO: 371347 - RNA, 19 nt, Homo sapiens
ggccgucuaugaggcuaaa

SEQ ID NO: 371348 - RNA, 19 nt, Homo sapiens
ggagggcugggagugagua

SEQ ID NO: 371349 - RNA, 19 nt, Homo sapiens
ccaccagcuucgcgaucaa

SEQ ID NO: 371350 - RNA, 19 nt, Homo sapiens
gugcuggugaauuacauuu

SEQ ID NO: 371351 - RNA, 19 nt, Homo sapiens
gaccacgucaagaaggaaa

SEQ ID NO: 371352 - RNA, 19 nt, Homo sapiens
ucuaugaggcuaaacucuu

SEQ ID NO: 371353 - RNA, 19 nt, Homo sapiens
gacuuugccuuccgcuucu

SEQ ID NO: 371354 - RNA, 19 nt, Homo sapiens
gcucggugcuacggaugga

SEQ ID NO: 371355 - RNA, 19 nt, Homo sapiens
caccauggccgucuaugag

SEQ ID NO: 371356 - RNA, 19 nt, Homo sapiens
acaccauggccgucuauga

SEQ ID NO: 371357 - RNA, 19 nt, Homo sapiens
cuccauuucuggcuccuau

SEQ ID NO: 371358 - RNA, 19 nt, Homo sapiens
cccaaguucuccauuucug

SEQ ID NO: 371359 - RNA, 19 nt, Homo sapiens
gagauugaagagguucuga

SEQ ID NO: 371360 - RNA, 19 nt, Homo sapiens
aaaugagggagauugaaga

SEQ ID NO: 371361 - RNA, 19 nt, Homo sapiens
ggugaauuacauuuacuuc

SEQ ID NO: 371362 - RNA, 19 nt, Homo sapiens
gcacguugagcaugauggu

SEQ ID NO: 371363 - RNA, 19 nt, Homo sapiens
ggaaacucgagggaagauu

SEQ ID NO: 371364 - RNA, 19 nt, Homo sapiens
gugggcacaauccagcuua

SEQ ID NO: 371365 - RNA, 19 nt, Homo sapiens
cgugggcagugcucuguuc

SEQ ID NO: 371366 - RNA, 19 nt, Homo sapiens
cgccacauccugcgauuca

SEQ ID NO: 371367 - RNA, 19 nt, Homo sapiens
ugaguccgauguccauagg

SEQ ID NO: 371368 - RNA, 19 nt, Homo sapiens
gaacuugucucuucaucua

SEQ ID NO: 371369 - RNA, 19 nt, Homo sapiens
gcacaaggaugaauugaau

SEQ ID NO: 371370 - RNA, 19 nt, Homo sapiens
gcaggcagguguuuauuaa

SEQ ID NO: 371371 - RNA, 19 nt, Homo sapiens
gcacagggauucucacaau

SEQ ID NO: 371372 - RNA, 19 nt, Homo sapiens
guucugagauucaauauug

SEQ ID NO: 371373 - RNA, 19 nt, Homo sapiens
caaauucuguucuccuuaa

SEQ ID NO: 371374 - RNA, 19 nt, Homo sapiens
gcaagcauguaacuuauau

SEQ ID NO: 371375 - RNA, 19 nt, Homo sapiens
gaaauacagucuuccacaa

SEQ ID NO: 371376 - RNA, 19 nt, Homo sapiens
caaagugugcuuagaaaua

SEQ ID NO: 371377 - RNA, 19 nt, Homo sapiens
gcacuaugcuuuccuucuu

SEQ ID NO: 371378 - RNA, 19 nt, Homo sapiens
ggaaacuacugccuuuaga

SEQ ID NO: 371379 - RNA, 19 nt, Homo sapiens
ccaaggauguggaggauga

SEQ ID NO: 371380 - RNA, 19 nt, Homo sapiens
gaagagacccuaugcaaag

SEQ ID NO: 371381 - RNA, 19 nt, Homo sapiens
ugacaugcauuguaaauag

SEQ ID NO: 371382 - RNA, 19 nt, Homo sapiens
cacguuaccuugacacaua

SEQ ID NO: 371383 - RNA, 19 nt, Homo sapiens
caaaggaauuggaaacugu

SEQ ID NO: 371384 - RNA, 19 nt, Homo sapiens
gaccaucccuuuauuuaca

SEQ ID NO: 371385 - RNA, 19 nt, Homo sapiens
gguuaaugcugccuacuuu

SEQ ID NO: 371386 - RNA, 19 nt, Homo sapiens
agaaauaacugaagauggu

SEQ ID NO: 371387 - RNA, 19 nt, Homo sapiens
acaaaucucugaaucuuuc

SEQ ID NO: 371388 - RNA, 19 nt, Homo sapiens
gaaaaggaaucacguuaga

SEQ ID NO: 371389 - RNA, 19 nt, Homo sapiens
gauauacccuuuggauuuc

SEQ ID NO: 371390 - RNA, 19 nt, Homo sapiens
caacaaaacucgaaacauc

SEQ ID NO: 371391 - RNA, 19 nt, Homo sapiens
gaauuucuccuaugcuauu

SEQ ID NO: 371392 - RNA, 19 nt, Homo sapiens
agaggaaguucagaucuua

SEQ ID NO: 371393 - RNA, 19 nt, Homo sapiens
ucuaguagcugaaaugcaa

SEQ ID NO: 371394 - RNA, 19 nt, Homo sapiens
ccagaaguccuuauguuaa

SEQ ID NO: 371395 - RNA, 19 nt, Homo sapiens
ggaaucacguuagaggaaa

SEQ ID NO: 371396 - RNA, 19 nt, Homo sapiens
ucucacagauggccacuuu

SEQ ID NO: 371397 - RNA, 19 nt, Homo sapiens
gcaaaggaauuggaaacug

SEQ ID NO: 371398 - RNA, 19 nt, Homo sapiens
cacaauagccgauaucaga

SEQ ID NO: 371399 - RNA, 19 nt, Homo sapiens
caacaagacagacaccaaa

SEQ ID NO: 371400 - RNA, 19 nt, Homo sapiens
agacaaaucucugaaucuu

SEQ ID NO: 371401 - RNA, 19 nt, Homo sapiens
guagacaaaucucugaauc

SEQ ID NO: 371402 - RNA, 19 nt, Homo sapiens
gauuaaagugcucacguua

SEQ ID NO: 371403 - RNA, 19 nt, Homo sapiens
gauaucagaauuuguguug

SEQ ID NO: 371404 - RNA, 19 nt, Homo sapiens
ggaguggcccuaucaaaug

SEQ ID NO: 371405 - RNA, 19 nt, Homo sapiens
gaagacacaucugauuucu

SEQ ID NO: 371406 - RNA, 19 nt, Homo sapiens
cagaucaacaacucaauua

SEQ ID NO: 371407 - RNA, 19 nt, Homo sapiens
caaauguuauccacaaagu

SEQ ID NO: 371408 - RNA, 19 nt, Homo sapiens
agauauacccuuuggauuu

SEQ ID NO: 371409 - RNA, 19 nt, Homo sapiens
gaaacuacugccuuuagaa

SEQ ID NO: 371410 - RNA, 19 nt, Homo sapiens
agaggaaacuacugccuuu

SEQ ID NO: 371411 - RNA, 19 nt, Homo sapiens
agacacaucugauuucucu

SEQ ID NO: 371412 - RNA, 19 nt, Homo sapiens
ggaugccgauuucuguaaa

SEQ ID NO: 371413 - RNA, 19 nt, Homo sapiens
gcaaauucuguucuccuua

SEQ ID NO: 371414 - RNA, 19 nt, Homo sapiens
ggaaguucagaucuuaaua

SEQ ID NO: 371415 - RNA, 19 nt, Homo sapiens
gcuccucgcuugccuguuc

SEQ ID NO: 371416 - RNA, 19 nt, Homo sapiens
gaauguccuuucagacuca

SEQ ID NO: 371417 - RNA, 19 nt, Homo sapiens
gaaacgaaaggucagauca

SEQ ID NO: 371418 - RNA, 19 nt, Homo sapiens
guucauggauuacuucucu

SEQ ID NO: 371419 - RNA, 19 nt, Homo sapiens
gcuuagaaauaacugaaga

SEQ ID NO: 371420 - RNA, 19 nt, Homo sapiens
guccagaaguccuuauguu

SEQ ID NO: 371421 - RNA, 19 nt, Homo sapiens
gacauacgcuuuuaaugaa

SEQ ID NO: 371422 - RNA, 19 nt, Homo sapiens
gccaguacuugucauaugu

SEQ ID NO: 371423 - RNA, 19 nt, Homo sapiens
gugaagacacaucugauuu

SEQ ID NO: 371424 - RNA, 19 nt, Homo sapiens
gacaguaucaauuguaaga

SEQ ID NO: 371425 - RNA, 19 nt, Homo sapiens
ugggaaacauugacaguau

SEQ ID NO: 371426 - RNA, 19 nt, Homo sapiens
cgaaaggucagaucaacaa

SEQ ID NO: 371427 - RNA, 19 nt, Homo sapiens
cagaauuuguguugaagga

SEQ ID NO: 371428 - RNA, 19 nt, Homo sapiens
cgaagagacccuaugcaaa

SEQ ID NO: 371429 - RNA, 19 nt, Homo sapiens
aaacuacugccuuuagaaa

SEQ ID NO: 371430 - RNA, 19 nt, Homo sapiens
ucgcagagcuuuucagauu

SEQ ID NO: 371431 - RNA, 19 nt, Homo sapiens
uauagaacuucauggauca

SEQ ID NO: 371432 - RNA, 19 nt, Homo sapiens
ugaagaaaguguagugcau

SEQ ID NO: 371433 - RNA, 19 nt, Homo sapiens
cugaaagacugaagaaagu

SEQ ID NO: 371434 - RNA, 19 nt, Homo sapiens
gucaaacucuccauuccaa

SEQ ID NO: 371435 - RNA, 19 nt, Homo sapiens
ccacaggcuuggagaagau

SEQ ID NO: 371436 - RNA, 19 nt, Homo sapiens
gaucaacaacucaauuaag

SEQ ID NO: 371437 - RNA, 19 nt, Homo sapiens
uuggacagguucuucauuu

SEQ ID NO: 371438 - RNA, 19 nt, Homo sapiens
ucaagugggugcuaaaggu

SEQ ID NO: 371439 - RNA, 19 nt, Homo sapiens
gaaauuggacagguucuuc

SEQ ID NO: 371440 - RNA, 19 nt, Homo sapiens
ugauuaaagugcucacguu

SEQ ID NO: 371441 - RNA, 19 nt, Homo sapiens
cacagggauucucacaaua

SEQ ID NO: 371442 - RNA, 19 nt, Homo sapiens
gaguggcccuaucaaaugu

SEQ ID NO: 371443 - RNA, 19 nt, Homo sapiens
gggaguggcccuaucaaau

SEQ ID NO: 371444 - RNA, 19 nt, Homo sapiens
ugauuucucuggaauguca

SEQ ID NO: 371445 - RNA, 19 nt, Homo sapiens
ucacagauggccacuuuga

SEQ ID NO: 371446 - RNA, 19 nt, Homo sapiens
ggcaggcagguguuuauua

SEQ ID NO: 371447 - RNA, 19 nt, Homo sapiens
uauguagccuucacacaga

SEQ ID NO: 371448 - RNA, 19 nt, Homo sapiens
ccucuucucuccaaucugu

SEQ ID NO: 371449 - RNA, 19 nt, Homo sapiens
ggcaaauucuguucuccuu

SEQ ID NO: 371450 - RNA, 19 nt, Homo sapiens
aaucuagggcugaaacaua

SEQ ID NO: 371451 - RNA, 19 nt, Homo sapiens
ccaaaauccuugugguuaa

SEQ ID NO: 371452 - RNA, 19 nt, Homo sapiens
gaaucuuucuacagaguuc

SEQ ID NO: 371453 - RNA, 19 nt, Homo sapiens
gaauguuggauaaggaauu

SEQ ID NO: 371454 - RNA, 19 nt, Homo sapiens
cauucucgcuucccugaaa

SEQ ID NO: 371455 - RNA, 19 nt, Homo sapiens
gaaagacugaagaaagugu

SEQ ID NO: 371456 - RNA, 19 nt, Homo sapiens
ggaaacauugacaguauca

SEQ ID NO: 371457 - RNA, 19 nt, Homo sapiens
caauuaaggaucucacaga

SEQ ID NO: 371458 - RNA, 19 nt, Homo sapiens
caacaacucaauuaaggau

SEQ ID NO: 371459 - RNA, 19 nt, Homo sapiens
aagacuaaguagcccauaa

SEQ ID NO: 371460 - RNA, 19 nt, Homo sapiens
caucugauuucucuggaau

SEQ ID NO: 371461 - RNA, 19 nt, Homo sapiens
ucauagagcuuccuuuuca

SEQ ID NO: 371462 - RNA, 19 nt, Homo sapiens
gaucauagagcuuccuuuu

SEQ ID NO: 371463 - RNA, 19 nt, Homo sapiens
ccaaaccagugcagaugau

SEQ ID NO: 371464 - RNA, 19 nt, Homo sapiens
aaaugaaauuggacagguu

SEQ ID NO: 371465 - RNA, 19 nt, Homo sapiens
cagacaaaauggauacaua

SEQ ID NO: 371466 - RNA, 19 nt, Homo sapiens
cuuaauaugcugcaacaaa

SEQ ID NO: 371467 - RNA, 19 nt, Homo sapiens
uccagaaguccuuauguua

SEQ ID NO: 371468 - RNA, 19 nt, Homo sapiens
ggagaaauauuuacccaaa

SEQ ID NO: 371469 - RNA, 19 nt, Homo sapiens
gcaaggaacugaauaugau

SEQ ID NO: 371470 - RNA, 19 nt, Homo sapiens
ggagaaaccugugcaaaug

SEQ ID NO: 371471 - RNA, 19 nt, Homo sapiens
ggacgaggcuggacaugau

SEQ ID NO: 371472 - RNA, 19 nt, Homo sapiens
agaaagaacucacuuacga

SEQ ID NO: 371473 - RNA, 19 nt, Homo sapiens
aaagacaacucgaagaaug

SEQ ID NO: 371474 - RNA, 19 nt, Homo sapiens
uggaggagcuugacuuuau

SEQ ID NO: 371475 - RNA, 19 nt, Homo sapiens
aaacaccgcugcacagaug

SEQ ID NO: 371476 - RNA, 19 nt, Homo sapiens
ugagaacgguggagaaaga

SEQ ID NO: 371477 - RNA, 19 nt, Homo sapiens
ggugaaugcugucuauuuc

SEQ ID NO: 371478 - RNA, 19 nt, Homo sapiens
guaaagacaacucgaagaa

SEQ ID NO: 371479 - RNA, 19 nt, Homo sapiens
ccagauacuuucuuucaau

SEQ ID NO: 371480 - RNA, 19 nt, Homo sapiens
gaggagagacuguuuaaag

SEQ ID NO: 371481 - RNA, 19 nt, Homo sapiens
gugauuuccucucaucuuu

SEQ ID NO: 371482 - RNA, 19 nt, Homo sapiens
cgagaccacugacuugaga

SEQ ID NO: 371483 - RNA, 19 nt, Homo sapiens
gguggcaguucagaaauaa

SEQ ID NO: 371484 - RNA, 19 nt, Homo sapiens
ggacgagaccacugacuug

SEQ ID NO: 371485 - RNA, 19 nt, Homo sapiens
gagaaaccugugcaaauga

SEQ ID NO: 371486 - RNA, 19 nt, Homo sapiens
cagcaagaaugaggagaaa

SEQ ID NO: 371487 - RNA, 19 nt, Homo sapiens
ggcaaggaacugaauauga

SEQ ID NO: 371488 - RNA, 19 nt, Homo sapiens
ggagaaagaacucacuuac

SEQ ID NO: 371489 - RNA, 19 nt, Homo sapiens
gauggaggagcuugacuuu

SEQ ID NO: 371490 - RNA, 19 nt, Homo sapiens
cgccacagcugccaucaug

SEQ ID NO: 371491 - RNA, 19 nt, Homo sapiens
gcuacgacauggagagugu

SEQ ID NO: 371492 - RNA, 19 nt, Homo sapiens
ggaggagcuugacuuuauc

SEQ ID NO: 371493 - RNA, 19 nt, Homo sapiens
gauuuccucucaucuuuua

SEQ ID NO: 371494 - RNA, 19 nt, Homo sapiens
gcacagauggcccagauac

SEQ ID NO: 371495 - RNA, 19 nt, Homo sapiens
ggagaacaccgaggagaga

SEQ ID NO: 371496 - RNA, 19 nt, Homo sapiens
ggaaacaccgcugcacaga

SEQ ID NO: 371497 - RNA, 19 nt, Homo sapiens
caacccaaguggccuuauc

SEQ ID NO: 371498 - RNA, 19 nt, Homo sapiens
ugaaaacgcuggguaaaga

SEQ ID NO: 371499 - RNA, 19 nt, Homo sapiens
gcccagauacuuucuuuca

SEQ ID NO: 371500 - RNA, 19 nt, Homo sapiens
gguuuaaacuagaggaaag

SEQ ID NO: 371501 - RNA, 19 nt, Homo sapiens
agaggcaaauggcaccuuu

SEQ ID NO: 371502 - RNA, 19 nt, Homo sapiens
ggggaaaagucuugugauu

SEQ ID NO: 371503 - RNA, 19 nt, Homo sapiens
cagauggcccagauacuuu

SEQ ID NO: 371504 - RNA, 19 nt, Homo sapiens
ggcuggacaugauggauga

SEQ ID NO: 371505 - RNA, 19 nt, Homo sapiens
gcuugggucugccaucaug

SEQ ID NO: 371506 - RNA, 19 nt, Homo sapiens
ugguggcaguucagaaaua

SEQ ID NO: 371507 - RNA, 19 nt, Homo sapiens
gaggagaaaccugugcaaa

SEQ ID NO: 371508 - RNA, 19 nt, Homo sapiens
ccaacgggauucucuucug

SEQ ID NO: 371509 - RNA, 19 nt, Homo sapiens
aggagagacuguuuaaagu

SEQ ID NO: 371510 - RNA, 19 nt, Homo sapiens
gaaaagacagaagguaaaa

SEQ ID NO: 371511 - RNA, 19 nt, Homo sapiens
gguaaagacaacucgaaga

SEQ ID NO: 371512 - RNA, 19 nt, Homo sapiens
ggcacgcaguacuugcuua

SEQ ID NO: 371513 - RNA, 19 nt, Homo sapiens
gaugcggugugccagauuc

SEQ ID NO: 371514 - RNA, 19 nt, Homo sapiens
agaacucacuuacgagaag

SEQ ID NO: 371515 - RNA, 19 nt, Homo sapiens
aaaucuuggugcuuccaua

SEQ ID NO: 371516 - RNA, 19 nt, Homo sapiens
gaaacaccgcugcacagau

SEQ ID NO: 371517 - RNA, 19 nt, Homo sapiens
cagaaagaccaacgggauu

SEQ ID NO: 371518 - RNA, 19 nt, Homo sapiens
caacucgaagaauguguuu

SEQ ID NO: 371519 - RNA, 19 nt, Homo sapiens
ggaacugaauaugaucauc

SEQ ID NO: 371520 - RNA, 19 nt, Homo sapiens
agaaaccugugcaaaugau

SEQ ID NO: 371521 - RNA, 19 nt, Homo sapiens
uggcccagauacuuucuuu

SEQ ID NO: 371522 - RNA, 19 nt, Homo sapiens
gggcaaggcagacuucucu

SEQ ID NO: 371523 - RNA, 19 nt, Homo sapiens
uaucagcgccguagagaag

SEQ ID NO: 371524 - RNA, 19 nt, Homo sapiens
caaggcugguucuggugaa

SEQ ID NO: 371525 - RNA, 19 nt, Homo sapiens
gugcagugguggcaguuca

SEQ ID NO: 371526 - RNA, 19 nt, Homo sapiens
ggacaugauggaugaagag

SEQ ID NO: 371527 - RNA, 19 nt, Homo sapiens
uggagaaagaacucacuua

SEQ ID NO: 371528 - RNA, 19 nt, Homo sapiens
ccgaggagagacuguuuaa

SEQ ID NO: 371529 - RNA, 19 nt, Homo sapiens
gaagaggagguggaagugu

SEQ ID NO: 371530 - RNA, 19 nt, Homo sapiens
guagagaaguccagaaaac

SEQ ID NO: 371531 - RNA, 19 nt, Homo sapiens
ccacagcugccaucaugau

SEQ ID NO: 371532 - RNA, 19 nt, Homo sapiens
ccaaggucgugcacaaguc

SEQ ID NO: 371533 - RNA, 19 nt, Homo sapiens
uguccaaggucgugcacaa

SEQ ID NO: 371534 - RNA, 19 nt, Homo sapiens
uuaaagucagcaagaauga

SEQ ID NO: 371535 - RNA, 19 nt, Homo sapiens
gggauggacaguuugacaa

SEQ ID NO: 371536 - RNA, 19 nt, Homo sapiens
gcacgcaguacuugcuuag

SEQ ID NO: 371537 - RNA, 19 nt, Homo sapiens
acagauggcccagauacuu

SEQ ID NO: 371538 - RNA, 19 nt, Homo sapiens
ggaugaagaggagguggaa

SEQ ID NO: 371539 - RNA, 19 nt, Homo sapiens
uaaagacaacucgaagaau

SEQ ID NO: 371540 - RNA, 19 nt, Homo sapiens
gaacgguggagaaagaacu

SEQ ID NO: 371541 - RNA, 19 nt, Homo sapiens
gcaaucuacuuuuaagaag

SEQ ID NO: 371542 - RNA, 19 nt, Homo sapiens
uggugaaugcugucuauuu

SEQ ID NO: 371543 - RNA, 19 nt, Homo sapiens
ucuggugaaugcugucuau

SEQ ID NO: 371544 - RNA, 19 nt, Homo sapiens
gaccaacgggauucucuuc

SEQ ID NO: 371545 - RNA, 19 nt, Homo sapiens
cugcacagauggcccagau

SEQ ID NO: 371546 - RNA, 19 nt, Homo sapiens
gacgagaccacugacuuga

SEQ ID NO: 371547 - RNA, 19 nt, Homo sapiens
aauaaagggcccauuugug

SEQ ID NO: 371548 - RNA, 19 nt, Homo sapiens
gagaaagaacucacuuacg

SEQ ID NO: 371549 - RNA, 19 nt, Homo sapiens
ucuuggugcuuccauaugu

SEQ ID NO: 371550 - RNA, 19 nt, Homo sapiens
gcaagaaugaggagaaacc

SEQ ID NO: 371551 - RNA, 19 nt, Homo sapiens
gaaugcugucuauuucaga

SEQ ID NO: 371552 - RNA, 19 nt, Homo sapiens
gggcucaguggauccauug

SEQ ID NO: 371553 - RNA, 19 nt, Homo sapiens
gggaaaagucuugugauuu

SEQ ID NO: 371554 - RNA, 19 nt, Homo sapiens
cccagauacuuucuuucaa

SEQ ID NO: 371555 - RNA, 19 nt, Homo sapiens
agaggaaagcuacgacaug

SEQ ID NO: 371556 - RNA, 19 nt, Homo sapiens
aggagaaaccugugcaaau

SEQ ID NO: 371557 - RNA, 19 nt, Homo sapiens
ucagcaagaaugaggagaa

SEQ ID NO: 371558 - RNA, 19 nt, Homo sapiens
ggauggacaguuugacaag

SEQ ID NO: 371559 - RNA, 19 nt, Homo sapiens
ccguagagaaguccagaaa

SEQ ID NO: 371560 - RNA, 19 nt, Homo sapiens
cgagaaguucguagaaugg

SEQ ID NO: 371561 - RNA, 19 nt, Homo sapiens
gagaacgguggagaaagaa

SEQ ID NO: 371562 - RNA, 19 nt, Homo sapiens
uguuuaaagucagcaagaa

SEQ ID NO: 371563 - RNA, 19 nt, Homo sapiens
gaaagaccaacgggauucu

SEQ ID NO: 371564 - RNA, 19 nt, Homo sapiens
gagaaguucguagaaugga

SEQ ID NO: 371565 - RNA, 19 nt, Homo sapiens
gcaaccugggcaugacuga

SEQ ID NO: 371566 - RNA, 19 nt, Homo sapiens
gaaaccugugcaaaugaug

SEQ ID NO: 371567 - RNA, 19 nt, Homo sapiens
gaggagcuugacuuuauca

SEQ ID NO: 371568 - RNA, 19 nt, Homo sapiens
aaacaaacccugaagagua

SEQ ID NO: 371569 - RNA, 19 nt, Homo sapiens
ugaaaucucuagccucuuu

SEQ ID NO: 371570 - RNA, 19 nt, Homo sapiens
gaaugccucugaaauugaa

SEQ ID NO: 371571 - RNA, 19 nt, Homo sapiens
uagaaaggcuuccagaugu

SEQ ID NO: 371572 - RNA, 19 nt, Homo sapiens
uaagaaugccucugaaauu

SEQ ID NO: 371573 - RNA, 19 nt, Homo sapiens
gcugaaaguucuuggcauu

SEQ ID NO: 371574 - RNA, 19 nt, Homo sapiens
gaucaucgccucccugguu

SEQ ID NO: 371575 - RNA, 19 nt, Homo sapiens
guucacagcuguagcacaa

SEQ ID NO: 371576 - RNA, 19 nt, Homo sapiens
gaacuguuaccuagguuaa

SEQ ID NO: 371577 - RNA, 19 nt, Homo sapiens
gaauaaagacauugugaca

SEQ ID NO: 371578 - RNA, 19 nt, Homo sapiens
gaacagacucgaugcaagu

SEQ ID NO: 371579 - RNA, 19 nt, Homo sapiens
uuacugacauguuugauuc

SEQ ID NO: 371580 - RNA, 19 nt, Homo sapiens
uggcauuacugacauguuu

SEQ ID NO: 371581 - RNA, 19 nt, Homo sapiens
aagaaugccucugaaauug

SEQ ID NO: 371582 - RNA, 19 nt, Homo sapiens
gaagauggaaccaaagcuu

SEQ ID NO: 371583 - RNA, 19 nt, Homo sapiens
ccagggauaugauugacaa

SEQ ID NO: 371584 - RNA, 19 nt, Homo sapiens
ugaaggagccgcugaaagu

SEQ ID NO: 371585 - RNA, 19 nt, Homo sapiens
ggucuguacuccuuggauu

SEQ ID NO: 371586 - RNA, 19 nt, Homo sapiens
ggaacacuguacugaggaa

SEQ ID NO: 371587 - RNA, 19 nt, Homo sapiens
aacaaacccugaagaguau

SEQ ID NO: 371588 - RNA, 19 nt, Homo sapiens
cagugaagauggaaccaaa

SEQ ID NO: 371589 - RNA, 19 nt, Homo sapiens
gaaaccagggauaugauug

SEQ ID NO: 371590 - RNA, 19 nt, Homo sapiens
uagaaacggugaaaucucu

SEQ ID NO: 371591 - RNA, 19 nt, Homo sapiens
ccauguuucucauaucuug

SEQ ID NO: 371592 - RNA, 19 nt, Homo sapiens
cuacuggucuguacuccuu

SEQ ID NO: 371593 - RNA, 19 nt, Homo sapiens
auaaagacauugugacagu

SEQ ID NO: 371594 - RNA, 19 nt, Homo sapiens
gauaaacaaacccugaaga

SEQ ID NO: 371595 - RNA, 19 nt, Homo sapiens
ugauugcacugccgacuga

SEQ ID NO: 371596 - RNA, 19 nt, Homo sapiens
ugaagucagugaagaugga

SEQ ID NO: 371597 - RNA, 19 nt, Homo sapiens
acacuguacugaggaauga

SEQ ID NO: 371598 - RNA, 19 nt, Homo sapiens
ccacacaucagcaccaaga

SEQ ID NO: 371599 - RNA, 19 nt, Homo sapiens
ucaagggucuguggaaauc

SEQ ID NO: 371600 - RNA, 19 nt, Homo sapiens
ccacuucaauccucugucu

SEQ ID NO: 371601 - RNA, 19 nt, Homo sapiens
gaaaguucuuggcauuacu

SEQ ID NO: 371602 - RNA, 19 nt, Homo sapiens
gaaggagccgcugaaaguu

SEQ ID NO: 371603 - RNA, 19 nt, Homo sapiens
gacgggaaauccuaucaag

SEQ ID NO: 371604 - RNA, 19 nt, Homo sapiens
cuacuuugcuacgaagaaa

SEQ ID NO: 371605 - RNA, 19 nt, Homo sapiens
aaagaaaccaugcaaagca

SEQ ID NO: 371606 - RNA, 19 nt, Homo sapiens
ccaagagggugcaggugau

SEQ ID NO: 371607 - RNA, 19 nt, Homo sapiens
ccaaugauuuaugguacaa

SEQ ID NO: 371608 - RNA, 19 nt, Homo sapiens
gguccggaaugugaacuuu

SEQ ID NO: 371609 - RNA, 19 nt, Homo sapiens
gccaucgucuccaagaaga

SEQ ID NO: 371610 - RNA, 19 nt, Homo sapiens
acugaggaaugaauagaaa

SEQ ID NO: 371611 - RNA, 19 nt, Homo sapiens
aagaaaccaugcaaagcaa

SEQ ID NO: 371612 - RNA, 19 nt, Homo sapiens
gaagaauaaagacauugug

SEQ ID NO: 371613 - RNA, 19 nt, Homo sapiens
uccaaagucuugauagcaa

SEQ ID NO: 371614 - RNA, 19 nt, Homo sapiens
cgggaaauccuaucaagug

SEQ ID NO: 371615 - RNA, 19 nt, Homo sapiens
aaauugaagucagugaaga

SEQ ID NO: 371616 - RNA, 19 nt, Homo sapiens
ccaagaagaauaaagacau

SEQ ID NO: 371617 - RNA, 19 nt, Homo sapiens
aaacuccugucuugcuaga

SEQ ID NO: 371618 - RNA, 19 nt, Homo sapiens
ucucuagccucuuuguguu

SEQ ID NO: 371619 - RNA, 19 nt, Homo sapiens
cagacucgaugcaaguguu

SEQ ID NO: 371620 - RNA, 19 nt, Homo sapiens
gcauuacugacauguuuga

SEQ ID NO: 371621 - RNA, 19 nt, Homo sapiens
ucaacgcaguguauuucaa

SEQ ID NO: 371622 - RNA, 19 nt, Homo sapiens
gaaugugaacuuugaggau

SEQ ID NO: 371623 - RNA, 19 nt, Homo sapiens
gcaacaacugcaauucuca

SEQ ID NO: 371624 - RNA, 19 nt, Homo sapiens
ugaaaguucuuggcauuac

SEQ ID NO: 371625 - RNA, 19 nt, Homo sapiens
ucauugaacugcccuacca

SEQ ID NO: 371626 - RNA, 19 nt, Homo sapiens
guuaagaaugccucugaaa

SEQ ID NO: 371627 - RNA, 19 nt, Homo sapiens
ugaagucgaggccucauga

SEQ ID NO: 371628 - RNA, 19 nt, Homo sapiens
auagaaaggcuuccagaug

SEQ ID NO: 371629 - RNA, 19 nt, Homo sapiens
aaaccagggauaugauuga

SEQ ID NO: 371630 - RNA, 19 nt, Homo sapiens
cgaugcaaguguuucuguu

SEQ ID NO: 371631 - RNA, 19 nt, Homo sapiens
acaaggccaucgucuccaa

SEQ ID NO: 371632 - RNA, 19 nt, Homo sapiens
gaaauugaagugccuuuug

SEQ ID NO: 371633 - RNA, 19 nt, Homo sapiens
caucugcucccacuucaau

SEQ ID NO: 371634 - RNA, 19 nt, Homo sapiens
uuaagaaugccucugaaau

SEQ ID NO: 371635 - RNA, 19 nt, Homo sapiens
ggguagaaacggugaaauc

SEQ ID NO: 371636 - RNA, 19 nt, Homo sapiens
ccagaugucuaaaagauuc

SEQ ID NO: 371637 - RNA, 19 nt, Homo sapiens
guacugaggaaugaauaga

SEQ ID NO: 371638 - RNA, 19 nt, Homo sapiens
caucagcaccaagaccaua

SEQ ID NO: 371639 - RNA, 19 nt, Homo sapiens
uccggaaugugaacuuuga

SEQ ID NO: 371640 - RNA, 19 nt, Homo sapiens
uuacaaggaacaaagaugu

SEQ ID NO: 371641 - RNA, 19 nt, Homo sapiens
ucgccucccugguuuauag

SEQ ID NO: 371642 - RNA, 19 nt, Homo sapiens
caucaaugcauggguuaaa

SEQ ID NO: 371643 - RNA, 19 nt, Homo sapiens
aagauguguuccaguguga

SEQ ID NO: 371644 - RNA, 19 nt, Homo sapiens
gaaacggugaaaucucuag

SEQ ID NO: 371645 - RNA, 19 nt, Homo sapiens
uaaacaaacccugaagagu

SEQ ID NO: 371646 - RNA, 19 nt, Homo sapiens
caaguucacagcuguagca

SEQ ID NO: 371647 - RNA, 19 nt, Homo sapiens
gccaucaucccacacauca

SEQ ID NO: 371648 - RNA, 19 nt, Homo sapiens
gauuuaugguacaacuuca

SEQ ID NO: 371649 - RNA, 19 nt, Homo sapiens
gguagaaacggugaaaucu

SEQ ID NO: 371650 - RNA, 19 nt, Homo sapiens
gggagguauuggagggaaa

SEQ ID NO: 371651 - RNA, 19 nt, Homo sapiens
caaaacuaguucuuaggaa

SEQ ID NO: 371652 - RNA, 19 nt, Homo sapiens
ucacagcuguagcacaaac

SEQ ID NO: 371653 - RNA, 19 nt, Homo sapiens
ggauccagguuuucaauca

SEQ ID NO: 371654 - RNA, 19 nt, Homo sapiens
caacgcaguguauuucaag

SEQ ID NO: 371655 - RNA, 19 nt, Homo sapiens
gaugcaaguguuucuguuc

SEQ ID NO: 371656 - RNA, 19 nt, Homo sapiens
caaaagaaaccaugcaaag

SEQ ID NO: 371657 - RNA, 19 nt, Homo sapiens
cagauaaacaaacccugaa

SEQ ID NO: 371658 - RNA, 19 nt, Homo sapiens
guucuuggcauuacugaca

SEQ ID NO: 371659 - RNA, 19 nt, Homo sapiens
uaugguacaacuucauuga

SEQ ID NO: 371660 - RNA, 19 nt, Homo sapiens
agaaaggcuuccagauguc

SEQ ID NO: 371661 - RNA, 19 nt, Homo sapiens
cggcguaaauggaguuggu

SEQ ID NO: 371662 - RNA, 19 nt, Homo sapiens
ugugagguccggaauguga

SEQ ID NO: 371663 - RNA, 19 nt, Homo sapiens
ucuccaagaagaauaaaga

SEQ ID NO: 371664 - RNA, 19 nt, Homo sapiens
agaaugccucugaaauuga

SEQ ID NO: 371665 - RNA, 19 nt, Homo sapiens
guaaauggaguugguaaaa

SEQ ID NO: 371666 - RNA, 19 nt, Homo sapiens
uuaaucagugugacagaaa

SEQ ID NO: 371667 - RNA, 19 nt, Homo sapiens
guugaguauuugcuguuug

SEQ ID NO: 371668 - RNA, 19 nt, Homo sapiens
gcaggaagcauauaaauga

SEQ ID NO: 371669 - RNA, 19 nt, Homo sapiens
gaaaguggaaugagcaauu

SEQ ID NO: 371670 - RNA, 19 nt, Homo sapiens
ggaggagaguuaugacuug

SEQ ID NO: 371671 - RNA, 19 nt, Homo sapiens
gaagagugcaggaagcaua

SEQ ID NO: 371672 - RNA, 19 nt, Homo sapiens
gaccuucucugauggauga

SEQ ID NO: 371673 - RNA, 19 nt, Homo sapiens
uaauuaacauucccuguga

SEQ ID NO: 371674 - RNA, 19 nt, Homo sapiens
ggacaacucaagaaacgua

SEQ ID NO: 371675 - RNA, 19 nt, Homo sapiens
gcuuagaacugccaacaga

SEQ ID NO: 371676 - RNA, 19 nt, Homo sapiens
gcacuuacauaugagaaau

SEQ ID NO: 371677 - RNA, 19 nt, Homo sapiens
gaagaggacaacucaagaa

SEQ ID NO: 371678 - RNA, 19 nt, Homo sapiens
caacagacucuuuggagaa

SEQ ID NO: 371679 - RNA, 19 nt, Homo sapiens
caaaggaggaauagucaaa

SEQ ID NO: 371680 - RNA, 19 nt, Homo sapiens
cuaccuaucuugccuuaau

SEQ ID NO: 371681 - RNA, 19 nt, Homo sapiens
cagguucucuucuccguaa

SEQ ID NO: 371682 - RNA, 19 nt, Homo sapiens
aaaguggaaugagcaauuu

SEQ ID NO: 371683 - RNA, 19 nt, Homo sapiens
cagagaagacugaagguaa

SEQ ID NO: 371684 - RNA, 19 nt, Homo sapiens
aggcagagcuggaggaguu

SEQ ID NO: 371685 - RNA, 19 nt, Homo sapiens
cagugcagaugauguuuaa

SEQ ID NO: 371686 - RNA, 19 nt, Homo sapiens
gccaucagcuuauuuaaaa

SEQ ID NO: 371687 - RNA, 19 nt, Homo sapiens
ucaccgagguuuccaguca

SEQ ID NO: 371688 - RNA, 19 nt, Homo sapiens
auacaaagacggagauauu

SEQ ID NO: 371689 - RNA, 19 nt, Homo sapiens
guuaugacuuggagccuuu

SEQ ID NO: 371690 - RNA, 19 nt, Homo sapiens
gaggacaacucaagaaacg

SEQ ID NO: 371691 - RNA, 19 nt, Homo sapiens
uaacauucccugugaccua

SEQ ID NO: 371692 - RNA, 19 nt, Homo sapiens
cuucgaagauuaggaauga

SEQ ID NO: 371693 - RNA, 19 nt, Homo sapiens
ggaagaggacaacucaaga

SEQ ID NO: 371694 - RNA, 19 nt, Homo sapiens
gaagacugaagguaagauu

SEQ ID NO: 371695 - RNA, 19 nt, Homo sapiens
gcagagaagacugaaggua

SEQ ID NO: 371696 - RNA, 19 nt, Homo sapiens
uaggaaugaucgaugcuuu

SEQ ID NO: 371697 - RNA, 19 nt, Homo sapiens
ggaguuguccuuugcugaa

SEQ ID NO: 371698 - RNA, 19 nt, Homo sapiens
aaagaauacugucagaagu

SEQ ID NO: 371699 - RNA, 19 nt, Homo sapiens
uucaaagccuggacaaauu

SEQ ID NO: 371700 - RNA, 19 nt, Homo sapiens
gaagcuaaguuuaaaaugg

SEQ ID NO: 371701 - RNA, 19 nt, Homo sapiens
uaaagaauacugucagaag

SEQ ID NO: 371702 - RNA, 19 nt, Homo sapiens
gcagaauggagccaagauu

SEQ ID NO: 371703 - RNA, 19 nt, Homo sapiens
gagcugagcauggucauuc

SEQ ID NO: 371704 - RNA, 19 nt, Homo sapiens
acucaguacuugcuuagaa

SEQ ID NO: 371705 - RNA, 19 nt, Homo sapiens
gagaaaagacgugugauuu

SEQ ID NO: 371706 - RNA, 19 nt, Homo sapiens
cccaggcacuuuguuuaua

SEQ ID NO: 371707 - RNA, 19 nt, Homo sapiens
gaucgaugcuuuugacgaa

SEQ ID NO: 371708 - RNA, 19 nt, Homo sapiens
gccuuuccuucgaagauua

SEQ ID NO: 371709 - RNA, 19 nt, Homo sapiens
uaaagcuggaggagaguua

SEQ ID NO: 371710 - RNA, 19 nt, Homo sapiens
ggaaugcucuuuaaaacca

SEQ ID NO: 371711 - RNA, 19 nt, Homo sapiens
ggagauauucaccgagguu

SEQ ID NO: 371712 - RNA, 19 nt, Homo sapiens
gcagaugauguuuaaggaa

SEQ ID NO: 371713 - RNA, 19 nt, Homo sapiens
caaggggaaugcucuuuaa

SEQ ID NO: 371714 - RNA, 19 nt, Homo sapiens
gaugaccucugugaagcaa

SEQ ID NO: 371715 - RNA, 19 nt, Homo sapiens
guauucuucucucccauga

SEQ ID NO: 371716 - RNA, 19 nt, Homo sapiens
caucuacaaaggaggaaua

SEQ ID NO: 371717 - RNA, 19 nt, Homo sapiens
ugauuuccuuccagacuuu

SEQ ID NO: 371718 - RNA, 19 nt, Homo sapiens
ggcacucaguacuugcuua

SEQ ID NO: 371719 - RNA, 19 nt, Homo sapiens
gagaagaaugugccucugu

SEQ ID NO: 371720 - RNA, 19 nt, Homo sapiens
ggagcugcccuauguggaa

SEQ ID NO: 371721 - RNA, 19 nt, Homo sapiens
gaaugagcaauuugacaga

SEQ ID NO: 371722 - RNA, 19 nt, Homo sapiens
agagaagacugaagguaag

SEQ ID NO: 371723 - RNA, 19 nt, Homo sapiens
cuacaaaggaggaauaguc

SEQ ID NO: 371724 - RNA, 19 nt, Homo sapiens
aaagacgugugauuuccuu

SEQ ID NO: 371725 - RNA, 19 nt, Homo sapiens
ucagugaaguuaacagaac

SEQ ID NO: 371726 - RNA, 19 nt, Homo sapiens
caaagcuaguccuugugaa

SEQ ID NO: 371727 - RNA, 19 nt, Homo sapiens
gggaagaggacaacucaag

SEQ ID NO: 371728 - RNA, 19 nt, Homo sapiens
ugaccucugugaagcaaau

SEQ ID NO: 371729 - RNA, 19 nt, Homo sapiens
caacucaagaaacguauuc

SEQ ID NO: 371730 - RNA, 19 nt, Homo sapiens
ccaggcacuuuguuuauac

SEQ ID NO: 371731 - RNA, 19 nt, Homo sapiens
guacauacccuccuuuccu

SEQ ID NO: 371732 - RNA, 19 nt, Homo sapiens
ucugauggaugaccucugu

SEQ ID NO: 371733 - RNA, 19 nt, Homo sapiens
gagugcaggaagcauauaa

SEQ ID NO: 371734 - RNA, 19 nt, Homo sapiens
gugauuuccuuccagacuu

SEQ ID NO: 371735 - RNA, 19 nt, Homo sapiens
uacauacccuccuuuccuu

SEQ ID NO: 371736 - RNA, 19 nt, Homo sapiens
gcagaccacccuuuucuuu

SEQ ID NO: 371737 - RNA, 19 nt, Homo sapiens
ggacaaauucagaaaaguu

SEQ ID NO: 371738 - RNA, 19 nt, Homo sapiens
guuuaaggaagcuaaguuu

SEQ ID NO: 371739 - RNA, 19 nt, Homo sapiens
gcaauuugacagaaaguac

SEQ ID NO: 371740 - RNA, 19 nt, Homo sapiens
agaauacugucagaaguuc

SEQ ID NO: 371741 - RNA, 19 nt, Homo sapiens
agacagugcagaugauguu

SEQ ID NO: 371742 - RNA, 19 nt, Homo sapiens
cuuccagacuuuaaagaau

SEQ ID NO: 371743 - RNA, 19 nt, Homo sapiens
aacagacucuuuggagaaa

SEQ ID NO: 371744 - RNA, 19 nt, Homo sapiens
gcacucaguacuugcuuag

SEQ ID NO: 371745 - RNA, 19 nt, Homo sapiens
ccaacugcaucuuguucug

SEQ ID NO: 371746 - RNA, 19 nt, Homo sapiens
ggagaaaagacgugugauu

SEQ ID NO: 371747 - RNA, 19 nt, Homo sapiens
gucccaggcacuuuguuua

SEQ ID NO: 371748 - RNA, 19 nt, Homo sapiens
agacugaagguaagauuuc

SEQ ID NO: 371749 - RNA, 19 nt, Homo sapiens
ugaagcaaauggcacuuuu

SEQ ID NO: 371750 - RNA, 19 nt, Homo sapiens
gugcaggaagcauauaaau

SEQ ID NO: 371751 - RNA, 19 nt, Homo sapiens
ucaaagccuggacaaauuc

SEQ ID NO: 371752 - RNA, 19 nt, Homo sapiens
uccuggagcugcccuaugu

SEQ ID NO: 371753 - RNA, 19 nt, Homo sapiens
acagugcagaugauguuua

SEQ ID NO: 371754 - RNA, 19 nt, Homo sapiens
aagaauacugucagaaguu

SEQ ID NO: 371755 - RNA, 19 nt, Homo sapiens
uaccuaucuugccuuaauu

SEQ ID NO: 371756 - RNA, 19 nt, Homo sapiens
cgaagccaaggcagacuuu

SEQ ID NO: 371757 - RNA, 19 nt, Homo sapiens
gcacugcagcccagauguc

SEQ ID NO: 371758 - RNA, 19 nt, Homo sapiens
aagaggagcugagcauggu

SEQ ID NO: 371759 - RNA, 19 nt, Homo sapiens
aaugagcaauuugacagaa

SEQ ID NO: 371760 - RNA, 19 nt, Homo sapiens
gagaagacugaagguaaga

SEQ ID NO: 371761 - RNA, 19 nt, Homo sapiens
acaaagacggagauauuca

SEQ ID NO: 371762 - RNA, 19 nt, Homo sapiens
aagaggacaacucaagaaa

SEQ ID NO: 371763 - RNA, 19 nt, Homo sapiens
ugagcaauuugacagaaag

SEQ ID NO: 371764 - RNA, 19 nt, Homo sapiens
gagauauucaccgagguuu

SEQ ID NO: 371765 - RNA, 19 nt, Homo sapiens
gagccuuuccuucgaagau

SEQ ID NO: 371766 - RNA, 19 nt, Homo sapiens
agaaugugccucuguccaa

SEQ ID NO: 371767 - RNA, 19 nt, Homo sapiens
aaagcuaguccuugugaau

SEQ ID NO: 371768 - RNA, 19 nt, Homo sapiens
guaaugagcuagaaacuaa

SEQ ID NO: 371769 - RNA, 19 nt, Homo sapiens
gaacaugagugacaguuug

SEQ ID NO: 371770 - RNA, 19 nt, Homo sapiens
gaucacaucuuucuuuaug

SEQ ID NO: 371771 - RNA, 19 nt, Homo sapiens
gcagauacuuauugcauuu

SEQ ID NO: 371772 - RNA, 19 nt, Homo sapiens
gcaaccagauguacauauu

SEQ ID NO: 371773 - RNA, 19 nt, Homo sapiens
gggaucacaucuuucuuua

SEQ ID NO: 371774 - RNA, 19 nt, Homo sapiens
gaaaguguucuaugcauuu

SEQ ID NO: 371775 - RNA, 19 nt, Homo sapiens
gcuagaaacuaaaguacaa

SEQ ID NO: 371776 - RNA, 19 nt, Homo sapiens
ggaaaugcccuuuaaaaua

SEQ ID NO: 371777 - RNA, 19 nt, Homo sapiens
gauagauaaugcugaguaa

SEQ ID NO: 371778 - RNA, 19 nt, Homo sapiens
ccuuaaagcucacuucaaa

SEQ ID NO: 371779 - RNA, 19 nt, Homo sapiens
gguaauaaauggugcuaga

SEQ ID NO: 371780 - RNA, 19 nt, Homo sapiens
gaugagggcagauuccuua

SEQ ID NO: 371781 - RNA, 19 nt, Homo sapiens
gaagugguaucucauugug

SEQ ID NO: 371782 - RNA, 19 nt, Homo sapiens
ggacagagccauccuccuu

SEQ ID NO: 371783 - RNA, 19 nt, Homo sapiens
gaagaguacugagguugaa

SEQ ID NO: 371784 - RNA, 19 nt, Homo sapiens
uaucagagcugcagaagag

SEQ ID NO: 371785 - RNA, 19 nt, Homo sapiens
guacauauuugaacucucu

SEQ ID NO: 371786 - RNA, 19 nt, Homo sapiens
cauaugucuuugccuauua

SEQ ID NO: 371787 - RNA, 19 nt, Homo sapiens
ucaagugccuaguucagua

SEQ ID NO: 371788 - RNA, 19 nt, Homo sapiens
ccacagcaguugaaccauu

SEQ ID NO: 371789 - RNA, 19 nt, Homo sapiens
ccaccaaucugcuuucugu

SEQ ID NO: 371790 - RNA, 19 nt, Homo sapiens
augauucccuguuguauua

SEQ ID NO: 371791 - RNA, 19 nt, Homo sapiens
guacugagguugaaguucu

SEQ ID NO: 371792 - RNA, 19 nt, Homo sapiens
gagguaaacuucacauaac

SEQ ID NO: 371793 - RNA, 19 nt, Homo sapiens
ggaccaagccagacuguau

SEQ ID NO: 371794 - RNA, 19 nt, Homo sapiens
gaugaaagacauuuguuug

SEQ ID NO: 371795 - RNA, 19 nt, Homo sapiens
uaaccaccaccuuuauuua

SEQ ID NO: 371796 - RNA, 19 nt, Homo sapiens
gaauguuuguguaccugua

SEQ ID NO: 371797 - RNA, 19 nt, Homo sapiens
aagauacugugucaagaua

SEQ ID NO: 371798 - RNA, 19 nt, Homo sapiens
gaaugaaccguuugacgaa

SEQ ID NO: 371799 - RNA, 19 nt, Homo sapiens
gggcacuucuuucguggua

SEQ ID NO: 371800 - RNA, 19 nt, Homo sapiens
gcagauuccuuaccugucu

SEQ ID NO: 371801 - RNA, 19 nt, Homo sapiens
acaagaggauuaugacaug

SEQ ID NO: 371802 - RNA, 19 nt, Homo sapiens
gcccagcccuaguucagua

SEQ ID NO: 371803 - RNA, 19 nt, Homo sapiens
ccggguagcucaauugaug

SEQ ID NO: 371804 - RNA, 19 nt, Homo sapiens
cgagcuauguaacuuauau

SEQ ID NO: 371805 - RNA, 19 nt, Homo sapiens
caagcaaaguucuucuaga

SEQ ID NO: 371806 - RNA, 19 nt, Homo sapiens
aaaguggaaugaaccguuu

SEQ ID NO: 371807 - RNA, 19 nt, Homo sapiens
gaacugcugggucauaugu

SEQ ID NO: 371808 - RNA, 19 nt, Homo sapiens
cgaauuguaugagaccuuu

SEQ ID NO: 371809 - RNA, 19 nt, Homo sapiens
ugagguaaacuucacauaa

SEQ ID NO: 371810 - RNA, 19 nt, Homo sapiens
gcaguaauaaguaaguuga

SEQ ID NO: 371811 - RNA, 19 nt, Homo sapiens
ugaaaguguucuaugcauu

SEQ ID NO: 371812 - RNA, 19 nt, Homo sapiens
ggugugaagugguaucuca

SEQ ID NO: 371813 - RNA, 19 nt, Homo sapiens
gaugucaagugccuaguuc

SEQ ID NO: 371814 - RNA, 19 nt, Homo sapiens
gacuuuggguuguuucuga

SEQ ID NO: 371815 - RNA, 19 nt, Homo sapiens
uagcauguaucaacacuuc

SEQ ID NO: 371816 - RNA, 19 nt, Homo sapiens
cagauacucuccauuccuu

SEQ ID NO: 371817 - RNA, 19 nt, Homo sapiens
gcaaagaugagggcagauu

SEQ ID NO: 371818 - RNA, 19 nt, Homo sapiens
aaacacagaggaagacauu

SEQ ID NO: 371819 - RNA, 19 nt, Homo sapiens
caccacacccggcuaauuu

SEQ ID NO: 371820 - RNA, 19 nt, Homo sapiens
uaaagauacugugucaaga

SEQ ID NO: 371821 - RNA, 19 nt, Homo sapiens
ugaccagguuggacuguuu

SEQ ID NO: 371822 - RNA, 19 nt, Homo sapiens
gcagaagaguccaggaaac

SEQ ID NO: 371823 - RNA, 19 nt, Homo sapiens
gcucuugaauuuccucauc

SEQ ID NO: 371824 - RNA, 19 nt, Homo sapiens
ccagucccuuugauagaua

SEQ ID NO: 371825 - RNA, 19 nt, Homo sapiens
gggacucugucuuacauau

SEQ ID NO: 371826 - RNA, 19 nt, Homo sapiens
ugaacucucuuuguacuug

SEQ ID NO: 371827 - RNA, 19 nt, Homo sapiens
ccaaagugcugggauuaca

SEQ ID NO: 371828 - RNA, 19 nt, Homo sapiens
caguuccucucaacguuua

SEQ ID NO: 371829 - RNA, 19 nt, Homo sapiens
caccagcaauguaugagaa

SEQ ID NO: 371830 - RNA, 19 nt, Homo sapiens
gguuggauaucacugaguu

SEQ ID NO: 371831 - RNA, 19 nt, Homo sapiens
ugucugcccucaugauuug

SEQ ID NO: 371832 - RNA, 19 nt, Homo sapiens
ucaaugccaucuacuucaa

SEQ ID NO: 371833 - RNA, 19 nt, Homo sapiens
gugaagugguaucucauug

SEQ ID NO: 371834 - RNA, 19 nt, Homo sapiens
gaaacauacacaagggaaa

SEQ ID NO: 371835 - RNA, 19 nt, Homo sapiens
gauggacuuuggguuguuu

SEQ ID NO: 371836 - RNA, 19 nt, Homo sapiens
aaccagauguacauauuug

SEQ ID NO: 371837 - RNA, 19 nt, Homo sapiens
caaccagauguacauauuu

SEQ ID NO: 371838 - RNA, 19 nt, Homo sapiens
uaaauggugcuagauauug

SEQ ID NO: 371839 - RNA, 19 nt, Homo sapiens
gcgucgagcugcuuuguag

SEQ ID NO: 371840 - RNA, 19 nt, Homo sapiens
aauccugucuucaauucua

SEQ ID NO: 371841 - RNA, 19 nt, Homo sapiens
guugaaccauuccacauuc

SEQ ID NO: 371842 - RNA, 19 nt, Homo sapiens
guaccuguauuuguuugaa

SEQ ID NO: 371843 - RNA, 19 nt, Homo sapiens
gugcugcuaugaauguuug

SEQ ID NO: 371844 - RNA, 19 nt, Homo sapiens
uggcuucuuucacuuagua

SEQ ID NO: 371845 - RNA, 19 nt, Homo sapiens
cauagugcaguaauaagua

SEQ ID NO: 371846 - RNA, 19 nt, Homo sapiens
gcacuucuuucgugguagu

SEQ ID NO: 371847 - RNA, 19 nt, Homo sapiens
cccaggcacugucuuuaaa

SEQ ID NO: 371848 - RNA, 19 nt, Homo sapiens
gaggaggaaugaaaacaaa

SEQ ID NO: 371849 - RNA, 19 nt, Homo sapiens
caugagugacaguuuguua

SEQ ID NO: 371850 - RNA, 19 nt, Homo sapiens
gcaagcaaaguucuucuag

SEQ ID NO: 371851 - RNA, 19 nt, Homo sapiens
acugcugggucauauguua

SEQ ID NO: 371852 - RNA, 19 nt, Homo sapiens
uauacgagcuauguaacuu

SEQ ID NO: 371853 - RNA, 19 nt, Homo sapiens
aaucugugcuucggcauuu

SEQ ID NO: 371854 - RNA, 19 nt, Homo sapiens
ccaaagugcuaggauuaca

SEQ ID NO: 371855 - RNA, 19 nt, Homo sapiens
gagaugaaagacauuuguu

SEQ ID NO: 371856 - RNA, 19 nt, Homo sapiens
ucucuuggguauauaucua

SEQ ID NO: 371857 - RNA, 19 nt, Homo sapiens
ucaccaagcaugcaccaaa

SEQ ID NO: 371858 - RNA, 19 nt, Homo sapiens
gcccaggcacugucuuuaa

SEQ ID NO: 371859 - RNA, 19 nt, Homo sapiens
caaaggccagugcagauga

SEQ ID NO: 371860 - RNA, 19 nt, Homo sapiens
gcaaaggccagugcagaug

SEQ ID NO: 371861 - RNA, 19 nt, Homo sapiens
aaaggaaaguggaaugaac

SEQ ID NO: 371862 - RNA, 19 nt, Homo sapiens
gaagaguccaggaaacaca

SEQ ID NO: 371863 - RNA, 19 nt, Homo sapiens
ggaguguaguggcaugauc

SEQ ID NO: 371864 - RNA, 19 nt, Homo sapiens
ugauagauaaugcugagua

SEQ ID NO: 371865 - RNA, 19 nt, Homo sapiens
gcaaccaccaaucugcuuu

SEQ ID NO: 371866 - RNA, 19 nt, Homo sapiens
ccucauagugcaguaauaa

SEQ ID NO: 371867 - RNA, 19 nt, Homo sapiens
aaauuccauucaacccuua

SEQ ID NO: 371868 - RNA, 19 nt, Homo sapiens
gaaaggacaucaacucuug

SEQ ID NO: 371869 - RNA, 19 nt, Homo sapiens
ggaaauaaaugaacaaggu

SEQ ID NO: 371870 - RNA, 19 nt, Homo sapiens
gcccaacgaugacuacuua

SEQ ID NO: 371871 - RNA, 19 nt, Homo sapiens
gagcaacucggaagaaaua

SEQ ID NO: 371872 - RNA, 19 nt, Homo sapiens
caacaucaaucaaccaguu

SEQ ID NO: 371873 - RNA, 19 nt, Homo sapiens
aagcaaagcugauuucuca

SEQ ID NO: 371874 - RNA, 19 nt, Homo sapiens
gaagaaauacacucugauu

SEQ ID NO: 371875 - RNA, 19 nt, Homo sapiens
ggugaacgcccuauacuuu

SEQ ID NO: 371876 - RNA, 19 nt, Homo sapiens
ggaagcuucugaucaaauc

SEQ ID NO: 371877 - RNA, 19 nt, Homo sapiens
gcaaaccagugcaaaugau

SEQ ID NO: 371878 - RNA, 19 nt, Homo sapiens
gaagacaguuaugaucuca

SEQ ID NO: 371879 - RNA, 19 nt, Homo sapiens
gugcagacaugauggaguu

SEQ ID NO: 371880 - RNA, 19 nt, Homo sapiens
aaacgagacuacaagcaaa

SEQ ID NO: 371881 - RNA, 19 nt, Homo sapiens
cugggaacaucaauucuua

SEQ ID NO: 371882 - RNA, 19 nt, Homo sapiens
ugaacgcccuauacuuuaa

SEQ ID NO: 371883 - RNA, 19 nt, Homo sapiens
cguaugcauuucacaauaa

SEQ ID NO: 371884 - RNA, 19 nt, Homo sapiens
aacgaugacuacuuacuua

SEQ ID NO: 371885 - RNA, 19 nt, Homo sapiens
cggaagaaauacacucuga

SEQ ID NO: 371886 - RNA, 19 nt, Homo sapiens
gugcaaaugauguuuauga

SEQ ID NO: 371887 - RNA, 19 nt, Homo sapiens
gcccaggugcuucaauuua

SEQ ID NO: 371888 - RNA, 19 nt, Homo sapiens
gcagaaccucagccuguua

SEQ ID NO: 371889 - RNA, 19 nt, Homo sapiens
gaaaauggaauucaacuug

SEQ ID NO: 371890 - RNA, 19 nt, Homo sapiens
ggaagacaguuaugaucuc

SEQ ID NO: 371891 - RNA, 19 nt, Homo sapiens
aaacagccaaugcgauaua

SEQ ID NO: 371892 - RNA, 19 nt, Homo sapiens
guuaugaucucaagucaac

SEQ ID NO: 371893 - RNA, 19 nt, Homo sapiens
gugaacgcccuauacuuua

SEQ ID NO: 371894 - RNA, 19 nt, Homo sapiens
ccaaacacuuaucucagaa

SEQ ID NO: 371895 - RNA, 19 nt, Homo sapiens
cccaggugcuucaauuuaa

SEQ ID NO: 371896 - RNA, 19 nt, Homo sapiens
ggagugagauagauauacg

SEQ ID NO: 371897 - RNA, 19 nt, Homo sapiens
caucaauucuuagugcaaa

SEQ ID NO: 371898 - RNA, 19 nt, Homo sapiens
gcccuauacuuuaaaggaa

SEQ ID NO: 371899 - RNA, 19 nt, Homo sapiens
aaagacagaccgaggguaa

SEQ ID NO: 371900 - RNA, 19 nt, Homo sapiens
uguggaagcuucugaucaa

SEQ ID NO: 371901 - RNA, 19 nt, Homo sapiens
ucaggaaugucuucagcaa

SEQ ID NO: 371902 - RNA, 19 nt, Homo sapiens
gaauuagagucccauccau

SEQ ID NO: 371903 - RNA, 19 nt, Homo sapiens
uaaacgagacuacaagcaa

SEQ ID NO: 371904 - RNA, 19 nt, Homo sapiens
gaauaaacgagacuacaag

SEQ ID NO: 371905 - RNA, 19 nt, Homo sapiens
caacuuccuugaccauagu

SEQ ID NO: 371906 - RNA, 19 nt, Homo sapiens
caacgaugacuacuuacuu

SEQ ID NO: 371907 - RNA, 19 nt, Homo sapiens
uccaaacacuuaucucaga

SEQ ID NO: 371908 - RNA, 19 nt, Homo sapiens
cagacaugauggaguugua

SEQ ID NO: 371909 - RNA, 19 nt, Homo sapiens
ccuaugagaagcugaauga

SEQ ID NO: 371910 - RNA, 19 nt, Homo sapiens
gcagugggccuucaacucu

SEQ ID NO: 371911 - RNA, 19 nt, Homo sapiens
aaaggaaucugggaacauc

SEQ ID NO: 371912 - RNA, 19 nt, Homo sapiens
gaccucagccugcuuauac

SEQ ID NO: 371913 - RNA, 19 nt, Homo sapiens
gaacgcccuauacuuuaaa

SEQ ID NO: 371914 - RNA, 19 nt, Homo sapiens
ugcgauauauggagagaaa

SEQ ID NO: 371915 - RNA, 19 nt, Homo sapiens
uaaaugaacaagguacuga

SEQ ID NO: 371916 - RNA, 19 nt, Homo sapiens
ccagugcaaaugauguuua

SEQ ID NO: 371917 - RNA, 19 nt, Homo sapiens
cagaaucuccugccugaug

SEQ ID NO: 371918 - RNA, 19 nt, Homo sapiens
uaaaacagccaaugcgaua

SEQ ID NO: 371919 - RNA, 19 nt, Homo sapiens
gcagugggagugagauaga

SEQ ID NO: 371920 - RNA, 19 nt, Homo sapiens
gcaaaugauguuuaugaag

SEQ ID NO: 371921 - RNA, 19 nt, Homo sapiens
ccauuccucuucuucauca

SEQ ID NO: 371922 - RNA, 19 nt, Homo sapiens
acguaugcauuucacaaua

SEQ ID NO: 371923 - RNA, 19 nt, Homo sapiens
caaaugugacccugaaagu

SEQ ID NO: 371924 - RNA, 19 nt, Homo sapiens
ccauaaggcuuuuguggaa

SEQ ID NO: 371925 - RNA, 19 nt, Homo sapiens
agaaucuccugccugauga

SEQ ID NO: 371926 - RNA, 19 nt, Homo sapiens
gccuucaacucuacuacaa

SEQ ID NO: 371927 - RNA, 19 nt, Homo sapiens
cagugcaaaugauguuuau

SEQ ID NO: 371928 - RNA, 19 nt, Homo sapiens
ccaaagcaaagcugauuuc

SEQ ID NO: 371929 - RNA, 19 nt, Homo sapiens
aaaaggccaucaccuauga

SEQ ID NO: 371930 - RNA, 19 nt, Homo sapiens
ccaaauggcccaggugcuu

SEQ ID NO: 371931 - RNA, 19 nt, Homo sapiens
aaugugacccugaaaguga

SEQ ID NO: 371932 - RNA, 19 nt, Homo sapiens
agugaugccuucagccaaa

SEQ ID NO: 371933 - RNA, 19 nt, Homo sapiens
ugauggaguuguaugaagu

SEQ ID NO: 371934 - RNA, 19 nt, Homo sapiens
ggaaaaggccaucaccuau

SEQ ID NO: 371935 - RNA, 19 nt, Homo sapiens
caagcaaaccagugcaaau

SEQ ID NO: 371936 - RNA, 19 nt, Homo sapiens
acacuuaucucagaaaucc

SEQ ID NO: 371937 - RNA, 19 nt, Homo sapiens
aauacacucugauuuccaa

SEQ ID NO: 371938 - RNA, 19 nt, Homo sapiens
gaccagugcagacaugaug

SEQ ID NO: 371939 - RNA, 19 nt, Homo sapiens
agaauaaacgagacuacaa

SEQ ID NO: 371940 - RNA, 19 nt, Homo sapiens
ugaaucugcucaggguaaa

SEQ ID NO: 371941 - RNA, 19 nt, Homo sapiens
caaaucacccauuccucuu

SEQ ID NO: 371942 - RNA, 19 nt, Homo sapiens
agacaguuaugaucucaag

SEQ ID NO: 371943 - RNA, 19 nt, Homo sapiens
ccuugaccauaguguauuu

SEQ ID NO: 371944 - RNA, 19 nt, Homo sapiens
ccugaugacucuguggauu

SEQ ID NO: 371945 - RNA, 19 nt, Homo sapiens
aaacguaugcauuucacaa

SEQ ID NO: 371946 - RNA, 19 nt, Homo sapiens
gaaucugggaacaucaauu

SEQ ID NO: 371947 - RNA, 19 nt, Homo sapiens
cagaaccucagccuguuaa

SEQ ID NO: 371948 - RNA, 19 nt, Homo sapiens
cgaugacuacuuacuuaaa

SEQ ID NO: 371949 - RNA, 19 nt, Homo sapiens
ucugauuuccaaacacuua

SEQ ID NO: 371950 - RNA, 19 nt, Homo sapiens
acacucugauuuccaaaca

SEQ ID NO: 371951 - RNA, 19 nt, Homo sapiens
agucaacccugagcaguau

SEQ ID NO: 371952 - RNA, 19 nt, Homo sapiens
gaaaaggccaucaccuaug

SEQ ID NO: 371953 - RNA, 19 nt, Homo sapiens
cagugggccuucaacucua

SEQ ID NO: 371954 - RNA, 19 nt, Homo sapiens
ggaagaaauacacucugau

SEQ ID NO: 371955 - RNA, 19 nt, Homo sapiens
uggcccaggugcuucaauu

SEQ ID NO: 371956 - RNA, 19 nt, Homo sapiens
caaacacuuaucucagaaa

SEQ ID NO: 371957 - RNA, 19 nt, Homo sapiens
ugaacaagguacugaagcu

SEQ ID NO: 371958 - RNA, 19 nt, Homo sapiens
gcuacaccuucccaaguuc

SEQ ID NO: 371959 - RNA, 19 nt, Homo sapiens
gaccagggagucaaaugug

SEQ ID NO: 371960 - RNA, 19 nt, Homo sapiens
caguuaugaucucaaguca

SEQ ID NO: 371961 - RNA, 19 nt, Homo sapiens
ggccaucaccuaugagaag

SEQ ID NO: 371962 - RNA, 19 nt, Homo sapiens
caaaccagugcaaaugaug

SEQ ID NO: 371963 - RNA, 19 nt, Homo sapiens
gcaaaacaccacagaaaag

SEQ ID NO: 371964 - RNA, 19 nt, Homo sapiens
uuaaaggaaucugggaaca

SEQ ID NO: 371965 - RNA, 19 nt, Homo sapiens
gccaaagcaaagcugauuu

SEQ ID NO: 371966 - RNA, 19 nt, Homo sapiens
agacauuaaugggcuggaa

SEQ ID NO: 371967 - RNA, 19 nt, Homo sapiens
aagcaaaccagugcaaaug

SEQ ID NO: 371968 - RNA, 19 nt, Homo sapiens
caaacaaucuggugaaaga

SEQ ID NO: 371969 - RNA, 19 nt, Homo sapiens
ugacaggccucucugauaa

SEQ ID NO: 371970 - RNA, 19 nt, Homo sapiens
gcuugaaacuguuacaaua

SEQ ID NO: 371971 - RNA, 19 nt, Homo sapiens
gaacacaaguggacaugau

SEQ ID NO: 371972 - RNA, 19 nt, Homo sapiens
caaggaauguuaucaguau

SEQ ID NO: 371973 - RNA, 19 nt, Homo sapiens
caggagaacugguacaauu

SEQ ID NO: 371974 - RNA, 19 nt, Homo sapiens
ccaaggaucuacccagaaa

SEQ ID NO: 371975 - RNA, 19 nt, Homo sapiens
ggaaugauugcaauuagua

SEQ ID NO: 371976 - RNA, 19 nt, Homo sapiens
caauauggcuuuccuugga

SEQ ID NO: 371977 - RNA, 19 nt, Homo sapiens
auaaguggguggagaauaa

SEQ ID NO: 371978 - RNA, 19 nt, Homo sapiens
aaagagagccaauauguga

SEQ ID NO: 371979 - RNA, 19 nt, Homo sapiens
gaaagugaaguccaaauuc

SEQ ID NO: 371980 - RNA, 19 nt, Homo sapiens
gagaauaacacaaacaauc

SEQ ID NO: 371981 - RNA, 19 nt, Homo sapiens
uuugaaggcucuuggaaua

SEQ ID NO: 371982 - RNA, 19 nt, Homo sapiens
aagcacagcugguugaaga

SEQ ID NO: 371983 - RNA, 19 nt, Homo sapiens
caaugaagcuggugguauc

SEQ ID NO: 371984 - RNA, 19 nt, Homo sapiens
ccaacuacaucaauaagug

SEQ ID NO: 371985 - RNA, 19 nt, Homo sapiens
ccaaagcaauucacaaguc

SEQ ID NO: 371986 - RNA, 19 nt, Homo sapiens
gagccaauaugugaugaaa

SEQ ID NO: 371987 - RNA, 19 nt, Homo sapiens
gaaagaaauccgccacuca

SEQ ID NO: 371988 - RNA, 19 nt, Homo sapiens
gaacugguacaauucuauu

SEQ ID NO: 371989 - RNA, 19 nt, Homo sapiens
ggagaugaaauaagcauga

SEQ ID NO: 371990 - RNA, 19 nt, Homo sapiens
ugaaggagaugaaauaagc

SEQ ID NO: 371991 - RNA, 19 nt, Homo sapiens
ggaagccauugcugacuug

SEQ ID NO: 371992 - RNA, 19 nt, Homo sapiens
gcuguauccucaaguuauu

SEQ ID NO: 371993 - RNA, 19 nt, Homo sapiens
cuaccaaguccuagaaaua

SEQ ID NO: 371994 - RNA, 19 nt, Homo sapiens
caaacaugguaacugcuaa

SEQ ID NO: 371995 - RNA, 19 nt, Homo sapiens
agaaauaccauaugaagga

SEQ ID NO: 371996 - RNA, 19 nt, Homo sapiens
cuaaagagagccaauaugu

SEQ ID NO: 371997 - RNA, 19 nt, Homo sapiens
gaaauccgccacucaaugg

SEQ ID NO: 371998 - RNA, 19 nt, Homo sapiens
guuugcaacugguauauau

SEQ ID NO: 371999 - RNA, 19 nt, Homo sapiens
gaaguccaaauuccaauga

SEQ ID NO: 372000 - RNA, 19 nt, Homo sapiens
cuaaagaugaugaaaguga

SEQ ID NO: 372001 - RNA, 19 nt, Homo sapiens
cauuaaugcugucuauuuc

SEQ ID NO: 372002 - RNA, 19 nt, Homo sapiens
caugguaacugcuaaagag

SEQ ID NO: 372003 - RNA, 19 nt, Homo sapiens
gggcaaacucugugaagaa

SEQ ID NO: 372004 - RNA, 19 nt, Homo sapiens
cacuaaagaugaugaaagu

SEQ ID NO: 372005 - RNA, 19 nt, Homo sapiens
ccacuuaucuggcccucau

SEQ ID NO: 372006 - RNA, 19 nt, Homo sapiens
caaacucugugaagaagca

SEQ ID NO: 372007 - RNA, 19 nt, Homo sapiens
uaggauggcugugcuguau

SEQ ID NO: 372008 - RNA, 19 nt, Homo sapiens
ucaggaaugauugcaauua

SEQ ID NO: 372009 - RNA, 19 nt, Homo sapiens
acaggccucucugauaaua

SEQ ID NO: 372010 - RNA, 19 nt, Homo sapiens
gugggaggcuugaaacugu

SEQ ID NO: 372011 - RNA, 19 nt, Homo sapiens
gaaacaaugaacacaagug

SEQ ID NO: 372012 - RNA, 19 nt, Homo sapiens
gcucuuggaauaacugaaa

SEQ ID NO: 372013 - RNA, 19 nt, Homo sapiens
ugaaagugaaguccaaauu

SEQ ID NO: 372014 - RNA, 19 nt, Homo sapiens
caacugguauauauuuagg

SEQ ID NO: 372015 - RNA, 19 nt, Homo sapiens
agaaacaggagaacuggua

SEQ ID NO: 372016 - RNA, 19 nt, Homo sapiens
gaucuacccagaaagaaau

SEQ ID NO: 372017 - RNA, 19 nt, Homo sapiens
caggaaugauugcaauuag

SEQ ID NO: 372018 - RNA, 19 nt, Homo sapiens
gagaugaaauaagcaugau

SEQ ID NO: 372019 - RNA, 19 nt, Homo sapiens
guggccaacuacaucaaua

SEQ ID NO: 372020 - RNA, 19 nt, Homo sapiens
ggaucuacccagaaagaaa

SEQ ID NO: 372021 - RNA, 19 nt, Homo sapiens
uaaugguccuguuauguca

SEQ ID NO: 372022 - RNA, 19 nt, Homo sapiens
uaagcuaaugguccuguua

SEQ ID NO: 372023 - RNA, 19 nt, Homo sapiens
ucaaggaauguuaucagua

SEQ ID NO: 372024 - RNA, 19 nt, Homo sapiens
ggauuuguguuuuacagua

SEQ ID NO: 372025 - RNA, 19 nt, Homo sapiens
gcugcugucucaggaauga

SEQ ID NO: 372026 - RNA, 19 nt, Homo sapiens
ccucauuaaugcugucuau

SEQ ID NO: 372027 - RNA, 19 nt, Homo sapiens
cacaaacaaucuggugaaa

SEQ ID NO: 372028 - RNA, 19 nt, Homo sapiens
aaagaaauccgccacucaa

SEQ ID NO: 372029 - RNA, 19 nt, Homo sapiens
uuugugugcuguuguuuaa

SEQ ID NO: 372030 - RNA, 19 nt, Homo sapiens
ggacaugauuucgaagaac

SEQ ID NO: 372031 - RNA, 19 nt, Homo sapiens
ggugaaagauuugguaucc

SEQ ID NO: 372032 - RNA, 19 nt, Homo sapiens
gccaauaugugaugaaaau

SEQ ID NO: 372033 - RNA, 19 nt, Homo sapiens
ccuagagguuaaugaagaa

SEQ ID NO: 372034 - RNA, 19 nt, Homo sapiens
ugaugaaagugaaguccaa

SEQ ID NO: 372035 - RNA, 19 nt, Homo sapiens
uaucuggcccucauuaaug

SEQ ID NO: 372036 - RNA, 19 nt, Homo sapiens
ucaaacaugguaacugcua

SEQ ID NO: 372037 - RNA, 19 nt, Homo sapiens
ccuguuaugucauuguguu

SEQ ID NO: 372038 - RNA, 19 nt, Homo sapiens
gacaugauuucgaagaacu

SEQ ID NO: 372039 - RNA, 19 nt, Homo sapiens
ucacaaguccuuccuagag

SEQ ID NO: 372040 - RNA, 19 nt, Homo sapiens
uaaaucauguggacuucag

SEQ ID NO: 372041 - RNA, 19 nt, Homo sapiens
gcaacugguauauauuuag

SEQ ID NO: 372042 - RNA, 19 nt, Homo sapiens
ggcaaacucugugaagaag

SEQ ID NO: 372043 - RNA, 19 nt, Homo sapiens
gagagccaauaugugauga

SEQ ID NO: 372044 - RNA, 19 nt, Homo sapiens
ggaaaacaguaacuaagca

SEQ ID NO: 372045 - RNA, 19 nt, Homo sapiens
agaagcugcugcugucuca

SEQ ID NO: 372046 - RNA, 19 nt, Homo sapiens
uaaugaagaaggcucagaa

SEQ ID NO: 372047 - RNA, 19 nt, Homo sapiens
uccuagagguuaaugaaga

SEQ ID NO: 372048 - RNA, 19 nt, Homo sapiens
gaauaacacaaacaaucug

SEQ ID NO: 372049 - RNA, 19 nt, Homo sapiens
uaaagagagccaauaugug

SEQ ID NO: 372050 - RNA, 19 nt, Homo sapiens
gucaaggaauguuaucagu

SEQ ID NO: 372051 - RNA, 19 nt, Homo sapiens
uagagccacuggugaagau

SEQ ID NO: 372052 - RNA, 19 nt, Homo sapiens
ggguggagaauaacacaaa

SEQ ID NO: 372053 - RNA, 19 nt, Homo sapiens
ucaauaaguggguggagaa

SEQ ID NO: 372054 - RNA, 19 nt, Homo sapiens
aauauucucuucucuccau

SEQ ID NO: 372055 - RNA, 19 nt, Homo sapiens
guuaugucauuguguuugu

SEQ ID NO: 372056 - RNA, 19 nt, Homo sapiens
aacaguaacuaagcacauu

SEQ ID NO: 372057 - RNA, 19 nt, Homo sapiens
ucucaggaaugauugcaau

SEQ ID NO: 372058 - RNA, 19 nt, Homo sapiens
cagugaauauguauaaucg

SEQ ID NO: 372059 - RNA, 19 nt, Homo sapiens
ucucuucucuccauugagu

SEQ ID NO: 372060 - RNA, 19 nt, Homo sapiens
cuagaaauaccauaugaag

SEQ ID NO: 372061 - RNA, 19 nt, Homo sapiens
agugauggcuccaaugaag

SEQ ID NO: 372062 - RNA, 19 nt, Homo sapiens
ggagaauaacacaaacaau

SEQ ID NO: 372063 - RNA, 19 nt, Homo sapiens
gcuaaagagagccaauaug

SEQ ID NO: 372064 - RNA, 19 nt, Homo sapiens
gcuaaugguccuguuaugu

SEQ ID NO: 372065 - RNA, 19 nt, Homo sapiens
agucaugcauccugaaaca

SEQ ID NO: 372066 - RNA, 19 nt, Homo sapiens
gcacagcugguugaagaau

SEQ ID NO: 372067 - RNA, 19 nt, Homo sapiens
uccuagaaauaccauauga

SEQ ID NO: 372068 - RNA, 19 nt, Homo sapiens
ggaaagcucugaaucuaua

SEQ ID NO: 372069 - RNA, 19 nt, Homo sapiens
gaaagaggauuugggaaua

SEQ ID NO: 372070 - RNA, 19 nt, Homo sapiens
ccagauggcucuauuagua

SEQ ID NO: 372071 - RNA, 19 nt, Homo sapiens
caacagauauuguggcaaa

SEQ ID NO: 372072 - RNA, 19 nt, Homo sapiens
acgaagagcucaagaauaa

SEQ ID NO: 372073 - RNA, 19 nt, Homo sapiens
gaaauaagcaaacucacua

SEQ ID NO: 372074 - RNA, 19 nt, Homo sapiens
gaaagucgaaagaagauua

SEQ ID NO: 372075 - RNA, 19 nt, Homo sapiens
uaagcaaacucacuaauga

SEQ ID NO: 372076 - RNA, 19 nt, Homo sapiens
ggaauaauguugcucugaa

SEQ ID NO: 372077 - RNA, 19 nt, Homo sapiens
gaaguuuccucaugucuau

SEQ ID NO: 372078 - RNA, 19 nt, Homo sapiens
ccaauaauguguguguuua

SEQ ID NO: 372079 - RNA, 19 nt, Homo sapiens
aaacauaccucuuccuuca

SEQ ID NO: 372080 - RNA, 19 nt, Homo sapiens
gaucccagcuacuuaauug

SEQ ID NO: 372081 - RNA, 19 nt, Homo sapiens
gaagagaaauuuuggauga

SEQ ID NO: 372082 - RNA, 19 nt, Homo sapiens
gcucugaacauguaaauaa

SEQ ID NO: 372083 - RNA, 19 nt, Homo sapiens
aaccaaaccucauugauaa

SEQ ID NO: 372084 - RNA, 19 nt, Homo sapiens
guacgaguauuaccaaaug

SEQ ID NO: 372085 - RNA, 19 nt, Homo sapiens
ggaggacgguuacgaucua

SEQ ID NO: 372086 - RNA, 19 nt, Homo sapiens
acacagagccauuccuuua

SEQ ID NO: 372087 - RNA, 19 nt, Homo sapiens
gcuuacaaguccuuaauuu

SEQ ID NO: 372088 - RNA, 19 nt, Homo sapiens
ggacagggaguuuaagaaa

SEQ ID NO: 372089 - RNA, 19 nt, Homo sapiens
gaacugaacauaaccaaca

SEQ ID NO: 372090 - RNA, 19 nt, Homo sapiens
gcaaaucacacauaggaaa

SEQ ID NO: 372091 - RNA, 19 nt, Homo sapiens
aaaccaaaccucauugaua

SEQ ID NO: 372092 - RNA, 19 nt, Homo sapiens
gagcacaaguaaaucugua

SEQ ID NO: 372093 - RNA, 19 nt, Homo sapiens
cgacuuggguuugaucuuu

SEQ ID NO: 372094 - RNA, 19 nt, Homo sapiens
uaaagaguacgaacuagua

SEQ ID NO: 372095 - RNA, 19 nt, Homo sapiens
ugaauaagagcacaaguaa

SEQ ID NO: 372096 - RNA, 19 nt, Homo sapiens
ggaaagaggauuugggaau

SEQ ID NO: 372097 - RNA, 19 nt, Homo sapiens
ggcauaggcuuuacuguca

SEQ ID NO: 372098 - RNA, 19 nt, Homo sapiens
gcacucgacuuggguuuga

SEQ ID NO: 372099 - RNA, 19 nt, Homo sapiens
aauaaucucuggcuuacaa

SEQ ID NO: 372100 - RNA, 19 nt, Homo sapiens
ggugaaauguauacaaauc

SEQ ID NO: 372101 - RNA, 19 nt, Homo sapiens
caucuuccauucuaacauu

SEQ ID NO: 372102 - RNA, 19 nt, Homo sapiens
guaaauugguaucuuguag

SEQ ID NO: 372103 - RNA, 19 nt, Homo sapiens
gaacacagaagcaguacau

SEQ ID NO: 372104 - RNA, 19 nt, Homo sapiens
aaacuagugucuucaaauc

SEQ ID NO: 372105 - RNA, 19 nt, Homo sapiens
ccuaagaaguuuccucaug

SEQ ID NO: 372106 - RNA, 19 nt, Homo sapiens
gaugaaagucgaaagaaga

SEQ ID NO: 372107 - RNA, 19 nt, Homo sapiens
cuaagaaguuuccucaugu

SEQ ID NO: 372108 - RNA, 19 nt, Homo sapiens
acagggaguuuaagaaaga

SEQ ID NO: 372109 - RNA, 19 nt, Homo sapiens
gaucaguaauccuccucua

SEQ ID NO: 372110 - RNA, 19 nt, Homo sapiens
uaaccauccucgaaaguga

SEQ ID NO: 372111 - RNA, 19 nt, Homo sapiens
uaaggugagucaaaccaaa

SEQ ID NO: 372112 - RNA, 19 nt, Homo sapiens
gcaaucaucccuuccuguu

SEQ ID NO: 372113 - RNA, 19 nt, Homo sapiens
gaauaaaggcugaagaaaa

SEQ ID NO: 372114 - RNA, 19 nt, Homo sapiens
uaugauacguggacauuuc

SEQ ID NO: 372115 - RNA, 19 nt, Homo sapiens
guacagaugaugacacaga

SEQ ID NO: 372116 - RNA, 19 nt, Homo sapiens
gaagagcucaagaauaaag

SEQ ID NO: 372117 - RNA, 19 nt, Homo sapiens
gguacaaaguggcaucuca

SEQ ID NO: 372118 - RNA, 19 nt, Homo sapiens
ugacuuaugcuuccuaguu

SEQ ID NO: 372119 - RNA, 19 nt, Homo sapiens
ucaaagagcugaagaaaac

SEQ ID NO: 372120 - RNA, 19 nt, Homo sapiens
gacgaagagcucaagaaua

SEQ ID NO: 372121 - RNA, 19 nt, Homo sapiens
agaaauugcugggccauau

SEQ ID NO: 372122 - RNA, 19 nt, Homo sapiens
ggagaggaugcccguauuu

SEQ ID NO: 372123 - RNA, 19 nt, Homo sapiens
uggugaacaugguuuauuu

SEQ ID NO: 372124 - RNA, 19 nt, Homo sapiens
cuaauuagguugagcuuuu

SEQ ID NO: 372125 - RNA, 19 nt, Homo sapiens
guucaucuguuguaguaug

SEQ ID NO: 372126 - RNA, 19 nt, Homo sapiens
ggaaucauaauacauguag

SEQ ID NO: 372127 - RNA, 19 nt, Homo sapiens
gcucugaaucuauaccuaa

SEQ ID NO: 372128 - RNA, 19 nt, Homo sapiens
gaauaagagcacaaguaaa

SEQ ID NO: 372129 - RNA, 19 nt, Homo sapiens
guacaucaacaauuccaaa

SEQ ID NO: 372130 - RNA, 19 nt, Homo sapiens
gagugagguacgaguauua

SEQ ID NO: 372131 - RNA, 19 nt, Homo sapiens
gcacacgaaaggagagaaa

SEQ ID NO: 372132 - RNA, 19 nt, Homo sapiens
aauaaguccugagaaauug

SEQ ID NO: 372133 - RNA, 19 nt, Homo sapiens
gccauggcauugcugcuuu

SEQ ID NO: 372134 - RNA, 19 nt, Homo sapiens
gcaaugggacagggaguuu

SEQ ID NO: 372135 - RNA, 19 nt, Homo sapiens
acauaccucuuccuucaaa

SEQ ID NO: 372136 - RNA, 19 nt, Homo sapiens
gaauaauguugcucugaac

SEQ ID NO: 372137 - RNA, 19 nt, Homo sapiens
gaugggcgaugccuucagu

SEQ ID NO: 372138 - RNA, 19 nt, Homo sapiens
ugagaacacagaagcagua

SEQ ID NO: 372139 - RNA, 19 nt, Homo sapiens
guggacauuuccucauaaa

SEQ ID NO: 372140 - RNA, 19 nt, Homo sapiens
uuggaaagcucugaaucua

SEQ ID NO: 372141 - RNA, 19 nt, Homo sapiens
cauuauccauuguuagaug

SEQ ID NO: 372142 - RNA, 19 nt, Homo sapiens
cagauauuguggcaaauca

SEQ ID NO: 372143 - RNA, 19 nt, Homo sapiens
gaagaaagaaaggugaauc

SEQ ID NO: 372144 - RNA, 19 nt, Homo sapiens
cuacuuaauugacuuaugc

SEQ ID NO: 372145 - RNA, 19 nt, Homo sapiens
cuuaauaaucucuggcuua

SEQ ID NO: 372146 - RNA, 19 nt, Homo sapiens
uuacucagcucauguuacu

SEQ ID NO: 372147 - RNA, 19 nt, Homo sapiens
caguaaagaguacgaacua

SEQ ID NO: 372148 - RNA, 19 nt, Homo sapiens
cuaccaguguuacucauau

SEQ ID NO: 372149 - RNA, 19 nt, Homo sapiens
caacagcauccucuucuuc

SEQ ID NO: 372150 - RNA, 19 nt, Homo sapiens
gaaaggugaaucugcacuu

SEQ ID NO: 372151 - RNA, 19 nt, Homo sapiens
gacuuaugcuuccuaguuc

SEQ ID NO: 372152 - RNA, 19 nt, Homo sapiens
gacagggaguuuaagaaag

SEQ ID NO: 372153 - RNA, 19 nt, Homo sapiens
cgaguauuaccaaaugaua

SEQ ID NO: 372154 - RNA, 19 nt, Homo sapiens
caguaauccuccucuauca

SEQ ID NO: 372155 - RNA, 19 nt, Homo sapiens
uaauuuggguugucugucu

SEQ ID NO: 372156 - RNA, 19 nt, Homo sapiens
gaaauugcugggccauaug

SEQ ID NO: 372157 - RNA, 19 nt, Homo sapiens
caguguuacucauaugauu

SEQ ID NO: 372158 - RNA, 19 nt, Homo sapiens
agaaguuccugcacaguuc

SEQ ID NO: 372159 - RNA, 19 nt, Homo sapiens
agguucaucuguuguagua

SEQ ID NO: 372160 - RNA, 19 nt, Homo sapiens
gcaugguguucuugagguu

SEQ ID NO: 372161 - RNA, 19 nt, Homo sapiens
ccaugacccuaagaaguuu

SEQ ID NO: 372162 - RNA, 19 nt, Homo sapiens
ccaccaccgucucuccaaa

SEQ ID NO: 372163 - RNA, 19 nt, Homo sapiens
cgaugaaagucgaaagaag

SEQ ID NO: 372164 - RNA, 19 nt, Homo sapiens
gcuuauuggccauuuguuu

SEQ ID NO: 372165 - RNA, 19 nt, Homo sapiens
ggauuguucccacuucuug

SEQ ID NO: 372166 - RNA, 19 nt, Homo sapiens
gcacuuagcaugguguucu

SEQ ID NO: 372167 - RNA, 19 nt, Homo sapiens
uaagaaguuuccucauguc

SEQ ID NO: 372168 - RNA, 19 nt, Homo sapiens
gaacauaaccgagauauuu

SEQ ID NO: 372169 - RNA, 19 nt, Homo sapiens
acacacagcugauaaauuu

SEQ ID NO: 372170 - RNA, 19 nt, Homo sapiens
gaaauaagccucccuagau

SEQ ID NO: 372171 - RNA, 19 nt, Homo sapiens
gcagauaagacaaacuuua

SEQ ID NO: 372172 - RNA, 19 nt, Homo sapiens
gagguuuccuuaucucaua

SEQ ID NO: 372173 - RNA, 19 nt, Homo sapiens
gcaagaagaggaaguagaa

SEQ ID NO: 372174 - RNA, 19 nt, Homo sapiens
gcucaaagccaauuuauag

SEQ ID NO: 372175 - RNA, 19 nt, Homo sapiens
ggaauaacuuugguucuug

SEQ ID NO: 372176 - RNA, 19 nt, Homo sapiens
gaauaacuuugguucuuga

SEQ ID NO: 372177 - RNA, 19 nt, Homo sapiens
ggugaugaauuuagcuuaa

SEQ ID NO: 372178 - RNA, 19 nt, Homo sapiens
gaagaggaaguagaaauaa

SEQ ID NO: 372179 - RNA, 19 nt, Homo sapiens
ggaaacagaaauucagaaa

SEQ ID NO: 372180 - RNA, 19 nt, Homo sapiens
aagcacagccucagaauaa

SEQ ID NO: 372181 - RNA, 19 nt, Homo sapiens
aaauaagccucccuagauu

SEQ ID NO: 372182 - RNA, 19 nt, Homo sapiens
gugcagagaugauaaguac

SEQ ID NO: 372183 - RNA, 19 nt, Homo sapiens
gaagagauuuagauucacu

SEQ ID NO: 372184 - RNA, 19 nt, Homo sapiens
cagaagguauggauauaga

SEQ ID NO: 372185 - RNA, 19 nt, Homo sapiens
aggaagagauuuagauuca

SEQ ID NO: 372186 - RNA, 19 nt, Homo sapiens
ggauauagaagaaguggaa

SEQ ID NO: 372187 - RNA, 19 nt, Homo sapiens
ggugaaugcuauuuauuuc

SEQ ID NO: 372188 - RNA, 19 nt, Homo sapiens
caaagccaauuuauagcaa

SEQ ID NO: 372189 - RNA, 19 nt, Homo sapiens
gaagcauaauccaacagaa

SEQ ID NO: 372190 - RNA, 19 nt, Homo sapiens
agaagaggaaguagaaaua

SEQ ID NO: 372191 - RNA, 19 nt, Homo sapiens
ccaaugcccucuaccuuca

SEQ ID NO: 372192 - RNA, 19 nt, Homo sapiens
aaaugaagaugguagugaa

SEQ ID NO: 372193 - RNA, 19 nt, Homo sapiens
caucugaaguguauguuuc

SEQ ID NO: 372194 - RNA, 19 nt, Homo sapiens
uaucauacuuccugcagaa

SEQ ID NO: 372195 - RNA, 19 nt, Homo sapiens
caaaggagauuggaaacag

SEQ ID NO: 372196 - RNA, 19 nt, Homo sapiens
gcaaaggcuugugcagaga

SEQ ID NO: 372197 - RNA, 19 nt, Homo sapiens
uagugaagcugcaacauca

SEQ ID NO: 372198 - RNA, 19 nt, Homo sapiens
gagauuggaaacagaaauu

SEQ ID NO: 372199 - RNA, 19 nt, Homo sapiens
uaacuuugguucuugagau

SEQ ID NO: 372200 - RNA, 19 nt, Homo sapiens
ucaagaugcucagcucaaa

SEQ ID NO: 372201 - RNA, 19 nt, Homo sapiens
gaagucaagccucaagaug

SEQ ID NO: 372202 - RNA, 19 nt, Homo sapiens
ugagauaaaugaagauggu

SEQ ID NO: 372203 - RNA, 19 nt, Homo sapiens
gaaagaacaguaucuccau

SEQ ID NO: 372204 - RNA, 19 nt, Homo sapiens
ucaagagguuuccuuaucu

SEQ ID NO: 372205 - RNA, 19 nt, Homo sapiens
cuauaaaacugguggauuu

SEQ ID NO: 372206 - RNA, 19 nt, Homo sapiens
gaagucaguuugggagaag

SEQ ID NO: 372207 - RNA, 19 nt, Homo sapiens
uggaauaacuuugguucuu

SEQ ID NO: 372208 - RNA, 19 nt, Homo sapiens
cgaccuuucuggaauaaca

SEQ ID NO: 372209 - RNA, 19 nt, Homo sapiens
gaggacacacagcugauaa

SEQ ID NO: 372210 - RNA, 19 nt, Homo sapiens
ucucauaaggacaacauua

SEQ ID NO: 372211 - RNA, 19 nt, Homo sapiens
caacugggagccaaaggaa

SEQ ID NO: 372212 - RNA, 19 nt, Homo sapiens
gcugcgaccuuucuggaau

SEQ ID NO: 372213 - RNA, 19 nt, Homo sapiens
auaagccucccuagauuua

SEQ ID NO: 372214 - RNA, 19 nt, Homo sapiens
caaaggugaugaauuuagc

SEQ ID NO: 372215 - RNA, 19 nt, Homo sapiens
ggacacacagcugauaaau

SEQ ID NO: 372216 - RNA, 19 nt, Homo sapiens
uaaaugaagaugguaguga

SEQ ID NO: 372217 - RNA, 19 nt, Homo sapiens
gaaaagcacagccucagaa

SEQ ID NO: 372218 - RNA, 19 nt, Homo sapiens
acuaauuacugcucaacaa

SEQ ID NO: 372219 - RNA, 19 nt, Homo sapiens
guauggauauagaagaagu

SEQ ID NO: 372220 - RNA, 19 nt, Homo sapiens
aauuugcaguggaucuuua

SEQ ID NO: 372221 - RNA, 19 nt, Homo sapiens
aaaggagauuggaaacaga

SEQ ID NO: 372222 - RNA, 19 nt, Homo sapiens
cagcagauaagacaaacuu

SEQ ID NO: 372223 - RNA, 19 nt, Homo sapiens
gaugcaagaagaggaagua

SEQ ID NO: 372224 - RNA, 19 nt, Homo sapiens
gaagguauggauauagaag

SEQ ID NO: 372225 - RNA, 19 nt, Homo sapiens
gacacacagcugauaaauu

SEQ ID NO: 372226 - RNA, 19 nt, Homo sapiens
ggaagucaagccucaagau

SEQ ID NO: 372227 - RNA, 19 nt, Homo sapiens
gaauuugcaguggaucuuu

SEQ ID NO: 372228 - RNA, 19 nt, Homo sapiens
agaaauaagccucccuaga

SEQ ID NO: 372229 - RNA, 19 nt, Homo sapiens
gaagaauuuggcccucuga

SEQ ID NO: 372230 - RNA, 19 nt, Homo sapiens
ugcagaagguauggauaua

SEQ ID NO: 372231 - RNA, 19 nt, Homo sapiens
ggagucuucuauugcuguu

SEQ ID NO: 372232 - RNA, 19 nt, Homo sapiens
ccuggugaaugcuauuuau

SEQ ID NO: 372233 - RNA, 19 nt, Homo sapiens
cuaccaaguuuuagaauug

SEQ ID NO: 372234 - RNA, 19 nt, Homo sapiens
caagagguuuccuuaucuc

SEQ ID NO: 372235 - RNA, 19 nt, Homo sapiens
guagugaagcugcaacauc

SEQ ID NO: 372236 - RNA, 19 nt, Homo sapiens
aagccucccuagauuuaaa

SEQ ID NO: 372237 - RNA, 19 nt, Homo sapiens
cagcagcagauaagacaaa

SEQ ID NO: 372238 - RNA, 19 nt, Homo sapiens
cugcgaccuuucuggaaua

SEQ ID NO: 372239 - RNA, 19 nt, Homo sapiens
cuaauuacugcucaacaaa

SEQ ID NO: 372240 - RNA, 19 nt, Homo sapiens
gcagaagguauggauauag

SEQ ID NO: 372241 - RNA, 19 nt, Homo sapiens
cuuguggagucuucuauug

SEQ ID NO: 372242 - RNA, 19 nt, Homo sapiens
aaagcacagccucagaaua

SEQ ID NO: 372243 - RNA, 19 nt, Homo sapiens
guguauguuucccaaguga

SEQ ID NO: 372244 - RNA, 19 nt, Homo sapiens
gcauaauccaacagaauca

SEQ ID NO: 372245 - RNA, 19 nt, Homo sapiens
caacaucaacuggcauaca

SEQ ID NO: 372246 - RNA, 19 nt, Homo sapiens
agaagucaguuugggagaa

SEQ ID NO: 372247 - RNA, 19 nt, Homo sapiens
aauaagccucccuagauuu

SEQ ID NO: 372248 - RNA, 19 nt, Homo sapiens
aaucuucccugaacuacca

SEQ ID NO: 372249 - RNA, 19 nt, Homo sapiens
ggagauuggaaacagaaau

SEQ ID NO: 372250 - RNA, 19 nt, Homo sapiens
gagauaaaugaagauggua

SEQ ID NO: 372251 - RNA, 19 nt, Homo sapiens
aagaggaaguagaaauaag

SEQ ID NO: 372252 - RNA, 19 nt, Homo sapiens
gauuggaaacagaaauuca

SEQ ID NO: 372253 - RNA, 19 nt, Homo sapiens
ucaaagccaauuuauagca

SEQ ID NO: 372254 - RNA, 19 nt, Homo sapiens
gauaaaugaagaugguagu

SEQ ID NO: 372255 - RNA, 19 nt, Homo sapiens
agguauggauauagaagaa

SEQ ID NO: 372256 - RNA, 19 nt, Homo sapiens
gcagagaugauaaguaccu

SEQ ID NO: 372257 - RNA, 19 nt, Homo sapiens
gcacagcagcagauaagac

SEQ ID NO: 372258 - RNA, 19 nt, Homo sapiens
gaaaagcacagcagcagau

SEQ ID NO: 372259 - RNA, 19 nt, Homo sapiens
gagauaaaaggaagagauu

SEQ ID NO: 372260 - RNA, 19 nt, Homo sapiens
cucccuagauuuaaaguag

SEQ ID NO: 372261 - RNA, 19 nt, Homo sapiens
aauuacugcucaacaaauc

SEQ ID NO: 372262 - RNA, 19 nt, Homo sapiens
ugcaguggaucuuuaucaa

SEQ ID NO: 372263 - RNA, 19 nt, Homo sapiens
aucaagagguuuccuuauc

SEQ ID NO: 372264 - RNA, 19 nt, Homo sapiens
uuaucaagagguuuccuua

SEQ ID NO: 372265 - RNA, 19 nt, Homo sapiens
aagcauaauccaacagaau

SEQ ID NO: 372266 - RNA, 19 nt, Homo sapiens
ugaagcauaauccaacaga

SEQ ID NO: 372267 - RNA, 19 nt, Homo sapiens
gcaguggaucuuuaucaag

SEQ ID NO: 372268 - RNA, 19 nt, Homo sapiens
ggacugaucuuuaaacuau

SEQ ID NO: 372269 - RNA, 19 nt, Homo sapiens
ucuaagaacugaugucuaa

SEQ ID NO: 372270 - RNA, 19 nt, Homo sapiens
uaagauaguccaucaguua

SEQ ID NO: 372271 - RNA, 19 nt, Homo sapiens
gaaggaagccuagauugua

SEQ ID NO: 372272 - RNA, 19 nt, Homo sapiens
gaaagagggcauaagguua

SEQ ID NO: 372273 - RNA, 19 nt, Homo sapiens
gcauagaaacucacauaua

SEQ ID NO: 372274 - RNA, 19 nt, Homo sapiens
ucaaauggcuuacuucauc

SEQ ID NO: 372275 - RNA, 19 nt, Homo sapiens
gaaauaaacagugccagua

SEQ ID NO: 372276 - RNA, 19 nt, Homo sapiens
ggaagaaguucgggaaaga

SEQ ID NO: 372277 - RNA, 19 nt, Homo sapiens
uauaauaccugaacucugu

SEQ ID NO: 372278 - RNA, 19 nt, Homo sapiens
gaugucagcucggugcuua

SEQ ID NO: 372279 - RNA, 19 nt, Homo sapiens
gcugaugucugauaaguau

SEQ ID NO: 372280 - RNA, 19 nt, Homo sapiens
ggaccgauaucacuguuga

SEQ ID NO: 372281 - RNA, 19 nt, Homo sapiens
cuggauaccuuaauuguaa

SEQ ID NO: 372282 - RNA, 19 nt, Homo sapiens
gcuacacucucucggguua

SEQ ID NO: 372283 - RNA, 19 nt, Homo sapiens
cuacauagauucugacagu

SEQ ID NO: 372284 - RNA, 19 nt, Homo sapiens
gaaauaguguccgucauuc

SEQ ID NO: 372285 - RNA, 19 nt, Homo sapiens
gauaauccauucacauagu

SEQ ID NO: 372286 - RNA, 19 nt, Homo sapiens
uaacuggguugcucuaaga

SEQ ID NO: 372287 - RNA, 19 nt, Homo sapiens
caccagauguuuacaaguu

SEQ ID NO: 372288 - RNA, 19 nt, Homo sapiens
uagaaggcaugauaguaua

SEQ ID NO: 372289 - RNA, 19 nt, Homo sapiens
gagaaacccuccacauuuu

SEQ ID NO: 372290 - RNA, 19 nt, Homo sapiens
acacaaggauguuagaaau

SEQ ID NO: 372291 - RNA, 19 nt, Homo sapiens
gauacaaaccacaucauuu

SEQ ID NO: 372292 - RNA, 19 nt, Homo sapiens
ccauggaacucaccgguaa

SEQ ID NO: 372293 - RNA, 19 nt, Homo sapiens
guacuuuguuccuguugua

SEQ ID NO: 372294 - RNA, 19 nt, Homo sapiens
ggaaaauacuguacuaaga

SEQ ID NO: 372295 - RNA, 19 nt, Homo sapiens
ccacucagguaugcaauuu

SEQ ID NO: 372296 - RNA, 19 nt, Homo sapiens
guaacaggcuacaucuuug

SEQ ID NO: 372297 - RNA, 19 nt, Homo sapiens
ggaggaauguugcagaaag

SEQ ID NO: 372298 - RNA, 19 nt, Homo sapiens
gaaacuucuugcacuuauu

SEQ ID NO: 372299 - RNA, 19 nt, Homo sapiens
agaaagaacugaaaaggua

SEQ ID NO: 372300 - RNA, 19 nt, Homo sapiens
ggaccaaagagaaucauuu

SEQ ID NO: 372301 - RNA, 19 nt, Homo sapiens
gcagacuuguuuacagaaa

SEQ ID NO: 372302 - RNA, 19 nt, Homo sapiens
agagaaacccuccacauuu

SEQ ID NO: 372303 - RNA, 19 nt, Homo sapiens
cgacuggacagacuuauuu

SEQ ID NO: 372304 - RNA, 19 nt, Homo sapiens
gcucggugcuuacaaacaa

SEQ ID NO: 372305 - RNA, 19 nt, Homo sapiens
ggaaagugagaaacuguaa

SEQ ID NO: 372306 - RNA, 19 nt, Homo sapiens
aaaggacugugaauucaaa

SEQ ID NO: 372307 - RNA, 19 nt, Homo sapiens
gaggaauguugcagaaaga

SEQ ID NO: 372308 - RNA, 19 nt, Homo sapiens
ggagagggaccaaagagaa

SEQ ID NO: 372309 - RNA, 19 nt, Homo sapiens
cagcagacuuguuuacaga

SEQ ID NO: 372310 - RNA, 19 nt, Homo sapiens
gagaaacuguaauauuugg

SEQ ID NO: 372311 - RNA, 19 nt, Homo sapiens
gaaaaggacugugaauuca

SEQ ID NO: 372312 - RNA, 19 nt, Homo sapiens
uauaaaugccuucguguuu

SEQ ID NO: 372313 - RNA, 19 nt, Homo sapiens
ugcauucacucuuuguuua

SEQ ID NO: 372314 - RNA, 19 nt, Homo sapiens
guagaacccguacccauaa

SEQ ID NO: 372315 - RNA, 19 nt, Homo sapiens
uaacagguuccuugaguaa

SEQ ID NO: 372316 - RNA, 19 nt, Homo sapiens
aagccuagauuguaagauu

SEQ ID NO: 372317 - RNA, 19 nt, Homo sapiens
cuacaucuuugcuuuguug

SEQ ID NO: 372318 - RNA, 19 nt, Homo sapiens
gagccuccaucuucaguug

SEQ ID NO: 372319 - RNA, 19 nt, Homo sapiens
ugaguaagauaguccauca

SEQ ID NO: 372320 - RNA, 19 nt, Homo sapiens
gaagcuguguugccaaugg

SEQ ID NO: 372321 - RNA, 19 nt, Homo sapiens
aaagauaccagcugcauga

SEQ ID NO: 372322 - RNA, 19 nt, Homo sapiens
gaauuuacagugaugagaa

SEQ ID NO: 372323 - RNA, 19 nt, Homo sapiens
gugauucuguauaggauuu

SEQ ID NO: 372324 - RNA, 19 nt, Homo sapiens
cagagaaacccuccacauu

SEQ ID NO: 372325 - RNA, 19 nt, Homo sapiens
guaagauaguccaucaguu

SEQ ID NO: 372326 - RNA, 19 nt, Homo sapiens
aaggaagccuagauuguaa

SEQ ID NO: 372327 - RNA, 19 nt, Homo sapiens
gaacugaaaagguauauga

SEQ ID NO: 372328 - RNA, 19 nt, Homo sapiens
ugucagaaauauccagauu

SEQ ID NO: 372329 - RNA, 19 nt, Homo sapiens
gaacucaccgguaauagag

SEQ ID NO: 372330 - RNA, 19 nt, Homo sapiens
gguagagccuccaucuuca

SEQ ID NO: 372331 - RNA, 19 nt, Homo sapiens
guagaauguugaacuagau

SEQ ID NO: 372332 - RNA, 19 nt, Homo sapiens
ccaguggccucaaagucua

SEQ ID NO: 372333 - RNA, 19 nt, Homo sapiens
ggaacucaccgguaauaga

SEQ ID NO: 372334 - RNA, 19 nt, Homo sapiens
uaaguuaugcuaccucuau

SEQ ID NO: 372335 - RNA, 19 nt, Homo sapiens
ccauuuagaaggcaugaua

SEQ ID NO: 372336 - RNA, 19 nt, Homo sapiens
ugaaauaguguccgucauu

SEQ ID NO: 372337 - RNA, 19 nt, Homo sapiens
gaacccguacccauaauau

SEQ ID NO: 372338 - RNA, 19 nt, Homo sapiens
ugaaagagggcauaagguu

SEQ ID NO: 372339 - RNA, 19 nt, Homo sapiens
gcucuacccugcuacuuag

SEQ ID NO: 372340 - RNA, 19 nt, Homo sapiens
uuaacugguugcacugaua

SEQ ID NO: 372341 - RNA, 19 nt, Homo sapiens
gaggacacaucucuuaacu

SEQ ID NO: 372342 - RNA, 19 nt, Homo sapiens
acaaggauguuagaaaugu

SEQ ID NO: 372343 - RNA, 19 nt, Homo sapiens
aaagggaucgauuugcuua

SEQ ID NO: 372344 - RNA, 19 nt, Homo sapiens
caaauggcuuacuucauca

SEQ ID NO: 372345 - RNA, 19 nt, Homo sapiens
guagaaggaagccuagauu

SEQ ID NO: 372346 - RNA, 19 nt, Homo sapiens
cugaauaccucccuuacug

SEQ ID NO: 372347 - RNA, 19 nt, Homo sapiens
caucuucaguuguguuugu

SEQ ID NO: 372348 - RNA, 19 nt, Homo sapiens
gggugagaauaaugagaua

SEQ ID NO: 372349 - RNA, 19 nt, Homo sapiens
caggcuacaucuuugcuuu

SEQ ID NO: 372350 - RNA, 19 nt, Homo sapiens
uaugugagccuucaguaaa

SEQ ID NO: 372351 - RNA, 19 nt, Homo sapiens
gaauaccucccuuacugaa

SEQ ID NO: 372352 - RNA, 19 nt, Homo sapiens
gggagagagucacgauaau

SEQ ID NO: 372353 - RNA, 19 nt, Homo sapiens
gcugaagggccaaacguuu

SEQ ID NO: 372354 - RNA, 19 nt, Homo sapiens
agaaaugucuuaguucaag

SEQ ID NO: 372355 - RNA, 19 nt, Homo sapiens
ucagcucggugcuuacaaa

SEQ ID NO: 372356 - RNA, 19 nt, Homo sapiens
gcacuggucgguauaugga

SEQ ID NO: 372357 - RNA, 19 nt, Homo sapiens
guacuaagagcagcacuga

SEQ ID NO: 372358 - RNA, 19 nt, Homo sapiens
ggaaguaaauuuguuucac

SEQ ID NO: 372359 - RNA, 19 nt, Homo sapiens
ugauaaguauugucagugu

SEQ ID NO: 372360 - RNA, 19 nt, Homo sapiens
uuaacagguuccuugagua

SEQ ID NO: 372361 - RNA, 19 nt, Homo sapiens
caacuuccucuuccucauu

SEQ ID NO: 372362 - RNA, 19 nt, Homo sapiens
ggacaaacgacuggacaga

SEQ ID NO: 372363 - RNA, 19 nt, Homo sapiens
gaaaacauccauaacauag

SEQ ID NO: 372364 - RNA, 19 nt, Homo sapiens
gcacugaauccugaaauag

SEQ ID NO: 372365 - RNA, 19 nt, Homo sapiens
cauagauucugacaguguu

SEQ ID NO: 372366 - RNA, 19 nt, Homo sapiens
uguagaauguugaacuaga

SEQ ID NO: 372367 - RNA, 19 nt, Homo sapiens
acagguuccuugaguaaga

SEQ ID NO: 372368 - RNA, 19 nt, Homo sapiens
ggacugaucuuuaaacuau

SEQ ID NO: 372369 - RNA, 19 nt, Homo sapiens
ucuaagaacugaugucuaa

SEQ ID NO: 372370 - RNA, 19 nt, Homo sapiens
uaagauaguccaucaguua

SEQ ID NO: 372371 - RNA, 19 nt, Homo sapiens
gaaggaagccuagauugua

SEQ ID NO: 372372 - RNA, 19 nt, Homo sapiens
gaaagagggcauaagguua

SEQ ID NO: 372373 - RNA, 19 nt, Homo sapiens
gcauagaaacucacauaua

SEQ ID NO: 372374 - RNA, 19 nt, Homo sapiens
ucaaauggcuuacuucauc

SEQ ID NO: 372375 - RNA, 19 nt, Homo sapiens
gaaauaaacagugccagua

SEQ ID NO: 372376 - RNA, 19 nt, Homo sapiens
ggaagaaguucgggaaaga

SEQ ID NO: 372377 - RNA, 19 nt, Homo sapiens
uauaauaccugaacucugu

SEQ ID NO: 372378 - RNA, 19 nt, Homo sapiens
gcugaugucugauaaguau

SEQ ID NO: 372379 - RNA, 19 nt, Homo sapiens
ggaccgauaucacuguuga

SEQ ID NO: 372380 - RNA, 19 nt, Homo sapiens
cuggauaccuuaauuguaa

SEQ ID NO: 372381 - RNA, 19 nt, Homo sapiens
gcuacacucucucggguua

SEQ ID NO: 372382 - RNA, 19 nt, Homo sapiens
cuacauagauucugacagu

SEQ ID NO: 372383 - RNA, 19 nt, Homo sapiens
uaacuggguugcucuaaga

SEQ ID NO: 372384 - RNA, 19 nt, Homo sapiens
caccagauguuuacaaguu

SEQ ID NO: 372385 - RNA, 19 nt, Homo sapiens
gagaaacccuccacauuuu

SEQ ID NO: 372386 - RNA, 19 nt, Homo sapiens
acacaaggauguuagaaau

SEQ ID NO: 372387 - RNA, 19 nt, Homo sapiens
ccauggaacucaccgguaa

SEQ ID NO: 372388 - RNA, 19 nt, Homo sapiens
guacuuuguuccuguugua

SEQ ID NO: 372389 - RNA, 19 nt, Homo sapiens
ccacucagguaugcaauuu

SEQ ID NO: 372390 - RNA, 19 nt, Homo sapiens
guaacaggcuacaucuuug

SEQ ID NO: 372391 - RNA, 19 nt, Homo sapiens
ggaggaauguugcagaaag

SEQ ID NO: 372392 - RNA, 19 nt, Homo sapiens
gaaacuucuugcacuuauu

SEQ ID NO: 372393 - RNA, 19 nt, Homo sapiens
agaaagaacugaaaaggua

SEQ ID NO: 372394 - RNA, 19 nt, Homo sapiens
ggaccaaagagaaucauuu

SEQ ID NO: 372395 - RNA, 19 nt, Homo sapiens
agagaaacccuccacauuu

SEQ ID NO: 372396 - RNA, 19 nt, Homo sapiens
cgacuggacagacuuauuu

SEQ ID NO: 372397 - RNA, 19 nt, Homo sapiens
ggaaagugagaaacuguaa

SEQ ID NO: 372398 - RNA, 19 nt, Homo sapiens
aaaggacugugaauucaaa

SEQ ID NO: 372399 - RNA, 19 nt, Homo sapiens
gaggaauguugcagaaaga

SEQ ID NO: 372400 - RNA, 19 nt, Homo sapiens
ggagagggaccaaagagaa

SEQ ID NO: 372401 - RNA, 19 nt, Homo sapiens
gagaaacuguaauauuugg

SEQ ID NO: 372402 - RNA, 19 nt, Homo sapiens
gaaaaggacugugaauuca

SEQ ID NO: 372403 - RNA, 19 nt, Homo sapiens
uauaaaugccuucguguuu

SEQ ID NO: 372404 - RNA, 19 nt, Homo sapiens
ugcauucacucuuuguuua

SEQ ID NO: 372405 - RNA, 19 nt, Homo sapiens
guagaacccguacccauaa

SEQ ID NO: 372406 - RNA, 19 nt, Homo sapiens
uaacagguuccuugaguaa

SEQ ID NO: 372407 - RNA, 19 nt, Homo sapiens
aagccuagauuguaagauu

SEQ ID NO: 372408 - RNA, 19 nt, Homo sapiens
cuacaucuuugcuuuguug

SEQ ID NO: 372409 - RNA, 19 nt, Homo sapiens
gagccuccaucuucaguug

SEQ ID NO: 372410 - RNA, 19 nt, Homo sapiens
ugaguaagauaguccauca

SEQ ID NO: 372411 - RNA, 19 nt, Homo sapiens
gaagcuguguugccaaugg

SEQ ID NO: 372412 - RNA, 19 nt, Homo sapiens
aaagauaccagcugcauga

SEQ ID NO: 372413 - RNA, 19 nt, Homo sapiens
gaauuuacagugaugagaa

SEQ ID NO: 372414 - RNA, 19 nt, Homo sapiens
gugauucuguauaggauuu

SEQ ID NO: 372415 - RNA, 19 nt, Homo sapiens
cagagaaacccuccacauu

SEQ ID NO: 372416 - RNA, 19 nt, Homo sapiens
guaagauaguccaucaguu

SEQ ID NO: 372417 - RNA, 19 nt, Homo sapiens
aaggaagccuagauuguaa

SEQ ID NO: 372418 - RNA, 19 nt, Homo sapiens
gaacugaaaagguauauga

SEQ ID NO: 372419 - RNA, 19 nt, Homo sapiens
ugucagaaauauccagauu

SEQ ID NO: 372420 - RNA, 19 nt, Homo sapiens
gaacucaccgguaauagag

SEQ ID NO: 372421 - RNA, 19 nt, Homo sapiens
gguagagccuccaucuuca

SEQ ID NO: 372422 - RNA, 19 nt, Homo sapiens
guagaauguugaacuagau

SEQ ID NO: 372423 - RNA, 19 nt, Homo sapiens
ccaguggccucaaagucua

SEQ ID NO: 372424 - RNA, 19 nt, Homo sapiens
ggaacucaccgguaauaga

SEQ ID NO: 372425 - RNA, 19 nt, Homo sapiens
uaaguuaugcuaccucuau

SEQ ID NO: 372426 - RNA, 19 nt, Homo sapiens
ugaaagagggcauaagguu

SEQ ID NO: 372427 - RNA, 19 nt, Homo sapiens
gaacccguacccauaauau

SEQ ID NO: 372428 - RNA, 19 nt, Homo sapiens
gcucuacccugcuacuuag

SEQ ID NO: 372429 - RNA, 19 nt, Homo sapiens
uuaacugguugcacugaua

SEQ ID NO: 372430 - RNA, 19 nt, Homo sapiens
gaggacacaucucuuaacu

SEQ ID NO: 372431 - RNA, 19 nt, Homo sapiens
acaaggauguuagaaaugu

SEQ ID NO: 372432 - RNA, 19 nt, Homo sapiens
caaauggcuuacuucauca

SEQ ID NO: 372433 - RNA, 19 nt, Homo sapiens
guagaaggaagccuagauu

SEQ ID NO: 372434 - RNA, 19 nt, Homo sapiens
cugaauaccucccuuacug

SEQ ID NO: 372435 - RNA, 19 nt, Homo sapiens
caucuucaguuguguuugu

SEQ ID NO: 372436 - RNA, 19 nt, Homo sapiens
gggugagaauaaugagaua

SEQ ID NO: 372437 - RNA, 19 nt, Homo sapiens
caggcuacaucuuugcuuu

SEQ ID NO: 372438 - RNA, 19 nt, Homo sapiens
uaugugagccuucaguaaa

SEQ ID NO: 372439 - RNA, 19 nt, Homo sapiens
gaauaccucccuuacugaa

SEQ ID NO: 372440 - RNA, 19 nt, Homo sapiens
gcugaagggccaaacguuu

SEQ ID NO: 372441 - RNA, 19 nt, Homo sapiens
agaaaugucuuaguucaag

SEQ ID NO: 372442 - RNA, 19 nt, Homo sapiens
gcacuggucgguauaugga

SEQ ID NO: 372443 - RNA, 19 nt, Homo sapiens
ucagggaucgauuugcuua

SEQ ID NO: 372444 - RNA, 19 nt, Homo sapiens
ggaaguaaauuuguuucac

SEQ ID NO: 372445 - RNA, 19 nt, Homo sapiens
ugauaaguauugucagugu

SEQ ID NO: 372446 - RNA, 19 nt, Homo sapiens
uuaacagguuccuugagua

SEQ ID NO: 372447 - RNA, 19 nt, Homo sapiens
caacuuccucuuccucauu

SEQ ID NO: 372448 - RNA, 19 nt, Homo sapiens
ggacaaacgacuggacaga

SEQ ID NO: 372449 - RNA, 19 nt, Homo sapiens
gaaaacauccauaacauag

SEQ ID NO: 372450 - RNA, 19 nt, Homo sapiens
cauagauucugacaguguu

SEQ ID NO: 372451 - RNA, 19 nt, Homo sapiens
uguagaacccguacccaua

SEQ ID NO: 372452 - RNA, 19 nt, Homo sapiens
uguagaauguugaacuaga

SEQ ID NO: 372453 - RNA, 19 nt, Homo sapiens
acagguuccuugaguaaga

SEQ ID NO: 372454 - RNA, 19 nt, Homo sapiens
gacuccagauucuaucauu

SEQ ID NO: 372455 - RNA, 19 nt, Homo sapiens
gguaauagaggacacaucu

SEQ ID NO: 372456 - RNA, 19 nt, Homo sapiens
gaaguuagggguuuuguug

SEQ ID NO: 372457 - RNA, 19 nt, Homo sapiens
ucuuugaacucuuaagguu

SEQ ID NO: 372458 - RNA, 19 nt, Homo sapiens
uggccucgcugaugucuga

SEQ ID NO: 372459 - RNA, 19 nt, Homo sapiens
gacacucaccagauguuua

SEQ ID NO: 372460 - RNA, 19 nt, Homo sapiens
cauuuaagccacucaggua

SEQ ID NO: 372461 - RNA, 19 nt, Homo sapiens
gcagagaaacccuccacau

SEQ ID NO: 372462 - RNA, 19 nt, Homo sapiens
uguguagaauguugaacua

SEQ ID NO: 372463 - RNA, 19 nt, Homo sapiens
aguaacaggcuacaucuuu

SEQ ID NO: 372464 - RNA, 19 nt, Homo sapiens
guacuaaaaugcaaaagca

SEQ ID NO: 372465 - RNA, 19 nt, Homo sapiens
cuggaagucuuuacacaug

SEQ ID NO: 372466 - RNA, 19 nt, Homo sapiens
uaacaccauuagacacuca

SEQ ID NO: 372467 - RNA, 19 nt, Homo sapiens
ggaugacuccagauucuau

SEQ ID NO: 372468 - RNA, 19 nt, Homo sapiens
ggacugaucuuuaaacuau

SEQ ID NO: 372469 - RNA, 19 nt, Homo sapiens
ucuaagaacugaugucuaa

SEQ ID NO: 372470 - RNA, 19 nt, Homo sapiens
uaagauaguccaucaguua

SEQ ID NO: 372471 - RNA, 19 nt, Homo sapiens
gaaggaagccuagauugua

SEQ ID NO: 372472 - RNA, 19 nt, Homo sapiens
gcauagaaacucacauaua

SEQ ID NO: 372473 - RNA, 19 nt, Homo sapiens
ucaaauggcuuacuucauc

SEQ ID NO: 372474 - RNA, 19 nt, Homo sapiens
gaaauaaacagugccagua

SEQ ID NO: 372475 - RNA, 19 nt, Homo sapiens
ggaagaaguucgggaaaga

SEQ ID NO: 372476 - RNA, 19 nt, Homo sapiens
uauaauaccugaacucugu

SEQ ID NO: 372477 - RNA, 19 nt, Homo sapiens
gcugaugucugauaaguau

SEQ ID NO: 372478 - RNA, 19 nt, Homo sapiens
ggaccgauaucacuguuga

SEQ ID NO: 372479 - RNA, 19 nt, Homo sapiens
cuggauaccuuaauuguaa

SEQ ID NO: 372480 - RNA, 19 nt, Homo sapiens
cuacauagauucugacagu

SEQ ID NO: 372481 - RNA, 19 nt, Homo sapiens
uaacuggguugcucuaaga

SEQ ID NO: 372482 - RNA, 19 nt, Homo sapiens
caccagauguuuacaaguu

SEQ ID NO: 372483 - RNA, 19 nt, Homo sapiens
gagaaacccuccacauuuu

SEQ ID NO: 372484 - RNA, 19 nt, Homo sapiens
acacaaggauguuagaaau

SEQ ID NO: 372485 - RNA, 19 nt, Homo sapiens
ccauggaacucaccgguaa

SEQ ID NO: 372486 - RNA, 19 nt, Homo sapiens
guacuuuguuccuguugua

SEQ ID NO: 372487 - RNA, 19 nt, Homo sapiens
ccacucagguaugcaauuu

SEQ ID NO: 372488 - RNA, 19 nt, Homo sapiens
guaacaggcuacaucuuug

SEQ ID NO: 372489 - RNA, 19 nt, Homo sapiens
ggaggaauguugcagaaag

SEQ ID NO: 372490 - RNA, 19 nt, Homo sapiens
gaaacuucuugcacuuauu

SEQ ID NO: 372491 - RNA, 19 nt, Homo sapiens
agaaagaacugaaaaggua

SEQ ID NO: 372492 - RNA, 19 nt, Homo sapiens
ggaccaaagagaaucauuu

SEQ ID NO: 372493 - RNA, 19 nt, Homo sapiens
agagaaacccuccacauuu

SEQ ID NO: 372494 - RNA, 19 nt, Homo sapiens
cgacuggacagacuuauuu

SEQ ID NO: 372495 - RNA, 19 nt, Homo sapiens
ggaaagugagaaacuguaa

SEQ ID NO: 372496 - RNA, 19 nt, Homo sapiens
aaaggacugugaauucaaa

SEQ ID NO: 372497 - RNA, 19 nt, Homo sapiens
gaggaauguugcagaaaga

SEQ ID NO: 372498 - RNA, 19 nt, Homo sapiens
ggagagggaccaaagagaa

SEQ ID NO: 372499 - RNA, 19 nt, Homo sapiens
gagaaacuguaauauuugg

SEQ ID NO: 372500 - RNA, 19 nt, Homo sapiens
gaaaaggacugugaauuca

SEQ ID NO: 372501 - RNA, 19 nt, Homo sapiens
uauaaaugccuucguguuu

SEQ ID NO: 372502 - RNA, 19 nt, Homo sapiens
ugcauucacucuuuguuua

SEQ ID NO: 372503 - RNA, 19 nt, Homo sapiens
uaacagguuccuugaguaa

SEQ ID NO: 372504 - RNA, 19 nt, Homo sapiens
aagccuagauuguaagauu

SEQ ID NO: 372505 - RNA, 19 nt, Homo sapiens
cuacaucuuugcuuuguug

SEQ ID NO: 372506 - RNA, 19 nt, Homo sapiens
gagccuccaucuucaguug

SEQ ID NO: 372507 - RNA, 19 nt, Homo sapiens
ugaguaagauaguccauca

SEQ ID NO: 372508 - RNA, 19 nt, Homo sapiens
gaagcuguguugccaaugg

SEQ ID NO: 372509 - RNA, 19 nt, Homo sapiens
aaagauaccagcugcauga

SEQ ID NO: 372510 - RNA, 19 nt, Homo sapiens
gaauuuacagugaugagaa

SEQ ID NO: 372511 - RNA, 19 nt, Homo sapiens
gugauucuguauaggauuu

SEQ ID NO: 372512 - RNA, 19 nt, Homo sapiens
cagagaaacccuccacauu

SEQ ID NO: 372513 - RNA, 19 nt, Homo sapiens
guaagauaguccaucaguu

SEQ ID NO: 372514 - RNA, 19 nt, Homo sapiens
aaggaagccuagauuguaa

SEQ ID NO: 372515 - RNA, 19 nt, Homo sapiens
gaacugaaaagguauauga

SEQ ID NO: 372516 - RNA, 19 nt, Homo sapiens
ugucagaaauauccagauu

SEQ ID NO: 372517 - RNA, 19 nt, Homo sapiens
ggaacucaccgguaauaga

SEQ ID NO: 372518 - RNA, 19 nt, Homo sapiens
gguagagccuccaucuuca

SEQ ID NO: 372519 - RNA, 19 nt, Homo sapiens
gaacucaccgguaauagag

SEQ ID NO: 372520 - RNA, 19 nt, Homo sapiens
guagaauguugaacuagau

SEQ ID NO: 372521 - RNA, 19 nt, Homo sapiens
uaaguuaugcuaccucuau

SEQ ID NO: 372522 - RNA, 19 nt, Homo sapiens
gcucuacccugcuacuuag

SEQ ID NO: 372523 - RNA, 19 nt, Homo sapiens
gaggacacaucucuuaacu

SEQ ID NO: 372524 - RNA, 19 nt, Homo sapiens
uuaacugguugcacugaua

SEQ ID NO: 372525 - RNA, 19 nt, Homo sapiens
acaaggauguuagaaaugu

SEQ ID NO: 372526 - RNA, 19 nt, Homo sapiens
caaauggcuuacuucauca

SEQ ID NO: 372527 - RNA, 19 nt, Homo sapiens
guagaaggaagccuagauu

SEQ ID NO: 372528 - RNA, 19 nt, Homo sapiens
cugaauaccucccuuacug

SEQ ID NO: 372529 - RNA, 19 nt, Homo sapiens
caucuucaguuguguuugu

SEQ ID NO: 372530 - RNA, 19 nt, Homo sapiens
gggugagaauaaugagaua

SEQ ID NO: 372531 - RNA, 19 nt, Homo sapiens
caggcuacaucuuugcuuu

SEQ ID NO: 372532 - RNA, 19 nt, Homo sapiens
uaugugagccuucaguaaa

SEQ ID NO: 372533 - RNA, 19 nt, Homo sapiens
gaauaccucccuuacugaa

SEQ ID NO: 372534 - RNA, 19 nt, Homo sapiens
gcugaagggccaaacguuu

SEQ ID NO: 372535 - RNA, 19 nt, Homo sapiens
agaaaugucuuaguucaag

SEQ ID NO: 372536 - RNA, 19 nt, Homo sapiens
gcacuggucgguauaugga

SEQ ID NO: 372537 - RNA, 19 nt, Homo sapiens
ggaaguaaauuuguuucac

SEQ ID NO: 372538 - RNA, 19 nt, Homo sapiens
ugauaaguauugucagugu

SEQ ID NO: 372539 - RNA, 19 nt, Homo sapiens
uuaacagguuccuugagua

SEQ ID NO: 372540 - RNA, 19 nt, Homo sapiens
caacuuccucuuccucauu

SEQ ID NO: 372541 - RNA, 19 nt, Homo sapiens
ggacaaacgacuggacaga

SEQ ID NO: 372542 - RNA, 19 nt, Homo sapiens
gaaaacauccauaacauag

SEQ ID NO: 372543 - RNA, 19 nt, Homo sapiens
cauagauucugacaguguu

SEQ ID NO: 372544 - RNA, 19 nt, Homo sapiens
gguaauagaggacacaucu

SEQ ID NO: 372545 - RNA, 19 nt, Homo sapiens
uguagaauguugaacuaga

SEQ ID NO: 372546 - RNA, 19 nt, Homo sapiens
acagguuccuugaguaaga

SEQ ID NO: 372547 - RNA, 19 nt, Homo sapiens
gacuccagauucuaucauu

SEQ ID NO: 372548 - RNA, 19 nt, Homo sapiens
gaaguuagggguuuuguug

SEQ ID NO: 372549 - RNA, 19 nt, Homo sapiens
ucuuugaacucuuaagguu

SEQ ID NO: 372550 - RNA, 19 nt, Homo sapiens
uggccucgcugaugucuga

SEQ ID NO: 372551 - RNA, 19 nt, Homo sapiens
gacacucaccagauguuua

SEQ ID NO: 372552 - RNA, 19 nt, Homo sapiens
cauuuaagccacucaggua

SEQ ID NO: 372553 - RNA, 19 nt, Homo sapiens
gcagagaaacccuccacau

SEQ ID NO: 372554 - RNA, 19 nt, Homo sapiens
uguguagaauguugaacua

SEQ ID NO: 372555 - RNA, 19 nt, Homo sapiens
aguaacaggcuacaucuuu

SEQ ID NO: 372556 - RNA, 19 nt, Homo sapiens
guacuaaaaugcaaaagca

SEQ ID NO: 372557 - RNA, 19 nt, Homo sapiens
uaacaccauuagacacuca

SEQ ID NO: 372558 - RNA, 19 nt, Homo sapiens
ggaugacuccagauucuau

SEQ ID NO: 372559 - RNA, 19 nt, Homo sapiens
aaacgacuggacagacuua

SEQ ID NO: 372560 - RNA, 19 nt, Homo sapiens
gaagcagccaguugugguu

SEQ ID NO: 372561 - RNA, 19 nt, Homo sapiens
uuauuagguucacucagua

SEQ ID NO: 372562 - RNA, 19 nt, Homo sapiens
gaaagugagaaacuguaau

SEQ ID NO: 372563 - RNA, 19 nt, Homo sapiens
ccucgcugaugucugauaa

SEQ ID NO: 372564 - RNA, 19 nt, Homo sapiens
gagagggaccaaagagaau

SEQ ID NO: 372565 - RNA, 19 nt, Homo sapiens
ggaaagauaccagcugcau

SEQ ID NO: 372566 - RNA, 19 nt, Homo sapiens
uuagaggcaugccaccauu

SEQ ID NO: 372567 - RNA, 19 nt, Homo sapiens
gugcauucacucuuuguuu

SEQ ID NO: 372568 - RNA, 19 nt, Homo sapiens
aaagcaagcugauagauua

SEQ ID NO: 372569 - RNA, 19 nt, Homo sapiens
ggacauccauuacauuauu

SEQ ID NO: 372570 - RNA, 19 nt, Homo sapiens
gaagugaugugguuucuau

SEQ ID NO: 372571 - RNA, 19 nt, Homo sapiens
cgacagcccuuuccugaua

SEQ ID NO: 372572 - RNA, 19 nt, Homo sapiens
ggaugaagcugaaaucaag

SEQ ID NO: 372573 - RNA, 19 nt, Homo sapiens
ggcagaaggucuuguauga

SEQ ID NO: 372574 - RNA, 19 nt, Homo sapiens
gugcuuauccuuucuguua

SEQ ID NO: 372575 - RNA, 19 nt, Homo sapiens
gagacaaauucaucuauug

SEQ ID NO: 372576 - RNA, 19 nt, Homo sapiens
gugguuaucuggugguaua

SEQ ID NO: 372577 - RNA, 19 nt, Homo sapiens
guacuacucuugaccuuuc

SEQ ID NO: 372578 - RNA, 19 nt, Homo sapiens
aaacauccaugcucggaaa

SEQ ID NO: 372579 - RNA, 19 nt, Homo sapiens
cauaugaagugaugugguu

SEQ ID NO: 372580 - RNA, 19 nt, Homo sapiens
ccagggaggucucauuuca

SEQ ID NO: 372581 - RNA, 19 nt, Homo sapiens
gugaugugguuucuauuaa

SEQ ID NO: 372582 - RNA, 19 nt, Homo sapiens
gaauagagaucaaaaccaa

SEQ ID NO: 372583 - RNA, 19 nt, Homo sapiens
ggaagcagcaugucauugu

SEQ ID NO: 372584 - RNA, 19 nt, Homo sapiens
guuaggccaucucaucuuu

SEQ ID NO: 372585 - RNA, 19 nt, Homo sapiens
gcccuagucuucauuacuu

SEQ ID NO: 372586 - RNA, 19 nt, Homo sapiens
ggaggccuacuguccauua

SEQ ID NO: 372587 - RNA, 19 nt, Homo sapiens
gaagcagcaugucauugug

SEQ ID NO: 372588 - RNA, 19 nt, Homo sapiens
uaggacauccauuacauua

SEQ ID NO: 372589 - RNA, 19 nt, Homo sapiens
gcugaugucuaucucaugu

SEQ ID NO: 372590 - RNA, 19 nt, Homo sapiens
uaaagcaagcugauagauu

SEQ ID NO: 372591 - RNA, 19 nt, Homo sapiens
guaagagaauagagaucaa

SEQ ID NO: 372592 - RNA, 19 nt, Homo sapiens
ccuccuaacuaguauagaa

SEQ ID NO: 372593 - RNA, 19 nt, Homo sapiens
gaacauggccaucuuugcu

SEQ ID NO: 372594 - RNA, 19 nt, Homo sapiens
caacacagcauggaauuuc

SEQ ID NO: 372595 - RNA, 19 nt, Homo sapiens
aagcugaaaucaaggaaga

SEQ ID NO: 372596 - RNA, 19 nt, Homo sapiens
gcacugacaccaucuaugc

SEQ ID NO: 372597 - RNA, 19 nt, Homo sapiens
gauaauguaugcucaaccu

SEQ ID NO: 372598 - RNA, 19 nt, Homo sapiens
uguaacauaugaagugaug

SEQ ID NO: 372599 - RNA, 19 nt, Homo sapiens
gcuuauccuuucuguuauu

SEQ ID NO: 372600 - RNA, 19 nt, Homo sapiens
gcccuuuccugauaacuau

SEQ ID NO: 372601 - RNA, 19 nt, Homo sapiens
caucuuugcuucuguaugc

SEQ ID NO: 372602 - RNA, 19 nt, Homo sapiens
ggccaucuuugcuucugua

SEQ ID NO: 372603 - RNA, 19 nt, Homo sapiens
gacagcccuuuccugauaa

SEQ ID NO: 372604 - RNA, 19 nt, Homo sapiens
agggaggucucauuucaaa

SEQ ID NO: 372605 - RNA, 19 nt, Homo sapiens
gaguugauuugacuuuauc

SEQ ID NO: 372606 - RNA, 19 nt, Homo sapiens
gcuguaacauaugaaguga

SEQ ID NO: 372607 - RNA, 19 nt, Homo sapiens
uguccagguuccucaguua

SEQ ID NO: 372608 - RNA, 19 nt, Homo sapiens
auauugggcugugguauuu

SEQ ID NO: 372609 - RNA, 19 nt, Homo sapiens
ugauuaaacuggccugagu

SEQ ID NO: 372610 - RNA, 19 nt, Homo sapiens
cucauucgcuugcagcuuu

SEQ ID NO: 372611 - RNA, 19 nt, Homo sapiens
ugugggagccguacucuuu

SEQ ID NO: 372612 - RNA, 19 nt, Homo sapiens
gguaagagaauagagauca

SEQ ID NO: 372613 - RNA, 19 nt, Homo sapiens
gauuugacuuuaucucagu

SEQ ID NO: 372614 - RNA, 19 nt, Homo sapiens
caccaucuaugccauguca

SEQ ID NO: 372615 - RNA, 19 nt, Homo sapiens
ugagggugcuuauccuuuc

SEQ ID NO: 372616 - RNA, 19 nt, Homo sapiens
gacauuugccauucagauu

SEQ ID NO: 372617 - RNA, 19 nt, Homo sapiens
ucacugauuggguauguuu

SEQ ID NO: 372618 - RNA, 19 nt, Homo sapiens
cuggggaccucuugaauua

SEQ ID NO: 372619 - RNA, 19 nt, Homo sapiens
gcaugucauugugguaaga

SEQ ID NO: 372620 - RNA, 19 nt, Homo sapiens
gggaugaagcugaaaucaa

SEQ ID NO: 372621 - RNA, 19 nt, Homo sapiens
ggccuacuguccauuagug

SEQ ID NO: 372622 - RNA, 19 nt, Homo sapiens
ugagggcgaugauuaaacu

SEQ ID NO: 372623 - RNA, 19 nt, Homo sapiens
ucaguuaaauuaggacauc

SEQ ID NO: 372624 - RNA, 19 nt, Homo sapiens
ccagcacacuauccuugaa

SEQ ID NO: 372625 - RNA, 19 nt, Homo sapiens
ucugugagggcgaugauua

SEQ ID NO: 372626 - RNA, 19 nt, Homo sapiens
ccagguuccucaguuaaau

SEQ ID NO: 372627 - RNA, 19 nt, Homo sapiens
uacuuucacuuauggguuu

SEQ ID NO: 372628 - RNA, 19 nt, Homo sapiens
ggugaagggcggaagaaga

SEQ ID NO: 372629 - RNA, 19 nt, Homo sapiens
gcugugcaguguuuguguu

SEQ ID NO: 372630 - RNA, 19 nt, Homo sapiens
agugaugugguuucuauua

SEQ ID NO: 372631 - RNA, 19 nt, Homo sapiens
cugaguugauuugacuuua

SEQ ID NO: 372632 - RNA, 19 nt, Homo sapiens
gacuuuaucucaguacuac

SEQ ID NO: 372633 - RNA, 19 nt, Homo sapiens
uaaagacagaguuccauuc

SEQ ID NO: 372634 - RNA, 19 nt, Homo sapiens
caaggaaagguugguagaa

SEQ ID NO: 372635 - RNA, 19 nt, Homo sapiens
uuucacaacuuucguaggu

SEQ ID NO: 372636 - RNA, 19 nt, Homo sapiens
ucuaggaacuuggcugugu

SEQ ID NO: 372637 - RNA, 19 nt, Homo sapiens
ggaaagguugguagaacau

SEQ ID NO: 372638 - RNA, 19 nt, Homo sapiens
gcuguuaggccaucucauc

SEQ ID NO: 372639 - RNA, 19 nt, Homo sapiens
aaagguugguagaacauca

SEQ ID NO: 372640 - RNA, 19 nt, Homo sapiens
gauuggguauguuuuguuu

SEQ ID NO: 372641 - RNA, 19 nt, Homo sapiens
cagcaugucauugugguaa

SEQ ID NO: 372642 - RNA, 19 nt, Homo sapiens
aggaagacuuguccagguu

SEQ ID NO: 372643 - RNA, 19 nt, Homo sapiens
guauauggaugagggucuu

SEQ ID NO: 372644 - RNA, 19 nt, Homo sapiens
aaacaaggaaagguuggua

SEQ ID NO: 372645 - RNA, 19 nt, Homo sapiens
ucucauugauggaggugaa

SEQ ID NO: 372646 - RNA, 19 nt, Homo sapiens
ucagagacaaauucaucua

SEQ ID NO: 372647 - RNA, 19 nt, Homo sapiens
ccucagagacaaauucauc

SEQ ID NO: 372648 - RNA, 19 nt, Homo sapiens
gaaacuaaaggcauguacu

SEQ ID NO: 372649 - RNA, 19 nt, Homo sapiens
gaagaaacuaaaggcaugu

SEQ ID NO: 372650 - RNA, 19 nt, Homo sapiens
cuaggaacuuggcuguguu

SEQ ID NO: 372651 - RNA, 19 nt, Homo sapiens
cagagacaaauucaucuau

SEQ ID NO: 372652 - RNA, 19 nt, Homo sapiens
gugagggugcuuauccuuu

SEQ ID NO: 372653 - RNA, 19 nt, Homo sapiens
ucauugugguaagagaaua

SEQ ID NO: 372654 - RNA, 19 nt, Homo sapiens
caucaacacagcauggaau

SEQ ID NO: 372655 - RNA, 19 nt, Homo sapiens
acauuugccauucagauuu

SEQ ID NO: 372656 - RNA, 19 nt, Homo sapiens
uuucguagguucacagucu

SEQ ID NO: 372657 - RNA, 19 nt, Homo sapiens
guuaucuggugguauaugg

SEQ ID NO: 372658 - RNA, 19 nt, Homo sapiens
acaagaaccaccuggacuu

SEQ ID NO: 372659 - RNA, 19 nt, Homo sapiens
ugacuuuaucucaguacua

SEQ ID NO: 372660 - RNA, 19 nt, Homo sapiens
uuaaagacagaguuccauu

SEQ ID NO: 372661 - RNA, 19 nt, Homo sapiens
aggaaagguugguagaaca

SEQ ID NO: 372662 - RNA, 19 nt, Homo sapiens
ucauuacuuucacuuaugg

SEQ ID NO: 372663 - RNA, 19 nt, Homo sapiens
ggaggugaagggcggaaga

SEQ ID NO: 372664 - RNA, 19 nt, Homo sapiens
caagaaccaccuggacuuc

SEQ ID NO: 372665 - RNA, 19 nt, Homo sapiens
uauuaaagcaagcugauag

SEQ ID NO: 372666 - RNA, 19 nt, Homo sapiens
cauuguauccagcacacua

SEQ ID NO: 372667 - RNA, 19 nt, Homo sapiens
gaaccaccuggacuucugu

SEQ ID NO: 372668 - RNA, 19 nt, Homo sapiens
aaagcaagcugauagauua

SEQ ID NO: 372669 - RNA, 19 nt, Homo sapiens
ggacauccauuacauuauu

SEQ ID NO: 372670 - RNA, 19 nt, Homo sapiens
gaagugaugugguuucuau

SEQ ID NO: 372671 - RNA, 19 nt, Homo sapiens
cgacagcccuuuccugaua

SEQ ID NO: 372672 - RNA, 19 nt, Homo sapiens
ggaugaagcugaaaucaag

SEQ ID NO: 372673 - RNA, 19 nt, Homo sapiens
ggcagaaggucuuguauga

SEQ ID NO: 372674 - RNA, 19 nt, Homo sapiens
gugcuuauccuuucuguua

SEQ ID NO: 372675 - RNA, 19 nt, Homo sapiens
gagacaaauucaucuauug

SEQ ID NO: 372676 - RNA, 19 nt, Homo sapiens
gugguuaucuggugguaua

SEQ ID NO: 372677 - RNA, 19 nt, Homo sapiens
aaacauccaugcucggaaa

SEQ ID NO: 372678 - RNA, 19 nt, Homo sapiens
cauaugaagugaugugguu

SEQ ID NO: 372679 - RNA, 19 nt, Homo sapiens
ccagggaggucucauuuca

SEQ ID NO: 372680 - RNA, 19 nt, Homo sapiens
gugaugugguuucuauuaa

SEQ ID NO: 372681 - RNA, 19 nt, Homo sapiens
gaauagagaucaaaaccaa

SEQ ID NO: 372682 - RNA, 19 nt, Homo sapiens
ggaagcagcaugucauugu

SEQ ID NO: 372683 - RNA, 19 nt, Homo sapiens
guuaggccaucucaucuuu

SEQ ID NO: 372684 - RNA, 19 nt, Homo sapiens
gcccuagucuucauuacuu

SEQ ID NO: 372685 - RNA, 19 nt, Homo sapiens
ggaggccuacuguccauua

SEQ ID NO: 372686 - RNA, 19 nt, Homo sapiens
gaagcagcaugucauugug

SEQ ID NO: 372687 - RNA, 19 nt, Homo sapiens
uaggacauccauuacauua

SEQ ID NO: 372688 - RNA, 19 nt, Homo sapiens
gcugaugucuaucucaugu

SEQ ID NO: 372689 - RNA, 19 nt, Homo sapiens
uaaagcaagcugauagauu

SEQ ID NO: 372690 - RNA, 19 nt, Homo sapiens
guaagagaauagagaucaa

SEQ ID NO: 372691 - RNA, 19 nt, Homo sapiens
ccuccuaacuaguauagaa

SEQ ID NO: 372692 - RNA, 19 nt, Homo sapiens
gaacauggccaucuuugcu

SEQ ID NO: 372693 - RNA, 19 nt, Homo sapiens
caacacagcauggaauuuc

SEQ ID NO: 372694 - RNA, 19 nt, Homo sapiens
aagcugaaaucaaggaaga

SEQ ID NO: 372695 - RNA, 19 nt, Homo sapiens
gcacugacaccaucuaugc

SEQ ID NO: 372696 - RNA, 19 nt, Homo sapiens
gauaauguaugcucaaccu

SEQ ID NO: 372697 - RNA, 19 nt, Homo sapiens
uguaacauaugaagugaug

SEQ ID NO: 372698 - RNA, 19 nt, Homo sapiens
gcuuauccuuucuguuauu

SEQ ID NO: 372699 - RNA, 19 nt, Homo sapiens
gcccuuuccugauaacuau

SEQ ID NO: 372700 - RNA, 19 nt, Homo sapiens
caucuuugcuucuguaugc

SEQ ID NO: 372701 - RNA, 19 nt, Homo sapiens
ggaagugcuuggccacagu

SEQ ID NO: 372702 - RNA, 19 nt, Homo sapiens
ggccaucuuugcuucugua

SEQ ID NO: 372703 - RNA, 19 nt, Homo sapiens
gacagcccuuuccugauaa

SEQ ID NO: 372704 - RNA, 19 nt, Homo sapiens
agggaggucucauuucaaa

SEQ ID NO: 372705 - RNA, 19 nt, Homo sapiens
gcuguaacauaugaaguga

SEQ ID NO: 372706 - RNA, 19 nt, Homo sapiens
uguccagguuccucaguua

SEQ ID NO: 372707 - RNA, 19 nt, Homo sapiens
auauugggcugugguauuu

SEQ ID NO: 372708 - RNA, 19 nt, Homo sapiens
ugauuaaacuggccugagu

SEQ ID NO: 372709 - RNA, 19 nt, Homo sapiens
cucauucgcuugcagcuuu

SEQ ID NO: 372710 - RNA, 19 nt, Homo sapiens
ugugggagccguacucuuu

SEQ ID NO: 372711 - RNA, 19 nt, Homo sapiens
gguaagagaauagagauca

SEQ ID NO: 372712 - RNA, 19 nt, Homo sapiens
caccaucuaugccauguca

SEQ ID NO: 372713 - RNA, 19 nt, Homo sapiens
ugagggugcuuauccuuuc

SEQ ID NO: 372714 - RNA, 19 nt, Homo sapiens
gacauuugccauucagauu

SEQ ID NO: 372715 - RNA, 19 nt, Homo sapiens
ucacugauuggguauguuu

SEQ ID NO: 372716 - RNA, 19 nt, Homo sapiens
cuggggaccucuugaauua

SEQ ID NO: 372717 - RNA, 19 nt, Homo sapiens
gcaugucauugugguaaga

SEQ ID NO: 372718 - RNA, 19 nt, Homo sapiens
gggaugaagcugaaaucaa

SEQ ID NO: 372719 - RNA, 19 nt, Homo sapiens
ggccuacuguccauuagug

SEQ ID NO: 372720 - RNA, 19 nt, Homo sapiens
ugagggcgaugauuaaacu

SEQ ID NO: 372721 - RNA, 19 nt, Homo sapiens
ucaguuaaauuaggacauc

SEQ ID NO: 372722 - RNA, 19 nt, Homo sapiens
ccagcacacuauccuugaa

SEQ ID NO: 372723 - RNA, 19 nt, Homo sapiens
ucugugagggcgaugauua

SEQ ID NO: 372724 - RNA, 19 nt, Homo sapiens
ccagguuccucaguuaaau

SEQ ID NO: 372725 - RNA, 19 nt, Homo sapiens
uacuuucacuuauggguuu

SEQ ID NO: 372726 - RNA, 19 nt, Homo sapiens
ggugaagggcggaagaaga

SEQ ID NO: 372727 - RNA, 19 nt, Homo sapiens
gcugugcaguguuuguguu

SEQ ID NO: 372728 - RNA, 19 nt, Homo sapiens
agugaugugguuucuauua

SEQ ID NO: 372729 - RNA, 19 nt, Homo sapiens
ggaaagguugguagaacau

SEQ ID NO: 372730 - RNA, 19 nt, Homo sapiens
uaaagacagaguuccauuc

SEQ ID NO: 372731 - RNA, 19 nt, Homo sapiens
caaggaaagguugguagaa

SEQ ID NO: 372732 - RNA, 19 nt, Homo sapiens
gcuguuaggccaucucauc

SEQ ID NO: 372733 - RNA, 19 nt, Homo sapiens
gauuggguauguuuuguuu

SEQ ID NO: 372734 - RNA, 19 nt, Homo sapiens
aaagguugguagaacauca

SEQ ID NO: 372735 - RNA, 19 nt, Homo sapiens
cagcaugucauugugguaa

SEQ ID NO: 372736 - RNA, 19 nt, Homo sapiens
aggaagacuuguccagguu

SEQ ID NO: 372737 - RNA, 19 nt, Homo sapiens
guauauggaugagggucuu

SEQ ID NO: 372738 - RNA, 19 nt, Homo sapiens
ucagagacaaauucaucua

SEQ ID NO: 372739 - RNA, 19 nt, Homo sapiens
aaacaaggaaagguuggua

SEQ ID NO: 372740 - RNA, 19 nt, Homo sapiens
ucucauugauggaggugaa

SEQ ID NO: 372741 - RNA, 19 nt, Homo sapiens
gaaacuaaaggcauguacu

SEQ ID NO: 372742 - RNA, 19 nt, Homo sapiens
ccucagagacaaauucauc

SEQ ID NO: 372743 - RNA, 19 nt, Homo sapiens
gaagaaacuaaaggcaugu

SEQ ID NO: 372744 - RNA, 19 nt, Homo sapiens
caucaacacagcauggaau

SEQ ID NO: 372745 - RNA, 19 nt, Homo sapiens
gugagggugcuuauccuuu

SEQ ID NO: 372746 - RNA, 19 nt, Homo sapiens
ucauugugguaagagaaua

SEQ ID NO: 372747 - RNA, 19 nt, Homo sapiens
cagagacaaauucaucuau

SEQ ID NO: 372748 - RNA, 19 nt, Homo sapiens
acauuugccauucagauuu

SEQ ID NO: 372749 - RNA, 19 nt, Homo sapiens
gcgcaacccuaggaacucu

SEQ ID NO: 372750 - RNA, 19 nt, Homo sapiens
acaagaaccaccuggacuu

SEQ ID NO: 372751 - RNA, 19 nt, Homo sapiens
guuaucuggugguauaugg

SEQ ID NO: 372752 - RNA, 19 nt, Homo sapiens
uuaaagacagaguuccauu

SEQ ID NO: 372753 - RNA, 19 nt, Homo sapiens
aggaaagguugguagaaca

SEQ ID NO: 372754 - RNA, 19 nt, Homo sapiens
ucauuacuuucacuuaugg

SEQ ID NO: 372755 - RNA, 19 nt, Homo sapiens
ggaggugaagggcggaaga

SEQ ID NO: 372756 - RNA, 19 nt, Homo sapiens
caagaaccaccuggacuuc

SEQ ID NO: 372757 - RNA, 19 nt, Homo sapiens
gaaccaccuggacuucugu

SEQ ID NO: 372758 - RNA, 19 nt, Homo sapiens
uauuaaagcaagcugauag

SEQ ID NO: 372759 - RNA, 19 nt, Homo sapiens
cauuguauccagcacacua

SEQ ID NO: 372760 - RNA, 19 nt, Homo sapiens
cugaagacccuuacagagu

SEQ ID NO: 372761 - RNA, 19 nt, Homo sapiens
gugaagggcggaagaagag

SEQ ID NO: 372762 - RNA, 19 nt, Homo sapiens
ucaaguggcagaaggucuu

SEQ ID NO: 372763 - RNA, 19 nt, Homo sapiens
aaagacagaguuccauucu

SEQ ID NO: 372764 - RNA, 19 nt, Homo sapiens
aaacuaaaggcauguacuc

SEQ ID NO: 372765 - RNA, 19 nt, Homo sapiens
cauccaugcucggaaauac

SEQ ID NO: 372766 - RNA, 19 nt, Homo sapiens
gccuugggaugaagcugaa

SEQ ID NO: 372767 - RNA, 19 nt, Homo sapiens
ugaugucuaucucaugucu

SEQ ID NO: 372768 - RNA, 19 nt, Homo sapiens
gaaagcaacuuacauacaa

SEQ ID NO: 372769 - RNA, 19 nt, Homo sapiens
gaaaugcuguaucuacuuu

SEQ ID NO: 372770 - RNA, 19 nt, Homo sapiens
gaaagaccauggcagguau

SEQ ID NO: 372771 - RNA, 19 nt, Homo sapiens
gauuguaccuucuaguuga

SEQ ID NO: 372772 - RNA, 19 nt, Homo sapiens
gagcaccacugauagaguu

SEQ ID NO: 372773 - RNA, 19 nt, Homo sapiens
ggaaagaccauggcaggua

SEQ ID NO: 372774 - RNA, 19 nt, Homo sapiens
ccaaauacauccucuaaaa

SEQ ID NO: 372775 - RNA, 19 nt, Homo sapiens
gaaacacacuugacauggu

SEQ ID NO: 372776 - RNA, 19 nt, Homo sapiens
gaaaacaccaugaaagaua

SEQ ID NO: 372777 - RNA, 19 nt, Homo sapiens
caacuuacauacaagaaca

SEQ ID NO: 372778 - RNA, 19 nt, Homo sapiens
gaacuucucaauauuggaa

SEQ ID NO: 372779 - RNA, 19 nt, Homo sapiens
guauggagcaccacugaua

SEQ ID NO: 372780 - RNA, 19 nt, Homo sapiens
cuacguggcuggccuuguu

SEQ ID NO: 372781 - RNA, 19 nt, Homo sapiens
cuaagaguguucaguagaa

SEQ ID NO: 372782 - RNA, 19 nt, Homo sapiens
aaacacacuugacaugguu

SEQ ID NO: 372783 - RNA, 19 nt, Homo sapiens
uuacguaguuacaacauga

SEQ ID NO: 372784 - RNA, 19 nt, Homo sapiens
gaaguucauuaucacacaa

SEQ ID NO: 372785 - RNA, 19 nt, Homo sapiens
gagauuguaccuucuaguu

SEQ ID NO: 372786 - RNA, 19 nt, Homo sapiens
uauccuaagugucuucauu

SEQ ID NO: 372787 - RNA, 19 nt, Homo sapiens
gagcaaagggagauauuuc

SEQ ID NO: 372788 - RNA, 19 nt, Homo sapiens
uggaauagaaagcaacuua

SEQ ID NO: 372789 - RNA, 19 nt, Homo sapiens
gaauagaaagcaacuuaca

SEQ ID NO: 372790 - RNA, 19 nt, Homo sapiens
ucaagagacuacuguauac

SEQ ID NO: 372791 - RNA, 19 nt, Homo sapiens
ggauauacuggaauagaaa

SEQ ID NO: 372792 - RNA, 19 nt, Homo sapiens
ucacuacaauuucuagcuu

SEQ ID NO: 372793 - RNA, 19 nt, Homo sapiens
ccaagcaguuccauuuaca

SEQ ID NO: 372794 - RNA, 19 nt, Homo sapiens
ccagaucacuacaauuucu

SEQ ID NO: 372795 - RNA, 19 nt, Homo sapiens
gcaaagggagauauuucuu

SEQ ID NO: 372796 - RNA, 19 nt, Homo sapiens
ucaauuauccuaagugucu

SEQ ID NO: 372797 - RNA, 19 nt, Homo sapiens
uaagaguguucaguagaaa

SEQ ID NO: 372798 - RNA, 19 nt, Homo sapiens
ugcuguaucuacuuucuua

SEQ ID NO: 372799 - RNA, 19 nt, Homo sapiens
uggauauacuggaauagaa

SEQ ID NO: 372800 - RNA, 19 nt, Homo sapiens
ggaccaaaccucaaagcau

SEQ ID NO: 372801 - RNA, 19 nt, Homo sapiens
uaacugcugucaaucuagu

SEQ ID NO: 372802 - RNA, 19 nt, Homo sapiens
uguaacugcugucaaucua

SEQ ID NO: 372803 - RNA, 19 nt, Homo sapiens
ggucaaagccaagcaguuc

SEQ ID NO: 372804 - RNA, 19 nt, Homo sapiens
cuaagugucuucauuccau

SEQ ID NO: 372805 - RNA, 19 nt, Homo sapiens
ggagcaaagggagauauuu

SEQ ID NO: 372806 - RNA, 19 nt, Homo sapiens
cuccagaucacuacaauuu

SEQ ID NO: 372807 - RNA, 19 nt, Homo sapiens
caguagaaauggaguuaca

SEQ ID NO: 372808 - RNA, 19 nt, Homo sapiens
gcaguuauuuugucuacuu

SEQ ID NO: 372809 - RNA, 19 nt, Homo sapiens
aagccaagcaguuccauuu

SEQ ID NO: 372810 - RNA, 19 nt, Homo sapiens
uggcuggccuuguuauuuc

SEQ ID NO: 372811 - RNA, 19 nt, Homo sapiens
gcuaagaguguucaguaga

SEQ ID NO: 372812 - RNA, 19 nt, Homo sapiens
ccucaaagcauggcuaaga

SEQ ID NO: 372813 - RNA, 19 nt, Homo sapiens
guagugaaaccaaauacau

SEQ ID NO: 372814 - RNA, 19 nt, Homo sapiens
gccaagcaguuccauuuac

SEQ ID NO: 372815 - RNA, 19 nt, Homo sapiens
gagagauuguaccuucuag

SEQ ID NO: 372816 - RNA, 19 nt, Homo sapiens
gauauuucuuugugcagau

SEQ ID NO: 372817 - RNA, 19 nt, Homo sapiens
gugccuugcuuauguuugu

SEQ ID NO: 372818 - RNA, 19 nt, Homo sapiens
cacacaagguaacuggauu

SEQ ID NO: 372819 - RNA, 19 nt, Homo sapiens
uuucaccacucuggauaua

SEQ ID NO: 372820 - RNA, 19 nt, Homo sapiens
uggcuaagaguguucagua

SEQ ID NO: 372821 - RNA, 19 nt, Homo sapiens
gcuuggagcacuuccuauu

SEQ ID NO: 372822 - RNA, 19 nt, Homo sapiens
ucuacuuucuuaugucuug

SEQ ID NO: 372823 - RNA, 19 nt, Homo sapiens
gauaucaagagacuacugu

SEQ ID NO: 372824 - RNA, 19 nt, Homo sapiens
guuaggaccaaaccucaaa

SEQ ID NO: 372825 - RNA, 19 nt, Homo sapiens
aaccaaauacauccucuaa

SEQ ID NO: 372826 - RNA, 19 nt, Homo sapiens
agggagauauuucuuugug

SEQ ID NO: 372827 - RNA, 19 nt, Homo sapiens
uuacuacugugccuugcuu

SEQ ID NO: 372828 - RNA, 19 nt, Homo sapiens
guaccuucuaguugaaaua

SEQ ID NO: 372829 - RNA, 19 nt, Homo sapiens
ucaccacucuggauauacu

SEQ ID NO: 372830 - RNA, 19 nt, Homo sapiens
cacuacaauuucuagcuuu

SEQ ID NO: 372831 - RNA, 19 nt, Homo sapiens
agaguuagcuagccaucca

SEQ ID NO: 372832 - RNA, 19 nt, Homo sapiens
aagcauggcuaagaguguu

SEQ ID NO: 372833 - RNA, 19 nt, Homo sapiens
ugagagauuguaccuucua

SEQ ID NO: 372834 - RNA, 19 nt, Homo sapiens
agaaagcaacuuacauaca

SEQ ID NO: 372835 - RNA, 19 nt, Homo sapiens
ggaauagaaagcaacuuac

SEQ ID NO: 372836 - RNA, 19 nt, Homo sapiens
uagcuagccauccaagaaa

SEQ ID NO: 372837 - RNA, 19 nt, Homo sapiens
guagaaauggaguuacauc

SEQ ID NO: 372838 - RNA, 19 nt, Homo sapiens
ccaugaaagauaacgauau

SEQ ID NO: 372839 - RNA, 19 nt, Homo sapiens
acacaagguaacuggauuu

SEQ ID NO: 372840 - RNA, 19 nt, Homo sapiens
agaaguucauuaucacaca

SEQ ID NO: 372841 - RNA, 19 nt, Homo sapiens
uaucaagagacuacuguau

SEQ ID NO: 372842 - RNA, 19 nt, Homo sapiens
aucaagagacuacuguaua

SEQ ID NO: 372843 - RNA, 19 nt, Homo sapiens
uuagcuagccauccaagaa

SEQ ID NO: 372844 - RNA, 19 nt, Homo sapiens
caucuguucugguuuugua

SEQ ID NO: 372845 - RNA, 19 nt, Homo sapiens
guggcuggccuuguuauuu

SEQ ID NO: 372846 - RNA, 19 nt, Homo sapiens
ggcuaagaguguucaguag

SEQ ID NO: 372847 - RNA, 19 nt, Homo sapiens
uuacauccauaugggagaa

SEQ ID NO: 372848 - RNA, 19 nt, Homo sapiens
ugaaaugcuguaucuacuu

SEQ ID NO: 372849 - RNA, 19 nt, Homo sapiens
cugucaaucuaguacuaua

SEQ ID NO: 372850 - RNA, 19 nt, Homo sapiens
gugcaucuguucugguuuu

SEQ ID NO: 372851 - RNA, 19 nt, Homo sapiens
ugacaugguugugcaucug

SEQ ID NO: 372852 - RNA, 19 nt, Homo sapiens
uacugugccuugcuuaugu

SEQ ID NO: 372853 - RNA, 19 nt, Homo sapiens
guaucuacuuucuuauguc

SEQ ID NO: 372854 - RNA, 19 nt, Homo sapiens
augaugugauuguagcuuu

SEQ ID NO: 372855 - RNA, 19 nt, Homo sapiens
agaauagucuccagaucac

SEQ ID NO: 372856 - RNA, 19 nt, Homo sapiens
uugcuuauguuuguuagga

SEQ ID NO: 372857 - RNA, 19 nt, Homo sapiens
ugucuuguuucuccuuuca

SEQ ID NO: 372858 - RNA, 19 nt, Homo sapiens
ccuucuaguugaaauaaag

SEQ ID NO: 372859 - RNA, 19 nt, Homo sapiens
uggaaacacacuugacaug

SEQ ID NO: 372860 - RNA, 19 nt, Homo sapiens
auacuggaauagaaagcaa

SEQ ID NO: 372861 - RNA, 19 nt, Homo sapiens
acuacaauuucuagcuuug

SEQ ID NO: 372862 - RNA, 19 nt, Homo sapiens
uguuucuccuuucauguaa

SEQ ID NO: 372863 - RNA, 19 nt, Homo sapiens
uaugucuuguuucuccuuu

SEQ ID NO: 372864 - RNA, 19 nt, Homo sapiens
gaugguaggaggcaguagu

SEQ ID NO: 372865 - RNA, 19 nt, Homo sapiens
acauccauaugggagaaua

SEQ ID NO: 372866 - RNA, 19 nt, Homo sapiens
aaagcaacuuacauacaag

SEQ ID NO: 372867 - RNA, 19 nt, Homo sapiens
caagaaaacaccaugaaag

SEQ ID NO: 372868 - RNA, 19 nt, Homo sapiens
gaaagcaacuuacauacaa

SEQ ID NO: 372869 - RNA, 19 nt, Homo sapiens
gaaaugcuguaucuacuuu

SEQ ID NO: 372870 - RNA, 19 nt, Homo sapiens
gaaagaccauggcagauga

SEQ ID NO: 372871 - RNA, 19 nt, Homo sapiens
gauuguaccuucuaguuga

SEQ ID NO: 372872 - RNA, 19 nt, Homo sapiens
gagcaccacugauagaguu

SEQ ID NO: 372873 - RNA, 19 nt, Homo sapiens
uuauagaucucuccaugua

SEQ ID NO: 372874 - RNA, 19 nt, Homo sapiens
ccaaauacauccucuaaaa

SEQ ID NO: 372875 - RNA, 19 nt, Homo sapiens
gaaacacacuugacauggu

SEQ ID NO: 372876 - RNA, 19 nt, Homo sapiens
gaaaacaccaugaaagaua

SEQ ID NO: 372877 - RNA, 19 nt, Homo sapiens
caacuuacauacaagaaca

SEQ ID NO: 372878 - RNA, 19 nt, Homo sapiens
gcagaugacaguagaaaga

SEQ ID NO: 372879 - RNA, 19 nt, Homo sapiens
gaacuucucaauauuggaa

SEQ ID NO: 372880 - RNA, 19 nt, Homo sapiens
guauggagcaccacugaua

SEQ ID NO: 372881 - RNA, 19 nt, Homo sapiens
cuacguggcuggccuuguu

SEQ ID NO: 372882 - RNA, 19 nt, Homo sapiens
aaacguagcacuuauagau

SEQ ID NO: 372883 - RNA, 19 nt, Homo sapiens
cuaagaguguucaguagaa

SEQ ID NO: 372884 - RNA, 19 nt, Homo sapiens
aaacacacuugacaugguu

SEQ ID NO: 372885 - RNA, 19 nt, Homo sapiens
uuacguaguuacaacauga

SEQ ID NO: 372886 - RNA, 19 nt, Homo sapiens
ggaaagaccauggcagaug

SEQ ID NO: 372887 - RNA, 19 nt, Homo sapiens
gaaguucauuaucacacaa

SEQ ID NO: 372888 - RNA, 19 nt, Homo sapiens
gagauuguaccuucuaguu

SEQ ID NO: 372889 - RNA, 19 nt, Homo sapiens
uauccuaagugucuucauu

SEQ ID NO: 372890 - RNA, 19 nt, Homo sapiens
gagcaaagggagauauuuc

SEQ ID NO: 372891 - RNA, 19 nt, Homo sapiens
uggaauagaaagcaacuua

SEQ ID NO: 372892 - RNA, 19 nt, Homo sapiens
gaauagaaagcaacuuaca

SEQ ID NO: 372893 - RNA, 19 nt, Homo sapiens
ucaagagacuacuguauac

SEQ ID NO: 372894 - RNA, 19 nt, Homo sapiens
ggauauacuggaauagaaa

SEQ ID NO: 372895 - RNA, 19 nt, Homo sapiens
ucacuacaauuucuagcuu

SEQ ID NO: 372896 - RNA, 19 nt, Homo sapiens
ccaagcaguuccauuuaca

SEQ ID NO: 372897 - RNA, 19 nt, Homo sapiens
ccagaucacuacaauuucu

SEQ ID NO: 372898 - RNA, 19 nt, Homo sapiens
gcaaagggagauauuucuu

SEQ ID NO: 372899 - RNA, 19 nt, Homo sapiens
ucaauuauccuaagugucu

SEQ ID NO: 372900 - RNA, 19 nt, Homo sapiens
uaagaguguucaguagaaa

SEQ ID NO: 372901 - RNA, 19 nt, Homo sapiens
ugcuguaucuacuuucuua

SEQ ID NO: 372902 - RNA, 19 nt, Homo sapiens
uggauauacuggaauagaa

SEQ ID NO: 372903 - RNA, 19 nt, Homo sapiens
ggaccaaaccucaaagcau

SEQ ID NO: 372904 - RNA, 19 nt, Homo sapiens
uaacugcugucaaucuagu

SEQ ID NO: 372905 - RNA, 19 nt, Homo sapiens
uguaacugcugucaaucua

SEQ ID NO: 372906 - RNA, 19 nt, Homo sapiens
ggucaaagccaagcaguuc

SEQ ID NO: 372907 - RNA, 19 nt, Homo sapiens
cuaagugucuucauuccau

SEQ ID NO: 372908 - RNA, 19 nt, Homo sapiens
ggagcaaagggagauauuu

SEQ ID NO: 372909 - RNA, 19 nt, Homo sapiens
cuccagaucacuacaauuu

SEQ ID NO: 372910 - RNA, 19 nt, Homo sapiens
caguagaaauggaguuaca

SEQ ID NO: 372911 - RNA, 19 nt, Homo sapiens
gcaguuauuuugucuacuu

SEQ ID NO: 372912 - RNA, 19 nt, Homo sapiens
aagccaagcaguuccauuu

SEQ ID NO: 372913 - RNA, 19 nt, Homo sapiens
uggcuggccuuguuauuuc

SEQ ID NO: 372914 - RNA, 19 nt, Homo sapiens
gaaaugaguaacuuaaucc

SEQ ID NO: 372915 - RNA, 19 nt, Homo sapiens
cauggcagaugacaguaga

SEQ ID NO: 372916 - RNA, 19 nt, Homo sapiens
gcuaagaguguucaguaga

SEQ ID NO: 372917 - RNA, 19 nt, Homo sapiens
ccucaaagcauggcuaaga

SEQ ID NO: 372918 - RNA, 19 nt, Homo sapiens
guagugaaaccaaauacau

SEQ ID NO: 372919 - RNA, 19 nt, Homo sapiens
gccaagcaguuccauuuac

SEQ ID NO: 372920 - RNA, 19 nt, Homo sapiens
gagagauuguaccuucuag

SEQ ID NO: 372921 - RNA, 19 nt, Homo sapiens
gauauuucuuugugcagau

SEQ ID NO: 372922 - RNA, 19 nt, Homo sapiens
caaccguagugcaagguau

SEQ ID NO: 372923 - RNA, 19 nt, Homo sapiens
gaaagaaaacguagcacuu

SEQ ID NO: 372924 - RNA, 19 nt, Homo sapiens
gugccuugcuuauguuugu

SEQ ID NO: 372925 - RNA, 19 nt, Homo sapiens
gaccauggcagaugacagu

SEQ ID NO: 372926 - RNA, 19 nt, Homo sapiens
cacacaagguaacuggauu

SEQ ID NO: 372927 - RNA, 19 nt, Homo sapiens
uuucaccacucuggauaua

SEQ ID NO: 372928 - RNA, 19 nt, Homo sapiens
gcuugguacugugaaauga

SEQ ID NO: 372929 - RNA, 19 nt, Homo sapiens
uggcuaagaguguucagua

SEQ ID NO: 372930 - RNA, 19 nt, Homo sapiens
gcuuggagcacuuccuauu

SEQ ID NO: 372931 - RNA, 19 nt, Homo sapiens
ucuacuuucuuaugucuug

SEQ ID NO: 372932 - RNA, 19 nt, Homo sapiens
gauaucaagagacuacugu

SEQ ID NO: 372933 - RNA, 19 nt, Homo sapiens
guuaggaccaaaccucaaa

SEQ ID NO: 372934 - RNA, 19 nt, Homo sapiens
aaccaaauacauccucuaa

SEQ ID NO: 372935 - RNA, 19 nt, Homo sapiens
agggagauauuucuuugug

SEQ ID NO: 372936 - RNA, 19 nt, Homo sapiens
aaagaaaacguagcacuua

SEQ ID NO: 372937 - RNA, 19 nt, Homo sapiens
uuacuacugugccuugcuu

SEQ ID NO: 372938 - RNA, 19 nt, Homo sapiens
guaccuucuaguugaaaua

SEQ ID NO: 372939 - RNA, 19 nt, Homo sapiens
agaguuagcuagccaucca

SEQ ID NO: 372940 - RNA, 19 nt, Homo sapiens
ucaccacucuggauauacu

SEQ ID NO: 372941 - RNA, 19 nt, Homo sapiens
cacuacaauuucuagcuuu

SEQ ID NO: 372942 - RNA, 19 nt, Homo sapiens
aagcauggcuaagaguguu

SEQ ID NO: 372943 - RNA, 19 nt, Homo sapiens
ugagagauuguaccuucua

SEQ ID NO: 372944 - RNA, 19 nt, Homo sapiens
ccaugaaagauaacgauau

SEQ ID NO: 372945 - RNA, 19 nt, Homo sapiens
agaaagcaacuuacauaca

SEQ ID NO: 372946 - RNA, 19 nt, Homo sapiens
ggaauagaaagcaacuuac

SEQ ID NO: 372947 - RNA, 19 nt, Homo sapiens
guagaaauggaguuacauc

SEQ ID NO: 372948 - RNA, 19 nt, Homo sapiens
uagcuagccauccaagaaa

SEQ ID NO: 372949 - RNA, 19 nt, Homo sapiens
acacaagguaacuggauuu

SEQ ID NO: 372950 - RNA, 19 nt, Homo sapiens
agaaguucauuaucacaca

SEQ ID NO: 372951 - RNA, 19 nt, Homo sapiens
uaucaagagacuacuguau

SEQ ID NO: 372952 - RNA, 19 nt, Homo sapiens
agaugacaguagaaagaaa

SEQ ID NO: 372953 - RNA, 19 nt, Homo sapiens
uuagcuagccauccaagaa

SEQ ID NO: 372954 - RNA, 19 nt, Homo sapiens
aucaagagacuacuguaua

SEQ ID NO: 372955 - RNA, 19 nt, Homo sapiens
caucuguucugguuuugua

SEQ ID NO: 372956 - RNA, 19 nt, Homo sapiens
guggcuggccuuguuauuu

SEQ ID NO: 372957 - RNA, 19 nt, Homo sapiens
ggcuaagaguguucaguag

SEQ ID NO: 372958 - RNA, 19 nt, Homo sapiens
gaaaacguagcacuuauag

SEQ ID NO: 372959 - RNA, 19 nt, Homo sapiens
uuacauccauaugggagaa

SEQ ID NO: 372960 - RNA, 19 nt, Homo sapiens
ugaaaugcuguaucuacuu

SEQ ID NO: 372961 - RNA, 19 nt, Homo sapiens
ugacaugguugugcaucug

SEQ ID NO: 372962 - RNA, 19 nt, Homo sapiens
cugucaaucuaguacuaua

SEQ ID NO: 372963 - RNA, 19 nt, Homo sapiens
gugcaucuguucugguuuu

SEQ ID NO: 372964 - RNA, 19 nt, Homo sapiens
cagaugacaguagaaagaa

SEQ ID NO: 372965 - RNA, 19 nt, Homo sapiens
uacugugccuugcuuaugu

SEQ ID NO: 372966 - RNA, 19 nt, Homo sapiens
guaucuacuuucuuauguc

SEQ ID NO: 372967 - RNA, 19 nt, Homo sapiens
augaugugauuguagcuuu

SEQ ID NO: 372968 - RNA, 19 nt, Homo sapiens
guacagggcuuauuuauuu

SEQ ID NO: 372969 - RNA, 19 nt, Homo sapiens
gcaggugacuggaaaucua

SEQ ID NO: 372970 - RNA, 19 nt, Homo sapiens
gaagaaauguccuacaaaa

SEQ ID NO: 372971 - RNA, 19 nt, Homo sapiens
agaaagcacuaccuucaua

SEQ ID NO: 372972 - RNA, 19 nt, Homo sapiens
ggaaaucuaacucaguaua

SEQ ID NO: 372973 - RNA, 19 nt, Homo sapiens
gagcggagcuuuucggaua

SEQ ID NO: 372974 - RNA, 19 nt, Homo sapiens
cuaagcauguucagguuua

SEQ ID NO: 372975 - RNA, 19 nt, Homo sapiens
caugggagaugacucuuaa

SEQ ID NO: 372976 - RNA, 19 nt, Homo sapiens
ggggagaccuuaagaauuu

SEQ ID NO: 372977 - RNA, 19 nt, Homo sapiens
gcacuaccuucauagaaau

SEQ ID NO: 372978 - RNA, 19 nt, Homo sapiens
ggacucucauguuaacaaa

SEQ ID NO: 372979 - RNA, 19 nt, Homo sapiens
ucaaggauauugucaucaa

SEQ ID NO: 372980 - RNA, 19 nt, Homo sapiens
gaucauaguauuucaguca

SEQ ID NO: 372981 - RNA, 19 nt, Homo sapiens
guucacagauagcugcuuu

SEQ ID NO: 372982 - RNA, 19 nt, Homo sapiens
ggaagaaauguccuacaaa

SEQ ID NO: 372983 - RNA, 19 nt, Homo sapiens
gcaaagaaagcacuaccuu

SEQ ID NO: 372984 - RNA, 19 nt, Homo sapiens
ccaagaaggaugagacaaa

SEQ ID NO: 372985 - RNA, 19 nt, Homo sapiens
aaacagaucuuccaaaaca

SEQ ID NO: 372986 - RNA, 19 nt, Homo sapiens
ugcagaaggugauuuacua

SEQ ID NO: 372987 - RNA, 19 nt, Homo sapiens
ggucaaggauauugucauc

SEQ ID NO: 372988 - RNA, 19 nt, Homo sapiens
aaaguaaugucagcaaaga

SEQ ID NO: 372989 - RNA, 19 nt, Homo sapiens
cuggaaaucuaacucagua

SEQ ID NO: 372990 - RNA, 19 nt, Homo sapiens
agaugacucuuaagccaua

SEQ ID NO: 372991 - RNA, 19 nt, Homo sapiens
ucuuaggucugcuugguua

SEQ ID NO: 372992 - RNA, 19 nt, Homo sapiens
aaagaaagcacuaccuuca

SEQ ID NO: 372993 - RNA, 19 nt, Homo sapiens
gaucaggagacucuguuaa

SEQ ID NO: 372994 - RNA, 19 nt, Homo sapiens
gggcuuauuuauuuacugu

SEQ ID NO: 372995 - RNA, 19 nt, Homo sapiens
cggcuggacugcuugauug

SEQ ID NO: 372996 - RNA, 19 nt, Homo sapiens
uagagcaggugacuggaaa

SEQ ID NO: 372997 - RNA, 19 nt, Homo sapiens
ccagaaagccacaucaaca

SEQ ID NO: 372998 - RNA, 19 nt, Homo sapiens
gacaaacaagaucauagua

SEQ ID NO: 372999 - RNA, 19 nt, Homo sapiens
ucagaugucuugagaaagc

SEQ ID NO: 373000 - RNA, 19 nt, Homo sapiens
gaagauugaucaggagacu

SEQ ID NO: 373001 - RNA, 19 nt, Homo sapiens
ggugucaagcacauuaaua

SEQ ID NO: 373002 - RNA, 19 nt, Homo sapiens
ggacugcuugauugaagua

SEQ ID NO: 373003 - RNA, 19 nt, Homo sapiens
guucagguuuacuuuguug

SEQ ID NO: 373004 - RNA, 19 nt, Homo sapiens
caagaaggaugagacaaaa

SEQ ID NO: 373005 - RNA, 19 nt, Homo sapiens
gaaagcacuaccuucauag

SEQ ID NO: 373006 - RNA, 19 nt, Homo sapiens
gacuucaucuuaugcuuca

SEQ ID NO: 373007 - RNA, 19 nt, Homo sapiens
acucucauguuaacaaaga

SEQ ID NO: 373008 - RNA, 19 nt, Homo sapiens
ccauuuacaugcagaaggu

SEQ ID NO: 373009 - RNA, 19 nt, Homo sapiens
caaaaguaaugucagcaaa

SEQ ID NO: 373010 - RNA, 19 nt, Homo sapiens
cagaaagccacaucaacaa

SEQ ID NO: 373011 - RNA, 19 nt, Homo sapiens
uuacuaccucugcaucuua

SEQ ID NO: 373012 - RNA, 19 nt, Homo sapiens
guuaccugguucacagaua

SEQ ID NO: 373013 - RNA, 19 nt, Homo sapiens
cacaguaugucaaaaguaa

SEQ ID NO: 373014 - RNA, 19 nt, Homo sapiens
agcacuaccuucauagaaa

SEQ ID NO: 373015 - RNA, 19 nt, Homo sapiens
cauggugucaagcacauua

SEQ ID NO: 373016 - RNA, 19 nt, Homo sapiens
ugacaaacaagaucauagu

SEQ ID NO: 373017 - RNA, 19 nt, Homo sapiens
cucaguauauuuccgugua

SEQ ID NO: 373018 - RNA, 19 nt, Homo sapiens
aacaagcccuucaguacug

SEQ ID NO: 373019 - RNA, 19 nt, Homo sapiens
gcuaagcauguucagguuu

SEQ ID NO: 373020 - RNA, 19 nt, Homo sapiens
caucuucaucacccucuua

SEQ ID NO: 373021 - RNA, 19 nt, Homo sapiens
ccaaguaguacccgucuuc

SEQ ID NO: 373022 - RNA, 19 nt, Homo sapiens
acaugcagaaggugauuua

SEQ ID NO: 373023 - RNA, 19 nt, Homo sapiens
ugggcaaggucaaggauau

SEQ ID NO: 373024 - RNA, 19 nt, Homo sapiens
caaccuagugccuguguuc

SEQ ID NO: 373025 - RNA, 19 nt, Homo sapiens
gguuuacuuuguugauguu

SEQ ID NO: 373026 - RNA, 19 nt, Homo sapiens
cauuauggauguagugcau

SEQ ID NO: 373027 - RNA, 19 nt, Homo sapiens
ccaugggagaugacucuua

SEQ ID NO: 373028 - RNA, 19 nt, Homo sapiens
ggacuuugguuuucagaca

SEQ ID NO: 373029 - RNA, 19 nt, Homo sapiens
gcauguucagguuuacuuu

SEQ ID NO: 373030 - RNA, 19 nt, Homo sapiens
ucaguauauuuccguguau

SEQ ID NO: 373031 - RNA, 19 nt, Homo sapiens
gucaagcacauuaauacuu

SEQ ID NO: 373032 - RNA, 19 nt, Homo sapiens
gcaaaacaaugggaaacug

SEQ ID NO: 373033 - RNA, 19 nt, Homo sapiens
caguauauuuccguguauu

SEQ ID NO: 373034 - RNA, 19 nt, Homo sapiens
ccucucugcugccaucuuc

SEQ ID NO: 373035 - RNA, 19 nt, Homo sapiens
gcaaggucaaggauauugu

SEQ ID NO: 373036 - RNA, 19 nt, Homo sapiens
gggacucucauguuaacaa

SEQ ID NO: 373037 - RNA, 19 nt, Homo sapiens
ccuagugccuguguucugu

SEQ ID NO: 373038 - RNA, 19 nt, Homo sapiens
agaaauguccuacaaaaga

SEQ ID NO: 373039 - RNA, 19 nt, Homo sapiens
cagguuuacuuuguugaug

SEQ ID NO: 373040 - RNA, 19 nt, Homo sapiens
caggugacuggaaaucuaa

SEQ ID NO: 373041 - RNA, 19 nt, Homo sapiens
gaacagcaugauccucucu

SEQ ID NO: 373042 - RNA, 19 nt, Homo sapiens
uuaccugguucacagauag

SEQ ID NO: 373043 - RNA, 19 nt, Homo sapiens
aaacaagcccuucaguacu

SEQ ID NO: 373044 - RNA, 19 nt, Homo sapiens
guaagguuuugccuacuuu

SEQ ID NO: 373045 - RNA, 19 nt, Homo sapiens
ucauagaaaugggcaaggu

SEQ ID NO: 373046 - RNA, 19 nt, Homo sapiens
ucauaguauuucagucaug

SEQ ID NO: 373047 - RNA, 19 nt, Homo sapiens
gaaauguccuacaaaagac

SEQ ID NO: 373048 - RNA, 19 nt, Homo sapiens
gcagaaggugauuuacuac

SEQ ID NO: 373049 - RNA, 19 nt, Homo sapiens
ugacuggaaaucuaacuca

SEQ ID NO: 373050 - RNA, 19 nt, Homo sapiens
uguacagggcuuauuuauu

SEQ ID NO: 373051 - RNA, 19 nt, Homo sapiens
ucuguacagggcuuauuua

SEQ ID NO: 373052 - RNA, 19 nt, Homo sapiens
aauaguaccccuuguguaa

SEQ ID NO: 373053 - RNA, 19 nt, Homo sapiens
acaguccuaggaaccauua

SEQ ID NO: 373054 - RNA, 19 nt, Homo sapiens
ggaaccacaugggauaucc

SEQ ID NO: 373055 - RNA, 19 nt, Homo sapiens
guacugguuagcaggaaga

SEQ ID NO: 373056 - RNA, 19 nt, Homo sapiens
aagcacuaccuucauagaa

SEQ ID NO: 373057 - RNA, 19 nt, Homo sapiens
ccucuuaggucugcuuggu

SEQ ID NO: 373058 - RNA, 19 nt, Homo sapiens
gagcaggugacuggaaauc

SEQ ID NO: 373059 - RNA, 19 nt, Homo sapiens
acugcuugauugaaguaua

SEQ ID NO: 373060 - RNA, 19 nt, Homo sapiens
ccucugcaucuuauugaaa

SEQ ID NO: 373061 - RNA, 19 nt, Homo sapiens
ggcaaggucaaggauauug

SEQ ID NO: 373062 - RNA, 19 nt, Homo sapiens
gggcaaggucaaggauauu

SEQ ID NO: 373063 - RNA, 19 nt, Homo sapiens
gcacauuaauacuuuucug

SEQ ID NO: 373064 - RNA, 19 nt, Homo sapiens
cuaccucugcaucuuauug

SEQ ID NO: 373065 - RNA, 19 nt, Homo sapiens
uacuaccucugcaucuuau

SEQ ID NO: 373066 - RNA, 19 nt, Homo sapiens
ucccuuggcauucagauga

SEQ ID NO: 373067 - RNA, 19 nt, Homo sapiens
cugcuugguuaucuccauu

SEQ ID NO: 373068 - RNA, 19 nt, Homo sapiens
ggacaaggauggcucauuc

SEQ ID NO: 373069 - RNA, 19 nt, Homo sapiens
ggaagaauacgccuugaua

SEQ ID NO: 373070 - RNA, 19 nt, Homo sapiens
gaacaaagccauucaggau

SEQ ID NO: 373071 - RNA, 19 nt, Homo sapiens
gaagaaugcugaccuccaa

SEQ ID NO: 373072 - RNA, 19 nt, Homo sapiens
gcagaacggugaccaucaa

SEQ ID NO: 373073 - RNA, 19 nt, Homo sapiens
gggcuaaccucaccaacuu

SEQ ID NO: 373074 - RNA, 19 nt, Homo sapiens
acaaucaccuucagaauca

SEQ ID NO: 373075 - RNA, 19 nt, Homo sapiens
gaacgucgaccgaguuuca

SEQ ID NO: 373076 - RNA, 19 nt, Homo sapiens
guccugggcuccuaaauga

SEQ ID NO: 373077 - RNA, 19 nt, Homo sapiens
ugaauaguguggaagguaa

SEQ ID NO: 373078 - RNA, 19 nt, Homo sapiens
gagaaauacuggugcaagu

SEQ ID NO: 373079 - RNA, 19 nt, Homo sapiens
caacuauacaggaagaaua

SEQ ID NO: 373080 - RNA, 19 nt, Homo sapiens
ggaaguggcuaaaacauug

SEQ ID NO: 373081 - RNA, 19 nt, Homo sapiens
gaagaauacgccuugauau

SEQ ID NO: 373082 - RNA, 19 nt, Homo sapiens
gcuccuaaaugacacuaaa

SEQ ID NO: 373083 - RNA, 19 nt, Homo sapiens
cacgaagagucccauauuu

SEQ ID NO: 373084 - RNA, 19 nt, Homo sapiens
cgaccgaguuucaaucaga

SEQ ID NO: 373085 - RNA, 19 nt, Homo sapiens
gaagaacgucgaccgaguu

SEQ ID NO: 373086 - RNA, 19 nt, Homo sapiens
gaucaagauuaucgaagga

SEQ ID NO: 373087 - RNA, 19 nt, Homo sapiens
caacugcccuuucaagacu

SEQ ID NO: 373088 - RNA, 19 nt, Homo sapiens
gggaugauuccaauaguaa

SEQ ID NO: 373089 - RNA, 19 nt, Homo sapiens
ggaggugaauaguguggaa

SEQ ID NO: 373090 - RNA, 19 nt, Homo sapiens
ccacgaagagucccauauu

SEQ ID NO: 373091 - RNA, 19 nt, Homo sapiens
gagaacagccggcuugucu

SEQ ID NO: 373092 - RNA, 19 nt, Homo sapiens
gccgaggccuguccuuuga

SEQ ID NO: 373093 - RNA, 19 nt, Homo sapiens
ccgaggaggugaauagugu

SEQ ID NO: 373094 - RNA, 19 nt, Homo sapiens
gagagaaggaaguggcuaa

SEQ ID NO: 373095 - RNA, 19 nt, Homo sapiens
gcaaggccuucgugaacug

SEQ ID NO: 373096 - RNA, 19 nt, Homo sapiens
ucacaggccugaggaagga

SEQ ID NO: 373097 - RNA, 19 nt, Homo sapiens
acacuaaagucuacacagu

SEQ ID NO: 373098 - RNA, 19 nt, Homo sapiens
caugggaugucaacagaau

SEQ ID NO: 373099 - RNA, 19 nt, Homo sapiens
gacaaucaccuucagaauc

SEQ ID NO: 373100 - RNA, 19 nt, Homo sapiens
guacugguguggagugaag

SEQ ID NO: 373101 - RNA, 19 nt, Homo sapiens
gaacggugaccaucaacug

SEQ ID NO: 373102 - RNA, 19 nt, Homo sapiens
gaccgaguuucaaucagaa

SEQ ID NO: 373103 - RNA, 19 nt, Homo sapiens
agcccgagcugguuuauga

SEQ ID NO: 373104 - RNA, 19 nt, Homo sapiens
gcaaaagcaucaaguacug

SEQ ID NO: 373105 - RNA, 19 nt, Homo sapiens
ccguggagaucaagauuau

SEQ ID NO: 373106 - RNA, 19 nt, Homo sapiens
ccagccaucuccacgaaga

SEQ ID NO: 373107 - RNA, 19 nt, Homo sapiens
gagauggccuacaaagacu

SEQ ID NO: 373108 - RNA, 19 nt, Homo sapiens
ccacugagagcaccacaga

SEQ ID NO: 373109 - RNA, 19 nt, Homo sapiens
cgagaacuccagggaauuu

SEQ ID NO: 373110 - RNA, 19 nt, Homo sapiens
caugcaaauucuccucgua

SEQ ID NO: 373111 - RNA, 19 nt, Homo sapiens
ggcaaacguggccaaauuu

SEQ ID NO: 373112 - RNA, 19 nt, Homo sapiens
gaggaggucccacuugcaa

SEQ ID NO: 373113 - RNA, 19 nt, Homo sapiens
ggagaucaagauuaucgaa

SEQ ID NO: 373114 - RNA, 19 nt, Homo sapiens
gcaaacguggccaaauuuc

SEQ ID NO: 373115 - RNA, 19 nt, Homo sapiens
caucaaagccuggccuaau

SEQ ID NO: 373116 - RNA, 19 nt, Homo sapiens
gaccaaagaacccaagaag

SEQ ID NO: 373117 - RNA, 19 nt, Homo sapiens
ccucaugggucccuugaag

SEQ ID NO: 373118 - RNA, 19 nt, Homo sapiens
aagccgagauggccuacaa

SEQ ID NO: 373119 - RNA, 19 nt, Homo sapiens
gaguuucaaucagaagcua

SEQ ID NO: 373120 - RNA, 19 nt, Homo sapiens
gaucaacgggagagaagga

SEQ ID NO: 373121 - RNA, 19 nt, Homo sapiens
cuacgucuccagcaaauau

SEQ ID NO: 373122 - RNA, 19 nt, Homo sapiens
gagagcugauugcagaaag

SEQ ID NO: 373123 - RNA, 19 nt, Homo sapiens
cgaagagucccauauuugg

SEQ ID NO: 373124 - RNA, 19 nt, Homo sapiens
aucaaagccuggccuaauu

SEQ ID NO: 373125 - RNA, 19 nt, Homo sapiens
ucaccaacuucccggagaa

SEQ ID NO: 373126 - RNA, 19 nt, Homo sapiens
cgagauggccuacaaagac

SEQ ID NO: 373127 - RNA, 19 nt, Homo sapiens
gcaccacagagaccaaaga

SEQ ID NO: 373128 - RNA, 19 nt, Homo sapiens
cggcagcucugaggaacaa

SEQ ID NO: 373129 - RNA, 19 nt, Homo sapiens
ccacuucuauggagagacu

SEQ ID NO: 373130 - RNA, 19 nt, Homo sapiens
gcuagagguggcugcauaa

SEQ ID NO: 373131 - RNA, 19 nt, Homo sapiens
ggagagcugauugcagaaa

SEQ ID NO: 373132 - RNA, 19 nt, Homo sapiens
uggcaacucuucgucaaug

SEQ ID NO: 373133 - RNA, 19 nt, Homo sapiens
gcccugagguggcaaacgu

SEQ ID NO: 373134 - RNA, 19 nt, Homo sapiens
ccuccucagugacaucaaa

SEQ ID NO: 373135 - RNA, 19 nt, Homo sapiens
gaagagucccauauuuggu

SEQ ID NO: 373136 - RNA, 19 nt, Homo sapiens
ucagguacggagaagaaua

SEQ ID NO: 373137 - RNA, 19 nt, Homo sapiens
ucaaagccuggccuaauug

SEQ ID NO: 373138 - RNA, 19 nt, Homo sapiens
gguggcagauacaagagau

SEQ ID NO: 373139 - RNA, 19 nt, Homo sapiens
ggcaacucuucgucaauga

SEQ ID NO: 373140 - RNA, 19 nt, Homo sapiens
ggggaugauuccaauagua

SEQ ID NO: 373141 - RNA, 19 nt, Homo sapiens
ggccuaauuguuccuauug

SEQ ID NO: 373142 - RNA, 19 nt, Homo sapiens
acgaagagucccauauuug

SEQ ID NO: 373143 - RNA, 19 nt, Homo sapiens
gugaauaguguggaaggua

SEQ ID NO: 373144 - RNA, 19 nt, Homo sapiens
gcaaauucuccucguacga

SEQ ID NO: 373145 - RNA, 19 nt, Homo sapiens
gcaacggcaccuucacugu

SEQ ID NO: 373146 - RNA, 19 nt, Homo sapiens
aaugaggaguccacgauuc

SEQ ID NO: 373147 - RNA, 19 nt, Homo sapiens
aaaugacacuaaagucuac

SEQ ID NO: 373148 - RNA, 19 nt, Homo sapiens
cuaaaugacacuaaagucu

SEQ ID NO: 373149 - RNA, 19 nt, Homo sapiens
gguccugggcuccuaaaug

SEQ ID NO: 373150 - RNA, 19 nt, Homo sapiens
gcagauacaagagaucaag

SEQ ID NO: 373151 - RNA, 19 nt, Homo sapiens
agcuagagguggcugcaua

SEQ ID NO: 373152 - RNA, 19 nt, Homo sapiens
gcagggccacuucuaugga

SEQ ID NO: 373153 - RNA, 19 nt, Homo sapiens
cagcaaggccuucgugaac

SEQ ID NO: 373154 - RNA, 19 nt, Homo sapiens
ucacuuuccaugcaaauuc

SEQ ID NO: 373155 - RNA, 19 nt, Homo sapiens
acaagcagauaggccugua

SEQ ID NO: 373156 - RNA, 19 nt, Homo sapiens
cgaggccuguccuuugaug

SEQ ID NO: 373157 - RNA, 19 nt, Homo sapiens
ccggagaacggcacauuug

SEQ ID NO: 373158 - RNA, 19 nt, Homo sapiens
ccucagguacggagaagaa

SEQ ID NO: 373159 - RNA, 19 nt, Homo sapiens
caaggaggaagccgagaug

SEQ ID NO: 373160 - RNA, 19 nt, Homo sapiens
caagauuaucgaaggagaa

SEQ ID NO: 373161 - RNA, 19 nt, Homo sapiens
aaacguggccaaauuucug

SEQ ID NO: 373162 - RNA, 19 nt, Homo sapiens
aaucccaacuauacaggaa

SEQ ID NO: 373163 - RNA, 19 nt, Homo sapiens
gaaaaggcgguggcagaua

SEQ ID NO: 373164 - RNA, 19 nt, Homo sapiens
ucaaugaggaguccacgau

SEQ ID NO: 373165 - RNA, 19 nt, Homo sapiens
gucaucgacuccagugguu

SEQ ID NO: 373166 - RNA, 19 nt, Homo sapiens
gaccaucaacugcccuuuc

SEQ ID NO: 373167 - RNA, 19 nt, Homo sapiens
ugggaugucaacagaauuu

SEQ ID NO: 373168 - RNA, 19 nt, Homo sapiens
ggacaaagaagaagcauua

SEQ ID NO: 373169 - RNA, 19 nt, Homo sapiens
caaagaagguuggcacuua

SEQ ID NO: 373170 - RNA, 19 nt, Homo sapiens
ucaaagaucuuguuacuga

SEQ ID NO: 373171 - RNA, 19 nt, Homo sapiens
ugagaaagcugaagggaua

SEQ ID NO: 373172 - RNA, 19 nt, Homo sapiens
gaagagagaucgacagcaa

SEQ ID NO: 373173 - RNA, 19 nt, Homo sapiens
gcaaagagacgguuaaaug

SEQ ID NO: 373174 - RNA, 19 nt, Homo sapiens
ccagauagcacacaauuua

SEQ ID NO: 373175 - RNA, 19 nt, Homo sapiens
caaggaagcuuaccuaucu

SEQ ID NO: 373176 - RNA, 19 nt, Homo sapiens
gaugauuccuucaggguua

SEQ ID NO: 373177 - RNA, 19 nt, Homo sapiens
aaagaaaggugaauggaaa

SEQ ID NO: 373178 - RNA, 19 nt, Homo sapiens
gaaauacaaucccucugaa

SEQ ID NO: 373179 - RNA, 19 nt, Homo sapiens
cauaaagacucaucacuug

SEQ ID NO: 373180 - RNA, 19 nt, Homo sapiens
uuaccaggcuuuccuaaua

SEQ ID NO: 373181 - RNA, 19 nt, Homo sapiens
gaaauuagacuacaacucu

SEQ ID NO: 373182 - RNA, 19 nt, Homo sapiens
gcacaaacccaggcuauuu

SEQ ID NO: 373183 - RNA, 19 nt, Homo sapiens
gaaauacaacccagauaaa

SEQ ID NO: 373184 - RNA, 19 nt, Homo sapiens
uauauuggcuucucaaaga

SEQ ID NO: 373185 - RNA, 19 nt, Homo sapiens
aggaggagcugugaaauua

SEQ ID NO: 373186 - RNA, 19 nt, Homo sapiens
ggcaagauauguuagcuuu

SEQ ID NO: 373187 - RNA, 19 nt, Homo sapiens
uaaaugggaugaacuaauc

SEQ ID NO: 373188 - RNA, 19 nt, Homo sapiens
gaacaacucagcuugcaaa

SEQ ID NO: 373189 - RNA, 19 nt, Homo sapiens
ggaaauacaaucccucuga

SEQ ID NO: 373190 - RNA, 19 nt, Homo sapiens
uagaaacacuagagaauga

SEQ ID NO: 373191 - RNA, 19 nt, Homo sapiens
gaauagugcuacagguuga

SEQ ID NO: 373192 - RNA, 19 nt, Homo sapiens
agaacuggcucuucaaauu

SEQ ID NO: 373193 - RNA, 19 nt, Homo sapiens
uauguuagcuuuacagaug

SEQ ID NO: 373194 - RNA, 19 nt, Homo sapiens
ggagaaacguuauuauugc

SEQ ID NO: 373195 - RNA, 19 nt, Homo sapiens
caaaauagcuaguacauca

SEQ ID NO: 373196 - RNA, 19 nt, Homo sapiens
ggaguaacccugccuuuga

SEQ ID NO: 373197 - RNA, 19 nt, Homo sapiens
caaguugacagaagcauua

SEQ ID NO: 373198 - RNA, 19 nt, Homo sapiens
gagacacccuguugaagaa

SEQ ID NO: 373199 - RNA, 19 nt, Homo sapiens
gaaagaaaggugaauggaa

SEQ ID NO: 373200 - RNA, 19 nt, Homo sapiens
gaggauaucaguaaauuug

SEQ ID NO: 373201 - RNA, 19 nt, Homo sapiens
gcucagauauuuagcaaca

SEQ ID NO: 373202 - RNA, 19 nt, Homo sapiens
cagaguggcuaaggaaaua

SEQ ID NO: 373203 - RNA, 19 nt, Homo sapiens
ggaaagcaaggacugauuu

SEQ ID NO: 373204 - RNA, 19 nt, Homo sapiens
guacaagcuuugaaauaug

SEQ ID NO: 373205 - RNA, 19 nt, Homo sapiens
gaacuggcucuucaaauug

SEQ ID NO: 373206 - RNA, 19 nt, Homo sapiens
acaaacaccuguaucaaau

SEQ ID NO: 373207 - RNA, 19 nt, Homo sapiens
gggagaaacguuauuauug

SEQ ID NO: 373208 - RNA, 19 nt, Homo sapiens
caacagcggauuuaaagaa

SEQ ID NO: 373209 - RNA, 19 nt, Homo sapiens
gggacaaucuccauauuuc

SEQ ID NO: 373210 - RNA, 19 nt, Homo sapiens
gcaaagaaacccuaagaca

SEQ ID NO: 373211 - RNA, 19 nt, Homo sapiens
uuacagaguuugaugaaug

SEQ ID NO: 373212 - RNA, 19 nt, Homo sapiens
caaaagauguggacaaaga

SEQ ID NO: 373213 - RNA, 19 nt, Homo sapiens
gcucauggaauuucaagua

SEQ ID NO: 373214 - RNA, 19 nt, Homo sapiens
agaagccagucuuuaaaua

SEQ ID NO: 373215 - RNA, 19 nt, Homo sapiens
gagcugacccaaauccaua

SEQ ID NO: 373216 - RNA, 19 nt, Homo sapiens
ggaaacuucuugauauucu

SEQ ID NO: 373217 - RNA, 19 nt, Homo sapiens
caacauaacuuagaaacac

SEQ ID NO: 373218 - RNA, 19 nt, Homo sapiens
ugaugugacuucuuuguuu

SEQ ID NO: 373219 - RNA, 19 nt, Homo sapiens
aggaagugcugcagaauaa

SEQ ID NO: 373220 - RNA, 19 nt, Homo sapiens
uaaacaggcugcauuccaa

SEQ ID NO: 373221 - RNA, 19 nt, Homo sapiens
gaaauuauccaucucuuac

SEQ ID NO: 373222 - RNA, 19 nt, Homo sapiens
gcagguuccuucaguccua

SEQ ID NO: 373223 - RNA, 19 nt, Homo sapiens
gaucugaggaugguaauuu

SEQ ID NO: 373224 - RNA, 19 nt, Homo sapiens
acaccuguauuaccaguua

SEQ ID NO: 373225 - RNA, 19 nt, Homo sapiens
gaguaacccugccuuugaa

SEQ ID NO: 373226 - RNA, 19 nt, Homo sapiens
cagagaacuuuaucuauuc

SEQ ID NO: 373227 - RNA, 19 nt, Homo sapiens
gaaggucuccauugacauu

SEQ ID NO: 373228 - RNA, 19 nt, Homo sapiens
caaaauggcuucaauccaa

SEQ ID NO: 373229 - RNA, 19 nt, Homo sapiens
ggauugaggccauuaguga

SEQ ID NO: 373230 - RNA, 19 nt, Homo sapiens
cagcuccaguuuacuauuu

SEQ ID NO: 373231 - RNA, 19 nt, Homo sapiens
aaacacccguggauuuaaa

SEQ ID NO: 373232 - RNA, 19 nt, Homo sapiens
ugaaacacccguggauuua

SEQ ID NO: 373233 - RNA, 19 nt, Homo sapiens
ggauuucagcuaccaguua

SEQ ID NO: 373234 - RNA, 19 nt, Homo sapiens
aaacccaggcuauuuguua

SEQ ID NO: 373235 - RNA, 19 nt, Homo sapiens
uucaggaacuucacaauaa

SEQ ID NO: 373236 - RNA, 19 nt, Homo sapiens
uuacuaggcuuauugaauc

SEQ ID NO: 373237 - RNA, 19 nt, Homo sapiens
gaaauacguuagagaugca

SEQ ID NO: 373238 - RNA, 19 nt, Homo sapiens
caggauccuuuaaagauaa

SEQ ID NO: 373239 - RNA, 19 nt, Homo sapiens
acaggauccuuuaaagaua

SEQ ID NO: 373240 - RNA, 19 nt, Homo sapiens
aaagggaaacuucuugaua

SEQ ID NO: 373241 - RNA, 19 nt, Homo sapiens
gaugugacuucuuuguuug

SEQ ID NO: 373242 - RNA, 19 nt, Homo sapiens
gaacagcagaagaugauga

SEQ ID NO: 373243 - RNA, 19 nt, Homo sapiens
ggacacagaaauuagacua

SEQ ID NO: 373244 - RNA, 19 nt, Homo sapiens
gaagccagucuuuaaauau

SEQ ID NO: 373245 - RNA, 19 nt, Homo sapiens
aagagacgguuaaauggua

SEQ ID NO: 373246 - RNA, 19 nt, Homo sapiens
cuacaacucuugaccuuca

SEQ ID NO: 373247 - RNA, 19 nt, Homo sapiens
gaggaagugcugcagaaua

SEQ ID NO: 373248 - RNA, 19 nt, Homo sapiens
aagcacagguuuauaacaa

SEQ ID NO: 373249 - RNA, 19 nt, Homo sapiens
caagauauguuagcuuuac

SEQ ID NO: 373250 - RNA, 19 nt, Homo sapiens
aagggaaacuucuugauau

SEQ ID NO: 373251 - RNA, 19 nt, Homo sapiens
gaaacacuagagaaugaua

SEQ ID NO: 373252 - RNA, 19 nt, Homo sapiens
caaaguagcaagaguguca

SEQ ID NO: 373253 - RNA, 19 nt, Homo sapiens
gccuacaacuugauaagaa

SEQ ID NO: 373254 - RNA, 19 nt, Homo sapiens
caaguaagcauaaaccaau

SEQ ID NO: 373255 - RNA, 19 nt, Homo sapiens
gaauaaucauugccuugga

SEQ ID NO: 373256 - RNA, 19 nt, Homo sapiens
gguauuagaccaugaggaa

SEQ ID NO: 373257 - RNA, 19 nt, Homo sapiens
ggacugauuuggagauaac

SEQ ID NO: 373258 - RNA, 19 nt, Homo sapiens
gaggagcugugaaauuauc

SEQ ID NO: 373259 - RNA, 19 nt, Homo sapiens
agaaauacaacccagauaa

SEQ ID NO: 373260 - RNA, 19 nt, Homo sapiens
ucagagaggcuuugaguug

SEQ ID NO: 373261 - RNA, 19 nt, Homo sapiens
caaaugggaccaguaguuu

SEQ ID NO: 373262 - RNA, 19 nt, Homo sapiens
gacaggauccuuuaaagau

SEQ ID NO: 373263 - RNA, 19 nt, Homo sapiens
cauuggaacuucuugauuc

SEQ ID NO: 373264 - RNA, 19 nt, Homo sapiens
agcaguagaucaaguaauu

SEQ ID NO: 373265 - RNA, 19 nt, Homo sapiens
gaaacacccguggauuuaa

SEQ ID NO: 373266 - RNA, 19 nt, Homo sapiens
gauaugucauggaaagaau

SEQ ID NO: 373267 - RNA, 19 nt, Homo sapiens
uaaacaaacaccuguauca

SEQ ID NO: 373268 - RNA, 19 nt, Homo sapiens
gggaggagcuaaacgguua

SEQ ID NO: 373269 - RNA, 19 nt, Homo sapiens
gaacauccgugucaucuuc

SEQ ID NO: 373270 - RNA, 19 nt, Homo sapiens
gaacuuggguugguuguga

SEQ ID NO: 373271 - RNA, 19 nt, Homo sapiens
acaaugagauguugguaua

SEQ ID NO: 373272 - RNA, 19 nt, Homo sapiens
cagcuggucucuaugaaua

SEQ ID NO: 373273 - RNA, 19 nt, Homo sapiens
ggaagacuauuuggacuuu

SEQ ID NO: 373274 - RNA, 19 nt, Homo sapiens
ccuauaugcuccugauuua

SEQ ID NO: 373275 - RNA, 19 nt, Homo sapiens
ggagggacuuugaauuuga

SEQ ID NO: 373276 - RNA, 19 nt, Homo sapiens
ggaagucccuggagucugu

SEQ ID NO: 373277 - RNA, 19 nt, Homo sapiens
gaacugacguuggcaggaa

SEQ ID NO: 373278 - RNA, 19 nt, Homo sapiens
gaacggaccauaaaugugu

SEQ ID NO: 373279 - RNA, 19 nt, Homo sapiens
ugucuucccuacuuuauua

SEQ ID NO: 373280 - RNA, 19 nt, Homo sapiens
gcaaagacaccucuggaaa

SEQ ID NO: 373281 - RNA, 19 nt, Homo sapiens
caucaacacuuucucuuug

SEQ ID NO: 373282 - RNA, 19 nt, Homo sapiens
caagagaggaagacuauuu

SEQ ID NO: 373283 - RNA, 19 nt, Homo sapiens
cagcaaaccguaaguuaua

SEQ ID NO: 373284 - RNA, 19 nt, Homo sapiens
gauggagacuucccacuga

SEQ ID NO: 373285 - RNA, 19 nt, Homo sapiens
ggaccgaccucaagcuguu

SEQ ID NO: 373286 - RNA, 19 nt, Homo sapiens
agaauuggcuggauauuuc

SEQ ID NO: 373287 - RNA, 19 nt, Homo sapiens
gaagagagagguucacugu

SEQ ID NO: 373288 - RNA, 19 nt, Homo sapiens
ggaauuacacaauaaguug

SEQ ID NO: 373289 - RNA, 19 nt, Homo sapiens
ggacgugggugacuuugug

SEQ ID NO: 373290 - RNA, 19 nt, Homo sapiens
gcucugacauccaagacua

SEQ ID NO: 373291 - RNA, 19 nt, Homo sapiens
uuaaagacaucaugcagaa

SEQ ID NO: 373292 - RNA, 19 nt, Homo sapiens
gccggaagcuucuggguuu

SEQ ID NO: 373293 - RNA, 19 nt, Homo sapiens
gaagaccagcgcaagcuua

SEQ ID NO: 373294 - RNA, 19 nt, Homo sapiens
gaaggugacuguguugugu

SEQ ID NO: 373295 - RNA, 19 nt, Homo sapiens
gcagagggaugguggagau

SEQ ID NO: 373296 - RNA, 19 nt, Homo sapiens
gaucucgacucacugcaaa

SEQ ID NO: 373297 - RNA, 19 nt, Homo sapiens
cagaagacauuugugcuuu

SEQ ID NO: 373298 - RNA, 19 nt, Homo sapiens
agagaucuguguacuguuu

SEQ ID NO: 373299 - RNA, 19 nt, Homo sapiens
caagagcucuggccgaauc

SEQ ID NO: 373300 - RNA, 19 nt, Homo sapiens
gcucugauccuacccuuaa

SEQ ID NO: 373301 - RNA, 19 nt, Homo sapiens
aaagagaucuguguacugu

SEQ ID NO: 373302 - RNA, 19 nt, Homo sapiens
gcagaggcuucacaguauu

SEQ ID NO: 373303 - RNA, 19 nt, Homo sapiens
ccacugggccuuucugauu

SEQ ID NO: 373304 - RNA, 19 nt, Homo sapiens
gcaauccuaccuacaauga

SEQ ID NO: 373305 - RNA, 19 nt, Homo sapiens
agagagagguucacuguag

SEQ ID NO: 373306 - RNA, 19 nt, Homo sapiens
ggauuggaguggugauuau

SEQ ID NO: 373307 - RNA, 19 nt, Homo sapiens
ucacaacccuccagaacug

SEQ ID NO: 373308 - RNA, 19 nt, Homo sapiens
uagcagaggcuucacagua

SEQ ID NO: 373309 - RNA, 19 nt, Homo sapiens
ccagauggauuuuacauuu

SEQ ID NO: 373310 - RNA, 19 nt, Homo sapiens
cagcauggaaguuuaaauu

SEQ ID NO: 373311 - RNA, 19 nt, Homo sapiens
gggagggacuuugaauuug

SEQ ID NO: 373312 - RNA, 19 nt, Homo sapiens
ucccuuaucucuucauauu

SEQ ID NO: 373313 - RNA, 19 nt, Homo sapiens
gagacugacucccuuaucu

SEQ ID NO: 373314 - RNA, 19 nt, Homo sapiens
caaaggcuauauauaugug

SEQ ID NO: 373315 - RNA, 19 nt, Homo sapiens
gcugagacccugcguaaga

SEQ ID NO: 373316 - RNA, 19 nt, Homo sapiens
guccuuagauguaguuuca

SEQ ID NO: 373317 - RNA, 19 nt, Homo sapiens
gcagcaaaguuuuaaguuu

SEQ ID NO: 373318 - RNA, 19 nt, Homo sapiens
gguuacaucuggcacuuga

SEQ ID NO: 373319 - RNA, 19 nt, Homo sapiens
gaccauaaauguguuacug

SEQ ID NO: 373320 - RNA, 19 nt, Homo sapiens
ccaacaaaggcuauauaua

SEQ ID NO: 373321 - RNA, 19 nt, Homo sapiens
ugaggagguugcugcauuu

SEQ ID NO: 373322 - RNA, 19 nt, Homo sapiens
gaacagagccaagcagaac

SEQ ID NO: 373323 - RNA, 19 nt, Homo sapiens
gcagcaaaccguaaguuau

SEQ ID NO: 373324 - RNA, 19 nt, Homo sapiens
gcagaaagaguccuuguac

SEQ ID NO: 373325 - RNA, 19 nt, Homo sapiens
gagaaagaagcuccauuga

SEQ ID NO: 373326 - RNA, 19 nt, Homo sapiens
gcagggagaguaagacaug

SEQ ID NO: 373327 - RNA, 19 nt, Homo sapiens
guucgacacuuaccacaau

SEQ ID NO: 373328 - RNA, 19 nt, Homo sapiens
uaaauguguuacuggcuuu

SEQ ID NO: 373329 - RNA, 19 nt, Homo sapiens
gaugaacggaccauaaaug

SEQ ID NO: 373330 - RNA, 19 nt, Homo sapiens
ccagaugaacggaccauaa

SEQ ID NO: 373331 - RNA, 19 nt, Homo sapiens
aaauagugauguuguccua

SEQ ID NO: 373332 - RNA, 19 nt, Homo sapiens
guggguggauaucuuaauu

SEQ ID NO: 373333 - RNA, 19 nt, Homo sapiens
cagacuggcugcagaaaca

SEQ ID NO: 373334 - RNA, 19 nt, Homo sapiens
gcuccuaaguccucagaug

SEQ ID NO: 373335 - RNA, 19 nt, Homo sapiens
gcaguucuuugcccucaau

SEQ ID NO: 373336 - RNA, 19 nt, Homo sapiens
ucacugaugcugacaagaa

SEQ ID NO: 373337 - RNA, 19 nt, Homo sapiens
ccaauacugccgcaaguuu

SEQ ID NO: 373338 - RNA, 19 nt, Homo sapiens
gagaagccaaagauuguuu

SEQ ID NO: 373339 - RNA, 19 nt, Homo sapiens
ucagagaagccaaagauug

SEQ ID NO: 373340 - RNA, 19 nt, Homo sapiens
cagaugaacggaccauaaa

SEQ ID NO: 373341 - RNA, 19 nt, Homo sapiens
ccaaagugcugggauuaca

SEQ ID NO: 373342 - RNA, 19 nt, Homo sapiens
gaagacauuugugcuuugg

SEQ ID NO: 373343 - RNA, 19 nt, Homo sapiens
gagaagggacguaccuaug

SEQ ID NO: 373344 - RNA, 19 nt, Homo sapiens
guauagagaaggaagaaga

SEQ ID NO: 373345 - RNA, 19 nt, Homo sapiens
ggacuuugaauuugauaug

SEQ ID NO: 373346 - RNA, 19 nt, Homo sapiens
gauguaguuucacccaaga

SEQ ID NO: 373347 - RNA, 19 nt, Homo sapiens
ccucuugucuucccuacuu

SEQ ID NO: 373348 - RNA, 19 nt, Homo sapiens
gccacuaccuacuucacua

SEQ ID NO: 373349 - RNA, 19 nt, Homo sapiens
augcugagcugcuagacua

SEQ ID NO: 373350 - RNA, 19 nt, Homo sapiens
gcuaccagcuaugaagauu

SEQ ID NO: 373351 - RNA, 19 nt, Homo sapiens
ugaacuaccucguccaucu

SEQ ID NO: 373352 - RNA, 19 nt, Homo sapiens
caacuguuccuccacugua

SEQ ID NO: 373353 - RNA, 19 nt, Homo sapiens
agagagagaugaggagguu

SEQ ID NO: 373354 - RNA, 19 nt, Homo sapiens
caauggccaugaguuguuu

SEQ ID NO: 373355 - RNA, 19 nt, Homo sapiens
uggaggaggugaagcaguu

SEQ ID NO: 373356 - RNA, 19 nt, Homo sapiens
caguuugccuugccaggua

SEQ ID NO: 373357 - RNA, 19 nt, Homo sapiens
aaacugucccucccuaauu

SEQ ID NO: 373358 - RNA, 19 nt, Homo sapiens
ccauaggucucucccuuca

SEQ ID NO: 373359 - RNA, 19 nt, Homo sapiens
ggcaagagaggaagacuau

SEQ ID NO: 373360 - RNA, 19 nt, Homo sapiens
cagagaagccaaagauugu

SEQ ID NO: 373361 - RNA, 19 nt, Homo sapiens
gagcuaaacgguuacaucu

SEQ ID NO: 373362 - RNA, 19 nt, Homo sapiens
gacaacaucaugcugaaga

SEQ ID NO: 373363 - RNA, 19 nt, Homo sapiens
ccugaccgcugccaucuug

SEQ ID NO: 373364 - RNA, 19 nt, Homo sapiens
ggucagcuggucucuauga

SEQ ID NO: 373365 - RNA, 19 nt, Homo sapiens
ggacuugcccugaauacca

SEQ ID NO: 373366 - RNA, 19 nt, Homo sapiens
ggagagcgcugugauaccu

SEQ ID NO: 373367 - RNA, 19 nt, Homo sapiens
caauaaacucuucaucaug

SEQ ID NO: 373368 - RNA, 19 nt, Homo sapiens
ggacaugucuuaaugcuua

SEQ ID NO: 373369 - RNA, 19 nt, Homo sapiens
ggaccgagcuccuuucauu

SEQ ID NO: 373370 - RNA, 19 nt, Homo sapiens
gaaaguacauggcagaaga

SEQ ID NO: 373371 - RNA, 19 nt, Homo sapiens
gcacaaaugucagccauaa

SEQ ID NO: 373372 - RNA, 19 nt, Homo sapiens
gaaacaagccugacagaaa

SEQ ID NO: 373373 - RNA, 19 nt, Homo sapiens
gaaagaaauuggcagacua

SEQ ID NO: 373374 - RNA, 19 nt, Homo sapiens
caacacaaccucuucauuu

SEQ ID NO: 373375 - RNA, 19 nt, Homo sapiens
gggaagaucuggagcacua

SEQ ID NO: 373376 - RNA, 19 nt, Homo sapiens
gaacuuugcugucgugcuu

SEQ ID NO: 373377 - RNA, 19 nt, Homo sapiens
gaaaguauccagacaaugu

SEQ ID NO: 373378 - RNA, 19 nt, Homo sapiens
gaacuaagucuaauucuuc

SEQ ID NO: 373379 - RNA, 19 nt, Homo sapiens
guaaauacuugucaucuuc

SEQ ID NO: 373380 - RNA, 19 nt, Homo sapiens
gaaaguagcauuccuccaa

SEQ ID NO: 373381 - RNA, 19 nt, Homo sapiens
gagaauagaaguaaucuug

SEQ ID NO: 373382 - RNA, 19 nt, Homo sapiens
caacagggcauucauuaaa

SEQ ID NO: 373383 - RNA, 19 nt, Homo sapiens
ccaaggacaugucuuaaug

SEQ ID NO: 373384 - RNA, 19 nt, Homo sapiens
gguaaagccuugaaugaug

SEQ ID NO: 373385 - RNA, 19 nt, Homo sapiens
ggacuugucuuccacuguu

SEQ ID NO: 373386 - RNA, 19 nt, Homo sapiens
guacauggcagaagaauau

SEQ ID NO: 373387 - RNA, 19 nt, Homo sapiens
gagaagaaguuuccagaca

SEQ ID NO: 373388 - RNA, 19 nt, Homo sapiens
guaaagccuugaaugauga

SEQ ID NO: 373389 - RNA, 19 nt, Homo sapiens
gcaaaaggcuugauagaga

SEQ ID NO: 373390 - RNA, 19 nt, Homo sapiens
gcacacaacauuccagaaa

SEQ ID NO: 373391 - RNA, 19 nt, Homo sapiens
gaaauccaguaaucuguau

SEQ ID NO: 373392 - RNA, 19 nt, Homo sapiens
caacugaacuauccacauc

SEQ ID NO: 373393 - RNA, 19 nt, Homo sapiens
uagacaaccucuugaauga

SEQ ID NO: 373394 - RNA, 19 nt, Homo sapiens
gaagguaacaacugaacua

SEQ ID NO: 373395 - RNA, 19 nt, Homo sapiens
caggaaagcuaucucgaaa

SEQ ID NO: 373396 - RNA, 19 nt, Homo sapiens
gauuccagauucaguauuu

SEQ ID NO: 373397 - RNA, 19 nt, Homo sapiens
gcaugaaauuugaugugua

SEQ ID NO: 373398 - RNA, 19 nt, Homo sapiens
ggccacauguuucauauug

SEQ ID NO: 373399 - RNA, 19 nt, Homo sapiens
gacaggagguacugaagaa

SEQ ID NO: 373400 - RNA, 19 nt, Homo sapiens
aaaugaagcacaccaaaua

SEQ ID NO: 373401 - RNA, 19 nt, Homo sapiens
gcagaagaauauagaguca

SEQ ID NO: 373402 - RNA, 19 nt, Homo sapiens
acaacuaggucgauugaaa

SEQ ID NO: 373403 - RNA, 19 nt, Homo sapiens
gcuuugccauugaagauua

SEQ ID NO: 373404 - RNA, 19 nt, Homo sapiens
gucaauagguuguuccauu

SEQ ID NO: 373405 - RNA, 19 nt, Homo sapiens
aaacagugauuguguacuu

SEQ ID NO: 373406 - RNA, 19 nt, Homo sapiens
gaaauuggcagacuagaag

SEQ ID NO: 373407 - RNA, 19 nt, Homo sapiens
caaccaacaaugcaaauuu

SEQ ID NO: 373408 - RNA, 19 nt, Homo sapiens
gcuaaucaaugucuacugu

SEQ ID NO: 373409 - RNA, 19 nt, Homo sapiens
guggaaaccaaacaaauua

SEQ ID NO: 373410 - RNA, 19 nt, Homo sapiens
gagcacuacuacagcauuu

SEQ ID NO: 373411 - RNA, 19 nt, Homo sapiens
gaagaaguuuccagacaag

SEQ ID NO: 373412 - RNA, 19 nt, Homo sapiens
gacaaccucuugaaugaug

SEQ ID NO: 373413 - RNA, 19 nt, Homo sapiens
aaacugcucccuuccuuua

SEQ ID NO: 373414 - RNA, 19 nt, Homo sapiens
uaugaaaccugauucugaa

SEQ ID NO: 373415 - RNA, 19 nt, Homo sapiens
uagagaagguaacaacuga

SEQ ID NO: 373416 - RNA, 19 nt, Homo sapiens
caaugucucuuaacacuca

SEQ ID NO: 373417 - RNA, 19 nt, Homo sapiens
ggaaagcuaucucgaaagc

SEQ ID NO: 373418 - RNA, 19 nt, Homo sapiens
gauaguagaugagaucagu

SEQ ID NO: 373419 - RNA, 19 nt, Homo sapiens
ccacacacuugcacaaaug

SEQ ID NO: 373420 - RNA, 19 nt, Homo sapiens
ggacugauaggaccauuga

SEQ ID NO: 373421 - RNA, 19 nt, Homo sapiens
ccaaauauccuugaaugaa

SEQ ID NO: 373422 - RNA, 19 nt, Homo sapiens
guaugaacaccaagaauuu

SEQ ID NO: 373423 - RNA, 19 nt, Homo sapiens
aggaaagucuggaguguuu

SEQ ID NO: 373424 - RNA, 19 nt, Homo sapiens
gaaacagacuccccuacua

SEQ ID NO: 373425 - RNA, 19 nt, Homo sapiens
gaagagaauagaaguaauc

SEQ ID NO: 373426 - RNA, 19 nt, Homo sapiens
gaauauagagucaauaggu

SEQ ID NO: 373427 - RNA, 19 nt, Homo sapiens
caccaaauauccuugaaug

SEQ ID NO: 373428 - RNA, 19 nt, Homo sapiens
acaaacaguugaaucauca

SEQ ID NO: 373429 - RNA, 19 nt, Homo sapiens
cauaagcccugccaaaucu

SEQ ID NO: 373430 - RNA, 19 nt, Homo sapiens
cuucagagauggaauacuu

SEQ ID NO: 373431 - RNA, 19 nt, Homo sapiens
ccaauucugugcagguaaa

SEQ ID NO: 373432 - RNA, 19 nt, Homo sapiens
ucaagaaauucguaaagug

SEQ ID NO: 373433 - RNA, 19 nt, Homo sapiens
gagucaacccucucaguua

SEQ ID NO: 373434 - RNA, 19 nt, Homo sapiens
gaauuagucuuuuguguug

SEQ ID NO: 373435 - RNA, 19 nt, Homo sapiens
gcuccaaggacaugucuua

SEQ ID NO: 373436 - RNA, 19 nt, Homo sapiens
gaaguuacaaacagugauu

SEQ ID NO: 373437 - RNA, 19 nt, Homo sapiens
ccaguaaucuguaucugau

SEQ ID NO: 373438 - RNA, 19 nt, Homo sapiens
gaacccugcccuauguaua

SEQ ID NO: 373439 - RNA, 19 nt, Homo sapiens
cagcugauguuaauuucaa

SEQ ID NO: 373440 - RNA, 19 nt, Homo sapiens
uagcaaagcaccagcaauu

SEQ ID NO: 373441 - RNA, 19 nt, Homo sapiens
caaaaucuguuccaaaaug

SEQ ID NO: 373442 - RNA, 19 nt, Homo sapiens
caagugauggacaauauuu

SEQ ID NO: 373443 - RNA, 19 nt, Homo sapiens
ccaaggagcagaaacuuau

SEQ ID NO: 373444 - RNA, 19 nt, Homo sapiens
gaccugaaauauguguaua

SEQ ID NO: 373445 - RNA, 19 nt, Homo sapiens
gguaacaacugaacuaucc

SEQ ID NO: 373446 - RNA, 19 nt, Homo sapiens
auacgagucuggccucuuu

SEQ ID NO: 373447 - RNA, 19 nt, Homo sapiens
guacugauugcaugaaauu

SEQ ID NO: 373448 - RNA, 19 nt, Homo sapiens
gcaauuaacauccgacucu

SEQ ID NO: 373449 - RNA, 19 nt, Homo sapiens
uaaaguggcaguucaacaa

SEQ ID NO: 373450 - RNA, 19 nt, Homo sapiens
cuacuacucucugaagaaa

SEQ ID NO: 373451 - RNA, 19 nt, Homo sapiens
aaacauauugccagacuuu

SEQ ID NO: 373452 - RNA, 19 nt, Homo sapiens
gagugagccucccguagaa

SEQ ID NO: 373453 - RNA, 19 nt, Homo sapiens
gggaauccaugcucacugu

SEQ ID NO: 373454 - RNA, 19 nt, Homo sapiens
ucaauagguuguuccauuc

SEQ ID NO: 373455 - RNA, 19 nt, Homo sapiens
gaacucuccuggcaucaag

SEQ ID NO: 373456 - RNA, 19 nt, Homo sapiens
gcaccuaccuuuuacaaau

SEQ ID NO: 373457 - RNA, 19 nt, Homo sapiens
guguuucccuguuaaauug

SEQ ID NO: 373458 - RNA, 19 nt, Homo sapiens
gcaaagauucaucgccauu

SEQ ID NO: 373459 - RNA, 19 nt, Homo sapiens
ccucuugaaugaugaacua

SEQ ID NO: 373460 - RNA, 19 nt, Homo sapiens
guucagagacuucagcaaa

SEQ ID NO: 373461 - RNA, 19 nt, Homo sapiens
caguauaauuucaccauug

SEQ ID NO: 373462 - RNA, 19 nt, Homo sapiens
cagugcacauguugaauuu

SEQ ID NO: 373463 - RNA, 19 nt, Homo sapiens
agaagaaguuuccagacaa

SEQ ID NO: 373464 - RNA, 19 nt, Homo sapiens
ccuaaugaaucacacgaaa

SEQ ID NO: 373465 - RNA, 19 nt, Homo sapiens
aaacaagccugacagaaaa

SEQ ID NO: 373466 - RNA, 19 nt, Homo sapiens
gauaggaccauugaaagaa

SEQ ID NO: 373467 - RNA, 19 nt, Homo sapiens
aguggcaguucaacaauua

SEQ ID NO: 373468 - RNA, 19 nt, Homo sapiens
auagauagcucccaaauua

SEQ ID NO: 373469 - RNA, 19 nt, Homo sapiens
caaugaagcugaauaaaga

SEQ ID NO: 373470 - RNA, 19 nt, Homo sapiens
gaacaacgguuucgcucuu

SEQ ID NO: 373471 - RNA, 19 nt, Homo sapiens
ggaggcaaauauccaguua

SEQ ID NO: 373472 - RNA, 19 nt, Homo sapiens
acucaacacuggcuaauua

SEQ ID NO: 373473 - RNA, 19 nt, Homo sapiens
gagcugauauccucucauu

SEQ ID NO: 373474 - RNA, 19 nt, Homo sapiens
gagcaaccuuuguauauug

SEQ ID NO: 373475 - RNA, 19 nt, Homo sapiens
cuggauagauugacauuua

SEQ ID NO: 373476 - RNA, 19 nt, Homo sapiens
gaaaguagauuggcuggau

SEQ ID NO: 373477 - RNA, 19 nt, Homo sapiens
ggaugucauugcuuaaaua

SEQ ID NO: 373478 - RNA, 19 nt, Homo sapiens
gagauguacuugaacguaa

SEQ ID NO: 373479 - RNA, 19 nt, Homo sapiens
ccacauagacuuuggauau

SEQ ID NO: 373480 - RNA, 19 nt, Homo sapiens
gguccaggcucucaaauau

SEQ ID NO: 373481 - RNA, 19 nt, Homo sapiens
ggagcaaccuuuguauauu

SEQ ID NO: 373482 - RNA, 19 nt, Homo sapiens
ggaacagauucacaaguuu

SEQ ID NO: 373483 - RNA, 19 nt, Homo sapiens
ggaaaugugucaaauucug

SEQ ID NO: 373484 - RNA, 19 nt, Homo sapiens
uagauuggcuggauagauu

SEQ ID NO: 373485 - RNA, 19 nt, Homo sapiens
gacaugcucugaucuuuau

SEQ ID NO: 373486 - RNA, 19 nt, Homo sapiens
gcuuagaccugucggauga

SEQ ID NO: 373487 - RNA, 19 nt, Homo sapiens
gcacacagagugagcagua

SEQ ID NO: 373488 - RNA, 19 nt, Homo sapiens
gcagagaaguuucacuaca

SEQ ID NO: 373489 - RNA, 19 nt, Homo sapiens
gaaguucucaggacuauau

SEQ ID NO: 373490 - RNA, 19 nt, Homo sapiens
gauauugcgugaucaccua

SEQ ID NO: 373491 - RNA, 19 nt, Homo sapiens
aggcaaauauccaguuaua

SEQ ID NO: 373492 - RNA, 19 nt, Homo sapiens
caacacuggcuaauuauuu

SEQ ID NO: 373493 - RNA, 19 nt, Homo sapiens
caggaaaugugucaaauuc

SEQ ID NO: 373494 - RNA, 19 nt, Homo sapiens
caccaaagcucaucgacaa

SEQ ID NO: 373495 - RNA, 19 nt, Homo sapiens
gauccaaacauuccagaua

SEQ ID NO: 373496 - RNA, 19 nt, Homo sapiens
caacagacauuuguagauc

SEQ ID NO: 373497 - RNA, 19 nt, Homo sapiens
gaauuuaguugagagcaaa

SEQ ID NO: 373498 - RNA, 19 nt, Homo sapiens
gaagcugaauaaagaaaug

SEQ ID NO: 373499 - RNA, 19 nt, Homo sapiens
gaaccuaccaagaaggaua

SEQ ID NO: 373500 - RNA, 19 nt, Homo sapiens
gauaucaacguccagcuua

SEQ ID NO: 373501 - RNA, 19 nt, Homo sapiens
gaacagauucacaaguuug

SEQ ID NO: 373502 - RNA, 19 nt, Homo sapiens
gaaagucuggccuaaugua

SEQ ID NO: 373503 - RNA, 19 nt, Homo sapiens
gaaaguggaaaucguaaga

SEQ ID NO: 373504 - RNA, 19 nt, Homo sapiens
gauaaagccuugaccaaaa

SEQ ID NO: 373505 - RNA, 19 nt, Homo sapiens
gcucugaucuuuauguuac

SEQ ID NO: 373506 - RNA, 19 nt, Homo sapiens
gaugguugauccaaacauu

SEQ ID NO: 373507 - RNA, 19 nt, Homo sapiens
ccaaguggcccucaccaua

SEQ ID NO: 373508 - RNA, 19 nt, Homo sapiens
cauggacacuuacguuaaa

SEQ ID NO: 373509 - RNA, 19 nt, Homo sapiens
gaucuuguuugggaguuua

SEQ ID NO: 373510 - RNA, 19 nt, Homo sapiens
gagacaugcucugaucuuu

SEQ ID NO: 373511 - RNA, 19 nt, Homo sapiens
uggaacagauucacaaguu

SEQ ID NO: 373512 - RNA, 19 nt, Homo sapiens
gaaauugacaccuuauaag

SEQ ID NO: 373513 - RNA, 19 nt, Homo sapiens
aaucuggacuugaaauuga

SEQ ID NO: 373514 - RNA, 19 nt, Homo sapiens
gacggaagauggaggcaaa

SEQ ID NO: 373515 - RNA, 19 nt, Homo sapiens
caaagacccaugagaugua

SEQ ID NO: 373516 - RNA, 19 nt, Homo sapiens
caagugugaugauaaggaa

SEQ ID NO: 373517 - RNA, 19 nt, Homo sapiens
ggcaaacucuuccacauag

SEQ ID NO: 373518 - RNA, 19 nt, Homo sapiens
caagaucucuguaccuucu

SEQ ID NO: 373519 - RNA, 19 nt, Homo sapiens
cacauagacuuuggauaua

SEQ ID NO: 373520 - RNA, 19 nt, Homo sapiens
gaaagaaaaucuggacuug

SEQ ID NO: 373521 - RNA, 19 nt, Homo sapiens
gcauggagaugauuuacgu

SEQ ID NO: 373522 - RNA, 19 nt, Homo sapiens
agaugucccuggagaauuu

SEQ ID NO: 373523 - RNA, 19 nt, Homo sapiens
caacguccagcuuaagaua

SEQ ID NO: 373524 - RNA, 19 nt, Homo sapiens
gugaucaccuauauacuug

SEQ ID NO: 373525 - RNA, 19 nt, Homo sapiens
gaagauggaggcaaauauc

SEQ ID NO: 373526 - RNA, 19 nt, Homo sapiens
gcgaaaaucuggaacaaga

SEQ ID NO: 373527 - RNA, 19 nt, Homo sapiens
caagaaggauagucagagu

SEQ ID NO: 373528 - RNA, 19 nt, Homo sapiens
agaagcagauggaucagaa

SEQ ID NO: 373529 - RNA, 19 nt, Homo sapiens
gaacauccuacaaagcauu

SEQ ID NO: 373530 - RNA, 19 nt, Homo sapiens
gagaacauccuacaaagca

SEQ ID NO: 373531 - RNA, 19 nt, Homo sapiens
ggagaugauuuacgucaag

SEQ ID NO: 373532 - RNA, 19 nt, Homo sapiens
gaugaggauuuguugaugu

SEQ ID NO: 373533 - RNA, 19 nt, Homo sapiens
gaucagaugagccgucuug

SEQ ID NO: 373534 - RNA, 19 nt, Homo sapiens
caaagcauuuaguacaaga

SEQ ID NO: 373535 - RNA, 19 nt, Homo sapiens
gggaagcauucagaacuuu

SEQ ID NO: 373536 - RNA, 19 nt, Homo sapiens
gaugauaaggaauauggua

SEQ ID NO: 373537 - RNA, 19 nt, Homo sapiens
guagcacucucucagaaga

SEQ ID NO: 373538 - RNA, 19 nt, Homo sapiens
aaacaggccuuggcacuuc

SEQ ID NO: 373539 - RNA, 19 nt, Homo sapiens
gagcaaacaccacaaccuu

SEQ ID NO: 373540 - RNA, 19 nt, Homo sapiens
gaaaauaugcaccaaguga

SEQ ID NO: 373541 - RNA, 19 nt, Homo sapiens
ggaagauggaggcaaauau

SEQ ID NO: 373542 - RNA, 19 nt, Homo sapiens
guacaacgcgaaaguggaa

SEQ ID NO: 373543 - RNA, 19 nt, Homo sapiens
gaaguuucacuacaucuau

SEQ ID NO: 373544 - RNA, 19 nt, Homo sapiens
gugaaacgaaguucuaauu

SEQ ID NO: 373545 - RNA, 19 nt, Homo sapiens
ccuuggaugucauugcuua

SEQ ID NO: 373546 - RNA, 19 nt, Homo sapiens
cagagaaguuucacuacau

SEQ ID NO: 373547 - RNA, 19 nt, Homo sapiens
gcaaacucuuccacauaga

SEQ ID NO: 373548 - RNA, 19 nt, Homo sapiens
guugugaccuggauaucaa

SEQ ID NO: 373549 - RNA, 19 nt, Homo sapiens
ugucagauguggaacuuau

SEQ ID NO: 373550 - RNA, 19 nt, Homo sapiens
gaauuugucagauguggaa

SEQ ID NO: 373551 - RNA, 19 nt, Homo sapiens
ggaacccgauggauguaga

SEQ ID NO: 373552 - RNA, 19 nt, Homo sapiens
ggaaauggaacccgaugga

SEQ ID NO: 373553 - RNA, 19 nt, Homo sapiens
cauccaagccacccacaua

SEQ ID NO: 373554 - RNA, 19 nt, Homo sapiens
aaaguagauuggcuggaua

SEQ ID NO: 373555 - RNA, 19 nt, Homo sapiens
cccaugagauguacuugaa

SEQ ID NO: 373556 - RNA, 19 nt, Homo sapiens
gaaugugaagaucaagaua

SEQ ID NO: 373557 - RNA, 19 nt, Homo sapiens
gauagcucccaaauuauaa

SEQ ID NO: 373558 - RNA, 19 nt, Homo sapiens
agauagcucccaaauuaua

SEQ ID NO: 373559 - RNA, 19 nt, Homo sapiens
gccaagggaugcaugacuu

SEQ ID NO: 373560 - RNA, 19 nt, Homo sapiens
augaagaggcugugcauua

SEQ ID NO: 373561 - RNA, 19 nt, Homo sapiens
caggauaaauuccgcuuag

SEQ ID NO: 373562 - RNA, 19 nt, Homo sapiens
ccaaugaagcugaauaaag

SEQ ID NO: 373563 - RNA, 19 nt, Homo sapiens
gaucaccuauauacuugga

SEQ ID NO: 373564 - RNA, 19 nt, Homo sapiens
gacaagcuguuacggaaag

SEQ ID NO: 373565 - RNA, 19 nt, Homo sapiens
gaagggaagagagaacaaa

SEQ ID NO: 373566 - RNA, 19 nt, Homo sapiens
gaacguaaugagaagauuc

SEQ ID NO: 373567 - RNA, 19 nt, Homo sapiens
gaaauagauagcucccaaa

SEQ ID NO: 373568 - RNA, 19 nt, Homo sapiens
uaaagaaacuccaugcuua

SEQ ID NO: 373569 - RNA, 19 nt, Homo sapiens
gcuaucaucugaacaauua

SEQ ID NO: 373570 - RNA, 19 nt, Homo sapiens
gcauugaacugaaagauaa

SEQ ID NO: 373571 - RNA, 19 nt, Homo sapiens
ggauagaggccaaauaaua

SEQ ID NO: 373572 - RNA, 19 nt, Homo sapiens
ggacaacuguuucauauag

SEQ ID NO: 373573 - RNA, 19 nt, Homo sapiens
gccaguaccucauggauua

SEQ ID NO: 373574 - RNA, 19 nt, Homo sapiens
gaaaauaucuggcaaaauc

SEQ ID NO: 373575 - RNA, 19 nt, Homo sapiens
gguuaaagauccugaagua

SEQ ID NO: 373576 - RNA, 19 nt, Homo sapiens
gacacaggauuucuuaaua

SEQ ID NO: 373577 - RNA, 19 nt, Homo sapiens
gaaagacgauggacaacug

SEQ ID NO: 373578 - RNA, 19 nt, Homo sapiens
ggaaugaauggcugaauua

SEQ ID NO: 373579 - RNA, 19 nt, Homo sapiens
gcaagaggcuuuggaguau

SEQ ID NO: 373580 - RNA, 19 nt, Homo sapiens
gaaagacccuagccuuaga

SEQ ID NO: 373581 - RNA, 19 nt, Homo sapiens
gaacgugugccauuuguuu

SEQ ID NO: 373582 - RNA, 19 nt, Homo sapiens
gaugaauacuuccuagaaa

SEQ ID NO: 373583 - RNA, 19 nt, Homo sapiens
gguaauaguuucuccaaau

SEQ ID NO: 373584 - RNA, 19 nt, Homo sapiens
gaagcaggauuuagcuauu

SEQ ID NO: 373585 - RNA, 19 nt, Homo sapiens
cuuaaagagugucgaauua

SEQ ID NO: 373586 - RNA, 19 nt, Homo sapiens
uaacugacauucucaaaca

SEQ ID NO: 373587 - RNA, 19 nt, Homo sapiens
ggagaacccuuaugugaca

SEQ ID NO: 373588 - RNA, 19 nt, Homo sapiens
ccaaauugcuucugucugu

SEQ ID NO: 373589 - RNA, 19 nt, Homo sapiens
caagagaauuugagagguu

SEQ ID NO: 373590 - RNA, 19 nt, Homo sapiens
gaacagcucaaagcaauuu

SEQ ID NO: 373591 - RNA, 19 nt, Homo sapiens
gaggagaacccuuauguga

SEQ ID NO: 373592 - RNA, 19 nt, Homo sapiens
caaaugaggcgaccagauu

SEQ ID NO: 373593 - RNA, 19 nt, Homo sapiens
ugacaaacuuucucaguau

SEQ ID NO: 373594 - RNA, 19 nt, Homo sapiens
ccagauguauugcuuggua

SEQ ID NO: 373595 - RNA, 19 nt, Homo sapiens
gacaaugaauuaagggaaa

SEQ ID NO: 373596 - RNA, 19 nt, Homo sapiens
gauccucaaucgagaaauu

SEQ ID NO: 373597 - RNA, 19 nt, Homo sapiens
gaacagcauuagauuuaca

SEQ ID NO: 373598 - RNA, 19 nt, Homo sapiens
caagaacaaaggagaaaua

SEQ ID NO: 373599 - RNA, 19 nt, Homo sapiens
gauagugacuuuagaaugc

SEQ ID NO: 373600 - RNA, 19 nt, Homo sapiens
gccaaucucuucauaaauc

SEQ ID NO: 373601 - RNA, 19 nt, Homo sapiens
gcacaaagacaagagaauu

SEQ ID NO: 373602 - RNA, 19 nt, Homo sapiens
gaggaaggaugaaacacaa

SEQ ID NO: 373603 - RNA, 19 nt, Homo sapiens
cgaauuaugucuucugcaa

SEQ ID NO: 373604 - RNA, 19 nt, Homo sapiens
uaacuuaacugacauucuc

SEQ ID NO: 373605 - RNA, 19 nt, Homo sapiens
gcgaaauucucacacuauu

SEQ ID NO: 373606 - RNA, 19 nt, Homo sapiens
uaaagagugucgaauuaug

SEQ ID NO: 373607 - RNA, 19 nt, Homo sapiens
gaagaaagcauugacuaau

SEQ ID NO: 373608 - RNA, 19 nt, Homo sapiens
augaauggcugaauuauga

SEQ ID NO: 373609 - RNA, 19 nt, Homo sapiens
gugguaaaguucccagaua

SEQ ID NO: 373610 - RNA, 19 nt, Homo sapiens
gcacuuaaacuaguucauu

SEQ ID NO: 373611 - RNA, 19 nt, Homo sapiens
gcaugccaaucucuucaua

SEQ ID NO: 373612 - RNA, 19 nt, Homo sapiens
gcuuagaguuggaguuuga

SEQ ID NO: 373613 - RNA, 19 nt, Homo sapiens
caggauuucuuaauaguga

SEQ ID NO: 373614 - RNA, 19 nt, Homo sapiens
ggagaucgucacaauagua

SEQ ID NO: 373615 - RNA, 19 nt, Homo sapiens
ccagauaugucagugauug

SEQ ID NO: 373616 - RNA, 19 nt, Homo sapiens
ggagaaacaucuacaaaau

SEQ ID NO: 373617 - RNA, 19 nt, Homo sapiens
gaugaaacaagacgacuuu

SEQ ID NO: 373618 - RNA, 19 nt, Homo sapiens
gacccuagccuuagauaaa

SEQ ID NO: 373619 - RNA, 19 nt, Homo sapiens
caagauaugcuaacacuuc

SEQ ID NO: 373620 - RNA, 19 nt, Homo sapiens
gaaaauacccucuccauca

SEQ ID NO: 373621 - RNA, 19 nt, Homo sapiens
cgacuuugccuuuccauuu

SEQ ID NO: 373622 - RNA, 19 nt, Homo sapiens
auaagaagcuguauaaugc

SEQ ID NO: 373623 - RNA, 19 nt, Homo sapiens
gauagaggccaaauaauag

SEQ ID NO: 373624 - RNA, 19 nt, Homo sapiens
gaacuucuggacuguaauu

SEQ ID NO: 373625 - RNA, 19 nt, Homo sapiens
ugccaaagcacauauauaa

SEQ ID NO: 373626 - RNA, 19 nt, Homo sapiens
caccagagcugccaaagca

SEQ ID NO: 373627 - RNA, 19 nt, Homo sapiens
ugccagaacuacaaucuuu

SEQ ID NO: 373628 - RNA, 19 nt, Homo sapiens
ccaaauggaaugauaguga

SEQ ID NO: 373629 - RNA, 19 nt, Homo sapiens
gaggaacacuguccauugg

SEQ ID NO: 373630 - RNA, 19 nt, Homo sapiens
ugaagaugauggcuaaaga

SEQ ID NO: 373631 - RNA, 19 nt, Homo sapiens
gaacuacaaucuuuugaug

SEQ ID NO: 373632 - RNA, 19 nt, Homo sapiens
gaaugauagugacuuuaga

SEQ ID NO: 373633 - RNA, 19 nt, Homo sapiens
gcccaagaaugcacaaaga

SEQ ID NO: 373634 - RNA, 19 nt, Homo sapiens
uaaaggagcccaagaaugc

SEQ ID NO: 373635 - RNA, 19 nt, Homo sapiens
gacaaacuuucucaguauu

SEQ ID NO: 373636 - RNA, 19 nt, Homo sapiens
ucacugagcaggagaaaga

SEQ ID NO: 373637 - RNA, 19 nt, Homo sapiens
gaaguauguugcuaucauc

SEQ ID NO: 373638 - RNA, 19 nt, Homo sapiens
gauagcacuuaaacuaguu

SEQ ID NO: 373639 - RNA, 19 nt, Homo sapiens
gauggacaacuguuucaua

SEQ ID NO: 373640 - RNA, 19 nt, Homo sapiens
cuaggaaaccucaggcuua

SEQ ID NO: 373641 - RNA, 19 nt, Homo sapiens
aagaacagcucaaagcaau

SEQ ID NO: 373642 - RNA, 19 nt, Homo sapiens
gaugauggcuaaagaaagc

SEQ ID NO: 373643 - RNA, 19 nt, Homo sapiens
ggaaugauagugacuuuag

SEQ ID NO: 373644 - RNA, 19 nt, Homo sapiens
uaggaaaccucaggcuuaa

SEQ ID NO: 373645 - RNA, 19 nt, Homo sapiens
agaaagcauugacuaauca

SEQ ID NO: 373646 - RNA, 19 nt, Homo sapiens
uaacuugcuugugagauuu

SEQ ID NO: 373647 - RNA, 19 nt, Homo sapiens
gauccucucucugaaauca

SEQ ID NO: 373648 - RNA, 19 nt, Homo sapiens
gaagaugauggcuaaagaa

SEQ ID NO: 373649 - RNA, 19 nt, Homo sapiens
caaauaaugacaagcagaa

SEQ ID NO: 373650 - RNA, 19 nt, Homo sapiens
caugguggcuggacaacaa

SEQ ID NO: 373651 - RNA, 19 nt, Homo sapiens
gagaacgugugccauuugu

SEQ ID NO: 373652 - RNA, 19 nt, Homo sapiens
uuggauaacuugcuuguga

SEQ ID NO: 373653 - RNA, 19 nt, Homo sapiens
guaauuacccagauccuau

SEQ ID NO: 373654 - RNA, 19 nt, Homo sapiens
gaaguagcccagauguauu

SEQ ID NO: 373655 - RNA, 19 nt, Homo sapiens
cagacuagcuagagacaau

SEQ ID NO: 373656 - RNA, 19 nt, Homo sapiens
guaacagacuagcuagaga

SEQ ID NO: 373657 - RNA, 19 nt, Homo sapiens
aaagaccgauugcauagga

SEQ ID NO: 373658 - RNA, 19 nt, Homo sapiens
acacaggauuucuuaauag

SEQ ID NO: 373659 - RNA, 19 nt, Homo sapiens
gagaucgucacaauaguaa

SEQ ID NO: 373660 - RNA, 19 nt, Homo sapiens
gugcaaaggcggcuugaaa

SEQ ID NO: 373661 - RNA, 19 nt, Homo sapiens
guauguugcuaucaucuga

SEQ ID NO: 373662 - RNA, 19 nt, Homo sapiens
aaacugagcaagaggcuuu

SEQ ID NO: 373663 - RNA, 19 nt, Homo sapiens
uuacaaggcuuaucuagcu

SEQ ID NO: 373664 - RNA, 19 nt, Homo sapiens
cgaaauucucacacuauua

SEQ ID NO: 373665 - RNA, 19 nt, Homo sapiens
gaugauuuacggcaagaua

SEQ ID NO: 373666 - RNA, 19 nt, Homo sapiens
caugugggauguauuugaa

SEQ ID NO: 373667 - RNA, 19 nt, Homo sapiens
ugaagaaagcauugacuaa

SEQ ID NO: 373668 - RNA, 19 nt, Homo sapiens
ggaagcaaguucacaauua

SEQ ID NO: 373669 - RNA, 19 nt, Homo sapiens
guacugagcuccuguguaa

SEQ ID NO: 373670 - RNA, 19 nt, Homo sapiens
gaaagaagcugguuuggau

SEQ ID NO: 373671 - RNA, 19 nt, Homo sapiens
uaacaacccuuuccaaauu

SEQ ID NO: 373672 - RNA, 19 nt, Homo sapiens
ggaauaaacuugaggaugu

SEQ ID NO: 373673 - RNA, 19 nt, Homo sapiens
gaagaaauguugaauccaa

SEQ ID NO: 373674 - RNA, 19 nt, Homo sapiens
uaaggacucucuugcauua

SEQ ID NO: 373675 - RNA, 19 nt, Homo sapiens
ugaacuggcuuaaagaaua

SEQ ID NO: 373676 - RNA, 19 nt, Homo sapiens
ccacuggaauuugauauua

SEQ ID NO: 373677 - RNA, 19 nt, Homo sapiens
gaaaaggucugcaugaauu

SEQ ID NO: 373678 - RNA, 19 nt, Homo sapiens
gagcaccucugaaacaauu

SEQ ID NO: 373679 - RNA, 19 nt, Homo sapiens
gaagcuaccauuucuuaua

SEQ ID NO: 373680 - RNA, 19 nt, Homo sapiens
gaaggauccugaaguaaau

SEQ ID NO: 373681 - RNA, 19 nt, Homo sapiens
caacaaagaugcccuucug

SEQ ID NO: 373682 - RNA, 19 nt, Homo sapiens
gaaucagacugcuguauau

SEQ ID NO: 373683 - RNA, 19 nt, Homo sapiens
gcacauuccugcugucuca

SEQ ID NO: 373684 - RNA, 19 nt, Homo sapiens
ggaaugaaccacuggaauu

SEQ ID NO: 373685 - RNA, 19 nt, Homo sapiens
cauagaggcugccauaaau

SEQ ID NO: 373686 - RNA, 19 nt, Homo sapiens
gaggaugcauaucugauuu

SEQ ID NO: 373687 - RNA, 19 nt, Homo sapiens
cgacaagacugccgagaga

SEQ ID NO: 373688 - RNA, 19 nt, Homo sapiens
aagaauggcucgauuaugu

SEQ ID NO: 373689 - RNA, 19 nt, Homo sapiens
ucacaucagucaaagauau

SEQ ID NO: 373690 - RNA, 19 nt, Homo sapiens
gaaggaagaugaaguuagc

SEQ ID NO: 373691 - RNA, 19 nt, Homo sapiens
gggaagcuaccauuucuua

SEQ ID NO: 373692 - RNA, 19 nt, Homo sapiens
ggacauauucuuggaaauu

SEQ ID NO: 373693 - RNA, 19 nt, Homo sapiens
ucucagaacucuauguuga

SEQ ID NO: 373694 - RNA, 19 nt, Homo sapiens
gaagcaaguucacaauuac

SEQ ID NO: 373695 - RNA, 19 nt, Homo sapiens
agggaaagcuggacuacua

SEQ ID NO: 373696 - RNA, 19 nt, Homo sapiens
gaacuggagacauaauauu

SEQ ID NO: 373697 - RNA, 19 nt, Homo sapiens
gaaugaaccacuggaauuu

SEQ ID NO: 373698 - RNA, 19 nt, Homo sapiens
ucaagugucuccuaauaug

SEQ ID NO: 373699 - RNA, 19 nt, Homo sapiens
gaauaaacuugaggauguu

SEQ ID NO: 373700 - RNA, 19 nt, Homo sapiens
cuaauucaguuccaguaua

SEQ ID NO: 373701 - RNA, 19 nt, Homo sapiens
caucguagcuguucauuuu

SEQ ID NO: 373702 - RNA, 19 nt, Homo sapiens
ggccagcucuuccacauug

SEQ ID NO: 373703 - RNA, 19 nt, Homo sapiens
ugaaacaauugcugacauu

SEQ ID NO: 373704 - RNA, 19 nt, Homo sapiens
gguauacaauaacaaggua

SEQ ID NO: 373705 - RNA, 19 nt, Homo sapiens
gaugagugaugaagaacuu

SEQ ID NO: 373706 - RNA, 19 nt, Homo sapiens
gaacuggcuuaaagaauac

SEQ ID NO: 373707 - RNA, 19 nt, Homo sapiens
ggauucaguuggagugauu

SEQ ID NO: 373708 - RNA, 19 nt, Homo sapiens
ugaaugccgugaaguuaaa

SEQ ID NO: 373709 - RNA, 19 nt, Homo sapiens
cccuagagcuucuggauuu

SEQ ID NO: 373710 - RNA, 19 nt, Homo sapiens
cgaaauucaucuaaucuuc

SEQ ID NO: 373711 - RNA, 19 nt, Homo sapiens
gaaguuagccccuaugauu

SEQ ID NO: 373712 - RNA, 19 nt, Homo sapiens
ccaguacguucgagaauau

SEQ ID NO: 373713 - RNA, 19 nt, Homo sapiens
uuucaagugucuccuaaua

SEQ ID NO: 373714 - RNA, 19 nt, Homo sapiens
gaaguuaaacagagccaaa

SEQ ID NO: 373715 - RNA, 19 nt, Homo sapiens
aagaagcacucaaacaguu

SEQ ID NO: 373716 - RNA, 19 nt, Homo sapiens
gaacucacaucagucaaag

SEQ ID NO: 373717 - RNA, 19 nt, Homo sapiens
ggccaugcauaccuguuua

SEQ ID NO: 373718 - RNA, 19 nt, Homo sapiens
cauguuaaauuuccagaga

SEQ ID NO: 373719 - RNA, 19 nt, Homo sapiens
auugagaacuggagacaua

SEQ ID NO: 373720 - RNA, 19 nt, Homo sapiens
ggcgguggauucacagaua

SEQ ID NO: 373721 - RNA, 19 nt, Homo sapiens
ggaccgagccauugaggaa

SEQ ID NO: 373722 - RNA, 19 nt, Homo sapiens
gagaacuggagacauaaua

SEQ ID NO: 373723 - RNA, 19 nt, Homo sapiens
caaauugucuugguuaagg

SEQ ID NO: 373724 - RNA, 19 nt, Homo sapiens
uuaagcagauguuauggaa

SEQ ID NO: 373725 - RNA, 19 nt, Homo sapiens
guguuuagcuuucaagugu

SEQ ID NO: 373726 - RNA, 19 nt, Homo sapiens
ugaaggauccugaaguaaa

SEQ ID NO: 373727 - RNA, 19 nt, Homo sapiens
cacauugacuuuggacaua

SEQ ID NO: 373728 - RNA, 19 nt, Homo sapiens
acagaugagugaugaagaa

SEQ ID NO: 373729 - RNA, 19 nt, Homo sapiens
gauuauguguugcaaguca

SEQ ID NO: 373730 - RNA, 19 nt, Homo sapiens
cuugaaggauccugaagua

SEQ ID NO: 373731 - RNA, 19 nt, Homo sapiens
ggaaggaggccaugcauac

SEQ ID NO: 373732 - RNA, 19 nt, Homo sapiens
gaaccacuggaauuugaua

SEQ ID NO: 373733 - RNA, 19 nt, Homo sapiens
ccaaagaaaacacgaauua

SEQ ID NO: 373734 - RNA, 19 nt, Homo sapiens
ugaaucagacugcuguaua

SEQ ID NO: 373735 - RNA, 19 nt, Homo sapiens
gaauggcucgauuauguuu

SEQ ID NO: 373736 - RNA, 19 nt, Homo sapiens
gugcuucaguuucauaaug

SEQ ID NO: 373737 - RNA, 19 nt, Homo sapiens
gaagaagcacucaaacagu

SEQ ID NO: 373738 - RNA, 19 nt, Homo sapiens
ugaagaagaagcacucaaa

SEQ ID NO: 373739 - RNA, 19 nt, Homo sapiens
gagauugcaagcagugaua

SEQ ID NO: 373740 - RNA, 19 nt, Homo sapiens
cagcagccuucaacaaaga

SEQ ID NO: 373741 - RNA, 19 nt, Homo sapiens
ucagaacucuauguugaaa

SEQ ID NO: 373742 - RNA, 19 nt, Homo sapiens
gcagugauagugcuaaugu

SEQ ID NO: 373743 - RNA, 19 nt, Homo sapiens
ccauagaggcugccauaaa

SEQ ID NO: 373744 - RNA, 19 nt, Homo sapiens
cgaagacucugugauguca

SEQ ID NO: 373745 - RNA, 19 nt, Homo sapiens
cuacuaaagugaacuggau

SEQ ID NO: 373746 - RNA, 19 nt, Homo sapiens
gcagcagccuucaacaaag

SEQ ID NO: 373747 - RNA, 19 nt, Homo sapiens
gcucuggccucauugaagu

SEQ ID NO: 373748 - RNA, 19 nt, Homo sapiens
gaucuuauuuggacuuugc

SEQ ID NO: 373749 - RNA, 19 nt, Homo sapiens
uuacacagcuggucuucau

SEQ ID NO: 373750 - RNA, 19 nt, Homo sapiens
ggaaagaagcugguuugga

SEQ ID NO: 373751 - RNA, 19 nt, Homo sapiens
gauuuacucuggaaagaag

SEQ ID NO: 373752 - RNA, 19 nt, Homo sapiens
caagguauuuggugaggau

SEQ ID NO: 373753 - RNA, 19 nt, Homo sapiens
gaagcacucaauaaguuaa

SEQ ID NO: 373754 - RNA, 19 nt, Homo sapiens
cugaugaacucgaagaaau

SEQ ID NO: 373755 - RNA, 19 nt, Homo sapiens
guggaaugcugcaagauca

SEQ ID NO: 373756 - RNA, 19 nt, Homo sapiens
gaaagagcacuugguaauc

SEQ ID NO: 373757 - RNA, 19 nt, Homo sapiens
agaaagagcacuugguaau

SEQ ID NO: 373758 - RNA, 19 nt, Homo sapiens
caucguaagcucagaggua

SEQ ID NO: 373759 - RNA, 19 nt, Homo sapiens
ggacguguuuagcuuucaa

SEQ ID NO: 373760 - RNA, 19 nt, Homo sapiens
cuucugaacuggcuuaaag

SEQ ID NO: 373761 - RNA, 19 nt, Homo sapiens
gaugauuuacgacaggaua

SEQ ID NO: 373762 - RNA, 19 nt, Homo sapiens
uuagaaagagcacuuggua

SEQ ID NO: 373763 - RNA, 19 nt, Homo sapiens
ucaaucaaguggaauaaac

SEQ ID NO: 373764 - RNA, 19 nt, Homo sapiens
cagcuuugcauguuaaauu

SEQ ID NO: 373765 - RNA, 19 nt, Homo sapiens
aagaaaugauugccauaga

SEQ ID NO: 373766 - RNA, 19 nt, Homo sapiens
gaaccauccaucccugaaa

SEQ ID NO: 373767 - RNA, 19 nt, Homo sapiens
gcaugggaaucucuucauc

SEQ ID NO: 373768 - RNA, 19 nt, Homo sapiens
gaacaacauuuacaacuca

SEQ ID NO: 373769 - RNA, 19 nt, Homo sapiens
guaaauguguguacaguug

SEQ ID NO: 373770 - RNA, 19 nt, Homo sapiens
ggauaggacuagcacauuu

SEQ ID NO: 373771 - RNA, 19 nt, Homo sapiens
ggaggucaauguuauguau

SEQ ID NO: 373772 - RNA, 19 nt, Homo sapiens
ugaaagaugcgcauucuaa

SEQ ID NO: 373773 - RNA, 19 nt, Homo sapiens
gcaaauagcagccuuucug

SEQ ID NO: 373774 - RNA, 19 nt, Homo sapiens
gagggucucuucagaaugu

SEQ ID NO: 373775 - RNA, 19 nt, Homo sapiens
gauaugguguguggagaua

SEQ ID NO: 373776 - RNA, 19 nt, Homo sapiens
gauacaggaacaacauuua

SEQ ID NO: 373777 - RNA, 19 nt, Homo sapiens
ggaacaacauuuacaacuc

SEQ ID NO: 373778 - RNA, 19 nt, Homo sapiens
uaugaaaggugccauggaa

SEQ ID NO: 373779 - RNA, 19 nt, Homo sapiens
ggagaaauacuugaacuug

SEQ ID NO: 373780 - RNA, 19 nt, Homo sapiens
gaagugguccugcugaaga

SEQ ID NO: 373781 - RNA, 19 nt, Homo sapiens
ggccucaacuccucccaua

SEQ ID NO: 373782 - RNA, 19 nt, Homo sapiens
ccaggaaacugcugagauc

SEQ ID NO: 373783 - RNA, 19 nt, Homo sapiens
gcacaaaccaagcaaucaa

SEQ ID NO: 373784 - RNA, 19 nt, Homo sapiens
ucaaacacguggagaagga

SEQ ID NO: 373785 - RNA, 19 nt, Homo sapiens
cagaaaagcuguaaaugug

SEQ ID NO: 373786 - RNA, 19 nt, Homo sapiens
gcagcucccuggcuucugu

SEQ ID NO: 373787 - RNA, 19 nt, Homo sapiens
uacuugaacuugccucuuu

SEQ ID NO: 373788 - RNA, 19 nt, Homo sapiens
caucaugaguucugcugaa

SEQ ID NO: 373789 - RNA, 19 nt, Homo sapiens
cauagauacucucuucuuc

SEQ ID NO: 373790 - RNA, 19 nt, Homo sapiens
gcaggacagugcuugauac

SEQ ID NO: 373791 - RNA, 19 nt, Homo sapiens
gaugggacccgaguguaua

SEQ ID NO: 373792 - RNA, 19 nt, Homo sapiens
auacuugcguuuggaauaa

SEQ ID NO: 373793 - RNA, 19 nt, Homo sapiens
cauagcugcugcccuaguu

SEQ ID NO: 373794 - RNA, 19 nt, Homo sapiens
gauuguaguggaucuaauu

SEQ ID NO: 373795 - RNA, 19 nt, Homo sapiens
ggauccugcuguaugauau

SEQ ID NO: 373796 - RNA, 19 nt, Homo sapiens
gacuguguauauaggauaa

SEQ ID NO: 373797 - RNA, 19 nt, Homo sapiens
ucauagguguccagcauug

SEQ ID NO: 373798 - RNA, 19 nt, Homo sapiens
gagguuggaugcucuuguc

SEQ ID NO: 373799 - RNA, 19 nt, Homo sapiens
gauacucucuucuucucau

SEQ ID NO: 373800 - RNA, 19 nt, Homo sapiens
ugacacgucucgccaagca

SEQ ID NO: 373801 - RNA, 19 nt, Homo sapiens
guguacaguuggcauggua

SEQ ID NO: 373802 - RNA, 19 nt, Homo sapiens
guggagauauuccuuucga

SEQ ID NO: 373803 - RNA, 19 nt, Homo sapiens
uaugguguguggagauauu

SEQ ID NO: 373804 - RNA, 19 nt, Homo sapiens
caguuggcaugguaguaua

SEQ ID NO: 373805 - RNA, 19 nt, Homo sapiens
ucucauagguguccagcau

SEQ ID NO: 373806 - RNA, 19 nt, Homo sapiens
ucccauagauacucucuuc

SEQ ID NO: 373807 - RNA, 19 nt, Homo sapiens
gggauccugcuguaugaua

SEQ ID NO: 373808 - RNA, 19 nt, Homo sapiens
ggggagagcugccuaaugg

SEQ ID NO: 373809 - RNA, 19 nt, Homo sapiens
aaaccaagcaaucaacaga

SEQ ID NO: 373810 - RNA, 19 nt, Homo sapiens
caacauuuacaacucauuc

SEQ ID NO: 373811 - RNA, 19 nt, Homo sapiens
gaaagaugcgcauucuaac

SEQ ID NO: 373812 - RNA, 19 nt, Homo sapiens
ugaaaggugccauggaaga

SEQ ID NO: 373813 - RNA, 19 nt, Homo sapiens
ucgagaggcccgacaguuu

SEQ ID NO: 373814 - RNA, 19 nt, Homo sapiens
ggccaaccuucgaagaaau

SEQ ID NO: 373815 - RNA, 19 nt, Homo sapiens
gaacuugccucuuuuaccu

SEQ ID NO: 373816 - RNA, 19 nt, Homo sapiens
gcuggacucugaaauaucc

SEQ ID NO: 373817 - RNA, 19 nt, Homo sapiens
ucgaagaaauccagaacca

SEQ ID NO: 373818 - RNA, 19 nt, Homo sapiens
uauacuugcguuuggaaua

SEQ ID NO: 373819 - RNA, 19 nt, Homo sapiens
accaagcaaucaacagaaa

SEQ ID NO: 373820 - RNA, 19 nt, Homo sapiens
caacuccucccauagauac

SEQ ID NO: 373821 - RNA, 19 nt, Homo sapiens
gggauaggacuagcacauu

SEQ ID NO: 373822 - RNA, 19 nt, Homo sapiens
caugaguucugcugaaugc

SEQ ID NO: 373823 - RNA, 19 nt, Homo sapiens
uagauacucucuucuucuc

SEQ ID NO: 373824 - RNA, 19 nt, Homo sapiens
ccauagauacucucuucuu

SEQ ID NO: 373825 - RNA, 19 nt, Homo sapiens
ccucaacuccucccauaga

SEQ ID NO: 373826 - RNA, 19 nt, Homo sapiens
cugcgacgcuugcucuguu

SEQ ID NO: 373827 - RNA, 19 nt, Homo sapiens
gcacagcccaggcauagcu

SEQ ID NO: 373828 - RNA, 19 nt, Homo sapiens
cgagugaacuggucuuccu

SEQ ID NO: 373829 - RNA, 19 nt, Homo sapiens
uugcuggacucugaaauau

SEQ ID NO: 373830 - RNA, 19 nt, Homo sapiens
ugauacaggaacaacauuu

SEQ ID NO: 373831 - RNA, 19 nt, Homo sapiens
cgagaggcccgacaguuuc

SEQ ID NO: 373832 - RNA, 19 nt, Homo sapiens
aaacacaguucuggauggu

SEQ ID NO: 373833 - RNA, 19 nt, Homo sapiens
caagaccucacacacacaa

SEQ ID NO: 373834 - RNA, 19 nt, Homo sapiens
gaaaggugccauggaagag

SEQ ID NO: 373835 - RNA, 19 nt, Homo sapiens
gggagaaauacuugaacuu

SEQ ID NO: 373836 - RNA, 19 nt, Homo sapiens
ucaacuccucccauagaua

SEQ ID NO: 373837 - RNA, 19 nt, Homo sapiens
ugagugaaauacuguacag

SEQ ID NO: 373838 - RNA, 19 nt, Homo sapiens
uuauuugguucccuuccua

SEQ ID NO: 373839 - RNA, 19 nt, Homo sapiens
caucagauaggccaaccuu

SEQ ID NO: 373840 - RNA, 19 nt, Homo sapiens
guguauagcccuccagagu

SEQ ID NO: 373841 - RNA, 19 nt, Homo sapiens
ugacuguguauauaggaua

SEQ ID NO: 373842 - RNA, 19 nt, Homo sapiens
gcugggagaaauacuugaa

SEQ ID NO: 373843 - RNA, 19 nt, Homo sapiens
gucuccagcuucccgagua

SEQ ID NO: 373844 - RNA, 19 nt, Homo sapiens
cagcacagcccaggcauag

SEQ ID NO: 373845 - RNA, 19 nt, Homo sapiens
aggccaaccuucgaagaaa

SEQ ID NO: 373846 - RNA, 19 nt, Homo sapiens
guguggagauauuccuuuc

SEQ ID NO: 373847 - RNA, 19 nt, Homo sapiens
ccgcgucuccgacaacuug

SEQ ID NO: 373848 - RNA, 19 nt, Homo sapiens
uuacaacucauuccagauc

SEQ ID NO: 373849 - RNA, 19 nt, Homo sapiens
gagcaugacgaagagauca

SEQ ID NO: 373850 - RNA, 19 nt, Homo sapiens
ggguuucuccggcgucauu

SEQ ID NO: 373851 - RNA, 19 nt, Homo sapiens
uggaagugguccugcugaa

SEQ ID NO: 373852 - RNA, 19 nt, Homo sapiens
auacucucuucuucucaua

SEQ ID NO: 373853 - RNA, 19 nt, Homo sapiens
cgaugggacccgaguguau

SEQ ID NO: 373854 - RNA, 19 nt, Homo sapiens
acaggaacaacauuuacaa

SEQ ID NO: 373855 - RNA, 19 nt, Homo sapiens
gaggucaauguuauguauu

SEQ ID NO: 373856 - RNA, 19 nt, Homo sapiens
gaaggugagcucggguuuc

SEQ ID NO: 373857 - RNA, 19 nt, Homo sapiens
aaggugagcucggguuucu

SEQ ID NO: 373858 - RNA, 19 nt, Homo sapiens
guggagaaggaccggauuu

SEQ ID NO: 373859 - RNA, 19 nt, Homo sapiens
gcucaaggacaccgucuac

SEQ ID NO: 373860 - RNA, 19 nt, Homo sapiens
ccuauuccaagcuuccaua

SEQ ID NO: 373861 - RNA, 19 nt, Homo sapiens
uggcaugguaguauacaaa

SEQ ID NO: 373862 - RNA, 19 nt, Homo sapiens
gcagcagcagcaaccacua

SEQ ID NO: 373863 - RNA, 19 nt, Homo sapiens
gcauugcuggacucugaaa

SEQ ID NO: 373864 - RNA, 19 nt, Homo sapiens
cggcugugcugggagaaau

SEQ ID NO: 373865 - RNA, 19 nt, Homo sapiens
gauaggacuagcacauuuu

SEQ ID NO: 373866 - RNA, 19 nt, Homo sapiens
ccaucaaacacguggagaa

SEQ ID NO: 373867 - RNA, 19 nt, Homo sapiens
ggaagugguccugcugaag

SEQ ID NO: 373868 - RNA, 19 nt, Homo sapiens
gcaaaggccuccacgaguu

SEQ ID NO: 373869 - RNA, 19 nt, Homo sapiens
ggaaacgccuccuucauuc

SEQ ID NO: 373870 - RNA, 19 nt, Homo sapiens
ccaaggagcugaugcacuu

SEQ ID NO: 373871 - RNA, 19 nt, Homo sapiens
gaaagcagguuuuaacaaa

SEQ ID NO: 373872 - RNA, 19 nt, Homo sapiens
gcaaguuaguuaaguauca

SEQ ID NO: 373873 - RNA, 19 nt, Homo sapiens
ccaaagacauccaguaucu

SEQ ID NO: 373874 - RNA, 19 nt, Homo sapiens
gcaacgagaugcugugcaa

SEQ ID NO: 373875 - RNA, 19 nt, Homo sapiens
ggccagaacucuuccagaa

SEQ ID NO: 373876 - RNA, 19 nt, Homo sapiens
ugaagaagcucaucaacuc

SEQ ID NO: 373877 - RNA, 19 nt, Homo sapiens
acgaugagcuguuccagua

SEQ ID NO: 373878 - RNA, 19 nt, Homo sapiens
gaacaagcaugaggaugug

SEQ ID NO: 373879 - RNA, 19 nt, Homo sapiens
gaugcuugcucuccacuuu

SEQ ID NO: 373880 - RNA, 19 nt, Homo sapiens
gggcagcuguuccacauug

SEQ ID NO: 373881 - RNA, 19 nt, Homo sapiens
agaaggaccugguguggaa

SEQ ID NO: 373882 - RNA, 19 nt, Homo sapiens
ggaacaagcaugaggaugu

SEQ ID NO: 373883 - RNA, 19 nt, Homo sapiens
gaaggcaaguuaguuaagu

SEQ ID NO: 373884 - RNA, 19 nt, Homo sapiens
gaaauaguuuaaggagcua

SEQ ID NO: 373885 - RNA, 19 nt, Homo sapiens
gauuugagcagcuuuagaa

SEQ ID NO: 373886 - RNA, 19 nt, Homo sapiens
ugacacucauugauucuaa

SEQ ID NO: 373887 - RNA, 19 nt, Homo sapiens
ccaagaagaaguccaagaa

SEQ ID NO: 373888 - RNA, 19 nt, Homo sapiens
aaacagccauaaacggaaa

SEQ ID NO: 373889 - RNA, 19 nt, Homo sapiens
gcacagcgacaacaucaug

SEQ ID NO: 373890 - RNA, 19 nt, Homo sapiens
uaacauaucaggccaugga

SEQ ID NO: 373891 - RNA, 19 nt, Homo sapiens
ggaccaaggaggagaauca

SEQ ID NO: 373892 - RNA, 19 nt, Homo sapiens
gaaguaaaggcagaugaaa

SEQ ID NO: 373893 - RNA, 19 nt, Homo sapiens
cacaggugauccuaacaua

SEQ ID NO: 373894 - RNA, 19 nt, Homo sapiens
ccaacuaacucugcagaug

SEQ ID NO: 373895 - RNA, 19 nt, Homo sapiens
guacgagaauucccucauc

SEQ ID NO: 373896 - RNA, 19 nt, Homo sapiens
ucaacuggcugaaguccaa

SEQ ID NO: 373897 - RNA, 19 nt, Homo sapiens
ugaaggcccugaaugacuu

SEQ ID NO: 373898 - RNA, 19 nt, Homo sapiens
uugagcagcuuuagaaaug

SEQ ID NO: 373899 - RNA, 19 nt, Homo sapiens
cgagaauucccucaucuuu

SEQ ID NO: 373900 - RNA, 19 nt, Homo sapiens
ggaaacugacggacgauga

SEQ ID NO: 373901 - RNA, 19 nt, Homo sapiens
gaacgcugccucuacaugu

SEQ ID NO: 373902 - RNA, 19 nt, Homo sapiens
gggccaaccucaugcuguu

SEQ ID NO: 373903 - RNA, 19 nt, Homo sapiens
gcgccaagaugugccaauu

SEQ ID NO: 373904 - RNA, 19 nt, Homo sapiens
cggaaacgccuccuucauu

SEQ ID NO: 373905 - RNA, 19 nt, Homo sapiens
ggaucuuucucucugacua

SEQ ID NO: 373906 - RNA, 19 nt, Homo sapiens
ccaaagugcugggauuaca

SEQ ID NO: 373907 - RNA, 19 nt, Homo sapiens
ggucacgcaugaaggcaaa

SEQ ID NO: 373908 - RNA, 19 nt, Homo sapiens
acugcgagcugaccaaauu

SEQ ID NO: 373909 - RNA, 19 nt, Homo sapiens
gugaaaccuugaaaugaga

SEQ ID NO: 373910 - RNA, 19 nt, Homo sapiens
ggugcaggcuuagucuuaa

SEQ ID NO: 373911 - RNA, 19 nt, Homo sapiens
gcgugggcaucaucuuuaa

SEQ ID NO: 373912 - RNA, 19 nt, Homo sapiens
gccaagaugugccaauucu

SEQ ID NO: 373913 - RNA, 19 nt, Homo sapiens
gcgugcgcguuauuuauuu

SEQ ID NO: 373914 - RNA, 19 nt, Homo sapiens
cgacauggcugccuuuugu

SEQ ID NO: 373915 - RNA, 19 nt, Homo sapiens
ugaacuggcuggcccacaa

SEQ ID NO: 373916 - RNA, 19 nt, Homo sapiens
acaugaaggugcugaugaa

SEQ ID NO: 373917 - RNA, 19 nt, Homo sapiens
uaccugaacuucccugugu

SEQ ID NO: 373918 - RNA, 19 nt, Homo sapiens
ucacugauguggguugaga

SEQ ID NO: 373919 - RNA, 19 nt, Homo sapiens
ugccagcucuguucugauu

SEQ ID NO: 373920 - RNA, 19 nt, Homo sapiens
uugaaauggugcaggcuua

SEQ ID NO: 373921 - RNA, 19 nt, Homo sapiens
gagcuaaacagccauaaac

SEQ ID NO: 373922 - RNA, 19 nt, Homo sapiens
gaauuucaagaccaaguuu

SEQ ID NO: 373923 - RNA, 19 nt, Homo sapiens
caaaggccuccacgaguuu

SEQ ID NO: 373924 - RNA, 19 nt, Homo sapiens
gagaauucccucaucuuuc

SEQ ID NO: 373925 - RNA, 19 nt, Homo sapiens
gcaggaggccuaccuagag

SEQ ID NO: 373926 - RNA, 19 nt, Homo sapiens
gggcuuugcuggucuuucu

SEQ ID NO: 373927 - RNA, 19 nt, Homo sapiens
ccaaguggaacaagcauga

SEQ ID NO: 373928 - RNA, 19 nt, Homo sapiens
ccagaaaccgcgugccaaa

SEQ ID NO: 373929 - RNA, 19 nt, Homo sapiens
ggucuuggguacgagaauu

SEQ ID NO: 373930 - RNA, 19 nt, Homo sapiens
cauccucaccuaugacuuu

SEQ ID NO: 373931 - RNA, 19 nt, Homo sapiens
gggcuggaccugaggauga

SEQ ID NO: 373932 - RNA, 19 nt, Homo sapiens
caagaucggccacuuccuu

SEQ ID NO: 373933 - RNA, 19 nt, Homo sapiens
gggaaggcaaguuaguuaa

SEQ ID NO: 373934 - RNA, 19 nt, Homo sapiens
ggugccagcucuguucuga

SEQ ID NO: 373935 - RNA, 19 nt, Homo sapiens
ccagaaccaucaccuuugg

SEQ ID NO: 373936 - RNA, 19 nt, Homo sapiens
uggcugggcuggucucgaa

SEQ ID NO: 373937 - RNA, 19 nt, Homo sapiens
ucaucuuucucuacuguaa

SEQ ID NO: 373938 - RNA, 19 nt, Homo sapiens
ggagcuaaacagccauaaa

SEQ ID NO: 373939 - RNA, 19 nt, Homo sapiens
ccaaagacaacaggcagua

SEQ ID NO: 373940 - RNA, 19 nt, Homo sapiens
ggaauuucaagaccaaguu

SEQ ID NO: 373941 - RNA, 19 nt, Homo sapiens
gaagaagcucaucaacuca

SEQ ID NO: 373942 - RNA, 19 nt, Homo sapiens
ugagguaccagaaguguga

SEQ ID NO: 373943 - RNA, 19 nt, Homo sapiens
gggaagcacugagcaaacu

SEQ ID NO: 373944 - RNA, 19 nt, Homo sapiens
ugugaaaccuugaaaugag

SEQ ID NO: 373945 - RNA, 19 nt, Homo sapiens
aaggcaaguuaguuaagua

SEQ ID NO: 373946 - RNA, 19 nt, Homo sapiens
ucucaaaggucuuccaaaa

SEQ ID NO: 373947 - RNA, 19 nt, Homo sapiens
gaugaggccagaacucuuc

SEQ ID NO: 373948 - RNA, 19 nt, Homo sapiens
ggucuuucuuggacuauuc

SEQ ID NO: 373949 - RNA, 19 nt, Homo sapiens
ggaccgcacaggccucauu

SEQ ID NO: 373950 - RNA, 19 nt, Homo sapiens
gacacucauugauucuaaa

SEQ ID NO: 373951 - RNA, 19 nt, Homo sapiens
gaagcacugagcaaacuga

SEQ ID NO: 373952 - RNA, 19 nt, Homo sapiens
uguggaagcugcggcauga

SEQ ID NO: 373953 - RNA, 19 nt, Homo sapiens
gagaaguaaaggcagauga

SEQ ID NO: 373954 - RNA, 19 nt, Homo sapiens
ccacagcguuucugguuuu

SEQ ID NO: 373955 - RNA, 19 nt, Homo sapiens
caagcacauugguccuaaa

SEQ ID NO: 373956 - RNA, 19 nt, Homo sapiens
gcacccugcuggcugaagu

SEQ ID NO: 373957 - RNA, 19 nt, Homo sapiens
gcuggucuuucuuggacua

SEQ ID NO: 373958 - RNA, 19 nt, Homo sapiens
guaccuguauggcaacuac

SEQ ID NO: 373959 - RNA, 19 nt, Homo sapiens
cgugcgcguuauuuauuua

SEQ ID NO: 373960 - RNA, 19 nt, Homo sapiens
ccacucugccauugucuaa

SEQ ID NO: 373961 - RNA, 19 nt, Homo sapiens
gcucucggcugaggauugu

SEQ ID NO: 373962 - RNA, 19 nt, Homo sapiens
gaaacgccuccuucauuca

SEQ ID NO: 373963 - RNA, 19 nt, Homo sapiens
ccuaugacuuuguccaugu

SEQ ID NO: 373964 - RNA, 19 nt, Homo sapiens
ccacagccgccuucaacaa

SEQ ID NO: 373965 - RNA, 19 nt, Homo sapiens
ucauggacguccuguggaa

SEQ ID NO: 373966 - RNA, 19 nt, Homo sapiens
ucaagucgcugcggaaacu

SEQ ID NO: 373967 - RNA, 19 nt, Homo sapiens
aaaggcagaugaaaagaaa

SEQ ID NO: 373968 - RNA, 19 nt, Homo sapiens
ggaagaagauugccaacaa

SEQ ID NO: 373969 - RNA, 19 nt, Homo sapiens
gcauggagcuggagaacua

SEQ ID NO: 373970 - RNA, 19 nt, Homo sapiens
gaacaccuuuacucuauaa

SEQ ID NO: 373971 - RNA, 19 nt, Homo sapiens
gcaaagaagacauugaaua

SEQ ID NO: 373972 - RNA, 19 nt, Homo sapiens
gaagaaaucucugauggau

SEQ ID NO: 373973 - RNA, 19 nt, Homo sapiens
cuacuugccuuauccauuu

SEQ ID NO: 373974 - RNA, 19 nt, Homo sapiens
aaguucagcuucucuauua

SEQ ID NO: 373975 - RNA, 19 nt, Homo sapiens
agaaaucucugauggauau

SEQ ID NO: 373976 - RNA, 19 nt, Homo sapiens
gaaggaaaccagucgcaua

SEQ ID NO: 373977 - RNA, 19 nt, Homo sapiens
gaacacuacuugccuuauc

SEQ ID NO: 373978 - RNA, 19 nt, Homo sapiens
cuacagcccuaucaaauga

SEQ ID NO: 373979 - RNA, 19 nt, Homo sapiens
gaauugcucuggcauuuua

SEQ ID NO: 373980 - RNA, 19 nt, Homo sapiens
ugacacauccuucagauuu

SEQ ID NO: 373981 - RNA, 19 nt, Homo sapiens
gguccaggcugugaaauuu

SEQ ID NO: 373982 - RNA, 19 nt, Homo sapiens
agagaaacauucagccuaa

SEQ ID NO: 373983 - RNA, 19 nt, Homo sapiens
caggagcgcuggcaauuga

SEQ ID NO: 373984 - RNA, 19 nt, Homo sapiens
gacgucaguucccaaguua

SEQ ID NO: 373985 - RNA, 19 nt, Homo sapiens
acuaaugacuuccuuauug

SEQ ID NO: 373986 - RNA, 19 nt, Homo sapiens
ggaaugaucgagauuguga

SEQ ID NO: 373987 - RNA, 19 nt, Homo sapiens
cacuauggcuugaguuuaa

SEQ ID NO: 373988 - RNA, 19 nt, Homo sapiens
acgaugauguucugcauua

SEQ ID NO: 373989 - RNA, 19 nt, Homo sapiens
ucaccaagauggccaagaa

SEQ ID NO: 373990 - RNA, 19 nt, Homo sapiens
aagaacaccuuuacucuau

SEQ ID NO: 373991 - RNA, 19 nt, Homo sapiens
gagaaaagauguuggcauu

SEQ ID NO: 373992 - RNA, 19 nt, Homo sapiens
gaugggaacuucuggaaag

SEQ ID NO: 373993 - RNA, 19 nt, Homo sapiens
gaacaccgaccucacaguu

SEQ ID NO: 373994 - RNA, 19 nt, Homo sapiens
gcauuaccuucuacaauug

SEQ ID NO: 373995 - RNA, 19 nt, Homo sapiens
gaagggaagucugggauca

SEQ ID NO: 373996 - RNA, 19 nt, Homo sapiens
ccauucuucuggacaauua

SEQ ID NO: 373997 - RNA, 19 nt, Homo sapiens
caaccuguauuguggauau

SEQ ID NO: 373998 - RNA, 19 nt, Homo sapiens
cagugucucuguuuaagua

SEQ ID NO: 373999 - RNA, 19 nt, Homo sapiens
gaaagacgccacgacaauu

SEQ ID NO: 374000 - RNA, 19 nt, Homo sapiens
gcaagaaauuguggccaaa

SEQ ID NO: 374001 - RNA, 19 nt, Homo sapiens
gagaauacguccuccacau

SEQ ID NO: 374002 - RNA, 19 nt, Homo sapiens
guggagagauuuguuuauu

SEQ ID NO: 374003 - RNA, 19 nt, Homo sapiens
gagcagaaaugcccaacca

SEQ ID NO: 374004 - RNA, 19 nt, Homo sapiens
cagcuucucuauuauguga

SEQ ID NO: 374005 - RNA, 19 nt, Homo sapiens
uaaaggaggcauucuagaa

SEQ ID NO: 374006 - RNA, 19 nt, Homo sapiens
aaagucacccuugauauua

SEQ ID NO: 374007 - RNA, 19 nt, Homo sapiens
gcugaagcgugguuuaaga

SEQ ID NO: 374008 - RNA, 19 nt, Homo sapiens
gaagggagaagaccaagga

SEQ ID NO: 374009 - RNA, 19 nt, Homo sapiens
cagaggaggugcuguggaa

SEQ ID NO: 374010 - RNA, 19 nt, Homo sapiens
caagaacaccuuuacucua

SEQ ID NO: 374011 - RNA, 19 nt, Homo sapiens
ccacaacucuuuacagacu

SEQ ID NO: 374012 - RNA, 19 nt, Homo sapiens
aagagugaguuaucuagua

SEQ ID NO: 374013 - RNA, 19 nt, Homo sapiens
ucucugaaauaucucguua

SEQ ID NO: 374014 - RNA, 19 nt, Homo sapiens
ugaauuaguuuccaaaugc

SEQ ID NO: 374015 - RNA, 19 nt, Homo sapiens
cccgaaagcuuuagaguuc

SEQ ID NO: 374016 - RNA, 19 nt, Homo sapiens
uaaacagacuaaugacuuc

SEQ ID NO: 374017 - RNA, 19 nt, Homo sapiens
ugcauuaccuucuacaauu

SEQ ID NO: 374018 - RNA, 19 nt, Homo sapiens
caacuaacccagacaagga

SEQ ID NO: 374019 - RNA, 19 nt, Homo sapiens
guuccaggguuaugaauau

SEQ ID NO: 374020 - RNA, 19 nt, Homo sapiens
gcaauuggaggcgaucaua

SEQ ID NO: 374021 - RNA, 19 nt, Homo sapiens
gaagaagauugccaacaac

SEQ ID NO: 374022 - RNA, 19 nt, Homo sapiens
gguacgagaucuacgacaa

SEQ ID NO: 374023 - RNA, 19 nt, Homo sapiens
auagauaccuguuugacuu

SEQ ID NO: 374024 - RNA, 19 nt, Homo sapiens
uaaaugaugcuuccaaaca

SEQ ID NO: 374025 - RNA, 19 nt, Homo sapiens
uguaaucguuguaaccuuu

SEQ ID NO: 374026 - RNA, 19 nt, Homo sapiens
gcuuuagaguuccauauga

SEQ ID NO: 374027 - RNA, 19 nt, Homo sapiens
ugacgucaguucccaaguu

SEQ ID NO: 374028 - RNA, 19 nt, Homo sapiens
ggaggacgaugauguucug

SEQ ID NO: 374029 - RNA, 19 nt, Homo sapiens
gcaaggaccacgagagugu

SEQ ID NO: 374030 - RNA, 19 nt, Homo sapiens
uccaacaucuucucauaaa

SEQ ID NO: 374031 - RNA, 19 nt, Homo sapiens
gcccacacuuccagaaauu

SEQ ID NO: 374032 - RNA, 19 nt, Homo sapiens
aagaugaaguccugaauca

SEQ ID NO: 374033 - RNA, 19 nt, Homo sapiens
ccaaguaaucgagauguua

SEQ ID NO: 374034 - RNA, 19 nt, Homo sapiens
aagaauugcucuggcauuu

SEQ ID NO: 374035 - RNA, 19 nt, Homo sapiens
cagcagaggacaaagaauu

SEQ ID NO: 374036 - RNA, 19 nt, Homo sapiens
caagaacggagaagagauu

SEQ ID NO: 374037 - RNA, 19 nt, Homo sapiens
gccaacaacugcaucuuca

SEQ ID NO: 374038 - RNA, 19 nt, Homo sapiens
gguggaaacugcagagagu

SEQ ID NO: 374039 - RNA, 19 nt, Homo sapiens
aaacacagcaggagaaauc

SEQ ID NO: 374040 - RNA, 19 nt, Homo sapiens
ugaucgagauugugaaaga

SEQ ID NO: 374041 - RNA, 19 nt, Homo sapiens
guaaaguaauggccuccaa

SEQ ID NO: 374042 - RNA, 19 nt, Homo sapiens
ggaccggguucgagcagaa

SEQ ID NO: 374043 - RNA, 19 nt, Homo sapiens
aaagagagagugccauuug

SEQ ID NO: 374044 - RNA, 19 nt, Homo sapiens
ggagagauuuguuuauucc

SEQ ID NO: 374045 - RNA, 19 nt, Homo sapiens
caacacgggagcauuuaaa

SEQ ID NO: 374046 - RNA, 19 nt, Homo sapiens
gggcaacacgggagcauuu

SEQ ID NO: 374047 - RNA, 19 nt, Homo sapiens
cauuucaacuggugacaaa

SEQ ID NO: 374048 - RNA, 19 nt, Homo sapiens
gcacgacuuuacccaacaa

SEQ ID NO: 374049 - RNA, 19 nt, Homo sapiens
uaagagccauugcaguuca

SEQ ID NO: 374050 - RNA, 19 nt, Homo sapiens
uaacugagacacacaaaca

SEQ ID NO: 374051 - RNA, 19 nt, Homo sapiens
cuaaugacuuccuuauugu

SEQ ID NO: 374052 - RNA, 19 nt, Homo sapiens
gguuuaaacagacuaauga

SEQ ID NO: 374053 - RNA, 19 nt, Homo sapiens
gcaguggagagauuuguuu

SEQ ID NO: 374054 - RNA, 19 nt, Homo sapiens
guaauggccuccaagaaaa

SEQ ID NO: 374055 - RNA, 19 nt, Homo sapiens
ggacgaugauguucugcau

SEQ ID NO: 374056 - RNA, 19 nt, Homo sapiens
aagcauauccuaagcuauu

SEQ ID NO: 374057 - RNA, 19 nt, Homo sapiens
caagauggccaagaagaaa

SEQ ID NO: 374058 - RNA, 19 nt, Homo sapiens
gaaucaacagggacacuuu

SEQ ID NO: 374059 - RNA, 19 nt, Homo sapiens
uggcauugcugauuguuug

SEQ ID NO: 374060 - RNA, 19 nt, Homo sapiens
acacaaaccuacugaucau

SEQ ID NO: 374061 - RNA, 19 nt, Homo sapiens
aaacucacgucugcaacua

SEQ ID NO: 374062 - RNA, 19 nt, Homo sapiens
gcaaaguucagcuucucua

SEQ ID NO: 374063 - RNA, 19 nt, Homo sapiens
caucaaacaaggagagaaa

SEQ ID NO: 374064 - RNA, 19 nt, Homo sapiens
gcaguuuaauugguuucua

SEQ ID NO: 374065 - RNA, 19 nt, Homo sapiens
cgagacaggaaaccuauuu

SEQ ID NO: 374066 - RNA, 19 nt, Homo sapiens
gacugaaucuuuggaucua

SEQ ID NO: 374067 - RNA, 19 nt, Homo sapiens
gccaagacaugcuuauuuu

SEQ ID NO: 374068 - RNA, 19 nt, Homo sapiens
ggaaaggcgggaacaauaa

SEQ ID NO: 374069 - RNA, 19 nt, Homo sapiens
gaacuucacucugcugcuu

SEQ ID NO: 374070 - RNA, 19 nt, Homo sapiens
acaauaagcugaucaaggu

SEQ ID NO: 374071 - RNA, 19 nt, Homo sapiens
gggaggaggugaacgagaa

SEQ ID NO: 374072 - RNA, 19 nt, Homo sapiens
agaaagagaugcaaaggau

SEQ ID NO: 374073 - RNA, 19 nt, Homo sapiens
gaugaagcguacugcaauu

SEQ ID NO: 374074 - RNA, 19 nt, Homo sapiens
gaaccucggccgugacauu

SEQ ID NO: 374075 - RNA, 19 nt, Homo sapiens
gggccagacucaagagaaa

SEQ ID NO: 374076 - RNA, 19 nt, Homo sapiens
uaagggucauggaauaauu

SEQ ID NO: 374077 - RNA, 19 nt, Homo sapiens
ggacaagagccgcgaguau

SEQ ID NO: 374078 - RNA, 19 nt, Homo sapiens
ucaaugagacuaucaagau

SEQ ID NO: 374079 - RNA, 19 nt, Homo sapiens
gcgcccagcuuaaggucua

SEQ ID NO: 374080 - RNA, 19 nt, Homo sapiens
ugacuucccuggcaccuau

SEQ ID NO: 374081 - RNA, 19 nt, Homo sapiens
cccaggagcugcagaugaa

SEQ ID NO: 374082 - RNA, 19 nt, Homo sapiens
gcgaguaugaccagcuuua

SEQ ID NO: 374083 - RNA, 19 nt, Homo sapiens
ccacaguccuggccaaugg

SEQ ID NO: 374084 - RNA, 19 nt, Homo sapiens
ggucauggaauaauuugaa

SEQ ID NO: 374085 - RNA, 19 nt, Homo sapiens
ccaccgagaugggcacuau

SEQ ID NO: 374086 - RNA, 19 nt, Homo sapiens
caaaggauccugcugaacu

SEQ ID NO: 374087 - RNA, 19 nt, Homo sapiens
agaaaugcagcaaggaaua

SEQ ID NO: 374088 - RNA, 19 nt, Homo sapiens
ggacagcgaaucucacuac

SEQ ID NO: 374089 - RNA, 19 nt, Homo sapiens
caaugagacuaucaagauc

SEQ ID NO: 374090 - RNA, 19 nt, Homo sapiens
gagaaagagaugcaaagga

SEQ ID NO: 374091 - RNA, 19 nt, Homo sapiens
caacagagagaucgacaag

SEQ ID NO: 374092 - RNA, 19 nt, Homo sapiens
ggcugcaccugccauguuu

SEQ ID NO: 374093 - RNA, 19 nt, Homo sapiens
gaagcguacugcaauugag

SEQ ID NO: 374094 - RNA, 19 nt, Homo sapiens
gacaagagccgcgaguaug

SEQ ID NO: 374095 - RNA, 19 nt, Homo sapiens
aggaaaggcgggaacaaua

SEQ ID NO: 374096 - RNA, 19 nt, Homo sapiens
gcuccaagcagccaaccua

SEQ ID NO: 374097 - RNA, 19 nt, Homo sapiens
gagaaaugcagcaaggaau

SEQ ID NO: 374098 - RNA, 19 nt, Homo sapiens
uuguaagggucauggaaua

SEQ ID NO: 374099 - RNA, 19 nt, Homo sapiens
ggaacaauaagcugaucaa

SEQ ID NO: 374100 - RNA, 19 nt, Homo sapiens
gcaagauccgagaccagua

SEQ ID NO: 374101 - RNA, 19 nt, Homo sapiens
gagcagggccagacucaag

SEQ ID NO: 374102 - RNA, 19 nt, Homo sapiens
gagacuaucaagaucuuug

SEQ ID NO: 374103 - RNA, 19 nt, Homo sapiens
gaaaggcgggaacaauaag

SEQ ID NO: 374104 - RNA, 19 nt, Homo sapiens
aguaugaccagcuuuauga

SEQ ID NO: 374105 - RNA, 19 nt, Homo sapiens
acaagagccgcgaguauga

SEQ ID NO: 374106 - RNA, 19 nt, Homo sapiens
caccugccauguuuacaga

SEQ ID NO: 374107 - RNA, 19 nt, Homo sapiens
ucuacccuguguccaaaua

SEQ ID NO: 374108 - RNA, 19 nt, Homo sapiens
ggaccaguacgcacucaug

SEQ ID NO: 374109 - RNA, 19 nt, Homo sapiens
cggcucaagucccgcauug

SEQ ID NO: 374110 - RNA, 19 nt, Homo sapiens
gaaaugcagcaaggaauac

SEQ ID NO: 374111 - RNA, 19 nt, Homo sapiens
gaguaugaccagcuuuaug

SEQ ID NO: 374112 - RNA, 19 nt, Homo sapiens
caagggaggaggugaacga

SEQ ID NO: 374113 - RNA, 19 nt, Homo sapiens
gcaccuauguggaguuccu

SEQ ID NO: 374114 - RNA, 19 nt, Homo sapiens
ugacgaguggcccuuguaa

SEQ ID NO: 374115 - RNA, 19 nt, Homo sapiens
ccucuacccuguguccaaa

SEQ ID NO: 374116 - RNA, 19 nt, Homo sapiens
ggacacacggcuccucuac

SEQ ID NO: 374117 - RNA, 19 nt, Homo sapiens
gcaagauccagggcgagua

SEQ ID NO: 374118 - RNA, 19 nt, Homo sapiens
gcacgcaggcagaggagau

SEQ ID NO: 374119 - RNA, 19 nt, Homo sapiens
ugcaaaggauccugcugaa

SEQ ID NO: 374120 - RNA, 19 nt, Homo sapiens
cagcaggaccagauuguca

SEQ ID NO: 374121 - RNA, 19 nt, Homo sapiens
ccuguaaucccagcacuuu

SEQ ID NO: 374122 - RNA, 19 nt, Homo sapiens
cagaugaagcguacugcaa

SEQ ID NO: 374123 - RNA, 19 nt, Homo sapiens
augaccagcuuuaugaaga

SEQ ID NO: 374124 - RNA, 19 nt, Homo sapiens
uuguggaccucaucaauca

SEQ ID NO: 374125 - RNA, 19 nt, Homo sapiens
ucaugcagcugcgcaagau

SEQ ID NO: 374126 - RNA, 19 nt, Homo sapiens
gcauugccgagauccauga

SEQ ID NO: 374127 - RNA, 19 nt, Homo sapiens
gggcaacgagaaagagaug

SEQ ID NO: 374128 - RNA, 19 nt, Homo sapiens
ugaagcguacugcaauuga

SEQ ID NO: 374129 - RNA, 19 nt, Homo sapiens
ucucagagccacucaccuu

SEQ ID NO: 374130 - RNA, 19 nt, Homo sapiens
gaacaauaagcugaucaag

SEQ ID NO: 374131 - RNA, 19 nt, Homo sapiens
guaagggucauggaauaau

SEQ ID NO: 374132 - RNA, 19 nt, Homo sapiens
ggaggaggugaacgagaaa

SEQ ID NO: 374133 - RNA, 19 nt, Homo sapiens
gagaucgacaagcgcauga

SEQ ID NO: 374134 - RNA, 19 nt, Homo sapiens
ugugacugcuggagauaga

SEQ ID NO: 374135 - RNA, 19 nt, Homo sapiens
gaccaagaccagccacauc

SEQ ID NO: 374136 - RNA, 19 nt, Homo sapiens
ucguguggcucacccagaa

SEQ ID NO: 374137 - RNA, 19 nt, Homo sapiens
aaaggauccugcugaacuc

SEQ ID NO: 374138 - RNA, 19 nt, Homo sapiens
agagaaaugcagcaaggaa

SEQ ID NO: 374139 - RNA, 19 nt, Homo sapiens
gcacaacgacgcgcucacu

SEQ ID NO: 374140 - RNA, 19 nt, Homo sapiens
acgaggaacgcacuuggua

SEQ ID NO: 374141 - RNA, 19 nt, Homo sapiens
gcaacgagaaagagaugca

SEQ ID NO: 374142 - RNA, 19 nt, Homo sapiens
caaaaccccgcaucuacua

SEQ ID NO: 374143 - RNA, 19 nt, Homo sapiens
gagaaccucggccgugaca

SEQ ID NO: 374144 - RNA, 19 nt, Homo sapiens
cccaccagcugacgaaugg

SEQ ID NO: 374145 - RNA, 19 nt, Homo sapiens
ccccgcaucuacuaaaaua

SEQ ID NO: 374146 - RNA, 19 nt, Homo sapiens
cgacuugcccgagcaguuc

SEQ ID NO: 374147 - RNA, 19 nt, Homo sapiens
gagggcaacgagaaagaga

SEQ ID NO: 374148 - RNA, 19 nt, Homo sapiens
ccgcgaguaugaccagcuu

SEQ ID NO: 374149 - RNA, 19 nt, Homo sapiens
aggaccagauugucaagga

SEQ ID NO: 374150 - RNA, 19 nt, Homo sapiens
caggaaaggcgggaacaau

SEQ ID NO: 374151 - RNA, 19 nt, Homo sapiens
gcaccugccauguuuacag

SEQ ID NO: 374152 - RNA, 19 nt, Homo sapiens
ggaccaagaccagccacau

SEQ ID NO: 374153 - RNA, 19 nt, Homo sapiens
caagauccgagaccaguac

SEQ ID NO: 374154 - RNA, 19 nt, Homo sapiens
ugaccagcuuuaugaagag

SEQ ID NO: 374155 - RNA, 19 nt, Homo sapiens
cagccaaccuaaccaucca

SEQ ID NO: 374156 - RNA, 19 nt, Homo sapiens
gccagacucaagagaaaug

SEQ ID NO: 374157 - RNA, 19 nt, Homo sapiens
uguaagggucauggaauaa

SEQ ID NO: 374158 - RNA, 19 nt, Homo sapiens
ccucaagccggaccucaug

SEQ ID NO: 374159 - RNA, 19 nt, Homo sapiens
gucauggaauaauuugaag

SEQ ID NO: 374160 - RNA, 19 nt, Homo sapiens
cgaaugguggacccaguga

SEQ ID NO: 374161 - RNA, 19 nt, Homo sapiens
agaugaagcguacugcaau

SEQ ID NO: 374162 - RNA, 19 nt, Homo sapiens
guaugaccagcuuuaugaa

SEQ ID NO: 374163 - RNA, 19 nt, Homo sapiens
cagcccugcuucaaccaau

SEQ ID NO: 374164 - RNA, 19 nt, Homo sapiens
caagauccagggcgaguac

SEQ ID NO: 374165 - RNA, 19 nt, Homo sapiens
ccaagcacugcgucaucua

SEQ ID NO: 374166 - RNA, 19 nt, Homo sapiens
gaggaccaguacgcacuca

SEQ ID NO: 374167 - RNA, 19 nt, Homo sapiens
gccugugacugcuggagau

SEQ ID NO: 374168 - RNA, 19 nt, Homo sapiens
gcagaaauuuggccuguuu

SEQ ID NO: 374169 - RNA, 19 nt, Homo sapiens
gacauaagcaucaugauua

SEQ ID NO: 374170 - RNA, 19 nt, Homo sapiens
gcucccagcugcacaaaua

SEQ ID NO: 374171 - RNA, 19 nt, Homo sapiens
gagcaucucucccuaccua

SEQ ID NO: 374172 - RNA, 19 nt, Homo sapiens
cuaccugucuuauuucaua

SEQ ID NO: 374173 - RNA, 19 nt, Homo sapiens
ggaagcaagucaacccaaa

SEQ ID NO: 374174 - RNA, 19 nt, Homo sapiens
gguuugagaucgccaagua

SEQ ID NO: 374175 - RNA, 19 nt, Homo sapiens
gagcuaacauuccuucugu

SEQ ID NO: 374176 - RNA, 19 nt, Homo sapiens
gugaagcgauguggaguua

SEQ ID NO: 374177 - RNA, 19 nt, Homo sapiens
ccacaggccucuccuacuu

SEQ ID NO: 374178 - RNA, 19 nt, Homo sapiens
gcgcgaggcugcaaauuuc

SEQ ID NO: 374179 - RNA, 19 nt, Homo sapiens
gcacaaauacuacaugaag

SEQ ID NO: 374180 - RNA, 19 nt, Homo sapiens
gaacaugaagacuaacauu

SEQ ID NO: 374181 - RNA, 19 nt, Homo sapiens
gaagacauaagcaucauga

SEQ ID NO: 374182 - RNA, 19 nt, Homo sapiens
gcaaugugcuucgcgagaa

SEQ ID NO: 374183 - RNA, 19 nt, Homo sapiens
agacacaacggcaacauua

SEQ ID NO: 374184 - RNA, 19 nt, Homo sapiens
gaagcgauguggaguuagu

SEQ ID NO: 374185 - RNA, 19 nt, Homo sapiens
ucacagaggagcuaacauu

SEQ ID NO: 374186 - RNA, 19 nt, Homo sapiens
auagguacaugaaguauug

SEQ ID NO: 374187 - RNA, 19 nt, Homo sapiens
ggaccgccauguucucaga

SEQ ID NO: 374188 - RNA, 19 nt, Homo sapiens
gaagagggccaccagaaag

SEQ ID NO: 374189 - RNA, 19 nt, Homo sapiens
aaucaggcaugucuaagaa

SEQ ID NO: 374190 - RNA, 19 nt, Homo sapiens
ucuggaacaugaagacuaa

SEQ ID NO: 374191 - RNA, 19 nt, Homo sapiens
ggagcaaccuggacauaac

SEQ ID NO: 374192 - RNA, 19 nt, Homo sapiens
gcgggaguuugauuucuuu

SEQ ID NO: 374193 - RNA, 19 nt, Homo sapiens
ggaguuugauuucuuuaac

SEQ ID NO: 374194 - RNA, 19 nt, Homo sapiens
gaucgagcgucucaucaca

SEQ ID NO: 374195 - RNA, 19 nt, Homo sapiens
gaucuacuccacugccuuu

SEQ ID NO: 374196 - RNA, 19 nt, Homo sapiens
ccuacgacaugauccagua

SEQ ID NO: 374197 - RNA, 19 nt, Homo sapiens
gaucaucgaccucuucaag

SEQ ID NO: 374198 - RNA, 19 nt, Homo sapiens
agacagacuucggcaugua

SEQ ID NO: 374199 - RNA, 19 nt, Homo sapiens
caagaaaucaggcaugucu

SEQ ID NO: 374200 - RNA, 19 nt, Homo sapiens
agacauaagcaucaugauu

SEQ ID NO: 374201 - RNA, 19 nt, Homo sapiens
uucccuaccugucuuauuu

SEQ ID NO: 374202 - RNA, 19 nt, Homo sapiens
cggaugagauggugaugau

SEQ ID NO: 374203 - RNA, 19 nt, Homo sapiens
acauuaugcuggacaagaa

SEQ ID NO: 374204 - RNA, 19 nt, Homo sapiens
gcaacauuaugcuggacaa

SEQ ID NO: 374205 - RNA, 19 nt, Homo sapiens
caucaagcccuacccuaaa

SEQ ID NO: 374206 - RNA, 19 nt, Homo sapiens
ccagaaagacccugacauc

SEQ ID NO: 374207 - RNA, 19 nt, Homo sapiens
uaagaacacagaagccauu

SEQ ID NO: 374208 - RNA, 19 nt, Homo sapiens
gcggcugcgugaagacaua

SEQ ID NO: 374209 - RNA, 19 nt, Homo sapiens
ccacugccuuugacuacuu

SEQ ID NO: 374210 - RNA, 19 nt, Homo sapiens
ccuggucacucucauguug

SEQ ID NO: 374211 - RNA, 19 nt, Homo sapiens
gacuuuggguucauguuug

SEQ ID NO: 374212 - RNA, 19 nt, Homo sapiens
ggccuggaccucuuuguuu

SEQ ID NO: 374213 - RNA, 19 nt, Homo sapiens
cagcaacccugaggccauu

SEQ ID NO: 374214 - RNA, 19 nt, Homo sapiens
agaaaucaggcaugucuaa

SEQ ID NO: 374215 - RNA, 19 nt, Homo sapiens
aaggcuggaucaacacaua

SEQ ID NO: 374216 - RNA, 19 nt, Homo sapiens
uaacauuccuucuguaccu

SEQ ID NO: 374217 - RNA, 19 nt, Homo sapiens
ggauggugcugucuaugca

SEQ ID NO: 374218 - RNA, 19 nt, Homo sapiens
ucaccaacgugucggcuau

SEQ ID NO: 374219 - RNA, 19 nt, Homo sapiens
ugaagagggccaccagaaa

SEQ ID NO: 374220 - RNA, 19 nt, Homo sapiens
gcuaugugcgggaguauau

SEQ ID NO: 374221 - RNA, 19 nt, Homo sapiens
ggacugcagcgacaaucaa

SEQ ID NO: 374222 - RNA, 19 nt, Homo sapiens
ucaagugguucauggagau

SEQ ID NO: 374223 - RNA, 19 nt, Homo sapiens
cgacuuuggguucauguuu

SEQ ID NO: 374224 - RNA, 19 nt, Homo sapiens
cgaagugacccgucucguu

SEQ ID NO: 374225 - RNA, 19 nt, Homo sapiens
gcagaucaucgaccucuuc

SEQ ID NO: 374226 - RNA, 19 nt, Homo sapiens
ucaucaagcccuacccuaa

SEQ ID NO: 374227 - RNA, 19 nt, Homo sapiens
gagaagcggcugcgugaag

SEQ ID NO: 374228 - RNA, 19 nt, Homo sapiens
cugcagcucugaccaagug

SEQ ID NO: 374229 - RNA, 19 nt, Homo sapiens
cugcacaaauacuacauga

SEQ ID NO: 374230 - RNA, 19 nt, Homo sapiens
gcaggcagccaucuucaag

SEQ ID NO: 374231 - RNA, 19 nt, Homo sapiens
caacgugucggcuaucauc

SEQ ID NO: 374232 - RNA, 19 nt, Homo sapiens
ccaacuggagaucuaagua

SEQ ID NO: 374233 - RNA, 19 nt, Homo sapiens
gccauguucucagauaaga

SEQ ID NO: 374234 - RNA, 19 nt, Homo sapiens
uaucauccacaucgacuuu

SEQ ID NO: 374235 - RNA, 19 nt, Homo sapiens
agagaaaacuugacaguag

SEQ ID NO: 374236 - RNA, 19 nt, Homo sapiens
cauauucccuaccugucuu

SEQ ID NO: 374237 - RNA, 19 nt, Homo sapiens
uuaacaagaucaccaacgu

SEQ ID NO: 374238 - RNA, 19 nt, Homo sapiens
uguuugcacuggacauauu

SEQ ID NO: 374239 - RNA, 19 nt, Homo sapiens
gggaguuugauuucuuuaa

SEQ ID NO: 374240 - RNA, 19 nt, Homo sapiens
ugaugugccugaagcaauc

SEQ ID NO: 374241 - RNA, 19 nt, Homo sapiens
guggccaacuggagaucua

SEQ ID NO: 374242 - RNA, 19 nt, Homo sapiens
gagccggaccuacgacaug

SEQ ID NO: 374243 - RNA, 19 nt, Homo sapiens
gcugggaacccgacaucaa

SEQ ID NO: 374244 - RNA, 19 nt, Homo sapiens
agaaagaaggcuugucugu

SEQ ID NO: 374245 - RNA, 19 nt, Homo sapiens
agaagcggcugcgugaaga

SEQ ID NO: 374246 - RNA, 19 nt, Homo sapiens
ggugugaguccucuguuug

SEQ ID NO: 374247 - RNA, 19 nt, Homo sapiens
acacaacggcaacauuaug

SEQ ID NO: 374248 - RNA, 19 nt, Homo sapiens
ugagugagaagcaguggaa

SEQ ID NO: 374249 - RNA, 19 nt, Homo sapiens
gacaugauccaguacuauc

SEQ ID NO: 374250 - RNA, 19 nt, Homo sapiens
acaugacgguggagcagaa

SEQ ID NO: 374251 - RNA, 19 nt, Homo sapiens
gaucaaggacagacacaac

SEQ ID NO: 374252 - RNA, 19 nt, Homo sapiens
cuaaaggcgacgagagaaa

SEQ ID NO: 374253 - RNA, 19 nt, Homo sapiens
ugaaaguccugcgguccuu

SEQ ID NO: 374254 - RNA, 19 nt, Homo sapiens
cuccagagcucagccaugu

SEQ ID NO: 374255 - RNA, 19 nt, Homo sapiens
guacugcagcucugaccaa

SEQ ID NO: 374256 - RNA, 19 nt, Homo sapiens
acccaaggcuggaucaaca

SEQ ID NO: 374257 - RNA, 19 nt, Homo sapiens
ggagcuaacauuccuucug

SEQ ID NO: 374258 - RNA, 19 nt, Homo sapiens
ccuccuggaucaguuggua

SEQ ID NO: 374259 - RNA, 19 nt, Homo sapiens
cagaagccauugggaacga

SEQ ID NO: 374260 - RNA, 19 nt, Homo sapiens
gaaaucaggcaugucuaag

SEQ ID NO: 374261 - RNA, 19 nt, Homo sapiens
ccccauaucuggccaaguu

SEQ ID NO: 374262 - RNA, 19 nt, Homo sapiens
ccauugugcuggacaucga

SEQ ID NO: 374263 - RNA, 19 nt, Homo sapiens
ugacgguggagcagaaauu

SEQ ID NO: 374264 - RNA, 19 nt, Homo sapiens
gacgguggagcagaaauuu

SEQ ID NO: 374265 - RNA, 19 nt, Homo sapiens
ccgccauguucucagauaa

SEQ ID NO: 374266 - RNA, 19 nt, Homo sapiens
gacacaacggcaacauuau

SEQ ID NO: 374267 - RNA, 19 nt, Homo sapiens
gugcgggaguauauucugu

SEQ ID NO: 374268 - RNA, 19 nt, Homo sapiens
ggauaaagcuauucagaaa

SEQ ID NO: 374269 - RNA, 19 nt, Homo sapiens
gcagaaauuuggccuguuu

SEQ ID NO: 374270 - RNA, 19 nt, Homo sapiens
ugaaggagauccaugauuu

SEQ ID NO: 374271 - RNA, 19 nt, Homo sapiens
gacauaagcaucaugauua

SEQ ID NO: 374272 - RNA, 19 nt, Homo sapiens
gcucccagcugcacaaaua

SEQ ID NO: 374273 - RNA, 19 nt, Homo sapiens
gagcaucucucccuaccua

SEQ ID NO: 374274 - RNA, 19 nt, Homo sapiens
ggaucuacauucagcuuua

SEQ ID NO: 374275 - RNA, 19 nt, Homo sapiens
aagaauaccuuugcaagua

SEQ ID NO: 374276 - RNA, 19 nt, Homo sapiens
cuaccugucuuauuucaua

SEQ ID NO: 374277 - RNA, 19 nt, Homo sapiens
ggaagcaagucaacccaaa

SEQ ID NO: 374278 - RNA, 19 nt, Homo sapiens
gcaggaauaucugaacaaa

SEQ ID NO: 374279 - RNA, 19 nt, Homo sapiens
gguuugagaucgccaagua

SEQ ID NO: 374280 - RNA, 19 nt, Homo sapiens
gugaagcgauguggaguua

SEQ ID NO: 374281 - RNA, 19 nt, Homo sapiens
gaacuugggaguacucauu

SEQ ID NO: 374282 - RNA, 19 nt, Homo sapiens
ccacaggccucuccuacuu

SEQ ID NO: 374283 - RNA, 19 nt, Homo sapiens
gcaucaagcuaucugagaa

SEQ ID NO: 374284 - RNA, 19 nt, Homo sapiens
gcgcgaggcugcaaauuuc

SEQ ID NO: 374285 - RNA, 19 nt, Homo sapiens
gcacaaauacuacaugaag

SEQ ID NO: 374286 - RNA, 19 nt, Homo sapiens
gaacaugaagacuaacauu

SEQ ID NO: 374287 - RNA, 19 nt, Homo sapiens
gaagacauaagcaucauga

SEQ ID NO: 374288 - RNA, 19 nt, Homo sapiens
guaauguucugcuacuuug

SEQ ID NO: 374289 - RNA, 19 nt, Homo sapiens
ucaacggugucacauauaa

SEQ ID NO: 374290 - RNA, 19 nt, Homo sapiens
gcgcugauauucacaagga

SEQ ID NO: 374291 - RNA, 19 nt, Homo sapiens
ggaaaucaauacaucuauc

SEQ ID NO: 374292 - RNA, 19 nt, Homo sapiens
gcaaugugcuucgcgagaa

SEQ ID NO: 374293 - RNA, 19 nt, Homo sapiens
gaaagacuacuccaacuuc

SEQ ID NO: 374294 - RNA, 19 nt, Homo sapiens
ggaguacucauuccuguaa

SEQ ID NO: 374295 - RNA, 19 nt, Homo sapiens
uggugaagcucuacaagua

SEQ ID NO: 374296 - RNA, 19 nt, Homo sapiens
agacacaacggcaacauua

SEQ ID NO: 374297 - RNA, 19 nt, Homo sapiens
gaugaaagacggagagaug

SEQ ID NO: 374298 - RNA, 19 nt, Homo sapiens
aggaauaucugaacaaaca

SEQ ID NO: 374299 - RNA, 19 nt, Homo sapiens
agacaaaucugggaugaug

SEQ ID NO: 374300 - RNA, 19 nt, Homo sapiens
gaagcgauguggaguuagu

SEQ ID NO: 374301 - RNA, 19 nt, Homo sapiens
ggacugugcugaagaccau

SEQ ID NO: 374302 - RNA, 19 nt, Homo sapiens
gguccguccuccaguauaa

SEQ ID NO: 374303 - RNA, 19 nt, Homo sapiens
ccaccuaccuccucucugu

SEQ ID NO: 374304 - RNA, 19 nt, Homo sapiens
aagauugugugguuccuua

SEQ ID NO: 374305 - RNA, 19 nt, Homo sapiens
cgagguguauggaaugauu

SEQ ID NO: 374306 - RNA, 19 nt, Homo sapiens
auagguacaugaaguauug

SEQ ID NO: 374307 - RNA, 19 nt, Homo sapiens
gacuuuggcuucauguuug

SEQ ID NO: 374308 - RNA, 19 nt, Homo sapiens
ggaccgccauguucucaga

SEQ ID NO: 374309 - RNA, 19 nt, Homo sapiens
gcagucauccucagcacua

SEQ ID NO: 374310 - RNA, 19 nt, Homo sapiens
gaccacggcuauaggcauu

SEQ ID NO: 374311 - RNA, 19 nt, Homo sapiens
ucaugaaccuguuggaguu

SEQ ID NO: 374312 - RNA, 19 nt, Homo sapiens
ggaagagcuugaagguguu

SEQ ID NO: 374313 - RNA, 19 nt, Homo sapiens
uaacucugcugucugaugu

SEQ ID NO: 374314 - RNA, 19 nt, Homo sapiens
gaagagggccaccagaaag

SEQ ID NO: 374315 - RNA, 19 nt, Homo sapiens
aaucaggcaugucuaagaa

SEQ ID NO: 374316 - RNA, 19 nt, Homo sapiens
caguauaacucagccauga

SEQ ID NO: 374317 - RNA, 19 nt, Homo sapiens
gcagggaacuugggaguac

SEQ ID NO: 374318 - RNA, 19 nt, Homo sapiens
gaucugccuuucacuacuu

SEQ ID NO: 374319 - RNA, 19 nt, Homo sapiens
ucuggaacaugaagacuaa

SEQ ID NO: 374320 - RNA, 19 nt, Homo sapiens
ggagcaaccuggacauaac

SEQ ID NO: 374321 - RNA, 19 nt, Homo sapiens
gagagcauccuucacuuug

SEQ ID NO: 374322 - RNA, 19 nt, Homo sapiens
ugaacaugauggcggauaa

SEQ ID NO: 374323 - RNA, 19 nt, Homo sapiens
guacugcguucaacagauc

SEQ ID NO: 374324 - RNA, 19 nt, Homo sapiens
gcgggaguuugauuucuuu

SEQ ID NO: 374325 - RNA, 19 nt, Homo sapiens
gguaauguucugcuacuuu

SEQ ID NO: 374326 - RNA, 19 nt, Homo sapiens
ucgaugugcugauuauuga

SEQ ID NO: 374327 - RNA, 19 nt, Homo sapiens
ggaguuugauuucuuuaac

SEQ ID NO: 374328 - RNA, 19 nt, Homo sapiens
aaagacaaaucugggauga

SEQ ID NO: 374329 - RNA, 19 nt, Homo sapiens
gaggauaaagcuauucaga

SEQ ID NO: 374330 - RNA, 19 nt, Homo sapiens
acggagagaugcagugauu

SEQ ID NO: 374331 - RNA, 19 nt, Homo sapiens
cgacuuuggcuucauguuu

SEQ ID NO: 374332 - RNA, 19 nt, Homo sapiens
gaucgagcgucucaucaca

SEQ ID NO: 374333 - RNA, 19 nt, Homo sapiens
gaucuacuccacugccuuu

SEQ ID NO: 374334 - RNA, 19 nt, Homo sapiens
gguccaggaucuacauuca

SEQ ID NO: 374335 - RNA, 19 nt, Homo sapiens
acucagccaugaagaauga

SEQ ID NO: 374336 - RNA, 19 nt, Homo sapiens
ccuacgacaugauccagua

SEQ ID NO: 374337 - RNA, 19 nt, Homo sapiens
gaucaucgaccucuucaag

SEQ ID NO: 374338 - RNA, 19 nt, Homo sapiens
caugggaucuuccaguuag

SEQ ID NO: 374339 - RNA, 19 nt, Homo sapiens
uaaggaggguggcagacaa

SEQ ID NO: 374340 - RNA, 19 nt, Homo sapiens
agacagacuucggcaugua

SEQ ID NO: 374341 - RNA, 19 nt, Homo sapiens
caagaaaucaggcaugucu

SEQ ID NO: 374342 - RNA, 19 nt, Homo sapiens
cugagaagcugcaguccaa

SEQ ID NO: 374343 - RNA, 19 nt, Homo sapiens
agacauaagcaucaugauu

SEQ ID NO: 374344 - RNA, 19 nt, Homo sapiens
agacaucgcuauugacaac

SEQ ID NO: 374345 - RNA, 19 nt, Homo sapiens
uucccuaccugucuuauuu

SEQ ID NO: 374346 - RNA, 19 nt, Homo sapiens
cggaugagauggugaugau

SEQ ID NO: 374347 - RNA, 19 nt, Homo sapiens
acauuaugcuggacaagaa

SEQ ID NO: 374348 - RNA, 19 nt, Homo sapiens
gcaacauuaugcuggacaa

SEQ ID NO: 374349 - RNA, 19 nt, Homo sapiens
caucaagcccuacccuaaa

SEQ ID NO: 374350 - RNA, 19 nt, Homo sapiens
ccagaaagacccugacauc

SEQ ID NO: 374351 - RNA, 19 nt, Homo sapiens
uaagaacacagaagccauu

SEQ ID NO: 374352 - RNA, 19 nt, Homo sapiens
gcggcugcgugaagacaua

SEQ ID NO: 374353 - RNA, 19 nt, Homo sapiens
ccacugccuuugacuacuu

SEQ ID NO: 374354 - RNA, 19 nt, Homo sapiens
uggcaaggauggaguggaa

SEQ ID NO: 374355 - RNA, 19 nt, Homo sapiens
gaacaugauggcggauaaa

SEQ ID NO: 374356 - RNA, 19 nt, Homo sapiens
gaaggccagcuccguugua

SEQ ID NO: 374357 - RNA, 19 nt, Homo sapiens
cagaccggauccacaauga

SEQ ID NO: 374358 - RNA, 19 nt, Homo sapiens
uuucaacggugucacauau

SEQ ID NO: 374359 - RNA, 19 nt, Homo sapiens
gaggaucugccuuucacua

SEQ ID NO: 374360 - RNA, 19 nt, Homo sapiens
ccuggucacucucauguug

SEQ ID NO: 374361 - RNA, 19 nt, Homo sapiens
ggccuggaccucuuuguuu

SEQ ID NO: 374362 - RNA, 19 nt, Homo sapiens
cagcaacccugaggccauu

SEQ ID NO: 374363 - RNA, 19 nt, Homo sapiens
gaucagccuuacuaugaca

SEQ ID NO: 374364 - RNA, 19 nt, Homo sapiens
gaggguggcagacaaguau

SEQ ID NO: 374365 - RNA, 19 nt, Homo sapiens
gauccuacagcagaaauuu

SEQ ID NO: 374366 - RNA, 19 nt, Homo sapiens
gcagaaaaccuuugcauca

SEQ ID NO: 374367 - RNA, 19 nt, Homo sapiens
uuacuacacuuccuucagu

SEQ ID NO: 374368 - RNA, 19 nt, Homo sapiens
ggagaugggugaugaggua

SEQ ID NO: 374369 - RNA, 19 nt, Homo sapiens
aaacagaggugacaaaugu

SEQ ID NO: 374370 - RNA, 19 nt, Homo sapiens
aaagagagguuccacauga

SEQ ID NO: 374371 - RNA, 19 nt, Homo sapiens
gaacaggccugcguggaaa

SEQ ID NO: 374372 - RNA, 19 nt, Homo sapiens
ggacgugggugaugccauu

SEQ ID NO: 374373 - RNA, 19 nt, Homo sapiens
ggaaauggaaggcaagaaa

SEQ ID NO: 374374 - RNA, 19 nt, Homo sapiens
gcaccgagaguauugauaa

SEQ ID NO: 374375 - RNA, 19 nt, Homo sapiens
ggaaacacauggacaaggu

SEQ ID NO: 374376 - RNA, 19 nt, Homo sapiens
ccacauagaaguuugcuuu

SEQ ID NO: 374377 - RNA, 19 nt, Homo sapiens
caacagcugugacaacauc

SEQ ID NO: 374378 - RNA, 19 nt, Homo sapiens
gaacagccagcaacccuaa

SEQ ID NO: 374379 - RNA, 19 nt, Homo sapiens
caacucagcuaaacagucu

SEQ ID NO: 374380 - RNA, 19 nt, Homo sapiens
gaucaagccauacaagauu

SEQ ID NO: 374381 - RNA, 19 nt, Homo sapiens
caaggagccuggaguacaa

SEQ ID NO: 374382 - RNA, 19 nt, Homo sapiens
gcagcaagguucucagcuu

SEQ ID NO: 374383 - RNA, 19 nt, Homo sapiens
gcaaggagccuguguucau

SEQ ID NO: 374384 - RNA, 19 nt, Homo sapiens
caaggagccuguguucauu

SEQ ID NO: 374385 - RNA, 19 nt, Homo sapiens
ggaaguccuugaaugugaa

SEQ ID NO: 374386 - RNA, 19 nt, Homo sapiens
gcaaccggcucuucugcuu

SEQ ID NO: 374387 - RNA, 19 nt, Homo sapiens
caagaaacacgaaggauca

SEQ ID NO: 374388 - RNA, 19 nt, Homo sapiens
gagagagaauucaucaagu

SEQ ID NO: 374389 - RNA, 19 nt, Homo sapiens
gccaggagguguuggagaa

SEQ ID NO: 374390 - RNA, 19 nt, Homo sapiens
ccacagcccuccaguguac

SEQ ID NO: 374391 - RNA, 19 nt, Homo sapiens
cacgaaggaucauguggua

SEQ ID NO: 374392 - RNA, 19 nt, Homo sapiens
gaacaacucagcuaaacag

SEQ ID NO: 374393 - RNA, 19 nt, Homo sapiens
ggaaaagagcucucaauuu
